United States Patent 7,691,997 (FUNCTIONAL AND HYPERFUNCTIONAL SIRNA) - sequence listing, part 29

SEQ ID NO: 1172069 - RNA, 19 nt, Homo sapiens
cuguugacuuguaugauau

SEQ ID NO: 1172070 - RNA, 19 nt, Homo sapiens
uugcaaaacuggaccaaug

SEQ ID NO: 1172071 - RNA, 19 nt, Homo sapiens
gguguguggugaccuucug

SEQ ID NO: 1172072 - RNA, 19 nt, Homo sapiens
cugaagcccucgagugacu

SEQ ID NO: 1172073 - RNA, 19 nt, Homo sapiens
gggagaaugccguccuaag

SEQ ID NO: 1172074 - RNA, 19 nt, Homo sapiens
gccauguggauguuuguga

SEQ ID NO: 1172075 - RNA, 19 nt, Homo sapiens
ugggagaaccugugucaag

SEQ ID NO: 1172076 - RNA, 19 nt, Homo sapiens
gcagggcuggugggacaaa

SEQ ID NO: 1172077 - RNA, 19 nt, Homo sapiens
aauguuuccuguucucagu

SEQ ID NO: 1172078 - RNA, 19 nt, Homo sapiens
ccacgaagcuucuguaaug

SEQ ID NO: 1172079 - RNA, 19 nt, Homo sapiens
ggaugaaacuguaacaauu

SEQ ID NO: 1172080 - RNA, 19 nt, Homo sapiens
ggaaagaugugccuaguuc

SEQ ID NO: 1172081 - RNA, 19 nt, Homo sapiens
cgacuuaguucaagaugua

SEQ ID NO: 1172082 - RNA, 19 nt, Homo sapiens
gaaauguuguucacucuga

SEQ ID NO: 1172083 - RNA, 19 nt, Homo sapiens
ucacaaggaugaaacugua

SEQ ID NO: 1172084 - RNA, 19 nt, Homo sapiens
gaagaagcauccaaagcaa

SEQ ID NO: 1172085 - RNA, 19 nt, Homo sapiens
gaccagaacugugugauga

SEQ ID NO: 1172086 - RNA, 19 nt, Homo sapiens
gaaaagaaccucauaaaug

SEQ ID NO: 1172087 - RNA, 19 nt, Homo sapiens
gaauaucccucuccaugug

SEQ ID NO: 1172088 - RNA, 19 nt, Homo sapiens
uaacagcuauucaaacuca

SEQ ID NO: 1172089 - RNA, 19 nt, Homo sapiens
gacaaggaauacuaaguuu

SEQ ID NO: 1172090 - RNA, 19 nt, Homo sapiens
gugcaaggauuugauuaua

SEQ ID NO: 1172091 - RNA, 19 nt, Homo sapiens
ggcauuauauuaucucuug

SEQ ID NO: 1172092 - RNA, 19 nt, Homo sapiens
uaagcuaccugacaaugaa

SEQ ID NO: 1172093 - RNA, 19 nt, Homo sapiens
ugaaguugcuggauuaugu

SEQ ID NO: 1172094 - RNA, 19 nt, Homo sapiens
gaccuaagcuaccugacaa

SEQ ID NO: 1172095 - RNA, 19 nt, Homo sapiens
gcauggaugucuaaacaau

SEQ ID NO: 1172096 - RNA, 19 nt, Homo sapiens
gcaaccgggcauuauauua

SEQ ID NO: 1172097 - RNA, 19 nt, Homo sapiens
gaagaugugugguuuuaaa

SEQ ID NO: 1172098 - RNA, 19 nt, Homo sapiens
gaagcagguucauauuuua

SEQ ID NO: 1172099 - RNA, 19 nt, Homo sapiens
caaagcaguuuaauuaagg

SEQ ID NO: 1172100 - RNA, 19 nt, Homo sapiens
guaagugauuugcauguau

SEQ ID NO: 1172101 - RNA, 19 nt, Homo sapiens
gaccagaagucucggauag

SEQ ID NO: 1172102 - RNA, 19 nt, Homo sapiens
ggacucugcucacuucugu

SEQ ID NO: 1172103 - RNA, 19 nt, Homo sapiens
gagauaaucauaacucuuc

SEQ ID NO: 1172104 - RNA, 19 nt, Homo sapiens
cagaggaacucauacuuca

SEQ ID NO: 1172105 - RNA, 19 nt, Homo sapiens
gaagugcggagcugucuuu

SEQ ID NO: 1172106 - RNA, 19 nt, Homo sapiens
gcaagugucacaaggauga

SEQ ID NO: 1172107 - RNA, 19 nt, Homo sapiens
gcagagcuaugcagguguu

SEQ ID NO: 1172108 - RNA, 19 nt, Homo sapiens
aaacagauucgauuacgua

SEQ ID NO: 1172109 - RNA, 19 nt, Homo sapiens
caagaagugucaaauaggu

SEQ ID NO: 1172110 - RNA, 19 nt, Homo sapiens
gcccaucucuuggaaauau

SEQ ID NO: 1172111 - RNA, 19 nt, Homo sapiens
ugaaaguccugauccagaa

SEQ ID NO: 1172112 - RNA, 19 nt, Homo sapiens
ccagaagucucggauagaa

SEQ ID NO: 1172113 - RNA, 19 nt, Homo sapiens
gaagugcuccuaccucaug

SEQ ID NO: 1172114 - RNA, 19 nt, Homo sapiens
ucugcucacuucuguauua

SEQ ID NO: 1172115 - RNA, 19 nt, Homo sapiens
gauguuauaccaacuauuc

SEQ ID NO: 1172116 - RNA, 19 nt, Homo sapiens
ggacaggaugccaauuuaa

SEQ ID NO: 1172117 - RNA, 19 nt, Homo sapiens
acacauacacaacaacaua

SEQ ID NO: 1172118 - RNA, 19 nt, Homo sapiens
ccucagcaauggagaauau

SEQ ID NO: 1172119 - RNA, 19 nt, Homo sapiens
gaccggaaauaaaucauuc

SEQ ID NO: 1172120 - RNA, 19 nt, Homo sapiens
gaggaacucauacuucaaa

SEQ ID NO: 1172121 - RNA, 19 nt, Homo sapiens
gaugaaacuguaacaauug

SEQ ID NO: 1172122 - RNA, 19 nt, Homo sapiens
cgacaaggaauacuaaguu

SEQ ID NO: 1172123 - RNA, 19 nt, Homo sapiens
gaacacauacacaacaaca

SEQ ID NO: 1172124 - RNA, 19 nt, Homo sapiens
guuaacagcuauucaaacu

SEQ ID NO: 1172125 - RNA, 19 nt, Homo sapiens
gcaaaggauuauaccaaag

SEQ ID NO: 1172126 - RNA, 19 nt, Homo sapiens
gcacaguucaagaaguaua

SEQ ID NO: 1172127 - RNA, 19 nt, Homo sapiens
ucucauaaauucagugugu

SEQ ID NO: 1172128 - RNA, 19 nt, Homo sapiens
aguaucaccuacagaauaa

SEQ ID NO: 1172129 - RNA, 19 nt, Homo sapiens
caaccaguucuguguaaua

SEQ ID NO: 1172130 - RNA, 19 nt, Homo sapiens
uggauuaugugauguguga

SEQ ID NO: 1172131 - RNA, 19 nt, Homo sapiens
aaacaggcguucuugacuu

SEQ ID NO: 1172132 - RNA, 19 nt, Homo sapiens
caaccgggcauuauauuau

SEQ ID NO: 1172133 - RNA, 19 nt, Homo sapiens
aaacagucuuuccauuuga

SEQ ID NO: 1172134 - RNA, 19 nt, Homo sapiens
ucacgugacucuucaugga

SEQ ID NO: 1172135 - RNA, 19 nt, Homo sapiens
gcaaugagacgggaagaug

SEQ ID NO: 1172136 - RNA, 19 nt, Homo sapiens
cgaagcuucuguaauguau

SEQ ID NO: 1172137 - RNA, 19 nt, Homo sapiens
gcgguuaaauuuguuucua

SEQ ID NO: 1172138 - RNA, 19 nt, Homo sapiens
aaacauuucuguacaucug

SEQ ID NO: 1172139 - RNA, 19 nt, Homo sapiens
gggaagaugugugguuuua

SEQ ID NO: 1172140 - RNA, 19 nt, Homo sapiens
gaugggagaggaauauuau

SEQ ID NO: 1172141 - RNA, 19 nt, Homo sapiens
ggagagaaauguuguucac

SEQ ID NO: 1172142 - RNA, 19 nt, Homo sapiens
guagcaaccgggcauuaua

SEQ ID NO: 1172143 - RNA, 19 nt, Homo sapiens
ccaggccuuuggagauuua

SEQ ID NO: 1172144 - RNA, 19 nt, Homo sapiens
gcaagcacaaugaucauau

SEQ ID NO: 1172145 - RNA, 19 nt, Homo sapiens
ugugauaucuuagcuguga

SEQ ID NO: 1172146 - RNA, 19 nt, Homo sapiens
gaaugaaaguccugaucca

SEQ ID NO: 1172147 - RNA, 19 nt, Homo sapiens
cgcaaaggauuauaccaaa

SEQ ID NO: 1172148 - RNA, 19 nt, Homo sapiens
uaaauucaguguguacuca

SEQ ID NO: 1172149 - RNA, 19 nt, Homo sapiens
gcccuuggcuguuguuaca

SEQ ID NO: 1172150 - RNA, 19 nt, Homo sapiens
gucguuaccugucaaguau

SEQ ID NO: 1172151 - RNA, 19 nt, Homo sapiens
cauuugauguugcgguuaa

SEQ ID NO: 1172152 - RNA, 19 nt, Homo sapiens
ugugucagcuuuaauaauc

SEQ ID NO: 1172153 - RNA, 19 nt, Homo sapiens
uugcacaguucaagaagua

SEQ ID NO: 1172154 - RNA, 19 nt, Homo sapiens
guuguucacucugagauaa

SEQ ID NO: 1172155 - RNA, 19 nt, Homo sapiens
gagaaauguuguucacucu

SEQ ID NO: 1172156 - RNA, 19 nt, Homo sapiens
cagaacacauacacaacaa

SEQ ID NO: 1172157 - RNA, 19 nt, Homo sapiens
ggagagagugcuagugaau

SEQ ID NO: 1172158 - RNA, 19 nt, Homo sapiens
aguggacaauguuaucuua

SEQ ID NO: 1172159 - RNA, 19 nt, Homo sapiens
guugaugacggaccucuua

SEQ ID NO: 1172160 - RNA, 19 nt, Homo sapiens
aggacaggaugccaauuua

SEQ ID NO: 1172161 - RNA, 19 nt, Homo sapiens
gaacccgacugugauaucu

SEQ ID NO: 1172162 - RNA, 19 nt, Homo sapiens
gguggacucugcucacuuc

SEQ ID NO: 1172163 - RNA, 19 nt, Homo sapiens
ucauaacucuucugagcaa

SEQ ID NO: 1172164 - RNA, 19 nt, Homo sapiens
gagucaggccuucugguua

SEQ ID NO: 1172165 - RNA, 19 nt, Homo sapiens
gaaaagauccaaagugcaa

SEQ ID NO: 1172166 - RNA, 19 nt, Homo sapiens
ucaaguaucaccuacagaa

SEQ ID NO: 1172167 - RNA, 19 nt, Homo sapiens
caucacaacugucaucacu

SEQ ID NO: 1172168 - RNA, 19 nt, Homo sapiens
gaaaaggaccucagcaaug

SEQ ID NO: 1172169 - RNA, 19 nt, Homo sapiens
ugauguuccuguucaguuu

SEQ ID NO: 1172170 - RNA, 19 nt, Homo sapiens
cuuugaaguugcuggauua

SEQ ID NO: 1172171 - RNA, 19 nt, Homo sapiens
uaauuucuauccucugaug

SEQ ID NO: 1172172 - RNA, 19 nt, Homo sapiens
ucacaacugucaucacucu

SEQ ID NO: 1172173 - RNA, 19 nt, Homo sapiens
ucacugggacagcauuaua

SEQ ID NO: 1172174 - RNA, 19 nt, Homo sapiens
gcagugcaaagccaaguuu

SEQ ID NO: 1172175 - RNA, 19 nt, Homo sapiens
gcuuugaaguugcuggauu

SEQ ID NO: 1172176 - RNA, 19 nt, Homo sapiens
ggccagaccggaaauaaau

SEQ ID NO: 1172177 - RNA, 19 nt, Homo sapiens
gggacagcauuauaauuca

SEQ ID NO: 1172178 - RNA, 19 nt, Homo sapiens
gagcauggcuaguggauuu

SEQ ID NO: 1172179 - RNA, 19 nt, Homo sapiens
gaaugaggcuucaccagua

SEQ ID NO: 1172180 - RNA, 19 nt, Homo sapiens
gcucaugucucauuaauca

SEQ ID NO: 1172181 - RNA, 19 nt, Homo sapiens
caacaacaauaccucgaua

SEQ ID NO: 1172182 - RNA, 19 nt, Homo sapiens
gauccgacguacugaaaua

SEQ ID NO: 1172183 - RNA, 19 nt, Homo sapiens
gcagccagauuucuauauu

SEQ ID NO: 1172184 - RNA, 19 nt, Homo sapiens
ggaaaccagucgaucuaaa

SEQ ID NO: 1172185 - RNA, 19 nt, Homo sapiens
ggaggaagccaucaugaaa

SEQ ID NO: 1172186 - RNA, 19 nt, Homo sapiens
gaucaggauucccuugaaa

SEQ ID NO: 1172187 - RNA, 19 nt, Homo sapiens
aguagaagcugguguuaaa

SEQ ID NO: 1172188 - RNA, 19 nt, Homo sapiens
cacauaggcuacuggaaua

SEQ ID NO: 1172189 - RNA, 19 nt, Homo sapiens
guucaacucugucugcaaa

SEQ ID NO: 1172190 - RNA, 19 nt, Homo sapiens
ggacagauucuuacggaaa

SEQ ID NO: 1172191 - RNA, 19 nt, Homo sapiens
ccauauagcaaguuuagua

SEQ ID NO: 1172192 - RNA, 19 nt, Homo sapiens
cgacagaacugaauguaac

SEQ ID NO: 1172193 - RNA, 19 nt, Homo sapiens
gagcucaguuuuaguuuua

SEQ ID NO: 1172194 - RNA, 19 nt, Homo sapiens
acaguaaccucacuuugaa

SEQ ID NO: 1172195 - RNA, 19 nt, Homo sapiens
gcgguuauguguucuguau

SEQ ID NO: 1172196 - RNA, 19 nt, Homo sapiens
gaagagaccaccagugaca

SEQ ID NO: 1172197 - RNA, 19 nt, Homo sapiens
gaccagauguggcgaaugg

SEQ ID NO: 1172198 - RNA, 19 nt, Homo sapiens
gaaacaguaaccucacuuu

SEQ ID NO: 1172199 - RNA, 19 nt, Homo sapiens
caacucugucugcaaauua

SEQ ID NO: 1172200 - RNA, 19 nt, Homo sapiens
ccuuucaccucuucacuua

SEQ ID NO: 1172201 - RNA, 19 nt, Homo sapiens
gauccaaggucacgagaag

SEQ ID NO: 1172202 - RNA, 19 nt, Homo sapiens
gaggaaaccagucgaucua

SEQ ID NO: 1172203 - RNA, 19 nt, Homo sapiens
acaaaugguucaacucugu

SEQ ID NO: 1172204 - RNA, 19 nt, Homo sapiens
caacaagaaucaguagaag

SEQ ID NO: 1172205 - RNA, 19 nt, Homo sapiens
gcacagacacagcucaugu

SEQ ID NO: 1172206 - RNA, 19 nt, Homo sapiens
ugcaguaucuguucuguga

SEQ ID NO: 1172207 - RNA, 19 nt, Homo sapiens
ggaucaggauucccuugaa

SEQ ID NO: 1172208 - RNA, 19 nt, Homo sapiens
gacagauucuuacggaaau

SEQ ID NO: 1172209 - RNA, 19 nt, Homo sapiens
gguuauguguucuguaugu

SEQ ID NO: 1172210 - RNA, 19 nt, Homo sapiens
cauguucgcuuccugacuu

SEQ ID NO: 1172211 - RNA, 19 nt, Homo sapiens
guacugaaauaggaaguca

SEQ ID NO: 1172212 - RNA, 19 nt, Homo sapiens
ccaacaagaaucaguagaa

SEQ ID NO: 1172213 - RNA, 19 nt, Homo sapiens
gaugauuccgcuccaagua

SEQ ID NO: 1172214 - RNA, 19 nt, Homo sapiens
agaaacagccagacgauga

SEQ ID NO: 1172215 - RNA, 19 nt, Homo sapiens
caacaaaugguucaacucu

SEQ ID NO: 1172216 - RNA, 19 nt, Homo sapiens
ccacgacgcacauggcuuu

SEQ ID NO: 1172217 - RNA, 19 nt, Homo sapiens
ggacaaagucagccagaca

SEQ ID NO: 1172218 - RNA, 19 nt, Homo sapiens
gauauuugcucugguaggu

SEQ ID NO: 1172219 - RNA, 19 nt, Homo sapiens
acaagaagagaaacaguaa

SEQ ID NO: 1172220 - RNA, 19 nt, Homo sapiens
gauggugguugaaauugau

SEQ ID NO: 1172221 - RNA, 19 nt, Homo sapiens
uaacuucaccgaguaaaga

SEQ ID NO: 1172222 - RNA, 19 nt, Homo sapiens
ccgaagagaccaccaguga

SEQ ID NO: 1172223 - RNA, 19 nt, Homo sapiens
guccacaucuaccauauag

SEQ ID NO: 1172224 - RNA, 19 nt, Homo sapiens
aaaauuagcuccacucaag

SEQ ID NO: 1172225 - RNA, 19 nt, Homo sapiens
aaacaacacauaccuguca

SEQ ID NO: 1172226 - RNA, 19 nt, Homo sapiens
ccacgugacgcuguucuua

SEQ ID NO: 1172227 - RNA, 19 nt, Homo sapiens
cagcucaugucucauuaau

SEQ ID NO: 1172228 - RNA, 19 nt, Homo sapiens
uaucuguucugugaaguuu

SEQ ID NO: 1172229 - RNA, 19 nt, Homo sapiens
cagccagauuucuauauug

SEQ ID NO: 1172230 - RNA, 19 nt, Homo sapiens
ggaguagaagcugguguua

SEQ ID NO: 1172231 - RNA, 19 nt, Homo sapiens
uuaccugacuugcuaugaa

SEQ ID NO: 1172232 - RNA, 19 nt, Homo sapiens
acacauaggcuacuggaau

SEQ ID NO: 1172233 - RNA, 19 nt, Homo sapiens
gcuggagucaaacuuauaa

SEQ ID NO: 1172234 - RNA, 19 nt, Homo sapiens
ugucacugcuggagucaaa

SEQ ID NO: 1172235 - RNA, 19 nt, Homo sapiens
ccugcuagccauuguauaa

SEQ ID NO: 1172236 - RNA, 19 nt, Homo sapiens
guacugggcacgcgucaga

SEQ ID NO: 1172237 - RNA, 19 nt, Homo sapiens
gaaucucuguuccaaaugc

SEQ ID NO: 1172238 - RNA, 19 nt, Homo sapiens
ucaacucugucugcaaauu

SEQ ID NO: 1172239 - RNA, 19 nt, Homo sapiens
agugauauuugcucuggua

SEQ ID NO: 1172240 - RNA, 19 nt, Homo sapiens
caaguaacagccaaucaga

SEQ ID NO: 1172241 - RNA, 19 nt, Homo sapiens
gagaaacaguaaccucacu

SEQ ID NO: 1172242 - RNA, 19 nt, Homo sapiens
cacaagaagagaaacagua

SEQ ID NO: 1172243 - RNA, 19 nt, Homo sapiens
uaccugacuugcuaugaaa

SEQ ID NO: 1172244 - RNA, 19 nt, Homo sapiens
gaucgugucgcugcgguua

SEQ ID NO: 1172245 - RNA, 19 nt, Homo sapiens
ccacgacuacuugagaaua

SEQ ID NO: 1172246 - RNA, 19 nt, Homo sapiens
acacagcucaugucucauu

SEQ ID NO: 1172247 - RNA, 19 nt, Homo sapiens
aauguaacuucaccgagua

SEQ ID NO: 1172248 - RNA, 19 nt, Homo sapiens
aacaauaccucgauaacca

SEQ ID NO: 1172249 - RNA, 19 nt, Homo sapiens
acaagaaucaguagaagug

SEQ ID NO: 1172250 - RNA, 19 nt, Homo sapiens
ccucuucacuuauccuuag

SEQ ID NO: 1172251 - RNA, 19 nt, Homo sapiens
agaagcugguguuaaaguu

SEQ ID NO: 1172252 - RNA, 19 nt, Homo sapiens
gaaaccagucgaucuaaac

SEQ ID NO: 1172253 - RNA, 19 nt, Homo sapiens
gaaacagccagacgaugau

SEQ ID NO: 1172254 - RNA, 19 nt, Homo sapiens
gcuccgagagugauauuug

SEQ ID NO: 1172255 - RNA, 19 nt, Homo sapiens
gcuaguggauuuaaaacaa

SEQ ID NO: 1172256 - RNA, 19 nt, Homo sapiens
ugauggugguugaaauuga

SEQ ID NO: 1172257 - RNA, 19 nt, Homo sapiens
gggaggaagccaucaugaa

SEQ ID NO: 1172258 - RNA, 19 nt, Homo sapiens
aaugaggcuucaccaguaa

SEQ ID NO: 1172259 - RNA, 19 nt, Homo sapiens
cacagcucaugucucauua

SEQ ID NO: 1172260 - RNA, 19 nt, Homo sapiens
gaguggaacccgcugcaaa

SEQ ID NO: 1172261 - RNA, 19 nt, Homo sapiens
ccacaucuaccauauagca

SEQ ID NO: 1172262 - RNA, 19 nt, Homo sapiens
ggccacgacuacuugagaa

SEQ ID NO: 1172263 - RNA, 19 nt, Homo sapiens
caaauuaacagcugaacac

SEQ ID NO: 1172264 - RNA, 19 nt, Homo sapiens
caucacacaagaagagaaa

SEQ ID NO: 1172265 - RNA, 19 nt, Homo sapiens
augaaucucuguuccaaau

SEQ ID NO: 1172266 - RNA, 19 nt, Homo sapiens
uauagcaaguuuaguaagg

SEQ ID NO: 1172267 - RNA, 19 nt, Homo sapiens
aacaguaaccucacuuuga

SEQ ID NO: 1172268 - RNA, 19 nt, Homo sapiens
gaguagaagcugguguuaa

SEQ ID NO: 1172269 - RNA, 19 nt, Homo sapiens
uagcuccacucaagacuag

SEQ ID NO: 1172270 - RNA, 19 nt, Homo sapiens
acgggaggcugcugagauu

SEQ ID NO: 1172271 - RNA, 19 nt, Homo sapiens
gaagcugguguuaaaguuc

SEQ ID NO: 1172272 - RNA, 19 nt, Homo sapiens
auugauuucuggcugguua

SEQ ID NO: 1172273 - RNA, 19 nt, Homo sapiens
ucgcugcgguuauguguuc

SEQ ID NO: 1172274 - RNA, 19 nt, Homo sapiens
gcaaauuaacagcugaaca

SEQ ID NO: 1172275 - RNA, 19 nt, Homo sapiens
cagccauccugguacugua

SEQ ID NO: 1172276 - RNA, 19 nt, Homo sapiens
aaacggccacgacuacuug

SEQ ID NO: 1172277 - RNA, 19 nt, Homo sapiens
aauaggaagucaugcucuu

SEQ ID NO: 1172278 - RNA, 19 nt, Homo sapiens
gcagaacacuggugggaua

SEQ ID NO: 1172279 - RNA, 19 nt, Homo sapiens
gaaacucccuccacuguga

SEQ ID NO: 1172280 - RNA, 19 nt, Homo sapiens
ggacauggcuuggcuguuc

SEQ ID NO: 1172281 - RNA, 19 nt, Homo sapiens
ggaaggccuugauuuguga

SEQ ID NO: 1172282 - RNA, 19 nt, Homo sapiens
gcacacacacgaauacaaa

SEQ ID NO: 1172283 - RNA, 19 nt, Homo sapiens
gaaagugaguccagagaag

SEQ ID NO: 1172284 - RNA, 19 nt, Homo sapiens
caacgucuguggaaugaug

SEQ ID NO: 1172285 - RNA, 19 nt, Homo sapiens
ggagaagccugggaugaga

SEQ ID NO: 1172286 - RNA, 19 nt, Homo sapiens
gaacaguaagccagaauau

SEQ ID NO: 1172287 - RNA, 19 nt, Homo sapiens
cacaggaucugcaaauaga

SEQ ID NO: 1172288 - RNA, 19 nt, Homo sapiens
gcuaccaccuggaugcuaa

SEQ ID NO: 1172289 - RNA, 19 nt, Homo sapiens
gagaaacucccuccacugu

SEQ ID NO: 1172290 - RNA, 19 nt, Homo sapiens
gcacaggaucugcaaauag

SEQ ID NO: 1172291 - RNA, 19 nt, Homo sapiens
gccaaccgauccaguauca

SEQ ID NO: 1172292 - RNA, 19 nt, Homo sapiens
gaggauggguccaagaaac

SEQ ID NO: 1172293 - RNA, 19 nt, Homo sapiens
ccacacaacuggcaaucca

SEQ ID NO: 1172294 - RNA, 19 nt, Homo sapiens
ggaaagugaguccagagaa

SEQ ID NO: 1172295 - RNA, 19 nt, Homo sapiens
caccagaacuuuacaaucc

SEQ ID NO: 1172296 - RNA, 19 nt, Homo sapiens
ucucuaaacugguccacaa

SEQ ID NO: 1172297 - RNA, 19 nt, Homo sapiens
gcagaaggaaugcucucua

SEQ ID NO: 1172298 - RNA, 19 nt, Homo sapiens
gaugcucugugcagucuga

SEQ ID NO: 1172299 - RNA, 19 nt, Homo sapiens
caucaccaaugacaagaga

SEQ ID NO: 1172300 - RNA, 19 nt, Homo sapiens
ccagaacuuuacaauccua

SEQ ID NO: 1172301 - RNA, 19 nt, Homo sapiens
ucaggaaggccuugauuug

SEQ ID NO: 1172302 - RNA, 19 nt, Homo sapiens
gaaacaugaggccuucuug

SEQ ID NO: 1172303 - RNA, 19 nt, Homo sapiens
gaacacuggugggauaaaa

SEQ ID NO: 1172304 - RNA, 19 nt, Homo sapiens
caaccgauccaguaucaug

SEQ ID NO: 1172305 - RNA, 19 nt, Homo sapiens
cuaaacugguccacaaugu

SEQ ID NO: 1172306 - RNA, 19 nt, Homo sapiens
gaagugggcagaagaacuc

SEQ ID NO: 1172307 - RNA, 19 nt, Homo sapiens
gagcacaggaucugcaaau

SEQ ID NO: 1172308 - RNA, 19 nt, Homo sapiens
gaguucuggucccugcuua

SEQ ID NO: 1172309 - RNA, 19 nt, Homo sapiens
gcgugcagguggugauuga

SEQ ID NO: 1172310 - RNA, 19 nt, Homo sapiens
ggaccaacgucuguggaau

SEQ ID NO: 1172311 - RNA, 19 nt, Homo sapiens
gagccuguguggccuacuu

SEQ ID NO: 1172312 - RNA, 19 nt, Homo sapiens
acaauuacacugauaagga

SEQ ID NO: 1172313 - RNA, 19 nt, Homo sapiens
gaaaguguccaucccugau

SEQ ID NO: 1172314 - RNA, 19 nt, Homo sapiens
cuucauggcuuguuuacuc

SEQ ID NO: 1172315 - RNA, 19 nt, Homo sapiens
cagaaggaaugcucucuac

SEQ ID NO: 1172316 - RNA, 19 nt, Homo sapiens
cugaaucccuucccuguuc

SEQ ID NO: 1172317 - RNA, 19 nt, Homo sapiens
gagaugcucugugcagucu

SEQ ID NO: 1172318 - RNA, 19 nt, Homo sapiens
aaucuacagccaagaauaa

SEQ ID NO: 1172319 - RNA, 19 nt, Homo sapiens
uggaaaagcucaagcaaga

SEQ ID NO: 1172320 - RNA, 19 nt, Homo sapiens
uggaauauuucaguaguga

SEQ ID NO: 1172321 - RNA, 19 nt, Homo sapiens
ccagagacaggaccagaaa

SEQ ID NO: 1172322 - RNA, 19 nt, Homo sapiens
guccugacuugaacucauu

SEQ ID NO: 1172323 - RNA, 19 nt, Homo sapiens
uguguggccuacuuccuua

SEQ ID NO: 1172324 - RNA, 19 nt, Homo sapiens
auaaccacaucaccaauga

SEQ ID NO: 1172325 - RNA, 19 nt, Homo sapiens
gaaagcaucaaguccucuu

SEQ ID NO: 1172326 - RNA, 19 nt, Homo sapiens
caugaggccuucuugacau

SEQ ID NO: 1172327 - RNA, 19 nt, Homo sapiens
ccaccuggaugcuaacucu

SEQ ID NO: 1172328 - RNA, 19 nt, Homo sapiens
uuaaaggccugaaggaaaa

SEQ ID NO: 1172329 - RNA, 19 nt, Homo sapiens
gcuggacagugccuuggaa

SEQ ID NO: 1172330 - RNA, 19 nt, Homo sapiens
caaagagccauacgaccuu

SEQ ID NO: 1172331 - RNA, 19 nt, Homo sapiens
uggccuacuuccuuacuaa

SEQ ID NO: 1172332 - RNA, 19 nt, Homo sapiens
ccuguaagagugagacuaa

SEQ ID NO: 1172333 - RNA, 19 nt, Homo sapiens
caaagccaaccguguguau

SEQ ID NO: 1172334 - RNA, 19 nt, Homo sapiens
ccaguaucaugaggcauuu

SEQ ID NO: 1172335 - RNA, 19 nt, Homo sapiens
gggaucuuguacucucuaa

SEQ ID NO: 1172336 - RNA, 19 nt, Homo sapiens
gaggaagugggcagaagaa

SEQ ID NO: 1172337 - RNA, 19 nt, Homo sapiens
ggacagugccuuggaagag

SEQ ID NO: 1172338 - RNA, 19 nt, Homo sapiens
aggaaggccuugauuugug

SEQ ID NO: 1172339 - RNA, 19 nt, Homo sapiens
ggaggauggguccaagaaa

SEQ ID NO: 1172340 - RNA, 19 nt, Homo sapiens
gaccaacgucuguggaaug

SEQ ID NO: 1172341 - RNA, 19 nt, Homo sapiens
gaucuuguacucucuaaac

SEQ ID NO: 1172342 - RNA, 19 nt, Homo sapiens
aaacaugaggccuucuuga

SEQ ID NO: 1172343 - RNA, 19 nt, Homo sapiens
uuuaaaggccugaaggaaa

SEQ ID NO: 1172344 - RNA, 19 nt, Homo sapiens
ccacaucaccaaugacaag

SEQ ID NO: 1172345 - RNA, 19 nt, Homo sapiens
gacagugccuuggaagagu

SEQ ID NO: 1172346 - RNA, 19 nt, Homo sapiens
ccucugaccauccucauug

SEQ ID NO: 1172347 - RNA, 19 nt, Homo sapiens
ugaacaguaagccagaaua

SEQ ID NO: 1172348 - RNA, 19 nt, Homo sapiens
agucugagaaagcaaauuu

SEQ ID NO: 1172349 - RNA, 19 nt, Homo sapiens
gcaccuggcuccccaucuu

SEQ ID NO: 1172350 - RNA, 19 nt, Homo sapiens
ucaccaaugacaagagauu

SEQ ID NO: 1172351 - RNA, 19 nt, Homo sapiens
gcaguggguuuggcugaag

SEQ ID NO: 1172352 - RNA, 19 nt, Homo sapiens
gcuccugcauguuaucuac

SEQ ID NO: 1172353 - RNA, 19 nt, Homo sapiens
aguguaagcgugguuguua

SEQ ID NO: 1172354 - RNA, 19 nt, Homo sapiens
aaaucuacagccaagaaua

SEQ ID NO: 1172355 - RNA, 19 nt, Homo sapiens
augauuacguggccucuga

SEQ ID NO: 1172356 - RNA, 19 nt, Homo sapiens
guaagagugagacuaaugg

SEQ ID NO: 1172357 - RNA, 19 nt, Homo sapiens
gagaagccugggaugagaa

SEQ ID NO: 1172358 - RNA, 19 nt, Homo sapiens
gcucugugcagucugagaa

SEQ ID NO: 1172359 - RNA, 19 nt, Homo sapiens
ccaagaagaggaagaugag

SEQ ID NO: 1172360 - RNA, 19 nt, Homo sapiens
acacugauaaggagcuaaa

SEQ ID NO: 1172361 - RNA, 19 nt, Homo sapiens
ugaccaguccccacaauua

SEQ ID NO: 1172362 - RNA, 19 nt, Homo sapiens
gacauggcuuggcuguuca

SEQ ID NO: 1172363 - RNA, 19 nt, Homo sapiens
ccauggggcuucacaaaau

SEQ ID NO: 1172364 - RNA, 19 nt, Homo sapiens
caauccuaauuuccaagaa

SEQ ID NO: 1172365 - RNA, 19 nt, Homo sapiens
gauuugugaugugcuagga

SEQ ID NO: 1172366 - RNA, 19 nt, Homo sapiens
cauaaccacaucaccaaug

SEQ ID NO: 1172367 - RNA, 19 nt, Homo sapiens
acaguaagccagaauaugc

SEQ ID NO: 1172368 - RNA, 19 nt, Homo sapiens
caggaaggccuugauuugu

SEQ ID NO: 1172369 - RNA, 19 nt, Homo sapiens
ggucugaaagcaucaaguc

SEQ ID NO: 1172370 - RNA, 19 nt, Homo sapiens
gcuucuucauggcuuguuu

SEQ ID NO: 1172371 - RNA, 19 nt, Homo sapiens
ggaagugggcagaagaacu

SEQ ID NO: 1172372 - RNA, 19 nt, Homo sapiens
guccuucagugccaccauu

SEQ ID NO: 1172373 - RNA, 19 nt, Homo sapiens
gccugggccucucaaggaa

SEQ ID NO: 1172374 - RNA, 19 nt, Homo sapiens
ucgauaaggcaguggguuu

SEQ ID NO: 1172375 - RNA, 19 nt, Homo sapiens
aaccugcuguccugacuug

SEQ ID NO: 1172376 - RNA, 19 nt, Homo sapiens
uguaugggccucccucaga

SEQ ID NO: 1172377 - RNA, 19 nt, Homo sapiens
ggccuugauuugugaugug

SEQ ID NO: 1172378 - RNA, 19 nt, Homo sapiens
ggaaggauaugcuaaguga

SEQ ID NO: 1172379 - RNA, 19 nt, Homo sapiens
aaacauggcuacuuucuaa

SEQ ID NO: 1172380 - RNA, 19 nt, Homo sapiens
gaacauuucuucacuuugu

SEQ ID NO: 1172381 - RNA, 19 nt, Homo sapiens
gaaauccgguaccaaguga

SEQ ID NO: 1172382 - RNA, 19 nt, Homo sapiens
gagcggagauuccucauag

SEQ ID NO: 1172383 - RNA, 19 nt, Homo sapiens
ggacagcacucacacucuu

SEQ ID NO: 1172384 - RNA, 19 nt, Homo sapiens
gugccaaacuugugaaauu

SEQ ID NO: 1172385 - RNA, 19 nt, Homo sapiens
gaaagaaagcaauaacuca

SEQ ID NO: 1172386 - RNA, 19 nt, Homo sapiens
gucaaacucuuaucaaaug

SEQ ID NO: 1172387 - RNA, 19 nt, Homo sapiens
ccaaaacucucuucucuaa

SEQ ID NO: 1172388 - RNA, 19 nt, Homo sapiens
cuagagacgucaagaaaug

SEQ ID NO: 1172389 - RNA, 19 nt, Homo sapiens
cagauuggcuccagcagaa

SEQ ID NO: 1172390 - RNA, 19 nt, Homo sapiens
gaaggcaucaagacaaauu

SEQ ID NO: 1172391 - RNA, 19 nt, Homo sapiens
cgaaaucucuaggaaguug

SEQ ID NO: 1172392 - RNA, 19 nt, Homo sapiens
guagagugcugcccgaaau

SEQ ID NO: 1172393 - RNA, 19 nt, Homo sapiens
gcacacaccaugaagauca

SEQ ID NO: 1172394 - RNA, 19 nt, Homo sapiens
gaggcuagcuuugaggaaa

SEQ ID NO: 1172395 - RNA, 19 nt, Homo sapiens
gggcauuucacuaccauua

SEQ ID NO: 1172396 - RNA, 19 nt, Homo sapiens
gcauuucacuaccauuaau

SEQ ID NO: 1172397 - RNA, 19 nt, Homo sapiens
gagauggagcugaacauuu

SEQ ID NO: 1172398 - RNA, 19 nt, Homo sapiens
guaagggccuggagaugug

SEQ ID NO: 1172399 - RNA, 19 nt, Homo sapiens
gaagacgggcugguaaauu

SEQ ID NO: 1172400 - RNA, 19 nt, Homo sapiens
agauggagcugaacauuuc

SEQ ID NO: 1172401 - RNA, 19 nt, Homo sapiens
caacucaucccuucucgaa

SEQ ID NO: 1172402 - RNA, 19 nt, Homo sapiens
gaaagacugguaacccaaa

SEQ ID NO: 1172403 - RNA, 19 nt, Homo sapiens
aagacgggcugguaaauug

SEQ ID NO: 1172404 - RNA, 19 nt, Homo sapiens
gaaggcaccaccucgcuuu

SEQ ID NO: 1172405 - RNA, 19 nt, Homo sapiens
gaagucaaacucuuaucaa

SEQ ID NO: 1172406 - RNA, 19 nt, Homo sapiens
ccugucagccuuucaauaa

SEQ ID NO: 1172407 - RNA, 19 nt, Homo sapiens
aaagccaccugucaacaaa

SEQ ID NO: 1172408 - RNA, 19 nt, Homo sapiens
caacauuaguuugcauuca

SEQ ID NO: 1172409 - RNA, 19 nt, Homo sapiens
ugacggugcucguucauag

SEQ ID NO: 1172410 - RNA, 19 nt, Homo sapiens
caccucaaaugacaauaaa

SEQ ID NO: 1172411 - RNA, 19 nt, Homo sapiens
gaagaucaccagcuuggau

SEQ ID NO: 1172412 - RNA, 19 nt, Homo sapiens
gcuguccucucgucuagaa

SEQ ID NO: 1172413 - RNA, 19 nt, Homo sapiens
ccaugaagaucaccagcuu

SEQ ID NO: 1172414 - RNA, 19 nt, Homo sapiens
ggcagaggcuggauuaaac

SEQ ID NO: 1172415 - RNA, 19 nt, Homo sapiens
ucgcaucuguuguaccuuu

SEQ ID NO: 1172416 - RNA, 19 nt, Homo sapiens
ccuugagguuguaauauaa

SEQ ID NO: 1172417 - RNA, 19 nt, Homo sapiens
ggaaauccgguaccaagug

SEQ ID NO: 1172418 - RNA, 19 nt, Homo sapiens
ggacacccaaggcgacuaa

SEQ ID NO: 1172419 - RNA, 19 nt, Homo sapiens
ucgaaggcaucaagacaaa

SEQ ID NO: 1172420 - RNA, 19 nt, Homo sapiens
uuagaucugugcagccuuu

SEQ ID NO: 1172421 - RNA, 19 nt, Homo sapiens
caacuugggcaccagcuuu

SEQ ID NO: 1172422 - RNA, 19 nt, Homo sapiens
gaagggcauuucacuacca

SEQ ID NO: 1172423 - RNA, 19 nt, Homo sapiens
ggggaaaauuuguauguaa

SEQ ID NO: 1172424 - RNA, 19 nt, Homo sapiens
uccuugagguuguaauaua

SEQ ID NO: 1172425 - RNA, 19 nt, Homo sapiens
uaguuugcauucaccuuua

SEQ ID NO: 1172426 - RNA, 19 nt, Homo sapiens
caccugagauggagcugaa

SEQ ID NO: 1172427 - RNA, 19 nt, Homo sapiens
gggcaggcaccacuuugua

SEQ ID NO: 1172428 - RNA, 19 nt, Homo sapiens
gagcacacaccaugaagau

SEQ ID NO: 1172429 - RNA, 19 nt, Homo sapiens
ggauggccgucaccucaga

SEQ ID NO: 1172430 - RNA, 19 nt, Homo sapiens
ccaccucaaaugacaauaa

SEQ ID NO: 1172431 - RNA, 19 nt, Homo sapiens
gcaguauggugugucaugu

SEQ ID NO: 1172432 - RNA, 19 nt, Homo sapiens
gcuauaaagccaccuguca

SEQ ID NO: 1172433 - RNA, 19 nt, Homo sapiens
ucuaagcuacaaaccauua

SEQ ID NO: 1172434 - RNA, 19 nt, Homo sapiens
gccugaagguuccuagaga

SEQ ID NO: 1172435 - RNA, 19 nt, Homo sapiens
caaaugagcaaucccaaac

SEQ ID NO: 1172436 - RNA, 19 nt, Homo sapiens
guaaauugguuuggcuaca

SEQ ID NO: 1172437 - RNA, 19 nt, Homo sapiens
uaaagccaccugucaacaa

SEQ ID NO: 1172438 - RNA, 19 nt, Homo sapiens
ggaaauugaagcuguagag

SEQ ID NO: 1172439 - RNA, 19 nt, Homo sapiens
ggucuuaaagguagucaga

SEQ ID NO: 1172440 - RNA, 19 nt, Homo sapiens
agaguaagaucaccugcau

SEQ ID NO: 1172441 - RNA, 19 nt, Homo sapiens
gcaagggacagcacucaca

SEQ ID NO: 1172442 - RNA, 19 nt, Homo sapiens
ccaaaugagcaaucccaaa

SEQ ID NO: 1172443 - RNA, 19 nt, Homo sapiens
agggauaccugaagcuguu

SEQ ID NO: 1172444 - RNA, 19 nt, Homo sapiens
ggacuaauccaucgaugac

SEQ ID NO: 1172445 - RNA, 19 nt, Homo sapiens
ucucugaucuccaccucaa

SEQ ID NO: 1172446 - RNA, 19 nt, Homo sapiens
cccgaaaucucuaggaagu

SEQ ID NO: 1172447 - RNA, 19 nt, Homo sapiens
ccaugggucucuucguguu

SEQ ID NO: 1172448 - RNA, 19 nt, Homo sapiens
ggagcggagauuccucaua

SEQ ID NO: 1172449 - RNA, 19 nt, Homo sapiens
gugauucugugaggaaaga

SEQ ID NO: 1172450 - RNA, 19 nt, Homo sapiens
agaggcagaggcuggauua

SEQ ID NO: 1172451 - RNA, 19 nt, Homo sapiens
ggaagacgggcugguaaau

SEQ ID NO: 1172452 - RNA, 19 nt, Homo sapiens
gccgacaccugggaucuug

SEQ ID NO: 1172453 - RNA, 19 nt, Homo sapiens
aaaacucucuucucuaaug

SEQ ID NO: 1172454 - RNA, 19 nt, Homo sapiens
caaaugugaacaccugaga

SEQ ID NO: 1172455 - RNA, 19 nt, Homo sapiens
gcaggcacccacuguuuca

SEQ ID NO: 1172456 - RNA, 19 nt, Homo sapiens
cccauuauguacagaauag

SEQ ID NO: 1172457 - RNA, 19 nt, Homo sapiens
gccuggagauguguaaaga

SEQ ID NO: 1172458 - RNA, 19 nt, Homo sapiens
uuucaugucccguguguuu

SEQ ID NO: 1172459 - RNA, 19 nt, Homo sapiens
cagcuguccucucgucuag

SEQ ID NO: 1172460 - RNA, 19 nt, Homo sapiens
uaugcuaagugaugaaagu

SEQ ID NO: 1172461 - RNA, 19 nt, Homo sapiens
caagggcaggcaccacuuu

SEQ ID NO: 1172462 - RNA, 19 nt, Homo sapiens
ugaauaucuuacacuguga

SEQ ID NO: 1172463 - RNA, 19 nt, Homo sapiens
aaagcaguaugguguguca

SEQ ID NO: 1172464 - RNA, 19 nt, Homo sapiens
ugaagucaaacucuuauca

SEQ ID NO: 1172465 - RNA, 19 nt, Homo sapiens
cagcuucagccuagggaua

SEQ ID NO: 1172466 - RNA, 19 nt, Homo sapiens
cuucagccaucaggacuaa

SEQ ID NO: 1172467 - RNA, 19 nt, Homo sapiens
ucacuggucguguaaacuu

SEQ ID NO: 1172468 - RNA, 19 nt, Homo sapiens
gauaugcuaagugaugaaa

SEQ ID NO: 1172469 - RNA, 19 nt, Homo sapiens
guacuguguuguggaagga

SEQ ID NO: 1172470 - RNA, 19 nt, Homo sapiens
ccaaggcgacuaagagaca

SEQ ID NO: 1172471 - RNA, 19 nt, Homo sapiens
ugaaagaaagcaauaacuc

SEQ ID NO: 1172472 - RNA, 19 nt, Homo sapiens
gcugauccguggccugaag

SEQ ID NO: 1172473 - RNA, 19 nt, Homo sapiens
ucuguaagcugugucuuca

SEQ ID NO: 1172474 - RNA, 19 nt, Homo sapiens
gaaauugaagcuguagagu

SEQ ID NO: 1172475 - RNA, 19 nt, Homo sapiens
ccacccugcaguccacuua

SEQ ID NO: 1172476 - RNA, 19 nt, Homo sapiens
uggaguacuugcuauaaag

SEQ ID NO: 1172477 - RNA, 19 nt, Homo sapiens
uuggaguacuugcuauaaa

SEQ ID NO: 1172478 - RNA, 19 nt, Homo sapiens
gcaccagacugcagaauga

SEQ ID NO: 1172479 - RNA, 19 nt, Homo sapiens
gaaagacagugaagaugug

SEQ ID NO: 1172480 - RNA, 19 nt, Homo sapiens
gagcucagaucaagaagga

SEQ ID NO: 1172481 - RNA, 19 nt, Homo sapiens
gaacauggacuugugacua

SEQ ID NO: 1172482 - RNA, 19 nt, Homo sapiens
gcagaaugaggcaauaaua

SEQ ID NO: 1172483 - RNA, 19 nt, Homo sapiens
ggacuggccuccuuguuca

SEQ ID NO: 1172484 - RNA, 19 nt, Homo sapiens
ccugugaccuccuacauaa

SEQ ID NO: 1172485 - RNA, 19 nt, Homo sapiens
gcacgaggccaguucauga

SEQ ID NO: 1172486 - RNA, 19 nt, Homo sapiens
gcacgucggcucauaguga

SEQ ID NO: 1172487 - RNA, 19 nt, Homo sapiens
ugaagaggcugaagcuuuc

SEQ ID NO: 1172488 - RNA, 19 nt, Homo sapiens
acaagaagccgccuuauca

SEQ ID NO: 1172489 - RNA, 19 nt, Homo sapiens
gcaauaauacggaccaaca

SEQ ID NO: 1172490 - RNA, 19 nt, Homo sapiens
ggaccgacauccugaacau

SEQ ID NO: 1172491 - RNA, 19 nt, Homo sapiens
ugacaaugcuggcuacaca

SEQ ID NO: 1172492 - RNA, 19 nt, Homo sapiens
gguuggagaugguacaguu

SEQ ID NO: 1172493 - RNA, 19 nt, Homo sapiens
aacauggacuugugacuaa

SEQ ID NO: 1172494 - RNA, 19 nt, Homo sapiens
ggguaaauccugaggcuuu

SEQ ID NO: 1172495 - RNA, 19 nt, Homo sapiens
ccaacaagaagccgccuua

SEQ ID NO: 1172496 - RNA, 19 nt, Homo sapiens
gaagccgccuuaucaaugc

SEQ ID NO: 1172497 - RNA, 19 nt, Homo sapiens
auaaggauguuguucucua

SEQ ID NO: 1172498 - RNA, 19 nt, Homo sapiens
gguaaauccugaggcuuug

SEQ ID NO: 1172499 - RNA, 19 nt, Homo sapiens
gaauuccagucuugcaaca

SEQ ID NO: 1172500 - RNA, 19 nt, Homo sapiens
gagaggagcuuggguugcu

SEQ ID NO: 1172501 - RNA, 19 nt, Homo sapiens
ccagaaagacagugaagau

SEQ ID NO: 1172502 - RNA, 19 nt, Homo sapiens
guucuucugucuucuguag

SEQ ID NO: 1172503 - RNA, 19 nt, Homo sapiens
cgauggaggaggaugauuu

SEQ ID NO: 1172504 - RNA, 19 nt, Homo sapiens
ggugagggguuaauaaguu

SEQ ID NO: 1172505 - RNA, 19 nt, Homo sapiens
caagaagccgccuuaucaa

SEQ ID NO: 1172506 - RNA, 19 nt, Homo sapiens
gaaaacagccccuccucuu

SEQ ID NO: 1172507 - RNA, 19 nt, Homo sapiens
ucugucuucuguaguauuu

SEQ ID NO: 1172508 - RNA, 19 nt, Homo sapiens
uaauacggaccaacaagaa

SEQ ID NO: 1172509 - RNA, 19 nt, Homo sapiens
uagaguauguaccauccaa

SEQ ID NO: 1172510 - RNA, 19 nt, Homo sapiens
gaaacccacagaaccaugu

SEQ ID NO: 1172511 - RNA, 19 nt, Homo sapiens
guacgagccagaccuacuu

SEQ ID NO: 1172512 - RNA, 19 nt, Homo sapiens
ucuacugccuccagaaaga

SEQ ID NO: 1172513 - RNA, 19 nt, Homo sapiens
uugaagaggcugaagcuuu

SEQ ID NO: 1172514 - RNA, 19 nt, Homo sapiens
ugaagcgcuuucucaguga

SEQ ID NO: 1172515 - RNA, 19 nt, Homo sapiens
ucuucugucuucuguagua

SEQ ID NO: 1172516 - RNA, 19 nt, Homo sapiens
augaugcgguggucaauga

SEQ ID NO: 1172517 - RNA, 19 nt, Homo sapiens
agaaagacagugaagaugu

SEQ ID NO: 1172518 - RNA, 19 nt, Homo sapiens
gaagcgcuuucucagugau

SEQ ID NO: 1172519 - RNA, 19 nt, Homo sapiens
agaagccgccuuaucaaug

SEQ ID NO: 1172520 - RNA, 19 nt, Homo sapiens
uguuugaacucucagacaa

SEQ ID NO: 1172521 - RNA, 19 nt, Homo sapiens
gauggaggaggaugauuuc

SEQ ID NO: 1172522 - RNA, 19 nt, Homo sapiens
guugaugagcucugacaaa

SEQ ID NO: 1172523 - RNA, 19 nt, Homo sapiens
gacuuucuguaccuccuuu

SEQ ID NO: 1172524 - RNA, 19 nt, Homo sapiens
uaaggauguuguucucuac

SEQ ID NO: 1172525 - RNA, 19 nt, Homo sapiens
agaggcacgucggcucaua

SEQ ID NO: 1172526 - RNA, 19 nt, Homo sapiens
gugagggguuaauaaguua

SEQ ID NO: 1172527 - RNA, 19 nt, Homo sapiens
gaggagaaaugagaaaauc

SEQ ID NO: 1172528 - RNA, 19 nt, Homo sapiens
caauaauacggaccaacaa

SEQ ID NO: 1172529 - RNA, 19 nt, Homo sapiens
gagugcacaauacgaguuu

SEQ ID NO: 1172530 - RNA, 19 nt, Homo sapiens
auuagcgacuggacuguuu

SEQ ID NO: 1172531 - RNA, 19 nt, Homo sapiens
gcuauaaggauguuguucu

SEQ ID NO: 1172532 - RNA, 19 nt, Homo sapiens
gccugugaccuccuacaua

SEQ ID NO: 1172533 - RNA, 19 nt, Homo sapiens
gcaacugguuccucuuuuc

SEQ ID NO: 1172534 - RNA, 19 nt, Homo sapiens
ccugggagcucagaucaag

SEQ ID NO: 1172535 - RNA, 19 nt, Homo sapiens
agagggugaucccggugua

SEQ ID NO: 1172536 - RNA, 19 nt, Homo sapiens
uugaugagcucugacaaag

SEQ ID NO: 1172537 - RNA, 19 nt, Homo sapiens
cuauaaggauguuguucuc

SEQ ID NO: 1172538 - RNA, 19 nt, Homo sapiens
ccuguguucuucugucuuc

SEQ ID NO: 1172539 - RNA, 19 nt, Homo sapiens
cacgucggcucauagugaa

SEQ ID NO: 1172540 - RNA, 19 nt, Homo sapiens
cagaaugaggcaauaauac

SEQ ID NO: 1172541 - RNA, 19 nt, Homo sapiens
ccugucgucgucauuguua

SEQ ID NO: 1172542 - RNA, 19 nt, Homo sapiens
aagacggguuugccuguga

SEQ ID NO: 1172543 - RNA, 19 nt, Homo sapiens
acagugaagaugugaauca

SEQ ID NO: 1172544 - RNA, 19 nt, Homo sapiens
uggccucccugucucaaga

SEQ ID NO: 1172545 - RNA, 19 nt, Homo sapiens
aauaaaggagcguggagaa

SEQ ID NO: 1172546 - RNA, 19 nt, Homo sapiens
cgucauuguuaucgugguu

SEQ ID NO: 1172547 - RNA, 19 nt, Homo sapiens
caacaagaagccgccuuau

SEQ ID NO: 1172548 - RNA, 19 nt, Homo sapiens
cagaaagacagugaagaug

SEQ ID NO: 1172549 - RNA, 19 nt, Homo sapiens
gaaccauguacacccucua

SEQ ID NO: 1172550 - RNA, 19 nt, Homo sapiens
gcuacacagcccugcauga

SEQ ID NO: 1172551 - RNA, 19 nt, Homo sapiens
gaguauguaccauccaaag

SEQ ID NO: 1172552 - RNA, 19 nt, Homo sapiens
ccauguacacccucuaagu

SEQ ID NO: 1172553 - RNA, 19 nt, Homo sapiens
gccagcagcgacaccauga

SEQ ID NO: 1172554 - RNA, 19 nt, Homo sapiens
gucccucccacucuuauuu

SEQ ID NO: 1172555 - RNA, 19 nt, Homo sapiens
guauugagggacuuucugu

SEQ ID NO: 1172556 - RNA, 19 nt, Homo sapiens
cuacaaccuccaaguguca

SEQ ID NO: 1172557 - RNA, 19 nt, Homo sapiens
cauguacacccucuaaguc

SEQ ID NO: 1172558 - RNA, 19 nt, Homo sapiens
ggguuaauaaguuacucua

SEQ ID NO: 1172559 - RNA, 19 nt, Homo sapiens
gcuaaaacaacaacaacaa

SEQ ID NO: 1172560 - RNA, 19 nt, Homo sapiens
cauugucccucccacucuu

SEQ ID NO: 1172561 - RNA, 19 nt, Homo sapiens
agacagugaagaugugaau

SEQ ID NO: 1172562 - RNA, 19 nt, Homo sapiens
guucaugaccaagaccaaa

SEQ ID NO: 1172563 - RNA, 19 nt, Homo sapiens
gcgguacgagccagaccua

SEQ ID NO: 1172564 - RNA, 19 nt, Homo sapiens
gcuaggcaagggcaggaaa

SEQ ID NO: 1172565 - RNA, 19 nt, Homo sapiens
gacgauuugagacaacuug

SEQ ID NO: 1172566 - RNA, 19 nt, Homo sapiens
aagaagccgccuuaucaau

SEQ ID NO: 1172567 - RNA, 19 nt, Homo sapiens
agaccuacuucggcuccua

SEQ ID NO: 1172568 - RNA, 19 nt, Homo sapiens
cugcaacugguuccucuuu

SEQ ID NO: 1172569 - RNA, 19 nt, Homo sapiens
ugggagcucagaucaagaa

SEQ ID NO: 1172570 - RNA, 19 nt, Homo sapiens
auaauacggaccaacaaga

SEQ ID NO: 1172571 - RNA, 19 nt, Homo sapiens
ucacgcgggucuccaauua

SEQ ID NO: 1172572 - RNA, 19 nt, Homo sapiens
gcaaauaacuaaccaaaag

SEQ ID NO: 1172573 - RNA, 19 nt, Homo sapiens
ggacacaccaugauaagga

SEQ ID NO: 1172574 - RNA, 19 nt, Homo sapiens
ccaauuacaucgacuggau

SEQ ID NO: 1172575 - RNA, 19 nt, Homo sapiens
gucagugucucuaagauug

SEQ ID NO: 1172576 - RNA, 19 nt, Homo sapiens
ccacggacacaccaugaua

SEQ ID NO: 1172577 - RNA, 19 nt, Homo sapiens
ccacuuacccaccuuaugu

SEQ ID NO: 1172578 - RNA, 19 nt, Homo sapiens
gcaccauucuacccaacaa

SEQ ID NO: 1172579 - RNA, 19 nt, Homo sapiens
ggaaaggucacagaaggaa

SEQ ID NO: 1172580 - RNA, 19 nt, Homo sapiens
ccacaagcccuccgucuuc

SEQ ID NO: 1172581 - RNA, 19 nt, Homo sapiens
ggugauugcaaauaacuaa

SEQ ID NO: 1172582 - RNA, 19 nt, Homo sapiens
cgacauugcccugcucaaa

SEQ ID NO: 1172583 - RNA, 19 nt, Homo sapiens
gaaaggucacagaaggaaa

SEQ ID NO: 1172584 - RNA, 19 nt, Homo sapiens
uacaucgacuggaucaauu

SEQ ID NO: 1172585 - RNA, 19 nt, Homo sapiens
auucggugauugcaaauaa

SEQ ID NO: 1172586 - RNA, 19 nt, Homo sapiens
ggucacagaaggaaaauaa

SEQ ID NO: 1172587 - RNA, 19 nt, Homo sapiens
gaagaagcgaggcccaaca

SEQ ID NO: 1172588 - RNA, 19 nt, Homo sapiens
ccaaccaaaucuccaaagg

SEQ ID NO: 1172589 - RNA, 19 nt, Homo sapiens
aaagugacaacuaugcaaa

SEQ ID NO: 1172590 - RNA, 19 nt, Homo sapiens
gcuccaauggcaaguggua

SEQ ID NO: 1172591 - RNA, 19 nt, Homo sapiens
uaaagugacaacuaugcaa

SEQ ID NO: 1172592 - RNA, 19 nt, Homo sapiens
caacggggcuguuccugau

SEQ ID NO: 1172593 - RNA, 19 nt, Homo sapiens
gauugcaaauaacuaacca

SEQ ID NO: 1172594 - RNA, 19 nt, Homo sapiens
cacaagcccuccgucuuca

SEQ ID NO: 1172595 - RNA, 19 nt, Homo sapiens
gaaaaccaguaugaucugu

SEQ ID NO: 1172596 - RNA, 19 nt, Homo sapiens
ccaaagggaacgacauugc

SEQ ID NO: 1172597 - RNA, 19 nt, Homo sapiens
cacggacacaccaugauaa

SEQ ID NO: 1172598 - RNA, 19 nt, Homo sapiens
uuacaucgacuggaucaau

SEQ ID NO: 1172599 - RNA, 19 nt, Homo sapiens
acgcgggucuccaauuaca

SEQ ID NO: 1172600 - RNA, 19 nt, Homo sapiens
ggugguuggcggugaagaa

SEQ ID NO: 1172601 - RNA, 19 nt, Homo sapiens
uuacccaccuuaugugacu

SEQ ID NO: 1172602 - RNA, 19 nt, Homo sapiens
gguugcugguuguggacua

SEQ ID NO: 1172603 - RNA, 19 nt, Homo sapiens
acauugcccugcucaaacu

SEQ ID NO: 1172604 - RNA, 19 nt, Homo sapiens
gacauugcccugcucaaac

SEQ ID NO: 1172605 - RNA, 19 nt, Homo sapiens
gcuggagcccucaguugug

SEQ ID NO: 1172606 - RNA, 19 nt, Homo sapiens
ccauucuacccaacaacua

SEQ ID NO: 1172607 - RNA, 19 nt, Homo sapiens
gaacaagucggucaaauua

SEQ ID NO: 1172608 - RNA, 19 nt, Homo sapiens
gagaguggcuauuucauua

SEQ ID NO: 1172609 - RNA, 19 nt, Homo sapiens
caaagaagcuauuuaggaa

SEQ ID NO: 1172610 - RNA, 19 nt, Homo sapiens
gaugauaucuucacuguca

SEQ ID NO: 1172611 - RNA, 19 nt, Homo sapiens
gcaagagccugguuuguca

SEQ ID NO: 1172612 - RNA, 19 nt, Homo sapiens
gaagguauaugcugcugaa

SEQ ID NO: 1172613 - RNA, 19 nt, Homo sapiens
gcaaagaagcuauuuagga

SEQ ID NO: 1172614 - RNA, 19 nt, Homo sapiens
gaacaacucucuugaugac

SEQ ID NO: 1172615 - RNA, 19 nt, Homo sapiens
ggaauucagugucuuuaga

SEQ ID NO: 1172616 - RNA, 19 nt, Homo sapiens
gccaaagucuucauuuauu

SEQ ID NO: 1172617 - RNA, 19 nt, Homo sapiens
ggaauagcaauuacaguua

SEQ ID NO: 1172618 - RNA, 19 nt, Homo sapiens
caaaucccguguuuccuua

SEQ ID NO: 1172619 - RNA, 19 nt, Homo sapiens
agaccaagaugaaacauuu

SEQ ID NO: 1172620 - RNA, 19 nt, Homo sapiens
caucaaagcugcauuucau

SEQ ID NO: 1172621 - RNA, 19 nt, Homo sapiens
uugaacaccuggccuauua

SEQ ID NO: 1172622 - RNA, 19 nt, Homo sapiens
gacuuaaccuccuccauaa

SEQ ID NO: 1172623 - RNA, 19 nt, Homo sapiens
ucacagaggaugaaauuaa

SEQ ID NO: 1172624 - RNA, 19 nt, Homo sapiens
cagaacaacucucuugaug

SEQ ID NO: 1172625 - RNA, 19 nt, Homo sapiens
gaaucucucugaauccauu

SEQ ID NO: 1172626 - RNA, 19 nt, Homo sapiens
ggacugacaggcugacaua

SEQ ID NO: 1172627 - RNA, 19 nt, Homo sapiens
gcucagugguggaaaugua

SEQ ID NO: 1172628 - RNA, 19 nt, Homo sapiens
gacauaagauggccuguag

SEQ ID NO: 1172629 - RNA, 19 nt, Homo sapiens
uagcaacacugcagaaaug

SEQ ID NO: 1172630 - RNA, 19 nt, Homo sapiens
acaagucggucaaauuaaa

SEQ ID NO: 1172631 - RNA, 19 nt, Homo sapiens
ucagggaccuuguggauga

SEQ ID NO: 1172632 - RNA, 19 nt, Homo sapiens
ggucucaaaucccguguuu

SEQ ID NO: 1172633 - RNA, 19 nt, Homo sapiens
cgaaagcuguuguuacuca

SEQ ID NO: 1172634 - RNA, 19 nt, Homo sapiens
ccaaagucuucauuuauug

SEQ ID NO: 1172635 - RNA, 19 nt, Homo sapiens
cauagcagauggugucaaa

SEQ ID NO: 1172636 - RNA, 19 nt, Homo sapiens
gaaaggaugaccacucaga

SEQ ID NO: 1172637 - RNA, 19 nt, Homo sapiens
aaacugaugcccaaucuuu

SEQ ID NO: 1172638 - RNA, 19 nt, Homo sapiens
ggaaacugaugcccaaucu

SEQ ID NO: 1172639 - RNA, 19 nt, Homo sapiens
gcacauccucuuagaauca

SEQ ID NO: 1172640 - RNA, 19 nt, Homo sapiens
agacuuaaccuccuccaua

SEQ ID NO: 1172641 - RNA, 19 nt, Homo sapiens
gaggaaugcuugcuggaau

SEQ ID NO: 1172642 - RNA, 19 nt, Homo sapiens
caacagucauuuagcaaca

SEQ ID NO: 1172643 - RNA, 19 nt, Homo sapiens
ggagaguggcuauuucauu

SEQ ID NO: 1172644 - RNA, 19 nt, Homo sapiens
cuaguauugucaacucuua

SEQ ID NO: 1172645 - RNA, 19 nt, Homo sapiens
cuacggagcgucaauugua

SEQ ID NO: 1172646 - RNA, 19 nt, Homo sapiens
acacuuaaccuugucaaua

SEQ ID NO: 1172647 - RNA, 19 nt, Homo sapiens
uuauacagguucaucagua

SEQ ID NO: 1172648 - RNA, 19 nt, Homo sapiens
guuaucagauucuuaaugg

SEQ ID NO: 1172649 - RNA, 19 nt, Homo sapiens
gagcgucaauuguauacug

SEQ ID NO: 1172650 - RNA, 19 nt, Homo sapiens
caccuaugcugccaaauug

SEQ ID NO: 1172651 - RNA, 19 nt, Homo sapiens
gaacaaaaggcaguuauuu

SEQ ID NO: 1172652 - RNA, 19 nt, Homo sapiens
aggccaaagucuucauuua

SEQ ID NO: 1172653 - RNA, 19 nt, Homo sapiens
ugaaacauuuacccacaaa

SEQ ID NO: 1172654 - RNA, 19 nt, Homo sapiens
ggccauggguaccuagaaa

SEQ ID NO: 1172655 - RNA, 19 nt, Homo sapiens
ggaauuccugcuuauauug

SEQ ID NO: 1172656 - RNA, 19 nt, Homo sapiens
gaagacauuuuguuuccua

SEQ ID NO: 1172657 - RNA, 19 nt, Homo sapiens
ugguggaaauguagacuua

SEQ ID NO: 1172658 - RNA, 19 nt, Homo sapiens
gccgaaagcuguuguuacu

SEQ ID NO: 1172659 - RNA, 19 nt, Homo sapiens
aaugugaacucuuccagaa

SEQ ID NO: 1172660 - RNA, 19 nt, Homo sapiens
ggugucaaauccagcauug

SEQ ID NO: 1172661 - RNA, 19 nt, Homo sapiens
gcucugaaaccuaguguga

SEQ ID NO: 1172662 - RNA, 19 nt, Homo sapiens
caucauuaccuucuccaua

SEQ ID NO: 1172663 - RNA, 19 nt, Homo sapiens
uaagauggccuguagcaau

SEQ ID NO: 1172664 - RNA, 19 nt, Homo sapiens
gcugugcugucucaacauu

SEQ ID NO: 1172665 - RNA, 19 nt, Homo sapiens
ggccaaagucuucauuuau

SEQ ID NO: 1172666 - RNA, 19 nt, Homo sapiens
aagaacauguaacguacua

SEQ ID NO: 1172667 - RNA, 19 nt, Homo sapiens
cugaaaggccagcuucuua

SEQ ID NO: 1172668 - RNA, 19 nt, Homo sapiens
uuaaagcaaugacuuccaa

SEQ ID NO: 1172669 - RNA, 19 nt, Homo sapiens
cacuuaaccuugucaauag

SEQ ID NO: 1172670 - RNA, 19 nt, Homo sapiens
cuaacaagcuccauuuuga

SEQ ID NO: 1172671 - RNA, 19 nt, Homo sapiens
ccacaaaggcaaucagauc

SEQ ID NO: 1172672 - RNA, 19 nt, Homo sapiens
uauacacuguuucacguaa

SEQ ID NO: 1172673 - RNA, 19 nt, Homo sapiens
aauaaacuuugcccaauca

SEQ ID NO: 1172674 - RNA, 19 nt, Homo sapiens
gucuggaucuacugacaua

SEQ ID NO: 1172675 - RNA, 19 nt, Homo sapiens
gaccaagaugaaacauuua

SEQ ID NO: 1172676 - RNA, 19 nt, Homo sapiens
cauuaaagaccaagaugaa

SEQ ID NO: 1172677 - RNA, 19 nt, Homo sapiens
cagcacauccucuuagaau

SEQ ID NO: 1172678 - RNA, 19 nt, Homo sapiens
ucaguacugugucuugaga

SEQ ID NO: 1172679 - RNA, 19 nt, Homo sapiens
gaaauggugggaauucagu

SEQ ID NO: 1172680 - RNA, 19 nt, Homo sapiens
ucaccuaugcugccaaauu

SEQ ID NO: 1172681 - RNA, 19 nt, Homo sapiens
aagauggccuguagcaaug

SEQ ID NO: 1172682 - RNA, 19 nt, Homo sapiens
aaauaaacuuugcccaauc

SEQ ID NO: 1172683 - RNA, 19 nt, Homo sapiens
cugacaggcugacauagaa

SEQ ID NO: 1172684 - RNA, 19 nt, Homo sapiens
gaaaggccagcuucuuauc

SEQ ID NO: 1172685 - RNA, 19 nt, Homo sapiens
uggaugauaucuucacugu

SEQ ID NO: 1172686 - RNA, 19 nt, Homo sapiens
cauaucaacauucgagauu

SEQ ID NO: 1172687 - RNA, 19 nt, Homo sapiens
aggaaugcuugcuggaaua

SEQ ID NO: 1172688 - RNA, 19 nt, Homo sapiens
agaaagacaucagaacaag

SEQ ID NO: 1172689 - RNA, 19 nt, Homo sapiens
caucaguacugugucuuga

SEQ ID NO: 1172690 - RNA, 19 nt, Homo sapiens
agaacaagucggucaaauu

SEQ ID NO: 1172691 - RNA, 19 nt, Homo sapiens
gauuuuagcuucccaucaa

SEQ ID NO: 1172692 - RNA, 19 nt, Homo sapiens
gaggcacuguugaagaaau

SEQ ID NO: 1172693 - RNA, 19 nt, Homo sapiens
uaauggagaguggcuauuu

SEQ ID NO: 1172694 - RNA, 19 nt, Homo sapiens
gaaccuacagcugguguug

SEQ ID NO: 1172695 - RNA, 19 nt, Homo sapiens
gaacaccuggccuauuauc

SEQ ID NO: 1172696 - RNA, 19 nt, Homo sapiens
cagagaaaauguugcaaaa

SEQ ID NO: 1172697 - RNA, 19 nt, Homo sapiens
ggaauuuacaggccaaagu

SEQ ID NO: 1172698 - RNA, 19 nt, Homo sapiens
gaaccaugugugcucagua

SEQ ID NO: 1172699 - RNA, 19 nt, Homo sapiens
uugaagaacauguaacgua

SEQ ID NO: 1172700 - RNA, 19 nt, Homo sapiens
ggaagacucguuuauacag

SEQ ID NO: 1172701 - RNA, 19 nt, Homo sapiens
uugaggcacuguugaagaa

SEQ ID NO: 1172702 - RNA, 19 nt, Homo sapiens
ucagucuguuucuguuuaa

SEQ ID NO: 1172703 - RNA, 19 nt, Homo sapiens
gaauuuacaggccaaaguc

SEQ ID NO: 1172704 - RNA, 19 nt, Homo sapiens
aaauguaaacccaaccuuu

SEQ ID NO: 1172705 - RNA, 19 nt, Homo sapiens
aaacuuugcccaaucacaa

SEQ ID NO: 1172706 - RNA, 19 nt, Homo sapiens
ccagaaguaaagaacauuu

SEQ ID NO: 1172707 - RNA, 19 nt, Homo sapiens
gaacaggacuucaucaaca

SEQ ID NO: 1172708 - RNA, 19 nt, Homo sapiens
gaagagaaauaugaagaug

SEQ ID NO: 1172709 - RNA, 19 nt, Homo sapiens
ucuaugauguguacuguua

SEQ ID NO: 1172710 - RNA, 19 nt, Homo sapiens
gaaagaggaggaagaagaa

SEQ ID NO: 1172711 - RNA, 19 nt, Homo sapiens
cagagaagcugacauugga

SEQ ID NO: 1172712 - RNA, 19 nt, Homo sapiens
gcuaugagguggacacugu

SEQ ID NO: 1172713 - RNA, 19 nt, Homo sapiens
ggaagaagagaaauaugaa

SEQ ID NO: 1172714 - RNA, 19 nt, Homo sapiens
ggagugacgugcccugcaa

SEQ ID NO: 1172715 - RNA, 19 nt, Homo sapiens
ggacgcuccuagaauuuga

SEQ ID NO: 1172716 - RNA, 19 nt, Homo sapiens
ggacccggaugaccucuau

SEQ ID NO: 1172717 - RNA, 19 nt, Homo sapiens
cggaugaccucuaugaugu

SEQ ID NO: 1172718 - RNA, 19 nt, Homo sapiens
gcaacuaccaccuguccua

SEQ ID NO: 1172719 - RNA, 19 nt, Homo sapiens
ggaggaagaagagaaauau

SEQ ID NO: 1172720 - RNA, 19 nt, Homo sapiens
ccgcuaugcuuucuccuuu

SEQ ID NO: 1172721 - RNA, 19 nt, Homo sapiens
guaaggcauuggaggaaga

SEQ ID NO: 1172722 - RNA, 19 nt, Homo sapiens
caacgacucggguaucuau

SEQ ID NO: 1172723 - RNA, 19 nt, Homo sapiens
cggaguaaaucccuaagug

SEQ ID NO: 1172724 - RNA, 19 nt, Homo sapiens
ugaagauaauucuggaaga

SEQ ID NO: 1172725 - RNA, 19 nt, Homo sapiens
cacaggaagugacaacaug

SEQ ID NO: 1172726 - RNA, 19 nt, Homo sapiens
aggaggagguggaggauga

SEQ ID NO: 1172727 - RNA, 19 nt, Homo sapiens
agaaagaggaggaagaaga

SEQ ID NO: 1172728 - RNA, 19 nt, Homo sapiens
ugaaacacaauccauggua

SEQ ID NO: 1172729 - RNA, 19 nt, Homo sapiens
gaucagaccgugagguauc

SEQ ID NO: 1172730 - RNA, 19 nt, Homo sapiens
caacccagccucugaugga

SEQ ID NO: 1172731 - RNA, 19 nt, Homo sapiens
caggauggagugucuguaa

SEQ ID NO: 1172732 - RNA, 19 nt, Homo sapiens
ccuagaauuugaaacacaa

SEQ ID NO: 1172733 - RNA, 19 nt, Homo sapiens
gaagaagagaaauaugaag

SEQ ID NO: 1172734 - RNA, 19 nt, Homo sapiens
gaagcuccacuccagaaga

SEQ ID NO: 1172735 - RNA, 19 nt, Homo sapiens
cagacuggcuuccccaaua

SEQ ID NO: 1172736 - RNA, 19 nt, Homo sapiens
ggaggaggcgacaaacuuc

SEQ ID NO: 1172737 - RNA, 19 nt, Homo sapiens
agaccuaaauggagaacug

SEQ ID NO: 1172738 - RNA, 19 nt, Homo sapiens
ggcaccagaucuuccauca

SEQ ID NO: 1172739 - RNA, 19 nt, Homo sapiens
aggaagaagagaaauauga

SEQ ID NO: 1172740 - RNA, 19 nt, Homo sapiens
gcuccuagaauuugaaaca

SEQ ID NO: 1172741 - RNA, 19 nt, Homo sapiens
gaugaccucuaugaugugu

SEQ ID NO: 1172742 - RNA, 19 nt, Homo sapiens
gcucugcccgcuaugcuuu

SEQ ID NO: 1172743 - RNA, 19 nt, Homo sapiens
gaaccuagcauccccauca

SEQ ID NO: 1172744 - RNA, 19 nt, Homo sapiens
agaggaagguaaggcauug

SEQ ID NO: 1172745 - RNA, 19 nt, Homo sapiens
uaugauguguacuguuaug

SEQ ID NO: 1172746 - RNA, 19 nt, Homo sapiens
gcucagaggaccgcgcuuu

SEQ ID NO: 1172747 - RNA, 19 nt, Homo sapiens
ggaacaggacuucaucaac

SEQ ID NO: 1172748 - RNA, 19 nt, Homo sapiens
ugaagaugaagaagagaaa

SEQ ID NO: 1172749 - RNA, 19 nt, Homo sapiens
ccagagaagcugacauugg

SEQ ID NO: 1172750 - RNA, 19 nt, Homo sapiens
guacuguuaugcugaagac

SEQ ID NO: 1172751 - RNA, 19 nt, Homo sapiens
cggaucagaccgugaggua

SEQ ID NO: 1172752 - RNA, 19 nt, Homo sapiens
caucagcacacccgaggaa

SEQ ID NO: 1172753 - RNA, 19 nt, Homo sapiens
gauggagagucagaagcuu

SEQ ID NO: 1172754 - RNA, 19 nt, Homo sapiens
auaugaagaugaagaagag

SEQ ID NO: 1172755 - RNA, 19 nt, Homo sapiens
uggaggaagaagagaaaua

SEQ ID NO: 1172756 - RNA, 19 nt, Homo sapiens
ucucagaagaggaagguaa

SEQ ID NO: 1172757 - RNA, 19 nt, Homo sapiens
cagagacccuggaggaacu

SEQ ID NO: 1172758 - RNA, 19 nt, Homo sapiens
ugaccucuaugauguguac

SEQ ID NO: 1172759 - RNA, 19 nt, Homo sapiens
agagaaagaggaggaagaa

SEQ ID NO: 1172760 - RNA, 19 nt, Homo sapiens
cggaggaggcgacaaacuu

SEQ ID NO: 1172761 - RNA, 19 nt, Homo sapiens
gaagcugacauuggaggaa

SEQ ID NO: 1172762 - RNA, 19 nt, Homo sapiens
aacaggacuucaucaacaa

SEQ ID NO: 1172763 - RNA, 19 nt, Homo sapiens
gagacccagugccggaugu

SEQ ID NO: 1172764 - RNA, 19 nt, Homo sapiens
gauguuggccuccgcuucu

SEQ ID NO: 1172765 - RNA, 19 nt, Homo sapiens
gaggaagaagagaaauaug

SEQ ID NO: 1172766 - RNA, 19 nt, Homo sapiens
ucaggaagccacagagagu

SEQ ID NO: 1172767 - RNA, 19 nt, Homo sapiens
gcucuaugccgccuaccuu

SEQ ID NO: 1172768 - RNA, 19 nt, Homo sapiens
uagaggcuaucgucacagu

SEQ ID NO: 1172769 - RNA, 19 nt, Homo sapiens
ggagcggggugcagagauu

SEQ ID NO: 1172770 - RNA, 19 nt, Homo sapiens
aggauggagugucuguaaa

SEQ ID NO: 1172771 - RNA, 19 nt, Homo sapiens
gcuggaaggcgcuguugau

SEQ ID NO: 1172772 - RNA, 19 nt, Homo sapiens
gcuucaacgucuacugcuu

SEQ ID NO: 1172773 - RNA, 19 nt, Homo sapiens
acuagaggcuaucgucaca

SEQ ID NO: 1172774 - RNA, 19 nt, Homo sapiens
cccagccucugauggacua

SEQ ID NO: 1172775 - RNA, 19 nt, Homo sapiens
ccggaugaccucuaugaug

SEQ ID NO: 1172776 - RNA, 19 nt, Homo sapiens
ccacaggaagugacaacau

SEQ ID NO: 1172777 - RNA, 19 nt, Homo sapiens
ugacgugcccugcaacuac

SEQ ID NO: 1172778 - RNA, 19 nt, Homo sapiens
caacgacaggaccaucgaa

SEQ ID NO: 1172779 - RNA, 19 nt, Homo sapiens
cugauggacuagaggcuau

SEQ ID NO: 1172780 - RNA, 19 nt, Homo sapiens
cugauccgaugccaagaga

SEQ ID NO: 1172781 - RNA, 19 nt, Homo sapiens
gcgcaucuggccagcauca

SEQ ID NO: 1172782 - RNA, 19 nt, Homo sapiens
gaagaugaagaagagaaag

SEQ ID NO: 1172783 - RNA, 19 nt, Homo sapiens
gacagagacccuggaggaa

SEQ ID NO: 1172784 - RNA, 19 nt, Homo sapiens
agacuggcuuccccaauaa

SEQ ID NO: 1172785 - RNA, 19 nt, Homo sapiens
cuguuaugcugaagaccua

SEQ ID NO: 1172786 - RNA, 19 nt, Homo sapiens
uggagugucuguaaaauca

SEQ ID NO: 1172787 - RNA, 19 nt, Homo sapiens
gaggaacaggacuucauca

SEQ ID NO: 1172788 - RNA, 19 nt, Homo sapiens
ccaccacgggccaacugua

SEQ ID NO: 1172789 - RNA, 19 nt, Homo sapiens
uguguacuguuaugcugaa

SEQ ID NO: 1172790 - RNA, 19 nt, Homo sapiens
ggauggagugucuguaaaa

SEQ ID NO: 1172791 - RNA, 19 nt, Homo sapiens
gauccgaugccaagagaac

SEQ ID NO: 1172792 - RNA, 19 nt, Homo sapiens
cuccagagaagcugacauu

SEQ ID NO: 1172793 - RNA, 19 nt, Homo sapiens
gggaaugggcuugcaggau

SEQ ID NO: 1172794 - RNA, 19 nt, Homo sapiens
guccuacaccugcaagaug

SEQ ID NO: 1172795 - RNA, 19 nt, Homo sapiens
cgaggaacaggacuucauc

SEQ ID NO: 1172796 - RNA, 19 nt, Homo sapiens
gaagggguccgcugccuau

SEQ ID NO: 1172797 - RNA, 19 nt, Homo sapiens
gcgacgcuguggaggucaa

SEQ ID NO: 1172798 - RNA, 19 nt, Homo sapiens
gagugcgcgucaaggugaa

SEQ ID NO: 1172799 - RNA, 19 nt, Homo sapiens
aagaugaagaagagaaaga

SEQ ID NO: 1172800 - RNA, 19 nt, Homo sapiens
ggaagccacagagagugaa

SEQ ID NO: 1172801 - RNA, 19 nt, Homo sapiens
caccacgggccaacuguau

SEQ ID NO: 1172802 - RNA, 19 nt, Homo sapiens
ccucuaugauguguacugu

SEQ ID NO: 1172803 - RNA, 19 nt, Homo sapiens
ggccggaguaaaucccuaa

SEQ ID NO: 1172804 - RNA, 19 nt, Homo sapiens
ggaguccaggugacaguuc

SEQ ID NO: 1172805 - RNA, 19 nt, Homo sapiens
agaggaggacccagaagga

SEQ ID NO: 1172806 - RNA, 19 nt, Homo sapiens
gaagcuuccaggccuccaa

SEQ ID NO: 1172807 - RNA, 19 nt, Homo sapiens
caaguacccugauagaguu

SEQ ID NO: 1172808 - RNA, 19 nt, Homo sapiens
gaacaggacgacagugaaa

SEQ ID NO: 1172809 - RNA, 19 nt, Homo sapiens
ggagaaagccagagaguca

SEQ ID NO: 1172810 - RNA, 19 nt, Homo sapiens
cauaaaggguugcacaaug

SEQ ID NO: 1172811 - RNA, 19 nt, Homo sapiens
ggagcgaauucacuugauu

SEQ ID NO: 1172812 - RNA, 19 nt, Homo sapiens
caaguucccuguccuuauc

SEQ ID NO: 1172813 - RNA, 19 nt, Homo sapiens
ugacaucgauagagacaug

SEQ ID NO: 1172814 - RNA, 19 nt, Homo sapiens
uuaccucccugucugcuua

SEQ ID NO: 1172815 - RNA, 19 nt, Homo sapiens
ugucucagcugaagaaugu

SEQ ID NO: 1172816 - RNA, 19 nt, Homo sapiens
uccagugucuccagaauaa

SEQ ID NO: 1172817 - RNA, 19 nt, Homo sapiens
aaagguggcuccuggugaa

SEQ ID NO: 1172818 - RNA, 19 nt, Homo sapiens
ccuaggaggucuuauucaa

SEQ ID NO: 1172819 - RNA, 19 nt, Homo sapiens
ucaaagccguggcaucugu

SEQ ID NO: 1172820 - RNA, 19 nt, Homo sapiens
auaaguuccuggccagaua

SEQ ID NO: 1172821 - RNA, 19 nt, Homo sapiens
gaaggcagaagccacaaga

SEQ ID NO: 1172822 - RNA, 19 nt, Homo sapiens
gagcugaggccaucugcaa

SEQ ID NO: 1172823 - RNA, 19 nt, Homo sapiens
ggagaucugcgacucaguu

SEQ ID NO: 1172824 - RNA, 19 nt, Homo sapiens
uccgacaccuggauagaua

SEQ ID NO: 1172825 - RNA, 19 nt, Homo sapiens
cuuugaagaugauaccaua

SEQ ID NO: 1172826 - RNA, 19 nt, Homo sapiens
ggauagauuccaugcaaga

SEQ ID NO: 1172827 - RNA, 19 nt, Homo sapiens
uccgagacauggagauuaa

SEQ ID NO: 1172828 - RNA, 19 nt, Homo sapiens
uaggaggucuuauucaaag

SEQ ID NO: 1172829 - RNA, 19 nt, Homo sapiens
ggcagagucuugugcuguu

SEQ ID NO: 1172830 - RNA, 19 nt, Homo sapiens
ucaaguacccugauagagu

SEQ ID NO: 1172831 - RNA, 19 nt, Homo sapiens
ggccuuuccucacucugua

SEQ ID NO: 1172832 - RNA, 19 nt, Homo sapiens
aaagaugugccuaucacua

SEQ ID NO: 1172833 - RNA, 19 nt, Homo sapiens
uggaggaugugaagggauu

SEQ ID NO: 1172834 - RNA, 19 nt, Homo sapiens
gaacacucuugacccuaca

SEQ ID NO: 1172835 - RNA, 19 nt, Homo sapiens
guccuuuccucaccaacua

SEQ ID NO: 1172836 - RNA, 19 nt, Homo sapiens
gggcuccuuuucuauauua

SEQ ID NO: 1172837 - RNA, 19 nt, Homo sapiens
cagaacaggacgacaguga

SEQ ID NO: 1172838 - RNA, 19 nt, Homo sapiens
gaucugcgacucaguugau

SEQ ID NO: 1172839 - RNA, 19 nt, Homo sapiens
ggucaaagccguggcaucu

SEQ ID NO: 1172840 - RNA, 19 nt, Homo sapiens
gaaaagaugugccuaucac

SEQ ID NO: 1172841 - RNA, 19 nt, Homo sapiens
guacccugauagaguuaaa

SEQ ID NO: 1172842 - RNA, 19 nt, Homo sapiens
ccaucagucucugcaguuu

SEQ ID NO: 1172843 - RNA, 19 nt, Homo sapiens
gcuccugccugcuccuuca

SEQ ID NO: 1172844 - RNA, 19 nt, Homo sapiens
uagauuccaugcaagaaca

SEQ ID NO: 1172845 - RNA, 19 nt, Homo sapiens
gggcugaggaugaguuugu

SEQ ID NO: 1172846 - RNA, 19 nt, Homo sapiens
ggggauagauuccaugcaa

SEQ ID NO: 1172847 - RNA, 19 nt, Homo sapiens
cguggcaucuguccuagga

SEQ ID NO: 1172848 - RNA, 19 nt, Homo sapiens
gcccuaugcuggagcgaau

SEQ ID NO: 1172849 - RNA, 19 nt, Homo sapiens
caagccacauucacucucu

SEQ ID NO: 1172850 - RNA, 19 nt, Homo sapiens
uaacuccuggugcuuugua

SEQ ID NO: 1172851 - RNA, 19 nt, Homo sapiens
gcuggaccauggugauaca

SEQ ID NO: 1172852 - RNA, 19 nt, Homo sapiens
auaaaggguugcacaaugc

SEQ ID NO: 1172853 - RNA, 19 nt, Homo sapiens
gcagagucuugugcuguuc

SEQ ID NO: 1172854 - RNA, 19 nt, Homo sapiens
gaugugccuaucacuauga

SEQ ID NO: 1172855 - RNA, 19 nt, Homo sapiens
ggccacuucuuacucaauc

SEQ ID NO: 1172856 - RNA, 19 nt, Homo sapiens
gaggaugaguuugugacau

SEQ ID NO: 1172857 - RNA, 19 nt, Homo sapiens
guuccuggccagauaugua

SEQ ID NO: 1172858 - RNA, 19 nt, Homo sapiens
cuaggaggucuuauucaaa

SEQ ID NO: 1172859 - RNA, 19 nt, Homo sapiens
gaggagaaagccagagagu

SEQ ID NO: 1172860 - RNA, 19 nt, Homo sapiens
aagaugugccuaucacuau

SEQ ID NO: 1172861 - RNA, 19 nt, Homo sapiens
gggcacaguuugggaggau

SEQ ID NO: 1172862 - RNA, 19 nt, Homo sapiens
gaagcucaaggccagcauu

SEQ ID NO: 1172863 - RNA, 19 nt, Homo sapiens
gcacaccuucgaucugcuu

SEQ ID NO: 1172864 - RNA, 19 nt, Homo sapiens
gauagauuccaugcaagaa

SEQ ID NO: 1172865 - RNA, 19 nt, Homo sapiens
ccacauucacucucucugu

SEQ ID NO: 1172866 - RNA, 19 nt, Homo sapiens
gcacaaugccacccaucca

SEQ ID NO: 1172867 - RNA, 19 nt, Homo sapiens
gaaucccaguggugagaca

SEQ ID NO: 1172868 - RNA, 19 nt, Homo sapiens
ccacugcaacgcacagaau

SEQ ID NO: 1172869 - RNA, 19 nt, Homo sapiens
gcacacugcacaccuucga

SEQ ID NO: 1172870 - RNA, 19 nt, Homo sapiens
gugaagagaggguggaaag

SEQ ID NO: 1172871 - RNA, 19 nt, Homo sapiens
uugcacacuugauuugcua

SEQ ID NO: 1172872 - RNA, 19 nt, Homo sapiens
gaacaccuuccuccuccau

SEQ ID NO: 1172873 - RNA, 19 nt, Homo sapiens
ccaggauccuccagugucu

SEQ ID NO: 1172874 - RNA, 19 nt, Homo sapiens
uuugugacaucgauagaga

SEQ ID NO: 1172875 - RNA, 19 nt, Homo sapiens
cacaaguucccuguccuua

SEQ ID NO: 1172876 - RNA, 19 nt, Homo sapiens
gcuguuguccugccugugu

SEQ ID NO: 1172877 - RNA, 19 nt, Homo sapiens
ccaugucucagcugaagaa

SEQ ID NO: 1172878 - RNA, 19 nt, Homo sapiens
ggaggagaucugcgacuca

SEQ ID NO: 1172879 - RNA, 19 nt, Homo sapiens
uccauuggcuguucuucga

SEQ ID NO: 1172880 - RNA, 19 nt, Homo sapiens
gcacaguuugggaggauuc

SEQ ID NO: 1172881 - RNA, 19 nt, Homo sapiens
cauauguaguauagagcaa

SEQ ID NO: 1172882 - RNA, 19 nt, Homo sapiens
ccuggccacuucuuacuca

SEQ ID NO: 1172883 - RNA, 19 nt, Homo sapiens
ccacaaguucccuguccuu

SEQ ID NO: 1172884 - RNA, 19 nt, Homo sapiens
cucaagugcuuccuuccuu

SEQ ID NO: 1172885 - RNA, 19 nt, Homo sapiens
gccaaguguuacccagaug

SEQ ID NO: 1172886 - RNA, 19 nt, Homo sapiens
ugaagaggaagaggagaaa

SEQ ID NO: 1172887 - RNA, 19 nt, Homo sapiens
gagaucugcgacucaguug

SEQ ID NO: 1172888 - RNA, 19 nt, Homo sapiens
ggugagacagcauucaaag

SEQ ID NO: 1172889 - RNA, 19 nt, Homo sapiens
acucuugacccuacacuga

SEQ ID NO: 1172890 - RNA, 19 nt, Homo sapiens
guccgagacauggagauua

SEQ ID NO: 1172891 - RNA, 19 nt, Homo sapiens
gauuccuggccacuucuua

SEQ ID NO: 1172892 - RNA, 19 nt, Homo sapiens
gagccuccagccacaaguu

SEQ ID NO: 1172893 - RNA, 19 nt, Homo sapiens
gcuuguugcacacuugauu

SEQ ID NO: 1172894 - RNA, 19 nt, Homo sapiens
ggacgacagugaaaagaac

SEQ ID NO: 1172895 - RNA, 19 nt, Homo sapiens
uguuuacuauggccgauga

SEQ ID NO: 1172896 - RNA, 19 nt, Homo sapiens
ucccaaaccagaauaagau

SEQ ID NO: 1172897 - RNA, 19 nt, Homo sapiens
ccuaggacguuccaaucca

SEQ ID NO: 1172898 - RNA, 19 nt, Homo sapiens
acaaguucccuguccuuau

SEQ ID NO: 1172899 - RNA, 19 nt, Homo sapiens
gcuggagacaggcaccauu

SEQ ID NO: 1172900 - RNA, 19 nt, Homo sapiens
uccagggucugcuuaacug

SEQ ID NO: 1172901 - RNA, 19 nt, Homo sapiens
gaugguggaggaugugaag

SEQ ID NO: 1172902 - RNA, 19 nt, Homo sapiens
agaugugccuaucacuaug

SEQ ID NO: 1172903 - RNA, 19 nt, Homo sapiens
ccuccagugucuccagaau

SEQ ID NO: 1172904 - RNA, 19 nt, Homo sapiens
cagaaucccaguggugaga

SEQ ID NO: 1172905 - RNA, 19 nt, Homo sapiens
uauuaacuccuggugcuuu

SEQ ID NO: 1172906 - RNA, 19 nt, Homo sapiens
uauguaguauagagcaaag

SEQ ID NO: 1172907 - RNA, 19 nt, Homo sapiens
gagaagaacuggagcuaga

SEQ ID NO: 1172908 - RNA, 19 nt, Homo sapiens
gggaaugcauccuauaauu

SEQ ID NO: 1172909 - RNA, 19 nt, Homo sapiens
cggagaagcucaucgacua

SEQ ID NO: 1172910 - RNA, 19 nt, Homo sapiens
uggcagugaucgaguauaa

SEQ ID NO: 1172911 - RNA, 19 nt, Homo sapiens
cugcagcccuuaaucagua

SEQ ID NO: 1172912 - RNA, 19 nt, Homo sapiens
ccaaagcuguuucaaguac

SEQ ID NO: 1172913 - RNA, 19 nt, Homo sapiens
gaugagugcuugggauuuc

SEQ ID NO: 1172914 - RNA, 19 nt, Homo sapiens
uaccugagauaguaaauuc

SEQ ID NO: 1172915 - RNA, 19 nt, Homo sapiens
ggcagaaguuggaaacaug

SEQ ID NO: 1172916 - RNA, 19 nt, Homo sapiens
guaaauucauggcuuaugc

SEQ ID NO: 1172917 - RNA, 19 nt, Homo sapiens
ucccaaagcuguuucaagu

SEQ ID NO: 1172918 - RNA, 19 nt, Homo sapiens
gcucaaacaccagggauuu

SEQ ID NO: 1172919 - RNA, 19 nt, Homo sapiens
gaucgaguauaaagggaau

SEQ ID NO: 1172920 - RNA, 19 nt, Homo sapiens
gaaagauuacuuccugaca

SEQ ID NO: 1172921 - RNA, 19 nt, Homo sapiens
gcagugaucgaguauaaag

SEQ ID NO: 1172922 - RNA, 19 nt, Homo sapiens
gggcagaaguuggaaacau

SEQ ID NO: 1172923 - RNA, 19 nt, Homo sapiens
cagucuaccugagauagua

SEQ ID NO: 1172924 - RNA, 19 nt, Homo sapiens
ccagaugacccucucuuug

SEQ ID NO: 1172925 - RNA, 19 nt, Homo sapiens
ucaaacaccagggauuuaa

SEQ ID NO: 1172926 - RNA, 19 nt, Homo sapiens
gggagacacuaacgaacga

SEQ ID NO: 1172927 - RNA, 19 nt, Homo sapiens
gagaugagugcuugggauu

SEQ ID NO: 1172928 - RNA, 19 nt, Homo sapiens
acacaagaaugcugcagau

SEQ ID NO: 1172929 - RNA, 19 nt, Homo sapiens
gaacuggagcuagagaugu

SEQ ID NO: 1172930 - RNA, 19 nt, Homo sapiens
gaagaacuggagcuagaga

SEQ ID NO: 1172931 - RNA, 19 nt, Homo sapiens
ucacagagaaggauuugau

SEQ ID NO: 1172932 - RNA, 19 nt, Homo sapiens
uuugacaucuggucuccua

SEQ ID NO: 1172933 - RNA, 19 nt, Homo sapiens
ugccagaggugguuguguu

SEQ ID NO: 1172934 - RNA, 19 nt, Homo sapiens
aacuggagcuagagaugua

SEQ ID NO: 1172935 - RNA, 19 nt, Homo sapiens
ucucuuugcacaauagaua

SEQ ID NO: 1172936 - RNA, 19 nt, Homo sapiens
ccuauaauuccaaauguug

SEQ ID NO: 1172937 - RNA, 19 nt, Homo sapiens
ggagaagcucaucgacuau

SEQ ID NO: 1172938 - RNA, 19 nt, Homo sapiens
agauggcagugaucgagua

SEQ ID NO: 1172939 - RNA, 19 nt, Homo sapiens
gacccucucuuugcacaau

SEQ ID NO: 1172940 - RNA, 19 nt, Homo sapiens
cauccuauaauuccaaaug

SEQ ID NO: 1172941 - RNA, 19 nt, Homo sapiens
guccuuaaauuuggguuau

SEQ ID NO: 1172942 - RNA, 19 nt, Homo sapiens
gcugggagacacuaacgaa

SEQ ID NO: 1172943 - RNA, 19 nt, Homo sapiens
gaagagucugcagcccuua

SEQ ID NO: 1172944 - RNA, 19 nt, Homo sapiens
gaaugcugcagaucccaaa

SEQ ID NO: 1172945 - RNA, 19 nt, Homo sapiens
ggaagcugggagacacuaa

SEQ ID NO: 1172946 - RNA, 19 nt, Homo sapiens
gagaagcucaucgacuaug

SEQ ID NO: 1172947 - RNA, 19 nt, Homo sapiens
cuucugguccuuaaauuug

SEQ ID NO: 1172948 - RNA, 19 nt, Homo sapiens
gcuucugguccuuaaauuu

SEQ ID NO: 1172949 - RNA, 19 nt, Homo sapiens
gccagaugacccucucuuu

SEQ ID NO: 1172950 - RNA, 19 nt, Homo sapiens
ggcaggaccucaggcaaag

SEQ ID NO: 1172951 - RNA, 19 nt, Homo sapiens
gcagagacagccaccuuac

SEQ ID NO: 1172952 - RNA, 19 nt, Homo sapiens
gcuugggauuucuuagaga

SEQ ID NO: 1172953 - RNA, 19 nt, Homo sapiens
cggcaggaccucaggcaaa

SEQ ID NO: 1172954 - RNA, 19 nt, Homo sapiens
auucauggcuuaugcuucu

SEQ ID NO: 1172955 - RNA, 19 nt, Homo sapiens
cagaugacccucucuuugc

SEQ ID NO: 1172956 - RNA, 19 nt, Homo sapiens
gguccuuaaauuuggguua

SEQ ID NO: 1172957 - RNA, 19 nt, Homo sapiens
gauguaaaauggacagucu

SEQ ID NO: 1172958 - RNA, 19 nt, Homo sapiens
gugcuugggauuucuuaga

SEQ ID NO: 1172959 - RNA, 19 nt, Homo sapiens
ccgcguauuucgccguaug

SEQ ID NO: 1172960 - RNA, 19 nt, Homo sapiens
gccagaggugguuguguuu

SEQ ID NO: 1172961 - RNA, 19 nt, Homo sapiens
gacaucuggucuccuagag

SEQ ID NO: 1172962 - RNA, 19 nt, Homo sapiens
caugggaaugcauccuaua

SEQ ID NO: 1172963 - RNA, 19 nt, Homo sapiens
acaugggaaugcauccuau

SEQ ID NO: 1172964 - RNA, 19 nt, Homo sapiens
gcucacagagaaggauuug

SEQ ID NO: 1172965 - RNA, 19 nt, Homo sapiens
ugacaucuggucuccuaga

SEQ ID NO: 1172966 - RNA, 19 nt, Homo sapiens
cuuaaugccaguuuacaug

SEQ ID NO: 1172967 - RNA, 19 nt, Homo sapiens
aaagcuguuucaaguacug

SEQ ID NO: 1172968 - RNA, 19 nt, Homo sapiens
cgcagagacagccaccuua

SEQ ID NO: 1172969 - RNA, 19 nt, Homo sapiens
caaagcuguuucaaguacu

SEQ ID NO: 1172970 - RNA, 19 nt, Homo sapiens
uuaugcuucugguccuuaa

SEQ ID NO: 1172971 - RNA, 19 nt, Homo sapiens
gagugcuugggauuucuua

SEQ ID NO: 1172972 - RNA, 19 nt, Homo sapiens
agaugacccucucuuugca

SEQ ID NO: 1172973 - RNA, 19 nt, Homo sapiens
caaccacagcucccacaca

SEQ ID NO: 1172974 - RNA, 19 nt, Homo sapiens
cccaaagcuguuucaagua

SEQ ID NO: 1172975 - RNA, 19 nt, Homo sapiens
ucuggagaaugagaauuau

SEQ ID NO: 1172976 - RNA, 19 nt, Homo sapiens
gaacuuagcuccuuuaaca

SEQ ID NO: 1172977 - RNA, 19 nt, Homo sapiens
guaaacaacugguucauca

SEQ ID NO: 1172978 - RNA, 19 nt, Homo sapiens
ccaagaagaucaagucuca

SEQ ID NO: 1172979 - RNA, 19 nt, Homo sapiens
gauaagaaguccaagaaca

SEQ ID NO: 1172980 - RNA, 19 nt, Homo sapiens
gaacaaacgaggagucuug

SEQ ID NO: 1172981 - RNA, 19 nt, Homo sapiens
ggaaggacuugaguuguuu

SEQ ID NO: 1172982 - RNA, 19 nt, Homo sapiens
gaagaaacauuggaaagca

SEQ ID NO: 1172983 - RNA, 19 nt, Homo sapiens
gaucuggacucaccaaauc

SEQ ID NO: 1172984 - RNA, 19 nt, Homo sapiens
gaaggcagaagaaacauug

SEQ ID NO: 1172985 - RNA, 19 nt, Homo sapiens
ucacagaacuuagcuccuu

SEQ ID NO: 1172986 - RNA, 19 nt, Homo sapiens
ucaaugaacucugcaagga

SEQ ID NO: 1172987 - RNA, 19 nt, Homo sapiens
ccaaaucccugaggacaga

SEQ ID NO: 1172988 - RNA, 19 nt, Homo sapiens
ggacagaagaagaggauga

SEQ ID NO: 1172989 - RNA, 19 nt, Homo sapiens
cggaaggacuugaguuguu

SEQ ID NO: 1172990 - RNA, 19 nt, Homo sapiens
gcaaugugcagugggauaa

SEQ ID NO: 1172991 - RNA, 19 nt, Homo sapiens
uuacaucaccugcuucaaa

SEQ ID NO: 1172992 - RNA, 19 nt, Homo sapiens
ggacgugcaguuucauuug

SEQ ID NO: 1172993 - RNA, 19 nt, Homo sapiens
uaauggacgugcaguuuca

SEQ ID NO: 1172994 - RNA, 19 nt, Homo sapiens
ccaucaauauccuaaaugu

SEQ ID NO: 1172995 - RNA, 19 nt, Homo sapiens
gcagaagaaacauuggaaa

SEQ ID NO: 1172996 - RNA, 19 nt, Homo sapiens
aagcaugccaccaauauaa

SEQ ID NO: 1172997 - RNA, 19 nt, Homo sapiens
caggacagcccacagauga

SEQ ID NO: 1172998 - RNA, 19 nt, Homo sapiens
ggaugaggaugagauggaa

SEQ ID NO: 1172999 - RNA, 19 nt, Homo sapiens
uaugauggcugcacacgau

SEQ ID NO: 1173000 - RNA, 19 nt, Homo sapiens
gaaggacuugaguuguuua

SEQ ID NO: 1173001 - RNA, 19 nt, Homo sapiens
gcaaaggagacaccuguuc

SEQ ID NO: 1173002 - RNA, 19 nt, Homo sapiens
ugacgcugcuguuugagaa

SEQ ID NO: 1173003 - RNA, 19 nt, Homo sapiens
ccaaaagagcugauauuua

SEQ ID NO: 1173004 - RNA, 19 nt, Homo sapiens
ccacagcccuggaggaacu

SEQ ID NO: 1173005 - RNA, 19 nt, Homo sapiens
ccaaaucaguagcuugaag

SEQ ID NO: 1173006 - RNA, 19 nt, Homo sapiens
ugugucagguggagccuua

SEQ ID NO: 1173007 - RNA, 19 nt, Homo sapiens
gcaaaaggauggucacucu

SEQ ID NO: 1173008 - RNA, 19 nt, Homo sapiens
ccagcuuccuuucuucauu

SEQ ID NO: 1173009 - RNA, 19 nt, Homo sapiens
ccaagcaugccaccaauau

SEQ ID NO: 1173010 - RNA, 19 nt, Homo sapiens
agauggcacugaucacuga

SEQ ID NO: 1173011 - RNA, 19 nt, Homo sapiens
caaagauucuggcccaacu

SEQ ID NO: 1173012 - RNA, 19 nt, Homo sapiens
caagcaugccaccaauaua

SEQ ID NO: 1173013 - RNA, 19 nt, Homo sapiens
guauacaggcacccucuuu

SEQ ID NO: 1173014 - RNA, 19 nt, Homo sapiens
caaaucaguagcuugaaga

SEQ ID NO: 1173015 - RNA, 19 nt, Homo sapiens
gaccugggcuuggaacaca

SEQ ID NO: 1173016 - RNA, 19 nt, Homo sapiens
aagaagaggaugaggauga

SEQ ID NO: 1173017 - RNA, 19 nt, Homo sapiens
ccaauauaaugcguucuug

SEQ ID NO: 1173018 - RNA, 19 nt, Homo sapiens
gacgugcaguuucauuugu

SEQ ID NO: 1173019 - RNA, 19 nt, Homo sapiens
ggaaggcagaagaaacauu

SEQ ID NO: 1173020 - RNA, 19 nt, Homo sapiens
ccugaggcaucacaucuug

SEQ ID NO: 1173021 - RNA, 19 nt, Homo sapiens
gaacugccgaggacucugu

SEQ ID NO: 1173022 - RNA, 19 nt, Homo sapiens
ggacaaugaggauaagaag

SEQ ID NO: 1173023 - RNA, 19 nt, Homo sapiens
cuucagcgaugacccagaa

SEQ ID NO: 1173024 - RNA, 19 nt, Homo sapiens
gagcacaaacccuucuuca

SEQ ID NO: 1173025 - RNA, 19 nt, Homo sapiens
uaagaaguccaagaacaaa

SEQ ID NO: 1173026 - RNA, 19 nt, Homo sapiens
ccaucaaccuucacucaca

SEQ ID NO: 1173027 - RNA, 19 nt, Homo sapiens
ggagaaagucaaugaacuc

SEQ ID NO: 1173028 - RNA, 19 nt, Homo sapiens
cagcuuccuuucuucauuc

SEQ ID NO: 1173029 - RNA, 19 nt, Homo sapiens
cagguuaucugggaaucuu

SEQ ID NO: 1173030 - RNA, 19 nt, Homo sapiens
uaggugaucacagaacuua

SEQ ID NO: 1173031 - RNA, 19 nt, Homo sapiens
gcacagcaaccauggacau

SEQ ID NO: 1173032 - RNA, 19 nt, Homo sapiens
ucccugaaaugaauguauu

SEQ ID NO: 1173033 - RNA, 19 nt, Homo sapiens
gucccuaggugaucacaga

SEQ ID NO: 1173034 - RNA, 19 nt, Homo sapiens
uggacaaucugauggugaa

SEQ ID NO: 1173035 - RNA, 19 nt, Homo sapiens
ggaaagacaggagugagau

SEQ ID NO: 1173036 - RNA, 19 nt, Homo sapiens
ucaccucccuccuggacaa

SEQ ID NO: 1173037 - RNA, 19 nt, Homo sapiens
cgaggucucccugaaauga

SEQ ID NO: 1173038 - RNA, 19 nt, Homo sapiens
cacagaacuuagcuccuuu

SEQ ID NO: 1173039 - RNA, 19 nt, Homo sapiens
caucaccuccgccagcuuu

SEQ ID NO: 1173040 - RNA, 19 nt, Homo sapiens
aaacaacugguucaucaau

SEQ ID NO: 1173041 - RNA, 19 nt, Homo sapiens
caaguaaacaacugguuca

SEQ ID NO: 1173042 - RNA, 19 nt, Homo sapiens
gaggauaagaaguccaaga

SEQ ID NO: 1173043 - RNA, 19 nt, Homo sapiens
gaucagaaugggauggaau

SEQ ID NO: 1173044 - RNA, 19 nt, Homo sapiens
gcaggaacaggagcacaaa

SEQ ID NO: 1173045 - RNA, 19 nt, Homo sapiens
gagcugcagacgacaaaug

SEQ ID NO: 1173046 - RNA, 19 nt, Homo sapiens
gcuccacgcccuccauaga

SEQ ID NO: 1173047 - RNA, 19 nt, Homo sapiens
uuucucagcuccuuugaca

SEQ ID NO: 1173048 - RNA, 19 nt, Homo sapiens
gaaagacaggagugagauc

SEQ ID NO: 1173049 - RNA, 19 nt, Homo sapiens
gcccaagcaugccaccaau

SEQ ID NO: 1173050 - RNA, 19 nt, Homo sapiens
uaaucugggugauccaauc

SEQ ID NO: 1173051 - RNA, 19 nt, Homo sapiens
uaacaacaggacaaugguu

SEQ ID NO: 1173052 - RNA, 19 nt, Homo sapiens
caaccucacccuccugcaa

SEQ ID NO: 1173053 - RNA, 19 nt, Homo sapiens
gcaugccaccaauauaaug

SEQ ID NO: 1173054 - RNA, 19 nt, Homo sapiens
ccaaccagcccuccaucaa

SEQ ID NO: 1173055 - RNA, 19 nt, Homo sapiens
ccaccaggcuccagcucau

SEQ ID NO: 1173056 - RNA, 19 nt, Homo sapiens
acaaugaggauaagaaguc

SEQ ID NO: 1173057 - RNA, 19 nt, Homo sapiens
ccagggagccauccagauc

SEQ ID NO: 1173058 - RNA, 19 nt, Homo sapiens
ucucagcuccuuugacaga

SEQ ID NO: 1173059 - RNA, 19 nt, Homo sapiens
ccaaagccaagaagaucaa

SEQ ID NO: 1173060 - RNA, 19 nt, Homo sapiens
auaagaaguccaagaacaa

SEQ ID NO: 1173061 - RNA, 19 nt, Homo sapiens
cgugcaguuucauuuguaa

SEQ ID NO: 1173062 - RNA, 19 nt, Homo sapiens
cagaagaaacauuggaaag

SEQ ID NO: 1173063 - RNA, 19 nt, Homo sapiens
gaaguuucucagcuccuuu

SEQ ID NO: 1173064 - RNA, 19 nt, Homo sapiens
gaugauggccacgcagaau

SEQ ID NO: 1173065 - RNA, 19 nt, Homo sapiens
ccacggaggaugagaagag

SEQ ID NO: 1173066 - RNA, 19 nt, Homo sapiens
ucccaucaauauccuaaau

SEQ ID NO: 1173067 - RNA, 19 nt, Homo sapiens
cgagcagccuguguggaaa

SEQ ID NO: 1173068 - RNA, 19 nt, Homo sapiens
aucaguagcuugaagaaag

SEQ ID NO: 1173069 - RNA, 19 nt, Homo sapiens
acagaacuuagcuccuuua

SEQ ID NO: 1173070 - RNA, 19 nt, Homo sapiens
cauauggaggugacuuuga

SEQ ID NO: 1173071 - RNA, 19 nt, Homo sapiens
ggaagcaccgagggaguug

SEQ ID NO: 1173072 - RNA, 19 nt, Homo sapiens
aggauaagaaguccaagaa

SEQ ID NO: 1173073 - RNA, 19 nt, Homo sapiens
ggcagaagaaacauuggaa

SEQ ID NO: 1173074 - RNA, 19 nt, Homo sapiens
uggagaaagucaaugaacu

SEQ ID NO: 1173075 - RNA, 19 nt, Homo sapiens
agaagaagaggaugaggau

SEQ ID NO: 1173076 - RNA, 19 nt, Homo sapiens
gaacugauuuguuugguuu

SEQ ID NO: 1173077 - RNA, 19 nt, Homo sapiens
gaaacagagucaaauguaa

SEQ ID NO: 1173078 - RNA, 19 nt, Homo sapiens
gagaauaccuagcuacuau

SEQ ID NO: 1173079 - RNA, 19 nt, Homo sapiens
ggagcagaauguaguauuu

SEQ ID NO: 1173080 - RNA, 19 nt, Homo sapiens
acaaaugacuugaccuuaa

SEQ ID NO: 1173081 - RNA, 19 nt, Homo sapiens
gaaccguccucaaaugaaa

SEQ ID NO: 1173082 - RNA, 19 nt, Homo sapiens
gaaagaagaggauaggauu

SEQ ID NO: 1173083 - RNA, 19 nt, Homo sapiens
ugacuugaccuuaauguua

SEQ ID NO: 1173084 - RNA, 19 nt, Homo sapiens
ccagaaagccugcagaauu

SEQ ID NO: 1173085 - RNA, 19 nt, Homo sapiens
cagaaagccugcagaauuc

SEQ ID NO: 1173086 - RNA, 19 nt, Homo sapiens
caaaugacuugaccuuaau

SEQ ID NO: 1173087 - RNA, 19 nt, Homo sapiens
gaacucuggacuuaacuua

SEQ ID NO: 1173088 - RNA, 19 nt, Homo sapiens
uaauaucccuuguuccauu

SEQ ID NO: 1173089 - RNA, 19 nt, Homo sapiens
gaaaggagcagaauguagu

SEQ ID NO: 1173090 - RNA, 19 nt, Homo sapiens
gaagagaugggaaaccaaa

SEQ ID NO: 1173091 - RNA, 19 nt, Homo sapiens
gaagcauucuguuauuugu

SEQ ID NO: 1173092 - RNA, 19 nt, Homo sapiens
gcaaagaagagaugggaaa

SEQ ID NO: 1173093 - RNA, 19 nt, Homo sapiens
ggagaacucuggacuuaac

SEQ ID NO: 1173094 - RNA, 19 nt, Homo sapiens
gauuuaauaucccuuguuc

SEQ ID NO: 1173095 - RNA, 19 nt, Homo sapiens
uuucagaguugcauaguaa

SEQ ID NO: 1173096 - RNA, 19 nt, Homo sapiens
ggaggcagacuugauauuu

SEQ ID NO: 1173097 - RNA, 19 nt, Homo sapiens
ggauggacccuugguauaa

SEQ ID NO: 1173098 - RNA, 19 nt, Homo sapiens
caagacauuuguagacuca

SEQ ID NO: 1173099 - RNA, 19 nt, Homo sapiens
gaauuaaugagcagaaaga

SEQ ID NO: 1173100 - RNA, 19 nt, Homo sapiens
gacuugaccuuaauguuau

SEQ ID NO: 1173101 - RNA, 19 nt, Homo sapiens
gauggacccuugguauaaa

SEQ ID NO: 1173102 - RNA, 19 nt, Homo sapiens
caaaugaaacccaguggaa

SEQ ID NO: 1173103 - RNA, 19 nt, Homo sapiens
ugaaacagagucaaaugua

SEQ ID NO: 1173104 - RNA, 19 nt, Homo sapiens
agaaagagaggauugguaa

SEQ ID NO: 1173105 - RNA, 19 nt, Homo sapiens
ucucuggguugauaauaua

SEQ ID NO: 1173106 - RNA, 19 nt, Homo sapiens
gaggcagacuugauauuuc

SEQ ID NO: 1173107 - RNA, 19 nt, Homo sapiens
aaaaggagguugaaaauuc

SEQ ID NO: 1173108 - RNA, 19 nt, Homo sapiens
guggaggaguggaauauug

SEQ ID NO: 1173109 - RNA, 19 nt, Homo sapiens
gcauagagaaagcaaaguu

SEQ ID NO: 1173110 - RNA, 19 nt, Homo sapiens
gaaaggggcuccggaaaau

SEQ ID NO: 1173111 - RNA, 19 nt, Homo sapiens
ucagccaugucauucuuua

SEQ ID NO: 1173112 - RNA, 19 nt, Homo sapiens
ucucguacuuucuuucuuu

SEQ ID NO: 1173113 - RNA, 19 nt, Homo sapiens
uuggagaacucuggacuua

SEQ ID NO: 1173114 - RNA, 19 nt, Homo sapiens
ggaacgguguaccuuucua

SEQ ID NO: 1173115 - RNA, 19 nt, Homo sapiens
gaauguaguauuuggaaga

SEQ ID NO: 1173116 - RNA, 19 nt, Homo sapiens
uggagucaaugauagauuu

SEQ ID NO: 1173117 - RNA, 19 nt, Homo sapiens
gaagaaaacgcuccagaaa

SEQ ID NO: 1173118 - RNA, 19 nt, Homo sapiens
gacuugauauuucagaguu

SEQ ID NO: 1173119 - RNA, 19 nt, Homo sapiens
caccacacccggcuaauuu

SEQ ID NO: 1173120 - RNA, 19 nt, Homo sapiens
gauuugacccgccuguuaa

SEQ ID NO: 1173121 - RNA, 19 nt, Homo sapiens
guucaccucuucugucguu

SEQ ID NO: 1173122 - RNA, 19 nt, Homo sapiens
aaagaaaggagcagaaugu

SEQ ID NO: 1173123 - RNA, 19 nt, Homo sapiens
ugacaguuguuuauaaugg

SEQ ID NO: 1173124 - RNA, 19 nt, Homo sapiens
guaaaugccuaugaagagu

SEQ ID NO: 1173125 - RNA, 19 nt, Homo sapiens
gugcagcgcuuaguucugu

SEQ ID NO: 1173126 - RNA, 19 nt, Homo sapiens
cuaccaugcugcccuugua

SEQ ID NO: 1173127 - RNA, 19 nt, Homo sapiens
gcaggaacgguguaccuuu

SEQ ID NO: 1173128 - RNA, 19 nt, Homo sapiens
ucauagauuucucaacaga

SEQ ID NO: 1173129 - RNA, 19 nt, Homo sapiens
gagcagaaagagaggauug

SEQ ID NO: 1173130 - RNA, 19 nt, Homo sapiens
uguaguauuuggaagauga

SEQ ID NO: 1173131 - RNA, 19 nt, Homo sapiens
guacagacaugagcuacca

SEQ ID NO: 1173132 - RNA, 19 nt, Homo sapiens
ccagugagcuucucguacu

SEQ ID NO: 1173133 - RNA, 19 nt, Homo sapiens
caaauguuggaaagucuua

SEQ ID NO: 1173134 - RNA, 19 nt, Homo sapiens
aaacugaaacagagucaaa

SEQ ID NO: 1173135 - RNA, 19 nt, Homo sapiens
ccagagugcuucaagacau

SEQ ID NO: 1173136 - RNA, 19 nt, Homo sapiens
caaauguaaaugccuauga

SEQ ID NO: 1173137 - RNA, 19 nt, Homo sapiens
guaaagaaccacucagcau

SEQ ID NO: 1173138 - RNA, 19 nt, Homo sapiens
cagagugcuucaagacauu

SEQ ID NO: 1173139 - RNA, 19 nt, Homo sapiens
ggaguggaauauugagaag

SEQ ID NO: 1173140 - RNA, 19 nt, Homo sapiens
guacauuuccugguucuga

SEQ ID NO: 1173141 - RNA, 19 nt, Homo sapiens
caggaacgguguaccuuuc

SEQ ID NO: 1173142 - RNA, 19 nt, Homo sapiens
uagcugggauuauggacaa

SEQ ID NO: 1173143 - RNA, 19 nt, Homo sapiens
gaagauaaagaggaugaga

SEQ ID NO: 1173144 - RNA, 19 nt, Homo sapiens
ggauuggaguguggcauug

SEQ ID NO: 1173145 - RNA, 19 nt, Homo sapiens
agaguguccuucuggaauu

SEQ ID NO: 1173146 - RNA, 19 nt, Homo sapiens
gccaugucauucuuuaaau

SEQ ID NO: 1173147 - RNA, 19 nt, Homo sapiens
uaaauucagcaacgccuaa

SEQ ID NO: 1173148 - RNA, 19 nt, Homo sapiens
gacaguuguuuauaaugga

SEQ ID NO: 1173149 - RNA, 19 nt, Homo sapiens
cugaguagcugggauuaug

SEQ ID NO: 1173150 - RNA, 19 nt, Homo sapiens
cuaccugucugauauaaac

SEQ ID NO: 1173151 - RNA, 19 nt, Homo sapiens
agauguacauuuccugguu

SEQ ID NO: 1173152 - RNA, 19 nt, Homo sapiens
gagcagaauguaguauuug

SEQ ID NO: 1173153 - RNA, 19 nt, Homo sapiens
agauuugacccgccuguua

SEQ ID NO: 1173154 - RNA, 19 nt, Homo sapiens
cauagagaaagcaaaguuu

SEQ ID NO: 1173155 - RNA, 19 nt, Homo sapiens
uauuuaugguggcacauuu

SEQ ID NO: 1173156 - RNA, 19 nt, Homo sapiens
uuuccuaccugucugauau

SEQ ID NO: 1173157 - RNA, 19 nt, Homo sapiens
ggaaaggggcuccggaaaa

SEQ ID NO: 1173158 - RNA, 19 nt, Homo sapiens
cagaaagagaggauuggua

SEQ ID NO: 1173159 - RNA, 19 nt, Homo sapiens
gagcuucucguacuuucuu

SEQ ID NO: 1173160 - RNA, 19 nt, Homo sapiens
gaaugugcagcgcuuaguu

SEQ ID NO: 1173161 - RNA, 19 nt, Homo sapiens
agaaaacgcuccagaaaag

SEQ ID NO: 1173162 - RNA, 19 nt, Homo sapiens
auagauuucucaacagaug

SEQ ID NO: 1173163 - RNA, 19 nt, Homo sapiens
acaggaagauaaagaggau

SEQ ID NO: 1173164 - RNA, 19 nt, Homo sapiens
uaaacuuucucuggguuga

SEQ ID NO: 1173165 - RNA, 19 nt, Homo sapiens
ggaguacagacaugagcua

SEQ ID NO: 1173166 - RNA, 19 nt, Homo sapiens
acauguaacuugccagagu

SEQ ID NO: 1173167 - RNA, 19 nt, Homo sapiens
aggcagacuugauauuuca

SEQ ID NO: 1173168 - RNA, 19 nt, Homo sapiens
gaacuccuggccucauaug

SEQ ID NO: 1173169 - RNA, 19 nt, Homo sapiens
ugagaaggcugaggaacuc

SEQ ID NO: 1173170 - RNA, 19 nt, Homo sapiens
gaagcuacguuggagaacu

SEQ ID NO: 1173171 - RNA, 19 nt, Homo sapiens
cagcggagguaaagaacca

SEQ ID NO: 1173172 - RNA, 19 nt, Homo sapiens
gguaacaugggaaaucguu

SEQ ID NO: 1173173 - RNA, 19 nt, Homo sapiens
agagaggauugguaacaug

SEQ ID NO: 1173174 - RNA, 19 nt, Homo sapiens
cagaauguaguauuuggaa

SEQ ID NO: 1173175 - RNA, 19 nt, Homo sapiens
gauguggagugggcugcua

SEQ ID NO: 1173176 - RNA, 19 nt, Homo sapiens
ggaagacccucaaagauga

SEQ ID NO: 1173177 - RNA, 19 nt, Homo sapiens
acagugcucucaagaauua

SEQ ID NO: 1173178 - RNA, 19 nt, Homo sapiens
guacauggucugcuucuua

SEQ ID NO: 1173179 - RNA, 19 nt, Homo sapiens
ggacauccuugcagaguug

SEQ ID NO: 1173180 - RNA, 19 nt, Homo sapiens
ccgaugaugucaaugaaua

SEQ ID NO: 1173181 - RNA, 19 nt, Homo sapiens
gcacccagcuuccucaaca

SEQ ID NO: 1173182 - RNA, 19 nt, Homo sapiens
gcacauggcggaccuccua

SEQ ID NO: 1173183 - RNA, 19 nt, Homo sapiens
ggccuucucugaauucauu

SEQ ID NO: 1173184 - RNA, 19 nt, Homo sapiens
caacaaggacugcuucuuc

SEQ ID NO: 1173185 - RNA, 19 nt, Homo sapiens
cuacagugcucucaagaau

SEQ ID NO: 1173186 - RNA, 19 nt, Homo sapiens
gcagagcuaugcggauuau

SEQ ID NO: 1173187 - RNA, 19 nt, Homo sapiens
gagaggaaccuguuugauc

SEQ ID NO: 1173188 - RNA, 19 nt, Homo sapiens
caacugggccuucucugaa

SEQ ID NO: 1173189 - RNA, 19 nt, Homo sapiens
gaaggcagccacuggaaug

SEQ ID NO: 1173190 - RNA, 19 nt, Homo sapiens
ccacagugagcauuaaauu

SEQ ID NO: 1173191 - RNA, 19 nt, Homo sapiens
aagaugaccuugcuuccaa

SEQ ID NO: 1173192 - RNA, 19 nt, Homo sapiens
ugccugagcuugacuuuca

SEQ ID NO: 1173193 - RNA, 19 nt, Homo sapiens
ccgaugagcuggcccaagu

SEQ ID NO: 1173194 - RNA, 19 nt, Homo sapiens
gcaagguggacuacuuuga

SEQ ID NO: 1173195 - RNA, 19 nt, Homo sapiens
cacagugagcauuaaauua

SEQ ID NO: 1173196 - RNA, 19 nt, Homo sapiens
cggaagacccucaaagaug

SEQ ID NO: 1173197 - RNA, 19 nt, Homo sapiens
ggacugcuucuucugcaaa

SEQ ID NO: 1173198 - RNA, 19 nt, Homo sapiens
ggaccacuaucccauucug

SEQ ID NO: 1173199 - RNA, 19 nt, Homo sapiens
ucaacagcguccucaauca

SEQ ID NO: 1173200 - RNA, 19 nt, Homo sapiens
cagcuacgcucaauaugcu

SEQ ID NO: 1173201 - RNA, 19 nt, Homo sapiens
agaacucgcugcuggaagu

SEQ ID NO: 1173202 - RNA, 19 nt, Homo sapiens
gcgcuacuauugggaugaa

SEQ ID NO: 1173203 - RNA, 19 nt, Homo sapiens
gggccacagugagcauuaa

SEQ ID NO: 1173204 - RNA, 19 nt, Homo sapiens
gccggcagcucaagguaug

SEQ ID NO: 1173205 - RNA, 19 nt, Homo sapiens
ccucaaagaugaccuugcu

SEQ ID NO: 1173206 - RNA, 19 nt, Homo sapiens
cugcagagcuaugcggauu

SEQ ID NO: 1173207 - RNA, 19 nt, Homo sapiens
gaauacaaggcuuccaauc

SEQ ID NO: 1173208 - RNA, 19 nt, Homo sapiens
gggcggucaugauguacaa

SEQ ID NO: 1173209 - RNA, 19 nt, Homo sapiens
cgccauggaugaccuagau

SEQ ID NO: 1173210 - RNA, 19 nt, Homo sapiens
gcggaagacccucaaagau

SEQ ID NO: 1173211 - RNA, 19 nt, Homo sapiens
gagcuaugcggauuauauc

SEQ ID NO: 1173212 - RNA, 19 nt, Homo sapiens
gcacagggucucucuuugc

SEQ ID NO: 1173213 - RNA, 19 nt, Homo sapiens
gaggacccgugaggacauu

SEQ ID NO: 1173214 - RNA, 19 nt, Homo sapiens
gguaugugccaccugcuuu

SEQ ID NO: 1173215 - RNA, 19 nt, Homo sapiens
ggccacaaguccugcaaag

SEQ ID NO: 1173216 - RNA, 19 nt, Homo sapiens
gcaccugaccucugcaucu

SEQ ID NO: 1173217 - RNA, 19 nt, Homo sapiens
auacacggcugccacaucu

SEQ ID NO: 1173218 - RNA, 19 nt, Homo sapiens
gcuucucccugcagagcua

SEQ ID NO: 1173219 - RNA, 19 nt, Homo sapiens
ugccugagauauuccuuga

SEQ ID NO: 1173220 - RNA, 19 nt, Homo sapiens
ucaacugggccuucucuga

SEQ ID NO: 1173221 - RNA, 19 nt, Homo sapiens
uugcacagcugcuaaacca

SEQ ID NO: 1173222 - RNA, 19 nt, Homo sapiens
cagcuacagugcucucaag

SEQ ID NO: 1173223 - RNA, 19 nt, Homo sapiens
gcguggccaucaacagcua

SEQ ID NO: 1173224 - RNA, 19 nt, Homo sapiens
gcaccucggagaaagugaa

SEQ ID NO: 1173225 - RNA, 19 nt, Homo sapiens
uaauugugccugagcuuga

SEQ ID NO: 1173226 - RNA, 19 nt, Homo sapiens
ccugagauauuccuugacu

SEQ ID NO: 1173227 - RNA, 19 nt, Homo sapiens
ucucugcccugcgcuacua

SEQ ID NO: 1173228 - RNA, 19 nt, Homo sapiens
gcccagccauggcccuaau

SEQ ID NO: 1173229 - RNA, 19 nt, Homo sapiens
ucaaccagcaccugaugaa

SEQ ID NO: 1173230 - RNA, 19 nt, Homo sapiens
agagcuaugcggauuauau

SEQ ID NO: 1173231 - RNA, 19 nt, Homo sapiens
gcugagaggaaccuguuug

SEQ ID NO: 1173232 - RNA, 19 nt, Homo sapiens
ucacacuggugccugagau

SEQ ID NO: 1173233 - RNA, 19 nt, Homo sapiens
ucucaagaauuacuuuggu

SEQ ID NO: 1173234 - RNA, 19 nt, Homo sapiens
gcuacagugcucucaagaa

SEQ ID NO: 1173235 - RNA, 19 nt, Homo sapiens
ucgcacagggucucucuuu

SEQ ID NO: 1173236 - RNA, 19 nt, Homo sapiens
accaagagccagaagguuu

SEQ ID NO: 1173237 - RNA, 19 nt, Homo sapiens
auacaaggcuuccaauccu

SEQ ID NO: 1173238 - RNA, 19 nt, Homo sapiens
guaucgccauggugaggaa

SEQ ID NO: 1173239 - RNA, 19 nt, Homo sapiens
ggagcucccaggcuaugaa

SEQ ID NO: 1173240 - RNA, 19 nt, Homo sapiens
cugaguacauggucugcuu

SEQ ID NO: 1173241 - RNA, 19 nt, Homo sapiens
cugcaaagccuguaucaac

SEQ ID NO: 1173242 - RNA, 19 nt, Homo sapiens
gagagcaagccacaucagu

SEQ ID NO: 1173243 - RNA, 19 nt, Homo sapiens
gagagagcaagccacauca

SEQ ID NO: 1173244 - RNA, 19 nt, Homo sapiens
cugcgugucuuggagauga

SEQ ID NO: 1173245 - RNA, 19 nt, Homo sapiens
ugucuccgaugaugucaau

SEQ ID NO: 1173246 - RNA, 19 nt, Homo sapiens
gcaaagccuguaucaacca

SEQ ID NO: 1173247 - RNA, 19 nt, Homo sapiens
cagcugagaggaaccuguu

SEQ ID NO: 1173248 - RNA, 19 nt, Homo sapiens
uugcagaguugaccaagag

SEQ ID NO: 1173249 - RNA, 19 nt, Homo sapiens
ccauggaugaccuagauga

SEQ ID NO: 1173250 - RNA, 19 nt, Homo sapiens
ugagcuggcccaaguggaa

SEQ ID NO: 1173251 - RNA, 19 nt, Homo sapiens
aggagaagaugcuggacau

SEQ ID NO: 1173252 - RNA, 19 nt, Homo sapiens
ugaccuagaugaggaugag

SEQ ID NO: 1173253 - RNA, 19 nt, Homo sapiens
aacaaggacugcuucuucu

SEQ ID NO: 1173254 - RNA, 19 nt, Homo sapiens
accagcaccugaugaacaa

SEQ ID NO: 1173255 - RNA, 19 nt, Homo sapiens
caacagcguccucaaucag

SEQ ID NO: 1173256 - RNA, 19 nt, Homo sapiens
uacauggucugcuucuuac

SEQ ID NO: 1173257 - RNA, 19 nt, Homo sapiens
ucagucagggccacaguga

SEQ ID NO: 1173258 - RNA, 19 nt, Homo sapiens
uggcaagguggacuacuuu

SEQ ID NO: 1173259 - RNA, 19 nt, Homo sapiens
agagagagcaagccacauc

SEQ ID NO: 1173260 - RNA, 19 nt, Homo sapiens
gcugccacaucugcugaaa

SEQ ID NO: 1173261 - RNA, 19 nt, Homo sapiens
cauucucgccaaacacuuu

SEQ ID NO: 1173262 - RNA, 19 nt, Homo sapiens
gugggugucuccgaugaug

SEQ ID NO: 1173263 - RNA, 19 nt, Homo sapiens
gcaaaaccaccacauccaa

SEQ ID NO: 1173264 - RNA, 19 nt, Homo sapiens
caucucugcuguguuccaa

SEQ ID NO: 1173265 - RNA, 19 nt, Homo sapiens
ccagucaaccgccauggau

SEQ ID NO: 1173266 - RNA, 19 nt, Homo sapiens
ggacccgugaggacauuga

SEQ ID NO: 1173267 - RNA, 19 nt, Homo sapiens
caccugaccucugcaucug

SEQ ID NO: 1173268 - RNA, 19 nt, Homo sapiens
gagcaccucggagaaagug

SEQ ID NO: 1173269 - RNA, 19 nt, Homo sapiens
ccccaggucuucuauaaug

SEQ ID NO: 1173270 - RNA, 19 nt, Homo sapiens
gaggagcucccaggcuaug

SEQ ID NO: 1173271 - RNA, 19 nt, Homo sapiens
gaccaagagccagaagguu

SEQ ID NO: 1173272 - RNA, 19 nt, Homo sapiens
aagccaacauugugaucga

SEQ ID NO: 1173273 - RNA, 19 nt, Homo sapiens
caagguggacuacuuugac

SEQ ID NO: 1173274 - RNA, 19 nt, Homo sapiens
cuaugcggauuauaucagu

SEQ ID NO: 1173275 - RNA, 19 nt, Homo sapiens
ccaaagccaacauugugau

SEQ ID NO: 1173276 - RNA, 19 nt, Homo sapiens
gaccagagcuguauauauu

SEQ ID NO: 1173277 - RNA, 19 nt, Homo sapiens
gauauucucuuccuauuga

SEQ ID NO: 1173278 - RNA, 19 nt, Homo sapiens
ggaagaagacuaccuguuu

SEQ ID NO: 1173279 - RNA, 19 nt, Homo sapiens
gaagaagacuaccuguuug

SEQ ID NO: 1173280 - RNA, 19 nt, Homo sapiens
ggacuaauacgcagcuaua

SEQ ID NO: 1173281 - RNA, 19 nt, Homo sapiens
ggagcaagcuguuagagau

SEQ ID NO: 1173282 - RNA, 19 nt, Homo sapiens
gaagcggcauguugaagaa

SEQ ID NO: 1173283 - RNA, 19 nt, Homo sapiens
gaaaauaccugccagucaa

SEQ ID NO: 1173284 - RNA, 19 nt, Homo sapiens
gcaagcaccucuucugucu

SEQ ID NO: 1173285 - RNA, 19 nt, Homo sapiens
caacugccaugucacaaga

SEQ ID NO: 1173286 - RNA, 19 nt, Homo sapiens
ggagaacagggaauugaua

SEQ ID NO: 1173287 - RNA, 19 nt, Homo sapiens
caaaggaguucuugaucug

SEQ ID NO: 1173288 - RNA, 19 nt, Homo sapiens
gaagacuaccuguuugaaa

SEQ ID NO: 1173289 - RNA, 19 nt, Homo sapiens
ugacugacaucacuguuug

SEQ ID NO: 1173290 - RNA, 19 nt, Homo sapiens
ucccagaacucuauccuuu

SEQ ID NO: 1173291 - RNA, 19 nt, Homo sapiens
ugaaauaccucugcaagca

SEQ ID NO: 1173292 - RNA, 19 nt, Homo sapiens
ccagagcuguauauauuga

SEQ ID NO: 1173293 - RNA, 19 nt, Homo sapiens
ggucccauuuguuaugaua

SEQ ID NO: 1173294 - RNA, 19 nt, Homo sapiens
ccaauacaguagacaguga

SEQ ID NO: 1173295 - RNA, 19 nt, Homo sapiens
gaagacacccuaguucuca

SEQ ID NO: 1173296 - RNA, 19 nt, Homo sapiens
gcccugagaugcucuguca

SEQ ID NO: 1173297 - RNA, 19 nt, Homo sapiens
ccaaaggaguucuugaucu

SEQ ID NO: 1173298 - RNA, 19 nt, Homo sapiens
gaaggaaaaucacccagaa

SEQ ID NO: 1173299 - RNA, 19 nt, Homo sapiens
ucacauuccuaauaccauu

SEQ ID NO: 1173300 - RNA, 19 nt, Homo sapiens
agcagaagcucacaugaaa

SEQ ID NO: 1173301 - RNA, 19 nt, Homo sapiens
gaaguccucaccaguacua

SEQ ID NO: 1173302 - RNA, 19 nt, Homo sapiens
gaggaagucagagggauua

SEQ ID NO: 1173303 - RNA, 19 nt, Homo sapiens
gagcaugcaucagguggaa

SEQ ID NO: 1173304 - RNA, 19 nt, Homo sapiens
gaguguagcucugagacuu

SEQ ID NO: 1173305 - RNA, 19 nt, Homo sapiens
gaagucagagggauuaucu

SEQ ID NO: 1173306 - RNA, 19 nt, Homo sapiens
aagaugggauucugcugua

SEQ ID NO: 1173307 - RNA, 19 nt, Homo sapiens
gcagcagccucuggacuug

SEQ ID NO: 1173308 - RNA, 19 nt, Homo sapiens
gaaccaaaucgucauccaa

SEQ ID NO: 1173309 - RNA, 19 nt, Homo sapiens
ucucucagcuguuagaauc

SEQ ID NO: 1173310 - RNA, 19 nt, Homo sapiens
ucacaagacuacgcauuca

SEQ ID NO: 1173311 - RNA, 19 nt, Homo sapiens
guugaaguccucaccagua

SEQ ID NO: 1173312 - RNA, 19 nt, Homo sapiens
gaccaguguuuccggcaaa

SEQ ID NO: 1173313 - RNA, 19 nt, Homo sapiens
gcagcuauaagccaagaaa

SEQ ID NO: 1173314 - RNA, 19 nt, Homo sapiens
ggguucagcuggucaucuu

SEQ ID NO: 1173315 - RNA, 19 nt, Homo sapiens
ggacacuucuccagguuuu

SEQ ID NO: 1173316 - RNA, 19 nt, Homo sapiens
uagaucacauuccuaauac

SEQ ID NO: 1173317 - RNA, 19 nt, Homo sapiens
gaaugcuucugcaagauac

SEQ ID NO: 1173318 - RNA, 19 nt, Homo sapiens
ccacuaaaucugcaggaaa

SEQ ID NO: 1173319 - RNA, 19 nt, Homo sapiens
ccgagacccugaucuuugu

SEQ ID NO: 1173320 - RNA, 19 nt, Homo sapiens
ccaagcauguuucucuuac

SEQ ID NO: 1173321 - RNA, 19 nt, Homo sapiens
gcuauaagccaagaaauac

SEQ ID NO: 1173322 - RNA, 19 nt, Homo sapiens
gagaacagggaauugauag

SEQ ID NO: 1173323 - RNA, 19 nt, Homo sapiens
ggaggaagucagagggauu

SEQ ID NO: 1173324 - RNA, 19 nt, Homo sapiens
gccuuggucccauuuguua

SEQ ID NO: 1173325 - RNA, 19 nt, Homo sapiens
uagcagaagcucacaugaa

SEQ ID NO: 1173326 - RNA, 19 nt, Homo sapiens
aagcauguuucucuuacuu

SEQ ID NO: 1173327 - RNA, 19 nt, Homo sapiens
ggaagacacccuaguucuc

SEQ ID NO: 1173328 - RNA, 19 nt, Homo sapiens
gccgagacccugaucuuug

SEQ ID NO: 1173329 - RNA, 19 nt, Homo sapiens
caacaugggagagaaguuc

SEQ ID NO: 1173330 - RNA, 19 nt, Homo sapiens
ggauucugcuguagagucu

SEQ ID NO: 1173331 - RNA, 19 nt, Homo sapiens
gcagaaucgaggcaguuaa

SEQ ID NO: 1173332 - RNA, 19 nt, Homo sapiens
gaacagggaauugauagcu

SEQ ID NO: 1173333 - RNA, 19 nt, Homo sapiens
ggacucuuaugcagaaucg

SEQ ID NO: 1173334 - RNA, 19 nt, Homo sapiens
gcagacauguguggagaac

SEQ ID NO: 1173335 - RNA, 19 nt, Homo sapiens
guggagagcgggagacgaa

SEQ ID NO: 1173336 - RNA, 19 nt, Homo sapiens
gcauguuucucuuacuuuu

SEQ ID NO: 1173337 - RNA, 19 nt, Homo sapiens
gaugcucugucaccuucaa

SEQ ID NO: 1173338 - RNA, 19 nt, Homo sapiens
ucugagacuugcuuccaaa

SEQ ID NO: 1173339 - RNA, 19 nt, Homo sapiens
gcaagauacugaaaauucu

SEQ ID NO: 1173340 - RNA, 19 nt, Homo sapiens
gggauuaucucaggaucag

SEQ ID NO: 1173341 - RNA, 19 nt, Homo sapiens
cggaacgaauucagacuuc

SEQ ID NO: 1173342 - RNA, 19 nt, Homo sapiens
guggguauuugccucauuc

SEQ ID NO: 1173343 - RNA, 19 nt, Homo sapiens
gguauuugccucauucagu

SEQ ID NO: 1173344 - RNA, 19 nt, Homo sapiens
ugaccagagcuguauauau

SEQ ID NO: 1173345 - RNA, 19 nt, Homo sapiens
gauaugggagaaccaaauc

SEQ ID NO: 1173346 - RNA, 19 nt, Homo sapiens
gacaguggaguucacaaga

SEQ ID NO: 1173347 - RNA, 19 nt, Homo sapiens
ccucuucugucuccucuca

SEQ ID NO: 1173348 - RNA, 19 nt, Homo sapiens
gcaugcaucagguggaaga

SEQ ID NO: 1173349 - RNA, 19 nt, Homo sapiens
ggauggcuguugggagaga

SEQ ID NO: 1173350 - RNA, 19 nt, Homo sapiens
agacauguguggagaacag

SEQ ID NO: 1173351 - RNA, 19 nt, Homo sapiens
ccaaugaaagaucugaaau

SEQ ID NO: 1173352 - RNA, 19 nt, Homo sapiens
ggagagcgggagacgaaug

SEQ ID NO: 1173353 - RNA, 19 nt, Homo sapiens
uaaaucugcaggaaacaug

SEQ ID NO: 1173354 - RNA, 19 nt, Homo sapiens
cacuaaaucugcaggaaac

SEQ ID NO: 1173355 - RNA, 19 nt, Homo sapiens
gagcaagcuguuagagaug

SEQ ID NO: 1173356 - RNA, 19 nt, Homo sapiens
ggagcacuguguccaucug

SEQ ID NO: 1173357 - RNA, 19 nt, Homo sapiens
ccaaacacggaacgaauuc

SEQ ID NO: 1173358 - RNA, 19 nt, Homo sapiens
ggacaaccagccaguucug

SEQ ID NO: 1173359 - RNA, 19 nt, Homo sapiens
gaacgaauucagacuucca

SEQ ID NO: 1173360 - RNA, 19 nt, Homo sapiens
gaucacauuccuaauacca

SEQ ID NO: 1173361 - RNA, 19 nt, Homo sapiens
ucgaggcaguuaacucuuc

SEQ ID NO: 1173362 - RNA, 19 nt, Homo sapiens
uucaaaggauggugucaga

SEQ ID NO: 1173363 - RNA, 19 nt, Homo sapiens
ugcaucagguggaagaaga

SEQ ID NO: 1173364 - RNA, 19 nt, Homo sapiens
auucuugaguugcaggaua

SEQ ID NO: 1173365 - RNA, 19 nt, Homo sapiens
ccacauucaugggacacuu

SEQ ID NO: 1173366 - RNA, 19 nt, Homo sapiens
gguggguauuugccucauu

SEQ ID NO: 1173367 - RNA, 19 nt, Homo sapiens
gggaagacacccuaguucu

SEQ ID NO: 1173368 - RNA, 19 nt, Homo sapiens
caagacuacgcauucaaga

SEQ ID NO: 1173369 - RNA, 19 nt, Homo sapiens
gaagacaguggaguucaca

SEQ ID NO: 1173370 - RNA, 19 nt, Homo sapiens
aagacuaccuguuugaaaa

SEQ ID NO: 1173371 - RNA, 19 nt, Homo sapiens
cuaccacucccgugaaaug

SEQ ID NO: 1173372 - RNA, 19 nt, Homo sapiens
gaugggauucugcuguaga

SEQ ID NO: 1173373 - RNA, 19 nt, Homo sapiens
cacccuaguucucaguguu

SEQ ID NO: 1173374 - RNA, 19 nt, Homo sapiens
gaucuggacgauggauauu

SEQ ID NO: 1173375 - RNA, 19 nt, Homo sapiens
ccagaacucuauccuuuuc

SEQ ID NO: 1173376 - RNA, 19 nt, Homo sapiens
gcccagagguuuacaaguu

SEQ ID NO: 1173377 - RNA, 19 nt, Homo sapiens
caacauagagucugagauu

SEQ ID NO: 1173378 - RNA, 19 nt, Homo sapiens
ccagggagcugcagggaaa

SEQ ID NO: 1173379 - RNA, 19 nt, Homo sapiens
caagaaguguguugagaug

SEQ ID NO: 1173380 - RNA, 19 nt, Homo sapiens
gaaagaggccaucaagauc

SEQ ID NO: 1173381 - RNA, 19 nt, Homo sapiens
ccaaagaagcggagaaaga

SEQ ID NO: 1173382 - RNA, 19 nt, Homo sapiens
ggaacccuguugccgauuu

SEQ ID NO: 1173383 - RNA, 19 nt, Homo sapiens
gagaucaggcaacacuuua

SEQ ID NO: 1173384 - RNA, 19 nt, Homo sapiens
ggugugggcugacaacuca

SEQ ID NO: 1173385 - RNA, 19 nt, Homo sapiens
ggagaucaggcaacacuuu

SEQ ID NO: 1173386 - RNA, 19 nt, Homo sapiens
agaagacccuggacaaugu

SEQ ID NO: 1173387 - RNA, 19 nt, Homo sapiens
gcaucauggucaagacuuu

SEQ ID NO: 1173388 - RNA, 19 nt, Homo sapiens
ugaaagaggccaucaagau

SEQ ID NO: 1173389 - RNA, 19 nt, Homo sapiens
gagacuucgugguagauaa

SEQ ID NO: 1173390 - RNA, 19 nt, Homo sapiens
gcagcucacugaacuccaa

SEQ ID NO: 1173391 - RNA, 19 nt, Homo sapiens
gaaagcaacagcuauaggu

SEQ ID NO: 1173392 - RNA, 19 nt, Homo sapiens
gacuuuagguuccguacaa

SEQ ID NO: 1173393 - RNA, 19 nt, Homo sapiens
gcccuucgcuuacaaacug

SEQ ID NO: 1173394 - RNA, 19 nt, Homo sapiens
ccucaggccuguugaacuu

SEQ ID NO: 1173395 - RNA, 19 nt, Homo sapiens
acaagaggaagaagaauaa

SEQ ID NO: 1173396 - RNA, 19 nt, Homo sapiens
cauugcagcuauguaauuu

SEQ ID NO: 1173397 - RNA, 19 nt, Homo sapiens
ucaagaagcuacaggaaaa

SEQ ID NO: 1173398 - RNA, 19 nt, Homo sapiens
aggaagaugugaguguuua

SEQ ID NO: 1173399 - RNA, 19 nt, Homo sapiens
uaaaaucacucgagacuuc

SEQ ID NO: 1173400 - RNA, 19 nt, Homo sapiens
acagagagguggacaagca

SEQ ID NO: 1173401 - RNA, 19 nt, Homo sapiens
gaugcugccguuucuauuu

SEQ ID NO: 1173402 - RNA, 19 nt, Homo sapiens
caaacccacugcccucuuc

SEQ ID NO: 1173403 - RNA, 19 nt, Homo sapiens
gcacagaggacaaguagcu

SEQ ID NO: 1173404 - RNA, 19 nt, Homo sapiens
cacaagaggaagaagaaua

SEQ ID NO: 1173405 - RNA, 19 nt, Homo sapiens
agacaggcccagagguuua

SEQ ID NO: 1173406 - RNA, 19 nt, Homo sapiens
gcagggaaagcaacagcua

SEQ ID NO: 1173407 - RNA, 19 nt, Homo sapiens
gcaagaaguguguugagau

SEQ ID NO: 1173408 - RNA, 19 nt, Homo sapiens
ggucugauccugguaaaug

SEQ ID NO: 1173409 - RNA, 19 nt, Homo sapiens
gcaaacacaagaggaagaa

SEQ ID NO: 1173410 - RNA, 19 nt, Homo sapiens
guaccugcauggugaagug

SEQ ID NO: 1173411 - RNA, 19 nt, Homo sapiens
guucugcccuggagacuuc

SEQ ID NO: 1173412 - RNA, 19 nt, Homo sapiens
ggaagcagugcccgacgua

SEQ ID NO: 1173413 - RNA, 19 nt, Homo sapiens
gagaugcugccguuucuau

SEQ ID NO: 1173414 - RNA, 19 nt, Homo sapiens
acaaugagauggcgcugau

SEQ ID NO: 1173415 - RNA, 19 nt, Homo sapiens
cccagagguuuacaaguuu

SEQ ID NO: 1173416 - RNA, 19 nt, Homo sapiens
acaagaaccugaggaugga

SEQ ID NO: 1173417 - RNA, 19 nt, Homo sapiens
gauggccucuacuuguuug

SEQ ID NO: 1173418 - RNA, 19 nt, Homo sapiens
caaagaagcggagaaagag

SEQ ID NO: 1173419 - RNA, 19 nt, Homo sapiens
guaaaugaaccauacuaca

SEQ ID NO: 1173420 - RNA, 19 nt, Homo sapiens
gaccucagccgacgugaug

SEQ ID NO: 1173421 - RNA, 19 nt, Homo sapiens
ucaagaagacccuggacaa

SEQ ID NO: 1173422 - RNA, 19 nt, Homo sapiens
gaagccaacucgggagaag

SEQ ID NO: 1173423 - RNA, 19 nt, Homo sapiens
ggcaagagcagcugcacaa

SEQ ID NO: 1173424 - RNA, 19 nt, Homo sapiens
ugaguuugaugcugaagug

SEQ ID NO: 1173425 - RNA, 19 nt, Homo sapiens
ggacagagagguggacaag

SEQ ID NO: 1173426 - RNA, 19 nt, Homo sapiens
gaacuuaaagcgcaaacac

SEQ ID NO: 1173427 - RNA, 19 nt, Homo sapiens
gaggaagaugugaguguuu

SEQ ID NO: 1173428 - RNA, 19 nt, Homo sapiens
gagacaggcccagagguuu

SEQ ID NO: 1173429 - RNA, 19 nt, Homo sapiens
gugguggccuucacacaug

SEQ ID NO: 1173430 - RNA, 19 nt, Homo sapiens
ggacuagaaggccuacugu

SEQ ID NO: 1173431 - RNA, 19 nt, Homo sapiens
aaacacaagaggaagaaga

SEQ ID NO: 1173432 - RNA, 19 nt, Homo sapiens
ggauggccucuacuuguuu

SEQ ID NO: 1173433 - RNA, 19 nt, Homo sapiens
caagaagacccuggacaau

SEQ ID NO: 1173434 - RNA, 19 nt, Homo sapiens
ccagcccucucuuggacua

SEQ ID NO: 1173435 - RNA, 19 nt, Homo sapiens
gcacaaggccagggcaagu

SEQ ID NO: 1173436 - RNA, 19 nt, Homo sapiens
ccaaggguuucaucaagag

SEQ ID NO: 1173437 - RNA, 19 nt, Homo sapiens
cuucucagcucucaucaag

SEQ ID NO: 1173438 - RNA, 19 nt, Homo sapiens
acauagagucugagauuga

SEQ ID NO: 1173439 - RNA, 19 nt, Homo sapiens
caaggucugauccugguaa

SEQ ID NO: 1173440 - RNA, 19 nt, Homo sapiens
caggauggcuccguggaau

SEQ ID NO: 1173441 - RNA, 19 nt, Homo sapiens
agaggaagaugugaguguu

SEQ ID NO: 1173442 - RNA, 19 nt, Homo sapiens
ggagacuucgugguagaua

SEQ ID NO: 1173443 - RNA, 19 nt, Homo sapiens
uuaaagcgcaaacacaaga

SEQ ID NO: 1173444 - RNA, 19 nt, Homo sapiens
gaaaaucggaacccuguug

SEQ ID NO: 1173445 - RNA, 19 nt, Homo sapiens
aggauggccucuacuuguu

SEQ ID NO: 1173446 - RNA, 19 nt, Homo sapiens
uguacaacauagagucuga

SEQ ID NO: 1173447 - RNA, 19 nt, Homo sapiens
gcacuuguacaacauagag

SEQ ID NO: 1173448 - RNA, 19 nt, Homo sapiens
gcugaccacccugacuuua

SEQ ID NO: 1173449 - RNA, 19 nt, Homo sapiens
uguugaacuugcucucuaa

SEQ ID NO: 1173450 - RNA, 19 nt, Homo sapiens
ggaaggcuaugaaaacagu

SEQ ID NO: 1173451 - RNA, 19 nt, Homo sapiens
acugucagcccuucgcuua

SEQ ID NO: 1173452 - RNA, 19 nt, Homo sapiens
ggaaagcaacagcuauagg

SEQ ID NO: 1173453 - RNA, 19 nt, Homo sapiens
uccaaggguuucaucaaga

SEQ ID NO: 1173454 - RNA, 19 nt, Homo sapiens
gcaggauggcuccguggaa

SEQ ID NO: 1173455 - RNA, 19 nt, Homo sapiens
ggacaagggaguggugauc

SEQ ID NO: 1173456 - RNA, 19 nt, Homo sapiens
ggacgagcaccccaagaua

SEQ ID NO: 1173457 - RNA, 19 nt, Homo sapiens
gcugggagacggacaaugg

SEQ ID NO: 1173458 - RNA, 19 nt, Homo sapiens
aagaguggcuacccugaca

SEQ ID NO: 1173459 - RNA, 19 nt, Homo sapiens
gagagccucaagaacauga

SEQ ID NO: 1173460 - RNA, 19 nt, Homo sapiens
cccaugcccugcuggagaa

SEQ ID NO: 1173461 - RNA, 19 nt, Homo sapiens
ucugcuaccucucccaaug

SEQ ID NO: 1173462 - RNA, 19 nt, Homo sapiens
caucaagaagcuacaggaa

SEQ ID NO: 1173463 - RNA, 19 nt, Homo sapiens
uggagagccucaagaacau

SEQ ID NO: 1173464 - RNA, 19 nt, Homo sapiens
ugugaguguuuacgacauu

SEQ ID NO: 1173465 - RNA, 19 nt, Homo sapiens
ggagcugauuggagaagag

SEQ ID NO: 1173466 - RNA, 19 nt, Homo sapiens
gcgugcagcucacugaacu

SEQ ID NO: 1173467 - RNA, 19 nt, Homo sapiens
agggaaagcaacagcuaua

SEQ ID NO: 1173468 - RNA, 19 nt, Homo sapiens
cuguugaacuugcucucua

SEQ ID NO: 1173469 - RNA, 19 nt, Homo sapiens
gcaaacccacugcccucuu

SEQ ID NO: 1173470 - RNA, 19 nt, Homo sapiens
gucugauccugguaaauga

SEQ ID NO: 1173471 - RNA, 19 nt, Homo sapiens
gcucaucuccauccaaggu

SEQ ID NO: 1173472 - RNA, 19 nt, Homo sapiens
ggacgacguggagcugauu

SEQ ID NO: 1173473 - RNA, 19 nt, Homo sapiens
gaugaaugggaagaugaua

SEQ ID NO: 1173474 - RNA, 19 nt, Homo sapiens
ugaccacccugacuuuagg

SEQ ID NO: 1173475 - RNA, 19 nt, Homo sapiens
gccgagaggaugcuguuga

SEQ ID NO: 1173476 - RNA, 19 nt, Homo sapiens
cauccuagcuuaacucuug

SEQ ID NO: 1173477 - RNA, 19 nt, Homo sapiens
caagacccgucacuuuaua

SEQ ID NO: 1173478 - RNA, 19 nt, Homo sapiens
ucacaagccucaccuguau

SEQ ID NO: 1173479 - RNA, 19 nt, Homo sapiens
cagcauuucuguuaggaua

SEQ ID NO: 1173480 - RNA, 19 nt, Homo sapiens
cauuuaagaucccagauaa

SEQ ID NO: 1173481 - RNA, 19 nt, Homo sapiens
gaacgucagaucauuauug

SEQ ID NO: 1173482 - RNA, 19 nt, Homo sapiens
guagagucauccuagcuua

SEQ ID NO: 1173483 - RNA, 19 nt, Homo sapiens
gccaagacccgucacuuua

SEQ ID NO: 1173484 - RNA, 19 nt, Homo sapiens
cagaagagcuugcgcuauc

SEQ ID NO: 1173485 - RNA, 19 nt, Homo sapiens
uaagguagauaaaggauca

SEQ ID NO: 1173486 - RNA, 19 nt, Homo sapiens
agacugagaucuuccgaaa

SEQ ID NO: 1173487 - RNA, 19 nt, Homo sapiens
ggaguaagguagauaaagg

SEQ ID NO: 1173488 - RNA, 19 nt, Homo sapiens
gcaguaagcaugcaugaug

SEQ ID NO: 1173489 - RNA, 19 nt, Homo sapiens
gaugagcuuucacaguuaa

SEQ ID NO: 1173490 - RNA, 19 nt, Homo sapiens
gaagaagacauuuaagauc

SEQ ID NO: 1173491 - RNA, 19 nt, Homo sapiens
gaaacagcuucuccuccua

SEQ ID NO: 1173492 - RNA, 19 nt, Homo sapiens
ugacacagauaacuucaga

SEQ ID NO: 1173493 - RNA, 19 nt, Homo sapiens
ugacaugccuagacuccua

SEQ ID NO: 1173494 - RNA, 19 nt, Homo sapiens
ugagacaucuuauucacuu

SEQ ID NO: 1173495 - RNA, 19 nt, Homo sapiens
ggaagauaauugaaaccaa

SEQ ID NO: 1173496 - RNA, 19 nt, Homo sapiens
ccacucagcuaauuaugau

SEQ ID NO: 1173497 - RNA, 19 nt, Homo sapiens
agacugaucuucuguccaa

SEQ ID NO: 1173498 - RNA, 19 nt, Homo sapiens
gcuccaaguucaaggcuuu

SEQ ID NO: 1173499 - RNA, 19 nt, Homo sapiens
ugauguagaugcccuauuc

SEQ ID NO: 1173500 - RNA, 19 nt, Homo sapiens
gaucccagauaaacaguau

SEQ ID NO: 1173501 - RNA, 19 nt, Homo sapiens
ggacaaacuacaacuccua

SEQ ID NO: 1173502 - RNA, 19 nt, Homo sapiens
ggaaggaaugccaguguuu

SEQ ID NO: 1173503 - RNA, 19 nt, Homo sapiens
cagcuacucuugacacaga

SEQ ID NO: 1173504 - RNA, 19 nt, Homo sapiens
acgaugagcuuucacaguu

SEQ ID NO: 1173505 - RNA, 19 nt, Homo sapiens
ggagugauuucuagauugg

SEQ ID NO: 1173506 - RNA, 19 nt, Homo sapiens
gaucuaaagcuuugaguca

SEQ ID NO: 1173507 - RNA, 19 nt, Homo sapiens
ucagagagacugcugguaa

SEQ ID NO: 1173508 - RNA, 19 nt, Homo sapiens
cgaugagcuuucacaguua

SEQ ID NO: 1173509 - RNA, 19 nt, Homo sapiens
guuaggauauuuagaugga

SEQ ID NO: 1173510 - RNA, 19 nt, Homo sapiens
gcauuccacucagcuaauu

SEQ ID NO: 1173511 - RNA, 19 nt, Homo sapiens
caaaugaucgccaucuaga

SEQ ID NO: 1173512 - RNA, 19 nt, Homo sapiens
guauagggauuacagcaau

SEQ ID NO: 1173513 - RNA, 19 nt, Homo sapiens
gggagugauuucuagauug

SEQ ID NO: 1173514 - RNA, 19 nt, Homo sapiens
gcauuucuguuaggauauu

SEQ ID NO: 1173515 - RNA, 19 nt, Homo sapiens
gaacagccuccgagacuuc

SEQ ID NO: 1173516 - RNA, 19 nt, Homo sapiens
ugaaugaagucagaacaga

SEQ ID NO: 1173517 - RNA, 19 nt, Homo sapiens
gcacagaccccuccacauu

SEQ ID NO: 1173518 - RNA, 19 nt, Homo sapiens
cuugaagccugccucauuu

SEQ ID NO: 1173519 - RNA, 19 nt, Homo sapiens
ggcaaaugaucgccaucua

SEQ ID NO: 1173520 - RNA, 19 nt, Homo sapiens
ggccaagacccgucacuuu

SEQ ID NO: 1173521 - RNA, 19 nt, Homo sapiens
ggacuuggcgcuggacauu

SEQ ID NO: 1173522 - RNA, 19 nt, Homo sapiens
uggaagauguggacacgaa

SEQ ID NO: 1173523 - RNA, 19 nt, Homo sapiens
cgagagcauuugaacauuc

SEQ ID NO: 1173524 - RNA, 19 nt, Homo sapiens
gaaugaagucagaacagaa

SEQ ID NO: 1173525 - RNA, 19 nt, Homo sapiens
gaagaggacacugagcaaa

SEQ ID NO: 1173526 - RNA, 19 nt, Homo sapiens
caaacuacaacuccuagaa

SEQ ID NO: 1173527 - RNA, 19 nt, Homo sapiens
gaacacagacgaccuugcu

SEQ ID NO: 1173528 - RNA, 19 nt, Homo sapiens
gcaaaugaucgccaucuag

SEQ ID NO: 1173529 - RNA, 19 nt, Homo sapiens
gagcuugcgcuaucucauu

SEQ ID NO: 1173530 - RNA, 19 nt, Homo sapiens
gcucggaagauaauugaaa

SEQ ID NO: 1173531 - RNA, 19 nt, Homo sapiens
caacaugccacuagugaca

SEQ ID NO: 1173532 - RNA, 19 nt, Homo sapiens
gagacuucguggaugauga

SEQ ID NO: 1173533 - RNA, 19 nt, Homo sapiens
uaauugaaaccaagucuga

SEQ ID NO: 1173534 - RNA, 19 nt, Homo sapiens
guucugcucugaaugaagu

SEQ ID NO: 1173535 - RNA, 19 nt, Homo sapiens
ugaaggaucgucaacaguu

SEQ ID NO: 1173536 - RNA, 19 nt, Homo sapiens
cagagagacugcugguaau

SEQ ID NO: 1173537 - RNA, 19 nt, Homo sapiens
gugaugaggaggaguauug

SEQ ID NO: 1173538 - RNA, 19 nt, Homo sapiens
ccaggagcuuucagaaguu

SEQ ID NO: 1173539 - RNA, 19 nt, Homo sapiens
caucuuauucacuuccuua

SEQ ID NO: 1173540 - RNA, 19 nt, Homo sapiens
gcggacauuugguucagaa

SEQ ID NO: 1173541 - RNA, 19 nt, Homo sapiens
ugccuagacuccuaauaaa

SEQ ID NO: 1173542 - RNA, 19 nt, Homo sapiens
cuaaagcuuugagucauga

SEQ ID NO: 1173543 - RNA, 19 nt, Homo sapiens
cagaggaggagaagauuga

SEQ ID NO: 1173544 - RNA, 19 nt, Homo sapiens
cgagugagcaccagcgauu

SEQ ID NO: 1173545 - RNA, 19 nt, Homo sapiens
agaagauuccgcacacaua

SEQ ID NO: 1173546 - RNA, 19 nt, Homo sapiens
gauggaaacgucauuacug

SEQ ID NO: 1173547 - RNA, 19 nt, Homo sapiens
agagagauuccgcuccuua

SEQ ID NO: 1173548 - RNA, 19 nt, Homo sapiens
gaggaggaguauuggaaca

SEQ ID NO: 1173549 - RNA, 19 nt, Homo sapiens
ccaagacccgucacuuuau

SEQ ID NO: 1173550 - RNA, 19 nt, Homo sapiens
ggaugaugaugacgaugau

SEQ ID NO: 1173551 - RNA, 19 nt, Homo sapiens
gaaggaaugccaguguuuc

SEQ ID NO: 1173552 - RNA, 19 nt, Homo sapiens
gaagagguaugggagucau

SEQ ID NO: 1173553 - RNA, 19 nt, Homo sapiens
gcagucccgucaaccugaa

SEQ ID NO: 1173554 - RNA, 19 nt, Homo sapiens
gaagauuccgcacacauac

SEQ ID NO: 1173555 - RNA, 19 nt, Homo sapiens
ugggagugauuucuagauu

SEQ ID NO: 1173556 - RNA, 19 nt, Homo sapiens
ggaagaauuaaguggcauu

SEQ ID NO: 1173557 - RNA, 19 nt, Homo sapiens
gcucgcaaauucgauggaa

SEQ ID NO: 1173558 - RNA, 19 nt, Homo sapiens
cucagcagcucgcaaauuc

SEQ ID NO: 1173559 - RNA, 19 nt, Homo sapiens
ccaucggguugucgaaauu

SEQ ID NO: 1173560 - RNA, 19 nt, Homo sapiens
aagaagagagcacccauug

SEQ ID NO: 1173561 - RNA, 19 nt, Homo sapiens
aacgucagaucauuauuga

SEQ ID NO: 1173562 - RNA, 19 nt, Homo sapiens
ggaaauaggggaucaaaag

SEQ ID NO: 1173563 - RNA, 19 nt, Homo sapiens
caggagcuuucagaaguuu

SEQ ID NO: 1173564 - RNA, 19 nt, Homo sapiens
acccgucacuuuauaagaa

SEQ ID NO: 1173565 - RNA, 19 nt, Homo sapiens
gaucagcagaggaggagaa

SEQ ID NO: 1173566 - RNA, 19 nt, Homo sapiens
gcagauauuacaggaguau

SEQ ID NO: 1173567 - RNA, 19 nt, Homo sapiens
uggcugggcuauaccaaga

SEQ ID NO: 1173568 - RNA, 19 nt, Homo sapiens
gaucauuauugaggcaaau

SEQ ID NO: 1173569 - RNA, 19 nt, Homo sapiens
gcccugagacaucuuauuc

SEQ ID NO: 1173570 - RNA, 19 nt, Homo sapiens
agaggacacugagcaaaga

SEQ ID NO: 1173571 - RNA, 19 nt, Homo sapiens
cggccuagacguuguguuu

SEQ ID NO: 1173572 - RNA, 19 nt, Homo sapiens
uaauuaugauccaggacuu

SEQ ID NO: 1173573 - RNA, 19 nt, Homo sapiens
uaggguggcuacugcauuc

SEQ ID NO: 1173574 - RNA, 19 nt, Homo sapiens
gaagaauuaaguggcauug

SEQ ID NO: 1173575 - RNA, 19 nt, Homo sapiens
gcagaggaggagaagauug

SEQ ID NO: 1173576 - RNA, 19 nt, Homo sapiens
gaacacagacugcaaauaa

SEQ ID NO: 1173577 - RNA, 19 nt, Homo sapiens
gaaggaaacucaaauucuu

SEQ ID NO: 1173578 - RNA, 19 nt, Homo sapiens
cagcagagcuuuaacaaau

SEQ ID NO: 1173579 - RNA, 19 nt, Homo sapiens
uaggauaccuuuccauuaa

SEQ ID NO: 1173580 - RNA, 19 nt, Homo sapiens
cgacggaaaugguuuguuu

SEQ ID NO: 1173581 - RNA, 19 nt, Homo sapiens
ggaauucacuucuggaugu

SEQ ID NO: 1173582 - RNA, 19 nt, Homo sapiens
aaagcuaccuggcaaguua

SEQ ID NO: 1173583 - RNA, 19 nt, Homo sapiens
gcagagcuuuaacaaauuu

SEQ ID NO: 1173584 - RNA, 19 nt, Homo sapiens
caacagauaagcuuucuuu

SEQ ID NO: 1173585 - RNA, 19 nt, Homo sapiens
aauaguagcuucucuguug

SEQ ID NO: 1173586 - RNA, 19 nt, Homo sapiens
gaagaggagucagaaagaa

SEQ ID NO: 1173587 - RNA, 19 nt, Homo sapiens
gagcuaagcauuucuaguu

SEQ ID NO: 1173588 - RNA, 19 nt, Homo sapiens
gcacaauauucucauaaga

SEQ ID NO: 1173589 - RNA, 19 nt, Homo sapiens
uagcagaacuggaaggaaa

SEQ ID NO: 1173590 - RNA, 19 nt, Homo sapiens
gaaagcaccuagugauucu

SEQ ID NO: 1173591 - RNA, 19 nt, Homo sapiens
aaagaaagaugccuguguu

SEQ ID NO: 1173592 - RNA, 19 nt, Homo sapiens
gggauuauaugcuucaguu

SEQ ID NO: 1173593 - RNA, 19 nt, Homo sapiens
gaagaucucuaugccaaau

SEQ ID NO: 1173594 - RNA, 19 nt, Homo sapiens
ggacuaauaggauaccuuu

SEQ ID NO: 1173595 - RNA, 19 nt, Homo sapiens
ucaccaagagcuacaauua

SEQ ID NO: 1173596 - RNA, 19 nt, Homo sapiens
caaccugacuggaaacaga

SEQ ID NO: 1173597 - RNA, 19 nt, Homo sapiens
agaagacgcuggagaucua

SEQ ID NO: 1173598 - RNA, 19 nt, Homo sapiens
ggaaauagcaacagauaag

SEQ ID NO: 1173599 - RNA, 19 nt, Homo sapiens
ggacaccggugcuaugcaa

SEQ ID NO: 1173600 - RNA, 19 nt, Homo sapiens
cauaagagcuaagcauuuc

SEQ ID NO: 1173601 - RNA, 19 nt, Homo sapiens
ggaaacagaauauacaauc

SEQ ID NO: 1173602 - RNA, 19 nt, Homo sapiens
ggaagacuguacugggaaa

SEQ ID NO: 1173603 - RNA, 19 nt, Homo sapiens
ggaaggaucagccucauuc

SEQ ID NO: 1173604 - RNA, 19 nt, Homo sapiens
gaaagaaagaugccugugu

SEQ ID NO: 1173605 - RNA, 19 nt, Homo sapiens
aaucagggcuacuugcuuu

SEQ ID NO: 1173606 - RNA, 19 nt, Homo sapiens
gcuaugguauuaugggauu

SEQ ID NO: 1173607 - RNA, 19 nt, Homo sapiens
gacaucaccucuucacugu

SEQ ID NO: 1173608 - RNA, 19 nt, Homo sapiens
cagagacaaugaucaaaug

SEQ ID NO: 1173609 - RNA, 19 nt, Homo sapiens
caggagaacuggagcuaga

SEQ ID NO: 1173610 - RNA, 19 nt, Homo sapiens
ccagagacaauacaacuaa

SEQ ID NO: 1173611 - RNA, 19 nt, Homo sapiens
ggaacuaauugcccgugaa

SEQ ID NO: 1173612 - RNA, 19 nt, Homo sapiens
gagagaugcuacaaugcaa

SEQ ID NO: 1173613 - RNA, 19 nt, Homo sapiens
cuauaucgcucaccagaga

SEQ ID NO: 1173614 - RNA, 19 nt, Homo sapiens
gagaugcuacaaugcaaua

SEQ ID NO: 1173615 - RNA, 19 nt, Homo sapiens
ggaaggaaacucaaauucu

SEQ ID NO: 1173616 - RNA, 19 nt, Homo sapiens
agaucucuaugccaaauua

SEQ ID NO: 1173617 - RNA, 19 nt, Homo sapiens
caucaccucuucacuguca

SEQ ID NO: 1173618 - RNA, 19 nt, Homo sapiens
gcuccuaccuguguuucua

SEQ ID NO: 1173619 - RNA, 19 nt, Homo sapiens
ggaagcugcugugaugaga

SEQ ID NO: 1173620 - RNA, 19 nt, Homo sapiens
gugaaggaaucauuuaugg

SEQ ID NO: 1173621 - RNA, 19 nt, Homo sapiens
gaaguugugcacagauauu

SEQ ID NO: 1173622 - RNA, 19 nt, Homo sapiens
aaagagagggaacuaauug

SEQ ID NO: 1173623 - RNA, 19 nt, Homo sapiens
gaacugguggucuucaaug

SEQ ID NO: 1173624 - RNA, 19 nt, Homo sapiens
aaacaccagugaccauaga

SEQ ID NO: 1173625 - RNA, 19 nt, Homo sapiens
ugacguguauguacucaug

SEQ ID NO: 1173626 - RNA, 19 nt, Homo sapiens
aaacaccagugacuucuca

SEQ ID NO: 1173627 - RNA, 19 nt, Homo sapiens
cauggaguauucagagaaa

SEQ ID NO: 1173628 - RNA, 19 nt, Homo sapiens
agacauaacaguagcagaa

SEQ ID NO: 1173629 - RNA, 19 nt, Homo sapiens
ccagugacuucucaggaaa

SEQ ID NO: 1173630 - RNA, 19 nt, Homo sapiens
gaugcuacaaugcaauaua

SEQ ID NO: 1173631 - RNA, 19 nt, Homo sapiens
guaacuccauuucucugaa

SEQ ID NO: 1173632 - RNA, 19 nt, Homo sapiens
uaaagaagacgcuggagau

SEQ ID NO: 1173633 - RNA, 19 nt, Homo sapiens
caacagcacagaaaguuca

SEQ ID NO: 1173634 - RNA, 19 nt, Homo sapiens
gcaggcaacagcacagaaa

SEQ ID NO: 1173635 - RNA, 19 nt, Homo sapiens
ugugaaauguguuuacuuc

SEQ ID NO: 1173636 - RNA, 19 nt, Homo sapiens
guuuguuucucuucugaua

SEQ ID NO: 1173637 - RNA, 19 nt, Homo sapiens
gaucaaauggacuagagaa

SEQ ID NO: 1173638 - RNA, 19 nt, Homo sapiens
ggucuucaaugacaaaguc

SEQ ID NO: 1173639 - RNA, 19 nt, Homo sapiens
gaaacagaauauacaaucc

SEQ ID NO: 1173640 - RNA, 19 nt, Homo sapiens
uuacgucaaccucuucuua

SEQ ID NO: 1173641 - RNA, 19 nt, Homo sapiens
gagacuagaugagccuuca

SEQ ID NO: 1173642 - RNA, 19 nt, Homo sapiens
caucuuaccuggugugacu

SEQ ID NO: 1173643 - RNA, 19 nt, Homo sapiens
ggagagaugcuacaaugca

SEQ ID NO: 1173644 - RNA, 19 nt, Homo sapiens
gagcuacaauuacgucaac

SEQ ID NO: 1173645 - RNA, 19 nt, Homo sapiens
cuggagagaugcuacaaug

SEQ ID NO: 1173646 - RNA, 19 nt, Homo sapiens
uaaccaaggacuaauagga

SEQ ID NO: 1173647 - RNA, 19 nt, Homo sapiens
uagaugagccuucaacaca

SEQ ID NO: 1173648 - RNA, 19 nt, Homo sapiens
aaacagaagaggagucaga

SEQ ID NO: 1173649 - RNA, 19 nt, Homo sapiens
cagagacaauacaacuaaa

SEQ ID NO: 1173650 - RNA, 19 nt, Homo sapiens
acaauuacgucaaccucuu

SEQ ID NO: 1173651 - RNA, 19 nt, Homo sapiens
caucauguuugaagagcuu

SEQ ID NO: 1173652 - RNA, 19 nt, Homo sapiens
gguauuaugggauuauaug

SEQ ID NO: 1173653 - RNA, 19 nt, Homo sapiens
cacaaugagugcccaacaa

SEQ ID NO: 1173654 - RNA, 19 nt, Homo sapiens
cagcuuugguacuuuguga

SEQ ID NO: 1173655 - RNA, 19 nt, Homo sapiens
aggaucagccucauucuaa

SEQ ID NO: 1173656 - RNA, 19 nt, Homo sapiens
gaacuaauugcccgugaag

SEQ ID NO: 1173657 - RNA, 19 nt, Homo sapiens
caugugaaggaaucauuua

SEQ ID NO: 1173658 - RNA, 19 nt, Homo sapiens
caaguuaaggcacuguuga

SEQ ID NO: 1173659 - RNA, 19 nt, Homo sapiens
gaauauacaauccgaacuc

SEQ ID NO: 1173660 - RNA, 19 nt, Homo sapiens
gaauucacuucuggauguu

SEQ ID NO: 1173661 - RNA, 19 nt, Homo sapiens
ucauaagagcuaagcauuu

SEQ ID NO: 1173662 - RNA, 19 nt, Homo sapiens
gaacuggaaggaaacucaa

SEQ ID NO: 1173663 - RNA, 19 nt, Homo sapiens
cugcagacaucaccucuuc

SEQ ID NO: 1173664 - RNA, 19 nt, Homo sapiens
accaaggacuaauaggaua

SEQ ID NO: 1173665 - RNA, 19 nt, Homo sapiens
uaagagcuaagcauuucua

SEQ ID NO: 1173666 - RNA, 19 nt, Homo sapiens
gauuauaugcuucaguugu

SEQ ID NO: 1173667 - RNA, 19 nt, Homo sapiens
uaucuuaaccaaggacuaa

SEQ ID NO: 1173668 - RNA, 19 nt, Homo sapiens
cugauauccuucugcagua

SEQ ID NO: 1173669 - RNA, 19 nt, Homo sapiens
ccagagacaaugaucaaau

SEQ ID NO: 1173670 - RNA, 19 nt, Homo sapiens
gugaaagcaccuagugauu

SEQ ID NO: 1173671 - RNA, 19 nt, Homo sapiens
aaucggaaauagcaacaga

SEQ ID NO: 1173672 - RNA, 19 nt, Homo sapiens
aaagaagacauaacaguag

SEQ ID NO: 1173673 - RNA, 19 nt, Homo sapiens
gaggacaucuaugcucaca

SEQ ID NO: 1173674 - RNA, 19 nt, Homo sapiens
ucaacagugucucgcauuc

SEQ ID NO: 1173675 - RNA, 19 nt, Homo sapiens
gcaaguuaaggcacuguug

SEQ ID NO: 1173676 - RNA, 19 nt, Homo sapiens
gaccugagcuugagcauaa

SEQ ID NO: 1173677 - RNA, 19 nt, Homo sapiens
ccacaaagauguuaauguu

SEQ ID NO: 1173678 - RNA, 19 nt, Homo sapiens
gcacagaugucuuuuguua

SEQ ID NO: 1173679 - RNA, 19 nt, Homo sapiens
ggaauccaguggugaaaua

SEQ ID NO: 1173680 - RNA, 19 nt, Homo sapiens
gcacuuggauuuccuguug

SEQ ID NO: 1173681 - RNA, 19 nt, Homo sapiens
caacuccgcuuccucagua

SEQ ID NO: 1173682 - RNA, 19 nt, Homo sapiens
guagaaggauuucggaauu

SEQ ID NO: 1173683 - RNA, 19 nt, Homo sapiens
ggaaccagauaaagccuua

SEQ ID NO: 1173684 - RNA, 19 nt, Homo sapiens
gaaacaauccguucacuau

SEQ ID NO: 1173685 - RNA, 19 nt, Homo sapiens
cauaagaucugugggauuu

SEQ ID NO: 1173686 - RNA, 19 nt, Homo sapiens
ggaagcagauccauccauu

SEQ ID NO: 1173687 - RNA, 19 nt, Homo sapiens
gaaagacccuucuccaaag

SEQ ID NO: 1173688 - RNA, 19 nt, Homo sapiens
ggaccucccuuguaugaaa

SEQ ID NO: 1173689 - RNA, 19 nt, Homo sapiens
gaagaucccaccauacuuu

SEQ ID NO: 1173690 - RNA, 19 nt, Homo sapiens
gaaagaaacccuugaacug

SEQ ID NO: 1173691 - RNA, 19 nt, Homo sapiens
uuaagugccuugcaaauuu

SEQ ID NO: 1173692 - RNA, 19 nt, Homo sapiens
gguauacagucacuucuaa

SEQ ID NO: 1173693 - RNA, 19 nt, Homo sapiens
ggaauaugguccaguccua

SEQ ID NO: 1173694 - RNA, 19 nt, Homo sapiens
gcaacccucucauauagaa

SEQ ID NO: 1173695 - RNA, 19 nt, Homo sapiens
uaagugccuugcaaauuua

SEQ ID NO: 1173696 - RNA, 19 nt, Homo sapiens
gaagagauccuggccguuu

SEQ ID NO: 1173697 - RNA, 19 nt, Homo sapiens
gaaggaggcaugcagagua

SEQ ID NO: 1173698 - RNA, 19 nt, Homo sapiens
ugacuuagcagccauuuaa

SEQ ID NO: 1173699 - RNA, 19 nt, Homo sapiens
ccagagcccugcagaauuc

SEQ ID NO: 1173700 - RNA, 19 nt, Homo sapiens
ucagcaaucugccgaauga

SEQ ID NO: 1173701 - RNA, 19 nt, Homo sapiens
acaauccguucacuauuua

SEQ ID NO: 1173702 - RNA, 19 nt, Homo sapiens
uagaaggauuucggaauua

SEQ ID NO: 1173703 - RNA, 19 nt, Homo sapiens
aacagaagcugccaugaaa

SEQ ID NO: 1173704 - RNA, 19 nt, Homo sapiens
ugaaagacccuucuccaaa

SEQ ID NO: 1173705 - RNA, 19 nt, Homo sapiens
ucugugggauuucaucuua

SEQ ID NO: 1173706 - RNA, 19 nt, Homo sapiens
gaagagugaagacaccaua

SEQ ID NO: 1173707 - RNA, 19 nt, Homo sapiens
gcaagaaucgcuuagugaa

SEQ ID NO: 1173708 - RNA, 19 nt, Homo sapiens
caggagagcugcaguacau

SEQ ID NO: 1173709 - RNA, 19 nt, Homo sapiens
caauauugaugucacuuga

SEQ ID NO: 1173710 - RNA, 19 nt, Homo sapiens
gaacugggcacaggcuuaa

SEQ ID NO: 1173711 - RNA, 19 nt, Homo sapiens
guacugcaauggcuccaaa

SEQ ID NO: 1173712 - RNA, 19 nt, Homo sapiens
aacaauccguucacuauuu

SEQ ID NO: 1173713 - RNA, 19 nt, Homo sapiens
gaacugagugggaauaugg

SEQ ID NO: 1173714 - RNA, 19 nt, Homo sapiens
uaacagaagcugccaugaa

SEQ ID NO: 1173715 - RNA, 19 nt, Homo sapiens
gaagaaacgucaguuagcu

SEQ ID NO: 1173716 - RNA, 19 nt, Homo sapiens
cagugaagaucccaccaua

SEQ ID NO: 1173717 - RNA, 19 nt, Homo sapiens
gaauggcccuuaaacacau

SEQ ID NO: 1173718 - RNA, 19 nt, Homo sapiens
gugauguucuggacuauga

SEQ ID NO: 1173719 - RNA, 19 nt, Homo sapiens
ccacgcaccuuuaccugaa

SEQ ID NO: 1173720 - RNA, 19 nt, Homo sapiens
gaacagcacuuggauuucc

SEQ ID NO: 1173721 - RNA, 19 nt, Homo sapiens
ugacucaucuggaucacaa

SEQ ID NO: 1173722 - RNA, 19 nt, Homo sapiens
gcaaaugcaauauugaugu

SEQ ID NO: 1173723 - RNA, 19 nt, Homo sapiens
ccucggaccucccuuguau

SEQ ID NO: 1173724 - RNA, 19 nt, Homo sapiens
ugacaucggucgugacauc

SEQ ID NO: 1173725 - RNA, 19 nt, Homo sapiens
gaacuuggcagcccacagu

SEQ ID NO: 1173726 - RNA, 19 nt, Homo sapiens
cagcaagaaucgcuuagug

SEQ ID NO: 1173727 - RNA, 19 nt, Homo sapiens
ccagaggccuucagcaauc

SEQ ID NO: 1173728 - RNA, 19 nt, Homo sapiens
gaccguuacucagauaauu

SEQ ID NO: 1173729 - RNA, 19 nt, Homo sapiens
agaaucaucuugucagcaa

SEQ ID NO: 1173730 - RNA, 19 nt, Homo sapiens
aaagaaacccuugaacuga

SEQ ID NO: 1173731 - RNA, 19 nt, Homo sapiens
gguaauagcaauucagcaa

SEQ ID NO: 1173732 - RNA, 19 nt, Homo sapiens
ggugggagaaugaaacuaa

SEQ ID NO: 1173733 - RNA, 19 nt, Homo sapiens
uuacagguauugacucuuc

SEQ ID NO: 1173734 - RNA, 19 nt, Homo sapiens
ucacagaccguuacucaga

SEQ ID NO: 1173735 - RNA, 19 nt, Homo sapiens
cauauacuauuucggcuau

SEQ ID NO: 1173736 - RNA, 19 nt, Homo sapiens
uaucaaaugcaccuuauga

SEQ ID NO: 1173737 - RNA, 19 nt, Homo sapiens
uuagagaguugcacagaug

SEQ ID NO: 1173738 - RNA, 19 nt, Homo sapiens
ugaugacucuuacauugaa

SEQ ID NO: 1173739 - RNA, 19 nt, Homo sapiens
cuugaugacucuuacauug

SEQ ID NO: 1173740 - RNA, 19 nt, Homo sapiens
gaguuugccuuuagaugga

SEQ ID NO: 1173741 - RNA, 19 nt, Homo sapiens
ggacguuagugcucuucuu

SEQ ID NO: 1173742 - RNA, 19 nt, Homo sapiens
ugaagacaccauagacuuu

SEQ ID NO: 1173743 - RNA, 19 nt, Homo sapiens
cugcaacccucucauauag

SEQ ID NO: 1173744 - RNA, 19 nt, Homo sapiens
ggaaacaccagacccaagu

SEQ ID NO: 1173745 - RNA, 19 nt, Homo sapiens
caaaugcaauauugauguc

SEQ ID NO: 1173746 - RNA, 19 nt, Homo sapiens
caacaccggacucuuaaug

SEQ ID NO: 1173747 - RNA, 19 nt, Homo sapiens
gaggagucagguuguaaua

SEQ ID NO: 1173748 - RNA, 19 nt, Homo sapiens
gaaggcggcaguaggaaga

SEQ ID NO: 1173749 - RNA, 19 nt, Homo sapiens
caccauacuuucuagaugu

SEQ ID NO: 1173750 - RNA, 19 nt, Homo sapiens
ccaccauacuuucuagaug

SEQ ID NO: 1173751 - RNA, 19 nt, Homo sapiens
guggugauguucuggacua

SEQ ID NO: 1173752 - RNA, 19 nt, Homo sapiens
uaagaucugugggauuuca

SEQ ID NO: 1173753 - RNA, 19 nt, Homo sapiens
ccuaauuucuacuguucua

SEQ ID NO: 1173754 - RNA, 19 nt, Homo sapiens
gcccuaauuucuacuguuc

SEQ ID NO: 1173755 - RNA, 19 nt, Homo sapiens
aaggaggcaugcagaguaa

SEQ ID NO: 1173756 - RNA, 19 nt, Homo sapiens
ggucagcaguagugaguca

SEQ ID NO: 1173757 - RNA, 19 nt, Homo sapiens
gcgaacaccuaucaaacca

SEQ ID NO: 1173758 - RNA, 19 nt, Homo sapiens
acaccggacucuuaaugaa

SEQ ID NO: 1173759 - RNA, 19 nt, Homo sapiens
uaacaaaucagugaagauc

SEQ ID NO: 1173760 - RNA, 19 nt, Homo sapiens
guuaacaaaucagugaaga

SEQ ID NO: 1173761 - RNA, 19 nt, Homo sapiens
caagaaucgcuuagugaaa

SEQ ID NO: 1173762 - RNA, 19 nt, Homo sapiens
guccagaguuugccuuuag

SEQ ID NO: 1173763 - RNA, 19 nt, Homo sapiens
ggagagcugcaguacauug

SEQ ID NO: 1173764 - RNA, 19 nt, Homo sapiens
aggcaacaccggacucuua

SEQ ID NO: 1173765 - RNA, 19 nt, Homo sapiens
gaaugcuuguuaugcaaug

SEQ ID NO: 1173766 - RNA, 19 nt, Homo sapiens
agacgcagcaaaugcaaua

SEQ ID NO: 1173767 - RNA, 19 nt, Homo sapiens
auaauuaagugccuugcaa

SEQ ID NO: 1173768 - RNA, 19 nt, Homo sapiens
gcaaagugagccagcuuau

SEQ ID NO: 1173769 - RNA, 19 nt, Homo sapiens
acagguaauuguugaugaa

SEQ ID NO: 1173770 - RNA, 19 nt, Homo sapiens
ucaaccaccuuuggaguga

SEQ ID NO: 1173771 - RNA, 19 nt, Homo sapiens
gcacugauucaccucuuga

SEQ ID NO: 1173772 - RNA, 19 nt, Homo sapiens
gcaauauugaugucacuug

SEQ ID NO: 1173773 - RNA, 19 nt, Homo sapiens
cgcagcaaaugcaauauug

SEQ ID NO: 1173774 - RNA, 19 nt, Homo sapiens
gagaggugauuugcaagug

SEQ ID NO: 1173775 - RNA, 19 nt, Homo sapiens
gcaaggggcuacuuuucaa

SEQ ID NO: 1173776 - RNA, 19 nt, Homo sapiens
gaacgaagcagauuuguaa

SEQ ID NO: 1173777 - RNA, 19 nt, Homo sapiens
gcaaaucgguucauuggaa

SEQ ID NO: 1173778 - RNA, 19 nt, Homo sapiens
aaacacaccucacuuauug

SEQ ID NO: 1173779 - RNA, 19 nt, Homo sapiens
gcaaguaccugucaugaag

SEQ ID NO: 1173780 - RNA, 19 nt, Homo sapiens
aaacagaagucaugaaugu

SEQ ID NO: 1173781 - RNA, 19 nt, Homo sapiens
gaaagcaaaugaacuucuu

SEQ ID NO: 1173782 - RNA, 19 nt, Homo sapiens
gaacagauccgacgaugga

SEQ ID NO: 1173783 - RNA, 19 nt, Homo sapiens
gagcaaacaucgcugaguu

SEQ ID NO: 1173784 - RNA, 19 nt, Homo sapiens
ggaauucaaugucaagaga

SEQ ID NO: 1173785 - RNA, 19 nt, Homo sapiens
gguaugaccuuaaugaugu

SEQ ID NO: 1173786 - RNA, 19 nt, Homo sapiens
gaggacggcuguaaacauu

SEQ ID NO: 1173787 - RNA, 19 nt, Homo sapiens
gaugugcucuguaaugaaa

SEQ ID NO: 1173788 - RNA, 19 nt, Homo sapiens
ccaguuugcugaauuauug

SEQ ID NO: 1173789 - RNA, 19 nt, Homo sapiens
gcaaaugaacuucuucuga

SEQ ID NO: 1173790 - RNA, 19 nt, Homo sapiens
caaagcagcugaugagaag

SEQ ID NO: 1173791 - RNA, 19 nt, Homo sapiens
gcaaagaugcugaaacaga

SEQ ID NO: 1173792 - RNA, 19 nt, Homo sapiens
gacaugaaguuucgaaguu

SEQ ID NO: 1173793 - RNA, 19 nt, Homo sapiens
gaaguuucauguuggcuuu

SEQ ID NO: 1173794 - RNA, 19 nt, Homo sapiens
gaaauuaagguguacuuga

SEQ ID NO: 1173795 - RNA, 19 nt, Homo sapiens
gaaagagaauggcaaaucg

SEQ ID NO: 1173796 - RNA, 19 nt, Homo sapiens
gugcaaagaugcugaaaca

SEQ ID NO: 1173797 - RNA, 19 nt, Homo sapiens
gaagaaagaaucuaugaag

SEQ ID NO: 1173798 - RNA, 19 nt, Homo sapiens
gcagauauagucaagauga

SEQ ID NO: 1173799 - RNA, 19 nt, Homo sapiens
caaagaugcugaaacagau

SEQ ID NO: 1173800 - RNA, 19 nt, Homo sapiens
ccuaugaugugcucuguaa

SEQ ID NO: 1173801 - RNA, 19 nt, Homo sapiens
caagaaagcaaaugaacuu

SEQ ID NO: 1173802 - RNA, 19 nt, Homo sapiens
gaaagaagacucggaaugg

SEQ ID NO: 1173803 - RNA, 19 nt, Homo sapiens
uguaagagcuggaaagaag

SEQ ID NO: 1173804 - RNA, 19 nt, Homo sapiens
cuaaagacaucuggaagaa

SEQ ID NO: 1173805 - RNA, 19 nt, Homo sapiens
ggacaugagagacauagaa

SEQ ID NO: 1173806 - RNA, 19 nt, Homo sapiens
ggaaagaagacucggaaug

SEQ ID NO: 1173807 - RNA, 19 nt, Homo sapiens
ggaagaaaguggcagaaaa

SEQ ID NO: 1173808 - RNA, 19 nt, Homo sapiens
gcgaacaccaucuagauaa

SEQ ID NO: 1173809 - RNA, 19 nt, Homo sapiens
caaaucgguucauuggaaa

SEQ ID NO: 1173810 - RNA, 19 nt, Homo sapiens
uggcugagaugaugcuuaa

SEQ ID NO: 1173811 - RNA, 19 nt, Homo sapiens
gcacaaauacuggaauuca

SEQ ID NO: 1173812 - RNA, 19 nt, Homo sapiens
ggacggcuguaaacauuuc

SEQ ID NO: 1173813 - RNA, 19 nt, Homo sapiens
gacaucauccggugguuua

SEQ ID NO: 1173814 - RNA, 19 nt, Homo sapiens
ggaauucucacacucaaga

SEQ ID NO: 1173815 - RNA, 19 nt, Homo sapiens
ucaaauagaagaagagaga

SEQ ID NO: 1173816 - RNA, 19 nt, Homo sapiens
aaagacaucuggaagaaag

SEQ ID NO: 1173817 - RNA, 19 nt, Homo sapiens
cgaacaccaucuagauaaa

SEQ ID NO: 1173818 - RNA, 19 nt, Homo sapiens
gcaggaaagugagcaaaca

SEQ ID NO: 1173819 - RNA, 19 nt, Homo sapiens
caauacugaucaacugaaa

SEQ ID NO: 1173820 - RNA, 19 nt, Homo sapiens
uagccaguuugcugaauua

SEQ ID NO: 1173821 - RNA, 19 nt, Homo sapiens
gaagaauaaaugucuguug

SEQ ID NO: 1173822 - RNA, 19 nt, Homo sapiens
gaagagagaguuuugguaa

SEQ ID NO: 1173823 - RNA, 19 nt, Homo sapiens
uaucagaagugcuuagaca

SEQ ID NO: 1173824 - RNA, 19 nt, Homo sapiens
gcuaugcccuguccuaucu

SEQ ID NO: 1173825 - RNA, 19 nt, Homo sapiens
gaacuggaagaauaaaugu

SEQ ID NO: 1173826 - RNA, 19 nt, Homo sapiens
caaaauauauggugaaguc

SEQ ID NO: 1173827 - RNA, 19 nt, Homo sapiens
aagcagcuauggaaagaaa

SEQ ID NO: 1173828 - RNA, 19 nt, Homo sapiens
aauagggucuuugcagaua

SEQ ID NO: 1173829 - RNA, 19 nt, Homo sapiens
caccaacccuggaagaaga

SEQ ID NO: 1173830 - RNA, 19 nt, Homo sapiens
ugucggagauguacauaga

SEQ ID NO: 1173831 - RNA, 19 nt, Homo sapiens
cagaagugcuuagacaaga

SEQ ID NO: 1173832 - RNA, 19 nt, Homo sapiens
guaaacauuuccucaucga

SEQ ID NO: 1173833 - RNA, 19 nt, Homo sapiens
cagaagucaugaauguaaa

SEQ ID NO: 1173834 - RNA, 19 nt, Homo sapiens
guagccaguuugcugaauu

SEQ ID NO: 1173835 - RNA, 19 nt, Homo sapiens
gaggcaaguuggagugaug

SEQ ID NO: 1173836 - RNA, 19 nt, Homo sapiens
aaugggaccuuguuuggaa

SEQ ID NO: 1173837 - RNA, 19 nt, Homo sapiens
gacaagaacagaauaagca

SEQ ID NO: 1173838 - RNA, 19 nt, Homo sapiens
cagaagaaagaaucuauga

SEQ ID NO: 1173839 - RNA, 19 nt, Homo sapiens
uggcagagcucagcgaaga

SEQ ID NO: 1173840 - RNA, 19 nt, Homo sapiens
aagaugaggucacauugga

SEQ ID NO: 1173841 - RNA, 19 nt, Homo sapiens
acagaagucaugaauguaa

SEQ ID NO: 1173842 - RNA, 19 nt, Homo sapiens
uggcggauuugguggaaua

SEQ ID NO: 1173843 - RNA, 19 nt, Homo sapiens
gagagaacgaagcagauuu

SEQ ID NO: 1173844 - RNA, 19 nt, Homo sapiens
agaagcagcuauggaaaga

SEQ ID NO: 1173845 - RNA, 19 nt, Homo sapiens
gcucagcgaagaacagaaa

SEQ ID NO: 1173846 - RNA, 19 nt, Homo sapiens
ccaaugacuggcauccuua

SEQ ID NO: 1173847 - RNA, 19 nt, Homo sapiens
agaauaagcaggcuguuug

SEQ ID NO: 1173848 - RNA, 19 nt, Homo sapiens
gaagggacaccaaggaucu

SEQ ID NO: 1173849 - RNA, 19 nt, Homo sapiens
gaugaggucacauuggauu

SEQ ID NO: 1173850 - RNA, 19 nt, Homo sapiens
uagauaaacccuaugaugu

SEQ ID NO: 1173851 - RNA, 19 nt, Homo sapiens
gcgaagaacagaaacagau

SEQ ID NO: 1173852 - RNA, 19 nt, Homo sapiens
gacaugagagacauagaaa

SEQ ID NO: 1173853 - RNA, 19 nt, Homo sapiens
ccaaagcagcugaugagaa

SEQ ID NO: 1173854 - RNA, 19 nt, Homo sapiens
gaugagagaggaacagauc

SEQ ID NO: 1173855 - RNA, 19 nt, Homo sapiens
cacaaauacuggaauucaa

SEQ ID NO: 1173856 - RNA, 19 nt, Homo sapiens
gagaagacuacaagagguu

SEQ ID NO: 1173857 - RNA, 19 nt, Homo sapiens
cggauaaccagcagacuaa

SEQ ID NO: 1173858 - RNA, 19 nt, Homo sapiens
uagggucuuugcagauaua

SEQ ID NO: 1173859 - RNA, 19 nt, Homo sapiens
gaaaggaucaaaggcuaug

SEQ ID NO: 1173860 - RNA, 19 nt, Homo sapiens
gaaaaccucagacaccaua

SEQ ID NO: 1173861 - RNA, 19 nt, Homo sapiens
cgaagcagauuuguaagag

SEQ ID NO: 1173862 - RNA, 19 nt, Homo sapiens
cauaugcauuucaccagaa

SEQ ID NO: 1173863 - RNA, 19 nt, Homo sapiens
ggacaagaggcaaguugga

SEQ ID NO: 1173864 - RNA, 19 nt, Homo sapiens
ggaugcuacuugugguuga

SEQ ID NO: 1173865 - RNA, 19 nt, Homo sapiens
acaugaaguuucgaaguuu

SEQ ID NO: 1173866 - RNA, 19 nt, Homo sapiens
cggauuugguggaauauca

SEQ ID NO: 1173867 - RNA, 19 nt, Homo sapiens
gaaggcauaugcauuucac

SEQ ID NO: 1173868 - RNA, 19 nt, Homo sapiens
aaagaaagagaauggcaaa

SEQ ID NO: 1173869 - RNA, 19 nt, Homo sapiens
gguaauagacacaaaugca

SEQ ID NO: 1173870 - RNA, 19 nt, Homo sapiens
guaugaccuuaaugaugua

SEQ ID NO: 1173871 - RNA, 19 nt, Homo sapiens
gcagagccaauacugauca

SEQ ID NO: 1173872 - RNA, 19 nt, Homo sapiens
cuagauaaacccuaugaug

SEQ ID NO: 1173873 - RNA, 19 nt, Homo sapiens
ggcgaacaccaucuagaua

SEQ ID NO: 1173874 - RNA, 19 nt, Homo sapiens
gauaaggaagucuggguau

SEQ ID NO: 1173875 - RNA, 19 nt, Homo sapiens
agagagaguuuugguaaua

SEQ ID NO: 1173876 - RNA, 19 nt, Homo sapiens
cuaaaucagugaaguguua

SEQ ID NO: 1173877 - RNA, 19 nt, Homo sapiens
cagguuaucuucauuguaa

SEQ ID NO: 1173878 - RNA, 19 nt, Homo sapiens
aaacagauuugcaaaguug

SEQ ID NO: 1173879 - RNA, 19 nt, Homo sapiens
ucagugaaguguuaccuua

SEQ ID NO: 1173880 - RNA, 19 nt, Homo sapiens
ggaaaaggauuuacauuug

SEQ ID NO: 1173881 - RNA, 19 nt, Homo sapiens
aaucuaggcuugagaauug

SEQ ID NO: 1173882 - RNA, 19 nt, Homo sapiens
gcaauaugcuguccugcuu

SEQ ID NO: 1173883 - RNA, 19 nt, Homo sapiens
guacaccuguuguuugaaa

SEQ ID NO: 1173884 - RNA, 19 nt, Homo sapiens
gaucgaagcugguuguuuu

SEQ ID NO: 1173885 - RNA, 19 nt, Homo sapiens
gcaaaguuguguuggauca

SEQ ID NO: 1173886 - RNA, 19 nt, Homo sapiens
caauguauguagccaaauu

SEQ ID NO: 1173887 - RNA, 19 nt, Homo sapiens
uaaagugucugaauuggau

SEQ ID NO: 1173888 - RNA, 19 nt, Homo sapiens
ccaggaaugugggcucuua

SEQ ID NO: 1173889 - RNA, 19 nt, Homo sapiens
ccacagccuuugauaaaug

SEQ ID NO: 1173890 - RNA, 19 nt, Homo sapiens
ccgaaucccuucagaaaga

SEQ ID NO: 1173891 - RNA, 19 nt, Homo sapiens
gaugguguuuguucuauau

SEQ ID NO: 1173892 - RNA, 19 nt, Homo sapiens
ggagaugccuggaauacag

SEQ ID NO: 1173893 - RNA, 19 nt, Homo sapiens
gcguacaccuguuguuuga

SEQ ID NO: 1173894 - RNA, 19 nt, Homo sapiens
gaauuguucagguguauuu

SEQ ID NO: 1173895 - RNA, 19 nt, Homo sapiens
gaugugaucagugaaauuu

SEQ ID NO: 1173896 - RNA, 19 nt, Homo sapiens
ugacccagcugaaagcaaa

SEQ ID NO: 1173897 - RNA, 19 nt, Homo sapiens
gaaugugggcucuuaguga

SEQ ID NO: 1173898 - RNA, 19 nt, Homo sapiens
gaauuugccucuucuacag

SEQ ID NO: 1173899 - RNA, 19 nt, Homo sapiens
ucagaaagacaccaaauug

SEQ ID NO: 1173900 - RNA, 19 nt, Homo sapiens
uaagggagauacuaacauc

SEQ ID NO: 1173901 - RNA, 19 nt, Homo sapiens
ggcagacguuggaaucuuu

SEQ ID NO: 1173902 - RNA, 19 nt, Homo sapiens
aguguuggcucuggaauua

SEQ ID NO: 1173903 - RNA, 19 nt, Homo sapiens
ucaguucccuggaggcuuu

SEQ ID NO: 1173904 - RNA, 19 nt, Homo sapiens
gauuuaagguggugcagau

SEQ ID NO: 1173905 - RNA, 19 nt, Homo sapiens
gaacucaguacauguuaau

SEQ ID NO: 1173906 - RNA, 19 nt, Homo sapiens
gacaugaauuuguaaacug

SEQ ID NO: 1173907 - RNA, 19 nt, Homo sapiens
ggagaugcccagccugaaa

SEQ ID NO: 1173908 - RNA, 19 nt, Homo sapiens
gagaauuguucagguguau

SEQ ID NO: 1173909 - RNA, 19 nt, Homo sapiens
gcagaugguguuuguucua

SEQ ID NO: 1173910 - RNA, 19 nt, Homo sapiens
caucaugccuauggacauu

SEQ ID NO: 1173911 - RNA, 19 nt, Homo sapiens
cuguuaaggucugcaauua

SEQ ID NO: 1173912 - RNA, 19 nt, Homo sapiens
gaaucuaggcuugagaauu

SEQ ID NO: 1173913 - RNA, 19 nt, Homo sapiens
caagaugugaucagugaaa

SEQ ID NO: 1173914 - RNA, 19 nt, Homo sapiens
gaugcuccguguucaaaug

SEQ ID NO: 1173915 - RNA, 19 nt, Homo sapiens
ggccgaaucccuucagaaa

SEQ ID NO: 1173916 - RNA, 19 nt, Homo sapiens
gauacuaacaucuccauca

SEQ ID NO: 1173917 - RNA, 19 nt, Homo sapiens
ggaaaauggugacaugaau

SEQ ID NO: 1173918 - RNA, 19 nt, Homo sapiens
ggaauuugccucuucuaca

SEQ ID NO: 1173919 - RNA, 19 nt, Homo sapiens
ugagaauuguucaggugua

SEQ ID NO: 1173920 - RNA, 19 nt, Homo sapiens
guagccaaauugaagaaau

SEQ ID NO: 1173921 - RNA, 19 nt, Homo sapiens
uaugauagucugagauuga

SEQ ID NO: 1173922 - RNA, 19 nt, Homo sapiens
ugaauaugauagucugaga

SEQ ID NO: 1173923 - RNA, 19 nt, Homo sapiens
aauaugcuguccugcuuaa

SEQ ID NO: 1173924 - RNA, 19 nt, Homo sapiens
ugaacucaguacauguuaa

SEQ ID NO: 1173925 - RNA, 19 nt, Homo sapiens
ccaacuauccuaaaucagu

SEQ ID NO: 1173926 - RNA, 19 nt, Homo sapiens
aaaguuguguuggaucauu

SEQ ID NO: 1173927 - RNA, 19 nt, Homo sapiens
ccuaaaugcugcuucucuu

SEQ ID NO: 1173928 - RNA, 19 nt, Homo sapiens
ccaaauugaagaaaucaug

SEQ ID NO: 1173929 - RNA, 19 nt, Homo sapiens
cagaugguguuuguucuau

SEQ ID NO: 1173930 - RNA, 19 nt, Homo sapiens
ucuuagugauuccagauaa

SEQ ID NO: 1173931 - RNA, 19 nt, Homo sapiens
gguaacaucaugccuaugg

SEQ ID NO: 1173932 - RNA, 19 nt, Homo sapiens
ugaauuggauggcagaaaa

SEQ ID NO: 1173933 - RNA, 19 nt, Homo sapiens
cugcuuaaccgauucaauu

SEQ ID NO: 1173934 - RNA, 19 nt, Homo sapiens
cccaauguauguagccaaa

SEQ ID NO: 1173935 - RNA, 19 nt, Homo sapiens
ucaugccuauggacauuaa

SEQ ID NO: 1173936 - RNA, 19 nt, Homo sapiens
gcgaaucccggaagucaga

SEQ ID NO: 1173937 - RNA, 19 nt, Homo sapiens
uuacccaacuauccuaaau

SEQ ID NO: 1173938 - RNA, 19 nt, Homo sapiens
gaauacaguaagggagaua

SEQ ID NO: 1173939 - RNA, 19 nt, Homo sapiens
ggaauacaguaagggagau

SEQ ID NO: 1173940 - RNA, 19 nt, Homo sapiens
guauguagccaaauugaag

SEQ ID NO: 1173941 - RNA, 19 nt, Homo sapiens
ucccacagccuuugauaaa

SEQ ID NO: 1173942 - RNA, 19 nt, Homo sapiens
caauaugcuguccugcuua

SEQ ID NO: 1173943 - RNA, 19 nt, Homo sapiens
uagccaaauugaagaaauc

SEQ ID NO: 1173944 - RNA, 19 nt, Homo sapiens
ggaaugugggcucuuagug

SEQ ID NO: 1173945 - RNA, 19 nt, Homo sapiens
gacauuaaaggaauagcaa

SEQ ID NO: 1173946 - RNA, 19 nt, Homo sapiens
ggacauuaaaggaauagca

SEQ ID NO: 1173947 - RNA, 19 nt, Homo sapiens
gcuguuaaggucugcaauu

SEQ ID NO: 1173948 - RNA, 19 nt, Homo sapiens
caaaugaucgaagcugguu

SEQ ID NO: 1173949 - RNA, 19 nt, Homo sapiens
gagaugcccagccugaaau

SEQ ID NO: 1173950 - RNA, 19 nt, Homo sapiens
ucccacgacuucacauuug

SEQ ID NO: 1173951 - RNA, 19 nt, Homo sapiens
cuauggacauuaaaggaau

SEQ ID NO: 1173952 - RNA, 19 nt, Homo sapiens
uaagucaaaggaggaauuu

SEQ ID NO: 1173953 - RNA, 19 nt, Homo sapiens
uaaaucugcugucuuugcu

SEQ ID NO: 1173954 - RNA, 19 nt, Homo sapiens
auggugacaugaauuugua

SEQ ID NO: 1173955 - RNA, 19 nt, Homo sapiens
gaaaauggugacaugaauu

SEQ ID NO: 1173956 - RNA, 19 nt, Homo sapiens
guaacaucaugccuaugga

SEQ ID NO: 1173957 - RNA, 19 nt, Homo sapiens
ugcccagccugaaauguuu

SEQ ID NO: 1173958 - RNA, 19 nt, Homo sapiens
cuuaaccgauucaauuauc

SEQ ID NO: 1173959 - RNA, 19 nt, Homo sapiens
ccaucaugcuggcaauaug

SEQ ID NO: 1173960 - RNA, 19 nt, Homo sapiens
acccaacuauccuaaauca

SEQ ID NO: 1173961 - RNA, 19 nt, Homo sapiens
gugcagaugguguuuguuc

SEQ ID NO: 1173962 - RNA, 19 nt, Homo sapiens
auacuaacaucuccaucau

SEQ ID NO: 1173963 - RNA, 19 nt, Homo sapiens
agaugguguuuguucuaua

SEQ ID NO: 1173964 - RNA, 19 nt, Homo sapiens
uaaggcagacguuggaauc

SEQ ID NO: 1173965 - RNA, 19 nt, Homo sapiens
aaugugggcucuuagugau

SEQ ID NO: 1173966 - RNA, 19 nt, Homo sapiens
gaauaugauagucugagau

SEQ ID NO: 1173967 - RNA, 19 nt, Homo sapiens
acucggagaugccuggaau

SEQ ID NO: 1173968 - RNA, 19 nt, Homo sapiens
ggacuugcucccacgacuu

SEQ ID NO: 1173969 - RNA, 19 nt, Homo sapiens
aaacaguauuccaaagaac

SEQ ID NO: 1173970 - RNA, 19 nt, Homo sapiens
gcuuggcauuuuauaguua

SEQ ID NO: 1173971 - RNA, 19 nt, Homo sapiens
gauuugcaaaguuguguug

SEQ ID NO: 1173972 - RNA, 19 nt, Homo sapiens
ccuauggacauuaaaggaa

SEQ ID NO: 1173973 - RNA, 19 nt, Homo sapiens
cuacaugcacgcuuuccaa

SEQ ID NO: 1173974 - RNA, 19 nt, Homo sapiens
guaagggagauacuaacau

SEQ ID NO: 1173975 - RNA, 19 nt, Homo sapiens
aaucauggagcacaggaaa

SEQ ID NO: 1173976 - RNA, 19 nt, Homo sapiens
gaaaguaagugcucagaaa

SEQ ID NO: 1173977 - RNA, 19 nt, Homo sapiens
gauagucacucuucccaua

SEQ ID NO: 1173978 - RNA, 19 nt, Homo sapiens
gggaauggcuuauggaguu

SEQ ID NO: 1173979 - RNA, 19 nt, Homo sapiens
acuaugagauggacuauaa

SEQ ID NO: 1173980 - RNA, 19 nt, Homo sapiens
gaaaugaucucaaaaccuu

SEQ ID NO: 1173981 - RNA, 19 nt, Homo sapiens
gaugaggacuugugagaau

SEQ ID NO: 1173982 - RNA, 19 nt, Homo sapiens
agagcuaaaugcuugauua

SEQ ID NO: 1173983 - RNA, 19 nt, Homo sapiens
gcagcaaugucuuuaaaca

SEQ ID NO: 1173984 - RNA, 19 nt, Homo sapiens
caugaugacugcuguuuga

SEQ ID NO: 1173985 - RNA, 19 nt, Homo sapiens
gugcugggauuacaaguuu

SEQ ID NO: 1173986 - RNA, 19 nt, Homo sapiens
ugacuaugcuguccugaaa

SEQ ID NO: 1173987 - RNA, 19 nt, Homo sapiens
gguuugagauacauaauga

SEQ ID NO: 1173988 - RNA, 19 nt, Homo sapiens
cuaagcacaugaagaaauu

SEQ ID NO: 1173989 - RNA, 19 nt, Homo sapiens
gaauauauggguccugaaa

SEQ ID NO: 1173990 - RNA, 19 nt, Homo sapiens
caagggauaucuuaaacau

SEQ ID NO: 1173991 - RNA, 19 nt, Homo sapiens
gggcugcaauuaaugcuaa

SEQ ID NO: 1173992 - RNA, 19 nt, Homo sapiens
gacuauaacuugcccaaau

SEQ ID NO: 1173993 - RNA, 19 nt, Homo sapiens
gaauccauccuccuugaua

SEQ ID NO: 1173994 - RNA, 19 nt, Homo sapiens
gaagcaggcauguaagauu

SEQ ID NO: 1173995 - RNA, 19 nt, Homo sapiens
agaagaagcaggcauguaa

SEQ ID NO: 1173996 - RNA, 19 nt, Homo sapiens
cuacuaaagccauacaaua

SEQ ID NO: 1173997 - RNA, 19 nt, Homo sapiens
caaggaaacaaacuacuuu

SEQ ID NO: 1173998 - RNA, 19 nt, Homo sapiens
aagcaggcauguaagauuu

SEQ ID NO: 1173999 - RNA, 19 nt, Homo sapiens
gaauagagccaaguaagug

SEQ ID NO: 1174000 - RNA, 19 nt, Homo sapiens
caaccaagccugcaaaucu

SEQ ID NO: 1174001 - RNA, 19 nt, Homo sapiens
cuuaguggguugauacaua

SEQ ID NO: 1174002 - RNA, 19 nt, Homo sapiens
gaaacugucggaauauaug

SEQ ID NO: 1174003 - RNA, 19 nt, Homo sapiens
gcaaugggaagaauaacaa

SEQ ID NO: 1174004 - RNA, 19 nt, Homo sapiens
cuaaagccauacaauauca

SEQ ID NO: 1174005 - RNA, 19 nt, Homo sapiens
gggaagaauaacaagauua

SEQ ID NO: 1174006 - RNA, 19 nt, Homo sapiens
gcugcuggcuuugcuuaua

SEQ ID NO: 1174007 - RNA, 19 nt, Homo sapiens
gaaggaaaauggacaacaa

SEQ ID NO: 1174008 - RNA, 19 nt, Homo sapiens
guccauauguauacucaaa

SEQ ID NO: 1174009 - RNA, 19 nt, Homo sapiens
acaaguaccuauggaacua

SEQ ID NO: 1174010 - RNA, 19 nt, Homo sapiens
uacugaaacugucggaaua

SEQ ID NO: 1174011 - RNA, 19 nt, Homo sapiens
caagcaaugggaagaauaa

SEQ ID NO: 1174012 - RNA, 19 nt, Homo sapiens
guucagguguuucacaaga

SEQ ID NO: 1174013 - RNA, 19 nt, Homo sapiens
agggauaucuuaaacauca

SEQ ID NO: 1174014 - RNA, 19 nt, Homo sapiens
uggcuaacuugcccuauuu

SEQ ID NO: 1174015 - RNA, 19 nt, Homo sapiens
caauacuacuaaagccaua

SEQ ID NO: 1174016 - RNA, 19 nt, Homo sapiens
auauauggguccugaaauu

SEQ ID NO: 1174017 - RNA, 19 nt, Homo sapiens
ugagauggacuauaacuug

SEQ ID NO: 1174018 - RNA, 19 nt, Homo sapiens
ccauauguauacucaaaga

SEQ ID NO: 1174019 - RNA, 19 nt, Homo sapiens
ggaauagagccaaguaagu

SEQ ID NO: 1174020 - RNA, 19 nt, Homo sapiens
gaugagugaugaggacuug

SEQ ID NO: 1174021 - RNA, 19 nt, Homo sapiens
aagagcagcuggcaugaug

SEQ ID NO: 1174022 - RNA, 19 nt, Homo sapiens
gcuauuaaggcaagggaua

SEQ ID NO: 1174023 - RNA, 19 nt, Homo sapiens
ggugacauuugguuaugaa

SEQ ID NO: 1174024 - RNA, 19 nt, Homo sapiens
uaagugggcaaccauaauu

SEQ ID NO: 1174025 - RNA, 19 nt, Homo sapiens
ccaaagugcugggauuaca

SEQ ID NO: 1174026 - RNA, 19 nt, Homo sapiens
ucagcaggauguagaaaug

SEQ ID NO: 1174027 - RNA, 19 nt, Homo sapiens
uaaaucagcaggauguaga

SEQ ID NO: 1174028 - RNA, 19 nt, Homo sapiens
ggacaacaaguaccuaugg

SEQ ID NO: 1174029 - RNA, 19 nt, Homo sapiens
agacaggguuucaccaugu

SEQ ID NO: 1174030 - RNA, 19 nt, Homo sapiens
guagaaaugaugagugaug

SEQ ID NO: 1174031 - RNA, 19 nt, Homo sapiens
guaccuauggaacuauaua

SEQ ID NO: 1174032 - RNA, 19 nt, Homo sapiens
ugagauacauaaugaagag

SEQ ID NO: 1174033 - RNA, 19 nt, Homo sapiens
cugcagcaaugucuuuaaa

SEQ ID NO: 1174034 - RNA, 19 nt, Homo sapiens
gaaauucagaagaugauag

SEQ ID NO: 1174035 - RNA, 19 nt, Homo sapiens
guacaguggugcgaucuca

SEQ ID NO: 1174036 - RNA, 19 nt, Homo sapiens
acuauaacuugcccaaauu

SEQ ID NO: 1174037 - RNA, 19 nt, Homo sapiens
uagaaaugaugagugauga

SEQ ID NO: 1174038 - RNA, 19 nt, Homo sapiens
cugcaaaucucccucuugu

SEQ ID NO: 1174039 - RNA, 19 nt, Homo sapiens
uaacauaagagcuaaaugc

SEQ ID NO: 1174040 - RNA, 19 nt, Homo sapiens
gacaacaaguaccuaugga

SEQ ID NO: 1174041 - RNA, 19 nt, Homo sapiens
ggaauggcuuauggaguug

SEQ ID NO: 1174042 - RNA, 19 nt, Homo sapiens
augaagagcuugacuaugc

SEQ ID NO: 1174043 - RNA, 19 nt, Homo sapiens
gagggugagugccgccauu

SEQ ID NO: 1174044 - RNA, 19 nt, Homo sapiens
ggaaaguaagugcucagaa

SEQ ID NO: 1174045 - RNA, 19 nt, Homo sapiens
gacauuugguuaugaagag

SEQ ID NO: 1174046 - RNA, 19 nt, Homo sapiens
cugaugugauuaccuauga

SEQ ID NO: 1174047 - RNA, 19 nt, Homo sapiens
cuauggaacuauauaaugg

SEQ ID NO: 1174048 - RNA, 19 nt, Homo sapiens
cugaaacugucggaauaua

SEQ ID NO: 1174049 - RNA, 19 nt, Homo sapiens
uaaugaagagcuugacuau

SEQ ID NO: 1174050 - RNA, 19 nt, Homo sapiens
gauaaccccucauaaagau

SEQ ID NO: 1174051 - RNA, 19 nt, Homo sapiens
caagauauucugcagcaau

SEQ ID NO: 1174052 - RNA, 19 nt, Homo sapiens
ggcaagggauaucuuaaac

SEQ ID NO: 1174053 - RNA, 19 nt, Homo sapiens
cagaaaguccagaguaugu

SEQ ID NO: 1174054 - RNA, 19 nt, Homo sapiens
uuaguggguugauacauau

SEQ ID NO: 1174055 - RNA, 19 nt, Homo sapiens
uaagggugacauuugguua

SEQ ID NO: 1174056 - RNA, 19 nt, Homo sapiens
gacaggguuucaccauguu

SEQ ID NO: 1174057 - RNA, 19 nt, Homo sapiens
gauacauaaugaagagcuu

SEQ ID NO: 1174058 - RNA, 19 nt, Homo sapiens
gcacaugaagaaauuaguc

SEQ ID NO: 1174059 - RNA, 19 nt, Homo sapiens
gauuaccuaugacacugaa

SEQ ID NO: 1174060 - RNA, 19 nt, Homo sapiens
gcagaaaguccagaguaug

SEQ ID NO: 1174061 - RNA, 19 nt, Homo sapiens
ggaaaauggacaacaagua

SEQ ID NO: 1174062 - RNA, 19 nt, Homo sapiens
guacagauaaccccucaua

SEQ ID NO: 1174063 - RNA, 19 nt, Homo sapiens
caugcaugcugcuggcuuu

SEQ ID NO: 1174064 - RNA, 19 nt, Homo sapiens
cagggacuaucacagaaga

SEQ ID NO: 1174065 - RNA, 19 nt, Homo sapiens
gcuuauggaguuguuauuu

SEQ ID NO: 1174066 - RNA, 19 nt, Homo sapiens
ggucagcgagcaaagaaau

SEQ ID NO: 1174067 - RNA, 19 nt, Homo sapiens
aagauauucugcagcaaug

SEQ ID NO: 1174068 - RNA, 19 nt, Homo sapiens
gcaggcauguaagauuuua

SEQ ID NO: 1174069 - RNA, 19 nt, Homo sapiens
ccacuggacccaaucuguu

SEQ ID NO: 1174070 - RNA, 19 nt, Homo sapiens
aaaucucccucuuguggaa

SEQ ID NO: 1174071 - RNA, 19 nt, Homo sapiens
gcaagggauaucuuaaaca

SEQ ID NO: 1174072 - RNA, 19 nt, Homo sapiens
guaagugggcaaccauaau

SEQ ID NO: 1174073 - RNA, 19 nt, Homo sapiens
ucaguuucaugacacuaaa

SEQ ID NO: 1174074 - RNA, 19 nt, Homo sapiens
caccacacccagcuaaauu

SEQ ID NO: 1174075 - RNA, 19 nt, Homo sapiens
cagguucaagcgauucuua

SEQ ID NO: 1174076 - RNA, 19 nt, Homo sapiens
gggaacagcucaucaauua

SEQ ID NO: 1174077 - RNA, 19 nt, Homo sapiens
uaacaucccugacaucuau

SEQ ID NO: 1174078 - RNA, 19 nt, Homo sapiens
uugcguaccucaugaaaua

SEQ ID NO: 1174079 - RNA, 19 nt, Homo sapiens
gaacuagcuugguaagugu

SEQ ID NO: 1174080 - RNA, 19 nt, Homo sapiens
gaacuugaacacugacauu

SEQ ID NO: 1174081 - RNA, 19 nt, Homo sapiens
ugaacuagcuugguaagug

SEQ ID NO: 1174082 - RNA, 19 nt, Homo sapiens
gggaaguggucaacguauu

SEQ ID NO: 1174083 - RNA, 19 nt, Homo sapiens
gccgauagcugguccucuu

SEQ ID NO: 1174084 - RNA, 19 nt, Homo sapiens
caaauaaccagaagcuugu

SEQ ID NO: 1174085 - RNA, 19 nt, Homo sapiens
cuacagcuucucccaaaua

SEQ ID NO: 1174086 - RNA, 19 nt, Homo sapiens
ggaaguggucaacguauuc

SEQ ID NO: 1174087 - RNA, 19 nt, Homo sapiens
acaccuagccugagacuug

SEQ ID NO: 1174088 - RNA, 19 nt, Homo sapiens
gaacagcucaucaauuacg

SEQ ID NO: 1174089 - RNA, 19 nt, Homo sapiens
gaagcuuguuucucagcaa

SEQ ID NO: 1174090 - RNA, 19 nt, Homo sapiens
gacugaacuugaacacuga

SEQ ID NO: 1174091 - RNA, 19 nt, Homo sapiens
ucaacucgccgguagguaa

SEQ ID NO: 1174092 - RNA, 19 nt, Homo sapiens
cggcugcuauccugaacua

SEQ ID NO: 1174093 - RNA, 19 nt, Homo sapiens
uacagcuucucccaaauaa

SEQ ID NO: 1174094 - RNA, 19 nt, Homo sapiens
cagcagcccuccaucuaca

SEQ ID NO: 1174095 - RNA, 19 nt, Homo sapiens
ggaccagccgccuugauga

SEQ ID NO: 1174096 - RNA, 19 nt, Homo sapiens
gcucgugacucgcgucucu

SEQ ID NO: 1174097 - RNA, 19 nt, Homo sapiens
uacauaaaggugccuguua

SEQ ID NO: 1174098 - RNA, 19 nt, Homo sapiens
agccuuaccuuaauagaau

SEQ ID NO: 1174099 - RNA, 19 nt, Homo sapiens
ugaaauaccacuccauguc

SEQ ID NO: 1174100 - RNA, 19 nt, Homo sapiens
acauaaaggugccuguuac

SEQ ID NO: 1174101 - RNA, 19 nt, Homo sapiens
guagguaacaucccugaca

SEQ ID NO: 1174102 - RNA, 19 nt, Homo sapiens
ccugacaucugccaucgau

SEQ ID NO: 1174103 - RNA, 19 nt, Homo sapiens
guaacaucccugacaucua

SEQ ID NO: 1174104 - RNA, 19 nt, Homo sapiens
ucccugacaucuaugagaa

SEQ ID NO: 1174105 - RNA, 19 nt, Homo sapiens
gauagcugguccucuuucu

SEQ ID NO: 1174106 - RNA, 19 nt, Homo sapiens
guacauaaaggugccuguu

SEQ ID NO: 1174107 - RNA, 19 nt, Homo sapiens
gggcuucaguacauaaagg

SEQ ID NO: 1174108 - RNA, 19 nt, Homo sapiens
ggugggaaguggucaacgu

SEQ ID NO: 1174109 - RNA, 19 nt, Homo sapiens
auccugaacuagcuuggua

SEQ ID NO: 1174110 - RNA, 19 nt, Homo sapiens
uccaacaccuagccugaga

SEQ ID NO: 1174111 - RNA, 19 nt, Homo sapiens
gguaacaucccugacaucu

SEQ ID NO: 1174112 - RNA, 19 nt, Homo sapiens
uagguaacaucccugacau

SEQ ID NO: 1174113 - RNA, 19 nt, Homo sapiens
ugacaucugccaucgaucu

SEQ ID NO: 1174114 - RNA, 19 nt, Homo sapiens
uaugagaaggaccuacgua

SEQ ID NO: 1174115 - RNA, 19 nt, Homo sapiens
cggauggugccuuguuaaa

SEQ ID NO: 1174116 - RNA, 19 nt, Homo sapiens
accggauggugccuuguua

SEQ ID NO: 1174117 - RNA, 19 nt, Homo sapiens
ucgagggcuucaguacaua

SEQ ID NO: 1174118 - RNA, 19 nt, Homo sapiens
gugggaaguggucaacgua

SEQ ID NO: 1174119 - RNA, 19 nt, Homo sapiens
ggauggugccuuguuaaag

SEQ ID NO: 1174120 - RNA, 19 nt, Homo sapiens
cgagggcuucaguacauaa

SEQ ID NO: 1174121 - RNA, 19 nt, Homo sapiens
gaucaacucgccgguaggu

SEQ ID NO: 1174122 - RNA, 19 nt, Homo sapiens
gagggcuucaguacauaaa

SEQ ID NO: 1174123 - RNA, 19 nt, Homo sapiens
caacaccgugcgcaugauc

SEQ ID NO: 1174124 - RNA, 19 nt, Homo sapiens
caacgacaaacuccuucug

SEQ ID NO: 1174125 - RNA, 19 nt, Homo sapiens
gccuuaccuuaauagaauu

SEQ ID NO: 1174126 - RNA, 19 nt, Homo sapiens
acacugacauuuuguuagu

SEQ ID NO: 1174127 - RNA, 19 nt, Homo sapiens
ugggaacagcucaucaauu

SEQ ID NO: 1174128 - RNA, 19 nt, Homo sapiens
cuugaacacugacauuuug

SEQ ID NO: 1174129 - RNA, 19 nt, Homo sapiens
aacaacaccgugcgcauga

SEQ ID NO: 1174130 - RNA, 19 nt, Homo sapiens
gaaguggucaacguauucu

SEQ ID NO: 1174131 - RNA, 19 nt, Homo sapiens
aagcuuguuucucagcaau

SEQ ID NO: 1174132 - RNA, 19 nt, Homo sapiens
agacagagcugaugugaaa

SEQ ID NO: 1174133 - RNA, 19 nt, Homo sapiens
ggacuacaguugguucuaa

SEQ ID NO: 1174134 - RNA, 19 nt, Homo sapiens
ggccucaccuguuuguuua

SEQ ID NO: 1174135 - RNA, 19 nt, Homo sapiens
ggacagcccuccugggaau

SEQ ID NO: 1174136 - RNA, 19 nt, Homo sapiens
agaaagagacuaagaagaa

SEQ ID NO: 1174137 - RNA, 19 nt, Homo sapiens
gaacaagaggcccaagaaa

SEQ ID NO: 1174138 - RNA, 19 nt, Homo sapiens
gaaaaugccuggcgugaga

SEQ ID NO: 1174139 - RNA, 19 nt, Homo sapiens
gcugaaggcgugcauauuu

SEQ ID NO: 1174140 - RNA, 19 nt, Homo sapiens
gaaguauggugaauaaacu

SEQ ID NO: 1174141 - RNA, 19 nt, Homo sapiens
ugaauaaacugacaugcau

SEQ ID NO: 1174142 - RNA, 19 nt, Homo sapiens
gaaagagacuaagaagaag

SEQ ID NO: 1174143 - RNA, 19 nt, Homo sapiens
ggacaugcagcguuaguga

SEQ ID NO: 1174144 - RNA, 19 nt, Homo sapiens
gugcugaggugacgaggaa

SEQ ID NO: 1174145 - RNA, 19 nt, Homo sapiens
gagcauagacuguauuagg

SEQ ID NO: 1174146 - RNA, 19 nt, Homo sapiens
guauuagguuuguucagaa

SEQ ID NO: 1174147 - RNA, 19 nt, Homo sapiens
cauagacuguauuagguuu

SEQ ID NO: 1174148 - RNA, 19 nt, Homo sapiens
ccgcagagaucuagacagu

SEQ ID NO: 1174149 - RNA, 19 nt, Homo sapiens
ccaagaaagagacuaagaa

SEQ ID NO: 1174150 - RNA, 19 nt, Homo sapiens
acaagaggcccaagaaaga

SEQ ID NO: 1174151 - RNA, 19 nt, Homo sapiens
gaagugaccaggcugaaag

SEQ ID NO: 1174152 - RNA, 19 nt, Homo sapiens
gaagaucugccagcucuga

SEQ ID NO: 1174153 - RNA, 19 nt, Homo sapiens
ggaaguauggugaauaaac

SEQ ID NO: 1174154 - RNA, 19 nt, Homo sapiens
gacuacaguugguucuaaa

SEQ ID NO: 1174155 - RNA, 19 nt, Homo sapiens
ggggaaguauggugaauaa

SEQ ID NO: 1174156 - RNA, 19 nt, Homo sapiens
uguauuagguuuguucaga

SEQ ID NO: 1174157 - RNA, 19 nt, Homo sapiens
augggaggcucgucaauuu

SEQ ID NO: 1174158 - RNA, 19 nt, Homo sapiens
gaaaugggaggcucgucaa

SEQ ID NO: 1174159 - RNA, 19 nt, Homo sapiens
gaucuagacagucguaaca

SEQ ID NO: 1174160 - RNA, 19 nt, Homo sapiens
cugcuucugugacgguuua

SEQ ID NO: 1174161 - RNA, 19 nt, Homo sapiens
caagaaagagacuaagaag

SEQ ID NO: 1174162 - RNA, 19 nt, Homo sapiens
ggaagcaauacucguguga

SEQ ID NO: 1174163 - RNA, 19 nt, Homo sapiens
cauauuuccugggcacaaa

SEQ ID NO: 1174164 - RNA, 19 nt, Homo sapiens
gcauagacuguauuagguu

SEQ ID NO: 1174165 - RNA, 19 nt, Homo sapiens
gugagcauagacuguauua

SEQ ID NO: 1174166 - RNA, 19 nt, Homo sapiens
gcacuuggaaccagaugau

SEQ ID NO: 1174167 - RNA, 19 nt, Homo sapiens
ucuaaagaguggugaguca

SEQ ID NO: 1174168 - RNA, 19 nt, Homo sapiens
ugacaugcaugcuucaaaa

SEQ ID NO: 1174169 - RNA, 19 nt, Homo sapiens
gcacacccucucccauuau

SEQ ID NO: 1174170 - RNA, 19 nt, Homo sapiens
ugaacaagaggcccaagaa

SEQ ID NO: 1174171 - RNA, 19 nt, Homo sapiens
aaagaguggugagucagaa

SEQ ID NO: 1174172 - RNA, 19 nt, Homo sapiens
agcacacccucucccauua

SEQ ID NO: 1174173 - RNA, 19 nt, Homo sapiens
agaagaagcgguagaagag

SEQ ID NO: 1174174 - RNA, 19 nt, Homo sapiens
aagaagaagcgguagaaga

SEQ ID NO: 1174175 - RNA, 19 nt, Homo sapiens
aagcaauacucgugugauc

SEQ ID NO: 1174176 - RNA, 19 nt, Homo sapiens
guagacagagcugauguga

SEQ ID NO: 1174177 - RNA, 19 nt, Homo sapiens
gggaaucuacauuguguuc

SEQ ID NO: 1174178 - RNA, 19 nt, Homo sapiens
cugaaggcgugcauauuuc

SEQ ID NO: 1174179 - RNA, 19 nt, Homo sapiens
gcucuuuccagaagucaaa

SEQ ID NO: 1174180 - RNA, 19 nt, Homo sapiens
uaaagaguggugagucaga

SEQ ID NO: 1174181 - RNA, 19 nt, Homo sapiens
gcaauacucgugugaucuc

SEQ ID NO: 1174182 - RNA, 19 nt, Homo sapiens
gugaauaaacugacaugca

SEQ ID NO: 1174183 - RNA, 19 nt, Homo sapiens
guugggcucuuuccagaag

SEQ ID NO: 1174184 - RNA, 19 nt, Homo sapiens
gggaggcucgucaauuuca

SEQ ID NO: 1174185 - RNA, 19 nt, Homo sapiens
cugauucacugcacuugga

SEQ ID NO: 1174186 - RNA, 19 nt, Homo sapiens
cacacccucucccauuauu

SEQ ID NO: 1174187 - RNA, 19 nt, Homo sapiens
gcugggcaauccaccacuu

SEQ ID NO: 1174188 - RNA, 19 nt, Homo sapiens
cuaagaagaagcgguagaa

SEQ ID NO: 1174189 - RNA, 19 nt, Homo sapiens
acaguugguucuaaagagu

SEQ ID NO: 1174190 - RNA, 19 nt, Homo sapiens
aagcacacccucucccauu

SEQ ID NO: 1174191 - RNA, 19 nt, Homo sapiens
cugggaaucuacauugugu

SEQ ID NO: 1174192 - RNA, 19 nt, Homo sapiens
uaaacugacaugcaugcuu

SEQ ID NO: 1174193 - RNA, 19 nt, Homo sapiens
uucauucccugaccaguga

SEQ ID NO: 1174194 - RNA, 19 nt, Homo sapiens
gaagccgggucagcucaca

SEQ ID NO: 1174195 - RNA, 19 nt, Homo sapiens
gcccaaggcugcuguuccu

SEQ ID NO: 1174196 - RNA, 19 nt, Homo sapiens
gggagugccaccugauuca

SEQ ID NO: 1174197 - RNA, 19 nt, Homo sapiens
gaaaaguggccauccuguu

SEQ ID NO: 1174198 - RNA, 19 nt, Homo sapiens
ccaggcacaugaccuucug

SEQ ID NO: 1174199 - RNA, 19 nt, Homo sapiens
cagaugauguugggcucuu

SEQ ID NO: 1174200 - RNA, 19 nt, Homo sapiens
ggcccaagaaagagacuaa

SEQ ID NO: 1174201 - RNA, 19 nt, Homo sapiens
uuccugagccucugaaaug

SEQ ID NO: 1174202 - RNA, 19 nt, Homo sapiens
uuccagaagucaaauccuu

SEQ ID NO: 1174203 - RNA, 19 nt, Homo sapiens
cuacaguugguucuaaaga

SEQ ID NO: 1174204 - RNA, 19 nt, Homo sapiens
ugaaagggaagcaauacuc

SEQ ID NO: 1174205 - RNA, 19 nt, Homo sapiens
ccacuuuccuggagaaccu

SEQ ID NO: 1174206 - RNA, 19 nt, Homo sapiens
ccucugaccuagacuucuc

SEQ ID NO: 1174207 - RNA, 19 nt, Homo sapiens
ggcugaaagggaagcaaua

SEQ ID NO: 1174208 - RNA, 19 nt, Homo sapiens
cacccucucccauuauuug

SEQ ID NO: 1174209 - RNA, 19 nt, Homo sapiens
ugaagugaccaggcugaaa

SEQ ID NO: 1174210 - RNA, 19 nt, Homo sapiens
gaagcaauacucgugugau

SEQ ID NO: 1174211 - RNA, 19 nt, Homo sapiens
ucuagacagucguaacagu

SEQ ID NO: 1174212 - RNA, 19 nt, Homo sapiens
gccaucaucguacccauuc

SEQ ID NO: 1174213 - RNA, 19 nt, Homo sapiens
auacucgugugaucucuca

SEQ ID NO: 1174214 - RNA, 19 nt, Homo sapiens
caacccaucauagcacguu

SEQ ID NO: 1174215 - RNA, 19 nt, Homo sapiens
gcgggagugccaccugauu

SEQ ID NO: 1174216 - RNA, 19 nt, Homo sapiens
aagaaagagacuaagaaga

SEQ ID NO: 1174217 - RNA, 19 nt, Homo sapiens
uauggugaauaaacugaca

SEQ ID NO: 1174218 - RNA, 19 nt, Homo sapiens
gccaagaugccauggacau

SEQ ID NO: 1174219 - RNA, 19 nt, Homo sapiens
agcauagacuguauuaggu

SEQ ID NO: 1174220 - RNA, 19 nt, Homo sapiens
uacaguugguucuaaagag

SEQ ID NO: 1174221 - RNA, 19 nt, Homo sapiens
gcauauuuccugggcacaa

SEQ ID NO: 1174222 - RNA, 19 nt, Homo sapiens
ggcgcaaucacgacucauu

SEQ ID NO: 1174223 - RNA, 19 nt, Homo sapiens
aacaagaggcccaagaaag

SEQ ID NO: 1174224 - RNA, 19 nt, Homo sapiens
aggccucaccuguuuguuu

SEQ ID NO: 1174225 - RNA, 19 nt, Homo sapiens
uagacuguauuagguuugu

SEQ ID NO: 1174226 - RNA, 19 nt, Homo sapiens
agagaucuagacagucgua

SEQ ID NO: 1174227 - RNA, 19 nt, Homo sapiens
gugaacaagaggcccaaga

SEQ ID NO: 1174228 - RNA, 19 nt, Homo sapiens
ggccaucaucguacccauu

SEQ ID NO: 1174229 - RNA, 19 nt, Homo sapiens
ucuuccagcucaucugugu

SEQ ID NO: 1174230 - RNA, 19 nt, Homo sapiens
gaaccuaccuggcagauau

SEQ ID NO: 1174231 - RNA, 19 nt, Homo sapiens
gaacagagacuccgagaug

SEQ ID NO: 1174232 - RNA, 19 nt, Homo sapiens
ggacagacauggccuuugu

SEQ ID NO: 1174233 - RNA, 19 nt, Homo sapiens
gagagaagcuacagccauu

SEQ ID NO: 1174234 - RNA, 19 nt, Homo sapiens
ggacaugaguguguacuau

SEQ ID NO: 1174235 - RNA, 19 nt, Homo sapiens
cgacgucacggaagaauaa

SEQ ID NO: 1174236 - RNA, 19 nt, Homo sapiens
guaacgaccgcuugucuuu

SEQ ID NO: 1174237 - RNA, 19 nt, Homo sapiens
gcuccuaacucugcccuaa

SEQ ID NO: 1174238 - RNA, 19 nt, Homo sapiens
gcucuggccugguguuuua

SEQ ID NO: 1174239 - RNA, 19 nt, Homo sapiens
ggaaggaagaggaagaaga

SEQ ID NO: 1174240 - RNA, 19 nt, Homo sapiens
gaaggaagaggaagaagag

SEQ ID NO: 1174241 - RNA, 19 nt, Homo sapiens
aggaagagcuuguguguac

SEQ ID NO: 1174242 - RNA, 19 nt, Homo sapiens
ccgagacucuguccaaaug

SEQ ID NO: 1174243 - RNA, 19 nt, Homo sapiens
gcaggccgcuccuaacucu

SEQ ID NO: 1174244 - RNA, 19 nt, Homo sapiens
gcaugaaguuucggacaga

SEQ ID NO: 1174245 - RNA, 19 nt, Homo sapiens
agcagagggugaagaaaua

SEQ ID NO: 1174246 - RNA, 19 nt, Homo sapiens
cagcuucucucucagacuu

SEQ ID NO: 1174247 - RNA, 19 nt, Homo sapiens
gcaggaagagcuugugugu

SEQ ID NO: 1174248 - RNA, 19 nt, Homo sapiens
gggcuuccuuucauagcua

SEQ ID NO: 1174249 - RNA, 19 nt, Homo sapiens
guggagagccugaggaaga

SEQ ID NO: 1174250 - RNA, 19 nt, Homo sapiens
ccaaaugcgucuagaacag

SEQ ID NO: 1174251 - RNA, 19 nt, Homo sapiens
gcucaucuccaccaucuau

SEQ ID NO: 1174252 - RNA, 19 nt, Homo sapiens
gggcucaucuccaccaucu

SEQ ID NO: 1174253 - RNA, 19 nt, Homo sapiens
gagaagcuacagccauuug

SEQ ID NO: 1174254 - RNA, 19 nt, Homo sapiens
acaugaguguguacuauga

SEQ ID NO: 1174255 - RNA, 19 nt, Homo sapiens
gccgguggcuggauucuca

SEQ ID NO: 1174256 - RNA, 19 nt, Homo sapiens
gaagaaauaccccaaggaa

SEQ ID NO: 1174257 - RNA, 19 nt, Homo sapiens
gcaaugugccuuuugagua

SEQ ID NO: 1174258 - RNA, 19 nt, Homo sapiens
gcuugucuuuggucucuaa

SEQ ID NO: 1174259 - RNA, 19 nt, Homo sapiens
gcgguggcuuccucuguuu

SEQ ID NO: 1174260 - RNA, 19 nt, Homo sapiens
cagcagagggugaagaaau

SEQ ID NO: 1174261 - RNA, 19 nt, Homo sapiens
gagaggauuuguggugcuu

SEQ ID NO: 1174262 - RNA, 19 nt, Homo sapiens
agaaggagauuuugaugaa

SEQ ID NO: 1174263 - RNA, 19 nt, Homo sapiens
gaggaggaggcgacaguuu

SEQ ID NO: 1174264 - RNA, 19 nt, Homo sapiens
cugaggcccuggauaguga

SEQ ID NO: 1174265 - RNA, 19 nt, Homo sapiens
ggaagaggaagaagagucu

SEQ ID NO: 1174266 - RNA, 19 nt, Homo sapiens
ggaagauggcucugugauc

SEQ ID NO: 1174267 - RNA, 19 nt, Homo sapiens
ggaggaagaaggagauuuu

SEQ ID NO: 1174268 - RNA, 19 nt, Homo sapiens
aggaggaggcgacaguuua

SEQ ID NO: 1174269 - RNA, 19 nt, Homo sapiens
ggcgguggcuuccucuguu

SEQ ID NO: 1174270 - RNA, 19 nt, Homo sapiens
gaaaagcuggguugaguga

SEQ ID NO: 1174271 - RNA, 19 nt, Homo sapiens
guuggaaggcagagaauga

SEQ ID NO: 1174272 - RNA, 19 nt, Homo sapiens
uccuaacucugcccuaauu

SEQ ID NO: 1174273 - RNA, 19 nt, Homo sapiens
caaugugccuuuugaguau

SEQ ID NO: 1174274 - RNA, 19 nt, Homo sapiens
ggccucaucuaccacugaa

SEQ ID NO: 1174275 - RNA, 19 nt, Homo sapiens
caaaugcgucuagaacaga

SEQ ID NO: 1174276 - RNA, 19 nt, Homo sapiens
gcccgagacucuguccaaa

SEQ ID NO: 1174277 - RNA, 19 nt, Homo sapiens
ggaaugggaacggcaugaa

SEQ ID NO: 1174278 - RNA, 19 nt, Homo sapiens
gaacagacagccgaugacu

SEQ ID NO: 1174279 - RNA, 19 nt, Homo sapiens
ggaagagcuuguguguaca

SEQ ID NO: 1174280 - RNA, 19 nt, Homo sapiens
acuccgagauggacaggaa

SEQ ID NO: 1174281 - RNA, 19 nt, Homo sapiens
uggagagccugaggaagaa

SEQ ID NO: 1174282 - RNA, 19 nt, Homo sapiens
gaacccaccagugcugaug

SEQ ID NO: 1174283 - RNA, 19 nt, Homo sapiens
ggauagugauggccaacac

SEQ ID NO: 1174284 - RNA, 19 nt, Homo sapiens
gcaggaggaagaaggagau

SEQ ID NO: 1174285 - RNA, 19 nt, Homo sapiens
ggaaccuaccuggcagaua

SEQ ID NO: 1174286 - RNA, 19 nt, Homo sapiens
gcccuggccucaucuacca

SEQ ID NO: 1174287 - RNA, 19 nt, Homo sapiens
cagagaugguggagacaag

SEQ ID NO: 1174288 - RNA, 19 nt, Homo sapiens
acucgagacucuacuccaa

SEQ ID NO: 1174289 - RNA, 19 nt, Homo sapiens
gacaugaguguguacuaug

SEQ ID NO: 1174290 - RNA, 19 nt, Homo sapiens
uggcugaccugaagcaacu

SEQ ID NO: 1174291 - RNA, 19 nt, Homo sapiens
gaaugggaacggcaugaag

SEQ ID NO: 1174292 - RNA, 19 nt, Homo sapiens
ggaggaggcgacaguuuac

SEQ ID NO: 1174293 - RNA, 19 nt, Homo sapiens
gaguguguacuaugacaga

SEQ ID NO: 1174294 - RNA, 19 nt, Homo sapiens
cgucacggaagaauaaaga

SEQ ID NO: 1174295 - RNA, 19 nt, Homo sapiens
ggauuuguggugcuuggaa

SEQ ID NO: 1174296 - RNA, 19 nt, Homo sapiens
caaggaugcccgagacucu

SEQ ID NO: 1174297 - RNA, 19 nt, Homo sapiens
gaagaaggagauuuugaug

SEQ ID NO: 1174298 - RNA, 19 nt, Homo sapiens
ggaagaaggagauuuugau

SEQ ID NO: 1174299 - RNA, 19 nt, Homo sapiens
cacccuggcugaccugaag

SEQ ID NO: 1174300 - RNA, 19 nt, Homo sapiens
gcgacgucacggaagaaua

SEQ ID NO: 1174301 - RNA, 19 nt, Homo sapiens
gguaacgaccgcuugucuu

SEQ ID NO: 1174302 - RNA, 19 nt, Homo sapiens
gaagagcuuguguguacag

SEQ ID NO: 1174303 - RNA, 19 nt, Homo sapiens
gagcaggaagagcuugugu

SEQ ID NO: 1174304 - RNA, 19 nt, Homo sapiens
ucgagacucuacuccaauc

SEQ ID NO: 1174305 - RNA, 19 nt, Homo sapiens
guugcgcucggcccauuua

SEQ ID NO: 1174306 - RNA, 19 nt, Homo sapiens
uaacgaccgcuugucuuug

SEQ ID NO: 1174307 - RNA, 19 nt, Homo sapiens
acagacauggccuuuguga

SEQ ID NO: 1174308 - RNA, 19 nt, Homo sapiens
ccaccagcaugaaguuucg

SEQ ID NO: 1174309 - RNA, 19 nt, Homo sapiens
guacagcagagggugaaga

SEQ ID NO: 1174310 - RNA, 19 nt, Homo sapiens
caugugacaauccaagaug

SEQ ID NO: 1174311 - RNA, 19 nt, Homo sapiens
uaucagcacagccuuccuu

SEQ ID NO: 1174312 - RNA, 19 nt, Homo sapiens
cagaugcaagcguggauug

SEQ ID NO: 1174313 - RNA, 19 nt, Homo sapiens
gcauugggcggaaggugau

SEQ ID NO: 1174314 - RNA, 19 nt, Homo sapiens
agauggcucugugaucgaa

SEQ ID NO: 1174315 - RNA, 19 nt, Homo sapiens
ggaggaggaggcgacaguu

SEQ ID NO: 1174316 - RNA, 19 nt, Homo sapiens
gaaguuucggacagacaug

SEQ ID NO: 1174317 - RNA, 19 nt, Homo sapiens
gagaugguggagacaagga

SEQ ID NO: 1174318 - RNA, 19 nt, Homo sapiens
acggaagaauaaagacguu

SEQ ID NO: 1174319 - RNA, 19 nt, Homo sapiens
guguugcgcucggcccauu

SEQ ID NO: 1174320 - RNA, 19 nt, Homo sapiens
ccgcuugucuuuggucucu

SEQ ID NO: 1174321 - RNA, 19 nt, Homo sapiens
aacgaccgcuugucuuugg

SEQ ID NO: 1174322 - RNA, 19 nt, Homo sapiens
agggccagcuucucucuca

SEQ ID NO: 1174323 - RNA, 19 nt, Homo sapiens
gccaaagccuuauuuaaau

SEQ ID NO: 1174324 - RNA, 19 nt, Homo sapiens
gcacgugccuucuguacug

SEQ ID NO: 1174325 - RNA, 19 nt, Homo sapiens
gagcagagaggaacacaaa

SEQ ID NO: 1174326 - RNA, 19 nt, Homo sapiens
ggcagagcaucuucuauuu

SEQ ID NO: 1174327 - RNA, 19 nt, Homo sapiens
guaggaugcuuaaagguau

SEQ ID NO: 1174328 - RNA, 19 nt, Homo sapiens
gccugaagcuccuuaagaa

SEQ ID NO: 1174329 - RNA, 19 nt, Homo sapiens
cgccaaagccuuauuuaaa

SEQ ID NO: 1174330 - RNA, 19 nt, Homo sapiens
gccaagggcuggaucuuca

SEQ ID NO: 1174331 - RNA, 19 nt, Homo sapiens
ggacuugccuguucaaccu

SEQ ID NO: 1174332 - RNA, 19 nt, Homo sapiens
gcacgccaaagccuuauuu

SEQ ID NO: 1174333 - RNA, 19 nt, Homo sapiens
gagcuguccugcacacugu

SEQ ID NO: 1174334 - RNA, 19 nt, Homo sapiens
gagcgagccuucaccuaca

SEQ ID NO: 1174335 - RNA, 19 nt, Homo sapiens
cagagcaucuucuauuucu

SEQ ID NO: 1174336 - RNA, 19 nt, Homo sapiens
ggacugacacguggacuug

SEQ ID NO: 1174337 - RNA, 19 nt, Homo sapiens
cuugcaagguguacacaua

SEQ ID NO: 1174338 - RNA, 19 nt, Homo sapiens
gaaccacccuguguaugca

SEQ ID NO: 1174339 - RNA, 19 nt, Homo sapiens
guggaucccuccgcacuaa

SEQ ID NO: 1174340 - RNA, 19 nt, Homo sapiens
ccuagaagccugacagaga

SEQ ID NO: 1174341 - RNA, 19 nt, Homo sapiens
gcacacuguaggaugcuua

SEQ ID NO: 1174342 - RNA, 19 nt, Homo sapiens
gcuggugguuucaugaguu

SEQ ID NO: 1174343 - RNA, 19 nt, Homo sapiens
gcagagcaucuucuauuuc

SEQ ID NO: 1174344 - RNA, 19 nt, Homo sapiens
cugaggagcuggugguuuc

SEQ ID NO: 1174345 - RNA, 19 nt, Homo sapiens
uagagacccuugccugugu

SEQ ID NO: 1174346 - RNA, 19 nt, Homo sapiens
uaagaagaguccacaacag

SEQ ID NO: 1174347 - RNA, 19 nt, Homo sapiens
uggcagagcaucuucuauu

SEQ ID NO: 1174348 - RNA, 19 nt, Homo sapiens
aaagcacgccaaagccuua

SEQ ID NO: 1174349 - RNA, 19 nt, Homo sapiens
gacuucggcuggaacaaga

SEQ ID NO: 1174350 - RNA, 19 nt, Homo sapiens
gaguuaaugauacaucuug

SEQ ID NO: 1174351 - RNA, 19 nt, Homo sapiens
gaacacacagacccaccuu

SEQ ID NO: 1174352 - RNA, 19 nt, Homo sapiens
gcggguuucucucugauca

SEQ ID NO: 1174353 - RNA, 19 nt, Homo sapiens
uguaggaugcuuaaaggua

SEQ ID NO: 1174354 - RNA, 19 nt, Homo sapiens
cuggugguuucaugaguua

SEQ ID NO: 1174355 - RNA, 19 nt, Homo sapiens
ggaaccacccuguguaugc

SEQ ID NO: 1174356 - RNA, 19 nt, Homo sapiens
gcauuucuguuaacaucca

SEQ ID NO: 1174357 - RNA, 19 nt, Homo sapiens
uggcauuucuguuaacauc

SEQ ID NO: 1174358 - RNA, 19 nt, Homo sapiens
ggacuuggucacuccaugu

SEQ ID NO: 1174359 - RNA, 19 nt, Homo sapiens
ucaacgugguuccuugguu

SEQ ID NO: 1174360 - RNA, 19 nt, Homo sapiens
ccaccuuucuggcguucuu

SEQ ID NO: 1174361 - RNA, 19 nt, Homo sapiens
ggccacaccuccagcuucu

SEQ ID NO: 1174362 - RNA, 19 nt, Homo sapiens
gcucccugcuccuggaaug

SEQ ID NO: 1174363 - RNA, 19 nt, Homo sapiens
caagguguacacauagaga

SEQ ID NO: 1174364 - RNA, 19 nt, Homo sapiens
ggagcuggugguuucauga

SEQ ID NO: 1174365 - RNA, 19 nt, Homo sapiens
acacacagacccaccuuuc

SEQ ID NO: 1174366 - RNA, 19 nt, Homo sapiens
ucagacaacagccagaaau

SEQ ID NO: 1174367 - RNA, 19 nt, Homo sapiens
ugaagcuccuuaagaagag

SEQ ID NO: 1174368 - RNA, 19 nt, Homo sapiens
cugaagcuccuuaagaaga

SEQ ID NO: 1174369 - RNA, 19 nt, Homo sapiens
gaggaacacaaaccacugu

SEQ ID NO: 1174370 - RNA, 19 nt, Homo sapiens
cuaggcggcuacuugaugu

SEQ ID NO: 1174371 - RNA, 19 nt, Homo sapiens
ggacuucggcuggaacaag

SEQ ID NO: 1174372 - RNA, 19 nt, Homo sapiens
uuaagaagaguccacaaca

SEQ ID NO: 1174373 - RNA, 19 nt, Homo sapiens
ccacaccuccagcuucugu

SEQ ID NO: 1174374 - RNA, 19 nt, Homo sapiens
gcuggcagagcaucuucua

SEQ ID NO: 1174375 - RNA, 19 nt, Homo sapiens
cccaaucccagcccacuuu

SEQ ID NO: 1174376 - RNA, 19 nt, Homo sapiens
agaaggugcgggagaguga

SEQ ID NO: 1174377 - RNA, 19 nt, Homo sapiens
acgccaaagccuuauuuaa

SEQ ID NO: 1174378 - RNA, 19 nt, Homo sapiens
cagacaacagccagaaaug

SEQ ID NO: 1174379 - RNA, 19 nt, Homo sapiens
ggguuucucucugaucauc

SEQ ID NO: 1174380 - RNA, 19 nt, Homo sapiens
gaaggucauccugcuguca

SEQ ID NO: 1174381 - RNA, 19 nt, Homo sapiens
ucuccuggcugcccaccuu

SEQ ID NO: 1174382 - RNA, 19 nt, Homo sapiens
agacaacagccagaaaugu

SEQ ID NO: 1174383 - RNA, 19 nt, Homo sapiens
gcagcucccagucagacaa

SEQ ID NO: 1174384 - RNA, 19 nt, Homo sapiens
gcagagaggaacacaaacc

SEQ ID NO: 1174385 - RNA, 19 nt, Homo sapiens
ggguggaccugagcucuac

SEQ ID NO: 1174386 - RNA, 19 nt, Homo sapiens
ccaucggccuccagaccuu

SEQ ID NO: 1174387 - RNA, 19 nt, Homo sapiens
gcgauuccggccagucuau

SEQ ID NO: 1174388 - RNA, 19 nt, Homo sapiens
ugcaagguguacacauaga

SEQ ID NO: 1174389 - RNA, 19 nt, Homo sapiens
cuccuggacuugccuguuc

SEQ ID NO: 1174390 - RNA, 19 nt, Homo sapiens
ugucuaggcggcuacuuga

SEQ ID NO: 1174391 - RNA, 19 nt, Homo sapiens
gugagucuguggucuuugc

SEQ ID NO: 1174392 - RNA, 19 nt, Homo sapiens
gcaagguguacacauagag

SEQ ID NO: 1174393 - RNA, 19 nt, Homo sapiens
gaagcuccuuaagaagagu

SEQ ID NO: 1174394 - RNA, 19 nt, Homo sapiens
cccacagccucuccaagga

SEQ ID NO: 1174395 - RNA, 19 nt, Homo sapiens
gcaggugucgugggugugu

SEQ ID NO: 1174396 - RNA, 19 nt, Homo sapiens
gugguuucaugaguuaaug

SEQ ID NO: 1174397 - RNA, 19 nt, Homo sapiens
gcuccagcaugcccaucug

SEQ ID NO: 1174398 - RNA, 19 nt, Homo sapiens
gcucucugggccucaguuu

SEQ ID NO: 1174399 - RNA, 19 nt, Homo sapiens
ugucgugggugugugucua

SEQ ID NO: 1174400 - RNA, 19 nt, Homo sapiens
gaacauggcugugcuguag

SEQ ID NO: 1174401 - RNA, 19 nt, Homo sapiens
gaagaugaguguuagagau

SEQ ID NO: 1174402 - RNA, 19 nt, Homo sapiens
ucacagccauguaggcaua

SEQ ID NO: 1174403 - RNA, 19 nt, Homo sapiens
gaaaucauucuaacccuuu

SEQ ID NO: 1174404 - RNA, 19 nt, Homo sapiens
ggacagguuuggagagugu

SEQ ID NO: 1174405 - RNA, 19 nt, Homo sapiens
auaaagccaugucucauuu

SEQ ID NO: 1174406 - RNA, 19 nt, Homo sapiens
gagagaagaugaguguuag

SEQ ID NO: 1174407 - RNA, 19 nt, Homo sapiens
ugaaggggcugcugaauaa

SEQ ID NO: 1174408 - RNA, 19 nt, Homo sapiens
gaagugcugacgagaaauu

SEQ ID NO: 1174409 - RNA, 19 nt, Homo sapiens
agagagaagaugaguguua

SEQ ID NO: 1174410 - RNA, 19 nt, Homo sapiens
caauucaucccauaaagaa

SEQ ID NO: 1174411 - RNA, 19 nt, Homo sapiens
gagaacaacaucccucuuc

SEQ ID NO: 1174412 - RNA, 19 nt, Homo sapiens
auuggaagcugccuaguuu

SEQ ID NO: 1174413 - RNA, 19 nt, Homo sapiens
agccaaagcuggagucaga

SEQ ID NO: 1174414 - RNA, 19 nt, Homo sapiens
gcaggaauaggccgaggua

SEQ ID NO: 1174415 - RNA, 19 nt, Homo sapiens
cugaagugcugacgagaaa

SEQ ID NO: 1174416 - RNA, 19 nt, Homo sapiens
cauaaagaaugcagagagu

SEQ ID NO: 1174417 - RNA, 19 nt, Homo sapiens
gcauaggguagcaggaaua

SEQ ID NO: 1174418 - RNA, 19 nt, Homo sapiens
gcagagagugggacagguu

SEQ ID NO: 1174419 - RNA, 19 nt, Homo sapiens
guaaacagccuagacaucu

SEQ ID NO: 1174420 - RNA, 19 nt, Homo sapiens
ugaauaaagccaugucuca

SEQ ID NO: 1174421 - RNA, 19 nt, Homo sapiens
ggaauaggccgagguaaac

SEQ ID NO: 1174422 - RNA, 19 nt, Homo sapiens
ucauuuaccugcugucucu

SEQ ID NO: 1174423 - RNA, 19 nt, Homo sapiens
guguuuguguaguguauaa

SEQ ID NO: 1174424 - RNA, 19 nt, Homo sapiens
ccaauucaucccauaaaga

SEQ ID NO: 1174425 - RNA, 19 nt, Homo sapiens
ggaacauggcugugcugua

SEQ ID NO: 1174426 - RNA, 19 nt, Homo sapiens
aauaaagccaugucucauu

SEQ ID NO: 1174427 - RNA, 19 nt, Homo sapiens
gaauaaagccaugucucau

SEQ ID NO: 1174428 - RNA, 19 nt, Homo sapiens
gagguaaacagccuagaca

SEQ ID NO: 1174429 - RNA, 19 nt, Homo sapiens
gccaauucaucccauaaag

SEQ ID NO: 1174430 - RNA, 19 nt, Homo sapiens
gguaaacagccuagacauc

SEQ ID NO: 1174431 - RNA, 19 nt, Homo sapiens
acagagagaagaugagugu

SEQ ID NO: 1174432 - RNA, 19 nt, Homo sapiens
gcucucagccacuaguguu

SEQ ID NO: 1174433 - RNA, 19 nt, Homo sapiens
aggaauaggccgagguaaa

SEQ ID NO: 1174434 - RNA, 19 nt, Homo sapiens
cuucugaaaccuguaauuu

SEQ ID NO: 1174435 - RNA, 19 nt, Homo sapiens
ggaaaacacugagaacaac

SEQ ID NO: 1174436 - RNA, 19 nt, Homo sapiens
gagaagaugaguguuagag

SEQ ID NO: 1174437 - RNA, 19 nt, Homo sapiens
uaaacagccuagacaucuc

SEQ ID NO: 1174438 - RNA, 19 nt, Homo sapiens
ggcauaggguagcaggaau

SEQ ID NO: 1174439 - RNA, 19 nt, Homo sapiens
ccugaggaaugcauacaag

SEQ ID NO: 1174440 - RNA, 19 nt, Homo sapiens
gcacggauggaagaggaaa

SEQ ID NO: 1174441 - RNA, 19 nt, Homo sapiens
aaagccaugucucauuuac

SEQ ID NO: 1174442 - RNA, 19 nt, Homo sapiens
uggaagcugccuaguuuga

SEQ ID NO: 1174443 - RNA, 19 nt, Homo sapiens
gaauaggccgagguaaaca

SEQ ID NO: 1174444 - RNA, 19 nt, Homo sapiens
ccuguaauuucaaugucuu

SEQ ID NO: 1174445 - RNA, 19 nt, Homo sapiens
gaacaacaucccucuuccu

SEQ ID NO: 1174446 - RNA, 19 nt, Homo sapiens
cauuggaagcugccuaguu

SEQ ID NO: 1174447 - RNA, 19 nt, Homo sapiens
gugaaggggcugcugaaua

SEQ ID NO: 1174448 - RNA, 19 nt, Homo sapiens
aguccugugucuuauauag

SEQ ID NO: 1174449 - RNA, 19 nt, Homo sapiens
agacaucucagcgggauug

SEQ ID NO: 1174450 - RNA, 19 nt, Homo sapiens
aaacagccuagacaucuca

SEQ ID NO: 1174451 - RNA, 19 nt, Homo sapiens
cagagagugggacagguuu

SEQ ID NO: 1174452 - RNA, 19 nt, Homo sapiens
aaugccaauucaucccaua

SEQ ID NO: 1174453 - RNA, 19 nt, Homo sapiens
uaacacugacccugugaag

SEQ ID NO: 1174454 - RNA, 19 nt, Homo sapiens
cuucugaaaucauucuaac

SEQ ID NO: 1174455 - RNA, 19 nt, Homo sapiens
gccuagaggucagcucagu

SEQ ID NO: 1174456 - RNA, 19 nt, Homo sapiens
ccugcugucucuccagugu

SEQ ID NO: 1174457 - RNA, 19 nt, Homo sapiens
uauagucacagccauguag

SEQ ID NO: 1174458 - RNA, 19 nt, Homo sapiens
uaguguuuguguaguguau

SEQ ID NO: 1174459 - RNA, 19 nt, Homo sapiens
agaagaugaguguuagaga

SEQ ID NO: 1174460 - RNA, 19 nt, Homo sapiens
guuuggagaguguaaggaa

SEQ ID NO: 1174461 - RNA, 19 nt, Homo sapiens
gcaaagccauguacacaaa

SEQ ID NO: 1174462 - RNA, 19 nt, Homo sapiens
ggagggagguguagaaaga

SEQ ID NO: 1174463 - RNA, 19 nt, Homo sapiens
gaugagaccuuaaacuuca

SEQ ID NO: 1174464 - RNA, 19 nt, Homo sapiens
gaagauagccgaggaaauc

SEQ ID NO: 1174465 - RNA, 19 nt, Homo sapiens
gaaacugcuucuugaaaug

SEQ ID NO: 1174466 - RNA, 19 nt, Homo sapiens
acaaggagguguuggaauu

SEQ ID NO: 1174467 - RNA, 19 nt, Homo sapiens
aaagggacaucauauuuga

SEQ ID NO: 1174468 - RNA, 19 nt, Homo sapiens
gcuaugacuuugucuauca

SEQ ID NO: 1174469 - RNA, 19 nt, Homo sapiens
caucgcaccuaauaaauau

SEQ ID NO: 1174470 - RNA, 19 nt, Homo sapiens
ucaaagggacaucauauuu

SEQ ID NO: 1174471 - RNA, 19 nt, Homo sapiens
gaaaggaugaugaccaaga

SEQ ID NO: 1174472 - RNA, 19 nt, Homo sapiens
ggcagcagcuuccgaaaga

SEQ ID NO: 1174473 - RNA, 19 nt, Homo sapiens
ugacaaggcucguggaaag

SEQ ID NO: 1174474 - RNA, 19 nt, Homo sapiens
ccagugagcugaccaagag

SEQ ID NO: 1174475 - RNA, 19 nt, Homo sapiens
ugaggaggauugcauuuga

SEQ ID NO: 1174476 - RNA, 19 nt, Homo sapiens
guacauggagaacaaguuu

SEQ ID NO: 1174477 - RNA, 19 nt, Homo sapiens
gaacagacucgcagugaca

SEQ ID NO: 1174478 - RNA, 19 nt, Homo sapiens
aagcaucuccggucuauaa

SEQ ID NO: 1174479 - RNA, 19 nt, Homo sapiens
gaaagagguacauggagaa

SEQ ID NO: 1174480 - RNA, 19 nt, Homo sapiens
gagcaaaucacucgagcuu

SEQ ID NO: 1174481 - RNA, 19 nt, Homo sapiens
ucaacaagguuaugcaagu

SEQ ID NO: 1174482 - RNA, 19 nt, Homo sapiens
guacacaaaggacuacaaa

SEQ ID NO: 1174483 - RNA, 19 nt, Homo sapiens
gacaucauauuugaacuga

SEQ ID NO: 1174484 - RNA, 19 nt, Homo sapiens
ugccaaacccagaguauua

SEQ ID NO: 1174485 - RNA, 19 nt, Homo sapiens
gaacugaggaggauugcau

SEQ ID NO: 1174486 - RNA, 19 nt, Homo sapiens
gaggacaaacgacaggaua

SEQ ID NO: 1174487 - RNA, 19 nt, Homo sapiens
ggucuauaauccugaauca

SEQ ID NO: 1174488 - RNA, 19 nt, Homo sapiens
ucaaucaccuuuauuaagc

SEQ ID NO: 1174489 - RNA, 19 nt, Homo sapiens
gacaggauauggcaaaugc

SEQ ID NO: 1174490 - RNA, 19 nt, Homo sapiens
aagaaaggaugaugaccaa

SEQ ID NO: 1174491 - RNA, 19 nt, Homo sapiens
cuucaaguccuaaccuuua

SEQ ID NO: 1174492 - RNA, 19 nt, Homo sapiens
cuacugaguucaucaacau

SEQ ID NO: 1174493 - RNA, 19 nt, Homo sapiens
uaaacuucaucgcaccuaa

SEQ ID NO: 1174494 - RNA, 19 nt, Homo sapiens
guagaaagagguacaugga

SEQ ID NO: 1174495 - RNA, 19 nt, Homo sapiens
gcucaaagggacaucauau

SEQ ID NO: 1174496 - RNA, 19 nt, Homo sapiens
ccaaggagcccagcagcua

SEQ ID NO: 1174497 - RNA, 19 nt, Homo sapiens
ggaacuaccaaaugaagga

SEQ ID NO: 1174498 - RNA, 19 nt, Homo sapiens
agagguacauggagaacaa

SEQ ID NO: 1174499 - RNA, 19 nt, Homo sapiens
ggacaaacgacaggauaug

SEQ ID NO: 1174500 - RNA, 19 nt, Homo sapiens
ucaucgcaccuaauaaaua

SEQ ID NO: 1174501 - RNA, 19 nt, Homo sapiens
cagcagaggacuucaacaa

SEQ ID NO: 1174502 - RNA, 19 nt, Homo sapiens
cuuggucccugucuacuaa

SEQ ID NO: 1174503 - RNA, 19 nt, Homo sapiens
caaauugcguagccugagu

SEQ ID NO: 1174504 - RNA, 19 nt, Homo sapiens
caacaagguuaugcaaguc

SEQ ID NO: 1174505 - RNA, 19 nt, Homo sapiens
gaaucugcauccagcuguu

SEQ ID NO: 1174506 - RNA, 19 nt, Homo sapiens
ccuccaaacccaacucuuu

SEQ ID NO: 1174507 - RNA, 19 nt, Homo sapiens
ccauugagcucaccaaaau

SEQ ID NO: 1174508 - RNA, 19 nt, Homo sapiens
agaagcaucuccggucuau

SEQ ID NO: 1174509 - RNA, 19 nt, Homo sapiens
gacuuucgcuacugaguuc

SEQ ID NO: 1174510 - RNA, 19 nt, Homo sapiens
uggcauccauuaucaagga

SEQ ID NO: 1174511 - RNA, 19 nt, Homo sapiens
gcccagcagcuaugacuuu

SEQ ID NO: 1174512 - RNA, 19 nt, Homo sapiens
aaaggaugaugaccaagau

SEQ ID NO: 1174513 - RNA, 19 nt, Homo sapiens
ucuauaauccugaaucaug

SEQ ID NO: 1174514 - RNA, 19 nt, Homo sapiens
ggacaucauauuugaacug

SEQ ID NO: 1174515 - RNA, 19 nt, Homo sapiens
guacaucaccgaacagacu

SEQ ID NO: 1174516 - RNA, 19 nt, Homo sapiens
cagcagcuaugacuuuguc

SEQ ID NO: 1174517 - RNA, 19 nt, Homo sapiens
uugaaucccugcaggagaa

SEQ ID NO: 1174518 - RNA, 19 nt, Homo sapiens
gcaagucguccgagagcaa

SEQ ID NO: 1174519 - RNA, 19 nt, Homo sapiens
caaaugaaggacgcaauga

SEQ ID NO: 1174520 - RNA, 19 nt, Homo sapiens
ucagcuauauguccuucaa

SEQ ID NO: 1174521 - RNA, 19 nt, Homo sapiens
cuauaauccugaaucaugu

SEQ ID NO: 1174522 - RNA, 19 nt, Homo sapiens
ugggacagcucaucucaca

SEQ ID NO: 1174523 - RNA, 19 nt, Homo sapiens
gaaugggacaaucuuacaa

SEQ ID NO: 1174524 - RNA, 19 nt, Homo sapiens
caggagaaacacuuacauu

SEQ ID NO: 1174525 - RNA, 19 nt, Homo sapiens
cuucaucgcaccuaauaaa

SEQ ID NO: 1174526 - RNA, 19 nt, Homo sapiens
gcacugauuaaugcacuuu

SEQ ID NO: 1174527 - RNA, 19 nt, Homo sapiens
cagaugguccucagcugua

SEQ ID NO: 1174528 - RNA, 19 nt, Homo sapiens
ccaaacccagaguauuaua

SEQ ID NO: 1174529 - RNA, 19 nt, Homo sapiens
ggauuuaccaaccacauca

SEQ ID NO: 1174530 - RNA, 19 nt, Homo sapiens
accaggagauucagaccua

SEQ ID NO: 1174531 - RNA, 19 nt, Homo sapiens
gcuacugaguucaucaaca

SEQ ID NO: 1174532 - RNA, 19 nt, Homo sapiens
cgacgugacuuucgcuacu

SEQ ID NO: 1174533 - RNA, 19 nt, Homo sapiens
cagacucgcagugacauua

SEQ ID NO: 1174534 - RNA, 19 nt, Homo sapiens
ggagguguagaaagaggua

SEQ ID NO: 1174535 - RNA, 19 nt, Homo sapiens
gaaaagugcucugaaacag

SEQ ID NO: 1174536 - RNA, 19 nt, Homo sapiens
gaaagauuguccccacaug

SEQ ID NO: 1174537 - RNA, 19 nt, Homo sapiens
cagaggacuucaacaaggu

SEQ ID NO: 1174538 - RNA, 19 nt, Homo sapiens
caacagcagaggacuucaa

SEQ ID NO: 1174539 - RNA, 19 nt, Homo sapiens
ugaccgagccuuugaagag

SEQ ID NO: 1174540 - RNA, 19 nt, Homo sapiens
ccaaaugaaggacgcaaug

SEQ ID NO: 1174541 - RNA, 19 nt, Homo sapiens
ggacaccuacauccggauu

SEQ ID NO: 1174542 - RNA, 19 nt, Homo sapiens
ggaagacaaacaugaaugc

SEQ ID NO: 1174543 - RNA, 19 nt, Homo sapiens
gggaagacaaacaugaaug

SEQ ID NO: 1174544 - RNA, 19 nt, Homo sapiens
ggacaacaugcuguacuug

SEQ ID NO: 1174545 - RNA, 19 nt, Homo sapiens
ccaaugaccaggcucaaag

SEQ ID NO: 1174546 - RNA, 19 nt, Homo sapiens
ccugggacaugguuucaau

SEQ ID NO: 1174547 - RNA, 19 nt, Homo sapiens
uauuauacccuccguuaug

SEQ ID NO: 1174548 - RNA, 19 nt, Homo sapiens
gggauugggccacgaggaa

SEQ ID NO: 1174549 - RNA, 19 nt, Homo sapiens
gcagcuaugacuuugucua

SEQ ID NO: 1174550 - RNA, 19 nt, Homo sapiens
cacccugacugccuuccua

SEQ ID NO: 1174551 - RNA, 19 nt, Homo sapiens
ccaccaccgucagacauug

SEQ ID NO: 1174552 - RNA, 19 nt, Homo sapiens
gacuuugucuaucacuaug

SEQ ID NO: 1174553 - RNA, 19 nt, Homo sapiens
cagcuaugacuuugucuau

SEQ ID NO: 1174554 - RNA, 19 nt, Homo sapiens
gaggacuucaacaagguua

SEQ ID NO: 1174555 - RNA, 19 nt, Homo sapiens
uggacaacaugcuguacuu

SEQ ID NO: 1174556 - RNA, 19 nt, Homo sapiens
cugaugagaccuuaaacuu

SEQ ID NO: 1174557 - RNA, 19 nt, Homo sapiens
cagcagcuuccgaaagauu

SEQ ID NO: 1174558 - RNA, 19 nt, Homo sapiens
gaucaguucaagagcaaau

SEQ ID NO: 1174559 - RNA, 19 nt, Homo sapiens
aaacaugaaugccccuuug

SEQ ID NO: 1174560 - RNA, 19 nt, Homo sapiens
guaaggcagccgugucugu

SEQ ID NO: 1174561 - RNA, 19 nt, Homo sapiens
gcaaagccauguacacaaa

SEQ ID NO: 1174562 - RNA, 19 nt, Homo sapiens
ggagggagguguagaaaga

SEQ ID NO: 1174563 - RNA, 19 nt, Homo sapiens
ggacauacguuagcacauu

SEQ ID NO: 1174564 - RNA, 19 nt, Homo sapiens
gaugagaccuuaaacuuca

SEQ ID NO: 1174565 - RNA, 19 nt, Homo sapiens
uaacaucucuggucuuuag

SEQ ID NO: 1174566 - RNA, 19 nt, Homo sapiens
gaagauagccgaggaaauc

SEQ ID NO: 1174567 - RNA, 19 nt, Homo sapiens
gaaacugcuucuugaaaug

SEQ ID NO: 1174568 - RNA, 19 nt, Homo sapiens
acaaggagguguuggaauu

SEQ ID NO: 1174569 - RNA, 19 nt, Homo sapiens
aaagggacaucauauuuga

SEQ ID NO: 1174570 - RNA, 19 nt, Homo sapiens
gccaaguccugcccucuua

SEQ ID NO: 1174571 - RNA, 19 nt, Homo sapiens
gcuaugacuuugucuauca

SEQ ID NO: 1174572 - RNA, 19 nt, Homo sapiens
caucgcaccuaauaaauau

SEQ ID NO: 1174573 - RNA, 19 nt, Homo sapiens
ucaaagggacaucauauuu

SEQ ID NO: 1174574 - RNA, 19 nt, Homo sapiens
gaaaggaugaugaccaaga

SEQ ID NO: 1174575 - RNA, 19 nt, Homo sapiens
ggcagcagcuuccgaaaga

SEQ ID NO: 1174576 - RNA, 19 nt, Homo sapiens
ugacaaggcucguggaaag

SEQ ID NO: 1174577 - RNA, 19 nt, Homo sapiens
ccagugagcugaccaagag

SEQ ID NO: 1174578 - RNA, 19 nt, Homo sapiens
caggaacgcugcagggaaa

SEQ ID NO: 1174579 - RNA, 19 nt, Homo sapiens
gagguuggcucuaacaucu

SEQ ID NO: 1174580 - RNA, 19 nt, Homo sapiens
ugaggaggauugcauuuga

SEQ ID NO: 1174581 - RNA, 19 nt, Homo sapiens
guacauggagaacaaguuu

SEQ ID NO: 1174582 - RNA, 19 nt, Homo sapiens
gaacagacucgcagugaca

SEQ ID NO: 1174583 - RNA, 19 nt, Homo sapiens
caaugaagaguguacuaua

SEQ ID NO: 1174584 - RNA, 19 nt, Homo sapiens
aagcaucuccggucuauaa

SEQ ID NO: 1174585 - RNA, 19 nt, Homo sapiens
ucuaacaucucuggucuuu

SEQ ID NO: 1174586 - RNA, 19 nt, Homo sapiens
gcagaggacagguguguug

SEQ ID NO: 1174587 - RNA, 19 nt, Homo sapiens
gaaagagguacauggagaa

SEQ ID NO: 1174588 - RNA, 19 nt, Homo sapiens
gagcaaaucacucgagcuu

SEQ ID NO: 1174589 - RNA, 19 nt, Homo sapiens
ucaacaagguuaugcaagu

SEQ ID NO: 1174590 - RNA, 19 nt, Homo sapiens
guacacaaaggacuacaaa

SEQ ID NO: 1174591 - RNA, 19 nt, Homo sapiens
gacaucauauuugaacuga

SEQ ID NO: 1174592 - RNA, 19 nt, Homo sapiens
ugccaaacccagaguauua

SEQ ID NO: 1174593 - RNA, 19 nt, Homo sapiens
gcacauuggcauucaguau

SEQ ID NO: 1174594 - RNA, 19 nt, Homo sapiens
gaacugaggaggauugcau

SEQ ID NO: 1174595 - RNA, 19 nt, Homo sapiens
gaggacaaacgacaggaua

SEQ ID NO: 1174596 - RNA, 19 nt, Homo sapiens
ggucuauaauccugaauca

SEQ ID NO: 1174597 - RNA, 19 nt, Homo sapiens
ucaaucaccuuuauuaagc

SEQ ID NO: 1174598 - RNA, 19 nt, Homo sapiens
gacauacguuagcacauug

SEQ ID NO: 1174599 - RNA, 19 nt, Homo sapiens
gacaggauauggcaaaugc

SEQ ID NO: 1174600 - RNA, 19 nt, Homo sapiens
aagaaaggaugaugaccaa

SEQ ID NO: 1174601 - RNA, 19 nt, Homo sapiens
cuucaaguccuaaccuuua

SEQ ID NO: 1174602 - RNA, 19 nt, Homo sapiens
cuacugaguucaucaacau

SEQ ID NO: 1174603 - RNA, 19 nt, Homo sapiens
ccucuuaagucuccaggaa

SEQ ID NO: 1174604 - RNA, 19 nt, Homo sapiens
guagaaagagguacaugga

SEQ ID NO: 1174605 - RNA, 19 nt, Homo sapiens
uaaacuucaucgcaccuaa

SEQ ID NO: 1174606 - RNA, 19 nt, Homo sapiens
gcucaaagggacaucauau

SEQ ID NO: 1174607 - RNA, 19 nt, Homo sapiens
uaucagagcagacggaaau

SEQ ID NO: 1174608 - RNA, 19 nt, Homo sapiens
agagguacauggagaacaa

SEQ ID NO: 1174609 - RNA, 19 nt, Homo sapiens
ccaaggagcccagcagcua

SEQ ID NO: 1174610 - RNA, 19 nt, Homo sapiens
ggaacuaccaaaugaagga

SEQ ID NO: 1174611 - RNA, 19 nt, Homo sapiens
guugagagccuugaaguga

SEQ ID NO: 1174612 - RNA, 19 nt, Homo sapiens
ccaguuugcuuuccuuugg

SEQ ID NO: 1174613 - RNA, 19 nt, Homo sapiens
cuucugagguuggcucuaa

SEQ ID NO: 1174614 - RNA, 19 nt, Homo sapiens
gugacuaccuguaucuuag

SEQ ID NO: 1174615 - RNA, 19 nt, Homo sapiens
ggacaaacgacaggauaug

SEQ ID NO: 1174616 - RNA, 19 nt, Homo sapiens
ucaucgcaccuaauaaaua

SEQ ID NO: 1174617 - RNA, 19 nt, Homo sapiens
cagcagaggacuucaacaa

SEQ ID NO: 1174618 - RNA, 19 nt, Homo sapiens
acauuggcauucaguauug

SEQ ID NO: 1174619 - RNA, 19 nt, Homo sapiens
cuuggucccugucuacuaa

SEQ ID NO: 1174620 - RNA, 19 nt, Homo sapiens
caaauugcguagccugagu

SEQ ID NO: 1174621 - RNA, 19 nt, Homo sapiens
caacaagguuaugcaaguc

SEQ ID NO: 1174622 - RNA, 19 nt, Homo sapiens
gaaucugcauccagcuguu

SEQ ID NO: 1174623 - RNA, 19 nt, Homo sapiens
ccuccaaacccaacucuuu

SEQ ID NO: 1174624 - RNA, 19 nt, Homo sapiens
ccauugagcucaccaaaau

SEQ ID NO: 1174625 - RNA, 19 nt, Homo sapiens
agaagcaucuccggucuau

SEQ ID NO: 1174626 - RNA, 19 nt, Homo sapiens
gacuuucgcuacugaguuc

SEQ ID NO: 1174627 - RNA, 19 nt, Homo sapiens
uggcauccauuaucaagga

SEQ ID NO: 1174628 - RNA, 19 nt, Homo sapiens
gcccagcagcuaugacuuu

SEQ ID NO: 1174629 - RNA, 19 nt, Homo sapiens
aaaggaugaugaccaagau

SEQ ID NO: 1174630 - RNA, 19 nt, Homo sapiens
ucuauaauccugaaucaug

SEQ ID NO: 1174631 - RNA, 19 nt, Homo sapiens
guauguaacacuuccaguu

SEQ ID NO: 1174632 - RNA, 19 nt, Homo sapiens
gaagugacuaccuguaucu

SEQ ID NO: 1174633 - RNA, 19 nt, Homo sapiens
ggacaucauauuugaacug

SEQ ID NO: 1174634 - RNA, 19 nt, Homo sapiens
guacaucaccgaacagacu

SEQ ID NO: 1174635 - RNA, 19 nt, Homo sapiens
cagcagcuaugacuuuguc

SEQ ID NO: 1174636 - RNA, 19 nt, Homo sapiens
uugaaucccugcaggagaa

SEQ ID NO: 1174637 - RNA, 19 nt, Homo sapiens
gcaagucguccgagagcaa

SEQ ID NO: 1174638 - RNA, 19 nt, Homo sapiens
caaaugaaggacgcaauga

SEQ ID NO: 1174639 - RNA, 19 nt, Homo sapiens
ucagcuauauguccuucaa

SEQ ID NO: 1174640 - RNA, 19 nt, Homo sapiens
cuauaauccugaaucaugu

SEQ ID NO: 1174641 - RNA, 19 nt, Homo sapiens
ugggacagcucaucucaca

SEQ ID NO: 1174642 - RNA, 19 nt, Homo sapiens
gaaugggacaaucuuacaa

SEQ ID NO: 1174643 - RNA, 19 nt, Homo sapiens
ugaagugacuaccuguauc

SEQ ID NO: 1174644 - RNA, 19 nt, Homo sapiens
caggagaaacacuuacauu

SEQ ID NO: 1174645 - RNA, 19 nt, Homo sapiens
cuucaucgcaccuaauaaa

SEQ ID NO: 1174646 - RNA, 19 nt, Homo sapiens
gcacugauuaaugcacuuu

SEQ ID NO: 1174647 - RNA, 19 nt, Homo sapiens
ccaaacccagaguauuaua

SEQ ID NO: 1174648 - RNA, 19 nt, Homo sapiens
cagaugguccucagcugua

SEQ ID NO: 1174649 - RNA, 19 nt, Homo sapiens
ccaagauuguaaccagaga

SEQ ID NO: 1174650 - RNA, 19 nt, Homo sapiens
ggauuuaccaaccacauca

SEQ ID NO: 1174651 - RNA, 19 nt, Homo sapiens
accaggagauucagaccua

SEQ ID NO: 1174652 - RNA, 19 nt, Homo sapiens
gcuacugaguucaucaaca

SEQ ID NO: 1174653 - RNA, 19 nt, Homo sapiens
cgacgugacuuucgcuacu

SEQ ID NO: 1174654 - RNA, 19 nt, Homo sapiens
cagacucgcagugacauua

SEQ ID NO: 1174655 - RNA, 19 nt, Homo sapiens
gauggaaccuuggggaaaa

SEQ ID NO: 1174656 - RNA, 19 nt, Homo sapiens
gaaaagugcucugaaacag

SEQ ID NO: 1174657 - RNA, 19 nt, Homo sapiens
gaaagauuguccccacaug

SEQ ID NO: 1174658 - RNA, 19 nt, Homo sapiens
cagaggacuucaacaaggu

SEQ ID NO: 1174659 - RNA, 19 nt, Homo sapiens
caacagcagaggacuucaa

SEQ ID NO: 1174660 - RNA, 19 nt, Homo sapiens
ugaccgagccuuugaagag

SEQ ID NO: 1174661 - RNA, 19 nt, Homo sapiens
gaaagaaguugggcuguaa

SEQ ID NO: 1174662 - RNA, 19 nt, Homo sapiens
gaauugggcuuguacagaa

SEQ ID NO: 1174663 - RNA, 19 nt, Homo sapiens
cagaaggcaucauuuauaa

SEQ ID NO: 1174664 - RNA, 19 nt, Homo sapiens
gaacuuggacaguaugaua

SEQ ID NO: 1174665 - RNA, 19 nt, Homo sapiens
cauaggagauagugcuuua

SEQ ID NO: 1174666 - RNA, 19 nt, Homo sapiens
gaaaggagaacuagaugaa

SEQ ID NO: 1174667 - RNA, 19 nt, Homo sapiens
gauagugacuuugaugauu

SEQ ID NO: 1174668 - RNA, 19 nt, Homo sapiens
gcagaaccaucuuggagaa

SEQ ID NO: 1174669 - RNA, 19 nt, Homo sapiens
ccaauaaagucaccaacaa

SEQ ID NO: 1174670 - RNA, 19 nt, Homo sapiens
gcaaaccacaguaucauuu

SEQ ID NO: 1174671 - RNA, 19 nt, Homo sapiens
gaaggcaucauuuauaaga

SEQ ID NO: 1174672 - RNA, 19 nt, Homo sapiens
gagcugcuguuaaggaauu

SEQ ID NO: 1174673 - RNA, 19 nt, Homo sapiens
gaccugaccugaagacgaa

SEQ ID NO: 1174674 - RNA, 19 nt, Homo sapiens
aaggagaacuagaugaaua

SEQ ID NO: 1174675 - RNA, 19 nt, Homo sapiens
gaaguugggcuguaaauca

SEQ ID NO: 1174676 - RNA, 19 nt, Homo sapiens
gaagaaggccacuugaaau

SEQ ID NO: 1174677 - RNA, 19 nt, Homo sapiens
ucagaaggcaucauuuaua

SEQ ID NO: 1174678 - RNA, 19 nt, Homo sapiens
gucaugauuuccuuucuua

SEQ ID NO: 1174679 - RNA, 19 nt, Homo sapiens
gauaauguauacccagaga

SEQ ID NO: 1174680 - RNA, 19 nt, Homo sapiens
uaaauagucuccuuugucu

SEQ ID NO: 1174681 - RNA, 19 nt, Homo sapiens
gggagccacugcaccaaua

SEQ ID NO: 1174682 - RNA, 19 nt, Homo sapiens
gauagacagucguguugaa

SEQ ID NO: 1174683 - RNA, 19 nt, Homo sapiens
gaaggccacuugaaauucu

SEQ ID NO: 1174684 - RNA, 19 nt, Homo sapiens
gacaauggcccuucagcua

SEQ ID NO: 1174685 - RNA, 19 nt, Homo sapiens
ggaauuucuugcuuauaga

SEQ ID NO: 1174686 - RNA, 19 nt, Homo sapiens
caucaucccuugcucuaga

SEQ ID NO: 1174687 - RNA, 19 nt, Homo sapiens
gaacagacaguauuuccau

SEQ ID NO: 1174688 - RNA, 19 nt, Homo sapiens
ggaugaugauagugacuuu

SEQ ID NO: 1174689 - RNA, 19 nt, Homo sapiens
gcgguaagcucuucaucau

SEQ ID NO: 1174690 - RNA, 19 nt, Homo sapiens
ggagaugccuggguguguu

SEQ ID NO: 1174691 - RNA, 19 nt, Homo sapiens
ugaagagcaugaauugguu

SEQ ID NO: 1174692 - RNA, 19 nt, Homo sapiens
gaaaagcuauggcaauauc

SEQ ID NO: 1174693 - RNA, 19 nt, Homo sapiens
ugaacgcgaucaagaguug

SEQ ID NO: 1174694 - RNA, 19 nt, Homo sapiens
ucaggaacuugucaugauu

SEQ ID NO: 1174695 - RNA, 19 nt, Homo sapiens
agaaagaaguugggcugua

SEQ ID NO: 1174696 - RNA, 19 nt, Homo sapiens
gcaguggaccuuugggaaa

SEQ ID NO: 1174697 - RNA, 19 nt, Homo sapiens
uaaugaagagcaugaauug

SEQ ID NO: 1174698 - RNA, 19 nt, Homo sapiens
agaagaaggccacuugaaa

SEQ ID NO: 1174699 - RNA, 19 nt, Homo sapiens
guuaaggaauuucuugcuu

SEQ ID NO: 1174700 - RNA, 19 nt, Homo sapiens
gugaagaagugaguauguu

SEQ ID NO: 1174701 - RNA, 19 nt, Homo sapiens
aacaauggcuggagguuug

SEQ ID NO: 1174702 - RNA, 19 nt, Homo sapiens
gaagaagugaguauguuuc

SEQ ID NO: 1174703 - RNA, 19 nt, Homo sapiens
ugacucagccacuuaagaa

SEQ ID NO: 1174704 - RNA, 19 nt, Homo sapiens
ugacuacagugacccaaau

SEQ ID NO: 1174705 - RNA, 19 nt, Homo sapiens
gcacaccugcuucaugaga

SEQ ID NO: 1174706 - RNA, 19 nt, Homo sapiens
caauggcccuucagcuaug

SEQ ID NO: 1174707 - RNA, 19 nt, Homo sapiens
gaucaggaacuugucauga

SEQ ID NO: 1174708 - RNA, 19 nt, Homo sapiens
gagcaugaauugguuuuaa

SEQ ID NO: 1174709 - RNA, 19 nt, Homo sapiens
agaacuagaugaauauguc

SEQ ID NO: 1174710 - RNA, 19 nt, Homo sapiens
cuaguguuguuaucuguuu

SEQ ID NO: 1174711 - RNA, 19 nt, Homo sapiens
gagaugccuggguguguua

SEQ ID NO: 1174712 - RNA, 19 nt, Homo sapiens
gaagagcaugaauugguuu

SEQ ID NO: 1174713 - RNA, 19 nt, Homo sapiens
cuuaagaccugaccugaag

SEQ ID NO: 1174714 - RNA, 19 nt, Homo sapiens
caaaauugacgaugugaua

SEQ ID NO: 1174715 - RNA, 19 nt, Homo sapiens
uaagacaguauggcaguua

SEQ ID NO: 1174716 - RNA, 19 nt, Homo sapiens
ggaggucucguggugcuua

SEQ ID NO: 1174717 - RNA, 19 nt, Homo sapiens
ccaugaacuuggacaguau

SEQ ID NO: 1174718 - RNA, 19 nt, Homo sapiens
ggagguuuguuugccauga

SEQ ID NO: 1174719 - RNA, 19 nt, Homo sapiens
uguugaagauccagaagaa

SEQ ID NO: 1174720 - RNA, 19 nt, Homo sapiens
gagccacaguucaaagcaa

SEQ ID NO: 1174721 - RNA, 19 nt, Homo sapiens
aggaauuucuugcuuauag

SEQ ID NO: 1174722 - RNA, 19 nt, Homo sapiens
ugaagaagugaguauguuu

SEQ ID NO: 1174723 - RNA, 19 nt, Homo sapiens
ucacagcaguggcauuugg

SEQ ID NO: 1174724 - RNA, 19 nt, Homo sapiens
gagguuuguuugccaugaa

SEQ ID NO: 1174725 - RNA, 19 nt, Homo sapiens
ucugcgaccuggacaguuu

SEQ ID NO: 1174726 - RNA, 19 nt, Homo sapiens
cagcuaugcuaggucuaua

SEQ ID NO: 1174727 - RNA, 19 nt, Homo sapiens
uguuucaccuggacauuaa

SEQ ID NO: 1174728 - RNA, 19 nt, Homo sapiens
caacaauggcuggagguuu

SEQ ID NO: 1174729 - RNA, 19 nt, Homo sapiens
agacuugggcuaucagaaa

SEQ ID NO: 1174730 - RNA, 19 nt, Homo sapiens
uaugcuaggucuauaaugg

SEQ ID NO: 1174731 - RNA, 19 nt, Homo sapiens
acaguauggcaguuaauua

SEQ ID NO: 1174732 - RNA, 19 nt, Homo sapiens
cagacaguauuuccaugaa

SEQ ID NO: 1174733 - RNA, 19 nt, Homo sapiens
aagaaggccacuugaaauu

SEQ ID NO: 1174734 - RNA, 19 nt, Homo sapiens
gaucuauaaugaagagcau

SEQ ID NO: 1174735 - RNA, 19 nt, Homo sapiens
guguggaacugagaaagaa

SEQ ID NO: 1174736 - RNA, 19 nt, Homo sapiens
ugagagacuugggcuauca

SEQ ID NO: 1174737 - RNA, 19 nt, Homo sapiens
gaggcaaaccacaguauca

SEQ ID NO: 1174738 - RNA, 19 nt, Homo sapiens
caauaaagucaccaacaau

SEQ ID NO: 1174739 - RNA, 19 nt, Homo sapiens
gaugauagugacuuugaug

SEQ ID NO: 1174740 - RNA, 19 nt, Homo sapiens
caaacaaaauugacgaugu

SEQ ID NO: 1174741 - RNA, 19 nt, Homo sapiens
caguauggcaguuaauuau

SEQ ID NO: 1174742 - RNA, 19 nt, Homo sapiens
gucagagacucgcucauca

SEQ ID NO: 1174743 - RNA, 19 nt, Homo sapiens
uaugauaguggcauggaua

SEQ ID NO: 1174744 - RNA, 19 nt, Homo sapiens
gacaguauuuccaugaacu

SEQ ID NO: 1174745 - RNA, 19 nt, Homo sapiens
uuaaugaacgcgaucaaga

SEQ ID NO: 1174746 - RNA, 19 nt, Homo sapiens
gacaguauggcaguuaauu

SEQ ID NO: 1174747 - RNA, 19 nt, Homo sapiens
aaugggaagugucacaguu

SEQ ID NO: 1174748 - RNA, 19 nt, Homo sapiens
gccaugaacagacaguauu

SEQ ID NO: 1174749 - RNA, 19 nt, Homo sapiens
uuaagaaugugcccgucaa

SEQ ID NO: 1174750 - RNA, 19 nt, Homo sapiens
agacagucguguugaagau

SEQ ID NO: 1174751 - RNA, 19 nt, Homo sapiens
uaggagauagugcuuuaaa

SEQ ID NO: 1174752 - RNA, 19 nt, Homo sapiens
ccaugacacacaacucuuu

SEQ ID NO: 1174753 - RNA, 19 nt, Homo sapiens
gcuaucagaaacaugcuuu

SEQ ID NO: 1174754 - RNA, 19 nt, Homo sapiens
cagaagaaggccacuugaa

SEQ ID NO: 1174755 - RNA, 19 nt, Homo sapiens
aagacaguauggcaguuaa

SEQ ID NO: 1174756 - RNA, 19 nt, Homo sapiens
gauguuugagcugcuguua

SEQ ID NO: 1174757 - RNA, 19 nt, Homo sapiens
gcaguggcauuuggaaggu

SEQ ID NO: 1174758 - RNA, 19 nt, Homo sapiens
ucuaucaccuccagaccaa

SEQ ID NO: 1174759 - RNA, 19 nt, Homo sapiens
uaauguauacccagagaug

SEQ ID NO: 1174760 - RNA, 19 nt, Homo sapiens
gcuauggcaauaucaguga

SEQ ID NO: 1174761 - RNA, 19 nt, Homo sapiens
ggaaauagcacaaauaguu

SEQ ID NO: 1174762 - RNA, 19 nt, Homo sapiens
caaugaagcuugaggauuu

SEQ ID NO: 1174763 - RNA, 19 nt, Homo sapiens
gaagaauccucauacagua

SEQ ID NO: 1174764 - RNA, 19 nt, Homo sapiens
uagcauaccuugcagauuu

SEQ ID NO: 1174765 - RNA, 19 nt, Homo sapiens
caaaugggaugaugacuau

SEQ ID NO: 1174766 - RNA, 19 nt, Homo sapiens
guuaagagcugcuuguuau

SEQ ID NO: 1174767 - RNA, 19 nt, Homo sapiens
uaagauagcacuugaugua

SEQ ID NO: 1174768 - RNA, 19 nt, Homo sapiens
gcaaguaaauggauauugg

SEQ ID NO: 1174769 - RNA, 19 nt, Homo sapiens
aaagagagaucguagaaga

SEQ ID NO: 1174770 - RNA, 19 nt, Homo sapiens
aaagacagcucuagaaauc

SEQ ID NO: 1174771 - RNA, 19 nt, Homo sapiens
gcacagaacuuuggaaacu

SEQ ID NO: 1174772 - RNA, 19 nt, Homo sapiens
gagagaaguuaucugcuuu

SEQ ID NO: 1174773 - RNA, 19 nt, Homo sapiens
caucagguccuaucaguua

SEQ ID NO: 1174774 - RNA, 19 nt, Homo sapiens
gcaaagacagcucuagaaa

SEQ ID NO: 1174775 - RNA, 19 nt, Homo sapiens
gauauuggauccauuucuu

SEQ ID NO: 1174776 - RNA, 19 nt, Homo sapiens
gaaguuaucugcuuuuguu

SEQ ID NO: 1174777 - RNA, 19 nt, Homo sapiens
ccaaauacuuacucacauu

SEQ ID NO: 1174778 - RNA, 19 nt, Homo sapiens
caagagcaguaauuuaguu

SEQ ID NO: 1174779 - RNA, 19 nt, Homo sapiens
ucaauagccugaagcauau

SEQ ID NO: 1174780 - RNA, 19 nt, Homo sapiens
gcaaaugggaugaugacua

SEQ ID NO: 1174781 - RNA, 19 nt, Homo sapiens
gaauacuaccugagaauuu

SEQ ID NO: 1174782 - RNA, 19 nt, Homo sapiens
cuacauaccuuugugaguu

SEQ ID NO: 1174783 - RNA, 19 nt, Homo sapiens
ugaagaaauuggcauagaa

SEQ ID NO: 1174784 - RNA, 19 nt, Homo sapiens
gaauauaguguccuccuuu

SEQ ID NO: 1174785 - RNA, 19 nt, Homo sapiens
ggagaagaauccucauaca

SEQ ID NO: 1174786 - RNA, 19 nt, Homo sapiens
ccacaagagcaguaauuua

SEQ ID NO: 1174787 - RNA, 19 nt, Homo sapiens
uaaagacauugccuacaaa

SEQ ID NO: 1174788 - RNA, 19 nt, Homo sapiens
caaagccaguccucuuaaa

SEQ ID NO: 1174789 - RNA, 19 nt, Homo sapiens
gaaaugagccaggauaucu

SEQ ID NO: 1174790 - RNA, 19 nt, Homo sapiens
uggcaucucuggaauacua

SEQ ID NO: 1174791 - RNA, 19 nt, Homo sapiens
uacaguagcugaaaaguua

SEQ ID NO: 1174792 - RNA, 19 nt, Homo sapiens
gggaugcucuguuuacugu

SEQ ID NO: 1174793 - RNA, 19 nt, Homo sapiens
guauguggcucuguuugua

SEQ ID NO: 1174794 - RNA, 19 nt, Homo sapiens
gauagcacuugauguaugu

SEQ ID NO: 1174795 - RNA, 19 nt, Homo sapiens
gaauuucucuucugugaac

SEQ ID NO: 1174796 - RNA, 19 nt, Homo sapiens
gaggauacuuuauuacaag

SEQ ID NO: 1174797 - RNA, 19 nt, Homo sapiens
gcauuugugcgcuauauaa

SEQ ID NO: 1174798 - RNA, 19 nt, Homo sapiens
auaaagacauugccuacaa

SEQ ID NO: 1174799 - RNA, 19 nt, Homo sapiens
cagaugaugugauccauuc

SEQ ID NO: 1174800 - RNA, 19 nt, Homo sapiens
gaagaaauuggcauagaau

SEQ ID NO: 1174801 - RNA, 19 nt, Homo sapiens
gaaaggaauagauguguuc

SEQ ID NO: 1174802 - RNA, 19 nt, Homo sapiens
gaugugauccauucuagaa

SEQ ID NO: 1174803 - RNA, 19 nt, Homo sapiens
gaaagcauuuggaguugca

SEQ ID NO: 1174804 - RNA, 19 nt, Homo sapiens
gcaacuacauaccuuugug

SEQ ID NO: 1174805 - RNA, 19 nt, Homo sapiens
gaugaaaugagccaggaua

SEQ ID NO: 1174806 - RNA, 19 nt, Homo sapiens
cguaucaauuugcguauuu

SEQ ID NO: 1174807 - RNA, 19 nt, Homo sapiens
gcuuuaaucugagugauga

SEQ ID NO: 1174808 - RNA, 19 nt, Homo sapiens
gaacacaguaucagcuaga

SEQ ID NO: 1174809 - RNA, 19 nt, Homo sapiens
acagaacuuuggaaacuuu

SEQ ID NO: 1174810 - RNA, 19 nt, Homo sapiens
acuguaagcugauauacuu

SEQ ID NO: 1174811 - RNA, 19 nt, Homo sapiens
uagaaauccuuaugccauu

SEQ ID NO: 1174812 - RNA, 19 nt, Homo sapiens
gagcaguaauuuaguugau

SEQ ID NO: 1174813 - RNA, 19 nt, Homo sapiens
uaaaguggguauucagcuu

SEQ ID NO: 1174814 - RNA, 19 nt, Homo sapiens
gcagguacccuuaucagau

SEQ ID NO: 1174815 - RNA, 19 nt, Homo sapiens
acaagcaucguaucaauuu

SEQ ID NO: 1174816 - RNA, 19 nt, Homo sapiens
gcaacuucuuccauggaua

SEQ ID NO: 1174817 - RNA, 19 nt, Homo sapiens
ugagacaacugacauggau

SEQ ID NO: 1174818 - RNA, 19 nt, Homo sapiens
gccaaauccuaauggaauu

SEQ ID NO: 1174819 - RNA, 19 nt, Homo sapiens
gcuaguggccaaauccuaa

SEQ ID NO: 1174820 - RNA, 19 nt, Homo sapiens
cauugcagcugaaauaaca

SEQ ID NO: 1174821 - RNA, 19 nt, Homo sapiens
agagagaaguuaucugcuu

SEQ ID NO: 1174822 - RNA, 19 nt, Homo sapiens
acacuuaaaugaacucagu

SEQ ID NO: 1174823 - RNA, 19 nt, Homo sapiens
uaagagcugcuuguuauuu

SEQ ID NO: 1174824 - RNA, 19 nt, Homo sapiens
guaauucugucucuuucau

SEQ ID NO: 1174825 - RNA, 19 nt, Homo sapiens
gagagaucguagaagaauu

SEQ ID NO: 1174826 - RNA, 19 nt, Homo sapiens
uuacaagcaucguaucaau

SEQ ID NO: 1174827 - RNA, 19 nt, Homo sapiens
guugauggcuuugaaaaua

SEQ ID NO: 1174828 - RNA, 19 nt, Homo sapiens
cucaauagccugaagcaua

SEQ ID NO: 1174829 - RNA, 19 nt, Homo sapiens
ggaauacuaccugagaauu

SEQ ID NO: 1174830 - RNA, 19 nt, Homo sapiens
gcaugcauucuuguaauua

SEQ ID NO: 1174831 - RNA, 19 nt, Homo sapiens
gcagauuuauucaaacacu

SEQ ID NO: 1174832 - RNA, 19 nt, Homo sapiens
ugaaaggaauagauguguu

SEQ ID NO: 1174833 - RNA, 19 nt, Homo sapiens
cagguacccuuaucagaug

SEQ ID NO: 1174834 - RNA, 19 nt, Homo sapiens
ugaggcaaguaaauggaua

SEQ ID NO: 1174835 - RNA, 19 nt, Homo sapiens
cacaagagcaguaauuuag

SEQ ID NO: 1174836 - RNA, 19 nt, Homo sapiens
gauggugccuccucuaugc

SEQ ID NO: 1174837 - RNA, 19 nt, Homo sapiens
gaaaccuugugcacuggaa

SEQ ID NO: 1174838 - RNA, 19 nt, Homo sapiens
cagcagaagucacuguaag

SEQ ID NO: 1174839 - RNA, 19 nt, Homo sapiens
caaagacagcucuagaaau

SEQ ID NO: 1174840 - RNA, 19 nt, Homo sapiens
acugagggaugcucuguuu

SEQ ID NO: 1174841 - RNA, 19 nt, Homo sapiens
gugaaaccuugaaagcauu

SEQ ID NO: 1174842 - RNA, 19 nt, Homo sapiens
gcuguaauucugucucuuu

SEQ ID NO: 1174843 - RNA, 19 nt, Homo sapiens
ggccaaauccuaauggaau

SEQ ID NO: 1174844 - RNA, 19 nt, Homo sapiens
agaaagagagaucguagaa

SEQ ID NO: 1174845 - RNA, 19 nt, Homo sapiens
gaucagagugaaaccuuga

SEQ ID NO: 1174846 - RNA, 19 nt, Homo sapiens
caacuucuuccauggauau

SEQ ID NO: 1174847 - RNA, 19 nt, Homo sapiens
gcagaggacugggaugaac

SEQ ID NO: 1174848 - RNA, 19 nt, Homo sapiens
ccuugcagauuuauucaaa

SEQ ID NO: 1174849 - RNA, 19 nt, Homo sapiens
guggugaggguaauaaauu

SEQ ID NO: 1174850 - RNA, 19 nt, Homo sapiens
ccuagcagcuggcguucuu

SEQ ID NO: 1174851 - RNA, 19 nt, Homo sapiens
uaucguaguuacacauugu

SEQ ID NO: 1174852 - RNA, 19 nt, Homo sapiens
agauagcacuugauguaug

SEQ ID NO: 1174853 - RNA, 19 nt, Homo sapiens
cauaagauagcacuugaug

SEQ ID NO: 1174854 - RNA, 19 nt, Homo sapiens
aggaauagauguguucaau

SEQ ID NO: 1174855 - RNA, 19 nt, Homo sapiens
agagaucguagaagaauuu

SEQ ID NO: 1174856 - RNA, 19 nt, Homo sapiens
aagagcugcuuguuauuug

SEQ ID NO: 1174857 - RNA, 19 nt, Homo sapiens
ggacaucauugaacaaaag

SEQ ID NO: 1174858 - RNA, 19 nt, Homo sapiens
gaugaugugauccauucua

SEQ ID NO: 1174859 - RNA, 19 nt, Homo sapiens
caacuacauaccuuuguga

SEQ ID NO: 1174860 - RNA, 19 nt, Homo sapiens
ggcaaagacagcucuagaa

SEQ ID NO: 1174861 - RNA, 19 nt, Homo sapiens
gaucuaaacuucaugaaca

SEQ ID NO: 1174862 - RNA, 19 nt, Homo sapiens
ucaccaagcaagauaauua

SEQ ID NO: 1174863 - RNA, 19 nt, Homo sapiens
caaagcagauagaagugaa

SEQ ID NO: 1174864 - RNA, 19 nt, Homo sapiens
auaaagcgaucuaaacuuc

SEQ ID NO: 1174865 - RNA, 19 nt, Homo sapiens
guggcugacuuaaagauaa

SEQ ID NO: 1174866 - RNA, 19 nt, Homo sapiens
agaggaggcuggauggaaa

SEQ ID NO: 1174867 - RNA, 19 nt, Homo sapiens
gaaaagaggaggaugagaa

SEQ ID NO: 1174868 - RNA, 19 nt, Homo sapiens
ggccugacauggaagaaga

SEQ ID NO: 1174869 - RNA, 19 nt, Homo sapiens
gcagauagaagugaauugu

SEQ ID NO: 1174870 - RNA, 19 nt, Homo sapiens
gauaaagcgaucuaaacuu

SEQ ID NO: 1174871 - RNA, 19 nt, Homo sapiens
gcaaagcagauagaaguga

SEQ ID NO: 1174872 - RNA, 19 nt, Homo sapiens
uauauuacaugcugcaaag

SEQ ID NO: 1174873 - RNA, 19 nt, Homo sapiens
gagaagaugagcagagcuu

SEQ ID NO: 1174874 - RNA, 19 nt, Homo sapiens
ugacauggaagaagauaau

SEQ ID NO: 1174875 - RNA, 19 nt, Homo sapiens
uggcugacuuaaagauaaa

SEQ ID NO: 1174876 - RNA, 19 nt, Homo sapiens
caaaugucaccaagcaaga

SEQ ID NO: 1174877 - RNA, 19 nt, Homo sapiens
ugacagauucagaggacua

SEQ ID NO: 1174878 - RNA, 19 nt, Homo sapiens
uuucaaaugucaccaagca

SEQ ID NO: 1174879 - RNA, 19 nt, Homo sapiens
gauuugggccugacaugga

SEQ ID NO: 1174880 - RNA, 19 nt, Homo sapiens
ggcuuuaccucgucucaca

SEQ ID NO: 1174881 - RNA, 19 nt, Homo sapiens
aaagcgaucuaaacuucau

SEQ ID NO: 1174882 - RNA, 19 nt, Homo sapiens
gaacaaguuuuagauuugg

SEQ ID NO: 1174883 - RNA, 19 nt, Homo sapiens
gacauggaagaagauaaua

SEQ ID NO: 1174884 - RNA, 19 nt, Homo sapiens
ggagaagaguaaaaugcaa

SEQ ID NO: 1174885 - RNA, 19 nt, Homo sapiens
agaggaggaugagaagaug

SEQ ID NO: 1174886 - RNA, 19 nt, Homo sapiens
cagauucagaggacuaaga

SEQ ID NO: 1174887 - RNA, 19 nt, Homo sapiens
auucagaggacuaagauga

SEQ ID NO: 1174888 - RNA, 19 nt, Homo sapiens
caccaagcaagauaauuau

SEQ ID NO: 1174889 - RNA, 19 nt, Homo sapiens
gaagaggaggcuggaugga

SEQ ID NO: 1174890 - RNA, 19 nt, Homo sapiens
gacagauucagaggacuaa

SEQ ID NO: 1174891 - RNA, 19 nt, Homo sapiens
gaggaggaugagaagauga

SEQ ID NO: 1174892 - RNA, 19 nt, Homo sapiens
aagaggaggaugagaagau

SEQ ID NO: 1174893 - RNA, 19 nt, Homo sapiens
aauuguccauuccagaaga

SEQ ID NO: 1174894 - RNA, 19 nt, Homo sapiens
aaugucaccaagcaagaua

SEQ ID NO: 1174895 - RNA, 19 nt, Homo sapiens
gagaagaguaaaaugcaaa

SEQ ID NO: 1174896 - RNA, 19 nt, Homo sapiens
uaaagcgaucuaaacuuca

SEQ ID NO: 1174897 - RNA, 19 nt, Homo sapiens
ucaaguggcugaaguugug

SEQ ID NO: 1174898 - RNA, 19 nt, Homo sapiens
gcacgaugcucgcuuacag

SEQ ID NO: 1174899 - RNA, 19 nt, Homo sapiens
cuggagaugucuuuauaaa

SEQ ID NO: 1174900 - RNA, 19 nt, Homo sapiens
ucagggacuugcuuuaguu

SEQ ID NO: 1174901 - RNA, 19 nt, Homo sapiens
guccagggcuuguuugaca

SEQ ID NO: 1174902 - RNA, 19 nt, Homo sapiens
acaggaagcuggagauguc

SEQ ID NO: 1174903 - RNA, 19 nt, Homo sapiens
ggaagcuggagaugucuuu

SEQ ID NO: 1174904 - RNA, 19 nt, Homo sapiens
gggaggaacagccugagaa

SEQ ID NO: 1174905 - RNA, 19 nt, Homo sapiens
gaagguggcacugcucugu

SEQ ID NO: 1174906 - RNA, 19 nt, Homo sapiens
gaagcuggagaugucuuua

SEQ ID NO: 1174907 - RNA, 19 nt, Homo sapiens
ggccuuccaugugcuguuu

SEQ ID NO: 1174908 - RNA, 19 nt, Homo sapiens
agcuggagaugucuuuaua

SEQ ID NO: 1174909 - RNA, 19 nt, Homo sapiens
ccaacugccuggucaucga

SEQ ID NO: 1174910 - RNA, 19 nt, Homo sapiens
gcuggagaugucuuuauaa

SEQ ID NO: 1174911 - RNA, 19 nt, Homo sapiens
guacaucagggacuugcuu

SEQ ID NO: 1174912 - RNA, 19 nt, Homo sapiens
ugggcacgaugcucgcuua

SEQ ID NO: 1174913 - RNA, 19 nt, Homo sapiens
ggaugagccagaugaggaa

SEQ ID NO: 1174914 - RNA, 19 nt, Homo sapiens
aggaacagccugagaagga

SEQ ID NO: 1174915 - RNA, 19 nt, Homo sapiens
gcugcucagugaugacuuc

SEQ ID NO: 1174916 - RNA, 19 nt, Homo sapiens
gcaucaacacccugcaguu

SEQ ID NO: 1174917 - RNA, 19 nt, Homo sapiens
ugugggaccuggugguguu

SEQ ID NO: 1174918 - RNA, 19 nt, Homo sapiens
gcccagaagcuuucagaca

SEQ ID NO: 1174919 - RNA, 19 nt, Homo sapiens
ggaggaacagccugagaag

SEQ ID NO: 1174920 - RNA, 19 nt, Homo sapiens
agaucgagguggagaagau

SEQ ID NO: 1174921 - RNA, 19 nt, Homo sapiens
gguacucugugguggagau

SEQ ID NO: 1174922 - RNA, 19 nt, Homo sapiens
cggcgcagccuguacauca

SEQ ID NO: 1174923 - RNA, 19 nt, Homo sapiens
caucaacacccugcaguuc

SEQ ID NO: 1174924 - RNA, 19 nt, Homo sapiens
caggaggcccagaagcuuu

SEQ ID NO: 1174925 - RNA, 19 nt, Homo sapiens
uagccucccugaagaagca

SEQ ID NO: 1174926 - RNA, 19 nt, Homo sapiens
cgaggaugauuuccacaac

SEQ ID NO: 1174927 - RNA, 19 nt, Homo sapiens
guccuuagccucccugaag

SEQ ID NO: 1174928 - RNA, 19 nt, Homo sapiens
ccugcuggguguguccuua

SEQ ID NO: 1174929 - RNA, 19 nt, Homo sapiens
caucagggacuugcuuuag

SEQ ID NO: 1174930 - RNA, 19 nt, Homo sapiens
gaggucugguuccgcuuca

SEQ ID NO: 1174931 - RNA, 19 nt, Homo sapiens
gcaggagcgaggucugguu

SEQ ID NO: 1174932 - RNA, 19 nt, Homo sapiens
cggacgguauggaggacua

SEQ ID NO: 1174933 - RNA, 19 nt, Homo sapiens
ucaacgaggguguuuccaa

SEQ ID NO: 1174934 - RNA, 19 nt, Homo sapiens
ggugguccagggcuuguuu

SEQ ID NO: 1174935 - RNA, 19 nt, Homo sapiens
gcucaaguggcugaaguug

SEQ ID NO: 1174936 - RNA, 19 nt, Homo sapiens
guacagcacccgugaaaag

SEQ ID NO: 1174937 - RNA, 19 nt, Homo sapiens
gugagaaaacugacaauga

SEQ ID NO: 1174938 - RNA, 19 nt, Homo sapiens
gacaggaagcuggagaugu

SEQ ID NO: 1174939 - RNA, 19 nt, Homo sapiens
ccacggagucucagaagcu

SEQ ID NO: 1174940 - RNA, 19 nt, Homo sapiens
ugagaaaacugacaaugac

SEQ ID NO: 1174941 - RNA, 19 nt, Homo sapiens
acucugugguggagaugaa

SEQ ID NO: 1174942 - RNA, 19 nt, Homo sapiens
ucaccuaccagacgaagca

SEQ ID NO: 1174943 - RNA, 19 nt, Homo sapiens
ccucuggguggaugaguuu

SEQ ID NO: 1174944 - RNA, 19 nt, Homo sapiens
ggaccucgcagagcuuugg

SEQ ID NO: 1174945 - RNA, 19 nt, Homo sapiens
gcacuagcaugugauauua

SEQ ID NO: 1174946 - RNA, 19 nt, Homo sapiens
ggaagggcaucauggcuua

SEQ ID NO: 1174947 - RNA, 19 nt, Homo sapiens
gaagauggcacaacuguag

SEQ ID NO: 1174948 - RNA, 19 nt, Homo sapiens
caucauggcuuacagucuu

SEQ ID NO: 1174949 - RNA, 19 nt, Homo sapiens
ugaagauacugcagugaaa

SEQ ID NO: 1174950 - RNA, 19 nt, Homo sapiens
ggaggaagauggcacaacu

SEQ ID NO: 1174951 - RNA, 19 nt, Homo sapiens
uuagggaguuugcaauaaa

SEQ ID NO: 1174952 - RNA, 19 nt, Homo sapiens
caagcgcacuagcauguga

SEQ ID NO: 1174953 - RNA, 19 nt, Homo sapiens
gggaguuugcaauaaauua

SEQ ID NO: 1174954 - RNA, 19 nt, Homo sapiens
ugaagucugucccuccauu

SEQ ID NO: 1174955 - RNA, 19 nt, Homo sapiens
gaacccacaggacuucauu

SEQ ID NO: 1174956 - RNA, 19 nt, Homo sapiens
ccauaagccugccaagaag

SEQ ID NO: 1174957 - RNA, 19 nt, Homo sapiens
gauauuagggaguuugcaa

SEQ ID NO: 1174958 - RNA, 19 nt, Homo sapiens
gccucacgcuuaacuggua

SEQ ID NO: 1174959 - RNA, 19 nt, Homo sapiens
cccauaagccugccaagaa

SEQ ID NO: 1174960 - RNA, 19 nt, Homo sapiens
ggaagauggcacaacugua

SEQ ID NO: 1174961 - RNA, 19 nt, Homo sapiens
uggcacaacuguagagaca

SEQ ID NO: 1174962 - RNA, 19 nt, Homo sapiens
ccacugucccucucccaua

SEQ ID NO: 1174963 - RNA, 19 nt, Homo sapiens
caugugauauuagggaguu

SEQ ID NO: 1174964 - RNA, 19 nt, Homo sapiens
cacugucccucucccauaa

SEQ ID NO: 1174965 - RNA, 19 nt, Homo sapiens
cgaccugucugaagauacu

SEQ ID NO: 1174966 - RNA, 19 nt, Homo sapiens
gggauacaguguucauggu

SEQ ID NO: 1174967 - RNA, 19 nt, Homo sapiens
ugaauucgcaagcgcacua

SEQ ID NO: 1174968 - RNA, 19 nt, Homo sapiens
gaagucugucccuccauug

SEQ ID NO: 1174969 - RNA, 19 nt, Homo sapiens
uagggaguuugcaauaaau

SEQ ID NO: 1174970 - RNA, 19 nt, Homo sapiens
ucauggugcucucuaccuu

SEQ ID NO: 1174971 - RNA, 19 nt, Homo sapiens
gaagauacugcagugaaag

SEQ ID NO: 1174972 - RNA, 19 nt, Homo sapiens
ggagagaggaggcuuugac

SEQ ID NO: 1174973 - RNA, 19 nt, Homo sapiens
auuagggaguuugcaauaa

SEQ ID NO: 1174974 - RNA, 19 nt, Homo sapiens
gcaguccagcugacaagga

SEQ ID NO: 1174975 - RNA, 19 nt, Homo sapiens
agugaaagcccaaguccuu

SEQ ID NO: 1174976 - RNA, 19 nt, Homo sapiens
cgcacuagcaugugauauu

SEQ ID NO: 1174977 - RNA, 19 nt, Homo sapiens
caguccagcugacaaggau

SEQ ID NO: 1174978 - RNA, 19 nt, Homo sapiens
uaacugguagugcccacaa

SEQ ID NO: 1174979 - RNA, 19 nt, Homo sapiens
uggaauacgccaugaaguc

SEQ ID NO: 1174980 - RNA, 19 nt, Homo sapiens
cugaagauacugcagugaa

SEQ ID NO: 1174981 - RNA, 19 nt, Homo sapiens
ugugaggucucuggacuag

SEQ ID NO: 1174982 - RNA, 19 nt, Homo sapiens
gagagaggaggcuuugacu

SEQ ID NO: 1174983 - RNA, 19 nt, Homo sapiens
gggacaaggcacccacugu

SEQ ID NO: 1174984 - RNA, 19 nt, Homo sapiens
caaggacccaugggagaga

SEQ ID NO: 1174985 - RNA, 19 nt, Homo sapiens
caacacagaucauggauuu

SEQ ID NO: 1174986 - RNA, 19 nt, Homo sapiens
gaacagugaugacgaaaca

SEQ ID NO: 1174987 - RNA, 19 nt, Homo sapiens
ggacgaugaugacauugua

SEQ ID NO: 1174988 - RNA, 19 nt, Homo sapiens
ggaggacgaugaugacauu

SEQ ID NO: 1174989 - RNA, 19 nt, Homo sapiens
ucaccucccucuucauuua

SEQ ID NO: 1174990 - RNA, 19 nt, Homo sapiens
gagcugagauggagaguca

SEQ ID NO: 1174991 - RNA, 19 nt, Homo sapiens
ucacacacauccaguauga

SEQ ID NO: 1174992 - RNA, 19 nt, Homo sapiens
ggacucaccucccucuuca

SEQ ID NO: 1174993 - RNA, 19 nt, Homo sapiens
gcacacggcacaagaagaa

SEQ ID NO: 1174994 - RNA, 19 nt, Homo sapiens
gaacagacagugaccaauc

SEQ ID NO: 1174995 - RNA, 19 nt, Homo sapiens
agaaauaccgcaaguacua

SEQ ID NO: 1174996 - RNA, 19 nt, Homo sapiens
ggaggaagccgccuacauc

SEQ ID NO: 1174997 - RNA, 19 nt, Homo sapiens
gcagcaagcccuacaagug

SEQ ID NO: 1174998 - RNA, 19 nt, Homo sapiens
gacaagcccuucaaaugca

SEQ ID NO: 1174999 - RNA, 19 nt, Homo sapiens
acaaccaggugcaguauau

SEQ ID NO: 1175000 - RNA, 19 nt, Homo sapiens
gaucuucugcugaacauga

SEQ ID NO: 1175001 - RNA, 19 nt, Homo sapiens
caucaucguugcccaggaa

SEQ ID NO: 1175002 - RNA, 19 nt, Homo sapiens
ggaagccgccuacauccaa

SEQ ID NO: 1175003 - RNA, 19 nt, Homo sapiens
gcacauggcacagcacuca

SEQ ID NO: 1175004 - RNA, 19 nt, Homo sapiens
gcagguggcuguggugaag

SEQ ID NO: 1175005 - RNA, 19 nt, Homo sapiens
ggcgacaacuuuccaguca

SEQ ID NO: 1175006 - RNA, 19 nt, Homo sapiens
caucugugguucucgcuuu

SEQ ID NO: 1175007 - RNA, 19 nt, Homo sapiens
gcaagaaauaccgcaagua

SEQ ID NO: 1175008 - RNA, 19 nt, Homo sapiens
gccagcagcuugucacaca

SEQ ID NO: 1175009 - RNA, 19 nt, Homo sapiens
gugacaagcccuucaaaug

SEQ ID NO: 1175010 - RNA, 19 nt, Homo sapiens
ccuggcaccugguccauuu

SEQ ID NO: 1175011 - RNA, 19 nt, Homo sapiens
ccucauugcucuguucuga

SEQ ID NO: 1175012 - RNA, 19 nt, Homo sapiens
cgacaacuuuccagucauc

SEQ ID NO: 1175013 - RNA, 19 nt, Homo sapiens
ggccagauccgacuccaaa

SEQ ID NO: 1175014 - RNA, 19 nt, Homo sapiens
caagaaauaccgcaaguac

SEQ ID NO: 1175015 - RNA, 19 nt, Homo sapiens
uguagacgcuggagccauu

SEQ ID NO: 1175016 - RNA, 19 nt, Homo sapiens
gcagacagccuuggaucuu

SEQ ID NO: 1175017 - RNA, 19 nt, Homo sapiens
ucugugaguuuguuuguga

SEQ ID NO: 1175018 - RNA, 19 nt, Homo sapiens
ucaaggagcacauguucaa

SEQ ID NO: 1175019 - RNA, 19 nt, Homo sapiens
gacagugcccgaacacauu

SEQ ID NO: 1175020 - RNA, 19 nt, Homo sapiens
gaucacacacauccaguau

SEQ ID NO: 1175021 - RNA, 19 nt, Homo sapiens
caacuuuccagucaucuga

SEQ ID NO: 1175022 - RNA, 19 nt, Homo sapiens
ggcccgaccucauccagaa

SEQ ID NO: 1175023 - RNA, 19 nt, Homo sapiens
ccgaucagauggaggagaa

SEQ ID NO: 1175024 - RNA, 19 nt, Homo sapiens
guaacgggcaccucaaguu

SEQ ID NO: 1175025 - RNA, 19 nt, Homo sapiens
gaaauaccgcaaguacuau

SEQ ID NO: 1175026 - RNA, 19 nt, Homo sapiens
gcacugagccaggaacaca

SEQ ID NO: 1175027 - RNA, 19 nt, Homo sapiens
caaagaaguuuuccugcaa

SEQ ID NO: 1175028 - RNA, 19 nt, Homo sapiens
caucaccaauguccaguuc

SEQ ID NO: 1175029 - RNA, 19 nt, Homo sapiens
agaggaacguggcuacgaa

SEQ ID NO: 1175030 - RNA, 19 nt, Homo sapiens
gaagucggaagauguggaa

SEQ ID NO: 1175031 - RNA, 19 nt, Homo sapiens
gcaaguacuauuacaaguc

SEQ ID NO: 1175032 - RNA, 19 nt, Homo sapiens
gcucggccaucgacaagau

SEQ ID NO: 1175033 - RNA, 19 nt, Homo sapiens
ccacuuccguccaguagca

SEQ ID NO: 1175034 - RNA, 19 nt, Homo sapiens
ggcaagaaauaccgcaagu

SEQ ID NO: 1175035 - RNA, 19 nt, Homo sapiens
cauccaguaugaacaagga

SEQ ID NO: 1175036 - RNA, 19 nt, Homo sapiens
cagcaagcccuacaagugu

SEQ ID NO: 1175037 - RNA, 19 nt, Homo sapiens
ggugugagccagucagaug

SEQ ID NO: 1175038 - RNA, 19 nt, Homo sapiens
ccugaacagugaugacgaa

SEQ ID NO: 1175039 - RNA, 19 nt, Homo sapiens
ugacaagcccuucaaaugc

SEQ ID NO: 1175040 - RNA, 19 nt, Homo sapiens
cagaggaggaggacgauga

SEQ ID NO: 1175041 - RNA, 19 nt, Homo sapiens
gaaccugcgccugcacgua

SEQ ID NO: 1175042 - RNA, 19 nt, Homo sapiens
gcaguucaaaugcaagaug

SEQ ID NO: 1175043 - RNA, 19 nt, Homo sapiens
ucauugcucuguucugaca

SEQ ID NO: 1175044 - RNA, 19 nt, Homo sapiens
uuaagaagcgcuacaccuu

SEQ ID NO: 1175045 - RNA, 19 nt, Homo sapiens
ccagucagaugcagagaac

SEQ ID NO: 1175046 - RNA, 19 nt, Homo sapiens
gcuuugggagagaaauuua

SEQ ID NO: 1175047 - RNA, 19 nt, Homo sapiens
ccaagcccuucgccuguga

SEQ ID NO: 1175048 - RNA, 19 nt, Homo sapiens
agaaggcacugcugaacca

SEQ ID NO: 1175049 - RNA, 19 nt, Homo sapiens
guucaagugugaguucugu

SEQ ID NO: 1175050 - RNA, 19 nt, Homo sapiens
uagccagcauccucucauu

SEQ ID NO: 1175051 - RNA, 19 nt, Homo sapiens
ccaucauccugaacaguga

SEQ ID NO: 1175052 - RNA, 19 nt, Homo sapiens
uaacgggcaccucaaguuc

SEQ ID NO: 1175053 - RNA, 19 nt, Homo sapiens
ccuuggaucuucugcugaa

SEQ ID NO: 1175054 - RNA, 19 nt, Homo sapiens
auagcuaccucccugauuc

SEQ ID NO: 1175055 - RNA, 19 nt, Homo sapiens
gccugucagucucaauaaa

SEQ ID NO: 1175056 - RNA, 19 nt, Homo sapiens
guacaggagggccagauca

SEQ ID NO: 1175057 - RNA, 19 nt, Homo sapiens
ccacugcugcaucaaagaa

SEQ ID NO: 1175058 - RNA, 19 nt, Homo sapiens
aaugcaagaugugccagua

SEQ ID NO: 1175059 - RNA, 19 nt, Homo sapiens
cuacagggcccagaugaug

SEQ ID NO: 1175060 - RNA, 19 nt, Homo sapiens
gaggaacguggcuacgaaa

SEQ ID NO: 1175061 - RNA, 19 nt, Homo sapiens
gacaaccaggugcaguaua

SEQ ID NO: 1175062 - RNA, 19 nt, Homo sapiens
gaugggaggaagucaggaa

SEQ ID NO: 1175063 - RNA, 19 nt, Homo sapiens
gaagcuggcacccacuaca

SEQ ID NO: 1175064 - RNA, 19 nt, Homo sapiens
ugaguucugugaguuuguu

SEQ ID NO: 1175065 - RNA, 19 nt, Homo sapiens
ucaagugugaguucuguga

SEQ ID NO: 1175066 - RNA, 19 nt, Homo sapiens
ugaagacgcacagcacuga

SEQ ID NO: 1175067 - RNA, 19 nt, Homo sapiens
ccucccagaugguguggaa

SEQ ID NO: 1175068 - RNA, 19 nt, Homo sapiens
ccacauccacauccacaug

SEQ ID NO: 1175069 - RNA, 19 nt, Homo sapiens
agccagaccugugcuguug

SEQ ID NO: 1175070 - RNA, 19 nt, Homo sapiens
aacagacagugaccaauca

SEQ ID NO: 1175071 - RNA, 19 nt, Homo sapiens
cacgguaccugauccuaca

SEQ ID NO: 1175072 - RNA, 19 nt, Homo sapiens
uacgaaagccucggaguga

SEQ ID NO: 1175073 - RNA, 19 nt, Homo sapiens
caguucaaaugcaagaugu

SEQ ID NO: 1175074 - RNA, 19 nt, Homo sapiens
ggaguccaguccugaacag

SEQ ID NO: 1175075 - RNA, 19 nt, Homo sapiens
gagccagaccugugcuguu

SEQ ID NO: 1175076 - RNA, 19 nt, Homo sapiens
acacauccaguaugaacaa

SEQ ID NO: 1175077 - RNA, 19 nt, Homo sapiens
guacccaguugcaccacau

SEQ ID NO: 1175078 - RNA, 19 nt, Homo sapiens
cagacagccuuggaucuuc

SEQ ID NO: 1175079 - RNA, 19 nt, Homo sapiens
guccaguccugaacagcuu

SEQ ID NO: 1175080 - RNA, 19 nt, Homo sapiens
ccaggaacacaucaucguu

SEQ ID NO: 1175081 - RNA, 19 nt, Homo sapiens
ggcagcguuucaaccguaa

SEQ ID NO: 1175082 - RNA, 19 nt, Homo sapiens
caugcugacucacacaaag

SEQ ID NO: 1175083 - RNA, 19 nt, Homo sapiens
gagaggaacguggcuacga

SEQ ID NO: 1175084 - RNA, 19 nt, Homo sapiens
gcaagcccuacaaguguga

SEQ ID NO: 1175085 - RNA, 19 nt, Homo sapiens
gaacugcugucaucaauuu

SEQ ID NO: 1175086 - RNA, 19 nt, Homo sapiens
ggaaauaguucgaggcaua

SEQ ID NO: 1175087 - RNA, 19 nt, Homo sapiens
gaaaguggauaucacauuu

SEQ ID NO: 1175088 - RNA, 19 nt, Homo sapiens
gagaaucgcuaauaaacua

SEQ ID NO: 1175089 - RNA, 19 nt, Homo sapiens
gauagcagccgguuuaaua

SEQ ID NO: 1175090 - RNA, 19 nt, Homo sapiens
caacucaacuccuuuaaau

SEQ ID NO: 1175091 - RNA, 19 nt, Homo sapiens
gaaagggaaauuugucuua

SEQ ID NO: 1175092 - RNA, 19 nt, Homo sapiens
gaugugaccugaaauggaa

SEQ ID NO: 1175093 - RNA, 19 nt, Homo sapiens
gaacacaccacuucauuau

SEQ ID NO: 1175094 - RNA, 19 nt, Homo sapiens
cgagagagguuuacacaug

SEQ ID NO: 1175095 - RNA, 19 nt, Homo sapiens
cuacaaaguucuucaaugu

SEQ ID NO: 1175096 - RNA, 19 nt, Homo sapiens
ggaaagaaagggaaauuug

SEQ ID NO: 1175097 - RNA, 19 nt, Homo sapiens
gcagagagaaucgcuaaua

SEQ ID NO: 1175098 - RNA, 19 nt, Homo sapiens
gaccugaaauggaagaauu

SEQ ID NO: 1175099 - RNA, 19 nt, Homo sapiens
gagagagguuuacacauga

SEQ ID NO: 1175100 - RNA, 19 nt, Homo sapiens
cagagagaaucgcuaauaa

SEQ ID NO: 1175101 - RNA, 19 nt, Homo sapiens
ggaucuggcuucucugaaa

SEQ ID NO: 1175102 - RNA, 19 nt, Homo sapiens
ggaacacaccacuucauua

SEQ ID NO: 1175103 - RNA, 19 nt, Homo sapiens
caacaauucuaccuaugaa

SEQ ID NO: 1175104 - RNA, 19 nt, Homo sapiens
gugcagaugucaacaauuc

SEQ ID NO: 1175105 - RNA, 19 nt, Homo sapiens
caagacaccuccuauacug

SEQ ID NO: 1175106 - RNA, 19 nt, Homo sapiens
caacaacucaacuccuuua

SEQ ID NO: 1175107 - RNA, 19 nt, Homo sapiens
gaacuuacagaucuacaaa

SEQ ID NO: 1175108 - RNA, 19 nt, Homo sapiens
ucaaggagcuggucaagca

SEQ ID NO: 1175109 - RNA, 19 nt, Homo sapiens
gaaagaaagggaaauuugu

SEQ ID NO: 1175110 - RNA, 19 nt, Homo sapiens
ggaaccagauauuuaaaca

SEQ ID NO: 1175111 - RNA, 19 nt, Homo sapiens
gcgaggaugugaccugaaa

SEQ ID NO: 1175112 - RNA, 19 nt, Homo sapiens
ggaaagaggaggugaagug

SEQ ID NO: 1175113 - RNA, 19 nt, Homo sapiens
ccgcacagcuuuaauggaa

SEQ ID NO: 1175114 - RNA, 19 nt, Homo sapiens
gcccugaaauuaagaaaga

SEQ ID NO: 1175115 - RNA, 19 nt, Homo sapiens
gaggugaagugaaugcauu

SEQ ID NO: 1175116 - RNA, 19 nt, Homo sapiens
uuacagaucuacaaaguuc

SEQ ID NO: 1175117 - RNA, 19 nt, Homo sapiens
gaauaccuguggauaugaa

SEQ ID NO: 1175118 - RNA, 19 nt, Homo sapiens
gcaaaggcauaugcugauu

SEQ ID NO: 1175119 - RNA, 19 nt, Homo sapiens
gaaauacgccgagcagaga

SEQ ID NO: 1175120 - RNA, 19 nt, Homo sapiens
gaagugggcaccauugcua

SEQ ID NO: 1175121 - RNA, 19 nt, Homo sapiens
guagauauuuccaucaaag

SEQ ID NO: 1175122 - RNA, 19 nt, Homo sapiens
agaagaacaucacagagaa

SEQ ID NO: 1175123 - RNA, 19 nt, Homo sapiens
gaaagcugcagacuggaua

SEQ ID NO: 1175124 - RNA, 19 nt, Homo sapiens
agagaucccuggcuucuga

SEQ ID NO: 1175125 - RNA, 19 nt, Homo sapiens
gagcagagagaaucgcuaa

SEQ ID NO: 1175126 - RNA, 19 nt, Homo sapiens
ggcauaugcugauuauaga

SEQ ID NO: 1175127 - RNA, 19 nt, Homo sapiens
caaaggcauaugcugauua

SEQ ID NO: 1175128 - RNA, 19 nt, Homo sapiens
uguugaaucuggagcuuua

SEQ ID NO: 1175129 - RNA, 19 nt, Homo sapiens
ccuuagagcuugugaagau

SEQ ID NO: 1175130 - RNA, 19 nt, Homo sapiens
acaagaaugucacugauag

SEQ ID NO: 1175131 - RNA, 19 nt, Homo sapiens
gaggaggggucaauauuaa

SEQ ID NO: 1175132 - RNA, 19 nt, Homo sapiens
caaagcagcaagcaaagaa

SEQ ID NO: 1175133 - RNA, 19 nt, Homo sapiens
acaaaguucuucaaugugu

SEQ ID NO: 1175134 - RNA, 19 nt, Homo sapiens
ucauagcaguuauuucuug

SEQ ID NO: 1175135 - RNA, 19 nt, Homo sapiens
gaaagaggaggugaaguga

SEQ ID NO: 1175136 - RNA, 19 nt, Homo sapiens
gaaagccaauauuccuuag

SEQ ID NO: 1175137 - RNA, 19 nt, Homo sapiens
gcagauaagggacuugaga

SEQ ID NO: 1175138 - RNA, 19 nt, Homo sapiens
gaagaacaucacagagaaa

SEQ ID NO: 1175139 - RNA, 19 nt, Homo sapiens
aaaggcauaugcugauuau

SEQ ID NO: 1175140 - RNA, 19 nt, Homo sapiens
gcagaugucaacaauucua

SEQ ID NO: 1175141 - RNA, 19 nt, Homo sapiens
gcacuuagccucaguuucc

SEQ ID NO: 1175142 - RNA, 19 nt, Homo sapiens
ugaaggcccugaaauuaag

SEQ ID NO: 1175143 - RNA, 19 nt, Homo sapiens
cuagauaacuugccgaaac

SEQ ID NO: 1175144 - RNA, 19 nt, Homo sapiens
ggcaaaggcugauaugacu

SEQ ID NO: 1175145 - RNA, 19 nt, Homo sapiens
gaacugggccaugaauugu

SEQ ID NO: 1175146 - RNA, 19 nt, Homo sapiens
acaagaagcagauagagaa

SEQ ID NO: 1175147 - RNA, 19 nt, Homo sapiens
caucaaagccaaagcaauc

SEQ ID NO: 1175148 - RNA, 19 nt, Homo sapiens
cagaagaacaucacagaga

SEQ ID NO: 1175149 - RNA, 19 nt, Homo sapiens
gcauggcuuuagcagauaa

SEQ ID NO: 1175150 - RNA, 19 nt, Homo sapiens
ugauauuggugcuaaauuc

SEQ ID NO: 1175151 - RNA, 19 nt, Homo sapiens
aagaggaggugaagugaau

SEQ ID NO: 1175152 - RNA, 19 nt, Homo sapiens
guggauaucacauuuauuc

SEQ ID NO: 1175153 - RNA, 19 nt, Homo sapiens
gagagaaucgcuaauaaac

SEQ ID NO: 1175154 - RNA, 19 nt, Homo sapiens
cauuaucgcugugcucuga

SEQ ID NO: 1175155 - RNA, 19 nt, Homo sapiens
guucacagaugcagaaacu

SEQ ID NO: 1175156 - RNA, 19 nt, Homo sapiens
ucacagaugcagaaacuga

SEQ ID NO: 1175157 - RNA, 19 nt, Homo sapiens
ccagauauuuaaacaaguc

SEQ ID NO: 1175158 - RNA, 19 nt, Homo sapiens
uuuaauagaugcagcuuca

SEQ ID NO: 1175159 - RNA, 19 nt, Homo sapiens
auaagggacuugagaacuu

SEQ ID NO: 1175160 - RNA, 19 nt, Homo sapiens
gggaacacaccacuucauu

SEQ ID NO: 1175161 - RNA, 19 nt, Homo sapiens
gcugauaugacuauaguug

SEQ ID NO: 1175162 - RNA, 19 nt, Homo sapiens
gagguggacuucgacgauu

SEQ ID NO: 1175163 - RNA, 19 nt, Homo sapiens
aagaggaacugcugucauc

SEQ ID NO: 1175164 - RNA, 19 nt, Homo sapiens
gagaagguauuuucaaaca

SEQ ID NO: 1175165 - RNA, 19 nt, Homo sapiens
gaaauaguucgaggcauau

SEQ ID NO: 1175166 - RNA, 19 nt, Homo sapiens
ccacaggccgcacagcuuu

SEQ ID NO: 1175167 - RNA, 19 nt, Homo sapiens
gagccaauccuaaugcaau

SEQ ID NO: 1175168 - RNA, 19 nt, Homo sapiens
gggcuguacucccacaaug

SEQ ID NO: 1175169 - RNA, 19 nt, Homo sapiens
uagccucaguuuccaauga

SEQ ID NO: 1175170 - RNA, 19 nt, Homo sapiens
gguaaugugguucaucuga

SEQ ID NO: 1175171 - RNA, 19 nt, Homo sapiens
acagaaggguaaugugguu

SEQ ID NO: 1175172 - RNA, 19 nt, Homo sapiens
acugaaggcccugaaauua

SEQ ID NO: 1175173 - RNA, 19 nt, Homo sapiens
gacugaaggcccugaaauu

SEQ ID NO: 1175174 - RNA, 19 nt, Homo sapiens
aaaaggagcuaacguuaau

SEQ ID NO: 1175175 - RNA, 19 nt, Homo sapiens
gcaaguggaaacauagaug

SEQ ID NO: 1175176 - RNA, 19 nt, Homo sapiens
ggaggaggggucaauauua

SEQ ID NO: 1175177 - RNA, 19 nt, Homo sapiens
acacaccacuucauuaugc

SEQ ID NO: 1175178 - RNA, 19 nt, Homo sapiens
gcaucacgcugcucauuuu

SEQ ID NO: 1175179 - RNA, 19 nt, Homo sapiens
ugucaacaauucuaccuau

SEQ ID NO: 1175180 - RNA, 19 nt, Homo sapiens
caaaggcugauaugacuau

SEQ ID NO: 1175181 - RNA, 19 nt, Homo sapiens
gaaaauagaaaagggcaua

SEQ ID NO: 1175182 - RNA, 19 nt, Homo sapiens
uaacguuaaugcaacagau

SEQ ID NO: 1175183 - RNA, 19 nt, Homo sapiens
ggagcuaacguuaaugcaa

SEQ ID NO: 1175184 - RNA, 19 nt, Homo sapiens
gugugcaaguggaaacaua

SEQ ID NO: 1175185 - RNA, 19 nt, Homo sapiens
gggaagagauuuacuuauu

SEQ ID NO: 1175186 - RNA, 19 nt, Homo sapiens
gggaguggcuguaaauaua

SEQ ID NO: 1175187 - RNA, 19 nt, Homo sapiens
ggugaaaggugguugcuua

SEQ ID NO: 1175188 - RNA, 19 nt, Homo sapiens
gaaauaaggucugaggauu

SEQ ID NO: 1175189 - RNA, 19 nt, Homo sapiens
gauuugggcuccuaugaua

SEQ ID NO: 1175190 - RNA, 19 nt, Homo sapiens
gcaauuagacggucccaua

SEQ ID NO: 1175191 - RNA, 19 nt, Homo sapiens
ggaaggauguguacuaaag

SEQ ID NO: 1175192 - RNA, 19 nt, Homo sapiens
gaacaaacuucacuaugca

SEQ ID NO: 1175193 - RNA, 19 nt, Homo sapiens
ggaagagauuuacuuauuc

SEQ ID NO: 1175194 - RNA, 19 nt, Homo sapiens
gcaggaggcugaugaagau

SEQ ID NO: 1175195 - RNA, 19 nt, Homo sapiens
gaaaggugguugcuuaaag

SEQ ID NO: 1175196 - RNA, 19 nt, Homo sapiens
ggaacaaacuucacuaugc

SEQ ID NO: 1175197 - RNA, 19 nt, Homo sapiens
ggucucaucucuacuucua

SEQ ID NO: 1175198 - RNA, 19 nt, Homo sapiens
ggacgcagggcgacaauaa

SEQ ID NO: 1175199 - RNA, 19 nt, Homo sapiens
gaagauggacguugagcaa

SEQ ID NO: 1175200 - RNA, 19 nt, Homo sapiens
gcaguucacaguaggauuu

SEQ ID NO: 1175201 - RNA, 19 nt, Homo sapiens
uagagaagauggacguuga

SEQ ID NO: 1175202 - RNA, 19 nt, Homo sapiens
aaacaagagaugcccauua

SEQ ID NO: 1175203 - RNA, 19 nt, Homo sapiens
caccaggucuaucucauuu

SEQ ID NO: 1175204 - RNA, 19 nt, Homo sapiens
gcacuggacaggaauaaga

SEQ ID NO: 1175205 - RNA, 19 nt, Homo sapiens
gaaucagccagcaauauuu

SEQ ID NO: 1175206 - RNA, 19 nt, Homo sapiens
ggagguggcucagguguca

SEQ ID NO: 1175207 - RNA, 19 nt, Homo sapiens
ggugguugcuuaaaggaaa

SEQ ID NO: 1175208 - RNA, 19 nt, Homo sapiens
gauccaagggcacaaauga

SEQ ID NO: 1175209 - RNA, 19 nt, Homo sapiens
ggcauuagauucucauaag

SEQ ID NO: 1175210 - RNA, 19 nt, Homo sapiens
ggaaauaaggucugaggau

SEQ ID NO: 1175211 - RNA, 19 nt, Homo sapiens
ggagaccgaauuauagaaa

SEQ ID NO: 1175212 - RNA, 19 nt, Homo sapiens
gaucaucaggcauuagauu

SEQ ID NO: 1175213 - RNA, 19 nt, Homo sapiens
cagaagagcagcuggagaa

SEQ ID NO: 1175214 - RNA, 19 nt, Homo sapiens
gaagagauuuacuuauucc

SEQ ID NO: 1175215 - RNA, 19 nt, Homo sapiens
ugacagaucaucaggcauu

SEQ ID NO: 1175216 - RNA, 19 nt, Homo sapiens
gagaugcccauuacuguga

SEQ ID NO: 1175217 - RNA, 19 nt, Homo sapiens
gacagaucaucaggcauua

SEQ ID NO: 1175218 - RNA, 19 nt, Homo sapiens
gaagaugaggacacagaaa

SEQ ID NO: 1175219 - RNA, 19 nt, Homo sapiens
ugaaucagccagcaauauu

SEQ ID NO: 1175220 - RNA, 19 nt, Homo sapiens
cauaaggagugcacaaucu

SEQ ID NO: 1175221 - RNA, 19 nt, Homo sapiens
agaaguaucugccuuuagg

SEQ ID NO: 1175222 - RNA, 19 nt, Homo sapiens
ggguacaggugacagaaga

SEQ ID NO: 1175223 - RNA, 19 nt, Homo sapiens
ucaucaggcuccaguuauu

SEQ ID NO: 1175224 - RNA, 19 nt, Homo sapiens
gggcuccuaugauaaucua

SEQ ID NO: 1175225 - RNA, 19 nt, Homo sapiens
gggagacagugacagauca

SEQ ID NO: 1175226 - RNA, 19 nt, Homo sapiens
gggcgacaauaaacuguau

SEQ ID NO: 1175227 - RNA, 19 nt, Homo sapiens
ggaguucaccaaguccuua

SEQ ID NO: 1175228 - RNA, 19 nt, Homo sapiens
caagagaugcccauuacug

SEQ ID NO: 1175229 - RNA, 19 nt, Homo sapiens
ggaaugaaacacuuugagu

SEQ ID NO: 1175230 - RNA, 19 nt, Homo sapiens
gaaggcucuuuccuaguga

SEQ ID NO: 1175231 - RNA, 19 nt, Homo sapiens
caaccaguaucuccuugga

SEQ ID NO: 1175232 - RNA, 19 nt, Homo sapiens
gggaagagacgauguaaaa

SEQ ID NO: 1175233 - RNA, 19 nt, Homo sapiens
caacucaccauaauguaga

SEQ ID NO: 1175234 - RNA, 19 nt, Homo sapiens
gugggaagagauuuacuua

SEQ ID NO: 1175235 - RNA, 19 nt, Homo sapiens
gcuggaaggauguguacua

SEQ ID NO: 1175236 - RNA, 19 nt, Homo sapiens
ccugggagaccgaauuaua

SEQ ID NO: 1175237 - RNA, 19 nt, Homo sapiens
aaacuucacuaugcauuuc

SEQ ID NO: 1175238 - RNA, 19 nt, Homo sapiens
gauguguacuaaagucuag

SEQ ID NO: 1175239 - RNA, 19 nt, Homo sapiens
caaacuucacuaugcauuu

SEQ ID NO: 1175240 - RNA, 19 nt, Homo sapiens
guagggaagagacgaugua

SEQ ID NO: 1175241 - RNA, 19 nt, Homo sapiens
ggaugauucaagugcauua

SEQ ID NO: 1175242 - RNA, 19 nt, Homo sapiens
ggagccagcgaguggauuu

SEQ ID NO: 1175243 - RNA, 19 nt, Homo sapiens
gaaccucucaacagcagaa

SEQ ID NO: 1175244 - RNA, 19 nt, Homo sapiens
aacaagagaugcccauuac

SEQ ID NO: 1175245 - RNA, 19 nt, Homo sapiens
aauaaggucugaggauuca

SEQ ID NO: 1175246 - RNA, 19 nt, Homo sapiens
ccagggaaauaaggucuga

SEQ ID NO: 1175247 - RNA, 19 nt, Homo sapiens
aagagcagcuggagaacau

SEQ ID NO: 1175248 - RNA, 19 nt, Homo sapiens
guucgcagccucccucuga

SEQ ID NO: 1175249 - RNA, 19 nt, Homo sapiens
gaugggagacagugacaga

SEQ ID NO: 1175250 - RNA, 19 nt, Homo sapiens
ucaccauaauguagaauca

SEQ ID NO: 1175251 - RNA, 19 nt, Homo sapiens
gcauuagauucucauaagg

SEQ ID NO: 1175252 - RNA, 19 nt, Homo sapiens
gaguggcuguaaauauaga

SEQ ID NO: 1175253 - RNA, 19 nt, Homo sapiens
cuggaaggauguguacuaa

SEQ ID NO: 1175254 - RNA, 19 nt, Homo sapiens
gagaagaaagcuggaagga

SEQ ID NO: 1175255 - RNA, 19 nt, Homo sapiens
ugaagugacuccguuugug

SEQ ID NO: 1175256 - RNA, 19 nt, Homo sapiens
ccaggucuaucucauuugg

SEQ ID NO: 1175257 - RNA, 19 nt, Homo sapiens
uaucucauuuggucucaga

SEQ ID NO: 1175258 - RNA, 19 nt, Homo sapiens
gcagagcucaggcgguaau

SEQ ID NO: 1175259 - RNA, 19 nt, Homo sapiens
ggauguguacuaaagucua

SEQ ID NO: 1175260 - RNA, 19 nt, Homo sapiens
gagaccgaauuauagaaag

SEQ ID NO: 1175261 - RNA, 19 nt, Homo sapiens
aaaggugguugcuuaaagg

SEQ ID NO: 1175262 - RNA, 19 nt, Homo sapiens
gcucuuuccuagugaugga

SEQ ID NO: 1175263 - RNA, 19 nt, Homo sapiens
ugucaucaggcuccaguua

SEQ ID NO: 1175264 - RNA, 19 nt, Homo sapiens
caauuagacggucccauau

SEQ ID NO: 1175265 - RNA, 19 nt, Homo sapiens
gcauccggauccugaagug

SEQ ID NO: 1175266 - RNA, 19 nt, Homo sapiens
ccaaguccuuagagaagau

SEQ ID NO: 1175267 - RNA, 19 nt, Homo sapiens
ugcacaaucuagauccuuu

SEQ ID NO: 1175268 - RNA, 19 nt, Homo sapiens
auacaacucaccauaaugu

SEQ ID NO: 1175269 - RNA, 19 nt, Homo sapiens
gaagagcagcuggagaaca

SEQ ID NO: 1175270 - RNA, 19 nt, Homo sapiens
ccaaguggagagugucauu

SEQ ID NO: 1175271 - RNA, 19 nt, Homo sapiens
ggcuguaaauauagaugaa

SEQ ID NO: 1175272 - RNA, 19 nt, Homo sapiens
gaaggauguguacuaaagu

SEQ ID NO: 1175273 - RNA, 19 nt, Homo sapiens
ucaccaaguccuuagagaa

SEQ ID NO: 1175274 - RNA, 19 nt, Homo sapiens
gugaaaggugguugcuuaa

SEQ ID NO: 1175275 - RNA, 19 nt, Homo sapiens
ucagggucuuggcucauuu

SEQ ID NO: 1175276 - RNA, 19 nt, Homo sapiens
ggaguggcuguaaauauag

SEQ ID NO: 1175277 - RNA, 19 nt, Homo sapiens
gcacaaucuagauccuuug

SEQ ID NO: 1175278 - RNA, 19 nt, Homo sapiens
gcagggcgacaauaaacug

SEQ ID NO: 1175279 - RNA, 19 nt, Homo sapiens
uagaagaugaggacacaga

SEQ ID NO: 1175280 - RNA, 19 nt, Homo sapiens
gucagggucuuggcucauu

SEQ ID NO: 1175281 - RNA, 19 nt, Homo sapiens
ggauuugggcuccuaugau

SEQ ID NO: 1175282 - RNA, 19 nt, Homo sapiens
cagaucaucaggcauuaga

SEQ ID NO: 1175283 - RNA, 19 nt, Homo sapiens
ucucagagcugugaaucag

SEQ ID NO: 1175284 - RNA, 19 nt, Homo sapiens
gacaguauucggcgagaga

SEQ ID NO: 1175285 - RNA, 19 nt, Homo sapiens
gaaaccauguucaccagua

SEQ ID NO: 1175286 - RNA, 19 nt, Homo sapiens
gaucagagcaaguuuaauu

SEQ ID NO: 1175287 - RNA, 19 nt, Homo sapiens
gagaacaucuacagcauga

SEQ ID NO: 1175288 - RNA, 19 nt, Homo sapiens
gaucaagucuccugcagaa

SEQ ID NO: 1175289 - RNA, 19 nt, Homo sapiens
gacagaagcuuaaagacuu

SEQ ID NO: 1175290 - RNA, 19 nt, Homo sapiens
gaaaguguuuagauucuug

SEQ ID NO: 1175291 - RNA, 19 nt, Homo sapiens
gagcauagcagcuguguga

SEQ ID NO: 1175292 - RNA, 19 nt, Homo sapiens
ccaaagagaugaaugacau

SEQ ID NO: 1175293 - RNA, 19 nt, Homo sapiens
ggacucaccucucauccuu

SEQ ID NO: 1175294 - RNA, 19 nt, Homo sapiens
gcaacgauauucccuauac

SEQ ID NO: 1175295 - RNA, 19 nt, Homo sapiens
gagcaacgauauucccuau

SEQ ID NO: 1175296 - RNA, 19 nt, Homo sapiens
agacgaacaugguuuggua

SEQ ID NO: 1175297 - RNA, 19 nt, Homo sapiens
ccaagagccugauagcauu

SEQ ID NO: 1175298 - RNA, 19 nt, Homo sapiens
gguaaucggucaaacacuu

SEQ ID NO: 1175299 - RNA, 19 nt, Homo sapiens
gaucaacccaauaucauaa

SEQ ID NO: 1175300 - RNA, 19 nt, Homo sapiens
ugauaaagauggaaaugga

SEQ ID NO: 1175301 - RNA, 19 nt, Homo sapiens
caagucuccugcagaaauu

SEQ ID NO: 1175302 - RNA, 19 nt, Homo sapiens
ccuauacgcuagaagaauu

SEQ ID NO: 1175303 - RNA, 19 nt, Homo sapiens
gcaagacucugccucaaaa

SEQ ID NO: 1175304 - RNA, 19 nt, Homo sapiens
ggaaauggaagagaaagaa

SEQ ID NO: 1175305 - RNA, 19 nt, Homo sapiens
cagcaacacuagcuaccua

SEQ ID NO: 1175306 - RNA, 19 nt, Homo sapiens
ggacaagcuuggagaacau

SEQ ID NO: 1175307 - RNA, 19 nt, Homo sapiens
gaaauggaagagaaagaaa

SEQ ID NO: 1175308 - RNA, 19 nt, Homo sapiens
gcaaacaauuaccaucaca

SEQ ID NO: 1175309 - RNA, 19 nt, Homo sapiens
ggauggagguugugagucu

SEQ ID NO: 1175310 - RNA, 19 nt, Homo sapiens
cagcuucacucugacuaua

SEQ ID NO: 1175311 - RNA, 19 nt, Homo sapiens
gagccucccuggcaaacaa

SEQ ID NO: 1175312 - RNA, 19 nt, Homo sapiens
gcauuccaguuaacacauu

SEQ ID NO: 1175313 - RNA, 19 nt, Homo sapiens
ggaaaguguuuagauucuu

SEQ ID NO: 1175314 - RNA, 19 nt, Homo sapiens
ggaugguaaucacaauuga

SEQ ID NO: 1175315 - RNA, 19 nt, Homo sapiens
ggacagaagcuuaaagacu

SEQ ID NO: 1175316 - RNA, 19 nt, Homo sapiens
auaaucaacucaucaagga

SEQ ID NO: 1175317 - RNA, 19 nt, Homo sapiens
ccuggaaaguguuuagauu

SEQ ID NO: 1175318 - RNA, 19 nt, Homo sapiens
gugaauguauguaauugug

SEQ ID NO: 1175319 - RNA, 19 nt, Homo sapiens
cauagcagcugugugaaug

SEQ ID NO: 1175320 - RNA, 19 nt, Homo sapiens
gaacaugguuugguaugac

SEQ ID NO: 1175321 - RNA, 19 nt, Homo sapiens
acaauuaccaucacacaaa

SEQ ID NO: 1175322 - RNA, 19 nt, Homo sapiens
gccaauacauaccuucugu

SEQ ID NO: 1175323 - RNA, 19 nt, Homo sapiens
auaagaaguuugugugaug

SEQ ID NO: 1175324 - RNA, 19 nt, Homo sapiens
aaacauaaaggucuugguu

SEQ ID NO: 1175325 - RNA, 19 nt, Homo sapiens
gagcaagacucugccucaa

SEQ ID NO: 1175326 - RNA, 19 nt, Homo sapiens
guccaugcauuccaguuaa

SEQ ID NO: 1175327 - RNA, 19 nt, Homo sapiens
augcacagcuucacucuga

SEQ ID NO: 1175328 - RNA, 19 nt, Homo sapiens
cauaucuacuggagccaua

SEQ ID NO: 1175329 - RNA, 19 nt, Homo sapiens
caaggucucugccuaugca

SEQ ID NO: 1175330 - RNA, 19 nt, Homo sapiens
caggauguauguuguguuc

SEQ ID NO: 1175331 - RNA, 19 nt, Homo sapiens
cuagagauccaaagagauu

SEQ ID NO: 1175332 - RNA, 19 nt, Homo sapiens
aaaccauguucaccaguaa

SEQ ID NO: 1175333 - RNA, 19 nt, Homo sapiens
gcugagaucaacccaauau

SEQ ID NO: 1175334 - RNA, 19 nt, Homo sapiens
gggacaagcuuggagaaca

SEQ ID NO: 1175335 - RNA, 19 nt, Homo sapiens
caucacaggcuuucauaga

SEQ ID NO: 1175336 - RNA, 19 nt, Homo sapiens
cuagaagaauuucaacauc

SEQ ID NO: 1175337 - RNA, 19 nt, Homo sapiens
agacaacaauuuccuguac

SEQ ID NO: 1175338 - RNA, 19 nt, Homo sapiens
ucaaguccuucccuuucua

SEQ ID NO: 1175339 - RNA, 19 nt, Homo sapiens
gaauuaaugaucagagcaa

SEQ ID NO: 1175340 - RNA, 19 nt, Homo sapiens
gcagcugugugaauguaug

SEQ ID NO: 1175341 - RNA, 19 nt, Homo sapiens
uagcagcugugugaaugua

SEQ ID NO: 1175342 - RNA, 19 nt, Homo sapiens
cgaacaugguuugguauga

SEQ ID NO: 1175343 - RNA, 19 nt, Homo sapiens
gggaucaugaagaacauua

SEQ ID NO: 1175344 - RNA, 19 nt, Homo sapiens
caagcugguucccgcugua

SEQ ID NO: 1175345 - RNA, 19 nt, Homo sapiens
cccaauaucauaagaaguu

SEQ ID NO: 1175346 - RNA, 19 nt, Homo sapiens
guauguuacugcagcuuug

SEQ ID NO: 1175347 - RNA, 19 nt, Homo sapiens
ggaggauuccaaaccgaua

SEQ ID NO: 1175348 - RNA, 19 nt, Homo sapiens
gauuccaaaccgauacuua

SEQ ID NO: 1175349 - RNA, 19 nt, Homo sapiens
gacaucacaggcuuucaua

SEQ ID NO: 1175350 - RNA, 19 nt, Homo sapiens
gaaaggaggauuccaaacc

SEQ ID NO: 1175351 - RNA, 19 nt, Homo sapiens
gacuaucucagguggaaua

SEQ ID NO: 1175352 - RNA, 19 nt, Homo sapiens
ugagcugggugugaugaua

SEQ ID NO: 1175353 - RNA, 19 nt, Homo sapiens
gauaaagauggaaauggaa

SEQ ID NO: 1175354 - RNA, 19 nt, Homo sapiens
uggcacugauggagcaaua

SEQ ID NO: 1175355 - RNA, 19 nt, Homo sapiens
gcacuucgcagacacaaac

SEQ ID NO: 1175356 - RNA, 19 nt, Homo sapiens
agauggaaauggaagagaa

SEQ ID NO: 1175357 - RNA, 19 nt, Homo sapiens
ccugggaccuggaaagugu

SEQ ID NO: 1175358 - RNA, 19 nt, Homo sapiens
uauucuagauccugcauau

SEQ ID NO: 1175359 - RNA, 19 nt, Homo sapiens
cauaagaaguuugugugau

SEQ ID NO: 1175360 - RNA, 19 nt, Homo sapiens
guacguggccagucaaugg

SEQ ID NO: 1175361 - RNA, 19 nt, Homo sapiens
ggaaauggugcuucuggau

SEQ ID NO: 1175362 - RNA, 19 nt, Homo sapiens
gcuagaagaauuucaacau

SEQ ID NO: 1175363 - RNA, 19 nt, Homo sapiens
caauuaccaucacacaaag

SEQ ID NO: 1175364 - RNA, 19 nt, Homo sapiens
gauauucccuauacuuucc

SEQ ID NO: 1175365 - RNA, 19 nt, Homo sapiens
cuagcuaccuaccaaacaa

SEQ ID NO: 1175366 - RNA, 19 nt, Homo sapiens
uaacuccucccuaccuauu

SEQ ID NO: 1175367 - RNA, 19 nt, Homo sapiens
gagaucaacccaauaucau

SEQ ID NO: 1175368 - RNA, 19 nt, Homo sapiens
ugagaucaacccaauauca

SEQ ID NO: 1175369 - RNA, 19 nt, Homo sapiens
uaucucagguggaauaugc

SEQ ID NO: 1175370 - RNA, 19 nt, Homo sapiens
acauaaaggucuugguuac

SEQ ID NO: 1175371 - RNA, 19 nt, Homo sapiens
ccagaaaggaggauuccaa

SEQ ID NO: 1175372 - RNA, 19 nt, Homo sapiens
gaauugaggaugauguagu

SEQ ID NO: 1175373 - RNA, 19 nt, Homo sapiens
gggaugguaaucacaauug

SEQ ID NO: 1175374 - RNA, 19 nt, Homo sapiens
cugcagaaauugaacgaau

SEQ ID NO: 1175375 - RNA, 19 nt, Homo sapiens
acaauuuccuguaccuaug

SEQ ID NO: 1175376 - RNA, 19 nt, Homo sapiens
gauggaaauggaagagaaa

SEQ ID NO: 1175377 - RNA, 19 nt, Homo sapiens
cagaaaggaggauuccaaa

SEQ ID NO: 1175378 - RNA, 19 nt, Homo sapiens
acucaggacucaccucuca

SEQ ID NO: 1175379 - RNA, 19 nt, Homo sapiens
gagucuuccugcuauguga

SEQ ID NO: 1175380 - RNA, 19 nt, Homo sapiens
guaaucggucaaacacuuu

SEQ ID NO: 1175381 - RNA, 19 nt, Homo sapiens
ucaagucuccugcagaaau

SEQ ID NO: 1175382 - RNA, 19 nt, Homo sapiens
gcaugagaauugcuugaac

SEQ ID NO: 1175383 - RNA, 19 nt, Homo sapiens
gagcuuuucuugccauuug

SEQ ID NO: 1175384 - RNA, 19 nt, Homo sapiens
cugguguccugcagucuua

SEQ ID NO: 1175385 - RNA, 19 nt, Homo sapiens
ccacguaggugacaacuga

SEQ ID NO: 1175386 - RNA, 19 nt, Homo sapiens
guauugagcuaauuccaaa

SEQ ID NO: 1175387 - RNA, 19 nt, Homo sapiens
gagccacuccuccuaguua

SEQ ID NO: 1175388 - RNA, 19 nt, Homo sapiens
ugacacagauuucauuucu

SEQ ID NO: 1175389 - RNA, 19 nt, Homo sapiens
gacagaagcccucgagguu

SEQ ID NO: 1175390 - RNA, 19 nt, Homo sapiens
ccacucacuugauuuggaa

SEQ ID NO: 1175391 - RNA, 19 nt, Homo sapiens
ucucuucuguggcuuauug

SEQ ID NO: 1175392 - RNA, 19 nt, Homo sapiens
gcccuucguuugucccuuu

SEQ ID NO: 1175393 - RNA, 19 nt, Homo sapiens
gcagauccuuccacuacuc

SEQ ID NO: 1175394 - RNA, 19 nt, Homo sapiens
ccuguggccugcaaugauu

SEQ ID NO: 1175395 - RNA, 19 nt, Homo sapiens
cagacccacucacuugauu

SEQ ID NO: 1175396 - RNA, 19 nt, Homo sapiens
gcugagaugccucugagaa

SEQ ID NO: 1175397 - RNA, 19 nt, Homo sapiens
ggaagacaagcucgugguu

SEQ ID NO: 1175398 - RNA, 19 nt, Homo sapiens
ugauugugcugugauuauu

SEQ ID NO: 1175399 - RNA, 19 nt, Homo sapiens
guguccagauucaaaugua

SEQ ID NO: 1175400 - RNA, 19 nt, Homo sapiens
gaagauccagggacagaag

SEQ ID NO: 1175401 - RNA, 19 nt, Homo sapiens
gugcugugauuauucaaca

SEQ ID NO: 1175402 - RNA, 19 nt, Homo sapiens
ugagaugccucugagaaag

SEQ ID NO: 1175403 - RNA, 19 nt, Homo sapiens
gugauuauucaacaccaua

SEQ ID NO: 1175404 - RNA, 19 nt, Homo sapiens
aaacuacauuagcacuuuc

SEQ ID NO: 1175405 - RNA, 19 nt, Homo sapiens
gacaagcucgugguucuga

SEQ ID NO: 1175406 - RNA, 19 nt, Homo sapiens
aagacaagcucgugguucu

SEQ ID NO: 1175407 - RNA, 19 nt, Homo sapiens
gccaguguccagauucaaa

SEQ ID NO: 1175408 - RNA, 19 nt, Homo sapiens
ccgcagauccuuccacuac

SEQ ID NO: 1175409 - RNA, 19 nt, Homo sapiens
gacccacucacuugauuug

SEQ ID NO: 1175410 - RNA, 19 nt, Homo sapiens
cauuucugauugcggaauu

SEQ ID NO: 1175411 - RNA, 19 nt, Homo sapiens
uagaagauccagggacaga

SEQ ID NO: 1175412 - RNA, 19 nt, Homo sapiens
gaauuuuacucucaaacca

SEQ ID NO: 1175413 - RNA, 19 nt, Homo sapiens
cagagccacuccuccuagu

SEQ ID NO: 1175414 - RNA, 19 nt, Homo sapiens
gucccuuguuuccggauuu

SEQ ID NO: 1175415 - RNA, 19 nt, Homo sapiens
cugagaugccucugagaaa

SEQ ID NO: 1175416 - RNA, 19 nt, Homo sapiens
ggacccagacccacucacu

SEQ ID NO: 1175417 - RNA, 19 nt, Homo sapiens
guuccuuccucuggucauu

SEQ ID NO: 1175418 - RNA, 19 nt, Homo sapiens
cccacucacuugauuugga

SEQ ID NO: 1175419 - RNA, 19 nt, Homo sapiens
cagauucaaauguacuguu

SEQ ID NO: 1175420 - RNA, 19 nt, Homo sapiens
gacccagacccacucacuu

SEQ ID NO: 1175421 - RNA, 19 nt, Homo sapiens
ccugacacagauuucauuu

SEQ ID NO: 1175422 - RNA, 19 nt, Homo sapiens
ccaggccugacacagauuu

SEQ ID NO: 1175423 - RNA, 19 nt, Homo sapiens
gaugagaggcuacguauua

SEQ ID NO: 1175424 - RNA, 19 nt, Homo sapiens
cgggauagcuguccuguua

SEQ ID NO: 1175425 - RNA, 19 nt, Homo sapiens
ggauguggcugaugaagaa

SEQ ID NO: 1175426 - RNA, 19 nt, Homo sapiens
gaaagucuccaucuaaaga

SEQ ID NO: 1175427 - RNA, 19 nt, Homo sapiens
agaaaucgguguguuauga

SEQ ID NO: 1175428 - RNA, 19 nt, Homo sapiens
gagcuccccuuaacuauua

SEQ ID NO: 1175429 - RNA, 19 nt, Homo sapiens
uaaaugagcuccagaaccu

SEQ ID NO: 1175430 - RNA, 19 nt, Homo sapiens
cgagcgacaugguaaauga

SEQ ID NO: 1175431 - RNA, 19 nt, Homo sapiens
gcucauguauggcaguuug

SEQ ID NO: 1175432 - RNA, 19 nt, Homo sapiens
gaccaaacccuaaucucua

SEQ ID NO: 1175433 - RNA, 19 nt, Homo sapiens
ggauagcuguccuguuaga

SEQ ID NO: 1175434 - RNA, 19 nt, Homo sapiens
gaugcuaucucuaaacuac

SEQ ID NO: 1175435 - RNA, 19 nt, Homo sapiens
gagaggcuacguauuaauu

SEQ ID NO: 1175436 - RNA, 19 nt, Homo sapiens
caaauuaugccucuuuaag

SEQ ID NO: 1175437 - RNA, 19 nt, Homo sapiens
ggacuuaacaaacauacug

SEQ ID NO: 1175438 - RNA, 19 nt, Homo sapiens
gaagacauuuggguguuuc

SEQ ID NO: 1175439 - RNA, 19 nt, Homo sapiens
uuaauucacucaggaagaa

SEQ ID NO: 1175440 - RNA, 19 nt, Homo sapiens
gcagaugagaggcuacgua

SEQ ID NO: 1175441 - RNA, 19 nt, Homo sapiens
uauguagacuggagaaugu

SEQ ID NO: 1175442 - RNA, 19 nt, Homo sapiens
ccaacuaauugacauguag

SEQ ID NO: 1175443 - RNA, 19 nt, Homo sapiens
guacaaagaguagcauaau

SEQ ID NO: 1175444 - RNA, 19 nt, Homo sapiens
aggcugcuguucuggauua

SEQ ID NO: 1175445 - RNA, 19 nt, Homo sapiens
uugaaagucuccaucuaaa

SEQ ID NO: 1175446 - RNA, 19 nt, Homo sapiens
gaggcuacguauuaauuca

SEQ ID NO: 1175447 - RNA, 19 nt, Homo sapiens
ugaagacauuuggguguuu

SEQ ID NO: 1175448 - RNA, 19 nt, Homo sapiens
gcuggaggcuuagucguau

SEQ ID NO: 1175449 - RNA, 19 nt, Homo sapiens
gaauguggcgcgaugugaa

SEQ ID NO: 1175450 - RNA, 19 nt, Homo sapiens
caaggcugcuguucuggau

SEQ ID NO: 1175451 - RNA, 19 nt, Homo sapiens
uaaacagauuggauagcaa

SEQ ID NO: 1175452 - RNA, 19 nt, Homo sapiens
uauagucuuccgucacuua

SEQ ID NO: 1175453 - RNA, 19 nt, Homo sapiens
gcagagcuccccuuaacua

SEQ ID NO: 1175454 - RNA, 19 nt, Homo sapiens
uaccugaugcuaucucuaa

SEQ ID NO: 1175455 - RNA, 19 nt, Homo sapiens
cuugaaagucuccaucuaa

SEQ ID NO: 1175456 - RNA, 19 nt, Homo sapiens
uuaauagaccaaacccuaa

SEQ ID NO: 1175457 - RNA, 19 nt, Homo sapiens
ccuugaaagucuccaucua

SEQ ID NO: 1175458 - RNA, 19 nt, Homo sapiens
aauuaugccucuuuaaguc

SEQ ID NO: 1175459 - RNA, 19 nt, Homo sapiens
auaaacagauuggauagca

SEQ ID NO: 1175460 - RNA, 19 nt, Homo sapiens
aaucagaaaucgguguguu

SEQ ID NO: 1175461 - RNA, 19 nt, Homo sapiens
cagaugagaggcuacguau

SEQ ID NO: 1175462 - RNA, 19 nt, Homo sapiens
gaggaaaaguuuguuggaa

SEQ ID NO: 1175463 - RNA, 19 nt, Homo sapiens
uaauugacauguagcucau

SEQ ID NO: 1175464 - RNA, 19 nt, Homo sapiens
uagcuguccuguuagaauc

SEQ ID NO: 1175465 - RNA, 19 nt, Homo sapiens
ccagcgagcgacaugguaa

SEQ ID NO: 1175466 - RNA, 19 nt, Homo sapiens
caaguucgaagucacuaug

SEQ ID NO: 1175467 - RNA, 19 nt, Homo sapiens
guuggaacaguauauauuc

SEQ ID NO: 1175468 - RNA, 19 nt, Homo sapiens
cauacuguucccauacaua

SEQ ID NO: 1175469 - RNA, 19 nt, Homo sapiens
ucagaaaucgguguguuau

SEQ ID NO: 1175470 - RNA, 19 nt, Homo sapiens
cguauagucuuccgucacu

SEQ ID NO: 1175471 - RNA, 19 nt, Homo sapiens
gagaauguggcgcgaugug

SEQ ID NO: 1175472 - RNA, 19 nt, Homo sapiens
augagaggcuacguauuaa

SEQ ID NO: 1175473 - RNA, 19 nt, Homo sapiens
gcuguucuggauuaucuaa

SEQ ID NO: 1175474 - RNA, 19 nt, Homo sapiens
uaauagaccaaacccuaau

SEQ ID NO: 1175475 - RNA, 19 nt, Homo sapiens
uccagaaccuauugagcuu

SEQ ID NO: 1175476 - RNA, 19 nt, Homo sapiens
uguggcugaugaagaaauu

SEQ ID NO: 1175477 - RNA, 19 nt, Homo sapiens
cauguauggcaguuuguaa

SEQ ID NO: 1175478 - RNA, 19 nt, Homo sapiens
uccaacuaauugacaugua

SEQ ID NO: 1175479 - RNA, 19 nt, Homo sapiens
agaccaaacccuaaucucu

SEQ ID NO: 1175480 - RNA, 19 nt, Homo sapiens
ccuguuagaaucagaaauc

SEQ ID NO: 1175481 - RNA, 19 nt, Homo sapiens
ucccauacauaguacaaag

SEQ ID NO: 1175482 - RNA, 19 nt, Homo sapiens
uggccuaccugaugcuauc

SEQ ID NO: 1175483 - RNA, 19 nt, Homo sapiens
uuuaaguccuugaaagucu

SEQ ID NO: 1175484 - RNA, 19 nt, Homo sapiens
gcuuagucguauagucuuc

SEQ ID NO: 1175485 - RNA, 19 nt, Homo sapiens
gaggcuuagucguauaguc

SEQ ID NO: 1175486 - RNA, 19 nt, Homo sapiens
guauuaauucacucaggaa

SEQ ID NO: 1175487 - RNA, 19 nt, Homo sapiens
gcuccacuucuucuuguga

SEQ ID NO: 1175488 - RNA, 19 nt, Homo sapiens
cugcuguucuggauuaucu

SEQ ID NO: 1175489 - RNA, 19 nt, Homo sapiens
aguucgaagucacuaugua

SEQ ID NO: 1175490 - RNA, 19 nt, Homo sapiens
guucgaagucacuauguag

SEQ ID NO: 1175491 - RNA, 19 nt, Homo sapiens
guaauccuggacuagcuuu

SEQ ID NO: 1175492 - RNA, 19 nt, Homo sapiens
acuguucccauacauagua

SEQ ID NO: 1175493 - RNA, 19 nt, Homo sapiens
gcaguuccagcaagcaaag

SEQ ID NO: 1175494 - RNA, 19 nt, Homo sapiens
ucaggaagaauaccauuuu

SEQ ID NO: 1175495 - RNA, 19 nt, Homo sapiens
ccuaugaauacgcagauga

SEQ ID NO: 1175496 - RNA, 19 nt, Homo sapiens
gaccaugggcaacuuucug

SEQ ID NO: 1175497 - RNA, 19 nt, Homo sapiens
gaaaucgguguguuaugac

SEQ ID NO: 1175498 - RNA, 19 nt, Homo sapiens
ugugauggcugaacaaaag

SEQ ID NO: 1175499 - RNA, 19 nt, Homo sapiens
aguacaaagaguagcauaa

SEQ ID NO: 1175500 - RNA, 19 nt, Homo sapiens
ugcuaucucuaaacuacuu

SEQ ID NO: 1175501 - RNA, 19 nt, Homo sapiens
cugaugcuaucucuaaacu

SEQ ID NO: 1175502 - RNA, 19 nt, Homo sapiens
gagcuccagaaccuauuga

SEQ ID NO: 1175503 - RNA, 19 nt, Homo sapiens
gaagaaaugugcaaagugu

SEQ ID NO: 1175504 - RNA, 19 nt, Homo sapiens
ggaaguugcugacucauau

SEQ ID NO: 1175505 - RNA, 19 nt, Homo sapiens
gcagaggaguguuguauau

SEQ ID NO: 1175506 - RNA, 19 nt, Homo sapiens
gcagaaggcuuuacguugu

SEQ ID NO: 1175507 - RNA, 19 nt, Homo sapiens
ucacacugcuucaaugaua

SEQ ID NO: 1175508 - RNA, 19 nt, Homo sapiens
gaggaguguuguauauaua

SEQ ID NO: 1175509 - RNA, 19 nt, Homo sapiens
gaacgacaguacaggaaga

SEQ ID NO: 1175510 - RNA, 19 nt, Homo sapiens
gcggagaccugaaggcauu

SEQ ID NO: 1175511 - RNA, 19 nt, Homo sapiens
gaaacccugucucuacuga

SEQ ID NO: 1175512 - RNA, 19 nt, Homo sapiens
ccaaagacaugggcaaguu

SEQ ID NO: 1175513 - RNA, 19 nt, Homo sapiens
agggagacguuauagauua

SEQ ID NO: 1175514 - RNA, 19 nt, Homo sapiens
ugcaagagcuggcugaauu

SEQ ID NO: 1175515 - RNA, 19 nt, Homo sapiens
ccaaagaaugcuccuguua

SEQ ID NO: 1175516 - RNA, 19 nt, Homo sapiens
gggagacguuauagauuaa

SEQ ID NO: 1175517 - RNA, 19 nt, Homo sapiens
uuagagaaauugcccauga

SEQ ID NO: 1175518 - RNA, 19 nt, Homo sapiens
gcagugagcugagauugca

SEQ ID NO: 1175519 - RNA, 19 nt, Homo sapiens
gcacagaaugccaaaguga

SEQ ID NO: 1175520 - RNA, 19 nt, Homo sapiens
ccauuuaacuugcuuucuu

SEQ ID NO: 1175521 - RNA, 19 nt, Homo sapiens
ggagggagacguuauagau

SEQ ID NO: 1175522 - RNA, 19 nt, Homo sapiens
ugacaaccaguucaaauaa

SEQ ID NO: 1175523 - RNA, 19 nt, Homo sapiens
uuacauagacggauuccua

SEQ ID NO: 1175524 - RNA, 19 nt, Homo sapiens
gaggcaaaguaauuucuug

SEQ ID NO: 1175525 - RNA, 19 nt, Homo sapiens
ccaaacaugcccauaaguu

SEQ ID NO: 1175526 - RNA, 19 nt, Homo sapiens
agaggaguguuguauauau

SEQ ID NO: 1175527 - RNA, 19 nt, Homo sapiens
gcaaaggcaugagcaagag

SEQ ID NO: 1175528 - RNA, 19 nt, Homo sapiens
aacaagagccuccuaagaa

SEQ ID NO: 1175529 - RNA, 19 nt, Homo sapiens
ugacucauaugcacagaau

SEQ ID NO: 1175530 - RNA, 19 nt, Homo sapiens
ggaguguuguauauauaga

SEQ ID NO: 1175531 - RNA, 19 nt, Homo sapiens
aaacaagagccuccuaaga

SEQ ID NO: 1175532 - RNA, 19 nt, Homo sapiens
gcaagaggcgacugcaaga

SEQ ID NO: 1175533 - RNA, 19 nt, Homo sapiens
cauuguggauggagcagua

SEQ ID NO: 1175534 - RNA, 19 nt, Homo sapiens
ggaagaaaugugcaaagug

SEQ ID NO: 1175535 - RNA, 19 nt, Homo sapiens
gaagaugaggagacuaugu

SEQ ID NO: 1175536 - RNA, 19 nt, Homo sapiens
cagaaggcuuuacguuguu

SEQ ID NO: 1175537 - RNA, 19 nt, Homo sapiens
gaggcaagcauuuagauca

SEQ ID NO: 1175538 - RNA, 19 nt, Homo sapiens
gggaaguugcugacucaua

SEQ ID NO: 1175539 - RNA, 19 nt, Homo sapiens
gagcaguagucaaguuugg

SEQ ID NO: 1175540 - RNA, 19 nt, Homo sapiens
gagggagacguuauagauu

SEQ ID NO: 1175541 - RNA, 19 nt, Homo sapiens
gcaggagaauugcuugaac

SEQ ID NO: 1175542 - RNA, 19 nt, Homo sapiens
agagcuggcugaauuggaa

SEQ ID NO: 1175543 - RNA, 19 nt, Homo sapiens
gagacguuauagauuaaga

SEQ ID NO: 1175544 - RNA, 19 nt, Homo sapiens
gcaagagcuggcugaauug

SEQ ID NO: 1175545 - RNA, 19 nt, Homo sapiens
gauugaggcuagggaaguu

SEQ ID NO: 1175546 - RNA, 19 nt, Homo sapiens
uaacugaguccauuuaacu

SEQ ID NO: 1175547 - RNA, 19 nt, Homo sapiens
acaagagccuccuaagaag

SEQ ID NO: 1175548 - RNA, 19 nt, Homo sapiens
gaaacaagagccuccuaag

SEQ ID NO: 1175549 - RNA, 19 nt, Homo sapiens
gccaaagaaugcuccuguu

SEQ ID NO: 1175550 - RNA, 19 nt, Homo sapiens
gacuagaggcaagcauuua

SEQ ID NO: 1175551 - RNA, 19 nt, Homo sapiens
ggaccuugauugacaacca

SEQ ID NO: 1175552 - RNA, 19 nt, Homo sapiens
cuaagaaggugaugaugac

SEQ ID NO: 1175553 - RNA, 19 nt, Homo sapiens
gacaguacaggaagaaaug

SEQ ID NO: 1175554 - RNA, 19 nt, Homo sapiens
gauugaugcugccaaacau

SEQ ID NO: 1175555 - RNA, 19 nt, Homo sapiens
ggcagaggcaggagaauug

SEQ ID NO: 1175556 - RNA, 19 nt, Homo sapiens
ggugaaacccugucucuac

SEQ ID NO: 1175557 - RNA, 19 nt, Homo sapiens
ggauggagcaguagucaag

SEQ ID NO: 1175558 - RNA, 19 nt, Homo sapiens
cagaagaugaggagacuau

SEQ ID NO: 1175559 - RNA, 19 nt, Homo sapiens
gaaccaugccgaaaguagu

SEQ ID NO: 1175560 - RNA, 19 nt, Homo sapiens
gagaagccccuccauguuu

SEQ ID NO: 1175561 - RNA, 19 nt, Homo sapiens
uaccauugaugaagaggaa

SEQ ID NO: 1175562 - RNA, 19 nt, Homo sapiens
caaagaaugcuccuguuac

SEQ ID NO: 1175563 - RNA, 19 nt, Homo sapiens
cuauauccauguguuugua

SEQ ID NO: 1175564 - RNA, 19 nt, Homo sapiens
uagaucaggaggcaaagua

SEQ ID NO: 1175565 - RNA, 19 nt, Homo sapiens
uagggaaguugcugacuca

SEQ ID NO: 1175566 - RNA, 19 nt, Homo sapiens
ugaccaaacggaccaaaga

SEQ ID NO: 1175567 - RNA, 19 nt, Homo sapiens
ccuaagaaggugaugauga

SEQ ID NO: 1175568 - RNA, 19 nt, Homo sapiens
aagaugaggagacuaugua

SEQ ID NO: 1175569 - RNA, 19 nt, Homo sapiens
uuacguuguuucccauuga

SEQ ID NO: 1175570 - RNA, 19 nt, Homo sapiens
ugucuaccauugaugaaga

SEQ ID NO: 1175571 - RNA, 19 nt, Homo sapiens
cagaggaguguuguauaua

SEQ ID NO: 1175572 - RNA, 19 nt, Homo sapiens
ggaggcagaggcaggagaa

SEQ ID NO: 1175573 - RNA, 19 nt, Homo sapiens
cccugucucuacugaaaua

SEQ ID NO: 1175574 - RNA, 19 nt, Homo sapiens
gacaaccaguucaaauaac

SEQ ID NO: 1175575 - RNA, 19 nt, Homo sapiens
agaaggugaugaugaccaa

SEQ ID NO: 1175576 - RNA, 19 nt, Homo sapiens
ggaaccaugccgaaaguag

SEQ ID NO: 1175577 - RNA, 19 nt, Homo sapiens
caaacggaccaaagacaug

SEQ ID NO: 1175578 - RNA, 19 nt, Homo sapiens
gugaaacccugucucuacu

SEQ ID NO: 1175579 - RNA, 19 nt, Homo sapiens
gaagaggaagaggagauug

SEQ ID NO: 1175580 - RNA, 19 nt, Homo sapiens
ggaaaacgaacauauauac

SEQ ID NO: 1175581 - RNA, 19 nt, Homo sapiens
gcccauaaguuuuguaaca

SEQ ID NO: 1175582 - RNA, 19 nt, Homo sapiens
auaccuauauccauguguu

SEQ ID NO: 1175583 - RNA, 19 nt, Homo sapiens
aacccugucucuacugaaa

SEQ ID NO: 1175584 - RNA, 19 nt, Homo sapiens
uacauucagugaggucuuu

SEQ ID NO: 1175585 - RNA, 19 nt, Homo sapiens
ggaggcaaaguaauuucuu

SEQ ID NO: 1175586 - RNA, 19 nt, Homo sapiens
ucaggaggcaaaguaauuu

SEQ ID NO: 1175587 - RNA, 19 nt, Homo sapiens
gaucaggaggcaaaguaau

SEQ ID NO: 1175588 - RNA, 19 nt, Homo sapiens
acagaaugccaaagugauu

SEQ ID NO: 1175589 - RNA, 19 nt, Homo sapiens
agaaacaagagccuccuaa

SEQ ID NO: 1175590 - RNA, 19 nt, Homo sapiens
cgacaguacaggaagaaau

SEQ ID NO: 1175591 - RNA, 19 nt, Homo sapiens
cauugauucuccuacauuc

SEQ ID NO: 1175592 - RNA, 19 nt, Homo sapiens
uagcagaaggcuuuacguu

SEQ ID NO: 1175593 - RNA, 19 nt, Homo sapiens
aguagugucucggucagua

SEQ ID NO: 1175594 - RNA, 19 nt, Homo sapiens
gacaugggcaaguucaguu

SEQ ID NO: 1175595 - RNA, 19 nt, Homo sapiens
gcguagaguuuucagauug

SEQ ID NO: 1175596 - RNA, 19 nt, Homo sapiens
acgaacauauauacucaga

SEQ ID NO: 1175597 - RNA, 19 nt, Homo sapiens
ccauugauucuccuacauu

SEQ ID NO: 1175598 - RNA, 19 nt, Homo sapiens
agacuagaggcaagcauuu

SEQ ID NO: 1175599 - RNA, 19 nt, Homo sapiens
ugugauugaugcugccaaa

SEQ ID NO: 1175600 - RNA, 19 nt, Homo sapiens
cauguuuacuacuguuugu

SEQ ID NO: 1175601 - RNA, 19 nt, Homo sapiens
caggagaauugcuugaacu

SEQ ID NO: 1175602 - RNA, 19 nt, Homo sapiens
agaagccccuccauguuua

SEQ ID NO: 1175603 - RNA, 19 nt, Homo sapiens
gaacagaaauaguggcauu

SEQ ID NO: 1175604 - RNA, 19 nt, Homo sapiens
gaacagauaccaaauuaga

SEQ ID NO: 1175605 - RNA, 19 nt, Homo sapiens
ccgaacagauaccaaauua

SEQ ID NO: 1175606 - RNA, 19 nt, Homo sapiens
caaauuagacuucaaccua

SEQ ID NO: 1175607 - RNA, 19 nt, Homo sapiens
caccacaccuggauaauuu

SEQ ID NO: 1175608 - RNA, 19 nt, Homo sapiens
cacacaagcuugauaauau

SEQ ID NO: 1175609 - RNA, 19 nt, Homo sapiens
gagaugggaucacuauguu

SEQ ID NO: 1175610 - RNA, 19 nt, Homo sapiens
gcaggaaacucuacuucga

SEQ ID NO: 1175611 - RNA, 19 nt, Homo sapiens
ccagugaacucuucuuaau

SEQ ID NO: 1175612 - RNA, 19 nt, Homo sapiens
caaugaaucucacucuuuc

SEQ ID NO: 1175613 - RNA, 19 nt, Homo sapiens
acaggaagaucgaaacuga

SEQ ID NO: 1175614 - RNA, 19 nt, Homo sapiens
ggaauugagaacagaaaua

SEQ ID NO: 1175615 - RNA, 19 nt, Homo sapiens
gacaucgucuacaaagaua

SEQ ID NO: 1175616 - RNA, 19 nt, Homo sapiens
aaaagaagcugcuggaauu

SEQ ID NO: 1175617 - RNA, 19 nt, Homo sapiens
agucagagcuaaacaaugu

SEQ ID NO: 1175618 - RNA, 19 nt, Homo sapiens
uuagcagggucuauauuua

SEQ ID NO: 1175619 - RNA, 19 nt, Homo sapiens
ggacaucgucuacaaagau

SEQ ID NO: 1175620 - RNA, 19 nt, Homo sapiens
ucacacaagcuugauaaua

SEQ ID NO: 1175621 - RNA, 19 nt, Homo sapiens
ucaacaagcagaaaucauu

SEQ ID NO: 1175622 - RNA, 19 nt, Homo sapiens
cuucgacacucaugccuua

SEQ ID NO: 1175623 - RNA, 19 nt, Homo sapiens
aacaguagcucugggauuu

SEQ ID NO: 1175624 - RNA, 19 nt, Homo sapiens
ggagaugggaucacuaugu

SEQ ID NO: 1175625 - RNA, 19 nt, Homo sapiens
gaagaucgaaacugagguu

SEQ ID NO: 1175626 - RNA, 19 nt, Homo sapiens
gaucaaaguccgaacagau

SEQ ID NO: 1175627 - RNA, 19 nt, Homo sapiens
gacaaugaaucucacucuu

SEQ ID NO: 1175628 - RNA, 19 nt, Homo sapiens
gaauugagaacagaaauag

SEQ ID NO: 1175629 - RNA, 19 nt, Homo sapiens
caacaagcagaaaucauug

SEQ ID NO: 1175630 - RNA, 19 nt, Homo sapiens
ugccaaaccuaauuauguu

SEQ ID NO: 1175631 - RNA, 19 nt, Homo sapiens
gaaaagagcagaguaaaag

SEQ ID NO: 1175632 - RNA, 19 nt, Homo sapiens
acaaugaaucucacucuuu

SEQ ID NO: 1175633 - RNA, 19 nt, Homo sapiens
aaacagagucagagcuaaa

SEQ ID NO: 1175634 - RNA, 19 nt, Homo sapiens
gaaaacagagucagagcua

SEQ ID NO: 1175635 - RNA, 19 nt, Homo sapiens
gaacuccugggcucaaaga

SEQ ID NO: 1175636 - RNA, 19 nt, Homo sapiens
ucaaacugcugaccucaag

SEQ ID NO: 1175637 - RNA, 19 nt, Homo sapiens
aaaccaugcuugagucaca

SEQ ID NO: 1175638 - RNA, 19 nt, Homo sapiens
uggaugaagugaucaaagu

SEQ ID NO: 1175639 - RNA, 19 nt, Homo sapiens
gaucgaaacugagguugcu

SEQ ID NO: 1175640 - RNA, 19 nt, Homo sapiens
caacauggacaucgucuac

SEQ ID NO: 1175641 - RNA, 19 nt, Homo sapiens
cagugaacucuucuuaaua

SEQ ID NO: 1175642 - RNA, 19 nt, Homo sapiens
gaaaagaagcugcuggaau

SEQ ID NO: 1175643 - RNA, 19 nt, Homo sapiens
gagcaggaaacucuacuuc

SEQ ID NO: 1175644 - RNA, 19 nt, Homo sapiens
aguaauggaugaagugauc

SEQ ID NO: 1175645 - RNA, 19 nt, Homo sapiens
cuaaagugcugggauuaca

SEQ ID NO: 1175646 - RNA, 19 nt, Homo sapiens
ucccagaguguuaggauua

SEQ ID NO: 1175647 - RNA, 19 nt, Homo sapiens
gccagcggcuucucuucuu

SEQ ID NO: 1175648 - RNA, 19 nt, Homo sapiens
gauaccaaauuagacuuca

SEQ ID NO: 1175649 - RNA, 19 nt, Homo sapiens
aacaacaaguaauggauga

SEQ ID NO: 1175650 - RNA, 19 nt, Homo sapiens
acauggacaucgucuacaa

SEQ ID NO: 1175651 - RNA, 19 nt, Homo sapiens
caagugauccacccaccuu

SEQ ID NO: 1175652 - RNA, 19 nt, Homo sapiens
cugcugaccucaagugauc

SEQ ID NO: 1175653 - RNA, 19 nt, Homo sapiens
uaacaguagcucugggauu

SEQ ID NO: 1175654 - RNA, 19 nt, Homo sapiens
gcaccaccacaccuggaua

SEQ ID NO: 1175655 - RNA, 19 nt, Homo sapiens
ccaguugccaaaccuaauu

SEQ ID NO: 1175656 - RNA, 19 nt, Homo sapiens
ccaccacaccuggauaauu

SEQ ID NO: 1175657 - RNA, 19 nt, Homo sapiens
gaaacucuacuucgacacu

SEQ ID NO: 1175658 - RNA, 19 nt, Homo sapiens
gccagugaacucuucuuaa

SEQ ID NO: 1175659 - RNA, 19 nt, Homo sapiens
cugaguagcugggauuaca

SEQ ID NO: 1175660 - RNA, 19 nt, Homo sapiens
gccuguggaucuaauaaag

SEQ ID NO: 1175661 - RNA, 19 nt, Homo sapiens
gagcagaaaaugagaaaau

SEQ ID NO: 1175662 - RNA, 19 nt, Homo sapiens
ccaagaugcagcaggaaau

SEQ ID NO: 1175663 - RNA, 19 nt, Homo sapiens
gaaaucauugugucugcau

SEQ ID NO: 1175664 - RNA, 19 nt, Homo sapiens
uaggaagacagacgagaaa

SEQ ID NO: 1175665 - RNA, 19 nt, Homo sapiens
uuuagcagggucuauauuu

SEQ ID NO: 1175666 - RNA, 19 nt, Homo sapiens
ccagcggcuucucuucuug

SEQ ID NO: 1175667 - RNA, 19 nt, Homo sapiens
cagaaauaguggcauugca

SEQ ID NO: 1175668 - RNA, 19 nt, Homo sapiens
gagcagaguaaaagaauug

SEQ ID NO: 1175669 - RNA, 19 nt, Homo sapiens
caccuuggccuccuaaagu

SEQ ID NO: 1175670 - RNA, 19 nt, Homo sapiens
caguagcucugggauuuua

SEQ ID NO: 1175671 - RNA, 19 nt, Homo sapiens
caaguaauggaugaaguga

SEQ ID NO: 1175672 - RNA, 19 nt, Homo sapiens
cuaggaagacagacgagaa

SEQ ID NO: 1175673 - RNA, 19 nt, Homo sapiens
caccaccacaccuggauaa

SEQ ID NO: 1175674 - RNA, 19 nt, Homo sapiens
aauuagacuucaaccuaga

SEQ ID NO: 1175675 - RNA, 19 nt, Homo sapiens
aucaaaguccgaacagaua

SEQ ID NO: 1175676 - RNA, 19 nt, Homo sapiens
gauccuggaggccaacaug

SEQ ID NO: 1175677 - RNA, 19 nt, Homo sapiens
cuccuaaagugcugggauu

SEQ ID NO: 1175678 - RNA, 19 nt, Homo sapiens
cuguggaucuaauaaagug

SEQ ID NO: 1175679 - RNA, 19 nt, Homo sapiens
uggaagacaaugaaucuca

SEQ ID NO: 1175680 - RNA, 19 nt, Homo sapiens
gagucacacaagcuugaua

SEQ ID NO: 1175681 - RNA, 19 nt, Homo sapiens
gaagcugcuggaauugaga

SEQ ID NO: 1175682 - RNA, 19 nt, Homo sapiens
caacaaguaauggaugaag

SEQ ID NO: 1175683 - RNA, 19 nt, Homo sapiens
caguugccaaaccuaauua

SEQ ID NO: 1175684 - RNA, 19 nt, Homo sapiens
agucacacaagcuugauaa

SEQ ID NO: 1175685 - RNA, 19 nt, Homo sapiens
caccacacccagccaguga

SEQ ID NO: 1175686 - RNA, 19 nt, Homo sapiens
agaagcugcuggaauugag

SEQ ID NO: 1175687 - RNA, 19 nt, Homo sapiens
uggguuugcuacucaacaa

SEQ ID NO: 1175688 - RNA, 19 nt, Homo sapiens
uugccaaaccuaauuaugu

SEQ ID NO: 1175689 - RNA, 19 nt, Homo sapiens
uagcagggucuauauuuac

SEQ ID NO: 1175690 - RNA, 19 nt, Homo sapiens
ggagcaggaaacucuacuu

SEQ ID NO: 1175691 - RNA, 19 nt, Homo sapiens
agaaauaguggcauugcau

SEQ ID NO: 1175692 - RNA, 19 nt, Homo sapiens
acaaguaauggaugaagug

SEQ ID NO: 1175693 - RNA, 19 nt, Homo sapiens
aaacugcugaccucaagug

SEQ ID NO: 1175694 - RNA, 19 nt, Homo sapiens
ggaugaagugaucaaaguc

SEQ ID NO: 1175695 - RNA, 19 nt, Homo sapiens
caagaugcagcaggaaauc

SEQ ID NO: 1175696 - RNA, 19 nt, Homo sapiens
caucgucuacaaagauaug

SEQ ID NO: 1175697 - RNA, 19 nt, Homo sapiens
aaauggagaugggaucacu

SEQ ID NO: 1175698 - RNA, 19 nt, Homo sapiens
uaucgccuguggaucuaau

SEQ ID NO: 1175699 - RNA, 19 nt, Homo sapiens
auauuuagcagggucuaua

SEQ ID NO: 1175700 - RNA, 19 nt, Homo sapiens
agacagacaggaagaucga

SEQ ID NO: 1175701 - RNA, 19 nt, Homo sapiens
gcccuuacccagacagaca

SEQ ID NO: 1175702 - RNA, 19 nt, Homo sapiens
ugaucaaaguccgaacaga

SEQ ID NO: 1175703 - RNA, 19 nt, Homo sapiens
gcaaagaagucaccauuua

SEQ ID NO: 1175704 - RNA, 19 nt, Homo sapiens
gaaauuaacugaaggaaac

SEQ ID NO: 1175705 - RNA, 19 nt, Homo sapiens
gaacaacccuuauucuaca

SEQ ID NO: 1175706 - RNA, 19 nt, Homo sapiens
agucgaagcuucucucuua

SEQ ID NO: 1175707 - RNA, 19 nt, Homo sapiens
gcacaucucuuauucuaca

SEQ ID NO: 1175708 - RNA, 19 nt, Homo sapiens
gaaaucagucuuuguugua

SEQ ID NO: 1175709 - RNA, 19 nt, Homo sapiens
gcgcacaucucuuauucua

SEQ ID NO: 1175710 - RNA, 19 nt, Homo sapiens
gaaacccugucucuacuaa

SEQ ID NO: 1175711 - RNA, 19 nt, Homo sapiens
gaugauaugucccacuuug

SEQ ID NO: 1175712 - RNA, 19 nt, Homo sapiens
gagaaacccuaugaaugua

SEQ ID NO: 1175713 - RNA, 19 nt, Homo sapiens
gagaaacccuaugaaugua

SEQ ID NO: 1175714 - RNA, 19 nt, Homo sapiens
cgacauaagagaauucaua

SEQ ID NO: 1175715 - RNA, 19 nt, Homo sapiens
caaugucagucuuucaaua

SEQ ID NO: 1175716 - RNA, 19 nt, Homo sapiens
gcgaaggccuuaagucaga

SEQ ID NO: 1175717 - RNA, 19 nt, Homo sapiens
gaaugaggcuaucaaacau

SEQ ID NO: 1175718 - RNA, 19 nt, Homo sapiens
gagagaaacccuaugaaug

SEQ ID NO: 1175719 - RNA, 19 nt, Homo sapiens
gagagaagccauauacaug

SEQ ID NO: 1175720 - RNA, 19 nt, Homo sapiens
guacacaccucgcccaaca

SEQ ID NO: 1175721 - RNA, 19 nt, Homo sapiens
gaaguuuggucagucauug

SEQ ID NO: 1175722 - RNA, 19 nt, Homo sapiens
ggggaaagcuucaaucaaa

SEQ ID NO: 1175723 - RNA, 19 nt, Homo sapiens
ggagagaaacccuaugaau

SEQ ID NO: 1175724 - RNA, 19 nt, Homo sapiens
gaagucaccauuuagagaa

SEQ ID NO: 1175725 - RNA, 19 nt, Homo sapiens
cagaaaaugugggaaauua

SEQ ID NO: 1175726 - RNA, 19 nt, Homo sapiens
aaucaaagaacaacccuua

SEQ ID NO: 1175727 - RNA, 19 nt, Homo sapiens
gaagccauauacaugcaaa

SEQ ID NO: 1175728 - RNA, 19 nt, Homo sapiens
ucagaaaguucauacaaag

SEQ ID NO: 1175729 - RNA, 19 nt, Homo sapiens
caaagaacaacccuuauuc

SEQ ID NO: 1175730 - RNA, 19 nt, Homo sapiens
cgaaugaggcuaucaaaca

SEQ ID NO: 1175731 - RNA, 19 nt, Homo sapiens
gaaacccuaugaauguaau

SEQ ID NO: 1175732 - RNA, 19 nt, Homo sapiens
cagagaaaccguacaaaug

SEQ ID NO: 1175733 - RNA, 19 nt, Homo sapiens
guaaaugugggaaggcaua

SEQ ID NO: 1175734 - RNA, 19 nt, Homo sapiens
gagaaaccguacaaaugug

SEQ ID NO: 1175735 - RNA, 19 nt, Homo sapiens
agagaaacccuaugaaugu

SEQ ID NO: 1175736 - RNA, 19 nt, Homo sapiens
agagaaacccuaugaaugu

SEQ ID NO: 1175737 - RNA, 19 nt, Homo sapiens
ggagagaagccauauacau

SEQ ID NO: 1175738 - RNA, 19 nt, Homo sapiens
gagagaaaaucccugaaaa

SEQ ID NO: 1175739 - RNA, 19 nt, Homo sapiens
ucaaagaacaacccuuauu

SEQ ID NO: 1175740 - RNA, 19 nt, Homo sapiens
ggaaagcuucaaucaaaga

SEQ ID NO: 1175741 - RNA, 19 nt, Homo sapiens
gagaauucaugauggaaag

SEQ ID NO: 1175742 - RNA, 19 nt, Homo sapiens
gaaaagccaugaaugcaau

SEQ ID NO: 1175743 - RNA, 19 nt, Homo sapiens
cagcgcacaucucuuauuc

SEQ ID NO: 1175744 - RNA, 19 nt, Homo sapiens
ccagagaauucacacuuca

SEQ ID NO: 1175745 - RNA, 19 nt, Homo sapiens
aagcuucucucuuaaacuu

SEQ ID NO: 1175746 - RNA, 19 nt, Homo sapiens
cagagaaacccuaugaaug

SEQ ID NO: 1175747 - RNA, 19 nt, Homo sapiens
agaaaucagucuuuguugu

SEQ ID NO: 1175748 - RNA, 19 nt, Homo sapiens
aaaggaaauucuugacugu

SEQ ID NO: 1175749 - RNA, 19 nt, Homo sapiens
gugcgcaccuguaaucuca

SEQ ID NO: 1175750 - RNA, 19 nt, Homo sapiens
agucagcgcacaucucuua

SEQ ID NO: 1175751 - RNA, 19 nt, Homo sapiens
gaauucacacuucagagaa

SEQ ID NO: 1175752 - RNA, 19 nt, Homo sapiens
gaaacccuaugaauguagu

SEQ ID NO: 1175753 - RNA, 19 nt, Homo sapiens
uaaggaaugugggaagaug

SEQ ID NO: 1175754 - RNA, 19 nt, Homo sapiens
gaaacuauuugaguguaag

SEQ ID NO: 1175755 - RNA, 19 nt, Homo sapiens
cagcaaagaagucaccauu

SEQ ID NO: 1175756 - RNA, 19 nt, Homo sapiens
gagaagccauauacaugca

SEQ ID NO: 1175757 - RNA, 19 nt, Homo sapiens
cauaagagaauucauacug

SEQ ID NO: 1175758 - RNA, 19 nt, Homo sapiens
caucaaagaauucauacug

SEQ ID NO: 1175759 - RNA, 19 nt, Homo sapiens
caaagaagucaccauuuag

SEQ ID NO: 1175760 - RNA, 19 nt, Homo sapiens
caucagaaaguucauacaa

SEQ ID NO: 1175761 - RNA, 19 nt, Homo sapiens
caacaucagaaaguucaua

SEQ ID NO: 1175762 - RNA, 19 nt, Homo sapiens
agagaaaccguacaaaugu

SEQ ID NO: 1175763 - RNA, 19 nt, Homo sapiens
gaaagcuucaaucaaagaa

SEQ ID NO: 1175764 - RNA, 19 nt, Homo sapiens
cgacaucagagaagucauu

SEQ ID NO: 1175765 - RNA, 19 nt, Homo sapiens
gggaagauguuuucuggaa

SEQ ID NO: 1175766 - RNA, 19 nt, Homo sapiens
aaucggcauucaucccuua

SEQ ID NO: 1175767 - RNA, 19 nt, Homo sapiens
gaucucauccauccuacuu

SEQ ID NO: 1175768 - RNA, 19 nt, Homo sapiens
gagagaagccuuuugaaug

SEQ ID NO: 1175769 - RNA, 19 nt, Homo sapiens
gggaaagcuucaaucaaag

SEQ ID NO: 1175770 - RNA, 19 nt, Homo sapiens
gauaugucccacuuugaaa

SEQ ID NO: 1175771 - RNA, 19 nt, Homo sapiens
gcauucaucccuuauucaa

SEQ ID NO: 1175772 - RNA, 19 nt, Homo sapiens
ucagacagaucucauccau

SEQ ID NO: 1175773 - RNA, 19 nt, Homo sapiens
caacccuuauucuacauau

SEQ ID NO: 1175774 - RNA, 19 nt, Homo sapiens
gcaggagaaucgcuugaac

SEQ ID NO: 1175775 - RNA, 19 nt, Homo sapiens
aaagaagucaccauuuaga

SEQ ID NO: 1175776 - RNA, 19 nt, Homo sapiens
ggugaaacccugucucuac

SEQ ID NO: 1175777 - RNA, 19 nt, Homo sapiens
ucagaaguuuggucaguca

SEQ ID NO: 1175778 - RNA, 19 nt, Homo sapiens
caacgaaugaggcuaucaa

SEQ ID NO: 1175779 - RNA, 19 nt, Homo sapiens
ucagagaaacccuaugaau

SEQ ID NO: 1175780 - RNA, 19 nt, Homo sapiens
gaagucauacuggagagaa

SEQ ID NO: 1175781 - RNA, 19 nt, Homo sapiens
ugaaugcaguaauuguaga

SEQ ID NO: 1175782 - RNA, 19 nt, Homo sapiens
ucagagaaaccguacaaau

SEQ ID NO: 1175783 - RNA, 19 nt, Homo sapiens
cauccuacuucaucagaga

SEQ ID NO: 1175784 - RNA, 19 nt, Homo sapiens
caucucuuauucuacauga

SEQ ID NO: 1175785 - RNA, 19 nt, Homo sapiens
gcaauaaaugugagaaggu

SEQ ID NO: 1175786 - RNA, 19 nt, Homo sapiens
cuaugaaugugaucagugu

SEQ ID NO: 1175787 - RNA, 19 nt, Homo sapiens
cggcauucaucccuuauuc

SEQ ID NO: 1175788 - RNA, 19 nt, Homo sapiens
gaaugcaguaauuguagaa

SEQ ID NO: 1175789 - RNA, 19 nt, Homo sapiens
gagaaaaucccugaaaaug

SEQ ID NO: 1175790 - RNA, 19 nt, Homo sapiens
gauggaaaggaaauucuug

SEQ ID NO: 1175791 - RNA, 19 nt, Homo sapiens
caaaagucauuggugauuu

SEQ ID NO: 1175792 - RNA, 19 nt, Homo sapiens
ccaaagagcaaaagucauu

SEQ ID NO: 1175793 - RNA, 19 nt, Homo sapiens
cgacaucagaauacacauu

SEQ ID NO: 1175794 - RNA, 19 nt, Homo sapiens
ggaaaggaaauucuugacu

SEQ ID NO: 1175795 - RNA, 19 nt, Homo sapiens
gaaagaaaagccaugaaug

SEQ ID NO: 1175796 - RNA, 19 nt, Homo sapiens
gcaccuguaaucucagcua

SEQ ID NO: 1175797 - RNA, 19 nt, Homo sapiens
ugauaugucccacuuugaa

SEQ ID NO: 1175798 - RNA, 19 nt, Homo sapiens
gaccuuauucgacaucaga

SEQ ID NO: 1175799 - RNA, 19 nt, Homo sapiens
cgaagcuucucucuuaaac

SEQ ID NO: 1175800 - RNA, 19 nt, Homo sapiens
cgcccaacaugaaagaauu

SEQ ID NO: 1175801 - RNA, 19 nt, Homo sapiens
gggaccauuugaugauaug

SEQ ID NO: 1175802 - RNA, 19 nt, Homo sapiens
agcaguggcucagaccuua

SEQ ID NO: 1175803 - RNA, 19 nt, Homo sapiens
gaaggcaucugcaguaaga

SEQ ID NO: 1175804 - RNA, 19 nt, Homo sapiens
guaggaagguggucaaaug

SEQ ID NO: 1175805 - RNA, 19 nt, Homo sapiens
cgacauuccuaucagguua

SEQ ID NO: 1175806 - RNA, 19 nt, Homo sapiens
ugaagaagcccaagauuga

SEQ ID NO: 1175807 - RNA, 19 nt, Homo sapiens
ggaagguggucaaauggaa

SEQ ID NO: 1175808 - RNA, 19 nt, Homo sapiens
gcaguaagaucuaccacau

SEQ ID NO: 1175809 - RNA, 19 nt, Homo sapiens
gcaggcagcucuccuacga

SEQ ID NO: 1175810 - RNA, 19 nt, Homo sapiens
ccaagcgccugcucuuuaa

SEQ ID NO: 1175811 - RNA, 19 nt, Homo sapiens
ccagguaccuccaaucaga

SEQ ID NO: 1175812 - RNA, 19 nt, Homo sapiens
cgacacagacggcuacuuu

SEQ ID NO: 1175813 - RNA, 19 nt, Homo sapiens
gccaagcgccugcucuuua

SEQ ID NO: 1175814 - RNA, 19 nt, Homo sapiens
caacacggcugugcucuuc

SEQ ID NO: 1175815 - RNA, 19 nt, Homo sapiens
ggagauggccaaugagaau

SEQ ID NO: 1175816 - RNA, 19 nt, Homo sapiens
gagcagagccgcuucaaac

SEQ ID NO: 1175817 - RNA, 19 nt, Homo sapiens
gaccaaugcugucaucaag

SEQ ID NO: 1175818 - RNA, 19 nt, Homo sapiens
ccacugacauaugaagauu

SEQ ID NO: 1175819 - RNA, 19 nt, Homo sapiens
cgugucaccuuccauguuu

SEQ ID NO: 1175820 - RNA, 19 nt, Homo sapiens
guguggagauggccaauga

SEQ ID NO: 1175821 - RNA, 19 nt, Homo sapiens
gaauguggaagacaccuuu

SEQ ID NO: 1175822 - RNA, 19 nt, Homo sapiens
gccauggucucucacuuug

SEQ ID NO: 1175823 - RNA, 19 nt, Homo sapiens
caccuuguuucauuuguaa

SEQ ID NO: 1175824 - RNA, 19 nt, Homo sapiens
ccaccuuguuucauuugua

SEQ ID NO: 1175825 - RNA, 19 nt, Homo sapiens
gaagaagcccaagauugaa

SEQ ID NO: 1175826 - RNA, 19 nt, Homo sapiens
gugaagaagcccaagauug

SEQ ID NO: 1175827 - RNA, 19 nt, Homo sapiens
gcaagaaggaggaaaugca

SEQ ID NO: 1175828 - RNA, 19 nt, Homo sapiens
ggagaaucgucccuacuac

SEQ ID NO: 1175829 - RNA, 19 nt, Homo sapiens
ccaagucccauguauauag

SEQ ID NO: 1175830 - RNA, 19 nt, Homo sapiens
ucaaauggaauguggaaga

SEQ ID NO: 1175831 - RNA, 19 nt, Homo sapiens
gcaaggugguagacaaagg

SEQ ID NO: 1175832 - RNA, 19 nt, Homo sapiens
guugccaccuuguuucauu

SEQ ID NO: 1175833 - RNA, 19 nt, Homo sapiens
ucaaacggauccgagagaa

SEQ ID NO: 1175834 - RNA, 19 nt, Homo sapiens
gaaccagucgugucaccuu

SEQ ID NO: 1175835 - RNA, 19 nt, Homo sapiens
gcguggagaugcacaugga

SEQ ID NO: 1175836 - RNA, 19 nt, Homo sapiens
guggaaggcaucugcagua

SEQ ID NO: 1175837 - RNA, 19 nt, Homo sapiens
agacuuugcuccacugagu

SEQ ID NO: 1175838 - RNA, 19 nt, Homo sapiens
cgccugcucuuuaaauaug

SEQ ID NO: 1175839 - RNA, 19 nt, Homo sapiens
gaaaagccucucaugcuaa

SEQ ID NO: 1175840 - RNA, 19 nt, Homo sapiens
gacucaagcuugguggaaa

SEQ ID NO: 1175841 - RNA, 19 nt, Homo sapiens
cccaaguccucaccucaaa

SEQ ID NO: 1175842 - RNA, 19 nt, Homo sapiens
gauccugccugccuuugag

SEQ ID NO: 1175843 - RNA, 19 nt, Homo sapiens
uggaaggcaucugcaguaa

SEQ ID NO: 1175844 - RNA, 19 nt, Homo sapiens
ccauccggcuggagaagaa

SEQ ID NO: 1175845 - RNA, 19 nt, Homo sapiens
agaaaagccucucaugcua

SEQ ID NO: 1175846 - RNA, 19 nt, Homo sapiens
aggaggaaaugcacuacaa

SEQ ID NO: 1175847 - RNA, 19 nt, Homo sapiens
ccaaggaggacuacaugga

SEQ ID NO: 1175848 - RNA, 19 nt, Homo sapiens
ggucaaauggaauguggaa

SEQ ID NO: 1175849 - RNA, 19 nt, Homo sapiens
gcgcaaggugguagacaaa

SEQ ID NO: 1175850 - RNA, 19 nt, Homo sapiens
ggcugccacugacauauga

SEQ ID NO: 1175851 - RNA, 19 nt, Homo sapiens
acagaacgacccuggcuuu

SEQ ID NO: 1175852 - RNA, 19 nt, Homo sapiens
aagcgucccugcugaguca

SEQ ID NO: 1175853 - RNA, 19 nt, Homo sapiens
gcaagcuguggcuccuuua

SEQ ID NO: 1175854 - RNA, 19 nt, Homo sapiens
caaggaggacuacauggau

SEQ ID NO: 1175855 - RNA, 19 nt, Homo sapiens
caaauggaauguggaagac

SEQ ID NO: 1175856 - RNA, 19 nt, Homo sapiens
ccagaccaaugcugucauc

SEQ ID NO: 1175857 - RNA, 19 nt, Homo sapiens
guacguccccugaagauaa

SEQ ID NO: 1175858 - RNA, 19 nt, Homo sapiens
ggagcagagccgcuucaaa

SEQ ID NO: 1175859 - RNA, 19 nt, Homo sapiens
gacgguaccagaugauguu

SEQ ID NO: 1175860 - RNA, 19 nt, Homo sapiens
cgcuacagcugcauugaug

SEQ ID NO: 1175861 - RNA, 19 nt, Homo sapiens
gaagguggucaaauggaau

SEQ ID NO: 1175862 - RNA, 19 nt, Homo sapiens
gcugagaacaagcccagaa

SEQ ID NO: 1175863 - RNA, 19 nt, Homo sapiens
ggccuuuccuugccucugu

SEQ ID NO: 1175864 - RNA, 19 nt, Homo sapiens
gaaaucaugaacgacauuc

SEQ ID NO: 1175865 - RNA, 19 nt, Homo sapiens
caagucccauguauauagg

SEQ ID NO: 1175866 - RNA, 19 nt, Homo sapiens
aaucagagccagcccuguu

SEQ ID NO: 1175867 - RNA, 19 nt, Homo sapiens
ccuacuacuucaaccgauu

SEQ ID NO: 1175868 - RNA, 19 nt, Homo sapiens
cuacaaggccguccacaac

SEQ ID NO: 1175869 - RNA, 19 nt, Homo sapiens
agaaggaggaaaugcacua

SEQ ID NO: 1175870 - RNA, 19 nt, Homo sapiens
gaucgcugccugugcaugu

SEQ ID NO: 1175871 - RNA, 19 nt, Homo sapiens
agggagagauggucaaggu

SEQ ID NO: 1175872 - RNA, 19 nt, Homo sapiens
gggcagcacgaugugauuu

SEQ ID NO: 1175873 - RNA, 19 nt, Homo sapiens
gaaucgucccuacuacuuc

SEQ ID NO: 1175874 - RNA, 19 nt, Homo sapiens
cuucaaacgccaccaguug

SEQ ID NO: 1175875 - RNA, 19 nt, Homo sapiens
cagguuaucccgaaucaag

SEQ ID NO: 1175876 - RNA, 19 nt, Homo sapiens
gagaacaagcccagaaagc

SEQ ID NO: 1175877 - RNA, 19 nt, Homo sapiens
cuccaagucccauguauau

SEQ ID NO: 1175878 - RNA, 19 nt, Homo sapiens
ccuccaagucccauguaua

SEQ ID NO: 1175879 - RNA, 19 nt, Homo sapiens
gcaacuacuucagcaagcu

SEQ ID NO: 1175880 - RNA, 19 nt, Homo sapiens
caaggugguagacaaagga

SEQ ID NO: 1175881 - RNA, 19 nt, Homo sapiens
aaucgucccuacuacuuca

SEQ ID NO: 1175882 - RNA, 19 nt, Homo sapiens
agaugcacauggagaacaa

SEQ ID NO: 1175883 - RNA, 19 nt, Homo sapiens
ugaacgacauuccuaucag

SEQ ID NO: 1175884 - RNA, 19 nt, Homo sapiens
ggaggaaaugcacuacaag

SEQ ID NO: 1175885 - RNA, 19 nt, Homo sapiens
uggaugccauggucucuca

SEQ ID NO: 1175886 - RNA, 19 nt, Homo sapiens
agcaagcuguggcuccuuu

SEQ ID NO: 1175887 - RNA, 19 nt, Homo sapiens
agaaucgucccuacuacuu

SEQ ID NO: 1175888 - RNA, 19 nt, Homo sapiens
gcgccugcucuuuaaauau

SEQ ID NO: 1175889 - RNA, 19 nt, Homo sapiens
gugaaaucaugaacgacau

SEQ ID NO: 1175890 - RNA, 19 nt, Homo sapiens
aagaagcccaagauugaaa

SEQ ID NO: 1175891 - RNA, 19 nt, Homo sapiens
ggucagccgcaacuacuuc

SEQ ID NO: 1175892 - RNA, 19 nt, Homo sapiens
agaacaacguggucugcau

SEQ ID NO: 1175893 - RNA, 19 nt, Homo sapiens
gguuaucccgaaucaaguu

SEQ ID NO: 1175894 - RNA, 19 nt, Homo sapiens
ugaaaucaugaacgacauu

SEQ ID NO: 1175895 - RNA, 19 nt, Homo sapiens
gcagcacgaugugauuucg

SEQ ID NO: 1175896 - RNA, 19 nt, Homo sapiens
cggcugugcucuuccuaca

SEQ ID NO: 1175897 - RNA, 19 nt, Homo sapiens
ugaugacucugccuuugag

SEQ ID NO: 1175898 - RNA, 19 nt, Homo sapiens
cagcugcauugaugacucu

SEQ ID NO: 1175899 - RNA, 19 nt, Homo sapiens
gagaaucgucccuacuacu

SEQ ID NO: 1175900 - RNA, 19 nt, Homo sapiens
uuugagagacugcuugaga

SEQ ID NO: 1175901 - RNA, 19 nt, Homo sapiens
gcuccgcucucagcucauc

SEQ ID NO: 1175902 - RNA, 19 nt, Homo sapiens
guggagauggccaaugaga

SEQ ID NO: 1175903 - RNA, 19 nt, Homo sapiens
gcacaaaucucaauauuca

SEQ ID NO: 1175904 - RNA, 19 nt, Homo sapiens
gaacagcuuuacagcacua

SEQ ID NO: 1175905 - RNA, 19 nt, Homo sapiens
gggagugacugcauaaugu

SEQ ID NO: 1175906 - RNA, 19 nt, Homo sapiens
ccugagagauuaagacuau

SEQ ID NO: 1175907 - RNA, 19 nt, Homo sapiens
gaaagacacggcacaaauc

SEQ ID NO: 1175908 - RNA, 19 nt, Homo sapiens
cggcacaaaucucaauauu

SEQ ID NO: 1175909 - RNA, 19 nt, Homo sapiens
uggauuggauggaggauuu

SEQ ID NO: 1175910 - RNA, 19 nt, Homo sapiens
auaauugucuuccacgaaa

SEQ ID NO: 1175911 - RNA, 19 nt, Homo sapiens
gugggcaccugagagauua

SEQ ID NO: 1175912 - RNA, 19 nt, Homo sapiens
caccgaccauggaauaauu

SEQ ID NO: 1175913 - RNA, 19 nt, Homo sapiens
uccaagaaaugcccauaaa

SEQ ID NO: 1175914 - RNA, 19 nt, Homo sapiens
gaacaggcgagauggaaca

SEQ ID NO: 1175915 - RNA, 19 nt, Homo sapiens
ugaaagacacggcacaaau

SEQ ID NO: 1175916 - RNA, 19 nt, Homo sapiens
ggacagagaacagcuuuac

SEQ ID NO: 1175917 - RNA, 19 nt, Homo sapiens
gagauggaacagggauuua

SEQ ID NO: 1175918 - RNA, 19 nt, Homo sapiens
gcagagggccaccuucuac

SEQ ID NO: 1175919 - RNA, 19 nt, Homo sapiens
gaucugaauccuccacuuc

SEQ ID NO: 1175920 - RNA, 19 nt, Homo sapiens
acacacaccugcugagacu

SEQ ID NO: 1175921 - RNA, 19 nt, Homo sapiens
uuacagcacuauccucagu

SEQ ID NO: 1175922 - RNA, 19 nt, Homo sapiens
gaggacagagaacagcuuu

SEQ ID NO: 1175923 - RNA, 19 nt, Homo sapiens
gggaucaccuuaacuugac

SEQ ID NO: 1175924 - RNA, 19 nt, Homo sapiens
gaugggagugacugcauaa

SEQ ID NO: 1175925 - RNA, 19 nt, Homo sapiens
cgagauggaacagggauuu

SEQ ID NO: 1175926 - RNA, 19 nt, Homo sapiens
ugcaugcccucaacucuug

SEQ ID NO: 1175927 - RNA, 19 nt, Homo sapiens
agaugggagugacugcaua

SEQ ID NO: 1175928 - RNA, 19 nt, Homo sapiens
gaacuggacagggugaaag

SEQ ID NO: 1175929 - RNA, 19 nt, Homo sapiens
ggaguggcugggagucuuu

SEQ ID NO: 1175930 - RNA, 19 nt, Homo sapiens
acucuucccuggugccaaa

SEQ ID NO: 1175931 - RNA, 19 nt, Homo sapiens
gaccauggaauaauugucu

SEQ ID NO: 1175932 - RNA, 19 nt, Homo sapiens
gugaaaguccucaaacucu

SEQ ID NO: 1175933 - RNA, 19 nt, Homo sapiens
agaaaugcccauaaaccaa

SEQ ID NO: 1175934 - RNA, 19 nt, Homo sapiens
gagcagagggccaccuucu

SEQ ID NO: 1175935 - RNA, 19 nt, Homo sapiens
gggaacaggcgagauggaa

SEQ ID NO: 1175936 - RNA, 19 nt, Homo sapiens
gggugaaaguccucaaacu

SEQ ID NO: 1175937 - RNA, 19 nt, Homo sapiens
agacacggcacaaaucuca

SEQ ID NO: 1175938 - RNA, 19 nt, Homo sapiens
uaccagagacugaaagaca

SEQ ID NO: 1175939 - RNA, 19 nt, Homo sapiens
gaagaauacauggaauugg

SEQ ID NO: 1175940 - RNA, 19 nt, Homo sapiens
agaagaauacauggaauug

SEQ ID NO: 1175941 - RNA, 19 nt, Homo sapiens
caagaaaugcccauaaacc

SEQ ID NO: 1175942 - RNA, 19 nt, Homo sapiens
gcucagcauuuggauugga

SEQ ID NO: 1175943 - RNA, 19 nt, Homo sapiens
ggaacuggacagggugaaa

SEQ ID NO: 1175944 - RNA, 19 nt, Homo sapiens
caauauucaucucccacau

SEQ ID NO: 1175945 - RNA, 19 nt, Homo sapiens
ggugaaaguccucaaacuc

SEQ ID NO: 1175946 - RNA, 19 nt, Homo sapiens
auauucaucucccacauca

SEQ ID NO: 1175947 - RNA, 19 nt, Homo sapiens
ccaaggaggagaggguaaa

SEQ ID NO: 1175948 - RNA, 19 nt, Homo sapiens
uggcucagcauuuggauug

SEQ ID NO: 1175949 - RNA, 19 nt, Homo sapiens
cugagucugucugauguuu

SEQ ID NO: 1175950 - RNA, 19 nt, Homo sapiens
ugagagauuaagacuauuc

SEQ ID NO: 1175951 - RNA, 19 nt, Homo sapiens
ggcacaaaucucaauauuc

SEQ ID NO: 1175952 - RNA, 19 nt, Homo sapiens
cgccaccgaccauggaaua

SEQ ID NO: 1175953 - RNA, 19 nt, Homo sapiens
acacaccugcugagacuug

SEQ ID NO: 1175954 - RNA, 19 nt, Homo sapiens
ccacacacaccugcugaga

SEQ ID NO: 1175955 - RNA, 19 nt, Homo sapiens
uggaguugcugcugagagu

SEQ ID NO: 1175956 - RNA, 19 nt, Homo sapiens
ccuugccacuggucucaaa

SEQ ID NO: 1175957 - RNA, 19 nt, Homo sapiens
acagcacuauccucaguca

SEQ ID NO: 1175958 - RNA, 19 nt, Homo sapiens
gagucugucugauguuuug

SEQ ID NO: 1175959 - RNA, 19 nt, Homo sapiens
agauggaacagggauuuaa

SEQ ID NO: 1175960 - RNA, 19 nt, Homo sapiens
ggagugacugcauaauguc

SEQ ID NO: 1175961 - RNA, 19 nt, Homo sapiens
gguaccagagacugaaaga

SEQ ID NO: 1175962 - RNA, 19 nt, Homo sapiens
acagagaacagcuuuacag

SEQ ID NO: 1175963 - RNA, 19 nt, Homo sapiens
ccaagaaaugcccauaaac

SEQ ID NO: 1175964 - RNA, 19 nt, Homo sapiens
gauggaacagggauuuaac

SEQ ID NO: 1175965 - RNA, 19 nt, Homo sapiens
aaagacacggcacaaaucu

SEQ ID NO: 1175966 - RNA, 19 nt, Homo sapiens
aagaaaugcccauaaacca

SEQ ID NO: 1175967 - RNA, 19 nt, Homo sapiens
gaguugcugcugagaguuc

SEQ ID NO: 1175968 - RNA, 19 nt, Homo sapiens
ccugcagacugaacuccuu

SEQ ID NO: 1175969 - RNA, 19 nt, Homo sapiens
ccaccgaccauggaauaau

SEQ ID NO: 1175970 - RNA, 19 nt, Homo sapiens
aauaauugucuuccacgaa

SEQ ID NO: 1175971 - RNA, 19 nt, Homo sapiens
ggacugggcugcuugcuuu

SEQ ID NO: 1175972 - RNA, 19 nt, Homo sapiens
gcugcuugcuuucuauuua

SEQ ID NO: 1175973 - RNA, 19 nt, Homo sapiens
ccaccaagcuggaguacga

SEQ ID NO: 1175974 - RNA, 19 nt, Homo sapiens
gagcagacaagaaugauga

SEQ ID NO: 1175975 - RNA, 19 nt, Homo sapiens
gcaucucaccgacaauuua

SEQ ID NO: 1175976 - RNA, 19 nt, Homo sapiens
gcagagcagacaagaauga

SEQ ID NO: 1175977 - RNA, 19 nt, Homo sapiens
ccugguggauaaugaauaa

SEQ ID NO: 1175978 - RNA, 19 nt, Homo sapiens
ggugcuggcugcauuggaa

SEQ ID NO: 1175979 - RNA, 19 nt, Homo sapiens
gaugggaagcucucauuug

SEQ ID NO: 1175980 - RNA, 19 nt, Homo sapiens
augggaagcucucauuuga

SEQ ID NO: 1175981 - RNA, 19 nt, Homo sapiens
gguggauaaugaauaacaa

SEQ ID NO: 1175982 - RNA, 19 nt, Homo sapiens
ccgcagagcagacaagaau

SEQ ID NO: 1175983 - RNA, 19 nt, Homo sapiens
caccgacaauuuagaaaca

SEQ ID NO: 1175984 - RNA, 19 nt, Homo sapiens
ggacuugggccugguggaa

SEQ ID NO: 1175985 - RNA, 19 nt, Homo sapiens
gcaaagaccagggcuuguc

SEQ ID NO: 1175986 - RNA, 19 nt, Homo sapiens
gcucagaggccgagaugca

SEQ ID NO: 1175987 - RNA, 19 nt, Homo sapiens
aaaguggaccaguuuguga

SEQ ID NO: 1175988 - RNA, 19 nt, Homo sapiens
gcgcugcuauguggacuuc

SEQ ID NO: 1175989 - RNA, 19 nt, Homo sapiens
gggcaucucaccgacaauu

SEQ ID NO: 1175990 - RNA, 19 nt, Homo sapiens
ggauaaugaauaacaacug

SEQ ID NO: 1175991 - RNA, 19 nt, Homo sapiens
aggaaggccugcaggacuu

SEQ ID NO: 1175992 - RNA, 19 nt, Homo sapiens
gcucucagcccagggauca

SEQ ID NO: 1175993 - RNA, 19 nt, Homo sapiens
cugcuugcuuucuauuuau

SEQ ID NO: 1175994 - RNA, 19 nt, Homo sapiens
cggacacccucaccauugu

SEQ ID NO: 1175995 - RNA, 19 nt, Homo sapiens
ccggacacccucaccauug

SEQ ID NO: 1175996 - RNA, 19 nt, Homo sapiens
gcauguguccgcccagaag

SEQ ID NO: 1175997 - RNA, 19 nt, Homo sapiens
ccgacaauuuagaaacaga

SEQ ID NO: 1175998 - RNA, 19 nt, Homo sapiens
cgacaauuuagaaacagaa

SEQ ID NO: 1175999 - RNA, 19 nt, Homo sapiens
acacagggcgcagcucaga

SEQ ID NO: 1176000 - RNA, 19 nt, Homo sapiens
ucucaccgacaauuuagaa

SEQ ID NO: 1176001 - RNA, 19 nt, Homo sapiens
gcagacaagaaugaugaug

SEQ ID NO: 1176002 - RNA, 19 nt, Homo sapiens
ccuucacccuguaugaguu

SEQ ID NO: 1176003 - RNA, 19 nt, Homo sapiens
gugccuccuucacccugua

SEQ ID NO: 1176004 - RNA, 19 nt, Homo sapiens
ggcaucucaccgacaauuu

SEQ ID NO: 1176005 - RNA, 19 nt, Homo sapiens
ugaugggaagcucucauuu

SEQ ID NO: 1176006 - RNA, 19 nt, Homo sapiens
ugacuugcacauccucaug

SEQ ID NO: 1176007 - RNA, 19 nt, Homo sapiens
ggacugggcugcuugcuuu

SEQ ID NO: 1176008 - RNA, 19 nt, Homo sapiens
gcugcuugcuuucuauuua

SEQ ID NO: 1176009 - RNA, 19 nt, Homo sapiens
ccaccaagcuggaguacga

SEQ ID NO: 1176010 - RNA, 19 nt, Homo sapiens
gcaucucaccgacaauuua

SEQ ID NO: 1176011 - RNA, 19 nt, Homo sapiens
gguccagggucaccuauug

SEQ ID NO: 1176012 - RNA, 19 nt, Homo sapiens
ccugguggauaaugaauaa

SEQ ID NO: 1176013 - RNA, 19 nt, Homo sapiens
gggcuugucuccuccugaa

SEQ ID NO: 1176014 - RNA, 19 nt, Homo sapiens
gaacuugggccugguggaa

SEQ ID NO: 1176015 - RNA, 19 nt, Homo sapiens
ggugcuggcugcauuggaa

SEQ ID NO: 1176016 - RNA, 19 nt, Homo sapiens
ggccaaguagcaauaauuu

SEQ ID NO: 1176017 - RNA, 19 nt, Homo sapiens
gguggauaaugaauaacaa

SEQ ID NO: 1176018 - RNA, 19 nt, Homo sapiens
caccgacaauuuagaaaca

SEQ ID NO: 1176019 - RNA, 19 nt, Homo sapiens
aaaguggaccaguuuguga

SEQ ID NO: 1176020 - RNA, 19 nt, Homo sapiens
gcaugucauuugcauaucg

SEQ ID NO: 1176021 - RNA, 19 nt, Homo sapiens
gcucagaagccgaaaugca

SEQ ID NO: 1176022 - RNA, 19 nt, Homo sapiens
gggcaucucaccgacaauu

SEQ ID NO: 1176023 - RNA, 19 nt, Homo sapiens
gcgcugcuauguggacuuc

SEQ ID NO: 1176024 - RNA, 19 nt, Homo sapiens
cagcacagaggcaauaaag

SEQ ID NO: 1176025 - RNA, 19 nt, Homo sapiens
ggauaaugaauaacaacug

SEQ ID NO: 1176026 - RNA, 19 nt, Homo sapiens
aggaaggccugcaggacuu

SEQ ID NO: 1176027 - RNA, 19 nt, Homo sapiens
ccucaccacuguguucuuc

SEQ ID NO: 1176028 - RNA, 19 nt, Homo sapiens
cagcucagaagccgaaaug

SEQ ID NO: 1176029 - RNA, 19 nt, Homo sapiens
gcaguggucccuuccaaaa

SEQ ID NO: 1176030 - RNA, 19 nt, Homo sapiens
cugcuugcuuucuauuuau

SEQ ID NO: 1176031 - RNA, 19 nt, Homo sapiens
cggacacccucaccacugu

SEQ ID NO: 1176032 - RNA, 19 nt, Homo sapiens
ccgacaauuuagaaacaga

SEQ ID NO: 1176033 - RNA, 19 nt, Homo sapiens
gcauguguccgcccagaag

SEQ ID NO: 1176034 - RNA, 19 nt, Homo sapiens
cgacaauuuagaaacagaa

SEQ ID NO: 1176035 - RNA, 19 nt, Homo sapiens
gccaaguagcaauaauuug

SEQ ID NO: 1176036 - RNA, 19 nt, Homo sapiens
uggguugguuugcauguca

SEQ ID NO: 1176037 - RNA, 19 nt, Homo sapiens
ggcagaagcagggcugaug

SEQ ID NO: 1176038 - RNA, 19 nt, Homo sapiens
acacagggcgcagcucaga

SEQ ID NO: 1176039 - RNA, 19 nt, Homo sapiens
ucucaccgacaauuuagaa

SEQ ID NO: 1176040 - RNA, 19 nt, Homo sapiens
ggcaucucaccgacaauuu

SEQ ID NO: 1176041 - RNA, 19 nt, Homo sapiens
uggccaaguagcaauaauu

SEQ ID NO: 1176042 - RNA, 19 nt, Homo sapiens
ccuucacccuguaugaguu

SEQ ID NO: 1176043 - RNA, 19 nt, Homo sapiens
gugccuccuucacccugua

SEQ ID NO: 1176044 - RNA, 19 nt, Homo sapiens
cacuucagccuccaagcua

SEQ ID NO: 1176045 - RNA, 19 nt, Homo sapiens
ugacuugcacauccucaug

SEQ ID NO: 1176046 - RNA, 19 nt, Homo sapiens
caagauguuuggcugauua

SEQ ID NO: 1176047 - RNA, 19 nt, Homo sapiens
gaaccuugauucaguuauu

SEQ ID NO: 1176048 - RNA, 19 nt, Homo sapiens
gcgggagccuggccauuua

SEQ ID NO: 1176049 - RNA, 19 nt, Homo sapiens
gaugggagcuuugucaaga

SEQ ID NO: 1176050 - RNA, 19 nt, Homo sapiens
ggacuaagcauccauaugg

SEQ ID NO: 1176051 - RNA, 19 nt, Homo sapiens
ggagaaccuugauucaguu

SEQ ID NO: 1176052 - RNA, 19 nt, Homo sapiens
gggagaaccuugauucagu

SEQ ID NO: 1176053 - RNA, 19 nt, Homo sapiens
ccauuuagcuuuggaagga

SEQ ID NO: 1176054 - RNA, 19 nt, Homo sapiens
ucauaagucucauggauca

SEQ ID NO: 1176055 - RNA, 19 nt, Homo sapiens
gcaagauguuuggcugauu

SEQ ID NO: 1176056 - RNA, 19 nt, Homo sapiens
gaacgaacuguccuucaug

SEQ ID NO: 1176057 - RNA, 19 nt, Homo sapiens
gaccaaaacuguucacuca

SEQ ID NO: 1176058 - RNA, 19 nt, Homo sapiens
agaaggugcuggcgauaga

SEQ ID NO: 1176059 - RNA, 19 nt, Homo sapiens
ccugggagcuggagacuag

SEQ ID NO: 1176060 - RNA, 19 nt, Homo sapiens
acgaggaucuuucccaguu

SEQ ID NO: 1176061 - RNA, 19 nt, Homo sapiens
ucucauaagucucauggau

SEQ ID NO: 1176062 - RNA, 19 nt, Homo sapiens
aaggagaggugauucgaau

SEQ ID NO: 1176063 - RNA, 19 nt, Homo sapiens
gaaggagaggugauucgaa

SEQ ID NO: 1176064 - RNA, 19 nt, Homo sapiens
caacugcugaccucaagaa

SEQ ID NO: 1176065 - RNA, 19 nt, Homo sapiens
gagaaccuugauucaguua

SEQ ID NO: 1176066 - RNA, 19 nt, Homo sapiens
gaggaucuuucccaguugu

SEQ ID NO: 1176067 - RNA, 19 nt, Homo sapiens
ggagcuuugucaagaagau

SEQ ID NO: 1176068 - RNA, 19 nt, Homo sapiens
caguagccauuuagcuuug

SEQ ID NO: 1176069 - RNA, 19 nt, Homo sapiens
agaacgaacuguccuucau

SEQ ID NO: 1176070 - RNA, 19 nt, Homo sapiens
caacaagagugggaaaaga

SEQ ID NO: 1176071 - RNA, 19 nt, Homo sapiens
gauccagccagccaaauuc

SEQ ID NO: 1176072 - RNA, 19 nt, Homo sapiens
ggaaguaagcccagaucca

SEQ ID NO: 1176073 - RNA, 19 nt, Homo sapiens
ucaguagccauuuagcuuu

SEQ ID NO: 1176074 - RNA, 19 nt, Homo sapiens
ggagaggugauucgaaugg

SEQ ID NO: 1176075 - RNA, 19 nt, Homo sapiens
ccagaggcccuucaagcuu

SEQ ID NO: 1176076 - RNA, 19 nt, Homo sapiens
agcauucaguagccauuua

SEQ ID NO: 1176077 - RNA, 19 nt, Homo sapiens
gcucagggucugcgcaaga

SEQ ID NO: 1176078 - RNA, 19 nt, Homo sapiens
ggccauggcuuggacaaac

SEQ ID NO: 1176079 - RNA, 19 nt, Homo sapiens
ccucucagccgcaacaaga

SEQ ID NO: 1176080 - RNA, 19 nt, Homo sapiens
ggagacgccaccagucaau

SEQ ID NO: 1176081 - RNA, 19 nt, Homo sapiens
ggaaggagaggugauucga

SEQ ID NO: 1176082 - RNA, 19 nt, Homo sapiens
gccaaauucuagagcauac

SEQ ID NO: 1176083 - RNA, 19 nt, Homo sapiens
ggaagggacuaagcaucca

SEQ ID NO: 1176084 - RNA, 19 nt, Homo sapiens
ggucugcgcaagauguuug

SEQ ID NO: 1176085 - RNA, 19 nt, Homo sapiens
aaaagaaccuucgggagaa

SEQ ID NO: 1176086 - RNA, 19 nt, Homo sapiens
gagacgccaccagucaaua

SEQ ID NO: 1176087 - RNA, 19 nt, Homo sapiens
caagaaggugcuggcgaua

SEQ ID NO: 1176088 - RNA, 19 nt, Homo sapiens
cgaggaucuuucccaguug

SEQ ID NO: 1176089 - RNA, 19 nt, Homo sapiens
gcuggagacuagcgagaag

SEQ ID NO: 1176090 - RNA, 19 nt, Homo sapiens
gagccuggccauuuaaagg

SEQ ID NO: 1176091 - RNA, 19 nt, Homo sapiens
ggagcugcccgaugcuaug

SEQ ID NO: 1176092 - RNA, 19 nt, Homo sapiens
gggcacagaacuauuucga

SEQ ID NO: 1176093 - RNA, 19 nt, Homo sapiens
cgaaacgcuugagcuggaa

SEQ ID NO: 1176094 - RNA, 19 nt, Homo sapiens
acugguugcugaacuugaa

SEQ ID NO: 1176095 - RNA, 19 nt, Homo sapiens
gggagcucauagagaaaug

SEQ ID NO: 1176096 - RNA, 19 nt, Homo sapiens
cuucugaucucugguacug

SEQ ID NO: 1176097 - RNA, 19 nt, Homo sapiens
gccauuuaaaggccuuaua

SEQ ID NO: 1176098 - RNA, 19 nt, Homo sapiens
ucuagagcauacucaagga

SEQ ID NO: 1176099 - RNA, 19 nt, Homo sapiens
gcagcauucaguagccauu

SEQ ID NO: 1176100 - RNA, 19 nt, Homo sapiens
gcugugaccggguguugga

SEQ ID NO: 1176101 - RNA, 19 nt, Homo sapiens
gcuagggcagccucaguug

SEQ ID NO: 1176102 - RNA, 19 nt, Homo sapiens
gcauucaguagccauuuag

SEQ ID NO: 1176103 - RNA, 19 nt, Homo sapiens
ccagauccagccagccaaa

SEQ ID NO: 1176104 - RNA, 19 nt, Homo sapiens
gauguuuggcugauuaaaa

SEQ ID NO: 1176105 - RNA, 19 nt, Homo sapiens
ccauuuaaaggccuuauac

SEQ ID NO: 1176106 - RNA, 19 nt, Homo sapiens
gagcugugaccggguguug

SEQ ID NO: 1176107 - RNA, 19 nt, Homo sapiens
cauggagggaggaaacuug

SEQ ID NO: 1176108 - RNA, 19 nt, Homo sapiens
gguacuggcuuugggguuu

SEQ ID NO: 1176109 - RNA, 19 nt, Homo sapiens
gggacuaagcauccauaug

SEQ ID NO: 1176110 - RNA, 19 nt, Homo sapiens
cagccaaauucuagagcau

SEQ ID NO: 1176111 - RNA, 19 nt, Homo sapiens
ccagccagccaaauucuag

SEQ ID NO: 1176112 - RNA, 19 nt, Homo sapiens
gcugccggguacuggcuuu

SEQ ID NO: 1176113 - RNA, 19 nt, Homo sapiens
cgccaccagucaauacaau

SEQ ID NO: 1176114 - RNA, 19 nt, Homo sapiens
guagccauuuagcuuugga

SEQ ID NO: 1176115 - RNA, 19 nt, Homo sapiens
gcuggacagagcuaacuau

SEQ ID NO: 1176116 - RNA, 19 nt, Homo sapiens
cgcuugagcuggaaguaag

SEQ ID NO: 1176117 - RNA, 19 nt, Homo sapiens
ucaaggagcuuacguucua

SEQ ID NO: 1176118 - RNA, 19 nt, Homo sapiens
agaaaggacuuguucauuu

SEQ ID NO: 1176119 - RNA, 19 nt, Homo sapiens
gaaauuggaugccuucaca

SEQ ID NO: 1176120 - RNA, 19 nt, Homo sapiens
ugacaaaccugaagaagau

SEQ ID NO: 1176121 - RNA, 19 nt, Homo sapiens
ggauugcaguugagaguua

SEQ ID NO: 1176122 - RNA, 19 nt, Homo sapiens
gacagcaaauuucuugaua

SEQ ID NO: 1176123 - RNA, 19 nt, Homo sapiens
gauggaggcugucuugcua

SEQ ID NO: 1176124 - RNA, 19 nt, Homo sapiens
gcaaggaggucugugaaau

SEQ ID NO: 1176125 - RNA, 19 nt, Homo sapiens
ggaaagaagugggaucuag

SEQ ID NO: 1176126 - RNA, 19 nt, Homo sapiens
gcuuucaggugcuucauua

SEQ ID NO: 1176127 - RNA, 19 nt, Homo sapiens
cgaauucucuuguccaaau

SEQ ID NO: 1176128 - RNA, 19 nt, Homo sapiens
gacaguggauauucuugua

SEQ ID NO: 1176129 - RNA, 19 nt, Homo sapiens
ggaggucugugaaauaauc

SEQ ID NO: 1176130 - RNA, 19 nt, Homo sapiens
agagagaguugugcuauuu

SEQ ID NO: 1176131 - RNA, 19 nt, Homo sapiens
gaacguuucugaacuaagc

SEQ ID NO: 1176132 - RNA, 19 nt, Homo sapiens
gaaguucauuggucuuugu

SEQ ID NO: 1176133 - RNA, 19 nt, Homo sapiens
gagcuuacguucuaguuag

SEQ ID NO: 1176134 - RNA, 19 nt, Homo sapiens
uauuuaagcugaccaguau

SEQ ID NO: 1176135 - RNA, 19 nt, Homo sapiens
caaggaggucugugaaaua

SEQ ID NO: 1176136 - RNA, 19 nt, Homo sapiens
gaauucucuuguccaaaua

SEQ ID NO: 1176137 - RNA, 19 nt, Homo sapiens
ccaagaaccugcugucucu

SEQ ID NO: 1176138 - RNA, 19 nt, Homo sapiens
gaggaaccuugaagaguga

SEQ ID NO: 1176139 - RNA, 19 nt, Homo sapiens
gaugaggccuggauuggau

SEQ ID NO: 1176140 - RNA, 19 nt, Homo sapiens
gaacuaagcaaggacaaau

SEQ ID NO: 1176141 - RNA, 19 nt, Homo sapiens
ggagaucacugaaguacac

SEQ ID NO: 1176142 - RNA, 19 nt, Homo sapiens
gagaggcgaugcuugaagu

SEQ ID NO: 1176143 - RNA, 19 nt, Homo sapiens
aaggaggucugugaaauaa

SEQ ID NO: 1176144 - RNA, 19 nt, Homo sapiens
cagcaaauuucuugauauc

SEQ ID NO: 1176145 - RNA, 19 nt, Homo sapiens
guugagaguuauucaguga

SEQ ID NO: 1176146 - RNA, 19 nt, Homo sapiens
gaaauaauccaggagaaca

SEQ ID NO: 1176147 - RNA, 19 nt, Homo sapiens
gagagaguugugcuauuua

SEQ ID NO: 1176148 - RNA, 19 nt, Homo sapiens
ucauuucgcuucucaaagu

SEQ ID NO: 1176149 - RNA, 19 nt, Homo sapiens
agagaguugugcuauuuaa

SEQ ID NO: 1176150 - RNA, 19 nt, Homo sapiens
ggagcuuacguucuaguua

SEQ ID NO: 1176151 - RNA, 19 nt, Homo sapiens
uccaauagcuaccauagau

SEQ ID NO: 1176152 - RNA, 19 nt, Homo sapiens
ccacugagauuuggagagu

SEQ ID NO: 1176153 - RNA, 19 nt, Homo sapiens
gggaggaggucugauaagu

SEQ ID NO: 1176154 - RNA, 19 nt, Homo sapiens
ccugggaucucuugaaauc

SEQ ID NO: 1176155 - RNA, 19 nt, Homo sapiens
caauagcuaccauagauga

SEQ ID NO: 1176156 - RNA, 19 nt, Homo sapiens
gcuuucaguuccuuuggua

SEQ ID NO: 1176157 - RNA, 19 nt, Homo sapiens
guccugggaucucuugaaa

SEQ ID NO: 1176158 - RNA, 19 nt, Homo sapiens
ggauuuaugcauggaauuu

SEQ ID NO: 1176159 - RNA, 19 nt, Homo sapiens
ggaaagcugcgaauucucu

SEQ ID NO: 1176160 - RNA, 19 nt, Homo sapiens
ggacuaaccaaggagauga

SEQ ID NO: 1176161 - RNA, 19 nt, Homo sapiens
aaauggagaucacugaagu

SEQ ID NO: 1176162 - RNA, 19 nt, Homo sapiens
ggaaauggagaucacugaa

SEQ ID NO: 1176163 - RNA, 19 nt, Homo sapiens
gcaaggacaaauucagaga

SEQ ID NO: 1176164 - RNA, 19 nt, Homo sapiens
agacuggccuggaggaaau

SEQ ID NO: 1176165 - RNA, 19 nt, Homo sapiens
ccaagggcauauagugaga

SEQ ID NO: 1176166 - RNA, 19 nt, Homo sapiens
ggaagccucucccaaagcu

SEQ ID NO: 1176167 - RNA, 19 nt, Homo sapiens
gcauggaauuuaauguagu

SEQ ID NO: 1176168 - RNA, 19 nt, Homo sapiens
gaagagugagaaacaccua

SEQ ID NO: 1176169 - RNA, 19 nt, Homo sapiens
ccaaagcucccaaccacuu

SEQ ID NO: 1176170 - RNA, 19 nt, Homo sapiens
gcugaccaguaucuauaaa

SEQ ID NO: 1176171 - RNA, 19 nt, Homo sapiens
uaaagaagcaccugaugag

SEQ ID NO: 1176172 - RNA, 19 nt, Homo sapiens
gugaaauaauccaggagaa

SEQ ID NO: 1176173 - RNA, 19 nt, Homo sapiens
gggaacguuucugaacuaa

SEQ ID NO: 1176174 - RNA, 19 nt, Homo sapiens
cuaaagaagcaccugauga

SEQ ID NO: 1176175 - RNA, 19 nt, Homo sapiens
guuguaagccacugagauu

SEQ ID NO: 1176176 - RNA, 19 nt, Homo sapiens
gaaauggagaucacugaag

SEQ ID NO: 1176177 - RNA, 19 nt, Homo sapiens
ugacagaaaggacuuguuc

SEQ ID NO: 1176178 - RNA, 19 nt, Homo sapiens
ugcuggcacuguauauuua

SEQ ID NO: 1176179 - RNA, 19 nt, Homo sapiens
gcacucgacagcaaauuuc

SEQ ID NO: 1176180 - RNA, 19 nt, Homo sapiens
cagaaaggacuuguucauu

SEQ ID NO: 1176181 - RNA, 19 nt, Homo sapiens
aagcugaccaguaucuaua

SEQ ID NO: 1176182 - RNA, 19 nt, Homo sapiens
ggagaguguuuucauuuug

SEQ ID NO: 1176183 - RNA, 19 nt, Homo sapiens
acaaguggguggcuuugau

SEQ ID NO: 1176184 - RNA, 19 nt, Homo sapiens
ggaggaggucugauaagug

SEQ ID NO: 1176185 - RNA, 19 nt, Homo sapiens
gcaagaaauaaaccuuugu

SEQ ID NO: 1176186 - RNA, 19 nt, Homo sapiens
uaaagagagaguugugcua

SEQ ID NO: 1176187 - RNA, 19 nt, Homo sapiens
gugaguaagcaagaaauaa

SEQ ID NO: 1176188 - RNA, 19 nt, Homo sapiens
aagagagaguugugcuauu

SEQ ID NO: 1176189 - RNA, 19 nt, Homo sapiens
agggaacguuucugaacua

SEQ ID NO: 1176190 - RNA, 19 nt, Homo sapiens
gugacaaaccugaagaaga

SEQ ID NO: 1176191 - RNA, 19 nt, Homo sapiens
gggaaauggagaucacuga

SEQ ID NO: 1176192 - RNA, 19 nt, Homo sapiens
guaagccacugagauuugg

SEQ ID NO: 1176193 - RNA, 19 nt, Homo sapiens
ccaucucccuccugagcua

SEQ ID NO: 1176194 - RNA, 19 nt, Homo sapiens
cccagacccucuucagcua

SEQ ID NO: 1176195 - RNA, 19 nt, Homo sapiens
cagagacccugagcuuuag

SEQ ID NO: 1176196 - RNA, 19 nt, Homo sapiens
ggaacccaaugcucugucu

SEQ ID NO: 1176197 - RNA, 19 nt, Homo sapiens
guucauuucgcuucucaaa

SEQ ID NO: 1176198 - RNA, 19 nt, Homo sapiens
aggauuccaugauucugua

SEQ ID NO: 1176199 - RNA, 19 nt, Homo sapiens
cuauuuaagcugaccagua

SEQ ID NO: 1176200 - RNA, 19 nt, Homo sapiens
caauaaagagagaguugug

SEQ ID NO: 1176201 - RNA, 19 nt, Homo sapiens
uggcuuugauggacgguuu

SEQ ID NO: 1176202 - RNA, 19 nt, Homo sapiens
gcugccugcugaagucuga

SEQ ID NO: 1176203 - RNA, 19 nt, Homo sapiens
cacagggacuaaccaagga

SEQ ID NO: 1176204 - RNA, 19 nt, Homo sapiens
gcuaaagaagcaccugaug

SEQ ID NO: 1176205 - RNA, 19 nt, Homo sapiens
ucugauaagugccuucaag

SEQ ID NO: 1176206 - RNA, 19 nt, Homo sapiens
gggcauauagugagacagu

SEQ ID NO: 1176207 - RNA, 19 nt, Homo sapiens
guacacagggacuaaccaa

SEQ ID NO: 1176208 - RNA, 19 nt, Homo sapiens
cgcacacacucaacucuga

SEQ ID NO: 1176209 - RNA, 19 nt, Homo sapiens
uauccugacugacagaaag

SEQ ID NO: 1176210 - RNA, 19 nt, Homo sapiens
ugaaguacacagggacuaa

SEQ ID NO: 1176211 - RNA, 19 nt, Homo sapiens
agcaagaaauaaaccuuug

SEQ ID NO: 1176212 - RNA, 19 nt, Homo sapiens
aaagagagaguugugcuau

SEQ ID NO: 1176213 - RNA, 19 nt, Homo sapiens
cagggaaagcugcgaauuc

SEQ ID NO: 1176214 - RNA, 19 nt, Homo sapiens
ccugggaggaggucugaua

SEQ ID NO: 1176215 - RNA, 19 nt, Homo sapiens
ggcacucgacagcaaauuu

SEQ ID NO: 1176216 - RNA, 19 nt, Homo sapiens
aguggcagcugcagcaaga

SEQ ID NO: 1176217 - RNA, 19 nt, Homo sapiens
gaaggagguugauagcaua

SEQ ID NO: 1176218 - RNA, 19 nt, Homo sapiens
ggagagcaauuucuaaguu

SEQ ID NO: 1176219 - RNA, 19 nt, Homo sapiens
uagcauagauggcaacuga

SEQ ID NO: 1176220 - RNA, 19 nt, Homo sapiens
gagagcaauuucuaaguuu

SEQ ID NO: 1176221 - RNA, 19 nt, Homo sapiens
ggaaggagguugauagcau

SEQ ID NO: 1176222 - RNA, 19 nt, Homo sapiens
ggaaggagagcaauuucua

SEQ ID NO: 1176223 - RNA, 19 nt, Homo sapiens
gaggacaguuggcuauuga

SEQ ID NO: 1176224 - RNA, 19 nt, Homo sapiens
gaagaagaguguggaggaa

SEQ ID NO: 1176225 - RNA, 19 nt, Homo sapiens
cauaaaguuucagccauua

SEQ ID NO: 1176226 - RNA, 19 nt, Homo sapiens
gaacacugaugaccaggau

SEQ ID NO: 1176227 - RNA, 19 nt, Homo sapiens
ccauaaaguuucagccauu

SEQ ID NO: 1176228 - RNA, 19 nt, Homo sapiens
gagaagcucccauuuagga

SEQ ID NO: 1176229 - RNA, 19 nt, Homo sapiens
gaaggagagcaauuucuaa

SEQ ID NO: 1176230 - RNA, 19 nt, Homo sapiens
ggaggaaggagagcaauuu

SEQ ID NO: 1176231 - RNA, 19 nt, Homo sapiens
aaaguaggcuguucauaag

SEQ ID NO: 1176232 - RNA, 19 nt, Homo sapiens
ugaccaggaugcagaggua

SEQ ID NO: 1176233 - RNA, 19 nt, Homo sapiens
cagaggcaguauuugauuu

SEQ ID NO: 1176234 - RNA, 19 nt, Homo sapiens
gagaagugcuaccugaucu

SEQ ID NO: 1176235 - RNA, 19 nt, Homo sapiens
acacuaccauuuauuggaa

SEQ ID NO: 1176236 - RNA, 19 nt, Homo sapiens
gcauagauggcaacugauu

SEQ ID NO: 1176237 - RNA, 19 nt, Homo sapiens
uauagugauugccaacuuu

SEQ ID NO: 1176238 - RNA, 19 nt, Homo sapiens
gaaauaaaaugagcaaugg

SEQ ID NO: 1176239 - RNA, 19 nt, Homo sapiens
ggacaguuggcuauugaaa

SEQ ID NO: 1176240 - RNA, 19 nt, Homo sapiens
ggacaggaggcaccaucua

SEQ ID NO: 1176241 - RNA, 19 nt, Homo sapiens
gcuguacaguugaagaaga

SEQ ID NO: 1176242 - RNA, 19 nt, Homo sapiens
ggagguugauagcauagau

SEQ ID NO: 1176243 - RNA, 19 nt, Homo sapiens
ccacagacaucaagauucc

SEQ ID NO: 1176244 - RNA, 19 nt, Homo sapiens
ggaggaaggagguugauag

SEQ ID NO: 1176245 - RNA, 19 nt, Homo sapiens
caggaggcaccaucuauuu

SEQ ID NO: 1176246 - RNA, 19 nt, Homo sapiens
acaaggagaacacugauga

SEQ ID NO: 1176247 - RNA, 19 nt, Homo sapiens
aaaaguaggcuguucauaa

SEQ ID NO: 1176248 - RNA, 19 nt, Homo sapiens
ggaggcaccaucuauuuca

SEQ ID NO: 1176249 - RNA, 19 nt, Homo sapiens
ggguuacacuaccauuuau

SEQ ID NO: 1176250 - RNA, 19 nt, Homo sapiens
uggguuacacuaccauuua

SEQ ID NO: 1176251 - RNA, 19 nt, Homo sapiens
gacaggaggcaccaucuau

SEQ ID NO: 1176252 - RNA, 19 nt, Homo sapiens
ugaggacaguuggcuauug

SEQ ID NO: 1176253 - RNA, 19 nt, Homo sapiens
ucacugaccguccuguuug

SEQ ID NO: 1176254 - RNA, 19 nt, Homo sapiens
gcgcagaaggugcucaaga

SEQ ID NO: 1176255 - RNA, 19 nt, Homo sapiens
gaauggugcuucugaucac

SEQ ID NO: 1176256 - RNA, 19 nt, Homo sapiens
ccagaggcaguauuugauu

SEQ ID NO: 1176257 - RNA, 19 nt, Homo sapiens
gaagcucccauuuaggaau

SEQ ID NO: 1176258 - RNA, 19 nt, Homo sapiens
uaaaguuucagccauuaug

SEQ ID NO: 1176259 - RNA, 19 nt, Homo sapiens
gagcaauuucuaaguuuca

SEQ ID NO: 1176260 - RNA, 19 nt, Homo sapiens
gcggaggcuuggugucaga

SEQ ID NO: 1176261 - RNA, 19 nt, Homo sapiens
gcaaaugccgcuggaagca

SEQ ID NO: 1176262 - RNA, 19 nt, Homo sapiens
guuacacuaccauuuauug

SEQ ID NO: 1176263 - RNA, 19 nt, Homo sapiens
ugacaugaacaguuucuuc

SEQ ID NO: 1176264 - RNA, 19 nt, Homo sapiens
uuauagugauugccaacuu

SEQ ID NO: 1176265 - RNA, 19 nt, Homo sapiens
caucaagauuccaguucau

SEQ ID NO: 1176266 - RNA, 19 nt, Homo sapiens
caccacagacaucaagauu

SEQ ID NO: 1176267 - RNA, 19 nt, Homo sapiens
cagagguggugguuguguu

SEQ ID NO: 1176268 - RNA, 19 nt, Homo sapiens
ccaccuccaucaucuuucu

SEQ ID NO: 1176269 - RNA, 19 nt, Homo sapiens
acaucaagauuccaguuca

SEQ ID NO: 1176270 - RNA, 19 nt, Homo sapiens
ucccagagguggugguugu

SEQ ID NO: 1176271 - RNA, 19 nt, Homo sapiens
agagguggugguuguguua

SEQ ID NO: 1176272 - RNA, 19 nt, Homo sapiens
gaggaaggagagcaauuuc

SEQ ID NO: 1176273 - RNA, 19 nt, Homo sapiens
gacaguuggcuauugaaau

SEQ ID NO: 1176274 - RNA, 19 nt, Homo sapiens
gacaugaacaguuucuucu

SEQ ID NO: 1176275 - RNA, 19 nt, Homo sapiens
gcgcuguacaguugaagaa

SEQ ID NO: 1176276 - RNA, 19 nt, Homo sapiens
gcaccacagacaucaagau

SEQ ID NO: 1176277 - RNA, 19 nt, Homo sapiens
caccaccuccaucaucuuu

SEQ ID NO: 1176278 - RNA, 19 nt, Homo sapiens
auccugcgcuguacaguug

SEQ ID NO: 1176279 - RNA, 19 nt, Homo sapiens
agagcaauuucuaaguuuc

SEQ ID NO: 1176280 - RNA, 19 nt, Homo sapiens
ugaccguccuguuugauac

SEQ ID NO: 1176281 - RNA, 19 nt, Homo sapiens
cgagaagugcuaccugauc

SEQ ID NO: 1176282 - RNA, 19 nt, Homo sapiens
gacaucaagauuccaguuc

SEQ ID NO: 1176283 - RNA, 19 nt, Homo sapiens
acaggaggcaccaucuauu

SEQ ID NO: 1176284 - RNA, 19 nt, Homo sapiens
gauucccaguuuaagauag

SEQ ID NO: 1176285 - RNA, 19 nt, Homo sapiens
gggaggaaggagguugaua

SEQ ID NO: 1176286 - RNA, 19 nt, Homo sapiens
auagugauugccaacuuua

SEQ ID NO: 1176287 - RNA, 19 nt, Homo sapiens
uaugggcacugguuuuaaa

SEQ ID NO: 1176288 - RNA, 19 nt, Homo sapiens
cgcagaaggugcucaagac

SEQ ID NO: 1176289 - RNA, 19 nt, Homo sapiens
gaguguggaggaagcuauu

SEQ ID NO: 1176290 - RNA, 19 nt, Homo sapiens
gaaggcugacccugccaau

SEQ ID NO: 1176291 - RNA, 19 nt, Homo sapiens
cccaagugcucgagaugca

SEQ ID NO: 1176292 - RNA, 19 nt, Homo sapiens
gagacuuccagccaagcua

SEQ ID NO: 1176293 - RNA, 19 nt, Homo sapiens
gguggugguuguguuacga

SEQ ID NO: 1176294 - RNA, 19 nt, Homo sapiens
cacugaccguccuguuuga

SEQ ID NO: 1176295 - RNA, 19 nt, Homo sapiens
gacaaggagaacacugaug

SEQ ID NO: 1176296 - RNA, 19 nt, Homo sapiens
aguaggcuguucauaagca

SEQ ID NO: 1176297 - RNA, 19 nt, Homo sapiens
agacaucaagauuccaguu

SEQ ID NO: 1176298 - RNA, 19 nt, Homo sapiens
gguuacacuaccauuuauu

SEQ ID NO: 1176299 - RNA, 19 nt, Homo sapiens
guuucaauccugcgcugua

SEQ ID NO: 1176300 - RNA, 19 nt, Homo sapiens
ugauucccaguuuaagaua

SEQ ID NO: 1176301 - RNA, 19 nt, Homo sapiens
ugucuucauucagugauau

SEQ ID NO: 1176302 - RNA, 19 nt, Homo sapiens
ggaaauaccuggaggauga

SEQ ID NO: 1176303 - RNA, 19 nt, Homo sapiens
gcacauacaugauaaagaa

SEQ ID NO: 1176304 - RNA, 19 nt, Homo sapiens
gggaagaaauugaugaaua

SEQ ID NO: 1176305 - RNA, 19 nt, Homo sapiens
ggacguaauugaugaagua

SEQ ID NO: 1176306 - RNA, 19 nt, Homo sapiens
gcagauggguucuuaaaug

SEQ ID NO: 1176307 - RNA, 19 nt, Homo sapiens
caaaugagguugaggaaau

SEQ ID NO: 1176308 - RNA, 19 nt, Homo sapiens
gauggguucuuaaauguua

SEQ ID NO: 1176309 - RNA, 19 nt, Homo sapiens
gaguagauguuuccauuaa

SEQ ID NO: 1176310 - RNA, 19 nt, Homo sapiens
ccaaagcacugcagaagaa

SEQ ID NO: 1176311 - RNA, 19 nt, Homo sapiens
gcagauaguccuucagaua

SEQ ID NO: 1176312 - RNA, 19 nt, Homo sapiens
gaauuuauaugcugggaaa

SEQ ID NO: 1176313 - RNA, 19 nt, Homo sapiens
ggaggaauuuggagacuuu

SEQ ID NO: 1176314 - RNA, 19 nt, Homo sapiens
gccaagcacuguuuaaauu

SEQ ID NO: 1176315 - RNA, 19 nt, Homo sapiens
gcaaaggaaucgucuaagu

SEQ ID NO: 1176316 - RNA, 19 nt, Homo sapiens
aaagaagacuugagaaaga

SEQ ID NO: 1176317 - RNA, 19 nt, Homo sapiens
uggaugagcuguuggauuu

SEQ ID NO: 1176318 - RNA, 19 nt, Homo sapiens
ccaggaagaugauguagaa

SEQ ID NO: 1176319 - RNA, 19 nt, Homo sapiens
gaacagugaucaccauagu

SEQ ID NO: 1176320 - RNA, 19 nt, Homo sapiens
gaagcgaucugagaaguug

SEQ ID NO: 1176321 - RNA, 19 nt, Homo sapiens
gggaguagauguuuccauu

SEQ ID NO: 1176322 - RNA, 19 nt, Homo sapiens
ggaaggaagugaguuauca

SEQ ID NO: 1176323 - RNA, 19 nt, Homo sapiens
ggacagggcagcuaugaaa

SEQ ID NO: 1176324 - RNA, 19 nt, Homo sapiens
gaaacuggcugcucucucu

SEQ ID NO: 1176325 - RNA, 19 nt, Homo sapiens
gaaaauaacucuccauugg

SEQ ID NO: 1176326 - RNA, 19 nt, Homo sapiens
gauccuuccuucuuucaua

SEQ ID NO: 1176327 - RNA, 19 nt, Homo sapiens
ggaugcagauggguucuua

SEQ ID NO: 1176328 - RNA, 19 nt, Homo sapiens
caagaaaguuacagccaaa

SEQ ID NO: 1176329 - RNA, 19 nt, Homo sapiens
gaugaaaguuacauggaaa

SEQ ID NO: 1176330 - RNA, 19 nt, Homo sapiens
gaagacaggcucacugcua

SEQ ID NO: 1176331 - RNA, 19 nt, Homo sapiens
gggcagcuaugaaacaauu

SEQ ID NO: 1176332 - RNA, 19 nt, Homo sapiens
ccaagucucucucaucaga

SEQ ID NO: 1176333 - RNA, 19 nt, Homo sapiens
gaaagaagagaaagaggaa

SEQ ID NO: 1176334 - RNA, 19 nt, Homo sapiens
gaagaggacguaauugaug

SEQ ID NO: 1176335 - RNA, 19 nt, Homo sapiens
gaugaagauuccuuuguga

SEQ ID NO: 1176336 - RNA, 19 nt, Homo sapiens
caugauuucuucaaacgua

SEQ ID NO: 1176337 - RNA, 19 nt, Homo sapiens
gcacugaaccuuccauauc

SEQ ID NO: 1176338 - RNA, 19 nt, Homo sapiens
cuacagacuuuaccacuga

SEQ ID NO: 1176339 - RNA, 19 nt, Homo sapiens
gacagaaauuccagugauu

SEQ ID NO: 1176340 - RNA, 19 nt, Homo sapiens
caaugauccuuccuucuuu

SEQ ID NO: 1176341 - RNA, 19 nt, Homo sapiens
gauaaugaguuugauagug

SEQ ID NO: 1176342 - RNA, 19 nt, Homo sapiens
gagaagagaagguagagaa

SEQ ID NO: 1176343 - RNA, 19 nt, Homo sapiens
gaagcagagugacauuaga

SEQ ID NO: 1176344 - RNA, 19 nt, Homo sapiens
gcacagcucuggacaucuc

SEQ ID NO: 1176345 - RNA, 19 nt, Homo sapiens
ggacagucaguuuaugaua

SEQ ID NO: 1176346 - RNA, 19 nt, Homo sapiens
ccaugaagaugaugaugaa

SEQ ID NO: 1176347 - RNA, 19 nt, Homo sapiens
ggaagaccaugaagaugau

SEQ ID NO: 1176348 - RNA, 19 nt, Homo sapiens
uaaaacaacugcauaguga

SEQ ID NO: 1176349 - RNA, 19 nt, Homo sapiens
ugaagaugaugaugaagaa

SEQ ID NO: 1176350 - RNA, 19 nt, Homo sapiens
gaacacagugacucuggua

SEQ ID NO: 1176351 - RNA, 19 nt, Homo sapiens
ggaggaagaggaagaaaug

SEQ ID NO: 1176352 - RNA, 19 nt, Homo sapiens
ugaaagacaugggcacuga

SEQ ID NO: 1176353 - RNA, 19 nt, Homo sapiens
gcaaauacuacugaaauga

SEQ ID NO: 1176354 - RNA, 19 nt, Homo sapiens
gcagccagauuaaguaaag

SEQ ID NO: 1176355 - RNA, 19 nt, Homo sapiens
ugauagcacuucaggauug

SEQ ID NO: 1176356 - RNA, 19 nt, Homo sapiens
gaagcgaagaugaguauga

SEQ ID NO: 1176357 - RNA, 19 nt, Homo sapiens
cagcaugggugauccaaug

SEQ ID NO: 1176358 - RNA, 19 nt, Homo sapiens
uaaauaaacaggagaagga

SEQ ID NO: 1176359 - RNA, 19 nt, Homo sapiens
gaagauuccuuugugauac

SEQ ID NO: 1176360 - RNA, 19 nt, Homo sapiens
aagaaaggcagccagauua

SEQ ID NO: 1176361 - RNA, 19 nt, Homo sapiens
aauuacagcugaagaagaa

SEQ ID NO: 1176362 - RNA, 19 nt, Homo sapiens
gaacugcagagucaaauca

SEQ ID NO: 1176363 - RNA, 19 nt, Homo sapiens
ccaagcacuguuuaaauua

SEQ ID NO: 1176364 - RNA, 19 nt, Homo sapiens
aaacuggguuggaggauga

SEQ ID NO: 1176365 - RNA, 19 nt, Homo sapiens
uggaaacucuacagacuuu

SEQ ID NO: 1176366 - RNA, 19 nt, Homo sapiens
gaaacugucugagccuuca

SEQ ID NO: 1176367 - RNA, 19 nt, Homo sapiens
ucaggagacugcagaauuc

SEQ ID NO: 1176368 - RNA, 19 nt, Homo sapiens
gaaagaagaggaggaggaa

SEQ ID NO: 1176369 - RNA, 19 nt, Homo sapiens
acaggaagguucuacaaga

SEQ ID NO: 1176370 - RNA, 19 nt, Homo sapiens
aggaagaaaugacagauga

SEQ ID NO: 1176371 - RNA, 19 nt, Homo sapiens
gcuaggugcugaugaagau

SEQ ID NO: 1176372 - RNA, 19 nt, Homo sapiens
ggaguagauguuuccauua

SEQ ID NO: 1176373 - RNA, 19 nt, Homo sapiens
gcaggaaggauuugguaaa

SEQ ID NO: 1176374 - RNA, 19 nt, Homo sapiens
gaagucaucuaaauaucag

SEQ ID NO: 1176375 - RNA, 19 nt, Homo sapiens
gcacugaaaguuggaauug

SEQ ID NO: 1176376 - RNA, 19 nt, Homo sapiens
gaugauagcacuucaggau

SEQ ID NO: 1176377 - RNA, 19 nt, Homo sapiens
gccagucgcccuaugguua

SEQ ID NO: 1176378 - RNA, 19 nt, Homo sapiens
aaacuauguuggaugauga

SEQ ID NO: 1176379 - RNA, 19 nt, Homo sapiens
caggaagagugacaagaaa

SEQ ID NO: 1176380 - RNA, 19 nt, Homo sapiens
gaaaccacaggaaucagua

SEQ ID NO: 1176381 - RNA, 19 nt, Homo sapiens
caaugaaacuccgaagguu

SEQ ID NO: 1176382 - RNA, 19 nt, Homo sapiens
ggaagagccugagcagcaa

SEQ ID NO: 1176383 - RNA, 19 nt, Homo sapiens
gaacauggaggaacuucug

SEQ ID NO: 1176384 - RNA, 19 nt, Homo sapiens
cagauggguucuuaaaugu

SEQ ID NO: 1176385 - RNA, 19 nt, Homo sapiens
guucauugcuaacaaagga

SEQ ID NO: 1176386 - RNA, 19 nt, Homo sapiens
aagagaagguagagaaaga

SEQ ID NO: 1176387 - RNA, 19 nt, Homo sapiens
ugaagauuccuuugugaua

SEQ ID NO: 1176388 - RNA, 19 nt, Homo sapiens
aaggaaacccagaucauua

SEQ ID NO: 1176389 - RNA, 19 nt, Homo sapiens
gaagagucauuagaaucaa

SEQ ID NO: 1176390 - RNA, 19 nt, Homo sapiens
gaaauuggcaaggcaguug

SEQ ID NO: 1176391 - RNA, 19 nt, Homo sapiens
gcaguugggccaccugaaa

SEQ ID NO: 1176392 - RNA, 19 nt, Homo sapiens
ggaagaugauguagaacag

SEQ ID NO: 1176393 - RNA, 19 nt, Homo sapiens
ccaaugauccuuccuucuu

SEQ ID NO: 1176394 - RNA, 19 nt, Homo sapiens
ggaagagugacaagaaaga

SEQ ID NO: 1176395 - RNA, 19 nt, Homo sapiens
ggaaucaguaccaagcuuu

SEQ ID NO: 1176396 - RNA, 19 nt, Homo sapiens
gcuccacgauuccauccua

SEQ ID NO: 1176397 - RNA, 19 nt, Homo sapiens
ggaggaagaagaaggaaau

SEQ ID NO: 1176398 - RNA, 19 nt, Homo sapiens
gaaagaggaagaacuagag

SEQ ID NO: 1176399 - RNA, 19 nt, Homo sapiens
gcuagaaauucaggagaaa

SEQ ID NO: 1176400 - RNA, 19 nt, Homo sapiens
gauguagaacagccauuua

SEQ ID NO: 1176401 - RNA, 19 nt, Homo sapiens
ugacuucuccuucaccuaa

SEQ ID NO: 1176402 - RNA, 19 nt, Homo sapiens
ggacaaaccuggccacaca

SEQ ID NO: 1176403 - RNA, 19 nt, Homo sapiens
ccaaagaacaacaaagaug

SEQ ID NO: 1176404 - RNA, 19 nt, Homo sapiens
caaagaacaacaaagaugu

SEQ ID NO: 1176405 - RNA, 19 nt, Homo sapiens
acaggguacucuccagaaa

SEQ ID NO: 1176406 - RNA, 19 nt, Homo sapiens
cuacccagccucacaaaga

SEQ ID NO: 1176407 - RNA, 19 nt, Homo sapiens
ccaaccuccucacaacuga

SEQ ID NO: 1176408 - RNA, 19 nt, Homo sapiens
ucaccaaccuccucacaac

SEQ ID NO: 1176409 - RNA, 19 nt, Homo sapiens
gcagacauugugcgugcua

SEQ ID NO: 1176410 - RNA, 19 nt, Homo sapiens
aggguacucuccagaaaga

SEQ ID NO: 1176411 - RNA, 19 nt, Homo sapiens
gguacucuccagaaagaaa

SEQ ID NO: 1176412 - RNA, 19 nt, Homo sapiens
gaggcggguuaccggcuaa

SEQ ID NO: 1176413 - RNA, 19 nt, Homo sapiens
aaaaugagccaaagaacaa

SEQ ID NO: 1176414 - RNA, 19 nt, Homo sapiens
gaaaacaccaugggcacua

SEQ ID NO: 1176415 - RNA, 19 nt, Homo sapiens
agccaaagaacaacaaaga

SEQ ID NO: 1176416 - RNA, 19 nt, Homo sapiens
aaaguccucagccaugaaa

SEQ ID NO: 1176417 - RNA, 19 nt, Homo sapiens
caaaguggaccccauccua

SEQ ID NO: 1176418 - RNA, 19 nt, Homo sapiens
acccaguccugcagacauu

SEQ ID NO: 1176419 - RNA, 19 nt, Homo sapiens
agccagcacucaaggacaa

SEQ ID NO: 1176420 - RNA, 19 nt, Homo sapiens
aaagaacaacaaagaugug

SEQ ID NO: 1176421 - RNA, 19 nt, Homo sapiens
gccaaagaacaacaaagau

SEQ ID NO: 1176422 - RNA, 19 nt, Homo sapiens
gugacucccuuugauccaa

SEQ ID NO: 1176423 - RNA, 19 nt, Homo sapiens
gcccugugacucccuuuga

SEQ ID NO: 1176424 - RNA, 19 nt, Homo sapiens
aaauaagcaucaccaaccu

SEQ ID NO: 1176425 - RNA, 19 nt, Homo sapiens
gauaauagcuuccaucuca

SEQ ID NO: 1176426 - RNA, 19 nt, Homo sapiens
ggacagagcugggaacuga

SEQ ID NO: 1176427 - RNA, 19 nt, Homo sapiens
guaagucccugcagugaaa

SEQ ID NO: 1176428 - RNA, 19 nt, Homo sapiens
gcucagcuaugaucagaaa

SEQ ID NO: 1176429 - RNA, 19 nt, Homo sapiens
ugacagcccugaucaauag

SEQ ID NO: 1176430 - RNA, 19 nt, Homo sapiens
ccacugaacuuucuggaau

SEQ ID NO: 1176431 - RNA, 19 nt, Homo sapiens
gaauaaaccauccaagaga

SEQ ID NO: 1176432 - RNA, 19 nt, Homo sapiens
ggagauagaauaaugaugu

SEQ ID NO: 1176433 - RNA, 19 nt, Homo sapiens
aaagguaacgguacacuua

SEQ ID NO: 1176434 - RNA, 19 nt, Homo sapiens
guaaacugcuguggaugua

SEQ ID NO: 1176435 - RNA, 19 nt, Homo sapiens
ggugugugauaauuacuua

SEQ ID NO: 1176436 - RNA, 19 nt, Homo sapiens
gauaugaaaugcuaagaac

SEQ ID NO: 1176437 - RNA, 19 nt, Homo sapiens
gcaaagcuguugagagcau

SEQ ID NO: 1176438 - RNA, 19 nt, Homo sapiens
ugacaggugugugauaauu

SEQ ID NO: 1176439 - RNA, 19 nt, Homo sapiens
ggacuggcccuaacaacaa

SEQ ID NO: 1176440 - RNA, 19 nt, Homo sapiens
gaaauuugccaucugacaa

SEQ ID NO: 1176441 - RNA, 19 nt, Homo sapiens
gaacugacagcccugauca

SEQ ID NO: 1176442 - RNA, 19 nt, Homo sapiens
aaacugcuguggauguauu

SEQ ID NO: 1176443 - RNA, 19 nt, Homo sapiens
gauguccucucgauaaauc

SEQ ID NO: 1176444 - RNA, 19 nt, Homo sapiens
uaggacagauuuggaauga

SEQ ID NO: 1176445 - RNA, 19 nt, Homo sapiens
gagauagaauaaugaugug

SEQ ID NO: 1176446 - RNA, 19 nt, Homo sapiens
gaauagaagcucugucagu

SEQ ID NO: 1176447 - RNA, 19 nt, Homo sapiens
gguuucagaucccuuaguu

SEQ ID NO: 1176448 - RNA, 19 nt, Homo sapiens
gaggcgagcuucagaucug

SEQ ID NO: 1176449 - RNA, 19 nt, Homo sapiens
agaauaaugaugugccuua

SEQ ID NO: 1176450 - RNA, 19 nt, Homo sapiens
gugccgacaucccaaguuu

SEQ ID NO: 1176451 - RNA, 19 nt, Homo sapiens
ccaguuggguggcuagguu

SEQ ID NO: 1176452 - RNA, 19 nt, Homo sapiens
auaaugaugugccuuacaa

SEQ ID NO: 1176453 - RNA, 19 nt, Homo sapiens
gggaauagaagcucuguca

SEQ ID NO: 1176454 - RNA, 19 nt, Homo sapiens
agaaagcaccgucgagaaa

SEQ ID NO: 1176455 - RNA, 19 nt, Homo sapiens
caguguaggugucuguaaa

SEQ ID NO: 1176456 - RNA, 19 nt, Homo sapiens
ccugaaauuugccaucuga

SEQ ID NO: 1176457 - RNA, 19 nt, Homo sapiens
gggaaaaccugccagagaa

SEQ ID NO: 1176458 - RNA, 19 nt, Homo sapiens
ccccaaaucugaaauaaaa

SEQ ID NO: 1176459 - RNA, 19 nt, Homo sapiens
gagccacagugcuuagaga

SEQ ID NO: 1176460 - RNA, 19 nt, Homo sapiens
caucauggcagaguuguaa

SEQ ID NO: 1176461 - RNA, 19 nt, Homo sapiens
guuguaaacugcuguggau

SEQ ID NO: 1176462 - RNA, 19 nt, Homo sapiens
gacaggugugugauaauua

SEQ ID NO: 1176463 - RNA, 19 nt, Homo sapiens
uaacaacaaaugaggagaa

SEQ ID NO: 1176464 - RNA, 19 nt, Homo sapiens
guggcuagguugccucauu

SEQ ID NO: 1176465 - RNA, 19 nt, Homo sapiens
gauuugauguccucucgau

SEQ ID NO: 1176466 - RNA, 19 nt, Homo sapiens
gaaagcaccgucgagaaau

SEQ ID NO: 1176467 - RNA, 19 nt, Homo sapiens
aacaaggacuccauacguu

SEQ ID NO: 1176468 - RNA, 19 nt, Homo sapiens
gcaccuguacguaguaugu

SEQ ID NO: 1176469 - RNA, 19 nt, Homo sapiens
guucaaauccugacucuac

SEQ ID NO: 1176470 - RNA, 19 nt, Homo sapiens
aaauccagguaacgacaua

SEQ ID NO: 1176471 - RNA, 19 nt, Homo sapiens
ucaauagucccaagaggaa

SEQ ID NO: 1176472 - RNA, 19 nt, Homo sapiens
uggcuagguugccucauuu

SEQ ID NO: 1176473 - RNA, 19 nt, Homo sapiens
agucuuccauuccaacuuu

SEQ ID NO: 1176474 - RNA, 19 nt, Homo sapiens
caauaggacagauuuggaa

SEQ ID NO: 1176475 - RNA, 19 nt, Homo sapiens
cauaggaugcuggacaaua

SEQ ID NO: 1176476 - RNA, 19 nt, Homo sapiens
gccauaggaugcuggacaa

SEQ ID NO: 1176477 - RNA, 19 nt, Homo sapiens
gagcagucuuccauuccaa

SEQ ID NO: 1176478 - RNA, 19 nt, Homo sapiens
guuugacccucuccugaaa

SEQ ID NO: 1176479 - RNA, 19 nt, Homo sapiens
aagaauaaaccauccaaga

SEQ ID NO: 1176480 - RNA, 19 nt, Homo sapiens
gagcaccagucacuuacuc

SEQ ID NO: 1176481 - RNA, 19 nt, Homo sapiens
uaacaaggacuccauacgu

SEQ ID NO: 1176482 - RNA, 19 nt, Homo sapiens
gaauaaugaugugccuuac

SEQ ID NO: 1176483 - RNA, 19 nt, Homo sapiens
ccacuuaggagcugugugu

SEQ ID NO: 1176484 - RNA, 19 nt, Homo sapiens
gacuggcccuaacaacaaa

SEQ ID NO: 1176485 - RNA, 19 nt, Homo sapiens
ccuggucuguaacaugaua

SEQ ID NO: 1176486 - RNA, 19 nt, Homo sapiens
ucccuggucuguaacauga

SEQ ID NO: 1176487 - RNA, 19 nt, Homo sapiens
cuugggagauagaauaaug

SEQ ID NO: 1176488 - RNA, 19 nt, Homo sapiens
ccuaggaggcagucccuua

SEQ ID NO: 1176489 - RNA, 19 nt, Homo sapiens
aaagcaccgucgagaaaug

SEQ ID NO: 1176490 - RNA, 19 nt, Homo sapiens
cuacugaggccuuggucua

SEQ ID NO: 1176491 - RNA, 19 nt, Homo sapiens
ugaugugccuuacaaugga

SEQ ID NO: 1176492 - RNA, 19 nt, Homo sapiens
ggacaauaggacagauuug

SEQ ID NO: 1176493 - RNA, 19 nt, Homo sapiens
gacccucuccugaaauuug

SEQ ID NO: 1176494 - RNA, 19 nt, Homo sapiens
gggcugauuugcugucucu

SEQ ID NO: 1176495 - RNA, 19 nt, Homo sapiens
guuuaugucuguucuuugg

SEQ ID NO: 1176496 - RNA, 19 nt, Homo sapiens
guucagagcauuggacaga

SEQ ID NO: 1176497 - RNA, 19 nt, Homo sapiens
auaggaugcuggacaauag

SEQ ID NO: 1176498 - RNA, 19 nt, Homo sapiens
uggaugccaugaauaccua

SEQ ID NO: 1176499 - RNA, 19 nt, Homo sapiens
uggagaggcugaacaaagg

SEQ ID NO: 1176500 - RNA, 19 nt, Homo sapiens
gcuaauugacacccacuga

SEQ ID NO: 1176501 - RNA, 19 nt, Homo sapiens
cuucagaucugcucaagcu

SEQ ID NO: 1176502 - RNA, 19 nt, Homo sapiens
ggaagcuugugggcucuga

SEQ ID NO: 1176503 - RNA, 19 nt, Homo sapiens
caaacaaacaaacagaaag

SEQ ID NO: 1176504 - RNA, 19 nt, Homo sapiens
cuaggaggcagaaagguuu

SEQ ID NO: 1176505 - RNA, 19 nt, Homo sapiens
acaaggacuccauacguuu

SEQ ID NO: 1176506 - RNA, 19 nt, Homo sapiens
ugucuugggagauagaaua

SEQ ID NO: 1176507 - RNA, 19 nt, Homo sapiens
cuacagccaagcuaauuga

SEQ ID NO: 1176508 - RNA, 19 nt, Homo sapiens
cgguuuaugucuguucuuu

SEQ ID NO: 1176509 - RNA, 19 nt, Homo sapiens
aaauaacaaggacuccaua

SEQ ID NO: 1176510 - RNA, 19 nt, Homo sapiens
guggcagcgucaucacuuu

SEQ ID NO: 1176511 - RNA, 19 nt, Homo sapiens
ucggagcaccagucacuua

SEQ ID NO: 1176512 - RNA, 19 nt, Homo sapiens
cagaaagcaccgucgagaa

SEQ ID NO: 1176513 - RNA, 19 nt, Homo sapiens
guaggugucuguaaaaugg

SEQ ID NO: 1176514 - RNA, 19 nt, Homo sapiens
gguaacgguacacuuaaga

SEQ ID NO: 1176515 - RNA, 19 nt, Homo sapiens
ggugugggccgugauagaa

SEQ ID NO: 1176516 - RNA, 19 nt, Homo sapiens
ucagguuucagaucccuua

SEQ ID NO: 1176517 - RNA, 19 nt, Homo sapiens
ucuguaacaugauauuugg

SEQ ID NO: 1176518 - RNA, 19 nt, Homo sapiens
gguaagucccugcagugaa

SEQ ID NO: 1176519 - RNA, 19 nt, Homo sapiens
uuugauguccucucgauaa

SEQ ID NO: 1176520 - RNA, 19 nt, Homo sapiens
gauuugcugucucugucuu

SEQ ID NO: 1176521 - RNA, 19 nt, Homo sapiens
gacuagcggccaccucauu

SEQ ID NO: 1176522 - RNA, 19 nt, Homo sapiens
uaaauaacaaggacuccau

SEQ ID NO: 1176523 - RNA, 19 nt, Homo sapiens
gcccauuugauaucuauga

SEQ ID NO: 1176524 - RNA, 19 nt, Homo sapiens
gaaugauaauagcuuccau

SEQ ID NO: 1176525 - RNA, 19 nt, Homo sapiens
gcagauaccucucaagaua

SEQ ID NO: 1176526 - RNA, 19 nt, Homo sapiens
ggaggcaucuuucaacuua

SEQ ID NO: 1176527 - RNA, 19 nt, Homo sapiens
gaagagaggugcaauagug

SEQ ID NO: 1176528 - RNA, 19 nt, Homo sapiens
aaagagggcuggacaguua

SEQ ID NO: 1176529 - RNA, 19 nt, Homo sapiens
gaaaggauuuaccuaauug

SEQ ID NO: 1176530 - RNA, 19 nt, Homo sapiens
ucacagaccuuuaaaguug

SEQ ID NO: 1176531 - RNA, 19 nt, Homo sapiens
ggaggagucuaccaaauaa

SEQ ID NO: 1176532 - RNA, 19 nt, Homo sapiens
gagaauaccuggaugaaca

SEQ ID NO: 1176533 - RNA, 19 nt, Homo sapiens
gugaugauauggauaguua

SEQ ID NO: 1176534 - RNA, 19 nt, Homo sapiens
uaaagaagguuguacauca

SEQ ID NO: 1176535 - RNA, 19 nt, Homo sapiens
gaaagaaggcagcaacauu

SEQ ID NO: 1176536 - RNA, 19 nt, Homo sapiens
ccuuaaaccucucaaauuu

SEQ ID NO: 1176537 - RNA, 19 nt, Homo sapiens
agaagaagauugacucuga

SEQ ID NO: 1176538 - RNA, 19 nt, Homo sapiens
agacguacauugagaagua

SEQ ID NO: 1176539 - RNA, 19 nt, Homo sapiens
gcacagugaugaugagguu

SEQ ID NO: 1176540 - RNA, 19 nt, Homo sapiens
uugagaagcuggagaauaa

SEQ ID NO: 1176541 - RNA, 19 nt, Homo sapiens
gaaacaauaccuagaagaa

SEQ ID NO: 1176542 - RNA, 19 nt, Homo sapiens
gaaccaugcuguugugaau

SEQ ID NO: 1176543 - RNA, 19 nt, Homo sapiens
ggaaagagcacccaagugu

SEQ ID NO: 1176544 - RNA, 19 nt, Homo sapiens
uuaacgaacuucugguuua

SEQ ID NO: 1176545 - RNA, 19 nt, Homo sapiens
gcucugcugugcuuuauuu

SEQ ID NO: 1176546 - RNA, 19 nt, Homo sapiens
ugagagaccuuuaccaaga

SEQ ID NO: 1176547 - RNA, 19 nt, Homo sapiens
ccaauuaaacucugucaua

SEQ ID NO: 1176548 - RNA, 19 nt, Homo sapiens
aaagaaggcagcaacauua

SEQ ID NO: 1176549 - RNA, 19 nt, Homo sapiens
gcacauggguugguguuga

SEQ ID NO: 1176550 - RNA, 19 nt, Homo sapiens
gaagcuggagaauaaauua

SEQ ID NO: 1176551 - RNA, 19 nt, Homo sapiens
gaaagacaacgacaacuug

SEQ ID NO: 1176552 - RNA, 19 nt, Homo sapiens
ucacuuggcugcuuaagga

SEQ ID NO: 1176553 - RNA, 19 nt, Homo sapiens
acaaaucgcuuacaaccuu

SEQ ID NO: 1176554 - RNA, 19 nt, Homo sapiens
caccaucgcuugugcauga

SEQ ID NO: 1176555 - RNA, 19 nt, Homo sapiens
gaggugacccuuucuauga

SEQ ID NO: 1176556 - RNA, 19 nt, Homo sapiens
gauggaaguuaucaugaaa

SEQ ID NO: 1176557 - RNA, 19 nt, Homo sapiens
gaaccagacuauaacuaug

SEQ ID NO: 1176558 - RNA, 19 nt, Homo sapiens
gaaguaacgcgaagaauag

SEQ ID NO: 1176559 - RNA, 19 nt, Homo sapiens
gagauucaguccucacuug

SEQ ID NO: 1176560 - RNA, 19 nt, Homo sapiens
gcagcaacauuaacaaauc

SEQ ID NO: 1176561 - RNA, 19 nt, Homo sapiens
ggauuuaccuaauugugaa

SEQ ID NO: 1176562 - RNA, 19 nt, Homo sapiens
gauauugagucauugaugu

SEQ ID NO: 1176563 - RNA, 19 nt, Homo sapiens
gaaguguccuauauggaaa

SEQ ID NO: 1176564 - RNA, 19 nt, Homo sapiens
gcaacaacuugguaggaaa

SEQ ID NO: 1176565 - RNA, 19 nt, Homo sapiens
ggacaugucugacuauagc

SEQ ID NO: 1176566 - RNA, 19 nt, Homo sapiens
caccaaauguucauaaugu

SEQ ID NO: 1176567 - RNA, 19 nt, Homo sapiens
caacacaggaggcaucuuu

SEQ ID NO: 1176568 - RNA, 19 nt, Homo sapiens
ugaaguaacgcgaagaaua

SEQ ID NO: 1176569 - RNA, 19 nt, Homo sapiens
gacgagaacuggaacugaa

SEQ ID NO: 1176570 - RNA, 19 nt, Homo sapiens
ggagaaacaauaccuagaa

SEQ ID NO: 1176571 - RNA, 19 nt, Homo sapiens
gaagagauagcacaggaaa

SEQ ID NO: 1176572 - RNA, 19 nt, Homo sapiens
ccagagagaugaugaggau

SEQ ID NO: 1176573 - RNA, 19 nt, Homo sapiens
gauguuuaguuaccaguuu

SEQ ID NO: 1176574 - RNA, 19 nt, Homo sapiens
gagaaugaccagguaauaa

SEQ ID NO: 1176575 - RNA, 19 nt, Homo sapiens
guaaaggacaagauaauug

SEQ ID NO: 1176576 - RNA, 19 nt, Homo sapiens
gaauaguaaugacccaguu

SEQ ID NO: 1176577 - RNA, 19 nt, Homo sapiens
ggaaagacaacgacaacuu

SEQ ID NO: 1176578 - RNA, 19 nt, Homo sapiens
gaaguguucagauggauaa

SEQ ID NO: 1176579 - RNA, 19 nt, Homo sapiens
ccagcugcauuccaaguua

SEQ ID NO: 1176580 - RNA, 19 nt, Homo sapiens
gcaugauucuguucacuug

SEQ ID NO: 1176581 - RNA, 19 nt, Homo sapiens
gaaugccucuucugugaug

SEQ ID NO: 1176582 - RNA, 19 nt, Homo sapiens
gagagaccuuuaccaagaa

SEQ ID NO: 1176583 - RNA, 19 nt, Homo sapiens
gaugaacucuuccgacaag

SEQ ID NO: 1176584 - RNA, 19 nt, Homo sapiens
gacaaaugcuacuuaguca

SEQ ID NO: 1176585 - RNA, 19 nt, Homo sapiens
gcagacaacuaugaagaga

SEQ ID NO: 1176586 - RNA, 19 nt, Homo sapiens
acaggaagcuaauaaguuc

SEQ ID NO: 1176587 - RNA, 19 nt, Homo sapiens
gagagcagcugguuaaagc

SEQ ID NO: 1176588 - RNA, 19 nt, Homo sapiens
ugaaaacccugaauaguaa

SEQ ID NO: 1176589 - RNA, 19 nt, Homo sapiens
acgaacuucugguuuauua

SEQ ID NO: 1176590 - RNA, 19 nt, Homo sapiens
aaagcaaauuugugccuua

SEQ ID NO: 1176591 - RNA, 19 nt, Homo sapiens
ggagagcuuuccaguagga

SEQ ID NO: 1176592 - RNA, 19 nt, Homo sapiens
gcuauuaacaggaagcuaa

SEQ ID NO: 1176593 - RNA, 19 nt, Homo sapiens
gauguagcauguuauggaa

SEQ ID NO: 1176594 - RNA, 19 nt, Homo sapiens
aaaggcaacugaggagaua

SEQ ID NO: 1176595 - RNA, 19 nt, Homo sapiens
ccaagugacucuucagauc

SEQ ID NO: 1176596 - RNA, 19 nt, Homo sapiens
gagauugguugaaagacuu

SEQ ID NO: 1176597 - RNA, 19 nt, Homo sapiens
gcaaagaugagcccacaga

SEQ ID NO: 1176598 - RNA, 19 nt, Homo sapiens
ccaguucucuuccucgauu

SEQ ID NO: 1176599 - RNA, 19 nt, Homo sapiens
gggaagagaagcugagaaa

SEQ ID NO: 1176600 - RNA, 19 nt, Homo sapiens
ggucagaugcacucauuaa

SEQ ID NO: 1176601 - RNA, 19 nt, Homo sapiens
uggaaugccucuucuguga

SEQ ID NO: 1176602 - RNA, 19 nt, Homo sapiens
gaggaaacgucgagauugg

SEQ ID NO: 1176603 - RNA, 19 nt, Homo sapiens
cagccaaaccucuaugaua

SEQ ID NO: 1176604 - RNA, 19 nt, Homo sapiens
gcaaauuugugccuuaucg

SEQ ID NO: 1176605 - RNA, 19 nt, Homo sapiens
gauaaggaucaaucucaua

SEQ ID NO: 1176606 - RNA, 19 nt, Homo sapiens
ccaccaacauccuugaaga

SEQ ID NO: 1176607 - RNA, 19 nt, Homo sapiens
acaaagaguugacagaagu

SEQ ID NO: 1176608 - RNA, 19 nt, Homo sapiens
uaacaaacgugagaagaag

SEQ ID NO: 1176609 - RNA, 19 nt, Homo sapiens
ccacauaccaguucucuuc

SEQ ID NO: 1176610 - RNA, 19 nt, Homo sapiens
gaugacaaaugcuacuuag

SEQ ID NO: 1176611 - RNA, 19 nt, Homo sapiens
ucacacagacacuuuauga

SEQ ID NO: 1176612 - RNA, 19 nt, Homo sapiens
gaacuagaacgcaauugug

SEQ ID NO: 1176613 - RNA, 19 nt, Homo sapiens
guuagagaaugaccaggua

SEQ ID NO: 1176614 - RNA, 19 nt, Homo sapiens
gaucccaccuccuggaaug

SEQ ID NO: 1176615 - RNA, 19 nt, Homo sapiens
gaagccauccugucaguau

SEQ ID NO: 1176616 - RNA, 19 nt, Homo sapiens
ucgauucucuucaugcuaa

SEQ ID NO: 1176617 - RNA, 19 nt, Homo sapiens
ggaucaaucucauauucau

SEQ ID NO: 1176618 - RNA, 19 nt, Homo sapiens
gaaugaccagguaauaauu

SEQ ID NO: 1176619 - RNA, 19 nt, Homo sapiens
ggaugaaucuaacacuaca

SEQ ID NO: 1176620 - RNA, 19 nt, Homo sapiens
cagccaauauuuacaacaa

SEQ ID NO: 1176621 - RNA, 19 nt, Homo sapiens
gcaaaccucagugccaaua

SEQ ID NO: 1176622 - RNA, 19 nt, Homo sapiens
gagaaacaauaccuagaag

SEQ ID NO: 1176623 - RNA, 19 nt, Homo sapiens
uaacgaacuucugguuuau

SEQ ID NO: 1176624 - RNA, 19 nt, Homo sapiens
ggaugacaaaugcuacuua

SEQ ID NO: 1176625 - RNA, 19 nt, Homo sapiens
gaaauuaacuguacagguu

SEQ ID NO: 1176626 - RNA, 19 nt, Homo sapiens
ccacuucccuuacgacuua

SEQ ID NO: 1176627 - RNA, 19 nt, Homo sapiens
gaccagaucugcucacauu

SEQ ID NO: 1176628 - RNA, 19 nt, Homo sapiens
gaagaaaccuuggacuaug

SEQ ID NO: 1176629 - RNA, 19 nt, Homo sapiens
caacaaagcugcgauugga

SEQ ID NO: 1176630 - RNA, 19 nt, Homo sapiens
gaaugaaggucccaagaga

SEQ ID NO: 1176631 - RNA, 19 nt, Homo sapiens
gaaaagugguccccuguua

SEQ ID NO: 1176632 - RNA, 19 nt, Homo sapiens
gaugaucagugcagaauga

SEQ ID NO: 1176633 - RNA, 19 nt, Homo sapiens
ccaugaaacccuacaauua

SEQ ID NO: 1176634 - RNA, 19 nt, Homo sapiens
gaaaauggguugccuagaa

SEQ ID NO: 1176635 - RNA, 19 nt, Homo sapiens
ucacuaagcugacaaugau

SEQ ID NO: 1176636 - RNA, 19 nt, Homo sapiens
ggaugaaucuaaaugcauu

SEQ ID NO: 1176637 - RNA, 19 nt, Homo sapiens
gcacacagcauaauucaau

SEQ ID NO: 1176638 - RNA, 19 nt, Homo sapiens
gcacaacucuaucuaaggu

SEQ ID NO: 1176639 - RNA, 19 nt, Homo sapiens
ugaacaaggugucuaagaa

SEQ ID NO: 1176640 - RNA, 19 nt, Homo sapiens
gauauugggagaugaauuu

SEQ ID NO: 1176641 - RNA, 19 nt, Homo sapiens
gagaagaaaccgagaaaga

SEQ ID NO: 1176642 - RNA, 19 nt, Homo sapiens
gaaggcugguacccacuua

SEQ ID NO: 1176643 - RNA, 19 nt, Homo sapiens
caaggugucuaagaauaua

SEQ ID NO: 1176644 - RNA, 19 nt, Homo sapiens
gagaugaauuugcaacaau

SEQ ID NO: 1176645 - RNA, 19 nt, Homo sapiens
gaaguguguuucaacuauu

SEQ ID NO: 1176646 - RNA, 19 nt, Homo sapiens
uaucuaagguguuuacuag

SEQ ID NO: 1176647 - RNA, 19 nt, Homo sapiens
ggagaugaauuugcaacaa

SEQ ID NO: 1176648 - RNA, 19 nt, Homo sapiens
uuacagggaugccagauga

SEQ ID NO: 1176649 - RNA, 19 nt, Homo sapiens
uuggguagcugaugucaua

SEQ ID NO: 1176650 - RNA, 19 nt, Homo sapiens
gaacaaggugucuaagaau

SEQ ID NO: 1176651 - RNA, 19 nt, Homo sapiens
gcaugggacucuugauaau

SEQ ID NO: 1176652 - RNA, 19 nt, Homo sapiens
cagcauaauucaaugucua

SEQ ID NO: 1176653 - RNA, 19 nt, Homo sapiens
guaauuggcacaacucuau

SEQ ID NO: 1176654 - RNA, 19 nt, Homo sapiens
gaaagaagaagaggaggaa

SEQ ID NO: 1176655 - RNA, 19 nt, Homo sapiens
caugaaacccuacaauuau

SEQ ID NO: 1176656 - RNA, 19 nt, Homo sapiens
ggacaauuaucucaaucau

SEQ ID NO: 1176657 - RNA, 19 nt, Homo sapiens
gguagcugaugucauaauu

SEQ ID NO: 1176658 - RNA, 19 nt, Homo sapiens
gcacugugauucuguuucu

SEQ ID NO: 1176659 - RNA, 19 nt, Homo sapiens
gauuagagaaccauguuaa

SEQ ID NO: 1176660 - RNA, 19 nt, Homo sapiens
guacagguuuguuaucaca

SEQ ID NO: 1176661 - RNA, 19 nt, Homo sapiens
aacaaggugucuaagaaua

SEQ ID NO: 1176662 - RNA, 19 nt, Homo sapiens
gaagcacugugauucuguu

SEQ ID NO: 1176663 - RNA, 19 nt, Homo sapiens
cagccaaucucucacaaug

SEQ ID NO: 1176664 - RNA, 19 nt, Homo sapiens
gcauucaauugguaacuau

SEQ ID NO: 1176665 - RNA, 19 nt, Homo sapiens
acaauuacggcaugcauua

SEQ ID NO: 1176666 - RNA, 19 nt, Homo sapiens
agucuaaccuucuguguug

SEQ ID NO: 1176667 - RNA, 19 nt, Homo sapiens
gggcaugggacucuugaua

SEQ ID NO: 1176668 - RNA, 19 nt, Homo sapiens
gaagaaaccgagaaagaag

SEQ ID NO: 1176669 - RNA, 19 nt, Homo sapiens
caagagagaggaucacaug

SEQ ID NO: 1176670 - RNA, 19 nt, Homo sapiens
cuaagguguuuacuaguuu

SEQ ID NO: 1176671 - RNA, 19 nt, Homo sapiens
cacaaugcaagaugaauua

SEQ ID NO: 1176672 - RNA, 19 nt, Homo sapiens
gaauaucacuaagcugaca

SEQ ID NO: 1176673 - RNA, 19 nt, Homo sapiens
ucuaagguguuuacuaguu

SEQ ID NO: 1176674 - RNA, 19 nt, Homo sapiens
ugaugagucuguuguaaug

SEQ ID NO: 1176675 - RNA, 19 nt, Homo sapiens
ucaaugagauagugcagau

SEQ ID NO: 1176676 - RNA, 19 nt, Homo sapiens
gcaguuggcaucaauguca

SEQ ID NO: 1176677 - RNA, 19 nt, Homo sapiens
auagauauuuccacucgua

SEQ ID NO: 1176678 - RNA, 19 nt, Homo sapiens
guaugaauccuucuaugaa

SEQ ID NO: 1176679 - RNA, 19 nt, Homo sapiens
gaccagaagcaaauuaaga

SEQ ID NO: 1176680 - RNA, 19 nt, Homo sapiens
caaauuaagaagccagaaa

SEQ ID NO: 1176681 - RNA, 19 nt, Homo sapiens
uaacacuaccguuugauga

SEQ ID NO: 1176682 - RNA, 19 nt, Homo sapiens
gguguuuacuaguuucuga

SEQ ID NO: 1176683 - RNA, 19 nt, Homo sapiens
aauaaacaguggucauuca

SEQ ID NO: 1176684 - RNA, 19 nt, Homo sapiens
gccaaucucucacaaugca

SEQ ID NO: 1176685 - RNA, 19 nt, Homo sapiens
ggcaugggacucuugauaa

SEQ ID NO: 1176686 - RNA, 19 nt, Homo sapiens
caacgacgcucuggacaac

SEQ ID NO: 1176687 - RNA, 19 nt, Homo sapiens
ccagccaacuacaaacuug

SEQ ID NO: 1176688 - RNA, 19 nt, Homo sapiens
gaggaccagaagcaaauua

SEQ ID NO: 1176689 - RNA, 19 nt, Homo sapiens
gugcagauauacacagauc

SEQ ID NO: 1176690 - RNA, 19 nt, Homo sapiens
cuaaaugcauucaauuggu

SEQ ID NO: 1176691 - RNA, 19 nt, Homo sapiens
gauaauuccaaguccauga

SEQ ID NO: 1176692 - RNA, 19 nt, Homo sapiens
agaagaaaccgagaaagaa

SEQ ID NO: 1176693 - RNA, 19 nt, Homo sapiens
cauguuaacacuaccguuu

SEQ ID NO: 1176694 - RNA, 19 nt, Homo sapiens
gaauaaagacaugcacaca

SEQ ID NO: 1176695 - RNA, 19 nt, Homo sapiens
ccagaugugcagaaaguuu

SEQ ID NO: 1176696 - RNA, 19 nt, Homo sapiens
ucacaaugcaagaugaauu

SEQ ID NO: 1176697 - RNA, 19 nt, Homo sapiens
aagaagaaaccuuggacua

SEQ ID NO: 1176698 - RNA, 19 nt, Homo sapiens
gaauccuucuaugaaagua

SEQ ID NO: 1176699 - RNA, 19 nt, Homo sapiens
ggaagacagggaagaggaa

SEQ ID NO: 1176700 - RNA, 19 nt, Homo sapiens
cagcacuuguuuuguauua

SEQ ID NO: 1176701 - RNA, 19 nt, Homo sapiens
agaagaaaccuuggacuau

SEQ ID NO: 1176702 - RNA, 19 nt, Homo sapiens
gaaaguacuuccccugagu

SEQ ID NO: 1176703 - RNA, 19 nt, Homo sapiens
gauauacacagaucuagag

SEQ ID NO: 1176704 - RNA, 19 nt, Homo sapiens
cguaugaauccuucuauga

SEQ ID NO: 1176705 - RNA, 19 nt, Homo sapiens
gcguaugaauccuucuaug

SEQ ID NO: 1176706 - RNA, 19 nt, Homo sapiens
gcgaggaccagaagcaaau

SEQ ID NO: 1176707 - RNA, 19 nt, Homo sapiens
gagaaugcgaggaccagaa

SEQ ID NO: 1176708 - RNA, 19 nt, Homo sapiens
aacuauuccucuucaagua

SEQ ID NO: 1176709 - RNA, 19 nt, Homo sapiens
cuugugggcugaguaauug

SEQ ID NO: 1176710 - RNA, 19 nt, Homo sapiens
gcuugugggcugaguaauu

SEQ ID NO: 1176711 - RNA, 19 nt, Homo sapiens
caccuccccugucuaauua

SEQ ID NO: 1176712 - RNA, 19 nt, Homo sapiens
uagcugaugucauaauucg

SEQ ID NO: 1176713 - RNA, 19 nt, Homo sapiens
cuauuccucuucaaguauu

SEQ ID NO: 1176714 - RNA, 19 nt, Homo sapiens
uaacuauuccucuucaagu

SEQ ID NO: 1176715 - RNA, 19 nt, Homo sapiens
uggcacaacucuaucuaag

SEQ ID NO: 1176716 - RNA, 19 nt, Homo sapiens
auacacagaucuagagacu

SEQ ID NO: 1176717 - RNA, 19 nt, Homo sapiens
gcucuggacaacuuaagaa

SEQ ID NO: 1176718 - RNA, 19 nt, Homo sapiens
acaaagcugcgauuggaaa

SEQ ID NO: 1176719 - RNA, 19 nt, Homo sapiens
agagaucaaugagauagug

SEQ ID NO: 1176720 - RNA, 19 nt, Homo sapiens
gacccaaaaugaaaacuga

SEQ ID NO: 1176721 - RNA, 19 nt, Homo sapiens
caaggucacccuacucuac

SEQ ID NO: 1176722 - RNA, 19 nt, Homo sapiens
gagaccagaucugcucaca

SEQ ID NO: 1176723 - RNA, 19 nt, Homo sapiens
gauuggaaagggucaaguu

SEQ ID NO: 1176724 - RNA, 19 nt, Homo sapiens
caaacagauuguccuucga

SEQ ID NO: 1176725 - RNA, 19 nt, Homo sapiens
ucacaaagaucuccgaaga

SEQ ID NO: 1176726 - RNA, 19 nt, Homo sapiens
ggaagcauuugaaguuaaa

SEQ ID NO: 1176727 - RNA, 19 nt, Homo sapiens
gaggaagcauuugaaguua

SEQ ID NO: 1176728 - RNA, 19 nt, Homo sapiens
ccacgaaggcggucuguua

SEQ ID NO: 1176729 - RNA, 19 nt, Homo sapiens
ucagugagcagguaauuua

SEQ ID NO: 1176730 - RNA, 19 nt, Homo sapiens
gcaaugaugcugucccuuu

SEQ ID NO: 1176731 - RNA, 19 nt, Homo sapiens
ccacaucgcugcucaagag

SEQ ID NO: 1176732 - RNA, 19 nt, Homo sapiens
gcaaacgcuucgaauguga

SEQ ID NO: 1176733 - RNA, 19 nt, Homo sapiens
agagagagaucacucaaau

SEQ ID NO: 1176734 - RNA, 19 nt, Homo sapiens
cuacauuccugaagacauu

SEQ ID NO: 1176735 - RNA, 19 nt, Homo sapiens
gcagguggccguccaaaga

SEQ ID NO: 1176736 - RNA, 19 nt, Homo sapiens
ggccagauguucagcacua

SEQ ID NO: 1176737 - RNA, 19 nt, Homo sapiens
gaaccaggcauaugcaaug

SEQ ID NO: 1176738 - RNA, 19 nt, Homo sapiens
cgaggugccugucuucuau

SEQ ID NO: 1176739 - RNA, 19 nt, Homo sapiens
gcagcuggcucaaguacau

SEQ ID NO: 1176740 - RNA, 19 nt, Homo sapiens
gcaagaaccacgucuaugg

SEQ ID NO: 1176741 - RNA, 19 nt, Homo sapiens
gaaguuaaagaugugcuua

SEQ ID NO: 1176742 - RNA, 19 nt, Homo sapiens
caggaaggcugcaucacaa

SEQ ID NO: 1176743 - RNA, 19 nt, Homo sapiens
agagagaucacucaaauga

SEQ ID NO: 1176744 - RNA, 19 nt, Homo sapiens
guacaaaugcgaccagugu

SEQ ID NO: 1176745 - RNA, 19 nt, Homo sapiens
ugaggaagcauuugaaguu

SEQ ID NO: 1176746 - RNA, 19 nt, Homo sapiens
gaccagaaccucaccaugu

SEQ ID NO: 1176747 - RNA, 19 nt, Homo sapiens
ggacaaccacgcacuuuua

SEQ ID NO: 1176748 - RNA, 19 nt, Homo sapiens
acggugacguuguaaauaa

SEQ ID NO: 1176749 - RNA, 19 nt, Homo sapiens
ggaagggaauggauagacu

SEQ ID NO: 1176750 - RNA, 19 nt, Homo sapiens
ccgaagaccugggcaguga

SEQ ID NO: 1176751 - RNA, 19 nt, Homo sapiens
ucggaaaucagaaacuuua

SEQ ID NO: 1176752 - RNA, 19 nt, Homo sapiens
ggacagcgacccugacaag

SEQ ID NO: 1176753 - RNA, 19 nt, Homo sapiens
caaggacuguggccagaug

SEQ ID NO: 1176754 - RNA, 19 nt, Homo sapiens
ccaggcauaugcaaugaug

SEQ ID NO: 1176755 - RNA, 19 nt, Homo sapiens
ggaagggcaaggagcgaua

SEQ ID NO: 1176756 - RNA, 19 nt, Homo sapiens
ggacggcagugacuuugag

SEQ ID NO: 1176757 - RNA, 19 nt, Homo sapiens
gaaggcugcaucacaaaga

SEQ ID NO: 1176758 - RNA, 19 nt, Homo sapiens
caaugaugcugucccuuuc

SEQ ID NO: 1176759 - RNA, 19 nt, Homo sapiens
ccauagagaccaugacaga

SEQ ID NO: 1176760 - RNA, 19 nt, Homo sapiens
ucaagcagcacaagcauau

SEQ ID NO: 1176761 - RNA, 19 nt, Homo sapiens
ggcaaacgcuucgaaugug

SEQ ID NO: 1176762 - RNA, 19 nt, Homo sapiens
cagccaaucucaccagaca

SEQ ID NO: 1176763 - RNA, 19 nt, Homo sapiens
gcgagggcaagaaccauua

SEQ ID NO: 1176764 - RNA, 19 nt, Homo sapiens
ucagaucagugagcaggua

SEQ ID NO: 1176765 - RNA, 19 nt, Homo sapiens
gucggagucuggagcauuu

SEQ ID NO: 1176766 - RNA, 19 nt, Homo sapiens
ccaaggccuucaacuggaa

SEQ ID NO: 1176767 - RNA, 19 nt, Homo sapiens
gguggacgcucugcugaga

SEQ ID NO: 1176768 - RNA, 19 nt, Homo sapiens
uagagaccaugacagagaa

SEQ ID NO: 1176769 - RNA, 19 nt, Homo sapiens
caugguucauuccgacuuu

SEQ ID NO: 1176770 - RNA, 19 nt, Homo sapiens
ggauuggucuugagaacac

SEQ ID NO: 1176771 - RNA, 19 nt, Homo sapiens
aggaagcauuugaaguuaa

SEQ ID NO: 1176772 - RNA, 19 nt, Homo sapiens
ccgcagagcagcugaggaa

SEQ ID NO: 1176773 - RNA, 19 nt, Homo sapiens
guccaggccuagccaguga

SEQ ID NO: 1176774 - RNA, 19 nt, Homo sapiens
gaucagugagcagguaauu

SEQ ID NO: 1176775 - RNA, 19 nt, Homo sapiens
ggugacguuguaaauaaua

SEQ ID NO: 1176776 - RNA, 19 nt, Homo sapiens
gacggugacguuguaaaua

SEQ ID NO: 1176777 - RNA, 19 nt, Homo sapiens
ucaaggaggaggagagaga

SEQ ID NO: 1176778 - RNA, 19 nt, Homo sapiens
gcuaagaaccaggcauaug

SEQ ID NO: 1176779 - RNA, 19 nt, Homo sapiens
gagcagcugaggaagcauu

SEQ ID NO: 1176780 - RNA, 19 nt, Homo sapiens
cagagcagcugaggaagca

SEQ ID NO: 1176781 - RNA, 19 nt, Homo sapiens
caucaacgcgaacagagaa

SEQ ID NO: 1176782 - RNA, 19 nt, Homo sapiens
acagcacggugaagccuuu

SEQ ID NO: 1176783 - RNA, 19 nt, Homo sapiens
uggagccgaugccgacuuu

SEQ ID NO: 1176784 - RNA, 19 nt, Homo sapiens
ugggagcccugaaggagaa

SEQ ID NO: 1176785 - RNA, 19 nt, Homo sapiens
ucgcauccauugccgagaa

SEQ ID NO: 1176786 - RNA, 19 nt, Homo sapiens
cggcaaacgcuucgaaugu

SEQ ID NO: 1176787 - RNA, 19 nt, Homo sapiens
gaggagcgcgaguacaaau

SEQ ID NO: 1176788 - RNA, 19 nt, Homo sapiens
gaagaccugggcagugaga

SEQ ID NO: 1176789 - RNA, 19 nt, Homo sapiens
gugcuuaauuccaccuuag

SEQ ID NO: 1176790 - RNA, 19 nt, Homo sapiens
aggagaagccuuucaagug

SEQ ID NO: 1176791 - RNA, 19 nt, Homo sapiens
cuuagauucugaggcuuua

SEQ ID NO: 1176792 - RNA, 19 nt, Homo sapiens
gcauuugaaguuaaagaug

SEQ ID NO: 1176793 - RNA, 19 nt, Homo sapiens
ccuuugaucucaccaccaa

SEQ ID NO: 1176794 - RNA, 19 nt, Homo sapiens
aagugacggugacguugua

SEQ ID NO: 1176795 - RNA, 19 nt, Homo sapiens
cagcugaggaagcauuuga

SEQ ID NO: 1176796 - RNA, 19 nt, Homo sapiens
ccaggaaggcugcaucaca

SEQ ID NO: 1176797 - RNA, 19 nt, Homo sapiens
aagaauaacccuuuuggua

SEQ ID NO: 1176798 - RNA, 19 nt, Homo sapiens
aaggcggucuguuagcuuu

SEQ ID NO: 1176799 - RNA, 19 nt, Homo sapiens
ggaacauccacaacaagga

SEQ ID NO: 1176800 - RNA, 19 nt, Homo sapiens
gggcuucaacgaguacuuu

SEQ ID NO: 1176801 - RNA, 19 nt, Homo sapiens
gaauaacccuuuugguaac

SEQ ID NO: 1176802 - RNA, 19 nt, Homo sapiens
agaauaacccuuuugguaa

SEQ ID NO: 1176803 - RNA, 19 nt, Homo sapiens
ugacaagaauaacccuuuu

SEQ ID NO: 1176804 - RNA, 19 nt, Homo sapiens
gagagagaucacucaaaug

SEQ ID NO: 1176805 - RNA, 19 nt, Homo sapiens
aaacucagaucccaaaagu

SEQ ID NO: 1176806 - RNA, 19 nt, Homo sapiens
gcaggcaggcuaagaacca

SEQ ID NO: 1176807 - RNA, 19 nt, Homo sapiens
ggaugggagcaaauacuga

SEQ ID NO: 1176808 - RNA, 19 nt, Homo sapiens
gaaggcggucuguuagcuu

SEQ ID NO: 1176809 - RNA, 19 nt, Homo sapiens
gcaucaacgcgaacagaga

SEQ ID NO: 1176810 - RNA, 19 nt, Homo sapiens
ucucggaaaucagaaacuu

SEQ ID NO: 1176811 - RNA, 19 nt, Homo sapiens
cacgagaacgcaccaguga

SEQ ID NO: 1176812 - RNA, 19 nt, Homo sapiens
ugacggugacguuguaaau

SEQ ID NO: 1176813 - RNA, 19 nt, Homo sapiens
cggaggagcgcgaguacaa

SEQ ID NO: 1176814 - RNA, 19 nt, Homo sapiens
cgaggaagcuagccaaaag

SEQ ID NO: 1176815 - RNA, 19 nt, Homo sapiens
ggaggagcgcgaguacaaa

SEQ ID NO: 1176816 - RNA, 19 nt, Homo sapiens
gggcggacaugcagaucgu

SEQ ID NO: 1176817 - RNA, 19 nt, Homo sapiens
ggacugcgagcggauguuc

SEQ ID NO: 1176818 - RNA, 19 nt, Homo sapiens
uaaagcagucguagagucu

SEQ ID NO: 1176819 - RNA, 19 nt, Homo sapiens
ggaaggcugcaucacaaag

SEQ ID NO: 1176820 - RNA, 19 nt, Homo sapiens
auagagaccaugacagaga

SEQ ID NO: 1176821 - RNA, 19 nt, Homo sapiens
ggucaaggccgagccaaag

SEQ ID NO: 1176822 - RNA, 19 nt, Homo sapiens
ucaaggccaucgcauccau

SEQ ID NO: 1176823 - RNA, 19 nt, Homo sapiens
ggacuguggccagauguuc

SEQ ID NO: 1176824 - RNA, 19 nt, Homo sapiens
ccaugugucagaucaguga

SEQ ID NO: 1176825 - RNA, 19 nt, Homo sapiens
gcacauagaaguuaaagua

SEQ ID NO: 1176826 - RNA, 19 nt, Homo sapiens
gcacagauguauucauaaa

SEQ ID NO: 1176827 - RNA, 19 nt, Homo sapiens
gugcacagauguauucaua

SEQ ID NO: 1176828 - RNA, 19 nt, Homo sapiens
gacauuagauccagccauu

SEQ ID NO: 1176829 - RNA, 19 nt, Homo sapiens
uaacguguauucucuuuga

SEQ ID NO: 1176830 - RNA, 19 nt, Homo sapiens
ggaguggagucgguucuua

SEQ ID NO: 1176831 - RNA, 19 nt, Homo sapiens
agaaguacgugaccgagua

SEQ ID NO: 1176832 - RNA, 19 nt, Homo sapiens
gaaagcagaagccagaaga

SEQ ID NO: 1176833 - RNA, 19 nt, Homo sapiens
guuguaugaugacgaauaa

SEQ ID NO: 1176834 - RNA, 19 nt, Homo sapiens
ugaaaggcauuaagacugu

SEQ ID NO: 1176835 - RNA, 19 nt, Homo sapiens
ugacuuagcuuugcagagu

SEQ ID NO: 1176836 - RNA, 19 nt, Homo sapiens
ggagauguuggcuguauuu

SEQ ID NO: 1176837 - RNA, 19 nt, Homo sapiens
caagcgaagucacaagaga

SEQ ID NO: 1176838 - RNA, 19 nt, Homo sapiens
ggagucgguucuuauacaa

SEQ ID NO: 1176839 - RNA, 19 nt, Homo sapiens
ugagagagaagcaggauuu

SEQ ID NO: 1176840 - RNA, 19 nt, Homo sapiens
cagcggcucugccauguug

SEQ ID NO: 1176841 - RNA, 19 nt, Homo sapiens
cgagaccaauuccgcagua

SEQ ID NO: 1176842 - RNA, 19 nt, Homo sapiens
gcgagcacauagaaguuaa

SEQ ID NO: 1176843 - RNA, 19 nt, Homo sapiens
cgacucaguuuaccaaucu

SEQ ID NO: 1176844 - RNA, 19 nt, Homo sapiens
gagagaagcaggauuuuaa

SEQ ID NO: 1176845 - RNA, 19 nt, Homo sapiens
aaacuucaauuccaaaggu

SEQ ID NO: 1176846 - RNA, 19 nt, Homo sapiens
aaaguaacguguauucucu

SEQ ID NO: 1176847 - RNA, 19 nt, Homo sapiens
gaacugcagagggauguuu

SEQ ID NO: 1176848 - RNA, 19 nt, Homo sapiens
gcagauguacagcuacuga

SEQ ID NO: 1176849 - RNA, 19 nt, Homo sapiens
gcucauggcuuccccacua

SEQ ID NO: 1176850 - RNA, 19 nt, Homo sapiens
cuucacagcugcccagaug

SEQ ID NO: 1176851 - RNA, 19 nt, Homo sapiens
gagcucgguuccuaugaga

SEQ ID NO: 1176852 - RNA, 19 nt, Homo sapiens
ggaaagugaagcugagaga

SEQ ID NO: 1176853 - RNA, 19 nt, Homo sapiens
gaaucgauuuccaauagag

SEQ ID NO: 1176854 - RNA, 19 nt, Homo sapiens
ucuccucacuucuggauuu

SEQ ID NO: 1176855 - RNA, 19 nt, Homo sapiens
ucucugcaauccaaaugua

SEQ ID NO: 1176856 - RNA, 19 nt, Homo sapiens
agagggauguuugggauuu

SEQ ID NO: 1176857 - RNA, 19 nt, Homo sapiens
ggaguucacaggcagugua

SEQ ID NO: 1176858 - RNA, 19 nt, Homo sapiens
cagcgaauacucagagaaa

SEQ ID NO: 1176859 - RNA, 19 nt, Homo sapiens
agacuguuauggccaauau

SEQ ID NO: 1176860 - RNA, 19 nt, Homo sapiens
ccgaguacaugcugcagaa

SEQ ID NO: 1176861 - RNA, 19 nt, Homo sapiens
gaaaggcauuaagacuguu

SEQ ID NO: 1176862 - RNA, 19 nt, Homo sapiens
gaaggcagaccuccuguac

SEQ ID NO: 1176863 - RNA, 19 nt, Homo sapiens
ccaaaggugcacagaugua

SEQ ID NO: 1176864 - RNA, 19 nt, Homo sapiens
cauaaaggaagacauuaga

SEQ ID NO: 1176865 - RNA, 19 nt, Homo sapiens
ggauuaagauuuucaugug

SEQ ID NO: 1176866 - RNA, 19 nt, Homo sapiens
uagauguguuugcuggaua

SEQ ID NO: 1176867 - RNA, 19 nt, Homo sapiens
gcucugccauguugcacaa

SEQ ID NO: 1176868 - RNA, 19 nt, Homo sapiens
gauguuggcuguauuuccu

SEQ ID NO: 1176869 - RNA, 19 nt, Homo sapiens
aaagucaugugcacuguag

SEQ ID NO: 1176870 - RNA, 19 nt, Homo sapiens
augaaucgauuuccaauag

SEQ ID NO: 1176871 - RNA, 19 nt, Homo sapiens
agaggcaggagauaaguua

SEQ ID NO: 1176872 - RNA, 19 nt, Homo sapiens
ucugucagcuuaacucuag

SEQ ID NO: 1176873 - RNA, 19 nt, Homo sapiens
gcgaauacucagagaaaga

SEQ ID NO: 1176874 - RNA, 19 nt, Homo sapiens
cagguuguaugaugacgaa

SEQ ID NO: 1176875 - RNA, 19 nt, Homo sapiens
acagauguauucauaaagg

SEQ ID NO: 1176876 - RNA, 19 nt, Homo sapiens
ucaaaaggcaucuuaguaa

SEQ ID NO: 1176877 - RNA, 19 nt, Homo sapiens
ggucaucacggucaucaug

SEQ ID NO: 1176878 - RNA, 19 nt, Homo sapiens
ggaaggcagaccuccugua

SEQ ID NO: 1176879 - RNA, 19 nt, Homo sapiens
uaaaggaagacauuagauc

SEQ ID NO: 1176880 - RNA, 19 nt, Homo sapiens
gcaggcagcagggaacauu

SEQ ID NO: 1176881 - RNA, 19 nt, Homo sapiens
gagaacacagacaguauuc

SEQ ID NO: 1176882 - RNA, 19 nt, Homo sapiens
cgacacaggguucgggaaa

SEQ ID NO: 1176883 - RNA, 19 nt, Homo sapiens
gaaagagacggaguucaca

SEQ ID NO: 1176884 - RNA, 19 nt, Homo sapiens
caucgacgccuccuccauu

SEQ ID NO: 1176885 - RNA, 19 nt, Homo sapiens
gguuguaugaugacgaaua

SEQ ID NO: 1176886 - RNA, 19 nt, Homo sapiens
acacggggauuaagauuuu

SEQ ID NO: 1176887 - RNA, 19 nt, Homo sapiens
gccagaaucccgaguggaa

SEQ ID NO: 1176888 - RNA, 19 nt, Homo sapiens
caaaaggcaucuuaguaau

SEQ ID NO: 1176889 - RNA, 19 nt, Homo sapiens
ucagucggcuugaccaaca

SEQ ID NO: 1176890 - RNA, 19 nt, Homo sapiens
ugaaucgauuuccaauaga

SEQ ID NO: 1176891 - RNA, 19 nt, Homo sapiens
auacaacuaugggcugaaa

SEQ ID NO: 1176892 - RNA, 19 nt, Homo sapiens
uaaaguaacguguauucuc

SEQ ID NO: 1176893 - RNA, 19 nt, Homo sapiens
gaacacagacaguauucac

SEQ ID NO: 1176894 - RNA, 19 nt, Homo sapiens
gauguuugggauuuguuua

SEQ ID NO: 1176895 - RNA, 19 nt, Homo sapiens
caagcgagcacauagaagu

SEQ ID NO: 1176896 - RNA, 19 nt, Homo sapiens
guuauuaggaacacaaaug

SEQ ID NO: 1176897 - RNA, 19 nt, Homo sapiens
aaagugaagcugagagaga

SEQ ID NO: 1176898 - RNA, 19 nt, Homo sapiens
gacuuagcuuugcagagua

SEQ ID NO: 1176899 - RNA, 19 nt, Homo sapiens
uuccaaaggugcacagaug

SEQ ID NO: 1176900 - RNA, 19 nt, Homo sapiens
ugagaacacagacaguauu

SEQ ID NO: 1176901 - RNA, 19 nt, Homo sapiens
caaaggugcacagauguau

SEQ ID NO: 1176902 - RNA, 19 nt, Homo sapiens
gaagcacguucagcucaca

SEQ ID NO: 1176903 - RNA, 19 nt, Homo sapiens
auuacggucugucagcuua

SEQ ID NO: 1176904 - RNA, 19 nt, Homo sapiens
ggauuuguuuagauguguu

SEQ ID NO: 1176905 - RNA, 19 nt, Homo sapiens
gcgacucaguuuaccaauc

SEQ ID NO: 1176906 - RNA, 19 nt, Homo sapiens
uguauuuccugucacauca

SEQ ID NO: 1176907 - RNA, 19 nt, Homo sapiens
cagauguauucauaaagga

SEQ ID NO: 1176908 - RNA, 19 nt, Homo sapiens
aguaacguguauucucuuu

SEQ ID NO: 1176909 - RNA, 19 nt, Homo sapiens
uaugagaacacagacagua

SEQ ID NO: 1176910 - RNA, 19 nt, Homo sapiens
aagugaagcugagagagaa

SEQ ID NO: 1176911 - RNA, 19 nt, Homo sapiens
uggagucgguucuuauaca

SEQ ID NO: 1176912 - RNA, 19 nt, Homo sapiens
uguauucucuuugaacuag

SEQ ID NO: 1176913 - RNA, 19 nt, Homo sapiens
uggccaauauuguguuuua

SEQ ID NO: 1176914 - RNA, 19 nt, Homo sapiens
uauggccaauauuguguuu

SEQ ID NO: 1176915 - RNA, 19 nt, Homo sapiens
ggauguuugggauuuguuu

SEQ ID NO: 1176916 - RNA, 19 nt, Homo sapiens
gagggauguuugggauuug

SEQ ID NO: 1176917 - RNA, 19 nt, Homo sapiens
ccucuaucguucccauuug

SEQ ID NO: 1176918 - RNA, 19 nt, Homo sapiens
caugaaucgauuuccaaua

SEQ ID NO: 1176919 - RNA, 19 nt, Homo sapiens
uaaagucaugugcacugua

SEQ ID NO: 1176920 - RNA, 19 nt, Homo sapiens
ucacggucaucaugugcaa

SEQ ID NO: 1176921 - RNA, 19 nt, Homo sapiens
acagagcauucagcaggua

SEQ ID NO: 1176922 - RNA, 19 nt, Homo sapiens
uuaagacuguuuggagaug

SEQ ID NO: 1176923 - RNA, 19 nt, Homo sapiens
guaauauccaugaaucgau

SEQ ID NO: 1176924 - RNA, 19 nt, Homo sapiens
gaguggagucgguucuuau

SEQ ID NO: 1176925 - RNA, 19 nt, Homo sapiens
gcaaagagauccaucagaa

SEQ ID NO: 1176926 - RNA, 19 nt, Homo sapiens
gagauaagcaccucaagua

SEQ ID NO: 1176927 - RNA, 19 nt, Homo sapiens
uaugagagcugcaaagaga

SEQ ID NO: 1176928 - RNA, 19 nt, Homo sapiens
ggaacuggauguccuaugu

SEQ ID NO: 1176929 - RNA, 19 nt, Homo sapiens
gcagaaggcuacagaugug

SEQ ID NO: 1176930 - RNA, 19 nt, Homo sapiens
ggacaagggcgauaggaaa

SEQ ID NO: 1176931 - RNA, 19 nt, Homo sapiens
ugaaagaugugggaaggua

SEQ ID NO: 1176932 - RNA, 19 nt, Homo sapiens
gaaauccugucucuaccaa

SEQ ID NO: 1176933 - RNA, 19 nt, Homo sapiens
cuacagaugugaaagaugu

SEQ ID NO: 1176934 - RNA, 19 nt, Homo sapiens
gauaaagacucccuucaac

SEQ ID NO: 1176935 - RNA, 19 nt, Homo sapiens
caagggcgauaggaaauuu

SEQ ID NO: 1176936 - RNA, 19 nt, Homo sapiens
ccagugaagugaagaccua

SEQ ID NO: 1176937 - RNA, 19 nt, Homo sapiens
ucacaaguguucuacaugu

SEQ ID NO: 1176938 - RNA, 19 nt, Homo sapiens
gcaccggccucacaagugu

SEQ ID NO: 1176939 - RNA, 19 nt, Homo sapiens
guucacagccuccagcaua

SEQ ID NO: 1176940 - RNA, 19 nt, Homo sapiens
agacugcuaugagaaauuu

SEQ ID NO: 1176941 - RNA, 19 nt, Homo sapiens
ggauaaagacucccuucaa

SEQ ID NO: 1176942 - RNA, 19 nt, Homo sapiens
caaguacugugguaaaucu

SEQ ID NO: 1176943 - RNA, 19 nt, Homo sapiens
gaaguuucaugaagacuac

SEQ ID NO: 1176944 - RNA, 19 nt, Homo sapiens
uaaagacucccuucaacuu

SEQ ID NO: 1176945 - RNA, 19 nt, Homo sapiens
gaucugggccaccaaauca

SEQ ID NO: 1176946 - RNA, 19 nt, Homo sapiens
ggaccugacacuuuaauuc

SEQ ID NO: 1176947 - RNA, 19 nt, Homo sapiens
gacgauggcugcucaugca

SEQ ID NO: 1176948 - RNA, 19 nt, Homo sapiens
ucuacgaucugcccuggua

SEQ ID NO: 1176949 - RNA, 19 nt, Homo sapiens
gguguguucugcaguaguu

SEQ ID NO: 1176950 - RNA, 19 nt, Homo sapiens
gaagaucugggccaccaaa

SEQ ID NO: 1176951 - RNA, 19 nt, Homo sapiens
gauaagcaccucaaguaca

SEQ ID NO: 1176952 - RNA, 19 nt, Homo sapiens
cucaaacucuggauaaaga

SEQ ID NO: 1176953 - RNA, 19 nt, Homo sapiens
ggagacaauucugugaugu

SEQ ID NO: 1176954 - RNA, 19 nt, Homo sapiens
uauggagacugcuaugaga

SEQ ID NO: 1176955 - RNA, 19 nt, Homo sapiens
gaagaccuacggagacaau

SEQ ID NO: 1176956 - RNA, 19 nt, Homo sapiens
gagaguggcccguguugug

SEQ ID NO: 1176957 - RNA, 19 nt, Homo sapiens
ggugaaauccugucucuac

SEQ ID NO: 1176958 - RNA, 19 nt, Homo sapiens
agacagcucuggaucugau

SEQ ID NO: 1176959 - RNA, 19 nt, Homo sapiens
ugcggaugcuucucuguua

SEQ ID NO: 1176960 - RNA, 19 nt, Homo sapiens
gagaagcaccggccucaca

SEQ ID NO: 1176961 - RNA, 19 nt, Homo sapiens
ggagacugcuaugagaaau

SEQ ID NO: 1176962 - RNA, 19 nt, Homo sapiens
caaugacucacgccuguaa

SEQ ID NO: 1176963 - RNA, 19 nt, Homo sapiens
gauguccuaugucaacugu

SEQ ID NO: 1176964 - RNA, 19 nt, Homo sapiens
uuguggaccugacacuuua

SEQ ID NO: 1176965 - RNA, 19 nt, Homo sapiens
gaccauaccagugugugua

SEQ ID NO: 1176966 - RNA, 19 nt, Homo sapiens
gaaggcuacagaugugaaa

SEQ ID NO: 1176967 - RNA, 19 nt, Homo sapiens
caucugggcccucugaaga

SEQ ID NO: 1176968 - RNA, 19 nt, Homo sapiens
gaccugcacuucguucugu

SEQ ID NO: 1176969 - RNA, 19 nt, Homo sapiens
agacagaccauaccagugu

SEQ ID NO: 1176970 - RNA, 19 nt, Homo sapiens
ggucauuugagccacuuua

SEQ ID NO: 1176971 - RNA, 19 nt, Homo sapiens
aaaugcaaguacuguggua

SEQ ID NO: 1176972 - RNA, 19 nt, Homo sapiens
gaaagaugugggaagguau

SEQ ID NO: 1176973 - RNA, 19 nt, Homo sapiens
cuuugaagauggucauuug

SEQ ID NO: 1176974 - RNA, 19 nt, Homo sapiens
cgagguggcgggaugguuu

SEQ ID NO: 1176975 - RNA, 19 nt, Homo sapiens
guuguggaccugacacuuu

SEQ ID NO: 1176976 - RNA, 19 nt, Homo sapiens
gucagaggauggucccaaa

SEQ ID NO: 1176977 - RNA, 19 nt, Homo sapiens
ccucacaaguguucuacau

SEQ ID NO: 1176978 - RNA, 19 nt, Homo sapiens
aaauuucccuguucucucu

SEQ ID NO: 1176979 - RNA, 19 nt, Homo sapiens
gacaagggcgauaggaaau

SEQ ID NO: 1176980 - RNA, 19 nt, Homo sapiens
ccaaggagcagaaccuagu

SEQ ID NO: 1176981 - RNA, 19 nt, Homo sapiens
cauuugagccacuuuauag

SEQ ID NO: 1176982 - RNA, 19 nt, Homo sapiens
cggagacaauucugugaug

SEQ ID NO: 1176983 - RNA, 19 nt, Homo sapiens
uuggugaagucccacauuu

SEQ ID NO: 1176984 - RNA, 19 nt, Homo sapiens
ucucagaucaagaaacauu

SEQ ID NO: 1176985 - RNA, 19 nt, Homo sapiens
ucauuugagccacuuuaua

SEQ ID NO: 1176986 - RNA, 19 nt, Homo sapiens
ggucaaugccagugaagug

SEQ ID NO: 1176987 - RNA, 19 nt, Homo sapiens
gggagccucucuacgaucu

SEQ ID NO: 1176988 - RNA, 19 nt, Homo sapiens
gugaagaccuacggagaca

SEQ ID NO: 1176989 - RNA, 19 nt, Homo sapiens
uauggacacuacagaaaca

SEQ ID NO: 1176990 - RNA, 19 nt, Homo sapiens
caguguguguauuguacua

SEQ ID NO: 1176991 - RNA, 19 nt, Homo sapiens
gucaagggcauauauuuua

SEQ ID NO: 1176992 - RNA, 19 nt, Homo sapiens
gcaaguacugugguaaauc

SEQ ID NO: 1176993 - RNA, 19 nt, Homo sapiens
aagagcuccuuguguggua

SEQ ID NO: 1176994 - RNA, 19 nt, Homo sapiens
caaacccuccaaccaagaa

SEQ ID NO: 1176995 - RNA, 19 nt, Homo sapiens
guacugugguaaaucuuuu

SEQ ID NO: 1176996 - RNA, 19 nt, Homo sapiens
gagacugcuaugagaaauu

SEQ ID NO: 1176997 - RNA, 19 nt, Homo sapiens
ccuguaaucccagcacuuu

SEQ ID NO: 1176998 - RNA, 19 nt, Homo sapiens
gagcagcagccacgaguac

SEQ ID NO: 1176999 - RNA, 19 nt, Homo sapiens
gugucaagggcauauauuu

SEQ ID NO: 1177000 - RNA, 19 nt, Homo sapiens
cgccaaaggagucagguuu

SEQ ID NO: 1177001 - RNA, 19 nt, Homo sapiens
ccuauggacacuacagaaa

SEQ ID NO: 1177002 - RNA, 19 nt, Homo sapiens
guggguggaucacucaagu

SEQ ID NO: 1177003 - RNA, 19 nt, Homo sapiens
ggaggaggaccugcacuuc

SEQ ID NO: 1177004 - RNA, 19 nt, Homo sapiens
aaagaugugggaagguauu

SEQ ID NO: 1177005 - RNA, 19 nt, Homo sapiens
gaacuggauguccuauguc

SEQ ID NO: 1177006 - RNA, 19 nt, Homo sapiens
gagccacuuuauagaugga

SEQ ID NO: 1177007 - RNA, 19 nt, Homo sapiens
gagacaauucugugaugug

SEQ ID NO: 1177008 - RNA, 19 nt, Homo sapiens
gaugugggagaucuuugaa

SEQ ID NO: 1177009 - RNA, 19 nt, Homo sapiens
aagguaaaguggucaaugc

SEQ ID NO: 1177010 - RNA, 19 nt, Homo sapiens
caagguaaaguggucaaug

SEQ ID NO: 1177011 - RNA, 19 nt, Homo sapiens
aaauguuucucucagucuu

SEQ ID NO: 1177012 - RNA, 19 nt, Homo sapiens
ggcuacagaugugaaagau

SEQ ID NO: 1177013 - RNA, 19 nt, Homo sapiens
uugagccacuuuauagaug

SEQ ID NO: 1177014 - RNA, 19 nt, Homo sapiens
ucucagucuuccagccuaa

SEQ ID NO: 1177015 - RNA, 19 nt, Homo sapiens
gaugugggaagguauuuac

SEQ ID NO: 1177016 - RNA, 19 nt, Homo sapiens
agagauccaucagaaccaa

SEQ ID NO: 1177017 - RNA, 19 nt, Homo sapiens
ccuaguugcugugcagugu

SEQ ID NO: 1177018 - RNA, 19 nt, Homo sapiens
caaugccagugaagugaag

SEQ ID NO: 1177019 - RNA, 19 nt, Homo sapiens
uuugguguguucugcagua

SEQ ID NO: 1177020 - RNA, 19 nt, Homo sapiens
acauucuacucccacauga

SEQ ID NO: 1177021 - RNA, 19 nt, Homo sapiens
guauggagacugcuaugag

SEQ ID NO: 1177022 - RNA, 19 nt, Homo sapiens
gguauggagacugcuauga

SEQ ID NO: 1177023 - RNA, 19 nt, Homo sapiens
gcagugucaagggcauaua

SEQ ID NO: 1177024 - RNA, 19 nt, Homo sapiens
caaggagcagaaccuaguu

SEQ ID NO: 1177025 - RNA, 19 nt, Homo sapiens
ucacagaacugaaagguua

SEQ ID NO: 1177026 - RNA, 19 nt, Homo sapiens
gaauaaggcuuguaguaaa

SEQ ID NO: 1177027 - RNA, 19 nt, Homo sapiens
cgaaauugauuccuuguua

SEQ ID NO: 1177028 - RNA, 19 nt, Homo sapiens
gcacagauauuacgcauuc

SEQ ID NO: 1177029 - RNA, 19 nt, Homo sapiens
gcaaccagcugugauauuu

SEQ ID NO: 1177030 - RNA, 19 nt, Homo sapiens
gagcaugaaucuucuagaa

SEQ ID NO: 1177031 - RNA, 19 nt, Homo sapiens
gcaguaggauuguguaaug

SEQ ID NO: 1177032 - RNA, 19 nt, Homo sapiens
ggagagcaaucguuugaaa

SEQ ID NO: 1177033 - RNA, 19 nt, Homo sapiens
gaaucuggguugaauaauu

SEQ ID NO: 1177034 - RNA, 19 nt, Homo sapiens
gugaauggcagaagaauua

SEQ ID NO: 1177035 - RNA, 19 nt, Homo sapiens
ugaaugagauuauggauca

SEQ ID NO: 1177036 - RNA, 19 nt, Homo sapiens
gcaauuacaucuggcauau

SEQ ID NO: 1177037 - RNA, 19 nt, Homo sapiens
cauauaaaguugugucuga

SEQ ID NO: 1177038 - RNA, 19 nt, Homo sapiens
gaaaguuuguuccuccuau

SEQ ID NO: 1177039 - RNA, 19 nt, Homo sapiens
gaugauagagccaggauuu

SEQ ID NO: 1177040 - RNA, 19 nt, Homo sapiens
gcagaaagacauuaagaga

SEQ ID NO: 1177041 - RNA, 19 nt, Homo sapiens
gaaacauguucauuacaga

SEQ ID NO: 1177042 - RNA, 19 nt, Homo sapiens
caacaaaucggccacaaga

SEQ ID NO: 1177043 - RNA, 19 nt, Homo sapiens
uaacucagcucaugaucga

SEQ ID NO: 1177044 - RNA, 19 nt, Homo sapiens
ucaauuagauggagcaaca

SEQ ID NO: 1177045 - RNA, 19 nt, Homo sapiens
gacaaaguauugcuuagug

SEQ ID NO: 1177046 - RNA, 19 nt, Homo sapiens
caucucugcuucauccuua

SEQ ID NO: 1177047 - RNA, 19 nt, Homo sapiens
ccaaagaugauugaacuua

SEQ ID NO: 1177048 - RNA, 19 nt, Homo sapiens
ccaauccaauacugaauaa

SEQ ID NO: 1177049 - RNA, 19 nt, Homo sapiens
caaagacucucuguuggaa

SEQ ID NO: 1177050 - RNA, 19 nt, Homo sapiens
gaacagaauccuaugaaag

SEQ ID NO: 1177051 - RNA, 19 nt, Homo sapiens
ggaucaaguucgacccaua

SEQ ID NO: 1177052 - RNA, 19 nt, Homo sapiens
ggaagauauugcaggagua

SEQ ID NO: 1177053 - RNA, 19 nt, Homo sapiens
cacaguaccuggagugaaa

SEQ ID NO: 1177054 - RNA, 19 nt, Homo sapiens
cagcuaguauaaugguuua

SEQ ID NO: 1177055 - RNA, 19 nt, Homo sapiens
ggcaggaucucaacaaaca

SEQ ID NO: 1177056 - RNA, 19 nt, Homo sapiens
ggaauauaauugagucauc

SEQ ID NO: 1177057 - RNA, 19 nt, Homo sapiens
aaggugugaucuaguauua

SEQ ID NO: 1177058 - RNA, 19 nt, Homo sapiens
caucagugguaauccauaa

SEQ ID NO: 1177059 - RNA, 19 nt, Homo sapiens
gaacaauuauggguagauc

SEQ ID NO: 1177060 - RNA, 19 nt, Homo sapiens
gagugaaacugcuuguguu

SEQ ID NO: 1177061 - RNA, 19 nt, Homo sapiens
gggagcgugugauauuuaa

SEQ ID NO: 1177062 - RNA, 19 nt, Homo sapiens
ugacauugcuaccauaaca

SEQ ID NO: 1177063 - RNA, 19 nt, Homo sapiens
gaagaaauugaacagauug

SEQ ID NO: 1177064 - RNA, 19 nt, Homo sapiens
uaucuucacuuuccauguu

SEQ ID NO: 1177065 - RNA, 19 nt, Homo sapiens
gggacacacuauuaauauu

SEQ ID NO: 1177066 - RNA, 19 nt, Homo sapiens
gccaauuuguuaccucuuu

SEQ ID NO: 1177067 - RNA, 19 nt, Homo sapiens
agacaucuuuacugguuua

SEQ ID NO: 1177068 - RNA, 19 nt, Homo sapiens
ccaguaaauugggaagaua

SEQ ID NO: 1177069 - RNA, 19 nt, Homo sapiens
ugaauaaggcuuguaguaa

SEQ ID NO: 1177070 - RNA, 19 nt, Homo sapiens
ucaaggcaucucuguauua

SEQ ID NO: 1177071 - RNA, 19 nt, Homo sapiens
gauggccacauaauucuua

SEQ ID NO: 1177072 - RNA, 19 nt, Homo sapiens
uguaauguauucucucuug

SEQ ID NO: 1177073 - RNA, 19 nt, Homo sapiens
gaaaagugagcucaaauuu

SEQ ID NO: 1177074 - RNA, 19 nt, Homo sapiens
gaccuaguguuucuccaaa

SEQ ID NO: 1177075 - RNA, 19 nt, Homo sapiens
ggaaccugcucuugcauca

SEQ ID NO: 1177076 - RNA, 19 nt, Homo sapiens
gcgggacacacuauuaaua

SEQ ID NO: 1177077 - RNA, 19 nt, Homo sapiens
gcaacauucuuuagcaucu

SEQ ID NO: 1177078 - RNA, 19 nt, Homo sapiens
uaucuaaccagucuuguuu

SEQ ID NO: 1177079 - RNA, 19 nt, Homo sapiens
gauauuacgcauucaguau

SEQ ID NO: 1177080 - RNA, 19 nt, Homo sapiens
uaaggaggccacugucuuu

SEQ ID NO: 1177081 - RNA, 19 nt, Homo sapiens
auaauugagucaucuggua

SEQ ID NO: 1177082 - RNA, 19 nt, Homo sapiens
auggauggauggaauauaa

SEQ ID NO: 1177083 - RNA, 19 nt, Homo sapiens
guaggauuguguaauguau

SEQ ID NO: 1177084 - RNA, 19 nt, Homo sapiens
gauuuaagaucucaaagcu

SEQ ID NO: 1177085 - RNA, 19 nt, Homo sapiens
acaaaucggccacaagaaa

SEQ ID NO: 1177086 - RNA, 19 nt, Homo sapiens
gagcaacaacaucuucuga

SEQ ID NO: 1177087 - RNA, 19 nt, Homo sapiens
ggaguagaauuugcuaaag

SEQ ID NO: 1177088 - RNA, 19 nt, Homo sapiens
gcaucagggucuucauaug

SEQ ID NO: 1177089 - RNA, 19 nt, Homo sapiens
ggagugaaacugcuugugu

SEQ ID NO: 1177090 - RNA, 19 nt, Homo sapiens
gcucuuaacucccguuuug

SEQ ID NO: 1177091 - RNA, 19 nt, Homo sapiens
aaugucagcuaguauaaug

SEQ ID NO: 1177092 - RNA, 19 nt, Homo sapiens
gcagacaugacacagcuuu

SEQ ID NO: 1177093 - RNA, 19 nt, Homo sapiens
aaaguuuguuccuccuaua

SEQ ID NO: 1177094 - RNA, 19 nt, Homo sapiens
ggacuuaauguguucuuau

SEQ ID NO: 1177095 - RNA, 19 nt, Homo sapiens
ggaggccacugucuuugau

SEQ ID NO: 1177096 - RNA, 19 nt, Homo sapiens
gacgcuagguuguuuaucu

SEQ ID NO: 1177097 - RNA, 19 nt, Homo sapiens
acuauuauccuaccacuuu

SEQ ID NO: 1177098 - RNA, 19 nt, Homo sapiens
gaacaaagugagaaugaac

SEQ ID NO: 1177099 - RNA, 19 nt, Homo sapiens
gaaauugaacagauuguac

SEQ ID NO: 1177100 - RNA, 19 nt, Homo sapiens
cagcugugauauuuauuga

SEQ ID NO: 1177101 - RNA, 19 nt, Homo sapiens
agaacagaauccuaugaaa

SEQ ID NO: 1177102 - RNA, 19 nt, Homo sapiens
gaccgaaggcagaugcaua

SEQ ID NO: 1177103 - RNA, 19 nt, Homo sapiens
cauagauucuuccagaugu

SEQ ID NO: 1177104 - RNA, 19 nt, Homo sapiens
gaaucaaggcaucucugua

SEQ ID NO: 1177105 - RNA, 19 nt, Homo sapiens
acccauagcuuacauugau

SEQ ID NO: 1177106 - RNA, 19 nt, Homo sapiens
ucacagcucugcaaaagaa

SEQ ID NO: 1177107 - RNA, 19 nt, Homo sapiens
aaacagauagugacaagug

SEQ ID NO: 1177108 - RNA, 19 nt, Homo sapiens
caaggagcauuguguacau

SEQ ID NO: 1177109 - RNA, 19 nt, Homo sapiens
ggacaggacgcuagguugu

SEQ ID NO: 1177110 - RNA, 19 nt, Homo sapiens
ggauggauggaauauaauu

SEQ ID NO: 1177111 - RNA, 19 nt, Homo sapiens
uaauacugcucucuuucaa

SEQ ID NO: 1177112 - RNA, 19 nt, Homo sapiens
gaaauagcaaggugugauc

SEQ ID NO: 1177113 - RNA, 19 nt, Homo sapiens
gauagagccaggauuugaa

SEQ ID NO: 1177114 - RNA, 19 nt, Homo sapiens
cauaacaccggaucaaguu

SEQ ID NO: 1177115 - RNA, 19 nt, Homo sapiens
gaagaagaaauugaacaga

SEQ ID NO: 1177116 - RNA, 19 nt, Homo sapiens
caaccagcugugauauuua

SEQ ID NO: 1177117 - RNA, 19 nt, Homo sapiens
guucuuaucuaaccagucu

SEQ ID NO: 1177118 - RNA, 19 nt, Homo sapiens
gcucuugcaucagugguaa

SEQ ID NO: 1177119 - RNA, 19 nt, Homo sapiens
gcauagauucuuccagaug

SEQ ID NO: 1177120 - RNA, 19 nt, Homo sapiens
gaaaguuggggauguguua

SEQ ID NO: 1177121 - RNA, 19 nt, Homo sapiens
uuuacaaacugcugacauu

SEQ ID NO: 1177122 - RNA, 19 nt, Homo sapiens
caagaacagaauccuauga

SEQ ID NO: 1177123 - RNA, 19 nt, Homo sapiens
cagccugccuacauuuaaa

SEQ ID NO: 1177124 - RNA, 19 nt, Homo sapiens
acaaacagauagugacaag

SEQ ID NO: 1177125 - RNA, 19 nt, Homo sapiens
gaacacagcuuaccuaaua

SEQ ID NO: 1177126 - RNA, 19 nt, Homo sapiens
gagaagagcugaaguaaau

SEQ ID NO: 1177127 - RNA, 19 nt, Homo sapiens
gaucauggcugaaauaguu

SEQ ID NO: 1177128 - RNA, 19 nt, Homo sapiens
gaagaaacauggauagaug

SEQ ID NO: 1177129 - RNA, 19 nt, Homo sapiens
uaacaacgcucuagaaaca

SEQ ID NO: 1177130 - RNA, 19 nt, Homo sapiens
caauaaagccacauacuua

SEQ ID NO: 1177131 - RNA, 19 nt, Homo sapiens
gaaagaggguggugagguu

SEQ ID NO: 1177132 - RNA, 19 nt, Homo sapiens
guacuuaguucaagaaaug

SEQ ID NO: 1177133 - RNA, 19 nt, Homo sapiens
gaacacaacuaauccauac

SEQ ID NO: 1177134 - RNA, 19 nt, Homo sapiens
gcaaaccacauguauaaua

SEQ ID NO: 1177135 - RNA, 19 nt, Homo sapiens
gaagggauaugucaacaau

SEQ ID NO: 1177136 - RNA, 19 nt, Homo sapiens
gagaauugauuacaucuug

SEQ ID NO: 1177137 - RNA, 19 nt, Homo sapiens
uaaauacucucucuaccua

SEQ ID NO: 1177138 - RNA, 19 nt, Homo sapiens
uuacaacucucacggaaua

SEQ ID NO: 1177139 - RNA, 19 nt, Homo sapiens
caugaaugcugcuuauaua

SEQ ID NO: 1177140 - RNA, 19 nt, Homo sapiens
ucaacaaugugcacucuua

SEQ ID NO: 1177141 - RNA, 19 nt, Homo sapiens
aaagacagauuuccaugua

SEQ ID NO: 1177142 - RNA, 19 nt, Homo sapiens
gaacuaggauacccguuga

SEQ ID NO: 1177143 - RNA, 19 nt, Homo sapiens
ucucaggaauucuguauua

SEQ ID NO: 1177144 - RNA, 19 nt, Homo sapiens
gaaaugcuguaaauacguu

SEQ ID NO: 1177145 - RNA, 19 nt, Homo sapiens
gcagagaggcugaauauca

SEQ ID NO: 1177146 - RNA, 19 nt, Homo sapiens
gcucuauccuuaagaagua

SEQ ID NO: 1177147 - RNA, 19 nt, Homo sapiens
gaaaugauggcaacuuuga

SEQ ID NO: 1177148 - RNA, 19 nt, Homo sapiens
gaucaccaaugcauuugua

SEQ ID NO: 1177149 - RNA, 19 nt, Homo sapiens
ugacaccuguuacccauua

SEQ ID NO: 1177150 - RNA, 19 nt, Homo sapiens
gcaaagagggcaucaguau

SEQ ID NO: 1177151 - RNA, 19 nt, Homo sapiens
ccacagaacagcaacauuu

SEQ ID NO: 1177152 - RNA, 19 nt, Homo sapiens
uaaaaugccuucucugaua

SEQ ID NO: 1177153 - RNA, 19 nt, Homo sapiens
guauacaccugccugagua

SEQ ID NO: 1177154 - RNA, 19 nt, Homo sapiens
caacuaauuccacuaagua

SEQ ID NO: 1177155 - RNA, 19 nt, Homo sapiens
caaguggaauuucaucaaa

SEQ ID NO: 1177156 - RNA, 19 nt, Homo sapiens
aagcaaagcaccauuauuu

SEQ ID NO: 1177157 - RNA, 19 nt, Homo sapiens
caaguaagccaagaaauuu

SEQ ID NO: 1177158 - RNA, 19 nt, Homo sapiens
gagcuacgcuuacucaaag

SEQ ID NO: 1177159 - RNA, 19 nt, Homo sapiens
caaagucacucgucuucuu

SEQ ID NO: 1177160 - RNA, 19 nt, Homo sapiens
gaagauuggacuauacuuu

SEQ ID NO: 1177161 - RNA, 19 nt, Homo sapiens
gugcugagauguucauuug

SEQ ID NO: 1177162 - RNA, 19 nt, Homo sapiens
cuaaguagguuauaaaugg

SEQ ID NO: 1177163 - RNA, 19 nt, Homo sapiens
ccucaaagcuuggcaaaga

SEQ ID NO: 1177164 - RNA, 19 nt, Homo sapiens
ugaaauauccagacuugua

SEQ ID NO: 1177165 - RNA, 19 nt, Homo sapiens
ucaggaauauucuucauga

SEQ ID NO: 1177166 - RNA, 19 nt, Homo sapiens
gaaggaguauacugaccua

SEQ ID NO: 1177167 - RNA, 19 nt, Homo sapiens
ccacauguauaauaugcua

SEQ ID NO: 1177168 - RNA, 19 nt, Homo sapiens
gcucugaucuuaaguuucu

SEQ ID NO: 1177169 - RNA, 19 nt, Homo sapiens
ugaccgaucucgucucauu

SEQ ID NO: 1177170 - RNA, 19 nt, Homo sapiens
agacauagaacacagcuua

SEQ ID NO: 1177171 - RNA, 19 nt, Homo sapiens
acaaggaaaucacacauau

SEQ ID NO: 1177172 - RNA, 19 nt, Homo sapiens
gaacgcaccaaauaugaaa

SEQ ID NO: 1177173 - RNA, 19 nt, Homo sapiens
gaggaaaacucaagugaaa

SEQ ID NO: 1177174 - RNA, 19 nt, Homo sapiens
gcaacuaauuccacuaagu

SEQ ID NO: 1177175 - RNA, 19 nt, Homo sapiens
aaacauggauagaugauag

SEQ ID NO: 1177176 - RNA, 19 nt, Homo sapiens
gccaguauuucucuaguaa

SEQ ID NO: 1177177 - RNA, 19 nt, Homo sapiens
aaucagaacacgcuacuua

SEQ ID NO: 1177178 - RNA, 19 nt, Homo sapiens
guaugaggcugaacuggaa

SEQ ID NO: 1177179 - RNA, 19 nt, Homo sapiens
gugagaagauuggacuaua

SEQ ID NO: 1177180 - RNA, 19 nt, Homo sapiens
gcaucagccucuggauuua

SEQ ID NO: 1177181 - RNA, 19 nt, Homo sapiens
aaacaauggcucauacaua

SEQ ID NO: 1177182 - RNA, 19 nt, Homo sapiens
guggguauccguaaacuua

SEQ ID NO: 1177183 - RNA, 19 nt, Homo sapiens
caacuuugcccuuccuuaa

SEQ ID NO: 1177184 - RNA, 19 nt, Homo sapiens
gcaaaacagugcaauagaa

SEQ ID NO: 1177185 - RNA, 19 nt, Homo sapiens
gcaaagggccucagacucu

SEQ ID NO: 1177186 - RNA, 19 nt, Homo sapiens
ggagaacucugccuuccau

SEQ ID NO: 1177187 - RNA, 19 nt, Homo sapiens
aggcugaacuggaacauuu

SEQ ID NO: 1177188 - RNA, 19 nt, Homo sapiens
ccacugaagucuuuaugug

SEQ ID NO: 1177189 - RNA, 19 nt, Homo sapiens
ggguuuaccuaccaacuuu

SEQ ID NO: 1177190 - RNA, 19 nt, Homo sapiens
gauagcuguuucauuguuu

SEQ ID NO: 1177191 - RNA, 19 nt, Homo sapiens
agacagauuuccauguaaa

SEQ ID NO: 1177192 - RNA, 19 nt, Homo sapiens
gcaggaagccaggauguaa

SEQ ID NO: 1177193 - RNA, 19 nt, Homo sapiens
ucaaguaagccaagaaauu

SEQ ID NO: 1177194 - RNA, 19 nt, Homo sapiens
ggaccucuguucaaagaug

SEQ ID NO: 1177195 - RNA, 19 nt, Homo sapiens
gaaaagugcuagacauaga

SEQ ID NO: 1177196 - RNA, 19 nt, Homo sapiens
ggaaauaaagcuacuacau

SEQ ID NO: 1177197 - RNA, 19 nt, Homo sapiens
gagcugaaguaaauguaug

SEQ ID NO: 1177198 - RNA, 19 nt, Homo sapiens
aagaaaugauggcaacuuu

SEQ ID NO: 1177199 - RNA, 19 nt, Homo sapiens
gggacacgcugugcaagua

SEQ ID NO: 1177200 - RNA, 19 nt, Homo sapiens
cccgauaucauguuuauua

SEQ ID NO: 1177201 - RNA, 19 nt, Homo sapiens
cagagcaaguuaauacuga

SEQ ID NO: 1177202 - RNA, 19 nt, Homo sapiens
ccauauugaucaacuagaa

SEQ ID NO: 1177203 - RNA, 19 nt, Homo sapiens
caaagcaccauuauuucua

SEQ ID NO: 1177204 - RNA, 19 nt, Homo sapiens
caacucucacggaauauua

SEQ ID NO: 1177205 - RNA, 19 nt, Homo sapiens
cgagagaaguacuuaguuc

SEQ ID NO: 1177206 - RNA, 19 nt, Homo sapiens
cagaauaacagacaucuau

SEQ ID NO: 1177207 - RNA, 19 nt, Homo sapiens
gaagagcuuucacuguaca

SEQ ID NO: 1177208 - RNA, 19 nt, Homo sapiens
uaugugaacucuuccauuc

SEQ ID NO: 1177209 - RNA, 19 nt, Homo sapiens
uggcaaaccacauguauaa

SEQ ID NO: 1177210 - RNA, 19 nt, Homo sapiens
gaaggaaucgguauauugg

SEQ ID NO: 1177211 - RNA, 19 nt, Homo sapiens
gcaaauauggaacaacuuc

SEQ ID NO: 1177212 - RNA, 19 nt, Homo sapiens
gaagccaaguauuacaaga

SEQ ID NO: 1177213 - RNA, 19 nt, Homo sapiens
ggacagucuucuuugcuau

SEQ ID NO: 1177214 - RNA, 19 nt, Homo sapiens
gggacagucuucuuugcua

SEQ ID NO: 1177215 - RNA, 19 nt, Homo sapiens
gcaggaugcaaacuuauuu

SEQ ID NO: 1177216 - RNA, 19 nt, Homo sapiens
ugacaugaauuacauagca

SEQ ID NO: 1177217 - RNA, 19 nt, Homo sapiens
ccacaucuauaaccuuaau

SEQ ID NO: 1177218 - RNA, 19 nt, Homo sapiens
aaaucaggcuggaugcaua

SEQ ID NO: 1177219 - RNA, 19 nt, Homo sapiens
gaaccuucauggacugaug

SEQ ID NO: 1177220 - RNA, 19 nt, Homo sapiens
gaugagauacaacuucuga

SEQ ID NO: 1177221 - RNA, 19 nt, Homo sapiens
cauauucacuuuccuccuu

SEQ ID NO: 1177222 - RNA, 19 nt, Homo sapiens
aaagagaagagcugaagua

SEQ ID NO: 1177223 - RNA, 19 nt, Homo sapiens
gaagggaguuuuauguuau

SEQ ID NO: 1177224 - RNA, 19 nt, Homo sapiens
cuacaucccuucaguuuac

SEQ ID NO: 1177225 - RNA, 19 nt, Homo sapiens
guacacggguuuaaaguuu

SEQ ID NO: 1177226 - RNA, 19 nt, Homo sapiens
gaaagaagcaagaaaugaa

SEQ ID NO: 1177227 - RNA, 19 nt, Homo sapiens
gaaaggggcuccaggauaa

SEQ ID NO: 1177228 - RNA, 19 nt, Homo sapiens
gaacacugaugacaacgaa

SEQ ID NO: 1177229 - RNA, 19 nt, Homo sapiens
caagaucucugacuucaug

SEQ ID NO: 1177230 - RNA, 19 nt, Homo sapiens
uaacugacaucaaugagaa

SEQ ID NO: 1177231 - RNA, 19 nt, Homo sapiens
gaagagaacccuaacaaca

SEQ ID NO: 1177232 - RNA, 19 nt, Homo sapiens
ugagauaacugacaucaau

SEQ ID NO: 1177233 - RNA, 19 nt, Homo sapiens
caaugaaggugacaaugaa

SEQ ID NO: 1177234 - RNA, 19 nt, Homo sapiens
gcaaugaaggugacaauga

SEQ ID NO: 1177235 - RNA, 19 nt, Homo sapiens
ggaagaggcgaucaucaua

SEQ ID NO: 1177236 - RNA, 19 nt, Homo sapiens
gcugcuaacuguauuuauu

SEQ ID NO: 1177237 - RNA, 19 nt, Homo sapiens
acagagacauugaguacua

SEQ ID NO: 1177238 - RNA, 19 nt, Homo sapiens
ggaaggaagugaagauguc

SEQ ID NO: 1177239 - RNA, 19 nt, Homo sapiens
gcagagaccucaucaucca

SEQ ID NO: 1177240 - RNA, 19 nt, Homo sapiens
gaagaugucugggaagaag

SEQ ID NO: 1177241 - RNA, 19 nt, Homo sapiens
ggacaucuaugaggaagga

SEQ ID NO: 1177242 - RNA, 19 nt, Homo sapiens
caacgaaggugacaaugag

SEQ ID NO: 1177243 - RNA, 19 nt, Homo sapiens
cgaaaccacugacaacaau

SEQ ID NO: 1177244 - RNA, 19 nt, Homo sapiens
agaaugaucuguggguuaa

SEQ ID NO: 1177245 - RNA, 19 nt, Homo sapiens
caagaacacugaugacaac

SEQ ID NO: 1177246 - RNA, 19 nt, Homo sapiens
gaacaucaaggcaggcaaa

SEQ ID NO: 1177247 - RNA, 19 nt, Homo sapiens
gaucaucucagacgaauca

SEQ ID NO: 1177248 - RNA, 19 nt, Homo sapiens
guacaggaucucagacaua

SEQ ID NO: 1177249 - RNA, 19 nt, Homo sapiens
gaaagcagagagagaaaug

SEQ ID NO: 1177250 - RNA, 19 nt, Homo sapiens
gcaacgaaggugacaauga

SEQ ID NO: 1177251 - RNA, 19 nt, Homo sapiens
ugacaggauugcugagauu

SEQ ID NO: 1177252 - RNA, 19 nt, Homo sapiens
caagaaaugaagaaacgua

SEQ ID NO: 1177253 - RNA, 19 nt, Homo sapiens
gcaacaacuucuucaaagg

SEQ ID NO: 1177254 - RNA, 19 nt, Homo sapiens
ggcaacaacuucuucaaag

SEQ ID NO: 1177255 - RNA, 19 nt, Homo sapiens
uugcugagauuaucaagaa

SEQ ID NO: 1177256 - RNA, 19 nt, Homo sapiens
cgagaauccugaagacaau

SEQ ID NO: 1177257 - RNA, 19 nt, Homo sapiens
gaugugagguggugaucau

SEQ ID NO: 1177258 - RNA, 19 nt, Homo sapiens
gagaaagaagcaagaaaug

SEQ ID NO: 1177259 - RNA, 19 nt, Homo sapiens
gcuccaggauaaagagaaa

SEQ ID NO: 1177260 - RNA, 19 nt, Homo sapiens
cgagaauccugaccacaau

SEQ ID NO: 1177261 - RNA, 19 nt, Homo sapiens
caaggccgcuucgccauug

SEQ ID NO: 1177262 - RNA, 19 nt, Homo sapiens
ccagugaugaugaagauaa

SEQ ID NO: 1177263 - RNA, 19 nt, Homo sapiens
acaacgagaccacugauaa

SEQ ID NO: 1177264 - RNA, 19 nt, Homo sapiens
ugacuacgaggacgugaua

SEQ ID NO: 1177265 - RNA, 19 nt, Homo sapiens
gacauugaguacuaugaga

SEQ ID NO: 1177266 - RNA, 19 nt, Homo sapiens
gcgcagagaccucaucauc

SEQ ID NO: 1177267 - RNA, 19 nt, Homo sapiens
gaagaggcgaucaucauag

SEQ ID NO: 1177268 - RNA, 19 nt, Homo sapiens
gggaucaccucucuguauc

SEQ ID NO: 1177269 - RNA, 19 nt, Homo sapiens
gugaagaugucugggaaga

SEQ ID NO: 1177270 - RNA, 19 nt, Homo sapiens
gcagcgacagugacaauga

SEQ ID NO: 1177271 - RNA, 19 nt, Homo sapiens
caacgagaauccugaagac

SEQ ID NO: 1177272 - RNA, 19 nt, Homo sapiens
ggagaccaccgacuacuuc

SEQ ID NO: 1177273 - RNA, 19 nt, Homo sapiens
cagcgacagugacaaugaa

SEQ ID NO: 1177274 - RNA, 19 nt, Homo sapiens
acaaugagagugcagauga

SEQ ID NO: 1177275 - RNA, 19 nt, Homo sapiens
gcgagaauccugaccacaa

SEQ ID NO: 1177276 - RNA, 19 nt, Homo sapiens
ggucaaagcauuccucaac

SEQ ID NO: 1177277 - RNA, 19 nt, Homo sapiens
acaacaacgagaacacuua

SEQ ID NO: 1177278 - RNA, 19 nt, Homo sapiens
uacaggaucucagacauau

SEQ ID NO: 1177279 - RNA, 19 nt, Homo sapiens
ugaccaaucugcagguaca

SEQ ID NO: 1177280 - RNA, 19 nt, Homo sapiens
gaccucaucauccagcaua

SEQ ID NO: 1177281 - RNA, 19 nt, Homo sapiens
cgacagagacauugaguac

SEQ ID NO: 1177282 - RNA, 19 nt, Homo sapiens
ggccagugaugaugaagau

SEQ ID NO: 1177283 - RNA, 19 nt, Homo sapiens
acaaugagauaacugacau

SEQ ID NO: 1177284 - RNA, 19 nt, Homo sapiens
ugacuauuaugcaguggaa

SEQ ID NO: 1177285 - RNA, 19 nt, Homo sapiens
gaagcaagaaaugaagaaa

SEQ ID NO: 1177286 - RNA, 19 nt, Homo sapiens
caaacauggugauugucaa

SEQ ID NO: 1177287 - RNA, 19 nt, Homo sapiens
gcagguacaggaucucaga

SEQ ID NO: 1177288 - RNA, 19 nt, Homo sapiens
caaccgacgugaugaagac

SEQ ID NO: 1177289 - RNA, 19 nt, Homo sapiens
ggaagcagaggaaggugaa

SEQ ID NO: 1177290 - RNA, 19 nt, Homo sapiens
gaugagcgggagaguauga

SEQ ID NO: 1177291 - RNA, 19 nt, Homo sapiens
gcaaggccgcuucgccauu

SEQ ID NO: 1177292 - RNA, 19 nt, Homo sapiens
ggaagaagagggcauugag

SEQ ID NO: 1177293 - RNA, 19 nt, Homo sapiens
gacaauucaugacaucaag

SEQ ID NO: 1177294 - RNA, 19 nt, Homo sapiens
ugaguacuaugagaaaguu

SEQ ID NO: 1177295 - RNA, 19 nt, Homo sapiens
acaauaacaagaacacuga

SEQ ID NO: 1177296 - RNA, 19 nt, Homo sapiens
ugacaucaaugagaacauc

SEQ ID NO: 1177297 - RNA, 19 nt, Homo sapiens
cccagaggcugacaggauu

SEQ ID NO: 1177298 - RNA, 19 nt, Homo sapiens
ugagaaaguuauugaagac

SEQ ID NO: 1177299 - RNA, 19 nt, Homo sapiens
cagcgaugaugacgacaga

SEQ ID NO: 1177300 - RNA, 19 nt, Homo sapiens
aagagaacccuaacaacaa

SEQ ID NO: 1177301 - RNA, 19 nt, Homo sapiens
caacaacgagaauccugaa

SEQ ID NO: 1177302 - RNA, 19 nt, Homo sapiens
cacaggugcuggccgauau

SEQ ID NO: 1177303 - RNA, 19 nt, Homo sapiens
agaaagaagcaagaaauga

SEQ ID NO: 1177304 - RNA, 19 nt, Homo sapiens
ggauaaagagaaagaagca

SEQ ID NO: 1177305 - RNA, 19 nt, Homo sapiens
ggaggaaggaagugaagau

SEQ ID NO: 1177306 - RNA, 19 nt, Homo sapiens
caacaacuucuucaaaggu

SEQ ID NO: 1177307 - RNA, 19 nt, Homo sapiens
cgagaccacugauaacaac

SEQ ID NO: 1177308 - RNA, 19 nt, Homo sapiens
gcuacuaccugagagaaag

SEQ ID NO: 1177309 - RNA, 19 nt, Homo sapiens
ccaauaaaauucugagcaa

SEQ ID NO: 1177310 - RNA, 19 nt, Homo sapiens
gguauucuuugcgguauuc

SEQ ID NO: 1177311 - RNA, 19 nt, Homo sapiens
ggaggaggaagcagaggaa

SEQ ID NO: 1177312 - RNA, 19 nt, Homo sapiens
ugagacaauucaugacauc

SEQ ID NO: 1177313 - RNA, 19 nt, Homo sapiens
ggaagacgccccugacuau

SEQ ID NO: 1177314 - RNA, 19 nt, Homo sapiens
agagaaagaagcaagaaau

SEQ ID NO: 1177315 - RNA, 19 nt, Homo sapiens
uaaagagaaagaagcaaga

SEQ ID NO: 1177316 - RNA, 19 nt, Homo sapiens
aagcuguacuuccagacua

SEQ ID NO: 1177317 - RNA, 19 nt, Homo sapiens
cauugcagaguucuuauuu

SEQ ID NO: 1177318 - RNA, 19 nt, Homo sapiens
gcagaugaggccagugaug

SEQ ID NO: 1177319 - RNA, 19 nt, Homo sapiens
cugagauuaucaagaauga

SEQ ID NO: 1177320 - RNA, 19 nt, Homo sapiens
gacaggauugcugagauua

SEQ ID NO: 1177321 - RNA, 19 nt, Homo sapiens
acgaaucaguggaagaaga

SEQ ID NO: 1177322 - RNA, 19 nt, Homo sapiens
agauaaugauggcaacgaa

SEQ ID NO: 1177323 - RNA, 19 nt, Homo sapiens
gugaugaugaagauaauga

SEQ ID NO: 1177324 - RNA, 19 nt, Homo sapiens
cagaugaggccagugauga

SEQ ID NO: 1177325 - RNA, 19 nt, Homo sapiens
acacagaacuggauuuaua

SEQ ID NO: 1177326 - RNA, 19 nt, Homo sapiens
gaccauaacucuuacguaa

SEQ ID NO: 1177327 - RNA, 19 nt, Homo sapiens
ggaauaaaccaguaacuaa

SEQ ID NO: 1177328 - RNA, 19 nt, Homo sapiens
gagcagcacuauuacagua

SEQ ID NO: 1177329 - RNA, 19 nt, Homo sapiens
gaauaggucugaaaacuua

SEQ ID NO: 1177330 - RNA, 19 nt, Homo sapiens
ggacaucacagaauucuuu

SEQ ID NO: 1177331 - RNA, 19 nt, Homo sapiens
ggaauuacuugacacagaa

SEQ ID NO: 1177332 - RNA, 19 nt, Homo sapiens
gaagaagguucaauuugga

SEQ ID NO: 1177333 - RNA, 19 nt, Homo sapiens
gcacaaaggcccaacuuga

SEQ ID NO: 1177334 - RNA, 19 nt, Homo sapiens
gaaagagacacagauauuu

SEQ ID NO: 1177335 - RNA, 19 nt, Homo sapiens
gagaaaagccucccaauaa

SEQ ID NO: 1177336 - RNA, 19 nt, Homo sapiens
gauagaagcaggacuagaa

SEQ ID NO: 1177337 - RNA, 19 nt, Homo sapiens
uagaacagauccauuagaa

SEQ ID NO: 1177338 - RNA, 19 nt, Homo sapiens
ucauggagcucguuucaaa

SEQ ID NO: 1177339 - RNA, 19 nt, Homo sapiens
guaguaugcuuaggcuuua

SEQ ID NO: 1177340 - RNA, 19 nt, Homo sapiens
gaagaugauuugacugauc

SEQ ID NO: 1177341 - RNA, 19 nt, Homo sapiens
ucacugaacuuaggagaaa

SEQ ID NO: 1177342 - RNA, 19 nt, Homo sapiens
ggagaaaguauacagaauu

SEQ ID NO: 1177343 - RNA, 19 nt, Homo sapiens
aagaagacuugguuugaua

SEQ ID NO: 1177344 - RNA, 19 nt, Homo sapiens
caaaauauguucuggcuuu

SEQ ID NO: 1177345 - RNA, 19 nt, Homo sapiens
gaugcaggcuggagaagaa

SEQ ID NO: 1177346 - RNA, 19 nt, Homo sapiens
gagcagccaucaucaggaa

SEQ ID NO: 1177347 - RNA, 19 nt, Homo sapiens
ggagagcgauagagaagau

SEQ ID NO: 1177348 - RNA, 19 nt, Homo sapiens
ggaaacaacacuaccgaaa

SEQ ID NO: 1177349 - RNA, 19 nt, Homo sapiens
gagaagaugauuugacuga

SEQ ID NO: 1177350 - RNA, 19 nt, Homo sapiens
acaaugaagucugaagaua

SEQ ID NO: 1177351 - RNA, 19 nt, Homo sapiens
ugacacagauggcuacaau

SEQ ID NO: 1177352 - RNA, 19 nt, Homo sapiens
gaaacgguguagagacuau

SEQ ID NO: 1177353 - RNA, 19 nt, Homo sapiens
gaacagauccauuagaaaa

SEQ ID NO: 1177354 - RNA, 19 nt, Homo sapiens
ucgaagagauucauacaga

SEQ ID NO: 1177355 - RNA, 19 nt, Homo sapiens
ccucugcaguugauaauaa

SEQ ID NO: 1177356 - RNA, 19 nt, Homo sapiens
gcaaagaaagcaauaucaa

SEQ ID NO: 1177357 - RNA, 19 nt, Homo sapiens
cuaaagacaucacacuaga

SEQ ID NO: 1177358 - RNA, 19 nt, Homo sapiens
gcuggaagcugccaaacga

SEQ ID NO: 1177359 - RNA, 19 nt, Homo sapiens
gagaagaagucacugaacu

SEQ ID NO: 1177360 - RNA, 19 nt, Homo sapiens
cacagaagauguuaauuuc

SEQ ID NO: 1177361 - RNA, 19 nt, Homo sapiens
gaagcaguauuaaacaauc

SEQ ID NO: 1177362 - RNA, 19 nt, Homo sapiens
ucaagaugaugaugaagaa

SEQ ID NO: 1177363 - RNA, 19 nt, Homo sapiens
aaacaacacuaccgaaagu

SEQ ID NO: 1177364 - RNA, 19 nt, Homo sapiens
caaugaagucugaagauaa

SEQ ID NO: 1177365 - RNA, 19 nt, Homo sapiens
gaaggaagcacccaacagu

SEQ ID NO: 1177366 - RNA, 19 nt, Homo sapiens
ggaaagggaucugguaaaa

SEQ ID NO: 1177367 - RNA, 19 nt, Homo sapiens
aaaaguuccuccagaauua

SEQ ID NO: 1177368 - RNA, 19 nt, Homo sapiens
agaagaagguucaauuugg

SEQ ID NO: 1177369 - RNA, 19 nt, Homo sapiens
gaagagauucauacagaga

SEQ ID NO: 1177370 - RNA, 19 nt, Homo sapiens
uaacuuagaggacuuuguu

SEQ ID NO: 1177371 - RNA, 19 nt, Homo sapiens
gacaaugaaucucguucuu

SEQ ID NO: 1177372 - RNA, 19 nt, Homo sapiens
caaaagagauuaugaucga

SEQ ID NO: 1177373 - RNA, 19 nt, Homo sapiens
ggacucagaaucaaggaaa

SEQ ID NO: 1177374 - RNA, 19 nt, Homo sapiens
gaagugauccaguaguugu

SEQ ID NO: 1177375 - RNA, 19 nt, Homo sapiens
aggaagagaucacuaagga

SEQ ID NO: 1177376 - RNA, 19 nt, Homo sapiens
gacaagagcagaagcugaa

SEQ ID NO: 1177377 - RNA, 19 nt, Homo sapiens
uuaccaaguugaaagauga

SEQ ID NO: 1177378 - RNA, 19 nt, Homo sapiens
agaaagagacacagauauu

SEQ ID NO: 1177379 - RNA, 19 nt, Homo sapiens
gggcggagucgcaguuaua

SEQ ID NO: 1177380 - RNA, 19 nt, Homo sapiens
ucagaaagagacacagaua

SEQ ID NO: 1177381 - RNA, 19 nt, Homo sapiens
cauuggagauuucugcauu

SEQ ID NO: 1177382 - RNA, 19 nt, Homo sapiens
ugacacagaacuggauuua

SEQ ID NO: 1177383 - RNA, 19 nt, Homo sapiens
agacucagaugcagaagga

SEQ ID NO: 1177384 - RNA, 19 nt, Homo sapiens
guacggaagcaguauuaaa

SEQ ID NO: 1177385 - RNA, 19 nt, Homo sapiens
gaaggugcccuaauccaau

SEQ ID NO: 1177386 - RNA, 19 nt, Homo sapiens
acuuacagguugcuuauaa

SEQ ID NO: 1177387 - RNA, 19 nt, Homo sapiens
ucagcaaacuuaaugaaca

SEQ ID NO: 1177388 - RNA, 19 nt, Homo sapiens
acaaaggcccaacuugaua

SEQ ID NO: 1177389 - RNA, 19 nt, Homo sapiens
gaccacccaugccaaagaa

SEQ ID NO: 1177390 - RNA, 19 nt, Homo sapiens
gaaacaacacuaccgaaag

SEQ ID NO: 1177391 - RNA, 19 nt, Homo sapiens
aagaagaauuucaggaaga

SEQ ID NO: 1177392 - RNA, 19 nt, Homo sapiens
gaaauugaagauugucaga

SEQ ID NO: 1177393 - RNA, 19 nt, Homo sapiens
cagaaggaauuacuugaca

SEQ ID NO: 1177394 - RNA, 19 nt, Homo sapiens
aaagagaggcuucgugaga

SEQ ID NO: 1177395 - RNA, 19 nt, Homo sapiens
guggaauggucucuuuaaa

SEQ ID NO: 1177396 - RNA, 19 nt, Homo sapiens
guaaacaauugcuaaagac

SEQ ID NO: 1177397 - RNA, 19 nt, Homo sapiens
caacauacgaagaagcaaa

SEQ ID NO: 1177398 - RNA, 19 nt, Homo sapiens
gcaaccaguucuguuccua

SEQ ID NO: 1177399 - RNA, 19 nt, Homo sapiens
ccaccuccaccaauucuua

SEQ ID NO: 1177400 - RNA, 19 nt, Homo sapiens
gaaaauagaagccgugaug

SEQ ID NO: 1177401 - RNA, 19 nt, Homo sapiens
gcuuaggcuuuacuaugua

SEQ ID NO: 1177402 - RNA, 19 nt, Homo sapiens
aaagacaucacacuagaaa

SEQ ID NO: 1177403 - RNA, 19 nt, Homo sapiens
gaacucuaccuguguuuca

SEQ ID NO: 1177404 - RNA, 19 nt, Homo sapiens
gaagaugcaggcuggagaa

SEQ ID NO: 1177405 - RNA, 19 nt, Homo sapiens
uuugaaggcugcacagaaa

SEQ ID NO: 1177406 - RNA, 19 nt, Homo sapiens
aacaaucgcuuuauuaagg

SEQ ID NO: 1177407 - RNA, 19 nt, Homo sapiens
ucagaagaagguucaauuu

SEQ ID NO: 1177408 - RNA, 19 nt, Homo sapiens
cuacaaagaagacuugguu

SEQ ID NO: 1177409 - RNA, 19 nt, Homo sapiens
ggauaguaguggacucaga

SEQ ID NO: 1177410 - RNA, 19 nt, Homo sapiens
cgaaaguuggucugaauuu

SEQ ID NO: 1177411 - RNA, 19 nt, Homo sapiens
acuaaagucuccaaguuau

SEQ ID NO: 1177412 - RNA, 19 nt, Homo sapiens
gaccaauacuuguuauaac

SEQ ID NO: 1177413 - RNA, 19 nt, Homo sapiens
aggaagcacccaacaguua

SEQ ID NO: 1177414 - RNA, 19 nt, Homo sapiens
gaaaaguuccuccagaauu

SEQ ID NO: 1177415 - RNA, 19 nt, Homo sapiens
cagaagaagguucaauuug

SEQ ID NO: 1177416 - RNA, 19 nt, Homo sapiens
acaaacacuuccagaccua

SEQ ID NO: 1177417 - RNA, 19 nt, Homo sapiens
gaugugaaucuuccuggua

SEQ ID NO: 1177418 - RNA, 19 nt, Homo sapiens
ggaagcaguauuaaacaau

SEQ ID NO: 1177419 - RNA, 19 nt, Homo sapiens
auaccaagcuugaacuuag

SEQ ID NO: 1177420 - RNA, 19 nt, Homo sapiens
gauaguaguggacucagaa

SEQ ID NO: 1177421 - RNA, 19 nt, Homo sapiens
gaaaagccucccaauaaaa

SEQ ID NO: 1177422 - RNA, 19 nt, Homo sapiens
ggacuaacaucaggggaua

SEQ ID NO: 1177423 - RNA, 19 nt, Homo sapiens
caaagaaacgguguagaga

SEQ ID NO: 1177424 - RNA, 19 nt, Homo sapiens
cgaagucgaaguuggagua

SEQ ID NO: 1177425 - RNA, 19 nt, Homo sapiens
gcccacauaucuuauuuau

SEQ ID NO: 1177426 - RNA, 19 nt, Homo sapiens
gaucacugcugcccacugu

SEQ ID NO: 1177427 - RNA, 19 nt, Homo sapiens
uaaauaggcucaucuaccu

SEQ ID NO: 1177428 - RNA, 19 nt, Homo sapiens
gaaggugccugugcagaca

SEQ ID NO: 1177429 - RNA, 19 nt, Homo sapiens
aaccauaccuguucucugu

SEQ ID NO: 1177430 - RNA, 19 nt, Homo sapiens
cgacagccauccucaaugc

SEQ ID NO: 1177431 - RNA, 19 nt, Homo sapiens
gcugaagguuccuaucauc

SEQ ID NO: 1177432 - RNA, 19 nt, Homo sapiens
gacagggacccaucacuga

SEQ ID NO: 1177433 - RNA, 19 nt, Homo sapiens
ucacugcugcccacuguuu

SEQ ID NO: 1177434 - RNA, 19 nt, Homo sapiens
uuguaacccugcccacaua

SEQ ID NO: 1177435 - RNA, 19 nt, Homo sapiens
gaagucugcagccaucugu

SEQ ID NO: 1177436 - RNA, 19 nt, Homo sapiens
ucaaggacaaccugaacaa

SEQ ID NO: 1177437 - RNA, 19 nt, Homo sapiens
caaggacaaccugaacaaa

SEQ ID NO: 1177438 - RNA, 19 nt, Homo sapiens
cugcccacauaucuuauuu

SEQ ID NO: 1177439 - RNA, 19 nt, Homo sapiens
gcugugugccggcuacuug

SEQ ID NO: 1177440 - RNA, 19 nt, Homo sapiens
ccucaaugcggccaggaua

SEQ ID NO: 1177441 - RNA, 19 nt, Homo sapiens
gcaggacagggacccauca

SEQ ID NO: 1177442 - RNA, 19 nt, Homo sapiens
cuauccaccucccuccaaa

SEQ ID NO: 1177443 - RNA, 19 nt, Homo sapiens
aagcugaagguuccuauca

SEQ ID NO: 1177444 - RNA, 19 nt, Homo sapiens
gugagcauccagaagaaug

SEQ ID NO: 1177445 - RNA, 19 nt, Homo sapiens
acccugcccacauaucuua

SEQ ID NO: 1177446 - RNA, 19 nt, Homo sapiens
ggaagucugcagccaucug

SEQ ID NO: 1177447 - RNA, 19 nt, Homo sapiens
cucgagcgcuccauacagu

SEQ ID NO: 1177448 - RNA, 19 nt, Homo sapiens
uaacccugcccacauaucu

SEQ ID NO: 1177449 - RNA, 19 nt, Homo sapiens
ucgugagcauccagaagaa

SEQ ID NO: 1177450 - RNA, 19 nt, Homo sapiens
gaagcugaagguuccuauc

SEQ ID NO: 1177451 - RNA, 19 nt, Homo sapiens
cuagagagcugcgacuuua

SEQ ID NO: 1177452 - RNA, 19 nt, Homo sapiens
gaaacgaauugagcgcuua

SEQ ID NO: 1177453 - RNA, 19 nt, Homo sapiens
gcgcagcucuggaauuuga

SEQ ID NO: 1177454 - RNA, 19 nt, Homo sapiens
ccaugcagguuuccaaaua

SEQ ID NO: 1177455 - RNA, 19 nt, Homo sapiens
ggacagugcuccucuagag

SEQ ID NO: 1177456 - RNA, 19 nt, Homo sapiens
gagcugcgacuuuaauuaa

SEQ ID NO: 1177457 - RNA, 19 nt, Homo sapiens
gaaauacgagaaacgaauu

SEQ ID NO: 1177458 - RNA, 19 nt, Homo sapiens
gcuuaacgauccugaaaga

SEQ ID NO: 1177459 - RNA, 19 nt, Homo sapiens
uuauguagaucgcgugaua

SEQ ID NO: 1177460 - RNA, 19 nt, Homo sapiens
cagcaugacuguccaucuu

SEQ ID NO: 1177461 - RNA, 19 nt, Homo sapiens
gaauugagcgcuuaacgau

SEQ ID NO: 1177462 - RNA, 19 nt, Homo sapiens
gcuacuggccuccuacuuu

SEQ ID NO: 1177463 - RNA, 19 nt, Homo sapiens
ccaagaucauggagaaaug

SEQ ID NO: 1177464 - RNA, 19 nt, Homo sapiens
ccacguuccuaacauuuau

SEQ ID NO: 1177465 - RNA, 19 nt, Homo sapiens
gcucaggacccgcgugaaa

SEQ ID NO: 1177466 - RNA, 19 nt, Homo sapiens
gaagacauccacguuccua

SEQ ID NO: 1177467 - RNA, 19 nt, Homo sapiens
uggagacgcuggaaaggaa

SEQ ID NO: 1177468 - RNA, 19 nt, Homo sapiens
acgcgcagcucuggaauuu

SEQ ID NO: 1177469 - RNA, 19 nt, Homo sapiens
cuacuggccuccuacuuuc

SEQ ID NO: 1177470 - RNA, 19 nt, Homo sapiens
ggacacauccaacuaacca

SEQ ID NO: 1177471 - RNA, 19 nt, Homo sapiens
gcaugacuguccaucuuca

SEQ ID NO: 1177472 - RNA, 19 nt, Homo sapiens
gcagaaauacgagaaacga

SEQ ID NO: 1177473 - RNA, 19 nt, Homo sapiens
cauccacguuccuaacauu

SEQ ID NO: 1177474 - RNA, 19 nt, Homo sapiens
guacgccaaucugggcaua

SEQ ID NO: 1177475 - RNA, 19 nt, Homo sapiens
gcgcuuaacgauccugaaa

SEQ ID NO: 1177476 - RNA, 19 nt, Homo sapiens
guagaucgcgugauaaagg

SEQ ID NO: 1177477 - RNA, 19 nt, Homo sapiens
caacggcgaccacuuccuu

SEQ ID NO: 1177478 - RNA, 19 nt, Homo sapiens
ccgagaaggccguguuuga

SEQ ID NO: 1177479 - RNA, 19 nt, Homo sapiens
gagagcugcgacuuuaauu

SEQ ID NO: 1177480 - RNA, 19 nt, Homo sapiens
gguggacagugcuccucua

SEQ ID NO: 1177481 - RNA, 19 nt, Homo sapiens
gaagauggagacgcuggaa

SEQ ID NO: 1177482 - RNA, 19 nt, Homo sapiens
cgguggagauggugaagga

SEQ ID NO: 1177483 - RNA, 19 nt, Homo sapiens
agacuucgcccuggugaaa

SEQ ID NO: 1177484 - RNA, 19 nt, Homo sapiens
guucaacggcgaccacuuc

SEQ ID NO: 1177485 - RNA, 19 nt, Homo sapiens
agagcugcgacuuuaauua

SEQ ID NO: 1177486 - RNA, 19 nt, Homo sapiens
agaaauacgagaaacgaau

SEQ ID NO: 1177487 - RNA, 19 nt, Homo sapiens
gcaggaaacguggucuuca

SEQ ID NO: 1177488 - RNA, 19 nt, Homo sapiens
cgaauugagcgcuuaacga

SEQ ID NO: 1177489 - RNA, 19 nt, Homo sapiens
gggcagaaauacgagaaac

SEQ ID NO: 1177490 - RNA, 19 nt, Homo sapiens
ugauaaaggggcagaaaua

SEQ ID NO: 1177491 - RNA, 19 nt, Homo sapiens
caacgugcccaugugcaaa

SEQ ID NO: 1177492 - RNA, 19 nt, Homo sapiens
caggaaacguggucuucag

SEQ ID NO: 1177493 - RNA, 19 nt, Homo sapiens
gacgacuccuucgccauga

SEQ ID NO: 1177494 - RNA, 19 nt, Homo sapiens
aaacgaauugagcgcuuaa

SEQ ID NO: 1177495 - RNA, 19 nt, Homo sapiens
caugcagguuuccaaauac

SEQ ID NO: 1177496 - RNA, 19 nt, Homo sapiens
aacguggucuucaggagaa

SEQ ID NO: 1177497 - RNA, 19 nt, Homo sapiens
ucaggacccgcgugaaaga

SEQ ID NO: 1177498 - RNA, 19 nt, Homo sapiens
ucuagagagcugcgacuuu

SEQ ID NO: 1177499 - RNA, 19 nt, Homo sapiens
uguuugacgugcacaggaa

SEQ ID NO: 1177500 - RNA, 19 nt, Homo sapiens
cccgagaggugagggaguu

SEQ ID NO: 1177501 - RNA, 19 nt, Homo sapiens
gccaggacgcgcaucauca

SEQ ID NO: 1177502 - RNA, 19 nt, Homo sapiens
ccugaaagaggaagaugga

SEQ ID NO: 1177503 - RNA, 19 nt, Homo sapiens
gggugugccuuugcugugu

SEQ ID NO: 1177504 - RNA, 19 nt, Homo sapiens
guuccuacgugggcgagaa

SEQ ID NO: 1177505 - RNA, 19 nt, Homo sapiens
cagaaauacgagaaacgaa

SEQ ID NO: 1177506 - RNA, 19 nt, Homo sapiens
gacauccacguuccuaaca

SEQ ID NO: 1177507 - RNA, 19 nt, Homo sapiens
cgguggagguggaagagau

SEQ ID NO: 1177508 - RNA, 19 nt, Homo sapiens
agagagcugcgacuuuaau

SEQ ID NO: 1177509 - RNA, 19 nt, Homo sapiens
gagccaugcagguuuccaa

SEQ ID NO: 1177510 - RNA, 19 nt, Homo sapiens
gacagugcuccucuagaga

SEQ ID NO: 1177511 - RNA, 19 nt, Homo sapiens
gagaggugagggaguucaa

SEQ ID NO: 1177512 - RNA, 19 nt, Homo sapiens
cacggaagaugagguggau

SEQ ID NO: 1177513 - RNA, 19 nt, Homo sapiens
uccacguuccuaacauuua

SEQ ID NO: 1177514 - RNA, 19 nt, Homo sapiens
gagaauaaaugacuugcuu

SEQ ID NO: 1177515 - RNA, 19 nt, Homo sapiens
gcagaaaccuacauauagu

SEQ ID NO: 1177516 - RNA, 19 nt, Homo sapiens
ugauagaucuguuaaguug

SEQ ID NO: 1177517 - RNA, 19 nt, Homo sapiens
guccaaaccuguugccaua

SEQ ID NO: 1177518 - RNA, 19 nt, Homo sapiens
uaucugggcucuaucauau

SEQ ID NO: 1177519 - RNA, 19 nt, Homo sapiens
gaauggacucggucuguua

SEQ ID NO: 1177520 - RNA, 19 nt, Homo sapiens
gaagaggaagauaagguua

SEQ ID NO: 1177521 - RNA, 19 nt, Homo sapiens
cuacacaucugccuaacuu

SEQ ID NO: 1177522 - RNA, 19 nt, Homo sapiens
gccaauauuuccuaucuau

SEQ ID NO: 1177523 - RNA, 19 nt, Homo sapiens
uaacugggccuacggcuuu

SEQ ID NO: 1177524 - RNA, 19 nt, Homo sapiens
gaucaucucccugguaauu

SEQ ID NO: 1177525 - RNA, 19 nt, Homo sapiens
ucacuuacaucuauaacug

SEQ ID NO: 1177526 - RNA, 19 nt, Homo sapiens
ucaucucccugguaauuua

SEQ ID NO: 1177527 - RNA, 19 nt, Homo sapiens
ucuguuaaguuguguagua

SEQ ID NO: 1177528 - RNA, 19 nt, Homo sapiens
agaguagacuggauugaaa

SEQ ID NO: 1177529 - RNA, 19 nt, Homo sapiens
gauuugaguuucucugaau

SEQ ID NO: 1177530 - RNA, 19 nt, Homo sapiens
aagcagaaaccuacauaua

SEQ ID NO: 1177531 - RNA, 19 nt, Homo sapiens
gcauaucauuugugagaau

SEQ ID NO: 1177532 - RNA, 19 nt, Homo sapiens
gaccaaacauucuaaaaga

SEQ ID NO: 1177533 - RNA, 19 nt, Homo sapiens
cgugaaacuuaacacuuua

SEQ ID NO: 1177534 - RNA, 19 nt, Homo sapiens
cuaauuaccuauacuaugc

SEQ ID NO: 1177535 - RNA, 19 nt, Homo sapiens
guaagcagaaaccuacaua

SEQ ID NO: 1177536 - RNA, 19 nt, Homo sapiens
ggauuugaguuucucugaa

SEQ ID NO: 1177537 - RNA, 19 nt, Homo sapiens
gugggaaaaugcuauauua

SEQ ID NO: 1177538 - RNA, 19 nt, Homo sapiens
ccuauacuaugccaauauu

SEQ ID NO: 1177539 - RNA, 19 nt, Homo sapiens
gucagagccucauggagua

SEQ ID NO: 1177540 - RNA, 19 nt, Homo sapiens
acgugaaacuuaacacuuu

SEQ ID NO: 1177541 - RNA, 19 nt, Homo sapiens
aauaugcacgugaaacuua

SEQ ID NO: 1177542 - RNA, 19 nt, Homo sapiens
uagcuaaggcuucauguug

SEQ ID NO: 1177543 - RNA, 19 nt, Homo sapiens
gauggacugggucuaauuu

SEQ ID NO: 1177544 - RNA, 19 nt, Homo sapiens
aaaugagguuuccaagauu

SEQ ID NO: 1177545 - RNA, 19 nt, Homo sapiens
gggaaugaaugugggagaa

SEQ ID NO: 1177546 - RNA, 19 nt, Homo sapiens
gcaaugccaagcccaggua

SEQ ID NO: 1177547 - RNA, 19 nt, Homo sapiens
ggacugggucuaauuuauc

SEQ ID NO: 1177548 - RNA, 19 nt, Homo sapiens
aaugagguuuccaagauuu

SEQ ID NO: 1177549 - RNA, 19 nt, Homo sapiens
guuguguaguaaagcauua

SEQ ID NO: 1177550 - RNA, 19 nt, Homo sapiens
gacugggucuaauuuauca

SEQ ID NO: 1177551 - RNA, 19 nt, Homo sapiens
gauaugucaucuaggaaag

SEQ ID NO: 1177552 - RNA, 19 nt, Homo sapiens
agaggaagauaagguuaaa

SEQ ID NO: 1177553 - RNA, 19 nt, Homo sapiens
aaaaugagguuuccaagau

SEQ ID NO: 1177554 - RNA, 19 nt, Homo sapiens
aaagauggacugggucuaa

SEQ ID NO: 1177555 - RNA, 19 nt, Homo sapiens
uagacuggauugaaagaug

SEQ ID NO: 1177556 - RNA, 19 nt, Homo sapiens
uaugucaucuaggaaagua

SEQ ID NO: 1177557 - RNA, 19 nt, Homo sapiens
uuugugaaguugugucuuu

SEQ ID NO: 1177558 - RNA, 19 nt, Homo sapiens
ggcaguguucauauuauua

SEQ ID NO: 1177559 - RNA, 19 nt, Homo sapiens
gaguuucucugaauagcau

SEQ ID NO: 1177560 - RNA, 19 nt, Homo sapiens
guuaaguuguguaguaaag

SEQ ID NO: 1177561 - RNA, 19 nt, Homo sapiens
ccaaaccuguugccauagu

SEQ ID NO: 1177562 - RNA, 19 nt, Homo sapiens
gagaagaggaagauaaggu

SEQ ID NO: 1177563 - RNA, 19 nt, Homo sapiens
aagagaauaugcacgugaa

SEQ ID NO: 1177564 - RNA, 19 nt, Homo sapiens
gcucuucuguggcuucauc

SEQ ID NO: 1177565 - RNA, 19 nt, Homo sapiens
gggcuaaggagaagaggaa

SEQ ID NO: 1177566 - RNA, 19 nt, Homo sapiens
ccagguacuucuacacauc

SEQ ID NO: 1177567 - RNA, 19 nt, Homo sapiens
gcugucacuuacaucuaua

SEQ ID NO: 1177568 - RNA, 19 nt, Homo sapiens
uagacaggcuucugauagu

SEQ ID NO: 1177569 - RNA, 19 nt, Homo sapiens
caaaccuguugccauaguu

SEQ ID NO: 1177570 - RNA, 19 nt, Homo sapiens
gaauaugcacgugaaacuu

SEQ ID NO: 1177571 - RNA, 19 nt, Homo sapiens
uggcaguguucauauuauu

SEQ ID NO: 1177572 - RNA, 19 nt, Homo sapiens
ggaaugaaugugggagaaa

SEQ ID NO: 1177573 - RNA, 19 nt, Homo sapiens
caacuacgaagaugaccuu

SEQ ID NO: 1177574 - RNA, 19 nt, Homo sapiens
cauauagacaggcuucuga

SEQ ID NO: 1177575 - RNA, 19 nt, Homo sapiens
uaaaacagccucaggagaa

SEQ ID NO: 1177576 - RNA, 19 nt, Homo sapiens
uaaguuguguaguaaagca

SEQ ID NO: 1177577 - RNA, 19 nt, Homo sapiens
gaaugaaugugggagaaaa

SEQ ID NO: 1177578 - RNA, 19 nt, Homo sapiens
gauuggcugugccuucuuc

SEQ ID NO: 1177579 - RNA, 19 nt, Homo sapiens
gacaggcuucugauaguuu

SEQ ID NO: 1177580 - RNA, 19 nt, Homo sapiens
guaguguuauaguuucaug

SEQ ID NO: 1177581 - RNA, 19 nt, Homo sapiens
ugacugauagaucuguuaa

SEQ ID NO: 1177582 - RNA, 19 nt, Homo sapiens
uggacugggucuaauuuau

SEQ ID NO: 1177583 - RNA, 19 nt, Homo sapiens
cauguugacucgauauguc

SEQ ID NO: 1177584 - RNA, 19 nt, Homo sapiens
cugccuaacuugggaauga

SEQ ID NO: 1177585 - RNA, 19 nt, Homo sapiens
ccaacccugcugucacuua

SEQ ID NO: 1177586 - RNA, 19 nt, Homo sapiens
agacaggcuucugauaguu

SEQ ID NO: 1177587 - RNA, 19 nt, Homo sapiens
gagggucauucuugucaca

SEQ ID NO: 1177588 - RNA, 19 nt, Homo sapiens
cgauaugucaucuaggaaa

SEQ ID NO: 1177589 - RNA, 19 nt, Homo sapiens
ucaagccuucgaacuauuu

SEQ ID NO: 1177590 - RNA, 19 nt, Homo sapiens
guuaagggcuaaggagaag

SEQ ID NO: 1177591 - RNA, 19 nt, Homo sapiens
ugccuuggcugcuguguuc

SEQ ID NO: 1177592 - RNA, 19 nt, Homo sapiens
uauagacaggcuucugaua

SEQ ID NO: 1177593 - RNA, 19 nt, Homo sapiens
acugauagaucuguuaagu

SEQ ID NO: 1177594 - RNA, 19 nt, Homo sapiens
cagaguagacuggauugaa

SEQ ID NO: 1177595 - RNA, 19 nt, Homo sapiens
aaggagaagaggaagauaa

SEQ ID NO: 1177596 - RNA, 19 nt, Homo sapiens
gggauuugaguuucucuga

SEQ ID NO: 1177597 - RNA, 19 nt, Homo sapiens
auagaucuguuaaguugug

SEQ ID NO: 1177598 - RNA, 19 nt, Homo sapiens
ggucuaauuuaucaugacu

SEQ ID NO: 1177599 - RNA, 19 nt, Homo sapiens
uaauuuaccccgugaagua

SEQ ID NO: 1177600 - RNA, 19 nt, Homo sapiens
uuucaagccuucgaacuau

SEQ ID NO: 1177601 - RNA, 19 nt, Homo sapiens
ccacgauuauccugauugg

SEQ ID NO: 1177602 - RNA, 19 nt, Homo sapiens
ucaggagaauaaaugacuu

SEQ ID NO: 1177603 - RNA, 19 nt, Homo sapiens
ugaaguacacccagaccuu

SEQ ID NO: 1177604 - RNA, 19 nt, Homo sapiens
gacucgauaugucaucuag

SEQ ID NO: 1177605 - RNA, 19 nt, Homo sapiens
agaauggacucggucuguu

SEQ ID NO: 1177606 - RNA, 19 nt, Homo sapiens
ccauuucgacuuacauaau

SEQ ID NO: 1177607 - RNA, 19 nt, Homo sapiens
cagaaaccuacauauaguu

SEQ ID NO: 1177608 - RNA, 19 nt, Homo sapiens
uuaggagggucauucuugu

SEQ ID NO: 1177609 - RNA, 19 nt, Homo sapiens
caacccugcugucacuuac

SEQ ID NO: 1177610 - RNA, 19 nt, Homo sapiens
caucggauaggucauuaug

SEQ ID NO: 1177611 - RNA, 19 nt, Homo sapiens
gaaagauggacugggucua

SEQ ID NO: 1177612 - RNA, 19 nt, Homo sapiens
cucgauaugucaucuagga

SEQ ID NO: 1177613 - RNA, 19 nt, Homo sapiens
gcugcuguguuccagauca

SEQ ID NO: 1177614 - RNA, 19 nt, Homo sapiens
guucuacucucuugaaaua

SEQ ID NO: 1177615 - RNA, 19 nt, Homo sapiens
ccaagaagguuuagaagug

SEQ ID NO: 1177616 - RNA, 19 nt, Homo sapiens
ggaaucaucuuguucaaag

SEQ ID NO: 1177617 - RNA, 19 nt, Homo sapiens
ggauucaacuuguuucuug

SEQ ID NO: 1177618 - RNA, 19 nt, Homo sapiens
ccaaauccauccauacauu

SEQ ID NO: 1177619 - RNA, 19 nt, Homo sapiens
caaagaauauuacccgaau

SEQ ID NO: 1177620 - RNA, 19 nt, Homo sapiens
gaauaggagucucauagau

SEQ ID NO: 1177621 - RNA, 19 nt, Homo sapiens
ucacggauguugaguuuga

SEQ ID NO: 1177622 - RNA, 19 nt, Homo sapiens
uggaggaucuauuaugaua

SEQ ID NO: 1177623 - RNA, 19 nt, Homo sapiens
gcaacuggcucaggcauau

SEQ ID NO: 1177624 - RNA, 19 nt, Homo sapiens
gaugaaaacuucuggauga

SEQ ID NO: 1177625 - RNA, 19 nt, Homo sapiens
caaccucaccuacagaaua

SEQ ID NO: 1177626 - RNA, 19 nt, Homo sapiens
gagauaagauucugguuuu

SEQ ID NO: 1177627 - RNA, 19 nt, Homo sapiens
uaucacggauguugaguuu

SEQ ID NO: 1177628 - RNA, 19 nt, Homo sapiens
caaagucacuccacuaaaa

SEQ ID NO: 1177629 - RNA, 19 nt, Homo sapiens
cauaagaguuuaagcuugu

SEQ ID NO: 1177630 - RNA, 19 nt, Homo sapiens
gaacuaauacuugguuuca

SEQ ID NO: 1177631 - RNA, 19 nt, Homo sapiens
cagaggauaugcugucuug

SEQ ID NO: 1177632 - RNA, 19 nt, Homo sapiens
ggauguugaguuugaauua

SEQ ID NO: 1177633 - RNA, 19 nt, Homo sapiens
gaggaucuauuaugauauc

SEQ ID NO: 1177634 - RNA, 19 nt, Homo sapiens
gagcaggauucaacuuguu

SEQ ID NO: 1177635 - RNA, 19 nt, Homo sapiens
gcaaagaaccaaagaacuc

SEQ ID NO: 1177636 - RNA, 19 nt, Homo sapiens
cgaaucaugagaacuaaua

SEQ ID NO: 1177637 - RNA, 19 nt, Homo sapiens
caaauccauccauacauua

SEQ ID NO: 1177638 - RNA, 19 nt, Homo sapiens
aggcauaucucaaccaguu

SEQ ID NO: 1177639 - RNA, 19 nt, Homo sapiens
gaauauuacccgaaucaug

SEQ ID NO: 1177640 - RNA, 19 nt, Homo sapiens
gcaauuugaauacgacauu

SEQ ID NO: 1177641 - RNA, 19 nt, Homo sapiens
gugauaagaccacaagaaa

SEQ ID NO: 1177642 - RNA, 19 nt, Homo sapiens
ggaauccaguccaucuaug

SEQ ID NO: 1177643 - RNA, 19 nt, Homo sapiens
gagcaaagucacuccacua

SEQ ID NO: 1177644 - RNA, 19 nt, Homo sapiens
gagaacuaauacuugguuu

SEQ ID NO: 1177645 - RNA, 19 nt, Homo sapiens
caagaagguuuagaagugu

SEQ ID NO: 1177646 - RNA, 19 nt, Homo sapiens
aauauuacccgaaucauga

SEQ ID NO: 1177647 - RNA, 19 nt, Homo sapiens
uguggaggaucuauuauga

SEQ ID NO: 1177648 - RNA, 19 nt, Homo sapiens
ggagcaggauucaacuugu

SEQ ID NO: 1177649 - RNA, 19 nt, Homo sapiens
gaaaacuucuggaugauca

SEQ ID NO: 1177650 - RNA, 19 nt, Homo sapiens
gcaaagucacuccacuaaa

SEQ ID NO: 1177651 - RNA, 19 nt, Homo sapiens
gaaauagaagggaaucauc

SEQ ID NO: 1177652 - RNA, 19 nt, Homo sapiens
ggaaucaguauccguguug

SEQ ID NO: 1177653 - RNA, 19 nt, Homo sapiens
gccuugauguucccaaauu

SEQ ID NO: 1177654 - RNA, 19 nt, Homo sapiens
uaaacuauacuccggauau

SEQ ID NO: 1177655 - RNA, 19 nt, Homo sapiens
aaccucaccuacagaauaa

SEQ ID NO: 1177656 - RNA, 19 nt, Homo sapiens
caaacacccuugagaucau

SEQ ID NO: 1177657 - RNA, 19 nt, Homo sapiens
gaaaauacaaccucaccua

SEQ ID NO: 1177658 - RNA, 19 nt, Homo sapiens
guucaaagcaagaauagga

SEQ ID NO: 1177659 - RNA, 19 nt, Homo sapiens
agaagggaaucaucuuguu

SEQ ID NO: 1177660 - RNA, 19 nt, Homo sapiens
caggaggcauaaagauauu

SEQ ID NO: 1177661 - RNA, 19 nt, Homo sapiens
uaucccaaauccauccaua

SEQ ID NO: 1177662 - RNA, 19 nt, Homo sapiens
gaagggaaucaucuuguuc

SEQ ID NO: 1177663 - RNA, 19 nt, Homo sapiens
gaauacgacauuaagacaa

SEQ ID NO: 1177664 - RNA, 19 nt, Homo sapiens
gcuggagguuugaugaaau

SEQ ID NO: 1177665 - RNA, 19 nt, Homo sapiens
gcagccgucugugauaaga

SEQ ID NO: 1177666 - RNA, 19 nt, Homo sapiens
ccuugauguucccaaauua

SEQ ID NO: 1177667 - RNA, 19 nt, Homo sapiens
ggcacgagcugcuguggau

SEQ ID NO: 1177668 - RNA, 19 nt, Homo sapiens
ucacuccaaugaucaaaca

SEQ ID NO: 1177669 - RNA, 19 nt, Homo sapiens
uguggcugcucaugaauuu

SEQ ID NO: 1177670 - RNA, 19 nt, Homo sapiens
ccacuaaaauucaccaaga

SEQ ID NO: 1177671 - RNA, 19 nt, Homo sapiens
ucaggaggcauaaagauau

SEQ ID NO: 1177672 - RNA, 19 nt, Homo sapiens
gccaaaggaacccacuaua

SEQ ID NO: 1177673 - RNA, 19 nt, Homo sapiens
gaaucaguauccguguuga

SEQ ID NO: 1177674 - RNA, 19 nt, Homo sapiens
gaugcagccgucugugaua

SEQ ID NO: 1177675 - RNA, 19 nt, Homo sapiens
uaugcugucuugccagauu

SEQ ID NO: 1177676 - RNA, 19 nt, Homo sapiens
agagauaagauucugguuu

SEQ ID NO: 1177677 - RNA, 19 nt, Homo sapiens
ccaaaggaacccacuauac

SEQ ID NO: 1177678 - RNA, 19 nt, Homo sapiens
aaacuauacuccggauaug

SEQ ID NO: 1177679 - RNA, 19 nt, Homo sapiens
gcacauucaggaggcauaa

SEQ ID NO: 1177680 - RNA, 19 nt, Homo sapiens
gaaguguggagcaaaguca

SEQ ID NO: 1177681 - RNA, 19 nt, Homo sapiens
caagaauaggagucucaua

SEQ ID NO: 1177682 - RNA, 19 nt, Homo sapiens
ccgcagagaaguaauguuc

SEQ ID NO: 1177683 - RNA, 19 nt, Homo sapiens
cucaacaggucuuuuaaua

SEQ ID NO: 1177684 - RNA, 19 nt, Homo sapiens
aagaacuccucauuugguu

SEQ ID NO: 1177685 - RNA, 19 nt, Homo sapiens
uauccaagaagguuuagaa

SEQ ID NO: 1177686 - RNA, 19 nt, Homo sapiens
ccucaccuacagaauaaua

SEQ ID NO: 1177687 - RNA, 19 nt, Homo sapiens
auacuugguuucaaugcaa

SEQ ID NO: 1177688 - RNA, 19 nt, Homo sapiens
ucacaacuuuccgcagaga

SEQ ID NO: 1177689 - RNA, 19 nt, Homo sapiens
ggauggagcaggauucaac

SEQ ID NO: 1177690 - RNA, 19 nt, Homo sapiens
gauugcagacaucaugauu

SEQ ID NO: 1177691 - RNA, 19 nt, Homo sapiens
aagaauaggagucucauag

SEQ ID NO: 1177692 - RNA, 19 nt, Homo sapiens
gaacuccucauuugguuuu

SEQ ID NO: 1177693 - RNA, 19 nt, Homo sapiens
aaccaaagaacuccucauu

SEQ ID NO: 1177694 - RNA, 19 nt, Homo sapiens
aggaugauaucaauggaau

SEQ ID NO: 1177695 - RNA, 19 nt, Homo sapiens
cagccuugauguucccaaa

SEQ ID NO: 1177696 - RNA, 19 nt, Homo sapiens
caaaggaacccacuauacc

SEQ ID NO: 1177697 - RNA, 19 nt, Homo sapiens
ucuuguggcugcucaugaa

SEQ ID NO: 1177698 - RNA, 19 nt, Homo sapiens
gauucaacuuguuucuugu

SEQ ID NO: 1177699 - RNA, 19 nt, Homo sapiens
gggaaucaucuuguucaaa

SEQ ID NO: 1177700 - RNA, 19 nt, Homo sapiens
aaagaacuccucauuuggu

SEQ ID NO: 1177701 - RNA, 19 nt, Homo sapiens
ccaguucuacucucuugaa

SEQ ID NO: 1177702 - RNA, 19 nt, Homo sapiens
gacaucaugauugccuuua

SEQ ID NO: 1177703 - RNA, 19 nt, Homo sapiens
gaugaaaugacccaaacca

SEQ ID NO: 1177704 - RNA, 19 nt, Homo sapiens
uaugauaucacggauguug

SEQ ID NO: 1177705 - RNA, 19 nt, Homo sapiens
agaauaggagucucauaga

SEQ ID NO: 1177706 - RNA, 19 nt, Homo sapiens
caucaugauugccuuuagg

SEQ ID NO: 1177707 - RNA, 19 nt, Homo sapiens
uuagaaguguggagcaaag

SEQ ID NO: 1177708 - RNA, 19 nt, Homo sapiens
ugagaacuaauacuugguu

SEQ ID NO: 1177709 - RNA, 19 nt, Homo sapiens
ugaauacgacauuaagaca

SEQ ID NO: 1177710 - RNA, 19 nt, Homo sapiens
auuaugauaucacggaugu

SEQ ID NO: 1177711 - RNA, 19 nt, Homo sapiens
aauaggagucucauagaug

SEQ ID NO: 1177712 - RNA, 19 nt, Homo sapiens
aaccaguucuacucucuug

SEQ ID NO: 1177713 - RNA, 19 nt, Homo sapiens
cuacucucuugaaauagaa

SEQ ID NO: 1177714 - RNA, 19 nt, Homo sapiens
cgaaugaaaucuacucuga

SEQ ID NO: 1177715 - RNA, 19 nt, Homo sapiens
ugaauuaccuucuuagcaa

SEQ ID NO: 1177716 - RNA, 19 nt, Homo sapiens
gaagaacggaggauauauu

SEQ ID NO: 1177717 - RNA, 19 nt, Homo sapiens
ggaaagagacaagcauaaa

SEQ ID NO: 1177718 - RNA, 19 nt, Homo sapiens
guaaauauggaccucaaua

SEQ ID NO: 1177719 - RNA, 19 nt, Homo sapiens
ucucagaacccaucaauuu

SEQ ID NO: 1177720 - RNA, 19 nt, Homo sapiens
gaacggaggauauauuugg

SEQ ID NO: 1177721 - RNA, 19 nt, Homo sapiens
agaauugacugccauaugu

SEQ ID NO: 1177722 - RNA, 19 nt, Homo sapiens
cgacaaggcauccaucauu

SEQ ID NO: 1177723 - RNA, 19 nt, Homo sapiens
ggauauauuuggauacagu

SEQ ID NO: 1177724 - RNA, 19 nt, Homo sapiens
gaaaucuacucugaccaaa

SEQ ID NO: 1177725 - RNA, 19 nt, Homo sapiens
gagacaagcauaaacaaug

SEQ ID NO: 1177726 - RNA, 19 nt, Homo sapiens
caucaaaucaucaggauau

SEQ ID NO: 1177727 - RNA, 19 nt, Homo sapiens
gacaaggcauccaucauuc

SEQ ID NO: 1177728 - RNA, 19 nt, Homo sapiens
guucgucacucgaguaaau

SEQ ID NO: 1177729 - RNA, 19 nt, Homo sapiens
gaggauauauuuggauaca

SEQ ID NO: 1177730 - RNA, 19 nt, Homo sapiens
gcagcagugucuuugacua

SEQ ID NO: 1177731 - RNA, 19 nt, Homo sapiens
caaaugaaauagggugguu

SEQ ID NO: 1177732 - RNA, 19 nt, Homo sapiens
ccaccuaacacaucaguaa

SEQ ID NO: 1177733 - RNA, 19 nt, Homo sapiens
gacuuauucuuucguguaa

SEQ ID NO: 1177734 - RNA, 19 nt, Homo sapiens
cggaggauauauuuggaua

SEQ ID NO: 1177735 - RNA, 19 nt, Homo sapiens
gcagaagaacggaggauau

SEQ ID NO: 1177736 - RNA, 19 nt, Homo sapiens
gcgagaacguuuacaagca

SEQ ID NO: 1177737 - RNA, 19 nt, Homo sapiens
gauaugaucaagauggaaa

SEQ ID NO: 1177738 - RNA, 19 nt, Homo sapiens
gaguaaauauggaccucaa

SEQ ID NO: 1177739 - RNA, 19 nt, Homo sapiens
agacaagcauaaacaaugu

SEQ ID NO: 1177740 - RNA, 19 nt, Homo sapiens
cagaagaacggaggauaua

SEQ ID NO: 1177741 - RNA, 19 nt, Homo sapiens
gaucaaugaagucagaauu

SEQ ID NO: 1177742 - RNA, 19 nt, Homo sapiens
ccagugcacuagccauuga

SEQ ID NO: 1177743 - RNA, 19 nt, Homo sapiens
gcauccaucauucgacuua

SEQ ID NO: 1177744 - RNA, 19 nt, Homo sapiens
gaauuaccuucuuagcaau

SEQ ID NO: 1177745 - RNA, 19 nt, Homo sapiens
cauagaauacucagucuug

SEQ ID NO: 1177746 - RNA, 19 nt, Homo sapiens
aaucaugggucucgugguu

SEQ ID NO: 1177747 - RNA, 19 nt, Homo sapiens
ucaccugacuuauucuuuc

SEQ ID NO: 1177748 - RNA, 19 nt, Homo sapiens
ccaucaauuucgacaauga

SEQ ID NO: 1177749 - RNA, 19 nt, Homo sapiens
cacuuggacuugcugaaua

SEQ ID NO: 1177750 - RNA, 19 nt, Homo sapiens
ccgaaacagucuccaucua

SEQ ID NO: 1177751 - RNA, 19 nt, Homo sapiens
ggaaggcccuccaccuaac

SEQ ID NO: 1177752 - RNA, 19 nt, Homo sapiens
gcagugucuuugacuaugu

SEQ ID NO: 1177753 - RNA, 19 nt, Homo sapiens
gaaagagacaagcauaaac

SEQ ID NO: 1177754 - RNA, 19 nt, Homo sapiens
ugaucaagauggaaagaga

SEQ ID NO: 1177755 - RNA, 19 nt, Homo sapiens
ggaccucaauaucauuuac

SEQ ID NO: 1177756 - RNA, 19 nt, Homo sapiens
gagaacguuuacaagcauu

SEQ ID NO: 1177757 - RNA, 19 nt, Homo sapiens
gcacuagccauugaaguau

SEQ ID NO: 1177758 - RNA, 19 nt, Homo sapiens
cuuaauuucuggccuguga

SEQ ID NO: 1177759 - RNA, 19 nt, Homo sapiens
aauaucaucugggugaauu

SEQ ID NO: 1177760 - RNA, 19 nt, Homo sapiens
caaaucaucaggauauaag

SEQ ID NO: 1177761 - RNA, 19 nt, Homo sapiens
ugacuuauucuuucgugua

SEQ ID NO: 1177762 - RNA, 19 nt, Homo sapiens
ggagaaaucccgagaugcu

SEQ ID NO: 1177763 - RNA, 19 nt, Homo sapiens
ugggugaauuaccuucuua

SEQ ID NO: 1177764 - RNA, 19 nt, Homo sapiens
guagauaucguagggaaga

SEQ ID NO: 1177765 - RNA, 19 nt, Homo sapiens
ucuaugaauuggccaaguu

SEQ ID NO: 1177766 - RNA, 19 nt, Homo sapiens
aaugugcccuguuugacua

SEQ ID NO: 1177767 - RNA, 19 nt, Homo sapiens
ggagaaaacuuccgaaucc

SEQ ID NO: 1177768 - RNA, 19 nt, Homo sapiens
aaggagaaaucccgagaug

SEQ ID NO: 1177769 - RNA, 19 nt, Homo sapiens
gcuaaccacugacaacacu

SEQ ID NO: 1177770 - RNA, 19 nt, Homo sapiens
gccugugacuagaauguuu

SEQ ID NO: 1177771 - RNA, 19 nt, Homo sapiens
uggaggcgcugcagagguu

SEQ ID NO: 1177772 - RNA, 19 nt, Homo sapiens
cgagaacguuuacaagcau

SEQ ID NO: 1177773 - RNA, 19 nt, Homo sapiens
uuacaagcauugagaaagg

SEQ ID NO: 1177774 - RNA, 19 nt, Homo sapiens
cuggauggcuuuguauuug

SEQ ID NO: 1177775 - RNA, 19 nt, Homo sapiens
ugaaguauuugaagcacau

SEQ ID NO: 1177776 - RNA, 19 nt, Homo sapiens
cagcuagccugacgcagau

SEQ ID NO: 1177777 - RNA, 19 nt, Homo sapiens
ccaagacgcccauggagau

SEQ ID NO: 1177778 - RNA, 19 nt, Homo sapiens
gaucucagaacccaucaau

SEQ ID NO: 1177779 - RNA, 19 nt, Homo sapiens
uuacagaggacaacgagaa

SEQ ID NO: 1177780 - RNA, 19 nt, Homo sapiens
aagaacggaggauauauuu

SEQ ID NO: 1177781 - RNA, 19 nt, Homo sapiens
ugaauaagggucagugugu

SEQ ID NO: 1177782 - RNA, 19 nt, Homo sapiens
aaagagacaagcauaaaca

SEQ ID NO: 1177783 - RNA, 19 nt, Homo sapiens
ggaggcaucgucggcauuu

SEQ ID NO: 1177784 - RNA, 19 nt, Homo sapiens
acaacgacaugaacugcaa

SEQ ID NO: 1177785 - RNA, 19 nt, Homo sapiens
gaauugacugccauauguu

SEQ ID NO: 1177786 - RNA, 19 nt, Homo sapiens
gcuuuccuuugcaucuuua

SEQ ID NO: 1177787 - RNA, 19 nt, Homo sapiens
ccauggagaugcucuacca

SEQ ID NO: 1177788 - RNA, 19 nt, Homo sapiens
ccaacgcgcacgcuguuaa

SEQ ID NO: 1177789 - RNA, 19 nt, Homo sapiens
ccacugacaacacucuuga

SEQ ID NO: 1177790 - RNA, 19 nt, Homo sapiens
gcaccagaagcgcaagaaa

SEQ ID NO: 1177791 - RNA, 19 nt, Homo sapiens
gccaagaaugcaaaugaaa

SEQ ID NO: 1177792 - RNA, 19 nt, Homo sapiens
gugccaccauagcuauuaa

SEQ ID NO: 1177793 - RNA, 19 nt, Homo sapiens
ugaaaucuacucugaccaa

SEQ ID NO: 1177794 - RNA, 19 nt, Homo sapiens
gucccuggauggcuuugua

SEQ ID NO: 1177795 - RNA, 19 nt, Homo sapiens
ccauugggguuucuucaua

SEQ ID NO: 1177796 - RNA, 19 nt, Homo sapiens
ucauucgacuuacaauuag

SEQ ID NO: 1177797 - RNA, 19 nt, Homo sapiens
gaacguuuacaagcauuga

SEQ ID NO: 1177798 - RNA, 19 nt, Homo sapiens
ucuuucaccugacuuauuc

SEQ ID NO: 1177799 - RNA, 19 nt, Homo sapiens
ccucggugcucaagaucaa

SEQ ID NO: 1177800 - RNA, 19 nt, Homo sapiens
ggccacagcuccaguaacc

SEQ ID NO: 1177801 - RNA, 19 nt, Homo sapiens
ugaauuggccaaguuguug

SEQ ID NO: 1177802 - RNA, 19 nt, Homo sapiens
uacgaucaaugaagucaga

SEQ ID NO: 1177803 - RNA, 19 nt, Homo sapiens
caaacgcggugugcacauc

SEQ ID NO: 1177804 - RNA, 19 nt, Homo sapiens
gccaaguuguugccucuuc

SEQ ID NO: 1177805 - RNA, 19 nt, Homo sapiens
ugccaagaaugcaaaugaa

SEQ ID NO: 1177806 - RNA, 19 nt, Homo sapiens
cgaaacagucuccaucuac

SEQ ID NO: 1177807 - RNA, 19 nt, Homo sapiens
cagaacccaucaauuucga

SEQ ID NO: 1177808 - RNA, 19 nt, Homo sapiens
ggacacacccauggacauc

SEQ ID NO: 1177809 - RNA, 19 nt, Homo sapiens
acuuggacuugcugaauaa

SEQ ID NO: 1177810 - RNA, 19 nt, Homo sapiens
cagaauugacugccauaug

SEQ ID NO: 1177811 - RNA, 19 nt, Homo sapiens
acuagccauugaaguauuu

SEQ ID NO: 1177812 - RNA, 19 nt, Homo sapiens
gcuauuaaugccaagaaug

SEQ ID NO: 1177813 - RNA, 19 nt, Homo sapiens
acaguccagugccaccaua

SEQ ID NO: 1177814 - RNA, 19 nt, Homo sapiens
gagaagagcuggaucacua

SEQ ID NO: 1177815 - RNA, 19 nt, Homo sapiens
gcacggagcugaacgauga

SEQ ID NO: 1177816 - RNA, 19 nt, Homo sapiens
gaagaucacucucaucaau

SEQ ID NO: 1177817 - RNA, 19 nt, Homo sapiens
ggacaucgaugacaacgaa

SEQ ID NO: 1177818 - RNA, 19 nt, Homo sapiens
gaaagucaaugucaaugaa

SEQ ID NO: 1177819 - RNA, 19 nt, Homo sapiens
ccaaagagcuggacuacga

SEQ ID NO: 1177820 - RNA, 19 nt, Homo sapiens
ggacaaggaugagaauuug

SEQ ID NO: 1177821 - RNA, 19 nt, Homo sapiens
gcacaagcguguaugagaa

SEQ ID NO: 1177822 - RNA, 19 nt, Homo sapiens
gaacgagccuucugucaca

SEQ ID NO: 1177823 - RNA, 19 nt, Homo sapiens
gauuaugacuugcuucuga

SEQ ID NO: 1177824 - RNA, 19 nt, Homo sapiens
gaacaacucccaccacuuc

SEQ ID NO: 1177825 - RNA, 19 nt, Homo sapiens
gaacaagcauucucuccau

SEQ ID NO: 1177826 - RNA, 19 nt, Homo sapiens
ccaaugggcugauuuaucu

SEQ ID NO: 1177827 - RNA, 19 nt, Homo sapiens
aaacagaagugacugaugu

SEQ ID NO: 1177828 - RNA, 19 nt, Homo sapiens
ggaggccucucgcuucuuu

SEQ ID NO: 1177829 - RNA, 19 nt, Homo sapiens
caacgacucugaagaugug

SEQ ID NO: 1177830 - RNA, 19 nt, Homo sapiens
ggucaggugucaucauuga

SEQ ID NO: 1177831 - RNA, 19 nt, Homo sapiens
gaggucaggugucaucauu

SEQ ID NO: 1177832 - RNA, 19 nt, Homo sapiens
ugaauuaccuggacuacga

SEQ ID NO: 1177833 - RNA, 19 nt, Homo sapiens
gaccaagucugaauacauc

SEQ ID NO: 1177834 - RNA, 19 nt, Homo sapiens
ggacaucaaugacaacaac

SEQ ID NO: 1177835 - RNA, 19 nt, Homo sapiens
gcacagggcuuaucaucac

SEQ ID NO: 1177836 - RNA, 19 nt, Homo sapiens
gaagaaggaccacuauauc

SEQ ID NO: 1177837 - RNA, 19 nt, Homo sapiens
ccacggugcuugugaaugu

SEQ ID NO: 1177838 - RNA, 19 nt, Homo sapiens
gagcagcuacggaaucuuu

SEQ ID NO: 1177839 - RNA, 19 nt, Homo sapiens
ggaugaaggucccaaugga

SEQ ID NO: 1177840 - RNA, 19 nt, Homo sapiens
ccaacgcgaucguguacua

SEQ ID NO: 1177841 - RNA, 19 nt, Homo sapiens
uuaaugggcuggucaccua

SEQ ID NO: 1177842 - RNA, 19 nt, Homo sapiens
gagcuggucuaccgaauag

SEQ ID NO: 1177843 - RNA, 19 nt, Homo sapiens
caggagggauuaugacuug

SEQ ID NO: 1177844 - RNA, 19 nt, Homo sapiens
gcgucaagaucgucauuaa

SEQ ID NO: 1177845 - RNA, 19 nt, Homo sapiens
ccacucagcuccacaaugc

SEQ ID NO: 1177846 - RNA, 19 nt, Homo sapiens
ggaaggcuccacccaguuu

SEQ ID NO: 1177847 - RNA, 19 nt, Homo sapiens
cccaagacauggacaauga

SEQ ID NO: 1177848 - RNA, 19 nt, Homo sapiens
caucugaccucuaccuuca

SEQ ID NO: 1177849 - RNA, 19 nt, Homo sapiens
cagcugagaucccugucua

SEQ ID NO: 1177850 - RNA, 19 nt, Homo sapiens
gcacagccauugucaccau

SEQ ID NO: 1177851 - RNA, 19 nt, Homo sapiens
ggaccuuccuggcccauga

SEQ ID NO: 1177852 - RNA, 19 nt, Homo sapiens
ugaaugacaucaacgacaa

SEQ ID NO: 1177853 - RNA, 19 nt, Homo sapiens
ugacagugguggcagauga

SEQ ID NO: 1177854 - RNA, 19 nt, Homo sapiens
guccaagucucgcuacauu

SEQ ID NO: 1177855 - RNA, 19 nt, Homo sapiens
gcacagaauccgccaaauc

SEQ ID NO: 1177856 - RNA, 19 nt, Homo sapiens
ccaggaguaugacaacauu

SEQ ID NO: 1177857 - RNA, 19 nt, Homo sapiens
gcacaaucauccugacagu

SEQ ID NO: 1177858 - RNA, 19 nt, Homo sapiens
ggacagagagaccaaguca

SEQ ID NO: 1177859 - RNA, 19 nt, Homo sapiens
gaacguggguggagguacu

SEQ ID NO: 1177860 - RNA, 19 nt, Homo sapiens
caacguggaugggaaguuc

SEQ ID NO: 1177861 - RNA, 19 nt, Homo sapiens
ggaaggacgcacccuacua

SEQ ID NO: 1177862 - RNA, 19 nt, Homo sapiens
gggcugccauccaggagua

SEQ ID NO: 1177863 - RNA, 19 nt, Homo sapiens
gagaagaaggaccacuaua

SEQ ID NO: 1177864 - RNA, 19 nt, Homo sapiens
ucacugugcuggacgagaa

SEQ ID NO: 1177865 - RNA, 19 nt, Homo sapiens
cuacgacuuugaucucuuu

SEQ ID NO: 1177866 - RNA, 19 nt, Homo sapiens
gcggagugcugaccuugaa

SEQ ID NO: 1177867 - RNA, 19 nt, Homo sapiens
ccaaaugugugcccagcuu

SEQ ID NO: 1177868 - RNA, 19 nt, Homo sapiens
gcgagcggaucccagagua

SEQ ID NO: 1177869 - RNA, 19 nt, Homo sapiens
ggacuaugagggaccauuu

SEQ ID NO: 1177870 - RNA, 19 nt, Homo sapiens
cagaucaccuacagcauug

SEQ ID NO: 1177871 - RNA, 19 nt, Homo sapiens
agacagaacugcuuaucca

SEQ ID NO: 1177872 - RNA, 19 nt, Homo sapiens
caacagccuugucuucuac

SEQ ID NO: 1177873 - RNA, 19 nt, Homo sapiens
ggaucaauguguuggaugu

SEQ ID NO: 1177874 - RNA, 19 nt, Homo sapiens
caaccgcccugucuuugug

SEQ ID NO: 1177875 - RNA, 19 nt, Homo sapiens
ccacggugcuguuccugaa

SEQ ID NO: 1177876 - RNA, 19 nt, Homo sapiens
ggaaaucguggacaucaau

SEQ ID NO: 1177877 - RNA, 19 nt, Homo sapiens
ugucaucacugcugccaaa

SEQ ID NO: 1177878 - RNA, 19 nt, Homo sapiens
gacgagagcacagggcuua

SEQ ID NO: 1177879 - RNA, 19 nt, Homo sapiens
gaccacagccgccuacaug

SEQ ID NO: 1177880 - RNA, 19 nt, Homo sapiens
caagaaagucaaugucaau

SEQ ID NO: 1177881 - RNA, 19 nt, Homo sapiens
guacagccuuggagaugga

SEQ ID NO: 1177882 - RNA, 19 nt, Homo sapiens
gaggacgccuuugcuguga

SEQ ID NO: 1177883 - RNA, 19 nt, Homo sapiens
ggucauccguguugguaau

SEQ ID NO: 1177884 - RNA, 19 nt, Homo sapiens
gggagaccaucgccuucua

SEQ ID NO: 1177885 - RNA, 19 nt, Homo sapiens
ggacgcacccuacuacauc

SEQ ID NO: 1177886 - RNA, 19 nt, Homo sapiens
acaagaaagucaaugucaa

SEQ ID NO: 1177887 - RNA, 19 nt, Homo sapiens
gaugaucgaugagaacaag

SEQ ID NO: 1177888 - RNA, 19 nt, Homo sapiens
agaagaaggaccacuauau

SEQ ID NO: 1177889 - RNA, 19 nt, Homo sapiens
ucaccauucugaucgauga

SEQ ID NO: 1177890 - RNA, 19 nt, Homo sapiens
gaauaccaacagcaucuuu

SEQ ID NO: 1177891 - RNA, 19 nt, Homo sapiens
caacaaguacuccuuugau

SEQ ID NO: 1177892 - RNA, 19 nt, Homo sapiens
ggagcuggucuaccgaaua

SEQ ID NO: 1177893 - RNA, 19 nt, Homo sapiens
gaguacaagcugaccauuu

SEQ ID NO: 1177894 - RNA, 19 nt, Homo sapiens
ugaacggccugguguccua

SEQ ID NO: 1177895 - RNA, 19 nt, Homo sapiens
ccagaucaccuacagcauu

SEQ ID NO: 1177896 - RNA, 19 nt, Homo sapiens
caacuuggccaucaucauc

SEQ ID NO: 1177897 - RNA, 19 nt, Homo sapiens
caagcauucucuccauuuc

SEQ ID NO: 1177898 - RNA, 19 nt, Homo sapiens
gaacuuugcgcagacagaa

SEQ ID NO: 1177899 - RNA, 19 nt, Homo sapiens
caaggugggcucagaguug

SEQ ID NO: 1177900 - RNA, 19 nt, Homo sapiens
gcaccucggucaucaccau

SEQ ID NO: 1177901 - RNA, 19 nt, Homo sapiens
ggagaagaaggaccacuau

SEQ ID NO: 1177902 - RNA, 19 nt, Homo sapiens
accaaccacuucuuugaua

SEQ ID NO: 1177903 - RNA, 19 nt, Homo sapiens
aguacaagcugaccauuuc

SEQ ID NO: 1177904 - RNA, 19 nt, Homo sapiens
gauacaaugucagugugaa

SEQ ID NO: 1177905 - RNA, 19 nt, Homo sapiens
gcgaguggcuacugucaag

SEQ ID NO: 1177906 - RNA, 19 nt, Homo sapiens
ggaaguucagcguggguua

SEQ ID NO: 1177907 - RNA, 19 nt, Homo sapiens
gcauggacuuccucaucaa

SEQ ID NO: 1177908 - RNA, 19 nt, Homo sapiens
gaaggacgcacccuacuac

SEQ ID NO: 1177909 - RNA, 19 nt, Homo sapiens
ggccaaagcccucuucaag

SEQ ID NO: 1177910 - RNA, 19 nt, Homo sapiens
caaaucacguaccgcuuca

SEQ ID NO: 1177911 - RNA, 19 nt, Homo sapiens
gauauccaaugggcugauu

SEQ ID NO: 1177912 - RNA, 19 nt, Homo sapiens
ggaaggcggacauucguau

SEQ ID NO: 1177913 - RNA, 19 nt, Homo sapiens
caaguacuccuuugaugga

SEQ ID NO: 1177914 - RNA, 19 nt, Homo sapiens
gcacggagcugaacgauga

SEQ ID NO: 1177915 - RNA, 19 nt, Homo sapiens
gaagaucacucucaucaau

SEQ ID NO: 1177916 - RNA, 19 nt, Homo sapiens
ggacaaggaugagaauuug

SEQ ID NO: 1177917 - RNA, 19 nt, Homo sapiens
gaacaacucccaccacuuc

SEQ ID NO: 1177918 - RNA, 19 nt, Homo sapiens
ggaggccucucgcuucuuu

SEQ ID NO: 1177919 - RNA, 19 nt, Homo sapiens
caagggaccucagcaauca

SEQ ID NO: 1177920 - RNA, 19 nt, Homo sapiens
cccaagacauggacaauga

SEQ ID NO: 1177921 - RNA, 19 nt, Homo sapiens
ggacagagagaccaaguca

SEQ ID NO: 1177922 - RNA, 19 nt, Homo sapiens
ccaaaucccugagcugugu

SEQ ID NO: 1177923 - RNA, 19 nt, Homo sapiens
cuacgacuuugaucucuuu

SEQ ID NO: 1177924 - RNA, 19 nt, Homo sapiens
gcggagugcugaccuugaa

SEQ ID NO: 1177925 - RNA, 19 nt, Homo sapiens
gaauaccaacagcaucuuu

SEQ ID NO: 1177926 - RNA, 19 nt, Homo sapiens
caacuuggccaucaucauc

SEQ ID NO: 1177927 - RNA, 19 nt, Homo sapiens
accaaccacuucuuugaua

SEQ ID NO: 1177928 - RNA, 19 nt, Homo sapiens
ggaaggcggacauucguau

SEQ ID NO: 1177929 - RNA, 19 nt, Homo sapiens
gaccuucaauauccugguu

SEQ ID NO: 1177930 - RNA, 19 nt, Homo sapiens
acagagagaccaagucaga

SEQ ID NO: 1177931 - RNA, 19 nt, Homo sapiens
gacaagaccaggccucugu

SEQ ID NO: 1177932 - RNA, 19 nt, Homo sapiens
ccacuucuuugauacauac

SEQ ID NO: 1177933 - RNA, 19 nt, Homo sapiens
ggucaacgccacagaucaa

SEQ ID NO: 1177934 - RNA, 19 nt, Homo sapiens
gaaggugaacauccagguu

SEQ ID NO: 1177935 - RNA, 19 nt, Homo sapiens
guucuucugugacccaguu

SEQ ID NO: 1177936 - RNA, 19 nt, Homo sapiens
ucaccaaccacuucuuuga

SEQ ID NO: 1177937 - RNA, 19 nt, Homo sapiens
gagugugccugaccaugug

SEQ ID NO: 1177938 - RNA, 19 nt, Homo sapiens
ucaccacgaccuucaauau

SEQ ID NO: 1177939 - RNA, 19 nt, Homo sapiens
gaaggcggacauucguauu

SEQ ID NO: 1177940 - RNA, 19 nt, Homo sapiens
auacauaccugcugaucag

SEQ ID NO: 1177941 - RNA, 19 nt, Homo sapiens
gcagcguccucuacuccuu

SEQ ID NO: 1177942 - RNA, 19 nt, Homo sapiens
ggacacgccuguggguucu

SEQ ID NO: 1177943 - RNA, 19 nt, Homo sapiens
uggacaaggaugagaauuu

SEQ ID NO: 1177944 - RNA, 19 nt, Homo sapiens
ggcagccacuggacagaga

SEQ ID NO: 1177945 - RNA, 19 nt, Homo sapiens
ccaagggaccucagcaauc

SEQ ID NO: 1177946 - RNA, 19 nt, Homo sapiens
ugaaccggcugcccuucuu

SEQ ID NO: 1177947 - RNA, 19 nt, Homo sapiens
ccuguggguucuucuguga

SEQ ID NO: 1177948 - RNA, 19 nt, Homo sapiens
caccaucguuucagggaau

SEQ ID NO: 1177949 - RNA, 19 nt, Homo sapiens
gcuacgacuuugaucucuu

SEQ ID NO: 1177950 - RNA, 19 nt, Homo sapiens
ggaacaacucccaccacuu

SEQ ID NO: 1177951 - RNA, 19 nt, Homo sapiens
gcgcccacauuucacaauc

SEQ ID NO: 1177952 - RNA, 19 nt, Homo sapiens
gagagaccaagucagaguu

SEQ ID NO: 1177953 - RNA, 19 nt, Homo sapiens
gauacauaccugcugauca

SEQ ID NO: 1177954 - RNA, 19 nt, Homo sapiens
ggagugcugaccuugaaug

SEQ ID NO: 1177955 - RNA, 19 nt, Homo sapiens
gggaauaccaacagcaucu

SEQ ID NO: 1177956 - RNA, 19 nt, Homo sapiens
cgccacagaucaagacaag

SEQ ID NO: 1177957 - RNA, 19 nt, Homo sapiens
ggacgcccaucuucaucgu

SEQ ID NO: 1177958 - RNA, 19 nt, Homo sapiens
ccgcaucccugagaauaca

SEQ ID NO: 1177959 - RNA, 19 nt, Homo sapiens
gccagccacuguacaacau

SEQ ID NO: 1177960 - RNA, 19 nt, Homo sapiens
ccacagaucaagacaagac

SEQ ID NO: 1177961 - RNA, 19 nt, Homo sapiens
ccaaccacuucuuugauac

SEQ ID NO: 1177962 - RNA, 19 nt, Homo sapiens
ccagagggauuuuguccaa

SEQ ID NO: 1177963 - RNA, 19 nt, Homo sapiens
gggaaggcggacauucgua

SEQ ID NO: 1177964 - RNA, 19 nt, Homo sapiens
gcuuugcccuuccacucuu

SEQ ID NO: 1177965 - RNA, 19 nt, Homo sapiens
ccauagaccaggauaaagg

SEQ ID NO: 1177966 - RNA, 19 nt, Homo sapiens
caacaucuacgagcauucu

SEQ ID NO: 1177967 - RNA, 19 nt, Homo sapiens
ccuaccagcucacggucaa

SEQ ID NO: 1177968 - RNA, 19 nt, Homo sapiens
gagaccaagucagaguuca

SEQ ID NO: 1177969 - RNA, 19 nt, Homo sapiens
gcgcgaugcuuggcuagag

SEQ ID NO: 1177970 - RNA, 19 nt, Homo sapiens
ggaccgcuacgacuuugau

SEQ ID NO: 1177971 - RNA, 19 nt, Homo sapiens
cgccauagaccaggauaaa

SEQ ID NO: 1177972 - RNA, 19 nt, Homo sapiens
gcgcaucaucaccgccaua

SEQ ID NO: 1177973 - RNA, 19 nt, Homo sapiens
uccgggagcuggacuacga

SEQ ID NO: 1177974 - RNA, 19 nt, Homo sapiens
acaucagccuguacgagaa

SEQ ID NO: 1177975 - RNA, 19 nt, Homo sapiens
caucaucaccgccauagac

SEQ ID NO: 1177976 - RNA, 19 nt, Homo sapiens
cagccacuguacaacauca

SEQ ID NO: 1177977 - RNA, 19 nt, Homo sapiens
caacucccaccacuucauc

SEQ ID NO: 1177978 - RNA, 19 nt, Homo sapiens
ucaucaaccugccuuacag

SEQ ID NO: 1177979 - RNA, 19 nt, Homo sapiens
uguccacccuggccaacuu

SEQ ID NO: 1177980 - RNA, 19 nt, Homo sapiens
ggaauaccaacagcaucuu

SEQ ID NO: 1177981 - RNA, 19 nt, Homo sapiens
guccgcaucccugagaaua

SEQ ID NO: 1177982 - RNA, 19 nt, Homo sapiens
gaaccggcugcccuucuuc

SEQ ID NO: 1177983 - RNA, 19 nt, Homo sapiens
caaccacuucuuugauaca

SEQ ID NO: 1177984 - RNA, 19 nt, Homo sapiens
uuugaucucuuugccaaug

SEQ ID NO: 1177985 - RNA, 19 nt, Homo sapiens
gaguacagcguggccauca

SEQ ID NO: 1177986 - RNA, 19 nt, Homo sapiens
cauagaccaggauaaagga

SEQ ID NO: 1177987 - RNA, 19 nt, Homo sapiens
guggaccgcuacgacuuug

SEQ ID NO: 1177988 - RNA, 19 nt, Homo sapiens
cuucaccaaccacuucuuu

SEQ ID NO: 1177989 - RNA, 19 nt, Homo sapiens
gagaauuugggccugaaca

SEQ ID NO: 1177990 - RNA, 19 nt, Homo sapiens
ccuucaauauccugguuau

SEQ ID NO: 1177991 - RNA, 19 nt, Homo sapiens
ggcuucauccugacuguga

SEQ ID NO: 1177992 - RNA, 19 nt, Homo sapiens
cacggaaggugaacaucca

SEQ ID NO: 1177993 - RNA, 19 nt, Homo sapiens
gcuaugccaaggugaagau

SEQ ID NO: 1177994 - RNA, 19 nt, Homo sapiens
cagcauguuugagguguac

SEQ ID NO: 1177995 - RNA, 19 nt, Homo sapiens
uuacagcaccaacaucuac

SEQ ID NO: 1177996 - RNA, 19 nt, Homo sapiens
acagcauguuugaggugua

SEQ ID NO: 1177997 - RNA, 19 nt, Homo sapiens
gugcugaucucuggaugcu

SEQ ID NO: 1177998 - RNA, 19 nt, Homo sapiens
ggagaccucuggccugaug

SEQ ID NO: 1177999 - RNA, 19 nt, Homo sapiens
ggaguccgcucagaauuug

SEQ ID NO: 1178000 - RNA, 19 nt, Homo sapiens
gcaguaaacuccaccuaac

SEQ ID NO: 1178001 - RNA, 19 nt, Homo sapiens
gcucagaauuugaucagau

SEQ ID NO: 1178002 - RNA, 19 nt, Homo sapiens
ugaaggcgcuugaguaugc

SEQ ID NO: 1178003 - RNA, 19 nt, Homo sapiens
gaccauaccugcucaucca

SEQ ID NO: 1178004 - RNA, 19 nt, Homo sapiens
gugaagagccuggaagaaa

SEQ ID NO: 1178005 - RNA, 19 nt, Homo sapiens
gcagcacgccgacaaguga

SEQ ID NO: 1178006 - RNA, 19 nt, Homo sapiens
gaaaagggcguuacuacaa

SEQ ID NO: 1178007 - RNA, 19 nt, Homo sapiens
ucaguaaacucugccuuga

SEQ ID NO: 1178008 - RNA, 19 nt, Homo sapiens
gcccagcgguguggaauga

SEQ ID NO: 1178009 - RNA, 19 nt, Homo sapiens
ccaccaggccgucaugauu

SEQ ID NO: 1178010 - RNA, 19 nt, Homo sapiens
ucccagaacucaccacuca

SEQ ID NO: 1178011 - RNA, 19 nt, Homo sapiens
caacccaaacuguguggua

SEQ ID NO: 1178012 - RNA, 19 nt, Homo sapiens
gcacacaggguacuuucug

SEQ ID NO: 1178013 - RNA, 19 nt, Homo sapiens
ugaagagccuggaagaaac

SEQ ID NO: 1178014 - RNA, 19 nt, Homo sapiens
caugaaggcgcuugaguau

SEQ ID NO: 1178015 - RNA, 19 nt, Homo sapiens
caccaugggccuuuaaaug

SEQ ID NO: 1178016 - RNA, 19 nt, Homo sapiens
caaacugugugguaauugc

SEQ ID NO: 1178017 - RNA, 19 nt, Homo sapiens
gcaccaacgagucgcagaa

SEQ ID NO: 1178018 - RNA, 19 nt, Homo sapiens
cccaaacugugugguaauu

SEQ ID NO: 1178019 - RNA, 19 nt, Homo sapiens
cuucagacucuuugcauuu

SEQ ID NO: 1178020 - RNA, 19 nt, Homo sapiens
acaugaaggcgcuugagua

SEQ ID NO: 1178021 - RNA, 19 nt, Homo sapiens
ccagucaccuuugcagaca

SEQ ID NO: 1178022 - RNA, 19 nt, Homo sapiens
ccaugggccuuuaaaugca

SEQ ID NO: 1178023 - RNA, 19 nt, Homo sapiens
ggaaguucaggcccaguga

SEQ ID NO: 1178024 - RNA, 19 nt, Homo sapiens
gcugggauuugacaucucu

SEQ ID NO: 1178025 - RNA, 19 nt, Homo sapiens
gacuucagcucccuguagu

SEQ ID NO: 1178026 - RNA, 19 nt, Homo sapiens
ccagcgguguggaaugaga

SEQ ID NO: 1178027 - RNA, 19 nt, Homo sapiens
uuucaagucugcccugcaa

SEQ ID NO: 1178028 - RNA, 19 nt, Homo sapiens
uguaaucccagcacuuuga

SEQ ID NO: 1178029 - RNA, 19 nt, Homo sapiens
ccuguaaucccagcacuuu

SEQ ID NO: 1178030 - RNA, 19 nt, Homo sapiens
agacgcaggagaaagcuuu

SEQ ID NO: 1178031 - RNA, 19 nt, Homo sapiens
aacccaaacugugugguaa

SEQ ID NO: 1178032 - RNA, 19 nt, Homo sapiens
gucaggagaucgagaccau

SEQ ID NO: 1178033 - RNA, 19 nt, Homo sapiens
ucagcucccuguagugaag

SEQ ID NO: 1178034 - RNA, 19 nt, Homo sapiens
caccaggccgucaugauug

SEQ ID NO: 1178035 - RNA, 19 nt, Homo sapiens
gacguuggucccuacauga

SEQ ID NO: 1178036 - RNA, 19 nt, Homo sapiens
aaacuccaccuaaccagau

SEQ ID NO: 1178037 - RNA, 19 nt, Homo sapiens
ccacucaccaugggccuuu

SEQ ID NO: 1178038 - RNA, 19 nt, Homo sapiens
cgacacauccaacccaaac

SEQ ID NO: 1178039 - RNA, 19 nt, Homo sapiens
cauccaacccaaacugugu

SEQ ID NO: 1178040 - RNA, 19 nt, Homo sapiens
gcaggaggaaacuaacagu

SEQ ID NO: 1178041 - RNA, 19 nt, Homo sapiens
ccaacgagucgcagaaguc

SEQ ID NO: 1178042 - RNA, 19 nt, Homo sapiens
ugacuucagcucccuguag

SEQ ID NO: 1178043 - RNA, 19 nt, Homo sapiens
ggaaaagggcguuacuaca

SEQ ID NO: 1178044 - RNA, 19 nt, Homo sapiens
cuucagaggcugggauuug

SEQ ID NO: 1178045 - RNA, 19 nt, Homo sapiens
ccacugccuccucuucaga

SEQ ID NO: 1178046 - RNA, 19 nt, Homo sapiens
uucagaggcugggauuuga

SEQ ID NO: 1178047 - RNA, 19 nt, Homo sapiens
ugcaguaaacuccaccuaa

SEQ ID NO: 1178048 - RNA, 19 nt, Homo sapiens
ugucaggccucugggaauc

SEQ ID NO: 1178049 - RNA, 19 nt, Homo sapiens
ucagacucuuugcauuuca

SEQ ID NO: 1178050 - RNA, 19 nt, Homo sapiens
gcaugggcaggcauuuguu

SEQ ID NO: 1178051 - RNA, 19 nt, Homo sapiens
gcaagcgauaggaguggaa

SEQ ID NO: 1178052 - RNA, 19 nt, Homo sapiens
ccacugcuggacagacuug

SEQ ID NO: 1178053 - RNA, 19 nt, Homo sapiens
ggccuccuaugcacagauc

SEQ ID NO: 1178054 - RNA, 19 nt, Homo sapiens
ucuucagacucuuugcauu

SEQ ID NO: 1178055 - RNA, 19 nt, Homo sapiens
gcucauaucacugggaaaa

SEQ ID NO: 1178056 - RNA, 19 nt, Homo sapiens
ggaaacaacucaauaagaa

SEQ ID NO: 1178057 - RNA, 19 nt, Homo sapiens
gaaagaagguggacccaaa

SEQ ID NO: 1178058 - RNA, 19 nt, Homo sapiens
gcaaugggaucucuaauac

SEQ ID NO: 1178059 - RNA, 19 nt, Homo sapiens
ucaaugaauuuguggcuua

SEQ ID NO: 1178060 - RNA, 19 nt, Homo sapiens
gagaacacauggaggauga

SEQ ID NO: 1178061 - RNA, 19 nt, Homo sapiens
ggauggaucaugcuaguua

SEQ ID NO: 1178062 - RNA, 19 nt, Homo sapiens
uaaacggugugcagcaaua

SEQ ID NO: 1178063 - RNA, 19 nt, Homo sapiens
gaagguggacccaaauuug

SEQ ID NO: 1178064 - RNA, 19 nt, Homo sapiens
gggaucaucuccuauugaa

SEQ ID NO: 1178065 - RNA, 19 nt, Homo sapiens
caacaucgcugugaaucug

SEQ ID NO: 1178066 - RNA, 19 nt, Homo sapiens
cugaugcaguggauuauua

SEQ ID NO: 1178067 - RNA, 19 nt, Homo sapiens
gaccacuucuuugcauuua

SEQ ID NO: 1178068 - RNA, 19 nt, Homo sapiens
gacugacccuggauuuaua

SEQ ID NO: 1178069 - RNA, 19 nt, Homo sapiens
ggacugacccuggauuuau

SEQ ID NO: 1178070 - RNA, 19 nt, Homo sapiens
caacugccaucacguuuua

SEQ ID NO: 1178071 - RNA, 19 nt, Homo sapiens
gaucaucuccuauugaauc

SEQ ID NO: 1178072 - RNA, 19 nt, Homo sapiens
gggcuacaguuucuucuug

SEQ ID NO: 1178073 - RNA, 19 nt, Homo sapiens
caaauacgaacaucgaauu

SEQ ID NO: 1178074 - RNA, 19 nt, Homo sapiens
gcagugagagcucugauug

SEQ ID NO: 1178075 - RNA, 19 nt, Homo sapiens
gaagaacaggucacaguug

SEQ ID NO: 1178076 - RNA, 19 nt, Homo sapiens
ucaauucguucugagauaa

SEQ ID NO: 1178077 - RNA, 19 nt, Homo sapiens
gaacuccacgccaucauga

SEQ ID NO: 1178078 - RNA, 19 nt, Homo sapiens
gaaauacaaagaccacuuc

SEQ ID NO: 1178079 - RNA, 19 nt, Homo sapiens
ccucaagaaugccaugaaa

SEQ ID NO: 1178080 - RNA, 19 nt, Homo sapiens
gaacacaucaggaaacaac

SEQ ID NO: 1178081 - RNA, 19 nt, Homo sapiens
gagaacacaucaggaaaca

SEQ ID NO: 1178082 - RNA, 19 nt, Homo sapiens
ugggaucucuaauacauuu

SEQ ID NO: 1178083 - RNA, 19 nt, Homo sapiens
aagaacaggucacaguuga

SEQ ID NO: 1178084 - RNA, 19 nt, Homo sapiens
gaagggcugcugcacauug

SEQ ID NO: 1178085 - RNA, 19 nt, Homo sapiens
gaagcgugcuaggugcaua

SEQ ID NO: 1178086 - RNA, 19 nt, Homo sapiens
gcauggagcugaggaguac

SEQ ID NO: 1178087 - RNA, 19 nt, Homo sapiens
gggaaucgggcuacaguuu

SEQ ID NO: 1178088 - RNA, 19 nt, Homo sapiens
ucggugggcucauaaugua

SEQ ID NO: 1178089 - RNA, 19 nt, Homo sapiens
gcugccaucuucuuuguug

SEQ ID NO: 1178090 - RNA, 19 nt, Homo sapiens
ucaggaaacaacucaauaa

SEQ ID NO: 1178091 - RNA, 19 nt, Homo sapiens
gucauuggcugcugcuaaa

SEQ ID NO: 1178092 - RNA, 19 nt, Homo sapiens
uugaauccaucgaccuuua

SEQ ID NO: 1178093 - RNA, 19 nt, Homo sapiens
gcacuccuguggacaucaa

SEQ ID NO: 1178094 - RNA, 19 nt, Homo sapiens
guacauuguccuguuauuu

SEQ ID NO: 1178095 - RNA, 19 nt, Homo sapiens
aaacacaaccaaggugaua

SEQ ID NO: 1178096 - RNA, 19 nt, Homo sapiens
caaacaggaugaagaacag

SEQ ID NO: 1178097 - RNA, 19 nt, Homo sapiens
ggaauggcaggacagcuuu

SEQ ID NO: 1178098 - RNA, 19 nt, Homo sapiens
aaauaacccucaagaaugc

SEQ ID NO: 1178099 - RNA, 19 nt, Homo sapiens
gaccauauuuaccuuacau

SEQ ID NO: 1178100 - RNA, 19 nt, Homo sapiens
gaaucgggcuacaguuucu

SEQ ID NO: 1178101 - RNA, 19 nt, Homo sapiens
gaagucaucccaggaggaa

SEQ ID NO: 1178102 - RNA, 19 nt, Homo sapiens
caacgugggcuuccagaau

SEQ ID NO: 1178103 - RNA, 19 nt, Homo sapiens
cuugggcucuugauucuaa

SEQ ID NO: 1178104 - RNA, 19 nt, Homo sapiens
aaggagguaugacacagua

SEQ ID NO: 1178105 - RNA, 19 nt, Homo sapiens
ccaguggaacucugaagua

SEQ ID NO: 1178106 - RNA, 19 nt, Homo sapiens
ugcaguggauuauuagaaa

SEQ ID NO: 1178107 - RNA, 19 nt, Homo sapiens
gacccuggauuuauagcuu

SEQ ID NO: 1178108 - RNA, 19 nt, Homo sapiens
guaugugguuucuguagga

SEQ ID NO: 1178109 - RNA, 19 nt, Homo sapiens
cgugcuaggugcauacauu

SEQ ID NO: 1178110 - RNA, 19 nt, Homo sapiens
cagguuaucugguuauggu

SEQ ID NO: 1178111 - RNA, 19 nt, Homo sapiens
aaugggaucucuaauacau

SEQ ID NO: 1178112 - RNA, 19 nt, Homo sapiens
gcaggacagcuuuaugguu

SEQ ID NO: 1178113 - RNA, 19 nt, Homo sapiens
ugauguccaugcuguacua

SEQ ID NO: 1178114 - RNA, 19 nt, Homo sapiens
ggaaaggagguaugacaca

SEQ ID NO: 1178115 - RNA, 19 nt, Homo sapiens
gaccguggccugcuucaug

SEQ ID NO: 1178116 - RNA, 19 nt, Homo sapiens
ugaacaaccagcagcgaua

SEQ ID NO: 1178117 - RNA, 19 nt, Homo sapiens
gaugaggagaugcaacaaa

SEQ ID NO: 1178118 - RNA, 19 nt, Homo sapiens
caaggguccuggugaaguc

SEQ ID NO: 1178119 - RNA, 19 nt, Homo sapiens
cugagauaaucgccacuua

SEQ ID NO: 1178120 - RNA, 19 nt, Homo sapiens
gugcagcaauauauaucaa

SEQ ID NO: 1178121 - RNA, 19 nt, Homo sapiens
uugccagacucauagguua

SEQ ID NO: 1178122 - RNA, 19 nt, Homo sapiens
ccacuucuuugcauuuaag

SEQ ID NO: 1178123 - RNA, 19 nt, Homo sapiens
aaacaacucuucggcacau

SEQ ID NO: 1178124 - RNA, 19 nt, Homo sapiens
gaauggcaggacagcuuua

SEQ ID NO: 1178125 - RNA, 19 nt, Homo sapiens
ggaaucgggcuacaguuuc

SEQ ID NO: 1178126 - RNA, 19 nt, Homo sapiens
ugagcaggauucuccaaga

SEQ ID NO: 1178127 - RNA, 19 nt, Homo sapiens
gaaacaacucaauaagaag

SEQ ID NO: 1178128 - RNA, 19 nt, Homo sapiens
gcaguggauuauuagaaag

SEQ ID NO: 1178129 - RNA, 19 nt, Homo sapiens
auacgaacaucgaauugau

SEQ ID NO: 1178130 - RNA, 19 nt, Homo sapiens
ccaaacaggaugaagaaca

SEQ ID NO: 1178131 - RNA, 19 nt, Homo sapiens
ugcaaugggaucucuaaua

SEQ ID NO: 1178132 - RNA, 19 nt, Homo sapiens
aauggaaaguggugauuca

SEQ ID NO: 1178133 - RNA, 19 nt, Homo sapiens
caucuccuauugaaucugu

SEQ ID NO: 1178134 - RNA, 19 nt, Homo sapiens
uuagaaagguuggauggau

SEQ ID NO: 1178135 - RNA, 19 nt, Homo sapiens
gcacugugauguccaugcu

SEQ ID NO: 1178136 - RNA, 19 nt, Homo sapiens
gauagcuuguugccaaagu

SEQ ID NO: 1178137 - RNA, 19 nt, Homo sapiens
caaugaauuuguggcuuau

SEQ ID NO: 1178138 - RNA, 19 nt, Homo sapiens
guccuucggugggcucaua

SEQ ID NO: 1178139 - RNA, 19 nt, Homo sapiens
ggagguaugacacaguaug

SEQ ID NO: 1178140 - RNA, 19 nt, Homo sapiens
gugauagcuuguugccaaa

SEQ ID NO: 1178141 - RNA, 19 nt, Homo sapiens
caaaauggauccacuugag

SEQ ID NO: 1178142 - RNA, 19 nt, Homo sapiens
gcccuguccugguuuggaa

SEQ ID NO: 1178143 - RNA, 19 nt, Homo sapiens
ccuauugaaucuguaguug

SEQ ID NO: 1178144 - RNA, 19 nt, Homo sapiens
caccaaacaggaugaagaa

SEQ ID NO: 1178145 - RNA, 19 nt, Homo sapiens
aagcagagcugugcaaagc

SEQ ID NO: 1178146 - RNA, 19 nt, Homo sapiens
guggaacucugaaguacag

SEQ ID NO: 1178147 - RNA, 19 nt, Homo sapiens
gaaacacaaccaaggugau

SEQ ID NO: 1178148 - RNA, 19 nt, Homo sapiens
ccagacucauagguuauaa

SEQ ID NO: 1178149 - RNA, 19 nt, Homo sapiens
ggaugaugaugaggagaug

SEQ ID NO: 1178150 - RNA, 19 nt, Homo sapiens
gaacacauggaggaugaug

SEQ ID NO: 1178151 - RNA, 19 nt, Homo sapiens
caucaacugccaucacguu

SEQ ID NO: 1178152 - RNA, 19 nt, Homo sapiens
gguggacccaaauuuguaa

SEQ ID NO: 1178153 - RNA, 19 nt, Homo sapiens
gcuaaucugcuccuacauc

SEQ ID NO: 1178154 - RNA, 19 nt, Homo sapiens
gccggguucucuaccauug

SEQ ID NO: 1178155 - RNA, 19 nt, Homo sapiens
uaccuuacaucaccaaguc

SEQ ID NO: 1178156 - RNA, 19 nt, Homo sapiens
caacagauccaauuucauu

SEQ ID NO: 1178157 - RNA, 19 nt, Homo sapiens
ggaacugcuucuauaauug

SEQ ID NO: 1178158 - RNA, 19 nt, Homo sapiens
cgaaauaacuccagcaacu

SEQ ID NO: 1178159 - RNA, 19 nt, Homo sapiens
gaauaucauugucauagug

SEQ ID NO: 1178160 - RNA, 19 nt, Homo sapiens
uacaggaacugcuucuaua

SEQ ID NO: 1178161 - RNA, 19 nt, Homo sapiens
caaagcacauucccacaga

SEQ ID NO: 1178162 - RNA, 19 nt, Homo sapiens
ugacguccaugguguguaa

SEQ ID NO: 1178163 - RNA, 19 nt, Homo sapiens
cauaguggcuggagcaaau

SEQ ID NO: 1178164 - RNA, 19 nt, Homo sapiens
caggaacacagucaucuua

SEQ ID NO: 1178165 - RNA, 19 nt, Homo sapiens
gcacauucccacagagaaa

SEQ ID NO: 1178166 - RNA, 19 nt, Homo sapiens
gaacugcuucuauaauugu

SEQ ID NO: 1178167 - RNA, 19 nt, Homo sapiens
agacagaaccugagccaaa

SEQ ID NO: 1178168 - RNA, 19 nt, Homo sapiens
gaaagugaggcugagauuu

SEQ ID NO: 1178169 - RNA, 19 nt, Homo sapiens
gaagacaugcucaacagau

SEQ ID NO: 1178170 - RNA, 19 nt, Homo sapiens
guggugggcuccugcauga

SEQ ID NO: 1178171 - RNA, 19 nt, Homo sapiens
gauguguucugcugcaaug

SEQ ID NO: 1178172 - RNA, 19 nt, Homo sapiens
gaaauaacuccagcaacuu

SEQ ID NO: 1178173 - RNA, 19 nt, Homo sapiens
gaaaggugccaaccagugu

SEQ ID NO: 1178174 - RNA, 19 nt, Homo sapiens
aggaacugcuucuauaauu

SEQ ID NO: 1178175 - RNA, 19 nt, Homo sapiens
ccucaagcuucaauuuauu

SEQ ID NO: 1178176 - RNA, 19 nt, Homo sapiens
gcuccuggcuaaugcuuau

SEQ ID NO: 1178177 - RNA, 19 nt, Homo sapiens
uagcagagccaaagucaug

SEQ ID NO: 1178178 - RNA, 19 nt, Homo sapiens
gacuaaagaugcugcuaca

SEQ ID NO: 1178179 - RNA, 19 nt, Homo sapiens
ccgcaggaguggagugaaa

SEQ ID NO: 1178180 - RNA, 19 nt, Homo sapiens
ggucugccagcucgaaaua

SEQ ID NO: 1178181 - RNA, 19 nt, Homo sapiens
gacagaaccugagccaaag

SEQ ID NO: 1178182 - RNA, 19 nt, Homo sapiens
gcacaaaacaaccagaauu

SEQ ID NO: 1178183 - RNA, 19 nt, Homo sapiens
gguggcugcuccuggcuaa

SEQ ID NO: 1178184 - RNA, 19 nt, Homo sapiens
gaaagucaaggcuguggau

SEQ ID NO: 1178185 - RNA, 19 nt, Homo sapiens
ccuucuaccuggcuuacua

SEQ ID NO: 1178186 - RNA, 19 nt, Homo sapiens
aauaaugaaggccagaaua

SEQ ID NO: 1178187 - RNA, 19 nt, Homo sapiens
cuacaggaacugcuucuau

SEQ ID NO: 1178188 - RNA, 19 nt, Homo sapiens
ugggagcucuggccuucua

SEQ ID NO: 1178189 - RNA, 19 nt, Homo sapiens
cagaauaucauugucauag

SEQ ID NO: 1178190 - RNA, 19 nt, Homo sapiens
cucaacagauccaauuuca

SEQ ID NO: 1178191 - RNA, 19 nt, Homo sapiens
uguguaagguuggcaaaga

SEQ ID NO: 1178192 - RNA, 19 nt, Homo sapiens
uaacuccagcaacuucuuu

SEQ ID NO: 1178193 - RNA, 19 nt, Homo sapiens
gcaggaacacagucaucuu

SEQ ID NO: 1178194 - RNA, 19 nt, Homo sapiens
ggaagacaugcucaacaga

SEQ ID NO: 1178195 - RNA, 19 nt, Homo sapiens
ugaaagugaggcugagauu

SEQ ID NO: 1178196 - RNA, 19 nt, Homo sapiens
cacaaaacaaccagaauua

SEQ ID NO: 1178197 - RNA, 19 nt, Homo sapiens
gcucaacagauccaauuuc

SEQ ID NO: 1178198 - RNA, 19 nt, Homo sapiens
gccagaauaucauugucau

SEQ ID NO: 1178199 - RNA, 19 nt, Homo sapiens
aaugaaggccagaauauca

SEQ ID NO: 1178200 - RNA, 19 nt, Homo sapiens
acaggaacugcuucuauaa

SEQ ID NO: 1178201 - RNA, 19 nt, Homo sapiens
uccucaagcuucaauuuau

SEQ ID NO: 1178202 - RNA, 19 nt, Homo sapiens
cauccucaagcuucaauuu

SEQ ID NO: 1178203 - RNA, 19 nt, Homo sapiens
cuaccuggcuuacuaucca

SEQ ID NO: 1178204 - RNA, 19 nt, Homo sapiens
gaaggccagaauaucauug

SEQ ID NO: 1178205 - RNA, 19 nt, Homo sapiens
auaaugaaggccagaauau

SEQ ID NO: 1178206 - RNA, 19 nt, Homo sapiens
caaccaguguguccaagcu

SEQ ID NO: 1178207 - RNA, 19 nt, Homo sapiens
acagucaucuuacccuuac

SEQ ID NO: 1178208 - RNA, 19 nt, Homo sapiens
uggaagacaugcucaacag

SEQ ID NO: 1178209 - RNA, 19 nt, Homo sapiens
guguucugcugcaaugaaa

SEQ ID NO: 1178210 - RNA, 19 nt, Homo sapiens
ccagaauaucauugucaua

SEQ ID NO: 1178211 - RNA, 19 nt, Homo sapiens
guguaagguuggcaaagau

SEQ ID NO: 1178212 - RNA, 19 nt, Homo sapiens
aaagugaggcugagauuuu

SEQ ID NO: 1178213 - RNA, 19 nt, Homo sapiens
cacagucaucuuacccuua

SEQ ID NO: 1178214 - RNA, 19 nt, Homo sapiens
ucuacacccucucagaugu

SEQ ID NO: 1178215 - RNA, 19 nt, Homo sapiens
aaauaacuccagcaacuuc

SEQ ID NO: 1178216 - RNA, 19 nt, Homo sapiens
ggaacacagucaucuuacc

SEQ ID NO: 1178217 - RNA, 19 nt, Homo sapiens
caggaacugcuucuauaau

SEQ ID NO: 1178218 - RNA, 19 nt, Homo sapiens
uguccaggcugcaggaaca

SEQ ID NO: 1178219 - RNA, 19 nt, Homo sapiens
aagacaugcucaacagauc

SEQ ID NO: 1178220 - RNA, 19 nt, Homo sapiens
caaaucuguccuuggaaga

SEQ ID NO: 1178221 - RNA, 19 nt, Homo sapiens
gagcaaugacguccauggu

SEQ ID NO: 1178222 - RNA, 19 nt, Homo sapiens
gaccuuccgcuuacucugu

SEQ ID NO: 1178223 - RNA, 19 nt, Homo sapiens
cugcauuagugcucuugaa

SEQ ID NO: 1178224 - RNA, 19 nt, Homo sapiens
ggaguggagugaaaaccuu

SEQ ID NO: 1178225 - RNA, 19 nt, Homo sapiens
uuuggaagcccuaacaaug

SEQ ID NO: 1178226 - RNA, 19 nt, Homo sapiens
ggccagaauaucauuguca

SEQ ID NO: 1178227 - RNA, 19 nt, Homo sapiens
gcuggagcaaauuuacuuu

SEQ ID NO: 1178228 - RNA, 19 nt, Homo sapiens
caauaaugaaggccagaau

SEQ ID NO: 1178229 - RNA, 19 nt, Homo sapiens
guaagguuggcaaagauuc

SEQ ID NO: 1178230 - RNA, 19 nt, Homo sapiens
cauccauggacauaaguuu

SEQ ID NO: 1178231 - RNA, 19 nt, Homo sapiens
guucuacacccucucagau

SEQ ID NO: 1178232 - RNA, 19 nt, Homo sapiens
ugccauugcugaccuggau

SEQ ID NO: 1178233 - RNA, 19 nt, Homo sapiens
ugaaggccagaauaucauu

SEQ ID NO: 1178234 - RNA, 19 nt, Homo sapiens
uaaugaaggccagaauauc

SEQ ID NO: 1178235 - RNA, 19 nt, Homo sapiens
gcugccaggugguaaucau

SEQ ID NO: 1178236 - RNA, 19 nt, Homo sapiens
gagggcagcagccaauguc

SEQ ID NO: 1178237 - RNA, 19 nt, Homo sapiens
cgaagucauccucaagcuu

SEQ ID NO: 1178238 - RNA, 19 nt, Homo sapiens
cagucuuacuucucguuug

SEQ ID NO: 1178239 - RNA, 19 nt, Homo sapiens
aagugaggcugagauuuua

SEQ ID NO: 1178240 - RNA, 19 nt, Homo sapiens
gaucgucuguuucuaauua

SEQ ID NO: 1178241 - RNA, 19 nt, Homo sapiens
gaagugauuuccuuuauug

SEQ ID NO: 1178242 - RNA, 19 nt, Homo sapiens
guagaggacuugauaaaga

SEQ ID NO: 1178243 - RNA, 19 nt, Homo sapiens
gcucaugccuguaaucgua

SEQ ID NO: 1178244 - RNA, 19 nt, Homo sapiens
ggaauuggaugaagacaug

SEQ ID NO: 1178245 - RNA, 19 nt, Homo sapiens
gcaguaaucuuguguuucu

SEQ ID NO: 1178246 - RNA, 19 nt, Homo sapiens
aaagggaauucuucucuua

SEQ ID NO: 1178247 - RNA, 19 nt, Homo sapiens
gaacagcacgcucacguuu

SEQ ID NO: 1178248 - RNA, 19 nt, Homo sapiens
gaggagagcugggaauuuc

SEQ ID NO: 1178249 - RNA, 19 nt, Homo sapiens
gugaaagggcuuauucuua

SEQ ID NO: 1178250 - RNA, 19 nt, Homo sapiens
gcguguaacucuuauuauu

SEQ ID NO: 1178251 - RNA, 19 nt, Homo sapiens
ugaaagggcuuauucuuac

SEQ ID NO: 1178252 - RNA, 19 nt, Homo sapiens
ggacugagaugguuuacac

SEQ ID NO: 1178253 - RNA, 19 nt, Homo sapiens
auauauggcuugagaauga

SEQ ID NO: 1178254 - RNA, 19 nt, Homo sapiens
guaaguaaccagcuacaaa

SEQ ID NO: 1178255 - RNA, 19 nt, Homo sapiens
ggacaaggcaggaggauca

SEQ ID NO: 1178256 - RNA, 19 nt, Homo sapiens
guaaccagcuacaaagaau

SEQ ID NO: 1178257 - RNA, 19 nt, Homo sapiens
ggugaaaccucgucucuac

SEQ ID NO: 1178258 - RNA, 19 nt, Homo sapiens
ggagugauacuaaaccauu

SEQ ID NO: 1178259 - RNA, 19 nt, Homo sapiens
cuacuuaauccucauguua

SEQ ID NO: 1178260 - RNA, 19 nt, Homo sapiens
ggacuugccucuuuaucca

SEQ ID NO: 1178261 - RNA, 19 nt, Homo sapiens
caaaggaagucugaucugu

SEQ ID NO: 1178262 - RNA, 19 nt, Homo sapiens
gacccaagcauuugacuuu

SEQ ID NO: 1178263 - RNA, 19 nt, Homo sapiens
ccucaaugaucgucuguuu

SEQ ID NO: 1178264 - RNA, 19 nt, Homo sapiens
ggaagucugaucuguguuu

SEQ ID NO: 1178265 - RNA, 19 nt, Homo sapiens
uagcaguaaucuuguguuu

SEQ ID NO: 1178266 - RNA, 19 nt, Homo sapiens
gugauuuccuuuauuguug

SEQ ID NO: 1178267 - RNA, 19 nt, Homo sapiens
gagaaucugcugcaaguug

SEQ ID NO: 1178268 - RNA, 19 nt, Homo sapiens
gggcuuauucuuacccuua

SEQ ID NO: 1178269 - RNA, 19 nt, Homo sapiens
caaagaauaaugucacuuc

SEQ ID NO: 1178270 - RNA, 19 nt, Homo sapiens
gcuugagaaugauaaugua

SEQ ID NO: 1178271 - RNA, 19 nt, Homo sapiens
gagugauacuaaaccauuu

SEQ ID NO: 1178272 - RNA, 19 nt, Homo sapiens
gcauguaagagugaauuua

SEQ ID NO: 1178273 - RNA, 19 nt, Homo sapiens
uaaaguguuagcaguguua

SEQ ID NO: 1178274 - RNA, 19 nt, Homo sapiens
ccacaugccuguaauucca

SEQ ID NO: 1178275 - RNA, 19 nt, Homo sapiens
gcaaaugugcguaguaguc

SEQ ID NO: 1178276 - RNA, 19 nt, Homo sapiens
gcaggaggaucacuugaac

SEQ ID NO: 1178277 - RNA, 19 nt, Homo sapiens
gaauaccuauaguugacuu

SEQ ID NO: 1178278 - RNA, 19 nt, Homo sapiens
gaauucuucucuuacuuca

SEQ ID NO: 1178279 - RNA, 19 nt, Homo sapiens
ucuaagaagugauuuccuu

SEQ ID NO: 1178280 - RNA, 19 nt, Homo sapiens
gacaguaggccauaaagug

SEQ ID NO: 1178281 - RNA, 19 nt, Homo sapiens
gagaaggaggaauacauuu

SEQ ID NO: 1178282 - RNA, 19 nt, Homo sapiens
gcuaaucagucagacauuc

SEQ ID NO: 1178283 - RNA, 19 nt, Homo sapiens
cuaaaccauuugagcuuaa

SEQ ID NO: 1178284 - RNA, 19 nt, Homo sapiens
ggaauucuucucuuacuuc

SEQ ID NO: 1178285 - RNA, 19 nt, Homo sapiens
uggagaaccugaaagugaa

SEQ ID NO: 1178286 - RNA, 19 nt, Homo sapiens
uuaaggaauuggaugaaga

SEQ ID NO: 1178287 - RNA, 19 nt, Homo sapiens
uagaggaggugcagcuguu

SEQ ID NO: 1178288 - RNA, 19 nt, Homo sapiens
uguuuaaggugaucucauu

SEQ ID NO: 1178289 - RNA, 19 nt, Homo sapiens
gucaauaacuauguggaaa

SEQ ID NO: 1178290 - RNA, 19 nt, Homo sapiens
acuaaaccauuugagcuua

SEQ ID NO: 1178291 - RNA, 19 nt, Homo sapiens
aaauguaaguaaccagcua

SEQ ID NO: 1178292 - RNA, 19 nt, Homo sapiens
ccagacuaaugaacuaaug

SEQ ID NO: 1178293 - RNA, 19 nt, Homo sapiens
cggaaggguugacauuaga

SEQ ID NO: 1178294 - RNA, 19 nt, Homo sapiens
ggaggagagcugggaauuu

SEQ ID NO: 1178295 - RNA, 19 nt, Homo sapiens
cggagaaucugcugcaagu

SEQ ID NO: 1178296 - RNA, 19 nt, Homo sapiens
gggaauucuucucuuacuu

SEQ ID NO: 1178297 - RNA, 19 nt, Homo sapiens
caacacagcgagaacuugu

SEQ ID NO: 1178298 - RNA, 19 nt, Homo sapiens
aguaggccauaaaguguua

SEQ ID NO: 1178299 - RNA, 19 nt, Homo sapiens
gaaggaggaauacauuucu

SEQ ID NO: 1178300 - RNA, 19 nt, Homo sapiens
gacggaaggguugacauua

SEQ ID NO: 1178301 - RNA, 19 nt, Homo sapiens
agaaucugcugcaaguuga

SEQ ID NO: 1178302 - RNA, 19 nt, Homo sapiens
uaagaguguuuguuuaagg

SEQ ID NO: 1178303 - RNA, 19 nt, Homo sapiens
aaggaagucugaucugugu

SEQ ID NO: 1178304 - RNA, 19 nt, Homo sapiens
cuugauauauggcuugaga

SEQ ID NO: 1178305 - RNA, 19 nt, Homo sapiens
aagcguguaacucuuauua

SEQ ID NO: 1178306 - RNA, 19 nt, Homo sapiens
ugaaaccucgucucuacua

SEQ ID NO: 1178307 - RNA, 19 nt, Homo sapiens
gcacccgacagacaacuuu

SEQ ID NO: 1178308 - RNA, 19 nt, Homo sapiens
ucagucagacauucuuuaa

SEQ ID NO: 1178309 - RNA, 19 nt, Homo sapiens
cauaaaguguuagcagugu

SEQ ID NO: 1178310 - RNA, 19 nt, Homo sapiens
uagcaaaugugcguaguag

SEQ ID NO: 1178311 - RNA, 19 nt, Homo sapiens
ccaaguauuuucugcuuaa

SEQ ID NO: 1178312 - RNA, 19 nt, Homo sapiens
gcuacuuccugucauagug

SEQ ID NO: 1178313 - RNA, 19 nt, Homo sapiens
uaggcuacuuccugucaua

SEQ ID NO: 1178314 - RNA, 19 nt, Homo sapiens
gcaguguuaugcuaugucu

SEQ ID NO: 1178315 - RNA, 19 nt, Homo sapiens
uaauagugcuuuccagacu

SEQ ID NO: 1178316 - RNA, 19 nt, Homo sapiens
gagauuuaauagugcuuuc

SEQ ID NO: 1178317 - RNA, 19 nt, Homo sapiens
ggugaaagggcuuauucuu

SEQ ID NO: 1178318 - RNA, 19 nt, Homo sapiens
augaagacaugcaucagaa

SEQ ID NO: 1178319 - RNA, 19 nt, Homo sapiens
gaggacaguaggccauaaa

SEQ ID NO: 1178320 - RNA, 19 nt, Homo sapiens
auacauuucugaggaguga

SEQ ID NO: 1178321 - RNA, 19 nt, Homo sapiens
gggcagacccaagcauuug

SEQ ID NO: 1178322 - RNA, 19 nt, Homo sapiens
caggacaucuguuauucuc

SEQ ID NO: 1178323 - RNA, 19 nt, Homo sapiens
uaaguaaccagcuacaaag

SEQ ID NO: 1178324 - RNA, 19 nt, Homo sapiens
ccucgucucuacuacaaau

SEQ ID NO: 1178325 - RNA, 19 nt, Homo sapiens
acagcacgcucacguuugu

SEQ ID NO: 1178326 - RNA, 19 nt, Homo sapiens
gggcaaguuuagaaguaau

SEQ ID NO: 1178327 - RNA, 19 nt, Homo sapiens
ucugaggagugauacuaaa

SEQ ID NO: 1178328 - RNA, 19 nt, Homo sapiens
agagaaggaggaauacauu

SEQ ID NO: 1178329 - RNA, 19 nt, Homo sapiens
gaaaccucgucucuacuac

SEQ ID NO: 1178330 - RNA, 19 nt, Homo sapiens
aaugaucgucuguuucuaa

SEQ ID NO: 1178331 - RNA, 19 nt, Homo sapiens
ggcuuauucuuacccuuaa

SEQ ID NO: 1178332 - RNA, 19 nt, Homo sapiens
gaaggugaaagggcuuauu

SEQ ID NO: 1178333 - RNA, 19 nt, Homo sapiens
cuggagaaccugaaaguga

SEQ ID NO: 1178334 - RNA, 19 nt, Homo sapiens
ucagugacguuuacaacag

SEQ ID NO: 1178335 - RNA, 19 nt, Homo sapiens
gccuugaauuccuugguaa

SEQ ID NO: 1178336 - RNA, 19 nt, Homo sapiens
uaaagcauguaagagugaa

SEQ ID NO: 1178337 - RNA, 19 nt, Homo sapiens
ggugaucucauugauggua

SEQ ID NO: 1178338 - RNA, 19 nt, Homo sapiens
ggacaguaggccauaaagu

SEQ ID NO: 1178339 - RNA, 19 nt, Homo sapiens
gaggagugauacuaaacca

SEQ ID NO: 1178340 - RNA, 19 nt, Homo sapiens
aaacagaacuuccuacuuu

SEQ ID NO: 1178341 - RNA, 19 nt, Homo sapiens
caagaaagguaaucuguaa

SEQ ID NO: 1178342 - RNA, 19 nt, Homo sapiens
caguugagauguauacuua

SEQ ID NO: 1178343 - RNA, 19 nt, Homo sapiens
guaaauugguagcaaguaa

SEQ ID NO: 1178344 - RNA, 19 nt, Homo sapiens
gaacuggauugaauuacuu

SEQ ID NO: 1178345 - RNA, 19 nt, Homo sapiens
uagcagauguugcauguaa

SEQ ID NO: 1178346 - RNA, 19 nt, Homo sapiens
uuacguggcuguauguuaa

SEQ ID NO: 1178347 - RNA, 19 nt, Homo sapiens
ggaagccguucuugacaaa

SEQ ID NO: 1178348 - RNA, 19 nt, Homo sapiens
gaauuagcauugagaggaa

SEQ ID NO: 1178349 - RNA, 19 nt, Homo sapiens
ugaaacagcacaguaaaua

SEQ ID NO: 1178350 - RNA, 19 nt, Homo sapiens
gcauguacaucuagcauuc

SEQ ID NO: 1178351 - RNA, 19 nt, Homo sapiens
guaccaaucuugaguuucu

SEQ ID NO: 1178352 - RNA, 19 nt, Homo sapiens
aaagaugugugucugauug

SEQ ID NO: 1178353 - RNA, 19 nt, Homo sapiens
aguacuagaugguguauaa

SEQ ID NO: 1178354 - RNA, 19 nt, Homo sapiens
gggauguucuucuugauga

SEQ ID NO: 1178355 - RNA, 19 nt, Homo sapiens
cccagaggauuaagaauuu

SEQ ID NO: 1178356 - RNA, 19 nt, Homo sapiens
cuauaaagguccaauuguu

SEQ ID NO: 1178357 - RNA, 19 nt, Homo sapiens
cagcuugaguuucuccaua

SEQ ID NO: 1178358 - RNA, 19 nt, Homo sapiens
agacuucaguugagaugua

SEQ ID NO: 1178359 - RNA, 19 nt, Homo sapiens
gaaccauucuccuuucucu

SEQ ID NO: 1178360 - RNA, 19 nt, Homo sapiens
acagaaagcucuauguuuu

SEQ ID NO: 1178361 - RNA, 19 nt, Homo sapiens
caacagagaaacagaacuu

SEQ ID NO: 1178362 - RNA, 19 nt, Homo sapiens
gaaacucagccuccagaaa

SEQ ID NO: 1178363 - RNA, 19 nt, Homo sapiens
gagaggaagguuacaacua

SEQ ID NO: 1178364 - RNA, 19 nt, Homo sapiens
uuacauagacuucaguuga

SEQ ID NO: 1178365 - RNA, 19 nt, Homo sapiens
guacaggauucugcuggua

SEQ ID NO: 1178366 - RNA, 19 nt, Homo sapiens
guacuuucccacacuauaa

SEQ ID NO: 1178367 - RNA, 19 nt, Homo sapiens
uaucugcucugaaauguca

SEQ ID NO: 1178368 - RNA, 19 nt, Homo sapiens
caagaucuaaucaguugua

SEQ ID NO: 1178369 - RNA, 19 nt, Homo sapiens
gaaacagaacuuccuacuu

SEQ ID NO: 1178370 - RNA, 19 nt, Homo sapiens
ucaaggaccgcgaggguua

SEQ ID NO: 1178371 - RNA, 19 nt, Homo sapiens
gaaauguacgggaacgauu

SEQ ID NO: 1178372 - RNA, 19 nt, Homo sapiens
agaggaagguuacaacuag

SEQ ID NO: 1178373 - RNA, 19 nt, Homo sapiens
ugcaagaucuaaucaguug

SEQ ID NO: 1178374 - RNA, 19 nt, Homo sapiens
ggaaaaggguguauugaca

SEQ ID NO: 1178375 - RNA, 19 nt, Homo sapiens
cagaaacgguccagaacug

SEQ ID NO: 1178376 - RNA, 19 nt, Homo sapiens
uaagucagaugcuccaaca

SEQ ID NO: 1178377 - RNA, 19 nt, Homo sapiens
gaaagguaaucuguaaguc

SEQ ID NO: 1178378 - RNA, 19 nt, Homo sapiens
ggacgagcaguaugauuug

SEQ ID NO: 1178379 - RNA, 19 nt, Homo sapiens
gaagcucugaagcauguua

SEQ ID NO: 1178380 - RNA, 19 nt, Homo sapiens
gcauguaaauugguagcaa

SEQ ID NO: 1178381 - RNA, 19 nt, Homo sapiens
gauguugcauguaaauugg

SEQ ID NO: 1178382 - RNA, 19 nt, Homo sapiens
gcuuucagguguuuagaga

SEQ ID NO: 1178383 - RNA, 19 nt, Homo sapiens
gacuauaaaccuuugcuuu

SEQ ID NO: 1178384 - RNA, 19 nt, Homo sapiens
gaggaagguuacaacuaga

SEQ ID NO: 1178385 - RNA, 19 nt, Homo sapiens
ggcauuccauucccuguug

SEQ ID NO: 1178386 - RNA, 19 nt, Homo sapiens
caacccagaggauuaagaa

SEQ ID NO: 1178387 - RNA, 19 nt, Homo sapiens
ggugaaccauucuccuuuc

SEQ ID NO: 1178388 - RNA, 19 nt, Homo sapiens
aaauguacgggaacgauua

SEQ ID NO: 1178389 - RNA, 19 nt, Homo sapiens
caguaccaaucuugaguuu

SEQ ID NO: 1178390 - RNA, 19 nt, Homo sapiens
caccaaagguaaauaucug

SEQ ID NO: 1178391 - RNA, 19 nt, Homo sapiens
guacgggaacgauuagcua

SEQ ID NO: 1178392 - RNA, 19 nt, Homo sapiens
acuagaggcuuguggaaug

SEQ ID NO: 1178393 - RNA, 19 nt, Homo sapiens
cauaguccauguuaauagu

SEQ ID NO: 1178394 - RNA, 19 nt, Homo sapiens
ccuagcagauguugcaugu

SEQ ID NO: 1178395 - RNA, 19 nt, Homo sapiens
ggauuuugcuucccaugua

SEQ ID NO: 1178396 - RNA, 19 nt, Homo sapiens
gcggcagcuucucgacuua

SEQ ID NO: 1178397 - RNA, 19 nt, Homo sapiens
gaugguguauaacucuaga

SEQ ID NO: 1178398 - RNA, 19 nt, Homo sapiens
uuucagguguuuagagauu

SEQ ID NO: 1178399 - RNA, 19 nt, Homo sapiens
gcagauguugcauguaaau

SEQ ID NO: 1178400 - RNA, 19 nt, Homo sapiens
gcuucgcccugaccuguuu

SEQ ID NO: 1178401 - RNA, 19 nt, Homo sapiens
ucauuuaucuacucacaca

SEQ ID NO: 1178402 - RNA, 19 nt, Homo sapiens
uaauaucugcucugaaaug

SEQ ID NO: 1178403 - RNA, 19 nt, Homo sapiens
gggcugcauuccauuuaug

SEQ ID NO: 1178404 - RNA, 19 nt, Homo sapiens
cuguauaucaucuggauua

SEQ ID NO: 1178405 - RNA, 19 nt, Homo sapiens
uauaucaucuggauuacgu

SEQ ID NO: 1178406 - RNA, 19 nt, Homo sapiens
gaaaagaugugugucugau

SEQ ID NO: 1178407 - RNA, 19 nt, Homo sapiens
gaaacagcacaguaaauac

SEQ ID NO: 1178408 - RNA, 19 nt, Homo sapiens
ugagauguauacuuagcaa

SEQ ID NO: 1178409 - RNA, 19 nt, Homo sapiens
ccauuuaugcuguauauag

SEQ ID NO: 1178410 - RNA, 19 nt, Homo sapiens
caagggcgacuccaaggaa

SEQ ID NO: 1178411 - RNA, 19 nt, Homo sapiens
ggcuguauguuaauugaau

SEQ ID NO: 1178412 - RNA, 19 nt, Homo sapiens
guugccauccucacuguua

SEQ ID NO: 1178413 - RNA, 19 nt, Homo sapiens
ucuccuuucucucaaguaa

SEQ ID NO: 1178414 - RNA, 19 nt, Homo sapiens
ccgcgaggguuacacauca

SEQ ID NO: 1178415 - RNA, 19 nt, Homo sapiens
ccucggacguccuggagaa

SEQ ID NO: 1178416 - RNA, 19 nt, Homo sapiens
aagcagcgccucaucaaga

SEQ ID NO: 1178417 - RNA, 19 nt, Homo sapiens
uggauugaauuacuuagug

SEQ ID NO: 1178418 - RNA, 19 nt, Homo sapiens
gacuguauaucaucuggau

SEQ ID NO: 1178419 - RNA, 19 nt, Homo sapiens
ccaaagguaaauaucugua

SEQ ID NO: 1178420 - RNA, 19 nt, Homo sapiens
cuuagacccugaaguggaa

SEQ ID NO: 1178421 - RNA, 19 nt, Homo sapiens
uggacgagcaguaugauuu

SEQ ID NO: 1178422 - RNA, 19 nt, Homo sapiens
ccaauaacaacauuaagca

SEQ ID NO: 1178423 - RNA, 19 nt, Homo sapiens
acaagaaagguaaucugua

SEQ ID NO: 1178424 - RNA, 19 nt, Homo sapiens
gauaauuagcauugucaga

SEQ ID NO: 1178425 - RNA, 19 nt, Homo sapiens
cuucaaucaugguuauuug

SEQ ID NO: 1178426 - RNA, 19 nt, Homo sapiens
aaacgcggcugacccugau

SEQ ID NO: 1178427 - RNA, 19 nt, Homo sapiens
ucucucaaguaaaccagua

SEQ ID NO: 1178428 - RNA, 19 nt, Homo sapiens
caacuagaggcuuguggaa

SEQ ID NO: 1178429 - RNA, 19 nt, Homo sapiens
ccucaccaauaacaacauu

SEQ ID NO: 1178430 - RNA, 19 nt, Homo sapiens
ugaagcauguuaaggaaac

SEQ ID NO: 1178431 - RNA, 19 nt, Homo sapiens
ucugaagcauguuaaggaa

SEQ ID NO: 1178432 - RNA, 19 nt, Homo sapiens
ggauguucuucuugaugaa

SEQ ID NO: 1178433 - RNA, 19 nt, Homo sapiens
guggcuguauguuaauuga

SEQ ID NO: 1178434 - RNA, 19 nt, Homo sapiens
ggaaugagacguaaaaguc

SEQ ID NO: 1178435 - RNA, 19 nt, Homo sapiens
cuagaggcuuguggaauga

SEQ ID NO: 1178436 - RNA, 19 nt, Homo sapiens
gaucuaaucaguuguacac

SEQ ID NO: 1178437 - RNA, 19 nt, Homo sapiens
ugacaacagagaaacagaa

SEQ ID NO: 1178438 - RNA, 19 nt, Homo sapiens
uagcauugucagacuauaa

SEQ ID NO: 1178439 - RNA, 19 nt, Homo sapiens
ucaaaugucaguccuagca

SEQ ID NO: 1178440 - RNA, 19 nt, Homo sapiens
ggaaaugcuucauaacuua

SEQ ID NO: 1178441 - RNA, 19 nt, Homo sapiens
ucacagagcugcagacuaa

SEQ ID NO: 1178442 - RNA, 19 nt, Homo sapiens
gaagacguaugcaucagua

SEQ ID NO: 1178443 - RNA, 19 nt, Homo sapiens
gcaaggaauuagaagcaua

SEQ ID NO: 1178444 - RNA, 19 nt, Homo sapiens
uaucauaccucaccucuga

SEQ ID NO: 1178445 - RNA, 19 nt, Homo sapiens
gaauagcaggcaagaauua

SEQ ID NO: 1178446 - RNA, 19 nt, Homo sapiens
gaggaacacuuuagauaga

SEQ ID NO: 1178447 - RNA, 19 nt, Homo sapiens
gauggaaggugacgacauu

SEQ ID NO: 1178448 - RNA, 19 nt, Homo sapiens
ggaauuagaagcauauuug

SEQ ID NO: 1178449 - RNA, 19 nt, Homo sapiens
gcaaggcucucaccacuca

SEQ ID NO: 1178450 - RNA, 19 nt, Homo sapiens
uauaguaacuggucuguga

SEQ ID NO: 1178451 - RNA, 19 nt, Homo sapiens
uaacuggucugugaucuuu

SEQ ID NO: 1178452 - RNA, 19 nt, Homo sapiens
gcacuacuaugucaucaau

SEQ ID NO: 1178453 - RNA, 19 nt, Homo sapiens
ccaagaaccugaccgauca

SEQ ID NO: 1178454 - RNA, 19 nt, Homo sapiens
ggaagaagccgaggaagaa

SEQ ID NO: 1178455 - RNA, 19 nt, Homo sapiens
uagaggaaaugcuucauaa

SEQ ID NO: 1178456 - RNA, 19 nt, Homo sapiens
gccaggagcugcccuuuga

SEQ ID NO: 1178457 - RNA, 19 nt, Homo sapiens
gagaauagcaggcaagaau

SEQ ID NO: 1178458 - RNA, 19 nt, Homo sapiens
caagaucuaugacagcauu

SEQ ID NO: 1178459 - RNA, 19 nt, Homo sapiens
cagaaagucuccuacauca

SEQ ID NO: 1178460 - RNA, 19 nt, Homo sapiens
cgaccaggcugacaccuuu

SEQ ID NO: 1178461 - RNA, 19 nt, Homo sapiens
cgacagaaauggcaacauc

SEQ ID NO: 1178462 - RNA, 19 nt, Homo sapiens
aggaagggcuggacauuaa

SEQ ID NO: 1178463 - RNA, 19 nt, Homo sapiens
gcucaguucuuucauggaa

SEQ ID NO: 1178464 - RNA, 19 nt, Homo sapiens
ggaccaagaggauugagua

SEQ ID NO: 1178465 - RNA, 19 nt, Homo sapiens
uaucuucccucuugagaaa

SEQ ID NO: 1178466 - RNA, 19 nt, Homo sapiens
caaaguauccuccaaaguc

SEQ ID NO: 1178467 - RNA, 19 nt, Homo sapiens
uaaccgugcucuccagaaa

SEQ ID NO: 1178468 - RNA, 19 nt, Homo sapiens
gaaaugaaccggcaucacu

SEQ ID NO: 1178469 - RNA, 19 nt, Homo sapiens
ugaaggaugucaacgaguu

SEQ ID NO: 1178470 - RNA, 19 nt, Homo sapiens
ccacgaagcucugagaaca

SEQ ID NO: 1178471 - RNA, 19 nt, Homo sapiens
gaucgagacuucauaucau

SEQ ID NO: 1178472 - RNA, 19 nt, Homo sapiens
guacacacauucucucucu

SEQ ID NO: 1178473 - RNA, 19 nt, Homo sapiens
cuaccugucugcagaguuu

SEQ ID NO: 1178474 - RNA, 19 nt, Homo sapiens
cuaguuaaguggcauuuau

SEQ ID NO: 1178475 - RNA, 19 nt, Homo sapiens
gaaauuuaacugcaaggaa

SEQ ID NO: 1178476 - RNA, 19 nt, Homo sapiens
caccaagucuacaaugaaa

SEQ ID NO: 1178477 - RNA, 19 nt, Homo sapiens
ucaaagagccagccuacaa

SEQ ID NO: 1178478 - RNA, 19 nt, Homo sapiens
ccagaaagcagauggaaau

SEQ ID NO: 1178479 - RNA, 19 nt, Homo sapiens
ggacuucaggguagacuuu

SEQ ID NO: 1178480 - RNA, 19 nt, Homo sapiens
gaaagucuccuacaucaac

SEQ ID NO: 1178481 - RNA, 19 nt, Homo sapiens
gagaccugcugcccaguuu

SEQ ID NO: 1178482 - RNA, 19 nt, Homo sapiens
gcugagcuaugacaaacaa

SEQ ID NO: 1178483 - RNA, 19 nt, Homo sapiens
gagauggacugggacgauu

SEQ ID NO: 1178484 - RNA, 19 nt, Homo sapiens
gaagcuggaucagauuugu

SEQ ID NO: 1178485 - RNA, 19 nt, Homo sapiens
ggacagcagugagaugauc

SEQ ID NO: 1178486 - RNA, 19 nt, Homo sapiens
gaaauggcaacaucaggaa

SEQ ID NO: 1178487 - RNA, 19 nt, Homo sapiens
ggaaaucugugcguucaag

SEQ ID NO: 1178488 - RNA, 19 nt, Homo sapiens
cagagcuggucccuaguua

SEQ ID NO: 1178489 - RNA, 19 nt, Homo sapiens
ggaggaacacuuuagauag

SEQ ID NO: 1178490 - RNA, 19 nt, Homo sapiens
ggacacaacacaacacaca

SEQ ID NO: 1178491 - RNA, 19 nt, Homo sapiens
acaaacaacaccaguauga

SEQ ID NO: 1178492 - RNA, 19 nt, Homo sapiens
gagcaugucaaucaucuga

SEQ ID NO: 1178493 - RNA, 19 nt, Homo sapiens
ucagaagucuuagaggaaa

SEQ ID NO: 1178494 - RNA, 19 nt, Homo sapiens
ugagguagaugccuaugug

SEQ ID NO: 1178495 - RNA, 19 nt, Homo sapiens
gcagaaggaguacacauuc

SEQ ID NO: 1178496 - RNA, 19 nt, Homo sapiens
gaauuagggccuugacaga

SEQ ID NO: 1178497 - RNA, 19 nt, Homo sapiens
gaacuucacacacguaagg

SEQ ID NO: 1178498 - RNA, 19 nt, Homo sapiens
gccaaggaauaaaguauca

SEQ ID NO: 1178499 - RNA, 19 nt, Homo sapiens
caacugccgccucgucuuu

SEQ ID NO: 1178500 - RNA, 19 nt, Homo sapiens
gaaaucgucaccacagaug

SEQ ID NO: 1178501 - RNA, 19 nt, Homo sapiens
ucuuagugcuuaacaguuu

SEQ ID NO: 1178502 - RNA, 19 nt, Homo sapiens
ggaucgagacuucauauca

SEQ ID NO: 1178503 - RNA, 19 nt, Homo sapiens
ccaagaggauugaguacca

SEQ ID NO: 1178504 - RNA, 19 nt, Homo sapiens
ucuccuaucuucccucuug

SEQ ID NO: 1178505 - RNA, 19 nt, Homo sapiens
uauggucccuuaucuccua

SEQ ID NO: 1178506 - RNA, 19 nt, Homo sapiens
caacaaggacacaacacaa

SEQ ID NO: 1178507 - RNA, 19 nt, Homo sapiens
gacuccagguugcuucaua

SEQ ID NO: 1178508 - RNA, 19 nt, Homo sapiens
ggaggaagaagccgaggaa

SEQ ID NO: 1178509 - RNA, 19 nt, Homo sapiens
aggaaaugcuucauaacuu

SEQ ID NO: 1178510 - RNA, 19 nt, Homo sapiens
gaagggcuggacauuaauu

SEQ ID NO: 1178511 - RNA, 19 nt, Homo sapiens
ggagaccuacucugagaaa

SEQ ID NO: 1178512 - RNA, 19 nt, Homo sapiens
cagagcugcagacuaauua

SEQ ID NO: 1178513 - RNA, 19 nt, Homo sapiens
uuagauagagggcaaauau

SEQ ID NO: 1178514 - RNA, 19 nt, Homo sapiens
gcuaaugaggucaaacgua

SEQ ID NO: 1178515 - RNA, 19 nt, Homo sapiens
caacacaacacacaacaag

SEQ ID NO: 1178516 - RNA, 19 nt, Homo sapiens
ggguagacuuuguccugua

SEQ ID NO: 1178517 - RNA, 19 nt, Homo sapiens
gacugaggcugccaaggaa

SEQ ID NO: 1178518 - RNA, 19 nt, Homo sapiens
acaguuugcucaguucuuu

SEQ ID NO: 1178519 - RNA, 19 nt, Homo sapiens
ggauggagcaacauaugaa

SEQ ID NO: 1178520 - RNA, 19 nt, Homo sapiens
gcugcagacuaauuacauu

SEQ ID NO: 1178521 - RNA, 19 nt, Homo sapiens
uggcaagacuggaccaaga

SEQ ID NO: 1178522 - RNA, 19 nt, Homo sapiens
aaacaacaccaguaugaga

SEQ ID NO: 1178523 - RNA, 19 nt, Homo sapiens
ugacaaacaacaccaguau

SEQ ID NO: 1178524 - RNA, 19 nt, Homo sapiens
gggcaaauauaucugaaaa

SEQ ID NO: 1178525 - RNA, 19 nt, Homo sapiens
gugacccucuucccugaua

SEQ ID NO: 1178526 - RNA, 19 nt, Homo sapiens
gaucugcaacuaugaaauc

SEQ ID NO: 1178527 - RNA, 19 nt, Homo sapiens
uaacugcaaggaauuagaa

SEQ ID NO: 1178528 - RNA, 19 nt, Homo sapiens
caaggacagucacaacaag

SEQ ID NO: 1178529 - RNA, 19 nt, Homo sapiens
caaggacagucacaacaag

SEQ ID NO: 1178530 - RNA, 19 nt, Homo sapiens
ccagguugcuucauacaag

SEQ ID NO: 1178531 - RNA, 19 nt, Homo sapiens
gaagaagccgaggaagaaa

SEQ ID NO: 1178532 - RNA, 19 nt, Homo sapiens
gaccaagucucagauaagg

SEQ ID NO: 1178533 - RNA, 19 nt, Homo sapiens
gaaggaugucaacgaguuu

SEQ ID NO: 1178534 - RNA, 19 nt, Homo sapiens
ucccuuaucuccuaucuuc

SEQ ID NO: 1178535 - RNA, 19 nt, Homo sapiens
auaaggagcaugucaauca

SEQ ID NO: 1178536 - RNA, 19 nt, Homo sapiens
gaggaaaugcuucauaacu

SEQ ID NO: 1178537 - RNA, 19 nt, Homo sapiens
agucauaacugagaacaau

SEQ ID NO: 1178538 - RNA, 19 nt, Homo sapiens
cagaaggaguacacauuca

SEQ ID NO: 1178539 - RNA, 19 nt, Homo sapiens
cauugcagcuucuucuuuc

SEQ ID NO: 1178540 - RNA, 19 nt, Homo sapiens
gaaauuggaugucaccauu

SEQ ID NO: 1178541 - RNA, 19 nt, Homo sapiens
ggaguagaaugcaugauua

SEQ ID NO: 1178542 - RNA, 19 nt, Homo sapiens
guaugaagcugaaggaauu

SEQ ID NO: 1178543 - RNA, 19 nt, Homo sapiens
caagauuucucuacauuug

SEQ ID NO: 1178544 - RNA, 19 nt, Homo sapiens
ggauguaacuggaauaaag

SEQ ID NO: 1178545 - RNA, 19 nt, Homo sapiens
uaagauaacccucaucauu

SEQ ID NO: 1178546 - RNA, 19 nt, Homo sapiens
gaugaaagcacuaguaaau

SEQ ID NO: 1178547 - RNA, 19 nt, Homo sapiens
ugaaagcacuaguaaauca

SEQ ID NO: 1178548 - RNA, 19 nt, Homo sapiens
ggaagcagauucacugagu

SEQ ID NO: 1178549 - RNA, 19 nt, Homo sapiens
caaaggaggugccuacuac

SEQ ID NO: 1178550 - RNA, 19 nt, Homo sapiens
ggacauguacugaaaauua

SEQ ID NO: 1178551 - RNA, 19 nt, Homo sapiens
uaaaagagcccaucauuaa

SEQ ID NO: 1178552 - RNA, 19 nt, Homo sapiens
gaacgaguggagcauauaa

SEQ ID NO: 1178553 - RNA, 19 nt, Homo sapiens
gcagauguguuuccagauc

SEQ ID NO: 1178554 - RNA, 19 nt, Homo sapiens
gcagaugaaagcacuagua

SEQ ID NO: 1178555 - RNA, 19 nt, Homo sapiens
gaaaaguucuguaaucugu

SEQ ID NO: 1178556 - RNA, 19 nt, Homo sapiens
guagaaugcaugauuauug

SEQ ID NO: 1178557 - RNA, 19 nt, Homo sapiens
aggauuugcucgaauauuu

SEQ ID NO: 1178558 - RNA, 19 nt, Homo sapiens
gcugaugaauuguauggaa

SEQ ID NO: 1178559 - RNA, 19 nt, Homo sapiens
guuugcagguuaccaguua

SEQ ID NO: 1178560 - RNA, 19 nt, Homo sapiens
gucccaaacugaaacuaua

SEQ ID NO: 1178561 - RNA, 19 nt, Homo sapiens
aaacaacggaguucucuuu

SEQ ID NO: 1178562 - RNA, 19 nt, Homo sapiens
uaagaaguuugaagaggaa

SEQ ID NO: 1178563 - RNA, 19 nt, Homo sapiens
gccaaaugcucguaucuca

SEQ ID NO: 1178564 - RNA, 19 nt, Homo sapiens
gaaauauuccucugcuguu

SEQ ID NO: 1178565 - RNA, 19 nt, Homo sapiens
cacauuaguuacaggauuu

SEQ ID NO: 1178566 - RNA, 19 nt, Homo sapiens
cuaggaagguugugaggaa

SEQ ID NO: 1178567 - RNA, 19 nt, Homo sapiens
agaaguaucugcugaggau

SEQ ID NO: 1178568 - RNA, 19 nt, Homo sapiens
cagauucacugaguucaaa

SEQ ID NO: 1178569 - RNA, 19 nt, Homo sapiens
caucaugcccuucacuuaa

SEQ ID NO: 1178570 - RNA, 19 nt, Homo sapiens
caacagcgcuccccauuuc

SEQ ID NO: 1178571 - RNA, 19 nt, Homo sapiens
gauaacaaaggaccaaaga

SEQ ID NO: 1178572 - RNA, 19 nt, Homo sapiens
gcaggcagccaauguguug

SEQ ID NO: 1178573 - RNA, 19 nt, Homo sapiens
gaagcagauucacugaguu

SEQ ID NO: 1178574 - RNA, 19 nt, Homo sapiens
cagaagaaauuggauguca

SEQ ID NO: 1178575 - RNA, 19 nt, Homo sapiens
gcccuucacuuaacuagga

SEQ ID NO: 1178576 - RNA, 19 nt, Homo sapiens
ggccguacauucuauaauc

SEQ ID NO: 1178577 - RNA, 19 nt, Homo sapiens
gaaaggcaucuguuacuuc

SEQ ID NO: 1178578 - RNA, 19 nt, Homo sapiens
gcaaggguaugggaugaug

SEQ ID NO: 1178579 - RNA, 19 nt, Homo sapiens
guacucacuuuguccaguu

SEQ ID NO: 1178580 - RNA, 19 nt, Homo sapiens
gaucuucauugcagaaagu

SEQ ID NO: 1178581 - RNA, 19 nt, Homo sapiens
ggaagaguaucaggaguag

SEQ ID NO: 1178582 - RNA, 19 nt, Homo sapiens
uaaaggauguuuucuguug

SEQ ID NO: 1178583 - RNA, 19 nt, Homo sapiens
uaacuggaauaaaggaugu

SEQ ID NO: 1178584 - RNA, 19 nt, Homo sapiens
gcguauagcccaagauuuc

SEQ ID NO: 1178585 - RNA, 19 nt, Homo sapiens
uacaggauuugcucgaaua

SEQ ID NO: 1178586 - RNA, 19 nt, Homo sapiens
gaaagucuggaguaaguga

SEQ ID NO: 1178587 - RNA, 19 nt, Homo sapiens
gaaacuauaccauucaaac

SEQ ID NO: 1178588 - RNA, 19 nt, Homo sapiens
aaaggcaucuguuacuuca

SEQ ID NO: 1178589 - RNA, 19 nt, Homo sapiens
ucuguaaucuguaaacuca

SEQ ID NO: 1178590 - RNA, 19 nt, Homo sapiens
aagcggagacaguaauuua

SEQ ID NO: 1178591 - RNA, 19 nt, Homo sapiens
ucacuuaacuaggaagguu

SEQ ID NO: 1178592 - RNA, 19 nt, Homo sapiens
gaacuacaagcagaugaaa

SEQ ID NO: 1178593 - RNA, 19 nt, Homo sapiens
acuaggagguggugagaaa

SEQ ID NO: 1178594 - RNA, 19 nt, Homo sapiens
ccaggagguggcauuauua

SEQ ID NO: 1178595 - RNA, 19 nt, Homo sapiens
cagguuaccaguuauauga

SEQ ID NO: 1178596 - RNA, 19 nt, Homo sapiens
gagcguauagcccaagauu

SEQ ID NO: 1178597 - RNA, 19 nt, Homo sapiens
caaggauggugccaagaug

SEQ ID NO: 1178598 - RNA, 19 nt, Homo sapiens
ugagaaagcccgagcacuu

SEQ ID NO: 1178599 - RNA, 19 nt, Homo sapiens
uaucccaguuugcagguua

SEQ ID NO: 1178600 - RNA, 19 nt, Homo sapiens
cccaagauuucucuacauu

SEQ ID NO: 1178601 - RNA, 19 nt, Homo sapiens
cagaugaaagcacuaguaa

SEQ ID NO: 1178602 - RNA, 19 nt, Homo sapiens
ugaaaggcaucuguuacuu

SEQ ID NO: 1178603 - RNA, 19 nt, Homo sapiens
gcgcaaggguaugggauga

SEQ ID NO: 1178604 - RNA, 19 nt, Homo sapiens
aagauaacccucaucauug

SEQ ID NO: 1178605 - RNA, 19 nt, Homo sapiens
acacauuaguuacaggauu

SEQ ID NO: 1178606 - RNA, 19 nt, Homo sapiens
gagaggucauugcuagaau

SEQ ID NO: 1178607 - RNA, 19 nt, Homo sapiens
ccacugggcuuuggaugau

SEQ ID NO: 1178608 - RNA, 19 nt, Homo sapiens
auacuuaccucgacaagca

SEQ ID NO: 1178609 - RNA, 19 nt, Homo sapiens
aaagagcccaucauuaaga

SEQ ID NO: 1178610 - RNA, 19 nt, Homo sapiens
uauggagacacauuaguua

SEQ ID NO: 1178611 - RNA, 19 nt, Homo sapiens
gcacuucacauaucaagag

SEQ ID NO: 1178612 - RNA, 19 nt, Homo sapiens
ccaguuauaugacaaugag

SEQ ID NO: 1178613 - RNA, 19 nt, Homo sapiens
ggaauuaucccaguuugca

SEQ ID NO: 1178614 - RNA, 19 nt, Homo sapiens
ccauaaagcggagacagua

SEQ ID NO: 1178615 - RNA, 19 nt, Homo sapiens
gcccaagugccuaagauaa

SEQ ID NO: 1178616 - RNA, 19 nt, Homo sapiens
caguuaugcugccaaagaa

SEQ ID NO: 1178617 - RNA, 19 nt, Homo sapiens
ccaguuaugcugccaaaga

SEQ ID NO: 1178618 - RNA, 19 nt, Homo sapiens
ggaguucucuuuucugaau

SEQ ID NO: 1178619 - RNA, 19 nt, Homo sapiens
gguuaugcuuggugauauu

SEQ ID NO: 1178620 - RNA, 19 nt, Homo sapiens
ccucugcuguuccuucaaa

SEQ ID NO: 1178621 - RNA, 19 nt, Homo sapiens
caauagagaagacugacuu

SEQ ID NO: 1178622 - RNA, 19 nt, Homo sapiens
aggcaauuaugucuucuaa

SEQ ID NO: 1178623 - RNA, 19 nt, Homo sapiens
uuacuucaguugcauaaag

SEQ ID NO: 1178624 - RNA, 19 nt, Homo sapiens
ucaguucuguaaucuguau

SEQ ID NO: 1178625 - RNA, 19 nt, Homo sapiens
ugaaggaauugccaaggau

SEQ ID NO: 1178626 - RNA, 19 nt, Homo sapiens
ggagacacauuaguuacag

SEQ ID NO: 1178627 - RNA, 19 nt, Homo sapiens
cuucacauaucaagaggaa

SEQ ID NO: 1178628 - RNA, 19 nt, Homo sapiens
uuagacuucucgaacauga

SEQ ID NO: 1178629 - RNA, 19 nt, Homo sapiens
caaaugcucguaucucagu

SEQ ID NO: 1178630 - RNA, 19 nt, Homo sapiens
cuauggagccggaaacuau

SEQ ID NO: 1178631 - RNA, 19 nt, Homo sapiens
gagaaagcccgagcacuuc

SEQ ID NO: 1178632 - RNA, 19 nt, Homo sapiens
caguagguaucguuggaaa

SEQ ID NO: 1178633 - RNA, 19 nt, Homo sapiens
gcaucuacuuaguugauuc

SEQ ID NO: 1178634 - RNA, 19 nt, Homo sapiens
ucaaaggaggugccuacua

SEQ ID NO: 1178635 - RNA, 19 nt, Homo sapiens
uagagaguaugaagcugaa

SEQ ID NO: 1178636 - RNA, 19 nt, Homo sapiens
ggaagguugugaggaaucu

SEQ ID NO: 1178637 - RNA, 19 nt, Homo sapiens
ucgacaagcagauguguuu

SEQ ID NO: 1178638 - RNA, 19 nt, Homo sapiens
uagaaugcaugauuauugc

SEQ ID NO: 1178639 - RNA, 19 nt, Homo sapiens
aagaguaucaggaguagaa

SEQ ID NO: 1178640 - RNA, 19 nt, Homo sapiens
ugaaagagcuguaaucaua

SEQ ID NO: 1178641 - RNA, 19 nt, Homo sapiens
gaagaaagcuggguaguuu

SEQ ID NO: 1178642 - RNA, 19 nt, Homo sapiens
gaagaagacuaauguauca

SEQ ID NO: 1178643 - RNA, 19 nt, Homo sapiens
gagcaagaaugcacaugua

SEQ ID NO: 1178644 - RNA, 19 nt, Homo sapiens
ggaagaaagagcuaaauuu

SEQ ID NO: 1178645 - RNA, 19 nt, Homo sapiens
gcacagguauguucucaga

SEQ ID NO: 1178646 - RNA, 19 nt, Homo sapiens
gagaaagaauuauguagug

SEQ ID NO: 1178647 - RNA, 19 nt, Homo sapiens
gauagugaauuccuaagaa

SEQ ID NO: 1178648 - RNA, 19 nt, Homo sapiens
gauaagauagccuugauuu

SEQ ID NO: 1178649 - RNA, 19 nt, Homo sapiens
gcaguucccuccauuuaga

SEQ ID NO: 1178650 - RNA, 19 nt, Homo sapiens
uagcagaaguggcauauga

SEQ ID NO: 1178651 - RNA, 19 nt, Homo sapiens
gagauggaaucacuaaaga

SEQ ID NO: 1178652 - RNA, 19 nt, Homo sapiens
caagaaugcacauguauaa

SEQ ID NO: 1178653 - RNA, 19 nt, Homo sapiens
gaacagaaucagaacauug

SEQ ID NO: 1178654 - RNA, 19 nt, Homo sapiens
gaagaaccaagaacuguaa

SEQ ID NO: 1178655 - RNA, 19 nt, Homo sapiens
ucaacaagcucaaauucuu

SEQ ID NO: 1178656 - RNA, 19 nt, Homo sapiens
ucucugacaugacauauuu

SEQ ID NO: 1178657 - RNA, 19 nt, Homo sapiens
gugugaagauguuguuaua

SEQ ID NO: 1178658 - RNA, 19 nt, Homo sapiens
gcaagaaugcacauguaua

SEQ ID NO: 1178659 - RNA, 19 nt, Homo sapiens
aaagagauguuuccagguu

SEQ ID NO: 1178660 - RNA, 19 nt, Homo sapiens
gauaauacuucaucugucu

SEQ ID NO: 1178661 - RNA, 19 nt, Homo sapiens
gaaugcacauguauaaagu

SEQ ID NO: 1178662 - RNA, 19 nt, Homo sapiens
ggcauucugugaaacuuua

SEQ ID NO: 1178663 - RNA, 19 nt, Homo sapiens
agacagacaauuaggauua

SEQ ID NO: 1178664 - RNA, 19 nt, Homo sapiens
ccaaacuacuguguauaua

SEQ ID NO: 1178665 - RNA, 19 nt, Homo sapiens
ucagugaccaucauaauaa

SEQ ID NO: 1178666 - RNA, 19 nt, Homo sapiens
guuguuaaccuuugaagua

SEQ ID NO: 1178667 - RNA, 19 nt, Homo sapiens
gauggaaucacuaaagaaa

SEQ ID NO: 1178668 - RNA, 19 nt, Homo sapiens
uuacaagcguuucuucaaa

SEQ ID NO: 1178669 - RNA, 19 nt, Homo sapiens
gaaucuagagcugauaaua

SEQ ID NO: 1178670 - RNA, 19 nt, Homo sapiens
gcuccaaacuacuguguau

SEQ ID NO: 1178671 - RNA, 19 nt, Homo sapiens
gaagacuaauguaucacaa

SEQ ID NO: 1178672 - RNA, 19 nt, Homo sapiens
gaagauggcaacuccuuau

SEQ ID NO: 1178673 - RNA, 19 nt, Homo sapiens
uaaguggacucaacagugu

SEQ ID NO: 1178674 - RNA, 19 nt, Homo sapiens
agaauuauguagugccuuu

SEQ ID NO: 1178675 - RNA, 19 nt, Homo sapiens
guaaguagaguuaggagaa

SEQ ID NO: 1178676 - RNA, 19 nt, Homo sapiens
uaaggcauauucuuucgaa

SEQ ID NO: 1178677 - RNA, 19 nt, Homo sapiens
uuagugaguuugccucuuu

SEQ ID NO: 1178678 - RNA, 19 nt, Homo sapiens
guuaugaagugauggaaga

SEQ ID NO: 1178679 - RNA, 19 nt, Homo sapiens
gaguuugccucuuucagaa

SEQ ID NO: 1178680 - RNA, 19 nt, Homo sapiens
gaugauaagcauggaauaa

SEQ ID NO: 1178681 - RNA, 19 nt, Homo sapiens
ggaauaaaguagaggaaaa

SEQ ID NO: 1178682 - RNA, 19 nt, Homo sapiens
aaagugccuuguuucauuu

SEQ ID NO: 1178683 - RNA, 19 nt, Homo sapiens
gaagaguggcaaauacuau

SEQ ID NO: 1178684 - RNA, 19 nt, Homo sapiens
gguuugagauagugaauuc

SEQ ID NO: 1178685 - RNA, 19 nt, Homo sapiens
cacguaaucuuuaucucua

SEQ ID NO: 1178686 - RNA, 19 nt, Homo sapiens
gaaagagcuguaaucauau

SEQ ID NO: 1178687 - RNA, 19 nt, Homo sapiens
ucagaagggucuuuaccaa

SEQ ID NO: 1178688 - RNA, 19 nt, Homo sapiens
uuuagaaccugaagaauca

SEQ ID NO: 1178689 - RNA, 19 nt, Homo sapiens
gaagacagacaauuaggau

SEQ ID NO: 1178690 - RNA, 19 nt, Homo sapiens
uuagaagacucaaauaugg

SEQ ID NO: 1178691 - RNA, 19 nt, Homo sapiens
gcauauuaguuguucucua

SEQ ID NO: 1178692 - RNA, 19 nt, Homo sapiens
guaccauucuguaucuuau

SEQ ID NO: 1178693 - RNA, 19 nt, Homo sapiens
ggagaaagaauuauguagu

SEQ ID NO: 1178694 - RNA, 19 nt, Homo sapiens
gaguuaggagaaagaauua

SEQ ID NO: 1178695 - RNA, 19 nt, Homo sapiens
cauauauacugcaaaguuc

SEQ ID NO: 1178696 - RNA, 19 nt, Homo sapiens
uaacauggagucaaggaaa

SEQ ID NO: 1178697 - RNA, 19 nt, Homo sapiens
uaaaguucuucaaggauga

SEQ ID NO: 1178698 - RNA, 19 nt, Homo sapiens
gaaacuuacuggggaaaua

SEQ ID NO: 1178699 - RNA, 19 nt, Homo sapiens
gaaggugaacagauccuaa

SEQ ID NO: 1178700 - RNA, 19 nt, Homo sapiens
gacuagcacuuccuccaaa

SEQ ID NO: 1178701 - RNA, 19 nt, Homo sapiens
agacaaguguuccugauca

SEQ ID NO: 1178702 - RNA, 19 nt, Homo sapiens
ccauauauacugcaaaguu

SEQ ID NO: 1178703 - RNA, 19 nt, Homo sapiens
gugaacagauccuaaaggu

SEQ ID NO: 1178704 - RNA, 19 nt, Homo sapiens
caaacuaccgcuuacagaa

SEQ ID NO: 1178705 - RNA, 19 nt, Homo sapiens
uaaguagaguuaggagaaa

SEQ ID NO: 1178706 - RNA, 19 nt, Homo sapiens
ucagaauacuaccuccuuu

SEQ ID NO: 1178707 - RNA, 19 nt, Homo sapiens
ggagauggaaucacuaaag

SEQ ID NO: 1178708 - RNA, 19 nt, Homo sapiens
cagaaagaacuacuugaaa

SEQ ID NO: 1178709 - RNA, 19 nt, Homo sapiens
ucucuaggcuuaaugacaa

SEQ ID NO: 1178710 - RNA, 19 nt, Homo sapiens
cuaccuagauuuagugagu

SEQ ID NO: 1178711 - RNA, 19 nt, Homo sapiens
agaagggucuuuaccaauc

SEQ ID NO: 1178712 - RNA, 19 nt, Homo sapiens
gccuauauauugcuccaaa

SEQ ID NO: 1178713 - RNA, 19 nt, Homo sapiens
cuacuauacuggguuauga

SEQ ID NO: 1178714 - RNA, 19 nt, Homo sapiens
aagagacacugaagaacaa

SEQ ID NO: 1178715 - RNA, 19 nt, Homo sapiens
caagagacacugaagaaca

SEQ ID NO: 1178716 - RNA, 19 nt, Homo sapiens
guacagcuucuuccauuga

SEQ ID NO: 1178717 - RNA, 19 nt, Homo sapiens
guuagaagacucaaauaug

SEQ ID NO: 1178718 - RNA, 19 nt, Homo sapiens
gauggcaacuccuuauguc

SEQ ID NO: 1178719 - RNA, 19 nt, Homo sapiens
gaagauguuguuauacugu

SEQ ID NO: 1178720 - RNA, 19 nt, Homo sapiens
gugaagauguuguuauacu

SEQ ID NO: 1178721 - RNA, 19 nt, Homo sapiens
ugaagaaucuagagcugau

SEQ ID NO: 1178722 - RNA, 19 nt, Homo sapiens
ucagaacauugucuuuaga

SEQ ID NO: 1178723 - RNA, 19 nt, Homo sapiens
acaaggacauugcuaacug

SEQ ID NO: 1178724 - RNA, 19 nt, Homo sapiens
uggcuugacuccugacauu

SEQ ID NO: 1178725 - RNA, 19 nt, Homo sapiens
guuugccucuuucagaaua

SEQ ID NO: 1178726 - RNA, 19 nt, Homo sapiens
aaaagugccuuguuucauu

SEQ ID NO: 1178727 - RNA, 19 nt, Homo sapiens
ugagucagcuuuaugaaaa

SEQ ID NO: 1178728 - RNA, 19 nt, Homo sapiens
gaagggucuuuaccaaucu

SEQ ID NO: 1178729 - RNA, 19 nt, Homo sapiens
aagcaguucccuccauuua

SEQ ID NO: 1178730 - RNA, 19 nt, Homo sapiens
caccuacuauacuggguua

SEQ ID NO: 1178731 - RNA, 19 nt, Homo sapiens
ugugcaagcuuguuggaaa

SEQ ID NO: 1178732 - RNA, 19 nt, Homo sapiens
gugauaagauagccuugau

SEQ ID NO: 1178733 - RNA, 19 nt, Homo sapiens
uaaaucagugaccaucaua

SEQ ID NO: 1178734 - RNA, 19 nt, Homo sapiens
gauagaaguagcagaagug

SEQ ID NO: 1178735 - RNA, 19 nt, Homo sapiens
ggaaagcagggcauucugu

SEQ ID NO: 1178736 - RNA, 19 nt, Homo sapiens
auuaagguguggcuguuua

SEQ ID NO: 1178737 - RNA, 19 nt, Homo sapiens
gagaacagaaucagaacau

SEQ ID NO: 1178738 - RNA, 19 nt, Homo sapiens
aaacuaccgcuuacagaaa

SEQ ID NO: 1178739 - RNA, 19 nt, Homo sapiens
gagacaaacuaccgcuuac

SEQ ID NO: 1178740 - RNA, 19 nt, Homo sapiens
ugaaagagcuguaaucaua

SEQ ID NO: 1178741 - RNA, 19 nt, Homo sapiens
gaagaaagcuggguaguuu

SEQ ID NO: 1178742 - RNA, 19 nt, Homo sapiens
gaagaagacuaauguauca

SEQ ID NO: 1178743 - RNA, 19 nt, Homo sapiens
gagcaagaaugcacaugua

SEQ ID NO: 1178744 - RNA, 19 nt, Homo sapiens
ggaagaaagagcuaaauuu

SEQ ID NO: 1178745 - RNA, 19 nt, Homo sapiens
gcacagguauguucucaga

SEQ ID NO: 1178746 - RNA, 19 nt, Homo sapiens
gagaaagaauuauguagug

SEQ ID NO: 1178747 - RNA, 19 nt, Homo sapiens
gauagugaauuccuaagaa

SEQ ID NO: 1178748 - RNA, 19 nt, Homo sapiens
gauaagauagccuugauuu

SEQ ID NO: 1178749 - RNA, 19 nt, Homo sapiens
gcaguucccuccauuuaga

SEQ ID NO: 1178750 - RNA, 19 nt, Homo sapiens
uagcagaaguggcauauga

SEQ ID NO: 1178751 - RNA, 19 nt, Homo sapiens
gagauggaaucacuaaaga

SEQ ID NO: 1178752 - RNA, 19 nt, Homo sapiens
caagaaugcacauguauaa

SEQ ID NO: 1178753 - RNA, 19 nt, Homo sapiens
gaacagaaucagaacauug

SEQ ID NO: 1178754 - RNA, 19 nt, Homo sapiens
gaagaaccaagaacuguaa

SEQ ID NO: 1178755 - RNA, 19 nt, Homo sapiens
ucaacaagcucaaauucuu

SEQ ID NO: 1178756 - RNA, 19 nt, Homo sapiens
ucucugacaugacauauuu

SEQ ID NO: 1178757 - RNA, 19 nt, Homo sapiens
gggcugagauagugaauuc

SEQ ID NO: 1178758 - RNA, 19 nt, Homo sapiens
gugugaagauguuguuaua

SEQ ID NO: 1178759 - RNA, 19 nt, Homo sapiens
gcaagaaugcacauguaua

SEQ ID NO: 1178760 - RNA, 19 nt, Homo sapiens
aaagagauguuuccagguu

SEQ ID NO: 1178761 - RNA, 19 nt, Homo sapiens
gauaauacuucaucugucu

SEQ ID NO: 1178762 - RNA, 19 nt, Homo sapiens
gaaugcacauguauaaagu

SEQ ID NO: 1178763 - RNA, 19 nt, Homo sapiens
ggcauucugugaaacuuua

SEQ ID NO: 1178764 - RNA, 19 nt, Homo sapiens
agacagacaauuaggauua

SEQ ID NO: 1178765 - RNA, 19 nt, Homo sapiens
ccaaacuacuguguauaua

SEQ ID NO: 1178766 - RNA, 19 nt, Homo sapiens
ucagugaccaucauaauaa

SEQ ID NO: 1178767 - RNA, 19 nt, Homo sapiens
guuguuaaccuuugaagua

SEQ ID NO: 1178768 - RNA, 19 nt, Homo sapiens
gauggaaucacuaaagaaa

SEQ ID NO: 1178769 - RNA, 19 nt, Homo sapiens
uuacaagcguuucuucaaa

SEQ ID NO: 1178770 - RNA, 19 nt, Homo sapiens
gaaucuagagcugauaaua

SEQ ID NO: 1178771 - RNA, 19 nt, Homo sapiens
gcuccaaacuacuguguau

SEQ ID NO: 1178772 - RNA, 19 nt, Homo sapiens
gaagacuaauguaucacaa

SEQ ID NO: 1178773 - RNA, 19 nt, Homo sapiens
gaagauggcaacuccuuau

SEQ ID NO: 1178774 - RNA, 19 nt, Homo sapiens
uaaguggacucaacagugu

SEQ ID NO: 1178775 - RNA, 19 nt, Homo sapiens
agaauuauguagugccuuu

SEQ ID NO: 1178776 - RNA, 19 nt, Homo sapiens
guaaguagaguuaggagaa

SEQ ID NO: 1178777 - RNA, 19 nt, Homo sapiens
uaaggcauauucuuucgaa

SEQ ID NO: 1178778 - RNA, 19 nt, Homo sapiens
uuagugaguuugccucuuu

SEQ ID NO: 1178779 - RNA, 19 nt, Homo sapiens
guuaugaagugauggaaga

SEQ ID NO: 1178780 - RNA, 19 nt, Homo sapiens
gaguuugccucuuucagaa

SEQ ID NO: 1178781 - RNA, 19 nt, Homo sapiens
aaagugccuuguuucauuu

SEQ ID NO: 1178782 - RNA, 19 nt, Homo sapiens
gaagaguggcaaauacuau

SEQ ID NO: 1178783 - RNA, 19 nt, Homo sapiens
cacguaaucuuuaucucua

SEQ ID NO: 1178784 - RNA, 19 nt, Homo sapiens
gaaagagcuguaaucauau

SEQ ID NO: 1178785 - RNA, 19 nt, Homo sapiens
gcauauuaguuguucucua

SEQ ID NO: 1178786 - RNA, 19 nt, Homo sapiens
uuuagaaccugaagaauca

SEQ ID NO: 1178787 - RNA, 19 nt, Homo sapiens
gaagacagacaauuaggau

SEQ ID NO: 1178788 - RNA, 19 nt, Homo sapiens
uuagaagacucaaauaugg

SEQ ID NO: 1178789 - RNA, 19 nt, Homo sapiens
guaccauucuguaucuuau

SEQ ID NO: 1178790 - RNA, 19 nt, Homo sapiens
ggagaaagaauuauguagu

SEQ ID NO: 1178791 - RNA, 19 nt, Homo sapiens
gaguuaggagaaagaauua

SEQ ID NO: 1178792 - RNA, 19 nt, Homo sapiens
cauauauacugcaaaguuc

SEQ ID NO: 1178793 - RNA, 19 nt, Homo sapiens
uaaaguucuucaaggauga

SEQ ID NO: 1178794 - RNA, 19 nt, Homo sapiens
gaaacuuacuggggaaaua

SEQ ID NO: 1178795 - RNA, 19 nt, Homo sapiens
gaaggugaacagauccuaa

SEQ ID NO: 1178796 - RNA, 19 nt, Homo sapiens
gacuagcacuuccuccaaa

SEQ ID NO: 1178797 - RNA, 19 nt, Homo sapiens
agacaaguguuccugauca

SEQ ID NO: 1178798 - RNA, 19 nt, Homo sapiens
ccauauauacugcaaaguu

SEQ ID NO: 1178799 - RNA, 19 nt, Homo sapiens
gugaacagauccuaaaggu

SEQ ID NO: 1178800 - RNA, 19 nt, Homo sapiens
caaacuaccgcuuacagaa

SEQ ID NO: 1178801 - RNA, 19 nt, Homo sapiens
uaaguagaguuaggagaaa

SEQ ID NO: 1178802 - RNA, 19 nt, Homo sapiens
ucagaauacuaccuccuuu

SEQ ID NO: 1178803 - RNA, 19 nt, Homo sapiens
uaaggagaguccgguuuaa

SEQ ID NO: 1178804 - RNA, 19 nt, Homo sapiens
ggagauggaaucacuaaag

SEQ ID NO: 1178805 - RNA, 19 nt, Homo sapiens
cagaaagaacuacuugaaa

SEQ ID NO: 1178806 - RNA, 19 nt, Homo sapiens
ucucuaggcuuaaugacaa

SEQ ID NO: 1178807 - RNA, 19 nt, Homo sapiens
gauggcaacuccuuauguc

SEQ ID NO: 1178808 - RNA, 19 nt, Homo sapiens
cuaccuagauuuagugagu

SEQ ID NO: 1178809 - RNA, 19 nt, Homo sapiens
gccuauauauugcuccaaa

SEQ ID NO: 1178810 - RNA, 19 nt, Homo sapiens
uuaaggagaguccgguuua

SEQ ID NO: 1178811 - RNA, 19 nt, Homo sapiens
cuacuauacuggguuauga

SEQ ID NO: 1178812 - RNA, 19 nt, Homo sapiens
aagagacacugaagaacaa

SEQ ID NO: 1178813 - RNA, 19 nt, Homo sapiens
caagagacacugaagaaca

SEQ ID NO: 1178814 - RNA, 19 nt, Homo sapiens
guacagcuucuuccauuga

SEQ ID NO: 1178815 - RNA, 19 nt, Homo sapiens
guuagaagacucaaauaug

SEQ ID NO: 1178816 - RNA, 19 nt, Homo sapiens
gaagauguuguuauacugu

SEQ ID NO: 1178817 - RNA, 19 nt, Homo sapiens
gugaagauguuguuauacu

SEQ ID NO: 1178818 - RNA, 19 nt, Homo sapiens
ugaagaaucuagagcugau

SEQ ID NO: 1178819 - RNA, 19 nt, Homo sapiens
ucagaacauugucuuuaga

SEQ ID NO: 1178820 - RNA, 19 nt, Homo sapiens
acaaggacauugcuaacug

SEQ ID NO: 1178821 - RNA, 19 nt, Homo sapiens
uggcuugacuccugacauu

SEQ ID NO: 1178822 - RNA, 19 nt, Homo sapiens
guuugccucuuucagaaua

SEQ ID NO: 1178823 - RNA, 19 nt, Homo sapiens
ugugcaagcuuguuggaaa

SEQ ID NO: 1178824 - RNA, 19 nt, Homo sapiens
aaaagugccuuguuucauu

SEQ ID NO: 1178825 - RNA, 19 nt, Homo sapiens
ugagucagcuuuaugaaaa

SEQ ID NO: 1178826 - RNA, 19 nt, Homo sapiens
aagcaguucccuccauuua

SEQ ID NO: 1178827 - RNA, 19 nt, Homo sapiens
caccuacuauacuggguua

SEQ ID NO: 1178828 - RNA, 19 nt, Homo sapiens
gugauaagauagccuugau

SEQ ID NO: 1178829 - RNA, 19 nt, Homo sapiens
uaaaucagugaccaucaua

SEQ ID NO: 1178830 - RNA, 19 nt, Homo sapiens
gauagaaguagcagaagug

SEQ ID NO: 1178831 - RNA, 19 nt, Homo sapiens
ggaaagcagggcauucugu

SEQ ID NO: 1178832 - RNA, 19 nt, Homo sapiens
auuaagguguggcuguuua

SEQ ID NO: 1178833 - RNA, 19 nt, Homo sapiens
gagaacagaaucagaacau

SEQ ID NO: 1178834 - RNA, 19 nt, Homo sapiens
aaacuaccgcuuacagaaa

SEQ ID NO: 1178835 - RNA, 19 nt, Homo sapiens
gagacaaacuaccgcuuac

SEQ ID NO: 1178836 - RNA, 19 nt, Homo sapiens
agagacaaacuaccgcuua

SEQ ID NO: 1178837 - RNA, 19 nt, Homo sapiens
acagugaauugggaagaua

SEQ ID NO: 1178838 - RNA, 19 nt, Homo sapiens
aggacuaaauuuacaggua

SEQ ID NO: 1178839 - RNA, 19 nt, Homo sapiens
caacaaacagaaaucaaag

SEQ ID NO: 1178840 - RNA, 19 nt, Homo sapiens
ugaaagagcuguaaucaua

SEQ ID NO: 1178841 - RNA, 19 nt, Homo sapiens
gaagaagacuaauguauca

SEQ ID NO: 1178842 - RNA, 19 nt, Homo sapiens
gagcaagaaugcacaugua

SEQ ID NO: 1178843 - RNA, 19 nt, Homo sapiens
ggaagaaagagcuaaauuu

SEQ ID NO: 1178844 - RNA, 19 nt, Homo sapiens
gcacagguauguucucaga

SEQ ID NO: 1178845 - RNA, 19 nt, Homo sapiens
gagaaagaauuauguagug

SEQ ID NO: 1178846 - RNA, 19 nt, Homo sapiens
gauagugaauuccuaagaa

SEQ ID NO: 1178847 - RNA, 19 nt, Homo sapiens
gauaagauagccuugauuu

SEQ ID NO: 1178848 - RNA, 19 nt, Homo sapiens
gcaguucccuccauuuaga

SEQ ID NO: 1178849 - RNA, 19 nt, Homo sapiens
uagcagaaguggcauauga

SEQ ID NO: 1178850 - RNA, 19 nt, Homo sapiens
gagauggaaucacuaaaga

SEQ ID NO: 1178851 - RNA, 19 nt, Homo sapiens
caagaaugcacauguauaa

SEQ ID NO: 1178852 - RNA, 19 nt, Homo sapiens
gaacagaaucagaacauug

SEQ ID NO: 1178853 - RNA, 19 nt, Homo sapiens
gaagaaccaagaacuguaa

SEQ ID NO: 1178854 - RNA, 19 nt, Homo sapiens
ucaacaagcucaaauucuu

SEQ ID NO: 1178855 - RNA, 19 nt, Homo sapiens
ucucugacaugacauauuu

SEQ ID NO: 1178856 - RNA, 19 nt, Homo sapiens
gugugaagauguuguuaua

SEQ ID NO: 1178857 - RNA, 19 nt, Homo sapiens
gcaagaaugcacauguaua

SEQ ID NO: 1178858 - RNA, 19 nt, Homo sapiens
gggcugagauagugaauuc

SEQ ID NO: 1178859 - RNA, 19 nt, Homo sapiens
aaagagauguuuccagguu

SEQ ID NO: 1178860 - RNA, 19 nt, Homo sapiens
gauaauacuucaucugucu

SEQ ID NO: 1178861 - RNA, 19 nt, Homo sapiens
gaaugcacauguauaaagu

SEQ ID NO: 1178862 - RNA, 19 nt, Homo sapiens
ggcauucugugaaacuuua

SEQ ID NO: 1178863 - RNA, 19 nt, Homo sapiens
agacagacaauuaggauua

SEQ ID NO: 1178864 - RNA, 19 nt, Homo sapiens
ccaaacuacuguguauaua

SEQ ID NO: 1178865 - RNA, 19 nt, Homo sapiens
ucagugaccaucauaauaa

SEQ ID NO: 1178866 - RNA, 19 nt, Homo sapiens
guuguuaaccuuugaagua

SEQ ID NO: 1178867 - RNA, 19 nt, Homo sapiens
gauggaaucacuaaagaaa

SEQ ID NO: 1178868 - RNA, 19 nt, Homo sapiens
uuacaagcguuucuucaaa

SEQ ID NO: 1178869 - RNA, 19 nt, Homo sapiens
gaaucuagagcugauaaua

SEQ ID NO: 1178870 - RNA, 19 nt, Homo sapiens
gcuccaaacuacuguguau

SEQ ID NO: 1178871 - RNA, 19 nt, Homo sapiens
gaagacuaauguaucacaa

SEQ ID NO: 1178872 - RNA, 19 nt, Homo sapiens
gaagauggcaacuccuuau

SEQ ID NO: 1178873 - RNA, 19 nt, Homo sapiens
uaaguggacucaacagugu

SEQ ID NO: 1178874 - RNA, 19 nt, Homo sapiens
agaauuauguagugccuuu

SEQ ID NO: 1178875 - RNA, 19 nt, Homo sapiens
guaaguagaguuaggagaa

SEQ ID NO: 1178876 - RNA, 19 nt, Homo sapiens
uaaggcauauucuuucgaa

SEQ ID NO: 1178877 - RNA, 19 nt, Homo sapiens
uuagugaguuugccucuuu

SEQ ID NO: 1178878 - RNA, 19 nt, Homo sapiens
guuaugaagugauggaaga

SEQ ID NO: 1178879 - RNA, 19 nt, Homo sapiens
gaguuugccucuuucagaa

SEQ ID NO: 1178880 - RNA, 19 nt, Homo sapiens
aaagugccuuguuucauuu

SEQ ID NO: 1178881 - RNA, 19 nt, Homo sapiens
gaagaguggcaaauacuau

SEQ ID NO: 1178882 - RNA, 19 nt, Homo sapiens
gcauauuaguuguucucua

SEQ ID NO: 1178883 - RNA, 19 nt, Homo sapiens
cacguaaucuuuaucucua

SEQ ID NO: 1178884 - RNA, 19 nt, Homo sapiens
gaaagagcuguaaucauau

SEQ ID NO: 1178885 - RNA, 19 nt, Homo sapiens
uuuagaaccugaagaauca

SEQ ID NO: 1178886 - RNA, 19 nt, Homo sapiens
gaagacagacaauuaggau

SEQ ID NO: 1178887 - RNA, 19 nt, Homo sapiens
uuagaagacucaaauaugg

SEQ ID NO: 1178888 - RNA, 19 nt, Homo sapiens
guaccauucuguaucuuau

SEQ ID NO: 1178889 - RNA, 19 nt, Homo sapiens
ggagaaagaauuauguagu

SEQ ID NO: 1178890 - RNA, 19 nt, Homo sapiens
gaguuaggagaaagaauua

SEQ ID NO: 1178891 - RNA, 19 nt, Homo sapiens
cauauauacugcaaaguuc

SEQ ID NO: 1178892 - RNA, 19 nt, Homo sapiens
uaaaguucuucaaggauga

SEQ ID NO: 1178893 - RNA, 19 nt, Homo sapiens
gaaacuuacuggggaaaua

SEQ ID NO: 1178894 - RNA, 19 nt, Homo sapiens
gaaggugaacagauccuaa

SEQ ID NO: 1178895 - RNA, 19 nt, Homo sapiens
gacuagcacuuccuccaaa

SEQ ID NO: 1178896 - RNA, 19 nt, Homo sapiens
agacaaguguuccugauca

SEQ ID NO: 1178897 - RNA, 19 nt, Homo sapiens
ccauauauacugcaaaguu

SEQ ID NO: 1178898 - RNA, 19 nt, Homo sapiens
gugaacagauccuaaaggu

SEQ ID NO: 1178899 - RNA, 19 nt, Homo sapiens
caaacuaccgcuuacagaa

SEQ ID NO: 1178900 - RNA, 19 nt, Homo sapiens
uaaguagaguuaggagaaa

SEQ ID NO: 1178901 - RNA, 19 nt, Homo sapiens
ucagaauacuaccuccuuu

SEQ ID NO: 1178902 - RNA, 19 nt, Homo sapiens
ggagauggaaucacuaaag

SEQ ID NO: 1178903 - RNA, 19 nt, Homo sapiens
cagaaagaacuacuugaaa

SEQ ID NO: 1178904 - RNA, 19 nt, Homo sapiens
uaaggagaguccgguuuaa

SEQ ID NO: 1178905 - RNA, 19 nt, Homo sapiens
cuaccuagauuuagugagu

SEQ ID NO: 1178906 - RNA, 19 nt, Homo sapiens
gccuauauauugcuccaaa

SEQ ID NO: 1178907 - RNA, 19 nt, Homo sapiens
uuaaggagaguccgguuua

SEQ ID NO: 1178908 - RNA, 19 nt, Homo sapiens
gauggcaacuccuuauguc

SEQ ID NO: 1178909 - RNA, 19 nt, Homo sapiens
cuacuauacuggguuauga

SEQ ID NO: 1178910 - RNA, 19 nt, Homo sapiens
aagagacacugaagaacaa

SEQ ID NO: 1178911 - RNA, 19 nt, Homo sapiens
caagagacacugaagaaca

SEQ ID NO: 1178912 - RNA, 19 nt, Homo sapiens
guacagcuucuuccauuga

SEQ ID NO: 1178913 - RNA, 19 nt, Homo sapiens
guuagaagacucaaauaug

SEQ ID NO: 1178914 - RNA, 19 nt, Homo sapiens
gaagauguuguuauacugu

SEQ ID NO: 1178915 - RNA, 19 nt, Homo sapiens
gugaagauguuguuauacu

SEQ ID NO: 1178916 - RNA, 19 nt, Homo sapiens
ugaagaaucuagagcugau

SEQ ID NO: 1178917 - RNA, 19 nt, Homo sapiens
ucagaacauugucuuuaga

SEQ ID NO: 1178918 - RNA, 19 nt, Homo sapiens
acaaggacauugcuaacug

SEQ ID NO: 1178919 - RNA, 19 nt, Homo sapiens
uggcuugacuccugacauu

SEQ ID NO: 1178920 - RNA, 19 nt, Homo sapiens
guuugccucuuucagaaua

SEQ ID NO: 1178921 - RNA, 19 nt, Homo sapiens
aaaagugccuuguuucauu

SEQ ID NO: 1178922 - RNA, 19 nt, Homo sapiens
ugagucagcuuuaugaaaa

SEQ ID NO: 1178923 - RNA, 19 nt, Homo sapiens
ugugcaagcuuguuggaaa

SEQ ID NO: 1178924 - RNA, 19 nt, Homo sapiens
aagcaguucccuccauuua

SEQ ID NO: 1178925 - RNA, 19 nt, Homo sapiens
caccuacuauacuggguua

SEQ ID NO: 1178926 - RNA, 19 nt, Homo sapiens
gugauaagauagccuugau

SEQ ID NO: 1178927 - RNA, 19 nt, Homo sapiens
uaaaucagugaccaucaua

SEQ ID NO: 1178928 - RNA, 19 nt, Homo sapiens
gauagaaguagcagaagug

SEQ ID NO: 1178929 - RNA, 19 nt, Homo sapiens
ggaaagcagggcauucugu

SEQ ID NO: 1178930 - RNA, 19 nt, Homo sapiens
auuaagguguggcuguuua

SEQ ID NO: 1178931 - RNA, 19 nt, Homo sapiens
gagaacagaaucagaacau

SEQ ID NO: 1178932 - RNA, 19 nt, Homo sapiens
aaacuaccgcuuacagaaa

SEQ ID NO: 1178933 - RNA, 19 nt, Homo sapiens
gagacaaacuaccgcuuac

SEQ ID NO: 1178934 - RNA, 19 nt, Homo sapiens
agagacaaacuaccgcuua

SEQ ID NO: 1178935 - RNA, 19 nt, Homo sapiens
acagugaauugggaagaua

SEQ ID NO: 1178936 - RNA, 19 nt, Homo sapiens
aggacuaaauuuacaggua

SEQ ID NO: 1178937 - RNA, 19 nt, Homo sapiens
aggcccacauucuuaaaua

SEQ ID NO: 1178938 - RNA, 19 nt, Homo sapiens
ugaagaagacuaauguauc

SEQ ID NO: 1178939 - RNA, 19 nt, Homo sapiens
cauaugaugcugaagaaga

SEQ ID NO: 1178940 - RNA, 19 nt, Homo sapiens
cagcagcgcuucaacauca

SEQ ID NO: 1178941 - RNA, 19 nt, Homo sapiens
gcccucagcuucacaguca

SEQ ID NO: 1178942 - RNA, 19 nt, Homo sapiens
caacgacaccuucuacuuc

SEQ ID NO: 1178943 - RNA, 19 nt, Homo sapiens
ccgaagaaaugaaguuaca

SEQ ID NO: 1178944 - RNA, 19 nt, Homo sapiens
caacaugugguucgacuuc

SEQ ID NO: 1178945 - RNA, 19 nt, Homo sapiens
ccaagaacaacaugugguu

SEQ ID NO: 1178946 - RNA, 19 nt, Homo sapiens
gaacgucuacgccaagaac

SEQ ID NO: 1178947 - RNA, 19 nt, Homo sapiens
ggacuuagagcuggacaca

SEQ ID NO: 1178948 - RNA, 19 nt, Homo sapiens
ugccugagcuccaguacau

SEQ ID NO: 1178949 - RNA, 19 nt, Homo sapiens
aggccgacauccuggguua

SEQ ID NO: 1178950 - RNA, 19 nt, Homo sapiens
gaaccacacgcagaucaga

SEQ ID NO: 1178951 - RNA, 19 nt, Homo sapiens
ugaaacugguacggucuuu

SEQ ID NO: 1178952 - RNA, 19 nt, Homo sapiens
ccaacgacaccuucuacuu

SEQ ID NO: 1178953 - RNA, 19 nt, Homo sapiens
gagguuggcgggaacugaa

SEQ ID NO: 1178954 - RNA, 19 nt, Homo sapiens
cacagucaccgaagaaaug

SEQ ID NO: 1178955 - RNA, 19 nt, Homo sapiens
caccgaagaaaugaaguua

SEQ ID NO: 1178956 - RNA, 19 nt, Homo sapiens
agaaagucaugcccaacga

SEQ ID NO: 1178957 - RNA, 19 nt, Homo sapiens
gagcucaagccucgacugu

SEQ ID NO: 1178958 - RNA, 19 nt, Homo sapiens
ucaagaaccacacgcagau

SEQ ID NO: 1178959 - RNA, 19 nt, Homo sapiens
aggccaagaugauguccuu

SEQ ID NO: 1178960 - RNA, 19 nt, Homo sapiens
ucacagucaccgaagaaau

SEQ ID NO: 1178961 - RNA, 19 nt, Homo sapiens
ucaccgaagaaaugaaguu

SEQ ID NO: 1178962 - RNA, 19 nt, Homo sapiens
ccagaggccaagaugaugu

SEQ ID NO: 1178963 - RNA, 19 nt, Homo sapiens
ugccucaggugcagaaagu

SEQ ID NO: 1178964 - RNA, 19 nt, Homo sapiens
gcagcagcgcuucaacauc

SEQ ID NO: 1178965 - RNA, 19 nt, Homo sapiens
gagaagccccucaagaaca

SEQ ID NO: 1178966 - RNA, 19 nt, Homo sapiens
cggagaagccccucaagaa

SEQ ID NO: 1178967 - RNA, 19 nt, Homo sapiens
gagcuacucucaaguuaua

SEQ ID NO: 1178968 - RNA, 19 nt, Homo sapiens
gcacagauuccguccuuua

SEQ ID NO: 1178969 - RNA, 19 nt, Homo sapiens
ccacacgccugaacuuuaa

SEQ ID NO: 1178970 - RNA, 19 nt, Homo sapiens
caaguaagcacucaauaaa

SEQ ID NO: 1178971 - RNA, 19 nt, Homo sapiens
gcggauggauucauucauu

SEQ ID NO: 1178972 - RNA, 19 nt, Homo sapiens
cauacuggcuucuagaauu

SEQ ID NO: 1178973 - RNA, 19 nt, Homo sapiens
gauccaaugaguugauuua

SEQ ID NO: 1178974 - RNA, 19 nt, Homo sapiens
ccaaguaagcacucaauaa

SEQ ID NO: 1178975 - RNA, 19 nt, Homo sapiens
gcgcagcucucuucugugu

SEQ ID NO: 1178976 - RNA, 19 nt, Homo sapiens
cgagaagggugaugaggaa

SEQ ID NO: 1178977 - RNA, 19 nt, Homo sapiens
ccaaugaguugauuuaggu

SEQ ID NO: 1178978 - RNA, 19 nt, Homo sapiens
guaaggaccugaagugacu

SEQ ID NO: 1178979 - RNA, 19 nt, Homo sapiens
gcagcucucuucuguguuc

SEQ ID NO: 1178980 - RNA, 19 nt, Homo sapiens
uauggaugcuucuaucuuu

SEQ ID NO: 1178981 - RNA, 19 nt, Homo sapiens
gaaauucacccucacaaac

SEQ ID NO: 1178982 - RNA, 19 nt, Homo sapiens
cagcgcagcucucuucugu

SEQ ID NO: 1178983 - RNA, 19 nt, Homo sapiens
caaguuacauagccucugu

SEQ ID NO: 1178984 - RNA, 19 nt, Homo sapiens
caagcucuuugcuaaguuu

SEQ ID NO: 1178985 - RNA, 19 nt, Homo sapiens
gacaagcucuuugcuaagu

SEQ ID NO: 1178986 - RNA, 19 nt, Homo sapiens
gcugggauaugacaucuca

SEQ ID NO: 1178987 - RNA, 19 nt, Homo sapiens
gagccaggaugggcaguuu

SEQ ID NO: 1178988 - RNA, 19 nt, Homo sapiens
aguaagcacucaauaaauc

SEQ ID NO: 1178989 - RNA, 19 nt, Homo sapiens
augacaagcucuuugcuaa

SEQ ID NO: 1178990 - RNA, 19 nt, Homo sapiens
cggauggauucauucauuu

SEQ ID NO: 1178991 - RNA, 19 nt, Homo sapiens
ucucggcucugcugggaua

SEQ ID NO: 1178992 - RNA, 19 nt, Homo sapiens
caauaaaucacucaacucu

SEQ ID NO: 1178993 - RNA, 19 nt, Homo sapiens
gaagggugaugaggaaguc

SEQ ID NO: 1178994 - RNA, 19 nt, Homo sapiens
gaccaaagagcgauacauc

SEQ ID NO: 1178995 - RNA, 19 nt, Homo sapiens
ggaaaagucuccaucuucu

SEQ ID NO: 1178996 - RNA, 19 nt, Homo sapiens
ggugagagaggacacagaa

SEQ ID NO: 1178997 - RNA, 19 nt, Homo sapiens
gugaggauccaaugaguug

SEQ ID NO: 1178998 - RNA, 19 nt, Homo sapiens
gcucuacacucucaaugac

SEQ ID NO: 1178999 - RNA, 19 nt, Homo sapiens
ucuuaacucuggccacuga

SEQ ID NO: 1179000 - RNA, 19 nt, Homo sapiens
ugcacuacaucuuuccaua

SEQ ID NO: 1179001 - RNA, 19 nt, Homo sapiens
gagaaauucacccucacaa

SEQ ID NO: 1179002 - RNA, 19 nt, Homo sapiens
guaagcacucaauaaauca

SEQ ID NO: 1179003 - RNA, 19 nt, Homo sapiens
gguaagcaccuagcacaug

SEQ ID NO: 1179004 - RNA, 19 nt, Homo sapiens
cacagaauggccacugaua

SEQ ID NO: 1179005 - RNA, 19 nt, Homo sapiens
gaacuuuaaggaucauugg

SEQ ID NO: 1179006 - RNA, 19 nt, Homo sapiens
ccaaagagcgauacaucuc

SEQ ID NO: 1179007 - RNA, 19 nt, Homo sapiens
gcacuacaucuuuccauac

SEQ ID NO: 1179008 - RNA, 19 nt, Homo sapiens
ccacugaacagaccuaugc

SEQ ID NO: 1179009 - RNA, 19 nt, Homo sapiens
auacuggcuucuagaauuc

SEQ ID NO: 1179010 - RNA, 19 nt, Homo sapiens
gccuggacauuguucuuug

SEQ ID NO: 1179011 - RNA, 19 nt, Homo sapiens
ccaccucucuccagcaaac

SEQ ID NO: 1179012 - RNA, 19 nt, Homo sapiens
agaaauucacccucacaaa

SEQ ID NO: 1179013 - RNA, 19 nt, Homo sapiens
cacagaaggugccaacacu

SEQ ID NO: 1179014 - RNA, 19 nt, Homo sapiens
cccacacgccugaacuuua

SEQ ID NO: 1179015 - RNA, 19 nt, Homo sapiens
aggcacagauuccguccuu

SEQ ID NO: 1179016 - RNA, 19 nt, Homo sapiens
cugagcggauggauucauu

SEQ ID NO: 1179017 - RNA, 19 nt, Homo sapiens
ucuacacucucaaugacaa

SEQ ID NO: 1179018 - RNA, 19 nt, Homo sapiens
gagcggauggauucauuca

SEQ ID NO: 1179019 - RNA, 19 nt, Homo sapiens
auacaucuccugccucuuc

SEQ ID NO: 1179020 - RNA, 19 nt, Homo sapiens
cagauuccguccuuuacca

SEQ ID NO: 1179021 - RNA, 19 nt, Homo sapiens
gugaugaggaagucuguga

SEQ ID NO: 1179022 - RNA, 19 nt, Homo sapiens
gaagcucuacacucucaau

SEQ ID NO: 1179023 - RNA, 19 nt, Homo sapiens
gcgaggagcaggucuuaac

SEQ ID NO: 1179024 - RNA, 19 nt, Homo sapiens
aguuugaccuccucuacaa

SEQ ID NO: 1179025 - RNA, 19 nt, Homo sapiens
ccuguggccuggacauugu

SEQ ID NO: 1179026 - RNA, 19 nt, Homo sapiens
guauggaugcuucuaucuu

SEQ ID NO: 1179027 - RNA, 19 nt, Homo sapiens
cagcgugcauuagguggaa

SEQ ID NO: 1179028 - RNA, 19 nt, Homo sapiens
cggcucugcugggauauga

SEQ ID NO: 1179029 - RNA, 19 nt, Homo sapiens
guguauggaugcuucuauc

SEQ ID NO: 1179030 - RNA, 19 nt, Homo sapiens
ccuagccaacugccucuua

SEQ ID NO: 1179031 - RNA, 19 nt, Homo sapiens
gcacucaauaaaucacuca

SEQ ID NO: 1179032 - RNA, 19 nt, Homo sapiens
cagaaggugccaacacugu

SEQ ID NO: 1179033 - RNA, 19 nt, Homo sapiens
uuaaggaucauuggacuau

SEQ ID NO: 1179034 - RNA, 19 nt, Homo sapiens
gagagaggacacagaaggu

SEQ ID NO: 1179035 - RNA, 19 nt, Homo sapiens
gccugaacuuuaaggauca

SEQ ID NO: 1179036 - RNA, 19 nt, Homo sapiens
gaaagguggagucgguagu

SEQ ID NO: 1179037 - RNA, 19 nt, Homo sapiens
gcauacuggcuucuagaau

SEQ ID NO: 1179038 - RNA, 19 nt, Homo sapiens
uuuaccagcugcagaaucu

SEQ ID NO: 1179039 - RNA, 19 nt, Homo sapiens
cuaugugaggacaguauua

SEQ ID NO: 1179040 - RNA, 19 nt, Homo sapiens
acaguaaggaccugaagug

SEQ ID NO: 1179041 - RNA, 19 nt, Homo sapiens
ucauuggacuaucuucucu

SEQ ID NO: 1179042 - RNA, 19 nt, Homo sapiens
cucaauaaaucacucaacu

SEQ ID NO: 1179043 - RNA, 19 nt, Homo sapiens
gaggauccaaugaguugau

SEQ ID NO: 1179044 - RNA, 19 nt, Homo sapiens
ggagcaggcauugguagug

SEQ ID NO: 1179045 - RNA, 19 nt, Homo sapiens
cagaauggccacugauagg

SEQ ID NO: 1179046 - RNA, 19 nt, Homo sapiens
gaucauuggacuaucuucu

SEQ ID NO: 1179047 - RNA, 19 nt, Homo sapiens
ggccuggacauuguucuuu

SEQ ID NO: 1179048 - RNA, 19 nt, Homo sapiens
gguggagucgguagugaga

SEQ ID NO: 1179049 - RNA, 19 nt, Homo sapiens
aaggaucauuggacuaucu

SEQ ID NO: 1179050 - RNA, 19 nt, Homo sapiens
acaagcucuuugcuaaguu

SEQ ID NO: 1179051 - RNA, 19 nt, Homo sapiens
aaugacaagcucuuugcua

SEQ ID NO: 1179052 - RNA, 19 nt, Homo sapiens
ggcauacuggcuucuagaa

SEQ ID NO: 1179053 - RNA, 19 nt, Homo sapiens
uuucugaauuuccuaugug

SEQ ID NO: 1179054 - RNA, 19 nt, Homo sapiens
ucaggagcaggcauuggua

SEQ ID NO: 1179055 - RNA, 19 nt, Homo sapiens
ugccaacacugucgcuaca

SEQ ID NO: 1179056 - RNA, 19 nt, Homo sapiens
aggagcaggucuuaacucu

SEQ ID NO: 1179057 - RNA, 19 nt, Homo sapiens
cagcagagugggccagcuu

SEQ ID NO: 1179058 - RNA, 19 nt, Homo sapiens
ccagcuaccaccaacuuuc

SEQ ID NO: 1179059 - RNA, 19 nt, Homo sapiens
ccaaagaugagcgccaaca

SEQ ID NO: 1179060 - RNA, 19 nt, Homo sapiens
gcaccaaguaagcacucaa

SEQ ID NO: 1179061 - RNA, 19 nt, Homo sapiens
caaugaguugauuuaggua

SEQ ID NO: 1179062 - RNA, 19 nt, Homo sapiens
caguaaggaccugaaguga

SEQ ID NO: 1179063 - RNA, 19 nt, Homo sapiens
gguguauggaugcuucuau

SEQ ID NO: 1179064 - RNA, 19 nt, Homo sapiens
caggguucagcgugcauua

SEQ ID NO: 1179065 - RNA, 19 nt, Homo sapiens
caucuuuccauaccaguuc

SEQ ID NO: 1179066 - RNA, 19 nt, Homo sapiens
uuucugcacuacaucuuuc

SEQ ID NO: 1179067 - RNA, 19 nt, Homo sapiens
ggacagagcucaucaagug

SEQ ID NO: 1179068 - RNA, 19 nt, Homo sapiens
gaauacaccucaacacuuu

SEQ ID NO: 1179069 - RNA, 19 nt, Homo sapiens
ucagacaucuccuuaaaua

SEQ ID NO: 1179070 - RNA, 19 nt, Homo sapiens
gaacacgcauucccaacua

SEQ ID NO: 1179071 - RNA, 19 nt, Homo sapiens
gaagaugacacguugauuu

SEQ ID NO: 1179072 - RNA, 19 nt, Homo sapiens
gcucagacaucuccuuaaa

SEQ ID NO: 1179073 - RNA, 19 nt, Homo sapiens
caagaaaggagacaucaua

SEQ ID NO: 1179074 - RNA, 19 nt, Homo sapiens
gggaaagugugaguuaaua

SEQ ID NO: 1179075 - RNA, 19 nt, Homo sapiens
uguagucacuucugauuua

SEQ ID NO: 1179076 - RNA, 19 nt, Homo sapiens
ggacaugucuugauuucca

SEQ ID NO: 1179077 - RNA, 19 nt, Homo sapiens
ggagacaucauagacauua

SEQ ID NO: 1179078 - RNA, 19 nt, Homo sapiens
gagaaugcccacccauaua

SEQ ID NO: 1179079 - RNA, 19 nt, Homo sapiens
ugaaggagaucccacaaau

SEQ ID NO: 1179080 - RNA, 19 nt, Homo sapiens
gaagauaaauuagcuuggu

SEQ ID NO: 1179081 - RNA, 19 nt, Homo sapiens
gauaauguguagucacuuc

SEQ ID NO: 1179082 - RNA, 19 nt, Homo sapiens
ggaaguggagaacaaagua

SEQ ID NO: 1179083 - RNA, 19 nt, Homo sapiens
cauagcaaauugaagauga

SEQ ID NO: 1179084 - RNA, 19 nt, Homo sapiens
aagaggaucuggagucuga

SEQ ID NO: 1179085 - RNA, 19 nt, Homo sapiens
gccagugacuccauggaua

SEQ ID NO: 1179086 - RNA, 19 nt, Homo sapiens
acacguugauuucuuguuu

SEQ ID NO: 1179087 - RNA, 19 nt, Homo sapiens
gauguaagcauagcaaauu

SEQ ID NO: 1179088 - RNA, 19 nt, Homo sapiens
gagagaaugcccacccaua

SEQ ID NO: 1179089 - RNA, 19 nt, Homo sapiens
gagcucagacaucuccuua

SEQ ID NO: 1179090 - RNA, 19 nt, Homo sapiens
ggaauacaccucaacacuu

SEQ ID NO: 1179091 - RNA, 19 nt, Homo sapiens
gugggaaacuucaaauuca

SEQ ID NO: 1179092 - RNA, 19 nt, Homo sapiens
ugaggaagauggagagaau

SEQ ID NO: 1179093 - RNA, 19 nt, Homo sapiens
gaugacacguugauuucuu

SEQ ID NO: 1179094 - RNA, 19 nt, Homo sapiens
gagauaauguguagucacu

SEQ ID NO: 1179095 - RNA, 19 nt, Homo sapiens
gagaggaagauaagauaaa

SEQ ID NO: 1179096 - RNA, 19 nt, Homo sapiens
agagucaccucauugaauu

SEQ ID NO: 1179097 - RNA, 19 nt, Homo sapiens
gagauuagauuggauacuc

SEQ ID NO: 1179098 - RNA, 19 nt, Homo sapiens
ggacagcuuucgacuggau

SEQ ID NO: 1179099 - RNA, 19 nt, Homo sapiens
gguaugaaggugaagcuua

SEQ ID NO: 1179100 - RNA, 19 nt, Homo sapiens
gaagaaauggagauuagau

SEQ ID NO: 1179101 - RNA, 19 nt, Homo sapiens
ucacuugcuuguauuagaa

SEQ ID NO: 1179102 - RNA, 19 nt, Homo sapiens
ccaacuauauaucuacaga

SEQ ID NO: 1179103 - RNA, 19 nt, Homo sapiens
gagaaggugucccucaaag

SEQ ID NO: 1179104 - RNA, 19 nt, Homo sapiens
uaacucuucuugagcuaaa

SEQ ID NO: 1179105 - RNA, 19 nt, Homo sapiens
gacaugguacauaagauua

SEQ ID NO: 1179106 - RNA, 19 nt, Homo sapiens
gaaaggagacaucauagac

SEQ ID NO: 1179107 - RNA, 19 nt, Homo sapiens
ggagaucccacaaauggaa

SEQ ID NO: 1179108 - RNA, 19 nt, Homo sapiens
guaagacuuugguaugugu

SEQ ID NO: 1179109 - RNA, 19 nt, Homo sapiens
ggagaggaagauaagauaa

SEQ ID NO: 1179110 - RNA, 19 nt, Homo sapiens
aaacccagaugacagaaga

SEQ ID NO: 1179111 - RNA, 19 nt, Homo sapiens
caaguacaguaucugcaaa

SEQ ID NO: 1179112 - RNA, 19 nt, Homo sapiens
cuacagaugcauuccauuu

SEQ ID NO: 1179113 - RNA, 19 nt, Homo sapiens
gcaaauugaagaugaagau

SEQ ID NO: 1179114 - RNA, 19 nt, Homo sapiens
guucagaugguacaaguaa

SEQ ID NO: 1179115 - RNA, 19 nt, Homo sapiens
gaaguggagaacaaaguaa

SEQ ID NO: 1179116 - RNA, 19 nt, Homo sapiens
gagagucaccucauugaau

SEQ ID NO: 1179117 - RNA, 19 nt, Homo sapiens
acacacgucucaagucuuc

SEQ ID NO: 1179118 - RNA, 19 nt, Homo sapiens
gauccagcacuuuaaauga

SEQ ID NO: 1179119 - RNA, 19 nt, Homo sapiens
ggguagauccagcacuuua

SEQ ID NO: 1179120 - RNA, 19 nt, Homo sapiens
gacagaagaagguuacuau

SEQ ID NO: 1179121 - RNA, 19 nt, Homo sapiens
gaaagugaauaguguuagc

SEQ ID NO: 1179122 - RNA, 19 nt, Homo sapiens
ggacucugguugcuauauc

SEQ ID NO: 1179123 - RNA, 19 nt, Homo sapiens
gacugcaacuuggaagaua

SEQ ID NO: 1179124 - RNA, 19 nt, Homo sapiens
gaaggaagaaauggagauu

SEQ ID NO: 1179125 - RNA, 19 nt, Homo sapiens
caucaggaaauucagauaa

SEQ ID NO: 1179126 - RNA, 19 nt, Homo sapiens
guuaugagacucuagaaga

SEQ ID NO: 1179127 - RNA, 19 nt, Homo sapiens
ccagagugcauacggauuu

SEQ ID NO: 1179128 - RNA, 19 nt, Homo sapiens
cagagaaggugucccucaa

SEQ ID NO: 1179129 - RNA, 19 nt, Homo sapiens
aaauggaaguggagaacaa

SEQ ID NO: 1179130 - RNA, 19 nt, Homo sapiens
gaaggagaucccacaaaug

SEQ ID NO: 1179131 - RNA, 19 nt, Homo sapiens
ccacacacgucucaagucu

SEQ ID NO: 1179132 - RNA, 19 nt, Homo sapiens
gacuacugcuccucuugua

SEQ ID NO: 1179133 - RNA, 19 nt, Homo sapiens
gaaaagaaagugaauagug

SEQ ID NO: 1179134 - RNA, 19 nt, Homo sapiens
ggaaagugugaguuaauau

SEQ ID NO: 1179135 - RNA, 19 nt, Homo sapiens
gcuaaaacgucaaauagga

SEQ ID NO: 1179136 - RNA, 19 nt, Homo sapiens
cagaagaagguuacuauca

SEQ ID NO: 1179137 - RNA, 19 nt, Homo sapiens
gcaaaccgaaggaguaaca

SEQ ID NO: 1179138 - RNA, 19 nt, Homo sapiens
gcacgaggaggaaggaaga

SEQ ID NO: 1179139 - RNA, 19 nt, Homo sapiens
ugacauaugcuuuauuugg

SEQ ID NO: 1179140 - RNA, 19 nt, Homo sapiens
caaagaggaucuggagucu

SEQ ID NO: 1179141 - RNA, 19 nt, Homo sapiens
guaugaaggugaagcuuac

SEQ ID NO: 1179142 - RNA, 19 nt, Homo sapiens
gaaauggagauuagauugg

SEQ ID NO: 1179143 - RNA, 19 nt, Homo sapiens
caaauaggagaggaagaua

SEQ ID NO: 1179144 - RNA, 19 nt, Homo sapiens
acagaugcauuccauuuua

SEQ ID NO: 1179145 - RNA, 19 nt, Homo sapiens
gagcucaucaaguggcaua

SEQ ID NO: 1179146 - RNA, 19 nt, Homo sapiens
gauauggaucuccuacauu

SEQ ID NO: 1179147 - RNA, 19 nt, Homo sapiens
guagauccagcacuuuaaa

SEQ ID NO: 1179148 - RNA, 19 nt, Homo sapiens
aggaagaaauggagauuag

SEQ ID NO: 1179149 - RNA, 19 nt, Homo sapiens
guggaaauguuuugucuuu

SEQ ID NO: 1179150 - RNA, 19 nt, Homo sapiens
uccaagcaauguuauauuc

SEQ ID NO: 1179151 - RNA, 19 nt, Homo sapiens
ugacaugguacauaagauu

SEQ ID NO: 1179152 - RNA, 19 nt, Homo sapiens
agaagaagguuacuaucag

SEQ ID NO: 1179153 - RNA, 19 nt, Homo sapiens
gaaggugaagcuuacaugu

SEQ ID NO: 1179154 - RNA, 19 nt, Homo sapiens
ucaggaaauucagauaaug

SEQ ID NO: 1179155 - RNA, 19 nt, Homo sapiens
gauguggacaggaauguug

SEQ ID NO: 1179156 - RNA, 19 nt, Homo sapiens
aagcauagcaaauugaaga

SEQ ID NO: 1179157 - RNA, 19 nt, Homo sapiens
ggaaaaggaugaggaagau

SEQ ID NO: 1179158 - RNA, 19 nt, Homo sapiens
aaagagagucaccucauug

SEQ ID NO: 1179159 - RNA, 19 nt, Homo sapiens
guaagcauagcaaauugaa

SEQ ID NO: 1179160 - RNA, 19 nt, Homo sapiens
guagagauaauguguaguc

SEQ ID NO: 1179161 - RNA, 19 nt, Homo sapiens
aaauggagauuagauugga

SEQ ID NO: 1179162 - RNA, 19 nt, Homo sapiens
auauggaucuccuacauuc

SEQ ID NO: 1179163 - RNA, 19 nt, Homo sapiens
gcaacuuggaagauaaauu

SEQ ID NO: 1179164 - RNA, 19 nt, Homo sapiens
gaggaggaaggaagaaaug

SEQ ID NO: 1179165 - RNA, 19 nt, Homo sapiens
gagacaucauagacauuau

SEQ ID NO: 1179166 - RNA, 19 nt, Homo sapiens
caaguaaccgggacagcuu

SEQ ID NO: 1179167 - RNA, 19 nt, Homo sapiens
gaacaacaccaacauaaga

SEQ ID NO: 1179168 - RNA, 19 nt, Homo sapiens
gaucuuggguuuccuauuc

SEQ ID NO: 1179169 - RNA, 19 nt, Homo sapiens
gagguuaucucaggaauga

SEQ ID NO: 1179170 - RNA, 19 nt, Homo sapiens
ggagagagggaaacuauuu

SEQ ID NO: 1179171 - RNA, 19 nt, Homo sapiens
gaacaaagacaaggucauu

SEQ ID NO: 1179172 - RNA, 19 nt, Homo sapiens
gaauaaaacuccuguaugu

SEQ ID NO: 1179173 - RNA, 19 nt, Homo sapiens
uggcauugcuguuuguuua

SEQ ID NO: 1179174 - RNA, 19 nt, Homo sapiens
gaaacuauuuguagcuugu

SEQ ID NO: 1179175 - RNA, 19 nt, Homo sapiens
gagaaaguccuagagguua

SEQ ID NO: 1179176 - RNA, 19 nt, Homo sapiens
gacugacccuuguguauaa

SEQ ID NO: 1179177 - RNA, 19 nt, Homo sapiens
cgagguagaugcaaagaug

SEQ ID NO: 1179178 - RNA, 19 nt, Homo sapiens
uaagcuaauuccagaagua

SEQ ID NO: 1179179 - RNA, 19 nt, Homo sapiens
ccacaucccguguaacaua

SEQ ID NO: 1179180 - RNA, 19 nt, Homo sapiens
guagugcacugguauuuca

SEQ ID NO: 1179181 - RNA, 19 nt, Homo sapiens
ucagucaccuuguugguaa

SEQ ID NO: 1179182 - RNA, 19 nt, Homo sapiens
ggagaaaguccuagagguu

SEQ ID NO: 1179183 - RNA, 19 nt, Homo sapiens
ggaagaaaauggaguuuau

SEQ ID NO: 1179184 - RNA, 19 nt, Homo sapiens
ggaaagaugacgggucuaa

SEQ ID NO: 1179185 - RNA, 19 nt, Homo sapiens
uaacccagcuacagggaaa

SEQ ID NO: 1179186 - RNA, 19 nt, Homo sapiens
aaucuggccucaucuugua

SEQ ID NO: 1179187 - RNA, 19 nt, Homo sapiens
uagcaucuacucuguauaa

SEQ ID NO: 1179188 - RNA, 19 nt, Homo sapiens
ggagcaaauuauccacaaa

SEQ ID NO: 1179189 - RNA, 19 nt, Homo sapiens
gaaauucagagaaagucua

SEQ ID NO: 1179190 - RNA, 19 nt, Homo sapiens
ggaaagggaagaaagacuu

SEQ ID NO: 1179191 - RNA, 19 nt, Homo sapiens
gguguucgauggagaugaa

SEQ ID NO: 1179192 - RNA, 19 nt, Homo sapiens
gcauugcuguuuguuuauu

SEQ ID NO: 1179193 - RNA, 19 nt, Homo sapiens
gcauuggcauugcuguuug

SEQ ID NO: 1179194 - RNA, 19 nt, Homo sapiens
gaucaaggacuccaaacug

SEQ ID NO: 1179195 - RNA, 19 nt, Homo sapiens
cgauggagaugaaaucaca

SEQ ID NO: 1179196 - RNA, 19 nt, Homo sapiens
ucaccucccugcaaaccua

SEQ ID NO: 1179197 - RNA, 19 nt, Homo sapiens
ccagguuucuaauaaguga

SEQ ID NO: 1179198 - RNA, 19 nt, Homo sapiens
gagagggaaacuauuugua

SEQ ID NO: 1179199 - RNA, 19 nt, Homo sapiens
gaaagccaagcccaagaaa

SEQ ID NO: 1179200 - RNA, 19 nt, Homo sapiens
gacuuuauucucucucuua

SEQ ID NO: 1179201 - RNA, 19 nt, Homo sapiens
acugugaccugaacaaaga

SEQ ID NO: 1179202 - RNA, 19 nt, Homo sapiens
gaagaggcccagcagaauc

SEQ ID NO: 1179203 - RNA, 19 nt, Homo sapiens
ggaagaggcccagcagaau

SEQ ID NO: 1179204 - RNA, 19 nt, Homo sapiens
gcgccugccuguagauguu

SEQ ID NO: 1179205 - RNA, 19 nt, Homo sapiens
uggaugcucucaccacuga

SEQ ID NO: 1179206 - RNA, 19 nt, Homo sapiens
gggaaacuauuuguagcuu

SEQ ID NO: 1179207 - RNA, 19 nt, Homo sapiens
gcaaauuauccacaaagga

SEQ ID NO: 1179208 - RNA, 19 nt, Homo sapiens
agacgggaguccugcaauu

SEQ ID NO: 1179209 - RNA, 19 nt, Homo sapiens
gagacugacccuuguguau

SEQ ID NO: 1179210 - RNA, 19 nt, Homo sapiens
ggaggaagcaugcacacau

SEQ ID NO: 1179211 - RNA, 19 nt, Homo sapiens
guggaaaggugggaaggaa

SEQ ID NO: 1179212 - RNA, 19 nt, Homo sapiens
guccagaucccaugaauag

SEQ ID NO: 1179213 - RNA, 19 nt, Homo sapiens
gcaaaucuggccucaucuu

SEQ ID NO: 1179214 - RNA, 19 nt, Homo sapiens
gccauuaguugucaaaauu

SEQ ID NO: 1179215 - RNA, 19 nt, Homo sapiens
cgggaguccugcaauugua

SEQ ID NO: 1179216 - RNA, 19 nt, Homo sapiens
agacugacccuuguguaua

SEQ ID NO: 1179217 - RNA, 19 nt, Homo sapiens
gaucugcuacugacaacuu

SEQ ID NO: 1179218 - RNA, 19 nt, Homo sapiens
caggauggaucaccagaca

SEQ ID NO: 1179219 - RNA, 19 nt, Homo sapiens
cacaucccguguaacauaa

SEQ ID NO: 1179220 - RNA, 19 nt, Homo sapiens
caggguaacucaggaagga

SEQ ID NO: 1179221 - RNA, 19 nt, Homo sapiens
ucaggaagcuguguuuguc

SEQ ID NO: 1179222 - RNA, 19 nt, Homo sapiens
agaaaguccuagagguuau

SEQ ID NO: 1179223 - RNA, 19 nt, Homo sapiens
uugcaaaucuggccucauc

SEQ ID NO: 1179224 - RNA, 19 nt, Homo sapiens
ugaauagcccacacaggua

SEQ ID NO: 1179225 - RNA, 19 nt, Homo sapiens
gagagagggaaacuauuug

SEQ ID NO: 1179226 - RNA, 19 nt, Homo sapiens
caaagacaaggucauuuca

SEQ ID NO: 1179227 - RNA, 19 nt, Homo sapiens
gcuacgugaugcccaguug

SEQ ID NO: 1179228 - RNA, 19 nt, Homo sapiens
ccaacucuauggauuaaac

SEQ ID NO: 1179229 - RNA, 19 nt, Homo sapiens
ucagaucacccuugcaaau

SEQ ID NO: 1179230 - RNA, 19 nt, Homo sapiens
gagcagcaaguggcccuua

SEQ ID NO: 1179231 - RNA, 19 nt, Homo sapiens
guugguaacacuaaaguug

SEQ ID NO: 1179232 - RNA, 19 nt, Homo sapiens
ccagugaggcucccagaga

SEQ ID NO: 1179233 - RNA, 19 nt, Homo sapiens
ggagacugacccuugugua

SEQ ID NO: 1179234 - RNA, 19 nt, Homo sapiens
cugagaagaaagagauuua

SEQ ID NO: 1179235 - RNA, 19 nt, Homo sapiens
aagccaagcccaagaaaug

SEQ ID NO: 1179236 - RNA, 19 nt, Homo sapiens
gaaggagagagggaaacua

SEQ ID NO: 1179237 - RNA, 19 nt, Homo sapiens
caaaucuggccucaucuug

SEQ ID NO: 1179238 - RNA, 19 nt, Homo sapiens
aaaggaaagggaagaaaga

SEQ ID NO: 1179239 - RNA, 19 nt, Homo sapiens
cuaccaggcuguccagaag

SEQ ID NO: 1179240 - RNA, 19 nt, Homo sapiens
caagaagccucaggaagcu

SEQ ID NO: 1179241 - RNA, 19 nt, Homo sapiens
uuaaacacuuggugaucaa

SEQ ID NO: 1179242 - RNA, 19 nt, Homo sapiens
gagcaaauuauccacaaag

SEQ ID NO: 1179243 - RNA, 19 nt, Homo sapiens
gaguccagaucccaugaau

SEQ ID NO: 1179244 - RNA, 19 nt, Homo sapiens
ugggcacucuggacacaua

SEQ ID NO: 1179245 - RNA, 19 nt, Homo sapiens
acaaagacaaggucauuuc

SEQ ID NO: 1179246 - RNA, 19 nt, Homo sapiens
gcagcaacgacauuaacaa

SEQ ID NO: 1179247 - RNA, 19 nt, Homo sapiens
caacaccaacauaagaaau

SEQ ID NO: 1179248 - RNA, 19 nt, Homo sapiens
cugaacaacaccaacauaa

SEQ ID NO: 1179249 - RNA, 19 nt, Homo sapiens
cuuagcaucuacucuguau

SEQ ID NO: 1179250 - RNA, 19 nt, Homo sapiens
ggauuugcauuacgucacu

SEQ ID NO: 1179251 - RNA, 19 nt, Homo sapiens
acaccaauaucuaauacca

SEQ ID NO: 1179252 - RNA, 19 nt, Homo sapiens
gaucacccuugcaaaucug

SEQ ID NO: 1179253 - RNA, 19 nt, Homo sapiens
cgacuacugugaccugaac

SEQ ID NO: 1179254 - RNA, 19 nt, Homo sapiens
ugcauuacgucacucgaaa

SEQ ID NO: 1179255 - RNA, 19 nt, Homo sapiens
cggagcaaauuauccacaa

SEQ ID NO: 1179256 - RNA, 19 nt, Homo sapiens
ucuauaagccagugcaaug

SEQ ID NO: 1179257 - RNA, 19 nt, Homo sapiens
gguauugucaucccugaau

SEQ ID NO: 1179258 - RNA, 19 nt, Homo sapiens
ggauuaaacacuuggugau

SEQ ID NO: 1179259 - RNA, 19 nt, Homo sapiens
ggcauuggcauugcuguuu

SEQ ID NO: 1179260 - RNA, 19 nt, Homo sapiens
guacaggcauuggcauugc

SEQ ID NO: 1179261 - RNA, 19 nt, Homo sapiens
caccauguuugcacuuuua

SEQ ID NO: 1179262 - RNA, 19 nt, Homo sapiens
uuaacaagcgggagaugaa

SEQ ID NO: 1179263 - RNA, 19 nt, Homo sapiens
caauagcagcaacgacauu

SEQ ID NO: 1179264 - RNA, 19 nt, Homo sapiens
caggugcagugccauacuu

SEQ ID NO: 1179265 - RNA, 19 nt, Homo sapiens
uggaagaggcccagcagaa

SEQ ID NO: 1179266 - RNA, 19 nt, Homo sapiens
acaccaacauaagaaauuc

SEQ ID NO: 1179267 - RNA, 19 nt, Homo sapiens
gaacuggucugcgugcaua

SEQ ID NO: 1179268 - RNA, 19 nt, Homo sapiens
gagaguggaucaagauaaa

SEQ ID NO: 1179269 - RNA, 19 nt, Homo sapiens
cacuaaagcuauccaguua

SEQ ID NO: 1179270 - RNA, 19 nt, Homo sapiens
caauguauguguccucuuu

SEQ ID NO: 1179271 - RNA, 19 nt, Homo sapiens
gaagaaguuuguugaauac

SEQ ID NO: 1179272 - RNA, 19 nt, Homo sapiens
ccaaagagcaauuaagaaa

SEQ ID NO: 1179273 - RNA, 19 nt, Homo sapiens
ggaaggaguuucagcaagu

SEQ ID NO: 1179274 - RNA, 19 nt, Homo sapiens
ucaaggagaugaagaagau

SEQ ID NO: 1179275 - RNA, 19 nt, Homo sapiens
ccagagaucuugcucauac

SEQ ID NO: 1179276 - RNA, 19 nt, Homo sapiens
gaaaucaaacccuucaaga

SEQ ID NO: 1179277 - RNA, 19 nt, Homo sapiens
ugaagaagauauugcauca

SEQ ID NO: 1179278 - RNA, 19 nt, Homo sapiens
agacaugccuuguagaaug

SEQ ID NO: 1179279 - RNA, 19 nt, Homo sapiens
gaaguuuguugaauacugu

SEQ ID NO: 1179280 - RNA, 19 nt, Homo sapiens
gcacugguacuucaaacua

SEQ ID NO: 1179281 - RNA, 19 nt, Homo sapiens
cauggaaguuugugaugua

SEQ ID NO: 1179282 - RNA, 19 nt, Homo sapiens
gcugaaaguacgucuaaua

SEQ ID NO: 1179283 - RNA, 19 nt, Homo sapiens
gcaaagcggacaccaagaa

SEQ ID NO: 1179284 - RNA, 19 nt, Homo sapiens
caauaagaauucaguguca

SEQ ID NO: 1179285 - RNA, 19 nt, Homo sapiens
gaucuuugcuuuuccauuu

SEQ ID NO: 1179286 - RNA, 19 nt, Homo sapiens
gacaugccuuguagaauga

SEQ ID NO: 1179287 - RNA, 19 nt, Homo sapiens
gaagauauugcaucacguu

SEQ ID NO: 1179288 - RNA, 19 nt, Homo sapiens
gaacgacaauguggugauc

SEQ ID NO: 1179289 - RNA, 19 nt, Homo sapiens
aaauuucccucaccaaaga

SEQ ID NO: 1179290 - RNA, 19 nt, Homo sapiens
cuagacacaugggaaauuu

SEQ ID NO: 1179291 - RNA, 19 nt, Homo sapiens
uugaaugcauuuaggcuua

SEQ ID NO: 1179292 - RNA, 19 nt, Homo sapiens
ugacgugaauaaugacaaa

SEQ ID NO: 1179293 - RNA, 19 nt, Homo sapiens
gagauugcauaucgaggaa

SEQ ID NO: 1179294 - RNA, 19 nt, Homo sapiens
ggacauuauucuccugauc

SEQ ID NO: 1179295 - RNA, 19 nt, Homo sapiens
ugcaugggcugguuuguuu

SEQ ID NO: 1179296 - RNA, 19 nt, Homo sapiens
cauaguauuugcacuuugu

SEQ ID NO: 1179297 - RNA, 19 nt, Homo sapiens
gaaauuucccucaccaaag

SEQ ID NO: 1179298 - RNA, 19 nt, Homo sapiens
uaacaugcaugggcugguu

SEQ ID NO: 1179299 - RNA, 19 nt, Homo sapiens
ugaauacugugacgugaau

SEQ ID NO: 1179300 - RNA, 19 nt, Homo sapiens
gugaagaaguuuguugaau

SEQ ID NO: 1179301 - RNA, 19 nt, Homo sapiens
ccacuaaagcuauccaguu

SEQ ID NO: 1179302 - RNA, 19 nt, Homo sapiens
gaaacaguuaugauccuaa

SEQ ID NO: 1179303 - RNA, 19 nt, Homo sapiens
gcauuuaggcuuaauuucu

SEQ ID NO: 1179304 - RNA, 19 nt, Homo sapiens
caccaaagagcaauuaaga

SEQ ID NO: 1179305 - RNA, 19 nt, Homo sapiens
cuaaagcuauccaguuaag

SEQ ID NO: 1179306 - RNA, 19 nt, Homo sapiens
ggagaaguauuugaaugca

SEQ ID NO: 1179307 - RNA, 19 nt, Homo sapiens
guggagaaguauuugaaug

SEQ ID NO: 1179308 - RNA, 19 nt, Homo sapiens
uguaugugguggagaagua

SEQ ID NO: 1179309 - RNA, 19 nt, Homo sapiens
ggagagcuggcuucagaaa

SEQ ID NO: 1179310 - RNA, 19 nt, Homo sapiens
ggaucaagauaaagacaag

SEQ ID NO: 1179311 - RNA, 19 nt, Homo sapiens
gaaggaguuucagcaagug

SEQ ID NO: 1179312 - RNA, 19 nt, Homo sapiens
uacgagaacuugccaaugg

SEQ ID NO: 1179313 - RNA, 19 nt, Homo sapiens
acugugacgugaauaauga

SEQ ID NO: 1179314 - RNA, 19 nt, Homo sapiens
cacagaaccagcucaagua

SEQ ID NO: 1179315 - RNA, 19 nt, Homo sapiens
ugaccgagcuggcuaacag

SEQ ID NO: 1179316 - RNA, 19 nt, Homo sapiens
gcacuuuguacuuuaaaug

SEQ ID NO: 1179317 - RNA, 19 nt, Homo sapiens
caagauaaagacaaggauu

SEQ ID NO: 1179318 - RNA, 19 nt, Homo sapiens
agaaccagcucaaguacau

SEQ ID NO: 1179319 - RNA, 19 nt, Homo sapiens
uuuaaacugugcaagguaa

SEQ ID NO: 1179320 - RNA, 19 nt, Homo sapiens
ggcaguaaauccagucaca

SEQ ID NO: 1179321 - RNA, 19 nt, Homo sapiens
cgaaggcaguuccuagaca

SEQ ID NO: 1179322 - RNA, 19 nt, Homo sapiens
gguacgagcagccgaaaug

SEQ ID NO: 1179323 - RNA, 19 nt, Homo sapiens
ccaagcagcccaagaacga

SEQ ID NO: 1179324 - RNA, 19 nt, Homo sapiens
cacauaguauuugcacuuu

SEQ ID NO: 1179325 - RNA, 19 nt, Homo sapiens
ggaaaucaaacccuucaag

SEQ ID NO: 1179326 - RNA, 19 nt, Homo sapiens
ccacagaaccagcucaagu

SEQ ID NO: 1179327 - RNA, 19 nt, Homo sapiens
ccugagacaugccuuguag

SEQ ID NO: 1179328 - RNA, 19 nt, Homo sapiens
gcacuggcagagaaggaua

SEQ ID NO: 1179329 - RNA, 19 nt, Homo sapiens
ugaaugcauuuaggcuuaa

SEQ ID NO: 1179330 - RNA, 19 nt, Homo sapiens
gcaaagauccccagcuaga

SEQ ID NO: 1179331 - RNA, 19 nt, Homo sapiens
auggagagcuggcuucaga

SEQ ID NO: 1179332 - RNA, 19 nt, Homo sapiens
gauucuaucucggcucaga

SEQ ID NO: 1179333 - RNA, 19 nt, Homo sapiens
gaacuucaagcugugauuc

SEQ ID NO: 1179334 - RNA, 19 nt, Homo sapiens
ccaguuaagugcagguagu

SEQ ID NO: 1179335 - RNA, 19 nt, Homo sapiens
ccagaugccugugcuuaca

SEQ ID NO: 1179336 - RNA, 19 nt, Homo sapiens
caaagcggacaccaagaaa

SEQ ID NO: 1179337 - RNA, 19 nt, Homo sapiens
agaaacaguuaugauccua

SEQ ID NO: 1179338 - RNA, 19 nt, Homo sapiens
ugagacaugccuuguagaa

SEQ ID NO: 1179339 - RNA, 19 nt, Homo sapiens
auuaugagcagucuccuua

SEQ ID NO: 1179340 - RNA, 19 nt, Homo sapiens
ucaccugaaccaauuauga

SEQ ID NO: 1179341 - RNA, 19 nt, Homo sapiens
gcaaucguauggcuuucuc

SEQ ID NO: 1179342 - RNA, 19 nt, Homo sapiens
gagaaguauuugaaugcau

SEQ ID NO: 1179343 - RNA, 19 nt, Homo sapiens
gugcaaagauccccagcua

SEQ ID NO: 1179344 - RNA, 19 nt, Homo sapiens
gccaaggaaacaaggauaa

SEQ ID NO: 1179345 - RNA, 19 nt, Homo sapiens
acagucagguccaguguca

SEQ ID NO: 1179346 - RNA, 19 nt, Homo sapiens
gaguggaucaagauaaaga

SEQ ID NO: 1179347 - RNA, 19 nt, Homo sapiens
aaggauaaauggcucauac

SEQ ID NO: 1179348 - RNA, 19 nt, Homo sapiens
acaaauccaucuccguaca

SEQ ID NO: 1179349 - RNA, 19 nt, Homo sapiens
ggagaugaagaagauauug

SEQ ID NO: 1179350 - RNA, 19 nt, Homo sapiens
cagggcacccagugucuua

SEQ ID NO: 1179351 - RNA, 19 nt, Homo sapiens
cagaaacacauaguauuug

SEQ ID NO: 1179352 - RNA, 19 nt, Homo sapiens
ugagaguggaucaagauaa

SEQ ID NO: 1179353 - RNA, 19 nt, Homo sapiens
gaacuugccaaugggaaau

SEQ ID NO: 1179354 - RNA, 19 nt, Homo sapiens
ugaaucacgcaaccacuaa

SEQ ID NO: 1179355 - RNA, 19 nt, Homo sapiens
uaauagacagccaaggaaa

SEQ ID NO: 1179356 - RNA, 19 nt, Homo sapiens
caagagguuccuucgcaaa

SEQ ID NO: 1179357 - RNA, 19 nt, Homo sapiens
gcaaugacgacggcaccua

SEQ ID NO: 1179358 - RNA, 19 nt, Homo sapiens
guagaaugauuuugugaug

SEQ ID NO: 1179359 - RNA, 19 nt, Homo sapiens
gaaucacgcaaccacuaaa

SEQ ID NO: 1179360 - RNA, 19 nt, Homo sapiens
gcugcaaucguauggcuuu

SEQ ID NO: 1179361 - RNA, 19 nt, Homo sapiens
caaggaaacaaggauaaau

SEQ ID NO: 1179362 - RNA, 19 nt, Homo sapiens
ucacguuacccuacccuuu

SEQ ID NO: 1179363 - RNA, 19 nt, Homo sapiens
acacauaguauuugcacuu

SEQ ID NO: 1179364 - RNA, 19 nt, Homo sapiens
ccaaggaaacaaggauaaa

SEQ ID NO: 1179365 - RNA, 19 nt, Homo sapiens
cacgguuccuuucugcuuu

SEQ ID NO: 1179366 - RNA, 19 nt, Homo sapiens
ccauggaaguuugugaugu

SEQ ID NO: 1179367 - RNA, 19 nt, Homo sapiens
ggaggcaucuugguuguaa

SEQ ID NO: 1179368 - RNA, 19 nt, Homo sapiens
guaagucccuuuauucaca

SEQ ID NO: 1179369 - RNA, 19 nt, Homo sapiens
ggacagcgaccucggauag

SEQ ID NO: 1179370 - RNA, 19 nt, Homo sapiens
gguuguaagucccuuuauu

SEQ ID NO: 1179371 - RNA, 19 nt, Homo sapiens
ggcagagucuuuccuguuc

SEQ ID NO: 1179372 - RNA, 19 nt, Homo sapiens
ucacuccgcugcccuuugu

SEQ ID NO: 1179373 - RNA, 19 nt, Homo sapiens
ggcauuacccaccauugua

SEQ ID NO: 1179374 - RNA, 19 nt, Homo sapiens
cauccagaaucccagaauu

SEQ ID NO: 1179375 - RNA, 19 nt, Homo sapiens
uaaggaauccaucggacaa

SEQ ID NO: 1179376 - RNA, 19 nt, Homo sapiens
guuguaagucccuuuauuc

SEQ ID NO: 1179377 - RNA, 19 nt, Homo sapiens
ucagagaccauccagaauc

SEQ ID NO: 1179378 - RNA, 19 nt, Homo sapiens
gccuugagcccuuaaacuu

SEQ ID NO: 1179379 - RNA, 19 nt, Homo sapiens
gggcauuacccaccauugu

SEQ ID NO: 1179380 - RNA, 19 nt, Homo sapiens
gucaggagagggucacuuu

SEQ ID NO: 1179381 - RNA, 19 nt, Homo sapiens
gcauuacccaccauuguag

SEQ ID NO: 1179382 - RNA, 19 nt, Homo sapiens
caggaggcaucuugguugu

SEQ ID NO: 1179383 - RNA, 19 nt, Homo sapiens
ucccagaauucuaggaaau

SEQ ID NO: 1179384 - RNA, 19 nt, Homo sapiens
uaucagccucccaagcaua

SEQ ID NO: 1179385 - RNA, 19 nt, Homo sapiens
cagccucccaagcauauaa

SEQ ID NO: 1179386 - RNA, 19 nt, Homo sapiens
ccgcugcccuuuguagguu

SEQ ID NO: 1179387 - RNA, 19 nt, Homo sapiens
ucccugcucuccauacuuc

SEQ ID NO: 1179388 - RNA, 19 nt, Homo sapiens
cagagaccauccagaaucc

SEQ ID NO: 1179389 - RNA, 19 nt, Homo sapiens
uggcagagucuuuccuguu

SEQ ID NO: 1179390 - RNA, 19 nt, Homo sapiens
guaucagccucccaagcau

SEQ ID NO: 1179391 - RNA, 19 nt, Homo sapiens
cuugagcccuuaaacuucu

SEQ ID NO: 1179392 - RNA, 19 nt, Homo sapiens
ggagagggucacuuuugua

SEQ ID NO: 1179393 - RNA, 19 nt, Homo sapiens
uguaucagccucccaagca

SEQ ID NO: 1179394 - RNA, 19 nt, Homo sapiens
aggaauccaucggacaaga

SEQ ID NO: 1179395 - RNA, 19 nt, Homo sapiens
gcuggggccugacuguaaa

SEQ ID NO: 1179396 - RNA, 19 nt, Homo sapiens
uugagaagggacuggcuua

SEQ ID NO: 1179397 - RNA, 19 nt, Homo sapiens
ggaggcaucuugguuguaa

SEQ ID NO: 1179398 - RNA, 19 nt, Homo sapiens
guaagucccuuuauucaca

SEQ ID NO: 1179399 - RNA, 19 nt, Homo sapiens
ggacagcgaccucggauag

SEQ ID NO: 1179400 - RNA, 19 nt, Homo sapiens
gguuguaagucccuuuauu

SEQ ID NO: 1179401 - RNA, 19 nt, Homo sapiens
ggcagagucuuuccuguuc

SEQ ID NO: 1179402 - RNA, 19 nt, Homo sapiens
ucacuccgcugcccuuugu

SEQ ID NO: 1179403 - RNA, 19 nt, Homo sapiens
ggcauuacccaccauugua

SEQ ID NO: 1179404 - RNA, 19 nt, Homo sapiens
cauccagaaucccagaauu

SEQ ID NO: 1179405 - RNA, 19 nt, Homo sapiens
uaaggaauccaucggacaa

SEQ ID NO: 1179406 - RNA, 19 nt, Homo sapiens
guuguaagucccuuuauuc

SEQ ID NO: 1179407 - RNA, 19 nt, Homo sapiens
ucagagaccauccagaauc

SEQ ID NO: 1179408 - RNA, 19 nt, Homo sapiens
gccuugagcccuuaaacuu

SEQ ID NO: 1179409 - RNA, 19 nt, Homo sapiens
gggcauuacccaccauugu

SEQ ID NO: 1179410 - RNA, 19 nt, Homo sapiens
gucaggagagggucacuuu

SEQ ID NO: 1179411 - RNA, 19 nt, Homo sapiens
gcauuacccaccauuguag

SEQ ID NO: 1179412 - RNA, 19 nt, Homo sapiens
caggaggcaucuugguugu

SEQ ID NO: 1179413 - RNA, 19 nt, Homo sapiens
ucccagaauucuaggaaau

SEQ ID NO: 1179414 - RNA, 19 nt, Homo sapiens
uaucagccucccaagcaua

SEQ ID NO: 1179415 - RNA, 19 nt, Homo sapiens
cagccucccaagcauauaa

SEQ ID NO: 1179416 - RNA, 19 nt, Homo sapiens
ccgcugcccuuuguagguu

SEQ ID NO: 1179417 - RNA, 19 nt, Homo sapiens
ucccugcucuccauacuuc

SEQ ID NO: 1179418 - RNA, 19 nt, Homo sapiens
cagagaccauccagaaucc

SEQ ID NO: 1179419 - RNA, 19 nt, Homo sapiens
uggcagagucuuuccuguu

SEQ ID NO: 1179420 - RNA, 19 nt, Homo sapiens
guaucagccucccaagcau

SEQ ID NO: 1179421 - RNA, 19 nt, Homo sapiens
cuugagcccuuaaacuucu

SEQ ID NO: 1179422 - RNA, 19 nt, Homo sapiens
ggagagggucacuuuugua

SEQ ID NO: 1179423 - RNA, 19 nt, Homo sapiens
uguaucagccucccaagca

SEQ ID NO: 1179424 - RNA, 19 nt, Homo sapiens
aggaauccaucggacaaga

SEQ ID NO: 1179425 - RNA, 19 nt, Homo sapiens
gcuggggccugacuguaaa

SEQ ID NO: 1179426 - RNA, 19 nt, Homo sapiens
uugagaagggacuggcuua

SEQ ID NO: 1179427 - RNA, 19 nt, Homo sapiens
ggaggcaucuugguuguaa

SEQ ID NO: 1179428 - RNA, 19 nt, Homo sapiens
guaagucccuuuauucaca

SEQ ID NO: 1179429 - RNA, 19 nt, Homo sapiens
ggacagcgaccucggauag

SEQ ID NO: 1179430 - RNA, 19 nt, Homo sapiens
gguuguaagucccuuuauu

SEQ ID NO: 1179431 - RNA, 19 nt, Homo sapiens
ggcagagucuuuccuguuc

SEQ ID NO: 1179432 - RNA, 19 nt, Homo sapiens
ucacuccgcugcccuuugu

SEQ ID NO: 1179433 - RNA, 19 nt, Homo sapiens
ggcauuacccaccauugua

SEQ ID NO: 1179434 - RNA, 19 nt, Homo sapiens
cauccagaaucccagaauu

SEQ ID NO: 1179435 - RNA, 19 nt, Homo sapiens
uaaggaauccaucggacaa

SEQ ID NO: 1179436 - RNA, 19 nt, Homo sapiens
guuguaagucccuuuauuc

SEQ ID NO: 1179437 - RNA, 19 nt, Homo sapiens
ucagagaccauccagaauc

SEQ ID NO: 1179438 - RNA, 19 nt, Homo sapiens
gccuugagcccuuaaacuu

SEQ ID NO: 1179439 - RNA, 19 nt, Homo sapiens
gggcauuacccaccauugu

SEQ ID NO: 1179440 - RNA, 19 nt, Homo sapiens
gucaggagagggucacuuu

SEQ ID NO: 1179441 - RNA, 19 nt, Homo sapiens
gcauuacccaccauuguag

SEQ ID NO: 1179442 - RNA, 19 nt, Homo sapiens
caggaggcaucuugguugu

SEQ ID NO: 1179443 - RNA, 19 nt, Homo sapiens
ucccagaauucuaggaaau

SEQ ID NO: 1179444 - RNA, 19 nt, Homo sapiens
uaucagccucccaagcaua

SEQ ID NO: 1179445 - RNA, 19 nt, Homo sapiens
cagccucccaagcauauaa

SEQ ID NO: 1179446 - RNA, 19 nt, Homo sapiens
ccgcugcccuuuguagguu

SEQ ID NO: 1179447 - RNA, 19 nt, Homo sapiens
ucccugcucuccauacuuc

SEQ ID NO: 1179448 - RNA, 19 nt, Homo sapiens
cagagaccauccagaaucc

SEQ ID NO: 1179449 - RNA, 19 nt, Homo sapiens
uggcagagucuuuccuguu

SEQ ID NO: 1179450 - RNA, 19 nt, Homo sapiens
guaucagccucccaagcau

SEQ ID NO: 1179451 - RNA, 19 nt, Homo sapiens
cuugagcccuuaaacuucu

SEQ ID NO: 1179452 - RNA, 19 nt, Homo sapiens
ggagagggucacuuuugua

SEQ ID NO: 1179453 - RNA, 19 nt, Homo sapiens
uguaucagccucccaagca

SEQ ID NO: 1179454 - RNA, 19 nt, Homo sapiens
aggaauccaucggacaaga

SEQ ID NO: 1179455 - RNA, 19 nt, Homo sapiens
gcuggggccugacuguaaa

SEQ ID NO: 1179456 - RNA, 19 nt, Homo sapiens
uugagaagggacuggcuua

SEQ ID NO: 1179457 - RNA, 19 nt, Homo sapiens
gaagauccauguaaacuua

SEQ ID NO: 1179458 - RNA, 19 nt, Homo sapiens
agaaaugggucuaaagaua

SEQ ID NO: 1179459 - RNA, 19 nt, Homo sapiens
ccaaaucccuggagaugua

SEQ ID NO: 1179460 - RNA, 19 nt, Homo sapiens
uaacgaaaccucauucuuu

SEQ ID NO: 1179461 - RNA, 19 nt, Homo sapiens
ccaauucacugucaagaaa

SEQ ID NO: 1179462 - RNA, 19 nt, Homo sapiens
caaaugagccgagaucuuu

SEQ ID NO: 1179463 - RNA, 19 nt, Homo sapiens
caaacaaccuggcuggaaa

SEQ ID NO: 1179464 - RNA, 19 nt, Homo sapiens
gaagaaaugggucuaaaga

SEQ ID NO: 1179465 - RNA, 19 nt, Homo sapiens
gaaggaagaacuugaagaa

SEQ ID NO: 1179466 - RNA, 19 nt, Homo sapiens
gaauccaaguuaacccuua

SEQ ID NO: 1179467 - RNA, 19 nt, Homo sapiens
gaagcaagacuuacccuaa

SEQ ID NO: 1179468 - RNA, 19 nt, Homo sapiens
gagccgagaucuuucuauu

SEQ ID NO: 1179469 - RNA, 19 nt, Homo sapiens
gagaagaaaugggucuaaa

SEQ ID NO: 1179470 - RNA, 19 nt, Homo sapiens
gaaauaaccagauaucagu

SEQ ID NO: 1179471 - RNA, 19 nt, Homo sapiens
cgccaaagcuuuauuagug

SEQ ID NO: 1179472 - RNA, 19 nt, Homo sapiens
gcacuaagucgccaaaguu

SEQ ID NO: 1179473 - RNA, 19 nt, Homo sapiens
uuacaaagguucacuucaa

SEQ ID NO: 1179474 - RNA, 19 nt, Homo sapiens
gcaggagaaugauaugguu

SEQ ID NO: 1179475 - RNA, 19 nt, Homo sapiens
uaggauaacugcaaacaug

SEQ ID NO: 1179476 - RNA, 19 nt, Homo sapiens
gaauacggcaggagaauga

SEQ ID NO: 1179477 - RNA, 19 nt, Homo sapiens
gccgagaucuuucuauuca

SEQ ID NO: 1179478 - RNA, 19 nt, Homo sapiens
agucggagcuuggagauua

SEQ ID NO: 1179479 - RNA, 19 nt, Homo sapiens
aaacaagucugaguauuuc

SEQ ID NO: 1179480 - RNA, 19 nt, Homo sapiens
gaaaugggucuaaagauag

SEQ ID NO: 1179481 - RNA, 19 nt, Homo sapiens
gaggaaagcccauaacagu

SEQ ID NO: 1179482 - RNA, 19 nt, Homo sapiens
gcaagcaccucuggaagug

SEQ ID NO: 1179483 - RNA, 19 nt, Homo sapiens
gaagaaauaaccagauauc

SEQ ID NO: 1179484 - RNA, 19 nt, Homo sapiens
gaaucaaacaccaucagua

SEQ ID NO: 1179485 - RNA, 19 nt, Homo sapiens
cagcaaguuuggauccaua

SEQ ID NO: 1179486 - RNA, 19 nt, Homo sapiens
gaucaguucucucggaagu

SEQ ID NO: 1179487 - RNA, 19 nt, Homo sapiens
caggacagcuuugcaaaug

SEQ ID NO: 1179488 - RNA, 19 nt, Homo sapiens
uaaacauacugcaggauau

SEQ ID NO: 1179489 - RNA, 19 nt, Homo sapiens
ccucagacaucuacaaaca

SEQ ID NO: 1179490 - RNA, 19 nt, Homo sapiens
gggaaaagauuguaacgaa

SEQ ID NO: 1179491 - RNA, 19 nt, Homo sapiens
aggcugagcugaauuacuu

SEQ ID NO: 1179492 - RNA, 19 nt, Homo sapiens
gaagccaucagacguauug

SEQ ID NO: 1179493 - RNA, 19 nt, Homo sapiens
gaagugacaaugauucugu

SEQ ID NO: 1179494 - RNA, 19 nt, Homo sapiens
gaucagaaugugacaagaa

SEQ ID NO: 1179495 - RNA, 19 nt, Homo sapiens
ucagugggaagcuguauua

SEQ ID NO: 1179496 - RNA, 19 nt, Homo sapiens
uguggaacaucauacauuu

SEQ ID NO: 1179497 - RNA, 19 nt, Homo sapiens
gaacacaaagaacugauca

SEQ ID NO: 1179498 - RNA, 19 nt, Homo sapiens
ucucggaagugaauucaaa

SEQ ID NO: 1179499 - RNA, 19 nt, Homo sapiens
gugggaagcuguauuaagg

SEQ ID NO: 1179500 - RNA, 19 nt, Homo sapiens
acaaagaacugaucaacac

SEQ ID NO: 1179501 - RNA, 19 nt, Homo sapiens
ggacagcuuugcaaaugag

SEQ ID NO: 1179502 - RNA, 19 nt, Homo sapiens
caaaggaggaggucacguu

SEQ ID NO: 1179503 - RNA, 19 nt, Homo sapiens
gcaaaugagccgagaucuu

SEQ ID NO: 1179504 - RNA, 19 nt, Homo sapiens
ccauagaaaggauucauaa

SEQ ID NO: 1179505 - RNA, 19 nt, Homo sapiens
gaagaagccauagaaagga

SEQ ID NO: 1179506 - RNA, 19 nt, Homo sapiens
gaaaacaagucugaguauu

SEQ ID NO: 1179507 - RNA, 19 nt, Homo sapiens
gaaguuaccgccaguaucg

SEQ ID NO: 1179508 - RNA, 19 nt, Homo sapiens
gacacaaggugacccaauc

SEQ ID NO: 1179509 - RNA, 19 nt, Homo sapiens
gacacaaggugacccaauc

SEQ ID NO: 1179510 - RNA, 19 nt, Homo sapiens
ggaaaagauuguaacgaaa

SEQ ID NO: 1179511 - RNA, 19 nt, Homo sapiens
ggaccuccauauacuuugu

SEQ ID NO: 1179512 - RNA, 19 nt, Homo sapiens
caagucugaguauuucuua

SEQ ID NO: 1179513 - RNA, 19 nt, Homo sapiens
aagauagccugauggaaga

SEQ ID NO: 1179514 - RNA, 19 nt, Homo sapiens
agacacagaucucguucga

SEQ ID NO: 1179515 - RNA, 19 nt, Homo sapiens
ucaguucucucggaaguga

SEQ ID NO: 1179516 - RNA, 19 nt, Homo sapiens
aaagagauuccauacacua

SEQ ID NO: 1179517 - RNA, 19 nt, Homo sapiens
cagcagugguagugaauca

SEQ ID NO: 1179518 - RNA, 19 nt, Homo sapiens
uauugcaccuucaccagua

SEQ ID NO: 1179519 - RNA, 19 nt, Homo sapiens
gaagugcaguguggaacau

SEQ ID NO: 1179520 - RNA, 19 nt, Homo sapiens
uaauagagaacaccggaaa

SEQ ID NO: 1179521 - RNA, 19 nt, Homo sapiens
ccauaacaguggugaagau

SEQ ID NO: 1179522 - RNA, 19 nt, Homo sapiens
ggaggaggaaagcccauaa

SEQ ID NO: 1179523 - RNA, 19 nt, Homo sapiens
ucaaacaccaucaguagga

SEQ ID NO: 1179524 - RNA, 19 nt, Homo sapiens
ggagauguauggcguugac

SEQ ID NO: 1179525 - RNA, 19 nt, Homo sapiens
gagauuccauacacuaaaa

SEQ ID NO: 1179526 - RNA, 19 nt, Homo sapiens
ugacaaugauucuguacag

SEQ ID NO: 1179527 - RNA, 19 nt, Homo sapiens
cguaaaccuuguggagaua

SEQ ID NO: 1179528 - RNA, 19 nt, Homo sapiens
ugaagaagccauagaaagg

SEQ ID NO: 1179529 - RNA, 19 nt, Homo sapiens
gaucuuguaccaccacuuc

SEQ ID NO: 1179530 - RNA, 19 nt, Homo sapiens
auucagaucuuaagcaaag

SEQ ID NO: 1179531 - RNA, 19 nt, Homo sapiens
auaaacauacugcaggaua

SEQ ID NO: 1179532 - RNA, 19 nt, Homo sapiens
gcaggacagcuuugcaaau

SEQ ID NO: 1179533 - RNA, 19 nt, Homo sapiens
ucagacaucuacaaacaac

SEQ ID NO: 1179534 - RNA, 19 nt, Homo sapiens
uaaaagagauuccauacac

SEQ ID NO: 1179535 - RNA, 19 nt, Homo sapiens
ggagaaugauaugguugau

SEQ ID NO: 1179536 - RNA, 19 nt, Homo sapiens
guaacgaaaccucauucuu

SEQ ID NO: 1179537 - RNA, 19 nt, Homo sapiens
caaagguucacuucaagga

SEQ ID NO: 1179538 - RNA, 19 nt, Homo sapiens
ugaccuccaucccgucuau

SEQ ID NO: 1179539 - RNA, 19 nt, Homo sapiens
uaucgcaggucccaguguu

SEQ ID NO: 1179540 - RNA, 19 nt, Homo sapiens
gaauuuuacugcgaaguuu

SEQ ID NO: 1179541 - RNA, 19 nt, Homo sapiens
cuacaauucucccagugau

SEQ ID NO: 1179542 - RNA, 19 nt, Homo sapiens
acaagaagucgaagcaaga

SEQ ID NO: 1179543 - RNA, 19 nt, Homo sapiens
gcaucaagaagucaacgaa

SEQ ID NO: 1179544 - RNA, 19 nt, Homo sapiens
gagaaaacaagucugagua

SEQ ID NO: 1179545 - RNA, 19 nt, Homo sapiens
gccauagaaaggauucaua

SEQ ID NO: 1179546 - RNA, 19 nt, Homo sapiens
gaucagaaggaagaacuug

SEQ ID NO: 1179547 - RNA, 19 nt, Homo sapiens
acagaagccaucagacgua

SEQ ID NO: 1179548 - RNA, 19 nt, Homo sapiens
cagaagccaucagacguau

SEQ ID NO: 1179549 - RNA, 19 nt, Homo sapiens
gcagugguagugaaucaga

SEQ ID NO: 1179550 - RNA, 19 nt, Homo sapiens
cugaguauuucuuaggauu

SEQ ID NO: 1179551 - RNA, 19 nt, Homo sapiens
gauaacugcaaacauggaa

SEQ ID NO: 1179552 - RNA, 19 nt, Homo sapiens
gcgcuguuccggaagaauu

SEQ ID NO: 1179553 - RNA, 19 nt, Homo sapiens
ucagaaggaagaacuugaa

SEQ ID NO: 1179554 - RNA, 19 nt, Homo sapiens
caucaggcauucucauucg

SEQ ID NO: 1179555 - RNA, 19 nt, Homo sapiens
gcaucaggcauucucauuc

SEQ ID NO: 1179556 - RNA, 19 nt, Homo sapiens
ccaauccgcaucaggcauu

SEQ ID NO: 1179557 - RNA, 19 nt, Homo sapiens
ggacgucuuugaugaauua

SEQ ID NO: 1179558 - RNA, 19 nt, Homo sapiens
uggaacagcucacugaaua

SEQ ID NO: 1179559 - RNA, 19 nt, Homo sapiens
gcaacaaccaccaccaaua

SEQ ID NO: 1179560 - RNA, 19 nt, Homo sapiens
gaaagugaacgcagugaaa

SEQ ID NO: 1179561 - RNA, 19 nt, Homo sapiens
caacaaccaccaccaauau

SEQ ID NO: 1179562 - RNA, 19 nt, Homo sapiens
caaccaccaccaauauuua

SEQ ID NO: 1179563 - RNA, 19 nt, Homo sapiens
caacucuccugcagaaaug

SEQ ID NO: 1179564 - RNA, 19 nt, Homo sapiens
cugaagauaucgugaacaa

SEQ ID NO: 1179565 - RNA, 19 nt, Homo sapiens
ugaaagaggccaucgugaa

SEQ ID NO: 1179566 - RNA, 19 nt, Homo sapiens
ggaccacccuuugcacuca

SEQ ID NO: 1179567 - RNA, 19 nt, Homo sapiens
gcacuuaaaggaauucuac

SEQ ID NO: 1179568 - RNA, 19 nt, Homo sapiens
gaaagaggccaucgugaac

SEQ ID NO: 1179569 - RNA, 19 nt, Homo sapiens
gaacagcucacugaauaca

SEQ ID NO: 1179570 - RNA, 19 nt, Homo sapiens
ggaaggaccccaaauuuga

SEQ ID NO: 1179571 - RNA, 19 nt, Homo sapiens
ucacugagcccacuuugug

SEQ ID NO: 1179572 - RNA, 19 nt, Homo sapiens
uaagcuggcuccggagaaa

SEQ ID NO: 1179573 - RNA, 19 nt, Homo sapiens
cagagaaguugguggaaca

SEQ ID NO: 1179574 - RNA, 19 nt, Homo sapiens
gacccucacugccuccaaa

SEQ ID NO: 1179575 - RNA, 19 nt, Homo sapiens
cagaagaacccggaacuug

SEQ ID NO: 1179576 - RNA, 19 nt, Homo sapiens
cagaaaugcugcacaacgu

SEQ ID NO: 1179577 - RNA, 19 nt, Homo sapiens
uugaagaacugcagaaggu

SEQ ID NO: 1179578 - RNA, 19 nt, Homo sapiens
acaaccaccaccaauauuu

SEQ ID NO: 1179579 - RNA, 19 nt, Homo sapiens
gaacccugcuaugccuuug

SEQ ID NO: 1179580 - RNA, 19 nt, Homo sapiens
ucuauggucuguucugcaa

SEQ ID NO: 1179581 - RNA, 19 nt, Homo sapiens
ucccaacucuccugcagaa

SEQ ID NO: 1179582 - RNA, 19 nt, Homo sapiens
ccacaagccagaagcacaa

SEQ ID NO: 1179583 - RNA, 19 nt, Homo sapiens
cugcucagcugcccuguca

SEQ ID NO: 1179584 - RNA, 19 nt, Homo sapiens
aaggaggaaagaagaaaua

SEQ ID NO: 1179585 - RNA, 19 nt, Homo sapiens
guggagagcaucuucaaca

SEQ ID NO: 1179586 - RNA, 19 nt, Homo sapiens
gcacucaguaggccuuugu

SEQ ID NO: 1179587 - RNA, 19 nt, Homo sapiens
cgauggagccggaguucuu

SEQ ID NO: 1179588 - RNA, 19 nt, Homo sapiens
ccaacucuccugcagaaau

SEQ ID NO: 1179589 - RNA, 19 nt, Homo sapiens
ugaacuuugucaaccagaa

SEQ ID NO: 1179590 - RNA, 19 nt, Homo sapiens
uggagagcaucuucaacaa

SEQ ID NO: 1179591 - RNA, 19 nt, Homo sapiens
ugcagaagguguugaugga

SEQ ID NO: 1179592 - RNA, 19 nt, Homo sapiens
gaagaacccggaacuugcu

SEQ ID NO: 1179593 - RNA, 19 nt, Homo sapiens
gcuucuuccugcacuuaaa

SEQ ID NO: 1179594 - RNA, 19 nt, Homo sapiens
ggagagcaucuucaacaag

SEQ ID NO: 1179595 - RNA, 19 nt, Homo sapiens
cauccuacaccaccuauuc

SEQ ID NO: 1179596 - RNA, 19 nt, Homo sapiens
ggugcucuauggucuguuc

SEQ ID NO: 1179597 - RNA, 19 nt, Homo sapiens
cgcuggagcugcugaagga

SEQ ID NO: 1179598 - RNA, 19 nt, Homo sapiens
aagaggccaucgugaacuu

SEQ ID NO: 1179599 - RNA, 19 nt, Homo sapiens
gaggaaagaagaaauaccu

SEQ ID NO: 1179600 - RNA, 19 nt, Homo sapiens
cuaccucacucccaacucu

SEQ ID NO: 1179601 - RNA, 19 nt, Homo sapiens
gaacuuugucaaccagaag

SEQ ID NO: 1179602 - RNA, 19 nt, Homo sapiens
cgccuggccuugcucaguu

SEQ ID NO: 1179603 - RNA, 19 nt, Homo sapiens
cggaggaggagcucucaaa

SEQ ID NO: 1179604 - RNA, 19 nt, Homo sapiens
ggacacccaguuugcagau

SEQ ID NO: 1179605 - RNA, 19 nt, Homo sapiens
agguggaggucaucacuau

SEQ ID NO: 1179606 - RNA, 19 nt, Homo sapiens
aagauaucgugaacaagga

SEQ ID NO: 1179607 - RNA, 19 nt, Homo sapiens
gaacugcagaagguguuga

SEQ ID NO: 1179608 - RNA, 19 nt, Homo sapiens
ggccuugcucaguuuauuu

SEQ ID NO: 1179609 - RNA, 19 nt, Homo sapiens
caaaaguggucugaaguca

SEQ ID NO: 1179610 - RNA, 19 nt, Homo sapiens
gagcguggagagcaucuuc

SEQ ID NO: 1179611 - RNA, 19 nt, Homo sapiens
gaucaaugccacucuucuc

SEQ ID NO: 1179612 - RNA, 19 nt, Homo sapiens
caucuuacucuugcugauu

SEQ ID NO: 1179613 - RNA, 19 nt, Homo sapiens
gaaggaccccaaauuugaa

SEQ ID NO: 1179614 - RNA, 19 nt, Homo sapiens
ugccaagcauuguucuaga

SEQ ID NO: 1179615 - RNA, 19 nt, Homo sapiens
gcugauuggacaacuugaa

SEQ ID NO: 1179616 - RNA, 19 nt, Homo sapiens
gagaaagugaacgcaguga

SEQ ID NO: 1179617 - RNA, 19 nt, Homo sapiens
gcucauccuacaccaccua

SEQ ID NO: 1179618 - RNA, 19 nt, Homo sapiens
gccaagcauuguucuagac

SEQ ID NO: 1179619 - RNA, 19 nt, Homo sapiens
gaggccaucgugaacuuug

SEQ ID NO: 1179620 - RNA, 19 nt, Homo sapiens
gauggagccggaguucuug

SEQ ID NO: 1179621 - RNA, 19 nt, Homo sapiens
uggccuugcucaguuuauu

SEQ ID NO: 1179622 - RNA, 19 nt, Homo sapiens
gccuggccuugcucaguuu

SEQ ID NO: 1179623 - RNA, 19 nt, Homo sapiens
acaaggacgagccuccaaa

SEQ ID NO: 1179624 - RNA, 19 nt, Homo sapiens
aaggacgucuuugaugaau

SEQ ID NO: 1179625 - RNA, 19 nt, Homo sapiens
caaggacgagccuccaaag

SEQ ID NO: 1179626 - RNA, 19 nt, Homo sapiens
guucgacgggcucauccua

SEQ ID NO: 1179627 - RNA, 19 nt, Homo sapiens
cgaacccugcuaugccuuu

SEQ ID NO: 1179628 - RNA, 19 nt, Homo sapiens
aucguuggauuaucuuuga

SEQ ID NO: 1179629 - RNA, 19 nt, Homo sapiens
caucguuggauuaucuuug

SEQ ID NO: 1179630 - RNA, 19 nt, Homo sapiens
aggacgagccuccaaagga

SEQ ID NO: 1179631 - RNA, 19 nt, Homo sapiens
gacaaggacgagccuccaa

SEQ ID NO: 1179632 - RNA, 19 nt, Homo sapiens
ugaacaaggaugccaagag

SEQ ID NO: 1179633 - RNA, 19 nt, Homo sapiens
ggcaacaaccaccaccaau

SEQ ID NO: 1179634 - RNA, 19 nt, Homo sapiens
gcuggaagcagaggacauc

SEQ ID NO: 1179635 - RNA, 19 nt, Homo sapiens
ucgacgggcucauccuaca

SEQ ID NO: 1179636 - RNA, 19 nt, Homo sapiens
gaaauaauguggucucuga

SEQ ID NO: 1179637 - RNA, 19 nt, Homo sapiens
agaaauaucuucagaggaa

SEQ ID NO: 1179638 - RNA, 19 nt, Homo sapiens
caagggaucuguuuacuuc

SEQ ID NO: 1179639 - RNA, 19 nt, Homo sapiens
gaggaagacugccgccaua

SEQ ID NO: 1179640 - RNA, 19 nt, Homo sapiens
gaaugugucuuuccuuuca

SEQ ID NO: 1179641 - RNA, 19 nt, Homo sapiens
gagcagaaccuuaaagaga

SEQ ID NO: 1179642 - RNA, 19 nt, Homo sapiens
ccacagagaacauggauaa

SEQ ID NO: 1179643 - RNA, 19 nt, Homo sapiens
ucaaucagcugguccuuug

SEQ ID NO: 1179644 - RNA, 19 nt, Homo sapiens
gaacauggauaaggaugga

SEQ ID NO: 1179645 - RNA, 19 nt, Homo sapiens
cagaagaacucucucaaag

SEQ ID NO: 1179646 - RNA, 19 nt, Homo sapiens
ggacaaccuuccuucucua

SEQ ID NO: 1179647 - RNA, 19 nt, Homo sapiens
uaacugcacuaacaaagga

SEQ ID NO: 1179648 - RNA, 19 nt, Homo sapiens
gaagagggcagccaagaug

SEQ ID NO: 1179649 - RNA, 19 nt, Homo sapiens
gaagauuacccacgcugua

SEQ ID NO: 1179650 - RNA, 19 nt, Homo sapiens
uaucuucccuuucaucuau

SEQ ID NO: 1179651 - RNA, 19 nt, Homo sapiens
caaccuuccuucucuauuc

SEQ ID NO: 1179652 - RNA, 19 nt, Homo sapiens
gaaaggagaaauaucuuca

SEQ ID NO: 1179653 - RNA, 19 nt, Homo sapiens
caauaaaggagucuugauu

SEQ ID NO: 1179654 - RNA, 19 nt, Homo sapiens
cagagaacauggauaagga

SEQ ID NO: 1179655 - RNA, 19 nt, Homo sapiens
gcacccauauucauagcuu

SEQ ID NO: 1179656 - RNA, 19 nt, Homo sapiens
ccaaagccauucaaccaau

SEQ ID NO: 1179657 - RNA, 19 nt, Homo sapiens
gcagaaccuuaaagagaga

SEQ ID NO: 1179658 - RNA, 19 nt, Homo sapiens
gaggaaaggagaaauaucu

SEQ ID NO: 1179659 - RNA, 19 nt, Homo sapiens
aaacagcaguggaaauucu

SEQ ID NO: 1179660 - RNA, 19 nt, Homo sapiens
ugaagaacguagagagaau

SEQ ID NO: 1179661 - RNA, 19 nt, Homo sapiens
gcugaggaaaggagaaaua

SEQ ID NO: 1179662 - RNA, 19 nt, Homo sapiens
caguggaaauucugugaaa

SEQ ID NO: 1179663 - RNA, 19 nt, Homo sapiens
ggaaguacugccagaguga

SEQ ID NO: 1179664 - RNA, 19 nt, Homo sapiens
gcaugaggaaugugucuuu

SEQ ID NO: 1179665 - RNA, 19 nt, Homo sapiens
cggcauaaccaccaauaaa

SEQ ID NO: 1179666 - RNA, 19 nt, Homo sapiens
ggaaaggagaaauaucuuc

SEQ ID NO: 1179667 - RNA, 19 nt, Homo sapiens
agaaacagcaguggaaauu

SEQ ID NO: 1179668 - RNA, 19 nt, Homo sapiens
ucaccucugucuucgauga

SEQ ID NO: 1179669 - RNA, 19 nt, Homo sapiens
gaggaaaggcuuauaacag

SEQ ID NO: 1179670 - RNA, 19 nt, Homo sapiens
ccagaagaacucucucaaa

SEQ ID NO: 1179671 - RNA, 19 nt, Homo sapiens
gagcacagauuugucuuuu

SEQ ID NO: 1179672 - RNA, 19 nt, Homo sapiens
uggcuuuccuugucacuuu

SEQ ID NO: 1179673 - RNA, 19 nt, Homo sapiens
gaagacugccgccauacug

SEQ ID NO: 1179674 - RNA, 19 nt, Homo sapiens
gcugguccuuugugaagaa

SEQ ID NO: 1179675 - RNA, 19 nt, Homo sapiens
aaggagaaauaucuucaga

SEQ ID NO: 1179676 - RNA, 19 nt, Homo sapiens
gcacuaacaaaggaucaaa

SEQ ID NO: 1179677 - RNA, 19 nt, Homo sapiens
auaauguggucucugauug

SEQ ID NO: 1179678 - RNA, 19 nt, Homo sapiens
gagaagagggcagccaaga

SEQ ID NO: 1179679 - RNA, 19 nt, Homo sapiens
gggagcagaaccuuaaaga

SEQ ID NO: 1179680 - RNA, 19 nt, Homo sapiens
uugcaucugucaagcuuaa

SEQ ID NO: 1179681 - RNA, 19 nt, Homo sapiens
caaagccauucaaccaauc

SEQ ID NO: 1179682 - RNA, 19 nt, Homo sapiens
gaagaacguagagagaaug

SEQ ID NO: 1179683 - RNA, 19 nt, Homo sapiens
gagccagggcccagaagaa

SEQ ID NO: 1179684 - RNA, 19 nt, Homo sapiens
gagaaacagcaguggaaau

SEQ ID NO: 1179685 - RNA, 19 nt, Homo sapiens
caucugucaagcuuaaaua

SEQ ID NO: 1179686 - RNA, 19 nt, Homo sapiens
agaagaacucucucaaaga

SEQ ID NO: 1179687 - RNA, 19 nt, Homo sapiens
gugcaacuucuuacaacua

SEQ ID NO: 1179688 - RNA, 19 nt, Homo sapiens
gcauggaggaugaaagcaa

SEQ ID NO: 1179689 - RNA, 19 nt, Homo sapiens
ggaaauucugugaaacgaa

SEQ ID NO: 1179690 - RNA, 19 nt, Homo sapiens
gaaacagcaguggaaauuc

SEQ ID NO: 1179691 - RNA, 19 nt, Homo sapiens
gcauaaccaccaauaaagg

SEQ ID NO: 1179692 - RNA, 19 nt, Homo sapiens
ggcauaaccaccaauaaag

SEQ ID NO: 1179693 - RNA, 19 nt, Homo sapiens
aagcuuaaauaaccaccuu

SEQ ID NO: 1179694 - RNA, 19 nt, Homo sapiens
cauugcaucugucaagcuu

SEQ ID NO: 1179695 - RNA, 19 nt, Homo sapiens
cugauugcauggaggauga

SEQ ID NO: 1179696 - RNA, 19 nt, Homo sapiens
gugaagaacguagagagaa

SEQ ID NO: 1179697 - RNA, 19 nt, Homo sapiens
cacuuuccguucaacuaua

SEQ ID NO: 1179698 - RNA, 19 nt, Homo sapiens
caaguggagggaugcauga

SEQ ID NO: 1179699 - RNA, 19 nt, Homo sapiens
ggccaaagccauucaacca

SEQ ID NO: 1179700 - RNA, 19 nt, Homo sapiens
cauaaccaccaauaaagga

SEQ ID NO: 1179701 - RNA, 19 nt, Homo sapiens
gcaguggaaauucugugaa

SEQ ID NO: 1179702 - RNA, 19 nt, Homo sapiens
cgaggaaaggcuuauaaca

SEQ ID NO: 1179703 - RNA, 19 nt, Homo sapiens
gaaguacugccagagugaa

SEQ ID NO: 1179704 - RNA, 19 nt, Homo sapiens
gugaaacgaaugaguaugg

SEQ ID NO: 1179705 - RNA, 19 nt, Homo sapiens
ucugugaaacgaaugagua

SEQ ID NO: 1179706 - RNA, 19 nt, Homo sapiens
ucacuugcacccauauuca

SEQ ID NO: 1179707 - RNA, 19 nt, Homo sapiens
ucacuuuccguucaacuau

SEQ ID NO: 1179708 - RNA, 19 nt, Homo sapiens
uggacaaccuuccuucucu

SEQ ID NO: 1179709 - RNA, 19 nt, Homo sapiens
ccuacaagggaucuguuua

SEQ ID NO: 1179710 - RNA, 19 nt, Homo sapiens
gagggaugcaugaggaaug

SEQ ID NO: 1179711 - RNA, 19 nt, Homo sapiens
uaaccaccuuuagaaauac

SEQ ID NO: 1179712 - RNA, 19 nt, Homo sapiens
ggugugcaacuucuuacaa

SEQ ID NO: 1179713 - RNA, 19 nt, Homo sapiens
aauaauguggucucugauu

SEQ ID NO: 1179714 - RNA, 19 nt, Homo sapiens
cgcuguaucuucccuuuca

SEQ ID NO: 1179715 - RNA, 19 nt, Homo sapiens
cacccauauucauagcuua

SEQ ID NO: 1179716 - RNA, 19 nt, Homo sapiens
gccaaagccauucaaccaa

SEQ ID NO: 1179717 - RNA, 19 nt, Homo sapiens
aagcugccuuuguguccua

SEQ ID NO: 1179718 - RNA, 19 nt, Homo sapiens
cuugggagcagaaccuuaa

SEQ ID NO: 1179719 - RNA, 19 nt, Homo sapiens
caugaggaaugugucuuuc

SEQ ID NO: 1179720 - RNA, 19 nt, Homo sapiens
gcaccaccugcuucaauca

SEQ ID NO: 1179721 - RNA, 19 nt, Homo sapiens
cagauaauccagagcucuu

SEQ ID NO: 1179722 - RNA, 19 nt, Homo sapiens
caacuucuuacaacuacga

SEQ ID NO: 1179723 - RNA, 19 nt, Homo sapiens
cccuccaucuacagaaaua

SEQ ID NO: 1179724 - RNA, 19 nt, Homo sapiens
gacaaccuuccuucucuau

SEQ ID NO: 1179725 - RNA, 19 nt, Homo sapiens
gcuuauaacagcugcaucu

SEQ ID NO: 1179726 - RNA, 19 nt, Homo sapiens
ggaagacugccgccauacu

SEQ ID NO: 1179727 - RNA, 19 nt, Homo sapiens
acuuuccguucaacuauaa

SEQ ID NO: 1179728 - RNA, 19 nt, Homo sapiens
cuacaagggaucuguuuac

SEQ ID NO: 1179729 - RNA, 19 nt, Homo sapiens
cagcugguccuuugugaag

SEQ ID NO: 1179730 - RNA, 19 nt, Homo sapiens
ccuuucaucuaucgaggaa

SEQ ID NO: 1179731 - RNA, 19 nt, Homo sapiens
cacgcuguaucuucccuuu

SEQ ID NO: 1179732 - RNA, 19 nt, Homo sapiens
gaucuguuuacuucacuug

SEQ ID NO: 1179733 - RNA, 19 nt, Homo sapiens
ccaauaaaggagucuugau

SEQ ID NO: 1179734 - RNA, 19 nt, Homo sapiens
gcggcauaaccaccaauaa

SEQ ID NO: 1179735 - RNA, 19 nt, Homo sapiens
gcaucugucaagcuuaaau

SEQ ID NO: 1179736 - RNA, 19 nt, Homo sapiens
caacaaacauccuuaaaga

SEQ ID NO: 1179737 - RNA, 19 nt, Homo sapiens
ucaagaagcuggaguauau

SEQ ID NO: 1179738 - RNA, 19 nt, Homo sapiens
gaacaugaauagcaaagaa

SEQ ID NO: 1179739 - RNA, 19 nt, Homo sapiens
gaacugugauugugacauu

SEQ ID NO: 1179740 - RNA, 19 nt, Homo sapiens
gaagggauuucugguauaa

SEQ ID NO: 1179741 - RNA, 19 nt, Homo sapiens
gcaauagaaugcacacaaa

SEQ ID NO: 1179742 - RNA, 19 nt, Homo sapiens
cuacagacaucuuucuuaa

SEQ ID NO: 1179743 - RNA, 19 nt, Homo sapiens
acaggaaacucaaauauga

SEQ ID NO: 1179744 - RNA, 19 nt, Homo sapiens
ugacagaauugcuuagaaa

SEQ ID NO: 1179745 - RNA, 19 nt, Homo sapiens
agauagaccuguacaugua

SEQ ID NO: 1179746 - RNA, 19 nt, Homo sapiens
gaucaucauuggcugcuuu

SEQ ID NO: 1179747 - RNA, 19 nt, Homo sapiens
cacaggaggccauaaauua

SEQ ID NO: 1179748 - RNA, 19 nt, Homo sapiens
gaagauagaccuguacaug

SEQ ID NO: 1179749 - RNA, 19 nt, Homo sapiens
cccaggcgauggugaauua

SEQ ID NO: 1179750 - RNA, 19 nt, Homo sapiens
gauccacaguuacaaguga

SEQ ID NO: 1179751 - RNA, 19 nt, Homo sapiens
caagagggauagacugaau

SEQ ID NO: 1179752 - RNA, 19 nt, Homo sapiens
gguauaagguugaaauugc

SEQ ID NO: 1179753 - RNA, 19 nt, Homo sapiens
ggacacaggacuauccauu

SEQ ID NO: 1179754 - RNA, 19 nt, Homo sapiens
aaacauccuuaaagaggua

SEQ ID NO: 1179755 - RNA, 19 nt, Homo sapiens
gguugaaauugcugagaua

SEQ ID NO: 1179756 - RNA, 19 nt, Homo sapiens
ugagguaccugguggaguu

SEQ ID NO: 1179757 - RNA, 19 nt, Homo sapiens
gaacgugccacaccaugaa

SEQ ID NO: 1179758 - RNA, 19 nt, Homo sapiens
guacaggaaacucaaauau

SEQ ID NO: 1179759 - RNA, 19 nt, Homo sapiens
gagaguauauacccaccaa

SEQ ID NO: 1179760 - RNA, 19 nt, Homo sapiens
gcugauucauuagggauua

SEQ ID NO: 1179761 - RNA, 19 nt, Homo sapiens
caaggcaugugucuauuca

SEQ ID NO: 1179762 - RNA, 19 nt, Homo sapiens
uuaaagacaugcccaaucu

SEQ ID NO: 1179763 - RNA, 19 nt, Homo sapiens
uggcguagcucucagucua

SEQ ID NO: 1179764 - RNA, 19 nt, Homo sapiens
cagaauugcuuagaaagga

SEQ ID NO: 1179765 - RNA, 19 nt, Homo sapiens
ccacaacccuuggaacugu

SEQ ID NO: 1179766 - RNA, 19 nt, Homo sapiens
gcgcaaguguggauucugu

SEQ ID NO: 1179767 - RNA, 19 nt, Homo sapiens
acacaggacuauccauuuc

SEQ ID NO: 1179768 - RNA, 19 nt, Homo sapiens
gaguauauacccaccaauu

SEQ ID NO: 1179769 - RNA, 19 nt, Homo sapiens
gaaauaagggguucagauu

SEQ ID NO: 1179770 - RNA, 19 nt, Homo sapiens
cagcggaugucaacugguu

SEQ ID NO: 1179771 - RNA, 19 nt, Homo sapiens
gcuccuagcucacuuaagc

SEQ ID NO: 1179772 - RNA, 19 nt, Homo sapiens
aaagcaccaugaauuugua

SEQ ID NO: 1179773 - RNA, 19 nt, Homo sapiens
gccgagagcugucuuugca

SEQ ID NO: 1179774 - RNA, 19 nt, Homo sapiens
agacaccacugacaagaug

SEQ ID NO: 1179775 - RNA, 19 nt, Homo sapiens
ugauguaacuucuuucagu

SEQ ID NO: 1179776 - RNA, 19 nt, Homo sapiens
ggagaagguggaagagaaa

SEQ ID NO: 1179777 - RNA, 19 nt, Homo sapiens
gguccaagccacaaguuaa

SEQ ID NO: 1179778 - RNA, 19 nt, Homo sapiens
ggcagaacaugaauagcaa

SEQ ID NO: 1179779 - RNA, 19 nt, Homo sapiens
ggacacaacgcgaaaguac

SEQ ID NO: 1179780 - RNA, 19 nt, Homo sapiens
gcaguaaccaguucagcaa

SEQ ID NO: 1179781 - RNA, 19 nt, Homo sapiens
ggccauaaauuagcauugu

SEQ ID NO: 1179782 - RNA, 19 nt, Homo sapiens
gcaccagauuccugcaguu

SEQ ID NO: 1179783 - RNA, 19 nt, Homo sapiens
gagcugucuuugcagaauu

SEQ ID NO: 1179784 - RNA, 19 nt, Homo sapiens
gacuauccauuucuacaga

SEQ ID NO: 1179785 - RNA, 19 nt, Homo sapiens
gaagacaucccagcagcaa

SEQ ID NO: 1179786 - RNA, 19 nt, Homo sapiens
gggaggagaagccugaauu

SEQ ID NO: 1179787 - RNA, 19 nt, Homo sapiens
gacacaggacuauccauuu

SEQ ID NO: 1179788 - RNA, 19 nt, Homo sapiens
caacuuggcccacaauaac

SEQ ID NO: 1179789 - RNA, 19 nt, Homo sapiens
gggcagaacaugaauagca

SEQ ID NO: 1179790 - RNA, 19 nt, Homo sapiens
ggaggagaagccugaauug

SEQ ID NO: 1179791 - RNA, 19 nt, Homo sapiens
ccuggacucugacacauga

SEQ ID NO: 1179792 - RNA, 19 nt, Homo sapiens
cacaauucaugaccauauu

SEQ ID NO: 1179793 - RNA, 19 nt, Homo sapiens
cgacagacaccacugacaa

SEQ ID NO: 1179794 - RNA, 19 nt, Homo sapiens
aagaagcucugggucauga

SEQ ID NO: 1179795 - RNA, 19 nt, Homo sapiens
uaucugaacuugggcaugu

SEQ ID NO: 1179796 - RNA, 19 nt, Homo sapiens
aggagaagguggaagagaa

SEQ ID NO: 1179797 - RNA, 19 nt, Homo sapiens
ucacaggaggccauaaauu

SEQ ID NO: 1179798 - RNA, 19 nt, Homo sapiens
gcucucagucuaaugcuuu

SEQ ID NO: 1179799 - RNA, 19 nt, Homo sapiens
acaggacuauccauuucua

SEQ ID NO: 1179800 - RNA, 19 nt, Homo sapiens
uaacuacaacaccuacaaa

SEQ ID NO: 1179801 - RNA, 19 nt, Homo sapiens
ccacaauucaugaccauau

SEQ ID NO: 1179802 - RNA, 19 nt, Homo sapiens
ccauguugauugucuucua

SEQ ID NO: 1179803 - RNA, 19 nt, Homo sapiens
cgacggcaccuugaacuuu

SEQ ID NO: 1179804 - RNA, 19 nt, Homo sapiens
ugauugagcggaaugcuuu

SEQ ID NO: 1179805 - RNA, 19 nt, Homo sapiens
acagacaucuuucuuaagc

SEQ ID NO: 1179806 - RNA, 19 nt, Homo sapiens
gguacaggaaacucaaaua

SEQ ID NO: 1179807 - RNA, 19 nt, Homo sapiens
ggucggauggcagaacuua

SEQ ID NO: 1179808 - RNA, 19 nt, Homo sapiens
ccucgagaccucaacauuu

SEQ ID NO: 1179809 - RNA, 19 nt, Homo sapiens
gcacacugaugggaagcuu

SEQ ID NO: 1179810 - RNA, 19 nt, Homo sapiens
guaaagcagagagaaugua

SEQ ID NO: 1179811 - RNA, 19 nt, Homo sapiens
gauggugaauuaugaacgu

SEQ ID NO: 1179812 - RNA, 19 nt, Homo sapiens
uaaagcagagagaauguau

SEQ ID NO: 1179813 - RNA, 19 nt, Homo sapiens
gcaaggcaugugucuauuc

SEQ ID NO: 1179814 - RNA, 19 nt, Homo sapiens
aaauucaaacgaacccuua

SEQ ID NO: 1179815 - RNA, 19 nt, Homo sapiens
cauguugauugucuucuau

SEQ ID NO: 1179816 - RNA, 19 nt, Homo sapiens
gagcacggcugagcuuaac

SEQ ID NO: 1179817 - RNA, 19 nt, Homo sapiens
ccugguggcuucgagagua

SEQ ID NO: 1179818 - RNA, 19 nt, Homo sapiens
ucaagaagcucugggucau

SEQ ID NO: 1179819 - RNA, 19 nt, Homo sapiens
uggaggagcuggagauguc

SEQ ID NO: 1179820 - RNA, 19 nt, Homo sapiens
ucaacuuggcccacaauaa

SEQ ID NO: 1179821 - RNA, 19 nt, Homo sapiens
gaaaagggagagacgaaaa

SEQ ID NO: 1179822 - RNA, 19 nt, Homo sapiens
aggcgauggugaauuauga

SEQ ID NO: 1179823 - RNA, 19 nt, Homo sapiens
cacuaucucugaaccuuau

SEQ ID NO: 1179824 - RNA, 19 nt, Homo sapiens
cuaccacggugcucauuca

SEQ ID NO: 1179825 - RNA, 19 nt, Homo sapiens
gcauauaccaccucuacca

SEQ ID NO: 1179826 - RNA, 19 nt, Homo sapiens
ugccuugccugacagaauu

SEQ ID NO: 1179827 - RNA, 19 nt, Homo sapiens
ggcaagagggauagacuga

SEQ ID NO: 1179828 - RNA, 19 nt, Homo sapiens
ucuacagacaucuuucuua

SEQ ID NO: 1179829 - RNA, 19 nt, Homo sapiens
uagacugaaucugucauuu

SEQ ID NO: 1179830 - RNA, 19 nt, Homo sapiens
ggacaccacgccagugcuu

SEQ ID NO: 1179831 - RNA, 19 nt, Homo sapiens
ccacuaucucugaaccuua

SEQ ID NO: 1179832 - RNA, 19 nt, Homo sapiens
caguagugcugcccacaau

SEQ ID NO: 1179833 - RNA, 19 nt, Homo sapiens
acacaacgcgaaaguacaa

SEQ ID NO: 1179834 - RNA, 19 nt, Homo sapiens
cucgagaccucaacauuuc

SEQ ID NO: 1179835 - RNA, 19 nt, Homo sapiens
gugcaacauuaaagacaug

SEQ ID NO: 1179836 - RNA, 19 nt, Homo sapiens
ggaaauagaugagaaugaa

SEQ ID NO: 1179837 - RNA, 19 nt, Homo sapiens
gaccagaacugaaauauuc

SEQ ID NO: 1179838 - RNA, 19 nt, Homo sapiens
gagagaagaagaagauuua

SEQ ID NO: 1179839 - RNA, 19 nt, Homo sapiens
gaagaagauuuacauggaa

SEQ ID NO: 1179840 - RNA, 19 nt, Homo sapiens
caaagaauccuccagagaa

SEQ ID NO: 1179841 - RNA, 19 nt, Homo sapiens
gaucaaucccacucuaaua

SEQ ID NO: 1179842 - RNA, 19 nt, Homo sapiens
gagagaccauggcaaagaa

SEQ ID NO: 1179843 - RNA, 19 nt, Homo sapiens
uuaaacugcuggcaacaua

SEQ ID NO: 1179844 - RNA, 19 nt, Homo sapiens
gagagagguuauuguugua

SEQ ID NO: 1179845 - RNA, 19 nt, Homo sapiens
ggaaauggcacugaugaaa

SEQ ID NO: 1179846 - RNA, 19 nt, Homo sapiens
gugauaacgugaccaugua

SEQ ID NO: 1179847 - RNA, 19 nt, Homo sapiens
agaagaagauuuacaugga

SEQ ID NO: 1179848 - RNA, 19 nt, Homo sapiens
agccagcucuccagaauua

SEQ ID NO: 1179849 - RNA, 19 nt, Homo sapiens
ugagagagguuauuguugu

SEQ ID NO: 1179850 - RNA, 19 nt, Homo sapiens
gguaauuccucucuucaug

SEQ ID NO: 1179851 - RNA, 19 nt, Homo sapiens
ggagagaagaagaagauuu

SEQ ID NO: 1179852 - RNA, 19 nt, Homo sapiens
gcaaagaauccuccagaga

SEQ ID NO: 1179853 - RNA, 19 nt, Homo sapiens
gguggucccucaagugaaa

SEQ ID NO: 1179854 - RNA, 19 nt, Homo sapiens
gaagaaauuaccacaacuu

SEQ ID NO: 1179855 - RNA, 19 nt, Homo sapiens
gaugagagagguuauuguu

SEQ ID NO: 1179856 - RNA, 19 nt, Homo sapiens
ugaagacugucacauucua

SEQ ID NO: 1179857 - RNA, 19 nt, Homo sapiens
gagagguuauuguuguauu

SEQ ID NO: 1179858 - RNA, 19 nt, Homo sapiens
uaccacaacuuucuuugaa

SEQ ID NO: 1179859 - RNA, 19 nt, Homo sapiens
guagguaauuccucucuuc

SEQ ID NO: 1179860 - RNA, 19 nt, Homo sapiens
ucaaugaauuucugccuau

SEQ ID NO: 1179861 - RNA, 19 nt, Homo sapiens
guagccagcucuccagaau

SEQ ID NO: 1179862 - RNA, 19 nt, Homo sapiens
cgagucaucugucguguca

SEQ ID NO: 1179863 - RNA, 19 nt, Homo sapiens
gagcucaaaugcuuaaacu

SEQ ID NO: 1179864 - RNA, 19 nt, Homo sapiens
ccacaacuuucuuugaaca

SEQ ID NO: 1179865 - RNA, 19 nt, Homo sapiens
gaugaaacauuggaaguac

SEQ ID NO: 1179866 - RNA, 19 nt, Homo sapiens
ccgcgucugugaaccuuua

SEQ ID NO: 1179867 - RNA, 19 nt, Homo sapiens
aaagaauccuccagagaau

SEQ ID NO: 1179868 - RNA, 19 nt, Homo sapiens
cagaaaagccuauugaaaa

SEQ ID NO: 1179869 - RNA, 19 nt, Homo sapiens
gaagaagaagauuuacaug

SEQ ID NO: 1179870 - RNA, 19 nt, Homo sapiens
gacccuaacucuaauuguc

SEQ ID NO: 1179871 - RNA, 19 nt, Homo sapiens
gcugagagaccauggcaaa

SEQ ID NO: 1179872 - RNA, 19 nt, Homo sapiens
gcuacuacccauauccaua

SEQ ID NO: 1179873 - RNA, 19 nt, Homo sapiens
ucacuuuccugccaacgaa

SEQ ID NO: 1179874 - RNA, 19 nt, Homo sapiens
cagaagaggaaauagauga

SEQ ID NO: 1179875 - RNA, 19 nt, Homo sapiens
uaauuccucucuucauguu

SEQ ID NO: 1179876 - RNA, 19 nt, Homo sapiens
caaucccacucuaauauca

SEQ ID NO: 1179877 - RNA, 19 nt, Homo sapiens
aaauggcacugaugaaaca

SEQ ID NO: 1179878 - RNA, 19 nt, Homo sapiens
gaagacugucacauucuaa

SEQ ID NO: 1179879 - RNA, 19 nt, Homo sapiens
ucaaagcaaggaaagagua

SEQ ID NO: 1179880 - RNA, 19 nt, Homo sapiens
aaacugcuggcaacauaua

SEQ ID NO: 1179881 - RNA, 19 nt, Homo sapiens
ccauauaaauucagcuucu

SEQ ID NO: 1179882 - RNA, 19 nt, Homo sapiens
gaaauggcacugaugaaac

SEQ ID NO: 1179883 - RNA, 19 nt, Homo sapiens
gcagaaaagccuauugaaa

SEQ ID NO: 1179884 - RNA, 19 nt, Homo sapiens
gaagaggaaauagaugaga

SEQ ID NO: 1179885 - RNA, 19 nt, Homo sapiens
gcuggcaacauauaauaaa

SEQ ID NO: 1179886 - RNA, 19 nt, Homo sapiens
aagaggaaauagaugagaa

SEQ ID NO: 1179887 - RNA, 19 nt, Homo sapiens
gcaguggagagaagaagaa

SEQ ID NO: 1179888 - RNA, 19 nt, Homo sapiens
gaacuuccaauaaaugacu

SEQ ID NO: 1179889 - RNA, 19 nt, Homo sapiens
gcggaaauggcacugauga

SEQ ID NO: 1179890 - RNA, 19 nt, Homo sapiens
gagaagaagaagauuuaca

SEQ ID NO: 1179891 - RNA, 19 nt, Homo sapiens
ggcaacauauaauaaaugc

SEQ ID NO: 1179892 - RNA, 19 nt, Homo sapiens
gcacugaugaaacauugga

SEQ ID NO: 1179893 - RNA, 19 nt, Homo sapiens
cuacagcaguggagagaag

SEQ ID NO: 1179894 - RNA, 19 nt, Homo sapiens
acaagcaagugaggaagaa

SEQ ID NO: 1179895 - RNA, 19 nt, Homo sapiens
ccucagcaguggucucuca

SEQ ID NO: 1179896 - RNA, 19 nt, Homo sapiens
caaggaaagaguacugugu

SEQ ID NO: 1179897 - RNA, 19 nt, Homo sapiens
uaacucuaauuguccuguu

SEQ ID NO: 1179898 - RNA, 19 nt, Homo sapiens
aaugcaugcuauucaauga

SEQ ID NO: 1179899 - RNA, 19 nt, Homo sapiens
gauaacgugaccauguauu

SEQ ID NO: 1179900 - RNA, 19 nt, Homo sapiens
cggauacacuggcaucuac

SEQ ID NO: 1179901 - RNA, 19 nt, Homo sapiens
ugaugaaacauuggaagua

SEQ ID NO: 1179902 - RNA, 19 nt, Homo sapiens
uggcacugaugaaacauug

SEQ ID NO: 1179903 - RNA, 19 nt, Homo sapiens
guaauuccucucuucaugu

SEQ ID NO: 1179904 - RNA, 19 nt, Homo sapiens
ugagagaccauggcaaaga

SEQ ID NO: 1179905 - RNA, 19 nt, Homo sapiens
ugaaccagaagaggaaaua

SEQ ID NO: 1179906 - RNA, 19 nt, Homo sapiens
ggacugguguuugguaucc

SEQ ID NO: 1179907 - RNA, 19 nt, Homo sapiens
caucugucgugucaucaug

SEQ ID NO: 1179908 - RNA, 19 nt, Homo sapiens
agagaauugugaagacugu

SEQ ID NO: 1179909 - RNA, 19 nt, Homo sapiens
ccaaggaggacgagucauc

SEQ ID NO: 1179910 - RNA, 19 nt, Homo sapiens
ugaccagaacugaaauauu

SEQ ID NO: 1179911 - RNA, 19 nt, Homo sapiens
gacaagcaagugaggaaga

SEQ ID NO: 1179912 - RNA, 19 nt, Homo sapiens
ggaggagggagaagaucuu

SEQ ID NO: 1179913 - RNA, 19 nt, Homo sapiens
acauggagcacacuuucua

SEQ ID NO: 1179914 - RNA, 19 nt, Homo sapiens
caaugaauuucugccuaug

SEQ ID NO: 1179915 - RNA, 19 nt, Homo sapiens
ggucuaauaggagguuuga

SEQ ID NO: 1179916 - RNA, 19 nt, Homo sapiens
caagugaaaguagagaaga

SEQ ID NO: 1179917 - RNA, 19 nt, Homo sapiens
gaaauagaugagaaugaag

SEQ ID NO: 1179918 - RNA, 19 nt, Homo sapiens
guggagagaagaagaagau

SEQ ID NO: 1179919 - RNA, 19 nt, Homo sapiens
ugacauggagcacacuuuc

SEQ ID NO: 1179920 - RNA, 19 nt, Homo sapiens
gcacuucuggccggaggua

SEQ ID NO: 1179921 - RNA, 19 nt, Homo sapiens
agaauccuccagagaauug

SEQ ID NO: 1179922 - RNA, 19 nt, Homo sapiens
ugaagaaauuaccacaacu

SEQ ID NO: 1179923 - RNA, 19 nt, Homo sapiens
ucucaguccucucaaagca

SEQ ID NO: 1179924 - RNA, 19 nt, Homo sapiens
ccugugaccagaacugaaa

SEQ ID NO: 1179925 - RNA, 19 nt, Homo sapiens
cagacaagcaagugaggaa

SEQ ID NO: 1179926 - RNA, 19 nt, Homo sapiens
ccagaauuacuuguaggua

SEQ ID NO: 1179927 - RNA, 19 nt, Homo sapiens
cugcuggcaacauauaaua

SEQ ID NO: 1179928 - RNA, 19 nt, Homo sapiens
uuugaacagucagugauuu

SEQ ID NO: 1179929 - RNA, 19 nt, Homo sapiens
ccagagaauugugaagacu

SEQ ID NO: 1179930 - RNA, 19 nt, Homo sapiens
ucuguuagccgacucacuu

SEQ ID NO: 1179931 - RNA, 19 nt, Homo sapiens
gauuaaagugauuccugaa

SEQ ID NO: 1179932 - RNA, 19 nt, Homo sapiens
agucaucugucgugucauc

SEQ ID NO: 1179933 - RNA, 19 nt, Homo sapiens
guggacugguguuugguau

SEQ ID NO: 1179934 - RNA, 19 nt, Homo sapiens
gagaaugaagaaauuacca

SEQ ID NO: 1179935 - RNA, 19 nt, Homo sapiens
gaggaaauagaugagaaug

SEQ ID NO: 1179936 - RNA, 19 nt, Homo sapiens
gaagaaauguggaaagaua

SEQ ID NO: 1179937 - RNA, 19 nt, Homo sapiens
ggaaagauauggaagaaug

SEQ ID NO: 1179938 - RNA, 19 nt, Homo sapiens
ggaagaaugucagaauaaa

SEQ ID NO: 1179939 - RNA, 19 nt, Homo sapiens
ccacaggacuauuuggaua

SEQ ID NO: 1179940 - RNA, 19 nt, Homo sapiens
gaaugcagguagauaauau

SEQ ID NO: 1179941 - RNA, 19 nt, Homo sapiens
uaucugagguggcauaauu

SEQ ID NO: 1179942 - RNA, 19 nt, Homo sapiens
gggaaggucauuuaauuua

SEQ ID NO: 1179943 - RNA, 19 nt, Homo sapiens
ggaauugccuugagacauc

SEQ ID NO: 1179944 - RNA, 19 nt, Homo sapiens
gaagauccaacccgaauaa

SEQ ID NO: 1179945 - RNA, 19 nt, Homo sapiens
gcucagcuaucauuguuaa

SEQ ID NO: 1179946 - RNA, 19 nt, Homo sapiens
ggauaaagcuagcauaaaa

SEQ ID NO: 1179947 - RNA, 19 nt, Homo sapiens
uaccuuaccucaugcaaua

SEQ ID NO: 1179948 - RNA, 19 nt, Homo sapiens
gaaaugguacuguccacua

SEQ ID NO: 1179949 - RNA, 19 nt, Homo sapiens
uaauguaccuuaccucaug

SEQ ID NO: 1179950 - RNA, 19 nt, Homo sapiens
acauacagcuuacaucuug

SEQ ID NO: 1179951 - RNA, 19 nt, Homo sapiens
caaauuaaugcgcauagua

SEQ ID NO: 1179952 - RNA, 19 nt, Homo sapiens
uagagaaugugaagaaaug

SEQ ID NO: 1179953 - RNA, 19 nt, Homo sapiens
cgaauaagauuagaagcuu

SEQ ID NO: 1179954 - RNA, 19 nt, Homo sapiens
uaagaaugcagguagauaa

SEQ ID NO: 1179955 - RNA, 19 nt, Homo sapiens
gugaagaaauguggaaaga

SEQ ID NO: 1179956 - RNA, 19 nt, Homo sapiens
gaagaagaacuuauuagag

SEQ ID NO: 1179957 - RNA, 19 nt, Homo sapiens
ggauaagaaugcagguaga

SEQ ID NO: 1179958 - RNA, 19 nt, Homo sapiens
gaacagcaacagauaaugg

SEQ ID NO: 1179959 - RNA, 19 nt, Homo sapiens
ggaaggucauuuaauuuac

SEQ ID NO: 1179960 - RNA, 19 nt, Homo sapiens
ccacuaaggagucaaagaa

SEQ ID NO: 1179961 - RNA, 19 nt, Homo sapiens
ggaugaacagcaacagaua

SEQ ID NO: 1179962 - RNA, 19 nt, Homo sapiens
uagaagcuuuccaucagua

SEQ ID NO: 1179963 - RNA, 19 nt, Homo sapiens
ugauaacacugcaugaaau

SEQ ID NO: 1179964 - RNA, 19 nt, Homo sapiens
gaaaagaagaguuccaaaa

SEQ ID NO: 1179965 - RNA, 19 nt, Homo sapiens
gaggcgaccuggaguuugu

SEQ ID NO: 1179966 - RNA, 19 nt, Homo sapiens
ugaagacguucucauaaca

SEQ ID NO: 1179967 - RNA, 19 nt, Homo sapiens
gacugaagacguucucaua

SEQ ID NO: 1179968 - RNA, 19 nt, Homo sapiens
aaacaauucccuugacuga

SEQ ID NO: 1179969 - RNA, 19 nt, Homo sapiens
gcaauauucuuuggauucu

SEQ ID NO: 1179970 - RNA, 19 nt, Homo sapiens
agugagugcuuuaguguuu

SEQ ID NO: 1179971 - RNA, 19 nt, Homo sapiens
caugugcugccaucuauua

SEQ ID NO: 1179972 - RNA, 19 nt, Homo sapiens
gauccaacccgaauaagau

SEQ ID NO: 1179973 - RNA, 19 nt, Homo sapiens
gaugaacagcaacagauaa

SEQ ID NO: 1179974 - RNA, 19 nt, Homo sapiens
aaaugguacuguccacuaa

SEQ ID NO: 1179975 - RNA, 19 nt, Homo sapiens
gugcugccaucuauuauuc

SEQ ID NO: 1179976 - RNA, 19 nt, Homo sapiens
caugaaauguuagagauuc

SEQ ID NO: 1179977 - RNA, 19 nt, Homo sapiens
guggaaagauauggaagaa

SEQ ID NO: 1179978 - RNA, 19 nt, Homo sapiens
ggaaucucuuaauguacua

SEQ ID NO: 1179979 - RNA, 19 nt, Homo sapiens
ucuagaggcuggagauuca

SEQ ID NO: 1179980 - RNA, 19 nt, Homo sapiens
ugagguggcauaauuuaaa

SEQ ID NO: 1179981 - RNA, 19 nt, Homo sapiens
gcaaauuaaugcgcauagu

SEQ ID NO: 1179982 - RNA, 19 nt, Homo sapiens
gcuggugcuucuuuauauu

SEQ ID NO: 1179983 - RNA, 19 nt, Homo sapiens
gaucugggugccaucauuu

SEQ ID NO: 1179984 - RNA, 19 nt, Homo sapiens
gauuagaagcuuuccauca

SEQ ID NO: 1179985 - RNA, 19 nt, Homo sapiens
uaauggaauugccuugaga

SEQ ID NO: 1179986 - RNA, 19 nt, Homo sapiens
guuaaaggaagacuuagaa

SEQ ID NO: 1179987 - RNA, 19 nt, Homo sapiens
acaauucccuugacugaag

SEQ ID NO: 1179988 - RNA, 19 nt, Homo sapiens
augggaaggucauuuaauu

SEQ ID NO: 1179989 - RNA, 19 nt, Homo sapiens
gaaauuauaaugggaaggu

SEQ ID NO: 1179990 - RNA, 19 nt, Homo sapiens
cagcuggugcuucuuuaua

SEQ ID NO: 1179991 - RNA, 19 nt, Homo sapiens
guaauggaauugccuugag

SEQ ID NO: 1179992 - RNA, 19 nt, Homo sapiens
cuaaggagucaaagaauga

SEQ ID NO: 1179993 - RNA, 19 nt, Homo sapiens
cugaaacacucaccgauuc

SEQ ID NO: 1179994 - RNA, 19 nt, Homo sapiens
cuacagaugugggagaugu

SEQ ID NO: 1179995 - RNA, 19 nt, Homo sapiens
ggauaguacuacagaugug

SEQ ID NO: 1179996 - RNA, 19 nt, Homo sapiens
gauaacacugcaugaaaug

SEQ ID NO: 1179997 - RNA, 19 nt, Homo sapiens
cgauucaaaugcucagcua

SEQ ID NO: 1179998 - RNA, 19 nt, Homo sapiens
ugugggagauguuacaaau

SEQ ID NO: 1179999 - RNA, 19 nt, Homo sapiens
gaaagauauggaagaaugu

SEQ ID NO: 1180000 - RNA, 19 nt, Homo sapiens
ugggagauguuacaaauac

SEQ ID NO: 1180001 - RNA, 19 nt, Homo sapiens
cacaaagcauauaucaaug

SEQ ID NO: 1180002 - RNA, 19 nt, Homo sapiens
gagcugcugcugcguaaug

SEQ ID NO: 1180003 - RNA, 19 nt, Homo sapiens
gcaugaaauguuagagauu

SEQ ID NO: 1180004 - RNA, 19 nt, Homo sapiens
guacuacacagugaauuga

SEQ ID NO: 1180005 - RNA, 19 nt, Homo sapiens
uggaagaaugucagaauaa

SEQ ID NO: 1180006 - RNA, 19 nt, Homo sapiens
ggaaccacaggacuauuug

SEQ ID NO: 1180007 - RNA, 19 nt, Homo sapiens
ucaagaaucaucuguaaac

SEQ ID NO: 1180008 - RNA, 19 nt, Homo sapiens
auggaagaaugucagaaua

SEQ ID NO: 1180009 - RNA, 19 nt, Homo sapiens
gaacuuauuagagaaugug

SEQ ID NO: 1180010 - RNA, 19 nt, Homo sapiens
ccagguuacauacagcuua

SEQ ID NO: 1180011 - RNA, 19 nt, Homo sapiens
gaauauaaggagaaacucu

SEQ ID NO: 1180012 - RNA, 19 nt, Homo sapiens
aaaggaagacuuagaaagg

SEQ ID NO: 1180013 - RNA, 19 nt, Homo sapiens
acuaaggagucaaagaaug

SEQ ID NO: 1180014 - RNA, 19 nt, Homo sapiens
ucacuuauuggaacugaaa

SEQ ID NO: 1180015 - RNA, 19 nt, Homo sapiens
uuaaugcgcauaguacuuu

SEQ ID NO: 1180016 - RNA, 19 nt, Homo sapiens
uaaaggaagacuuagaaag

SEQ ID NO: 1180017 - RNA, 19 nt, Homo sapiens
caugcaauauucuuuggau

SEQ ID NO: 1180018 - RNA, 19 nt, Homo sapiens
gaagcuuuccaucaguaaa

SEQ ID NO: 1180019 - RNA, 19 nt, Homo sapiens
gugguuggaugaacagcaa

SEQ ID NO: 1180020 - RNA, 19 nt, Homo sapiens
aagacguucucauaacauu

SEQ ID NO: 1180021 - RNA, 19 nt, Homo sapiens
gagauguuacaaauacuga

SEQ ID NO: 1180022 - RNA, 19 nt, Homo sapiens
uaauaucugagguggcaua

SEQ ID NO: 1180023 - RNA, 19 nt, Homo sapiens
acaggacuauuuggauaaa

SEQ ID NO: 1180024 - RNA, 19 nt, Homo sapiens
cagaagauccaacccgaau

SEQ ID NO: 1180025 - RNA, 19 nt, Homo sapiens
cuugagacauccagaagau

SEQ ID NO: 1180026 - RNA, 19 nt, Homo sapiens
gaagacguucucauaacau

SEQ ID NO: 1180027 - RNA, 19 nt, Homo sapiens
gagguggcauaauuuaaaa

SEQ ID NO: 1180028 - RNA, 19 nt, Homo sapiens
ugaaacaauucccuugacu

SEQ ID NO: 1180029 - RNA, 19 nt, Homo sapiens
agaaugcagguagauaaua

SEQ ID NO: 1180030 - RNA, 19 nt, Homo sapiens
uggaaccacaggacuauuu

SEQ ID NO: 1180031 - RNA, 19 nt, Homo sapiens
gaaacacucaccgauucaa

SEQ ID NO: 1180032 - RNA, 19 nt, Homo sapiens
ucugagguggcauaauuua

SEQ ID NO: 1180033 - RNA, 19 nt, Homo sapiens
uggaaucucuuaauguacu

SEQ ID NO: 1180034 - RNA, 19 nt, Homo sapiens
ggagauguuacaaauacug

SEQ ID NO: 1180035 - RNA, 19 nt, Homo sapiens
gcgcauaguacuuuuauug

SEQ ID NO: 1180036 - RNA, 19 nt, Homo sapiens
ggaaggcgcucgucaccau

SEQ ID NO: 1180037 - RNA, 19 nt, Homo sapiens
cuacaaaccucaccuucuc

SEQ ID NO: 1180038 - RNA, 19 nt, Homo sapiens
agaaugggacuaacacuga

SEQ ID NO: 1180039 - RNA, 19 nt, Homo sapiens
gacaaugccacaugcaaga

SEQ ID NO: 1180040 - RNA, 19 nt, Homo sapiens
ccauugcuguggaaagguu

SEQ ID NO: 1180041 - RNA, 19 nt, Homo sapiens
cuacaccacugugcucuuc

SEQ ID NO: 1180042 - RNA, 19 nt, Homo sapiens
caucaucuacggcuacuuc

SEQ ID NO: 1180043 - RNA, 19 nt, Homo sapiens
gugcagggcaugucugugu

SEQ ID NO: 1180044 - RNA, 19 nt, Homo sapiens
uggcuggccuucuucaaca

SEQ ID NO: 1180045 - RNA, 19 nt, Homo sapiens
caccuucuccuccuacuau

SEQ ID NO: 1180046 - RNA, 19 nt, Homo sapiens
ggccauugcuguggaaagg

SEQ ID NO: 1180047 - RNA, 19 nt, Homo sapiens
gcaguuggccccuaaguca

SEQ ID NO: 1180048 - RNA, 19 nt, Homo sapiens
gggcaacacccuggucugu

SEQ ID NO: 1180049 - RNA, 19 nt, Homo sapiens
gcacuggcuggccuucuuc

SEQ ID NO: 1180050 - RNA, 19 nt, Homo sapiens
aaugccacaugcaagauga

SEQ ID NO: 1180051 - RNA, 19 nt, Homo sapiens
gcuacaaaccucaccuucu

SEQ ID NO: 1180052 - RNA, 19 nt, Homo sapiens
gcuccuacccucucuacuc

SEQ ID NO: 1180053 - RNA, 19 nt, Homo sapiens
ucaagaaccggcacaugca

SEQ ID NO: 1180054 - RNA, 19 nt, Homo sapiens
gcucuucucgcacaucuac

SEQ ID NO: 1180055 - RNA, 19 nt, Homo sapiens
ccaacauguucauccucaa

SEQ ID NO: 1180056 - RNA, 19 nt, Homo sapiens
gugaggagcaccacuucau

SEQ ID NO: 1180057 - RNA, 19 nt, Homo sapiens
ggguggcccuucgacaaug

SEQ ID NO: 1180058 - RNA, 19 nt, Homo sapiens
aagaaccggcacaugcaua

SEQ ID NO: 1180059 - RNA, 19 nt, Homo sapiens
gcucaagaaccggcacaug

SEQ ID NO: 1180060 - RNA, 19 nt, Homo sapiens
ccuaugcgcucaucuuccu

SEQ ID NO: 1180061 - RNA, 19 nt, Homo sapiens
cgcacuggcuggccuucuu

SEQ ID NO: 1180062 - RNA, 19 nt, Homo sapiens
gcucaucguggucauguac

SEQ ID NO: 1180063 - RNA, 19 nt, Homo sapiens
gguggccauugcuguggaa

SEQ ID NO: 1180064 - RNA, 19 nt, Homo sapiens
ucacacugguggccauugc

SEQ ID NO: 1180065 - RNA, 19 nt, Homo sapiens
caacauguucauccucaac

SEQ ID NO: 1180066 - RNA, 19 nt, Homo sapiens
gaacaucugugucuuuauu

SEQ ID NO: 1180067 - RNA, 19 nt, Homo sapiens
ggaucaaguuuguagaaua

SEQ ID NO: 1180068 - RNA, 19 nt, Homo sapiens
ccaaguacauaauggauuu

SEQ ID NO: 1180069 - RNA, 19 nt, Homo sapiens
gaggaagucuccagaaaug

SEQ ID NO: 1180070 - RNA, 19 nt, Homo sapiens
gcagacauuucaagaacua

SEQ ID NO: 1180071 - RNA, 19 nt, Homo sapiens
uaugaaacaugaccaagua

SEQ ID NO: 1180072 - RNA, 19 nt, Homo sapiens
gaaacgagcaaaccugaaa

SEQ ID NO: 1180073 - RNA, 19 nt, Homo sapiens
ugacaaagccguccaaauc

SEQ ID NO: 1180074 - RNA, 19 nt, Homo sapiens
gaguggguaugagaaauua

SEQ ID NO: 1180075 - RNA, 19 nt, Homo sapiens
gagcagacauuucaagaac

SEQ ID NO: 1180076 - RNA, 19 nt, Homo sapiens
ggaaggaucccaugacaca

SEQ ID NO: 1180077 - RNA, 19 nt, Homo sapiens
aaaauaggcuugccacuuu

SEQ ID NO: 1180078 - RNA, 19 nt, Homo sapiens
ucaaaugcuuuacaucaga

SEQ ID NO: 1180079 - RNA, 19 nt, Homo sapiens
aauaugagaugccugaguu

SEQ ID NO: 1180080 - RNA, 19 nt, Homo sapiens
ccugaaagcuacucucuca

SEQ ID NO: 1180081 - RNA, 19 nt, Homo sapiens
ccaagaaccagucagauga

SEQ ID NO: 1180082 - RNA, 19 nt, Homo sapiens
gcucaaggguggaagcaau

SEQ ID NO: 1180083 - RNA, 19 nt, Homo sapiens
ccacauggacgcugaaguu

SEQ ID NO: 1180084 - RNA, 19 nt, Homo sapiens
gaagcaauaccaacagaga

SEQ ID NO: 1180085 - RNA, 19 nt, Homo sapiens
caaaugcuuuacaucagaa

SEQ ID NO: 1180086 - RNA, 19 nt, Homo sapiens
cugaacaucugugucuuua

SEQ ID NO: 1180087 - RNA, 19 nt, Homo sapiens
ggacuugggagcagacauu

SEQ ID NO: 1180088 - RNA, 19 nt, Homo sapiens
caagcaggaucaaguuugu

SEQ ID NO: 1180089 - RNA, 19 nt, Homo sapiens
ggccaaaggugccagaagu

SEQ ID NO: 1180090 - RNA, 19 nt, Homo sapiens
aaacaugaccaaguacaua

SEQ ID NO: 1180091 - RNA, 19 nt, Homo sapiens
ggcugccacuuuaauauaa

SEQ ID NO: 1180092 - RNA, 19 nt, Homo sapiens
guagucaaaugcuuuacau

SEQ ID NO: 1180093 - RNA, 19 nt, Homo sapiens
ggaguggguaugagaaauu

SEQ ID NO: 1180094 - RNA, 19 nt, Homo sapiens
cagcauauacugaagaaau

SEQ ID NO: 1180095 - RNA, 19 nt, Homo sapiens
cauggacgcugaaguugga

SEQ ID NO: 1180096 - RNA, 19 nt, Homo sapiens
gcaaccuggugcagcauau

SEQ ID NO: 1180097 - RNA, 19 nt, Homo sapiens
ggagcagacauuucaagaa

SEQ ID NO: 1180098 - RNA, 19 nt, Homo sapiens
cugaagaaauacuauggaa

SEQ ID NO: 1180099 - RNA, 19 nt, Homo sapiens
ccugaguucuccucggaua

SEQ ID NO: 1180100 - RNA, 19 nt, Homo sapiens
cgagcaaaccugaaagcua

SEQ ID NO: 1180101 - RNA, 19 nt, Homo sapiens
ggaagugucccuggaagga

SEQ ID NO: 1180102 - RNA, 19 nt, Homo sapiens
gauagcaccaugaggauuc

SEQ ID NO: 1180103 - RNA, 19 nt, Homo sapiens
gaaacaugaccaaguacau

SEQ ID NO: 1180104 - RNA, 19 nt, Homo sapiens
uuuccuagcuauccucuga

SEQ ID NO: 1180105 - RNA, 19 nt, Homo sapiens
ccaugaggauucugagcaa

SEQ ID NO: 1180106 - RNA, 19 nt, Homo sapiens
gccaagaaccagucagaug

SEQ ID NO: 1180107 - RNA, 19 nt, Homo sapiens
gaaaauaggcuugccacuu

SEQ ID NO: 1180108 - RNA, 19 nt, Homo sapiens
uucaagaacuaauccaaga

SEQ ID NO: 1180109 - RNA, 19 nt, Homo sapiens
gaaaacaguaugaaacaug

SEQ ID NO: 1180110 - RNA, 19 nt, Homo sapiens
gaccaagcaggaucaaguu

SEQ ID NO: 1180111 - RNA, 19 nt, Homo sapiens
ccaagcaggaucaaguuug

SEQ ID NO: 1180112 - RNA, 19 nt, Homo sapiens
ccacugaacaucugugucu

SEQ ID NO: 1180113 - RNA, 19 nt, Homo sapiens
gcuugccacuuucucuuau

SEQ ID NO: 1180114 - RNA, 19 nt, Homo sapiens
gcuccuggucccaauauga

SEQ ID NO: 1180115 - RNA, 19 nt, Homo sapiens
ggauggcaaccuucagcua

SEQ ID NO: 1180116 - RNA, 19 nt, Homo sapiens
acacugguuuccuagcuau

SEQ ID NO: 1180117 - RNA, 19 nt, Homo sapiens
uuaauuccaugguagucaa

SEQ ID NO: 1180118 - RNA, 19 nt, Homo sapiens
gccacuuucucuuauuuua

SEQ ID NO: 1180119 - RNA, 19 nt, Homo sapiens
gggagcagacauuucaaga

SEQ ID NO: 1180120 - RNA, 19 nt, Homo sapiens
gggaguggguaugagaaau

SEQ ID NO: 1180121 - RNA, 19 nt, Homo sapiens
cugcuuguauuuauuguag

SEQ ID NO: 1180122 - RNA, 19 nt, Homo sapiens
uggaagcaauaccaacaga

SEQ ID NO: 1180123 - RNA, 19 nt, Homo sapiens
caggaucaaguuuguagaa

SEQ ID NO: 1180124 - RNA, 19 nt, Homo sapiens
agucaaaugcuuuacauca

SEQ ID NO: 1180125 - RNA, 19 nt, Homo sapiens
guaugaaacaugaccaagu

SEQ ID NO: 1180126 - RNA, 19 nt, Homo sapiens
ggcuugccacuuucucuua

SEQ ID NO: 1180127 - RNA, 19 nt, Homo sapiens
gucaaaugcuuuacaucag

SEQ ID NO: 1180128 - RNA, 19 nt, Homo sapiens
aacaugaccaaguacauaa

SEQ ID NO: 1180129 - RNA, 19 nt, Homo sapiens
uugccacuuucucuuauuu

SEQ ID NO: 1180130 - RNA, 19 nt, Homo sapiens
ucgcaaaccaagccaagaa

SEQ ID NO: 1180131 - RNA, 19 nt, Homo sapiens
gguggaagcaauaccaaca

SEQ ID NO: 1180132 - RNA, 19 nt, Homo sapiens
caaccuggugcagcauaua

SEQ ID NO: 1180133 - RNA, 19 nt, Homo sapiens
ggauagcaccaugaggauu

SEQ ID NO: 1180134 - RNA, 19 nt, Homo sapiens
aaauaggcuugccacuuuc

SEQ ID NO: 1180135 - RNA, 19 nt, Homo sapiens
gcuuguauuuauuguaguc

SEQ ID NO: 1180136 - RNA, 19 nt, Homo sapiens
cuccagaaaugccaguaau

SEQ ID NO: 1180137 - RNA, 19 nt, Homo sapiens
gaccaaguacauaauggau

SEQ ID NO: 1180138 - RNA, 19 nt, Homo sapiens
uggaauuggugcuguguac

SEQ ID NO: 1180139 - RNA, 19 nt, Homo sapiens
agaccaagcaggaucaagu

SEQ ID NO: 1180140 - RNA, 19 nt, Homo sapiens
cuggaaggaucccaugaca

SEQ ID NO: 1180141 - RNA, 19 nt, Homo sapiens
guuguagauuucuggacuu

SEQ ID NO: 1180142 - RNA, 19 nt, Homo sapiens
gaagugucccuggaaggau

SEQ ID NO: 1180143 - RNA, 19 nt, Homo sapiens
ugcagcauauacugaagaa

SEQ ID NO: 1180144 - RNA, 19 nt, Homo sapiens
agacccagauccacugaac

SEQ ID NO: 1180145 - RNA, 19 nt, Homo sapiens
ccgccaaguugcagauucu

SEQ ID NO: 1180146 - RNA, 19 nt, Homo sapiens
ugaccaaguacauaaugga

SEQ ID NO: 1180147 - RNA, 19 nt, Homo sapiens
caugaccaaguacauaaug

SEQ ID NO: 1180148 - RNA, 19 nt, Homo sapiens
uccuagcuauccucugaaa

SEQ ID NO: 1180149 - RNA, 19 nt, Homo sapiens
gacaaagccguccaaaucc

SEQ ID NO: 1180150 - RNA, 19 nt, Homo sapiens
gugcguaugaggcucuuug

SEQ ID NO: 1180151 - RNA, 19 nt, Homo sapiens
ugaaacaugaccaaguaca

SEQ ID NO: 1180152 - RNA, 19 nt, Homo sapiens
aacacugguuuccuagcua

SEQ ID NO: 1180153 - RNA, 19 nt, Homo sapiens
gcaggaucaaguuuguaga

SEQ ID NO: 1180154 - RNA, 19 nt, Homo sapiens
ccagucagaugaggcaaaa

SEQ ID NO: 1180155 - RNA, 19 nt, Homo sapiens
caagaaccagucagaugag

SEQ ID NO: 1180156 - RNA, 19 nt, Homo sapiens
caaaccaagccaagaacca

SEQ ID NO: 1180157 - RNA, 19 nt, Homo sapiens
agagagcauuuggcugguu

SEQ ID NO: 1180158 - RNA, 19 nt, Homo sapiens
gcaagucgcuggaugguuu

SEQ ID NO: 1180159 - RNA, 19 nt, Homo sapiens
ccaaagcuguccaaauuua

SEQ ID NO: 1180160 - RNA, 19 nt, Homo sapiens
aaccaaagcuguccaaauu

SEQ ID NO: 1180161 - RNA, 19 nt, Homo sapiens
ccacugcccugcuaacuuu

SEQ ID NO: 1180162 - RNA, 19 nt, Homo sapiens
gauccacguugacauuuaa

SEQ ID NO: 1180163 - RNA, 19 nt, Homo sapiens
ggauccacguugacauuua

SEQ ID NO: 1180164 - RNA, 19 nt, Homo sapiens
gaugguuuauuaccugaaa

SEQ ID NO: 1180165 - RNA, 19 nt, Homo sapiens
ggaccaaccugacuuucca

SEQ ID NO: 1180166 - RNA, 19 nt, Homo sapiens
gcaaggaggagcagcagaa

SEQ ID NO: 1180167 - RNA, 19 nt, Homo sapiens
ccauguaccuguuccauag

SEQ ID NO: 1180168 - RNA, 19 nt, Homo sapiens
gucgcuggaugguuuauua

SEQ ID NO: 1180169 - RNA, 19 nt, Homo sapiens
caacuaccuucuccaggaa

SEQ ID NO: 1180170 - RNA, 19 nt, Homo sapiens
ccugaacguugucacauaa

SEQ ID NO: 1180171 - RNA, 19 nt, Homo sapiens
caaccugacuuuccacuac

SEQ ID NO: 1180172 - RNA, 19 nt, Homo sapiens
gauggugucucuccuccuu

SEQ ID NO: 1180173 - RNA, 19 nt, Homo sapiens
gcagaaggaguacagauuc

SEQ ID NO: 1180174 - RNA, 19 nt, Homo sapiens
gccugaacguugucacaua

SEQ ID NO: 1180175 - RNA, 19 nt, Homo sapiens
cgagaaguguuacucuuuc

SEQ ID NO: 1180176 - RNA, 19 nt, Homo sapiens
gacauggaaugccagcaaa

SEQ ID NO: 1180177 - RNA, 19 nt, Homo sapiens
gauggcaggugcagagcaa

SEQ ID NO: 1180178 - RNA, 19 nt, Homo sapiens
gaaauuauggagagugaag

SEQ ID NO: 1180179 - RNA, 19 nt, Homo sapiens
gaguacagauucagaucau

SEQ ID NO: 1180180 - RNA, 19 nt, Homo sapiens
ugaaggcuauggaggaugu

SEQ ID NO: 1180181 - RNA, 19 nt, Homo sapiens
gaaggaguacagauucaga

SEQ ID NO: 1180182 - RNA, 19 nt, Homo sapiens
acacaccacugucaaaguc

SEQ ID NO: 1180183 - RNA, 19 nt, Homo sapiens
cagaaggaguacagauuca

SEQ ID NO: 1180184 - RNA, 19 nt, Homo sapiens
caacgccucccaaaccaaa

SEQ ID NO: 1180185 - RNA, 19 nt, Homo sapiens
gaagucuccacgccaauga

SEQ ID NO: 1180186 - RNA, 19 nt, Homo sapiens
uauggagagugaagaaguu

SEQ ID NO: 1180187 - RNA, 19 nt, Homo sapiens
uggaaauuauggagaguga

SEQ ID NO: 1180188 - RNA, 19 nt, Homo sapiens
caacggugaugaggccuau

SEQ ID NO: 1180189 - RNA, 19 nt, Homo sapiens
gcaaauacuccaggaccaa

SEQ ID NO: 1180190 - RNA, 19 nt, Homo sapiens
cauggaaugccagcaaaua

SEQ ID NO: 1180191 - RNA, 19 nt, Homo sapiens
gccgagaaguguuacucuu

SEQ ID NO: 1180192 - RNA, 19 nt, Homo sapiens
agacgacauucucuauuuc

SEQ ID NO: 1180193 - RNA, 19 nt, Homo sapiens
guggggagcugccgucuuu

SEQ ID NO: 1180194 - RNA, 19 nt, Homo sapiens
ccacguugacauuuaaaga

SEQ ID NO: 1180195 - RNA, 19 nt, Homo sapiens
gcuccuacguggcguugug

SEQ ID NO: 1180196 - RNA, 19 nt, Homo sapiens
ggaguacagauucagauca

SEQ ID NO: 1180197 - RNA, 19 nt, Homo sapiens
ccgagaaguguuacucuuu

SEQ ID NO: 1180198 - RNA, 19 nt, Homo sapiens
ggugaaggcuauggaggau

SEQ ID NO: 1180199 - RNA, 19 nt, Homo sapiens
caaagcuguccaaauuuau

SEQ ID NO: 1180200 - RNA, 19 nt, Homo sapiens
aaaccaaagcuguccaaau

SEQ ID NO: 1180201 - RNA, 19 nt, Homo sapiens
ccaaaaugcuguaaaacca

SEQ ID NO: 1180202 - RNA, 19 nt, Homo sapiens
ggaagucuccacgccaaug

SEQ ID NO: 1180203 - RNA, 19 nt, Homo sapiens
guugacauuuaaagacaga

SEQ ID NO: 1180204 - RNA, 19 nt, Homo sapiens
caggauccacguugacauu

SEQ ID NO: 1180205 - RNA, 19 nt, Homo sapiens
gcagugacggugacguguu

SEQ ID NO: 1180206 - RNA, 19 nt, Homo sapiens
ugacauggaaugccagcaa

SEQ ID NO: 1180207 - RNA, 19 nt, Homo sapiens
ugacuuuccacuacagauu

SEQ ID NO: 1180208 - RNA, 19 nt, Homo sapiens
cagugacggugacguguuc

SEQ ID NO: 1180209 - RNA, 19 nt, Homo sapiens
ggacuaggagacucugaag

SEQ ID NO: 1180210 - RNA, 19 nt, Homo sapiens
ggaaugccagcaaauacuc

SEQ ID NO: 1180211 - RNA, 19 nt, Homo sapiens
gcaggugcagagcaagaaa

SEQ ID NO: 1180212 - RNA, 19 nt, Homo sapiens
gcagaugggagccaauugc

SEQ ID NO: 1180213 - RNA, 19 nt, Homo sapiens
gaucacagacacccagaac

SEQ ID NO: 1180214 - RNA, 19 nt, Homo sapiens
ggaugccugugcagagaca

SEQ ID NO: 1180215 - RNA, 19 nt, Homo sapiens
ucacagacacccagaacgu

SEQ ID NO: 1180216 - RNA, 19 nt, Homo sapiens
cuacuucaauuuagaaacc

SEQ ID NO: 1180217 - RNA, 19 nt, Homo sapiens
ccuucugucuuuauggaaa

SEQ ID NO: 1180218 - RNA, 19 nt, Homo sapiens
cguccaaaaugcuguaaaa

SEQ ID NO: 1180219 - RNA, 19 nt, Homo sapiens
cgggaugccugugcagaga

SEQ ID NO: 1180220 - RNA, 19 nt, Homo sapiens
ggcuauggaggauguauau

SEQ ID NO: 1180221 - RNA, 19 nt, Homo sapiens
uggaugccgagaaguguua

SEQ ID NO: 1180222 - RNA, 19 nt, Homo sapiens
ccugcaacgucaccauaga

SEQ ID NO: 1180223 - RNA, 19 nt, Homo sapiens
caagucgcuggaugguuua

SEQ ID NO: 1180224 - RNA, 19 nt, Homo sapiens
guaguccaguuggccaaga

SEQ ID NO: 1180225 - RNA, 19 nt, Homo sapiens
guaccuguuccauagcauu

SEQ ID NO: 1180226 - RNA, 19 nt, Homo sapiens
gggucagggugaaggcuau

SEQ ID NO: 1180227 - RNA, 19 nt, Homo sapiens
caccauagaaggcuuggau

SEQ ID NO: 1180228 - RNA, 19 nt, Homo sapiens
aggagcagcagaaggagua

SEQ ID NO: 1180229 - RNA, 19 nt, Homo sapiens
augagucucuguguucaaa

SEQ ID NO: 1180230 - RNA, 19 nt, Homo sapiens
cuacggggaucuccucuau

SEQ ID NO: 1180231 - RNA, 19 nt, Homo sapiens
ccgugcaggugacauggaa

SEQ ID NO: 1180232 - RNA, 19 nt, Homo sapiens
gagucucuguguucaaagg

SEQ ID NO: 1180233 - RNA, 19 nt, Homo sapiens
acaccacugucaaagucaa

SEQ ID NO: 1180234 - RNA, 19 nt, Homo sapiens
ugaaugaccgcuccuacgu

SEQ ID NO: 1180235 - RNA, 19 nt, Homo sapiens
caaggcagcacguccaaaa

SEQ ID NO: 1180236 - RNA, 19 nt, Homo sapiens
ugaacguugucacauaaac

SEQ ID NO: 1180237 - RNA, 19 nt, Homo sapiens
aggaggagcagcagaagga

SEQ ID NO: 1180238 - RNA, 19 nt, Homo sapiens
ccaaugaugguaggacuag

SEQ ID NO: 1180239 - RNA, 19 nt, Homo sapiens
uggcccaccuccacaagau

SEQ ID NO: 1180240 - RNA, 19 nt, Homo sapiens
ccgaguggcaguccaaaca

SEQ ID NO: 1180241 - RNA, 19 nt, Homo sapiens
uuucgugccugaacguugu

SEQ ID NO: 1180242 - RNA, 19 nt, Homo sapiens
cagcgugccagacccgaaa

SEQ ID NO: 1180243 - RNA, 19 nt, Homo sapiens
gagcagcgagacgacauuc

SEQ ID NO: 1180244 - RNA, 19 nt, Homo sapiens
uaccugcaacgucaccaua

SEQ ID NO: 1180245 - RNA, 19 nt, Homo sapiens
ccaaaccaaagcuguccaa

SEQ ID NO: 1180246 - RNA, 19 nt, Homo sapiens
gacaccaacgccucccaaa

SEQ ID NO: 1180247 - RNA, 19 nt, Homo sapiens
gcuuggaugccgagaagug

SEQ ID NO: 1180248 - RNA, 19 nt, Homo sapiens
ccagugcaccaacuaccuu

SEQ ID NO: 1180249 - RNA, 19 nt, Homo sapiens
gcucggagauggugaaaua

SEQ ID NO: 1180250 - RNA, 19 nt, Homo sapiens
gcaaugaguuagcaguaua

SEQ ID NO: 1180251 - RNA, 19 nt, Homo sapiens
gaacucagcaguaugauga

SEQ ID NO: 1180252 - RNA, 19 nt, Homo sapiens
gaagaaagacuggcaugua

SEQ ID NO: 1180253 - RNA, 19 nt, Homo sapiens
gaacuacuguccugaguca

SEQ ID NO: 1180254 - RNA, 19 nt, Homo sapiens
gaacagauuaugcaacauu

SEQ ID NO: 1180255 - RNA, 19 nt, Homo sapiens
guagaaaucgugugacuuu

SEQ ID NO: 1180256 - RNA, 19 nt, Homo sapiens
cgaagaggcuuauuaugga

SEQ ID NO: 1180257 - RNA, 19 nt, Homo sapiens
gaaggaaggcuguacuuug

SEQ ID NO: 1180258 - RNA, 19 nt, Homo sapiens
gaagaagagucccaucaca

SEQ ID NO: 1180259 - RNA, 19 nt, Homo sapiens
gaagaggcuuauuauggaa

SEQ ID NO: 1180260 - RNA, 19 nt, Homo sapiens
gaaaucgugugacuuuaag

SEQ ID NO: 1180261 - RNA, 19 nt, Homo sapiens
gcaguaugaugaucugguu

SEQ ID NO: 1180262 - RNA, 19 nt, Homo sapiens
aaggaaggcuguacuuuga

SEQ ID NO: 1180263 - RNA, 19 nt, Homo sapiens
ugaaggaacucagcaguau

SEQ ID NO: 1180264 - RNA, 19 nt, Homo sapiens
ggaaggcuguacuuugaug

SEQ ID NO: 1180265 - RNA, 19 nt, Homo sapiens
gcgagggucuuauuucugu

SEQ ID NO: 1180266 - RNA, 19 nt, Homo sapiens
uugcuuagcuauuugagua

SEQ ID NO: 1180267 - RNA, 19 nt, Homo sapiens
gaagcaaccuggaaaucag

SEQ ID NO: 1180268 - RNA, 19 nt, Homo sapiens
guacuuugaugguuugaag

SEQ ID NO: 1180269 - RNA, 19 nt, Homo sapiens
ggaaggaaggcuguacuuu

SEQ ID NO: 1180270 - RNA, 19 nt, Homo sapiens
cagcagcgauaucucaguu

SEQ ID NO: 1180271 - RNA, 19 nt, Homo sapiens
gauggaagaacuuuguauu

SEQ ID NO: 1180272 - RNA, 19 nt, Homo sapiens
uggccaaacugcauaagaa

SEQ ID NO: 1180273 - RNA, 19 nt, Homo sapiens
caaaguaucauuuccucuu

SEQ ID NO: 1180274 - RNA, 19 nt, Homo sapiens
acacuuacauccugaucaa

SEQ ID NO: 1180275 - RNA, 19 nt, Homo sapiens
gcauguaccuucauuugcu

SEQ ID NO: 1180276 - RNA, 19 nt, Homo sapiens
cgugugacuuuaaggauuu

SEQ ID NO: 1180277 - RNA, 19 nt, Homo sapiens
gauugggucuguuaaugau

SEQ ID NO: 1180278 - RNA, 19 nt, Homo sapiens
ucacaccaauccaccagaa

SEQ ID NO: 1180279 - RNA, 19 nt, Homo sapiens
uagaaaucgugugacuuua

SEQ ID NO: 1180280 - RNA, 19 nt, Homo sapiens
cuacuguccugagucauaa

SEQ ID NO: 1180281 - RNA, 19 nt, Homo sapiens
uauccgaagaggcuuauua

SEQ ID NO: 1180282 - RNA, 19 nt, Homo sapiens
gugcaacccucaaaguauc

SEQ ID NO: 1180283 - RNA, 19 nt, Homo sapiens
gagauggugaaauacguua

SEQ ID NO: 1180284 - RNA, 19 nt, Homo sapiens
agaaaucgugugacuuuaa

SEQ ID NO: 1180285 - RNA, 19 nt, Homo sapiens
gggcgagggucuuauuucu

SEQ ID NO: 1180286 - RNA, 19 nt, Homo sapiens
gcagcgauaucucaguuac

SEQ ID NO: 1180287 - RNA, 19 nt, Homo sapiens
aagaaagacuggcauguac

SEQ ID NO: 1180288 - RNA, 19 nt, Homo sapiens
uaaaugagauuggucuacu

SEQ ID NO: 1180289 - RNA, 19 nt, Homo sapiens
ccaauccaccagaauauga

SEQ ID NO: 1180290 - RNA, 19 nt, Homo sapiens
acaccaauccaccagaaua

SEQ ID NO: 1180291 - RNA, 19 nt, Homo sapiens
gauccugggccuuaucuau

SEQ ID NO: 1180292 - RNA, 19 nt, Homo sapiens
ccgaagaggcuuauuaugg

SEQ ID NO: 1180293 - RNA, 19 nt, Homo sapiens
gcaagcaccacacuuacau

SEQ ID NO: 1180294 - RNA, 19 nt, Homo sapiens
cuggcacacuuaauaaauu

SEQ ID NO: 1180295 - RNA, 19 nt, Homo sapiens
uguccugagucauaaguaa

SEQ ID NO: 1180296 - RNA, 19 nt, Homo sapiens
ggaaaucagcaagauggaa

SEQ ID NO: 1180297 - RNA, 19 nt, Homo sapiens
gcaccugccugcccgaaaa

SEQ ID NO: 1180298 - RNA, 19 nt, Homo sapiens
ggugcaacccucaaaguau

SEQ ID NO: 1180299 - RNA, 19 nt, Homo sapiens
gcuguacuuugaugguuug

SEQ ID NO: 1180300 - RNA, 19 nt, Homo sapiens
cgaagcaaccuggaaauca

SEQ ID NO: 1180301 - RNA, 19 nt, Homo sapiens
uugaacagauuaugcaaca

SEQ ID NO: 1180302 - RNA, 19 nt, Homo sapiens
ccaaacugcauaagaagga

SEQ ID NO: 1180303 - RNA, 19 nt, Homo sapiens
uacccuggcacacuuaaua

SEQ ID NO: 1180304 - RNA, 19 nt, Homo sapiens
gaguuuugcugguuuugua

SEQ ID NO: 1180305 - RNA, 19 nt, Homo sapiens
caaacugcauaagaaggaa

SEQ ID NO: 1180306 - RNA, 19 nt, Homo sapiens
ggagauggugaaauacguu

SEQ ID NO: 1180307 - RNA, 19 nt, Homo sapiens
gaaggaacucagcaguaug

SEQ ID NO: 1180308 - RNA, 19 nt, Homo sapiens
ggcuguacuuugaugguuu

SEQ ID NO: 1180309 - RNA, 19 nt, Homo sapiens
agacuggcauguaccuuca

SEQ ID NO: 1180310 - RNA, 19 nt, Homo sapiens
uggcggaguuggugcaguu

SEQ ID NO: 1180311 - RNA, 19 nt, Homo sapiens
ugaaagacaagaagaagag

SEQ ID NO: 1180312 - RNA, 19 nt, Homo sapiens
ggcuuauuauggaagauuu

SEQ ID NO: 1180313 - RNA, 19 nt, Homo sapiens
gagcaucugcgguaugucu

SEQ ID NO: 1180314 - RNA, 19 nt, Homo sapiens
ggauggaagaacuuuguau

SEQ ID NO: 1180315 - RNA, 19 nt, Homo sapiens
uaaaauggauggaagaacu

SEQ ID NO: 1180316 - RNA, 19 nt, Homo sapiens
aaggaacucagcaguauga

SEQ ID NO: 1180317 - RNA, 19 nt, Homo sapiens
ugcgguaugucuuugguuu

SEQ ID NO: 1180318 - RNA, 19 nt, Homo sapiens
ggaacucagcaguaugaug

SEQ ID NO: 1180319 - RNA, 19 nt, Homo sapiens
aaaugagauuggucuacuu

SEQ ID NO: 1180320 - RNA, 19 nt, Homo sapiens
caucugcgguaugucuuug

SEQ ID NO: 1180321 - RNA, 19 nt, Homo sapiens
ucgugugacuuuaaggauu

SEQ ID NO: 1180322 - RNA, 19 nt, Homo sapiens
gugaaagacaagaagaaga

SEQ ID NO: 1180323 - RNA, 19 nt, Homo sapiens
aguauacccuggcacacuu

SEQ ID NO: 1180324 - RNA, 19 nt, Homo sapiens
uggcauguaccuucauuug

SEQ ID NO: 1180325 - RNA, 19 nt, Homo sapiens
gcaucugcgguaugucuuu

SEQ ID NO: 1180326 - RNA, 19 nt, Homo sapiens
aaugagauuggucuacuuu

SEQ ID NO: 1180327 - RNA, 19 nt, Homo sapiens
guauacccuggcacacuua

SEQ ID NO: 1180328 - RNA, 19 nt, Homo sapiens
caaagcucccgcugccauu

SEQ ID NO: 1180329 - RNA, 19 nt, Homo sapiens
cauguaccuucauuugcuu

SEQ ID NO: 1180330 - RNA, 19 nt, Homo sapiens
ccuguaggauuuuauugua

SEQ ID NO: 1180331 - RNA, 19 nt, Homo sapiens
cuauuugaguaucuagaga

SEQ ID NO: 1180332 - RNA, 19 nt, Homo sapiens
ucauuugcuuagcuauuug

SEQ ID NO: 1180333 - RNA, 19 nt, Homo sapiens
cagauuaugcaacauugga

SEQ ID NO: 1180334 - RNA, 19 nt, Homo sapiens
aacagauuaugcaacauug

SEQ ID NO: 1180335 - RNA, 19 nt, Homo sapiens
acuacuguccugagucaua

SEQ ID NO: 1180336 - RNA, 19 nt, Homo sapiens
gaggguuggugaaaaguug

SEQ ID NO: 1180337 - RNA, 19 nt, Homo sapiens
caccaauccaccagaauau

SEQ ID NO: 1180338 - RNA, 19 nt, Homo sapiens
gugcagcagcgauaucuca

SEQ ID NO: 1180339 - RNA, 19 nt, Homo sapiens
gaaagacuggcauguaccu

SEQ ID NO: 1180340 - RNA, 19 nt, Homo sapiens
uccugggccuuaucuauau

SEQ ID NO: 1180341 - RNA, 19 nt, Homo sapiens
uugggucuguuaaugauga

SEQ ID NO: 1180342 - RNA, 19 nt, Homo sapiens
agauugggucuguuaauga

SEQ ID NO: 1180343 - RNA, 19 nt, Homo sapiens
aagaagaagagucccauca

SEQ ID NO: 1180344 - RNA, 19 nt, Homo sapiens
gcaguuccuccuggugaaa

SEQ ID NO: 1180345 - RNA, 19 nt, Homo sapiens
caauccaccagaauaugaa

SEQ ID NO: 1180346 - RNA, 19 nt, Homo sapiens
auacguuauuggagacuug

SEQ ID NO: 1180347 - RNA, 19 nt, Homo sapiens
ugcaaugaguuagcaguau

SEQ ID NO: 1180348 - RNA, 19 nt, Homo sapiens
gaaagacaagaagaagagu

SEQ ID NO: 1180349 - RNA, 19 nt, Homo sapiens
gcacauagagacuuaauuu

SEQ ID NO: 1180350 - RNA, 19 nt, Homo sapiens
gaaaauagaugaugcagaa

SEQ ID NO: 1180351 - RNA, 19 nt, Homo sapiens
ggaggaacguucaagaaga

SEQ ID NO: 1180352 - RNA, 19 nt, Homo sapiens
gaaagaagccucaauuuug

SEQ ID NO: 1180353 - RNA, 19 nt, Homo sapiens
acaaauaagugaacaagga

SEQ ID NO: 1180354 - RNA, 19 nt, Homo sapiens
gaggaacguucaagaagaa

SEQ ID NO: 1180355 - RNA, 19 nt, Homo sapiens
gcaggaugcugagugauuu

SEQ ID NO: 1180356 - RNA, 19 nt, Homo sapiens
ggagacugcuauucaagaa

SEQ ID NO: 1180357 - RNA, 19 nt, Homo sapiens
gcacaguuacacuuaauaa

SEQ ID NO: 1180358 - RNA, 19 nt, Homo sapiens
cuaaagcuguggccuguaa

SEQ ID NO: 1180359 - RNA, 19 nt, Homo sapiens
agaaaucucugauaaugga

SEQ ID NO: 1180360 - RNA, 19 nt, Homo sapiens
caaggagacugcuauucaa

SEQ ID NO: 1180361 - RNA, 19 nt, Homo sapiens
gcaaaugcuuuagaaaucu

SEQ ID NO: 1180362 - RNA, 19 nt, Homo sapiens
ccugagaucuggaagaaau

SEQ ID NO: 1180363 - RNA, 19 nt, Homo sapiens
gaguacaccugcagucaau

SEQ ID NO: 1180364 - RNA, 19 nt, Homo sapiens
ggaaagaagccucaauuuu

SEQ ID NO: 1180365 - RNA, 19 nt, Homo sapiens
agaauaacaugguugacaa

SEQ ID NO: 1180366 - RNA, 19 nt, Homo sapiens
caucagcuauggaucauca

SEQ ID NO: 1180367 - RNA, 19 nt, Homo sapiens
gggaaagaagccucaauuu

SEQ ID NO: 1180368 - RNA, 19 nt, Homo sapiens
ucuaucgugucaaauguua

SEQ ID NO: 1180369 - RNA, 19 nt, Homo sapiens
gcauauuuguuacguaaag

SEQ ID NO: 1180370 - RNA, 19 nt, Homo sapiens
aauagaugaugcagaauug

SEQ ID NO: 1180371 - RNA, 19 nt, Homo sapiens
gaacguucaagaagaaaga

SEQ ID NO: 1180372 - RNA, 19 nt, Homo sapiens
caacuugccauugagauuu

SEQ ID NO: 1180373 - RNA, 19 nt, Homo sapiens
guacaccugcagucaauaa

SEQ ID NO: 1180374 - RNA, 19 nt, Homo sapiens
ugucaaggauccaugcauu

SEQ ID NO: 1180375 - RNA, 19 nt, Homo sapiens
ucaaggagacugcuauuca

SEQ ID NO: 1180376 - RNA, 19 nt, Homo sapiens
gaauaacaugguugacaaa

SEQ ID NO: 1180377 - RNA, 19 nt, Homo sapiens
gcgaagaccacacggaaga

SEQ ID NO: 1180378 - RNA, 19 nt, Homo sapiens
caaauauucugagccuaga

SEQ ID NO: 1180379 - RNA, 19 nt, Homo sapiens
gagaacaacaacagccaaa

SEQ ID NO: 1180380 - RNA, 19 nt, Homo sapiens
gaaauguaaaugucugugu

SEQ ID NO: 1180381 - RNA, 19 nt, Homo sapiens
ugcaaaugcuuuagaaauc

SEQ ID NO: 1180382 - RNA, 19 nt, Homo sapiens
acauugggcugcacauaga

SEQ ID NO: 1180383 - RNA, 19 nt, Homo sapiens
augaaucugugaucaauug

SEQ ID NO: 1180384 - RNA, 19 nt, Homo sapiens
guuaaugaaucugugauca

SEQ ID NO: 1180385 - RNA, 19 nt, Homo sapiens
gcuguggccuguaaucuac

SEQ ID NO: 1180386 - RNA, 19 nt, Homo sapiens
gaugcugagugauuugugu

SEQ ID NO: 1180387 - RNA, 19 nt, Homo sapiens
ugucaguacagcuauaaua

SEQ ID NO: 1180388 - RNA, 19 nt, Homo sapiens
gcaccaagaaauccagaau

SEQ ID NO: 1180389 - RNA, 19 nt, Homo sapiens
aagaguagcuacauacacu

SEQ ID NO: 1180390 - RNA, 19 nt, Homo sapiens
caagcuuguuaacaucaaa

SEQ ID NO: 1180391 - RNA, 19 nt, Homo sapiens
cgugucaaauguuaaugaa

SEQ ID NO: 1180392 - RNA, 19 nt, Homo sapiens
gaugcagaauugaaacaag

SEQ ID NO: 1180393 - RNA, 19 nt, Homo sapiens
ggcugcacauagagacuua

SEQ ID NO: 1180394 - RNA, 19 nt, Homo sapiens
ccuccucacuacccuauau

SEQ ID NO: 1180395 - RNA, 19 nt, Homo sapiens
gaucaucaacggcaauuuu

SEQ ID NO: 1180396 - RNA, 19 nt, Homo sapiens
ggaagaguagcuacauaca

SEQ ID NO: 1180397 - RNA, 19 nt, Homo sapiens
gcagaauugaaacaagaaa

SEQ ID NO: 1180398 - RNA, 19 nt, Homo sapiens
caaauaagugaacaaggau

SEQ ID NO: 1180399 - RNA, 19 nt, Homo sapiens
gauaauggagagagagaca

SEQ ID NO: 1180400 - RNA, 19 nt, Homo sapiens
acggaagaguagcuacaua

SEQ ID NO: 1180401 - RNA, 19 nt, Homo sapiens
ccuggagccugucccuaaa

SEQ ID NO: 1180402 - RNA, 19 nt, Homo sapiens
aaacauugggcugcacaua

SEQ ID NO: 1180403 - RNA, 19 nt, Homo sapiens
acauacacuucaucagcua

SEQ ID NO: 1180404 - RNA, 19 nt, Homo sapiens
gggaggaacguucaagaag

SEQ ID NO: 1180405 - RNA, 19 nt, Homo sapiens
ccaacuugccauugagauu

SEQ ID NO: 1180406 - RNA, 19 nt, Homo sapiens
guaaaugucuguguaaaac

SEQ ID NO: 1180407 - RNA, 19 nt, Homo sapiens
cagaagagcacccugaaaa

SEQ ID NO: 1180408 - RNA, 19 nt, Homo sapiens
gcuuuagaaaucucugaua

SEQ ID NO: 1180409 - RNA, 19 nt, Homo sapiens
caaaugcuuuagaaaucuc

SEQ ID NO: 1180410 - RNA, 19 nt, Homo sapiens
augcagaauugaaacaaga

SEQ ID NO: 1180411 - RNA, 19 nt, Homo sapiens
gaaucugugaucaauugaa

SEQ ID NO: 1180412 - RNA, 19 nt, Homo sapiens
cagaauaacaugguugaca

SEQ ID NO: 1180413 - RNA, 19 nt, Homo sapiens
uggcacaguuacacuuaau

SEQ ID NO: 1180414 - RNA, 19 nt, Homo sapiens
guagcuacauacacuucau

SEQ ID NO: 1180415 - RNA, 19 nt, Homo sapiens
ucaagcuuguuaacaucaa

SEQ ID NO: 1180416 - RNA, 19 nt, Homo sapiens
gccagaauaacaugguuga

SEQ ID NO: 1180417 - RNA, 19 nt, Homo sapiens
uagaugaugcagaauugaa

SEQ ID NO: 1180418 - RNA, 19 nt, Homo sapiens
agacugcuauucaagaaaa

SEQ ID NO: 1180419 - RNA, 19 nt, Homo sapiens
ccucacuacccuauauaaa

SEQ ID NO: 1180420 - RNA, 19 nt, Homo sapiens
ucaaggauccaugcauuca

SEQ ID NO: 1180421 - RNA, 19 nt, Homo sapiens
gaagaguagcuacauacac

SEQ ID NO: 1180422 - RNA, 19 nt, Homo sapiens
gagacugcuauucaagaaa

SEQ ID NO: 1180423 - RNA, 19 nt, Homo sapiens
ucugcaggaugcugaguga

SEQ ID NO: 1180424 - RNA, 19 nt, Homo sapiens
gaacaacaacagccaaaag

SEQ ID NO: 1180425 - RNA, 19 nt, Homo sapiens
gcauucaccaugugccaau

SEQ ID NO: 1180426 - RNA, 19 nt, Homo sapiens
gcugagugauuugugucaa

SEQ ID NO: 1180427 - RNA, 19 nt, Homo sapiens
ggcacaguuacacuuaaua

SEQ ID NO: 1180428 - RNA, 19 nt, Homo sapiens
auucugagccuagaggaua

SEQ ID NO: 1180429 - RNA, 19 nt, Homo sapiens
uaauggagagagagacaga

SEQ ID NO: 1180430 - RNA, 19 nt, Homo sapiens
gaguagcuacauacacuuc

SEQ ID NO: 1180431 - RNA, 19 nt, Homo sapiens
gaagaccacacggaagagu

SEQ ID NO: 1180432 - RNA, 19 nt, Homo sapiens
auuccaaucuucacagcaa

SEQ ID NO: 1180433 - RNA, 19 nt, Homo sapiens
acuucaagcuuguuaacau

SEQ ID NO: 1180434 - RNA, 19 nt, Homo sapiens
gaccugccagcaccaagaa

SEQ ID NO: 1180435 - RNA, 19 nt, Homo sapiens
cuucaagcuuguuaacauc

SEQ ID NO: 1180436 - RNA, 19 nt, Homo sapiens
ugacaaauaagugaacaag

SEQ ID NO: 1180437 - RNA, 19 nt, Homo sapiens
gaucuggaagaaauaugga

SEQ ID NO: 1180438 - RNA, 19 nt, Homo sapiens
ccuugucaguacagcuaua

SEQ ID NO: 1180439 - RNA, 19 nt, Homo sapiens
caacaacagccaaaagugu

SEQ ID NO: 1180440 - RNA, 19 nt, Homo sapiens
ccacacggaagaguagcua

SEQ ID NO: 1180441 - RNA, 19 nt, Homo sapiens
ucugugaucaauugaaaug

SEQ ID NO: 1180442 - RNA, 19 nt, Homo sapiens
acagaagagcacccugaaa

SEQ ID NO: 1180443 - RNA, 19 nt, Homo sapiens
agaugaugcagaauugaaa

SEQ ID NO: 1180444 - RNA, 19 nt, Homo sapiens
gccaaugacuuauuuuacu

SEQ ID NO: 1180445 - RNA, 19 nt, Homo sapiens
caugugccaaugacuuauu

SEQ ID NO: 1180446 - RNA, 19 nt, Homo sapiens
accaugugccaaugacuua

SEQ ID NO: 1180447 - RNA, 19 nt, Homo sapiens
guuccuaaccugcccaaag

SEQ ID NO: 1180448 - RNA, 19 nt, Homo sapiens
cgugagacguguuccuaac

SEQ ID NO: 1180449 - RNA, 19 nt, Homo sapiens
gagcggagguuaagauauu

SEQ ID NO: 1180450 - RNA, 19 nt, Homo sapiens
gaacaggaaaguagccuua

SEQ ID NO: 1180451 - RNA, 19 nt, Homo sapiens
guacugaccuacauuuaug

SEQ ID NO: 1180452 - RNA, 19 nt, Homo sapiens
gugaauaucuuuguuguug

SEQ ID NO: 1180453 - RNA, 19 nt, Homo sapiens
gcagagcucuuggacauga

SEQ ID NO: 1180454 - RNA, 19 nt, Homo sapiens
ggaaagcgcuauugauugc

SEQ ID NO: 1180455 - RNA, 19 nt, Homo sapiens
ggugugaacuucuaaaaua

SEQ ID NO: 1180456 - RNA, 19 nt, Homo sapiens
ugagagagaugcugugaau

SEQ ID NO: 1180457 - RNA, 19 nt, Homo sapiens
ugaccuacauuuaugauga

SEQ ID NO: 1180458 - RNA, 19 nt, Homo sapiens
gguacuaggugcaagugua

SEQ ID NO: 1180459 - RNA, 19 nt, Homo sapiens
gaagagaaggcgauugcua

SEQ ID NO: 1180460 - RNA, 19 nt, Homo sapiens
gaagggauauggcaaugag

SEQ ID NO: 1180461 - RNA, 19 nt, Homo sapiens
gcacgucccuccagacagu

SEQ ID NO: 1180462 - RNA, 19 nt, Homo sapiens
aguaucagcuuguuuggua

SEQ ID NO: 1180463 - RNA, 19 nt, Homo sapiens
gaggagcaauugagagaga

SEQ ID NO: 1180464 - RNA, 19 nt, Homo sapiens
ugacccagauaauacauuu

SEQ ID NO: 1180465 - RNA, 19 nt, Homo sapiens
ccuguggucuggcauauuu

SEQ ID NO: 1180466 - RNA, 19 nt, Homo sapiens
ggaggauuacuuugaauuu

SEQ ID NO: 1180467 - RNA, 19 nt, Homo sapiens
guacagagaggagcaauug

SEQ ID NO: 1180468 - RNA, 19 nt, Homo sapiens
cugcaaugcuugaaguaua

SEQ ID NO: 1180469 - RNA, 19 nt, Homo sapiens
agaauagaaugcugagauu

SEQ ID NO: 1180470 - RNA, 19 nt, Homo sapiens
ccaaccagaucucauugaa

SEQ ID NO: 1180471 - RNA, 19 nt, Homo sapiens
gcccagcacuugauguuau

SEQ ID NO: 1180472 - RNA, 19 nt, Homo sapiens
ggacaugaacccucggaaa

SEQ ID NO: 1180473 - RNA, 19 nt, Homo sapiens
uaggaaggauguaguucua

SEQ ID NO: 1180474 - RNA, 19 nt, Homo sapiens
uauaagcccuuugucguuu

SEQ ID NO: 1180475 - RNA, 19 nt, Homo sapiens
guugucggcuuauguacua

SEQ ID NO: 1180476 - RNA, 19 nt, Homo sapiens
ccacuuaccagaaggauga

SEQ ID NO: 1180477 - RNA, 19 nt, Homo sapiens
cuaaagguguaauugacua

SEQ ID NO: 1180478 - RNA, 19 nt, Homo sapiens
gggaguugcaggucaaaua

SEQ ID NO: 1180479 - RNA, 19 nt, Homo sapiens
guacacaaguucuuucacu

SEQ ID NO: 1180480 - RNA, 19 nt, Homo sapiens
cuaaggagauaccgggaaa

SEQ ID NO: 1180481 - RNA, 19 nt, Homo sapiens
gagaggagcaauugagaga

SEQ ID NO: 1180482 - RNA, 19 nt, Homo sapiens
gaugagaacaggaaaguag

SEQ ID NO: 1180483 - RNA, 19 nt, Homo sapiens
gaggauuacuuugaauuuc

SEQ ID NO: 1180484 - RNA, 19 nt, Homo sapiens
agaaggcgauugcuagaga

SEQ ID NO: 1180485 - RNA, 19 nt, Homo sapiens
aaacaucuaguucugagua

SEQ ID NO: 1180486 - RNA, 19 nt, Homo sapiens
gaccuacauuuaugaugaa

SEQ ID NO: 1180487 - RNA, 19 nt, Homo sapiens
ggcaaugaguagagcauga

SEQ ID NO: 1180488 - RNA, 19 nt, Homo sapiens
ugcaaugcuugaaguauaa

SEQ ID NO: 1180489 - RNA, 19 nt, Homo sapiens
ugaaguaucagcuuguuug

SEQ ID NO: 1180490 - RNA, 19 nt, Homo sapiens
aaccagaucucauugaagu

SEQ ID NO: 1180491 - RNA, 19 nt, Homo sapiens
ccagcuaaguuuugcauua

SEQ ID NO: 1180492 - RNA, 19 nt, Homo sapiens
acacugccauuuaccuauu

SEQ ID NO: 1180493 - RNA, 19 nt, Homo sapiens
ggaguugcaggucaaauau

SEQ ID NO: 1180494 - RNA, 19 nt, Homo sapiens
uaauuacugucgaugaaug

SEQ ID NO: 1180495 - RNA, 19 nt, Homo sapiens
gaauuuggacgcuggaugu

SEQ ID NO: 1180496 - RNA, 19 nt, Homo sapiens
caggaaaguagccuuagua

SEQ ID NO: 1180497 - RNA, 19 nt, Homo sapiens
cauguuggaucauugacaa

SEQ ID NO: 1180498 - RNA, 19 nt, Homo sapiens
ggagugcaguggcgugauc

SEQ ID NO: 1180499 - RNA, 19 nt, Homo sapiens
ggacgcuggauguuucaua

SEQ ID NO: 1180500 - RNA, 19 nt, Homo sapiens
gcugagauugguuaaguuu

SEQ ID NO: 1180501 - RNA, 19 nt, Homo sapiens
ugaaagugcugggauuaca

SEQ ID NO: 1180502 - RNA, 19 nt, Homo sapiens
guucuacacugccauuuac

SEQ ID NO: 1180503 - RNA, 19 nt, Homo sapiens
guauaagcccuuugucguu

SEQ ID NO: 1180504 - RNA, 19 nt, Homo sapiens
guaauugacuaggaaggau

SEQ ID NO: 1180505 - RNA, 19 nt, Homo sapiens
aaaguugucggcuuaugua

SEQ ID NO: 1180506 - RNA, 19 nt, Homo sapiens
ggagggaugagaacaggaa

SEQ ID NO: 1180507 - RNA, 19 nt, Homo sapiens
ucggaaagcgcuauugauu

SEQ ID NO: 1180508 - RNA, 19 nt, Homo sapiens
gaauagaaugcugagauug

SEQ ID NO: 1180509 - RNA, 19 nt, Homo sapiens
uacacaaguucuuucacua

SEQ ID NO: 1180510 - RNA, 19 nt, Homo sapiens
ccucaucccugugaauuuc

SEQ ID NO: 1180511 - RNA, 19 nt, Homo sapiens
ucguuucugugccuauuua

SEQ ID NO: 1180512 - RNA, 19 nt, Homo sapiens
gcaaugaguagagcaugaa

SEQ ID NO: 1180513 - RNA, 19 nt, Homo sapiens
acaauucgcagagagcuua

SEQ ID NO: 1180514 - RNA, 19 nt, Homo sapiens
agagagaugcugugaauca

SEQ ID NO: 1180515 - RNA, 19 nt, Homo sapiens
ucuggagagugaucuuuaa

SEQ ID NO: 1180516 - RNA, 19 nt, Homo sapiens
gaguacagacugcuuggaa

SEQ ID NO: 1180517 - RNA, 19 nt, Homo sapiens
cagaauagaaugcugagau

SEQ ID NO: 1180518 - RNA, 19 nt, Homo sapiens
gcugccaaguaacucauuu

SEQ ID NO: 1180519 - RNA, 19 nt, Homo sapiens
uuauaggugugaacuucua

SEQ ID NO: 1180520 - RNA, 19 nt, Homo sapiens
caaaacaaaaggcagaaua

SEQ ID NO: 1180521 - RNA, 19 nt, Homo sapiens
gagaagagaaggcgauugc

SEQ ID NO: 1180522 - RNA, 19 nt, Homo sapiens
gacaugaacccucggaaag

SEQ ID NO: 1180523 - RNA, 19 nt, Homo sapiens
agaaugcugagauugguua

SEQ ID NO: 1180524 - RNA, 19 nt, Homo sapiens
gugcaaguguagcauguca

SEQ ID NO: 1180525 - RNA, 19 nt, Homo sapiens
caaguucuuucacuaucug

SEQ ID NO: 1180526 - RNA, 19 nt, Homo sapiens
gaacuccugaccucaagug

SEQ ID NO: 1180527 - RNA, 19 nt, Homo sapiens
caggcaauauuggaaggua

SEQ ID NO: 1180528 - RNA, 19 nt, Homo sapiens
aauuauaggugugaacuuc

SEQ ID NO: 1180529 - RNA, 19 nt, Homo sapiens
ugaccauguuggaucauug

SEQ ID NO: 1180530 - RNA, 19 nt, Homo sapiens
cagauaauccuagggaguu

SEQ ID NO: 1180531 - RNA, 19 nt, Homo sapiens
ucugcuaugugucaucaaa

SEQ ID NO: 1180532 - RNA, 19 nt, Homo sapiens
gauccugagcggagguuaa

SEQ ID NO: 1180533 - RNA, 19 nt, Homo sapiens
gcaaguguagcaugucaca

SEQ ID NO: 1180534 - RNA, 19 nt, Homo sapiens
ccugugaauuucuuauugu

SEQ ID NO: 1180535 - RNA, 19 nt, Homo sapiens
uauguuggcacaggcauua

SEQ ID NO: 1180536 - RNA, 19 nt, Homo sapiens
gcaugacagugggugaguu

SEQ ID NO: 1180537 - RNA, 19 nt, Homo sapiens
ugagauugguuaaguuugc

SEQ ID NO: 1180538 - RNA, 19 nt, Homo sapiens
cacaaguucuuucacuauc

SEQ ID NO: 1180539 - RNA, 19 nt, Homo sapiens
acacaaguucuuucacuau

SEQ ID NO: 1180540 - RNA, 19 nt, Homo sapiens
gaggagguauuugggguua

SEQ ID NO: 1180541 - RNA, 19 nt, Homo sapiens
caaugaccaucuugaacca

SEQ ID NO: 1180542 - RNA, 19 nt, Homo sapiens
ccagaucucauugaaguau

SEQ ID NO: 1180543 - RNA, 19 nt, Homo sapiens
aggaaaaguugucggcuua

SEQ ID NO: 1180544 - RNA, 19 nt, Homo sapiens
cggaaagcgcuauugauug

SEQ ID NO: 1180545 - RNA, 19 nt, Homo sapiens
gaccauguuggaucauuga

SEQ ID NO: 1180546 - RNA, 19 nt, Homo sapiens
gcggaggauuacuuugaau

SEQ ID NO: 1180547 - RNA, 19 nt, Homo sapiens
gaacagucuauauacucuu

SEQ ID NO: 1180548 - RNA, 19 nt, Homo sapiens
gaaaaguugucggcuuaug

SEQ ID NO: 1180549 - RNA, 19 nt, Homo sapiens
gaaaagagccuauucgaua

SEQ ID NO: 1180550 - RNA, 19 nt, Homo sapiens
ggacuaggcugaagaugug

SEQ ID NO: 1180551 - RNA, 19 nt, Homo sapiens
ggagaaauguggcugucua

SEQ ID NO: 1180552 - RNA, 19 nt, Homo sapiens
gaucaucacugcgguggua

SEQ ID NO: 1180553 - RNA, 19 nt, Homo sapiens
caaaucagcccaaggauau

SEQ ID NO: 1180554 - RNA, 19 nt, Homo sapiens
gaaauguggcugucuacua

SEQ ID NO: 1180555 - RNA, 19 nt, Homo sapiens
ugaguaacaugcccaguuu

SEQ ID NO: 1180556 - RNA, 19 nt, Homo sapiens
gaagggaauaugaaaggua

SEQ ID NO: 1180557 - RNA, 19 nt, Homo sapiens
gagaaauccuaacuauauc

SEQ ID NO: 1180558 - RNA, 19 nt, Homo sapiens
gccacugccuucuuuguaa

SEQ ID NO: 1180559 - RNA, 19 nt, Homo sapiens
uaauagaacgagcaaagua

SEQ ID NO: 1180560 - RNA, 19 nt, Homo sapiens
cuacguaguuggagcuauu

SEQ ID NO: 1180561 - RNA, 19 nt, Homo sapiens
caaagggauacaacuauaa

SEQ ID NO: 1180562 - RNA, 19 nt, Homo sapiens
gauaauagaacgagcaaag

SEQ ID NO: 1180563 - RNA, 19 nt, Homo sapiens
acacagacaucaucuacau

SEQ ID NO: 1180564 - RNA, 19 nt, Homo sapiens
cauaggccauuauccugua

SEQ ID NO: 1180565 - RNA, 19 nt, Homo sapiens
ccaaggauauaguuaggau

SEQ ID NO: 1180566 - RNA, 19 nt, Homo sapiens
ucaaaucagcccaaggaua

SEQ ID NO: 1180567 - RNA, 19 nt, Homo sapiens
gacaccacauucuuccuaa

SEQ ID NO: 1180568 - RNA, 19 nt, Homo sapiens
cggaggagcuagggacuaa

SEQ ID NO: 1180569 - RNA, 19 nt, Homo sapiens
gccagccacugccuucuuu

SEQ ID NO: 1180570 - RNA, 19 nt, Homo sapiens
aaccaaagccgucaucauu

SEQ ID NO: 1180571 - RNA, 19 nt, Homo sapiens
gggacuaacuguugcucuu

SEQ ID NO: 1180572 - RNA, 19 nt, Homo sapiens
gacaucaucuacaucuuca

SEQ ID NO: 1180573 - RNA, 19 nt, Homo sapiens
ucaccuggcuagggagaua

SEQ ID NO: 1180574 - RNA, 19 nt, Homo sapiens
gagagagcggugagugaua

SEQ ID NO: 1180575 - RNA, 19 nt, Homo sapiens
gaacgagcaaaguaaccua

SEQ ID NO: 1180576 - RNA, 19 nt, Homo sapiens
gaagguagaagagaucugu

SEQ ID NO: 1180577 - RNA, 19 nt, Homo sapiens
gcuagaagggaauaugaaa

SEQ ID NO: 1180578 - RNA, 19 nt, Homo sapiens
agacagagcaggccacaug

SEQ ID NO: 1180579 - RNA, 19 nt, Homo sapiens
cgaaagguuuacuccauca

SEQ ID NO: 1180580 - RNA, 19 nt, Homo sapiens
gggauacaacuauaaaugu

SEQ ID NO: 1180581 - RNA, 19 nt, Homo sapiens
aaauguggcugucuacuac

SEQ ID NO: 1180582 - RNA, 19 nt, Homo sapiens
gaacucuugcuuccuguau

SEQ ID NO: 1180583 - RNA, 19 nt, Homo sapiens
ggacacauaggccauuauc

SEQ ID NO: 1180584 - RNA, 19 nt, Homo sapiens
ccaaagccgucaucauugc

SEQ ID NO: 1180585 - RNA, 19 nt, Homo sapiens
ucaggaagguagaagagau

SEQ ID NO: 1180586 - RNA, 19 nt, Homo sapiens
uaacaugcccaguuuccuu

SEQ ID NO: 1180587 - RNA, 19 nt, Homo sapiens
gggauugucacuagcauug

SEQ ID NO: 1180588 - RNA, 19 nt, Homo sapiens
ggugacuucucucuguuug

SEQ ID NO: 1180589 - RNA, 19 nt, Homo sapiens
ggaaguagccagggugaag

SEQ ID NO: 1180590 - RNA, 19 nt, Homo sapiens
agagugggaugaccggaaa

SEQ ID NO: 1180591 - RNA, 19 nt, Homo sapiens
ggccaucauugcuaucuuc

SEQ ID NO: 1180592 - RNA, 19 nt, Homo sapiens
guuccuggcuuacgacaca

SEQ ID NO: 1180593 - RNA, 19 nt, Homo sapiens
gaauaugaaagguagaagu

SEQ ID NO: 1180594 - RNA, 19 nt, Homo sapiens
gauugucacuagcauugug

SEQ ID NO: 1180595 - RNA, 19 nt, Homo sapiens
guccuaugcugucuucguu

SEQ ID NO: 1180596 - RNA, 19 nt, Homo sapiens
ccacugccuucuuuguaau

SEQ ID NO: 1180597 - RNA, 19 nt, Homo sapiens
gcauugugcucuacuucca

SEQ ID NO: 1180598 - RNA, 19 nt, Homo sapiens
aaucaaaucagcccaagga

SEQ ID NO: 1180599 - RNA, 19 nt, Homo sapiens
gaaguagccagggugaaga

SEQ ID NO: 1180600 - RNA, 19 nt, Homo sapiens
gagcaaaguaaccuauaca

SEQ ID NO: 1180601 - RNA, 19 nt, Homo sapiens
aauagaacgagcaaaguaa

SEQ ID NO: 1180602 - RNA, 19 nt, Homo sapiens
ucacaggcuucuugacuac

SEQ ID NO: 1180603 - RNA, 19 nt, Homo sapiens
ggacuaacuguugcucuug

SEQ ID NO: 1180604 - RNA, 19 nt, Homo sapiens
ucacugcggugguauccau

SEQ ID NO: 1180605 - RNA, 19 nt, Homo sapiens
uaucuucaccuuuguggaa

SEQ ID NO: 1180606 - RNA, 19 nt, Homo sapiens
cgagcaaaguaaccuauac

SEQ ID NO: 1180607 - RNA, 19 nt, Homo sapiens
ugacaccacauucuuccua

SEQ ID NO: 1180608 - RNA, 19 nt, Homo sapiens
gggacuaggcugaagaugu

SEQ ID NO: 1180609 - RNA, 19 nt, Homo sapiens
ggagagagcggugagugau

SEQ ID NO: 1180610 - RNA, 19 nt, Homo sapiens
uagccagggugaagagaga

SEQ ID NO: 1180611 - RNA, 19 nt, Homo sapiens
ccauuauccuguauuccuu

SEQ ID NO: 1180612 - RNA, 19 nt, Homo sapiens
ugacuguggucugggcuuu

SEQ ID NO: 1180613 - RNA, 19 nt, Homo sapiens
ugacuucucucuguuuguc

SEQ ID NO: 1180614 - RNA, 19 nt, Homo sapiens
gagcuagggacuaacuguu

SEQ ID NO: 1180615 - RNA, 19 nt, Homo sapiens
ucaaucccuucuuguuuca

SEQ ID NO: 1180616 - RNA, 19 nt, Homo sapiens
cuucaaucccuucuuguuu

SEQ ID NO: 1180617 - RNA, 19 nt, Homo sapiens
gcccaaggauauaguuagg

SEQ ID NO: 1180618 - RNA, 19 nt, Homo sapiens
ccauuucagucaccaucuu

SEQ ID NO: 1180619 - RNA, 19 nt, Homo sapiens
ucagugacauauguauugu

SEQ ID NO: 1180620 - RNA, 19 nt, Homo sapiens
guaguuggagcuauuucuu

SEQ ID NO: 1180621 - RNA, 19 nt, Homo sapiens
gggaauaugaaagguagaa

SEQ ID NO: 1180622 - RNA, 19 nt, Homo sapiens
uagcuagaagggaauauga

SEQ ID NO: 1180623 - RNA, 19 nt, Homo sapiens
gaaccugucagcgccuuug

SEQ ID NO: 1180624 - RNA, 19 nt, Homo sapiens
ucacccuguuccuggcuua

SEQ ID NO: 1180625 - RNA, 19 nt, Homo sapiens
agagagcggugagugauag

SEQ ID NO: 1180626 - RNA, 19 nt, Homo sapiens
gggcaccauuuccaguaug

SEQ ID NO: 1180627 - RNA, 19 nt, Homo sapiens
gcagggacuaggcugaaga

SEQ ID NO: 1180628 - RNA, 19 nt, Homo sapiens
caucuacaucuucaccuuu

SEQ ID NO: 1180629 - RNA, 19 nt, Homo sapiens
ucauugcuaucuucaccuu

SEQ ID NO: 1180630 - RNA, 19 nt, Homo sapiens
uugcuucaaucccuucuug

SEQ ID NO: 1180631 - RNA, 19 nt, Homo sapiens
ucaucuacaucuucaccuu

SEQ ID NO: 1180632 - RNA, 19 nt, Homo sapiens
gcuucaaucccuucuuguu

SEQ ID NO: 1180633 - RNA, 19 nt, Homo sapiens
ggagcuagggacuaacugu

SEQ ID NO: 1180634 - RNA, 19 nt, Homo sapiens
agacaucaucuacaucuuc

SEQ ID NO: 1180635 - RNA, 19 nt, Homo sapiens
uucaaucccuucuuguuuc

SEQ ID NO: 1180636 - RNA, 19 nt, Homo sapiens
gcucuacuuccaauacguu

SEQ ID NO: 1180637 - RNA, 19 nt, Homo sapiens
ccuaugcugucuucguugu

SEQ ID NO: 1180638 - RNA, 19 nt, Homo sapiens
uaagugccuugagcuggaa

SEQ ID NO: 1180639 - RNA, 19 nt, Homo sapiens
ucauacguguggccaggaa

SEQ ID NO: 1180640 - RNA, 19 nt, Homo sapiens
cuggacacauaggccauua

SEQ ID NO: 1180641 - RNA, 19 nt, Homo sapiens
guaugacaccacauucuuc

SEQ ID NO: 1180642 - RNA, 19 nt, Homo sapiens
ggcaccauuuccaguaugu

SEQ ID NO: 1180643 - RNA, 19 nt, Homo sapiens
cagcccaaggauauaguua

SEQ ID NO: 1180644 - RNA, 19 nt, Homo sapiens
gggacaagggucagucugu

SEQ ID NO: 1180645 - RNA, 19 nt, Homo sapiens
gaagccuacugugguacug

SEQ ID NO: 1180646 - RNA, 19 nt, Homo sapiens
gcuugcuccuggcuuguga

SEQ ID NO: 1180647 - RNA, 19 nt, Homo sapiens
ccugggcucucccuuccaa

SEQ ID NO: 1180648 - RNA, 19 nt, Homo sapiens
gcagauuuacacagacauc

SEQ ID NO: 1180649 - RNA, 19 nt, Homo sapiens
acaaugaucucaggaauua

SEQ ID NO: 1180650 - RNA, 19 nt, Homo sapiens
ucagaaugcuggaauguua

SEQ ID NO: 1180651 - RNA, 19 nt, Homo sapiens
ugacaaagcccaacaauga

SEQ ID NO: 1180652 - RNA, 19 nt, Homo sapiens
gcagauauguuuccagaga

SEQ ID NO: 1180653 - RNA, 19 nt, Homo sapiens
gaaggcaguugcuguguuu

SEQ ID NO: 1180654 - RNA, 19 nt, Homo sapiens
caagagacaugcauucuau

SEQ ID NO: 1180655 - RNA, 19 nt, Homo sapiens
gaucaaagauucaaauggu

SEQ ID NO: 1180656 - RNA, 19 nt, Homo sapiens
gcgaugcccuccacaauuu

SEQ ID NO: 1180657 - RNA, 19 nt, Homo sapiens
caaauucucugucaucugu

SEQ ID NO: 1180658 - RNA, 19 nt, Homo sapiens
gaaagaaugcuaaagaugu

SEQ ID NO: 1180659 - RNA, 19 nt, Homo sapiens
guacaucaaggacagauua

SEQ ID NO: 1180660 - RNA, 19 nt, Homo sapiens
uuaggaacuugcaguauua

SEQ ID NO: 1180661 - RNA, 19 nt, Homo sapiens
gaagaugguguuguuaaua

SEQ ID NO: 1180662 - RNA, 19 nt, Homo sapiens
ggaacuugcaguauuauuu

SEQ ID NO: 1180663 - RNA, 19 nt, Homo sapiens
ggaagaugguguuguuaau

SEQ ID NO: 1180664 - RNA, 19 nt, Homo sapiens
gauuucaccuucuucauga

SEQ ID NO: 1180665 - RNA, 19 nt, Homo sapiens
uaacuuugguccucaagaa

SEQ ID NO: 1180666 - RNA, 19 nt, Homo sapiens
ugagaugccugguauauag

SEQ ID NO: 1180667 - RNA, 19 nt, Homo sapiens
ugaaugauaugcugagaga

SEQ ID NO: 1180668 - RNA, 19 nt, Homo sapiens
gcaacaauuucgcuccaaa

SEQ ID NO: 1180669 - RNA, 19 nt, Homo sapiens
caacaaugaucucaggaau

SEQ ID NO: 1180670 - RNA, 19 nt, Homo sapiens
ucaucaaccuaaagcauua

SEQ ID NO: 1180671 - RNA, 19 nt, Homo sapiens
ugacuccacugauaaagaa

SEQ ID NO: 1180672 - RNA, 19 nt, Homo sapiens
gagcugcuguucuuucgaa

SEQ ID NO: 1180673 - RNA, 19 nt, Homo sapiens
gagccuguuuacucauuua

SEQ ID NO: 1180674 - RNA, 19 nt, Homo sapiens
gcagauuuggugaauauuu

SEQ ID NO: 1180675 - RNA, 19 nt, Homo sapiens
gcaagagacaugcauucua

SEQ ID NO: 1180676 - RNA, 19 nt, Homo sapiens
ccaaauaaccagcuccaaa

SEQ ID NO: 1180677 - RNA, 19 nt, Homo sapiens
agacaugcauucuauaauc

SEQ ID NO: 1180678 - RNA, 19 nt, Homo sapiens
gcauguuccugcuauguug

SEQ ID NO: 1180679 - RNA, 19 nt, Homo sapiens
caaauaaccagcuccaaau

SEQ ID NO: 1180680 - RNA, 19 nt, Homo sapiens
gcauguuccucuauauuuc

SEQ ID NO: 1180681 - RNA, 19 nt, Homo sapiens
gagcauauguacgcaaauc

SEQ ID NO: 1180682 - RNA, 19 nt, Homo sapiens
uagcagcaaugcagauuug

SEQ ID NO: 1180683 - RNA, 19 nt, Homo sapiens
gacaugcauucuauaauca

SEQ ID NO: 1180684 - RNA, 19 nt, Homo sapiens
ucugugaaauaguccauua

SEQ ID NO: 1180685 - RNA, 19 nt, Homo sapiens
ucaauggugugacaugcua

SEQ ID NO: 1180686 - RNA, 19 nt, Homo sapiens
aaagacauauggucagaau

SEQ ID NO: 1180687 - RNA, 19 nt, Homo sapiens
caaguuauauccugaaagc

SEQ ID NO: 1180688 - RNA, 19 nt, Homo sapiens
caacuuccuuucugcaugu

SEQ ID NO: 1180689 - RNA, 19 nt, Homo sapiens
gaauggucauacccacuuu

SEQ ID NO: 1180690 - RNA, 19 nt, Homo sapiens
gaucucaggaauuacauuu

SEQ ID NO: 1180691 - RNA, 19 nt, Homo sapiens
uauaggagccuuugggaaa

SEQ ID NO: 1180692 - RNA, 19 nt, Homo sapiens
cgaauuggaguaauagaaa

SEQ ID NO: 1180693 - RNA, 19 nt, Homo sapiens
ggucauacccacuuuggaa

SEQ ID NO: 1180694 - RNA, 19 nt, Homo sapiens
ccuaagaaguggcgugguu

SEQ ID NO: 1180695 - RNA, 19 nt, Homo sapiens
gaaaucgaauuggaguaau

SEQ ID NO: 1180696 - RNA, 19 nt, Homo sapiens
caggagaaaucgaauugga

SEQ ID NO: 1180697 - RNA, 19 nt, Homo sapiens
acgauugccuggaugauaa

SEQ ID NO: 1180698 - RNA, 19 nt, Homo sapiens
cauaugguauaccuugaaa

SEQ ID NO: 1180699 - RNA, 19 nt, Homo sapiens
acaaauggcagaacaguau

SEQ ID NO: 1180700 - RNA, 19 nt, Homo sapiens
ccaagucauucagaaguuu

SEQ ID NO: 1180701 - RNA, 19 nt, Homo sapiens
gcccaaacugucagaaaua

SEQ ID NO: 1180702 - RNA, 19 nt, Homo sapiens
caagagcaaguacaucaaa

SEQ ID NO: 1180703 - RNA, 19 nt, Homo sapiens
aagcugauccuauuuaguu

SEQ ID NO: 1180704 - RNA, 19 nt, Homo sapiens
aaagguaacuggaagaaaa

SEQ ID NO: 1180705 - RNA, 19 nt, Homo sapiens
ggcccaaacugucagaaau

SEQ ID NO: 1180706 - RNA, 19 nt, Homo sapiens
aaggacagauuaacuggaa

SEQ ID NO: 1180707 - RNA, 19 nt, Homo sapiens
guucaggcuuagaggcuua

SEQ ID NO: 1180708 - RNA, 19 nt, Homo sapiens
aauggaagaugguguuguu

SEQ ID NO: 1180709 - RNA, 19 nt, Homo sapiens
uuccagagaugaaugauau

SEQ ID NO: 1180710 - RNA, 19 nt, Homo sapiens
ggugugacaugcuaugcaa

SEQ ID NO: 1180711 - RNA, 19 nt, Homo sapiens
caaagucgacaguuauguu

SEQ ID NO: 1180712 - RNA, 19 nt, Homo sapiens
ucaaaugcuacccaaauaa

SEQ ID NO: 1180713 - RNA, 19 nt, Homo sapiens
gcuggaauguuaacuggau

SEQ ID NO: 1180714 - RNA, 19 nt, Homo sapiens
ggcauguuccucuauauuu

SEQ ID NO: 1180715 - RNA, 19 nt, Homo sapiens
ccagaggcauuuggauuug

SEQ ID NO: 1180716 - RNA, 19 nt, Homo sapiens
uuacagcaauugaacuuuc

SEQ ID NO: 1180717 - RNA, 19 nt, Homo sapiens
uucaaaugcuacccaaaua

SEQ ID NO: 1180718 - RNA, 19 nt, Homo sapiens
gaaggugaagaauauguug

SEQ ID NO: 1180719 - RNA, 19 nt, Homo sapiens
aauguuaacuggauucaca

SEQ ID NO: 1180720 - RNA, 19 nt, Homo sapiens
gauuuugacuccacugaua

SEQ ID NO: 1180721 - RNA, 19 nt, Homo sapiens
uggcaucucuccucggauu

SEQ ID NO: 1180722 - RNA, 19 nt, Homo sapiens
gagaaagaaauuggaugua

SEQ ID NO: 1180723 - RNA, 19 nt, Homo sapiens
gaagcaagagacaugcauu

SEQ ID NO: 1180724 - RNA, 19 nt, Homo sapiens
caguauuccaugcauauua

SEQ ID NO: 1180725 - RNA, 19 nt, Homo sapiens
ccuguuuacucauuuagaa

SEQ ID NO: 1180726 - RNA, 19 nt, Homo sapiens
cagagccuguuuacucauu

SEQ ID NO: 1180727 - RNA, 19 nt, Homo sapiens
ucagagagguuuuauuuca

SEQ ID NO: 1180728 - RNA, 19 nt, Homo sapiens
cgacaguuauguugagaag

SEQ ID NO: 1180729 - RNA, 19 nt, Homo sapiens
gauauggauuccugucagu

SEQ ID NO: 1180730 - RNA, 19 nt, Homo sapiens
caauuaggaacuugcagua

SEQ ID NO: 1180731 - RNA, 19 nt, Homo sapiens
gggacucaguacuuccaua

SEQ ID NO: 1180732 - RNA, 19 nt, Homo sapiens
caaugcagauuuggugaau

SEQ ID NO: 1180733 - RNA, 19 nt, Homo sapiens
gugauuugauggugaggaa

SEQ ID NO: 1180734 - RNA, 19 nt, Homo sapiens
cacuuaaggugauuugaug

SEQ ID NO: 1180735 - RNA, 19 nt, Homo sapiens
gauucacacucccaaguca

SEQ ID NO: 1180736 - RNA, 19 nt, Homo sapiens
gaauauguugguuuagaga

SEQ ID NO: 1180737 - RNA, 19 nt, Homo sapiens
auuaggaacuugcaguauu

SEQ ID NO: 1180738 - RNA, 19 nt, Homo sapiens
agagacaugcauucuauaa

SEQ ID NO: 1180739 - RNA, 19 nt, Homo sapiens
gacgauugccuggaugaua

SEQ ID NO: 1180740 - RNA, 19 nt, Homo sapiens
caaauaguaaacacccuuu

SEQ ID NO: 1180741 - RNA, 19 nt, Homo sapiens
gcugguaacaccucgguuu

SEQ ID NO: 1180742 - RNA, 19 nt, Homo sapiens
uaggagccuuugggaaaua

SEQ ID NO: 1180743 - RNA, 19 nt, Homo sapiens
ucagaaauagggacgauug

SEQ ID NO: 1180744 - RNA, 19 nt, Homo sapiens
cacagaagcuaauggacau

SEQ ID NO: 1180745 - RNA, 19 nt, Homo sapiens
uuaaagacauauggucaga

SEQ ID NO: 1180746 - RNA, 19 nt, Homo sapiens
augcagauuuggugaauau

SEQ ID NO: 1180747 - RNA, 19 nt, Homo sapiens
uagcacaccaugguuauuu

SEQ ID NO: 1180748 - RNA, 19 nt, Homo sapiens
agucugagaugccugguau

SEQ ID NO: 1180749 - RNA, 19 nt, Homo sapiens
gggaaucuccugcuacuua

SEQ ID NO: 1180750 - RNA, 19 nt, Homo sapiens
gcacggagguccuguccaa

SEQ ID NO: 1180751 - RNA, 19 nt, Homo sapiens
gagaggagcuggccaaggu

SEQ ID NO: 1180752 - RNA, 19 nt, Homo sapiens
ggaaucuccugcuacuuaa

SEQ ID NO: 1180753 - RNA, 19 nt, Homo sapiens
gugcaaaagugaacaauaa

SEQ ID NO: 1180754 - RNA, 19 nt, Homo sapiens
gaagcgagccuccaaagag

SEQ ID NO: 1180755 - RNA, 19 nt, Homo sapiens
ggauuacugugacgccauu

SEQ ID NO: 1180756 - RNA, 19 nt, Homo sapiens
agaagucucuggccuggaa

SEQ ID NO: 1180757 - RNA, 19 nt, Homo sapiens
gcaagaagcgagccuccaa

SEQ ID NO: 1180758 - RNA, 19 nt, Homo sapiens
gaccugcuccaaagaauga

SEQ ID NO: 1180759 - RNA, 19 nt, Homo sapiens
ccaaugacccggagguguu

SEQ ID NO: 1180760 - RNA, 19 nt, Homo sapiens
aagcgagccuccaaagaga

SEQ ID NO: 1180761 - RNA, 19 nt, Homo sapiens
gacacguccuacuuaagaa

SEQ ID NO: 1180762 - RNA, 19 nt, Homo sapiens
caaaauaugcaaaguguga

SEQ ID NO: 1180763 - RNA, 19 nt, Homo sapiens
gcagcguccugggagcaua

SEQ ID NO: 1180764 - RNA, 19 nt, Homo sapiens
cggagguccuguccaagaa

SEQ ID NO: 1180765 - RNA, 19 nt, Homo sapiens
ccaggucacggauugcuuu

SEQ ID NO: 1180766 - RNA, 19 nt, Homo sapiens
gcaguucugugccaaugac

SEQ ID NO: 1180767 - RNA, 19 nt, Homo sapiens
ccaaagggcaacagaugug

SEQ ID NO: 1180768 - RNA, 19 nt, Homo sapiens
caagaagcgagccuccaaa

SEQ ID NO: 1180769 - RNA, 19 nt, Homo sapiens
gccaaaauaugcaaagugu

SEQ ID NO: 1180770 - RNA, 19 nt, Homo sapiens
ggagcuggccgaggaguau

SEQ ID NO: 1180771 - RNA, 19 nt, Homo sapiens
gggaccugcuccaaagaau

SEQ ID NO: 1180772 - RNA, 19 nt, Homo sapiens
gccaagagaggucacuaug

SEQ ID NO: 1180773 - RNA, 19 nt, Homo sapiens
ccacagaugauagccaaga

SEQ ID NO: 1180774 - RNA, 19 nt, Homo sapiens
gugcaguucugugccaaug

SEQ ID NO: 1180775 - RNA, 19 nt, Homo sapiens
gagguccuguccaagaaca

SEQ ID NO: 1180776 - RNA, 19 nt, Homo sapiens
gcuacuuaauguggaaaga

SEQ ID NO: 1180777 - RNA, 19 nt, Homo sapiens
ggaccugcuccaaagaaug

SEQ ID NO: 1180778 - RNA, 19 nt, Homo sapiens
gagugggaccugcuccaaa

SEQ ID NO: 1180779 - RNA, 19 nt, Homo sapiens
aaaagaagcagcugaggaa

SEQ ID NO: 1180780 - RNA, 19 nt, Homo sapiens
ugcaaagugugaccagugu

SEQ ID NO: 1180781 - RNA, 19 nt, Homo sapiens
gggcccaccucuucaagcu

SEQ ID NO: 1180782 - RNA, 19 nt, Homo sapiens
ccaucccuguguuugcuaa

SEQ ID NO: 1180783 - RNA, 19 nt, Homo sapiens
caaugacccggagguguuu

SEQ ID NO: 1180784 - RNA, 19 nt, Homo sapiens
cugcccaggucacggauug

SEQ ID NO: 1180785 - RNA, 19 nt, Homo sapiens
cgaggaguaucuggacauc

SEQ ID NO: 1180786 - RNA, 19 nt, Homo sapiens
acccggagguguuuguuca

SEQ ID NO: 1180787 - RNA, 19 nt, Homo sapiens
ccaagagaggucacuaugg

SEQ ID NO: 1180788 - RNA, 19 nt, Homo sapiens
gugacgccauugaccugaa

SEQ ID NO: 1180789 - RNA, 19 nt, Homo sapiens
uacuuaauguggaaagaca

SEQ ID NO: 1180790 - RNA, 19 nt, Homo sapiens
gagggcaucgcugcuguga

SEQ ID NO: 1180791 - RNA, 19 nt, Homo sapiens
aggaguaucuggacaucgu

SEQ ID NO: 1180792 - RNA, 19 nt, Homo sapiens
agugggaccugcuccaaag

SEQ ID NO: 1180793 - RNA, 19 nt, Homo sapiens
ccaagaacaagcaaaagaa

SEQ ID NO: 1180794 - RNA, 19 nt, Homo sapiens
gaucugccagcccuacauc

SEQ ID NO: 1180795 - RNA, 19 nt, Homo sapiens
uugacaagaccgugaggua

SEQ ID NO: 1180796 - RNA, 19 nt, Homo sapiens
uggcucaggauuacuguga

SEQ ID NO: 1180797 - RNA, 19 nt, Homo sapiens
ucccggagauugacaagac

SEQ ID NO: 1180798 - RNA, 19 nt, Homo sapiens
uaaaggaggugacuaaauu

SEQ ID NO: 1180799 - RNA, 19 nt, Homo sapiens
gcacuggucugcauucuaa

SEQ ID NO: 1180800 - RNA, 19 nt, Homo sapiens
gaacuuugcugugacauga

SEQ ID NO: 1180801 - RNA, 19 nt, Homo sapiens
gaaaguaccaacaagauuu

SEQ ID NO: 1180802 - RNA, 19 nt, Homo sapiens
gcaauuaucaagcugaaua

SEQ ID NO: 1180803 - RNA, 19 nt, Homo sapiens
gaacaggagcauugauaua

SEQ ID NO: 1180804 - RNA, 19 nt, Homo sapiens
gaaacgccaucuagucuga

SEQ ID NO: 1180805 - RNA, 19 nt, Homo sapiens
caaagaaucuauggcaauu

SEQ ID NO: 1180806 - RNA, 19 nt, Homo sapiens
caugaucgauguuguaauu

SEQ ID NO: 1180807 - RNA, 19 nt, Homo sapiens
ccaacaagauuuauaagga

SEQ ID NO: 1180808 - RNA, 19 nt, Homo sapiens
uaacaagacuucacauuac

SEQ ID NO: 1180809 - RNA, 19 nt, Homo sapiens
ucuaaagccuacaaaguua

SEQ ID NO: 1180810 - RNA, 19 nt, Homo sapiens
ugaaagcgcugacacacaa

SEQ ID NO: 1180811 - RNA, 19 nt, Homo sapiens
uccaauagcuccuuuguga

SEQ ID NO: 1180812 - RNA, 19 nt, Homo sapiens
caucuuagcuuuuaucuga

SEQ ID NO: 1180813 - RNA, 19 nt, Homo sapiens
ggguagaguuucucauuug

SEQ ID NO: 1180814 - RNA, 19 nt, Homo sapiens
cauggaggcuuuaacaaga

SEQ ID NO: 1180815 - RNA, 19 nt, Homo sapiens
gaaguggaagugcuuauga

SEQ ID NO: 1180816 - RNA, 19 nt, Homo sapiens
ggaaaguaccaacaagauu

SEQ ID NO: 1180817 - RNA, 19 nt, Homo sapiens
uggaagugcuuaugacaaa

SEQ ID NO: 1180818 - RNA, 19 nt, Homo sapiens
agaaggugguguuucauaa

SEQ ID NO: 1180819 - RNA, 19 nt, Homo sapiens
gggaacaggagcauugaua

SEQ ID NO: 1180820 - RNA, 19 nt, Homo sapiens
gaaacucauuccacaacug

SEQ ID NO: 1180821 - RNA, 19 nt, Homo sapiens
caacugaagcuacuauauc

SEQ ID NO: 1180822 - RNA, 19 nt, Homo sapiens
gauaugcaaucuuaugaac

SEQ ID NO: 1180823 - RNA, 19 nt, Homo sapiens
uuaguaagguggugcagaa

SEQ ID NO: 1180824 - RNA, 19 nt, Homo sapiens
caugggagcugcugcuugu

SEQ ID NO: 1180825 - RNA, 19 nt, Homo sapiens
caaaguugauggucugucu

SEQ ID NO: 1180826 - RNA, 19 nt, Homo sapiens
gcauugauauacgucauug

SEQ ID NO: 1180827 - RNA, 19 nt, Homo sapiens
cuguggauaugcaaucuua

SEQ ID NO: 1180828 - RNA, 19 nt, Homo sapiens
ggaacaggagcauugauau

SEQ ID NO: 1180829 - RNA, 19 nt, Homo sapiens
gacuacaacuuccacuguu

SEQ ID NO: 1180830 - RNA, 19 nt, Homo sapiens
gaaucuauggcaauuauca

SEQ ID NO: 1180831 - RNA, 19 nt, Homo sapiens
cuuaugaacuuugcuguga

SEQ ID NO: 1180832 - RNA, 19 nt, Homo sapiens
agacuucacauuacuguuu

SEQ ID NO: 1180833 - RNA, 19 nt, Homo sapiens
caauagcuccuuugugaau

SEQ ID NO: 1180834 - RNA, 19 nt, Homo sapiens
gaagugcuuaugacaaaga

SEQ ID NO: 1180835 - RNA, 19 nt, Homo sapiens
gaucgauguuguaauugau

SEQ ID NO: 1180836 - RNA, 19 nt, Homo sapiens
ugaucgauguuguaauuga

SEQ ID NO: 1180837 - RNA, 19 nt, Homo sapiens
cagaaggugguguuucaua

SEQ ID NO: 1180838 - RNA, 19 nt, Homo sapiens
gaagauggaaguggaagug

SEQ ID NO: 1180839 - RNA, 19 nt, Homo sapiens
aaaguuaacccagacauga

SEQ ID NO: 1180840 - RNA, 19 nt, Homo sapiens
guaagguggugcagaaacu

SEQ ID NO: 1180841 - RNA, 19 nt, Homo sapiens
aggaugacauuuccaauag

SEQ ID NO: 1180842 - RNA, 19 nt, Homo sapiens
guauauauggguuaaagga

SEQ ID NO: 1180843 - RNA, 19 nt, Homo sapiens
guaauugaugugucuugua

SEQ ID NO: 1180844 - RNA, 19 nt, Homo sapiens
aaaucuacauugcaacaga

SEQ ID NO: 1180845 - RNA, 19 nt, Homo sapiens
ggauaugcaaucuuaugaa

SEQ ID NO: 1180846 - RNA, 19 nt, Homo sapiens
aaacacagagggacauuca

SEQ ID NO: 1180847 - RNA, 19 nt, Homo sapiens
uugauggucugucugauga

SEQ ID NO: 1180848 - RNA, 19 nt, Homo sapiens
aaggaugacauuuccaaua

SEQ ID NO: 1180849 - RNA, 19 nt, Homo sapiens
acuagugccuccagucuga

SEQ ID NO: 1180850 - RNA, 19 nt, Homo sapiens
gcaaguccuccauccagaa

SEQ ID NO: 1180851 - RNA, 19 nt, Homo sapiens
gacccaaccuuugacuaug

SEQ ID NO: 1180852 - RNA, 19 nt, Homo sapiens
gaugugucuuguauauaug

SEQ ID NO: 1180853 - RNA, 19 nt, Homo sapiens
gcagaaacucauuccacaa

SEQ ID NO: 1180854 - RNA, 19 nt, Homo sapiens
guacaacugaagcuacuau

SEQ ID NO: 1180855 - RNA, 19 nt, Homo sapiens
ggucggaugccacgugcua

SEQ ID NO: 1180856 - RNA, 19 nt, Homo sapiens
ggugguguuucauaagaug

SEQ ID NO: 1180857 - RNA, 19 nt, Homo sapiens
uauauggguuaaaggaaga

SEQ ID NO: 1180858 - RNA, 19 nt, Homo sapiens
gcagaugcugggcuagaaa

SEQ ID NO: 1180859 - RNA, 19 nt, Homo sapiens
cagagggacauucaucaaa

SEQ ID NO: 1180860 - RNA, 19 nt, Homo sapiens
ccgauucguuuccaaagga

SEQ ID NO: 1180861 - RNA, 19 nt, Homo sapiens
gaugacauuuccaauagcu

SEQ ID NO: 1180862 - RNA, 19 nt, Homo sapiens
cugaagcuacuauaucuuu

SEQ ID NO: 1180863 - RNA, 19 nt, Homo sapiens
uccagaaggugguguuuca

SEQ ID NO: 1180864 - RNA, 19 nt, Homo sapiens
gcuuuuaucugacuaguau

SEQ ID NO: 1180865 - RNA, 19 nt, Homo sapiens
agagggacauucaucaaag

SEQ ID NO: 1180866 - RNA, 19 nt, Homo sapiens
gagcauugauauacgucau

SEQ ID NO: 1180867 - RNA, 19 nt, Homo sapiens
aaggugguguuucauaaga

SEQ ID NO: 1180868 - RNA, 19 nt, Homo sapiens
uagaguuucucauuuggau

SEQ ID NO: 1180869 - RNA, 19 nt, Homo sapiens
gguagaguuucucauuugg

SEQ ID NO: 1180870 - RNA, 19 nt, Homo sapiens
ggaaguggaagugcuuaug

SEQ ID NO: 1180871 - RNA, 19 nt, Homo sapiens
ugacccaaccuuugacuau

SEQ ID NO: 1180872 - RNA, 19 nt, Homo sapiens
gaaggugguguuucauaag

SEQ ID NO: 1180873 - RNA, 19 nt, Homo sapiens
uaguaucuaugaccauuca

SEQ ID NO: 1180874 - RNA, 19 nt, Homo sapiens
caaaguuaacccagacaug

SEQ ID NO: 1180875 - RNA, 19 nt, Homo sapiens
cuacauggaggcuuuaaca

SEQ ID NO: 1180876 - RNA, 19 nt, Homo sapiens
ucuggugccuguuccacua

SEQ ID NO: 1180877 - RNA, 19 nt, Homo sapiens
acuacaacuuccacuguuu

SEQ ID NO: 1180878 - RNA, 19 nt, Homo sapiens
gcaccaugucccugcagua

SEQ ID NO: 1180879 - RNA, 19 nt, Homo sapiens
cuuugugaauuuccagaua

SEQ ID NO: 1180880 - RNA, 19 nt, Homo sapiens
aaaggaggugacuaaauuu

SEQ ID NO: 1180881 - RNA, 19 nt, Homo sapiens
caacugccgaccuuggaaa

SEQ ID NO: 1180882 - RNA, 19 nt, Homo sapiens
gagggacauucaucaaagg

SEQ ID NO: 1180883 - RNA, 19 nt, Homo sapiens
ucuaagggaagaaagcuuu

SEQ ID NO: 1180884 - RNA, 19 nt, Homo sapiens
auagcuccuuugugaauuu

SEQ ID NO: 1180885 - RNA, 19 nt, Homo sapiens
gaauaauacaacuguccuu

SEQ ID NO: 1180886 - RNA, 19 nt, Homo sapiens
acaaagaaucuauggcaau

SEQ ID NO: 1180887 - RNA, 19 nt, Homo sapiens
gauggucugucugaugauc

SEQ ID NO: 1180888 - RNA, 19 nt, Homo sapiens
cuaaagccuacaaaguuaa

SEQ ID NO: 1180889 - RNA, 19 nt, Homo sapiens
gacuucacauuacuguuuc

SEQ ID NO: 1180890 - RNA, 19 nt, Homo sapiens
gggguagaguuucucauuu

SEQ ID NO: 1180891 - RNA, 19 nt, Homo sapiens
acccaaccuuugacuauga

SEQ ID NO: 1180892 - RNA, 19 nt, Homo sapiens
ggaagugcuuaugacaaag

SEQ ID NO: 1180893 - RNA, 19 nt, Homo sapiens
acuaguaucuaugaccauu

SEQ ID NO: 1180894 - RNA, 19 nt, Homo sapiens
ccacgaaacgccaucuagu

SEQ ID NO: 1180895 - RNA, 19 nt, Homo sapiens
uuaaaggaggugacuaaau

SEQ ID NO: 1180896 - RNA, 19 nt, Homo sapiens
ggccaaugaugaccuugca

SEQ ID NO: 1180897 - RNA, 19 nt, Homo sapiens
agacaugaauuuugagguu

SEQ ID NO: 1180898 - RNA, 19 nt, Homo sapiens
gagagcagauggcagauuu

SEQ ID NO: 1180899 - RNA, 19 nt, Homo sapiens
gcaaucgccuugauguuug

SEQ ID NO: 1180900 - RNA, 19 nt, Homo sapiens
ucuaccagcuguuuaacua

SEQ ID NO: 1180901 - RNA, 19 nt, Homo sapiens
ugcgaaggcugcucaagua

SEQ ID NO: 1180902 - RNA, 19 nt, Homo sapiens
gaacacagugggccgaaga

SEQ ID NO: 1180903 - RNA, 19 nt, Homo sapiens
cgacccggcuuccuucuau

SEQ ID NO: 1180904 - RNA, 19 nt, Homo sapiens
ggcaaucgccuugauguuu

SEQ ID NO: 1180905 - RNA, 19 nt, Homo sapiens
gcagauggcagauuugcau

SEQ ID NO: 1180906 - RNA, 19 nt, Homo sapiens
gauggagcauuugaagaug

SEQ ID NO: 1180907 - RNA, 19 nt, Homo sapiens
cuauggccauuccgaguuu

SEQ ID NO: 1180908 - RNA, 19 nt, Homo sapiens
ugaaugaguggcaggauga

SEQ ID NO: 1180909 - RNA, 19 nt, Homo sapiens
cucaguauguggacaaguu

SEQ ID NO: 1180910 - RNA, 19 nt, Homo sapiens
gaacuggcaaucgccuuga

SEQ ID NO: 1180911 - RNA, 19 nt, Homo sapiens
ugauggagcauuugaagau

SEQ ID NO: 1180912 - RNA, 19 nt, Homo sapiens
ccuuugugauggagcauuu

SEQ ID NO: 1180913 - RNA, 19 nt, Homo sapiens
ucagggagaaguugaagga

SEQ ID NO: 1180914 - RNA, 19 nt, Homo sapiens
gcccaguguucgucaaagu

SEQ ID NO: 1180915 - RNA, 19 nt, Homo sapiens
ggagagcagauggcagauu

SEQ ID NO: 1180916 - RNA, 19 nt, Homo sapiens
gaaccacuggaaccacuuc

SEQ ID NO: 1180917 - RNA, 19 nt, Homo sapiens
accagaagcucagggagaa

SEQ ID NO: 1180918 - RNA, 19 nt, Homo sapiens
ggucccggcuacaggugaa

SEQ ID NO: 1180919 - RNA, 19 nt, Homo sapiens
gaaggaggaggagaacaca

SEQ ID NO: 1180920 - RNA, 19 nt, Homo sapiens
uggagcauuugaagaugaa

SEQ ID NO: 1180921 - RNA, 19 nt, Homo sapiens
ugaccgagaggcacgagaa

SEQ ID NO: 1180922 - RNA, 19 nt, Homo sapiens
gagcauuugaagaugaaga

SEQ ID NO: 1180923 - RNA, 19 nt, Homo sapiens
ugaagagcuugagcaguca

SEQ ID NO: 1180924 - RNA, 19 nt, Homo sapiens
gaagcucagggagaaguug

SEQ ID NO: 1180925 - RNA, 19 nt, Homo sapiens
gcgcagcuggaccucauug

SEQ ID NO: 1180926 - RNA, 19 nt, Homo sapiens
ggauauagcucucaaaguu

SEQ ID NO: 1180927 - RNA, 19 nt, Homo sapiens
ggaaaccacuggcuugaua

SEQ ID NO: 1180928 - RNA, 19 nt, Homo sapiens
gcagauauuuggaaaguaa

SEQ ID NO: 1180929 - RNA, 19 nt, Homo sapiens
guaaucaccugacacauuu

SEQ ID NO: 1180930 - RNA, 19 nt, Homo sapiens
gaaguuaguugcuuugaga

SEQ ID NO: 1180931 - RNA, 19 nt, Homo sapiens
gauggagacuacauaaaua

SEQ ID NO: 1180932 - RNA, 19 nt, Homo sapiens
caagacagguuuaucacua

SEQ ID NO: 1180933 - RNA, 19 nt, Homo sapiens
gcacuaggauacagauauu

SEQ ID NO: 1180934 - RNA, 19 nt, Homo sapiens
cuaauaagcucuucuguuc

SEQ ID NO: 1180935 - RNA, 19 nt, Homo sapiens
agagaaugguggauaauua

SEQ ID NO: 1180936 - RNA, 19 nt, Homo sapiens
cuagaaagauucaagaaga

SEQ ID NO: 1180937 - RNA, 19 nt, Homo sapiens
caucagugguuacagcuua

SEQ ID NO: 1180938 - RNA, 19 nt, Homo sapiens
gauacaaauucaacggaua

SEQ ID NO: 1180939 - RNA, 19 nt, Homo sapiens
ggaaccgucuguauagaaa

SEQ ID NO: 1180940 - RNA, 19 nt, Homo sapiens
gaauauggauggagacuac

SEQ ID NO: 1180941 - RNA, 19 nt, Homo sapiens
uaacucaacucuuacugaa

SEQ ID NO: 1180942 - RNA, 19 nt, Homo sapiens
gcaaacugccauuuagaua

SEQ ID NO: 1180943 - RNA, 19 nt, Homo sapiens
gagcugacauacucaaaug

SEQ ID NO: 1180944 - RNA, 19 nt, Homo sapiens
gaaaguggaacauaagaga

SEQ ID NO: 1180945 - RNA, 19 nt, Homo sapiens
ggagaacacaucuuacaaa

SEQ ID NO: 1180946 - RNA, 19 nt, Homo sapiens
cauaggagaacacaucuua

SEQ ID NO: 1180947 - RNA, 19 nt, Homo sapiens
cauagagaaugguggauaa

SEQ ID NO: 1180948 - RNA, 19 nt, Homo sapiens
gcucuucuguucaaucauu

SEQ ID NO: 1180949 - RNA, 19 nt, Homo sapiens
uagacuagcugagaaauug

SEQ ID NO: 1180950 - RNA, 19 nt, Homo sapiens
gagaaaagcugcauaugau

SEQ ID NO: 1180951 - RNA, 19 nt, Homo sapiens
gaacacaucuuacaaaacu

SEQ ID NO: 1180952 - RNA, 19 nt, Homo sapiens
gguuacagcuuaccucuuc

SEQ ID NO: 1180953 - RNA, 19 nt, Homo sapiens
ggaccagcaugccuaauca

SEQ ID NO: 1180954 - RNA, 19 nt, Homo sapiens
uacagaaaguggaacauaa

SEQ ID NO: 1180955 - RNA, 19 nt, Homo sapiens
uggaauuacucaccugaua

SEQ ID NO: 1180956 - RNA, 19 nt, Homo sapiens
ggauggagacuacauaaau

SEQ ID NO: 1180957 - RNA, 19 nt, Homo sapiens
cuguauagcugcaaauauu

SEQ ID NO: 1180958 - RNA, 19 nt, Homo sapiens
caaacugccauuuagauaa

SEQ ID NO: 1180959 - RNA, 19 nt, Homo sapiens
caagcuacuuuaaggauau

SEQ ID NO: 1180960 - RNA, 19 nt, Homo sapiens
acucaacucuuacugaauu

SEQ ID NO: 1180961 - RNA, 19 nt, Homo sapiens
ggacacccuuucuaacuca

SEQ ID NO: 1180962 - RNA, 19 nt, Homo sapiens
gaugugcauugaaggcaua

SEQ ID NO: 1180963 - RNA, 19 nt, Homo sapiens
gcugugagcugacauacuc

SEQ ID NO: 1180964 - RNA, 19 nt, Homo sapiens
agagucauaucuucaguaa

SEQ ID NO: 1180965 - RNA, 19 nt, Homo sapiens
ucugacaacuucuuauuga

SEQ ID NO: 1180966 - RNA, 19 nt, Homo sapiens
cagcuuaccucuucacagu

SEQ ID NO: 1180967 - RNA, 19 nt, Homo sapiens
auacaucucuaucucauug

SEQ ID NO: 1180968 - RNA, 19 nt, Homo sapiens
gaacaagcuacuuuaagga

SEQ ID NO: 1180969 - RNA, 19 nt, Homo sapiens
aaucauugcuggacugcua

SEQ ID NO: 1180970 - RNA, 19 nt, Homo sapiens
gcucaaacccacccacauu

SEQ ID NO: 1180971 - RNA, 19 nt, Homo sapiens
caaacccacccacauuaua

SEQ ID NO: 1180972 - RNA, 19 nt, Homo sapiens
gauauagcucucaaaguuu

SEQ ID NO: 1180973 - RNA, 19 nt, Homo sapiens
ugaacaagcuacuuuaagg

SEQ ID NO: 1180974 - RNA, 19 nt, Homo sapiens
gagaacacaucuuacaaaa

SEQ ID NO: 1180975 - RNA, 19 nt, Homo sapiens
cugagaaauuguugacaua

SEQ ID NO: 1180976 - RNA, 19 nt, Homo sapiens
gaauugaagccugcuauug

SEQ ID NO: 1180977 - RNA, 19 nt, Homo sapiens
gugaaauaguucugucaaa

SEQ ID NO: 1180978 - RNA, 19 nt, Homo sapiens
gcauacaucucuaucucau

SEQ ID NO: 1180979 - RNA, 19 nt, Homo sapiens
aauaagcucuucuguucaa

SEQ ID NO: 1180980 - RNA, 19 nt, Homo sapiens
caacggauauagcucucaa

SEQ ID NO: 1180981 - RNA, 19 nt, Homo sapiens
caaguuaucugugaaucau

SEQ ID NO: 1180982 - RNA, 19 nt, Homo sapiens
caucuucauuacuagguua

SEQ ID NO: 1180983 - RNA, 19 nt, Homo sapiens
gcauggaugugcauugaag

SEQ ID NO: 1180984 - RNA, 19 nt, Homo sapiens
ugaaauacgcaauggaauu

SEQ ID NO: 1180985 - RNA, 19 nt, Homo sapiens
cuuucuaacucaacucuua

SEQ ID NO: 1180986 - RNA, 19 nt, Homo sapiens
gcugagaaauuguugacau

SEQ ID NO: 1180987 - RNA, 19 nt, Homo sapiens
gaaaggucacagauaggua

SEQ ID NO: 1180988 - RNA, 19 nt, Homo sapiens
acaagcuacuuuaaggaua

SEQ ID NO: 1180989 - RNA, 19 nt, Homo sapiens
guggaugaccaauguauaa

SEQ ID NO: 1180990 - RNA, 19 nt, Homo sapiens
ccacuuuguugaauuguuc

SEQ ID NO: 1180991 - RNA, 19 nt, Homo sapiens
gauggaaccgucuguauag

SEQ ID NO: 1180992 - RNA, 19 nt, Homo sapiens
uaauugcacuaacacagaa

SEQ ID NO: 1180993 - RNA, 19 nt, Homo sapiens
guugggaucaauacaaaua

SEQ ID NO: 1180994 - RNA, 19 nt, Homo sapiens
caucgaaaggucacagaua

SEQ ID NO: 1180995 - RNA, 19 nt, Homo sapiens
cagaaggaaguuauuauug

SEQ ID NO: 1180996 - RNA, 19 nt, Homo sapiens
acacagaaggaaguuauua

SEQ ID NO: 1180997 - RNA, 19 nt, Homo sapiens
aaggaucacucaacuagga

SEQ ID NO: 1180998 - RNA, 19 nt, Homo sapiens
ugccuaaucauucuuguua

SEQ ID NO: 1180999 - RNA, 19 nt, Homo sapiens
caaagcaccaggacaacaa

SEQ ID NO: 1181000 - RNA, 19 nt, Homo sapiens
ugauuugucuugccauaug

SEQ ID NO: 1181001 - RNA, 19 nt, Homo sapiens
ugacucguguugccuuuga

SEQ ID NO: 1181002 - RNA, 19 nt, Homo sapiens
guauaugaauguccugaag

SEQ ID NO: 1181003 - RNA, 19 nt, Homo sapiens
ggaauugaagccugcuauu

SEQ ID NO: 1181004 - RNA, 19 nt, Homo sapiens
ugauggaaccgucuguaua

SEQ ID NO: 1181005 - RNA, 19 nt, Homo sapiens
acagguuuaucacuaauga

SEQ ID NO: 1181006 - RNA, 19 nt, Homo sapiens
aagacagguuuaucacuaa

SEQ ID NO: 1181007 - RNA, 19 nt, Homo sapiens
cagcaugccuaaucauucu

SEQ ID NO: 1181008 - RNA, 19 nt, Homo sapiens
guaccuggcuucagaucca

SEQ ID NO: 1181009 - RNA, 19 nt, Homo sapiens
gauauuauggcacaaccaa

SEQ ID NO: 1181010 - RNA, 19 nt, Homo sapiens
aaucuuugcuguagccuau

SEQ ID NO: 1181011 - RNA, 19 nt, Homo sapiens
guaauuucagucucaauga

SEQ ID NO: 1181012 - RNA, 19 nt, Homo sapiens
gaguauugguccuuugcuu

SEQ ID NO: 1181013 - RNA, 19 nt, Homo sapiens
ggacaaguuaucugugaau

SEQ ID NO: 1181014 - RNA, 19 nt, Homo sapiens
gaaaagggaaugauaagau

SEQ ID NO: 1181015 - RNA, 19 nt, Homo sapiens
gcuauaggaacuguagaua

SEQ ID NO: 1181016 - RNA, 19 nt, Homo sapiens
gcuuaccucuucacaguca

SEQ ID NO: 1181017 - RNA, 19 nt, Homo sapiens
uguaaucaccugacacauu

SEQ ID NO: 1181018 - RNA, 19 nt, Homo sapiens
guguguaccuggcuucaga

SEQ ID NO: 1181019 - RNA, 19 nt, Homo sapiens
cacgagaaguauaugaaug

SEQ ID NO: 1181020 - RNA, 19 nt, Homo sapiens
aacauaaggucuugugcaa

SEQ ID NO: 1181021 - RNA, 19 nt, Homo sapiens
ggagucaucauauacaaag

SEQ ID NO: 1181022 - RNA, 19 nt, Homo sapiens
gaucacucaacuaggaaua

SEQ ID NO: 1181023 - RNA, 19 nt, Homo sapiens
uuacaaggaucacucaacu

SEQ ID NO: 1181024 - RNA, 19 nt, Homo sapiens
aggaaauggugucacaauu

SEQ ID NO: 1181025 - RNA, 19 nt, Homo sapiens
ggaggaaagagucauaucu

SEQ ID NO: 1181026 - RNA, 19 nt, Homo sapiens
ggaaacagcucgacuuuaa

SEQ ID NO: 1181027 - RNA, 19 nt, Homo sapiens
ggaauaaacuguugaguca

SEQ ID NO: 1181028 - RNA, 19 nt, Homo sapiens
gcaaaugucuuccuggauu

SEQ ID NO: 1181029 - RNA, 19 nt, Homo sapiens
gaaguuagcucuauucaac

SEQ ID NO: 1181030 - RNA, 19 nt, Homo sapiens
gaccucagcuuugauauuu

SEQ ID NO: 1181031 - RNA, 19 nt, Homo sapiens
gaacugaacucugacaaca

SEQ ID NO: 1181032 - RNA, 19 nt, Homo sapiens
ccaaagaccacuacagaua

SEQ ID NO: 1181033 - RNA, 19 nt, Homo sapiens
ucagacaccucuucaauug

SEQ ID NO: 1181034 - RNA, 19 nt, Homo sapiens
gaaaucagguugccgaucu

SEQ ID NO: 1181035 - RNA, 19 nt, Homo sapiens
gcuuuaggauguacaguua

SEQ ID NO: 1181036 - RNA, 19 nt, Homo sapiens
caaaugucuuccuggauua

SEQ ID NO: 1181037 - RNA, 19 nt, Homo sapiens
caacauggccgugaacuuu

SEQ ID NO: 1181038 - RNA, 19 nt, Homo sapiens
guacaguuauggauugaaa

SEQ ID NO: 1181039 - RNA, 19 nt, Homo sapiens
caaagaacgucaugcuaga

SEQ ID NO: 1181040 - RNA, 19 nt, Homo sapiens
ggaauuaccagucccauug

SEQ ID NO: 1181041 - RNA, 19 nt, Homo sapiens
ucacuaggcuucugguuga

SEQ ID NO: 1181042 - RNA, 19 nt, Homo sapiens
guacacagaacacauaauu

SEQ ID NO: 1181043 - RNA, 19 nt, Homo sapiens
gaucacauguggacuuuua

SEQ ID NO: 1181044 - RNA, 19 nt, Homo sapiens
gauguacaguuauggauug

SEQ ID NO: 1181045 - RNA, 19 nt, Homo sapiens
ggaguacacagaacacaua

SEQ ID NO: 1181046 - RNA, 19 nt, Homo sapiens
gcaguuccauuucauuugu

SEQ ID NO: 1181047 - RNA, 19 nt, Homo sapiens
ccagaaugcuuuaggaugu

SEQ ID NO: 1181048 - RNA, 19 nt, Homo sapiens
gauugaaaguuuacaggaa

SEQ ID NO: 1181049 - RNA, 19 nt, Homo sapiens
ggacauauacacagagaau

SEQ ID NO: 1181050 - RNA, 19 nt, Homo sapiens
guugaagccuuuguaaauu

SEQ ID NO: 1181051 - RNA, 19 nt, Homo sapiens
guaugaaugugaugaaauc

SEQ ID NO: 1181052 - RNA, 19 nt, Homo sapiens
ccugugaacugaacucuga

SEQ ID NO: 1181053 - RNA, 19 nt, Homo sapiens
ccauggaugugcuuguuaa

SEQ ID NO: 1181054 - RNA, 19 nt, Homo sapiens
cccaagacauucuagguuu

SEQ ID NO: 1181055 - RNA, 19 nt, Homo sapiens
ggaugaagguguauguucu

SEQ ID NO: 1181056 - RNA, 19 nt, Homo sapiens
ggaugugcuuguuaacuga

SEQ ID NO: 1181057 - RNA, 19 nt, Homo sapiens
ccucagcccugcacgguuu

SEQ ID NO: 1181058 - RNA, 19 nt, Homo sapiens
gcaccgaguucaaccucaa

SEQ ID NO: 1181059 - RNA, 19 nt, Homo sapiens
gaggacauauacacagaga

SEQ ID NO: 1181060 - RNA, 19 nt, Homo sapiens
gauguauguugaagccuuu

SEQ ID NO: 1181061 - RNA, 19 nt, Homo sapiens
ggaacaacauuggcagugu

SEQ ID NO: 1181062 - RNA, 19 nt, Homo sapiens
caaagaccacuacagauau

SEQ ID NO: 1181063 - RNA, 19 nt, Homo sapiens
caucgcggcugcccaagaa

SEQ ID NO: 1181064 - RNA, 19 nt, Homo sapiens
gaaacagcucgacuuuaaa

SEQ ID NO: 1181065 - RNA, 19 nt, Homo sapiens
gaacgucaugcuagaagaa

SEQ ID NO: 1181066 - RNA, 19 nt, Homo sapiens
ggugaaagcgaauggauug

SEQ ID NO: 1181067 - RNA, 19 nt, Homo sapiens
gggaucacauguggacuuu

SEQ ID NO: 1181068 - RNA, 19 nt, Homo sapiens
gaagaggaguacacagaac

SEQ ID NO: 1181069 - RNA, 19 nt, Homo sapiens
ggacuggccucugcugauc

SEQ ID NO: 1181070 - RNA, 19 nt, Homo sapiens
gcacugaugcuggcaaaga

SEQ ID NO: 1181071 - RNA, 19 nt, Homo sapiens
uacaacauguucaggaauu

SEQ ID NO: 1181072 - RNA, 19 nt, Homo sapiens
acaagaggcaguuccauuu

SEQ ID NO: 1181073 - RNA, 19 nt, Homo sapiens
gaaaucaguuacucuucag

SEQ ID NO: 1181074 - RNA, 19 nt, Homo sapiens
acacagaacacauaauuca

SEQ ID NO: 1181075 - RNA, 19 nt, Homo sapiens
ccacaugcaagaaguauau

SEQ ID NO: 1181076 - RNA, 19 nt, Homo sapiens
ugaaauagacccacaagag

SEQ ID NO: 1181077 - RNA, 19 nt, Homo sapiens
ccaagacauucuagguuug

SEQ ID NO: 1181078 - RNA, 19 nt, Homo sapiens
gcgagcaauugcagaaguu

SEQ ID NO: 1181079 - RNA, 19 nt, Homo sapiens
ccaggcaacucaccaaugg

SEQ ID NO: 1181080 - RNA, 19 nt, Homo sapiens
agacucagcuucccaaggu

SEQ ID NO: 1181081 - RNA, 19 nt, Homo sapiens
ggaacacuuucucucuaga

SEQ ID NO: 1181082 - RNA, 19 nt, Homo sapiens
gggaacacuuucucucuag

SEQ ID NO: 1181083 - RNA, 19 nt, Homo sapiens
cagaugcugugcaaauguu

SEQ ID NO: 1181084 - RNA, 19 nt, Homo sapiens
gcacaaccuucagaucaca

SEQ ID NO: 1181085 - RNA, 19 nt, Homo sapiens
agacaccucuucaauugug

SEQ ID NO: 1181086 - RNA, 19 nt, Homo sapiens
gcucagacaccucuucaau

SEQ ID NO: 1181087 - RNA, 19 nt, Homo sapiens
cagaaugcuuuaggaugua

SEQ ID NO: 1181088 - RNA, 19 nt, Homo sapiens
guugaugccugugaacuga

SEQ ID NO: 1181089 - RNA, 19 nt, Homo sapiens
uuagugaccucagcuuuga

SEQ ID NO: 1181090 - RNA, 19 nt, Homo sapiens
cugcaaggcucuguauuug

SEQ ID NO: 1181091 - RNA, 19 nt, Homo sapiens
aaagaccacuacagauaug

SEQ ID NO: 1181092 - RNA, 19 nt, Homo sapiens
ggaauuccuucacaucacu

SEQ ID NO: 1181093 - RNA, 19 nt, Homo sapiens
gcaaccugcugaagaaugc

SEQ ID NO: 1181094 - RNA, 19 nt, Homo sapiens
cagucucgcuuccucagua

SEQ ID NO: 1181095 - RNA, 19 nt, Homo sapiens
acaacauguucaggaauua

SEQ ID NO: 1181096 - RNA, 19 nt, Homo sapiens
acaccagacucuugcuuug

SEQ ID NO: 1181097 - RNA, 19 nt, Homo sapiens
gaaugacaccauccuggaa

SEQ ID NO: 1181098 - RNA, 19 nt, Homo sapiens
gauauguaccugcugauuc

SEQ ID NO: 1181099 - RNA, 19 nt, Homo sapiens
guuaaccuuugauggcuuu

SEQ ID NO: 1181100 - RNA, 19 nt, Homo sapiens
ggacuuuuauuuccaguga

SEQ ID NO: 1181101 - RNA, 19 nt, Homo sapiens
ggacagccccuccuccaua

SEQ ID NO: 1181102 - RNA, 19 nt, Homo sapiens
ucagugcccuccaggauag

SEQ ID NO: 1181103 - RNA, 19 nt, Homo sapiens
gaggcugggugacaugugu

SEQ ID NO: 1181104 - RNA, 19 nt, Homo sapiens
gcagaaguuagcucuauuc

SEQ ID NO: 1181105 - RNA, 19 nt, Homo sapiens
gcucuguauuugcgcgaua

SEQ ID NO: 1181106 - RNA, 19 nt, Homo sapiens
ggauguacaguuauggauu

SEQ ID NO: 1181107 - RNA, 19 nt, Homo sapiens
gcccauggaugugcuuguu

SEQ ID NO: 1181108 - RNA, 19 nt, Homo sapiens
gugagcaggcugugaguuu

SEQ ID NO: 1181109 - RNA, 19 nt, Homo sapiens
gcaagcacuuccacuccau

SEQ ID NO: 1181110 - RNA, 19 nt, Homo sapiens
gaagcugccacaugcaaga

SEQ ID NO: 1181111 - RNA, 19 nt, Homo sapiens
uugaagccuuuguaaauug

SEQ ID NO: 1181112 - RNA, 19 nt, Homo sapiens
ccucagcuuugauauuuca

SEQ ID NO: 1181113 - RNA, 19 nt, Homo sapiens
gcagaaggacugaagaaaa

SEQ ID NO: 1181114 - RNA, 19 nt, Homo sapiens
uggauuggcugccuuccuu

SEQ ID NO: 1181115 - RNA, 19 nt, Homo sapiens
gugcugcccuggccuuugu

SEQ ID NO: 1181116 - RNA, 19 nt, Homo sapiens
ucaguuaagccuuuggaaa

SEQ ID NO: 1181117 - RNA, 19 nt, Homo sapiens
ucaguuacucuucaguuaa

SEQ ID NO: 1181118 - RNA, 19 nt, Homo sapiens
uagaggagguugacaagcu

SEQ ID NO: 1181119 - RNA, 19 nt, Homo sapiens
uccugaaguuguccaauaa

SEQ ID NO: 1181120 - RNA, 19 nt, Homo sapiens
cccgagaccugcagaguca

SEQ ID NO: 1181121 - RNA, 19 nt, Homo sapiens
acucuucaguuaagccuuu

SEQ ID NO: 1181122 - RNA, 19 nt, Homo sapiens
caguaugaaugugaugaaa

SEQ ID NO: 1181123 - RNA, 19 nt, Homo sapiens
gacaccagacucuugcuuu

SEQ ID NO: 1181124 - RNA, 19 nt, Homo sapiens
gaguucaaguucagguuca

SEQ ID NO: 1181125 - RNA, 19 nt, Homo sapiens
ccaggaauuucucuuuguc

SEQ ID NO: 1181126 - RNA, 19 nt, Homo sapiens
ggacaugggucaucacuga

SEQ ID NO: 1181127 - RNA, 19 nt, Homo sapiens
gaaggacgcucaaauacug

SEQ ID NO: 1181128 - RNA, 19 nt, Homo sapiens
ugaaggagcugauggagaa

SEQ ID NO: 1181129 - RNA, 19 nt, Homo sapiens
gaucgugucucaauccauu

SEQ ID NO: 1181130 - RNA, 19 nt, Homo sapiens
gcauggaggucguaucuau

SEQ ID NO: 1181131 - RNA, 19 nt, Homo sapiens
caccacaccuggcuaauuu

SEQ ID NO: 1181132 - RNA, 19 nt, Homo sapiens
acaaggagaucaugaagga

SEQ ID NO: 1181133 - RNA, 19 nt, Homo sapiens
ggcccaaccugauucauga

SEQ ID NO: 1181134 - RNA, 19 nt, Homo sapiens
acccagcccuguauucuua

SEQ ID NO: 1181135 - RNA, 19 nt, Homo sapiens
gaaguggcccaaccugauu

SEQ ID NO: 1181136 - RNA, 19 nt, Homo sapiens
ggagugcaguggcccauca

SEQ ID NO: 1181137 - RNA, 19 nt, Homo sapiens
ggucguaucuauccagucu

SEQ ID NO: 1181138 - RNA, 19 nt, Homo sapiens
caccucagccucucaagua

SEQ ID NO: 1181139 - RNA, 19 nt, Homo sapiens
cccagaaccugcugucuug

SEQ ID NO: 1181140 - RNA, 19 nt, Homo sapiens
gaagagcacagcugcagau

SEQ ID NO: 1181141 - RNA, 19 nt, Homo sapiens
caucagggcucacuguaac

SEQ ID NO: 1181142 - RNA, 19 nt, Homo sapiens
gaggagacgcugccagaug

SEQ ID NO: 1181143 - RNA, 19 nt, Homo sapiens
ggaggugcaugaggacuuc

SEQ ID NO: 1181144 - RNA, 19 nt, Homo sapiens
gaacguacugggacaacug

SEQ ID NO: 1181145 - RNA, 19 nt, Homo sapiens
ggaaggacgcucaaauacu

SEQ ID NO: 1181146 - RNA, 19 nt, Homo sapiens
ccaaagugcugggauugca

SEQ ID NO: 1181147 - RNA, 19 nt, Homo sapiens
gauggaaggacgcucaaau

SEQ ID NO: 1181148 - RNA, 19 nt, Homo sapiens
agaaccugcugucuuguga

SEQ ID NO: 1181149 - RNA, 19 nt, Homo sapiens
ggagaauggcccuguccaa

SEQ ID NO: 1181150 - RNA, 19 nt, Homo sapiens
gaacaggcaguggcagugu

SEQ ID NO: 1181151 - RNA, 19 nt, Homo sapiens
ccaaggauguaugcaugga

SEQ ID NO: 1181152 - RNA, 19 nt, Homo sapiens
ggacuucuuccuauacaag

SEQ ID NO: 1181153 - RNA, 19 nt, Homo sapiens
ucaugagccucuugaccaa

SEQ ID NO: 1181154 - RNA, 19 nt, Homo sapiens
ggcauccgaucgugucuca

SEQ ID NO: 1181155 - RNA, 19 nt, Homo sapiens
ccaccacaccuggcuaauu

SEQ ID NO: 1181156 - RNA, 19 nt, Homo sapiens
acugugaccucuucugcaa

SEQ ID NO: 1181157 - RNA, 19 nt, Homo sapiens
ucguaucuauccagucuug

SEQ ID NO: 1181158 - RNA, 19 nt, Homo sapiens
ccuguauucuuauucuuca

SEQ ID NO: 1181159 - RNA, 19 nt, Homo sapiens
auggaaggacgcucaaaua

SEQ ID NO: 1181160 - RNA, 19 nt, Homo sapiens
caucaaccagggcaacuau

SEQ ID NO: 1181161 - RNA, 19 nt, Homo sapiens
gcacccagcccuguauucu

SEQ ID NO: 1181162 - RNA, 19 nt, Homo sapiens
ccaucagggcucacuguaa

SEQ ID NO: 1181163 - RNA, 19 nt, Homo sapiens
cgacugcugcccugacuuc

SEQ ID NO: 1181164 - RNA, 19 nt, Homo sapiens
guggcagugugaccaagaa

SEQ ID NO: 1181165 - RNA, 19 nt, Homo sapiens
ccagcccuguauucuuauu

SEQ ID NO: 1181166 - RNA, 19 nt, Homo sapiens
cgacaaggagaucaugaag

SEQ ID NO: 1181167 - RNA, 19 nt, Homo sapiens
cauccgaucgugucucaau

SEQ ID NO: 1181168 - RNA, 19 nt, Homo sapiens
gggacccacucagucaaga

SEQ ID NO: 1181169 - RNA, 19 nt, Homo sapiens
agaaguggcccaaccugau

SEQ ID NO: 1181170 - RNA, 19 nt, Homo sapiens
gcaccauccgcccaucuuc

SEQ ID NO: 1181171 - RNA, 19 nt, Homo sapiens
ggaacguacugggacaacu

SEQ ID NO: 1181172 - RNA, 19 nt, Homo sapiens
gcaguggcagugugaccaa

SEQ ID NO: 1181173 - RNA, 19 nt, Homo sapiens
uggaggacaugggucauca

SEQ ID NO: 1181174 - RNA, 19 nt, Homo sapiens
cguacugggacaacuguaa

SEQ ID NO: 1181175 - RNA, 19 nt, Homo sapiens
caacgacaaggagaucaug

SEQ ID NO: 1181176 - RNA, 19 nt, Homo sapiens
gcagugugaccaagaacca

SEQ ID NO: 1181177 - RNA, 19 nt, Homo sapiens
gcccuguauucuuauucuu

SEQ ID NO: 1181178 - RNA, 19 nt, Homo sapiens
ccacagaucuggacguuca

SEQ ID NO: 1181179 - RNA, 19 nt, Homo sapiens
ggccuaggcuucaacauca

SEQ ID NO: 1181180 - RNA, 19 nt, Homo sapiens
ugaagcugguuguccguua

SEQ ID NO: 1181181 - RNA, 19 nt, Homo sapiens
guuccuggcacuuuauuua

SEQ ID NO: 1181182 - RNA, 19 nt, Homo sapiens
uguaugagcagcuuuauga

SEQ ID NO: 1181183 - RNA, 19 nt, Homo sapiens
caucauggguggcaaagag

SEQ ID NO: 1181184 - RNA, 19 nt, Homo sapiens
gagcaaaacucgcccaucu

SEQ ID NO: 1181185 - RNA, 19 nt, Homo sapiens
gccaacagcaucagagcua

SEQ ID NO: 1181186 - RNA, 19 nt, Homo sapiens
uauuguuccuggcacuuua

SEQ ID NO: 1181187 - RNA, 19 nt, Homo sapiens
cacaguggcugccuucaca

SEQ ID NO: 1181188 - RNA, 19 nt, Homo sapiens
gaagcugguuguccguuac

SEQ ID NO: 1181189 - RNA, 19 nt, Homo sapiens
caacaucauggguggcaaa

SEQ ID NO: 1181190 - RNA, 19 nt, Homo sapiens
gaugagggccuaggcuuca

SEQ ID NO: 1181191 - RNA, 19 nt, Homo sapiens
cgugcacucucuuccugua

SEQ ID NO: 1181192 - RNA, 19 nt, Homo sapiens
gggccuaggcuucaacauc

SEQ ID NO: 1181193 - RNA, 19 nt, Homo sapiens
cuuggagucucgagguuga

SEQ ID NO: 1181194 - RNA, 19 nt, Homo sapiens
aaccacagaucuggacguu

SEQ ID NO: 1181195 - RNA, 19 nt, Homo sapiens
ccuguacaguauuuauugu

SEQ ID NO: 1181196 - RNA, 19 nt, Homo sapiens
uaguggagcuacccaagac

SEQ ID NO: 1181197 - RNA, 19 nt, Homo sapiens
gcacucucuuccuguacag

SEQ ID NO: 1181198 - RNA, 19 nt, Homo sapiens
gcaaaacucgcccaucuac

SEQ ID NO: 1181199 - RNA, 19 nt, Homo sapiens
gaaauaggaugauguuugu

SEQ ID NO: 1181200 - RNA, 19 nt, Homo sapiens
caaaguagcagaaauagga

SEQ ID NO: 1181201 - RNA, 19 nt, Homo sapiens
gggagaaugucuacgauga

SEQ ID NO: 1181202 - RNA, 19 nt, Homo sapiens
ggaugaaacucacaaagca

SEQ ID NO: 1181203 - RNA, 19 nt, Homo sapiens
ccagagcccuuccguuuga

SEQ ID NO: 1181204 - RNA, 19 nt, Homo sapiens
ugaaacaguucuacuccua

SEQ ID NO: 1181205 - RNA, 19 nt, Homo sapiens
gagaacagcugccgauacu

SEQ ID NO: 1181206 - RNA, 19 nt, Homo sapiens
acacaaaguagcagaaaua

SEQ ID NO: 1181207 - RNA, 19 nt, Homo sapiens
caacgggacaugcaacaua

SEQ ID NO: 1181208 - RNA, 19 nt, Homo sapiens
gagcaaaacuccugagcua

SEQ ID NO: 1181209 - RNA, 19 nt, Homo sapiens
gaacaggcagcccaucaaa

SEQ ID NO: 1181210 - RNA, 19 nt, Homo sapiens
ugaccaagaugaaacaguu

SEQ ID NO: 1181211 - RNA, 19 nt, Homo sapiens
gaacagacagcaacaacga

SEQ ID NO: 1181212 - RNA, 19 nt, Homo sapiens
gcugaguccuucuuccaua

SEQ ID NO: 1181213 - RNA, 19 nt, Homo sapiens
uugggcagcuggacuauua

SEQ ID NO: 1181214 - RNA, 19 nt, Homo sapiens
ggagcacagucauaaguga

SEQ ID NO: 1181215 - RNA, 19 nt, Homo sapiens
ggagcugggugccgucaaa

SEQ ID NO: 1181216 - RNA, 19 nt, Homo sapiens
acaaagaccacuucuacua

SEQ ID NO: 1181217 - RNA, 19 nt, Homo sapiens
gcagaaauaggaugauguu

SEQ ID NO: 1181218 - RNA, 19 nt, Homo sapiens
gcacugaagcugcacaaug

SEQ ID NO: 1181219 - RNA, 19 nt, Homo sapiens
uggacaagcgcucuaauua

SEQ ID NO: 1181220 - RNA, 19 nt, Homo sapiens
gcgaagaagccaccgagua

SEQ ID NO: 1181221 - RNA, 19 nt, Homo sapiens
gggaagggaccuaauguga

SEQ ID NO: 1181222 - RNA, 19 nt, Homo sapiens
gaacagcugccgauacuac

SEQ ID NO: 1181223 - RNA, 19 nt, Homo sapiens
ccucaaggcugccacacaa

SEQ ID NO: 1181224 - RNA, 19 nt, Homo sapiens
ccacaaagaccacuucuac

SEQ ID NO: 1181225 - RNA, 19 nt, Homo sapiens
aauccaagcugcucugguu

SEQ ID NO: 1181226 - RNA, 19 nt, Homo sapiens
caggacaaaugaccaguug

SEQ ID NO: 1181227 - RNA, 19 nt, Homo sapiens
gcaccagacucaagaccau

SEQ ID NO: 1181228 - RNA, 19 nt, Homo sapiens
agaaauaggaugauguuug

SEQ ID NO: 1181229 - RNA, 19 nt, Homo sapiens
ggacugccauggacaucug

SEQ ID NO: 1181230 - RNA, 19 nt, Homo sapiens
gaacagcaggagaaaggaa

SEQ ID NO: 1181231 - RNA, 19 nt, Homo sapiens
ggagguuuguagaauaugu

SEQ ID NO: 1181232 - RNA, 19 nt, Homo sapiens
ugucucaccucuucuguug

SEQ ID NO: 1181233 - RNA, 19 nt, Homo sapiens
ggacaagcgcucuaauuac

SEQ ID NO: 1181234 - RNA, 19 nt, Homo sapiens
ccucugaccuucucgaaca

SEQ ID NO: 1181235 - RNA, 19 nt, Homo sapiens
cagcaucugugcaccucua

SEQ ID NO: 1181236 - RNA, 19 nt, Homo sapiens
cgaagaagccaccgaguag

SEQ ID NO: 1181237 - RNA, 19 nt, Homo sapiens
gacaacaaccugcgcauca

SEQ ID NO: 1181238 - RNA, 19 nt, Homo sapiens
gaccuucuuugauccuuga

SEQ ID NO: 1181239 - RNA, 19 nt, Homo sapiens
gacaagcgcucuaauuacc

SEQ ID NO: 1181240 - RNA, 19 nt, Homo sapiens
gacucaggauggcuacuuu

SEQ ID NO: 1181241 - RNA, 19 nt, Homo sapiens
ugaguccacugccgaauuc

SEQ ID NO: 1181242 - RNA, 19 nt, Homo sapiens
ccuacgacauccucauuga

SEQ ID NO: 1181243 - RNA, 19 nt, Homo sapiens
ggagugcgacgcucacaug

SEQ ID NO: 1181244 - RNA, 19 nt, Homo sapiens
ccaccuaccugcagagcau

SEQ ID NO: 1181245 - RNA, 19 nt, Homo sapiens
ggagugaccaaaccacaug

SEQ ID NO: 1181246 - RNA, 19 nt, Homo sapiens
gaccaugaccuucuuugau

SEQ ID NO: 1181247 - RNA, 19 nt, Homo sapiens
uuacggagcacagucauaa

SEQ ID NO: 1181248 - RNA, 19 nt, Homo sapiens
caaucuggcugugagcaaa

SEQ ID NO: 1181249 - RNA, 19 nt, Homo sapiens
gcaagugccaguacaagca

SEQ ID NO: 1181250 - RNA, 19 nt, Homo sapiens
aaagaccacuucuacuaca

SEQ ID NO: 1181251 - RNA, 19 nt, Homo sapiens
ucaaggccaucuaccacaa

SEQ ID NO: 1181252 - RNA, 19 nt, Homo sapiens
uuacugccgccacaaguua

SEQ ID NO: 1181253 - RNA, 19 nt, Homo sapiens
aacgggacaugcaacauaa

SEQ ID NO: 1181254 - RNA, 19 nt, Homo sapiens
ggguugaacuauucuccuu

SEQ ID NO: 1181255 - RNA, 19 nt, Homo sapiens
cccaagggcucugcaaaug

SEQ ID NO: 1181256 - RNA, 19 nt, Homo sapiens
cacugaagcugcacaaugg

SEQ ID NO: 1181257 - RNA, 19 nt, Homo sapiens
gagaaagugcgaacagaca

SEQ ID NO: 1181258 - RNA, 19 nt, Homo sapiens
ugccagagcccuuccguuu

SEQ ID NO: 1181259 - RNA, 19 nt, Homo sapiens
ccggagguuuguagaauau

SEQ ID NO: 1181260 - RNA, 19 nt, Homo sapiens
gauaccgagauaugaauuu

SEQ ID NO: 1181261 - RNA, 19 nt, Homo sapiens
gcaacaacgagaacucugu

SEQ ID NO: 1181262 - RNA, 19 nt, Homo sapiens
uagcagaaauaggaugaug

SEQ ID NO: 1181263 - RNA, 19 nt, Homo sapiens
gugccagccuugaaaguca

SEQ ID NO: 1181264 - RNA, 19 nt, Homo sapiens
agggauggcuggacucguu

SEQ ID NO: 1181265 - RNA, 19 nt, Homo sapiens
gagaggcuauuccgcaacu

SEQ ID NO: 1181266 - RNA, 19 nt, Homo sapiens
aaacaguucuacuccuaca

SEQ ID NO: 1181267 - RNA, 19 nt, Homo sapiens
gaagaagccaccgaguaga

SEQ ID NO: 1181268 - RNA, 19 nt, Homo sapiens
gcaacgcggaugaaacuca

SEQ ID NO: 1181269 - RNA, 19 nt, Homo sapiens
guugaacuauucuccuuag

SEQ ID NO: 1181270 - RNA, 19 nt, Homo sapiens
gcucugcaaaugccaguuu

SEQ ID NO: 1181271 - RNA, 19 nt, Homo sapiens
gagcagcagaacuucguuu

SEQ ID NO: 1181272 - RNA, 19 nt, Homo sapiens
gaggcuauuccgcaacuuu

SEQ ID NO: 1181273 - RNA, 19 nt, Homo sapiens
gcugugagcaaacuagaga

SEQ ID NO: 1181274 - RNA, 19 nt, Homo sapiens
cgagauaugaauuucuuga

SEQ ID NO: 1181275 - RNA, 19 nt, Homo sapiens
uggcguuucucucccgaua

SEQ ID NO: 1181276 - RNA, 19 nt, Homo sapiens
caaagaccacuucuacuac

SEQ ID NO: 1181277 - RNA, 19 nt, Homo sapiens
gaccaaaccacaugaacca

SEQ ID NO: 1181278 - RNA, 19 nt, Homo sapiens
ccaagcugcucugguugaa

SEQ ID NO: 1181279 - RNA, 19 nt, Homo sapiens
uuccagggcuuucugauca

SEQ ID NO: 1181280 - RNA, 19 nt, Homo sapiens
gaggguaaagccaacaaga

SEQ ID NO: 1181281 - RNA, 19 nt, Homo sapiens
ggucucuccuggccauaga

SEQ ID NO: 1181282 - RNA, 19 nt, Homo sapiens
ggagaacagcugccgauac

SEQ ID NO: 1181283 - RNA, 19 nt, Homo sapiens
cgagaacucuguccccaaa

SEQ ID NO: 1181284 - RNA, 19 nt, Homo sapiens
gcaaaacuccugagcuaga

SEQ ID NO: 1181285 - RNA, 19 nt, Homo sapiens
cagcagaacuucguuuacg

SEQ ID NO: 1181286 - RNA, 19 nt, Homo sapiens
gaagcaccagccugaguug

SEQ ID NO: 1181287 - RNA, 19 nt, Homo sapiens
gcuggacuauuaccuguac

SEQ ID NO: 1181288 - RNA, 19 nt, Homo sapiens
guggacaagcgcucuaauu

SEQ ID NO: 1181289 - RNA, 19 nt, Homo sapiens
gcacugccgccaggagauu

SEQ ID NO: 1181290 - RNA, 19 nt, Homo sapiens
ggguggaucccgucaaugu

SEQ ID NO: 1181291 - RNA, 19 nt, Homo sapiens
cacaaaaccuucgucaauu

SEQ ID NO: 1181292 - RNA, 19 nt, Homo sapiens
gaugaaacucacaaagcaa

SEQ ID NO: 1181293 - RNA, 19 nt, Homo sapiens
ccacacaaaguagcagaaa

SEQ ID NO: 1181294 - RNA, 19 nt, Homo sapiens
aagagaaagugcgaacaga

SEQ ID NO: 1181295 - RNA, 19 nt, Homo sapiens
uggaugagccgguggguau

SEQ ID NO: 1181296 - RNA, 19 nt, Homo sapiens
uugaagccguggugaauca

SEQ ID NO: 1181297 - RNA, 19 nt, Homo sapiens
accaugaccuucuuugauc

SEQ ID NO: 1181298 - RNA, 19 nt, Homo sapiens
gaaagagaaagugcgaaca

SEQ ID NO: 1181299 - RNA, 19 nt, Homo sapiens
gaacagaagaugugcaaua

SEQ ID NO: 1181300 - RNA, 19 nt, Homo sapiens
agaagaaccuggaguaauu

SEQ ID NO: 1181301 - RNA, 19 nt, Homo sapiens
gaagaagacucugucaaga

SEQ ID NO: 1181302 - RNA, 19 nt, Homo sapiens
gagagaaacuagaacagaa

SEQ ID NO: 1181303 - RNA, 19 nt, Homo sapiens
caaacuaccucucaggaaa

SEQ ID NO: 1181304 - RNA, 19 nt, Homo sapiens
agacugaggucacgcaaua

SEQ ID NO: 1181305 - RNA, 19 nt, Homo sapiens
ggacaagaauuuccucaag

SEQ ID NO: 1181306 - RNA, 19 nt, Homo sapiens
gaaauaugcaacagaagaa

SEQ ID NO: 1181307 - RNA, 19 nt, Homo sapiens
gaagguggacacaguauga

SEQ ID NO: 1181308 - RNA, 19 nt, Homo sapiens
ggaaauugcaccuuacaga

SEQ ID NO: 1181309 - RNA, 19 nt, Homo sapiens
ggacaagcguuccgacuac

SEQ ID NO: 1181310 - RNA, 19 nt, Homo sapiens
ggaagaagacucugucaag

SEQ ID NO: 1181311 - RNA, 19 nt, Homo sapiens
gagcccaccugcuauuguu

SEQ ID NO: 1181312 - RNA, 19 nt, Homo sapiens
cagagacgcuugagaugug

SEQ ID NO: 1181313 - RNA, 19 nt, Homo sapiens
gacaagaauuuccucaagu

SEQ ID NO: 1181314 - RNA, 19 nt, Homo sapiens
ggccacaucuuaugacauc

SEQ ID NO: 1181315 - RNA, 19 nt, Homo sapiens
ugucaagacucucagaaga

SEQ ID NO: 1181316 - RNA, 19 nt, Homo sapiens
ucaccuuccugucuaguuu

SEQ ID NO: 1181317 - RNA, 19 nt, Homo sapiens
ccaagaaccgggacaagaa

SEQ ID NO: 1181318 - RNA, 19 nt, Homo sapiens
ugagacccaugcagaguuu

SEQ ID NO: 1181319 - RNA, 19 nt, Homo sapiens
ggaagugggccaugucugu

SEQ ID NO: 1181320 - RNA, 19 nt, Homo sapiens
gaaacuagaacagaagaug

SEQ ID NO: 1181321 - RNA, 19 nt, Homo sapiens
ggagagaaacuagaacaga

SEQ ID NO: 1181322 - RNA, 19 nt, Homo sapiens
gcuacaagcuggcgauugc

SEQ ID NO: 1181323 - RNA, 19 nt, Homo sapiens
gcaaacuaccucucaggaa

SEQ ID NO: 1181324 - RNA, 19 nt, Homo sapiens
gcgugcaccuguauuucua

SEQ ID NO: 1181325 - RNA, 19 nt, Homo sapiens
ugaaauaugcaacagaaga

SEQ ID NO: 1181326 - RNA, 19 nt, Homo sapiens
gcagaucccagcaggcauu

SEQ ID NO: 1181327 - RNA, 19 nt, Homo sapiens
gaagggcaccagcagcauu

SEQ ID NO: 1181328 - RNA, 19 nt, Homo sapiens
gcaggacaguucuuuugua

SEQ ID NO: 1181329 - RNA, 19 nt, Homo sapiens
gaccggcucuuccaugagu

SEQ ID NO: 1181330 - RNA, 19 nt, Homo sapiens
cagcgugaagucugaaaua

SEQ ID NO: 1181331 - RNA, 19 nt, Homo sapiens
gaagaaccuggaguaauug

SEQ ID NO: 1181332 - RNA, 19 nt, Homo sapiens
cccgggaaauugcaccuua

SEQ ID NO: 1181333 - RNA, 19 nt, Homo sapiens
ccagugggcucagugaugu

SEQ ID NO: 1181334 - RNA, 19 nt, Homo sapiens
gcagcuuuguggaguaugu

SEQ ID NO: 1181335 - RNA, 19 nt, Homo sapiens
gagcagcacuucuuuuaca

SEQ ID NO: 1181336 - RNA, 19 nt, Homo sapiens
gcaagugccaguacaagca

SEQ ID NO: 1181337 - RNA, 19 nt, Homo sapiens
acaagaauuuccucaaguc

SEQ ID NO: 1181338 - RNA, 19 nt, Homo sapiens
cgugaagucugaaauaugc

SEQ ID NO: 1181339 - RNA, 19 nt, Homo sapiens
gaccuucaaccgcaaacua

SEQ ID NO: 1181340 - RNA, 19 nt, Homo sapiens
gcagagacgcuugagaugu

SEQ ID NO: 1181341 - RNA, 19 nt, Homo sapiens
cagggaagguggacacagu

SEQ ID NO: 1181342 - RNA, 19 nt, Homo sapiens
gugagacccucguggacaa

SEQ ID NO: 1181343 - RNA, 19 nt, Homo sapiens
augaggagcugguggcauu

SEQ ID NO: 1181344 - RNA, 19 nt, Homo sapiens
gcaccuguauuucuaugac

SEQ ID NO: 1181345 - RNA, 19 nt, Homo sapiens
agaauuuccucaagucaca

SEQ ID NO: 1181346 - RNA, 19 nt, Homo sapiens
gagaaacuagaacagaaga

SEQ ID NO: 1181347 - RNA, 19 nt, Homo sapiens
gugcugcccuugaccuuca

SEQ ID NO: 1181348 - RNA, 19 nt, Homo sapiens
agaagacucugucaagacu

SEQ ID NO: 1181349 - RNA, 19 nt, Homo sapiens
uggcauuccuauccaagaa

SEQ ID NO: 1181350 - RNA, 19 nt, Homo sapiens
gagcagcgugggaagaaga

SEQ ID NO: 1181351 - RNA, 19 nt, Homo sapiens
aacagaagaugugcaauag

SEQ ID NO: 1181352 - RNA, 19 nt, Homo sapiens
cuggagcccugcagacuga

SEQ ID NO: 1181353 - RNA, 19 nt, Homo sapiens
cuuaugacaucacaguaga

SEQ ID NO: 1181354 - RNA, 19 nt, Homo sapiens
ccagguucaucaagaaaca

SEQ ID NO: 1181355 - RNA, 19 nt, Homo sapiens
ggacaacuccagguucauc

SEQ ID NO: 1181356 - RNA, 19 nt, Homo sapiens
gcugaagcgucuccucaag

SEQ ID NO: 1181357 - RNA, 19 nt, Homo sapiens
caucaagaacccacacaga

SEQ ID NO: 1181358 - RNA, 19 nt, Homo sapiens
ggaucgacccaaccuaugu

SEQ ID NO: 1181359 - RNA, 19 nt, Homo sapiens
aagggucgcugaagcuguu

SEQ ID NO: 1181360 - RNA, 19 nt, Homo sapiens
cgggacaacuccagguuca

SEQ ID NO: 1181361 - RNA, 19 nt, Homo sapiens
ucacgagcagcacuucuuu

SEQ ID NO: 1181362 - RNA, 19 nt, Homo sapiens
agcaggagaucgccaaugu

SEQ ID NO: 1181363 - RNA, 19 nt, Homo sapiens
cagaagaaccuggaguaau

SEQ ID NO: 1181364 - RNA, 19 nt, Homo sapiens
gcccgaagaacaggugaua

SEQ ID NO: 1181365 - RNA, 19 nt, Homo sapiens
ccaaggacacagacaguuc

SEQ ID NO: 1181366 - RNA, 19 nt, Homo sapiens
uaugacaucacaguagaua

SEQ ID NO: 1181367 - RNA, 19 nt, Homo sapiens
ccagcgugcaccuguauuu

SEQ ID NO: 1181368 - RNA, 19 nt, Homo sapiens
gaaccgggacaagaauuuc

SEQ ID NO: 1181369 - RNA, 19 nt, Homo sapiens
ucagaagaaccuggaguaa

SEQ ID NO: 1181370 - RNA, 19 nt, Homo sapiens
caagaaccgggacaagaau

SEQ ID NO: 1181371 - RNA, 19 nt, Homo sapiens
ucaagacucucagaagaac

SEQ ID NO: 1181372 - RNA, 19 nt, Homo sapiens
gucaagacucucagaagaa

SEQ ID NO: 1181373 - RNA, 19 nt, Homo sapiens
acagggaacugagcagcuu

SEQ ID NO: 1181374 - RNA, 19 nt, Homo sapiens
gccugggacuucuucauca

SEQ ID NO: 1181375 - RNA, 19 nt, Homo sapiens
ccgaagaacaggugauauc

SEQ ID NO: 1181376 - RNA, 19 nt, Homo sapiens
guauuucuaugacgaccau

SEQ ID NO: 1181377 - RNA, 19 nt, Homo sapiens
caugcucacugcuuacaca

SEQ ID NO: 1181378 - RNA, 19 nt, Homo sapiens
caaggacacagacaguuca

SEQ ID NO: 1181379 - RNA, 19 nt, Homo sapiens
ccagccuccugacgaugua

SEQ ID NO: 1181380 - RNA, 19 nt, Homo sapiens
gggaagaagacucugucaa

SEQ ID NO: 1181381 - RNA, 19 nt, Homo sapiens
ggaagguggacacaguaug

SEQ ID NO: 1181382 - RNA, 19 nt, Homo sapiens
cggcagagacgcuugagau

SEQ ID NO: 1181383 - RNA, 19 nt, Homo sapiens
gggcaaggacgcacugucu

SEQ ID NO: 1181384 - RNA, 19 nt, Homo sapiens
gaucccagcaggcauugug

SEQ ID NO: 1181385 - RNA, 19 nt, Homo sapiens
gcugagcccaccugcuauu

SEQ ID NO: 1181386 - RNA, 19 nt, Homo sapiens
uugcugagcccaccugcua

SEQ ID NO: 1181387 - RNA, 19 nt, Homo sapiens
ccauuucagccaucaagaa

SEQ ID NO: 1181388 - RNA, 19 nt, Homo sapiens
guacauggagcagaguuuc

SEQ ID NO: 1181389 - RNA, 19 nt, Homo sapiens
caagaauuuccucaaguca

SEQ ID NO: 1181390 - RNA, 19 nt, Homo sapiens
gcgugaagucugaaauaug

SEQ ID NO: 1181391 - RNA, 19 nt, Homo sapiens
uagaacagaagaugugcaa

SEQ ID NO: 1181392 - RNA, 19 nt, Homo sapiens
aaacuagaacagaagaugu

SEQ ID NO: 1181393 - RNA, 19 nt, Homo sapiens
guggacacaguaugaacua

SEQ ID NO: 1181394 - RNA, 19 nt, Homo sapiens
acacggugcuggagaacag

SEQ ID NO: 1181395 - RNA, 19 nt, Homo sapiens
gagcugguggcauuccuau

SEQ ID NO: 1181396 - RNA, 19 nt, Homo sapiens
ggaguaauugugccugaag

SEQ ID NO: 1181397 - RNA, 19 nt, Homo sapiens
gaugucaugcucacugcuu

SEQ ID NO: 1181398 - RNA, 19 nt, Homo sapiens
guugggagagaaacuagaa

SEQ ID NO: 1181399 - RNA, 19 nt, Homo sapiens
gagagaagaugauguauaa

SEQ ID NO: 1181400 - RNA, 19 nt, Homo sapiens
ugacaaggauucaaacuua

SEQ ID NO: 1181401 - RNA, 19 nt, Homo sapiens
gagaauaacucaucagaau

SEQ ID NO: 1181402 - RNA, 19 nt, Homo sapiens
gaaaugguaucguguuauu

SEQ ID NO: 1181403 - RNA, 19 nt, Homo sapiens
gaaaucaucugcaaaugug

SEQ ID NO: 1181404 - RNA, 19 nt, Homo sapiens
gaagauccauuuaaagaga

SEQ ID NO: 1181405 - RNA, 19 nt, Homo sapiens
cuacagaacugacauaaga

SEQ ID NO: 1181406 - RNA, 19 nt, Homo sapiens
ggaaaugaaucagguguaa

SEQ ID NO: 1181407 - RNA, 19 nt, Homo sapiens
gaauaacccaucacuaaua

SEQ ID NO: 1181408 - RNA, 19 nt, Homo sapiens
gaagaaggucuggauauua

SEQ ID NO: 1181409 - RNA, 19 nt, Homo sapiens
gaacaaugauggugcacaa

SEQ ID NO: 1181410 - RNA, 19 nt, Homo sapiens
gaaauauugccaagcauua

SEQ ID NO: 1181411 - RNA, 19 nt, Homo sapiens
gcaaggaguuccaaccauu

SEQ ID NO: 1181412 - RNA, 19 nt, Homo sapiens
ggaaucagcacgaggaaua

SEQ ID NO: 1181413 - RNA, 19 nt, Homo sapiens
cagagaagauccauuuaaa

SEQ ID NO: 1181414 - RNA, 19 nt, Homo sapiens
gaagauauccauguaauug

SEQ ID NO: 1181415 - RNA, 19 nt, Homo sapiens
acagauagauuucucauga

SEQ ID NO: 1181416 - RNA, 19 nt, Homo sapiens
gagaagauccauuuaaaga

SEQ ID NO: 1181417 - RNA, 19 nt, Homo sapiens
gaggaacuguugacaauug

SEQ ID NO: 1181418 - RNA, 19 nt, Homo sapiens
ucaaggaacuuuacauugu

SEQ ID NO: 1181419 - RNA, 19 nt, Homo sapiens
gcacgaggaauaaucuuua

SEQ ID NO: 1181420 - RNA, 19 nt, Homo sapiens
cagaguggcuguuuacauu

SEQ ID NO: 1181421 - RNA, 19 nt, Homo sapiens
gcucaggccuuaccaaaug

SEQ ID NO: 1181422 - RNA, 19 nt, Homo sapiens
aagaaggucuggauauuaa

SEQ ID NO: 1181423 - RNA, 19 nt, Homo sapiens
gaaacuggaugaaacagau

SEQ ID NO: 1181424 - RNA, 19 nt, Homo sapiens
uaagaaguuugcagucaua

SEQ ID NO: 1181425 - RNA, 19 nt, Homo sapiens
ugacacaauucgaaugaua

SEQ ID NO: 1181426 - RNA, 19 nt, Homo sapiens
ggaagaauaucaucaucug

SEQ ID NO: 1181427 - RNA, 19 nt, Homo sapiens
gagaauuuaucacaaguug

SEQ ID NO: 1181428 - RNA, 19 nt, Homo sapiens
aaagaaagaugucgaaugg

SEQ ID NO: 1181429 - RNA, 19 nt, Homo sapiens
caacaaagaagcaguguau

SEQ ID NO: 1181430 - RNA, 19 nt, Homo sapiens
gauaagaaguuugcaguca

SEQ ID NO: 1181431 - RNA, 19 nt, Homo sapiens
gaaauaaugacaaggauuc

SEQ ID NO: 1181432 - RNA, 19 nt, Homo sapiens
acaauagacucaagaaaga

SEQ ID NO: 1181433 - RNA, 19 nt, Homo sapiens
augcagagauugagaauuu

SEQ ID NO: 1181434 - RNA, 19 nt, Homo sapiens
ggaugaaacagauagauuu

SEQ ID NO: 1181435 - RNA, 19 nt, Homo sapiens
uuagagacgucuuggauaa

SEQ ID NO: 1181436 - RNA, 19 nt, Homo sapiens
gaacugacauaagaaucaa

SEQ ID NO: 1181437 - RNA, 19 nt, Homo sapiens
gaaagaaagaugucgaaug

SEQ ID NO: 1181438 - RNA, 19 nt, Homo sapiens
gggaagauauccauguaau

SEQ ID NO: 1181439 - RNA, 19 nt, Homo sapiens
aagaauaacccaucacuaa

SEQ ID NO: 1181440 - RNA, 19 nt, Homo sapiens
agaaggaaaucgcaaagaa

SEQ ID NO: 1181441 - RNA, 19 nt, Homo sapiens
gaacucaacccuaugaaca

SEQ ID NO: 1181442 - RNA, 19 nt, Homo sapiens
gaauaacucaucagaauca

SEQ ID NO: 1181443 - RNA, 19 nt, Homo sapiens
gaaguuugcagucauagaa

SEQ ID NO: 1181444 - RNA, 19 nt, Homo sapiens
agaaagcaaugcagagauu

SEQ ID NO: 1181445 - RNA, 19 nt, Homo sapiens
caaugaggcccuacaaauu

SEQ ID NO: 1181446 - RNA, 19 nt, Homo sapiens
ucaaaugaguccaauguca

SEQ ID NO: 1181447 - RNA, 19 nt, Homo sapiens
aaugaggcccuacaaauua

SEQ ID NO: 1181448 - RNA, 19 nt, Homo sapiens
acaaagaagcaguguauaa

SEQ ID NO: 1181449 - RNA, 19 nt, Homo sapiens
gucaaguccugugauauua

SEQ ID NO: 1181450 - RNA, 19 nt, Homo sapiens
aagaaaugguaucguguua

SEQ ID NO: 1181451 - RNA, 19 nt, Homo sapiens
gaagaaaugguaucguguu

SEQ ID NO: 1181452 - RNA, 19 nt, Homo sapiens
gaugaaagucuuggacaua

SEQ ID NO: 1181453 - RNA, 19 nt, Homo sapiens
caaguccugugauauuauu

SEQ ID NO: 1181454 - RNA, 19 nt, Homo sapiens
gaacaugcaggcaguugaa

SEQ ID NO: 1181455 - RNA, 19 nt, Homo sapiens
gaaaaugcaucacgucaau

SEQ ID NO: 1181456 - RNA, 19 nt, Homo sapiens
gaauuacagaugcaaagua

SEQ ID NO: 1181457 - RNA, 19 nt, Homo sapiens
agaagaaggucuggauauu

SEQ ID NO: 1181458 - RNA, 19 nt, Homo sapiens
gauuagcacuugauugaag

SEQ ID NO: 1181459 - RNA, 19 nt, Homo sapiens
gaagcaguguauaauaaca

SEQ ID NO: 1181460 - RNA, 19 nt, Homo sapiens
aaagaagugugccgacuau

SEQ ID NO: 1181461 - RNA, 19 nt, Homo sapiens
gaacaugagacaguuaaug

SEQ ID NO: 1181462 - RNA, 19 nt, Homo sapiens
ugaaaaggcuggcugaaaa

SEQ ID NO: 1181463 - RNA, 19 nt, Homo sapiens
gaugaugaguauugugaug

SEQ ID NO: 1181464 - RNA, 19 nt, Homo sapiens
cauagaagaugauagugau

SEQ ID NO: 1181465 - RNA, 19 nt, Homo sapiens
ccagagaagauccauuuaa

SEQ ID NO: 1181466 - RNA, 19 nt, Homo sapiens
gaagacagaaaccggauug

SEQ ID NO: 1181467 - RNA, 19 nt, Homo sapiens
gagaagaugauguauaaag

SEQ ID NO: 1181468 - RNA, 19 nt, Homo sapiens
gugccaaucuugaugcauu

SEQ ID NO: 1181469 - RNA, 19 nt, Homo sapiens
gaagcaagccaaagcugaa

SEQ ID NO: 1181470 - RNA, 19 nt, Homo sapiens
caaagaagcaguguauaau

SEQ ID NO: 1181471 - RNA, 19 nt, Homo sapiens
gcacuugauugaagauucu

SEQ ID NO: 1181472 - RNA, 19 nt, Homo sapiens
gcagugugcuagccuguuc

SEQ ID NO: 1181473 - RNA, 19 nt, Homo sapiens
gccaagcauuacaagaaua

SEQ ID NO: 1181474 - RNA, 19 nt, Homo sapiens
gcagaacauuugaggaagu

SEQ ID NO: 1181475 - RNA, 19 nt, Homo sapiens
gacaaggauucaaacuuau

SEQ ID NO: 1181476 - RNA, 19 nt, Homo sapiens
caaccacaguucagccaaa

SEQ ID NO: 1181477 - RNA, 19 nt, Homo sapiens
cgagagaagaugauguaua

SEQ ID NO: 1181478 - RNA, 19 nt, Homo sapiens
ucacagugguucaggaguu

SEQ ID NO: 1181479 - RNA, 19 nt, Homo sapiens
cagaacauuugaggaagua

SEQ ID NO: 1181480 - RNA, 19 nt, Homo sapiens
aaaccuugaucaacugaaa

SEQ ID NO: 1181481 - RNA, 19 nt, Homo sapiens
guugucaaguccugugaua

SEQ ID NO: 1181482 - RNA, 19 nt, Homo sapiens
gaagugugccgacuaucaa

SEQ ID NO: 1181483 - RNA, 19 nt, Homo sapiens
gaugcaaaguauaauggaa

SEQ ID NO: 1181484 - RNA, 19 nt, Homo sapiens
ggaagauauccauguaauu

SEQ ID NO: 1181485 - RNA, 19 nt, Homo sapiens
caugaggcauuauuugaug

SEQ ID NO: 1181486 - RNA, 19 nt, Homo sapiens
caguacagcucaaauccuu

SEQ ID NO: 1181487 - RNA, 19 nt, Homo sapiens
agagaaauauugccaagca

SEQ ID NO: 1181488 - RNA, 19 nt, Homo sapiens
ggaguuaucgaacaugaga

SEQ ID NO: 1181489 - RNA, 19 nt, Homo sapiens
ucaaacccaugacacagaa

SEQ ID NO: 1181490 - RNA, 19 nt, Homo sapiens
gaaaagcugaccaaauuaa

SEQ ID NO: 1181491 - RNA, 19 nt, Homo sapiens
ugaagaugaggaugauuua

SEQ ID NO: 1181492 - RNA, 19 nt, Homo sapiens
gaagagaaagauaagaagu

SEQ ID NO: 1181493 - RNA, 19 nt, Homo sapiens
gaagaugaggaugauuuaa

SEQ ID NO: 1181494 - RNA, 19 nt, Homo sapiens
ugaguccaaugucagauuu

SEQ ID NO: 1181495 - RNA, 19 nt, Homo sapiens
caacaugggcagugauuca

SEQ ID NO: 1181496 - RNA, 19 nt, Homo sapiens
guggacaagcuucuaguua

SEQ ID NO: 1181497 - RNA, 19 nt, Homo sapiens
gguaucguguuauuggauu

SEQ ID NO: 1181498 - RNA, 19 nt, Homo sapiens
gaaugcuguuuauuuagug

SEQ ID NO: 1181499 - RNA, 19 nt, Homo sapiens
gaggagaccugacauguuu

SEQ ID NO: 1181500 - RNA, 19 nt, Homo sapiens
ggaaguggaucccauugaa

SEQ ID NO: 1181501 - RNA, 19 nt, Homo sapiens
agaaggagcuggugacaga

SEQ ID NO: 1181502 - RNA, 19 nt, Homo sapiens
ucaagugccucucagguaa

SEQ ID NO: 1181503 - RNA, 19 nt, Homo sapiens
ggauuucacccauuauuaa

SEQ ID NO: 1181504 - RNA, 19 nt, Homo sapiens
gcuccuaucucuccuaugu

SEQ ID NO: 1181505 - RNA, 19 nt, Homo sapiens
gcaauaaugucuguguuuc

SEQ ID NO: 1181506 - RNA, 19 nt, Homo sapiens
caauggagcuccuaucucu

SEQ ID NO: 1181507 - RNA, 19 nt, Homo sapiens
ccaggagucuucccaaguu

SEQ ID NO: 1181508 - RNA, 19 nt, Homo sapiens
aaacugggcugcuauaagg

SEQ ID NO: 1181509 - RNA, 19 nt, Homo sapiens
caaguggugucccucauga

SEQ ID NO: 1181510 - RNA, 19 nt, Homo sapiens
guuggagacucuaaggaua

SEQ ID NO: 1181511 - RNA, 19 nt, Homo sapiens
gggauuucacccauuauua

SEQ ID NO: 1181512 - RNA, 19 nt, Homo sapiens
gcacagaggaagagugaug

SEQ ID NO: 1181513 - RNA, 19 nt, Homo sapiens
ccagcaaggucuucaacaa

SEQ ID NO: 1181514 - RNA, 19 nt, Homo sapiens
ccacagauucuuccuauca

SEQ ID NO: 1181515 - RNA, 19 nt, Homo sapiens
ugaagaagguggagaacca

SEQ ID NO: 1181516 - RNA, 19 nt, Homo sapiens
gaaguggaucccauugaaa

SEQ ID NO: 1181517 - RNA, 19 nt, Homo sapiens
gugccaagcucuuugagau

SEQ ID NO: 1181518 - RNA, 19 nt, Homo sapiens
ggauagcgccucuuguuuc

SEQ ID NO: 1181519 - RNA, 19 nt, Homo sapiens
gggcagauccugguuaaug

SEQ ID NO: 1181520 - RNA, 19 nt, Homo sapiens
gggagcaccucaacuacug

SEQ ID NO: 1181521 - RNA, 19 nt, Homo sapiens
caacccggcugacuucauc

SEQ ID NO: 1181522 - RNA, 19 nt, Homo sapiens
caacaacccgccugucaug

SEQ ID NO: 1181523 - RNA, 19 nt, Homo sapiens
guucagggcugugcagaau

SEQ ID NO: 1181524 - RNA, 19 nt, Homo sapiens
caacccgccugucauguuc

SEQ ID NO: 1181525 - RNA, 19 nt, Homo sapiens
gagcuccuaucucuccuau

SEQ ID NO: 1181526 - RNA, 19 nt, Homo sapiens
gcaagucuacauucaugaa

SEQ ID NO: 1181527 - RNA, 19 nt, Homo sapiens
acacagggaugccaguugu

SEQ ID NO: 1181528 - RNA, 19 nt, Homo sapiens
ucguggagcuguccuauuc

SEQ ID NO: 1181529 - RNA, 19 nt, Homo sapiens
auaagacccuucucaagug

SEQ ID NO: 1181530 - RNA, 19 nt, Homo sapiens
gaagacccaacccuccuuu

SEQ ID NO: 1181531 - RNA, 19 nt, Homo sapiens
uauaagacccuucucaagu

SEQ ID NO: 1181532 - RNA, 19 nt, Homo sapiens
cgccaucccuguccucuug

SEQ ID NO: 1181533 - RNA, 19 nt, Homo sapiens
gccaagcucuuugagaugu

SEQ ID NO: 1181534 - RNA, 19 nt, Homo sapiens
gagcaugucuggcuuuccu

SEQ ID NO: 1181535 - RNA, 19 nt, Homo sapiens
ccacugcugcucauucaaa

SEQ ID NO: 1181536 - RNA, 19 nt, Homo sapiens
ucucagcccuacacacuug

SEQ ID NO: 1181537 - RNA, 19 nt, Homo sapiens
gaagagcagcccugagaag

SEQ ID NO: 1181538 - RNA, 19 nt, Homo sapiens
ccaugucccuccacuguuc

SEQ ID NO: 1181539 - RNA, 19 nt, Homo sapiens
gaacuggagaaugcacuuu

SEQ ID NO: 1181540 - RNA, 19 nt, Homo sapiens
ucaagaccauccccacuua

SEQ ID NO: 1181541 - RNA, 19 nt, Homo sapiens
caacaccggcugccucuuc

SEQ ID NO: 1181542 - RNA, 19 nt, Homo sapiens
ccagcacccucacacaguu

SEQ ID NO: 1181543 - RNA, 19 nt, Homo sapiens
gagcagcccugagaagaac

SEQ ID NO: 1181544 - RNA, 19 nt, Homo sapiens
agaaugggcugugcgcuau

SEQ ID NO: 1181545 - RNA, 19 nt, Homo sapiens
cugaggaccuuccgcaaga

SEQ ID NO: 1181546 - RNA, 19 nt, Homo sapiens
uggcaagucuacauucaug

SEQ ID NO: 1181547 - RNA, 19 nt, Homo sapiens
gcuggcaagucuacauuca

SEQ ID NO: 1181548 - RNA, 19 nt, Homo sapiens
ggaugccaguuguauuugu

SEQ ID NO: 1181549 - RNA, 19 nt, Homo sapiens
ccugacauguuuagaggaa

SEQ ID NO: 1181550 - RNA, 19 nt, Homo sapiens
caagcucuuugagauguuu

SEQ ID NO: 1181551 - RNA, 19 nt, Homo sapiens
cuacauucaugaacaucuu

SEQ ID NO: 1181552 - RNA, 19 nt, Homo sapiens
cagcacagaggaagaguga

SEQ ID NO: 1181553 - RNA, 19 nt, Homo sapiens
uccaacaccugcaugcaaa

SEQ ID NO: 1181554 - RNA, 19 nt, Homo sapiens
aagaagagcagcccugaga

SEQ ID NO: 1181555 - RNA, 19 nt, Homo sapiens
gaacaucuuggcaggauac

SEQ ID NO: 1181556 - RNA, 19 nt, Homo sapiens
gcacuagaucccuggaguu

SEQ ID NO: 1181557 - RNA, 19 nt, Homo sapiens
gguggccucuggcgaguau

SEQ ID NO: 1181558 - RNA, 19 nt, Homo sapiens
gcucagccguggacaucga

SEQ ID NO: 1181559 - RNA, 19 nt, Homo sapiens
gaugccaguuguauuugug

SEQ ID NO: 1181560 - RNA, 19 nt, Homo sapiens
cguauuaccuggccaagac

SEQ ID NO: 1181561 - RNA, 19 nt, Homo sapiens
gagauggcggucuucauga

SEQ ID NO: 1181562 - RNA, 19 nt, Homo sapiens
ggccuccucuaccugcaua

SEQ ID NO: 1181563 - RNA, 19 nt, Homo sapiens
guucaugucccacgugguu

SEQ ID NO: 1181564 - RNA, 19 nt, Homo sapiens
ccacaacccggcugacuuc

SEQ ID NO: 1181565 - RNA, 19 nt, Homo sapiens
ugccacagauucuuccuau

SEQ ID NO: 1181566 - RNA, 19 nt, Homo sapiens
ggaaccaacacaagcacaa

SEQ ID NO: 1181567 - RNA, 19 nt, Homo sapiens
gugcaauaaugucuguguu

SEQ ID NO: 1181568 - RNA, 19 nt, Homo sapiens
guaaacugggcugcuauaa

SEQ ID NO: 1181569 - RNA, 19 nt, Homo sapiens
ccuagacccuggcugacuu

SEQ ID NO: 1181570 - RNA, 19 nt, Homo sapiens
ggagaaccacaucacugaa

SEQ ID NO: 1181571 - RNA, 19 nt, Homo sapiens
cgaggagaccugacauguu

SEQ ID NO: 1181572 - RNA, 19 nt, Homo sapiens
cagggagucuggaaugaag

SEQ ID NO: 1181573 - RNA, 19 nt, Homo sapiens
uaaagggacucggcuugca

SEQ ID NO: 1181574 - RNA, 19 nt, Homo sapiens
gaagaaggagcuggugaca

SEQ ID NO: 1181575 - RNA, 19 nt, Homo sapiens
ggcagauccugguuaaugg

SEQ ID NO: 1181576 - RNA, 19 nt, Homo sapiens
ugaccacgcaccugaagaa

SEQ ID NO: 1181577 - RNA, 19 nt, Homo sapiens
ucaaacuucuguccauguc

SEQ ID NO: 1181578 - RNA, 19 nt, Homo sapiens
ccaaguugaugcgguuugu

SEQ ID NO: 1181579 - RNA, 19 nt, Homo sapiens
ggacuguuuuaaccuuaua

SEQ ID NO: 1181580 - RNA, 19 nt, Homo sapiens
gcgcuauggcugagaagaa

SEQ ID NO: 1181581 - RNA, 19 nt, Homo sapiens
ucuuugagauguuugacaa

SEQ ID NO: 1181582 - RNA, 19 nt, Homo sapiens
guuauaagacccuucucaa

SEQ ID NO: 1181583 - RNA, 19 nt, Homo sapiens
gugagaagcaggaggugaa

SEQ ID NO: 1181584 - RNA, 19 nt, Homo sapiens
ucauucugcuucugauuuc

SEQ ID NO: 1181585 - RNA, 19 nt, Homo sapiens
ggagugacaggcacauaca

SEQ ID NO: 1181586 - RNA, 19 nt, Homo sapiens
cccuacagguggccacuuu

SEQ ID NO: 1181587 - RNA, 19 nt, Homo sapiens
uagcgccucuuguuuccaa

SEQ ID NO: 1181588 - RNA, 19 nt, Homo sapiens
cccuggagcuggucaacaa

SEQ ID NO: 1181589 - RNA, 19 nt, Homo sapiens
uuauggauguugaaaugga

SEQ ID NO: 1181590 - RNA, 19 nt, Homo sapiens
uggcugacgugcccuuuca

SEQ ID NO: 1181591 - RNA, 19 nt, Homo sapiens
agagauggcggucuucaug

SEQ ID NO: 1181592 - RNA, 19 nt, Homo sapiens
gauagcgccucuuguuucc

SEQ ID NO: 1181593 - RNA, 19 nt, Homo sapiens
ccugucauguucuuugaug

SEQ ID NO: 1181594 - RNA, 19 nt, Homo sapiens
gcagacacacucagagcau

SEQ ID NO: 1181595 - RNA, 19 nt, Homo sapiens
gagaaccacaucacugaag

SEQ ID NO: 1181596 - RNA, 19 nt, Homo sapiens
uggagaaccacaucacuga

SEQ ID NO: 1181597 - RNA, 19 nt, Homo sapiens
ugaacaucuuggcaggaua

SEQ ID NO: 1181598 - RNA, 19 nt, Homo sapiens
gcucaucggccuccucuac

SEQ ID NO: 1181599 - RNA, 19 nt, Homo sapiens
ggagaaaguugaccagaaa

SEQ ID NO: 1181600 - RNA, 19 nt, Homo sapiens
gaaaguguaugagcugaua

SEQ ID NO: 1181601 - RNA, 19 nt, Homo sapiens
ugaaggaucugcagucuuu

SEQ ID NO: 1181602 - RNA, 19 nt, Homo sapiens
ccagaaagcuccagaauac

SEQ ID NO: 1181603 - RNA, 19 nt, Homo sapiens
ggaagaccgugaugucaaa

SEQ ID NO: 1181604 - RNA, 19 nt, Homo sapiens
uagagaagcucacugcauu

SEQ ID NO: 1181605 - RNA, 19 nt, Homo sapiens
gauagacgcuuuaaguaag

SEQ ID NO: 1181606 - RNA, 19 nt, Homo sapiens
acaccgagcugcuagaauu

SEQ ID NO: 1181607 - RNA, 19 nt, Homo sapiens
caucaaggcauacaucuuu

SEQ ID NO: 1181608 - RNA, 19 nt, Homo sapiens
ucacuuagcucaacucaac

SEQ ID NO: 1181609 - RNA, 19 nt, Homo sapiens
gaagcucuacgagaaauua

SEQ ID NO: 1181610 - RNA, 19 nt, Homo sapiens
gcagaucgauaacaucaag

SEQ ID NO: 1181611 - RNA, 19 nt, Homo sapiens
gcaaaggacagguuguuga

SEQ ID NO: 1181612 - RNA, 19 nt, Homo sapiens
gauaugagucuuucagcua

SEQ ID NO: 1181613 - RNA, 19 nt, Homo sapiens
gaugucaaagggcaaauua

SEQ ID NO: 1181614 - RNA, 19 nt, Homo sapiens
uacgagaaauuacgacuuu

SEQ ID NO: 1181615 - RNA, 19 nt, Homo sapiens
gagagcagcagauugauga

SEQ ID NO: 1181616 - RNA, 19 nt, Homo sapiens
ucgauaacaucaaggcaua

SEQ ID NO: 1181617 - RNA, 19 nt, Homo sapiens
gaagagggccguggagaga

SEQ ID NO: 1181618 - RNA, 19 nt, Homo sapiens
gcacccaccuugcuuaugc

SEQ ID NO: 1181619 - RNA, 19 nt, Homo sapiens
ccaccuugcuuaugcuuug

SEQ ID NO: 1181620 - RNA, 19 nt, Homo sapiens
caacaucacaucauucauc

SEQ ID NO: 1181621 - RNA, 19 nt, Homo sapiens
ugauagacgcuuuaaguaa

SEQ ID NO: 1181622 - RNA, 19 nt, Homo sapiens
gcaaagauucgagcaauag

SEQ ID NO: 1181623 - RNA, 19 nt, Homo sapiens
ucacucacauuacgaggaa

SEQ ID NO: 1181624 - RNA, 19 nt, Homo sapiens
ucagagaaaucggcccuuu

SEQ ID NO: 1181625 - RNA, 19 nt, Homo sapiens
gcugauagacgcuuuaagu

SEQ ID NO: 1181626 - RNA, 19 nt, Homo sapiens
agagagagcagcagauuga

SEQ ID NO: 1181627 - RNA, 19 nt, Homo sapiens
gaucugcagucuuucuauc

SEQ ID NO: 1181628 - RNA, 19 nt, Homo sapiens
gaauugaccacuauguugu

SEQ ID NO: 1181629 - RNA, 19 nt, Homo sapiens
caaaggacagguuguugaa

SEQ ID NO: 1181630 - RNA, 19 nt, Homo sapiens
gaguggaagugcagaaagu

SEQ ID NO: 1181631 - RNA, 19 nt, Homo sapiens
uagaggugcugacagagaa

SEQ ID NO: 1181632 - RNA, 19 nt, Homo sapiens
gaucagauacucagcuaca

SEQ ID NO: 1181633 - RNA, 19 nt, Homo sapiens
caagagagagcagcagauu

SEQ ID NO: 1181634 - RNA, 19 nt, Homo sapiens
gaccggauccgcugcugua

SEQ ID NO: 1181635 - RNA, 19 nt, Homo sapiens
gaagcucacugcauuugac

SEQ ID NO: 1181636 - RNA, 19 nt, Homo sapiens
ccaaggauaugagucuuuc

SEQ ID NO: 1181637 - RNA, 19 nt, Homo sapiens
gcucgguccuggaugagaa

SEQ ID NO: 1181638 - RNA, 19 nt, Homo sapiens
gaggaacccaccuguauca

SEQ ID NO: 1181639 - RNA, 19 nt, Homo sapiens
ucuaucagcuucacucaca

SEQ ID NO: 1181640 - RNA, 19 nt, Homo sapiens
gcugugaggagccaucuuu

SEQ ID NO: 1181641 - RNA, 19 nt, Homo sapiens
ugucaaagggcaaauuaaa

SEQ ID NO: 1181642 - RNA, 19 nt, Homo sapiens
cagcagauccacaacauca

SEQ ID NO: 1181643 - RNA, 19 nt, Homo sapiens
uggagaaaguugaccagaa

SEQ ID NO: 1181644 - RNA, 19 nt, Homo sapiens
ugcagagaaugaucagaua

SEQ ID NO: 1181645 - RNA, 19 nt, Homo sapiens
gagaagcucacugcauuug

SEQ ID NO: 1181646 - RNA, 19 nt, Homo sapiens
gcaaggacacgcugcucaa

SEQ ID NO: 1181647 - RNA, 19 nt, Homo sapiens
ugcaaagauucgagcaaua

SEQ ID NO: 1181648 - RNA, 19 nt, Homo sapiens
caaauacugagucugcaaa

SEQ ID NO: 1181649 - RNA, 19 nt, Homo sapiens
ucagcucgguccuggauga

SEQ ID NO: 1181650 - RNA, 19 nt, Homo sapiens
cgaccaggaugucccuuuc

SEQ ID NO: 1181651 - RNA, 19 nt, Homo sapiens
cagcagaucgauaacauca

SEQ ID NO: 1181652 - RNA, 19 nt, Homo sapiens
aaaguugcuugguuugaug

SEQ ID NO: 1181653 - RNA, 19 nt, Homo sapiens
ggaagugcagaaaguguau

SEQ ID NO: 1181654 - RNA, 19 nt, Homo sapiens
ucuauuaugugcaagaagu

SEQ ID NO: 1181655 - RNA, 19 nt, Homo sapiens
ggucuauuaugugcaagaa

SEQ ID NO: 1181656 - RNA, 19 nt, Homo sapiens
guagaggugcugacagaga

SEQ ID NO: 1181657 - RNA, 19 nt, Homo sapiens
ucccuggacuucagagaaa

SEQ ID NO: 1181658 - RNA, 19 nt, Homo sapiens
acacgcugcucaagagaga

SEQ ID NO: 1181659 - RNA, 19 nt, Homo sapiens
gggaagaccgugaugucaa

SEQ ID NO: 1181660 - RNA, 19 nt, Homo sapiens
gcgggucuauuaugugcaa

SEQ ID NO: 1181661 - RNA, 19 nt, Homo sapiens
ccagacagcccagcuccua

SEQ ID NO: 1181662 - RNA, 19 nt, Homo sapiens
gaccagaaagcuccagaau

SEQ ID NO: 1181663 - RNA, 19 nt, Homo sapiens
cagaacaaauacugagucu

SEQ ID NO: 1181664 - RNA, 19 nt, Homo sapiens
guggaagucaauaaacuaa

SEQ ID NO: 1181665 - RNA, 19 nt, Homo sapiens
agaauugaccacuauguug

SEQ ID NO: 1181666 - RNA, 19 nt, Homo sapiens
uaacaucaaggcauacauc

SEQ ID NO: 1181667 - RNA, 19 nt, Homo sapiens
uuaaaagucuuguccagaa

SEQ ID NO: 1181668 - RNA, 19 nt, Homo sapiens
aggaggaaauggagaggaa

SEQ ID NO: 1181669 - RNA, 19 nt, Homo sapiens
gagaaugaucagauacuca

SEQ ID NO: 1181670 - RNA, 19 nt, Homo sapiens
gagcugauagacgcuuuaa

SEQ ID NO: 1181671 - RNA, 19 nt, Homo sapiens
gaaagcuccagaauacauc

SEQ ID NO: 1181672 - RNA, 19 nt, Homo sapiens
gugaagcucuacgagaaau

SEQ ID NO: 1181673 - RNA, 19 nt, Homo sapiens
gaggaaauggagaggaaga

SEQ ID NO: 1181674 - RNA, 19 nt, Homo sapiens
uguccagacugugggaaua

SEQ ID NO: 1181675 - RNA, 19 nt, Homo sapiens
cccuugagauggacaguga

SEQ ID NO: 1181676 - RNA, 19 nt, Homo sapiens
gcagauccacaacaucaca

SEQ ID NO: 1181677 - RNA, 19 nt, Homo sapiens
caccacauccaagcaauuu

SEQ ID NO: 1181678 - RNA, 19 nt, Homo sapiens
cugauagacgcuuuaagua

SEQ ID NO: 1181679 - RNA, 19 nt, Homo sapiens
gcagcagauugaugagaag

SEQ ID NO: 1181680 - RNA, 19 nt, Homo sapiens
uacugagucugcaaagauu

SEQ ID NO: 1181681 - RNA, 19 nt, Homo sapiens
cugcuagaauugaccacua

SEQ ID NO: 1181682 - RNA, 19 nt, Homo sapiens
uccacaacaucacaucauu

SEQ ID NO: 1181683 - RNA, 19 nt, Homo sapiens
ugaugucacugccgaccaa

SEQ ID NO: 1181684 - RNA, 19 nt, Homo sapiens
ccaggacccuccaccacau

SEQ ID NO: 1181685 - RNA, 19 nt, Homo sapiens
cugcaaagauucgagcaau

SEQ ID NO: 1181686 - RNA, 19 nt, Homo sapiens
uagaauugaccacuauguu

SEQ ID NO: 1181687 - RNA, 19 nt, Homo sapiens
agguagaggugcugacaga

SEQ ID NO: 1181688 - RNA, 19 nt, Homo sapiens
gcccucugguuccugguaa

SEQ ID NO: 1181689 - RNA, 19 nt, Homo sapiens
caaagauucgagcaauaga

SEQ ID NO: 1181690 - RNA, 19 nt, Homo sapiens
gcucacugcauuugacaga

SEQ ID NO: 1181691 - RNA, 19 nt, Homo sapiens
ggaguuggaacgagaaagg

SEQ ID NO: 1181692 - RNA, 19 nt, Homo sapiens
aacaucacaucauucauca

SEQ ID NO: 1181693 - RNA, 19 nt, Homo sapiens
cacaacaucacaucauuca

SEQ ID NO: 1181694 - RNA, 19 nt, Homo sapiens
aaaggaaggaggaaaugga

SEQ ID NO: 1181695 - RNA, 19 nt, Homo sapiens
cagcuucacucacauuacg

SEQ ID NO: 1181696 - RNA, 19 nt, Homo sapiens
aagauucgagcaauagaaa

SEQ ID NO: 1181697 - RNA, 19 nt, Homo sapiens
agucagggacccaaggaua

SEQ ID NO: 1181698 - RNA, 19 nt, Homo sapiens
auaugagucuuucagcuau

SEQ ID NO: 1181699 - RNA, 19 nt, Homo sapiens
ggaugaaggugaaugacua

SEQ ID NO: 1181700 - RNA, 19 nt, Homo sapiens
ggacauuuccuaacaauuc

SEQ ID NO: 1181701 - RNA, 19 nt, Homo sapiens
gaaaucaguuacggacaaa

SEQ ID NO: 1181702 - RNA, 19 nt, Homo sapiens
ccaaaggaguggacauuuc

SEQ ID NO: 1181703 - RNA, 19 nt, Homo sapiens
ucacaaacgucuauuggau

SEQ ID NO: 1181704 - RNA, 19 nt, Homo sapiens
ugaaaucaguuacggacaa

SEQ ID NO: 1181705 - RNA, 19 nt, Homo sapiens
gugaaugacuaaagcuuug

SEQ ID NO: 1181706 - RNA, 19 nt, Homo sapiens
gaaggugaaugacuaaagc

SEQ ID NO: 1181707 - RNA, 19 nt, Homo sapiens
acaaacgucuauuggauga

SEQ ID NO: 1181708 - RNA, 19 nt, Homo sapiens
agaaauguuugcccugaaa

SEQ ID NO: 1181709 - RNA, 19 nt, Homo sapiens
gaguggacauuuccuaaca

SEQ ID NO: 1181710 - RNA, 19 nt, Homo sapiens
gcucgcauaugacaggaaa

SEQ ID NO: 1181711 - RNA, 19 nt, Homo sapiens
uuggauggcucgcauauga

SEQ ID NO: 1181712 - RNA, 19 nt, Homo sapiens
ccucggaccuguauaaucu

SEQ ID NO: 1181713 - RNA, 19 nt, Homo sapiens
gacuaaagcuuugcuacug

SEQ ID NO: 1181714 - RNA, 19 nt, Homo sapiens
gggcugaggauuccggaua

SEQ ID NO: 1181715 - RNA, 19 nt, Homo sapiens
ggaggaaggugggguaauu

SEQ ID NO: 1181716 - RNA, 19 nt, Homo sapiens
ggcuacaacuugaggagaa

SEQ ID NO: 1181717 - RNA, 19 nt, Homo sapiens
ggugaaugacuaaagcuuu

SEQ ID NO: 1181718 - RNA, 19 nt, Homo sapiens
gaugaaggugaaugacuaa

SEQ ID NO: 1181719 - RNA, 19 nt, Homo sapiens
acgcaaacacuuucacuuu

SEQ ID NO: 1181720 - RNA, 19 nt, Homo sapiens
gcuacaacuugaggagaaa

SEQ ID NO: 1181721 - RNA, 19 nt, Homo sapiens
ucuauuggaugaaggugaa

SEQ ID NO: 1181722 - RNA, 19 nt, Homo sapiens
cagaaauguuugcccugaa

SEQ ID NO: 1181723 - RNA, 19 nt, Homo sapiens
gacauuuccuaacaauucu

SEQ ID NO: 1181724 - RNA, 19 nt, Homo sapiens
guggacauuuccuaacaau

SEQ ID NO: 1181725 - RNA, 19 nt, Homo sapiens
guuccucggaccuguauaa

SEQ ID NO: 1181726 - RNA, 19 nt, Homo sapiens
gaaauguuugcccugaaau

SEQ ID NO: 1181727 - RNA, 19 nt, Homo sapiens
aaacgucuauuggaugaag

SEQ ID NO: 1181728 - RNA, 19 nt, Homo sapiens
gacaaaauguuggcuacaa

SEQ ID NO: 1181729 - RNA, 19 nt, Homo sapiens
ccaagacgcaaacacuuuc

SEQ ID NO: 1181730 - RNA, 19 nt, Homo sapiens
caagguuugguaauaaugu

SEQ ID NO: 1181731 - RNA, 19 nt, Homo sapiens
acaauucuguauggaggaa

SEQ ID NO: 1181732 - RNA, 19 nt, Homo sapiens
ggauggcucgcauaugaca

SEQ ID NO: 1181733 - RNA, 19 nt, Homo sapiens
agggcugccuguuuauuga

SEQ ID NO: 1181734 - RNA, 19 nt, Homo sapiens
gcugggcaaaucuuacuug

SEQ ID NO: 1181735 - RNA, 19 nt, Homo sapiens
guucacaaacgucuauugg

SEQ ID NO: 1181736 - RNA, 19 nt, Homo sapiens
ccuaacaauucuguaugga

SEQ ID NO: 1181737 - RNA, 19 nt, Homo sapiens
gacagcaggacguucacaa

SEQ ID NO: 1181738 - RNA, 19 nt, Homo sapiens
aaucuuacuuggcaucaac

SEQ ID NO: 1181739 - RNA, 19 nt, Homo sapiens
gagcugggcaaaucuuacu

SEQ ID NO: 1181740 - RNA, 19 nt, Homo sapiens
auaauguaguccccaaaua

SEQ ID NO: 1181741 - RNA, 19 nt, Homo sapiens
ggaguggacauuuccuaac

SEQ ID NO: 1181742 - RNA, 19 nt, Homo sapiens
ccaaggcauggcagacuga

SEQ ID NO: 1181743 - RNA, 19 nt, Homo sapiens
acagcaggacguucacaaa

SEQ ID NO: 1181744 - RNA, 19 nt, Homo sapiens
gacgcaaacacuuucacuu

SEQ ID NO: 1181745 - RNA, 19 nt, Homo sapiens
caaaggaguggacauuucc

SEQ ID NO: 1181746 - RNA, 19 nt, Homo sapiens
accaagacgcaaacacuuu

SEQ ID NO: 1181747 - RNA, 19 nt, Homo sapiens
ugacuaaagcuuugcuacu

SEQ ID NO: 1181748 - RNA, 19 nt, Homo sapiens
ugaaggugaaugacuaaag

SEQ ID NO: 1181749 - RNA, 19 nt, Homo sapiens
ggagaggaguugucaauaa

SEQ ID NO: 1181750 - RNA, 19 nt, Homo sapiens
gggcugagauccaguauug

SEQ ID NO: 1181751 - RNA, 19 nt, Homo sapiens
uggagaagcugcccaguua

SEQ ID NO: 1181752 - RNA, 19 nt, Homo sapiens
gaaacgcuaucuucacuga

SEQ ID NO: 1181753 - RNA, 19 nt, Homo sapiens
caaaggaugugguuucuca

SEQ ID NO: 1181754 - RNA, 19 nt, Homo sapiens
gcagaagcauaauuacuug

SEQ ID NO: 1181755 - RNA, 19 nt, Homo sapiens
acaaauccaucuugaauga

SEQ ID NO: 1181756 - RNA, 19 nt, Homo sapiens
ucaaagaccucaagaagca

SEQ ID NO: 1181757 - RNA, 19 nt, Homo sapiens
ccaaggaggcccugaauuu

SEQ ID NO: 1181758 - RNA, 19 nt, Homo sapiens
ucaagaaccuggagaagga

SEQ ID NO: 1181759 - RNA, 19 nt, Homo sapiens
guacaucacuuccaaaauu

SEQ ID NO: 1181760 - RNA, 19 nt, Homo sapiens
gcacaucaaugccaucaag

SEQ ID NO: 1181761 - RNA, 19 nt, Homo sapiens
ggaaguacacccucauuga

SEQ ID NO: 1181762 - RNA, 19 nt, Homo sapiens
caacaaaucgcucucauuc

SEQ ID NO: 1181763 - RNA, 19 nt, Homo sapiens
ugacuuugcucaugaaaug

SEQ ID NO: 1181764 - RNA, 19 nt, Homo sapiens
gaaaacaaauccaucuuga

SEQ ID NO: 1181765 - RNA, 19 nt, Homo sapiens
ggacuugguuuaugagaca

SEQ ID NO: 1181766 - RNA, 19 nt, Homo sapiens
guagugagaucaaccgaau

SEQ ID NO: 1181767 - RNA, 19 nt, Homo sapiens
cagacagacuggucguuua

SEQ ID NO: 1181768 - RNA, 19 nt, Homo sapiens
gcaccuuugugaccuauga

SEQ ID NO: 1181769 - RNA, 19 nt, Homo sapiens
gaaggaagccaccuacauc

SEQ ID NO: 1181770 - RNA, 19 nt, Homo sapiens
gaacacauuuggccugcau

SEQ ID NO: 1181771 - RNA, 19 nt, Homo sapiens
ggugagaccaacaggauua

SEQ ID NO: 1181772 - RNA, 19 nt, Homo sapiens
caaggagucuucauuaagg

SEQ ID NO: 1181773 - RNA, 19 nt, Homo sapiens
uagagcagaagcauaauua

SEQ ID NO: 1181774 - RNA, 19 nt, Homo sapiens
ccaagaagacauucaaaga

SEQ ID NO: 1181775 - RNA, 19 nt, Homo sapiens
ggcaagacauacaccauga

SEQ ID NO: 1181776 - RNA, 19 nt, Homo sapiens
ccaccuacaucaacaaauc

SEQ ID NO: 1181777 - RNA, 19 nt, Homo sapiens
ggaagaaagccaaguccaa

SEQ ID NO: 1181778 - RNA, 19 nt, Homo sapiens
ggagaaggaacuagcacua

SEQ ID NO: 1181779 - RNA, 19 nt, Homo sapiens
gacgggagcuggcaagaca

SEQ ID NO: 1181780 - RNA, 19 nt, Homo sapiens
uaaguuggauggaguucuu

SEQ ID NO: 1181781 - RNA, 19 nt, Homo sapiens
gagaggaguugucaauaac

SEQ ID NO: 1181782 - RNA, 19 nt, Homo sapiens
agauagagcagaagcauaa

SEQ ID NO: 1181783 - RNA, 19 nt, Homo sapiens
ccucaaggagucuucauua

SEQ ID NO: 1181784 - RNA, 19 nt, Homo sapiens
uaccaaaccugggaagaaa

SEQ ID NO: 1181785 - RNA, 19 nt, Homo sapiens
ccacugagccugccaucaa

SEQ ID NO: 1181786 - RNA, 19 nt, Homo sapiens
gaagccaccuacaucaaca

SEQ ID NO: 1181787 - RNA, 19 nt, Homo sapiens
uagaauggguacuaggaaa

SEQ ID NO: 1181788 - RNA, 19 nt, Homo sapiens
uugaggaguuuaagaauga

SEQ ID NO: 1181789 - RNA, 19 nt, Homo sapiens
ucaaggagguguucaacca

SEQ ID NO: 1181790 - RNA, 19 nt, Homo sapiens
ggaacuagcacuacucaag

SEQ ID NO: 1181791 - RNA, 19 nt, Homo sapiens
caacugagaauuacaagca

SEQ ID NO: 1181792 - RNA, 19 nt, Homo sapiens
ggauggaguucuucacgau

SEQ ID NO: 1181793 - RNA, 19 nt, Homo sapiens
ccucaucgccaguaccuua

SEQ ID NO: 1181794 - RNA, 19 nt, Homo sapiens
gcucaaagaccucaagaag

SEQ ID NO: 1181795 - RNA, 19 nt, Homo sapiens
ggauguugauggccaccua

SEQ ID NO: 1181796 - RNA, 19 nt, Homo sapiens
cagcacagcgaacacauuu

SEQ ID NO: 1181797 - RNA, 19 nt, Homo sapiens
caaacccaccgaugacuuu

SEQ ID NO: 1181798 - RNA, 19 nt, Homo sapiens
gcacagcgaacacauuugg

SEQ ID NO: 1181799 - RNA, 19 nt, Homo sapiens
aaaguaugaugcugagaga

SEQ ID NO: 1181800 - RNA, 19 nt, Homo sapiens
gagaagcugcccaguuaga

SEQ ID NO: 1181801 - RNA, 19 nt, Homo sapiens
ggacaaccuugcucaucuc

SEQ ID NO: 1181802 - RNA, 19 nt, Homo sapiens
gaagaugaccaggacaaau

SEQ ID NO: 1181803 - RNA, 19 nt, Homo sapiens
gacaaaagaagcauugaua

SEQ ID NO: 1181804 - RNA, 19 nt, Homo sapiens
aaacaucuauggagaagcu

SEQ ID NO: 1181805 - RNA, 19 nt, Homo sapiens
gcaacucccaccuacugua

SEQ ID NO: 1181806 - RNA, 19 nt, Homo sapiens
gagaagaugaccaggacaa

SEQ ID NO: 1181807 - RNA, 19 nt, Homo sapiens
gggagaagcaaggcaagua

SEQ ID NO: 1181808 - RNA, 19 nt, Homo sapiens
ugacaggaaugacuuugca

SEQ ID NO: 1181809 - RNA, 19 nt, Homo sapiens
auuaagggcuugucaguuc

SEQ ID NO: 1181810 - RNA, 19 nt, Homo sapiens
aagaugaccaggacaaauu

SEQ ID NO: 1181811 - RNA, 19 nt, Homo sapiens
cucaaggagucuucauuaa

SEQ ID NO: 1181812 - RNA, 19 nt, Homo sapiens
gaagaacgccccacacaug

SEQ ID NO: 1181813 - RNA, 19 nt, Homo sapiens
ccacacagcacaucaaugc

SEQ ID NO: 1181814 - RNA, 19 nt, Homo sapiens
caagaagacauucaaagag

SEQ ID NO: 1181815 - RNA, 19 nt, Homo sapiens
gacgagaucgacauaauca

SEQ ID NO: 1181816 - RNA, 19 nt, Homo sapiens
gauuauagccucccacacu

SEQ ID NO: 1181817 - RNA, 19 nt, Homo sapiens
cccaggacuugguuuauga

SEQ ID NO: 1181818 - RNA, 19 nt, Homo sapiens
gcagggacaggauaaaaua

SEQ ID NO: 1181819 - RNA, 19 nt, Homo sapiens
ggacgagaucgacauaauc

SEQ ID NO: 1181820 - RNA, 19 nt, Homo sapiens
ugagacaguugcaaaggau

SEQ ID NO: 1181821 - RNA, 19 nt, Homo sapiens
caaccgaauuuucaaagaa

SEQ ID NO: 1181822 - RNA, 19 nt, Homo sapiens
gagccugccaucaaugaaa

SEQ ID NO: 1181823 - RNA, 19 nt, Homo sapiens
acaaaucgcucucauuccu

SEQ ID NO: 1181824 - RNA, 19 nt, Homo sapiens
agacagacuggucguuuaa

SEQ ID NO: 1181825 - RNA, 19 nt, Homo sapiens
auaaucagccuuagacaga

SEQ ID NO: 1181826 - RNA, 19 nt, Homo sapiens
gagaccaacaggauuauag

SEQ ID NO: 1181827 - RNA, 19 nt, Homo sapiens
aaugagagccuguuugauc

SEQ ID NO: 1181828 - RNA, 19 nt, Homo sapiens
ugaacaggauugugucucu

SEQ ID NO: 1181829 - RNA, 19 nt, Homo sapiens
caaggaggcccugaauuuc

SEQ ID NO: 1181830 - RNA, 19 nt, Homo sapiens
agauugaugugaccaagga

SEQ ID NO: 1181831 - RNA, 19 nt, Homo sapiens
gaaguacacccucauugac

SEQ ID NO: 1181832 - RNA, 19 nt, Homo sapiens
cgacauaaucagccuuaga

SEQ ID NO: 1181833 - RNA, 19 nt, Homo sapiens
guaugaugcugagagaaug

SEQ ID NO: 1181834 - RNA, 19 nt, Homo sapiens
ucaauaaccaacagacaga

SEQ ID NO: 1181835 - RNA, 19 nt, Homo sapiens
ccacacaugccaucacugu

SEQ ID NO: 1181836 - RNA, 19 nt, Homo sapiens
gaccagcaacucccaccua

SEQ ID NO: 1181837 - RNA, 19 nt, Homo sapiens
gcucauggaauuugacauc

SEQ ID NO: 1181838 - RNA, 19 nt, Homo sapiens
gcaccuaguggaucagugu

SEQ ID NO: 1181839 - RNA, 19 nt, Homo sapiens
gaaaacaaggggcugauga

SEQ ID NO: 1181840 - RNA, 19 nt, Homo sapiens
gaagcaaggcaaguacgaa

SEQ ID NO: 1181841 - RNA, 19 nt, Homo sapiens
uggacgagaucgacauaau

SEQ ID NO: 1181842 - RNA, 19 nt, Homo sapiens
gacaaacaucuauggagaa

SEQ ID NO: 1181843 - RNA, 19 nt, Homo sapiens
caguucaccucacaaguca

SEQ ID NO: 1181844 - RNA, 19 nt, Homo sapiens
caagacauacaccaugaug

SEQ ID NO: 1181845 - RNA, 19 nt, Homo sapiens
gaggaguugucaauaacca

SEQ ID NO: 1181846 - RNA, 19 nt, Homo sapiens
uuugacaucugguacaaug

SEQ ID NO: 1181847 - RNA, 19 nt, Homo sapiens
gccagcaccuaguggauca

SEQ ID NO: 1181848 - RNA, 19 nt, Homo sapiens
agacuggucguuuaaguug

SEQ ID NO: 1181849 - RNA, 19 nt, Homo sapiens
gaacguaacccuucagaau

SEQ ID NO: 1181850 - RNA, 19 nt, Homo sapiens
cuggagaacuuuaaacuaa

SEQ ID NO: 1181851 - RNA, 19 nt, Homo sapiens
ggauugcuauuuaagauga

SEQ ID NO: 1181852 - RNA, 19 nt, Homo sapiens
gaagauuguuaaaguggaa

SEQ ID NO: 1181853 - RNA, 19 nt, Homo sapiens
agaaaugccugaagccaaa

SEQ ID NO: 1181854 - RNA, 19 nt, Homo sapiens
ugugauagcuguccuugaa

SEQ ID NO: 1181855 - RNA, 19 nt, Homo sapiens
cuaaagaacugugguagug

SEQ ID NO: 1181856 - RNA, 19 nt, Homo sapiens
gaaacucccucuggugaug

SEQ ID NO: 1181857 - RNA, 19 nt, Homo sapiens
ugacagaggagcagcauaa

SEQ ID NO: 1181858 - RNA, 19 nt, Homo sapiens
agagagacauuaacagguu

SEQ ID NO: 1181859 - RNA, 19 nt, Homo sapiens
gacauuaacagguuucuga

SEQ ID NO: 1181860 - RNA, 19 nt, Homo sapiens
gagcugcgcaguuucauug

SEQ ID NO: 1181861 - RNA, 19 nt, Homo sapiens
gaacugugguaguggagau

SEQ ID NO: 1181862 - RNA, 19 nt, Homo sapiens
gagagacauuaacagguuu

SEQ ID NO: 1181863 - RNA, 19 nt, Homo sapiens
uaaaguggaacaugaagaa

SEQ ID NO: 1181864 - RNA, 19 nt, Homo sapiens
gaaguuaaagaaucagaug

SEQ ID NO: 1181865 - RNA, 19 nt, Homo sapiens
gcauaagucuguggucauc

SEQ ID NO: 1181866 - RNA, 19 nt, Homo sapiens
gauagacucugaacguaac

SEQ ID NO: 1181867 - RNA, 19 nt, Homo sapiens
uagcuguccuugaagaauu

SEQ ID NO: 1181868 - RNA, 19 nt, Homo sapiens
gaagaauucaugaaagaag

SEQ ID NO: 1181869 - RNA, 19 nt, Homo sapiens
ucaaggacuuauucaugaa

SEQ ID NO: 1181870 - RNA, 19 nt, Homo sapiens
gaagggcuggguaauguug

SEQ ID NO: 1181871 - RNA, 19 nt, Homo sapiens
uuacacuccuguugaaguu

SEQ ID NO: 1181872 - RNA, 19 nt, Homo sapiens
gcagcugguuugaggaugu

SEQ ID NO: 1181873 - RNA, 19 nt, Homo sapiens
gaaguaaccgguuuuguga

SEQ ID NO: 1181874 - RNA, 19 nt, Homo sapiens
uucaaggacuuauucauga

SEQ ID NO: 1181875 - RNA, 19 nt, Homo sapiens
acacuccuguugaaguuaa

SEQ ID NO: 1181876 - RNA, 19 nt, Homo sapiens
ggauggagaugaaaaggaa

SEQ ID NO: 1181877 - RNA, 19 nt, Homo sapiens
caguaacgauagacucuga

SEQ ID NO: 1181878 - RNA, 19 nt, Homo sapiens
agccagagcugcgcaguuu

SEQ ID NO: 1181879 - RNA, 19 nt, Homo sapiens
aggauuggaugcaagcuuu

SEQ ID NO: 1181880 - RNA, 19 nt, Homo sapiens
ugauagcuguccuugaaga

SEQ ID NO: 1181881 - RNA, 19 nt, Homo sapiens
ggagauacuuuugaagauu

SEQ ID NO: 1181882 - RNA, 19 nt, Homo sapiens
ccaaaggguuguucuucuc

SEQ ID NO: 1181883 - RNA, 19 nt, Homo sapiens
gcuacaugcugcuuugagu

SEQ ID NO: 1181884 - RNA, 19 nt, Homo sapiens
uaucugagcagcugguuug

SEQ ID NO: 1181885 - RNA, 19 nt, Homo sapiens
acguaacccuucagaauau

SEQ ID NO: 1181886 - RNA, 19 nt, Homo sapiens
gucgauggauggagaugaa

SEQ ID NO: 1181887 - RNA, 19 nt, Homo sapiens
acaaagagagacauuaaca

SEQ ID NO: 1181888 - RNA, 19 nt, Homo sapiens
uacaugcugcuuugaguua

SEQ ID NO: 1181889 - RNA, 19 nt, Homo sapiens
aacguaacccuucagaaua

SEQ ID NO: 1181890 - RNA, 19 nt, Homo sapiens
uuaccgaguugguuguuau

SEQ ID NO: 1181891 - RNA, 19 nt, Homo sapiens
aguggaacaugaagaaaug

SEQ ID NO: 1181892 - RNA, 19 nt, Homo sapiens
uaaacuaaaggccauacaa

SEQ ID NO: 1181893 - RNA, 19 nt, Homo sapiens
cgauagacucugaacguaa

SEQ ID NO: 1181894 - RNA, 19 nt, Homo sapiens
gagauacuuuugaagauug

SEQ ID NO: 1181895 - RNA, 19 nt, Homo sapiens
cagaggagcagcauaaguc

SEQ ID NO: 1181896 - RNA, 19 nt, Homo sapiens
uguuacauguuccuaaaga

SEQ ID NO: 1181897 - RNA, 19 nt, Homo sapiens
uugaagggcuggguaaugu

SEQ ID NO: 1181898 - RNA, 19 nt, Homo sapiens
guuacauguuccuaaagaa

SEQ ID NO: 1181899 - RNA, 19 nt, Homo sapiens
ggaaguaaccgguuuugug

SEQ ID NO: 1181900 - RNA, 19 nt, Homo sapiens
acgauagacucugaacgua

SEQ ID NO: 1181901 - RNA, 19 nt, Homo sapiens
ggguuguucuucucuuuca

SEQ ID NO: 1181902 - RNA, 19 nt, Homo sapiens
guuaccgaguugguuguua

SEQ ID NO: 1181903 - RNA, 19 nt, Homo sapiens
gauguuguaugcccaaucc

SEQ ID NO: 1181904 - RNA, 19 nt, Homo sapiens
cgaguugguuguuauuacu

SEQ ID NO: 1181905 - RNA, 19 nt, Homo sapiens
cagccucaguucugcaaug

SEQ ID NO: 1181906 - RNA, 19 nt, Homo sapiens
cacauaaaauccuaucuga

SEQ ID NO: 1181907 - RNA, 19 nt, Homo sapiens
uggguaauguugcaucugu

SEQ ID NO: 1181908 - RNA, 19 nt, Homo sapiens
uuuaaauggugccaaagga

SEQ ID NO: 1181909 - RNA, 19 nt, Homo sapiens
gcaccaugacuucuuugug

SEQ ID NO: 1181910 - RNA, 19 nt, Homo sapiens
aaggguuguucuucucuuu

SEQ ID NO: 1181911 - RNA, 19 nt, Homo sapiens
cauacaagacacaaacaau

SEQ ID NO: 1181912 - RNA, 19 nt, Homo sapiens
cuaaaggccauacaagaca

SEQ ID NO: 1181913 - RNA, 19 nt, Homo sapiens
ccgcaaugcuccccucuuu

SEQ ID NO: 1181914 - RNA, 19 nt, Homo sapiens
aaggcaccaugacuucuuu

SEQ ID NO: 1181915 - RNA, 19 nt, Homo sapiens
cuucaaggacuuauucaug

SEQ ID NO: 1181916 - RNA, 19 nt, Homo sapiens
uuaacagguuucugagugu

SEQ ID NO: 1181917 - RNA, 19 nt, Homo sapiens
cugaaacaguaacgauaga

SEQ ID NO: 1181918 - RNA, 19 nt, Homo sapiens
uugcaucuguggagcuaaa

SEQ ID NO: 1181919 - RNA, 19 nt, Homo sapiens
cugcgcaguuucauugcua

SEQ ID NO: 1181920 - RNA, 19 nt, Homo sapiens
gauagcuguccuugaagaa

SEQ ID NO: 1181921 - RNA, 19 nt, Homo sapiens
aaacuaaaggccauacaag

SEQ ID NO: 1181922 - RNA, 19 nt, Homo sapiens
ugaauuggacaaguacauu

SEQ ID NO: 1181923 - RNA, 19 nt, Homo sapiens
agucuguggucaucgauug

SEQ ID NO: 1181924 - RNA, 19 nt, Homo sapiens
gagcagcugguuugaggau

SEQ ID NO: 1181925 - RNA, 19 nt, Homo sapiens
uggcacaaaugcagaaacu

SEQ ID NO: 1181926 - RNA, 19 nt, Homo sapiens
ccagagcugcgcaguuuca

SEQ ID NO: 1181927 - RNA, 19 nt, Homo sapiens
ugcaggaaguaaccgguuu

SEQ ID NO: 1181928 - RNA, 19 nt, Homo sapiens
gaaacaguaacgauagacu

SEQ ID NO: 1181929 - RNA, 19 nt, Homo sapiens
gcagcucccagccucaguu

SEQ ID NO: 1181930 - RNA, 19 nt, Homo sapiens
guuguaugcccaauccaaa

SEQ ID NO: 1181931 - RNA, 19 nt, Homo sapiens
caaggggccuggagaguca

SEQ ID NO: 1181932 - RNA, 19 nt, Homo sapiens
ccgaguugguuguuauuac

SEQ ID NO: 1181933 - RNA, 19 nt, Homo sapiens
guuugaggauguuguaugc

SEQ ID NO: 1181934 - RNA, 19 nt, Homo sapiens
ggccuggagagucacauaa

SEQ ID NO: 1181935 - RNA, 19 nt, Homo sapiens
gggccuggagagucacaua

SEQ ID NO: 1181936 - RNA, 19 nt, Homo sapiens
caaagagagacauuaacag

SEQ ID NO: 1181937 - RNA, 19 nt, Homo sapiens
uaaucuaccauccgaagug

SEQ ID NO: 1181938 - RNA, 19 nt, Homo sapiens
gaagcucuugaccaaaguu

SEQ ID NO: 1181939 - RNA, 19 nt, Homo sapiens
ccauacaagacacaaacaa

SEQ ID NO: 1181940 - RNA, 19 nt, Homo sapiens
gaggacggaagcccaagug

SEQ ID NO: 1181941 - RNA, 19 nt, Homo sapiens
gaggauuggaugcaagcuu

SEQ ID NO: 1181942 - RNA, 19 nt, Homo sapiens
gagccagagcugcgcaguu

SEQ ID NO: 1181943 - RNA, 19 nt, Homo sapiens
ucugcuacaugcugcuuug

SEQ ID NO: 1181944 - RNA, 19 nt, Homo sapiens
aaaggguuguucuucucuu

SEQ ID NO: 1181945 - RNA, 19 nt, Homo sapiens
gccuggagagucacauaaa

SEQ ID NO: 1181946 - RNA, 19 nt, Homo sapiens
gucuuaguguuugaaauug

SEQ ID NO: 1181947 - RNA, 19 nt, Homo sapiens
auaagucuguggucaucga

SEQ ID NO: 1181948 - RNA, 19 nt, Homo sapiens
uccaaaggguuguucuucu

SEQ ID NO: 1181949 - RNA, 19 nt, Homo sapiens
caauaaaccuuugugaaug

SEQ ID NO: 1181950 - RNA, 19 nt, Homo sapiens
ggagagugcuggugaaugg

SEQ ID NO: 1181951 - RNA, 19 nt, Homo sapiens
gcuauucccugcucccuuu

SEQ ID NO: 1181952 - RNA, 19 nt, Homo sapiens
ccaauaaaccuuugugaau

SEQ ID NO: 1181953 - RNA, 19 nt, Homo sapiens
gauggauccucuacaguga

SEQ ID NO: 1181954 - RNA, 19 nt, Homo sapiens
ccucgggacuccauaauau

SEQ ID NO: 1181955 - RNA, 19 nt, Homo sapiens
guacuuuccuuuccuuugg

SEQ ID NO: 1181956 - RNA, 19 nt, Homo sapiens
ggaggagagugcuggugaa

SEQ ID NO: 1181957 - RNA, 19 nt, Homo sapiens
ccagauggauccucuacag

SEQ ID NO: 1181958 - RNA, 19 nt, Homo sapiens
gaacugcccgagacacugu

SEQ ID NO: 1181959 - RNA, 19 nt, Homo sapiens
ccacuggccucuugaaagc

SEQ ID NO: 1181960 - RNA, 19 nt, Homo sapiens
caccugauccacacucuuu

SEQ ID NO: 1181961 - RNA, 19 nt, Homo sapiens
gaucuguugcuguuucuug

SEQ ID NO: 1181962 - RNA, 19 nt, Homo sapiens
gauccucuacagugacuaa

SEQ ID NO: 1181963 - RNA, 19 nt, Homo sapiens
aauaaaccuuugugaaugg

SEQ ID NO: 1181964 - RNA, 19 nt, Homo sapiens
ggaccagccgcgaaacuuc

SEQ ID NO: 1181965 - RNA, 19 nt, Homo sapiens
cuacagugacuaacccaaa

SEQ ID NO: 1181966 - RNA, 19 nt, Homo sapiens
ccaggcagggacccaauaa

SEQ ID NO: 1181967 - RNA, 19 nt, Homo sapiens
gggcuucccacucaugcua

SEQ ID NO: 1181968 - RNA, 19 nt, Homo sapiens
cuuuagggcugucaucugu

SEQ ID NO: 1181969 - RNA, 19 nt, Homo sapiens
ccaauaagaagcaccugau

SEQ ID NO: 1181970 - RNA, 19 nt, Homo sapiens
ccgaggcccagcccaauaa

SEQ ID NO: 1181971 - RNA, 19 nt, Homo sapiens
cuucaccacuggccguuug

SEQ ID NO: 1181972 - RNA, 19 nt, Homo sapiens
uuagggcugucaucuguuc

SEQ ID NO: 1181973 - RNA, 19 nt, Homo sapiens
cccaauaaaccuuugugaa

SEQ ID NO: 1181974 - RNA, 19 nt, Homo sapiens
gcagggacccaauaaaccu

SEQ ID NO: 1181975 - RNA, 19 nt, Homo sapiens
gguacuuuccuuuccuuug

SEQ ID NO: 1181976 - RNA, 19 nt, Homo sapiens
gcuucccacucaugcuauu

SEQ ID NO: 1181977 - RNA, 19 nt, Homo sapiens
ccauuccuccuccuccuuu

SEQ ID NO: 1181978 - RNA, 19 nt, Homo sapiens
caauaagaagcaccugauc

SEQ ID NO: 1181979 - RNA, 19 nt, Homo sapiens
gggacccaauaaaccuuug

SEQ ID NO: 1181980 - RNA, 19 nt, Homo sapiens
gaggagagugcuggugaau

SEQ ID NO: 1181981 - RNA, 19 nt, Homo sapiens
ccagggaugcucaggaaag

SEQ ID NO: 1181982 - RNA, 19 nt, Homo sapiens
ccacuggccguuugucucu

SEQ ID NO: 1181983 - RNA, 19 nt, Homo sapiens
ucgggacuccauaauauug

SEQ ID NO: 1181984 - RNA, 19 nt, Homo sapiens
aggcccagcccaauaagaa

SEQ ID NO: 1181985 - RNA, 19 nt, Homo sapiens
gggaccagccgcgaaacuu

SEQ ID NO: 1181986 - RNA, 19 nt, Homo sapiens
gaaagaggcugucagaaag

SEQ ID NO: 1181987 - RNA, 19 nt, Homo sapiens
gcaaugagaucuuaacaag

SEQ ID NO: 1181988 - RNA, 19 nt, Homo sapiens
guacagaaauaaacaguga

SEQ ID NO: 1181989 - RNA, 19 nt, Homo sapiens
caauaucccugguuucuuu

SEQ ID NO: 1181990 - RNA, 19 nt, Homo sapiens
ggacaugucugagagcuuu

SEQ ID NO: 1181991 - RNA, 19 nt, Homo sapiens
gcagugagauuuagagugu

SEQ ID NO: 1181992 - RNA, 19 nt, Homo sapiens
gaagaaugaugcugaaaca

SEQ ID NO: 1181993 - RNA, 19 nt, Homo sapiens
cagagcaacuugaaauuaa

SEQ ID NO: 1181994 - RNA, 19 nt, Homo sapiens
caagauggcugaaauaaaa

SEQ ID NO: 1181995 - RNA, 19 nt, Homo sapiens
gaaccagaaucagaaauga

SEQ ID NO: 1181996 - RNA, 19 nt, Homo sapiens
cuacucagcuaaagacuaa

SEQ ID NO: 1181997 - RNA, 19 nt, Homo sapiens
gcaaauugaugaugucaca

SEQ ID NO: 1181998 - RNA, 19 nt, Homo sapiens
ucacaaauguugcugaguu

SEQ ID NO: 1181999 - RNA, 19 nt, Homo sapiens
agaugaaggugaagaauuu

SEQ ID NO: 1182000 - RNA, 19 nt, Homo sapiens
ggaggcugcugucgauuaa

SEQ ID NO: 1182001 - RNA, 19 nt, Homo sapiens
gaaauucgagucuauacaa

SEQ ID NO: 1182002 - RNA, 19 nt, Homo sapiens
gcaguguuaucauguauug

SEQ ID NO: 1182003 - RNA, 19 nt, Homo sapiens
ugaaagugaucaugaaguu

SEQ ID NO: 1182004 - RNA, 19 nt, Homo sapiens
gacaagaccaaguggauua

SEQ ID NO: 1182005 - RNA, 19 nt, Homo sapiens
gcuaugaacuguugaagca

SEQ ID NO: 1182006 - RNA, 19 nt, Homo sapiens
gaaacaagcuaugcagaag

SEQ ID NO: 1182007 - RNA, 19 nt, Homo sapiens
gauaagauuccaaauguga

SEQ ID NO: 1182008 - RNA, 19 nt, Homo sapiens
aaucagauauggaagauga

SEQ ID NO: 1182009 - RNA, 19 nt, Homo sapiens
gaaauaaacagugaugaug

SEQ ID NO: 1182010 - RNA, 19 nt, Homo sapiens
ugaaagaggcugucagaaa

SEQ ID NO: 1182011 - RNA, 19 nt, Homo sapiens
gcugaaacauugcagaaau

SEQ ID NO: 1182012 - RNA, 19 nt, Homo sapiens
uuaaagaaguccacauaga

SEQ ID NO: 1182013 - RNA, 19 nt, Homo sapiens
cagaucagaugcugugaaa

SEQ ID NO: 1182014 - RNA, 19 nt, Homo sapiens
gagguggaauccuuuaaga

SEQ ID NO: 1182015 - RNA, 19 nt, Homo sapiens
aaggaaacacuucguauua

SEQ ID NO: 1182016 - RNA, 19 nt, Homo sapiens
auucauaggucaacaauug

SEQ ID NO: 1182017 - RNA, 19 nt, Homo sapiens
gccagagccuguaguauau

SEQ ID NO: 1182018 - RNA, 19 nt, Homo sapiens
aaacaaugauggcaggaaa

SEQ ID NO: 1182019 - RNA, 19 nt, Homo sapiens
aaacagcaaugcagugaga

SEQ ID NO: 1182020 - RNA, 19 nt, Homo sapiens
cacaaauguugcugaguua

SEQ ID NO: 1182021 - RNA, 19 nt, Homo sapiens
gaaagacuacuccacauca

SEQ ID NO: 1182022 - RNA, 19 nt, Homo sapiens
gaaauugcuuuguauuggu

SEQ ID NO: 1182023 - RNA, 19 nt, Homo sapiens
gauugaugaugauguguuu

SEQ ID NO: 1182024 - RNA, 19 nt, Homo sapiens
gaucagaugcugugaaaca

SEQ ID NO: 1182025 - RNA, 19 nt, Homo sapiens
ggaagaugguggccuuuua

SEQ ID NO: 1182026 - RNA, 19 nt, Homo sapiens
ggacuaaucaggaaugcuu

SEQ ID NO: 1182027 - RNA, 19 nt, Homo sapiens
gaaacacuucguauuacua

SEQ ID NO: 1182028 - RNA, 19 nt, Homo sapiens
ugaagcagauguccauuuc

SEQ ID NO: 1182029 - RNA, 19 nt, Homo sapiens
gagugugccugcucauaaa

SEQ ID NO: 1182030 - RNA, 19 nt, Homo sapiens
auuagaagaugccagaaua

SEQ ID NO: 1182031 - RNA, 19 nt, Homo sapiens
ggugugcccuuugugaaua

SEQ ID NO: 1182032 - RNA, 19 nt, Homo sapiens
gcaccaaggaugugaaaga

SEQ ID NO: 1182033 - RNA, 19 nt, Homo sapiens
gcccagugguuaaugcaua

SEQ ID NO: 1182034 - RNA, 19 nt, Homo sapiens
gaacucaguagccaucuug

SEQ ID NO: 1182035 - RNA, 19 nt, Homo sapiens
gccaagacuucccaagauu

SEQ ID NO: 1182036 - RNA, 19 nt, Homo sapiens
gacuggagcugcagaagga

SEQ ID NO: 1182037 - RNA, 19 nt, Homo sapiens
guauuacuauugcagguuu

SEQ ID NO: 1182038 - RNA, 19 nt, Homo sapiens
ggaaucaucgaaucuuuga

SEQ ID NO: 1182039 - RNA, 19 nt, Homo sapiens
ggagaggguaauagaauuu

SEQ ID NO: 1182040 - RNA, 19 nt, Homo sapiens
gaaaugaagaugagacuac

SEQ ID NO: 1182041 - RNA, 19 nt, Homo sapiens
ucugagagcuuuggagaaa

SEQ ID NO: 1182042 - RNA, 19 nt, Homo sapiens
ugaguuacuuguagauuug

SEQ ID NO: 1182043 - RNA, 19 nt, Homo sapiens
gaagagacugcuacagcua

SEQ ID NO: 1182044 - RNA, 19 nt, Homo sapiens
gaagaacacagaggugauu

SEQ ID NO: 1182045 - RNA, 19 nt, Homo sapiens
caauaacuccucucaguga

SEQ ID NO: 1182046 - RNA, 19 nt, Homo sapiens
uauggaagaugaugaggaa

SEQ ID NO: 1182047 - RNA, 19 nt, Homo sapiens
aaagauaggacaugucuga

SEQ ID NO: 1182048 - RNA, 19 nt, Homo sapiens
aaugagaucuuaacaaguc

SEQ ID NO: 1182049 - RNA, 19 nt, Homo sapiens
aaacagugaugaugagcaa

SEQ ID NO: 1182050 - RNA, 19 nt, Homo sapiens
ggaaacacuucguauuacu

SEQ ID NO: 1182051 - RNA, 19 nt, Homo sapiens
ucaacaggcuuaagugcaa

SEQ ID NO: 1182052 - RNA, 19 nt, Homo sapiens
gaaagaaagaacucaagau

SEQ ID NO: 1182053 - RNA, 19 nt, Homo sapiens
gagaugaaggugaagaauu

SEQ ID NO: 1182054 - RNA, 19 nt, Homo sapiens
gcaaugcagugagauuuag

SEQ ID NO: 1182055 - RNA, 19 nt, Homo sapiens
gaagaugagacuaccaaga

SEQ ID NO: 1182056 - RNA, 19 nt, Homo sapiens
ccaagacuucccaagauua

SEQ ID NO: 1182057 - RNA, 19 nt, Homo sapiens
ggccaagacuucccaagau

SEQ ID NO: 1182058 - RNA, 19 nt, Homo sapiens
ucaaaacacuucauuguga

SEQ ID NO: 1182059 - RNA, 19 nt, Homo sapiens
cgauccagcugauguaaga

SEQ ID NO: 1182060 - RNA, 19 nt, Homo sapiens
agacuacuccacaucauua

SEQ ID NO: 1182061 - RNA, 19 nt, Homo sapiens
gcaaacagcaaugcaguga

SEQ ID NO: 1182062 - RNA, 19 nt, Homo sapiens
gaugccaccuugacuacaa

SEQ ID NO: 1182063 - RNA, 19 nt, Homo sapiens
caaggaaacacuucguauu

SEQ ID NO: 1182064 - RNA, 19 nt, Homo sapiens
gaguaaugcuccuucaaca

SEQ ID NO: 1182065 - RNA, 19 nt, Homo sapiens
gaugaaugcccagugguua

SEQ ID NO: 1182066 - RNA, 19 nt, Homo sapiens
ggaguucauucauuaccuu

SEQ ID NO: 1182067 - RNA, 19 nt, Homo sapiens
gguacaauccugugacuga

SEQ ID NO: 1182068 - RNA, 19 nt, Homo sapiens
gcauuaccuuacaggauuu

SEQ ID NO: 1182069 - RNA, 19 nt, Homo sapiens
gaacuggugggacucugua

SEQ ID NO: 1182070 - RNA, 19 nt, Homo sapiens
gcaaggaaacacuucguau

SEQ ID NO: 1182071 - RNA, 19 nt, Homo sapiens
ggauaccagugaagaagga

SEQ ID NO: 1182072 - RNA, 19 nt, Homo sapiens
caaagucuacucagcuaaa

SEQ ID NO: 1182073 - RNA, 19 nt, Homo sapiens
uaucaggccuuaacaguac

SEQ ID NO: 1182074 - RNA, 19 nt, Homo sapiens
ccaagauuaucaggccuua

SEQ ID NO: 1182075 - RNA, 19 nt, Homo sapiens
gaagguacagaaauaaaca

SEQ ID NO: 1182076 - RNA, 19 nt, Homo sapiens
aaagaaagaacucaagaug

SEQ ID NO: 1182077 - RNA, 19 nt, Homo sapiens
caacaaggucuuaaugaca

SEQ ID NO: 1182078 - RNA, 19 nt, Homo sapiens
uaugagagcuauguccauu

SEQ ID NO: 1182079 - RNA, 19 nt, Homo sapiens
gaaguuagacgggcagugu

SEQ ID NO: 1182080 - RNA, 19 nt, Homo sapiens
gaugaugauguguuugaua

SEQ ID NO: 1182081 - RNA, 19 nt, Homo sapiens
caaaagaucuucugguucu

SEQ ID NO: 1182082 - RNA, 19 nt, Homo sapiens
gccagaaauucgagucuau

SEQ ID NO: 1182083 - RNA, 19 nt, Homo sapiens
guacaauccugugacugaa

SEQ ID NO: 1182084 - RNA, 19 nt, Homo sapiens
aagcagauguccauuucaa

SEQ ID NO: 1182085 - RNA, 19 nt, Homo sapiens
gaaagagacagagcaacuu

SEQ ID NO: 1182086 - RNA, 19 nt, Homo sapiens
uaacagagcugauuauugu

SEQ ID NO: 1182087 - RNA, 19 nt, Homo sapiens
guaccaaacugaacuuguu

SEQ ID NO: 1182088 - RNA, 19 nt, Homo sapiens
caacagugguucccuaguu

SEQ ID NO: 1182089 - RNA, 19 nt, Homo sapiens
ugagaaagcuugccaucca

SEQ ID NO: 1182090 - RNA, 19 nt, Homo sapiens
gaacuaggccacugguugu

SEQ ID NO: 1182091 - RNA, 19 nt, Homo sapiens
caguuaaucuugaccagaa

SEQ ID NO: 1182092 - RNA, 19 nt, Homo sapiens
gcuaauagaagccuuguuc

SEQ ID NO: 1182093 - RNA, 19 nt, Homo sapiens
gaaagcuugccauccauuu

SEQ ID NO: 1182094 - RNA, 19 nt, Homo sapiens
cagaacagauaaaaccuua

SEQ ID NO: 1182095 - RNA, 19 nt, Homo sapiens
gauaauccugcuaauagaa

SEQ ID NO: 1182096 - RNA, 19 nt, Homo sapiens
cagauggaccuuugagaaa

SEQ ID NO: 1182097 - RNA, 19 nt, Homo sapiens
guauuaacagagcugauua

SEQ ID NO: 1182098 - RNA, 19 nt, Homo sapiens
ccagauggaccuuugagaa

SEQ ID NO: 1182099 - RNA, 19 nt, Homo sapiens
ugauaauccugcuaauaga

SEQ ID NO: 1182100 - RNA, 19 nt, Homo sapiens
gugguucccuaguuuagaa

SEQ ID NO: 1182101 - RNA, 19 nt, Homo sapiens
gagaaagcuugccauccau

SEQ ID NO: 1182102 - RNA, 19 nt, Homo sapiens
guccuccacugguuagaaa

SEQ ID NO: 1182103 - RNA, 19 nt, Homo sapiens
aacagugguucccuaguuu

SEQ ID NO: 1182104 - RNA, 19 nt, Homo sapiens
auuauuguccugaguguua

SEQ ID NO: 1182105 - RNA, 19 nt, Homo sapiens
cugauaauccugcuaauag

SEQ ID NO: 1182106 - RNA, 19 nt, Homo sapiens
caaacugaacuuguugaaa

SEQ ID NO: 1182107 - RNA, 19 nt, Homo sapiens
ccugauaauccugcuaaua

SEQ ID NO: 1182108 - RNA, 19 nt, Homo sapiens
uuaacagagcugauuauug

SEQ ID NO: 1182109 - RNA, 19 nt, Homo sapiens
cguauuaacagagcugauu

SEQ ID NO: 1182110 - RNA, 19 nt, Homo sapiens
ccaaacugaacuuguugaa

SEQ ID NO: 1182111 - RNA, 19 nt, Homo sapiens
uaauucacauugcccugau

SEQ ID NO: 1182112 - RNA, 19 nt, Homo sapiens
acagugguucccuaguuua

SEQ ID NO: 1182113 - RNA, 19 nt, Homo sapiens
aacccugcauuacaguuaa

SEQ ID NO: 1182114 - RNA, 19 nt, Homo sapiens
gcugauuauuguccugagu

SEQ ID NO: 1182115 - RNA, 19 nt, Homo sapiens
cuuagaccguauuaacaga

SEQ ID NO: 1182116 - RNA, 19 nt, Homo sapiens
ugauuauuguccugagugu

SEQ ID NO: 1182117 - RNA, 19 nt, Homo sapiens
guauucuuagaccguauua

SEQ ID NO: 1182118 - RNA, 19 nt, Homo sapiens
gguauucuuagaccguauu

SEQ ID NO: 1182119 - RNA, 19 nt, Homo sapiens
gagaauagauuucauguuc

SEQ ID NO: 1182120 - RNA, 19 nt, Homo sapiens
gaagaucacuuugaaacua

SEQ ID NO: 1182121 - RNA, 19 nt, Homo sapiens
gagauuagccuggauauua

SEQ ID NO: 1182122 - RNA, 19 nt, Homo sapiens
ggacuuggcuaaugguuaa

SEQ ID NO: 1182123 - RNA, 19 nt, Homo sapiens
ggaaauguuugaugaaguu

SEQ ID NO: 1182124 - RNA, 19 nt, Homo sapiens
caaguuaggugauggcuuu

SEQ ID NO: 1182125 - RNA, 19 nt, Homo sapiens
agacaaagcucuugacaug

SEQ ID NO: 1182126 - RNA, 19 nt, Homo sapiens
ggaaugauauuuggcuuaa

SEQ ID NO: 1182127 - RNA, 19 nt, Homo sapiens
ugaauaugcucaaggauuu

SEQ ID NO: 1182128 - RNA, 19 nt, Homo sapiens
cagcaaagaucuugaaauc

SEQ ID NO: 1182129 - RNA, 19 nt, Homo sapiens
gaaagcugcugaacucuuc

SEQ ID NO: 1182130 - RNA, 19 nt, Homo sapiens
ccaguugggugaaauuuaa

SEQ ID NO: 1182131 - RNA, 19 nt, Homo sapiens
gcaaagaucuugaaaucac

SEQ ID NO: 1182132 - RNA, 19 nt, Homo sapiens
gaguaggucugauucauga

SEQ ID NO: 1182133 - RNA, 19 nt, Homo sapiens
gcagugccaugaagaacua

SEQ ID NO: 1182134 - RNA, 19 nt, Homo sapiens
gaucaucucuggcacaaca

SEQ ID NO: 1182135 - RNA, 19 nt, Homo sapiens
ucaaagagaugaugacuac

SEQ ID NO: 1182136 - RNA, 19 nt, Homo sapiens
gaucacaucuggauauuuu

SEQ ID NO: 1182137 - RNA, 19 nt, Homo sapiens
gaacuuaucgcuguuaaug

SEQ ID NO: 1182138 - RNA, 19 nt, Homo sapiens
cuacauaguuugugauuuc

SEQ ID NO: 1182139 - RNA, 19 nt, Homo sapiens
ccagaaagcugcugaacuc

SEQ ID NO: 1182140 - RNA, 19 nt, Homo sapiens
uaaaauggcuggagaagaa

SEQ ID NO: 1182141 - RNA, 19 nt, Homo sapiens
gaaaugcuaagaaugauga

SEQ ID NO: 1182142 - RNA, 19 nt, Homo sapiens
ggagcagucugucaaauag

SEQ ID NO: 1182143 - RNA, 19 nt, Homo sapiens
gaaagguuaucaagacaca

SEQ ID NO: 1182144 - RNA, 19 nt, Homo sapiens
ggaauggaaggaaagguua

SEQ ID NO: 1182145 - RNA, 19 nt, Homo sapiens
uaaagaaguucagcuauag

SEQ ID NO: 1182146 - RNA, 19 nt, Homo sapiens
ggucauuccucuccauuau

SEQ ID NO: 1182147 - RNA, 19 nt, Homo sapiens
ggacucaaaugguuacuac

SEQ ID NO: 1182148 - RNA, 19 nt, Homo sapiens
gaggagaaauuccagaaag

SEQ ID NO: 1182149 - RNA, 19 nt, Homo sapiens
gaaauacuauguggcuaug

SEQ ID NO: 1182150 - RNA, 19 nt, Homo sapiens
ggcuaaugguuaauacuua

SEQ ID NO: 1182151 - RNA, 19 nt, Homo sapiens
gagcaggcauauugcacua

SEQ ID NO: 1182152 - RNA, 19 nt, Homo sapiens
gaacuuggcagcucuccuu

SEQ ID NO: 1182153 - RNA, 19 nt, Homo sapiens
gaaggaaagguuaucaaga

SEQ ID NO: 1182154 - RNA, 19 nt, Homo sapiens
gaaauuuaauguggacuca

SEQ ID NO: 1182155 - RNA, 19 nt, Homo sapiens
gaagagagagcaggcauau

SEQ ID NO: 1182156 - RNA, 19 nt, Homo sapiens
gcaagaggugaaacuauuu

SEQ ID NO: 1182157 - RNA, 19 nt, Homo sapiens
ggaugggaccaacucauua

SEQ ID NO: 1182158 - RNA, 19 nt, Homo sapiens
gaugaaguuuccuauaaca

SEQ ID NO: 1182159 - RNA, 19 nt, Homo sapiens
agauuagccuggauauuaa

SEQ ID NO: 1182160 - RNA, 19 nt, Homo sapiens
agagagagcaggcauauug

SEQ ID NO: 1182161 - RNA, 19 nt, Homo sapiens
gaaguucagcuauagaaau

SEQ ID NO: 1182162 - RNA, 19 nt, Homo sapiens
gaauagauuucauguucca

SEQ ID NO: 1182163 - RNA, 19 nt, Homo sapiens
gaauguguguuuugaagua

SEQ ID NO: 1182164 - RNA, 19 nt, Homo sapiens
cacugaagcuacuugauuu

SEQ ID NO: 1182165 - RNA, 19 nt, Homo sapiens
gcaaugcuacccaguuuau

SEQ ID NO: 1182166 - RNA, 19 nt, Homo sapiens
ggacagaaggaauauuuca

SEQ ID NO: 1182167 - RNA, 19 nt, Homo sapiens
uacaggaaauguuugauga

SEQ ID NO: 1182168 - RNA, 19 nt, Homo sapiens
gaagauucaagauacauga

SEQ ID NO: 1182169 - RNA, 19 nt, Homo sapiens
caacagcaggauggaauua

SEQ ID NO: 1182170 - RNA, 19 nt, Homo sapiens
gaaaauuggggccucauua

SEQ ID NO: 1182171 - RNA, 19 nt, Homo sapiens
gaacuugaaggaggucuuu

SEQ ID NO: 1182172 - RNA, 19 nt, Homo sapiens
gaguuacccugcucaugaa

SEQ ID NO: 1182173 - RNA, 19 nt, Homo sapiens
gcacagcaaagaucuugaa

SEQ ID NO: 1182174 - RNA, 19 nt, Homo sapiens
ugcaagaggugaaacuauu

SEQ ID NO: 1182175 - RNA, 19 nt, Homo sapiens
gaaccacacacuucucaga

SEQ ID NO: 1182176 - RNA, 19 nt, Homo sapiens
aggcaaagcuggagugaca

SEQ ID NO: 1182177 - RNA, 19 nt, Homo sapiens
guuacuacaucguucacua

SEQ ID NO: 1182178 - RNA, 19 nt, Homo sapiens
augaagaacuacgagauua

SEQ ID NO: 1182179 - RNA, 19 nt, Homo sapiens
auccagagcugcaauuuga

SEQ ID NO: 1182180 - RNA, 19 nt, Homo sapiens
ucacugaagcuacuugauu

SEQ ID NO: 1182181 - RNA, 19 nt, Homo sapiens
cagaggaagauucaagaua

SEQ ID NO: 1182182 - RNA, 19 nt, Homo sapiens
gaacuaggaauggaaggaa

SEQ ID NO: 1182183 - RNA, 19 nt, Homo sapiens
gagacugacccuagacaaa

SEQ ID NO: 1182184 - RNA, 19 nt, Homo sapiens
ugccaaagguuaagacaau

SEQ ID NO: 1182185 - RNA, 19 nt, Homo sapiens
agaggaagauucaagauac

SEQ ID NO: 1182186 - RNA, 19 nt, Homo sapiens
aauaugaacugucaauguc

SEQ ID NO: 1182187 - RNA, 19 nt, Homo sapiens
guuaccuucuucaguauuu

SEQ ID NO: 1182188 - RNA, 19 nt, Homo sapiens
cuuacuaccuccaacauga

SEQ ID NO: 1182189 - RNA, 19 nt, Homo sapiens
gagagguaccuguggcaua

SEQ ID NO: 1182190 - RNA, 19 nt, Homo sapiens
gcaggcauauugcacuauc

SEQ ID NO: 1182191 - RNA, 19 nt, Homo sapiens
cgccucaccugaaauacua

SEQ ID NO: 1182192 - RNA, 19 nt, Homo sapiens
gaggaagauucaagauaca

SEQ ID NO: 1182193 - RNA, 19 nt, Homo sapiens
ucuugaagcuggccuguga

SEQ ID NO: 1182194 - RNA, 19 nt, Homo sapiens
ugaguuacuuggaaucguu

SEQ ID NO: 1182195 - RNA, 19 nt, Homo sapiens
cgacucaaauacaggaaau

SEQ ID NO: 1182196 - RNA, 19 nt, Homo sapiens
ggaaggaaagguuaucaag

SEQ ID NO: 1182197 - RNA, 19 nt, Homo sapiens
caauaugaacugucaaugu

SEQ ID NO: 1182198 - RNA, 19 nt, Homo sapiens
cugaaaaccucaagcguua

SEQ ID NO: 1182199 - RNA, 19 nt, Homo sapiens
ccagacaaacggaaucaaa

SEQ ID NO: 1182200 - RNA, 19 nt, Homo sapiens
aaacuguucuggaaacgau

SEQ ID NO: 1182201 - RNA, 19 nt, Homo sapiens
ggucugaguuacuuggaau

SEQ ID NO: 1182202 - RNA, 19 nt, Homo sapiens
gggaccaacucauuacaca

SEQ ID NO: 1182203 - RNA, 19 nt, Homo sapiens
uaacauucacagaggauuu

SEQ ID NO: 1182204 - RNA, 19 nt, Homo sapiens
acaauggaaugguggaaug

SEQ ID NO: 1182205 - RNA, 19 nt, Homo sapiens
caaacuggauuuaauugcu

SEQ ID NO: 1182206 - RNA, 19 nt, Homo sapiens
ucaccucucuggacuuugu

SEQ ID NO: 1182207 - RNA, 19 nt, Homo sapiens
gacuugggcucauaugaca

SEQ ID NO: 1182208 - RNA, 19 nt, Homo sapiens
agagguaccuguggcauau

SEQ ID NO: 1182209 - RNA, 19 nt, Homo sapiens
guaacaugcucgccuuucu

SEQ ID NO: 1182210 - RNA, 19 nt, Homo sapiens
gcugcaauuugaugacuau

SEQ ID NO: 1182211 - RNA, 19 nt, Homo sapiens
ggaaugguggaaugauauu

SEQ ID NO: 1182212 - RNA, 19 nt, Homo sapiens
ucucagugccaucuaguua

SEQ ID NO: 1182213 - RNA, 19 nt, Homo sapiens
gauuucauguuccauucuu

SEQ ID NO: 1182214 - RNA, 19 nt, Homo sapiens
gggucaagguguccaucua

SEQ ID NO: 1182215 - RNA, 19 nt, Homo sapiens
cuaguuaucacuucacuga

SEQ ID NO: 1182216 - RNA, 19 nt, Homo sapiens
cagaaggaauauuucagau

SEQ ID NO: 1182217 - RNA, 19 nt, Homo sapiens
caagaugacaaguaacaug

SEQ ID NO: 1182218 - RNA, 19 nt, Homo sapiens
gaucccaagaugacaagua

SEQ ID NO: 1182219 - RNA, 19 nt, Homo sapiens
ggaauaagcucuaucauau

SEQ ID NO: 1182220 - RNA, 19 nt, Homo sapiens
ggaguaccauuuaguaaua

SEQ ID NO: 1182221 - RNA, 19 nt, Homo sapiens
ucaacaagcucagaaauua

SEQ ID NO: 1182222 - RNA, 19 nt, Homo sapiens
gcaaguaguaugcaaauua

SEQ ID NO: 1182223 - RNA, 19 nt, Homo sapiens
cagaagagcuaugugaaua

SEQ ID NO: 1182224 - RNA, 19 nt, Homo sapiens
gaaguaauguggauuucuu

SEQ ID NO: 1182225 - RNA, 19 nt, Homo sapiens
uacagaagcuuucaaauga

SEQ ID NO: 1182226 - RNA, 19 nt, Homo sapiens
gaagagcuaugugaauauu

SEQ ID NO: 1182227 - RNA, 19 nt, Homo sapiens
uaauggagaugcacaauga

SEQ ID NO: 1182228 - RNA, 19 nt, Homo sapiens
caaacaaccuuggcuguaa

SEQ ID NO: 1182229 - RNA, 19 nt, Homo sapiens
gagcaaacccgucaagaaa

SEQ ID NO: 1182230 - RNA, 19 nt, Homo sapiens
gcaaagaacaacauuaaug

SEQ ID NO: 1182231 - RNA, 19 nt, Homo sapiens
gcauaugcauaaaggaaua

SEQ ID NO: 1182232 - RNA, 19 nt, Homo sapiens
cuaauaaucuugacacaga

SEQ ID NO: 1182233 - RNA, 19 nt, Homo sapiens
ccacuucacuaaccaaauu

SEQ ID NO: 1182234 - RNA, 19 nt, Homo sapiens
gaacaauccugugauaagu

SEQ ID NO: 1182235 - RNA, 19 nt, Homo sapiens
gcaggagauuuaauguaua

SEQ ID NO: 1182236 - RNA, 19 nt, Homo sapiens
ccaagaagccuccaauuug

SEQ ID NO: 1182237 - RNA, 19 nt, Homo sapiens
gaacucacaucuacaaugc

SEQ ID NO: 1182238 - RNA, 19 nt, Homo sapiens
gcaaagcugaaacugauua

SEQ ID NO: 1182239 - RNA, 19 nt, Homo sapiens
cauauggucugauuaguga

SEQ ID NO: 1182240 - RNA, 19 nt, Homo sapiens
gaauuagaaugacuugaga

SEQ ID NO: 1182241 - RNA, 19 nt, Homo sapiens
gaagacaaccaguggauga

SEQ ID NO: 1182242 - RNA, 19 nt, Homo sapiens
gcaccuagguuuaaaauau

SEQ ID NO: 1182243 - RNA, 19 nt, Homo sapiens
uugcagauguccaaacuua

SEQ ID NO: 1182244 - RNA, 19 nt, Homo sapiens
gcacaaugauuauucaaac

SEQ ID NO: 1182245 - RNA, 19 nt, Homo sapiens
gcagacugauuguauauag

SEQ ID NO: 1182246 - RNA, 19 nt, Homo sapiens
gaacaacauuaauggagau

SEQ ID NO: 1182247 - RNA, 19 nt, Homo sapiens
gaagacaucuguuuucgaa

SEQ ID NO: 1182248 - RNA, 19 nt, Homo sapiens
aaagaaagacuaccaagaa

SEQ ID NO: 1182249 - RNA, 19 nt, Homo sapiens
gcagauguccaaacuuaaa

SEQ ID NO: 1182250 - RNA, 19 nt, Homo sapiens
ggaaacguaacauggaaua

SEQ ID NO: 1182251 - RNA, 19 nt, Homo sapiens
gaacaauucguaacuagau

SEQ ID NO: 1182252 - RNA, 19 nt, Homo sapiens
uaaguuggaguaccauuua

SEQ ID NO: 1182253 - RNA, 19 nt, Homo sapiens
aagaggaccuggaagaauu

SEQ ID NO: 1182254 - RNA, 19 nt, Homo sapiens
ggaccuaaguauaaauauc

SEQ ID NO: 1182255 - RNA, 19 nt, Homo sapiens
gaaaguauuagacagaaga

SEQ ID NO: 1182256 - RNA, 19 nt, Homo sapiens
gaacguaccagguguuuac

SEQ ID NO: 1182257 - RNA, 19 nt, Homo sapiens
uagggagaguuuacacuua

SEQ ID NO: 1182258 - RNA, 19 nt, Homo sapiens
caaaguagcaugguaguau

SEQ ID NO: 1182259 - RNA, 19 nt, Homo sapiens
agaagagacuguuuggaaa

SEQ ID NO: 1182260 - RNA, 19 nt, Homo sapiens
caacagaaggaacuuuaaa

SEQ ID NO: 1182261 - RNA, 19 nt, Homo sapiens
gaacuaugcauugaacauu

SEQ ID NO: 1182262 - RNA, 19 nt, Homo sapiens
gcaacauugugucauuuau

SEQ ID NO: 1182263 - RNA, 19 nt, Homo sapiens
ccaaagaaguaauguggau

SEQ ID NO: 1182264 - RNA, 19 nt, Homo sapiens
aaaugaaucucgcuacaug

SEQ ID NO: 1182265 - RNA, 19 nt, Homo sapiens
ugucagcgguccaggcuua

SEQ ID NO: 1182266 - RNA, 19 nt, Homo sapiens
gaaguccugucgauucaau

SEQ ID NO: 1182267 - RNA, 19 nt, Homo sapiens
ggagcaaacccgucaagaa

SEQ ID NO: 1182268 - RNA, 19 nt, Homo sapiens
ccagguguuuacagauuua

SEQ ID NO: 1182269 - RNA, 19 nt, Homo sapiens
ucacaguccauuacaguua

SEQ ID NO: 1182270 - RNA, 19 nt, Homo sapiens
ugacuacuaucuuugcauu

SEQ ID NO: 1182271 - RNA, 19 nt, Homo sapiens
uaauguggauuucuuggaa

SEQ ID NO: 1182272 - RNA, 19 nt, Homo sapiens
ucaaauagccaaccaucaa

SEQ ID NO: 1182273 - RNA, 19 nt, Homo sapiens
cuaaccaaauuccuacuuu

SEQ ID NO: 1182274 - RNA, 19 nt, Homo sapiens
caacuucugcuauucauau

SEQ ID NO: 1182275 - RNA, 19 nt, Homo sapiens
ugaaauugcucaacuucug

SEQ ID NO: 1182276 - RNA, 19 nt, Homo sapiens
aaacugggaccuaaguaua

SEQ ID NO: 1182277 - RNA, 19 nt, Homo sapiens
cuaggcaguuuccaaagua

SEQ ID NO: 1182278 - RNA, 19 nt, Homo sapiens
ugaaucagcugcagucucu

SEQ ID NO: 1182279 - RNA, 19 nt, Homo sapiens
acaguaacauccagaguga

SEQ ID NO: 1182280 - RNA, 19 nt, Homo sapiens
uggaauaagcucuaucaua

SEQ ID NO: 1182281 - RNA, 19 nt, Homo sapiens
guacuaggcaguuuccaaa

SEQ ID NO: 1182282 - RNA, 19 nt, Homo sapiens
caacaagcucagaaauuaa

SEQ ID NO: 1182283 - RNA, 19 nt, Homo sapiens
gcuguaaccuauagaaucu

SEQ ID NO: 1182284 - RNA, 19 nt, Homo sapiens
gaauaguaguguauggaau

SEQ ID NO: 1182285 - RNA, 19 nt, Homo sapiens
gcaaacccgucaagaaagg

SEQ ID NO: 1182286 - RNA, 19 nt, Homo sapiens
gaauguuuguuguaaaugg

SEQ ID NO: 1182287 - RNA, 19 nt, Homo sapiens
acaccugggucaacucuuu

SEQ ID NO: 1182288 - RNA, 19 nt, Homo sapiens
ucucaguucucauucagua

SEQ ID NO: 1182289 - RNA, 19 nt, Homo sapiens
gcaagacauuccaaagaag

SEQ ID NO: 1182290 - RNA, 19 nt, Homo sapiens
gaacaacagaaggaacuuu

SEQ ID NO: 1182291 - RNA, 19 nt, Homo sapiens
gagcugguaugaaaucagu

SEQ ID NO: 1182292 - RNA, 19 nt, Homo sapiens
gaaugugugugagugugua

SEQ ID NO: 1182293 - RNA, 19 nt, Homo sapiens
gaaagaagagacuguuugg

SEQ ID NO: 1182294 - RNA, 19 nt, Homo sapiens
gguggauccugaacaacua

SEQ ID NO: 1182295 - RNA, 19 nt, Homo sapiens
gauagaagaggaccuggaa

SEQ ID NO: 1182296 - RNA, 19 nt, Homo sapiens
gagaguuuacacuuacuua

SEQ ID NO: 1182297 - RNA, 19 nt, Homo sapiens
guacaaaggcaaacagaca

SEQ ID NO: 1182298 - RNA, 19 nt, Homo sapiens
gauacagacagcuaacuuu

SEQ ID NO: 1182299 - RNA, 19 nt, Homo sapiens
gaagaggaccuggaagaau

SEQ ID NO: 1182300 - RNA, 19 nt, Homo sapiens
gguccaggcuuauuagaag

SEQ ID NO: 1182301 - RNA, 19 nt, Homo sapiens
caaagaaagacuaccaaga

SEQ ID NO: 1182302 - RNA, 19 nt, Homo sapiens
cuagaacugucaaauaaca

SEQ ID NO: 1182303 - RNA, 19 nt, Homo sapiens
caguguuacuucccaauuu

SEQ ID NO: 1182304 - RNA, 19 nt, Homo sapiens
ugagagucuuuacagcuua

SEQ ID NO: 1182305 - RNA, 19 nt, Homo sapiens
ugcaggagauuuaauguau

SEQ ID NO: 1182306 - RNA, 19 nt, Homo sapiens
cauccagagugacaaauug

SEQ ID NO: 1182307 - RNA, 19 nt, Homo sapiens
caaagaacaacauuaaugg

SEQ ID NO: 1182308 - RNA, 19 nt, Homo sapiens
ccacguaucagguuauaga

SEQ ID NO: 1182309 - RNA, 19 nt, Homo sapiens
cguauacuguaaaggguua

SEQ ID NO: 1182310 - RNA, 19 nt, Homo sapiens
aaacugucguauacuguaa

SEQ ID NO: 1182311 - RNA, 19 nt, Homo sapiens
gaaucucgcuacaugaucu

SEQ ID NO: 1182312 - RNA, 19 nt, Homo sapiens
aaagaaggaucucaaacuc

SEQ ID NO: 1182313 - RNA, 19 nt, Homo sapiens
uggaugacccagauaaaua

SEQ ID NO: 1182314 - RNA, 19 nt, Homo sapiens
cugcaaagcugaaacugau

SEQ ID NO: 1182315 - RNA, 19 nt, Homo sapiens
cauauauacuggaaccuau

SEQ ID NO: 1182316 - RNA, 19 nt, Homo sapiens
aaaguagcaugguaguauu

SEQ ID NO: 1182317 - RNA, 19 nt, Homo sapiens
caacauuaauggagaugca

SEQ ID NO: 1182318 - RNA, 19 nt, Homo sapiens
cagaaguccugucgauuca

SEQ ID NO: 1182319 - RNA, 19 nt, Homo sapiens
aaacacagcugcguaaaua

SEQ ID NO: 1182320 - RNA, 19 nt, Homo sapiens
ucaugaagcugcagaagaa

SEQ ID NO: 1182321 - RNA, 19 nt, Homo sapiens
ggaaucuggugcccugaaa

SEQ ID NO: 1182322 - RNA, 19 nt, Homo sapiens
gaccagagcacacaaaugg

SEQ ID NO: 1182323 - RNA, 19 nt, Homo sapiens
guaaggacuccaagaugua

SEQ ID NO: 1182324 - RNA, 19 nt, Homo sapiens
cguaaggacuccaagaugu

SEQ ID NO: 1182325 - RNA, 19 nt, Homo sapiens
cugcugagcuccaaagaug

SEQ ID NO: 1182326 - RNA, 19 nt, Homo sapiens
gcaaggaggagaacuacga

SEQ ID NO: 1182327 - RNA, 19 nt, Homo sapiens
ucaaggagcugcgggugaa

SEQ ID NO: 1182328 - RNA, 19 nt, Homo sapiens
uggaggaggucgccauuga

SEQ ID NO: 1182329 - RNA, 19 nt, Homo sapiens
ccucacgcaucacaccuua

SEQ ID NO: 1182330 - RNA, 19 nt, Homo sapiens
uucaggaucuguucuguuu

SEQ ID NO: 1182331 - RNA, 19 nt, Homo sapiens
ucaggaagaugcagaaagg

SEQ ID NO: 1182332 - RNA, 19 nt, Homo sapiens
caggaucuguucuguuuca

SEQ ID NO: 1182333 - RNA, 19 nt, Homo sapiens
acacagcugcguaaauaaa

SEQ ID NO: 1182334 - RNA, 19 nt, Homo sapiens
acacccagcucucagacaa

SEQ ID NO: 1182335 - RNA, 19 nt, Homo sapiens
caccauguaacacacaaua

SEQ ID NO: 1182336 - RNA, 19 nt, Homo sapiens
acccgcagcuguacaagaa

SEQ ID NO: 1182337 - RNA, 19 nt, Homo sapiens
acuccaagauguacaagga

SEQ ID NO: 1182338 - RNA, 19 nt, Homo sapiens
gcgacaacaccgacacuga

SEQ ID NO: 1182339 - RNA, 19 nt, Homo sapiens
ggaccagagcacacaaaug

SEQ ID NO: 1182340 - RNA, 19 nt, Homo sapiens
gcugcaaggaggagaacua

SEQ ID NO: 1182341 - RNA, 19 nt, Homo sapiens
gcauuguauuaguguuaga

SEQ ID NO: 1182342 - RNA, 19 nt, Homo sapiens
ggaggacacccagcucuca

SEQ ID NO: 1182343 - RNA, 19 nt, Homo sapiens
gcauggaggagaaggagau

SEQ ID NO: 1182344 - RNA, 19 nt, Homo sapiens
gcaccagagugaggagaag

SEQ ID NO: 1182345 - RNA, 19 nt, Homo sapiens
uaacacacaauacaugcau

SEQ ID NO: 1182346 - RNA, 19 nt, Homo sapiens
cgccaucuguguaacuuca

SEQ ID NO: 1182347 - RNA, 19 nt, Homo sapiens
ucgcugacuuggccuggaa

SEQ ID NO: 1182348 - RNA, 19 nt, Homo sapiens
gcaagcacacgcugaagcu

SEQ ID NO: 1182349 - RNA, 19 nt, Homo sapiens
gcucaagcacagccucaug

SEQ ID NO: 1182350 - RNA, 19 nt, Homo sapiens
cugaggccaugucggacua

SEQ ID NO: 1182351 - RNA, 19 nt, Homo sapiens
gagcaggccaacaccaucu

SEQ ID NO: 1182352 - RNA, 19 nt, Homo sapiens
gucaugaagcugcagaaga

SEQ ID NO: 1182353 - RNA, 19 nt, Homo sapiens
ucuacuacccgcagcugua

SEQ ID NO: 1182354 - RNA, 19 nt, Homo sapiens
caaccuggucauccgcaaa

SEQ ID NO: 1182355 - RNA, 19 nt, Homo sapiens
gcugucccgucaggccaua

SEQ ID NO: 1182356 - RNA, 19 nt, Homo sapiens
gagcuccaaagaugacuuc

SEQ ID NO: 1182357 - RNA, 19 nt, Homo sapiens
gaggaggaccgggagaaca

SEQ ID NO: 1182358 - RNA, 19 nt, Homo sapiens
ccugagcuccgaccuggaa

SEQ ID NO: 1182359 - RNA, 19 nt, Homo sapiens
ucaagcacagccucaugaa

SEQ ID NO: 1182360 - RNA, 19 nt, Homo sapiens
cuguguaacuucaggaucu

SEQ ID NO: 1182361 - RNA, 19 nt, Homo sapiens
uggaggagaaggagauguu

SEQ ID NO: 1182362 - RNA, 19 nt, Homo sapiens
accugcagcuggagauuga

SEQ ID NO: 1182363 - RNA, 19 nt, Homo sapiens
gcaugcauuguauuagugu

SEQ ID NO: 1182364 - RNA, 19 nt, Homo sapiens
aaacacagcugcguaaaua

SEQ ID NO: 1182365 - RNA, 19 nt, Homo sapiens
ucaugaagcugcagaagaa

SEQ ID NO: 1182366 - RNA, 19 nt, Homo sapiens
ggaaucuggugcccugaaa

SEQ ID NO: 1182367 - RNA, 19 nt, Homo sapiens
guaaggacuccaagaugua

SEQ ID NO: 1182368 - RNA, 19 nt, Homo sapiens
cguaaggacuccaagaugu

SEQ ID NO: 1182369 - RNA, 19 nt, Homo sapiens
cugcugagcuccaaagaug

SEQ ID NO: 1182370 - RNA, 19 nt, Homo sapiens
gcaaggaggagaacuacga

SEQ ID NO: 1182371 - RNA, 19 nt, Homo sapiens
ucaaggagcugcgggugaa

SEQ ID NO: 1182372 - RNA, 19 nt, Homo sapiens
uggaggaggucgccauuga

SEQ ID NO: 1182373 - RNA, 19 nt, Homo sapiens
ccucacgcaucacaccuua

SEQ ID NO: 1182374 - RNA, 19 nt, Homo sapiens
uucaggaucuguucuguuu

SEQ ID NO: 1182375 - RNA, 19 nt, Homo sapiens
ucaggaagaugcagaaagg

SEQ ID NO: 1182376 - RNA, 19 nt, Homo sapiens
caggaucuguucuguuuca

SEQ ID NO: 1182377 - RNA, 19 nt, Homo sapiens
acacagcugcguaaauaaa

SEQ ID NO: 1182378 - RNA, 19 nt, Homo sapiens
acacccagcucucagacaa

SEQ ID NO: 1182379 - RNA, 19 nt, Homo sapiens
caccauguaacacacaaua

SEQ ID NO: 1182380 - RNA, 19 nt, Homo sapiens
acccgcagcuguacaagaa

SEQ ID NO: 1182381 - RNA, 19 nt, Homo sapiens
acuccaagauguacaagga

SEQ ID NO: 1182382 - RNA, 19 nt, Homo sapiens
gcgacaacaccgacacuga

SEQ ID NO: 1182383 - RNA, 19 nt, Homo sapiens
gcugcaaggaggagaacua

SEQ ID NO: 1182384 - RNA, 19 nt, Homo sapiens
acaugcaugcacuguauua

SEQ ID NO: 1182385 - RNA, 19 nt, Homo sapiens
ggaggacacccagcucuca

SEQ ID NO: 1182386 - RNA, 19 nt, Homo sapiens
gcauggaggagaaggagau

SEQ ID NO: 1182387 - RNA, 19 nt, Homo sapiens
gcaccagagugaggagaag

SEQ ID NO: 1182388 - RNA, 19 nt, Homo sapiens
uaacacacaauacaugcau

SEQ ID NO: 1182389 - RNA, 19 nt, Homo sapiens
ccugaacccugaugaugag

SEQ ID NO: 1182390 - RNA, 19 nt, Homo sapiens
cgccaucuguguaacuuca

SEQ ID NO: 1182391 - RNA, 19 nt, Homo sapiens
ucgcugacuuggccuggaa

SEQ ID NO: 1182392 - RNA, 19 nt, Homo sapiens
gcaagcacacgcugaagcu

SEQ ID NO: 1182393 - RNA, 19 nt, Homo sapiens
gcucaagcacagccucaug

SEQ ID NO: 1182394 - RNA, 19 nt, Homo sapiens
cugaggccaugucggacua

SEQ ID NO: 1182395 - RNA, 19 nt, Homo sapiens
gagcaggccaacaccaucu

SEQ ID NO: 1182396 - RNA, 19 nt, Homo sapiens
gucaugaagcugcagaaga

SEQ ID NO: 1182397 - RNA, 19 nt, Homo sapiens
ucuacuacccgcagcugua

SEQ ID NO: 1182398 - RNA, 19 nt, Homo sapiens
caaccuggucauccgcaaa

SEQ ID NO: 1182399 - RNA, 19 nt, Homo sapiens
gagcuccaaagaugacuuc

SEQ ID NO: 1182400 - RNA, 19 nt, Homo sapiens
gaggaggaccgggagaaca

SEQ ID NO: 1182401 - RNA, 19 nt, Homo sapiens
ccugagcuccgaccuggaa

SEQ ID NO: 1182402 - RNA, 19 nt, Homo sapiens
ucaagcacagccucaugaa

SEQ ID NO: 1182403 - RNA, 19 nt, Homo sapiens
cuguguaacuucaggaucu

SEQ ID NO: 1182404 - RNA, 19 nt, Homo sapiens
uggaggagaaggagauguu

SEQ ID NO: 1182405 - RNA, 19 nt, Homo sapiens
accugcagcuggagauuga

SEQ ID NO: 1182406 - RNA, 19 nt, Homo sapiens
aaacacagcugcguaaaua

SEQ ID NO: 1182407 - RNA, 19 nt, Homo sapiens
ucaugaagcugcagaagaa

SEQ ID NO: 1182408 - RNA, 19 nt, Homo sapiens
guaaggacuccaagaugua

SEQ ID NO: 1182409 - RNA, 19 nt, Homo sapiens
cguaaggacuccaagaugu

SEQ ID NO: 1182410 - RNA, 19 nt, Homo sapiens
cugcugagcuccaaagaug

SEQ ID NO: 1182411 - RNA, 19 nt, Homo sapiens
gcaaggaggagaacuacga

SEQ ID NO: 1182412 - RNA, 19 nt, Homo sapiens
ucaaggagcugcgggugaa

SEQ ID NO: 1182413 - RNA, 19 nt, Homo sapiens
uggaggaggucgccauuga

SEQ ID NO: 1182414 - RNA, 19 nt, Homo sapiens
ccucacgcaucacaccuua

SEQ ID NO: 1182415 - RNA, 19 nt, Homo sapiens
uucaggaucuguucuguuu

SEQ ID NO: 1182416 - RNA, 19 nt, Homo sapiens
caggaucuguucuguuuca

SEQ ID NO: 1182417 - RNA, 19 nt, Homo sapiens
acacagcugcguaaauaaa

SEQ ID NO: 1182418 - RNA, 19 nt, Homo sapiens
acacccagcucucagacaa

SEQ ID NO: 1182419 - RNA, 19 nt, Homo sapiens
caccauguaacacacaaua

SEQ ID NO: 1182420 - RNA, 19 nt, Homo sapiens
acccgcagcuguacaagaa

SEQ ID NO: 1182421 - RNA, 19 nt, Homo sapiens
acuccaagauguacaagga

SEQ ID NO: 1182422 - RNA, 19 nt, Homo sapiens
gcugcaaggaggagaacua

SEQ ID NO: 1182423 - RNA, 19 nt, Homo sapiens
ggaggacacccagcucuca

SEQ ID NO: 1182424 - RNA, 19 nt, Homo sapiens
gcauggaggagaaggagau

SEQ ID NO: 1182425 - RNA, 19 nt, Homo sapiens
gcaccagagugaggagaag

SEQ ID NO: 1182426 - RNA, 19 nt, Homo sapiens
uaacacacaauacaugcau

SEQ ID NO: 1182427 - RNA, 19 nt, Homo sapiens
cgccaucuguguaacuuca

SEQ ID NO: 1182428 - RNA, 19 nt, Homo sapiens
gcaagcacacgcugaagcu

SEQ ID NO: 1182429 - RNA, 19 nt, Homo sapiens
gcucaagcacagccucaug

SEQ ID NO: 1182430 - RNA, 19 nt, Homo sapiens
cugaggccaugucggacua

SEQ ID NO: 1182431 - RNA, 19 nt, Homo sapiens
gagcaggccaacaccaucu

SEQ ID NO: 1182432 - RNA, 19 nt, Homo sapiens
gucaugaagcugcagaaga

SEQ ID NO: 1182433 - RNA, 19 nt, Homo sapiens
ucuacuacccgcagcugua

SEQ ID NO: 1182434 - RNA, 19 nt, Homo sapiens
gagcuccaaagaugacuuc

SEQ ID NO: 1182435 - RNA, 19 nt, Homo sapiens
caaccuggucauccgcaaa

SEQ ID NO: 1182436 - RNA, 19 nt, Homo sapiens
ccugagcuccgaccuggaa

SEQ ID NO: 1182437 - RNA, 19 nt, Homo sapiens
ucaagcacagccucaugaa

SEQ ID NO: 1182438 - RNA, 19 nt, Homo sapiens
cuguguaacuucaggaucu

SEQ ID NO: 1182439 - RNA, 19 nt, Homo sapiens
uggaggagaaggagauguu

SEQ ID NO: 1182440 - RNA, 19 nt, Homo sapiens
accugcagcuggagauuga

SEQ ID NO: 1182441 - RNA, 19 nt, Homo sapiens
ggagugggcuuaucauuua

SEQ ID NO: 1182442 - RNA, 19 nt, Homo sapiens
gaaacuaguugugaugaua

SEQ ID NO: 1182443 - RNA, 19 nt, Homo sapiens
ggaaagccauagagcauuu

SEQ ID NO: 1182444 - RNA, 19 nt, Homo sapiens
gcucaugcacuuacuauua

SEQ ID NO: 1182445 - RNA, 19 nt, Homo sapiens
agacauugcugccacagua

SEQ ID NO: 1182446 - RNA, 19 nt, Homo sapiens
gggcuuaucauuuagcuua

SEQ ID NO: 1182447 - RNA, 19 nt, Homo sapiens
ggaugaaacuggaaaugug

SEQ ID NO: 1182448 - RNA, 19 nt, Homo sapiens
caagugaccucucagcaau

SEQ ID NO: 1182449 - RNA, 19 nt, Homo sapiens
ccagagugcuccaccauga

SEQ ID NO: 1182450 - RNA, 19 nt, Homo sapiens
gauaaauauuccuggauug

SEQ ID NO: 1182451 - RNA, 19 nt, Homo sapiens
gcaauugcaacuaccauaa

SEQ ID NO: 1182452 - RNA, 19 nt, Homo sapiens
guaaguaugcuaaucuuga

SEQ ID NO: 1182453 - RNA, 19 nt, Homo sapiens
gaaccaaaauguccucuug

SEQ ID NO: 1182454 - RNA, 19 nt, Homo sapiens
ggaaugguauugaaagacu

SEQ ID NO: 1182455 - RNA, 19 nt, Homo sapiens
gaacacaucgggcuauucu

SEQ ID NO: 1182456 - RNA, 19 nt, Homo sapiens
caucaaaccucccuugcau

SEQ ID NO: 1182457 - RNA, 19 nt, Homo sapiens
gcaauacauucccaaacug

SEQ ID NO: 1182458 - RNA, 19 nt, Homo sapiens
gcauuaugauugcauggaa

SEQ ID NO: 1182459 - RNA, 19 nt, Homo sapiens
gcaacacagugcacuuugu

SEQ ID NO: 1182460 - RNA, 19 nt, Homo sapiens
gaggaagguauauuucuaa

SEQ ID NO: 1182461 - RNA, 19 nt, Homo sapiens
agaggaagguauauuucua

SEQ ID NO: 1182462 - RNA, 19 nt, Homo sapiens
ggcauuaguucaaggaguu

SEQ ID NO: 1182463 - RNA, 19 nt, Homo sapiens
gggagugggcuuaucauuu

SEQ ID NO: 1182464 - RNA, 19 nt, Homo sapiens
ggaaauguguugggagaag

SEQ ID NO: 1182465 - RNA, 19 nt, Homo sapiens
gaauugaaacuaguuguga

SEQ ID NO: 1182466 - RNA, 19 nt, Homo sapiens
gauaugauuucugcuguuc

SEQ ID NO: 1182467 - RNA, 19 nt, Homo sapiens
gaaugguauugaaagacua

SEQ ID NO: 1182468 - RNA, 19 nt, Homo sapiens
acaauggcaugucaucuug

SEQ ID NO: 1182469 - RNA, 19 nt, Homo sapiens
gcucauuucugcagguaug

SEQ ID NO: 1182470 - RNA, 19 nt, Homo sapiens
gacuaagacugcaggaguu

SEQ ID NO: 1182471 - RNA, 19 nt, Homo sapiens
aaaccucccuugcaucaug

SEQ ID NO: 1182472 - RNA, 19 nt, Homo sapiens
gaguaaguaugcuaaucuu

SEQ ID NO: 1182473 - RNA, 19 nt, Homo sapiens
gcacuuacuauuagguuga

SEQ ID NO: 1182474 - RNA, 19 nt, Homo sapiens
ucaaggaguuucagauuuu

SEQ ID NO: 1182475 - RNA, 19 nt, Homo sapiens
gaagcaauacauucccaaa

SEQ ID NO: 1182476 - RNA, 19 nt, Homo sapiens
uagaaggcauccgcuauga

SEQ ID NO: 1182477 - RNA, 19 nt, Homo sapiens
cucaacagcuucacagaga

SEQ ID NO: 1182478 - RNA, 19 nt, Homo sapiens
cccagacuaugcacugaua

SEQ ID NO: 1182479 - RNA, 19 nt, Homo sapiens
ucaacacguuacugauaaa

SEQ ID NO: 1182480 - RNA, 19 nt, Homo sapiens
guucaaggaguuucagauu

SEQ ID NO: 1182481 - RNA, 19 nt, Homo sapiens
uauggaggcucaugcacuu

SEQ ID NO: 1182482 - RNA, 19 nt, Homo sapiens
caacagcuucacagagaaa

SEQ ID NO: 1182483 - RNA, 19 nt, Homo sapiens
gaaggcauccgcuaugaac

SEQ ID NO: 1182484 - RNA, 19 nt, Homo sapiens
cgugguggcuugggcauuu

SEQ ID NO: 1182485 - RNA, 19 nt, Homo sapiens
guaugcuaaucuugacuaa

SEQ ID NO: 1182486 - RNA, 19 nt, Homo sapiens
caacgaauaguacaagaag

SEQ ID NO: 1182487 - RNA, 19 nt, Homo sapiens
ggaauugaaacuaguugug

SEQ ID NO: 1182488 - RNA, 19 nt, Homo sapiens
gggcuauucuguuuuguaa

SEQ ID NO: 1182489 - RNA, 19 nt, Homo sapiens
cuucaacacguuacugaua

SEQ ID NO: 1182490 - RNA, 19 nt, Homo sapiens
ccaaacaaggaaauagauu

SEQ ID NO: 1182491 - RNA, 19 nt, Homo sapiens
caggugacaugcuugacaa

SEQ ID NO: 1182492 - RNA, 19 nt, Homo sapiens
caauugcaacuaccauaaa

SEQ ID NO: 1182493 - RNA, 19 nt, Homo sapiens
gucccuaaagguaguauua

SEQ ID NO: 1182494 - RNA, 19 nt, Homo sapiens
uaagcagagagacuuguua

SEQ ID NO: 1182495 - RNA, 19 nt, Homo sapiens
acaucgggcuauucuguuu

SEQ ID NO: 1182496 - RNA, 19 nt, Homo sapiens
ggcaugucaucuugugaaa

SEQ ID NO: 1182497 - RNA, 19 nt, Homo sapiens
uucaacacguuacugauaa

SEQ ID NO: 1182498 - RNA, 19 nt, Homo sapiens
uaugauuucugcuguucaa

SEQ ID NO: 1182499 - RNA, 19 nt, Homo sapiens
gcauggaaugguauugaaa

SEQ ID NO: 1182500 - RNA, 19 nt, Homo sapiens
uucaaggaguuucagauuu

SEQ ID NO: 1182501 - RNA, 19 nt, Homo sapiens
caauacauucccaaacuga

SEQ ID NO: 1182502 - RNA, 19 nt, Homo sapiens
ccaauaaaguagaauuucc

SEQ ID NO: 1182503 - RNA, 19 nt, Homo sapiens
uagguugaccaauaaagua

SEQ ID NO: 1182504 - RNA, 19 nt, Homo sapiens
ccaagugaccucucagcaa

SEQ ID NO: 1182505 - RNA, 19 nt, Homo sapiens
ucaaaccucccuugcauca

SEQ ID NO: 1182506 - RNA, 19 nt, Homo sapiens
guugaccaauaaaguagaa

SEQ ID NO: 1182507 - RNA, 19 nt, Homo sapiens
gaugaaacuggaaaugugu

SEQ ID NO: 1182508 - RNA, 19 nt, Homo sapiens
gaguagacauaucaaaaga

SEQ ID NO: 1182509 - RNA, 19 nt, Homo sapiens
aaaauguccucuuggagua

SEQ ID NO: 1182510 - RNA, 19 nt, Homo sapiens
gggcaaauccugucuucag

SEQ ID NO: 1182511 - RNA, 19 nt, Homo sapiens
aaaccaggacuugcuuuaa

SEQ ID NO: 1182512 - RNA, 19 nt, Homo sapiens
agagacuuguuaccucaaa

SEQ ID NO: 1182513 - RNA, 19 nt, Homo sapiens
guaagcagagagacuuguu

SEQ ID NO: 1182514 - RNA, 19 nt, Homo sapiens
aaccaggacuugcuuuaag

SEQ ID NO: 1182515 - RNA, 19 nt, Homo sapiens
ucaacagcuucacagagaa

SEQ ID NO: 1182516 - RNA, 19 nt, Homo sapiens
ugaaacuaguugugaugau

SEQ ID NO: 1182517 - RNA, 19 nt, Homo sapiens
gucacugucuguuggcauu

SEQ ID NO: 1182518 - RNA, 19 nt, Homo sapiens
uagaguaaguaugcuaauc

SEQ ID NO: 1182519 - RNA, 19 nt, Homo sapiens
ucauucccauucaucauau

SEQ ID NO: 1182520 - RNA, 19 nt, Homo sapiens
acagugcacuuuguugugu

SEQ ID NO: 1182521 - RNA, 19 nt, Homo sapiens
aaagaggaagguauauuuc

SEQ ID NO: 1182522 - RNA, 19 nt, Homo sapiens
uaaguaugcuaaucuugac

SEQ ID NO: 1182523 - RNA, 19 nt, Homo sapiens
ucucagcaauugcaacuac

SEQ ID NO: 1182524 - RNA, 19 nt, Homo sapiens
ccauaaaaguaccacaauu

SEQ ID NO: 1182525 - RNA, 19 nt, Homo sapiens
ggagaagcuuccauaaaag

SEQ ID NO: 1182526 - RNA, 19 nt, Homo sapiens
augauugcauggaauggua

SEQ ID NO: 1182527 - RNA, 19 nt, Homo sapiens
gcagagagacuuguuaccu

SEQ ID NO: 1182528 - RNA, 19 nt, Homo sapiens
cacaauggcaugucaucuu

SEQ ID NO: 1182529 - RNA, 19 nt, Homo sapiens
ccacaguacagcacacaau

SEQ ID NO: 1182530 - RNA, 19 nt, Homo sapiens
caagguggcaagaagacuu

SEQ ID NO: 1182531 - RNA, 19 nt, Homo sapiens
ugacaagguggcaagaaga

SEQ ID NO: 1182532 - RNA, 19 nt, Homo sapiens
cugguggugucgcaaguaa

SEQ ID NO: 1182533 - RNA, 19 nt, Homo sapiens
aaauaaugcaguacugguu

SEQ ID NO: 1182534 - RNA, 19 nt, Homo sapiens
acacaucgggcuauucugu

SEQ ID NO: 1182535 - RNA, 19 nt, Homo sapiens
gggaaagccauagagcauu

SEQ ID NO: 1182536 - RNA, 19 nt, Homo sapiens
cucaugcacuuacuauuag

SEQ ID NO: 1182537 - RNA, 19 nt, Homo sapiens
guagacauaucaaaagaag

SEQ ID NO: 1182538 - RNA, 19 nt, Homo sapiens
aagaacacaucgggcuauu

SEQ ID NO: 1182539 - RNA, 19 nt, Homo sapiens
ucaacgaauaguacaagaa

SEQ ID NO: 1182540 - RNA, 19 nt, Homo sapiens
guauugggaauugaaacua

SEQ ID NO: 1182541 - RNA, 19 nt, Homo sapiens
gaagguaucuggaaagaaa

SEQ ID NO: 1182542 - RNA, 19 nt, Homo sapiens
ggaaagaaauagagaagaa

SEQ ID NO: 1182543 - RNA, 19 nt, Homo sapiens
gaaagaagguaucuggaaa

SEQ ID NO: 1182544 - RNA, 19 nt, Homo sapiens
ugaaagagcuuccuaacaa

SEQ ID NO: 1182545 - RNA, 19 nt, Homo sapiens
gagagaagauuaucaaaca

SEQ ID NO: 1182546 - RNA, 19 nt, Homo sapiens
aaacugaacuggccagaaa

SEQ ID NO: 1182547 - RNA, 19 nt, Homo sapiens
caaagaaucuggcaaacau

SEQ ID NO: 1182548 - RNA, 19 nt, Homo sapiens
acaagcaguuucagauuua

SEQ ID NO: 1182549 - RNA, 19 nt, Homo sapiens
ucacagacuccaagaauua

SEQ ID NO: 1182550 - RNA, 19 nt, Homo sapiens
gaaggaucauggaacuaua

SEQ ID NO: 1182551 - RNA, 19 nt, Homo sapiens
gagaagauuuggaacucua

SEQ ID NO: 1182552 - RNA, 19 nt, Homo sapiens
ugaguggaaugcuaucuua

SEQ ID NO: 1182553 - RNA, 19 nt, Homo sapiens
gaagagaucccaguuuguu

SEQ ID NO: 1182554 - RNA, 19 nt, Homo sapiens
ggagagagaccaggaauga

SEQ ID NO: 1182555 - RNA, 19 nt, Homo sapiens
uaacaagaaucaggaagaa

SEQ ID NO: 1182556 - RNA, 19 nt, Homo sapiens
gaaagucacagcaucaaug

SEQ ID NO: 1182557 - RNA, 19 nt, Homo sapiens
cuacuuaaaugaagagaga

SEQ ID NO: 1182558 - RNA, 19 nt, Homo sapiens
gaucccaguuuguuagaaa

SEQ ID NO: 1182559 - RNA, 19 nt, Homo sapiens
gaugagcggcagacuaaua

SEQ ID NO: 1182560 - RNA, 19 nt, Homo sapiens
gcaauugaccagcuuaaga

SEQ ID NO: 1182561 - RNA, 19 nt, Homo sapiens
gaaagagcuuccuaacaag

SEQ ID NO: 1182562 - RNA, 19 nt, Homo sapiens
gaacugaaacucaaaucau

SEQ ID NO: 1182563 - RNA, 19 nt, Homo sapiens
cgacccgacucuuaaguuu

SEQ ID NO: 1182564 - RNA, 19 nt, Homo sapiens
aagaguaucuccucaacuu

SEQ ID NO: 1182565 - RNA, 19 nt, Homo sapiens
ucauggaacuauaagcuaa

SEQ ID NO: 1182566 - RNA, 19 nt, Homo sapiens
uggaagagaucccaguuug

SEQ ID NO: 1182567 - RNA, 19 nt, Homo sapiens
ugaaacaaguaaaggaaga

SEQ ID NO: 1182568 - RNA, 19 nt, Homo sapiens
cauuucagcuggauuucua

SEQ ID NO: 1182569 - RNA, 19 nt, Homo sapiens
uaguagaaguuaaggauga

SEQ ID NO: 1182570 - RNA, 19 nt, Homo sapiens
uagaugagcggcagacuaa

SEQ ID NO: 1182571 - RNA, 19 nt, Homo sapiens
gaaagagagaagauuauca

SEQ ID NO: 1182572 - RNA, 19 nt, Homo sapiens
gaccaaagaaucuggcaaa

SEQ ID NO: 1182573 - RNA, 19 nt, Homo sapiens
uaucaugccuacaaugguu

SEQ ID NO: 1182574 - RNA, 19 nt, Homo sapiens
ggaaugaguggaaugcuau

SEQ ID NO: 1182575 - RNA, 19 nt, Homo sapiens
ggaggaacuuggaagagau

SEQ ID NO: 1182576 - RNA, 19 nt, Homo sapiens
ccacagaccaauuagugua

SEQ ID NO: 1182577 - RNA, 19 nt, Homo sapiens
uaaugaggcugauggaaca

SEQ ID NO: 1182578 - RNA, 19 nt, Homo sapiens
ugaagaugcuauugcagaa

SEQ ID NO: 1182579 - RNA, 19 nt, Homo sapiens
aacaagcaguuucagauuu

SEQ ID NO: 1182580 - RNA, 19 nt, Homo sapiens
aaauagagaagaaccagua

SEQ ID NO: 1182581 - RNA, 19 nt, Homo sapiens
acaauccacagaccaauua

SEQ ID NO: 1182582 - RNA, 19 nt, Homo sapiens
ggaaauguuuauucaccau

SEQ ID NO: 1182583 - RNA, 19 nt, Homo sapiens
guagaagacaggacaauca

SEQ ID NO: 1182584 - RNA, 19 nt, Homo sapiens
uaauuuagcuguggugaag

SEQ ID NO: 1182585 - RNA, 19 nt, Homo sapiens
guacaucacccuaccagau

SEQ ID NO: 1182586 - RNA, 19 nt, Homo sapiens
cuacaaugguuggaagaaa

SEQ ID NO: 1182587 - RNA, 19 nt, Homo sapiens
gaaaagccacugcagaaaa

SEQ ID NO: 1182588 - RNA, 19 nt, Homo sapiens
ggaacuauaagcuaaauac

SEQ ID NO: 1182589 - RNA, 19 nt, Homo sapiens
ccagggagaucaagaugag

SEQ ID NO: 1182590 - RNA, 19 nt, Homo sapiens
ggaacaauccacagaccaa

SEQ ID NO: 1182591 - RNA, 19 nt, Homo sapiens
aaugcuaucuuaagccaaa

SEQ ID NO: 1182592 - RNA, 19 nt, Homo sapiens
caaccagaauuauauuugc

SEQ ID NO: 1182593 - RNA, 19 nt, Homo sapiens
ccagaucacccuucacuuc

SEQ ID NO: 1182594 - RNA, 19 nt, Homo sapiens
aaacugcucaugcaacuug

SEQ ID NO: 1182595 - RNA, 19 nt, Homo sapiens
gaucauuggaagauucaaa

SEQ ID NO: 1182596 - RNA, 19 nt, Homo sapiens
ccaauuaguguaacuuugu

SEQ ID NO: 1182597 - RNA, 19 nt, Homo sapiens
uauucaccaucaacaguua

SEQ ID NO: 1182598 - RNA, 19 nt, Homo sapiens
uugaccagcuuaagagaaa

SEQ ID NO: 1182599 - RNA, 19 nt, Homo sapiens
caucacagacuccaagaau

SEQ ID NO: 1182600 - RNA, 19 nt, Homo sapiens
gauuuggaacucuacuaua

SEQ ID NO: 1182601 - RNA, 19 nt, Homo sapiens
gaaacaaguaaaggaagaa

SEQ ID NO: 1182602 - RNA, 19 nt, Homo sapiens
gaucacccuucacuuccuu

SEQ ID NO: 1182603 - RNA, 19 nt, Homo sapiens
gauaucaugccuacaaugg

SEQ ID NO: 1182604 - RNA, 19 nt, Homo sapiens
acaaguaaaggaagaaaga

SEQ ID NO: 1182605 - RNA, 19 nt, Homo sapiens
gaccaauuaguguaacuuu

SEQ ID NO: 1182606 - RNA, 19 nt, Homo sapiens
agagaaaacuagauacuga

SEQ ID NO: 1182607 - RNA, 19 nt, Homo sapiens
agaaagaagguaucuggaa

SEQ ID NO: 1182608 - RNA, 19 nt, Homo sapiens
gaagaugcuauugcagaaa

SEQ ID NO: 1182609 - RNA, 19 nt, Homo sapiens
ggaaacaaagaaagucaca

SEQ ID NO: 1182610 - RNA, 19 nt, Homo sapiens
aagaagguaucuggaaaga

SEQ ID NO: 1182611 - RNA, 19 nt, Homo sapiens
acugaaagagagaagauua

SEQ ID NO: 1182612 - RNA, 19 nt, Homo sapiens
caggaucauuggaagauuc

SEQ ID NO: 1182613 - RNA, 19 nt, Homo sapiens
aggaaugaguggaaugcua

SEQ ID NO: 1182614 - RNA, 19 nt, Homo sapiens
uagcgcgacccgacucuua

SEQ ID NO: 1182615 - RNA, 19 nt, Homo sapiens
ggaagagaucccaguuugu

SEQ ID NO: 1182616 - RNA, 19 nt, Homo sapiens
gagcggcagacuaauaaug

SEQ ID NO: 1182617 - RNA, 19 nt, Homo sapiens
gggugaagaugcuauugca

SEQ ID NO: 1182618 - RNA, 19 nt, Homo sapiens
caagaugagaccaaagaau

SEQ ID NO: 1182619 - RNA, 19 nt, Homo sapiens
gcagacuaauaaugguguu

SEQ ID NO: 1182620 - RNA, 19 nt, Homo sapiens
gcaugcaauugaccagcuu

SEQ ID NO: 1182621 - RNA, 19 nt, Homo sapiens
aaagaaagucacagcauca

SEQ ID NO: 1182622 - RNA, 19 nt, Homo sapiens
gaucauggaacuauaagcu

SEQ ID NO: 1182623 - RNA, 19 nt, Homo sapiens
aaugauugcuuuggcacua

SEQ ID NO: 1182624 - RNA, 19 nt, Homo sapiens
gaacaauccacagaccaau

SEQ ID NO: 1182625 - RNA, 19 nt, Homo sapiens
ugaaggaucauggaacuau

SEQ ID NO: 1182626 - RNA, 19 nt, Homo sapiens
cauaguagaaguuaaggau

SEQ ID NO: 1182627 - RNA, 19 nt, Homo sapiens
gaauaugucacucaaucca

SEQ ID NO: 1182628 - RNA, 19 nt, Homo sapiens
guucuuucuucaggaauaa

SEQ ID NO: 1182629 - RNA, 19 nt, Homo sapiens
uaauaauccagaucacuga

SEQ ID NO: 1182630 - RNA, 19 nt, Homo sapiens
uaaaggaagaaagaaggua

SEQ ID NO: 1182631 - RNA, 19 nt, Homo sapiens
gaccaggaaugaguggaau

SEQ ID NO: 1182632 - RNA, 19 nt, Homo sapiens
gaaggaaaagcaagaauca

SEQ ID NO: 1182633 - RNA, 19 nt, Homo sapiens
ucagauuuacgaacauuga

SEQ ID NO: 1182634 - RNA, 19 nt, Homo sapiens
gggagcgucuuggugaguu

SEQ ID NO: 1182635 - RNA, 19 nt, Homo sapiens
ugagguacagcaugcaauu

SEQ ID NO: 1182636 - RNA, 19 nt, Homo sapiens
ccagaucacugagguacag

SEQ ID NO: 1182637 - RNA, 19 nt, Homo sapiens
ccaaagaaucuggcaaaca

SEQ ID NO: 1182638 - RNA, 19 nt, Homo sapiens
uggaggagguuuuaacaaa

SEQ ID NO: 1182639 - RNA, 19 nt, Homo sapiens
ucagcuggauuucuaagag

SEQ ID NO: 1182640 - RNA, 19 nt, Homo sapiens
uuaugucccugaaggauca

SEQ ID NO: 1182641 - RNA, 19 nt, Homo sapiens
gaacgacacucagaaauug

SEQ ID NO: 1182642 - RNA, 19 nt, Homo sapiens
ucacugaguucuagaauga

SEQ ID NO: 1182643 - RNA, 19 nt, Homo sapiens
gaaauuggccugccucauc

SEQ ID NO: 1182644 - RNA, 19 nt, Homo sapiens
caucaaggcugucauugga

SEQ ID NO: 1182645 - RNA, 19 nt, Homo sapiens
gcagagagcuccgcuaagg

SEQ ID NO: 1182646 - RNA, 19 nt, Homo sapiens
gauguuaaccugcgcaauu

SEQ ID NO: 1182647 - RNA, 19 nt, Homo sapiens
ucacugagauucccauaca

SEQ ID NO: 1182648 - RNA, 19 nt, Homo sapiens
uaaggcagguuuaccagaa

SEQ ID NO: 1182649 - RNA, 19 nt, Homo sapiens
ggagcagauugaccucaua

SEQ ID NO: 1182650 - RNA, 19 nt, Homo sapiens
gacaauagccucuccaucu

SEQ ID NO: 1182651 - RNA, 19 nt, Homo sapiens
agaaagggcuacaggaugu

SEQ ID NO: 1182652 - RNA, 19 nt, Homo sapiens
caauagccucuccaucuua

SEQ ID NO: 1182653 - RNA, 19 nt, Homo sapiens
gggcagagagcuccgcuaa

SEQ ID NO: 1182654 - RNA, 19 nt, Homo sapiens
acacuggacagccaaguua

SEQ ID NO: 1182655 - RNA, 19 nt, Homo sapiens
gccacucgcuggacaauag

SEQ ID NO: 1182656 - RNA, 19 nt, Homo sapiens
gggcaugaugguagacuua

SEQ ID NO: 1182657 - RNA, 19 nt, Homo sapiens
acaauagccucuccaucuu

SEQ ID NO: 1182658 - RNA, 19 nt, Homo sapiens
ccacaaaguuccccuguug

SEQ ID NO: 1182659 - RNA, 19 nt, Homo sapiens
gaacgguggcgucgugaug

SEQ ID NO: 1182660 - RNA, 19 nt, Homo sapiens
ugaacgacacucagaaauu

SEQ ID NO: 1182661 - RNA, 19 nt, Homo sapiens
gaaggugguggcagaaaug

SEQ ID NO: 1182662 - RNA, 19 nt, Homo sapiens
ccacauacccgguccugau

SEQ ID NO: 1182663 - RNA, 19 nt, Homo sapiens
ccacaucaaggcugucauu

SEQ ID NO: 1182664 - RNA, 19 nt, Homo sapiens
gaagaaaacaaauggcaaa

SEQ ID NO: 1182665 - RNA, 19 nt, Homo sapiens
cagccaauguguccacugu

SEQ ID NO: 1182666 - RNA, 19 nt, Homo sapiens
ugacugacuuuggugagaa

SEQ ID NO: 1182667 - RNA, 19 nt, Homo sapiens
gaugagcagcugagcaguu

SEQ ID NO: 1182668 - RNA, 19 nt, Homo sapiens
caucuuacguaccuucuac

SEQ ID NO: 1182669 - RNA, 19 nt, Homo sapiens
cgggauugguggagauuau

SEQ ID NO: 1182670 - RNA, 19 nt, Homo sapiens
gugcaacagugcucggaau

SEQ ID NO: 1182671 - RNA, 19 nt, Homo sapiens
gcaugugugccuccuauuc

SEQ ID NO: 1182672 - RNA, 19 nt, Homo sapiens
ccgcaugugugccuccuau

SEQ ID NO: 1182673 - RNA, 19 nt, Homo sapiens
agaaggugguggcagaaau

SEQ ID NO: 1182674 - RNA, 19 nt, Homo sapiens
gcaugaugguagacuuauc

SEQ ID NO: 1182675 - RNA, 19 nt, Homo sapiens
ccagaaagggcuacaggau

SEQ ID NO: 1182676 - RNA, 19 nt, Homo sapiens
cacauacccgguccugaua

SEQ ID NO: 1182677 - RNA, 19 nt, Homo sapiens
aggcacaaauauuucuuga

SEQ ID NO: 1182678 - RNA, 19 nt, Homo sapiens
gaaaccugcugcgggucuu

SEQ ID NO: 1182679 - RNA, 19 nt, Homo sapiens
gaagacguguccacauacc

SEQ ID NO: 1182680 - RNA, 19 nt, Homo sapiens
ggauugguggagauuauga

SEQ ID NO: 1182681 - RNA, 19 nt, Homo sapiens
cauacccgguccugauaga

SEQ ID NO: 1182682 - RNA, 19 nt, Homo sapiens
gcgucgugauggugucuuu

SEQ ID NO: 1182683 - RNA, 19 nt, Homo sapiens
gagaaggugguggcagaaa

SEQ ID NO: 1182684 - RNA, 19 nt, Homo sapiens
ggaagacguguccacauac

SEQ ID NO: 1182685 - RNA, 19 nt, Homo sapiens
ccugccagaugucacugua

SEQ ID NO: 1182686 - RNA, 19 nt, Homo sapiens
aggacaaguucccggauga

SEQ ID NO: 1182687 - RNA, 19 nt, Homo sapiens
ucacuucgaccacaucaag

SEQ ID NO: 1182688 - RNA, 19 nt, Homo sapiens
gcaacagugcucggaaugu

SEQ ID NO: 1182689 - RNA, 19 nt, Homo sapiens
ccucauacgccgcaugugu

SEQ ID NO: 1182690 - RNA, 19 nt, Homo sapiens
auguuaaccugcgcaauuu

SEQ ID NO: 1182691 - RNA, 19 nt, Homo sapiens
gaaaagguacaggaagaaa

SEQ ID NO: 1182692 - RNA, 19 nt, Homo sapiens
caacccaucagccaaugug

SEQ ID NO: 1182693 - RNA, 19 nt, Homo sapiens
gaaagggcuacaggauguu

SEQ ID NO: 1182694 - RNA, 19 nt, Homo sapiens
aaagggcuacaggauguua

SEQ ID NO: 1182695 - RNA, 19 nt, Homo sapiens
caggguguccuucguggaa

SEQ ID NO: 1182696 - RNA, 19 nt, Homo sapiens
aaggcagguuuaccagaaa

SEQ ID NO: 1182697 - RNA, 19 nt, Homo sapiens
gguggccucugcugagucu

SEQ ID NO: 1182698 - RNA, 19 nt, Homo sapiens
caccuucccaguccuuauu

SEQ ID NO: 1182699 - RNA, 19 nt, Homo sapiens
caucgggauugguggagau

SEQ ID NO: 1182700 - RNA, 19 nt, Homo sapiens
gaaccgccugggcaugaug

SEQ ID NO: 1182701 - RNA, 19 nt, Homo sapiens
gcaggcacaaauauuucuu

SEQ ID NO: 1182702 - RNA, 19 nt, Homo sapiens
ccaaguuaccagccaagug

SEQ ID NO: 1182703 - RNA, 19 nt, Homo sapiens
gaccucauacgccgcaugu

SEQ ID NO: 1182704 - RNA, 19 nt, Homo sapiens
gagcagauugaccucauac

SEQ ID NO: 1182705 - RNA, 19 nt, Homo sapiens
gcucugaugacccaguuag

SEQ ID NO: 1182706 - RNA, 19 nt, Homo sapiens
guuaaccugcgcaauuuca

SEQ ID NO: 1182707 - RNA, 19 nt, Homo sapiens
uggaaaagguacaggaaga

SEQ ID NO: 1182708 - RNA, 19 nt, Homo sapiens
guccacuccuucuacaaca

SEQ ID NO: 1182709 - RNA, 19 nt, Homo sapiens
gaucacuucgaccacauca

SEQ ID NO: 1182710 - RNA, 19 nt, Homo sapiens
cagaucacuucgaccacau

SEQ ID NO: 1182711 - RNA, 19 nt, Homo sapiens
gugcaacccaucagccaau

SEQ ID NO: 1182712 - RNA, 19 nt, Homo sapiens
aauagccucuccaucuuac

SEQ ID NO: 1182713 - RNA, 19 nt, Homo sapiens
cggcuaaagcucugaacga

SEQ ID NO: 1182714 - RNA, 19 nt, Homo sapiens
guacaacgcugaccucuuc

SEQ ID NO: 1182715 - RNA, 19 nt, Homo sapiens
guacuuaagugucugugua

SEQ ID NO: 1182716 - RNA, 19 nt, Homo sapiens
gaacucuucugcacucuga

SEQ ID NO: 1182717 - RNA, 19 nt, Homo sapiens
gagagaagcccuuugaaga

SEQ ID NO: 1182718 - RNA, 19 nt, Homo sapiens
guagacaaccaaagaauaa

SEQ ID NO: 1182719 - RNA, 19 nt, Homo sapiens
ggaaguagcagcugagaga

SEQ ID NO: 1182720 - RNA, 19 nt, Homo sapiens
uaacagcgauacaguacuu

SEQ ID NO: 1182721 - RNA, 19 nt, Homo sapiens
gaaccuagacuauuaccaa

SEQ ID NO: 1182722 - RNA, 19 nt, Homo sapiens
cagaugaccuggugaagau

SEQ ID NO: 1182723 - RNA, 19 nt, Homo sapiens
caucacagaucauuacauc

SEQ ID NO: 1182724 - RNA, 19 nt, Homo sapiens
agcagaaccuagacuauua

SEQ ID NO: 1182725 - RNA, 19 nt, Homo sapiens
ucccaucgcauuauaauua

SEQ ID NO: 1182726 - RNA, 19 nt, Homo sapiens
acaacuaccuugaguacaa

SEQ ID NO: 1182727 - RNA, 19 nt, Homo sapiens
gcgaagggcccuaugacua

SEQ ID NO: 1182728 - RNA, 19 nt, Homo sapiens
gcucacagccuucuacaug

SEQ ID NO: 1182729 - RNA, 19 nt, Homo sapiens
gagcgaugcugaguucuug

SEQ ID NO: 1182730 - RNA, 19 nt, Homo sapiens
gcccaaggaugagcuauga

SEQ ID NO: 1182731 - RNA, 19 nt, Homo sapiens
ggacuucgauggcggaaac

SEQ ID NO: 1182732 - RNA, 19 nt, Homo sapiens
gcauaacagcgauacagua

SEQ ID NO: 1182733 - RNA, 19 nt, Homo sapiens
gcugagagauagcgagugu

SEQ ID NO: 1182734 - RNA, 19 nt, Homo sapiens
ccacauacucccaaugaaa

SEQ ID NO: 1182735 - RNA, 19 nt, Homo sapiens
cccaagagauugcaagaga

SEQ ID NO: 1182736 - RNA, 19 nt, Homo sapiens
gagaagugauucccaagag

SEQ ID NO: 1182737 - RNA, 19 nt, Homo sapiens
gcggaggccucucugaaug

SEQ ID NO: 1182738 - RNA, 19 nt, Homo sapiens
gcagagaggaaggaugaua

SEQ ID NO: 1182739 - RNA, 19 nt, Homo sapiens
cagcgaagccuacuggaaa

SEQ ID NO: 1182740 - RNA, 19 nt, Homo sapiens
gagaagaacacaccagauc

SEQ ID NO: 1182741 - RNA, 19 nt, Homo sapiens
gcagcaaccucaggagaug

SEQ ID NO: 1182742 - RNA, 19 nt, Homo sapiens
gcaucagucucaccaugaa

SEQ ID NO: 1182743 - RNA, 19 nt, Homo sapiens
ccaacgcccugucauuaug

SEQ ID NO: 1182744 - RNA, 19 nt, Homo sapiens
aaucgaagcccaaggauga

SEQ ID NO: 1182745 - RNA, 19 nt, Homo sapiens
agaccuaucuucucuucuu

SEQ ID NO: 1182746 - RNA, 19 nt, Homo sapiens
caagagauugcaagagaaa

SEQ ID NO: 1182747 - RNA, 19 nt, Homo sapiens
ccaagagauugcaagagaa

SEQ ID NO: 1182748 - RNA, 19 nt, Homo sapiens
gagauugggaaccuuauga

SEQ ID NO: 1182749 - RNA, 19 nt, Homo sapiens
ccagagcgcccuugguuug

SEQ ID NO: 1182750 - RNA, 19 nt, Homo sapiens
gcaggucgccuacuucaag

SEQ ID NO: 1182751 - RNA, 19 nt, Homo sapiens
uuucuucgcuuaugauguu

SEQ ID NO: 1182752 - RNA, 19 nt, Homo sapiens
caaaccaugucuggaguga

SEQ ID NO: 1182753 - RNA, 19 nt, Homo sapiens
gcagaugaccuggugaaga

SEQ ID NO: 1182754 - RNA, 19 nt, Homo sapiens
gagaagcccuuugaagacu

SEQ ID NO: 1182755 - RNA, 19 nt, Homo sapiens
gcgauacaguacuuaagug

SEQ ID NO: 1182756 - RNA, 19 nt, Homo sapiens
gagcggaggccucucugaa

SEQ ID NO: 1182757 - RNA, 19 nt, Homo sapiens
ggacaacugcauccugaau

SEQ ID NO: 1182758 - RNA, 19 nt, Homo sapiens
gaagugauucccaagagau

SEQ ID NO: 1182759 - RNA, 19 nt, Homo sapiens
auaauuaucugcaguuugc

SEQ ID NO: 1182760 - RNA, 19 nt, Homo sapiens
ggagaagugauucccaaga

SEQ ID NO: 1182761 - RNA, 19 nt, Homo sapiens
cagcagaaccuagacuauu

SEQ ID NO: 1182762 - RNA, 19 nt, Homo sapiens
gaguggacaugaccagaca

SEQ ID NO: 1182763 - RNA, 19 nt, Homo sapiens
gaagagguccaggcagaga

SEQ ID NO: 1182764 - RNA, 19 nt, Homo sapiens
ggaaaugcagcagaaccua

SEQ ID NO: 1182765 - RNA, 19 nt, Homo sapiens
gcagagugcccaccuguac

SEQ ID NO: 1182766 - RNA, 19 nt, Homo sapiens
ggaaaucgagacccuugug

SEQ ID NO: 1182767 - RNA, 19 nt, Homo sapiens
cagcuaugcuuggagaaga

SEQ ID NO: 1182768 - RNA, 19 nt, Homo sapiens
ugacuacgauggcuacaac

SEQ ID NO: 1182769 - RNA, 19 nt, Homo sapiens
gaacuccaaacuccugaau

SEQ ID NO: 1182770 - RNA, 19 nt, Homo sapiens
ucgagacccuuguggaaga

SEQ ID NO: 1182771 - RNA, 19 nt, Homo sapiens
gaagaacacaccagaucca

SEQ ID NO: 1182772 - RNA, 19 nt, Homo sapiens
gggcaauccugagcacaug

SEQ ID NO: 1182773 - RNA, 19 nt, Homo sapiens
acauggaaaugcagcagaa

SEQ ID NO: 1182774 - RNA, 19 nt, Homo sapiens
uguagacaaccaaagaaua

SEQ ID NO: 1182775 - RNA, 19 nt, Homo sapiens
gaagagccgugggauucuc

SEQ ID NO: 1182776 - RNA, 19 nt, Homo sapiens
gacuacagcgccauccuuu

SEQ ID NO: 1182777 - RNA, 19 nt, Homo sapiens
caggagauugggaaccuua

SEQ ID NO: 1182778 - RNA, 19 nt, Homo sapiens
gaaacagccguacgcaucu

SEQ ID NO: 1182779 - RNA, 19 nt, Homo sapiens
agaagugauucccaagaga

SEQ ID NO: 1182780 - RNA, 19 nt, Homo sapiens
ccaaugacgaggugaugaa

SEQ ID NO: 1182781 - RNA, 19 nt, Homo sapiens
gaaaaguucuaugguguca

SEQ ID NO: 1182782 - RNA, 19 nt, Homo sapiens
gucaggagcugcagagacu

SEQ ID NO: 1182783 - RNA, 19 nt, Homo sapiens
gcaguuugccuacuauaac

SEQ ID NO: 1182784 - RNA, 19 nt, Homo sapiens
gcagcagaaccuagacuau

SEQ ID NO: 1182785 - RNA, 19 nt, Homo sapiens
gacaaccaaagaauaaaug

SEQ ID NO: 1182786 - RNA, 19 nt, Homo sapiens
auacaguacuuaagugucu

SEQ ID NO: 1182787 - RNA, 19 nt, Homo sapiens
gcagagcagugagccuaca

SEQ ID NO: 1182788 - RNA, 19 nt, Homo sapiens
caucauggaguccuacuuc

SEQ ID NO: 1182789 - RNA, 19 nt, Homo sapiens
ggugauggacggcguaauc

SEQ ID NO: 1182790 - RNA, 19 nt, Homo sapiens
gaagucagaacgggaaaca

SEQ ID NO: 1182791 - RNA, 19 nt, Homo sapiens
ucagacggaugggugacua

SEQ ID NO: 1182792 - RNA, 19 nt, Homo sapiens
ugcagagacugaccaaugu

SEQ ID NO: 1182793 - RNA, 19 nt, Homo sapiens
aaccuagacuauuaccaaa

SEQ ID NO: 1182794 - RNA, 19 nt, Homo sapiens
gcuccaacgcccugucauu

SEQ ID NO: 1182795 - RNA, 19 nt, Homo sapiens
uggugucacugucuucaaa

SEQ ID NO: 1182796 - RNA, 19 nt, Homo sapiens
cgagagaagcccuuugaag

SEQ ID NO: 1182797 - RNA, 19 nt, Homo sapiens
uccagguccucaacuguaa

SEQ ID NO: 1182798 - RNA, 19 nt, Homo sapiens
ucacagaucauuacaucca

SEQ ID NO: 1182799 - RNA, 19 nt, Homo sapiens
cuagacccauggagaggaa

SEQ ID NO: 1182800 - RNA, 19 nt, Homo sapiens
ggagcgaugcugaguucuu

SEQ ID NO: 1182801 - RNA, 19 nt, Homo sapiens
cuccaacgcccugucauua

SEQ ID NO: 1182802 - RNA, 19 nt, Homo sapiens
acuccaaacuccugaaugg

SEQ ID NO: 1182803 - RNA, 19 nt, Homo sapiens
uaugaaggcaucagucuca

SEQ ID NO: 1182804 - RNA, 19 nt, Homo sapiens
aagagaaacagaagucaga

SEQ ID NO: 1182805 - RNA, 19 nt, Homo sapiens
gaccuaucuucucuucuuc

SEQ ID NO: 1182806 - RNA, 19 nt, Homo sapiens
caguuugccuacuauaaca

SEQ ID NO: 1182807 - RNA, 19 nt, Homo sapiens
gcgguuccguuaggucuga

SEQ ID NO: 1182808 - RNA, 19 nt, Homo sapiens
aaccaugucuggagugaag

SEQ ID NO: 1182809 - RNA, 19 nt, Homo sapiens
cugcagagacugaccaaug

SEQ ID NO: 1182810 - RNA, 19 nt, Homo sapiens
ggagaagaacacaccagau

SEQ ID NO: 1182811 - RNA, 19 nt, Homo sapiens
gcuguugaaugugccaaga

SEQ ID NO: 1182812 - RNA, 19 nt, Homo sapiens
cgaagggcccuaugacuac

SEQ ID NO: 1182813 - RNA, 19 nt, Homo sapiens
ucacagccuucuacauggu

SEQ ID NO: 1182814 - RNA, 19 nt, Homo sapiens
gauguuaaccugcgaaauu

SEQ ID NO: 1182815 - RNA, 19 nt, Homo sapiens
gcagagaguuccaccaagu

SEQ ID NO: 1182816 - RNA, 19 nt, Homo sapiens
gacaagcuuuggugagaaa

SEQ ID NO: 1182817 - RNA, 19 nt, Homo sapiens
gaaaguaguagaggaguug

SEQ ID NO: 1182818 - RNA, 19 nt, Homo sapiens
uaagaaggguccuggaagu

SEQ ID NO: 1182819 - RNA, 19 nt, Homo sapiens
gauaagaaggguccuggaa

SEQ ID NO: 1182820 - RNA, 19 nt, Homo sapiens
ggucugaacagcucucaaa

SEQ ID NO: 1182821 - RNA, 19 nt, Homo sapiens
ucggacaccuugauaagaa

SEQ ID NO: 1182822 - RNA, 19 nt, Homo sapiens
ugagacagcguuacaagaa

SEQ ID NO: 1182823 - RNA, 19 nt, Homo sapiens
agaaugugcuucaggaugu

SEQ ID NO: 1182824 - RNA, 19 nt, Homo sapiens
ggagcagauugaccucauu

SEQ ID NO: 1182825 - RNA, 19 nt, Homo sapiens
gagacagcguuacaagaau

SEQ ID NO: 1182826 - RNA, 19 nt, Homo sapiens
gcugagaauaaacauguua

SEQ ID NO: 1182827 - RNA, 19 nt, Homo sapiens
aagcuggccugccucauug

SEQ ID NO: 1182828 - RNA, 19 nt, Homo sapiens
gagcugugugugacaauuu

SEQ ID NO: 1182829 - RNA, 19 nt, Homo sapiens
agacagcguuacaagaaug

SEQ ID NO: 1182830 - RNA, 19 nt, Homo sapiens
gaggcugaguuuccauaug

SEQ ID NO: 1182831 - RNA, 19 nt, Homo sapiens
gggcagagaguuccaccaa

SEQ ID NO: 1182832 - RNA, 19 nt, Homo sapiens
cgggauugguggaaauuau

SEQ ID NO: 1182833 - RNA, 19 nt, Homo sapiens
gggcagucauuggaucuga

SEQ ID NO: 1182834 - RNA, 19 nt, Homo sapiens
ccacaucagggcagucauu

SEQ ID NO: 1182835 - RNA, 19 nt, Homo sapiens
gcaucggacaccuugauaa

SEQ ID NO: 1182836 - RNA, 19 nt, Homo sapiens
gaaugugcuucaggauguu

SEQ ID NO: 1182837 - RNA, 19 nt, Homo sapiens
gaggaguugcugagucgua

SEQ ID NO: 1182838 - RNA, 19 nt, Homo sapiens
ugaauguucccgaugauau

SEQ ID NO: 1182839 - RNA, 19 nt, Homo sapiens
ugacaagcuuuggugagaa

SEQ ID NO: 1182840 - RNA, 19 nt, Homo sapiens
caucagggcagucauugga

SEQ ID NO: 1182841 - RNA, 19 nt, Homo sapiens
aaagcuggccugccucauu

SEQ ID NO: 1182842 - RNA, 19 nt, Homo sapiens
cacauacccaguccugaua

SEQ ID NO: 1182843 - RNA, 19 nt, Homo sapiens
ccacauacccaguccugau

SEQ ID NO: 1182844 - RNA, 19 nt, Homo sapiens
ggauugguggaaauuauga

SEQ ID NO: 1182845 - RNA, 19 nt, Homo sapiens
gaauguucccgaugauauc

SEQ ID NO: 1182846 - RNA, 19 nt, Homo sapiens
acucugaacucgagcuugu

SEQ ID NO: 1182847 - RNA, 19 nt, Homo sapiens
agaaaguaguagaggaguu

SEQ ID NO: 1182848 - RNA, 19 nt, Homo sapiens
gacaccacauguacaccaa

SEQ ID NO: 1182849 - RNA, 19 nt, Homo sapiens
ucucugugcugcgcaguuu

SEQ ID NO: 1182850 - RNA, 19 nt, Homo sapiens
uguugaauguucccgauga

SEQ ID NO: 1182851 - RNA, 19 nt, Homo sapiens
gaaaccugcugcgggucuu

SEQ ID NO: 1182852 - RNA, 19 nt, Homo sapiens
caucgggauugguggaaau

SEQ ID NO: 1182853 - RNA, 19 nt, Homo sapiens
ccagagcugugugugacaa

SEQ ID NO: 1182854 - RNA, 19 nt, Homo sapiens
gugcgcuaccugacacuua

SEQ ID NO: 1182855 - RNA, 19 nt, Homo sapiens
gagcagauugaccucauuc

SEQ ID NO: 1182856 - RNA, 19 nt, Homo sapiens
ugaccaagcagccaaccaa

SEQ ID NO: 1182857 - RNA, 19 nt, Homo sapiens
aggcugaguuuccauaugg

SEQ ID NO: 1182858 - RNA, 19 nt, Homo sapiens
gcaugaugauagauuuguc

SEQ ID NO: 1182859 - RNA, 19 nt, Homo sapiens
ucuccuaguucauucacaa

SEQ ID NO: 1182860 - RNA, 19 nt, Homo sapiens
cauuggaucugaguucauc

SEQ ID NO: 1182861 - RNA, 19 nt, Homo sapiens
auguuaaccugcgaaauuu

SEQ ID NO: 1182862 - RNA, 19 nt, Homo sapiens
guucagacaccacauguac

SEQ ID NO: 1182863 - RNA, 19 nt, Homo sapiens
uggcaaagccucacaaagc

SEQ ID NO: 1182864 - RNA, 19 nt, Homo sapiens
gauauccugcagcuucuga

SEQ ID NO: 1182865 - RNA, 19 nt, Homo sapiens
uugacaagcuuuggugaga

SEQ ID NO: 1182866 - RNA, 19 nt, Homo sapiens
ccaagcagccaaccaaucg

SEQ ID NO: 1182867 - RNA, 19 nt, Homo sapiens
ggacaccaggcuacucauc

SEQ ID NO: 1182868 - RNA, 19 nt, Homo sapiens
ugggcaugaugauagauuu

SEQ ID NO: 1182869 - RNA, 19 nt, Homo sapiens
cguggaggguggucacuca

SEQ ID NO: 1182870 - RNA, 19 nt, Homo sapiens
gggauugguggaaauuaug

SEQ ID NO: 1182871 - RNA, 19 nt, Homo sapiens
caaguucagacaccacaug

SEQ ID NO: 1182872 - RNA, 19 nt, Homo sapiens
uugcuaacguguccacugu

SEQ ID NO: 1182873 - RNA, 19 nt, Homo sapiens
acaccaggcuacucaucug

SEQ ID NO: 1182874 - RNA, 19 nt, Homo sapiens
ggaggcugaguuuccauau

SEQ ID NO: 1182875 - RNA, 19 nt, Homo sapiens
cauacccaguccugauaga

SEQ ID NO: 1182876 - RNA, 19 nt, Homo sapiens
caucggacaccuugauaag

SEQ ID NO: 1182877 - RNA, 19 nt, Homo sapiens
acaccaacgucagcggauu

SEQ ID NO: 1182878 - RNA, 19 nt, Homo sapiens
cauaugcugagaauaaaca

SEQ ID NO: 1182879 - RNA, 19 nt, Homo sapiens
caguggcucugcugacaca

SEQ ID NO: 1182880 - RNA, 19 nt, Homo sapiens
guuaaccugcgaaauuuca

SEQ ID NO: 1182881 - RNA, 19 nt, Homo sapiens
gcugcgcaguuucuaugug

SEQ ID NO: 1182882 - RNA, 19 nt, Homo sapiens
ggucagccuccgucucaug

SEQ ID NO: 1182883 - RNA, 19 nt, Homo sapiens
gggcaugaugauagauuug

SEQ ID NO: 1182884 - RNA, 19 nt, Homo sapiens
gaaccgccugggcaugaug

SEQ ID NO: 1182885 - RNA, 19 nt, Homo sapiens
gagaguuccaccaaguuca

SEQ ID NO: 1182886 - RNA, 19 nt, Homo sapiens
cagagaguuccaccaaguu

SEQ ID NO: 1182887 - RNA, 19 nt, Homo sapiens
gugcugcgcaguuucuaug

SEQ ID NO: 1182888 - RNA, 19 nt, Homo sapiens
ccucgugccucagaaugga

SEQ ID NO: 1182889 - RNA, 19 nt, Homo sapiens
cagaucacuuugaccacau

SEQ ID NO: 1182890 - RNA, 19 nt, Homo sapiens
cacuguggcagaucacuuu

SEQ ID NO: 1182891 - RNA, 19 nt, Homo sapiens
gucauuggaucugaguuca

SEQ ID NO: 1182892 - RNA, 19 nt, Homo sapiens
guugaauguucccgaugau

SEQ ID NO: 1182893 - RNA, 19 nt, Homo sapiens
gccugggcaugaugauaga

SEQ ID NO: 1182894 - RNA, 19 nt, Homo sapiens
gagaauaaacauguuacac

SEQ ID NO: 1182895 - RNA, 19 nt, Homo sapiens
ccuaguucauucacaagca

SEQ ID NO: 1182896 - RNA, 19 nt, Homo sapiens
guuacaagaaugugcuuca

SEQ ID NO: 1182897 - RNA, 19 nt, Homo sapiens
gaccacaucagggcaguca

SEQ ID NO: 1182898 - RNA, 19 nt, Homo sapiens
agagcugugugugacaauu

SEQ ID NO: 1182899 - RNA, 19 nt, Homo sapiens
ggucauccauuccacauua

SEQ ID NO: 1182900 - RNA, 19 nt, Homo sapiens
aguaggagcuucacuauuu

SEQ ID NO: 1182901 - RNA, 19 nt, Homo sapiens
ucacagaucuggagaagug

SEQ ID NO: 1182902 - RNA, 19 nt, Homo sapiens
gcagacauauuccuugaga

SEQ ID NO: 1182903 - RNA, 19 nt, Homo sapiens
acacugagcugaagguuga

SEQ ID NO: 1182904 - RNA, 19 nt, Homo sapiens
ucaaugaccugaagaagga

SEQ ID NO: 1182905 - RNA, 19 nt, Homo sapiens
uaucugagguuggaaauaa

SEQ ID NO: 1182906 - RNA, 19 nt, Homo sapiens
uaaguucccugauagaaga

SEQ ID NO: 1182907 - RNA, 19 nt, Homo sapiens
gaaacagcaucuggauaaa

SEQ ID NO: 1182908 - RNA, 19 nt, Homo sapiens
cuaaguaucuggcaugugu

SEQ ID NO: 1182909 - RNA, 19 nt, Homo sapiens
ccagauaccgggcuaagua

SEQ ID NO: 1182910 - RNA, 19 nt, Homo sapiens
agaaacagcaucuggauaa

SEQ ID NO: 1182911 - RNA, 19 nt, Homo sapiens
agacggagcauguuuauga

SEQ ID NO: 1182912 - RNA, 19 nt, Homo sapiens
ucagugguauccauuauga

SEQ ID NO: 1182913 - RNA, 19 nt, Homo sapiens
uaugagcucuuggagaaua

SEQ ID NO: 1182914 - RNA, 19 nt, Homo sapiens
aaacuuaucugagguugga

SEQ ID NO: 1182915 - RNA, 19 nt, Homo sapiens
uuuaugagcucuuggagaa

SEQ ID NO: 1182916 - RNA, 19 nt, Homo sapiens
uuaauaaguucccugauag

SEQ ID NO: 1182917 - RNA, 19 nt, Homo sapiens
gauggcagcucugguggaa

SEQ ID NO: 1182918 - RNA, 19 nt, Homo sapiens
gggcugauguggagaaucu

SEQ ID NO: 1182919 - RNA, 19 nt, Homo sapiens
gugcagacauauuccuuga

SEQ ID NO: 1182920 - RNA, 19 nt, Homo sapiens
gcaugcaacagaaguauga

SEQ ID NO: 1182921 - RNA, 19 nt, Homo sapiens
gagcuucacuauuucuaag

SEQ ID NO: 1182922 - RNA, 19 nt, Homo sapiens
ggagaaggaccaaagcaau

SEQ ID NO: 1182923 - RNA, 19 nt, Homo sapiens
cagcuguccuguucccuuu

SEQ ID NO: 1182924 - RNA, 19 nt, Homo sapiens
aagcagagaaggaguguaa

SEQ ID NO: 1182925 - RNA, 19 nt, Homo sapiens
aagagaaggugacauugga

SEQ ID NO: 1182926 - RNA, 19 nt, Homo sapiens
aaacucacuucauggauuc

SEQ ID NO: 1182927 - RNA, 19 nt, Homo sapiens
gaggagcgcaugcaacaga

SEQ ID NO: 1182928 - RNA, 19 nt, Homo sapiens
gcaccucaaugaccugaag

SEQ ID NO: 1182929 - RNA, 19 nt, Homo sapiens
gacaguaggagcuucacua

SEQ ID NO: 1182930 - RNA, 19 nt, Homo sapiens
auaaagagaaggugacauu

SEQ ID NO: 1182931 - RNA, 19 nt, Homo sapiens
guaggagcuucacuauuuc

SEQ ID NO: 1182932 - RNA, 19 nt, Homo sapiens
ggagacggagcauguuuau

SEQ ID NO: 1182933 - RNA, 19 nt, Homo sapiens
cacccuggaugagagauua

SEQ ID NO: 1182934 - RNA, 19 nt, Homo sapiens
gaugagagauuauuuugca

SEQ ID NO: 1182935 - RNA, 19 nt, Homo sapiens
gagaaggaccaaagcaauc

SEQ ID NO: 1182936 - RNA, 19 nt, Homo sapiens
ggcaguggguggagagaga

SEQ ID NO: 1182937 - RNA, 19 nt, Homo sapiens
uggauucagugggcaaaua

SEQ ID NO: 1182938 - RNA, 19 nt, Homo sapiens
aauccaggcuagcaaagaa

SEQ ID NO: 1182939 - RNA, 19 nt, Homo sapiens
gaagggcagcugagugugu

SEQ ID NO: 1182940 - RNA, 19 nt, Homo sapiens
ggagcuucacuauuucuaa

SEQ ID NO: 1182941 - RNA, 19 nt, Homo sapiens
cuugagagcauuugagaaa

SEQ ID NO: 1182942 - RNA, 19 nt, Homo sapiens
caagaaacagcaucuggau

SEQ ID NO: 1182943 - RNA, 19 nt, Homo sapiens
guacagacccaggcucuuc

SEQ ID NO: 1182944 - RNA, 19 nt, Homo sapiens
caaauagcggcaagcaaga

SEQ ID NO: 1182945 - RNA, 19 nt, Homo sapiens
gauaaaacaugggcugaug

SEQ ID NO: 1182946 - RNA, 19 nt, Homo sapiens
aacgagaacuccaggacaa

SEQ ID NO: 1182947 - RNA, 19 nt, Homo sapiens
gcauguuuaugagcucuug

SEQ ID NO: 1182948 - RNA, 19 nt, Homo sapiens
gagaacuccaggacaagaa

SEQ ID NO: 1182949 - RNA, 19 nt, Homo sapiens
gggagacgacagaggauga

SEQ ID NO: 1182950 - RNA, 19 nt, Homo sapiens
gagcggauagaaaggaaga

SEQ ID NO: 1182951 - RNA, 19 nt, Homo sapiens
gugaaaaggucccguuugu

SEQ ID NO: 1182952 - RNA, 19 nt, Homo sapiens
gaagacaccaggaaaacaa

SEQ ID NO: 1182953 - RNA, 19 nt, Homo sapiens
gggagaaggaccaaagcaa

SEQ ID NO: 1182954 - RNA, 19 nt, Homo sapiens
gagugugucugcgggagaa

SEQ ID NO: 1182955 - RNA, 19 nt, Homo sapiens
gaauccaggcuagcaaaga

SEQ ID NO: 1182956 - RNA, 19 nt, Homo sapiens
gcggaacacugagcugaag

SEQ ID NO: 1182957 - RNA, 19 nt, Homo sapiens
gaacacugagcugaagguu

SEQ ID NO: 1182958 - RNA, 19 nt, Homo sapiens
ccagugcagucacagaucu

SEQ ID NO: 1182959 - RNA, 19 nt, Homo sapiens
gagaugguacccagaacga

SEQ ID NO: 1182960 - RNA, 19 nt, Homo sapiens
gucauccauuccacauuaa

SEQ ID NO: 1182961 - RNA, 19 nt, Homo sapiens
gagcuccgacgccaguuug

SEQ ID NO: 1182962 - RNA, 19 nt, Homo sapiens
ucuacaagcggaacacuga

SEQ ID NO: 1182963 - RNA, 19 nt, Homo sapiens
gagguuggaaauaaagaga

SEQ ID NO: 1182964 - RNA, 19 nt, Homo sapiens
aaaacucacuucauggauu

SEQ ID NO: 1182965 - RNA, 19 nt, Homo sapiens
gguuggaaauaaagagaag

SEQ ID NO: 1182966 - RNA, 19 nt, Homo sapiens
ucucaacagucagaaugaa

SEQ ID NO: 1182967 - RNA, 19 nt, Homo sapiens
ugaaguggagagcuugaaa

SEQ ID NO: 1182968 - RNA, 19 nt, Homo sapiens
gcuguccuguucccuuuca

SEQ ID NO: 1182969 - RNA, 19 nt, Homo sapiens
gcggauagaaaggaagaaa

SEQ ID NO: 1182970 - RNA, 19 nt, Homo sapiens
ggggugcucuggggaaaua

SEQ ID NO: 1182971 - RNA, 19 nt, Homo sapiens
uaaagagaaggugacauug

SEQ ID NO: 1182972 - RNA, 19 nt, Homo sapiens
ggauucagugggcaaauag

SEQ ID NO: 1182973 - RNA, 19 nt, Homo sapiens
caggagacggagcauguuu

SEQ ID NO: 1182974 - RNA, 19 nt, Homo sapiens
aagaaacagcaucuggaua

SEQ ID NO: 1182975 - RNA, 19 nt, Homo sapiens
cauauuccuugagagcauu

SEQ ID NO: 1182976 - RNA, 19 nt, Homo sapiens
uaauaaguucccugauaga

SEQ ID NO: 1182977 - RNA, 19 nt, Homo sapiens
ggauagaaaggaagaaacg

SEQ ID NO: 1182978 - RNA, 19 nt, Homo sapiens
gccucaagcugcgcaucua

SEQ ID NO: 1182979 - RNA, 19 nt, Homo sapiens
gggcucacuacacgccuua

SEQ ID NO: 1182980 - RNA, 19 nt, Homo sapiens
aaagagaaggugacauugg

SEQ ID NO: 1182981 - RNA, 19 nt, Homo sapiens
ggaggaauccaggcuagca

SEQ ID NO: 1182982 - RNA, 19 nt, Homo sapiens
ggagacgacagaggaugaa

SEQ ID NO: 1182983 - RNA, 19 nt, Homo sapiens
ccaggcucuucgagacuuu

SEQ ID NO: 1182984 - RNA, 19 nt, Homo sapiens
aaguaucuggcauguguua

SEQ ID NO: 1182985 - RNA, 19 nt, Homo sapiens
gacauuggagcggauagaa

SEQ ID NO: 1182986 - RNA, 19 nt, Homo sapiens
uuucagugguauccauuau

SEQ ID NO: 1182987 - RNA, 19 nt, Homo sapiens
gacggagcauguuuaugag

SEQ ID NO: 1182988 - RNA, 19 nt, Homo sapiens
gcaggagacggagcauguu

SEQ ID NO: 1182989 - RNA, 19 nt, Homo sapiens
ggagagcuugaaacgagaa

SEQ ID NO: 1182990 - RNA, 19 nt, Homo sapiens
gaaguggagagcuugaaac

SEQ ID NO: 1182991 - RNA, 19 nt, Homo sapiens
gcucuucgagacuuugaga

SEQ ID NO: 1182992 - RNA, 19 nt, Homo sapiens
ucccguuugugcagacaua

SEQ ID NO: 1182993 - RNA, 19 nt, Homo sapiens
cagcagcuuuucuuaguga

SEQ ID NO: 1182994 - RNA, 19 nt, Homo sapiens
uggcauguguuacagaaac

SEQ ID NO: 1182995 - RNA, 19 nt, Homo sapiens
agugguauccauuaugaaa

SEQ ID NO: 1182996 - RNA, 19 nt, Homo sapiens
gaaucucaacagucagaau

SEQ ID NO: 1182997 - RNA, 19 nt, Homo sapiens
aauaaguucccugauagaa

SEQ ID NO: 1182998 - RNA, 19 nt, Homo sapiens
acaguaggagcuucacuau

SEQ ID NO: 1182999 - RNA, 19 nt, Homo sapiens
gauauugacucucuugaua

SEQ ID NO: 1183000 - RNA, 19 nt, Homo sapiens
caagagcucucacauguuu

SEQ ID NO: 1183001 - RNA, 19 nt, Homo sapiens
gacaagagcucucacaugu

SEQ ID NO: 1183002 - RNA, 19 nt, Homo sapiens
ggagagaauucaugaaaca

SEQ ID NO: 1183003 - RNA, 19 nt, Homo sapiens
ccagaauccucucaaagua

SEQ ID NO: 1183004 - RNA, 19 nt, Homo sapiens
uggcaucuguucuugauua

SEQ ID NO: 1183005 - RNA, 19 nt, Homo sapiens
guacagagcaaagaaguuu

SEQ ID NO: 1183006 - RNA, 19 nt, Homo sapiens
caaaugugauguccucaug

SEQ ID NO: 1183007 - RNA, 19 nt, Homo sapiens
ccaaauacuuagaguuaug

SEQ ID NO: 1183008 - RNA, 19 nt, Homo sapiens
gcucucacauguuuaucua

SEQ ID NO: 1183009 - RNA, 19 nt, Homo sapiens
ucaaaguacucaaguguca

SEQ ID NO: 1183010 - RNA, 19 nt, Homo sapiens
aaacagcacuacuuaaguc

SEQ ID NO: 1183011 - RNA, 19 nt, Homo sapiens
caugaaacagcacuacuua

SEQ ID NO: 1183012 - RNA, 19 nt, Homo sapiens
ccaagacuuuccugauauu

SEQ ID NO: 1183013 - RNA, 19 nt, Homo sapiens
ggaauacacuuuugucuuc

SEQ ID NO: 1183014 - RNA, 19 nt, Homo sapiens
gaaccuaucggcaacuaga

SEQ ID NO: 1183015 - RNA, 19 nt, Homo sapiens
acccaagacuuuccugaua

SEQ ID NO: 1183016 - RNA, 19 nt, Homo sapiens
aaucuucccuucccuaaau

SEQ ID NO: 1183017 - RNA, 19 nt, Homo sapiens
cauagaagaccuaaagaug

SEQ ID NO: 1183018 - RNA, 19 nt, Homo sapiens
gaaacagcacuacuuaagu

SEQ ID NO: 1183019 - RNA, 19 nt, Homo sapiens
uaacuuugccuguguuguu

SEQ ID NO: 1183020 - RNA, 19 nt, Homo sapiens
uaaagaugguagaaccuau

SEQ ID NO: 1183021 - RNA, 19 nt, Homo sapiens
gguccagaauccucucaaa

SEQ ID NO: 1183022 - RNA, 19 nt, Homo sapiens
uugacucucuugauacaua

SEQ ID NO: 1183023 - RNA, 19 nt, Homo sapiens
uagaagaccuaaagauggu

SEQ ID NO: 1183024 - RNA, 19 nt, Homo sapiens
caacuacauugaauuccau

SEQ ID NO: 1183025 - RNA, 19 nt, Homo sapiens
uacccaagcugaacaaucu

SEQ ID NO: 1183026 - RNA, 19 nt, Homo sapiens
gcauagaagaccuaaagau

SEQ ID NO: 1183027 - RNA, 19 nt, Homo sapiens
ggauggaucgcuuccgaaa

SEQ ID NO: 1183028 - RNA, 19 nt, Homo sapiens
ucagagaguacaaauguga

SEQ ID NO: 1183029 - RNA, 19 nt, Homo sapiens
uugauuaacccaagacuuu

SEQ ID NO: 1183030 - RNA, 19 nt, Homo sapiens
gcucauauggcaucuguuc

SEQ ID NO: 1183031 - RNA, 19 nt, Homo sapiens
ggacggguauguugauagc

SEQ ID NO: 1183032 - RNA, 19 nt, Homo sapiens
ugaaacagcacuacuuaag

SEQ ID NO: 1183033 - RNA, 19 nt, Homo sapiens
ucccuucccuaaauaaauu

SEQ ID NO: 1183034 - RNA, 19 nt, Homo sapiens
cccaagacuuuccugauau

SEQ ID NO: 1183035 - RNA, 19 nt, Homo sapiens
cagcucauauggcaucugu

SEQ ID NO: 1183036 - RNA, 19 nt, Homo sapiens
gcaggagcuucaacuacau

SEQ ID NO: 1183037 - RNA, 19 nt, Homo sapiens
cuuccgaaaugcauaugua

SEQ ID NO: 1183038 - RNA, 19 nt, Homo sapiens
cauauggcaucuguucuug

SEQ ID NO: 1183039 - RNA, 19 nt, Homo sapiens
gugauguccucaugagaga

SEQ ID NO: 1183040 - RNA, 19 nt, Homo sapiens
ggcaucuguucuugauuaa

SEQ ID NO: 1183041 - RNA, 19 nt, Homo sapiens
uagcauagaagaccuaaag

SEQ ID NO: 1183042 - RNA, 19 nt, Homo sapiens
auggaucgcuuccgaaaug

SEQ ID NO: 1183043 - RNA, 19 nt, Homo sapiens
cagcacuacuuaaguccaa

SEQ ID NO: 1183044 - RNA, 19 nt, Homo sapiens
aaaugaagcucugaaagac

SEQ ID NO: 1183045 - RNA, 19 nt, Homo sapiens
gaauucagagaguacaaau

SEQ ID NO: 1183046 - RNA, 19 nt, Homo sapiens
uauggcaucuguucuugau

SEQ ID NO: 1183047 - RNA, 19 nt, Homo sapiens
ccacuccccucuugcauuu

SEQ ID NO: 1183048 - RNA, 19 nt, Homo sapiens
gagcaggagcuucaacuac

SEQ ID NO: 1183049 - RNA, 19 nt, Homo sapiens
uagaaccuaucggcaacua

SEQ ID NO: 1183050 - RNA, 19 nt, Homo sapiens
gauguccucaugagagaaa

SEQ ID NO: 1183051 - RNA, 19 nt, Homo sapiens
ggcccuacuuugcauccua

SEQ ID NO: 1183052 - RNA, 19 nt, Homo sapiens
gcauggacggguauguuga

SEQ ID NO: 1183053 - RNA, 19 nt, Homo sapiens
acagagagcaggagcuuca

SEQ ID NO: 1183054 - RNA, 19 nt, Homo sapiens
ccauaacuuugccuguguu

SEQ ID NO: 1183055 - RNA, 19 nt, Homo sapiens
gucgagaauucagagagua

SEQ ID NO: 1183056 - RNA, 19 nt, Homo sapiens
ucaagugucaccaggagaa

SEQ ID NO: 1183057 - RNA, 19 nt, Homo sapiens
gcacuagugacaacuggau

SEQ ID NO: 1183058 - RNA, 19 nt, Homo sapiens
augaagcucugaaagacaa

SEQ ID NO: 1183059 - RNA, 19 nt, Homo sapiens
uauugacucucuugauaca

SEQ ID NO: 1183060 - RNA, 19 nt, Homo sapiens
cuaaagaugguagaaccua

SEQ ID NO: 1183061 - RNA, 19 nt, Homo sapiens
acauugaauuccauuguag

SEQ ID NO: 1183062 - RNA, 19 nt, Homo sapiens
gguacaaaaucgagcauau

SEQ ID NO: 1183063 - RNA, 19 nt, Homo sapiens
agacaagagcucucacaug

SEQ ID NO: 1183064 - RNA, 19 nt, Homo sapiens
gcccuacuuugcauccuau

SEQ ID NO: 1183065 - RNA, 19 nt, Homo sapiens
guacaaaaucgagcauaua

SEQ ID NO: 1183066 - RNA, 19 nt, Homo sapiens
ccucuugcauuuauuuguc

SEQ ID NO: 1183067 - RNA, 19 nt, Homo sapiens
agcaggagcuucaacuaca

SEQ ID NO: 1183068 - RNA, 19 nt, Homo sapiens
ucauauggcaucuguucuu

SEQ ID NO: 1183069 - RNA, 19 nt, Homo sapiens
ucaugaaacagcacuacuu

SEQ ID NO: 1183070 - RNA, 19 nt, Homo sapiens
uauaugcacuagugacaac

SEQ ID NO: 1183071 - RNA, 19 nt, Homo sapiens
gauacauacccaagcugaa

SEQ ID NO: 1183072 - RNA, 19 nt, Homo sapiens
ugucgacauucagcucaua

SEQ ID NO: 1183073 - RNA, 19 nt, Homo sapiens
aaaaugaagcucugaaaga

SEQ ID NO: 1183074 - RNA, 19 nt, Homo sapiens
uuggagagaauucaugaaa

SEQ ID NO: 1183075 - RNA, 19 nt, Homo sapiens
cuacauugaauuccauugu

SEQ ID NO: 1183076 - RNA, 19 nt, Homo sapiens
ugaaagacaagagcucuca

SEQ ID NO: 1183077 - RNA, 19 nt, Homo sapiens
auucagagaguacaaaugu

SEQ ID NO: 1183078 - RNA, 19 nt, Homo sapiens
gagaauucagagaguacaa

SEQ ID NO: 1183079 - RNA, 19 nt, Homo sapiens
gaaaaugaagcucugaaag

SEQ ID NO: 1183080 - RNA, 19 nt, Homo sapiens
caucuguucuugauuaacc

SEQ ID NO: 1183081 - RNA, 19 nt, Homo sapiens
gccccugccuccaucaaua

SEQ ID NO: 1183082 - RNA, 19 nt, Homo sapiens
acaaucuucccuucccuaa

SEQ ID NO: 1183083 - RNA, 19 nt, Homo sapiens
agacuuuccugauauugac

SEQ ID NO: 1183084 - RNA, 19 nt, Homo sapiens
ucagguauugguagaguau

SEQ ID NO: 1183085 - RNA, 19 nt, Homo sapiens
gauagcauagaagaccuaa

SEQ ID NO: 1183086 - RNA, 19 nt, Homo sapiens
ucucaaaguacucaagugu

SEQ ID NO: 1183087 - RNA, 19 nt, Homo sapiens
agaauccucucaaaguacu

SEQ ID NO: 1183088 - RNA, 19 nt, Homo sapiens
cauauaugcacuagugaca

SEQ ID NO: 1183089 - RNA, 19 nt, Homo sapiens
gagaguacaaaugugaugu

SEQ ID NO: 1183090 - RNA, 19 nt, Homo sapiens
cgacauucagcucauaugg

SEQ ID NO: 1183091 - RNA, 19 nt, Homo sapiens
ccucagguauugguagagu

SEQ ID NO: 1183092 - RNA, 19 nt, Homo sapiens
uagcauggacggguauguu

SEQ ID NO: 1183093 - RNA, 19 nt, Homo sapiens
uccagaauccucucaaagu

SEQ ID NO: 1183094 - RNA, 19 nt, Homo sapiens
aacuuugccuguguuguuu

SEQ ID NO: 1183095 - RNA, 19 nt, Homo sapiens
aaugugauguccucaugag

SEQ ID NO: 1183096 - RNA, 19 nt, Homo sapiens
uaugcacacugcuuguaca

SEQ ID NO: 1183097 - RNA, 19 nt, Homo sapiens
uggagagaauucaugaaac

SEQ ID NO: 1183098 - RNA, 19 nt, Homo sapiens
gagagcaggagcuucaacu

SEQ ID NO: 1183099 - RNA, 19 nt, Homo sapiens
ggaagaaccuaauagauga

SEQ ID NO: 1183100 - RNA, 19 nt, Homo sapiens
gcagugacauugcagauaa

SEQ ID NO: 1183101 - RNA, 19 nt, Homo sapiens
gcacaaaacucucaugaug

SEQ ID NO: 1183102 - RNA, 19 nt, Homo sapiens
caacuucuaucaaauguca

SEQ ID NO: 1183103 - RNA, 19 nt, Homo sapiens
caucuaaagucaacugaaa

SEQ ID NO: 1183104 - RNA, 19 nt, Homo sapiens
gaaccaaaggacuuaguua

SEQ ID NO: 1183105 - RNA, 19 nt, Homo sapiens
gacaguugauggcgaauuu

SEQ ID NO: 1183106 - RNA, 19 nt, Homo sapiens
gagcccagaugaacuuaaa

SEQ ID NO: 1183107 - RNA, 19 nt, Homo sapiens
aaugucaacuccagaaaua

SEQ ID NO: 1183108 - RNA, 19 nt, Homo sapiens
ggacuuaguuaccuguuuc

SEQ ID NO: 1183109 - RNA, 19 nt, Homo sapiens
gaaacugauugucgauaug

SEQ ID NO: 1183110 - RNA, 19 nt, Homo sapiens
gauaaacucuaugccuuga

SEQ ID NO: 1183111 - RNA, 19 nt, Homo sapiens
aaagagcucccuaauguuu

SEQ ID NO: 1183112 - RNA, 19 nt, Homo sapiens
ggaggagaaagaaauuaua

SEQ ID NO: 1183113 - RNA, 19 nt, Homo sapiens
cuacccaacuucuaucaaa

SEQ ID NO: 1183114 - RNA, 19 nt, Homo sapiens
gaaugacaggguauauaua

SEQ ID NO: 1183115 - RNA, 19 nt, Homo sapiens
gagcaugggauucuuaguu

SEQ ID NO: 1183116 - RNA, 19 nt, Homo sapiens
caacugcauugugaauaaa

SEQ ID NO: 1183117 - RNA, 19 nt, Homo sapiens
gcgaauuucugcauuacau

SEQ ID NO: 1183118 - RNA, 19 nt, Homo sapiens
caagauccguacacacgaa

SEQ ID NO: 1183119 - RNA, 19 nt, Homo sapiens
auacagccauggaaagaaa

SEQ ID NO: 1183120 - RNA, 19 nt, Homo sapiens
uaaacucuaugccuugaau

SEQ ID NO: 1183121 - RNA, 19 nt, Homo sapiens
gagaugccauugccaacug

SEQ ID NO: 1183122 - RNA, 19 nt, Homo sapiens
cugugcagcugacauauuu

SEQ ID NO: 1183123 - RNA, 19 nt, Homo sapiens
ccagugaaauagcaaaaua

SEQ ID NO: 1183124 - RNA, 19 nt, Homo sapiens
ugaaugacaggguauauau

SEQ ID NO: 1183125 - RNA, 19 nt, Homo sapiens
agaaacugauugucgauau

SEQ ID NO: 1183126 - RNA, 19 nt, Homo sapiens
gaaggagccauuuaucauc

SEQ ID NO: 1183127 - RNA, 19 nt, Homo sapiens
acgauacugugauaaauga

SEQ ID NO: 1183128 - RNA, 19 nt, Homo sapiens
gacaggguauauauaggaa

SEQ ID NO: 1183129 - RNA, 19 nt, Homo sapiens
gaagcaagaggccgaagga

SEQ ID NO: 1183130 - RNA, 19 nt, Homo sapiens
uggaagaaccuaauagaug

SEQ ID NO: 1183131 - RNA, 19 nt, Homo sapiens
gauggcgaauuucugcauu

SEQ ID NO: 1183132 - RNA, 19 nt, Homo sapiens
gagaauuccaaguguugua

SEQ ID NO: 1183133 - RNA, 19 nt, Homo sapiens
guacacacgaagccuuuaa

SEQ ID NO: 1183134 - RNA, 19 nt, Homo sapiens
gacaucaaagucugaaauu

SEQ ID NO: 1183135 - RNA, 19 nt, Homo sapiens
gaaggaaaggaaauaccaa

SEQ ID NO: 1183136 - RNA, 19 nt, Homo sapiens
ggaucagagugacaguuga

SEQ ID NO: 1183137 - RNA, 19 nt, Homo sapiens
ucagaacgauugcuuugag

SEQ ID NO: 1183138 - RNA, 19 nt, Homo sapiens
ggagccauuuaucaucuug

SEQ ID NO: 1183139 - RNA, 19 nt, Homo sapiens
uuuaucaucuugccaguau

SEQ ID NO: 1183140 - RNA, 19 nt, Homo sapiens
agcaugggauucuuaguuu

SEQ ID NO: 1183141 - RNA, 19 nt, Homo sapiens
ggaaggaaaggaaauacca

SEQ ID NO: 1183142 - RNA, 19 nt, Homo sapiens
caaaucaggagcccagaug

SEQ ID NO: 1183143 - RNA, 19 nt, Homo sapiens
cgaaggagccauuuaucau

SEQ ID NO: 1183144 - RNA, 19 nt, Homo sapiens
gcacaaccuggaagcaaga

SEQ ID NO: 1183145 - RNA, 19 nt, Homo sapiens
gaacacccagucugcacaa

SEQ ID NO: 1183146 - RNA, 19 nt, Homo sapiens
gaagaaccuaauagaugaa

SEQ ID NO: 1183147 - RNA, 19 nt, Homo sapiens
aaagucaacugaaaaguga

SEQ ID NO: 1183148 - RNA, 19 nt, Homo sapiens
uccagacgauacugugaua

SEQ ID NO: 1183149 - RNA, 19 nt, Homo sapiens
ucaggaaggaucagaguga

SEQ ID NO: 1183150 - RNA, 19 nt, Homo sapiens
gauaaaugacaucaaaguc

SEQ ID NO: 1183151 - RNA, 19 nt, Homo sapiens
agacgauacugugauaaau

SEQ ID NO: 1183152 - RNA, 19 nt, Homo sapiens
cagacgauacugugauaaa

SEQ ID NO: 1183153 - RNA, 19 nt, Homo sapiens
cauugcagauaaacucuau

SEQ ID NO: 1183154 - RNA, 19 nt, Homo sapiens
uaucaaguucgcagcauaa

SEQ ID NO: 1183155 - RNA, 19 nt, Homo sapiens
uaucaucuugccaguauuu

SEQ ID NO: 1183156 - RNA, 19 nt, Homo sapiens
gcuaauuggcagugacauu

SEQ ID NO: 1183157 - RNA, 19 nt, Homo sapiens
gcaguaauacagccaugga

SEQ ID NO: 1183158 - RNA, 19 nt, Homo sapiens
ccaaaggacuuaguuaccu

SEQ ID NO: 1183159 - RNA, 19 nt, Homo sapiens
gacucucucuucaucauuc

SEQ ID NO: 1183160 - RNA, 19 nt, Homo sapiens
gacgauacugugauaaaug

SEQ ID NO: 1183161 - RNA, 19 nt, Homo sapiens
caaaugucaacuccagaaa

SEQ ID NO: 1183162 - RNA, 19 nt, Homo sapiens
ucaaaugucaacuccagaa

SEQ ID NO: 1183163 - RNA, 19 nt, Homo sapiens
gcccgagaauuccaagugu

SEQ ID NO: 1183164 - RNA, 19 nt, Homo sapiens
uaauacagccauggaaaga

SEQ ID NO: 1183165 - RNA, 19 nt, Homo sapiens
ugacaggguauauauagga

SEQ ID NO: 1183166 - RNA, 19 nt, Homo sapiens
aauuauaucugcucuuugc

SEQ ID NO: 1183167 - RNA, 19 nt, Homo sapiens
cauaaccuuugcccgagaa

SEQ ID NO: 1183168 - RNA, 19 nt, Homo sapiens
gaagcaggcaguaauacag

SEQ ID NO: 1183169 - RNA, 19 nt, Homo sapiens
uccuuuaugucuucaguuu

SEQ ID NO: 1183170 - RNA, 19 nt, Homo sapiens
gcagacuggauccaaauca

SEQ ID NO: 1183171 - RNA, 19 nt, Homo sapiens
ugacaucaaagucugaaau

SEQ ID NO: 1183172 - RNA, 19 nt, Homo sapiens
uuugagcucugaagugguu

SEQ ID NO: 1183173 - RNA, 19 nt, Homo sapiens
guucgcagcauaaccuuug

SEQ ID NO: 1183174 - RNA, 19 nt, Homo sapiens
guaauacagccauggaaag

SEQ ID NO: 1183175 - RNA, 19 nt, Homo sapiens
ucagugucaucuaaaguca

SEQ ID NO: 1183176 - RNA, 19 nt, Homo sapiens
ccagaugaacuuaaagaag

SEQ ID NO: 1183177 - RNA, 19 nt, Homo sapiens
cuaauuggcagugacauug

SEQ ID NO: 1183178 - RNA, 19 nt, Homo sapiens
gcccagaugaacuuaaaga

SEQ ID NO: 1183179 - RNA, 19 nt, Homo sapiens
acacgaagccuuuaaucag

SEQ ID NO: 1183180 - RNA, 19 nt, Homo sapiens
gaagcgagcaugggauucu

SEQ ID NO: 1183181 - RNA, 19 nt, Homo sapiens
ggccgaaggagccauuuau

SEQ ID NO: 1183182 - RNA, 19 nt, Homo sapiens
ggaaaggaaauaccaaaau

SEQ ID NO: 1183183 - RNA, 19 nt, Homo sapiens
gauauucggcuacccaacu

SEQ ID NO: 1183184 - RNA, 19 nt, Homo sapiens
ccgaaggagccauuuauca

SEQ ID NO: 1183185 - RNA, 19 nt, Homo sapiens
acaaaacucucaugaugga

SEQ ID NO: 1183186 - RNA, 19 nt, Homo sapiens
cagugacauugcagauaaa

SEQ ID NO: 1183187 - RNA, 19 nt, Homo sapiens
auaucaaguucgcagcaua

SEQ ID NO: 1183188 - RNA, 19 nt, Homo sapiens
uauggaagaaccuaauaga

SEQ ID NO: 1183189 - RNA, 19 nt, Homo sapiens
cgcuacaucucccgccuuu

SEQ ID NO: 1183190 - RNA, 19 nt, Homo sapiens
uaaacucuccuugcuuguu

SEQ ID NO: 1183191 - RNA, 19 nt, Homo sapiens
caacuccaguguccguuuu

SEQ ID NO: 1183192 - RNA, 19 nt, Homo sapiens
ugucugggcuuggguagau

SEQ ID NO: 1183193 - RNA, 19 nt, Homo sapiens
caaauucagaagcgagaug

SEQ ID NO: 1183194 - RNA, 19 nt, Homo sapiens
gaucaccccugacacaaca

SEQ ID NO: 1183195 - RNA, 19 nt, Homo sapiens
ugacauugcagauaaacuc

SEQ ID NO: 1183196 - RNA, 19 nt, Homo sapiens
ggcagugacauugcagaua

SEQ ID NO: 1183197 - RNA, 19 nt, Homo sapiens
cagaaacugauugucgaua

SEQ ID NO: 1183198 - RNA, 19 nt, Homo sapiens
ggguggcaguggauucuuc

SEQ ID NO: 1183199 - RNA, 19 nt, Homo sapiens
gaagugacauccuguuauu

SEQ ID NO: 1183200 - RNA, 19 nt, Homo sapiens
gaaaguggauucugagguu

SEQ ID NO: 1183201 - RNA, 19 nt, Homo sapiens
gaacauaagaguccauauu

SEQ ID NO: 1183202 - RNA, 19 nt, Homo sapiens
gaacagagggaauaugguu

SEQ ID NO: 1183203 - RNA, 19 nt, Homo sapiens
ccucucagcuccugccuua

SEQ ID NO: 1183204 - RNA, 19 nt, Homo sapiens
cagcaucucuggcaaguga

SEQ ID NO: 1183205 - RNA, 19 nt, Homo sapiens
gaucaaaggccucugaaug

SEQ ID NO: 1183206 - RNA, 19 nt, Homo sapiens
gaaggaggauucccagagu

SEQ ID NO: 1183207 - RNA, 19 nt, Homo sapiens
cagauaaugugccugcuuu

SEQ ID NO: 1183208 - RNA, 19 nt, Homo sapiens
gcagcuggaugaauuccua

SEQ ID NO: 1183209 - RNA, 19 nt, Homo sapiens
gagaugagcccacccaaug

SEQ ID NO: 1183210 - RNA, 19 nt, Homo sapiens
ggaauaugguugcacaauc

SEQ ID NO: 1183211 - RNA, 19 nt, Homo sapiens
gaaggaccaucaucuugug

SEQ ID NO: 1183212 - RNA, 19 nt, Homo sapiens
gaagggucuuucucaugua

SEQ ID NO: 1183213 - RNA, 19 nt, Homo sapiens
cagcgguucuucacagaua

SEQ ID NO: 1183214 - RNA, 19 nt, Homo sapiens
ggagcugacuucaccuuug

SEQ ID NO: 1183215 - RNA, 19 nt, Homo sapiens
ugugaaaucuggcaacuau

SEQ ID NO: 1183216 - RNA, 19 nt, Homo sapiens
gugagacacuugcguuuga

SEQ ID NO: 1183217 - RNA, 19 nt, Homo sapiens
ugaagggucuuucucaugu

SEQ ID NO: 1183218 - RNA, 19 nt, Homo sapiens
agaaggaacugaaggacuu

SEQ ID NO: 1183219 - RNA, 19 nt, Homo sapiens
ggaagugguacaccugaua

SEQ ID NO: 1183220 - RNA, 19 nt, Homo sapiens
uggcaacuauacaguguua

SEQ ID NO: 1183221 - RNA, 19 nt, Homo sapiens
guacaaagaacauaagagu

SEQ ID NO: 1183222 - RNA, 19 nt, Homo sapiens
uugcauggcuguacaaaga

SEQ ID NO: 1183223 - RNA, 19 nt, Homo sapiens
ugaguuagcugcccagagu

SEQ ID NO: 1183224 - RNA, 19 nt, Homo sapiens
ccauauuucuaguggauuu

SEQ ID NO: 1183225 - RNA, 19 nt, Homo sapiens
cagcagaaauggagcuaug

SEQ ID NO: 1183226 - RNA, 19 nt, Homo sapiens
cgacacacagucuacaaua

SEQ ID NO: 1183227 - RNA, 19 nt, Homo sapiens
guacaaaccacaggugauu

SEQ ID NO: 1183228 - RNA, 19 nt, Homo sapiens
ggaaaucccucagcugaac

SEQ ID NO: 1183229 - RNA, 19 nt, Homo sapiens
gacacacagucuacaauau

SEQ ID NO: 1183230 - RNA, 19 nt, Homo sapiens
gcacgaggaauccagcuuu

SEQ ID NO: 1183231 - RNA, 19 nt, Homo sapiens
caagugaacagagggaaua

SEQ ID NO: 1183232 - RNA, 19 nt, Homo sapiens
ggacaauccuugaaaugcu

SEQ ID NO: 1183233 - RNA, 19 nt, Homo sapiens
gcacaauccagugacguua

SEQ ID NO: 1183234 - RNA, 19 nt, Homo sapiens
gaauaugguugcacaaucc

SEQ ID NO: 1183235 - RNA, 19 nt, Homo sapiens
ccagguggcugcagaugug

SEQ ID NO: 1183236 - RNA, 19 nt, Homo sapiens
gcugaagaauaaagauuuc

SEQ ID NO: 1183237 - RNA, 19 nt, Homo sapiens
agacuguucugacaaucua

SEQ ID NO: 1183238 - RNA, 19 nt, Homo sapiens
gagcugcccacgcuucuuu

SEQ ID NO: 1183239 - RNA, 19 nt, Homo sapiens
caaguuggauucucuacag

SEQ ID NO: 1183240 - RNA, 19 nt, Homo sapiens
ggaguuguuugaagugaca

SEQ ID NO: 1183241 - RNA, 19 nt, Homo sapiens
gagcugacuucaccuuugg

SEQ ID NO: 1183242 - RNA, 19 nt, Homo sapiens
caucuguccugcaggguuu

SEQ ID NO: 1183243 - RNA, 19 nt, Homo sapiens
cagcugugcucacugguau

SEQ ID NO: 1183244 - RNA, 19 nt, Homo sapiens
aaacugguguggccuagug

SEQ ID NO: 1183245 - RNA, 19 nt, Homo sapiens
cccaagaugugaagccaaa

SEQ ID NO: 1183246 - RNA, 19 nt, Homo sapiens
ccugagaguugcugguauu

SEQ ID NO: 1183247 - RNA, 19 nt, Homo sapiens
gcagaaauggagcuaugaa

SEQ ID NO: 1183248 - RNA, 19 nt, Homo sapiens
ggaaaaggauccccguaau

SEQ ID NO: 1183249 - RNA, 19 nt, Homo sapiens
ccugagugacccagaauua

SEQ ID NO: 1183250 - RNA, 19 nt, Homo sapiens
ggucaccuguacagacuga

SEQ ID NO: 1183251 - RNA, 19 nt, Homo sapiens
gaaauggagcuaugaagac

SEQ ID NO: 1183252 - RNA, 19 nt, Homo sapiens
uugaaaugcuccuggguuu

SEQ ID NO: 1183253 - RNA, 19 nt, Homo sapiens
cuccuugacuccuuccuua

SEQ ID NO: 1183254 - RNA, 19 nt, Homo sapiens
gaggaguuguuugaaguga

SEQ ID NO: 1183255 - RNA, 19 nt, Homo sapiens
ucuaccugcugaagaauaa

SEQ ID NO: 1183256 - RNA, 19 nt, Homo sapiens
uauacaguguuacaaguug

SEQ ID NO: 1183257 - RNA, 19 nt, Homo sapiens
ccaccugagcccugaguua

SEQ ID NO: 1183258 - RNA, 19 nt, Homo sapiens
ucaugggccuccugaguga

SEQ ID NO: 1183259 - RNA, 19 nt, Homo sapiens
gagaaggagcccucaguuc

SEQ ID NO: 1183260 - RNA, 19 nt, Homo sapiens
acaauccagugacguuauu

SEQ ID NO: 1183261 - RNA, 19 nt, Homo sapiens
guuauuucccuaucgauuu

SEQ ID NO: 1183262 - RNA, 19 nt, Homo sapiens
ggccuagacuguucugaca

SEQ ID NO: 1183263 - RNA, 19 nt, Homo sapiens
gaaggagcccucaguucug

SEQ ID NO: 1183264 - RNA, 19 nt, Homo sapiens
gagaguugcugguauuucc

SEQ ID NO: 1183265 - RNA, 19 nt, Homo sapiens
acacuugcguuugaagaaa

SEQ ID NO: 1183266 - RNA, 19 nt, Homo sapiens
ggaugaauuccuacagcua

SEQ ID NO: 1183267 - RNA, 19 nt, Homo sapiens
gcacuggaagcaucaggaa

SEQ ID NO: 1183268 - RNA, 19 nt, Homo sapiens
ccagcaauguaccgccuuu

SEQ ID NO: 1183269 - RNA, 19 nt, Homo sapiens
gcgcugugcuggcuucuac

SEQ ID NO: 1183270 - RNA, 19 nt, Homo sapiens
gcuggcagauguugucuac

SEQ ID NO: 1183271 - RNA, 19 nt, Homo sapiens
cauaagaguccauauuucu

SEQ ID NO: 1183272 - RNA, 19 nt, Homo sapiens
acauaagaguccauauuuc

SEQ ID NO: 1183273 - RNA, 19 nt, Homo sapiens
ccacagacacagcacaaau

SEQ ID NO: 1183274 - RNA, 19 nt, Homo sapiens
agucaggccuucacucuuc

SEQ ID NO: 1183275 - RNA, 19 nt, Homo sapiens
gcccuuggguccucucuag

SEQ ID NO: 1183276 - RNA, 19 nt, Homo sapiens
gcuaugaagacaaagauca

SEQ ID NO: 1183277 - RNA, 19 nt, Homo sapiens
agaaauggagcuaugaaga

SEQ ID NO: 1183278 - RNA, 19 nt, Homo sapiens
gcaacuauacaguguuaca

SEQ ID NO: 1183279 - RNA, 19 nt, Homo sapiens
gcuccuggguuucuugaag

SEQ ID NO: 1183280 - RNA, 19 nt, Homo sapiens
ugacugccuuucccacaga

SEQ ID NO: 1183281 - RNA, 19 nt, Homo sapiens
ucagacagauggcagaaaa

SEQ ID NO: 1183282 - RNA, 19 nt, Homo sapiens
cacacagucuacaauauca

SEQ ID NO: 1183283 - RNA, 19 nt, Homo sapiens
ccuagacuguucugacaau

SEQ ID NO: 1183284 - RNA, 19 nt, Homo sapiens
ucucucugcucaugucuga

SEQ ID NO: 1183285 - RNA, 19 nt, Homo sapiens
aaauggagcuaugaagaca

SEQ ID NO: 1183286 - RNA, 19 nt, Homo sapiens
ccagagagaagaccucauc

SEQ ID NO: 1183287 - RNA, 19 nt, Homo sapiens
gaauccagcuuuugucaca

SEQ ID NO: 1183288 - RNA, 19 nt, Homo sapiens
ggagaugagcccacccaau

SEQ ID NO: 1183289 - RNA, 19 nt, Homo sapiens
gagccuaggagcugacuuc

SEQ ID NO: 1183290 - RNA, 19 nt, Homo sapiens
cugggucucuugcauuuau

SEQ ID NO: 1183291 - RNA, 19 nt, Homo sapiens
gcugaaggaccaucaucuu

SEQ ID NO: 1183292 - RNA, 19 nt, Homo sapiens
gcgcaaggaagcaguguca

SEQ ID NO: 1183293 - RNA, 19 nt, Homo sapiens
gaagccaaacuacuugaag

SEQ ID NO: 1183294 - RNA, 19 nt, Homo sapiens
ggagcuaugaagacaaaga

SEQ ID NO: 1183295 - RNA, 19 nt, Homo sapiens
ugaaggaccaucaucuugu

SEQ ID NO: 1183296 - RNA, 19 nt, Homo sapiens
uaagaguccauauuucuag

SEQ ID NO: 1183297 - RNA, 19 nt, Homo sapiens
cugauacuguucuaugaga

SEQ ID NO: 1183298 - RNA, 19 nt, Homo sapiens
gagcagauuccagccauuc

SEQ ID NO: 1183299 - RNA, 19 nt, Homo sapiens
gaauaaggaugcgcgaauu

SEQ ID NO: 1183300 - RNA, 19 nt, Homo sapiens
ggacgagucugagauguug

SEQ ID NO: 1183301 - RNA, 19 nt, Homo sapiens
caccaaaucugaauaagga

SEQ ID NO: 1183302 - RNA, 19 nt, Homo sapiens
gcaacgcuguagccaauuu

SEQ ID NO: 1183303 - RNA, 19 nt, Homo sapiens
caauacugaugccuuguuu

SEQ ID NO: 1183304 - RNA, 19 nt, Homo sapiens
gguacaagcuaauacucaa

SEQ ID NO: 1183305 - RNA, 19 nt, Homo sapiens
gcgaggagcucuacgucau

SEQ ID NO: 1183306 - RNA, 19 nt, Homo sapiens
caaagaacgccggaugaaa

SEQ ID NO: 1183307 - RNA, 19 nt, Homo sapiens
ccaaagagacggacaacuc

SEQ ID NO: 1183308 - RNA, 19 nt, Homo sapiens
gcgcguggcacaucaaaug

SEQ ID NO: 1183309 - RNA, 19 nt, Homo sapiens
ucuuucaccucaacuguuu

SEQ ID NO: 1183310 - RNA, 19 nt, Homo sapiens
ggagaccggccucaacaug

SEQ ID NO: 1183311 - RNA, 19 nt, Homo sapiens
ccaaagaacgccggaugaa

SEQ ID NO: 1183312 - RNA, 19 nt, Homo sapiens
aauaaggaugcgcgaauua

SEQ ID NO: 1183313 - RNA, 19 nt, Homo sapiens
gcuguagccaauuuagaua

SEQ ID NO: 1183314 - RNA, 19 nt, Homo sapiens
gcagccuccugaaaccaaa

SEQ ID NO: 1183315 - RNA, 19 nt, Homo sapiens
gaagcagccuccugaaacc

SEQ ID NO: 1183316 - RNA, 19 nt, Homo sapiens
caacgcuguagccaauuua

SEQ ID NO: 1183317 - RNA, 19 nt, Homo sapiens
acaaggagacggccaacaa

SEQ ID NO: 1183318 - RNA, 19 nt, Homo sapiens
cagcaaccgcgagcaauuu

SEQ ID NO: 1183319 - RNA, 19 nt, Homo sapiens
aaagaacgccggaugaaac

SEQ ID NO: 1183320 - RNA, 19 nt, Homo sapiens
cgaagcagccuccugaaac

SEQ ID NO: 1183321 - RNA, 19 nt, Homo sapiens
cgucaccaaaucugaauaa

SEQ ID NO: 1183322 - RNA, 19 nt, Homo sapiens
ugaauaaggaugcgcgaau

SEQ ID NO: 1183323 - RNA, 19 nt, Homo sapiens
ccagcaaccgcgagcaauu

SEQ ID NO: 1183324 - RNA, 19 nt, Homo sapiens
ccacgucaccaaaucugaa

SEQ ID NO: 1183325 - RNA, 19 nt, Homo sapiens
gggcaagcucuacugcaaa

SEQ ID NO: 1183326 - RNA, 19 nt, Homo sapiens
gcucauccagccucaagga

SEQ ID NO: 1183327 - RNA, 19 nt, Homo sapiens
ggcaagcucuacugcaaaa

SEQ ID NO: 1183328 - RNA, 19 nt, Homo sapiens
gccagagauugcccaagga

SEQ ID NO: 1183329 - RNA, 19 nt, Homo sapiens
ccagcagccacccgagaua

SEQ ID NO: 1183330 - RNA, 19 nt, Homo sapiens
uguagccaauuuagauaug

SEQ ID NO: 1183331 - RNA, 19 nt, Homo sapiens
caaccgcgagcaauuucuu

SEQ ID NO: 1183332 - RNA, 19 nt, Homo sapiens
ccgaagcagccuccugaaa

SEQ ID NO: 1183333 - RNA, 19 nt, Homo sapiens
agggcaagcucuacugcaa

SEQ ID NO: 1183334 - RNA, 19 nt, Homo sapiens
gagcucauccagccucaag

SEQ ID NO: 1183335 - RNA, 19 nt, Homo sapiens
acaaguucgugugcaaaga

SEQ ID NO: 1183336 - RNA, 19 nt, Homo sapiens
gauccggaccgcuugaaag

SEQ ID NO: 1183337 - RNA, 19 nt, Homo sapiens
gcagcgccacgucaccaaa

SEQ ID NO: 1183338 - RNA, 19 nt, Homo sapiens
uccggagggucaagagauu

SEQ ID NO: 1183339 - RNA, 19 nt, Homo sapiens
aagcaacuacgacuucuuc

SEQ ID NO: 1183340 - RNA, 19 nt, Homo sapiens
caagcuaauacucaacaau

SEQ ID NO: 1183341 - RNA, 19 nt, Homo sapiens
ggauccggaccgcuugaaa

SEQ ID NO: 1183342 - RNA, 19 nt, Homo sapiens
caggagaccggccucaaca

SEQ ID NO: 1183343 - RNA, 19 nt, Homo sapiens
cuaccaaggcgacuacuac

SEQ ID NO: 1183344 - RNA, 19 nt, Homo sapiens
gcuaauacucaacaauacu

SEQ ID NO: 1183345 - RNA, 19 nt, Homo sapiens
gagacuaccaaggcgacua

SEQ ID NO: 1183346 - RNA, 19 nt, Homo sapiens
gcccauccucgaccgcuuu

SEQ ID NO: 1183347 - RNA, 19 nt, Homo sapiens
cagguucaccgacaugauc

SEQ ID NO: 1183348 - RNA, 19 nt, Homo sapiens
cuacuacggagacuaccaa

SEQ ID NO: 1183349 - RNA, 19 nt, Homo sapiens
guacggaccgcaguuuguc

SEQ ID NO: 1183350 - RNA, 19 nt, Homo sapiens
acaagcuaauacucaacaa

SEQ ID NO: 1183351 - RNA, 19 nt, Homo sapiens
cuaauacucaacaauacug

SEQ ID NO: 1183352 - RNA, 19 nt, Homo sapiens
gaaacaagauugaaggaaa

SEQ ID NO: 1183353 - RNA, 19 nt, Homo sapiens
gcauuacucuuguucauua

SEQ ID NO: 1183354 - RNA, 19 nt, Homo sapiens
gaacugaacuugaaacacu

SEQ ID NO: 1183355 - RNA, 19 nt, Homo sapiens
gcagagguaugaugauauu

SEQ ID NO: 1183356 - RNA, 19 nt, Homo sapiens
gacaauugguggccauuua

SEQ ID NO: 1183357 - RNA, 19 nt, Homo sapiens
gcagaaggacuuugacaua

SEQ ID NO: 1183358 - RNA, 19 nt, Homo sapiens
caagaaguaugguuaaguu

SEQ ID NO: 1183359 - RNA, 19 nt, Homo sapiens
gaagaugcacugacuagaa

SEQ ID NO: 1183360 - RNA, 19 nt, Homo sapiens
aaugaaagauugcugauga

SEQ ID NO: 1183361 - RNA, 19 nt, Homo sapiens
gacuagaacugaacuugaa

SEQ ID NO: 1183362 - RNA, 19 nt, Homo sapiens
gcggagaccuggaguuguu

SEQ ID NO: 1183363 - RNA, 19 nt, Homo sapiens
ccaagcaacugaaggauuc

SEQ ID NO: 1183364 - RNA, 19 nt, Homo sapiens
gagaugauguucaccuuca

SEQ ID NO: 1183365 - RNA, 19 nt, Homo sapiens
ugacagaugugacaaccaa

SEQ ID NO: 1183366 - RNA, 19 nt, Homo sapiens
gaggagccguggacucaaa

SEQ ID NO: 1183367 - RNA, 19 nt, Homo sapiens
gaaggcagagguaugauga

SEQ ID NO: 1183368 - RNA, 19 nt, Homo sapiens
gaacgaaggcagagguaug

SEQ ID NO: 1183369 - RNA, 19 nt, Homo sapiens
uagaagaaauugaggaaca

SEQ ID NO: 1183370 - RNA, 19 nt, Homo sapiens
acaacuggaugaacuacua

SEQ ID NO: 1183371 - RNA, 19 nt, Homo sapiens
gcuaaaagcugaauauucu

SEQ ID NO: 1183372 - RNA, 19 nt, Homo sapiens
gaaggacuuugacauagca

SEQ ID NO: 1183373 - RNA, 19 nt, Homo sapiens
gcaagaguguggauguauc

SEQ ID NO: 1183374 - RNA, 19 nt, Homo sapiens
ggaguuguuugacuuagug

SEQ ID NO: 1183375 - RNA, 19 nt, Homo sapiens
aaagauugcccacgaauug

SEQ ID NO: 1183376 - RNA, 19 nt, Homo sapiens
gguacaaguugcugguuga

SEQ ID NO: 1183377 - RNA, 19 nt, Homo sapiens
aaaccugaauuuccuguau

SEQ ID NO: 1183378 - RNA, 19 nt, Homo sapiens
uaucguaagcuuucacuaa

SEQ ID NO: 1183379 - RNA, 19 nt, Homo sapiens
cagaaggacuuugacauag

SEQ ID NO: 1183380 - RNA, 19 nt, Homo sapiens
gagcuggcauuacucuugu

SEQ ID NO: 1183381 - RNA, 19 nt, Homo sapiens
gaauugggucgaucuguga

SEQ ID NO: 1183382 - RNA, 19 nt, Homo sapiens
cagcaagaguguggaugua

SEQ ID NO: 1183383 - RNA, 19 nt, Homo sapiens
ugaauuuccuguauacaca

SEQ ID NO: 1183384 - RNA, 19 nt, Homo sapiens
ugaauauucugggagauga

SEQ ID NO: 1183385 - RNA, 19 nt, Homo sapiens
gcaccugaauggacagaag

SEQ ID NO: 1183386 - RNA, 19 nt, Homo sapiens
aggcagagguaugaugaua

SEQ ID NO: 1183387 - RNA, 19 nt, Homo sapiens
auacacaccuuuagaaacu

SEQ ID NO: 1183388 - RNA, 19 nt, Homo sapiens
guauacacaccuuuagaaa

SEQ ID NO: 1183389 - RNA, 19 nt, Homo sapiens
gagccaagcggcagaagga

SEQ ID NO: 1183390 - RNA, 19 nt, Homo sapiens
ugacaagaaguaugguuaa

SEQ ID NO: 1183391 - RNA, 19 nt, Homo sapiens
caacugacaagaaguaugg

SEQ ID NO: 1183392 - RNA, 19 nt, Homo sapiens
aggaacaaauggaugauug

SEQ ID NO: 1183393 - RNA, 19 nt, Homo sapiens
aaaggaagaugcacugacu

SEQ ID NO: 1183394 - RNA, 19 nt, Homo sapiens
aaucgacaguucagaauuc

SEQ ID NO: 1183395 - RNA, 19 nt, Homo sapiens
gaaauugaggaacaaaugg

SEQ ID NO: 1183396 - RNA, 19 nt, Homo sapiens
gaagaaauugaggaacaaa

SEQ ID NO: 1183397 - RNA, 19 nt, Homo sapiens
gagcggagaccuggaguug

SEQ ID NO: 1183398 - RNA, 19 nt, Homo sapiens
gaacugguccaaaagaaaa

SEQ ID NO: 1183399 - RNA, 19 nt, Homo sapiens
ccagaugugucccguccaa

SEQ ID NO: 1183400 - RNA, 19 nt, Homo sapiens
cagacaagaauaaagauga

SEQ ID NO: 1183401 - RNA, 19 nt, Homo sapiens
gggagaugauguucaccuu

SEQ ID NO: 1183402 - RNA, 19 nt, Homo sapiens
ggacuuugacauagcagaa

SEQ ID NO: 1183403 - RNA, 19 nt, Homo sapiens
aaccugaauuuccuguaua

SEQ ID NO: 1183404 - RNA, 19 nt, Homo sapiens
cguaagcuuucacuaacuu

SEQ ID NO: 1183405 - RNA, 19 nt, Homo sapiens
gagguaugaugauauucug

SEQ ID NO: 1183406 - RNA, 19 nt, Homo sapiens
ggaaaagauugcccacgaa

SEQ ID NO: 1183407 - RNA, 19 nt, Homo sapiens
gggauuugguuuugccuua

SEQ ID NO: 1183408 - RNA, 19 nt, Homo sapiens
ggccauuuaugaaguuuua

SEQ ID NO: 1183409 - RNA, 19 nt, Homo sapiens
gacaagaaguaugguuaag

SEQ ID NO: 1183410 - RNA, 19 nt, Homo sapiens
uuuaaaggaugaugaacga

SEQ ID NO: 1183411 - RNA, 19 nt, Homo sapiens
caaaucgacaguucagaau

SEQ ID NO: 1183412 - RNA, 19 nt, Homo sapiens
agaagaaauugaggaacaa

SEQ ID NO: 1183413 - RNA, 19 nt, Homo sapiens
aaagauugcugaugaaacc

SEQ ID NO: 1183414 - RNA, 19 nt, Homo sapiens
gcagcaagaguguggaugu

SEQ ID NO: 1183415 - RNA, 19 nt, Homo sapiens
caacuggaugaacuacuaa

SEQ ID NO: 1183416 - RNA, 19 nt, Homo sapiens
aagacuguaucgcuaggua

SEQ ID NO: 1183417 - RNA, 19 nt, Homo sapiens
cauagaagaaauugaggaa

SEQ ID NO: 1183418 - RNA, 19 nt, Homo sapiens
ugacuagaacugaacuuga

SEQ ID NO: 1183419 - RNA, 19 nt, Homo sapiens
gaaagauugcugaugaaac

SEQ ID NO: 1183420 - RNA, 19 nt, Homo sapiens
gagcaaggaagacuguauc

SEQ ID NO: 1183421 - RNA, 19 nt, Homo sapiens
ccaccaccuugcccgauga

SEQ ID NO: 1183422 - RNA, 19 nt, Homo sapiens
agaaauugaggaacaaaug

SEQ ID NO: 1183423 - RNA, 19 nt, Homo sapiens
caauauuucuacgucaugu

SEQ ID NO: 1183424 - RNA, 19 nt, Homo sapiens
gaggagagccugagaaaag

SEQ ID NO: 1183425 - RNA, 19 nt, Homo sapiens
gaacaaauggaugauuggu

SEQ ID NO: 1183426 - RNA, 19 nt, Homo sapiens
uuacauccagacaagaaua

SEQ ID NO: 1183427 - RNA, 19 nt, Homo sapiens
gaguguggauguaucaaaa

SEQ ID NO: 1183428 - RNA, 19 nt, Homo sapiens
gguggccauuuaugaaguu

SEQ ID NO: 1183429 - RNA, 19 nt, Homo sapiens
caagagcaaggaagacugu

SEQ ID NO: 1183430 - RNA, 19 nt, Homo sapiens
cagaggagccguggacuca

SEQ ID NO: 1183431 - RNA, 19 nt, Homo sapiens
ugaaagauugcugaugaaa

SEQ ID NO: 1183432 - RNA, 19 nt, Homo sapiens
caagaguguggauguauca

SEQ ID NO: 1183433 - RNA, 19 nt, Homo sapiens
gaccuggaguuguuugacu

SEQ ID NO: 1183434 - RNA, 19 nt, Homo sapiens
gccaagcaacugaaggauu

SEQ ID NO: 1183435 - RNA, 19 nt, Homo sapiens
cugacaagaaguaugguua

SEQ ID NO: 1183436 - RNA, 19 nt, Homo sapiens
gaauuccaggcccaucaaa

SEQ ID NO: 1183437 - RNA, 19 nt, Homo sapiens
gaggaacaaauggaugauu

SEQ ID NO: 1183438 - RNA, 19 nt, Homo sapiens
ggaagaugcacugacuaga

SEQ ID NO: 1183439 - RNA, 19 nt, Homo sapiens
uaacuuuacauccagacaa

SEQ ID NO: 1183440 - RNA, 19 nt, Homo sapiens
acaguggcaugauuugcuu

SEQ ID NO: 1183441 - RNA, 19 nt, Homo sapiens
guaugaugauauucugauc

SEQ ID NO: 1183442 - RNA, 19 nt, Homo sapiens
uggaggaggugcagcucaa

SEQ ID NO: 1183443 - RNA, 19 nt, Homo sapiens
ggaggugcagcucaacuuc

SEQ ID NO: 1183444 - RNA, 19 nt, Homo sapiens
ccaaagccaagcaacugaa

SEQ ID NO: 1183445 - RNA, 19 nt, Homo sapiens
uguauacacaccuuuagaa

SEQ ID NO: 1183446 - RNA, 19 nt, Homo sapiens
aagaugcacugacuagaac

SEQ ID NO: 1183447 - RNA, 19 nt, Homo sapiens
gcugugguuuggucaaucu

SEQ ID NO: 1183448 - RNA, 19 nt, Homo sapiens
ugagcuggcauuacucuug

SEQ ID NO: 1183449 - RNA, 19 nt, Homo sapiens
aggugcagcucaacuucua

SEQ ID NO: 1183450 - RNA, 19 nt, Homo sapiens
agcauuaccucaccucauc

SEQ ID NO: 1183451 - RNA, 19 nt, Homo sapiens
ggaacaaauggaugauugg

SEQ ID NO: 1183452 - RNA, 19 nt, Homo sapiens
gcaauuagcuugugagauu

SEQ ID NO: 1183453 - RNA, 19 nt, Homo sapiens
gcaagagucuguacauuau

SEQ ID NO: 1183454 - RNA, 19 nt, Homo sapiens
gaagauagguagcaacuag

SEQ ID NO: 1183455 - RNA, 19 nt, Homo sapiens
gaagguaacuguucuuguc

SEQ ID NO: 1183456 - RNA, 19 nt, Homo sapiens
gaaacagugucugcuauuu

SEQ ID NO: 1183457 - RNA, 19 nt, Homo sapiens
auaaauggcuguaugauga

SEQ ID NO: 1183458 - RNA, 19 nt, Homo sapiens
cagcagacaucccuuuaaa

SEQ ID NO: 1183459 - RNA, 19 nt, Homo sapiens
uagaagugguggaguaaua

SEQ ID NO: 1183460 - RNA, 19 nt, Homo sapiens
gaaacucgcauaugacuug

SEQ ID NO: 1183461 - RNA, 19 nt, Homo sapiens
gaugaaacccuggaagaua

SEQ ID NO: 1183462 - RNA, 19 nt, Homo sapiens
ccaaagauugugcuuauaa

SEQ ID NO: 1183463 - RNA, 19 nt, Homo sapiens
caacaaaagcuguaucuua

SEQ ID NO: 1183464 - RNA, 19 nt, Homo sapiens
gagcaagagucuguacauu

SEQ ID NO: 1183465 - RNA, 19 nt, Homo sapiens
gaucggagauuggcugaga

SEQ ID NO: 1183466 - RNA, 19 nt, Homo sapiens
ggacgaauagaaguaaaua

SEQ ID NO: 1183467 - RNA, 19 nt, Homo sapiens
gaacuuaacaccuaugaac

SEQ ID NO: 1183468 - RNA, 19 nt, Homo sapiens
cuccuaagcugauaucauu

SEQ ID NO: 1183469 - RNA, 19 nt, Homo sapiens
guggagcgguucauuuauu

SEQ ID NO: 1183470 - RNA, 19 nt, Homo sapiens
caaaugauuccucgucaaa

SEQ ID NO: 1183471 - RNA, 19 nt, Homo sapiens
gaaauguauugucaaguac

SEQ ID NO: 1183472 - RNA, 19 nt, Homo sapiens
caauuagcuugugagauua

SEQ ID NO: 1183473 - RNA, 19 nt, Homo sapiens
gcacaagccaggcagauca

SEQ ID NO: 1183474 - RNA, 19 nt, Homo sapiens
uggaaacuaugacaugaaa

SEQ ID NO: 1183475 - RNA, 19 nt, Homo sapiens
ggacagcagacaucccuuu

SEQ ID NO: 1183476 - RNA, 19 nt, Homo sapiens
accaagaacuuaacaccua

SEQ ID NO: 1183477 - RNA, 19 nt, Homo sapiens
gagccuuggucaucauuug

SEQ ID NO: 1183478 - RNA, 19 nt, Homo sapiens
uuuggaaacucgcauauga

SEQ ID NO: 1183479 - RNA, 19 nt, Homo sapiens
ugauaucauuggcuuauug

SEQ ID NO: 1183480 - RNA, 19 nt, Homo sapiens
ucacauccuuucagcagaa

SEQ ID NO: 1183481 - RNA, 19 nt, Homo sapiens
gcuuauaaauggcuguaug

SEQ ID NO: 1183482 - RNA, 19 nt, Homo sapiens
gaaauccagacuuguauca

SEQ ID NO: 1183483 - RNA, 19 nt, Homo sapiens
gaugaaacagugucugcua

SEQ ID NO: 1183484 - RNA, 19 nt, Homo sapiens
acaggaggaugagaaagua

SEQ ID NO: 1183485 - RNA, 19 nt, Homo sapiens
ccacuuacguucauugacu

SEQ ID NO: 1183486 - RNA, 19 nt, Homo sapiens
ccaagaacuuaacaccuau

SEQ ID NO: 1183487 - RNA, 19 nt, Homo sapiens
gaucagauugaauucguuu

SEQ ID NO: 1183488 - RNA, 19 nt, Homo sapiens
gguaacuguucuugucuug

SEQ ID NO: 1183489 - RNA, 19 nt, Homo sapiens
gcagaucauuucuccuaag

SEQ ID NO: 1183490 - RNA, 19 nt, Homo sapiens
cuauagagcguuccaaaga

SEQ ID NO: 1183491 - RNA, 19 nt, Homo sapiens
gcuggucgcuuuugcauuu

SEQ ID NO: 1183492 - RNA, 19 nt, Homo sapiens
gacagcagacaucccuuua

SEQ ID NO: 1183493 - RNA, 19 nt, Homo sapiens
caaagugguugcgcucgaa

SEQ ID NO: 1183494 - RNA, 19 nt, Homo sapiens
aaguagaccuccacaccua

SEQ ID NO: 1183495 - RNA, 19 nt, Homo sapiens
uaacuguucuugucuugca

SEQ ID NO: 1183496 - RNA, 19 nt, Homo sapiens
cgagagauauauugaugca

SEQ ID NO: 1183497 - RNA, 19 nt, Homo sapiens
caaaagcuguaucuuauuc

SEQ ID NO: 1183498 - RNA, 19 nt, Homo sapiens
uggagcgguucauuuauuu

SEQ ID NO: 1183499 - RNA, 19 nt, Homo sapiens
gaagugguggaguaauaaa

SEQ ID NO: 1183500 - RNA, 19 nt, Homo sapiens
gcauaugacuuguauuccu

SEQ ID NO: 1183501 - RNA, 19 nt, Homo sapiens
agcaagagucuguacauua

SEQ ID NO: 1183502 - RNA, 19 nt, Homo sapiens
auagagcguuccaaagauu

SEQ ID NO: 1183503 - RNA, 19 nt, Homo sapiens
gcgguucauuuauuuggaa

SEQ ID NO: 1183504 - RNA, 19 nt, Homo sapiens
ggcagaucauuucuccuaa

SEQ ID NO: 1183505 - RNA, 19 nt, Homo sapiens
uuccaaagauugugcuuau

SEQ ID NO: 1183506 - RNA, 19 nt, Homo sapiens
gaaaacaggaggaugagaa

SEQ ID NO: 1183507 - RNA, 19 nt, Homo sapiens
cccaaagcguagggaauua

SEQ ID NO: 1183508 - RNA, 19 nt, Homo sapiens
uauagagcguuccaaagau

SEQ ID NO: 1183509 - RNA, 19 nt, Homo sapiens
ucaaaugauuccucgucaa

SEQ ID NO: 1183510 - RNA, 19 nt, Homo sapiens
ucaggaauccgccaaggaa

SEQ ID NO: 1183511 - RNA, 19 nt, Homo sapiens
guauuccuguacuucuaua

SEQ ID NO: 1183512 - RNA, 19 nt, Homo sapiens
aaggccagcuuagacuuua

SEQ ID NO: 1183513 - RNA, 19 nt, Homo sapiens
gcaacuagacugucguuuu

SEQ ID NO: 1183514 - RNA, 19 nt, Homo sapiens
ugagaaaguaguuaacaug

SEQ ID NO: 1183515 - RNA, 19 nt, Homo sapiens
gauuaagguucugcacaug

SEQ ID NO: 1183516 - RNA, 19 nt, Homo sapiens
aguguuaucuggcaauuag

SEQ ID NO: 1183517 - RNA, 19 nt, Homo sapiens
aauccagacuuguaucaug

SEQ ID NO: 1183518 - RNA, 19 nt, Homo sapiens
ccggaaauccagacuugua

SEQ ID NO: 1183519 - RNA, 19 nt, Homo sapiens
aaaaguaguuggaauguuc

SEQ ID NO: 1183520 - RNA, 19 nt, Homo sapiens
caagccaggcagaucauuu

SEQ ID NO: 1183521 - RNA, 19 nt, Homo sapiens
ugguggagcgguucauuua

SEQ ID NO: 1183522 - RNA, 19 nt, Homo sapiens
agauugugcuuauaaaugg

SEQ ID NO: 1183523 - RNA, 19 nt, Homo sapiens
gaggaugagaaaguaguua

SEQ ID NO: 1183524 - RNA, 19 nt, Homo sapiens
caaaacugauuuacugguu

SEQ ID NO: 1183525 - RNA, 19 nt, Homo sapiens
cuuguacuguugcugauuu

SEQ ID NO: 1183526 - RNA, 19 nt, Homo sapiens
gaugcgagagauauauuga

SEQ ID NO: 1183527 - RNA, 19 nt, Homo sapiens
caaagcguagggaauuauu

SEQ ID NO: 1183528 - RNA, 19 nt, Homo sapiens
uaaguguuaucuggcaauu

SEQ ID NO: 1183529 - RNA, 19 nt, Homo sapiens
gacuuuaagcguuacguaa

SEQ ID NO: 1183530 - RNA, 19 nt, Homo sapiens
ugguugcgcucgaaaguga

SEQ ID NO: 1183531 - RNA, 19 nt, Homo sapiens
acuugaagcuggugccaaa

SEQ ID NO: 1183532 - RNA, 19 nt, Homo sapiens
cagcagaagguaacuguuc

SEQ ID NO: 1183533 - RNA, 19 nt, Homo sapiens
gaugagaaaguaguuaaca

SEQ ID NO: 1183534 - RNA, 19 nt, Homo sapiens
ccacuugaugcgagagaua

SEQ ID NO: 1183535 - RNA, 19 nt, Homo sapiens
aacagugucugcuauuuua

SEQ ID NO: 1183536 - RNA, 19 nt, Homo sapiens
caugcacccucaagacuuc

SEQ ID NO: 1183537 - RNA, 19 nt, Homo sapiens
ugcgagagauauauugaug

SEQ ID NO: 1183538 - RNA, 19 nt, Homo sapiens
ugaaacagugucugcuauu

SEQ ID NO: 1183539 - RNA, 19 nt, Homo sapiens
cguaaccgaucggagauug

SEQ ID NO: 1183540 - RNA, 19 nt, Homo sapiens
cgaaccggauuucaggaau

SEQ ID NO: 1183541 - RNA, 19 nt, Homo sapiens
ucccggaaauccagacuug

SEQ ID NO: 1183542 - RNA, 19 nt, Homo sapiens
aagcaaaacugauuuacug

SEQ ID NO: 1183543 - RNA, 19 nt, Homo sapiens
gcugauaucauuggcuuau

SEQ ID NO: 1183544 - RNA, 19 nt, Homo sapiens
uauaaauggcuguaugaug

SEQ ID NO: 1183545 - RNA, 19 nt, Homo sapiens
cuuaacaccuaugaacuau

SEQ ID NO: 1183546 - RNA, 19 nt, Homo sapiens
uuaagguucugcacaugga

SEQ ID NO: 1183547 - RNA, 19 nt, Homo sapiens
gacccuggcgcaaaucuau

SEQ ID NO: 1183548 - RNA, 19 nt, Homo sapiens
acucgcauaugacuuguau

SEQ ID NO: 1183549 - RNA, 19 nt, Homo sapiens
gcugagacccuggcgcaaa

SEQ ID NO: 1183550 - RNA, 19 nt, Homo sapiens
aggcagaucauuucuccua

SEQ ID NO: 1183551 - RNA, 19 nt, Homo sapiens
augaaacccuggaagauag

SEQ ID NO: 1183552 - RNA, 19 nt, Homo sapiens
ccaaacaucuaaacaauca

SEQ ID NO: 1183553 - RNA, 19 nt, Homo sapiens
gaaugugccuuuaagaaga

SEQ ID NO: 1183554 - RNA, 19 nt, Homo sapiens
acaaagaguugaacaaaga

SEQ ID NO: 1183555 - RNA, 19 nt, Homo sapiens
gcacagccaucuugucaug

SEQ ID NO: 1183556 - RNA, 19 nt, Homo sapiens
gcacagcccugacuaggau

SEQ ID NO: 1183557 - RNA, 19 nt, Homo sapiens
ugagguagcuuaaacucua

SEQ ID NO: 1183558 - RNA, 19 nt, Homo sapiens
gcacugagguagcuuaaac

SEQ ID NO: 1183559 - RNA, 19 nt, Homo sapiens
ggagacagccagcgaguuu

SEQ ID NO: 1183560 - RNA, 19 nt, Homo sapiens
ugucagagacuguuuauuu

SEQ ID NO: 1183561 - RNA, 19 nt, Homo sapiens
gggaugcucuauucuggua

SEQ ID NO: 1183562 - RNA, 19 nt, Homo sapiens
gcuagagucugcaagaaug

SEQ ID NO: 1183563 - RNA, 19 nt, Homo sapiens
agaagggccuccaggauuu

SEQ ID NO: 1183564 - RNA, 19 nt, Homo sapiens
gagaggagcuucugcuacu

SEQ ID NO: 1183565 - RNA, 19 nt, Homo sapiens
gcaaaucauuaaagaaguc

SEQ ID NO: 1183566 - RNA, 19 nt, Homo sapiens
gaguuugacuucuuugaga

SEQ ID NO: 1183567 - RNA, 19 nt, Homo sapiens
ugaagaaccuggagaggau

SEQ ID NO: 1183568 - RNA, 19 nt, Homo sapiens
ggaaauacaaagaguugaa

SEQ ID NO: 1183569 - RNA, 19 nt, Homo sapiens
gaaaacugcuugucagaga

SEQ ID NO: 1183570 - RNA, 19 nt, Homo sapiens
caccaaacaucuaaacaau

SEQ ID NO: 1183571 - RNA, 19 nt, Homo sapiens
gcacaugagcucucuaaca

SEQ ID NO: 1183572 - RNA, 19 nt, Homo sapiens
uggaagagauucagcuguu

SEQ ID NO: 1183573 - RNA, 19 nt, Homo sapiens
gcccgcaaaucauuaaaga

SEQ ID NO: 1183574 - RNA, 19 nt, Homo sapiens
cagcgaguuugacuucuuu

SEQ ID NO: 1183575 - RNA, 19 nt, Homo sapiens
acaaucauaugcuaacaug

SEQ ID NO: 1183576 - RNA, 19 nt, Homo sapiens
guaaugaacaccaaacauc

SEQ ID NO: 1183577 - RNA, 19 nt, Homo sapiens
ugucagccuuggccucuua

SEQ ID NO: 1183578 - RNA, 19 nt, Homo sapiens
gugcucaucugguggaaga

SEQ ID NO: 1183579 - RNA, 19 nt, Homo sapiens
gcagugagcccauccugau

SEQ ID NO: 1183580 - RNA, 19 nt, Homo sapiens
uaacaugccacuccuggaa

SEQ ID NO: 1183581 - RNA, 19 nt, Homo sapiens
cacaugagcucucuaacag

SEQ ID NO: 1183582 - RNA, 19 nt, Homo sapiens
acagccaucuugucaugua

SEQ ID NO: 1183583 - RNA, 19 nt, Homo sapiens
cagaagggccuccaggauu

SEQ ID NO: 1183584 - RNA, 19 nt, Homo sapiens
gaacguagggcacuuagcu

SEQ ID NO: 1183585 - RNA, 19 nt, Homo sapiens
ggaagagauucagcuguuc

SEQ ID NO: 1183586 - RNA, 19 nt, Homo sapiens
gcucuauucugguacuaug

SEQ ID NO: 1183587 - RNA, 19 nt, Homo sapiens
cuacacugauauugaagaa

SEQ ID NO: 1183588 - RNA, 19 nt, Homo sapiens
uggaugggaugcucuauuc

SEQ ID NO: 1183589 - RNA, 19 nt, Homo sapiens
gggcacagccaucuuguca

SEQ ID NO: 1183590 - RNA, 19 nt, Homo sapiens
gaagaagagcaaugagaca

SEQ ID NO: 1183591 - RNA, 19 nt, Homo sapiens
gagugaaugugccuuuaag

SEQ ID NO: 1183592 - RNA, 19 nt, Homo sapiens
gaacaccaaacaucuaaac

SEQ ID NO: 1183593 - RNA, 19 nt, Homo sapiens
gagaggauccuucaguucu

SEQ ID NO: 1183594 - RNA, 19 nt, Homo sapiens
gcuccuacacugauauuga

SEQ ID NO: 1183595 - RNA, 19 nt, Homo sapiens
gaauccagacaccgaguuu

SEQ ID NO: 1183596 - RNA, 19 nt, Homo sapiens
gccuuggccucuuauuauu

SEQ ID NO: 1183597 - RNA, 19 nt, Homo sapiens
cagccuuggccucuuauua

SEQ ID NO: 1183598 - RNA, 19 nt, Homo sapiens
gcuguucccugacccugaa

SEQ ID NO: 1183599 - RNA, 19 nt, Homo sapiens
gugaaugugccuuuaagaa

SEQ ID NO: 1183600 - RNA, 19 nt, Homo sapiens
gaugaacguagggcacuua

SEQ ID NO: 1183601 - RNA, 19 nt, Homo sapiens
cacugucacuguccucuuu

SEQ ID NO: 1183602 - RNA, 19 nt, Homo sapiens
gaaacuucacgcuggacua

SEQ ID NO: 1183603 - RNA, 19 nt, Homo sapiens
ccacaucuacgcagucuuc

SEQ ID NO: 1183604 - RNA, 19 nt, Homo sapiens
aagagugaaugugccuuua

SEQ ID NO: 1183605 - RNA, 19 nt, Homo sapiens
ugaaaucuggcguggagua

SEQ ID NO: 1183606 - RNA, 19 nt, Homo sapiens
acauugaacgugucuuuaa

SEQ ID NO: 1183607 - RNA, 19 nt, Homo sapiens
guagggcacuuagcuucuu

SEQ ID NO: 1183608 - RNA, 19 nt, Homo sapiens
gaucugcucccuccugcuu

SEQ ID NO: 1183609 - RNA, 19 nt, Homo sapiens
ggagaggauccuucaguuc

SEQ ID NO: 1183610 - RNA, 19 nt, Homo sapiens
uggagaggauccuucaguu

SEQ ID NO: 1183611 - RNA, 19 nt, Homo sapiens
ccagcgaguuugacuucuu

SEQ ID NO: 1183612 - RNA, 19 nt, Homo sapiens
ccugaagucugaccaccuu

SEQ ID NO: 1183613 - RNA, 19 nt, Homo sapiens
ucaagauuccuaccuguug

SEQ ID NO: 1183614 - RNA, 19 nt, Homo sapiens
ccaggacccuaugguaaug

SEQ ID NO: 1183615 - RNA, 19 nt, Homo sapiens
caacuguagugucuaugag

SEQ ID NO: 1183616 - RNA, 19 nt, Homo sapiens
uuaagaagaagagcaauga

SEQ ID NO: 1183617 - RNA, 19 nt, Homo sapiens
gagccuucuucacuccuuu

SEQ ID NO: 1183618 - RNA, 19 nt, Homo sapiens
acaccgaguuucccacugu

SEQ ID NO: 1183619 - RNA, 19 nt, Homo sapiens
ccaacuguagugucuauga

SEQ ID NO: 1183620 - RNA, 19 nt, Homo sapiens
gaaaucuggcguggaguau

SEQ ID NO: 1183621 - RNA, 19 nt, Homo sapiens
uacaaagaguugaacaaag

SEQ ID NO: 1183622 - RNA, 19 nt, Homo sapiens
uccguguccugguuucuua

SEQ ID NO: 1183623 - RNA, 19 nt, Homo sapiens
cugaccaccuuucuucuug

SEQ ID NO: 1183624 - RNA, 19 nt, Homo sapiens
acaccaaacaucuaaacaa

SEQ ID NO: 1183625 - RNA, 19 nt, Homo sapiens
cuacaauggcucccucuug

SEQ ID NO: 1183626 - RNA, 19 nt, Homo sapiens
ccgcaaaucauuaaagaag

SEQ ID NO: 1183627 - RNA, 19 nt, Homo sapiens
caucaugacgccuccuuug

SEQ ID NO: 1183628 - RNA, 19 nt, Homo sapiens
ccucaagaccgacaacuuc

SEQ ID NO: 1183629 - RNA, 19 nt, Homo sapiens
gucagagacuguuuauuuu

SEQ ID NO: 1183630 - RNA, 19 nt, Homo sapiens
cuccuacacugauauugaa

SEQ ID NO: 1183631 - RNA, 19 nt, Homo sapiens
gagguagcuuaaacucuag

SEQ ID NO: 1183632 - RNA, 19 nt, Homo sapiens
ccuccagucucccaaggaa

SEQ ID NO: 1183633 - RNA, 19 nt, Homo sapiens
gauagugcaggauggaguu

SEQ ID NO: 1183634 - RNA, 19 nt, Homo sapiens
cgagccaacuguagugucu

SEQ ID NO: 1183635 - RNA, 19 nt, Homo sapiens
caaagaguugaacaaagaa

SEQ ID NO: 1183636 - RNA, 19 nt, Homo sapiens
ggucgucuacuucuucuuc

SEQ ID NO: 1183637 - RNA, 19 nt, Homo sapiens
ugaaugugccuuuaagaag

SEQ ID NO: 1183638 - RNA, 19 nt, Homo sapiens
gguaaucugagccuucuuc

SEQ ID NO: 1183639 - RNA, 19 nt, Homo sapiens
cauugaacgugucuuuaag

SEQ ID NO: 1183640 - RNA, 19 nt, Homo sapiens
caggagcucugcgguuugu

SEQ ID NO: 1183641 - RNA, 19 nt, Homo sapiens
gaucccagccuguccucaa

SEQ ID NO: 1183642 - RNA, 19 nt, Homo sapiens
accaggagcucugcgguuu

SEQ ID NO: 1183643 - RNA, 19 nt, Homo sapiens
acaaggucauggagggaaa

SEQ ID NO: 1183644 - RNA, 19 nt, Homo sapiens
cuucauccguguccugguu

SEQ ID NO: 1183645 - RNA, 19 nt, Homo sapiens
aaugugccuuuaagaagaa

SEQ ID NO: 1183646 - RNA, 19 nt, Homo sapiens
gaaacuccacucugaagcu

SEQ ID NO: 1183647 - RNA, 19 nt, Homo sapiens
gcuccugaguggugaugga

SEQ ID NO: 1183648 - RNA, 19 nt, Homo sapiens
ccugaguggugauggaaau

SEQ ID NO: 1183649 - RNA, 19 nt, Homo sapiens
aagcacaugagcucucuaa

SEQ ID NO: 1183650 - RNA, 19 nt, Homo sapiens
gcaagguucagggcuguga

SEQ ID NO: 1183651 - RNA, 19 nt, Homo sapiens
cauacccugugaucuccua

SEQ ID NO: 1183652 - RNA, 19 nt, Homo sapiens
gaaccaaccugaauauuga

SEQ ID NO: 1183653 - RNA, 19 nt, Homo sapiens
gaagaugacuccaguguga

SEQ ID NO: 1183654 - RNA, 19 nt, Homo sapiens
gcaauuaccuugaagaagu

SEQ ID NO: 1183655 - RNA, 19 nt, Homo sapiens
gaagaaggcaugcuuaugu

SEQ ID NO: 1183656 - RNA, 19 nt, Homo sapiens
ggagcccucuugaaauuaa

SEQ ID NO: 1183657 - RNA, 19 nt, Homo sapiens
caggagcccucuugaaauu

SEQ ID NO: 1183658 - RNA, 19 nt, Homo sapiens
gcacagugaugauuacuac

SEQ ID NO: 1183659 - RNA, 19 nt, Homo sapiens
ggaaccaaccugaauauug

SEQ ID NO: 1183660 - RNA, 19 nt, Homo sapiens
acaacaaccuugaagauga

SEQ ID NO: 1183661 - RNA, 19 nt, Homo sapiens
ggacgcacagugaugauua

SEQ ID NO: 1183662 - RNA, 19 nt, Homo sapiens
gcaguaagaagauacguuu

SEQ ID NO: 1183663 - RNA, 19 nt, Homo sapiens
aaaguacccugaagacaaa

SEQ ID NO: 1183664 - RNA, 19 nt, Homo sapiens
gagcucugcuucucugaaa

SEQ ID NO: 1183665 - RNA, 19 nt, Homo sapiens
aaacaguuguguaugauug

SEQ ID NO: 1183666 - RNA, 19 nt, Homo sapiens
caaaguacccugaagacaa

SEQ ID NO: 1183667 - RNA, 19 nt, Homo sapiens
ggagggauaccgccaauga

SEQ ID NO: 1183668 - RNA, 19 nt, Homo sapiens
gugauuauuuccaauguga

SEQ ID NO: 1183669 - RNA, 19 nt, Homo sapiens
caucugaaauccacaauac

SEQ ID NO: 1183670 - RNA, 19 nt, Homo sapiens
gagccucuuugauggauuu

SEQ ID NO: 1183671 - RNA, 19 nt, Homo sapiens
gagcgaagaccuagaagug

SEQ ID NO: 1183672 - RNA, 19 nt, Homo sapiens
gaaacaacaaccuugaaga

SEQ ID NO: 1183673 - RNA, 19 nt, Homo sapiens
ggucgauguuccuguaauu

SEQ ID NO: 1183674 - RNA, 19 nt, Homo sapiens
cuacauggcacuugaagaa

SEQ ID NO: 1183675 - RNA, 19 nt, Homo sapiens
gguaggagguauggaagaa

SEQ ID NO: 1183676 - RNA, 19 nt, Homo sapiens
gauuggagccucuuugaug

SEQ ID NO: 1183677 - RNA, 19 nt, Homo sapiens
aaaucucccugcuccuuua

SEQ ID NO: 1183678 - RNA, 19 nt, Homo sapiens
aaacugcccuugcgcacuu

SEQ ID NO: 1183679 - RNA, 19 nt, Homo sapiens
caauuaccuugaagaaguu

SEQ ID NO: 1183680 - RNA, 19 nt, Homo sapiens
gcagcaauggcagcaauua

SEQ ID NO: 1183681 - RNA, 19 nt, Homo sapiens
gaaacccuccuaagucaga

SEQ ID NO: 1183682 - RNA, 19 nt, Homo sapiens
aaugaggacuauuccagua

SEQ ID NO: 1183683 - RNA, 19 nt, Homo sapiens
ugaaaacaguuguguauga

SEQ ID NO: 1183684 - RNA, 19 nt, Homo sapiens
ucaccuacauggcacuuga

SEQ ID NO: 1183685 - RNA, 19 nt, Homo sapiens
gaaagacgaacuccgaagu

SEQ ID NO: 1183686 - RNA, 19 nt, Homo sapiens
gaaucuagcaagccuguau

SEQ ID NO: 1183687 - RNA, 19 nt, Homo sapiens
uggaaacccuccuaaguca

SEQ ID NO: 1183688 - RNA, 19 nt, Homo sapiens
gcaggagcccucuugaaau

SEQ ID NO: 1183689 - RNA, 19 nt, Homo sapiens
caucugcuguagcgaauau

SEQ ID NO: 1183690 - RNA, 19 nt, Homo sapiens
agaaccaucucuucaggaa

SEQ ID NO: 1183691 - RNA, 19 nt, Homo sapiens
gaacuccgaagucccaaug

SEQ ID NO: 1183692 - RNA, 19 nt, Homo sapiens
gaggagugaccaagugaaa

SEQ ID NO: 1183693 - RNA, 19 nt, Homo sapiens
ggaagaaggcaugcuuaug

SEQ ID NO: 1183694 - RNA, 19 nt, Homo sapiens
aaacaacaaccuugaagau

SEQ ID NO: 1183695 - RNA, 19 nt, Homo sapiens
ggaaacaacaaccuugaag

SEQ ID NO: 1183696 - RNA, 19 nt, Homo sapiens
gggaauguguugcuguuac

SEQ ID NO: 1183697 - RNA, 19 nt, Homo sapiens
ggaauguguugcuguuacu

SEQ ID NO: 1183698 - RNA, 19 nt, Homo sapiens
caacaaccuugaagaugac

SEQ ID NO: 1183699 - RNA, 19 nt, Homo sapiens
uggcagcaauuaccuugaa

SEQ ID NO: 1183700 - RNA, 19 nt, Homo sapiens
gcagugccguaaaagcuua

SEQ ID NO: 1183701 - RNA, 19 nt, Homo sapiens
gaaaacaguuguguaugau

SEQ ID NO: 1183702 - RNA, 19 nt, Homo sapiens
cugaagccauuuccuaugu

SEQ ID NO: 1183703 - RNA, 19 nt, Homo sapiens
cagugaugauuacuacaaa

SEQ ID NO: 1183704 - RNA, 19 nt, Homo sapiens
uaaaugcuacuugagauug

SEQ ID NO: 1183705 - RNA, 19 nt, Homo sapiens
gaagauacguuuucuaacc

SEQ ID NO: 1183706 - RNA, 19 nt, Homo sapiens
ccgagauccuggucacuga

SEQ ID NO: 1183707 - RNA, 19 nt, Homo sapiens
gcaagcaaggagagcauug

SEQ ID NO: 1183708 - RNA, 19 nt, Homo sapiens
gagccaaaguacccugaag

SEQ ID NO: 1183709 - RNA, 19 nt, Homo sapiens
ggauaccgccaaugacaau

SEQ ID NO: 1183710 - RNA, 19 nt, Homo sapiens
uaaaucucccugcuccuuu

SEQ ID NO: 1183711 - RNA, 19 nt, Homo sapiens
ugaagaucauggcgcaguu

SEQ ID NO: 1183712 - RNA, 19 nt, Homo sapiens
uaucgaagccgagagcaaa

SEQ ID NO: 1183713 - RNA, 19 nt, Homo sapiens
guaauugcagugccguaaa

SEQ ID NO: 1183714 - RNA, 19 nt, Homo sapiens
gagauugcaguaagaagau

SEQ ID NO: 1183715 - RNA, 19 nt, Homo sapiens
ugagauugcaguaagaaga

SEQ ID NO: 1183716 - RNA, 19 nt, Homo sapiens
ucuaaaugcuacuugagau

SEQ ID NO: 1183717 - RNA, 19 nt, Homo sapiens
ugcaggagcccucuugaaa

SEQ ID NO: 1183718 - RNA, 19 nt, Homo sapiens
ccaccacuauuuccacaag

SEQ ID NO: 1183719 - RNA, 19 nt, Homo sapiens
ccuggaagaaggagaaauu

SEQ ID NO: 1183720 - RNA, 19 nt, Homo sapiens
cagcaauuaccuugaagaa

SEQ ID NO: 1183721 - RNA, 19 nt, Homo sapiens
uuaccugccugcugaagug

SEQ ID NO: 1183722 - RNA, 19 nt, Homo sapiens
uagccuaaaccuauugauu

SEQ ID NO: 1183723 - RNA, 19 nt, Homo sapiens
gggaaccuccacaggcuaa

SEQ ID NO: 1183724 - RNA, 19 nt, Homo sapiens
gcauuuguuuucuucagua

SEQ ID NO: 1183725 - RNA, 19 nt, Homo sapiens
ugauuccucgugauuauuu

SEQ ID NO: 1183726 - RNA, 19 nt, Homo sapiens
gaagaucauggcgcaguug

SEQ ID NO: 1183727 - RNA, 19 nt, Homo sapiens
uggauuugcagauggguua

SEQ ID NO: 1183728 - RNA, 19 nt, Homo sapiens
gaggacuauuccaguacuu

SEQ ID NO: 1183729 - RNA, 19 nt, Homo sapiens
cuaaaugcuacuugagauu

SEQ ID NO: 1183730 - RNA, 19 nt, Homo sapiens
uccaguaccaugagaauga

SEQ ID NO: 1183731 - RNA, 19 nt, Homo sapiens
ggccuuagaagaaagugaa

SEQ ID NO: 1183732 - RNA, 19 nt, Homo sapiens
gaccaagugaaaccagaaa

SEQ ID NO: 1183733 - RNA, 19 nt, Homo sapiens
guagaaugggaauguguug

SEQ ID NO: 1183734 - RNA, 19 nt, Homo sapiens
gcuccuuuauucuauacug

SEQ ID NO: 1183735 - RNA, 19 nt, Homo sapiens
aaaccaaucagucaguuag

SEQ ID NO: 1183736 - RNA, 19 nt, Homo sapiens
ggaaauaaaaccaaucagu

SEQ ID NO: 1183737 - RNA, 19 nt, Homo sapiens
guuuacuccuggucugauu

SEQ ID NO: 1183738 - RNA, 19 nt, Homo sapiens
caagcaaggagagcauuga

SEQ ID NO: 1183739 - RNA, 19 nt, Homo sapiens
ggauggaaacaacaaccuu

SEQ ID NO: 1183740 - RNA, 19 nt, Homo sapiens
gcagcaauuaccuugaaga

SEQ ID NO: 1183741 - RNA, 19 nt, Homo sapiens
cggauggccuggcaagaag

SEQ ID NO: 1183742 - RNA, 19 nt, Homo sapiens
ggauugccagccagagaaa

SEQ ID NO: 1183743 - RNA, 19 nt, Homo sapiens
aagaaggcaugcuuauguc

SEQ ID NO: 1183744 - RNA, 19 nt, Homo sapiens
ggaggguaucaguccaaua

SEQ ID NO: 1183745 - RNA, 19 nt, Homo sapiens
cuaaagaccaaggccguuu

SEQ ID NO: 1183746 - RNA, 19 nt, Homo sapiens
cuccaggccuuagaagaaa

SEQ ID NO: 1183747 - RNA, 19 nt, Homo sapiens
gcugaagccauuuccuaug

SEQ ID NO: 1183748 - RNA, 19 nt, Homo sapiens
gcuaucccgagccaaagua

SEQ ID NO: 1183749 - RNA, 19 nt, Homo sapiens
uaauugcagugccguaaaa

SEQ ID NO: 1183750 - RNA, 19 nt, Homo sapiens
gaaagaagagcgggaaccu

SEQ ID NO: 1183751 - RNA, 19 nt, Homo sapiens
gcgaggagugaccaaguga

SEQ ID NO: 1183752 - RNA, 19 nt, Homo sapiens
ugacagggacggccauuua

SEQ ID NO: 1183753 - RNA, 19 nt, Homo sapiens
gagaagggccagagaaugu

SEQ ID NO: 1183754 - RNA, 19 nt, Homo sapiens
uacugggacuguucuauua

SEQ ID NO: 1183755 - RNA, 19 nt, Homo sapiens
cagcuacucugaggaauau

SEQ ID NO: 1183756 - RNA, 19 nt, Homo sapiens
gccauauucuguuggauga

SEQ ID NO: 1183757 - RNA, 19 nt, Homo sapiens
gaagauacugggacuguuc

SEQ ID NO: 1183758 - RNA, 19 nt, Homo sapiens
gcagcuacucugaggaaua

SEQ ID NO: 1183759 - RNA, 19 nt, Homo sapiens
uaaacuuguuccugagaaa

SEQ ID NO: 1183760 - RNA, 19 nt, Homo sapiens
ggaagugugcuacaucuca

SEQ ID NO: 1183761 - RNA, 19 nt, Homo sapiens
ugcccaagaucuacaagua

SEQ ID NO: 1183762 - RNA, 19 nt, Homo sapiens
gcagccaccuuucuucucu

SEQ ID NO: 1183763 - RNA, 19 nt, Homo sapiens
ggaagauacugggacuguu

SEQ ID NO: 1183764 - RNA, 19 nt, Homo sapiens
gccuuuggcuauuaugaaa

SEQ ID NO: 1183765 - RNA, 19 nt, Homo sapiens
gccaagccauauucuguug

SEQ ID NO: 1183766 - RNA, 19 nt, Homo sapiens
gagcagcuacucugaggaa

SEQ ID NO: 1183767 - RNA, 19 nt, Homo sapiens
gagcugcccuggacuugag

SEQ ID NO: 1183768 - RNA, 19 nt, Homo sapiens
caagccauauucuguugga

SEQ ID NO: 1183769 - RNA, 19 nt, Homo sapiens
caacccaccugcccaucug

SEQ ID NO: 1183770 - RNA, 19 nt, Homo sapiens
ggagaagggccagagaaug

SEQ ID NO: 1183771 - RNA, 19 nt, Homo sapiens
gcccagcccuguggauuuc

SEQ ID NO: 1183772 - RNA, 19 nt, Homo sapiens
gcucuaugcagccaccuuu

SEQ ID NO: 1183773 - RNA, 19 nt, Homo sapiens
caucucagccuuggucuug

SEQ ID NO: 1183774 - RNA, 19 nt, Homo sapiens
guuaguguguucccugcaa

SEQ ID NO: 1183775 - RNA, 19 nt, Homo sapiens
uuuaugccuuuggcuauua

SEQ ID NO: 1183776 - RNA, 19 nt, Homo sapiens
cagcagguccuccggauca

SEQ ID NO: 1183777 - RNA, 19 nt, Homo sapiens
ccuacacgcugcugcacaa

SEQ ID NO: 1183778 - RNA, 19 nt, Homo sapiens
gcugugauccugcagaaca

SEQ ID NO: 1183779 - RNA, 19 nt, Homo sapiens
ggaagcagccaaggcacuu

SEQ ID NO: 1183780 - RNA, 19 nt, Homo sapiens
gcuacuacacguaccgaaa

SEQ ID NO: 1183781 - RNA, 19 nt, Homo sapiens
gcuccucucugcccucuac

SEQ ID NO: 1183782 - RNA, 19 nt, Homo sapiens
gcucaugccugugcuccau

SEQ ID NO: 1183783 - RNA, 19 nt, Homo sapiens
gauuccaucucccgcugaa

SEQ ID NO: 1183784 - RNA, 19 nt, Homo sapiens
gcucugccaucagccuuga

SEQ ID NO: 1183785 - RNA, 19 nt, Homo sapiens
caucugugcugaggcaugu

SEQ ID NO: 1183786 - RNA, 19 nt, Homo sapiens
cuacaacgccauccaccuu

SEQ ID NO: 1183787 - RNA, 19 nt, Homo sapiens
ccacggaugucuccuaccu

SEQ ID NO: 1183788 - RNA, 19 nt, Homo sapiens
gcagcuaccacaccuccaa

SEQ ID NO: 1183789 - RNA, 19 nt, Homo sapiens
cuccugagcucccuguguu

SEQ ID NO: 1183790 - RNA, 19 nt, Homo sapiens
gcucugcuccacccacuug

SEQ ID NO: 1183791 - RNA, 19 nt, Homo sapiens
gcauguuccugccuaccau

SEQ ID NO: 1183792 - RNA, 19 nt, Homo sapiens
ccuggagacucaugaugga

SEQ ID NO: 1183793 - RNA, 19 nt, Homo sapiens
gcagcugguacaucgauga

SEQ ID NO: 1183794 - RNA, 19 nt, Homo sapiens
gggaugcagcugcuacaga

SEQ ID NO: 1183795 - RNA, 19 nt, Homo sapiens
ugguggagcuggugaagca

SEQ ID NO: 1183796 - RNA, 19 nt, Homo sapiens
auaaacuuguuccugagaa

SEQ ID NO: 1183797 - RNA, 19 nt, Homo sapiens
ggucuuguccugcuuacuc

SEQ ID NO: 1183798 - RNA, 19 nt, Homo sapiens
auacugggacuguucuauu

SEQ ID NO: 1183799 - RNA, 19 nt, Homo sapiens
uguguucccugcaauaaac

SEQ ID NO: 1183800 - RNA, 19 nt, Homo sapiens
uggcugugauccugcagaa

SEQ ID NO: 1183801 - RNA, 19 nt, Homo sapiens
gaggagcugcccuggacuu

SEQ ID NO: 1183802 - RNA, 19 nt, Homo sapiens
cuauuaugcugcccucuac

SEQ ID NO: 1183803 - RNA, 19 nt, Homo sapiens
cuacacguaccgaaacuuc

SEQ ID NO: 1183804 - RNA, 19 nt, Homo sapiens
cccaagaucuacaaguacu

SEQ ID NO: 1183805 - RNA, 19 nt, Homo sapiens
gauacugggacuguucuau

SEQ ID NO: 1183806 - RNA, 19 nt, Homo sapiens
ccgccaagccauauucugu

SEQ ID NO: 1183807 - RNA, 19 nt, Homo sapiens
ggagcugcccuggacuuga

SEQ ID NO: 1183808 - RNA, 19 nt, Homo sapiens
ucugugggcucuggaagug

SEQ ID NO: 1183809 - RNA, 19 nt, Homo sapiens
ccaagaucuacaaguacua

SEQ ID NO: 1183810 - RNA, 19 nt, Homo sapiens
acacguaccgaaacuucuu

SEQ ID NO: 1183811 - RNA, 19 nt, Homo sapiens
ucuauuaugcugcccucua

SEQ ID NO: 1183812 - RNA, 19 nt, Homo sapiens
ucaccacggaugucuccua

SEQ ID NO: 1183813 - RNA, 19 nt, Homo sapiens
gguacccacuauccagaag

SEQ ID NO: 1183814 - RNA, 19 nt, Homo sapiens
cugggacuguucuauuaug

SEQ ID NO: 1183815 - RNA, 19 nt, Homo sapiens
ugccuacccuuucaucucu

SEQ ID NO: 1183816 - RNA, 19 nt, Homo sapiens
gaacugagcugccuagaag

SEQ ID NO: 1183817 - RNA, 19 nt, Homo sapiens
gggaggagcugcagaccuu

SEQ ID NO: 1183818 - RNA, 19 nt, Homo sapiens
gagagauucugagguguuu

SEQ ID NO: 1183819 - RNA, 19 nt, Homo sapiens
caacaucccucaggagauc

SEQ ID NO: 1183820 - RNA, 19 nt, Homo sapiens
ccugagacuuguuuauaaa

SEQ ID NO: 1183821 - RNA, 19 nt, Homo sapiens
ccaaaggccaggacagaaa

SEQ ID NO: 1183822 - RNA, 19 nt, Homo sapiens
acucauggcuggcagauuc

SEQ ID NO: 1183823 - RNA, 19 nt, Homo sapiens
gcuccucccuuucuuucuu

SEQ ID NO: 1183824 - RNA, 19 nt, Homo sapiens
gauccgaguucugcuacuu

SEQ ID NO: 1183825 - RNA, 19 nt, Homo sapiens
ggagagauucugagguguu

SEQ ID NO: 1183826 - RNA, 19 nt, Homo sapiens
ccauugguuuccacgauuu

SEQ ID NO: 1183827 - RNA, 19 nt, Homo sapiens
gcgcacuucucccgaccua

SEQ ID NO: 1183828 - RNA, 19 nt, Homo sapiens
caccugagacuuguuuaua

SEQ ID NO: 1183829 - RNA, 19 nt, Homo sapiens
ccaaggcucuucccuacag

SEQ ID NO: 1183830 - RNA, 19 nt, Homo sapiens
gagauucugagguguuuga

SEQ ID NO: 1183831 - RNA, 19 nt, Homo sapiens
gcgaggguccugucuauag

SEQ ID NO: 1183832 - RNA, 19 nt, Homo sapiens
gauuucaauuggcugagaa

SEQ ID NO: 1183833 - RNA, 19 nt, Homo sapiens
uuacaacggugaggaguuc

SEQ ID NO: 1183834 - RNA, 19 nt, Homo sapiens
ggaaucucccuguaucuag

SEQ ID NO: 1183835 - RNA, 19 nt, Homo sapiens
accugagacuuguuuauaa

SEQ ID NO: 1183836 - RNA, 19 nt, Homo sapiens
uggcgaggguccugucuau

SEQ ID NO: 1183837 - RNA, 19 nt, Homo sapiens
gcccauugguuuccacgau

SEQ ID NO: 1183838 - RNA, 19 nt, Homo sapiens
gccaaugccugagagaagu

SEQ ID NO: 1183839 - RNA, 19 nt, Homo sapiens
aaagaaggcgauccgaguu

SEQ ID NO: 1183840 - RNA, 19 nt, Homo sapiens
gaggcaaagugaagcuucu

SEQ ID NO: 1183841 - RNA, 19 nt, Homo sapiens
gcauugagaauaucaugag

SEQ ID NO: 1183842 - RNA, 19 nt, Homo sapiens
cgaguucugcuacuuccua

SEQ ID NO: 1183843 - RNA, 19 nt, Homo sapiens
acagaaacgccgagaggaa

SEQ ID NO: 1183844 - RNA, 19 nt, Homo sapiens
gcuagcuccucccuuucuu

SEQ ID NO: 1183845 - RNA, 19 nt, Homo sapiens
ucccacaccuuccuaugga

SEQ ID NO: 1183846 - RNA, 19 nt, Homo sapiens
gcacuucucccgaccuacu

SEQ ID NO: 1183847 - RNA, 19 nt, Homo sapiens
uagcugaagcccauugguu

SEQ ID NO: 1183848 - RNA, 19 nt, Homo sapiens
caacugacaugccccaucu

SEQ ID NO: 1183849 - RNA, 19 nt, Homo sapiens
ggacgacagauauuacaac

SEQ ID NO: 1183850 - RNA, 19 nt, Homo sapiens
cgauuucaauuggcugaga

SEQ ID NO: 1183851 - RNA, 19 nt, Homo sapiens
cccauugguuuccacgauu

SEQ ID NO: 1183852 - RNA, 19 nt, Homo sapiens
ugaacugagcugccuagaa

SEQ ID NO: 1183853 - RNA, 19 nt, Homo sapiens
gcugaagcccauugguuuc

SEQ ID NO: 1183854 - RNA, 19 nt, Homo sapiens
gggcauugagaauaucaug

SEQ ID NO: 1183855 - RNA, 19 nt, Homo sapiens
ccgagaggaaccaagauga

SEQ ID NO: 1183856 - RNA, 19 nt, Homo sapiens
cgugcucgauuccggaaga

SEQ ID NO: 1183857 - RNA, 19 nt, Homo sapiens
ggggaaaccugugcagaug

SEQ ID NO: 1183858 - RNA, 19 nt, Homo sapiens
gccgagggaggcaaaguga

SEQ ID NO: 1183859 - RNA, 19 nt, Homo sapiens
ccaccugagacuuguuuau

SEQ ID NO: 1183860 - RNA, 19 nt, Homo sapiens
gccaaaggccaggacagaa

SEQ ID NO: 1183861 - RNA, 19 nt, Homo sapiens
caccuccuccuucuuguga

SEQ ID NO: 1183862 - RNA, 19 nt, Homo sapiens
cgagggaggcaaagugaag

SEQ ID NO: 1183863 - RNA, 19 nt, Homo sapiens
gaacuuggauugcugaauu

SEQ ID NO: 1183864 - RNA, 19 nt, Homo sapiens
aaacagagcccauucuuaa

SEQ ID NO: 1183865 - RNA, 19 nt, Homo sapiens
ccaaauauguggaccugua

SEQ ID NO: 1183866 - RNA, 19 nt, Homo sapiens
caacaacuuuacaggcuua

SEQ ID NO: 1183867 - RNA, 19 nt, Homo sapiens
ccaccgagauagauagaua

SEQ ID NO: 1183868 - RNA, 19 nt, Homo sapiens
gagaauacacucuagguuu

SEQ ID NO: 1183869 - RNA, 19 nt, Homo sapiens
aggaagagcuuggguguua

SEQ ID NO: 1183870 - RNA, 19 nt, Homo sapiens
cgagauagauagauaggaa

SEQ ID NO: 1183871 - RNA, 19 nt, Homo sapiens
ucaaugaggugguccuaaa

SEQ ID NO: 1183872 - RNA, 19 nt, Homo sapiens
gggaagaaauuacgaugga

SEQ ID NO: 1183873 - RNA, 19 nt, Homo sapiens
gaagagacacuggaugaaa

SEQ ID NO: 1183874 - RNA, 19 nt, Homo sapiens
gaaugugguugaagaaagu

SEQ ID NO: 1183875 - RNA, 19 nt, Homo sapiens
gggacgggcugaugaguga

SEQ ID NO: 1183876 - RNA, 19 nt, Homo sapiens
guacacagaggaagauauu

SEQ ID NO: 1183877 - RNA, 19 nt, Homo sapiens
ggaaugugguugaagaaag

SEQ ID NO: 1183878 - RNA, 19 nt, Homo sapiens
agaauacacucuagguuug

SEQ ID NO: 1183879 - RNA, 19 nt, Homo sapiens
caucucagcucuucugcaa

SEQ ID NO: 1183880 - RNA, 19 nt, Homo sapiens
caugaaggcuagaggaaga

SEQ ID NO: 1183881 - RNA, 19 nt, Homo sapiens
ugaaauagcccagaugaug

SEQ ID NO: 1183882 - RNA, 19 nt, Homo sapiens
gaugaaauagcccagauga

SEQ ID NO: 1183883 - RNA, 19 nt, Homo sapiens
ggaagaaauuacgauggaa

SEQ ID NO: 1183884 - RNA, 19 nt, Homo sapiens
cagaaucuccaacaacuuu

SEQ ID NO: 1183885 - RNA, 19 nt, Homo sapiens
caaggaggaacaacucuuu

SEQ ID NO: 1183886 - RNA, 19 nt, Homo sapiens
caguguaggccaagacuua

SEQ ID NO: 1183887 - RNA, 19 nt, Homo sapiens
cuggugggcuuucaaauug

SEQ ID NO: 1183888 - RNA, 19 nt, Homo sapiens
gaaagugggccaggugguu

SEQ ID NO: 1183889 - RNA, 19 nt, Homo sapiens
caaaguggaaugugguuga

SEQ ID NO: 1183890 - RNA, 19 nt, Homo sapiens
gaagccaagccaauccuuu

SEQ ID NO: 1183891 - RNA, 19 nt, Homo sapiens
uaaagacacgcauuccaaa

SEQ ID NO: 1183892 - RNA, 19 nt, Homo sapiens
gcuggugggcuuucaaauu

SEQ ID NO: 1183893 - RNA, 19 nt, Homo sapiens
ggucuugacauguuuguug

SEQ ID NO: 1183894 - RNA, 19 nt, Homo sapiens
aagagacacuggaugaaau

SEQ ID NO: 1183895 - RNA, 19 nt, Homo sapiens
ggagaauacacucuagguu

SEQ ID NO: 1183896 - RNA, 19 nt, Homo sapiens
aagaucacuuggugccuua

SEQ ID NO: 1183897 - RNA, 19 nt, Homo sapiens
gauaggaacuuggauugcu

SEQ ID NO: 1183898 - RNA, 19 nt, Homo sapiens
uuggauugcugaauucaaa

SEQ ID NO: 1183899 - RNA, 19 nt, Homo sapiens
auagauagauaggaacuug

SEQ ID NO: 1183900 - RNA, 19 nt, Homo sapiens
ggacuaucuuucuguuucu

SEQ ID NO: 1183901 - RNA, 19 nt, Homo sapiens
gacuuauggucuacagauu

SEQ ID NO: 1183902 - RNA, 19 nt, Homo sapiens
uagcccagaugauggugua

SEQ ID NO: 1183903 - RNA, 19 nt, Homo sapiens
aagaagagacacuggauga

SEQ ID NO: 1183904 - RNA, 19 nt, Homo sapiens
agacacgcauuccaaagug

SEQ ID NO: 1183905 - RNA, 19 nt, Homo sapiens
uggacuaucuuucuguuuc

SEQ ID NO: 1183906 - RNA, 19 nt, Homo sapiens
cagauggucuccuuagcau

SEQ ID NO: 1183907 - RNA, 19 nt, Homo sapiens
ccagaggauuaacuacuuc

SEQ ID NO: 1183908 - RNA, 19 nt, Homo sapiens
ucccagggcugcaagucua

SEQ ID NO: 1183909 - RNA, 19 nt, Homo sapiens
uuacaaaccaggucagugu

SEQ ID NO: 1183910 - RNA, 19 nt, Homo sapiens
cccagaggauuaacuacuu

SEQ ID NO: 1183911 - RNA, 19 nt, Homo sapiens
aaaccugauugacuacuuc

SEQ ID NO: 1183912 - RNA, 19 nt, Homo sapiens
uuaaagacacgcauuccaa

SEQ ID NO: 1183913 - RNA, 19 nt, Homo sapiens
gauuaacuacuuccuguca

SEQ ID NO: 1183914 - RNA, 19 nt, Homo sapiens
cauggacuaucuuucuguu

SEQ ID NO: 1183915 - RNA, 19 nt, Homo sapiens
ucccaagggcuuauuauga

SEQ ID NO: 1183916 - RNA, 19 nt, Homo sapiens
acagagcccauucuuaaga

SEQ ID NO: 1183917 - RNA, 19 nt, Homo sapiens
caaagacugcugcccuaga

SEQ ID NO: 1183918 - RNA, 19 nt, Homo sapiens
aaagacugcugcccuagag

SEQ ID NO: 1183919 - RNA, 19 nt, Homo sapiens
agagacacuggaugaaaua

SEQ ID NO: 1183920 - RNA, 19 nt, Homo sapiens
ggaagagcuuggguguuag

SEQ ID NO: 1183921 - RNA, 19 nt, Homo sapiens
ugugggagcucagcaaauc

SEQ ID NO: 1183922 - RNA, 19 nt, Homo sapiens
aaaguggaaugugguugaa

SEQ ID NO: 1183923 - RNA, 19 nt, Homo sapiens
cagagcccauucuuaagau

SEQ ID NO: 1183924 - RNA, 19 nt, Homo sapiens
uuaacuacuuccugucaug

SEQ ID NO: 1183925 - RNA, 19 nt, Homo sapiens
uaaagaagagacacuggau

SEQ ID NO: 1183926 - RNA, 19 nt, Homo sapiens
gcaaaucccaagggcuuau

SEQ ID NO: 1183927 - RNA, 19 nt, Homo sapiens
gagcuccuguauaaagaag

SEQ ID NO: 1183928 - RNA, 19 nt, Homo sapiens
aggaaaaccugauugacua

SEQ ID NO: 1183929 - RNA, 19 nt, Homo sapiens
gcagaaucuccaacaacuu

SEQ ID NO: 1183930 - RNA, 19 nt, Homo sapiens
uagauaggaacuuggauug

SEQ ID NO: 1183931 - RNA, 19 nt, Homo sapiens
cagcagccacuaacaaaca

SEQ ID NO: 1183932 - RNA, 19 nt, Homo sapiens
guacaaggagcagcugaug

SEQ ID NO: 1183933 - RNA, 19 nt, Homo sapiens
gguggagaauacacucuag

SEQ ID NO: 1183934 - RNA, 19 nt, Homo sapiens
ccaagggcuuauuaugaca

SEQ ID NO: 1183935 - RNA, 19 nt, Homo sapiens
cccaagggcuuauuaugac

SEQ ID NO: 1183936 - RNA, 19 nt, Homo sapiens
ucacuuggugccuuaaaga

SEQ ID NO: 1183937 - RNA, 19 nt, Homo sapiens
cacggaugcugguggagaa

SEQ ID NO: 1183938 - RNA, 19 nt, Homo sapiens
aguggaaugugguugaaga

SEQ ID NO: 1183939 - RNA, 19 nt, Homo sapiens
ggucccaccgagauagaua

SEQ ID NO: 1183940 - RNA, 19 nt, Homo sapiens
ggcaggccuuacauuagaa

SEQ ID NO: 1183941 - RNA, 19 nt, Homo sapiens
ucuauuucccagaggauua

SEQ ID NO: 1183942 - RNA, 19 nt, Homo sapiens
gguccuugggccacacuua

SEQ ID NO: 1183943 - RNA, 19 nt, Homo sapiens
caccagacccuguucaucu

SEQ ID NO: 1183944 - RNA, 19 nt, Homo sapiens
gcuggcgccuuccucuguu

SEQ ID NO: 1183945 - RNA, 19 nt, Homo sapiens
gauggucccgggaagaaau

SEQ ID NO: 1183946 - RNA, 19 nt, Homo sapiens
caucgccacguuccacuuu

SEQ ID NO: 1183947 - RNA, 19 nt, Homo sapiens
gaucacuuggugccuuaaa

SEQ ID NO: 1183948 - RNA, 19 nt, Homo sapiens
uaacuacuuccugucauga

SEQ ID NO: 1183949 - RNA, 19 nt, Homo sapiens
ggagauuguggagaccaua

SEQ ID NO: 1183950 - RNA, 19 nt, Homo sapiens
ugaggugguccuaaaguug

SEQ ID NO: 1183951 - RNA, 19 nt, Homo sapiens
ccaggugguugaagaaagc

SEQ ID NO: 1183952 - RNA, 19 nt, Homo sapiens
caacuuuacaggcuuagag

SEQ ID NO: 1183953 - RNA, 19 nt, Homo sapiens
cccagaugaugguguaugu

SEQ ID NO: 1183954 - RNA, 19 nt, Homo sapiens
gaagggaaaaguacacaga

SEQ ID NO: 1183955 - RNA, 19 nt, Homo sapiens
gcuuucaaauugguacuuc

SEQ ID NO: 1183956 - RNA, 19 nt, Homo sapiens
gggcuggugggcuuucaaa

SEQ ID NO: 1183957 - RNA, 19 nt, Homo sapiens
gccaggugguugaagaaag

SEQ ID NO: 1183958 - RNA, 19 nt, Homo sapiens
ggagcuccuguauaaagaa

SEQ ID NO: 1183959 - RNA, 19 nt, Homo sapiens
ugcagaaucuccaacaacu

SEQ ID NO: 1183960 - RNA, 19 nt, Homo sapiens
ccagauggucuccuuagca

SEQ ID NO: 1183961 - RNA, 19 nt, Homo sapiens
ggaugaaauagcccagaug

SEQ ID NO: 1183962 - RNA, 19 nt, Homo sapiens
gcuccuguauaaagaagag

SEQ ID NO: 1183963 - RNA, 19 nt, Homo sapiens
guaagaugcucugaccuuu

SEQ ID NO: 1183964 - RNA, 19 nt, Homo sapiens
ugacggagcugagcaucaa

SEQ ID NO: 1183965 - RNA, 19 nt, Homo sapiens
aagaugcucugaccuuuga

SEQ ID NO: 1183966 - RNA, 19 nt, Homo sapiens
uguaugaucucaacuccaa

SEQ ID NO: 1183967 - RNA, 19 nt, Homo sapiens
gugcugggcuagccuguga

SEQ ID NO: 1183968 - RNA, 19 nt, Homo sapiens
acaagaacaucgcgucugu

SEQ ID NO: 1183969 - RNA, 19 nt, Homo sapiens
gaucucaacuccaauaacc

SEQ ID NO: 1183970 - RNA, 19 nt, Homo sapiens
guggaaggguuuauuaguc

SEQ ID NO: 1183971 - RNA, 19 nt, Homo sapiens
cuggagagaucaagagaga

SEQ ID NO: 1183972 - RNA, 19 nt, Homo sapiens
aaacugcuaugucuggaau

SEQ ID NO: 1183973 - RNA, 19 nt, Homo sapiens
cagguggaaggguuuauua

SEQ ID NO: 1183974 - RNA, 19 nt, Homo sapiens
gggccucgguccauagaga

SEQ ID NO: 1183975 - RNA, 19 nt, Homo sapiens
ggagagaucaagagagagu

SEQ ID NO: 1183976 - RNA, 19 nt, Homo sapiens
ccacaucugggacuugaaa

SEQ ID NO: 1183977 - RNA, 19 nt, Homo sapiens
gcucuuagcccugcacaau

SEQ ID NO: 1183978 - RNA, 19 nt, Homo sapiens
cuacauggcagcugucaau

SEQ ID NO: 1183979 - RNA, 19 nt, Homo sapiens
uaugaucucaacuccaaua

SEQ ID NO: 1183980 - RNA, 19 nt, Homo sapiens
gccugcaccugcgcucuua

SEQ ID NO: 1183981 - RNA, 19 nt, Homo sapiens
gaaacugcuaugucuggaa

SEQ ID NO: 1183982 - RNA, 19 nt, Homo sapiens
gaaccaggcagagcucauc

SEQ ID NO: 1183983 - RNA, 19 nt, Homo sapiens
gcagauguugcucgggaaa

SEQ ID NO: 1183984 - RNA, 19 nt, Homo sapiens
ugcuaugucuggaaucuga

SEQ ID NO: 1183985 - RNA, 19 nt, Homo sapiens
uaagaugcucugaccuuug

SEQ ID NO: 1183986 - RNA, 19 nt, Homo sapiens
cauggcagcugucaauagc

SEQ ID NO: 1183987 - RNA, 19 nt, Homo sapiens
cguaagaugcucugaccuu

SEQ ID NO: 1183988 - RNA, 19 nt, Homo sapiens
gguggaaggguuuauuagu

SEQ ID NO: 1183989 - RNA, 19 nt, Homo sapiens
ccaguugcuuauccagaug

SEQ ID NO: 1183990 - RNA, 19 nt, Homo sapiens
ccgcauguaugaucucaac

SEQ ID NO: 1183991 - RNA, 19 nt, Homo sapiens
gugcaggccacaccaugaa

SEQ ID NO: 1183992 - RNA, 19 nt, Homo sapiens
cccaguugcuuauccagau

SEQ ID NO: 1183993 - RNA, 19 nt, Homo sapiens
ucuuagcccugcacaaucu

SEQ ID NO: 1183994 - RNA, 19 nt, Homo sapiens
uccaacuucucccugauga

SEQ ID NO: 1183995 - RNA, 19 nt, Homo sapiens
gcccugcagugucgcuuca

SEQ ID NO: 1183996 - RNA, 19 nt, Homo sapiens
ucaacuccaauaacccuaa

SEQ ID NO: 1183997 - RNA, 19 nt, Homo sapiens
acaccggaccgcagcauga

SEQ ID NO: 1183998 - RNA, 19 nt, Homo sapiens
gagacuggagagaucaaga

SEQ ID NO: 1183999 - RNA, 19 nt, Homo sapiens
uguggagacuggagagauc

SEQ ID NO: 1184000 - RNA, 19 nt, Homo sapiens
ugaacgcacccauuaacug

SEQ ID NO: 1184001 - RNA, 19 nt, Homo sapiens
gcauguaugaucucaacuc

SEQ ID NO: 1184002 - RNA, 19 nt, Homo sapiens
gcugaucagacgugcaaga

SEQ ID NO: 1184003 - RNA, 19 nt, Homo sapiens
caacuccaauaacccuaac

SEQ ID NO: 1184004 - RNA, 19 nt, Homo sapiens
gggcucagucugggaggua

SEQ ID NO: 1184005 - RNA, 19 nt, Homo sapiens
gcaggccacaccaugaaca

SEQ ID NO: 1184006 - RNA, 19 nt, Homo sapiens
ugccuggccuucaaugaca

SEQ ID NO: 1184007 - RNA, 19 nt, Homo sapiens
gagagaucaagagagagua

SEQ ID NO: 1184008 - RNA, 19 nt, Homo sapiens
ccagguggaaggguuuauu

SEQ ID NO: 1184009 - RNA, 19 nt, Homo sapiens
caucacguccgcccacauc

SEQ ID NO: 1184010 - RNA, 19 nt, Homo sapiens
gaacauagcguaacaauau

SEQ ID NO: 1184011 - RNA, 19 nt, Homo sapiens
uuaaagagcugcuucauug

SEQ ID NO: 1184012 - RNA, 19 nt, Homo sapiens
gcaaacaacuuggaacuug

SEQ ID NO: 1184013 - RNA, 19 nt, Homo sapiens
gaucagagauugguguauu

SEQ ID NO: 1184014 - RNA, 19 nt, Homo sapiens
ucaaaggccuggauuaaug

SEQ ID NO: 1184015 - RNA, 19 nt, Homo sapiens
gaaugagaauguucaaaug

SEQ ID NO: 1184016 - RNA, 19 nt, Homo sapiens
cgaauggacuacuaaauau

SEQ ID NO: 1184017 - RNA, 19 nt, Homo sapiens
caacaauaaugccgaaguu

SEQ ID NO: 1184018 - RNA, 19 nt, Homo sapiens
gcauguaucccaucaauug

SEQ ID NO: 1184019 - RNA, 19 nt, Homo sapiens
ggaaagugguuuaaauaac

SEQ ID NO: 1184020 - RNA, 19 nt, Homo sapiens
gcaaggaaauguagacaac

SEQ ID NO: 1184021 - RNA, 19 nt, Homo sapiens
gagccaugcuacugguuua

SEQ ID NO: 1184022 - RNA, 19 nt, Homo sapiens
ggaaauugcuccguguaau

SEQ ID NO: 1184023 - RNA, 19 nt, Homo sapiens
ucauaugguucaucuagua

SEQ ID NO: 1184024 - RNA, 19 nt, Homo sapiens
caauggaauuaacgugaua

SEQ ID NO: 1184025 - RNA, 19 nt, Homo sapiens
ggacagaccuauuuucaug

SEQ ID NO: 1184026 - RNA, 19 nt, Homo sapiens
guaucaagcugcaguuuca

SEQ ID NO: 1184027 - RNA, 19 nt, Homo sapiens
gaaauacagugaccagacu

SEQ ID NO: 1184028 - RNA, 19 nt, Homo sapiens
cuaguagccuggcccuuua

SEQ ID NO: 1184029 - RNA, 19 nt, Homo sapiens
ucaggaaagugguuuaaau

SEQ ID NO: 1184030 - RNA, 19 nt, Homo sapiens
caaacaacuuggaacuuga

SEQ ID NO: 1184031 - RNA, 19 nt, Homo sapiens
acuauuagcugcuucuuga

SEQ ID NO: 1184032 - RNA, 19 nt, Homo sapiens
caggaaagugguuuaaaua

SEQ ID NO: 1184033 - RNA, 19 nt, Homo sapiens
acagggagguccaguacua

SEQ ID NO: 1184034 - RNA, 19 nt, Homo sapiens
cuucacagccucuaaauuu

SEQ ID NO: 1184035 - RNA, 19 nt, Homo sapiens
gcaaaccauugacgaagga

SEQ ID NO: 1184036 - RNA, 19 nt, Homo sapiens
aaaggcagcucuucaaugg

SEQ ID NO: 1184037 - RNA, 19 nt, Homo sapiens
ggacacggaauacuaagaa

SEQ ID NO: 1184038 - RNA, 19 nt, Homo sapiens
gcccagccauaaagcaaua

SEQ ID NO: 1184039 - RNA, 19 nt, Homo sapiens
caacuuggaacuugaagaa

SEQ ID NO: 1184040 - RNA, 19 nt, Homo sapiens
gagaaagucaugaagcauu

SEQ ID NO: 1184041 - RNA, 19 nt, Homo sapiens
gggcauguaucccaucaau

SEQ ID NO: 1184042 - RNA, 19 nt, Homo sapiens
gaaauggagcgucuuaugg

SEQ ID NO: 1184043 - RNA, 19 nt, Homo sapiens
gagcugcgauucuccuuag

SEQ ID NO: 1184044 - RNA, 19 nt, Homo sapiens
ccugugacccucaucauua

SEQ ID NO: 1184045 - RNA, 19 nt, Homo sapiens
gauauaggcaguacuuuua

SEQ ID NO: 1184046 - RNA, 19 nt, Homo sapiens
acgaauggacuacuaaaua

SEQ ID NO: 1184047 - RNA, 19 nt, Homo sapiens
gaagaugccagugcaauuc

SEQ ID NO: 1184048 - RNA, 19 nt, Homo sapiens
gaaauguagacaaccaauu

SEQ ID NO: 1184049 - RNA, 19 nt, Homo sapiens
aagagcugcuucacauaua

SEQ ID NO: 1184050 - RNA, 19 nt, Homo sapiens
uguaugcucaucaguauua

SEQ ID NO: 1184051 - RNA, 19 nt, Homo sapiens
gacgaaggaucagagauug

SEQ ID NO: 1184052 - RNA, 19 nt, Homo sapiens
aagauaagcuggaaauugc

SEQ ID NO: 1184053 - RNA, 19 nt, Homo sapiens
ccaugcuacugguuuauuu

SEQ ID NO: 1184054 - RNA, 19 nt, Homo sapiens
gcgauucuccuuagcauug

SEQ ID NO: 1184055 - RNA, 19 nt, Homo sapiens
caacccagccuacuacuuc

SEQ ID NO: 1184056 - RNA, 19 nt, Homo sapiens
agaaagucaugaagcauug

SEQ ID NO: 1184057 - RNA, 19 nt, Homo sapiens
aaagauaagcuggaaauug

SEQ ID NO: 1184058 - RNA, 19 nt, Homo sapiens
acaauaaugccgaaguuaa

SEQ ID NO: 1184059 - RNA, 19 nt, Homo sapiens
gagguccaguacuaaauga

SEQ ID NO: 1184060 - RNA, 19 nt, Homo sapiens
gaaaaucgacccaugaaug

SEQ ID NO: 1184061 - RNA, 19 nt, Homo sapiens
gcacagagucaccaguuuc

SEQ ID NO: 1184062 - RNA, 19 nt, Homo sapiens
gccuggcccuuuaauguuu

SEQ ID NO: 1184063 - RNA, 19 nt, Homo sapiens
gaaaccccaucuuaacuaa

SEQ ID NO: 1184064 - RNA, 19 nt, Homo sapiens
gcaauucuaguucagauca

SEQ ID NO: 1184065 - RNA, 19 nt, Homo sapiens
cagcagcaauucuaguuca

SEQ ID NO: 1184066 - RNA, 19 nt, Homo sapiens
ugacgaaggaucagagauu

SEQ ID NO: 1184067 - RNA, 19 nt, Homo sapiens
gcaucuaucuaacguuuac

SEQ ID NO: 1184068 - RNA, 19 nt, Homo sapiens
caagcuggaugguuuccuu

SEQ ID NO: 1184069 - RNA, 19 nt, Homo sapiens
gagacuggcuagacuggau

SEQ ID NO: 1184070 - RNA, 19 nt, Homo sapiens
ccauaaagcaauaaacuuc

SEQ ID NO: 1184071 - RNA, 19 nt, Homo sapiens
uaaagauccuaacagaaca

SEQ ID NO: 1184072 - RNA, 19 nt, Homo sapiens
gcacgaauggacuacuaaa

SEQ ID NO: 1184073 - RNA, 19 nt, Homo sapiens
gaagauggaggugaagaug

SEQ ID NO: 1184074 - RNA, 19 nt, Homo sapiens
gcucaggccacaucaaaug

SEQ ID NO: 1184075 - RNA, 19 nt, Homo sapiens
gcucaucaguauuauaugc

SEQ ID NO: 1184076 - RNA, 19 nt, Homo sapiens
uagagaaagucaugaagca

SEQ ID NO: 1184077 - RNA, 19 nt, Homo sapiens
uacagugaccagacuauua

SEQ ID NO: 1184078 - RNA, 19 nt, Homo sapiens
ucaccaguuuccauaugua

SEQ ID NO: 1184079 - RNA, 19 nt, Homo sapiens
gaucaacaacuccaucauc

SEQ ID NO: 1184080 - RNA, 19 nt, Homo sapiens
acgcaucuaucuaacguuu

SEQ ID NO: 1184081 - RNA, 19 nt, Homo sapiens
aggcagcucuucaauggaa

SEQ ID NO: 1184082 - RNA, 19 nt, Homo sapiens
augaugggcuugaagauga

SEQ ID NO: 1184083 - RNA, 19 nt, Homo sapiens
uuaaagcaccgaaucagaa

SEQ ID NO: 1184084 - RNA, 19 nt, Homo sapiens
cgccauggcucacgucugu

SEQ ID NO: 1184085 - RNA, 19 nt, Homo sapiens
aagcacgaauggacuacua

SEQ ID NO: 1184086 - RNA, 19 nt, Homo sapiens
uggagaagauggaggugaa

SEQ ID NO: 1184087 - RNA, 19 nt, Homo sapiens
ucagcaggcucccaacaau

SEQ ID NO: 1184088 - RNA, 19 nt, Homo sapiens
cauauguaaugcaaggaaa

SEQ ID NO: 1184089 - RNA, 19 nt, Homo sapiens
caauagagaaagucaugaa

SEQ ID NO: 1184090 - RNA, 19 nt, Homo sapiens
uaaagcaccgaaucagaaa

SEQ ID NO: 1184091 - RNA, 19 nt, Homo sapiens
gaaaacaagaugaguauca

SEQ ID NO: 1184092 - RNA, 19 nt, Homo sapiens
agagcugcuucacauauaa

SEQ ID NO: 1184093 - RNA, 19 nt, Homo sapiens
uaccaggacagaccuauuu

SEQ ID NO: 1184094 - RNA, 19 nt, Homo sapiens
ggagguccaguacuaaaug

SEQ ID NO: 1184095 - RNA, 19 nt, Homo sapiens
gcacagggagguccaguac

SEQ ID NO: 1184096 - RNA, 19 nt, Homo sapiens
uccaucaucuggucaagaa

SEQ ID NO: 1184097 - RNA, 19 nt, Homo sapiens
ucaauggaauuaacgugau

SEQ ID NO: 1184098 - RNA, 19 nt, Homo sapiens
gcucuucaauggaauuaac

SEQ ID NO: 1184099 - RNA, 19 nt, Homo sapiens
aucaguaccuuaacagaaa

SEQ ID NO: 1184100 - RNA, 19 nt, Homo sapiens
aaagagcugcuucacauau

SEQ ID NO: 1184101 - RNA, 19 nt, Homo sapiens
gcaaugggcuucguauccu

SEQ ID NO: 1184102 - RNA, 19 nt, Homo sapiens
uagacuggauguacacguu

SEQ ID NO: 1184103 - RNA, 19 nt, Homo sapiens
aaacgcaucuaucuaacgu

SEQ ID NO: 1184104 - RNA, 19 nt, Homo sapiens
cgaaucagaaauacaguga

SEQ ID NO: 1184105 - RNA, 19 nt, Homo sapiens
aagcaccgaaucagaaaua

SEQ ID NO: 1184106 - RNA, 19 nt, Homo sapiens
uuaaagauccuaacagaac

SEQ ID NO: 1184107 - RNA, 19 nt, Homo sapiens
caaggagggucugacuuca

SEQ ID NO: 1184108 - RNA, 19 nt, Homo sapiens
uggagcgucuuauggauga

SEQ ID NO: 1184109 - RNA, 19 nt, Homo sapiens
cagcaggcucccaacaaua

SEQ ID NO: 1184110 - RNA, 19 nt, Homo sapiens
guagagaucuuguagaaua

SEQ ID NO: 1184111 - RNA, 19 nt, Homo sapiens
gcacugauauuucuuugua

SEQ ID NO: 1184112 - RNA, 19 nt, Homo sapiens
gaagaaaccuaugcaaauu

SEQ ID NO: 1184113 - RNA, 19 nt, Homo sapiens
gaugggagauugaaagaua

SEQ ID NO: 1184114 - RNA, 19 nt, Homo sapiens
gaagaaaccauguccagua

SEQ ID NO: 1184115 - RNA, 19 nt, Homo sapiens
cauacgagaucuuaacaua

SEQ ID NO: 1184116 - RNA, 19 nt, Homo sapiens
gcacauccaucucauagga

SEQ ID NO: 1184117 - RNA, 19 nt, Homo sapiens
gaagaaaucuaccagaaac

SEQ ID NO: 1184118 - RNA, 19 nt, Homo sapiens
uaacaaggauucucaaagu

SEQ ID NO: 1184119 - RNA, 19 nt, Homo sapiens
gaccauaacuuugaacuug

SEQ ID NO: 1184120 - RNA, 19 nt, Homo sapiens
caagagauaccuauuguaa

SEQ ID NO: 1184121 - RNA, 19 nt, Homo sapiens
ggaagcacauacacaauug

SEQ ID NO: 1184122 - RNA, 19 nt, Homo sapiens
cuacuggacuucaugcuua

SEQ ID NO: 1184123 - RNA, 19 nt, Homo sapiens
ggaguuagcacugauauuu

SEQ ID NO: 1184124 - RNA, 19 nt, Homo sapiens
ggacaagccuuacauugca

SEQ ID NO: 1184125 - RNA, 19 nt, Homo sapiens
guaacaaacucuaucaaag

SEQ ID NO: 1184126 - RNA, 19 nt, Homo sapiens
ugaagaugaugaccuagua

SEQ ID NO: 1184127 - RNA, 19 nt, Homo sapiens
ucaaggaaguggcgauaaa

SEQ ID NO: 1184128 - RNA, 19 nt, Homo sapiens
gcauacaaguuuggaauga

SEQ ID NO: 1184129 - RNA, 19 nt, Homo sapiens
gaagaugaccauaacuuug

SEQ ID NO: 1184130 - RNA, 19 nt, Homo sapiens
ggaagaaaucuaccagaaa

SEQ ID NO: 1184131 - RNA, 19 nt, Homo sapiens
gauuggagcuauccuuaug

SEQ ID NO: 1184132 - RNA, 19 nt, Homo sapiens
caacaggcauacaaguuug

SEQ ID NO: 1184133 - RNA, 19 nt, Homo sapiens
caucauugcuuugaauuga

SEQ ID NO: 1184134 - RNA, 19 nt, Homo sapiens
gagauuggagcuauccuua

SEQ ID NO: 1184135 - RNA, 19 nt, Homo sapiens
gggcauauguuaaauacuc

SEQ ID NO: 1184136 - RNA, 19 nt, Homo sapiens
ggaaugaaguauuugugau

SEQ ID NO: 1184137 - RNA, 19 nt, Homo sapiens
gagcacauacgagaucuua

SEQ ID NO: 1184138 - RNA, 19 nt, Homo sapiens
ggucauguuugcuauguau

SEQ ID NO: 1184139 - RNA, 19 nt, Homo sapiens
gacuagcucuguccaggua

SEQ ID NO: 1184140 - RNA, 19 nt, Homo sapiens
gaugaugaccuaguaaauu

SEQ ID NO: 1184141 - RNA, 19 nt, Homo sapiens
cuaguagcaucauaaguuu

SEQ ID NO: 1184142 - RNA, 19 nt, Homo sapiens
gaaauuggaacagugauug

SEQ ID NO: 1184143 - RNA, 19 nt, Homo sapiens
gcacauacacaauuguuuc

SEQ ID NO: 1184144 - RNA, 19 nt, Homo sapiens
cugaugagguuaugaagaa

SEQ ID NO: 1184145 - RNA, 19 nt, Homo sapiens
gaugaguucugccgucguu

SEQ ID NO: 1184146 - RNA, 19 nt, Homo sapiens
cuucagaucuggagcgaaa

SEQ ID NO: 1184147 - RNA, 19 nt, Homo sapiens
gagcaagagauaccuauug

SEQ ID NO: 1184148 - RNA, 19 nt, Homo sapiens
gaccaggugucucaucaug

SEQ ID NO: 1184149 - RNA, 19 nt, Homo sapiens
ugaagaaaccuaugcaaau

SEQ ID NO: 1184150 - RNA, 19 nt, Homo sapiens
uggaagaaaucuaccagaa

SEQ ID NO: 1184151 - RNA, 19 nt, Homo sapiens
cuauagcugucuuguguaa

SEQ ID NO: 1184152 - RNA, 19 nt, Homo sapiens
gagcuauccuuaugaacau

SEQ ID NO: 1184153 - RNA, 19 nt, Homo sapiens
agacugucauccaacaaua

SEQ ID NO: 1184154 - RNA, 19 nt, Homo sapiens
gaagaugaugaccuaguaa

SEQ ID NO: 1184155 - RNA, 19 nt, Homo sapiens
guacuugggcauauguuaa

SEQ ID NO: 1184156 - RNA, 19 nt, Homo sapiens
gaaaccauguccaguacag

SEQ ID NO: 1184157 - RNA, 19 nt, Homo sapiens
caaaaucuaucaaggagaa

SEQ ID NO: 1184158 - RNA, 19 nt, Homo sapiens
ugacagaccuaauggaacu

SEQ ID NO: 1184159 - RNA, 19 nt, Homo sapiens
uuaugaagaugaugaccua

SEQ ID NO: 1184160 - RNA, 19 nt, Homo sapiens
uaaggaagcacauacacaa

SEQ ID NO: 1184161 - RNA, 19 nt, Homo sapiens
caucaugccagauuaaaga

SEQ ID NO: 1184162 - RNA, 19 nt, Homo sapiens
gcaagagauaccuauugua

SEQ ID NO: 1184163 - RNA, 19 nt, Homo sapiens
gaaagauauugaugaagac

SEQ ID NO: 1184164 - RNA, 19 nt, Homo sapiens
ggagcuauccuuaugaaca

SEQ ID NO: 1184165 - RNA, 19 nt, Homo sapiens
ggacugacuggcuucauug

SEQ ID NO: 1184166 - RNA, 19 nt, Homo sapiens
auaaguggaucuaaaguca

SEQ ID NO: 1184167 - RNA, 19 nt, Homo sapiens
aaagggaagucauuucuac

SEQ ID NO: 1184168 - RNA, 19 nt, Homo sapiens
ugaagaugaccauaacuuu

SEQ ID NO: 1184169 - RNA, 19 nt, Homo sapiens
ucuaguagcaucauaaguu

SEQ ID NO: 1184170 - RNA, 19 nt, Homo sapiens
gaaguuacuagacgucgaa

SEQ ID NO: 1184171 - RNA, 19 nt, Homo sapiens
uacgagaucuuaacauagu

SEQ ID NO: 1184172 - RNA, 19 nt, Homo sapiens
gaacauucauaugguuugg

SEQ ID NO: 1184173 - RNA, 19 nt, Homo sapiens
gcucuguccagguauauaa

SEQ ID NO: 1184174 - RNA, 19 nt, Homo sapiens
uaaaguugcugugcugcuu

SEQ ID NO: 1184175 - RNA, 19 nt, Homo sapiens
gaauugcacauccaucuca

SEQ ID NO: 1184176 - RNA, 19 nt, Homo sapiens
ucaccgugcucuuucauca

SEQ ID NO: 1184177 - RNA, 19 nt, Homo sapiens
uaauaaucuugcugcagua

SEQ ID NO: 1184178 - RNA, 19 nt, Homo sapiens
ggagauugaaagauauuga

SEQ ID NO: 1184179 - RNA, 19 nt, Homo sapiens
aaucuugguugcuuccuuu

SEQ ID NO: 1184180 - RNA, 19 nt, Homo sapiens
gcacauacgagaucuuaac

SEQ ID NO: 1184181 - RNA, 19 nt, Homo sapiens
ucauaggaauuguaaaugg

SEQ ID NO: 1184182 - RNA, 19 nt, Homo sapiens
uuguagagaucuuguagaa

SEQ ID NO: 1184183 - RNA, 19 nt, Homo sapiens
ucucaaaucuugguugcuu

SEQ ID NO: 1184184 - RNA, 19 nt, Homo sapiens
gaaacaacaggcauacaag

SEQ ID NO: 1184185 - RNA, 19 nt, Homo sapiens
aaaguuggauugguggaaa

SEQ ID NO: 1184186 - RNA, 19 nt, Homo sapiens
ccaacaauaacaagaagaa

SEQ ID NO: 1184187 - RNA, 19 nt, Homo sapiens
gaaauugaagaaaccuaug

SEQ ID NO: 1184188 - RNA, 19 nt, Homo sapiens
cauacacaauuguuucuca

SEQ ID NO: 1184189 - RNA, 19 nt, Homo sapiens
acaacaggcauacaaguuu

SEQ ID NO: 1184190 - RNA, 19 nt, Homo sapiens
uaaggcagucuguaacaaa

SEQ ID NO: 1184191 - RNA, 19 nt, Homo sapiens
aaagauggguggagaugag

SEQ ID NO: 1184192 - RNA, 19 nt, Homo sapiens
gaaaucugguuccauugcu

SEQ ID NO: 1184193 - RNA, 19 nt, Homo sapiens
ggcaggagcuuuucguaaa

SEQ ID NO: 1184194 - RNA, 19 nt, Homo sapiens
caucucauaggaauuguaa

SEQ ID NO: 1184195 - RNA, 19 nt, Homo sapiens
auacauaccagauuugaug

SEQ ID NO: 1184196 - RNA, 19 nt, Homo sapiens
aagaugaccauaacuuuga

SEQ ID NO: 1184197 - RNA, 19 nt, Homo sapiens
ccagguauauaaucugucu

SEQ ID NO: 1184198 - RNA, 19 nt, Homo sapiens
uaaagggaagucauuucua

SEQ ID NO: 1184199 - RNA, 19 nt, Homo sapiens
guaaagggaagucauuucu

SEQ ID NO: 1184200 - RNA, 19 nt, Homo sapiens
ucagagaaauuggaacagu

SEQ ID NO: 1184201 - RNA, 19 nt, Homo sapiens
uguguaaccuugucaugga

SEQ ID NO: 1184202 - RNA, 19 nt, Homo sapiens
ucauuggccuaaacucuau

SEQ ID NO: 1184203 - RNA, 19 nt, Homo sapiens
aguaaauucugaugagguu

SEQ ID NO: 1184204 - RNA, 19 nt, Homo sapiens
gaaaacacuuggaucucaa

SEQ ID NO: 1184205 - RNA, 19 nt, Homo sapiens
guagcaggagcaagagaua

SEQ ID NO: 1184206 - RNA, 19 nt, Homo sapiens
uaaacgagagcuucgaaau

SEQ ID NO: 1184207 - RNA, 19 nt, Homo sapiens
gacuugcgauggaagaaau

SEQ ID NO: 1184208 - RNA, 19 nt, Homo sapiens
cauacaaguuuggaaugaa

SEQ ID NO: 1184209 - RNA, 19 nt, Homo sapiens
aaagcacaaugauggcaaa

SEQ ID NO: 1184210 - RNA, 19 nt, Homo sapiens
gcaauugaguagcugauaa

SEQ ID NO: 1184211 - RNA, 19 nt, Homo sapiens
ggaaacaggcuuacucuga

SEQ ID NO: 1184212 - RNA, 19 nt, Homo sapiens
gaacucugcuuacccauuc

SEQ ID NO: 1184213 - RNA, 19 nt, Homo sapiens
ccacuagucucuuuaauag

SEQ ID NO: 1184214 - RNA, 19 nt, Homo sapiens
ucacaaaucuacaaucugu

SEQ ID NO: 1184215 - RNA, 19 nt, Homo sapiens
gcuaugaguuugugccuuu

SEQ ID NO: 1184216 - RNA, 19 nt, Homo sapiens
ugaaguugcuagaaguuua

SEQ ID NO: 1184217 - RNA, 19 nt, Homo sapiens
caucaaaugucaucaacuu

SEQ ID NO: 1184218 - RNA, 19 nt, Homo sapiens
aggaagggcugaugacuuu

SEQ ID NO: 1184219 - RNA, 19 nt, Homo sapiens
uggcuugccucccuuauaa

SEQ ID NO: 1184220 - RNA, 19 nt, Homo sapiens
ggacugcuauacagccaaa

SEQ ID NO: 1184221 - RNA, 19 nt, Homo sapiens
gcagaaaucaaaguuauug

SEQ ID NO: 1184222 - RNA, 19 nt, Homo sapiens
gaucuuguguggcaugaug

SEQ ID NO: 1184223 - RNA, 19 nt, Homo sapiens
uaucaucucuggcucucua

SEQ ID NO: 1184224 - RNA, 19 nt, Homo sapiens
ucauagugcucccaucaaa

SEQ ID NO: 1184225 - RNA, 19 nt, Homo sapiens
ugacuggccuggcauuaug

SEQ ID NO: 1184226 - RNA, 19 nt, Homo sapiens
ucaaacaggccaccuuaaa

SEQ ID NO: 1184227 - RNA, 19 nt, Homo sapiens
gcaacaccaucaugacauc

SEQ ID NO: 1184228 - RNA, 19 nt, Homo sapiens
gauggaagacagagaagaa

SEQ ID NO: 1184229 - RNA, 19 nt, Homo sapiens
gagggcauuugcauuguga

SEQ ID NO: 1184230 - RNA, 19 nt, Homo sapiens
gcacucugcuggaauucug

SEQ ID NO: 1184231 - RNA, 19 nt, Homo sapiens
ggacugagaaaccagaguu

SEQ ID NO: 1184232 - RNA, 19 nt, Homo sapiens
gaagaugaagguaaguaga

SEQ ID NO: 1184233 - RNA, 19 nt, Homo sapiens
cacaaccacuagucucuuu

SEQ ID NO: 1184234 - RNA, 19 nt, Homo sapiens
gcagauggcaauugaguag

SEQ ID NO: 1184235 - RNA, 19 nt, Homo sapiens
gcauuugcauugugaugga

SEQ ID NO: 1184236 - RNA, 19 nt, Homo sapiens
caaacaggccaccuuaaau

SEQ ID NO: 1184237 - RNA, 19 nt, Homo sapiens
gcuguaaacacuggaauaa

SEQ ID NO: 1184238 - RNA, 19 nt, Homo sapiens
gaguaucacauccuguaua

SEQ ID NO: 1184239 - RNA, 19 nt, Homo sapiens
gcuagaaguuuacagaaaa

SEQ ID NO: 1184240 - RNA, 19 nt, Homo sapiens
gaaugagacucugggaagu

SEQ ID NO: 1184241 - RNA, 19 nt, Homo sapiens
acgcagaaaucaaaguuau

SEQ ID NO: 1184242 - RNA, 19 nt, Homo sapiens
cacaaccuguucccaauga

SEQ ID NO: 1184243 - RNA, 19 nt, Homo sapiens
caaccacuagucucuuuaa

SEQ ID NO: 1184244 - RNA, 19 nt, Homo sapiens
uguaaacacuggaauaagg

SEQ ID NO: 1184245 - RNA, 19 nt, Homo sapiens
uuacugaaguugcuagaag

SEQ ID NO: 1184246 - RNA, 19 nt, Homo sapiens
ggagggcauuugcauugug

SEQ ID NO: 1184247 - RNA, 19 nt, Homo sapiens
aaacaggccaccuuaaauc

SEQ ID NO: 1184248 - RNA, 19 nt, Homo sapiens
ggaagugcaggaacauuuc

SEQ ID NO: 1184249 - RNA, 19 nt, Homo sapiens
aaaagcagauggcaauuga

SEQ ID NO: 1184250 - RNA, 19 nt, Homo sapiens
gaaggaacaaccagccaau

SEQ ID NO: 1184251 - RNA, 19 nt, Homo sapiens
ugucugcccugguggguuu

SEQ ID NO: 1184252 - RNA, 19 nt, Homo sapiens
ucaaaguuauugggacuau

SEQ ID NO: 1184253 - RNA, 19 nt, Homo sapiens
gauuugcacucugcuggaa

SEQ ID NO: 1184254 - RNA, 19 nt, Homo sapiens
gaagggcugaugacuuuca

SEQ ID NO: 1184255 - RNA, 19 nt, Homo sapiens
ugucaaacaggccaccuua

SEQ ID NO: 1184256 - RNA, 19 nt, Homo sapiens
aaucuacaaucugugagua

SEQ ID NO: 1184257 - RNA, 19 nt, Homo sapiens
acaaaucuacaaucuguga

SEQ ID NO: 1184258 - RNA, 19 nt, Homo sapiens
ggaaccaacgggcacaguu

SEQ ID NO: 1184259 - RNA, 19 nt, Homo sapiens
guaaacacuggaauaagga

SEQ ID NO: 1184260 - RNA, 19 nt, Homo sapiens
augagacucugggaaguua

SEQ ID NO: 1184261 - RNA, 19 nt, Homo sapiens
ugcuagaaguuuacagaaa

SEQ ID NO: 1184262 - RNA, 19 nt, Homo sapiens
gcccugguggguuucauua

SEQ ID NO: 1184263 - RNA, 19 nt, Homo sapiens
aggauagccugaagaaaca

SEQ ID NO: 1184264 - RNA, 19 nt, Homo sapiens
caaaugucaucaacuucuc

SEQ ID NO: 1184265 - RNA, 19 nt, Homo sapiens
gcaugaugguauugagcuu

SEQ ID NO: 1184266 - RNA, 19 nt, Homo sapiens
caucauagugcucccauca

SEQ ID NO: 1184267 - RNA, 19 nt, Homo sapiens
guaaguagaaaccguugau

SEQ ID NO: 1184268 - RNA, 19 nt, Homo sapiens
agaugaagguaaguagaaa

SEQ ID NO: 1184269 - RNA, 19 nt, Homo sapiens
gaauaaggaagggcugaug

SEQ ID NO: 1184270 - RNA, 19 nt, Homo sapiens
gaaaauucacuggauauga

SEQ ID NO: 1184271 - RNA, 19 nt, Homo sapiens
gaagugcaggaacauuuca

SEQ ID NO: 1184272 - RNA, 19 nt, Homo sapiens
ggacuauccagaucuugug

SEQ ID NO: 1184273 - RNA, 19 nt, Homo sapiens
cagaagaugaagguaagua

SEQ ID NO: 1184274 - RNA, 19 nt, Homo sapiens
aguaucacauccuguauag

SEQ ID NO: 1184275 - RNA, 19 nt, Homo sapiens
cuguauagcuguaaacacu

SEQ ID NO: 1184276 - RNA, 19 nt, Homo sapiens
ggauccagugaaugucuua

SEQ ID NO: 1184277 - RNA, 19 nt, Homo sapiens
gagacucugggaaguuaaa

SEQ ID NO: 1184278 - RNA, 19 nt, Homo sapiens
cagccugguuggaagcauu

SEQ ID NO: 1184279 - RNA, 19 nt, Homo sapiens
gggagggcauuugcauugu

SEQ ID NO: 1184280 - RNA, 19 nt, Homo sapiens
gcuggaacucucucucuga

SEQ ID NO: 1184281 - RNA, 19 nt, Homo sapiens
cauccuguauagcuguaaa

SEQ ID NO: 1184282 - RNA, 19 nt, Homo sapiens
gacugagaaaccagaguua

SEQ ID NO: 1184283 - RNA, 19 nt, Homo sapiens
aagaugaagguaaguagaa

SEQ ID NO: 1184284 - RNA, 19 nt, Homo sapiens
gaaaagcagauggcaauug

SEQ ID NO: 1184285 - RNA, 19 nt, Homo sapiens
gcacuguguugaguauguc

SEQ ID NO: 1184286 - RNA, 19 nt, Homo sapiens
ccugguggguuucauuauc

SEQ ID NO: 1184287 - RNA, 19 nt, Homo sapiens
cauagcagccugguuggaa

SEQ ID NO: 1184288 - RNA, 19 nt, Homo sapiens
gugcucccaucaaauguca

SEQ ID NO: 1184289 - RNA, 19 nt, Homo sapiens
cugagaaaccagaguuaaa

SEQ ID NO: 1184290 - RNA, 19 nt, Homo sapiens
ucaaaugucaucaacuucu

SEQ ID NO: 1184291 - RNA, 19 nt, Homo sapiens
gaaguugcuagaaguuuac

SEQ ID NO: 1184292 - RNA, 19 nt, Homo sapiens
ucuuaucccugcacugugu

SEQ ID NO: 1184293 - RNA, 19 nt, Homo sapiens
aaacaucuacacgcagaaa

SEQ ID NO: 1184294 - RNA, 19 nt, Homo sapiens
aggaagugcaggaacauuu

SEQ ID NO: 1184295 - RNA, 19 nt, Homo sapiens
accacuagucucuuuaaua

SEQ ID NO: 1184296 - RNA, 19 nt, Homo sapiens
ugcaggaacauuucacaaa

SEQ ID NO: 1184297 - RNA, 19 nt, Homo sapiens
gcgaagggaaugagacucu

SEQ ID NO: 1184298 - RNA, 19 nt, Homo sapiens
ggcaauugaguagcugaua

SEQ ID NO: 1184299 - RNA, 19 nt, Homo sapiens
ugggagggcauuugcauug

SEQ ID NO: 1184300 - RNA, 19 nt, Homo sapiens
uaucuuaucccugcacugu

SEQ ID NO: 1184301 - RNA, 19 nt, Homo sapiens
ucucucugaugcugauuug

SEQ ID NO: 1184302 - RNA, 19 nt, Homo sapiens
cuucuacacuguugaacuc

SEQ ID NO: 1184303 - RNA, 19 nt, Homo sapiens
guauugagcuuggggauca

SEQ ID NO: 1184304 - RNA, 19 nt, Homo sapiens
caaccuguucccaaugaga

SEQ ID NO: 1184305 - RNA, 19 nt, Homo sapiens
acucugggaaguuaaauga

SEQ ID NO: 1184306 - RNA, 19 nt, Homo sapiens
gcugauaagcugaaaauuc

SEQ ID NO: 1184307 - RNA, 19 nt, Homo sapiens
aaaaggaagugcaggaaca

SEQ ID NO: 1184308 - RNA, 19 nt, Homo sapiens
gcagugugaguuggacaaa

SEQ ID NO: 1184309 - RNA, 19 nt, Homo sapiens
uaucacauccuguauagcu

SEQ ID NO: 1184310 - RNA, 19 nt, Homo sapiens
gaaaguagcuggcuucaaa

SEQ ID NO: 1184311 - RNA, 19 nt, Homo sapiens
ggaguuaacugauuuguug

SEQ ID NO: 1184312 - RNA, 19 nt, Homo sapiens
caacaggaguuaacugauu

SEQ ID NO: 1184313 - RNA, 19 nt, Homo sapiens
ggaaacaggcuuacucuga

SEQ ID NO: 1184314 - RNA, 19 nt, Homo sapiens
gaacucugcuuacccauuc

SEQ ID NO: 1184315 - RNA, 19 nt, Homo sapiens
ucacaaaucuacaaucugu

SEQ ID NO: 1184316 - RNA, 19 nt, Homo sapiens
ugaaguugcuagaaguuua

SEQ ID NO: 1184317 - RNA, 19 nt, Homo sapiens
caucaaaugucaucaacuu

SEQ ID NO: 1184318 - RNA, 19 nt, Homo sapiens
uaagauauguguucauugg

SEQ ID NO: 1184319 - RNA, 19 nt, Homo sapiens
aggaagggcugaugacuuu

SEQ ID NO: 1184320 - RNA, 19 nt, Homo sapiens
gcagaaaucaaaguuauug

SEQ ID NO: 1184321 - RNA, 19 nt, Homo sapiens
gaucuuguguggcaugaug

SEQ ID NO: 1184322 - RNA, 19 nt, Homo sapiens
guagcuggcuucaaaauaa

SEQ ID NO: 1184323 - RNA, 19 nt, Homo sapiens
uaucaucucuggcucucua

SEQ ID NO: 1184324 - RNA, 19 nt, Homo sapiens
ucauagugcucccaucaaa

SEQ ID NO: 1184325 - RNA, 19 nt, Homo sapiens
aaacaaggcagaaugauca

SEQ ID NO: 1184326 - RNA, 19 nt, Homo sapiens
ucaaacaggccaccuuaaa

SEQ ID NO: 1184327 - RNA, 19 nt, Homo sapiens
gcaacaccaucaugacauc

SEQ ID NO: 1184328 - RNA, 19 nt, Homo sapiens
gcacucugcuggaauucug

SEQ ID NO: 1184329 - RNA, 19 nt, Homo sapiens
ggacugagaaaccagaguu

SEQ ID NO: 1184330 - RNA, 19 nt, Homo sapiens
gaagaugaagguaaguaga

SEQ ID NO: 1184331 - RNA, 19 nt, Homo sapiens
gaucauucccagaaacauu

SEQ ID NO: 1184332 - RNA, 19 nt, Homo sapiens
ccucacaguuacauuggua

SEQ ID NO: 1184333 - RNA, 19 nt, Homo sapiens
caaacaggccaccuuaaau

SEQ ID NO: 1184334 - RNA, 19 nt, Homo sapiens
gcuguaaacacuggaauaa

SEQ ID NO: 1184335 - RNA, 19 nt, Homo sapiens
gaguaucacauccuguaua

SEQ ID NO: 1184336 - RNA, 19 nt, Homo sapiens
gcuagaaguuuacagaaaa

SEQ ID NO: 1184337 - RNA, 19 nt, Homo sapiens
acgcagaaaucaaaguuau

SEQ ID NO: 1184338 - RNA, 19 nt, Homo sapiens
cacaaccuguucccaauga

SEQ ID NO: 1184339 - RNA, 19 nt, Homo sapiens
aaugaagucucaggguaua

SEQ ID NO: 1184340 - RNA, 19 nt, Homo sapiens
uguaaacacuggaauaagg

SEQ ID NO: 1184341 - RNA, 19 nt, Homo sapiens
aacaggaguuaacugauuu

SEQ ID NO: 1184342 - RNA, 19 nt, Homo sapiens
gacauugacuucagcaaaa

SEQ ID NO: 1184343 - RNA, 19 nt, Homo sapiens
uuacugaaguugcuagaag

SEQ ID NO: 1184344 - RNA, 19 nt, Homo sapiens
aagcuugaguuuccuaaau

SEQ ID NO: 1184345 - RNA, 19 nt, Homo sapiens
aaacaggccaccuuaaauc

SEQ ID NO: 1184346 - RNA, 19 nt, Homo sapiens
ggaagugcaggaacauuuc

SEQ ID NO: 1184347 - RNA, 19 nt, Homo sapiens
ugucugcccugguggguuu

SEQ ID NO: 1184348 - RNA, 19 nt, Homo sapiens
ucaaaguuauugggacuau

SEQ ID NO: 1184349 - RNA, 19 nt, Homo sapiens
ugacauugacuucagcaaa

SEQ ID NO: 1184350 - RNA, 19 nt, Homo sapiens
gauuugcacucugcuggaa

SEQ ID NO: 1184351 - RNA, 19 nt, Homo sapiens
gaagggcugaugacuuuca

SEQ ID NO: 1184352 - RNA, 19 nt, Homo sapiens
gcaaagcuugaguuuccua

SEQ ID NO: 1184353 - RNA, 19 nt, Homo sapiens
ggauaugaagaacuauuga

SEQ ID NO: 1184354 - RNA, 19 nt, Homo sapiens
ugucaaacaggccaccuua

SEQ ID NO: 1184355 - RNA, 19 nt, Homo sapiens
aaucuacaaucugugagua

SEQ ID NO: 1184356 - RNA, 19 nt, Homo sapiens
gaagucucaggguauauga

SEQ ID NO: 1184357 - RNA, 19 nt, Homo sapiens
acaaaucuacaaucuguga

SEQ ID NO: 1184358 - RNA, 19 nt, Homo sapiens
ggaaccaacgggcacaguu

SEQ ID NO: 1184359 - RNA, 19 nt, Homo sapiens
guaaacacuggaauaagga

SEQ ID NO: 1184360 - RNA, 19 nt, Homo sapiens
uagauuagccaaauagucu

SEQ ID NO: 1184361 - RNA, 19 nt, Homo sapiens
gaacuauugacuucuuaag

SEQ ID NO: 1184362 - RNA, 19 nt, Homo sapiens
gcccugguggguuucauua

SEQ ID NO: 1184363 - RNA, 19 nt, Homo sapiens
ugcuagaaguuuacagaaa

SEQ ID NO: 1184364 - RNA, 19 nt, Homo sapiens
aggauagccugaagaaaca

SEQ ID NO: 1184365 - RNA, 19 nt, Homo sapiens
caaaugucaucaacuucuc

SEQ ID NO: 1184366 - RNA, 19 nt, Homo sapiens
uuauacaggugcuaguguu

SEQ ID NO: 1184367 - RNA, 19 nt, Homo sapiens
gaagcaaaggacacaacuu

SEQ ID NO: 1184368 - RNA, 19 nt, Homo sapiens
gggagaaauauuaaucaga

SEQ ID NO: 1184369 - RNA, 19 nt, Homo sapiens
gaauaaggaagggcugaug

SEQ ID NO: 1184370 - RNA, 19 nt, Homo sapiens
guggaacucucucucugau

SEQ ID NO: 1184371 - RNA, 19 nt, Homo sapiens
gcaugaugguauugagcuu

SEQ ID NO: 1184372 - RNA, 19 nt, Homo sapiens
caucauagugcucccauca

SEQ ID NO: 1184373 - RNA, 19 nt, Homo sapiens
guaaguagaaaccguugau

SEQ ID NO: 1184374 - RNA, 19 nt, Homo sapiens
agaugaagguaaguagaaa

SEQ ID NO: 1184375 - RNA, 19 nt, Homo sapiens
gcuugaguuuccuaaaugu

SEQ ID NO: 1184376 - RNA, 19 nt, Homo sapiens
cuguggauaugaagaacua

SEQ ID NO: 1184377 - RNA, 19 nt, Homo sapiens
gaagugcaggaacauuuca

SEQ ID NO: 1184378 - RNA, 19 nt, Homo sapiens
ggacuauccagaucuugug

SEQ ID NO: 1184379 - RNA, 19 nt, Homo sapiens
cagaagaugaagguaagua

SEQ ID NO: 1184380 - RNA, 19 nt, Homo sapiens
aguaucacauccuguauag

SEQ ID NO: 1184381 - RNA, 19 nt, Homo sapiens
cuguauagcuguaaacacu

SEQ ID NO: 1184382 - RNA, 19 nt, Homo sapiens
uaaugaagucucaggguau

SEQ ID NO: 1184383 - RNA, 19 nt, Homo sapiens
cagccugguuggaagcauu

SEQ ID NO: 1184384 - RNA, 19 nt, Homo sapiens
aagaugaagguaaguagaa

SEQ ID NO: 1184385 - RNA, 19 nt, Homo sapiens
gucaacaggaguuaacuga

SEQ ID NO: 1184386 - RNA, 19 nt, Homo sapiens
acucaugacuguggauaug

SEQ ID NO: 1184387 - RNA, 19 nt, Homo sapiens
cauccuguauagcuguaaa

SEQ ID NO: 1184388 - RNA, 19 nt, Homo sapiens
gacugagaaaccagaguua

SEQ ID NO: 1184389 - RNA, 19 nt, Homo sapiens
ugacuguggauaugaagaa

SEQ ID NO: 1184390 - RNA, 19 nt, Homo sapiens
ccugguggguuucauuauc

SEQ ID NO: 1184391 - RNA, 19 nt, Homo sapiens
cauagcagccugguuggaa

SEQ ID NO: 1184392 - RNA, 19 nt, Homo sapiens
gugcucccaucaaauguca

SEQ ID NO: 1184393 - RNA, 19 nt, Homo sapiens
cugagaaaccagaguuaaa

SEQ ID NO: 1184394 - RNA, 19 nt, Homo sapiens
ucaaaugucaucaacuucu

SEQ ID NO: 1184395 - RNA, 19 nt, Homo sapiens
aggaagugcaggaacauuu

SEQ ID NO: 1184396 - RNA, 19 nt, Homo sapiens
gcaguggaacucucucucu

SEQ ID NO: 1184397 - RNA, 19 nt, Homo sapiens
aaacaucuacacgcagaaa

SEQ ID NO: 1184398 - RNA, 19 nt, Homo sapiens
gaaguugcuagaaguuuac

SEQ ID NO: 1184399 - RNA, 19 nt, Homo sapiens
guuguggugcucagacuuu

SEQ ID NO: 1184400 - RNA, 19 nt, Homo sapiens
caaagcuugaguuuccuaa

SEQ ID NO: 1184401 - RNA, 19 nt, Homo sapiens
gauuagccaaauagucuga

SEQ ID NO: 1184402 - RNA, 19 nt, Homo sapiens
ucucucugaugcugauuug

SEQ ID NO: 1184403 - RNA, 19 nt, Homo sapiens
cuucuacacuguugaacuc

SEQ ID NO: 1184404 - RNA, 19 nt, Homo sapiens
guauugagcuuggggauca

SEQ ID NO: 1184405 - RNA, 19 nt, Homo sapiens
caaccuguucccaaugaga

SEQ ID NO: 1184406 - RNA, 19 nt, Homo sapiens
ugcaggaacauuucacaaa

SEQ ID NO: 1184407 - RNA, 19 nt, Homo sapiens
uacaggugcuaguguuuua

SEQ ID NO: 1184408 - RNA, 19 nt, Homo sapiens
uaucacauccuguauagcu

SEQ ID NO: 1184409 - RNA, 19 nt, Homo sapiens
ugacuucuacacuguugaa

SEQ ID NO: 1184410 - RNA, 19 nt, Homo sapiens
gaaaguagcuggcuucaaa

SEQ ID NO: 1184411 - RNA, 19 nt, Homo sapiens
ggaguuaacugauuuguug

SEQ ID NO: 1184412 - RNA, 19 nt, Homo sapiens
caacaggaguuaacugauu

SEQ ID NO: 1184413 - RNA, 19 nt, Homo sapiens
ggaaacaggcuuacucuga

SEQ ID NO: 1184414 - RNA, 19 nt, Homo sapiens
gaacucugcuuacccauuc

SEQ ID NO: 1184415 - RNA, 19 nt, Homo sapiens
ucacaaaucuacaaucugu

SEQ ID NO: 1184416 - RNA, 19 nt, Homo sapiens
ugaaguugcuagaaguuua

SEQ ID NO: 1184417 - RNA, 19 nt, Homo sapiens
caucaaaugucaucaacuu

SEQ ID NO: 1184418 - RNA, 19 nt, Homo sapiens
uaagauauguguucauugg

SEQ ID NO: 1184419 - RNA, 19 nt, Homo sapiens
aggaagggcugaugacuuu

SEQ ID NO: 1184420 - RNA, 19 nt, Homo sapiens
ggacugcuauacagccaaa

SEQ ID NO: 1184421 - RNA, 19 nt, Homo sapiens
gcagaaaucaaaguuauug

SEQ ID NO: 1184422 - RNA, 19 nt, Homo sapiens
gaucuuguguggcaugaug

SEQ ID NO: 1184423 - RNA, 19 nt, Homo sapiens
guagcuggcuucaaaauaa

SEQ ID NO: 1184424 - RNA, 19 nt, Homo sapiens
uaucaucucuggcucucua

SEQ ID NO: 1184425 - RNA, 19 nt, Homo sapiens
ucauagugcucccaucaaa

SEQ ID NO: 1184426 - RNA, 19 nt, Homo sapiens
aaacaaggcagaaugauca

SEQ ID NO: 1184427 - RNA, 19 nt, Homo sapiens
ucaaacaggccaccuuaaa

SEQ ID NO: 1184428 - RNA, 19 nt, Homo sapiens
gcaacaccaucaugacauc

SEQ ID NO: 1184429 - RNA, 19 nt, Homo sapiens
gcacucugcuggaauucug

SEQ ID NO: 1184430 - RNA, 19 nt, Homo sapiens
ggacugagaaaccagaguu

SEQ ID NO: 1184431 - RNA, 19 nt, Homo sapiens
gaagaugaagguaaguaga

SEQ ID NO: 1184432 - RNA, 19 nt, Homo sapiens
gaucauucccagaaacauu

SEQ ID NO: 1184433 - RNA, 19 nt, Homo sapiens
ccucacaguuacauuggua

SEQ ID NO: 1184434 - RNA, 19 nt, Homo sapiens
caaacaggccaccuuaaau

SEQ ID NO: 1184435 - RNA, 19 nt, Homo sapiens
gcuguaaacacuggaauaa

SEQ ID NO: 1184436 - RNA, 19 nt, Homo sapiens
gaguaucacauccuguaua

SEQ ID NO: 1184437 - RNA, 19 nt, Homo sapiens
gcuagaaguuuacagaaaa

SEQ ID NO: 1184438 - RNA, 19 nt, Homo sapiens
acgcagaaaucaaaguuau

SEQ ID NO: 1184439 - RNA, 19 nt, Homo sapiens
cacaaccuguucccaauga

SEQ ID NO: 1184440 - RNA, 19 nt, Homo sapiens
aaugaagucucaggguaua

SEQ ID NO: 1184441 - RNA, 19 nt, Homo sapiens
uguaaacacuggaauaagg

SEQ ID NO: 1184442 - RNA, 19 nt, Homo sapiens
aacaggaguuaacugauuu

SEQ ID NO: 1184443 - RNA, 19 nt, Homo sapiens
gacauugacuucagcaaaa

SEQ ID NO: 1184444 - RNA, 19 nt, Homo sapiens
uuacugaaguugcuagaag

SEQ ID NO: 1184445 - RNA, 19 nt, Homo sapiens
aagcuugaguuuccuaaau

SEQ ID NO: 1184446 - RNA, 19 nt, Homo sapiens
aaacaggccaccuuaaauc

SEQ ID NO: 1184447 - RNA, 19 nt, Homo sapiens
ggaagugcaggaacauuuc

SEQ ID NO: 1184448 - RNA, 19 nt, Homo sapiens
ugucugcccugguggguuu

SEQ ID NO: 1184449 - RNA, 19 nt, Homo sapiens
ucaaaguuauugggacuau

SEQ ID NO: 1184450 - RNA, 19 nt, Homo sapiens
ugacauugacuucagcaaa

SEQ ID NO: 1184451 - RNA, 19 nt, Homo sapiens
gauuugcacucugcuggaa

SEQ ID NO: 1184452 - RNA, 19 nt, Homo sapiens
gaagggcugaugacuuuca

SEQ ID NO: 1184453 - RNA, 19 nt, Homo sapiens
gcaaagcuugaguuuccua

SEQ ID NO: 1184454 - RNA, 19 nt, Homo sapiens
ggauaugaagaacuauuga

SEQ ID NO: 1184455 - RNA, 19 nt, Homo sapiens
ugucaaacaggccaccuua

SEQ ID NO: 1184456 - RNA, 19 nt, Homo sapiens
gaagucucaggguauauga

SEQ ID NO: 1184457 - RNA, 19 nt, Homo sapiens
aaucuacaaucugugagua

SEQ ID NO: 1184458 - RNA, 19 nt, Homo sapiens
ggaaccaacgggcacaguu

SEQ ID NO: 1184459 - RNA, 19 nt, Homo sapiens
guaaacacuggaauaagga

SEQ ID NO: 1184460 - RNA, 19 nt, Homo sapiens
acaaaucuacaaucuguga

SEQ ID NO: 1184461 - RNA, 19 nt, Homo sapiens
uagauuagccaaauagucu

SEQ ID NO: 1184462 - RNA, 19 nt, Homo sapiens
gaacuauugacuucuuaag

SEQ ID NO: 1184463 - RNA, 19 nt, Homo sapiens
ugcuagaaguuuacagaaa

SEQ ID NO: 1184464 - RNA, 19 nt, Homo sapiens
gcccugguggguuucauua

SEQ ID NO: 1184465 - RNA, 19 nt, Homo sapiens
aggauagccugaagaaaca

SEQ ID NO: 1184466 - RNA, 19 nt, Homo sapiens
caaaugucaucaacuucuc

SEQ ID NO: 1184467 - RNA, 19 nt, Homo sapiens
uuauacaggugcuaguguu

SEQ ID NO: 1184468 - RNA, 19 nt, Homo sapiens
gaagcaaaggacacaacuu

SEQ ID NO: 1184469 - RNA, 19 nt, Homo sapiens
gaauaaggaagggcugaug

SEQ ID NO: 1184470 - RNA, 19 nt, Homo sapiens
gggagaaauauuaaucaga

SEQ ID NO: 1184471 - RNA, 19 nt, Homo sapiens
gcaugaugguauugagcuu

SEQ ID NO: 1184472 - RNA, 19 nt, Homo sapiens
caucauagugcucccauca

SEQ ID NO: 1184473 - RNA, 19 nt, Homo sapiens
guaaguagaaaccguugau

SEQ ID NO: 1184474 - RNA, 19 nt, Homo sapiens
agaugaagguaaguagaaa

SEQ ID NO: 1184475 - RNA, 19 nt, Homo sapiens
gcuugaguuuccuaaaugu

SEQ ID NO: 1184476 - RNA, 19 nt, Homo sapiens
cuguggauaugaagaacua

SEQ ID NO: 1184477 - RNA, 19 nt, Homo sapiens
gaagugcaggaacauuuca

SEQ ID NO: 1184478 - RNA, 19 nt, Homo sapiens
ggacuauccagaucuugug

SEQ ID NO: 1184479 - RNA, 19 nt, Homo sapiens
cagaagaugaagguaagua

SEQ ID NO: 1184480 - RNA, 19 nt, Homo sapiens
aguaucacauccuguauag

SEQ ID NO: 1184481 - RNA, 19 nt, Homo sapiens
cuguauagcuguaaacacu

SEQ ID NO: 1184482 - RNA, 19 nt, Homo sapiens
uaaugaagucucaggguau

SEQ ID NO: 1184483 - RNA, 19 nt, Homo sapiens
cagccugguuggaagcauu

SEQ ID NO: 1184484 - RNA, 19 nt, Homo sapiens
aagaugaagguaaguagaa

SEQ ID NO: 1184485 - RNA, 19 nt, Homo sapiens
gucaacaggaguuaacuga

SEQ ID NO: 1184486 - RNA, 19 nt, Homo sapiens
cauccuguauagcuguaaa

SEQ ID NO: 1184487 - RNA, 19 nt, Homo sapiens
acucaugacuguggauaug

SEQ ID NO: 1184488 - RNA, 19 nt, Homo sapiens
gcuggaacucucucucuga

SEQ ID NO: 1184489 - RNA, 19 nt, Homo sapiens
gacugagaaaccagaguua

SEQ ID NO: 1184490 - RNA, 19 nt, Homo sapiens
ugacuguggauaugaagaa

SEQ ID NO: 1184491 - RNA, 19 nt, Homo sapiens
ccugguggguuucauuauc

SEQ ID NO: 1184492 - RNA, 19 nt, Homo sapiens
cauagcagccugguuggaa

SEQ ID NO: 1184493 - RNA, 19 nt, Homo sapiens
gugcucccaucaaauguca

SEQ ID NO: 1184494 - RNA, 19 nt, Homo sapiens
cugagaaaccagaguuaaa

SEQ ID NO: 1184495 - RNA, 19 nt, Homo sapiens
ucaaaugucaucaacuucu

SEQ ID NO: 1184496 - RNA, 19 nt, Homo sapiens
gaaguugcuagaaguuuac

SEQ ID NO: 1184497 - RNA, 19 nt, Homo sapiens
aggaagugcaggaacauuu

SEQ ID NO: 1184498 - RNA, 19 nt, Homo sapiens
aaacaucuacacgcagaaa

SEQ ID NO: 1184499 - RNA, 19 nt, Homo sapiens
guuguggugcucagacuuu

SEQ ID NO: 1184500 - RNA, 19 nt, Homo sapiens
caaagcuugaguuuccuaa

SEQ ID NO: 1184501 - RNA, 19 nt, Homo sapiens
gauuagccaaauagucuga

SEQ ID NO: 1184502 - RNA, 19 nt, Homo sapiens
ucucucugaugcugauuug

SEQ ID NO: 1184503 - RNA, 19 nt, Homo sapiens
cuucuacacuguugaacuc

SEQ ID NO: 1184504 - RNA, 19 nt, Homo sapiens
guauugagcuuggggauca

SEQ ID NO: 1184505 - RNA, 19 nt, Homo sapiens
ugcaggaacauuucacaaa

SEQ ID NO: 1184506 - RNA, 19 nt, Homo sapiens
caaccuguucccaaugaga

SEQ ID NO: 1184507 - RNA, 19 nt, Homo sapiens
uacaggugcuaguguuuua

SEQ ID NO: 1184508 - RNA, 19 nt, Homo sapiens
aaaaggaagugcaggaaca

SEQ ID NO: 1184509 - RNA, 19 nt, Homo sapiens
uaucacauccuguauagcu

SEQ ID NO: 1184510 - RNA, 19 nt, Homo sapiens
agaaaucacugcuucagaa

SEQ ID NO: 1184511 - RNA, 19 nt, Homo sapiens
agcaauagcuggaaucauu

SEQ ID NO: 1184512 - RNA, 19 nt, Homo sapiens
agacugaaguaccaacuaa

SEQ ID NO: 1184513 - RNA, 19 nt, Homo sapiens
gacuagcacugugagaaua

SEQ ID NO: 1184514 - RNA, 19 nt, Homo sapiens
ggaguuaucuuccuuuuca

SEQ ID NO: 1184515 - RNA, 19 nt, Homo sapiens
cagauccuguuuggaauua

SEQ ID NO: 1184516 - RNA, 19 nt, Homo sapiens
aaucacugcuucagaauau

SEQ ID NO: 1184517 - RNA, 19 nt, Homo sapiens
gaauaugaguccacagaac

SEQ ID NO: 1184518 - RNA, 19 nt, Homo sapiens
ccaacuaaaucaucuccuu

SEQ ID NO: 1184519 - RNA, 19 nt, Homo sapiens
uugaugacuuucagcauua

SEQ ID NO: 1184520 - RNA, 19 nt, Homo sapiens
caacuaaaucaucuccuuu

SEQ ID NO: 1184521 - RNA, 19 nt, Homo sapiens
gaacauggucuagacugaa

SEQ ID NO: 1184522 - RNA, 19 nt, Homo sapiens
ggucuagacugaaguacca

SEQ ID NO: 1184523 - RNA, 19 nt, Homo sapiens
ucucugccuuucucaauuu

SEQ ID NO: 1184524 - RNA, 19 nt, Homo sapiens
ucuggagccuuccuaauug

SEQ ID NO: 1184525 - RNA, 19 nt, Homo sapiens
gauccuguuuggaauuaug

SEQ ID NO: 1184526 - RNA, 19 nt, Homo sapiens
ugaaguaccaacuaaauca

SEQ ID NO: 1184527 - RNA, 19 nt, Homo sapiens
gaaaucacugcuucagaau

SEQ ID NO: 1184528 - RNA, 19 nt, Homo sapiens
cacauuugguuucauccua

SEQ ID NO: 1184529 - RNA, 19 nt, Homo sapiens
agaacauggucuagacuga

SEQ ID NO: 1184530 - RNA, 19 nt, Homo sapiens
cagaauaugaguccacaga

SEQ ID NO: 1184531 - RNA, 19 nt, Homo sapiens
guccuguucuugggaauuu

SEQ ID NO: 1184532 - RNA, 19 nt, Homo sapiens
ugagccgaauaaugaauuu

SEQ ID NO: 1184533 - RNA, 19 nt, Homo sapiens
cuacauuugugguuauucu

SEQ ID NO: 1184534 - RNA, 19 nt, Homo sapiens
gaaaagaacauggucuaga

SEQ ID NO: 1184535 - RNA, 19 nt, Homo sapiens
ggacuauccagauccuguu

SEQ ID NO: 1184536 - RNA, 19 nt, Homo sapiens
auugaugacuuucagcauu

SEQ ID NO: 1184537 - RNA, 19 nt, Homo sapiens
gaaguaccaacuaaaucau

SEQ ID NO: 1184538 - RNA, 19 nt, Homo sapiens
gcacugugagaauaaagau

SEQ ID NO: 1184539 - RNA, 19 nt, Homo sapiens
ccucacauuugguuucauc

SEQ ID NO: 1184540 - RNA, 19 nt, Homo sapiens
cagaggauugugauuguga

SEQ ID NO: 1184541 - RNA, 19 nt, Homo sapiens
cuuccuaauugcagugaaa

SEQ ID NO: 1184542 - RNA, 19 nt, Homo sapiens
ucacugcuucagaauauga

SEQ ID NO: 1184543 - RNA, 19 nt, Homo sapiens
aaaucacugcuucagaaua

SEQ ID NO: 1184544 - RNA, 19 nt, Homo sapiens
ugacuagcacugugagaau

SEQ ID NO: 1184545 - RNA, 19 nt, Homo sapiens
ccagauccuguuuggaauu

SEQ ID NO: 1184546 - RNA, 19 nt, Homo sapiens
uuacauugaugacuuucag

SEQ ID NO: 1184547 - RNA, 19 nt, Homo sapiens
caucuccuuucaaauuauc

SEQ ID NO: 1184548 - RNA, 19 nt, Homo sapiens
acuaaaucaucuccuuuca

SEQ ID NO: 1184549 - RNA, 19 nt, Homo sapiens
ggagcaauagcuggaauca

SEQ ID NO: 1184550 - RNA, 19 nt, Homo sapiens
cuaaaucaucuccuuucaa

SEQ ID NO: 1184551 - RNA, 19 nt, Homo sapiens
cagaaaucacugcuucaga

SEQ ID NO: 1184552 - RNA, 19 nt, Homo sapiens
ugacuuucagcauuauuga

SEQ ID NO: 1184553 - RNA, 19 nt, Homo sapiens
gguuucauccuagaucaaa

SEQ ID NO: 1184554 - RNA, 19 nt, Homo sapiens
agguuucccuuuauauuuc

SEQ ID NO: 1184555 - RNA, 19 nt, Homo sapiens
gaccuuuucuuuuggaguu

SEQ ID NO: 1184556 - RNA, 19 nt, Homo sapiens
cuagcacugugagaauaaa

SEQ ID NO: 1184557 - RNA, 19 nt, Homo sapiens
cucagaggauugugauugu

SEQ ID NO: 1184558 - RNA, 19 nt, Homo sapiens
ucauuucucugccuuucuc

SEQ ID NO: 1184559 - RNA, 19 nt, Homo sapiens
gcucuguuuuguucauuaa

SEQ ID NO: 1184560 - RNA, 19 nt, Homo sapiens
ggaauuaugaccuuuucuu

SEQ ID NO: 1184561 - RNA, 19 nt, Homo sapiens
agaggauugugauugugaa

SEQ ID NO: 1184562 - RNA, 19 nt, Homo sapiens
aaucauucuccucacauuu

SEQ ID NO: 1184563 - RNA, 19 nt, Homo sapiens
ucagaggauugugauugug

SEQ ID NO: 1184564 - RNA, 19 nt, Homo sapiens
ccacucagaggauugugau

SEQ ID NO: 1184565 - RNA, 19 nt, Homo sapiens
ggcuguuacuguccuguuc

SEQ ID NO: 1184566 - RNA, 19 nt, Homo sapiens
cauccuagaucaaaacuac

SEQ ID NO: 1184567 - RNA, 19 nt, Homo sapiens
gacugaaguaccaacuaaa

SEQ ID NO: 1184568 - RNA, 19 nt, Homo sapiens
cuuagggacuauccagauc

SEQ ID NO: 1184569 - RNA, 19 nt, Homo sapiens
cauggucuagacugaagua

SEQ ID NO: 1184570 - RNA, 19 nt, Homo sapiens
acucagaggauugugauug

SEQ ID NO: 1184571 - RNA, 19 nt, Homo sapiens
aaaagaacauggucuagac

SEQ ID NO: 1184572 - RNA, 19 nt, Homo sapiens
gacuauccagauccuguuu

SEQ ID NO: 1184573 - RNA, 19 nt, Homo sapiens
agaauaugaguccacagaa

SEQ ID NO: 1184574 - RNA, 19 nt, Homo sapiens
ggucaugccuauauaaguu

SEQ ID NO: 1184575 - RNA, 19 nt, Homo sapiens
ggacauacacugagaguca

SEQ ID NO: 1184576 - RNA, 19 nt, Homo sapiens
gagagucaguccuccuuaa

SEQ ID NO: 1184577 - RNA, 19 nt, Homo sapiens
gugacgagcuguacuguga

SEQ ID NO: 1184578 - RNA, 19 nt, Homo sapiens
ggacaauggugggcaguug

SEQ ID NO: 1184579 - RNA, 19 nt, Homo sapiens
ugacauacuagcucuauaa

SEQ ID NO: 1184580 - RNA, 19 nt, Homo sapiens
ggcaguugcucuuacauga

SEQ ID NO: 1184581 - RNA, 19 nt, Homo sapiens
cuaauggugucacugugua

SEQ ID NO: 1184582 - RNA, 19 nt, Homo sapiens
ccagggucaugccuauaua

SEQ ID NO: 1184583 - RNA, 19 nt, Homo sapiens
ggacuggcauugcacuagu

SEQ ID NO: 1184584 - RNA, 19 nt, Homo sapiens
ggacagcuccuuggaagug

SEQ ID NO: 1184585 - RNA, 19 nt, Homo sapiens
gugaggacauacacugaga

SEQ ID NO: 1184586 - RNA, 19 nt, Homo sapiens
gggccagggucaugccuau

SEQ ID NO: 1184587 - RNA, 19 nt, Homo sapiens
gacauacuagcucuauaaa

SEQ ID NO: 1184588 - RNA, 19 nt, Homo sapiens
gacgagcuguacugugaga

SEQ ID NO: 1184589 - RNA, 19 nt, Homo sapiens
ucaagaugcugcaggaaaa

SEQ ID NO: 1184590 - RNA, 19 nt, Homo sapiens
uacaugagcuaaguuugga

SEQ ID NO: 1184591 - RNA, 19 nt, Homo sapiens
cuacaccugugccgacugu

SEQ ID NO: 1184592 - RNA, 19 nt, Homo sapiens
gugucacuguguaaaguuu

SEQ ID NO: 1184593 - RNA, 19 nt, Homo sapiens
ugagguggccacugccuuu

SEQ ID NO: 1184594 - RNA, 19 nt, Homo sapiens
gccagggucaugccuauau

SEQ ID NO: 1184595 - RNA, 19 nt, Homo sapiens
gcuaauggugucacugugu

SEQ ID NO: 1184596 - RNA, 19 nt, Homo sapiens
ccacugaccggcucaaagg

SEQ ID NO: 1184597 - RNA, 19 nt, Homo sapiens
gggcuaauggugucacugu

SEQ ID NO: 1184598 - RNA, 19 nt, Homo sapiens
gacauaaucguggccauca

SEQ ID NO: 1184599 - RNA, 19 nt, Homo sapiens
gguggccacugccuuugau

SEQ ID NO: 1184600 - RNA, 19 nt, Homo sapiens
guaccagcaucgcgaacca

SEQ ID NO: 1184601 - RNA, 19 nt, Homo sapiens
acugugggcugaaccugaa

SEQ ID NO: 1184602 - RNA, 19 nt, Homo sapiens
ccuggaggcugaggagaga

SEQ ID NO: 1184603 - RNA, 19 nt, Homo sapiens
ugagagucaguccuccuua

SEQ ID NO: 1184604 - RNA, 19 nt, Homo sapiens
uggcauugcacuagucuga

SEQ ID NO: 1184605 - RNA, 19 nt, Homo sapiens
gggcaguugcucuuacaug

SEQ ID NO: 1184606 - RNA, 19 nt, Homo sapiens
ugugagaagugcaguacca

SEQ ID NO: 1184607 - RNA, 19 nt, Homo sapiens
cagggucaugccuauauaa

SEQ ID NO: 1184608 - RNA, 19 nt, Homo sapiens
uuacaugagcuaaguuugg

SEQ ID NO: 1184609 - RNA, 19 nt, Homo sapiens
gugggcaguugcucuuaca

SEQ ID NO: 1184610 - RNA, 19 nt, Homo sapiens
ggugggcaguugcucuuac

SEQ ID NO: 1184611 - RNA, 19 nt, Homo sapiens
cgacaguccagcuccuuuc

SEQ ID NO: 1184612 - RNA, 19 nt, Homo sapiens
agucaguccuccuuaaggu

SEQ ID NO: 1184613 - RNA, 19 nt, Homo sapiens
gaggacauacacugagagu

SEQ ID NO: 1184614 - RNA, 19 nt, Homo sapiens
ugccuuugaucaaccuuug

SEQ ID NO: 1184615 - RNA, 19 nt, Homo sapiens
cugaccggcucaaagguau

SEQ ID NO: 1184616 - RNA, 19 nt, Homo sapiens
ggccacugccuuugaucaa

SEQ ID NO: 1184617 - RNA, 19 nt, Homo sapiens
ggaaugggcucaacaguga

SEQ ID NO: 1184618 - RNA, 19 nt, Homo sapiens
gaaauaagcuggcagugau

SEQ ID NO: 1184619 - RNA, 19 nt, Homo sapiens
gaaaugagagugccaugua

SEQ ID NO: 1184620 - RNA, 19 nt, Homo sapiens
ucaaagaugucuccuugua

SEQ ID NO: 1184621 - RNA, 19 nt, Homo sapiens
gaaacuuggugagaaauaa

SEQ ID NO: 1184622 - RNA, 19 nt, Homo sapiens
ggaguuaccugaucacauc

SEQ ID NO: 1184623 - RNA, 19 nt, Homo sapiens
gauagaaucugccuacaag

SEQ ID NO: 1184624 - RNA, 19 nt, Homo sapiens
gaccauaagugacagagaa

SEQ ID NO: 1184625 - RNA, 19 nt, Homo sapiens
caggacaucucaagucuuu

SEQ ID NO: 1184626 - RNA, 19 nt, Homo sapiens
gaagcaagguuaucaugca

SEQ ID NO: 1184627 - RNA, 19 nt, Homo sapiens
gcagugagauucuuguagu

SEQ ID NO: 1184628 - RNA, 19 nt, Homo sapiens
caauggaagugguuuauag

SEQ ID NO: 1184629 - RNA, 19 nt, Homo sapiens
aauaagggaucaucucauu

SEQ ID NO: 1184630 - RNA, 19 nt, Homo sapiens
gcaaggaacgggaaauaga

SEQ ID NO: 1184631 - RNA, 19 nt, Homo sapiens
gcagggacaugugguuauu

SEQ ID NO: 1184632 - RNA, 19 nt, Homo sapiens
gcaagguuaucaugcagaa

SEQ ID NO: 1184633 - RNA, 19 nt, Homo sapiens
guccaugggucuccaagua

SEQ ID NO: 1184634 - RNA, 19 nt, Homo sapiens
gacccaagaauguaaauaa

SEQ ID NO: 1184635 - RNA, 19 nt, Homo sapiens
caagagaguccagaugaua

SEQ ID NO: 1184636 - RNA, 19 nt, Homo sapiens
ccaggcagauccucaaaga

SEQ ID NO: 1184637 - RNA, 19 nt, Homo sapiens
ggugaccucucaucuuuga

SEQ ID NO: 1184638 - RNA, 19 nt, Homo sapiens
gggcuuacauccugagguu

SEQ ID NO: 1184639 - RNA, 19 nt, Homo sapiens
ggauaaaggauuaggcaaa

SEQ ID NO: 1184640 - RNA, 19 nt, Homo sapiens
uguggcagcucaaauguuu

SEQ ID NO: 1184641 - RNA, 19 nt, Homo sapiens
ggugggacaucacaucuug

SEQ ID NO: 1184642 - RNA, 19 nt, Homo sapiens
caaauauagucaacagugu

SEQ ID NO: 1184643 - RNA, 19 nt, Homo sapiens
gaaauagaaaccuccaaga

SEQ ID NO: 1184644 - RNA, 19 nt, Homo sapiens
ugggugaccucucaucuuu

SEQ ID NO: 1184645 - RNA, 19 nt, Homo sapiens
acaucuagauucacaauga

SEQ ID NO: 1184646 - RNA, 19 nt, Homo sapiens
gacaugugguuauuuggaa

SEQ ID NO: 1184647 - RNA, 19 nt, Homo sapiens
uaccagaaguggcagauga

SEQ ID NO: 1184648 - RNA, 19 nt, Homo sapiens
gaaucugccuacaagaaau

SEQ ID NO: 1184649 - RNA, 19 nt, Homo sapiens
gcucugaacgucugaaaug

SEQ ID NO: 1184650 - RNA, 19 nt, Homo sapiens
gcaauggaagugguuuaua

SEQ ID NO: 1184651 - RNA, 19 nt, Homo sapiens
ggacaucucaagucuuuua

SEQ ID NO: 1184652 - RNA, 19 nt, Homo sapiens
ugaggagagugacaagaaa

SEQ ID NO: 1184653 - RNA, 19 nt, Homo sapiens
ggccaugggugaccucuca

SEQ ID NO: 1184654 - RNA, 19 nt, Homo sapiens
gauaaaggauuaggcaaaa

SEQ ID NO: 1184655 - RNA, 19 nt, Homo sapiens
ggucggaguuaccugauca

SEQ ID NO: 1184656 - RNA, 19 nt, Homo sapiens
ggacaugugguuauuugga

SEQ ID NO: 1184657 - RNA, 19 nt, Homo sapiens
gacaggacaucucaagucu

SEQ ID NO: 1184658 - RNA, 19 nt, Homo sapiens
ccauguauuucuuucuuga

SEQ ID NO: 1184659 - RNA, 19 nt, Homo sapiens
ccaugggucuccaaguaaa

SEQ ID NO: 1184660 - RNA, 19 nt, Homo sapiens
caaggaacgggaaauagaa

SEQ ID NO: 1184661 - RNA, 19 nt, Homo sapiens
ccacaggccuggacugcau

SEQ ID NO: 1184662 - RNA, 19 nt, Homo sapiens
ugacugagcggacccaaga

SEQ ID NO: 1184663 - RNA, 19 nt, Homo sapiens
gagacucgugugacuauuu

SEQ ID NO: 1184664 - RNA, 19 nt, Homo sapiens
gagcggacccaagaaugua

SEQ ID NO: 1184665 - RNA, 19 nt, Homo sapiens
aagcaggccuugaaugcaa

SEQ ID NO: 1184666 - RNA, 19 nt, Homo sapiens
cauuaagacuccauuugug

SEQ ID NO: 1184667 - RNA, 19 nt, Homo sapiens
ggugcaacaucuagauuca

SEQ ID NO: 1184668 - RNA, 19 nt, Homo sapiens
ggaagacccagaguuaaau

SEQ ID NO: 1184669 - RNA, 19 nt, Homo sapiens
ccaagagaguccagaugau

SEQ ID NO: 1184670 - RNA, 19 nt, Homo sapiens
ugacugcgguuacccuugu

SEQ ID NO: 1184671 - RNA, 19 nt, Homo sapiens
ggccuugaaugcaauggaa

SEQ ID NO: 1184672 - RNA, 19 nt, Homo sapiens
uaagggaucaucucauuag

SEQ ID NO: 1184673 - RNA, 19 nt, Homo sapiens
ugaaacaccugaaaacguu

SEQ ID NO: 1184674 - RNA, 19 nt, Homo sapiens
gaagguggaggccgucaug

SEQ ID NO: 1184675 - RNA, 19 nt, Homo sapiens
agaaucugaucauggguuu

SEQ ID NO: 1184676 - RNA, 19 nt, Homo sapiens
cuaaggucaugcuguuuga

SEQ ID NO: 1184677 - RNA, 19 nt, Homo sapiens
aaaugagagugccauguau

SEQ ID NO: 1184678 - RNA, 19 nt, Homo sapiens
gcugaacgcugugaaucug

SEQ ID NO: 1184679 - RNA, 19 nt, Homo sapiens
aauagaaaccuccaagaga

SEQ ID NO: 1184680 - RNA, 19 nt, Homo sapiens
gaagacccagaguuaaaug

SEQ ID NO: 1184681 - RNA, 19 nt, Homo sapiens
gugcaugacugcucugaac

SEQ ID NO: 1184682 - RNA, 19 nt, Homo sapiens
uagaaucugccuacaagaa

SEQ ID NO: 1184683 - RNA, 19 nt, Homo sapiens
gaucaugugcauccuagga

SEQ ID NO: 1184684 - RNA, 19 nt, Homo sapiens
uggaagacccagaguuaaa

SEQ ID NO: 1184685 - RNA, 19 nt, Homo sapiens
ccauuaagacuccauuugu

SEQ ID NO: 1184686 - RNA, 19 nt, Homo sapiens
cugaacgucugaaaugaga

SEQ ID NO: 1184687 - RNA, 19 nt, Homo sapiens
cacaaugaacuuucugauu

SEQ ID NO: 1184688 - RNA, 19 nt, Homo sapiens
caacaucuagauucacaau

SEQ ID NO: 1184689 - RNA, 19 nt, Homo sapiens
gacaacuaauccaaugugu

SEQ ID NO: 1184690 - RNA, 19 nt, Homo sapiens
ccucagaaacauacaagaa

SEQ ID NO: 1184691 - RNA, 19 nt, Homo sapiens
ccgcguaggucuccuuuac

SEQ ID NO: 1184692 - RNA, 19 nt, Homo sapiens
uuacgcgucuccuucagaa

SEQ ID NO: 1184693 - RNA, 19 nt, Homo sapiens
cuacaagaaaucagcaauu

SEQ ID NO: 1184694 - RNA, 19 nt, Homo sapiens
gcgagacgcugcacuacac

SEQ ID NO: 1184695 - RNA, 19 nt, Homo sapiens
ggcagauccucaaagaugu

SEQ ID NO: 1184696 - RNA, 19 nt, Homo sapiens
aagugaagcugccgacugu

SEQ ID NO: 1184697 - RNA, 19 nt, Homo sapiens
gcagaucaugugcauccua

SEQ ID NO: 1184698 - RNA, 19 nt, Homo sapiens
agaaauaagcuggcaguga

SEQ ID NO: 1184699 - RNA, 19 nt, Homo sapiens
ggacccaagaauguaaaua

SEQ ID NO: 1184700 - RNA, 19 nt, Homo sapiens
ugugacaacuaauccaaug

SEQ ID NO: 1184701 - RNA, 19 nt, Homo sapiens
gugaauuucuaacucuugu

SEQ ID NO: 1184702 - RNA, 19 nt, Homo sapiens
gaguccagaugauagaauc

SEQ ID NO: 1184703 - RNA, 19 nt, Homo sapiens
agaguuaaaugcagauguc

SEQ ID NO: 1184704 - RNA, 19 nt, Homo sapiens
gggagacucgugugacuau

SEQ ID NO: 1184705 - RNA, 19 nt, Homo sapiens
gcucuugucauccuaggaa

SEQ ID NO: 1184706 - RNA, 19 nt, Homo sapiens
ucaaauguuucugugacaa

SEQ ID NO: 1184707 - RNA, 19 nt, Homo sapiens
uauagucccuugcucuuac

SEQ ID NO: 1184708 - RNA, 19 nt, Homo sapiens
gaacgcugugaaucuguuu

SEQ ID NO: 1184709 - RNA, 19 nt, Homo sapiens
gcguaggucuccuuuacca

SEQ ID NO: 1184710 - RNA, 19 nt, Homo sapiens
cuacagagcacccagugau

SEQ ID NO: 1184711 - RNA, 19 nt, Homo sapiens
guggagagcgggcagauca

SEQ ID NO: 1184712 - RNA, 19 nt, Homo sapiens
gcagaauuggguaagaaug

SEQ ID NO: 1184713 - RNA, 19 nt, Homo sapiens
gccauguauuucuuucuug

SEQ ID NO: 1184714 - RNA, 19 nt, Homo sapiens
ugaacgcugugaaucuguu

SEQ ID NO: 1184715 - RNA, 19 nt, Homo sapiens
agaaucugccuacaagaaa

SEQ ID NO: 1184716 - RNA, 19 nt, Homo sapiens
aggcagauccucaaagaug

SEQ ID NO: 1184717 - RNA, 19 nt, Homo sapiens
gggcaaugcuuuacuauga

SEQ ID NO: 1184718 - RNA, 19 nt, Homo sapiens
ucauggagcuggacucgua

SEQ ID NO: 1184719 - RNA, 19 nt, Homo sapiens
aaccuaagcuucaaaguga

SEQ ID NO: 1184720 - RNA, 19 nt, Homo sapiens
gaaccuaagcuucaaagug

SEQ ID NO: 1184721 - RNA, 19 nt, Homo sapiens
ccacauggccuccuucuuc

SEQ ID NO: 1184722 - RNA, 19 nt, Homo sapiens
gaucugguccuccugauga

SEQ ID NO: 1184723 - RNA, 19 nt, Homo sapiens
ucagagaccucaacuacca

SEQ ID NO: 1184724 - RNA, 19 nt, Homo sapiens
ggucuucuguugcaggauu

SEQ ID NO: 1184725 - RNA, 19 nt, Homo sapiens
gcggaggccugucugaugu

SEQ ID NO: 1184726 - RNA, 19 nt, Homo sapiens
gaccaucggcuuccucuau

SEQ ID NO: 1184727 - RNA, 19 nt, Homo sapiens
ggaaagcagagacgaagga

SEQ ID NO: 1184728 - RNA, 19 nt, Homo sapiens
cgagagaccuuggccuuca

SEQ ID NO: 1184729 - RNA, 19 nt, Homo sapiens
gugccuacaucaucaucua

SEQ ID NO: 1184730 - RNA, 19 nt, Homo sapiens
ggcaaugcuuuacuaugaa

SEQ ID NO: 1184731 - RNA, 19 nt, Homo sapiens
agagggcaaugcuuuacua

SEQ ID NO: 1184732 - RNA, 19 nt, Homo sapiens
ucagagagggcaaugcuuu

SEQ ID NO: 1184733 - RNA, 19 nt, Homo sapiens
uaagguucaucaaacagaa

SEQ ID NO: 1184734 - RNA, 19 nt, Homo sapiens
uugaagggcugaugaagau

SEQ ID NO: 1184735 - RNA, 19 nt, Homo sapiens
gggugcagcuccuguggaa

SEQ ID NO: 1184736 - RNA, 19 nt, Homo sapiens
aaacagaaaccaagucaag

SEQ ID NO: 1184737 - RNA, 19 nt, Homo sapiens
ccucagcgguggcuucaug

SEQ ID NO: 1184738 - RNA, 19 nt, Homo sapiens
gauaaaauccucaguguca

SEQ ID NO: 1184739 - RNA, 19 nt, Homo sapiens
cagcucuccuucauggaua

SEQ ID NO: 1184740 - RNA, 19 nt, Homo sapiens
gcaauccugcugacuucua

SEQ ID NO: 1184741 - RNA, 19 nt, Homo sapiens
gcacaugguccaguauuuc

SEQ ID NO: 1184742 - RNA, 19 nt, Homo sapiens
gagauaaaauccucagugu

SEQ ID NO: 1184743 - RNA, 19 nt, Homo sapiens
agagagggcugccgaaagg

SEQ ID NO: 1184744 - RNA, 19 nt, Homo sapiens
ucucccagcugccagaauu

SEQ ID NO: 1184745 - RNA, 19 nt, Homo sapiens
gaagggcugaugaagauuc

SEQ ID NO: 1184746 - RNA, 19 nt, Homo sapiens
cagagagggcaaugcuuua

SEQ ID NO: 1184747 - RNA, 19 nt, Homo sapiens
gcagcuggcucaguucaag

SEQ ID NO: 1184748 - RNA, 19 nt, Homo sapiens
gcuuuacuaugaacuggaa

SEQ ID NO: 1184749 - RNA, 19 nt, Homo sapiens
gcauccagcucuccuucau

SEQ ID NO: 1184750 - RNA, 19 nt, Homo sapiens
cagcagagagcaggaauug

SEQ ID NO: 1184751 - RNA, 19 nt, Homo sapiens
ccucugggcucgacagcuu

SEQ ID NO: 1184752 - RNA, 19 nt, Homo sapiens
ggagagagggcugccgaaa

SEQ ID NO: 1184753 - RNA, 19 nt, Homo sapiens
cagcagaagaacuuauaaa

SEQ ID NO: 1184754 - RNA, 19 nt, Homo sapiens
gcaaugcuuuacuaugaac

SEQ ID NO: 1184755 - RNA, 19 nt, Homo sapiens
ucgcagcccuguuucuaga

SEQ ID NO: 1184756 - RNA, 19 nt, Homo sapiens
ccucucaggucccuugguu

SEQ ID NO: 1184757 - RNA, 19 nt, Homo sapiens
aagauucaguucagcagaa

SEQ ID NO: 1184758 - RNA, 19 nt, Homo sapiens
caauccugcugacuucuau

SEQ ID NO: 1184759 - RNA, 19 nt, Homo sapiens
ucggugcucucaucccuuu

SEQ ID NO: 1184760 - RNA, 19 nt, Homo sapiens
ccaucggcuuccucuauuu

SEQ ID NO: 1184761 - RNA, 19 nt, Homo sapiens
gcaaccggcuggugcucau

SEQ ID NO: 1184762 - RNA, 19 nt, Homo sapiens
agauuguucuccucugaaa

SEQ ID NO: 1184763 - RNA, 19 nt, Homo sapiens
cacauggccuccuucuuca

SEQ ID NO: 1184764 - RNA, 19 nt, Homo sapiens
gagccuccuugcuagaugu

SEQ ID NO: 1184765 - RNA, 19 nt, Homo sapiens
ggugagcgcaggagaguca

SEQ ID NO: 1184766 - RNA, 19 nt, Homo sapiens
auagauuguucuccucuga

SEQ ID NO: 1184767 - RNA, 19 nt, Homo sapiens
ucaaacagaaaccaaguca

SEQ ID NO: 1184768 - RNA, 19 nt, Homo sapiens
ccacugguccauauuucuu

SEQ ID NO: 1184769 - RNA, 19 nt, Homo sapiens
gcagagacgaaggaucuug

SEQ ID NO: 1184770 - RNA, 19 nt, Homo sapiens
gaccugaccagcauugaca

SEQ ID NO: 1184771 - RNA, 19 nt, Homo sapiens
cccagcacaugguccagua

SEQ ID NO: 1184772 - RNA, 19 nt, Homo sapiens
gcaggagagucagcauugg

SEQ ID NO: 1184773 - RNA, 19 nt, Homo sapiens
ccuuaagguucaucaaaca

SEQ ID NO: 1184774 - RNA, 19 nt, Homo sapiens
gcuucaugguccuguacua

SEQ ID NO: 1184775 - RNA, 19 nt, Homo sapiens
ggaggccugucugauguca

SEQ ID NO: 1184776 - RNA, 19 nt, Homo sapiens
gagagagggcugccgaaag

SEQ ID NO: 1184777 - RNA, 19 nt, Homo sapiens
gaaggcggcagaggagaga

SEQ ID NO: 1184778 - RNA, 19 nt, Homo sapiens
gagagaccuuggccuucau

SEQ ID NO: 1184779 - RNA, 19 nt, Homo sapiens
auagggagcucagguugug

SEQ ID NO: 1184780 - RNA, 19 nt, Homo sapiens
aagcagagacgaaggaucu

SEQ ID NO: 1184781 - RNA, 19 nt, Homo sapiens
guccuuaagguucaucaaa

SEQ ID NO: 1184782 - RNA, 19 nt, Homo sapiens
ucucaggucccuugguuug

SEQ ID NO: 1184783 - RNA, 19 nt, Homo sapiens
ucuacgggaugcccaccua

SEQ ID NO: 1184784 - RNA, 19 nt, Homo sapiens
cagagacgaaggaucuuga

SEQ ID NO: 1184785 - RNA, 19 nt, Homo sapiens
gggagaaggcucagucacu

SEQ ID NO: 1184786 - RNA, 19 nt, Homo sapiens
gcagcagagagcaggaauu

SEQ ID NO: 1184787 - RNA, 19 nt, Homo sapiens
cagaugcggcugcccagaa

SEQ ID NO: 1184788 - RNA, 19 nt, Homo sapiens
ggccuucauugcccagaug

SEQ ID NO: 1184789 - RNA, 19 nt, Homo sapiens
ccuccaggauagauuguuc

SEQ ID NO: 1184790 - RNA, 19 nt, Homo sapiens
caacgucauucuggauguc

SEQ ID NO: 1184791 - RNA, 19 nt, Homo sapiens
ucaacgucauucuggaugu

SEQ ID NO: 1184792 - RNA, 19 nt, Homo sapiens
gaaagcagagacgaaggau

SEQ ID NO: 1184793 - RNA, 19 nt, Homo sapiens
gcgcaggagagucagcauu

SEQ ID NO: 1184794 - RNA, 19 nt, Homo sapiens
ggacucguacccucucuac

SEQ ID NO: 1184795 - RNA, 19 nt, Homo sapiens
cagcacaugguccaguauu

SEQ ID NO: 1184796 - RNA, 19 nt, Homo sapiens
ccaucuaccucaucgucau

SEQ ID NO: 1184797 - RNA, 19 nt, Homo sapiens
ccagcugccagaauucuug

SEQ ID NO: 1184798 - RNA, 19 nt, Homo sapiens
accaucggcuuccucuauu

SEQ ID NO: 1184799 - RNA, 19 nt, Homo sapiens
agcacaugguccaguauuu

SEQ ID NO: 1184800 - RNA, 19 nt, Homo sapiens
gcugccagaauucuuguga

SEQ ID NO: 1184801 - RNA, 19 nt, Homo sapiens
cagccucgcucugacaucu

SEQ ID NO: 1184802 - RNA, 19 nt, Homo sapiens
gcccacaaccuggugaaga

SEQ ID NO: 1184803 - RNA, 19 nt, Homo sapiens
caucaaacagaaaccaagu

SEQ ID NO: 1184804 - RNA, 19 nt, Homo sapiens
guacuacguguccuuaagg

SEQ ID NO: 1184805 - RNA, 19 nt, Homo sapiens
uguacuacguguccuuaag

SEQ ID NO: 1184806 - RNA, 19 nt, Homo sapiens
ucagcagaagaacuuauaa

SEQ ID NO: 1184807 - RNA, 19 nt, Homo sapiens
ggcugguggucuucuguug

SEQ ID NO: 1184808 - RNA, 19 nt, Homo sapiens
gagggcaaugcuuuacuau

SEQ ID NO: 1184809 - RNA, 19 nt, Homo sapiens
aggccugucugaugucaau

SEQ ID NO: 1184810 - RNA, 19 nt, Homo sapiens
ucagauuuccaacgacuuc

SEQ ID NO: 1184811 - RNA, 19 nt, Homo sapiens
gagagccuccuugcuagau

SEQ ID NO: 1184812 - RNA, 19 nt, Homo sapiens
gucacucgcagcccuguuu

SEQ ID NO: 1184813 - RNA, 19 nt, Homo sapiens
uguccucgcuacagcaauc

SEQ ID NO: 1184814 - RNA, 19 nt, Homo sapiens
ugacaucuucaggcuguuu

SEQ ID NO: 1184815 - RNA, 19 nt, Homo sapiens
cgcaggagagucagcauug

SEQ ID NO: 1184816 - RNA, 19 nt, Homo sapiens
gugcgugacuuagaugacu

SEQ ID NO: 1184817 - RNA, 19 nt, Homo sapiens
ggacgacacuucaauuauu

SEQ ID NO: 1184818 - RNA, 19 nt, Homo sapiens
aaacuaugguguucucuua

SEQ ID NO: 1184819 - RNA, 19 nt, Homo sapiens
gcaacuguaccuauuauua

SEQ ID NO: 1184820 - RNA, 19 nt, Homo sapiens
gauaucagcuuuaauguac

SEQ ID NO: 1184821 - RNA, 19 nt, Homo sapiens
caaagcaacuguaccuauu

SEQ ID NO: 1184822 - RNA, 19 nt, Homo sapiens
ggaccuuaaugaaguauuu

SEQ ID NO: 1184823 - RNA, 19 nt, Homo sapiens
caacaaaucucagcaugga

SEQ ID NO: 1184824 - RNA, 19 nt, Homo sapiens
cagaugaaguugccacaua

SEQ ID NO: 1184825 - RNA, 19 nt, Homo sapiens
gcaaggcucuuucguucuu

SEQ ID NO: 1184826 - RNA, 19 nt, Homo sapiens
cagcugaccucaucaaaga

SEQ ID NO: 1184827 - RNA, 19 nt, Homo sapiens
gauaaaggauggugguuca

SEQ ID NO: 1184828 - RNA, 19 nt, Homo sapiens
gcaaauccaauaaucagua

SEQ ID NO: 1184829 - RNA, 19 nt, Homo sapiens
caaacaacaucaaggcaaa

SEQ ID NO: 1184830 - RNA, 19 nt, Homo sapiens
guucauauguggccaaaga

SEQ ID NO: 1184831 - RNA, 19 nt, Homo sapiens
gacgacacuucaauuauuu

SEQ ID NO: 1184832 - RNA, 19 nt, Homo sapiens
ggaauugguucuuauaguc

SEQ ID NO: 1184833 - RNA, 19 nt, Homo sapiens
gaauagaccugagccuuca

SEQ ID NO: 1184834 - RNA, 19 nt, Homo sapiens
gagagcagcugaccucauc

SEQ ID NO: 1184835 - RNA, 19 nt, Homo sapiens
gaagcaggccuuugauuau

SEQ ID NO: 1184836 - RNA, 19 nt, Homo sapiens
uaucgaagauccuuuacaa

SEQ ID NO: 1184837 - RNA, 19 nt, Homo sapiens
ugaagcaggccuuugauua

SEQ ID NO: 1184838 - RNA, 19 nt, Homo sapiens
ggccaucaaugcuuuauau

SEQ ID NO: 1184839 - RNA, 19 nt, Homo sapiens
gcaaaguacuaucccaaca

SEQ ID NO: 1184840 - RNA, 19 nt, Homo sapiens
acagaaagcauacuaggua

SEQ ID NO: 1184841 - RNA, 19 nt, Homo sapiens
caaggcaaauccaauaauc

SEQ ID NO: 1184842 - RNA, 19 nt, Homo sapiens
gcagagggaccuuaaugaa

SEQ ID NO: 1184843 - RNA, 19 nt, Homo sapiens
caucaaggcaaauccaaua

SEQ ID NO: 1184844 - RNA, 19 nt, Homo sapiens
gaaagcauacuagguagaa

SEQ ID NO: 1184845 - RNA, 19 nt, Homo sapiens
caaugaaacagaaagcaua

SEQ ID NO: 1184846 - RNA, 19 nt, Homo sapiens
gagauuggauaucaaagca

SEQ ID NO: 1184847 - RNA, 19 nt, Homo sapiens
caucaaugcuuuauaucga

SEQ ID NO: 1184848 - RNA, 19 nt, Homo sapiens
uuacugaagugaaaguuga

SEQ ID NO: 1184849 - RNA, 19 nt, Homo sapiens
gauuaugccuacguuguuu

SEQ ID NO: 1184850 - RNA, 19 nt, Homo sapiens
agcaaaggcuuccaaggua

SEQ ID NO: 1184851 - RNA, 19 nt, Homo sapiens
gagggaccuuaaugaagua

SEQ ID NO: 1184852 - RNA, 19 nt, Homo sapiens
gaagugaaaguugauauca

SEQ ID NO: 1184853 - RNA, 19 nt, Homo sapiens
ugacguagauuccgaugca

SEQ ID NO: 1184854 - RNA, 19 nt, Homo sapiens
gaccugagccuucaugcaa

SEQ ID NO: 1184855 - RNA, 19 nt, Homo sapiens
uaucaccaauagcaaagua

SEQ ID NO: 1184856 - RNA, 19 nt, Homo sapiens
ggccaaagaugaaguacag

SEQ ID NO: 1184857 - RNA, 19 nt, Homo sapiens
gcagucaguuuccuucagu

SEQ ID NO: 1184858 - RNA, 19 nt, Homo sapiens
ugacuuagcaacugcguuu

SEQ ID NO: 1184859 - RNA, 19 nt, Homo sapiens
caacagcaccaacaaaucu

SEQ ID NO: 1184860 - RNA, 19 nt, Homo sapiens
cgaguagggucgcaagaug

SEQ ID NO: 1184861 - RNA, 19 nt, Homo sapiens
caauggaaaugaaacucuu

SEQ ID NO: 1184862 - RNA, 19 nt, Homo sapiens
cagguggaauugguucuua

SEQ ID NO: 1184863 - RNA, 19 nt, Homo sapiens
caaagcacccaaaccacua

SEQ ID NO: 1184864 - RNA, 19 nt, Homo sapiens
guugauaucagcuuuaaug

SEQ ID NO: 1184865 - RNA, 19 nt, Homo sapiens
cagaauggaucaugaagac

SEQ ID NO: 1184866 - RNA, 19 nt, Homo sapiens
ggugaaaguuuuagacaaa

SEQ ID NO: 1184867 - RNA, 19 nt, Homo sapiens
guccagcucuagugacgua

SEQ ID NO: 1184868 - RNA, 19 nt, Homo sapiens
caaagaugaaguacagaaa

SEQ ID NO: 1184869 - RNA, 19 nt, Homo sapiens
aaaggauggugguucauau

SEQ ID NO: 1184870 - RNA, 19 nt, Homo sapiens
uaaaggauggugguucaua

SEQ ID NO: 1184871 - RNA, 19 nt, Homo sapiens
agagggaccuuaaugaagu

SEQ ID NO: 1184872 - RNA, 19 nt, Homo sapiens
aaaguacuaucccaacaau

SEQ ID NO: 1184873 - RNA, 19 nt, Homo sapiens
gaaguugccacauauagag

SEQ ID NO: 1184874 - RNA, 19 nt, Homo sapiens
gaugaaguugccacauaua

SEQ ID NO: 1184875 - RNA, 19 nt, Homo sapiens
uagaguaacagaugaaguu

SEQ ID NO: 1184876 - RNA, 19 nt, Homo sapiens
ugaaacagaaagcauacua

SEQ ID NO: 1184877 - RNA, 19 nt, Homo sapiens
cuaugguguucucuuaaua

SEQ ID NO: 1184878 - RNA, 19 nt, Homo sapiens
caaagucgcagaugaggau

SEQ ID NO: 1184879 - RNA, 19 nt, Homo sapiens
aaagcaacuguaccuauua

SEQ ID NO: 1184880 - RNA, 19 nt, Homo sapiens
ugucuucucugugcaauga

SEQ ID NO: 1184881 - RNA, 19 nt, Homo sapiens
caagguacaacucaaacaa

SEQ ID NO: 1184882 - RNA, 19 nt, Homo sapiens
ggaguccucucaggcaguu

SEQ ID NO: 1184883 - RNA, 19 nt, Homo sapiens
agaugaaguugccacauau

SEQ ID NO: 1184884 - RNA, 19 nt, Homo sapiens
gaaacagaaagcauacuag

SEQ ID NO: 1184885 - RNA, 19 nt, Homo sapiens
caaaguacuaucccaacaa

SEQ ID NO: 1184886 - RNA, 19 nt, Homo sapiens
cgaagauccuuuacaacca

SEQ ID NO: 1184887 - RNA, 19 nt, Homo sapiens
ccaaagaugaaguacagaa

SEQ ID NO: 1184888 - RNA, 19 nt, Homo sapiens
ggauggugguucauaugug

SEQ ID NO: 1184889 - RNA, 19 nt, Homo sapiens
ucaggagccucacacuguu

SEQ ID NO: 1184890 - RNA, 19 nt, Homo sapiens
aagcaacuguaccuauuau

SEQ ID NO: 1184891 - RNA, 19 nt, Homo sapiens
gaagacugacaacugcaaa

SEQ ID NO: 1184892 - RNA, 19 nt, Homo sapiens
ccacagaauggaucaugaa

SEQ ID NO: 1184893 - RNA, 19 nt, Homo sapiens
gccacagaauggaucauga

SEQ ID NO: 1184894 - RNA, 19 nt, Homo sapiens
cagcaaaggcuuccaaggu

SEQ ID NO: 1184895 - RNA, 19 nt, Homo sapiens
gguggaauugguucuuaua

SEQ ID NO: 1184896 - RNA, 19 nt, Homo sapiens
gagccuucaugcaauggaa

SEQ ID NO: 1184897 - RNA, 19 nt, Homo sapiens
aagcauacuagguagaaua

SEQ ID NO: 1184898 - RNA, 19 nt, Homo sapiens
aagcaggccuuugauuaug

SEQ ID NO: 1184899 - RNA, 19 nt, Homo sapiens
cagcuuuaauguacagaau

SEQ ID NO: 1184900 - RNA, 19 nt, Homo sapiens
gguggacugucuucucugu

SEQ ID NO: 1184901 - RNA, 19 nt, Homo sapiens
ccucuggacucuggaagaa

SEQ ID NO: 1184902 - RNA, 19 nt, Homo sapiens
uacaggccaucaaugcuuu

SEQ ID NO: 1184903 - RNA, 19 nt, Homo sapiens
gcgguggacugucuucucu

SEQ ID NO: 1184904 - RNA, 19 nt, Homo sapiens
gaggauucggugaaaguuu

SEQ ID NO: 1184905 - RNA, 19 nt, Homo sapiens
gcuuuaauguacagaaugg

SEQ ID NO: 1184906 - RNA, 19 nt, Homo sapiens
ugacaaacaaacaacauca

SEQ ID NO: 1184907 - RNA, 19 nt, Homo sapiens
gcaauggaaaugaaacucu

SEQ ID NO: 1184908 - RNA, 19 nt, Homo sapiens
aguacuaucccaacaauga

SEQ ID NO: 1184909 - RNA, 19 nt, Homo sapiens
caauacaaacuaugguguu

SEQ ID NO: 1184910 - RNA, 19 nt, Homo sapiens
ucaguuuccuucaguuaca

SEQ ID NO: 1184911 - RNA, 19 nt, Homo sapiens
guucagacguugacuuagc

SEQ ID NO: 1184912 - RNA, 19 nt, Homo sapiens
ucccaacaaugaaacagaa

SEQ ID NO: 1184913 - RNA, 19 nt, Homo sapiens
guacuaucccaacaaugaa

SEQ ID NO: 1184914 - RNA, 19 nt, Homo sapiens
accaagaaauauccuguau

SEQ ID NO: 1184915 - RNA, 19 nt, Homo sapiens
gcugaccucaucaaagauu

SEQ ID NO: 1184916 - RNA, 19 nt, Homo sapiens
guuccuugaugacaaacaa

SEQ ID NO: 1184917 - RNA, 19 nt, Homo sapiens
gaauuuaacccgucucuua

SEQ ID NO: 1184918 - RNA, 19 nt, Homo sapiens
gaucagaagccaucaguua

SEQ ID NO: 1184919 - RNA, 19 nt, Homo sapiens
caaugaagcuuuaguacaa

SEQ ID NO: 1184920 - RNA, 19 nt, Homo sapiens
gaaacuaacuugaauaagc

SEQ ID NO: 1184921 - RNA, 19 nt, Homo sapiens
gaaagaagcauuagucaca

SEQ ID NO: 1184922 - RNA, 19 nt, Homo sapiens
aaaggacucuguuauauga

SEQ ID NO: 1184923 - RNA, 19 nt, Homo sapiens
cuagagaaguugcuaauga

SEQ ID NO: 1184924 - RNA, 19 nt, Homo sapiens
ucagcaaugucaagaaaua

SEQ ID NO: 1184925 - RNA, 19 nt, Homo sapiens
gaagaaaggacucuguuau

SEQ ID NO: 1184926 - RNA, 19 nt, Homo sapiens
uaaguuugcugccuggaua

SEQ ID NO: 1184927 - RNA, 19 nt, Homo sapiens
ggaaccacaucuacuuuga

SEQ ID NO: 1184928 - RNA, 19 nt, Homo sapiens
ggcuugagauccuaaauaa

SEQ ID NO: 1184929 - RNA, 19 nt, Homo sapiens
gaacuuaaucgaucugaga

SEQ ID NO: 1184930 - RNA, 19 nt, Homo sapiens
uaaccaagaccaacaaauu

SEQ ID NO: 1184931 - RNA, 19 nt, Homo sapiens
uauccuagcucuacuucua

SEQ ID NO: 1184932 - RNA, 19 nt, Homo sapiens
gggagaagguggaauguag

SEQ ID NO: 1184933 - RNA, 19 nt, Homo sapiens
gaaaggacucuguuauaug

SEQ ID NO: 1184934 - RNA, 19 nt, Homo sapiens
agaaaggacucuguuauau

SEQ ID NO: 1184935 - RNA, 19 nt, Homo sapiens
uaaaaguggugaucuguua

SEQ ID NO: 1184936 - RNA, 19 nt, Homo sapiens
gagaguuuaugucaugaaa

SEQ ID NO: 1184937 - RNA, 19 nt, Homo sapiens
cagaagccaucaguuauuu

SEQ ID NO: 1184938 - RNA, 19 nt, Homo sapiens
gaccagaaauacaucuuug

SEQ ID NO: 1184939 - RNA, 19 nt, Homo sapiens
gucaagaaauacucacuaa

SEQ ID NO: 1184940 - RNA, 19 nt, Homo sapiens
guagaaaguuguccugaag

SEQ ID NO: 1184941 - RNA, 19 nt, Homo sapiens
uaaucgaucugagaguuua

SEQ ID NO: 1184942 - RNA, 19 nt, Homo sapiens
gauugucuguguccaaauu

SEQ ID NO: 1184943 - RNA, 19 nt, Homo sapiens
aggagaagcugcauaucua

SEQ ID NO: 1184944 - RNA, 19 nt, Homo sapiens
ggagaaacuaacuugaaua

SEQ ID NO: 1184945 - RNA, 19 nt, Homo sapiens
ggagauggagccaaagaaa

SEQ ID NO: 1184946 - RNA, 19 nt, Homo sapiens
caacugcaggcguuuauaa

SEQ ID NO: 1184947 - RNA, 19 nt, Homo sapiens
caucuacuuugaaggauuu

SEQ ID NO: 1184948 - RNA, 19 nt, Homo sapiens
gaggagaaacuaacuugaa

SEQ ID NO: 1184949 - RNA, 19 nt, Homo sapiens
gaucugagaguuuauguca

SEQ ID NO: 1184950 - RNA, 19 nt, Homo sapiens
ucaguuauuucccuucaaa

SEQ ID NO: 1184951 - RNA, 19 nt, Homo sapiens
acaggucguuucaaagaua

SEQ ID NO: 1184952 - RNA, 19 nt, Homo sapiens
gaaagccacccuguuugua

SEQ ID NO: 1184953 - RNA, 19 nt, Homo sapiens
ccacuuacccuacaacuca

SEQ ID NO: 1184954 - RNA, 19 nt, Homo sapiens
gauacuuccuuuccaugaa

SEQ ID NO: 1184955 - RNA, 19 nt, Homo sapiens
uaacugaugugcugcucuu

SEQ ID NO: 1184956 - RNA, 19 nt, Homo sapiens
aagaaaggacucuguuaua

SEQ ID NO: 1184957 - RNA, 19 nt, Homo sapiens
uaacagaagcaaagcuaaa

SEQ ID NO: 1184958 - RNA, 19 nt, Homo sapiens
uacaagccauacagaauuu

SEQ ID NO: 1184959 - RNA, 19 nt, Homo sapiens
gaaggacaagugaaucuga

SEQ ID NO: 1184960 - RNA, 19 nt, Homo sapiens
uggcaugagucuaauuaaa

SEQ ID NO: 1184961 - RNA, 19 nt, Homo sapiens
gaagguggaauguagaaau

SEQ ID NO: 1184962 - RNA, 19 nt, Homo sapiens
gagaaaccaggagauauuu

SEQ ID NO: 1184963 - RNA, 19 nt, Homo sapiens
ugagaaaccaggagauauu

SEQ ID NO: 1184964 - RNA, 19 nt, Homo sapiens
guccugagauguaugaaau

SEQ ID NO: 1184965 - RNA, 19 nt, Homo sapiens
gagagaggaauguuucuga

SEQ ID NO: 1184966 - RNA, 19 nt, Homo sapiens
gcuuauugcuagagaaguu

SEQ ID NO: 1184967 - RNA, 19 nt, Homo sapiens
gccaucagauacuuccuuu

SEQ ID NO: 1184968 - RNA, 19 nt, Homo sapiens
ggacaagugaaucugauga

SEQ ID NO: 1184969 - RNA, 19 nt, Homo sapiens
agaaaguuguccugaagaa

SEQ ID NO: 1184970 - RNA, 19 nt, Homo sapiens
ugaagaaaggacucuguua

SEQ ID NO: 1184971 - RNA, 19 nt, Homo sapiens
caugaaagcagcaaggauu

SEQ ID NO: 1184972 - RNA, 19 nt, Homo sapiens
caacucaaucucauucuga

SEQ ID NO: 1184973 - RNA, 19 nt, Homo sapiens
agaggaauguuucugauca

SEQ ID NO: 1184974 - RNA, 19 nt, Homo sapiens
ccacaucuacuuugaagga

SEQ ID NO: 1184975 - RNA, 19 nt, Homo sapiens
caucaaugaagcuuuagua

SEQ ID NO: 1184976 - RNA, 19 nt, Homo sapiens
caaggacaaugaccagaca

SEQ ID NO: 1184977 - RNA, 19 nt, Homo sapiens
gaagcaaagcuaaaucuac

SEQ ID NO: 1184978 - RNA, 19 nt, Homo sapiens
uauaugauggccuuguuua

SEQ ID NO: 1184979 - RNA, 19 nt, Homo sapiens
gcaccuggagcaccaacua

SEQ ID NO: 1184980 - RNA, 19 nt, Homo sapiens
caaugaagcaauuuggauu

SEQ ID NO: 1184981 - RNA, 19 nt, Homo sapiens
aagccacccuguuuguaua

SEQ ID NO: 1184982 - RNA, 19 nt, Homo sapiens
cuacaggucguuucaaaga

SEQ ID NO: 1184983 - RNA, 19 nt, Homo sapiens
gaaccacaucuacuuugaa

SEQ ID NO: 1184984 - RNA, 19 nt, Homo sapiens
ucugagaguuuaugucaug

SEQ ID NO: 1184985 - RNA, 19 nt, Homo sapiens
uaucuaugcugaacuugga

SEQ ID NO: 1184986 - RNA, 19 nt, Homo sapiens
gaaaguuguccugaagaaa

SEQ ID NO: 1184987 - RNA, 19 nt, Homo sapiens
gcccacuccucauuaaguu

SEQ ID NO: 1184988 - RNA, 19 nt, Homo sapiens
aagguggaauguagaaauu

SEQ ID NO: 1184989 - RNA, 19 nt, Homo sapiens
gaggagaagcugcauaucu

SEQ ID NO: 1184990 - RNA, 19 nt, Homo sapiens
gaggagagaggaauguuuc

SEQ ID NO: 1184991 - RNA, 19 nt, Homo sapiens
ggcaugagucuaauuaaau

SEQ ID NO: 1184992 - RNA, 19 nt, Homo sapiens
cuugagauccuaaauaaga

SEQ ID NO: 1184993 - RNA, 19 nt, Homo sapiens
caagugaaucugaugaaga

SEQ ID NO: 1184994 - RNA, 19 nt, Homo sapiens
ggacaaugaccagacaaga

SEQ ID NO: 1184995 - RNA, 19 nt, Homo sapiens
augaggagcuggccaaugu

SEQ ID NO: 1184996 - RNA, 19 nt, Homo sapiens
gugcguauuuggaggagaa

SEQ ID NO: 1184997 - RNA, 19 nt, Homo sapiens
guuauaugauggccuuguu

SEQ ID NO: 1184998 - RNA, 19 nt, Homo sapiens
caacuaccacucccuggaa

SEQ ID NO: 1184999 - RNA, 19 nt, Homo sapiens
gugauugucuguguccaaa

SEQ ID NO: 1185000 - RNA, 19 nt, Homo sapiens
gcuccaguaugacaaagug

SEQ ID NO: 1185001 - RNA, 19 nt, Homo sapiens
ggugaggacuagugaacau

SEQ ID NO: 1185002 - RNA, 19 nt, Homo sapiens
uugcaacaguggauuuaaa

SEQ ID NO: 1185003 - RNA, 19 nt, Homo sapiens
gaaaacucauucuucauca

SEQ ID NO: 1185004 - RNA, 19 nt, Homo sapiens
gaacgcaauaacuggauga

SEQ ID NO: 1185005 - RNA, 19 nt, Homo sapiens
ccaaggaggaacgcaauaa

SEQ ID NO: 1185006 - RNA, 19 nt, Homo sapiens
aaacauacacgaagcucaa

SEQ ID NO: 1185007 - RNA, 19 nt, Homo sapiens
ucagaagccaucaguuauu

SEQ ID NO: 1185008 - RNA, 19 nt, Homo sapiens
gaaagcagcaaggauucuu

SEQ ID NO: 1185009 - RNA, 19 nt, Homo sapiens
uagcucuacuucuaacuga

SEQ ID NO: 1185010 - RNA, 19 nt, Homo sapiens
gagaagguggaauguagaa

SEQ ID NO: 1185011 - RNA, 19 nt, Homo sapiens
aggagaaacuaacuugaau

SEQ ID NO: 1185012 - RNA, 19 nt, Homo sapiens
uauaacagaagcaaagcua

SEQ ID NO: 1185013 - RNA, 19 nt, Homo sapiens
caacaaacugaauccauca

SEQ ID NO: 1185014 - RNA, 19 nt, Homo sapiens
gauugcaacaguggauuua

SEQ ID NO: 1185015 - RNA, 19 nt, Homo sapiens
ggagaagcugcauaucuau

SEQ ID NO: 1185016 - RNA, 19 nt, Homo sapiens
aaccaagaccaacaaauuu

SEQ ID NO: 1185017 - RNA, 19 nt, Homo sapiens
gaagaugccuuacgucuga

SEQ ID NO: 1185018 - RNA, 19 nt, Homo sapiens
caacaaagauuccauacag

SEQ ID NO: 1185019 - RNA, 19 nt, Homo sapiens
ucacauggcucccaggaaa

SEQ ID NO: 1185020 - RNA, 19 nt, Homo sapiens
ucacaaaggugguggaugu

SEQ ID NO: 1185021 - RNA, 19 nt, Homo sapiens
ggaaagugcugugcccuau

SEQ ID NO: 1185022 - RNA, 19 nt, Homo sapiens
aagaacgacuucaagagua

SEQ ID NO: 1185023 - RNA, 19 nt, Homo sapiens
ggacuggaaugugacuuga

SEQ ID NO: 1185024 - RNA, 19 nt, Homo sapiens
ccacugauaccaucugauu

SEQ ID NO: 1185025 - RNA, 19 nt, Homo sapiens
ccaccucucugaagcuuga

SEQ ID NO: 1185026 - RNA, 19 nt, Homo sapiens
aaagugagauccuggaagu

SEQ ID NO: 1185027 - RNA, 19 nt, Homo sapiens
caaggaaggagccaagaaa

SEQ ID NO: 1185028 - RNA, 19 nt, Homo sapiens
ccaguugggugccaggaaa

SEQ ID NO: 1185029 - RNA, 19 nt, Homo sapiens
ucaauacaguggcccaaga

SEQ ID NO: 1185030 - RNA, 19 nt, Homo sapiens
gaagaucuggcgucacaug

SEQ ID NO: 1185031 - RNA, 19 nt, Homo sapiens
ggaauauucuuuucucuuc

SEQ ID NO: 1185032 - RNA, 19 nt, Homo sapiens
acauuucgccugagauaua

SEQ ID NO: 1185033 - RNA, 19 nt, Homo sapiens
agaaguugcuguucaugga

SEQ ID NO: 1185034 - RNA, 19 nt, Homo sapiens
cuagguggauucugauuca

SEQ ID NO: 1185035 - RNA, 19 nt, Homo sapiens
caagagcuacugcagagaa

SEQ ID NO: 1185036 - RNA, 19 nt, Homo sapiens
ugucggagguguucaauac

SEQ ID NO: 1185037 - RNA, 19 nt, Homo sapiens
cauggaaacuucggccaaa

SEQ ID NO: 1185038 - RNA, 19 nt, Homo sapiens
gaaguggcuccguggguaa

SEQ ID NO: 1185039 - RNA, 19 nt, Homo sapiens
agacauuucgccugagaua

SEQ ID NO: 1185040 - RNA, 19 nt, Homo sapiens
cugaguuucuguccaauga

SEQ ID NO: 1185041 - RNA, 19 nt, Homo sapiens
gaggaaggaaggauuggaa

SEQ ID NO: 1185042 - RNA, 19 nt, Homo sapiens
aggaagaucuggcgucaca

SEQ ID NO: 1185043 - RNA, 19 nt, Homo sapiens
acgcugcgcuucuggugua

SEQ ID NO: 1185044 - RNA, 19 nt, Homo sapiens
agaacgacuucaagaguau

SEQ ID NO: 1185045 - RNA, 19 nt, Homo sapiens
ggauucugauucacuguca

SEQ ID NO: 1185046 - RNA, 19 nt, Homo sapiens
gaaaugcaggacuggaaug

SEQ ID NO: 1185047 - RNA, 19 nt, Homo sapiens
ggaaaugcaggacuggaau

SEQ ID NO: 1185048 - RNA, 19 nt, Homo sapiens
cauuucgccugagauauaa

SEQ ID NO: 1185049 - RNA, 19 nt, Homo sapiens
ugagacauuucgccugaga

SEQ ID NO: 1185050 - RNA, 19 nt, Homo sapiens
augcaggacuggaauguga

SEQ ID NO: 1185051 - RNA, 19 nt, Homo sapiens
aagcugaguuucuguccaa

SEQ ID NO: 1185052 - RNA, 19 nt, Homo sapiens
cagcuggccaggagaagua

SEQ ID NO: 1185053 - RNA, 19 nt, Homo sapiens
gagaaagcggagacaggua

SEQ ID NO: 1185054 - RNA, 19 nt, Homo sapiens
gcaacaaagauuccauaca

SEQ ID NO: 1185055 - RNA, 19 nt, Homo sapiens
gaaaagcgggcuccaguug

SEQ ID NO: 1185056 - RNA, 19 nt, Homo sapiens
gugcaacaaagauuccaua

SEQ ID NO: 1185057 - RNA, 19 nt, Homo sapiens
gaaguugcuguucauggaa

SEQ ID NO: 1185058 - RNA, 19 nt, Homo sapiens
gagaaguccuggugaugcu

SEQ ID NO: 1185059 - RNA, 19 nt, Homo sapiens
aaacuucggccaaacugaa

SEQ ID NO: 1185060 - RNA, 19 nt, Homo sapiens
gaaacuucggccaaacuga

SEQ ID NO: 1185061 - RNA, 19 nt, Homo sapiens
caaaugcugcgcccacuag

SEQ ID NO: 1185062 - RNA, 19 nt, Homo sapiens
gccagaaguugcuguucau

SEQ ID NO: 1185063 - RNA, 19 nt, Homo sapiens
acagugggaggaauuaauu

SEQ ID NO: 1185064 - RNA, 19 nt, Homo sapiens
gugagauccuggaagugaa

SEQ ID NO: 1185065 - RNA, 19 nt, Homo sapiens
gacaucaccaggaaggauu

SEQ ID NO: 1185066 - RNA, 19 nt, Homo sapiens
ugagauauaaguuguacug

SEQ ID NO: 1185067 - RNA, 19 nt, Homo sapiens
gugggaagaugccuuacgu

SEQ ID NO: 1185068 - RNA, 19 nt, Homo sapiens
ccaaggaaggagccaagaa

SEQ ID NO: 1185069 - RNA, 19 nt, Homo sapiens
cagcgacggugggaagaug

SEQ ID NO: 1185070 - RNA, 19 nt, Homo sapiens
ggccagcucuagguggauu

SEQ ID NO: 1185071 - RNA, 19 nt, Homo sapiens
uguacgacaucaccaggaa

SEQ ID NO: 1185072 - RNA, 19 nt, Homo sapiens
uauaaguuguacugcguau

SEQ ID NO: 1185073 - RNA, 19 nt, Homo sapiens
uacaguggcccaagagcua

SEQ ID NO: 1185074 - RNA, 19 nt, Homo sapiens
ggaaacuucggccaaacug

SEQ ID NO: 1185075 - RNA, 19 nt, Homo sapiens
ggagaagaggccugaccuu

SEQ ID NO: 1185076 - RNA, 19 nt, Homo sapiens
cgccugagauauaaguugu

SEQ ID NO: 1185077 - RNA, 19 nt, Homo sapiens
gacagugggaggaauuaau

SEQ ID NO: 1185078 - RNA, 19 nt, Homo sapiens
caucugaccggaauauucu

SEQ ID NO: 1185079 - RNA, 19 nt, Homo sapiens
gcugacagugggaggaauu

SEQ ID NO: 1185080 - RNA, 19 nt, Homo sapiens
ggcccaggauuuccacauc

SEQ ID NO: 1185081 - RNA, 19 nt, Homo sapiens
guccgaggcugcugcucuu

SEQ ID NO: 1185082 - RNA, 19 nt, Homo sapiens
gcccaggauuuccacaucu

SEQ ID NO: 1185083 - RNA, 19 nt, Homo sapiens
cagagaggaaggaaggauu

SEQ ID NO: 1185084 - RNA, 19 nt, Homo sapiens
ucaagugcaacaaagauuc

SEQ ID NO: 1185085 - RNA, 19 nt, Homo sapiens
gaaagugcugugcccuauc

SEQ ID NO: 1185086 - RNA, 19 nt, Homo sapiens
ccaaaugcugcgcccacua

SEQ ID NO: 1185087 - RNA, 19 nt, Homo sapiens
aacauucugugccaaagug

SEQ ID NO: 1185088 - RNA, 19 nt, Homo sapiens
ccaggaagggaaggaguuu

SEQ ID NO: 1185089 - RNA, 19 nt, Homo sapiens
ggagcugcacccaggagaa

SEQ ID NO: 1185090 - RNA, 19 nt, Homo sapiens
gcuguggacuggugaugac

SEQ ID NO: 1185091 - RNA, 19 nt, Homo sapiens
gugaccacaugaccacugu

SEQ ID NO: 1185092 - RNA, 19 nt, Homo sapiens
gggaacugccagaggaaga

SEQ ID NO: 1185093 - RNA, 19 nt, Homo sapiens
ccaaagugagauccuggaa

SEQ ID NO: 1185094 - RNA, 19 nt, Homo sapiens
agccagaaguugcuguuca

SEQ ID NO: 1185095 - RNA, 19 nt, Homo sapiens
ggugaugacaggcucuuca

SEQ ID NO: 1185096 - RNA, 19 nt, Homo sapiens
ugccuuacgucugaucuug

SEQ ID NO: 1185097 - RNA, 19 nt, Homo sapiens
ggaaggaaggauuggaaaa

SEQ ID NO: 1185098 - RNA, 19 nt, Homo sapiens
ugccucaggugaccacaug

SEQ ID NO: 1185099 - RNA, 19 nt, Homo sapiens
uaaguuguacugcguaugc

SEQ ID NO: 1185100 - RNA, 19 nt, Homo sapiens
cuucugggcuguugguuuu

SEQ ID NO: 1185101 - RNA, 19 nt, Homo sapiens
agagaggaaggaaggauug

SEQ ID NO: 1185102 - RNA, 19 nt, Homo sapiens
ggaacugccagaggaagau

SEQ ID NO: 1185103 - RNA, 19 nt, Homo sapiens
ugagauccuggaagugaaa

SEQ ID NO: 1185104 - RNA, 19 nt, Homo sapiens
ggaccagagagaggagaaa

SEQ ID NO: 1185105 - RNA, 19 nt, Homo sapiens
ucaucugaccggaauauuc

SEQ ID NO: 1185106 - RNA, 19 nt, Homo sapiens
aaguugcuguucauggaaa

SEQ ID NO: 1185107 - RNA, 19 nt, Homo sapiens
ggugggcugugcguucuuc

SEQ ID NO: 1185108 - RNA, 19 nt, Homo sapiens
gcucuucagcucccugcaa

SEQ ID NO: 1185109 - RNA, 19 nt, Homo sapiens
ccacaucuuggugaaguug

SEQ ID NO: 1185110 - RNA, 19 nt, Homo sapiens
cccaggauuuccacaucuu

SEQ ID NO: 1185111 - RNA, 19 nt, Homo sapiens
ccuuacgucugaucuugau

SEQ ID NO: 1185112 - RNA, 19 nt, Homo sapiens
aaagugcugugcccuaucc

SEQ ID NO: 1185113 - RNA, 19 nt, Homo sapiens
cagcuguggcucugaacaa

SEQ ID NO: 1185114 - RNA, 19 nt, Homo sapiens
agugagauccuggaaguga

SEQ ID NO: 1185115 - RNA, 19 nt, Homo sapiens
uguggacuuugcccugaaa

SEQ ID NO: 1185116 - RNA, 19 nt, Homo sapiens
ccugagauauaaguuguac

SEQ ID NO: 1185117 - RNA, 19 nt, Homo sapiens
gaacacagaccucuuucuu

SEQ ID NO: 1185118 - RNA, 19 nt, Homo sapiens
augaagagcuguccacaua

SEQ ID NO: 1185119 - RNA, 19 nt, Homo sapiens
gucauaaccuucuaacuug

SEQ ID NO: 1185120 - RNA, 19 nt, Homo sapiens
gggaagguauccuccauga

SEQ ID NO: 1185121 - RNA, 19 nt, Homo sapiens
acacagaccucuuucuugu

SEQ ID NO: 1185122 - RNA, 19 nt, Homo sapiens
cagaagacaucaccaagug

SEQ ID NO: 1185123 - RNA, 19 nt, Homo sapiens
ggaguacugugacuucaug

SEQ ID NO: 1185124 - RNA, 19 nt, Homo sapiens
gaagguauccuccaugaag

SEQ ID NO: 1185125 - RNA, 19 nt, Homo sapiens
gagagucgguggccaagau

SEQ ID NO: 1185126 - RNA, 19 nt, Homo sapiens
cggaaacgcugccagauca

SEQ ID NO: 1185127 - RNA, 19 nt, Homo sapiens
caccucauguggccaauaa

SEQ ID NO: 1185128 - RNA, 19 nt, Homo sapiens
uauacuacuuccugucaua

SEQ ID NO: 1185129 - RNA, 19 nt, Homo sapiens
ccacauacccggaugaagu

SEQ ID NO: 1185130 - RNA, 19 nt, Homo sapiens
cgaggugccugaccaguuc

SEQ ID NO: 1185131 - RNA, 19 nt, Homo sapiens
gaggaggacacaacugauu

SEQ ID NO: 1185132 - RNA, 19 nt, Homo sapiens
ugucauaaccuucuaacuu

SEQ ID NO: 1185133 - RNA, 19 nt, Homo sapiens
guucaucaguggccucuuc

SEQ ID NO: 1185134 - RNA, 19 nt, Homo sapiens
ccgcagcgcugaugaaagg

SEQ ID NO: 1185135 - RNA, 19 nt, Homo sapiens
uagcugccauuaacuugaa

SEQ ID NO: 1185136 - RNA, 19 nt, Homo sapiens
caucagcuuuggcaaguuc

SEQ ID NO: 1185137 - RNA, 19 nt, Homo sapiens
ccuucuaacuuguuucuug

SEQ ID NO: 1185138 - RNA, 19 nt, Homo sapiens
ugugugggcuccugccuuu

SEQ ID NO: 1185139 - RNA, 19 nt, Homo sapiens
gaagagcuguccacauacc

SEQ ID NO: 1185140 - RNA, 19 nt, Homo sapiens
caacugauuuccccgauga

SEQ ID NO: 1185141 - RNA, 19 nt, Homo sapiens
ugacaacuuugcccacauc

SEQ ID NO: 1185142 - RNA, 19 nt, Homo sapiens
cugcauggaugaugugugu

SEQ ID NO: 1185143 - RNA, 19 nt, Homo sapiens
gcuggacacauccuucuuu

SEQ ID NO: 1185144 - RNA, 19 nt, Homo sapiens
cguuagggauggcaccuuu

SEQ ID NO: 1185145 - RNA, 19 nt, Homo sapiens
gccguggauugacaacuuu

SEQ ID NO: 1185146 - RNA, 19 nt, Homo sapiens
cuucuaacuuguuucuuga

SEQ ID NO: 1185147 - RNA, 19 nt, Homo sapiens
augaaaggccgcuccguua

SEQ ID NO: 1185148 - RNA, 19 nt, Homo sapiens
gcaggugcacagcuucauu

SEQ ID NO: 1185149 - RNA, 19 nt, Homo sapiens
gcaugcagaagaucauaga

SEQ ID NO: 1185150 - RNA, 19 nt, Homo sapiens
gcauagccaucaucuaccu

SEQ ID NO: 1185151 - RNA, 19 nt, Homo sapiens
gaccacaggcccuucuuca

SEQ ID NO: 1185152 - RNA, 19 nt, Homo sapiens
ggaggacacaacugauuuc

SEQ ID NO: 1185153 - RNA, 19 nt, Homo sapiens
gcacggcgucgaagcuuca

SEQ ID NO: 1185154 - RNA, 19 nt, Homo sapiens
ggcuaaagcuggacauucc

SEQ ID NO: 1185155 - RNA, 19 nt, Homo sapiens
ccugaacacagaccucuuu

SEQ ID NO: 1185156 - RNA, 19 nt, Homo sapiens
guggugcucuuccucuuca

SEQ ID NO: 1185157 - RNA, 19 nt, Homo sapiens
ccgcauagccaucaucuac

SEQ ID NO: 1185158 - RNA, 19 nt, Homo sapiens
gaaaggccgcuccguuagg

SEQ ID NO: 1185159 - RNA, 19 nt, Homo sapiens
cagcugggcaugcagaaga

SEQ ID NO: 1185160 - RNA, 19 nt, Homo sapiens
gggcauuuauuauacuacu

SEQ ID NO: 1185161 - RNA, 19 nt, Homo sapiens
gcucuuccucuucaccuuu

SEQ ID NO: 1185162 - RNA, 19 nt, Homo sapiens
ucuacgagaacgucaagua

SEQ ID NO: 1185163 - RNA, 19 nt, Homo sapiens
agacagcccacaucucuuc

SEQ ID NO: 1185164 - RNA, 19 nt, Homo sapiens
ggaagguauccuccaugaa

SEQ ID NO: 1185165 - RNA, 19 nt, Homo sapiens
ccucaugaguggccagaag

SEQ ID NO: 1185166 - RNA, 19 nt, Homo sapiens
caucggaggcagcgcuaaa

SEQ ID NO: 1185167 - RNA, 19 nt, Homo sapiens
ucauaaccuucuaacuugu

SEQ ID NO: 1185168 - RNA, 19 nt, Homo sapiens
acugacaaguucugugaga

SEQ ID NO: 1185169 - RNA, 19 nt, Homo sapiens
ugccguggauugacaacuu

SEQ ID NO: 1185170 - RNA, 19 nt, Homo sapiens
ccagaagacaucaccaagu

SEQ ID NO: 1185171 - RNA, 19 nt, Homo sapiens
ugacagcacccagaaaugg

SEQ ID NO: 1185172 - RNA, 19 nt, Homo sapiens
uacaucagcuuuggcaagu

SEQ ID NO: 1185173 - RNA, 19 nt, Homo sapiens
cauccuggccugccucuuc

SEQ ID NO: 1185174 - RNA, 19 nt, Homo sapiens
gaggcuggcggaagcagaa

SEQ ID NO: 1185175 - RNA, 19 nt, Homo sapiens
aagguauccuccaugaaga

SEQ ID NO: 1185176 - RNA, 19 nt, Homo sapiens
gcucugccaggaaccauga

SEQ ID NO: 1185177 - RNA, 19 nt, Homo sapiens
ccgggcauuuauuauacua

SEQ ID NO: 1185178 - RNA, 19 nt, Homo sapiens
gggcaugcagaagaucaua

SEQ ID NO: 1185179 - RNA, 19 nt, Homo sapiens
gaucccagggugugugaug

SEQ ID NO: 1185180 - RNA, 19 nt, Homo sapiens
cuggacacauccuucuuug

SEQ ID NO: 1185181 - RNA, 19 nt, Homo sapiens
uggaggaggacacaacuga

SEQ ID NO: 1185182 - RNA, 19 nt, Homo sapiens
gaaacgcugccagaucauc

SEQ ID NO: 1185183 - RNA, 19 nt, Homo sapiens
cacauacccggaugaaguu

SEQ ID NO: 1185184 - RNA, 19 nt, Homo sapiens
gcacugcauggaugaugug

SEQ ID NO: 1185185 - RNA, 19 nt, Homo sapiens
ugaaaggccgcuccguuag

SEQ ID NO: 1185186 - RNA, 19 nt, Homo sapiens
ccucauguggccaauaaau

SEQ ID NO: 1185187 - RNA, 19 nt, Homo sapiens
cauaaccuucuaacuuguu

SEQ ID NO: 1185188 - RNA, 19 nt, Homo sapiens
ggccagaagacaucaccaa

SEQ ID NO: 1185189 - RNA, 19 nt, Homo sapiens
gcuaaaggacugggagaag

SEQ ID NO: 1185190 - RNA, 19 nt, Homo sapiens
ggaggaggacacaacugau

SEQ ID NO: 1185191 - RNA, 19 nt, Homo sapiens
ucauguggccaauaaaugg

SEQ ID NO: 1185192 - RNA, 19 nt, Homo sapiens
gagcuggacacauccuucu

SEQ ID NO: 1185193 - RNA, 19 nt, Homo sapiens
aggaggacacaacugauuu

SEQ ID NO: 1185194 - RNA, 19 nt, Homo sapiens
ccuacuggcuuaccuucgu

SEQ ID NO: 1185195 - RNA, 19 nt, Homo sapiens
ucuugugccuuguucacuu

SEQ ID NO: 1185196 - RNA, 19 nt, Homo sapiens
gagugagcaaggacaguga

SEQ ID NO: 1185197 - RNA, 19 nt, Homo sapiens
cagaaauggcagcgcaaga

SEQ ID NO: 1185198 - RNA, 19 nt, Homo sapiens
ggccacaagagacaguuug

SEQ ID NO: 1185199 - RNA, 19 nt, Homo sapiens
ccagcucccgcucagguuu

SEQ ID NO: 1185200 - RNA, 19 nt, Homo sapiens
gaguaugccagccgagaca

SEQ ID NO: 1185201 - RNA, 19 nt, Homo sapiens
ggccgcagcgcugaugaaa

SEQ ID NO: 1185202 - RNA, 19 nt, Homo sapiens
gaguaagccuuccaaauua

SEQ ID NO: 1185203 - RNA, 19 nt, Homo sapiens
gcaccaaguucaaaucuuu

SEQ ID NO: 1185204 - RNA, 19 nt, Homo sapiens
cagcagaacuggacuaauu

SEQ ID NO: 1185205 - RNA, 19 nt, Homo sapiens
caagguaccucuuuaauuc

SEQ ID NO: 1185206 - RNA, 19 nt, Homo sapiens
gagaaacccuaucaaugua

SEQ ID NO: 1185207 - RNA, 19 nt, Homo sapiens
ugacacagcucagauauga

SEQ ID NO: 1185208 - RNA, 19 nt, Homo sapiens
gcaaagccuucauucagaa

SEQ ID NO: 1185209 - RNA, 19 nt, Homo sapiens
caccaaaucuuaucuggaa

SEQ ID NO: 1185210 - RNA, 19 nt, Homo sapiens
ccauaagggugaugaguuu

SEQ ID NO: 1185211 - RNA, 19 nt, Homo sapiens
gggaaaagcuucacuaaga

SEQ ID NO: 1185212 - RNA, 19 nt, Homo sapiens
acaguuaucccuuuacuua

SEQ ID NO: 1185213 - RNA, 19 nt, Homo sapiens
ucaaguggcuuauucuguu

SEQ ID NO: 1185214 - RNA, 19 nt, Homo sapiens
cagagaaacuuguaaacga

SEQ ID NO: 1185215 - RNA, 19 nt, Homo sapiens
caacagacauacagcuuca

SEQ ID NO: 1185216 - RNA, 19 nt, Homo sapiens
gagagaaacccuaucaaug

SEQ ID NO: 1185217 - RNA, 19 nt, Homo sapiens
gagccacacuggagagaaa

SEQ ID NO: 1185218 - RNA, 19 nt, Homo sapiens
gaaccaggcuccagaccau

SEQ ID NO: 1185219 - RNA, 19 nt, Homo sapiens
agaguaagccuuccaaauu

SEQ ID NO: 1185220 - RNA, 19 nt, Homo sapiens
ggucaagccugaaugaaca

SEQ ID NO: 1185221 - RNA, 19 nt, Homo sapiens
ggaggaggcuguggcugua

SEQ ID NO: 1185222 - RNA, 19 nt, Homo sapiens
gaggaacaguacgaucuua

SEQ ID NO: 1185223 - RNA, 19 nt, Homo sapiens
caucauugcaaccuuauua

SEQ ID NO: 1185224 - RNA, 19 nt, Homo sapiens
ggcaaagccuucauucaga

SEQ ID NO: 1185225 - RNA, 19 nt, Homo sapiens
gcaggaaccaacagacaua

SEQ ID NO: 1185226 - RNA, 19 nt, Homo sapiens
cagcaugcuuagacacuua

SEQ ID NO: 1185227 - RNA, 19 nt, Homo sapiens
gggaaagccuucagucauc

SEQ ID NO: 1185228 - RNA, 19 nt, Homo sapiens
gaacaguacgaucuuaaga

SEQ ID NO: 1185229 - RNA, 19 nt, Homo sapiens
ggagagaaacccuaucaau

SEQ ID NO: 1185230 - RNA, 19 nt, Homo sapiens
gaagccauaugaaugugaa

SEQ ID NO: 1185231 - RNA, 19 nt, Homo sapiens
cagcaucauuuaaguaguu

SEQ ID NO: 1185232 - RNA, 19 nt, Homo sapiens
uuaaaggcaccaaaucuua

SEQ ID NO: 1185233 - RNA, 19 nt, Homo sapiens
ggagaagccauaugaaugu

SEQ ID NO: 1185234 - RNA, 19 nt, Homo sapiens
gaacaagauggugaaagua

SEQ ID NO: 1185235 - RNA, 19 nt, Homo sapiens
gaacauggacauucugaag

SEQ ID NO: 1185236 - RNA, 19 nt, Homo sapiens
uugcuaagaucaaaggaua

SEQ ID NO: 1185237 - RNA, 19 nt, Homo sapiens
acaagauggugaaaguaua

SEQ ID NO: 1185238 - RNA, 19 nt, Homo sapiens
gaauaagaaucguccacau

SEQ ID NO: 1185239 - RNA, 19 nt, Homo sapiens
uaaaugcugcuaugcuaua

SEQ ID NO: 1185240 - RNA, 19 nt, Homo sapiens
ucuaaaugcugcuaugcua

SEQ ID NO: 1185241 - RNA, 19 nt, Homo sapiens
ggaaugugauagauagcuu

SEQ ID NO: 1185242 - RNA, 19 nt, Homo sapiens
aaucacaguuaucccuuua

SEQ ID NO: 1185243 - RNA, 19 nt, Homo sapiens
cgagaacucugucaucagu

SEQ ID NO: 1185244 - RNA, 19 nt, Homo sapiens
gaaaagaagucugauaucu

SEQ ID NO: 1185245 - RNA, 19 nt, Homo sapiens
uugaagaucuggaacaaga

SEQ ID NO: 1185246 - RNA, 19 nt, Homo sapiens
gcaagcagcaucauuuaag

SEQ ID NO: 1185247 - RNA, 19 nt, Homo sapiens
ggaaagccuucagucauca

SEQ ID NO: 1185248 - RNA, 19 nt, Homo sapiens
ccaagaagccucccgacaa

SEQ ID NO: 1185249 - RNA, 19 nt, Homo sapiens
agagaaacccuaucaaugu

SEQ ID NO: 1185250 - RNA, 19 nt, Homo sapiens
gggagaagccauaugaaug

SEQ ID NO: 1185251 - RNA, 19 nt, Homo sapiens
agaacaagauggugaaagu

SEQ ID NO: 1185252 - RNA, 19 nt, Homo sapiens
ccaccaauuucaagaacaa

SEQ ID NO: 1185253 - RNA, 19 nt, Homo sapiens
acauacagcuucagccuau

SEQ ID NO: 1185254 - RNA, 19 nt, Homo sapiens
agaccaguaucuauguaua

SEQ ID NO: 1185255 - RNA, 19 nt, Homo sapiens
guggaugacugugauugua

SEQ ID NO: 1185256 - RNA, 19 nt, Homo sapiens
gauacacacuggagagaag

SEQ ID NO: 1185257 - RNA, 19 nt, Homo sapiens
ggccagaaauccacaccaa

SEQ ID NO: 1185258 - RNA, 19 nt, Homo sapiens
caagaagccucccgacaac

SEQ ID NO: 1185259 - RNA, 19 nt, Homo sapiens
cauaggguacauaagauua

SEQ ID NO: 1185260 - RNA, 19 nt, Homo sapiens
aaacagaggaugauaccaa

SEQ ID NO: 1185261 - RNA, 19 nt, Homo sapiens
gcagcauuauccauaguau

SEQ ID NO: 1185262 - RNA, 19 nt, Homo sapiens
cuaggaaugugauagauag

SEQ ID NO: 1185263 - RNA, 19 nt, Homo sapiens
aaagaccaguaucuaugua

SEQ ID NO: 1185264 - RNA, 19 nt, Homo sapiens
ucagugcaguaaacucuuu

SEQ ID NO: 1185265 - RNA, 19 nt, Homo sapiens
cacaggaaaucauugcuau

SEQ ID NO: 1185266 - RNA, 19 nt, Homo sapiens
ggcuuauucuguucuuaua

SEQ ID NO: 1185267 - RNA, 19 nt, Homo sapiens
ggagagaagcgcuaucagu

SEQ ID NO: 1185268 - RNA, 19 nt, Homo sapiens
ccauaugaaugcaaagugu

SEQ ID NO: 1185269 - RNA, 19 nt, Homo sapiens
ggaguuggcaucaaagcaa

SEQ ID NO: 1185270 - RNA, 19 nt, Homo sapiens
ccucauaggguacauaaga

SEQ ID NO: 1185271 - RNA, 19 nt, Homo sapiens
caagcagcaucauuuaagu

SEQ ID NO: 1185272 - RNA, 19 nt, Homo sapiens
ucacaagguaccucuuuaa

SEQ ID NO: 1185273 - RNA, 19 nt, Homo sapiens
agucaucauugcaaccuua

SEQ ID NO: 1185274 - RNA, 19 nt, Homo sapiens
gaaacccuaucaauguaag

SEQ ID NO: 1185275 - RNA, 19 nt, Homo sapiens
caacagaggaacaguacga

SEQ ID NO: 1185276 - RNA, 19 nt, Homo sapiens
guccauuucuuaugauuuc

SEQ ID NO: 1185277 - RNA, 19 nt, Homo sapiens
ggaggucaagccugaauga

SEQ ID NO: 1185278 - RNA, 19 nt, Homo sapiens
gugaaaguauaccugagaa

SEQ ID NO: 1185279 - RNA, 19 nt, Homo sapiens
aguaagccuuccaaauuaa

SEQ ID NO: 1185280 - RNA, 19 nt, Homo sapiens
cauaucaaauucucaaugc

SEQ ID NO: 1185281 - RNA, 19 nt, Homo sapiens
gcauugaaccacuugucua

SEQ ID NO: 1185282 - RNA, 19 nt, Homo sapiens
accaauaccuuccucauag

SEQ ID NO: 1185283 - RNA, 19 nt, Homo sapiens
acaagguaccucuuuaauu

SEQ ID NO: 1185284 - RNA, 19 nt, Homo sapiens
gcuaagaucaaaggauauu

SEQ ID NO: 1185285 - RNA, 19 nt, Homo sapiens
uaaaggcaccaaaucuuau

SEQ ID NO: 1185286 - RNA, 19 nt, Homo sapiens
gcaaccuuauuaggcauuu

SEQ ID NO: 1185287 - RNA, 19 nt, Homo sapiens
ccacaggaaaucauugcua

SEQ ID NO: 1185288 - RNA, 19 nt, Homo sapiens
ggauagcaaacuccaaaga

SEQ ID NO: 1185289 - RNA, 19 nt, Homo sapiens
auagcaaacuccaaagaga

SEQ ID NO: 1185290 - RNA, 19 nt, Homo sapiens
ggcuguggcuguaguugaa

SEQ ID NO: 1185291 - RNA, 19 nt, Homo sapiens
gagaagccauaugaaugug

SEQ ID NO: 1185292 - RNA, 19 nt, Homo sapiens
gaagccucccgacaacuuu

SEQ ID NO: 1185293 - RNA, 19 nt, Homo sapiens
uaccaauaccuuccucaua

SEQ ID NO: 1185294 - RNA, 19 nt, Homo sapiens
caaguggcuuauucuguuc

SEQ ID NO: 1185295 - RNA, 19 nt, Homo sapiens
uggaacaucugaaggucaa

SEQ ID NO: 1185296 - RNA, 19 nt, Homo sapiens
caaauuaaccccaggaaug

SEQ ID NO: 1185297 - RNA, 19 nt, Homo sapiens
aaaucacaguuaucccuuu

SEQ ID NO: 1185298 - RNA, 19 nt, Homo sapiens
ggugaaaguauaccugaga

SEQ ID NO: 1185299 - RNA, 19 nt, Homo sapiens
gaucuggaacaagagcuua

SEQ ID NO: 1185300 - RNA, 19 nt, Homo sapiens
ccagaaauccacaccaaag

SEQ ID NO: 1185301 - RNA, 19 nt, Homo sapiens
acacuuauugccaggguua

SEQ ID NO: 1185302 - RNA, 19 nt, Homo sapiens
gaagaugacuuacaguuaa

SEQ ID NO: 1185303 - RNA, 19 nt, Homo sapiens
gaagaaagcagaagagaaa

SEQ ID NO: 1185304 - RNA, 19 nt, Homo sapiens
caaguuugcucaccuuaua

SEQ ID NO: 1185305 - RNA, 19 nt, Homo sapiens
agaaggaacugauucauuu

SEQ ID NO: 1185306 - RNA, 19 nt, Homo sapiens
gaccuaagcuaucaagaaa

SEQ ID NO: 1185307 - RNA, 19 nt, Homo sapiens
uaacaaagaugaagaggau

SEQ ID NO: 1185308 - RNA, 19 nt, Homo sapiens
gaagugcaguugcuauauu

SEQ ID NO: 1185309 - RNA, 19 nt, Homo sapiens
gaaccaggcccaagacuuu

SEQ ID NO: 1185310 - RNA, 19 nt, Homo sapiens
ggaagaagaggaagaauga

SEQ ID NO: 1185311 - RNA, 19 nt, Homo sapiens
gggcagaaauuacgaaguu

SEQ ID NO: 1185312 - RNA, 19 nt, Homo sapiens
gaagaacauuugauugaga

SEQ ID NO: 1185313 - RNA, 19 nt, Homo sapiens
uaacagcuauucccauauu

SEQ ID NO: 1185314 - RNA, 19 nt, Homo sapiens
gacaaaggauacucaauga

SEQ ID NO: 1185315 - RNA, 19 nt, Homo sapiens
caacaaagcacucucaaga

SEQ ID NO: 1185316 - RNA, 19 nt, Homo sapiens
aaacagaucuacugcuuga

SEQ ID NO: 1185317 - RNA, 19 nt, Homo sapiens
caaugaagguguugagauu

SEQ ID NO: 1185318 - RNA, 19 nt, Homo sapiens
gcaacuaccagaauauuaa

SEQ ID NO: 1185319 - RNA, 19 nt, Homo sapiens
ggaacaagauccugaugug

SEQ ID NO: 1185320 - RNA, 19 nt, Homo sapiens
ggaagaagaggaagaagaa

SEQ ID NO: 1185321 - RNA, 19 nt, Homo sapiens
gaauuacguucuauguuga

SEQ ID NO: 1185322 - RNA, 19 nt, Homo sapiens
ugaagaggaucaagaagaa

SEQ ID NO: 1185323 - RNA, 19 nt, Homo sapiens
gagaagaagaugcauauug

SEQ ID NO: 1185324 - RNA, 19 nt, Homo sapiens
ugaaagaugcugugucuaa

SEQ ID NO: 1185325 - RNA, 19 nt, Homo sapiens
gaaggaacugauucauuua

SEQ ID NO: 1185326 - RNA, 19 nt, Homo sapiens
aaagcacucucaagaagua

SEQ ID NO: 1185327 - RNA, 19 nt, Homo sapiens
uguaacagcuauucccaua

SEQ ID NO: 1185328 - RNA, 19 nt, Homo sapiens
cuacacacaucucuacaaa

SEQ ID NO: 1185329 - RNA, 19 nt, Homo sapiens
ggacuuucuuguauauuug

SEQ ID NO: 1185330 - RNA, 19 nt, Homo sapiens
caugaacgcauuauagaua

SEQ ID NO: 1185331 - RNA, 19 nt, Homo sapiens
gugcagauguacauaaaga

SEQ ID NO: 1185332 - RNA, 19 nt, Homo sapiens
uaucaagaaugcagagaaa

SEQ ID NO: 1185333 - RNA, 19 nt, Homo sapiens
gcccaagacuuuaccauuc

SEQ ID NO: 1185334 - RNA, 19 nt, Homo sapiens
cuaagaaugucuaggaaga

SEQ ID NO: 1185335 - RNA, 19 nt, Homo sapiens
gaaagcagaagagaaacua

SEQ ID NO: 1185336 - RNA, 19 nt, Homo sapiens
gaccauagaagaacauuug

SEQ ID NO: 1185337 - RNA, 19 nt, Homo sapiens
gguauaaucccacagacua

SEQ ID NO: 1185338 - RNA, 19 nt, Homo sapiens
gagaaggaacugauucauu

SEQ ID NO: 1185339 - RNA, 19 nt, Homo sapiens
uaagaaacccauuccauug

SEQ ID NO: 1185340 - RNA, 19 nt, Homo sapiens
gaggaagaaugacccuuug

SEQ ID NO: 1185341 - RNA, 19 nt, Homo sapiens
ucaguggacuuucuuguau

SEQ ID NO: 1185342 - RNA, 19 nt, Homo sapiens
ggauuuaggacaaagagua

SEQ ID NO: 1185343 - RNA, 19 nt, Homo sapiens
caaggaaaguuugaauaug

SEQ ID NO: 1185344 - RNA, 19 nt, Homo sapiens
ggcagaagcuucagagagu

SEQ ID NO: 1185345 - RNA, 19 nt, Homo sapiens
gaaaagaaacccagaaguu

SEQ ID NO: 1185346 - RNA, 19 nt, Homo sapiens
gaacugauucauuuacuuc

SEQ ID NO: 1185347 - RNA, 19 nt, Homo sapiens
ggaacugauucauuuacuu

SEQ ID NO: 1185348 - RNA, 19 nt, Homo sapiens
ugaagaugacuuacaguua

SEQ ID NO: 1185349 - RNA, 19 nt, Homo sapiens
gcauauagcauggcagaaa

SEQ ID NO: 1185350 - RNA, 19 nt, Homo sapiens
gcagaagcuucagagagua

SEQ ID NO: 1185351 - RNA, 19 nt, Homo sapiens
aaagaaacccagaaguuaa

SEQ ID NO: 1185352 - RNA, 19 nt, Homo sapiens
aggaagagaucauugaaga

SEQ ID NO: 1185353 - RNA, 19 nt, Homo sapiens
gaaagaugcugugucuaag

SEQ ID NO: 1185354 - RNA, 19 nt, Homo sapiens
gagaagacauuuuaccauu

SEQ ID NO: 1185355 - RNA, 19 nt, Homo sapiens
gaaagcuuccuaagaaugu

SEQ ID NO: 1185356 - RNA, 19 nt, Homo sapiens
cgaagaaacggaagcauga

SEQ ID NO: 1185357 - RNA, 19 nt, Homo sapiens
ggaugaagaugacuuacag

SEQ ID NO: 1185358 - RNA, 19 nt, Homo sapiens
ucgaagaucugcuacugaa

SEQ ID NO: 1185359 - RNA, 19 nt, Homo sapiens
gugauguucugaauauuga

SEQ ID NO: 1185360 - RNA, 19 nt, Homo sapiens
guaaccuacuucagaauau

SEQ ID NO: 1185361 - RNA, 19 nt, Homo sapiens
agagggaacuugaggaaga

SEQ ID NO: 1185362 - RNA, 19 nt, Homo sapiens
ucaauacuguggauggaaa

SEQ ID NO: 1185363 - RNA, 19 nt, Homo sapiens
ggaagaaagcagaagagaa

SEQ ID NO: 1185364 - RNA, 19 nt, Homo sapiens
cgaaagcugguaauuguuu

SEQ ID NO: 1185365 - RNA, 19 nt, Homo sapiens
acaaagcacucucaagaag

SEQ ID NO: 1185366 - RNA, 19 nt, Homo sapiens
uggaacaaaugguuaaaga

SEQ ID NO: 1185367 - RNA, 19 nt, Homo sapiens
gguaauuguuucucugaug

SEQ ID NO: 1185368 - RNA, 19 nt, Homo sapiens
aagugcaguugcuauauua

SEQ ID NO: 1185369 - RNA, 19 nt, Homo sapiens
gaaacuagagcgagagcuu

SEQ ID NO: 1185370 - RNA, 19 nt, Homo sapiens
gaaguuaggccagagaugu

SEQ ID NO: 1185371 - RNA, 19 nt, Homo sapiens
guagaggaaugaagucagu

SEQ ID NO: 1185372 - RNA, 19 nt, Homo sapiens
aaggugauguucugaauau

SEQ ID NO: 1185373 - RNA, 19 nt, Homo sapiens
gaugaucuguuaguaguuc

SEQ ID NO: 1185374 - RNA, 19 nt, Homo sapiens
gauugucccucucaugaau

SEQ ID NO: 1185375 - RNA, 19 nt, Homo sapiens
caacaacaucaucguauug

SEQ ID NO: 1185376 - RNA, 19 nt, Homo sapiens
cuaagaaacccauuccauu

SEQ ID NO: 1185377 - RNA, 19 nt, Homo sapiens
uaucugaaauguguuguga

SEQ ID NO: 1185378 - RNA, 19 nt, Homo sapiens
acaaaggacuggcagaagu

SEQ ID NO: 1185379 - RNA, 19 nt, Homo sapiens
gaagcaugaacgcauuaua

SEQ ID NO: 1185380 - RNA, 19 nt, Homo sapiens
gauggaugaagaugacuua

SEQ ID NO: 1185381 - RNA, 19 nt, Homo sapiens
caaggaaguagaagugaaa

SEQ ID NO: 1185382 - RNA, 19 nt, Homo sapiens
acaacaacaucaucguauu

SEQ ID NO: 1185383 - RNA, 19 nt, Homo sapiens
agaagaagaugcauauugc

SEQ ID NO: 1185384 - RNA, 19 nt, Homo sapiens
uucaagagcugaccauaga

SEQ ID NO: 1185385 - RNA, 19 nt, Homo sapiens
gaucuagagacaaaggaua

SEQ ID NO: 1185386 - RNA, 19 nt, Homo sapiens
caaaacagaucuacugcuu

SEQ ID NO: 1185387 - RNA, 19 nt, Homo sapiens
gcagagaaaguggaagaaa

SEQ ID NO: 1185388 - RNA, 19 nt, Homo sapiens
ggcagaaauuacgaaguua

SEQ ID NO: 1185389 - RNA, 19 nt, Homo sapiens
cagagaaaguggaagaaag

SEQ ID NO: 1185390 - RNA, 19 nt, Homo sapiens
ucaaggaaguagaagugaa

SEQ ID NO: 1185391 - RNA, 19 nt, Homo sapiens
cauauuaucagauccagaa

SEQ ID NO: 1185392 - RNA, 19 nt, Homo sapiens
gaaaagcgaccagguaaaa

SEQ ID NO: 1185393 - RNA, 19 nt, Homo sapiens
agacaaaggauacucaaug

SEQ ID NO: 1185394 - RNA, 19 nt, Homo sapiens
gcagauguacauaaagaug

SEQ ID NO: 1185395 - RNA, 19 nt, Homo sapiens
cauauagcauggcagaaau

SEQ ID NO: 1185396 - RNA, 19 nt, Homo sapiens
ccuaagcuaucaagaaagu

SEQ ID NO: 1185397 - RNA, 19 nt, Homo sapiens
gacuggaucuuacugaagu

SEQ ID NO: 1185398 - RNA, 19 nt, Homo sapiens
uccaagcuuucgcaaguua

SEQ ID NO: 1185399 - RNA, 19 nt, Homo sapiens
gacauucaauccuccuguu

SEQ ID NO: 1185400 - RNA, 19 nt, Homo sapiens
uuuagcaacuaccagaaua

SEQ ID NO: 1185401 - RNA, 19 nt, Homo sapiens
gcucuugccuucaucaaac

SEQ ID NO: 1185402 - RNA, 19 nt, Homo sapiens
uaacaugacuugcgaauau

SEQ ID NO: 1185403 - RNA, 19 nt, Homo sapiens
ggcagaagcuuccuacuug

SEQ ID NO: 1185404 - RNA, 19 nt, Homo sapiens
cagagaaggucaccaugua

SEQ ID NO: 1185405 - RNA, 19 nt, Homo sapiens
ccacaagcuucgccucuuu

SEQ ID NO: 1185406 - RNA, 19 nt, Homo sapiens
acaguucccuuccugguua

SEQ ID NO: 1185407 - RNA, 19 nt, Homo sapiens
ggucacagccucuagagaa

SEQ ID NO: 1185408 - RNA, 19 nt, Homo sapiens
gggcagaagcuuccuacuu

SEQ ID NO: 1185409 - RNA, 19 nt, Homo sapiens
gguuccauguacauauuua

SEQ ID NO: 1185410 - RNA, 19 nt, Homo sapiens
aagcuugacuuucggaaug

SEQ ID NO: 1185411 - RNA, 19 nt, Homo sapiens
gcguguggcuuacaugauc

SEQ ID NO: 1185412 - RNA, 19 nt, Homo sapiens
cauggaaccugggaacaga

SEQ ID NO: 1185413 - RNA, 19 nt, Homo sapiens
gccuucaccugcuguuuga

SEQ ID NO: 1185414 - RNA, 19 nt, Homo sapiens
cgacacaggcagcuucuuc

SEQ ID NO: 1185415 - RNA, 19 nt, Homo sapiens
cagacuccaccaccucuua

SEQ ID NO: 1185416 - RNA, 19 nt, Homo sapiens
caugacuugcgaauauuua

SEQ ID NO: 1185417 - RNA, 19 nt, Homo sapiens
guaacaugacuugcgaaua

SEQ ID NO: 1185418 - RNA, 19 nt, Homo sapiens
caagaccuuuuguacauuu

SEQ ID NO: 1185419 - RNA, 19 nt, Homo sapiens
uucccuuccugguuaauua

SEQ ID NO: 1185420 - RNA, 19 nt, Homo sapiens
ggcuaaggguggccagaga

SEQ ID NO: 1185421 - RNA, 19 nt, Homo sapiens
ccagagaaggucaccaugu

SEQ ID NO: 1185422 - RNA, 19 nt, Homo sapiens
ucagacuggugcuguguuc

SEQ ID NO: 1185423 - RNA, 19 nt, Homo sapiens
gaagggugacucccacaag

SEQ ID NO: 1185424 - RNA, 19 nt, Homo sapiens
ccauguaccacacaccaaa

SEQ ID NO: 1185425 - RNA, 19 nt, Homo sapiens
gcucagccucuaaaucuca

SEQ ID NO: 1185426 - RNA, 19 nt, Homo sapiens
gcaguccucugaccuuucc

SEQ ID NO: 1185427 - RNA, 19 nt, Homo sapiens
ccgcaguccucugaccuuu

SEQ ID NO: 1185428 - RNA, 19 nt, Homo sapiens
gcuaaggguggccagagaa

SEQ ID NO: 1185429 - RNA, 19 nt, Homo sapiens
agaccaagcaucacaugga

SEQ ID NO: 1185430 - RNA, 19 nt, Homo sapiens
ggccuucaccugcuguuug

SEQ ID NO: 1185431 - RNA, 19 nt, Homo sapiens
gacuggugcuguguuccua

SEQ ID NO: 1185432 - RNA, 19 nt, Homo sapiens
ucaccaaggaggagaagga

SEQ ID NO: 1185433 - RNA, 19 nt, Homo sapiens
caagaccaagcaucacaug

SEQ ID NO: 1185434 - RNA, 19 nt, Homo sapiens
gaccauuuccggccaccuu

SEQ ID NO: 1185435 - RNA, 19 nt, Homo sapiens
uaaaggaagagcggaagga

SEQ ID NO: 1185436 - RNA, 19 nt, Homo sapiens
cccacaagcuugacuuucg

SEQ ID NO: 1185437 - RNA, 19 nt, Homo sapiens
ggcuucuucuguaacauga

SEQ ID NO: 1185438 - RNA, 19 nt, Homo sapiens
gggcuucuucuguaacaug

SEQ ID NO: 1185439 - RNA, 19 nt, Homo sapiens
cccaacauguucccguuca

SEQ ID NO: 1185440 - RNA, 19 nt, Homo sapiens
aacaugacuugcgaauauu

SEQ ID NO: 1185441 - RNA, 19 nt, Homo sapiens
cacccacauugaucccuuu

SEQ ID NO: 1185442 - RNA, 19 nt, Homo sapiens
ggaaguggugugccaugca

SEQ ID NO: 1185443 - RNA, 19 nt, Homo sapiens
gaaggcaggggucaaucua

SEQ ID NO: 1185444 - RNA, 19 nt, Homo sapiens
guaccacacaccaaagaag

SEQ ID NO: 1185445 - RNA, 19 nt, Homo sapiens
gggguuccauguacauauu

SEQ ID NO: 1185446 - RNA, 19 nt, Homo sapiens
agacuccaccaccucuuaa

SEQ ID NO: 1185447 - RNA, 19 nt, Homo sapiens
gguccuagggcugagguuu

SEQ ID NO: 1185448 - RNA, 19 nt, Homo sapiens
ggacuccaggcucagacaa

SEQ ID NO: 1185449 - RNA, 19 nt, Homo sapiens
ugaggcgggugaggagcua

SEQ ID NO: 1185450 - RNA, 19 nt, Homo sapiens
gucacagccucuagagaag

SEQ ID NO: 1185451 - RNA, 19 nt, Homo sapiens
gugcguguggcuuacauga

SEQ ID NO: 1185452 - RNA, 19 nt, Homo sapiens
cgccgucuuugcccagaaa

SEQ ID NO: 1185453 - RNA, 19 nt, Homo sapiens
ggaaggaaauucucacaga

SEQ ID NO: 1185454 - RNA, 19 nt, Homo sapiens
gcacugccaugcuguauga

SEQ ID NO: 1185455 - RNA, 19 nt, Homo sapiens
ggaccaggauucacaguau

SEQ ID NO: 1185456 - RNA, 19 nt, Homo sapiens
gaaggaaauucucacagau

SEQ ID NO: 1185457 - RNA, 19 nt, Homo sapiens
guagaugucuccaaaggau

SEQ ID NO: 1185458 - RNA, 19 nt, Homo sapiens
gaucuugccucacugaaag

SEQ ID NO: 1185459 - RNA, 19 nt, Homo sapiens
ccagaaagcuaugcuagau

SEQ ID NO: 1185460 - RNA, 19 nt, Homo sapiens
cagcaaagguugggcgaaa

SEQ ID NO: 1185461 - RNA, 19 nt, Homo sapiens
ggucaaaucagcaaagguu

SEQ ID NO: 1185462 - RNA, 19 nt, Homo sapiens
gagggaggcaauaaagaua

SEQ ID NO: 1185463 - RNA, 19 nt, Homo sapiens
cgaaaccgauacuucauca

SEQ ID NO: 1185464 - RNA, 19 nt, Homo sapiens
gagcgaaaccgauacuuca

SEQ ID NO: 1185465 - RNA, 19 nt, Homo sapiens
gauaacaacaucccucaug

SEQ ID NO: 1185466 - RNA, 19 nt, Homo sapiens
gaaauucucacagauaaca

SEQ ID NO: 1185467 - RNA, 19 nt, Homo sapiens
aggaaauucucacagauaa

SEQ ID NO: 1185468 - RNA, 19 nt, Homo sapiens
uaaaggaaauggcagaacu

SEQ ID NO: 1185469 - RNA, 19 nt, Homo sapiens
gaacuacaggugauuaaag

SEQ ID NO: 1185470 - RNA, 19 nt, Homo sapiens
ccucugaaguugaaguauu

SEQ ID NO: 1185471 - RNA, 19 nt, Homo sapiens
gcagcaugcuacaaccaaa

SEQ ID NO: 1185472 - RNA, 19 nt, Homo sapiens
gaacggaggcacccaaagg

SEQ ID NO: 1185473 - RNA, 19 nt, Homo sapiens
ggagggaggcaauaaagau

SEQ ID NO: 1185474 - RNA, 19 nt, Homo sapiens
gaugaacuacaggugauua

SEQ ID NO: 1185475 - RNA, 19 nt, Homo sapiens
ugagucagcuguagauguc

SEQ ID NO: 1185476 - RNA, 19 nt, Homo sapiens
gcagagagccccucgugua

SEQ ID NO: 1185477 - RNA, 19 nt, Homo sapiens
acagaucucuauccgaaau

SEQ ID NO: 1185478 - RNA, 19 nt, Homo sapiens
ggagaucuacaucacuuug

SEQ ID NO: 1185479 - RNA, 19 nt, Homo sapiens
cccgaggacuuucagauga

SEQ ID NO: 1185480 - RNA, 19 nt, Homo sapiens
gaccaggauucacaguaug

SEQ ID NO: 1185481 - RNA, 19 nt, Homo sapiens
ucaucugccucuaugguuu

SEQ ID NO: 1185482 - RNA, 19 nt, Homo sapiens
gaagguccuccacaagaga

SEQ ID NO: 1185483 - RNA, 19 nt, Homo sapiens
gcgaaacccagaaagcuau

SEQ ID NO: 1185484 - RNA, 19 nt, Homo sapiens
aaggaaauucucacagaua

SEQ ID NO: 1185485 - RNA, 19 nt, Homo sapiens
ggacacccgguucuuccua

SEQ ID NO: 1185486 - RNA, 19 nt, Homo sapiens
ggaaauggcagaacuucac

SEQ ID NO: 1185487 - RNA, 19 nt, Homo sapiens
gagagccccucguguauga

SEQ ID NO: 1185488 - RNA, 19 nt, Homo sapiens
uagaugaacuacaggugau

SEQ ID NO: 1185489 - RNA, 19 nt, Homo sapiens
gaugggagggaggcaauaa

SEQ ID NO: 1185490 - RNA, 19 nt, Homo sapiens
ugggagaucuacaucacuu

SEQ ID NO: 1185491 - RNA, 19 nt, Homo sapiens
gaacuucaccaugggagau

SEQ ID NO: 1185492 - RNA, 19 nt, Homo sapiens
ucucacagauaacaacauc

SEQ ID NO: 1185493 - RNA, 19 nt, Homo sapiens
uacaggugauuaaaggaaa

SEQ ID NO: 1185494 - RNA, 19 nt, Homo sapiens
ggcgaaacccagaaagcua

SEQ ID NO: 1185495 - RNA, 19 nt, Homo sapiens
uguaugaucuugccucacu

SEQ ID NO: 1185496 - RNA, 19 nt, Homo sapiens
ggugugcaguguccagugu

SEQ ID NO: 1185497 - RNA, 19 nt, Homo sapiens
gcaggacucgggacugugu

SEQ ID NO: 1185498 - RNA, 19 nt, Homo sapiens
ugaagguccuccacaagag

SEQ ID NO: 1185499 - RNA, 19 nt, Homo sapiens
gggaaucauugaccuugag

SEQ ID NO: 1185500 - RNA, 19 nt, Homo sapiens
gagaaagggaaggaaauuc

SEQ ID NO: 1185501 - RNA, 19 nt, Homo sapiens
ugagaaagggaaggaaauu

SEQ ID NO: 1185502 - RNA, 19 nt, Homo sapiens
gaaagggaaggaaauucuc

SEQ ID NO: 1185503 - RNA, 19 nt, Homo sapiens
gaacggcagcaugcuacaa

SEQ ID NO: 1185504 - RNA, 19 nt, Homo sapiens
cuacaggugauuaaaggaa

SEQ ID NO: 1185505 - RNA, 19 nt, Homo sapiens
cccaugaggugccacagau

SEQ ID NO: 1185506 - RNA, 19 nt, Homo sapiens
gggagggaggcaauaaaga

SEQ ID NO: 1185507 - RNA, 19 nt, Homo sapiens
cagcacccuugcagcagaa

SEQ ID NO: 1185508 - RNA, 19 nt, Homo sapiens
ccucauggccaguguguca

SEQ ID NO: 1185509 - RNA, 19 nt, Homo sapiens
cccugggccuggaaucuaa

SEQ ID NO: 1185510 - RNA, 19 nt, Homo sapiens
gcugggagcgcucuaaagg

SEQ ID NO: 1185511 - RNA, 19 nt, Homo sapiens
cagaggaccaggauucaca

SEQ ID NO: 1185512 - RNA, 19 nt, Homo sapiens
cucugaaguugaaguauug

SEQ ID NO: 1185513 - RNA, 19 nt, Homo sapiens
ugugucaucugccucuaug

SEQ ID NO: 1185514 - RNA, 19 nt, Homo sapiens
gcgaaaccgauacuucauc

SEQ ID NO: 1185515 - RNA, 19 nt, Homo sapiens
aggcugagcgaaaccgaua

SEQ ID NO: 1185516 - RNA, 19 nt, Homo sapiens
ggcagucggugugcagugu

SEQ ID NO: 1185517 - RNA, 19 nt, Homo sapiens
ucuaugguuuccaggagaa

SEQ ID NO: 1185518 - RNA, 19 nt, Homo sapiens
caugggagaucuacaucac

SEQ ID NO: 1185519 - RNA, 19 nt, Homo sapiens
cuaucuagaugaacuacag

SEQ ID NO: 1185520 - RNA, 19 nt, Homo sapiens
gcuucacucuggugcuuca

SEQ ID NO: 1185521 - RNA, 19 nt, Homo sapiens
caggaacggcagcaugcua

SEQ ID NO: 1185522 - RNA, 19 nt, Homo sapiens
augaacagauccacacgau

SEQ ID NO: 1185523 - RNA, 19 nt, Homo sapiens
ucaggucccagcagaguau

SEQ ID NO: 1185524 - RNA, 19 nt, Homo sapiens
ggaugggagggaggcaaua

SEQ ID NO: 1185525 - RNA, 19 nt, Homo sapiens
ugaacuacaggugauuaaa

SEQ ID NO: 1185526 - RNA, 19 nt, Homo sapiens
caaggagcccauggaccua

SEQ ID NO: 1185527 - RNA, 19 nt, Homo sapiens
ugagcgaaaccgauacuuc

SEQ ID NO: 1185528 - RNA, 19 nt, Homo sapiens
aaaggaaauggcagaacuu

SEQ ID NO: 1185529 - RNA, 19 nt, Homo sapiens
cgaaauccccgaggacuuu

SEQ ID NO: 1185530 - RNA, 19 nt, Homo sapiens
acaggugauuaaaggaaau

SEQ ID NO: 1185531 - RNA, 19 nt, Homo sapiens
uugaagguccuccacaaga

SEQ ID NO: 1185532 - RNA, 19 nt, Homo sapiens
aaagggaaggaaauucuca

SEQ ID NO: 1185533 - RNA, 19 nt, Homo sapiens
aguugaagguccuccacaa

SEQ ID NO: 1185534 - RNA, 19 nt, Homo sapiens
agcuguagaugucuccaaa

SEQ ID NO: 1185535 - RNA, 19 nt, Homo sapiens
gauacuucaucagccuuca

SEQ ID NO: 1185536 - RNA, 19 nt, Homo sapiens
ugaucuugccucacugaaa

SEQ ID NO: 1185537 - RNA, 19 nt, Homo sapiens
gggagaucuacaucacuuu

SEQ ID NO: 1185538 - RNA, 19 nt, Homo sapiens
cugcagaggaccaggauuc

SEQ ID NO: 1185539 - RNA, 19 nt, Homo sapiens
cuacaucacuuugcauccu

SEQ ID NO: 1185540 - RNA, 19 nt, Homo sapiens
gcacggaauuugaacagua

SEQ ID NO: 1185541 - RNA, 19 nt, Homo sapiens
caaguuaacuagcuuugaa

SEQ ID NO: 1185542 - RNA, 19 nt, Homo sapiens
caacuauccugacguguga

SEQ ID NO: 1185543 - RNA, 19 nt, Homo sapiens
caaaacagcuuccuccauu

SEQ ID NO: 1185544 - RNA, 19 nt, Homo sapiens
gggcaugacuccgguguga

SEQ ID NO: 1185545 - RNA, 19 nt, Homo sapiens
ccugaaaguuuauugauca

SEQ ID NO: 1185546 - RNA, 19 nt, Homo sapiens
uaacuagcuuugaaugugu

SEQ ID NO: 1185547 - RNA, 19 nt, Homo sapiens
uaaaagguguguuggcaua

SEQ ID NO: 1185548 - RNA, 19 nt, Homo sapiens
gcaagaugcugggcaaguc

SEQ ID NO: 1185549 - RNA, 19 nt, Homo sapiens
aaagguguguuggcauaua

SEQ ID NO: 1185550 - RNA, 19 nt, Homo sapiens
ggggugagguuucauuuaa

SEQ ID NO: 1185551 - RNA, 19 nt, Homo sapiens
gggugagguuucauuuaaa

SEQ ID NO: 1185552 - RNA, 19 nt, Homo sapiens
uuaacuagcuuugaaugug

SEQ ID NO: 1185553 - RNA, 19 nt, Homo sapiens
ccagcuccgcgguauauua

SEQ ID NO: 1185554 - RNA, 19 nt, Homo sapiens
gagauuuguuucccauagu

SEQ ID NO: 1185555 - RNA, 19 nt, Homo sapiens
guauauuacugcaacuauc

SEQ ID NO: 1185556 - RNA, 19 nt, Homo sapiens
ccagcgcccuucacgugua

SEQ ID NO: 1185557 - RNA, 19 nt, Homo sapiens
ggaccgcacggaauuugaa

SEQ ID NO: 1185558 - RNA, 19 nt, Homo sapiens
ucccauaguuggauuguca

SEQ ID NO: 1185559 - RNA, 19 nt, Homo sapiens
aagguguguuggcauauaa

SEQ ID NO: 1185560 - RNA, 19 nt, Homo sapiens
gcaugacuccggugugaau

SEQ ID NO: 1185561 - RNA, 19 nt, Homo sapiens
cacggaauuugaacaguau

SEQ ID NO: 1185562 - RNA, 19 nt, Homo sapiens
ggugagguuucauuuaaaa

SEQ ID NO: 1185563 - RNA, 19 nt, Homo sapiens
uggaggagcuaaggaaauc

SEQ ID NO: 1185564 - RNA, 19 nt, Homo sapiens
agagauuuguuucccauag

SEQ ID NO: 1185565 - RNA, 19 nt, Homo sapiens
gguauauuacugcaacuau

SEQ ID NO: 1185566 - RNA, 19 nt, Homo sapiens
aaacagcuuccuccauuuc

SEQ ID NO: 1185567 - RNA, 19 nt, Homo sapiens
gcuccgcgguauauuacug

SEQ ID NO: 1185568 - RNA, 19 nt, Homo sapiens
agauuuguuucccauaguu

SEQ ID NO: 1185569 - RNA, 19 nt, Homo sapiens
caggccagaagcaguguua

SEQ ID NO: 1185570 - RNA, 19 nt, Homo sapiens
acgcgcaggucucggacua

SEQ ID NO: 1185571 - RNA, 19 nt, Homo sapiens
ugaacaguaucugcacuuc

SEQ ID NO: 1185572 - RNA, 19 nt, Homo sapiens
uguuguugcuguuguuguu

SEQ ID NO: 1185573 - RNA, 19 nt, Homo sapiens
gagguggaccgcacggaau

SEQ ID NO: 1185574 - RNA, 19 nt, Homo sapiens
gguguguuggcauauaauu

SEQ ID NO: 1185575 - RNA, 19 nt, Homo sapiens
aacaguaucugcacuucgu

SEQ ID NO: 1185576 - RNA, 19 nt, Homo sapiens
aaaacagcuuccuccauuu

SEQ ID NO: 1185577 - RNA, 19 nt, Homo sapiens
guuaacuagcuuugaaugu

SEQ ID NO: 1185578 - RNA, 19 nt, Homo sapiens
ucugccacuugaacaguuu

SEQ ID NO: 1185579 - RNA, 19 nt, Homo sapiens
guguguuggcauauaauuu

SEQ ID NO: 1185580 - RNA, 19 nt, Homo sapiens
ggccagaagcaguguuaca

SEQ ID NO: 1185581 - RNA, 19 nt, Homo sapiens
gaucuucacugcagacuua

SEQ ID NO: 1185582 - RNA, 19 nt, Homo sapiens
gaacuuaccuucaacuaca

SEQ ID NO: 1185583 - RNA, 19 nt, Homo sapiens
gaaaguaaacgucaaagaa

SEQ ID NO: 1185584 - RNA, 19 nt, Homo sapiens
gauauuugcuccuaagaaa

SEQ ID NO: 1185585 - RNA, 19 nt, Homo sapiens
gaacagaaguaguaccaau

SEQ ID NO: 1185586 - RNA, 19 nt, Homo sapiens
gaacugcaguggcuucuug

SEQ ID NO: 1185587 - RNA, 19 nt, Homo sapiens
ggacgagaauucuuugauu

SEQ ID NO: 1185588 - RNA, 19 nt, Homo sapiens
caggaacccucuuguaaua

SEQ ID NO: 1185589 - RNA, 19 nt, Homo sapiens
gcaaguggcuuuuggaaua

SEQ ID NO: 1185590 - RNA, 19 nt, Homo sapiens
gaaggaaacugguauugca

SEQ ID NO: 1185591 - RNA, 19 nt, Homo sapiens
aaacagaagccucucauua

SEQ ID NO: 1185592 - RNA, 19 nt, Homo sapiens
gaacuacccagaagaaauu

SEQ ID NO: 1185593 - RNA, 19 nt, Homo sapiens
gcuuauagaugaagaagaa

SEQ ID NO: 1185594 - RNA, 19 nt, Homo sapiens
uaagacagcugcaggaaga

SEQ ID NO: 1185595 - RNA, 19 nt, Homo sapiens
gccgagagcuguugagaaa

SEQ ID NO: 1185596 - RNA, 19 nt, Homo sapiens
gaaagacuguuugcaaaug

SEQ ID NO: 1185597 - RNA, 19 nt, Homo sapiens
gaucaaagccuucauccaa

SEQ ID NO: 1185598 - RNA, 19 nt, Homo sapiens
gaaaguggauggucuaaaa

SEQ ID NO: 1185599 - RNA, 19 nt, Homo sapiens
gugaagcucugcuauauug

SEQ ID NO: 1185600 - RNA, 19 nt, Homo sapiens
ggacagcccuuucgguaau

SEQ ID NO: 1185601 - RNA, 19 nt, Homo sapiens
gacaaacccucuccaguga

SEQ ID NO: 1185602 - RNA, 19 nt, Homo sapiens
gaucagauauuugcuccua

SEQ ID NO: 1185603 - RNA, 19 nt, Homo sapiens
agugagaacucguuaauaa

SEQ ID NO: 1185604 - RNA, 19 nt, Homo sapiens
gaagagcaauuaaacucaa

SEQ ID NO: 1185605 - RNA, 19 nt, Homo sapiens
gaauggagauacccgugua

SEQ ID NO: 1185606 - RNA, 19 nt, Homo sapiens
gaacauugauaucccugaa

SEQ ID NO: 1185607 - RNA, 19 nt, Homo sapiens
gacgagaauucuuugauuu

SEQ ID NO: 1185608 - RNA, 19 nt, Homo sapiens
gaaccagacuacaaauuca

SEQ ID NO: 1185609 - RNA, 19 nt, Homo sapiens
gaaggcaucuacucuuguu

SEQ ID NO: 1185610 - RNA, 19 nt, Homo sapiens
guaggagucucuaagguuu

SEQ ID NO: 1185611 - RNA, 19 nt, Homo sapiens
ugaaagauaugcaugauag

SEQ ID NO: 1185612 - RNA, 19 nt, Homo sapiens
ucagaacucuugugacauu

SEQ ID NO: 1185613 - RNA, 19 nt, Homo sapiens
gcagagcaaucaacaggaa

SEQ ID NO: 1185614 - RNA, 19 nt, Homo sapiens
gagcuggacucuguaauga

SEQ ID NO: 1185615 - RNA, 19 nt, Homo sapiens
gaacaucaaagccaucaaa

SEQ ID NO: 1185616 - RNA, 19 nt, Homo sapiens
agaaagagcucugauaauc

SEQ ID NO: 1185617 - RNA, 19 nt, Homo sapiens
gaggagaucuuugaggaaa

SEQ ID NO: 1185618 - RNA, 19 nt, Homo sapiens
uaaaucaaguggugccuaa

SEQ ID NO: 1185619 - RNA, 19 nt, Homo sapiens
gcauaagguuccucagaaa

SEQ ID NO: 1185620 - RNA, 19 nt, Homo sapiens
ccagacagacugcucauua

SEQ ID NO: 1185621 - RNA, 19 nt, Homo sapiens
gagcugcacucaaggagaa

SEQ ID NO: 1185622 - RNA, 19 nt, Homo sapiens
cgaagugauuccauuagua

SEQ ID NO: 1185623 - RNA, 19 nt, Homo sapiens
cagccaagaugcaguguaa

SEQ ID NO: 1185624 - RNA, 19 nt, Homo sapiens
ugaaucagcuuccaagugu

SEQ ID NO: 1185625 - RNA, 19 nt, Homo sapiens
caaggagacuguugaggaa

SEQ ID NO: 1185626 - RNA, 19 nt, Homo sapiens
cagagaacauguuaucuau

SEQ ID NO: 1185627 - RNA, 19 nt, Homo sapiens
caaauucaguacauugcua

SEQ ID NO: 1185628 - RNA, 19 nt, Homo sapiens
aagaagauaugccauuuga

SEQ ID NO: 1185629 - RNA, 19 nt, Homo sapiens
caaagacuaucaagaaugg

SEQ ID NO: 1185630 - RNA, 19 nt, Homo sapiens
gaucagaccugugaacuac

SEQ ID NO: 1185631 - RNA, 19 nt, Homo sapiens
ggauucaagugacauagaa

SEQ ID NO: 1185632 - RNA, 19 nt, Homo sapiens
gaagauaugccauuugaag

SEQ ID NO: 1185633 - RNA, 19 nt, Homo sapiens
ugaagaagauaugccauuu

SEQ ID NO: 1185634 - RNA, 19 nt, Homo sapiens
caaaggagcgagaagauga

SEQ ID NO: 1185635 - RNA, 19 nt, Homo sapiens
gggccacgguuaaauguuu

SEQ ID NO: 1185636 - RNA, 19 nt, Homo sapiens
ggcagaagauccuaguaaa

SEQ ID NO: 1185637 - RNA, 19 nt, Homo sapiens
gagaacauguuaucuaugc

SEQ ID NO: 1185638 - RNA, 19 nt, Homo sapiens
gaagugauuccauuaguau

SEQ ID NO: 1185639 - RNA, 19 nt, Homo sapiens
gcucagacgccaauuguuu

SEQ ID NO: 1185640 - RNA, 19 nt, Homo sapiens
gaagaugaguguuuuaguu

SEQ ID NO: 1185641 - RNA, 19 nt, Homo sapiens
ugggugagcuuauagauga

SEQ ID NO: 1185642 - RNA, 19 nt, Homo sapiens
agaagccucucauuaguaa

SEQ ID NO: 1185643 - RNA, 19 nt, Homo sapiens
gaagagcuaccuguccuua

SEQ ID NO: 1185644 - RNA, 19 nt, Homo sapiens
uaggaaacaugcuagaauu

SEQ ID NO: 1185645 - RNA, 19 nt, Homo sapiens
agacaaagaccgaaucauu

SEQ ID NO: 1185646 - RNA, 19 nt, Homo sapiens
cagcaagguuugaggaauu

SEQ ID NO: 1185647 - RNA, 19 nt, Homo sapiens
caucugcccuaaucacuuu

SEQ ID NO: 1185648 - RNA, 19 nt, Homo sapiens
gagaauggcauaacugaau

SEQ ID NO: 1185649 - RNA, 19 nt, Homo sapiens
gaaccuuggccuaaacuuu

SEQ ID NO: 1185650 - RNA, 19 nt, Homo sapiens
ggcauaagguuccucagaa

SEQ ID NO: 1185651 - RNA, 19 nt, Homo sapiens
guucugauccguugauuaa

SEQ ID NO: 1185652 - RNA, 19 nt, Homo sapiens
gaaguggucugugaaugga

SEQ ID NO: 1185653 - RNA, 19 nt, Homo sapiens
acaagaagccaccaccuua

SEQ ID NO: 1185654 - RNA, 19 nt, Homo sapiens
cuaaugaacuuuccaggau

SEQ ID NO: 1185655 - RNA, 19 nt, Homo sapiens
gaaaagcaaucgucauguu

SEQ ID NO: 1185656 - RNA, 19 nt, Homo sapiens
agaauuaccuggaacuuca

SEQ ID NO: 1185657 - RNA, 19 nt, Homo sapiens
guaauggucaauccaauuu

SEQ ID NO: 1185658 - RNA, 19 nt, Homo sapiens
gacaaagaccgaaucauug

SEQ ID NO: 1185659 - RNA, 19 nt, Homo sapiens
ucugaggaauugcuaguua

SEQ ID NO: 1185660 - RNA, 19 nt, Homo sapiens
gagaagaaacgccuuagga

SEQ ID NO: 1185661 - RNA, 19 nt, Homo sapiens
gcaaucugauccugguaaa

SEQ ID NO: 1185662 - RNA, 19 nt, Homo sapiens
guuaaucucucugaucuga

SEQ ID NO: 1185663 - RNA, 19 nt, Homo sapiens
gagaagagggaaacagaaa

SEQ ID NO: 1185664 - RNA, 19 nt, Homo sapiens
gcaauuaugagacuaaauc

SEQ ID NO: 1185665 - RNA, 19 nt, Homo sapiens
aaucagaacagaaguagua

SEQ ID NO: 1185666 - RNA, 19 nt, Homo sapiens
gauaaugggccacuuaaca

SEQ ID NO: 1185667 - RNA, 19 nt, Homo sapiens
aaacagcaguggugaaaca

SEQ ID NO: 1185668 - RNA, 19 nt, Homo sapiens
uaaugaacuuuccaggaua

SEQ ID NO: 1185669 - RNA, 19 nt, Homo sapiens
cuuaauggcuguuugaaau

SEQ ID NO: 1185670 - RNA, 19 nt, Homo sapiens
gaagagggaaacagaaaga

SEQ ID NO: 1185671 - RNA, 19 nt, Homo sapiens
cuacgccacugaaguauga

SEQ ID NO: 1185672 - RNA, 19 nt, Homo sapiens
agacaggccuacugacaaa

SEQ ID NO: 1185673 - RNA, 19 nt, Homo sapiens
gcaggaagaccgaaagaau

SEQ ID NO: 1185674 - RNA, 19 nt, Homo sapiens
ggaaacugguauugcaaug

SEQ ID NO: 1185675 - RNA, 19 nt, Homo sapiens
guaagcgcaugaacagauu

SEQ ID NO: 1185676 - RNA, 19 nt, Homo sapiens
ucacauaccuauugaacca

SEQ ID NO: 1185677 - RNA, 19 nt, Homo sapiens
ugaacaauaugcaugagaa

SEQ ID NO: 1185678 - RNA, 19 nt, Homo sapiens
agauguagauucugaaaug

SEQ ID NO: 1185679 - RNA, 19 nt, Homo sapiens
gaaguaguaccaaucaaug

SEQ ID NO: 1185680 - RNA, 19 nt, Homo sapiens
gugaauuugugaaugagua

SEQ ID NO: 1185681 - RNA, 19 nt, Homo sapiens
gaucuucacugcagacuua

SEQ ID NO: 1185682 - RNA, 19 nt, Homo sapiens
ggacagcccuuucggauga

SEQ ID NO: 1185683 - RNA, 19 nt, Homo sapiens
gaacuuaccuucaacuaca

SEQ ID NO: 1185684 - RNA, 19 nt, Homo sapiens
gaaaguaaacgucaaagaa

SEQ ID NO: 1185685 - RNA, 19 nt, Homo sapiens
gauauuugcuccuaagaaa

SEQ ID NO: 1185686 - RNA, 19 nt, Homo sapiens
gaacagaaguaguaccaau

SEQ ID NO: 1185687 - RNA, 19 nt, Homo sapiens
gaacugcaguggcuucuug

SEQ ID NO: 1185688 - RNA, 19 nt, Homo sapiens
ggacgagaauucuuugauu

SEQ ID NO: 1185689 - RNA, 19 nt, Homo sapiens
gcaaguggcuuuuggaaua

SEQ ID NO: 1185690 - RNA, 19 nt, Homo sapiens
gaaggaaacugguauugca

SEQ ID NO: 1185691 - RNA, 19 nt, Homo sapiens
aaacagaagccucucauua

SEQ ID NO: 1185692 - RNA, 19 nt, Homo sapiens
gaacuacccagaagaaauu

SEQ ID NO: 1185693 - RNA, 19 nt, Homo sapiens
gcuuauagaugaagaagaa

SEQ ID NO: 1185694 - RNA, 19 nt, Homo sapiens
uaagacagcugcaggaaga

SEQ ID NO: 1185695 - RNA, 19 nt, Homo sapiens
gccgagagcuguugagaaa

SEQ ID NO: 1185696 - RNA, 19 nt, Homo sapiens
gaaagacuguuugcaaaug

SEQ ID NO: 1185697 - RNA, 19 nt, Homo sapiens
gaucaaagccuucauccaa

SEQ ID NO: 1185698 - RNA, 19 nt, Homo sapiens
gaaaguggauggucuaaaa

SEQ ID NO: 1185699 - RNA, 19 nt, Homo sapiens
gugaagcucugcuauauug

SEQ ID NO: 1185700 - RNA, 19 nt, Homo sapiens
gacaaacccucuccaguga

SEQ ID NO: 1185701 - RNA, 19 nt, Homo sapiens
gaucagauauuugcuccua

SEQ ID NO: 1185702 - RNA, 19 nt, Homo sapiens
agugagaacucguuaauaa

SEQ ID NO: 1185703 - RNA, 19 nt, Homo sapiens
gaauggagauacccgugua

SEQ ID NO: 1185704 - RNA, 19 nt, Homo sapiens
gaacauugauaucccugaa

SEQ ID NO: 1185705 - RNA, 19 nt, Homo sapiens
gacgagaauucuuugauuu

SEQ ID NO: 1185706 - RNA, 19 nt, Homo sapiens
gaaccagacuacaaauuca

SEQ ID NO: 1185707 - RNA, 19 nt, Homo sapiens
gaaggcaucuacucuuguu

SEQ ID NO: 1185708 - RNA, 19 nt, Homo sapiens
guaggagucucuaagguuu

SEQ ID NO: 1185709 - RNA, 19 nt, Homo sapiens
ugaaagauaugcaugauag

SEQ ID NO: 1185710 - RNA, 19 nt, Homo sapiens
ucagaacucuugugacauu

SEQ ID NO: 1185711 - RNA, 19 nt, Homo sapiens
gcagagcaaucaacaggaa

SEQ ID NO: 1185712 - RNA, 19 nt, Homo sapiens
gagcuggacucuguaauga

SEQ ID NO: 1185713 - RNA, 19 nt, Homo sapiens
gaacaucaaagccaucaaa

SEQ ID NO: 1185714 - RNA, 19 nt, Homo sapiens
agaaagagcucugauaauc

SEQ ID NO: 1185715 - RNA, 19 nt, Homo sapiens
uaaaucaaguggugccuaa

SEQ ID NO: 1185716 - RNA, 19 nt, Homo sapiens
gcauaagguuccucagaaa

SEQ ID NO: 1185717 - RNA, 19 nt, Homo sapiens
ccagacagacugcucauua

SEQ ID NO: 1185718 - RNA, 19 nt, Homo sapiens
gagcugcacucaaggagaa

SEQ ID NO: 1185719 - RNA, 19 nt, Homo sapiens
cgaagugauuccauuagua

SEQ ID NO: 1185720 - RNA, 19 nt, Homo sapiens
cagccaagaugcaguguaa

SEQ ID NO: 1185721 - RNA, 19 nt, Homo sapiens
ugaaucagcuuccaagugu

SEQ ID NO: 1185722 - RNA, 19 nt, Homo sapiens
caaggagacuguugaggaa

SEQ ID NO: 1185723 - RNA, 19 nt, Homo sapiens
cagagaacauguuaucuau

SEQ ID NO: 1185724 - RNA, 19 nt, Homo sapiens
caaauucaguacauugcua

SEQ ID NO: 1185725 - RNA, 19 nt, Homo sapiens
aagaagauaugccauuuga

SEQ ID NO: 1185726 - RNA, 19 nt, Homo sapiens
gaucagaccugugaacuac

SEQ ID NO: 1185727 - RNA, 19 nt, Homo sapiens
ggauucaagugacauagaa

SEQ ID NO: 1185728 - RNA, 19 nt, Homo sapiens
gaagauaugccauuugaag

SEQ ID NO: 1185729 - RNA, 19 nt, Homo sapiens
ugaagaagauaugccauuu

SEQ ID NO: 1185730 - RNA, 19 nt, Homo sapiens
caaaggagcgagaagauga

SEQ ID NO: 1185731 - RNA, 19 nt, Homo sapiens
gggccacgguuaaauguuu

SEQ ID NO: 1185732 - RNA, 19 nt, Homo sapiens
ggcagaagauccuaguaaa

SEQ ID NO: 1185733 - RNA, 19 nt, Homo sapiens
gagaacauguuaucuaugc

SEQ ID NO: 1185734 - RNA, 19 nt, Homo sapiens
gaagugauuccauuaguau

SEQ ID NO: 1185735 - RNA, 19 nt, Homo sapiens
gaagaugaguguuuuaguu

SEQ ID NO: 1185736 - RNA, 19 nt, Homo sapiens
ugggugagcuuauagauga

SEQ ID NO: 1185737 - RNA, 19 nt, Homo sapiens
agaagccucucauuaguaa

SEQ ID NO: 1185738 - RNA, 19 nt, Homo sapiens
gaagagcuaccuguccuua

SEQ ID NO: 1185739 - RNA, 19 nt, Homo sapiens
uaggaaacaugcuagaauu

SEQ ID NO: 1185740 - RNA, 19 nt, Homo sapiens
agacaaagaccgaaucauu

SEQ ID NO: 1185741 - RNA, 19 nt, Homo sapiens
cagcaagguuugaggaauu

SEQ ID NO: 1185742 - RNA, 19 nt, Homo sapiens
caucugcccuaaucacuuu

SEQ ID NO: 1185743 - RNA, 19 nt, Homo sapiens
gagaauggcauaacugaau

SEQ ID NO: 1185744 - RNA, 19 nt, Homo sapiens
gaaccuuggccuaaacuuu

SEQ ID NO: 1185745 - RNA, 19 nt, Homo sapiens
ggcauaagguuccucagaa

SEQ ID NO: 1185746 - RNA, 19 nt, Homo sapiens
guucugauccguugauuaa

SEQ ID NO: 1185747 - RNA, 19 nt, Homo sapiens
gaaguggucugugaaugga

SEQ ID NO: 1185748 - RNA, 19 nt, Homo sapiens
acaagaagccaccaccuua

SEQ ID NO: 1185749 - RNA, 19 nt, Homo sapiens
cuaaugaacuuuccaggau

SEQ ID NO: 1185750 - RNA, 19 nt, Homo sapiens
gaaaagcaaucgucauguu

SEQ ID NO: 1185751 - RNA, 19 nt, Homo sapiens
agaauuaccuggaacuuca

SEQ ID NO: 1185752 - RNA, 19 nt, Homo sapiens
gacaaagaccgaaucauug

SEQ ID NO: 1185753 - RNA, 19 nt, Homo sapiens
ucugaggaauugcuaguua

SEQ ID NO: 1185754 - RNA, 19 nt, Homo sapiens
gagaagaaacgccuuagga

SEQ ID NO: 1185755 - RNA, 19 nt, Homo sapiens
gcaaucugauccugguaaa

SEQ ID NO: 1185756 - RNA, 19 nt, Homo sapiens
guuaaucucucugaucuga

SEQ ID NO: 1185757 - RNA, 19 nt, Homo sapiens
gagaagagggaaacagaaa

SEQ ID NO: 1185758 - RNA, 19 nt, Homo sapiens
aaucagaacagaaguagua

SEQ ID NO: 1185759 - RNA, 19 nt, Homo sapiens
gauaaugggccacuuaaca

SEQ ID NO: 1185760 - RNA, 19 nt, Homo sapiens
aaacagcaguggugaaaca

SEQ ID NO: 1185761 - RNA, 19 nt, Homo sapiens
uaaugaacuuuccaggaua

SEQ ID NO: 1185762 - RNA, 19 nt, Homo sapiens
cuuaauggcuguuugaaau

SEQ ID NO: 1185763 - RNA, 19 nt, Homo sapiens
gaagagggaaacagaaaga

SEQ ID NO: 1185764 - RNA, 19 nt, Homo sapiens
cuacgccacugaaguauga

SEQ ID NO: 1185765 - RNA, 19 nt, Homo sapiens
agacaggccuacugacaaa

SEQ ID NO: 1185766 - RNA, 19 nt, Homo sapiens
gcaggaagaccgaaagaau

SEQ ID NO: 1185767 - RNA, 19 nt, Homo sapiens
ggaaacugguauugcaaug

SEQ ID NO: 1185768 - RNA, 19 nt, Homo sapiens
guaagcgcaugaacagauu

SEQ ID NO: 1185769 - RNA, 19 nt, Homo sapiens
ucacauaccuauugaacca

SEQ ID NO: 1185770 - RNA, 19 nt, Homo sapiens
ugaacaauaugcaugagaa

SEQ ID NO: 1185771 - RNA, 19 nt, Homo sapiens
gaaguaguaccaaucaaug

SEQ ID NO: 1185772 - RNA, 19 nt, Homo sapiens
gugaauuugugaaugagua

SEQ ID NO: 1185773 - RNA, 19 nt, Homo sapiens
aauguuagcuggugcuuug

SEQ ID NO: 1185774 - RNA, 19 nt, Homo sapiens
ggaacuucaucaucaucua

SEQ ID NO: 1185775 - RNA, 19 nt, Homo sapiens
uggaaagacuguuugcaaa

SEQ ID NO: 1185776 - RNA, 19 nt, Homo sapiens
gauaagaugagacaugaug

SEQ ID NO: 1185777 - RNA, 19 nt, Homo sapiens
gggcagaagauccuaguaa

SEQ ID NO: 1185778 - RNA, 19 nt, Homo sapiens
gaaggaacucucuuacaga

SEQ ID NO: 1185779 - RNA, 19 nt, Homo sapiens
caaucaaguuggacaguga

SEQ ID NO: 1185780 - RNA, 19 nt, Homo sapiens
guaugugggugagcuuaua

SEQ ID NO: 1185781 - RNA, 19 nt, Homo sapiens
gaaaugaccugcaauucga

SEQ ID NO: 1185782 - RNA, 19 nt, Homo sapiens
gcuaaugugugcuguguua

SEQ ID NO: 1185783 - RNA, 19 nt, Homo sapiens
aaacagccuugguauaaua

SEQ ID NO: 1185784 - RNA, 19 nt, Homo sapiens
ggaagaggauauuaagaga

SEQ ID NO: 1185785 - RNA, 19 nt, Homo sapiens
gaaaagagguucaaauugg

SEQ ID NO: 1185786 - RNA, 19 nt, Homo sapiens
caaagaaacagccuuggua

SEQ ID NO: 1185787 - RNA, 19 nt, Homo sapiens
gaagaagcauacaugacaa

SEQ ID NO: 1185788 - RNA, 19 nt, Homo sapiens
ggaguuacaaagaagauua

SEQ ID NO: 1185789 - RNA, 19 nt, Homo sapiens
gcagauauuucaagauugg

SEQ ID NO: 1185790 - RNA, 19 nt, Homo sapiens
gaaacagccuugguauaau

SEQ ID NO: 1185791 - RNA, 19 nt, Homo sapiens
gaccaucuguauccuaauu

SEQ ID NO: 1185792 - RNA, 19 nt, Homo sapiens
gaaauugucucugccucaa

SEQ ID NO: 1185793 - RNA, 19 nt, Homo sapiens
cauaagaaccuguuagcua

SEQ ID NO: 1185794 - RNA, 19 nt, Homo sapiens
agaaacagccuugguauaa

SEQ ID NO: 1185795 - RNA, 19 nt, Homo sapiens
uggcagauauuucaagauu

SEQ ID NO: 1185796 - RNA, 19 nt, Homo sapiens
ugaaggcacuguuauuuua

SEQ ID NO: 1185797 - RNA, 19 nt, Homo sapiens
cuacaaggaugucucguau

SEQ ID NO: 1185798 - RNA, 19 nt, Homo sapiens
gagagcaacuggaacagau

SEQ ID NO: 1185799 - RNA, 19 nt, Homo sapiens
caaugucaaucuuauguug

SEQ ID NO: 1185800 - RNA, 19 nt, Homo sapiens
guaaagcagucucuuaugc

SEQ ID NO: 1185801 - RNA, 19 nt, Homo sapiens
cuagugaucucuauaaugg

SEQ ID NO: 1185802 - RNA, 19 nt, Homo sapiens
gcaacgggcucaucaacuc

SEQ ID NO: 1185803 - RNA, 19 nt, Homo sapiens
gaacucauucuuaaacaga

SEQ ID NO: 1185804 - RNA, 19 nt, Homo sapiens
uaauagaugucccaagugu

SEQ ID NO: 1185805 - RNA, 19 nt, Homo sapiens
ccagauaccauuuggcuuu

SEQ ID NO: 1185806 - RNA, 19 nt, Homo sapiens
aauaauagaugucccaagu

SEQ ID NO: 1185807 - RNA, 19 nt, Homo sapiens
cuaagacuuugcuaacuuu

SEQ ID NO: 1185808 - RNA, 19 nt, Homo sapiens
caacagacagucagcuaaa

SEQ ID NO: 1185809 - RNA, 19 nt, Homo sapiens
gaagagguguuggaguguu

SEQ ID NO: 1185810 - RNA, 19 nt, Homo sapiens
aguauagucucuaguauug

SEQ ID NO: 1185811 - RNA, 19 nt, Homo sapiens
gaagaagaaacaacuggaa

SEQ ID NO: 1185812 - RNA, 19 nt, Homo sapiens
uuauauagcuuguggaagu

SEQ ID NO: 1185813 - RNA, 19 nt, Homo sapiens
ggaagaaaugaguggcuua

SEQ ID NO: 1185814 - RNA, 19 nt, Homo sapiens
ggaggacaauaauagaugu

SEQ ID NO: 1185815 - RNA, 19 nt, Homo sapiens
aaaguguucucgacaaaga

SEQ ID NO: 1185816 - RNA, 19 nt, Homo sapiens
caauggagauuauauagcu

SEQ ID NO: 1185817 - RNA, 19 nt, Homo sapiens
caagccaguuggaugaauu

SEQ ID NO: 1185818 - RNA, 19 nt, Homo sapiens
gcuuugauaugauugaaga

SEQ ID NO: 1185819 - RNA, 19 nt, Homo sapiens
gauuaugaaggcacuguua

SEQ ID NO: 1185820 - RNA, 19 nt, Homo sapiens
guuggaguguugacuuuaa

SEQ ID NO: 1185821 - RNA, 19 nt, Homo sapiens
agaaugaaaugaccugcaa

SEQ ID NO: 1185822 - RNA, 19 nt, Homo sapiens
agaaaugaguggcuuauac

SEQ ID NO: 1185823 - RNA, 19 nt, Homo sapiens
uaagagagagcaacuggaa

SEQ ID NO: 1185824 - RNA, 19 nt, Homo sapiens
caucugcuuugauaugauu

SEQ ID NO: 1185825 - RNA, 19 nt, Homo sapiens
gauggauccuaaacucuug

SEQ ID NO: 1185826 - RNA, 19 nt, Homo sapiens
uaagagaguggaagaaaug

SEQ ID NO: 1185827 - RNA, 19 nt, Homo sapiens
gcugauugcugcuaacagu

SEQ ID NO: 1185828 - RNA, 19 nt, Homo sapiens
gcauugaggcaaaggcuaa

SEQ ID NO: 1185829 - RNA, 19 nt, Homo sapiens
ggaguguugacuuuaauuu

SEQ ID NO: 1185830 - RNA, 19 nt, Homo sapiens
ugaccgggauugugacuau

SEQ ID NO: 1185831 - RNA, 19 nt, Homo sapiens
ucacacaguaguauuauug

SEQ ID NO: 1185832 - RNA, 19 nt, Homo sapiens
cagaaggagcuaaguguuu

SEQ ID NO: 1185833 - RNA, 19 nt, Homo sapiens
aaaaucagcuguaucaguu

SEQ ID NO: 1185834 - RNA, 19 nt, Homo sapiens
acaaggaugucucguaucu

SEQ ID NO: 1185835 - RNA, 19 nt, Homo sapiens
ugaagaagcauacaugaca

SEQ ID NO: 1185836 - RNA, 19 nt, Homo sapiens
gauauucauuacccugaga

SEQ ID NO: 1185837 - RNA, 19 nt, Homo sapiens
gaagaaaugaguggcuuau

SEQ ID NO: 1185838 - RNA, 19 nt, Homo sapiens
gcccaacuacagauucuua

SEQ ID NO: 1185839 - RNA, 19 nt, Homo sapiens
ucuaagacuuugcuaacuu

SEQ ID NO: 1185840 - RNA, 19 nt, Homo sapiens
uguccaaguuuacucgaua

SEQ ID NO: 1185841 - RNA, 19 nt, Homo sapiens
gaaaugaguggcuuauacu

SEQ ID NO: 1185842 - RNA, 19 nt, Homo sapiens
gaaauaagagagagcaacu

SEQ ID NO: 1185843 - RNA, 19 nt, Homo sapiens
gguggcagauauuucaaga

SEQ ID NO: 1185844 - RNA, 19 nt, Homo sapiens
caaaggacaccguaaagca

SEQ ID NO: 1185845 - RNA, 19 nt, Homo sapiens
ccaucacacaguaguauua

SEQ ID NO: 1185846 - RNA, 19 nt, Homo sapiens
ccucaagguugcaagaaga

SEQ ID NO: 1185847 - RNA, 19 nt, Homo sapiens
gaaacaacuggaagcagaa

SEQ ID NO: 1185848 - RNA, 19 nt, Homo sapiens
cuaauuucuuggugaauga

SEQ ID NO: 1185849 - RNA, 19 nt, Homo sapiens
ggacaauauugaccaucug

SEQ ID NO: 1185850 - RNA, 19 nt, Homo sapiens
cuucaagggucauaucaau

SEQ ID NO: 1185851 - RNA, 19 nt, Homo sapiens
ggaauguagggaaaccaua

SEQ ID NO: 1185852 - RNA, 19 nt, Homo sapiens
aaggaugucucguaucuca

SEQ ID NO: 1185853 - RNA, 19 nt, Homo sapiens
caagaagaaauaagagaga

SEQ ID NO: 1185854 - RNA, 19 nt, Homo sapiens
ggaguccaaugugcugauu

SEQ ID NO: 1185855 - RNA, 19 nt, Homo sapiens
uaugaaggcacuguuauuu

SEQ ID NO: 1185856 - RNA, 19 nt, Homo sapiens
ccaguauagucucuaguau

SEQ ID NO: 1185857 - RNA, 19 nt, Homo sapiens
cgacaaagaccgaaaagaa

SEQ ID NO: 1185858 - RNA, 19 nt, Homo sapiens
gauuauauagcuuguggaa

SEQ ID NO: 1185859 - RNA, 19 nt, Homo sapiens
aaagcagucucuuaugcaa

SEQ ID NO: 1185860 - RNA, 19 nt, Homo sapiens
uggaguaguuaccauaaga

SEQ ID NO: 1185861 - RNA, 19 nt, Homo sapiens
caauauugaccaucuguau

SEQ ID NO: 1185862 - RNA, 19 nt, Homo sapiens
auagaugucccaaguguaa

SEQ ID NO: 1185863 - RNA, 19 nt, Homo sapiens
caaaaguguucucgacaaa

SEQ ID NO: 1185864 - RNA, 19 nt, Homo sapiens
auaacucucucuaccugua

SEQ ID NO: 1185865 - RNA, 19 nt, Homo sapiens
aaaccauacugccuacguu

SEQ ID NO: 1185866 - RNA, 19 nt, Homo sapiens
uguaucaguuggaguaguu

SEQ ID NO: 1185867 - RNA, 19 nt, Homo sapiens
gcaagccaguuggaugaau

SEQ ID NO: 1185868 - RNA, 19 nt, Homo sapiens
uuaagagaguggaagaaau

SEQ ID NO: 1185869 - RNA, 19 nt, Homo sapiens
aagaggauauuaagagagu

SEQ ID NO: 1185870 - RNA, 19 nt, Homo sapiens
gaagaaacaacuggaagca

SEQ ID NO: 1185871 - RNA, 19 nt, Homo sapiens
uauaauagcacguuagcau

SEQ ID NO: 1185872 - RNA, 19 nt, Homo sapiens
ggaaaagagguucaaauug

SEQ ID NO: 1185873 - RNA, 19 nt, Homo sapiens
uggcaagcauugaggcaaa

SEQ ID NO: 1185874 - RNA, 19 nt, Homo sapiens
guguuggaguguugacuuu

SEQ ID NO: 1185875 - RNA, 19 nt, Homo sapiens
ccaaguuuacucgauauaa

SEQ ID NO: 1185876 - RNA, 19 nt, Homo sapiens
gauugaagaagcauacaug

SEQ ID NO: 1185877 - RNA, 19 nt, Homo sapiens
caagauugguugggaacug

SEQ ID NO: 1185878 - RNA, 19 nt, Homo sapiens
ggaguaguuaccauaagaa

SEQ ID NO: 1185879 - RNA, 19 nt, Homo sapiens
caacuacagauucuuaugg

SEQ ID NO: 1185880 - RNA, 19 nt, Homo sapiens
gaacugaccaagauaaccu

SEQ ID NO: 1185881 - RNA, 19 nt, Homo sapiens
ggaaagaaauuugguguau

SEQ ID NO: 1185882 - RNA, 19 nt, Homo sapiens
ugacaaagaucauuggaaa

SEQ ID NO: 1185883 - RNA, 19 nt, Homo sapiens
aaacuccucuuucuucaua

SEQ ID NO: 1185884 - RNA, 19 nt, Homo sapiens
gaaauuguguguccaucuu

SEQ ID NO: 1185885 - RNA, 19 nt, Homo sapiens
aagcguaguuucugauuua

SEQ ID NO: 1185886 - RNA, 19 nt, Homo sapiens
uguagaagcugacuugaaa

SEQ ID NO: 1185887 - RNA, 19 nt, Homo sapiens
gguaggaaguaucauguaa

SEQ ID NO: 1185888 - RNA, 19 nt, Homo sapiens
aggaauaucuucuguugua

SEQ ID NO: 1185889 - RNA, 19 nt, Homo sapiens
uaaaugggcugucuucauc

SEQ ID NO: 1185890 - RNA, 19 nt, Homo sapiens
cuaaauggcucccugauuc

SEQ ID NO: 1185891 - RNA, 19 nt, Homo sapiens
ccaaauacuucaagggauu

SEQ ID NO: 1185892 - RNA, 19 nt, Homo sapiens
ggaagaagcacuccagaga

SEQ ID NO: 1185893 - RNA, 19 nt, Homo sapiens
guaaauacaaucacccaua

SEQ ID NO: 1185894 - RNA, 19 nt, Homo sapiens
caagaaagaugacacaacu

SEQ ID NO: 1185895 - RNA, 19 nt, Homo sapiens
gcugggaaauuucuauauu

SEQ ID NO: 1185896 - RNA, 19 nt, Homo sapiens
ccucagaacuacuauauuc

SEQ ID NO: 1185897 - RNA, 19 nt, Homo sapiens
aaacuuuacucccaagaaa

SEQ ID NO: 1185898 - RNA, 19 nt, Homo sapiens
gaacaguuuugcaguauaa

SEQ ID NO: 1185899 - RNA, 19 nt, Homo sapiens
cuaauaagcugugguagga

SEQ ID NO: 1185900 - RNA, 19 nt, Homo sapiens
guagaagcauuuccauuca

SEQ ID NO: 1185901 - RNA, 19 nt, Homo sapiens
gagcugcgcuugaaaucau

SEQ ID NO: 1185902 - RNA, 19 nt, Homo sapiens
ggaguucuaucuacccuau

SEQ ID NO: 1185903 - RNA, 19 nt, Homo sapiens
gaauguagaagcugacuug

SEQ ID NO: 1185904 - RNA, 19 nt, Homo sapiens
gaaagaaauuugguguauc

SEQ ID NO: 1185905 - RNA, 19 nt, Homo sapiens
gaaguaucauguaaucaca

SEQ ID NO: 1185906 - RNA, 19 nt, Homo sapiens
caaagaucauuggaaauug

SEQ ID NO: 1185907 - RNA, 19 nt, Homo sapiens
agaccuggaugaacaaauu

SEQ ID NO: 1185908 - RNA, 19 nt, Homo sapiens
uuagagagccacaggaaua

SEQ ID NO: 1185909 - RNA, 19 nt, Homo sapiens
ccgcaagcauggaaucuuu

SEQ ID NO: 1185910 - RNA, 19 nt, Homo sapiens
gaacuuggcuauggcugau

SEQ ID NO: 1185911 - RNA, 19 nt, Homo sapiens
gcauggaaucuuuauauga

SEQ ID NO: 1185912 - RNA, 19 nt, Homo sapiens
gaugguuucuuggcuuuaa

SEQ ID NO: 1185913 - RNA, 19 nt, Homo sapiens
aaagaugacacaacuauga

SEQ ID NO: 1185914 - RNA, 19 nt, Homo sapiens
ccaguuggccuuucucgua

SEQ ID NO: 1185915 - RNA, 19 nt, Homo sapiens
gcagauuccuuacagacau

SEQ ID NO: 1185916 - RNA, 19 nt, Homo sapiens
acacaacuaugacaaagau

SEQ ID NO: 1185917 - RNA, 19 nt, Homo sapiens
uaauggaguuggaacaaga

SEQ ID NO: 1185918 - RNA, 19 nt, Homo sapiens
ggcaacugcuuguagauau

SEQ ID NO: 1185919 - RNA, 19 nt, Homo sapiens
gcauucuucuguagacauu

SEQ ID NO: 1185920 - RNA, 19 nt, Homo sapiens
gaugggauguuuguuacuu

SEQ ID NO: 1185921 - RNA, 19 nt, Homo sapiens
uauauucaguggcuaaaug

SEQ ID NO: 1185922 - RNA, 19 nt, Homo sapiens
cagcauucaugguguaaga

SEQ ID NO: 1185923 - RNA, 19 nt, Homo sapiens
caucagcauucauggugua

SEQ ID NO: 1185924 - RNA, 19 nt, Homo sapiens
uauaugaucucugggaguu

SEQ ID NO: 1185925 - RNA, 19 nt, Homo sapiens
gggaugguuucuuggcuuu

SEQ ID NO: 1185926 - RNA, 19 nt, Homo sapiens
gaaacuuuacucccaagaa

SEQ ID NO: 1185927 - RNA, 19 nt, Homo sapiens
gaaugauacugauuagacu

SEQ ID NO: 1185928 - RNA, 19 nt, Homo sapiens
cagauuccuuacagacaua

SEQ ID NO: 1185929 - RNA, 19 nt, Homo sapiens
cuugguggcuuguaauauu

SEQ ID NO: 1185930 - RNA, 19 nt, Homo sapiens
ggaauccgagcccgcauuu

SEQ ID NO: 1185931 - RNA, 19 nt, Homo sapiens
gcuuuaaguccacugaaua

SEQ ID NO: 1185932 - RNA, 19 nt, Homo sapiens
cguaguuucugauuuaugu

SEQ ID NO: 1185933 - RNA, 19 nt, Homo sapiens
gauacugauuagacuuuga

SEQ ID NO: 1185934 - RNA, 19 nt, Homo sapiens
guauaacacgaucugauaa

SEQ ID NO: 1185935 - RNA, 19 nt, Homo sapiens
uaagaacaguuuugcagua

SEQ ID NO: 1185936 - RNA, 19 nt, Homo sapiens
uaggaaguaucauguaauc

SEQ ID NO: 1185937 - RNA, 19 nt, Homo sapiens
gcaacugcuuguagauauc

SEQ ID NO: 1185938 - RNA, 19 nt, Homo sapiens
cagccaagccuucuguaaa

SEQ ID NO: 1185939 - RNA, 19 nt, Homo sapiens
gggaguccacgauauguuu

SEQ ID NO: 1185940 - RNA, 19 nt, Homo sapiens
cuucaucgguggaauacaa

SEQ ID NO: 1185941 - RNA, 19 nt, Homo sapiens
ggucaugcuucuucuucuu

SEQ ID NO: 1185942 - RNA, 19 nt, Homo sapiens
uguuggagcuguaaugguu

SEQ ID NO: 1185943 - RNA, 19 nt, Homo sapiens
gccauucucuacguuguuu

SEQ ID NO: 1185944 - RNA, 19 nt, Homo sapiens
gaaagaugacacaacuaug

SEQ ID NO: 1185945 - RNA, 19 nt, Homo sapiens
uacaaucacccauaugaaa

SEQ ID NO: 1185946 - RNA, 19 nt, Homo sapiens
agaaagaugacacaacuau

SEQ ID NO: 1185947 - RNA, 19 nt, Homo sapiens
gcuaaauggcucccugauu

SEQ ID NO: 1185948 - RNA, 19 nt, Homo sapiens
cauaguugccaguguuuaa

SEQ ID NO: 1185949 - RNA, 19 nt, Homo sapiens
cacgauauguuuccuucuu

SEQ ID NO: 1185950 - RNA, 19 nt, Homo sapiens
cccgagaacuccagauuca

SEQ ID NO: 1185951 - RNA, 19 nt, Homo sapiens
guuaugguucuccuucuua

SEQ ID NO: 1185952 - RNA, 19 nt, Homo sapiens
gcacuccagagacgacuaa

SEQ ID NO: 1185953 - RNA, 19 nt, Homo sapiens
uugaagaccuggaugaaca

SEQ ID NO: 1185954 - RNA, 19 nt, Homo sapiens
aaagcguaguuucugauuu

SEQ ID NO: 1185955 - RNA, 19 nt, Homo sapiens
cccauuauguacuuuauuc

SEQ ID NO: 1185956 - RNA, 19 nt, Homo sapiens
cauaaucuacgaagaacuu

SEQ ID NO: 1185957 - RNA, 19 nt, Homo sapiens
gggaaagaaauuuggugua

SEQ ID NO: 1185958 - RNA, 19 nt, Homo sapiens
cagaugaacaagaagauga

SEQ ID NO: 1185959 - RNA, 19 nt, Homo sapiens
cuucagcacucauugacaa

SEQ ID NO: 1185960 - RNA, 19 nt, Homo sapiens
uuauugggaugguuucuug

SEQ ID NO: 1185961 - RNA, 19 nt, Homo sapiens
aguauaacacgaucugaua

SEQ ID NO: 1185962 - RNA, 19 nt, Homo sapiens
guucacagcaucagcauuc

SEQ ID NO: 1185963 - RNA, 19 nt, Homo sapiens
gagcuguaaugguugcaau

SEQ ID NO: 1185964 - RNA, 19 nt, Homo sapiens
cugggaaauuucuauauug

SEQ ID NO: 1185965 - RNA, 19 nt, Homo sapiens
ccuauugguugaugaaaca

SEQ ID NO: 1185966 - RNA, 19 nt, Homo sapiens
guaucccgcuguuaugguu

SEQ ID NO: 1185967 - RNA, 19 nt, Homo sapiens
aaagaaauuugguguaucc

SEQ ID NO: 1185968 - RNA, 19 nt, Homo sapiens
gaacaagaagaugaagaug

SEQ ID NO: 1185969 - RNA, 19 nt, Homo sapiens
gcaagcauggaaucuuuau

SEQ ID NO: 1185970 - RNA, 19 nt, Homo sapiens
caaacuccgggacuucuaa

SEQ ID NO: 1185971 - RNA, 19 nt, Homo sapiens
gcaaacuccgggacuucua

SEQ ID NO: 1185972 - RNA, 19 nt, Homo sapiens
guaaaugggcaucagaaag

SEQ ID NO: 1185973 - RNA, 19 nt, Homo sapiens
gcucugcucugccugugau

SEQ ID NO: 1185974 - RNA, 19 nt, Homo sapiens
gagaaaaucagaugaacaa

SEQ ID NO: 1185975 - RNA, 19 nt, Homo sapiens
cuauaaaugccgaguggua

SEQ ID NO: 1185976 - RNA, 19 nt, Homo sapiens
cauugugucugguccgaaa

SEQ ID NO: 1185977 - RNA, 19 nt, Homo sapiens
ugacacaacuaugacaaag

SEQ ID NO: 1185978 - RNA, 19 nt, Homo sapiens
gaagccaacaauucuugaa

SEQ ID NO: 1185979 - RNA, 19 nt, Homo sapiens
guuacucauucuugggaua

SEQ ID NO: 1185980 - RNA, 19 nt, Homo sapiens
gaaaaucagaugaacaaga

SEQ ID NO: 1185981 - RNA, 19 nt, Homo sapiens
gcuaauaccuccagaaaua

SEQ ID NO: 1185982 - RNA, 19 nt, Homo sapiens
gaugaaggcucuagucuua

SEQ ID NO: 1185983 - RNA, 19 nt, Homo sapiens
gauauucacuggcuuauuu

SEQ ID NO: 1185984 - RNA, 19 nt, Homo sapiens
ggaaaucacugccacacua

SEQ ID NO: 1185985 - RNA, 19 nt, Homo sapiens
ggaagcauaugauaaauug

SEQ ID NO: 1185986 - RNA, 19 nt, Homo sapiens
ccaaagcuaugaacuuaua

SEQ ID NO: 1185987 - RNA, 19 nt, Homo sapiens
gaauuuagcuaagcaguuu

SEQ ID NO: 1185988 - RNA, 19 nt, Homo sapiens
ggaaugacaucaaugaguu

SEQ ID NO: 1185989 - RNA, 19 nt, Homo sapiens
gauguacucccuagaauua

SEQ ID NO: 1185990 - RNA, 19 nt, Homo sapiens
caucugaaguugacauuaa

SEQ ID NO: 1185991 - RNA, 19 nt, Homo sapiens
ugauaaagaugacauggua

SEQ ID NO: 1185992 - RNA, 19 nt, Homo sapiens
gauaauuggcuaccucuua

SEQ ID NO: 1185993 - RNA, 19 nt, Homo sapiens
guccaaagcuaugaacuua

SEQ ID NO: 1185994 - RNA, 19 nt, Homo sapiens
gaagauauucacuggcuua

SEQ ID NO: 1185995 - RNA, 19 nt, Homo sapiens
gcuaugaacuuauaugaag

SEQ ID NO: 1185996 - RNA, 19 nt, Homo sapiens
uuacuaaccugcugucaaa

SEQ ID NO: 1185997 - RNA, 19 nt, Homo sapiens
caacguagcaauccuguuu

SEQ ID NO: 1185998 - RNA, 19 nt, Homo sapiens
uaacuuugguucaagauga

SEQ ID NO: 1185999 - RNA, 19 nt, Homo sapiens
ugauacagaugaaguguuu

SEQ ID NO: 1186000 - RNA, 19 nt, Homo sapiens
uggaagaagugcuugauaa

SEQ ID NO: 1186001 - RNA, 19 nt, Homo sapiens
gcaccaggcugaauauucu

SEQ ID NO: 1186002 - RNA, 19 nt, Homo sapiens
gauggaaguuuacaagaau

SEQ ID NO: 1186003 - RNA, 19 nt, Homo sapiens
gaaguugaaucucgagcaa

SEQ ID NO: 1186004 - RNA, 19 nt, Homo sapiens
ucacacaccucacuuguuc

SEQ ID NO: 1186005 - RNA, 19 nt, Homo sapiens
uaacugccauuccaaguga

SEQ ID NO: 1186006 - RNA, 19 nt, Homo sapiens
gcgaagugcugcauuggaa

SEQ ID NO: 1186007 - RNA, 19 nt, Homo sapiens
cacaggaucucuugaaguu

SEQ ID NO: 1186008 - RNA, 19 nt, Homo sapiens
cagcggauguuguguugua

SEQ ID NO: 1186009 - RNA, 19 nt, Homo sapiens
ggaagaagugcuugauaaa

SEQ ID NO: 1186010 - RNA, 19 nt, Homo sapiens
gcaacacggcacuuucuua

SEQ ID NO: 1186011 - RNA, 19 nt, Homo sapiens
guagcaauccuguuuaauu

SEQ ID NO: 1186012 - RNA, 19 nt, Homo sapiens
gaagcccaccucuuaauuu

SEQ ID NO: 1186013 - RNA, 19 nt, Homo sapiens
aagaagugcuugauaaaga

SEQ ID NO: 1186014 - RNA, 19 nt, Homo sapiens
caacacggcacuuucuuaa

SEQ ID NO: 1186015 - RNA, 19 nt, Homo sapiens
gaagagaaagggcaaacuu

SEQ ID NO: 1186016 - RNA, 19 nt, Homo sapiens
caacaugcaguucaaguuu

SEQ ID NO: 1186017 - RNA, 19 nt, Homo sapiens
ccagauggcacaagaaauu

SEQ ID NO: 1186018 - RNA, 19 nt, Homo sapiens
caagaccugcuucucauua

SEQ ID NO: 1186019 - RNA, 19 nt, Homo sapiens
gcacauauggacacagaaa

SEQ ID NO: 1186020 - RNA, 19 nt, Homo sapiens
gcaagcagcacuccuccua

SEQ ID NO: 1186021 - RNA, 19 nt, Homo sapiens
ugugagaacugguggaauu

SEQ ID NO: 1186022 - RNA, 19 nt, Homo sapiens
gaaagggcaaacuuaguaa

SEQ ID NO: 1186023 - RNA, 19 nt, Homo sapiens
ucucagaguuucagaaguu

SEQ ID NO: 1186024 - RNA, 19 nt, Homo sapiens
gaagaaagaguaacaagac

SEQ ID NO: 1186025 - RNA, 19 nt, Homo sapiens
ggaaugcuaggaagaauug

SEQ ID NO: 1186026 - RNA, 19 nt, Homo sapiens
ccaccuagcugcuccagau

SEQ ID NO: 1186027 - RNA, 19 nt, Homo sapiens
gacugucaaucucauuaua

SEQ ID NO: 1186028 - RNA, 19 nt, Homo sapiens
ggucgaaacauuacuauca

SEQ ID NO: 1186029 - RNA, 19 nt, Homo sapiens
ugauggaaguuuacaagaa

SEQ ID NO: 1186030 - RNA, 19 nt, Homo sapiens
gaaauuugacugccaaugg

SEQ ID NO: 1186031 - RNA, 19 nt, Homo sapiens
cagcgauucuuaagaguga

SEQ ID NO: 1186032 - RNA, 19 nt, Homo sapiens
gggcaaacuuaguaauuca

SEQ ID NO: 1186033 - RNA, 19 nt, Homo sapiens
agaaagggcaaacuuagua

SEQ ID NO: 1186034 - RNA, 19 nt, Homo sapiens
ucaaugaguucggagguuu

SEQ ID NO: 1186035 - RNA, 19 nt, Homo sapiens
gagaacugguggaauuuag

SEQ ID NO: 1186036 - RNA, 19 nt, Homo sapiens
gacaaacauuuccauaaag

SEQ ID NO: 1186037 - RNA, 19 nt, Homo sapiens
cauggaagcauaugauaaa

SEQ ID NO: 1186038 - RNA, 19 nt, Homo sapiens
cagcaagacccaguuauuu

SEQ ID NO: 1186039 - RNA, 19 nt, Homo sapiens
uaagagugauaaaccaaga

SEQ ID NO: 1186040 - RNA, 19 nt, Homo sapiens
ccauuaagcauucaucuga

SEQ ID NO: 1186041 - RNA, 19 nt, Homo sapiens
caggaucucuugaaguuuc

SEQ ID NO: 1186042 - RNA, 19 nt, Homo sapiens
cggcaaagaauagauguua

SEQ ID NO: 1186043 - RNA, 19 nt, Homo sapiens
cagcagcgauucuuaagag

SEQ ID NO: 1186044 - RNA, 19 nt, Homo sapiens
aaaccaaacagcaguauug

SEQ ID NO: 1186045 - RNA, 19 nt, Homo sapiens
gcgaagcuuucuacacguu

SEQ ID NO: 1186046 - RNA, 19 nt, Homo sapiens
gcaaagaauagauguuaca

SEQ ID NO: 1186047 - RNA, 19 nt, Homo sapiens
uaugaagccugccuuacuu

SEQ ID NO: 1186048 - RNA, 19 nt, Homo sapiens
gaugacaaacauuuccaua

SEQ ID NO: 1186049 - RNA, 19 nt, Homo sapiens
gguggucuccuuuguguaa

SEQ ID NO: 1186050 - RNA, 19 nt, Homo sapiens
gaacuuuucuccuccuuug

SEQ ID NO: 1186051 - RNA, 19 nt, Homo sapiens
gcaauaagagcagaucuca

SEQ ID NO: 1186052 - RNA, 19 nt, Homo sapiens
aguugaaucucgagcaaua

SEQ ID NO: 1186053 - RNA, 19 nt, Homo sapiens
ccucuuagcugaugauacu

SEQ ID NO: 1186054 - RNA, 19 nt, Homo sapiens
uugaugaucucuaugaaga

SEQ ID NO: 1186055 - RNA, 19 nt, Homo sapiens
ugaacuggucgaaacauua

SEQ ID NO: 1186056 - RNA, 19 nt, Homo sapiens
gcucuagucuuaggagguu

SEQ ID NO: 1186057 - RNA, 19 nt, Homo sapiens
agcaggaccuugcaaauga

SEQ ID NO: 1186058 - RNA, 19 nt, Homo sapiens
gagcaggaccuugcaaaug

SEQ ID NO: 1186059 - RNA, 19 nt, Homo sapiens
gaaguugcacauaaacaga

SEQ ID NO: 1186060 - RNA, 19 nt, Homo sapiens
gugcagaggacauugauga

SEQ ID NO: 1186061 - RNA, 19 nt, Homo sapiens
gaagaagugcuugauaaag

SEQ ID NO: 1186062 - RNA, 19 nt, Homo sapiens
ugguauacauggaagcaua

SEQ ID NO: 1186063 - RNA, 19 nt, Homo sapiens
gcccaccucuuaauuucuu

SEQ ID NO: 1186064 - RNA, 19 nt, Homo sapiens
gcaagacccaguuauuuac

SEQ ID NO: 1186065 - RNA, 19 nt, Homo sapiens
cagcagaagaagagcaaua

SEQ ID NO: 1186066 - RNA, 19 nt, Homo sapiens
ggaauuuagcuaagcaguu

SEQ ID NO: 1186067 - RNA, 19 nt, Homo sapiens
aagagaaagggcaaacuua

SEQ ID NO: 1186068 - RNA, 19 nt, Homo sapiens
guggggaucuccagcauua

SEQ ID NO: 1186069 - RNA, 19 nt, Homo sapiens
uaccagagauuagcagaug

SEQ ID NO: 1186070 - RNA, 19 nt, Homo sapiens
gaacuggucgaaacauuac

SEQ ID NO: 1186071 - RNA, 19 nt, Homo sapiens
gaaaccaaacagcaguauu

SEQ ID NO: 1186072 - RNA, 19 nt, Homo sapiens
agcaagacccaguuauuua

SEQ ID NO: 1186073 - RNA, 19 nt, Homo sapiens
gucgaaacauuacuaucaa

SEQ ID NO: 1186074 - RNA, 19 nt, Homo sapiens
gaauuaggaaugacaucaa

SEQ ID NO: 1186075 - RNA, 19 nt, Homo sapiens
gcagaugugucagcaagag

SEQ ID NO: 1186076 - RNA, 19 nt, Homo sapiens
agccgaagcccaccucuua

SEQ ID NO: 1186077 - RNA, 19 nt, Homo sapiens
ccagaugggcaaagauauu

SEQ ID NO: 1186078 - RNA, 19 nt, Homo sapiens
guauaccucuucugacaag

SEQ ID NO: 1186079 - RNA, 19 nt, Homo sapiens
ggaggaagaaauaagugaa

SEQ ID NO: 1186080 - RNA, 19 nt, Homo sapiens
gaagugcugcauuggaaga

SEQ ID NO: 1186081 - RNA, 19 nt, Homo sapiens
gaaagcaaauuggcaaaua

SEQ ID NO: 1186082 - RNA, 19 nt, Homo sapiens
gcagagagcuccaccguau

SEQ ID NO: 1186083 - RNA, 19 nt, Homo sapiens
caaagcagguaaauuguaa

SEQ ID NO: 1186084 - RNA, 19 nt, Homo sapiens
guacauacuugguuguuaa

SEQ ID NO: 1186085 - RNA, 19 nt, Homo sapiens
gcagguaaauuguaaaugu

SEQ ID NO: 1186086 - RNA, 19 nt, Homo sapiens
gaagggcacuuuccuaugu

SEQ ID NO: 1186087 - RNA, 19 nt, Homo sapiens
ugaaagguguccaugguua

SEQ ID NO: 1186088 - RNA, 19 nt, Homo sapiens
guagacacguuaguuauaa

SEQ ID NO: 1186089 - RNA, 19 nt, Homo sapiens
caaagggaaucugagaaua

SEQ ID NO: 1186090 - RNA, 19 nt, Homo sapiens
gcugaaagauauauucgaa

SEQ ID NO: 1186091 - RNA, 19 nt, Homo sapiens
gaucuagacaucugaauuu

SEQ ID NO: 1186092 - RNA, 19 nt, Homo sapiens
uuacggaguuguuccuuua

SEQ ID NO: 1186093 - RNA, 19 nt, Homo sapiens
ggugacacguuccuucaua

SEQ ID NO: 1186094 - RNA, 19 nt, Homo sapiens
caccuuguaucucuaaaua

SEQ ID NO: 1186095 - RNA, 19 nt, Homo sapiens
gaagaacaccucugcaugu

SEQ ID NO: 1186096 - RNA, 19 nt, Homo sapiens
gaacagauccgacguaucc

SEQ ID NO: 1186097 - RNA, 19 nt, Homo sapiens
caagugaauuguugcuauu

SEQ ID NO: 1186098 - RNA, 19 nt, Homo sapiens
ggaacucauucgccucuuu

SEQ ID NO: 1186099 - RNA, 19 nt, Homo sapiens
gaaaucaacagccucauuc

SEQ ID NO: 1186100 - RNA, 19 nt, Homo sapiens
gcacuucacaugcuggaua

SEQ ID NO: 1186101 - RNA, 19 nt, Homo sapiens
gcaguugcauggaagagaa

SEQ ID NO: 1186102 - RNA, 19 nt, Homo sapiens
gccaagcuguggaugauuu

SEQ ID NO: 1186103 - RNA, 19 nt, Homo sapiens
guagggaauugcaugcuuu

SEQ ID NO: 1186104 - RNA, 19 nt, Homo sapiens
gaugaaagguguccauggu

SEQ ID NO: 1186105 - RNA, 19 nt, Homo sapiens
gaaaagaacaagugaauug

SEQ ID NO: 1186106 - RNA, 19 nt, Homo sapiens
gcagcugaguacuuaaauu

SEQ ID NO: 1186107 - RNA, 19 nt, Homo sapiens
gagaacagauccgacguau

SEQ ID NO: 1186108 - RNA, 19 nt, Homo sapiens
gaaccaguccauucacauu

SEQ ID NO: 1186109 - RNA, 19 nt, Homo sapiens
gaauguauuuggcuuugau

SEQ ID NO: 1186110 - RNA, 19 nt, Homo sapiens
ggacaggcuucagucauug

SEQ ID NO: 1186111 - RNA, 19 nt, Homo sapiens
gcaggaagaaagcaaauug

SEQ ID NO: 1186112 - RNA, 19 nt, Homo sapiens
aaagguaaauacagcauug

SEQ ID NO: 1186113 - RNA, 19 nt, Homo sapiens
ggcuuacccucuagaauuu

SEQ ID NO: 1186114 - RNA, 19 nt, Homo sapiens
gagaagggcacuuuccuau

SEQ ID NO: 1186115 - RNA, 19 nt, Homo sapiens
gaagggagcagacccaagu

SEQ ID NO: 1186116 - RNA, 19 nt, Homo sapiens
gauaugaaccaguccauuc

SEQ ID NO: 1186117 - RNA, 19 nt, Homo sapiens
gcacuuuccuauguucuug

SEQ ID NO: 1186118 - RNA, 19 nt, Homo sapiens
uggcaaauauuucccaaga

SEQ ID NO: 1186119 - RNA, 19 nt, Homo sapiens
uugcacagcuucagcauga

SEQ ID NO: 1186120 - RNA, 19 nt, Homo sapiens
gcaaaaugaugcucacuug

SEQ ID NO: 1186121 - RNA, 19 nt, Homo sapiens
ggccagcucuguugcauuc

SEQ ID NO: 1186122 - RNA, 19 nt, Homo sapiens
ugaagaacacaguaucaua

SEQ ID NO: 1186123 - RNA, 19 nt, Homo sapiens
gauaaugugccaugauguu

SEQ ID NO: 1186124 - RNA, 19 nt, Homo sapiens
agagagcuccaccguauua

SEQ ID NO: 1186125 - RNA, 19 nt, Homo sapiens
gaucaaagggaaucugaga

SEQ ID NO: 1186126 - RNA, 19 nt, Homo sapiens
cuagacaucugaauuugau

SEQ ID NO: 1186127 - RNA, 19 nt, Homo sapiens
guaaucaguuuguggaucu

SEQ ID NO: 1186128 - RNA, 19 nt, Homo sapiens
gcugaguacuuaaauucuu

SEQ ID NO: 1186129 - RNA, 19 nt, Homo sapiens
ggaguacaguggcaugauc

SEQ ID NO: 1186130 - RNA, 19 nt, Homo sapiens
gguuagaauuugaucuuug

SEQ ID NO: 1186131 - RNA, 19 nt, Homo sapiens
ugauggaccugcuugcaaa

SEQ ID NO: 1186132 - RNA, 19 nt, Homo sapiens
ggauugaucacauuguuug

SEQ ID NO: 1186133 - RNA, 19 nt, Homo sapiens
uuucaaagcagguaaauug

SEQ ID NO: 1186134 - RNA, 19 nt, Homo sapiens
guuaggcaguccugaugua

SEQ ID NO: 1186135 - RNA, 19 nt, Homo sapiens
gcauuuggcagcugaagaa

SEQ ID NO: 1186136 - RNA, 19 nt, Homo sapiens
uccaugaacuccagagaaa

SEQ ID NO: 1186137 - RNA, 19 nt, Homo sapiens
ggagaagggcacuuuccua

SEQ ID NO: 1186138 - RNA, 19 nt, Homo sapiens
uaccugagccuucugagua

SEQ ID NO: 1186139 - RNA, 19 nt, Homo sapiens
uaauuucucuuggcagauu

SEQ ID NO: 1186140 - RNA, 19 nt, Homo sapiens
ggagaacagauccgacgua

SEQ ID NO: 1186141 - RNA, 19 nt, Homo sapiens
acaaugcugugguccauga

SEQ ID NO: 1186142 - RNA, 19 nt, Homo sapiens
ggcacgagauggccucuga

SEQ ID NO: 1186143 - RNA, 19 nt, Homo sapiens
gaucuuugcaaacuguaua

SEQ ID NO: 1186144 - RNA, 19 nt, Homo sapiens
acauagaccauuugccuua

SEQ ID NO: 1186145 - RNA, 19 nt, Homo sapiens
gcacauccgaagucauaaa

SEQ ID NO: 1186146 - RNA, 19 nt, Homo sapiens
gaauaagagucugguugau

SEQ ID NO: 1186147 - RNA, 19 nt, Homo sapiens
ucacugccauucucaaaca

SEQ ID NO: 1186148 - RNA, 19 nt, Homo sapiens
caaaccaacucuggaauac

SEQ ID NO: 1186149 - RNA, 19 nt, Homo sapiens
ccacagaaccagcauguag

SEQ ID NO: 1186150 - RNA, 19 nt, Homo sapiens
ccuuguaucucuaaauaug

SEQ ID NO: 1186151 - RNA, 19 nt, Homo sapiens
ggaauguauuuggcuuuga

SEQ ID NO: 1186152 - RNA, 19 nt, Homo sapiens
uaaagcagauggggaguua

SEQ ID NO: 1186153 - RNA, 19 nt, Homo sapiens
cacuaagucuuuguagaua

SEQ ID NO: 1186154 - RNA, 19 nt, Homo sapiens
ucaaagcagguaaauugua

SEQ ID NO: 1186155 - RNA, 19 nt, Homo sapiens
guauuuggcuuugauuaca

SEQ ID NO: 1186156 - RNA, 19 nt, Homo sapiens
ugaagaagcaaaucuggaa

SEQ ID NO: 1186157 - RNA, 19 nt, Homo sapiens
ccacaaaccaacucuggaa

SEQ ID NO: 1186158 - RNA, 19 nt, Homo sapiens
ucuguugcauucccaauuu

SEQ ID NO: 1186159 - RNA, 19 nt, Homo sapiens
uggacaggcuucagucauu

SEQ ID NO: 1186160 - RNA, 19 nt, Homo sapiens
gcaaauguaaguuguuucu

SEQ ID NO: 1186161 - RNA, 19 nt, Homo sapiens
uggcaaauguaaguuguuu

SEQ ID NO: 1186162 - RNA, 19 nt, Homo sapiens
gaccauuugccuuauauug

SEQ ID NO: 1186163 - RNA, 19 nt, Homo sapiens
gaacagccagugcauuugg

SEQ ID NO: 1186164 - RNA, 19 nt, Homo sapiens
gggagagcauggaagaugu

SEQ ID NO: 1186165 - RNA, 19 nt, Homo sapiens
aagggaaucugagaauauu

SEQ ID NO: 1186166 - RNA, 19 nt, Homo sapiens
ucacuaagucuuuguagau

SEQ ID NO: 1186167 - RNA, 19 nt, Homo sapiens
ggaucuagacaucugaauu

SEQ ID NO: 1186168 - RNA, 19 nt, Homo sapiens
uggcagauuugcauauuuc

SEQ ID NO: 1186169 - RNA, 19 nt, Homo sapiens
gcaaaucuggaacucauuc

SEQ ID NO: 1186170 - RNA, 19 nt, Homo sapiens
aaugaacaccacacaguua

SEQ ID NO: 1186171 - RNA, 19 nt, Homo sapiens
acaaaccaacucuggaaua

SEQ ID NO: 1186172 - RNA, 19 nt, Homo sapiens
gaauugaagaacacaguau

SEQ ID NO: 1186173 - RNA, 19 nt, Homo sapiens
gcacuccucgccuggcuaa

SEQ ID NO: 1186174 - RNA, 19 nt, Homo sapiens
uaucugggaucuagacauc

SEQ ID NO: 1186175 - RNA, 19 nt, Homo sapiens
caguaucgguugacacaau

SEQ ID NO: 1186176 - RNA, 19 nt, Homo sapiens
aagcaaaucuggaacucau

SEQ ID NO: 1186177 - RNA, 19 nt, Homo sapiens
aauaagagucugguugaua

SEQ ID NO: 1186178 - RNA, 19 nt, Homo sapiens
aggcuucccuguaccagua

SEQ ID NO: 1186179 - RNA, 19 nt, Homo sapiens
cucuaaauauggugugaua

SEQ ID NO: 1186180 - RNA, 19 nt, Homo sapiens
aagauacccuuuggauuga

SEQ ID NO: 1186181 - RNA, 19 nt, Homo sapiens
gaaaguaacugggauaucu

SEQ ID NO: 1186182 - RNA, 19 nt, Homo sapiens
ggacgcugcuucuacauaa

SEQ ID NO: 1186183 - RNA, 19 nt, Homo sapiens
gcaaagggcuucagaucug

SEQ ID NO: 1186184 - RNA, 19 nt, Homo sapiens
uaacugggauaucuucaua

SEQ ID NO: 1186185 - RNA, 19 nt, Homo sapiens
gaacaaugauguccugcaa

SEQ ID NO: 1186186 - RNA, 19 nt, Homo sapiens
gaacugagaagacuuacaa

SEQ ID NO: 1186187 - RNA, 19 nt, Homo sapiens
gagaagagguucaagugau

SEQ ID NO: 1186188 - RNA, 19 nt, Homo sapiens
gaagagaccgcccuuacaa

SEQ ID NO: 1186189 - RNA, 19 nt, Homo sapiens
gaggauaucccuuuaaauc

SEQ ID NO: 1186190 - RNA, 19 nt, Homo sapiens
ugagggagcuucucuaaag

SEQ ID NO: 1186191 - RNA, 19 nt, Homo sapiens
gagaagacuuacaagagaa

SEQ ID NO: 1186192 - RNA, 19 nt, Homo sapiens
ugagaagacuuacaagaga

SEQ ID NO: 1186193 - RNA, 19 nt, Homo sapiens
ccaaaugacugucucuauc

SEQ ID NO: 1186194 - RNA, 19 nt, Homo sapiens
ccagaaagccucacauugu

SEQ ID NO: 1186195 - RNA, 19 nt, Homo sapiens
gaggaaagugaguggauua

SEQ ID NO: 1186196 - RNA, 19 nt, Homo sapiens
cuuuaaaucucccaaauga

SEQ ID NO: 1186197 - RNA, 19 nt, Homo sapiens
cagaggagguggugguauu

SEQ ID NO: 1186198 - RNA, 19 nt, Homo sapiens
ugacagugcuggcuacaau

SEQ ID NO: 1186199 - RNA, 19 nt, Homo sapiens
ccaagaacuuaacgacuga

SEQ ID NO: 1186200 - RNA, 19 nt, Homo sapiens
ggauaucccuuuaaaucuc

SEQ ID NO: 1186201 - RNA, 19 nt, Homo sapiens
uacauaaaguggcauggua

SEQ ID NO: 1186202 - RNA, 19 nt, Homo sapiens
gaaagugaguggauuaacc

SEQ ID NO: 1186203 - RNA, 19 nt, Homo sapiens
gaaggucgguuagauuugg

SEQ ID NO: 1186204 - RNA, 19 nt, Homo sapiens
caagagaaccuccuaagag

SEQ ID NO: 1186205 - RNA, 19 nt, Homo sapiens
aaagaacugagaagacuua

SEQ ID NO: 1186206 - RNA, 19 nt, Homo sapiens
agaagagguucaagugauu

SEQ ID NO: 1186207 - RNA, 19 nt, Homo sapiens
caagaaggucgguuagauu

SEQ ID NO: 1186208 - RNA, 19 nt, Homo sapiens
gagcagugccucucucaga

SEQ ID NO: 1186209 - RNA, 19 nt, Homo sapiens
uaaaagaggucuagaugug

SEQ ID NO: 1186210 - RNA, 19 nt, Homo sapiens
ggacacagacccugaagag

SEQ ID NO: 1186211 - RNA, 19 nt, Homo sapiens
cuacauaaauucacugacu

SEQ ID NO: 1186212 - RNA, 19 nt, Homo sapiens
gagggagcuucucuaaaga

SEQ ID NO: 1186213 - RNA, 19 nt, Homo sapiens
gggccgaaguuguuucaug

SEQ ID NO: 1186214 - RNA, 19 nt, Homo sapiens
gagaaccuccuaagaguca

SEQ ID NO: 1186215 - RNA, 19 nt, Homo sapiens
gcagugccucucucagaua

SEQ ID NO: 1186216 - RNA, 19 nt, Homo sapiens
ggaaggaccaagcggaaga

SEQ ID NO: 1186217 - RNA, 19 nt, Homo sapiens
gcauugcugcuguggauaa

SEQ ID NO: 1186218 - RNA, 19 nt, Homo sapiens
gcaggugucucuggcugaa

SEQ ID NO: 1186219 - RNA, 19 nt, Homo sapiens
uggagaagcugagagaaga

SEQ ID NO: 1186220 - RNA, 19 nt, Homo sapiens
gagugugacuugagguguu

SEQ ID NO: 1186221 - RNA, 19 nt, Homo sapiens
acaagaaggucgguuagau

SEQ ID NO: 1186222 - RNA, 19 nt, Homo sapiens
gaacagccaggacaagaag

SEQ ID NO: 1186223 - RNA, 19 nt, Homo sapiens
caaacaaucggcugagaau

SEQ ID NO: 1186224 - RNA, 19 nt, Homo sapiens
aagagaaccuccuaagagu

SEQ ID NO: 1186225 - RNA, 19 nt, Homo sapiens
ggugagggagcuucucuaa

SEQ ID NO: 1186226 - RNA, 19 nt, Homo sapiens
cccagcagccuauaugaua

SEQ ID NO: 1186227 - RNA, 19 nt, Homo sapiens
uugaggauaucccuuuaaa

SEQ ID NO: 1186228 - RNA, 19 nt, Homo sapiens
aaacauauuuccggucauc

SEQ ID NO: 1186229 - RNA, 19 nt, Homo sapiens
ggugauagcacacucagau

SEQ ID NO: 1186230 - RNA, 19 nt, Homo sapiens
gcccaaccaugacacucua

SEQ ID NO: 1186231 - RNA, 19 nt, Homo sapiens
ugccaaagcccaaccauga

SEQ ID NO: 1186232 - RNA, 19 nt, Homo sapiens
ucucucagauacaagaauu

SEQ ID NO: 1186233 - RNA, 19 nt, Homo sapiens
cacagacccugaagaggaa

SEQ ID NO: 1186234 - RNA, 19 nt, Homo sapiens
aagaaggucgguuagauuu

SEQ ID NO: 1186235 - RNA, 19 nt, Homo sapiens
gagacacggugcccagcuu

SEQ ID NO: 1186236 - RNA, 19 nt, Homo sapiens
caacuucaccagccucuuc

SEQ ID NO: 1186237 - RNA, 19 nt, Homo sapiens
gaaccgcgugcgcaacaaa

SEQ ID NO: 1186238 - RNA, 19 nt, Homo sapiens
agucggagcugguguccaa

SEQ ID NO: 1186239 - RNA, 19 nt, Homo sapiens
cucuaugccuuuacuuaua

SEQ ID NO: 1186240 - RNA, 19 nt, Homo sapiens
gcuccugaaucuucugaug

SEQ ID NO: 1186241 - RNA, 19 nt, Homo sapiens
cuuguucccuguuaucauu

SEQ ID NO: 1186242 - RNA, 19 nt, Homo sapiens
gugagaggcugguguucug

SEQ ID NO: 1186243 - RNA, 19 nt, Homo sapiens
ugauagcacacucagauaa

SEQ ID NO: 1186244 - RNA, 19 nt, Homo sapiens
agauguggauggcauuuau

SEQ ID NO: 1186245 - RNA, 19 nt, Homo sapiens
ggcgcaagcucaggaagaa

SEQ ID NO: 1186246 - RNA, 19 nt, Homo sapiens
caaccugggaauuguguuu

SEQ ID NO: 1186247 - RNA, 19 nt, Homo sapiens
gaauuaauaggcucaaugc

SEQ ID NO: 1186248 - RNA, 19 nt, Homo sapiens
ggacaagaaggucgguuag

SEQ ID NO: 1186249 - RNA, 19 nt, Homo sapiens
gaagaggaacaaugauguc

SEQ ID NO: 1186250 - RNA, 19 nt, Homo sapiens
caaaugacugucucuaucu

SEQ ID NO: 1186251 - RNA, 19 nt, Homo sapiens
gaaggucacagugggagaa

SEQ ID NO: 1186252 - RNA, 19 nt, Homo sapiens
aacaaucggcugagaauga

SEQ ID NO: 1186253 - RNA, 19 nt, Homo sapiens
gacugucucuaucuucaug

SEQ ID NO: 1186254 - RNA, 19 nt, Homo sapiens
ggccagagcaggagacauc

SEQ ID NO: 1186255 - RNA, 19 nt, Homo sapiens
gguuagauuuggacaguac

SEQ ID NO: 1186256 - RNA, 19 nt, Homo sapiens
gauaaaagaggucuagaug

SEQ ID NO: 1186257 - RNA, 19 nt, Homo sapiens
ccgaaguuguuucaugguu

SEQ ID NO: 1186258 - RNA, 19 nt, Homo sapiens
ccaaacaaucggcugagaa

SEQ ID NO: 1186259 - RNA, 19 nt, Homo sapiens
agaggcugguguucuguuu

SEQ ID NO: 1186260 - RNA, 19 nt, Homo sapiens
ggaagaagagaaaacauau

SEQ ID NO: 1186261 - RNA, 19 nt, Homo sapiens
ucagauaagaaucgcauga

SEQ ID NO: 1186262 - RNA, 19 nt, Homo sapiens
gcgaagagaccgcccuuac

SEQ ID NO: 1186263 - RNA, 19 nt, Homo sapiens
ucgagcggcugguuagaug

SEQ ID NO: 1186264 - RNA, 19 nt, Homo sapiens
ccagcucugugcccucuau

SEQ ID NO: 1186265 - RNA, 19 nt, Homo sapiens
agaggaaagugaguggauu

SEQ ID NO: 1186266 - RNA, 19 nt, Homo sapiens
aaaugacugucucuaucuu

SEQ ID NO: 1186267 - RNA, 19 nt, Homo sapiens
acaagagaaccuccuaaga

SEQ ID NO: 1186268 - RNA, 19 nt, Homo sapiens
gauagcacacucagauaag

SEQ ID NO: 1186269 - RNA, 19 nt, Homo sapiens
gaagcugagagaagaggaa

SEQ ID NO: 1186270 - RNA, 19 nt, Homo sapiens
gugauagcacacucagaua

SEQ ID NO: 1186271 - RNA, 19 nt, Homo sapiens
gguguucggcugccaguug

SEQ ID NO: 1186272 - RNA, 19 nt, Homo sapiens
cgaagagaccgcccuuaca

SEQ ID NO: 1186273 - RNA, 19 nt, Homo sapiens
ugaagaggaacaaugaugu

SEQ ID NO: 1186274 - RNA, 19 nt, Homo sapiens
gacgcugcuucuacauaaa

SEQ ID NO: 1186275 - RNA, 19 nt, Homo sapiens
ugagaagagguucaaguga

SEQ ID NO: 1186276 - RNA, 19 nt, Homo sapiens
cauaaaguggcaugguauu

SEQ ID NO: 1186277 - RNA, 19 nt, Homo sapiens
uaaaagaacugagaagacu

SEQ ID NO: 1186278 - RNA, 19 nt, Homo sapiens
aggaagacuugccgucaga

SEQ ID NO: 1186279 - RNA, 19 nt, Homo sapiens
gagcagccuccuccacuuc

SEQ ID NO: 1186280 - RNA, 19 nt, Homo sapiens
ggucacagugggagaacaa

SEQ ID NO: 1186281 - RNA, 19 nt, Homo sapiens
ggagagccguguucaauga

SEQ ID NO: 1186282 - RNA, 19 nt, Homo sapiens
caagaaacaucccaaagug

SEQ ID NO: 1186283 - RNA, 19 nt, Homo sapiens
gcccagagcugcuagaguu

SEQ ID NO: 1186284 - RNA, 19 nt, Homo sapiens
caaacugggucauagcuuu

SEQ ID NO: 1186285 - RNA, 19 nt, Homo sapiens
ccaagaagcccaagaaaca

SEQ ID NO: 1186286 - RNA, 19 nt, Homo sapiens
acacagugcuuuggaaauu

SEQ ID NO: 1186287 - RNA, 19 nt, Homo sapiens
gggcgaggaugcugaggaa

SEQ ID NO: 1186288 - RNA, 19 nt, Homo sapiens
gcacagagccaauguucgu

SEQ ID NO: 1186289 - RNA, 19 nt, Homo sapiens
ggaaugaugaagaggcuuu

SEQ ID NO: 1186290 - RNA, 19 nt, Homo sapiens
ggaguguucugaugcaagu

SEQ ID NO: 1186291 - RNA, 19 nt, Homo sapiens
gaggagagccguguucaau

SEQ ID NO: 1186292 - RNA, 19 nt, Homo sapiens
ccaagaaacaucccaaagu

SEQ ID NO: 1186293 - RNA, 19 nt, Homo sapiens
acagcgagauugaggaguu

SEQ ID NO: 1186294 - RNA, 19 nt, Homo sapiens
ccgaggaugucguccaguu

SEQ ID NO: 1186295 - RNA, 19 nt, Homo sapiens
cccugaagcuauuugauga

SEQ ID NO: 1186296 - RNA, 19 nt, Homo sapiens
gacagggaaugaugaagag

SEQ ID NO: 1186297 - RNA, 19 nt, Homo sapiens
cugcuagaguucuuaggua

SEQ ID NO: 1186298 - RNA, 19 nt, Homo sapiens
cucagugaaugauguuuaa

SEQ ID NO: 1186299 - RNA, 19 nt, Homo sapiens
ccacacagugcuuuggaaa

SEQ ID NO: 1186300 - RNA, 19 nt, Homo sapiens
gaucggcugucuggagugu

SEQ ID NO: 1186301 - RNA, 19 nt, Homo sapiens
aagaaggagugaccgguau

SEQ ID NO: 1186302 - RNA, 19 nt, Homo sapiens
ggaugaagcaagacaugug

SEQ ID NO: 1186303 - RNA, 19 nt, Homo sapiens
gcuccaagaagcccaagaa

SEQ ID NO: 1186304 - RNA, 19 nt, Homo sapiens
gggcacagagccaauguuc

SEQ ID NO: 1186305 - RNA, 19 nt, Homo sapiens
agacagggaaugaugaaga

SEQ ID NO: 1186306 - RNA, 19 nt, Homo sapiens
gggcucaccagcagagauu

SEQ ID NO: 1186307 - RNA, 19 nt, Homo sapiens
cagcgagauugaggaguuu

SEQ ID NO: 1186308 - RNA, 19 nt, Homo sapiens
ucagcaaacugggucauag

SEQ ID NO: 1186309 - RNA, 19 nt, Homo sapiens
gguauagacggcccugcua

SEQ ID NO: 1186310 - RNA, 19 nt, Homo sapiens
gaagcuauuugaugauccu

SEQ ID NO: 1186311 - RNA, 19 nt, Homo sapiens
cuccaaggaugccgaguug

SEQ ID NO: 1186312 - RNA, 19 nt, Homo sapiens
ucucagugaaugauguuua

SEQ ID NO: 1186313 - RNA, 19 nt, Homo sapiens
ggagaggagagccguguuc

SEQ ID NO: 1186314 - RNA, 19 nt, Homo sapiens
cuuuggaaauucucaguga

SEQ ID NO: 1186315 - RNA, 19 nt, Homo sapiens
gcuggacccucugggcauu

SEQ ID NO: 1186316 - RNA, 19 nt, Homo sapiens
ccaggcgacuucagaaugc

SEQ ID NO: 1186317 - RNA, 19 nt, Homo sapiens
gcaaacugggucauagcuu

SEQ ID NO: 1186318 - RNA, 19 nt, Homo sapiens
ugucuggaguguucugaug

SEQ ID NO: 1186319 - RNA, 19 nt, Homo sapiens
cagggacgccuccaaggaa

SEQ ID NO: 1186320 - RNA, 19 nt, Homo sapiens
gcgaggaugcugaggaauc

SEQ ID NO: 1186321 - RNA, 19 nt, Homo sapiens
ggucuaggcaccacacagu

SEQ ID NO: 1186322 - RNA, 19 nt, Homo sapiens
gagccguguucaaugagau

SEQ ID NO: 1186323 - RNA, 19 nt, Homo sapiens
ggucacagcacccagaacu

SEQ ID NO: 1186324 - RNA, 19 nt, Homo sapiens
guacauccaggaccacgau

SEQ ID NO: 1186325 - RNA, 19 nt, Homo sapiens
gcaagaccaaguggcagaa

SEQ ID NO: 1186326 - RNA, 19 nt, Homo sapiens
cagagcugcuagaguucuu

SEQ ID NO: 1186327 - RNA, 19 nt, Homo sapiens
cccaggagaggaauacuga

SEQ ID NO: 1186328 - RNA, 19 nt, Homo sapiens
cggaggacgugucauccau

SEQ ID NO: 1186329 - RNA, 19 nt, Homo sapiens
gagaggagagccguguuca

SEQ ID NO: 1186330 - RNA, 19 nt, Homo sapiens
aagaggacuuggaccagau

SEQ ID NO: 1186331 - RNA, 19 nt, Homo sapiens
ggaugucguccaguucuug

SEQ ID NO: 1186332 - RNA, 19 nt, Homo sapiens
gcccaagaaacaucccaaa

SEQ ID NO: 1186333 - RNA, 19 nt, Homo sapiens
caagaagcccaagaaacau

SEQ ID NO: 1186334 - RNA, 19 nt, Homo sapiens
aagaccaaguggcagaaga

SEQ ID NO: 1186335 - RNA, 19 nt, Homo sapiens
ucagacagggaaugaugaa

SEQ ID NO: 1186336 - RNA, 19 nt, Homo sapiens
gaggaugucguccaguucu

SEQ ID NO: 1186337 - RNA, 19 nt, Homo sapiens
cuccugagccuccucuuga

SEQ ID NO: 1186338 - RNA, 19 nt, Homo sapiens
ggcagaagccugggucaca

SEQ ID NO: 1186339 - RNA, 19 nt, Homo sapiens
cacagugcuuuggaaauuc

SEQ ID NO: 1186340 - RNA, 19 nt, Homo sapiens
ggacaucuugcaguacauc

SEQ ID NO: 1186341 - RNA, 19 nt, Homo sapiens
gcucuaaagggagaaguca

SEQ ID NO: 1186342 - RNA, 19 nt, Homo sapiens
ccaaggaugaagcaagaca

SEQ ID NO: 1186343 - RNA, 19 nt, Homo sapiens
cugaagcuauuugaugauc

SEQ ID NO: 1186344 - RNA, 19 nt, Homo sapiens
ggagagccguguucaauga

SEQ ID NO: 1186345 - RNA, 19 nt, Homo sapiens
gcccagagcugcuagaguu

SEQ ID NO: 1186346 - RNA, 19 nt, Homo sapiens
caaacugggucauagcuuu

SEQ ID NO: 1186347 - RNA, 19 nt, Homo sapiens
ccaagaagcccaagaaaca

SEQ ID NO: 1186348 - RNA, 19 nt, Homo sapiens
acacagugcuuuggaaauu

SEQ ID NO: 1186349 - RNA, 19 nt, Homo sapiens
caagaaacaucggugugaa

SEQ ID NO: 1186350 - RNA, 19 nt, Homo sapiens
gggcgaggaugcugaggaa

SEQ ID NO: 1186351 - RNA, 19 nt, Homo sapiens
gcacagagccaauguucgu

SEQ ID NO: 1186352 - RNA, 19 nt, Homo sapiens
ggaaugaugaagaggcuuu

SEQ ID NO: 1186353 - RNA, 19 nt, Homo sapiens
ggaguguucugaugcaagu

SEQ ID NO: 1186354 - RNA, 19 nt, Homo sapiens
gaggagagccguguucaau

SEQ ID NO: 1186355 - RNA, 19 nt, Homo sapiens
acagcgagauugaggaguu

SEQ ID NO: 1186356 - RNA, 19 nt, Homo sapiens
ccaagaaacaucgguguga

SEQ ID NO: 1186357 - RNA, 19 nt, Homo sapiens
ccgaggaugucguccaguu

SEQ ID NO: 1186358 - RNA, 19 nt, Homo sapiens
gacagggaaugaugaagag

SEQ ID NO: 1186359 - RNA, 19 nt, Homo sapiens
cugcuagaguucuuaggua

SEQ ID NO: 1186360 - RNA, 19 nt, Homo sapiens
cucagugaaugauguuuaa

SEQ ID NO: 1186361 - RNA, 19 nt, Homo sapiens
ccacacagugcuuuggaaa

SEQ ID NO: 1186362 - RNA, 19 nt, Homo sapiens
gaucggcugucuggagugu

SEQ ID NO: 1186363 - RNA, 19 nt, Homo sapiens
aagaaggagugaccgguau

SEQ ID NO: 1186364 - RNA, 19 nt, Homo sapiens
ggaugaagcaagacaugug

SEQ ID NO: 1186365 - RNA, 19 nt, Homo sapiens
gcuccaagaagcccaagaa

SEQ ID NO: 1186366 - RNA, 19 nt, Homo sapiens
gggcacagagccaauguuc

SEQ ID NO: 1186367 - RNA, 19 nt, Homo sapiens
agacagggaaugaugaaga

SEQ ID NO: 1186368 - RNA, 19 nt, Homo sapiens
gggcucaccagcagagauu

SEQ ID NO: 1186369 - RNA, 19 nt, Homo sapiens
cagcgagauugaggaguuu

SEQ ID NO: 1186370 - RNA, 19 nt, Homo sapiens
ucagcaaacugggucauag

SEQ ID NO: 1186371 - RNA, 19 nt, Homo sapiens
gguauagacggcccugcua

SEQ ID NO: 1186372 - RNA, 19 nt, Homo sapiens
cuccaaggaugccgaguug

SEQ ID NO: 1186373 - RNA, 19 nt, Homo sapiens
ucucagugaaugauguuua

SEQ ID NO: 1186374 - RNA, 19 nt, Homo sapiens
ggagaggagagccguguuc

SEQ ID NO: 1186375 - RNA, 19 nt, Homo sapiens
cuuuggaaauucucaguga

SEQ ID NO: 1186376 - RNA, 19 nt, Homo sapiens
gcuggacccucugggcauu

SEQ ID NO: 1186377 - RNA, 19 nt, Homo sapiens
ccaggcgacuucagaaugc

SEQ ID NO: 1186378 - RNA, 19 nt, Homo sapiens
gcaaacugggucauagcuu

SEQ ID NO: 1186379 - RNA, 19 nt, Homo sapiens
ugucuggaguguucugaug

SEQ ID NO: 1186380 - RNA, 19 nt, Homo sapiens
gcgaggaugcugaggaauc

SEQ ID NO: 1186381 - RNA, 19 nt, Homo sapiens
ggucuaggcaccacacagu

SEQ ID NO: 1186382 - RNA, 19 nt, Homo sapiens
gagccguguucaaugagau

SEQ ID NO: 1186383 - RNA, 19 nt, Homo sapiens
ggucacagcacccagaacu

SEQ ID NO: 1186384 - RNA, 19 nt, Homo sapiens
gcaagaccaaguggcagaa

SEQ ID NO: 1186385 - RNA, 19 nt, Homo sapiens
cagagcugcuagaguucuu

SEQ ID NO: 1186386 - RNA, 19 nt, Homo sapiens
cccaggagaggaauacuga

SEQ ID NO: 1186387 - RNA, 19 nt, Homo sapiens
gagaggagagccguguuca

SEQ ID NO: 1186388 - RNA, 19 nt, Homo sapiens
caagaagcccaagaaacau

SEQ ID NO: 1186389 - RNA, 19 nt, Homo sapiens
aagaccaaguggcagaaga

SEQ ID NO: 1186390 - RNA, 19 nt, Homo sapiens
ucagacagggaaugaugaa

SEQ ID NO: 1186391 - RNA, 19 nt, Homo sapiens
ggaugucguccaguucuug

SEQ ID NO: 1186392 - RNA, 19 nt, Homo sapiens
cuccugagccuccucuuga

SEQ ID NO: 1186393 - RNA, 19 nt, Homo sapiens
ggcagaagccugggucaca

SEQ ID NO: 1186394 - RNA, 19 nt, Homo sapiens
gaggaugucguccaguucu

SEQ ID NO: 1186395 - RNA, 19 nt, Homo sapiens
cacagugcuuuggaaauuc

SEQ ID NO: 1186396 - RNA, 19 nt, Homo sapiens
gcucuaaagggagaaguca

SEQ ID NO: 1186397 - RNA, 19 nt, Homo sapiens
ccaaggaugaagcaagaca

SEQ ID NO: 1186398 - RNA, 19 nt, Homo sapiens
gaaacaaccugaucauuga

SEQ ID NO: 1186399 - RNA, 19 nt, Homo sapiens
gaugauaucuguauucuga

SEQ ID NO: 1186400 - RNA, 19 nt, Homo sapiens
ggacagagguggaaacuca

SEQ ID NO: 1186401 - RNA, 19 nt, Homo sapiens
gaaauucucuggaagacaa

SEQ ID NO: 1186402 - RNA, 19 nt, Homo sapiens
aaucagaacugccuuuaua

SEQ ID NO: 1186403 - RNA, 19 nt, Homo sapiens
gcacauuccuuaaguccua

SEQ ID NO: 1186404 - RNA, 19 nt, Homo sapiens
gcuacaaucuaaagaagua

SEQ ID NO: 1186405 - RNA, 19 nt, Homo sapiens
uggaagagauucacgauuu

SEQ ID NO: 1186406 - RNA, 19 nt, Homo sapiens
aaacugcacuugaugaauu

SEQ ID NO: 1186407 - RNA, 19 nt, Homo sapiens
gcagaggucuucaguaucu

SEQ ID NO: 1186408 - RNA, 19 nt, Homo sapiens
gaacugccuuuauaagaau

SEQ ID NO: 1186409 - RNA, 19 nt, Homo sapiens
gaauuuaaauccaccuuca

SEQ ID NO: 1186410 - RNA, 19 nt, Homo sapiens
ugaggacacuuaucucuuu

SEQ ID NO: 1186411 - RNA, 19 nt, Homo sapiens
gaagacaauuccuggguau

SEQ ID NO: 1186412 - RNA, 19 nt, Homo sapiens
agacaacucugaaucuuug

SEQ ID NO: 1186413 - RNA, 19 nt, Homo sapiens
cgagagguuugcauugaua

SEQ ID NO: 1186414 - RNA, 19 nt, Homo sapiens
cuaagaaucugaaauaugc

SEQ ID NO: 1186415 - RNA, 19 nt, Homo sapiens
gagauaauuugaagagcaa

SEQ ID NO: 1186416 - RNA, 19 nt, Homo sapiens
gaauggaauuggagauugu

SEQ ID NO: 1186417 - RNA, 19 nt, Homo sapiens
ggaagagauucacgauuuc

SEQ ID NO: 1186418 - RNA, 19 nt, Homo sapiens
gaacugaugaggaaagaau

SEQ ID NO: 1186419 - RNA, 19 nt, Homo sapiens
gacgagaacaaguaaauaa

SEQ ID NO: 1186420 - RNA, 19 nt, Homo sapiens
ugaaacaaccugaucauug

SEQ ID NO: 1186421 - RNA, 19 nt, Homo sapiens
gcacaaaacugcacuugau

SEQ ID NO: 1186422 - RNA, 19 nt, Homo sapiens
cuaagcauuucaagugaua

SEQ ID NO: 1186423 - RNA, 19 nt, Homo sapiens
aaacuaagcauuucaagug

SEQ ID NO: 1186424 - RNA, 19 nt, Homo sapiens
gaacaagagcuggaacuga

SEQ ID NO: 1186425 - RNA, 19 nt, Homo sapiens
gaauaaagacaacucugaa

SEQ ID NO: 1186426 - RNA, 19 nt, Homo sapiens
gaaagaauguagcgaucuc

SEQ ID NO: 1186427 - RNA, 19 nt, Homo sapiens
agaacugccuuuauaagaa

SEQ ID NO: 1186428 - RNA, 19 nt, Homo sapiens
aagcugaacuacuaagaaa

SEQ ID NO: 1186429 - RNA, 19 nt, Homo sapiens
ugaacacacuguacaauag

SEQ ID NO: 1186430 - RNA, 19 nt, Homo sapiens
gaaagcaauccuccaauca

SEQ ID NO: 1186431 - RNA, 19 nt, Homo sapiens
ccaaacaaacggauccaua

SEQ ID NO: 1186432 - RNA, 19 nt, Homo sapiens
ugucauggaugcacuggua

SEQ ID NO: 1186433 - RNA, 19 nt, Homo sapiens
gugaagaccuuggaagaga

SEQ ID NO: 1186434 - RNA, 19 nt, Homo sapiens
gaucauugaagccaacuuu

SEQ ID NO: 1186435 - RNA, 19 nt, Homo sapiens
ggucuucaguaucuauauu

SEQ ID NO: 1186436 - RNA, 19 nt, Homo sapiens
caaacaaacggauccauau

SEQ ID NO: 1186437 - RNA, 19 nt, Homo sapiens
guaaauaaggccuaucaug

SEQ ID NO: 1186438 - RNA, 19 nt, Homo sapiens
ggacgagaacaaguaaaua

SEQ ID NO: 1186439 - RNA, 19 nt, Homo sapiens
gaacugaagagagaaaugu

SEQ ID NO: 1186440 - RNA, 19 nt, Homo sapiens
caaauugcauaauggaaca

SEQ ID NO: 1186441 - RNA, 19 nt, Homo sapiens
uaaauccaccuucaucaaa

SEQ ID NO: 1186442 - RNA, 19 nt, Homo sapiens
gugaguagguuacauuucu

SEQ ID NO: 1186443 - RNA, 19 nt, Homo sapiens
guacaugcuuucaggaaca

SEQ ID NO: 1186444 - RNA, 19 nt, Homo sapiens
ggacagacaaugagagauc

SEQ ID NO: 1186445 - RNA, 19 nt, Homo sapiens
gguuacauuucuguuguua

SEQ ID NO: 1186446 - RNA, 19 nt, Homo sapiens
uugcagaggucuucaguau

SEQ ID NO: 1186447 - RNA, 19 nt, Homo sapiens
caacugcaaucaagaaagc

SEQ ID NO: 1186448 - RNA, 19 nt, Homo sapiens
cauaagagagauacaguga

SEQ ID NO: 1186449 - RNA, 19 nt, Homo sapiens
ucagaagaauggaauugga

SEQ ID NO: 1186450 - RNA, 19 nt, Homo sapiens
cuacagaaagccaaacaaa

SEQ ID NO: 1186451 - RNA, 19 nt, Homo sapiens
gaugaggaauuuaaaucca

SEQ ID NO: 1186452 - RNA, 19 nt, Homo sapiens
gcagcuacaaucuaaagaa

SEQ ID NO: 1186453 - RNA, 19 nt, Homo sapiens
ugaauaaagacaacucuga

SEQ ID NO: 1186454 - RNA, 19 nt, Homo sapiens
uaaggccuaucaugcauau

SEQ ID NO: 1186455 - RNA, 19 nt, Homo sapiens
agaaagcaauccuccaauc

SEQ ID NO: 1186456 - RNA, 19 nt, Homo sapiens
ucaaguacaagcugaacua

SEQ ID NO: 1186457 - RNA, 19 nt, Homo sapiens
aacaagagcuggaacugau

SEQ ID NO: 1186458 - RNA, 19 nt, Homo sapiens
ugaaugagcagcuacaauc

SEQ ID NO: 1186459 - RNA, 19 nt, Homo sapiens
gaagagcaaacuggacaaa

SEQ ID NO: 1186460 - RNA, 19 nt, Homo sapiens
uauaugcuauugcguuuca

SEQ ID NO: 1186461 - RNA, 19 nt, Homo sapiens
ggaacaaauggcaauguga

SEQ ID NO: 1186462 - RNA, 19 nt, Homo sapiens
gaacacacuguacaauagu

SEQ ID NO: 1186463 - RNA, 19 nt, Homo sapiens
cagaacugccuuuauaaga

SEQ ID NO: 1186464 - RNA, 19 nt, Homo sapiens
gacaauuccuggguauuuc

SEQ ID NO: 1186465 - RNA, 19 nt, Homo sapiens
aacucugccuucuauauua

SEQ ID NO: 1186466 - RNA, 19 nt, Homo sapiens
gaagagcagagaucuccaa

SEQ ID NO: 1186467 - RNA, 19 nt, Homo sapiens
aaacucugccuucuauauu

SEQ ID NO: 1186468 - RNA, 19 nt, Homo sapiens
gaagagagaaaugucuaau

SEQ ID NO: 1186469 - RNA, 19 nt, Homo sapiens
aaauagaacuacagaaagc

SEQ ID NO: 1186470 - RNA, 19 nt, Homo sapiens
augagcagcuacaaucuaa

SEQ ID NO: 1186471 - RNA, 19 nt, Homo sapiens
aagcaauccuccaaucaug

SEQ ID NO: 1186472 - RNA, 19 nt, Homo sapiens
uggaugcacugguagaaga

SEQ ID NO: 1186473 - RNA, 19 nt, Homo sapiens
agaauggaauuggagauug

SEQ ID NO: 1186474 - RNA, 19 nt, Homo sapiens
ccuccuaaaucaagugaga

SEQ ID NO: 1186475 - RNA, 19 nt, Homo sapiens
agacaauuccuggguauuu

SEQ ID NO: 1186476 - RNA, 19 nt, Homo sapiens
uaaugaugguacaugcuuu

SEQ ID NO: 1186477 - RNA, 19 nt, Homo sapiens
guacaagcugaacuacuaa

SEQ ID NO: 1186478 - RNA, 19 nt, Homo sapiens
cagcuacaaucuaaagaag

SEQ ID NO: 1186479 - RNA, 19 nt, Homo sapiens
gaagagauucacgauuuca

SEQ ID NO: 1186480 - RNA, 19 nt, Homo sapiens
gcugugaccugaagaucca

SEQ ID NO: 1186481 - RNA, 19 nt, Homo sapiens
uaaagacaacucugaaucu

SEQ ID NO: 1186482 - RNA, 19 nt, Homo sapiens
ccacacuuccaaucacuuu

SEQ ID NO: 1186483 - RNA, 19 nt, Homo sapiens
uagguuacauuucuguugu

SEQ ID NO: 1186484 - RNA, 19 nt, Homo sapiens
caagcugaacuacuaagaa

SEQ ID NO: 1186485 - RNA, 19 nt, Homo sapiens
gcacugguagaagaugaua

SEQ ID NO: 1186486 - RNA, 19 nt, Homo sapiens
acuuaaggauucagagaaa

SEQ ID NO: 1186487 - RNA, 19 nt, Homo sapiens
cauaguugguuuucuagua

SEQ ID NO: 1186488 - RNA, 19 nt, Homo sapiens
acugggaacugaagagaga

SEQ ID NO: 1186489 - RNA, 19 nt, Homo sapiens
guagcgaucucaaaauaga

SEQ ID NO: 1186490 - RNA, 19 nt, Homo sapiens
caggugaugaggaauuuaa

SEQ ID NO: 1186491 - RNA, 19 nt, Homo sapiens
gagcagcuacaaucuaaag

SEQ ID NO: 1186492 - RNA, 19 nt, Homo sapiens
caacucugaaucuuugaaa

SEQ ID NO: 1186493 - RNA, 19 nt, Homo sapiens
gggacgagaacaaguaaau

SEQ ID NO: 1186494 - RNA, 19 nt, Homo sapiens
acucugccuucuauauuaa

SEQ ID NO: 1186495 - RNA, 19 nt, Homo sapiens
gaggacacuuaucucuuuc

SEQ ID NO: 1186496 - RNA, 19 nt, Homo sapiens
uaccacaucuuccccuuua

SEQ ID NO: 1186497 - RNA, 19 nt, Homo sapiens
gaacuacuaagaaaacuga

SEQ ID NO: 1186498 - RNA, 19 nt, Homo sapiens
ggagacagauuuagauaua

SEQ ID NO: 1186499 - RNA, 19 nt, Homo sapiens
gaacugcucuggacauaug

SEQ ID NO: 1186500 - RNA, 19 nt, Homo sapiens
ccacugaacuuacccaauu

SEQ ID NO: 1186501 - RNA, 19 nt, Homo sapiens
gcacuuaccuugacuuuac

SEQ ID NO: 1186502 - RNA, 19 nt, Homo sapiens
ggacacagcaucuuugauu

SEQ ID NO: 1186503 - RNA, 19 nt, Homo sapiens
ggacaaggccucuaucaug

SEQ ID NO: 1186504 - RNA, 19 nt, Homo sapiens
gcaagagcauccacaccuu

SEQ ID NO: 1186505 - RNA, 19 nt, Homo sapiens
gaaacucaccaaucucuau

SEQ ID NO: 1186506 - RNA, 19 nt, Homo sapiens
gacacagcaucuuugauuu

SEQ ID NO: 1186507 - RNA, 19 nt, Homo sapiens
ggacuagacuggccacacu

SEQ ID NO: 1186508 - RNA, 19 nt, Homo sapiens
gagcuuccauggccuguca

SEQ ID NO: 1186509 - RNA, 19 nt, Homo sapiens
agaaguggcuggcuauagu

SEQ ID NO: 1186510 - RNA, 19 nt, Homo sapiens
cgacaggauugcagaagug

SEQ ID NO: 1186511 - RNA, 19 nt, Homo sapiens
uggcuuaccugucggagaa

SEQ ID NO: 1186512 - RNA, 19 nt, Homo sapiens
caaucucuauacaccauaa

SEQ ID NO: 1186513 - RNA, 19 nt, Homo sapiens
gagaguggccuauccagau

SEQ ID NO: 1186514 - RNA, 19 nt, Homo sapiens
auaaagaccucaccuuggu

SEQ ID NO: 1186515 - RNA, 19 nt, Homo sapiens
gagcaagggccaggcagua

SEQ ID NO: 1186516 - RNA, 19 nt, Homo sapiens
cagcaucuuugauuucauc

SEQ ID NO: 1186517 - RNA, 19 nt, Homo sapiens
aaacucaccaaucucuaua

SEQ ID NO: 1186518 - RNA, 19 nt, Homo sapiens
gaugugggcccucaaugga

SEQ ID NO: 1186519 - RNA, 19 nt, Homo sapiens
agaguggccuauccagauu

SEQ ID NO: 1186520 - RNA, 19 nt, Homo sapiens
ccagcuuucuuucuacaga

SEQ ID NO: 1186521 - RNA, 19 nt, Homo sapiens
gagacagauuuagauauag

SEQ ID NO: 1186522 - RNA, 19 nt, Homo sapiens
gacaugcacuuaccuugac

SEQ ID NO: 1186523 - RNA, 19 nt, Homo sapiens
guggagacagauuuagaua

SEQ ID NO: 1186524 - RNA, 19 nt, Homo sapiens
ggcaguggagacagauuua

SEQ ID NO: 1186525 - RNA, 19 nt, Homo sapiens
gccacagccuggacaugaa

SEQ ID NO: 1186526 - RNA, 19 nt, Homo sapiens
gcucugaaacucaccaauc

SEQ ID NO: 1186527 - RNA, 19 nt, Homo sapiens
gcagaaguggcuggcuaua

SEQ ID NO: 1186528 - RNA, 19 nt, Homo sapiens
cacagcaucuuugauuuca

SEQ ID NO: 1186529 - RNA, 19 nt, Homo sapiens
agacaugcacuuaccuuga

SEQ ID NO: 1186530 - RNA, 19 nt, Homo sapiens
cugaacugcucuggacaua

SEQ ID NO: 1186531 - RNA, 19 nt, Homo sapiens
ccuggaaggugcugaacug

SEQ ID NO: 1186532 - RNA, 19 nt, Homo sapiens
cuccauggaugaugacuuc

SEQ ID NO: 1186533 - RNA, 19 nt, Homo sapiens
uaaagaccucaccuuggua

SEQ ID NO: 1186534 - RNA, 19 nt, Homo sapiens
cuucaugccucuccauucu

SEQ ID NO: 1186535 - RNA, 19 nt, Homo sapiens
agccugaguuuccuucuga

SEQ ID NO: 1186536 - RNA, 19 nt, Homo sapiens
uuucugcucuuuccucuca

SEQ ID NO: 1186537 - RNA, 19 nt, Homo sapiens
cugaugcucuggauuugga

SEQ ID NO: 1186538 - RNA, 19 nt, Homo sapiens
gaaugugcacagacucuuc

SEQ ID NO: 1186539 - RNA, 19 nt, Homo sapiens
cggagaguaucgucugugu

SEQ ID NO: 1186540 - RNA, 19 nt, Homo sapiens
cggagaaugucagcaaaca

SEQ ID NO: 1186541 - RNA, 19 nt, Homo sapiens
ucaugccucuccauucuca

SEQ ID NO: 1186542 - RNA, 19 nt, Homo sapiens
gcuguuccgccuacgagua

SEQ ID NO: 1186543 - RNA, 19 nt, Homo sapiens
agaccgaggugcuguacca

SEQ ID NO: 1186544 - RNA, 19 nt, Homo sapiens
ggauggggcuucaguagca

SEQ ID NO: 1186545 - RNA, 19 nt, Homo sapiens
gcaguaacagggcaguauc

SEQ ID NO: 1186546 - RNA, 19 nt, Homo sapiens
ggacauaugagggccuaca

SEQ ID NO: 1186547 - RNA, 19 nt, Homo sapiens
gcacugcucgcucuguuuu

SEQ ID NO: 1186548 - RNA, 19 nt, Homo sapiens
cccaauuccuucuuucagu

SEQ ID NO: 1186549 - RNA, 19 nt, Homo sapiens
gagaaugugcacagacucu

SEQ ID NO: 1186550 - RNA, 19 nt, Homo sapiens
acacagcaucuuugauuuc

SEQ ID NO: 1186551 - RNA, 19 nt, Homo sapiens
ggaugcugaugcucuggau

SEQ ID NO: 1186552 - RNA, 19 nt, Homo sapiens
agacagauuuagauauagc

SEQ ID NO: 1186553 - RNA, 19 nt, Homo sapiens
uaucgucuguguccauuuu

SEQ ID NO: 1186554 - RNA, 19 nt, Homo sapiens
ggugcugucugcauauugc

SEQ ID NO: 1186555 - RNA, 19 nt, Homo sapiens
cuuacccaauuccuucuuu

SEQ ID NO: 1186556 - RNA, 19 nt, Homo sapiens
agauauagcucaggaugcu

SEQ ID NO: 1186557 - RNA, 19 nt, Homo sapiens
ccgagaaugugcacagacu

SEQ ID NO: 1186558 - RNA, 19 nt, Homo sapiens
caucuaugugccucccuua

SEQ ID NO: 1186559 - RNA, 19 nt, Homo sapiens
cauuggacacagcaucuuu

SEQ ID NO: 1186560 - RNA, 19 nt, Homo sapiens
gaaguggcuggcuauaguc

SEQ ID NO: 1186561 - RNA, 19 nt, Homo sapiens
gucggagaaugucagcaaa

SEQ ID NO: 1186562 - RNA, 19 nt, Homo sapiens
cuacagauggugcuacucu

SEQ ID NO: 1186563 - RNA, 19 nt, Homo sapiens
acagauggugcuacucuug

SEQ ID NO: 1186564 - RNA, 19 nt, Homo sapiens
ugggugguuugcaaucuga

SEQ ID NO: 1186565 - RNA, 19 nt, Homo sapiens
ccgagggagacauggcuua

SEQ ID NO: 1186566 - RNA, 19 nt, Homo sapiens
cugaggcaguggagacaga

SEQ ID NO: 1186567 - RNA, 19 nt, Homo sapiens
ggcaguaacagggcaguau

SEQ ID NO: 1186568 - RNA, 19 nt, Homo sapiens
cgccacagccuggacauga

SEQ ID NO: 1186569 - RNA, 19 nt, Homo sapiens
cagcuuucuuucuacagau

SEQ ID NO: 1186570 - RNA, 19 nt, Homo sapiens
gacuuuaccccacauguuu

SEQ ID NO: 1186571 - RNA, 19 nt, Homo sapiens
augcugaugcucuggauuu

SEQ ID NO: 1186572 - RNA, 19 nt, Homo sapiens
caguggagacagauuuaga

SEQ ID NO: 1186573 - RNA, 19 nt, Homo sapiens
caagggccaggcaguaaca

SEQ ID NO: 1186574 - RNA, 19 nt, Homo sapiens
gcaagggccaggcaguaac

SEQ ID NO: 1186575 - RNA, 19 nt, Homo sapiens
gacauaugagggccuacaa

SEQ ID NO: 1186576 - RNA, 19 nt, Homo sapiens
acucaccaaucucuauaca

SEQ ID NO: 1186577 - RNA, 19 nt, Homo sapiens
ccagacaugcacuuaccuu

SEQ ID NO: 1186578 - RNA, 19 nt, Homo sapiens
caccgagaaugugcacaga

SEQ ID NO: 1186579 - RNA, 19 nt, Homo sapiens
ggagacagauuuagauaua

SEQ ID NO: 1186580 - RNA, 19 nt, Homo sapiens
gaacugcucuggacauaug

SEQ ID NO: 1186581 - RNA, 19 nt, Homo sapiens
ggacacagcaucuuugauu

SEQ ID NO: 1186582 - RNA, 19 nt, Homo sapiens
ggacaaggccucuaucaug

SEQ ID NO: 1186583 - RNA, 19 nt, Homo sapiens
gcaagagcauccacaccuu

SEQ ID NO: 1186584 - RNA, 19 nt, Homo sapiens
gacacagcaucuuugauuu

SEQ ID NO: 1186585 - RNA, 19 nt, Homo sapiens
auacuugguuaccucauua

SEQ ID NO: 1186586 - RNA, 19 nt, Homo sapiens
gagcuuccauggccuguca

SEQ ID NO: 1186587 - RNA, 19 nt, Homo sapiens
gaucacauuuccuucuauc

SEQ ID NO: 1186588 - RNA, 19 nt, Homo sapiens
agaaguggcuggcuauagu

SEQ ID NO: 1186589 - RNA, 19 nt, Homo sapiens
cgacaggauugcagaagug

SEQ ID NO: 1186590 - RNA, 19 nt, Homo sapiens
gugaucacauuuccuucua

SEQ ID NO: 1186591 - RNA, 19 nt, Homo sapiens
uggcuuaccugucggagaa

SEQ ID NO: 1186592 - RNA, 19 nt, Homo sapiens
ggucauaucuguguuucca

SEQ ID NO: 1186593 - RNA, 19 nt, Homo sapiens
ccuggacacugacuucauu

SEQ ID NO: 1186594 - RNA, 19 nt, Homo sapiens
gagcaagggccaggcagua

SEQ ID NO: 1186595 - RNA, 19 nt, Homo sapiens
cagcaucuuugauuucauc

SEQ ID NO: 1186596 - RNA, 19 nt, Homo sapiens
cccagugacuuccgauuga

SEQ ID NO: 1186597 - RNA, 19 nt, Homo sapiens
gggucaacgugaucacauu

SEQ ID NO: 1186598 - RNA, 19 nt, Homo sapiens
ggucaacgugaucacauuu

SEQ ID NO: 1186599 - RNA, 19 nt, Homo sapiens
gagacagauuuagauauag

SEQ ID NO: 1186600 - RNA, 19 nt, Homo sapiens
gguucucaauacuugguua

SEQ ID NO: 1186601 - RNA, 19 nt, Homo sapiens
guggagacagauuuagaua

SEQ ID NO: 1186602 - RNA, 19 nt, Homo sapiens
ggcaguggagacagauuua

SEQ ID NO: 1186603 - RNA, 19 nt, Homo sapiens
gccacagccuggacaugaa

SEQ ID NO: 1186604 - RNA, 19 nt, Homo sapiens
gcagaaguggcuggcuaua

SEQ ID NO: 1186605 - RNA, 19 nt, Homo sapiens
cacagcaucuuugauuuca

SEQ ID NO: 1186606 - RNA, 19 nt, Homo sapiens
cugaacugcucuggacaua

SEQ ID NO: 1186607 - RNA, 19 nt, Homo sapiens
ccuggaaggugcugaacug

SEQ ID NO: 1186608 - RNA, 19 nt, Homo sapiens
aauacuugguuaccucauu

SEQ ID NO: 1186609 - RNA, 19 nt, Homo sapiens
cuucuauccuucuuguauu

SEQ ID NO: 1186610 - RNA, 19 nt, Homo sapiens
cacauuuccuucuauccuu

SEQ ID NO: 1186611 - RNA, 19 nt, Homo sapiens
cuccauggaugaugacuuc

SEQ ID NO: 1186612 - RNA, 19 nt, Homo sapiens
agccugaguuuccuucuga

SEQ ID NO: 1186613 - RNA, 19 nt, Homo sapiens
uuucugcucuuuccucuca

SEQ ID NO: 1186614 - RNA, 19 nt, Homo sapiens
cugaugcucuggauuugga

SEQ ID NO: 1186615 - RNA, 19 nt, Homo sapiens
gaaugugcacagacucuuc

SEQ ID NO: 1186616 - RNA, 19 nt, Homo sapiens
cggagaguaucgucugugu

SEQ ID NO: 1186617 - RNA, 19 nt, Homo sapiens
cggagaaugucagcaaaca

SEQ ID NO: 1186618 - RNA, 19 nt, Homo sapiens
ucacugcucucuccguacu

SEQ ID NO: 1186619 - RNA, 19 nt, Homo sapiens
gcuguuccgccuacgagua

SEQ ID NO: 1186620 - RNA, 19 nt, Homo sapiens
agaccgaggugcuguacca

SEQ ID NO: 1186621 - RNA, 19 nt, Homo sapiens
gaaugugggacucugaucu

SEQ ID NO: 1186622 - RNA, 19 nt, Homo sapiens
gguggucucagcucaguga

SEQ ID NO: 1186623 - RNA, 19 nt, Homo sapiens
uaagaaugugggacucuga

SEQ ID NO: 1186624 - RNA, 19 nt, Homo sapiens
ccagaaaggaccucaacca

SEQ ID NO: 1186625 - RNA, 19 nt, Homo sapiens
ggauggggcuucaguagca

SEQ ID NO: 1186626 - RNA, 19 nt, Homo sapiens
gcaguaacagggcaguauc

SEQ ID NO: 1186627 - RNA, 19 nt, Homo sapiens
ggacauaugagggccuaca

SEQ ID NO: 1186628 - RNA, 19 nt, Homo sapiens
gagaaugugcacagacucu

SEQ ID NO: 1186629 - RNA, 19 nt, Homo sapiens
acacagcaucuuugauuuc

SEQ ID NO: 1186630 - RNA, 19 nt, Homo sapiens
ggaugcugaugcucuggau

SEQ ID NO: 1186631 - RNA, 19 nt, Homo sapiens
agacagauuuagauauagc

SEQ ID NO: 1186632 - RNA, 19 nt, Homo sapiens
uaucgucuguguccauuuu

SEQ ID NO: 1186633 - RNA, 19 nt, Homo sapiens
agauauagcucaggaugcu

SEQ ID NO: 1186634 - RNA, 19 nt, Homo sapiens
ccgagaaugugcacagacu

SEQ ID NO: 1186635 - RNA, 19 nt, Homo sapiens
gucggagaaugucagcaaa

SEQ ID NO: 1186636 - RNA, 19 nt, Homo sapiens
cauuggacacagcaucuuu

SEQ ID NO: 1186637 - RNA, 19 nt, Homo sapiens
gaaguggcuggcuauaguc

SEQ ID NO: 1186638 - RNA, 19 nt, Homo sapiens
ugaucacauuuccuucuau

SEQ ID NO: 1186639 - RNA, 19 nt, Homo sapiens
guuaccucauuaucccuuu

SEQ ID NO: 1186640 - RNA, 19 nt, Homo sapiens
ucucucaggauuucucuug

SEQ ID NO: 1186641 - RNA, 19 nt, Homo sapiens
ccgagggagacauggcuua

SEQ ID NO: 1186642 - RNA, 19 nt, Homo sapiens
cugaggcaguggagacaga

SEQ ID NO: 1186643 - RNA, 19 nt, Homo sapiens
ggcaguaacagggcaguau

SEQ ID NO: 1186644 - RNA, 19 nt, Homo sapiens
cgccacagccuggacauga

SEQ ID NO: 1186645 - RNA, 19 nt, Homo sapiens
ccuucuauccuucuuguau

SEQ ID NO: 1186646 - RNA, 19 nt, Homo sapiens
augcugaugcucuggauuu

SEQ ID NO: 1186647 - RNA, 19 nt, Homo sapiens
caguggagacagauuuaga

SEQ ID NO: 1186648 - RNA, 19 nt, Homo sapiens
caagggccaggcaguaaca

SEQ ID NO: 1186649 - RNA, 19 nt, Homo sapiens
gcaagggccaggcaguaac

SEQ ID NO: 1186650 - RNA, 19 nt, Homo sapiens
gacauaugagggccuacaa

SEQ ID NO: 1186651 - RNA, 19 nt, Homo sapiens
caccgagaaugugcacaga

SEQ ID NO: 1186652 - RNA, 19 nt, Homo sapiens
ggagacagauuuagauaua

SEQ ID NO: 1186653 - RNA, 19 nt, Homo sapiens
gaacugcucuggacauaug

SEQ ID NO: 1186654 - RNA, 19 nt, Homo sapiens
ggacacagcaucuuugauu

SEQ ID NO: 1186655 - RNA, 19 nt, Homo sapiens
ggacaaggccucuaucaug

SEQ ID NO: 1186656 - RNA, 19 nt, Homo sapiens
gcaagagcauccacaccuu

SEQ ID NO: 1186657 - RNA, 19 nt, Homo sapiens
gacacagcaucuuugauuu

SEQ ID NO: 1186658 - RNA, 19 nt, Homo sapiens
gagcuuccauggccuguca

SEQ ID NO: 1186659 - RNA, 19 nt, Homo sapiens
acuaaagccugaucuucua

SEQ ID NO: 1186660 - RNA, 19 nt, Homo sapiens
agaaguggcuggcuauagu

SEQ ID NO: 1186661 - RNA, 19 nt, Homo sapiens
cgacaggauugcagaagug

SEQ ID NO: 1186662 - RNA, 19 nt, Homo sapiens
uuaccuagcuggcuuaaac

SEQ ID NO: 1186663 - RNA, 19 nt, Homo sapiens
uggcuuaccugucggagaa

SEQ ID NO: 1186664 - RNA, 19 nt, Homo sapiens
gagcaagggccaggcagua

SEQ ID NO: 1186665 - RNA, 19 nt, Homo sapiens
gguugagggucauacagaa

SEQ ID NO: 1186666 - RNA, 19 nt, Homo sapiens
cagcaucuuugauuucauc

SEQ ID NO: 1186667 - RNA, 19 nt, Homo sapiens
gagacagauuuagauauag

SEQ ID NO: 1186668 - RNA, 19 nt, Homo sapiens
guggagacagauuuagaua

SEQ ID NO: 1186669 - RNA, 19 nt, Homo sapiens
ggcaguggagacagauuua

SEQ ID NO: 1186670 - RNA, 19 nt, Homo sapiens
gccacagccuggacaugaa

SEQ ID NO: 1186671 - RNA, 19 nt, Homo sapiens
gcagaaguggcuggcuaua

SEQ ID NO: 1186672 - RNA, 19 nt, Homo sapiens
cacagcaucuuugauuuca

SEQ ID NO: 1186673 - RNA, 19 nt, Homo sapiens
gacuaaagccugaucuucu

SEQ ID NO: 1186674 - RNA, 19 nt, Homo sapiens
cugaacugcucuggacaua

SEQ ID NO: 1186675 - RNA, 19 nt, Homo sapiens
ccuggaaggugcugaacug

SEQ ID NO: 1186676 - RNA, 19 nt, Homo sapiens
gggauucucuggcccucau

SEQ ID NO: 1186677 - RNA, 19 nt, Homo sapiens
cuccauggaugaugacuuc

SEQ ID NO: 1186678 - RNA, 19 nt, Homo sapiens
uuucugcucuuuccucuca

SEQ ID NO: 1186679 - RNA, 19 nt, Homo sapiens
cagcaugagcgacagaaug

SEQ ID NO: 1186680 - RNA, 19 nt, Homo sapiens
agccugaucuucuaguuuc

SEQ ID NO: 1186681 - RNA, 19 nt, Homo sapiens
aaagccugaucuucuaguu

SEQ ID NO: 1186682 - RNA, 19 nt, Homo sapiens
cugaugcucuggauuugga

SEQ ID NO: 1186683 - RNA, 19 nt, Homo sapiens
gaaugugcacagacucuuc

SEQ ID NO: 1186684 - RNA, 19 nt, Homo sapiens
cggagaguaucgucugugu

SEQ ID NO: 1186685 - RNA, 19 nt, Homo sapiens
cggagaaugucagcaaaca

SEQ ID NO: 1186686 - RNA, 19 nt, Homo sapiens
gcuguuccgccuacgagua

SEQ ID NO: 1186687 - RNA, 19 nt, Homo sapiens
agaccgaggugcuguacca

SEQ ID NO: 1186688 - RNA, 19 nt, Homo sapiens
gauucucuggcccucauua

SEQ ID NO: 1186689 - RNA, 19 nt, Homo sapiens
gagacuaaagccugaucuu

SEQ ID NO: 1186690 - RNA, 19 nt, Homo sapiens
ggauggggcuucaguagca

SEQ ID NO: 1186691 - RNA, 19 nt, Homo sapiens
gcaguaacagggcaguauc

SEQ ID NO: 1186692 - RNA, 19 nt, Homo sapiens
ggacauaugagggccuaca

SEQ ID NO: 1186693 - RNA, 19 nt, Homo sapiens
gagaaugugcacagacucu

SEQ ID NO: 1186694 - RNA, 19 nt, Homo sapiens
acacagcaucuuugauuuc

SEQ ID NO: 1186695 - RNA, 19 nt, Homo sapiens
ggucauacagaaagucagu

SEQ ID NO: 1186696 - RNA, 19 nt, Homo sapiens
ggaugcugaugcucuggau

SEQ ID NO: 1186697 - RNA, 19 nt, Homo sapiens
agacagauuuagauauagc

SEQ ID NO: 1186698 - RNA, 19 nt, Homo sapiens
uaucgucuguguccauuuu

SEQ ID NO: 1186699 - RNA, 19 nt, Homo sapiens
agauauagcucaggaugcu

SEQ ID NO: 1186700 - RNA, 19 nt, Homo sapiens
ccgagaaugugcacagacu

SEQ ID NO: 1186701 - RNA, 19 nt, Homo sapiens
cgacagaaugggaccuugu

SEQ ID NO: 1186702 - RNA, 19 nt, Homo sapiens
gucggagaaugucagcaaa

SEQ ID NO: 1186703 - RNA, 19 nt, Homo sapiens
gaaguggcuggcuauaguc

SEQ ID NO: 1186704 - RNA, 19 nt, Homo sapiens
cauuggacacagcaucuuu

SEQ ID NO: 1186705 - RNA, 19 nt, Homo sapiens
agacuaaagccugaucuuc

SEQ ID NO: 1186706 - RNA, 19 nt, Homo sapiens
guugagggucauacagaaa

SEQ ID NO: 1186707 - RNA, 19 nt, Homo sapiens
ccgagggagacauggcuua

SEQ ID NO: 1186708 - RNA, 19 nt, Homo sapiens
cugaggcaguggagacaga

SEQ ID NO: 1186709 - RNA, 19 nt, Homo sapiens
ggcaguaacagggcaguau

SEQ ID NO: 1186710 - RNA, 19 nt, Homo sapiens
cgccacagccuggacauga

SEQ ID NO: 1186711 - RNA, 19 nt, Homo sapiens
augcugaugcucuggauuu

SEQ ID NO: 1186712 - RNA, 19 nt, Homo sapiens
caguggagacagauuuaga

SEQ ID NO: 1186713 - RNA, 19 nt, Homo sapiens
caagggccaggcaguaaca

SEQ ID NO: 1186714 - RNA, 19 nt, Homo sapiens
gcaagggccaggcaguaac

SEQ ID NO: 1186715 - RNA, 19 nt, Homo sapiens
gacauaugagggccuacaa

SEQ ID NO: 1186716 - RNA, 19 nt, Homo sapiens
auagauaggaaaccagaga

SEQ ID NO: 1186717 - RNA, 19 nt, Homo sapiens
caccgagaaugugcacaga

SEQ ID NO: 1186718 - RNA, 19 nt, Homo sapiens
ggagacagauuuagauaua

SEQ ID NO: 1186719 - RNA, 19 nt, Homo sapiens
gaacugcucuggacauaug

SEQ ID NO: 1186720 - RNA, 19 nt, Homo sapiens
ggacacagcaucuuugauu

SEQ ID NO: 1186721 - RNA, 19 nt, Homo sapiens
ggacaaggccucuaucaug

SEQ ID NO: 1186722 - RNA, 19 nt, Homo sapiens
gcaagagcauccacaccuu

SEQ ID NO: 1186723 - RNA, 19 nt, Homo sapiens
gcagcuaugugccaucaug

SEQ ID NO: 1186724 - RNA, 19 nt, Homo sapiens
gacacagcaucuuugauuu

SEQ ID NO: 1186725 - RNA, 19 nt, Homo sapiens
ccaccacgcccgacaguaa

SEQ ID NO: 1186726 - RNA, 19 nt, Homo sapiens
agaaguggcuggcuauagu

SEQ ID NO: 1186727 - RNA, 19 nt, Homo sapiens
cgacaggauugcagaagug

SEQ ID NO: 1186728 - RNA, 19 nt, Homo sapiens
uggcugauguuuauauguu

SEQ ID NO: 1186729 - RNA, 19 nt, Homo sapiens
gugcugggauuacugguau

SEQ ID NO: 1186730 - RNA, 19 nt, Homo sapiens
gagcaagggccaggcagua

SEQ ID NO: 1186731 - RNA, 19 nt, Homo sapiens
cagcaucuuugauuucauc

SEQ ID NO: 1186732 - RNA, 19 nt, Homo sapiens
gacgagguuucaccauguu

SEQ ID NO: 1186733 - RNA, 19 nt, Homo sapiens
agacgagguuucaccaugu

SEQ ID NO: 1186734 - RNA, 19 nt, Homo sapiens
gagacagauuuagauauag

SEQ ID NO: 1186735 - RNA, 19 nt, Homo sapiens
ccaaagugcugggauuacu

SEQ ID NO: 1186736 - RNA, 19 nt, Homo sapiens
guggagacagauuuagaua

SEQ ID NO: 1186737 - RNA, 19 nt, Homo sapiens
ggcaguggagacagauuua

SEQ ID NO: 1186738 - RNA, 19 nt, Homo sapiens
gccacagccuggacaugaa

SEQ ID NO: 1186739 - RNA, 19 nt, Homo sapiens
gcagaaguggcuggcuaua

SEQ ID NO: 1186740 - RNA, 19 nt, Homo sapiens
cacagcaucuuugauuuca

SEQ ID NO: 1186741 - RNA, 19 nt, Homo sapiens
cugaacugcucuggacaua

SEQ ID NO: 1186742 - RNA, 19 nt, Homo sapiens
ccuggaaggugcugaacug

SEQ ID NO: 1186743 - RNA, 19 nt, Homo sapiens
gcccgacaguaaauauguu

SEQ ID NO: 1186744 - RNA, 19 nt, Homo sapiens
ggcugauguuuauauguuu

SEQ ID NO: 1186745 - RNA, 19 nt, Homo sapiens
ugaaugagccccuggguuu

SEQ ID NO: 1186746 - RNA, 19 nt, Homo sapiens
gaaugugcacagacucuuc

SEQ ID NO: 1186747 - RNA, 19 nt, Homo sapiens
cggagaguaucgucugugu

SEQ ID NO: 1186748 - RNA, 19 nt, Homo sapiens
agaccgaggugcuguacca

SEQ ID NO: 1186749 - RNA, 19 nt, Homo sapiens
gcuguuccgccuacgagua

SEQ ID NO: 1186750 - RNA, 19 nt, Homo sapiens
augccuggcugauguuuau

SEQ ID NO: 1186751 - RNA, 19 nt, Homo sapiens
ggauggggcuucaguagca

SEQ ID NO: 1186752 - RNA, 19 nt, Homo sapiens
gcaguaacagggcaguauc

SEQ ID NO: 1186753 - RNA, 19 nt, Homo sapiens
ggacauaugagggccuaca

SEQ ID NO: 1186754 - RNA, 19 nt, Homo sapiens
gagaaugugcacagacucu

SEQ ID NO: 1186755 - RNA, 19 nt, Homo sapiens
acacagcaucuuugauuuc

SEQ ID NO: 1186756 - RNA, 19 nt, Homo sapiens
agacagauuuagauauagc

SEQ ID NO: 1186757 - RNA, 19 nt, Homo sapiens
uaucgucuguguccauuuu

SEQ ID NO: 1186758 - RNA, 19 nt, Homo sapiens
ccgagaaugugcacagacu

SEQ ID NO: 1186759 - RNA, 19 nt, Homo sapiens
cauuggacacagcaucuuu

SEQ ID NO: 1186760 - RNA, 19 nt, Homo sapiens
gaaguggcuggcuauaguc

SEQ ID NO: 1186761 - RNA, 19 nt, Homo sapiens
ccacgcccgacaguaaaua

SEQ ID NO: 1186762 - RNA, 19 nt, Homo sapiens
cuccugggcucaagugauc

SEQ ID NO: 1186763 - RNA, 19 nt, Homo sapiens
gccccuggguuuucacuuu

SEQ ID NO: 1186764 - RNA, 19 nt, Homo sapiens
cugaggcaguggagacaga

SEQ ID NO: 1186765 - RNA, 19 nt, Homo sapiens
ggcaguaacagggcaguau

SEQ ID NO: 1186766 - RNA, 19 nt, Homo sapiens
cgccacagccuggacauga

SEQ ID NO: 1186767 - RNA, 19 nt, Homo sapiens
caaagugcugggauuacug

SEQ ID NO: 1186768 - RNA, 19 nt, Homo sapiens
cuucagcucccacaaguag

SEQ ID NO: 1186769 - RNA, 19 nt, Homo sapiens
caguggagacagauuuaga

SEQ ID NO: 1186770 - RNA, 19 nt, Homo sapiens
caagggccaggcaguaaca

SEQ ID NO: 1186771 - RNA, 19 nt, Homo sapiens
gcaagggccaggcaguaac

SEQ ID NO: 1186772 - RNA, 19 nt, Homo sapiens
gacauaugagggccuacaa

SEQ ID NO: 1186773 - RNA, 19 nt, Homo sapiens
caccacgcccgacaguaaa

SEQ ID NO: 1186774 - RNA, 19 nt, Homo sapiens
caccgagaaugugcacaga

SEQ ID NO: 1186775 - RNA, 19 nt, Homo sapiens
gguaaugguucauaucaua

SEQ ID NO: 1186776 - RNA, 19 nt, Homo sapiens
gcagggcccuugcuuagaa

SEQ ID NO: 1186777 - RNA, 19 nt, Homo sapiens
caacauuccaucacuaaua

SEQ ID NO: 1186778 - RNA, 19 nt, Homo sapiens
gagaaagggccuccgcuua

SEQ ID NO: 1186779 - RNA, 19 nt, Homo sapiens
gaaagggccuccgcuuaga

SEQ ID NO: 1186780 - RNA, 19 nt, Homo sapiens
gauuagacuuguuauguga

SEQ ID NO: 1186781 - RNA, 19 nt, Homo sapiens
gauccgagaugacccagaa

SEQ ID NO: 1186782 - RNA, 19 nt, Homo sapiens
gaugagaaauuaccagaag

SEQ ID NO: 1186783 - RNA, 19 nt, Homo sapiens
gaacuacaaagaugagaaa

SEQ ID NO: 1186784 - RNA, 19 nt, Homo sapiens
gaauuggauuguugacuug

SEQ ID NO: 1186785 - RNA, 19 nt, Homo sapiens
uaacgaauccuucucuuug

SEQ ID NO: 1186786 - RNA, 19 nt, Homo sapiens
aaacaguacuucagugaga

SEQ ID NO: 1186787 - RNA, 19 nt, Homo sapiens
guagguuguuggccucuua

SEQ ID NO: 1186788 - RNA, 19 nt, Homo sapiens
guucagaggcguacaacua

SEQ ID NO: 1186789 - RNA, 19 nt, Homo sapiens
ugaauuggauuguugacuu

SEQ ID NO: 1186790 - RNA, 19 nt, Homo sapiens
cuaaugagcuguugacacu

SEQ ID NO: 1186791 - RNA, 19 nt, Homo sapiens
aagcagaacuacaaagaug

SEQ ID NO: 1186792 - RNA, 19 nt, Homo sapiens
caaagcagaacuacaaaga

SEQ ID NO: 1186793 - RNA, 19 nt, Homo sapiens
ggaacgggcugcuggugau

SEQ ID NO: 1186794 - RNA, 19 nt, Homo sapiens
aaauguagcuaagguaaug

SEQ ID NO: 1186795 - RNA, 19 nt, Homo sapiens
ggccagaacuucgagauca

SEQ ID NO: 1186796 - RNA, 19 nt, Homo sapiens
caagaccauugauuuggaa

SEQ ID NO: 1186797 - RNA, 19 nt, Homo sapiens
cagccaagaccauugauuu

SEQ ID NO: 1186798 - RNA, 19 nt, Homo sapiens
ccaaagugcugggauuaca

SEQ ID NO: 1186799 - RNA, 19 nt, Homo sapiens
caucuuggcucacuucaac

SEQ ID NO: 1186800 - RNA, 19 nt, Homo sapiens
cgauuagacuuguuaugug

SEQ ID NO: 1186801 - RNA, 19 nt, Homo sapiens
gcgauuagacuuguuaugu

SEQ ID NO: 1186802 - RNA, 19 nt, Homo sapiens
gcagcccacucuuguguuc

SEQ ID NO: 1186803 - RNA, 19 nt, Homo sapiens
ggccuugugucgccuugua

SEQ ID NO: 1186804 - RNA, 19 nt, Homo sapiens
uggcuaggcuggucucgaa

SEQ ID NO: 1186805 - RNA, 19 nt, Homo sapiens
uagcuaagguaaugguuca

SEQ ID NO: 1186806 - RNA, 19 nt, Homo sapiens
gauguuaccagccugaaau

SEQ ID NO: 1186807 - RNA, 19 nt, Homo sapiens
caacucuguucucaggauu

SEQ ID NO: 1186808 - RNA, 19 nt, Homo sapiens
cuaagguaaugguucauau

SEQ ID NO: 1186809 - RNA, 19 nt, Homo sapiens
cugaaauucuguuaacgaa

SEQ ID NO: 1186810 - RNA, 19 nt, Homo sapiens
gaaaaucauugccaaguac

SEQ ID NO: 1186811 - RNA, 19 nt, Homo sapiens
ggaagguugugugcaggaa

SEQ ID NO: 1186812 - RNA, 19 nt, Homo sapiens
ucaaacaguacuucaguga

SEQ ID NO: 1186813 - RNA, 19 nt, Homo sapiens
guuguuggccucuuacuug

SEQ ID NO: 1186814 - RNA, 19 nt, Homo sapiens
ccgaguagcugggauuaca

SEQ ID NO: 1186815 - RNA, 19 nt, Homo sapiens
gcuaagguaaugguucaua

SEQ ID NO: 1186816 - RNA, 19 nt, Homo sapiens
gaaaagcagcccacucuug

SEQ ID NO: 1186817 - RNA, 19 nt, Homo sapiens
guuguuccuugcugaauug

SEQ ID NO: 1186818 - RNA, 19 nt, Homo sapiens
ccacgauccugaaauucug

SEQ ID NO: 1186819 - RNA, 19 nt, Homo sapiens
ucucuguggugccuuguuu

SEQ ID NO: 1186820 - RNA, 19 nt, Homo sapiens
gacuuguuaugugauguua

SEQ ID NO: 1186821 - RNA, 19 nt, Homo sapiens
gaaacaaugggcagucucu

SEQ ID NO: 1186822 - RNA, 19 nt, Homo sapiens
ccugagacguuauuuaaaa

SEQ ID NO: 1186823 - RNA, 19 nt, Homo sapiens
gggaggaugacaugacuga

SEQ ID NO: 1186824 - RNA, 19 nt, Homo sapiens
ggaaauaaagcaggcaucu

SEQ ID NO: 1186825 - RNA, 19 nt, Homo sapiens
uuucaaagcagaacuacaa

SEQ ID NO: 1186826 - RNA, 19 nt, Homo sapiens
gauccugaaauucuguuaa

SEQ ID NO: 1186827 - RNA, 19 nt, Homo sapiens
ggguggaggugcugaacga

SEQ ID NO: 1186828 - RNA, 19 nt, Homo sapiens
auaccgaauuuccaacauu

SEQ ID NO: 1186829 - RNA, 19 nt, Homo sapiens
ccaaguacaaagccaaaga

SEQ ID NO: 1186830 - RNA, 19 nt, Homo sapiens
aaauaaagcaggcaucucu

SEQ ID NO: 1186831 - RNA, 19 nt, Homo sapiens
agaaagggccuccgcuuag

SEQ ID NO: 1186832 - RNA, 19 nt, Homo sapiens
cuccugagacguuauuuaa

SEQ ID NO: 1186833 - RNA, 19 nt, Homo sapiens
uggaggccuuugugaauga

SEQ ID NO: 1186834 - RNA, 19 nt, Homo sapiens
guggaggccuuugugaaug

SEQ ID NO: 1186835 - RNA, 19 nt, Homo sapiens
ucaaccggcuguacggaau

SEQ ID NO: 1186836 - RNA, 19 nt, Homo sapiens
guucauaucauacaaacag

SEQ ID NO: 1186837 - RNA, 19 nt, Homo sapiens
cugacucccugcgagauua

SEQ ID NO: 1186838 - RNA, 19 nt, Homo sapiens
ucacgugggcgucuauuuc

SEQ ID NO: 1186839 - RNA, 19 nt, Homo sapiens
agaaaaucauugccaagua

SEQ ID NO: 1186840 - RNA, 19 nt, Homo sapiens
uugcugaauuggauuguug

SEQ ID NO: 1186841 - RNA, 19 nt, Homo sapiens
guuccuugcugaauuggau

SEQ ID NO: 1186842 - RNA, 19 nt, Homo sapiens
aaugagcuguugacacugu

SEQ ID NO: 1186843 - RNA, 19 nt, Homo sapiens
uaccagaagccucgccuuu

SEQ ID NO: 1186844 - RNA, 19 nt, Homo sapiens
uuaacgaauccuucucuuu

SEQ ID NO: 1186845 - RNA, 19 nt, Homo sapiens
guuaacgaauccuucucuu

SEQ ID NO: 1186846 - RNA, 19 nt, Homo sapiens
ggcagaguccaccguguuu

SEQ ID NO: 1186847 - RNA, 19 nt, Homo sapiens
cgaaagagaaacagacaac

SEQ ID NO: 1186848 - RNA, 19 nt, Homo sapiens
gugccuuguuucugcagua

SEQ ID NO: 1186849 - RNA, 19 nt, Homo sapiens
ccagaagccucgccuuuuc

SEQ ID NO: 1186850 - RNA, 19 nt, Homo sapiens
gcaccaucuuggcucacuu

SEQ ID NO: 1186851 - RNA, 19 nt, Homo sapiens
ggaggcaggccagaacuuc

SEQ ID NO: 1186852 - RNA, 19 nt, Homo sapiens
gccauucccuuuuauuuuc

SEQ ID NO: 1186853 - RNA, 19 nt, Homo sapiens
guggaauccuaccggaaga

SEQ ID NO: 1186854 - RNA, 19 nt, Homo sapiens
gaaauaaagcaggcaucuc

SEQ ID NO: 1186855 - RNA, 19 nt, Homo sapiens
gcagaacuacaaagaugag

SEQ ID NO: 1186856 - RNA, 19 nt, Homo sapiens
cucccacgauccugaaauu

SEQ ID NO: 1186857 - RNA, 19 nt, Homo sapiens
cguggaggcugagcugaga

SEQ ID NO: 1186858 - RNA, 19 nt, Homo sapiens
ucaaaccggagcccaucua

SEQ ID NO: 1186859 - RNA, 19 nt, Homo sapiens
ugauggacguggaggagau

SEQ ID NO: 1186860 - RNA, 19 nt, Homo sapiens
gccgauagcugagaaaauc

SEQ ID NO: 1186861 - RNA, 19 nt, Homo sapiens
ggcccuugcuuagaaacaa

SEQ ID NO: 1186862 - RNA, 19 nt, Homo sapiens
aaggaagcuuguagagguu

SEQ ID NO: 1186863 - RNA, 19 nt, Homo sapiens
gcaaaaggaagcuuguaga

SEQ ID NO: 1186864 - RNA, 19 nt, Homo sapiens
ggucucacgugggcgucua

SEQ ID NO: 1186865 - RNA, 19 nt, Homo sapiens
acaacucuguucucaggau

SEQ ID NO: 1186866 - RNA, 19 nt, Homo sapiens
gccagaacuucgagaucau

SEQ ID NO: 1186867 - RNA, 19 nt, Homo sapiens
gagaaaagcagcccacucu

SEQ ID NO: 1186868 - RNA, 19 nt, Homo sapiens
ccuccugagacguuauuua

SEQ ID NO: 1186869 - RNA, 19 nt, Homo sapiens
uuagacuuguuaugugaug

SEQ ID NO: 1186870 - RNA, 19 nt, Homo sapiens
ggauuguugacuuguaguu

SEQ ID NO: 1186871 - RNA, 19 nt, Homo sapiens
gaggaugacaugacugacu

SEQ ID NO: 1186872 - RNA, 19 nt, Homo sapiens
cagaggcguacaacuaguu

SEQ ID NO: 1186873 - RNA, 19 nt, Homo sapiens
guaguucagaggcguacaa

SEQ ID NO: 1186874 - RNA, 19 nt, Homo sapiens
uagaaacaaugggcagucu

SEQ ID NO: 1186875 - RNA, 19 nt, Homo sapiens
gaggacaaguuccgaaaua

SEQ ID NO: 1186876 - RNA, 19 nt, Homo sapiens
gaaggaguaugcugcguuu

SEQ ID NO: 1186877 - RNA, 19 nt, Homo sapiens
gggcagagauggagaguuc

SEQ ID NO: 1186878 - RNA, 19 nt, Homo sapiens
gcucuuugaucuugaauau

SEQ ID NO: 1186879 - RNA, 19 nt, Homo sapiens
gcaagucucugcuucuuac

SEQ ID NO: 1186880 - RNA, 19 nt, Homo sapiens
gcaaaaggcuggauaucaa

SEQ ID NO: 1186881 - RNA, 19 nt, Homo sapiens
ccaaagaaacggagagaaa

SEQ ID NO: 1186882 - RNA, 19 nt, Homo sapiens
gacaaguuccgaaauaauu

SEQ ID NO: 1186883 - RNA, 19 nt, Homo sapiens
gcagcaguaucgccaggua

SEQ ID NO: 1186884 - RNA, 19 nt, Homo sapiens
ucaacaaguucaauaguuc

SEQ ID NO: 1186885 - RNA, 19 nt, Homo sapiens
gagaagagcagcaccaaag

SEQ ID NO: 1186886 - RNA, 19 nt, Homo sapiens
ggccgaaggucccugacua

SEQ ID NO: 1186887 - RNA, 19 nt, Homo sapiens
gauggagaguucaaaggaa

SEQ ID NO: 1186888 - RNA, 19 nt, Homo sapiens
gaagagcagcaccaaagaa

SEQ ID NO: 1186889 - RNA, 19 nt, Homo sapiens
ggacugggaugccgcuagu

SEQ ID NO: 1186890 - RNA, 19 nt, Homo sapiens
uugaggaacugaagaaaga

SEQ ID NO: 1186891 - RNA, 19 nt, Homo sapiens
ggacaaguuccgaaauaau

SEQ ID NO: 1186892 - RNA, 19 nt, Homo sapiens
caaagaagaagguccuguu

SEQ ID NO: 1186893 - RNA, 19 nt, Homo sapiens
ugucaggagugccauuaaa

SEQ ID NO: 1186894 - RNA, 19 nt, Homo sapiens
ggaguaugcugcguuugug

SEQ ID NO: 1186895 - RNA, 19 nt, Homo sapiens
uugaugagcugaauguugu

SEQ ID NO: 1186896 - RNA, 19 nt, Homo sapiens
ggagcuggaugccgaaguc

SEQ ID NO: 1186897 - RNA, 19 nt, Homo sapiens
agaagaagguccuguuugc

SEQ ID NO: 1186898 - RNA, 19 nt, Homo sapiens
gcacagagccccucgugaa

SEQ ID NO: 1186899 - RNA, 19 nt, Homo sapiens
cuugggaagucgcuuaauu

SEQ ID NO: 1186900 - RNA, 19 nt, Homo sapiens
aggcaaaacuccaauauga

SEQ ID NO: 1186901 - RNA, 19 nt, Homo sapiens
aaagaagaagguccuguuu

SEQ ID NO: 1186902 - RNA, 19 nt, Homo sapiens
caaggcaggcugagguaaa

SEQ ID NO: 1186903 - RNA, 19 nt, Homo sapiens
gaucaacaaguucaauagu

SEQ ID NO: 1186904 - RNA, 19 nt, Homo sapiens
ccugaaggccauccucuuu

SEQ ID NO: 1186905 - RNA, 19 nt, Homo sapiens
gagcuuguuuccucaucug

SEQ ID NO: 1186906 - RNA, 19 nt, Homo sapiens
agacugacaugcagaucau

SEQ ID NO: 1186907 - RNA, 19 nt, Homo sapiens
gcagagauggagaguucaa

SEQ ID NO: 1186908 - RNA, 19 nt, Homo sapiens
aggacaaguuccgaaauaa

SEQ ID NO: 1186909 - RNA, 19 nt, Homo sapiens
ugaaggccauccucuuucu

SEQ ID NO: 1186910 - RNA, 19 nt, Homo sapiens
gcugcgcucuuugaucuug

SEQ ID NO: 1186911 - RNA, 19 nt, Homo sapiens
aagagcagcaccaaagaaa

SEQ ID NO: 1186912 - RNA, 19 nt, Homo sapiens
gcccaggaguugcaagucu

SEQ ID NO: 1186913 - RNA, 19 nt, Homo sapiens
gagacugacaugcagauca

SEQ ID NO: 1186914 - RNA, 19 nt, Homo sapiens
ccaagcagcagcucuguac

SEQ ID NO: 1186915 - RNA, 19 nt, Homo sapiens
ggaccugcuuuccuuuggu

SEQ ID NO: 1186916 - RNA, 19 nt, Homo sapiens
gcaaggcaggcugagguaa

SEQ ID NO: 1186917 - RNA, 19 nt, Homo sapiens
ccgaaguccuggagguguu

SEQ ID NO: 1186918 - RNA, 19 nt, Homo sapiens
gaagaagguccuguuugca

SEQ ID NO: 1186919 - RNA, 19 nt, Homo sapiens
gaauauuauguccaucaga

SEQ ID NO: 1186920 - RNA, 19 nt, Homo sapiens
ugguacggcugaucaacaa

SEQ ID NO: 1186921 - RNA, 19 nt, Homo sapiens
agagugcacuggcaaaauu

SEQ ID NO: 1186922 - RNA, 19 nt, Homo sapiens
ggugagugguugggugaug

SEQ ID NO: 1186923 - RNA, 19 nt, Homo sapiens
gagcugacccaggagaugu

SEQ ID NO: 1186924 - RNA, 19 nt, Homo sapiens
ggagagaaaagaaaccaaa

SEQ ID NO: 1186925 - RNA, 19 nt, Homo sapiens
agaaggugcugcagacacu

SEQ ID NO: 1186926 - RNA, 19 nt, Homo sapiens
ccauugaggaacugaagaa

SEQ ID NO: 1186927 - RNA, 19 nt, Homo sapiens
cuacacaucucaggaucuc

SEQ ID NO: 1186928 - RNA, 19 nt, Homo sapiens
ggcuggauaucaacaccaa

SEQ ID NO: 1186929 - RNA, 19 nt, Homo sapiens
ccaauaugaggacaaguuc

SEQ ID NO: 1186930 - RNA, 19 nt, Homo sapiens
gagcagcaccaaagaaacg

SEQ ID NO: 1186931 - RNA, 19 nt, Homo sapiens
uugcugcgcucuuugaucu

SEQ ID NO: 1186932 - RNA, 19 nt, Homo sapiens
agacuuugaugagcugaau

SEQ ID NO: 1186933 - RNA, 19 nt, Homo sapiens
cgaaggucccugacuaugg

SEQ ID NO: 1186934 - RNA, 19 nt, Homo sapiens
aagaagaagguccuguuug

SEQ ID NO: 1186935 - RNA, 19 nt, Homo sapiens
caaagaaacggagagaaaa

SEQ ID NO: 1186936 - RNA, 19 nt, Homo sapiens
ggaaagagaggcaaaacuc

SEQ ID NO: 1186937 - RNA, 19 nt, Homo sapiens
caggagugccauuaaagga

SEQ ID NO: 1186938 - RNA, 19 nt, Homo sapiens
gcugaaggagcugagauga

SEQ ID NO: 1186939 - RNA, 19 nt, Homo sapiens
cugaucaacaaguucaaua

SEQ ID NO: 1186940 - RNA, 19 nt, Homo sapiens
ggcaaggcaggcugaggua

SEQ ID NO: 1186941 - RNA, 19 nt, Homo sapiens
caacaccaacaccuacaca

SEQ ID NO: 1186942 - RNA, 19 nt, Homo sapiens
gaaacggagagaaaagaaa

SEQ ID NO: 1186943 - RNA, 19 nt, Homo sapiens
acacaucucaggaucucaa

SEQ ID NO: 1186944 - RNA, 19 nt, Homo sapiens
caccaacaccuacacaucu

SEQ ID NO: 1186945 - RNA, 19 nt, Homo sapiens
agaagagcagcaccaaaga

SEQ ID NO: 1186946 - RNA, 19 nt, Homo sapiens
gagauggagaguucaaagg

SEQ ID NO: 1186947 - RNA, 19 nt, Homo sapiens
cccagagccugccuucauc

SEQ ID NO: 1186948 - RNA, 19 nt, Homo sapiens
uccaauaugaggacaaguu

SEQ ID NO: 1186949 - RNA, 19 nt, Homo sapiens
ccagguggaggccaucgaa

SEQ ID NO: 1186950 - RNA, 19 nt, Homo sapiens
ugaauauuauguccaucag

SEQ ID NO: 1186951 - RNA, 19 nt, Homo sapiens
guacggcugaucaacaagu

SEQ ID NO: 1186952 - RNA, 19 nt, Homo sapiens
caggagauguccccagaga

SEQ ID NO: 1186953 - RNA, 19 nt, Homo sapiens
agauggagaguucaaagga

SEQ ID NO: 1186954 - RNA, 19 nt, Homo sapiens
gccgaaggucccugacuau

SEQ ID NO: 1186955 - RNA, 19 nt, Homo sapiens
ucaagagugcacuggcaaa

SEQ ID NO: 1186956 - RNA, 19 nt, Homo sapiens
cuuguuuccucaucuguca

SEQ ID NO: 1186957 - RNA, 19 nt, Homo sapiens
agucucugcuucuuaccaa

SEQ ID NO: 1186958 - RNA, 19 nt, Homo sapiens
uugcaagucucugcuucuu

SEQ ID NO: 1186959 - RNA, 19 nt, Homo sapiens
gccgcucacugcaaagaag

SEQ ID NO: 1186960 - RNA, 19 nt, Homo sapiens
ccaaccaggugacgaaaua

SEQ ID NO: 1186961 - RNA, 19 nt, Homo sapiens
cgaauucucuucccacauu

SEQ ID NO: 1186962 - RNA, 19 nt, Homo sapiens
gaaguucccuggccuuugu

SEQ ID NO: 1186963 - RNA, 19 nt, Homo sapiens
gaacucggguggcuaugaa

SEQ ID NO: 1186964 - RNA, 19 nt, Homo sapiens
gggagaagcccuuuaaaug

SEQ ID NO: 1186965 - RNA, 19 nt, Homo sapiens
gagaagcccuuuaaauguc

SEQ ID NO: 1186966 - RNA, 19 nt, Homo sapiens
ggagaagcccuuuaaaugu

SEQ ID NO: 1186967 - RNA, 19 nt, Homo sapiens
guacagcgaugaggaguca

SEQ ID NO: 1186968 - RNA, 19 nt, Homo sapiens
gcacugccguauccucuuc

SEQ ID NO: 1186969 - RNA, 19 nt, Homo sapiens
ccaauagccuuaccaaacg

SEQ ID NO: 1186970 - RNA, 19 nt, Homo sapiens
ccucugagcgggcaacuuu

SEQ ID NO: 1186971 - RNA, 19 nt, Homo sapiens
gggcugccauggcuucaga

SEQ ID NO: 1186972 - RNA, 19 nt, Homo sapiens
gccaauagccuuaccaaac

SEQ ID NO: 1186973 - RNA, 19 nt, Homo sapiens
caacaucugugguuaucac

SEQ ID NO: 1186974 - RNA, 19 nt, Homo sapiens
ugccauaacuaccuacaga

SEQ ID NO: 1186975 - RNA, 19 nt, Homo sapiens
gcgggcaacuuucaucgau

SEQ ID NO: 1186976 - RNA, 19 nt, Homo sapiens
acaaggagcggugccauaa

SEQ ID NO: 1186977 - RNA, 19 nt, Homo sapiens
ggacuccacagacacagaa

SEQ ID NO: 1186978 - RNA, 19 nt, Homo sapiens
gaacucacgccugucauca

SEQ ID NO: 1186979 - RNA, 19 nt, Homo sapiens
ucucagaccuccccuauga

SEQ ID NO: 1186980 - RNA, 19 nt, Homo sapiens
gaauucucuucccacauug

SEQ ID NO: 1186981 - RNA, 19 nt, Homo sapiens
ccagccaccucccaccauu

SEQ ID NO: 1186982 - RNA, 19 nt, Homo sapiens
gaaagcaaccacgaagauc

SEQ ID NO: 1186983 - RNA, 19 nt, Homo sapiens
gagaguagugagccuguga

SEQ ID NO: 1186984 - RNA, 19 nt, Homo sapiens
ccacagacacagaaagcaa

SEQ ID NO: 1186985 - RNA, 19 nt, Homo sapiens
uuaaaugucccuucugcaa

SEQ ID NO: 1186986 - RNA, 19 nt, Homo sapiens
gccaggaccgguacgaauu

SEQ ID NO: 1186987 - RNA, 19 nt, Homo sapiens
gauuguggaagauucauug

SEQ ID NO: 1186988 - RNA, 19 nt, Homo sapiens
gaccacgucauguucacua

SEQ ID NO: 1186989 - RNA, 19 nt, Homo sapiens
gcggugccauaacuaccua

SEQ ID NO: 1186990 - RNA, 19 nt, Homo sapiens
uguggaagauucauugucu

SEQ ID NO: 1186991 - RNA, 19 nt, Homo sapiens
agccagcacucuucuccua

SEQ ID NO: 1186992 - RNA, 19 nt, Homo sapiens
auggcaagcucaaguguga

SEQ ID NO: 1186993 - RNA, 19 nt, Homo sapiens
ugaaaaggauguggaguug

SEQ ID NO: 1186994 - RNA, 19 nt, Homo sapiens
ucgaucgucuggccaauag

SEQ ID NO: 1186995 - RNA, 19 nt, Homo sapiens
agaaagcaaccacgaagau

SEQ ID NO: 1186996 - RNA, 19 nt, Homo sapiens
cacaaggagcggugccaua

SEQ ID NO: 1186997 - RNA, 19 nt, Homo sapiens
aaaggacgacagcgugauu

SEQ ID NO: 1186998 - RNA, 19 nt, Homo sapiens
ucagaacucacgccuguca

SEQ ID NO: 1186999 - RNA, 19 nt, Homo sapiens
aaaugucccuucugcaacu

SEQ ID NO: 1187000 - RNA, 19 nt, Homo sapiens
gacccaacgugcucauggu

SEQ ID NO: 1187001 - RNA, 19 nt, Homo sapiens
ggaccgguacgaauucucu

SEQ ID NO: 1187002 - RNA, 19 nt, Homo sapiens
cagaaagcaaccacgaaga

SEQ ID NO: 1187003 - RNA, 19 nt, Homo sapiens
cauugcaucucagaacuca

SEQ ID NO: 1187004 - RNA, 19 nt, Homo sapiens
auaacuaccuacagagucu

SEQ ID NO: 1187005 - RNA, 19 nt, Homo sapiens
gagugcaacaucugugguu

SEQ ID NO: 1187006 - RNA, 19 nt, Homo sapiens
ugccaggacuccacagaca

SEQ ID NO: 1187007 - RNA, 19 nt, Homo sapiens
cgucuggccaauagccuua

SEQ ID NO: 1187008 - RNA, 19 nt, Homo sapiens
aaggagcggugccauaacu

SEQ ID NO: 1187009 - RNA, 19 nt, Homo sapiens
gcuacaaacagcagaguac

SEQ ID NO: 1187010 - RNA, 19 nt, Homo sapiens
ucuccuagccgcucacuca

SEQ ID NO: 1187011 - RNA, 19 nt, Homo sapiens
ggacgacagcgugauugug

SEQ ID NO: 1187012 - RNA, 19 nt, Homo sapiens
ccaauggcaagcucaagug

SEQ ID NO: 1187013 - RNA, 19 nt, Homo sapiens
uggaagauucauugucuga

SEQ ID NO: 1187014 - RNA, 19 nt, Homo sapiens
cgacagcgugauuguggaa

SEQ ID NO: 1187015 - RNA, 19 nt, Homo sapiens
gcacaagcgcagucacacu

SEQ ID NO: 1187016 - RNA, 19 nt, Homo sapiens
agugcaacaucugugguua

SEQ ID NO: 1187017 - RNA, 19 nt, Homo sapiens
ccaacagccagcacucuuc

SEQ ID NO: 1187018 - RNA, 19 nt, Homo sapiens
gucaucagcucugucuaca

SEQ ID NO: 1187019 - RNA, 19 nt, Homo sapiens
ccaccaacccauugcaucu

SEQ ID NO: 1187020 - RNA, 19 nt, Homo sapiens
acagcgugauuguggaaga

SEQ ID NO: 1187021 - RNA, 19 nt, Homo sapiens
caacagccagcacucuucu

SEQ ID NO: 1187022 - RNA, 19 nt, Homo sapiens
gcgugauuguggaagauuc

SEQ ID NO: 1187023 - RNA, 19 nt, Homo sapiens
ggagauguacagcgaugag

SEQ ID NO: 1187024 - RNA, 19 nt, Homo sapiens
uacgugaccuggagauggu

SEQ ID NO: 1187025 - RNA, 19 nt, Homo sapiens
ccaggaccgguacgaauuc

SEQ ID NO: 1187026 - RNA, 19 nt, Homo sapiens
ugcaacaucugugguuauc

SEQ ID NO: 1187027 - RNA, 19 nt, Homo sapiens
gugcaacaucugugguuau

SEQ ID NO: 1187028 - RNA, 19 nt, Homo sapiens
ggccaauagccuuaccaaa

SEQ ID NO: 1187029 - RNA, 19 nt, Homo sapiens
ccauaacuaccuacagagu

SEQ ID NO: 1187030 - RNA, 19 nt, Homo sapiens
gaaacuaaaucaucgcuuu

SEQ ID NO: 1187031 - RNA, 19 nt, Homo sapiens
guacagaaauugccuuaaa

SEQ ID NO: 1187032 - RNA, 19 nt, Homo sapiens
gaagagcacuaaucaacuu

SEQ ID NO: 1187033 - RNA, 19 nt, Homo sapiens
gaaacuguguagaaacuaa

SEQ ID NO: 1187034 - RNA, 19 nt, Homo sapiens
gaauuggagugcagucaua

SEQ ID NO: 1187035 - RNA, 19 nt, Homo sapiens
gaagagagcuuggucaaac

SEQ ID NO: 1187036 - RNA, 19 nt, Homo sapiens
aaucaucgcuuuaguaaga

SEQ ID NO: 1187037 - RNA, 19 nt, Homo sapiens
gcauugaacuggauguuau

SEQ ID NO: 1187038 - RNA, 19 nt, Homo sapiens
cagacuaccuuaacgauuu

SEQ ID NO: 1187039 - RNA, 19 nt, Homo sapiens
uaaagugucugcuaauuca

SEQ ID NO: 1187040 - RNA, 19 nt, Homo sapiens
ccaaacaaauuucucaaga

SEQ ID NO: 1187041 - RNA, 19 nt, Homo sapiens
cuaauaaagugucugcuaa

SEQ ID NO: 1187042 - RNA, 19 nt, Homo sapiens
gguacuaggucuuccuuaa

SEQ ID NO: 1187043 - RNA, 19 nt, Homo sapiens
gagagaaugugauagugaa

SEQ ID NO: 1187044 - RNA, 19 nt, Homo sapiens
caacauccuuuacacuauu

SEQ ID NO: 1187045 - RNA, 19 nt, Homo sapiens
gagauaaagugaagucauc

SEQ ID NO: 1187046 - RNA, 19 nt, Homo sapiens
ugacgaaacuguguagaaa

SEQ ID NO: 1187047 - RNA, 19 nt, Homo sapiens
ugucuccucuucagaauua

SEQ ID NO: 1187048 - RNA, 19 nt, Homo sapiens
ggaaacacaugagagaaug

SEQ ID NO: 1187049 - RNA, 19 nt, Homo sapiens
gcacauaaccaacauugau

SEQ ID NO: 1187050 - RNA, 19 nt, Homo sapiens
ucacauuccuuaaguugaa

SEQ ID NO: 1187051 - RNA, 19 nt, Homo sapiens
ggucaucccuaauaaagug

SEQ ID NO: 1187052 - RNA, 19 nt, Homo sapiens
gaaccucggccaucccaua

SEQ ID NO: 1187053 - RNA, 19 nt, Homo sapiens
guggauaacuauaaugaga

SEQ ID NO: 1187054 - RNA, 19 nt, Homo sapiens
uaggugagguggauaacua

SEQ ID NO: 1187055 - RNA, 19 nt, Homo sapiens
gcacugugauauguacuuu

SEQ ID NO: 1187056 - RNA, 19 nt, Homo sapiens
gacaacauccuuuacacua

SEQ ID NO: 1187057 - RNA, 19 nt, Homo sapiens
ucacccaucuguugaaguu

SEQ ID NO: 1187058 - RNA, 19 nt, Homo sapiens
gagcuuggucaaacaauaa

SEQ ID NO: 1187059 - RNA, 19 nt, Homo sapiens
cuucagaauuagccauuua

SEQ ID NO: 1187060 - RNA, 19 nt, Homo sapiens
aaagugaagucauccuuau

SEQ ID NO: 1187061 - RNA, 19 nt, Homo sapiens
ggagugcagucauaaucuu

SEQ ID NO: 1187062 - RNA, 19 nt, Homo sapiens
cccaagaacucaugguuga

SEQ ID NO: 1187063 - RNA, 19 nt, Homo sapiens
ucagggagcuggaacagau

SEQ ID NO: 1187064 - RNA, 19 nt, Homo sapiens
uaaagugaagucauccuua

SEQ ID NO: 1187065 - RNA, 19 nt, Homo sapiens
uaaguugaaucgguaguuu

SEQ ID NO: 1187066 - RNA, 19 nt, Homo sapiens
guaguucccugcccugaug

SEQ ID NO: 1187067 - RNA, 19 nt, Homo sapiens
ugaaucagcucucgacucu

SEQ ID NO: 1187068 - RNA, 19 nt, Homo sapiens
cagacugacuccuaugaaa

SEQ ID NO: 1187069 - RNA, 19 nt, Homo sapiens
ggaaacagccagccaagca

SEQ ID NO: 1187070 - RNA, 19 nt, Homo sapiens
caagaacucaugguugaua

SEQ ID NO: 1187071 - RNA, 19 nt, Homo sapiens
caagcaaucugggcuauag

SEQ ID NO: 1187072 - RNA, 19 nt, Homo sapiens
guaaaacaguuaagacuug

SEQ ID NO: 1187073 - RNA, 19 nt, Homo sapiens
ggucagggucauuuauaua

SEQ ID NO: 1187074 - RNA, 19 nt, Homo sapiens
caucgaaggcgcaagcaua

SEQ ID NO: 1187075 - RNA, 19 nt, Homo sapiens
gaacagauuuggggugaaa

SEQ ID NO: 1187076 - RNA, 19 nt, Homo sapiens
caaggcuuauccauacuuu

SEQ ID NO: 1187077 - RNA, 19 nt, Homo sapiens
gcacuaaucaacuuaaguc

SEQ ID NO: 1187078 - RNA, 19 nt, Homo sapiens
gaacagauggugaucaaaa

SEQ ID NO: 1187079 - RNA, 19 nt, Homo sapiens
uguaauaacucacguacuc

SEQ ID NO: 1187080 - RNA, 19 nt, Homo sapiens
gauguuauuucugccauau

SEQ ID NO: 1187081 - RNA, 19 nt, Homo sapiens
uagaacaguuagacacauu

SEQ ID NO: 1187082 - RNA, 19 nt, Homo sapiens
cacgagcacucccagcaua

SEQ ID NO: 1187083 - RNA, 19 nt, Homo sapiens
cuuacaagauguucauuug

SEQ ID NO: 1187084 - RNA, 19 nt, Homo sapiens
uaacaaggcggugugguuu

SEQ ID NO: 1187085 - RNA, 19 nt, Homo sapiens
caaaagagauaaagugaag

SEQ ID NO: 1187086 - RNA, 19 nt, Homo sapiens
gaauuucucacauuuaugg

SEQ ID NO: 1187087 - RNA, 19 nt, Homo sapiens
caagagggcacauaaccaa

SEQ ID NO: 1187088 - RNA, 19 nt, Homo sapiens
ucccaaauauccagacuga

SEQ ID NO: 1187089 - RNA, 19 nt, Homo sapiens
gugaagucauccuuauuau

SEQ ID NO: 1187090 - RNA, 19 nt, Homo sapiens
ggauguuauuucugccaua

SEQ ID NO: 1187091 - RNA, 19 nt, Homo sapiens
aaucagcucucgacucuag

SEQ ID NO: 1187092 - RNA, 19 nt, Homo sapiens
cuacucauuucaguguuua

SEQ ID NO: 1187093 - RNA, 19 nt, Homo sapiens
cuucaaggcuuauccauac

SEQ ID NO: 1187094 - RNA, 19 nt, Homo sapiens
gcagacaacauccuuuaca

SEQ ID NO: 1187095 - RNA, 19 nt, Homo sapiens
agugaagucauccuuauua

SEQ ID NO: 1187096 - RNA, 19 nt, Homo sapiens
gaugaaaacucaggaaugu

SEQ ID NO: 1187097 - RNA, 19 nt, Homo sapiens
gguguggaaaugaauauaa

SEQ ID NO: 1187098 - RNA, 19 nt, Homo sapiens
guagacggguuugaaagga

SEQ ID NO: 1187099 - RNA, 19 nt, Homo sapiens
agagcuuggucaaacaaua

SEQ ID NO: 1187100 - RNA, 19 nt, Homo sapiens
ugagguggauaacuauaau

SEQ ID NO: 1187101 - RNA, 19 nt, Homo sapiens
ugaacuggauguuauuucu

SEQ ID NO: 1187102 - RNA, 19 nt, Homo sapiens
gagugcagucauaaucuua

SEQ ID NO: 1187103 - RNA, 19 nt, Homo sapiens
acaacauccuuuacacuau

SEQ ID NO: 1187104 - RNA, 19 nt, Homo sapiens
gauauguacuuugcagaca

SEQ ID NO: 1187105 - RNA, 19 nt, Homo sapiens
gaaaccagacuaccuuaac

SEQ ID NO: 1187106 - RNA, 19 nt, Homo sapiens
caacuaugccagcaaagga

SEQ ID NO: 1187107 - RNA, 19 nt, Homo sapiens
uggaacagauggugaucaa

SEQ ID NO: 1187108 - RNA, 19 nt, Homo sapiens
ucugugacuucaaauugua

SEQ ID NO: 1187109 - RNA, 19 nt, Homo sapiens
guugauaacccuuugaauc

SEQ ID NO: 1187110 - RNA, 19 nt, Homo sapiens
ugaaaacucaggaauguua

SEQ ID NO: 1187111 - RNA, 19 nt, Homo sapiens
aaacugagaacauguccaa

SEQ ID NO: 1187112 - RNA, 19 nt, Homo sapiens
auauguggaugcaaaugua

SEQ ID NO: 1187113 - RNA, 19 nt, Homo sapiens
aagaacucaugguugauaa

SEQ ID NO: 1187114 - RNA, 19 nt, Homo sapiens
gagcacuaaucaacuuaag

SEQ ID NO: 1187115 - RNA, 19 nt, Homo sapiens
cagaagagcacuaaucaac

SEQ ID NO: 1187116 - RNA, 19 nt, Homo sapiens
ugucaucuuuguccauuug

SEQ ID NO: 1187117 - RNA, 19 nt, Homo sapiens
gauuuggggugaaaaguuu

SEQ ID NO: 1187118 - RNA, 19 nt, Homo sapiens
uaugggaugucauggguau

SEQ ID NO: 1187119 - RNA, 19 nt, Homo sapiens
uaacucacguacucugaag

SEQ ID NO: 1187120 - RNA, 19 nt, Homo sapiens
gaggaaauguaaaacaguu

SEQ ID NO: 1187121 - RNA, 19 nt, Homo sapiens
gggcacauaaccaacauug

SEQ ID NO: 1187122 - RNA, 19 nt, Homo sapiens
uauccagacugacuccuau

SEQ ID NO: 1187123 - RNA, 19 nt, Homo sapiens
ccaaauauccagacugacu

SEQ ID NO: 1187124 - RNA, 19 nt, Homo sapiens
cccacgaaaucccaaauau

SEQ ID NO: 1187125 - RNA, 19 nt, Homo sapiens
gagaacauguccaaaaugg

SEQ ID NO: 1187126 - RNA, 19 nt, Homo sapiens
ccuaauaaagugucugcua

SEQ ID NO: 1187127 - RNA, 19 nt, Homo sapiens
uaacuugucccaucaucga

SEQ ID NO: 1187128 - RNA, 19 nt, Homo sapiens
ucugcuaauucaaggcuua

SEQ ID NO: 1187129 - RNA, 19 nt, Homo sapiens
ugacuccuaugaaaguaug

SEQ ID NO: 1187130 - RNA, 19 nt, Homo sapiens
ggauuaagguuccaaauaa

SEQ ID NO: 1187131 - RNA, 19 nt, Homo sapiens
uuaauuagcugcaggauuu

SEQ ID NO: 1187132 - RNA, 19 nt, Homo sapiens
ggaauaaaguucaacauca

SEQ ID NO: 1187133 - RNA, 19 nt, Homo sapiens
gcacaacaccguccacuau

SEQ ID NO: 1187134 - RNA, 19 nt, Homo sapiens
gagggucacucgggacuua

SEQ ID NO: 1187135 - RNA, 19 nt, Homo sapiens
uuaaugagcugaaaucaag

SEQ ID NO: 1187136 - RNA, 19 nt, Homo sapiens
ggaggacgaugccaacuuc

SEQ ID NO: 1187137 - RNA, 19 nt, Homo sapiens
cuacauggauuaccugaug

SEQ ID NO: 1187138 - RNA, 19 nt, Homo sapiens
gaagaacuagucugacaaa

SEQ ID NO: 1187139 - RNA, 19 nt, Homo sapiens
gaauaaaguucaacaucag

SEQ ID NO: 1187140 - RNA, 19 nt, Homo sapiens
gaacuagucugacaaaaca

SEQ ID NO: 1187141 - RNA, 19 nt, Homo sapiens
gggaagaacuagucugaca

SEQ ID NO: 1187142 - RNA, 19 nt, Homo sapiens
gagcugaaaucaagaagag

SEQ ID NO: 1187143 - RNA, 19 nt, Homo sapiens
caaauaaagcacaugguuu

SEQ ID NO: 1187144 - RNA, 19 nt, Homo sapiens
ccacgugguuugcagcuuu

SEQ ID NO: 1187145 - RNA, 19 nt, Homo sapiens
ccaaauaaagcacaugguu

SEQ ID NO: 1187146 - RNA, 19 nt, Homo sapiens
gcaccuacgacuucuacua

SEQ ID NO: 1187147 - RNA, 19 nt, Homo sapiens
uggauuaccugauguucaa

SEQ ID NO: 1187148 - RNA, 19 nt, Homo sapiens
ggagggacgucauuguucu

SEQ ID NO: 1187149 - RNA, 19 nt, Homo sapiens
gcuccauucuccucaaguu

SEQ ID NO: 1187150 - RNA, 19 nt, Homo sapiens
uaccugauguucaacuauu

SEQ ID NO: 1187151 - RNA, 19 nt, Homo sapiens
ggacgaugccaacuucuuc

SEQ ID NO: 1187152 - RNA, 19 nt, Homo sapiens
gcugagaacugggcagaca

SEQ ID NO: 1187153 - RNA, 19 nt, Homo sapiens
aaauaaagcacaugguuuc

SEQ ID NO: 1187154 - RNA, 19 nt, Homo sapiens
ggaagcgggugcucauggu

SEQ ID NO: 1187155 - RNA, 19 nt, Homo sapiens
gaggaucgcccaccaguac

SEQ ID NO: 1187156 - RNA, 19 nt, Homo sapiens
ggagguucccuuggauuaa

SEQ ID NO: 1187157 - RNA, 19 nt, Homo sapiens
ccacgugucccguaucuuc

SEQ ID NO: 1187158 - RNA, 19 nt, Homo sapiens
ggagcucagccgacaguuu

SEQ ID NO: 1187159 - RNA, 19 nt, Homo sapiens
ggaagaacuagucugacaa

SEQ ID NO: 1187160 - RNA, 19 nt, Homo sapiens
gagguucccuuggauuaag

SEQ ID NO: 1187161 - RNA, 19 nt, Homo sapiens
gaugagcagggaagucuga

SEQ ID NO: 1187162 - RNA, 19 nt, Homo sapiens
gcaggugccaggaauaaag

SEQ ID NO: 1187163 - RNA, 19 nt, Homo sapiens
gcgacgagcagaugaguuc

SEQ ID NO: 1187164 - RNA, 19 nt, Homo sapiens
cagcaggugccaggaauaa

SEQ ID NO: 1187165 - RNA, 19 nt, Homo sapiens
ucaagcgccuggacaccuu

SEQ ID NO: 1187166 - RNA, 19 nt, Homo sapiens
gccgucugcucaucaagaa

SEQ ID NO: 1187167 - RNA, 19 nt, Homo sapiens
cagggaagaacuagucuga

SEQ ID NO: 1187168 - RNA, 19 nt, Homo sapiens
gcagcgcaccuacgacuuc

SEQ ID NO: 1187169 - RNA, 19 nt, Homo sapiens
gagcucagccgacaguuuu

SEQ ID NO: 1187170 - RNA, 19 nt, Homo sapiens
ccugcgaccuggaacaaug

SEQ ID NO: 1187171 - RNA, 19 nt, Homo sapiens
ccaggauggugacuugaag

SEQ ID NO: 1187172 - RNA, 19 nt, Homo sapiens
gggagggacgucauuguuc

SEQ ID NO: 1187173 - RNA, 19 nt, Homo sapiens
cagccucucucccaacaag

SEQ ID NO: 1187174 - RNA, 19 nt, Homo sapiens
caacuauuccaagcccuuu

SEQ ID NO: 1187175 - RNA, 19 nt, Homo sapiens
cgacuucuacuacauggau

SEQ ID NO: 1187176 - RNA, 19 nt, Homo sapiens
gcgcagggaagaacuaguc

SEQ ID NO: 1187177 - RNA, 19 nt, Homo sapiens
gaagagccccaucucagaa

SEQ ID NO: 1187178 - RNA, 19 nt, Homo sapiens
gcaggccuccuccucuuca

SEQ ID NO: 1187179 - RNA, 19 nt, Homo sapiens
gaucggcgacgagcagaug

SEQ ID NO: 1187180 - RNA, 19 nt, Homo sapiens
acaacaccguccacuaugg

SEQ ID NO: 1187181 - RNA, 19 nt, Homo sapiens
cgccugguguggacgauga

SEQ ID NO: 1187182 - RNA, 19 nt, Homo sapiens
gaugucccgcacucccuua

SEQ ID NO: 1187183 - RNA, 19 nt, Homo sapiens
ccaccggacagagaacuuu

SEQ ID NO: 1187184 - RNA, 19 nt, Homo sapiens
gagacccaccggacagaga

SEQ ID NO: 1187185 - RNA, 19 nt, Homo sapiens
gcccagcgguaagggaugu

SEQ ID NO: 1187186 - RNA, 19 nt, Homo sapiens
aaaggcagcgcaccuacga

SEQ ID NO: 1187187 - RNA, 19 nt, Homo sapiens
ucucuuccauccugcuguu

SEQ ID NO: 1187188 - RNA, 19 nt, Homo sapiens
ggucgccacuggagaucuc

SEQ ID NO: 1187189 - RNA, 19 nt, Homo sapiens
gcaccuacaccaagaugcu

SEQ ID NO: 1187190 - RNA, 19 nt, Homo sapiens
cugcaggccuccuccucuu

SEQ ID NO: 1187191 - RNA, 19 nt, Homo sapiens
ccaagcccuuugcagaucu

SEQ ID NO: 1187192 - RNA, 19 nt, Homo sapiens
uuagagcgguuuuaauuag

SEQ ID NO: 1187193 - RNA, 19 nt, Homo sapiens
ccagcaggugccaggaaua

SEQ ID NO: 1187194 - RNA, 19 nt, Homo sapiens
cacaugguuuccagagcaa

SEQ ID NO: 1187195 - RNA, 19 nt, Homo sapiens
ccuacgacuucuacuacau

SEQ ID NO: 1187196 - RNA, 19 nt, Homo sapiens
cggcuggccugcauguucu

SEQ ID NO: 1187197 - RNA, 19 nt, Homo sapiens
cgggagggacgucauuguu

SEQ ID NO: 1187198 - RNA, 19 nt, Homo sapiens
cuacgacuucuacuacaug

SEQ ID NO: 1187199 - RNA, 19 nt, Homo sapiens
gaacuauucuucuagacua

SEQ ID NO: 1187200 - RNA, 19 nt, Homo sapiens
ggccuuagcucuagaguga

SEQ ID NO: 1187201 - RNA, 19 nt, Homo sapiens
cagaaucacugggaaauuu

SEQ ID NO: 1187202 - RNA, 19 nt, Homo sapiens
gaacugccuuccauucaau

SEQ ID NO: 1187203 - RNA, 19 nt, Homo sapiens
gcagagcccugagaaguug

SEQ ID NO: 1187204 - RNA, 19 nt, Homo sapiens
ggagucaggccucacauuu

SEQ ID NO: 1187205 - RNA, 19 nt, Homo sapiens
ggcaguagcuggcuguuuc

SEQ ID NO: 1187206 - RNA, 19 nt, Homo sapiens
ggccgaauccuccucuuua

SEQ ID NO: 1187207 - RNA, 19 nt, Homo sapiens
gaggagaccuggacuuuug

SEQ ID NO: 1187208 - RNA, 19 nt, Homo sapiens
ucaggaaucugcauuuuaa

SEQ ID NO: 1187209 - RNA, 19 nt, Homo sapiens
ggaaccagcccagauauca

SEQ ID NO: 1187210 - RNA, 19 nt, Homo sapiens
gcccagaacugccuuccau

SEQ ID NO: 1187211 - RNA, 19 nt, Homo sapiens
acagaaggcaggagacuuu

SEQ ID NO: 1187212 - RNA, 19 nt, Homo sapiens
ucaaagucaugcagagguu

SEQ ID NO: 1187213 - RNA, 19 nt, Homo sapiens
gcaggagacuuuggucagu

SEQ ID NO: 1187214 - RNA, 19 nt, Homo sapiens
gaaucacugggaaauuuaa

SEQ ID NO: 1187215 - RNA, 19 nt, Homo sapiens
gauugccucuggaacuauu

SEQ ID NO: 1187216 - RNA, 19 nt, Homo sapiens
gcucaggccuggucauugc

SEQ ID NO: 1187217 - RNA, 19 nt, Homo sapiens
gggcgacccugacaaguac

SEQ ID NO: 1187218 - RNA, 19 nt, Homo sapiens
acacucacuuugacgauga

SEQ ID NO: 1187219 - RNA, 19 nt, Homo sapiens
aggagacuuuggucaguua

SEQ ID NO: 1187220 - RNA, 19 nt, Homo sapiens
caugagcuaugcccugaug

SEQ ID NO: 1187221 - RNA, 19 nt, Homo sapiens
agucaggccucacauuuca

SEQ ID NO: 1187222 - RNA, 19 nt, Homo sapiens
caacgcugguggaaagaca

SEQ ID NO: 1187223 - RNA, 19 nt, Homo sapiens
acucaacgcugguggaaag

SEQ ID NO: 1187224 - RNA, 19 nt, Homo sapiens
agaacugccuuccauucaa

SEQ ID NO: 1187225 - RNA, 19 nt, Homo sapiens
ugacaagcccacaaggaaa

SEQ ID NO: 1187226 - RNA, 19 nt, Homo sapiens
agaaucacugggaaauuua

SEQ ID NO: 1187227 - RNA, 19 nt, Homo sapiens
uggcauuccugggucguua

SEQ ID NO: 1187228 - RNA, 19 nt, Homo sapiens
cgacauccucaucgacuuu

SEQ ID NO: 1187229 - RNA, 19 nt, Homo sapiens
ucaguuaccugggaauucu

SEQ ID NO: 1187230 - RNA, 19 nt, Homo sapiens
uaaaugauugccucuggaa

SEQ ID NO: 1187231 - RNA, 19 nt, Homo sapiens
ccacaccgauggccugaac

SEQ ID NO: 1187232 - RNA, 19 nt, Homo sapiens
acugggaaauuuaaguuug

SEQ ID NO: 1187233 - RNA, 19 nt, Homo sapiens
gcgauggccugcagcaacu

SEQ ID NO: 1187234 - RNA, 19 nt, Homo sapiens
ucacugggaaauuuaaguu

SEQ ID NO: 1187235 - RNA, 19 nt, Homo sapiens
uagacuaucccacaucaga

SEQ ID NO: 1187236 - RNA, 19 nt, Homo sapiens
gccgaauccuccucuuuag

SEQ ID NO: 1187237 - RNA, 19 nt, Homo sapiens
ccagaacugccuuccauuc

SEQ ID NO: 1187238 - RNA, 19 nt, Homo sapiens
ucuccaggcuguuaaccuu

SEQ ID NO: 1187239 - RNA, 19 nt, Homo sapiens
caggagacuuuggucaguu

SEQ ID NO: 1187240 - RNA, 19 nt, Homo sapiens
ucuagacuaucccacauca

SEQ ID NO: 1187241 - RNA, 19 nt, Homo sapiens
acaaguaccgccugucuca

SEQ ID NO: 1187242 - RNA, 19 nt, Homo sapiens
gaaggcaggagacuuuggu

SEQ ID NO: 1187243 - RNA, 19 nt, Homo sapiens
acaaacagaucagcaugag

SEQ ID NO: 1187244 - RNA, 19 nt, Homo sapiens
ggucaggaaucugcauuuu

SEQ ID NO: 1187245 - RNA, 19 nt, Homo sapiens
caacucaacgcugguggaa

SEQ ID NO: 1187246 - RNA, 19 nt, Homo sapiens
gauuugggccucugucagu

SEQ ID NO: 1187247 - RNA, 19 nt, Homo sapiens
cagaacugccuuccauuca

SEQ ID NO: 1187248 - RNA, 19 nt, Homo sapiens
ggaaucugcauuuuaacua

SEQ ID NO: 1187249 - RNA, 19 nt, Homo sapiens
caucagaaucacugggaaa

SEQ ID NO: 1187250 - RNA, 19 nt, Homo sapiens
ggaacuauucuucuagacu

SEQ ID NO: 1187251 - RNA, 19 nt, Homo sapiens
gagucaggccucacauuuc

SEQ ID NO: 1187252 - RNA, 19 nt, Homo sapiens
gaagaagcgaacccugaca

SEQ ID NO: 1187253 - RNA, 19 nt, Homo sapiens
gguguagccucccgcugau

SEQ ID NO: 1187254 - RNA, 19 nt, Homo sapiens
cccaagaacagcaucaaga

SEQ ID NO: 1187255 - RNA, 19 nt, Homo sapiens
ggggaaauuuguauauuag

SEQ ID NO: 1187256 - RNA, 19 nt, Homo sapiens
ggacacucacuuugacgau

SEQ ID NO: 1187257 - RNA, 19 nt, Homo sapiens
gaaucugcauuuuaacuag

SEQ ID NO: 1187258 - RNA, 19 nt, Homo sapiens
cuggaacuauucuucuaga

SEQ ID NO: 1187259 - RNA, 19 nt, Homo sapiens
guccgaaaccugcgauugu

SEQ ID NO: 1187260 - RNA, 19 nt, Homo sapiens
aagcgaacccugacaugga

SEQ ID NO: 1187261 - RNA, 19 nt, Homo sapiens
ugggcgacccugacaagua

SEQ ID NO: 1187262 - RNA, 19 nt, Homo sapiens
ccauggguagagucacuua

SEQ ID NO: 1187263 - RNA, 19 nt, Homo sapiens
ggaggccccuugucuguuc

SEQ ID NO: 1187264 - RNA, 19 nt, Homo sapiens
gaugugagggcaauuuuga

SEQ ID NO: 1187265 - RNA, 19 nt, Homo sapiens
augauugccucuggaacua

SEQ ID NO: 1187266 - RNA, 19 nt, Homo sapiens
ggcugacucgcuaugguua

SEQ ID NO: 1187267 - RNA, 19 nt, Homo sapiens
ccacacacagcccauccuu

SEQ ID NO: 1187268 - RNA, 19 nt, Homo sapiens
ggacagaaggcaggagacu

SEQ ID NO: 1187269 - RNA, 19 nt, Homo sapiens
uacaaacagaucagcauga

SEQ ID NO: 1187270 - RNA, 19 nt, Homo sapiens
gggcaguagcuggcuguuu

SEQ ID NO: 1187271 - RNA, 19 nt, Homo sapiens
gacuaucccacaucagaau

SEQ ID NO: 1187272 - RNA, 19 nt, Homo sapiens
gaugaggagaccuggacuu

SEQ ID NO: 1187273 - RNA, 19 nt, Homo sapiens
ggucaguuaccugggaauu

SEQ ID NO: 1187274 - RNA, 19 nt, Homo sapiens
ccuagcccaugccuucuuc

SEQ ID NO: 1187275 - RNA, 19 nt, Homo sapiens
cacccugaauccucacuca

SEQ ID NO: 1187276 - RNA, 19 nt, Homo sapiens
ucagaaucacugggaaauu

SEQ ID NO: 1187277 - RNA, 19 nt, Homo sapiens
gggaggccuuagcucuaga

SEQ ID NO: 1187278 - RNA, 19 nt, Homo sapiens
ugacucccaucaacucaac

SEQ ID NO: 1187279 - RNA, 19 nt, Homo sapiens
ccaagaacagcaucaagac

SEQ ID NO: 1187280 - RNA, 19 nt, Homo sapiens
gacaagcccacaaggaaac

SEQ ID NO: 1187281 - RNA, 19 nt, Homo sapiens
cguccugggugguggaauc

SEQ ID NO: 1187282 - RNA, 19 nt, Homo sapiens
cccggaaccagcccagaua

SEQ ID NO: 1187283 - RNA, 19 nt, Homo sapiens
ugacaccuacuucuucaag

SEQ ID NO: 1187284 - RNA, 19 nt, Homo sapiens
uaugacaagcccacaagga

SEQ ID NO: 1187285 - RNA, 19 nt, Homo sapiens
gggcugccaggaaacgauu

SEQ ID NO: 1187286 - RNA, 19 nt, Homo sapiens
gcuguuucguggcauuucu

SEQ ID NO: 1187287 - RNA, 19 nt, Homo sapiens
gaaaccugcgauugucagu

SEQ ID NO: 1187288 - RNA, 19 nt, Homo sapiens
cacagaacgggaagaccua

SEQ ID NO: 1187289 - RNA, 19 nt, Homo sapiens
gaacuauucuucuagacua

SEQ ID NO: 1187290 - RNA, 19 nt, Homo sapiens
ggccuuagcucuagaguga

SEQ ID NO: 1187291 - RNA, 19 nt, Homo sapiens
cagaaucacugggaaauuu

SEQ ID NO: 1187292 - RNA, 19 nt, Homo sapiens
gaacugccuuccauucaau

SEQ ID NO: 1187293 - RNA, 19 nt, Homo sapiens
gcagagcccugagaaguug

SEQ ID NO: 1187294 - RNA, 19 nt, Homo sapiens
ggagucaggccucacauuu

SEQ ID NO: 1187295 - RNA, 19 nt, Homo sapiens
ggcaguagcuggcuguuuc

SEQ ID NO: 1187296 - RNA, 19 nt, Homo sapiens
ggccgaauccuccucuuua

SEQ ID NO: 1187297 - RNA, 19 nt, Homo sapiens
gaggagaccuggacuuuug

SEQ ID NO: 1187298 - RNA, 19 nt, Homo sapiens
ucaggaaucugcauuuuaa

SEQ ID NO: 1187299 - RNA, 19 nt, Homo sapiens
ggaaccagcccagauauca

SEQ ID NO: 1187300 - RNA, 19 nt, Homo sapiens
gcccagaacugccuuccau

SEQ ID NO: 1187301 - RNA, 19 nt, Homo sapiens
acagaaggcaggagacuuu

SEQ ID NO: 1187302 - RNA, 19 nt, Homo sapiens
ucaaagucaugcagagguu

SEQ ID NO: 1187303 - RNA, 19 nt, Homo sapiens
gcaggagacuuuggucagu

SEQ ID NO: 1187304 - RNA, 19 nt, Homo sapiens
gaaucacugggaaauuuaa

SEQ ID NO: 1187305 - RNA, 19 nt, Homo sapiens
gauugccucuggaacuauu

SEQ ID NO: 1187306 - RNA, 19 nt, Homo sapiens
gcucaggccuggucauugc

SEQ ID NO: 1187307 - RNA, 19 nt, Homo sapiens
gggcgacccugacaaguac

SEQ ID NO: 1187308 - RNA, 19 nt, Homo sapiens
acacucacuuugacgauga

SEQ ID NO: 1187309 - RNA, 19 nt, Homo sapiens
aggagacuuuggucaguua

SEQ ID NO: 1187310 - RNA, 19 nt, Homo sapiens
caugagcuaugcccugaug

SEQ ID NO: 1187311 - RNA, 19 nt, Homo sapiens
agucaggccucacauuuca

SEQ ID NO: 1187312 - RNA, 19 nt, Homo sapiens
caacgcugguggaaagaca

SEQ ID NO: 1187313 - RNA, 19 nt, Homo sapiens
acucaacgcugguggaaag

SEQ ID NO: 1187314 - RNA, 19 nt, Homo sapiens
agaacugccuuccauucaa

SEQ ID NO: 1187315 - RNA, 19 nt, Homo sapiens
ugacaagcccacaaggaaa

SEQ ID NO: 1187316 - RNA, 19 nt, Homo sapiens
agaaucacugggaaauuua

SEQ ID NO: 1187317 - RNA, 19 nt, Homo sapiens
uggcauuccugggucguua

SEQ ID NO: 1187318 - RNA, 19 nt, Homo sapiens
cgacauccucaucgacuuu

SEQ ID NO: 1187319 - RNA, 19 nt, Homo sapiens
uaaaugauugccucuggaa

SEQ ID NO: 1187320 - RNA, 19 nt, Homo sapiens
ccacaccgauggccugaac

SEQ ID NO: 1187321 - RNA, 19 nt, Homo sapiens
acugggaaauuuaaguuug

SEQ ID NO: 1187322 - RNA, 19 nt, Homo sapiens
gcgauggccugcagcaacu

SEQ ID NO: 1187323 - RNA, 19 nt, Homo sapiens
ucacugggaaauuuaaguu

SEQ ID NO: 1187324 - RNA, 19 nt, Homo sapiens
uagacuaucccacaucaga

SEQ ID NO: 1187325 - RNA, 19 nt, Homo sapiens
gccgaauccuccucuuuag

SEQ ID NO: 1187326 - RNA, 19 nt, Homo sapiens
ccagaacugccuuccauuc

SEQ ID NO: 1187327 - RNA, 19 nt, Homo sapiens
ucuccaggcuguuaaccuu

SEQ ID NO: 1187328 - RNA, 19 nt, Homo sapiens
caggagacuuuggucaguu

SEQ ID NO: 1187329 - RNA, 19 nt, Homo sapiens
ucuagacuaucccacauca

SEQ ID NO: 1187330 - RNA, 19 nt, Homo sapiens
acaaguaccgccugucuca

SEQ ID NO: 1187331 - RNA, 19 nt, Homo sapiens
gaaggcaggagacuuuggu

SEQ ID NO: 1187332 - RNA, 19 nt, Homo sapiens
acaaacagaucagcaugag

SEQ ID NO: 1187333 - RNA, 19 nt, Homo sapiens
ggucaggaaucugcauuuu

SEQ ID NO: 1187334 - RNA, 19 nt, Homo sapiens
caacucaacgcugguggaa

SEQ ID NO: 1187335 - RNA, 19 nt, Homo sapiens
cagaacugccuuccauuca

SEQ ID NO: 1187336 - RNA, 19 nt, Homo sapiens
gaagaagcgaacccugaca

SEQ ID NO: 1187337 - RNA, 19 nt, Homo sapiens
ggaaucugcauuuuaacua

SEQ ID NO: 1187338 - RNA, 19 nt, Homo sapiens
caucagaaucacugggaaa

SEQ ID NO: 1187339 - RNA, 19 nt, Homo sapiens
ggaacuauucuucuagacu

SEQ ID NO: 1187340 - RNA, 19 nt, Homo sapiens
gguguagccucccgcugau

SEQ ID NO: 1187341 - RNA, 19 nt, Homo sapiens
gagucaggccucacauuuc

SEQ ID NO: 1187342 - RNA, 19 nt, Homo sapiens
cccaagaacagcaucaaga

SEQ ID NO: 1187343 - RNA, 19 nt, Homo sapiens
ggacacucacuuugacgau

SEQ ID NO: 1187344 - RNA, 19 nt, Homo sapiens
gaaucugcauuuuaacuag

SEQ ID NO: 1187345 - RNA, 19 nt, Homo sapiens
cuggaacuauucuucuaga

SEQ ID NO: 1187346 - RNA, 19 nt, Homo sapiens
guccgaaaccugcgauugu

SEQ ID NO: 1187347 - RNA, 19 nt, Homo sapiens
aagcgaacccugacaugga

SEQ ID NO: 1187348 - RNA, 19 nt, Homo sapiens
ugggcgacccugacaagua

SEQ ID NO: 1187349 - RNA, 19 nt, Homo sapiens
ccauggguagagucacuua

SEQ ID NO: 1187350 - RNA, 19 nt, Homo sapiens
gaugugagggcaauuuuga

SEQ ID NO: 1187351 - RNA, 19 nt, Homo sapiens
augauugccucuggaacua

SEQ ID NO: 1187352 - RNA, 19 nt, Homo sapiens
ggcugacucgcuaugguua

SEQ ID NO: 1187353 - RNA, 19 nt, Homo sapiens
ccacacacagcccauccuu

SEQ ID NO: 1187354 - RNA, 19 nt, Homo sapiens
ggacagaaggcaggagacu

SEQ ID NO: 1187355 - RNA, 19 nt, Homo sapiens
uacaaacagaucagcauga

SEQ ID NO: 1187356 - RNA, 19 nt, Homo sapiens
gggcaguagcuggcuguuu

SEQ ID NO: 1187357 - RNA, 19 nt, Homo sapiens
gacuaucccacaucagaau

SEQ ID NO: 1187358 - RNA, 19 nt, Homo sapiens
gaugaggagaccuggacuu

SEQ ID NO: 1187359 - RNA, 19 nt, Homo sapiens
ggucaguuaccugggaauu

SEQ ID NO: 1187360 - RNA, 19 nt, Homo sapiens
ccuagcccaugccuucuuc

SEQ ID NO: 1187361 - RNA, 19 nt, Homo sapiens
cacccugaauccucacuca

SEQ ID NO: 1187362 - RNA, 19 nt, Homo sapiens
ucagaaucacugggaaauu

SEQ ID NO: 1187363 - RNA, 19 nt, Homo sapiens
gggaggccuuagcucuaga

SEQ ID NO: 1187364 - RNA, 19 nt, Homo sapiens
ugacucccaucaacucaac

SEQ ID NO: 1187365 - RNA, 19 nt, Homo sapiens
ccaagaacagcaucaagac

SEQ ID NO: 1187366 - RNA, 19 nt, Homo sapiens
gacaagcccacaaggaaac

SEQ ID NO: 1187367 - RNA, 19 nt, Homo sapiens
cguccugggugguggaauc

SEQ ID NO: 1187368 - RNA, 19 nt, Homo sapiens
cccggaaccagcccagaua

SEQ ID NO: 1187369 - RNA, 19 nt, Homo sapiens
ugacaccuacuucuucaag

SEQ ID NO: 1187370 - RNA, 19 nt, Homo sapiens
uaugacaagcccacaagga

SEQ ID NO: 1187371 - RNA, 19 nt, Homo sapiens
gcuguuucguggcauuucu

SEQ ID NO: 1187372 - RNA, 19 nt, Homo sapiens
gaaaccugcgauugucagu

SEQ ID NO: 1187373 - RNA, 19 nt, Homo sapiens
cacagaacgggaagaccua

SEQ ID NO: 1187374 - RNA, 19 nt, Homo sapiens
gcaaguaccucaagaguga

SEQ ID NO: 1187375 - RNA, 19 nt, Homo sapiens
ggacuuagcuuccugauac

SEQ ID NO: 1187376 - RNA, 19 nt, Homo sapiens
gaaggaaauuuacgugauu

SEQ ID NO: 1187377 - RNA, 19 nt, Homo sapiens
acacaaaggucucuauauu

SEQ ID NO: 1187378 - RNA, 19 nt, Homo sapiens
ggaaauugaugaccggaaa

SEQ ID NO: 1187379 - RNA, 19 nt, Homo sapiens
gaaauuggcuugggaugga

SEQ ID NO: 1187380 - RNA, 19 nt, Homo sapiens
gcagcaagcacuucucuua

SEQ ID NO: 1187381 - RNA, 19 nt, Homo sapiens
gcuguggucucuugauaua

SEQ ID NO: 1187382 - RNA, 19 nt, Homo sapiens
gcagcacaauguagaaauu

SEQ ID NO: 1187383 - RNA, 19 nt, Homo sapiens
ggaaggaaauuuacgugau

SEQ ID NO: 1187384 - RNA, 19 nt, Homo sapiens
ggucuugguuucauaaaug

SEQ ID NO: 1187385 - RNA, 19 nt, Homo sapiens
ccacuucccuaguauguga

SEQ ID NO: 1187386 - RNA, 19 nt, Homo sapiens
gggaaucaguaaacuuuga

SEQ ID NO: 1187387 - RNA, 19 nt, Homo sapiens
uauggaaucugacaaaugu

SEQ ID NO: 1187388 - RNA, 19 nt, Homo sapiens
cacaaaggucucuauauua

SEQ ID NO: 1187389 - RNA, 19 nt, Homo sapiens
gaaggaaaaugcuggaaaa

SEQ ID NO: 1187390 - RNA, 19 nt, Homo sapiens
ugugcaaccuccauaaaua

SEQ ID NO: 1187391 - RNA, 19 nt, Homo sapiens
uaagugaccguauauugua

SEQ ID NO: 1187392 - RNA, 19 nt, Homo sapiens
caugagaccugagcaagaa

SEQ ID NO: 1187393 - RNA, 19 nt, Homo sapiens
ggucagcaauucacuguca

SEQ ID NO: 1187394 - RNA, 19 nt, Homo sapiens
gaguaaugcuuauggaauc

SEQ ID NO: 1187395 - RNA, 19 nt, Homo sapiens
gaccguauauuguaaagag

SEQ ID NO: 1187396 - RNA, 19 nt, Homo sapiens
gagcagagcaggcuacaca

SEQ ID NO: 1187397 - RNA, 19 nt, Homo sapiens
gaacucaggaggcagaaau

SEQ ID NO: 1187398 - RNA, 19 nt, Homo sapiens
ccagcgaaauuauauacuu

SEQ ID NO: 1187399 - RNA, 19 nt, Homo sapiens
gaugaacucuggugugcau

SEQ ID NO: 1187400 - RNA, 19 nt, Homo sapiens
gaugguggaucuagagaca

SEQ ID NO: 1187401 - RNA, 19 nt, Homo sapiens
ggaaauuuacgugauugua

SEQ ID NO: 1187402 - RNA, 19 nt, Homo sapiens
ggaguugagucgcuuugug

SEQ ID NO: 1187403 - RNA, 19 nt, Homo sapiens
gcaaugaaagcaauaugau

SEQ ID NO: 1187404 - RNA, 19 nt, Homo sapiens
uagaagggaguaaggaaua

SEQ ID NO: 1187405 - RNA, 19 nt, Homo sapiens
ggcagaacaugcagcagaa

SEQ ID NO: 1187406 - RNA, 19 nt, Homo sapiens
gcaaggugcauuucuguca

SEQ ID NO: 1187407 - RNA, 19 nt, Homo sapiens
gcagcaccauucggaguaa

SEQ ID NO: 1187408 - RNA, 19 nt, Homo sapiens
cuaauaaaccugauaccaa

SEQ ID NO: 1187409 - RNA, 19 nt, Homo sapiens
gggauuaagcuaagaacuu

SEQ ID NO: 1187410 - RNA, 19 nt, Homo sapiens
gcuggaaccugaggauaga

SEQ ID NO: 1187411 - RNA, 19 nt, Homo sapiens
gagcgcaaguaccucaaga

SEQ ID NO: 1187412 - RNA, 19 nt, Homo sapiens
gaugacagcaggcccagaa

SEQ ID NO: 1187413 - RNA, 19 nt, Homo sapiens
cgagcacacucucuucgaa

SEQ ID NO: 1187414 - RNA, 19 nt, Homo sapiens
cauggaacccacacagaua

SEQ ID NO: 1187415 - RNA, 19 nt, Homo sapiens
gggcauucguugggaaauu

SEQ ID NO: 1187416 - RNA, 19 nt, Homo sapiens
gaugggaggagucgugauu

SEQ ID NO: 1187417 - RNA, 19 nt, Homo sapiens
gugggaaucaguaaacuuu

SEQ ID NO: 1187418 - RNA, 19 nt, Homo sapiens
cagcgaaauuauauacuuc

SEQ ID NO: 1187419 - RNA, 19 nt, Homo sapiens
agaagggaguaaggaauaa

SEQ ID NO: 1187420 - RNA, 19 nt, Homo sapiens
gugaaaccguauacuacuu

SEQ ID NO: 1187421 - RNA, 19 nt, Homo sapiens
ggaaaaugcuggaaaacca

SEQ ID NO: 1187422 - RNA, 19 nt, Homo sapiens
aagagugacuggugcaaga

SEQ ID NO: 1187423 - RNA, 19 nt, Homo sapiens
ugugaaggaaggaaauuua

SEQ ID NO: 1187424 - RNA, 19 nt, Homo sapiens
cagaaaagcugugaaggaa

SEQ ID NO: 1187425 - RNA, 19 nt, Homo sapiens
ccuauaauguggaauaugc

SEQ ID NO: 1187426 - RNA, 19 nt, Homo sapiens
ucaggaggcagaaaucaaa

SEQ ID NO: 1187427 - RNA, 19 nt, Homo sapiens
agagaaggguguucaaggu

SEQ ID NO: 1187428 - RNA, 19 nt, Homo sapiens
gugcauuucugucauuucu

SEQ ID NO: 1187429 - RNA, 19 nt, Homo sapiens
ggaaucaguaaacuuugaa

SEQ ID NO: 1187430 - RNA, 19 nt, Homo sapiens
ggcauucguugggaaauug

SEQ ID NO: 1187431 - RNA, 19 nt, Homo sapiens
ggcuugggauggauaggua

SEQ ID NO: 1187432 - RNA, 19 nt, Homo sapiens
ucgaggugaugcacuguaa

SEQ ID NO: 1187433 - RNA, 19 nt, Homo sapiens
gacccacccuuccgacuca

SEQ ID NO: 1187434 - RNA, 19 nt, Homo sapiens
gaacuuacagaaugcaaac

SEQ ID NO: 1187435 - RNA, 19 nt, Homo sapiens
gaaggaaggaaauuuacgu

SEQ ID NO: 1187436 - RNA, 19 nt, Homo sapiens
gaagggaguaaggaauaaa

SEQ ID NO: 1187437 - RNA, 19 nt, Homo sapiens
ugaaaccguauacuacuuu

SEQ ID NO: 1187438 - RNA, 19 nt, Homo sapiens
ggagcgcucauucuuguga

SEQ ID NO: 1187439 - RNA, 19 nt, Homo sapiens
guaaauccggcauugaugu

SEQ ID NO: 1187440 - RNA, 19 nt, Homo sapiens
ggagagagagagagagaag

SEQ ID NO: 1187441 - RNA, 19 nt, Homo sapiens
acacacaaaggucucuaua

SEQ ID NO: 1187442 - RNA, 19 nt, Homo sapiens
gcaacaacucggagagaug

SEQ ID NO: 1187443 - RNA, 19 nt, Homo sapiens
ucacugucaugcaccuauu

SEQ ID NO: 1187444 - RNA, 19 nt, Homo sapiens
gaagguguuuuacucagaa

SEQ ID NO: 1187445 - RNA, 19 nt, Homo sapiens
gaggugaugcacuguaaau

SEQ ID NO: 1187446 - RNA, 19 nt, Homo sapiens
ggaucaggcccgaaggaaa

SEQ ID NO: 1187447 - RNA, 19 nt, Homo sapiens
gccaaccccuaucauuuua

SEQ ID NO: 1187448 - RNA, 19 nt, Homo sapiens
gcacaaaacaugcuuccuu

SEQ ID NO: 1187449 - RNA, 19 nt, Homo sapiens
ggagagggagagagagaga

SEQ ID NO: 1187450 - RNA, 19 nt, Homo sapiens
ugggagcgcucauucuugu

SEQ ID NO: 1187451 - RNA, 19 nt, Homo sapiens
guuaucguauguacaaagu

SEQ ID NO: 1187452 - RNA, 19 nt, Homo sapiens
gcuuauggaaucugacaaa

SEQ ID NO: 1187453 - RNA, 19 nt, Homo sapiens
cacaaaacaugcuuccuuu

SEQ ID NO: 1187454 - RNA, 19 nt, Homo sapiens
ucacgucauugcaggaugu

SEQ ID NO: 1187455 - RNA, 19 nt, Homo sapiens
gcagagcaggcuacacaau

SEQ ID NO: 1187456 - RNA, 19 nt, Homo sapiens
gugcaaccuccauaaauau

SEQ ID NO: 1187457 - RNA, 19 nt, Homo sapiens
gaucgcaaguggagcuuuu

SEQ ID NO: 1187458 - RNA, 19 nt, Homo sapiens
gcaaacacgagcacacucu

SEQ ID NO: 1187459 - RNA, 19 nt, Homo sapiens
ggagggauuaagcuaagaa

SEQ ID NO: 1187460 - RNA, 19 nt, Homo sapiens
gacuagagaacucagagaa

SEQ ID NO: 1187461 - RNA, 19 nt, Homo sapiens
ggacgaacaaacauuaggu

SEQ ID NO: 1187462 - RNA, 19 nt, Homo sapiens
aagggacgaacaaacauua

SEQ ID NO: 1187463 - RNA, 19 nt, Homo sapiens
caaggugcauuucugucau

SEQ ID NO: 1187464 - RNA, 19 nt, Homo sapiens
gggcuccuuugcucaguug

SEQ ID NO: 1187465 - RNA, 19 nt, Homo sapiens
gauggcagcaccagaucaa

SEQ ID NO: 1187466 - RNA, 19 nt, Homo sapiens
ugagucgcuuugugguaua

SEQ ID NO: 1187467 - RNA, 19 nt, Homo sapiens
cuagaaagccccuauaaug

SEQ ID NO: 1187468 - RNA, 19 nt, Homo sapiens
caacuugagccacuuggau

SEQ ID NO: 1187469 - RNA, 19 nt, Homo sapiens
gaucaggcccgaaggaaaa

SEQ ID NO: 1187470 - RNA, 19 nt, Homo sapiens
gugcaacuccuucuacauc

SEQ ID NO: 1187471 - RNA, 19 nt, Homo sapiens
aggauguucuggaagcuuu

SEQ ID NO: 1187472 - RNA, 19 nt, Homo sapiens
uggaaaaccucaagucaga

SEQ ID NO: 1187473 - RNA, 19 nt, Homo sapiens
uaaugcuuauggaaucuga

SEQ ID NO: 1187474 - RNA, 19 nt, Homo sapiens
guaagaaacuccgaaauua

SEQ ID NO: 1187475 - RNA, 19 nt, Homo sapiens
ccaaugagcuuguauacuu

SEQ ID NO: 1187476 - RNA, 19 nt, Homo sapiens
gaacagcgguacaggaaug

SEQ ID NO: 1187477 - RNA, 19 nt, Homo sapiens
ggagaaauauguauacagu

SEQ ID NO: 1187478 - RNA, 19 nt, Homo sapiens
gaaagaagggaaugaguuu

SEQ ID NO: 1187479 - RNA, 19 nt, Homo sapiens
ggaaugaguuuaagaugau

SEQ ID NO: 1187480 - RNA, 19 nt, Homo sapiens
gggaaugaguuuaagauga

SEQ ID NO: 1187481 - RNA, 19 nt, Homo sapiens
gaaaguugcuccgagaaga

SEQ ID NO: 1187482 - RNA, 19 nt, Homo sapiens
ugaaucagcuugucuaaca

SEQ ID NO: 1187483 - RNA, 19 nt, Homo sapiens
gguaagaaacuccgaaauu

SEQ ID NO: 1187484 - RNA, 19 nt, Homo sapiens
ccaaacagcuaaacuugau

SEQ ID NO: 1187485 - RNA, 19 nt, Homo sapiens
cagcagagauuucaguuuc

SEQ ID NO: 1187486 - RNA, 19 nt, Homo sapiens
gaucuggccauguguguua

SEQ ID NO: 1187487 - RNA, 19 nt, Homo sapiens
gcucauagcaugugaccua

SEQ ID NO: 1187488 - RNA, 19 nt, Homo sapiens
ggaaagaagggaaugaguu

SEQ ID NO: 1187489 - RNA, 19 nt, Homo sapiens
ucaaugaguuuaagaugga

SEQ ID NO: 1187490 - RNA, 19 nt, Homo sapiens
gaaauuacuaugcagcaaa

SEQ ID NO: 1187491 - RNA, 19 nt, Homo sapiens
gagcuuguauacuuccaaa

SEQ ID NO: 1187492 - RNA, 19 nt, Homo sapiens
gcuuagaacuuugacuauu

SEQ ID NO: 1187493 - RNA, 19 nt, Homo sapiens
gcagagaauuccacgugau

SEQ ID NO: 1187494 - RNA, 19 nt, Homo sapiens
uggcagagauuucaguuuc

SEQ ID NO: 1187495 - RNA, 19 nt, Homo sapiens
guacauuccucugcuuaau

SEQ ID NO: 1187496 - RNA, 19 nt, Homo sapiens
ggaagaaucaugccaagag

SEQ ID NO: 1187497 - RNA, 19 nt, Homo sapiens
uuagagagcaagcaacaua

SEQ ID NO: 1187498 - RNA, 19 nt, Homo sapiens
ggaauuccggcagcauuua

SEQ ID NO: 1187499 - RNA, 19 nt, Homo sapiens
cagcuaaacuugauuucca

SEQ ID NO: 1187500 - RNA, 19 nt, Homo sapiens
gagaaucugggauauguau

SEQ ID NO: 1187501 - RNA, 19 nt, Homo sapiens
gcaagcaacauaagagcaa

SEQ ID NO: 1187502 - RNA, 19 nt, Homo sapiens
gaauucaaauacucccaau

SEQ ID NO: 1187503 - RNA, 19 nt, Homo sapiens
gaagggaaugaguuuaaga

SEQ ID NO: 1187504 - RNA, 19 nt, Homo sapiens
ucccagggcuuaaccagaa

SEQ ID NO: 1187505 - RNA, 19 nt, Homo sapiens
ucccagggcuuaaccagaa

SEQ ID NO: 1187506 - RNA, 19 nt, Homo sapiens
ccugacggcuuagaacuuu

SEQ ID NO: 1187507 - RNA, 19 nt, Homo sapiens
ucugggauauguauaguga

SEQ ID NO: 1187508 - RNA, 19 nt, Homo sapiens
gcagaugggcuccuuuaag

SEQ ID NO: 1187509 - RNA, 19 nt, Homo sapiens
gggaagaagaguuaucgaa

SEQ ID NO: 1187510 - RNA, 19 nt, Homo sapiens
gaaaccccaucucuacuaa

SEQ ID NO: 1187511 - RNA, 19 nt, Homo sapiens
caacuugcccugcuuugug

SEQ ID NO: 1187512 - RNA, 19 nt, Homo sapiens
ugggauauguauagugauu

SEQ ID NO: 1187513 - RNA, 19 nt, Homo sapiens
cagaugggcuccuuuaagc

SEQ ID NO: 1187514 - RNA, 19 nt, Homo sapiens
gauggagaaucugggauau

SEQ ID NO: 1187515 - RNA, 19 nt, Homo sapiens
gaguacauuccucugcuua

SEQ ID NO: 1187516 - RNA, 19 nt, Homo sapiens
uggagaaucugggauaugu

SEQ ID NO: 1187517 - RNA, 19 nt, Homo sapiens
aagaagggaaugaguuuaa

SEQ ID NO: 1187518 - RNA, 19 nt, Homo sapiens
caaugagcuuguauacuuc

SEQ ID NO: 1187519 - RNA, 19 nt, Homo sapiens
aguuuaagaugaugccuaa

SEQ ID NO: 1187520 - RNA, 19 nt, Homo sapiens
gaaacuccgaaauuacuau

SEQ ID NO: 1187521 - RNA, 19 nt, Homo sapiens
uuccaagccucauauuuga

SEQ ID NO: 1187522 - RNA, 19 nt, Homo sapiens
guggauuucacacauauaa

SEQ ID NO: 1187523 - RNA, 19 nt, Homo sapiens
uagaaacuguuaaggucuu

SEQ ID NO: 1187524 - RNA, 19 nt, Homo sapiens
gagagcaagcaacauaaga

SEQ ID NO: 1187525 - RNA, 19 nt, Homo sapiens
ugugaugccuccuucaguu

SEQ ID NO: 1187526 - RNA, 19 nt, Homo sapiens
gaaucugggauauguauag

SEQ ID NO: 1187527 - RNA, 19 nt, Homo sapiens
gcaggagaauggcgugaac

SEQ ID NO: 1187528 - RNA, 19 nt, Homo sapiens
ccacggagaaugauuacug

SEQ ID NO: 1187529 - RNA, 19 nt, Homo sapiens
ccgcagaugggcuccuuua

SEQ ID NO: 1187530 - RNA, 19 nt, Homo sapiens
caaugauccucuugcaaca

SEQ ID NO: 1187531 - RNA, 19 nt, Homo sapiens
uauaauugccgccuucuuc

SEQ ID NO: 1187532 - RNA, 19 nt, Homo sapiens
cagcagguccuuacuucaa

SEQ ID NO: 1187533 - RNA, 19 nt, Homo sapiens
cgaaauuacuaugcagcaa

SEQ ID NO: 1187534 - RNA, 19 nt, Homo sapiens
gagaucauccuggcuaaca

SEQ ID NO: 1187535 - RNA, 19 nt, Homo sapiens
gucaguaggauacauuauu

SEQ ID NO: 1187536 - RNA, 19 nt, Homo sapiens
aggcuucccuacccaauga

SEQ ID NO: 1187537 - RNA, 19 nt, Homo sapiens
gccaccaggucuacaggaa

SEQ ID NO: 1187538 - RNA, 19 nt, Homo sapiens
gcagguccuuacuucaauc

SEQ ID NO: 1187539 - RNA, 19 nt, Homo sapiens
gaaugaguuuaagaugaug

SEQ ID NO: 1187540 - RNA, 19 nt, Homo sapiens
uaagaaacuccgaaauuac

SEQ ID NO: 1187541 - RNA, 19 nt, Homo sapiens
auucaaauacucccaauga

SEQ ID NO: 1187542 - RNA, 19 nt, Homo sapiens
aaauaggucagcagagauu

SEQ ID NO: 1187543 - RNA, 19 nt, Homo sapiens
cggcuuagaacuuugacua

SEQ ID NO: 1187544 - RNA, 19 nt, Homo sapiens
ggagaaucugggauaugua

SEQ ID NO: 1187545 - RNA, 19 nt, Homo sapiens
agagcaaggugucugaaca

SEQ ID NO: 1187546 - RNA, 19 nt, Homo sapiens
cacgugaucuggccaugug

SEQ ID NO: 1187547 - RNA, 19 nt, Homo sapiens
ccuaacaggagaaauaugu

SEQ ID NO: 1187548 - RNA, 19 nt, Homo sapiens
ggaggugggugugaagaac

SEQ ID NO: 1187549 - RNA, 19 nt, Homo sapiens
gaguuuaagauggauauga

SEQ ID NO: 1187550 - RNA, 19 nt, Homo sapiens
aaagaagggaaugaguuua

SEQ ID NO: 1187551 - RNA, 19 nt, Homo sapiens
gagaaaguugcuccgagaa

SEQ ID NO: 1187552 - RNA, 19 nt, Homo sapiens
uuuccaagccucauauuug

SEQ ID NO: 1187553 - RNA, 19 nt, Homo sapiens
uggcggaagcucagaguaa

SEQ ID NO: 1187554 - RNA, 19 nt, Homo sapiens
gggauauguauagugauua

SEQ ID NO: 1187555 - RNA, 19 nt, Homo sapiens
gcauuuagagagcaagcaa

SEQ ID NO: 1187556 - RNA, 19 nt, Homo sapiens
caggagaaauauguauaca

SEQ ID NO: 1187557 - RNA, 19 nt, Homo sapiens
cuugaacucugcacagcaa

SEQ ID NO: 1187558 - RNA, 19 nt, Homo sapiens
ccuguaaucccagcacuuu

SEQ ID NO: 1187559 - RNA, 19 nt, Homo sapiens
ccaagccucauauuugaau

SEQ ID NO: 1187560 - RNA, 19 nt, Homo sapiens
ucucaucacccacuggauu

SEQ ID NO: 1187561 - RNA, 19 nt, Homo sapiens
uagagagcaagcaacauaa

SEQ ID NO: 1187562 - RNA, 19 nt, Homo sapiens
gucaggaggucgagaucau

SEQ ID NO: 1187563 - RNA, 19 nt, Homo sapiens
gcuuguauacuuccaaaca

SEQ ID NO: 1187564 - RNA, 19 nt, Homo sapiens
gcccugcuuuguggucuuu

SEQ ID NO: 1187565 - RNA, 19 nt, Homo sapiens
gaaccgccaccucaaugca

SEQ ID NO: 1187566 - RNA, 19 nt, Homo sapiens
cagaaccgccaccucaaug

SEQ ID NO: 1187567 - RNA, 19 nt, Homo sapiens
ggucuuucccgggacauuu

SEQ ID NO: 1187568 - RNA, 19 nt, Homo sapiens
gaaccgccaccucaaugca

SEQ ID NO: 1187569 - RNA, 19 nt, Homo sapiens
cagaaccgccaccucaaug

SEQ ID NO: 1187570 - RNA, 19 nt, Homo sapiens
guuccgauuugaagaccuu

SEQ ID NO: 1187571 - RNA, 19 nt, Homo sapiens
gccugcagcuacuccaguu

SEQ ID NO: 1187572 - RNA, 19 nt, Homo sapiens
ggucgagccugcagcuacu

SEQ ID NO: 1187573 - RNA, 19 nt, Homo sapiens
gguggugggugccuguagu

SEQ ID NO: 1187574 - RNA, 19 nt, Homo sapiens
guaagaaacuccgaaauua

SEQ ID NO: 1187575 - RNA, 19 nt, Homo sapiens
ccaaugagcuuguauacuu

SEQ ID NO: 1187576 - RNA, 19 nt, Homo sapiens
gaacagcgguacaggaaug

SEQ ID NO: 1187577 - RNA, 19 nt, Homo sapiens
gaaaguugcuccgauuuga

SEQ ID NO: 1187578 - RNA, 19 nt, Homo sapiens
ggagaaauauguauacagu

SEQ ID NO: 1187579 - RNA, 19 nt, Homo sapiens
gaaagaagggaaugaguuu

SEQ ID NO: 1187580 - RNA, 19 nt, Homo sapiens
ggaaugaguuuaagaugau

SEQ ID NO: 1187581 - RNA, 19 nt, Homo sapiens
gggaaugaguuuaagauga

SEQ ID NO: 1187582 - RNA, 19 nt, Homo sapiens
ugaaucagcuugucuaaca

SEQ ID NO: 1187583 - RNA, 19 nt, Homo sapiens
gguaagaaacuccgaaauu

SEQ ID NO: 1187584 - RNA, 19 nt, Homo sapiens
ccaaacagcuaaacuugau

SEQ ID NO: 1187585 - RNA, 19 nt, Homo sapiens
cagcagagauuucaguuuc

SEQ ID NO: 1187586 - RNA, 19 nt, Homo sapiens
gaucuggccauguguguua

SEQ ID NO: 1187587 - RNA, 19 nt, Homo sapiens
gcucauagcaugugaccua

SEQ ID NO: 1187588 - RNA, 19 nt, Homo sapiens
ggaaagaagggaaugaguu

SEQ ID NO: 1187589 - RNA, 19 nt, Homo sapiens
ucaaugaguuuaagaugga

SEQ ID NO: 1187590 - RNA, 19 nt, Homo sapiens
gaaauuacuaugcagcaaa

SEQ ID NO: 1187591 - RNA, 19 nt, Homo sapiens
gagcuuguauacuuccaaa

SEQ ID NO: 1187592 - RNA, 19 nt, Homo sapiens
gcuuagaacuuugacuauu

SEQ ID NO: 1187593 - RNA, 19 nt, Homo sapiens
gcagagaauuccacgugau

SEQ ID NO: 1187594 - RNA, 19 nt, Homo sapiens
uggcagagauuucaguuuc

SEQ ID NO: 1187595 - RNA, 19 nt, Homo sapiens
guacauuccucugcuuaau

SEQ ID NO: 1187596 - RNA, 19 nt, Homo sapiens
uaauucagguccuuacuuc

SEQ ID NO: 1187597 - RNA, 19 nt, Homo sapiens
ggaagaaucaugccaagag

SEQ ID NO: 1187598 - RNA, 19 nt, Homo sapiens
uuagagagcaagcaacaua

SEQ ID NO: 1187599 - RNA, 19 nt, Homo sapiens
ggaauuccggcagcauuua

SEQ ID NO: 1187600 - RNA, 19 nt, Homo sapiens
cagcuaaacuugauuucca

SEQ ID NO: 1187601 - RNA, 19 nt, Homo sapiens
gagaaucugggauauguau

SEQ ID NO: 1187602 - RNA, 19 nt, Homo sapiens
gcaagcaacauaagagcaa

SEQ ID NO: 1187603 - RNA, 19 nt, Homo sapiens
gaauucaaauacucccaau

SEQ ID NO: 1187604 - RNA, 19 nt, Homo sapiens
gagaaaguugcuccgauuu

SEQ ID NO: 1187605 - RNA, 19 nt, Homo sapiens
gaagggaaugaguuuaaga

SEQ ID NO: 1187606 - RNA, 19 nt, Homo sapiens
ucccagggcuuaaccagaa

SEQ ID NO: 1187607 - RNA, 19 nt, Homo sapiens
ucccagggcuuaaccagaa

SEQ ID NO: 1187608 - RNA, 19 nt, Homo sapiens
ccugacggcuuagaacuuu

SEQ ID NO: 1187609 - RNA, 19 nt, Homo sapiens
ucugggauauguauaguga

SEQ ID NO: 1187610 - RNA, 19 nt, Homo sapiens
gcagaugggcuccuuuaag

SEQ ID NO: 1187611 - RNA, 19 nt, Homo sapiens
gggaagaagaguuaucgaa

SEQ ID NO: 1187612 - RNA, 19 nt, Homo sapiens
gaaaccccaucucuacuaa

SEQ ID NO: 1187613 - RNA, 19 nt, Homo sapiens
caacuugcccugcuuugug

SEQ ID NO: 1187614 - RNA, 19 nt, Homo sapiens
ugggauauguauagugauu

SEQ ID NO: 1187615 - RNA, 19 nt, Homo sapiens
cagaugggcuccuuuaagc

SEQ ID NO: 1187616 - RNA, 19 nt, Homo sapiens
gauggagaaucugggauau

SEQ ID NO: 1187617 - RNA, 19 nt, Homo sapiens
gaguacauuccucugcuua

SEQ ID NO: 1187618 - RNA, 19 nt, Homo sapiens
uggagaaucugggauaugu

SEQ ID NO: 1187619 - RNA, 19 nt, Homo sapiens
aagaagggaaugaguuuaa

SEQ ID NO: 1187620 - RNA, 19 nt, Homo sapiens
caaugagcuuguauacuuc

SEQ ID NO: 1187621 - RNA, 19 nt, Homo sapiens
aguuuaagaugaugccuaa

SEQ ID NO: 1187622 - RNA, 19 nt, Homo sapiens
gaaacuccgaaauuacuau

SEQ ID NO: 1187623 - RNA, 19 nt, Homo sapiens
uuccaagccucauauuuga

SEQ ID NO: 1187624 - RNA, 19 nt, Homo sapiens
guggauuucacacauauaa

SEQ ID NO: 1187625 - RNA, 19 nt, Homo sapiens
uagaaacuguuaaggucuu

SEQ ID NO: 1187626 - RNA, 19 nt, Homo sapiens
gagagcaagcaacauaaga

SEQ ID NO: 1187627 - RNA, 19 nt, Homo sapiens
ugugaugccuccuucaguu

SEQ ID NO: 1187628 - RNA, 19 nt, Homo sapiens
gaaucugggauauguauag

SEQ ID NO: 1187629 - RNA, 19 nt, Homo sapiens
gcaggagaauggcgugaac

SEQ ID NO: 1187630 - RNA, 19 nt, Homo sapiens
ccacggagaaugauuacug

SEQ ID NO: 1187631 - RNA, 19 nt, Homo sapiens
ccgcagaugggcuccuuua

SEQ ID NO: 1187632 - RNA, 19 nt, Homo sapiens
caaugauccucuugcaaca

SEQ ID NO: 1187633 - RNA, 19 nt, Homo sapiens
uauaauugccgccuucuuc

SEQ ID NO: 1187634 - RNA, 19 nt, Homo sapiens
cgaaauuacuaugcagcaa

SEQ ID NO: 1187635 - RNA, 19 nt, Homo sapiens
gagaucauccuggcuaaca

SEQ ID NO: 1187636 - RNA, 19 nt, Homo sapiens
aggcuucccuacccaauga

SEQ ID NO: 1187637 - RNA, 19 nt, Homo sapiens
gucaguaggauacauuauu

SEQ ID NO: 1187638 - RNA, 19 nt, Homo sapiens
gccaccaggucuacaggaa

SEQ ID NO: 1187639 - RNA, 19 nt, Homo sapiens
gaaugaguuuaagaugaug

SEQ ID NO: 1187640 - RNA, 19 nt, Homo sapiens
gcuccgauuugaagaccuu

SEQ ID NO: 1187641 - RNA, 19 nt, Homo sapiens
uaagaaacuccgaaauuac

SEQ ID NO: 1187642 - RNA, 19 nt, Homo sapiens
auucaaauacucccaauga

SEQ ID NO: 1187643 - RNA, 19 nt, Homo sapiens
aaauaggucagcagagauu

SEQ ID NO: 1187644 - RNA, 19 nt, Homo sapiens
cggcuuagaacuuugacua

SEQ ID NO: 1187645 - RNA, 19 nt, Homo sapiens
ggagaaucugggauaugua

SEQ ID NO: 1187646 - RNA, 19 nt, Homo sapiens
agagcaaggugucugaaca

SEQ ID NO: 1187647 - RNA, 19 nt, Homo sapiens
cacgugaucuggccaugug

SEQ ID NO: 1187648 - RNA, 19 nt, Homo sapiens
ccuaacaggagaaauaugu

SEQ ID NO: 1187649 - RNA, 19 nt, Homo sapiens
ggaggugggugugaagaac

SEQ ID NO: 1187650 - RNA, 19 nt, Homo sapiens
gaguuuaagauggauauga

SEQ ID NO: 1187651 - RNA, 19 nt, Homo sapiens
aaagaagggaaugaguuua

SEQ ID NO: 1187652 - RNA, 19 nt, Homo sapiens
uuuccaagccucauauuug

SEQ ID NO: 1187653 - RNA, 19 nt, Homo sapiens
uggcggaagcucagaguaa

SEQ ID NO: 1187654 - RNA, 19 nt, Homo sapiens
gggauauguauagugauua

SEQ ID NO: 1187655 - RNA, 19 nt, Homo sapiens
gcauuuagagagcaagcaa

SEQ ID NO: 1187656 - RNA, 19 nt, Homo sapiens
caggagaaauauguauaca

SEQ ID NO: 1187657 - RNA, 19 nt, Homo sapiens
cuugaacucugcacagcaa

SEQ ID NO: 1187658 - RNA, 19 nt, Homo sapiens
ccuguaaucccagcacuuu

SEQ ID NO: 1187659 - RNA, 19 nt, Homo sapiens
ccaagccucauauuugaau

SEQ ID NO: 1187660 - RNA, 19 nt, Homo sapiens
uagagagcaagcaacauaa

SEQ ID NO: 1187661 - RNA, 19 nt, Homo sapiens
ucucaucacccacuggauu

SEQ ID NO: 1187662 - RNA, 19 nt, Homo sapiens
gucaggaggucgagaucau

SEQ ID NO: 1187663 - RNA, 19 nt, Homo sapiens
gcuuguauacuuccaaaca

SEQ ID NO: 1187664 - RNA, 19 nt, Homo sapiens
gcccugcuuuguggucuuu

SEQ ID NO: 1187665 - RNA, 19 nt, Homo sapiens
agaaaguugcuccgauuug

SEQ ID NO: 1187666 - RNA, 19 nt, Homo sapiens
gaaccgccaccucaaugca

SEQ ID NO: 1187667 - RNA, 19 nt, Homo sapiens
cagaaccgccaccucaaug

SEQ ID NO: 1187668 - RNA, 19 nt, Homo sapiens
ggucuuucccgggacauuu

SEQ ID NO: 1187669 - RNA, 19 nt, Homo sapiens
gaaccgccaccucaaugca

SEQ ID NO: 1187670 - RNA, 19 nt, Homo sapiens
cagaaccgccaccucaaug

SEQ ID NO: 1187671 - RNA, 19 nt, Homo sapiens
gccugcagcuacuccaguu

SEQ ID NO: 1187672 - RNA, 19 nt, Homo sapiens
ggucgagccugcagcuacu

SEQ ID NO: 1187673 - RNA, 19 nt, Homo sapiens
gguggugggugccuguagu

SEQ ID NO: 1187674 - RNA, 19 nt, Homo sapiens
gagcauagcauuuagauua

SEQ ID NO: 1187675 - RNA, 19 nt, Homo sapiens
guagaaagcuugccaaaga

SEQ ID NO: 1187676 - RNA, 19 nt, Homo sapiens
gcagcuggaugguuuaaua

SEQ ID NO: 1187677 - RNA, 19 nt, Homo sapiens
gagaugaugucuugauaaa

SEQ ID NO: 1187678 - RNA, 19 nt, Homo sapiens
caaaugaucuugaaugagu

SEQ ID NO: 1187679 - RNA, 19 nt, Homo sapiens
ugaacaagaugguauagua

SEQ ID NO: 1187680 - RNA, 19 nt, Homo sapiens
gaauccagcaugaauauua

SEQ ID NO: 1187681 - RNA, 19 nt, Homo sapiens
guauguaucugugcaaaua

SEQ ID NO: 1187682 - RNA, 19 nt, Homo sapiens
gaaaaugacuguagguaaa

SEQ ID NO: 1187683 - RNA, 19 nt, Homo sapiens
gaaagaauccagcaugaau

SEQ ID NO: 1187684 - RNA, 19 nt, Homo sapiens
ggucagaggaucuaacaua

SEQ ID NO: 1187685 - RNA, 19 nt, Homo sapiens
aaaguuagcuucacaccuu

SEQ ID NO: 1187686 - RNA, 19 nt, Homo sapiens
gaaaauaucugucaaacca

SEQ ID NO: 1187687 - RNA, 19 nt, Homo sapiens
guaaguacuucugugguua

SEQ ID NO: 1187688 - RNA, 19 nt, Homo sapiens
caucuaaggugacuaacaa

SEQ ID NO: 1187689 - RNA, 19 nt, Homo sapiens
cagcgggucugucaguuua

SEQ ID NO: 1187690 - RNA, 19 nt, Homo sapiens
cgaaggagcauagcauuua

SEQ ID NO: 1187691 - RNA, 19 nt, Homo sapiens
ugaccuagcuucugcaaga

SEQ ID NO: 1187692 - RNA, 19 nt, Homo sapiens
guacuucugugguuaaugu

SEQ ID NO: 1187693 - RNA, 19 nt, Homo sapiens
gauguacacuugucauguu

SEQ ID NO: 1187694 - RNA, 19 nt, Homo sapiens
ucuaauaucuuuccaguuc

SEQ ID NO: 1187695 - RNA, 19 nt, Homo sapiens
gaauagagccauguucauu

SEQ ID NO: 1187696 - RNA, 19 nt, Homo sapiens
cuacugauauucacaucua

SEQ ID NO: 1187697 - RNA, 19 nt, Homo sapiens
gaacuuggacagcagguuu

SEQ ID NO: 1187698 - RNA, 19 nt, Homo sapiens
agacuaagcugagaaacuu

SEQ ID NO: 1187699 - RNA, 19 nt, Homo sapiens
gcuguaacuucuuguauau

SEQ ID NO: 1187700 - RNA, 19 nt, Homo sapiens
ccaaagauggugaauacua

SEQ ID NO: 1187701 - RNA, 19 nt, Homo sapiens
uauaguaccuucagaaugg

SEQ ID NO: 1187702 - RNA, 19 nt, Homo sapiens
gaacaacuggcuaucaaau

SEQ ID NO: 1187703 - RNA, 19 nt, Homo sapiens
ggaaacaguagcacuuuga

SEQ ID NO: 1187704 - RNA, 19 nt, Homo sapiens
guaucgagaugaugucuug

SEQ ID NO: 1187705 - RNA, 19 nt, Homo sapiens
gaugacgcauuaauguaaa

SEQ ID NO: 1187706 - RNA, 19 nt, Homo sapiens
ggauauuucuugucuuaca

SEQ ID NO: 1187707 - RNA, 19 nt, Homo sapiens
aaauuuggcuuuccuagga

SEQ ID NO: 1187708 - RNA, 19 nt, Homo sapiens
gaccuucccuuuauauauc

SEQ ID NO: 1187709 - RNA, 19 nt, Homo sapiens
gaaggagcauagcauuuag

SEQ ID NO: 1187710 - RNA, 19 nt, Homo sapiens
gguagggccucaagaaauc

SEQ ID NO: 1187711 - RNA, 19 nt, Homo sapiens
aggaguacauccaaauaua

SEQ ID NO: 1187712 - RNA, 19 nt, Homo sapiens
ggagaagaauggcgauuac

SEQ ID NO: 1187713 - RNA, 19 nt, Homo sapiens
acagugacauuaagauuug

SEQ ID NO: 1187714 - RNA, 19 nt, Homo sapiens
agggauauuucuugucuua

SEQ ID NO: 1187715 - RNA, 19 nt, Homo sapiens
gauguaaacucaugcuuuu

SEQ ID NO: 1187716 - RNA, 19 nt, Homo sapiens
ggacaauacagaagacuau

SEQ ID NO: 1187717 - RNA, 19 nt, Homo sapiens
gaagaucucaucaguugga

SEQ ID NO: 1187718 - RNA, 19 nt, Homo sapiens
gugagaagguggcggugua

SEQ ID NO: 1187719 - RNA, 19 nt, Homo sapiens
ggaccucaguuaucuaucu

SEQ ID NO: 1187720 - RNA, 19 nt, Homo sapiens
acaaaggccuuaugaacug

SEQ ID NO: 1187721 - RNA, 19 nt, Homo sapiens
gaauggcugucuucugugu

SEQ ID NO: 1187722 - RNA, 19 nt, Homo sapiens
agaagcugaugacgcauua

SEQ ID NO: 1187723 - RNA, 19 nt, Homo sapiens
uagaacaacuggcuaucaa

SEQ ID NO: 1187724 - RNA, 19 nt, Homo sapiens
caaagauggugaauacuac

SEQ ID NO: 1187725 - RNA, 19 nt, Homo sapiens
uugaauggcuucuaaacaa

SEQ ID NO: 1187726 - RNA, 19 nt, Homo sapiens
gaaggaaacaauuaaugug

SEQ ID NO: 1187727 - RNA, 19 nt, Homo sapiens
ucaguacgauguaaacuca

SEQ ID NO: 1187728 - RNA, 19 nt, Homo sapiens
gauuugugcucuaggagaa

SEQ ID NO: 1187729 - RNA, 19 nt, Homo sapiens
gaauacuacugguguugga

SEQ ID NO: 1187730 - RNA, 19 nt, Homo sapiens
uggauuagauucuguaaag

SEQ ID NO: 1187731 - RNA, 19 nt, Homo sapiens
uaacuucggcuuugaccua

SEQ ID NO: 1187732 - RNA, 19 nt, Homo sapiens
cgguauaaaugucaugaaa

SEQ ID NO: 1187733 - RNA, 19 nt, Homo sapiens
ggaguacauccaaauauau

SEQ ID NO: 1187734 - RNA, 19 nt, Homo sapiens
gaauggcgauuacacaaaa

SEQ ID NO: 1187735 - RNA, 19 nt, Homo sapiens
uuuaauggcccuacugaua

SEQ ID NO: 1187736 - RNA, 19 nt, Homo sapiens
uaaggaguacauccaaaua

SEQ ID NO: 1187737 - RNA, 19 nt, Homo sapiens
uaagauuugugcucuagga

SEQ ID NO: 1187738 - RNA, 19 nt, Homo sapiens
gaagaauggcgauuacaca

SEQ ID NO: 1187739 - RNA, 19 nt, Homo sapiens
uaauggcccuacugauauu

SEQ ID NO: 1187740 - RNA, 19 nt, Homo sapiens
ucgagaugaugucuugaua

SEQ ID NO: 1187741 - RNA, 19 nt, Homo sapiens
guucagugguucuuggaaa

SEQ ID NO: 1187742 - RNA, 19 nt, Homo sapiens
aaguggagauggauguaua

SEQ ID NO: 1187743 - RNA, 19 nt, Homo sapiens
aaagaacucgguauaaaug

SEQ ID NO: 1187744 - RNA, 19 nt, Homo sapiens
ggagauuccugaccagaac

SEQ ID NO: 1187745 - RNA, 19 nt, Homo sapiens
ggaaagaauccagcaugaa

SEQ ID NO: 1187746 - RNA, 19 nt, Homo sapiens
ccagggauauuucuugucu

SEQ ID NO: 1187747 - RNA, 19 nt, Homo sapiens
uuucugaccuucccuuuau

SEQ ID NO: 1187748 - RNA, 19 nt, Homo sapiens
gggcagaacaagaccauga

SEQ ID NO: 1187749 - RNA, 19 nt, Homo sapiens
guacacuugucauguuuua

SEQ ID NO: 1187750 - RNA, 19 nt, Homo sapiens
gaacaaugaaaguuagcuu

SEQ ID NO: 1187751 - RNA, 19 nt, Homo sapiens
caaaccauuucugucagua

SEQ ID NO: 1187752 - RNA, 19 nt, Homo sapiens
gaaacaguagcacuuugaa

SEQ ID NO: 1187753 - RNA, 19 nt, Homo sapiens
gauuacgcuuggcuucuuu

SEQ ID NO: 1187754 - RNA, 19 nt, Homo sapiens
gaauggcuucuaaacaauu

SEQ ID NO: 1187755 - RNA, 19 nt, Homo sapiens
aaagaauccagcaugaaua

SEQ ID NO: 1187756 - RNA, 19 nt, Homo sapiens
guaaauaaggucagaggau

SEQ ID NO: 1187757 - RNA, 19 nt, Homo sapiens
ugccaaagauggugaauac

SEQ ID NO: 1187758 - RNA, 19 nt, Homo sapiens
agaacaagaccaugaggua

SEQ ID NO: 1187759 - RNA, 19 nt, Homo sapiens
ucuaguauguucagugguu

SEQ ID NO: 1187760 - RNA, 19 nt, Homo sapiens
gaacaagaugguauaguac

SEQ ID NO: 1187761 - RNA, 19 nt, Homo sapiens
ucaccagaauguuaaacuu

SEQ ID NO: 1187762 - RNA, 19 nt, Homo sapiens
gacaaugaaggaaacaauu

SEQ ID NO: 1187763 - RNA, 19 nt, Homo sapiens
ugaugacgcauuaauguaa

SEQ ID NO: 1187764 - RNA, 19 nt, Homo sapiens
gcuaacagcaauuucauag

SEQ ID NO: 1187765 - RNA, 19 nt, Homo sapiens
guacggacaauacagaaga

SEQ ID NO: 1187766 - RNA, 19 nt, Homo sapiens
caaacgcaauacacugaau

SEQ ID NO: 1187767 - RNA, 19 nt, Homo sapiens
gaacucgguauaaauguca

SEQ ID NO: 1187768 - RNA, 19 nt, Homo sapiens
acaacuggcuaucaaauac

SEQ ID NO: 1187769 - RNA, 19 nt, Homo sapiens
ggauguuccuucaacuugu

SEQ ID NO: 1187770 - RNA, 19 nt, Homo sapiens
ugacucaccagaauguuaa

SEQ ID NO: 1187771 - RNA, 19 nt, Homo sapiens
ugaauggcuucuaaacaau

SEQ ID NO: 1187772 - RNA, 19 nt, Homo sapiens
ccucaguuaucuaucugua

SEQ ID NO: 1187773 - RNA, 19 nt, Homo sapiens
gacaaaggccuuaugaacu

SEQ ID NO: 1187774 - RNA, 19 nt, Homo sapiens
ggucauaccuccaaaguua

SEQ ID NO: 1187775 - RNA, 19 nt, Homo sapiens
gaaaggagcauugaaauua

SEQ ID NO: 1187776 - RNA, 19 nt, Homo sapiens
uaagagaaguggucuaaua

SEQ ID NO: 1187777 - RNA, 19 nt, Homo sapiens
gagaagaucuuguugcaaa

SEQ ID NO: 1187778 - RNA, 19 nt, Homo sapiens
gauaaugaauggccuagua

SEQ ID NO: 1187779 - RNA, 19 nt, Homo sapiens
caaauagccuucuuacauu

SEQ ID NO: 1187780 - RNA, 19 nt, Homo sapiens
gcaaucuggugauaauuua

SEQ ID NO: 1187781 - RNA, 19 nt, Homo sapiens
gaggugagauugaaguaua

SEQ ID NO: 1187782 - RNA, 19 nt, Homo sapiens
gaucuaacccggcacauua

SEQ ID NO: 1187783 - RNA, 19 nt, Homo sapiens
gaaauaaacucugaugaca

SEQ ID NO: 1187784 - RNA, 19 nt, Homo sapiens
gcaugaagguggugaauga

SEQ ID NO: 1187785 - RNA, 19 nt, Homo sapiens
uaacagaucuggugagugu

SEQ ID NO: 1187786 - RNA, 19 nt, Homo sapiens
gcaaauagccuucuuacau

SEQ ID NO: 1187787 - RNA, 19 nt, Homo sapiens
gcacauauauccacucaca

SEQ ID NO: 1187788 - RNA, 19 nt, Homo sapiens
gcagucagcugucuugcua

SEQ ID NO: 1187789 - RNA, 19 nt, Homo sapiens
gaaauuggcacucgcuaua

SEQ ID NO: 1187790 - RNA, 19 nt, Homo sapiens
gaagauuucuccuccuaaa

SEQ ID NO: 1187791 - RNA, 19 nt, Homo sapiens
gcacaaagauaacguugau

SEQ ID NO: 1187792 - RNA, 19 nt, Homo sapiens
ggccauaccugccacauuu

SEQ ID NO: 1187793 - RNA, 19 nt, Homo sapiens
gcacauuucuggccaguug

SEQ ID NO: 1187794 - RNA, 19 nt, Homo sapiens
gaccuaacgucuaccuuua

SEQ ID NO: 1187795 - RNA, 19 nt, Homo sapiens
guaaaucucuguaaaugug

SEQ ID NO: 1187796 - RNA, 19 nt, Homo sapiens
ugaaagacaucacugguaa

SEQ ID NO: 1187797 - RNA, 19 nt, Homo sapiens
gaacaaagucgacaagaug

SEQ ID NO: 1187798 - RNA, 19 nt, Homo sapiens
gaaauguauuggugucuuu

SEQ ID NO: 1187799 - RNA, 19 nt, Homo sapiens
ggaagaaugcugcccuuua

SEQ ID NO: 1187800 - RNA, 19 nt, Homo sapiens
aaccagaccuacuguauua

SEQ ID NO: 1187801 - RNA, 19 nt, Homo sapiens
caugaucgauuacaaguuu

SEQ ID NO: 1187802 - RNA, 19 nt, Homo sapiens
gaauaaagcaucugaauac

SEQ ID NO: 1187803 - RNA, 19 nt, Homo sapiens
gaagaaugcugcccuuuac

SEQ ID NO: 1187804 - RNA, 19 nt, Homo sapiens
ggacuucgcuuugguggaa

SEQ ID NO: 1187805 - RNA, 19 nt, Homo sapiens
guacagcaauucaagaaga

SEQ ID NO: 1187806 - RNA, 19 nt, Homo sapiens
cuacagggauuacaagaaa

SEQ ID NO: 1187807 - RNA, 19 nt, Homo sapiens
ggaagcaaaucacauagug

SEQ ID NO: 1187808 - RNA, 19 nt, Homo sapiens
agaaaccucucuuugauuu

SEQ ID NO: 1187809 - RNA, 19 nt, Homo sapiens
gagaagaccgaauuccuua

SEQ ID NO: 1187810 - RNA, 19 nt, Homo sapiens
gaugacaccugacugcaaa

SEQ ID NO: 1187811 - RNA, 19 nt, Homo sapiens
gaagauacagauccuaauu

SEQ ID NO: 1187812 - RNA, 19 nt, Homo sapiens
ucagacagcuuauguggaa

SEQ ID NO: 1187813 - RNA, 19 nt, Homo sapiens
gaaacugucugucaucaag

SEQ ID NO: 1187814 - RNA, 19 nt, Homo sapiens
guauaaagcugugaacuuc

SEQ ID NO: 1187815 - RNA, 19 nt, Homo sapiens
ggacacaaagacaugauua

SEQ ID NO: 1187816 - RNA, 19 nt, Homo sapiens
gaacaagaagccuuagauu

SEQ ID NO: 1187817 - RNA, 19 nt, Homo sapiens
ucuuaugacugcacaauua

SEQ ID NO: 1187818 - RNA, 19 nt, Homo sapiens
gcagauaacuauggagaug

SEQ ID NO: 1187819 - RNA, 19 nt, Homo sapiens
ggacagagccagaaagcaa

SEQ ID NO: 1187820 - RNA, 19 nt, Homo sapiens
gcacauaugcucugguuug

SEQ ID NO: 1187821 - RNA, 19 nt, Homo sapiens
gcuccugacuuaccuuuaa

SEQ ID NO: 1187822 - RNA, 19 nt, Homo sapiens
gagaugagccagauaguga

SEQ ID NO: 1187823 - RNA, 19 nt, Homo sapiens
ugaaguauauugugaagug

SEQ ID NO: 1187824 - RNA, 19 nt, Homo sapiens
gcaaagaaauaccagaaac

SEQ ID NO: 1187825 - RNA, 19 nt, Homo sapiens
caaauacagucacgacaga

SEQ ID NO: 1187826 - RNA, 19 nt, Homo sapiens
caagaugaaccuuccaaua

SEQ ID NO: 1187827 - RNA, 19 nt, Homo sapiens
gcagugagccaagaucaua

SEQ ID NO: 1187828 - RNA, 19 nt, Homo sapiens
uaaagcaucugaauacagu

SEQ ID NO: 1187829 - RNA, 19 nt, Homo sapiens
uaaccaugguccuuacaua

SEQ ID NO: 1187830 - RNA, 19 nt, Homo sapiens
gguaacaagucagaaauga

SEQ ID NO: 1187831 - RNA, 19 nt, Homo sapiens
caauagcaaccaagaaaua

SEQ ID NO: 1187832 - RNA, 19 nt, Homo sapiens
ggaaagagaagaugaugga

SEQ ID NO: 1187833 - RNA, 19 nt, Homo sapiens
ccagaagaguuaacaguug

SEQ ID NO: 1187834 - RNA, 19 nt, Homo sapiens
aguaaaagcuggaaaguua

SEQ ID NO: 1187835 - RNA, 19 nt, Homo sapiens
gcacugaggacccauagaa

SEQ ID NO: 1187836 - RNA, 19 nt, Homo sapiens
acaagaagccuuagauuug

SEQ ID NO: 1187837 - RNA, 19 nt, Homo sapiens
guagugacccaaauaaauu

SEQ ID NO: 1187838 - RNA, 19 nt, Homo sapiens
gaaaccagaccuacuguau

SEQ ID NO: 1187839 - RNA, 19 nt, Homo sapiens
gaaggaaagaaaccauuaa

SEQ ID NO: 1187840 - RNA, 19 nt, Homo sapiens
gaugaaaggagcauugaaa

SEQ ID NO: 1187841 - RNA, 19 nt, Homo sapiens
acaccaagcugccguaaau

SEQ ID NO: 1187842 - RNA, 19 nt, Homo sapiens
cuagagagcuauccacuuc

SEQ ID NO: 1187843 - RNA, 19 nt, Homo sapiens
gaacuucguaacuuuguaa

SEQ ID NO: 1187844 - RNA, 19 nt, Homo sapiens
cagauucacucuaaauuca

SEQ ID NO: 1187845 - RNA, 19 nt, Homo sapiens
gaaccuguguuugucauau

SEQ ID NO: 1187846 - RNA, 19 nt, Homo sapiens
caaauaaccacgucuccua

SEQ ID NO: 1187847 - RNA, 19 nt, Homo sapiens
gcgacauagugcacaauua

SEQ ID NO: 1187848 - RNA, 19 nt, Homo sapiens
gaagguacaggcaaagaaa

SEQ ID NO: 1187849 - RNA, 19 nt, Homo sapiens
cuugauaacuacaggaaua

SEQ ID NO: 1187850 - RNA, 19 nt, Homo sapiens
gaccugauguuacuugaau

SEQ ID NO: 1187851 - RNA, 19 nt, Homo sapiens
gauagaaagcucaguguga

SEQ ID NO: 1187852 - RNA, 19 nt, Homo sapiens
ccaaucagcuggucuuucu

SEQ ID NO: 1187853 - RNA, 19 nt, Homo sapiens
aaugauggccaaaguauua

SEQ ID NO: 1187854 - RNA, 19 nt, Homo sapiens
gaacaacaguaacggaaac

SEQ ID NO: 1187855 - RNA, 19 nt, Homo sapiens
gaacagccaaauucacaaa

SEQ ID NO: 1187856 - RNA, 19 nt, Homo sapiens
guggucaccuucaacauaa

SEQ ID NO: 1187857 - RNA, 19 nt, Homo sapiens
gccaggagaugaugaugaa

SEQ ID NO: 1187858 - RNA, 19 nt, Homo sapiens
cggagccucucuucaaaua

SEQ ID NO: 1187859 - RNA, 19 nt, Homo sapiens
ggaaaagcauggaacaaaa

SEQ ID NO: 1187860 - RNA, 19 nt, Homo sapiens
guagaaauguagaagaauc

SEQ ID NO: 1187861 - RNA, 19 nt, Homo sapiens
caaauaaauugggaaagga

SEQ ID NO: 1187862 - RNA, 19 nt, Homo sapiens
cagaagaguuaacaguuga

SEQ ID NO: 1187863 - RNA, 19 nt, Homo sapiens
gcagguuccuuuguaugua

SEQ ID NO: 1187864 - RNA, 19 nt, Homo sapiens
gguaagaacucugauuugg

SEQ ID NO: 1187865 - RNA, 19 nt, Homo sapiens
ggauaacaaucuucugcaa

SEQ ID NO: 1187866 - RNA, 19 nt, Homo sapiens
gaacugcugaugagaaaga

SEQ ID NO: 1187867 - RNA, 19 nt, Homo sapiens
cacaaggccucuucugauu

SEQ ID NO: 1187868 - RNA, 19 nt, Homo sapiens
gaaaagcuguugaaaaucu

SEQ ID NO: 1187869 - RNA, 19 nt, Homo sapiens
uaaccacacuagugagauu

SEQ ID NO: 1187870 - RNA, 19 nt, Homo sapiens
caguaaaccuguagaagug

SEQ ID NO: 1187871 - RNA, 19 nt, Homo sapiens
ccuagagacuuguuucuga

SEQ ID NO: 1187872 - RNA, 19 nt, Homo sapiens
uaaaggacacaguagauuu

SEQ ID NO: 1187873 - RNA, 19 nt, Homo sapiens
gaauuacagucucaugauc

SEQ ID NO: 1187874 - RNA, 19 nt, Homo sapiens
gcagcaagauugaggauaa

SEQ ID NO: 1187875 - RNA, 19 nt, Homo sapiens
caacugauuuacucacuua

SEQ ID NO: 1187876 - RNA, 19 nt, Homo sapiens
gguugaagcuacuuuguua

SEQ ID NO: 1187877 - RNA, 19 nt, Homo sapiens
caagagagauggagcagaa

SEQ ID NO: 1187878 - RNA, 19 nt, Homo sapiens
gacaagaacuaacugcuuu

SEQ ID NO: 1187879 - RNA, 19 nt, Homo sapiens
gaacaauggccacuacuuu

SEQ ID NO: 1187880 - RNA, 19 nt, Homo sapiens
gagaagaauuuguauggaa

SEQ ID NO: 1187881 - RNA, 19 nt, Homo sapiens
gaucaacucuggcaaaaua

SEQ ID NO: 1187882 - RNA, 19 nt, Homo sapiens
ccuaaacccuuucugcuua

SEQ ID NO: 1187883 - RNA, 19 nt, Homo sapiens
gaggagaucuuaaccuaug

SEQ ID NO: 1187884 - RNA, 19 nt, Homo sapiens
gaaauggacucugucauca

SEQ ID NO: 1187885 - RNA, 19 nt, Homo sapiens
gaaacaaaccauagaagaa

SEQ ID NO: 1187886 - RNA, 19 nt, Homo sapiens
ugaaggagaugaaguucua

SEQ ID NO: 1187887 - RNA, 19 nt, Homo sapiens
guaauaaacuggaauucug

SEQ ID NO: 1187888 - RNA, 19 nt, Homo sapiens
gaauuccgaucuugauaaa

SEQ ID NO: 1187889 - RNA, 19 nt, Homo sapiens
caucagagauacuuuccua

SEQ ID NO: 1187890 - RNA, 19 nt, Homo sapiens
guaaugaaauggacucugu

SEQ ID NO: 1187891 - RNA, 19 nt, Homo sapiens
gaacuagcauagauucugu

SEQ ID NO: 1187892 - RNA, 19 nt, Homo sapiens
gaucuuaaccuaugaggaa

SEQ ID NO: 1187893 - RNA, 19 nt, Homo sapiens
ugagagaaaucauugagaa

SEQ ID NO: 1187894 - RNA, 19 nt, Homo sapiens
gaggaaaugucacuuuauc

SEQ ID NO: 1187895 - RNA, 19 nt, Homo sapiens
gaugagagaguuuaugaaa

SEQ ID NO: 1187896 - RNA, 19 nt, Homo sapiens
gcaaagggaagccaugaaa

SEQ ID NO: 1187897 - RNA, 19 nt, Homo sapiens
gagaugaaguucuagagau

SEQ ID NO: 1187898 - RNA, 19 nt, Homo sapiens
guucuuagaucucuugaau

SEQ ID NO: 1187899 - RNA, 19 nt, Homo sapiens
ccacuuggcugaggugaaa

SEQ ID NO: 1187900 - RNA, 19 nt, Homo sapiens
cauagcagcuggaaaguuc

SEQ ID NO: 1187901 - RNA, 19 nt, Homo sapiens
uggcagguguucauuauaa

SEQ ID NO: 1187902 - RNA, 19 nt, Homo sapiens
agaaagacuucgggcauua

SEQ ID NO: 1187903 - RNA, 19 nt, Homo sapiens
aaaguggucuguugcauga

SEQ ID NO: 1187904 - RNA, 19 nt, Homo sapiens
gaaacaguaauccauguaa

SEQ ID NO: 1187905 - RNA, 19 nt, Homo sapiens
ugagagaguuuaugaaagu

SEQ ID NO: 1187906 - RNA, 19 nt, Homo sapiens
uaagucgucucaacugauu

SEQ ID NO: 1187907 - RNA, 19 nt, Homo sapiens
caacagagcauuccauuuu

SEQ ID NO: 1187908 - RNA, 19 nt, Homo sapiens
aauggaagcuuucaacaga

SEQ ID NO: 1187909 - RNA, 19 nt, Homo sapiens
gaagauaaggagccagaaa

SEQ ID NO: 1187910 - RNA, 19 nt, Homo sapiens
ccagaaugcauuuaagaua

SEQ ID NO: 1187911 - RNA, 19 nt, Homo sapiens
gaaguagccgguagagauu

SEQ ID NO: 1187912 - RNA, 19 nt, Homo sapiens
gauucuaaauggaagcuuu

SEQ ID NO: 1187913 - RNA, 19 nt, Homo sapiens
gaggauagcacauuugaca

SEQ ID NO: 1187914 - RNA, 19 nt, Homo sapiens
gcagaacaauggccacuac

SEQ ID NO: 1187915 - RNA, 19 nt, Homo sapiens
ggugauauacuucauguga

SEQ ID NO: 1187916 - RNA, 19 nt, Homo sapiens
ggacgaagauaaucaaccu

SEQ ID NO: 1187917 - RNA, 19 nt, Homo sapiens
ggaaacaguaauccaugua

SEQ ID NO: 1187918 - RNA, 19 nt, Homo sapiens
caaggccaguccuccauuu

SEQ ID NO: 1187919 - RNA, 19 nt, Homo sapiens
ggacaagaacuaacugcuu

SEQ ID NO: 1187920 - RNA, 19 nt, Homo sapiens
uaaggaaggacaagaacua

SEQ ID NO: 1187921 - RNA, 19 nt, Homo sapiens
ugacugugcuacguauaua

SEQ ID NO: 1187922 - RNA, 19 nt, Homo sapiens
gaagauaaucaaccucuag

SEQ ID NO: 1187923 - RNA, 19 nt, Homo sapiens
gagagaguuuaugaaagua

SEQ ID NO: 1187924 - RNA, 19 nt, Homo sapiens
gauagcacauuugacaguu

SEQ ID NO: 1187925 - RNA, 19 nt, Homo sapiens
ggaucagacucuacacuca

SEQ ID NO: 1187926 - RNA, 19 nt, Homo sapiens
gauggaaggcagcaguaua

SEQ ID NO: 1187927 - RNA, 19 nt, Homo sapiens
cauugagcauggugaauuu

SEQ ID NO: 1187928 - RNA, 19 nt, Homo sapiens
gaagccaguucaucauaag

SEQ ID NO: 1187929 - RNA, 19 nt, Homo sapiens
gagauuaccacuuuguuuc

SEQ ID NO: 1187930 - RNA, 19 nt, Homo sapiens
ggaaaugucacuuuaucau

SEQ ID NO: 1187931 - RNA, 19 nt, Homo sapiens
cagaaugcauuuaagauac

SEQ ID NO: 1187932 - RNA, 19 nt, Homo sapiens
gcaugaaggagaugaaguu

SEQ ID NO: 1187933 - RNA, 19 nt, Homo sapiens
uaaagccuaucaggaauug

SEQ ID NO: 1187934 - RNA, 19 nt, Homo sapiens
ugaagacucuccggaauuc

SEQ ID NO: 1187935 - RNA, 19 nt, Homo sapiens
gucagaggcucaugaacaa

SEQ ID NO: 1187936 - RNA, 19 nt, Homo sapiens
ugacaacgaggagaucuua

SEQ ID NO: 1187937 - RNA, 19 nt, Homo sapiens
gaugaaguucuagagauua

SEQ ID NO: 1187938 - RNA, 19 nt, Homo sapiens
agaaaaggcucgugauauu

SEQ ID NO: 1187939 - RNA, 19 nt, Homo sapiens
acgaggagaucuuaaccua

SEQ ID NO: 1187940 - RNA, 19 nt, Homo sapiens
gauauuccguugggugcua

SEQ ID NO: 1187941 - RNA, 19 nt, Homo sapiens
guccaugucucacacaaau

SEQ ID NO: 1187942 - RNA, 19 nt, Homo sapiens
gugcauggcauccuuuauu

SEQ ID NO: 1187943 - RNA, 19 nt, Homo sapiens
gaaaugucacuuuaucauc

SEQ ID NO: 1187944 - RNA, 19 nt, Homo sapiens
augaggaaaugucacuuua

SEQ ID NO: 1187945 - RNA, 19 nt, Homo sapiens
agaugaaguucuagagauu

SEQ ID NO: 1187946 - RNA, 19 nt, Homo sapiens
uaacugcuuugcugaauac

SEQ ID NO: 1187947 - RNA, 19 nt, Homo sapiens
aaacuggaauucuguugau

SEQ ID NO: 1187948 - RNA, 19 nt, Homo sapiens
ucagagauacuuuccuaaa

SEQ ID NO: 1187949 - RNA, 19 nt, Homo sapiens
gaaguucuagagauuaaug

SEQ ID NO: 1187950 - RNA, 19 nt, Homo sapiens
gaaaguauuggccaguaug

SEQ ID NO: 1187951 - RNA, 19 nt, Homo sapiens
cuaacugcuuugcugaaua

SEQ ID NO: 1187952 - RNA, 19 nt, Homo sapiens
ggcaguauuugcuuaggaa

SEQ ID NO: 1187953 - RNA, 19 nt, Homo sapiens
ccugaagaguugagagaaa

SEQ ID NO: 1187954 - RNA, 19 nt, Homo sapiens
ugaaacaaaccauagaaga

SEQ ID NO: 1187955 - RNA, 19 nt, Homo sapiens
ggagaugaaguucuagaga

SEQ ID NO: 1187956 - RNA, 19 nt, Homo sapiens
cagaugagagaguuuauga

SEQ ID NO: 1187957 - RNA, 19 nt, Homo sapiens
aguauaagcuguagaucug

SEQ ID NO: 1187958 - RNA, 19 nt, Homo sapiens
uccaaagccugaagaguug

SEQ ID NO: 1187959 - RNA, 19 nt, Homo sapiens
gggcauuauuggccaaaga

SEQ ID NO: 1187960 - RNA, 19 nt, Homo sapiens
cgaagauaaucaaccucua

SEQ ID NO: 1187961 - RNA, 19 nt, Homo sapiens
ucaacacacucuaaucuac

SEQ ID NO: 1187962 - RNA, 19 nt, Homo sapiens
gauacacaaugccaucaca

SEQ ID NO: 1187963 - RNA, 19 nt, Homo sapiens
gcccgacacugcagcaaga

SEQ ID NO: 1187964 - RNA, 19 nt, Homo sapiens
gagaaaucauugagaagac

SEQ ID NO: 1187965 - RNA, 19 nt, Homo sapiens
cagaacgaauugcgucaga

SEQ ID NO: 1187966 - RNA, 19 nt, Homo sapiens
ugauaugcaugguacuuug

SEQ ID NO: 1187967 - RNA, 19 nt, Homo sapiens
gugcuacaguucguaauga

SEQ ID NO: 1187968 - RNA, 19 nt, Homo sapiens
ugaaaguauuggccaguau

SEQ ID NO: 1187969 - RNA, 19 nt, Homo sapiens
uagcgguucuugccucauu

SEQ ID NO: 1187970 - RNA, 19 nt, Homo sapiens
cuguagaucuguucuuaga

SEQ ID NO: 1187971 - RNA, 19 nt, Homo sapiens
gaaggcagcaguauaagcu

SEQ ID NO: 1187972 - RNA, 19 nt, Homo sapiens
ugaauuccgaucuugauaa

SEQ ID NO: 1187973 - RNA, 19 nt, Homo sapiens
acacaaugccaucacagua

SEQ ID NO: 1187974 - RNA, 19 nt, Homo sapiens
caacgugccuuauuccaua

SEQ ID NO: 1187975 - RNA, 19 nt, Homo sapiens
ggaagaauaugacaaagug

SEQ ID NO: 1187976 - RNA, 19 nt, Homo sapiens
gaaaucaaaugugcacuuu

SEQ ID NO: 1187977 - RNA, 19 nt, Homo sapiens
ugaaggagaugcuaaguuu

SEQ ID NO: 1187978 - RNA, 19 nt, Homo sapiens
gcacuuugcucuccacauu

SEQ ID NO: 1187979 - RNA, 19 nt, Homo sapiens
gcacauacacauacucaua

SEQ ID NO: 1187980 - RNA, 19 nt, Homo sapiens
ggaaagagaccuaguacuu

SEQ ID NO: 1187981 - RNA, 19 nt, Homo sapiens
acacagaaauuccauugua

SEQ ID NO: 1187982 - RNA, 19 nt, Homo sapiens
aaacacaacugcuucugua

SEQ ID NO: 1187983 - RNA, 19 nt, Homo sapiens
caaagacuauugcaaagaa

SEQ ID NO: 1187984 - RNA, 19 nt, Homo sapiens
ucagaaagauuguauggaa

SEQ ID NO: 1187985 - RNA, 19 nt, Homo sapiens
ugaagaugcucuccuuuaa

SEQ ID NO: 1187986 - RNA, 19 nt, Homo sapiens
gagaacagccagagucuuu

SEQ ID NO: 1187987 - RNA, 19 nt, Homo sapiens
ggaaaacucuacaaaauug

SEQ ID NO: 1187988 - RNA, 19 nt, Homo sapiens
acagaaugcuacacacuua

SEQ ID NO: 1187989 - RNA, 19 nt, Homo sapiens
gaacaagugccucuguaaa

SEQ ID NO: 1187990 - RNA, 19 nt, Homo sapiens
gcagaaagcacaaacacaa

SEQ ID NO: 1187991 - RNA, 19 nt, Homo sapiens
agaacucccugaugaauuu

SEQ ID NO: 1187992 - RNA, 19 nt, Homo sapiens
ggaaagauuaugaaaguga

SEQ ID NO: 1187993 - RNA, 19 nt, Homo sapiens
ggaaguuacuggaggaaau

SEQ ID NO: 1187994 - RNA, 19 nt, Homo sapiens
gugagcaacuugauauaaa

SEQ ID NO: 1187995 - RNA, 19 nt, Homo sapiens
ggaagaaauggauggguua

SEQ ID NO: 1187996 - RNA, 19 nt, Homo sapiens
ggucacaucuugggauuug

SEQ ID NO: 1187997 - RNA, 19 nt, Homo sapiens
gaugaaagaggacugcuaa

SEQ ID NO: 1187998 - RNA, 19 nt, Homo sapiens
ggguuuguguuacauauuu

SEQ ID NO: 1187999 - RNA, 19 nt, Homo sapiens
gcacuggguuuguguuaca

SEQ ID NO: 1188000 - RNA, 19 nt, Homo sapiens
gagaagcggugacgucaag

SEQ ID NO: 1188001 - RNA, 19 nt, Homo sapiens
acaaagcaguggcaagaaa

SEQ ID NO: 1188002 - RNA, 19 nt, Homo sapiens
gcugagaaaucugguuauu

SEQ ID NO: 1188003 - RNA, 19 nt, Homo sapiens
cacagaaauuccauuguaa

SEQ ID NO: 1188004 - RNA, 19 nt, Homo sapiens
gggcagguauucuugauca

SEQ ID NO: 1188005 - RNA, 19 nt, Homo sapiens
gugaacaaguggacagaaa

SEQ ID NO: 1188006 - RNA, 19 nt, Homo sapiens
gauggaagaauaugacaaa

SEQ ID NO: 1188007 - RNA, 19 nt, Homo sapiens
gaaagagaccuaguacuuc

SEQ ID NO: 1188008 - RNA, 19 nt, Homo sapiens
gaggacaacugcucuuugg

SEQ ID NO: 1188009 - RNA, 19 nt, Homo sapiens
uugcagaacuccacagaaa

SEQ ID NO: 1188010 - RNA, 19 nt, Homo sapiens
uugcaucgcuguacauauu

SEQ ID NO: 1188011 - RNA, 19 nt, Homo sapiens
gagagaauguuucagaacu

SEQ ID NO: 1188012 - RNA, 19 nt, Homo sapiens
cuaaacaacucccguuaca

SEQ ID NO: 1188013 - RNA, 19 nt, Homo sapiens
ccucaugaccacauucuua

SEQ ID NO: 1188014 - RNA, 19 nt, Homo sapiens
gaagagaucagcagaaagc

SEQ ID NO: 1188015 - RNA, 19 nt, Homo sapiens
gcaaaguccugugacaaag

SEQ ID NO: 1188016 - RNA, 19 nt, Homo sapiens
ugauuacacuggaugauau

SEQ ID NO: 1188017 - RNA, 19 nt, Homo sapiens
uggaagagaucagcagaaa

SEQ ID NO: 1188018 - RNA, 19 nt, Homo sapiens
ugacaugacaucuuacuug

SEQ ID NO: 1188019 - RNA, 19 nt, Homo sapiens
gguacaaccugcacagaca

SEQ ID NO: 1188020 - RNA, 19 nt, Homo sapiens
gauagacaucccacugaua

SEQ ID NO: 1188021 - RNA, 19 nt, Homo sapiens
gaugguggguugugcuuuc

SEQ ID NO: 1188022 - RNA, 19 nt, Homo sapiens
gaagggagcggagcaagga

SEQ ID NO: 1188023 - RNA, 19 nt, Homo sapiens
agaaacauccgcagaguga

SEQ ID NO: 1188024 - RNA, 19 nt, Homo sapiens
gaacaaguggacagaaaca

SEQ ID NO: 1188025 - RNA, 19 nt, Homo sapiens
gaagaaauggauggguuaa

SEQ ID NO: 1188026 - RNA, 19 nt, Homo sapiens
cacaacugcuucuguauuc

SEQ ID NO: 1188027 - RNA, 19 nt, Homo sapiens
acaccaaguugauuugaga

SEQ ID NO: 1188028 - RNA, 19 nt, Homo sapiens
uggaccagauggaagaaua

SEQ ID NO: 1188029 - RNA, 19 nt, Homo sapiens
gaggccauauuccagguuu

SEQ ID NO: 1188030 - RNA, 19 nt, Homo sapiens
ggaaaucaaaugugcacuu

SEQ ID NO: 1188031 - RNA, 19 nt, Homo sapiens
guauggaagcuacguguuu

SEQ ID NO: 1188032 - RNA, 19 nt, Homo sapiens
ccagaauucuacagauaau

SEQ ID NO: 1188033 - RNA, 19 nt, Homo sapiens
uaacgauacuguguucaga

SEQ ID NO: 1188034 - RNA, 19 nt, Homo sapiens
cagagucuuucuugaaguu

SEQ ID NO: 1188035 - RNA, 19 nt, Homo sapiens
gaaaguuguauguguccua

SEQ ID NO: 1188036 - RNA, 19 nt, Homo sapiens
ggguugugcuuuccagauu

SEQ ID NO: 1188037 - RNA, 19 nt, Homo sapiens
agaaauggauggguuaagu

SEQ ID NO: 1188038 - RNA, 19 nt, Homo sapiens
gaauaaagggaggagauga

SEQ ID NO: 1188039 - RNA, 19 nt, Homo sapiens
ccgaacaagugccucugua

SEQ ID NO: 1188040 - RNA, 19 nt, Homo sapiens
agccagaauucuacagaua

SEQ ID NO: 1188041 - RNA, 19 nt, Homo sapiens
ugacaaagcaguggcaaga

SEQ ID NO: 1188042 - RNA, 19 nt, Homo sapiens
agacaucccacugauauaa

SEQ ID NO: 1188043 - RNA, 19 nt, Homo sapiens
gcagaugugcuguggauag

SEQ ID NO: 1188044 - RNA, 19 nt, Homo sapiens
gaaauggauggguuaagug

SEQ ID NO: 1188045 - RNA, 19 nt, Homo sapiens
uggaugauauggaagaaau

SEQ ID NO: 1188046 - RNA, 19 nt, Homo sapiens
agagagaagucuuggaaag

SEQ ID NO: 1188047 - RNA, 19 nt, Homo sapiens
cugaagaugcucuccuuua

SEQ ID NO: 1188048 - RNA, 19 nt, Homo sapiens
cugaugaauuucuaaguga

SEQ ID NO: 1188049 - RNA, 19 nt, Homo sapiens
uccgauggaucuaauuaaa

SEQ ID NO: 1188050 - RNA, 19 nt, Homo sapiens
acacuccugugauuucauu

SEQ ID NO: 1188051 - RNA, 19 nt, Homo sapiens
gccagaauucuacagauaa

SEQ ID NO: 1188052 - RNA, 19 nt, Homo sapiens
gaugugcuguggauagaca

SEQ ID NO: 1188053 - RNA, 19 nt, Homo sapiens
ucagaggaccagcaucuaa

SEQ ID NO: 1188054 - RNA, 19 nt, Homo sapiens
ggcagacgaugcugaagau

SEQ ID NO: 1188055 - RNA, 19 nt, Homo sapiens
caugagaggcugugugaga

SEQ ID NO: 1188056 - RNA, 19 nt, Homo sapiens
ccugaugaauuucuaagug

SEQ ID NO: 1188057 - RNA, 19 nt, Homo sapiens
gcuccaggcucugucgaaa

SEQ ID NO: 1188058 - RNA, 19 nt, Homo sapiens
ggggaaagauuaugaaagu

SEQ ID NO: 1188059 - RNA, 19 nt, Homo sapiens
gccagagucuuucuugaag

SEQ ID NO: 1188060 - RNA, 19 nt, Homo sapiens
aaagggaggagaugaaaga

SEQ ID NO: 1188061 - RNA, 19 nt, Homo sapiens
ugagagagaagucuuggaa

SEQ ID NO: 1188062 - RNA, 19 nt, Homo sapiens
cgaacaagugccucuguaa

SEQ ID NO: 1188063 - RNA, 19 nt, Homo sapiens
ucauggaggugucuguguu

SEQ ID NO: 1188064 - RNA, 19 nt, Homo sapiens
gacccagacucacaaugga

SEQ ID NO: 1188065 - RNA, 19 nt, Homo sapiens
uggagaagaugaacuaggu

SEQ ID NO: 1188066 - RNA, 19 nt, Homo sapiens
ucgcauuccaucccaauua

SEQ ID NO: 1188067 - RNA, 19 nt, Homo sapiens
agaagguuaugugaagaua

SEQ ID NO: 1188068 - RNA, 19 nt, Homo sapiens
gaagaugcucuccuuuaag

SEQ ID NO: 1188069 - RNA, 19 nt, Homo sapiens
guacuauacuaggagagaa

SEQ ID NO: 1188070 - RNA, 19 nt, Homo sapiens
cacauacacauacucauaa

SEQ ID NO: 1188071 - RNA, 19 nt, Homo sapiens
gguugugcuuuccagauuu

SEQ ID NO: 1188072 - RNA, 19 nt, Homo sapiens
ggaggacaacugcucuuug

SEQ ID NO: 1188073 - RNA, 19 nt, Homo sapiens
caagaacggugggcuaucg

SEQ ID NO: 1188074 - RNA, 19 nt, Homo sapiens
ggaaaccugucucuaagua

SEQ ID NO: 1188075 - RNA, 19 nt, Homo sapiens
gaagaaaccagaacacuug

SEQ ID NO: 1188076 - RNA, 19 nt, Homo sapiens
gaauuuaccuugguuguga

SEQ ID NO: 1188077 - RNA, 19 nt, Homo sapiens
ccacugacuuucuuuguuu

SEQ ID NO: 1188078 - RNA, 19 nt, Homo sapiens
gaaguccgguauuuaaaug

SEQ ID NO: 1188079 - RNA, 19 nt, Homo sapiens
uuaccaagauggcguauuu

SEQ ID NO: 1188080 - RNA, 19 nt, Homo sapiens
caaacgaucugaaggugaa

SEQ ID NO: 1188081 - RNA, 19 nt, Homo sapiens
aaacugaaaucacugagaa

SEQ ID NO: 1188082 - RNA, 19 nt, Homo sapiens
ggaauacucucuucuugca

SEQ ID NO: 1188083 - RNA, 19 nt, Homo sapiens
gcacugucuuacugauuua

SEQ ID NO: 1188084 - RNA, 19 nt, Homo sapiens
uuacaucccugauaacuau

SEQ ID NO: 1188085 - RNA, 19 nt, Homo sapiens
gauggcguauuuaaguuua

SEQ ID NO: 1188086 - RNA, 19 nt, Homo sapiens
ugagaaaugucuuuaguuc

SEQ ID NO: 1188087 - RNA, 19 nt, Homo sapiens
cuaaugaaguccgguauuu

SEQ ID NO: 1188088 - RNA, 19 nt, Homo sapiens
ugaaaucacugagaaaugu

SEQ ID NO: 1188089 - RNA, 19 nt, Homo sapiens
guuaggaaauggagaggua

SEQ ID NO: 1188090 - RNA, 19 nt, Homo sapiens
uaauagagcagacagaauu

SEQ ID NO: 1188091 - RNA, 19 nt, Homo sapiens
gaagagagcauuugcaaaa

SEQ ID NO: 1188092 - RNA, 19 nt, Homo sapiens
gugguuaucuaguucagua

SEQ ID NO: 1188093 - RNA, 19 nt, Homo sapiens
gcacugcucguuuguuuga

SEQ ID NO: 1188094 - RNA, 19 nt, Homo sapiens
gaacugcaccaaagaaaca

SEQ ID NO: 1188095 - RNA, 19 nt, Homo sapiens
gugcacugcucguuuguuu

SEQ ID NO: 1188096 - RNA, 19 nt, Homo sapiens
guucaguacuccaaauuau

SEQ ID NO: 1188097 - RNA, 19 nt, Homo sapiens
gagaaaagaugcugacuca

SEQ ID NO: 1188098 - RNA, 19 nt, Homo sapiens
gcaauuagcuuuucuccau

SEQ ID NO: 1188099 - RNA, 19 nt, Homo sapiens
gccaggagcucugcauuga

SEQ ID NO: 1188100 - RNA, 19 nt, Homo sapiens
gaagaccccuaugcaauua

SEQ ID NO: 1188101 - RNA, 19 nt, Homo sapiens
guaaaguuguugacagugu

SEQ ID NO: 1188102 - RNA, 19 nt, Homo sapiens
caggugagcuggaugugaa

SEQ ID NO: 1188103 - RNA, 19 nt, Homo sapiens
caagauggcguauuuaagu

SEQ ID NO: 1188104 - RNA, 19 nt, Homo sapiens
gcagcacagucaacaaaug

SEQ ID NO: 1188105 - RNA, 19 nt, Homo sapiens
caguuuacaucccugauaa

SEQ ID NO: 1188106 - RNA, 19 nt, Homo sapiens
gaauucagcacuacuuaau

SEQ ID NO: 1188107 - RNA, 19 nt, Homo sapiens
uuacaacggcuucuaauga

SEQ ID NO: 1188108 - RNA, 19 nt, Homo sapiens
agagagagcagguuccaua

SEQ ID NO: 1188109 - RNA, 19 nt, Homo sapiens
gaagacagaagauuuggau

SEQ ID NO: 1188110 - RNA, 19 nt, Homo sapiens
gaacccagaggcugcagua

SEQ ID NO: 1188111 - RNA, 19 nt, Homo sapiens
gaaccauaaucauauuugg

SEQ ID NO: 1188112 - RNA, 19 nt, Homo sapiens
ggcauggacuuuaccaaga

SEQ ID NO: 1188113 - RNA, 19 nt, Homo sapiens
caguacagccuuucaguaa

SEQ ID NO: 1188114 - RNA, 19 nt, Homo sapiens
cugaagaacagcacaauaa

SEQ ID NO: 1188115 - RNA, 19 nt, Homo sapiens
gcggaaccauaaucauauu

SEQ ID NO: 1188116 - RNA, 19 nt, Homo sapiens
gaagcuaccaggcgucuau

SEQ ID NO: 1188117 - RNA, 19 nt, Homo sapiens
uacaacggcuucuaaugaa

SEQ ID NO: 1188118 - RNA, 19 nt, Homo sapiens
gcauggacuuuaccaagau

SEQ ID NO: 1188119 - RNA, 19 nt, Homo sapiens
gguaaguugcauucauuua

SEQ ID NO: 1188120 - RNA, 19 nt, Homo sapiens
cagaagauuuggaugauac

SEQ ID NO: 1188121 - RNA, 19 nt, Homo sapiens
gacagaagauuuggaugau

SEQ ID NO: 1188122 - RNA, 19 nt, Homo sapiens
uuccauagcucagcacuuu

SEQ ID NO: 1188123 - RNA, 19 nt, Homo sapiens
aagguaaguugcauucauu

SEQ ID NO: 1188124 - RNA, 19 nt, Homo sapiens
aaaccugucucuaaguaau

SEQ ID NO: 1188125 - RNA, 19 nt, Homo sapiens
ggugugcacugcucguuug

SEQ ID NO: 1188126 - RNA, 19 nt, Homo sapiens
gaagagaagacauuaacag

SEQ ID NO: 1188127 - RNA, 19 nt, Homo sapiens
aaacagcugccuucuauuc

SEQ ID NO: 1188128 - RNA, 19 nt, Homo sapiens
uaaugaaguccgguauuua

SEQ ID NO: 1188129 - RNA, 19 nt, Homo sapiens
gagagcagguuccauagcu

SEQ ID NO: 1188130 - RNA, 19 nt, Homo sapiens
gaugauacaccacugacuu

SEQ ID NO: 1188131 - RNA, 19 nt, Homo sapiens
ggaccuugaggcuuaagua

SEQ ID NO: 1188132 - RNA, 19 nt, Homo sapiens
gaaaccugucucuaaguaa

SEQ ID NO: 1188133 - RNA, 19 nt, Homo sapiens
gaggacugccugaagagua

SEQ ID NO: 1188134 - RNA, 19 nt, Homo sapiens
agaaaacaguggcgacuua

SEQ ID NO: 1188135 - RNA, 19 nt, Homo sapiens
aaucauauuuggcagguau

SEQ ID NO: 1188136 - RNA, 19 nt, Homo sapiens
ggaaccauaaucauauuug

SEQ ID NO: 1188137 - RNA, 19 nt, Homo sapiens
aaugugguuuggaguaaua

SEQ ID NO: 1188138 - RNA, 19 nt, Homo sapiens
gaucugaaggugaagagaa

SEQ ID NO: 1188139 - RNA, 19 nt, Homo sapiens
aaugaaguccgguauuuaa

SEQ ID NO: 1188140 - RNA, 19 nt, Homo sapiens
agaaaugucuuuaguucag

SEQ ID NO: 1188141 - RNA, 19 nt, Homo sapiens
aaacaguggcgacuuaaga

SEQ ID NO: 1188142 - RNA, 19 nt, Homo sapiens
ugaagaacagcacaauaaa

SEQ ID NO: 1188143 - RNA, 19 nt, Homo sapiens
agacagaagauuuggauga

SEQ ID NO: 1188144 - RNA, 19 nt, Homo sapiens
uaaaguuguugacaguguu

SEQ ID NO: 1188145 - RNA, 19 nt, Homo sapiens
acagaagauuuggaugaua

SEQ ID NO: 1188146 - RNA, 19 nt, Homo sapiens
ucuuaucgcucugcauuaa

SEQ ID NO: 1188147 - RNA, 19 nt, Homo sapiens
cagaauucagcacuacuua

SEQ ID NO: 1188148 - RNA, 19 nt, Homo sapiens
ucaguacuccaaauuauug

SEQ ID NO: 1188149 - RNA, 19 nt, Homo sapiens
caggagcucugcauugaag

SEQ ID NO: 1188150 - RNA, 19 nt, Homo sapiens
gaaauggagagguauagag

SEQ ID NO: 1188151 - RNA, 19 nt, Homo sapiens
aaagguaaguugcauucau

SEQ ID NO: 1188152 - RNA, 19 nt, Homo sapiens
ggaauccuucuguacauga

SEQ ID NO: 1188153 - RNA, 19 nt, Homo sapiens
uuaaugugguuuggaguaa

SEQ ID NO: 1188154 - RNA, 19 nt, Homo sapiens
cagcagcacagucaacaaa

SEQ ID NO: 1188155 - RNA, 19 nt, Homo sapiens
gaaaugucuuuaguucagu

SEQ ID NO: 1188156 - RNA, 19 nt, Homo sapiens
gguuucaguuguauauaug

SEQ ID NO: 1188157 - RNA, 19 nt, Homo sapiens
cagacagaauucagcacua

SEQ ID NO: 1188158 - RNA, 19 nt, Homo sapiens
uaaagugaaugccgaagac

SEQ ID NO: 1188159 - RNA, 19 nt, Homo sapiens
caucuuaucgcucugcauu

SEQ ID NO: 1188160 - RNA, 19 nt, Homo sapiens
ucacugagaaaugucuuua

SEQ ID NO: 1188161 - RNA, 19 nt, Homo sapiens
uaacagcaggguuuggaaa

SEQ ID NO: 1188162 - RNA, 19 nt, Homo sapiens
gaagaacagcacaauaaaa

SEQ ID NO: 1188163 - RNA, 19 nt, Homo sapiens
ugcacugucuuacugauuu

SEQ ID NO: 1188164 - RNA, 19 nt, Homo sapiens
aguggaagaucauuugaau

SEQ ID NO: 1188165 - RNA, 19 nt, Homo sapiens
gaccuugaggcuuaaguaa

SEQ ID NO: 1188166 - RNA, 19 nt, Homo sapiens
guaaagugaaugccgaaga

SEQ ID NO: 1188167 - RNA, 19 nt, Homo sapiens
ggaaauggagagguauaga

SEQ ID NO: 1188168 - RNA, 19 nt, Homo sapiens
aggacugccugaagaguaa

SEQ ID NO: 1188169 - RNA, 19 nt, Homo sapiens
guucgauauuccugucuuu

SEQ ID NO: 1188170 - RNA, 19 nt, Homo sapiens
gagaaaugucuuuaguuca

SEQ ID NO: 1188171 - RNA, 19 nt, Homo sapiens
uaaaucagugguuucaguu

SEQ ID NO: 1188172 - RNA, 19 nt, Homo sapiens
auaaaucagugguuucagu

SEQ ID NO: 1188173 - RNA, 19 nt, Homo sapiens
uuagggugguuaucuaguu

SEQ ID NO: 1188174 - RNA, 19 nt, Homo sapiens
cuacagagcucgacaguuc

SEQ ID NO: 1188175 - RNA, 19 nt, Homo sapiens
gagagaacaucaucaccua

SEQ ID NO: 1188176 - RNA, 19 nt, Homo sapiens
gcacaggcccucugaguga

SEQ ID NO: 1188177 - RNA, 19 nt, Homo sapiens
gcaagaagcgcugauggua

SEQ ID NO: 1188178 - RNA, 19 nt, Homo sapiens
gggccuccaucucuaauuu

SEQ ID NO: 1188179 - RNA, 19 nt, Homo sapiens
ccaggaaucuuugucucua

SEQ ID NO: 1188180 - RNA, 19 nt, Homo sapiens
cuacuugguucccauagaa

SEQ ID NO: 1188181 - RNA, 19 nt, Homo sapiens
guucugaagcucacacaua

SEQ ID NO: 1188182 - RNA, 19 nt, Homo sapiens
cuccaucucuaauuucaua

SEQ ID NO: 1188183 - RNA, 19 nt, Homo sapiens
gcccacaucucccuuccuu

SEQ ID NO: 1188184 - RNA, 19 nt, Homo sapiens
ggcauugucuugugugcuu

SEQ ID NO: 1188185 - RNA, 19 nt, Homo sapiens
caguagccaugucuccuuu

SEQ ID NO: 1188186 - RNA, 19 nt, Homo sapiens
guagccaugucuccuuuca

SEQ ID NO: 1188187 - RNA, 19 nt, Homo sapiens
gaggaggacguccgagaga

SEQ ID NO: 1188188 - RNA, 19 nt, Homo sapiens
gggcccugaugccaacuuu

SEQ ID NO: 1188189 - RNA, 19 nt, Homo sapiens
gcugagcccuacgauacuu

SEQ ID NO: 1188190 - RNA, 19 nt, Homo sapiens
aagaagcgcugaugguacu

SEQ ID NO: 1188191 - RNA, 19 nt, Homo sapiens
gaagcaagaagcgcugaug

SEQ ID NO: 1188192 - RNA, 19 nt, Homo sapiens
ccacaucucccuuccuucu

SEQ ID NO: 1188193 - RNA, 19 nt, Homo sapiens
caggaaucuuugucucuau

SEQ ID NO: 1188194 - RNA, 19 nt, Homo sapiens
gugugucucucuccaggaa

SEQ ID NO: 1188195 - RNA, 19 nt, Homo sapiens
gaaucuuugucucuaucug

SEQ ID NO: 1188196 - RNA, 19 nt, Homo sapiens
ggaugagaaugacaaugcu

SEQ ID NO: 1188197 - RNA, 19 nt, Homo sapiens
gccuccaucucuaauuuca

SEQ ID NO: 1188198 - RNA, 19 nt, Homo sapiens
ccuacuugguucccauaga

SEQ ID NO: 1188199 - RNA, 19 nt, Homo sapiens
gcuccuggccagcugauuc

SEQ ID NO: 1188200 - RNA, 19 nt, Homo sapiens
gagggaguagggaaaggaa

SEQ ID NO: 1188201 - RNA, 19 nt, Homo sapiens
agccaugucuccuuucaag

SEQ ID NO: 1188202 - RNA, 19 nt, Homo sapiens
ccuccucccuguccuugug

SEQ ID NO: 1188203 - RNA, 19 nt, Homo sapiens
gggaguagggaaaggaaag

SEQ ID NO: 1188204 - RNA, 19 nt, Homo sapiens
uucugaagcucacacauag

SEQ ID NO: 1188205 - RNA, 19 nt, Homo sapiens
acgacucggugcaggugua

SEQ ID NO: 1188206 - RNA, 19 nt, Homo sapiens
caccgaggccuucgacauc

SEQ ID NO: 1188207 - RNA, 19 nt, Homo sapiens
gcccugaugccaacuuuac

SEQ ID NO: 1188208 - RNA, 19 nt, Homo sapiens
aaagaaggcuguucacuua

SEQ ID NO: 1188209 - RNA, 19 nt, Homo sapiens
cauaguagguguucaauaa

SEQ ID NO: 1188210 - RNA, 19 nt, Homo sapiens
gaaccuaccucgaagaguu

SEQ ID NO: 1188211 - RNA, 19 nt, Homo sapiens
gggacaacgucaucaaaua

SEQ ID NO: 1188212 - RNA, 19 nt, Homo sapiens
ggacgaggaugaagacaug

SEQ ID NO: 1188213 - RNA, 19 nt, Homo sapiens
gaaagaaggcuguucacuu

SEQ ID NO: 1188214 - RNA, 19 nt, Homo sapiens
uaacagaaccuaccucgaa

SEQ ID NO: 1188215 - RNA, 19 nt, Homo sapiens
ggacaaucaugcacagcua

SEQ ID NO: 1188216 - RNA, 19 nt, Homo sapiens
uaaaugcuagccuuuguua

SEQ ID NO: 1188217 - RNA, 19 nt, Homo sapiens
gacaugacuuaccaccuua

SEQ ID NO: 1188218 - RNA, 19 nt, Homo sapiens
gaaggcuguucacuuacua

SEQ ID NO: 1188219 - RNA, 19 nt, Homo sapiens
ggagcggacucuuccauuc

SEQ ID NO: 1188220 - RNA, 19 nt, Homo sapiens
agacaugacuuaccaccuu

SEQ ID NO: 1188221 - RNA, 19 nt, Homo sapiens
ggagagaacacagacauga

SEQ ID NO: 1188222 - RNA, 19 nt, Homo sapiens
gcacauaguagguguucaa

SEQ ID NO: 1188223 - RNA, 19 nt, Homo sapiens
gaagaguugugaggcuaaa

SEQ ID NO: 1188224 - RNA, 19 nt, Homo sapiens
gagccagacuucucagugu

SEQ ID NO: 1188225 - RNA, 19 nt, Homo sapiens
gaccagaucuucgauaucg

SEQ ID NO: 1188226 - RNA, 19 nt, Homo sapiens
cagcaacccucauuucucu

SEQ ID NO: 1188227 - RNA, 19 nt, Homo sapiens
ucacagugcuggccaugga

SEQ ID NO: 1188228 - RNA, 19 nt, Homo sapiens
ggacaacgucaucaaauac

SEQ ID NO: 1188229 - RNA, 19 nt, Homo sapiens
acacagacaugacuuacca

SEQ ID NO: 1188230 - RNA, 19 nt, Homo sapiens
cagaagauguaccaguuca

SEQ ID NO: 1188231 - RNA, 19 nt, Homo sapiens
caucagaguuaagaggaaa

SEQ ID NO: 1188232 - RNA, 19 nt, Homo sapiens
cgcagaagauguaccaguu

SEQ ID NO: 1188233 - RNA, 19 nt, Homo sapiens
gagcaggacuucgccuauc

SEQ ID NO: 1188234 - RNA, 19 nt, Homo sapiens
gcacggagccccuguaugu

SEQ ID NO: 1188235 - RNA, 19 nt, Homo sapiens
ucauaugugucaagugguu

SEQ ID NO: 1188236 - RNA, 19 nt, Homo sapiens
aauaaaugcuagccuuugu

SEQ ID NO: 1188237 - RNA, 19 nt, Homo sapiens
gaggaaagaaggcuguuca

SEQ ID NO: 1188238 - RNA, 19 nt, Homo sapiens
ucaguuuccucaucuguca

SEQ ID NO: 1188239 - RNA, 19 nt, Homo sapiens
caucaaauacaacgacgaa

SEQ ID NO: 1188240 - RNA, 19 nt, Homo sapiens
guacagagaccagcucagu

SEQ ID NO: 1188241 - RNA, 19 nt, Homo sapiens
caccgaagccuacgacaug

SEQ ID NO: 1188242 - RNA, 19 nt, Homo sapiens
caagauccacuccgacuca

SEQ ID NO: 1188243 - RNA, 19 nt, Homo sapiens
gcaccuggccagugaaugg

SEQ ID NO: 1188244 - RNA, 19 nt, Homo sapiens
ucaggaggccaucaucgua

SEQ ID NO: 1188245 - RNA, 19 nt, Homo sapiens
ccacagacagcgacacuca

SEQ ID NO: 1188246 - RNA, 19 nt, Homo sapiens
gcuagccuuuguuacuauu

SEQ ID NO: 1188247 - RNA, 19 nt, Homo sapiens
ucaauaaaugcuagccuuu

SEQ ID NO: 1188248 - RNA, 19 nt, Homo sapiens
gggcaccgcuucuauuucc

SEQ ID NO: 1188249 - RNA, 19 nt, Homo sapiens
gaacacagacaugacuuac

SEQ ID NO: 1188250 - RNA, 19 nt, Homo sapiens
caauaaaugcuagccuuug

SEQ ID NO: 1188251 - RNA, 19 nt, Homo sapiens
gaccagcucagucgucaga

SEQ ID NO: 1188252 - RNA, 19 nt, Homo sapiens
ccauggaggcggacaauca

SEQ ID NO: 1188253 - RNA, 19 nt, Homo sapiens
uggaccagaucuucgauau

SEQ ID NO: 1188254 - RNA, 19 nt, Homo sapiens
gauccaggccacagacaug

SEQ ID NO: 1188255 - RNA, 19 nt, Homo sapiens
aagggcaccuggccaguga

SEQ ID NO: 1188256 - RNA, 19 nt, Homo sapiens
agaacacagacaugacuua

SEQ ID NO: 1188257 - RNA, 19 nt, Homo sapiens
gcagaagauguaccaguuc

SEQ ID NO: 1188258 - RNA, 19 nt, Homo sapiens
cugggacgcuguacagaga

SEQ ID NO: 1188259 - RNA, 19 nt, Homo sapiens
gcacaggcacgcucaccau

SEQ ID NO: 1188260 - RNA, 19 nt, Homo sapiens
gcuacgagguggugaucca

SEQ ID NO: 1188261 - RNA, 19 nt, Homo sapiens
gguccucaguuuccucauc

SEQ ID NO: 1188262 - RNA, 19 nt, Homo sapiens
ccagcucagucgucagaga

SEQ ID NO: 1188263 - RNA, 19 nt, Homo sapiens
ccaucagaguuaagaggaa

SEQ ID NO: 1188264 - RNA, 19 nt, Homo sapiens
ggugcgggauucugaccaa

SEQ ID NO: 1188265 - RNA, 19 nt, Homo sapiens
gcaacaccacggccuuugu

SEQ ID NO: 1188266 - RNA, 19 nt, Homo sapiens
gagucggaguucaucauca

SEQ ID NO: 1188267 - RNA, 19 nt, Homo sapiens
agucggaguucaucaucaa

SEQ ID NO: 1188268 - RNA, 19 nt, Homo sapiens
acaacgucaucaaauacaa

SEQ ID NO: 1188269 - RNA, 19 nt, Homo sapiens
gcgggacaacgucaucaaa

SEQ ID NO: 1188270 - RNA, 19 nt, Homo sapiens
cgauaucgaugcggacaca

SEQ ID NO: 1188271 - RNA, 19 nt, Homo sapiens
ccauugaccgcgaaucaga

SEQ ID NO: 1188272 - RNA, 19 nt, Homo sapiens
ggaaagaaggcuguucacu

SEQ ID NO: 1188273 - RNA, 19 nt, Homo sapiens
gacaacgucaucaaauaca

SEQ ID NO: 1188274 - RNA, 19 nt, Homo sapiens
caccacggccuuugucaug

SEQ ID NO: 1188275 - RNA, 19 nt, Homo sapiens
ggcaggagcaggacguguu

SEQ ID NO: 1188276 - RNA, 19 nt, Homo sapiens
gcggcgauguguucaaggu

SEQ ID NO: 1188277 - RNA, 19 nt, Homo sapiens
aguagguguucaauaaaug

SEQ ID NO: 1188278 - RNA, 19 nt, Homo sapiens
cgaagaguugugaggcuaa

SEQ ID NO: 1188279 - RNA, 19 nt, Homo sapiens
gccgagcucucaccuacag

SEQ ID NO: 1188280 - RNA, 19 nt, Homo sapiens
gagaacacagacaugacuu

SEQ ID NO: 1188281 - RNA, 19 nt, Homo sapiens
augcuagccuuuguuacua

SEQ ID NO: 1188282 - RNA, 19 nt, Homo sapiens
cuucucugguccucaguuu

SEQ ID NO: 1188283 - RNA, 19 nt, Homo sapiens
caucaaguacaccaucuca

SEQ ID NO: 1188284 - RNA, 19 nt, Homo sapiens
ccaacggcauuaaaacuga

SEQ ID NO: 1188285 - RNA, 19 nt, Homo sapiens
gcaggagcaggacguguuc

SEQ ID NO: 1188286 - RNA, 19 nt, Homo sapiens
acucagacgugggagagaa

SEQ ID NO: 1188287 - RNA, 19 nt, Homo sapiens
agaaggcuguucacuuacu

SEQ ID NO: 1188288 - RNA, 19 nt, Homo sapiens
caacaccacggccuuuguc

SEQ ID NO: 1188289 - RNA, 19 nt, Homo sapiens
ccacuaccgucaccaucgu

SEQ ID NO: 1188290 - RNA, 19 nt, Homo sapiens
ggaaaggaccccagagaag

SEQ ID NO: 1188291 - RNA, 19 nt, Homo sapiens
cagcucagucgucagagaa

SEQ ID NO: 1188292 - RNA, 19 nt, Homo sapiens
gcucccagcaacccucauu

SEQ ID NO: 1188293 - RNA, 19 nt, Homo sapiens
ggaccagaucuucgauauc

SEQ ID NO: 1188294 - RNA, 19 nt, Homo sapiens
gugcaggacaucaaugaca

SEQ ID NO: 1188295 - RNA, 19 nt, Homo sapiens
caaggugcaggacaucaau

SEQ ID NO: 1188296 - RNA, 19 nt, Homo sapiens
gaaaggaccccagagaagu

SEQ ID NO: 1188297 - RNA, 19 nt, Homo sapiens
gagcugacaggcgacauuc

SEQ ID NO: 1188298 - RNA, 19 nt, Homo sapiens
cagcucauccagaccauca

SEQ ID NO: 1188299 - RNA, 19 nt, Homo sapiens
ggaccaucuuccugaucga

SEQ ID NO: 1188300 - RNA, 19 nt, Homo sapiens
ucaucaaggugcaggacau

SEQ ID NO: 1188301 - RNA, 19 nt, Homo sapiens
ccagacuucucaguguuca

SEQ ID NO: 1188302 - RNA, 19 nt, Homo sapiens
ggagcaggacguguucuuc

SEQ ID NO: 1188303 - RNA, 19 nt, Homo sapiens
ucagcgugguggacagaga

SEQ ID NO: 1188304 - RNA, 19 nt, Homo sapiens
gacaaucaugcacagcuau

SEQ ID NO: 1188305 - RNA, 19 nt, Homo sapiens
uguucaaggucaccacaga

SEQ ID NO: 1188306 - RNA, 19 nt, Homo sapiens
cguagucaccgacgucaau

SEQ ID NO: 1188307 - RNA, 19 nt, Homo sapiens
gcugacaggcgacauucau

SEQ ID NO: 1188308 - RNA, 19 nt, Homo sapiens
caagggaccucaacaaauu

SEQ ID NO: 1188309 - RNA, 19 nt, Homo sapiens
aagcaaaucuccuuaagua

SEQ ID NO: 1188310 - RNA, 19 nt, Homo sapiens
cuacggaacuucagauuaa

SEQ ID NO: 1188311 - RNA, 19 nt, Homo sapiens
gaagacacauucaucucua

SEQ ID NO: 1188312 - RNA, 19 nt, Homo sapiens
gaagugaucugguucuuac

SEQ ID NO: 1188313 - RNA, 19 nt, Homo sapiens
gcauuaggcuuuggaaauu

SEQ ID NO: 1188314 - RNA, 19 nt, Homo sapiens
agaauaagauccacauuug

SEQ ID NO: 1188315 - RNA, 19 nt, Homo sapiens
gaagacacccgcuccagua

SEQ ID NO: 1188316 - RNA, 19 nt, Homo sapiens
gcaaugaauuccaagaugu

SEQ ID NO: 1188317 - RNA, 19 nt, Homo sapiens
gagaauaagauccacauuu

SEQ ID NO: 1188318 - RNA, 19 nt, Homo sapiens
aaacgcagcucuugacuuc

SEQ ID NO: 1188319 - RNA, 19 nt, Homo sapiens
gcaaaucuccuuaaguaau

SEQ ID NO: 1188320 - RNA, 19 nt, Homo sapiens
cagaaaguguuaucucauu

SEQ ID NO: 1188321 - RNA, 19 nt, Homo sapiens
gagauggacuagaggcuuu

SEQ ID NO: 1188322 - RNA, 19 nt, Homo sapiens
gaagaagcaaggagucuaa

SEQ ID NO: 1188323 - RNA, 19 nt, Homo sapiens
cauuugaacucauuccuaa

SEQ ID NO: 1188324 - RNA, 19 nt, Homo sapiens
uacaguaucugccaguaua

SEQ ID NO: 1188325 - RNA, 19 nt, Homo sapiens
gagagaagauggaaacaac

SEQ ID NO: 1188326 - RNA, 19 nt, Homo sapiens
ccacauugguucauauuca

SEQ ID NO: 1188327 - RNA, 19 nt, Homo sapiens
acagaaacaugaccagauu

SEQ ID NO: 1188328 - RNA, 19 nt, Homo sapiens
ucugaaaucugacaucuau

SEQ ID NO: 1188329 - RNA, 19 nt, Homo sapiens
guagaaaucagaaaugaga

SEQ ID NO: 1188330 - RNA, 19 nt, Homo sapiens
gaagauggaaacaacauug

SEQ ID NO: 1188331 - RNA, 19 nt, Homo sapiens
guaauaucaccucuaguua

SEQ ID NO: 1188332 - RNA, 19 nt, Homo sapiens
uaaaugaacuagggaagga

SEQ ID NO: 1188333 - RNA, 19 nt, Homo sapiens
aaucagacguugccauuug

SEQ ID NO: 1188334 - RNA, 19 nt, Homo sapiens
caagacaguuauacacguu

SEQ ID NO: 1188335 - RNA, 19 nt, Homo sapiens
gcacuuggccaaagaaaca

SEQ ID NO: 1188336 - RNA, 19 nt, Homo sapiens
ggguagaaaucagaaauga

SEQ ID NO: 1188337 - RNA, 19 nt, Homo sapiens
caaauucaccuuaaagcaa

SEQ ID NO: 1188338 - RNA, 19 nt, Homo sapiens
gcaagggaccucaacaaau

SEQ ID NO: 1188339 - RNA, 19 nt, Homo sapiens
gaaaguguuaucucauuga

SEQ ID NO: 1188340 - RNA, 19 nt, Homo sapiens
caacauugcuuuucuuuuc

SEQ ID NO: 1188341 - RNA, 19 nt, Homo sapiens
gaauaagauccacauuuga

SEQ ID NO: 1188342 - RNA, 19 nt, Homo sapiens
uaccaaagcagcauaauau

SEQ ID NO: 1188343 - RNA, 19 nt, Homo sapiens
gagacgaucacgcucauuu

SEQ ID NO: 1188344 - RNA, 19 nt, Homo sapiens
gaagaaacaagcaaagaag

SEQ ID NO: 1188345 - RNA, 19 nt, Homo sapiens
gccauuugguuauaaagaa

SEQ ID NO: 1188346 - RNA, 19 nt, Homo sapiens
gauuuggucccauccuuua

SEQ ID NO: 1188347 - RNA, 19 nt, Homo sapiens
ggacguacccaguuauaca

SEQ ID NO: 1188348 - RNA, 19 nt, Homo sapiens
gacaaacugcuuucccaua

SEQ ID NO: 1188349 - RNA, 19 nt, Homo sapiens
gaacuagggaaggauguaa

SEQ ID NO: 1188350 - RNA, 19 nt, Homo sapiens
gaaaucagaaaugagauga

SEQ ID NO: 1188351 - RNA, 19 nt, Homo sapiens
uacaucugcuucuaacaua

SEQ ID NO: 1188352 - RNA, 19 nt, Homo sapiens
gcacaaagcagaguguauc

SEQ ID NO: 1188353 - RNA, 19 nt, Homo sapiens
caaccuacccuccacaguu

SEQ ID NO: 1188354 - RNA, 19 nt, Homo sapiens
gauagccugugaagauuuc

SEQ ID NO: 1188355 - RNA, 19 nt, Homo sapiens
acugaaauaugucauguga

SEQ ID NO: 1188356 - RNA, 19 nt, Homo sapiens
gaacaagacaguuauacac

SEQ ID NO: 1188357 - RNA, 19 nt, Homo sapiens
guuuggcccuuuagaauug

SEQ ID NO: 1188358 - RNA, 19 nt, Homo sapiens
gaacucauuccuaagugaa

SEQ ID NO: 1188359 - RNA, 19 nt, Homo sapiens
gggagaugaagaacauuua

SEQ ID NO: 1188360 - RNA, 19 nt, Homo sapiens
acucagauauccaaauguu

SEQ ID NO: 1188361 - RNA, 19 nt, Homo sapiens
ggaaggaagaccucagaga

SEQ ID NO: 1188362 - RNA, 19 nt, Homo sapiens
ucucauguuuggcccuuua

SEQ ID NO: 1188363 - RNA, 19 nt, Homo sapiens
cuaaggcccuagcgauuug

SEQ ID NO: 1188364 - RNA, 19 nt, Homo sapiens
acauggacguacccaguua

SEQ ID NO: 1188365 - RNA, 19 nt, Homo sapiens
caacaaauucaccuuaaag

SEQ ID NO: 1188366 - RNA, 19 nt, Homo sapiens
acaaacugcuuucccauag

SEQ ID NO: 1188367 - RNA, 19 nt, Homo sapiens
cccaggacgucucauguuu

SEQ ID NO: 1188368 - RNA, 19 nt, Homo sapiens
cagagaccaacaaaucuua

SEQ ID NO: 1188369 - RNA, 19 nt, Homo sapiens
ggaacaagacaguuauaca

SEQ ID NO: 1188370 - RNA, 19 nt, Homo sapiens
caaacugcuuucccauaga

SEQ ID NO: 1188371 - RNA, 19 nt, Homo sapiens
ccagguagggaacuaagua

SEQ ID NO: 1188372 - RNA, 19 nt, Homo sapiens
caaugaauuccaagaugua

SEQ ID NO: 1188373 - RNA, 19 nt, Homo sapiens
aaccuacccuccacaguuu

SEQ ID NO: 1188374 - RNA, 19 nt, Homo sapiens
caguagaucugggcacuug

SEQ ID NO: 1188375 - RNA, 19 nt, Homo sapiens
gggaaggauguaauaaauu

SEQ ID NO: 1188376 - RNA, 19 nt, Homo sapiens
ggaagaagcaaggagucua

SEQ ID NO: 1188377 - RNA, 19 nt, Homo sapiens
auacucagauauccaaaug

SEQ ID NO: 1188378 - RNA, 19 nt, Homo sapiens
uguaucagcucauggaaca

SEQ ID NO: 1188379 - RNA, 19 nt, Homo sapiens
agaaaguguuaucucauug

SEQ ID NO: 1188380 - RNA, 19 nt, Homo sapiens
agggaaggauguaauaaau

SEQ ID NO: 1188381 - RNA, 19 nt, Homo sapiens
ggagaugaagaacauuuau

SEQ ID NO: 1188382 - RNA, 19 nt, Homo sapiens
guguagaagugaucugguu

SEQ ID NO: 1188383 - RNA, 19 nt, Homo sapiens
gccaguauauucuguaaaa

SEQ ID NO: 1188384 - RNA, 19 nt, Homo sapiens
ccucagagaccaacaaauc

SEQ ID NO: 1188385 - RNA, 19 nt, Homo sapiens
ugaacucauuccuaaguga

SEQ ID NO: 1188386 - RNA, 19 nt, Homo sapiens
gguaauaguguagaaguga

SEQ ID NO: 1188387 - RNA, 19 nt, Homo sapiens
ucauggaacaagacaguua

SEQ ID NO: 1188388 - RNA, 19 nt, Homo sapiens
cauggucuguaaauauuug

SEQ ID NO: 1188389 - RNA, 19 nt, Homo sapiens
cuagauuaaugacugagaa

SEQ ID NO: 1188390 - RNA, 19 nt, Homo sapiens
gaaacgcagcucuugacuu

SEQ ID NO: 1188391 - RNA, 19 nt, Homo sapiens
gcaaaguugucaaaaguuc

SEQ ID NO: 1188392 - RNA, 19 nt, Homo sapiens
ugacaaacuuauacaucug

SEQ ID NO: 1188393 - RNA, 19 nt, Homo sapiens
agacguugccauuugguua

SEQ ID NO: 1188394 - RNA, 19 nt, Homo sapiens
agaagaaacaagcaaagaa

SEQ ID NO: 1188395 - RNA, 19 nt, Homo sapiens
guacccaguuauacaaagu

SEQ ID NO: 1188396 - RNA, 19 nt, Homo sapiens
guaauaguguagaagugau

SEQ ID NO: 1188397 - RNA, 19 nt, Homo sapiens
ucagauauccaaauguuca

SEQ ID NO: 1188398 - RNA, 19 nt, Homo sapiens
caaagaagccaaaaucaga

SEQ ID NO: 1188399 - RNA, 19 nt, Homo sapiens
ccucaacaaauucaccuua

SEQ ID NO: 1188400 - RNA, 19 nt, Homo sapiens
ccagauuucuuaaaacuga

SEQ ID NO: 1188401 - RNA, 19 nt, Homo sapiens
cauuaggcuuuggaaauuu

SEQ ID NO: 1188402 - RNA, 19 nt, Homo sapiens
aguaauaucaccucuaguu

SEQ ID NO: 1188403 - RNA, 19 nt, Homo sapiens
uuaccaaagcagcauaaua

SEQ ID NO: 1188404 - RNA, 19 nt, Homo sapiens
cucaacaaauucaccuuaa

SEQ ID NO: 1188405 - RNA, 19 nt, Homo sapiens
ggauagccugugaagauuu

SEQ ID NO: 1188406 - RNA, 19 nt, Homo sapiens
gacacccgcuccaguagau

SEQ ID NO: 1188407 - RNA, 19 nt, Homo sapiens
aaccugaguuucaugaaga

SEQ ID NO: 1188408 - RNA, 19 nt, Homo sapiens
ggaagaagaagccauauaa

SEQ ID NO: 1188409 - RNA, 19 nt, Homo sapiens
gcaggucacuggcuucuuu

SEQ ID NO: 1188410 - RNA, 19 nt, Homo sapiens
gcacuaggcucuuaucagu

SEQ ID NO: 1188411 - RNA, 19 nt, Homo sapiens
guaagaauuuccaguggua

SEQ ID NO: 1188412 - RNA, 19 nt, Homo sapiens
gaaagaagagcauuaagga

SEQ ID NO: 1188413 - RNA, 19 nt, Homo sapiens
guaaggagcucaaguacuc

SEQ ID NO: 1188414 - RNA, 19 nt, Homo sapiens
ccacacaccugcugaagga

SEQ ID NO: 1188415 - RNA, 19 nt, Homo sapiens
gaaccacacagcaauauug

SEQ ID NO: 1188416 - RNA, 19 nt, Homo sapiens
gaugacaccugccuguuca

SEQ ID NO: 1188417 - RNA, 19 nt, Homo sapiens
ucaaagugcuguugguguu

SEQ ID NO: 1188418 - RNA, 19 nt, Homo sapiens
acaauaauaccguugcuua

SEQ ID NO: 1188419 - RNA, 19 nt, Homo sapiens
gcacauauaaaucagaguu

SEQ ID NO: 1188420 - RNA, 19 nt, Homo sapiens
gaacugggaaucaagguau

SEQ ID NO: 1188421 - RNA, 19 nt, Homo sapiens
gaagccagagacagaaaua

SEQ ID NO: 1188422 - RNA, 19 nt, Homo sapiens
ggagaaccacacagcaaua

SEQ ID NO: 1188423 - RNA, 19 nt, Homo sapiens
gcauucagcugcccacaag

SEQ ID NO: 1188424 - RNA, 19 nt, Homo sapiens
ggugaugucuccgaaagaa

SEQ ID NO: 1188425 - RNA, 19 nt, Homo sapiens
cugaauggcuuauccaaau

SEQ ID NO: 1188426 - RNA, 19 nt, Homo sapiens
agaagaagccauauaauag

SEQ ID NO: 1188427 - RNA, 19 nt, Homo sapiens
gaagaagaagccauauaau

SEQ ID NO: 1188428 - RNA, 19 nt, Homo sapiens
caucaaacaggacaacuuu

SEQ ID NO: 1188429 - RNA, 19 nt, Homo sapiens
ccacacagcaauauuguau

SEQ ID NO: 1188430 - RNA, 19 nt, Homo sapiens
ugauggagcugaugcuuuc

SEQ ID NO: 1188431 - RNA, 19 nt, Homo sapiens
gauuacaagucucaugugu

SEQ ID NO: 1188432 - RNA, 19 nt, Homo sapiens
ccuaagggcugaagcaaag

SEQ ID NO: 1188433 - RNA, 19 nt, Homo sapiens
aagaagagcauuaaggaaa

SEQ ID NO: 1188434 - RNA, 19 nt, Homo sapiens
gauggacgauuacaagucu

SEQ ID NO: 1188435 - RNA, 19 nt, Homo sapiens
gaaguauggcuacaauuca

SEQ ID NO: 1188436 - RNA, 19 nt, Homo sapiens
ugagaaguauggcuacaau

SEQ ID NO: 1188437 - RNA, 19 nt, Homo sapiens
gaccauguuuacccagaaa

SEQ ID NO: 1188438 - RNA, 19 nt, Homo sapiens
ggaccauguuuacccagaa

SEQ ID NO: 1188439 - RNA, 19 nt, Homo sapiens
ugaaauuggucuucuggau

SEQ ID NO: 1188440 - RNA, 19 nt, Homo sapiens
gauucgcagugucucauuu

SEQ ID NO: 1188441 - RNA, 19 nt, Homo sapiens
gcagucguuuccucucuga

SEQ ID NO: 1188442 - RNA, 19 nt, Homo sapiens
uacaagcgcuggaacuuca

SEQ ID NO: 1188443 - RNA, 19 nt, Homo sapiens
ggaaaucauucugguggau

SEQ ID NO: 1188444 - RNA, 19 nt, Homo sapiens
gcugaugcuuucucuccua

SEQ ID NO: 1188445 - RNA, 19 nt, Homo sapiens
gaagagggaaggccugauc

SEQ ID NO: 1188446 - RNA, 19 nt, Homo sapiens
uuaagaacuccaucaagua

SEQ ID NO: 1188447 - RNA, 19 nt, Homo sapiens
ggaacuucauccagaaugg

SEQ ID NO: 1188448 - RNA, 19 nt, Homo sapiens
ugggcuugcugcuucauua

SEQ ID NO: 1188449 - RNA, 19 nt, Homo sapiens
ggauguauacggaggagaa

SEQ ID NO: 1188450 - RNA, 19 nt, Homo sapiens
gauccgcgcucgcauugag

SEQ ID NO: 1188451 - RNA, 19 nt, Homo sapiens
agaggaguauguccacaaa

SEQ ID NO: 1188452 - RNA, 19 nt, Homo sapiens
cauguuagcacuucccaaa

SEQ ID NO: 1188453 - RNA, 19 nt, Homo sapiens
gaugcuuucucuccuaauc

SEQ ID NO: 1188454 - RNA, 19 nt, Homo sapiens
gaagaagccauauaauagc

SEQ ID NO: 1188455 - RNA, 19 nt, Homo sapiens
uaagaacuccaucaaguag

SEQ ID NO: 1188456 - RNA, 19 nt, Homo sapiens
auuaagaacuccaucaagu

SEQ ID NO: 1188457 - RNA, 19 nt, Homo sapiens
acccagaaaugagaagaua

SEQ ID NO: 1188458 - RNA, 19 nt, Homo sapiens
gucacuggcuucuuugaug

SEQ ID NO: 1188459 - RNA, 19 nt, Homo sapiens
uggugaaggugguaagaaa

SEQ ID NO: 1188460 - RNA, 19 nt, Homo sapiens
cucauuuggugacgucuua

SEQ ID NO: 1188461 - RNA, 19 nt, Homo sapiens
ugagaaggguguggguuug

SEQ ID NO: 1188462 - RNA, 19 nt, Homo sapiens
ugguuagggugcacauaua

SEQ ID NO: 1188463 - RNA, 19 nt, Homo sapiens
gaaccuaagggcugaagca

SEQ ID NO: 1188464 - RNA, 19 nt, Homo sapiens
gagaaccacacagcaauau

SEQ ID NO: 1188465 - RNA, 19 nt, Homo sapiens
gagcuguggugcauguaca

SEQ ID NO: 1188466 - RNA, 19 nt, Homo sapiens
gguuagggugcacauauaa

SEQ ID NO: 1188467 - RNA, 19 nt, Homo sapiens
gcacugcagcucuggacuu

SEQ ID NO: 1188468 - RNA, 19 nt, Homo sapiens
cgaaagaagagcauuaagg

SEQ ID NO: 1188469 - RNA, 19 nt, Homo sapiens
acauugagcggaagaagaa

SEQ ID NO: 1188470 - RNA, 19 nt, Homo sapiens
agaaguauggcuacaauuc

SEQ ID NO: 1188471 - RNA, 19 nt, Homo sapiens
cggaagaagaagccauaua

SEQ ID NO: 1188472 - RNA, 19 nt, Homo sapiens
guucuucggugaaauuggu

SEQ ID NO: 1188473 - RNA, 19 nt, Homo sapiens
caaaucccuugggcucauu

SEQ ID NO: 1188474 - RNA, 19 nt, Homo sapiens
aaauacauguuagcacuuc

SEQ ID NO: 1188475 - RNA, 19 nt, Homo sapiens
acuaggcucuuaucagugu

SEQ ID NO: 1188476 - RNA, 19 nt, Homo sapiens
gauguggaccugguacuga

SEQ ID NO: 1188477 - RNA, 19 nt, Homo sapiens
gccauauaauagcaacauu

SEQ ID NO: 1188478 - RNA, 19 nt, Homo sapiens
ugacgaugcugaccuagcu

SEQ ID NO: 1188479 - RNA, 19 nt, Homo sapiens
ccugggcacuaggcucuua

SEQ ID NO: 1188480 - RNA, 19 nt, Homo sapiens
agagguggaccauuaagaa

SEQ ID NO: 1188481 - RNA, 19 nt, Homo sapiens
gcugaauggcuuauccaaa

SEQ ID NO: 1188482 - RNA, 19 nt, Homo sapiens
ccagaaaugagaagauaca

SEQ ID NO: 1188483 - RNA, 19 nt, Homo sapiens
ccauauaauagcaacauug

SEQ ID NO: 1188484 - RNA, 19 nt, Homo sapiens
ugaauggcuuauccaaauc

SEQ ID NO: 1188485 - RNA, 19 nt, Homo sapiens
gcugggagcuguggugcau

SEQ ID NO: 1188486 - RNA, 19 nt, Homo sapiens
gugugacgaugcugaccua

SEQ ID NO: 1188487 - RNA, 19 nt, Homo sapiens
gaggagaaggcagucguuu

SEQ ID NO: 1188488 - RNA, 19 nt, Homo sapiens
agaggaagccagagacaga

SEQ ID NO: 1188489 - RNA, 19 nt, Homo sapiens
ccuaaucccugggcacuag

SEQ ID NO: 1188490 - RNA, 19 nt, Homo sapiens
cacugcagcucuggacuuu

SEQ ID NO: 1188491 - RNA, 19 nt, Homo sapiens
gagaauccgggaauugaca

SEQ ID NO: 1188492 - RNA, 19 nt, Homo sapiens
gcuggagaauccgggaauu

SEQ ID NO: 1188493 - RNA, 19 nt, Homo sapiens
cuccugagaugaccugaug

SEQ ID NO: 1188494 - RNA, 19 nt, Homo sapiens
ugaggaccaggcacuauuu

SEQ ID NO: 1188495 - RNA, 19 nt, Homo sapiens
aaagugcuguugguguuga

SEQ ID NO: 1188496 - RNA, 19 nt, Homo sapiens
gagaaguauggcuacaauu

SEQ ID NO: 1188497 - RNA, 19 nt, Homo sapiens
ugaaggugguaagaaauca

SEQ ID NO: 1188498 - RNA, 19 nt, Homo sapiens
guacaagcgcuggaacuuc

SEQ ID NO: 1188499 - RNA, 19 nt, Homo sapiens
caaaagacgucugcuugga

SEQ ID NO: 1188500 - RNA, 19 nt, Homo sapiens
aaagaagagcauuaaggaa

SEQ ID NO: 1188501 - RNA, 19 nt, Homo sapiens
ggaaccugccgcuggagaa

SEQ ID NO: 1188502 - RNA, 19 nt, Homo sapiens
aagaagccauauaauagca

SEQ ID NO: 1188503 - RNA, 19 nt, Homo sapiens
ggagaaggcagucguuucc

SEQ ID NO: 1188504 - RNA, 19 nt, Homo sapiens
gcuuuuggcucaccucauu

SEQ ID NO: 1188505 - RNA, 19 nt, Homo sapiens
gcagcugaauggcuuaucc

SEQ ID NO: 1188506 - RNA, 19 nt, Homo sapiens
gugaggaccaggcacuauu

SEQ ID NO: 1188507 - RNA, 19 nt, Homo sapiens
gguggaccauuaagaacuc

SEQ ID NO: 1188508 - RNA, 19 nt, Homo sapiens
ugaaacaaguggagaaaua

SEQ ID NO: 1188509 - RNA, 19 nt, Homo sapiens
gcacauaccaguuacuuaa

SEQ ID NO: 1188510 - RNA, 19 nt, Homo sapiens
gcaccaagcuuaucaugga

SEQ ID NO: 1188511 - RNA, 19 nt, Homo sapiens
gagaacugcugaacauuug

SEQ ID NO: 1188512 - RNA, 19 nt, Homo sapiens
guaagacucuggacugcua

SEQ ID NO: 1188513 - RNA, 19 nt, Homo sapiens
gagaacagguggacgauca

SEQ ID NO: 1188514 - RNA, 19 nt, Homo sapiens
cgagagaacugcugaacau

SEQ ID NO: 1188515 - RNA, 19 nt, Homo sapiens
ucccugagcuccaagauaa

SEQ ID NO: 1188516 - RNA, 19 nt, Homo sapiens
ugacauccaugaggccuua

SEQ ID NO: 1188517 - RNA, 19 nt, Homo sapiens
gccuugagaucaccuguuu

SEQ ID NO: 1188518 - RNA, 19 nt, Homo sapiens
gacgagcgcaccaagcuua

SEQ ID NO: 1188519 - RNA, 19 nt, Homo sapiens
caugaggccuuauuagcaa

SEQ ID NO: 1188520 - RNA, 19 nt, Homo sapiens
ccaaggaugucugggugua

SEQ ID NO: 1188521 - RNA, 19 nt, Homo sapiens
gcugugcacauaccaguua

SEQ ID NO: 1188522 - RNA, 19 nt, Homo sapiens
gcugucaccuccugaguca

SEQ ID NO: 1188523 - RNA, 19 nt, Homo sapiens
gcacugccacacauccuuu

SEQ ID NO: 1188524 - RNA, 19 nt, Homo sapiens
ucaccauccucuugcguuu

SEQ ID NO: 1188525 - RNA, 19 nt, Homo sapiens
ggcaggguguccaaacuug

SEQ ID NO: 1188526 - RNA, 19 nt, Homo sapiens
gcagccagaucuucaucau

SEQ ID NO: 1188527 - RNA, 19 nt, Homo sapiens
agagaacugcugaacauuu

SEQ ID NO: 1188528 - RNA, 19 nt, Homo sapiens
gggcucuacugccaucuau

SEQ ID NO: 1188529 - RNA, 19 nt, Homo sapiens
ggagaacugccucuaugug

SEQ ID NO: 1188530 - RNA, 19 nt, Homo sapiens
ggacgugccauggugcuuu

SEQ ID NO: 1188531 - RNA, 19 nt, Homo sapiens
guaagucccagcccaccua

SEQ ID NO: 1188532 - RNA, 19 nt, Homo sapiens
uguccaagguccagugcua

SEQ ID NO: 1188533 - RNA, 19 nt, Homo sapiens
ccgaguuccuggagaagaa

SEQ ID NO: 1188534 - RNA, 19 nt, Homo sapiens
gaaacaaguggagaaauac

SEQ ID NO: 1188535 - RNA, 19 nt, Homo sapiens
cauccaugaggccuuauua

SEQ ID NO: 1188536 - RNA, 19 nt, Homo sapiens
gccagaccuucauguguga

SEQ ID NO: 1188537 - RNA, 19 nt, Homo sapiens
gcagugguuugugggaaga

SEQ ID NO: 1188538 - RNA, 19 nt, Homo sapiens
cuggagaacugccucuaug

SEQ ID NO: 1188539 - RNA, 19 nt, Homo sapiens
gcucuacugccaucuauag

SEQ ID NO: 1188540 - RNA, 19 nt, Homo sapiens
ggacugccaccaggacuga

SEQ ID NO: 1188541 - RNA, 19 nt, Homo sapiens
caagagaagagaagcaucu

SEQ ID NO: 1188542 - RNA, 19 nt, Homo sapiens
gagcgcaccaagcuuauca

SEQ ID NO: 1188543 - RNA, 19 nt, Homo sapiens
cgcaagcacugcauguuca

SEQ ID NO: 1188544 - RNA, 19 nt, Homo sapiens
gguuggcgccugucaguga

SEQ ID NO: 1188545 - RNA, 19 nt, Homo sapiens
ccacuucagauacauggaa

SEQ ID NO: 1188546 - RNA, 19 nt, Homo sapiens
caggcgacaugcugcaguu

SEQ ID NO: 1188547 - RNA, 19 nt, Homo sapiens
ccaugaacgucacccucuu

SEQ ID NO: 1188548 - RNA, 19 nt, Homo sapiens
ccaugaggccuuauuagca

SEQ ID NO: 1188549 - RNA, 19 nt, Homo sapiens
gggcuguucugagcuuuag

SEQ ID NO: 1188550 - RNA, 19 nt, Homo sapiens
cuucaugugugacaagauc

SEQ ID NO: 1188551 - RNA, 19 nt, Homo sapiens
gacgugccauggugcuuuc

SEQ ID NO: 1188552 - RNA, 19 nt, Homo sapiens
gagagaacugcugaacauu

SEQ ID NO: 1188553 - RNA, 19 nt, Homo sapiens
gcagagcgaggacuucaac

SEQ ID NO: 1188554 - RNA, 19 nt, Homo sapiens
ccgccgaguuccuggagaa

SEQ ID NO: 1188555 - RNA, 19 nt, Homo sapiens
ccacaaggccaaggagauc

SEQ ID NO: 1188556 - RNA, 19 nt, Homo sapiens
guugcuucauugagauaaa

SEQ ID NO: 1188557 - RNA, 19 nt, Homo sapiens
gggcaggguguccaaacuu

SEQ ID NO: 1188558 - RNA, 19 nt, Homo sapiens
gagguuggcgccugucagu

SEQ ID NO: 1188559 - RNA, 19 nt, Homo sapiens
ggaggugacacggaauuca

SEQ ID NO: 1188560 - RNA, 19 nt, Homo sapiens
cuucagcuuugcagugguu

SEQ ID NO: 1188561 - RNA, 19 nt, Homo sapiens
gcuggagaacugccucuau

SEQ ID NO: 1188562 - RNA, 19 nt, Homo sapiens
caccguacaugaggaaugg

SEQ ID NO: 1188563 - RNA, 19 nt, Homo sapiens
gggccagaccuucaugugu

SEQ ID NO: 1188564 - RNA, 19 nt, Homo sapiens
cauaccaguuacuuaagca

SEQ ID NO: 1188565 - RNA, 19 nt, Homo sapiens
ucagugaccauccuaaugc

SEQ ID NO: 1188566 - RNA, 19 nt, Homo sapiens
ccugggcuauggagagguu

SEQ ID NO: 1188567 - RNA, 19 nt, Homo sapiens
gacccucaccauccucuug

SEQ ID NO: 1188568 - RNA, 19 nt, Homo sapiens
uugcagagccuugagauca

SEQ ID NO: 1188569 - RNA, 19 nt, Homo sapiens
ccaagguccagugcuauga

SEQ ID NO: 1188570 - RNA, 19 nt, Homo sapiens
cgacaccguacaugaggaa

SEQ ID NO: 1188571 - RNA, 19 nt, Homo sapiens
ggaccuuugggcaggguuu

SEQ ID NO: 1188572 - RNA, 19 nt, Homo sapiens
ccugacaccugggcuaugg

SEQ ID NO: 1188573 - RNA, 19 nt, Homo sapiens
gcgacaugcugcaguucca

SEQ ID NO: 1188574 - RNA, 19 nt, Homo sapiens
gcuaugaccccacuucaga

SEQ ID NO: 1188575 - RNA, 19 nt, Homo sapiens
gaacagguggacgaucaag

SEQ ID NO: 1188576 - RNA, 19 nt, Homo sapiens
caugcugauugcccgcuuu

SEQ ID NO: 1188577 - RNA, 19 nt, Homo sapiens
ccucacgcaucgccaucaa

SEQ ID NO: 1188578 - RNA, 19 nt, Homo sapiens
gaguucuccuggcgcaugu

SEQ ID NO: 1188579 - RNA, 19 nt, Homo sapiens
cgggauggcgucagcaaug

SEQ ID NO: 1188580 - RNA, 19 nt, Homo sapiens
cgaggagaacgcugaguca

SEQ ID NO: 1188581 - RNA, 19 nt, Homo sapiens
gagcugcugcuggacuuug

SEQ ID NO: 1188582 - RNA, 19 nt, Homo sapiens
acacacugcuggaccucau

SEQ ID NO: 1188583 - RNA, 19 nt, Homo sapiens
gcaccaugucggucagugu

SEQ ID NO: 1188584 - RNA, 19 nt, Homo sapiens
gcgcaccaagcuuaucaug

SEQ ID NO: 1188585 - RNA, 19 nt, Homo sapiens
gggccucagugacauccau

SEQ ID NO: 1188586 - RNA, 19 nt, Homo sapiens
gcuaugaccccucggagaa

SEQ ID NO: 1188587 - RNA, 19 nt, Homo sapiens
gggauggcgucagcaaugc

SEQ ID NO: 1188588 - RNA, 19 nt, Homo sapiens
ugccgggaguggucucuga

SEQ ID NO: 1188589 - RNA, 19 nt, Homo sapiens
gaacuuggcucugcuguuu

SEQ ID NO: 1188590 - RNA, 19 nt, Homo sapiens
gagaagaucuggucuaauc

SEQ ID NO: 1188591 - RNA, 19 nt, Homo sapiens
guaaugagauaguacaguu

SEQ ID NO: 1188592 - RNA, 19 nt, Homo sapiens
ggagaaauauaaagaugug

SEQ ID NO: 1188593 - RNA, 19 nt, Homo sapiens
ggaggagucugauguacuu

SEQ ID NO: 1188594 - RNA, 19 nt, Homo sapiens
ggaaggagcacuggacuaa

SEQ ID NO: 1188595 - RNA, 19 nt, Homo sapiens
gaagaugcaccucuacuug

SEQ ID NO: 1188596 - RNA, 19 nt, Homo sapiens
ccagacagcucccaaaucu

SEQ ID NO: 1188597 - RNA, 19 nt, Homo sapiens
ccauuuaucuauaccauga

SEQ ID NO: 1188598 - RNA, 19 nt, Homo sapiens
gacccaaccugcugaagaa

SEQ ID NO: 1188599 - RNA, 19 nt, Homo sapiens
gaccaagagucgaagcuuu

SEQ ID NO: 1188600 - RNA, 19 nt, Homo sapiens
gaaaagcucuaaaccagaa

SEQ ID NO: 1188601 - RNA, 19 nt, Homo sapiens
gcuccugcuuuauauauuu

SEQ ID NO: 1188602 - RNA, 19 nt, Homo sapiens
ggagcugacuaaccaggua

SEQ ID NO: 1188603 - RNA, 19 nt, Homo sapiens
gcagaaaugugcggcucua

SEQ ID NO: 1188604 - RNA, 19 nt, Homo sapiens
gaacgggaguggccuuugg

SEQ ID NO: 1188605 - RNA, 19 nt, Homo sapiens
cuacaucucugucuuugau

SEQ ID NO: 1188606 - RNA, 19 nt, Homo sapiens
caauaaaccugggaaccaa

SEQ ID NO: 1188607 - RNA, 19 nt, Homo sapiens
ggagagcagugaaugucaa

SEQ ID NO: 1188608 - RNA, 19 nt, Homo sapiens
aaacagaggagaccaguga

SEQ ID NO: 1188609 - RNA, 19 nt, Homo sapiens
gaaguaaggagagcaguga

SEQ ID NO: 1188610 - RNA, 19 nt, Homo sapiens
ugagguaacugaaguaagg

SEQ ID NO: 1188611 - RNA, 19 nt, Homo sapiens
cuggagagcuggcacugua

SEQ ID NO: 1188612 - RNA, 19 nt, Homo sapiens
uaaauacuguggagaugau

SEQ ID NO: 1188613 - RNA, 19 nt, Homo sapiens
gaugaaaugugggauugga

SEQ ID NO: 1188614 - RNA, 19 nt, Homo sapiens
ucacauugauacuagagaa

SEQ ID NO: 1188615 - RNA, 19 nt, Homo sapiens
cagcuucccugcucuugaa

SEQ ID NO: 1188616 - RNA, 19 nt, Homo sapiens
guagagagccauugcuguu

SEQ ID NO: 1188617 - RNA, 19 nt, Homo sapiens
ccacuggccuuccaacaca

SEQ ID NO: 1188618 - RNA, 19 nt, Homo sapiens
ggaauccgcaagaaguuaa

SEQ ID NO: 1188619 - RNA, 19 nt, Homo sapiens
caagcuggcugccucuuca

SEQ ID NO: 1188620 - RNA, 19 nt, Homo sapiens
uaucgauucugaccaggua

SEQ ID NO: 1188621 - RNA, 19 nt, Homo sapiens
gucauuggaucaacccuuu

SEQ ID NO: 1188622 - RNA, 19 nt, Homo sapiens
gaagguguauaccggaaag

SEQ ID NO: 1188623 - RNA, 19 nt, Homo sapiens
ugacccagcuccucugugu

SEQ ID NO: 1188624 - RNA, 19 nt, Homo sapiens
gaguucaucucccgaaagu

SEQ ID NO: 1188625 - RNA, 19 nt, Homo sapiens
gcagcaaggacaacaaguu

SEQ ID NO: 1188626 - RNA, 19 nt, Homo sapiens
gcacugacgaggaugaaau

SEQ ID NO: 1188627 - RNA, 19 nt, Homo sapiens
gaaaugugcggcucuaaac

SEQ ID NO: 1188628 - RNA, 19 nt, Homo sapiens
cagauaagaaagagcauuu

SEQ ID NO: 1188629 - RNA, 19 nt, Homo sapiens
cugagaagaucuggucuaa

SEQ ID NO: 1188630 - RNA, 19 nt, Homo sapiens
caugagagauuuuggguuu

SEQ ID NO: 1188631 - RNA, 19 nt, Homo sapiens
ggucuuagagcaggcuuua

SEQ ID NO: 1188632 - RNA, 19 nt, Homo sapiens
cauggaaguuuauauagag

SEQ ID NO: 1188633 - RNA, 19 nt, Homo sapiens
ggacagugaagccagagaa

SEQ ID NO: 1188634 - RNA, 19 nt, Homo sapiens
gccaguguaugaggaagua

SEQ ID NO: 1188635 - RNA, 19 nt, Homo sapiens
cgucagaaguuuggcacua

SEQ ID NO: 1188636 - RNA, 19 nt, Homo sapiens
acacgggaguggacaguga

SEQ ID NO: 1188637 - RNA, 19 nt, Homo sapiens
uagcucagauugacuugga

SEQ ID NO: 1188638 - RNA, 19 nt, Homo sapiens
gcacugacuuacugugaac

SEQ ID NO: 1188639 - RNA, 19 nt, Homo sapiens
ggagaucagugugguuucu

SEQ ID NO: 1188640 - RNA, 19 nt, Homo sapiens
ugucuggaguaaugagaua

SEQ ID NO: 1188641 - RNA, 19 nt, Homo sapiens
agagagagcagagguguuu

SEQ ID NO: 1188642 - RNA, 19 nt, Homo sapiens
gagcaggcuuuacaauggu

SEQ ID NO: 1188643 - RNA, 19 nt, Homo sapiens
guacgaggagccaguguau

SEQ ID NO: 1188644 - RNA, 19 nt, Homo sapiens
gggaauccgcaagaaguua

SEQ ID NO: 1188645 - RNA, 19 nt, Homo sapiens
agagcaggcuuuacaaugg

SEQ ID NO: 1188646 - RNA, 19 nt, Homo sapiens
cagcugggauggacuugug

SEQ ID NO: 1188647 - RNA, 19 nt, Homo sapiens
acgagugucuggaguaaug

SEQ ID NO: 1188648 - RNA, 19 nt, Homo sapiens
ccauaagccccacauauua

SEQ ID NO: 1188649 - RNA, 19 nt, Homo sapiens
ccucugcccuggcuggaaa

SEQ ID NO: 1188650 - RNA, 19 nt, Homo sapiens
gagagccauugcuguuguu

SEQ ID NO: 1188651 - RNA, 19 nt, Homo sapiens
cgagguggcugagaagauc

SEQ ID NO: 1188652 - RNA, 19 nt, Homo sapiens
aaggagcacuggacuaaag

SEQ ID NO: 1188653 - RNA, 19 nt, Homo sapiens
ccaguguggugcuguggaa

SEQ ID NO: 1188654 - RNA, 19 nt, Homo sapiens
ccagaucgcaggccuuuca

SEQ ID NO: 1188655 - RNA, 19 nt, Homo sapiens
uccauguucuuuccaauga

SEQ ID NO: 1188656 - RNA, 19 nt, Homo sapiens
caacucuagcacugacuua

SEQ ID NO: 1188657 - RNA, 19 nt, Homo sapiens
ucuuugauaucgauucuga

SEQ ID NO: 1188658 - RNA, 19 nt, Homo sapiens
gagcuggcacuguacaaga

SEQ ID NO: 1188659 - RNA, 19 nt, Homo sapiens
ggagucugauguacuuugg

SEQ ID NO: 1188660 - RNA, 19 nt, Homo sapiens
gaucccaaaucagauagug

SEQ ID NO: 1188661 - RNA, 19 nt, Homo sapiens
cugaggagcugacuaacca

SEQ ID NO: 1188662 - RNA, 19 nt, Homo sapiens
cuggagaccucaucaugga

SEQ ID NO: 1188663 - RNA, 19 nt, Homo sapiens
gagauaguacaguuauuca

SEQ ID NO: 1188664 - RNA, 19 nt, Homo sapiens
gccagaggguguucguguu

SEQ ID NO: 1188665 - RNA, 19 nt, Homo sapiens
guggagaugaugccuaauu

SEQ ID NO: 1188666 - RNA, 19 nt, Homo sapiens
gagcagucuucagcccuaa

SEQ ID NO: 1188667 - RNA, 19 nt, Homo sapiens
ugagagauuuuggguuuua

SEQ ID NO: 1188668 - RNA, 19 nt, Homo sapiens
guaaggagagcagugaaug

SEQ ID NO: 1188669 - RNA, 19 nt, Homo sapiens
gaaggagcacuggacuaaa

SEQ ID NO: 1188670 - RNA, 19 nt, Homo sapiens
ggaccaccagcauccuuaa

SEQ ID NO: 1188671 - RNA, 19 nt, Homo sapiens
gauaagaaagagcauuugg

SEQ ID NO: 1188672 - RNA, 19 nt, Homo sapiens
gaaauguuugcaucggaaa

SEQ ID NO: 1188673 - RNA, 19 nt, Homo sapiens
guucugggaucuccaaggu

SEQ ID NO: 1188674 - RNA, 19 nt, Homo sapiens
ggaggcuggugcucacugu

SEQ ID NO: 1188675 - RNA, 19 nt, Homo sapiens
gcccagcccauuuaucuau

SEQ ID NO: 1188676 - RNA, 19 nt, Homo sapiens
acgaggagccaguguauga

SEQ ID NO: 1188677 - RNA, 19 nt, Homo sapiens
uuaaagcccagcacgauga

SEQ ID NO: 1188678 - RNA, 19 nt, Homo sapiens
ccagguagcucagauugac

SEQ ID NO: 1188679 - RNA, 19 nt, Homo sapiens
cagaggagaccagugauga

SEQ ID NO: 1188680 - RNA, 19 nt, Homo sapiens
uggagaugaugccuaauuc

SEQ ID NO: 1188681 - RNA, 19 nt, Homo sapiens
ugggugauguuaaagucua

SEQ ID NO: 1188682 - RNA, 19 nt, Homo sapiens
ucagaaguuuggcacuaug

SEQ ID NO: 1188683 - RNA, 19 nt, Homo sapiens
gaggaugaaaugugggauu

SEQ ID NO: 1188684 - RNA, 19 nt, Homo sapiens
gaccucaucauggaaguuu

SEQ ID NO: 1188685 - RNA, 19 nt, Homo sapiens
gaccagguagcucagauug

SEQ ID NO: 1188686 - RNA, 19 nt, Homo sapiens
ucuaucgggugcagaaaug

SEQ ID NO: 1188687 - RNA, 19 nt, Homo sapiens
cuggagaaauauaaagaug

SEQ ID NO: 1188688 - RNA, 19 nt, Homo sapiens
ggaguaaugagauaguaca

SEQ ID NO: 1188689 - RNA, 19 nt, Homo sapiens
gaucauaaccguaacauuu

SEQ ID NO: 1188690 - RNA, 19 nt, Homo sapiens
gaagaagacugacuuugga

SEQ ID NO: 1188691 - RNA, 19 nt, Homo sapiens
ccuagaaucucguguguua

SEQ ID NO: 1188692 - RNA, 19 nt, Homo sapiens
gcagaaugcuuuaugaguu

SEQ ID NO: 1188693 - RNA, 19 nt, Homo sapiens
gcaaauggcucagaugaug

SEQ ID NO: 1188694 - RNA, 19 nt, Homo sapiens
gcucagaugaugauaauua

SEQ ID NO: 1188695 - RNA, 19 nt, Homo sapiens
caacucuagugcaauauua

SEQ ID NO: 1188696 - RNA, 19 nt, Homo sapiens
ugacaacucuagugcaaua

SEQ ID NO: 1188697 - RNA, 19 nt, Homo sapiens
cagaaugcuuuaugaguua

SEQ ID NO: 1188698 - RNA, 19 nt, Homo sapiens
ucagguugaucuucuauua

SEQ ID NO: 1188699 - RNA, 19 nt, Homo sapiens
ugacagacuucuucaguuu

SEQ ID NO: 1188700 - RNA, 19 nt, Homo sapiens
cuacuucucucuucuauga

SEQ ID NO: 1188701 - RNA, 19 nt, Homo sapiens
caagggugcuggaaaugua

SEQ ID NO: 1188702 - RNA, 19 nt, Homo sapiens
gauccugagugaaauuuaa

SEQ ID NO: 1188703 - RNA, 19 nt, Homo sapiens
guucugacccugaaauuua

SEQ ID NO: 1188704 - RNA, 19 nt, Homo sapiens
uaagaaugcuacauaguga

SEQ ID NO: 1188705 - RNA, 19 nt, Homo sapiens
ggaaauaaagucuguaucu

SEQ ID NO: 1188706 - RNA, 19 nt, Homo sapiens
gaauuuaguccauuuccua

SEQ ID NO: 1188707 - RNA, 19 nt, Homo sapiens
ucacaucuguucauucguu

SEQ ID NO: 1188708 - RNA, 19 nt, Homo sapiens
ucacuggaaucaagaagaa

SEQ ID NO: 1188709 - RNA, 19 nt, Homo sapiens
aaacauggaguucguauug

SEQ ID NO: 1188710 - RNA, 19 nt, Homo sapiens
ucagaaauccauggaaaua

SEQ ID NO: 1188711 - RNA, 19 nt, Homo sapiens
guucauuccugauggcuuu

SEQ ID NO: 1188712 - RNA, 19 nt, Homo sapiens
ugucagagcugcacuugug

SEQ ID NO: 1188713 - RNA, 19 nt, Homo sapiens
guagccaacauuaaaguua

SEQ ID NO: 1188714 - RNA, 19 nt, Homo sapiens
gagguacacggcagucuua

SEQ ID NO: 1188715 - RNA, 19 nt, Homo sapiens
ccucguagcugacagacuu

SEQ ID NO: 1188716 - RNA, 19 nt, Homo sapiens
gcacugaaucucuuauuuc

SEQ ID NO: 1188717 - RNA, 19 nt, Homo sapiens
uagaaaggauucaugacuu

SEQ ID NO: 1188718 - RNA, 19 nt, Homo sapiens
uaaagucagugcccuaaag

SEQ ID NO: 1188719 - RNA, 19 nt, Homo sapiens
uuaucuggcuuuacuagua

SEQ ID NO: 1188720 - RNA, 19 nt, Homo sapiens
gaaauuuacuaugcaccuu

SEQ ID NO: 1188721 - RNA, 19 nt, Homo sapiens
gaaucaagaagaagacuga

SEQ ID NO: 1188722 - RNA, 19 nt, Homo sapiens
cauaauuugugacacugua

SEQ ID NO: 1188723 - RNA, 19 nt, Homo sapiens
gaaagauggaggguucaua

SEQ ID NO: 1188724 - RNA, 19 nt, Homo sapiens
guuagugauuggugccuua

SEQ ID NO: 1188725 - RNA, 19 nt, Homo sapiens
uaaaggagacaaugauuca

SEQ ID NO: 1188726 - RNA, 19 nt, Homo sapiens
gguagucacuggaaucaag

SEQ ID NO: 1188727 - RNA, 19 nt, Homo sapiens
uguaacaauuccugacuaa

SEQ ID NO: 1188728 - RNA, 19 nt, Homo sapiens
uaaagucuguaucuugugu

SEQ ID NO: 1188729 - RNA, 19 nt, Homo sapiens
aaagauggaggguucauaa

SEQ ID NO: 1188730 - RNA, 19 nt, Homo sapiens
cuucagaaauccauggaaa

SEQ ID NO: 1188731 - RNA, 19 nt, Homo sapiens
cgucaugguuuguggauau

SEQ ID NO: 1188732 - RNA, 19 nt, Homo sapiens
gaagacugacuuuggagaa

SEQ ID NO: 1188733 - RNA, 19 nt, Homo sapiens
uaugacaacucuagugcaa

SEQ ID NO: 1188734 - RNA, 19 nt, Homo sapiens
gaccuuuccuucacuguuc

SEQ ID NO: 1188735 - RNA, 19 nt, Homo sapiens
caggagaggaugacacuuu

SEQ ID NO: 1188736 - RNA, 19 nt, Homo sapiens
aagaguagccaacauuaaa

SEQ ID NO: 1188737 - RNA, 19 nt, Homo sapiens
aaacuucuccuuugccauu

SEQ ID NO: 1188738 - RNA, 19 nt, Homo sapiens
ccuguaaucccaacacuuu

SEQ ID NO: 1188739 - RNA, 19 nt, Homo sapiens
uaagaguagccaacauuaa

SEQ ID NO: 1188740 - RNA, 19 nt, Homo sapiens
guauaaguuugguugguau

SEQ ID NO: 1188741 - RNA, 19 nt, Homo sapiens
uguauaaguuugguuggua

SEQ ID NO: 1188742 - RNA, 19 nt, Homo sapiens
ggauaugcccauuuggaaa

SEQ ID NO: 1188743 - RNA, 19 nt, Homo sapiens
ucucucagauaaugcagua

SEQ ID NO: 1188744 - RNA, 19 nt, Homo sapiens
caagaagaagacugacuuu

SEQ ID NO: 1188745 - RNA, 19 nt, Homo sapiens
gauggaggguucauaaagc

SEQ ID NO: 1188746 - RNA, 19 nt, Homo sapiens
ucauaaccguaacauuuga

SEQ ID NO: 1188747 - RNA, 19 nt, Homo sapiens
acaggaaccagacaaauga

SEQ ID NO: 1188748 - RNA, 19 nt, Homo sapiens
cagcagauuuucuuguaua

SEQ ID NO: 1188749 - RNA, 19 nt, Homo sapiens
uuaagaguagccaacauua

SEQ ID NO: 1188750 - RNA, 19 nt, Homo sapiens
acacggcagucuuagagaa

SEQ ID NO: 1188751 - RNA, 19 nt, Homo sapiens
gaaaccccgucucuacuaa

SEQ ID NO: 1188752 - RNA, 19 nt, Homo sapiens
ggguaaauuugauuagagu

SEQ ID NO: 1188753 - RNA, 19 nt, Homo sapiens
guugcuaucaguuuguuua

SEQ ID NO: 1188754 - RNA, 19 nt, Homo sapiens
gaaucucguguguuaguuu

SEQ ID NO: 1188755 - RNA, 19 nt, Homo sapiens
cuggaaauguaaacaagaa

SEQ ID NO: 1188756 - RNA, 19 nt, Homo sapiens
guguaacaauuccugacua

SEQ ID NO: 1188757 - RNA, 19 nt, Homo sapiens
uauggcaucugcugucuuc

SEQ ID NO: 1188758 - RNA, 19 nt, Homo sapiens
caaaugaugucuucaaaac

SEQ ID NO: 1188759 - RNA, 19 nt, Homo sapiens
ccauggaaauaaagucugu

SEQ ID NO: 1188760 - RNA, 19 nt, Homo sapiens
caucuuauauuugcacagu

SEQ ID NO: 1188761 - RNA, 19 nt, Homo sapiens
uggcucagaugaugauaau

SEQ ID NO: 1188762 - RNA, 19 nt, Homo sapiens
ggaaccagacaaaugaugu

SEQ ID NO: 1188763 - RNA, 19 nt, Homo sapiens
cagaaauccauggaaauaa

SEQ ID NO: 1188764 - RNA, 19 nt, Homo sapiens
aaggauucaugacuuugua

SEQ ID NO: 1188765 - RNA, 19 nt, Homo sapiens
gauacugaaagacagcaua

SEQ ID NO: 1188766 - RNA, 19 nt, Homo sapiens
aaacauguuggcuacagua

SEQ ID NO: 1188767 - RNA, 19 nt, Homo sapiens
ggaggcagagguuguagug

SEQ ID NO: 1188768 - RNA, 19 nt, Homo sapiens
gucuguaucuuguguaaca

SEQ ID NO: 1188769 - RNA, 19 nt, Homo sapiens
guuaacaaauugguugcaa

SEQ ID NO: 1188770 - RNA, 19 nt, Homo sapiens
auccugagguuuauagaaa

SEQ ID NO: 1188771 - RNA, 19 nt, Homo sapiens
cuggauccaugucuuuaaa

SEQ ID NO: 1188772 - RNA, 19 nt, Homo sapiens
ucaagaagaagacugacuu

SEQ ID NO: 1188773 - RNA, 19 nt, Homo sapiens
gcaccuguaguuucagcua

SEQ ID NO: 1188774 - RNA, 19 nt, Homo sapiens
uuaagaaugcuacauagug

SEQ ID NO: 1188775 - RNA, 19 nt, Homo sapiens
gaaauccauggaaauaaag

SEQ ID NO: 1188776 - RNA, 19 nt, Homo sapiens
cacaucuguucauucguua

SEQ ID NO: 1188777 - RNA, 19 nt, Homo sapiens
ccucacaucuguucauucg

SEQ ID NO: 1188778 - RNA, 19 nt, Homo sapiens
cccuggauguuauuuauau

SEQ ID NO: 1188779 - RNA, 19 nt, Homo sapiens
gcaagggugcuggaaaugu

SEQ ID NO: 1188780 - RNA, 19 nt, Homo sapiens
cuuauucucugaggaaaga

SEQ ID NO: 1188781 - RNA, 19 nt, Homo sapiens
cuauuuaucuggcuuuacu

SEQ ID NO: 1188782 - RNA, 19 nt, Homo sapiens
gcucaggaaguguauacaa

SEQ ID NO: 1188783 - RNA, 19 nt, Homo sapiens
caaauggcucagaugauga

SEQ ID NO: 1188784 - RNA, 19 nt, Homo sapiens
guacacggcagucuuagag

SEQ ID NO: 1188785 - RNA, 19 nt, Homo sapiens
cuagugcaauauuagaguu

SEQ ID NO: 1188786 - RNA, 19 nt, Homo sapiens
agaagcaaauggcucagau

SEQ ID NO: 1188787 - RNA, 19 nt, Homo sapiens
cauucuggcuuuauguaau

SEQ ID NO: 1188788 - RNA, 19 nt, Homo sapiens
ggauccaugucuuuaaagg

SEQ ID NO: 1188789 - RNA, 19 nt, Homo sapiens
gcacucauacuaccaauua

SEQ ID NO: 1188790 - RNA, 19 nt, Homo sapiens
gaaagaaacaguugucuau

SEQ ID NO: 1188791 - RNA, 19 nt, Homo sapiens
gaaaauaccuugcuacuuc

SEQ ID NO: 1188792 - RNA, 19 nt, Homo sapiens
guacaggaguuaaauuuga

SEQ ID NO: 1188793 - RNA, 19 nt, Homo sapiens
guaaaucacugcguuauug

SEQ ID NO: 1188794 - RNA, 19 nt, Homo sapiens
gggauuccauaccaaauua

SEQ ID NO: 1188795 - RNA, 19 nt, Homo sapiens
ggucaaugaugaauuacua

SEQ ID NO: 1188796 - RNA, 19 nt, Homo sapiens
caaguggacugucauuuga

SEQ ID NO: 1188797 - RNA, 19 nt, Homo sapiens
gcaaggagcagaguugaua

SEQ ID NO: 1188798 - RNA, 19 nt, Homo sapiens
caagaagggaauagaauua

SEQ ID NO: 1188799 - RNA, 19 nt, Homo sapiens
ugaauuggguaacuguuua

SEQ ID NO: 1188800 - RNA, 19 nt, Homo sapiens
guauuucucuucugguaua

SEQ ID NO: 1188801 - RNA, 19 nt, Homo sapiens
gaaaaguacucucauagaa

SEQ ID NO: 1188802 - RNA, 19 nt, Homo sapiens
ccacauugcugguuacaug

SEQ ID NO: 1188803 - RNA, 19 nt, Homo sapiens
gaacccaaguuacauuuua

SEQ ID NO: 1188804 - RNA, 19 nt, Homo sapiens
uuaagucucuccaaucuuu

SEQ ID NO: 1188805 - RNA, 19 nt, Homo sapiens
gcuacaaauucuuccaaua

SEQ ID NO: 1188806 - RNA, 19 nt, Homo sapiens
agagguaauucacuucuua

SEQ ID NO: 1188807 - RNA, 19 nt, Homo sapiens
gcucaaugcuauccaaaga

SEQ ID NO: 1188808 - RNA, 19 nt, Homo sapiens
ccaaagggaugcgccauuu

SEQ ID NO: 1188809 - RNA, 19 nt, Homo sapiens
cgagucagaucacuauaaa

SEQ ID NO: 1188810 - RNA, 19 nt, Homo sapiens
gcucugcaauggucaauga

SEQ ID NO: 1188811 - RNA, 19 nt, Homo sapiens
gaaaguauguagggaguca

SEQ ID NO: 1188812 - RNA, 19 nt, Homo sapiens
ggauauacuggaugaaaua

SEQ ID NO: 1188813 - RNA, 19 nt, Homo sapiens
uaacugauccuuuccuuga

SEQ ID NO: 1188814 - RNA, 19 nt, Homo sapiens
ccaaagcgggauauuaaua

SEQ ID NO: 1188815 - RNA, 19 nt, Homo sapiens
aaaguacucucauagaaga

SEQ ID NO: 1188816 - RNA, 19 nt, Homo sapiens
gcagagaacccaaguuaca

SEQ ID NO: 1188817 - RNA, 19 nt, Homo sapiens
caaagcgggauauuaauaa

SEQ ID NO: 1188818 - RNA, 19 nt, Homo sapiens
ucaaugcuauccaaagauu

SEQ ID NO: 1188819 - RNA, 19 nt, Homo sapiens
ggagucaaaugcuuacugu

SEQ ID NO: 1188820 - RNA, 19 nt, Homo sapiens
uuaaugcucugccuugaaa

SEQ ID NO: 1188821 - RNA, 19 nt, Homo sapiens
uuaaaugacugccauaaag

SEQ ID NO: 1188822 - RNA, 19 nt, Homo sapiens
acacucaccucugguauuu

SEQ ID NO: 1188823 - RNA, 19 nt, Homo sapiens
gaagugaacaugcauucuu

SEQ ID NO: 1188824 - RNA, 19 nt, Homo sapiens
ucacugcguuauugcuuua

SEQ ID NO: 1188825 - RNA, 19 nt, Homo sapiens
gaacuuguauaccacuauc

SEQ ID NO: 1188826 - RNA, 19 nt, Homo sapiens
ggauaggaaacaaguauuu

SEQ ID NO: 1188827 - RNA, 19 nt, Homo sapiens
ugacaagacuggaagaagu

SEQ ID NO: 1188828 - RNA, 19 nt, Homo sapiens
gaaauaggaguugcggaua

SEQ ID NO: 1188829 - RNA, 19 nt, Homo sapiens
aaauaacacugcacuuuca

SEQ ID NO: 1188830 - RNA, 19 nt, Homo sapiens
acaauagccuugauagaau

SEQ ID NO: 1188831 - RNA, 19 nt, Homo sapiens
gaaauacaagcgguuaauu

SEQ ID NO: 1188832 - RNA, 19 nt, Homo sapiens
gaauguagaccagauaaau

SEQ ID NO: 1188833 - RNA, 19 nt, Homo sapiens
ggaagaauuugcagaagac

SEQ ID NO: 1188834 - RNA, 19 nt, Homo sapiens
ucagaugucuugguuguga

SEQ ID NO: 1188835 - RNA, 19 nt, Homo sapiens
gaagcgauguggccaagca

SEQ ID NO: 1188836 - RNA, 19 nt, Homo sapiens
gaacauguacaggaguuaa

SEQ ID NO: 1188837 - RNA, 19 nt, Homo sapiens
ugacugccauaaaguauau

SEQ ID NO: 1188838 - RNA, 19 nt, Homo sapiens
gaaauaaugccuccaccau

SEQ ID NO: 1188839 - RNA, 19 nt, Homo sapiens
ucagaaagaggaaauaaug

SEQ ID NO: 1188840 - RNA, 19 nt, Homo sapiens
gcuauaugcuuaggucuau

SEQ ID NO: 1188841 - RNA, 19 nt, Homo sapiens
uuucaggaauguuugcuua

SEQ ID NO: 1188842 - RNA, 19 nt, Homo sapiens
ugacuacacucugcauuug

SEQ ID NO: 1188843 - RNA, 19 nt, Homo sapiens
gauaacugauccuuuccuu

SEQ ID NO: 1188844 - RNA, 19 nt, Homo sapiens
ccugauaacugauccuuuc

SEQ ID NO: 1188845 - RNA, 19 nt, Homo sapiens
guaauucacuucuuauucc

SEQ ID NO: 1188846 - RNA, 19 nt, Homo sapiens
ccuaagagguaauucacuu

SEQ ID NO: 1188847 - RNA, 19 nt, Homo sapiens
uggcagagaacccaaguua

SEQ ID NO: 1188848 - RNA, 19 nt, Homo sapiens
gcaaacucuuucucuuaga

SEQ ID NO: 1188849 - RNA, 19 nt, Homo sapiens
ccaguuuacuuacagaaga

SEQ ID NO: 1188850 - RNA, 19 nt, Homo sapiens
guagggagucaaaugcuua

SEQ ID NO: 1188851 - RNA, 19 nt, Homo sapiens
gcagcaaguuuaagucucu

SEQ ID NO: 1188852 - RNA, 19 nt, Homo sapiens
uaaaugguuugccuucuca

SEQ ID NO: 1188853 - RNA, 19 nt, Homo sapiens
gauggacccagacaugaua

SEQ ID NO: 1188854 - RNA, 19 nt, Homo sapiens
gaucugagaaugaaaucuu

SEQ ID NO: 1188855 - RNA, 19 nt, Homo sapiens
ccagcauacucuauuacua

SEQ ID NO: 1188856 - RNA, 19 nt, Homo sapiens
ggaagaaguaaauagagaa

SEQ ID NO: 1188857 - RNA, 19 nt, Homo sapiens
gacaagacuggaagaagua

SEQ ID NO: 1188858 - RNA, 19 nt, Homo sapiens
gagaauguagaccagauaa

SEQ ID NO: 1188859 - RNA, 19 nt, Homo sapiens
gaaaagggacgcacaguga

SEQ ID NO: 1188860 - RNA, 19 nt, Homo sapiens
uggcuaugcugauuauuga

SEQ ID NO: 1188861 - RNA, 19 nt, Homo sapiens
ggaagcagcaaguuuaagu

SEQ ID NO: 1188862 - RNA, 19 nt, Homo sapiens
agaaguaaauagagaagug

SEQ ID NO: 1188863 - RNA, 19 nt, Homo sapiens
gaugaaauacaagcgguua

SEQ ID NO: 1188864 - RNA, 19 nt, Homo sapiens
gaggauaggaaacaaguau

SEQ ID NO: 1188865 - RNA, 19 nt, Homo sapiens
gcuucaaacuugucaaauc

SEQ ID NO: 1188866 - RNA, 19 nt, Homo sapiens
gcacuggauguuacacuuu

SEQ ID NO: 1188867 - RNA, 19 nt, Homo sapiens
gcacagugaaagcaguaua

SEQ ID NO: 1188868 - RNA, 19 nt, Homo sapiens
aagacuggguagaauauaa

SEQ ID NO: 1188869 - RNA, 19 nt, Homo sapiens
cguuauugcuuuagucauu

SEQ ID NO: 1188870 - RNA, 19 nt, Homo sapiens
ucagggaacuuguauacca

SEQ ID NO: 1188871 - RNA, 19 nt, Homo sapiens
gagaacccaaguuacauuu

SEQ ID NO: 1188872 - RNA, 19 nt, Homo sapiens
gaguuaaauuugaggucua

SEQ ID NO: 1188873 - RNA, 19 nt, Homo sapiens
gagcaguugguguucuuua

SEQ ID NO: 1188874 - RNA, 19 nt, Homo sapiens
uacaauagccuugauagaa

SEQ ID NO: 1188875 - RNA, 19 nt, Homo sapiens
aauggaagcagcaaguuua

SEQ ID NO: 1188876 - RNA, 19 nt, Homo sapiens
augcuuaggucuauacgua

SEQ ID NO: 1188877 - RNA, 19 nt, Homo sapiens
gcgguaucuuggcuauuua

SEQ ID NO: 1188878 - RNA, 19 nt, Homo sapiens
ggcauaauauugugguugu

SEQ ID NO: 1188879 - RNA, 19 nt, Homo sapiens
gagauacacuacgccuuga

SEQ ID NO: 1188880 - RNA, 19 nt, Homo sapiens
uggaagaaguaaauagaga

SEQ ID NO: 1188881 - RNA, 19 nt, Homo sapiens
aaacaagaagggaauagaa

SEQ ID NO: 1188882 - RNA, 19 nt, Homo sapiens
gcggauacauuggauauac

SEQ ID NO: 1188883 - RNA, 19 nt, Homo sapiens
cagcauacucuauuacuau

SEQ ID NO: 1188884 - RNA, 19 nt, Homo sapiens
cugcaaacucuuucucuua

SEQ ID NO: 1188885 - RNA, 19 nt, Homo sapiens
acacugcacuuucaggaau

SEQ ID NO: 1188886 - RNA, 19 nt, Homo sapiens
cagaacauguacaggaguu

SEQ ID NO: 1188887 - RNA, 19 nt, Homo sapiens
uggaagaauuugcagaaga

SEQ ID NO: 1188888 - RNA, 19 nt, Homo sapiens
gaaguaaauagagaaguga

SEQ ID NO: 1188889 - RNA, 19 nt, Homo sapiens
cagaagggcucauauuuaa

SEQ ID NO: 1188890 - RNA, 19 nt, Homo sapiens
gcagaagggcucauauuua

SEQ ID NO: 1188891 - RNA, 19 nt, Homo sapiens
ugacacagaucacaaaaua

SEQ ID NO: 1188892 - RNA, 19 nt, Homo sapiens
ggacaaagcccagcgcuau

SEQ ID NO: 1188893 - RNA, 19 nt, Homo sapiens
ggacugugcucuucgaagu

SEQ ID NO: 1188894 - RNA, 19 nt, Homo sapiens
gaagccagcccaugacauu

SEQ ID NO: 1188895 - RNA, 19 nt, Homo sapiens
gaacaagaaggugaaguuu

SEQ ID NO: 1188896 - RNA, 19 nt, Homo sapiens
ggauaucuguggccacuau

SEQ ID NO: 1188897 - RNA, 19 nt, Homo sapiens
ggaguucucugcucugaag

SEQ ID NO: 1188898 - RNA, 19 nt, Homo sapiens
gggaucaccugcacugaga

SEQ ID NO: 1188899 - RNA, 19 nt, Homo sapiens
cagcagcaaugccuuguga

SEQ ID NO: 1188900 - RNA, 19 nt, Homo sapiens
gaaagacacguuugagagu

SEQ ID NO: 1188901 - RNA, 19 nt, Homo sapiens
gagaaagacacguuugaga

SEQ ID NO: 1188902 - RNA, 19 nt, Homo sapiens
ugaagaagccagcccauga

SEQ ID NO: 1188903 - RNA, 19 nt, Homo sapiens
acaagaaggugaaguuugg

SEQ ID NO: 1188904 - RNA, 19 nt, Homo sapiens
ggcagaagggcucauauuu

SEQ ID NO: 1188905 - RNA, 19 nt, Homo sapiens
aaagacacguuugagagua

SEQ ID NO: 1188906 - RNA, 19 nt, Homo sapiens
gaaggagaaagacacguuu

SEQ ID NO: 1188907 - RNA, 19 nt, Homo sapiens
acaaagacccuaccuguca

SEQ ID NO: 1188908 - RNA, 19 nt, Homo sapiens
gaggaggacugugcucuuc

SEQ ID NO: 1188909 - RNA, 19 nt, Homo sapiens
caucaacucucagaacugu

SEQ ID NO: 1188910 - RNA, 19 nt, Homo sapiens
gaggaguucucugcucuga

SEQ ID NO: 1188911 - RNA, 19 nt, Homo sapiens
gaauauaaagaucgggauu

SEQ ID NO: 1188912 - RNA, 19 nt, Homo sapiens
ggaagcaggacuacguuga

SEQ ID NO: 1188913 - RNA, 19 nt, Homo sapiens
aauguaaccuccucugaga

SEQ ID NO: 1188914 - RNA, 19 nt, Homo sapiens
gaagggcucauauuuaacu

SEQ ID NO: 1188915 - RNA, 19 nt, Homo sapiens
agagaugucuggagcuguu

SEQ ID NO: 1188916 - RNA, 19 nt, Homo sapiens
ccacugagauccucuaccu

SEQ ID NO: 1188917 - RNA, 19 nt, Homo sapiens
gcucaggcuacaacuauuu

SEQ ID NO: 1188918 - RNA, 19 nt, Homo sapiens
gcugagcccuuagcagaga

SEQ ID NO: 1188919 - RNA, 19 nt, Homo sapiens
cugcugcuuuccuuaguua

SEQ ID NO: 1188920 - RNA, 19 nt, Homo sapiens
agccaugacuucacaaaga

SEQ ID NO: 1188921 - RNA, 19 nt, Homo sapiens
agcaaugccuugugaagaa

SEQ ID NO: 1188922 - RNA, 19 nt, Homo sapiens
guauccaggcugugaauuu

SEQ ID NO: 1188923 - RNA, 19 nt, Homo sapiens
ggaggacugugcucuucga

SEQ ID NO: 1188924 - RNA, 19 nt, Homo sapiens
ggugaaguuuggcaugaau

SEQ ID NO: 1188925 - RNA, 19 nt, Homo sapiens
ugaggcaguuugacacaga

SEQ ID NO: 1188926 - RNA, 19 nt, Homo sapiens
ggauucccaucaacucuca

SEQ ID NO: 1188927 - RNA, 19 nt, Homo sapiens
gcaaaggggaggagauuuu

SEQ ID NO: 1188928 - RNA, 19 nt, Homo sapiens
gggagcugcuggaggaguu

SEQ ID NO: 1188929 - RNA, 19 nt, Homo sapiens
cgguuugucugcccaguaa

SEQ ID NO: 1188930 - RNA, 19 nt, Homo sapiens
gaaguuuggcaugaaugua

SEQ ID NO: 1188931 - RNA, 19 nt, Homo sapiens
gacccuaccugucaguucu

SEQ ID NO: 1188932 - RNA, 19 nt, Homo sapiens
gaagcaggacuacguugau

SEQ ID NO: 1188933 - RNA, 19 nt, Homo sapiens
ggccgagacuacuguuuca

SEQ ID NO: 1188934 - RNA, 19 nt, Homo sapiens
gcaaugccuugugaagaag

SEQ ID NO: 1188935 - RNA, 19 nt, Homo sapiens
acugggagcuucaccuaug

SEQ ID NO: 1188936 - RNA, 19 nt, Homo sapiens
gggaggagauuuucuucuu

SEQ ID NO: 1188937 - RNA, 19 nt, Homo sapiens
guagaucggcucagcaaag

SEQ ID NO: 1188938 - RNA, 19 nt, Homo sapiens
gggcacauguugguagauc

SEQ ID NO: 1188939 - RNA, 19 nt, Homo sapiens
ccacugggagcuucaccua

SEQ ID NO: 1188940 - RNA, 19 nt, Homo sapiens
agaacaagaaggugaaguu

SEQ ID NO: 1188941 - RNA, 19 nt, Homo sapiens
cagaggcuaugacaucaag

SEQ ID NO: 1188942 - RNA, 19 nt, Homo sapiens
ucaccugcacugagaauga

SEQ ID NO: 1188943 - RNA, 19 nt, Homo sapiens
gaacauggcagccccaaag

SEQ ID NO: 1188944 - RNA, 19 nt, Homo sapiens
ggaggaggacugugcucuu

SEQ ID NO: 1188945 - RNA, 19 nt, Homo sapiens
gaagaagccagcccaugac

SEQ ID NO: 1188946 - RNA, 19 nt, Homo sapiens
gcugcugcuuuccuuaguu

SEQ ID NO: 1188947 - RNA, 19 nt, Homo sapiens
auaaagaucgggauuacau

SEQ ID NO: 1188948 - RNA, 19 nt, Homo sapiens
aaggugaaguuuggcauga

SEQ ID NO: 1188949 - RNA, 19 nt, Homo sapiens
gcccaguaauccuguucaa

SEQ ID NO: 1188950 - RNA, 19 nt, Homo sapiens
gcagcaaugccuugugaag

SEQ ID NO: 1188951 - RNA, 19 nt, Homo sapiens
gaggugcgcucagccuucu

SEQ ID NO: 1188952 - RNA, 19 nt, Homo sapiens
gauaaggucagaggcuaug

SEQ ID NO: 1188953 - RNA, 19 nt, Homo sapiens
cagcaaugccuugugaaga

SEQ ID NO: 1188954 - RNA, 19 nt, Homo sapiens
aaguuuggcaugaauguaa

SEQ ID NO: 1188955 - RNA, 19 nt, Homo sapiens
ggagaaagacacguuugag

SEQ ID NO: 1188956 - RNA, 19 nt, Homo sapiens
ugagaaugaggcaguuuga

SEQ ID NO: 1188957 - RNA, 19 nt, Homo sapiens
ggagccaguaucaguguug

SEQ ID NO: 1188958 - RNA, 19 nt, Homo sapiens
gacucacucucugaacauu

SEQ ID NO: 1188959 - RNA, 19 nt, Homo sapiens
ccagcgcuaugccgacuuc

SEQ ID NO: 1188960 - RNA, 19 nt, Homo sapiens
ugaauguaaccuccucuga

SEQ ID NO: 1188961 - RNA, 19 nt, Homo sapiens
gauaccugucagucaaaua

SEQ ID NO: 1188962 - RNA, 19 nt, Homo sapiens
agaaugaggcaguuugaca

SEQ ID NO: 1188963 - RNA, 19 nt, Homo sapiens
caauuugcccgugguguug

SEQ ID NO: 1188964 - RNA, 19 nt, Homo sapiens
cgacuucucccuggucaug

SEQ ID NO: 1188965 - RNA, 19 nt, Homo sapiens
cucacucucugaacauuga

SEQ ID NO: 1188966 - RNA, 19 nt, Homo sapiens
aagcaggacuacguugaug

SEQ ID NO: 1188967 - RNA, 19 nt, Homo sapiens
gacaaagcccagcgcuaug

SEQ ID NO: 1188968 - RNA, 19 nt, Homo sapiens
gaaguggugacacgcaucu

SEQ ID NO: 1188969 - RNA, 19 nt, Homo sapiens
gccaugacuucacaaagac

SEQ ID NO: 1188970 - RNA, 19 nt, Homo sapiens
ggaggagauuuucuucuuc

SEQ ID NO: 1188971 - RNA, 19 nt, Homo sapiens
gaguaugagaguucugaga

SEQ ID NO: 1188972 - RNA, 19 nt, Homo sapiens
uggcagaagggcucauauu

SEQ ID NO: 1188973 - RNA, 19 nt, Homo sapiens
agaaggagaaagacacguu

SEQ ID NO: 1188974 - RNA, 19 nt, Homo sapiens
ucaagggcaagcacauuug

SEQ ID NO: 1188975 - RNA, 19 nt, Homo sapiens
gaucaccugcacugagaau

SEQ ID NO: 1188976 - RNA, 19 nt, Homo sapiens
ucaggcagcuuggcuugca

SEQ ID NO: 1188977 - RNA, 19 nt, Homo sapiens
ccguacaggugagcaaguu

SEQ ID NO: 1188978 - RNA, 19 nt, Homo sapiens
cuaccucacuguggccuau

SEQ ID NO: 1188979 - RNA, 19 nt, Homo sapiens
cugagaagguggacaaagc

SEQ ID NO: 1188980 - RNA, 19 nt, Homo sapiens
ucguguuccuggaguauga

SEQ ID NO: 1188981 - RNA, 19 nt, Homo sapiens
cagcaggagcgccaacuca

SEQ ID NO: 1188982 - RNA, 19 nt, Homo sapiens
auauaaagaucgggauuac

SEQ ID NO: 1188983 - RNA, 19 nt, Homo sapiens
gaggcaguuugacacagau

SEQ ID NO: 1188984 - RNA, 19 nt, Homo sapiens
gcccuuagcagagaaucaa

SEQ ID NO: 1188985 - RNA, 19 nt, Homo sapiens
uaaagaucgggauuacaug

SEQ ID NO: 1188986 - RNA, 19 nt, Homo sapiens
uauccaggcugugaauuuu

SEQ ID NO: 1188987 - RNA, 19 nt, Homo sapiens
ucaacucucagaacugugu

SEQ ID NO: 1188988 - RNA, 19 nt, Homo sapiens
uagaucggcucagcaaagg

SEQ ID NO: 1188989 - RNA, 19 nt, Homo sapiens
gaacacauguaccaauuua

SEQ ID NO: 1188990 - RNA, 19 nt, Homo sapiens
ggaaagaucacuucuguuu

SEQ ID NO: 1188991 - RNA, 19 nt, Homo sapiens
ggaagaagaucuguauuug

SEQ ID NO: 1188992 - RNA, 19 nt, Homo sapiens
ccaaagauguuccagauga

SEQ ID NO: 1188993 - RNA, 19 nt, Homo sapiens
gcaaauaaacucaagaaga

SEQ ID NO: 1188994 - RNA, 19 nt, Homo sapiens
gaggaaagaucacuucugu

SEQ ID NO: 1188995 - RNA, 19 nt, Homo sapiens
gaauggaccugaaccuuuc

SEQ ID NO: 1188996 - RNA, 19 nt, Homo sapiens
gcauuugccuggaaggaua

SEQ ID NO: 1188997 - RNA, 19 nt, Homo sapiens
gaaggaauuugcccaggaa

SEQ ID NO: 1188998 - RNA, 19 nt, Homo sapiens
caagaucucauaugugaua

SEQ ID NO: 1188999 - RNA, 19 nt, Homo sapiens
ggaaaugaccuuuaauauc

SEQ ID NO: 1189000 - RNA, 19 nt, Homo sapiens
gagaugggcuuaaguuugg

SEQ ID NO: 1189001 - RNA, 19 nt, Homo sapiens
ggaauggaccugaaccuuu

SEQ ID NO: 1189002 - RNA, 19 nt, Homo sapiens
gcaaauguuucaagcacuu

SEQ ID NO: 1189003 - RNA, 19 nt, Homo sapiens
gauguacacugugauauug

SEQ ID NO: 1189004 - RNA, 19 nt, Homo sapiens
ggccagagaugguaucaga

SEQ ID NO: 1189005 - RNA, 19 nt, Homo sapiens
gaugauggaaguuucaaua

SEQ ID NO: 1189006 - RNA, 19 nt, Homo sapiens
cccaagaucucauauguga

SEQ ID NO: 1189007 - RNA, 19 nt, Homo sapiens
ugugugagauggcaaauaa

SEQ ID NO: 1189008 - RNA, 19 nt, Homo sapiens
gggaagaagaucuguauuu

SEQ ID NO: 1189009 - RNA, 19 nt, Homo sapiens
gauggcagauggacacuga

SEQ ID NO: 1189010 - RNA, 19 nt, Homo sapiens
gaaauuauacgucuagucu

SEQ ID NO: 1189011 - RNA, 19 nt, Homo sapiens
gaacagugacguaggcaaa

SEQ ID NO: 1189012 - RNA, 19 nt, Homo sapiens
gacauugacugcaagagaa

SEQ ID NO: 1189013 - RNA, 19 nt, Homo sapiens
cagaacacauguaccaauu

SEQ ID NO: 1189014 - RNA, 19 nt, Homo sapiens
gauuuaagaugguggcuau

SEQ ID NO: 1189015 - RNA, 19 nt, Homo sapiens
ggugguaucuggcuaacuu

SEQ ID NO: 1189016 - RNA, 19 nt, Homo sapiens
ccagacagcugaaguugau

SEQ ID NO: 1189017 - RNA, 19 nt, Homo sapiens
uggaggagauguauuuauu

SEQ ID NO: 1189018 - RNA, 19 nt, Homo sapiens
auacguggcugcagaacua

SEQ ID NO: 1189019 - RNA, 19 nt, Homo sapiens
ugaaguugaucucuuagaa

SEQ ID NO: 1189020 - RNA, 19 nt, Homo sapiens
gaaaccugcuugagaugga

SEQ ID NO: 1189021 - RNA, 19 nt, Homo sapiens
aaaggcaccuggagagaaa

SEQ ID NO: 1189022 - RNA, 19 nt, Homo sapiens
ggacucaguguguugauaa

SEQ ID NO: 1189023 - RNA, 19 nt, Homo sapiens
ucugcaaccuccuauauaa

SEQ ID NO: 1189024 - RNA, 19 nt, Homo sapiens
ggccaaagauguuccagau

SEQ ID NO: 1189025 - RNA, 19 nt, Homo sapiens
caggaaaugaccuuuaaua

SEQ ID NO: 1189026 - RNA, 19 nt, Homo sapiens
ucaguaacauuucaggauu

SEQ ID NO: 1189027 - RNA, 19 nt, Homo sapiens
gggcuagaguuugacuuua

SEQ ID NO: 1189028 - RNA, 19 nt, Homo sapiens
acaagugaauggaauaaga

SEQ ID NO: 1189029 - RNA, 19 nt, Homo sapiens
gaccaguucugugcaauga

SEQ ID NO: 1189030 - RNA, 19 nt, Homo sapiens
gaugguaucagaaggaauu

SEQ ID NO: 1189031 - RNA, 19 nt, Homo sapiens
gaacacucaugggagcuuu

SEQ ID NO: 1189032 - RNA, 19 nt, Homo sapiens
ggagaaaacucaggaauuc

SEQ ID NO: 1189033 - RNA, 19 nt, Homo sapiens
gcuacuguauggauggaua

SEQ ID NO: 1189034 - RNA, 19 nt, Homo sapiens
aagaagaucuguauuugca

SEQ ID NO: 1189035 - RNA, 19 nt, Homo sapiens
aaacagaccaucaguaaca

SEQ ID NO: 1189036 - RNA, 19 nt, Homo sapiens
uaggaaaguuggaucagaa

SEQ ID NO: 1189037 - RNA, 19 nt, Homo sapiens
agacauagaugagugugaa

SEQ ID NO: 1189038 - RNA, 19 nt, Homo sapiens
gaggaaagccaaggagaaa

SEQ ID NO: 1189039 - RNA, 19 nt, Homo sapiens
gaaaggcaccuggagagaa

SEQ ID NO: 1189040 - RNA, 19 nt, Homo sapiens
ccacacaucuugccacaac

SEQ ID NO: 1189041 - RNA, 19 nt, Homo sapiens
gcagugagaugggcuuaag

SEQ ID NO: 1189042 - RNA, 19 nt, Homo sapiens
cccaggaaaugaccuuuaa

SEQ ID NO: 1189043 - RNA, 19 nt, Homo sapiens
gaaagaucacuucuguuug

SEQ ID NO: 1189044 - RNA, 19 nt, Homo sapiens
gaccaucaguaacauuuca

SEQ ID NO: 1189045 - RNA, 19 nt, Homo sapiens
uggcaacccuccagaaaug

SEQ ID NO: 1189046 - RNA, 19 nt, Homo sapiens
gaacuacuggccaaagaug

SEQ ID NO: 1189047 - RNA, 19 nt, Homo sapiens
gcaaauaacaauagcaacu

SEQ ID NO: 1189048 - RNA, 19 nt, Homo sapiens
gaucuguauuugcaacuau

SEQ ID NO: 1189049 - RNA, 19 nt, Homo sapiens
ggcuagaguuugacuuuau

SEQ ID NO: 1189050 - RNA, 19 nt, Homo sapiens
gaacuugagacuccugaug

SEQ ID NO: 1189051 - RNA, 19 nt, Homo sapiens
gagaugguaucagaaggaa

SEQ ID NO: 1189052 - RNA, 19 nt, Homo sapiens
acaagugccuguagugugu

SEQ ID NO: 1189053 - RNA, 19 nt, Homo sapiens
gaacaagugccuguagugu

SEQ ID NO: 1189054 - RNA, 19 nt, Homo sapiens
aaagaucacuucuguuugc

SEQ ID NO: 1189055 - RNA, 19 nt, Homo sapiens
caaacaacaacaagacauu

SEQ ID NO: 1189056 - RNA, 19 nt, Homo sapiens
gaagggaagaagaucugua

SEQ ID NO: 1189057 - RNA, 19 nt, Homo sapiens
cagaacuacuggccaaaga

SEQ ID NO: 1189058 - RNA, 19 nt, Homo sapiens
aaugaaaccugcuugagau

SEQ ID NO: 1189059 - RNA, 19 nt, Homo sapiens
gaucagaacacauguacca

SEQ ID NO: 1189060 - RNA, 19 nt, Homo sapiens
caacaacaagacauucauu

SEQ ID NO: 1189061 - RNA, 19 nt, Homo sapiens
gcuagaguuugacuuuaug

SEQ ID NO: 1189062 - RNA, 19 nt, Homo sapiens
caugugggccugcaacuuu

SEQ ID NO: 1189063 - RNA, 19 nt, Homo sapiens
gcagauggcggguguugga

SEQ ID NO: 1189064 - RNA, 19 nt, Homo sapiens
ggaccaaucaguucauauc

SEQ ID NO: 1189065 - RNA, 19 nt, Homo sapiens
caguaacauuucaggauuu

SEQ ID NO: 1189066 - RNA, 19 nt, Homo sapiens
gaagauacaguuucaagcu

SEQ ID NO: 1189067 - RNA, 19 nt, Homo sapiens
uaaugaaaccugcuugaga

SEQ ID NO: 1189068 - RNA, 19 nt, Homo sapiens
uaaaacagaccaucaguaa

SEQ ID NO: 1189069 - RNA, 19 nt, Homo sapiens
gauuauacggugaauguga

SEQ ID NO: 1189070 - RNA, 19 nt, Homo sapiens
uugcaacuauggauuugua

SEQ ID NO: 1189071 - RNA, 19 nt, Homo sapiens
ggagucaccauaaggagaa

SEQ ID NO: 1189072 - RNA, 19 nt, Homo sapiens
gcuguugugaucauucuua

SEQ ID NO: 1189073 - RNA, 19 nt, Homo sapiens
caaagauguuccagaugau

SEQ ID NO: 1189074 - RNA, 19 nt, Homo sapiens
caacaucguuuaacuucac

SEQ ID NO: 1189075 - RNA, 19 nt, Homo sapiens
gcaacaucguuuaacuuca

SEQ ID NO: 1189076 - RNA, 19 nt, Homo sapiens
gaagaugauggaaguuuca

SEQ ID NO: 1189077 - RNA, 19 nt, Homo sapiens
gguaccaacuacaauguca

SEQ ID NO: 1189078 - RNA, 19 nt, Homo sapiens
gcaaagagaagggaagaag

SEQ ID NO: 1189079 - RNA, 19 nt, Homo sapiens
cagcugauauggaggagau

SEQ ID NO: 1189080 - RNA, 19 nt, Homo sapiens
ugaaggaagucauugaaaa

SEQ ID NO: 1189081 - RNA, 19 nt, Homo sapiens
caacgccucugaugcugau

SEQ ID NO: 1189082 - RNA, 19 nt, Homo sapiens
ccacaugccagcaaagaga

SEQ ID NO: 1189083 - RNA, 19 nt, Homo sapiens
cagcugaaguugaucucuu

SEQ ID NO: 1189084 - RNA, 19 nt, Homo sapiens
cagcuccucuagacauuga

SEQ ID NO: 1189085 - RNA, 19 nt, Homo sapiens
caguucauaucagguguua

SEQ ID NO: 1189086 - RNA, 19 nt, Homo sapiens
ugacaacccagauaacaga

SEQ ID NO: 1189087 - RNA, 19 nt, Homo sapiens
cgucaucgguuuccagaca

SEQ ID NO: 1189088 - RNA, 19 nt, Homo sapiens
ugagagcccuggaggaaag

SEQ ID NO: 1189089 - RNA, 19 nt, Homo sapiens
ggacaaagcugacuacaga

SEQ ID NO: 1189090 - RNA, 19 nt, Homo sapiens
gaagagagcuagaacaguu

SEQ ID NO: 1189091 - RNA, 19 nt, Homo sapiens
ccacaaagaucacaugaaa

SEQ ID NO: 1189092 - RNA, 19 nt, Homo sapiens
ugaaaugugucucuacuua

SEQ ID NO: 1189093 - RNA, 19 nt, Homo sapiens
gagcugagauugugucauu

SEQ ID NO: 1189094 - RNA, 19 nt, Homo sapiens
guacggagccaaaguauaa

SEQ ID NO: 1189095 - RNA, 19 nt, Homo sapiens
gcacaacuauggauaaagu

SEQ ID NO: 1189096 - RNA, 19 nt, Homo sapiens
caaccuuagugaagaauua

SEQ ID NO: 1189097 - RNA, 19 nt, Homo sapiens
gaacaugccugagauccuu

SEQ ID NO: 1189098 - RNA, 19 nt, Homo sapiens
ugaauaagcuagacauguu

SEQ ID NO: 1189099 - RNA, 19 nt, Homo sapiens
ggauaaaguugucgaaauc

SEQ ID NO: 1189100 - RNA, 19 nt, Homo sapiens
ccagauaucuuuaguggau

SEQ ID NO: 1189101 - RNA, 19 nt, Homo sapiens
gcuugaagguuuaucuaua

SEQ ID NO: 1189102 - RNA, 19 nt, Homo sapiens
gcagagcucucguuucaca

SEQ ID NO: 1189103 - RNA, 19 nt, Homo sapiens
ucaaagacauccaaagugu

SEQ ID NO: 1189104 - RNA, 19 nt, Homo sapiens
gagugcagcuugaagguuu

SEQ ID NO: 1189105 - RNA, 19 nt, Homo sapiens
gcagugagcugagauugug

SEQ ID NO: 1189106 - RNA, 19 nt, Homo sapiens
caaaggauacuuacucuga

SEQ ID NO: 1189107 - RNA, 19 nt, Homo sapiens
gaacgcauauccaaauguc

SEQ ID NO: 1189108 - RNA, 19 nt, Homo sapiens
gaccaacaaucaaagagaa

SEQ ID NO: 1189109 - RNA, 19 nt, Homo sapiens
gaagguuuaucuauacugu

SEQ ID NO: 1189110 - RNA, 19 nt, Homo sapiens
gaucugggcucuguacuuc

SEQ ID NO: 1189111 - RNA, 19 nt, Homo sapiens
gaauuccacuccacauaau

SEQ ID NO: 1189112 - RNA, 19 nt, Homo sapiens
caacuacucuaagcaguga

SEQ ID NO: 1189113 - RNA, 19 nt, Homo sapiens
caacagaccgcaacacuca

SEQ ID NO: 1189114 - RNA, 19 nt, Homo sapiens
cgagagcauuuacaauauu

SEQ ID NO: 1189115 - RNA, 19 nt, Homo sapiens
ggagaaccaacuacucuaa

SEQ ID NO: 1189116 - RNA, 19 nt, Homo sapiens
caacacacauaacagaaca

SEQ ID NO: 1189117 - RNA, 19 nt, Homo sapiens
gaucgaagauuuuaccaaa

SEQ ID NO: 1189118 - RNA, 19 nt, Homo sapiens
guucugugaucgaagauuu

SEQ ID NO: 1189119 - RNA, 19 nt, Homo sapiens
gauacuacguucugugauc

SEQ ID NO: 1189120 - RNA, 19 nt, Homo sapiens
gagcaagacccuguuuaaa

SEQ ID NO: 1189121 - RNA, 19 nt, Homo sapiens
ggaagaaacgaauuauauc

SEQ ID NO: 1189122 - RNA, 19 nt, Homo sapiens
caccaaagcuuuucaguga

SEQ ID NO: 1189123 - RNA, 19 nt, Homo sapiens
aggagaagcugcuagaaug

SEQ ID NO: 1189124 - RNA, 19 nt, Homo sapiens
ccagaauucuucccaguca

SEQ ID NO: 1189125 - RNA, 19 nt, Homo sapiens
gaauaagcuagacauguuu

SEQ ID NO: 1189126 - RNA, 19 nt, Homo sapiens
gaagcugaguuaccuaaac

SEQ ID NO: 1189127 - RNA, 19 nt, Homo sapiens
cagccaaucugauacuguu

SEQ ID NO: 1189128 - RNA, 19 nt, Homo sapiens
gcaaggagaagcugcuaga

SEQ ID NO: 1189129 - RNA, 19 nt, Homo sapiens
uaauggaacuguccuguac

SEQ ID NO: 1189130 - RNA, 19 nt, Homo sapiens
gauacuuacucugauuuga

SEQ ID NO: 1189131 - RNA, 19 nt, Homo sapiens
aacgagagcauuuacaaua

SEQ ID NO: 1189132 - RNA, 19 nt, Homo sapiens
acacauaacagaacaagga

SEQ ID NO: 1189133 - RNA, 19 nt, Homo sapiens
caaccuagagcaaccacua

SEQ ID NO: 1189134 - RNA, 19 nt, Homo sapiens
guauccaacuaucuccaua

SEQ ID NO: 1189135 - RNA, 19 nt, Homo sapiens
augcagagcucucguuuca

SEQ ID NO: 1189136 - RNA, 19 nt, Homo sapiens
ccaaggcagaggaauauuu

SEQ ID NO: 1189137 - RNA, 19 nt, Homo sapiens
guacacaggagacuucaga

SEQ ID NO: 1189138 - RNA, 19 nt, Homo sapiens
gacaauaguuccuaguacu

SEQ ID NO: 1189139 - RNA, 19 nt, Homo sapiens
aagcagagauaaagaugug

SEQ ID NO: 1189140 - RNA, 19 nt, Homo sapiens
cuacagaccaacaaucaaa

SEQ ID NO: 1189141 - RNA, 19 nt, Homo sapiens
cgagacuccuacccagaua

SEQ ID NO: 1189142 - RNA, 19 nt, Homo sapiens
acuaaggaguuguuguuaa

SEQ ID NO: 1189143 - RNA, 19 nt, Homo sapiens
gagauaaagaugugacaau

SEQ ID NO: 1189144 - RNA, 19 nt, Homo sapiens
gauggagaaucaacucaca

SEQ ID NO: 1189145 - RNA, 19 nt, Homo sapiens
gaugaaaucacagaugaga

SEQ ID NO: 1189146 - RNA, 19 nt, Homo sapiens
gcaggagaaucacuugaac

SEQ ID NO: 1189147 - RNA, 19 nt, Homo sapiens
uggauaaaguugucgaaau

SEQ ID NO: 1189148 - RNA, 19 nt, Homo sapiens
ggacuggagagaguucaua

SEQ ID NO: 1189149 - RNA, 19 nt, Homo sapiens
caaagacauccaaagugua

SEQ ID NO: 1189150 - RNA, 19 nt, Homo sapiens
gauaaagaugugacaauag

SEQ ID NO: 1189151 - RNA, 19 nt, Homo sapiens
ucacaugaaaggauuaaga

SEQ ID NO: 1189152 - RNA, 19 nt, Homo sapiens
ucacaucuccucccagaau

SEQ ID NO: 1189153 - RNA, 19 nt, Homo sapiens
ccagugggaaguauucuuu

SEQ ID NO: 1189154 - RNA, 19 nt, Homo sapiens
gaaguaggaaucccagcuu

SEQ ID NO: 1189155 - RNA, 19 nt, Homo sapiens
aaagacauccaaaguguau

SEQ ID NO: 1189156 - RNA, 19 nt, Homo sapiens
ugacuaaggaguuguuguu

SEQ ID NO: 1189157 - RNA, 19 nt, Homo sapiens
aaaugugucucuacuuaca

SEQ ID NO: 1189158 - RNA, 19 nt, Homo sapiens
cuuuguagauugugaagaa

SEQ ID NO: 1189159 - RNA, 19 nt, Homo sapiens
aaaguacggagccaaagua

SEQ ID NO: 1189160 - RNA, 19 nt, Homo sapiens
agaauuccacuccacauaa

SEQ ID NO: 1189161 - RNA, 19 nt, Homo sapiens
acgagagcauuuacaauau

SEQ ID NO: 1189162 - RNA, 19 nt, Homo sapiens
cacaggagacuucagauug

SEQ ID NO: 1189163 - RNA, 19 nt, Homo sapiens
cuaaggaguuguuguuaac

SEQ ID NO: 1189164 - RNA, 19 nt, Homo sapiens
ggccaaggcaggagaauca

SEQ ID NO: 1189165 - RNA, 19 nt, Homo sapiens
caaagcguuucaaccuaga

SEQ ID NO: 1189166 - RNA, 19 nt, Homo sapiens
aagaucacaugaaaggauu

SEQ ID NO: 1189167 - RNA, 19 nt, Homo sapiens
aaucacagaugagaguuug

SEQ ID NO: 1189168 - RNA, 19 nt, Homo sapiens
augacuaucucuuugauga

SEQ ID NO: 1189169 - RNA, 19 nt, Homo sapiens
guucauacagagcuuguuu

SEQ ID NO: 1189170 - RNA, 19 nt, Homo sapiens
agagcaagacccuguuuaa

SEQ ID NO: 1189171 - RNA, 19 nt, Homo sapiens
ugacaauaguuccuaguac

SEQ ID NO: 1189172 - RNA, 19 nt, Homo sapiens
ccaacaaucaaagagaaua

SEQ ID NO: 1189173 - RNA, 19 nt, Homo sapiens
uagaauuccacuccacaua

SEQ ID NO: 1189174 - RNA, 19 nt, Homo sapiens
cggcuuauggcuaugaaua

SEQ ID NO: 1189175 - RNA, 19 nt, Homo sapiens
gcuggcaacuggugagagu

SEQ ID NO: 1189176 - RNA, 19 nt, Homo sapiens
cagugacucugauggagaa

SEQ ID NO: 1189177 - RNA, 19 nt, Homo sapiens
uucaaugacugcaguauca

SEQ ID NO: 1189178 - RNA, 19 nt, Homo sapiens
acaaagaucacaugaaagg

SEQ ID NO: 1189179 - RNA, 19 nt, Homo sapiens
aaggauacuuacucugauu

SEQ ID NO: 1189180 - RNA, 19 nt, Homo sapiens
gacuacagaccaacaauca

SEQ ID NO: 1189181 - RNA, 19 nt, Homo sapiens
ugggacagccaaucugaua

SEQ ID NO: 1189182 - RNA, 19 nt, Homo sapiens
uaacagaacaaggaaguca

SEQ ID NO: 1189183 - RNA, 19 nt, Homo sapiens
gacuaaggaguuguuguua

SEQ ID NO: 1189184 - RNA, 19 nt, Homo sapiens
agugggaaguauucuuuaa

SEQ ID NO: 1189185 - RNA, 19 nt, Homo sapiens
ugaagaagaaguaggaauc

SEQ ID NO: 1189186 - RNA, 19 nt, Homo sapiens
gugaacgcauauccaaaug

SEQ ID NO: 1189187 - RNA, 19 nt, Homo sapiens
ugccugagauccuucauca

SEQ ID NO: 1189188 - RNA, 19 nt, Homo sapiens
gaucacaugaaaggauuaa

SEQ ID NO: 1189189 - RNA, 19 nt, Homo sapiens
gcaaacagauggaauauuc

SEQ ID NO: 1189190 - RNA, 19 nt, Homo sapiens
ggaagaagaugaagaugaa

SEQ ID NO: 1189191 - RNA, 19 nt, Homo sapiens
ggaagaauaugaagagagu

SEQ ID NO: 1189192 - RNA, 19 nt, Homo sapiens
ggacuuauauguuuaugca

SEQ ID NO: 1189193 - RNA, 19 nt, Homo sapiens
gagaguggauuguuggaaa

SEQ ID NO: 1189194 - RNA, 19 nt, Homo sapiens
caagacacuucacaaugua

SEQ ID NO: 1189195 - RNA, 19 nt, Homo sapiens
gcggauggguagauacaua

SEQ ID NO: 1189196 - RNA, 19 nt, Homo sapiens
cugcagauauggaagaaua

SEQ ID NO: 1189197 - RNA, 19 nt, Homo sapiens
cagccuuacuuguuuaaua

SEQ ID NO: 1189198 - RNA, 19 nt, Homo sapiens
ccauagaugugaccauuga

SEQ ID NO: 1189199 - RNA, 19 nt, Homo sapiens
uuaccagacuccacgauua

SEQ ID NO: 1189200 - RNA, 19 nt, Homo sapiens
gaagagagcauaaaaucua

SEQ ID NO: 1189201 - RNA, 19 nt, Homo sapiens
acaagacacuucacaaugu

SEQ ID NO: 1189202 - RNA, 19 nt, Homo sapiens
uaaggaaacagguguaauu

SEQ ID NO: 1189203 - RNA, 19 nt, Homo sapiens
cuaccagccuuacuuguuu

SEQ ID NO: 1189204 - RNA, 19 nt, Homo sapiens
gggaagaauugaaagugaa

SEQ ID NO: 1189205 - RNA, 19 nt, Homo sapiens
uauaagcggugcaaacaga

SEQ ID NO: 1189206 - RNA, 19 nt, Homo sapiens
gaauaugacuacacaagac

SEQ ID NO: 1189207 - RNA, 19 nt, Homo sapiens
gagcaacggcagccuuuaa

SEQ ID NO: 1189208 - RNA, 19 nt, Homo sapiens
gaacuuaugaccuuuacau

SEQ ID NO: 1189209 - RNA, 19 nt, Homo sapiens
ugaagagaguggauuguug

SEQ ID NO: 1189210 - RNA, 19 nt, Homo sapiens
gaaagugaaggcauaccua

SEQ ID NO: 1189211 - RNA, 19 nt, Homo sapiens
auauaaggcuucaagauug

SEQ ID NO: 1189212 - RNA, 19 nt, Homo sapiens
ggaaacagguguaauuacc

SEQ ID NO: 1189213 - RNA, 19 nt, Homo sapiens
ugaagaagaugauggugau

SEQ ID NO: 1189214 - RNA, 19 nt, Homo sapiens
uaucacaacacagguauua

SEQ ID NO: 1189215 - RNA, 19 nt, Homo sapiens
aggagaagcugcagauaug

SEQ ID NO: 1189216 - RNA, 19 nt, Homo sapiens
ggaaucaaaguuuaaggaa

SEQ ID NO: 1189217 - RNA, 19 nt, Homo sapiens
ggaugcagaaugugauuaa

SEQ ID NO: 1189218 - RNA, 19 nt, Homo sapiens
gaauuaacccauagaugug

SEQ ID NO: 1189219 - RNA, 19 nt, Homo sapiens
gauggcggauggguagaua

SEQ ID NO: 1189220 - RNA, 19 nt, Homo sapiens
gaagggaaaggcacuggaa

SEQ ID NO: 1189221 - RNA, 19 nt, Homo sapiens
agaauuaacccauagaugu

SEQ ID NO: 1189222 - RNA, 19 nt, Homo sapiens
aaccagaacuuaugaccuu

SEQ ID NO: 1189223 - RNA, 19 nt, Homo sapiens
agaugaagaugaaggagaa

SEQ ID NO: 1189224 - RNA, 19 nt, Homo sapiens
aaagagaucacacuggaaa

SEQ ID NO: 1189225 - RNA, 19 nt, Homo sapiens
cucaaggaaucaaaguuua

SEQ ID NO: 1189226 - RNA, 19 nt, Homo sapiens
cagaugaauuggaagcuau

SEQ ID NO: 1189227 - RNA, 19 nt, Homo sapiens
gcucagcacuaugugaaga

SEQ ID NO: 1189228 - RNA, 19 nt, Homo sapiens
uuaauacugugaagggaaa

SEQ ID NO: 1189229 - RNA, 19 nt, Homo sapiens
ggugcaaacagauggaaua

SEQ ID NO: 1189230 - RNA, 19 nt, Homo sapiens
caguugagcacauguauga

SEQ ID NO: 1189231 - RNA, 19 nt, Homo sapiens
ccacgauuaugguuguuug

SEQ ID NO: 1189232 - RNA, 19 nt, Homo sapiens
gaaggagaagcugcagaua

SEQ ID NO: 1189233 - RNA, 19 nt, Homo sapiens
acacagguauuacaggaau

SEQ ID NO: 1189234 - RNA, 19 nt, Homo sapiens
gaauuggaagcuaucauug

SEQ ID NO: 1189235 - RNA, 19 nt, Homo sapiens
gaugugaccauugaccaua

SEQ ID NO: 1189236 - RNA, 19 nt, Homo sapiens
ccucaaggaaucaaaguuu

SEQ ID NO: 1189237 - RNA, 19 nt, Homo sapiens
uggaagcuaucauugaaga

SEQ ID NO: 1189238 - RNA, 19 nt, Homo sapiens
ugaauuggaagcuaucauu

SEQ ID NO: 1189239 - RNA, 19 nt, Homo sapiens
ucagaugaauuggaagcua

SEQ ID NO: 1189240 - RNA, 19 nt, Homo sapiens
aauugaaagugaaggcaua

SEQ ID NO: 1189241 - RNA, 19 nt, Homo sapiens
ggaagccguuaaagagauc

SEQ ID NO: 1189242 - RNA, 19 nt, Homo sapiens
gaaggcauaccuaccaaca

SEQ ID NO: 1189243 - RNA, 19 nt, Homo sapiens
guaaugaagagagcauaaa

SEQ ID NO: 1189244 - RNA, 19 nt, Homo sapiens
cauugagacuguugcagaa

SEQ ID NO: 1189245 - RNA, 19 nt, Homo sapiens
augcugaggugaugaagaa

SEQ ID NO: 1189246 - RNA, 19 nt, Homo sapiens
ccagaacuuaugaccuuua

SEQ ID NO: 1189247 - RNA, 19 nt, Homo sapiens
gugaagaggaagaagauga

SEQ ID NO: 1189248 - RNA, 19 nt, Homo sapiens
caauauaaggcuucaagau

SEQ ID NO: 1189249 - RNA, 19 nt, Homo sapiens
cagauggaauauucagaug

SEQ ID NO: 1189250 - RNA, 19 nt, Homo sapiens
uaccagccuuacuuguuua

SEQ ID NO: 1189251 - RNA, 19 nt, Homo sapiens
uaacaguugagcacaugua

SEQ ID NO: 1189252 - RNA, 19 nt, Homo sapiens
cggcagccuuuaacaguug

SEQ ID NO: 1189253 - RNA, 19 nt, Homo sapiens
gaugaggcuacccuagaua

SEQ ID NO: 1189254 - RNA, 19 nt, Homo sapiens
aaggaaacagguguaauua

SEQ ID NO: 1189255 - RNA, 19 nt, Homo sapiens
gagcacauguaugaagaca

SEQ ID NO: 1189256 - RNA, 19 nt, Homo sapiens
gcuauaagcggugcaaaca

SEQ ID NO: 1189257 - RNA, 19 nt, Homo sapiens
cacaagacacuucacaaug

SEQ ID NO: 1189258 - RNA, 19 nt, Homo sapiens
gaaaauaguagaagcuugu

SEQ ID NO: 1189259 - RNA, 19 nt, Homo sapiens
cagaugaggcuacccuaga

SEQ ID NO: 1189260 - RNA, 19 nt, Homo sapiens
gacaauauaaggcuucaag

SEQ ID NO: 1189261 - RNA, 19 nt, Homo sapiens
ucacaacacagguauuaca

SEQ ID NO: 1189262 - RNA, 19 nt, Homo sapiens
ccauugaccauauucauca

SEQ ID NO: 1189263 - RNA, 19 nt, Homo sapiens
acacaagacacuucacaau

SEQ ID NO: 1189264 - RNA, 19 nt, Homo sapiens
gaaaaucauugagacuguu

SEQ ID NO: 1189265 - RNA, 19 nt, Homo sapiens
ugaagaggaagaagaugaa

SEQ ID NO: 1189266 - RNA, 19 nt, Homo sapiens
cggaagccguuaaagagau

SEQ ID NO: 1189267 - RNA, 19 nt, Homo sapiens
ugcagaaugugauuaauac

SEQ ID NO: 1189268 - RNA, 19 nt, Homo sapiens
gaagcuaucauugaagaag

SEQ ID NO: 1189269 - RNA, 19 nt, Homo sapiens
ugacacggcugcacuuucc

SEQ ID NO: 1189270 - RNA, 19 nt, Homo sapiens
gucaggaucaugugaagaa

SEQ ID NO: 1189271 - RNA, 19 nt, Homo sapiens
uacccuagauacaaggaaa

SEQ ID NO: 1189272 - RNA, 19 nt, Homo sapiens
auuggaagcuaucauugaa

SEQ ID NO: 1189273 - RNA, 19 nt, Homo sapiens
gagcauaaaaucuauccua

SEQ ID NO: 1189274 - RNA, 19 nt, Homo sapiens
agaaaacagugaccauuga

SEQ ID NO: 1189275 - RNA, 19 nt, Homo sapiens
ggggaagaauugaaaguga

SEQ ID NO: 1189276 - RNA, 19 nt, Homo sapiens
gaagaaaacagugaccauu

SEQ ID NO: 1189277 - RNA, 19 nt, Homo sapiens
gagaagcugcagauaugga

SEQ ID NO: 1189278 - RNA, 19 nt, Homo sapiens
gugaaggcauaccuaccaa

SEQ ID NO: 1189279 - RNA, 19 nt, Homo sapiens
ccacuaccagccuuacuug

SEQ ID NO: 1189280 - RNA, 19 nt, Homo sapiens
gaugcagaaugugauuaau

SEQ ID NO: 1189281 - RNA, 19 nt, Homo sapiens
gaguucauauguaucuucu

SEQ ID NO: 1189282 - RNA, 19 nt, Homo sapiens
caagcugucauuccaacaa

SEQ ID NO: 1189283 - RNA, 19 nt, Homo sapiens
uguacaagcugucauucca

SEQ ID NO: 1189284 - RNA, 19 nt, Homo sapiens
ggaguucauauguaucuuc

SEQ ID NO: 1189285 - RNA, 19 nt, Homo sapiens
gccaccaccucccaugugu

SEQ ID NO: 1189286 - RNA, 19 nt, Homo sapiens
acccauagaugugaccauu

SEQ ID NO: 1189287 - RNA, 19 nt, Homo sapiens
agaauaugacuacacaaga

SEQ ID NO: 1189288 - RNA, 19 nt, Homo sapiens
ggaagaauugaaagugaag

SEQ ID NO: 1189289 - RNA, 19 nt, Homo sapiens
ccagcaagguuuaaucaaa

SEQ ID NO: 1189290 - RNA, 19 nt, Homo sapiens
ggaggucgcugcuaugauc

SEQ ID NO: 1189291 - RNA, 19 nt, Homo sapiens
ggagauaccaccaaguuug

SEQ ID NO: 1189292 - RNA, 19 nt, Homo sapiens
caaagaaacugugugugau

SEQ ID NO: 1189293 - RNA, 19 nt, Homo sapiens
uagcugauccugagaauug

SEQ ID NO: 1189294 - RNA, 19 nt, Homo sapiens
acaaagaaacuguguguga

SEQ ID NO: 1189295 - RNA, 19 nt, Homo sapiens
ucaaacaacuccuuaagcu

SEQ ID NO: 1189296 - RNA, 19 nt, Homo sapiens
gccaucacaucaacagaaa

SEQ ID NO: 1189297 - RNA, 19 nt, Homo sapiens
gagaagcacgagauugaaa

SEQ ID NO: 1189298 - RNA, 19 nt, Homo sapiens
acacaucccuggacaaguc

SEQ ID NO: 1189299 - RNA, 19 nt, Homo sapiens
gagauaccaccaaguuuga

SEQ ID NO: 1189300 - RNA, 19 nt, Homo sapiens
ggaggugugugucaucgau

SEQ ID NO: 1189301 - RNA, 19 nt, Homo sapiens
gcuuggagguggcugaguu

SEQ ID NO: 1189302 - RNA, 19 nt, Homo sapiens
gcgauguccuaaccacuga

SEQ ID NO: 1189303 - RNA, 19 nt, Homo sapiens
aaacaaagaaacugugugu

SEQ ID NO: 1189304 - RNA, 19 nt, Homo sapiens
cuggaugcguggccaauaa

SEQ ID NO: 1189305 - RNA, 19 nt, Homo sapiens
aaacuuggccaucacauca

SEQ ID NO: 1189306 - RNA, 19 nt, Homo sapiens
ccgagaagcacgagauuga

SEQ ID NO: 1189307 - RNA, 19 nt, Homo sapiens
cacaggacaugcugccauu

SEQ ID NO: 1189308 - RNA, 19 nt, Homo sapiens
gcuccaaccugaagaagcu

SEQ ID NO: 1189309 - RNA, 19 nt, Homo sapiens
caaguuugauguggagguu

SEQ ID NO: 1189310 - RNA, 19 nt, Homo sapiens
ccucccaccugcuuccuaa

SEQ ID NO: 1189311 - RNA, 19 nt, Homo sapiens
agaagagccugaaccucaa

SEQ ID NO: 1189312 - RNA, 19 nt, Homo sapiens
ggacacaucccuggacaag

SEQ ID NO: 1189313 - RNA, 19 nt, Homo sapiens
gaaacuuggccaucacauc

SEQ ID NO: 1189314 - RNA, 19 nt, Homo sapiens
cagcaagguuuaaucaaaa

SEQ ID NO: 1189315 - RNA, 19 nt, Homo sapiens
aacgggagcuggccgacua

SEQ ID NO: 1189316 - RNA, 19 nt, Homo sapiens
gcacuggucgagcuguuug

SEQ ID NO: 1189317 - RNA, 19 nt, Homo sapiens
gaggaggucgcugcuauga

SEQ ID NO: 1189318 - RNA, 19 nt, Homo sapiens
gcuucaagaucagcacauu

SEQ ID NO: 1189319 - RNA, 19 nt, Homo sapiens
uugcaagucuuuacugcuu

SEQ ID NO: 1189320 - RNA, 19 nt, Homo sapiens
gccugaaccucaacaucuu

SEQ ID NO: 1189321 - RNA, 19 nt, Homo sapiens
ucagcaccaugaaggcuuu

SEQ ID NO: 1189322 - RNA, 19 nt, Homo sapiens
guucucaaacaacuccuua

SEQ ID NO: 1189323 - RNA, 19 nt, Homo sapiens
gaggcguucuuccugguau

SEQ ID NO: 1189324 - RNA, 19 nt, Homo sapiens
gcuagcugauccugagaau

SEQ ID NO: 1189325 - RNA, 19 nt, Homo sapiens
ggccaucacaucaacagaa

SEQ ID NO: 1189326 - RNA, 19 nt, Homo sapiens
acgaggaggucgcugcuau

SEQ ID NO: 1189327 - RNA, 19 nt, Homo sapiens
gggcacuggucgagcuguu

SEQ ID NO: 1189328 - RNA, 19 nt, Homo sapiens
gcucagaggccagcuccaa

SEQ ID NO: 1189329 - RNA, 19 nt, Homo sapiens
ggaaguucaaggcaagaug

SEQ ID NO: 1189330 - RNA, 19 nt, Homo sapiens
gcuaccagcugcgaaucga

SEQ ID NO: 1189331 - RNA, 19 nt, Homo sapiens
gauccgggcuggagauacc

SEQ ID NO: 1189332 - RNA, 19 nt, Homo sapiens
gcccagcaagguuuaauca

SEQ ID NO: 1189333 - RNA, 19 nt, Homo sapiens
uuaagcuccuucccgagaa

SEQ ID NO: 1189334 - RNA, 19 nt, Homo sapiens
gauaccaccaaguuugaug

SEQ ID NO: 1189335 - RNA, 19 nt, Homo sapiens
gagccuguggccaccagua

SEQ ID NO: 1189336 - RNA, 19 nt, Homo sapiens
uguggagguucucaaacaa

SEQ ID NO: 1189337 - RNA, 19 nt, Homo sapiens
gcccugcagcugaaacuug

SEQ ID NO: 1189338 - RNA, 19 nt, Homo sapiens
ccugagaauugggaacuuc

SEQ ID NO: 1189339 - RNA, 19 nt, Homo sapiens
aaagaaacugugugugauc

SEQ ID NO: 1189340 - RNA, 19 nt, Homo sapiens
cuggagauaccaccaaguu

SEQ ID NO: 1189341 - RNA, 19 nt, Homo sapiens
gcuggaugcguggccaaua

SEQ ID NO: 1189342 - RNA, 19 nt, Homo sapiens
ggaggaggugugugucauc

SEQ ID NO: 1189343 - RNA, 19 nt, Homo sapiens
ugauguggagguucucaaa

SEQ ID NO: 1189344 - RNA, 19 nt, Homo sapiens
cgagaagcacgagauugaa

SEQ ID NO: 1189345 - RNA, 19 nt, Homo sapiens
gagccugaaccucaacauc

SEQ ID NO: 1189346 - RNA, 19 nt, Homo sapiens
cuucagcccagcaagguuu

SEQ ID NO: 1189347 - RNA, 19 nt, Homo sapiens
ggaugccagcgauguccua

SEQ ID NO: 1189348 - RNA, 19 nt, Homo sapiens
ggaacagcccucgcaagca

SEQ ID NO: 1189349 - RNA, 19 nt, Homo sapiens
agaccaagucccagcagaa

SEQ ID NO: 1189350 - RNA, 19 nt, Homo sapiens
gcugaaacuuggccaucac

SEQ ID NO: 1189351 - RNA, 19 nt, Homo sapiens
ggaccgggaagcgaaggaa

SEQ ID NO: 1189352 - RNA, 19 nt, Homo sapiens
gaagcaggaggaggugugu

SEQ ID NO: 1189353 - RNA, 19 nt, Homo sapiens
agugcaugcugcuguguga

SEQ ID NO: 1189354 - RNA, 19 nt, Homo sapiens
gaacagaguuggcaaugaa

SEQ ID NO: 1189355 - RNA, 19 nt, Homo sapiens
gaacagccauugcaccuuu

SEQ ID NO: 1189356 - RNA, 19 nt, Homo sapiens
gaagaaauacugaagauga

SEQ ID NO: 1189357 - RNA, 19 nt, Homo sapiens
gcacauacaugacuuccaa

SEQ ID NO: 1189358 - RNA, 19 nt, Homo sapiens
gcaaagcggaggaagauua

SEQ ID NO: 1189359 - RNA, 19 nt, Homo sapiens
cuacaacaauggcagauua

SEQ ID NO: 1189360 - RNA, 19 nt, Homo sapiens
ggaaguauaugaugcugaa

SEQ ID NO: 1189361 - RNA, 19 nt, Homo sapiens
gaagauuacugcauaugug

SEQ ID NO: 1189362 - RNA, 19 nt, Homo sapiens
caacugugcuugucuuaug

SEQ ID NO: 1189363 - RNA, 19 nt, Homo sapiens
gaagacguguauaaauuug

SEQ ID NO: 1189364 - RNA, 19 nt, Homo sapiens
auacaugacuuccaaauug

SEQ ID NO: 1189365 - RNA, 19 nt, Homo sapiens
caagaccucuggccaaaug

SEQ ID NO: 1189366 - RNA, 19 nt, Homo sapiens
ugaagaagaucacaaacug

SEQ ID NO: 1189367 - RNA, 19 nt, Homo sapiens
gcgaugcuauccacaauga

SEQ ID NO: 1189368 - RNA, 19 nt, Homo sapiens
caacaugcagccacuauuu

SEQ ID NO: 1189369 - RNA, 19 nt, Homo sapiens
uagaagcguugaagucuuu

SEQ ID NO: 1189370 - RNA, 19 nt, Homo sapiens
cugaagacguguauaaauu

SEQ ID NO: 1189371 - RNA, 19 nt, Homo sapiens
ggaggaagauuaccuagac

SEQ ID NO: 1189372 - RNA, 19 nt, Homo sapiens
ucauugagcucaggaguuu

SEQ ID NO: 1189373 - RNA, 19 nt, Homo sapiens
gcagugagcuaugauugug

SEQ ID NO: 1189374 - RNA, 19 nt, Homo sapiens
gaacuuaauuucggauucu

SEQ ID NO: 1189375 - RNA, 19 nt, Homo sapiens
gauggauucuuguauugaa

SEQ ID NO: 1189376 - RNA, 19 nt, Homo sapiens
uggauacccucaucaaauu

SEQ ID NO: 1189377 - RNA, 19 nt, Homo sapiens
cagaagaaauacugaagau

SEQ ID NO: 1189378 - RNA, 19 nt, Homo sapiens
aggcgaagauuacugcaua

SEQ ID NO: 1189379 - RNA, 19 nt, Homo sapiens
acaaugacuugcaagauga

SEQ ID NO: 1189380 - RNA, 19 nt, Homo sapiens
cacaaugacuugcaagaug

SEQ ID NO: 1189381 - RNA, 19 nt, Homo sapiens
gugcuugucuuaugcagaa

SEQ ID NO: 1189382 - RNA, 19 nt, Homo sapiens
gaaauacugaagaugauug

SEQ ID NO: 1189383 - RNA, 19 nt, Homo sapiens
gaccaaaacuuacagagaa

SEQ ID NO: 1189384 - RNA, 19 nt, Homo sapiens
caaauugaccugacagugu

SEQ ID NO: 1189385 - RNA, 19 nt, Homo sapiens
ggaacuuaauuucggauuc

SEQ ID NO: 1189386 - RNA, 19 nt, Homo sapiens
gcauaugguuucuggauac

SEQ ID NO: 1189387 - RNA, 19 nt, Homo sapiens
aaauugaccugacaguguu

SEQ ID NO: 1189388 - RNA, 19 nt, Homo sapiens
ugaagaugauugaggagaa

SEQ ID NO: 1189389 - RNA, 19 nt, Homo sapiens
gagcccaucugaagcuuuc

SEQ ID NO: 1189390 - RNA, 19 nt, Homo sapiens
ggacuggagcccucaaaug

SEQ ID NO: 1189391 - RNA, 19 nt, Homo sapiens
ccauugcaccuuugucaua

SEQ ID NO: 1189392 - RNA, 19 nt, Homo sapiens
ggcaaugaaucuuugaauc

SEQ ID NO: 1189393 - RNA, 19 nt, Homo sapiens
auaaagcgauggccagguu

SEQ ID NO: 1189394 - RNA, 19 nt, Homo sapiens
gaaaucaagguugcaguga

SEQ ID NO: 1189395 - RNA, 19 nt, Homo sapiens
ugucuuaacuccugugcuu

SEQ ID NO: 1189396 - RNA, 19 nt, Homo sapiens
gcaaugaaucuuugaaucg

SEQ ID NO: 1189397 - RNA, 19 nt, Homo sapiens
agagugaacuggcgcuaga

SEQ ID NO: 1189398 - RNA, 19 nt, Homo sapiens
uacaugacuuccaaauuga

SEQ ID NO: 1189399 - RNA, 19 nt, Homo sapiens
caaauggaaguauaugaug

SEQ ID NO: 1189400 - RNA, 19 nt, Homo sapiens
ccaggcaacaugcgcuuua

SEQ ID NO: 1189401 - RNA, 19 nt, Homo sapiens
cgucacgucagaagaaaua

SEQ ID NO: 1189402 - RNA, 19 nt, Homo sapiens
cugcagagacuaucauuga

SEQ ID NO: 1189403 - RNA, 19 nt, Homo sapiens
ucuaugaaggcgaagauua

SEQ ID NO: 1189404 - RNA, 19 nt, Homo sapiens
gagcucauaggguaguuaa

SEQ ID NO: 1189405 - RNA, 19 nt, Homo sapiens
ugaagucuuugccaucaga

SEQ ID NO: 1189406 - RNA, 19 nt, Homo sapiens
gcucugaacaccaggagaa

SEQ ID NO: 1189407 - RNA, 19 nt, Homo sapiens
aguauaugaugcugaauug

SEQ ID NO: 1189408 - RNA, 19 nt, Homo sapiens
gaagccagcaucucaacug

SEQ ID NO: 1189409 - RNA, 19 nt, Homo sapiens
ccaaauggaaguauaugau

SEQ ID NO: 1189410 - RNA, 19 nt, Homo sapiens
gaagaugauugaggagaac

SEQ ID NO: 1189411 - RNA, 19 nt, Homo sapiens
ugaacagaguuggcaauga

SEQ ID NO: 1189412 - RNA, 19 nt, Homo sapiens
ucagauguaucaguugaga

SEQ ID NO: 1189413 - RNA, 19 nt, Homo sapiens
uguggcugcugcugucuua

SEQ ID NO: 1189414 - RNA, 19 nt, Homo sapiens
guugaagucuuugccauca

SEQ ID NO: 1189415 - RNA, 19 nt, Homo sapiens
ggcuaaagcugcagagacu

SEQ ID NO: 1189416 - RNA, 19 nt, Homo sapiens
gcaggcacuuugugggaau

SEQ ID NO: 1189417 - RNA, 19 nt, Homo sapiens
cagcgaugcuauccacaau

SEQ ID NO: 1189418 - RNA, 19 nt, Homo sapiens
gcuagagagucagaccaaa

SEQ ID NO: 1189419 - RNA, 19 nt, Homo sapiens
ccugaaaucccagcacuuu

SEQ ID NO: 1189420 - RNA, 19 nt, Homo sapiens
uggcugguccuauucauuu

SEQ ID NO: 1189421 - RNA, 19 nt, Homo sapiens
cugaagaucuccaaaagaa

SEQ ID NO: 1189422 - RNA, 19 nt, Homo sapiens
aacaagaccucuggccaaa

SEQ ID NO: 1189423 - RNA, 19 nt, Homo sapiens
uuaccuagacgcaugcuuu

SEQ ID NO: 1189424 - RNA, 19 nt, Homo sapiens
ggauacccucaucaaauuu

SEQ ID NO: 1189425 - RNA, 19 nt, Homo sapiens
gauccuggcagcugaaaca

SEQ ID NO: 1189426 - RNA, 19 nt, Homo sapiens
caaugaaucuuugaaucgu

SEQ ID NO: 1189427 - RNA, 19 nt, Homo sapiens
ccaggagaaugaacagagu

SEQ ID NO: 1189428 - RNA, 19 nt, Homo sapiens
uuucagauguaucaguuga

SEQ ID NO: 1189429 - RNA, 19 nt, Homo sapiens
gccagaagccagcaucuca

SEQ ID NO: 1189430 - RNA, 19 nt, Homo sapiens
gaggcaggacgauuacuug

SEQ ID NO: 1189431 - RNA, 19 nt, Homo sapiens
gaugauggagauagccaaa

SEQ ID NO: 1189432 - RNA, 19 nt, Homo sapiens
caucaaauuucgagcucau

SEQ ID NO: 1189433 - RNA, 19 nt, Homo sapiens
ccuggcagcugaaacagau

SEQ ID NO: 1189434 - RNA, 19 nt, Homo sapiens
auacuugccuugcacauac

SEQ ID NO: 1189435 - RNA, 19 nt, Homo sapiens
gaggagaacagccauugca

SEQ ID NO: 1189436 - RNA, 19 nt, Homo sapiens
gcaagaugacucccucuac

SEQ ID NO: 1189437 - RNA, 19 nt, Homo sapiens
aacaugcgcuuuaccuugu

SEQ ID NO: 1189438 - RNA, 19 nt, Homo sapiens
gcccucaaaugcaacacuu

SEQ ID NO: 1189439 - RNA, 19 nt, Homo sapiens
ggcugaggcaggacgauua

SEQ ID NO: 1189440 - RNA, 19 nt, Homo sapiens
gaccugacaguguuacaga

SEQ ID NO: 1189441 - RNA, 19 nt, Homo sapiens
gcaacaugcgcuuuaccuu

SEQ ID NO: 1189442 - RNA, 19 nt, Homo sapiens
cauacaugacuuccaaauu

SEQ ID NO: 1189443 - RNA, 19 nt, Homo sapiens
uuacuugcuugaccuacaa

SEQ ID NO: 1189444 - RNA, 19 nt, Homo sapiens
ugcauaugguuucuggaua

SEQ ID NO: 1189445 - RNA, 19 nt, Homo sapiens
cgcuuuaccuuguaugaga

SEQ ID NO: 1189446 - RNA, 19 nt, Homo sapiens
ccaugaggcugaagaucuc

SEQ ID NO: 1189447 - RNA, 19 nt, Homo sapiens
cgaagauuacugcauaugu

SEQ ID NO: 1189448 - RNA, 19 nt, Homo sapiens
gaguuggcaaugaaucuuu

SEQ ID NO: 1189449 - RNA, 19 nt, Homo sapiens
gcuuuaccuuguaugagaa

SEQ ID NO: 1189450 - RNA, 19 nt, Homo sapiens
ccucagaccgccuggcaaa

SEQ ID NO: 1189451 - RNA, 19 nt, Homo sapiens
cugaacaccaggagaauga

SEQ ID NO: 1189452 - RNA, 19 nt, Homo sapiens
gaggcaggaagaucauuga

SEQ ID NO: 1189453 - RNA, 19 nt, Homo sapiens
cauacuugccuugcacaua

SEQ ID NO: 1189454 - RNA, 19 nt, Homo sapiens
gaagaugggucaagaggaa

SEQ ID NO: 1189455 - RNA, 19 nt, Homo sapiens
gaaaucaacuggacagagu

SEQ ID NO: 1189456 - RNA, 19 nt, Homo sapiens
cauagugggugcuaaauaa

SEQ ID NO: 1189457 - RNA, 19 nt, Homo sapiens
gcacugggcaugguaauua

SEQ ID NO: 1189458 - RNA, 19 nt, Homo sapiens
gagagaagguauugaaaca

SEQ ID NO: 1189459 - RNA, 19 nt, Homo sapiens
guucauaccuggagagaga

SEQ ID NO: 1189460 - RNA, 19 nt, Homo sapiens
gagaagguauugaaacauc

SEQ ID NO: 1189461 - RNA, 19 nt, Homo sapiens
ggaauucgguccagaggau

SEQ ID NO: 1189462 - RNA, 19 nt, Homo sapiens
ucaguucccucaccuguaa

SEQ ID NO: 1189463 - RNA, 19 nt, Homo sapiens
aggaugaagucuaccauua

SEQ ID NO: 1189464 - RNA, 19 nt, Homo sapiens
ggagagagaagguauugaa

SEQ ID NO: 1189465 - RNA, 19 nt, Homo sapiens
ggaccucauucaccaacua

SEQ ID NO: 1189466 - RNA, 19 nt, Homo sapiens
ccaagugccugguacauag

SEQ ID NO: 1189467 - RNA, 19 nt, Homo sapiens
ggaagcuucugaugagaga

SEQ ID NO: 1189468 - RNA, 19 nt, Homo sapiens
gaaccuuucaucaggauaa

SEQ ID NO: 1189469 - RNA, 19 nt, Homo sapiens
ugucuccacucuugcauua

SEQ ID NO: 1189470 - RNA, 19 nt, Homo sapiens
gauggaugcucaccucuuc

SEQ ID NO: 1189471 - RNA, 19 nt, Homo sapiens
cuagauccauaguuaauga

SEQ ID NO: 1189472 - RNA, 19 nt, Homo sapiens
gaagcaugaucuccuuuua

SEQ ID NO: 1189473 - RNA, 19 nt, Homo sapiens
uaagaagcaugaucuccuu

SEQ ID NO: 1189474 - RNA, 19 nt, Homo sapiens
uaagggauauugugaggau

SEQ ID NO: 1189475 - RNA, 19 nt, Homo sapiens
guacauagugggugcuaaa

SEQ ID NO: 1189476 - RNA, 19 nt, Homo sapiens
gggcuugagucccaccuuu

SEQ ID NO: 1189477 - RNA, 19 nt, Homo sapiens
gaagggaacuauagaaaag

SEQ ID NO: 1189478 - RNA, 19 nt, Homo sapiens
gaaacagaaagcagagaaa

SEQ ID NO: 1189479 - RNA, 19 nt, Homo sapiens
gaagaagcgucaaaaggaa

SEQ ID NO: 1189480 - RNA, 19 nt, Homo sapiens
aagaggacauaguggauuu

SEQ ID NO: 1189481 - RNA, 19 nt, Homo sapiens
ggaaagcgaaagugugaga

SEQ ID NO: 1189482 - RNA, 19 nt, Homo sapiens
gaauauucaccaaggguuu

SEQ ID NO: 1189483 - RNA, 19 nt, Homo sapiens
gaagaggacauaguggauu

SEQ ID NO: 1189484 - RNA, 19 nt, Homo sapiens
gggcagggccaaguauaua

SEQ ID NO: 1189485 - RNA, 19 nt, Homo sapiens
gaggagcgcaugaaacaga

SEQ ID NO: 1189486 - RNA, 19 nt, Homo sapiens
gggacugucagcucauuua

SEQ ID NO: 1189487 - RNA, 19 nt, Homo sapiens
acugucagcucauuuaaau

SEQ ID NO: 1189488 - RNA, 19 nt, Homo sapiens
ggacugucagcucauuuaa

SEQ ID NO: 1189489 - RNA, 19 nt, Homo sapiens
gccauuuccuguccagauu

SEQ ID NO: 1189490 - RNA, 19 nt, Homo sapiens
caagaagggaacuauagaa

SEQ ID NO: 1189491 - RNA, 19 nt, Homo sapiens
cuuauucucuagauccaua

SEQ ID NO: 1189492 - RNA, 19 nt, Homo sapiens
caacaucuaagccucaguu

SEQ ID NO: 1189493 - RNA, 19 nt, Homo sapiens
gagagagaagguauugaaa

SEQ ID NO: 1189494 - RNA, 19 nt, Homo sapiens
ucaccaaggguuugcauuu

SEQ ID NO: 1189495 - RNA, 19 nt, Homo sapiens
uagcagagacagugagaaa

SEQ ID NO: 1189496 - RNA, 19 nt, Homo sapiens
gcucaagaagggaacuaua

SEQ ID NO: 1189497 - RNA, 19 nt, Homo sapiens
gggacaguguggugaagaa

SEQ ID NO: 1189498 - RNA, 19 nt, Homo sapiens
gcgaaagugugagaaaaua

SEQ ID NO: 1189499 - RNA, 19 nt, Homo sapiens
caccaaggguuugcauuug

SEQ ID NO: 1189500 - RNA, 19 nt, Homo sapiens
ggaagcgacaggagcguuu

SEQ ID NO: 1189501 - RNA, 19 nt, Homo sapiens
caucugggccuuucucuuc

SEQ ID NO: 1189502 - RNA, 19 nt, Homo sapiens
ggucgcugcugcacccaaa

SEQ ID NO: 1189503 - RNA, 19 nt, Homo sapiens
ugugugacuuucccaaauu

SEQ ID NO: 1189504 - RNA, 19 nt, Homo sapiens
guaugacucugaccucucu

SEQ ID NO: 1189505 - RNA, 19 nt, Homo sapiens
aaacauccuuugguucuca

SEQ ID NO: 1189506 - RNA, 19 nt, Homo sapiens
acugaaacauccuuugguu

SEQ ID NO: 1189507 - RNA, 19 nt, Homo sapiens
gacauaguguggugacagu

SEQ ID NO: 1189508 - RNA, 19 nt, Homo sapiens
gauauugugaggauggaaa

SEQ ID NO: 1189509 - RNA, 19 nt, Homo sapiens
gugugacuuucccaaauuu

SEQ ID NO: 1189510 - RNA, 19 nt, Homo sapiens
gcaaguccuuccuguaucc

SEQ ID NO: 1189511 - RNA, 19 nt, Homo sapiens
guauugaaacaucuccuuu

SEQ ID NO: 1189512 - RNA, 19 nt, Homo sapiens
ggccauacauguccacacu

SEQ ID NO: 1189513 - RNA, 19 nt, Homo sapiens
ucucacugcuagaauauuc

SEQ ID NO: 1189514 - RNA, 19 nt, Homo sapiens
gcagagagaagggacugaa

SEQ ID NO: 1189515 - RNA, 19 nt, Homo sapiens
aagaagggaacuauagaaa

SEQ ID NO: 1189516 - RNA, 19 nt, Homo sapiens
ccacauccacugaaacauc

SEQ ID NO: 1189517 - RNA, 19 nt, Homo sapiens
ccgcaaguccuuccuguau

SEQ ID NO: 1189518 - RNA, 19 nt, Homo sapiens
cugugggucuugcucaaua

SEQ ID NO: 1189519 - RNA, 19 nt, Homo sapiens
ucaagaagggaacuauaga

SEQ ID NO: 1189520 - RNA, 19 nt, Homo sapiens
ggaugaagucuaccauuac

SEQ ID NO: 1189521 - RNA, 19 nt, Homo sapiens
gaaacauccuuugguucuc

SEQ ID NO: 1189522 - RNA, 19 nt, Homo sapiens
ugaaacauccuuugguucu

SEQ ID NO: 1189523 - RNA, 19 nt, Homo sapiens
ggaucuaucuagcacuuuu

SEQ ID NO: 1189524 - RNA, 19 nt, Homo sapiens
ggccagcacuaccucagau

SEQ ID NO: 1189525 - RNA, 19 nt, Homo sapiens
caacugaauuccccacuuc

SEQ ID NO: 1189526 - RNA, 19 nt, Homo sapiens
gacuugggcuccagcaucu

SEQ ID NO: 1189527 - RNA, 19 nt, Homo sapiens
aaaagcgacucaagaagaa

SEQ ID NO: 1189528 - RNA, 19 nt, Homo sapiens
ugaaacagaaagcagagaa

SEQ ID NO: 1189529 - RNA, 19 nt, Homo sapiens
ggugcuaaauaaaccacuu

SEQ ID NO: 1189530 - RNA, 19 nt, Homo sapiens
gcagagacagugagaaagc

SEQ ID NO: 1189531 - RNA, 19 nt, Homo sapiens
uucucuagauccauaguua

SEQ ID NO: 1189532 - RNA, 19 nt, Homo sapiens
ggauggaaagcgaaagugu

SEQ ID NO: 1189533 - RNA, 19 nt, Homo sapiens
uggccugucuccacucuug

SEQ ID NO: 1189534 - RNA, 19 nt, Homo sapiens
gacagaagaggaagccaau

SEQ ID NO: 1189535 - RNA, 19 nt, Homo sapiens
acauagugggugcuaaaua

SEQ ID NO: 1189536 - RNA, 19 nt, Homo sapiens
ccagcugggucaccuugga

SEQ ID NO: 1189537 - RNA, 19 nt, Homo sapiens
gaugaagucuaccauuacc

SEQ ID NO: 1189538 - RNA, 19 nt, Homo sapiens
gaaaggagccccacaucca

SEQ ID NO: 1189539 - RNA, 19 nt, Homo sapiens
gaaagcgaaagugugagaa

SEQ ID NO: 1189540 - RNA, 19 nt, Homo sapiens
uaaaugugggucugcagaa

SEQ ID NO: 1189541 - RNA, 19 nt, Homo sapiens
ucaagggucaacugaauuc

SEQ ID NO: 1189542 - RNA, 19 nt, Homo sapiens
gcugguagggccauacaug

SEQ ID NO: 1189543 - RNA, 19 nt, Homo sapiens
ggacauaguggauuuucuu

SEQ ID NO: 1189544 - RNA, 19 nt, Homo sapiens
gcucaauacuguucauacc

SEQ ID NO: 1189545 - RNA, 19 nt, Homo sapiens
gggucuugcucaauacugu

SEQ ID NO: 1189546 - RNA, 19 nt, Homo sapiens
agaagcuccuggugacaga

SEQ ID NO: 1189547 - RNA, 19 nt, Homo sapiens
cauagggcagggccaagua

SEQ ID NO: 1189548 - RNA, 19 nt, Homo sapiens
aaagcgaaagugugagaaa

SEQ ID NO: 1189549 - RNA, 19 nt, Homo sapiens
cuacaaccuuggccacucu

SEQ ID NO: 1189550 - RNA, 19 nt, Homo sapiens
ggacucacuggaucuaucu

SEQ ID NO: 1189551 - RNA, 19 nt, Homo sapiens
gaggauggaaagcgaaagu

SEQ ID NO: 1189552 - RNA, 19 nt, Homo sapiens
gaugaagggaaaucaacug

SEQ ID NO: 1189553 - RNA, 19 nt, Homo sapiens
gugcucaccuccucucacu

SEQ ID NO: 1189554 - RNA, 19 nt, Homo sapiens
gggagcuacuuccaaauua

SEQ ID NO: 1189555 - RNA, 19 nt, Homo sapiens
ggagcuacuuccaaauuaa

SEQ ID NO: 1189556 - RNA, 19 nt, Homo sapiens
gcagagaccgugcuuauca

SEQ ID NO: 1189557 - RNA, 19 nt, Homo sapiens
caucaagccugucaaagug

SEQ ID NO: 1189558 - RNA, 19 nt, Homo sapiens
gacgggagcuacuuccaaa

SEQ ID NO: 1189559 - RNA, 19 nt, Homo sapiens
ugacggaccuggaugacuu

SEQ ID NO: 1189560 - RNA, 19 nt, Homo sapiens
ucccagcguuugucuaaua

SEQ ID NO: 1189561 - RNA, 19 nt, Homo sapiens
gauacugccaggaaauuaa

SEQ ID NO: 1189562 - RNA, 19 nt, Homo sapiens
ggagagccagcgagaguuu

SEQ ID NO: 1189563 - RNA, 19 nt, Homo sapiens
ccaggaaauuaaccucauu

SEQ ID NO: 1189564 - RNA, 19 nt, Homo sapiens
gcaucaagccugucaaagu

SEQ ID NO: 1189565 - RNA, 19 nt, Homo sapiens
ggaaauuaaccucauucuu

SEQ ID NO: 1189566 - RNA, 19 nt, Homo sapiens
gaucugcuaugccgagaag

SEQ ID NO: 1189567 - RNA, 19 nt, Homo sapiens
cagcugaauccuacagaua

SEQ ID NO: 1189568 - RNA, 19 nt, Homo sapiens
ucagguugcuggaggaaga

SEQ ID NO: 1189569 - RNA, 19 nt, Homo sapiens
cccgagagcucuuuggaau

SEQ ID NO: 1189570 - RNA, 19 nt, Homo sapiens
cuacagauacugccaggaa

SEQ ID NO: 1189571 - RNA, 19 nt, Homo sapiens
gugaugcccugcuaugaca

SEQ ID NO: 1189572 - RNA, 19 nt, Homo sapiens
acgaggagcugaagaaggu

SEQ ID NO: 1189573 - RNA, 19 nt, Homo sapiens
ggccaagauucgcauugaa

SEQ ID NO: 1189574 - RNA, 19 nt, Homo sapiens
ucuggaggcuucccuugaa

SEQ ID NO: 1189575 - RNA, 19 nt, Homo sapiens
gcagaggcugguuguaguu

SEQ ID NO: 1189576 - RNA, 19 nt, Homo sapiens
ccuugaagcucugugcaaa

SEQ ID NO: 1189577 - RNA, 19 nt, Homo sapiens
caagaucuaccacgucaca

SEQ ID NO: 1189578 - RNA, 19 nt, Homo sapiens
gguucuagaugcuaacaag

SEQ ID NO: 1189579 - RNA, 19 nt, Homo sapiens
gccaaggucucgcuaaacg

SEQ ID NO: 1189580 - RNA, 19 nt, Homo sapiens
gcguacggcuuccgcaaca

SEQ ID NO: 1189581 - RNA, 19 nt, Homo sapiens
ccgcagagaccgugcuuau

SEQ ID NO: 1189582 - RNA, 19 nt, Homo sapiens
ccucacaacaggagaaguu

SEQ ID NO: 1189583 - RNA, 19 nt, Homo sapiens
ucuagaugcuaacaagaug

SEQ ID NO: 1189584 - RNA, 19 nt, Homo sapiens
gaagaugacgggagcuacu

SEQ ID NO: 1189585 - RNA, 19 nt, Homo sapiens
uggccaagauucgcauuga

SEQ ID NO: 1189586 - RNA, 19 nt, Homo sapiens
cccagcguuugucuaauaa

SEQ ID NO: 1189587 - RNA, 19 nt, Homo sapiens
uucaggagcuguacacaca

SEQ ID NO: 1189588 - RNA, 19 nt, Homo sapiens
gagaguuugugcggcgauu

SEQ ID NO: 1189589 - RNA, 19 nt, Homo sapiens
gccaggaaauuaaccucau

SEQ ID NO: 1189590 - RNA, 19 nt, Homo sapiens
uacagauacugccaggaaa

SEQ ID NO: 1189591 - RNA, 19 nt, Homo sapiens
ccaagauucgcauugaaga

SEQ ID NO: 1189592 - RNA, 19 nt, Homo sapiens
cgaguaggagcuaggacua

SEQ ID NO: 1189593 - RNA, 19 nt, Homo sapiens
cgggagcuacuuccaaauu

SEQ ID NO: 1189594 - RNA, 19 nt, Homo sapiens
cgagagcucuuuggaaucc

SEQ ID NO: 1189595 - RNA, 19 nt, Homo sapiens
aggccaaggucucgcuaaa

SEQ ID NO: 1189596 - RNA, 19 nt, Homo sapiens
gugcaucaagccugucaaa

SEQ ID NO: 1189597 - RNA, 19 nt, Homo sapiens
gguuguaguuucggucuca

SEQ ID NO: 1189598 - RNA, 19 nt, Homo sapiens
caggagaaguuuucagguu

SEQ ID NO: 1189599 - RNA, 19 nt, Homo sapiens
agauucgcauugaagauga

SEQ ID NO: 1189600 - RNA, 19 nt, Homo sapiens
cacgggauguggacugugu

SEQ ID NO: 1189601 - RNA, 19 nt, Homo sapiens
ucucccagcguuugucuaa

SEQ ID NO: 1189602 - RNA, 19 nt, Homo sapiens
cagauacugccaggaaauu

SEQ ID NO: 1189603 - RNA, 19 nt, Homo sapiens
gcacguggagagacuguac

SEQ ID NO: 1189604 - RNA, 19 nt, Homo sapiens
gacacgggauguggacugu

SEQ ID NO: 1189605 - RNA, 19 nt, Homo sapiens
aaacgcaccccuccuaaaa

SEQ ID NO: 1189606 - RNA, 19 nt, Homo sapiens
caagauucgcauugaagau

SEQ ID NO: 1189607 - RNA, 19 nt, Homo sapiens
gcugaauccuacagauacu

SEQ ID NO: 1189608 - RNA, 19 nt, Homo sapiens
gccacgaggagcugaagaa

SEQ ID NO: 1189609 - RNA, 19 nt, Homo sapiens
agauacugccaggaaauua

SEQ ID NO: 1189610 - RNA, 19 nt, Homo sapiens
ucagcugaauccuacagau

SEQ ID NO: 1189611 - RNA, 19 nt, Homo sapiens
gcaagccaaguacgaagca

SEQ ID NO: 1189612 - RNA, 19 nt, Homo sapiens
gcaaaaggugggaaacaga

SEQ ID NO: 1189613 - RNA, 19 nt, Homo sapiens
gccaagauucgcauugaag

SEQ ID NO: 1189614 - RNA, 19 nt, Homo sapiens
caaccaggagcaccagaca

SEQ ID NO: 1189615 - RNA, 19 nt, Homo sapiens
ucaccacagucuagagcau

SEQ ID NO: 1189616 - RNA, 19 nt, Homo sapiens
gaagcucugugcaaaaggu

SEQ ID NO: 1189617 - RNA, 19 nt, Homo sapiens
gagcuacuuccaaauuaac

SEQ ID NO: 1189618 - RNA, 19 nt, Homo sapiens
gaugcccugcuaugacaaa

SEQ ID NO: 1189619 - RNA, 19 nt, Homo sapiens
gcuaugccgagaagacuca

SEQ ID NO: 1189620 - RNA, 19 nt, Homo sapiens
ugacgggagcuacuuccaa

SEQ ID NO: 1189621 - RNA, 19 nt, Homo sapiens
gaggcugguuguaguuucg

SEQ ID NO: 1189622 - RNA, 19 nt, Homo sapiens
gaagguguuucaagaauaa

SEQ ID NO: 1189623 - RNA, 19 nt, Homo sapiens
caauacagcuuaacaauag

SEQ ID NO: 1189624 - RNA, 19 nt, Homo sapiens
gaacucaauuugucagauu

SEQ ID NO: 1189625 - RNA, 19 nt, Homo sapiens
ggacuugaguggccaguaa

SEQ ID NO: 1189626 - RNA, 19 nt, Homo sapiens
ggacugucaugauucuuua

SEQ ID NO: 1189627 - RNA, 19 nt, Homo sapiens
ucaacuagaugaagucuuu

SEQ ID NO: 1189628 - RNA, 19 nt, Homo sapiens
gggauuagcuuuaggaaca

SEQ ID NO: 1189629 - RNA, 19 nt, Homo sapiens
auagauagcugcuguuaaa

SEQ ID NO: 1189630 - RNA, 19 nt, Homo sapiens
ccauguaucuccaguauug

SEQ ID NO: 1189631 - RNA, 19 nt, Homo sapiens
ggaaguagauggaggaacu

SEQ ID NO: 1189632 - RNA, 19 nt, Homo sapiens
uauagaagguguuucaaga

SEQ ID NO: 1189633 - RNA, 19 nt, Homo sapiens
ucacaucacugcagaaagu

SEQ ID NO: 1189634 - RNA, 19 nt, Homo sapiens
gauaagagagucagaagug

SEQ ID NO: 1189635 - RNA, 19 nt, Homo sapiens
gaaaauguguggaaaagug

SEQ ID NO: 1189636 - RNA, 19 nt, Homo sapiens
ccaauacagcuuaacaaua

SEQ ID NO: 1189637 - RNA, 19 nt, Homo sapiens
caaguaaguuaacggcauu

SEQ ID NO: 1189638 - RNA, 19 nt, Homo sapiens
ucagaaguguucgcuauaa

SEQ ID NO: 1189639 - RNA, 19 nt, Homo sapiens
guagauggaggaacuuuaa

SEQ ID NO: 1189640 - RNA, 19 nt, Homo sapiens
gagauccucuuccaauugu

SEQ ID NO: 1189641 - RNA, 19 nt, Homo sapiens
gaccaucacuguccuugga

SEQ ID NO: 1189642 - RNA, 19 nt, Homo sapiens
aaacuucuauugagucaug

SEQ ID NO: 1189643 - RNA, 19 nt, Homo sapiens
uuacuucaaugccauguuu

SEQ ID NO: 1189644 - RNA, 19 nt, Homo sapiens
gguacguucuguucgguua

SEQ ID NO: 1189645 - RNA, 19 nt, Homo sapiens
ccucaaaggugcccuagug

SEQ ID NO: 1189646 - RNA, 19 nt, Homo sapiens
gagaggugcucggcuugua

SEQ ID NO: 1189647 - RNA, 19 nt, Homo sapiens
gaugauuccuuuauagaag

SEQ ID NO: 1189648 - RNA, 19 nt, Homo sapiens
gaggaacuuuaaacaggua

SEQ ID NO: 1189649 - RNA, 19 nt, Homo sapiens
aaauuggacugucaugauu

SEQ ID NO: 1189650 - RNA, 19 nt, Homo sapiens
gaagagaaggcuaaagauc

SEQ ID NO: 1189651 - RNA, 19 nt, Homo sapiens
caucauagcccuugguguu

SEQ ID NO: 1189652 - RNA, 19 nt, Homo sapiens
agaagguguuucaagaaua

SEQ ID NO: 1189653 - RNA, 19 nt, Homo sapiens
cuaaagaucgaauucagua

SEQ ID NO: 1189654 - RNA, 19 nt, Homo sapiens
uaacagaugugugaugaag

SEQ ID NO: 1189655 - RNA, 19 nt, Homo sapiens
gcagaaaguguaacagaug

SEQ ID NO: 1189656 - RNA, 19 nt, Homo sapiens
cacaagagguuuacgauac

SEQ ID NO: 1189657 - RNA, 19 nt, Homo sapiens
cuugaaggcaugacaauua

SEQ ID NO: 1189658 - RNA, 19 nt, Homo sapiens
cagaaguguucgcuauaaa

SEQ ID NO: 1189659 - RNA, 19 nt, Homo sapiens
caauagaacaguugaaaca

SEQ ID NO: 1189660 - RNA, 19 nt, Homo sapiens
gcaugacaauuaaagaaca

SEQ ID NO: 1189661 - RNA, 19 nt, Homo sapiens
agagaaggcugucaccaau

SEQ ID NO: 1189662 - RNA, 19 nt, Homo sapiens
ccggaaauuucucaggaua

SEQ ID NO: 1189663 - RNA, 19 nt, Homo sapiens
gguguaaucugcguuaaca

SEQ ID NO: 1189664 - RNA, 19 nt, Homo sapiens
gaauuccugcccuucuuua

SEQ ID NO: 1189665 - RNA, 19 nt, Homo sapiens
uagaagguguuucaagaau

SEQ ID NO: 1189666 - RNA, 19 nt, Homo sapiens
cuauagaacucaauuuguc

SEQ ID NO: 1189667 - RNA, 19 nt, Homo sapiens
ccacaagagguuuacgaua

SEQ ID NO: 1189668 - RNA, 19 nt, Homo sapiens
ugaaggagauggacuugag

SEQ ID NO: 1189669 - RNA, 19 nt, Homo sapiens
gaccucaccugcagauaca

SEQ ID NO: 1189670 - RNA, 19 nt, Homo sapiens
aguguucgcuauaaaguaa

SEQ ID NO: 1189671 - RNA, 19 nt, Homo sapiens
gagaaggcugucaccaaua

SEQ ID NO: 1189672 - RNA, 19 nt, Homo sapiens
uugaaggcaugacaauuaa

SEQ ID NO: 1189673 - RNA, 19 nt, Homo sapiens
caauuugucagauucagua

SEQ ID NO: 1189674 - RNA, 19 nt, Homo sapiens
agucauggauugaagagaa

SEQ ID NO: 1189675 - RNA, 19 nt, Homo sapiens
uauccaugcugcuuucauu

SEQ ID NO: 1189676 - RNA, 19 nt, Homo sapiens
cuagugccaugauuuaaau

SEQ ID NO: 1189677 - RNA, 19 nt, Homo sapiens
gagacaaaauucuugauga

SEQ ID NO: 1189678 - RNA, 19 nt, Homo sapiens
ggaacacagugaagaucga

SEQ ID NO: 1189679 - RNA, 19 nt, Homo sapiens
uguaacagaugugugauga

SEQ ID NO: 1189680 - RNA, 19 nt, Homo sapiens
gcccuagugccaugauuua

SEQ ID NO: 1189681 - RNA, 19 nt, Homo sapiens
caaugagccuacucugguu

SEQ ID NO: 1189682 - RNA, 19 nt, Homo sapiens
cgaagagccucgaauacag

SEQ ID NO: 1189683 - RNA, 19 nt, Homo sapiens
gaugugugaugaagaugga

SEQ ID NO: 1189684 - RNA, 19 nt, Homo sapiens
cagaaaguguaacagaugu

SEQ ID NO: 1189685 - RNA, 19 nt, Homo sapiens
ggauugaagagaaggcuaa

SEQ ID NO: 1189686 - RNA, 19 nt, Homo sapiens
uaccauguaucuccaguau

SEQ ID NO: 1189687 - RNA, 19 nt, Homo sapiens
cauagcccuugguguuaua

SEQ ID NO: 1189688 - RNA, 19 nt, Homo sapiens
acacugagguuggguuuca

SEQ ID NO: 1189689 - RNA, 19 nt, Homo sapiens
uuacgauacugguuauaug

SEQ ID NO: 1189690 - RNA, 19 nt, Homo sapiens
gaaguguucgcuauaaagu

SEQ ID NO: 1189691 - RNA, 19 nt, Homo sapiens
acagaugugugaugaagau

SEQ ID NO: 1189692 - RNA, 19 nt, Homo sapiens
uaaauuggacugucaugau

SEQ ID NO: 1189693 - RNA, 19 nt, Homo sapiens
gaaggcaugacaauuaaag

SEQ ID NO: 1189694 - RNA, 19 nt, Homo sapiens
ucuauugagucauggauug

SEQ ID NO: 1189695 - RNA, 19 nt, Homo sapiens
ucuguucgguuaucaaguu

SEQ ID NO: 1189696 - RNA, 19 nt, Homo sapiens
aaauagauagcugcuguua

SEQ ID NO: 1189697 - RNA, 19 nt, Homo sapiens
agucagaaguguucgcuau

SEQ ID NO: 1189698 - RNA, 19 nt, Homo sapiens
gcagauaagagagucagaa

SEQ ID NO: 1189699 - RNA, 19 nt, Homo sapiens
agagaaggcuaaagaucga

SEQ ID NO: 1189700 - RNA, 19 nt, Homo sapiens
acacuggauucuccuaguu

SEQ ID NO: 1189701 - RNA, 19 nt, Homo sapiens
cugguuauauggagacaaa

SEQ ID NO: 1189702 - RNA, 19 nt, Homo sapiens
caccgaagagccucgaaua

SEQ ID NO: 1189703 - RNA, 19 nt, Homo sapiens
gcuuaacaauagaacaguu

SEQ ID NO: 1189704 - RNA, 19 nt, Homo sapiens
gcaugugguacuucucuuu

SEQ ID NO: 1189705 - RNA, 19 nt, Homo sapiens
cuagaugaagucuuuguuu

SEQ ID NO: 1189706 - RNA, 19 nt, Homo sapiens
gaaaguguaacagaugugu

SEQ ID NO: 1189707 - RNA, 19 nt, Homo sapiens
ccucaguugauauuucuua

SEQ ID NO: 1189708 - RNA, 19 nt, Homo sapiens
gggcugagguguccaugac

SEQ ID NO: 1189709 - RNA, 19 nt, Homo sapiens
agaaggcugucaccaauac

SEQ ID NO: 1189710 - RNA, 19 nt, Homo sapiens
gauaugggaaguagaugga

SEQ ID NO: 1189711 - RNA, 19 nt, Homo sapiens
gcaccacguucacaucacu

SEQ ID NO: 1189712 - RNA, 19 nt, Homo sapiens
cugcauaugccuuugaauu

SEQ ID NO: 1189713 - RNA, 19 nt, Homo sapiens
gauggaggaacuuuaaaca

SEQ ID NO: 1189714 - RNA, 19 nt, Homo sapiens
cgaauucaguauuaucaac

SEQ ID NO: 1189715 - RNA, 19 nt, Homo sapiens
uggauuagcugcauuugcu

SEQ ID NO: 1189716 - RNA, 19 nt, Homo sapiens
uauuggcccuuacauacaa

SEQ ID NO: 1189717 - RNA, 19 nt, Homo sapiens
guugugguauuggcccuua

SEQ ID NO: 1189718 - RNA, 19 nt, Homo sapiens
ggaccucaccugcagauac

SEQ ID NO: 1189719 - RNA, 19 nt, Homo sapiens
cuacucugguuaagauguu

SEQ ID NO: 1189720 - RNA, 19 nt, Homo sapiens
uaagagagucagaaguguu

SEQ ID NO: 1189721 - RNA, 19 nt, Homo sapiens
uaucaucggcucuccuuug

SEQ ID NO: 1189722 - RNA, 19 nt, Homo sapiens
gaaagcaccucuaauguug

SEQ ID NO: 1189723 - RNA, 19 nt, Homo sapiens
gaacgugacugguacauug

SEQ ID NO: 1189724 - RNA, 19 nt, Homo sapiens
ggucauauauugagaguuu

SEQ ID NO: 1189725 - RNA, 19 nt, Homo sapiens
gagaugagcucguuauuuc

SEQ ID NO: 1189726 - RNA, 19 nt, Homo sapiens
gauaauggauccuguugaa

SEQ ID NO: 1189727 - RNA, 19 nt, Homo sapiens
gaauugccauacaaaguua

SEQ ID NO: 1189728 - RNA, 19 nt, Homo sapiens
uaaggcaguuggaauguua

SEQ ID NO: 1189729 - RNA, 19 nt, Homo sapiens
cagaagacauagacaguuu

SEQ ID NO: 1189730 - RNA, 19 nt, Homo sapiens
ggaaagcaccucuaauguu

SEQ ID NO: 1189731 - RNA, 19 nt, Homo sapiens
caaagcaguucuauuagga

SEQ ID NO: 1189732 - RNA, 19 nt, Homo sapiens
gcuuagccuucaagaauua

SEQ ID NO: 1189733 - RNA, 19 nt, Homo sapiens
gagaaggccucaaauguac

SEQ ID NO: 1189734 - RNA, 19 nt, Homo sapiens
guacuuguguggauacuug

SEQ ID NO: 1189735 - RNA, 19 nt, Homo sapiens
gauauccgauuuauucuuc

SEQ ID NO: 1189736 - RNA, 19 nt, Homo sapiens
uauacaagcucauccacua

SEQ ID NO: 1189737 - RNA, 19 nt, Homo sapiens
gaugaagaacguuauagua

SEQ ID NO: 1189738 - RNA, 19 nt, Homo sapiens
caaauguacuggaagaaau

SEQ ID NO: 1189739 - RNA, 19 nt, Homo sapiens
gaagagaaggccucaaaug

SEQ ID NO: 1189740 - RNA, 19 nt, Homo sapiens
gaaagagaauguucacaac

SEQ ID NO: 1189741 - RNA, 19 nt, Homo sapiens
cacaaacgaugaugaagaa

SEQ ID NO: 1189742 - RNA, 19 nt, Homo sapiens
caagaggacaugccauaua

SEQ ID NO: 1189743 - RNA, 19 nt, Homo sapiens
gaagacugguaccaauuug

SEQ ID NO: 1189744 - RNA, 19 nt, Homo sapiens
gaagacauagacaguuuaa

SEQ ID NO: 1189745 - RNA, 19 nt, Homo sapiens
uaaaguacuuguguggaua

SEQ ID NO: 1189746 - RNA, 19 nt, Homo sapiens
gguauacucugaaacuaau

SEQ ID NO: 1189747 - RNA, 19 nt, Homo sapiens
gauccaagugggaaaguua

SEQ ID NO: 1189748 - RNA, 19 nt, Homo sapiens
ugacuggucugaugauaau

SEQ ID NO: 1189749 - RNA, 19 nt, Homo sapiens
gcuaagcuccguaaaguug

SEQ ID NO: 1189750 - RNA, 19 nt, Homo sapiens
ggagaugagcucguuauuu

SEQ ID NO: 1189751 - RNA, 19 nt, Homo sapiens
caaaaggccuggcaugaaa

SEQ ID NO: 1189752 - RNA, 19 nt, Homo sapiens
cauacaaaguuaacagcua

SEQ ID NO: 1189753 - RNA, 19 nt, Homo sapiens
aagaggacaugccauauau

SEQ ID NO: 1189754 - RNA, 19 nt, Homo sapiens
agagaaggccucaaaugua

SEQ ID NO: 1189755 - RNA, 19 nt, Homo sapiens
ccagaacuguuucaacuag

SEQ ID NO: 1189756 - RNA, 19 nt, Homo sapiens
gaguucaguuguucacauu

SEQ ID NO: 1189757 - RNA, 19 nt, Homo sapiens
gucaucaaaugcaauguuu

SEQ ID NO: 1189758 - RNA, 19 nt, Homo sapiens
ggagagugcuuagccuuca

SEQ ID NO: 1189759 - RNA, 19 nt, Homo sapiens
ugaaggagaugagcucguu

SEQ ID NO: 1189760 - RNA, 19 nt, Homo sapiens
uggaagaaauugccaagga

SEQ ID NO: 1189761 - RNA, 19 nt, Homo sapiens
gugcuuagccuucaagaau

SEQ ID NO: 1189762 - RNA, 19 nt, Homo sapiens
cagaagagaaggccucaaa

SEQ ID NO: 1189763 - RNA, 19 nt, Homo sapiens
guaaugucaucaaaugcaa

SEQ ID NO: 1189764 - RNA, 19 nt, Homo sapiens
guacauugguuugguaucu

SEQ ID NO: 1189765 - RNA, 19 nt, Homo sapiens
ggacaaaguuuuaaaagac

SEQ ID NO: 1189766 - RNA, 19 nt, Homo sapiens
gaggacaugccauauauuc

SEQ ID NO: 1189767 - RNA, 19 nt, Homo sapiens
ccacaaacgaugaugaaga

SEQ ID NO: 1189768 - RNA, 19 nt, Homo sapiens
aaguuuagguccaauagaa

SEQ ID NO: 1189769 - RNA, 19 nt, Homo sapiens
ccucaaauguacuggaaga

SEQ ID NO: 1189770 - RNA, 19 nt, Homo sapiens
aagcaguucuauuaggaua

SEQ ID NO: 1189771 - RNA, 19 nt, Homo sapiens
gaugaugaagaacguuaua

SEQ ID NO: 1189772 - RNA, 19 nt, Homo sapiens
ggaguucaguuguucacau

SEQ ID NO: 1189773 - RNA, 19 nt, Homo sapiens
guuaaauccugaagcuguu

SEQ ID NO: 1189774 - RNA, 19 nt, Homo sapiens
ggaagcaauuuuacaagaa

SEQ ID NO: 1189775 - RNA, 19 nt, Homo sapiens
gauuaaguaccuugaagaa

SEQ ID NO: 1189776 - RNA, 19 nt, Homo sapiens
gacuuuagagaacugauua

SEQ ID NO: 1189777 - RNA, 19 nt, Homo sapiens
uguggauacuuguucaaua

SEQ ID NO: 1189778 - RNA, 19 nt, Homo sapiens
guugaagguuaacauaaug

SEQ ID NO: 1189779 - RNA, 19 nt, Homo sapiens
ugaauugccauacaaaguu

SEQ ID NO: 1189780 - RNA, 19 nt, Homo sapiens
uuaguaggcuuugguaaau

SEQ ID NO: 1189781 - RNA, 19 nt, Homo sapiens
guaccaauuuguucuaagg

SEQ ID NO: 1189782 - RNA, 19 nt, Homo sapiens
caauagaagacuuuagaga

SEQ ID NO: 1189783 - RNA, 19 nt, Homo sapiens
cauaucaguguucuaagua

SEQ ID NO: 1189784 - RNA, 19 nt, Homo sapiens
guaacugugauucuuguaa

SEQ ID NO: 1189785 - RNA, 19 nt, Homo sapiens
ugggauauccgauuuauuc

SEQ ID NO: 1189786 - RNA, 19 nt, Homo sapiens
guggauacuuguucaauac

SEQ ID NO: 1189787 - RNA, 19 nt, Homo sapiens
uuuaaugacuggucugaug

SEQ ID NO: 1189788 - RNA, 19 nt, Homo sapiens
gggaaagcaccucuaaugu

SEQ ID NO: 1189789 - RNA, 19 nt, Homo sapiens
ucucuuagccaucuuaaug

SEQ ID NO: 1189790 - RNA, 19 nt, Homo sapiens
uuaaaguacuuguguggau

SEQ ID NO: 1189791 - RNA, 19 nt, Homo sapiens
aauaugaacgugacuggua

SEQ ID NO: 1189792 - RNA, 19 nt, Homo sapiens
ggccucaaauguacuggaa

SEQ ID NO: 1189793 - RNA, 19 nt, Homo sapiens
aaagggaaagcaccucuaa

SEQ ID NO: 1189794 - RNA, 19 nt, Homo sapiens
aaaguuaaauccugaagcu

SEQ ID NO: 1189795 - RNA, 19 nt, Homo sapiens
gaaggagaugagcucguua

SEQ ID NO: 1189796 - RNA, 19 nt, Homo sapiens
uggauccuguugaagguua

SEQ ID NO: 1189797 - RNA, 19 nt, Homo sapiens
caaaguuaacagcuaugua

SEQ ID NO: 1189798 - RNA, 19 nt, Homo sapiens
acuguaaugucaucaaaug

SEQ ID NO: 1189799 - RNA, 19 nt, Homo sapiens
gagcucauuuugacuguaa

SEQ ID NO: 1189800 - RNA, 19 nt, Homo sapiens
gaaggaagcaauuuuacaa

SEQ ID NO: 1189801 - RNA, 19 nt, Homo sapiens
uaggauacccugcuguuga

SEQ ID NO: 1189802 - RNA, 19 nt, Homo sapiens
ggucagugggccaaucuuu

SEQ ID NO: 1189803 - RNA, 19 nt, Homo sapiens
ggccuggcaugaaagagaa

SEQ ID NO: 1189804 - RNA, 19 nt, Homo sapiens
agaagacugguaccaauuu

SEQ ID NO: 1189805 - RNA, 19 nt, Homo sapiens
ccucuaauguugccugcuu

SEQ ID NO: 1189806 - RNA, 19 nt, Homo sapiens
cguaaaguugguucucuua

SEQ ID NO: 1189807 - RNA, 19 nt, Homo sapiens
ucaaauguacuggaagaaa

SEQ ID NO: 1189808 - RNA, 19 nt, Homo sapiens
acaaagcaguucuauuagg

SEQ ID NO: 1189809 - RNA, 19 nt, Homo sapiens
uaacugugauucuuguaac

SEQ ID NO: 1189810 - RNA, 19 nt, Homo sapiens
ucaugggaauuacuuuaug

SEQ ID NO: 1189811 - RNA, 19 nt, Homo sapiens
cagguauacucugaaacua

SEQ ID NO: 1189812 - RNA, 19 nt, Homo sapiens
aagagaaggccucaaaugu

SEQ ID NO: 1189813 - RNA, 19 nt, Homo sapiens
acauaucaguguucuaagu

SEQ ID NO: 1189814 - RNA, 19 nt, Homo sapiens
uaggugaauugccauacaa

SEQ ID NO: 1189815 - RNA, 19 nt, Homo sapiens
gcauaauugauucucauga

SEQ ID NO: 1189816 - RNA, 19 nt, Homo sapiens
gcaaguuuagguccaauag

SEQ ID NO: 1189817 - RNA, 19 nt, Homo sapiens
ggauacuuguucaauacug

SEQ ID NO: 1189818 - RNA, 19 nt, Homo sapiens
caaaaccucuccacauaca

SEQ ID NO: 1189819 - RNA, 19 nt, Homo sapiens
aaacgaugaugaagaacgu

SEQ ID NO: 1189820 - RNA, 19 nt, Homo sapiens
ugccaggaauguucuauca

SEQ ID NO: 1189821 - RNA, 19 nt, Homo sapiens
ggguaugauucuaauaugg

SEQ ID NO: 1189822 - RNA, 19 nt, Homo sapiens
gaaagaagauguaugcuau

SEQ ID NO: 1189823 - RNA, 19 nt, Homo sapiens
ggauauuccuuuacacaua

SEQ ID NO: 1189824 - RNA, 19 nt, Homo sapiens
gauaguggauauuccuuua

SEQ ID NO: 1189825 - RNA, 19 nt, Homo sapiens
gaauuaugcuguaucauug

SEQ ID NO: 1189826 - RNA, 19 nt, Homo sapiens
gaagauguaugcuaugugu

SEQ ID NO: 1189827 - RNA, 19 nt, Homo sapiens
gcugaaagcacaaauuuaa

SEQ ID NO: 1189828 - RNA, 19 nt, Homo sapiens
gagauaauccuuccgaauu

SEQ ID NO: 1189829 - RNA, 19 nt, Homo sapiens
gggaacaaauucuucguuu

SEQ ID NO: 1189830 - RNA, 19 nt, Homo sapiens
gaauugggauguucagaga

SEQ ID NO: 1189831 - RNA, 19 nt, Homo sapiens
agacugaucuuauaugugu

SEQ ID NO: 1189832 - RNA, 19 nt, Homo sapiens
ggacauagcgucugugaag

SEQ ID NO: 1189833 - RNA, 19 nt, Homo sapiens
gaaguucgaugucuuacuc

SEQ ID NO: 1189834 - RNA, 19 nt, Homo sapiens
gauauaggcauucaagaaa

SEQ ID NO: 1189835 - RNA, 19 nt, Homo sapiens
caagcaguauuaagaguaa

SEQ ID NO: 1189836 - RNA, 19 nt, Homo sapiens
gaaccauacuuuaacuuca

SEQ ID NO: 1189837 - RNA, 19 nt, Homo sapiens
aagagaagauuacgaagaa

SEQ ID NO: 1189838 - RNA, 19 nt, Homo sapiens
cagaagcuauugucuauuc

SEQ ID NO: 1189839 - RNA, 19 nt, Homo sapiens
gagcuagacuaccauaaca

SEQ ID NO: 1189840 - RNA, 19 nt, Homo sapiens
ucacugaaccauacuuuaa

SEQ ID NO: 1189841 - RNA, 19 nt, Homo sapiens
gacugugacuaaacuauuu

SEQ ID NO: 1189842 - RNA, 19 nt, Homo sapiens
gagaugguguugaguggaa

SEQ ID NO: 1189843 - RNA, 19 nt, Homo sapiens
cgaauuaugcuguaucauu

SEQ ID NO: 1189844 - RNA, 19 nt, Homo sapiens
gaugaaacacaugugauua

SEQ ID NO: 1189845 - RNA, 19 nt, Homo sapiens
ggauaaaugugggaggaaa

SEQ ID NO: 1189846 - RNA, 19 nt, Homo sapiens
gaaugaaaguugugaccau

SEQ ID NO: 1189847 - RNA, 19 nt, Homo sapiens
gggaagagaugguguugag

SEQ ID NO: 1189848 - RNA, 19 nt, Homo sapiens
aaaucuaccugaagaaaug

SEQ ID NO: 1189849 - RNA, 19 nt, Homo sapiens
ggaaaacucuuaaccaauc

SEQ ID NO: 1189850 - RNA, 19 nt, Homo sapiens
agagacaaguuugggauua

SEQ ID NO: 1189851 - RNA, 19 nt, Homo sapiens
gguggagacuaagcuaaua

SEQ ID NO: 1189852 - RNA, 19 nt, Homo sapiens
ggaugaaacacaugugauu

SEQ ID NO: 1189853 - RNA, 19 nt, Homo sapiens
gcagcuacauguuauggau

SEQ ID NO: 1189854 - RNA, 19 nt, Homo sapiens
uucaaaggcuucuuaggua

SEQ ID NO: 1189855 - RNA, 19 nt, Homo sapiens
gaaaaugugucgguuauuc

SEQ ID NO: 1189856 - RNA, 19 nt, Homo sapiens
gaagauauggugguaacaa

SEQ ID NO: 1189857 - RNA, 19 nt, Homo sapiens
caagagaagauuacgaaga

SEQ ID NO: 1189858 - RNA, 19 nt, Homo sapiens
gaaaugggaauuccagaag

SEQ ID NO: 1189859 - RNA, 19 nt, Homo sapiens
ugaaagaagauguaugcua

SEQ ID NO: 1189860 - RNA, 19 nt, Homo sapiens
gaggaaaacucuuaaccaa

SEQ ID NO: 1189861 - RNA, 19 nt, Homo sapiens
ucagaaguucgaugucuua

SEQ ID NO: 1189862 - RNA, 19 nt, Homo sapiens
uagcugaaagcacaaauuu

SEQ ID NO: 1189863 - RNA, 19 nt, Homo sapiens
gaccauaagguuuaauuuc

SEQ ID NO: 1189864 - RNA, 19 nt, Homo sapiens
guugugaccauaagguuua

SEQ ID NO: 1189865 - RNA, 19 nt, Homo sapiens
gggaucggguuuacucaga

SEQ ID NO: 1189866 - RNA, 19 nt, Homo sapiens
uccagaagcuauugucuau

SEQ ID NO: 1189867 - RNA, 19 nt, Homo sapiens
acauggauauugcaaaguu

SEQ ID NO: 1189868 - RNA, 19 nt, Homo sapiens
uaaccaaucaucuaaagga

SEQ ID NO: 1189869 - RNA, 19 nt, Homo sapiens
aaugaaaguugugaccaua

SEQ ID NO: 1189870 - RNA, 19 nt, Homo sapiens
uagcgucugugaagagaaa

SEQ ID NO: 1189871 - RNA, 19 nt, Homo sapiens
caaccagauagaugaaaua

SEQ ID NO: 1189872 - RNA, 19 nt, Homo sapiens
cgaccuuagugcuggauaa

SEQ ID NO: 1189873 - RNA, 19 nt, Homo sapiens
cauagguauuuccgagaua

SEQ ID NO: 1189874 - RNA, 19 nt, Homo sapiens
gagacuaagcuaauaaagu

SEQ ID NO: 1189875 - RNA, 19 nt, Homo sapiens
ccaaccagauagaugaaau

SEQ ID NO: 1189876 - RNA, 19 nt, Homo sapiens
agacauggauauugcaaag

SEQ ID NO: 1189877 - RNA, 19 nt, Homo sapiens
cacauauaguuccuuauug

SEQ ID NO: 1189878 - RNA, 19 nt, Homo sapiens
uuaaaaggguggagacuaa

SEQ ID NO: 1189879 - RNA, 19 nt, Homo sapiens
ugauauaggcauucaagaa

SEQ ID NO: 1189880 - RNA, 19 nt, Homo sapiens
gaagaauaccaguuucaag

SEQ ID NO: 1189881 - RNA, 19 nt, Homo sapiens
uaaaagagguuaaggaacu

SEQ ID NO: 1189882 - RNA, 19 nt, Homo sapiens
ggaucggguuuacucagaa

SEQ ID NO: 1189883 - RNA, 19 nt, Homo sapiens
aaugagagauuugcuguuc

SEQ ID NO: 1189884 - RNA, 19 nt, Homo sapiens
acaggcagcuacauguuau

SEQ ID NO: 1189885 - RNA, 19 nt, Homo sapiens
agaagcaauuauucggaua

SEQ ID NO: 1189886 - RNA, 19 nt, Homo sapiens
ccaguuucaagcaguauua

SEQ ID NO: 1189887 - RNA, 19 nt, Homo sapiens
gauguucagagacaaguuu

SEQ ID NO: 1189888 - RNA, 19 nt, Homo sapiens
cagcacgucuuaaaacuuu

SEQ ID NO: 1189889 - RNA, 19 nt, Homo sapiens
guggugagaugacgaccuu

SEQ ID NO: 1189890 - RNA, 19 nt, Homo sapiens
auacuuugaucgauugcua

SEQ ID NO: 1189891 - RNA, 19 nt, Homo sapiens
ggauuuagggaucggguuu

SEQ ID NO: 1189892 - RNA, 19 nt, Homo sapiens
gaaacacaugugauuaauc

SEQ ID NO: 1189893 - RNA, 19 nt, Homo sapiens
ucaagcaguauuaagagua

SEQ ID NO: 1189894 - RNA, 19 nt, Homo sapiens
ggaacuguguuaccuuuug

SEQ ID NO: 1189895 - RNA, 19 nt, Homo sapiens
ugaaaguugugaccauaag

SEQ ID NO: 1189896 - RNA, 19 nt, Homo sapiens
cugaaaacccuauuacuua

SEQ ID NO: 1189897 - RNA, 19 nt, Homo sapiens
gaaaggagaagaaaauaca

SEQ ID NO: 1189898 - RNA, 19 nt, Homo sapiens
ucaagugaaagaagaugua

SEQ ID NO: 1189899 - RNA, 19 nt, Homo sapiens
aagaagauguaugcuaugu

SEQ ID NO: 1189900 - RNA, 19 nt, Homo sapiens
uauuaucacugaaccauac

SEQ ID NO: 1189901 - RNA, 19 nt, Homo sapiens
gagacaaguuugggauuac

SEQ ID NO: 1189902 - RNA, 19 nt, Homo sapiens
guaacucaguccacauuuu

SEQ ID NO: 1189903 - RNA, 19 nt, Homo sapiens
cuucuuagguagguuacua

SEQ ID NO: 1189904 - RNA, 19 nt, Homo sapiens
gacauagcgucugugaaga

SEQ ID NO: 1189905 - RNA, 19 nt, Homo sapiens
gcuaugugucucaggauuu

SEQ ID NO: 1189906 - RNA, 19 nt, Homo sapiens
ugucgguuauuccuaauug

SEQ ID NO: 1189907 - RNA, 19 nt, Homo sapiens
gaagcuauugucuauucaa

SEQ ID NO: 1189908 - RNA, 19 nt, Homo sapiens
ggaaauacucuuuaauccu

SEQ ID NO: 1189909 - RNA, 19 nt, Homo sapiens
uacaggcagcuacauguua

SEQ ID NO: 1189910 - RNA, 19 nt, Homo sapiens
guuccuuauuguagaagua

SEQ ID NO: 1189911 - RNA, 19 nt, Homo sapiens
gcuagacuaccauaacaau

SEQ ID NO: 1189912 - RNA, 19 nt, Homo sapiens
ggaauuccagaagcuauug

SEQ ID NO: 1189913 - RNA, 19 nt, Homo sapiens
ugacugugacuaaacuauu

SEQ ID NO: 1189914 - RNA, 19 nt, Homo sapiens
ggagcuagacuaccauaac

SEQ ID NO: 1189915 - RNA, 19 nt, Homo sapiens
ucagugcacauagguauuu

SEQ ID NO: 1189916 - RNA, 19 nt, Homo sapiens
agacccuucuggacucuuu

SEQ ID NO: 1189917 - RNA, 19 nt, Homo sapiens
cauagcgucugugaagaga

SEQ ID NO: 1189918 - RNA, 19 nt, Homo sapiens
gggaauuccagaagcuauu

SEQ ID NO: 1189919 - RNA, 19 nt, Homo sapiens
ccggaaauacucuuuaauc

SEQ ID NO: 1189920 - RNA, 19 nt, Homo sapiens
auagguauuuccgagauaa

SEQ ID NO: 1189921 - RNA, 19 nt, Homo sapiens
aaauggacauagcgucugu

SEQ ID NO: 1189922 - RNA, 19 nt, Homo sapiens
guacaaagccgcucugaaa

SEQ ID NO: 1189923 - RNA, 19 nt, Homo sapiens
caacauaccucagauucaa

SEQ ID NO: 1189924 - RNA, 19 nt, Homo sapiens
gugcagaucaugauguuua

SEQ ID NO: 1189925 - RNA, 19 nt, Homo sapiens
gcaauaaggagaucaugga

SEQ ID NO: 1189926 - RNA, 19 nt, Homo sapiens
gaucauggagcacaucaga

SEQ ID NO: 1189927 - RNA, 19 nt, Homo sapiens
gugcaucugugaaguggaa

SEQ ID NO: 1189928 - RNA, 19 nt, Homo sapiens
ggaaauccuuuugcauuaa

SEQ ID NO: 1189929 - RNA, 19 nt, Homo sapiens
gggaagaggaggaggagaa

SEQ ID NO: 1189930 - RNA, 19 nt, Homo sapiens
uaccucagauucaauacaa

SEQ ID NO: 1189931 - RNA, 19 nt, Homo sapiens
cugcucugcuggucaauaa

SEQ ID NO: 1189932 - RNA, 19 nt, Homo sapiens
ggugcuagcuaguccuuuc

SEQ ID NO: 1189933 - RNA, 19 nt, Homo sapiens
ggagauuggaaugggauua

SEQ ID NO: 1189934 - RNA, 19 nt, Homo sapiens
ggaagaggaggaggagaaa

SEQ ID NO: 1189935 - RNA, 19 nt, Homo sapiens
ucauggagcacaucagaaa

SEQ ID NO: 1189936 - RNA, 19 nt, Homo sapiens
gggugcagaucaugauguu

SEQ ID NO: 1189937 - RNA, 19 nt, Homo sapiens
auaaaacgcuuccuaauag

SEQ ID NO: 1189938 - RNA, 19 nt, Homo sapiens
guggagaccaagagcaaua

SEQ ID NO: 1189939 - RNA, 19 nt, Homo sapiens
uggaaauccuuuugcauua

SEQ ID NO: 1189940 - RNA, 19 nt, Homo sapiens
gugaaggucaugacaguga

SEQ ID NO: 1189941 - RNA, 19 nt, Homo sapiens
ucaugacagugaauuacaa

SEQ ID NO: 1189942 - RNA, 19 nt, Homo sapiens
ggagaagccgcgugagauc

SEQ ID NO: 1189943 - RNA, 19 nt, Homo sapiens
cugagcugcuaaaugaaua

SEQ ID NO: 1189944 - RNA, 19 nt, Homo sapiens
caagagcaauaaggagauc

SEQ ID NO: 1189945 - RNA, 19 nt, Homo sapiens
cagaucaugauguuuaaga

SEQ ID NO: 1189946 - RNA, 19 nt, Homo sapiens
ugaaggucaugacagugaa

SEQ ID NO: 1189947 - RNA, 19 nt, Homo sapiens
gcugagcugcuaaaugaau

SEQ ID NO: 1189948 - RNA, 19 nt, Homo sapiens
ggagugcaucugugaagug

SEQ ID NO: 1189949 - RNA, 19 nt, Homo sapiens
acauaccucagauucaaua

SEQ ID NO: 1189950 - RNA, 19 nt, Homo sapiens
ugcagaucaugauguuuaa

SEQ ID NO: 1189951 - RNA, 19 nt, Homo sapiens
gggagaagccgcgugagau

SEQ ID NO: 1189952 - RNA, 19 nt, Homo sapiens
agaccaagagcaauaagga

SEQ ID NO: 1189953 - RNA, 19 nt, Homo sapiens
gagaggagggucugaagcu

SEQ ID NO: 1189954 - RNA, 19 nt, Homo sapiens
ucaauaaaacgcuuccuaa

SEQ ID NO: 1189955 - RNA, 19 nt, Homo sapiens
ccgugaaggucaugacagu

SEQ ID NO: 1189956 - RNA, 19 nt, Homo sapiens
gggagugcaucugugaagu

SEQ ID NO: 1189957 - RNA, 19 nt, Homo sapiens
gaucaugauguuuaagaac

SEQ ID NO: 1189958 - RNA, 19 nt, Homo sapiens
gccgcacccugcaauaucu

SEQ ID NO: 1189959 - RNA, 19 nt, Homo sapiens
gagacucuggaaauccuuu

SEQ ID NO: 1189960 - RNA, 19 nt, Homo sapiens
gaaggucaugacagugaau

SEQ ID NO: 1189961 - RNA, 19 nt, Homo sapiens
ccuggagacucuggaaauc

SEQ ID NO: 1189962 - RNA, 19 nt, Homo sapiens
gagaucauggagcacauca

SEQ ID NO: 1189963 - RNA, 19 nt, Homo sapiens
ucaacauaccucagauuca

SEQ ID NO: 1189964 - RNA, 19 nt, Homo sapiens
gauuggaaugggauuacuu

SEQ ID NO: 1189965 - RNA, 19 nt, Homo sapiens
cgccaggaaguuuguguuu

SEQ ID NO: 1189966 - RNA, 19 nt, Homo sapiens
ggucaugacagugaauuac

SEQ ID NO: 1189967 - RNA, 19 nt, Homo sapiens
aaacgcuuccuaauagcaa

SEQ ID NO: 1189968 - RNA, 19 nt, Homo sapiens
ccaagagcaauaaggagau

SEQ ID NO: 1189969 - RNA, 19 nt, Homo sapiens
cgucacccuuccugcgauu

SEQ ID NO: 1189970 - RNA, 19 nt, Homo sapiens
gagauuggaaugggauuac

SEQ ID NO: 1189971 - RNA, 19 nt, Homo sapiens
ucacagagcugaagaagaa

SEQ ID NO: 1189972 - RNA, 19 nt, Homo sapiens
ggaagaaaguggagaaaga

SEQ ID NO: 1189973 - RNA, 19 nt, Homo sapiens
gaagaagacuuagccuaga

SEQ ID NO: 1189974 - RNA, 19 nt, Homo sapiens
gagcagcgauucauacauc

SEQ ID NO: 1189975 - RNA, 19 nt, Homo sapiens
ggaggacccuucagcuaaa

SEQ ID NO: 1189976 - RNA, 19 nt, Homo sapiens
ugacaucuaugaagaguau

SEQ ID NO: 1189977 - RNA, 19 nt, Homo sapiens
ggagaaagaugagaacuac

SEQ ID NO: 1189978 - RNA, 19 nt, Homo sapiens
gcaaccaaguccagaagaa

SEQ ID NO: 1189979 - RNA, 19 nt, Homo sapiens
gaaggaggcagacgccaua

SEQ ID NO: 1189980 - RNA, 19 nt, Homo sapiens
ggauuacaguugucacgua

SEQ ID NO: 1189981 - RNA, 19 nt, Homo sapiens
ccaaguaccacauggcuua

SEQ ID NO: 1189982 - RNA, 19 nt, Homo sapiens
gcagcucccugaccauuug

SEQ ID NO: 1189983 - RNA, 19 nt, Homo sapiens
ggaugcagcuucuggacaa

SEQ ID NO: 1189984 - RNA, 19 nt, Homo sapiens
ccacauggcuuaccucacu

SEQ ID NO: 1189985 - RNA, 19 nt, Homo sapiens
gagagcaacugcaauaacu

SEQ ID NO: 1189986 - RNA, 19 nt, Homo sapiens
ccacugaaguugugaucuu

SEQ ID NO: 1189987 - RNA, 19 nt, Homo sapiens
caacugcaauaacuaaaca

SEQ ID NO: 1189988 - RNA, 19 nt, Homo sapiens
ucagagagcaacugcaaua

SEQ ID NO: 1189989 - RNA, 19 nt, Homo sapiens
gagcaacugcaauaacuaa

SEQ ID NO: 1189990 - RNA, 19 nt, Homo sapiens
cuaaacaggguaaugcuua

SEQ ID NO: 1189991 - RNA, 19 nt, Homo sapiens
gcaccugaaugcuuucugu

SEQ ID NO: 1189992 - RNA, 19 nt, Homo sapiens
ccauugacaucuaugaaga

SEQ ID NO: 1189993 - RNA, 19 nt, Homo sapiens
gcggagcuauccaccauug

SEQ ID NO: 1189994 - RNA, 19 nt, Homo sapiens
cuacaaaucaggaacagaa

SEQ ID NO: 1189995 - RNA, 19 nt, Homo sapiens
cguagccucuuccauguuu

SEQ ID NO: 1189996 - RNA, 19 nt, Homo sapiens
ucagagcgguuugagauga

SEQ ID NO: 1189997 - RNA, 19 nt, Homo sapiens
ggacaaauuccuaggaucu

SEQ ID NO: 1189998 - RNA, 19 nt, Homo sapiens
ggaagcagcggaggaagaa

SEQ ID NO: 1189999 - RNA, 19 nt, Homo sapiens
gccaagacgucagcugaaa

SEQ ID NO: 1190000 - RNA, 19 nt, Homo sapiens
gaggaggacccuucagcua

SEQ ID NO: 1190001 - RNA, 19 nt, Homo sapiens
gggacgagcuuggcuguuc

SEQ ID NO: 1190002 - RNA, 19 nt, Homo sapiens
gcauacuccugcuuggauu

SEQ ID NO: 1190003 - RNA, 19 nt, Homo sapiens
gaagaaaguggagaaagau

SEQ ID NO: 1190004 - RNA, 19 nt, Homo sapiens
ccugaaugcuuucuguuau

SEQ ID NO: 1190005 - RNA, 19 nt, Homo sapiens
ggacaucaccaagaaggaa

SEQ ID NO: 1190006 - RNA, 19 nt, Homo sapiens
gggaagcagugcaauuucu

SEQ ID NO: 1190007 - RNA, 19 nt, Homo sapiens
ggaguucgaaucuacuuug

SEQ ID NO: 1190008 - RNA, 19 nt, Homo sapiens
cugcuacaauggacagaua

SEQ ID NO: 1190009 - RNA, 19 nt, Homo sapiens
ggaaguuggcaguggcaua

SEQ ID NO: 1190010 - RNA, 19 nt, Homo sapiens
aagaagacuuagccuagaa

SEQ ID NO: 1190011 - RNA, 19 nt, Homo sapiens
gaggaguucuucgacauca

SEQ ID NO: 1190012 - RNA, 19 nt, Homo sapiens
ggacggaacccuggauauc

SEQ ID NO: 1190013 - RNA, 19 nt, Homo sapiens
gaaagaugagaacuacguu

SEQ ID NO: 1190014 - RNA, 19 nt, Homo sapiens
ggaggcagacgccauaaag

SEQ ID NO: 1190015 - RNA, 19 nt, Homo sapiens
gagcgagcccacugaaguu

SEQ ID NO: 1190016 - RNA, 19 nt, Homo sapiens
ccaucuggcugcagucgaa

SEQ ID NO: 1190017 - RNA, 19 nt, Homo sapiens
ccaccgagacccuguguau

SEQ ID NO: 1190018 - RNA, 19 nt, Homo sapiens
uaaacaggguaaugcuuag

SEQ ID NO: 1190019 - RNA, 19 nt, Homo sapiens
ggaaggguuucuccuccau

SEQ ID NO: 1190020 - RNA, 19 nt, Homo sapiens
caucuacgcccuccagaga

SEQ ID NO: 1190021 - RNA, 19 nt, Homo sapiens
gacgucagcugaaaagauu

SEQ ID NO: 1190022 - RNA, 19 nt, Homo sapiens
gaugagaacuacguuaacg

SEQ ID NO: 1190023 - RNA, 19 nt, Homo sapiens
ucuguuauccuaauucuug

SEQ ID NO: 1190024 - RNA, 19 nt, Homo sapiens
ccaaugugcugggauuaca

SEQ ID NO: 1190025 - RNA, 19 nt, Homo sapiens
gugcugggauuacaguugu

SEQ ID NO: 1190026 - RNA, 19 nt, Homo sapiens
ggaugaagaaguggaagaa

SEQ ID NO: 1190027 - RNA, 19 nt, Homo sapiens
ggaagaaggggaugaagaa

SEQ ID NO: 1190028 - RNA, 19 nt, Homo sapiens
aagaugagaacuacguuaa

SEQ ID NO: 1190029 - RNA, 19 nt, Homo sapiens
aaagaugagaacuacguua

SEQ ID NO: 1190030 - RNA, 19 nt, Homo sapiens
ccauggagauuguguacgu

SEQ ID NO: 1190031 - RNA, 19 nt, Homo sapiens
augaagaaguggaagaaga

SEQ ID NO: 1190032 - RNA, 19 nt, Homo sapiens
gagcugaacaucgacauca

SEQ ID NO: 1190033 - RNA, 19 nt, Homo sapiens
gaucccacccucagcuuga

SEQ ID NO: 1190034 - RNA, 19 nt, Homo sapiens
ggacgagcuuggcuguucu

SEQ ID NO: 1190035 - RNA, 19 nt, Homo sapiens
caaaucaggaacagaaagu

SEQ ID NO: 1190036 - RNA, 19 nt, Homo sapiens
gcagcucggcucuaucaug

SEQ ID NO: 1190037 - RNA, 19 nt, Homo sapiens
ucaugcagcucggcucuau

SEQ ID NO: 1190038 - RNA, 19 nt, Homo sapiens
gaaaguggagaaagaugag

SEQ ID NO: 1190039 - RNA, 19 nt, Homo sapiens
gaagacagccgggaaucgu

SEQ ID NO: 1190040 - RNA, 19 nt, Homo sapiens
ucuacgcccuccagagaaa

SEQ ID NO: 1190041 - RNA, 19 nt, Homo sapiens
gaaguuggcaguggcauac

SEQ ID NO: 1190042 - RNA, 19 nt, Homo sapiens
cagagcgguuugagaugaa

SEQ ID NO: 1190043 - RNA, 19 nt, Homo sapiens
ggaacacgaggccaacuca

SEQ ID NO: 1190044 - RNA, 19 nt, Homo sapiens
caagaaggaacaguuggaa

SEQ ID NO: 1190045 - RNA, 19 nt, Homo sapiens
ucaagaagcgcagcgaguu

SEQ ID NO: 1190046 - RNA, 19 nt, Homo sapiens
gcaaggccgaggaggaguu

SEQ ID NO: 1190047 - RNA, 19 nt, Homo sapiens
ggauaucugggacuucaug

SEQ ID NO: 1190048 - RNA, 19 nt, Homo sapiens
gcaccauggagauugugua

SEQ ID NO: 1190049 - RNA, 19 nt, Homo sapiens
ggugggacauccgaaagau

SEQ ID NO: 1190050 - RNA, 19 nt, Homo sapiens
agaaaguggagaaagauga

SEQ ID NO: 1190051 - RNA, 19 nt, Homo sapiens
caauaacuaaacaggguaa

SEQ ID NO: 1190052 - RNA, 19 nt, Homo sapiens
agaugcggcugaaggagaa

SEQ ID NO: 1190053 - RNA, 19 nt, Homo sapiens
ucaccaagaaggaacaguu

SEQ ID NO: 1190054 - RNA, 19 nt, Homo sapiens
cuggguggcugcuacaaug

SEQ ID NO: 1190055 - RNA, 19 nt, Homo sapiens
ccccaaagauucccacgua

SEQ ID NO: 1190056 - RNA, 19 nt, Homo sapiens
uuauugcccuccucagaga

SEQ ID NO: 1190057 - RNA, 19 nt, Homo sapiens
aaggguuucuccuccauga

SEQ ID NO: 1190058 - RNA, 19 nt, Homo sapiens
augaggagcuggccguaga

SEQ ID NO: 1190059 - RNA, 19 nt, Homo sapiens
uaucugggacuucauguuc

SEQ ID NO: 1190060 - RNA, 19 nt, Homo sapiens
gggaaucguccaucaugug

SEQ ID NO: 1190061 - RNA, 19 nt, Homo sapiens
aggaggacccuucagcuaa

SEQ ID NO: 1190062 - RNA, 19 nt, Homo sapiens
uaacuaaacaggguaaugc

SEQ ID NO: 1190063 - RNA, 19 nt, Homo sapiens
gaggaggccauggaaguga

SEQ ID NO: 1190064 - RNA, 19 nt, Homo sapiens
gcagcgaguucgggaagca

SEQ ID NO: 1190065 - RNA, 19 nt, Homo sapiens
gaugagcgagcccacugaa

SEQ ID NO: 1190066 - RNA, 19 nt, Homo sapiens
cgacuggacagcccgcauu

SEQ ID NO: 1190067 - RNA, 19 nt, Homo sapiens
ucgggaagcagugcaauuu

SEQ ID NO: 1190068 - RNA, 19 nt, Homo sapiens
caaagauucccacguacuc

SEQ ID NO: 1190069 - RNA, 19 nt, Homo sapiens
agccugaacuugcucugaa

SEQ ID NO: 1190070 - RNA, 19 nt, Homo sapiens
gagcagaccauccguuucc

SEQ ID NO: 1190071 - RNA, 19 nt, Homo sapiens
gaaccaaacuacaacauua

SEQ ID NO: 1190072 - RNA, 19 nt, Homo sapiens
ggaaacaacuugaacugua

SEQ ID NO: 1190073 - RNA, 19 nt, Homo sapiens
gaagcaaagugcauuauuu

SEQ ID NO: 1190074 - RNA, 19 nt, Homo sapiens
uuacacagcuggucaaaua

SEQ ID NO: 1190075 - RNA, 19 nt, Homo sapiens
gaaagucgccuguguguaa

SEQ ID NO: 1190076 - RNA, 19 nt, Homo sapiens
caacagaacuucccugaga

SEQ ID NO: 1190077 - RNA, 19 nt, Homo sapiens
gaacauuacugucuccaaa

SEQ ID NO: 1190078 - RNA, 19 nt, Homo sapiens
gagcaaaccugucugcaaa

SEQ ID NO: 1190079 - RNA, 19 nt, Homo sapiens
agacagaggucaauuauga

SEQ ID NO: 1190080 - RNA, 19 nt, Homo sapiens
ggacaagcaucguuugaaa

SEQ ID NO: 1190081 - RNA, 19 nt, Homo sapiens
gaaugugacuggagaguaa

SEQ ID NO: 1190082 - RNA, 19 nt, Homo sapiens
gcaccugccuugccaauuu

SEQ ID NO: 1190083 - RNA, 19 nt, Homo sapiens
gaaaggaguucaaaugauc

SEQ ID NO: 1190084 - RNA, 19 nt, Homo sapiens
ugaaugaugucgugaauuu

SEQ ID NO: 1190085 - RNA, 19 nt, Homo sapiens
caacaggacugauucauag

SEQ ID NO: 1190086 - RNA, 19 nt, Homo sapiens
gaacaguacuuccaaccaa

SEQ ID NO: 1190087 - RNA, 19 nt, Homo sapiens
ggagauggcuucaguuaca

SEQ ID NO: 1190088 - RNA, 19 nt, Homo sapiens
gaaacaacuugaacuguau

SEQ ID NO: 1190089 - RNA, 19 nt, Homo sapiens
caaauuauccagaggaaua

SEQ ID NO: 1190090 - RNA, 19 nt, Homo sapiens
gagauacacucaccuuuga

SEQ ID NO: 1190091 - RNA, 19 nt, Homo sapiens
guacggugcucaaguauug

SEQ ID NO: 1190092 - RNA, 19 nt, Homo sapiens
gcaaaguccucugcuagua

SEQ ID NO: 1190093 - RNA, 19 nt, Homo sapiens
gaacacgaauacucugaaa

SEQ ID NO: 1190094 - RNA, 19 nt, Homo sapiens
ggaacgagauucaacauag

SEQ ID NO: 1190095 - RNA, 19 nt, Homo sapiens
ccaaggagguguugcauug

SEQ ID NO: 1190096 - RNA, 19 nt, Homo sapiens
uuaccaagccuaugaauua

SEQ ID NO: 1190097 - RNA, 19 nt, Homo sapiens
agacagcccugaaugauuu

SEQ ID NO: 1190098 - RNA, 19 nt, Homo sapiens
gaagaugggcuguggagua

SEQ ID NO: 1190099 - RNA, 19 nt, Homo sapiens
ggaccgacauucugacuug

SEQ ID NO: 1190100 - RNA, 19 nt, Homo sapiens
gcauauaguucgcuuggaa

SEQ ID NO: 1190101 - RNA, 19 nt, Homo sapiens
ggaaaggaguucaaaugau

SEQ ID NO: 1190102 - RNA, 19 nt, Homo sapiens
cgaauucaccuaaucuuua

SEQ ID NO: 1190103 - RNA, 19 nt, Homo sapiens
gagcaagugucaaaggaaa

SEQ ID NO: 1190104 - RNA, 19 nt, Homo sapiens
gcauugauccugcucauaa

SEQ ID NO: 1190105 - RNA, 19 nt, Homo sapiens
caaaggaaaugaaggaaca

SEQ ID NO: 1190106 - RNA, 19 nt, Homo sapiens
gaaggaggaggcccacuua

SEQ ID NO: 1190107 - RNA, 19 nt, Homo sapiens
gcucccgacugcacaauua

SEQ ID NO: 1190108 - RNA, 19 nt, Homo sapiens
guaaaguggucuaugaaug

SEQ ID NO: 1190109 - RNA, 19 nt, Homo sapiens
gaugauggcuuugucaaga

SEQ ID NO: 1190110 - RNA, 19 nt, Homo sapiens
ggaacaacaugaacugugu

SEQ ID NO: 1190111 - RNA, 19 nt, Homo sapiens
ugacaggcauuuacaagaa

SEQ ID NO: 1190112 - RNA, 19 nt, Homo sapiens
cggaagcugucaacgauua

SEQ ID NO: 1190113 - RNA, 19 nt, Homo sapiens
gacaagcagugauuccuuu

SEQ ID NO: 1190114 - RNA, 19 nt, Homo sapiens
caacaagacugugagcuau

SEQ ID NO: 1190115 - RNA, 19 nt, Homo sapiens
gcacuucccuucagaguac

SEQ ID NO: 1190116 - RNA, 19 nt, Homo sapiens
gaaaggaguucugcaugga

SEQ ID NO: 1190117 - RNA, 19 nt, Homo sapiens
gagagaaguuaaugaaaca

SEQ ID NO: 1190118 - RNA, 19 nt, Homo sapiens
ccaggaaacgguucauuua

SEQ ID NO: 1190119 - RNA, 19 nt, Homo sapiens
aaucaugacuuccuugaaa

SEQ ID NO: 1190120 - RNA, 19 nt, Homo sapiens
gcacagaacauguaaagca

SEQ ID NO: 1190121 - RNA, 19 nt, Homo sapiens
gcaccuuacugcaguuuga

SEQ ID NO: 1190122 - RNA, 19 nt, Homo sapiens
ucagaacuguggaggcuua

SEQ ID NO: 1190123 - RNA, 19 nt, Homo sapiens
gaaagaggaggauuuacuu

SEQ ID NO: 1190124 - RNA, 19 nt, Homo sapiens
gaaacccacuuggcaugua

SEQ ID NO: 1190125 - RNA, 19 nt, Homo sapiens
ggacaagaguuggaacaga

SEQ ID NO: 1190126 - RNA, 19 nt, Homo sapiens
gauccuggcauuccuauaa

SEQ ID NO: 1190127 - RNA, 19 nt, Homo sapiens
cacggaagcuccauccaua

SEQ ID NO: 1190128 - RNA, 19 nt, Homo sapiens
gacaugaaauggacaggaa

SEQ ID NO: 1190129 - RNA, 19 nt, Homo sapiens
ccaucgaucuuccuacuuu

SEQ ID NO: 1190130 - RNA, 19 nt, Homo sapiens
acaguaaaguggucuauga

SEQ ID NO: 1190131 - RNA, 19 nt, Homo sapiens
ugaaugauuuggcagaauu

SEQ ID NO: 1190132 - RNA, 19 nt, Homo sapiens
ggugaugacuuuaagacaa

SEQ ID NO: 1190133 - RNA, 19 nt, Homo sapiens
ggagagcuguuuaccuaug

SEQ ID NO: 1190134 - RNA, 19 nt, Homo sapiens
gaacuuccgugaggauaug

SEQ ID NO: 1190135 - RNA, 19 nt, Homo sapiens
gaaucauacugaacaauca

SEQ ID NO: 1190136 - RNA, 19 nt, Homo sapiens
gcacggaguuuacaucaac

SEQ ID NO: 1190137 - RNA, 19 nt, Homo sapiens
gaacuacccuuuuccaaga

SEQ ID NO: 1190138 - RNA, 19 nt, Homo sapiens
caauuucacucaacgaaga

SEQ ID NO: 1190139 - RNA, 19 nt, Homo sapiens
ugaagugucucaugggaaa

SEQ ID NO: 1190140 - RNA, 19 nt, Homo sapiens
cuaauuauccgguucagua

SEQ ID NO: 1190141 - RNA, 19 nt, Homo sapiens
ggaagucgaauucaccuaa

SEQ ID NO: 1190142 - RNA, 19 nt, Homo sapiens
guauuaaaguggaaccaaa

SEQ ID NO: 1190143 - RNA, 19 nt, Homo sapiens
gggcuucaauaucacauuu

SEQ ID NO: 1190144 - RNA, 19 nt, Homo sapiens
ggagauacacucaccuuug

SEQ ID NO: 1190145 - RNA, 19 nt, Homo sapiens
gcagucggaugauagcauu

SEQ ID NO: 1190146 - RNA, 19 nt, Homo sapiens
gagaacauguggauccaau

SEQ ID NO: 1190147 - RNA, 19 nt, Homo sapiens
ggauaugauuucuuagaga

SEQ ID NO: 1190148 - RNA, 19 nt, Homo sapiens
cuggagagcuguuuaccua

SEQ ID NO: 1190149 - RNA, 19 nt, Homo sapiens
aagcaggaguaaucaguua

SEQ ID NO: 1190150 - RNA, 19 nt, Homo sapiens
gcauuggucucucacaugu

SEQ ID NO: 1190151 - RNA, 19 nt, Homo sapiens
gacggaagcugucaacgau

SEQ ID NO: 1190152 - RNA, 19 nt, Homo sapiens
gaaacuggaacuacccuuu

SEQ ID NO: 1190153 - RNA, 19 nt, Homo sapiens
gcagggccguucccacauu

SEQ ID NO: 1190154 - RNA, 19 nt, Homo sapiens
ugaaggagauacucuaaag

SEQ ID NO: 1190155 - RNA, 19 nt, Homo sapiens
gggaaaggaguucaaauga

SEQ ID NO: 1190156 - RNA, 19 nt, Homo sapiens
ccacugugaugauggcuuu

SEQ ID NO: 1190157 - RNA, 19 nt, Homo sapiens
gugaugacuuuaagacaaa

SEQ ID NO: 1190158 - RNA, 19 nt, Homo sapiens
aagaaaggauucaagauuc

SEQ ID NO: 1190159 - RNA, 19 nt, Homo sapiens
ggaguaaucaguuauaucu

SEQ ID NO: 1190160 - RNA, 19 nt, Homo sapiens
gcaauaggauacaguuguc

SEQ ID NO: 1190161 - RNA, 19 nt, Homo sapiens
ggauuauucugucaccaaa

SEQ ID NO: 1190162 - RNA, 19 nt, Homo sapiens
gauuuaaacuugcuuacca

SEQ ID NO: 1190163 - RNA, 19 nt, Homo sapiens
ggaaugugguggucagauc

SEQ ID NO: 1190164 - RNA, 19 nt, Homo sapiens
uaacuguccuggguacuuu

SEQ ID NO: 1190165 - RNA, 19 nt, Homo sapiens
ggacugauucauagccaua

SEQ ID NO: 1190166 - RNA, 19 nt, Homo sapiens
gcaggaguaaucaguuaua

SEQ ID NO: 1190167 - RNA, 19 nt, Homo sapiens
gcacaaugcccagcaaaug

SEQ ID NO: 1190168 - RNA, 19 nt, Homo sapiens
caguaucuuucgaguguua

SEQ ID NO: 1190169 - RNA, 19 nt, Homo sapiens
gauaauacccaugagugua

SEQ ID NO: 1190170 - RNA, 19 nt, Homo sapiens
uacgagggcuucaauauca

SEQ ID NO: 1190171 - RNA, 19 nt, Homo sapiens
ucauuaaagugcauggaaa

SEQ ID NO: 1190172 - RNA, 19 nt, Homo sapiens
gggagcagcaccucuacua

SEQ ID NO: 1190173 - RNA, 19 nt, Homo sapiens
caaccggccuggcaucuac

SEQ ID NO: 1190174 - RNA, 19 nt, Homo sapiens
ggacuggauccaccacuau

SEQ ID NO: 1190175 - RNA, 19 nt, Homo sapiens
gaccggacgucaaggaucu

SEQ ID NO: 1190176 - RNA, 19 nt, Homo sapiens
cauacuggaugcacuucug

SEQ ID NO: 1190177 - RNA, 19 nt, Homo sapiens
gugcuggaccucauuaaag

SEQ ID NO: 1190178 - RNA, 19 nt, Homo sapiens
ggaccucauuaaagugcau

SEQ ID NO: 1190179 - RNA, 19 nt, Homo sapiens
cauuaaagugcauggaaau

SEQ ID NO: 1190180 - RNA, 19 nt, Homo sapiens
ugcuggaccucauuaaagu

SEQ ID NO: 1190181 - RNA, 19 nt, Homo sapiens
caaagaagguucagauuga

SEQ ID NO: 1190182 - RNA, 19 nt, Homo sapiens
gcaaggacccucuggcuua

SEQ ID NO: 1190183 - RNA, 19 nt, Homo sapiens
agacuuugcucuucauuua

SEQ ID NO: 1190184 - RNA, 19 nt, Homo sapiens
gaucaggucugcuucaaau

SEQ ID NO: 1190185 - RNA, 19 nt, Homo sapiens
gcgcaggucucauugguuu

SEQ ID NO: 1190186 - RNA, 19 nt, Homo sapiens
gccaauaucuuucgaagga

SEQ ID NO: 1190187 - RNA, 19 nt, Homo sapiens
guaaaucugugaagucaug

SEQ ID NO: 1190188 - RNA, 19 nt, Homo sapiens
uaauuccucugguauguua

SEQ ID NO: 1190189 - RNA, 19 nt, Homo sapiens
uacagaagcuggauuaguu

SEQ ID NO: 1190190 - RNA, 19 nt, Homo sapiens
uacagugccuuuccauuua

SEQ ID NO: 1190191 - RNA, 19 nt, Homo sapiens
gaagaagcaggaaggauaa

SEQ ID NO: 1190192 - RNA, 19 nt, Homo sapiens
gcaaggaggugcaggugau

SEQ ID NO: 1190193 - RNA, 19 nt, Homo sapiens
ccaccaaguucacaaagaa

SEQ ID NO: 1190194 - RNA, 19 nt, Homo sapiens
ggagcuggcuucccaagga

SEQ ID NO: 1190195 - RNA, 19 nt, Homo sapiens
aaggauaaaugccauauug

SEQ ID NO: 1190196 - RNA, 19 nt, Homo sapiens
gaagauucucugugucaua

SEQ ID NO: 1190197 - RNA, 19 nt, Homo sapiens
gcacaaguaucccauuggu

SEQ ID NO: 1190198 - RNA, 19 nt, Homo sapiens
cagauggccugagugaaua

SEQ ID NO: 1190199 - RNA, 19 nt, Homo sapiens
gaagcuggauuaguuaaca

SEQ ID NO: 1190200 - RNA, 19 nt, Homo sapiens
cagagacccuuuaaagaug

SEQ ID NO: 1190201 - RNA, 19 nt, Homo sapiens
gaagaaacaguuacaagca

SEQ ID NO: 1190202 - RNA, 19 nt, Homo sapiens
agaagaagcaggaaggaua

SEQ ID NO: 1190203 - RNA, 19 nt, Homo sapiens
ggaguggccugguaaggau

SEQ ID NO: 1190204 - RNA, 19 nt, Homo sapiens
ccagagacccuuuaaagau

SEQ ID NO: 1190205 - RNA, 19 nt, Homo sapiens
ccaggacucugaagaaaca

SEQ ID NO: 1190206 - RNA, 19 nt, Homo sapiens
ccaagcgacucuguaguuu

SEQ ID NO: 1190207 - RNA, 19 nt, Homo sapiens
guagucaccuuugcacuug

SEQ ID NO: 1190208 - RNA, 19 nt, Homo sapiens
acacagauaagcacaagua

SEQ ID NO: 1190209 - RNA, 19 nt, Homo sapiens
gguguuccuugggauauua

SEQ ID NO: 1190210 - RNA, 19 nt, Homo sapiens
ggacugcuggucacuguuu

SEQ ID NO: 1190211 - RNA, 19 nt, Homo sapiens
gcucuucauuuaaaccaaa

SEQ ID NO: 1190212 - RNA, 19 nt, Homo sapiens
caacggaguuaccugaaag

SEQ ID NO: 1190213 - RNA, 19 nt, Homo sapiens
uaauaugccuaaaggguau

SEQ ID NO: 1190214 - RNA, 19 nt, Homo sapiens
gaggaauucaugaucauuu

SEQ ID NO: 1190215 - RNA, 19 nt, Homo sapiens
ccaacggaguuaccugaaa

SEQ ID NO: 1190216 - RNA, 19 nt, Homo sapiens
caucuugaacgaccuauuu

SEQ ID NO: 1190217 - RNA, 19 nt, Homo sapiens
ggauaaaugccauauugga

SEQ ID NO: 1190218 - RNA, 19 nt, Homo sapiens
gcuaauuccucugguaugu

SEQ ID NO: 1190219 - RNA, 19 nt, Homo sapiens
ggauaauucucuggauuuc

SEQ ID NO: 1190220 - RNA, 19 nt, Homo sapiens
ccagauggccugagugaau

SEQ ID NO: 1190221 - RNA, 19 nt, Homo sapiens
ccaaagguaauaugccuaa

SEQ ID NO: 1190222 - RNA, 19 nt, Homo sapiens
uaaggagacuuugcucuuc

SEQ ID NO: 1190223 - RNA, 19 nt, Homo sapiens
gagaucaggucugcuucaa

SEQ ID NO: 1190224 - RNA, 19 nt, Homo sapiens
auacagugccuuuccauuu

SEQ ID NO: 1190225 - RNA, 19 nt, Homo sapiens
cuacaccuagguuuauuua

SEQ ID NO: 1190226 - RNA, 19 nt, Homo sapiens
uguauuggcucugugguaa

SEQ ID NO: 1190227 - RNA, 19 nt, Homo sapiens
acaaagaagguucagauug

SEQ ID NO: 1190228 - RNA, 19 nt, Homo sapiens
gauaaaugccauauuggau

SEQ ID NO: 1190229 - RNA, 19 nt, Homo sapiens
ugucauaucuacaguuucu

SEQ ID NO: 1190230 - RNA, 19 nt, Homo sapiens
ucugguauguuaacucuug

SEQ ID NO: 1190231 - RNA, 19 nt, Homo sapiens
ggcauaaacugaguguuca

SEQ ID NO: 1190232 - RNA, 19 nt, Homo sapiens
ggucgugugacuuucaaua

SEQ ID NO: 1190233 - RNA, 19 nt, Homo sapiens
ccucgaagcucccaaagac

SEQ ID NO: 1190234 - RNA, 19 nt, Homo sapiens
ggucugacuugguggacaa

SEQ ID NO: 1190235 - RNA, 19 nt, Homo sapiens
ugggaaauguccuaggaaa

SEQ ID NO: 1190236 - RNA, 19 nt, Homo sapiens
gaaggauaaaugccauauu

SEQ ID NO: 1190237 - RNA, 19 nt, Homo sapiens
ucacaaagaagguucagau

SEQ ID NO: 1190238 - RNA, 19 nt, Homo sapiens
guaguaaugccaauaucuu

SEQ ID NO: 1190239 - RNA, 19 nt, Homo sapiens
uacaacaucuggaaacagu

SEQ ID NO: 1190240 - RNA, 19 nt, Homo sapiens
uauuacagaagcuggauua

SEQ ID NO: 1190241 - RNA, 19 nt, Homo sapiens
ggagguguuccuugggaua

SEQ ID NO: 1190242 - RNA, 19 nt, Homo sapiens
aaccagugcuucaaagaga

SEQ ID NO: 1190243 - RNA, 19 nt, Homo sapiens
cauugucacuggaagaaga

SEQ ID NO: 1190244 - RNA, 19 nt, Homo sapiens
ugucauaucugcaguucuc

SEQ ID NO: 1190245 - RNA, 19 nt, Homo sapiens
aagauucucugugucauau

SEQ ID NO: 1190246 - RNA, 19 nt, Homo sapiens
aagcacaaguaucccauug

SEQ ID NO: 1190247 - RNA, 19 nt, Homo sapiens
gagcccagauggccugagu

SEQ ID NO: 1190248 - RNA, 19 nt, Homo sapiens
ggagcacucaucucuauca

SEQ ID NO: 1190249 - RNA, 19 nt, Homo sapiens
ugauggcuuucauggauuu

SEQ ID NO: 1190250 - RNA, 19 nt, Homo sapiens
gcaauacugauggugauga

SEQ ID NO: 1190251 - RNA, 19 nt, Homo sapiens
gaaucugucuuuguuucug

SEQ ID NO: 1190252 - RNA, 19 nt, Homo sapiens
gguauuagccgacaguaac

SEQ ID NO: 1190253 - RNA, 19 nt, Homo sapiens
aaucuucacucccaaccuu

SEQ ID NO: 1190254 - RNA, 19 nt, Homo sapiens
gagacuuugcucuucauuu

SEQ ID NO: 1190255 - RNA, 19 nt, Homo sapiens
guucuggucgugugacuuu

SEQ ID NO: 1190256 - RNA, 19 nt, Homo sapiens
agucugcacuacaccuaua

SEQ ID NO: 1190257 - RNA, 19 nt, Homo sapiens
gaagaagaagcaggaagga

SEQ ID NO: 1190258 - RNA, 19 nt, Homo sapiens
ucugugaagucauguacaa

SEQ ID NO: 1190259 - RNA, 19 nt, Homo sapiens
ucucacaguugcaaaucaa

SEQ ID NO: 1190260 - RNA, 19 nt, Homo sapiens
ucaaggcauuugcaaccaa

SEQ ID NO: 1190261 - RNA, 19 nt, Homo sapiens
cggcauaaacugaguguuc

SEQ ID NO: 1190262 - RNA, 19 nt, Homo sapiens
ucucauugguuucauucuu

SEQ ID NO: 1190263 - RNA, 19 nt, Homo sapiens
uuggagcacucaucucuau

SEQ ID NO: 1190264 - RNA, 19 nt, Homo sapiens
caaagguaauaugccuaaa

SEQ ID NO: 1190265 - RNA, 19 nt, Homo sapiens
acagaagcuggauuaguua

SEQ ID NO: 1190266 - RNA, 19 nt, Homo sapiens
caaagaccccuucagcaua

SEQ ID NO: 1190267 - RNA, 19 nt, Homo sapiens
caauacugauggugaugau

SEQ ID NO: 1190268 - RNA, 19 nt, Homo sapiens
uaucuggucuucgaacuag

SEQ ID NO: 1190269 - RNA, 19 nt, Homo sapiens
gcacccaggacucagauuc

SEQ ID NO: 1190270 - RNA, 19 nt, Homo sapiens
aggaauucaugaucauuug

SEQ ID NO: 1190271 - RNA, 19 nt, Homo sapiens
gcaggaaggauaaaagauu

SEQ ID NO: 1190272 - RNA, 19 nt, Homo sapiens
acacggaugccuacaccua

SEQ ID NO: 1190273 - RNA, 19 nt, Homo sapiens
ugacacagauaagcacaag

SEQ ID NO: 1190274 - RNA, 19 nt, Homo sapiens
guccggagcccaucucaga

SEQ ID NO: 1190275 - RNA, 19 nt, Homo sapiens
uaaaggguauguguaucug

SEQ ID NO: 1190276 - RNA, 19 nt, Homo sapiens
ccuauaaaccgaggaauuc

SEQ ID NO: 1190277 - RNA, 19 nt, Homo sapiens
uggauaauucucuggauuu

SEQ ID NO: 1190278 - RNA, 19 nt, Homo sapiens
gugccuuuccauuuauuua

SEQ ID NO: 1190279 - RNA, 19 nt, Homo sapiens
acagugccuuuccauuuau

SEQ ID NO: 1190280 - RNA, 19 nt, Homo sapiens
uuacauuccuugcaauacu

SEQ ID NO: 1190281 - RNA, 19 nt, Homo sapiens
gaacuugucuuucaccaau

SEQ ID NO: 1190282 - RNA, 19 nt, Homo sapiens
caaaugcacuuacugaugu

SEQ ID NO: 1190283 - RNA, 19 nt, Homo sapiens
ggauacaucucgccugauu

SEQ ID NO: 1190284 - RNA, 19 nt, Homo sapiens
ccaaugagauguggaauca

SEQ ID NO: 1190285 - RNA, 19 nt, Homo sapiens
ugacggaaguugauacuau

SEQ ID NO: 1190286 - RNA, 19 nt, Homo sapiens
ugaguuggaugaaaugauu

SEQ ID NO: 1190287 - RNA, 19 nt, Homo sapiens
gcuaagagacgacauugaa

SEQ ID NO: 1190288 - RNA, 19 nt, Homo sapiens
ggauuaugcugauggaaau

SEQ ID NO: 1190289 - RNA, 19 nt, Homo sapiens
gcucagcuacgccuuguua

SEQ ID NO: 1190290 - RNA, 19 nt, Homo sapiens
caaagacccugcaggagau

SEQ ID NO: 1190291 - RNA, 19 nt, Homo sapiens
guacuuuaacgacaacuua

SEQ ID NO: 1190292 - RNA, 19 nt, Homo sapiens
caagacggccgaacauuga

SEQ ID NO: 1190293 - RNA, 19 nt, Homo sapiens
agacugaaaugaccauaga

SEQ ID NO: 1190294 - RNA, 19 nt, Homo sapiens
gacggaaguugauacuauu

SEQ ID NO: 1190295 - RNA, 19 nt, Homo sapiens
ggagagacaaaugcacuua

SEQ ID NO: 1190296 - RNA, 19 nt, Homo sapiens
gggccaaauuuacagauga

SEQ ID NO: 1190297 - RNA, 19 nt, Homo sapiens
gggcuuugauggagacuga

SEQ ID NO: 1190298 - RNA, 19 nt, Homo sapiens
ugaaccgaaugcuaauaua

SEQ ID NO: 1190299 - RNA, 19 nt, Homo sapiens
ccaauucccuguacaucga

SEQ ID NO: 1190300 - RNA, 19 nt, Homo sapiens
ggacaggagagauuuacaa

SEQ ID NO: 1190301 - RNA, 19 nt, Homo sapiens
gaacguguagguuguacuu

SEQ ID NO: 1190302 - RNA, 19 nt, Homo sapiens
caagauacacaccggauga

SEQ ID NO: 1190303 - RNA, 19 nt, Homo sapiens
gaaccacuuucuucacaag

SEQ ID NO: 1190304 - RNA, 19 nt, Homo sapiens
gaaccgaaugcuaauauag

SEQ ID NO: 1190305 - RNA, 19 nt, Homo sapiens
cugcagaugcuaagaauaa

SEQ ID NO: 1190306 - RNA, 19 nt, Homo sapiens
caacagagcgucccagcau

SEQ ID NO: 1190307 - RNA, 19 nt, Homo sapiens
gaagcuacauuuggauaag

SEQ ID NO: 1190308 - RNA, 19 nt, Homo sapiens
ucagguagcccgagaaugu

SEQ ID NO: 1190309 - RNA, 19 nt, Homo sapiens
ucaagaaggccaucaagga

SEQ ID NO: 1190310 - RNA, 19 nt, Homo sapiens
cgacaggacaggagagauu

SEQ ID NO: 1190311 - RNA, 19 nt, Homo sapiens
ggaaguugauacuauucug

SEQ ID NO: 1190312 - RNA, 19 nt, Homo sapiens
gguccaauuuaaccaacua

SEQ ID NO: 1190313 - RNA, 19 nt, Homo sapiens
acguguagguuguacuuua

SEQ ID NO: 1190314 - RNA, 19 nt, Homo sapiens
cguguagguuguacuuuaa

SEQ ID NO: 1190315 - RNA, 19 nt, Homo sapiens
ugguacagguccaauuuaa

SEQ ID NO: 1190316 - RNA, 19 nt, Homo sapiens
aagccacacucgaguauga

SEQ ID NO: 1190317 - RNA, 19 nt, Homo sapiens
caucucgccugauucaaga

SEQ ID NO: 1190318 - RNA, 19 nt, Homo sapiens
gcacaagacggccgaacau

SEQ ID NO: 1190319 - RNA, 19 nt, Homo sapiens
gacaggagagauuuacaaa

SEQ ID NO: 1190320 - RNA, 19 nt, Homo sapiens
agacaaaugcacuuacuga

SEQ ID NO: 1190321 - RNA, 19 nt, Homo sapiens
ugaaaugauuggagagaca

SEQ ID NO: 1190322 - RNA, 19 nt, Homo sapiens
uaucaagaguccaacacuu

SEQ ID NO: 1190323 - RNA, 19 nt, Homo sapiens
cagaggguguccgagaaua

SEQ ID NO: 1190324 - RNA, 19 nt, Homo sapiens
cgaugaaguugaagcacaa

SEQ ID NO: 1190325 - RNA, 19 nt, Homo sapiens
caaagccaauucccuguac

SEQ ID NO: 1190326 - RNA, 19 nt, Homo sapiens
gaaugggaaucgaccuagu

SEQ ID NO: 1190327 - RNA, 19 nt, Homo sapiens
gagaaugggaaucgaccua

SEQ ID NO: 1190328 - RNA, 19 nt, Homo sapiens
gagaaacuaagaguggaua

SEQ ID NO: 1190329 - RNA, 19 nt, Homo sapiens
ggccgaacauugaguugug

SEQ ID NO: 1190330 - RNA, 19 nt, Homo sapiens
gaccauagaauccaucaag

SEQ ID NO: 1190331 - RNA, 19 nt, Homo sapiens
gugacaaacagacggcuua

SEQ ID NO: 1190332 - RNA, 19 nt, Homo sapiens
gaaaugaccauagaaucca

SEQ ID NO: 1190333 - RNA, 19 nt, Homo sapiens
gcccgagaaugucuauuuc

SEQ ID NO: 1190334 - RNA, 19 nt, Homo sapiens
gagcacugucucagcauuu

SEQ ID NO: 1190335 - RNA, 19 nt, Homo sapiens
ccauagaauccaucaagaa

SEQ ID NO: 1190336 - RNA, 19 nt, Homo sapiens
gacugcagaugcuaagaau

SEQ ID NO: 1190337 - RNA, 19 nt, Homo sapiens
ggaccugagugacaaacag

SEQ ID NO: 1190338 - RNA, 19 nt, Homo sapiens
gaaaaggaccugagugaca

SEQ ID NO: 1190339 - RNA, 19 nt, Homo sapiens
ggagacccagcacauacua

SEQ ID NO: 1190340 - RNA, 19 nt, Homo sapiens
gaccaacaccaaccaacuu

SEQ ID NO: 1190341 - RNA, 19 nt, Homo sapiens
caaagccacacucgaguau

SEQ ID NO: 1190342 - RNA, 19 nt, Homo sapiens
cagacgcacuuagcaaaga

SEQ ID NO: 1190343 - RNA, 19 nt, Homo sapiens
gaaguugauacuauucugu

SEQ ID NO: 1190344 - RNA, 19 nt, Homo sapiens
caacacuucccgacauaau

SEQ ID NO: 1190345 - RNA, 19 nt, Homo sapiens
cacagaggguguccgagaa

SEQ ID NO: 1190346 - RNA, 19 nt, Homo sapiens
ucaaagccacacucgagua

SEQ ID NO: 1190347 - RNA, 19 nt, Homo sapiens
gaaaugauuggagagacaa

SEQ ID NO: 1190348 - RNA, 19 nt, Homo sapiens
ugggagaacgugucaauga

SEQ ID NO: 1190349 - RNA, 19 nt, Homo sapiens
ccaauuuaaccaacuauca

SEQ ID NO: 1190350 - RNA, 19 nt, Homo sapiens
cauggaacguguagguugu

SEQ ID NO: 1190351 - RNA, 19 nt, Homo sapiens
acaaaugcacuuacugaug

SEQ ID NO: 1190352 - RNA, 19 nt, Homo sapiens
acaagacggccgaacauug

SEQ ID NO: 1190353 - RNA, 19 nt, Homo sapiens
agaaggccaucaaggacaa

SEQ ID NO: 1190354 - RNA, 19 nt, Homo sapiens
gcagaugcuaagaauaaga

SEQ ID NO: 1190355 - RNA, 19 nt, Homo sapiens
cgacauaauucggagaaac

SEQ ID NO: 1190356 - RNA, 19 nt, Homo sapiens
uccaacacuucccgacaua

SEQ ID NO: 1190357 - RNA, 19 nt, Homo sapiens
ucaaagccaauucccugua

SEQ ID NO: 1190358 - RNA, 19 nt, Homo sapiens
uugauacuauucuguguug

SEQ ID NO: 1190359 - RNA, 19 nt, Homo sapiens
ccgagaaugucuauuucau

SEQ ID NO: 1190360 - RNA, 19 nt, Homo sapiens
gaugaaaugauuggagaga

SEQ ID NO: 1190361 - RNA, 19 nt, Homo sapiens
caaagucgccuccaauucc

SEQ ID NO: 1190362 - RNA, 19 nt, Homo sapiens
aagaaagaaugaagcuaca

SEQ ID NO: 1190363 - RNA, 19 nt, Homo sapiens
cauagaauccaucaagaag

SEQ ID NO: 1190364 - RNA, 19 nt, Homo sapiens
gaaacuaagaguggauaca

SEQ ID NO: 1190365 - RNA, 19 nt, Homo sapiens
cuacaaagucgccuccaau

SEQ ID NO: 1190366 - RNA, 19 nt, Homo sapiens
uaagcuaagagacgacauu

SEQ ID NO: 1190367 - RNA, 19 nt, Homo sapiens
ugaagcuacauuuggauaa

SEQ ID NO: 1190368 - RNA, 19 nt, Homo sapiens
gacaggacaggagagauuu

SEQ ID NO: 1190369 - RNA, 19 nt, Homo sapiens
caacaccaaccaacuuucu

SEQ ID NO: 1190370 - RNA, 19 nt, Homo sapiens
gaauaccaugcuucccuuu

SEQ ID NO: 1190371 - RNA, 19 nt, Homo sapiens
cuaagagacgacauugaaa

SEQ ID NO: 1190372 - RNA, 19 nt, Homo sapiens
gacauaggguuuuggaaau

SEQ ID NO: 1190373 - RNA, 19 nt, Homo sapiens
aaaggauuaugcugaugga

SEQ ID NO: 1190374 - RNA, 19 nt, Homo sapiens
cagcacauacuacaaaguc

SEQ ID NO: 1190375 - RNA, 19 nt, Homo sapiens
guccaacacuucccgacau

SEQ ID NO: 1190376 - RNA, 19 nt, Homo sapiens
uacaaagucgccuccaauu

SEQ ID NO: 1190377 - RNA, 19 nt, Homo sapiens
acacaccggaugacuggua

SEQ ID NO: 1190378 - RNA, 19 nt, Homo sapiens
uaccaugcuucccuuuguu

SEQ ID NO: 1190379 - RNA, 19 nt, Homo sapiens
uaacgagguacacgagguu

SEQ ID NO: 1190380 - RNA, 19 nt, Homo sapiens
guaccauggccucaagcua

SEQ ID NO: 1190381 - RNA, 19 nt, Homo sapiens
gaagagauacugucuauuu

SEQ ID NO: 1190382 - RNA, 19 nt, Homo sapiens
uaacagacauuaaggauga

SEQ ID NO: 1190383 - RNA, 19 nt, Homo sapiens
guacauaguuugauccauu

SEQ ID NO: 1190384 - RNA, 19 nt, Homo sapiens
gauuggaccucauuacaua

SEQ ID NO: 1190385 - RNA, 19 nt, Homo sapiens
gagcaucuauagugaauuu

SEQ ID NO: 1190386 - RNA, 19 nt, Homo sapiens
gaugaagaguucuggaaua

SEQ ID NO: 1190387 - RNA, 19 nt, Homo sapiens
ggugaaaucugucucugua

SEQ ID NO: 1190388 - RNA, 19 nt, Homo sapiens
caagaagaguacauaguuu

SEQ ID NO: 1190389 - RNA, 19 nt, Homo sapiens
gaaagagccaacaacguua

SEQ ID NO: 1190390 - RNA, 19 nt, Homo sapiens
uaaugaggcuuacaacuug

SEQ ID NO: 1190391 - RNA, 19 nt, Homo sapiens
gugguaagcucuacuaaau

SEQ ID NO: 1190392 - RNA, 19 nt, Homo sapiens
gguaagcucuacuaaaugu

SEQ ID NO: 1190393 - RNA, 19 nt, Homo sapiens
gaagaguucuggaauaggu

SEQ ID NO: 1190394 - RNA, 19 nt, Homo sapiens
gaaccaggcaggcuacuuu

SEQ ID NO: 1190395 - RNA, 19 nt, Homo sapiens
gaaauccugucuuuaccaa

SEQ ID NO: 1190396 - RNA, 19 nt, Homo sapiens
gugaagagauacugucuau

SEQ ID NO: 1190397 - RNA, 19 nt, Homo sapiens
gaugaauccugcugcauga

SEQ ID NO: 1190398 - RNA, 19 nt, Homo sapiens
guaggaagauagaacaaug

SEQ ID NO: 1190399 - RNA, 19 nt, Homo sapiens
caaggacucuuacgacuuc

SEQ ID NO: 1190400 - RNA, 19 nt, Homo sapiens
ggucgagucuaaucaauuc

SEQ ID NO: 1190401 - RNA, 19 nt, Homo sapiens
gccauaauuugccaucuuu

SEQ ID NO: 1190402 - RNA, 19 nt, Homo sapiens
aaacacugaucuuugcuaa

SEQ ID NO: 1190403 - RNA, 19 nt, Homo sapiens
acacugaucuuugcuaaug

SEQ ID NO: 1190404 - RNA, 19 nt, Homo sapiens
gaagaggaggugauugaaa

SEQ ID NO: 1190405 - RNA, 19 nt, Homo sapiens
uaggugcucugauaaguaa

SEQ ID NO: 1190406 - RNA, 19 nt, Homo sapiens
ggaacaagaagaguacaua

SEQ ID NO: 1190407 - RNA, 19 nt, Homo sapiens
ggacgucuuuggaauuugu

SEQ ID NO: 1190408 - RNA, 19 nt, Homo sapiens
ugaaagagccaacaacguu

SEQ ID NO: 1190409 - RNA, 19 nt, Homo sapiens
caaccagggugaaaucugu

SEQ ID NO: 1190410 - RNA, 19 nt, Homo sapiens
ggcagaagguuaucucuag

SEQ ID NO: 1190411 - RNA, 19 nt, Homo sapiens
uaaagcacauuuggagaaa

SEQ ID NO: 1190412 - RNA, 19 nt, Homo sapiens
cagaagagcaucuauagug

SEQ ID NO: 1190413 - RNA, 19 nt, Homo sapiens
ccuuguagcucauauauag

SEQ ID NO: 1190414 - RNA, 19 nt, Homo sapiens
ucaauuccauuucuuagug

SEQ ID NO: 1190415 - RNA, 19 nt, Homo sapiens
guaaagcacauuuggagaa

SEQ ID NO: 1190416 - RNA, 19 nt, Homo sapiens
ugaaccagguggcggauuu

SEQ ID NO: 1190417 - RNA, 19 nt, Homo sapiens
uggagaaagucagaaguua

SEQ ID NO: 1190418 - RNA, 19 nt, Homo sapiens
agaagagcaucuauaguga

SEQ ID NO: 1190419 - RNA, 19 nt, Homo sapiens
gggagucgcuggucugauc

SEQ ID NO: 1190420 - RNA, 19 nt, Homo sapiens
gcagugagccaugaucauu

SEQ ID NO: 1190421 - RNA, 19 nt, Homo sapiens
ccaacaacguuaaguaugg

SEQ ID NO: 1190422 - RNA, 19 nt, Homo sapiens
caagaauccugccaucauc

SEQ ID NO: 1190423 - RNA, 19 nt, Homo sapiens
gauaaucuccuugucuauu

SEQ ID NO: 1190424 - RNA, 19 nt, Homo sapiens
caagguggguggaucacuu

SEQ ID NO: 1190425 - RNA, 19 nt, Homo sapiens
gaagguuaucucuagcuua

SEQ ID NO: 1190426 - RNA, 19 nt, Homo sapiens
gcaagaauccugccaucau

SEQ ID NO: 1190427 - RNA, 19 nt, Homo sapiens
gaauuugccacucuacuug

SEQ ID NO: 1190428 - RNA, 19 nt, Homo sapiens
gaacaagaagaguacauag

SEQ ID NO: 1190429 - RNA, 19 nt, Homo sapiens
gagccaacaacguuaagua

SEQ ID NO: 1190430 - RNA, 19 nt, Homo sapiens
ucacuugaguucaggaguu

SEQ ID NO: 1190431 - RNA, 19 nt, Homo sapiens
uauccucaguucuuaguaa

SEQ ID NO: 1190432 - RNA, 19 nt, Homo sapiens
ggaauuugccacucuacuu

SEQ ID NO: 1190433 - RNA, 19 nt, Homo sapiens
guggacgucuuuggaauuu

SEQ ID NO: 1190434 - RNA, 19 nt, Homo sapiens
uaacuuuacccacuaguga

SEQ ID NO: 1190435 - RNA, 19 nt, Homo sapiens
aagguuaucucuagcuuau

SEQ ID NO: 1190436 - RNA, 19 nt, Homo sapiens
gaagagcaucuauagugaa

SEQ ID NO: 1190437 - RNA, 19 nt, Homo sapiens
gcaaacuccuggauaaagc

SEQ ID NO: 1190438 - RNA, 19 nt, Homo sapiens
ugugcaaacuccuggauaa

SEQ ID NO: 1190439 - RNA, 19 nt, Homo sapiens
cuaaugaggcuuacaacuu

SEQ ID NO: 1190440 - RNA, 19 nt, Homo sapiens
acaagaagaguacauaguu

SEQ ID NO: 1190441 - RNA, 19 nt, Homo sapiens
guuaaacacugaucuuugc

SEQ ID NO: 1190442 - RNA, 19 nt, Homo sapiens
gcaagaaccauggacauuc

SEQ ID NO: 1190443 - RNA, 19 nt, Homo sapiens
ggcaucaguuguucaaugu

SEQ ID NO: 1190444 - RNA, 19 nt, Homo sapiens
caaccuggaugagugcauu

SEQ ID NO: 1190445 - RNA, 19 nt, Homo sapiens
ucauugaacucuugggaau

SEQ ID NO: 1190446 - RNA, 19 nt, Homo sapiens
gugaagaggaggugauuga

SEQ ID NO: 1190447 - RNA, 19 nt, Homo sapiens
gauaacagacauuaaggau

SEQ ID NO: 1190448 - RNA, 19 nt, Homo sapiens
gugagggaguggauaaguu

SEQ ID NO: 1190449 - RNA, 19 nt, Homo sapiens
ggugaaauccugucuuuac

SEQ ID NO: 1190450 - RNA, 19 nt, Homo sapiens
cauaguguuucuuucauca

SEQ ID NO: 1190451 - RNA, 19 nt, Homo sapiens
caucaccguuaaacacuga

SEQ ID NO: 1190452 - RNA, 19 nt, Homo sapiens
aagaggaggugauugaaag

SEQ ID NO: 1190453 - RNA, 19 nt, Homo sapiens
gcugaaggugcccaaauuu

SEQ ID NO: 1190454 - RNA, 19 nt, Homo sapiens
gauaaguaaagcacauuug

SEQ ID NO: 1190455 - RNA, 19 nt, Homo sapiens
gcaggaucuuuguccagaa

SEQ ID NO: 1190456 - RNA, 19 nt, Homo sapiens
ccuauaaucccagcacuuu

SEQ ID NO: 1190457 - RNA, 19 nt, Homo sapiens
ucaggcuccucccagguua

SEQ ID NO: 1190458 - RNA, 19 nt, Homo sapiens
aaagagauuuguagaagcu

SEQ ID NO: 1190459 - RNA, 19 nt, Homo sapiens
aagaggaaaggcagaauuu

SEQ ID NO: 1190460 - RNA, 19 nt, Homo sapiens
cacagugccucaugccuau

SEQ ID NO: 1190461 - RNA, 19 nt, Homo sapiens
gagcugaaccuuccuuucg

SEQ ID NO: 1190462 - RNA, 19 nt, Homo sapiens
ggugauaacagacauuaag

SEQ ID NO: 1190463 - RNA, 19 nt, Homo sapiens
ggauaaagcagguguucca

SEQ ID NO: 1190464 - RNA, 19 nt, Homo sapiens
gcucagucguaaagaggaa

SEQ ID NO: 1190465 - RNA, 19 nt, Homo sapiens
ugacuuggcagaagguuau

SEQ ID NO: 1190466 - RNA, 19 nt, Homo sapiens
ucaaaaccaucaccguuaa

SEQ ID NO: 1190467 - RNA, 19 nt, Homo sapiens
uagcuuauccucaguucuu

SEQ ID NO: 1190468 - RNA, 19 nt, Homo sapiens
uggcaugaauuccagcuau

SEQ ID NO: 1190469 - RNA, 19 nt, Homo sapiens
gcaggcaucaguuguucaa

SEQ ID NO: 1190470 - RNA, 19 nt, Homo sapiens
cauaggugcucugauaagu

SEQ ID NO: 1190471 - RNA, 19 nt, Homo sapiens
aagagcaucuauagugaau

SEQ ID NO: 1190472 - RNA, 19 nt, Homo sapiens
guaaagaggaaaggcagaa

SEQ ID NO: 1190473 - RNA, 19 nt, Homo sapiens
gagauacugucuauuuuca

SEQ ID NO: 1190474 - RNA, 19 nt, Homo sapiens
ggaugaagaguucuggaau

SEQ ID NO: 1190475 - RNA, 19 nt, Homo sapiens
ggagaaagucagaaguuac

SEQ ID NO: 1190476 - RNA, 19 nt, Homo sapiens
uugcugaccuggaagauag

SEQ ID NO: 1190477 - RNA, 19 nt, Homo sapiens
caagaaccauggacauucc

SEQ ID NO: 1190478 - RNA, 19 nt, Homo sapiens
ggaaggcuaugugguaagc

SEQ ID NO: 1190479 - RNA, 19 nt, Homo sapiens
gagaucagccuaggcaaca

SEQ ID NO: 1190480 - RNA, 19 nt, Homo sapiens
ggcaugaauuccagcuaug

SEQ ID NO: 1190481 - RNA, 19 nt, Homo sapiens
gaagagauacugucuauuu

SEQ ID NO: 1190482 - RNA, 19 nt, Homo sapiens
uaacagacauuaaggauga

SEQ ID NO: 1190483 - RNA, 19 nt, Homo sapiens
guacauaguuugauccauu

SEQ ID NO: 1190484 - RNA, 19 nt, Homo sapiens
gauuggaccucauuacaua

SEQ ID NO: 1190485 - RNA, 19 nt, Homo sapiens
gaugaagaguucuggaaua

SEQ ID NO: 1190486 - RNA, 19 nt, Homo sapiens
caagaagaguacauaguuu

SEQ ID NO: 1190487 - RNA, 19 nt, Homo sapiens
gaaagagccaacaacguua

SEQ ID NO: 1190488 - RNA, 19 nt, Homo sapiens
uaaugaggcuuacaacuug

SEQ ID NO: 1190489 - RNA, 19 nt, Homo sapiens
gugguaagcucuacuaaau

SEQ ID NO: 1190490 - RNA, 19 nt, Homo sapiens
gguaagcucuacuaaaugu

SEQ ID NO: 1190491 - RNA, 19 nt, Homo sapiens
gaagaguucuggaauaggu

SEQ ID NO: 1190492 - RNA, 19 nt, Homo sapiens
gaaccaggcaggcuacuuu

SEQ ID NO: 1190493 - RNA, 19 nt, Homo sapiens
gaaauccugucuuuaccaa

SEQ ID NO: 1190494 - RNA, 19 nt, Homo sapiens
gugaagagauacugucuau

SEQ ID NO: 1190495 - RNA, 19 nt, Homo sapiens
gaugaauccugcugcauga

SEQ ID NO: 1190496 - RNA, 19 nt, Homo sapiens
guaggaagauagaacaaug

SEQ ID NO: 1190497 - RNA, 19 nt, Homo sapiens
caaggacucuuacgacuuc

SEQ ID NO: 1190498 - RNA, 19 nt, Homo sapiens
ccaaccaggucagaaguua

SEQ ID NO: 1190499 - RNA, 19 nt, Homo sapiens
ggucgagucuaaucaauuc

SEQ ID NO: 1190500 - RNA, 19 nt, Homo sapiens
gccauaauuugccaucuuu

SEQ ID NO: 1190501 - RNA, 19 nt, Homo sapiens
aaacacugaucuuugcuaa

SEQ ID NO: 1190502 - RNA, 19 nt, Homo sapiens
acacugaucuuugcuaaug

SEQ ID NO: 1190503 - RNA, 19 nt, Homo sapiens
gaagaggaggugauugaaa

SEQ ID NO: 1190504 - RNA, 19 nt, Homo sapiens
ggaacaagaagaguacaua

SEQ ID NO: 1190505 - RNA, 19 nt, Homo sapiens
ggacgucuuuggaauuugu

SEQ ID NO: 1190506 - RNA, 19 nt, Homo sapiens
ugaaagagccaacaacguu

SEQ ID NO: 1190507 - RNA, 19 nt, Homo sapiens
ggucagaaguuacgucaag

SEQ ID NO: 1190508 - RNA, 19 nt, Homo sapiens
ggcagaagguuaucucuag

SEQ ID NO: 1190509 - RNA, 19 nt, Homo sapiens
ccuuguagcucauauauag

SEQ ID NO: 1190510 - RNA, 19 nt, Homo sapiens
ucaauuccauuucuuagug

SEQ ID NO: 1190511 - RNA, 19 nt, Homo sapiens
ugaaccagguggcggauuu

SEQ ID NO: 1190512 - RNA, 19 nt, Homo sapiens
gggagucgcuggucugauc

SEQ ID NO: 1190513 - RNA, 19 nt, Homo sapiens
gcagugagccaugaucauu

SEQ ID NO: 1190514 - RNA, 19 nt, Homo sapiens
ccaacaacguuaaguaugg

SEQ ID NO: 1190515 - RNA, 19 nt, Homo sapiens
caagaauccugccaucauc

SEQ ID NO: 1190516 - RNA, 19 nt, Homo sapiens
gauaaucuccuugucuauu

SEQ ID NO: 1190517 - RNA, 19 nt, Homo sapiens
caagguggguggaucacuu

SEQ ID NO: 1190518 - RNA, 19 nt, Homo sapiens
gaagguuaucucuagcuua

SEQ ID NO: 1190519 - RNA, 19 nt, Homo sapiens
gcaagaauccugccaucau

SEQ ID NO: 1190520 - RNA, 19 nt, Homo sapiens
gaauuugccacucuacuug

SEQ ID NO: 1190521 - RNA, 19 nt, Homo sapiens
gaacaagaagaguacauag

SEQ ID NO: 1190522 - RNA, 19 nt, Homo sapiens
gagccaacaacguuaagua

SEQ ID NO: 1190523 - RNA, 19 nt, Homo sapiens
ucacuugaguucaggaguu

SEQ ID NO: 1190524 - RNA, 19 nt, Homo sapiens
uauccucaguucuuaguaa

SEQ ID NO: 1190525 - RNA, 19 nt, Homo sapiens
ggaauuugccacucuacuu

SEQ ID NO: 1190526 - RNA, 19 nt, Homo sapiens
guggacgucuuuggaauuu

SEQ ID NO: 1190527 - RNA, 19 nt, Homo sapiens
uaacuuuacccacuaguga

SEQ ID NO: 1190528 - RNA, 19 nt, Homo sapiens
aagguuaucucuagcuuau

SEQ ID NO: 1190529 - RNA, 19 nt, Homo sapiens
gcaaacuccuggauaaagc

SEQ ID NO: 1190530 - RNA, 19 nt, Homo sapiens
ugugcaaacuccuggauaa

SEQ ID NO: 1190531 - RNA, 19 nt, Homo sapiens
cuaaugaggcuuacaacuu

SEQ ID NO: 1190532 - RNA, 19 nt, Homo sapiens
acaagaagaguacauaguu

SEQ ID NO: 1190533 - RNA, 19 nt, Homo sapiens
guuaaacacugaucuuugc

SEQ ID NO: 1190534 - RNA, 19 nt, Homo sapiens
gcaagaaccauggacauuc

SEQ ID NO: 1190535 - RNA, 19 nt, Homo sapiens
ggcaucaguuguucaaugu

SEQ ID NO: 1190536 - RNA, 19 nt, Homo sapiens
caaccuggaugagugcauu

SEQ ID NO: 1190537 - RNA, 19 nt, Homo sapiens
ucauugaacucuugggaau

SEQ ID NO: 1190538 - RNA, 19 nt, Homo sapiens
gugaagaggaggugauuga

SEQ ID NO: 1190539 - RNA, 19 nt, Homo sapiens
gauaacagacauuaaggau

SEQ ID NO: 1190540 - RNA, 19 nt, Homo sapiens
gugagggaguggauaaguu

SEQ ID NO: 1190541 - RNA, 19 nt, Homo sapiens
ggugaaauccugucuuuac

SEQ ID NO: 1190542 - RNA, 19 nt, Homo sapiens
cauaguguuucuuucauca

SEQ ID NO: 1190543 - RNA, 19 nt, Homo sapiens
caucaccguuaaacacuga

SEQ ID NO: 1190544 - RNA, 19 nt, Homo sapiens
aagaggaggugauugaaag

SEQ ID NO: 1190545 - RNA, 19 nt, Homo sapiens
gcugaaggugcccaaauuu

SEQ ID NO: 1190546 - RNA, 19 nt, Homo sapiens
ccuauaaucccagcacuuu

SEQ ID NO: 1190547 - RNA, 19 nt, Homo sapiens
ucaggcuccucccagguua

SEQ ID NO: 1190548 - RNA, 19 nt, Homo sapiens
aagaggaaaggcagaauuu

SEQ ID NO: 1190549 - RNA, 19 nt, Homo sapiens
cacagugccucaugccuau

SEQ ID NO: 1190550 - RNA, 19 nt, Homo sapiens
gagcugaaccuuccuuucg

SEQ ID NO: 1190551 - RNA, 19 nt, Homo sapiens
ggugauaacagacauuaag

SEQ ID NO: 1190552 - RNA, 19 nt, Homo sapiens
ggauaaagcagguguucca

SEQ ID NO: 1190553 - RNA, 19 nt, Homo sapiens
gcucagucguaaagaggaa

SEQ ID NO: 1190554 - RNA, 19 nt, Homo sapiens
ugacuuggcagaagguuau

SEQ ID NO: 1190555 - RNA, 19 nt, Homo sapiens
ucaaaaccaucaccguuaa

SEQ ID NO: 1190556 - RNA, 19 nt, Homo sapiens
uagcuuauccucaguucuu

SEQ ID NO: 1190557 - RNA, 19 nt, Homo sapiens
uggcaugaauuccagcuau

SEQ ID NO: 1190558 - RNA, 19 nt, Homo sapiens
gcaggcaucaguuguucaa

SEQ ID NO: 1190559 - RNA, 19 nt, Homo sapiens
guaaagaggaaaggcagaa

SEQ ID NO: 1190560 - RNA, 19 nt, Homo sapiens
gagauacugucuauuuuca

SEQ ID NO: 1190561 - RNA, 19 nt, Homo sapiens
ggaugaagaguucuggaau

SEQ ID NO: 1190562 - RNA, 19 nt, Homo sapiens
uugcugaccuggaagauag

SEQ ID NO: 1190563 - RNA, 19 nt, Homo sapiens
caagaaccauggacauucc

SEQ ID NO: 1190564 - RNA, 19 nt, Homo sapiens
ggaaggcuaugugguaagc

SEQ ID NO: 1190565 - RNA, 19 nt, Homo sapiens
gagaucagccuaggcaaca

SEQ ID NO: 1190566 - RNA, 19 nt, Homo sapiens
ggcaugaauuccagcuaug

SEQ ID NO: 1190567 - RNA, 19 nt, Homo sapiens
cuucuucacugagaucaaa

SEQ ID NO: 1190568 - RNA, 19 nt, Homo sapiens
guagagagggagccaagga

SEQ ID NO: 1190569 - RNA, 19 nt, Homo sapiens
aggcaucaguuguucaaug

SEQ ID NO: 1190570 - RNA, 19 nt, Homo sapiens
gcucacggguccugaacca

SEQ ID NO: 1190571 - RNA, 19 nt, Homo sapiens
gggaugaagaguucuggaa

SEQ ID NO: 1190572 - RNA, 19 nt, Homo sapiens
aaagagccaacaacguuaa

SEQ ID NO: 1190573 - RNA, 19 nt, Homo sapiens
cugcaugacggaagagaua

SEQ ID NO: 1190574 - RNA, 19 nt, Homo sapiens
gaauccugccaucaucuuu

SEQ ID NO: 1190575 - RNA, 19 nt, Homo sapiens
gcagggaacacugugauag

SEQ ID NO: 1190576 - RNA, 19 nt, Homo sapiens
aagaguacauaguuugauc

SEQ ID NO: 1190577 - RNA, 19 nt, Homo sapiens
aaagaggaaaggcagaauu

SEQ ID NO: 1190578 - RNA, 19 nt, Homo sapiens
uuggagagauuauggagau

SEQ ID NO: 1190579 - RNA, 19 nt, Homo sapiens
guggugcccucugccuaua

SEQ ID NO: 1190580 - RNA, 19 nt, Homo sapiens
auggugaaauccugucuuu

SEQ ID NO: 1190581 - RNA, 19 nt, Homo sapiens
gaacguuccucucuaauua

SEQ ID NO: 1190582 - RNA, 19 nt, Homo sapiens
gagaacagcuuaccaagua

SEQ ID NO: 1190583 - RNA, 19 nt, Homo sapiens
gcacucagguugcaaauuu

SEQ ID NO: 1190584 - RNA, 19 nt, Homo sapiens
gaaagcuccuucuaauuaa

SEQ ID NO: 1190585 - RNA, 19 nt, Homo sapiens
gaaggaagcugcauuuuaa

SEQ ID NO: 1190586 - RNA, 19 nt, Homo sapiens
gaacuaagccucucaagau

SEQ ID NO: 1190587 - RNA, 19 nt, Homo sapiens
gaacaaggaugaaugucaa

SEQ ID NO: 1190588 - RNA, 19 nt, Homo sapiens
ugaaagcuccuucuaauua

SEQ ID NO: 1190589 - RNA, 19 nt, Homo sapiens
gaaguucaguucuuuaaug

SEQ ID NO: 1190590 - RNA, 19 nt, Homo sapiens
gaacaacugcacuuuauuu

SEQ ID NO: 1190591 - RNA, 19 nt, Homo sapiens
gaaaugcuucucuagauua

SEQ ID NO: 1190592 - RNA, 19 nt, Homo sapiens
ggaauagacugguauaugg

SEQ ID NO: 1190593 - RNA, 19 nt, Homo sapiens
gaacagagguuugaaucau

SEQ ID NO: 1190594 - RNA, 19 nt, Homo sapiens
caacaacuaucacaaagga

SEQ ID NO: 1190595 - RNA, 19 nt, Homo sapiens
gaacauggaauaccaauca

SEQ ID NO: 1190596 - RNA, 19 nt, Homo sapiens
ggaguuacaccucguuaua

SEQ ID NO: 1190597 - RNA, 19 nt, Homo sapiens
ucaaagaugugaaggcauu

SEQ ID NO: 1190598 - RNA, 19 nt, Homo sapiens
ggaaaugacacuuauugaa

SEQ ID NO: 1190599 - RNA, 19 nt, Homo sapiens
gcagagaagaugccuagua

SEQ ID NO: 1190600 - RNA, 19 nt, Homo sapiens
caacgagucaucuuuagua

SEQ ID NO: 1190601 - RNA, 19 nt, Homo sapiens
aaagauggcuaacuuacuu

SEQ ID NO: 1190602 - RNA, 19 nt, Homo sapiens
gacaggaacugcagaaagu

SEQ ID NO: 1190603 - RNA, 19 nt, Homo sapiens
gaaccugaauacuggauau

SEQ ID NO: 1190604 - RNA, 19 nt, Homo sapiens
gaacugaaagcuccuucua

SEQ ID NO: 1190605 - RNA, 19 nt, Homo sapiens
uaacuuacuuugcuacuuc

SEQ ID NO: 1190606 - RNA, 19 nt, Homo sapiens
ggaccaaccugaaauugca

SEQ ID NO: 1190607 - RNA, 19 nt, Homo sapiens
gaaagggcuucauucacaa

SEQ ID NO: 1190608 - RNA, 19 nt, Homo sapiens
caccagcacugaagaauau

SEQ ID NO: 1190609 - RNA, 19 nt, Homo sapiens
cuaaaggacuguuuuguua

SEQ ID NO: 1190610 - RNA, 19 nt, Homo sapiens
agaaugcacugacaucaaa

SEQ ID NO: 1190611 - RNA, 19 nt, Homo sapiens
gaauccaugugaugauaaa

SEQ ID NO: 1190612 - RNA, 19 nt, Homo sapiens
agaaagggcuucauucaca

SEQ ID NO: 1190613 - RNA, 19 nt, Homo sapiens
ccacaacgagucaucuuua

SEQ ID NO: 1190614 - RNA, 19 nt, Homo sapiens
ggaugaaugucaaagaugu

SEQ ID NO: 1190615 - RNA, 19 nt, Homo sapiens
ugcaacaucucauacuuua

SEQ ID NO: 1190616 - RNA, 19 nt, Homo sapiens
gaaaacuugugaccacuua

SEQ ID NO: 1190617 - RNA, 19 nt, Homo sapiens
gcagaaagacccucuaugg

SEQ ID NO: 1190618 - RNA, 19 nt, Homo sapiens
gaagugauauuugcaacau

SEQ ID NO: 1190619 - RNA, 19 nt, Homo sapiens
cgagauaaauucaaguuag

SEQ ID NO: 1190620 - RNA, 19 nt, Homo sapiens
aaacaggaaaugacacuua

SEQ ID NO: 1190621 - RNA, 19 nt, Homo sapiens
uaauuacucugaagcacua

SEQ ID NO: 1190622 - RNA, 19 nt, Homo sapiens
cagaauccaugugaugaua

SEQ ID NO: 1190623 - RNA, 19 nt, Homo sapiens
ugaaaugcuucucuagauu

SEQ ID NO: 1190624 - RNA, 19 nt, Homo sapiens
gcucugagguucaauuucu

SEQ ID NO: 1190625 - RNA, 19 nt, Homo sapiens
caaggaauuugcacuggaa

SEQ ID NO: 1190626 - RNA, 19 nt, Homo sapiens
caagaaggaagcugcauuu

SEQ ID NO: 1190627 - RNA, 19 nt, Homo sapiens
ggacugaagaggaagauga

SEQ ID NO: 1190628 - RNA, 19 nt, Homo sapiens
gcacaagcucaucuucaua

SEQ ID NO: 1190629 - RNA, 19 nt, Homo sapiens
ggaacuauccaaacugcua

SEQ ID NO: 1190630 - RNA, 19 nt, Homo sapiens
gaucaucaccauccucauu

SEQ ID NO: 1190631 - RNA, 19 nt, Homo sapiens
guacagaaagggcuucauu

SEQ ID NO: 1190632 - RNA, 19 nt, Homo sapiens
auagaaagauggcuaacuu

SEQ ID NO: 1190633 - RNA, 19 nt, Homo sapiens
cagauugcaugaacugaaa

SEQ ID NO: 1190634 - RNA, 19 nt, Homo sapiens
aaagagugcuaauuacuuc

SEQ ID NO: 1190635 - RNA, 19 nt, Homo sapiens
acaaaggaauagacuggua

SEQ ID NO: 1190636 - RNA, 19 nt, Homo sapiens
cuggauaucucauguucua

SEQ ID NO: 1190637 - RNA, 19 nt, Homo sapiens
ugaggaaguucaguucuuu

SEQ ID NO: 1190638 - RNA, 19 nt, Homo sapiens
gucaagauaucauagcuau

SEQ ID NO: 1190639 - RNA, 19 nt, Homo sapiens
cagagaagaugccuaguac

SEQ ID NO: 1190640 - RNA, 19 nt, Homo sapiens
gcagaugauucucaacaag

SEQ ID NO: 1190641 - RNA, 19 nt, Homo sapiens
gauuugcgaugguuacaug

SEQ ID NO: 1190642 - RNA, 19 nt, Homo sapiens
aaaggacucugcuggaaga

SEQ ID NO: 1190643 - RNA, 19 nt, Homo sapiens
cagcuacugugauggauga

SEQ ID NO: 1190644 - RNA, 19 nt, Homo sapiens
gugaaggcauuacuagaga

SEQ ID NO: 1190645 - RNA, 19 nt, Homo sapiens
ggaacaaggaugaauguca

SEQ ID NO: 1190646 - RNA, 19 nt, Homo sapiens
guacauccuuguggacauu

SEQ ID NO: 1190647 - RNA, 19 nt, Homo sapiens
gggaagaggcugacauugu

SEQ ID NO: 1190648 - RNA, 19 nt, Homo sapiens
caagugaaccugaauacug

SEQ ID NO: 1190649 - RNA, 19 nt, Homo sapiens
gcacuggagacaagaacua

SEQ ID NO: 1190650 - RNA, 19 nt, Homo sapiens
gaagaauauccacaucuga

SEQ ID NO: 1190651 - RNA, 19 nt, Homo sapiens
gaugaguucuggugguuuc

SEQ ID NO: 1190652 - RNA, 19 nt, Homo sapiens
ggggaagacuggacuauuu

SEQ ID NO: 1190653 - RNA, 19 nt, Homo sapiens
gaagcagaaugcacugaca

SEQ ID NO: 1190654 - RNA, 19 nt, Homo sapiens
aggaacaacugcacuuuau

SEQ ID NO: 1190655 - RNA, 19 nt, Homo sapiens
cgagucaucuuuaguagag

SEQ ID NO: 1190656 - RNA, 19 nt, Homo sapiens
ucucuacucuggcuacaaa

SEQ ID NO: 1190657 - RNA, 19 nt, Homo sapiens
ucuauugccuuccagcuuu

SEQ ID NO: 1190658 - RNA, 19 nt, Homo sapiens
ugaagaauauccacaucug

SEQ ID NO: 1190659 - RNA, 19 nt, Homo sapiens
ggaaagagggaacaaggau

SEQ ID NO: 1190660 - RNA, 19 nt, Homo sapiens
agauauaccuccucuuaca

SEQ ID NO: 1190661 - RNA, 19 nt, Homo sapiens
ggacaauguguguauaaau

SEQ ID NO: 1190662 - RNA, 19 nt, Homo sapiens
cuaccgagaucauaaugug

SEQ ID NO: 1190663 - RNA, 19 nt, Homo sapiens
ggaagaguucagacacuaa

SEQ ID NO: 1190664 - RNA, 19 nt, Homo sapiens
guuguucacucacacuauu

SEQ ID NO: 1190665 - RNA, 19 nt, Homo sapiens
uaccuccucuuacagauaa

SEQ ID NO: 1190666 - RNA, 19 nt, Homo sapiens
ugaaaccacugcagaagca

SEQ ID NO: 1190667 - RNA, 19 nt, Homo sapiens
guauauccuucccaucuau

SEQ ID NO: 1190668 - RNA, 19 nt, Homo sapiens
acugaaagcuccuucuaau

SEQ ID NO: 1190669 - RNA, 19 nt, Homo sapiens
caacuaucacaaaggaaua

SEQ ID NO: 1190670 - RNA, 19 nt, Homo sapiens
caacggugauucaggaucu

SEQ ID NO: 1190671 - RNA, 19 nt, Homo sapiens
caagauacuuuuagugcua

SEQ ID NO: 1190672 - RNA, 19 nt, Homo sapiens
gaugauaaacgacacaaag

SEQ ID NO: 1190673 - RNA, 19 nt, Homo sapiens
ggaauucagagaguacuuu

SEQ ID NO: 1190674 - RNA, 19 nt, Homo sapiens
aaaggacaauguguguaua

SEQ ID NO: 1190675 - RNA, 19 nt, Homo sapiens
guaauucucguguccaaga

SEQ ID NO: 1190676 - RNA, 19 nt, Homo sapiens
gcagauugcaugaacugaa

SEQ ID NO: 1190677 - RNA, 19 nt, Homo sapiens
aacuaagccucucaagaua

SEQ ID NO: 1190678 - RNA, 19 nt, Homo sapiens
gaguuacaccucguuauaa

SEQ ID NO: 1190679 - RNA, 19 nt, Homo sapiens
gaucugacccagcuacugu

SEQ ID NO: 1190680 - RNA, 19 nt, Homo sapiens
caggaacaacugcacuuua

SEQ ID NO: 1190681 - RNA, 19 nt, Homo sapiens
gagaagagcuguuaucuau

SEQ ID NO: 1190682 - RNA, 19 nt, Homo sapiens
gaacugagggugaaauaua

SEQ ID NO: 1190683 - RNA, 19 nt, Homo sapiens
gaagagcuguuaucuauuc

SEQ ID NO: 1190684 - RNA, 19 nt, Homo sapiens
gaucaacauucucuucuaa

SEQ ID NO: 1190685 - RNA, 19 nt, Homo sapiens
gaagauggauauacucaau

SEQ ID NO: 1190686 - RNA, 19 nt, Homo sapiens
uuaaauagcucagagagua

SEQ ID NO: 1190687 - RNA, 19 nt, Homo sapiens
ggaaacugcucucauagga

SEQ ID NO: 1190688 - RNA, 19 nt, Homo sapiens
caagaacaauggaauauca

SEQ ID NO: 1190689 - RNA, 19 nt, Homo sapiens
gaaaagagcucccaaaugc

SEQ ID NO: 1190690 - RNA, 19 nt, Homo sapiens
caggauagcuguuguuuca

SEQ ID NO: 1190691 - RNA, 19 nt, Homo sapiens
gauagggucucacuuuguu

SEQ ID NO: 1190692 - RNA, 19 nt, Homo sapiens
cagcugaggucaagauaaa

SEQ ID NO: 1190693 - RNA, 19 nt, Homo sapiens
agaaauaugugagguagua

SEQ ID NO: 1190694 - RNA, 19 nt, Homo sapiens
uagggaaacugcucucaua

SEQ ID NO: 1190695 - RNA, 19 nt, Homo sapiens
ggaauccuaugcuugguaa

SEQ ID NO: 1190696 - RNA, 19 nt, Homo sapiens
gugcugauuugucuuauuu

SEQ ID NO: 1190697 - RNA, 19 nt, Homo sapiens
aaacugcucucauaggaaa

SEQ ID NO: 1190698 - RNA, 19 nt, Homo sapiens
ggagaaggagagagaaaua

SEQ ID NO: 1190699 - RNA, 19 nt, Homo sapiens
gaagggagaggcugugauu

SEQ ID NO: 1190700 - RNA, 19 nt, Homo sapiens
cugaauagcuaaaugaaga

SEQ ID NO: 1190701 - RNA, 19 nt, Homo sapiens
gaggaaggguggagaagga

SEQ ID NO: 1190702 - RNA, 19 nt, Homo sapiens
gaaaacccaucuccaaauu

SEQ ID NO: 1190703 - RNA, 19 nt, Homo sapiens
ggauagcuguuguuucaga

SEQ ID NO: 1190704 - RNA, 19 nt, Homo sapiens
ucaaagcaauaccaggaua

SEQ ID NO: 1190705 - RNA, 19 nt, Homo sapiens
ccaaguagcugggauuaca

SEQ ID NO: 1190706 - RNA, 19 nt, Homo sapiens
gagaguacaucugccauau

SEQ ID NO: 1190707 - RNA, 19 nt, Homo sapiens
ggaucaacauucucuucua

SEQ ID NO: 1190708 - RNA, 19 nt, Homo sapiens
gagaagaaguuuucaaugu

SEQ ID NO: 1190709 - RNA, 19 nt, Homo sapiens
gaggauggaucaacauucu

SEQ ID NO: 1190710 - RNA, 19 nt, Homo sapiens
gaguacaucugccauaucu

SEQ ID NO: 1190711 - RNA, 19 nt, Homo sapiens
cagguaggcuaguauuauu

SEQ ID NO: 1190712 - RNA, 19 nt, Homo sapiens
uuacaguccucuaauguug

SEQ ID NO: 1190713 - RNA, 19 nt, Homo sapiens
gagaggcugugauuucugu

SEQ ID NO: 1190714 - RNA, 19 nt, Homo sapiens
ggaugaagauggauauacu

SEQ ID NO: 1190715 - RNA, 19 nt, Homo sapiens
auagacagcucaaaugaau

SEQ ID NO: 1190716 - RNA, 19 nt, Homo sapiens
guuaguagaucccuagaca

SEQ ID NO: 1190717 - RNA, 19 nt, Homo sapiens
guagaucccuagacaugga

SEQ ID NO: 1190718 - RNA, 19 nt, Homo sapiens
caacuguaaucuuaaccaa

SEQ ID NO: 1190719 - RNA, 19 nt, Homo sapiens
aaacccaucuccaaauugu

SEQ ID NO: 1190720 - RNA, 19 nt, Homo sapiens
guaguaaggaggacagaaa

SEQ ID NO: 1190721 - RNA, 19 nt, Homo sapiens
caccacacccggcuaauuu

SEQ ID NO: 1190722 - RNA, 19 nt, Homo sapiens
gaaggagagagaaauaugu

SEQ ID NO: 1190723 - RNA, 19 nt, Homo sapiens
gagagaaauaugugaggua

SEQ ID NO: 1190724 - RNA, 19 nt, Homo sapiens
aaagagcucccaaaugcua

SEQ ID NO: 1190725 - RNA, 19 nt, Homo sapiens
gcuggcaacugggcucuaa

SEQ ID NO: 1190726 - RNA, 19 nt, Homo sapiens
aagcgaaucuuaauuucug

SEQ ID NO: 1190727 - RNA, 19 nt, Homo sapiens
ccaaagugcugggauuaca

SEQ ID NO: 1190728 - RNA, 19 nt, Homo sapiens
uauaugagaagagcuguua

SEQ ID NO: 1190729 - RNA, 19 nt, Homo sapiens
agacaggguuucuccaugu

SEQ ID NO: 1190730 - RNA, 19 nt, Homo sapiens
gugcugggauuacagaugu

SEQ ID NO: 1190731 - RNA, 19 nt, Homo sapiens
agugugcccucauauagua

SEQ ID NO: 1190732 - RNA, 19 nt, Homo sapiens
aaccacagcuacccaagaa

SEQ ID NO: 1190733 - RNA, 19 nt, Homo sapiens
gaaccacagcuacccaaga

SEQ ID NO: 1190734 - RNA, 19 nt, Homo sapiens
gauagacagcucaaaugaa

SEQ ID NO: 1190735 - RNA, 19 nt, Homo sapiens
caaauuguguauggauuca

SEQ ID NO: 1190736 - RNA, 19 nt, Homo sapiens
guuaugaacugagggugaa

SEQ ID NO: 1190737 - RNA, 19 nt, Homo sapiens
caccaugccaggcuaauuu

SEQ ID NO: 1190738 - RNA, 19 nt, Homo sapiens
ccucauauaguauuuguga

SEQ ID NO: 1190739 - RNA, 19 nt, Homo sapiens
aaagauagacagcucaaau

SEQ ID NO: 1190740 - RNA, 19 nt, Homo sapiens
gcgccucauugcuguaauu

SEQ ID NO: 1190741 - RNA, 19 nt, Homo sapiens
gaaacugcucucauaggaa

SEQ ID NO: 1190742 - RNA, 19 nt, Homo sapiens
aaauuuggaugaagaugga

SEQ ID NO: 1190743 - RNA, 19 nt, Homo sapiens
ccaaccugauaauucauuu

SEQ ID NO: 1190744 - RNA, 19 nt, Homo sapiens
gcccuuguccuccuaauug

SEQ ID NO: 1190745 - RNA, 19 nt, Homo sapiens
agccuagaaucuuguauaa

SEQ ID NO: 1190746 - RNA, 19 nt, Homo sapiens
gcugugauuucuguauuug

SEQ ID NO: 1190747 - RNA, 19 nt, Homo sapiens
guagugugcccucauauag

SEQ ID NO: 1190748 - RNA, 19 nt, Homo sapiens
cagccuagaaucuuguaua

SEQ ID NO: 1190749 - RNA, 19 nt, Homo sapiens
gggagaggcugugauuucu

SEQ ID NO: 1190750 - RNA, 19 nt, Homo sapiens
uuggccaacuguaaucuua

SEQ ID NO: 1190751 - RNA, 19 nt, Homo sapiens
agacagcucaaaugaauug

SEQ ID NO: 1190752 - RNA, 19 nt, Homo sapiens
gagaaggagagagaaauau

SEQ ID NO: 1190753 - RNA, 19 nt, Homo sapiens
ccaaaugcuauaucuauca

SEQ ID NO: 1190754 - RNA, 19 nt, Homo sapiens
ggcugugauuucuguauuu

SEQ ID NO: 1190755 - RNA, 19 nt, Homo sapiens
gagcuuggccaacuguaau

SEQ ID NO: 1190756 - RNA, 19 nt, Homo sapiens
caugugcugauuugucuua

SEQ ID NO: 1190757 - RNA, 19 nt, Homo sapiens
guacaucugccauaucucu

SEQ ID NO: 1190758 - RNA, 19 nt, Homo sapiens
gaaaauguuuagagagcuu

SEQ ID NO: 1190759 - RNA, 19 nt, Homo sapiens
gaaaacagaacagaaaaga

SEQ ID NO: 1190760 - RNA, 19 nt, Homo sapiens
gcucccaaaugcuauaucu

SEQ ID NO: 1190761 - RNA, 19 nt, Homo sapiens
uguguagugugcccucaua

SEQ ID NO: 1190762 - RNA, 19 nt, Homo sapiens
ucacgugucagucauuuau

SEQ ID NO: 1190763 - RNA, 19 nt, Homo sapiens
caacauucucuucuaacuu

SEQ ID NO: 1190764 - RNA, 19 nt, Homo sapiens
aaaguaaccaaccucauug

SEQ ID NO: 1190765 - RNA, 19 nt, Homo sapiens
gaaauaugugagguaguaa

SEQ ID NO: 1190766 - RNA, 19 nt, Homo sapiens
caaaugcuauaucuaucag

SEQ ID NO: 1190767 - RNA, 19 nt, Homo sapiens
gcucaaaugaauugggauu

SEQ ID NO: 1190768 - RNA, 19 nt, Homo sapiens
cuauucagcaugucacuaa

SEQ ID NO: 1190769 - RNA, 19 nt, Homo sapiens
ugagaagagcuguuaucua

SEQ ID NO: 1190770 - RNA, 19 nt, Homo sapiens
caaccucauuggaacaagu

SEQ ID NO: 1190771 - RNA, 19 nt, Homo sapiens
gaacuccugaccucaagug

SEQ ID NO: 1190772 - RNA, 19 nt, Homo sapiens
cucauuggaacaaguauua

SEQ ID NO: 1190773 - RNA, 19 nt, Homo sapiens
gcacccagccuagaaucuu

SEQ ID NO: 1190774 - RNA, 19 nt, Homo sapiens
ucuagcaguauaucaguua

SEQ ID NO: 1190775 - RNA, 19 nt, Homo sapiens
ucucaagaacaauggaaua

SEQ ID NO: 1190776 - RNA, 19 nt, Homo sapiens
uaacagcugaggucaagau

SEQ ID NO: 1190777 - RNA, 19 nt, Homo sapiens
agauagacagcucaaauga

SEQ ID NO: 1190778 - RNA, 19 nt, Homo sapiens
ccucauugcuguaauuuug

SEQ ID NO: 1190779 - RNA, 19 nt, Homo sapiens
uuagagagcuuggccaacu

SEQ ID NO: 1190780 - RNA, 19 nt, Homo sapiens
gcugaggucaagauaaaug

SEQ ID NO: 1190781 - RNA, 19 nt, Homo sapiens
gaggagggcuaccggacua

SEQ ID NO: 1190782 - RNA, 19 nt, Homo sapiens
caucaacccugucaucuac

SEQ ID NO: 1190783 - RNA, 19 nt, Homo sapiens
cuaggaauguggacgcuuu

SEQ ID NO: 1190784 - RNA, 19 nt, Homo sapiens
gcguggcgcucaucucguu

SEQ ID NO: 1190785 - RNA, 19 nt, Homo sapiens
cauccgcaaucccaacauu

SEQ ID NO: 1190786 - RNA, 19 nt, Homo sapiens
ucaucucguuggaccguua

SEQ ID NO: 1190787 - RNA, 19 nt, Homo sapiens
ccaucaacccugucaucua

SEQ ID NO: 1190788 - RNA, 19 nt, Homo sapiens
caacauuucgaugcuccua

SEQ ID NO: 1190789 - RNA, 19 nt, Homo sapiens
gcaaucccaacauuucgau

SEQ ID NO: 1190790 - RNA, 19 nt, Homo sapiens
caucuacgccauccgcaau

SEQ ID NO: 1190791 - RNA, 19 nt, Homo sapiens
ccaccaccguccucaucau

SEQ ID NO: 1190792 - RNA, 19 nt, Homo sapiens
cagcgagcauggccuuacu

SEQ ID NO: 1190793 - RNA, 19 nt, Homo sapiens
caucuaaccuuuccuguuu

SEQ ID NO: 1190794 - RNA, 19 nt, Homo sapiens
gggcauggacuguaucuua

SEQ ID NO: 1190795 - RNA, 19 nt, Homo sapiens
cuaguacacuuuagcaaua

SEQ ID NO: 1190796 - RNA, 19 nt, Homo sapiens
gcacuuaucacacuguauu

SEQ ID NO: 1190797 - RNA, 19 nt, Homo sapiens
ccucaagugugaugccuua

SEQ ID NO: 1190798 - RNA, 19 nt, Homo sapiens
cacaguaggcgcucaauaa

SEQ ID NO: 1190799 - RNA, 19 nt, Homo sapiens
caagugugaugccuuacaa

SEQ ID NO: 1190800 - RNA, 19 nt, Homo sapiens
ucuagacugugaauccuua

SEQ ID NO: 1190801 - RNA, 19 nt, Homo sapiens
aguaggcgcucaauaaaug

SEQ ID NO: 1190802 - RNA, 19 nt, Homo sapiens
ggcauggacuguaucuuau

SEQ ID NO: 1190803 - RNA, 19 nt, Homo sapiens
acagagccauuccuaagaa

SEQ ID NO: 1190804 - RNA, 19 nt, Homo sapiens
ugaaggauaugcacaagag

SEQ ID NO: 1190805 - RNA, 19 nt, Homo sapiens
acacucaucuggcccuuug

SEQ ID NO: 1190806 - RNA, 19 nt, Homo sapiens
acaguggccucaaguguga

SEQ ID NO: 1190807 - RNA, 19 nt, Homo sapiens
cggaaucgcuacccuaaag

SEQ ID NO: 1190808 - RNA, 19 nt, Homo sapiens
gacuguaucuuaugcaucu

SEQ ID NO: 1190809 - RNA, 19 nt, Homo sapiens
gugcaggcuuccauugaaa

SEQ ID NO: 1190810 - RNA, 19 nt, Homo sapiens
gcaguuugccagccauauu

SEQ ID NO: 1190811 - RNA, 19 nt, Homo sapiens
ggccgaugcuguauucuca

SEQ ID NO: 1190812 - RNA, 19 nt, Homo sapiens
uuaagggcauggacuguau

SEQ ID NO: 1190813 - RNA, 19 nt, Homo sapiens
ugucaaugcuucucuugug

SEQ ID NO: 1190814 - RNA, 19 nt, Homo sapiens
gaggagaaccugggcuuug

SEQ ID NO: 1190815 - RNA, 19 nt, Homo sapiens
gacagagccauuccuaaga

SEQ ID NO: 1190816 - RNA, 19 nt, Homo sapiens
caagcaagacaugcaguuu

SEQ ID NO: 1190817 - RNA, 19 nt, Homo sapiens
caacuacagcuaccucauc

SEQ ID NO: 1190818 - RNA, 19 nt, Homo sapiens
acaguaggcgcucaauaaa

SEQ ID NO: 1190819 - RNA, 19 nt, Homo sapiens
ccaccagacuaguuagagu

SEQ ID NO: 1190820 - RNA, 19 nt, Homo sapiens
ccgaugcuguauucucauu

SEQ ID NO: 1190821 - RNA, 19 nt, Homo sapiens
aauaccaccagacuaguua

SEQ ID NO: 1190822 - RNA, 19 nt, Homo sapiens
gcacaucuggccugguugu

SEQ ID NO: 1190823 - RNA, 19 nt, Homo sapiens
uugcacaucuggccugguu

SEQ ID NO: 1190824 - RNA, 19 nt, Homo sapiens
ugagcucacuggacacugu

SEQ ID NO: 1190825 - RNA, 19 nt, Homo sapiens
gcugugggcggaccuuuga

SEQ ID NO: 1190826 - RNA, 19 nt, Homo sapiens
caauaccaccagacuaguu

SEQ ID NO: 1190827 - RNA, 19 nt, Homo sapiens
caucuggcccuuugcaguu

SEQ ID NO: 1190828 - RNA, 19 nt, Homo sapiens
agacagagccauuccuaag

SEQ ID NO: 1190829 - RNA, 19 nt, Homo sapiens
ucagacagagccauuccua

SEQ ID NO: 1190830 - RNA, 19 nt, Homo sapiens
gaucaggcgaugagacugu

SEQ ID NO: 1190831 - RNA, 19 nt, Homo sapiens
cuacaacccguuccugaga

SEQ ID NO: 1190832 - RNA, 19 nt, Homo sapiens
agcaagacaugcaguuuca

SEQ ID NO: 1190833 - RNA, 19 nt, Homo sapiens
cauauucccaugugauuuc

SEQ ID NO: 1190834 - RNA, 19 nt, Homo sapiens
gaugcuguauucucauuuu

SEQ ID NO: 1190835 - RNA, 19 nt, Homo sapiens
uaucuuaugcaucucugua

SEQ ID NO: 1190836 - RNA, 19 nt, Homo sapiens
acagcuaccucaucaucga

SEQ ID NO: 1190837 - RNA, 19 nt, Homo sapiens
ugugcaggcuuccauugaa

SEQ ID NO: 1190838 - RNA, 19 nt, Homo sapiens
gcacacaguaggcgcucaa

SEQ ID NO: 1190839 - RNA, 19 nt, Homo sapiens
gggucgagaucccuuugga

SEQ ID NO: 1190840 - RNA, 19 nt, Homo sapiens
gccauauucccaugugauu

SEQ ID NO: 1190841 - RNA, 19 nt, Homo sapiens
cugagacucugcccucuuc

SEQ ID NO: 1190842 - RNA, 19 nt, Homo sapiens
caggaggccucaucucacu

SEQ ID NO: 1190843 - RNA, 19 nt, Homo sapiens
ugccuucgcucaugcuguu

SEQ ID NO: 1190844 - RNA, 19 nt, Homo sapiens
gaacacugaagggcuggaa

SEQ ID NO: 1190845 - RNA, 19 nt, Homo sapiens
ggagggaucaggcgaugag

SEQ ID NO: 1190846 - RNA, 19 nt, Homo sapiens
acacaguaggcgcucaaua

SEQ ID NO: 1190847 - RNA, 19 nt, Homo sapiens
ucuuaugcaucucuguauu

SEQ ID NO: 1190848 - RNA, 19 nt, Homo sapiens
gcauggacuguaucuuaug

SEQ ID NO: 1190849 - RNA, 19 nt, Homo sapiens
cagccucuaguacacuuua

SEQ ID NO: 1190850 - RNA, 19 nt, Homo sapiens
ucacaguggccucaagugu

SEQ ID NO: 1190851 - RNA, 19 nt, Homo sapiens
ccaagcaagacaugcaguu

SEQ ID NO: 1190852 - RNA, 19 nt, Homo sapiens
ccagccauauucccaugug

SEQ ID NO: 1190853 - RNA, 19 nt, Homo sapiens
cggcugcucuuccgaaucg

SEQ ID NO: 1190854 - RNA, 19 nt, Homo sapiens
caggucacaugcucuccuu

SEQ ID NO: 1190855 - RNA, 19 nt, Homo sapiens
gcugaaggauaugcacaag

SEQ ID NO: 1190856 - RNA, 19 nt, Homo sapiens
uacaacccguuccugagaa

SEQ ID NO: 1190857 - RNA, 19 nt, Homo sapiens
cuuaugcaucucuguauuu

SEQ ID NO: 1190858 - RNA, 19 nt, Homo sapiens
cuacagcuaccucaucauc

SEQ ID NO: 1190859 - RNA, 19 nt, Homo sapiens
ggaggccucaucucacugu

SEQ ID NO: 1190860 - RNA, 19 nt, Homo sapiens
ccaccaacaccucaucauc

SEQ ID NO: 1190861 - RNA, 19 nt, Homo sapiens
gauaugcacaagagcaagu

SEQ ID NO: 1190862 - RNA, 19 nt, Homo sapiens
ggcuacaccuggccacaca

SEQ ID NO: 1190863 - RNA, 19 nt, Homo sapiens
ccaucuaaccuuuccuguu

SEQ ID NO: 1190864 - RNA, 19 nt, Homo sapiens
cauccaugguugggaaaga

SEQ ID NO: 1190865 - RNA, 19 nt, Homo sapiens
augcaucucuguauuucug

SEQ ID NO: 1190866 - RNA, 19 nt, Homo sapiens
uuaugcaucucuguauuuc

SEQ ID NO: 1190867 - RNA, 19 nt, Homo sapiens
aacuacagcuaccucauca

SEQ ID NO: 1190868 - RNA, 19 nt, Homo sapiens
cagacagagccauuccuaa

SEQ ID NO: 1190869 - RNA, 19 nt, Homo sapiens
gucaggaggccucaucuca

SEQ ID NO: 1190870 - RNA, 19 nt, Homo sapiens
uggcacuuaucacacugua

SEQ ID NO: 1190871 - RNA, 19 nt, Homo sapiens
uagcaauaccaccagacua

SEQ ID NO: 1190872 - RNA, 19 nt, Homo sapiens
caaaagcaccacucagaug

SEQ ID NO: 1190873 - RNA, 19 nt, Homo sapiens
cagccauauucccauguga

SEQ ID NO: 1190874 - RNA, 19 nt, Homo sapiens
ucuguaaccugacacucau

SEQ ID NO: 1190875 - RNA, 19 nt, Homo sapiens
acacugaagggcuggaaug

SEQ ID NO: 1190876 - RNA, 19 nt, Homo sapiens
caguaggcgcucaauaaau

SEQ ID NO: 1190877 - RNA, 19 nt, Homo sapiens
gguuggaaaucagaagucu

SEQ ID NO: 1190878 - RNA, 19 nt, Homo sapiens
ucuaaccuuuccuguuuua

SEQ ID NO: 1190879 - RNA, 19 nt, Homo sapiens
gaggccucaucucacugua

SEQ ID NO: 1190880 - RNA, 19 nt, Homo sapiens
cacaaggccaucuggucua

SEQ ID NO: 1190881 - RNA, 19 nt, Homo sapiens
cauggacuguaucuuaugc

SEQ ID NO: 1190882 - RNA, 19 nt, Homo sapiens
caaguucaucucucacgau

SEQ ID NO: 1190883 - RNA, 19 nt, Homo sapiens
gcaauaccaccagacuagu

SEQ ID NO: 1190884 - RNA, 19 nt, Homo sapiens
ucuaguacacuuuagcaau

SEQ ID NO: 1190885 - RNA, 19 nt, Homo sapiens
ccauauucccaugugauuu

SEQ ID NO: 1190886 - RNA, 19 nt, Homo sapiens
caucaacggcaagaggaaa

SEQ ID NO: 1190887 - RNA, 19 nt, Homo sapiens
ucauccuucucaucgcuaa

SEQ ID NO: 1190888 - RNA, 19 nt, Homo sapiens
ucaccuuggucgccauucu

SEQ ID NO: 1190889 - RNA, 19 nt, Homo sapiens
aagcaagacaugcaguuuc

SEQ ID NO: 1190890 - RNA, 19 nt, Homo sapiens
caccagacuaguuagaguu

SEQ ID NO: 1190891 - RNA, 19 nt, Homo sapiens
cacagccucuaguacacuu

SEQ ID NO: 1190892 - RNA, 19 nt, Homo sapiens
ugacgaagaugaagacaug

SEQ ID NO: 1190893 - RNA, 19 nt, Homo sapiens
caagauugcugagauccua

SEQ ID NO: 1190894 - RNA, 19 nt, Homo sapiens
gcacaggaacuaaaggaaa

SEQ ID NO: 1190895 - RNA, 19 nt, Homo sapiens
gcuguuggaugacauaaug

SEQ ID NO: 1190896 - RNA, 19 nt, Homo sapiens
ggguaaauguggauuguau

SEQ ID NO: 1190897 - RNA, 19 nt, Homo sapiens
gaauacagggcuucucauu

SEQ ID NO: 1190898 - RNA, 19 nt, Homo sapiens
gaagagaagcaucguguuc

SEQ ID NO: 1190899 - RNA, 19 nt, Homo sapiens
uugcugagauccuauguaa

SEQ ID NO: 1190900 - RNA, 19 nt, Homo sapiens
guuguugaguugaauauga

SEQ ID NO: 1190901 - RNA, 19 nt, Homo sapiens
uaacaagauugcugagauc

SEQ ID NO: 1190902 - RNA, 19 nt, Homo sapiens
caacagcagccuuaacuuc

SEQ ID NO: 1190903 - RNA, 19 nt, Homo sapiens
aaauguggauuguauggaa

SEQ ID NO: 1190904 - RNA, 19 nt, Homo sapiens
ggaugaagccaccugaaga

SEQ ID NO: 1190905 - RNA, 19 nt, Homo sapiens
gcaauccccugcaauacua

SEQ ID NO: 1190906 - RNA, 19 nt, Homo sapiens
cuaacaagauugcugagau

SEQ ID NO: 1190907 - RNA, 19 nt, Homo sapiens
uaauacagcagaacuccua

SEQ ID NO: 1190908 - RNA, 19 nt, Homo sapiens
aggaauaucuggugaacau

SEQ ID NO: 1190909 - RNA, 19 nt, Homo sapiens
aaagagaucgagucacaaa

SEQ ID NO: 1190910 - RNA, 19 nt, Homo sapiens
uaaagugauuaccaaggaa

SEQ ID NO: 1190911 - RNA, 19 nt, Homo sapiens
uggauuguauggaaugaaa

SEQ ID NO: 1190912 - RNA, 19 nt, Homo sapiens
gaauaucuggugaacauca

SEQ ID NO: 1190913 - RNA, 19 nt, Homo sapiens
auaaagugauuaccaagga

SEQ ID NO: 1190914 - RNA, 19 nt, Homo sapiens
gcugagauccuauguaagg

SEQ ID NO: 1190915 - RNA, 19 nt, Homo sapiens
gaagacaugcugagcuaca

SEQ ID NO: 1190916 - RNA, 19 nt, Homo sapiens
ccugaucacugacgaagau

SEQ ID NO: 1190917 - RNA, 19 nt, Homo sapiens
gaccacaacuucgcaggau

SEQ ID NO: 1190918 - RNA, 19 nt, Homo sapiens
caccacaacagcagccuua

SEQ ID NO: 1190919 - RNA, 19 nt, Homo sapiens
gaucacugacgaagaugaa

SEQ ID NO: 1190920 - RNA, 19 nt, Homo sapiens
gccuggagguggaagaaga

SEQ ID NO: 1190921 - RNA, 19 nt, Homo sapiens
augaagacaugcugagcua

SEQ ID NO: 1190922 - RNA, 19 nt, Homo sapiens
ggacggcaguacucagcau

SEQ ID NO: 1190923 - RNA, 19 nt, Homo sapiens
caaggaauaucuggugaac

SEQ ID NO: 1190924 - RNA, 19 nt, Homo sapiens
guacucagcauggucuuau

SEQ ID NO: 1190925 - RNA, 19 nt, Homo sapiens
ucugcaagaucauguuguu

SEQ ID NO: 1190926 - RNA, 19 nt, Homo sapiens
agugguauccggauuauga

SEQ ID NO: 1190927 - RNA, 19 nt, Homo sapiens
cagcagccuuaacuucuuc

SEQ ID NO: 1190928 - RNA, 19 nt, Homo sapiens
guaaauguggauuguaugg

SEQ ID NO: 1190929 - RNA, 19 nt, Homo sapiens
guauccggauuaugaagug

SEQ ID NO: 1190930 - RNA, 19 nt, Homo sapiens
auacagggcuucucauucc

SEQ ID NO: 1190931 - RNA, 19 nt, Homo sapiens
caacuucgcaggaucuaac

SEQ ID NO: 1190932 - RNA, 19 nt, Homo sapiens
ugagugguauccggauuau

SEQ ID NO: 1190933 - RNA, 19 nt, Homo sapiens
gaugaagccaccugaagag

SEQ ID NO: 1190934 - RNA, 19 nt, Homo sapiens
acagcagccuuaacuucuu

SEQ ID NO: 1190935 - RNA, 19 nt, Homo sapiens
cagaauaaagugauuacca

SEQ ID NO: 1190936 - RNA, 19 nt, Homo sapiens
ggagguggaagaagagaag

SEQ ID NO: 1190937 - RNA, 19 nt, Homo sapiens
cacaggaacuaaaggaaaa

SEQ ID NO: 1190938 - RNA, 19 nt, Homo sapiens
gaagcaucguguucaucuc

SEQ ID NO: 1190939 - RNA, 19 nt, Homo sapiens
agagaagcaucguguucau

SEQ ID NO: 1190940 - RNA, 19 nt, Homo sapiens
gagcuggagccgguuaaug

SEQ ID NO: 1190941 - RNA, 19 nt, Homo sapiens
cuucugggccaauguuauu

SEQ ID NO: 1190942 - RNA, 19 nt, Homo sapiens
ucucauuccacuccaauug

SEQ ID NO: 1190943 - RNA, 19 nt, Homo sapiens
ccaaggaauaucuggugaa

SEQ ID NO: 1190944 - RNA, 19 nt, Homo sapiens
ccaguuguugaguugaaua

SEQ ID NO: 1190945 - RNA, 19 nt, Homo sapiens
ucacugacgaagaugaaga

SEQ ID NO: 1190946 - RNA, 19 nt, Homo sapiens
gaggaugaagccaccugaa

SEQ ID NO: 1190947 - RNA, 19 nt, Homo sapiens
gcaccgccuucaggaugga

SEQ ID NO: 1190948 - RNA, 19 nt, Homo sapiens
agccuuaacuucuucaacu

SEQ ID NO: 1190949 - RNA, 19 nt, Homo sapiens
cacaacagcagccuuaacu

SEQ ID NO: 1190950 - RNA, 19 nt, Homo sapiens
gccuuaacuucuucaacug

SEQ ID NO: 1190951 - RNA, 19 nt, Homo sapiens
cuuccagaauaaagugauu

SEQ ID NO: 1190952 - RNA, 19 nt, Homo sapiens
gguaaauguggauuguaug

SEQ ID NO: 1190953 - RNA, 19 nt, Homo sapiens
gagcaucagauuuuaccua

SEQ ID NO: 1190954 - RNA, 19 nt, Homo sapiens
ccacaacuucgcaggaucu

SEQ ID NO: 1190955 - RNA, 19 nt, Homo sapiens
ucccaguuguugaguugaa

SEQ ID NO: 1190956 - RNA, 19 nt, Homo sapiens
cggugcugcuguuggauga

SEQ ID NO: 1190957 - RNA, 19 nt, Homo sapiens
gagaagcaucguguucauc

SEQ ID NO: 1190958 - RNA, 19 nt, Homo sapiens
gcacagcaccugccaaaua

SEQ ID NO: 1190959 - RNA, 19 nt, Homo sapiens
gacauuaccuccauucuga

SEQ ID NO: 1190960 - RNA, 19 nt, Homo sapiens
gcaaggacauuaccuccau

SEQ ID NO: 1190961 - RNA, 19 nt, Homo sapiens
ccagggauuuguacucauu

SEQ ID NO: 1190962 - RNA, 19 nt, Homo sapiens
uaccuuaccuugccuccua

SEQ ID NO: 1190963 - RNA, 19 nt, Homo sapiens
caggaccgcuuccgcauug

SEQ ID NO: 1190964 - RNA, 19 nt, Homo sapiens
gcauugacauugugauucg

SEQ ID NO: 1190965 - RNA, 19 nt, Homo sapiens
ggacauuaccuccauucug

SEQ ID NO: 1190966 - RNA, 19 nt, Homo sapiens
cuccuacccucuucucuuu

SEQ ID NO: 1190967 - RNA, 19 nt, Homo sapiens
caaggacauuaccuccauu

SEQ ID NO: 1190968 - RNA, 19 nt, Homo sapiens
cacagcaccugccaaauac

SEQ ID NO: 1190969 - RNA, 19 nt, Homo sapiens
cugugaugcucauaccuua

SEQ ID NO: 1190970 - RNA, 19 nt, Homo sapiens
aaacacccagggauuugua

SEQ ID NO: 1190971 - RNA, 19 nt, Homo sapiens
guacucauuuuccaaguug

SEQ ID NO: 1190972 - RNA, 19 nt, Homo sapiens
gcuccuuccuccucuucuu

SEQ ID NO: 1190973 - RNA, 19 nt, Homo sapiens
gagcucugcccucggaugu

SEQ ID NO: 1190974 - RNA, 19 nt, Homo sapiens
agucuugcauugacauugu

SEQ ID NO: 1190975 - RNA, 19 nt, Homo sapiens
ugaggcagccacugugaug

SEQ ID NO: 1190976 - RNA, 19 nt, Homo sapiens
ugagcugucugaggaagga

SEQ ID NO: 1190977 - RNA, 19 nt, Homo sapiens
uccgggagcucaucuuguc

SEQ ID NO: 1190978 - RNA, 19 nt, Homo sapiens
gugggacgcaaggacauua

SEQ ID NO: 1190979 - RNA, 19 nt, Homo sapiens
ugacggggauugugucugu

SEQ ID NO: 1190980 - RNA, 19 nt, Homo sapiens
ugacgcagagggauaugug

SEQ ID NO: 1190981 - RNA, 19 nt, Homo sapiens
ccaggaccgcuuccgcauu

SEQ ID NO: 1190982 - RNA, 19 nt, Homo sapiens
gagcguggaugacuacuga

SEQ ID NO: 1190983 - RNA, 19 nt, Homo sapiens
ccuaugauguccacgauua

SEQ ID NO: 1190984 - RNA, 19 nt, Homo sapiens
ggaagugguucuacaagga

SEQ ID NO: 1190985 - RNA, 19 nt, Homo sapiens
gaaaugggcaccuuugaug

SEQ ID NO: 1190986 - RNA, 19 nt, Homo sapiens
gcuggaagccaaagaauuu

SEQ ID NO: 1190987 - RNA, 19 nt, Homo sapiens
cggaagagcugcaggacaa

SEQ ID NO: 1190988 - RNA, 19 nt, Homo sapiens
gaagaaaugggcaccuuug

SEQ ID NO: 1190989 - RNA, 19 nt, Homo sapiens
ccggagaucuggaggauga

SEQ ID NO: 1190990 - RNA, 19 nt, Homo sapiens
aauacaagcuggcugacua

SEQ ID NO: 1190991 - RNA, 19 nt, Homo sapiens
caaggugggucccggaaga

SEQ ID NO: 1190992 - RNA, 19 nt, Homo sapiens
gauagugggugugacaaug

SEQ ID NO: 1190993 - RNA, 19 nt, Homo sapiens
cgaugaggaugaagaaaug

SEQ ID NO: 1190994 - RNA, 19 nt, Homo sapiens
ccaaagaagcaucgaagaa

SEQ ID NO: 1190995 - RNA, 19 nt, Homo sapiens
aaacacacgaugcaccuua

SEQ ID NO: 1190996 - RNA, 19 nt, Homo sapiens
ggacgaugaggaugaagaa

SEQ ID NO: 1190997 - RNA, 19 nt, Homo sapiens
gcgcaaguuugaauuugau

SEQ ID NO: 1190998 - RNA, 19 nt, Homo sapiens
ccacgaggcacuuuacaga

SEQ ID NO: 1190999 - RNA, 19 nt, Homo sapiens
ggcgcaaguuugaauuuga

SEQ ID NO: 1191000 - RNA, 19 nt, Homo sapiens
caaagaagcaucgaagaag

SEQ ID NO: 1191001 - RNA, 19 nt, Homo sapiens
gcagagagcacaggaagag

SEQ ID NO: 1191002 - RNA, 19 nt, Homo sapiens
ggacucaucucuggguaac

SEQ ID NO: 1191003 - RNA, 19 nt, Homo sapiens
ggaggaggaagagcuguuu

SEQ ID NO: 1191004 - RNA, 19 nt, Homo sapiens
gcgaggugaucaagaugug

SEQ ID NO: 1191005 - RNA, 19 nt, Homo sapiens
gaagcgggaggaagaggaa

SEQ ID NO: 1191006 - RNA, 19 nt, Homo sapiens
aggaaaugcuggcucucua

SEQ ID NO: 1191007 - RNA, 19 nt, Homo sapiens
gagcagcccaucucucagu

SEQ ID NO: 1191008 - RNA, 19 nt, Homo sapiens
ggacgugcccauggcugua

SEQ ID NO: 1191009 - RNA, 19 nt, Homo sapiens
gaggauagugggugugaca

SEQ ID NO: 1191010 - RNA, 19 nt, Homo sapiens
ugaagaaaugggcaccuuu

SEQ ID NO: 1191011 - RNA, 19 nt, Homo sapiens
ggaagguccacagagguuu

SEQ ID NO: 1191012 - RNA, 19 nt, Homo sapiens
aacacacgaugcaccuuaa

SEQ ID NO: 1191013 - RNA, 19 nt, Homo sapiens
ucgagagcguggaugacua

SEQ ID NO: 1191014 - RNA, 19 nt, Homo sapiens
uaugauguccacgauuaua

SEQ ID NO: 1191015 - RNA, 19 nt, Homo sapiens
gaccaggagcggcugaaga

SEQ ID NO: 1191016 - RNA, 19 nt, Homo sapiens
gcccggaagugguucuaca

SEQ ID NO: 1191017 - RNA, 19 nt, Homo sapiens
gcucagacagcgagaacug

SEQ ID NO: 1191018 - RNA, 19 nt, Homo sapiens
gcaagcgucgagaggagaa

SEQ ID NO: 1191019 - RNA, 19 nt, Homo sapiens
aguggugccuggacgauga

SEQ ID NO: 1191020 - RNA, 19 nt, Homo sapiens
cggcgcaaguuugaauuug

SEQ ID NO: 1191021 - RNA, 19 nt, Homo sapiens
ggaaaugcuggcucucuac

SEQ ID NO: 1191022 - RNA, 19 nt, Homo sapiens
aagaagagaagcugcugaa

SEQ ID NO: 1191023 - RNA, 19 nt, Homo sapiens
cggagcagcccaucucuca

SEQ ID NO: 1191024 - RNA, 19 nt, Homo sapiens
agcagcagcucacggcauu

SEQ ID NO: 1191025 - RNA, 19 nt, Homo sapiens
gcggagggccaagcagaaa

SEQ ID NO: 1191026 - RNA, 19 nt, Homo sapiens
ggacacgcuggaagccaaa

SEQ ID NO: 1191027 - RNA, 19 nt, Homo sapiens
gagaucuggaggaugauga

SEQ ID NO: 1191028 - RNA, 19 nt, Homo sapiens
ggauagugggugugacaau

SEQ ID NO: 1191029 - RNA, 19 nt, Homo sapiens
gacagcacgauguggcuuu

SEQ ID NO: 1191030 - RNA, 19 nt, Homo sapiens
gacucgagcuucccaucuc

SEQ ID NO: 1191031 - RNA, 19 nt, Homo sapiens
agacggaggaagaagagaa

SEQ ID NO: 1191032 - RNA, 19 nt, Homo sapiens
ugggcgaggugaucaagau

SEQ ID NO: 1191033 - RNA, 19 nt, Homo sapiens
ugacucauacagccaccua

SEQ ID NO: 1191034 - RNA, 19 nt, Homo sapiens
ggacucgagcuucccaucu

SEQ ID NO: 1191035 - RNA, 19 nt, Homo sapiens
gcuuugaggaggacaagga

SEQ ID NO: 1191036 - RNA, 19 nt, Homo sapiens
cgaggaggguguggugaag

SEQ ID NO: 1191037 - RNA, 19 nt, Homo sapiens
gaggaaaugcuggcucucu

SEQ ID NO: 1191038 - RNA, 19 nt, Homo sapiens
agaaaugggcaccuuugau

SEQ ID NO: 1191039 - RNA, 19 nt, Homo sapiens
gggaugacagcacgaugug

SEQ ID NO: 1191040 - RNA, 19 nt, Homo sapiens
gacagcugcuuuuaccaaa

SEQ ID NO: 1191041 - RNA, 19 nt, Homo sapiens
ccuggacgaugaggaugaa

SEQ ID NO: 1191042 - RNA, 19 nt, Homo sapiens
aggagcggcugaagaagca

SEQ ID NO: 1191043 - RNA, 19 nt, Homo sapiens
gccgaaaggacucgagcuu

SEQ ID NO: 1191044 - RNA, 19 nt, Homo sapiens
aagaaaugggcaccuuuga

SEQ ID NO: 1191045 - RNA, 19 nt, Homo sapiens
guuaugggcgagaggaaau

SEQ ID NO: 1191046 - RNA, 19 nt, Homo sapiens
gaacaacacugagauaguc

SEQ ID NO: 1191047 - RNA, 19 nt, Homo sapiens
gcagugaccucaacaagac

SEQ ID NO: 1191048 - RNA, 19 nt, Homo sapiens
gggcuacgguugcuacugu

SEQ ID NO: 1191049 - RNA, 19 nt, Homo sapiens
cgagaacaacacugagaua

SEQ ID NO: 1191050 - RNA, 19 nt, Homo sapiens
uaccguggcuuccucaaug

SEQ ID NO: 1191051 - RNA, 19 nt, Homo sapiens
ucaacaagacagaguguga

SEQ ID NO: 1191052 - RNA, 19 nt, Homo sapiens
caacugcagcaucuaugaa

SEQ ID NO: 1191053 - RNA, 19 nt, Homo sapiens
gagaacaacacugagauag

SEQ ID NO: 1191054 - RNA, 19 nt, Homo sapiens
ggagcgccauccuguccuu

SEQ ID NO: 1191055 - RNA, 19 nt, Homo sapiens
caagacagagugugacaag

SEQ ID NO: 1191056 - RNA, 19 nt, Homo sapiens
agacguaccgagaggagua

SEQ ID NO: 1191057 - RNA, 19 nt, Homo sapiens
ccaacugcagcaucuauga

SEQ ID NO: 1191058 - RNA, 19 nt, Homo sapiens
cgacugcugcuaccaggaa

SEQ ID NO: 1191059 - RNA, 19 nt, Homo sapiens
gaucacaccaucgagaaca

SEQ ID NO: 1191060 - RNA, 19 nt, Homo sapiens
ccaucgagaacaacacuga

SEQ ID NO: 1191061 - RNA, 19 nt, Homo sapiens
agacagagugugacaagca

SEQ ID NO: 1191062 - RNA, 19 nt, Homo sapiens
guggccagcccaaggauga

SEQ ID NO: 1191063 - RNA, 19 nt, Homo sapiens
ccaggaacucuuugaccaa

SEQ ID NO: 1191064 - RNA, 19 nt, Homo sapiens
gcccaacugcagcaucuau

SEQ ID NO: 1191065 - RNA, 19 nt, Homo sapiens
guaccguggcuuccucaau

SEQ ID NO: 1191066 - RNA, 19 nt, Homo sapiens
gcuaccaggaacucuuuga

SEQ ID NO: 1191067 - RNA, 19 nt, Homo sapiens
guggcuuccucaaugucua

SEQ ID NO: 1191068 - RNA, 19 nt, Homo sapiens
gggaagagcuagagaaguu

SEQ ID NO: 1191069 - RNA, 19 nt, Homo sapiens
gcacggagcuggccaucaa

SEQ ID NO: 1191070 - RNA, 19 nt, Homo sapiens
gcaggaagauggugcugua

SEQ ID NO: 1191071 - RNA, 19 nt, Homo sapiens
gcaaugaagugcuccagaa

SEQ ID NO: 1191072 - RNA, 19 nt, Homo sapiens
ggccagugcucgauauaua

SEQ ID NO: 1191073 - RNA, 19 nt, Homo sapiens
ggccacagcugacaagauu

SEQ ID NO: 1191074 - RNA, 19 nt, Homo sapiens
gaggaaaucuucaaaauug

SEQ ID NO: 1191075 - RNA, 19 nt, Homo sapiens
uagcagggcugucugguuu

SEQ ID NO: 1191076 - RNA, 19 nt, Homo sapiens
ccaucaagcugcuggagua

SEQ ID NO: 1191077 - RNA, 19 nt, Homo sapiens
cagcaucacucaaggagaa

SEQ ID NO: 1191078 - RNA, 19 nt, Homo sapiens
agaaggaugucucagauga

SEQ ID NO: 1191079 - RNA, 19 nt, Homo sapiens
gcuacaaggugcaacagaa

SEQ ID NO: 1191080 - RNA, 19 nt, Homo sapiens
caaugugggugaccucaaa

SEQ ID NO: 1191081 - RNA, 19 nt, Homo sapiens
ucaagcugcuggaguauga

SEQ ID NO: 1191082 - RNA, 19 nt, Homo sapiens
ggucaaggcuuugcuucuu

SEQ ID NO: 1191083 - RNA, 19 nt, Homo sapiens
ggaagauggugcuguacug

SEQ ID NO: 1191084 - RNA, 19 nt, Homo sapiens
ggaugacaaucaccaggaa

SEQ ID NO: 1191085 - RNA, 19 nt, Homo sapiens
ggagcaaacuggcacuaag

SEQ ID NO: 1191086 - RNA, 19 nt, Homo sapiens
gcucaccuauagccaauau

SEQ ID NO: 1191087 - RNA, 19 nt, Homo sapiens
gagcugaaccgaggagauu

SEQ ID NO: 1191088 - RNA, 19 nt, Homo sapiens
gagcugagccucguauugu

SEQ ID NO: 1191089 - RNA, 19 nt, Homo sapiens
ucaaggagaagcuauguga

SEQ ID NO: 1191090 - RNA, 19 nt, Homo sapiens
gcagaagggccauaguuca

SEQ ID NO: 1191091 - RNA, 19 nt, Homo sapiens
uggcagauuuggaagauug

SEQ ID NO: 1191092 - RNA, 19 nt, Homo sapiens
ggaucccgcucaccuauag

SEQ ID NO: 1191093 - RNA, 19 nt, Homo sapiens
gaaggaguaugagaaagag

SEQ ID NO: 1191094 - RNA, 19 nt, Homo sapiens
gagaagcuaugugaguuca

SEQ ID NO: 1191095 - RNA, 19 nt, Homo sapiens
ggaaauaugagcuguacag

SEQ ID NO: 1191096 - RNA, 19 nt, Homo sapiens
ggccugaccuuuaccucuu

SEQ ID NO: 1191097 - RNA, 19 nt, Homo sapiens
ccauugcacugcugaggaa

SEQ ID NO: 1191098 - RNA, 19 nt, Homo sapiens
guggagaucugcaugaaac

SEQ ID NO: 1191099 - RNA, 19 nt, Homo sapiens
gcaugaaacaacauaacaa

SEQ ID NO: 1191100 - RNA, 19 nt, Homo sapiens
gcacgagccuaugguugug

SEQ ID NO: 1191101 - RNA, 19 nt, Homo sapiens
acagaaggaugucucagau

SEQ ID NO: 1191102 - RNA, 19 nt, Homo sapiens
gccagaaggcggacgagua

SEQ ID NO: 1191103 - RNA, 19 nt, Homo sapiens
gagcaagaaaucacccauu

SEQ ID NO: 1191104 - RNA, 19 nt, Homo sapiens
ucagaaggaguaugagaaa

SEQ ID NO: 1191105 - RNA, 19 nt, Homo sapiens
ggaccgaguggcacacauu

SEQ ID NO: 1191106 - RNA, 19 nt, Homo sapiens
agcaagaaaucacccauug

SEQ ID NO: 1191107 - RNA, 19 nt, Homo sapiens
gcccauggcccucaguuug

SEQ ID NO: 1191108 - RNA, 19 nt, Homo sapiens
gaagcuaugugaguucaac

SEQ ID NO: 1191109 - RNA, 19 nt, Homo sapiens
ccauggcccucaguuugua

SEQ ID NO: 1191110 - RNA, 19 nt, Homo sapiens
caccagccauggacugcua

SEQ ID NO: 1191111 - RNA, 19 nt, Homo sapiens
agcagaaggucaaggcuuu

SEQ ID NO: 1191112 - RNA, 19 nt, Homo sapiens
gcgaggaaaucuucaaaau

SEQ ID NO: 1191113 - RNA, 19 nt, Homo sapiens
gagaaagcugcuaguguga

SEQ ID NO: 1191114 - RNA, 19 nt, Homo sapiens
ccagauaugcgaguacuug

SEQ ID NO: 1191115 - RNA, 19 nt, Homo sapiens
gcagggcugucugguuuua

SEQ ID NO: 1191116 - RNA, 19 nt, Homo sapiens
ucaaugcuguucgggacua

SEQ ID NO: 1191117 - RNA, 19 nt, Homo sapiens
ggacagcaucacucaagga

SEQ ID NO: 1191118 - RNA, 19 nt, Homo sapiens
gaucuuucacacugaguuu

SEQ ID NO: 1191119 - RNA, 19 nt, Homo sapiens
caaauacgaagccaagaag

SEQ ID NO: 1191120 - RNA, 19 nt, Homo sapiens
ucuacaaggccaagaauga

SEQ ID NO: 1191121 - RNA, 19 nt, Homo sapiens
ccacugggccugcuacaag

SEQ ID NO: 1191122 - RNA, 19 nt, Homo sapiens
agaaggaguaugagaaaga

SEQ ID NO: 1191123 - RNA, 19 nt, Homo sapiens
gugcuguacugguuuaugg

SEQ ID NO: 1191124 - RNA, 19 nt, Homo sapiens
gaaggucaaggcuuugcuu

SEQ ID NO: 1191125 - RNA, 19 nt, Homo sapiens
aauacgaagccaagaagua

SEQ ID NO: 1191126 - RNA, 19 nt, Homo sapiens
guaagcaucaggagcuaga

SEQ ID NO: 1191127 - RNA, 19 nt, Homo sapiens
ggaccugcgugugcucaau

SEQ ID NO: 1191128 - RNA, 19 nt, Homo sapiens
acaaauacgaagccaagaa

SEQ ID NO: 1191129 - RNA, 19 nt, Homo sapiens
ggaagagcuagagaaguuu

SEQ ID NO: 1191130 - RNA, 19 nt, Homo sapiens
ggaagauugggaagagcua

SEQ ID NO: 1191131 - RNA, 19 nt, Homo sapiens
gcagcuggcacgugacuuc

SEQ ID NO: 1191132 - RNA, 19 nt, Homo sapiens
aggaggaacucagggauug

SEQ ID NO: 1191133 - RNA, 19 nt, Homo sapiens
acaaucaggaugacaauca

SEQ ID NO: 1191134 - RNA, 19 nt, Homo sapiens
ccacagcugacaagauuca

SEQ ID NO: 1191135 - RNA, 19 nt, Homo sapiens
ggagaagcuaugugaguuc

SEQ ID NO: 1191136 - RNA, 19 nt, Homo sapiens
aggagaagcuaugugaguu

SEQ ID NO: 1191137 - RNA, 19 nt, Homo sapiens
agauggugcuguacugguu

SEQ ID NO: 1191138 - RNA, 19 nt, Homo sapiens
gcaagaaaucacccauugg

SEQ ID NO: 1191139 - RNA, 19 nt, Homo sapiens
ucaugacccuucggaauca

SEQ ID NO: 1191140 - RNA, 19 nt, Homo sapiens
gcagguaccccuucuccua

SEQ ID NO: 1191141 - RNA, 19 nt, Homo sapiens
gcaacagaaggaugucuca

SEQ ID NO: 1191142 - RNA, 19 nt, Homo sapiens
cuagagaaguuuuccaaga

SEQ ID NO: 1191143 - RNA, 19 nt, Homo sapiens
guacuugcgccuuccugaa

SEQ ID NO: 1191144 - RNA, 19 nt, Homo sapiens
gcugucugguuuuaaauaa

SEQ ID NO: 1191145 - RNA, 19 nt, Homo sapiens
ggagaucugcaugaaacaa

SEQ ID NO: 1191146 - RNA, 19 nt, Homo sapiens
guuaccacccucauucuug

SEQ ID NO: 1191147 - RNA, 19 nt, Homo sapiens
gcaaacuggcacuaagcaa

SEQ ID NO: 1191148 - RNA, 19 nt, Homo sapiens
ccgagagcauccaguuugu

SEQ ID NO: 1191149 - RNA, 19 nt, Homo sapiens
ugaggccagugcucgauau

SEQ ID NO: 1191150 - RNA, 19 nt, Homo sapiens
cagcaugggcaaugaagug

SEQ ID NO: 1191151 - RNA, 19 nt, Homo sapiens
auaagcagcucaccaucca

SEQ ID NO: 1191152 - RNA, 19 nt, Homo sapiens
ccagaaggcggacgaguac

SEQ ID NO: 1191153 - RNA, 19 nt, Homo sapiens
cccacgaguuccugcauga

SEQ ID NO: 1191154 - RNA, 19 nt, Homo sapiens
ggcagaagggccauaguuc

SEQ ID NO: 1191155 - RNA, 19 nt, Homo sapiens
gcaccugggcuuggcagaa

SEQ ID NO: 1191156 - RNA, 19 nt, Homo sapiens
gaggccagugcucgauaua

SEQ ID NO: 1191157 - RNA, 19 nt, Homo sapiens
acaguuaccacccucauuc

SEQ ID NO: 1191158 - RNA, 19 nt, Homo sapiens
gggaucccgcucaccuaua

SEQ ID NO: 1191159 - RNA, 19 nt, Homo sapiens
cauugaggcugcaggacau

SEQ ID NO: 1191160 - RNA, 19 nt, Homo sapiens
gcuacacggcgaacuggaa

SEQ ID NO: 1191161 - RNA, 19 nt, Homo sapiens
gggaaaggcggcugauggu

SEQ ID NO: 1191162 - RNA, 19 nt, Homo sapiens
cagaagggccauaguucau

SEQ ID NO: 1191163 - RNA, 19 nt, Homo sapiens
ccacauccgagccagcuau

SEQ ID NO: 1191164 - RNA, 19 nt, Homo sapiens
cagcgaggaaaucuucaaa

SEQ ID NO: 1191165 - RNA, 19 nt, Homo sapiens
ggccagcgaggaaaucuuc

SEQ ID NO: 1191166 - RNA, 19 nt, Homo sapiens
guagcagggcugucugguu

SEQ ID NO: 1191167 - RNA, 19 nt, Homo sapiens
gaaggagaaagcugcuagu

SEQ ID NO: 1191168 - RNA, 19 nt, Homo sapiens
gggaagagcuagagaaguu

SEQ ID NO: 1191169 - RNA, 19 nt, Homo sapiens
gcacggagcuggccaucaa

SEQ ID NO: 1191170 - RNA, 19 nt, Homo sapiens
gcaggaagauggugcugua

SEQ ID NO: 1191171 - RNA, 19 nt, Homo sapiens
gcaaugaagugcuccagaa

SEQ ID NO: 1191172 - RNA, 19 nt, Homo sapiens
ggccagugcucgauauaua

SEQ ID NO: 1191173 - RNA, 19 nt, Homo sapiens
ggccacagcugacaagauu

SEQ ID NO: 1191174 - RNA, 19 nt, Homo sapiens
uagcagggcugucugguuu

SEQ ID NO: 1191175 - RNA, 19 nt, Homo sapiens
ccaucaagcugcuggagua

SEQ ID NO: 1191176 - RNA, 19 nt, Homo sapiens
cagcaucacucaaggagaa

SEQ ID NO: 1191177 - RNA, 19 nt, Homo sapiens
agaaggaugucucagauga

SEQ ID NO: 1191178 - RNA, 19 nt, Homo sapiens
gcuacaaggugcaacagaa

SEQ ID NO: 1191179 - RNA, 19 nt, Homo sapiens
caaugugggugaccucaaa

SEQ ID NO: 1191180 - RNA, 19 nt, Homo sapiens
ucaagcugcuggaguauga

SEQ ID NO: 1191181 - RNA, 19 nt, Homo sapiens
ccgagagcauccaauauaa

SEQ ID NO: 1191182 - RNA, 19 nt, Homo sapiens
ggucaaggcuuugcuucuu

SEQ ID NO: 1191183 - RNA, 19 nt, Homo sapiens
ggaagauggugcuguacug

SEQ ID NO: 1191184 - RNA, 19 nt, Homo sapiens
ggaugacaaucaccaggaa

SEQ ID NO: 1191185 - RNA, 19 nt, Homo sapiens
ggagcaaacuggcacuaag

SEQ ID NO: 1191186 - RNA, 19 nt, Homo sapiens
gagcugaaccgaggagauu

SEQ ID NO: 1191187 - RNA, 19 nt, Homo sapiens
gagcugagccucguauugu

SEQ ID NO: 1191188 - RNA, 19 nt, Homo sapiens
ucaaggagaagcuauguga

SEQ ID NO: 1191189 - RNA, 19 nt, Homo sapiens
gcagaagggccauaguuca

SEQ ID NO: 1191190 - RNA, 19 nt, Homo sapiens
uggcagauuuggaagauug

SEQ ID NO: 1191191 - RNA, 19 nt, Homo sapiens
gagaagcuaugugaguuca

SEQ ID NO: 1191192 - RNA, 19 nt, Homo sapiens
ggaaauaugagcuguacag

SEQ ID NO: 1191193 - RNA, 19 nt, Homo sapiens
ggccugaccuuuaccucuu

SEQ ID NO: 1191194 - RNA, 19 nt, Homo sapiens
ccauugcacugcugaggaa

SEQ ID NO: 1191195 - RNA, 19 nt, Homo sapiens
guggagaucugcaugaaac

SEQ ID NO: 1191196 - RNA, 19 nt, Homo sapiens
cccgagagcauccaauaua

SEQ ID NO: 1191197 - RNA, 19 nt, Homo sapiens
gcaugaaacaacauaacaa

SEQ ID NO: 1191198 - RNA, 19 nt, Homo sapiens
gcacgagccuaugguugug

SEQ ID NO: 1191199 - RNA, 19 nt, Homo sapiens
acagaaggaugucucagau

SEQ ID NO: 1191200 - RNA, 19 nt, Homo sapiens
gagcaagaaaucacccauu

SEQ ID NO: 1191201 - RNA, 19 nt, Homo sapiens
ggaccgaguggcacacauu

SEQ ID NO: 1191202 - RNA, 19 nt, Homo sapiens
agcaagaaaucacccauug

SEQ ID NO: 1191203 - RNA, 19 nt, Homo sapiens
gcccauggcccucaguuug

SEQ ID NO: 1191204 - RNA, 19 nt, Homo sapiens
gaagcuaugugaguucaac

SEQ ID NO: 1191205 - RNA, 19 nt, Homo sapiens
ccauggcccucaguuugua

SEQ ID NO: 1191206 - RNA, 19 nt, Homo sapiens
caccagccauggacugcua

SEQ ID NO: 1191207 - RNA, 19 nt, Homo sapiens
agcagaaggucaaggcuuu

SEQ ID NO: 1191208 - RNA, 19 nt, Homo sapiens
gagaaagcugcuaguguga

SEQ ID NO: 1191209 - RNA, 19 nt, Homo sapiens
ccagauaugcgaguacuug

SEQ ID NO: 1191210 - RNA, 19 nt, Homo sapiens
gcagggcugucugguuuua

SEQ ID NO: 1191211 - RNA, 19 nt, Homo sapiens
ggacagcaucacucaagga

SEQ ID NO: 1191212 - RNA, 19 nt, Homo sapiens
gaucuuucacacugaguuu

SEQ ID NO: 1191213 - RNA, 19 nt, Homo sapiens
caaauacgaagccaagaag

SEQ ID NO: 1191214 - RNA, 19 nt, Homo sapiens
ucuacaaggccaagaauga

SEQ ID NO: 1191215 - RNA, 19 nt, Homo sapiens
ccacugggccugcuacaag

SEQ ID NO: 1191216 - RNA, 19 nt, Homo sapiens
gugcuguacugguuuaugg

SEQ ID NO: 1191217 - RNA, 19 nt, Homo sapiens
gaaggucaaggcuuugcuu

SEQ ID NO: 1191218 - RNA, 19 nt, Homo sapiens
aauacgaagccaagaagua

SEQ ID NO: 1191219 - RNA, 19 nt, Homo sapiens
guaagcaucaggagcuaga

SEQ ID NO: 1191220 - RNA, 19 nt, Homo sapiens
acaaauacgaagccaagaa

SEQ ID NO: 1191221 - RNA, 19 nt, Homo sapiens
aggaggaacucagggauug

SEQ ID NO: 1191222 - RNA, 19 nt, Homo sapiens
ggaagagcuagagaaguuu

SEQ ID NO: 1191223 - RNA, 19 nt, Homo sapiens
ggaagauugggaagagcua

SEQ ID NO: 1191224 - RNA, 19 nt, Homo sapiens
gcagcuggcacgugacuuc

SEQ ID NO: 1191225 - RNA, 19 nt, Homo sapiens
acaaucaggaugacaauca

SEQ ID NO: 1191226 - RNA, 19 nt, Homo sapiens
ccacagcugacaagauuca

SEQ ID NO: 1191227 - RNA, 19 nt, Homo sapiens
ggagaagcuaugugaguuc

SEQ ID NO: 1191228 - RNA, 19 nt, Homo sapiens
aggagaagcuaugugaguu

SEQ ID NO: 1191229 - RNA, 19 nt, Homo sapiens
gcaagaaaucacccauugg

SEQ ID NO: 1191230 - RNA, 19 nt, Homo sapiens
ucaugacccuucggaauca

SEQ ID NO: 1191231 - RNA, 19 nt, Homo sapiens
gcagguaccccuucuccua

SEQ ID NO: 1191232 - RNA, 19 nt, Homo sapiens
gcaacagaaggaugucuca

SEQ ID NO: 1191233 - RNA, 19 nt, Homo sapiens
agauggugcuguacugguu

SEQ ID NO: 1191234 - RNA, 19 nt, Homo sapiens
cuagagaaguuuuccaaga

SEQ ID NO: 1191235 - RNA, 19 nt, Homo sapiens
guacuugcgccuuccugaa

SEQ ID NO: 1191236 - RNA, 19 nt, Homo sapiens
cacccgagagcauccaaua

SEQ ID NO: 1191237 - RNA, 19 nt, Homo sapiens
gcugucugguuuuaaauaa

SEQ ID NO: 1191238 - RNA, 19 nt, Homo sapiens
ugaggccagugcucgauau

SEQ ID NO: 1191239 - RNA, 19 nt, Homo sapiens
ggagaucugcaugaaacaa

SEQ ID NO: 1191240 - RNA, 19 nt, Homo sapiens
guuaccacccucauucuug

SEQ ID NO: 1191241 - RNA, 19 nt, Homo sapiens
gcaaacuggcacuaagcaa

SEQ ID NO: 1191242 - RNA, 19 nt, Homo sapiens
cagcaugggcaaugaagug

SEQ ID NO: 1191243 - RNA, 19 nt, Homo sapiens
auaagcagcucaccaucca

SEQ ID NO: 1191244 - RNA, 19 nt, Homo sapiens
ggcagaagggccauaguuc

SEQ ID NO: 1191245 - RNA, 19 nt, Homo sapiens
gcaccugggcuuggcagaa

SEQ ID NO: 1191246 - RNA, 19 nt, Homo sapiens
gaggccagugcucgauaua

SEQ ID NO: 1191247 - RNA, 19 nt, Homo sapiens
gagagcauccaauauaagc

SEQ ID NO: 1191248 - RNA, 19 nt, Homo sapiens
gcuacacggcgaacuggaa

SEQ ID NO: 1191249 - RNA, 19 nt, Homo sapiens
acaguuaccacccucauuc

SEQ ID NO: 1191250 - RNA, 19 nt, Homo sapiens
gggaaaggcggcugauggu

SEQ ID NO: 1191251 - RNA, 19 nt, Homo sapiens
cagaagggccauaguucau

SEQ ID NO: 1191252 - RNA, 19 nt, Homo sapiens
ccacauccgagccagcuau

SEQ ID NO: 1191253 - RNA, 19 nt, Homo sapiens
guagcagggcugucugguu

SEQ ID NO: 1191254 - RNA, 19 nt, Homo sapiens
gaaggagaaagcugcuagu

SEQ ID NO: 1191255 - RNA, 19 nt, Homo sapiens
gcagaaggucaaggcuuug

SEQ ID NO: 1191256 - RNA, 19 nt, Homo sapiens
caaggccaagaaugaguuu

SEQ ID NO: 1191257 - RNA, 19 nt, Homo sapiens
ccggaaauaugagcuguac

SEQ ID NO: 1191258 - RNA, 19 nt, Homo sapiens
gaagagcuagagaaguuuu

SEQ ID NO: 1191259 - RNA, 19 nt, Homo sapiens
gauggugcuguacugguuu

SEQ ID NO: 1191260 - RNA, 19 nt, Homo sapiens
ccauccagauaugcgagua

SEQ ID NO: 1191261 - RNA, 19 nt, Homo sapiens
aauauaagcagcucaccau

SEQ ID NO: 1191262 - RNA, 19 nt, Homo sapiens
caccugggcuuggcagaag

SEQ ID NO: 1191263 - RNA, 19 nt, Homo sapiens
ccaaggcuacagaggauca

SEQ ID NO: 1191264 - RNA, 19 nt, Homo sapiens
gagcaaacuggcacuaagc

SEQ ID NO: 1191265 - RNA, 19 nt, Homo sapiens
ugagcugagccucguauug

SEQ ID NO: 1191266 - RNA, 19 nt, Homo sapiens
ggccaagaaugaguuugca

SEQ ID NO: 1191267 - RNA, 19 nt, Homo sapiens
ccuggcagauuuggaagau

SEQ ID NO: 1191268 - RNA, 19 nt, Homo sapiens
gggaagagcuagagaaguu

SEQ ID NO: 1191269 - RNA, 19 nt, Homo sapiens
gcacggagcuggccaucaa

SEQ ID NO: 1191270 - RNA, 19 nt, Homo sapiens
ggccacagcugacaagauu

SEQ ID NO: 1191271 - RNA, 19 nt, Homo sapiens
uagcagggcugucugguuu

SEQ ID NO: 1191272 - RNA, 19 nt, Homo sapiens
agaaggaugucucagauga

SEQ ID NO: 1191273 - RNA, 19 nt, Homo sapiens
ggucaaggcuuugcuucuu

SEQ ID NO: 1191274 - RNA, 19 nt, Homo sapiens
ggaugacaaucaccaggaa

SEQ ID NO: 1191275 - RNA, 19 nt, Homo sapiens
ggagcaaacuggcacuaag

SEQ ID NO: 1191276 - RNA, 19 nt, Homo sapiens
gagcugaaccgaggagauu

SEQ ID NO: 1191277 - RNA, 19 nt, Homo sapiens
gagcugagccucguauugu

SEQ ID NO: 1191278 - RNA, 19 nt, Homo sapiens
gcagaagggccauaguuca

SEQ ID NO: 1191279 - RNA, 19 nt, Homo sapiens
uggcagauuuggaagauug

SEQ ID NO: 1191280 - RNA, 19 nt, Homo sapiens
guggagaucugcaugaaac

SEQ ID NO: 1191281 - RNA, 19 nt, Homo sapiens
acagaaggaugucucagau

SEQ ID NO: 1191282 - RNA, 19 nt, Homo sapiens
gcaugaaacaacauaacaa

SEQ ID NO: 1191283 - RNA, 19 nt, Homo sapiens
gcacgagccuaugguugug

SEQ ID NO: 1191284 - RNA, 19 nt, Homo sapiens
gagcaagaaaucacccauu

SEQ ID NO: 1191285 - RNA, 19 nt, Homo sapiens
agcaagaaaucacccauug

SEQ ID NO: 1191286 - RNA, 19 nt, Homo sapiens
gcccauggcccucaguuug

SEQ ID NO: 1191287 - RNA, 19 nt, Homo sapiens
ccauggcccucaguuugua

SEQ ID NO: 1191288 - RNA, 19 nt, Homo sapiens
agcagaaggucaaggcuuu

SEQ ID NO: 1191289 - RNA, 19 nt, Homo sapiens
gcagggcugucugguuuua

SEQ ID NO: 1191290 - RNA, 19 nt, Homo sapiens
caaauacgaagccaagaag

SEQ ID NO: 1191291 - RNA, 19 nt, Homo sapiens
ucuacaaggccaagaauga

SEQ ID NO: 1191292 - RNA, 19 nt, Homo sapiens
gaaggucaaggcuuugcuu

SEQ ID NO: 1191293 - RNA, 19 nt, Homo sapiens
aauacgaagccaagaagua

SEQ ID NO: 1191294 - RNA, 19 nt, Homo sapiens
guaagcaucaggagcuaga

SEQ ID NO: 1191295 - RNA, 19 nt, Homo sapiens
acaaauacgaagccaagaa

SEQ ID NO: 1191296 - RNA, 19 nt, Homo sapiens
ggaagagcuagagaaguuu

SEQ ID NO: 1191297 - RNA, 19 nt, Homo sapiens
ggaagauugggaagagcua

SEQ ID NO: 1191298 - RNA, 19 nt, Homo sapiens
gcagcuggcacgugacuuc

SEQ ID NO: 1191299 - RNA, 19 nt, Homo sapiens
acaaucaggaugacaauca

SEQ ID NO: 1191300 - RNA, 19 nt, Homo sapiens
ccacagcugacaagauuca

SEQ ID NO: 1191301 - RNA, 19 nt, Homo sapiens
gcaacagaaggaugucuca

SEQ ID NO: 1191302 - RNA, 19 nt, Homo sapiens
gcaagaaaucacccauugg

SEQ ID NO: 1191303 - RNA, 19 nt, Homo sapiens
ucaugacccuucggaauca

SEQ ID NO: 1191304 - RNA, 19 nt, Homo sapiens
gcagguaccccuucuccua

SEQ ID NO: 1191305 - RNA, 19 nt, Homo sapiens
cuagagaaguuuuccaaga

SEQ ID NO: 1191306 - RNA, 19 nt, Homo sapiens
gcugucugguuuuaaauaa

SEQ ID NO: 1191307 - RNA, 19 nt, Homo sapiens
ggagaucugcaugaaacaa

SEQ ID NO: 1191308 - RNA, 19 nt, Homo sapiens
guuaccacccucauucuug

SEQ ID NO: 1191309 - RNA, 19 nt, Homo sapiens
gcaaacuggcacuaagcaa

SEQ ID NO: 1191310 - RNA, 19 nt, Homo sapiens
acucugaugugguuguuca

SEQ ID NO: 1191311 - RNA, 19 nt, Homo sapiens
ggcagaagggccauaguuc

SEQ ID NO: 1191312 - RNA, 19 nt, Homo sapiens
gcaccugggcuuggcagaa

SEQ ID NO: 1191313 - RNA, 19 nt, Homo sapiens
acaguuaccacccucauuc

SEQ ID NO: 1191314 - RNA, 19 nt, Homo sapiens
cagaagggccauaguucau

SEQ ID NO: 1191315 - RNA, 19 nt, Homo sapiens
ccacauccgagccagcuau

SEQ ID NO: 1191316 - RNA, 19 nt, Homo sapiens
guagcagggcugucugguu

SEQ ID NO: 1191317 - RNA, 19 nt, Homo sapiens
gcagaaggucaaggcuuug

SEQ ID NO: 1191318 - RNA, 19 nt, Homo sapiens
caaggccaagaaugaguuu

SEQ ID NO: 1191319 - RNA, 19 nt, Homo sapiens
gaagagcuagagaaguuuu

SEQ ID NO: 1191320 - RNA, 19 nt, Homo sapiens
caccugggcuuggcagaag

SEQ ID NO: 1191321 - RNA, 19 nt, Homo sapiens
ccaaggcuacagaggauca

SEQ ID NO: 1191322 - RNA, 19 nt, Homo sapiens
gccagcuccuucucucugu

SEQ ID NO: 1191323 - RNA, 19 nt, Homo sapiens
gagcaaacuggcacuaagc

SEQ ID NO: 1191324 - RNA, 19 nt, Homo sapiens
ugagcugagccucguauug

SEQ ID NO: 1191325 - RNA, 19 nt, Homo sapiens
ggccaagaaugaguuugca

SEQ ID NO: 1191326 - RNA, 19 nt, Homo sapiens
ccuggcagauuuggaagau

SEQ ID NO: 1191327 - RNA, 19 nt, Homo sapiens
ggcuacagaggaucaaaug

SEQ ID NO: 1191328 - RNA, 19 nt, Homo sapiens
gaggagcaaacuggcacua

SEQ ID NO: 1191329 - RNA, 19 nt, Homo sapiens
gcaaggagccagcaucuua

SEQ ID NO: 1191330 - RNA, 19 nt, Homo sapiens
gaaaagagcugcagaucua

SEQ ID NO: 1191331 - RNA, 19 nt, Homo sapiens
gaggugacauuaucuuaua

SEQ ID NO: 1191332 - RNA, 19 nt, Homo sapiens
ggcaaacaauuaaugcuua

SEQ ID NO: 1191333 - RNA, 19 nt, Homo sapiens
gaugaaauguuguaugugu

SEQ ID NO: 1191334 - RNA, 19 nt, Homo sapiens
gaagcgagccgcagacauu

SEQ ID NO: 1191335 - RNA, 19 nt, Homo sapiens
ggaaucaugucauuaaguc

SEQ ID NO: 1191336 - RNA, 19 nt, Homo sapiens
gagauuagcuaaggagaug

SEQ ID NO: 1191337 - RNA, 19 nt, Homo sapiens
gcuuauagcuuaaucucuu

SEQ ID NO: 1191338 - RNA, 19 nt, Homo sapiens
cuaaggagaugcuguugaa

SEQ ID NO: 1191339 - RNA, 19 nt, Homo sapiens
uaaaugaacccaccauaga

SEQ ID NO: 1191340 - RNA, 19 nt, Homo sapiens
gcacaucccaggcguggua

SEQ ID NO: 1191341 - RNA, 19 nt, Homo sapiens
caauggaaauggauucaga

SEQ ID NO: 1191342 - RNA, 19 nt, Homo sapiens
ccaggaagguucauuuaca

SEQ ID NO: 1191343 - RNA, 19 nt, Homo sapiens
caaccugaauugaaugaug

SEQ ID NO: 1191344 - RNA, 19 nt, Homo sapiens
gcuaagagcagaaaugcaa

SEQ ID NO: 1191345 - RNA, 19 nt, Homo sapiens
uguguuugcuuauagcuua

SEQ ID NO: 1191346 - RNA, 19 nt, Homo sapiens
guauggagcgagcuaauaa

SEQ ID NO: 1191347 - RNA, 19 nt, Homo sapiens
gcaauucuuuguuaugaac

SEQ ID NO: 1191348 - RNA, 19 nt, Homo sapiens
gcacaaaacuacuuacucu

SEQ ID NO: 1191349 - RNA, 19 nt, Homo sapiens
guauguguguuugcuuaua

SEQ ID NO: 1191350 - RNA, 19 nt, Homo sapiens
ccuuucagauaccaauuua

SEQ ID NO: 1191351 - RNA, 19 nt, Homo sapiens
gaugguggcuacacaaacu

SEQ ID NO: 1191352 - RNA, 19 nt, Homo sapiens
aaacgcaaccugaauugaa

SEQ ID NO: 1191353 - RNA, 19 nt, Homo sapiens
ggagccagcaucuuacuug

SEQ ID NO: 1191354 - RNA, 19 nt, Homo sapiens
caacacaaggaaauaauca

SEQ ID NO: 1191355 - RNA, 19 nt, Homo sapiens
uuacucugauggaccaaua

SEQ ID NO: 1191356 - RNA, 19 nt, Homo sapiens
ggucccacguccuccuaua

SEQ ID NO: 1191357 - RNA, 19 nt, Homo sapiens
gaaauaaucaaggguacau

SEQ ID NO: 1191358 - RNA, 19 nt, Homo sapiens
caagugguguuugggacua

SEQ ID NO: 1191359 - RNA, 19 nt, Homo sapiens
gaaauguuguauguguguu

SEQ ID NO: 1191360 - RNA, 19 nt, Homo sapiens
gaaaaccaccuuccuaugu

SEQ ID NO: 1191361 - RNA, 19 nt, Homo sapiens
cgccucaacagucuaauua

SEQ ID NO: 1191362 - RNA, 19 nt, Homo sapiens
ccucaacagucuaauuaca

SEQ ID NO: 1191363 - RNA, 19 nt, Homo sapiens
uggagauccugagagauua

SEQ ID NO: 1191364 - RNA, 19 nt, Homo sapiens
cuuauggaaucaugucauu

SEQ ID NO: 1191365 - RNA, 19 nt, Homo sapiens
uacaguaccuccagcaaca

SEQ ID NO: 1191366 - RNA, 19 nt, Homo sapiens
guucauuuacacagcauua

SEQ ID NO: 1191367 - RNA, 19 nt, Homo sapiens
aaccugaauugaaugauga

SEQ ID NO: 1191368 - RNA, 19 nt, Homo sapiens
ucugauggaccaauaauga

SEQ ID NO: 1191369 - RNA, 19 nt, Homo sapiens
gaggagccauggucaucau

SEQ ID NO: 1191370 - RNA, 19 nt, Homo sapiens
ggacggagagcaagaagac

SEQ ID NO: 1191371 - RNA, 19 nt, Homo sapiens
gcaagaagacucgauccau

SEQ ID NO: 1191372 - RNA, 19 nt, Homo sapiens
uagaggugacauuaucuua

SEQ ID NO: 1191373 - RNA, 19 nt, Homo sapiens
ggaccaauaaugaagaaag

SEQ ID NO: 1191374 - RNA, 19 nt, Homo sapiens
ucaacagucuaauuacagu

SEQ ID NO: 1191375 - RNA, 19 nt, Homo sapiens
caauaaccaggacaucauu

SEQ ID NO: 1191376 - RNA, 19 nt, Homo sapiens
gccaugaccggacuuguug

SEQ ID NO: 1191377 - RNA, 19 nt, Homo sapiens
gccauuagcccgagugaag

SEQ ID NO: 1191378 - RNA, 19 nt, Homo sapiens
uuguauguguguuugcuua

SEQ ID NO: 1191379 - RNA, 19 nt, Homo sapiens
ggacaacuucuuugauggu

SEQ ID NO: 1191380 - RNA, 19 nt, Homo sapiens
cagcggcaauggaaaugga

SEQ ID NO: 1191381 - RNA, 19 nt, Homo sapiens
gcacaccacacaauaacca

SEQ ID NO: 1191382 - RNA, 19 nt, Homo sapiens
gaccaauaaugaagaaagc

SEQ ID NO: 1191383 - RNA, 19 nt, Homo sapiens
caccggcucuccuuaugga

SEQ ID NO: 1191384 - RNA, 19 nt, Homo sapiens
augaauggcuacagcaaug

SEQ ID NO: 1191385 - RNA, 19 nt, Homo sapiens
cuggagauccugagagauu

SEQ ID NO: 1191386 - RNA, 19 nt, Homo sapiens
ucuaaacaguucugcaaag

SEQ ID NO: 1191387 - RNA, 19 nt, Homo sapiens
ugguagaggugacauuauc

SEQ ID NO: 1191388 - RNA, 19 nt, Homo sapiens
ggggacaacuucuuugaug

SEQ ID NO: 1191389 - RNA, 19 nt, Homo sapiens
uaccagcacggaagacuuu

SEQ ID NO: 1191390 - RNA, 19 nt, Homo sapiens
ccaccuuccuauguuugua

SEQ ID NO: 1191391 - RNA, 19 nt, Homo sapiens
uaagagcagaaaugcaauu

SEQ ID NO: 1191392 - RNA, 19 nt, Homo sapiens
gcuaaggagaugcuguuga

SEQ ID NO: 1191393 - RNA, 19 nt, Homo sapiens
cauccuccauccucccauu

SEQ ID NO: 1191394 - RNA, 19 nt, Homo sapiens
caacagucuaauuacagua

SEQ ID NO: 1191395 - RNA, 19 nt, Homo sapiens
ccugagagauuagcuaagg

SEQ ID NO: 1191396 - RNA, 19 nt, Homo sapiens
gauggaccaauaaugaaga

SEQ ID NO: 1191397 - RNA, 19 nt, Homo sapiens
uauggcacaccacacaaua

SEQ ID NO: 1191398 - RNA, 19 nt, Homo sapiens
cuaaacaguucugcaaagg

SEQ ID NO: 1191399 - RNA, 19 nt, Homo sapiens
cgugguagaggugacauua

SEQ ID NO: 1191400 - RNA, 19 nt, Homo sapiens
uauguguguuugcuuauag

SEQ ID NO: 1191401 - RNA, 19 nt, Homo sapiens
caacacaagcagcaucucu

SEQ ID NO: 1191402 - RNA, 19 nt, Homo sapiens
aaacagaagagugccuuug

SEQ ID NO: 1191403 - RNA, 19 nt, Homo sapiens
ccacgccucaacagucuaa

SEQ ID NO: 1191404 - RNA, 19 nt, Homo sapiens
gagccauggucaucaucau

SEQ ID NO: 1191405 - RNA, 19 nt, Homo sapiens
gauccugagagauuagcua

SEQ ID NO: 1191406 - RNA, 19 nt, Homo sapiens
uuaaaugaacccaccauag

SEQ ID NO: 1191407 - RNA, 19 nt, Homo sapiens
guagaggugacauuaucuu

SEQ ID NO: 1191408 - RNA, 19 nt, Homo sapiens
ggacaaggacaaaagaugu

SEQ ID NO: 1191409 - RNA, 19 nt, Homo sapiens
uacacaaacugacccucuu

SEQ ID NO: 1191410 - RNA, 19 nt, Homo sapiens
gagucaacacaaggaaaua

SEQ ID NO: 1191411 - RNA, 19 nt, Homo sapiens
ggucagcaucucagaguca

SEQ ID NO: 1191412 - RNA, 19 nt, Homo sapiens
aaucuaaacaguucugcaa

SEQ ID NO: 1191413 - RNA, 19 nt, Homo sapiens
aacgcaaccugaauugaau

SEQ ID NO: 1191414 - RNA, 19 nt, Homo sapiens
gaaagcacuaggagcucuu

SEQ ID NO: 1191415 - RNA, 19 nt, Homo sapiens
ggaaauaaucaaggguaca

SEQ ID NO: 1191416 - RNA, 19 nt, Homo sapiens
ugaaauguuguaugugugu

SEQ ID NO: 1191417 - RNA, 19 nt, Homo sapiens
aaaaccaccuuccuauguu

SEQ ID NO: 1191418 - RNA, 19 nt, Homo sapiens
caugaccggacuuguugua

SEQ ID NO: 1191419 - RNA, 19 nt, Homo sapiens
caaacagaagagugccuuu

SEQ ID NO: 1191420 - RNA, 19 nt, Homo sapiens
ccauuuuccucuucaguuu

SEQ ID NO: 1191421 - RNA, 19 nt, Homo sapiens
guaccuccagcaacaguau

SEQ ID NO: 1191422 - RNA, 19 nt, Homo sapiens
ggguacauccgcaacacaa

SEQ ID NO: 1191423 - RNA, 19 nt, Homo sapiens
gaucuaguggaagcucuuu

SEQ ID NO: 1191424 - RNA, 19 nt, Homo sapiens
uagcuaaggagaugcuguu

SEQ ID NO: 1191425 - RNA, 19 nt, Homo sapiens
uaaacaguucugcaaagga

SEQ ID NO: 1191426 - RNA, 19 nt, Homo sapiens
ggaggagccauggucauca

SEQ ID NO: 1191427 - RNA, 19 nt, Homo sapiens
caucucagagucaacacaa

SEQ ID NO: 1191428 - RNA, 19 nt, Homo sapiens
gaugggaaucaacuccuau

SEQ ID NO: 1191429 - RNA, 19 nt, Homo sapiens
ggucuuagcuacagcaaua

SEQ ID NO: 1191430 - RNA, 19 nt, Homo sapiens
gaacagacuugggaacaaa

SEQ ID NO: 1191431 - RNA, 19 nt, Homo sapiens
ccaaagauguuacaauuuc

SEQ ID NO: 1191432 - RNA, 19 nt, Homo sapiens
ggagggcuuuauacaauua

SEQ ID NO: 1191433 - RNA, 19 nt, Homo sapiens
gaggagggcuuuauacaau

SEQ ID NO: 1191434 - RNA, 19 nt, Homo sapiens
gaaaguaucagccauuuag

SEQ ID NO: 1191435 - RNA, 19 nt, Homo sapiens
gagaaaguaucagccauuu

SEQ ID NO: 1191436 - RNA, 19 nt, Homo sapiens
gagcuaauguuuguccuaa

SEQ ID NO: 1191437 - RNA, 19 nt, Homo sapiens
uuacagagcuaauguuugu

SEQ ID NO: 1191438 - RNA, 19 nt, Homo sapiens
uaucagccauuuagcauuu

SEQ ID NO: 1191439 - RNA, 19 nt, Homo sapiens
gguuauugcuuaaugcuuu

SEQ ID NO: 1191440 - RNA, 19 nt, Homo sapiens
ggaacaagcugacccuuuu

SEQ ID NO: 1191441 - RNA, 19 nt, Homo sapiens
ggaacacucacuaugguua

SEQ ID NO: 1191442 - RNA, 19 nt, Homo sapiens
gcuaauguuuguccuaaau

SEQ ID NO: 1191443 - RNA, 19 nt, Homo sapiens
gaacuuagaaccagacagu

SEQ ID NO: 1191444 - RNA, 19 nt, Homo sapiens
gcaauuggagcuuaucuug

SEQ ID NO: 1191445 - RNA, 19 nt, Homo sapiens
guacuuugcuguuaucucu

SEQ ID NO: 1191446 - RNA, 19 nt, Homo sapiens
acaaaugugugacgacuga

SEQ ID NO: 1191447 - RNA, 19 nt, Homo sapiens
gcaaaugucucugcuacca

SEQ ID NO: 1191448 - RNA, 19 nt, Homo sapiens
ccacuaagcuauuuguuuu

SEQ ID NO: 1191449 - RNA, 19 nt, Homo sapiens
gaucugcauuacaguguuu

SEQ ID NO: 1191450 - RNA, 19 nt, Homo sapiens
gaacauaccaauuuaagcu

SEQ ID NO: 1191451 - RNA, 19 nt, Homo sapiens
gaacacucacuaugguuaa

SEQ ID NO: 1191452 - RNA, 19 nt, Homo sapiens
gaugugaauuucucuaaag

SEQ ID NO: 1191453 - RNA, 19 nt, Homo sapiens
gaccauagucuugaguuua

SEQ ID NO: 1191454 - RNA, 19 nt, Homo sapiens
cuuaagguguugagcuuua

SEQ ID NO: 1191455 - RNA, 19 nt, Homo sapiens
ggaacagacuugggaacaa

SEQ ID NO: 1191456 - RNA, 19 nt, Homo sapiens
uuaaagaacugccaauaac

SEQ ID NO: 1191457 - RNA, 19 nt, Homo sapiens
guguugagcuuuaacucua

SEQ ID NO: 1191458 - RNA, 19 nt, Homo sapiens
uaacaggaauucgaggauu

SEQ ID NO: 1191459 - RNA, 19 nt, Homo sapiens
ccauuuagcauuuaaguug

SEQ ID NO: 1191460 - RNA, 19 nt, Homo sapiens
ugaggucaauuggaaauaa

SEQ ID NO: 1191461 - RNA, 19 nt, Homo sapiens
gugaauuucucuaaagugu

SEQ ID NO: 1191462 - RNA, 19 nt, Homo sapiens
cauccacaguguacuuuaa

SEQ ID NO: 1191463 - RNA, 19 nt, Homo sapiens
ucacagccauccucauaau

SEQ ID NO: 1191464 - RNA, 19 nt, Homo sapiens
gaacugccaauaacaggaa

SEQ ID NO: 1191465 - RNA, 19 nt, Homo sapiens
gcacuuguuucacgaacug

SEQ ID NO: 1191466 - RNA, 19 nt, Homo sapiens
uagcagauauaacccaaga

SEQ ID NO: 1191467 - RNA, 19 nt, Homo sapiens
gagcuuguuugcaguacuu

SEQ ID NO: 1191468 - RNA, 19 nt, Homo sapiens
aacaggaauucgaggauua

SEQ ID NO: 1191469 - RNA, 19 nt, Homo sapiens
aaagaaguauggcuuaugg

SEQ ID NO: 1191470 - RNA, 19 nt, Homo sapiens
auaagcaccucaacacuug

SEQ ID NO: 1191471 - RNA, 19 nt, Homo sapiens
cuuaugaggucaauuggaa

SEQ ID NO: 1191472 - RNA, 19 nt, Homo sapiens
ggcauucuuuccauuauug

SEQ ID NO: 1191473 - RNA, 19 nt, Homo sapiens
gaaagaaguauggcuuaug

SEQ ID NO: 1191474 - RNA, 19 nt, Homo sapiens
guacuaaaucugaaucaug

SEQ ID NO: 1191475 - RNA, 19 nt, Homo sapiens
gcaccacuuugaacagaau

SEQ ID NO: 1191476 - RNA, 19 nt, Homo sapiens
gauauuagcaaaugucucu

SEQ ID NO: 1191477 - RNA, 19 nt, Homo sapiens
acaguguacuuuaagauug

SEQ ID NO: 1191478 - RNA, 19 nt, Homo sapiens
ucuaaaugcuggcucaaau

SEQ ID NO: 1191479 - RNA, 19 nt, Homo sapiens
uaucagcacccaggucuua

SEQ ID NO: 1191480 - RNA, 19 nt, Homo sapiens
gcagccaugucuagcauca

SEQ ID NO: 1191481 - RNA, 19 nt, Homo sapiens
ccaagagcaugaaagaagu

SEQ ID NO: 1191482 - RNA, 19 nt, Homo sapiens
gaaaguguugcagcguuua

SEQ ID NO: 1191483 - RNA, 19 nt, Homo sapiens
agaaaguguugcagcguuu

SEQ ID NO: 1191484 - RNA, 19 nt, Homo sapiens
cacaguagguaguaugguu

SEQ ID NO: 1191485 - RNA, 19 nt, Homo sapiens
ugaaagaaguauggcuuau

SEQ ID NO: 1191486 - RNA, 19 nt, Homo sapiens
cgaugugaauuucucuaaa

SEQ ID NO: 1191487 - RNA, 19 nt, Homo sapiens
gucuugaguuuacuuauga

SEQ ID NO: 1191488 - RNA, 19 nt, Homo sapiens
aaugcuggcucaaauuuau

SEQ ID NO: 1191489 - RNA, 19 nt, Homo sapiens
agaaauguaucugcaugaa

SEQ ID NO: 1191490 - RNA, 19 nt, Homo sapiens
gcacccaggucuuaguuuu

SEQ ID NO: 1191491 - RNA, 19 nt, Homo sapiens
uauuacaguuggcauggua

SEQ ID NO: 1191492 - RNA, 19 nt, Homo sapiens
gggaacaagcugacccuuu

SEQ ID NO: 1191493 - RNA, 19 nt, Homo sapiens
ucacuaugguuaaauaagg

SEQ ID NO: 1191494 - RNA, 19 nt, Homo sapiens
ggugguacuuugcuguuau

SEQ ID NO: 1191495 - RNA, 19 nt, Homo sapiens
guuguggaccuauuuguuu

SEQ ID NO: 1191496 - RNA, 19 nt, Homo sapiens
cuuaaagaacugccaauaa

SEQ ID NO: 1191497 - RNA, 19 nt, Homo sapiens
caaggaaugauaacaggaa

SEQ ID NO: 1191498 - RNA, 19 nt, Homo sapiens
aauuggagcuuaucuugga

SEQ ID NO: 1191499 - RNA, 19 nt, Homo sapiens
ugugugugguuauugcuua

SEQ ID NO: 1191500 - RNA, 19 nt, Homo sapiens
aaauguaucugcaugaacu

SEQ ID NO: 1191501 - RNA, 19 nt, Homo sapiens
ggcccucccuuccuauuug

SEQ ID NO: 1191502 - RNA, 19 nt, Homo sapiens
uuacaguguuucucuccua

SEQ ID NO: 1191503 - RNA, 19 nt, Homo sapiens
cggccaagauuccauagug

SEQ ID NO: 1191504 - RNA, 19 nt, Homo sapiens
cagagucguugccugagaa

SEQ ID NO: 1191505 - RNA, 19 nt, Homo sapiens
caucuugugugugguuauu

SEQ ID NO: 1191506 - RNA, 19 nt, Homo sapiens
gucagugugauaucuauua

SEQ ID NO: 1191507 - RNA, 19 nt, Homo sapiens
gccacuaagcuauuuguuu

SEQ ID NO: 1191508 - RNA, 19 nt, Homo sapiens
aaacuuggaacacucacua

SEQ ID NO: 1191509 - RNA, 19 nt, Homo sapiens
cauaagcaccucaacacuu

SEQ ID NO: 1191510 - RNA, 19 nt, Homo sapiens
gaacuccgugggaacuaaa

SEQ ID NO: 1191511 - RNA, 19 nt, Homo sapiens
uccggaacauaccaauuua

SEQ ID NO: 1191512 - RNA, 19 nt, Homo sapiens
cuuguugccuuguuuauuc

SEQ ID NO: 1191513 - RNA, 19 nt, Homo sapiens
cagcaccacuuugaacaga

SEQ ID NO: 1191514 - RNA, 19 nt, Homo sapiens
uuacuuaugaggucaauug

SEQ ID NO: 1191515 - RNA, 19 nt, Homo sapiens
agucacagccauccucaua

SEQ ID NO: 1191516 - RNA, 19 nt, Homo sapiens
gagcaugaaagaaguaugg

SEQ ID NO: 1191517 - RNA, 19 nt, Homo sapiens
ggaauucgaggauuaugca

SEQ ID NO: 1191518 - RNA, 19 nt, Homo sapiens
ucaacagggugucguucaa

SEQ ID NO: 1191519 - RNA, 19 nt, Homo sapiens
caagagcaugaaagaagua

SEQ ID NO: 1191520 - RNA, 19 nt, Homo sapiens
gcuguuaucucuguuucug

SEQ ID NO: 1191521 - RNA, 19 nt, Homo sapiens
cacucacuaugguuaaaua

SEQ ID NO: 1191522 - RNA, 19 nt, Homo sapiens
ggauguacauuccauuucc

SEQ ID NO: 1191523 - RNA, 19 nt, Homo sapiens
ucagaaccuuggaugaugu

SEQ ID NO: 1191524 - RNA, 19 nt, Homo sapiens
guauuuagagccuguaauc

SEQ ID NO: 1191525 - RNA, 19 nt, Homo sapiens
ugaacuccgugggaacuaa

SEQ ID NO: 1191526 - RNA, 19 nt, Homo sapiens
ggcccucuauggauucauu

SEQ ID NO: 1191527 - RNA, 19 nt, Homo sapiens
gaggucaauuggaaauaag

SEQ ID NO: 1191528 - RNA, 19 nt, Homo sapiens
ccagagucguugccugaga

SEQ ID NO: 1191529 - RNA, 19 nt, Homo sapiens
ugaaauaccugcaaaguag

SEQ ID NO: 1191530 - RNA, 19 nt, Homo sapiens
gaaccaauauauacaaugg

SEQ ID NO: 1191531 - RNA, 19 nt, Homo sapiens
gcaaugacaauaaaguuug

SEQ ID NO: 1191532 - RNA, 19 nt, Homo sapiens
aagaacaucuccagaggaa

SEQ ID NO: 1191533 - RNA, 19 nt, Homo sapiens
caauaaaguuugagaagcu

SEQ ID NO: 1191534 - RNA, 19 nt, Homo sapiens
gaacaucuccagaggaacu

SEQ ID NO: 1191535 - RNA, 19 nt, Homo sapiens
ggcaaugacaauaaaguuu

SEQ ID NO: 1191536 - RNA, 19 nt, Homo sapiens
gacaauaaaguuugagaag

SEQ ID NO: 1191537 - RNA, 19 nt, Homo sapiens
ugaaugaccacgcccgaaa

SEQ ID NO: 1191538 - RNA, 19 nt, Homo sapiens
uugaaauaccugcaaagua

SEQ ID NO: 1191539 - RNA, 19 nt, Homo sapiens
aaauggaggaggaggaauu

SEQ ID NO: 1191540 - RNA, 19 nt, Homo sapiens
ccaaauggaggaggaggaa

SEQ ID NO: 1191541 - RNA, 19 nt, Homo sapiens
caagaagcuacaucucuca

SEQ ID NO: 1191542 - RNA, 19 nt, Homo sapiens
gccugccgcugacauugaa

SEQ ID NO: 1191543 - RNA, 19 nt, Homo sapiens
gaccacgcccgaaagaaca

SEQ ID NO: 1191544 - RNA, 19 nt, Homo sapiens
gaaugaccacgcccgaaag

SEQ ID NO: 1191545 - RNA, 19 nt, Homo sapiens
cccgcaaccugcuccgaaa

SEQ ID NO: 1191546 - RNA, 19 nt, Homo sapiens
guugaaauaccugcaaagu

SEQ ID NO: 1191547 - RNA, 19 nt, Homo sapiens
ugguugaaauaccugcaaa

SEQ ID NO: 1191548 - RNA, 19 nt, Homo sapiens
gcccgaaagaacagaauca

SEQ ID NO: 1191549 - RNA, 19 nt, Homo sapiens
gaaccaauauauacaaugg

SEQ ID NO: 1191550 - RNA, 19 nt, Homo sapiens
gaggaggaauucauagaaa

SEQ ID NO: 1191551 - RNA, 19 nt, Homo sapiens
ggaggaauucauagaaaua

SEQ ID NO: 1191552 - RNA, 19 nt, Homo sapiens
ggaggaggaggaauucaua

SEQ ID NO: 1191553 - RNA, 19 nt, Homo sapiens
ucauagaaauaacgacuga

SEQ ID NO: 1191554 - RNA, 19 nt, Homo sapiens
aagaacaucuccagaggaa

SEQ ID NO: 1191555 - RNA, 19 nt, Homo sapiens
caucgaagaaccaauauau

SEQ ID NO: 1191556 - RNA, 19 nt, Homo sapiens
agacaucgaagaaccaaua

SEQ ID NO: 1191557 - RNA, 19 nt, Homo sapiens
gaagcuacaucccucaaac

SEQ ID NO: 1191558 - RNA, 19 nt, Homo sapiens
ggaggaggaauucauagaa

SEQ ID NO: 1191559 - RNA, 19 nt, Homo sapiens
agaaauaacgacugaaaga

SEQ ID NO: 1191560 - RNA, 19 nt, Homo sapiens
gaacaucuccagaggaacu

SEQ ID NO: 1191561 - RNA, 19 nt, Homo sapiens
ccucaaacuucggcaauga

SEQ ID NO: 1191562 - RNA, 19 nt, Homo sapiens
cgaagaaccaauauauaca

SEQ ID NO: 1191563 - RNA, 19 nt, Homo sapiens
gaaauaacgacugaaagac

SEQ ID NO: 1191564 - RNA, 19 nt, Homo sapiens
ccaaugaggccaacaagac

SEQ ID NO: 1191565 - RNA, 19 nt, Homo sapiens
ucgaagaaccaauauauac

SEQ ID NO: 1191566 - RNA, 19 nt, Homo sapiens
aaauggaggaggaggaauu

SEQ ID NO: 1191567 - RNA, 19 nt, Homo sapiens
ucaaacuucggcaaugaaa

SEQ ID NO: 1191568 - RNA, 19 nt, Homo sapiens
aggaggaauucauagaaau

SEQ ID NO: 1191569 - RNA, 19 nt, Homo sapiens
ccaaauggaggaggaggaa

SEQ ID NO: 1191570 - RNA, 19 nt, Homo sapiens
cccgcaaccugcuccuaaa

SEQ ID NO: 1191571 - RNA, 19 nt, Homo sapiens
caccaggaggguaugcaua

SEQ ID NO: 1191572 - RNA, 19 nt, Homo sapiens
ggaauucauagaaauaacg

SEQ ID NO: 1191573 - RNA, 19 nt, Homo sapiens
gcuacaucccucaaacuuc

SEQ ID NO: 1191574 - RNA, 19 nt, Homo sapiens
uauauacaaugggccaaca

SEQ ID NO: 1191575 - RNA, 19 nt, Homo sapiens
gccaaugaggccaacaaga

SEQ ID NO: 1191576 - RNA, 19 nt, Homo sapiens
gaggaggaggaauucauag

SEQ ID NO: 1191577 - RNA, 19 nt, Homo sapiens
uaaaguuugagaagcugaa

SEQ ID NO: 1191578 - RNA, 19 nt, Homo sapiens
ugaaauaccugcaaaguag

SEQ ID NO: 1191579 - RNA, 19 nt, Homo sapiens
gaaccaauauauacaaugg

SEQ ID NO: 1191580 - RNA, 19 nt, Homo sapiens
aagaacaucuccagaggaa

SEQ ID NO: 1191581 - RNA, 19 nt, Homo sapiens
gaacaucuccagaggaacu

SEQ ID NO: 1191582 - RNA, 19 nt, Homo sapiens
uugaaauaccugcaaagua

SEQ ID NO: 1191583 - RNA, 19 nt, Homo sapiens
aaauggaggaggaggaauu

SEQ ID NO: 1191584 - RNA, 19 nt, Homo sapiens
ccaaauggaggaggaggaa

SEQ ID NO: 1191585 - RNA, 19 nt, Homo sapiens
caagaagcuacaucucuca

SEQ ID NO: 1191586 - RNA, 19 nt, Homo sapiens
cccgcaaccugcuccuaaa

SEQ ID NO: 1191587 - RNA, 19 nt, Homo sapiens
gccugccacugacauugaa

SEQ ID NO: 1191588 - RNA, 19 nt, Homo sapiens
guugaaauaccugcaaagu

SEQ ID NO: 1191589 - RNA, 19 nt, Homo sapiens
ugguugaaauaccugcaaa

SEQ ID NO: 1191590 - RNA, 19 nt, Homo sapiens
gcacgcaucuugaguuuca

SEQ ID NO: 1191591 - RNA, 19 nt, Homo sapiens
gaucucagcuugucuucuu

SEQ ID NO: 1191592 - RNA, 19 nt, Homo sapiens
gaugccagcugcuuccuaa

SEQ ID NO: 1191593 - RNA, 19 nt, Homo sapiens
gagcuuacagguaccaaua

SEQ ID NO: 1191594 - RNA, 19 nt, Homo sapiens
gagcuuggcagaccacuuu

SEQ ID NO: 1191595 - RNA, 19 nt, Homo sapiens
gcugacaucuuugguacua

SEQ ID NO: 1191596 - RNA, 19 nt, Homo sapiens
ccauccagcugacaucuuu

SEQ ID NO: 1191597 - RNA, 19 nt, Homo sapiens
gcagcgacaugacugauuc

SEQ ID NO: 1191598 - RNA, 19 nt, Homo sapiens
caaacaauucucuggauuu

SEQ ID NO: 1191599 - RNA, 19 nt, Homo sapiens
ucaaacaauucucuggauu

SEQ ID NO: 1191600 - RNA, 19 nt, Homo sapiens
ugacugggcuguugaagag

SEQ ID NO: 1191601 - RNA, 19 nt, Homo sapiens
gcuuacagguaccaauaaa

SEQ ID NO: 1191602 - RNA, 19 nt, Homo sapiens
cuagaucccuuuauugaca

SEQ ID NO: 1191603 - RNA, 19 nt, Homo sapiens
acaaugagcugggagacaa

SEQ ID NO: 1191604 - RNA, 19 nt, Homo sapiens
ggaauuuaaucaggcaaga

SEQ ID NO: 1191605 - RNA, 19 nt, Homo sapiens
caagaguucagacccauuu

SEQ ID NO: 1191606 - RNA, 19 nt, Homo sapiens
gauuugagcucugugaucu

SEQ ID NO: 1191607 - RNA, 19 nt, Homo sapiens
gaaacaggaagcccagaga

SEQ ID NO: 1191608 - RNA, 19 nt, Homo sapiens
cagacuagguguggauuug

SEQ ID NO: 1191609 - RNA, 19 nt, Homo sapiens
gaacagcugugaccaaaac

SEQ ID NO: 1191610 - RNA, 19 nt, Homo sapiens
acuauuaucucagggcuuu

SEQ ID NO: 1191611 - RNA, 19 nt, Homo sapiens
gcugcuuucuuguaauuau

SEQ ID NO: 1191612 - RNA, 19 nt, Homo sapiens
acaggaggcugagagcuuu

SEQ ID NO: 1191613 - RNA, 19 nt, Homo sapiens
ugaaagaggagaaguugga

SEQ ID NO: 1191614 - RNA, 19 nt, Homo sapiens
gccagcugcuuccuaaaug

SEQ ID NO: 1191615 - RNA, 19 nt, Homo sapiens
ccuaaaugguggccuugaa

SEQ ID NO: 1191616 - RNA, 19 nt, Homo sapiens
cugaacagcugugaccaaa

SEQ ID NO: 1191617 - RNA, 19 nt, Homo sapiens
caccaugacugggcuguug

SEQ ID NO: 1191618 - RNA, 19 nt, Homo sapiens
uggcacgcaucuugaguuu

SEQ ID NO: 1191619 - RNA, 19 nt, Homo sapiens
ggaucaccgucuucuacuu

SEQ ID NO: 1191620 - RNA, 19 nt, Homo sapiens
gggcuuuggugcagacuag

SEQ ID NO: 1191621 - RNA, 19 nt, Homo sapiens
ggacugugaagacuauaau

SEQ ID NO: 1191622 - RNA, 19 nt, Homo sapiens
agagaccuguugcugcuuu

SEQ ID NO: 1191623 - RNA, 19 nt, Homo sapiens
caugggccguguggaauuu

SEQ ID NO: 1191624 - RNA, 19 nt, Homo sapiens
gaucaccgucuucuacuuc

SEQ ID NO: 1191625 - RNA, 19 nt, Homo sapiens
cagcaucgggcacuaguga

SEQ ID NO: 1191626 - RNA, 19 nt, Homo sapiens
ugagcucugugaucuaugu

SEQ ID NO: 1191627 - RNA, 19 nt, Homo sapiens
gcccaaagacggugagaca

SEQ ID NO: 1191628 - RNA, 19 nt, Homo sapiens
ugacaucuuugguacuagu

SEQ ID NO: 1191629 - RNA, 19 nt, Homo sapiens
uggagaugcugcaguggaa

SEQ ID NO: 1191630 - RNA, 19 nt, Homo sapiens
gaaauuugaccagcuggau

SEQ ID NO: 1191631 - RNA, 19 nt, Homo sapiens
gcucuucuaucuccacaac

SEQ ID NO: 1191632 - RNA, 19 nt, Homo sapiens
gcagacuagguguggauuu

SEQ ID NO: 1191633 - RNA, 19 nt, Homo sapiens
gcaagaguucagacccauu

SEQ ID NO: 1191634 - RNA, 19 nt, Homo sapiens
gcagggagggcugugagaa

SEQ ID NO: 1191635 - RNA, 19 nt, Homo sapiens
uugcugcuuucuuguaauu

SEQ ID NO: 1191636 - RNA, 19 nt, Homo sapiens
agcccuagaucccuuuauu

SEQ ID NO: 1191637 - RNA, 19 nt, Homo sapiens
ccagcugacaucuuuggua

SEQ ID NO: 1191638 - RNA, 19 nt, Homo sapiens
ggaucgaucgggaggagaa

SEQ ID NO: 1191639 - RNA, 19 nt, Homo sapiens
ccacuggacugugaagacu

SEQ ID NO: 1191640 - RNA, 19 nt, Homo sapiens
ccacagcuugcucuucuau

SEQ ID NO: 1191641 - RNA, 19 nt, Homo sapiens
gcacacuccugguuuucaa

SEQ ID NO: 1191642 - RNA, 19 nt, Homo sapiens
uguugcugcuuucuuguaa

SEQ ID NO: 1191643 - RNA, 19 nt, Homo sapiens
gaagcccuagaucccuuua

SEQ ID NO: 1191644 - RNA, 19 nt, Homo sapiens
acagcuugcucuucuaucu

SEQ ID NO: 1191645 - RNA, 19 nt, Homo sapiens
cccuagaucccuuuauuga

SEQ ID NO: 1191646 - RNA, 19 nt, Homo sapiens
ugaggaggcuuugguugca

SEQ ID NO: 1191647 - RNA, 19 nt, Homo sapiens
ggugagacagggcugaaau

SEQ ID NO: 1191648 - RNA, 19 nt, Homo sapiens
gaaccaugccccagacuau

SEQ ID NO: 1191649 - RNA, 19 nt, Homo sapiens
gcccuagaucccuuuauug

SEQ ID NO: 1191650 - RNA, 19 nt, Homo sapiens
ggcuguagcuucacaucag

SEQ ID NO: 1191651 - RNA, 19 nt, Homo sapiens
uauacccuuuguuugcuaa

SEQ ID NO: 1191652 - RNA, 19 nt, Homo sapiens
ggccacagccuuuauucca

SEQ ID NO: 1191653 - RNA, 19 nt, Homo sapiens
ggauuugagcucugugauc

SEQ ID NO: 1191654 - RNA, 19 nt, Homo sapiens
ugaggaccaggaugucuuu

SEQ ID NO: 1191655 - RNA, 19 nt, Homo sapiens
ggugugaggaccaggaugu

SEQ ID NO: 1191656 - RNA, 19 nt, Homo sapiens
gcagcagcgacaugacuga

SEQ ID NO: 1191657 - RNA, 19 nt, Homo sapiens
gagugucagaacuauaauu

SEQ ID NO: 1191658 - RNA, 19 nt, Homo sapiens
uuugagcucugugaucuau

SEQ ID NO: 1191659 - RNA, 19 nt, Homo sapiens
uauucuggcuguagcuuca

SEQ ID NO: 1191660 - RNA, 19 nt, Homo sapiens
cagccuggcacgcaucuug

SEQ ID NO: 1191661 - RNA, 19 nt, Homo sapiens
gcuugaaagaggagaaguu

SEQ ID NO: 1191662 - RNA, 19 nt, Homo sapiens
ggguggcuccugaggguuu

SEQ ID NO: 1191663 - RNA, 19 nt, Homo sapiens
ggccaaggacaucaucuag

SEQ ID NO: 1191664 - RNA, 19 nt, Homo sapiens
ugccgucgcuucucuuugg

SEQ ID NO: 1191665 - RNA, 19 nt, Homo sapiens
gauugaggaggcuuugguu

SEQ ID NO: 1191666 - RNA, 19 nt, Homo sapiens
ucacuacacaucacagaag

SEQ ID NO: 1191667 - RNA, 19 nt, Homo sapiens
ggaggaggaagaggaggaa

SEQ ID NO: 1191668 - RNA, 19 nt, Homo sapiens
ucacccgccugcaguugga

SEQ ID NO: 1191669 - RNA, 19 nt, Homo sapiens
gacuagguguggauuugag

SEQ ID NO: 1191670 - RNA, 19 nt, Homo sapiens
ggagauugaggaggcuuug

SEQ ID NO: 1191671 - RNA, 19 nt, Homo sapiens
gauguuccuuagcccaaag

SEQ ID NO: 1191672 - RNA, 19 nt, Homo sapiens
gcaucuugaguuucaguga

SEQ ID NO: 1191673 - RNA, 19 nt, Homo sapiens
acuggacugugaagacuau

SEQ ID NO: 1191674 - RNA, 19 nt, Homo sapiens
ccagcugcuuccuaaaugg

SEQ ID NO: 1191675 - RNA, 19 nt, Homo sapiens
uuauacccuuuguuugcua

SEQ ID NO: 1191676 - RNA, 19 nt, Homo sapiens
gggaaggaggaaacaggaa

SEQ ID NO: 1191677 - RNA, 19 nt, Homo sapiens
ugagacagggcugaaauca

SEQ ID NO: 1191678 - RNA, 19 nt, Homo sapiens
gagccuggaagaggagaaa

SEQ ID NO: 1191679 - RNA, 19 nt, Homo sapiens
ccacaacgugagccuggaa

SEQ ID NO: 1191680 - RNA, 19 nt, Homo sapiens
gccagggcuucaccagugu

SEQ ID NO: 1191681 - RNA, 19 nt, Homo sapiens
ggaugccagcugcuuccua

SEQ ID NO: 1191682 - RNA, 19 nt, Homo sapiens
ccaugggccguguggaauu

SEQ ID NO: 1191683 - RNA, 19 nt, Homo sapiens
caccuuguaccugagcuua

SEQ ID NO: 1191684 - RNA, 19 nt, Homo sapiens
uguugaagaggaaauuuga

SEQ ID NO: 1191685 - RNA, 19 nt, Homo sapiens
augcugcaguggaagcuuu

SEQ ID NO: 1191686 - RNA, 19 nt, Homo sapiens
acccacagcuugcucuucu

SEQ ID NO: 1191687 - RNA, 19 nt, Homo sapiens
gcgacaugacugauucuuc

SEQ ID NO: 1191688 - RNA, 19 nt, Homo sapiens
ugugguggaugccauugau

SEQ ID NO: 1191689 - RNA, 19 nt, Homo sapiens
gauggaccacacagcauuc

SEQ ID NO: 1191690 - RNA, 19 nt, Homo sapiens
ugaaauaccugcaaaguag

SEQ ID NO: 1191691 - RNA, 19 nt, Homo sapiens
gaaccaauauauacaaugg

SEQ ID NO: 1191692 - RNA, 19 nt, Homo sapiens
aagaacaucuccagaggaa

SEQ ID NO: 1191693 - RNA, 19 nt, Homo sapiens
gaacaucuccagaggaacu

SEQ ID NO: 1191694 - RNA, 19 nt, Homo sapiens
uugaaauaccugcaaagua

SEQ ID NO: 1191695 - RNA, 19 nt, Homo sapiens
aaauggaggaggaggaauu

SEQ ID NO: 1191696 - RNA, 19 nt, Homo sapiens
ccaaauggaggaggaggaa

SEQ ID NO: 1191697 - RNA, 19 nt, Homo sapiens
caagaagcuacaucucuca

SEQ ID NO: 1191698 - RNA, 19 nt, Homo sapiens
cccgcaaccugcuccuaaa

SEQ ID NO: 1191699 - RNA, 19 nt, Homo sapiens
guugaaauaccugcaaagu

SEQ ID NO: 1191700 - RNA, 19 nt, Homo sapiens
uaaaguuugagaagcugaa

SEQ ID NO: 1191701 - RNA, 19 nt, Homo sapiens
ugguugaaauaccugcaaa

SEQ ID NO: 1191702 - RNA, 19 nt, Homo sapiens
gaacugcucuucaaauuua

SEQ ID NO: 1191703 - RNA, 19 nt, Homo sapiens
gcacaaaccucaauguauu

SEQ ID NO: 1191704 - RNA, 19 nt, Homo sapiens
gcagccagcuucugaauua

SEQ ID NO: 1191705 - RNA, 19 nt, Homo sapiens
uugcaaagcucauguauua

SEQ ID NO: 1191706 - RNA, 19 nt, Homo sapiens
gagaagauguggacuauga

SEQ ID NO: 1191707 - RNA, 19 nt, Homo sapiens
gcauuuaacuguuugcaua

SEQ ID NO: 1191708 - RNA, 19 nt, Homo sapiens
ggacaagugugcacaauug

SEQ ID NO: 1191709 - RNA, 19 nt, Homo sapiens
gcucauagauuuaagcaaa

SEQ ID NO: 1191710 - RNA, 19 nt, Homo sapiens
ggacagaaacgauuacuaa

SEQ ID NO: 1191711 - RNA, 19 nt, Homo sapiens
gugcaaagguucaacauuu

SEQ ID NO: 1191712 - RNA, 19 nt, Homo sapiens
ggacauaggcgcuuucaaa

SEQ ID NO: 1191713 - RNA, 19 nt, Homo sapiens
ugaaauaacuccacuuguu

SEQ ID NO: 1191714 - RNA, 19 nt, Homo sapiens
gaaggaaacuuacccaaag

SEQ ID NO: 1191715 - RNA, 19 nt, Homo sapiens
gaaggaauuuguucacuug

SEQ ID NO: 1191716 - RNA, 19 nt, Homo sapiens
gaaaugagcugcacaaacc

SEQ ID NO: 1191717 - RNA, 19 nt, Homo sapiens
gaccaaacaucaaagcuaa

SEQ ID NO: 1191718 - RNA, 19 nt, Homo sapiens
caacaaacgugaccaaaca

SEQ ID NO: 1191719 - RNA, 19 nt, Homo sapiens
ucacauuccugcucucuua

SEQ ID NO: 1191720 - RNA, 19 nt, Homo sapiens
gaaauaacuccacuuguuu

SEQ ID NO: 1191721 - RNA, 19 nt, Homo sapiens
ccaaagagacauaguauuu

SEQ ID NO: 1191722 - RNA, 19 nt, Homo sapiens
gaaagaagcagacuuguag

SEQ ID NO: 1191723 - RNA, 19 nt, Homo sapiens
uaacuccacuuguuuguaa

SEQ ID NO: 1191724 - RNA, 19 nt, Homo sapiens
gaagaaaggacaacgauga

SEQ ID NO: 1191725 - RNA, 19 nt, Homo sapiens
caucaaagcuaaagcaaug

SEQ ID NO: 1191726 - RNA, 19 nt, Homo sapiens
gaaacaaucucagcauuca

SEQ ID NO: 1191727 - RNA, 19 nt, Homo sapiens
ggaggaagguacucuuuga

SEQ ID NO: 1191728 - RNA, 19 nt, Homo sapiens
gaacuaugguuuucacuua

SEQ ID NO: 1191729 - RNA, 19 nt, Homo sapiens
gaauuucucuugcuuagga

SEQ ID NO: 1191730 - RNA, 19 nt, Homo sapiens
gcucagaggauuugaauuu

SEQ ID NO: 1191731 - RNA, 19 nt, Homo sapiens
gggaacugcucauagauuu

SEQ ID NO: 1191732 - RNA, 19 nt, Homo sapiens
ggacgagguuguucuguug

SEQ ID NO: 1191733 - RNA, 19 nt, Homo sapiens
gagauuggcuccuuugcuu

SEQ ID NO: 1191734 - RNA, 19 nt, Homo sapiens
gaagcugucugucucuuga

SEQ ID NO: 1191735 - RNA, 19 nt, Homo sapiens
ggccuuauguagaucauua

SEQ ID NO: 1191736 - RNA, 19 nt, Homo sapiens
guggaaaccuggugcuaua

SEQ ID NO: 1191737 - RNA, 19 nt, Homo sapiens
ggaagagaauguuguuuua

SEQ ID NO: 1191738 - RNA, 19 nt, Homo sapiens
aaggaaagcuggcaguuaa

SEQ ID NO: 1191739 - RNA, 19 nt, Homo sapiens
caaagaaggagauaccaua

SEQ ID NO: 1191740 - RNA, 19 nt, Homo sapiens
gcauuggccuuguauauca

SEQ ID NO: 1191741 - RNA, 19 nt, Homo sapiens
ggaauuuguucacuuguug

SEQ ID NO: 1191742 - RNA, 19 nt, Homo sapiens
gaaaggaguaagugaaauu

SEQ ID NO: 1191743 - RNA, 19 nt, Homo sapiens
gaaggaaagcuggcaguua

SEQ ID NO: 1191744 - RNA, 19 nt, Homo sapiens
ccaaugggauggcaaaguu

SEQ ID NO: 1191745 - RNA, 19 nt, Homo sapiens
gaggucaugucauuaauau

SEQ ID NO: 1191746 - RNA, 19 nt, Homo sapiens
gaaaggacaacgaugauug

SEQ ID NO: 1191747 - RNA, 19 nt, Homo sapiens
gaagggagcacaagcuuug

SEQ ID NO: 1191748 - RNA, 19 nt, Homo sapiens
gcagauaaaguugguguua

SEQ ID NO: 1191749 - RNA, 19 nt, Homo sapiens
gaacugcucauagauuuaa

SEQ ID NO: 1191750 - RNA, 19 nt, Homo sapiens
ccaaguggcugcagugguu

SEQ ID NO: 1191751 - RNA, 19 nt, Homo sapiens
caacagagccauugccuau

SEQ ID NO: 1191752 - RNA, 19 nt, Homo sapiens
uuacauagcuucauuacca

SEQ ID NO: 1191753 - RNA, 19 nt, Homo sapiens
gaugaugacugggaauauu

SEQ ID NO: 1191754 - RNA, 19 nt, Homo sapiens
ucuaauggcuccuuucuug

SEQ ID NO: 1191755 - RNA, 19 nt, Homo sapiens
ggagggagagggaaugaua

SEQ ID NO: 1191756 - RNA, 19 nt, Homo sapiens
ucagagauccuguccauaa

SEQ ID NO: 1191757 - RNA, 19 nt, Homo sapiens
caaaggaacacaacacuug

SEQ ID NO: 1191758 - RNA, 19 nt, Homo sapiens
caauauccaugacuacuug

SEQ ID NO: 1191759 - RNA, 19 nt, Homo sapiens
cauaaucagucuccaaaga

SEQ ID NO: 1191760 - RNA, 19 nt, Homo sapiens
gaacacaacaguagaccuu

SEQ ID NO: 1191761 - RNA, 19 nt, Homo sapiens
caagggauuugcaggaauu

SEQ ID NO: 1191762 - RNA, 19 nt, Homo sapiens
gcaaguagaacaagaggaa

SEQ ID NO: 1191763 - RNA, 19 nt, Homo sapiens
ggaauuuauuugugacuug

SEQ ID NO: 1191764 - RNA, 19 nt, Homo sapiens
gaacaugggucagaaacag

SEQ ID NO: 1191765 - RNA, 19 nt, Homo sapiens
gcagcuuugucgcuucuua

SEQ ID NO: 1191766 - RNA, 19 nt, Homo sapiens
gaugaauccucacaguauu

SEQ ID NO: 1191767 - RNA, 19 nt, Homo sapiens
gagcuugguuucugaugaa

SEQ ID NO: 1191768 - RNA, 19 nt, Homo sapiens
gaaugccaccuuauccuua

SEQ ID NO: 1191769 - RNA, 19 nt, Homo sapiens
gcauagaaggaaaggauua

SEQ ID NO: 1191770 - RNA, 19 nt, Homo sapiens
gaauuauggucuucugaug

SEQ ID NO: 1191771 - RNA, 19 nt, Homo sapiens
uaaaguugguguuagaguu

SEQ ID NO: 1191772 - RNA, 19 nt, Homo sapiens
agaaggagauaccauaaau

SEQ ID NO: 1191773 - RNA, 19 nt, Homo sapiens
gaagaugacggcaugaaug

SEQ ID NO: 1191774 - RNA, 19 nt, Homo sapiens
gaugagagcuugguuucug

SEQ ID NO: 1191775 - RNA, 19 nt, Homo sapiens
gagcuuaaguugaauacuc

SEQ ID NO: 1191776 - RNA, 19 nt, Homo sapiens
gaaaacggguggugaaaug

SEQ ID NO: 1191777 - RNA, 19 nt, Homo sapiens
gcaccuaaugcuucuguua

SEQ ID NO: 1191778 - RNA, 19 nt, Homo sapiens
gcaauguuccucaaauuau

SEQ ID NO: 1191779 - RNA, 19 nt, Homo sapiens
gaacaaaccaaagaagaau

SEQ ID NO: 1191780 - RNA, 19 nt, Homo sapiens
gcccugcuaugcccucuua

SEQ ID NO: 1191781 - RNA, 19 nt, Homo sapiens
ucacagacauacugcagaa

SEQ ID NO: 1191782 - RNA, 19 nt, Homo sapiens
cgacucagcuuggauuguu

SEQ ID NO: 1191783 - RNA, 19 nt, Homo sapiens
ggaagucugugcucucauc

SEQ ID NO: 1191784 - RNA, 19 nt, Homo sapiens
gaguggaauuuauuuguga

SEQ ID NO: 1191785 - RNA, 19 nt, Homo sapiens
cagaaacaaucucagcauu

SEQ ID NO: 1191786 - RNA, 19 nt, Homo sapiens
cagcaauguuccucaaauu

SEQ ID NO: 1191787 - RNA, 19 nt, Homo sapiens
gacauaguauuucucauuc

SEQ ID NO: 1191788 - RNA, 19 nt, Homo sapiens
caacauggcagcucuaagu

SEQ ID NO: 1191789 - RNA, 19 nt, Homo sapiens
aaacgugacuucugcacaa

SEQ ID NO: 1191790 - RNA, 19 nt, Homo sapiens
gcaccacccuaaugcuuug

SEQ ID NO: 1191791 - RNA, 19 nt, Homo sapiens
ggucagcucuccuacaaag

SEQ ID NO: 1191792 - RNA, 19 nt, Homo sapiens
ggauucacuuuaagagauu

SEQ ID NO: 1191793 - RNA, 19 nt, Homo sapiens
agaaauagcaguucagaug

SEQ ID NO: 1191794 - RNA, 19 nt, Homo sapiens
gaucacuauuccugaaauu

SEQ ID NO: 1191795 - RNA, 19 nt, Homo sapiens
aaauauggauugcuguuug

SEQ ID NO: 1191796 - RNA, 19 nt, Homo sapiens
ggaaaggauuacauagcuu

SEQ ID NO: 1191797 - RNA, 19 nt, Homo sapiens
aaacaggauuuaugcauca

SEQ ID NO: 1191798 - RNA, 19 nt, Homo sapiens
caacauaccagcaaaggau

SEQ ID NO: 1191799 - RNA, 19 nt, Homo sapiens
ggaucaggcuauaagaaga

SEQ ID NO: 1191800 - RNA, 19 nt, Homo sapiens
ucacuuagcccaccacaug

SEQ ID NO: 1191801 - RNA, 19 nt, Homo sapiens
gcagcaauuugauagguau

SEQ ID NO: 1191802 - RNA, 19 nt, Homo sapiens
aaacagugaucucuucuaa

SEQ ID NO: 1191803 - RNA, 19 nt, Homo sapiens
gaaguccucugcuguguug

SEQ ID NO: 1191804 - RNA, 19 nt, Homo sapiens
gggauuagauuaagaguag

SEQ ID NO: 1191805 - RNA, 19 nt, Homo sapiens
gaauuucucucuuggacaa

SEQ ID NO: 1191806 - RNA, 19 nt, Homo sapiens
uagcaaacccuucauuuaa

SEQ ID NO: 1191807 - RNA, 19 nt, Homo sapiens
acagugaucucuucuaaau

SEQ ID NO: 1191808 - RNA, 19 nt, Homo sapiens
gcaaacccuucauuuaaag

SEQ ID NO: 1191809 - RNA, 19 nt, Homo sapiens
ugaagcugaugguguauaa

SEQ ID NO: 1191810 - RNA, 19 nt, Homo sapiens
gcucuggccucgucuucua

SEQ ID NO: 1191811 - RNA, 19 nt, Homo sapiens
ccacacugcuaauuacuau

SEQ ID NO: 1191812 - RNA, 19 nt, Homo sapiens
ucuguaaucugcuaugaaa

SEQ ID NO: 1191813 - RNA, 19 nt, Homo sapiens
ggagggaggugcguuggaa

SEQ ID NO: 1191814 - RNA, 19 nt, Homo sapiens
ccuguuagcucccaaacuu

SEQ ID NO: 1191815 - RNA, 19 nt, Homo sapiens
gcagcagggucuggucaua

SEQ ID NO: 1191816 - RNA, 19 nt, Homo sapiens
ccagaucucuaccacagaa

SEQ ID NO: 1191817 - RNA, 19 nt, Homo sapiens
ggguaucaaugcuaauauu

SEQ ID NO: 1191818 - RNA, 19 nt, Homo sapiens
gggcacaggccaacuauau

SEQ ID NO: 1191819 - RNA, 19 nt, Homo sapiens
cccauaaguuggaggauaa

SEQ ID NO: 1191820 - RNA, 19 nt, Homo sapiens
gcacagagggccuagauac

SEQ ID NO: 1191821 - RNA, 19 nt, Homo sapiens
cagcuucccuuaacucugu

SEQ ID NO: 1191822 - RNA, 19 nt, Homo sapiens
gcauaacagugaggcauug

SEQ ID NO: 1191823 - RNA, 19 nt, Homo sapiens
uuagcaaacccuucauuua

SEQ ID NO: 1191824 - RNA, 19 nt, Homo sapiens
caaauuagcaaacccuuca

SEQ ID NO: 1191825 - RNA, 19 nt, Homo sapiens
ccuugaagcugauggugua

SEQ ID NO: 1191826 - RNA, 19 nt, Homo sapiens
ggaggugcguuggaaauuc

SEQ ID NO: 1191827 - RNA, 19 nt, Homo sapiens
caaggcccaugaugacauu

SEQ ID NO: 1191828 - RNA, 19 nt, Homo sapiens
gcucuucccucccucacuu

SEQ ID NO: 1191829 - RNA, 19 nt, Homo sapiens
ucaacacccuaagcaauuu

SEQ ID NO: 1191830 - RNA, 19 nt, Homo sapiens
guaaucugcuaugaaagaa

SEQ ID NO: 1191831 - RNA, 19 nt, Homo sapiens
aaauggguaucaaugcuaa

SEQ ID NO: 1191832 - RNA, 19 nt, Homo sapiens
ugucaagucugcuggaaug

SEQ ID NO: 1191833 - RNA, 19 nt, Homo sapiens
agcaaacccuucauuuaaa

SEQ ID NO: 1191834 - RNA, 19 nt, Homo sapiens
gcacuaugcggucaggauu

SEQ ID NO: 1191835 - RNA, 19 nt, Homo sapiens
ggagagagaggcaguguac

SEQ ID NO: 1191836 - RNA, 19 nt, Homo sapiens
gaucucuaccacagaauaa

SEQ ID NO: 1191837 - RNA, 19 nt, Homo sapiens
gcacaggccaacuauaugg

SEQ ID NO: 1191838 - RNA, 19 nt, Homo sapiens
guucccacacugcuaauua

SEQ ID NO: 1191839 - RNA, 19 nt, Homo sapiens
ggaauuaggggauuagauu

SEQ ID NO: 1191840 - RNA, 19 nt, Homo sapiens
gaaagccaauguggagaag

SEQ ID NO: 1191841 - RNA, 19 nt, Homo sapiens
gcaggaaguagaacagaau

SEQ ID NO: 1191842 - RNA, 19 nt, Homo sapiens
cagcagagacccauuugug

SEQ ID NO: 1191843 - RNA, 19 nt, Homo sapiens
cuggagguguucaauauga

SEQ ID NO: 1191844 - RNA, 19 nt, Homo sapiens
ccagagguuucuuucuuuc

SEQ ID NO: 1191845 - RNA, 19 nt, Homo sapiens
acucgaggcugaacaagga

SEQ ID NO: 1191846 - RNA, 19 nt, Homo sapiens
gauuaagaguagguaaaga

SEQ ID NO: 1191847 - RNA, 19 nt, Homo sapiens
gcccagaccacaauauuuc

SEQ ID NO: 1191848 - RNA, 19 nt, Homo sapiens
gagagaggcaguguacuug

SEQ ID NO: 1191849 - RNA, 19 nt, Homo sapiens
ggagguuaaggcuagguua

SEQ ID NO: 1191850 - RNA, 19 nt, Homo sapiens
ccuaagcaauuucucaaag

SEQ ID NO: 1191851 - RNA, 19 nt, Homo sapiens
cuuaaacagugaucucuuc

SEQ ID NO: 1191852 - RNA, 19 nt, Homo sapiens
ccaguggcaacuccuguua

SEQ ID NO: 1191853 - RNA, 19 nt, Homo sapiens
gaggugcguuggaaauucu

SEQ ID NO: 1191854 - RNA, 19 nt, Homo sapiens
ccaggugccuuuggagguu

SEQ ID NO: 1191855 - RNA, 19 nt, Homo sapiens
ugaguccucugucaugugu

SEQ ID NO: 1191856 - RNA, 19 nt, Homo sapiens
aagaugaggugaggaagga

SEQ ID NO: 1191857 - RNA, 19 nt, Homo sapiens
ggacgugucgggaauuucu

SEQ ID NO: 1191858 - RNA, 19 nt, Homo sapiens
acacugcuaauuacuauga

SEQ ID NO: 1191859 - RNA, 19 nt, Homo sapiens
cuauacaacugugaaauac

SEQ ID NO: 1191860 - RNA, 19 nt, Homo sapiens
ccgugaagcuggagguguu

SEQ ID NO: 1191861 - RNA, 19 nt, Homo sapiens
ccugaaggcacuacugaaa

SEQ ID NO: 1191862 - RNA, 19 nt, Homo sapiens
gugacaaggcccaugauga

SEQ ID NO: 1191863 - RNA, 19 nt, Homo sapiens
gccuggagcccuacuuuga

SEQ ID NO: 1191864 - RNA, 19 nt, Homo sapiens
uguaaucugcuaugaaaga

SEQ ID NO: 1191865 - RNA, 19 nt, Homo sapiens
aaaguugcccucacccaaa

SEQ ID NO: 1191866 - RNA, 19 nt, Homo sapiens
gaauuaggggauuagauua

SEQ ID NO: 1191867 - RNA, 19 nt, Homo sapiens
guguuggccuggucgcuuu

SEQ ID NO: 1191868 - RNA, 19 nt, Homo sapiens
ggguugcuguccaguguug

SEQ ID NO: 1191869 - RNA, 19 nt, Homo sapiens
gcagucugacccaaaguug

SEQ ID NO: 1191870 - RNA, 19 nt, Homo sapiens
uaacagugaggcauugugu

SEQ ID NO: 1191871 - RNA, 19 nt, Homo sapiens
guucaacacccuaagcaau

SEQ ID NO: 1191872 - RNA, 19 nt, Homo sapiens
ucccuaggcuacaaugcua

SEQ ID NO: 1191873 - RNA, 19 nt, Homo sapiens
accagagguuucuuucuuu

SEQ ID NO: 1191874 - RNA, 19 nt, Homo sapiens
cagcugauacgugugcaua

SEQ ID NO: 1191875 - RNA, 19 nt, Homo sapiens
ucccaaacuuaaacaguga

SEQ ID NO: 1191876 - RNA, 19 nt, Homo sapiens
cagcagcaguucucaugag

SEQ ID NO: 1191877 - RNA, 19 nt, Homo sapiens
ugaaagccaauguggagaa

SEQ ID NO: 1191878 - RNA, 19 nt, Homo sapiens
ugaaggcacuacugaaagc

SEQ ID NO: 1191879 - RNA, 19 nt, Homo sapiens
gugaagaugaggugaggaa

SEQ ID NO: 1191880 - RNA, 19 nt, Homo sapiens
gauguggcauuggcuaugg

SEQ ID NO: 1191881 - RNA, 19 nt, Homo sapiens
agagagaggcaguguacuu

SEQ ID NO: 1191882 - RNA, 19 nt, Homo sapiens
cagcagggucuggucauaa

SEQ ID NO: 1191883 - RNA, 19 nt, Homo sapiens
gucgggaauuucucucuug

SEQ ID NO: 1191884 - RNA, 19 nt, Homo sapiens
ggaagcccuugaagcugau

SEQ ID NO: 1191885 - RNA, 19 nt, Homo sapiens
gcugauacgugugcauaac

SEQ ID NO: 1191886 - RNA, 19 nt, Homo sapiens
uaaagcaaacccuugucaa

SEQ ID NO: 1191887 - RNA, 19 nt, Homo sapiens
uaaacagugaucucuucua

SEQ ID NO: 1191888 - RNA, 19 nt, Homo sapiens
ggacuucuuuacgcucauc

SEQ ID NO: 1191889 - RNA, 19 nt, Homo sapiens
ugacaaggcccaugaugac

SEQ ID NO: 1191890 - RNA, 19 nt, Homo sapiens
caggugccuuuggagguua

SEQ ID NO: 1191891 - RNA, 19 nt, Homo sapiens
uacuuugacuucaucauca

SEQ ID NO: 1191892 - RNA, 19 nt, Homo sapiens
agucucaccuuuacaggau

SEQ ID NO: 1191893 - RNA, 19 nt, Homo sapiens
gggaggugcguuggaaauu

SEQ ID NO: 1191894 - RNA, 19 nt, Homo sapiens
cauaauccagugugaagau

SEQ ID NO: 1191895 - RNA, 19 nt, Homo sapiens
gcugugacaaggcccauga

SEQ ID NO: 1191896 - RNA, 19 nt, Homo sapiens
gugagcagguguggcaugu

SEQ ID NO: 1191897 - RNA, 19 nt, Homo sapiens
gaaauucuaggcccuucag

SEQ ID NO: 1191898 - RNA, 19 nt, Homo sapiens
ccuggucgcuuugauucuu

SEQ ID NO: 1191899 - RNA, 19 nt, Homo sapiens
ggcccaugaugacauuuca

SEQ ID NO: 1191900 - RNA, 19 nt, Homo sapiens
agcuggagguguucaauau

SEQ ID NO: 1191901 - RNA, 19 nt, Homo sapiens
gaaugcaggaaguagaaca

SEQ ID NO: 1191902 - RNA, 19 nt, Homo sapiens
ugacauugcuuguuuguaa

SEQ ID NO: 1191903 - RNA, 19 nt, Homo sapiens
gagagacgcccucaaauuu

SEQ ID NO: 1191904 - RNA, 19 nt, Homo sapiens
gacaugaggugcccuuauu

SEQ ID NO: 1191905 - RNA, 19 nt, Homo sapiens
gaauaggccugaaugagau

SEQ ID NO: 1191906 - RNA, 19 nt, Homo sapiens
ggugggaauugcaagauua

SEQ ID NO: 1191907 - RNA, 19 nt, Homo sapiens
ggaacaacuuuauccagaa

SEQ ID NO: 1191908 - RNA, 19 nt, Homo sapiens
ccaugaaccuaauaaacua

SEQ ID NO: 1191909 - RNA, 19 nt, Homo sapiens
gaugaaauguaucguguuc

SEQ ID NO: 1191910 - RNA, 19 nt, Homo sapiens
gcacuguuccuaaaucauu

SEQ ID NO: 1191911 - RNA, 19 nt, Homo sapiens
ugaauuugaucucugauug

SEQ ID NO: 1191912 - RNA, 19 nt, Homo sapiens
gaaguuaggugggaauugc

SEQ ID NO: 1191913 - RNA, 19 nt, Homo sapiens
gaacaacuuuauccagaac

SEQ ID NO: 1191914 - RNA, 19 nt, Homo sapiens
ggaaggaguaaaucuaaga

SEQ ID NO: 1191915 - RNA, 19 nt, Homo sapiens
ugaaacagguauugucauc

SEQ ID NO: 1191916 - RNA, 19 nt, Homo sapiens
guaacuauuugagacauga

SEQ ID NO: 1191917 - RNA, 19 nt, Homo sapiens
guuaaagcccuauuugcua

SEQ ID NO: 1191918 - RNA, 19 nt, Homo sapiens
ugauugagcucucuucucu

SEQ ID NO: 1191919 - RNA, 19 nt, Homo sapiens
agucuugcauuucuagaua

SEQ ID NO: 1191920 - RNA, 19 nt, Homo sapiens
ggaauugcaagauuaagga

SEQ ID NO: 1191921 - RNA, 19 nt, Homo sapiens
ggaauucuguuaaaagaug

SEQ ID NO: 1191922 - RNA, 19 nt, Homo sapiens
ccacagucuugcauuucua

SEQ ID NO: 1191923 - RNA, 19 nt, Homo sapiens
gaggugcccuuauuguaca

SEQ ID NO: 1191924 - RNA, 19 nt, Homo sapiens
gaauuugaucucugauuga

SEQ ID NO: 1191925 - RNA, 19 nt, Homo sapiens
agaauaggccugaaugaga

SEQ ID NO: 1191926 - RNA, 19 nt, Homo sapiens
uuauagcacuguuccuaaa

SEQ ID NO: 1191927 - RNA, 19 nt, Homo sapiens
ccaccacuauccucagcua

SEQ ID NO: 1191928 - RNA, 19 nt, Homo sapiens
aaauuuaacuccuggugau

SEQ ID NO: 1191929 - RNA, 19 nt, Homo sapiens
ucucuggaauucuguuaaa

SEQ ID NO: 1191930 - RNA, 19 nt, Homo sapiens
cagguauugucaucucuuu

SEQ ID NO: 1191931 - RNA, 19 nt, Homo sapiens
ggauuucugucuauguauc

SEQ ID NO: 1191932 - RNA, 19 nt, Homo sapiens
gcauaucucacucccagaa

SEQ ID NO: 1191933 - RNA, 19 nt, Homo sapiens
uauccaagguaucaaggaa

SEQ ID NO: 1191934 - RNA, 19 nt, Homo sapiens
aaacagguauugucaucuc

SEQ ID NO: 1191935 - RNA, 19 nt, Homo sapiens
agucucugcuugaauguaa

SEQ ID NO: 1191936 - RNA, 19 nt, Homo sapiens
ugagcucucuucucuggaa

SEQ ID NO: 1191937 - RNA, 19 nt, Homo sapiens
cuggauuucugucuaugua

SEQ ID NO: 1191938 - RNA, 19 nt, Homo sapiens
uuaugcuucuguucuguua

SEQ ID NO: 1191939 - RNA, 19 nt, Homo sapiens
ggauuaguccuucaugcaa

SEQ ID NO: 1191940 - RNA, 19 nt, Homo sapiens
uuacuucaguuccuugugu

SEQ ID NO: 1191941 - RNA, 19 nt, Homo sapiens
ccaaaguuauagcacuguu

SEQ ID NO: 1191942 - RNA, 19 nt, Homo sapiens
ccacuauccucagcuacuu

SEQ ID NO: 1191943 - RNA, 19 nt, Homo sapiens
gacaaccugcccucacuuu

SEQ ID NO: 1191944 - RNA, 19 nt, Homo sapiens
ugucaucucuuugugucua

SEQ ID NO: 1191945 - RNA, 19 nt, Homo sapiens
ucacuucauuucauuaggu

SEQ ID NO: 1191946 - RNA, 19 nt, Homo sapiens
caaccugcccucacuuuua

SEQ ID NO: 1191947 - RNA, 19 nt, Homo sapiens
gguauugucaucucuuugu

SEQ ID NO: 1191948 - RNA, 19 nt, Homo sapiens
cauauccacagaacucuuu

SEQ ID NO: 1191949 - RNA, 19 nt, Homo sapiens
guuauagcacuguuccuaa

SEQ ID NO: 1191950 - RNA, 19 nt, Homo sapiens
gggaaggaguaaaucuaag

SEQ ID NO: 1191951 - RNA, 19 nt, Homo sapiens
ugacuucuuucccaaccuu

SEQ ID NO: 1191952 - RNA, 19 nt, Homo sapiens
uagcacuguuccuaaauca

SEQ ID NO: 1191953 - RNA, 19 nt, Homo sapiens
ucacaacuggguagcauau

SEQ ID NO: 1191954 - RNA, 19 nt, Homo sapiens
gggacaaccugcccucacu

SEQ ID NO: 1191955 - RNA, 19 nt, Homo sapiens
gcucucuucucuggaauuc

SEQ ID NO: 1191956 - RNA, 19 nt, Homo sapiens
uccaagguaucaaggaaga

SEQ ID NO: 1191957 - RNA, 19 nt, Homo sapiens
ugucuacuuugccaccuuu

SEQ ID NO: 1191958 - RNA, 19 nt, Homo sapiens
caacuuuauccagaacuuu

SEQ ID NO: 1191959 - RNA, 19 nt, Homo sapiens
uccagucucugcuugaaug

SEQ ID NO: 1191960 - RNA, 19 nt, Homo sapiens
gaaugagauugaaaacguu

SEQ ID NO: 1191961 - RNA, 19 nt, Homo sapiens
ccagaauaggccugaauga

SEQ ID NO: 1191962 - RNA, 19 nt, Homo sapiens
uaucauauccacagaacuc

SEQ ID NO: 1191963 - RNA, 19 nt, Homo sapiens
ggaaguuaggugggaauug

SEQ ID NO: 1191964 - RNA, 19 nt, Homo sapiens
ucucuucucuggaauucug

SEQ ID NO: 1191965 - RNA, 19 nt, Homo sapiens
ugaaugagauugaaaacgu

SEQ ID NO: 1191966 - RNA, 19 nt, Homo sapiens
uaugaaacagguauuguca

SEQ ID NO: 1191967 - RNA, 19 nt, Homo sapiens
gcuacuuuaugcuucuguu

SEQ ID NO: 1191968 - RNA, 19 nt, Homo sapiens
ggacaaccugcccucacuu

SEQ ID NO: 1191969 - RNA, 19 nt, Homo sapiens
gcuuguuuguaacuaagaa

SEQ ID NO: 1191970 - RNA, 19 nt, Homo sapiens
guauugucaucucuuugug

SEQ ID NO: 1191971 - RNA, 19 nt, Homo sapiens
uuuccacagucuugcauuu

SEQ ID NO: 1191972 - RNA, 19 nt, Homo sapiens
acaacuggguagcauaucu

SEQ ID NO: 1191973 - RNA, 19 nt, Homo sapiens
augcuucuguucuguuaaa

SEQ ID NO: 1191974 - RNA, 19 nt, Homo sapiens
acaacuuuauccagaacuu

SEQ ID NO: 1191975 - RNA, 19 nt, Homo sapiens
gugcuuaauugcaguuggu

SEQ ID NO: 1191976 - RNA, 19 nt, Homo sapiens
guugguguucuaauaguuu

SEQ ID NO: 1191977 - RNA, 19 nt, Homo sapiens
uaaugccacuccagucucu

SEQ ID NO: 1191978 - RNA, 19 nt, Homo sapiens
uggugaauuugaucucuga

SEQ ID NO: 1191979 - RNA, 19 nt, Homo sapiens
guaugaaacagguauuguc

SEQ ID NO: 1191980 - RNA, 19 nt, Homo sapiens
gugggaauugcaagauuaa

SEQ ID NO: 1191981 - RNA, 19 nt, Homo sapiens
uugcauuucuagauacuuc

SEQ ID NO: 1191982 - RNA, 19 nt, Homo sapiens
cucuguugguguucuaaua

SEQ ID NO: 1191983 - RNA, 19 nt, Homo sapiens
gugaauuugaucucugauu

SEQ ID NO: 1191984 - RNA, 19 nt, Homo sapiens
gacauugcuuguuuguaac

SEQ ID NO: 1191985 - RNA, 19 nt, Homo sapiens
gggaauugcaagauuaagg

SEQ ID NO: 1191986 - RNA, 19 nt, Homo sapiens
ucacaugccuccccuagca

SEQ ID NO: 1191987 - RNA, 19 nt, Homo sapiens
gcaaggggaaggaguaaau

SEQ ID NO: 1191988 - RNA, 19 nt, Homo sapiens
aaacguuacuucaguuccu

SEQ ID NO: 1191989 - RNA, 19 nt, Homo sapiens
cagaauaggccugaaugag

SEQ ID NO: 1191990 - RNA, 19 nt, Homo sapiens
aggcauccauuuccacagu

SEQ ID NO: 1191991 - RNA, 19 nt, Homo sapiens
uuucuggauuucugucuau

SEQ ID NO: 1191992 - RNA, 19 nt, Homo sapiens
guuucuuccuucacuguug

SEQ ID NO: 1191993 - RNA, 19 nt, Homo sapiens
cuagugguuucuuccuuca

SEQ ID NO: 1191994 - RNA, 19 nt, Homo sapiens
gccuagugguuucuuccuu

SEQ ID NO: 1191995 - RNA, 19 nt, Homo sapiens
ccucagcuacuuuaugcuu

SEQ ID NO: 1191996 - RNA, 19 nt, Homo sapiens
ugaggugcccuuauuguac

SEQ ID NO: 1191997 - RNA, 19 nt, Homo sapiens
caugaggugcccuuauugu

SEQ ID NO: 1191998 - RNA, 19 nt, Homo sapiens
gcauccauuuccacagucu

SEQ ID NO: 1191999 - RNA, 19 nt, Homo sapiens
gcaguuggugaauuugauc

SEQ ID NO: 1192000 - RNA, 19 nt, Homo sapiens
gcaagauuaaggagauuuu

SEQ ID NO: 1192001 - RNA, 19 nt, Homo sapiens
ggggaaggaguaaaucuaa

SEQ ID NO: 1192002 - RNA, 19 nt, Homo sapiens
gaaccaauauauacaaugg

SEQ ID NO: 1192003 - RNA, 19 nt, Homo sapiens
gaggaggaauucauagaaa

SEQ ID NO: 1192004 - RNA, 19 nt, Homo sapiens
ggaggaauucauagaaaua

SEQ ID NO: 1192005 - RNA, 19 nt, Homo sapiens
ggaggaggaggaauucaua

SEQ ID NO: 1192006 - RNA, 19 nt, Homo sapiens
ucauagaaauaacgacuga

SEQ ID NO: 1192007 - RNA, 19 nt, Homo sapiens
aagaacaucuccagaggaa

SEQ ID NO: 1192008 - RNA, 19 nt, Homo sapiens
caucgaagaaccaauauau

SEQ ID NO: 1192009 - RNA, 19 nt, Homo sapiens
agacaucgaagaaccaaua

SEQ ID NO: 1192010 - RNA, 19 nt, Homo sapiens
gaagcuacaucccucaaac

SEQ ID NO: 1192011 - RNA, 19 nt, Homo sapiens
ggaggaggaauucauagaa

SEQ ID NO: 1192012 - RNA, 19 nt, Homo sapiens
agaaauaacgacugaaaga

SEQ ID NO: 1192013 - RNA, 19 nt, Homo sapiens
gaacaucuccagaggaacu

SEQ ID NO: 1192014 - RNA, 19 nt, Homo sapiens
ccucaaacuucggcaauga

SEQ ID NO: 1192015 - RNA, 19 nt, Homo sapiens
cgaagaaccaauauauaca

SEQ ID NO: 1192016 - RNA, 19 nt, Homo sapiens
gaaauaacgacugaaagac

SEQ ID NO: 1192017 - RNA, 19 nt, Homo sapiens
ccaaugaggccaacaagac

SEQ ID NO: 1192018 - RNA, 19 nt, Homo sapiens
ucgaagaaccaauauauac

SEQ ID NO: 1192019 - RNA, 19 nt, Homo sapiens
aaauggaggaggaggaauu

SEQ ID NO: 1192020 - RNA, 19 nt, Homo sapiens
ucaaacuucggcaaugaaa

SEQ ID NO: 1192021 - RNA, 19 nt, Homo sapiens
aggaggaauucauagaaau

SEQ ID NO: 1192022 - RNA, 19 nt, Homo sapiens
ccaaauggaggaggaggaa

SEQ ID NO: 1192023 - RNA, 19 nt, Homo sapiens
cccgcaaccugcuccuaaa

SEQ ID NO: 1192024 - RNA, 19 nt, Homo sapiens
caccaggaggguaugcaua

SEQ ID NO: 1192025 - RNA, 19 nt, Homo sapiens
ggaauucauagaaauaacg

SEQ ID NO: 1192026 - RNA, 19 nt, Homo sapiens
gcuacaucccucaaacuuc

SEQ ID NO: 1192027 - RNA, 19 nt, Homo sapiens
uauauacaaugggccaaca

SEQ ID NO: 1192028 - RNA, 19 nt, Homo sapiens
gccaaugaggccaacaaga

SEQ ID NO: 1192029 - RNA, 19 nt, Homo sapiens
gaggaggaggaauucauag

SEQ ID NO: 1192030 - RNA, 19 nt, Homo sapiens
ggaaagggcuguguuuaug

SEQ ID NO: 1192031 - RNA, 19 nt, Homo sapiens
caaagaggcugggcaauga

SEQ ID NO: 1192032 - RNA, 19 nt, Homo sapiens
gcaaugacaucgcccuuau

SEQ ID NO: 1192033 - RNA, 19 nt, Homo sapiens
gaaaugauccagccugugu

SEQ ID NO: 1192034 - RNA, 19 nt, Homo sapiens
gaucaccucuugccagaug

SEQ ID NO: 1192035 - RNA, 19 nt, Homo sapiens
caaaauuccugacgagaua

SEQ ID NO: 1192036 - RNA, 19 nt, Homo sapiens
ucagauaaccucagaguga

SEQ ID NO: 1192037 - RNA, 19 nt, Homo sapiens
gaaccaaacccacccuuuc

SEQ ID NO: 1192038 - RNA, 19 nt, Homo sapiens
gcucauccuuuaaguguau

SEQ ID NO: 1192039 - RNA, 19 nt, Homo sapiens
guaacacuguggccuacua

SEQ ID NO: 1192040 - RNA, 19 nt, Homo sapiens
gaaaauaaguccuguugca

SEQ ID NO: 1192041 - RNA, 19 nt, Homo sapiens
ggagugcaguggcgaaauc

SEQ ID NO: 1192042 - RNA, 19 nt, Homo sapiens
gaggcacccuuccaucuga

SEQ ID NO: 1192043 - RNA, 19 nt, Homo sapiens
ggagguuaaucuaggaaug

SEQ ID NO: 1192044 - RNA, 19 nt, Homo sapiens
guccaucgaucaccucuug

SEQ ID NO: 1192045 - RNA, 19 nt, Homo sapiens
caucguggguggaaacaug

SEQ ID NO: 1192046 - RNA, 19 nt, Homo sapiens
ggaagggucacuacgcaaa

SEQ ID NO: 1192047 - RNA, 19 nt, Homo sapiens
gauauuagcacuggccauu

SEQ ID NO: 1192048 - RNA, 19 nt, Homo sapiens
gaaagaggcacccuuccau

SEQ ID NO: 1192049 - RNA, 19 nt, Homo sapiens
ccaccacacccaacuaauu

SEQ ID NO: 1192050 - RNA, 19 nt, Homo sapiens
gcccagaagugcagaacug

SEQ ID NO: 1192051 - RNA, 19 nt, Homo sapiens
agacaggguuucaccaugu

SEQ ID NO: 1192052 - RNA, 19 nt, Homo sapiens
caccacacccaacuaauuu

SEQ ID NO: 1192053 - RNA, 19 nt, Homo sapiens
ugacaucgcccuuaugaag

SEQ ID NO: 1192054 - RNA, 19 nt, Homo sapiens
ugacaaggugacugcauua

SEQ ID NO: 1192055 - RNA, 19 nt, Homo sapiens
ccacagugcugggauuaca

SEQ ID NO: 1192056 - RNA, 19 nt, Homo sapiens
caucacugcugcacacugu

SEQ ID NO: 1192057 - RNA, 19 nt, Homo sapiens
gaguucagauaaccucaga

SEQ ID NO: 1192058 - RNA, 19 nt, Homo sapiens
caagcuaugugaguucaga

SEQ ID NO: 1192059 - RNA, 19 nt, Homo sapiens
ucauugggaucauugcauu

SEQ ID NO: 1192060 - RNA, 19 nt, Homo sapiens
cuacuuccaagacuuauuu

SEQ ID NO: 1192061 - RNA, 19 nt, Homo sapiens
gagaggaggcuguggaagu

SEQ ID NO: 1192062 - RNA, 19 nt, Homo sapiens
acaaguagccaccugaguu

SEQ ID NO: 1192063 - RNA, 19 nt, Homo sapiens
gcagauggagagagaccua

SEQ ID NO: 1192064 - RNA, 19 nt, Homo sapiens
agaggaggcuguggaaguu

SEQ ID NO: 1192065 - RNA, 19 nt, Homo sapiens
ccaaagaggcugggcaaug

SEQ ID NO: 1192066 - RNA, 19 nt, Homo sapiens
uauguuuccuucccucaaa

SEQ ID NO: 1192067 - RNA, 19 nt, Homo sapiens
gguggagucucgcucuguu

SEQ ID NO: 1192068 - RNA, 19 nt, Homo sapiens
gcaaguacaagccaaagag

SEQ ID NO: 1192069 - RNA, 19 nt, Homo sapiens
caaggugacugcauuacac

SEQ ID NO: 1192070 - RNA, 19 nt, Homo sapiens
gggaggaguuuguguccau

SEQ ID NO: 1192071 - RNA, 19 nt, Homo sapiens
gcuaugugaguucagauaa

SEQ ID NO: 1192072 - RNA, 19 nt, Homo sapiens
ccacugguccaucugguuu

SEQ ID NO: 1192073 - RNA, 19 nt, Homo sapiens
uggccaggcugcucucaaa

SEQ ID NO: 1192074 - RNA, 19 nt, Homo sapiens
gagguuaaucuaggaauga

SEQ ID NO: 1192075 - RNA, 19 nt, Homo sapiens
ccaggggucuugcaaaauu

SEQ ID NO: 1192076 - RNA, 19 nt, Homo sapiens
gacaggguuucaccauguu

SEQ ID NO: 1192077 - RNA, 19 nt, Homo sapiens
ccaggaaagggcuguguuu

SEQ ID NO: 1192078 - RNA, 19 nt, Homo sapiens
caggaaagggcuguguuua

SEQ ID NO: 1192079 - RNA, 19 nt, Homo sapiens
gcauuacaccacucaguau

SEQ ID NO: 1192080 - RNA, 19 nt, Homo sapiens
gaaagggcuguguuuaugg

SEQ ID NO: 1192081 - RNA, 19 nt, Homo sapiens
uuuggugcuugacguauua

SEQ ID NO: 1192082 - RNA, 19 nt, Homo sapiens
cugacgagauaagcaguua

SEQ ID NO: 1192083 - RNA, 19 nt, Homo sapiens
ggacggcucggguacuuuc

SEQ ID NO: 1192084 - RNA, 19 nt, Homo sapiens
acucgggaauuaugaggua

SEQ ID NO: 1192085 - RNA, 19 nt, Homo sapiens
gggucuaguuucccuguug

SEQ ID NO: 1192086 - RNA, 19 nt, Homo sapiens
gcucagggaaguacagaug

SEQ ID NO: 1192087 - RNA, 19 nt, Homo sapiens
cuaggaaugacucguuuaa

SEQ ID NO: 1192088 - RNA, 19 nt, Homo sapiens
gaacaagccugggguguac

SEQ ID NO: 1192089 - RNA, 19 nt, Homo sapiens
uggagaagauugucuacca

SEQ ID NO: 1192090 - RNA, 19 nt, Homo sapiens
uuacaccacucaguauaug

SEQ ID NO: 1192091 - RNA, 19 nt, Homo sapiens
cagagguccugaaauaguc

SEQ ID NO: 1192092 - RNA, 19 nt, Homo sapiens
gacguauuauuguccuuug

SEQ ID NO: 1192093 - RNA, 19 nt, Homo sapiens
gcauuuggugcuugacgua

SEQ ID NO: 1192094 - RNA, 19 nt, Homo sapiens
aggaaugacucguuuaagg

SEQ ID NO: 1192095 - RNA, 19 nt, Homo sapiens
ucggguacuuucguucuua

SEQ ID NO: 1192096 - RNA, 19 nt, Homo sapiens
gccucacgcuccuuucuga

SEQ ID NO: 1192097 - RNA, 19 nt, Homo sapiens
ugucacugcugccauugaa

SEQ ID NO: 1192098 - RNA, 19 nt, Homo sapiens
caaguagccaccugaguuc

SEQ ID NO: 1192099 - RNA, 19 nt, Homo sapiens
ccaacaagaucugcaacca

SEQ ID NO: 1192100 - RNA, 19 nt, Homo sapiens
gaagggucacuacgcaaau

SEQ ID NO: 1192101 - RNA, 19 nt, Homo sapiens
ucacagcugcuucguggaa

SEQ ID NO: 1192102 - RNA, 19 nt, Homo sapiens
gguacuuucguucuuaauu

SEQ ID NO: 1192103 - RNA, 19 nt, Homo sapiens
aaacccacccuuucuacuu

SEQ ID NO: 1192104 - RNA, 19 nt, Homo sapiens
ucaaaccccugaccucaaa

SEQ ID NO: 1192105 - RNA, 19 nt, Homo sapiens
ggcaaugacaucgcccuua

SEQ ID NO: 1192106 - RNA, 19 nt, Homo sapiens
cauuacaccacucaguaua

SEQ ID NO: 1192107 - RNA, 19 nt, Homo sapiens
aaugacaucgcccuuauga

SEQ ID NO: 1192108 - RNA, 19 nt, Homo sapiens
caaaagaagcagcaacuug

SEQ ID NO: 1192109 - RNA, 19 nt, Homo sapiens
gugacggagucucggauug

SEQ ID NO: 1192110 - RNA, 19 nt, Homo sapiens
acgagcagauggagagaga

SEQ ID NO: 1192111 - RNA, 19 nt, Homo sapiens
gaggaggcuguggaaguua

SEQ ID NO: 1192112 - RNA, 19 nt, Homo sapiens
gcaaccacagggacgugua

SEQ ID NO: 1192113 - RNA, 19 nt, Homo sapiens
caucgucauugggaucauu

SEQ ID NO: 1192114 - RNA, 19 nt, Homo sapiens
uggccuugaugauuugaaa

SEQ ID NO: 1192115 - RNA, 19 nt, Homo sapiens
cggguacuuucguucuuaa

SEQ ID NO: 1192116 - RNA, 19 nt, Homo sapiens
ggucacuacgcaaauguug

SEQ ID NO: 1192117 - RNA, 19 nt, Homo sapiens
uauuagcacuggccauugg

SEQ ID NO: 1192118 - RNA, 19 nt, Homo sapiens
ggugcuugacguauuauug

SEQ ID NO: 1192119 - RNA, 19 nt, Homo sapiens
uaguuucccuguuggacaa

SEQ ID NO: 1192120 - RNA, 19 nt, Homo sapiens
gcaguuccgggaggaguuu

SEQ ID NO: 1192121 - RNA, 19 nt, Homo sapiens
gugcuugacguauuauugu

SEQ ID NO: 1192122 - RNA, 19 nt, Homo sapiens
ccuuugauuuccaacaaga

SEQ ID NO: 1192123 - RNA, 19 nt, Homo sapiens
aggaaagggcuguguuuau

SEQ ID NO: 1192124 - RNA, 19 nt, Homo sapiens
ccuuucugaucuucacuaa

SEQ ID NO: 1192125 - RNA, 19 nt, Homo sapiens
uuaaguguaucgagcugau

SEQ ID NO: 1192126 - RNA, 19 nt, Homo sapiens
ucagggaaguacagauguc

SEQ ID NO: 1192127 - RNA, 19 nt, Homo sapiens
ucacgcuccuuucugaucu

SEQ ID NO: 1192128 - RNA, 19 nt, Homo sapiens
cguggugccaucuacauuu

SEQ ID NO: 1192129 - RNA, 19 nt, Homo sapiens
cgaaagaggcacccuucca

SEQ ID NO: 1192130 - RNA, 19 nt, Homo sapiens
ggacugaacuagagaaugu

SEQ ID NO: 1192131 - RNA, 19 nt, Homo sapiens
caaagaggcugggcaauga

SEQ ID NO: 1192132 - RNA, 19 nt, Homo sapiens
gggaaaggauaguuaaauu

SEQ ID NO: 1192133 - RNA, 19 nt, Homo sapiens
gcaaugacaucgcccuuau

SEQ ID NO: 1192134 - RNA, 19 nt, Homo sapiens
caaauaagaugccauucug

SEQ ID NO: 1192135 - RNA, 19 nt, Homo sapiens
gaaaugauccagccugugu

SEQ ID NO: 1192136 - RNA, 19 nt, Homo sapiens
gaucaccucuugccagaug

SEQ ID NO: 1192137 - RNA, 19 nt, Homo sapiens
caaaauuccugacgagaua

SEQ ID NO: 1192138 - RNA, 19 nt, Homo sapiens
ucagauaaccucagaguga

SEQ ID NO: 1192139 - RNA, 19 nt, Homo sapiens
gaaccaaacccacccuuuc

SEQ ID NO: 1192140 - RNA, 19 nt, Homo sapiens
gcucauccuuuaaguguau

SEQ ID NO: 1192141 - RNA, 19 nt, Homo sapiens
uuaacuagaugacucugua

SEQ ID NO: 1192142 - RNA, 19 nt, Homo sapiens
ggagugcaguggcgaaauc

SEQ ID NO: 1192143 - RNA, 19 nt, Homo sapiens
gaggcacccuuccaucuga

SEQ ID NO: 1192144 - RNA, 19 nt, Homo sapiens
cuagaugacucuguaaaga

SEQ ID NO: 1192145 - RNA, 19 nt, Homo sapiens
ggagguuaaucuaggaaug

SEQ ID NO: 1192146 - RNA, 19 nt, Homo sapiens
guccaucgaucaccucuug

SEQ ID NO: 1192147 - RNA, 19 nt, Homo sapiens
caucguggguggaaacaug

SEQ ID NO: 1192148 - RNA, 19 nt, Homo sapiens
ggaagggucacuacgcaaa

SEQ ID NO: 1192149 - RNA, 19 nt, Homo sapiens
gauauuagcacuggccauu

SEQ ID NO: 1192150 - RNA, 19 nt, Homo sapiens
gaaagaggcacccuuccau

SEQ ID NO: 1192151 - RNA, 19 nt, Homo sapiens
ccaccacacccaacuaauu

SEQ ID NO: 1192152 - RNA, 19 nt, Homo sapiens
gcccagaagugcagaacug

SEQ ID NO: 1192153 - RNA, 19 nt, Homo sapiens
agacaggguuucaccaugu

SEQ ID NO: 1192154 - RNA, 19 nt, Homo sapiens
caccacacccaacuaauuu

SEQ ID NO: 1192155 - RNA, 19 nt, Homo sapiens
ugacaucgcccuuaugaag

SEQ ID NO: 1192156 - RNA, 19 nt, Homo sapiens
aagaugccauucugaggua

SEQ ID NO: 1192157 - RNA, 19 nt, Homo sapiens
ugacaaggugacugcauua

SEQ ID NO: 1192158 - RNA, 19 nt, Homo sapiens
ggauacuauucaacccaua

SEQ ID NO: 1192159 - RNA, 19 nt, Homo sapiens
ccacagugcugggauuaca

SEQ ID NO: 1192160 - RNA, 19 nt, Homo sapiens
caucacugcugcacacugu

SEQ ID NO: 1192161 - RNA, 19 nt, Homo sapiens
gaguucagauaaccucaga

SEQ ID NO: 1192162 - RNA, 19 nt, Homo sapiens
caagcuaugugaguucaga

SEQ ID NO: 1192163 - RNA, 19 nt, Homo sapiens
ucauugggaucauugcauu

SEQ ID NO: 1192164 - RNA, 19 nt, Homo sapiens
cuacuuccaagacuuauuu

SEQ ID NO: 1192165 - RNA, 19 nt, Homo sapiens
gagaggaggcuguggaagu

SEQ ID NO: 1192166 - RNA, 19 nt, Homo sapiens
acaaguagccaccugaguu

SEQ ID NO: 1192167 - RNA, 19 nt, Homo sapiens
gcagauggagagagaccua

SEQ ID NO: 1192168 - RNA, 19 nt, Homo sapiens
agaggaggcuguggaaguu

SEQ ID NO: 1192169 - RNA, 19 nt, Homo sapiens
ccaaagaggcugggcaaug

SEQ ID NO: 1192170 - RNA, 19 nt, Homo sapiens
uccaggccaucuccaaaua

SEQ ID NO: 1192171 - RNA, 19 nt, Homo sapiens
uauguuuccuucccucaaa

SEQ ID NO: 1192172 - RNA, 19 nt, Homo sapiens
gguggagucucgcucuguu

SEQ ID NO: 1192173 - RNA, 19 nt, Homo sapiens
gcaaguacaagccaaagag

SEQ ID NO: 1192174 - RNA, 19 nt, Homo sapiens
caaggugacugcauuacac

SEQ ID NO: 1192175 - RNA, 19 nt, Homo sapiens
gggaggaguuuguguccau

SEQ ID NO: 1192176 - RNA, 19 nt, Homo sapiens
gcuaugugaguucagauaa

SEQ ID NO: 1192177 - RNA, 19 nt, Homo sapiens
ucugagguacuaagaguua

SEQ ID NO: 1192178 - RNA, 19 nt, Homo sapiens
ccacugguccaucugguuu

SEQ ID NO: 1192179 - RNA, 19 nt, Homo sapiens
uggccaggcugcucucaaa

SEQ ID NO: 1192180 - RNA, 19 nt, Homo sapiens
gagguuaaucuaggaauga

SEQ ID NO: 1192181 - RNA, 19 nt, Homo sapiens
ccaggggucuugcaaaauu

SEQ ID NO: 1192182 - RNA, 19 nt, Homo sapiens
gacaggguuucaccauguu

SEQ ID NO: 1192183 - RNA, 19 nt, Homo sapiens
gcauuacaccacucaguau

SEQ ID NO: 1192184 - RNA, 19 nt, Homo sapiens
uuuggugcuugacguauua

SEQ ID NO: 1192185 - RNA, 19 nt, Homo sapiens
ccaaauaagaugccauucu

SEQ ID NO: 1192186 - RNA, 19 nt, Homo sapiens
cugacgagauaagcaguua

SEQ ID NO: 1192187 - RNA, 19 nt, Homo sapiens
gggucuaguuucccuguug

SEQ ID NO: 1192188 - RNA, 19 nt, Homo sapiens
gcucagggaaguacagaug

SEQ ID NO: 1192189 - RNA, 19 nt, Homo sapiens
cuaggaaugacucguuuaa

SEQ ID NO: 1192190 - RNA, 19 nt, Homo sapiens
gaacaagccugggguguac

SEQ ID NO: 1192191 - RNA, 19 nt, Homo sapiens
uggagaagauugucuacca

SEQ ID NO: 1192192 - RNA, 19 nt, Homo sapiens
uuacaccacucaguauaug

SEQ ID NO: 1192193 - RNA, 19 nt, Homo sapiens
gacguauuauuguccuuug

SEQ ID NO: 1192194 - RNA, 19 nt, Homo sapiens
gcauuuggugcuugacgua

SEQ ID NO: 1192195 - RNA, 19 nt, Homo sapiens
aggaaugacucguuuaagg

SEQ ID NO: 1192196 - RNA, 19 nt, Homo sapiens
gccucacgcuccuuucuga

SEQ ID NO: 1192197 - RNA, 19 nt, Homo sapiens
ugucacugcugccauugaa

SEQ ID NO: 1192198 - RNA, 19 nt, Homo sapiens
caaguagccaccugaguuc

SEQ ID NO: 1192199 - RNA, 19 nt, Homo sapiens
ccaacaagaucugcaacca

SEQ ID NO: 1192200 - RNA, 19 nt, Homo sapiens
gaagggucacuacgcaaau

SEQ ID NO: 1192201 - RNA, 19 nt, Homo sapiens
ucacagcugcuucguggaa

SEQ ID NO: 1192202 - RNA, 19 nt, Homo sapiens
aaacccacccuuucuacuu

SEQ ID NO: 1192203 - RNA, 19 nt, Homo sapiens
gguggcccuuucccuaauu

SEQ ID NO: 1192204 - RNA, 19 nt, Homo sapiens
guggcccuuucccuaauua

SEQ ID NO: 1192205 - RNA, 19 nt, Homo sapiens
ucaaaccccugaccucaaa

SEQ ID NO: 1192206 - RNA, 19 nt, Homo sapiens
ggcaaugacaucgcccuua

SEQ ID NO: 1192207 - RNA, 19 nt, Homo sapiens
cauuacaccacucaguaua

SEQ ID NO: 1192208 - RNA, 19 nt, Homo sapiens
uaacuagaugacucuguaa

SEQ ID NO: 1192209 - RNA, 19 nt, Homo sapiens
aaugacaucgcccuuauga

SEQ ID NO: 1192210 - RNA, 19 nt, Homo sapiens
gcagguaggacugaacuag

SEQ ID NO: 1192211 - RNA, 19 nt, Homo sapiens
caaaagaagcagcaacuug

SEQ ID NO: 1192212 - RNA, 19 nt, Homo sapiens
gugacggagucucggauug

SEQ ID NO: 1192213 - RNA, 19 nt, Homo sapiens
acgagcagauggagagaga

SEQ ID NO: 1192214 - RNA, 19 nt, Homo sapiens
gaggaggcuguggaaguua

SEQ ID NO: 1192215 - RNA, 19 nt, Homo sapiens
gcaaccacagggacgugua

SEQ ID NO: 1192216 - RNA, 19 nt, Homo sapiens
caucgucauugggaucauu

SEQ ID NO: 1192217 - RNA, 19 nt, Homo sapiens
ccaggccaucuccaaauaa

SEQ ID NO: 1192218 - RNA, 19 nt, Homo sapiens
ggucacuacgcaaauguug

SEQ ID NO: 1192219 - RNA, 19 nt, Homo sapiens
uauuagcacuggccauugg

SEQ ID NO: 1192220 - RNA, 19 nt, Homo sapiens
ggugcuugacguauuauug

SEQ ID NO: 1192221 - RNA, 19 nt, Homo sapiens
uaguuucccuguuggacaa

SEQ ID NO: 1192222 - RNA, 19 nt, Homo sapiens
gcaguuccgggaggaguuu

SEQ ID NO: 1192223 - RNA, 19 nt, Homo sapiens
ggguggcccuuucccuaau

SEQ ID NO: 1192224 - RNA, 19 nt, Homo sapiens
gugcuugacguauuauugu

SEQ ID NO: 1192225 - RNA, 19 nt, Homo sapiens
ccuuugauuuccaacaaga

SEQ ID NO: 1192226 - RNA, 19 nt, Homo sapiens
caggccaucuccaaauaag

SEQ ID NO: 1192227 - RNA, 19 nt, Homo sapiens
guuaucagaugcagaugcu

SEQ ID NO: 1192228 - RNA, 19 nt, Homo sapiens
ggcccacccuaaugacuca

SEQ ID NO: 1192229 - RNA, 19 nt, Homo sapiens
ccuuucugaucuucacuaa

SEQ ID NO: 1192230 - RNA, 19 nt, Homo sapiens
ugaaagagcuguugguuaa

SEQ ID NO: 1192231 - RNA, 19 nt, Homo sapiens
caaagaggcugggcaauga

SEQ ID NO: 1192232 - RNA, 19 nt, Homo sapiens
gcaaugacaucgcccuuau

SEQ ID NO: 1192233 - RNA, 19 nt, Homo sapiens
gaaaugauccagccugugu

SEQ ID NO: 1192234 - RNA, 19 nt, Homo sapiens
gaucaccucuugccagaug

SEQ ID NO: 1192235 - RNA, 19 nt, Homo sapiens
caaaauuccugacgagaua

SEQ ID NO: 1192236 - RNA, 19 nt, Homo sapiens
ucagauaaccucagaguga

SEQ ID NO: 1192237 - RNA, 19 nt, Homo sapiens
gaaccaaacccacccuuuc

SEQ ID NO: 1192238 - RNA, 19 nt, Homo sapiens
gcucauccuuuaaguguau

SEQ ID NO: 1192239 - RNA, 19 nt, Homo sapiens
aaagagcuguugguuaauu

SEQ ID NO: 1192240 - RNA, 19 nt, Homo sapiens
ggagugcaguggcgaaauc

SEQ ID NO: 1192241 - RNA, 19 nt, Homo sapiens
gaggcacccuuccaucuga

SEQ ID NO: 1192242 - RNA, 19 nt, Homo sapiens
ggagguuaaucuaggaaug

SEQ ID NO: 1192243 - RNA, 19 nt, Homo sapiens
guccaucgaucaccucuug

SEQ ID NO: 1192244 - RNA, 19 nt, Homo sapiens
caucguggguggaaacaug

SEQ ID NO: 1192245 - RNA, 19 nt, Homo sapiens
ggaagggucacuacgcaaa

SEQ ID NO: 1192246 - RNA, 19 nt, Homo sapiens
gaaagaggcacccuuccau

SEQ ID NO: 1192247 - RNA, 19 nt, Homo sapiens
ccaccacacccaacuaauu

SEQ ID NO: 1192248 - RNA, 19 nt, Homo sapiens
gcccagaagugcagaacug

SEQ ID NO: 1192249 - RNA, 19 nt, Homo sapiens
agacaggguuucaccaugu

SEQ ID NO: 1192250 - RNA, 19 nt, Homo sapiens
caccacacccaacuaauuu

SEQ ID NO: 1192251 - RNA, 19 nt, Homo sapiens
ugacaucgcccuuaugaag

SEQ ID NO: 1192252 - RNA, 19 nt, Homo sapiens
ugacaaggugacugcauua

SEQ ID NO: 1192253 - RNA, 19 nt, Homo sapiens
ccacagugcugggauuaca

SEQ ID NO: 1192254 - RNA, 19 nt, Homo sapiens
caucacugcugcacacugu

SEQ ID NO: 1192255 - RNA, 19 nt, Homo sapiens
gaguucagauaaccucaga

SEQ ID NO: 1192256 - RNA, 19 nt, Homo sapiens
caagcuaugugaguucaga

SEQ ID NO: 1192257 - RNA, 19 nt, Homo sapiens
cuacuuccaagacuuauuu

SEQ ID NO: 1192258 - RNA, 19 nt, Homo sapiens
gagaggaggcuguggaagu

SEQ ID NO: 1192259 - RNA, 19 nt, Homo sapiens
acaaguagccaccugaguu

SEQ ID NO: 1192260 - RNA, 19 nt, Homo sapiens
gcagauggagagagaccua

SEQ ID NO: 1192261 - RNA, 19 nt, Homo sapiens
agaggaggcuguggaaguu

SEQ ID NO: 1192262 - RNA, 19 nt, Homo sapiens
ccaaagaggcugggcaaug

SEQ ID NO: 1192263 - RNA, 19 nt, Homo sapiens
uauguuuccuucccucaaa

SEQ ID NO: 1192264 - RNA, 19 nt, Homo sapiens
gguggagucucgcucuguu

SEQ ID NO: 1192265 - RNA, 19 nt, Homo sapiens
gcaaguacaagccaaagag

SEQ ID NO: 1192266 - RNA, 19 nt, Homo sapiens
caaggugacugcauuacac

SEQ ID NO: 1192267 - RNA, 19 nt, Homo sapiens
gggaggaguuuguguccau

SEQ ID NO: 1192268 - RNA, 19 nt, Homo sapiens
gcuaugugaguucagauaa

SEQ ID NO: 1192269 - RNA, 19 nt, Homo sapiens
ccacugguccaucugguuu

SEQ ID NO: 1192270 - RNA, 19 nt, Homo sapiens
uggccaggcugcucucaaa

SEQ ID NO: 1192271 - RNA, 19 nt, Homo sapiens
gagguuaaucuaggaauga

SEQ ID NO: 1192272 - RNA, 19 nt, Homo sapiens
ccaggggucuugcaaaauu

SEQ ID NO: 1192273 - RNA, 19 nt, Homo sapiens
gacaggguuucaccauguu

SEQ ID NO: 1192274 - RNA, 19 nt, Homo sapiens
gcauuacaccacucaguau

SEQ ID NO: 1192275 - RNA, 19 nt, Homo sapiens
uuuggugcuugacguauua

SEQ ID NO: 1192276 - RNA, 19 nt, Homo sapiens
cugacgagauaagcaguua

SEQ ID NO: 1192277 - RNA, 19 nt, Homo sapiens
gggucuaguuucccuguug

SEQ ID NO: 1192278 - RNA, 19 nt, Homo sapiens
gcucagggaaguacagaug

SEQ ID NO: 1192279 - RNA, 19 nt, Homo sapiens
cuaggaaugacucguuuaa

SEQ ID NO: 1192280 - RNA, 19 nt, Homo sapiens
gaacaagccugggguguac

SEQ ID NO: 1192281 - RNA, 19 nt, Homo sapiens
uggagaagauugucuacca

SEQ ID NO: 1192282 - RNA, 19 nt, Homo sapiens
uuacaccacucaguauaug

SEQ ID NO: 1192283 - RNA, 19 nt, Homo sapiens
gacguauuauuguccuuug

SEQ ID NO: 1192284 - RNA, 19 nt, Homo sapiens
gcauuuggugcuugacgua

SEQ ID NO: 1192285 - RNA, 19 nt, Homo sapiens
aggaaugacucguuuaagg

SEQ ID NO: 1192286 - RNA, 19 nt, Homo sapiens
gccucacgcuccuuucuga

SEQ ID NO: 1192287 - RNA, 19 nt, Homo sapiens
cugaaagagcuguugguua

SEQ ID NO: 1192288 - RNA, 19 nt, Homo sapiens
caaguagccaccugaguuc

SEQ ID NO: 1192289 - RNA, 19 nt, Homo sapiens
ccaacaagaucugcaacca

SEQ ID NO: 1192290 - RNA, 19 nt, Homo sapiens
gaagggucacuacgcaaau

SEQ ID NO: 1192291 - RNA, 19 nt, Homo sapiens
ucacagcugcuucguggaa

SEQ ID NO: 1192292 - RNA, 19 nt, Homo sapiens
aaacccacccuuucuacuu

SEQ ID NO: 1192293 - RNA, 19 nt, Homo sapiens
ucaaaccccugaccucaaa

SEQ ID NO: 1192294 - RNA, 19 nt, Homo sapiens
ggcaaugacaucgcccuua

SEQ ID NO: 1192295 - RNA, 19 nt, Homo sapiens
cauuacaccacucaguaua

SEQ ID NO: 1192296 - RNA, 19 nt, Homo sapiens
aaugacaucgcccuuauga

SEQ ID NO: 1192297 - RNA, 19 nt, Homo sapiens
gugacggagucucggauug

SEQ ID NO: 1192298 - RNA, 19 nt, Homo sapiens
caaaagaagcagcaacuug

SEQ ID NO: 1192299 - RNA, 19 nt, Homo sapiens
acgagcagauggagagaga

SEQ ID NO: 1192300 - RNA, 19 nt, Homo sapiens
gaggaggcuguggaaguua

SEQ ID NO: 1192301 - RNA, 19 nt, Homo sapiens
gcaaccacagggacgugua

SEQ ID NO: 1192302 - RNA, 19 nt, Homo sapiens
gaaagagcuguugguuaau

SEQ ID NO: 1192303 - RNA, 19 nt, Homo sapiens
ggucacuacgcaaauguug

SEQ ID NO: 1192304 - RNA, 19 nt, Homo sapiens
ggugcuugacguauuauug

SEQ ID NO: 1192305 - RNA, 19 nt, Homo sapiens
uaguuucccuguuggacaa

SEQ ID NO: 1192306 - RNA, 19 nt, Homo sapiens
gcaguuccgggaggaguuu

SEQ ID NO: 1192307 - RNA, 19 nt, Homo sapiens
gugcuugacguauuauugu

SEQ ID NO: 1192308 - RNA, 19 nt, Homo sapiens
ccuuugauuuccaacaaga

SEQ ID NO: 1192309 - RNA, 19 nt, Homo sapiens
uuaaguguaucgagcugau

SEQ ID NO: 1192310 - RNA, 19 nt, Homo sapiens
ccuuucugaucuucacuaa

SEQ ID NO: 1192311 - RNA, 19 nt, Homo sapiens
ucagggaaguacagauguc

SEQ ID NO: 1192312 - RNA, 19 nt, Homo sapiens
ccggguggguggucagaau

SEQ ID NO: 1192313 - RNA, 19 nt, Homo sapiens
ucacgcuccuuucugaucu

SEQ ID NO: 1192314 - RNA, 19 nt, Homo sapiens
cgaaagaggcacccuucca

SEQ ID NO: 1192315 - RNA, 19 nt, Homo sapiens
cguguacgguggcaucauc

SEQ ID NO: 1192316 - RNA, 19 nt, Homo sapiens
guggaaacauguccuugcu

SEQ ID NO: 1192317 - RNA, 19 nt, Homo sapiens
ugcauuacaccacucagua

SEQ ID NO: 1192318 - RNA, 19 nt, Homo sapiens
augacaaggugacugcauu

SEQ ID NO: 1192319 - RNA, 19 nt, Homo sapiens
uuucuacuuccaagacuua

SEQ ID NO: 1192320 - RNA, 19 nt, Homo sapiens
guucagauaaccucagagu

SEQ ID NO: 1192321 - RNA, 19 nt, Homo sapiens
ccaggugggucuaguuucc

SEQ ID NO: 1192322 - RNA, 19 nt, Homo sapiens
ugacguauuauuguccuuu

SEQ ID NO: 1192323 - RNA, 19 nt, Homo sapiens
aacccacccuuucuacuuc

SEQ ID NO: 1192324 - RNA, 19 nt, Homo sapiens
ccaccaacagccacucaga

SEQ ID NO: 1192325 - RNA, 19 nt, Homo sapiens
ucccuuugauuuccaacaa

SEQ ID NO: 1192326 - RNA, 19 nt, Homo sapiens
ucgcucauccuuuaagugu

SEQ ID NO: 1192327 - RNA, 19 nt, Homo sapiens
caugauuucuuuguagcau

SEQ ID NO: 1192328 - RNA, 19 nt, Homo sapiens
caccaacagccacucagaa

SEQ ID NO: 1192329 - RNA, 19 nt, Homo sapiens
aagagcuguugguuaauuc

SEQ ID NO: 1192330 - RNA, 19 nt, Homo sapiens
uaugauggcugcuuuauaa

SEQ ID NO: 1192331 - RNA, 19 nt, Homo sapiens
ggaaagggcuguguuuaug

SEQ ID NO: 1192332 - RNA, 19 nt, Homo sapiens
caaagaggcugggcaauga

SEQ ID NO: 1192333 - RNA, 19 nt, Homo sapiens
gcaaugacaucgcccuuau

SEQ ID NO: 1192334 - RNA, 19 nt, Homo sapiens
ccacucacguucaauggua

SEQ ID NO: 1192335 - RNA, 19 nt, Homo sapiens
gaucaccucuugccagaug

SEQ ID NO: 1192336 - RNA, 19 nt, Homo sapiens
ucaagaggauuugcaauug

SEQ ID NO: 1192337 - RNA, 19 nt, Homo sapiens
ucagauaaccucagaguga

SEQ ID NO: 1192338 - RNA, 19 nt, Homo sapiens
gcucauccuuuaaguguau

SEQ ID NO: 1192339 - RNA, 19 nt, Homo sapiens
gcucauugaagcauucuua

SEQ ID NO: 1192340 - RNA, 19 nt, Homo sapiens
guaacacuguggccuacua

SEQ ID NO: 1192341 - RNA, 19 nt, Homo sapiens
gaaaauaaguccuguugca

SEQ ID NO: 1192342 - RNA, 19 nt, Homo sapiens
cauugaagcauucuuauga

SEQ ID NO: 1192343 - RNA, 19 nt, Homo sapiens
guccaucgaucaccucuug

SEQ ID NO: 1192344 - RNA, 19 nt, Homo sapiens
caucguggguggaaacaug

SEQ ID NO: 1192345 - RNA, 19 nt, Homo sapiens
ggaagggucacuacgcaaa

SEQ ID NO: 1192346 - RNA, 19 nt, Homo sapiens
gauauuagcacuggccauu

SEQ ID NO: 1192347 - RNA, 19 nt, Homo sapiens
ugacaucgcccuuaugaag

SEQ ID NO: 1192348 - RNA, 19 nt, Homo sapiens
ugacaaggugacugcauua

SEQ ID NO: 1192349 - RNA, 19 nt, Homo sapiens
caucacugcugcacacugu

SEQ ID NO: 1192350 - RNA, 19 nt, Homo sapiens
gaguucagauaaccucaga

SEQ ID NO: 1192351 - RNA, 19 nt, Homo sapiens
caagcuaugugaguucaga

SEQ ID NO: 1192352 - RNA, 19 nt, Homo sapiens
ucauugggaucauugcauu

SEQ ID NO: 1192353 - RNA, 19 nt, Homo sapiens
cugcagcucuuccuuuguu

SEQ ID NO: 1192354 - RNA, 19 nt, Homo sapiens
ccaaagaggcugggcaaug

SEQ ID NO: 1192355 - RNA, 19 nt, Homo sapiens
gcaaguacaagccaaagag

SEQ ID NO: 1192356 - RNA, 19 nt, Homo sapiens
caaggugacugcauuacac

SEQ ID NO: 1192357 - RNA, 19 nt, Homo sapiens
gggaggaguuuguguccau

SEQ ID NO: 1192358 - RNA, 19 nt, Homo sapiens
gcuaugugaguucagauaa

SEQ ID NO: 1192359 - RNA, 19 nt, Homo sapiens
caagaggauuugcaauugc

SEQ ID NO: 1192360 - RNA, 19 nt, Homo sapiens
gcauuacaccacucaguau

SEQ ID NO: 1192361 - RNA, 19 nt, Homo sapiens
ccaggaaagggcuguguuu

SEQ ID NO: 1192362 - RNA, 19 nt, Homo sapiens
caggaaagggcuguguuua

SEQ ID NO: 1192363 - RNA, 19 nt, Homo sapiens
gaaagggcuguguuuaugg

SEQ ID NO: 1192364 - RNA, 19 nt, Homo sapiens
aaauugugaugcuccuaaa

SEQ ID NO: 1192365 - RNA, 19 nt, Homo sapiens
ggacggcucggguacuuuc

SEQ ID NO: 1192366 - RNA, 19 nt, Homo sapiens
gggucuaguuucccuguug

SEQ ID NO: 1192367 - RNA, 19 nt, Homo sapiens
gcucagggaaguacagaug

SEQ ID NO: 1192368 - RNA, 19 nt, Homo sapiens
acucgggaauuaugaggua

SEQ ID NO: 1192369 - RNA, 19 nt, Homo sapiens
uggagaagauugucuacca

SEQ ID NO: 1192370 - RNA, 19 nt, Homo sapiens
uuacaccacucaguauaug

SEQ ID NO: 1192371 - RNA, 19 nt, Homo sapiens
cagagguccugaaauaguc

SEQ ID NO: 1192372 - RNA, 19 nt, Homo sapiens
gcucuuccuuuguuucaag

SEQ ID NO: 1192373 - RNA, 19 nt, Homo sapiens
ucggguacuuucguucuua

SEQ ID NO: 1192374 - RNA, 19 nt, Homo sapiens
ugucacugcugccauugaa

SEQ ID NO: 1192375 - RNA, 19 nt, Homo sapiens
gaagggucacuacgcaaau

SEQ ID NO: 1192376 - RNA, 19 nt, Homo sapiens
ucacagcugcuucguggaa

SEQ ID NO: 1192377 - RNA, 19 nt, Homo sapiens
gguacuuucguucuuaauu

SEQ ID NO: 1192378 - RNA, 19 nt, Homo sapiens
gauggcugcuuuauaaucc

SEQ ID NO: 1192379 - RNA, 19 nt, Homo sapiens
ggcaaugacaucgcccuua

SEQ ID NO: 1192380 - RNA, 19 nt, Homo sapiens
cauuacaccacucaguaua

SEQ ID NO: 1192381 - RNA, 19 nt, Homo sapiens
guacaucugggucucuaug

SEQ ID NO: 1192382 - RNA, 19 nt, Homo sapiens
aaugacaucgcccuuauga

SEQ ID NO: 1192383 - RNA, 19 nt, Homo sapiens
gugacggagucucggauug

SEQ ID NO: 1192384 - RNA, 19 nt, Homo sapiens
caucgucauugggaucauu

SEQ ID NO: 1192385 - RNA, 19 nt, Homo sapiens
cggguacuuucguucuuaa

SEQ ID NO: 1192386 - RNA, 19 nt, Homo sapiens
uggccuugaugauuugaaa

SEQ ID NO: 1192387 - RNA, 19 nt, Homo sapiens
guucugcagcucuuccuuu

SEQ ID NO: 1192388 - RNA, 19 nt, Homo sapiens
ggucacuacgcaaauguug

SEQ ID NO: 1192389 - RNA, 19 nt, Homo sapiens
uauuagcacuggccauugg

SEQ ID NO: 1192390 - RNA, 19 nt, Homo sapiens
uaguuucccuguuggacaa

SEQ ID NO: 1192391 - RNA, 19 nt, Homo sapiens
gcaguuccgggaggaguuu

SEQ ID NO: 1192392 - RNA, 19 nt, Homo sapiens
uugaagcauucuuaugaug

SEQ ID NO: 1192393 - RNA, 19 nt, Homo sapiens
aggaaagggcuguguuuau

SEQ ID NO: 1192394 - RNA, 19 nt, Homo sapiens
uuaaguguaucgagcugau

SEQ ID NO: 1192395 - RNA, 19 nt, Homo sapiens
ucagggaaguacagauguc

SEQ ID NO: 1192396 - RNA, 19 nt, Homo sapiens
guggaaacauguccuugcu

SEQ ID NO: 1192397 - RNA, 19 nt, Homo sapiens
ugcauuacaccacucagua

SEQ ID NO: 1192398 - RNA, 19 nt, Homo sapiens
augacaaggugacugcauu

SEQ ID NO: 1192399 - RNA, 19 nt, Homo sapiens
cguggugccaucuacauuu

SEQ ID NO: 1192400 - RNA, 19 nt, Homo sapiens
ccggguggguggucagaau

SEQ ID NO: 1192401 - RNA, 19 nt, Homo sapiens
ccaggugggucuaguuucc

SEQ ID NO: 1192402 - RNA, 19 nt, Homo sapiens
guucagauaaccucagagu

SEQ ID NO: 1192403 - RNA, 19 nt, Homo sapiens
uucaagaggauuugcaauu

SEQ ID NO: 1192404 - RNA, 19 nt, Homo sapiens
uuaugauggcugcuuuaua

SEQ ID NO: 1192405 - RNA, 19 nt, Homo sapiens
ggauuugcaauugcucauu

SEQ ID NO: 1192406 - RNA, 19 nt, Homo sapiens
ucgcucauccuuuaagugu

SEQ ID NO: 1192407 - RNA, 19 nt, Homo sapiens
ccugauucauguugguguu

SEQ ID NO: 1192408 - RNA, 19 nt, Homo sapiens
uaacacuguggccuacuau

SEQ ID NO: 1192409 - RNA, 19 nt, Homo sapiens
cggcucggguacuuucguu

SEQ ID NO: 1192410 - RNA, 19 nt, Homo sapiens
aauuccaacuccugauuca

SEQ ID NO: 1192411 - RNA, 19 nt, Homo sapiens
ucauugaagcauucuuaug

SEQ ID NO: 1192412 - RNA, 19 nt, Homo sapiens
gggccacucacguucaaug

SEQ ID NO: 1192413 - RNA, 19 nt, Homo sapiens
guuuaugggaagccaguaa

SEQ ID NO: 1192414 - RNA, 19 nt, Homo sapiens
ucacugcugccauugaagu

SEQ ID NO: 1192415 - RNA, 19 nt, Homo sapiens
cggagucucggauugcaaa

SEQ ID NO: 1192416 - RNA, 19 nt, Homo sapiens
gaacagaaacccucaagua

SEQ ID NO: 1192417 - RNA, 19 nt, Homo sapiens
uagaagaccuuaucauuga

SEQ ID NO: 1192418 - RNA, 19 nt, Homo sapiens
ggaaguggauuucugcauu

SEQ ID NO: 1192419 - RNA, 19 nt, Homo sapiens
gagcuaaugcugcuuauuu

SEQ ID NO: 1192420 - RNA, 19 nt, Homo sapiens
uaacuagacuucugaacuu

SEQ ID NO: 1192421 - RNA, 19 nt, Homo sapiens
cagcuccgaucuccaauua

SEQ ID NO: 1192422 - RNA, 19 nt, Homo sapiens
gaagauguccaaagugaaa

SEQ ID NO: 1192423 - RNA, 19 nt, Homo sapiens
ccaagaagauguccaaagu

SEQ ID NO: 1192424 - RNA, 19 nt, Homo sapiens
gaaguggauuucugcauug

SEQ ID NO: 1192425 - RNA, 19 nt, Homo sapiens
cagaaacccucaaguaauc

SEQ ID NO: 1192426 - RNA, 19 nt, Homo sapiens
caucaagaaugaaguguau

SEQ ID NO: 1192427 - RNA, 19 nt, Homo sapiens
aagaagauguccaaaguga

SEQ ID NO: 1192428 - RNA, 19 nt, Homo sapiens
cgaaagaaggauaucaaua

SEQ ID NO: 1192429 - RNA, 19 nt, Homo sapiens
ggacauacccagauuacau

SEQ ID NO: 1192430 - RNA, 19 nt, Homo sapiens
gaacucagcagcagguaga

SEQ ID NO: 1192431 - RNA, 19 nt, Homo sapiens
guacagguucugauucuaa

SEQ ID NO: 1192432 - RNA, 19 nt, Homo sapiens
ucaagacccugcaugaaug

SEQ ID NO: 1192433 - RNA, 19 nt, Homo sapiens
gcugggcuguguuuacuaa

SEQ ID NO: 1192434 - RNA, 19 nt, Homo sapiens
gcacagcucagcagaacaa

SEQ ID NO: 1192435 - RNA, 19 nt, Homo sapiens
gacauacccagauuacaua

SEQ ID NO: 1192436 - RNA, 19 nt, Homo sapiens
agaacaagcugaagcaucu

SEQ ID NO: 1192437 - RNA, 19 nt, Homo sapiens
ugacuaaccucugguaucu

SEQ ID NO: 1192438 - RNA, 19 nt, Homo sapiens
gcuccgaucuccaauuagu

SEQ ID NO: 1192439 - RNA, 19 nt, Homo sapiens
gagguggcguggacagauu

SEQ ID NO: 1192440 - RNA, 19 nt, Homo sapiens
gaacuagaagaccuuauca

SEQ ID NO: 1192441 - RNA, 19 nt, Homo sapiens
gaucauggacgcuugacaa

SEQ ID NO: 1192442 - RNA, 19 nt, Homo sapiens
aagcagagguuaccaacau

SEQ ID NO: 1192443 - RNA, 19 nt, Homo sapiens
cagauuacauagccaacaa

SEQ ID NO: 1192444 - RNA, 19 nt, Homo sapiens
gcagguagaagcagagguu

SEQ ID NO: 1192445 - RNA, 19 nt, Homo sapiens
gagccaaccaguacaaaga

SEQ ID NO: 1192446 - RNA, 19 nt, Homo sapiens
cuagaagaccuuaucauug

SEQ ID NO: 1192447 - RNA, 19 nt, Homo sapiens
ggacaccaagggcccauuu

SEQ ID NO: 1192448 - RNA, 19 nt, Homo sapiens
ugacuacucagccuuguuu

SEQ ID NO: 1192449 - RNA, 19 nt, Homo sapiens
ggaacuagaagaccuuauc

SEQ ID NO: 1192450 - RNA, 19 nt, Homo sapiens
agacuuaacuagacuucug

SEQ ID NO: 1192451 - RNA, 19 nt, Homo sapiens
acuaaccucugguaucuga

SEQ ID NO: 1192452 - RNA, 19 nt, Homo sapiens
aacagaaacccucaaguaa

SEQ ID NO: 1192453 - RNA, 19 nt, Homo sapiens
guuguucccuucagacuca

SEQ ID NO: 1192454 - RNA, 19 nt, Homo sapiens
gcaucaagaaugaagugua

SEQ ID NO: 1192455 - RNA, 19 nt, Homo sapiens
gaacugccggcuaaugcuu

SEQ ID NO: 1192456 - RNA, 19 nt, Homo sapiens
gaacaguuucagguuauau

SEQ ID NO: 1192457 - RNA, 19 nt, Homo sapiens
cacuggaacugccggcuaa

SEQ ID NO: 1192458 - RNA, 19 nt, Homo sapiens
cuagacuucugaacuugaa

SEQ ID NO: 1192459 - RNA, 19 nt, Homo sapiens
acagaaacccucaaguaau

SEQ ID NO: 1192460 - RNA, 19 nt, Homo sapiens
ccacaguccucacgauggu

SEQ ID NO: 1192461 - RNA, 19 nt, Homo sapiens
gagguuaccaacaucaaga

SEQ ID NO: 1192462 - RNA, 19 nt, Homo sapiens
acuagaagaccuuaucauu

SEQ ID NO: 1192463 - RNA, 19 nt, Homo sapiens
ugaagcaucuuaccaucgu

SEQ ID NO: 1192464 - RNA, 19 nt, Homo sapiens
gucaagacccugcaugaau

SEQ ID NO: 1192465 - RNA, 19 nt, Homo sapiens
guaugucuuuggagaacuu

SEQ ID NO: 1192466 - RNA, 19 nt, Homo sapiens
guaccacaguccucacgau

SEQ ID NO: 1192467 - RNA, 19 nt, Homo sapiens
agaggcagcccaccaagaa

SEQ ID NO: 1192468 - RNA, 19 nt, Homo sapiens
cagggaugauugugaagga

SEQ ID NO: 1192469 - RNA, 19 nt, Homo sapiens
guacaaagagaaccacaac

SEQ ID NO: 1192470 - RNA, 19 nt, Homo sapiens
gcugaaagaccuggagaug

SEQ ID NO: 1192471 - RNA, 19 nt, Homo sapiens
ccaccaaugccaucccaaa

SEQ ID NO: 1192472 - RNA, 19 nt, Homo sapiens
cugcaugaauggugugaug

SEQ ID NO: 1192473 - RNA, 19 nt, Homo sapiens
gccgugacauccgaaagaa

SEQ ID NO: 1192474 - RNA, 19 nt, Homo sapiens
ccaggagguucuugucucu

SEQ ID NO: 1192475 - RNA, 19 nt, Homo sapiens
gucagacacugcucagcuu

SEQ ID NO: 1192476 - RNA, 19 nt, Homo sapiens
gcagagguuaccaacauca

SEQ ID NO: 1192477 - RNA, 19 nt, Homo sapiens
gcaguuguugaaccuguuu

SEQ ID NO: 1192478 - RNA, 19 nt, Homo sapiens
gauggugcagugauuucua

SEQ ID NO: 1192479 - RNA, 19 nt, Homo sapiens
cggaguguaugucuuugga

SEQ ID NO: 1192480 - RNA, 19 nt, Homo sapiens
gccaaccaguacaaagaga

SEQ ID NO: 1192481 - RNA, 19 nt, Homo sapiens
gcaggagcuugcggaagga

SEQ ID NO: 1192482 - RNA, 19 nt, Homo sapiens
gcucucccaagaucuuuaa

SEQ ID NO: 1192483 - RNA, 19 nt, Homo sapiens
caagaagauguccaaagug

SEQ ID NO: 1192484 - RNA, 19 nt, Homo sapiens
ccaccaagaagauguccaa

SEQ ID NO: 1192485 - RNA, 19 nt, Homo sapiens
ugauggcugugaagcaguu

SEQ ID NO: 1192486 - RNA, 19 nt, Homo sapiens
gaaucuccgggaacuagaa

SEQ ID NO: 1192487 - RNA, 19 nt, Homo sapiens
ugagagcgcuggguugacu

SEQ ID NO: 1192488 - RNA, 19 nt, Homo sapiens
agcccucacugcucucaua

SEQ ID NO: 1192489 - RNA, 19 nt, Homo sapiens
caucaagaagacacucaaa

SEQ ID NO: 1192490 - RNA, 19 nt, Homo sapiens
cauggacgcuugacaaccu

SEQ ID NO: 1192491 - RNA, 19 nt, Homo sapiens
gggcaucgagcagcaaguu

SEQ ID NO: 1192492 - RNA, 19 nt, Homo sapiens
cauugaggcugucuacacu

SEQ ID NO: 1192493 - RNA, 19 nt, Homo sapiens
gcccagcuccgaucuccaa

SEQ ID NO: 1192494 - RNA, 19 nt, Homo sapiens
uugaggcugucuacacuga

SEQ ID NO: 1192495 - RNA, 19 nt, Homo sapiens
gcccucugaugauggcauu

SEQ ID NO: 1192496 - RNA, 19 nt, Homo sapiens
uguugcugcuucugucuuu

SEQ ID NO: 1192497 - RNA, 19 nt, Homo sapiens
uuaccaacaucaagaagac

SEQ ID NO: 1192498 - RNA, 19 nt, Homo sapiens
ggccgugacauccgaaaga

SEQ ID NO: 1192499 - RNA, 19 nt, Homo sapiens
uacagguucugauucuaau

SEQ ID NO: 1192500 - RNA, 19 nt, Homo sapiens
guugagagcgcuggguuga

SEQ ID NO: 1192501 - RNA, 19 nt, Homo sapiens
aaggagcuaaugcugcuua

SEQ ID NO: 1192502 - RNA, 19 nt, Homo sapiens
gaagcagagguuaccaaca

SEQ ID NO: 1192503 - RNA, 19 nt, Homo sapiens
gugaugcugggcuguguuu

SEQ ID NO: 1192504 - RNA, 19 nt, Homo sapiens
guucuugucucuguguaag

SEQ ID NO: 1192505 - RNA, 19 nt, Homo sapiens
ucaagaagacacucaaagc

SEQ ID NO: 1192506 - RNA, 19 nt, Homo sapiens
gagagccaaccaguacaaa

SEQ ID NO: 1192507 - RNA, 19 nt, Homo sapiens
agcuaaugcugcuuauuug

SEQ ID NO: 1192508 - RNA, 19 nt, Homo sapiens
guuggcagcuccaguucag

SEQ ID NO: 1192509 - RNA, 19 nt, Homo sapiens
ccaaugccaucccaaaaca

SEQ ID NO: 1192510 - RNA, 19 nt, Homo sapiens
ccucacugcucucauaagc

SEQ ID NO: 1192511 - RNA, 19 nt, Homo sapiens
ggaaucuccgggaacuaga

SEQ ID NO: 1192512 - RNA, 19 nt, Homo sapiens
ggagcaguuuauuuuacua

SEQ ID NO: 1192513 - RNA, 19 nt, Homo sapiens
ggaacagaaacccucaagu

SEQ ID NO: 1192514 - RNA, 19 nt, Homo sapiens
gcaucgagcagcaaguucu

SEQ ID NO: 1192515 - RNA, 19 nt, Homo sapiens
aacaagcugaagcaucuua

SEQ ID NO: 1192516 - RNA, 19 nt, Homo sapiens
ugaaagccaugucaaauua

SEQ ID NO: 1192517 - RNA, 19 nt, Homo sapiens
gcaaauaaaguuccaguua

SEQ ID NO: 1192518 - RNA, 19 nt, Homo sapiens
gaugaauucugaacuguua

SEQ ID NO: 1192519 - RNA, 19 nt, Homo sapiens
gcaauaagauuugagauga

SEQ ID NO: 1192520 - RNA, 19 nt, Homo sapiens
auaggaagguuguugauua

SEQ ID NO: 1192521 - RNA, 19 nt, Homo sapiens
gauuugagaugaacacuau

SEQ ID NO: 1192522 - RNA, 19 nt, Homo sapiens
gagaugaacacuauugaaa

SEQ ID NO: 1192523 - RNA, 19 nt, Homo sapiens
gcaaaccauuguaugugua

SEQ ID NO: 1192524 - RNA, 19 nt, Homo sapiens
gagagaugcucauggaaga

SEQ ID NO: 1192525 - RNA, 19 nt, Homo sapiens
gaaggaugauucucacuca

SEQ ID NO: 1192526 - RNA, 19 nt, Homo sapiens
cgaugaagauuuccuaaug

SEQ ID NO: 1192527 - RNA, 19 nt, Homo sapiens
gguaggagauaaagaugaa

SEQ ID NO: 1192528 - RNA, 19 nt, Homo sapiens
gaaauaggaagguuguuga

SEQ ID NO: 1192529 - RNA, 19 nt, Homo sapiens
ucaaaggcaucaaaggaaa

SEQ ID NO: 1192530 - RNA, 19 nt, Homo sapiens
gaagguuguugauuacuca

SEQ ID NO: 1192531 - RNA, 19 nt, Homo sapiens
ugaagggucugaagaugaa

SEQ ID NO: 1192532 - RNA, 19 nt, Homo sapiens
gaaccuacuuaagauagaa

SEQ ID NO: 1192533 - RNA, 19 nt, Homo sapiens
caaagaagaagaugaggaa

SEQ ID NO: 1192534 - RNA, 19 nt, Homo sapiens
acaaagaugugaagaccaa

SEQ ID NO: 1192535 - RNA, 19 nt, Homo sapiens
ggaagaugaugacgauagu

SEQ ID NO: 1192536 - RNA, 19 nt, Homo sapiens
gaggcgaucuggaaagaau

SEQ ID NO: 1192537 - RNA, 19 nt, Homo sapiens
gaugaacacuauugaaacu

SEQ ID NO: 1192538 - RNA, 19 nt, Homo sapiens
gaaagaauucacaggaaga

SEQ ID NO: 1192539 - RNA, 19 nt, Homo sapiens
acacaaguaucaaugucua

SEQ ID NO: 1192540 - RNA, 19 nt, Homo sapiens
gaugaagggucugaagaug

SEQ ID NO: 1192541 - RNA, 19 nt, Homo sapiens
agagagagaugcucaugga

SEQ ID NO: 1192542 - RNA, 19 nt, Homo sapiens
gaaagccaugucaaauuaa

SEQ ID NO: 1192543 - RNA, 19 nt, Homo sapiens
gaugaagauuuccuaaugg

SEQ ID NO: 1192544 - RNA, 19 nt, Homo sapiens
ccacgguuguaaagcaaua

SEQ ID NO: 1192545 - RNA, 19 nt, Homo sapiens
agaugaagauuauggaaga

SEQ ID NO: 1192546 - RNA, 19 nt, Homo sapiens
aaagaugaauucugaacug

SEQ ID NO: 1192547 - RNA, 19 nt, Homo sapiens
gcagguaggagauaaagau

SEQ ID NO: 1192548 - RNA, 19 nt, Homo sapiens
guaccacgguuguaaagca

SEQ ID NO: 1192549 - RNA, 19 nt, Homo sapiens
cggcagcgaugaagauuuc

SEQ ID NO: 1192550 - RNA, 19 nt, Homo sapiens
ggacucagaagacaaagau

SEQ ID NO: 1192551 - RNA, 19 nt, Homo sapiens
ugaugcagaugaagauuau

SEQ ID NO: 1192552 - RNA, 19 nt, Homo sapiens
ggucacaguggauuucuuu

SEQ ID NO: 1192553 - RNA, 19 nt, Homo sapiens
caaugaaagccaugucaaa

SEQ ID NO: 1192554 - RNA, 19 nt, Homo sapiens
ggcuauggcuugacucaug

SEQ ID NO: 1192555 - RNA, 19 nt, Homo sapiens
ccggaaagccugccagaaa

SEQ ID NO: 1192556 - RNA, 19 nt, Homo sapiens
gaaguccaaaccugaauga

SEQ ID NO: 1192557 - RNA, 19 nt, Homo sapiens
gaggguaugggcuuucuuu

SEQ ID NO: 1192558 - RNA, 19 nt, Homo sapiens
caucacuuguuaucucaaa

SEQ ID NO: 1192559 - RNA, 19 nt, Homo sapiens
ugaacacuauugaaacuuc

SEQ ID NO: 1192560 - RNA, 19 nt, Homo sapiens
ggaagguuguugauuacuc

SEQ ID NO: 1192561 - RNA, 19 nt, Homo sapiens
uggaaagaauucacaggaa

SEQ ID NO: 1192562 - RNA, 19 nt, Homo sapiens
gaagauuauggaagagauu

SEQ ID NO: 1192563 - RNA, 19 nt, Homo sapiens
gcagugaggaagaacaaga

SEQ ID NO: 1192564 - RNA, 19 nt, Homo sapiens
aauaagaggcgaucuggaa

SEQ ID NO: 1192565 - RNA, 19 nt, Homo sapiens
aaagacuccuucucccaaa

SEQ ID NO: 1192566 - RNA, 19 nt, Homo sapiens
guccaaaccugaaugaaaa

SEQ ID NO: 1192567 - RNA, 19 nt, Homo sapiens
gauugacugcuucaucuuu

SEQ ID NO: 1192568 - RNA, 19 nt, Homo sapiens
gaagaugaggaaccggaaa

SEQ ID NO: 1192569 - RNA, 19 nt, Homo sapiens
gcagaugaagauuauggaa

SEQ ID NO: 1192570 - RNA, 19 nt, Homo sapiens
caaaccauuguauguguaa

SEQ ID NO: 1192571 - RNA, 19 nt, Homo sapiens
ggaugaagggucugaagau

SEQ ID NO: 1192572 - RNA, 19 nt, Homo sapiens
ugaggcagguaggagauaa

SEQ ID NO: 1192573 - RNA, 19 nt, Homo sapiens
ucaaaaugauugcuccuuu

SEQ ID NO: 1192574 - RNA, 19 nt, Homo sapiens
gcaaguugaauaguaauca

SEQ ID NO: 1192575 - RNA, 19 nt, Homo sapiens
cauuguauguguaaguguu

SEQ ID NO: 1192576 - RNA, 19 nt, Homo sapiens
uaaagcaaaccauuguaug

SEQ ID NO: 1192577 - RNA, 19 nt, Homo sapiens
aauggaagaugaugacgau

SEQ ID NO: 1192578 - RNA, 19 nt, Homo sapiens
guugauuacucacaguuuc

SEQ ID NO: 1192579 - RNA, 19 nt, Homo sapiens
uggaagaugugggcaguga

SEQ ID NO: 1192580 - RNA, 19 nt, Homo sapiens
cagaggauagugaagauga

SEQ ID NO: 1192581 - RNA, 19 nt, Homo sapiens
gaacaugguuuuggcuaug

SEQ ID NO: 1192582 - RNA, 19 nt, Homo sapiens
uaagaaguccaaaccugaa

SEQ ID NO: 1192583 - RNA, 19 nt, Homo sapiens
gagauaaagaugaauucug

SEQ ID NO: 1192584 - RNA, 19 nt, Homo sapiens
aaagcaaaccauuguaugu

SEQ ID NO: 1192585 - RNA, 19 nt, Homo sapiens
gaaaggcaaagggaaagug

SEQ ID NO: 1192586 - RNA, 19 nt, Homo sapiens
gacgccaaguccagugaaa

SEQ ID NO: 1192587 - RNA, 19 nt, Homo sapiens
agacuaaaggcuacaguga

SEQ ID NO: 1192588 - RNA, 19 nt, Homo sapiens
ccaaaacucuugauuucau

SEQ ID NO: 1192589 - RNA, 19 nt, Homo sapiens
gcccaaacccagacuaaag

SEQ ID NO: 1192590 - RNA, 19 nt, Homo sapiens
ugaagauuauggaagagau

SEQ ID NO: 1192591 - RNA, 19 nt, Homo sapiens
ucaacaagaucagucuaca

SEQ ID NO: 1192592 - RNA, 19 nt, Homo sapiens
aaugauugcuccuuucucu

SEQ ID NO: 1192593 - RNA, 19 nt, Homo sapiens
aagaggcgaucuggaaaga

SEQ ID NO: 1192594 - RNA, 19 nt, Homo sapiens
gaagacaaagaugugaaga

SEQ ID NO: 1192595 - RNA, 19 nt, Homo sapiens
gaccuuauuugaggguaug

SEQ ID NO: 1192596 - RNA, 19 nt, Homo sapiens
gggaugaagggucugaaga

SEQ ID NO: 1192597 - RNA, 19 nt, Homo sapiens
uaggaagguuguugauuac

SEQ ID NO: 1192598 - RNA, 19 nt, Homo sapiens
aaaguuccaguuaauguga

SEQ ID NO: 1192599 - RNA, 19 nt, Homo sapiens
uggauugacugcuucaucu

SEQ ID NO: 1192600 - RNA, 19 nt, Homo sapiens
cgagaaaucuggggaugaa

SEQ ID NO: 1192601 - RNA, 19 nt, Homo sapiens
gaggauagugaagaugaaa

SEQ ID NO: 1192602 - RNA, 19 nt, Homo sapiens
caaaaugauugcuccuuuc

SEQ ID NO: 1192603 - RNA, 19 nt, Homo sapiens
cagcagaggauagugaaga

SEQ ID NO: 1192604 - RNA, 19 nt, Homo sapiens
ugaagaccaagaaggauga

SEQ ID NO: 1192605 - RNA, 19 nt, Homo sapiens
ggauuucuuuucaaacuga

SEQ ID NO: 1192606 - RNA, 19 nt, Homo sapiens
gauuucauauuuccuucuc

SEQ ID NO: 1192607 - RNA, 19 nt, Homo sapiens
gaucuggaaagaauucaca

SEQ ID NO: 1192608 - RNA, 19 nt, Homo sapiens
ugucagaaauaggaagguu

SEQ ID NO: 1192609 - RNA, 19 nt, Homo sapiens
agaaccuacuuaagauaga

SEQ ID NO: 1192610 - RNA, 19 nt, Homo sapiens
cggaaagccugccagaaaa

SEQ ID NO: 1192611 - RNA, 19 nt, Homo sapiens
agaaauaggaagguuguug

SEQ ID NO: 1192612 - RNA, 19 nt, Homo sapiens
gcaggcggcaucuaaagca

SEQ ID NO: 1192613 - RNA, 19 nt, Homo sapiens
uaaaguuccaguuaaugug

SEQ ID NO: 1192614 - RNA, 19 nt, Homo sapiens
aguccaaaccugaaugaaa

SEQ ID NO: 1192615 - RNA, 19 nt, Homo sapiens
gcgaugaagauuuccuaau

SEQ ID NO: 1192616 - RNA, 19 nt, Homo sapiens
gaaggugauugaauacaaa

SEQ ID NO: 1192617 - RNA, 19 nt, Homo sapiens
ggaaggugauugaauacaa

SEQ ID NO: 1192618 - RNA, 19 nt, Homo sapiens
gucggaaggugauugaaua

SEQ ID NO: 1192619 - RNA, 19 nt, Homo sapiens
ggacguggccaccuucuug

SEQ ID NO: 1192620 - RNA, 19 nt, Homo sapiens
ccaagaauguguuugucaa

SEQ ID NO: 1192621 - RNA, 19 nt, Homo sapiens
gaauguguuugucaaguuc

SEQ ID NO: 1192622 - RNA, 19 nt, Homo sapiens
gcagguggcuuuugacgaa

SEQ ID NO: 1192623 - RNA, 19 nt, Homo sapiens
cgagcuggcugaggaguuu

SEQ ID NO: 1192624 - RNA, 19 nt, Homo sapiens
cagcguccaucacugcuuu

SEQ ID NO: 1192625 - RNA, 19 nt, Homo sapiens
gaucagcggccaguuaaga

SEQ ID NO: 1192626 - RNA, 19 nt, Homo sapiens
gagcugugcauugugaaua

SEQ ID NO: 1192627 - RNA, 19 nt, Homo sapiens
gggaucagcggccaguuaa

SEQ ID NO: 1192628 - RNA, 19 nt, Homo sapiens
ccaugcggcuggaggauga

SEQ ID NO: 1192629 - RNA, 19 nt, Homo sapiens
agaauguguuugucaaguu

SEQ ID NO: 1192630 - RNA, 19 nt, Homo sapiens
ugaaaccacuaagaaguau

SEQ ID NO: 1192631 - RNA, 19 nt, Homo sapiens
agagggagcugugcauugu

SEQ ID NO: 1192632 - RNA, 19 nt, Homo sapiens
gcaguacuuuggacucaag

SEQ ID NO: 1192633 - RNA, 19 nt, Homo sapiens
gcugaggaguuugguguga

SEQ ID NO: 1192634 - RNA, 19 nt, Homo sapiens
ccacgaggacaucaucauu

SEQ ID NO: 1192635 - RNA, 19 nt, Homo sapiens
ucaaccaccugcugcuguu

SEQ ID NO: 1192636 - RNA, 19 nt, Homo sapiens
gggaggcauuggcugagaa

SEQ ID NO: 1192637 - RNA, 19 nt, Homo sapiens
gaaguaugcgccuguggau

SEQ ID NO: 1192638 - RNA, 19 nt, Homo sapiens
caucauugcugagcuggau

SEQ ID NO: 1192639 - RNA, 19 nt, Homo sapiens
gugcacggcuucccuacuc

SEQ ID NO: 1192640 - RNA, 19 nt, Homo sapiens
ggcauuggcugagaaguac

SEQ ID NO: 1192641 - RNA, 19 nt, Homo sapiens
acacugugguucucuucaa

SEQ ID NO: 1192642 - RNA, 19 nt, Homo sapiens
cauugugaauaaagaguga

SEQ ID NO: 1192643 - RNA, 19 nt, Homo sapiens
gguccaaggaggaacugua

SEQ ID NO: 1192644 - RNA, 19 nt, Homo sapiens
uugaaaccacuaagaagua

SEQ ID NO: 1192645 - RNA, 19 nt, Homo sapiens
gcugugcauugugaauaaa

SEQ ID NO: 1192646 - RNA, 19 nt, Homo sapiens
gacgaaaccaagaaugugu

SEQ ID NO: 1192647 - RNA, 19 nt, Homo sapiens
ggaguacccuacgcucaag

SEQ ID NO: 1192648 - RNA, 19 nt, Homo sapiens
ggucggaaggugauugaau

SEQ ID NO: 1192649 - RNA, 19 nt, Homo sapiens
gcacgugcugcaguacuuu

SEQ ID NO: 1192650 - RNA, 19 nt, Homo sapiens
agggagcugugcauuguga

SEQ ID NO: 1192651 - RNA, 19 nt, Homo sapiens
ugggaucagcggccaguua

SEQ ID NO: 1192652 - RNA, 19 nt, Homo sapiens
caaggacacugugguucuc

SEQ ID NO: 1192653 - RNA, 19 nt, Homo sapiens
cagagggagcugugcauug

SEQ ID NO: 1192654 - RNA, 19 nt, Homo sapiens
aggcauuggcugagaagua

SEQ ID NO: 1192655 - RNA, 19 nt, Homo sapiens
acccuacgcucaaguucuu

SEQ ID NO: 1192656 - RNA, 19 nt, Homo sapiens
ggacacugugguucucuuc

SEQ ID NO: 1192657 - RNA, 19 nt, Homo sapiens
cacgaggacaucaucauug

SEQ ID NO: 1192658 - RNA, 19 nt, Homo sapiens
aagaauguguuugucaagu

SEQ ID NO: 1192659 - RNA, 19 nt, Homo sapiens
ccaaggacacugugguucu

SEQ ID NO: 1192660 - RNA, 19 nt, Homo sapiens
cucaaguucuuccgcaaug

SEQ ID NO: 1192661 - RNA, 19 nt, Homo sapiens
agcugugcauugugaauaa

SEQ ID NO: 1192662 - RNA, 19 nt, Homo sapiens
cggcuucccuacucucaag

SEQ ID NO: 1192663 - RNA, 19 nt, Homo sapiens
uggcugagaaguaccaaga

SEQ ID NO: 1192664 - RNA, 19 nt, Homo sapiens
ugacgaaaccaagaaugug

SEQ ID NO: 1192665 - RNA, 19 nt, Homo sapiens
gcucaaguucuuccgcaau

SEQ ID NO: 1192666 - RNA, 19 nt, Homo sapiens
gugaauaaagagugagcuu

SEQ ID NO: 1192667 - RNA, 19 nt, Homo sapiens
ccaaggaggaugggaucuu

SEQ ID NO: 1192668 - RNA, 19 nt, Homo sapiens
gcggcucuuucagcaguuu

SEQ ID NO: 1192669 - RNA, 19 nt, Homo sapiens
cggaguacccuacgcucaa

SEQ ID NO: 1192670 - RNA, 19 nt, Homo sapiens
caagaauguguuugucaag

SEQ ID NO: 1192671 - RNA, 19 nt, Homo sapiens
gaaaccacuaagaaguaug

SEQ ID NO: 1192672 - RNA, 19 nt, Homo sapiens
ggagcugugcauugugaau

SEQ ID NO: 1192673 - RNA, 19 nt, Homo sapiens
ccucaacggccaagucaag

SEQ ID NO: 1192674 - RNA, 19 nt, Homo sapiens
gcccuggacaugaccuuug

SEQ ID NO: 1192675 - RNA, 19 nt, Homo sapiens
gaaaugacuuugccuguga

SEQ ID NO: 1192676 - RNA, 19 nt, Homo sapiens
gcaaguaccaccugcguua

SEQ ID NO: 1192677 - RNA, 19 nt, Homo sapiens
ggccacagccgcaccauaa

SEQ ID NO: 1192678 - RNA, 19 nt, Homo sapiens
ucacgguguuuaugucuuu

SEQ ID NO: 1192679 - RNA, 19 nt, Homo sapiens
ccaccugcguuacuacaaa

SEQ ID NO: 1192680 - RNA, 19 nt, Homo sapiens
ggacacagaacgcaaguac

SEQ ID NO: 1192681 - RNA, 19 nt, Homo sapiens
ggcgacggcugccaguauu

SEQ ID NO: 1192682 - RNA, 19 nt, Homo sapiens
gcacggagcagcaguucca

SEQ ID NO: 1192683 - RNA, 19 nt, Homo sapiens
cguguucccuaucuacaaa

SEQ ID NO: 1192684 - RNA, 19 nt, Homo sapiens
gccaggccaugauugagaa

SEQ ID NO: 1192685 - RNA, 19 nt, Homo sapiens
gaaccaccuggccguguuu

SEQ ID NO: 1192686 - RNA, 19 nt, Homo sapiens
guuuaugucuuugaacaga

SEQ ID NO: 1192687 - RNA, 19 nt, Homo sapiens
caucaggacccgcgucaau

SEQ ID NO: 1192688 - RNA, 19 nt, Homo sapiens
cugagaagccgacccacua

SEQ ID NO: 1192689 - RNA, 19 nt, Homo sapiens
gacggcaccuucaacuaca

SEQ ID NO: 1192690 - RNA, 19 nt, Homo sapiens
caaggaggccgaggagaga

SEQ ID NO: 1192691 - RNA, 19 nt, Homo sapiens
gaaaugccaagcggagaga

SEQ ID NO: 1192692 - RNA, 19 nt, Homo sapiens
gcaacgacaugcgccaaac

SEQ ID NO: 1192693 - RNA, 19 nt, Homo sapiens
ccacagccgcaccauaaau

SEQ ID NO: 1192694 - RNA, 19 nt, Homo sapiens
gcagcgagcaagacagcaa

SEQ ID NO: 1192695 - RNA, 19 nt, Homo sapiens
cuacaaaucuacaaaaugc

SEQ ID NO: 1192696 - RNA, 19 nt, Homo sapiens
cgacggcaccuucaacuac

SEQ ID NO: 1192697 - RNA, 19 nt, Homo sapiens
cauaaauccugagggagau

SEQ ID NO: 1192698 - RNA, 19 nt, Homo sapiens
agaaccaccuggccguguu

SEQ ID NO: 1192699 - RNA, 19 nt, Homo sapiens
acacagaacgcaaguacca

SEQ ID NO: 1192700 - RNA, 19 nt, Homo sapiens
gacguguacugcuccaagu

SEQ ID NO: 1192701 - RNA, 19 nt, Homo sapiens
ugcccacacuaccacaaua

SEQ ID NO: 1192702 - RNA, 19 nt, Homo sapiens
ccagccaggccaugauuga

SEQ ID NO: 1192703 - RNA, 19 nt, Homo sapiens
gaagaaugggcugcacugu

SEQ ID NO: 1192704 - RNA, 19 nt, Homo sapiens
gcgacggcaccuucaacua

SEQ ID NO: 1192705 - RNA, 19 nt, Homo sapiens
ggcaccguguggcccauuu

SEQ ID NO: 1192706 - RNA, 19 nt, Homo sapiens
gcgcucacgguguuuaugu

SEQ ID NO: 1192707 - RNA, 19 nt, Homo sapiens
ggccagacccgcaaugacu

SEQ ID NO: 1192708 - RNA, 19 nt, Homo sapiens
uaaauccugagggagauaa

SEQ ID NO: 1192709 - RNA, 19 nt, Homo sapiens
ggaauggccccacaugugu

SEQ ID NO: 1192710 - RNA, 19 nt, Homo sapiens
gcuaugcgugcccacacua

SEQ ID NO: 1192711 - RNA, 19 nt, Homo sapiens
gccacugcgugaagaaugg

SEQ ID NO: 1192712 - RNA, 19 nt, Homo sapiens
uucccuaucuacaaaucua

SEQ ID NO: 1192713 - RNA, 19 nt, Homo sapiens
ucaggacccgcgucaaugu

SEQ ID NO: 1192714 - RNA, 19 nt, Homo sapiens
ccaggaagccuugcagaac

SEQ ID NO: 1192715 - RNA, 19 nt, Homo sapiens
ggccaugauugagaagauc

SEQ ID NO: 1192716 - RNA, 19 nt, Homo sapiens
gagaagccgacccacuaca

SEQ ID NO: 1192717 - RNA, 19 nt, Homo sapiens
caagauggguggagaaugu

SEQ ID NO: 1192718 - RNA, 19 nt, Homo sapiens
ugucuucucuuuccucuuu

SEQ ID NO: 1192719 - RNA, 19 nt, Homo sapiens
gaugaaccgugccgucuau

SEQ ID NO: 1192720 - RNA, 19 nt, Homo sapiens
gcuaugcucuuggaucuga

SEQ ID NO: 1192721 - RNA, 19 nt, Homo sapiens
ccuggucccucuccaauga

SEQ ID NO: 1192722 - RNA, 19 nt, Homo sapiens
gagcgagaacuaugccuuu

SEQ ID NO: 1192723 - RNA, 19 nt, Homo sapiens
ggaagggacggaacuagau

SEQ ID NO: 1192724 - RNA, 19 nt, Homo sapiens
gagaaugucaagcaaggaa

SEQ ID NO: 1192725 - RNA, 19 nt, Homo sapiens
gggcuaugcucuuggaucu

SEQ ID NO: 1192726 - RNA, 19 nt, Homo sapiens
ggccaaggcugcugucaac

SEQ ID NO: 1192727 - RNA, 19 nt, Homo sapiens
caucaaugcuugccucaac

SEQ ID NO: 1192728 - RNA, 19 nt, Homo sapiens
cagggaagcugaccaaagc

SEQ ID NO: 1192729 - RNA, 19 nt, Homo sapiens
ggagggacucgaugucuau

SEQ ID NO: 1192730 - RNA, 19 nt, Homo sapiens
gcagugcucgugccuauag

SEQ ID NO: 1192731 - RNA, 19 nt, Homo sapiens
caccaacguuuccacaguu

SEQ ID NO: 1192732 - RNA, 19 nt, Homo sapiens
gcucgugccuauagcaaca

SEQ ID NO: 1192733 - RNA, 19 nt, Homo sapiens
ggaggcgggagcagaagua

SEQ ID NO: 1192734 - RNA, 19 nt, Homo sapiens
ucucuuuccucuuugauau

SEQ ID NO: 1192735 - RNA, 19 nt, Homo sapiens
caaggcugcugucaacaag

SEQ ID NO: 1192736 - RNA, 19 nt, Homo sapiens
ggacaagauggguggagaa

SEQ ID NO: 1192737 - RNA, 19 nt, Homo sapiens
gaaagggaggagagacaga

SEQ ID NO: 1192738 - RNA, 19 nt, Homo sapiens
uggaggacuuugaggauga

SEQ ID NO: 1192739 - RNA, 19 nt, Homo sapiens
cggagggacucgaugucua

SEQ ID NO: 1192740 - RNA, 19 nt, Homo sapiens
gagaaagggaggagagaca

SEQ ID NO: 1192741 - RNA, 19 nt, Homo sapiens
gguguggcagcaagucuua

SEQ ID NO: 1192742 - RNA, 19 nt, Homo sapiens
ggcggugucuguucugaau

SEQ ID NO: 1192743 - RNA, 19 nt, Homo sapiens
gguggagaaugucaagcaa

SEQ ID NO: 1192744 - RNA, 19 nt, Homo sapiens
acacgucacugagcgagaa

SEQ ID NO: 1192745 - RNA, 19 nt, Homo sapiens
ugaccaaagccaagcguuu

SEQ ID NO: 1192746 - RNA, 19 nt, Homo sapiens
guggcagugucuucucuuu

SEQ ID NO: 1192747 - RNA, 19 nt, Homo sapiens
guaccgcacaccaacguuu

SEQ ID NO: 1192748 - RNA, 19 nt, Homo sapiens
gaaugucaagcaaggaaug

SEQ ID NO: 1192749 - RNA, 19 nt, Homo sapiens
ucacugagcgagaacuaug

SEQ ID NO: 1192750 - RNA, 19 nt, Homo sapiens
gaaccgugccgucuaugag

SEQ ID NO: 1192751 - RNA, 19 nt, Homo sapiens
ccaaggcugcugucaacaa

SEQ ID NO: 1192752 - RNA, 19 nt, Homo sapiens
acaaguugcugcucuacag

SEQ ID NO: 1192753 - RNA, 19 nt, Homo sapiens
gaagggacggaacuagauc

SEQ ID NO: 1192754 - RNA, 19 nt, Homo sapiens
ccacagggaagcugaccaa

SEQ ID NO: 1192755 - RNA, 19 nt, Homo sapiens
acaccaacguuuccacagu

SEQ ID NO: 1192756 - RNA, 19 nt, Homo sapiens
ccucacugcucaucaaugc

SEQ ID NO: 1192757 - RNA, 19 nt, Homo sapiens
ccacaggcaagaaagugaa

SEQ ID NO: 1192758 - RNA, 19 nt, Homo sapiens
gggaggagagacagaagga

SEQ ID NO: 1192759 - RNA, 19 nt, Homo sapiens
agaaggaaccggcgacagu

SEQ ID NO: 1192760 - RNA, 19 nt, Homo sapiens
ggaggacuuugaggaugau

SEQ ID NO: 1192761 - RNA, 19 nt, Homo sapiens
ucacugcucaucaaugcuu

SEQ ID NO: 1192762 - RNA, 19 nt, Homo sapiens
gcucgggacgcucacauuc

SEQ ID NO: 1192763 - RNA, 19 nt, Homo sapiens
caucuccacaggcaagaaa

SEQ ID NO: 1192764 - RNA, 19 nt, Homo sapiens
ggcagugucuucucuuucc

SEQ ID NO: 1192765 - RNA, 19 nt, Homo sapiens
cacagugcuucgcgugcua

SEQ ID NO: 1192766 - RNA, 19 nt, Homo sapiens
ugcgugcacuucuuugaug

SEQ ID NO: 1192767 - RNA, 19 nt, Homo sapiens
gacaagauggguggagaau

SEQ ID NO: 1192768 - RNA, 19 nt, Homo sapiens
gcgugcacuucuuugaugu

SEQ ID NO: 1192769 - RNA, 19 nt, Homo sapiens
gcaguggacgcgagguaca

SEQ ID NO: 1192770 - RNA, 19 nt, Homo sapiens
uguccuugcucuguccuuu

SEQ ID NO: 1192771 - RNA, 19 nt, Homo sapiens
gggcaccgucguucuguca

SEQ ID NO: 1192772 - RNA, 19 nt, Homo sapiens
guucugaaucgcugugugu

SEQ ID NO: 1192773 - RNA, 19 nt, Homo sapiens
uccuugcucuguccuuuga

SEQ ID NO: 1192774 - RNA, 19 nt, Homo sapiens
cgaugucuauggcaauggu

SEQ ID NO: 1192775 - RNA, 19 nt, Homo sapiens
ucaacaacaaccucacugu

SEQ ID NO: 1192776 - RNA, 19 nt, Homo sapiens
gggugcgcuucgccaauga

SEQ ID NO: 1192777 - RNA, 19 nt, Homo sapiens
ugaaccgugccgucuauga

SEQ ID NO: 1192778 - RNA, 19 nt, Homo sapiens
uagcaguggacgcgaggua

SEQ ID NO: 1192779 - RNA, 19 nt, Homo sapiens
aaagggaggagagacagaa

SEQ ID NO: 1192780 - RNA, 19 nt, Homo sapiens
gacgggcagugaggacaug

SEQ ID NO: 1192781 - RNA, 19 nt, Homo sapiens
accaacguuuccacaguuu

SEQ ID NO: 1192782 - RNA, 19 nt, Homo sapiens
uggaagggacggaacuaga

SEQ ID NO: 1192783 - RNA, 19 nt, Homo sapiens
gagcaaaucagaagaaaua

SEQ ID NO: 1192784 - RNA, 19 nt, Homo sapiens
caacagagaggaauuaauu

SEQ ID NO: 1192785 - RNA, 19 nt, Homo sapiens
agaaacagcucucuaaaga

SEQ ID NO: 1192786 - RNA, 19 nt, Homo sapiens
gcaagaaacagcucucuaa

SEQ ID NO: 1192787 - RNA, 19 nt, Homo sapiens
ggaggaggauaacaaguuu

SEQ ID NO: 1192788 - RNA, 19 nt, Homo sapiens
gguuaaagcuccugucaga

SEQ ID NO: 1192789 - RNA, 19 nt, Homo sapiens
gcaauacccuagagaagga

SEQ ID NO: 1192790 - RNA, 19 nt, Homo sapiens
gaacuucuauggagccaau

SEQ ID NO: 1192791 - RNA, 19 nt, Homo sapiens
ccaauggcaugaugaacua

SEQ ID NO: 1192792 - RNA, 19 nt, Homo sapiens
ccucagauguggaaauaaa

SEQ ID NO: 1192793 - RNA, 19 nt, Homo sapiens
caugaugccuccaccagua

SEQ ID NO: 1192794 - RNA, 19 nt, Homo sapiens
agaccucucuguugcuuua

SEQ ID NO: 1192795 - RNA, 19 nt, Homo sapiens
cagcugcaauggaaccuua

SEQ ID NO: 1192796 - RNA, 19 nt, Homo sapiens
gaaauggacaggcagcaaa

SEQ ID NO: 1192797 - RNA, 19 nt, Homo sapiens
gaugaacuauggacaguca

SEQ ID NO: 1192798 - RNA, 19 nt, Homo sapiens
ggacaucaaugccuuuagg

SEQ ID NO: 1192799 - RNA, 19 nt, Homo sapiens
augcagagcuuaacgugua

SEQ ID NO: 1192800 - RNA, 19 nt, Homo sapiens
gaagaccucucuguugcuu

SEQ ID NO: 1192801 - RNA, 19 nt, Homo sapiens
gugcacauauccaggguaa

SEQ ID NO: 1192802 - RNA, 19 nt, Homo sapiens
ggacagcuuuccucucagu

SEQ ID NO: 1192803 - RNA, 19 nt, Homo sapiens
aaacagcucucuaaagacu

SEQ ID NO: 1192804 - RNA, 19 nt, Homo sapiens
gcagaaggcacuuaaacug

SEQ ID NO: 1192805 - RNA, 19 nt, Homo sapiens
cuaccucucuguuugguuu

SEQ ID NO: 1192806 - RNA, 19 nt, Homo sapiens
gcagauggcugggaugaac

SEQ ID NO: 1192807 - RNA, 19 nt, Homo sapiens
gaaugaagcaaguacugaa

SEQ ID NO: 1192808 - RNA, 19 nt, Homo sapiens
guccucagauguggaaaua

SEQ ID NO: 1192809 - RNA, 19 nt, Homo sapiens
ucaaaugccuacucaagca

SEQ ID NO: 1192810 - RNA, 19 nt, Homo sapiens
caagaaacagcucucuaaa

SEQ ID NO: 1192811 - RNA, 19 nt, Homo sapiens
cagaagaaauaggcaagaa

SEQ ID NO: 1192812 - RNA, 19 nt, Homo sapiens
gcacauauccaggguaaag

SEQ ID NO: 1192813 - RNA, 19 nt, Homo sapiens
caauggaaccuuacucaga

SEQ ID NO: 1192814 - RNA, 19 nt, Homo sapiens
gcaaaccgacuuuaugaag

SEQ ID NO: 1192815 - RNA, 19 nt, Homo sapiens
cgggacagcuuuccucuca

SEQ ID NO: 1192816 - RNA, 19 nt, Homo sapiens
uauccagggugcucuguuu

SEQ ID NO: 1192817 - RNA, 19 nt, Homo sapiens
gaagaaauaggcaagaaac

SEQ ID NO: 1192818 - RNA, 19 nt, Homo sapiens
agacccagcuguugaagga

SEQ ID NO: 1192819 - RNA, 19 nt, Homo sapiens
caagagaugggaaauggaa

SEQ ID NO: 1192820 - RNA, 19 nt, Homo sapiens
aauaagcuguuucuaagug

SEQ ID NO: 1192821 - RNA, 19 nt, Homo sapiens
ggacaggcagcaaaucaga

SEQ ID NO: 1192822 - RNA, 19 nt, Homo sapiens
caucaaugccuuuaggaaa

SEQ ID NO: 1192823 - RNA, 19 nt, Homo sapiens
uaauuuaucagcagccuaa

SEQ ID NO: 1192824 - RNA, 19 nt, Homo sapiens
ggaaugaagcaaguacuga

SEQ ID NO: 1192825 - RNA, 19 nt, Homo sapiens
gcaaacaggggaaagcuua

SEQ ID NO: 1192826 - RNA, 19 nt, Homo sapiens
gggagcaaaucagaagaaa

SEQ ID NO: 1192827 - RNA, 19 nt, Homo sapiens
gagaaggauuuagaucugu

SEQ ID NO: 1192828 - RNA, 19 nt, Homo sapiens
gcagauugccagucuaaag

SEQ ID NO: 1192829 - RNA, 19 nt, Homo sapiens
cagcgccugucauggauuu

SEQ ID NO: 1192830 - RNA, 19 nt, Homo sapiens
agacaaauaugagaagaag

SEQ ID NO: 1192831 - RNA, 19 nt, Homo sapiens
cuguggguguuguauauua

SEQ ID NO: 1192832 - RNA, 19 nt, Homo sapiens
caugaagaccucucuguug

SEQ ID NO: 1192833 - RNA, 19 nt, Homo sapiens
ugaagcaaguacugaaauc

SEQ ID NO: 1192834 - RNA, 19 nt, Homo sapiens
agagaaggauuuagaucug

SEQ ID NO: 1192835 - RNA, 19 nt, Homo sapiens
ggaccgaagucuggacauc

SEQ ID NO: 1192836 - RNA, 19 nt, Homo sapiens
gauagacccagcuguugaa

SEQ ID NO: 1192837 - RNA, 19 nt, Homo sapiens
uuacaacagagaggaauua

SEQ ID NO: 1192838 - RNA, 19 nt, Homo sapiens
uggcugggaugaacuucua

SEQ ID NO: 1192839 - RNA, 19 nt, Homo sapiens
caccagcaccuuagaaguu

SEQ ID NO: 1192840 - RNA, 19 nt, Homo sapiens
aauggaaccuuacucagau

SEQ ID NO: 1192841 - RNA, 19 nt, Homo sapiens
ucagauagacccagcuguu

SEQ ID NO: 1192842 - RNA, 19 nt, Homo sapiens
aauaguaagaccagcaaua

SEQ ID NO: 1192843 - RNA, 19 nt, Homo sapiens
gcaaguacugaaaucaaau

SEQ ID NO: 1192844 - RNA, 19 nt, Homo sapiens
gaagcaaguacugaaauca

SEQ ID NO: 1192845 - RNA, 19 nt, Homo sapiens
gagacaaauaugagaagaa

SEQ ID NO: 1192846 - RNA, 19 nt, Homo sapiens
ccuguggccugcuccauug

SEQ ID NO: 1192847 - RNA, 19 nt, Homo sapiens
ccaguggacucaagaacag

SEQ ID NO: 1192848 - RNA, 19 nt, Homo sapiens
cggaaaagcuccccgaaau

SEQ ID NO: 1192849 - RNA, 19 nt, Homo sapiens
cgagacaaauaugagaaga

SEQ ID NO: 1192850 - RNA, 19 nt, Homo sapiens
aagaacagauucagugcau

SEQ ID NO: 1192851 - RNA, 19 nt, Homo sapiens
gacaagaaaacuuugcuua

SEQ ID NO: 1192852 - RNA, 19 nt, Homo sapiens
ggucugcugaucacucuuu

SEQ ID NO: 1192853 - RNA, 19 nt, Homo sapiens
uaacguguacugcuugugu

SEQ ID NO: 1192854 - RNA, 19 nt, Homo sapiens
agcaaguacugaaaucaaa

SEQ ID NO: 1192855 - RNA, 19 nt, Homo sapiens
gugcagauugccagucuaa

SEQ ID NO: 1192856 - RNA, 19 nt, Homo sapiens
gaacuauggacagucaaug

SEQ ID NO: 1192857 - RNA, 19 nt, Homo sapiens
ggaaauggacaggcagcaa

SEQ ID NO: 1192858 - RNA, 19 nt, Homo sapiens
gucaaugaguggcggaaau

SEQ ID NO: 1192859 - RNA, 19 nt, Homo sapiens
agaaggauuuagaucuguu

SEQ ID NO: 1192860 - RNA, 19 nt, Homo sapiens
gaccagcaauacccuagag

SEQ ID NO: 1192861 - RNA, 19 nt, Homo sapiens
caaauaguaagaccagcaa

SEQ ID NO: 1192862 - RNA, 19 nt, Homo sapiens
gaaauacauggaccgaagu

SEQ ID NO: 1192863 - RNA, 19 nt, Homo sapiens
gucuguggguguuguauau

SEQ ID NO: 1192864 - RNA, 19 nt, Homo sapiens
cagaaggcacuuaaacugu

SEQ ID NO: 1192865 - RNA, 19 nt, Homo sapiens
cgaugggccucuuggaaca

SEQ ID NO: 1192866 - RNA, 19 nt, Homo sapiens
gaaggauuuagaucuguug

SEQ ID NO: 1192867 - RNA, 19 nt, Homo sapiens
ggacucaagaacagauuca

SEQ ID NO: 1192868 - RNA, 19 nt, Homo sapiens
uuuccuaccucucuguuug

SEQ ID NO: 1192869 - RNA, 19 nt, Homo sapiens
gaucccagacgccucaaau

SEQ ID NO: 1192870 - RNA, 19 nt, Homo sapiens
aggcaaaccgacuuuauga

SEQ ID NO: 1192871 - RNA, 19 nt, Homo sapiens
ggucuguggguguuguaua

SEQ ID NO: 1192872 - RNA, 19 nt, Homo sapiens
ucuguugcuuuauguugua

SEQ ID NO: 1192873 - RNA, 19 nt, Homo sapiens
gugagugugugugugugua

SEQ ID NO: 1192874 - RNA, 19 nt, Homo sapiens
uaagcuguuucuaaguguu

SEQ ID NO: 1192875 - RNA, 19 nt, Homo sapiens
agaagaaauaggcaagaaa

SEQ ID NO: 1192876 - RNA, 19 nt, Homo sapiens
uggaggaggauaacaaguu

SEQ ID NO: 1192877 - RNA, 19 nt, Homo sapiens
ugcaagagaugggaaaugg

SEQ ID NO: 1192878 - RNA, 19 nt, Homo sapiens
agaagggucuguggguguu

SEQ ID NO: 1192879 - RNA, 19 nt, Homo sapiens
uggcaggcauggcagcuau

SEQ ID NO: 1192880 - RNA, 19 nt, Homo sapiens
gcaaaucagaagaaauagg

SEQ ID NO: 1192881 - RNA, 19 nt, Homo sapiens
ccagcaauacccuagagaa

SEQ ID NO: 1192882 - RNA, 19 nt, Homo sapiens
gcuguugaaggauuuauuc

SEQ ID NO: 1192883 - RNA, 19 nt, Homo sapiens
ggacugagccugguguaua

SEQ ID NO: 1192884 - RNA, 19 nt, Homo sapiens
gaaaggugguucagaaucu

SEQ ID NO: 1192885 - RNA, 19 nt, Homo sapiens
cagaucagcugccauguug

SEQ ID NO: 1192886 - RNA, 19 nt, Homo sapiens
gagcagacauuugccugua

SEQ ID NO: 1192887 - RNA, 19 nt, Homo sapiens
gaacaagaaaccaaaggaa

SEQ ID NO: 1192888 - RNA, 19 nt, Homo sapiens
uaagugaacugcccagcaa

SEQ ID NO: 1192889 - RNA, 19 nt, Homo sapiens
gcacugagguaguucaaac

SEQ ID NO: 1192890 - RNA, 19 nt, Homo sapiens
gcaguuugauguaguagug

SEQ ID NO: 1192891 - RNA, 19 nt, Homo sapiens
gagccuacgugaauauaug

SEQ ID NO: 1192892 - RNA, 19 nt, Homo sapiens
gaggauguguaacaaguau

SEQ ID NO: 1192893 - RNA, 19 nt, Homo sapiens
ucacucagccuguccuuaa

SEQ ID NO: 1192894 - RNA, 19 nt, Homo sapiens
gcacagccuucucauggau

SEQ ID NO: 1192895 - RNA, 19 nt, Homo sapiens
gcagacauuugccuguaga

SEQ ID NO: 1192896 - RNA, 19 nt, Homo sapiens
ggagugacccagguagaua

SEQ ID NO: 1192897 - RNA, 19 nt, Homo sapiens
ggauguguaacaaguauuu

SEQ ID NO: 1192898 - RNA, 19 nt, Homo sapiens
gacugagccugguguauau

SEQ ID NO: 1192899 - RNA, 19 nt, Homo sapiens
ggccagagccuacgugaau

SEQ ID NO: 1192900 - RNA, 19 nt, Homo sapiens
ugaccaaccuggccuguag

SEQ ID NO: 1192901 - RNA, 19 nt, Homo sapiens
ccauaugucuguguuuguu

SEQ ID NO: 1192902 - RNA, 19 nt, Homo sapiens
ggcugaagcugccugguau

SEQ ID NO: 1192903 - RNA, 19 nt, Homo sapiens
gggcugaagcugccuggua

SEQ ID NO: 1192904 - RNA, 19 nt, Homo sapiens
caagaaaccaaaggaagaa

SEQ ID NO: 1192905 - RNA, 19 nt, Homo sapiens
ggaacaagaaaccaaagga

SEQ ID NO: 1192906 - RNA, 19 nt, Homo sapiens
ggugcaguuugauguagua

SEQ ID NO: 1192907 - RNA, 19 nt, Homo sapiens
gcccaguuauugcuacuug

SEQ ID NO: 1192908 - RNA, 19 nt, Homo sapiens
ccaugugcauugucacuug

SEQ ID NO: 1192909 - RNA, 19 nt, Homo sapiens
uaaacggccucgccaugug

SEQ ID NO: 1192910 - RNA, 19 nt, Homo sapiens
gcacggcagggauuuguau

SEQ ID NO: 1192911 - RNA, 19 nt, Homo sapiens
gccagagccuacgugaaua

SEQ ID NO: 1192912 - RNA, 19 nt, Homo sapiens
aaacuuugauggacuuugg

SEQ ID NO: 1192913 - RNA, 19 nt, Homo sapiens
gauccgggcucgaaaucca

SEQ ID NO: 1192914 - RNA, 19 nt, Homo sapiens
gggcuaggcaucuugagaa

SEQ ID NO: 1192915 - RNA, 19 nt, Homo sapiens
acaagaaaccaaaggaaga

SEQ ID NO: 1192916 - RNA, 19 nt, Homo sapiens
caaggugcaguuugaugua

SEQ ID NO: 1192917 - RNA, 19 nt, Homo sapiens
ugacccagguagauaacaa

SEQ ID NO: 1192918 - RNA, 19 nt, Homo sapiens
gcagcagucuccagagcau

SEQ ID NO: 1192919 - RNA, 19 nt, Homo sapiens
gagugacccagguagauaa

SEQ ID NO: 1192920 - RNA, 19 nt, Homo sapiens
ggcuaggcaucuugagaaa

SEQ ID NO: 1192921 - RNA, 19 nt, Homo sapiens
ugaccgcacugagguaguu

SEQ ID NO: 1192922 - RNA, 19 nt, Homo sapiens
aagacuggaugguggcuuu

SEQ ID NO: 1192923 - RNA, 19 nt, Homo sapiens
cauuucagccacaaacuuu

SEQ ID NO: 1192924 - RNA, 19 nt, Homo sapiens
gagaguugaugaggaugug

SEQ ID NO: 1192925 - RNA, 19 nt, Homo sapiens
caccugggcugcucacagu

SEQ ID NO: 1192926 - RNA, 19 nt, Homo sapiens
ccagagcauuccaugagau

SEQ ID NO: 1192927 - RNA, 19 nt, Homo sapiens
gcauuucagccacaaacuu

SEQ ID NO: 1192928 - RNA, 19 nt, Homo sapiens
ccagaggaguugcaaagac

SEQ ID NO: 1192929 - RNA, 19 nt, Homo sapiens
agaaucaggugcaaacacu

SEQ ID NO: 1192930 - RNA, 19 nt, Homo sapiens
ggcccacuauggagaauca

SEQ ID NO: 1192931 - RNA, 19 nt, Homo sapiens
gcuacacgcacuacguaaa

SEQ ID NO: 1192932 - RNA, 19 nt, Homo sapiens
uagauaacaaguccgguuu

SEQ ID NO: 1192933 - RNA, 19 nt, Homo sapiens
ucugagaguugaugaggau

SEQ ID NO: 1192934 - RNA, 19 nt, Homo sapiens
ggcagggauuuguaucguu

SEQ ID NO: 1192935 - RNA, 19 nt, Homo sapiens
ccaaggugcaguuugaugu

SEQ ID NO: 1192936 - RNA, 19 nt, Homo sapiens
ugaugaggauguguaacaa

SEQ ID NO: 1192937 - RNA, 19 nt, Homo sapiens
gaguugaugaggaugugua

SEQ ID NO: 1192938 - RNA, 19 nt, Homo sapiens
ggcacagccuucucaugga

SEQ ID NO: 1192939 - RNA, 19 nt, Homo sapiens
guaaaacuaccuaccauug

SEQ ID NO: 1192940 - RNA, 19 nt, Homo sapiens
gcuggaacaagaaaccaaa

SEQ ID NO: 1192941 - RNA, 19 nt, Homo sapiens
ggcaagaacugagcuacac

SEQ ID NO: 1192942 - RNA, 19 nt, Homo sapiens
gaucagcugccauguuggu

SEQ ID NO: 1192943 - RNA, 19 nt, Homo sapiens
aaaguucucuauggugauc

SEQ ID NO: 1192944 - RNA, 19 nt, Homo sapiens
gauaacaaguccgguuucc

SEQ ID NO: 1192945 - RNA, 19 nt, Homo sapiens
gacuuuggcucagguacug

SEQ ID NO: 1192946 - RNA, 19 nt, Homo sapiens
caugagauccgggcucgaa

SEQ ID NO: 1192947 - RNA, 19 nt, Homo sapiens
ggaaaacccagacuuaucu

SEQ ID NO: 1192948 - RNA, 19 nt, Homo sapiens
cccuucagcuggaacaaga

SEQ ID NO: 1192949 - RNA, 19 nt, Homo sapiens
gcaaggcugaccgcacuga

SEQ ID NO: 1192950 - RNA, 19 nt, Homo sapiens
ccagagccuacgugaauau

SEQ ID NO: 1192951 - RNA, 19 nt, Homo sapiens
aacccagacuuaucucaga

SEQ ID NO: 1192952 - RNA, 19 nt, Homo sapiens
ugucuguguuuguuugaga

SEQ ID NO: 1192953 - RNA, 19 nt, Homo sapiens
gagauccgggcucgaaauc

SEQ ID NO: 1192954 - RNA, 19 nt, Homo sapiens
ugaggauguguaacaagua

SEQ ID NO: 1192955 - RNA, 19 nt, Homo sapiens
cacucagccuguccuuaaa

SEQ ID NO: 1192956 - RNA, 19 nt, Homo sapiens
gguggagaauggaacaaaa

SEQ ID NO: 1192957 - RNA, 19 nt, Homo sapiens
gcguaagacaggucauuuc

SEQ ID NO: 1192958 - RNA, 19 nt, Homo sapiens
gggcugcucacaguauuug

SEQ ID NO: 1192959 - RNA, 19 nt, Homo sapiens
uaccuaccauuggcaagaa

SEQ ID NO: 1192960 - RNA, 19 nt, Homo sapiens
guacugguggagaauggaa

SEQ ID NO: 1192961 - RNA, 19 nt, Homo sapiens
ggcguaagacaggucauuu

SEQ ID NO: 1192962 - RNA, 19 nt, Homo sapiens
auaugucuguguuuguuug

SEQ ID NO: 1192963 - RNA, 19 nt, Homo sapiens
cacuugugcuguccagaug

SEQ ID NO: 1192964 - RNA, 19 nt, Homo sapiens
acagaucagcugccauguu

SEQ ID NO: 1192965 - RNA, 19 nt, Homo sapiens
caugugcauugucacuugu

SEQ ID NO: 1192966 - RNA, 19 nt, Homo sapiens
gauguaguagugucagcuu

SEQ ID NO: 1192967 - RNA, 19 nt, Homo sapiens
cagcugccauguugguuuu

SEQ ID NO: 1192968 - RNA, 19 nt, Homo sapiens
cagagccuacgugaauaua

SEQ ID NO: 1192969 - RNA, 19 nt, Homo sapiens
gcucagguacugguucugu

SEQ ID NO: 1192970 - RNA, 19 nt, Homo sapiens
uccagagcauuccaugaga

SEQ ID NO: 1192971 - RNA, 19 nt, Homo sapiens
uuauauuccaggugucuuu

SEQ ID NO: 1192972 - RNA, 19 nt, Homo sapiens
ucagcugccauguugguuu

SEQ ID NO: 1192973 - RNA, 19 nt, Homo sapiens
cauaugucuguguuuguuu

SEQ ID NO: 1192974 - RNA, 19 nt, Homo sapiens
augaggauguguaacaagu

SEQ ID NO: 1192975 - RNA, 19 nt, Homo sapiens
ucacuugugcuguccagau

SEQ ID NO: 1192976 - RNA, 19 nt, Homo sapiens
uaagggaaaggagaaguca

SEQ ID NO: 1192977 - RNA, 19 nt, Homo sapiens
ggacuuuggcucagguacu

SEQ ID NO: 1192978 - RNA, 19 nt, Homo sapiens
ugacaaagauggcaauaua

SEQ ID NO: 1192979 - RNA, 19 nt, Homo sapiens
gaagaaggaucauaucucu

SEQ ID NO: 1192980 - RNA, 19 nt, Homo sapiens
guacauaucuaacucuguu

SEQ ID NO: 1192981 - RNA, 19 nt, Homo sapiens
ggcagaagaugacauuuaa

SEQ ID NO: 1192982 - RNA, 19 nt, Homo sapiens
gaaguaacauugcacuaau

SEQ ID NO: 1192983 - RNA, 19 nt, Homo sapiens
gcacugcgcuucuucaaag

SEQ ID NO: 1192984 - RNA, 19 nt, Homo sapiens
gcauuagagucacaguuua

SEQ ID NO: 1192985 - RNA, 19 nt, Homo sapiens
gaaacaacaggaaguagua

SEQ ID NO: 1192986 - RNA, 19 nt, Homo sapiens
gcaacuguaccaaguaaua

SEQ ID NO: 1192987 - RNA, 19 nt, Homo sapiens
ggaaguaacauugcacuaa

SEQ ID NO: 1192988 - RNA, 19 nt, Homo sapiens
gggcagaagaugacauuua

SEQ ID NO: 1192989 - RNA, 19 nt, Homo sapiens
gaaaggagacggauagaag

SEQ ID NO: 1192990 - RNA, 19 nt, Homo sapiens
cauagaguaucucaaauug

SEQ ID NO: 1192991 - RNA, 19 nt, Homo sapiens
gaaauggccucaguuugau

SEQ ID NO: 1192992 - RNA, 19 nt, Homo sapiens
gcagcuggcuuugauuaaa

SEQ ID NO: 1192993 - RNA, 19 nt, Homo sapiens
ggaugcagauuccgugauu

SEQ ID NO: 1192994 - RNA, 19 nt, Homo sapiens
ucaaagacuucaaagagaa

SEQ ID NO: 1192995 - RNA, 19 nt, Homo sapiens
gaaguagucccagcucaua

SEQ ID NO: 1192996 - RNA, 19 nt, Homo sapiens
gaucaaagacuucaaagag

SEQ ID NO: 1192997 - RNA, 19 nt, Homo sapiens
caaguaauaugaugucagu

SEQ ID NO: 1192998 - RNA, 19 nt, Homo sapiens
gaaugcaacuguaccaagu

SEQ ID NO: 1192999 - RNA, 19 nt, Homo sapiens
gcagauaauggcagcuuua

SEQ ID NO: 1193000 - RNA, 19 nt, Homo sapiens
gagguuggauucuuugaug

SEQ ID NO: 1193001 - RNA, 19 nt, Homo sapiens
ccucacagauuauaauaga

SEQ ID NO: 1193002 - RNA, 19 nt, Homo sapiens
gaaagagaacgucugcaaa

SEQ ID NO: 1193003 - RNA, 19 nt, Homo sapiens
gcucauagguguucauacu

SEQ ID NO: 1193004 - RNA, 19 nt, Homo sapiens
uagaacaccucagagauuu

SEQ ID NO: 1193005 - RNA, 19 nt, Homo sapiens
gcuguuuaguucagaguua

SEQ ID NO: 1193006 - RNA, 19 nt, Homo sapiens
cucaacaccucacagauua

SEQ ID NO: 1193007 - RNA, 19 nt, Homo sapiens
gagucuaucuccucaaguu

SEQ ID NO: 1193008 - RNA, 19 nt, Homo sapiens
guacaagugcgauuucaaa

SEQ ID NO: 1193009 - RNA, 19 nt, Homo sapiens
agaaauggccucaguuuga

SEQ ID NO: 1193010 - RNA, 19 nt, Homo sapiens
gaaguuacaugagcuacau

SEQ ID NO: 1193011 - RNA, 19 nt, Homo sapiens
ggagagugguauagauaga

SEQ ID NO: 1193012 - RNA, 19 nt, Homo sapiens
guagaacaccucagagauu

SEQ ID NO: 1193013 - RNA, 19 nt, Homo sapiens
aaacaucgguugugaagag

SEQ ID NO: 1193014 - RNA, 19 nt, Homo sapiens
ggagacggauagaagaaga

SEQ ID NO: 1193015 - RNA, 19 nt, Homo sapiens
gaacagcagcaaauucuca

SEQ ID NO: 1193016 - RNA, 19 nt, Homo sapiens
caacaagccuuugcuggau

SEQ ID NO: 1193017 - RNA, 19 nt, Homo sapiens
aaacaugucuaaagaggau

SEQ ID NO: 1193018 - RNA, 19 nt, Homo sapiens
uaaaucacuucuuguagga

SEQ ID NO: 1193019 - RNA, 19 nt, Homo sapiens
agaaggaucauaucucuuu

SEQ ID NO: 1193020 - RNA, 19 nt, Homo sapiens
ccucaaauuuguauaagug

SEQ ID NO: 1193021 - RNA, 19 nt, Homo sapiens
gcacuaauauggaaaucac

SEQ ID NO: 1193022 - RNA, 19 nt, Homo sapiens
gaccucagaucaaagacuu

SEQ ID NO: 1193023 - RNA, 19 nt, Homo sapiens
gauaauggcagcuuuaaac

SEQ ID NO: 1193024 - RNA, 19 nt, Homo sapiens
auacauaugcccaugcuua

SEQ ID NO: 1193025 - RNA, 19 nt, Homo sapiens
gauauuggucugaugguuu

SEQ ID NO: 1193026 - RNA, 19 nt, Homo sapiens
gacacgaccucagaucaaa

SEQ ID NO: 1193027 - RNA, 19 nt, Homo sapiens
agaaugacccagauuguuu

SEQ ID NO: 1193028 - RNA, 19 nt, Homo sapiens
gaagaagcccuggagaaug

SEQ ID NO: 1193029 - RNA, 19 nt, Homo sapiens
ugggaaacaugucuaaaga

SEQ ID NO: 1193030 - RNA, 19 nt, Homo sapiens
guuaggcacuuccuggauu

SEQ ID NO: 1193031 - RNA, 19 nt, Homo sapiens
caaauuggcaccuacugaa

SEQ ID NO: 1193032 - RNA, 19 nt, Homo sapiens
aaagaaauggccucaguuu

SEQ ID NO: 1193033 - RNA, 19 nt, Homo sapiens
caacaccucacagauuaua

SEQ ID NO: 1193034 - RNA, 19 nt, Homo sapiens
cauauggguuguuugaguu

SEQ ID NO: 1193035 - RNA, 19 nt, Homo sapiens
gggugcagcuguuuaguuc

SEQ ID NO: 1193036 - RNA, 19 nt, Homo sapiens
ugacaacuccuacucuuug

SEQ ID NO: 1193037 - RNA, 19 nt, Homo sapiens
accagaagcugcagaagaa

SEQ ID NO: 1193038 - RNA, 19 nt, Homo sapiens
cauauaauccagacacuug

SEQ ID NO: 1193039 - RNA, 19 nt, Homo sapiens
uaacauugcacuaauaugg

SEQ ID NO: 1193040 - RNA, 19 nt, Homo sapiens
gaugguuugugaacucuug

SEQ ID NO: 1193041 - RNA, 19 nt, Homo sapiens
cacagacaauuaugacauu

SEQ ID NO: 1193042 - RNA, 19 nt, Homo sapiens
ggacacgaccucagaucaa

SEQ ID NO: 1193043 - RNA, 19 nt, Homo sapiens
uauagaaaccauggaguua

SEQ ID NO: 1193044 - RNA, 19 nt, Homo sapiens
guaggaggguuuucauuaa

SEQ ID NO: 1193045 - RNA, 19 nt, Homo sapiens
guuacaguguccucuaauu

SEQ ID NO: 1193046 - RNA, 19 nt, Homo sapiens
cuacauauggguuguuuga

SEQ ID NO: 1193047 - RNA, 19 nt, Homo sapiens
aauccuaaaucacuucuug

SEQ ID NO: 1193048 - RNA, 19 nt, Homo sapiens
gaagggagagugguauaga

SEQ ID NO: 1193049 - RNA, 19 nt, Homo sapiens
ggaauuugccacagacaau

SEQ ID NO: 1193050 - RNA, 19 nt, Homo sapiens
gagcaguguauguuacuuu

SEQ ID NO: 1193051 - RNA, 19 nt, Homo sapiens
agauggcaauauacacuua

SEQ ID NO: 1193052 - RNA, 19 nt, Homo sapiens
ggagaauuggaaauacaua

SEQ ID NO: 1193053 - RNA, 19 nt, Homo sapiens
ggcaaagcauuucauccaa

SEQ ID NO: 1193054 - RNA, 19 nt, Homo sapiens
gcacauguuaagaugaauu

SEQ ID NO: 1193055 - RNA, 19 nt, Homo sapiens
aagcaggcacuaauauaua

SEQ ID NO: 1193056 - RNA, 19 nt, Homo sapiens
guauagaaaccauggaguu

SEQ ID NO: 1193057 - RNA, 19 nt, Homo sapiens
aaacucaaauuggcaccua

SEQ ID NO: 1193058 - RNA, 19 nt, Homo sapiens
gugcagcuggcuuugauua

SEQ ID NO: 1193059 - RNA, 19 nt, Homo sapiens
acaguguccucuaauuuga

SEQ ID NO: 1193060 - RNA, 19 nt, Homo sapiens
agucacaguuuaccuuauu

SEQ ID NO: 1193061 - RNA, 19 nt, Homo sapiens
gaugcagauuccgugauua

SEQ ID NO: 1193062 - RNA, 19 nt, Homo sapiens
gucaagcucuuaaauaggu

SEQ ID NO: 1193063 - RNA, 19 nt, Homo sapiens
aagaagcccuggagaaugg

SEQ ID NO: 1193064 - RNA, 19 nt, Homo sapiens
caacaggcagcauuacaga

SEQ ID NO: 1193065 - RNA, 19 nt, Homo sapiens
guaugcagcccaacaguau

SEQ ID NO: 1193066 - RNA, 19 nt, Homo sapiens
gaggaaaggagacggauag

SEQ ID NO: 1193067 - RNA, 19 nt, Homo sapiens
aagcauuucauccaacuua

SEQ ID NO: 1193068 - RNA, 19 nt, Homo sapiens
ggcaauauacacuuaaugu

SEQ ID NO: 1193069 - RNA, 19 nt, Homo sapiens
gcauaugggaaguaacauu

SEQ ID NO: 1193070 - RNA, 19 nt, Homo sapiens
caucgguugugaagagaaa

SEQ ID NO: 1193071 - RNA, 19 nt, Homo sapiens
agaaucucuuccaguaaua

SEQ ID NO: 1193072 - RNA, 19 nt, Homo sapiens
ggaaaggagacggauagaa

SEQ ID NO: 1193073 - RNA, 19 nt, Homo sapiens
aaagcaggcacuaauauau

SEQ ID NO: 1193074 - RNA, 19 nt, Homo sapiens
guacauaugguauagaaac

SEQ ID NO: 1193075 - RNA, 19 nt, Homo sapiens
caggcucucugucagcuuu

SEQ ID NO: 1193076 - RNA, 19 nt, Homo sapiens
auuggcaccuacugaauua

SEQ ID NO: 1193077 - RNA, 19 nt, Homo sapiens
cuucauagaguaucucaaa

SEQ ID NO: 1193078 - RNA, 19 nt, Homo sapiens
gcagagagaauccuucaua

SEQ ID NO: 1193079 - RNA, 19 nt, Homo sapiens
gggaauaugugaagauguu

SEQ ID NO: 1193080 - RNA, 19 nt, Homo sapiens
auaauggacuggaaaguua

SEQ ID NO: 1193081 - RNA, 19 nt, Homo sapiens
gagaauccuucauaaagaa

SEQ ID NO: 1193082 - RNA, 19 nt, Homo sapiens
gauggaauuuggaagauuu

SEQ ID NO: 1193083 - RNA, 19 nt, Homo sapiens
gguguaacguguauucuuu

SEQ ID NO: 1193084 - RNA, 19 nt, Homo sapiens
ggacuggaaaguuauauuu

SEQ ID NO: 1193085 - RNA, 19 nt, Homo sapiens
gcugugagcugguuuaaag

SEQ ID NO: 1193086 - RNA, 19 nt, Homo sapiens
gaaguacaguaaacaugaa

SEQ ID NO: 1193087 - RNA, 19 nt, Homo sapiens
ugaggacccuaaucacuua

SEQ ID NO: 1193088 - RNA, 19 nt, Homo sapiens
ugggauggcuguauucuaa

SEQ ID NO: 1193089 - RNA, 19 nt, Homo sapiens
ggaaguacaguaaacauga

SEQ ID NO: 1193090 - RNA, 19 nt, Homo sapiens
cagagagaauccuucauaa

SEQ ID NO: 1193091 - RNA, 19 nt, Homo sapiens
ugaagucucuuucugauca

SEQ ID NO: 1193092 - RNA, 19 nt, Homo sapiens
gagagaauccuucauaaag

SEQ ID NO: 1193093 - RNA, 19 nt, Homo sapiens
gcaagugaauaccacgaaa

SEQ ID NO: 1193094 - RNA, 19 nt, Homo sapiens
acacaucguugguuugaaa

SEQ ID NO: 1193095 - RNA, 19 nt, Homo sapiens
gagcuucuguugagauaau

SEQ ID NO: 1193096 - RNA, 19 nt, Homo sapiens
gcuauuauguugcuguguu

SEQ ID NO: 1193097 - RNA, 19 nt, Homo sapiens
aacaauagcuugcgcucua

SEQ ID NO: 1193098 - RNA, 19 nt, Homo sapiens
agaaugggcuuaacacauc

SEQ ID NO: 1193099 - RNA, 19 nt, Homo sapiens
caagugcaauuaacagugu

SEQ ID NO: 1193100 - RNA, 19 nt, Homo sapiens
uaacugauguaaaggacuu

SEQ ID NO: 1193101 - RNA, 19 nt, Homo sapiens
cgaaauucaugcugcugua

SEQ ID NO: 1193102 - RNA, 19 nt, Homo sapiens
ggugggaaccuaaauuauu

SEQ ID NO: 1193103 - RNA, 19 nt, Homo sapiens
agagaauccuucauaaaga

SEQ ID NO: 1193104 - RNA, 19 nt, Homo sapiens
gugggaaccuaaauuauuc

SEQ ID NO: 1193105 - RNA, 19 nt, Homo sapiens
gguggaauauuuaaugcuu

SEQ ID NO: 1193106 - RNA, 19 nt, Homo sapiens
gauaauugccuauguacau

SEQ ID NO: 1193107 - RNA, 19 nt, Homo sapiens
caaugacccuuuucaauuu

SEQ ID NO: 1193108 - RNA, 19 nt, Homo sapiens
gcaaugacccuuuucaauu

SEQ ID NO: 1193109 - RNA, 19 nt, Homo sapiens
ggauacagccuuuucuuua

SEQ ID NO: 1193110 - RNA, 19 nt, Homo sapiens
cauacugaaugagaaguua

SEQ ID NO: 1193111 - RNA, 19 nt, Homo sapiens
gauugaagcuuuguuaggu

SEQ ID NO: 1193112 - RNA, 19 nt, Homo sapiens
cagaauacauaugcuguga

SEQ ID NO: 1193113 - RNA, 19 nt, Homo sapiens
ggauggcuguauucuaaga

SEQ ID NO: 1193114 - RNA, 19 nt, Homo sapiens
ggccaucauuuccaucauu

SEQ ID NO: 1193115 - RNA, 19 nt, Homo sapiens
guaggcuaaucaacaauga

SEQ ID NO: 1193116 - RNA, 19 nt, Homo sapiens
uaucaucugugucugcuau

SEQ ID NO: 1193117 - RNA, 19 nt, Homo sapiens
ggaauuuggaagauuugua

SEQ ID NO: 1193118 - RNA, 19 nt, Homo sapiens
uaacacaucguugguuuga

SEQ ID NO: 1193119 - RNA, 19 nt, Homo sapiens
cuuaacacaucguugguuu

SEQ ID NO: 1193120 - RNA, 19 nt, Homo sapiens
agacaaagggaagaaauaa

SEQ ID NO: 1193121 - RNA, 19 nt, Homo sapiens
gaucagagagcagagagaa

SEQ ID NO: 1193122 - RNA, 19 nt, Homo sapiens
uuugauagaccgaguauuu

SEQ ID NO: 1193123 - RNA, 19 nt, Homo sapiens
uaaacgagauaugcaagug

SEQ ID NO: 1193124 - RNA, 19 nt, Homo sapiens
uaacguguauucuuucacu

SEQ ID NO: 1193125 - RNA, 19 nt, Homo sapiens
agaauuggaaguacaguaa

SEQ ID NO: 1193126 - RNA, 19 nt, Homo sapiens
gaacauccaggugaacuuc

SEQ ID NO: 1193127 - RNA, 19 nt, Homo sapiens
gaaaauugcuguggaacau

SEQ ID NO: 1193128 - RNA, 19 nt, Homo sapiens
gagcugguuuaaaggcaaa

SEQ ID NO: 1193129 - RNA, 19 nt, Homo sapiens
cgagauaugcaagugaaua

SEQ ID NO: 1193130 - RNA, 19 nt, Homo sapiens
ucacuuagggauguaauuu

SEQ ID NO: 1193131 - RNA, 19 nt, Homo sapiens
aaauagaagggcugcguua

SEQ ID NO: 1193132 - RNA, 19 nt, Homo sapiens
gagaaugggcuuaacacau

SEQ ID NO: 1193133 - RNA, 19 nt, Homo sapiens
gacaaagggaagaaauaaa

SEQ ID NO: 1193134 - RNA, 19 nt, Homo sapiens
gaaugugucaugagaaugg

SEQ ID NO: 1193135 - RNA, 19 nt, Homo sapiens
ccuaaauuauucugcaaga

SEQ ID NO: 1193136 - RNA, 19 nt, Homo sapiens
gccaucauuuccaucauug

SEQ ID NO: 1193137 - RNA, 19 nt, Homo sapiens
gaacaucagcugggaacug

SEQ ID NO: 1193138 - RNA, 19 nt, Homo sapiens
guguuuggacuucaacuua

SEQ ID NO: 1193139 - RNA, 19 nt, Homo sapiens
guauaaacuuucuguacag

SEQ ID NO: 1193140 - RNA, 19 nt, Homo sapiens
gaagggcugcguuacacaa

SEQ ID NO: 1193141 - RNA, 19 nt, Homo sapiens
gauacagccuuuucuuuau

SEQ ID NO: 1193142 - RNA, 19 nt, Homo sapiens
ucaucugugucugcuauua

SEQ ID NO: 1193143 - RNA, 19 nt, Homo sapiens
gagcagagagaauccuuca

SEQ ID NO: 1193144 - RNA, 19 nt, Homo sapiens
gaauuggaaguacaguaaa

SEQ ID NO: 1193145 - RNA, 19 nt, Homo sapiens
uaugaagucucuuucugau

SEQ ID NO: 1193146 - RNA, 19 nt, Homo sapiens
caauggaggaggaggauga

SEQ ID NO: 1193147 - RNA, 19 nt, Homo sapiens
acaaugaaaggguuagaaa

SEQ ID NO: 1193148 - RNA, 19 nt, Homo sapiens
uggagcuucuguugagaua

SEQ ID NO: 1193149 - RNA, 19 nt, Homo sapiens
uguauuguguguugcuaaa

SEQ ID NO: 1193150 - RNA, 19 nt, Homo sapiens
ggaggaggaggaugaggaa

SEQ ID NO: 1193151 - RNA, 19 nt, Homo sapiens
agagagaauccuucauaaa

SEQ ID NO: 1193152 - RNA, 19 nt, Homo sapiens
uuucugaucacgaacaaua

SEQ ID NO: 1193153 - RNA, 19 nt, Homo sapiens
ugaaaggguuagaaaauug

SEQ ID NO: 1193154 - RNA, 19 nt, Homo sapiens
caagacaaagggaagaaau

SEQ ID NO: 1193155 - RNA, 19 nt, Homo sapiens
gcaagacaaagggaagaaa

SEQ ID NO: 1193156 - RNA, 19 nt, Homo sapiens
ucuguggucuuacucuauu

SEQ ID NO: 1193157 - RNA, 19 nt, Homo sapiens
uaucuguggucuuacucua

SEQ ID NO: 1193158 - RNA, 19 nt, Homo sapiens
gggacucuccuacucauug

SEQ ID NO: 1193159 - RNA, 19 nt, Homo sapiens
aacaucaucuggguucuuu

SEQ ID NO: 1193160 - RNA, 19 nt, Homo sapiens
gcccuucagacucaaguua

SEQ ID NO: 1193161 - RNA, 19 nt, Homo sapiens
gcccuggguggaauauuua

SEQ ID NO: 1193162 - RNA, 19 nt, Homo sapiens
ugcccuggguggaauauuu

SEQ ID NO: 1193163 - RNA, 19 nt, Homo sapiens
gaaauucaugcugcuguau

SEQ ID NO: 1193164 - RNA, 19 nt, Homo sapiens
aagacaaagggaagaaaua

SEQ ID NO: 1193165 - RNA, 19 nt, Homo sapiens
cccuguggcuuauauuuau

SEQ ID NO: 1193166 - RNA, 19 nt, Homo sapiens
gcugauggaauuuggaaga

SEQ ID NO: 1193167 - RNA, 19 nt, Homo sapiens
uuacugaggacccuaauca

SEQ ID NO: 1193168 - RNA, 19 nt, Homo sapiens
uauuguguguugcuaaaga

SEQ ID NO: 1193169 - RNA, 19 nt, Homo sapiens
gcaguagcagccacucuug

SEQ ID NO: 1193170 - RNA, 19 nt, Homo sapiens
gcagcaagugcaauuaaca

SEQ ID NO: 1193171 - RNA, 19 nt, Homo sapiens
ccaauguaguuuuguguuu

SEQ ID NO: 1193172 - RNA, 19 nt, Homo sapiens
uagcugcuuuguuugcauu

SEQ ID NO: 1193173 - RNA, 19 nt, Homo sapiens
gaacuucaggaaagacagu

SEQ ID NO: 1193174 - RNA, 19 nt, Homo sapiens
guguguugcuaaagaauuc

SEQ ID NO: 1193175 - RNA, 19 nt, Homo sapiens
gauguggaacccuuggauu

SEQ ID NO: 1193176 - RNA, 19 nt, Homo sapiens
gcaguugcccagaauacau

SEQ ID NO: 1193177 - RNA, 19 nt, Homo sapiens
uagggaauaugugaagaug

SEQ ID NO: 1193178 - RNA, 19 nt, Homo sapiens
guacgugacucucguguuc

SEQ ID NO: 1193179 - RNA, 19 nt, Homo sapiens
auaaagaccuggcuucuca

SEQ ID NO: 1193180 - RNA, 19 nt, Homo sapiens
ggucauuguuugucauuga

SEQ ID NO: 1193181 - RNA, 19 nt, Homo sapiens
ggagggagaccgcaucuga

SEQ ID NO: 1193182 - RNA, 19 nt, Homo sapiens
cuucagcccuuaccuguuu

SEQ ID NO: 1193183 - RNA, 19 nt, Homo sapiens
ccaaacccuucuguuauuu

SEQ ID NO: 1193184 - RNA, 19 nt, Homo sapiens
gaccuggcuucucaucuuu

SEQ ID NO: 1193185 - RNA, 19 nt, Homo sapiens
cccaaacccuucuguuauu

SEQ ID NO: 1193186 - RNA, 19 nt, Homo sapiens
ucaccugcguugugcauaa

SEQ ID NO: 1193187 - RNA, 19 nt, Homo sapiens
gcccuugguuuccagaauu

SEQ ID NO: 1193188 - RNA, 19 nt, Homo sapiens
caaacccuucuguuauuua

SEQ ID NO: 1193189 - RNA, 19 nt, Homo sapiens
gggcaugauuccagucaau

SEQ ID NO: 1193190 - RNA, 19 nt, Homo sapiens
gcuagaaggacauuuagga

SEQ ID NO: 1193191 - RNA, 19 nt, Homo sapiens
gcgagugagugucgugguu

SEQ ID NO: 1193192 - RNA, 19 nt, Homo sapiens
agaccuggcuucucaucuu

SEQ ID NO: 1193193 - RNA, 19 nt, Homo sapiens
gggacaacuucagcccuua

SEQ ID NO: 1193194 - RNA, 19 nt, Homo sapiens
gcacuugccccuacuauug

SEQ ID NO: 1193195 - RNA, 19 nt, Homo sapiens
gaaggacauuuaggagaca

SEQ ID NO: 1193196 - RNA, 19 nt, Homo sapiens
ccacgugagugccaaaguc

SEQ ID NO: 1193197 - RNA, 19 nt, Homo sapiens
caauaggagcccuugguuu

SEQ ID NO: 1193198 - RNA, 19 nt, Homo sapiens
aauaggagcccuugguuuc

SEQ ID NO: 1193199 - RNA, 19 nt, Homo sapiens
ggauucuucugcuaugaca

SEQ ID NO: 1193200 - RNA, 19 nt, Homo sapiens
ggagaccgcaucugaagag

SEQ ID NO: 1193201 - RNA, 19 nt, Homo sapiens
gugcccaggucaucccaaa

SEQ ID NO: 1193202 - RNA, 19 nt, Homo sapiens
gcacacccagggauucuuc

SEQ ID NO: 1193203 - RNA, 19 nt, Homo sapiens
ccuggcuucucaucuuuaa

SEQ ID NO: 1193204 - RNA, 19 nt, Homo sapiens
cagccagacccagacauua

SEQ ID NO: 1193205 - RNA, 19 nt, Homo sapiens
ggagagcaccaucgugucu

SEQ ID NO: 1193206 - RNA, 19 nt, Homo sapiens
aauggaaggugcgcacuug

SEQ ID NO: 1193207 - RNA, 19 nt, Homo sapiens
uagaagauggcuagaagga

SEQ ID NO: 1193208 - RNA, 19 nt, Homo sapiens
gagggagaccgcaucugaa

SEQ ID NO: 1193209 - RNA, 19 nt, Homo sapiens
cacccacucucuccuaauc

SEQ ID NO: 1193210 - RNA, 19 nt, Homo sapiens
gagcggcugugagucuuca

SEQ ID NO: 1193211 - RNA, 19 nt, Homo sapiens
gggcaacuccagccagugu

SEQ ID NO: 1193212 - RNA, 19 nt, Homo sapiens
ucccaaacccuucuguuau

SEQ ID NO: 1193213 - RNA, 19 nt, Homo sapiens
gggccucaguuuccacauc

SEQ ID NO: 1193214 - RNA, 19 nt, Homo sapiens
cagggauucuucugcuaug

SEQ ID NO: 1193215 - RNA, 19 nt, Homo sapiens
gaggucauuguuugucauu

SEQ ID NO: 1193216 - RNA, 19 nt, Homo sapiens
caaaggagaggagggagau

SEQ ID NO: 1193217 - RNA, 19 nt, Homo sapiens
cgacugaacagccaauagg

SEQ ID NO: 1193218 - RNA, 19 nt, Homo sapiens
auuagaagauggcuagaag

SEQ ID NO: 1193219 - RNA, 19 nt, Homo sapiens
gcaaucccacgccacacuu

SEQ ID NO: 1193220 - RNA, 19 nt, Homo sapiens
ggccucaguuuccacaucu

SEQ ID NO: 1193221 - RNA, 19 nt, Homo sapiens
gcaacuccagccaguguuc

SEQ ID NO: 1193222 - RNA, 19 nt, Homo sapiens
ccgaugggcacaaauggaa

SEQ ID NO: 1193223 - RNA, 19 nt, Homo sapiens
ccagccagacccagacauu

SEQ ID NO: 1193224 - RNA, 19 nt, Homo sapiens
ccagggauucuucugcuau

SEQ ID NO: 1193225 - RNA, 19 nt, Homo sapiens
uuccacaucugcacaaugg

SEQ ID NO: 1193226 - RNA, 19 nt, Homo sapiens
ugucuaagcaugugcaaag

SEQ ID NO: 1193227 - RNA, 19 nt, Homo sapiens
ccgagugccuccugcucuu

SEQ ID NO: 1193228 - RNA, 19 nt, Homo sapiens
aucccaaacccuucuguua

SEQ ID NO: 1193229 - RNA, 19 nt, Homo sapiens
cccuugguuuccagaauuu

SEQ ID NO: 1193230 - RNA, 19 nt, Homo sapiens
uuuaagggccaaagcuuga

SEQ ID NO: 1193231 - RNA, 19 nt, Homo sapiens
gacccagacauuagaagau

SEQ ID NO: 1193232 - RNA, 19 nt, Homo sapiens
gccagacccagacauuaga

SEQ ID NO: 1193233 - RNA, 19 nt, Homo sapiens
gcaaaggcaguggguagag

SEQ ID NO: 1193234 - RNA, 19 nt, Homo sapiens
acccagacauuagaagaug

SEQ ID NO: 1193235 - RNA, 19 nt, Homo sapiens
uugugauccugcuugcuua

SEQ ID NO: 1193236 - RNA, 19 nt, Homo sapiens
ggacaacuucagcccuuac

SEQ ID NO: 1193237 - RNA, 19 nt, Homo sapiens
uaauaaagaccuggcuucu

SEQ ID NO: 1193238 - RNA, 19 nt, Homo sapiens
ugccucagccucauacaga

SEQ ID NO: 1193239 - RNA, 19 nt, Homo sapiens
gcaugauuccagucaaugg

SEQ ID NO: 1193240 - RNA, 19 nt, Homo sapiens
uagagugggugggcaugau

SEQ ID NO: 1193241 - RNA, 19 nt, Homo sapiens
uuggaauccuccugcaaga

SEQ ID NO: 1193242 - RNA, 19 nt, Homo sapiens
cccagggauucuucugcua

SEQ ID NO: 1193243 - RNA, 19 nt, Homo sapiens
gaaacaaggugcuggauuu

SEQ ID NO: 1193244 - RNA, 19 nt, Homo sapiens
gaugagaacacuccaauua

SEQ ID NO: 1193245 - RNA, 19 nt, Homo sapiens
gaagaaacauguggauuug

SEQ ID NO: 1193246 - RNA, 19 nt, Homo sapiens
gaccauaccuucuguguug

SEQ ID NO: 1193247 - RNA, 19 nt, Homo sapiens
caacagaacaacacaauuu

SEQ ID NO: 1193248 - RNA, 19 nt, Homo sapiens
ggaagaauccaguaucuaa

SEQ ID NO: 1193249 - RNA, 19 nt, Homo sapiens
cagcugcuauuuaaacuua

SEQ ID NO: 1193250 - RNA, 19 nt, Homo sapiens
acaagaagauccauaagaa

SEQ ID NO: 1193251 - RNA, 19 nt, Homo sapiens
guuaaugacuggaagguaa

SEQ ID NO: 1193252 - RNA, 19 nt, Homo sapiens
gcaagaacuuucccaacaa

SEQ ID NO: 1193253 - RNA, 19 nt, Homo sapiens
ccucuuagcugcuuuguug

SEQ ID NO: 1193254 - RNA, 19 nt, Homo sapiens
caaaguggaaucagcauua

SEQ ID NO: 1193255 - RNA, 19 nt, Homo sapiens
caagauugcuucaguuugu

SEQ ID NO: 1193256 - RNA, 19 nt, Homo sapiens
gaacaaauggugcaacaug

SEQ ID NO: 1193257 - RNA, 19 nt, Homo sapiens
gcagaaaggauuuaaugaa

SEQ ID NO: 1193258 - RNA, 19 nt, Homo sapiens
uggaagcgauuaaugauaa

SEQ ID NO: 1193259 - RNA, 19 nt, Homo sapiens
gaagguaaacacccgguua

SEQ ID NO: 1193260 - RNA, 19 nt, Homo sapiens
gaacaacacaauuuacaga

SEQ ID NO: 1193261 - RNA, 19 nt, Homo sapiens
agaauacgcuugauccaaa

SEQ ID NO: 1193262 - RNA, 19 nt, Homo sapiens
gagguuggauuuaugcaaa

SEQ ID NO: 1193263 - RNA, 19 nt, Homo sapiens
ggaagucaauuaccuugga

SEQ ID NO: 1193264 - RNA, 19 nt, Homo sapiens
caacaucaauugugaagag

SEQ ID NO: 1193265 - RNA, 19 nt, Homo sapiens
gaucuuagcaacaucaauu

SEQ ID NO: 1193266 - RNA, 19 nt, Homo sapiens
gcaguauucuacacuuaaa

SEQ ID NO: 1193267 - RNA, 19 nt, Homo sapiens
acauucagcugcuauuuaa

SEQ ID NO: 1193268 - RNA, 19 nt, Homo sapiens
ugacaagcuucaaggauuu

SEQ ID NO: 1193269 - RNA, 19 nt, Homo sapiens
guacaagucacauuucauu

SEQ ID NO: 1193270 - RNA, 19 nt, Homo sapiens
cagcagaguuucaaagaau

SEQ ID NO: 1193271 - RNA, 19 nt, Homo sapiens
ggaguuagagcucauuauu

SEQ ID NO: 1193272 - RNA, 19 nt, Homo sapiens
gaagacauuugaugagaag

SEQ ID NO: 1193273 - RNA, 19 nt, Homo sapiens
gugaagagcuugguccauu

SEQ ID NO: 1193274 - RNA, 19 nt, Homo sapiens
ucaagucucucaaacauca

SEQ ID NO: 1193275 - RNA, 19 nt, Homo sapiens
ugaagaaacauguggauuu

SEQ ID NO: 1193276 - RNA, 19 nt, Homo sapiens
ccacuuuguuggacgaaua

SEQ ID NO: 1193277 - RNA, 19 nt, Homo sapiens
ggcaagaacuuucccaaca

SEQ ID NO: 1193278 - RNA, 19 nt, Homo sapiens
gaaauuacaugagcagaac

SEQ ID NO: 1193279 - RNA, 19 nt, Homo sapiens
gaagauccauaagaaacaa

SEQ ID NO: 1193280 - RNA, 19 nt, Homo sapiens
uaucagagguuggauuuau

SEQ ID NO: 1193281 - RNA, 19 nt, Homo sapiens
gcuaacagccauugaagaa

SEQ ID NO: 1193282 - RNA, 19 nt, Homo sapiens
cagaaaggauuuaaugaag

SEQ ID NO: 1193283 - RNA, 19 nt, Homo sapiens
gcaaaaguaucccuguuaa

SEQ ID NO: 1193284 - RNA, 19 nt, Homo sapiens
cgacauagaaauuacauga

SEQ ID NO: 1193285 - RNA, 19 nt, Homo sapiens
aguuagagcucauuauuug

SEQ ID NO: 1193286 - RNA, 19 nt, Homo sapiens
caacaggcagaguuuauuu

SEQ ID NO: 1193287 - RNA, 19 nt, Homo sapiens
gaagaaggccuugacuaug

SEQ ID NO: 1193288 - RNA, 19 nt, Homo sapiens
gaagaauccaguaucuaaa

SEQ ID NO: 1193289 - RNA, 19 nt, Homo sapiens
gaacauuuauccuauuucc

SEQ ID NO: 1193290 - RNA, 19 nt, Homo sapiens
ucacaacgacauagaaauu

SEQ ID NO: 1193291 - RNA, 19 nt, Homo sapiens
ggaagcgauuaaugauaaa

SEQ ID NO: 1193292 - RNA, 19 nt, Homo sapiens
gagcagaacacauuuacau

SEQ ID NO: 1193293 - RNA, 19 nt, Homo sapiens
acccaggacucuauuuaua

SEQ ID NO: 1193294 - RNA, 19 nt, Homo sapiens
cuggaaagcuguggaguuu

SEQ ID NO: 1193295 - RNA, 19 nt, Homo sapiens
gagaagaaggccuugacua

SEQ ID NO: 1193296 - RNA, 19 nt, Homo sapiens
cggaacauuuauccuauuu

SEQ ID NO: 1193297 - RNA, 19 nt, Homo sapiens
gcaggucauugccgcauug

SEQ ID NO: 1193298 - RNA, 19 nt, Homo sapiens
ugagaacacuccaauuagu

SEQ ID NO: 1193299 - RNA, 19 nt, Homo sapiens
gagaaccgccucuggaaga

SEQ ID NO: 1193300 - RNA, 19 nt, Homo sapiens
uaacagccauugaagaaac

SEQ ID NO: 1193301 - RNA, 19 nt, Homo sapiens
ucaauuaccuuggaugaca

SEQ ID NO: 1193302 - RNA, 19 nt, Homo sapiens
gaugggagauccguaauac

SEQ ID NO: 1193303 - RNA, 19 nt, Homo sapiens
caaagacacugguuaucag

SEQ ID NO: 1193304 - RNA, 19 nt, Homo sapiens
ggaaagauagauguuaaug

SEQ ID NO: 1193305 - RNA, 19 nt, Homo sapiens
ccagaaggcuaugaacaga

SEQ ID NO: 1193306 - RNA, 19 nt, Homo sapiens
ugacaaugauacaguuaga

SEQ ID NO: 1193307 - RNA, 19 nt, Homo sapiens
ucacagauuucaagucucu

SEQ ID NO: 1193308 - RNA, 19 nt, Homo sapiens
gaguuagagcucauuauuu

SEQ ID NO: 1193309 - RNA, 19 nt, Homo sapiens
gaaguaauuccacaacauc

SEQ ID NO: 1193310 - RNA, 19 nt, Homo sapiens
uaacaagaacuacgcaaug

SEQ ID NO: 1193311 - RNA, 19 nt, Homo sapiens
caagaagauccauaagaaa

SEQ ID NO: 1193312 - RNA, 19 nt, Homo sapiens
gguuguaucucuugucaca

SEQ ID NO: 1193313 - RNA, 19 nt, Homo sapiens
uaaaucggcagaaccaauu

SEQ ID NO: 1193314 - RNA, 19 nt, Homo sapiens
ccaauuaguggaacaaaug

SEQ ID NO: 1193315 - RNA, 19 nt, Homo sapiens
ugaagacauuugaugagaa

SEQ ID NO: 1193316 - RNA, 19 nt, Homo sapiens
gggaaugguuguaucucuu

SEQ ID NO: 1193317 - RNA, 19 nt, Homo sapiens
gauaaaauuucguggagaa

SEQ ID NO: 1193318 - RNA, 19 nt, Homo sapiens
gcagaacacauuuacauac

SEQ ID NO: 1193319 - RNA, 19 nt, Homo sapiens
cauuaugaccuguauauug

SEQ ID NO: 1193320 - RNA, 19 nt, Homo sapiens
gcaugaacuuaaaccaaau

SEQ ID NO: 1193321 - RNA, 19 nt, Homo sapiens
gggaauggcuguguuucau

SEQ ID NO: 1193322 - RNA, 19 nt, Homo sapiens
caguuaauccggaacauuu

SEQ ID NO: 1193323 - RNA, 19 nt, Homo sapiens
aagaaggccuugacuaugg

SEQ ID NO: 1193324 - RNA, 19 nt, Homo sapiens
agaagaaggccuugacuau

SEQ ID NO: 1193325 - RNA, 19 nt, Homo sapiens
aggcagaguuuauuucguu

SEQ ID NO: 1193326 - RNA, 19 nt, Homo sapiens
gaagagcgacgagcaagau

SEQ ID NO: 1193327 - RNA, 19 nt, Homo sapiens
ugaaguaauuccacaacau

SEQ ID NO: 1193328 - RNA, 19 nt, Homo sapiens
gaauaugucaggcucuaug

SEQ ID NO: 1193329 - RNA, 19 nt, Homo sapiens
gaagucaauuaccuuggau

SEQ ID NO: 1193330 - RNA, 19 nt, Homo sapiens
caugaaauguugaauccau

SEQ ID NO: 1193331 - RNA, 19 nt, Homo sapiens
cagauacugugaagaauac

SEQ ID NO: 1193332 - RNA, 19 nt, Homo sapiens
gaccauaacaacagaacaa

SEQ ID NO: 1193333 - RNA, 19 nt, Homo sapiens
caacaaggccagguguauu

SEQ ID NO: 1193334 - RNA, 19 nt, Homo sapiens
gcaauugcuugggaaguca

SEQ ID NO: 1193335 - RNA, 19 nt, Homo sapiens
acuauggccucuuccagua

SEQ ID NO: 1193336 - RNA, 19 nt, Homo sapiens
gcaacaggcagaguuuauu

SEQ ID NO: 1193337 - RNA, 19 nt, Homo sapiens
ugaagagcuugguccauug

SEQ ID NO: 1193338 - RNA, 19 nt, Homo sapiens
uuagcaacaucaauuguga

SEQ ID NO: 1193339 - RNA, 19 nt, Homo sapiens
gcaacaaggccagguguau

SEQ ID NO: 1193340 - RNA, 19 nt, Homo sapiens
ugcagucguuuauuugaua

SEQ ID NO: 1193341 - RNA, 19 nt, Homo sapiens
cacauucagcugcuauuua

SEQ ID NO: 1193342 - RNA, 19 nt, Homo sapiens
ccaggacucuauuuauaca

SEQ ID NO: 1193343 - RNA, 19 nt, Homo sapiens
ggacugagcucccucugua

SEQ ID NO: 1193344 - RNA, 19 nt, Homo sapiens
agaaauggcuucaguauau

SEQ ID NO: 1193345 - RNA, 19 nt, Homo sapiens
gaagguuuaugaagaauga

SEQ ID NO: 1193346 - RNA, 19 nt, Homo sapiens
ggaaagugcuagacugaga

SEQ ID NO: 1193347 - RNA, 19 nt, Homo sapiens
gacacaagcuacaguauga

SEQ ID NO: 1193348 - RNA, 19 nt, Homo sapiens
gcccagagaacaaauauua

SEQ ID NO: 1193349 - RNA, 19 nt, Homo sapiens
gaaaggagcgucauacaca

SEQ ID NO: 1193350 - RNA, 19 nt, Homo sapiens
gaaagcauguagugugaug

SEQ ID NO: 1193351 - RNA, 19 nt, Homo sapiens
gagcuugucuccagguuga

SEQ ID NO: 1193352 - RNA, 19 nt, Homo sapiens
guagcuaucuguuuaggaa

SEQ ID NO: 1193353 - RNA, 19 nt, Homo sapiens
gaaauggcuucaguauauu

SEQ ID NO: 1193354 - RNA, 19 nt, Homo sapiens
gaagagcuuuccagaguca

SEQ ID NO: 1193355 - RNA, 19 nt, Homo sapiens
acaaguaacuggagaaauc

SEQ ID NO: 1193356 - RNA, 19 nt, Homo sapiens
gcacugagcauuuguucaa

SEQ ID NO: 1193357 - RNA, 19 nt, Homo sapiens
ccacguaaaucgcacagaa

SEQ ID NO: 1193358 - RNA, 19 nt, Homo sapiens
gaggaacagucgauuaugu

SEQ ID NO: 1193359 - RNA, 19 nt, Homo sapiens
gagcauggucacauucuua

SEQ ID NO: 1193360 - RNA, 19 nt, Homo sapiens
caaaagagcugcugcacaa

SEQ ID NO: 1193361 - RNA, 19 nt, Homo sapiens
ucacugggcugugguguuu

SEQ ID NO: 1193362 - RNA, 19 nt, Homo sapiens
uuugagggcuucaguauuu

SEQ ID NO: 1193363 - RNA, 19 nt, Homo sapiens
ggaacacucccacgaauga

SEQ ID NO: 1193364 - RNA, 19 nt, Homo sapiens
gcucuacuguucuauuuau

SEQ ID NO: 1193365 - RNA, 19 nt, Homo sapiens
gggaagaagucaaauaugc

SEQ ID NO: 1193366 - RNA, 19 nt, Homo sapiens
gagaaauggcuucaguaua

SEQ ID NO: 1193367 - RNA, 19 nt, Homo sapiens
caugaaagaugacgcugaa

SEQ ID NO: 1193368 - RNA, 19 nt, Homo sapiens
ggagaaaucuagacuucag

SEQ ID NO: 1193369 - RNA, 19 nt, Homo sapiens
gcaaaacaauggaaaguau

SEQ ID NO: 1193370 - RNA, 19 nt, Homo sapiens
ccaccucuccugugaaaua

SEQ ID NO: 1193371 - RNA, 19 nt, Homo sapiens
ccagacaccuccugauugu

SEQ ID NO: 1193372 - RNA, 19 nt, Homo sapiens
gaacaccacccucagacaa

SEQ ID NO: 1193373 - RNA, 19 nt, Homo sapiens
caacauuuccuaacauuuc

SEQ ID NO: 1193374 - RNA, 19 nt, Homo sapiens
ucugacagcugcuuacuga

SEQ ID NO: 1193375 - RNA, 19 nt, Homo sapiens
cauaaguaguucugggaua

SEQ ID NO: 1193376 - RNA, 19 nt, Homo sapiens
ucuuguagcuaucuguuua

SEQ ID NO: 1193377 - RNA, 19 nt, Homo sapiens
gaaaggaggaaagaacaaa

SEQ ID NO: 1193378 - RNA, 19 nt, Homo sapiens
ugucauauguggcagcuuu

SEQ ID NO: 1193379 - RNA, 19 nt, Homo sapiens
guagaggaacagucgauua

SEQ ID NO: 1193380 - RNA, 19 nt, Homo sapiens
cuaauggucuggcuggaaa

SEQ ID NO: 1193381 - RNA, 19 nt, Homo sapiens
guaugacacuucagcagaa

SEQ ID NO: 1193382 - RNA, 19 nt, Homo sapiens
aaacuugugugaagaagau

SEQ ID NO: 1193383 - RNA, 19 nt, Homo sapiens
gggagagcauggucacauu

SEQ ID NO: 1193384 - RNA, 19 nt, Homo sapiens
cugaagagcuuuccagagu

SEQ ID NO: 1193385 - RNA, 19 nt, Homo sapiens
auacuaggcucuacuguuc

SEQ ID NO: 1193386 - RNA, 19 nt, Homo sapiens
ggccuuugcuuccugguuu

SEQ ID NO: 1193387 - RNA, 19 nt, Homo sapiens
gguugagaauuaccuguuu

SEQ ID NO: 1193388 - RNA, 19 nt, Homo sapiens
ggcaugagauccuaguuca

SEQ ID NO: 1193389 - RNA, 19 nt, Homo sapiens
ugacaacacccaauccaaa

SEQ ID NO: 1193390 - RNA, 19 nt, Homo sapiens
agacaugcuuugcucauug

SEQ ID NO: 1193391 - RNA, 19 nt, Homo sapiens
ugacugugaugaaguuaga

SEQ ID NO: 1193392 - RNA, 19 nt, Homo sapiens
caagggagacagaccaauu

SEQ ID NO: 1193393 - RNA, 19 nt, Homo sapiens
gcagagaagguccaaguuc

SEQ ID NO: 1193394 - RNA, 19 nt, Homo sapiens
gaucagaaccccuauuuga

SEQ ID NO: 1193395 - RNA, 19 nt, Homo sapiens
gaaaucuagacuucaguuu

SEQ ID NO: 1193396 - RNA, 19 nt, Homo sapiens
ccucaaaguucuucugaca

SEQ ID NO: 1193397 - RNA, 19 nt, Homo sapiens
gacaggaaaccuacacauu

SEQ ID NO: 1193398 - RNA, 19 nt, Homo sapiens
ggagacauggccucuugua

SEQ ID NO: 1193399 - RNA, 19 nt, Homo sapiens
uggaaagcauguaguguga

SEQ ID NO: 1193400 - RNA, 19 nt, Homo sapiens
aaauagaaaugcuggaaag

SEQ ID NO: 1193401 - RNA, 19 nt, Homo sapiens
cacaacauuuccuaacauu

SEQ ID NO: 1193402 - RNA, 19 nt, Homo sapiens
ccacaacauuuccuaacau

SEQ ID NO: 1193403 - RNA, 19 nt, Homo sapiens
gaggucugcuguucucaug

SEQ ID NO: 1193404 - RNA, 19 nt, Homo sapiens
aacacaaggucacuaugua

SEQ ID NO: 1193405 - RNA, 19 nt, Homo sapiens
uagcuuugcucucaucugu

SEQ ID NO: 1193406 - RNA, 19 nt, Homo sapiens
gauacuaggcucuacuguu

SEQ ID NO: 1193407 - RNA, 19 nt, Homo sapiens
caggaaaccuacacauucu

SEQ ID NO: 1193408 - RNA, 19 nt, Homo sapiens
ugugaagguuuaugaagaa

SEQ ID NO: 1193409 - RNA, 19 nt, Homo sapiens
uggcagcuuugacauguaa

SEQ ID NO: 1193410 - RNA, 19 nt, Homo sapiens
gaaagugcuagacugagaa

SEQ ID NO: 1193411 - RNA, 19 nt, Homo sapiens
gaacagucgauuauguaug

SEQ ID NO: 1193412 - RNA, 19 nt, Homo sapiens
gagaaaggaggaaagaaca

SEQ ID NO: 1193413 - RNA, 19 nt, Homo sapiens
gcugugguguuucuuguuc

SEQ ID NO: 1193414 - RNA, 19 nt, Homo sapiens
agaugacgcugaagacaug

SEQ ID NO: 1193415 - RNA, 19 nt, Homo sapiens
uaacauuuccuaggcauga

SEQ ID NO: 1193416 - RNA, 19 nt, Homo sapiens
aggagucugugaagguuua

SEQ ID NO: 1193417 - RNA, 19 nt, Homo sapiens
ggagaaaggaggaaagaac

SEQ ID NO: 1193418 - RNA, 19 nt, Homo sapiens
ccaagucucaaucaaugua

SEQ ID NO: 1193419 - RNA, 19 nt, Homo sapiens
gcuuugacauguaaaccaa

SEQ ID NO: 1193420 - RNA, 19 nt, Homo sapiens
gaagaagucaaauaugcau

SEQ ID NO: 1193421 - RNA, 19 nt, Homo sapiens
aacagucgauuauguaugu

SEQ ID NO: 1193422 - RNA, 19 nt, Homo sapiens
ggaacagucgauuauguau

SEQ ID NO: 1193423 - RNA, 19 nt, Homo sapiens
gcucuuacuuuguuugcau

SEQ ID NO: 1193424 - RNA, 19 nt, Homo sapiens
ugaaagaugacgcugaaga

SEQ ID NO: 1193425 - RNA, 19 nt, Homo sapiens
uaauacugcuuagcuucua

SEQ ID NO: 1193426 - RNA, 19 nt, Homo sapiens
ggcuauugauugacuuuga

SEQ ID NO: 1193427 - RNA, 19 nt, Homo sapiens
ggaagaagucaaauaugca

SEQ ID NO: 1193428 - RNA, 19 nt, Homo sapiens
gcuacaguaugaucuaugg

SEQ ID NO: 1193429 - RNA, 19 nt, Homo sapiens
gacagggcauguggcagua

SEQ ID NO: 1193430 - RNA, 19 nt, Homo sapiens
uauggaggguucaaucaau

SEQ ID NO: 1193431 - RNA, 19 nt, Homo sapiens
ccgaggagaugcggacuga

SEQ ID NO: 1193432 - RNA, 19 nt, Homo sapiens
uacaugagauuuacuacca

SEQ ID NO: 1193433 - RNA, 19 nt, Homo sapiens
acacaaggucacuauguaa

SEQ ID NO: 1193434 - RNA, 19 nt, Homo sapiens
ucacagauguaugacacuu

SEQ ID NO: 1193435 - RNA, 19 nt, Homo sapiens
gacaugcuuugcucauugu

SEQ ID NO: 1193436 - RNA, 19 nt, Homo sapiens
gcuggcaccucauugaucu

SEQ ID NO: 1193437 - RNA, 19 nt, Homo sapiens
aaacacaaggucacuaugu

SEQ ID NO: 1193438 - RNA, 19 nt, Homo sapiens
gagccaagucucaaucaau

SEQ ID NO: 1193439 - RNA, 19 nt, Homo sapiens
acagauguaugacacuuca

SEQ ID NO: 1193440 - RNA, 19 nt, Homo sapiens
gguuuguacucuccucuug

SEQ ID NO: 1193441 - RNA, 19 nt, Homo sapiens
ucacugaauccauguguug

SEQ ID NO: 1193442 - RNA, 19 nt, Homo sapiens
caaucaauguacagguuau

SEQ ID NO: 1193443 - RNA, 19 nt, Homo sapiens
gaucuggagucaaauauua

SEQ ID NO: 1193444 - RNA, 19 nt, Homo sapiens
gaaauucuguuccguguuu

SEQ ID NO: 1193445 - RNA, 19 nt, Homo sapiens
cagagaagcuuuacucauu

SEQ ID NO: 1193446 - RNA, 19 nt, Homo sapiens
gaaccucucuuauuggaaa

SEQ ID NO: 1193447 - RNA, 19 nt, Homo sapiens
ggacaaggaugcugauaug

SEQ ID NO: 1193448 - RNA, 19 nt, Homo sapiens
gaacacagccugauugaag

SEQ ID NO: 1193449 - RNA, 19 nt, Homo sapiens
ggaaggaaguucaagaauc

SEQ ID NO: 1193450 - RNA, 19 nt, Homo sapiens
gagaagcacgauuauaaua

SEQ ID NO: 1193451 - RNA, 19 nt, Homo sapiens
caaggaugcugauaugcua

SEQ ID NO: 1193452 - RNA, 19 nt, Homo sapiens
gagaggagcucaccaucug

SEQ ID NO: 1193453 - RNA, 19 nt, Homo sapiens
uagagaagcacgauuauaa

SEQ ID NO: 1193454 - RNA, 19 nt, Homo sapiens
gaggaagccuuguucuaug

SEQ ID NO: 1193455 - RNA, 19 nt, Homo sapiens
gaaggaaguucaagaaucc

SEQ ID NO: 1193456 - RNA, 19 nt, Homo sapiens
ggaggaagccuuguucuau

SEQ ID NO: 1193457 - RNA, 19 nt, Homo sapiens
gugugaaccucucuuauug

SEQ ID NO: 1193458 - RNA, 19 nt, Homo sapiens
caaacugacugaagauaag

SEQ ID NO: 1193459 - RNA, 19 nt, Homo sapiens
uuaacaaacugacugaaga

SEQ ID NO: 1193460 - RNA, 19 nt, Homo sapiens
uggcagaguugucuucaaa

SEQ ID NO: 1193461 - RNA, 19 nt, Homo sapiens
guaaauaaaggcagacaug

SEQ ID NO: 1193462 - RNA, 19 nt, Homo sapiens
gaccaguacugcuuugaau

SEQ ID NO: 1193463 - RNA, 19 nt, Homo sapiens
uuuaugaucuggagucaaa

SEQ ID NO: 1193464 - RNA, 19 nt, Homo sapiens
gccaaauacuguagugcua

SEQ ID NO: 1193465 - RNA, 19 nt, Homo sapiens
cacacucuaugcuuuguua

SEQ ID NO: 1193466 - RNA, 19 nt, Homo sapiens
aaagugaucugcaacucuu

SEQ ID NO: 1193467 - RNA, 19 nt, Homo sapiens
agagaagcuuuacucauuu

SEQ ID NO: 1193468 - RNA, 19 nt, Homo sapiens
caacaucagagcauccuaa

SEQ ID NO: 1193469 - RNA, 19 nt, Homo sapiens
ggaaugcaaaugccuuaaa

SEQ ID NO: 1193470 - RNA, 19 nt, Homo sapiens
gaagccuuguucuauggua

SEQ ID NO: 1193471 - RNA, 19 nt, Homo sapiens
ggauggagcaccuucagaa

SEQ ID NO: 1193472 - RNA, 19 nt, Homo sapiens
gaaugcaaaugccuuaaaa

SEQ ID NO: 1193473 - RNA, 19 nt, Homo sapiens
gagacuggcuuuugauauu

SEQ ID NO: 1193474 - RNA, 19 nt, Homo sapiens
guagagaagcacgauuaua

SEQ ID NO: 1193475 - RNA, 19 nt, Homo sapiens
gagaacacagccugauuga

SEQ ID NO: 1193476 - RNA, 19 nt, Homo sapiens
cagaaucagagaagcuuua

SEQ ID NO: 1193477 - RNA, 19 nt, Homo sapiens
gugaaccucucuuauugga

SEQ ID NO: 1193478 - RNA, 19 nt, Homo sapiens
gaacgcagucagagggaaa

SEQ ID NO: 1193479 - RNA, 19 nt, Homo sapiens
gcaaacugcagcuacauca

SEQ ID NO: 1193480 - RNA, 19 nt, Homo sapiens
ccaccugccuuugaccuuu

SEQ ID NO: 1193481 - RNA, 19 nt, Homo sapiens
ugacugaagauaagaaaga

SEQ ID NO: 1193482 - RNA, 19 nt, Homo sapiens
uggagcaccuucagaauca

SEQ ID NO: 1193483 - RNA, 19 nt, Homo sapiens
cugaacggcuucccgauau

SEQ ID NO: 1193484 - RNA, 19 nt, Homo sapiens
caagaaucauuaguuguag

SEQ ID NO: 1193485 - RNA, 19 nt, Homo sapiens
gucacacacucuaugcuuu

SEQ ID NO: 1193486 - RNA, 19 nt, Homo sapiens
gaucauaagcagcaauucu

SEQ ID NO: 1193487 - RNA, 19 nt, Homo sapiens
caaauacuguagugcuaag

SEQ ID NO: 1193488 - RNA, 19 nt, Homo sapiens
gcuaacuggugaugagcaa

SEQ ID NO: 1193489 - RNA, 19 nt, Homo sapiens
ggaccaguacugcuuugaa

SEQ ID NO: 1193490 - RNA, 19 nt, Homo sapiens
acaaacugacugaagauaa

SEQ ID NO: 1193491 - RNA, 19 nt, Homo sapiens
gagaagcuuuacucauuuu

SEQ ID NO: 1193492 - RNA, 19 nt, Homo sapiens
aauaaaggcagacaugguu

SEQ ID NO: 1193493 - RNA, 19 nt, Homo sapiens
gaacggcuucccgauauca

SEQ ID NO: 1193494 - RNA, 19 nt, Homo sapiens
gcaaguauggaaggaaguu

SEQ ID NO: 1193495 - RNA, 19 nt, Homo sapiens
caacauuucaugagagaag

SEQ ID NO: 1193496 - RNA, 19 nt, Homo sapiens
ccaaauacuguagugcuaa

SEQ ID NO: 1193497 - RNA, 19 nt, Homo sapiens
gcugugugaaccucucuua

SEQ ID NO: 1193498 - RNA, 19 nt, Homo sapiens
gugaugagcaaguauggaa

SEQ ID NO: 1193499 - RNA, 19 nt, Homo sapiens
gcaacucuuucaccaucug

SEQ ID NO: 1193500 - RNA, 19 nt, Homo sapiens
gagagaagaaauacaggau

SEQ ID NO: 1193501 - RNA, 19 nt, Homo sapiens
aggcagacaugguuugcaa

SEQ ID NO: 1193502 - RNA, 19 nt, Homo sapiens
gcaucaaccucggccuguu

SEQ ID NO: 1193503 - RNA, 19 nt, Homo sapiens
ugugugaaccucucuuauu

SEQ ID NO: 1193504 - RNA, 19 nt, Homo sapiens
cagccugauugaagauuug

SEQ ID NO: 1193505 - RNA, 19 nt, Homo sapiens
ggucacacacucuaugcuu

SEQ ID NO: 1193506 - RNA, 19 nt, Homo sapiens
ccaguacugcuuugaaugu

SEQ ID NO: 1193507 - RNA, 19 nt, Homo sapiens
caguaucucuuugcucaau

SEQ ID NO: 1193508 - RNA, 19 nt, Homo sapiens
ccacaagcgggaaugcaaa

SEQ ID NO: 1193509 - RNA, 19 nt, Homo sapiens
uuuguugaaugccuuauug

SEQ ID NO: 1193510 - RNA, 19 nt, Homo sapiens
gcgaucauaagcagcaauu

SEQ ID NO: 1193511 - RNA, 19 nt, Homo sapiens
ggagaggagcucaccaucu

SEQ ID NO: 1193512 - RNA, 19 nt, Homo sapiens
guaucucuuugcucaauca

SEQ ID NO: 1193513 - RNA, 19 nt, Homo sapiens
uaacaaacugacugaagau

SEQ ID NO: 1193514 - RNA, 19 nt, Homo sapiens
uaugaucuggagucaaaua

SEQ ID NO: 1193515 - RNA, 19 nt, Homo sapiens
agagaacacagccugauug

SEQ ID NO: 1193516 - RNA, 19 nt, Homo sapiens
cagagaacacagccugauu

SEQ ID NO: 1193517 - RNA, 19 nt, Homo sapiens
cccaagcaaugaagaaucu

SEQ ID NO: 1193518 - RNA, 19 nt, Homo sapiens
uaaaggcagacaugguuug

SEQ ID NO: 1193519 - RNA, 19 nt, Homo sapiens
guguuuguguagguaaaua

SEQ ID NO: 1193520 - RNA, 19 nt, Homo sapiens
ucacacacucuaugcuuug

SEQ ID NO: 1193521 - RNA, 19 nt, Homo sapiens
caagcaaugaagaaucuga

SEQ ID NO: 1193522 - RNA, 19 nt, Homo sapiens
cuacuguucuccguguauu

SEQ ID NO: 1193523 - RNA, 19 nt, Homo sapiens
uuguagagaagcacgauua

SEQ ID NO: 1193524 - RNA, 19 nt, Homo sapiens
gcgugugucuuuguugaau

SEQ ID NO: 1193525 - RNA, 19 nt, Homo sapiens
gaaugcgacgccaacauca

SEQ ID NO: 1193526 - RNA, 19 nt, Homo sapiens
acagccugauugaagauuu

SEQ ID NO: 1193527 - RNA, 19 nt, Homo sapiens
ucuguuccguguuugugua

SEQ ID NO: 1193528 - RNA, 19 nt, Homo sapiens
gcagagaacacagccugau

SEQ ID NO: 1193529 - RNA, 19 nt, Homo sapiens
gagggaccaguacugcuuu

SEQ ID NO: 1193530 - RNA, 19 nt, Homo sapiens
gauggagcaccuucagaau

SEQ ID NO: 1193531 - RNA, 19 nt, Homo sapiens
agacuggcuuuugauauua

SEQ ID NO: 1193532 - RNA, 19 nt, Homo sapiens
caacaucuaccagcugaag

SEQ ID NO: 1193533 - RNA, 19 nt, Homo sapiens
ucugaacggcuucccgaua

SEQ ID NO: 1193534 - RNA, 19 nt, Homo sapiens
gccaaacccaggacaagga

SEQ ID NO: 1193535 - RNA, 19 nt, Homo sapiens
caacuguucgauuguguuc

SEQ ID NO: 1193536 - RNA, 19 nt, Homo sapiens
agagaagcacgauuauaau

SEQ ID NO: 1193537 - RNA, 19 nt, Homo sapiens
aacacagccugauugaaga

SEQ ID NO: 1193538 - RNA, 19 nt, Homo sapiens
aggaagccaucccgucaga

SEQ ID NO: 1193539 - RNA, 19 nt, Homo sapiens
uaugcuaacuggugaugag

SEQ ID NO: 1193540 - RNA, 19 nt, Homo sapiens
gcaguaauuaaacucuuuc

SEQ ID NO: 1193541 - RNA, 19 nt, Homo sapiens
gcuuugaaugugacuguuu

SEQ ID NO: 1193542 - RNA, 19 nt, Homo sapiens
ucaggcaacucguaaugac

SEQ ID NO: 1193543 - RNA, 19 nt, Homo sapiens
ccagucagauccuguguuu

SEQ ID NO: 1193544 - RNA, 19 nt, Homo sapiens
gauuauggcuccuguauac

SEQ ID NO: 1193545 - RNA, 19 nt, Homo sapiens
ccaccuggcucgugaaaga

SEQ ID NO: 1193546 - RNA, 19 nt, Homo sapiens
ggagcaaacuggacugcaa

SEQ ID NO: 1193547 - RNA, 19 nt, Homo sapiens
ucacugcccuccacaucua

SEQ ID NO: 1193548 - RNA, 19 nt, Homo sapiens
gggcagguccuaagaaaga

SEQ ID NO: 1193549 - RNA, 19 nt, Homo sapiens
gcaguuggucuuaggcaua

SEQ ID NO: 1193550 - RNA, 19 nt, Homo sapiens
ggaagugacugccaaucag

SEQ ID NO: 1193551 - RNA, 19 nt, Homo sapiens
gcgggcagguccuaagaaa

SEQ ID NO: 1193552 - RNA, 19 nt, Homo sapiens
ccaggccgguucaaauaaa

SEQ ID NO: 1193553 - RNA, 19 nt, Homo sapiens
ggacauccucaaugacgua

SEQ ID NO: 1193554 - RNA, 19 nt, Homo sapiens
caaaggccaugccaaggau

SEQ ID NO: 1193555 - RNA, 19 nt, Homo sapiens
ucaaugacguagccauguu

SEQ ID NO: 1193556 - RNA, 19 nt, Homo sapiens
ccaagugcaucgugagugu

SEQ ID NO: 1193557 - RNA, 19 nt, Homo sapiens
gagauuauggcuccuguau

SEQ ID NO: 1193558 - RNA, 19 nt, Homo sapiens
gacaugcuguucccaaagu

SEQ ID NO: 1193559 - RNA, 19 nt, Homo sapiens
gaagugacugccaaucaga

SEQ ID NO: 1193560 - RNA, 19 nt, Homo sapiens
gaugguagcgcuugugaca

SEQ ID NO: 1193561 - RNA, 19 nt, Homo sapiens
ccaaucuguuucaccauga

SEQ ID NO: 1193562 - RNA, 19 nt, Homo sapiens
ccauguuccuugagauuau

SEQ ID NO: 1193563 - RNA, 19 nt, Homo sapiens
uugcggacauccucaauga

SEQ ID NO: 1193564 - RNA, 19 nt, Homo sapiens
ccagcaaccuagccaagug

SEQ ID NO: 1193565 - RNA, 19 nt, Homo sapiens
guagccauguuccuugaga

SEQ ID NO: 1193566 - RNA, 19 nt, Homo sapiens
ccaaaggccaugccaagga

SEQ ID NO: 1193567 - RNA, 19 nt, Homo sapiens
ccugugaggcuguggcuua

SEQ ID NO: 1193568 - RNA, 19 nt, Homo sapiens
ccccugagcuuguguuuaa

SEQ ID NO: 1193569 - RNA, 19 nt, Homo sapiens
gggaagugacugccaauca

SEQ ID NO: 1193570 - RNA, 19 nt, Homo sapiens
cgacccaacugcagccaau

SEQ ID NO: 1193571 - RNA, 19 nt, Homo sapiens
caaggagacacacgaagug

SEQ ID NO: 1193572 - RNA, 19 nt, Homo sapiens
gccauguuccuugagauua

SEQ ID NO: 1193573 - RNA, 19 nt, Homo sapiens
gcaacaaaaccaaaccuuu

SEQ ID NO: 1193574 - RNA, 19 nt, Homo sapiens
gcuucagccuuggauguuu

SEQ ID NO: 1193575 - RNA, 19 nt, Homo sapiens
aaauugaggcccugcaguu

SEQ ID NO: 1193576 - RNA, 19 nt, Homo sapiens
gugaggcuguggcuuaugg

SEQ ID NO: 1193577 - RNA, 19 nt, Homo sapiens
ccuuggauguuucuucuuc

SEQ ID NO: 1193578 - RNA, 19 nt, Homo sapiens
gaugcucccucugguguca

SEQ ID NO: 1193579 - RNA, 19 nt, Homo sapiens
gagcaaacuggacugcaau

SEQ ID NO: 1193580 - RNA, 19 nt, Homo sapiens
ucccaaaguucuugaaagg

SEQ ID NO: 1193581 - RNA, 19 nt, Homo sapiens
ccacaucuacgccaacuac

SEQ ID NO: 1193582 - RNA, 19 nt, Homo sapiens
gcuggaagaccgagaagca

SEQ ID NO: 1193583 - RNA, 19 nt, Homo sapiens
ccaccucuguccagucuac

SEQ ID NO: 1193584 - RNA, 19 nt, Homo sapiens
ggacaugcuguucccaaag

SEQ ID NO: 1193585 - RNA, 19 nt, Homo sapiens
uggacaugcuguucccaaa

SEQ ID NO: 1193586 - RNA, 19 nt, Homo sapiens
uggcuucugucucccgaaa

SEQ ID NO: 1193587 - RNA, 19 nt, Homo sapiens
ucaaggagacacacgaagu

SEQ ID NO: 1193588 - RNA, 19 nt, Homo sapiens
ugacguagccauguuccuu

SEQ ID NO: 1193589 - RNA, 19 nt, Homo sapiens
gggaggcuuuaaucaccaa

SEQ ID NO: 1193590 - RNA, 19 nt, Homo sapiens
gggcacccauucuguacag

SEQ ID NO: 1193591 - RNA, 19 nt, Homo sapiens
ccucugcucauuccacaaa

SEQ ID NO: 1193592 - RNA, 19 nt, Homo sapiens
ccgagaagcaccagcuaga

SEQ ID NO: 1193593 - RNA, 19 nt, Homo sapiens
cuguauacccaaucuguuu

SEQ ID NO: 1193594 - RNA, 19 nt, Homo sapiens
cgucagcccggacuacuug

SEQ ID NO: 1193595 - RNA, 19 nt, Homo sapiens
ccuaccagcugugggauuc

SEQ ID NO: 1193596 - RNA, 19 nt, Homo sapiens
guauugugcccaccaguca

SEQ ID NO: 1193597 - RNA, 19 nt, Homo sapiens
ccugugcccucgggauaaa

SEQ ID NO: 1193598 - RNA, 19 nt, Homo sapiens
gcuccuguauacccaaucu

SEQ ID NO: 1193599 - RNA, 19 nt, Homo sapiens
caccaacccaucaacauca

SEQ ID NO: 1193600 - RNA, 19 nt, Homo sapiens
aauugaggcccugcaguua

SEQ ID NO: 1193601 - RNA, 19 nt, Homo sapiens
cauagaagccccagaggaa

SEQ ID NO: 1193602 - RNA, 19 nt, Homo sapiens
gcugggucgucgucaagga

SEQ ID NO: 1193603 - RNA, 19 nt, Homo sapiens
ucauggagaccuugaacga

SEQ ID NO: 1193604 - RNA, 19 nt, Homo sapiens
ucaccaacccaucaacauc

SEQ ID NO: 1193605 - RNA, 19 nt, Homo sapiens
cagaugguagcgcuuguga

SEQ ID NO: 1193606 - RNA, 19 nt, Homo sapiens
caggccgguucaaauaaau

SEQ ID NO: 1193607 - RNA, 19 nt, Homo sapiens
cagcucaggucugucuaca

SEQ ID NO: 1193608 - RNA, 19 nt, Homo sapiens
gcugccuccuccuggguaa

SEQ ID NO: 1193609 - RNA, 19 nt, Homo sapiens
gagcugggucgucgucaag

SEQ ID NO: 1193610 - RNA, 19 nt, Homo sapiens
ggucuccagugucuuugag

SEQ ID NO: 1193611 - RNA, 19 nt, Homo sapiens
caguuggucuuaggcauag

SEQ ID NO: 1193612 - RNA, 19 nt, Homo sapiens
gaccgagaagcaccagcua

SEQ ID NO: 1193613 - RNA, 19 nt, Homo sapiens
caggaugccggcuggaaga

SEQ ID NO: 1193614 - RNA, 19 nt, Homo sapiens
ggcugguccugaagcacua

SEQ ID NO: 1193615 - RNA, 19 nt, Homo sapiens
ugucuacacccagauggua

SEQ ID NO: 1193616 - RNA, 19 nt, Homo sapiens
cacggccacugccaucaug

SEQ ID NO: 1193617 - RNA, 19 nt, Homo sapiens
ggccagcuccgucucuauc

SEQ ID NO: 1193618 - RNA, 19 nt, Homo sapiens
cauguuccuugagauuaug

SEQ ID NO: 1193619 - RNA, 19 nt, Homo sapiens
gaacgaaaguuauauggaa

SEQ ID NO: 1193620 - RNA, 19 nt, Homo sapiens
gaacugagaccucuacauu

SEQ ID NO: 1193621 - RNA, 19 nt, Homo sapiens
ucuaagaucugaugaagua

SEQ ID NO: 1193622 - RNA, 19 nt, Homo sapiens
gaaauggcauaaagacuga

SEQ ID NO: 1193623 - RNA, 19 nt, Homo sapiens
uggaaacacugaagaguua

SEQ ID NO: 1193624 - RNA, 19 nt, Homo sapiens
gagacguccucaucaaaua

SEQ ID NO: 1193625 - RNA, 19 nt, Homo sapiens
gaaagcauaugucaguugu

SEQ ID NO: 1193626 - RNA, 19 nt, Homo sapiens
cguauguccuggaauauua

SEQ ID NO: 1193627 - RNA, 19 nt, Homo sapiens
gggaugagcuucuuauugg

SEQ ID NO: 1193628 - RNA, 19 nt, Homo sapiens
gcacugcagauauuaauuu

SEQ ID NO: 1193629 - RNA, 19 nt, Homo sapiens
gaaaagugauucagugauu

SEQ ID NO: 1193630 - RNA, 19 nt, Homo sapiens
ccaaggaccagauugcuua

SEQ ID NO: 1193631 - RNA, 19 nt, Homo sapiens
gcauaugucaguuguuuaa

SEQ ID NO: 1193632 - RNA, 19 nt, Homo sapiens
ucaaauagcagacuuguuc

SEQ ID NO: 1193633 - RNA, 19 nt, Homo sapiens
gaagaguuaucgccagugu

SEQ ID NO: 1193634 - RNA, 19 nt, Homo sapiens
gaagcaugguguuucagaa

SEQ ID NO: 1193635 - RNA, 19 nt, Homo sapiens
aauggaagcuacuuugaaa

SEQ ID NO: 1193636 - RNA, 19 nt, Homo sapiens
ucacuuaaaugacaagaca

SEQ ID NO: 1193637 - RNA, 19 nt, Homo sapiens
aagcauaugucaguuguuu

SEQ ID NO: 1193638 - RNA, 19 nt, Homo sapiens
agaaagagaagaagagaaa

SEQ ID NO: 1193639 - RNA, 19 nt, Homo sapiens
gagaagaaaguuaaagcaa

SEQ ID NO: 1193640 - RNA, 19 nt, Homo sapiens
guauaacucuaagaucuga

SEQ ID NO: 1193641 - RNA, 19 nt, Homo sapiens
ucaggaggaugguugugua

SEQ ID NO: 1193642 - RNA, 19 nt, Homo sapiens
ggaagcacugcagauauua

SEQ ID NO: 1193643 - RNA, 19 nt, Homo sapiens
aaccguauguccuggaaua

SEQ ID NO: 1193644 - RNA, 19 nt, Homo sapiens
ggaaagcauaugucaguug

SEQ ID NO: 1193645 - RNA, 19 nt, Homo sapiens
aggaagcacugcagauauu

SEQ ID NO: 1193646 - RNA, 19 nt, Homo sapiens
gaagcacugcagauauuaa

SEQ ID NO: 1193647 - RNA, 19 nt, Homo sapiens
ugacaagacaggauucuga

SEQ ID NO: 1193648 - RNA, 19 nt, Homo sapiens
ggaccagauugcuuacuca

SEQ ID NO: 1193649 - RNA, 19 nt, Homo sapiens
ggaggaugguuguguaguc

SEQ ID NO: 1193650 - RNA, 19 nt, Homo sapiens
ggaaggaaccgcuggaaac

SEQ ID NO: 1193651 - RNA, 19 nt, Homo sapiens
gugauucagugauuucaga

SEQ ID NO: 1193652 - RNA, 19 nt, Homo sapiens
ggaaccguauguccuggaa

SEQ ID NO: 1193653 - RNA, 19 nt, Homo sapiens
uaaaugacaagacaggauu

SEQ ID NO: 1193654 - RNA, 19 nt, Homo sapiens
ggcccaauauuguaauuuc

SEQ ID NO: 1193655 - RNA, 19 nt, Homo sapiens
gcacuucgagccucacaug

SEQ ID NO: 1193656 - RNA, 19 nt, Homo sapiens
uaaauggaagcuacuuuga

SEQ ID NO: 1193657 - RNA, 19 nt, Homo sapiens
gaggaugguuguguaguca

SEQ ID NO: 1193658 - RNA, 19 nt, Homo sapiens
ucaggaagcacugcagaua

SEQ ID NO: 1193659 - RNA, 19 nt, Homo sapiens
gaaggaaccgcuggaaaca

SEQ ID NO: 1193660 - RNA, 19 nt, Homo sapiens
caacuucaggcccaauauu

SEQ ID NO: 1193661 - RNA, 19 nt, Homo sapiens
ggaucuacccugugaaauc

SEQ ID NO: 1193662 - RNA, 19 nt, Homo sapiens
cuucagaacgaaaguuaua

SEQ ID NO: 1193663 - RNA, 19 nt, Homo sapiens
gauuucagauagacuacug

SEQ ID NO: 1193664 - RNA, 19 nt, Homo sapiens
ggaugguuguguagucaug

SEQ ID NO: 1193665 - RNA, 19 nt, Homo sapiens
uaaaggugcucaggaggau

SEQ ID NO: 1193666 - RNA, 19 nt, Homo sapiens
ccguuuaacugauuaugga

SEQ ID NO: 1193667 - RNA, 19 nt, Homo sapiens
aaagggugauggcuuguuc

SEQ ID NO: 1193668 - RNA, 19 nt, Homo sapiens
gacaccagcccauucuuga

SEQ ID NO: 1193669 - RNA, 19 nt, Homo sapiens
caaacgcccaccacaaaug

SEQ ID NO: 1193670 - RNA, 19 nt, Homo sapiens
aaagagaagaagagaaaga

SEQ ID NO: 1193671 - RNA, 19 nt, Homo sapiens
gacaagacaggauucugaa

SEQ ID NO: 1193672 - RNA, 19 nt, Homo sapiens
gaucuacccugugaaaucc

SEQ ID NO: 1193673 - RNA, 19 nt, Homo sapiens
cuacacaaaggaccuacua

SEQ ID NO: 1193674 - RNA, 19 nt, Homo sapiens
gagaaagagaagaagagaa

SEQ ID NO: 1193675 - RNA, 19 nt, Homo sapiens
cuuaguaggacuucaguaa

SEQ ID NO: 1193676 - RNA, 19 nt, Homo sapiens
gcauuggauuuccuaaagg

SEQ ID NO: 1193677 - RNA, 19 nt, Homo sapiens
caugagguacgcaaugaaa

SEQ ID NO: 1193678 - RNA, 19 nt, Homo sapiens
agaguuaucgccaguguga

SEQ ID NO: 1193679 - RNA, 19 nt, Homo sapiens
gaaccgcuggaaacacuga

SEQ ID NO: 1193680 - RNA, 19 nt, Homo sapiens
gaccuacuacugccuauca

SEQ ID NO: 1193681 - RNA, 19 nt, Homo sapiens
gcccaauauuguaauuuca

SEQ ID NO: 1193682 - RNA, 19 nt, Homo sapiens
ggcuagagaagaaaguuaa

SEQ ID NO: 1193683 - RNA, 19 nt, Homo sapiens
gaauaaauggaagcuacuu

SEQ ID NO: 1193684 - RNA, 19 nt, Homo sapiens
gguuacugcucgccaggaa

SEQ ID NO: 1193685 - RNA, 19 nt, Homo sapiens
gauuauauugggaaguuga

SEQ ID NO: 1193686 - RNA, 19 nt, Homo sapiens
gguacgcaaugaaaauuaa

SEQ ID NO: 1193687 - RNA, 19 nt, Homo sapiens
caggagggaaacaugguua

SEQ ID NO: 1193688 - RNA, 19 nt, Homo sapiens
uggcgcagcucuggaucua

SEQ ID NO: 1193689 - RNA, 19 nt, Homo sapiens
acugagaccucuacauuuu

SEQ ID NO: 1193690 - RNA, 19 nt, Homo sapiens
gcaugguguuucagaacug

SEQ ID NO: 1193691 - RNA, 19 nt, Homo sapiens
cgagacguccucaucaaau

SEQ ID NO: 1193692 - RNA, 19 nt, Homo sapiens
aaauggaagcuacuuugaa

SEQ ID NO: 1193693 - RNA, 19 nt, Homo sapiens
caaccaggagggaaacaug

SEQ ID NO: 1193694 - RNA, 19 nt, Homo sapiens
agaagaagagaaagaggaa

SEQ ID NO: 1193695 - RNA, 19 nt, Homo sapiens
gaaaaucaccacucuuugg

SEQ ID NO: 1193696 - RNA, 19 nt, Homo sapiens
uaucaaacgcccaccacaa

SEQ ID NO: 1193697 - RNA, 19 nt, Homo sapiens
acuccaggcuagagaagaa

SEQ ID NO: 1193698 - RNA, 19 nt, Homo sapiens
aaggaaagcauaugucagu

SEQ ID NO: 1193699 - RNA, 19 nt, Homo sapiens
gauucagugauuucagaua

SEQ ID NO: 1193700 - RNA, 19 nt, Homo sapiens
gaaugccacuucccuuuuc

SEQ ID NO: 1193701 - RNA, 19 nt, Homo sapiens
gaagagaaagaggaagagu

SEQ ID NO: 1193702 - RNA, 19 nt, Homo sapiens
gcuagagaagaaaguuaaa

SEQ ID NO: 1193703 - RNA, 19 nt, Homo sapiens
auaaauggaagcuacuuug

SEQ ID NO: 1193704 - RNA, 19 nt, Homo sapiens
caggaagcacugcagauau

SEQ ID NO: 1193705 - RNA, 19 nt, Homo sapiens
ggaugagcuucuuauuggu

SEQ ID NO: 1193706 - RNA, 19 nt, Homo sapiens
cuucaggcccaauauugua

SEQ ID NO: 1193707 - RNA, 19 nt, Homo sapiens
cgaccgagacguccucauc

SEQ ID NO: 1193708 - RNA, 19 nt, Homo sapiens
ggaaaaggaaagcauaugu

SEQ ID NO: 1193709 - RNA, 19 nt, Homo sapiens
gagugcuccuucuccaguu

SEQ ID NO: 1193710 - RNA, 19 nt, Homo sapiens
cagcauuggauuuccuaaa

SEQ ID NO: 1193711 - RNA, 19 nt, Homo sapiens
ucagacagcauuggauuuc

SEQ ID NO: 1193712 - RNA, 19 nt, Homo sapiens
aagaagagaaagaggaaga

SEQ ID NO: 1193713 - RNA, 19 nt, Homo sapiens
cuaccacucguuagagaaa

SEQ ID NO: 1193714 - RNA, 19 nt, Homo sapiens
ucuccugcuucuccguuua

SEQ ID NO: 1193715 - RNA, 19 nt, Homo sapiens
gaaacacugaagaguuauc

SEQ ID NO: 1193716 - RNA, 19 nt, Homo sapiens
ucagugcagccuacacaaa

SEQ ID NO: 1193717 - RNA, 19 nt, Homo sapiens
cauucuugauccuuucuga

SEQ ID NO: 1193718 - RNA, 19 nt, Homo sapiens
ggauaaccagcuuccugaa

SEQ ID NO: 1193719 - RNA, 19 nt, Homo sapiens
gaaggagucucauuuguaa

SEQ ID NO: 1193720 - RNA, 19 nt, Homo sapiens
cagcaaggcuucaaaguuu

SEQ ID NO: 1193721 - RNA, 19 nt, Homo sapiens
guuguuacauucacacuua

SEQ ID NO: 1193722 - RNA, 19 nt, Homo sapiens
gaaacaagauacauacuac

SEQ ID NO: 1193723 - RNA, 19 nt, Homo sapiens
ggaaacaagauacauacua

SEQ ID NO: 1193724 - RNA, 19 nt, Homo sapiens
gcagagcgguagaggugua

SEQ ID NO: 1193725 - RNA, 19 nt, Homo sapiens
guacaggaauuugcaaaga

SEQ ID NO: 1193726 - RNA, 19 nt, Homo sapiens
gcucagugcuuguuucugu

SEQ ID NO: 1193727 - RNA, 19 nt, Homo sapiens
caagauggaauucacagua

SEQ ID NO: 1193728 - RNA, 19 nt, Homo sapiens
gcagcaaggcuucaaaguu

SEQ ID NO: 1193729 - RNA, 19 nt, Homo sapiens
gagacaagaagaaauagaa

SEQ ID NO: 1193730 - RNA, 19 nt, Homo sapiens
ugaaggagucucauuugua

SEQ ID NO: 1193731 - RNA, 19 nt, Homo sapiens
acaaagaaagggauaguuu

SEQ ID NO: 1193732 - RNA, 19 nt, Homo sapiens
ggacuggaacgucugguuu

SEQ ID NO: 1193733 - RNA, 19 nt, Homo sapiens
caagauacauacuacugau

SEQ ID NO: 1193734 - RNA, 19 nt, Homo sapiens
gugauagugucuacuuuga

SEQ ID NO: 1193735 - RNA, 19 nt, Homo sapiens
caucaguguuuaaagagaa

SEQ ID NO: 1193736 - RNA, 19 nt, Homo sapiens
ggaauucacaguauguugu

SEQ ID NO: 1193737 - RNA, 19 nt, Homo sapiens
ugaggaaacaagauacaua

SEQ ID NO: 1193738 - RNA, 19 nt, Homo sapiens
ggaguaacaaacaagauug

SEQ ID NO: 1193739 - RNA, 19 nt, Homo sapiens
ggcaaccccuucaaaauaa

SEQ ID NO: 1193740 - RNA, 19 nt, Homo sapiens
aagauggaauucacaguau

SEQ ID NO: 1193741 - RNA, 19 nt, Homo sapiens
acaggaauuugcaaagaga

SEQ ID NO: 1193742 - RNA, 19 nt, Homo sapiens
gaauuugcaaagagaugua

SEQ ID NO: 1193743 - RNA, 19 nt, Homo sapiens
gaauucacaguauguuguu

SEQ ID NO: 1193744 - RNA, 19 nt, Homo sapiens
uaaccaagauggaauucac

SEQ ID NO: 1193745 - RNA, 19 nt, Homo sapiens
ccaaguuacuagcuacaca

SEQ ID NO: 1193746 - RNA, 19 nt, Homo sapiens
gcgguagagguguauauuu

SEQ ID NO: 1193747 - RNA, 19 nt, Homo sapiens
gaacugcuuuuauuuggau

SEQ ID NO: 1193748 - RNA, 19 nt, Homo sapiens
ugagcuagauaaauaaagg

SEQ ID NO: 1193749 - RNA, 19 nt, Homo sapiens
gaggaaacaagauacauac

SEQ ID NO: 1193750 - RNA, 19 nt, Homo sapiens
ggagacaagaagaaauaga

SEQ ID NO: 1193751 - RNA, 19 nt, Homo sapiens
ucacaggccagaaguggaa

SEQ ID NO: 1193752 - RNA, 19 nt, Homo sapiens
guagaaggugccacaguga

SEQ ID NO: 1193753 - RNA, 19 nt, Homo sapiens
cauaacaaagaaagggaua

SEQ ID NO: 1193754 - RNA, 19 nt, Homo sapiens
guuucuaccuucuauucaa

SEQ ID NO: 1193755 - RNA, 19 nt, Homo sapiens
uggaacgucugguuucugu

SEQ ID NO: 1193756 - RNA, 19 nt, Homo sapiens
cgguagagguguauauuuu

SEQ ID NO: 1193757 - RNA, 19 nt, Homo sapiens
ucaaccagguccuccaaag

SEQ ID NO: 1193758 - RNA, 19 nt, Homo sapiens
gauggaauucacaguaugu

SEQ ID NO: 1193759 - RNA, 19 nt, Homo sapiens
cugaaggagucucauuugu

SEQ ID NO: 1193760 - RNA, 19 nt, Homo sapiens
gcaaggcuucaaaguuuca

SEQ ID NO: 1193761 - RNA, 19 nt, Homo sapiens
acaagauacauacuacuga

SEQ ID NO: 1193762 - RNA, 19 nt, Homo sapiens
guuacuagcuacacaucag

SEQ ID NO: 1193763 - RNA, 19 nt, Homo sapiens
ggggagacaagaagaaaua

SEQ ID NO: 1193764 - RNA, 19 nt, Homo sapiens
ggaauuugcaaagagaugu

SEQ ID NO: 1193765 - RNA, 19 nt, Homo sapiens
uaacaaagaaagggauagu

SEQ ID NO: 1193766 - RNA, 19 nt, Homo sapiens
cuacuuugagcuagauaaa

SEQ ID NO: 1193767 - RNA, 19 nt, Homo sapiens
gagcgguagagguguauau

SEQ ID NO: 1193768 - RNA, 19 nt, Homo sapiens
auacaaaggaugcaaacau

SEQ ID NO: 1193769 - RNA, 19 nt, Homo sapiens
guaaaaggaguaacaaaca

SEQ ID NO: 1193770 - RNA, 19 nt, Homo sapiens
uacaggaauuugcaaagag

SEQ ID NO: 1193771 - RNA, 19 nt, Homo sapiens
ccagaaguggaaaggguuu

SEQ ID NO: 1193772 - RNA, 19 nt, Homo sapiens
agauggaauucacaguaug

SEQ ID NO: 1193773 - RNA, 19 nt, Homo sapiens
acaucaguguuuaaagaga

SEQ ID NO: 1193774 - RNA, 19 nt, Homo sapiens
ggugcucagugcuuguuuc

SEQ ID NO: 1193775 - RNA, 19 nt, Homo sapiens
aaaggaguaacaaacaaga

SEQ ID NO: 1193776 - RNA, 19 nt, Homo sapiens
gagucucauuuguaaccaa

SEQ ID NO: 1193777 - RNA, 19 nt, Homo sapiens
ucuugaaacuugaggaaac

SEQ ID NO: 1193778 - RNA, 19 nt, Homo sapiens
uuauccaaguuacuagcua

SEQ ID NO: 1193779 - RNA, 19 nt, Homo sapiens
gcagcuacgucuauuuucu

SEQ ID NO: 1193780 - RNA, 19 nt, Homo sapiens
aggaguaacaaacaagauu

SEQ ID NO: 1193781 - RNA, 19 nt, Homo sapiens
ucucauuuguaaccaagau

SEQ ID NO: 1193782 - RNA, 19 nt, Homo sapiens
aggcaaccccuucaaaaua

SEQ ID NO: 1193783 - RNA, 19 nt, Homo sapiens
cccucaagguggacaguga

SEQ ID NO: 1193784 - RNA, 19 nt, Homo sapiens
gacaagaagaaauagaacu

SEQ ID NO: 1193785 - RNA, 19 nt, Homo sapiens
agaaggugccacagugaga

SEQ ID NO: 1193786 - RNA, 19 nt, Homo sapiens
gccuguuucuaccuucuau

SEQ ID NO: 1193787 - RNA, 19 nt, Homo sapiens
ugugauagugucuacuuug

SEQ ID NO: 1193788 - RNA, 19 nt, Homo sapiens
caagaaagcuggagauuug

SEQ ID NO: 1193789 - RNA, 19 nt, Homo sapiens
gaacucugcuuuaaaguga

SEQ ID NO: 1193790 - RNA, 19 nt, Homo sapiens
gagcagagguuuguacuuu

SEQ ID NO: 1193791 - RNA, 19 nt, Homo sapiens
gaaagcagguggaccauuc

SEQ ID NO: 1193792 - RNA, 19 nt, Homo sapiens
gaaauucccuccucugcuu

SEQ ID NO: 1193793 - RNA, 19 nt, Homo sapiens
ccacgaagcugcccugaga

SEQ ID NO: 1193794 - RNA, 19 nt, Homo sapiens
gaaguucgccugcauuuau

SEQ ID NO: 1193795 - RNA, 19 nt, Homo sapiens
gaagcaaguuuccacgauu

SEQ ID NO: 1193796 - RNA, 19 nt, Homo sapiens
cgucuucucugccuuguua

SEQ ID NO: 1193797 - RNA, 19 nt, Homo sapiens
gaaaugcuaccacaagaaa

SEQ ID NO: 1193798 - RNA, 19 nt, Homo sapiens
gauuguggaugacuucuuu

SEQ ID NO: 1193799 - RNA, 19 nt, Homo sapiens
caaaccaagugccucauuu

SEQ ID NO: 1193800 - RNA, 19 nt, Homo sapiens
gaaaugagaagaaggaaca

SEQ ID NO: 1193801 - RNA, 19 nt, Homo sapiens
gaagcucccucaaggaaau

SEQ ID NO: 1193802 - RNA, 19 nt, Homo sapiens
cugaagagcugguauagga

SEQ ID NO: 1193803 - RNA, 19 nt, Homo sapiens
gaccacaccuugucuguca

SEQ ID NO: 1193804 - RNA, 19 nt, Homo sapiens
aaacuagggucucaguauu

SEQ ID NO: 1193805 - RNA, 19 nt, Homo sapiens
ccaagugccucauuucugu

SEQ ID NO: 1193806 - RNA, 19 nt, Homo sapiens
ugacuuaucugacacaucu

SEQ ID NO: 1193807 - RNA, 19 nt, Homo sapiens
ggaagaauuggccacguua

SEQ ID NO: 1193808 - RNA, 19 nt, Homo sapiens
gaaagggacaugcaaggaa

SEQ ID NO: 1193809 - RNA, 19 nt, Homo sapiens
gcauuuaucagcccucuuu

SEQ ID NO: 1193810 - RNA, 19 nt, Homo sapiens
guacaaggcggauauuuca

SEQ ID NO: 1193811 - RNA, 19 nt, Homo sapiens
gaaggaggaucuggacaau

SEQ ID NO: 1193812 - RNA, 19 nt, Homo sapiens
gcacaaaggaggacgugaa

SEQ ID NO: 1193813 - RNA, 19 nt, Homo sapiens
gaaccucagugcagaugga

SEQ ID NO: 1193814 - RNA, 19 nt, Homo sapiens
caaguguauuucaggcuua

SEQ ID NO: 1193815 - RNA, 19 nt, Homo sapiens
gggaagaauuggccacguu

SEQ ID NO: 1193816 - RNA, 19 nt, Homo sapiens
gcaaggaguccauguguuc

SEQ ID NO: 1193817 - RNA, 19 nt, Homo sapiens
gagaugucauggugaaaug

SEQ ID NO: 1193818 - RNA, 19 nt, Homo sapiens
ggagaaaugagaagaagga

SEQ ID NO: 1193819 - RNA, 19 nt, Homo sapiens
aaagggacaugcaaggaaa

SEQ ID NO: 1193820 - RNA, 19 nt, Homo sapiens
gaaauuuguucaagacacu

SEQ ID NO: 1193821 - RNA, 19 nt, Homo sapiens
caaauguccuucccgacuu

SEQ ID NO: 1193822 - RNA, 19 nt, Homo sapiens
caucuaagccacugaauca

SEQ ID NO: 1193823 - RNA, 19 nt, Homo sapiens
agaacucacuccuaucuga

SEQ ID NO: 1193824 - RNA, 19 nt, Homo sapiens
caagcaaccuacccugaug

SEQ ID NO: 1193825 - RNA, 19 nt, Homo sapiens
gagaccagguugugaaugg

SEQ ID NO: 1193826 - RNA, 19 nt, Homo sapiens
ggacaaugccagcaaagau

SEQ ID NO: 1193827 - RNA, 19 nt, Homo sapiens
gagcugguauaggaaguuu

SEQ ID NO: 1193828 - RNA, 19 nt, Homo sapiens
gcaaggaaacagcacagaa

SEQ ID NO: 1193829 - RNA, 19 nt, Homo sapiens
caaagaaggucugagaacu

SEQ ID NO: 1193830 - RNA, 19 nt, Homo sapiens
uauuaucgauggcagaauu

SEQ ID NO: 1193831 - RNA, 19 nt, Homo sapiens
ggaaggaggaucuggacaa

SEQ ID NO: 1193832 - RNA, 19 nt, Homo sapiens
gaaaggcugguguggacua

SEQ ID NO: 1193833 - RNA, 19 nt, Homo sapiens
caaacuagggucucaguau

SEQ ID NO: 1193834 - RNA, 19 nt, Homo sapiens
gaacaagaaagcuggagau

SEQ ID NO: 1193835 - RNA, 19 nt, Homo sapiens
ccagagacaccguauguga

SEQ ID NO: 1193836 - RNA, 19 nt, Homo sapiens
gugaaaugcuaccacaaga

SEQ ID NO: 1193837 - RNA, 19 nt, Homo sapiens
cagcaaagaugaccguuuu

SEQ ID NO: 1193838 - RNA, 19 nt, Homo sapiens
aagcaaguuuccacgauuu

SEQ ID NO: 1193839 - RNA, 19 nt, Homo sapiens
ggaccuccuucucuaacuu

SEQ ID NO: 1193840 - RNA, 19 nt, Homo sapiens
gacaggaaguggaucaaag

SEQ ID NO: 1193841 - RNA, 19 nt, Homo sapiens
guguucaacuccagcauuu

SEQ ID NO: 1193842 - RNA, 19 nt, Homo sapiens
cccaggaccucgauauuau

SEQ ID NO: 1193843 - RNA, 19 nt, Homo sapiens
gcaaggcuccucugcugaa

SEQ ID NO: 1193844 - RNA, 19 nt, Homo sapiens
ggacggauaagacggaaga

SEQ ID NO: 1193845 - RNA, 19 nt, Homo sapiens
cacaacagacccacugaua

SEQ ID NO: 1193846 - RNA, 19 nt, Homo sapiens
uuucucugcuccuuaaaua

SEQ ID NO: 1193847 - RNA, 19 nt, Homo sapiens
aaaagucacugugcauuua

SEQ ID NO: 1193848 - RNA, 19 nt, Homo sapiens
gaggagaaaugagaagaag

SEQ ID NO: 1193849 - RNA, 19 nt, Homo sapiens
ggaccgagaggagaaauga

SEQ ID NO: 1193850 - RNA, 19 nt, Homo sapiens
gcucgaaugaaccauauuu

SEQ ID NO: 1193851 - RNA, 19 nt, Homo sapiens
gaacaagccaucgccaugu

SEQ ID NO: 1193852 - RNA, 19 nt, Homo sapiens
ccagauaguccaggugaua

SEQ ID NO: 1193853 - RNA, 19 nt, Homo sapiens
cagcugcccuucuccaaau

SEQ ID NO: 1193854 - RNA, 19 nt, Homo sapiens
cagcaacguuggugaagau

SEQ ID NO: 1193855 - RNA, 19 nt, Homo sapiens
cagcagauccucauguguu

SEQ ID NO: 1193856 - RNA, 19 nt, Homo sapiens
ggaaugugcuuugugaacu

SEQ ID NO: 1193857 - RNA, 19 nt, Homo sapiens
caaggcggauauuucaaga

SEQ ID NO: 1193858 - RNA, 19 nt, Homo sapiens
gaaacaggcagaguuggaa

SEQ ID NO: 1193859 - RNA, 19 nt, Homo sapiens
agauggagaugcuaacgaa

SEQ ID NO: 1193860 - RNA, 19 nt, Homo sapiens
caacgaccacggugugauu

SEQ ID NO: 1193861 - RNA, 19 nt, Homo sapiens
gagcugggccacaucagaa

SEQ ID NO: 1193862 - RNA, 19 nt, Homo sapiens
ccaugucccuggcacacua

SEQ ID NO: 1193863 - RNA, 19 nt, Homo sapiens
ugaauuggccuuuccugaa

SEQ ID NO: 1193864 - RNA, 19 nt, Homo sapiens
ccagugccauugucaacuu

SEQ ID NO: 1193865 - RNA, 19 nt, Homo sapiens
gcagcaacguuggugaaga

SEQ ID NO: 1193866 - RNA, 19 nt, Homo sapiens
gaacauccccagagugaaa

SEQ ID NO: 1193867 - RNA, 19 nt, Homo sapiens
ucaaaggucaugauugguu

SEQ ID NO: 1193868 - RNA, 19 nt, Homo sapiens
gaaagggugcucgaaugaa

SEQ ID NO: 1193869 - RNA, 19 nt, Homo sapiens
gcagcccucucccagcaaa

SEQ ID NO: 1193870 - RNA, 19 nt, Homo sapiens
guuaagcuauagccauguu

SEQ ID NO: 1193871 - RNA, 19 nt, Homo sapiens
gugcaggccagguuccuua

SEQ ID NO: 1193872 - RNA, 19 nt, Homo sapiens
gucaggaggugcuggcauu

SEQ ID NO: 1193873 - RNA, 19 nt, Homo sapiens
caugcugacuguccugauu

SEQ ID NO: 1193874 - RNA, 19 nt, Homo sapiens
gaauuggccacguuagaga

SEQ ID NO: 1193875 - RNA, 19 nt, Homo sapiens
gcaucacccugacagacaa

SEQ ID NO: 1193876 - RNA, 19 nt, Homo sapiens
gugauaaacuugugaucgu

SEQ ID NO: 1193877 - RNA, 19 nt, Homo sapiens
gaacaagcugugugucauc

SEQ ID NO: 1193878 - RNA, 19 nt, Homo sapiens
ugugaacucugcuuuaaag

SEQ ID NO: 1193879 - RNA, 19 nt, Homo sapiens
gauaauuugccauugcuau

SEQ ID NO: 1193880 - RNA, 19 nt, Homo sapiens
gaacacagcagggccuaca

SEQ ID NO: 1193881 - RNA, 19 nt, Homo sapiens
gagaugcuaacgaaacuga

SEQ ID NO: 1193882 - RNA, 19 nt, Homo sapiens
gcagugccacggauaaugu

SEQ ID NO: 1193883 - RNA, 19 nt, Homo sapiens
ugaaagggugcucgaauga

SEQ ID NO: 1193884 - RNA, 19 nt, Homo sapiens
gaagggagugcgguugaaa

SEQ ID NO: 1193885 - RNA, 19 nt, Homo sapiens
gcuacgggcugguguuugg

SEQ ID NO: 1193886 - RNA, 19 nt, Homo sapiens
ggaaagggacaugcaagga

SEQ ID NO: 1193887 - RNA, 19 nt, Homo sapiens
ugacagacaaucagaggaa

SEQ ID NO: 1193888 - RNA, 19 nt, Homo sapiens
gccaagaggugacacgaaa

SEQ ID NO: 1193889 - RNA, 19 nt, Homo sapiens
ggacagcacagcaauaaau

SEQ ID NO: 1193890 - RNA, 19 nt, Homo sapiens
cuacacaguugcuggcuuu

SEQ ID NO: 1193891 - RNA, 19 nt, Homo sapiens
ucagugcacuuuggcauuu

SEQ ID NO: 1193892 - RNA, 19 nt, Homo sapiens
ccaaggagccaaacagaug

SEQ ID NO: 1193893 - RNA, 19 nt, Homo sapiens
caccagagccugagagcua

SEQ ID NO: 1193894 - RNA, 19 nt, Homo sapiens
gucuugaccugcaggaaua

SEQ ID NO: 1193895 - RNA, 19 nt, Homo sapiens
ccaaacagauggcuuucca

SEQ ID NO: 1193896 - RNA, 19 nt, Homo sapiens
gcugagaccugacauuuug

SEQ ID NO: 1193897 - RNA, 19 nt, Homo sapiens
ggagacaggcuaugacaca

SEQ ID NO: 1193898 - RNA, 19 nt, Homo sapiens
cgucuggacucuuagauuc

SEQ ID NO: 1193899 - RNA, 19 nt, Homo sapiens
aaacagcagugaccgagau

SEQ ID NO: 1193900 - RNA, 19 nt, Homo sapiens
agcaauaaauggugugauu

SEQ ID NO: 1193901 - RNA, 19 nt, Homo sapiens
cagcgggacuacacaguug

SEQ ID NO: 1193902 - RNA, 19 nt, Homo sapiens
gugaccaccucucugauga

SEQ ID NO: 1193903 - RNA, 19 nt, Homo sapiens
gcagaucuccguggaugaa

SEQ ID NO: 1193904 - RNA, 19 nt, Homo sapiens
cgaaacaggaggaaacuca

SEQ ID NO: 1193905 - RNA, 19 nt, Homo sapiens
gggccaagccugugacuca

SEQ ID NO: 1193906 - RNA, 19 nt, Homo sapiens
caaggagacugcggcaugu

SEQ ID NO: 1193907 - RNA, 19 nt, Homo sapiens
gaccgcaugucccggauuc

SEQ ID NO: 1193908 - RNA, 19 nt, Homo sapiens
gcccaguguucuugauaga

SEQ ID NO: 1193909 - RNA, 19 nt, Homo sapiens
ccgagaucgucaacaguuu

SEQ ID NO: 1193910 - RNA, 19 nt, Homo sapiens
ggagacugcggcauguuga

SEQ ID NO: 1193911 - RNA, 19 nt, Homo sapiens
gagccuauucuccguguug

SEQ ID NO: 1193912 - RNA, 19 nt, Homo sapiens
gcccaugccgcuucuagaa

SEQ ID NO: 1193913 - RNA, 19 nt, Homo sapiens
ggagaaggagcagugaaug

SEQ ID NO: 1193914 - RNA, 19 nt, Homo sapiens
gggacuugaugcagagaau

SEQ ID NO: 1193915 - RNA, 19 nt, Homo sapiens
ccauugccuucgucaaguu

SEQ ID NO: 1193916 - RNA, 19 nt, Homo sapiens
gcuaugaggacacccuaga

SEQ ID NO: 1193917 - RNA, 19 nt, Homo sapiens
caagaggugacacgaaaca

SEQ ID NO: 1193918 - RNA, 19 nt, Homo sapiens
gagaaggagcagugaaugg

SEQ ID NO: 1193919 - RNA, 19 nt, Homo sapiens
cccuagaccuggaggaaga

SEQ ID NO: 1193920 - RNA, 19 nt, Homo sapiens
gacagcacagcaauaaaug

SEQ ID NO: 1193921 - RNA, 19 nt, Homo sapiens
ccggacagcacagcaauaa

SEQ ID NO: 1193922 - RNA, 19 nt, Homo sapiens
uggaggagcuugggugaca

SEQ ID NO: 1193923 - RNA, 19 nt, Homo sapiens
agacuggguuucagggaau

SEQ ID NO: 1193924 - RNA, 19 nt, Homo sapiens
gaggagacaggcuaugaca

SEQ ID NO: 1193925 - RNA, 19 nt, Homo sapiens
ccuggagccuugucugugu

SEQ ID NO: 1193926 - RNA, 19 nt, Homo sapiens
cuucuguacuggccauuug

SEQ ID NO: 1193927 - RNA, 19 nt, Homo sapiens
accgacagcuuccuggauu

SEQ ID NO: 1193928 - RNA, 19 nt, Homo sapiens
gcauuugcacggugucuuc

SEQ ID NO: 1193929 - RNA, 19 nt, Homo sapiens
ccuguaugcucaucucauc

SEQ ID NO: 1193930 - RNA, 19 nt, Homo sapiens
ccagccgccucauggcaaa

SEQ ID NO: 1193931 - RNA, 19 nt, Homo sapiens
ccuggaaacuguugcaaaa

SEQ ID NO: 1193932 - RNA, 19 nt, Homo sapiens
aacugcgucuggacucuua

SEQ ID NO: 1193933 - RNA, 19 nt, Homo sapiens
gggcccaguguucuugaua

SEQ ID NO: 1193934 - RNA, 19 nt, Homo sapiens
gagacaggcuaugacacau

SEQ ID NO: 1193935 - RNA, 19 nt, Homo sapiens
cuuccuggauuccggcuuu

SEQ ID NO: 1193936 - RNA, 19 nt, Homo sapiens
gaacugcgucuggacucuu

SEQ ID NO: 1193937 - RNA, 19 nt, Homo sapiens
ggccaagccugugacucaa

SEQ ID NO: 1193938 - RNA, 19 nt, Homo sapiens
gauuccggcuuucaaacuc

SEQ ID NO: 1193939 - RNA, 19 nt, Homo sapiens
ugacacauacguccacgau

SEQ ID NO: 1193940 - RNA, 19 nt, Homo sapiens
ccacacuccggcuguuuga

SEQ ID NO: 1193941 - RNA, 19 nt, Homo sapiens
ggacucuuagauucauaaa

SEQ ID NO: 1193942 - RNA, 19 nt, Homo sapiens
ggcccaguguucuugauag

SEQ ID NO: 1193943 - RNA, 19 nt, Homo sapiens
uggcuuggcccauggagaa

SEQ ID NO: 1193944 - RNA, 19 nt, Homo sapiens
gcucaucucaucgggcauu

SEQ ID NO: 1193945 - RNA, 19 nt, Homo sapiens
gccauugccuucgucaagu

SEQ ID NO: 1193946 - RNA, 19 nt, Homo sapiens
cugcugagaccugacauuu

SEQ ID NO: 1193947 - RNA, 19 nt, Homo sapiens
uggaggaguucugcaagga

SEQ ID NO: 1193948 - RNA, 19 nt, Homo sapiens
cauacguccacgaugcuua

SEQ ID NO: 1193949 - RNA, 19 nt, Homo sapiens
gagcucaggggacagauaa

SEQ ID NO: 1193950 - RNA, 19 nt, Homo sapiens
ccaagccugugacucaacu

SEQ ID NO: 1193951 - RNA, 19 nt, Homo sapiens
ucaccacacuccggcuguu

SEQ ID NO: 1193952 - RNA, 19 nt, Homo sapiens
ggauucuggaucagccaua

SEQ ID NO: 1193953 - RNA, 19 nt, Homo sapiens
cagcacagcaauaaauggu

SEQ ID NO: 1193954 - RNA, 19 nt, Homo sapiens
cgccaggcauuaccucaca

SEQ ID NO: 1193955 - RNA, 19 nt, Homo sapiens
cacaugauccucgccagaa

SEQ ID NO: 1193956 - RNA, 19 nt, Homo sapiens
gcgucuggacucuuagauu

SEQ ID NO: 1193957 - RNA, 19 nt, Homo sapiens
ggauuccggcuuucaaacu

SEQ ID NO: 1193958 - RNA, 19 nt, Homo sapiens
caucucaucgggcauugug

SEQ ID NO: 1193959 - RNA, 19 nt, Homo sapiens
cgagaucgucaacaguuuc

SEQ ID NO: 1193960 - RNA, 19 nt, Homo sapiens
gggaagaacuguaggaaua

SEQ ID NO: 1193961 - RNA, 19 nt, Homo sapiens
gcacaugacaucaagaaua

SEQ ID NO: 1193962 - RNA, 19 nt, Homo sapiens
ggacagaguuucuagauac

SEQ ID NO: 1193963 - RNA, 19 nt, Homo sapiens
guacuggagugaugaguuu

SEQ ID NO: 1193964 - RNA, 19 nt, Homo sapiens
cacaugacaucaagaauaa

SEQ ID NO: 1193965 - RNA, 19 nt, Homo sapiens
ggacuaaccagaagugauu

SEQ ID NO: 1193966 - RNA, 19 nt, Homo sapiens
uaacaucccugugagauug

SEQ ID NO: 1193967 - RNA, 19 nt, Homo sapiens
cagaguaugucauccagua

SEQ ID NO: 1193968 - RNA, 19 nt, Homo sapiens
uguaagagaucccaugauu

SEQ ID NO: 1193969 - RNA, 19 nt, Homo sapiens
ccagaaauuugccaacauu

SEQ ID NO: 1193970 - RNA, 19 nt, Homo sapiens
ccacggcucuugugccuuu

SEQ ID NO: 1193971 - RNA, 19 nt, Homo sapiens
caagauaagugccauagag

SEQ ID NO: 1193972 - RNA, 19 nt, Homo sapiens
gaagaggcauauugcaauc

SEQ ID NO: 1193973 - RNA, 19 nt, Homo sapiens
uaagagaucccaugauuuc

SEQ ID NO: 1193974 - RNA, 19 nt, Homo sapiens
gggacagaguuucuagaua

SEQ ID NO: 1193975 - RNA, 19 nt, Homo sapiens
aguuguagcuuucaagaua

SEQ ID NO: 1193976 - RNA, 19 nt, Homo sapiens
caccaaaccuccacacuuc

SEQ ID NO: 1193977 - RNA, 19 nt, Homo sapiens
caacauggaacuuauugaa

SEQ ID NO: 1193978 - RNA, 19 nt, Homo sapiens
gaaaugcacaugacaucaa

SEQ ID NO: 1193979 - RNA, 19 nt, Homo sapiens
gagcaacgccuucuaugau

SEQ ID NO: 1193980 - RNA, 19 nt, Homo sapiens
gacccaggcuuucagaaga

SEQ ID NO: 1193981 - RNA, 19 nt, Homo sapiens
gcaucaagcuccauaucug

SEQ ID NO: 1193982 - RNA, 19 nt, Homo sapiens
cagaagugauuguaguuga

SEQ ID NO: 1193983 - RNA, 19 nt, Homo sapiens
gaaauuugccaacauuaca

SEQ ID NO: 1193984 - RNA, 19 nt, Homo sapiens
cgaagagcaucccagacua

SEQ ID NO: 1193985 - RNA, 19 nt, Homo sapiens
cagaagaucacccuuaguu

SEQ ID NO: 1193986 - RNA, 19 nt, Homo sapiens
acauggaacuuauugaaga

SEQ ID NO: 1193987 - RNA, 19 nt, Homo sapiens
ggagcaacgccuucuauga

SEQ ID NO: 1193988 - RNA, 19 nt, Homo sapiens
gaagaucacccuuaguucu

SEQ ID NO: 1193989 - RNA, 19 nt, Homo sapiens
ccugugagauugaauacuu

SEQ ID NO: 1193990 - RNA, 19 nt, Homo sapiens
gaagagcaucccagacuau

SEQ ID NO: 1193991 - RNA, 19 nt, Homo sapiens
ggacaacauggaacuuauu

SEQ ID NO: 1193992 - RNA, 19 nt, Homo sapiens
gaaugcaaguuuggcacua

SEQ ID NO: 1193993 - RNA, 19 nt, Homo sapiens
ggcacuagcuguaagagau

SEQ ID NO: 1193994 - RNA, 19 nt, Homo sapiens
ucaaagccuucguucagaa

SEQ ID NO: 1193995 - RNA, 19 nt, Homo sapiens
cgauggcaauucuuggaua

SEQ ID NO: 1193996 - RNA, 19 nt, Homo sapiens
gcaaacccacauuuccuaa

SEQ ID NO: 1193997 - RNA, 19 nt, Homo sapiens
caccugcucugccuugaaa

SEQ ID NO: 1193998 - RNA, 19 nt, Homo sapiens
gauaagugccauagaguuc

SEQ ID NO: 1193999 - RNA, 19 nt, Homo sapiens
guaagagaucccaugauuu

SEQ ID NO: 1194000 - RNA, 19 nt, Homo sapiens
ggcauuaguuggucugugu

SEQ ID NO: 1194001 - RNA, 19 nt, Homo sapiens
ucucauggcaucauaguuu

SEQ ID NO: 1194002 - RNA, 19 nt, Homo sapiens
ugacuuugcugcuuauugg

SEQ ID NO: 1194003 - RNA, 19 nt, Homo sapiens
uaugauagcugcgugaaca

SEQ ID NO: 1194004 - RNA, 19 nt, Homo sapiens
cucauugucugaacuuuaa

SEQ ID NO: 1194005 - RNA, 19 nt, Homo sapiens
gaagaacuguaggaauagu

SEQ ID NO: 1194006 - RNA, 19 nt, Homo sapiens
gaguuugucucugcaguga

SEQ ID NO: 1194007 - RNA, 19 nt, Homo sapiens
gugaugaguuugguucuug

SEQ ID NO: 1194008 - RNA, 19 nt, Homo sapiens
guuguagcuuucaagauaa

SEQ ID NO: 1194009 - RNA, 19 nt, Homo sapiens
cuccauaucugccaguauu

SEQ ID NO: 1194010 - RNA, 19 nt, Homo sapiens
ccauagaguucauuuccau

SEQ ID NO: 1194011 - RNA, 19 nt, Homo sapiens
gcagugauucgguuucuca

SEQ ID NO: 1194012 - RNA, 19 nt, Homo sapiens
guuugucucugcagugauu

SEQ ID NO: 1194013 - RNA, 19 nt, Homo sapiens
agcaacgccuucuaugaua

SEQ ID NO: 1194014 - RNA, 19 nt, Homo sapiens
ccucaccacugacuggauu

SEQ ID NO: 1194015 - RNA, 19 nt, Homo sapiens
gauggcaauucuuggauag

SEQ ID NO: 1194016 - RNA, 19 nt, Homo sapiens
ugccaacucuuguuucaga

SEQ ID NO: 1194017 - RNA, 19 nt, Homo sapiens
gggaggauuuggacaacau

SEQ ID NO: 1194018 - RNA, 19 nt, Homo sapiens
gaucccaugauuucucuaa

SEQ ID NO: 1194019 - RNA, 19 nt, Homo sapiens
uagaguucauuuccauuug

SEQ ID NO: 1194020 - RNA, 19 nt, Homo sapiens
cuccugggcucuggcauua

SEQ ID NO: 1194021 - RNA, 19 nt, Homo sapiens
guucuuaaucucuugcuaa

SEQ ID NO: 1194022 - RNA, 19 nt, Homo sapiens
ccacugacuggauuuggua

SEQ ID NO: 1194023 - RNA, 19 nt, Homo sapiens
gacaacauggaacuuauug

SEQ ID NO: 1194024 - RNA, 19 nt, Homo sapiens
cagaucuguuuguaccaua

SEQ ID NO: 1194025 - RNA, 19 nt, Homo sapiens
cccaugauuucucuaauuc

SEQ ID NO: 1194026 - RNA, 19 nt, Homo sapiens
ucccaugauuucucuaauu

SEQ ID NO: 1194027 - RNA, 19 nt, Homo sapiens
gcuaugccaacucuuguuu

SEQ ID NO: 1194028 - RNA, 19 nt, Homo sapiens
cagaguuucuagauacaau

SEQ ID NO: 1194029 - RNA, 19 nt, Homo sapiens
ucagaagauugagcgagua

SEQ ID NO: 1194030 - RNA, 19 nt, Homo sapiens
caugauuucucuaauucug

SEQ ID NO: 1194031 - RNA, 19 nt, Homo sapiens
gacagaguuucuagauaca

SEQ ID NO: 1194032 - RNA, 19 nt, Homo sapiens
gagcuacuuugcccgagau

SEQ ID NO: 1194033 - RNA, 19 nt, Homo sapiens
gagcaucccagacuauugg

SEQ ID NO: 1194034 - RNA, 19 nt, Homo sapiens
ggccuccucugucaccaaa

SEQ ID NO: 1194035 - RNA, 19 nt, Homo sapiens
ugagucagccaguaccuuu

SEQ ID NO: 1194036 - RNA, 19 nt, Homo sapiens
cagaaauuugccaacauua

SEQ ID NO: 1194037 - RNA, 19 nt, Homo sapiens
ccaguaccuuucacucuca

SEQ ID NO: 1194038 - RNA, 19 nt, Homo sapiens
caaccugagugugcugaga

SEQ ID NO: 1194039 - RNA, 19 nt, Homo sapiens
ggaagaacuguaggaauag

SEQ ID NO: 1194040 - RNA, 19 nt, Homo sapiens
ugaagaggcauauugcaau

SEQ ID NO: 1194041 - RNA, 19 nt, Homo sapiens
ggauuuggacaacauggaa

SEQ ID NO: 1194042 - RNA, 19 nt, Homo sapiens
ugccuaccauuuauagaaa

SEQ ID NO: 1194043 - RNA, 19 nt, Homo sapiens
gaugugacgaccaugcaaa

SEQ ID NO: 1194044 - RNA, 19 nt, Homo sapiens
caaagccuucguucagaaa

SEQ ID NO: 1194045 - RNA, 19 nt, Homo sapiens
aaaggauccugugcucuga

SEQ ID NO: 1194046 - RNA, 19 nt, Homo sapiens
uugccaacauuacaacaaa

SEQ ID NO: 1194047 - RNA, 19 nt, Homo sapiens
gccagaaauuugccaacau

SEQ ID NO: 1194048 - RNA, 19 nt, Homo sapiens
uaugccaacucuuguuuca

SEQ ID NO: 1194049 - RNA, 19 nt, Homo sapiens
caugacaucaagaauaaga

SEQ ID NO: 1194050 - RNA, 19 nt, Homo sapiens
gcuguaagagaucccauga

SEQ ID NO: 1194051 - RNA, 19 nt, Homo sapiens
guugaccaccugagcuaua

SEQ ID NO: 1194052 - RNA, 19 nt, Homo sapiens
aaggacagaugcagaagca

SEQ ID NO: 1194053 - RNA, 19 nt, Homo sapiens
uuucagaagaucacccuua

SEQ ID NO: 1194054 - RNA, 19 nt, Homo sapiens
ucaccaaaccuccacacuu

SEQ ID NO: 1194055 - RNA, 19 nt, Homo sapiens
ucucauugucugaacuuua

SEQ ID NO: 1194056 - RNA, 19 nt, Homo sapiens
agagucucauggcaucaua

SEQ ID NO: 1194057 - RNA, 19 nt, Homo sapiens
guucagcagccgacaguga

SEQ ID NO: 1194058 - RNA, 19 nt, Homo sapiens
uggacaacauggaacuuau

SEQ ID NO: 1194059 - RNA, 19 nt, Homo sapiens
uuggagaaguuggguauga

SEQ ID NO: 1194060 - RNA, 19 nt, Homo sapiens
gaacagaugugaucaguuu

SEQ ID NO: 1194061 - RNA, 19 nt, Homo sapiens
gcaaagacauucaaggaaa

SEQ ID NO: 1194062 - RNA, 19 nt, Homo sapiens
ggagagagcuggcccgaaa

SEQ ID NO: 1194063 - RNA, 19 nt, Homo sapiens
gaacaagaccgagauauaa

SEQ ID NO: 1194064 - RNA, 19 nt, Homo sapiens
ggaacaagaccgagauaua

SEQ ID NO: 1194065 - RNA, 19 nt, Homo sapiens
uaaaggagccagugcaaua

SEQ ID NO: 1194066 - RNA, 19 nt, Homo sapiens
gaacaaaacugaucaaugc

SEQ ID NO: 1194067 - RNA, 19 nt, Homo sapiens
gcagaaauccuuuaugcaa

SEQ ID NO: 1194068 - RNA, 19 nt, Homo sapiens
guacgucacucaacaaaca

SEQ ID NO: 1194069 - RNA, 19 nt, Homo sapiens
gauccaagcaggaguuaua

SEQ ID NO: 1194070 - RNA, 19 nt, Homo sapiens
gagaaacucuuacuaugca

SEQ ID NO: 1194071 - RNA, 19 nt, Homo sapiens
ggagguggcuaaggcauuu

SEQ ID NO: 1194072 - RNA, 19 nt, Homo sapiens
ccgaagaugucauaucauu

SEQ ID NO: 1194073 - RNA, 19 nt, Homo sapiens
gggaugaacucacucuaau

SEQ ID NO: 1194074 - RNA, 19 nt, Homo sapiens
gugagaagguaugauauuu

SEQ ID NO: 1194075 - RNA, 19 nt, Homo sapiens
uaucaggacucucuauaga

SEQ ID NO: 1194076 - RNA, 19 nt, Homo sapiens
gaaggucgccuccgaaaca

SEQ ID NO: 1194077 - RNA, 19 nt, Homo sapiens
caaguagguuuaugugaga

SEQ ID NO: 1194078 - RNA, 19 nt, Homo sapiens
gcacuuuccuuugcacuug

SEQ ID NO: 1194079 - RNA, 19 nt, Homo sapiens
cagaaauccuuuaugcaaa

SEQ ID NO: 1194080 - RNA, 19 nt, Homo sapiens
gggacacaauuucauguuu

SEQ ID NO: 1194081 - RNA, 19 nt, Homo sapiens
gaugucauaucauucuuug

SEQ ID NO: 1194082 - RNA, 19 nt, Homo sapiens
gcacuccuguuuccugcua

SEQ ID NO: 1194083 - RNA, 19 nt, Homo sapiens
ucacuacgguucauugguu

SEQ ID NO: 1194084 - RNA, 19 nt, Homo sapiens
gcuauaaguuugugaacau

SEQ ID NO: 1194085 - RNA, 19 nt, Homo sapiens
caacggagagugcguagaa

SEQ ID NO: 1194086 - RNA, 19 nt, Homo sapiens
guaaauagggauaagagaa

SEQ ID NO: 1194087 - RNA, 19 nt, Homo sapiens
cgacaucgaugaguauuca

SEQ ID NO: 1194088 - RNA, 19 nt, Homo sapiens
guccgaagaugucauauca

SEQ ID NO: 1194089 - RNA, 19 nt, Homo sapiens
guccaucacuggcuaggua

SEQ ID NO: 1194090 - RNA, 19 nt, Homo sapiens
ccaagacgguggugguuug

SEQ ID NO: 1194091 - RNA, 19 nt, Homo sapiens
gaacacaccauccgcaaca

SEQ ID NO: 1194092 - RNA, 19 nt, Homo sapiens
gaagaugucauaucauucu

SEQ ID NO: 1194093 - RNA, 19 nt, Homo sapiens
caagcaggaguuauaguua

SEQ ID NO: 1194094 - RNA, 19 nt, Homo sapiens
gagaagaacagaugugauc

SEQ ID NO: 1194095 - RNA, 19 nt, Homo sapiens
gggcaccgcuauaaguuug

SEQ ID NO: 1194096 - RNA, 19 nt, Homo sapiens
cggaagaaauccucucaga

SEQ ID NO: 1194097 - RNA, 19 nt, Homo sapiens
ugacacaaauccuucugaa

SEQ ID NO: 1194098 - RNA, 19 nt, Homo sapiens
ggacacaauuucauguuuu

SEQ ID NO: 1194099 - RNA, 19 nt, Homo sapiens
gaaacugcccagcaccuuu

SEQ ID NO: 1194100 - RNA, 19 nt, Homo sapiens
cccagaagcuagugaagaa

SEQ ID NO: 1194101 - RNA, 19 nt, Homo sapiens
ugaagacacugaaguuuac

SEQ ID NO: 1194102 - RNA, 19 nt, Homo sapiens
aaaggcaugugcagagaaa

SEQ ID NO: 1194103 - RNA, 19 nt, Homo sapiens
ggaggagggucacuauguc

SEQ ID NO: 1194104 - RNA, 19 nt, Homo sapiens
acacugaaguuuacaacau

SEQ ID NO: 1194105 - RNA, 19 nt, Homo sapiens
ccgaaacccugguccauca

SEQ ID NO: 1194106 - RNA, 19 nt, Homo sapiens
ucugaaagcacuccuguuu

SEQ ID NO: 1194107 - RNA, 19 nt, Homo sapiens
acacaaauccuucugaaag

SEQ ID NO: 1194108 - RNA, 19 nt, Homo sapiens
uacacaacaucgucacuaa

SEQ ID NO: 1194109 - RNA, 19 nt, Homo sapiens
uagagauuccgguacauua

SEQ ID NO: 1194110 - RNA, 19 nt, Homo sapiens
uaugugagaagguaugaua

SEQ ID NO: 1194111 - RNA, 19 nt, Homo sapiens
gagaaggucgccuccgaaa

SEQ ID NO: 1194112 - RNA, 19 nt, Homo sapiens
agucagaacuucccuacga

SEQ ID NO: 1194113 - RNA, 19 nt, Homo sapiens
caaugaagacacugaaguu

SEQ ID NO: 1194114 - RNA, 19 nt, Homo sapiens
ucaagcugcuggaacaaga

SEQ ID NO: 1194115 - RNA, 19 nt, Homo sapiens
gagggucacuaugucauug

SEQ ID NO: 1194116 - RNA, 19 nt, Homo sapiens
ggaccaguauuuuguuaaa

SEQ ID NO: 1194117 - RNA, 19 nt, Homo sapiens
caaagcagaguacgucaug

SEQ ID NO: 1194118 - RNA, 19 nt, Homo sapiens
ccaagcaggaguuauaguu

SEQ ID NO: 1194119 - RNA, 19 nt, Homo sapiens
cagcaggcaucccgggaaa

SEQ ID NO: 1194120 - RNA, 19 nt, Homo sapiens
cgacuggaaugaagaaugc

SEQ ID NO: 1194121 - RNA, 19 nt, Homo sapiens
gcaaugaagacacugaagu

SEQ ID NO: 1194122 - RNA, 19 nt, Homo sapiens
guagaagggcugcgggaaa

SEQ ID NO: 1194123 - RNA, 19 nt, Homo sapiens
gaucaaugcgugugcuaga

SEQ ID NO: 1194124 - RNA, 19 nt, Homo sapiens
gaugaacucacucuaaugg

SEQ ID NO: 1194125 - RNA, 19 nt, Homo sapiens
gcuaaggcauuuccugaac

SEQ ID NO: 1194126 - RNA, 19 nt, Homo sapiens
caaaauagccaaagcugaa

SEQ ID NO: 1194127 - RNA, 19 nt, Homo sapiens
uagaggaaguguccaaguc

SEQ ID NO: 1194128 - RNA, 19 nt, Homo sapiens
gcauuagccuuccauucca

SEQ ID NO: 1194129 - RNA, 19 nt, Homo sapiens
gaggaccaguauuuuguua

SEQ ID NO: 1194130 - RNA, 19 nt, Homo sapiens
ucucggaggaccaguauuu

SEQ ID NO: 1194131 - RNA, 19 nt, Homo sapiens
ucaggacucuggagauagu

SEQ ID NO: 1194132 - RNA, 19 nt, Homo sapiens
cuagguaucugccaagaac

SEQ ID NO: 1194133 - RNA, 19 nt, Homo sapiens
caaagacauucaaggaaaa

SEQ ID NO: 1194134 - RNA, 19 nt, Homo sapiens
agauagagauuccgguaca

SEQ ID NO: 1194135 - RNA, 19 nt, Homo sapiens
uggaggauaucacauucaa

SEQ ID NO: 1194136 - RNA, 19 nt, Homo sapiens
cauggaggauaucacauuc

SEQ ID NO: 1194137 - RNA, 19 nt, Homo sapiens
agccaaagcugaaagacau

SEQ ID NO: 1194138 - RNA, 19 nt, Homo sapiens
cauacgaccuccacuucau

SEQ ID NO: 1194139 - RNA, 19 nt, Homo sapiens
gcaggcagaaauccuuuau

SEQ ID NO: 1194140 - RNA, 19 nt, Homo sapiens
augaagacacugaaguuua

SEQ ID NO: 1194141 - RNA, 19 nt, Homo sapiens
cccaaaauauagccaaaua

SEQ ID NO: 1194142 - RNA, 19 nt, Homo sapiens
ggagggucacuaugucauu

SEQ ID NO: 1194143 - RNA, 19 nt, Homo sapiens
gcgagaagaacagauguga

SEQ ID NO: 1194144 - RNA, 19 nt, Homo sapiens
ugugaucaguuuagagguu

SEQ ID NO: 1194145 - RNA, 19 nt, Homo sapiens
gcugcagccucaaggaugu

SEQ ID NO: 1194146 - RNA, 19 nt, Homo sapiens
aggagccagugcaauauuu

SEQ ID NO: 1194147 - RNA, 19 nt, Homo sapiens
aaucauucuuacccaagua

SEQ ID NO: 1194148 - RNA, 19 nt, Homo sapiens
gacacaaauccuucugaaa

SEQ ID NO: 1194149 - RNA, 19 nt, Homo sapiens
ugcaauauuucaacagugu

SEQ ID NO: 1194150 - RNA, 19 nt, Homo sapiens
gggcucccuuuccucauga

SEQ ID NO: 1194151 - RNA, 19 nt, Homo sapiens
acaaccacgugcccaauuc

SEQ ID NO: 1194152 - RNA, 19 nt, Homo sapiens
gagauuccgguacauuaug

SEQ ID NO: 1194153 - RNA, 19 nt, Homo sapiens
aggcagaaauccuuuaugc

SEQ ID NO: 1194154 - RNA, 19 nt, Homo sapiens
ccagugcaauauuucaaca

SEQ ID NO: 1194155 - RNA, 19 nt, Homo sapiens
ugaaugcaaugaagacacu

SEQ ID NO: 1194156 - RNA, 19 nt, Homo sapiens
cagcuggugugacaaagca

SEQ ID NO: 1194157 - RNA, 19 nt, Homo sapiens
uauaguuacccuagacaaa

SEQ ID NO: 1194158 - RNA, 19 nt, Homo sapiens
cagaugugaucaguuuaga

SEQ ID NO: 1194159 - RNA, 19 nt, Homo sapiens
caaguucagccucccagaa

SEQ ID NO: 1194160 - RNA, 19 nt, Homo sapiens
gaacaacaguggagaagca

SEQ ID NO: 1194161 - RNA, 19 nt, Homo sapiens
gcaagauguucaagaagaa

SEQ ID NO: 1194162 - RNA, 19 nt, Homo sapiens
acgcaaagcuccacacuga

SEQ ID NO: 1194163 - RNA, 19 nt, Homo sapiens
ggcaagauguucaagaaga

SEQ ID NO: 1194164 - RNA, 19 nt, Homo sapiens
gcaccuccauucccuguug

SEQ ID NO: 1194165 - RNA, 19 nt, Homo sapiens
gaagaccuuugucaaccuu

SEQ ID NO: 1194166 - RNA, 19 nt, Homo sapiens
guggcaagauguucaagaa

SEQ ID NO: 1194167 - RNA, 19 nt, Homo sapiens
ccuuguaaguucuaaauug

SEQ ID NO: 1194168 - RNA, 19 nt, Homo sapiens
uuaccaaguuccuuuauca

SEQ ID NO: 1194169 - RNA, 19 nt, Homo sapiens
cuggagagguccuggcuaa

SEQ ID NO: 1194170 - RNA, 19 nt, Homo sapiens
ggcaaagcguuccgucaga

SEQ ID NO: 1194171 - RNA, 19 nt, Homo sapiens
uggaagccauugagaucua

SEQ ID NO: 1194172 - RNA, 19 nt, Homo sapiens
cagcuucugaccacaguua

SEQ ID NO: 1194173 - RNA, 19 nt, Homo sapiens
cagcauuuguggcaagaug

SEQ ID NO: 1194174 - RNA, 19 nt, Homo sapiens
gugcagccgugaauuugga

SEQ ID NO: 1194175 - RNA, 19 nt, Homo sapiens
ggcaaggcuuucacgcaaa

SEQ ID NO: 1194176 - RNA, 19 nt, Homo sapiens
guuacgagcugcgcaaugg

SEQ ID NO: 1194177 - RNA, 19 nt, Homo sapiens
agaggaaccugucauuggu

SEQ ID NO: 1194178 - RNA, 19 nt, Homo sapiens
uuaagcaucuguacauacu

SEQ ID NO: 1194179 - RNA, 19 nt, Homo sapiens
ccuuaagcaucuguacaua

SEQ ID NO: 1194180 - RNA, 19 nt, Homo sapiens
gguggaagccauugagauc

SEQ ID NO: 1194181 - RNA, 19 nt, Homo sapiens
ggaagaccuuugucaaccu

SEQ ID NO: 1194182 - RNA, 19 nt, Homo sapiens
cagaggaaccugucauugg

SEQ ID NO: 1194183 - RNA, 19 nt, Homo sapiens
uaaagacuggguugccaaa

SEQ ID NO: 1194184 - RNA, 19 nt, Homo sapiens
aagcaucuguacauacugu

SEQ ID NO: 1194185 - RNA, 19 nt, Homo sapiens
gcuccaagcccuucaacuc

SEQ ID NO: 1194186 - RNA, 19 nt, Homo sapiens
agaagucucacgugcguaa

SEQ ID NO: 1194187 - RNA, 19 nt, Homo sapiens
gaggaacaacaguggagaa

SEQ ID NO: 1194188 - RNA, 19 nt, Homo sapiens
uggcaccuguggcaagaaa

SEQ ID NO: 1194189 - RNA, 19 nt, Homo sapiens
guaaccaccugcgcacaca

SEQ ID NO: 1194190 - RNA, 19 nt, Homo sapiens
gaaaccaucaauaaagacu

SEQ ID NO: 1194191 - RNA, 19 nt, Homo sapiens
ggagagguccuggcuaagg

SEQ ID NO: 1194192 - RNA, 19 nt, Homo sapiens
cuuguaaguucuaaauugg

SEQ ID NO: 1194193 - RNA, 19 nt, Homo sapiens
ggaagccauugagaucuac

SEQ ID NO: 1194194 - RNA, 19 nt, Homo sapiens
gagcggccauacccauguc

SEQ ID NO: 1194195 - RNA, 19 nt, Homo sapiens
gcaccgcuaccaucacaca

SEQ ID NO: 1194196 - RNA, 19 nt, Homo sapiens
cagaggugccugugucuca

SEQ ID NO: 1194197 - RNA, 19 nt, Homo sapiens
gcauuuguggcaagauguu

SEQ ID NO: 1194198 - RNA, 19 nt, Homo sapiens
gcaccuguggcaagaaagu

SEQ ID NO: 1194199 - RNA, 19 nt, Homo sapiens
ccugugcagccgugaauuu

SEQ ID NO: 1194200 - RNA, 19 nt, Homo sapiens
ccagaggaaccugucauug

SEQ ID NO: 1194201 - RNA, 19 nt, Homo sapiens
cccaccaccuuguaaguuc

SEQ ID NO: 1194202 - RNA, 19 nt, Homo sapiens
uccauucccuguugcugaa

SEQ ID NO: 1194203 - RNA, 19 nt, Homo sapiens
gcccuuugccugugaagug

SEQ ID NO: 1194204 - RNA, 19 nt, Homo sapiens
uagcagcgagucacacuuc

SEQ ID NO: 1194205 - RNA, 19 nt, Homo sapiens
agaguacccaccugaaaga

SEQ ID NO: 1194206 - RNA, 19 nt, Homo sapiens
cagaguacccaccugaaag

SEQ ID NO: 1194207 - RNA, 19 nt, Homo sapiens
ccacacaggagcucuucug

SEQ ID NO: 1194208 - RNA, 19 nt, Homo sapiens
uugucaaccuuaccaaguu

SEQ ID NO: 1194209 - RNA, 19 nt, Homo sapiens
aaagcguuccgucagagua

SEQ ID NO: 1194210 - RNA, 19 nt, Homo sapiens
ccugugcagucgugucuuc

SEQ ID NO: 1194211 - RNA, 19 nt, Homo sapiens
uaucaccggcguacucaug

SEQ ID NO: 1194212 - RNA, 19 nt, Homo sapiens
ugucaaccuuaccaaguuc

SEQ ID NO: 1194213 - RNA, 19 nt, Homo sapiens
ccaugcgccuggcagaaca

SEQ ID NO: 1194214 - RNA, 19 nt, Homo sapiens
gugaauaccccuacaagug

SEQ ID NO: 1194215 - RNA, 19 nt, Homo sapiens
ugacccggcaccaacguuu

SEQ ID NO: 1194216 - RNA, 19 nt, Homo sapiens
gugggaagaccuuugucaa

SEQ ID NO: 1194217 - RNA, 19 nt, Homo sapiens
gguccuugacacacauaaa

SEQ ID NO: 1194218 - RNA, 19 nt, Homo sapiens
ggcugacucugcccgacuu

SEQ ID NO: 1194219 - RNA, 19 nt, Homo sapiens
ggccacucgugcaccaguu

SEQ ID NO: 1194220 - RNA, 19 nt, Homo sapiens
ccucuuagcucaaauaauu

SEQ ID NO: 1194221 - RNA, 19 nt, Homo sapiens
gcacaauaguguuuacaaa

SEQ ID NO: 1194222 - RNA, 19 nt, Homo sapiens
ucaaaugagugacagguua

SEQ ID NO: 1194223 - RNA, 19 nt, Homo sapiens
ggacuaauguuccgacguu

SEQ ID NO: 1194224 - RNA, 19 nt, Homo sapiens
gcauuuaacugcuuucuuc

SEQ ID NO: 1194225 - RNA, 19 nt, Homo sapiens
gguacuagcugccuugauu

SEQ ID NO: 1194226 - RNA, 19 nt, Homo sapiens
uaacguggauguaauauag

SEQ ID NO: 1194227 - RNA, 19 nt, Homo sapiens
gagaagagaugagagaaga

SEQ ID NO: 1194228 - RNA, 19 nt, Homo sapiens
ggagaagaauccuauugaa

SEQ ID NO: 1194229 - RNA, 19 nt, Homo sapiens
acaaucacauuuccucuua

SEQ ID NO: 1194230 - RNA, 19 nt, Homo sapiens
ggauauaccucuucaggau

SEQ ID NO: 1194231 - RNA, 19 nt, Homo sapiens
caccaugccuggcuaauuu

SEQ ID NO: 1194232 - RNA, 19 nt, Homo sapiens
ggucuuagcccaaaugaaa

SEQ ID NO: 1194233 - RNA, 19 nt, Homo sapiens
gaaugucccuaaguguuua

SEQ ID NO: 1194234 - RNA, 19 nt, Homo sapiens
guagggaacuguagucuag

SEQ ID NO: 1194235 - RNA, 19 nt, Homo sapiens
gugaugcucugcuugauaa

SEQ ID NO: 1194236 - RNA, 19 nt, Homo sapiens
gcaguuguguuuaauguca

SEQ ID NO: 1194237 - RNA, 19 nt, Homo sapiens
caagucaaguugugaaaug

SEQ ID NO: 1194238 - RNA, 19 nt, Homo sapiens
gagaagaauccuauugaaa

SEQ ID NO: 1194239 - RNA, 19 nt, Homo sapiens
gauaacuugugaauggaua

SEQ ID NO: 1194240 - RNA, 19 nt, Homo sapiens
gaaaggccaugagagaaga

SEQ ID NO: 1194241 - RNA, 19 nt, Homo sapiens
gggaacgcuuggucauuua

SEQ ID NO: 1194242 - RNA, 19 nt, Homo sapiens
uuagauaacuugugaaugg

SEQ ID NO: 1194243 - RNA, 19 nt, Homo sapiens
gaagaauccuauugaaagg

SEQ ID NO: 1194244 - RNA, 19 nt, Homo sapiens
caaagucauuccuguucua

SEQ ID NO: 1194245 - RNA, 19 nt, Homo sapiens
ggaguuauccugcagaaau

SEQ ID NO: 1194246 - RNA, 19 nt, Homo sapiens
guuauucucucuuuacaga

SEQ ID NO: 1194247 - RNA, 19 nt, Homo sapiens
uauaauaccuuguggucuu

SEQ ID NO: 1194248 - RNA, 19 nt, Homo sapiens
ucucauugcucauauagaa

SEQ ID NO: 1194249 - RNA, 19 nt, Homo sapiens
ggcaguaguugaaaucuau

SEQ ID NO: 1194250 - RNA, 19 nt, Homo sapiens
acagauagcuauagacauc

SEQ ID NO: 1194251 - RNA, 19 nt, Homo sapiens
gaugaaaggccaugagaga

SEQ ID NO: 1194252 - RNA, 19 nt, Homo sapiens
gagcuguucucuagugguu

SEQ ID NO: 1194253 - RNA, 19 nt, Homo sapiens
ggauggagcaggagaagaa

SEQ ID NO: 1194254 - RNA, 19 nt, Homo sapiens
ggaucaaguucaucauaug

SEQ ID NO: 1194255 - RNA, 19 nt, Homo sapiens
caauaacucugccuggaau

SEQ ID NO: 1194256 - RNA, 19 nt, Homo sapiens
uggaauucuugcuguauua

SEQ ID NO: 1194257 - RNA, 19 nt, Homo sapiens
aaacuaagaccaggacuaa

SEQ ID NO: 1194258 - RNA, 19 nt, Homo sapiens
guaaggagccugaaauaac

SEQ ID NO: 1194259 - RNA, 19 nt, Homo sapiens
gcuguucucuagugguuaa

SEQ ID NO: 1194260 - RNA, 19 nt, Homo sapiens
caaaggcaguaguugaaau

SEQ ID NO: 1194261 - RNA, 19 nt, Homo sapiens
gacagaagacuuauaauac

SEQ ID NO: 1194262 - RNA, 19 nt, Homo sapiens
ugagaucucugguuguuuc

SEQ ID NO: 1194263 - RNA, 19 nt, Homo sapiens
cugcaaagauacagucuga

SEQ ID NO: 1194264 - RNA, 19 nt, Homo sapiens
gacaggauuucuccauguu

SEQ ID NO: 1194265 - RNA, 19 nt, Homo sapiens
ggagugcaauggcguaucu

SEQ ID NO: 1194266 - RNA, 19 nt, Homo sapiens
guauuggccucuaagucua

SEQ ID NO: 1194267 - RNA, 19 nt, Homo sapiens
guaaugcauucuaaacauc

SEQ ID NO: 1194268 - RNA, 19 nt, Homo sapiens
ugucuuagccuccugagua

SEQ ID NO: 1194269 - RNA, 19 nt, Homo sapiens
ggagcagcauuucauguuc

SEQ ID NO: 1194270 - RNA, 19 nt, Homo sapiens
gauaaggacgagacugauu

SEQ ID NO: 1194271 - RNA, 19 nt, Homo sapiens
gaucuuaagguuugguauu

SEQ ID NO: 1194272 - RNA, 19 nt, Homo sapiens
uauagccuguguuuaguuu

SEQ ID NO: 1194273 - RNA, 19 nt, Homo sapiens
aagggauucuccugucuua

SEQ ID NO: 1194274 - RNA, 19 nt, Homo sapiens
cuuaauggaugucuuagga

SEQ ID NO: 1194275 - RNA, 19 nt, Homo sapiens
gcaaagucauuccuguucu

SEQ ID NO: 1194276 - RNA, 19 nt, Homo sapiens
gaguuauccugcagaaaug

SEQ ID NO: 1194277 - RNA, 19 nt, Homo sapiens
gcaaguguuaggugcauuu

SEQ ID NO: 1194278 - RNA, 19 nt, Homo sapiens
caaaugagugacagguuaa

SEQ ID NO: 1194279 - RNA, 19 nt, Homo sapiens
gacugaauguguaauagga

SEQ ID NO: 1194280 - RNA, 19 nt, Homo sapiens
uuucaucaaucccaucuuu

SEQ ID NO: 1194281 - RNA, 19 nt, Homo sapiens
gcaauccaggacauuauaa

SEQ ID NO: 1194282 - RNA, 19 nt, Homo sapiens
gaagagaugagagaagaug

SEQ ID NO: 1194283 - RNA, 19 nt, Homo sapiens
gugagccaguguuagauaa

SEQ ID NO: 1194284 - RNA, 19 nt, Homo sapiens
gaaauggugguucacacaa

SEQ ID NO: 1194285 - RNA, 19 nt, Homo sapiens
ugaaugucccuaaguguuu

SEQ ID NO: 1194286 - RNA, 19 nt, Homo sapiens
gaagggaucagccccaaua

SEQ ID NO: 1194287 - RNA, 19 nt, Homo sapiens
uagcaguuguguuuaaugu

SEQ ID NO: 1194288 - RNA, 19 nt, Homo sapiens
gcagcuuaauuaaaucugu

SEQ ID NO: 1194289 - RNA, 19 nt, Homo sapiens
agugacagguuaacuagaa

SEQ ID NO: 1194290 - RNA, 19 nt, Homo sapiens
uggaauagcuagcauugca

SEQ ID NO: 1194291 - RNA, 19 nt, Homo sapiens
ggugucaguugauauuuag

SEQ ID NO: 1194292 - RNA, 19 nt, Homo sapiens
ggagucucauugcucauau

SEQ ID NO: 1194293 - RNA, 19 nt, Homo sapiens
caaguaaggagccugaaau

SEQ ID NO: 1194294 - RNA, 19 nt, Homo sapiens
ugaccacucugcucuuuag

SEQ ID NO: 1194295 - RNA, 19 nt, Homo sapiens
uaacaaccccucuuacuuu

SEQ ID NO: 1194296 - RNA, 19 nt, Homo sapiens
ucugguaccucaaagaaau

SEQ ID NO: 1194297 - RNA, 19 nt, Homo sapiens
ggacacuaaccaaggauga

SEQ ID NO: 1194298 - RNA, 19 nt, Homo sapiens
gagucucauugcucauaua

SEQ ID NO: 1194299 - RNA, 19 nt, Homo sapiens
uggugucaguugauauuua

SEQ ID NO: 1194300 - RNA, 19 nt, Homo sapiens
ugaagucccuccugauuuu

SEQ ID NO: 1194301 - RNA, 19 nt, Homo sapiens
ccagacuucucguacaguu

SEQ ID NO: 1194302 - RNA, 19 nt, Homo sapiens
aaugagaucucugguuguu

SEQ ID NO: 1194303 - RNA, 19 nt, Homo sapiens
gccucuaagucuaauauug

SEQ ID NO: 1194304 - RNA, 19 nt, Homo sapiens
ggccgguuauucucucuuu

SEQ ID NO: 1194305 - RNA, 19 nt, Homo sapiens
ggaguugguuauucucucu

SEQ ID NO: 1194306 - RNA, 19 nt, Homo sapiens
uaaccaaaguugacagacu

SEQ ID NO: 1194307 - RNA, 19 nt, Homo sapiens
ccugauaccuaguuucaca

SEQ ID NO: 1194308 - RNA, 19 nt, Homo sapiens
ccuccuugcugucuuuauu

SEQ ID NO: 1194309 - RNA, 19 nt, Homo sapiens
ccacucugcucuuuaggau

SEQ ID NO: 1194310 - RNA, 19 nt, Homo sapiens
agaagaauccuauugaaag

SEQ ID NO: 1194311 - RNA, 19 nt, Homo sapiens
gagcagcauuucauguucu

SEQ ID NO: 1194312 - RNA, 19 nt, Homo sapiens
gcucucuucuucaaacaau

SEQ ID NO: 1194313 - RNA, 19 nt, Homo sapiens
uuucaaagcugcauaucuc

SEQ ID NO: 1194314 - RNA, 19 nt, Homo sapiens
guaacuguugcaccauuua

SEQ ID NO: 1194315 - RNA, 19 nt, Homo sapiens
ggagugaagggacaggauu

SEQ ID NO: 1194316 - RNA, 19 nt, Homo sapiens
gcaccuggccgguuauucu

SEQ ID NO: 1194317 - RNA, 19 nt, Homo sapiens
agacggaguuucgcuguug

SEQ ID NO: 1194318 - RNA, 19 nt, Homo sapiens
caucuuacuuugacagaag

SEQ ID NO: 1194319 - RNA, 19 nt, Homo sapiens
ggcaauccaggacauuaua

SEQ ID NO: 1194320 - RNA, 19 nt, Homo sapiens
gcaagaucgucaacuauua

SEQ ID NO: 1194321 - RNA, 19 nt, Homo sapiens
ggaagcagaucagcaaaua

SEQ ID NO: 1194322 - RNA, 19 nt, Homo sapiens
uaacgaaggugcagcagua

SEQ ID NO: 1194323 - RNA, 19 nt, Homo sapiens
aagcgaagauugcacauua

SEQ ID NO: 1194324 - RNA, 19 nt, Homo sapiens
cagaacaacuugaagauau

SEQ ID NO: 1194325 - RNA, 19 nt, Homo sapiens
gugaaaccauggaauuaua

SEQ ID NO: 1194326 - RNA, 19 nt, Homo sapiens
ccaccagacuccuaacaua

SEQ ID NO: 1194327 - RNA, 19 nt, Homo sapiens
gcucaugucugauucucua

SEQ ID NO: 1194328 - RNA, 19 nt, Homo sapiens
ucagcuaccuuuagaguuu

SEQ ID NO: 1194329 - RNA, 19 nt, Homo sapiens
ugaguuacauggucacuuu

SEQ ID NO: 1194330 - RNA, 19 nt, Homo sapiens
gaagccagcccuuucagua

SEQ ID NO: 1194331 - RNA, 19 nt, Homo sapiens
gaagaccucggaagagaua

SEQ ID NO: 1194332 - RNA, 19 nt, Homo sapiens
ggaagaagaccucggaaga

SEQ ID NO: 1194333 - RNA, 19 nt, Homo sapiens
gaaacaacuuccuggacaa

SEQ ID NO: 1194334 - RNA, 19 nt, Homo sapiens
gaagagcacuagaaacaac

SEQ ID NO: 1194335 - RNA, 19 nt, Homo sapiens
gcacagaacaacuugaaga

SEQ ID NO: 1194336 - RNA, 19 nt, Homo sapiens
gagaugagcuguucuuucc

SEQ ID NO: 1194337 - RNA, 19 nt, Homo sapiens
gggaagacguucuggauag

SEQ ID NO: 1194338 - RNA, 19 nt, Homo sapiens
gaagauugcacauuaguuc

SEQ ID NO: 1194339 - RNA, 19 nt, Homo sapiens
uaaccagacuccaaaccua

SEQ ID NO: 1194340 - RNA, 19 nt, Homo sapiens
ggaggcuuauuguaacaua

SEQ ID NO: 1194341 - RNA, 19 nt, Homo sapiens
gagcuguucuuucccacua

SEQ ID NO: 1194342 - RNA, 19 nt, Homo sapiens
gcacauuaguucuccacaa

SEQ ID NO: 1194343 - RNA, 19 nt, Homo sapiens
cgcaugagaugaagcauaa

SEQ ID NO: 1194344 - RNA, 19 nt, Homo sapiens
cuaugugccuuccuaauuu

SEQ ID NO: 1194345 - RNA, 19 nt, Homo sapiens
uaauggaggcuuauuguaa

SEQ ID NO: 1194346 - RNA, 19 nt, Homo sapiens
gcgaaaagccuuauucuaa

SEQ ID NO: 1194347 - RNA, 19 nt, Homo sapiens
ccacaaggucuaacucuuu

SEQ ID NO: 1194348 - RNA, 19 nt, Homo sapiens
ggacugcuccaucaugauu

SEQ ID NO: 1194349 - RNA, 19 nt, Homo sapiens
gcuagguuguacagacuua

SEQ ID NO: 1194350 - RNA, 19 nt, Homo sapiens
acaaauagaugggccuuau

SEQ ID NO: 1194351 - RNA, 19 nt, Homo sapiens
gaagauggacgagaaugaa

SEQ ID NO: 1194352 - RNA, 19 nt, Homo sapiens
guguagagauuaagccaaa

SEQ ID NO: 1194353 - RNA, 19 nt, Homo sapiens
gcuaugugccuuccuaauu

SEQ ID NO: 1194354 - RNA, 19 nt, Homo sapiens
gaaacuauuuugcugauug

SEQ ID NO: 1194355 - RNA, 19 nt, Homo sapiens
aaccagggcucaugucuga

SEQ ID NO: 1194356 - RNA, 19 nt, Homo sapiens
aaauggaaguguccguuaa

SEQ ID NO: 1194357 - RNA, 19 nt, Homo sapiens
gaauugaagagcacuagaa

SEQ ID NO: 1194358 - RNA, 19 nt, Homo sapiens
gaugccagcucugaucaaa

SEQ ID NO: 1194359 - RNA, 19 nt, Homo sapiens
aaacagagaaugcacuuug

SEQ ID NO: 1194360 - RNA, 19 nt, Homo sapiens
gaaguuuccuccaaauagg

SEQ ID NO: 1194361 - RNA, 19 nt, Homo sapiens
gccaaggacugcuccauca

SEQ ID NO: 1194362 - RNA, 19 nt, Homo sapiens
gaaugcacuuugccuugaa

SEQ ID NO: 1194363 - RNA, 19 nt, Homo sapiens
ggaagauggacgagaauga

SEQ ID NO: 1194364 - RNA, 19 nt, Homo sapiens
gaccuuugguugugaaugu

SEQ ID NO: 1194365 - RNA, 19 nt, Homo sapiens
gcugaaugauagagauauu

SEQ ID NO: 1194366 - RNA, 19 nt, Homo sapiens
uaugugccuuccuaauuua

SEQ ID NO: 1194367 - RNA, 19 nt, Homo sapiens
ccaggaagcugcucacacu

SEQ ID NO: 1194368 - RNA, 19 nt, Homo sapiens
caaggaauguaggaaguga

SEQ ID NO: 1194369 - RNA, 19 nt, Homo sapiens
gaaggccucuacccucugu

SEQ ID NO: 1194370 - RNA, 19 nt, Homo sapiens
cggaagagauauuucaaca

SEQ ID NO: 1194371 - RNA, 19 nt, Homo sapiens
ggaagcugcucacacucuu

SEQ ID NO: 1194372 - RNA, 19 nt, Homo sapiens
gacaaggaauguaggaagu

SEQ ID NO: 1194373 - RNA, 19 nt, Homo sapiens
gcagugucuuugaaacuug

SEQ ID NO: 1194374 - RNA, 19 nt, Homo sapiens
uaagaauggugagcugauu

SEQ ID NO: 1194375 - RNA, 19 nt, Homo sapiens
acaaggaccuggauacucu

SEQ ID NO: 1194376 - RNA, 19 nt, Homo sapiens
ugugaaggcugaaugauag

SEQ ID NO: 1194377 - RNA, 19 nt, Homo sapiens
uagaugggccuuaugauga

SEQ ID NO: 1194378 - RNA, 19 nt, Homo sapiens
ccacauaucaacacagguu

SEQ ID NO: 1194379 - RNA, 19 nt, Homo sapiens
gaucgucaacuauuauuca

SEQ ID NO: 1194380 - RNA, 19 nt, Homo sapiens
uggauacucucagugguua

SEQ ID NO: 1194381 - RNA, 19 nt, Homo sapiens
aagaagaccucggaagaga

SEQ ID NO: 1194382 - RNA, 19 nt, Homo sapiens
cauaaggucugucgauacu

SEQ ID NO: 1194383 - RNA, 19 nt, Homo sapiens
gaagcugcucacacucuua

SEQ ID NO: 1194384 - RNA, 19 nt, Homo sapiens
ggcaagaucgucaacuauu

SEQ ID NO: 1194385 - RNA, 19 nt, Homo sapiens
ggaccuggauacucucagu

SEQ ID NO: 1194386 - RNA, 19 nt, Homo sapiens
cccaacagcucagugcuuu

SEQ ID NO: 1194387 - RNA, 19 nt, Homo sapiens
ggaagacguucuggauagu

SEQ ID NO: 1194388 - RNA, 19 nt, Homo sapiens
gauauuuucuguuguguug

SEQ ID NO: 1194389 - RNA, 19 nt, Homo sapiens
caagaucgucaacuauuau

SEQ ID NO: 1194390 - RNA, 19 nt, Homo sapiens
ggagaugagcuguucuuuc

SEQ ID NO: 1194391 - RNA, 19 nt, Homo sapiens
ccagacuccuaacauagaa

SEQ ID NO: 1194392 - RNA, 19 nt, Homo sapiens
cgucaacuauuauucaaag

SEQ ID NO: 1194393 - RNA, 19 nt, Homo sapiens
gauucuguguguagagauu

SEQ ID NO: 1194394 - RNA, 19 nt, Homo sapiens
cuugagacguguugcguuu

SEQ ID NO: 1194395 - RNA, 19 nt, Homo sapiens
aaauagaugggccuuauga

SEQ ID NO: 1194396 - RNA, 19 nt, Homo sapiens
ggacaucgaaggccucuac

SEQ ID NO: 1194397 - RNA, 19 nt, Homo sapiens
agaauggugagcugauuua

SEQ ID NO: 1194398 - RNA, 19 nt, Homo sapiens
agaaugcacuuugccuuga

SEQ ID NO: 1194399 - RNA, 19 nt, Homo sapiens
gaagaagaccucggaagag

SEQ ID NO: 1194400 - RNA, 19 nt, Homo sapiens
aaauguggguuuauuccuu

SEQ ID NO: 1194401 - RNA, 19 nt, Homo sapiens
ggaaacaaacagagaaugc

SEQ ID NO: 1194402 - RNA, 19 nt, Homo sapiens
ucaaggaaagcgaagauug

SEQ ID NO: 1194403 - RNA, 19 nt, Homo sapiens
caaagacaacgccgugaug

SEQ ID NO: 1194404 - RNA, 19 nt, Homo sapiens
gcagaucagcaaauacugu

SEQ ID NO: 1194405 - RNA, 19 nt, Homo sapiens
ggaaucuugguuucaguuu

SEQ ID NO: 1194406 - RNA, 19 nt, Homo sapiens
cacaaggucuaacucuuuc

SEQ ID NO: 1194407 - RNA, 19 nt, Homo sapiens
gccuuaugaugaagcauuu

SEQ ID NO: 1194408 - RNA, 19 nt, Homo sapiens
aauguggguuuauuccuuu

SEQ ID NO: 1194409 - RNA, 19 nt, Homo sapiens
gaaaccauggaauuauaug

SEQ ID NO: 1194410 - RNA, 19 nt, Homo sapiens
gguuguacagacuuauuua

SEQ ID NO: 1194411 - RNA, 19 nt, Homo sapiens
cauaguggacuuugggaaa

SEQ ID NO: 1194412 - RNA, 19 nt, Homo sapiens
gcuguucuuucccacuaaa

SEQ ID NO: 1194413 - RNA, 19 nt, Homo sapiens
cacauuaguucuccacaag

SEQ ID NO: 1194414 - RNA, 19 nt, Homo sapiens
aaggacugcuccaucauga

SEQ ID NO: 1194415 - RNA, 19 nt, Homo sapiens
agaugggccuuaugaugaa

SEQ ID NO: 1194416 - RNA, 19 nt, Homo sapiens
gaaacaaacagagaaugca

SEQ ID NO: 1194417 - RNA, 19 nt, Homo sapiens
uagugaaaccauggaauua

SEQ ID NO: 1194418 - RNA, 19 nt, Homo sapiens
ggacuaauggaggcuuauu

SEQ ID NO: 1194419 - RNA, 19 nt, Homo sapiens
gcaaggcucaggucaggau

SEQ ID NO: 1194420 - RNA, 19 nt, Homo sapiens
gaacacaagucacauuuca

SEQ ID NO: 1194421 - RNA, 19 nt, Homo sapiens
uaacagaacugcaggaaga

SEQ ID NO: 1194422 - RNA, 19 nt, Homo sapiens
ggauugaucugaaguuaaa

SEQ ID NO: 1194423 - RNA, 19 nt, Homo sapiens
gacauugggucuuacuuua

SEQ ID NO: 1194424 - RNA, 19 nt, Homo sapiens
gcaggaagaugaagacaau

SEQ ID NO: 1194425 - RNA, 19 nt, Homo sapiens
gaaggaaccggaaguuuaa

SEQ ID NO: 1194426 - RNA, 19 nt, Homo sapiens
gaaaguagaacacaaguca

SEQ ID NO: 1194427 - RNA, 19 nt, Homo sapiens
cgaaggaaccggaaguuua

SEQ ID NO: 1194428 - RNA, 19 nt, Homo sapiens
ggaagacacucagauguau

SEQ ID NO: 1194429 - RNA, 19 nt, Homo sapiens
gguaguagauucauguuca

SEQ ID NO: 1194430 - RNA, 19 nt, Homo sapiens
gauggaggcuguaaauauc

SEQ ID NO: 1194431 - RNA, 19 nt, Homo sapiens
gaagugggacggaaaguga

SEQ ID NO: 1194432 - RNA, 19 nt, Homo sapiens
gugcguuucucccuucuua

SEQ ID NO: 1194433 - RNA, 19 nt, Homo sapiens
gcggaaacauuggcaaauu

SEQ ID NO: 1194434 - RNA, 19 nt, Homo sapiens
uaucaugccuuauggaaau

SEQ ID NO: 1194435 - RNA, 19 nt, Homo sapiens
ugacauaucugaucaucuc

SEQ ID NO: 1194436 - RNA, 19 nt, Homo sapiens
uaaauguggugacaaacaa

SEQ ID NO: 1194437 - RNA, 19 nt, Homo sapiens
ucagauguauggcaauauu

SEQ ID NO: 1194438 - RNA, 19 nt, Homo sapiens
cggaaacauuggcaaauuu

SEQ ID NO: 1194439 - RNA, 19 nt, Homo sapiens
gcacaggauugaucugaag

SEQ ID NO: 1194440 - RNA, 19 nt, Homo sapiens
gcaguugccaauauucaua

SEQ ID NO: 1194441 - RNA, 19 nt, Homo sapiens
caggauugaucugaaguua

SEQ ID NO: 1194442 - RNA, 19 nt, Homo sapiens
gcaccagcuucaucuguga

SEQ ID NO: 1194443 - RNA, 19 nt, Homo sapiens
acaaacaagucauuucugu

SEQ ID NO: 1194444 - RNA, 19 nt, Homo sapiens
guagauucauguucaagga

SEQ ID NO: 1194445 - RNA, 19 nt, Homo sapiens
cauaucugaucaucucuuu

SEQ ID NO: 1194446 - RNA, 19 nt, Homo sapiens
gugauacccuucaagaaau

SEQ ID NO: 1194447 - RNA, 19 nt, Homo sapiens
gaagaugaagacaauguug

SEQ ID NO: 1194448 - RNA, 19 nt, Homo sapiens
ggaaacauuggcaaauuug

SEQ ID NO: 1194449 - RNA, 19 nt, Homo sapiens
auacuuuccugcugacaua

SEQ ID NO: 1194450 - RNA, 19 nt, Homo sapiens
ucucugaccucacaaagau

SEQ ID NO: 1194451 - RNA, 19 nt, Homo sapiens
acaagucauuucuguaaga

SEQ ID NO: 1194452 - RNA, 19 nt, Homo sapiens
caaacaagucauuucugua

SEQ ID NO: 1194453 - RNA, 19 nt, Homo sapiens
ggagcuggcggaaacauug

SEQ ID NO: 1194454 - RNA, 19 nt, Homo sapiens
gaaauguucucugguuuug

SEQ ID NO: 1194455 - RNA, 19 nt, Homo sapiens
ugugauacccuucaagaaa

SEQ ID NO: 1194456 - RNA, 19 nt, Homo sapiens
ugacacuucuccagacuuc

SEQ ID NO: 1194457 - RNA, 19 nt, Homo sapiens
gaaccggaaguuuaaggaa

SEQ ID NO: 1194458 - RNA, 19 nt, Homo sapiens
guaguagauucauguucaa

SEQ ID NO: 1194459 - RNA, 19 nt, Homo sapiens
guagaacacaagucacauu

SEQ ID NO: 1194460 - RNA, 19 nt, Homo sapiens
ggaagaugaagacaauguu

SEQ ID NO: 1194461 - RNA, 19 nt, Homo sapiens
cauugggucuuacuuuaug

SEQ ID NO: 1194462 - RNA, 19 nt, Homo sapiens
uucaguaaauccucgguua

SEQ ID NO: 1194463 - RNA, 19 nt, Homo sapiens
aaacauccuucaccugagu

SEQ ID NO: 1194464 - RNA, 19 nt, Homo sapiens
cgagcugacuauuagaaga

SEQ ID NO: 1194465 - RNA, 19 nt, Homo sapiens
uggaagacacucagaugua

SEQ ID NO: 1194466 - RNA, 19 nt, Homo sapiens
ucaugcaguugccaauauu

SEQ ID NO: 1194467 - RNA, 19 nt, Homo sapiens
guaguuuguucuaaaugug

SEQ ID NO: 1194468 - RNA, 19 nt, Homo sapiens
ucacaaagauaaacauccu

SEQ ID NO: 1194469 - RNA, 19 nt, Homo sapiens
acucagauguauggcaaua

SEQ ID NO: 1194470 - RNA, 19 nt, Homo sapiens
acacaagucacauuucaga

SEQ ID NO: 1194471 - RNA, 19 nt, Homo sapiens
uagaacacaagucacauuu

SEQ ID NO: 1194472 - RNA, 19 nt, Homo sapiens
agauggaggcuguaaauau

SEQ ID NO: 1194473 - RNA, 19 nt, Homo sapiens
cgacagaucuaugcuuuug

SEQ ID NO: 1194474 - RNA, 19 nt, Homo sapiens
ccugugacuuugaguaguu

SEQ ID NO: 1194475 - RNA, 19 nt, Homo sapiens
uaucugaucaucucuuuca

SEQ ID NO: 1194476 - RNA, 19 nt, Homo sapiens
cagauguauggcaauauua

SEQ ID NO: 1194477 - RNA, 19 nt, Homo sapiens
gaagacacucagauguaug

SEQ ID NO: 1194478 - RNA, 19 nt, Homo sapiens
ggaggacccugaggaucug

SEQ ID NO: 1194479 - RNA, 19 nt, Homo sapiens
gaaaagagggagccaggaa

SEQ ID NO: 1194480 - RNA, 19 nt, Homo sapiens
caaauucucaugcuuuacu

SEQ ID NO: 1194481 - RNA, 19 nt, Homo sapiens
ucagauggaggcuguaaau

SEQ ID NO: 1194482 - RNA, 19 nt, Homo sapiens
ggcacaggauugaucugaa

SEQ ID NO: 1194483 - RNA, 19 nt, Homo sapiens
guucaggaccagcucauug

SEQ ID NO: 1194484 - RNA, 19 nt, Homo sapiens
gcugacauaucugaucauc

SEQ ID NO: 1194485 - RNA, 19 nt, Homo sapiens
aaccacgagcugacuauua

SEQ ID NO: 1194486 - RNA, 19 nt, Homo sapiens
acauggcgaugcacaacaa

SEQ ID NO: 1194487 - RNA, 19 nt, Homo sapiens
agcgacagaucuaugcuuu

SEQ ID NO: 1194488 - RNA, 19 nt, Homo sapiens
cuucaaauucucaugcuuu

SEQ ID NO: 1194489 - RNA, 19 nt, Homo sapiens
ggaaccggaaguuuaagga

SEQ ID NO: 1194490 - RNA, 19 nt, Homo sapiens
aaauuucacaggcuucaaa

SEQ ID NO: 1194491 - RNA, 19 nt, Homo sapiens
acaagucacauuucagaug

SEQ ID NO: 1194492 - RNA, 19 nt, Homo sapiens
ugauacccuucaagaaaug

SEQ ID NO: 1194493 - RNA, 19 nt, Homo sapiens
cagaacugcaggaagauga

SEQ ID NO: 1194494 - RNA, 19 nt, Homo sapiens
ggaagugggacggaaagug

SEQ ID NO: 1194495 - RNA, 19 nt, Homo sapiens
cagauggaggcuguaaaua

SEQ ID NO: 1194496 - RNA, 19 nt, Homo sapiens
guucucugguuuuguuuua

SEQ ID NO: 1194497 - RNA, 19 nt, Homo sapiens
accacgagcugacuauuag

SEQ ID NO: 1194498 - RNA, 19 nt, Homo sapiens
gcaaauuuggagcgacaga

SEQ ID NO: 1194499 - RNA, 19 nt, Homo sapiens
cuccagacuuccacaauca

SEQ ID NO: 1194500 - RNA, 19 nt, Homo sapiens
ucacaggcuucaaauucuc

SEQ ID NO: 1194501 - RNA, 19 nt, Homo sapiens
uuucacaggcuucaaauuc

SEQ ID NO: 1194502 - RNA, 19 nt, Homo sapiens
uuucugaguugguaguaga

SEQ ID NO: 1194503 - RNA, 19 nt, Homo sapiens
cuuaaaucuuucugaguug

SEQ ID NO: 1194504 - RNA, 19 nt, Homo sapiens
aaacauuggcaaauuugga

SEQ ID NO: 1194505 - RNA, 19 nt, Homo sapiens
cuaaauguggugacaaaca

SEQ ID NO: 1194506 - RNA, 19 nt, Homo sapiens
ugagggaagcuaccuggaa

SEQ ID NO: 1194507 - RNA, 19 nt, Homo sapiens
cugcugacauaucugauca

SEQ ID NO: 1194508 - RNA, 19 nt, Homo sapiens
uuguacagcucauacuuuc

SEQ ID NO: 1194509 - RNA, 19 nt, Homo sapiens
caucugugauacccuucaa

SEQ ID NO: 1194510 - RNA, 19 nt, Homo sapiens
gaucgaaggaaccggaagu

SEQ ID NO: 1194511 - RNA, 19 nt, Homo sapiens
gacuuugaguaguuuguuc

SEQ ID NO: 1194512 - RNA, 19 nt, Homo sapiens
aaaucuuucugaguuggua

SEQ ID NO: 1194513 - RNA, 19 nt, Homo sapiens
gcugaaaguagaacacaag

SEQ ID NO: 1194514 - RNA, 19 nt, Homo sapiens
gcguuucucccuucuuaga

SEQ ID NO: 1194515 - RNA, 19 nt, Homo sapiens
uucuaaauguggugacaaa

SEQ ID NO: 1194516 - RNA, 19 nt, Homo sapiens
gagcgacagaucuaugcuu

SEQ ID NO: 1194517 - RNA, 19 nt, Homo sapiens
gaaacauuggcaaauuugg

SEQ ID NO: 1194518 - RNA, 19 nt, Homo sapiens
ccaggaagugggacggaaa

SEQ ID NO: 1194519 - RNA, 19 nt, Homo sapiens
gcuucaaauucucaugcuu

SEQ ID NO: 1194520 - RNA, 19 nt, Homo sapiens
gaacaagacuucagaaaug

SEQ ID NO: 1194521 - RNA, 19 nt, Homo sapiens
gaacaucccuaauggaauu

SEQ ID NO: 1194522 - RNA, 19 nt, Homo sapiens
ggaauaaccuuaccaaauc

SEQ ID NO: 1194523 - RNA, 19 nt, Homo sapiens
gaacuuggcuauauugaau

SEQ ID NO: 1194524 - RNA, 19 nt, Homo sapiens
gaagcugaauguuguguua

SEQ ID NO: 1194525 - RNA, 19 nt, Homo sapiens
ggacaggcuuuaucauuaa

SEQ ID NO: 1194526 - RNA, 19 nt, Homo sapiens
gaaauucagagguugauua

SEQ ID NO: 1194527 - RNA, 19 nt, Homo sapiens
guuaacauauggcuucuua

SEQ ID NO: 1194528 - RNA, 19 nt, Homo sapiens
ccacggcgguuaauucuuu

SEQ ID NO: 1194529 - RNA, 19 nt, Homo sapiens
guggauaacuaggaaauua

SEQ ID NO: 1194530 - RNA, 19 nt, Homo sapiens
caucuuaaguucacaauug

SEQ ID NO: 1194531 - RNA, 19 nt, Homo sapiens
acacacagcuccucaagaa

SEQ ID NO: 1194532 - RNA, 19 nt, Homo sapiens
gagccacuuucuacaauua

SEQ ID NO: 1194533 - RNA, 19 nt, Homo sapiens
cgaaggcaguugagaauuu

SEQ ID NO: 1194534 - RNA, 19 nt, Homo sapiens
agaagaaaguuguggauaa

SEQ ID NO: 1194535 - RNA, 19 nt, Homo sapiens
ugagauauauugacacuga

SEQ ID NO: 1194536 - RNA, 19 nt, Homo sapiens
caacacagcuagucagcaa

SEQ ID NO: 1194537 - RNA, 19 nt, Homo sapiens
caaagaacaucccuaaugg

SEQ ID NO: 1194538 - RNA, 19 nt, Homo sapiens
acaagaggauucagaaauu

SEQ ID NO: 1194539 - RNA, 19 nt, Homo sapiens
agaaacagauaccuaauga

SEQ ID NO: 1194540 - RNA, 19 nt, Homo sapiens
uggacaggcuuuaucauua

SEQ ID NO: 1194541 - RNA, 19 nt, Homo sapiens
ggaauuauuucugcccuuu

SEQ ID NO: 1194542 - RNA, 19 nt, Homo sapiens
ccaaaucacucuugaacau

SEQ ID NO: 1194543 - RNA, 19 nt, Homo sapiens
gugaaaagcucccaguuua

SEQ ID NO: 1194544 - RNA, 19 nt, Homo sapiens
gaaaggcaauacugucugu

SEQ ID NO: 1194545 - RNA, 19 nt, Homo sapiens
gcucacacuuccauaauga

SEQ ID NO: 1194546 - RNA, 19 nt, Homo sapiens
uaaugaagcuucugcuaga

SEQ ID NO: 1194547 - RNA, 19 nt, Homo sapiens
cauguuagcugagaauauu

SEQ ID NO: 1194548 - RNA, 19 nt, Homo sapiens
ggaggaagcccuagucaau

SEQ ID NO: 1194549 - RNA, 19 nt, Homo sapiens
gaaauggaggcauguauau

SEQ ID NO: 1194550 - RNA, 19 nt, Homo sapiens
uaaagaguguucuccuaaa

SEQ ID NO: 1194551 - RNA, 19 nt, Homo sapiens
gggaauaaccuuaccaaau

SEQ ID NO: 1194552 - RNA, 19 nt, Homo sapiens
ggagugaaacuauggcuuu

SEQ ID NO: 1194553 - RNA, 19 nt, Homo sapiens
gaauaaccuuaccaaauca

SEQ ID NO: 1194554 - RNA, 19 nt, Homo sapiens
gcuauuccauccauucuga

SEQ ID NO: 1194555 - RNA, 19 nt, Homo sapiens
gccaggaccuauuuaagaa

SEQ ID NO: 1194556 - RNA, 19 nt, Homo sapiens
gaagaaaguuguggauaac

SEQ ID NO: 1194557 - RNA, 19 nt, Homo sapiens
gagugaaacuauggcuuua

SEQ ID NO: 1194558 - RNA, 19 nt, Homo sapiens
gaagagcuguuaaaaguga

SEQ ID NO: 1194559 - RNA, 19 nt, Homo sapiens
gaacaagaggauucagaaa

SEQ ID NO: 1194560 - RNA, 19 nt, Homo sapiens
aagaagugcuaacagauaa

SEQ ID NO: 1194561 - RNA, 19 nt, Homo sapiens
gcuagaagcacuccugaaa

SEQ ID NO: 1194562 - RNA, 19 nt, Homo sapiens
uaucagcuauuccaacauu

SEQ ID NO: 1194563 - RNA, 19 nt, Homo sapiens
ucaaagaacaucccuaaug

SEQ ID NO: 1194564 - RNA, 19 nt, Homo sapiens
guacuuagcaauuagaguu

SEQ ID NO: 1194565 - RNA, 19 nt, Homo sapiens
ggaacaaacugcaugucau

SEQ ID NO: 1194566 - RNA, 19 nt, Homo sapiens
ggucauugcaagaucauua

SEQ ID NO: 1194567 - RNA, 19 nt, Homo sapiens
auaaagaagugcuaacaga

SEQ ID NO: 1194568 - RNA, 19 nt, Homo sapiens
ggaggcauguauaucugua

SEQ ID NO: 1194569 - RNA, 19 nt, Homo sapiens
ccacaacaaggaauucaua

SEQ ID NO: 1194570 - RNA, 19 nt, Homo sapiens
gaaguagguuggucucucu

SEQ ID NO: 1194571 - RNA, 19 nt, Homo sapiens
gauaaacaacuucaacaug

SEQ ID NO: 1194572 - RNA, 19 nt, Homo sapiens
ugaggugacucgacuaaga

SEQ ID NO: 1194573 - RNA, 19 nt, Homo sapiens
guucagaaacagcauauuu

SEQ ID NO: 1194574 - RNA, 19 nt, Homo sapiens
aaagaagugcuaacagaua

SEQ ID NO: 1194575 - RNA, 19 nt, Homo sapiens
ggaagcaauugguaagauc

SEQ ID NO: 1194576 - RNA, 19 nt, Homo sapiens
ggaaacagaccuacuaaaa

SEQ ID NO: 1194577 - RNA, 19 nt, Homo sapiens
uaaggaaacagaccuacua

SEQ ID NO: 1194578 - RNA, 19 nt, Homo sapiens
caacaaaggaagcagaaga

SEQ ID NO: 1194579 - RNA, 19 nt, Homo sapiens
aagcuucucuccgaucuua

SEQ ID NO: 1194580 - RNA, 19 nt, Homo sapiens
caacugggccuuguuaaug

SEQ ID NO: 1194581 - RNA, 19 nt, Homo sapiens
uuaggaagcugaauguugu

SEQ ID NO: 1194582 - RNA, 19 nt, Homo sapiens
ccuaagaaauaaugggaaa

SEQ ID NO: 1194583 - RNA, 19 nt, Homo sapiens
agaugucacugaugaauga

SEQ ID NO: 1194584 - RNA, 19 nt, Homo sapiens
ucaccugccuacucuaauu

SEQ ID NO: 1194585 - RNA, 19 nt, Homo sapiens
uaucaucucccuucaugua

SEQ ID NO: 1194586 - RNA, 19 nt, Homo sapiens
gcuaacagauaagcuauag

SEQ ID NO: 1194587 - RNA, 19 nt, Homo sapiens
gguacagguugaaauaguu

SEQ ID NO: 1194588 - RNA, 19 nt, Homo sapiens
uaaaggaagcaauugguaa

SEQ ID NO: 1194589 - RNA, 19 nt, Homo sapiens
cuaagagaauuaaccagaa

SEQ ID NO: 1194590 - RNA, 19 nt, Homo sapiens
gcauguauaucuguacuuc

SEQ ID NO: 1194591 - RNA, 19 nt, Homo sapiens
aaacagaccuacuaaaaug

SEQ ID NO: 1194592 - RNA, 19 nt, Homo sapiens
cuccaaagguucauucuga

SEQ ID NO: 1194593 - RNA, 19 nt, Homo sapiens
cauccuaaguuaacauaug

SEQ ID NO: 1194594 - RNA, 19 nt, Homo sapiens
gauuaaggguacagguuga

SEQ ID NO: 1194595 - RNA, 19 nt, Homo sapiens
gugaaacuauggcuuuaau

SEQ ID NO: 1194596 - RNA, 19 nt, Homo sapiens
guaaguggaaacacagaua

SEQ ID NO: 1194597 - RNA, 19 nt, Homo sapiens
acaaggaauucauaaggaa

SEQ ID NO: 1194598 - RNA, 19 nt, Homo sapiens
cauaucagcuauuccaaca

SEQ ID NO: 1194599 - RNA, 19 nt, Homo sapiens
caagaggauucagaaauuc

SEQ ID NO: 1194600 - RNA, 19 nt, Homo sapiens
gaagauucagguucagaaa

SEQ ID NO: 1194601 - RNA, 19 nt, Homo sapiens
gaauuaaccagaacuuuac

SEQ ID NO: 1194602 - RNA, 19 nt, Homo sapiens
ccagagagcaaauuagaga

SEQ ID NO: 1194603 - RNA, 19 nt, Homo sapiens
caagugaaagaaaggauuu

SEQ ID NO: 1194604 - RNA, 19 nt, Homo sapiens
ggccaggaccuauuuaaga

SEQ ID NO: 1194605 - RNA, 19 nt, Homo sapiens
ggauugcaaccuugaauug

SEQ ID NO: 1194606 - RNA, 19 nt, Homo sapiens
gcccaaaacugacauauca

SEQ ID NO: 1194607 - RNA, 19 nt, Homo sapiens
uaauggaauuccugcugua

SEQ ID NO: 1194608 - RNA, 19 nt, Homo sapiens
caaaagauacggaucaaaa

SEQ ID NO: 1194609 - RNA, 19 nt, Homo sapiens
cacaauugcuacaagaaga

SEQ ID NO: 1194610 - RNA, 19 nt, Homo sapiens
gaaaguucaucaggugcuu

SEQ ID NO: 1194611 - RNA, 19 nt, Homo sapiens
gcugcaagccugggaauaa

SEQ ID NO: 1194612 - RNA, 19 nt, Homo sapiens
agaaauggaggcauguaua

SEQ ID NO: 1194613 - RNA, 19 nt, Homo sapiens
aaacagauaccuaaugaag

SEQ ID NO: 1194614 - RNA, 19 nt, Homo sapiens
caacaaggaauucauaagg

SEQ ID NO: 1194615 - RNA, 19 nt, Homo sapiens
guucacaauugcuacaaga

SEQ ID NO: 1194616 - RNA, 19 nt, Homo sapiens
gagaaaugaauucagaaga

SEQ ID NO: 1194617 - RNA, 19 nt, Homo sapiens
caaauaagagcagcuacaa

SEQ ID NO: 1194618 - RNA, 19 nt, Homo sapiens
uugaauaugucacugcaaa

SEQ ID NO: 1194619 - RNA, 19 nt, Homo sapiens
cagcaacugggccuuguua

SEQ ID NO: 1194620 - RNA, 19 nt, Homo sapiens
gaaaugggcaugagaauaa

SEQ ID NO: 1194621 - RNA, 19 nt, Homo sapiens
gagaaaagcuugugugaaa

SEQ ID NO: 1194622 - RNA, 19 nt, Homo sapiens
gagagaaccucaccaaaca

SEQ ID NO: 1194623 - RNA, 19 nt, Homo sapiens
cagcuguucuuacugcuua

SEQ ID NO: 1194624 - RNA, 19 nt, Homo sapiens
ggaaaugggcaugagaaua

SEQ ID NO: 1194625 - RNA, 19 nt, Homo sapiens
ggacuucacuagagcuuac

SEQ ID NO: 1194626 - RNA, 19 nt, Homo sapiens
aaagccagcuggauguuug

SEQ ID NO: 1194627 - RNA, 19 nt, Homo sapiens
ggacagugguguguguaga

SEQ ID NO: 1194628 - RNA, 19 nt, Homo sapiens
ggagagaaccucaccaaac

SEQ ID NO: 1194629 - RNA, 19 nt, Homo sapiens
aggacuggcuguaaccuua

SEQ ID NO: 1194630 - RNA, 19 nt, Homo sapiens
auaaauaccuccccaaauu

SEQ ID NO: 1194631 - RNA, 19 nt, Homo sapiens
gcagagggccagaguaagu

SEQ ID NO: 1194632 - RNA, 19 nt, Homo sapiens
cagaagugcaagcugauua

SEQ ID NO: 1194633 - RNA, 19 nt, Homo sapiens
gaaagccagcuggauguuu

SEQ ID NO: 1194634 - RNA, 19 nt, Homo sapiens
gaggguaucaguaucauuc

SEQ ID NO: 1194635 - RNA, 19 nt, Homo sapiens
cuuaagcccaucaaaguua

SEQ ID NO: 1194636 - RNA, 19 nt, Homo sapiens
agauaaagaugaggagguu

SEQ ID NO: 1194637 - RNA, 19 nt, Homo sapiens
cuuagaaucuucaccaagu

SEQ ID NO: 1194638 - RNA, 19 nt, Homo sapiens
cgugaggacaguugaauuu

SEQ ID NO: 1194639 - RNA, 19 nt, Homo sapiens
aaauguguguuguuuguuc

SEQ ID NO: 1194640 - RNA, 19 nt, Homo sapiens
ggacuggcuguaaccuuaa

SEQ ID NO: 1194641 - RNA, 19 nt, Homo sapiens
gaaaagcuugugugaaauu

SEQ ID NO: 1194642 - RNA, 19 nt, Homo sapiens
cauaaggacuggcuguaac

SEQ ID NO: 1194643 - RNA, 19 nt, Homo sapiens
gaggcagacaccaugguua

SEQ ID NO: 1194644 - RNA, 19 nt, Homo sapiens
guaucaguaucauucauuc

SEQ ID NO: 1194645 - RNA, 19 nt, Homo sapiens
ccgcaccuuuccuuuguuu

SEQ ID NO: 1194646 - RNA, 19 nt, Homo sapiens
gggaagaaucugucagugu

SEQ ID NO: 1194647 - RNA, 19 nt, Homo sapiens
gguaucaguaucauucauu

SEQ ID NO: 1194648 - RNA, 19 nt, Homo sapiens
ccagggaggguaucaguau

SEQ ID NO: 1194649 - RNA, 19 nt, Homo sapiens
agugcaagcugauuacuca

SEQ ID NO: 1194650 - RNA, 19 nt, Homo sapiens
gagcuugauugugggagaa

SEQ ID NO: 1194651 - RNA, 19 nt, Homo sapiens
gaauaaauaccuccccaaa

SEQ ID NO: 1194652 - RNA, 19 nt, Homo sapiens
ccauaaggacuggcuguaa

SEQ ID NO: 1194653 - RNA, 19 nt, Homo sapiens
guucagacuugggaagaau

SEQ ID NO: 1194654 - RNA, 19 nt, Homo sapiens
ucacugguauggguucaga

SEQ ID NO: 1194655 - RNA, 19 nt, Homo sapiens
ugugugaaauucccucuuc

SEQ ID NO: 1194656 - RNA, 19 nt, Homo sapiens
cagaguaagugcaagucau

SEQ ID NO: 1194657 - RNA, 19 nt, Homo sapiens
gaggcgagaugagcuccuu

SEQ ID NO: 1194658 - RNA, 19 nt, Homo sapiens
aaaugggcaugagaauaaa

SEQ ID NO: 1194659 - RNA, 19 nt, Homo sapiens
ugaggacaguugaauuugg

SEQ ID NO: 1194660 - RNA, 19 nt, Homo sapiens
ggucugggacuucacuaga

SEQ ID NO: 1194661 - RNA, 19 nt, Homo sapiens
gcagcugggucugggacuu

SEQ ID NO: 1194662 - RNA, 19 nt, Homo sapiens
acagugguguguguagaaa

SEQ ID NO: 1194663 - RNA, 19 nt, Homo sapiens
gacagugguguguguagaa

SEQ ID NO: 1194664 - RNA, 19 nt, Homo sapiens
uugcagagggccagaguaa

SEQ ID NO: 1194665 - RNA, 19 nt, Homo sapiens
aauagucccugcuccucuu

SEQ ID NO: 1194666 - RNA, 19 nt, Homo sapiens
gugccuaggaggagauaaa

SEQ ID NO: 1194667 - RNA, 19 nt, Homo sapiens
cgccgcaccuuuccuuugu

SEQ ID NO: 1194668 - RNA, 19 nt, Homo sapiens
gguucagacuugggaagaa

SEQ ID NO: 1194669 - RNA, 19 nt, Homo sapiens
gguauggguucagagcaau

SEQ ID NO: 1194670 - RNA, 19 nt, Homo sapiens
ccuaggaggagauaaagau

SEQ ID NO: 1194671 - RNA, 19 nt, Homo sapiens
uagaaagccagcuggaugu

SEQ ID NO: 1194672 - RNA, 19 nt, Homo sapiens
gggaaaugggcaugagaau

SEQ ID NO: 1194673 - RNA, 19 nt, Homo sapiens
ggguggccauggugggaaa

SEQ ID NO: 1194674 - RNA, 19 nt, Homo sapiens
gcagacaccaugguuaggu

SEQ ID NO: 1194675 - RNA, 19 nt, Homo sapiens
acagagggguucagacuug

SEQ ID NO: 1194676 - RNA, 19 nt, Homo sapiens
ucaguaucauucauucucu

SEQ ID NO: 1194677 - RNA, 19 nt, Homo sapiens
gggaagucucugccaggua

SEQ ID NO: 1194678 - RNA, 19 nt, Homo sapiens
uaggaggagauaaagauga

SEQ ID NO: 1194679 - RNA, 19 nt, Homo sapiens
gagcccagcaggagaggau

SEQ ID NO: 1194680 - RNA, 19 nt, Homo sapiens
ugguauggguucagagcaa

SEQ ID NO: 1194681 - RNA, 19 nt, Homo sapiens
guuaggugauagggucuga

SEQ ID NO: 1194682 - RNA, 19 nt, Homo sapiens
uuagaaucuucaccaagug

SEQ ID NO: 1194683 - RNA, 19 nt, Homo sapiens
gcaugcccagcuguucuua

SEQ ID NO: 1194684 - RNA, 19 nt, Homo sapiens
gauaaagaugaggagguuu

SEQ ID NO: 1194685 - RNA, 19 nt, Homo sapiens
ggaggguaucaguaucauu

SEQ ID NO: 1194686 - RNA, 19 nt, Homo sapiens
uagcagagcagagggaagu

SEQ ID NO: 1194687 - RNA, 19 nt, Homo sapiens
ccuggacaguggugugugu

SEQ ID NO: 1194688 - RNA, 19 nt, Homo sapiens
uaaccuuaagcccaucaaa

SEQ ID NO: 1194689 - RNA, 19 nt, Homo sapiens
ggguaucaguaucauucau

SEQ ID NO: 1194690 - RNA, 19 nt, Homo sapiens
gggaggguaucaguaucau

SEQ ID NO: 1194691 - RNA, 19 nt, Homo sapiens
agaguaagugcaagucaug

SEQ ID NO: 1194692 - RNA, 19 nt, Homo sapiens
cccaagaacaaaccauuuc

SEQ ID NO: 1194693 - RNA, 19 nt, Homo sapiens
aggaggagauaaagaugag

SEQ ID NO: 1194694 - RNA, 19 nt, Homo sapiens
gggucugccugccuguuuc

SEQ ID NO: 1194695 - RNA, 19 nt, Homo sapiens
gugaggacaguugaauuug

SEQ ID NO: 1194696 - RNA, 19 nt, Homo sapiens
cagggaggguaucaguauc

SEQ ID NO: 1194697 - RNA, 19 nt, Homo sapiens
gaagugaguuugccaagga

SEQ ID NO: 1194698 - RNA, 19 nt, Homo sapiens
gagccuuucugucucauuu

SEQ ID NO: 1194699 - RNA, 19 nt, Homo sapiens
gcacaacagggucuucuuu

SEQ ID NO: 1194700 - RNA, 19 nt, Homo sapiens
caccaaaccuaucagcuuu

SEQ ID NO: 1194701 - RNA, 19 nt, Homo sapiens
gggcugggaugcucuguga

SEQ ID NO: 1194702 - RNA, 19 nt, Homo sapiens
gugagcaggcaauuaauua

SEQ ID NO: 1194703 - RNA, 19 nt, Homo sapiens
guucugugcucuugccuaa

SEQ ID NO: 1194704 - RNA, 19 nt, Homo sapiens
ccaguuagauauuaugaca

SEQ ID NO: 1194705 - RNA, 19 nt, Homo sapiens
gggcaaggcuggguacuca

SEQ ID NO: 1194706 - RNA, 19 nt, Homo sapiens
ggacuuuguugugucauga

SEQ ID NO: 1194707 - RNA, 19 nt, Homo sapiens
ggucaucuccggagcguuu

SEQ ID NO: 1194708 - RNA, 19 nt, Homo sapiens
gaacucaaccagcacaaca

SEQ ID NO: 1194709 - RNA, 19 nt, Homo sapiens
acaacagggucuucuuuga

SEQ ID NO: 1194710 - RNA, 19 nt, Homo sapiens
ucugugcucuugccuaauu

SEQ ID NO: 1194711 - RNA, 19 nt, Homo sapiens
cagcuacucuguuccuuca

SEQ ID NO: 1194712 - RNA, 19 nt, Homo sapiens
ggcaauuaauuaggaguaa

SEQ ID NO: 1194713 - RNA, 19 nt, Homo sapiens
cguuggagcugauccgaaa

SEQ ID NO: 1194714 - RNA, 19 nt, Homo sapiens
gagggcaggugaacacaag

SEQ ID NO: 1194715 - RNA, 19 nt, Homo sapiens
aacagggucuucuuugauu

SEQ ID NO: 1194716 - RNA, 19 nt, Homo sapiens
gcgacggcuucuucacuaa

SEQ ID NO: 1194717 - RNA, 19 nt, Homo sapiens
caacagggucuucuuugau

SEQ ID NO: 1194718 - RNA, 19 nt, Homo sapiens
gcucaaauggcaagacgaa

SEQ ID NO: 1194719 - RNA, 19 nt, Homo sapiens
gaaauccaccugucuccau

SEQ ID NO: 1194720 - RNA, 19 nt, Homo sapiens
uuacugugcugcugagugu

SEQ ID NO: 1194721 - RNA, 19 nt, Homo sapiens
uucgagagguggucaguuu

SEQ ID NO: 1194722 - RNA, 19 nt, Homo sapiens
ggugagcaggcaauuaauu

SEQ ID NO: 1194723 - RNA, 19 nt, Homo sapiens
gcaauuauuuucucacagu

SEQ ID NO: 1194724 - RNA, 19 nt, Homo sapiens
aaagugggcagcucaaaug

SEQ ID NO: 1194725 - RNA, 19 nt, Homo sapiens
ccaccaaaccuaucagcuu

SEQ ID NO: 1194726 - RNA, 19 nt, Homo sapiens
gcaauuaauuaggaguaag

SEQ ID NO: 1194727 - RNA, 19 nt, Homo sapiens
gcagaggagggaaaauuua

SEQ ID NO: 1194728 - RNA, 19 nt, Homo sapiens
gcuggcauccacaucauuu

SEQ ID NO: 1194729 - RNA, 19 nt, Homo sapiens
caaagugggcagcucaaau

SEQ ID NO: 1194730 - RNA, 19 nt, Homo sapiens
ucaaagaugaagaagaaga

SEQ ID NO: 1194731 - RNA, 19 nt, Homo sapiens
gcaaagugggcagcucaaa

SEQ ID NO: 1194732 - RNA, 19 nt, Homo sapiens
ccaaaccuaucagcuuuua

SEQ ID NO: 1194733 - RNA, 19 nt, Homo sapiens
ugacaaggacaccaccaaa

SEQ ID NO: 1194734 - RNA, 19 nt, Homo sapiens
gacggcaggugaacacaag

SEQ ID NO: 1194735 - RNA, 19 nt, Homo sapiens
cuggugagcaggcaauuaa

SEQ ID NO: 1194736 - RNA, 19 nt, Homo sapiens
ggacaccaccaaaccuauc

SEQ ID NO: 1194737 - RNA, 19 nt, Homo sapiens
ggaggauggcuuuaaugug

SEQ ID NO: 1194738 - RNA, 19 nt, Homo sapiens
gcuccuggccucucugugu

SEQ ID NO: 1194739 - RNA, 19 nt, Homo sapiens
ggacggcaggugaacacaa

SEQ ID NO: 1194740 - RNA, 19 nt, Homo sapiens
cagaaggagaagugaguuu

SEQ ID NO: 1194741 - RNA, 19 nt, Homo sapiens
ugcgacggcuucuucacua

SEQ ID NO: 1194742 - RNA, 19 nt, Homo sapiens
gggaugagcgcucguacca

SEQ ID NO: 1194743 - RNA, 19 nt, Homo sapiens
uugcugcccuucuuucaug

SEQ ID NO: 1194744 - RNA, 19 nt, Homo sapiens
gggcuggcauccacaucau

SEQ ID NO: 1194745 - RNA, 19 nt, Homo sapiens
caaagaugaagaagaagag

SEQ ID NO: 1194746 - RNA, 19 nt, Homo sapiens
gggaaggagcaucaaagau

SEQ ID NO: 1194747 - RNA, 19 nt, Homo sapiens
caagcagagacugggauua

SEQ ID NO: 1194748 - RNA, 19 nt, Homo sapiens
gagcaggcaauuaauuagg

SEQ ID NO: 1194749 - RNA, 19 nt, Homo sapiens
gaaggagaagugaguuugc

SEQ ID NO: 1194750 - RNA, 19 nt, Homo sapiens
acacagacaagucguugga

SEQ ID NO: 1194751 - RNA, 19 nt, Homo sapiens
gccuggugcucugguauga

SEQ ID NO: 1194752 - RNA, 19 nt, Homo sapiens
uccuggcguuggcaauuua

SEQ ID NO: 1194753 - RNA, 19 nt, Homo sapiens
acaagucguuggagcugau

SEQ ID NO: 1194754 - RNA, 19 nt, Homo sapiens
cuuggaggauggcuuuaau

SEQ ID NO: 1194755 - RNA, 19 nt, Homo sapiens
cacaacagggucuucuuug

SEQ ID NO: 1194756 - RNA, 19 nt, Homo sapiens
uagccacucacucgacuuu

SEQ ID NO: 1194757 - RNA, 19 nt, Homo sapiens
gcuuggaggauggcuuuaa

SEQ ID NO: 1194758 - RNA, 19 nt, Homo sapiens
ccaagcagagacugggauu

SEQ ID NO: 1194759 - RNA, 19 nt, Homo sapiens
caucacagaguggaaugaa

SEQ ID NO: 1194760 - RNA, 19 nt, Homo sapiens
cgggaaggagcaucaaaga

SEQ ID NO: 1194761 - RNA, 19 nt, Homo sapiens
ccuaucagcuuuuacuugu

SEQ ID NO: 1194762 - RNA, 19 nt, Homo sapiens
ggagggcaggugaacacaa

SEQ ID NO: 1194763 - RNA, 19 nt, Homo sapiens
agaaggagaagugaguuug

SEQ ID NO: 1194764 - RNA, 19 nt, Homo sapiens
aagcagagacugggauuag

SEQ ID NO: 1194765 - RNA, 19 nt, Homo sapiens
gcuucuucacuaacuauaa

SEQ ID NO: 1194766 - RNA, 19 nt, Homo sapiens
ucaaauggcaagacgaacu

SEQ ID NO: 1194767 - RNA, 19 nt, Homo sapiens
agcaggcaauuaauuagga

SEQ ID NO: 1194768 - RNA, 19 nt, Homo sapiens
gacaaggacaccaccaaac

SEQ ID NO: 1194769 - RNA, 19 nt, Homo sapiens
cagcuggagcccacaccua

SEQ ID NO: 1194770 - RNA, 19 nt, Homo sapiens
caaauggcaagacgaacuc

SEQ ID NO: 1194771 - RNA, 19 nt, Homo sapiens
ggagggaaaauuuauagug

SEQ ID NO: 1194772 - RNA, 19 nt, Homo sapiens
ccgcuuggaggauggcuuu

SEQ ID NO: 1194773 - RNA, 19 nt, Homo sapiens
gcuucuccguggcuuuguu

SEQ ID NO: 1194774 - RNA, 19 nt, Homo sapiens
aaggacaccaccaaaccua

SEQ ID NO: 1194775 - RNA, 19 nt, Homo sapiens
aggaggagcaggaggauca

SEQ ID NO: 1194776 - RNA, 19 nt, Homo sapiens
uggaggauggcuuuaaugu

SEQ ID NO: 1194777 - RNA, 19 nt, Homo sapiens
guacgugggcguggaugug

SEQ ID NO: 1194778 - RNA, 19 nt, Homo sapiens
ugcgguaccucaccacaca

SEQ ID NO: 1194779 - RNA, 19 nt, Homo sapiens
ugaucaacaucgagaacuc

SEQ ID NO: 1194780 - RNA, 19 nt, Homo sapiens
uggaagagcugacauaugg

SEQ ID NO: 1194781 - RNA, 19 nt, Homo sapiens
gcgcauggaccaaguauug

SEQ ID NO: 1194782 - RNA, 19 nt, Homo sapiens
gaagcgacaugguccacuu

SEQ ID NO: 1194783 - RNA, 19 nt, Homo sapiens
guauuguucuuguccauug

SEQ ID NO: 1194784 - RNA, 19 nt, Homo sapiens
gggcuagggugucugcuau

SEQ ID NO: 1194785 - RNA, 19 nt, Homo sapiens
ccgaguaccuugaggaugu

SEQ ID NO: 1194786 - RNA, 19 nt, Homo sapiens
ccacugcuuugauguccua

SEQ ID NO: 1194787 - RNA, 19 nt, Homo sapiens
gcacaacgggacacaguau

SEQ ID NO: 1194788 - RNA, 19 nt, Homo sapiens
agagacugauccacacaua

SEQ ID NO: 1194789 - RNA, 19 nt, Homo sapiens
gcucagacacucagagaga

SEQ ID NO: 1194790 - RNA, 19 nt, Homo sapiens
ggacuugccugucguugcu

SEQ ID NO: 1194791 - RNA, 19 nt, Homo sapiens
ggcauggucuucugucugu

SEQ ID NO: 1194792 - RNA, 19 nt, Homo sapiens
acaaggaccuggugcucuu

SEQ ID NO: 1194793 - RNA, 19 nt, Homo sapiens
uauggucgcugcucaaugg

SEQ ID NO: 1194794 - RNA, 19 nt, Homo sapiens
gggaacuucuacagugcua

SEQ ID NO: 1194795 - RNA, 19 nt, Homo sapiens
gaaccuggagcggguguuu

SEQ ID NO: 1194796 - RNA, 19 nt, Homo sapiens
caauaaaggcauggaagaa

SEQ ID NO: 1194797 - RNA, 19 nt, Homo sapiens
ccaauaaaggcauggaaga

SEQ ID NO: 1194798 - RNA, 19 nt, Homo sapiens
ggacugggcagagaugaau

SEQ ID NO: 1194799 - RNA, 19 nt, Homo sapiens
ucagagggcuguguacaag

SEQ ID NO: 1194800 - RNA, 19 nt, Homo sapiens
ggacauggccuggguagac

SEQ ID NO: 1194801 - RNA, 19 nt, Homo sapiens
gaccaaguauugccagacu

SEQ ID NO: 1194802 - RNA, 19 nt, Homo sapiens
gaaagacucacugcucaca

SEQ ID NO: 1194803 - RNA, 19 nt, Homo sapiens
ggauguggcccuggaguga

SEQ ID NO: 1194804 - RNA, 19 nt, Homo sapiens
guacugggcuagggugucu

SEQ ID NO: 1194805 - RNA, 19 nt, Homo sapiens
gcccuggagugaacuuugu

SEQ ID NO: 1194806 - RNA, 19 nt, Homo sapiens
gcugugcaccgacggcuaa

SEQ ID NO: 1194807 - RNA, 19 nt, Homo sapiens
uguccuagaccuccacuuu

SEQ ID NO: 1194808 - RNA, 19 nt, Homo sapiens
uugaggauguucuggaaga

SEQ ID NO: 1194809 - RNA, 19 nt, Homo sapiens
agagggcuguguacaagga

SEQ ID NO: 1194810 - RNA, 19 nt, Homo sapiens
gggacuggaugugccaaug

SEQ ID NO: 1194811 - RNA, 19 nt, Homo sapiens
gauccacacauacaaacug

SEQ ID NO: 1194812 - RNA, 19 nt, Homo sapiens
ucacuuccggcaugcagua

SEQ ID NO: 1194813 - RNA, 19 nt, Homo sapiens
uccuagaccuccacuuuca

SEQ ID NO: 1194814 - RNA, 19 nt, Homo sapiens
ccuugaggauguucuggaa

SEQ ID NO: 1194815 - RNA, 19 nt, Homo sapiens
agacugauccacacauaca

SEQ ID NO: 1194816 - RNA, 19 nt, Homo sapiens
acaugaggcuuggcuagga

SEQ ID NO: 1194817 - RNA, 19 nt, Homo sapiens
ugucugcuaugccugguau

SEQ ID NO: 1194818 - RNA, 19 nt, Homo sapiens
gggaugccacgcuauguuc

SEQ ID NO: 1194819 - RNA, 19 nt, Homo sapiens
gauauggucgcugcucaau

SEQ ID NO: 1194820 - RNA, 19 nt, Homo sapiens
ggacuggaugugccaaugg

SEQ ID NO: 1194821 - RNA, 19 nt, Homo sapiens
acaaguucguggucaucuu

SEQ ID NO: 1194822 - RNA, 19 nt, Homo sapiens
uccaaucccuggcccuaau

SEQ ID NO: 1194823 - RNA, 19 nt, Homo sapiens
ggcgggagcuuugcagaac

SEQ ID NO: 1194824 - RNA, 19 nt, Homo sapiens
ggaccacugcuuugauguc

SEQ ID NO: 1194825 - RNA, 19 nt, Homo sapiens
ugcuaugccugguauuguu

SEQ ID NO: 1194826 - RNA, 19 nt, Homo sapiens
cgaguaccuugaggauguu

SEQ ID NO: 1194827 - RNA, 19 nt, Homo sapiens
gcuagggugucugcuaugc

SEQ ID NO: 1194828 - RNA, 19 nt, Homo sapiens
gacauggccuggguagacu

SEQ ID NO: 1194829 - RNA, 19 nt, Homo sapiens
caacaaguucguggucauc

SEQ ID NO: 1194830 - RNA, 19 nt, Homo sapiens
acaacaaguucguggucau

SEQ ID NO: 1194831 - RNA, 19 nt, Homo sapiens
ccauucagagggcugugua

SEQ ID NO: 1194832 - RNA, 19 nt, Homo sapiens
gcaguacagcaccgucauc

SEQ ID NO: 1194833 - RNA, 19 nt, Homo sapiens
gaacucccauguaucauua

SEQ ID NO: 1194834 - RNA, 19 nt, Homo sapiens
ggaauaauauguccaaguu

SEQ ID NO: 1194835 - RNA, 19 nt, Homo sapiens
caacaaaggucacuaagga

SEQ ID NO: 1194836 - RNA, 19 nt, Homo sapiens
guaagaagacccuauaaua

SEQ ID NO: 1194837 - RNA, 19 nt, Homo sapiens
gaaacuccaucucuucuaa

SEQ ID NO: 1194838 - RNA, 19 nt, Homo sapiens
gaaacacugucucuacuaa

SEQ ID NO: 1194839 - RNA, 19 nt, Homo sapiens
gagcagaucuuagaaauag

SEQ ID NO: 1194840 - RNA, 19 nt, Homo sapiens
gagaaaggguugugaauag

SEQ ID NO: 1194841 - RNA, 19 nt, Homo sapiens
gauaaggacugucaauugu

SEQ ID NO: 1194842 - RNA, 19 nt, Homo sapiens
caacuuugcugugaccuua

SEQ ID NO: 1194843 - RNA, 19 nt, Homo sapiens
ugacuaaucuuaccuacuu

SEQ ID NO: 1194844 - RNA, 19 nt, Homo sapiens
cuaaugaacucccauguau

SEQ ID NO: 1194845 - RNA, 19 nt, Homo sapiens
aaggaaaccuguugacuaa

SEQ ID NO: 1194846 - RNA, 19 nt, Homo sapiens
uuaaauggcuaucaaguug

SEQ ID NO: 1194847 - RNA, 19 nt, Homo sapiens
aaacaaagcucauuaaacc

SEQ ID NO: 1194848 - RNA, 19 nt, Homo sapiens
gauacaagcuacaacaaca

SEQ ID NO: 1194849 - RNA, 19 nt, Homo sapiens
ggacagacuggaauaauau

SEQ ID NO: 1194850 - RNA, 19 nt, Homo sapiens
caacauaugauacaagcua

SEQ ID NO: 1194851 - RNA, 19 nt, Homo sapiens
caaaggagaccaucaacuu

SEQ ID NO: 1194852 - RNA, 19 nt, Homo sapiens
gguauaagccagagucgua

SEQ ID NO: 1194853 - RNA, 19 nt, Homo sapiens
ggaaaccuguugacuaaac

SEQ ID NO: 1194854 - RNA, 19 nt, Homo sapiens
uaaggaaaccuguugacua

SEQ ID NO: 1194855 - RNA, 19 nt, Homo sapiens
cacaguggcucacaccuaa

SEQ ID NO: 1194856 - RNA, 19 nt, Homo sapiens
uggacagacuggaauaaua

SEQ ID NO: 1194857 - RNA, 19 nt, Homo sapiens
cagaaucuagcauaacuua

SEQ ID NO: 1194858 - RNA, 19 nt, Homo sapiens
ggacacuacuuugaaacaa

SEQ ID NO: 1194859 - RNA, 19 nt, Homo sapiens
ggauggcgaugcaccacua

SEQ ID NO: 1194860 - RNA, 19 nt, Homo sapiens
gagagauacugcccauaug

SEQ ID NO: 1194861 - RNA, 19 nt, Homo sapiens
cuuaggaaaucaacaguuu

SEQ ID NO: 1194862 - RNA, 19 nt, Homo sapiens
gugaauagcuuagguuugg

SEQ ID NO: 1194863 - RNA, 19 nt, Homo sapiens
cuacuucuacuuugucuua

SEQ ID NO: 1194864 - RNA, 19 nt, Homo sapiens
uaacacaguuucacucucu

SEQ ID NO: 1194865 - RNA, 19 nt, Homo sapiens
cgauacaaaugcacagaaa

SEQ ID NO: 1194866 - RNA, 19 nt, Homo sapiens
cagcaucaacuauuuauga

SEQ ID NO: 1194867 - RNA, 19 nt, Homo sapiens
ggucuucccuuccuucugu

SEQ ID NO: 1194868 - RNA, 19 nt, Homo sapiens
cauuaaaccuauuguagug

SEQ ID NO: 1194869 - RNA, 19 nt, Homo sapiens
ucacucaggauguguauaa

SEQ ID NO: 1194870 - RNA, 19 nt, Homo sapiens
gcacaguggcucacaccua

SEQ ID NO: 1194871 - RNA, 19 nt, Homo sapiens
gagcugagacggugccauu

SEQ ID NO: 1194872 - RNA, 19 nt, Homo sapiens
ggagcagaucuuagaaaua

SEQ ID NO: 1194873 - RNA, 19 nt, Homo sapiens
gauguuagaguaagguauu

SEQ ID NO: 1194874 - RNA, 19 nt, Homo sapiens
guagugaggaaguuucuuu

SEQ ID NO: 1194875 - RNA, 19 nt, Homo sapiens
gagcgaaacuccgucucaa

SEQ ID NO: 1194876 - RNA, 19 nt, Homo sapiens
gauccaguuuauguuguua

SEQ ID NO: 1194877 - RNA, 19 nt, Homo sapiens
gaucaugccacugcacuuu

SEQ ID NO: 1194878 - RNA, 19 nt, Homo sapiens
ugagaaaggguugugaaua

SEQ ID NO: 1194879 - RNA, 19 nt, Homo sapiens
gauaaggguccaacugguu

SEQ ID NO: 1194880 - RNA, 19 nt, Homo sapiens
cacagagucuugguaauga

SEQ ID NO: 1194881 - RNA, 19 nt, Homo sapiens
ugacacagagucuugguaa

SEQ ID NO: 1194882 - RNA, 19 nt, Homo sapiens
gcagaucuuagaaauagaa

SEQ ID NO: 1194883 - RNA, 19 nt, Homo sapiens
uaucuacuguguaagaaga

SEQ ID NO: 1194884 - RNA, 19 nt, Homo sapiens
gaauagcuuagguuuggua

SEQ ID NO: 1194885 - RNA, 19 nt, Homo sapiens
cgagauauagauccaguuu

SEQ ID NO: 1194886 - RNA, 19 nt, Homo sapiens
aagggaggauguuagagua

SEQ ID NO: 1194887 - RNA, 19 nt, Homo sapiens
caaagcucauuaaaccuau

SEQ ID NO: 1194888 - RNA, 19 nt, Homo sapiens
aaauuuagcucacuguaac

SEQ ID NO: 1194889 - RNA, 19 nt, Homo sapiens
agauaugaccugaggaaua

SEQ ID NO: 1194890 - RNA, 19 nt, Homo sapiens
ccacuaaugagaauaccua

SEQ ID NO: 1194891 - RNA, 19 nt, Homo sapiens
gagauauagauccaguuua

SEQ ID NO: 1194892 - RNA, 19 nt, Homo sapiens
acaaagcucauuaaaccua

SEQ ID NO: 1194893 - RNA, 19 nt, Homo sapiens
guggugagcugagaucaug

SEQ ID NO: 1194894 - RNA, 19 nt, Homo sapiens
caguuuauguuguuacuca

SEQ ID NO: 1194895 - RNA, 19 nt, Homo sapiens
ucccauauauuaccuuuca

SEQ ID NO: 1194896 - RNA, 19 nt, Homo sapiens
ugagagauacugcccauau

SEQ ID NO: 1194897 - RNA, 19 nt, Homo sapiens
gaacuaguagagacugaga

SEQ ID NO: 1194898 - RNA, 19 nt, Homo sapiens
gacuaaacaaagcucauua

SEQ ID NO: 1194899 - RNA, 19 nt, Homo sapiens
gcaggagaauugcuugaac

SEQ ID NO: 1194900 - RNA, 19 nt, Homo sapiens
gaccucagaaucuagcaua

SEQ ID NO: 1194901 - RNA, 19 nt, Homo sapiens
ggagggagcacauucuaag

SEQ ID NO: 1194902 - RNA, 19 nt, Homo sapiens
gagauacugcccauauguu

SEQ ID NO: 1194903 - RNA, 19 nt, Homo sapiens
uacccagcaucaacuauuu

SEQ ID NO: 1194904 - RNA, 19 nt, Homo sapiens
gcugugaccuuagugaaca

SEQ ID NO: 1194905 - RNA, 19 nt, Homo sapiens
uaaggacugucaauugucu

SEQ ID NO: 1194906 - RNA, 19 nt, Homo sapiens
gggagcacauucuaaguac

SEQ ID NO: 1194907 - RNA, 19 nt, Homo sapiens
ucaaagggaggauguuaga

SEQ ID NO: 1194908 - RNA, 19 nt, Homo sapiens
agauaaggacugucaauug

SEQ ID NO: 1194909 - RNA, 19 nt, Homo sapiens
uggagcagaucuuagaaau

SEQ ID NO: 1194910 - RNA, 19 nt, Homo sapiens
gaaucuagcauaacuuagg

SEQ ID NO: 1194911 - RNA, 19 nt, Homo sapiens
acaaaggucacuaaggaaa

SEQ ID NO: 1194912 - RNA, 19 nt, Homo sapiens
gcucauuaaaccuauugua

SEQ ID NO: 1194913 - RNA, 19 nt, Homo sapiens
ucacuaaggaaaccuguug

SEQ ID NO: 1194914 - RNA, 19 nt, Homo sapiens
aaaauuagcuggucuuggu

SEQ ID NO: 1194915 - RNA, 19 nt, Homo sapiens
cuucuacuuugucuuauug

SEQ ID NO: 1194916 - RNA, 19 nt, Homo sapiens
aaagauaugaccugaggaa

SEQ ID NO: 1194917 - RNA, 19 nt, Homo sapiens
uauaugggcauuacugaga

SEQ ID NO: 1194918 - RNA, 19 nt, Homo sapiens
gugaaacacugucucuacu

SEQ ID NO: 1194919 - RNA, 19 nt, Homo sapiens
gagaccagccugaccaaca

SEQ ID NO: 1194920 - RNA, 19 nt, Homo sapiens
gggaacuaguagagacuga

SEQ ID NO: 1194921 - RNA, 19 nt, Homo sapiens
acacagagucuugguaaug

SEQ ID NO: 1194922 - RNA, 19 nt, Homo sapiens
caccuaaucccagcacuuu

SEQ ID NO: 1194923 - RNA, 19 nt, Homo sapiens
ugaaacacugucucuacua

SEQ ID NO: 1194924 - RNA, 19 nt, Homo sapiens
gggcauuacugagagauac

SEQ ID NO: 1194925 - RNA, 19 nt, Homo sapiens
aaugaacucccauguauca

SEQ ID NO: 1194926 - RNA, 19 nt, Homo sapiens
ucuaaugaacucccaugua

SEQ ID NO: 1194927 - RNA, 19 nt, Homo sapiens
cuagaugcuuucuggguau

SEQ ID NO: 1194928 - RNA, 19 nt, Homo sapiens
uaacuuaggcuagguuugg

SEQ ID NO: 1194929 - RNA, 19 nt, Homo sapiens
acccuugccuucccaguuu

SEQ ID NO: 1194930 - RNA, 19 nt, Homo sapiens
agcaagaccucagaaucua

SEQ ID NO: 1194931 - RNA, 19 nt, Homo sapiens
uagcaagaccucagaaucu

SEQ ID NO: 1194932 - RNA, 19 nt, Homo sapiens
gcuauucaaagccuuaaau

SEQ ID NO: 1194933 - RNA, 19 nt, Homo sapiens
ucaauaagcucauuaaugg

SEQ ID NO: 1194934 - RNA, 19 nt, Homo sapiens
gcaaagccauugacaggaa

SEQ ID NO: 1194935 - RNA, 19 nt, Homo sapiens
gauuuggucuucagcagua

SEQ ID NO: 1194936 - RNA, 19 nt, Homo sapiens
gaacuucgacucugagauc

SEQ ID NO: 1194937 - RNA, 19 nt, Homo sapiens
ucacagugcugccggaaga

SEQ ID NO: 1194938 - RNA, 19 nt, Homo sapiens
agagagagcuggacaaggu

SEQ ID NO: 1194939 - RNA, 19 nt, Homo sapiens
uggaggagcugcugcacua

SEQ ID NO: 1194940 - RNA, 19 nt, Homo sapiens
ggaaacgcaucauauucug

SEQ ID NO: 1194941 - RNA, 19 nt, Homo sapiens
gcucaucuguggccauguu

SEQ ID NO: 1194942 - RNA, 19 nt, Homo sapiens
gaucugugguguuguguca

SEQ ID NO: 1194943 - RNA, 19 nt, Homo sapiens
gagaugcacucaauaagcu

SEQ ID NO: 1194944 - RNA, 19 nt, Homo sapiens
gaaacuggcuucggaccau

SEQ ID NO: 1194945 - RNA, 19 nt, Homo sapiens
gcacucaauaagcucauua

SEQ ID NO: 1194946 - RNA, 19 nt, Homo sapiens
ucaaagauacggugcagaa

SEQ ID NO: 1194947 - RNA, 19 nt, Homo sapiens
gaaucacaaggacgaguua

SEQ ID NO: 1194948 - RNA, 19 nt, Homo sapiens
gggagaugcuggccucugu

SEQ ID NO: 1194949 - RNA, 19 nt, Homo sapiens
gagcagaacccggcagaug

SEQ ID NO: 1194950 - RNA, 19 nt, Homo sapiens
acaagguccugcagaaguu

SEQ ID NO: 1194951 - RNA, 19 nt, Homo sapiens
gcugaagugucccuacugu

SEQ ID NO: 1194952 - RNA, 19 nt, Homo sapiens
gaacccggcagaugggaaa

SEQ ID NO: 1194953 - RNA, 19 nt, Homo sapiens
gaaacgcaucauauucuga

SEQ ID NO: 1194954 - RNA, 19 nt, Homo sapiens
gaggagcugugccaggaau

SEQ ID NO: 1194955 - RNA, 19 nt, Homo sapiens
ucugagaucugugguguug

SEQ ID NO: 1194956 - RNA, 19 nt, Homo sapiens
ggaaggaauuuuguugaaa

SEQ ID NO: 1194957 - RNA, 19 nt, Homo sapiens
gcacuucauccgccucuug

SEQ ID NO: 1194958 - RNA, 19 nt, Homo sapiens
caagcagccuuuccuagag

SEQ ID NO: 1194959 - RNA, 19 nt, Homo sapiens
ucaagcagccuuuccuaga

SEQ ID NO: 1194960 - RNA, 19 nt, Homo sapiens
acaggaacuucgacucuga

SEQ ID NO: 1194961 - RNA, 19 nt, Homo sapiens
gccggaagaucaaagauac

SEQ ID NO: 1194962 - RNA, 19 nt, Homo sapiens
acuacagccucaacaguaa

SEQ ID NO: 1194963 - RNA, 19 nt, Homo sapiens
ggcaagggauuuggucuuc

SEQ ID NO: 1194964 - RNA, 19 nt, Homo sapiens
gggaaacgcaucauauucu

SEQ ID NO: 1194965 - RNA, 19 nt, Homo sapiens
ggaaucacaaggacgaguu

SEQ ID NO: 1194966 - RNA, 19 nt, Homo sapiens
gcucauuaauggaggaaag

SEQ ID NO: 1194967 - RNA, 19 nt, Homo sapiens
ugagaucugugguguugug

SEQ ID NO: 1194968 - RNA, 19 nt, Homo sapiens
ggacauucacagcagugua

SEQ ID NO: 1194969 - RNA, 19 nt, Homo sapiens
gaaggaauuuuguugaaag

SEQ ID NO: 1194970 - RNA, 19 nt, Homo sapiens
cgaguuaccgauugagauu

SEQ ID NO: 1194971 - RNA, 19 nt, Homo sapiens
gcaagggauuuggucuuca

SEQ ID NO: 1194972 - RNA, 19 nt, Homo sapiens
gacauucacagcaguguau

SEQ ID NO: 1194973 - RNA, 19 nt, Homo sapiens
gagauugaacuaggcauga

SEQ ID NO: 1194974 - RNA, 19 nt, Homo sapiens
agagaucugugagaccuuu

SEQ ID NO: 1194975 - RNA, 19 nt, Homo sapiens
gaauguggacuuggauuuc

SEQ ID NO: 1194976 - RNA, 19 nt, Homo sapiens
aaacuggcuucggaccaua

SEQ ID NO: 1194977 - RNA, 19 nt, Homo sapiens
cacuacagccucaacagua

SEQ ID NO: 1194978 - RNA, 19 nt, Homo sapiens
gacaagguccugcagaagu

SEQ ID NO: 1194979 - RNA, 19 nt, Homo sapiens
caaggacgaguuaccgauu

SEQ ID NO: 1194980 - RNA, 19 nt, Homo sapiens
ugaauguggacuuggauuu

SEQ ID NO: 1194981 - RNA, 19 nt, Homo sapiens
gggaacagcagcagcagau

SEQ ID NO: 1194982 - RNA, 19 nt, Homo sapiens
uggaagcccugcacgaaca

SEQ ID NO: 1194983 - RNA, 19 nt, Homo sapiens
ugcagaaguuccugaccua

SEQ ID NO: 1194984 - RNA, 19 nt, Homo sapiens
gcacuggggucuggaauca

SEQ ID NO: 1194985 - RNA, 19 nt, Homo sapiens
ucuguuugcguuugacuua

SEQ ID NO: 1194986 - RNA, 19 nt, Homo sapiens
gacugugguugguuucaga

SEQ ID NO: 1194987 - RNA, 19 nt, Homo sapiens
cagcuaugcucggcacuuc

SEQ ID NO: 1194988 - RNA, 19 nt, Homo sapiens
gugcgugcguggagagaga

SEQ ID NO: 1194989 - RNA, 19 nt, Homo sapiens
ggaaucaacgcugaaugug

SEQ ID NO: 1194990 - RNA, 19 nt, Homo sapiens
caagggauuuggucuucag

SEQ ID NO: 1194991 - RNA, 19 nt, Homo sapiens
gcacuggagcagcccuuug

SEQ ID NO: 1194992 - RNA, 19 nt, Homo sapiens
ggagagagagcuggacaag

SEQ ID NO: 1194993 - RNA, 19 nt, Homo sapiens
caaagauacggugcagaaa

SEQ ID NO: 1194994 - RNA, 19 nt, Homo sapiens
aagauacggugcagaaacu

SEQ ID NO: 1194995 - RNA, 19 nt, Homo sapiens
cucaauaagcucauuaaug

SEQ ID NO: 1194996 - RNA, 19 nt, Homo sapiens
aaggacgaguuaccgauug

SEQ ID NO: 1194997 - RNA, 19 nt, Homo sapiens
caucguggaacaccuguau

SEQ ID NO: 1194998 - RNA, 19 nt, Homo sapiens
gcguuugacuuaguagcaa

SEQ ID NO: 1194999 - RNA, 19 nt, Homo sapiens
cccgagaugcacucaauaa

SEQ ID NO: 1195000 - RNA, 19 nt, Homo sapiens
guuugcguuugacuuagua

SEQ ID NO: 1195001 - RNA, 19 nt, Homo sapiens
ucgguaggguggucaacuu

SEQ ID NO: 1195002 - RNA, 19 nt, Homo sapiens
agauugaacuaggcaugaa

SEQ ID NO: 1195003 - RNA, 19 nt, Homo sapiens
guguggcgcugccuguguu

SEQ ID NO: 1195004 - RNA, 19 nt, Homo sapiens
gaccauaaggacauucaca

SEQ ID NO: 1195005 - RNA, 19 nt, Homo sapiens
ggacugugguugguuucag

SEQ ID NO: 1195006 - RNA, 19 nt, Homo sapiens
gccagcagacgucagauuc

SEQ ID NO: 1195007 - RNA, 19 nt, Homo sapiens
aguuaccgauugagauuga

SEQ ID NO: 1195008 - RNA, 19 nt, Homo sapiens
ggagauccaggugaugaug

SEQ ID NO: 1195009 - RNA, 19 nt, Homo sapiens
ugacaggaacuucgacucu

SEQ ID NO: 1195010 - RNA, 19 nt, Homo sapiens
aauguggacuuggauuuca

SEQ ID NO: 1195011 - RNA, 19 nt, Homo sapiens
cagcagacgucagauucca

SEQ ID NO: 1195012 - RNA, 19 nt, Homo sapiens
gcugguaccacuccguguu

SEQ ID NO: 1195013 - RNA, 19 nt, Homo sapiens
cggcugggcuuggagaagu

SEQ ID NO: 1195014 - RNA, 19 nt, Homo sapiens
ccacuacagccucaacagu

SEQ ID NO: 1195015 - RNA, 19 nt, Homo sapiens
aguggacugugguugguuu

SEQ ID NO: 1195016 - RNA, 19 nt, Homo sapiens
ugccggaagaucaaagaua

SEQ ID NO: 1195017 - RNA, 19 nt, Homo sapiens
guaggguggucaacuucag

SEQ ID NO: 1195018 - RNA, 19 nt, Homo sapiens
aggacgaguuaccgauuga

SEQ ID NO: 1195019 - RNA, 19 nt, Homo sapiens
gagaucugugagaccuuua

SEQ ID NO: 1195020 - RNA, 19 nt, Homo sapiens
gcaccgacugcacuucauc

SEQ ID NO: 1195021 - RNA, 19 nt, Homo sapiens
aagcagccuuuccuagagu

SEQ ID NO: 1195022 - RNA, 19 nt, Homo sapiens
gacagaguggcaagggauu

SEQ ID NO: 1195023 - RNA, 19 nt, Homo sapiens
ugggaaacgcaucauauuc

SEQ ID NO: 1195024 - RNA, 19 nt, Homo sapiens
gauuccaacccucccauca

SEQ ID NO: 1195025 - RNA, 19 nt, Homo sapiens
cuucgacucugagaucugu

SEQ ID NO: 1195026 - RNA, 19 nt, Homo sapiens
gacgaguuaccgauugaga

SEQ ID NO: 1195027 - RNA, 19 nt, Homo sapiens
cuuaguagcaaccgacaga

SEQ ID NO: 1195028 - RNA, 19 nt, Homo sapiens
cgagaugcacucaauaagc

SEQ ID NO: 1195029 - RNA, 19 nt, Homo sapiens
aaagauacggugcagaaac

SEQ ID NO: 1195030 - RNA, 19 nt, Homo sapiens
aggaaucaacgcugaaugu

SEQ ID NO: 1195031 - RNA, 19 nt, Homo sapiens
ggcaacaucuguaguauua

SEQ ID NO: 1195032 - RNA, 19 nt, Homo sapiens
gaagauauguucacucaga

SEQ ID NO: 1195033 - RNA, 19 nt, Homo sapiens
gaucugaaauccuugcuua

SEQ ID NO: 1195034 - RNA, 19 nt, Homo sapiens
gaacaucuguaucuguaaa

SEQ ID NO: 1195035 - RNA, 19 nt, Homo sapiens
ggacauacauuccaagcuu

SEQ ID NO: 1195036 - RNA, 19 nt, Homo sapiens
gagcuuagaugaucccaaa

SEQ ID NO: 1195037 - RNA, 19 nt, Homo sapiens
guucagaaauccucaagua

SEQ ID NO: 1195038 - RNA, 19 nt, Homo sapiens
gauuuaaccuguacuguga

SEQ ID NO: 1195039 - RNA, 19 nt, Homo sapiens
gaauaugaguuggaaguaa

SEQ ID NO: 1195040 - RNA, 19 nt, Homo sapiens
ggacaauggugguucagaa

SEQ ID NO: 1195041 - RNA, 19 nt, Homo sapiens
ggagaagaauuagaaugua

SEQ ID NO: 1195042 - RNA, 19 nt, Homo sapiens
ucaaggaccugcugaaguu

SEQ ID NO: 1195043 - RNA, 19 nt, Homo sapiens
gaagugcccuaauugaaug

SEQ ID NO: 1195044 - RNA, 19 nt, Homo sapiens
gggaagagccgugcaauaa

SEQ ID NO: 1195045 - RNA, 19 nt, Homo sapiens
gaaaucaaguaaccagaau

SEQ ID NO: 1195046 - RNA, 19 nt, Homo sapiens
gaauucaggcuauaaauga

SEQ ID NO: 1195047 - RNA, 19 nt, Homo sapiens
gcaagaauaugaguuggaa

SEQ ID NO: 1195048 - RNA, 19 nt, Homo sapiens
gaacugcugcuauaaagaa

SEQ ID NO: 1195049 - RNA, 19 nt, Homo sapiens
gaagugaggucaugcuuac

SEQ ID NO: 1195050 - RNA, 19 nt, Homo sapiens
caaagcaccucgaguaaca

SEQ ID NO: 1195051 - RNA, 19 nt, Homo sapiens
ccaggaagcugaagugugu

SEQ ID NO: 1195052 - RNA, 19 nt, Homo sapiens
gaucagaauucaggcuaua

SEQ ID NO: 1195053 - RNA, 19 nt, Homo sapiens
ggaaugguguuugauggua

SEQ ID NO: 1195054 - RNA, 19 nt, Homo sapiens
cuauuaaccugaucucuuu

SEQ ID NO: 1195055 - RNA, 19 nt, Homo sapiens
cuucagaacugcugcuaua

SEQ ID NO: 1195056 - RNA, 19 nt, Homo sapiens
cagaagauauguucacuca

SEQ ID NO: 1195057 - RNA, 19 nt, Homo sapiens
gaagaauccuuagaacuca

SEQ ID NO: 1195058 - RNA, 19 nt, Homo sapiens
ggagaggauuuaaccugua

SEQ ID NO: 1195059 - RNA, 19 nt, Homo sapiens
gcacaacaguauacaaugg

SEQ ID NO: 1195060 - RNA, 19 nt, Homo sapiens
caauuacagugcaaucuuu

SEQ ID NO: 1195061 - RNA, 19 nt, Homo sapiens
gagagggaaugguguuuga

SEQ ID NO: 1195062 - RNA, 19 nt, Homo sapiens
caaagcaccuuguauuucu

SEQ ID NO: 1195063 - RNA, 19 nt, Homo sapiens
gccaagagguggugugcua

SEQ ID NO: 1195064 - RNA, 19 nt, Homo sapiens
gaagagaaucugaguacaa

SEQ ID NO: 1195065 - RNA, 19 nt, Homo sapiens
caucaaagcaccucgagua

SEQ ID NO: 1195066 - RNA, 19 nt, Homo sapiens
ccacagguuucuaauauuc

SEQ ID NO: 1195067 - RNA, 19 nt, Homo sapiens
gaauguacgucacaaugau

SEQ ID NO: 1195068 - RNA, 19 nt, Homo sapiens
gaagaagccacauuccaaa

SEQ ID NO: 1195069 - RNA, 19 nt, Homo sapiens
gaaaccaccuaccggauca

SEQ ID NO: 1195070 - RNA, 19 nt, Homo sapiens
cagaagcacugcaaguuga

SEQ ID NO: 1195071 - RNA, 19 nt, Homo sapiens
gcaagaagcagcccaaagu

SEQ ID NO: 1195072 - RNA, 19 nt, Homo sapiens
gaccacagcaucugcauuu

SEQ ID NO: 1195073 - RNA, 19 nt, Homo sapiens
aagagcaucuagugcauua

SEQ ID NO: 1195074 - RNA, 19 nt, Homo sapiens
gugcaaaguguuacucuua

SEQ ID NO: 1195075 - RNA, 19 nt, Homo sapiens
gaaugguguuugaugguaa

SEQ ID NO: 1195076 - RNA, 19 nt, Homo sapiens
uaaccagaaugcaccuaua

SEQ ID NO: 1195077 - RNA, 19 nt, Homo sapiens
ccuuagaacucauuuauca

SEQ ID NO: 1195078 - RNA, 19 nt, Homo sapiens
gagggaaguucuccaugaa

SEQ ID NO: 1195079 - RNA, 19 nt, Homo sapiens
gaauguaaccugaaagauc

SEQ ID NO: 1195080 - RNA, 19 nt, Homo sapiens
gagaagugcccuaauugaa

SEQ ID NO: 1195081 - RNA, 19 nt, Homo sapiens
caucacacacgaacaauaa

SEQ ID NO: 1195082 - RNA, 19 nt, Homo sapiens
aauuggagcuggaccauuu

SEQ ID NO: 1195083 - RNA, 19 nt, Homo sapiens
ucucauggcuuuaguguca

SEQ ID NO: 1195084 - RNA, 19 nt, Homo sapiens
cauauucucugccuuguuc

SEQ ID NO: 1195085 - RNA, 19 nt, Homo sapiens
cuagagguaugaauuaaug

SEQ ID NO: 1195086 - RNA, 19 nt, Homo sapiens
gggaaguucuccaugaaug

SEQ ID NO: 1195087 - RNA, 19 nt, Homo sapiens
acagugaacuuguccuuug

SEQ ID NO: 1195088 - RNA, 19 nt, Homo sapiens
gcaaagcaccuuguauuuc

SEQ ID NO: 1195089 - RNA, 19 nt, Homo sapiens
ugagggaaguucuccauga

SEQ ID NO: 1195090 - RNA, 19 nt, Homo sapiens
guuauucucguucaaguua

SEQ ID NO: 1195091 - RNA, 19 nt, Homo sapiens
gcaaauauauuccaaaagg

SEQ ID NO: 1195092 - RNA, 19 nt, Homo sapiens
gaagccacauuccaaaucu

SEQ ID NO: 1195093 - RNA, 19 nt, Homo sapiens
ucagaaaccuauaccuuca

SEQ ID NO: 1195094 - RNA, 19 nt, Homo sapiens
cagaaauccucaaguacuu

SEQ ID NO: 1195095 - RNA, 19 nt, Homo sapiens
ucagggacauuuaagaguu

SEQ ID NO: 1195096 - RNA, 19 nt, Homo sapiens
gaccugaacacgucacuuu

SEQ ID NO: 1195097 - RNA, 19 nt, Homo sapiens
ggauuucaguguugucaga

SEQ ID NO: 1195098 - RNA, 19 nt, Homo sapiens
gguauugguuggaagagaa

SEQ ID NO: 1195099 - RNA, 19 nt, Homo sapiens
ugacggaauucacaugcua

SEQ ID NO: 1195100 - RNA, 19 nt, Homo sapiens
caccaugcauguuaugaaa

SEQ ID NO: 1195101 - RNA, 19 nt, Homo sapiens
gaagagccgugcaauaacg

SEQ ID NO: 1195102 - RNA, 19 nt, Homo sapiens
ggcaagagcaguuguguug

SEQ ID NO: 1195103 - RNA, 19 nt, Homo sapiens
cagaaugcaccuauaaauu

SEQ ID NO: 1195104 - RNA, 19 nt, Homo sapiens
aagagaaucugaguacaaa

SEQ ID NO: 1195105 - RNA, 19 nt, Homo sapiens
aaagaucuccuuccagaaa

SEQ ID NO: 1195106 - RNA, 19 nt, Homo sapiens
gaagcacacaguauacauu

SEQ ID NO: 1195107 - RNA, 19 nt, Homo sapiens
gcaacagauuaucauguga

SEQ ID NO: 1195108 - RNA, 19 nt, Homo sapiens
gagaagaccaguacagcaa

SEQ ID NO: 1195109 - RNA, 19 nt, Homo sapiens
gacauacauuccaagcuuu

SEQ ID NO: 1195110 - RNA, 19 nt, Homo sapiens
ugaagugugugaaguacaa

SEQ ID NO: 1195111 - RNA, 19 nt, Homo sapiens
gauauguucacucagauaa

SEQ ID NO: 1195112 - RNA, 19 nt, Homo sapiens
gggcuaggauuucaguguu

SEQ ID NO: 1195113 - RNA, 19 nt, Homo sapiens
gaaguucuccaugaaugua

SEQ ID NO: 1195114 - RNA, 19 nt, Homo sapiens
gagcaucuagugcauuaaa

SEQ ID NO: 1195115 - RNA, 19 nt, Homo sapiens
guguuacucuuacguguuu

SEQ ID NO: 1195116 - RNA, 19 nt, Homo sapiens
gcagucuucuuauguguca

SEQ ID NO: 1195117 - RNA, 19 nt, Homo sapiens
cuacaggccuucaaucaag

SEQ ID NO: 1195118 - RNA, 19 nt, Homo sapiens
gaccaaagcacaaagaagu

SEQ ID NO: 1195119 - RNA, 19 nt, Homo sapiens
uuacaguggagaagaauua

SEQ ID NO: 1195120 - RNA, 19 nt, Homo sapiens
cacaauauauggugagcaa

SEQ ID NO: 1195121 - RNA, 19 nt, Homo sapiens
gcacaagaaauuccaguca

SEQ ID NO: 1195122 - RNA, 19 nt, Homo sapiens
acuagagaguucuguauuu

SEQ ID NO: 1195123 - RNA, 19 nt, Homo sapiens
gaccagaauuauaugacaa

SEQ ID NO: 1195124 - RNA, 19 nt, Homo sapiens
uauggagcauuguagauuu

SEQ ID NO: 1195125 - RNA, 19 nt, Homo sapiens
gggagaagaugaagaaucc

SEQ ID NO: 1195126 - RNA, 19 nt, Homo sapiens
gguauggucccuauucuga

SEQ ID NO: 1195127 - RNA, 19 nt, Homo sapiens
gcgaaguucuuguuuguac

SEQ ID NO: 1195128 - RNA, 19 nt, Homo sapiens
gagguggccuuaucagaca

SEQ ID NO: 1195129 - RNA, 19 nt, Homo sapiens
gaaauuccagucaugugaa

SEQ ID NO: 1195130 - RNA, 19 nt, Homo sapiens
uugaacaucuguaucugua

SEQ ID NO: 1195131 - RNA, 19 nt, Homo sapiens
ggacauacgugaacaaauu

SEQ ID NO: 1195132 - RNA, 19 nt, Homo sapiens
gaacgggauuguuuaauaa

SEQ ID NO: 1195133 - RNA, 19 nt, Homo sapiens
gcagagccuuccuccauua

SEQ ID NO: 1195134 - RNA, 19 nt, Homo sapiens
ggaaucaccugguucaaga

SEQ ID NO: 1195135 - RNA, 19 nt, Homo sapiens
ggacaucccugaagagcuu

SEQ ID NO: 1195136 - RNA, 19 nt, Homo sapiens
agaacgggauuguuuaaua

SEQ ID NO: 1195137 - RNA, 19 nt, Homo sapiens
gaacuguccuuucucaaca

SEQ ID NO: 1195138 - RNA, 19 nt, Homo sapiens
ccagaguccucguggauuu

SEQ ID NO: 1195139 - RNA, 19 nt, Homo sapiens
gacacucggucuucucuuu

SEQ ID NO: 1195140 - RNA, 19 nt, Homo sapiens
ggacacacccggaccagaa

SEQ ID NO: 1195141 - RNA, 19 nt, Homo sapiens
ugaaggugaucucgaguuu

SEQ ID NO: 1195142 - RNA, 19 nt, Homo sapiens
aaacgcagccuuacauuug

SEQ ID NO: 1195143 - RNA, 19 nt, Homo sapiens
gcucgggucucaauucuuc

SEQ ID NO: 1195144 - RNA, 19 nt, Homo sapiens
ggcaguaggugucuccaaa

SEQ ID NO: 1195145 - RNA, 19 nt, Homo sapiens
gaacuacaguguccccaua

SEQ ID NO: 1195146 - RNA, 19 nt, Homo sapiens
uaaaguggacccugauaaa

SEQ ID NO: 1195147 - RNA, 19 nt, Homo sapiens
caucaaagaccuagacguu

SEQ ID NO: 1195148 - RNA, 19 nt, Homo sapiens
cagaagcgcuuuugcaauu

SEQ ID NO: 1195149 - RNA, 19 nt, Homo sapiens
gcugaacuguccuuucuca

SEQ ID NO: 1195150 - RNA, 19 nt, Homo sapiens
gagaaaauccccauacuga

SEQ ID NO: 1195151 - RNA, 19 nt, Homo sapiens
guggagacuucgcaaagaa

SEQ ID NO: 1195152 - RNA, 19 nt, Homo sapiens
caaaggauccggcucucaa

SEQ ID NO: 1195153 - RNA, 19 nt, Homo sapiens
ucaaagaccuagacguuuu

SEQ ID NO: 1195154 - RNA, 19 nt, Homo sapiens
ggacugagugaguggcuaa

SEQ ID NO: 1195155 - RNA, 19 nt, Homo sapiens
ggucucaauucuucucaga

SEQ ID NO: 1195156 - RNA, 19 nt, Homo sapiens
cgacaucacuguggacuac

SEQ ID NO: 1195157 - RNA, 19 nt, Homo sapiens
gaucuggaauaugccauga

SEQ ID NO: 1195158 - RNA, 19 nt, Homo sapiens
cacaggauacccaacuuua

SEQ ID NO: 1195159 - RNA, 19 nt, Homo sapiens
gccuuacauuugcucauua

SEQ ID NO: 1195160 - RNA, 19 nt, Homo sapiens
caaagaaaacgcagccuua

SEQ ID NO: 1195161 - RNA, 19 nt, Homo sapiens
gcgcagagccuuccuccau

SEQ ID NO: 1195162 - RNA, 19 nt, Homo sapiens
caaugggaaucaccugguu

SEQ ID NO: 1195163 - RNA, 19 nt, Homo sapiens
ccagagcacaggaaguuaa

SEQ ID NO: 1195164 - RNA, 19 nt, Homo sapiens
gaacaggagaagaugaaca

SEQ ID NO: 1195165 - RNA, 19 nt, Homo sapiens
gcucauuaaagacagauuu

SEQ ID NO: 1195166 - RNA, 19 nt, Homo sapiens
gaucaguccucaggucaca

SEQ ID NO: 1195167 - RNA, 19 nt, Homo sapiens
gacauacgugaacaaauuu

SEQ ID NO: 1195168 - RNA, 19 nt, Homo sapiens
gccuggagaugauggagaa

SEQ ID NO: 1195169 - RNA, 19 nt, Homo sapiens
ccuuacauuugcucauuaa

SEQ ID NO: 1195170 - RNA, 19 nt, Homo sapiens
ccucguggauuuaguugug

SEQ ID NO: 1195171 - RNA, 19 nt, Homo sapiens
ugagaacgggauuguuuaa

SEQ ID NO: 1195172 - RNA, 19 nt, Homo sapiens
uggcugaacuguccuuucu

SEQ ID NO: 1195173 - RNA, 19 nt, Homo sapiens
gaccggcucugggagaaug

SEQ ID NO: 1195174 - RNA, 19 nt, Homo sapiens
gagaccggcucugggagaa

SEQ ID NO: 1195175 - RNA, 19 nt, Homo sapiens
gggcugaacaggagaagau

SEQ ID NO: 1195176 - RNA, 19 nt, Homo sapiens
cuacgccgaucuggaauau

SEQ ID NO: 1195177 - RNA, 19 nt, Homo sapiens
gagcacaggaaguuaaagu

SEQ ID NO: 1195178 - RNA, 19 nt, Homo sapiens
gagaagaugaacaaaggau

SEQ ID NO: 1195179 - RNA, 19 nt, Homo sapiens
aggagaagaugaacaaagg

SEQ ID NO: 1195180 - RNA, 19 nt, Homo sapiens
gaaaaugugccaccucuca

SEQ ID NO: 1195181 - RNA, 19 nt, Homo sapiens
gacauuuucucauugguuu

SEQ ID NO: 1195182 - RNA, 19 nt, Homo sapiens
gcuuuuaaguggagauuuu

SEQ ID NO: 1195183 - RNA, 19 nt, Homo sapiens
gaccagaaaccaauuccau

SEQ ID NO: 1195184 - RNA, 19 nt, Homo sapiens
ucuggaauaugccaugaug

SEQ ID NO: 1195185 - RNA, 19 nt, Homo sapiens
gggauuguuuaauaagauc

SEQ ID NO: 1195186 - RNA, 19 nt, Homo sapiens
ucacaggauacccaacuuu

SEQ ID NO: 1195187 - RNA, 19 nt, Homo sapiens
acugagaacgggauuguuu

SEQ ID NO: 1195188 - RNA, 19 nt, Homo sapiens
uuaaaguggacccugauaa

SEQ ID NO: 1195189 - RNA, 19 nt, Homo sapiens
caguaggugucuccaaaca

SEQ ID NO: 1195190 - RNA, 19 nt, Homo sapiens
acaggauacccaacuuuaa

SEQ ID NO: 1195191 - RNA, 19 nt, Homo sapiens
uaccaaguguucuuugaag

SEQ ID NO: 1195192 - RNA, 19 nt, Homo sapiens
cgcagagccuuccuccauu

SEQ ID NO: 1195193 - RNA, 19 nt, Homo sapiens
guuaaaguggacccugaua

SEQ ID NO: 1195194 - RNA, 19 nt, Homo sapiens
gaagcgcuuuugcaauuga

SEQ ID NO: 1195195 - RNA, 19 nt, Homo sapiens
gaacaaauuuggggcuaca

SEQ ID NO: 1195196 - RNA, 19 nt, Homo sapiens
gcgacugcaucaccaugga

SEQ ID NO: 1195197 - RNA, 19 nt, Homo sapiens
caaacaggacauacgugaa

SEQ ID NO: 1195198 - RNA, 19 nt, Homo sapiens
cgggauuguuuaauaagau

SEQ ID NO: 1195199 - RNA, 19 nt, Homo sapiens
gggcaacaagucaaaauaa

SEQ ID NO: 1195200 - RNA, 19 nt, Homo sapiens
cuccaguucuguuucuaaa

SEQ ID NO: 1195201 - RNA, 19 nt, Homo sapiens
cugagaacgggauuguuua

SEQ ID NO: 1195202 - RNA, 19 nt, Homo sapiens
caggauacccaacuuuaag

SEQ ID NO: 1195203 - RNA, 19 nt, Homo sapiens
gaaaacgcagccuuacauu

SEQ ID NO: 1195204 - RNA, 19 nt, Homo sapiens
gcucugggagaauggguuu

SEQ ID NO: 1195205 - RNA, 19 nt, Homo sapiens
ggagaagaugaacaaagga

SEQ ID NO: 1195206 - RNA, 19 nt, Homo sapiens
aaggugaucucgaguuugc

SEQ ID NO: 1195207 - RNA, 19 nt, Homo sapiens
gaaggugaucucgaguuug

SEQ ID NO: 1195208 - RNA, 19 nt, Homo sapiens
gcuacgccgaucuggaaua

SEQ ID NO: 1195209 - RNA, 19 nt, Homo sapiens
cagagcacaggaaguuaaa

SEQ ID NO: 1195210 - RNA, 19 nt, Homo sapiens
gcagcagagggacaaguga

SEQ ID NO: 1195211 - RNA, 19 nt, Homo sapiens
aagaucagccuggagauga

SEQ ID NO: 1195212 - RNA, 19 nt, Homo sapiens
caagaucagccuggagaug

SEQ ID NO: 1195213 - RNA, 19 nt, Homo sapiens
guuccaacaccacgacuga

SEQ ID NO: 1195214 - RNA, 19 nt, Homo sapiens
aaacaggacauacgugaac

SEQ ID NO: 1195215 - RNA, 19 nt, Homo sapiens
uguggagacuucgcaaaga

SEQ ID NO: 1195216 - RNA, 19 nt, Homo sapiens
ccaaagccaaugggaauca

SEQ ID NO: 1195217 - RNA, 19 nt, Homo sapiens
gcaagcgcccaaagccaau

SEQ ID NO: 1195218 - RNA, 19 nt, Homo sapiens
gacuacauccucacuccaa

SEQ ID NO: 1195219 - RNA, 19 nt, Homo sapiens
cagaguccucguggauuua

SEQ ID NO: 1195220 - RNA, 19 nt, Homo sapiens
gagaacgggauuguuuaau

SEQ ID NO: 1195221 - RNA, 19 nt, Homo sapiens
cacucggucuucucuuuga

SEQ ID NO: 1195222 - RNA, 19 nt, Homo sapiens
uuuaccaaguguucuuuga

SEQ ID NO: 1195223 - RNA, 19 nt, Homo sapiens
cagccuacgucacauuugc

SEQ ID NO: 1195224 - RNA, 19 nt, Homo sapiens
gacacacccggaccagaaa

SEQ ID NO: 1195225 - RNA, 19 nt, Homo sapiens
cgacugagaacgggauugu

SEQ ID NO: 1195226 - RNA, 19 nt, Homo sapiens
gggaaucaccugguucaag

SEQ ID NO: 1195227 - RNA, 19 nt, Homo sapiens
gugcacgcgcuuucaagaa

SEQ ID NO: 1195228 - RNA, 19 nt, Homo sapiens
acauuugcccagugccuua

SEQ ID NO: 1195229 - RNA, 19 nt, Homo sapiens
uugagucgguuucuguuuc

SEQ ID NO: 1195230 - RNA, 19 nt, Homo sapiens
ccaacaccacgacugagaa

SEQ ID NO: 1195231 - RNA, 19 nt, Homo sapiens
guagagggauccagaagua

SEQ ID NO: 1195232 - RNA, 19 nt, Homo sapiens
ugaggaagcugguggauuu

SEQ ID NO: 1195233 - RNA, 19 nt, Homo sapiens
gcuaaugagucgcgaauaa

SEQ ID NO: 1195234 - RNA, 19 nt, Homo sapiens
gcagagagccuugcuguuu

SEQ ID NO: 1195235 - RNA, 19 nt, Homo sapiens
cagagagccuugcuguuua

SEQ ID NO: 1195236 - RNA, 19 nt, Homo sapiens
ggacgacacccacuacuuu

SEQ ID NO: 1195237 - RNA, 19 nt, Homo sapiens
gaccuccagugcuguauua

SEQ ID NO: 1195238 - RNA, 19 nt, Homo sapiens
guaaugagaugcuaaugag

SEQ ID NO: 1195239 - RNA, 19 nt, Homo sapiens
gcauugaucuggagaacau

SEQ ID NO: 1195240 - RNA, 19 nt, Homo sapiens
gccuugcuguuuacaauua

SEQ ID NO: 1195241 - RNA, 19 nt, Homo sapiens
gcuguauuauuccuuagua

SEQ ID NO: 1195242 - RNA, 19 nt, Homo sapiens
gagccuugcuguuuacaau

SEQ ID NO: 1195243 - RNA, 19 nt, Homo sapiens
uggagaacauuguguacua

SEQ ID NO: 1195244 - RNA, 19 nt, Homo sapiens
cuucaaaguucgagaaaug

SEQ ID NO: 1195245 - RNA, 19 nt, Homo sapiens
caacggcgacuaaaugaga

SEQ ID NO: 1195246 - RNA, 19 nt, Homo sapiens
ggaccugugugcacuuugu

SEQ ID NO: 1195247 - RNA, 19 nt, Homo sapiens
guacgagaccuguaugaug

SEQ ID NO: 1195248 - RNA, 19 nt, Homo sapiens
ucaaggaccagcucaacua

SEQ ID NO: 1195249 - RNA, 19 nt, Homo sapiens
agaagaagaugugccuuug

SEQ ID NO: 1195250 - RNA, 19 nt, Homo sapiens
gaaguaaugagaugcuaau

SEQ ID NO: 1195251 - RNA, 19 nt, Homo sapiens
uacgagaccuguaugaugu

SEQ ID NO: 1195252 - RNA, 19 nt, Homo sapiens
gcaacugcuugggcacuaa

SEQ ID NO: 1195253 - RNA, 19 nt, Homo sapiens
gagcuacgaggcuacauga

SEQ ID NO: 1195254 - RNA, 19 nt, Homo sapiens
aagaagaugugccuuugga

SEQ ID NO: 1195255 - RNA, 19 nt, Homo sapiens
gaggcaaacuggccauugg

SEQ ID NO: 1195256 - RNA, 19 nt, Homo sapiens
ccucaggcaccaugaauaa

SEQ ID NO: 1195257 - RNA, 19 nt, Homo sapiens
caaguucucucgccacaac

SEQ ID NO: 1195258 - RNA, 19 nt, Homo sapiens
ggacucagauguggaacag

SEQ ID NO: 1195259 - RNA, 19 nt, Homo sapiens
cagcgguuguccucccuua

SEQ ID NO: 1195260 - RNA, 19 nt, Homo sapiens
cacuaaagguggcagagaa

SEQ ID NO: 1195261 - RNA, 19 nt, Homo sapiens
gaacaacgacaagacagau

SEQ ID NO: 1195262 - RNA, 19 nt, Homo sapiens
gaauuugacguccuuaucu

SEQ ID NO: 1195263 - RNA, 19 nt, Homo sapiens
gaaauucacugggguguca

SEQ ID NO: 1195264 - RNA, 19 nt, Homo sapiens
aggaggagaugaagagguu

SEQ ID NO: 1195265 - RNA, 19 nt, Homo sapiens
cgaaggaggaggagaugaa

SEQ ID NO: 1195266 - RNA, 19 nt, Homo sapiens
gcugggagcucuggaagca

SEQ ID NO: 1195267 - RNA, 19 nt, Homo sapiens
ggaacaacgacaagacaga

SEQ ID NO: 1195268 - RNA, 19 nt, Homo sapiens
ucacagacauccccagaaa

SEQ ID NO: 1195269 - RNA, 19 nt, Homo sapiens
agacacaggugccggagau

SEQ ID NO: 1195270 - RNA, 19 nt, Homo sapiens
ccaagucacuguggaccaa

SEQ ID NO: 1195271 - RNA, 19 nt, Homo sapiens
aauugaaucuggaggagaa

SEQ ID NO: 1195272 - RNA, 19 nt, Homo sapiens
cccaggagauggacauuuc

SEQ ID NO: 1195273 - RNA, 19 nt, Homo sapiens
gaguccacgucuccgauuu

SEQ ID NO: 1195274 - RNA, 19 nt, Homo sapiens
cuccagugcuguauuauuc

SEQ ID NO: 1195275 - RNA, 19 nt, Homo sapiens
uaaagguggcagagaauga

SEQ ID NO: 1195276 - RNA, 19 nt, Homo sapiens
caggcaccaugaauaacua

SEQ ID NO: 1195277 - RNA, 19 nt, Homo sapiens
ggagaacauuguguacuac

SEQ ID NO: 1195278 - RNA, 19 nt, Homo sapiens
cugcagaccuuugccaaga

SEQ ID NO: 1195279 - RNA, 19 nt, Homo sapiens
gagauggacauuucuacug

SEQ ID NO: 1195280 - RNA, 19 nt, Homo sapiens
agaccuguaugaugugcua

SEQ ID NO: 1195281 - RNA, 19 nt, Homo sapiens
gcaauguggcccaguaugg

SEQ ID NO: 1195282 - RNA, 19 nt, Homo sapiens
gacacccacuacuuuguga

SEQ ID NO: 1195283 - RNA, 19 nt, Homo sapiens
ucucaaagccacaggcauu

SEQ ID NO: 1195284 - RNA, 19 nt, Homo sapiens
ggaagcugguggauuuggu

SEQ ID NO: 1195285 - RNA, 19 nt, Homo sapiens
cagaaguaaugagaugcua

SEQ ID NO: 1195286 - RNA, 19 nt, Homo sapiens
gagcagcacccaggagaug

SEQ ID NO: 1195287 - RNA, 19 nt, Homo sapiens
gcacuaaagguggcagaga

SEQ ID NO: 1195288 - RNA, 19 nt, Homo sapiens
gcgcaugcccacuuugaga

SEQ ID NO: 1195289 - RNA, 19 nt, Homo sapiens
ggacuggccagacaccaau

SEQ ID NO: 1195290 - RNA, 19 nt, Homo sapiens
gcuggccaacuaugaauuu

SEQ ID NO: 1195291 - RNA, 19 nt, Homo sapiens
cugcccagcuggccaacua

SEQ ID NO: 1195292 - RNA, 19 nt, Homo sapiens
ugaucacggugcaggaauu

SEQ ID NO: 1195293 - RNA, 19 nt, Homo sapiens
aagaagaagaugugccuuu

SEQ ID NO: 1195294 - RNA, 19 nt, Homo sapiens
acagcucguugacaagaaa

SEQ ID NO: 1195295 - RNA, 19 nt, Homo sapiens
gugaagaggaagaagaaga

SEQ ID NO: 1195296 - RNA, 19 nt, Homo sapiens
gaggaggccgagcucauga

SEQ ID NO: 1195297 - RNA, 19 nt, Homo sapiens
acaccucuauguccuggaa

SEQ ID NO: 1195298 - RNA, 19 nt, Homo sapiens
agugcuguauuauuccuua

SEQ ID NO: 1195299 - RNA, 19 nt, Homo sapiens
gaggaacaacgacaagaca

SEQ ID NO: 1195300 - RNA, 19 nt, Homo sapiens
cagccaacuuugugaaugg

SEQ ID NO: 1195301 - RNA, 19 nt, Homo sapiens
cuaaugagucgcgaauaaa

SEQ ID NO: 1195302 - RNA, 19 nt, Homo sapiens
caacauggcgucggacucu

SEQ ID NO: 1195303 - RNA, 19 nt, Homo sapiens
gaagaagaugugccuuugg

SEQ ID NO: 1195304 - RNA, 19 nt, Homo sapiens
aaaggaaggcagcgauaga

SEQ ID NO: 1195305 - RNA, 19 nt, Homo sapiens
ccacgucuccgauuugucu

SEQ ID NO: 1195306 - RNA, 19 nt, Homo sapiens
uguaccagcuucugucaca

SEQ ID NO: 1195307 - RNA, 19 nt, Homo sapiens
ugaagaggaagaagaagau

SEQ ID NO: 1195308 - RNA, 19 nt, Homo sapiens
gagaaugagcugggcauca

SEQ ID NO: 1195309 - RNA, 19 nt, Homo sapiens
gaguucugcucgugugcaa

SEQ ID NO: 1195310 - RNA, 19 nt, Homo sapiens
ccugaugucucugccuuug

SEQ ID NO: 1195311 - RNA, 19 nt, Homo sapiens
gaacagcaaaagaaacuau

SEQ ID NO: 1195312 - RNA, 19 nt, Homo sapiens
augaauaacuacccaacau

SEQ ID NO: 1195313 - RNA, 19 nt, Homo sapiens
gaagaggaagaagaagaug

SEQ ID NO: 1195314 - RNA, 19 nt, Homo sapiens
ccagugaagaggaagaaga

SEQ ID NO: 1195315 - RNA, 19 nt, Homo sapiens
gaaaacaugcaucgcaaug

SEQ ID NO: 1195316 - RNA, 19 nt, Homo sapiens
ggaagaaaaccuaaagaca

SEQ ID NO: 1195317 - RNA, 19 nt, Homo sapiens
gaaaagcgcaccaaguucu

SEQ ID NO: 1195318 - RNA, 19 nt, Homo sapiens
cagugaagaggaagaagaa

SEQ ID NO: 1195319 - RNA, 19 nt, Homo sapiens
ccacaccaagugagaauag

SEQ ID NO: 1195320 - RNA, 19 nt, Homo sapiens
cgauagaggcccugagagu

SEQ ID NO: 1195321 - RNA, 19 nt, Homo sapiens
ggaccuccagugcuguauu

SEQ ID NO: 1195322 - RNA, 19 nt, Homo sapiens
gagggauccagaaguaaug

SEQ ID NO: 1195323 - RNA, 19 nt, Homo sapiens
gacgacacccacuacuuug

SEQ ID NO: 1195324 - RNA, 19 nt, Homo sapiens
ggccaacuaugaauuugac

SEQ ID NO: 1195325 - RNA, 19 nt, Homo sapiens
ggagcuacgaggcuacaug

SEQ ID NO: 1195326 - RNA, 19 nt, Homo sapiens
ucacggugcaggaauugaa

SEQ ID NO: 1195327 - RNA, 19 nt, Homo sapiens
ugucaacggccauuucuuc

SEQ ID NO: 1195328 - RNA, 19 nt, Homo sapiens
caaggaaaaugcagaggau

SEQ ID NO: 1195329 - RNA, 19 nt, Homo sapiens
gcagaggaacaacgacaag

SEQ ID NO: 1195330 - RNA, 19 nt, Homo sapiens
gaucacggugcaggaauug

SEQ ID NO: 1195331 - RNA, 19 nt, Homo sapiens
guaaagcacuggcaaguuu

SEQ ID NO: 1195332 - RNA, 19 nt, Homo sapiens
ggaaagaaaccaaagauuu

SEQ ID NO: 1195333 - RNA, 19 nt, Homo sapiens
ccaaaugguucaauaauga

SEQ ID NO: 1195334 - RNA, 19 nt, Homo sapiens
gcacuggccucuuagguuu

SEQ ID NO: 1195335 - RNA, 19 nt, Homo sapiens
cagaagugcugguuagaua

SEQ ID NO: 1195336 - RNA, 19 nt, Homo sapiens
gaucugaaauguuugagaa

SEQ ID NO: 1195337 - RNA, 19 nt, Homo sapiens
gucaagaaauuccaguuua

SEQ ID NO: 1195338 - RNA, 19 nt, Homo sapiens
gcaaguuuguuacuguuaa

SEQ ID NO: 1195339 - RNA, 19 nt, Homo sapiens
agaaagcacuguaugguuu

SEQ ID NO: 1195340 - RNA, 19 nt, Homo sapiens
gaagcucccuuagugauuu

SEQ ID NO: 1195341 - RNA, 19 nt, Homo sapiens
ggaugcagcugcucacuug

SEQ ID NO: 1195342 - RNA, 19 nt, Homo sapiens
ccacguagaugaugucugu

SEQ ID NO: 1195343 - RNA, 19 nt, Homo sapiens
ccaaggagacucuguauga

SEQ ID NO: 1195344 - RNA, 19 nt, Homo sapiens
caagccaaaugguucaaua

SEQ ID NO: 1195345 - RNA, 19 nt, Homo sapiens
ggaagugguugauuaucuu

SEQ ID NO: 1195346 - RNA, 19 nt, Homo sapiens
gcaaaacaauuagcaguua

SEQ ID NO: 1195347 - RNA, 19 nt, Homo sapiens
gaucaucgccguugaggaa

SEQ ID NO: 1195348 - RNA, 19 nt, Homo sapiens
caacuuagccagucuuguu

SEQ ID NO: 1195349 - RNA, 19 nt, Homo sapiens
acacugaguucucuauauu

SEQ ID NO: 1195350 - RNA, 19 nt, Homo sapiens
gugaaaggauggccucauu

SEQ ID NO: 1195351 - RNA, 19 nt, Homo sapiens
gaggaagcauuucauguuc

SEQ ID NO: 1195352 - RNA, 19 nt, Homo sapiens
gaaaccucgucucuacuaa

SEQ ID NO: 1195353 - RNA, 19 nt, Homo sapiens
ggaaguuucuggccaucaa

SEQ ID NO: 1195354 - RNA, 19 nt, Homo sapiens
caucgcugcuugauccuua

SEQ ID NO: 1195355 - RNA, 19 nt, Homo sapiens
ggaagcauuucauguucaa

SEQ ID NO: 1195356 - RNA, 19 nt, Homo sapiens
ggugaaaccucgucucuac

SEQ ID NO: 1195357 - RNA, 19 nt, Homo sapiens
cgaagcacauggaggauga

SEQ ID NO: 1195358 - RNA, 19 nt, Homo sapiens
ggacaaggcaagcggauau

SEQ ID NO: 1195359 - RNA, 19 nt, Homo sapiens
ggcauuauuugaucugaaa

SEQ ID NO: 1195360 - RNA, 19 nt, Homo sapiens
ggaccugauucuaguuuau

SEQ ID NO: 1195361 - RNA, 19 nt, Homo sapiens
gcaauggaccugauucuag

SEQ ID NO: 1195362 - RNA, 19 nt, Homo sapiens
gccaaaugguucaauaaug

SEQ ID NO: 1195363 - RNA, 19 nt, Homo sapiens
gguugggucuugccagaua

SEQ ID NO: 1195364 - RNA, 19 nt, Homo sapiens
guuaguggcucuauugcaa

SEQ ID NO: 1195365 - RNA, 19 nt, Homo sapiens
caacggacugcguguguua

SEQ ID NO: 1195366 - RNA, 19 nt, Homo sapiens
ucaccuuccucuucguuua

SEQ ID NO: 1195367 - RNA, 19 nt, Homo sapiens
ccaaagcauuuacugguau

SEQ ID NO: 1195368 - RNA, 19 nt, Homo sapiens
uuucuaaucuugcugguuu

SEQ ID NO: 1195369 - RNA, 19 nt, Homo sapiens
gcuuaaacuuugaucugua

SEQ ID NO: 1195370 - RNA, 19 nt, Homo sapiens
gauuaucuuugccuucauu

SEQ ID NO: 1195371 - RNA, 19 nt, Homo sapiens
gagacucuguaugagauua

SEQ ID NO: 1195372 - RNA, 19 nt, Homo sapiens
ggccaaagaggaagcauuu

SEQ ID NO: 1195373 - RNA, 19 nt, Homo sapiens
gagcagcugugucacuugu

SEQ ID NO: 1195374 - RNA, 19 nt, Homo sapiens
gcgcacgccuguaaucuca

SEQ ID NO: 1195375 - RNA, 19 nt, Homo sapiens
gggaagugguugauuaucu

SEQ ID NO: 1195376 - RNA, 19 nt, Homo sapiens
caccuguacuuuagaguuu

SEQ ID NO: 1195377 - RNA, 19 nt, Homo sapiens
uaacaggcagcauccauuu

SEQ ID NO: 1195378 - RNA, 19 nt, Homo sapiens
uguacuacguccuuguuua

SEQ ID NO: 1195379 - RNA, 19 nt, Homo sapiens
caauggaccugauucuagu

SEQ ID NO: 1195380 - RNA, 19 nt, Homo sapiens
gaagaaagcacuguauggu

SEQ ID NO: 1195381 - RNA, 19 nt, Homo sapiens
gcaagcggauauaugaaag

SEQ ID NO: 1195382 - RNA, 19 nt, Homo sapiens
caaagcauuuacugguauu

SEQ ID NO: 1195383 - RNA, 19 nt, Homo sapiens
gagaauaugcggcuuaaac

SEQ ID NO: 1195384 - RNA, 19 nt, Homo sapiens
uuugggaagugguugauua

SEQ ID NO: 1195385 - RNA, 19 nt, Homo sapiens
caaggacagugagaagaaa

SEQ ID NO: 1195386 - RNA, 19 nt, Homo sapiens
cggcggagaugguauguuc

SEQ ID NO: 1195387 - RNA, 19 nt, Homo sapiens
ccuguaaucucagcuacua

SEQ ID NO: 1195388 - RNA, 19 nt, Homo sapiens
ucacaaaguuuccccaaaa

SEQ ID NO: 1195389 - RNA, 19 nt, Homo sapiens
gcuccugguuggaaagaaa

SEQ ID NO: 1195390 - RNA, 19 nt, Homo sapiens
gaaaggauggccucauucu

SEQ ID NO: 1195391 - RNA, 19 nt, Homo sapiens
uugcaggacuuauucugua

SEQ ID NO: 1195392 - RNA, 19 nt, Homo sapiens
gcagaagaaagcacuguau

SEQ ID NO: 1195393 - RNA, 19 nt, Homo sapiens
gaaaauggcagaaaaugga

SEQ ID NO: 1195394 - RNA, 19 nt, Homo sapiens
ccacugacaucaucguuac

SEQ ID NO: 1195395 - RNA, 19 nt, Homo sapiens
gcggauauaugaaagaaaa

SEQ ID NO: 1195396 - RNA, 19 nt, Homo sapiens
gggaaagucugagugaaag

SEQ ID NO: 1195397 - RNA, 19 nt, Homo sapiens
ugacuucguuccugaauac

SEQ ID NO: 1195398 - RNA, 19 nt, Homo sapiens
acaauuagcaguuaugcaa

SEQ ID NO: 1195399 - RNA, 19 nt, Homo sapiens
gagaucagccugcccaaca

SEQ ID NO: 1195400 - RNA, 19 nt, Homo sapiens
gcagaagcucccuuaguga

SEQ ID NO: 1195401 - RNA, 19 nt, Homo sapiens
ugcagaagcucccuuagug

SEQ ID NO: 1195402 - RNA, 19 nt, Homo sapiens
caacaguguaguuuagaaa

SEQ ID NO: 1195403 - RNA, 19 nt, Homo sapiens
ccagcugguucgacucuuu

SEQ ID NO: 1195404 - RNA, 19 nt, Homo sapiens
ucaagaaauuccaguuuac

SEQ ID NO: 1195405 - RNA, 19 nt, Homo sapiens
caucaccacugacaucauc

SEQ ID NO: 1195406 - RNA, 19 nt, Homo sapiens
gcaccacuguucaccuuag

SEQ ID NO: 1195407 - RNA, 19 nt, Homo sapiens
cuagauaggcucugauuuc

SEQ ID NO: 1195408 - RNA, 19 nt, Homo sapiens
cugaguggcucuggugaua

SEQ ID NO: 1195409 - RNA, 19 nt, Homo sapiens
gaauaugcggcuuaaacuu

SEQ ID NO: 1195410 - RNA, 19 nt, Homo sapiens
gcucugugccuguaucuga

SEQ ID NO: 1195411 - RNA, 19 nt, Homo sapiens
gaagugguugauuaucuuu

SEQ ID NO: 1195412 - RNA, 19 nt, Homo sapiens
guacauauuuggcauuuuc

SEQ ID NO: 1195413 - RNA, 19 nt, Homo sapiens
acaaacauguccugugcuu

SEQ ID NO: 1195414 - RNA, 19 nt, Homo sapiens
ccaaagaggaagcauuuca

SEQ ID NO: 1195415 - RNA, 19 nt, Homo sapiens
ggucaggaguuugagauca

SEQ ID NO: 1195416 - RNA, 19 nt, Homo sapiens
ugucaaauaccaaugcuuu

SEQ ID NO: 1195417 - RNA, 19 nt, Homo sapiens
gaaaugcuccagguucaau

SEQ ID NO: 1195418 - RNA, 19 nt, Homo sapiens
gaaagcacuguaugguuug

SEQ ID NO: 1195419 - RNA, 19 nt, Homo sapiens
caacaccuguacuuuagag

SEQ ID NO: 1195420 - RNA, 19 nt, Homo sapiens
aauaugcggcuuaaacuuu

SEQ ID NO: 1195421 - RNA, 19 nt, Homo sapiens
ucaacaguguaguuuagaa

SEQ ID NO: 1195422 - RNA, 19 nt, Homo sapiens
uuacagaccaauuauguug

SEQ ID NO: 1195423 - RNA, 19 nt, Homo sapiens
uuacugaacaugcuaauca

SEQ ID NO: 1195424 - RNA, 19 nt, Homo sapiens
aaucagaagugcugguuag

SEQ ID NO: 1195425 - RNA, 19 nt, Homo sapiens
ugaaaccucgucucuacua

SEQ ID NO: 1195426 - RNA, 19 nt, Homo sapiens
aaacuuugaucuguaagga

SEQ ID NO: 1195427 - RNA, 19 nt, Homo sapiens
uaaacugcgucucggaugu

SEQ ID NO: 1195428 - RNA, 19 nt, Homo sapiens
guacacgugguccagauuu

SEQ ID NO: 1195429 - RNA, 19 nt, Homo sapiens
ccacuuugcaggacuuauu

SEQ ID NO: 1195430 - RNA, 19 nt, Homo sapiens
aaacauguccugugcuugu

SEQ ID NO: 1195431 - RNA, 19 nt, Homo sapiens
gcacagacauggaacagua

SEQ ID NO: 1195432 - RNA, 19 nt, Homo sapiens
gacgagaacuggcauauuu

SEQ ID NO: 1195433 - RNA, 19 nt, Homo sapiens
gaaggaagauggcgcuguu

SEQ ID NO: 1195434 - RNA, 19 nt, Homo sapiens
gcagcaagguucacggaua

SEQ ID NO: 1195435 - RNA, 19 nt, Homo sapiens
caucuuugcuugcagcuua

SEQ ID NO: 1195436 - RNA, 19 nt, Homo sapiens
guacugggcucuuaagcaa

SEQ ID NO: 1195437 - RNA, 19 nt, Homo sapiens
gaauaaacaugcccugaag

SEQ ID NO: 1195438 - RNA, 19 nt, Homo sapiens
ucauuuggguucagaauaa

SEQ ID NO: 1195439 - RNA, 19 nt, Homo sapiens
gcacaggacagaaggaauu

SEQ ID NO: 1195440 - RNA, 19 nt, Homo sapiens
gagaauuuguuguaacuuc

SEQ ID NO: 1195441 - RNA, 19 nt, Homo sapiens
gcgagggacuucacucuug

SEQ ID NO: 1195442 - RNA, 19 nt, Homo sapiens
ugaaagggaucauaucauc

SEQ ID NO: 1195443 - RNA, 19 nt, Homo sapiens
aaacaugcccugaaguuaa

SEQ ID NO: 1195444 - RNA, 19 nt, Homo sapiens
gaagauggcgcuguuauca

SEQ ID NO: 1195445 - RNA, 19 nt, Homo sapiens
aagaucagcuuuguuguaa

SEQ ID NO: 1195446 - RNA, 19 nt, Homo sapiens
gucgguagcugaugucaaa

SEQ ID NO: 1195447 - RNA, 19 nt, Homo sapiens
guaaugagcacuaaaugug

SEQ ID NO: 1195448 - RNA, 19 nt, Homo sapiens
gauugugccugaccuuuau

SEQ ID NO: 1195449 - RNA, 19 nt, Homo sapiens
ggauugugccugaccuuua

SEQ ID NO: 1195450 - RNA, 19 nt, Homo sapiens
gagcaugccuccagaacca

SEQ ID NO: 1195451 - RNA, 19 nt, Homo sapiens
uaagaucagcuuuguugua

SEQ ID NO: 1195452 - RNA, 19 nt, Homo sapiens
cagcaagguucacggauau

SEQ ID NO: 1195453 - RNA, 19 nt, Homo sapiens
gcuaauggcacuuuacaga

SEQ ID NO: 1195454 - RNA, 19 nt, Homo sapiens
gcacgggcacucaucagua

SEQ ID NO: 1195455 - RNA, 19 nt, Homo sapiens
agaaagagauccuuaagcu

SEQ ID NO: 1195456 - RNA, 19 nt, Homo sapiens
ugccugaccuuuauuuauu

SEQ ID NO: 1195457 - RNA, 19 nt, Homo sapiens
ggacagaaggaauugagaa

SEQ ID NO: 1195458 - RNA, 19 nt, Homo sapiens
cgacagccauggagcucua

SEQ ID NO: 1195459 - RNA, 19 nt, Homo sapiens
ccaccuaugucccaaacuu

SEQ ID NO: 1195460 - RNA, 19 nt, Homo sapiens
gcaaguguguggcuaucga

SEQ ID NO: 1195461 - RNA, 19 nt, Homo sapiens
ugagcugacuggaauggua

SEQ ID NO: 1195462 - RNA, 19 nt, Homo sapiens
gguaagcuuuggacgagaa

SEQ ID NO: 1195463 - RNA, 19 nt, Homo sapiens
gcacucaucaguagaagau

SEQ ID NO: 1195464 - RNA, 19 nt, Homo sapiens
gaucagcuuuguuguaaaa

SEQ ID NO: 1195465 - RNA, 19 nt, Homo sapiens
gcaaaagucugagaaacaa

SEQ ID NO: 1195466 - RNA, 19 nt, Homo sapiens
uaaacaugcccugaaguua

SEQ ID NO: 1195467 - RNA, 19 nt, Homo sapiens
caauugagcaguagcuuug

SEQ ID NO: 1195468 - RNA, 19 nt, Homo sapiens
uguaacuucuucaggauaa

SEQ ID NO: 1195469 - RNA, 19 nt, Homo sapiens
ccaacagacugcccagguu

SEQ ID NO: 1195470 - RNA, 19 nt, Homo sapiens
ggaagaggcacaagagaag

SEQ ID NO: 1195471 - RNA, 19 nt, Homo sapiens
aauguucucuucuuuccua

SEQ ID NO: 1195472 - RNA, 19 nt, Homo sapiens
gacaaucacuguggcuguu

SEQ ID NO: 1195473 - RNA, 19 nt, Homo sapiens
caagacagugguuugaauu

SEQ ID NO: 1195474 - RNA, 19 nt, Homo sapiens
ccaccucccugaccuggaa

SEQ ID NO: 1195475 - RNA, 19 nt, Homo sapiens
ggguaaaguucucuuccuu

SEQ ID NO: 1195476 - RNA, 19 nt, Homo sapiens
gcuguuccauugugagcua

SEQ ID NO: 1195477 - RNA, 19 nt, Homo sapiens
cgagggacuucacucuuga

SEQ ID NO: 1195478 - RNA, 19 nt, Homo sapiens
ggcagggcauuggcaguua

SEQ ID NO: 1195479 - RNA, 19 nt, Homo sapiens
ccauggcgauguccucuau

SEQ ID NO: 1195480 - RNA, 19 nt, Homo sapiens
aacaugcccugaaguuaaa

SEQ ID NO: 1195481 - RNA, 19 nt, Homo sapiens
gaguuggggucaucuguua

SEQ ID NO: 1195482 - RNA, 19 nt, Homo sapiens
gcccauuguuuauucuuug

SEQ ID NO: 1195483 - RNA, 19 nt, Homo sapiens
acaagacagugguuugaau

SEQ ID NO: 1195484 - RNA, 19 nt, Homo sapiens
agacacugcugaaaucaca

SEQ ID NO: 1195485 - RNA, 19 nt, Homo sapiens
gccugaccuuuauuuauuu

SEQ ID NO: 1195486 - RNA, 19 nt, Homo sapiens
gaggagggaaggcagguaa

SEQ ID NO: 1195487 - RNA, 19 nt, Homo sapiens
ccagggcuguugguucuuu

SEQ ID NO: 1195488 - RNA, 19 nt, Homo sapiens
uuaagcccauuguuuauuc

SEQ ID NO: 1195489 - RNA, 19 nt, Homo sapiens
ggacgagaacuggcauauu

SEQ ID NO: 1195490 - RNA, 19 nt, Homo sapiens
gaaggcagguaagcuuugg

SEQ ID NO: 1195491 - RNA, 19 nt, Homo sapiens
uagcugaugucaaacucaa

SEQ ID NO: 1195492 - RNA, 19 nt, Homo sapiens
cacuguggcuguuggguuu

SEQ ID NO: 1195493 - RNA, 19 nt, Homo sapiens
uagggaaugugccaacaga

SEQ ID NO: 1195494 - RNA, 19 nt, Homo sapiens
gcccagaaagagauccuua

SEQ ID NO: 1195495 - RNA, 19 nt, Homo sapiens
ggaaggggcuaacugaauc

SEQ ID NO: 1195496 - RNA, 19 nt, Homo sapiens
gagcuaccauggcgauguc

SEQ ID NO: 1195497 - RNA, 19 nt, Homo sapiens
gagaacuggcauauuuauu

SEQ ID NO: 1195498 - RNA, 19 nt, Homo sapiens
ggaaggcagguaagcuuug

SEQ ID NO: 1195499 - RNA, 19 nt, Homo sapiens
gcuaggcuacaguggaaua

SEQ ID NO: 1195500 - RNA, 19 nt, Homo sapiens
uccaggcgcucaaguaugu

SEQ ID NO: 1195501 - RNA, 19 nt, Homo sapiens
gggcagcgacagcaacuga

SEQ ID NO: 1195502 - RNA, 19 nt, Homo sapiens
gacagugguuugaauucug

SEQ ID NO: 1195503 - RNA, 19 nt, Homo sapiens
uaacauuucuuggcaacag

SEQ ID NO: 1195504 - RNA, 19 nt, Homo sapiens
ggaagauggcgcuguuauc

SEQ ID NO: 1195505 - RNA, 19 nt, Homo sapiens
gcugaugucaaacucaauu

SEQ ID NO: 1195506 - RNA, 19 nt, Homo sapiens
ccacaaacuuggggucaua

SEQ ID NO: 1195507 - RNA, 19 nt, Homo sapiens
acugugaguuucuguuuau

SEQ ID NO: 1195508 - RNA, 19 nt, Homo sapiens
gggaaggcagguaagcuuu

SEQ ID NO: 1195509 - RNA, 19 nt, Homo sapiens
ccagaucuccugagucauc

SEQ ID NO: 1195510 - RNA, 19 nt, Homo sapiens
uuuaagaucagcuuuguug

SEQ ID NO: 1195511 - RNA, 19 nt, Homo sapiens
ggauauccgugugucuugu

SEQ ID NO: 1195512 - RNA, 19 nt, Homo sapiens
uacugugaguuucuguuua

SEQ ID NO: 1195513 - RNA, 19 nt, Homo sapiens
aaugagcacuaaaugugaa

SEQ ID NO: 1195514 - RNA, 19 nt, Homo sapiens
uaaugagcacuaaauguga

SEQ ID NO: 1195515 - RNA, 19 nt, Homo sapiens
cgagaacuggcauauuuau

SEQ ID NO: 1195516 - RNA, 19 nt, Homo sapiens
uaauggcacuuuacagacu

SEQ ID NO: 1195517 - RNA, 19 nt, Homo sapiens
gcuuagcuuugagauacua

SEQ ID NO: 1195518 - RNA, 19 nt, Homo sapiens
caagagcucaggucacaca

SEQ ID NO: 1195519 - RNA, 19 nt, Homo sapiens
ucucuucuuuccuaaguga

SEQ ID NO: 1195520 - RNA, 19 nt, Homo sapiens
ccucagcucuuugacaauc

SEQ ID NO: 1195521 - RNA, 19 nt, Homo sapiens
agaauaaacaugcccugaa

SEQ ID NO: 1195522 - RNA, 19 nt, Homo sapiens
ggggcuaacugaaucuuuu

SEQ ID NO: 1195523 - RNA, 19 nt, Homo sapiens
gggccuuuguguaggauug

SEQ ID NO: 1195524 - RNA, 19 nt, Homo sapiens
gagaaacaagacagugguu

SEQ ID NO: 1195525 - RNA, 19 nt, Homo sapiens
cugcuaggcuacaguggaa

SEQ ID NO: 1195526 - RNA, 19 nt, Homo sapiens
cagcagcacagacauggaa

SEQ ID NO: 1195527 - RNA, 19 nt, Homo sapiens
cuacugugaguuucuguuu

SEQ ID NO: 1195528 - RNA, 19 nt, Homo sapiens
ccacucauuuggguucaga

SEQ ID NO: 1195529 - RNA, 19 nt, Homo sapiens
ucagguggaccaucuucua

SEQ ID NO: 1195530 - RNA, 19 nt, Homo sapiens
cggaagaggcacaagagaa

SEQ ID NO: 1195531 - RNA, 19 nt, Homo sapiens
gaagaaagcuaaucuguuu

SEQ ID NO: 1195532 - RNA, 19 nt, Homo sapiens
gaagagaaguuguggcuua

SEQ ID NO: 1195533 - RNA, 19 nt, Homo sapiens
gaaaggcccucuccaauca

SEQ ID NO: 1195534 - RNA, 19 nt, Homo sapiens
ggacagaggugaucgagau

SEQ ID NO: 1195535 - RNA, 19 nt, Homo sapiens
gaagauagaagcuguguau

SEQ ID NO: 1195536 - RNA, 19 nt, Homo sapiens
ucacacagcuuaagaguag

SEQ ID NO: 1195537 - RNA, 19 nt, Homo sapiens
gaacagcggaugaagauau

SEQ ID NO: 1195538 - RNA, 19 nt, Homo sapiens
gauagaagcuguguaugug

SEQ ID NO: 1195539 - RNA, 19 nt, Homo sapiens
aaagagcgcucgccaguga

SEQ ID NO: 1195540 - RNA, 19 nt, Homo sapiens
ggacaccacccuuacuaua

SEQ ID NO: 1195541 - RNA, 19 nt, Homo sapiens
ggugauaguugggcauaua

SEQ ID NO: 1195542 - RNA, 19 nt, Homo sapiens
gagacuacccguucuauga

SEQ ID NO: 1195543 - RNA, 19 nt, Homo sapiens
caacuuuccuuccaacaug

SEQ ID NO: 1195544 - RNA, 19 nt, Homo sapiens
gagaaguuguggcuuaugu

SEQ ID NO: 1195545 - RNA, 19 nt, Homo sapiens
uagcagggcccaaugguua

SEQ ID NO: 1195546 - RNA, 19 nt, Homo sapiens
cuacuucugugccugcuua

SEQ ID NO: 1195547 - RNA, 19 nt, Homo sapiens
auacaagacucugaagaua

SEQ ID NO: 1195548 - RNA, 19 nt, Homo sapiens
ggacaacugcucccacuga

SEQ ID NO: 1195549 - RNA, 19 nt, Homo sapiens
ggaagaaagcuaaucuguu

SEQ ID NO: 1195550 - RNA, 19 nt, Homo sapiens
ggaaccuuguguccuauuu

SEQ ID NO: 1195551 - RNA, 19 nt, Homo sapiens
gaaagagacuacccguucu

SEQ ID NO: 1195552 - RNA, 19 nt, Homo sapiens
ccaaugagacuguagaaga

SEQ ID NO: 1195553 - RNA, 19 nt, Homo sapiens
ggaugaagauauggaauuc

SEQ ID NO: 1195554 - RNA, 19 nt, Homo sapiens
ccaaggcacuggccaaauc

SEQ ID NO: 1195555 - RNA, 19 nt, Homo sapiens
gaaccuuguguccuauuua

SEQ ID NO: 1195556 - RNA, 19 nt, Homo sapiens
gcaguagccgggaucguua

SEQ ID NO: 1195557 - RNA, 19 nt, Homo sapiens
gcagagaccagccuaggaa

SEQ ID NO: 1195558 - RNA, 19 nt, Homo sapiens
ggauaggacaccacccuua

SEQ ID NO: 1195559 - RNA, 19 nt, Homo sapiens
ucacagaaguagauaucaa

SEQ ID NO: 1195560 - RNA, 19 nt, Homo sapiens
ggaaaggcccucuccaauc

SEQ ID NO: 1195561 - RNA, 19 nt, Homo sapiens
uuacggcuuucucaaauuu

SEQ ID NO: 1195562 - RNA, 19 nt, Homo sapiens
gaagauuaccuggucauga

SEQ ID NO: 1195563 - RNA, 19 nt, Homo sapiens
gaucgacgccuuagaguag

SEQ ID NO: 1195564 - RNA, 19 nt, Homo sapiens
ggaauucaaagcucuaaug

SEQ ID NO: 1195565 - RNA, 19 nt, Homo sapiens
ggaguuagguaugagaaca

SEQ ID NO: 1195566 - RNA, 19 nt, Homo sapiens
gaaguaacucgacgcauca

SEQ ID NO: 1195567 - RNA, 19 nt, Homo sapiens
ccaaguggcuaguagucuu

SEQ ID NO: 1195568 - RNA, 19 nt, Homo sapiens
ccucugcccuugacucauu

SEQ ID NO: 1195569 - RNA, 19 nt, Homo sapiens
ucagagaaguggaugagau

SEQ ID NO: 1195570 - RNA, 19 nt, Homo sapiens
gcggggagauguaaagaua

SEQ ID NO: 1195571 - RNA, 19 nt, Homo sapiens
gaagauauggaauucaaag

SEQ ID NO: 1195572 - RNA, 19 nt, Homo sapiens
caaccuagacaucacugua

SEQ ID NO: 1195573 - RNA, 19 nt, Homo sapiens
caaugagacuguagaagag

SEQ ID NO: 1195574 - RNA, 19 nt, Homo sapiens
gcacgagaauuugaucgau

SEQ ID NO: 1195575 - RNA, 19 nt, Homo sapiens
gacuaguacuuacggcuuu

SEQ ID NO: 1195576 - RNA, 19 nt, Homo sapiens
ugaccggccucugaagaua

SEQ ID NO: 1195577 - RNA, 19 nt, Homo sapiens
aagauuaccuggucaugau

SEQ ID NO: 1195578 - RNA, 19 nt, Homo sapiens
ugaccgcaguccagaauug

SEQ ID NO: 1195579 - RNA, 19 nt, Homo sapiens
acaagacucugaagauaag

SEQ ID NO: 1195580 - RNA, 19 nt, Homo sapiens
auuaugagcuggugacaga

SEQ ID NO: 1195581 - RNA, 19 nt, Homo sapiens
acgagaauuugaucgauuu

SEQ ID NO: 1195582 - RNA, 19 nt, Homo sapiens
cgacgacccgcaacaauga

SEQ ID NO: 1195583 - RNA, 19 nt, Homo sapiens
gaauacaagacucugaaga

SEQ ID NO: 1195584 - RNA, 19 nt, Homo sapiens
guacacaagauuucuggaa

SEQ ID NO: 1195585 - RNA, 19 nt, Homo sapiens
cuaaagggaggaaaugauu

SEQ ID NO: 1195586 - RNA, 19 nt, Homo sapiens
ccgcaacaaugaagggaaa

SEQ ID NO: 1195587 - RNA, 19 nt, Homo sapiens
guagccgcuugcauaguua

SEQ ID NO: 1195588 - RNA, 19 nt, Homo sapiens
ucacucagcgucuccguuu

SEQ ID NO: 1195589 - RNA, 19 nt, Homo sapiens
ggacugcagcuacuucugu

SEQ ID NO: 1195590 - RNA, 19 nt, Homo sapiens
gaggacggccuguuucaug

SEQ ID NO: 1195591 - RNA, 19 nt, Homo sapiens
uuacuaaaauggcagcuua

SEQ ID NO: 1195592 - RNA, 19 nt, Homo sapiens
gaucauuguccguggguuu

SEQ ID NO: 1195593 - RNA, 19 nt, Homo sapiens
aaccuuguguccuauuuaa

SEQ ID NO: 1195594 - RNA, 19 nt, Homo sapiens
cgagguaguuuggagaaga

SEQ ID NO: 1195595 - RNA, 19 nt, Homo sapiens
gagagugaccgcccacgaa

SEQ ID NO: 1195596 - RNA, 19 nt, Homo sapiens
auacagagaucgugauagg

SEQ ID NO: 1195597 - RNA, 19 nt, Homo sapiens
gagaacaagaagagagaaa

SEQ ID NO: 1195598 - RNA, 19 nt, Homo sapiens
ggguucaacuggaggcaaa

SEQ ID NO: 1195599 - RNA, 19 nt, Homo sapiens
caugcugccuggacccaua

SEQ ID NO: 1195600 - RNA, 19 nt, Homo sapiens
uaacggagagugauuuaag

SEQ ID NO: 1195601 - RNA, 19 nt, Homo sapiens
ucagauaggaguuagguau

SEQ ID NO: 1195602 - RNA, 19 nt, Homo sapiens
aaagaagaccgcucugaug

SEQ ID NO: 1195603 - RNA, 19 nt, Homo sapiens
cacgagaauuugaucgauu

SEQ ID NO: 1195604 - RNA, 19 nt, Homo sapiens
caucagacacugccacuuc

SEQ ID NO: 1195605 - RNA, 19 nt, Homo sapiens
gagaagagccagggugaca

SEQ ID NO: 1195606 - RNA, 19 nt, Homo sapiens
ggaggacgucaucuggaua

SEQ ID NO: 1195607 - RNA, 19 nt, Homo sapiens
agaaguggaugagauuuca

SEQ ID NO: 1195608 - RNA, 19 nt, Homo sapiens
ggagagagaaagagacuac

SEQ ID NO: 1195609 - RNA, 19 nt, Homo sapiens
uacaagacucugaagauaa

SEQ ID NO: 1195610 - RNA, 19 nt, Homo sapiens
aauggcagcuuaaaguugu

SEQ ID NO: 1195611 - RNA, 19 nt, Homo sapiens
gcgcugacccuguuauagu

SEQ ID NO: 1195612 - RNA, 19 nt, Homo sapiens
aguagccgcuugcauaguu

SEQ ID NO: 1195613 - RNA, 19 nt, Homo sapiens
cagcaaaacugguugaaca

SEQ ID NO: 1195614 - RNA, 19 nt, Homo sapiens
uccaguagccgcuugcaua

SEQ ID NO: 1195615 - RNA, 19 nt, Homo sapiens
gagcggagcaagaaguuag

SEQ ID NO: 1195616 - RNA, 19 nt, Homo sapiens
gagaaguggaugagauuuc

SEQ ID NO: 1195617 - RNA, 19 nt, Homo sapiens
aaaguuguguaucugcuau

SEQ ID NO: 1195618 - RNA, 19 nt, Homo sapiens
agauaggaguuagguauga

SEQ ID NO: 1195619 - RNA, 19 nt, Homo sapiens
caaaguagcagggcccaau

SEQ ID NO: 1195620 - RNA, 19 nt, Homo sapiens
ggcaucagccucucccaaa

SEQ ID NO: 1195621 - RNA, 19 nt, Homo sapiens
caacagcgacaaugaucga

SEQ ID NO: 1195622 - RNA, 19 nt, Homo sapiens
gguggaggacggccuguuu

SEQ ID NO: 1195623 - RNA, 19 nt, Homo sapiens
gcaaaguggcccagcucaa

SEQ ID NO: 1195624 - RNA, 19 nt, Homo sapiens
aaacgucacugcgcuccuu

SEQ ID NO: 1195625 - RNA, 19 nt, Homo sapiens
acaccacccuuacuauaca

SEQ ID NO: 1195626 - RNA, 19 nt, Homo sapiens
cagagaaguggaugagauu

SEQ ID NO: 1195627 - RNA, 19 nt, Homo sapiens
gaauucaaagcucuaaugg

SEQ ID NO: 1195628 - RNA, 19 nt, Homo sapiens
gguaugagaacaagaagag

SEQ ID NO: 1195629 - RNA, 19 nt, Homo sapiens
gaucgaucuucccgucuuc

SEQ ID NO: 1195630 - RNA, 19 nt, Homo sapiens
ggaccuuuauccugacucu

SEQ ID NO: 1195631 - RNA, 19 nt, Homo sapiens
gagcaaggcuguacaauga

SEQ ID NO: 1195632 - RNA, 19 nt, Homo sapiens
aaacagaggucucagcaua

SEQ ID NO: 1195633 - RNA, 19 nt, Homo sapiens
uaaaguugcuuccaaguuu

SEQ ID NO: 1195634 - RNA, 19 nt, Homo sapiens
gaaaccagcuccuguguca

SEQ ID NO: 1195635 - RNA, 19 nt, Homo sapiens
cauagucacucuucacaua

SEQ ID NO: 1195636 - RNA, 19 nt, Homo sapiens
gcacagaccuccccacuaa

SEQ ID NO: 1195637 - RNA, 19 nt, Homo sapiens
gcaacaagguucccgagaa

SEQ ID NO: 1195638 - RNA, 19 nt, Homo sapiens
ggugggagcugucuucuga

SEQ ID NO: 1195639 - RNA, 19 nt, Homo sapiens
gcaccagccuguucaaaga

SEQ ID NO: 1195640 - RNA, 19 nt, Homo sapiens
gaccuugccucucaucuuu

SEQ ID NO: 1195641 - RNA, 19 nt, Homo sapiens
ggacagugccuuaucauug

SEQ ID NO: 1195642 - RNA, 19 nt, Homo sapiens
aagaggagcugcagauuga

SEQ ID NO: 1195643 - RNA, 19 nt, Homo sapiens
uaccugagcugguguugua

SEQ ID NO: 1195644 - RNA, 19 nt, Homo sapiens
gcacaccugucccuuaugu

SEQ ID NO: 1195645 - RNA, 19 nt, Homo sapiens
ggugaagcaugcacuuuaa

SEQ ID NO: 1195646 - RNA, 19 nt, Homo sapiens
gaaaucgaccauuguacua

SEQ ID NO: 1195647 - RNA, 19 nt, Homo sapiens
ggacggacucaacauguua

SEQ ID NO: 1195648 - RNA, 19 nt, Homo sapiens
ggaauagugugaacaacau

SEQ ID NO: 1195649 - RNA, 19 nt, Homo sapiens
caagaaaucgaccauugua

SEQ ID NO: 1195650 - RNA, 19 nt, Homo sapiens
cacaagaaaucgaccauug

SEQ ID NO: 1195651 - RNA, 19 nt, Homo sapiens
cuaaauugcuucaaguaga

SEQ ID NO: 1195652 - RNA, 19 nt, Homo sapiens
gaagaggagcugcagauug

SEQ ID NO: 1195653 - RNA, 19 nt, Homo sapiens
gcugauguuucaagaauug

SEQ ID NO: 1195654 - RNA, 19 nt, Homo sapiens
gcuuggagcuucccaugaa

SEQ ID NO: 1195655 - RNA, 19 nt, Homo sapiens
gaagccaacuuuccuuucu

SEQ ID NO: 1195656 - RNA, 19 nt, Homo sapiens
gagcugguguuguaucuuc

SEQ ID NO: 1195657 - RNA, 19 nt, Homo sapiens
gacagugccuuaucauugu

SEQ ID NO: 1195658 - RNA, 19 nt, Homo sapiens
ccagucagccgauguguaa

SEQ ID NO: 1195659 - RNA, 19 nt, Homo sapiens
gaagaugccaggaccuuug

SEQ ID NO: 1195660 - RNA, 19 nt, Homo sapiens
gaagcaugcacuuuaauau

SEQ ID NO: 1195661 - RNA, 19 nt, Homo sapiens
ggacugcaggugucucaua

SEQ ID NO: 1195662 - RNA, 19 nt, Homo sapiens
gcaguuaaacagcauagaa

SEQ ID NO: 1195663 - RNA, 19 nt, Homo sapiens
guacuacucucacuuacag

SEQ ID NO: 1195664 - RNA, 19 nt, Homo sapiens
caucaauaccuucucauaa

SEQ ID NO: 1195665 - RNA, 19 nt, Homo sapiens
cagccgauguguaagagua

SEQ ID NO: 1195666 - RNA, 19 nt, Homo sapiens
gcuccaggguuucagauga

SEQ ID NO: 1195667 - RNA, 19 nt, Homo sapiens
ggacucaacauguuaagug

SEQ ID NO: 1195668 - RNA, 19 nt, Homo sapiens
ucaguggccuccagacaaa

SEQ ID NO: 1195669 - RNA, 19 nt, Homo sapiens
gaggguugcuggacuguuc

SEQ ID NO: 1195670 - RNA, 19 nt, Homo sapiens
caauaugguuuagcacuga

SEQ ID NO: 1195671 - RNA, 19 nt, Homo sapiens
gugcugauguuucaagaau

SEQ ID NO: 1195672 - RNA, 19 nt, Homo sapiens
guauuccuguuucacauuu

SEQ ID NO: 1195673 - RNA, 19 nt, Homo sapiens
gcucaucuuugaccaacuu

SEQ ID NO: 1195674 - RNA, 19 nt, Homo sapiens
gaccaccacuuuggcagua

SEQ ID NO: 1195675 - RNA, 19 nt, Homo sapiens
uaaccaaccuccacuacuc

SEQ ID NO: 1195676 - RNA, 19 nt, Homo sapiens
uguuggcucuucugauuua

SEQ ID NO: 1195677 - RNA, 19 nt, Homo sapiens
gcaggacucuuuucauuug

SEQ ID NO: 1195678 - RNA, 19 nt, Homo sapiens
cccaagaccuacacaguga

SEQ ID NO: 1195679 - RNA, 19 nt, Homo sapiens
gcaaugcuuuuccacauaa

SEQ ID NO: 1195680 - RNA, 19 nt, Homo sapiens
ugaagcaugcacuuuaaua

SEQ ID NO: 1195681 - RNA, 19 nt, Homo sapiens
gcagacugaaggcuaauuu

SEQ ID NO: 1195682 - RNA, 19 nt, Homo sapiens
gaaugaagccagcugauac

SEQ ID NO: 1195683 - RNA, 19 nt, Homo sapiens
gagaacugcaggacucuuu

SEQ ID NO: 1195684 - RNA, 19 nt, Homo sapiens
ucaaagggcuuccaaaccu

SEQ ID NO: 1195685 - RNA, 19 nt, Homo sapiens
gauccacguuuggcucuaa

SEQ ID NO: 1195686 - RNA, 19 nt, Homo sapiens
ggagcugucuucugaguac

SEQ ID NO: 1195687 - RNA, 19 nt, Homo sapiens
gcacugaugagccugaaga

SEQ ID NO: 1195688 - RNA, 19 nt, Homo sapiens
gugcuuuccucuuccuuaa

SEQ ID NO: 1195689 - RNA, 19 nt, Homo sapiens
agacugugcuuuccucuuc

SEQ ID NO: 1195690 - RNA, 19 nt, Homo sapiens
ggagcaaggcuguacaaug

SEQ ID NO: 1195691 - RNA, 19 nt, Homo sapiens
ggaagcaucauuagucauc

SEQ ID NO: 1195692 - RNA, 19 nt, Homo sapiens
gcucuaaauugcuucaagu

SEQ ID NO: 1195693 - RNA, 19 nt, Homo sapiens
uugcagaccuuuccuguuc

SEQ ID NO: 1195694 - RNA, 19 nt, Homo sapiens
cuuguuggcucuucugauu

SEQ ID NO: 1195695 - RNA, 19 nt, Homo sapiens
guuuagcacugaauucaau

SEQ ID NO: 1195696 - RNA, 19 nt, Homo sapiens
guagagauucauucuuuga

SEQ ID NO: 1195697 - RNA, 19 nt, Homo sapiens
ucaauaagacugugcuuuc

SEQ ID NO: 1195698 - RNA, 19 nt, Homo sapiens
caucauuagucaucaauac

SEQ ID NO: 1195699 - RNA, 19 nt, Homo sapiens
uaaauugcuucaaguagag

SEQ ID NO: 1195700 - RNA, 19 nt, Homo sapiens
cagacaaacuccagacaag

SEQ ID NO: 1195701 - RNA, 19 nt, Homo sapiens
gacucaacauguuaaguga

SEQ ID NO: 1195702 - RNA, 19 nt, Homo sapiens
aaucuuugcuguggaauug

SEQ ID NO: 1195703 - RNA, 19 nt, Homo sapiens
ugucaugaauucuccuuug

SEQ ID NO: 1195704 - RNA, 19 nt, Homo sapiens
ugaagcacaucaagguuuc

SEQ ID NO: 1195705 - RNA, 19 nt, Homo sapiens
uuaaauaaccacccacaga

SEQ ID NO: 1195706 - RNA, 19 nt, Homo sapiens
caacaucccagcugcuaug

SEQ ID NO: 1195707 - RNA, 19 nt, Homo sapiens
uguauaaaguugcuuccaa

SEQ ID NO: 1195708 - RNA, 19 nt, Homo sapiens
cgauggugcugauguuuca

SEQ ID NO: 1195709 - RNA, 19 nt, Homo sapiens
cuucugaccuugccucuca

SEQ ID NO: 1195710 - RNA, 19 nt, Homo sapiens
ugacauagaaggaagcaau

SEQ ID NO: 1195711 - RNA, 19 nt, Homo sapiens
agaaggcaguggaacagaa

SEQ ID NO: 1195712 - RNA, 19 nt, Homo sapiens
gcuuuccucuuccuuaaau

SEQ ID NO: 1195713 - RNA, 19 nt, Homo sapiens
cgaccucauuccauuucua

SEQ ID NO: 1195714 - RNA, 19 nt, Homo sapiens
uggcacaccugucccuuau

SEQ ID NO: 1195715 - RNA, 19 nt, Homo sapiens
guucaaagaccucaacagu

SEQ ID NO: 1195716 - RNA, 19 nt, Homo sapiens
gcacccuguucaaccauau

SEQ ID NO: 1195717 - RNA, 19 nt, Homo sapiens
ggaccaucccagcaacuaa

SEQ ID NO: 1195718 - RNA, 19 nt, Homo sapiens
acaccugucccuuauguaa

SEQ ID NO: 1195719 - RNA, 19 nt, Homo sapiens
ggaagaggagcugcagauu

SEQ ID NO: 1195720 - RNA, 19 nt, Homo sapiens
gaccaagcccguauuccaa

SEQ ID NO: 1195721 - RNA, 19 nt, Homo sapiens
gguguuguaucuucaaguc

SEQ ID NO: 1195722 - RNA, 19 nt, Homo sapiens
caauuuguccuuaggucua

SEQ ID NO: 1195723 - RNA, 19 nt, Homo sapiens
gaagaggaagaccauuuua

SEQ ID NO: 1195724 - RNA, 19 nt, Homo sapiens
caacgcaucugcucuucac

SEQ ID NO: 1195725 - RNA, 19 nt, Homo sapiens
guuaaacagcauagaacua

SEQ ID NO: 1195726 - RNA, 19 nt, Homo sapiens
ggaagaugccaggaccuuu

SEQ ID NO: 1195727 - RNA, 19 nt, Homo sapiens
gaagcaucauuagucauca

SEQ ID NO: 1195728 - RNA, 19 nt, Homo sapiens
cagggacagugccuuauca

SEQ ID NO: 1195729 - RNA, 19 nt, Homo sapiens
uaggcagacugaaggcuaa

SEQ ID NO: 1195730 - RNA, 19 nt, Homo sapiens
agaaugaagccagcugaua

SEQ ID NO: 1195731 - RNA, 19 nt, Homo sapiens
gaagaucccugaccauuua

SEQ ID NO: 1195732 - RNA, 19 nt, Homo sapiens
ucaaaguccuuccuaaaua

SEQ ID NO: 1195733 - RNA, 19 nt, Homo sapiens
caaaguccuuccuaaauaa

SEQ ID NO: 1195734 - RNA, 19 nt, Homo sapiens
caacugagauuccuugugu

SEQ ID NO: 1195735 - RNA, 19 nt, Homo sapiens
aagaaucacugccauauaa

SEQ ID NO: 1195736 - RNA, 19 nt, Homo sapiens
ggacuugggugcugacuau

SEQ ID NO: 1195737 - RNA, 19 nt, Homo sapiens
gaagggaaaugguuaaacu

SEQ ID NO: 1195738 - RNA, 19 nt, Homo sapiens
cagaauggcuccucacaga

SEQ ID NO: 1195739 - RNA, 19 nt, Homo sapiens
aaacugagcuuguuauugc

SEQ ID NO: 1195740 - RNA, 19 nt, Homo sapiens
gcucccagcuccugcauuu

SEQ ID NO: 1195741 - RNA, 19 nt, Homo sapiens
gcaagaagccuccguugug

SEQ ID NO: 1195742 - RNA, 19 nt, Homo sapiens
gaucauauuugacgguaau

SEQ ID NO: 1195743 - RNA, 19 nt, Homo sapiens
ccagaauccugucccauuu

SEQ ID NO: 1195744 - RNA, 19 nt, Homo sapiens
gaaucacugccauauaaua

SEQ ID NO: 1195745 - RNA, 19 nt, Homo sapiens
gaaaucaaaguccuuccua

SEQ ID NO: 1195746 - RNA, 19 nt, Homo sapiens
agaaaggacugaaugacuu

SEQ ID NO: 1195747 - RNA, 19 nt, Homo sapiens
gagaggggcuuauuucaaa

SEQ ID NO: 1195748 - RNA, 19 nt, Homo sapiens
ggagcugguugaccuugua

SEQ ID NO: 1195749 - RNA, 19 nt, Homo sapiens
ugacgguaauacacaaaua

SEQ ID NO: 1195750 - RNA, 19 nt, Homo sapiens
ccacagaaaugcuuuuaaa

SEQ ID NO: 1195751 - RNA, 19 nt, Homo sapiens
gaagggcccuguuuucaaa

SEQ ID NO: 1195752 - RNA, 19 nt, Homo sapiens
aaacuuagaaccacagaaa

SEQ ID NO: 1195753 - RNA, 19 nt, Homo sapiens
acagaaugcuuacaacgaa

SEQ ID NO: 1195754 - RNA, 19 nt, Homo sapiens
ccaaccucguucagaauua

SEQ ID NO: 1195755 - RNA, 19 nt, Homo sapiens
gaucuuauuugccucaucu

SEQ ID NO: 1195756 - RNA, 19 nt, Homo sapiens
ccacagcccaggcccuuua

SEQ ID NO: 1195757 - RNA, 19 nt, Homo sapiens
ucacuaguacuacagauaa

SEQ ID NO: 1195758 - RNA, 19 nt, Homo sapiens
ggucaucgccuguucacaa

SEQ ID NO: 1195759 - RNA, 19 nt, Homo sapiens
uuggacagcuucagaugua

SEQ ID NO: 1195760 - RNA, 19 nt, Homo sapiens
ccacaaagcacagguacaa

SEQ ID NO: 1195761 - RNA, 19 nt, Homo sapiens
agaauugugucuuugauca

SEQ ID NO: 1195762 - RNA, 19 nt, Homo sapiens
uaagaaucacugccauaua

SEQ ID NO: 1195763 - RNA, 19 nt, Homo sapiens
guucagaauuacaagaaga

SEQ ID NO: 1195764 - RNA, 19 nt, Homo sapiens
caacauuauugcauagaag

SEQ ID NO: 1195765 - RNA, 19 nt, Homo sapiens
uaaccagccugcauuacau

SEQ ID NO: 1195766 - RNA, 19 nt, Homo sapiens
gaacuggaaucugcauaac

SEQ ID NO: 1195767 - RNA, 19 nt, Homo sapiens
aaaucaaaguccuuccuaa

SEQ ID NO: 1195768 - RNA, 19 nt, Homo sapiens
aaucuaacauugcaagugu

SEQ ID NO: 1195769 - RNA, 19 nt, Homo sapiens
ucaaagcuaucagaauugu

SEQ ID NO: 1195770 - RNA, 19 nt, Homo sapiens
cuacagauaaucaaagcua

SEQ ID NO: 1195771 - RNA, 19 nt, Homo sapiens
ggaauugcaauguaguuau

SEQ ID NO: 1195772 - RNA, 19 nt, Homo sapiens
aaacuuaggcugucuugau

SEQ ID NO: 1195773 - RNA, 19 nt, Homo sapiens
aagagcacccgcacacuua

SEQ ID NO: 1195774 - RNA, 19 nt, Homo sapiens
gacgguaauacacaaauaa

SEQ ID NO: 1195775 - RNA, 19 nt, Homo sapiens
gggcaggcuucucagauca

SEQ ID NO: 1195776 - RNA, 19 nt, Homo sapiens
gggaaaggcagacgaaugg

SEQ ID NO: 1195777 - RNA, 19 nt, Homo sapiens
uaucagaauugugucuuug

SEQ ID NO: 1195778 - RNA, 19 nt, Homo sapiens
ccugacaccucacaacuag

SEQ ID NO: 1195779 - RNA, 19 nt, Homo sapiens
agcaagcacuaaucucuuu

SEQ ID NO: 1195780 - RNA, 19 nt, Homo sapiens
gauguuggccucauacucu

SEQ ID NO: 1195781 - RNA, 19 nt, Homo sapiens
aauauguucuguacaagug

SEQ ID NO: 1195782 - RNA, 19 nt, Homo sapiens
aaucaaaguccuuccuaaa

SEQ ID NO: 1195783 - RNA, 19 nt, Homo sapiens
gggcagaaaggacugaaug

SEQ ID NO: 1195784 - RNA, 19 nt, Homo sapiens
gaauauguucuguacaagu

SEQ ID NO: 1195785 - RNA, 19 nt, Homo sapiens
gauuggcuuuguacaugaa

SEQ ID NO: 1195786 - RNA, 19 nt, Homo sapiens
ugaacuggaaucugcauaa

SEQ ID NO: 1195787 - RNA, 19 nt, Homo sapiens
gucaucgccuguucacaaa

SEQ ID NO: 1195788 - RNA, 19 nt, Homo sapiens
cuaucagaauugugucuuu

SEQ ID NO: 1195789 - RNA, 19 nt, Homo sapiens
agaagaucccugaccauuu

SEQ ID NO: 1195790 - RNA, 19 nt, Homo sapiens
uaagagcacccgcacacuu

SEQ ID NO: 1195791 - RNA, 19 nt, Homo sapiens
caguuucacuagccacaaa

SEQ ID NO: 1195792 - RNA, 19 nt, Homo sapiens
cuucagauguacaguuuca

SEQ ID NO: 1195793 - RNA, 19 nt, Homo sapiens
cuuccaaccucguucagaa

SEQ ID NO: 1195794 - RNA, 19 nt, Homo sapiens
uagaagaucccugaccauu

SEQ ID NO: 1195795 - RNA, 19 nt, Homo sapiens
ugguugaccuuguacagaa

SEQ ID NO: 1195796 - RNA, 19 nt, Homo sapiens
gcaaacuuaggcugucuug

SEQ ID NO: 1195797 - RNA, 19 nt, Homo sapiens
gguuaaacugagcuuguua

SEQ ID NO: 1195798 - RNA, 19 nt, Homo sapiens
ccagaagggaaaugguuaa

SEQ ID NO: 1195799 - RNA, 19 nt, Homo sapiens
acucagggcuuaaugaacu

SEQ ID NO: 1195800 - RNA, 19 nt, Homo sapiens
aaacagucgcccagauaaa

SEQ ID NO: 1195801 - RNA, 19 nt, Homo sapiens
ugauuggcuuuguacauga

SEQ ID NO: 1195802 - RNA, 19 nt, Homo sapiens
uaggcugucuugaugcaaa

SEQ ID NO: 1195803 - RNA, 19 nt, Homo sapiens
cguuuggaauugcaaugua

SEQ ID NO: 1195804 - RNA, 19 nt, Homo sapiens
uaaacugagcuuguuauug

SEQ ID NO: 1195805 - RNA, 19 nt, Homo sapiens
cagccugacuuggagauau

SEQ ID NO: 1195806 - RNA, 19 nt, Homo sapiens
ucagaauugugucuuugau

SEQ ID NO: 1195807 - RNA, 19 nt, Homo sapiens
uaagcaagcacuaaucucu

SEQ ID NO: 1195808 - RNA, 19 nt, Homo sapiens
guauccagauugugcagau

SEQ ID NO: 1195809 - RNA, 19 nt, Homo sapiens
agaauccugucccauuuca

SEQ ID NO: 1195810 - RNA, 19 nt, Homo sapiens
agacgaauggcauggcuuu

SEQ ID NO: 1195811 - RNA, 19 nt, Homo sapiens
aaaaugcucucuugaucuu

SEQ ID NO: 1195812 - RNA, 19 nt, Homo sapiens
aauaagaaucacugccaua

SEQ ID NO: 1195813 - RNA, 19 nt, Homo sapiens
ccaaggagaaaucaaaguc

SEQ ID NO: 1195814 - RNA, 19 nt, Homo sapiens
aaagcuaucagaauugugu

SEQ ID NO: 1195815 - RNA, 19 nt, Homo sapiens
gucuuugucuuuggaaauu

SEQ ID NO: 1195816 - RNA, 19 nt, Homo sapiens
gaucccugaccauuuacua

SEQ ID NO: 1195817 - RNA, 19 nt, Homo sapiens
aaaagauguuggccucaua

SEQ ID NO: 1195818 - RNA, 19 nt, Homo sapiens
gaaaagauguuggccucau

SEQ ID NO: 1195819 - RNA, 19 nt, Homo sapiens
cuguggccauagagaauua

SEQ ID NO: 1195820 - RNA, 19 nt, Homo sapiens
caaccucguucagaauuac

SEQ ID NO: 1195821 - RNA, 19 nt, Homo sapiens
ccaugucagaggcuuauuu

SEQ ID NO: 1195822 - RNA, 19 nt, Homo sapiens
guacuacagauaaucaaag

SEQ ID NO: 1195823 - RNA, 19 nt, Homo sapiens
uaauucuacucccugucua

SEQ ID NO: 1195824 - RNA, 19 nt, Homo sapiens
acucuauacucagggcuua

SEQ ID NO: 1195825 - RNA, 19 nt, Homo sapiens
aaugcucucuugaucuuau

SEQ ID NO: 1195826 - RNA, 19 nt, Homo sapiens
uaaaugauuggcuuuguac

SEQ ID NO: 1195827 - RNA, 19 nt, Homo sapiens
gucagggagucguuuggaa

SEQ ID NO: 1195828 - RNA, 19 nt, Homo sapiens
ggcagaaaggacugaauga

SEQ ID NO: 1195829 - RNA, 19 nt, Homo sapiens
ccucacagaaugcuuacaa

SEQ ID NO: 1195830 - RNA, 19 nt, Homo sapiens
ggagucguuuggaauugca

SEQ ID NO: 1195831 - RNA, 19 nt, Homo sapiens
uaacauggcuucaguauga

SEQ ID NO: 1195832 - RNA, 19 nt, Homo sapiens
ggaaauuucuucuggguua

SEQ ID NO: 1195833 - RNA, 19 nt, Homo sapiens
gaacuaccauguacaaauu

SEQ ID NO: 1195834 - RNA, 19 nt, Homo sapiens
gaacacuucuugugaauug

SEQ ID NO: 1195835 - RNA, 19 nt, Homo sapiens
gaacauugauucugaagga

SEQ ID NO: 1195836 - RNA, 19 nt, Homo sapiens
gaaagaacccaauuacaaa

SEQ ID NO: 1195837 - RNA, 19 nt, Homo sapiens
ggaaagaacccaauuacaa

SEQ ID NO: 1195838 - RNA, 19 nt, Homo sapiens
gaucaugcuuuaagguuua

SEQ ID NO: 1195839 - RNA, 19 nt, Homo sapiens
gaaugaaacugcaguggaa

SEQ ID NO: 1195840 - RNA, 19 nt, Homo sapiens
gcgggaagauuauauauga

SEQ ID NO: 1195841 - RNA, 19 nt, Homo sapiens
gcugagaaguagauuguua

SEQ ID NO: 1195842 - RNA, 19 nt, Homo sapiens
gaaaagaaauucgagguua

SEQ ID NO: 1195843 - RNA, 19 nt, Homo sapiens
ugacagaccugaaaucaau

SEQ ID NO: 1195844 - RNA, 19 nt, Homo sapiens
gaacagaucgaacaaacaa

SEQ ID NO: 1195845 - RNA, 19 nt, Homo sapiens
gaacuggaauuggauaaau

SEQ ID NO: 1195846 - RNA, 19 nt, Homo sapiens
uaaagaaaguguacugaug

SEQ ID NO: 1195847 - RNA, 19 nt, Homo sapiens
ggucauuccuguucaguuu

SEQ ID NO: 1195848 - RNA, 19 nt, Homo sapiens
ggacaugguuaauacaguu

SEQ ID NO: 1195849 - RNA, 19 nt, Homo sapiens
uaagaaagguuaggcauau

SEQ ID NO: 1195850 - RNA, 19 nt, Homo sapiens
ggagauagcaaacuacuga

SEQ ID NO: 1195851 - RNA, 19 nt, Homo sapiens
ucaaggagauagcaaacua

SEQ ID NO: 1195852 - RNA, 19 nt, Homo sapiens
guuguuaacuccuguauau

SEQ ID NO: 1195853 - RNA, 19 nt, Homo sapiens
gaagucaucacaagaauug

SEQ ID NO: 1195854 - RNA, 19 nt, Homo sapiens
ucaggaauauuacguguuu

SEQ ID NO: 1195855 - RNA, 19 nt, Homo sapiens
gccagcauaugguuuaaua

SEQ ID NO: 1195856 - RNA, 19 nt, Homo sapiens
gaacaagaaggaguauaua

SEQ ID NO: 1195857 - RNA, 19 nt, Homo sapiens
ggacuccaguucaguugua

SEQ ID NO: 1195858 - RNA, 19 nt, Homo sapiens
uagauggucucaugaguuu

SEQ ID NO: 1195859 - RNA, 19 nt, Homo sapiens
gaagcaauuucucuacaga

SEQ ID NO: 1195860 - RNA, 19 nt, Homo sapiens
gguaugggcugguccuauu

SEQ ID NO: 1195861 - RNA, 19 nt, Homo sapiens
gaaauucgagguuaagaga

SEQ ID NO: 1195862 - RNA, 19 nt, Homo sapiens
ggaggaaagaacccaauua

SEQ ID NO: 1195863 - RNA, 19 nt, Homo sapiens
ggacuaagaacauugauuc

SEQ ID NO: 1195864 - RNA, 19 nt, Homo sapiens
gaacuuuucuucacuugua

SEQ ID NO: 1195865 - RNA, 19 nt, Homo sapiens
gcaaguggaugaguuggaa

SEQ ID NO: 1195866 - RNA, 19 nt, Homo sapiens
ggaaugagugauuuacuuu

SEQ ID NO: 1195867 - RNA, 19 nt, Homo sapiens
gaaccaggauuugaaguca

SEQ ID NO: 1195868 - RNA, 19 nt, Homo sapiens
gaaguuacaacaccagauu

SEQ ID NO: 1195869 - RNA, 19 nt, Homo sapiens
guggaugaguuggaaauua

SEQ ID NO: 1195870 - RNA, 19 nt, Homo sapiens
uaccuuacuucgauuguua

SEQ ID NO: 1195871 - RNA, 19 nt, Homo sapiens
ugaagcagaugauauuuag

SEQ ID NO: 1195872 - RNA, 19 nt, Homo sapiens
ggaauuggauaaauauugc

SEQ ID NO: 1195873 - RNA, 19 nt, Homo sapiens
guugugagcgggaagauua

SEQ ID NO: 1195874 - RNA, 19 nt, Homo sapiens
aaaggaugccgaaguaaua

SEQ ID NO: 1195875 - RNA, 19 nt, Homo sapiens
caagaaggaguauauauuc

SEQ ID NO: 1195876 - RNA, 19 nt, Homo sapiens
caucugcauuucaaaguaa

SEQ ID NO: 1195877 - RNA, 19 nt, Homo sapiens
gcauaugguuuaauacaag

SEQ ID NO: 1195878 - RNA, 19 nt, Homo sapiens
gaacaguuacgaagcagaa

SEQ ID NO: 1195879 - RNA, 19 nt, Homo sapiens
guacaaauuuccaucuucu

SEQ ID NO: 1195880 - RNA, 19 nt, Homo sapiens
ggaccgaacuaccauguac

SEQ ID NO: 1195881 - RNA, 19 nt, Homo sapiens
gcaguuacuuagaaucuca

SEQ ID NO: 1195882 - RNA, 19 nt, Homo sapiens
gaaugggacaugguuaaua

SEQ ID NO: 1195883 - RNA, 19 nt, Homo sapiens
cgacaguacucagcuuaaa

SEQ ID NO: 1195884 - RNA, 19 nt, Homo sapiens
cuuauuggguuucagauuu

SEQ ID NO: 1195885 - RNA, 19 nt, Homo sapiens
ucgauaacauuccucagua

SEQ ID NO: 1195886 - RNA, 19 nt, Homo sapiens
gaagagacacuuuguugca

SEQ ID NO: 1195887 - RNA, 19 nt, Homo sapiens
gggaagagacacuuuguug

SEQ ID NO: 1195888 - RNA, 19 nt, Homo sapiens
gauaauaugaagcagauga

SEQ ID NO: 1195889 - RNA, 19 nt, Homo sapiens
ccaaauagccuuuccuuuu

SEQ ID NO: 1195890 - RNA, 19 nt, Homo sapiens
gcucuacacuuucaucaag

SEQ ID NO: 1195891 - RNA, 19 nt, Homo sapiens
uaaguggauuggcaguaua

SEQ ID NO: 1195892 - RNA, 19 nt, Homo sapiens
uaacagaacagaucgaaca

SEQ ID NO: 1195893 - RNA, 19 nt, Homo sapiens
gaaaccacauaccaaugga

SEQ ID NO: 1195894 - RNA, 19 nt, Homo sapiens
gaaagaccaaugaccaaga

SEQ ID NO: 1195895 - RNA, 19 nt, Homo sapiens
gauagcaaacuacugauug

SEQ ID NO: 1195896 - RNA, 19 nt, Homo sapiens
gaaaugacagcccaacaca

SEQ ID NO: 1195897 - RNA, 19 nt, Homo sapiens
gaaagcaagcauggaaauu

SEQ ID NO: 1195898 - RNA, 19 nt, Homo sapiens
accauuggaugaugcauua

SEQ ID NO: 1195899 - RNA, 19 nt, Homo sapiens
acaagaagaaccaggauuu

SEQ ID NO: 1195900 - RNA, 19 nt, Homo sapiens
gggcugguccuauuuggua

SEQ ID NO: 1195901 - RNA, 19 nt, Homo sapiens
ucacucaucuuguggaaag

SEQ ID NO: 1195902 - RNA, 19 nt, Homo sapiens
ucaaugcagucuaaugugu

SEQ ID NO: 1195903 - RNA, 19 nt, Homo sapiens
uggaugaguuggaaauuau

SEQ ID NO: 1195904 - RNA, 19 nt, Homo sapiens
gaccaaaugcaucagaauu

SEQ ID NO: 1195905 - RNA, 19 nt, Homo sapiens
caacgaccaccuucagaaa

SEQ ID NO: 1195906 - RNA, 19 nt, Homo sapiens
caaagucacaaacuacauu

SEQ ID NO: 1195907 - RNA, 19 nt, Homo sapiens
uauauucacucaucuugug

SEQ ID NO: 1195908 - RNA, 19 nt, Homo sapiens
uuucaucaaugcagucuaa

SEQ ID NO: 1195909 - RNA, 19 nt, Homo sapiens
ggagagaaccgguaucacu

SEQ ID NO: 1195910 - RNA, 19 nt, Homo sapiens
gaaggaguauauauucacu

SEQ ID NO: 1195911 - RNA, 19 nt, Homo sapiens
ucuaaaggaugacgucguu

SEQ ID NO: 1195912 - RNA, 19 nt, Homo sapiens
ccaguucaguuguagaaug

SEQ ID NO: 1195913 - RNA, 19 nt, Homo sapiens
acaguacucagcuuaaaua

SEQ ID NO: 1195914 - RNA, 19 nt, Homo sapiens
caaauagccuuuccuuuuc

SEQ ID NO: 1195915 - RNA, 19 nt, Homo sapiens
cagauuaacaccugcauga

SEQ ID NO: 1195916 - RNA, 19 nt, Homo sapiens
ccuacuguauguaugauuu

SEQ ID NO: 1195917 - RNA, 19 nt, Homo sapiens
agaaaaggaugccgaagua

SEQ ID NO: 1195918 - RNA, 19 nt, Homo sapiens
aauuaaauguggaggcuuu

SEQ ID NO: 1195919 - RNA, 19 nt, Homo sapiens
gauaacauuccucaguauu

SEQ ID NO: 1195920 - RNA, 19 nt, Homo sapiens
cggcuugauuucaggaaua

SEQ ID NO: 1195921 - RNA, 19 nt, Homo sapiens
cagaacagaucgaacaaac

SEQ ID NO: 1195922 - RNA, 19 nt, Homo sapiens
gaaauuucuucuggguuau

SEQ ID NO: 1195923 - RNA, 19 nt, Homo sapiens
aaagcaagcauggaaauuu

SEQ ID NO: 1195924 - RNA, 19 nt, Homo sapiens
gauuugaagucaucacaag

SEQ ID NO: 1195925 - RNA, 19 nt, Homo sapiens
gugaaucuccacaggauaa

SEQ ID NO: 1195926 - RNA, 19 nt, Homo sapiens
gguauucugucuaaaggau

SEQ ID NO: 1195927 - RNA, 19 nt, Homo sapiens
ggaaaccacauaccaaugg

SEQ ID NO: 1195928 - RNA, 19 nt, Homo sapiens
gcagaaugggacaugguua

SEQ ID NO: 1195929 - RNA, 19 nt, Homo sapiens
ugaacaagaaggaguauau

SEQ ID NO: 1195930 - RNA, 19 nt, Homo sapiens
uuacuucgauuguuagaca

SEQ ID NO: 1195931 - RNA, 19 nt, Homo sapiens
cacaaugcauggaguauua

SEQ ID NO: 1195932 - RNA, 19 nt, Homo sapiens
gaacaaagacgagcucaug

SEQ ID NO: 1195933 - RNA, 19 nt, Homo sapiens
caccagggcuaagcaauua

SEQ ID NO: 1195934 - RNA, 19 nt, Homo sapiens
uggaagaacucaugaacaa

SEQ ID NO: 1195935 - RNA, 19 nt, Homo sapiens
gcacaacgcccauccuuag

SEQ ID NO: 1195936 - RNA, 19 nt, Homo sapiens
gaagaacucaugaacaagu

SEQ ID NO: 1195937 - RNA, 19 nt, Homo sapiens
ggucggagcuggaagaacu

SEQ ID NO: 1195938 - RNA, 19 nt, Homo sapiens
uggcaaagcugcagaagca

SEQ ID NO: 1195939 - RNA, 19 nt, Homo sapiens
uaucggugcucaaggauga

SEQ ID NO: 1195940 - RNA, 19 nt, Homo sapiens
caccagccauggccaagua

SEQ ID NO: 1195941 - RNA, 19 nt, Homo sapiens
ggaagaagaagggcaagaa

SEQ ID NO: 1195942 - RNA, 19 nt, Homo sapiens
gcaccagggcuaagcaauu

SEQ ID NO: 1195943 - RNA, 19 nt, Homo sapiens
gcgaagccaucacgucugu

SEQ ID NO: 1195944 - RNA, 19 nt, Homo sapiens
gagcagaggaagaaguauu

SEQ ID NO: 1195945 - RNA, 19 nt, Homo sapiens
aggaggagcugaagaaagu

SEQ ID NO: 1195946 - RNA, 19 nt, Homo sapiens
ccagucagcuccccacaua

SEQ ID NO: 1195947 - RNA, 19 nt, Homo sapiens
ccacauucaucauggacaa

SEQ ID NO: 1195948 - RNA, 19 nt, Homo sapiens
ucaagauccuguaugacuu

SEQ ID NO: 1195949 - RNA, 19 nt, Homo sapiens
gauccuguaugacuucaca

SEQ ID NO: 1195950 - RNA, 19 nt, Homo sapiens
aggaggagcuggaagacuu

SEQ ID NO: 1195951 - RNA, 19 nt, Homo sapiens
gaagaagaagggcaagaag

SEQ ID NO: 1195952 - RNA, 19 nt, Homo sapiens
ccaaguuucaggccaauga

SEQ ID NO: 1195953 - RNA, 19 nt, Homo sapiens
acaaggaggagcugaagaa

SEQ ID NO: 1195954 - RNA, 19 nt, Homo sapiens
cgugcuggcucagaagaua

SEQ ID NO: 1195955 - RNA, 19 nt, Homo sapiens
guacgugcccugcaacauc

SEQ ID NO: 1195956 - RNA, 19 nt, Homo sapiens
caagccggauguccacuuc

SEQ ID NO: 1195957 - RNA, 19 nt, Homo sapiens
gcaccuggccacauucauc

SEQ ID NO: 1195958 - RNA, 19 nt, Homo sapiens
cgacggccauuaccaaucg

SEQ ID NO: 1195959 - RNA, 19 nt, Homo sapiens
cauaagaaacucccagaag

SEQ ID NO: 1195960 - RNA, 19 nt, Homo sapiens
gagccgacaguccauaaga

SEQ ID NO: 1195961 - RNA, 19 nt, Homo sapiens
gaaaugccaacgagcuauc

SEQ ID NO: 1195962 - RNA, 19 nt, Homo sapiens
acacacacuucaccugcaa

SEQ ID NO: 1195963 - RNA, 19 nt, Homo sapiens
agacuaaucucagccaaac

SEQ ID NO: 1195964 - RNA, 19 nt, Homo sapiens
ggcacaacgcccauccuua

SEQ ID NO: 1195965 - RNA, 19 nt, Homo sapiens
agacgcaaauccucaacug

SEQ ID NO: 1195966 - RNA, 19 nt, Homo sapiens
cuaagcaauuaaaccaguu

SEQ ID NO: 1195967 - RNA, 19 nt, Homo sapiens
gggaagcccacccacaaug

SEQ ID NO: 1195968 - RNA, 19 nt, Homo sapiens
caacuccaacgucaucaug

SEQ ID NO: 1195969 - RNA, 19 nt, Homo sapiens
gaggaggugaguccaguga

SEQ ID NO: 1195970 - RNA, 19 nt, Homo sapiens
gagcaggccggucagaagu

SEQ ID NO: 1195971 - RNA, 19 nt, Homo sapiens
uaagaaacucccagaagca

SEQ ID NO: 1195972 - RNA, 19 nt, Homo sapiens
caucgacugcuuccagaaa

SEQ ID NO: 1195973 - RNA, 19 nt, Homo sapiens
gacaagagcgaagccauca

SEQ ID NO: 1195974 - RNA, 19 nt, Homo sapiens
gggcuaagcaauuaaacca

SEQ ID NO: 1195975 - RNA, 19 nt, Homo sapiens
acgucaagauccuguauga

SEQ ID NO: 1195976 - RNA, 19 nt, Homo sapiens
ccaaguacgucaagauccu

SEQ ID NO: 1195977 - RNA, 19 nt, Homo sapiens
ggacgacaucgagugguuu

SEQ ID NO: 1195978 - RNA, 19 nt, Homo sapiens
ccacaaugcauggaguauu

SEQ ID NO: 1195979 - RNA, 19 nt, Homo sapiens
gagcuggaagaacucauga

SEQ ID NO: 1195980 - RNA, 19 nt, Homo sapiens
gcucuucucccucaacaag

SEQ ID NO: 1195981 - RNA, 19 nt, Homo sapiens
gcacauggacgaggucaac

SEQ ID NO: 1195982 - RNA, 19 nt, Homo sapiens
gaagggacaccaggagaag

SEQ ID NO: 1195983 - RNA, 19 nt, Homo sapiens
ggagcuggaagaacucaug

SEQ ID NO: 1195984 - RNA, 19 nt, Homo sapiens
caaggaggagcugaagaaa

SEQ ID NO: 1195985 - RNA, 19 nt, Homo sapiens
caagauccuguaugacuuc

SEQ ID NO: 1195986 - RNA, 19 nt, Homo sapiens
gccgacaguccauaagaaa

SEQ ID NO: 1195987 - RNA, 19 nt, Homo sapiens
gcgaguucaucgacugcuu

SEQ ID NO: 1195988 - RNA, 19 nt, Homo sapiens
aguuaagucucccaggaaa

SEQ ID NO: 1195989 - RNA, 19 nt, Homo sapiens
cucagaagauagagaagga

SEQ ID NO: 1195990 - RNA, 19 nt, Homo sapiens
ccacucagcgagccagguu

SEQ ID NO: 1195991 - RNA, 19 nt, Homo sapiens
ugaagggacaccaggagaa

SEQ ID NO: 1195992 - RNA, 19 nt, Homo sapiens
ccagggcuaagcaauuaaa

SEQ ID NO: 1195993 - RNA, 19 nt, Homo sapiens
gcaggccggucagaaguac

SEQ ID NO: 1195994 - RNA, 19 nt, Homo sapiens
guacgucaagauccuguau

SEQ ID NO: 1195995 - RNA, 19 nt, Homo sapiens
uagagaaggagacgcaaau

SEQ ID NO: 1195996 - RNA, 19 nt, Homo sapiens
ggacaccaggagaagauuc

SEQ ID NO: 1195997 - RNA, 19 nt, Homo sapiens
gcaagccggauguccacuu

SEQ ID NO: 1195998 - RNA, 19 nt, Homo sapiens
cagcccacaccaagacuaa

SEQ ID NO: 1195999 - RNA, 19 nt, Homo sapiens
gagcucauccggaaaauca

SEQ ID NO: 1196000 - RNA, 19 nt, Homo sapiens
ugacuucacagcccgaaau

SEQ ID NO: 1196001 - RNA, 19 nt, Homo sapiens
gcucgugcacuuccucuuc

SEQ ID NO: 1196002 - RNA, 19 nt, Homo sapiens
uggacgacaucgagugguu

SEQ ID NO: 1196003 - RNA, 19 nt, Homo sapiens
gccagacgguccucaacca

SEQ ID NO: 1196004 - RNA, 19 nt, Homo sapiens
caacaaggaggagcugaag

SEQ ID NO: 1196005 - RNA, 19 nt, Homo sapiens
gccauuaccaaucgcgaaa

SEQ ID NO: 1196006 - RNA, 19 nt, Homo sapiens
ccgaaaugccaacgagcua

SEQ ID NO: 1196007 - RNA, 19 nt, Homo sapiens
agucucacccuacagauga

SEQ ID NO: 1196008 - RNA, 19 nt, Homo sapiens
agaaguauuccaacuccaa

SEQ ID NO: 1196009 - RNA, 19 nt, Homo sapiens
cgacaguccauaagaaacu

SEQ ID NO: 1196010 - RNA, 19 nt, Homo sapiens
acagccagcucaccaugca

SEQ ID NO: 1196011 - RNA, 19 nt, Homo sapiens
ucaacaaggaggagcugaa

SEQ ID NO: 1196012 - RNA, 19 nt, Homo sapiens
cagcucuucucccucaaca

SEQ ID NO: 1196013 - RNA, 19 nt, Homo sapiens
ggucaacgacgagcucauc

SEQ ID NO: 1196014 - RNA, 19 nt, Homo sapiens
ugcagaagcacauccagaa

SEQ ID NO: 1196015 - RNA, 19 nt, Homo sapiens
gggaacgacacacacuuca

SEQ ID NO: 1196016 - RNA, 19 nt, Homo sapiens
caaugcauggaguauuauu

SEQ ID NO: 1196017 - RNA, 19 nt, Homo sapiens
ggaagcccacccacaaugc

SEQ ID NO: 1196018 - RNA, 19 nt, Homo sapiens
gugagccgacaguccauaa

SEQ ID NO: 1196019 - RNA, 19 nt, Homo sapiens
gagucucacccuacagaug

SEQ ID NO: 1196020 - RNA, 19 nt, Homo sapiens
gaagcccacccacaaugca

SEQ ID NO: 1196021 - RNA, 19 nt, Homo sapiens
ggaagaacucaugaacaag

SEQ ID NO: 1196022 - RNA, 19 nt, Homo sapiens
ggccaaguacgucaagauc

SEQ ID NO: 1196023 - RNA, 19 nt, Homo sapiens
uugagcagaggaagaagua

SEQ ID NO: 1196024 - RNA, 19 nt, Homo sapiens
ccauaagaaacucccagaa

SEQ ID NO: 1196025 - RNA, 19 nt, Homo sapiens
agccgacaguccauaagaa

SEQ ID NO: 1196026 - RNA, 19 nt, Homo sapiens
gagaugccguggacuuccu

SEQ ID NO: 1196027 - RNA, 19 nt, Homo sapiens
cacaggaggagcuggaaga

SEQ ID NO: 1196028 - RNA, 19 nt, Homo sapiens
gcagaagcacauccagaac

SEQ ID NO: 1196029 - RNA, 19 nt, Homo sapiens
cgacaucgagugguuugug

SEQ ID NO: 1196030 - RNA, 19 nt, Homo sapiens
gacgacaucgagugguuug

SEQ ID NO: 1196031 - RNA, 19 nt, Homo sapiens
gagcaggccugaucaagau

SEQ ID NO: 1196032 - RNA, 19 nt, Homo sapiens
gaggagagcacuacaggua

SEQ ID NO: 1196033 - RNA, 19 nt, Homo sapiens
ggucagacaugaacuccaa

SEQ ID NO: 1196034 - RNA, 19 nt, Homo sapiens
cuacagcccugaccauaga

SEQ ID NO: 1196035 - RNA, 19 nt, Homo sapiens
ccacaggaguugagacaau

SEQ ID NO: 1196036 - RNA, 19 nt, Homo sapiens
ccaauccuguggcauacua

SEQ ID NO: 1196037 - RNA, 19 nt, Homo sapiens
gcauauucuucuacuauuc

SEQ ID NO: 1196038 - RNA, 19 nt, Homo sapiens
gcucugaucucccauccau

SEQ ID NO: 1196039 - RNA, 19 nt, Homo sapiens
ggagagcacuacagguaca

SEQ ID NO: 1196040 - RNA, 19 nt, Homo sapiens
gggcaucucgucuuucgua

SEQ ID NO: 1196041 - RNA, 19 nt, Homo sapiens
ggacaaacagcgucuacug

SEQ ID NO: 1196042 - RNA, 19 nt, Homo sapiens
ggaccgaguucugcagaug

SEQ ID NO: 1196043 - RNA, 19 nt, Homo sapiens
ggcauauucuucuacuauu

SEQ ID NO: 1196044 - RNA, 19 nt, Homo sapiens
ggagcaggccugaucaaga

SEQ ID NO: 1196045 - RNA, 19 nt, Homo sapiens
gagcugaggcccuacuuca

SEQ ID NO: 1196046 - RNA, 19 nt, Homo sapiens
gaacacccacuucaacucu

SEQ ID NO: 1196047 - RNA, 19 nt, Homo sapiens
gcacaacgacuggaucauc

SEQ ID NO: 1196048 - RNA, 19 nt, Homo sapiens
ggccaugucugguacucuu

SEQ ID NO: 1196049 - RNA, 19 nt, Homo sapiens
gcacuacagguacaaguuc

SEQ ID NO: 1196050 - RNA, 19 nt, Homo sapiens
ccauagacccagccaggua

SEQ ID NO: 1196051 - RNA, 19 nt, Homo sapiens
gacugggcaucucgucuuu

SEQ ID NO: 1196052 - RNA, 19 nt, Homo sapiens
ggacugggcaucucgucuu

SEQ ID NO: 1196053 - RNA, 19 nt, Homo sapiens
cuucaacucucuucacauc

SEQ ID NO: 1196054 - RNA, 19 nt, Homo sapiens
ugaacuggcugacuauggu

SEQ ID NO: 1196055 - RNA, 19 nt, Homo sapiens
uggcauuccugguggcuuu

SEQ ID NO: 1196056 - RNA, 19 nt, Homo sapiens
cagcgucuacugcacauuu

SEQ ID NO: 1196057 - RNA, 19 nt, Homo sapiens
caucucgucuuucguacug

SEQ ID NO: 1196058 - RNA, 19 nt, Homo sapiens
gagcacaacgacuggauca

SEQ ID NO: 1196059 - RNA, 19 nt, Homo sapiens
ccucuucaaugguguguuc

SEQ ID NO: 1196060 - RNA, 19 nt, Homo sapiens
uggacuggcugaugugguu

SEQ ID NO: 1196061 - RNA, 19 nt, Homo sapiens
ggcgagaccucaccugcau

SEQ ID NO: 1196062 - RNA, 19 nt, Homo sapiens
gaggaucggagccuacuuc

SEQ ID NO: 1196063 - RNA, 19 nt, Homo sapiens
uagacgugcaccagaaaua

SEQ ID NO: 1196064 - RNA, 19 nt, Homo sapiens
uuccugaacuggcugacua

SEQ ID NO: 1196065 - RNA, 19 nt, Homo sapiens
uauaccacuuaccagcuua

SEQ ID NO: 1196066 - RNA, 19 nt, Homo sapiens
ggucuguugucacauacug

SEQ ID NO: 1196067 - RNA, 19 nt, Homo sapiens
gacgugcaccagaaauaaa

SEQ ID NO: 1196068 - RNA, 19 nt, Homo sapiens
ggacuggucagacaugaac

SEQ ID NO: 1196069 - RNA, 19 nt, Homo sapiens
uggcauauucuucuacuau

SEQ ID NO: 1196070 - RNA, 19 nt, Homo sapiens
caucaucgucggacaaaca

SEQ ID NO: 1196071 - RNA, 19 nt, Homo sapiens
gacaauggcaauccugaca

SEQ ID NO: 1196072 - RNA, 19 nt, Homo sapiens
agacgugcaccagaaauaa

SEQ ID NO: 1196073 - RNA, 19 nt, Homo sapiens
agacggcccugccucaucu

SEQ ID NO: 1196074 - RNA, 19 nt, Homo sapiens
cacaggaguugagacaaug

SEQ ID NO: 1196075 - RNA, 19 nt, Homo sapiens
gcucagcaaccacuucauc

SEQ ID NO: 1196076 - RNA, 19 nt, Homo sapiens
ucuguucccucuucaaugg

SEQ ID NO: 1196077 - RNA, 19 nt, Homo sapiens
ccugacagcccaacaaugg

SEQ ID NO: 1196078 - RNA, 19 nt, Homo sapiens
ucggaagcaucaccaagga

SEQ ID NO: 1196079 - RNA, 19 nt, Homo sapiens
ucaacucucuucacaucgu

SEQ ID NO: 1196080 - RNA, 19 nt, Homo sapiens
ggucaugaacacccacuuc

SEQ ID NO: 1196081 - RNA, 19 nt, Homo sapiens
gcuccaggcaggucaugaa

SEQ ID NO: 1196082 - RNA, 19 nt, Homo sapiens
cuacaugucccugguuaau

SEQ ID NO: 1196083 - RNA, 19 nt, Homo sapiens
uuauaccacuuaccagcuu

SEQ ID NO: 1196084 - RNA, 19 nt, Homo sapiens
cgccuggacuggcugaugu

SEQ ID NO: 1196085 - RNA, 19 nt, Homo sapiens
ggacuuccagcaguacuuc

SEQ ID NO: 1196086 - RNA, 19 nt, Homo sapiens
ccaggcaggucaugaacac

SEQ ID NO: 1196087 - RNA, 19 nt, Homo sapiens
uuccuauucuugagccaua

SEQ ID NO: 1196088 - RNA, 19 nt, Homo sapiens
gaguugagacaauggcaau

SEQ ID NO: 1196089 - RNA, 19 nt, Homo sapiens
gcgccaacaugcuucucau

SEQ ID NO: 1196090 - RNA, 19 nt, Homo sapiens
ggcccuagccuucguguac

SEQ ID NO: 1196091 - RNA, 19 nt, Homo sapiens
cucuacaugucccugguua

SEQ ID NO: 1196092 - RNA, 19 nt, Homo sapiens
cgugcacacuuucaucauc

SEQ ID NO: 1196093 - RNA, 19 nt, Homo sapiens
cacuucaacucucuucaca

SEQ ID NO: 1196094 - RNA, 19 nt, Homo sapiens
cuacacgcaucccacacau

SEQ ID NO: 1196095 - RNA, 19 nt, Homo sapiens
gauggacuggucagacaug

SEQ ID NO: 1196096 - RNA, 19 nt, Homo sapiens
acuacgaguucaagugcaa

SEQ ID NO: 1196097 - RNA, 19 nt, Homo sapiens
gcccgugguccucaacuug

SEQ ID NO: 1196098 - RNA, 19 nt, Homo sapiens
cacuacagcccugaccaua

SEQ ID NO: 1196099 - RNA, 19 nt, Homo sapiens
ucagcuacaugcccaccau

SEQ ID NO: 1196100 - RNA, 19 nt, Homo sapiens
gcuuggagcaggccugauc

SEQ ID NO: 1196101 - RNA, 19 nt, Homo sapiens
ccuauuauaccacuuacca

SEQ ID NO: 1196102 - RNA, 19 nt, Homo sapiens
cacuacagguacaaguuca

SEQ ID NO: 1196103 - RNA, 19 nt, Homo sapiens
gagcacuacagguacaagu

SEQ ID NO: 1196104 - RNA, 19 nt, Homo sapiens
agccuggccugcuuugaug

SEQ ID NO: 1196105 - RNA, 19 nt, Homo sapiens
cagccuggccugcuuugau

SEQ ID NO: 1196106 - RNA, 19 nt, Homo sapiens
gcccaauccuguggcauac

SEQ ID NO: 1196107 - RNA, 19 nt, Homo sapiens
ccugguggcuuuccaucag

SEQ ID NO: 1196108 - RNA, 19 nt, Homo sapiens
gugaagaacucgaguauuu

SEQ ID NO: 1196109 - RNA, 19 nt, Homo sapiens
gaaagaagcccaagauguc

SEQ ID NO: 1196110 - RNA, 19 nt, Homo sapiens
gaacuagcuuucugggauu

SEQ ID NO: 1196111 - RNA, 19 nt, Homo sapiens
ggagcuagaugaagaagga

SEQ ID NO: 1196112 - RNA, 19 nt, Homo sapiens
aaagcaaacuguccagaaa

SEQ ID NO: 1196113 - RNA, 19 nt, Homo sapiens
ugacacgucuaucaaguuu

SEQ ID NO: 1196114 - RNA, 19 nt, Homo sapiens
gcaauucaaucgggaaaug

SEQ ID NO: 1196115 - RNA, 19 nt, Homo sapiens
gaagaggccuugaauuucc

SEQ ID NO: 1196116 - RNA, 19 nt, Homo sapiens
ggacagccauggccacaca

SEQ ID NO: 1196117 - RNA, 19 nt, Homo sapiens
gaagagaagcccaaagaca

SEQ ID NO: 1196118 - RNA, 19 nt, Homo sapiens
ggaggagacucgaaagaag

SEQ ID NO: 1196119 - RNA, 19 nt, Homo sapiens
gcaguuagccucacagaag

SEQ ID NO: 1196120 - RNA, 19 nt, Homo sapiens
gaaagcaguuagccucaca

SEQ ID NO: 1196121 - RNA, 19 nt, Homo sapiens
ccagagcuguugccuguga

SEQ ID NO: 1196122 - RNA, 19 nt, Homo sapiens
gguagaagagaaaggaaua

SEQ ID NO: 1196123 - RNA, 19 nt, Homo sapiens
gcagcaagauggccaagca

SEQ ID NO: 1196124 - RNA, 19 nt, Homo sapiens
ucccuugucugcauuauaa

SEQ ID NO: 1196125 - RNA, 19 nt, Homo sapiens
uugauugucugaacacaua

SEQ ID NO: 1196126 - RNA, 19 nt, Homo sapiens
ggagaagcguuuugacuuu

SEQ ID NO: 1196127 - RNA, 19 nt, Homo sapiens
ccucaucccugacuuuguu

SEQ ID NO: 1196128 - RNA, 19 nt, Homo sapiens
gaagcucauuacuuuauca

SEQ ID NO: 1196129 - RNA, 19 nt, Homo sapiens
aucagaagcucauuacuuu

SEQ ID NO: 1196130 - RNA, 19 nt, Homo sapiens
gaagaacucgaguauuuua

SEQ ID NO: 1196131 - RNA, 19 nt, Homo sapiens
gcaaagaugaauccguuga

SEQ ID NO: 1196132 - RNA, 19 nt, Homo sapiens
ggaugagccugacucuaug

SEQ ID NO: 1196133 - RNA, 19 nt, Homo sapiens
caaagacagugaagaacuc

SEQ ID NO: 1196134 - RNA, 19 nt, Homo sapiens
gaguuacccuggccuccua

SEQ ID NO: 1196135 - RNA, 19 nt, Homo sapiens
cgaaagaagcccaagaugu

SEQ ID NO: 1196136 - RNA, 19 nt, Homo sapiens
gaacaagagaguuggaaag

SEQ ID NO: 1196137 - RNA, 19 nt, Homo sapiens
caagaugcacccacaaaga

SEQ ID NO: 1196138 - RNA, 19 nt, Homo sapiens
gagacagaguggaugaaga

SEQ ID NO: 1196139 - RNA, 19 nt, Homo sapiens
gaagagugaauacgucaug

SEQ ID NO: 1196140 - RNA, 19 nt, Homo sapiens
gaaacccucaacucaaauu

SEQ ID NO: 1196141 - RNA, 19 nt, Homo sapiens
guccauauguccacccauu

SEQ ID NO: 1196142 - RNA, 19 nt, Homo sapiens
gcacugacgacacaugaug

SEQ ID NO: 1196143 - RNA, 19 nt, Homo sapiens
gcacauguguuccccuaaa

SEQ ID NO: 1196144 - RNA, 19 nt, Homo sapiens
cagcggcucucccuggaaa

SEQ ID NO: 1196145 - RNA, 19 nt, Homo sapiens
gaacacauaaagcaaacug

SEQ ID NO: 1196146 - RNA, 19 nt, Homo sapiens
gaggagaccagcagucaug

SEQ ID NO: 1196147 - RNA, 19 nt, Homo sapiens
ggacaagagugugauugag

SEQ ID NO: 1196148 - RNA, 19 nt, Homo sapiens
ggucuuuacugcgcaugua

SEQ ID NO: 1196149 - RNA, 19 nt, Homo sapiens
gcccaaagacagugaagaa

SEQ ID NO: 1196150 - RNA, 19 nt, Homo sapiens
cagaagcucauuacuuuau

SEQ ID NO: 1196151 - RNA, 19 nt, Homo sapiens
ccguugaucucgaggaauu

SEQ ID NO: 1196152 - RNA, 19 nt, Homo sapiens
augaagaggccuugaauuu

SEQ ID NO: 1196153 - RNA, 19 nt, Homo sapiens
ccgaugaugaccaagauua

SEQ ID NO: 1196154 - RNA, 19 nt, Homo sapiens
gcacacagccaugcuucaa

SEQ ID NO: 1196155 - RNA, 19 nt, Homo sapiens
gguggagacuuuaguguac

SEQ ID NO: 1196156 - RNA, 19 nt, Homo sapiens
gguccgcccugucuauaau

SEQ ID NO: 1196157 - RNA, 19 nt, Homo sapiens
uaaagcaaacuguccagaa

SEQ ID NO: 1196158 - RNA, 19 nt, Homo sapiens
uggaugagccugacucuau

SEQ ID NO: 1196159 - RNA, 19 nt, Homo sapiens
ggugugcgauggaaaugug

SEQ ID NO: 1196160 - RNA, 19 nt, Homo sapiens
gccuuaggguggagacuuu

SEQ ID NO: 1196161 - RNA, 19 nt, Homo sapiens
ugagcaaguuacugugaaa

SEQ ID NO: 1196162 - RNA, 19 nt, Homo sapiens
ggacgagaaagacccacua

SEQ ID NO: 1196163 - RNA, 19 nt, Homo sapiens
gaugaugaccaagauuaaa

SEQ ID NO: 1196164 - RNA, 19 nt, Homo sapiens
gggaggagacucgaaagaa

SEQ ID NO: 1196165 - RNA, 19 nt, Homo sapiens
gaggcuagcugaggaaagg

SEQ ID NO: 1196166 - RNA, 19 nt, Homo sapiens
ggugacacgucuaucaagu

SEQ ID NO: 1196167 - RNA, 19 nt, Homo sapiens
gaugaagaggccuugaauu

SEQ ID NO: 1196168 - RNA, 19 nt, Homo sapiens
guucacggcuaaagcaauc

SEQ ID NO: 1196169 - RNA, 19 nt, Homo sapiens
ggagacaucggacaagagu

SEQ ID NO: 1196170 - RNA, 19 nt, Homo sapiens
gugccucggugaccauuga

SEQ ID NO: 1196171 - RNA, 19 nt, Homo sapiens
ucacccacccucuguguuu

SEQ ID NO: 1196172 - RNA, 19 nt, Homo sapiens
gcacccacaugucaagaac

SEQ ID NO: 1196173 - RNA, 19 nt, Homo sapiens
ggaugaagaggccuugaau

SEQ ID NO: 1196174 - RNA, 19 nt, Homo sapiens
uagcaucccuugucugcau

SEQ ID NO: 1196175 - RNA, 19 nt, Homo sapiens
caguguagcccauucuuga

SEQ ID NO: 1196176 - RNA, 19 nt, Homo sapiens
gaaagggaggagacucgaa

SEQ ID NO: 1196177 - RNA, 19 nt, Homo sapiens
gaagaggcuagcugaggaa

SEQ ID NO: 1196178 - RNA, 19 nt, Homo sapiens
gcagcaguaugccaagaag

SEQ ID NO: 1196179 - RNA, 19 nt, Homo sapiens
caggagacaucggacaaga

SEQ ID NO: 1196180 - RNA, 19 nt, Homo sapiens
caguuagccucacagaaga

SEQ ID NO: 1196181 - RNA, 19 nt, Homo sapiens
aaucagaagcucauuacuu

SEQ ID NO: 1196182 - RNA, 19 nt, Homo sapiens
gccaaucagaagcucauua

SEQ ID NO: 1196183 - RNA, 19 nt, Homo sapiens
uggaugcucugcuggaaga

SEQ ID NO: 1196184 - RNA, 19 nt, Homo sapiens
gaucaugacauuccauaac

SEQ ID NO: 1196185 - RNA, 19 nt, Homo sapiens
ggguggagacuuuagugua

SEQ ID NO: 1196186 - RNA, 19 nt, Homo sapiens
gagcuacacuggaaauccu

SEQ ID NO: 1196187 - RNA, 19 nt, Homo sapiens
gcaagaugcacccacaaag

SEQ ID NO: 1196188 - RNA, 19 nt, Homo sapiens
ugaagaggccuugaauuuc

SEQ ID NO: 1196189 - RNA, 19 nt, Homo sapiens
ucagaagcucauuacuuua

SEQ ID NO: 1196190 - RNA, 19 nt, Homo sapiens
ggaugacuuugacaacgau

SEQ ID NO: 1196191 - RNA, 19 nt, Homo sapiens
cgggaagcauacggaaaua

SEQ ID NO: 1196192 - RNA, 19 nt, Homo sapiens
gcagucgaguccauauguc

SEQ ID NO: 1196193 - RNA, 19 nt, Homo sapiens
gcgccucuuuggacacuga

SEQ ID NO: 1196194 - RNA, 19 nt, Homo sapiens
uaaagcaaucguucagaga

SEQ ID NO: 1196195 - RNA, 19 nt, Homo sapiens
aaagaugaauccguugauc

SEQ ID NO: 1196196 - RNA, 19 nt, Homo sapiens
gcccuuagccagccagaug

SEQ ID NO: 1196197 - RNA, 19 nt, Homo sapiens
caagguuggcuucuguuga

SEQ ID NO: 1196198 - RNA, 19 nt, Homo sapiens
ccauauguccacccauuga

SEQ ID NO: 1196199 - RNA, 19 nt, Homo sapiens
gguggucccucuccagucu

SEQ ID NO: 1196200 - RNA, 19 nt, Homo sapiens
ggaaagcuccaggccugaa

SEQ ID NO: 1196201 - RNA, 19 nt, Homo sapiens
cgaugaugaccaagauuaa

SEQ ID NO: 1196202 - RNA, 19 nt, Homo sapiens
aaagggaggagacucgaaa

SEQ ID NO: 1196203 - RNA, 19 nt, Homo sapiens
uguaagaacaagagaguug

SEQ ID NO: 1196204 - RNA, 19 nt, Homo sapiens
aagaugcacccacaaagaa

SEQ ID NO: 1196205 - RNA, 19 nt, Homo sapiens
cugcagcugugaauaguca

SEQ ID NO: 1196206 - RNA, 19 nt, Homo sapiens
augcuuggaugacagauga

SEQ ID NO: 1196207 - RNA, 19 nt, Homo sapiens
caagguccgcccugucuau

SEQ ID NO: 1196208 - RNA, 19 nt, Homo sapiens
gaggagaugucaauuauga

SEQ ID NO: 1196209 - RNA, 19 nt, Homo sapiens
gaauuugccuacucacuaa

SEQ ID NO: 1196210 - RNA, 19 nt, Homo sapiens
ucacauauguccaguuaaa

SEQ ID NO: 1196211 - RNA, 19 nt, Homo sapiens
ggauggaauucauaaagua

SEQ ID NO: 1196212 - RNA, 19 nt, Homo sapiens
gggaggagaugucaauuau

SEQ ID NO: 1196213 - RNA, 19 nt, Homo sapiens
ggaaggaaauggagaugug

SEQ ID NO: 1196214 - RNA, 19 nt, Homo sapiens
ccucacauauguccaguua

SEQ ID NO: 1196215 - RNA, 19 nt, Homo sapiens
caaaugaacguauacuuga

SEQ ID NO: 1196216 - RNA, 19 nt, Homo sapiens
gagcaagacuccaucucaa

SEQ ID NO: 1196217 - RNA, 19 nt, Homo sapiens
ggauuuaccaccucacaua

SEQ ID NO: 1196218 - RNA, 19 nt, Homo sapiens
gugcagaucugaaaucaca

SEQ ID NO: 1196219 - RNA, 19 nt, Homo sapiens
uguauuggcuugaauguga

SEQ ID NO: 1196220 - RNA, 19 nt, Homo sapiens
acucaaaccuggaagauga

SEQ ID NO: 1196221 - RNA, 19 nt, Homo sapiens
gaugugguauuccugcuuu

SEQ ID NO: 1196222 - RNA, 19 nt, Homo sapiens
gcacacgccuguaauacca

SEQ ID NO: 1196223 - RNA, 19 nt, Homo sapiens
ggacaacuaugcugaaagc

SEQ ID NO: 1196224 - RNA, 19 nt, Homo sapiens
gagugaggauccuagaauu

SEQ ID NO: 1196225 - RNA, 19 nt, Homo sapiens
cuucugacaucacugaaua

SEQ ID NO: 1196226 - RNA, 19 nt, Homo sapiens
ccaaaugaacguauacuug

SEQ ID NO: 1196227 - RNA, 19 nt, Homo sapiens
cauccugucucaaauaaau

SEQ ID NO: 1196228 - RNA, 19 nt, Homo sapiens
agacagaaauucccaccuu

SEQ ID NO: 1196229 - RNA, 19 nt, Homo sapiens
gaccauagacagcauaaau

SEQ ID NO: 1196230 - RNA, 19 nt, Homo sapiens
gaaauggagaugugguauu

SEQ ID NO: 1196231 - RNA, 19 nt, Homo sapiens
ccaaagaccuguaaaaugg

SEQ ID NO: 1196232 - RNA, 19 nt, Homo sapiens
guaguuuaaucacguguau

SEQ ID NO: 1196233 - RNA, 19 nt, Homo sapiens
gcccaaugauacaacagua

SEQ ID NO: 1196234 - RNA, 19 nt, Homo sapiens
gaagggugaggcagaauug

SEQ ID NO: 1196235 - RNA, 19 nt, Homo sapiens
gcuaauugcacaccacaaa

SEQ ID NO: 1196236 - RNA, 19 nt, Homo sapiens
cuaauaggccgauucagaa

SEQ ID NO: 1196237 - RNA, 19 nt, Homo sapiens
gaggagauccggauggaau

SEQ ID NO: 1196238 - RNA, 19 nt, Homo sapiens
ggagugaggauccuagaau

SEQ ID NO: 1196239 - RNA, 19 nt, Homo sapiens
aaauggagaugugguauuc

SEQ ID NO: 1196240 - RNA, 19 nt, Homo sapiens
gcagacacacagagacaaa

SEQ ID NO: 1196241 - RNA, 19 nt, Homo sapiens
ccauagacagcauaaauga

SEQ ID NO: 1196242 - RNA, 19 nt, Homo sapiens
ggaaggcaccugucacaca

SEQ ID NO: 1196243 - RNA, 19 nt, Homo sapiens
uuugagaacccgcauguua

SEQ ID NO: 1196244 - RNA, 19 nt, Homo sapiens
caaggugggcggaucauga

SEQ ID NO: 1196245 - RNA, 19 nt, Homo sapiens
gcggacaacuaugcugaaa

SEQ ID NO: 1196246 - RNA, 19 nt, Homo sapiens
caacagagcaagacuccau

SEQ ID NO: 1196247 - RNA, 19 nt, Homo sapiens
gaaaccccaucucuacuaa

SEQ ID NO: 1196248 - RNA, 19 nt, Homo sapiens
ccagugaaaucagcauguu

SEQ ID NO: 1196249 - RNA, 19 nt, Homo sapiens
ucaauacuguggcacuuuc

SEQ ID NO: 1196250 - RNA, 19 nt, Homo sapiens
aaacuugagugcaaugucu

SEQ ID NO: 1196251 - RNA, 19 nt, Homo sapiens
uugauucacccaacaaaua

SEQ ID NO: 1196252 - RNA, 19 nt, Homo sapiens
gaaaccccgucucuacuaa

SEQ ID NO: 1196253 - RNA, 19 nt, Homo sapiens
ugaagcuggugcacucaaa

SEQ ID NO: 1196254 - RNA, 19 nt, Homo sapiens
ugaggauccuagaauuuga

SEQ ID NO: 1196255 - RNA, 19 nt, Homo sapiens
ucagaagggugaggcagaa

SEQ ID NO: 1196256 - RNA, 19 nt, Homo sapiens
agaauuugccuacucacua

SEQ ID NO: 1196257 - RNA, 19 nt, Homo sapiens
uguggcacuuucucaguua

SEQ ID NO: 1196258 - RNA, 19 nt, Homo sapiens
caaaaucccaucucuacua

SEQ ID NO: 1196259 - RNA, 19 nt, Homo sapiens
cggauggaauucauaaagu

SEQ ID NO: 1196260 - RNA, 19 nt, Homo sapiens
guccagagaucgagaccau

SEQ ID NO: 1196261 - RNA, 19 nt, Homo sapiens
cgagaucgcgccacuauac

SEQ ID NO: 1196262 - RNA, 19 nt, Homo sapiens
gauaaaggaagccugucuu

SEQ ID NO: 1196263 - RNA, 19 nt, Homo sapiens
gcugugaauucgagcuaug

SEQ ID NO: 1196264 - RNA, 19 nt, Homo sapiens
gugaggauccuagaauuug

SEQ ID NO: 1196265 - RNA, 19 nt, Homo sapiens
caaaacgcauucuucauuc

SEQ ID NO: 1196266 - RNA, 19 nt, Homo sapiens
gcaaugucuuggauaugca

SEQ ID NO: 1196267 - RNA, 19 nt, Homo sapiens
ucacguguauuggcuugaa

SEQ ID NO: 1196268 - RNA, 19 nt, Homo sapiens
gcagagacagggaggagau

SEQ ID NO: 1196269 - RNA, 19 nt, Homo sapiens
gaaccugggguacuuaaaa

SEQ ID NO: 1196270 - RNA, 19 nt, Homo sapiens
aauguuagguuggugcaaa

SEQ ID NO: 1196271 - RNA, 19 nt, Homo sapiens
ugugugcacugcuguucua

SEQ ID NO: 1196272 - RNA, 19 nt, Homo sapiens
ggaaauggagaugugguau

SEQ ID NO: 1196273 - RNA, 19 nt, Homo sapiens
caaaggcacgggcugugaa

SEQ ID NO: 1196274 - RNA, 19 nt, Homo sapiens
ugaggcauaagaauuguuu

SEQ ID NO: 1196275 - RNA, 19 nt, Homo sapiens
ugguggcgaugcuaaguuu

SEQ ID NO: 1196276 - RNA, 19 nt, Homo sapiens
gcagcccaaugauacaaca

SEQ ID NO: 1196277 - RNA, 19 nt, Homo sapiens
gauccggauggaauucaua

SEQ ID NO: 1196278 - RNA, 19 nt, Homo sapiens
aaugccaaaugaacguaua

SEQ ID NO: 1196279 - RNA, 19 nt, Homo sapiens
aaaaucccaucucuacuaa

SEQ ID NO: 1196280 - RNA, 19 nt, Homo sapiens
cgugguggcucacacuugu

SEQ ID NO: 1196281 - RNA, 19 nt, Homo sapiens
ucaaaacgcauucuucauu

SEQ ID NO: 1196282 - RNA, 19 nt, Homo sapiens
ugagugcaaugucuuggau

SEQ ID NO: 1196283 - RNA, 19 nt, Homo sapiens
uaauaggccgauucagaaa

SEQ ID NO: 1196284 - RNA, 19 nt, Homo sapiens
gcacucaaaccuggaagau

SEQ ID NO: 1196285 - RNA, 19 nt, Homo sapiens
gcaagacuccaucucaaaa

SEQ ID NO: 1196286 - RNA, 19 nt, Homo sapiens
gcauucuucauucucuaua

SEQ ID NO: 1196287 - RNA, 19 nt, Homo sapiens
ggacugugguggcgaugcu

SEQ ID NO: 1196288 - RNA, 19 nt, Homo sapiens
gaguggugaucgucuucaa

SEQ ID NO: 1196289 - RNA, 19 nt, Homo sapiens
gauuuaccaccucacauau

SEQ ID NO: 1196290 - RNA, 19 nt, Homo sapiens
ccaagccaccggaaggaaa

SEQ ID NO: 1196291 - RNA, 19 nt, Homo sapiens
gaucacaagguccagagau

SEQ ID NO: 1196292 - RNA, 19 nt, Homo sapiens
caagauugcgccacuguac

SEQ ID NO: 1196293 - RNA, 19 nt, Homo sapiens
gaucaugaggucaggagau

SEQ ID NO: 1196294 - RNA, 19 nt, Homo sapiens
ucagaaacuugagugcaau

SEQ ID NO: 1196295 - RNA, 19 nt, Homo sapiens
ccuguaaucccagcacuuu

SEQ ID NO: 1196296 - RNA, 19 nt, Homo sapiens
gccgagaucgcgccacuau

SEQ ID NO: 1196297 - RNA, 19 nt, Homo sapiens
gauccuagaauuugagaac

SEQ ID NO: 1196298 - RNA, 19 nt, Homo sapiens
gucaggagaucgagaccau

SEQ ID NO: 1196299 - RNA, 19 nt, Homo sapiens
cgucuucaaugcugacauc

SEQ ID NO: 1196300 - RNA, 19 nt, Homo sapiens
uucagaaacuugagugcaa

SEQ ID NO: 1196301 - RNA, 19 nt, Homo sapiens
ccccagaacuucccaaaga

SEQ ID NO: 1196302 - RNA, 19 nt, Homo sapiens
cacagggcguucacucaga

SEQ ID NO: 1196303 - RNA, 19 nt, Homo sapiens
ggcugaggcauaagaauug

SEQ ID NO: 1196304 - RNA, 19 nt, Homo sapiens
uggcugaggcauaagaauu

SEQ ID NO: 1196305 - RNA, 19 nt, Homo sapiens
ggcugaggcauaagaauug

SEQ ID NO: 1196306 - RNA, 19 nt, Homo sapiens
uauguccaguuaaacaguu

SEQ ID NO: 1196307 - RNA, 19 nt, Homo sapiens
uuuaccaccucacauaugu

SEQ ID NO: 1196308 - RNA, 19 nt, Homo sapiens
ggacauagccugcaagaua

SEQ ID NO: 1196309 - RNA, 19 nt, Homo sapiens
gcacagagcugcaggagaa

SEQ ID NO: 1196310 - RNA, 19 nt, Homo sapiens
ggaaguggcucaagaagaa

SEQ ID NO: 1196311 - RNA, 19 nt, Homo sapiens
cuagagaucucauguauuu

SEQ ID NO: 1196312 - RNA, 19 nt, Homo sapiens
gaacugagcuggcuuucug

SEQ ID NO: 1196313 - RNA, 19 nt, Homo sapiens
ugacugagcuggagaguuu

SEQ ID NO: 1196314 - RNA, 19 nt, Homo sapiens
ggucaaaggucgugauaaa

SEQ ID NO: 1196315 - RNA, 19 nt, Homo sapiens
gcacguaacuacuaggauu

SEQ ID NO: 1196316 - RNA, 19 nt, Homo sapiens
gacggugaguuacuaauua

SEQ ID NO: 1196317 - RNA, 19 nt, Homo sapiens
gacauagccugcaagauaa

SEQ ID NO: 1196318 - RNA, 19 nt, Homo sapiens
gaaacucucugcuucugaa

SEQ ID NO: 1196319 - RNA, 19 nt, Homo sapiens
gugcuaaacuuucuccuuu

SEQ ID NO: 1196320 - RNA, 19 nt, Homo sapiens
gaacaguaaugaacaccuu

SEQ ID NO: 1196321 - RNA, 19 nt, Homo sapiens
acacuggcauguuggauua

SEQ ID NO: 1196322 - RNA, 19 nt, Homo sapiens
gcagagagaagcagaauuc

SEQ ID NO: 1196323 - RNA, 19 nt, Homo sapiens
acagauaaguccucacaaa

SEQ ID NO: 1196324 - RNA, 19 nt, Homo sapiens
gaaggagauucaacuggaa

SEQ ID NO: 1196325 - RNA, 19 nt, Homo sapiens
ccaagaaccagcacaagua

SEQ ID NO: 1196326 - RNA, 19 nt, Homo sapiens
gagaaaagauugaccuuga

SEQ ID NO: 1196327 - RNA, 19 nt, Homo sapiens
ugugaugccuucuacuuua

SEQ ID NO: 1196328 - RNA, 19 nt, Homo sapiens
gauaaguccucacaaacug

SEQ ID NO: 1196329 - RNA, 19 nt, Homo sapiens
guaaggaguuguacagagu

SEQ ID NO: 1196330 - RNA, 19 nt, Homo sapiens
gaauugagcaguccugguu

SEQ ID NO: 1196331 - RNA, 19 nt, Homo sapiens
uggaaaggcugagcaagua

SEQ ID NO: 1196332 - RNA, 19 nt, Homo sapiens
gauuacguuuguccuguua

SEQ ID NO: 1196333 - RNA, 19 nt, Homo sapiens
gcuuaaggauucugaguug

SEQ ID NO: 1196334 - RNA, 19 nt, Homo sapiens
gcagagagaaggagauuca

SEQ ID NO: 1196335 - RNA, 19 nt, Homo sapiens
gccagcagcuuaaggauuc

SEQ ID NO: 1196336 - RNA, 19 nt, Homo sapiens
gcaaugauggagacacuuu

SEQ ID NO: 1196337 - RNA, 19 nt, Homo sapiens
gcccuaggcugacaugaga

SEQ ID NO: 1196338 - RNA, 19 nt, Homo sapiens
ggagacacuuuauucagau

SEQ ID NO: 1196339 - RNA, 19 nt, Homo sapiens
gcgaggaaguuugauauuc

SEQ ID NO: 1196340 - RNA, 19 nt, Homo sapiens
gagcuggcuuucuggguuu

SEQ ID NO: 1196341 - RNA, 19 nt, Homo sapiens
gaaggagcuuucagugcaa

SEQ ID NO: 1196342 - RNA, 19 nt, Homo sapiens
gcccagcccucuaauuugu

SEQ ID NO: 1196343 - RNA, 19 nt, Homo sapiens
uaaacuuucuccuuuguuc

SEQ ID NO: 1196344 - RNA, 19 nt, Homo sapiens
gaagaaacaggaagaaagg

SEQ ID NO: 1196345 - RNA, 19 nt, Homo sapiens
gcuaaacuuucuccuuugu

SEQ ID NO: 1196346 - RNA, 19 nt, Homo sapiens
caagaaccagcacaaguaa

SEQ ID NO: 1196347 - RNA, 19 nt, Homo sapiens
guaaugaacaccuucugaa

SEQ ID NO: 1196348 - RNA, 19 nt, Homo sapiens
aaaugcagcuucagaaugg

SEQ ID NO: 1196349 - RNA, 19 nt, Homo sapiens
ggacacagccauugguaca

SEQ ID NO: 1196350 - RNA, 19 nt, Homo sapiens
gcaaaugcagcuucagaau

SEQ ID NO: 1196351 - RNA, 19 nt, Homo sapiens
gagcaaaugcagcuucaga

SEQ ID NO: 1196352 - RNA, 19 nt, Homo sapiens
gguacaucaugcucagaua

SEQ ID NO: 1196353 - RNA, 19 nt, Homo sapiens
gcaaguaccagugacaaug

SEQ ID NO: 1196354 - RNA, 19 nt, Homo sapiens
caaccagggucuccaccuu

SEQ ID NO: 1196355 - RNA, 19 nt, Homo sapiens
ggacuugauugagaagaau

SEQ ID NO: 1196356 - RNA, 19 nt, Homo sapiens
gcaggaaguggcucaagaa

SEQ ID NO: 1196357 - RNA, 19 nt, Homo sapiens
gagaagcagcagcguauug

SEQ ID NO: 1196358 - RNA, 19 nt, Homo sapiens
gagcagaaagugcgagaga

SEQ ID NO: 1196359 - RNA, 19 nt, Homo sapiens
gugcccagcccucuaauuu

SEQ ID NO: 1196360 - RNA, 19 nt, Homo sapiens
caacagauaaguccucaca

SEQ ID NO: 1196361 - RNA, 19 nt, Homo sapiens
ggauuacguuuguccuguu

SEQ ID NO: 1196362 - RNA, 19 nt, Homo sapiens
cauguuggauuacguuugu

SEQ ID NO: 1196363 - RNA, 19 nt, Homo sapiens
uuucuuacgugcacaguuu

SEQ ID NO: 1196364 - RNA, 19 nt, Homo sapiens
ucucucagcuggagcagaa

SEQ ID NO: 1196365 - RNA, 19 nt, Homo sapiens
uggagacacuuuauucaga

SEQ ID NO: 1196366 - RNA, 19 nt, Homo sapiens
agaccucggugcaaugaaa

SEQ ID NO: 1196367 - RNA, 19 nt, Homo sapiens
gaaagugugggaaugacaa

SEQ ID NO: 1196368 - RNA, 19 nt, Homo sapiens
gcucuggccuccuugaaag

SEQ ID NO: 1196369 - RNA, 19 nt, Homo sapiens
caaaugcagcuucagaaug

SEQ ID NO: 1196370 - RNA, 19 nt, Homo sapiens
cauggaaucuacccucaau

SEQ ID NO: 1196371 - RNA, 19 nt, Homo sapiens
gaagaggcgaggaaguuug

SEQ ID NO: 1196372 - RNA, 19 nt, Homo sapiens
gauuagagagcucaucaga

SEQ ID NO: 1196373 - RNA, 19 nt, Homo sapiens
cagaugugaucaagaggaa

SEQ ID NO: 1196374 - RNA, 19 nt, Homo sapiens
ccaguugccuucaagaucu

SEQ ID NO: 1196375 - RNA, 19 nt, Homo sapiens
caggcaaucugcagagaga

SEQ ID NO: 1196376 - RNA, 19 nt, Homo sapiens
caaaggucgugauaaacau

SEQ ID NO: 1196377 - RNA, 19 nt, Homo sapiens
gaaaagaaacucucugcuu

SEQ ID NO: 1196378 - RNA, 19 nt, Homo sapiens
ggaccacauucuaauagca

SEQ ID NO: 1196379 - RNA, 19 nt, Homo sapiens
gaagccagaugugaucaag

SEQ ID NO: 1196380 - RNA, 19 nt, Homo sapiens
aaccaggacuugauugaga

SEQ ID NO: 1196381 - RNA, 19 nt, Homo sapiens
gggagaagcagcagcguau

SEQ ID NO: 1196382 - RNA, 19 nt, Homo sapiens
gaagcauucugaggaagug

SEQ ID NO: 1196383 - RNA, 19 nt, Homo sapiens
guuccgaugugauucagaa

SEQ ID NO: 1196384 - RNA, 19 nt, Homo sapiens
gaaucuacccucaaucagu

SEQ ID NO: 1196385 - RNA, 19 nt, Homo sapiens
ccaccaugcugacggguau

SEQ ID NO: 1196386 - RNA, 19 nt, Homo sapiens
gaaacuagaagagguucaa

SEQ ID NO: 1196387 - RNA, 19 nt, Homo sapiens
gaucaagaggaaacuagaa

SEQ ID NO: 1196388 - RNA, 19 nt, Homo sapiens
cagagacucagcuagauuu

SEQ ID NO: 1196389 - RNA, 19 nt, Homo sapiens
ggagaccaguggagaaggu

SEQ ID NO: 1196390 - RNA, 19 nt, Homo sapiens
ucaaaggucgugauaaaca

SEQ ID NO: 1196391 - RNA, 19 nt, Homo sapiens
ccucuaaacucccuuuguc

SEQ ID NO: 1196392 - RNA, 19 nt, Homo sapiens
gcagaagccagaugugauc

SEQ ID NO: 1196393 - RNA, 19 nt, Homo sapiens
ggaagaaagggucaaaggu

SEQ ID NO: 1196394 - RNA, 19 nt, Homo sapiens
caggcugucuguagcauug

SEQ ID NO: 1196395 - RNA, 19 nt, Homo sapiens
guuuacagauggagcaaau

SEQ ID NO: 1196396 - RNA, 19 nt, Homo sapiens
gguaauguguugguuagca

SEQ ID NO: 1196397 - RNA, 19 nt, Homo sapiens
gcagaagauggaucaguug

SEQ ID NO: 1196398 - RNA, 19 nt, Homo sapiens
cguaguggcugcagucagu

SEQ ID NO: 1196399 - RNA, 19 nt, Homo sapiens
caggagaaauauccaacug

SEQ ID NO: 1196400 - RNA, 19 nt, Homo sapiens
cccagaagccucaggguaa

SEQ ID NO: 1196401 - RNA, 19 nt, Homo sapiens
cgacggugaguuacuaauu

SEQ ID NO: 1196402 - RNA, 19 nt, Homo sapiens
agacucagcuagauuugca

SEQ ID NO: 1196403 - RNA, 19 nt, Homo sapiens
guacaucaugcucagauau

SEQ ID NO: 1196404 - RNA, 19 nt, Homo sapiens
ggaguuguacagaguguug

SEQ ID NO: 1196405 - RNA, 19 nt, Homo sapiens
gaggcgaggaaguuugaua

SEQ ID NO: 1196406 - RNA, 19 nt, Homo sapiens
ggaggagaccaguggagaa

SEQ ID NO: 1196407 - RNA, 19 nt, Homo sapiens
gcagugggguccucccuuu

SEQ ID NO: 1196408 - RNA, 19 nt, Homo sapiens
guacaacgcuccaucuuca

SEQ ID NO: 1196409 - RNA, 19 nt, Homo sapiens
gauugugccuggaguguua

SEQ ID NO: 1196410 - RNA, 19 nt, Homo sapiens
ccacaaagaacauucauuu

SEQ ID NO: 1196411 - RNA, 19 nt, Homo sapiens
gaggagagacagugcauua

SEQ ID NO: 1196412 - RNA, 19 nt, Homo sapiens
cagcaagacuucccagaaa

SEQ ID NO: 1196413 - RNA, 19 nt, Homo sapiens
ucacguggauuguucagua

SEQ ID NO: 1196414 - RNA, 19 nt, Homo sapiens
ggccugaccuucauaagaa

SEQ ID NO: 1196415 - RNA, 19 nt, Homo sapiens
gagagacagugcauuaaga

SEQ ID NO: 1196416 - RNA, 19 nt, Homo sapiens
gaggaaagcacacgugaaa

SEQ ID NO: 1196417 - RNA, 19 nt, Homo sapiens
cagaauaugucaacucguu

SEQ ID NO: 1196418 - RNA, 19 nt, Homo sapiens
caagagccaugaccaguug

SEQ ID NO: 1196419 - RNA, 19 nt, Homo sapiens
guaaaacucuugccuauug

SEQ ID NO: 1196420 - RNA, 19 nt, Homo sapiens
gcaaaguauuccuguguug

SEQ ID NO: 1196421 - RNA, 19 nt, Homo sapiens
ccaaagaagcauucgguua

SEQ ID NO: 1196422 - RNA, 19 nt, Homo sapiens
guaggaauguaccguuaaa

SEQ ID NO: 1196423 - RNA, 19 nt, Homo sapiens
cacaauaaauacggucuua

SEQ ID NO: 1196424 - RNA, 19 nt, Homo sapiens
agaaacugcuuaagccuuu

SEQ ID NO: 1196425 - RNA, 19 nt, Homo sapiens
uaacgcggcuagcugauau

SEQ ID NO: 1196426 - RNA, 19 nt, Homo sapiens
gaagauauuuuguguguuc

SEQ ID NO: 1196427 - RNA, 19 nt, Homo sapiens
gaaaugcaaguuugaggaa

SEQ ID NO: 1196428 - RNA, 19 nt, Homo sapiens
caaagaagcauucgguuag

SEQ ID NO: 1196429 - RNA, 19 nt, Homo sapiens
gcccuuaacuguguucuga

SEQ ID NO: 1196430 - RNA, 19 nt, Homo sapiens
ggauugauguccaguucuu

SEQ ID NO: 1196431 - RNA, 19 nt, Homo sapiens
caucuucaccugcagaaua

SEQ ID NO: 1196432 - RNA, 19 nt, Homo sapiens
gcgcauacauuggcaugaa

SEQ ID NO: 1196433 - RNA, 19 nt, Homo sapiens
caagucacguggauuguuc

SEQ ID NO: 1196434 - RNA, 19 nt, Homo sapiens
gggcuuagaucucccucaa

SEQ ID NO: 1196435 - RNA, 19 nt, Homo sapiens
ccagggagcugaagcacau

SEQ ID NO: 1196436 - RNA, 19 nt, Homo sapiens
agaaagcucugcaguccuu

SEQ ID NO: 1196437 - RNA, 19 nt, Homo sapiens
agacgguauuugaagauua

SEQ ID NO: 1196438 - RNA, 19 nt, Homo sapiens
gagauuaagauggaagaua

SEQ ID NO: 1196439 - RNA, 19 nt, Homo sapiens
ggacagcuuugcaauacca

SEQ ID NO: 1196440 - RNA, 19 nt, Homo sapiens
gcuuagaucucccucaagu

SEQ ID NO: 1196441 - RNA, 19 nt, Homo sapiens
gacagugcauuaagacuuc

SEQ ID NO: 1196442 - RNA, 19 nt, Homo sapiens
auaagaagacccagaguaa

SEQ ID NO: 1196443 - RNA, 19 nt, Homo sapiens
ccagaaaucccaugcuguu

SEQ ID NO: 1196444 - RNA, 19 nt, Homo sapiens
cagcaguguuucaggaauu

SEQ ID NO: 1196445 - RNA, 19 nt, Homo sapiens
cuucagaaaugcaaguuug

SEQ ID NO: 1196446 - RNA, 19 nt, Homo sapiens
guaaagcaggugcaagaaa

SEQ ID NO: 1196447 - RNA, 19 nt, Homo sapiens
aaacaacccugacauucca

SEQ ID NO: 1196448 - RNA, 19 nt, Homo sapiens
gaggaacgaaacuucauuu

SEQ ID NO: 1196449 - RNA, 19 nt, Homo sapiens
cauaagaagacccagagua

SEQ ID NO: 1196450 - RNA, 19 nt, Homo sapiens
ggugguugguguuugauga

SEQ ID NO: 1196451 - RNA, 19 nt, Homo sapiens
uaaagcaggugcaagaaaa

SEQ ID NO: 1196452 - RNA, 19 nt, Homo sapiens
guugcgagcugguggaguu

SEQ ID NO: 1196453 - RNA, 19 nt, Homo sapiens
cgacaucgccaaggucaaa

SEQ ID NO: 1196454 - RNA, 19 nt, Homo sapiens
ucgguuagcacaagugaua

SEQ ID NO: 1196455 - RNA, 19 nt, Homo sapiens
gcaagcaaaggcuacgaaa

SEQ ID NO: 1196456 - RNA, 19 nt, Homo sapiens
caacguuucugagauuaag

SEQ ID NO: 1196457 - RNA, 19 nt, Homo sapiens
caugauccagucaguauuu

SEQ ID NO: 1196458 - RNA, 19 nt, Homo sapiens
cagaaugucuugcuaucag

SEQ ID NO: 1196459 - RNA, 19 nt, Homo sapiens
ggaggaacgaaacuucauu

SEQ ID NO: 1196460 - RNA, 19 nt, Homo sapiens
gaaauccuacguucggaau

SEQ ID NO: 1196461 - RNA, 19 nt, Homo sapiens
guucagaagcaaaguauuc

SEQ ID NO: 1196462 - RNA, 19 nt, Homo sapiens
ggagagacagugcauuaag

SEQ ID NO: 1196463 - RNA, 19 nt, Homo sapiens
uuucugagauuaagaugga

SEQ ID NO: 1196464 - RNA, 19 nt, Homo sapiens
uaagaagacccagaguaaa

SEQ ID NO: 1196465 - RNA, 19 nt, Homo sapiens
gggccuccacccacauuua

SEQ ID NO: 1196466 - RNA, 19 nt, Homo sapiens
guaacgcggcuagcugaua

SEQ ID NO: 1196467 - RNA, 19 nt, Homo sapiens
uaagacuucaucacuguuu

SEQ ID NO: 1196468 - RNA, 19 nt, Homo sapiens
gcauuaagacuucaucacu

SEQ ID NO: 1196469 - RNA, 19 nt, Homo sapiens
gaaacucagaggacuuuua

SEQ ID NO: 1196470 - RNA, 19 nt, Homo sapiens
gcgaaacggaggaacgaaa

SEQ ID NO: 1196471 - RNA, 19 nt, Homo sapiens
cgccggaucucgcuucuca

SEQ ID NO: 1196472 - RNA, 19 nt, Homo sapiens
gacgguauuugaagauuac

SEQ ID NO: 1196473 - RNA, 19 nt, Homo sapiens
gcauggagcaggaggaaag

SEQ ID NO: 1196474 - RNA, 19 nt, Homo sapiens
ugaagcagacagaaucuug

SEQ ID NO: 1196475 - RNA, 19 nt, Homo sapiens
uuagggagcuacccagaca

SEQ ID NO: 1196476 - RNA, 19 nt, Homo sapiens
gaaaccaggaggagagaca

SEQ ID NO: 1196477 - RNA, 19 nt, Homo sapiens
ccuaucagcgcauacauug

SEQ ID NO: 1196478 - RNA, 19 nt, Homo sapiens
gggucugugucuuguauug

SEQ ID NO: 1196479 - RNA, 19 nt, Homo sapiens
gauggaagauauuuugugu

SEQ ID NO: 1196480 - RNA, 19 nt, Homo sapiens
ccacuacagccucuuccua

SEQ ID NO: 1196481 - RNA, 19 nt, Homo sapiens
ucaagcagcaugugacugu

SEQ ID NO: 1196482 - RNA, 19 nt, Homo sapiens
gcauacauuggcaugaauu

SEQ ID NO: 1196483 - RNA, 19 nt, Homo sapiens
ccuggagccugauagaaau

SEQ ID NO: 1196484 - RNA, 19 nt, Homo sapiens
ugacugugguucccagcaa

SEQ ID NO: 1196485 - RNA, 19 nt, Homo sapiens
aagacuucaucacuguuua

SEQ ID NO: 1196486 - RNA, 19 nt, Homo sapiens
cucguuggcuucucacaaa

SEQ ID NO: 1196487 - RNA, 19 nt, Homo sapiens
gaagagaaaaucagaaaag

SEQ ID NO: 1196488 - RNA, 19 nt, Homo sapiens
gagaagagaaaaucagaaa

SEQ ID NO: 1196489 - RNA, 19 nt, Homo sapiens
uagcacaagugauagaaac

SEQ ID NO: 1196490 - RNA, 19 nt, Homo sapiens
ugucagaggaggcuuguga

SEQ ID NO: 1196491 - RNA, 19 nt, Homo sapiens
guacagcgggacagcaaga

SEQ ID NO: 1196492 - RNA, 19 nt, Homo sapiens
agacaggcuuuaguuccua

SEQ ID NO: 1196493 - RNA, 19 nt, Homo sapiens
gaggaaagaacagcagugu

SEQ ID NO: 1196494 - RNA, 19 nt, Homo sapiens
ggccuccacccacauuuaa

SEQ ID NO: 1196495 - RNA, 19 nt, Homo sapiens
cccgggaugugauguaaga

SEQ ID NO: 1196496 - RNA, 19 nt, Homo sapiens
cagacgguauuugaagauu

SEQ ID NO: 1196497 - RNA, 19 nt, Homo sapiens
gccaagaaaacuaguguua

SEQ ID NO: 1196498 - RNA, 19 nt, Homo sapiens
ccucaagucacguggauug

SEQ ID NO: 1196499 - RNA, 19 nt, Homo sapiens
gagcuucggacuaagagau

SEQ ID NO: 1196500 - RNA, 19 nt, Homo sapiens
gcagacgguauuugaagau

SEQ ID NO: 1196501 - RNA, 19 nt, Homo sapiens
aaaucaacguuucugagau

SEQ ID NO: 1196502 - RNA, 19 nt, Homo sapiens
uuagaucucccucaaguca

SEQ ID NO: 1196503 - RNA, 19 nt, Homo sapiens
aaugcaaguuugaggaaga

SEQ ID NO: 1196504 - RNA, 19 nt, Homo sapiens
ccagcaaacugaggcuugu

SEQ ID NO: 1196505 - RNA, 19 nt, Homo sapiens
uacagccucuuccuacaga

SEQ ID NO: 1196506 - RNA, 19 nt, Homo sapiens
gacugugguucccagcaaa

SEQ ID NO: 1196507 - RNA, 19 nt, Homo sapiens
ggacgccugguggaucaua

SEQ ID NO: 1196508 - RNA, 19 nt, Homo sapiens
gauugugccuggaguguua

SEQ ID NO: 1196509 - RNA, 19 nt, Homo sapiens
ccacaaagaacauucauuu

SEQ ID NO: 1196510 - RNA, 19 nt, Homo sapiens
gaggagagacagugcauua

SEQ ID NO: 1196511 - RNA, 19 nt, Homo sapiens
gagagacagugcauuaaga

SEQ ID NO: 1196512 - RNA, 19 nt, Homo sapiens
caagagccaugaccaguug

SEQ ID NO: 1196513 - RNA, 19 nt, Homo sapiens
guaaaacucuugccuauug

SEQ ID NO: 1196514 - RNA, 19 nt, Homo sapiens
gcaaaguauuccuguguug

SEQ ID NO: 1196515 - RNA, 19 nt, Homo sapiens
ccaaagaagcauucgguua

SEQ ID NO: 1196516 - RNA, 19 nt, Homo sapiens
cacaauaaauacggucuua

SEQ ID NO: 1196517 - RNA, 19 nt, Homo sapiens
agaaacugcuuaagccuuu

SEQ ID NO: 1196518 - RNA, 19 nt, Homo sapiens
uaacgcggcuagcugauau

SEQ ID NO: 1196519 - RNA, 19 nt, Homo sapiens
gaaaugcaaguuugaggaa

SEQ ID NO: 1196520 - RNA, 19 nt, Homo sapiens
caaagaagcauucgguuag

SEQ ID NO: 1196521 - RNA, 19 nt, Homo sapiens
ggacagcuuugcaauacca

SEQ ID NO: 1196522 - RNA, 19 nt, Homo sapiens
gacagugcauuaagacuuc

SEQ ID NO: 1196523 - RNA, 19 nt, Homo sapiens
gacauuagguuuucuguug

SEQ ID NO: 1196524 - RNA, 19 nt, Homo sapiens
ucugugcaguucuuaauuu

SEQ ID NO: 1196525 - RNA, 19 nt, Homo sapiens
gaagcauacuguucugucu

SEQ ID NO: 1196526 - RNA, 19 nt, Homo sapiens
cagcaguguuucaggaauu

SEQ ID NO: 1196527 - RNA, 19 nt, Homo sapiens
cuucagaaaugcaaguuug

SEQ ID NO: 1196528 - RNA, 19 nt, Homo sapiens
guaaagcaggugcaagaaa

SEQ ID NO: 1196529 - RNA, 19 nt, Homo sapiens
aaacaacccugacauucca

SEQ ID NO: 1196530 - RNA, 19 nt, Homo sapiens
gaggaacgaaacuucauuu

SEQ ID NO: 1196531 - RNA, 19 nt, Homo sapiens
uaaaucaccugugcugcuu

SEQ ID NO: 1196532 - RNA, 19 nt, Homo sapiens
ggugguugguguuugauga

SEQ ID NO: 1196533 - RNA, 19 nt, Homo sapiens
uaaagcaggugcaagaaaa

SEQ ID NO: 1196534 - RNA, 19 nt, Homo sapiens
guugcgagcugguggaguu

SEQ ID NO: 1196535 - RNA, 19 nt, Homo sapiens
guugacgaguugauaagaa

SEQ ID NO: 1196536 - RNA, 19 nt, Homo sapiens
ucgguuagcacaagugaua

SEQ ID NO: 1196537 - RNA, 19 nt, Homo sapiens
gcaagcaaaggcuacgaaa

SEQ ID NO: 1196538 - RNA, 19 nt, Homo sapiens
caugauccagucaguauuu

SEQ ID NO: 1196539 - RNA, 19 nt, Homo sapiens
cagaaugucuugcuaucag

SEQ ID NO: 1196540 - RNA, 19 nt, Homo sapiens
ggaggaacgaaacuucauu

SEQ ID NO: 1196541 - RNA, 19 nt, Homo sapiens
guucagaagcaaaguauuc

SEQ ID NO: 1196542 - RNA, 19 nt, Homo sapiens
ggagagacagugcauuaag

SEQ ID NO: 1196543 - RNA, 19 nt, Homo sapiens
uaagaaguaccaccgaaug

SEQ ID NO: 1196544 - RNA, 19 nt, Homo sapiens
gggccuccacccacauuua

SEQ ID NO: 1196545 - RNA, 19 nt, Homo sapiens
ucaguucugugucccaaau

SEQ ID NO: 1196546 - RNA, 19 nt, Homo sapiens
uuucuaagccaccugauuu

SEQ ID NO: 1196547 - RNA, 19 nt, Homo sapiens
guaacgcggcuagcugaua

SEQ ID NO: 1196548 - RNA, 19 nt, Homo sapiens
uaagacuucaucacuguuu

SEQ ID NO: 1196549 - RNA, 19 nt, Homo sapiens
gcauuaagacuucaucacu

SEQ ID NO: 1196550 - RNA, 19 nt, Homo sapiens
gaaacucagaggacuuuua

SEQ ID NO: 1196551 - RNA, 19 nt, Homo sapiens
gcgaaacggaggaacgaaa

SEQ ID NO: 1196552 - RNA, 19 nt, Homo sapiens
gcauggagcaggaggaaag

SEQ ID NO: 1196553 - RNA, 19 nt, Homo sapiens
ugaagcagacagaaucuug

SEQ ID NO: 1196554 - RNA, 19 nt, Homo sapiens
uuagggagcuacccagaca

SEQ ID NO: 1196555 - RNA, 19 nt, Homo sapiens
cgccggaucucgcuucuca

SEQ ID NO: 1196556 - RNA, 19 nt, Homo sapiens
gaaaccaggaggagagaca

SEQ ID NO: 1196557 - RNA, 19 nt, Homo sapiens
gagauacggcugugaagag

SEQ ID NO: 1196558 - RNA, 19 nt, Homo sapiens
ggagauacggcugugaaga

SEQ ID NO: 1196559 - RNA, 19 nt, Homo sapiens
ccacuacagccucuuccua

SEQ ID NO: 1196560 - RNA, 19 nt, Homo sapiens
ucaagcagcaugugacugu

SEQ ID NO: 1196561 - RNA, 19 nt, Homo sapiens
cagaagaugcaccuaaauc

SEQ ID NO: 1196562 - RNA, 19 nt, Homo sapiens
ugacugugguucccagcaa

SEQ ID NO: 1196563 - RNA, 19 nt, Homo sapiens
aagacuucaucacuguuua

SEQ ID NO: 1196564 - RNA, 19 nt, Homo sapiens
gaagagaaaaucagaaaag

SEQ ID NO: 1196565 - RNA, 19 nt, Homo sapiens
gagaagagaaaaucagaaa

SEQ ID NO: 1196566 - RNA, 19 nt, Homo sapiens
uagcacaagugauagaaac

SEQ ID NO: 1196567 - RNA, 19 nt, Homo sapiens
aauguagacuuucgugcuu

SEQ ID NO: 1196568 - RNA, 19 nt, Homo sapiens
uucagaagaugcaccuaaa

SEQ ID NO: 1196569 - RNA, 19 nt, Homo sapiens
gaggaaagaacagcagugu

SEQ ID NO: 1196570 - RNA, 19 nt, Homo sapiens
agacaggcuuuaguuccua

SEQ ID NO: 1196571 - RNA, 19 nt, Homo sapiens
ggccuccacccacauuuaa

SEQ ID NO: 1196572 - RNA, 19 nt, Homo sapiens
agaagaugcaccuaaauca

SEQ ID NO: 1196573 - RNA, 19 nt, Homo sapiens
gacgaguugauaagaagua

SEQ ID NO: 1196574 - RNA, 19 nt, Homo sapiens
gcuaggagacaaaggagau

SEQ ID NO: 1196575 - RNA, 19 nt, Homo sapiens
gccaagaaaacuaguguua

SEQ ID NO: 1196576 - RNA, 19 nt, Homo sapiens
gaggcuaggagacaaagga

SEQ ID NO: 1196577 - RNA, 19 nt, Homo sapiens
ccaggaggcuaggagacaa

SEQ ID NO: 1196578 - RNA, 19 nt, Homo sapiens
gaagaugcaccuaaaucac

SEQ ID NO: 1196579 - RNA, 19 nt, Homo sapiens
ucauuauguugacgaguug

SEQ ID NO: 1196580 - RNA, 19 nt, Homo sapiens
aaugcaaguuugaggaaga

SEQ ID NO: 1196581 - RNA, 19 nt, Homo sapiens
ccagcaaacugaggcuugu

SEQ ID NO: 1196582 - RNA, 19 nt, Homo sapiens
gaagagucacaaugucagu

SEQ ID NO: 1196583 - RNA, 19 nt, Homo sapiens
auacggcugugaagaguca

SEQ ID NO: 1196584 - RNA, 19 nt, Homo sapiens
uacagccucuuccuacaga

SEQ ID NO: 1196585 - RNA, 19 nt, Homo sapiens
gacugugguucccagcaaa

SEQ ID NO: 1196586 - RNA, 19 nt, Homo sapiens
ggacgccugguggaucaua

SEQ ID NO: 1196587 - RNA, 19 nt, Homo sapiens
uucaagcaauggagucaaa

SEQ ID NO: 1196588 - RNA, 19 nt, Homo sapiens
ugaccaguguucagaagca

SEQ ID NO: 1196589 - RNA, 19 nt, Homo sapiens
ugucuaguaugaccagugu

SEQ ID NO: 1196590 - RNA, 19 nt, Homo sapiens
gccagacuccgcaaaggaa

SEQ ID NO: 1196591 - RNA, 19 nt, Homo sapiens
ccagacgggcucagguaaa

SEQ ID NO: 1196592 - RNA, 19 nt, Homo sapiens
agacagugcauuaagacuu

SEQ ID NO: 1196593 - RNA, 19 nt, Homo sapiens
cuggacagcuuugcaauac

SEQ ID NO: 1196594 - RNA, 19 nt, Homo sapiens
guaaaugcugaaugccaaa

SEQ ID NO: 1196595 - RNA, 19 nt, Homo sapiens
agugauacuuaaugcugua

SEQ ID NO: 1196596 - RNA, 19 nt, Homo sapiens
ugaugaagcagacagaauc

SEQ ID NO: 1196597 - RNA, 19 nt, Homo sapiens
auuaagacuucaucacugu

SEQ ID NO: 1196598 - RNA, 19 nt, Homo sapiens
aagaaacucagaggacuuu

SEQ ID NO: 1196599 - RNA, 19 nt, Homo sapiens
uauguugacgaguugauaa

SEQ ID NO: 1196600 - RNA, 19 nt, Homo sapiens
cuaaagugcugaggaaacg

SEQ ID NO: 1196601 - RNA, 19 nt, Homo sapiens
uaucagcgacacucacaga

SEQ ID NO: 1196602 - RNA, 19 nt, Homo sapiens
ccugguggaucauauaaaa

SEQ ID NO: 1196603 - RNA, 19 nt, Homo sapiens
caaaggcuacgaaaagaaa

SEQ ID NO: 1196604 - RNA, 19 nt, Homo sapiens
acgguucgcucuucgacaa

SEQ ID NO: 1196605 - RNA, 19 nt, Homo sapiens
ugaggaagaccagaagaug

SEQ ID NO: 1196606 - RNA, 19 nt, Homo sapiens
gaccaguguucagaagcaa

SEQ ID NO: 1196607 - RNA, 19 nt, Homo sapiens
ccacauuuaauuuccacaa

SEQ ID NO: 1196608 - RNA, 19 nt, Homo sapiens
gaagagaacguuccauaua

SEQ ID NO: 1196609 - RNA, 19 nt, Homo sapiens
guuagaagcuagcaaauuu

SEQ ID NO: 1196610 - RNA, 19 nt, Homo sapiens
gccaaaggcuucucaauga

SEQ ID NO: 1196611 - RNA, 19 nt, Homo sapiens
acacggaaaucaccaaaua

SEQ ID NO: 1196612 - RNA, 19 nt, Homo sapiens
gaaccagaaagaugaauua

SEQ ID NO: 1196613 - RNA, 19 nt, Homo sapiens
caagagaugcccugaauaa

SEQ ID NO: 1196614 - RNA, 19 nt, Homo sapiens
cggccaagaugcugaauua

SEQ ID NO: 1196615 - RNA, 19 nt, Homo sapiens
gaaagaaagcugugauaga

SEQ ID NO: 1196616 - RNA, 19 nt, Homo sapiens
ccaagaugcugaauuauca

SEQ ID NO: 1196617 - RNA, 19 nt, Homo sapiens
ggacuccuguguuucuaua

SEQ ID NO: 1196618 - RNA, 19 nt, Homo sapiens
cagauuuggugcuaaguua

SEQ ID NO: 1196619 - RNA, 19 nt, Homo sapiens
gaagaacguuacacggaaa

SEQ ID NO: 1196620 - RNA, 19 nt, Homo sapiens
gaaaagccauugauaagaa

SEQ ID NO: 1196621 - RNA, 19 nt, Homo sapiens
gaaaaccucugcuugagua

SEQ ID NO: 1196622 - RNA, 19 nt, Homo sapiens
ggaaggaguacuauuguuu

SEQ ID NO: 1196623 - RNA, 19 nt, Homo sapiens
aaagaaagcugugauagau

SEQ ID NO: 1196624 - RNA, 19 nt, Homo sapiens
aagagaacguuccauauaa

SEQ ID NO: 1196625 - RNA, 19 nt, Homo sapiens
ggucuguggucauauuaua

SEQ ID NO: 1196626 - RNA, 19 nt, Homo sapiens
ugagguaucuucauuuaug

SEQ ID NO: 1196627 - RNA, 19 nt, Homo sapiens
gagcagaaacggaaauuga

SEQ ID NO: 1196628 - RNA, 19 nt, Homo sapiens
ggaguacuauuguuugguu

SEQ ID NO: 1196629 - RNA, 19 nt, Homo sapiens
ugaauuaccuauugaagug

SEQ ID NO: 1196630 - RNA, 19 nt, Homo sapiens
gcaaaccagugggcugaua

SEQ ID NO: 1196631 - RNA, 19 nt, Homo sapiens
gcaccagcaucaaacauug

SEQ ID NO: 1196632 - RNA, 19 nt, Homo sapiens
gaaguguucuuaaguugau

SEQ ID NO: 1196633 - RNA, 19 nt, Homo sapiens
caucaaacauuguguaucu

SEQ ID NO: 1196634 - RNA, 19 nt, Homo sapiens
gcaaacaacagauaacaau

SEQ ID NO: 1196635 - RNA, 19 nt, Homo sapiens
gcaacuuuauuucuucuga

SEQ ID NO: 1196636 - RNA, 19 nt, Homo sapiens
caaagcguaucaucucauu

SEQ ID NO: 1196637 - RNA, 19 nt, Homo sapiens
ggaaccauuuguggaguua

SEQ ID NO: 1196638 - RNA, 19 nt, Homo sapiens
ggaaucuggucuuucugua

SEQ ID NO: 1196639 - RNA, 19 nt, Homo sapiens
gaacaaaguccaggagaug

SEQ ID NO: 1196640 - RNA, 19 nt, Homo sapiens
gagaaagaguacuguggaa

SEQ ID NO: 1196641 - RNA, 19 nt, Homo sapiens
ugugagguaucuucauuua

SEQ ID NO: 1196642 - RNA, 19 nt, Homo sapiens
gcacuucuuucgacaagga

SEQ ID NO: 1196643 - RNA, 19 nt, Homo sapiens
uggaggagcucaucgacua

SEQ ID NO: 1196644 - RNA, 19 nt, Homo sapiens
ugugauagauuccagauau

SEQ ID NO: 1196645 - RNA, 19 nt, Homo sapiens
ccagugggcugauaucugu

SEQ ID NO: 1196646 - RNA, 19 nt, Homo sapiens
aaacagcuccuuggaauuu

SEQ ID NO: 1196647 - RNA, 19 nt, Homo sapiens
ggaauccucuuugaaguuc

SEQ ID NO: 1196648 - RNA, 19 nt, Homo sapiens
gcauguguguauuguauau

SEQ ID NO: 1196649 - RNA, 19 nt, Homo sapiens
ggaacaaaguccaggagau

SEQ ID NO: 1196650 - RNA, 19 nt, Homo sapiens
ugauaucugugacaucuuu

SEQ ID NO: 1196651 - RNA, 19 nt, Homo sapiens
gaauaaaggauacuguuca

SEQ ID NO: 1196652 - RNA, 19 nt, Homo sapiens
gagugaacaucaauaggaa

SEQ ID NO: 1196653 - RNA, 19 nt, Homo sapiens
ggagugaacaucaauagga

SEQ ID NO: 1196654 - RNA, 19 nt, Homo sapiens
cuucauuucugaucaagua

SEQ ID NO: 1196655 - RNA, 19 nt, Homo sapiens
aaacuuugccaaccuguua

SEQ ID NO: 1196656 - RNA, 19 nt, Homo sapiens
gaccgaaacccaugaaguu

SEQ ID NO: 1196657 - RNA, 19 nt, Homo sapiens
gugcauguguguauuguau

SEQ ID NO: 1196658 - RNA, 19 nt, Homo sapiens
cagaagagaacguuccaua

SEQ ID NO: 1196659 - RNA, 19 nt, Homo sapiens
gaggagcucugucaggaau

SEQ ID NO: 1196660 - RNA, 19 nt, Homo sapiens
gaaggaguacuauuguuug

SEQ ID NO: 1196661 - RNA, 19 nt, Homo sapiens
cgagaggcauuacaauaug

SEQ ID NO: 1196662 - RNA, 19 nt, Homo sapiens
ccaaaggcuucucaaugaa

SEQ ID NO: 1196663 - RNA, 19 nt, Homo sapiens
cuaaagcagugaaggaaga

SEQ ID NO: 1196664 - RNA, 19 nt, Homo sapiens
agaaagcugugauagauuc

SEQ ID NO: 1196665 - RNA, 19 nt, Homo sapiens
gcgagaggcauuacaauau

SEQ ID NO: 1196666 - RNA, 19 nt, Homo sapiens
gacaaggaaugcuggaugu

SEQ ID NO: 1196667 - RNA, 19 nt, Homo sapiens
ugaaagagaagguagagaa

SEQ ID NO: 1196668 - RNA, 19 nt, Homo sapiens
ccagacccaucacuuuaaa

SEQ ID NO: 1196669 - RNA, 19 nt, Homo sapiens
ggucuugguagcccuauua

SEQ ID NO: 1196670 - RNA, 19 nt, Homo sapiens
gcauagaguggaaggagua

SEQ ID NO: 1196671 - RNA, 19 nt, Homo sapiens
guaaauacaccagcaguug

SEQ ID NO: 1196672 - RNA, 19 nt, Homo sapiens
gugcugguaucacucuaua

SEQ ID NO: 1196673 - RNA, 19 nt, Homo sapiens
ccagaaagaugaauuaccu

SEQ ID NO: 1196674 - RNA, 19 nt, Homo sapiens
caaaacagcuccuuggaau

SEQ ID NO: 1196675 - RNA, 19 nt, Homo sapiens
aagagaagguagagaauuc

SEQ ID NO: 1196676 - RNA, 19 nt, Homo sapiens
gaaagagaagguagagaau

SEQ ID NO: 1196677 - RNA, 19 nt, Homo sapiens
gaauugugguuaugaaacu

SEQ ID NO: 1196678 - RNA, 19 nt, Homo sapiens
gacaagggauugagaacuc

SEQ ID NO: 1196679 - RNA, 19 nt, Homo sapiens
uaaugcagcuaaccaagga

SEQ ID NO: 1196680 - RNA, 19 nt, Homo sapiens
aaauuggucuguggucaua

SEQ ID NO: 1196681 - RNA, 19 nt, Homo sapiens
ggaaaugcuuauagcucaa

SEQ ID NO: 1196682 - RNA, 19 nt, Homo sapiens
ggaagagaacagagacaaa

SEQ ID NO: 1196683 - RNA, 19 nt, Homo sapiens
gaacaucaauaggaauacu

SEQ ID NO: 1196684 - RNA, 19 nt, Homo sapiens
gaacguuuauugcuguuuu

SEQ ID NO: 1196685 - RNA, 19 nt, Homo sapiens
gcaguuaccagacccauca

SEQ ID NO: 1196686 - RNA, 19 nt, Homo sapiens
gaaggaaagcagcauguuc

SEQ ID NO: 1196687 - RNA, 19 nt, Homo sapiens
gauaacaauccacccauga

SEQ ID NO: 1196688 - RNA, 19 nt, Homo sapiens
ucaggaaucuggucuuucu

SEQ ID NO: 1196689 - RNA, 19 nt, Homo sapiens
gcugauaucugugacaucu

SEQ ID NO: 1196690 - RNA, 19 nt, Homo sapiens
ggagaugccaaacagauau

SEQ ID NO: 1196691 - RNA, 19 nt, Homo sapiens
gagaugcccugaauaaaau

SEQ ID NO: 1196692 - RNA, 19 nt, Homo sapiens
gggacacuuucacuuguuu

SEQ ID NO: 1196693 - RNA, 19 nt, Homo sapiens
gugaacaucaauaggaaua

SEQ ID NO: 1196694 - RNA, 19 nt, Homo sapiens
aaagacuucuguggacaua

SEQ ID NO: 1196695 - RNA, 19 nt, Homo sapiens
uaccagacccaucacuuua

SEQ ID NO: 1196696 - RNA, 19 nt, Homo sapiens
guugauauuuacucucuug

SEQ ID NO: 1196697 - RNA, 19 nt, Homo sapiens
uuaacuggcuggugugaga

SEQ ID NO: 1196698 - RNA, 19 nt, Homo sapiens
uaacaauccacccaugaaa

SEQ ID NO: 1196699 - RNA, 19 nt, Homo sapiens
gcugguaucacucuauauu

SEQ ID NO: 1196700 - RNA, 19 nt, Homo sapiens
agagaaauguggcacuuca

SEQ ID NO: 1196701 - RNA, 19 nt, Homo sapiens
gcugcguguuuaagaauuu

SEQ ID NO: 1196702 - RNA, 19 nt, Homo sapiens
cgccauguguuuaauauuc

SEQ ID NO: 1196703 - RNA, 19 nt, Homo sapiens
gaugguggagcacuucuuu

SEQ ID NO: 1196704 - RNA, 19 nt, Homo sapiens
gagcacuucuuucgacaag

SEQ ID NO: 1196705 - RNA, 19 nt, Homo sapiens
aaacacagaagcaaagaga

SEQ ID NO: 1196706 - RNA, 19 nt, Homo sapiens
gacauggagugaacaucaa

SEQ ID NO: 1196707 - RNA, 19 nt, Homo sapiens
guagcccuauuauaucauu

SEQ ID NO: 1196708 - RNA, 19 nt, Homo sapiens
gcagaaagguguugaaaug

SEQ ID NO: 1196709 - RNA, 19 nt, Homo sapiens
ggacagaggcuauaugaaa

SEQ ID NO: 1196710 - RNA, 19 nt, Homo sapiens
ggaagaaccggguaucaua

SEQ ID NO: 1196711 - RNA, 19 nt, Homo sapiens
gaacugccuuacuagauuu

SEQ ID NO: 1196712 - RNA, 19 nt, Homo sapiens
caauuaaacucaugcagaa

SEQ ID NO: 1196713 - RNA, 19 nt, Homo sapiens
ugauagaacugccuuacua

SEQ ID NO: 1196714 - RNA, 19 nt, Homo sapiens
gaauaagaccuguucacua

SEQ ID NO: 1196715 - RNA, 19 nt, Homo sapiens
gaagugaaggccuuuauga

SEQ ID NO: 1196716 - RNA, 19 nt, Homo sapiens
gaaugaaggucugucaguu

SEQ ID NO: 1196717 - RNA, 19 nt, Homo sapiens
ggacagcaaucuucucuac

SEQ ID NO: 1196718 - RNA, 19 nt, Homo sapiens
gaaagguguugaaaugcuu

SEQ ID NO: 1196719 - RNA, 19 nt, Homo sapiens
aauaagaccuguucacuag

SEQ ID NO: 1196720 - RNA, 19 nt, Homo sapiens
gcgcauggcugaggucuug

SEQ ID NO: 1196721 - RNA, 19 nt, Homo sapiens
uaaaucagcuauagcaucu

SEQ ID NO: 1196722 - RNA, 19 nt, Homo sapiens
gcaaucuucucuaccaguu

SEQ ID NO: 1196723 - RNA, 19 nt, Homo sapiens
ggaagacauucacgauugu

SEQ ID NO: 1196724 - RNA, 19 nt, Homo sapiens
ccaggaaacucaugacagu

SEQ ID NO: 1196725 - RNA, 19 nt, Homo sapiens
acagagagacggcaauuaa

SEQ ID NO: 1196726 - RNA, 19 nt, Homo sapiens
gaagaaccggguaucauau

SEQ ID NO: 1196727 - RNA, 19 nt, Homo sapiens
caaagcaacauuuaaagga

SEQ ID NO: 1196728 - RNA, 19 nt, Homo sapiens
gaggacagaggcuauauga

SEQ ID NO: 1196729 - RNA, 19 nt, Homo sapiens
ggaauucaaggaugucaaa

SEQ ID NO: 1196730 - RNA, 19 nt, Homo sapiens
aaucaacccuucuggcaaa

SEQ ID NO: 1196731 - RNA, 19 nt, Homo sapiens
agaacugccuuacuagauu

SEQ ID NO: 1196732 - RNA, 19 nt, Homo sapiens
gugaugagcauaaggaauu

SEQ ID NO: 1196733 - RNA, 19 nt, Homo sapiens
gaguaguuguuaaagguuu

SEQ ID NO: 1196734 - RNA, 19 nt, Homo sapiens
ccaaacagcgacaugcuaa

SEQ ID NO: 1196735 - RNA, 19 nt, Homo sapiens
gcaaugcaaagacaagauu

SEQ ID NO: 1196736 - RNA, 19 nt, Homo sapiens
ggaaaucuaccagcuuuau

SEQ ID NO: 1196737 - RNA, 19 nt, Homo sapiens
gcaccuucauggcaucuga

SEQ ID NO: 1196738 - RNA, 19 nt, Homo sapiens
gcuauagcaucuuucuaga

SEQ ID NO: 1196739 - RNA, 19 nt, Homo sapiens
aaucagcuauagcaucuuu

SEQ ID NO: 1196740 - RNA, 19 nt, Homo sapiens
aggaagacauucacgauug

SEQ ID NO: 1196741 - RNA, 19 nt, Homo sapiens
aaacucuucuaccgcuuua

SEQ ID NO: 1196742 - RNA, 19 nt, Homo sapiens
gaagccagaaugacacaaa

SEQ ID NO: 1196743 - RNA, 19 nt, Homo sapiens
ucggaaaucuaccagcuuu

SEQ ID NO: 1196744 - RNA, 19 nt, Homo sapiens
gaaauugugugccccuauu

SEQ ID NO: 1196745 - RNA, 19 nt, Homo sapiens
gucaauagaguaguuguua

SEQ ID NO: 1196746 - RNA, 19 nt, Homo sapiens
ucaaggaugucaaacucuu

SEQ ID NO: 1196747 - RNA, 19 nt, Homo sapiens
aaagauagacgucaucauc

SEQ ID NO: 1196748 - RNA, 19 nt, Homo sapiens
gucaucaucucaagaccua

SEQ ID NO: 1196749 - RNA, 19 nt, Homo sapiens
acaaagcaaugcaaagaca

SEQ ID NO: 1196750 - RNA, 19 nt, Homo sapiens
ggacgauugucauggaagu

SEQ ID NO: 1196751 - RNA, 19 nt, Homo sapiens
uagaguaguuguuaaaggu

SEQ ID NO: 1196752 - RNA, 19 nt, Homo sapiens
cagagucaauagaguaguu

SEQ ID NO: 1196753 - RNA, 19 nt, Homo sapiens
uaucuuaguuugcagaaag

SEQ ID NO: 1196754 - RNA, 19 nt, Homo sapiens
gaaagaggcagagcagcuu

SEQ ID NO: 1196755 - RNA, 19 nt, Homo sapiens
ggaagucauggaggaguua

SEQ ID NO: 1196756 - RNA, 19 nt, Homo sapiens
ucaauguccugcauguaga

SEQ ID NO: 1196757 - RNA, 19 nt, Homo sapiens
gcaccuucccauuggauaa

SEQ ID NO: 1196758 - RNA, 19 nt, Homo sapiens
cugauugacuggcugauug

SEQ ID NO: 1196759 - RNA, 19 nt, Homo sapiens
ggaaugaaggucugucagu

SEQ ID NO: 1196760 - RNA, 19 nt, Homo sapiens
gaaaucuaccagcuuuaug

SEQ ID NO: 1196761 - RNA, 19 nt, Homo sapiens
ggaagcagagccaugacaa

SEQ ID NO: 1196762 - RNA, 19 nt, Homo sapiens
gacagaggcuauaugaaaa

SEQ ID NO: 1196763 - RNA, 19 nt, Homo sapiens
gagggaagccagaaugaca

SEQ ID NO: 1196764 - RNA, 19 nt, Homo sapiens
gaaggucugucaguuuguc

SEQ ID NO: 1196765 - RNA, 19 nt, Homo sapiens
gguuucaauuguggcauua

SEQ ID NO: 1196766 - RNA, 19 nt, Homo sapiens
uaagaccuguucacuagca

SEQ ID NO: 1196767 - RNA, 19 nt, Homo sapiens
aaccggguaucauaucuuu

SEQ ID NO: 1196768 - RNA, 19 nt, Homo sapiens
acacaaagcaaugcaaaga

SEQ ID NO: 1196769 - RNA, 19 nt, Homo sapiens
ugacggcaccuucccauug

SEQ ID NO: 1196770 - RNA, 19 nt, Homo sapiens
cuucuuaauuccugccuuu

SEQ ID NO: 1196771 - RNA, 19 nt, Homo sapiens
ggaauaagaccuguucacu

SEQ ID NO: 1196772 - RNA, 19 nt, Homo sapiens
gaaguaagccaugccacau

SEQ ID NO: 1196773 - RNA, 19 nt, Homo sapiens
ccaaguccgugcugaagag

SEQ ID NO: 1196774 - RNA, 19 nt, Homo sapiens
uagcucucauucauuguuu

SEQ ID NO: 1196775 - RNA, 19 nt, Homo sapiens
caaggaagacauucacgau

SEQ ID NO: 1196776 - RNA, 19 nt, Homo sapiens
auaaggaauucaaggaugu

SEQ ID NO: 1196777 - RNA, 19 nt, Homo sapiens
cagagagacggcaauuaaa

SEQ ID NO: 1196778 - RNA, 19 nt, Homo sapiens
gacagagagacggcaauua

SEQ ID NO: 1196779 - RNA, 19 nt, Homo sapiens
gaccuguucacuagcauuu

SEQ ID NO: 1196780 - RNA, 19 nt, Homo sapiens
gugaggagaagcagcauga

SEQ ID NO: 1196781 - RNA, 19 nt, Homo sapiens
gaagcagagccaugacaau

SEQ ID NO: 1196782 - RNA, 19 nt, Homo sapiens
gcauaaggaauucaaggau

SEQ ID NO: 1196783 - RNA, 19 nt, Homo sapiens
guguugaaaugcuucucua

SEQ ID NO: 1196784 - RNA, 19 nt, Homo sapiens
cgagucuucuccgcacaua

SEQ ID NO: 1196785 - RNA, 19 nt, Homo sapiens
ugacacaaagcaaugcaaa

SEQ ID NO: 1196786 - RNA, 19 nt, Homo sapiens
cagcuuugccaccggcuua

SEQ ID NO: 1196787 - RNA, 19 nt, Homo sapiens
gaaccggguaucauaucuu

SEQ ID NO: 1196788 - RNA, 19 nt, Homo sapiens
augaaggucugucaguuug

SEQ ID NO: 1196789 - RNA, 19 nt, Homo sapiens
caaacucuucuaccgcuuu

SEQ ID NO: 1196790 - RNA, 19 nt, Homo sapiens
gauagaacugccuuacuag

SEQ ID NO: 1196791 - RNA, 19 nt, Homo sapiens
gacggcaccuucccauugg

SEQ ID NO: 1196792 - RNA, 19 nt, Homo sapiens
uuguagcucucauucauug

SEQ ID NO: 1196793 - RNA, 19 nt, Homo sapiens
acagcaaucuucucuacca

SEQ ID NO: 1196794 - RNA, 19 nt, Homo sapiens
gaugagcccugaaaacaca

SEQ ID NO: 1196795 - RNA, 19 nt, Homo sapiens
gauagacgucaucaucuca

SEQ ID NO: 1196796 - RNA, 19 nt, Homo sapiens
cuucagagucaauagagua

SEQ ID NO: 1196797 - RNA, 19 nt, Homo sapiens
guagaaaacauuugggaaa

SEQ ID NO: 1196798 - RNA, 19 nt, Homo sapiens
cagaaugacacaaagcaau

SEQ ID NO: 1196799 - RNA, 19 nt, Homo sapiens
aaugaaggucugucaguuu

SEQ ID NO: 1196800 - RNA, 19 nt, Homo sapiens
gggcauuauucaccaugug

SEQ ID NO: 1196801 - RNA, 19 nt, Homo sapiens
ccagcaagcacccauuugu

SEQ ID NO: 1196802 - RNA, 19 nt, Homo sapiens
gauuucaccaagauucaaa

SEQ ID NO: 1196803 - RNA, 19 nt, Homo sapiens
caagaccuacccaaacugu

SEQ ID NO: 1196804 - RNA, 19 nt, Homo sapiens
gaagacauucacgauuguu

SEQ ID NO: 1196805 - RNA, 19 nt, Homo sapiens
aaucuucucuaccaguuca

SEQ ID NO: 1196806 - RNA, 19 nt, Homo sapiens
aaaggaauaagaccuguuc

SEQ ID NO: 1196807 - RNA, 19 nt, Homo sapiens
ugacagagagacggcaauu

SEQ ID NO: 1196808 - RNA, 19 nt, Homo sapiens
gcuaagaguuucuguaaua

SEQ ID NO: 1196809 - RNA, 19 nt, Homo sapiens
cgaauaaacuuaccagaua

SEQ ID NO: 1196810 - RNA, 19 nt, Homo sapiens
guaaacaucuucccuauga

SEQ ID NO: 1196811 - RNA, 19 nt, Homo sapiens
gagaacauauugccgauuu

SEQ ID NO: 1196812 - RNA, 19 nt, Homo sapiens
gaacacgugucaagagaaa

SEQ ID NO: 1196813 - RNA, 19 nt, Homo sapiens
caucauccaucaagaaaua

SEQ ID NO: 1196814 - RNA, 19 nt, Homo sapiens
gaaaccagacuuaagaaua

SEQ ID NO: 1196815 - RNA, 19 nt, Homo sapiens
gaagaaaccagacuuaaga

SEQ ID NO: 1196816 - RNA, 19 nt, Homo sapiens
gauaucaccuccgcauuua

SEQ ID NO: 1196817 - RNA, 19 nt, Homo sapiens
gaacuaugcuauaccagaa

SEQ ID NO: 1196818 - RNA, 19 nt, Homo sapiens
cgauagaucuggugacuuu

SEQ ID NO: 1196819 - RNA, 19 nt, Homo sapiens
ugacucaacucaccuuaua

SEQ ID NO: 1196820 - RNA, 19 nt, Homo sapiens
gcuaugaucuugagaacaa

SEQ ID NO: 1196821 - RNA, 19 nt, Homo sapiens
ugagagaugugguugguua

SEQ ID NO: 1196822 - RNA, 19 nt, Homo sapiens
ccagauauguuccuaagaa

SEQ ID NO: 1196823 - RNA, 19 nt, Homo sapiens
gaaauugguuugcuuugug

SEQ ID NO: 1196824 - RNA, 19 nt, Homo sapiens
auacagcgcuggcucuuua

SEQ ID NO: 1196825 - RNA, 19 nt, Homo sapiens
agagacaccuggagaauuu

SEQ ID NO: 1196826 - RNA, 19 nt, Homo sapiens
gauaugaccuucucucagu

SEQ ID NO: 1196827 - RNA, 19 nt, Homo sapiens
ggaaaagccugcagaauga

SEQ ID NO: 1196828 - RNA, 19 nt, Homo sapiens
gcuaggaggugaaucagaa

SEQ ID NO: 1196829 - RNA, 19 nt, Homo sapiens
ugaagaccuuuaucaguua

SEQ ID NO: 1196830 - RNA, 19 nt, Homo sapiens
gaaauaucagcaccuaaua

SEQ ID NO: 1196831 - RNA, 19 nt, Homo sapiens
ggaggacuauuauccauau

SEQ ID NO: 1196832 - RNA, 19 nt, Homo sapiens
agaaugaccuuuaugucua

SEQ ID NO: 1196833 - RNA, 19 nt, Homo sapiens
gaacaaucccuucuucuuc

SEQ ID NO: 1196834 - RNA, 19 nt, Homo sapiens
ggaauacaguacauaacaa

SEQ ID NO: 1196835 - RNA, 19 nt, Homo sapiens
caagaaauaucagcaccua

SEQ ID NO: 1196836 - RNA, 19 nt, Homo sapiens
gagcaacaguccaaagaug

SEQ ID NO: 1196837 - RNA, 19 nt, Homo sapiens
gaggcugugugacaucuua

SEQ ID NO: 1196838 - RNA, 19 nt, Homo sapiens
gauauuccuuccuaccuaa

SEQ ID NO: 1196839 - RNA, 19 nt, Homo sapiens
gaagaccuuuaucaguuaa

SEQ ID NO: 1196840 - RNA, 19 nt, Homo sapiens
ccaucgaucuucugcauuu

SEQ ID NO: 1196841 - RNA, 19 nt, Homo sapiens
uaucacaccugaagcugua

SEQ ID NO: 1196842 - RNA, 19 nt, Homo sapiens
gaagauuugugauccuaau

SEQ ID NO: 1196843 - RNA, 19 nt, Homo sapiens
gaaugaccuuuaugucuau

SEQ ID NO: 1196844 - RNA, 19 nt, Homo sapiens
ggaaauugguuugcuuugu

SEQ ID NO: 1196845 - RNA, 19 nt, Homo sapiens
gaaaugauccuggaauaca

SEQ ID NO: 1196846 - RNA, 19 nt, Homo sapiens
aagaaaugauccuggaaua

SEQ ID NO: 1196847 - RNA, 19 nt, Homo sapiens
acaaaugggugcuaaagga

SEQ ID NO: 1196848 - RNA, 19 nt, Homo sapiens
gagcugacgaauaaacuua

SEQ ID NO: 1196849 - RNA, 19 nt, Homo sapiens
aguuugagcugacgaauaa

SEQ ID NO: 1196850 - RNA, 19 nt, Homo sapiens
caaggaacauuuuagcuua

SEQ ID NO: 1196851 - RNA, 19 nt, Homo sapiens
uaauacagcaguaggauuu

SEQ ID NO: 1196852 - RNA, 19 nt, Homo sapiens
caggacagguucaaaauua

SEQ ID NO: 1196853 - RNA, 19 nt, Homo sapiens
caagagaaaccuaagaaug

SEQ ID NO: 1196854 - RNA, 19 nt, Homo sapiens
uagcagauauggccuugaa

SEQ ID NO: 1196855 - RNA, 19 nt, Homo sapiens
cagcuccucugcauaguuu

SEQ ID NO: 1196856 - RNA, 19 nt, Homo sapiens
uugcuuggcuguuauauug

SEQ ID NO: 1196857 - RNA, 19 nt, Homo sapiens
gcuuaagaauugcuauuug

SEQ ID NO: 1196858 - RNA, 19 nt, Homo sapiens
caccauugcugauauugaa

SEQ ID NO: 1196859 - RNA, 19 nt, Homo sapiens
uaaaggagaguagcagaua

SEQ ID NO: 1196860 - RNA, 19 nt, Homo sapiens
aagagaaaccuaagaauga

SEQ ID NO: 1196861 - RNA, 19 nt, Homo sapiens
gaaagaaaugggcacaaga

SEQ ID NO: 1196862 - RNA, 19 nt, Homo sapiens
aaacaucuucccuaugaua

SEQ ID NO: 1196863 - RNA, 19 nt, Homo sapiens
cuaaaggaaucacgucaga

SEQ ID NO: 1196864 - RNA, 19 nt, Homo sapiens
gauauguuccuaagaagaa

SEQ ID NO: 1196865 - RNA, 19 nt, Homo sapiens
ccauaagacucgacuaaag

SEQ ID NO: 1196866 - RNA, 19 nt, Homo sapiens
ugacaaaggccaugaaagu

SEQ ID NO: 1196867 - RNA, 19 nt, Homo sapiens
gcagauauggccuugaaga

SEQ ID NO: 1196868 - RNA, 19 nt, Homo sapiens
caaaggccaugaaagucaa

SEQ ID NO: 1196869 - RNA, 19 nt, Homo sapiens
gauaacugaucaccugcaa

SEQ ID NO: 1196870 - RNA, 19 nt, Homo sapiens
ccaccaacagcaaggauua

SEQ ID NO: 1196871 - RNA, 19 nt, Homo sapiens
uaacugaucaccugcaaau

SEQ ID NO: 1196872 - RNA, 19 nt, Homo sapiens
augaagaccuuuaucaguu

SEQ ID NO: 1196873 - RNA, 19 nt, Homo sapiens
ucaagaggacaucaugaua

SEQ ID NO: 1196874 - RNA, 19 nt, Homo sapiens
gauaagccagcaucuaguu

SEQ ID NO: 1196875 - RNA, 19 nt, Homo sapiens
gaacauauugccgauuuca

SEQ ID NO: 1196876 - RNA, 19 nt, Homo sapiens
cgacuaaagaagauacuaa

SEQ ID NO: 1196877 - RNA, 19 nt, Homo sapiens
gacucuaacuuucagcauu

SEQ ID NO: 1196878 - RNA, 19 nt, Homo sapiens
guaguagugcugacucuaa

SEQ ID NO: 1196879 - RNA, 19 nt, Homo sapiens
ggaggugaaucagaacaga

SEQ ID NO: 1196880 - RNA, 19 nt, Homo sapiens
gcacagccagucaaugaga

SEQ ID NO: 1196881 - RNA, 19 nt, Homo sapiens
gcauucacuucauaauugu

SEQ ID NO: 1196882 - RNA, 19 nt, Homo sapiens
aguaucugcucuuaguuua

SEQ ID NO: 1196883 - RNA, 19 nt, Homo sapiens
ccagauccaugaagaccuu

SEQ ID NO: 1196884 - RNA, 19 nt, Homo sapiens
gccuuaaccucgcauauag

SEQ ID NO: 1196885 - RNA, 19 nt, Homo sapiens
acgaguuagugcuguauua

SEQ ID NO: 1196886 - RNA, 19 nt, Homo sapiens
cauaagacucgacuaaaga

SEQ ID NO: 1196887 - RNA, 19 nt, Homo sapiens
guacaagggccaagaugga

SEQ ID NO: 1196888 - RNA, 19 nt, Homo sapiens
agcauucacuucauaauug

SEQ ID NO: 1196889 - RNA, 19 nt, Homo sapiens
gaccaccauugcugauauu

SEQ ID NO: 1196890 - RNA, 19 nt, Homo sapiens
ccaaacauuucucagucaa

SEQ ID NO: 1196891 - RNA, 19 nt, Homo sapiens
cuugaagacuggagaaaga

SEQ ID NO: 1196892 - RNA, 19 nt, Homo sapiens
ugauauuccuuccuaccua

SEQ ID NO: 1196893 - RNA, 19 nt, Homo sapiens
gaggacaucaugauaggaa

SEQ ID NO: 1196894 - RNA, 19 nt, Homo sapiens
uguagccacuuucacuaua

SEQ ID NO: 1196895 - RNA, 19 nt, Homo sapiens
ugauaucaccuccgcauuu

SEQ ID NO: 1196896 - RNA, 19 nt, Homo sapiens
caucuggauugcaguuuga

SEQ ID NO: 1196897 - RNA, 19 nt, Homo sapiens
ggccuuaaccucgcauaua

SEQ ID NO: 1196898 - RNA, 19 nt, Homo sapiens
uacaucugcucccaucaua

SEQ ID NO: 1196899 - RNA, 19 nt, Homo sapiens
caagaggacaucaugauag

SEQ ID NO: 1196900 - RNA, 19 nt, Homo sapiens
cacguaagauuccaacugu

SEQ ID NO: 1196901 - RNA, 19 nt, Homo sapiens
ccacuauugucugcuauug

SEQ ID NO: 1196902 - RNA, 19 nt, Homo sapiens
ggcauuggcuaugaucuug

SEQ ID NO: 1196903 - RNA, 19 nt, Homo sapiens
gagaugugguugguuacuu

SEQ ID NO: 1196904 - RNA, 19 nt, Homo sapiens
cgucaaaucugggaaccuu

SEQ ID NO: 1196905 - RNA, 19 nt, Homo sapiens
gcacguaagauuccaacug

SEQ ID NO: 1196906 - RNA, 19 nt, Homo sapiens
uuucagcauucacuucaua

SEQ ID NO: 1196907 - RNA, 19 nt, Homo sapiens
ucgaucuucugcauuuaua

SEQ ID NO: 1196908 - RNA, 19 nt, Homo sapiens
gaauguggauguucucuua

SEQ ID NO: 1196909 - RNA, 19 nt, Homo sapiens
gaagagagcaugccaauca

SEQ ID NO: 1196910 - RNA, 19 nt, Homo sapiens
gcagaacugugaucccaua

SEQ ID NO: 1196911 - RNA, 19 nt, Homo sapiens
gcacauuacuuaccaggaa

SEQ ID NO: 1196912 - RNA, 19 nt, Homo sapiens
gcucaucaguaucuuguua

SEQ ID NO: 1196913 - RNA, 19 nt, Homo sapiens
gacaaguucuuaaggauuu

SEQ ID NO: 1196914 - RNA, 19 nt, Homo sapiens
gaaaagggcacauuacuua

SEQ ID NO: 1196915 - RNA, 19 nt, Homo sapiens
uaaagaggauacaggauuu

SEQ ID NO: 1196916 - RNA, 19 nt, Homo sapiens
ggagucagccggcaugaua

SEQ ID NO: 1196917 - RNA, 19 nt, Homo sapiens
ggauuucuguuacaaacua

SEQ ID NO: 1196918 - RNA, 19 nt, Homo sapiens
gaaauucaaccuggacaua

SEQ ID NO: 1196919 - RNA, 19 nt, Homo sapiens
gaacugugaucccauagag

SEQ ID NO: 1196920 - RNA, 19 nt, Homo sapiens
gucagcagcucauuauaaa

SEQ ID NO: 1196921 - RNA, 19 nt, Homo sapiens
ggaacgagaugccagucaa

SEQ ID NO: 1196922 - RNA, 19 nt, Homo sapiens
gaagauccaggaaguaguu

SEQ ID NO: 1196923 - RNA, 19 nt, Homo sapiens
cccaggaguuugagaauuu

SEQ ID NO: 1196924 - RNA, 19 nt, Homo sapiens
cagcaaagcauucaccaaa

SEQ ID NO: 1196925 - RNA, 19 nt, Homo sapiens
gcaaaggaaagcucacuga

SEQ ID NO: 1196926 - RNA, 19 nt, Homo sapiens
caccagaucugcccucuca

SEQ ID NO: 1196927 - RNA, 19 nt, Homo sapiens
gagcugacccaucugcuaa

SEQ ID NO: 1196928 - RNA, 19 nt, Homo sapiens
gcgcggagacgccaucuuu

SEQ ID NO: 1196929 - RNA, 19 nt, Homo sapiens
ggacaaguucuuaaggauu

SEQ ID NO: 1196930 - RNA, 19 nt, Homo sapiens
ggacgaacaguuugacaga

SEQ ID NO: 1196931 - RNA, 19 nt, Homo sapiens
ggaaauuugcauacuguga

SEQ ID NO: 1196932 - RNA, 19 nt, Homo sapiens
aaacagauggucagacuug

SEQ ID NO: 1196933 - RNA, 19 nt, Homo sapiens
caucaacgccuccgauuuc

SEQ ID NO: 1196934 - RNA, 19 nt, Homo sapiens
ggacaaucaguaucauuau

SEQ ID NO: 1196935 - RNA, 19 nt, Homo sapiens
cggacaaucaguaucauua

SEQ ID NO: 1196936 - RNA, 19 nt, Homo sapiens
gagagcaugccaaucaauu

SEQ ID NO: 1196937 - RNA, 19 nt, Homo sapiens
agaacgcacuguacgguuu

SEQ ID NO: 1196938 - RNA, 19 nt, Homo sapiens
uaacggacaaucaguauca

SEQ ID NO: 1196939 - RNA, 19 nt, Homo sapiens
ugaggaagauccaggaagu

SEQ ID NO: 1196940 - RNA, 19 nt, Homo sapiens
ggaccgccaucaagauauc

SEQ ID NO: 1196941 - RNA, 19 nt, Homo sapiens
gcacuccacccuugcagaa

SEQ ID NO: 1196942 - RNA, 19 nt, Homo sapiens
gaguuuagggccauuugua

SEQ ID NO: 1196943 - RNA, 19 nt, Homo sapiens
gaacuuuagcuguuuccuu

SEQ ID NO: 1196944 - RNA, 19 nt, Homo sapiens
gaauucggacaaguucuua

SEQ ID NO: 1196945 - RNA, 19 nt, Homo sapiens
ugucagcagcucauuauaa

SEQ ID NO: 1196946 - RNA, 19 nt, Homo sapiens
aagcagugacuucccauua

SEQ ID NO: 1196947 - RNA, 19 nt, Homo sapiens
caagauaucagcaaagcau

SEQ ID NO: 1196948 - RNA, 19 nt, Homo sapiens
ugaggaaacuaagaauuca

SEQ ID NO: 1196949 - RNA, 19 nt, Homo sapiens
gcacacaagaugaaagaag

SEQ ID NO: 1196950 - RNA, 19 nt, Homo sapiens
ccaucaagauaucagcaaa

SEQ ID NO: 1196951 - RNA, 19 nt, Homo sapiens
cacagcagcuacaggaaga

SEQ ID NO: 1196952 - RNA, 19 nt, Homo sapiens
aaagagcaacgggaaauuu

SEQ ID NO: 1196953 - RNA, 19 nt, Homo sapiens
ggcgccagcuccugaaaga

SEQ ID NO: 1196954 - RNA, 19 nt, Homo sapiens
ggagcugacccaucugcua

SEQ ID NO: 1196955 - RNA, 19 nt, Homo sapiens
cuccagaacuuuagcuguu

SEQ ID NO: 1196956 - RNA, 19 nt, Homo sapiens
gauccagaaugcacacaag

SEQ ID NO: 1196957 - RNA, 19 nt, Homo sapiens
gcuguguccuccugcuaaa

SEQ ID NO: 1196958 - RNA, 19 nt, Homo sapiens
gaggauuauuucaacuuca

SEQ ID NO: 1196959 - RNA, 19 nt, Homo sapiens
ccagaucugcccucucauu

SEQ ID NO: 1196960 - RNA, 19 nt, Homo sapiens
auaaagaggauacaggauu

SEQ ID NO: 1196961 - RNA, 19 nt, Homo sapiens
ucaauuaccucgacuuccu

SEQ ID NO: 1196962 - RNA, 19 nt, Homo sapiens
gcagccagggauaagcuua

SEQ ID NO: 1196963 - RNA, 19 nt, Homo sapiens
gugcagaggauuauuucaa

SEQ ID NO: 1196964 - RNA, 19 nt, Homo sapiens
gauacgacaccgagggaaa

SEQ ID NO: 1196965 - RNA, 19 nt, Homo sapiens
cgggaaauuugcauacugu

SEQ ID NO: 1196966 - RNA, 19 nt, Homo sapiens
agaaggacguggccagaca

SEQ ID NO: 1196967 - RNA, 19 nt, Homo sapiens
gaaagaaugcaaggagaag

SEQ ID NO: 1196968 - RNA, 19 nt, Homo sapiens
gaacgagaugccagucaau

SEQ ID NO: 1196969 - RNA, 19 nt, Homo sapiens
caaaacugaucaauccaaa

SEQ ID NO: 1196970 - RNA, 19 nt, Homo sapiens
gcagaggauuauuucaacu

SEQ ID NO: 1196971 - RNA, 19 nt, Homo sapiens
gcuaagcgucgcagauuuc

SEQ ID NO: 1196972 - RNA, 19 nt, Homo sapiens
ucacugaugcacaggauga

SEQ ID NO: 1196973 - RNA, 19 nt, Homo sapiens
gagugucagcagcucauua

SEQ ID NO: 1196974 - RNA, 19 nt, Homo sapiens
caaccuggacauaagcaaa

SEQ ID NO: 1196975 - RNA, 19 nt, Homo sapiens
ugaaagaaugcaaggagaa

SEQ ID NO: 1196976 - RNA, 19 nt, Homo sapiens
gggcauuccuccaguagac

SEQ ID NO: 1196977 - RNA, 19 nt, Homo sapiens
aaaggaaagcucacugaug

SEQ ID NO: 1196978 - RNA, 19 nt, Homo sapiens
cagaaugcacacaagauga

SEQ ID NO: 1196979 - RNA, 19 nt, Homo sapiens
ccagaaugcacacaagaug

SEQ ID NO: 1196980 - RNA, 19 nt, Homo sapiens
gacagcagccacaccaaug

SEQ ID NO: 1196981 - RNA, 19 nt, Homo sapiens
gaggaagauccaggaagua

SEQ ID NO: 1196982 - RNA, 19 nt, Homo sapiens
gagcucagcccaaggaaaa

SEQ ID NO: 1196983 - RNA, 19 nt, Homo sapiens
gcucacugaugcacaggau

SEQ ID NO: 1196984 - RNA, 19 nt, Homo sapiens
ucggacaaguucuuaagga

SEQ ID NO: 1196985 - RNA, 19 nt, Homo sapiens
aaauucaaccuggacauaa

SEQ ID NO: 1196986 - RNA, 19 nt, Homo sapiens
gcugaugagugggcugaga

SEQ ID NO: 1196987 - RNA, 19 nt, Homo sapiens
acauaaagaacgcacugua

SEQ ID NO: 1196988 - RNA, 19 nt, Homo sapiens
gagaacagcaagucaacag

SEQ ID NO: 1196989 - RNA, 19 nt, Homo sapiens
caaaggaaagcucacugau

SEQ ID NO: 1196990 - RNA, 19 nt, Homo sapiens
ugcauacugugacuucauu

SEQ ID NO: 1196991 - RNA, 19 nt, Homo sapiens
uaaagagcaacgggaaauu

SEQ ID NO: 1196992 - RNA, 19 nt, Homo sapiens
gcacuguacgguuuugaua

SEQ ID NO: 1196993 - RNA, 19 nt, Homo sapiens
ccagaacuuuagcuguuuc

SEQ ID NO: 1196994 - RNA, 19 nt, Homo sapiens
cuacagaauucggacaagu

SEQ ID NO: 1196995 - RNA, 19 nt, Homo sapiens
ugacccaucugcuaaacag

SEQ ID NO: 1196996 - RNA, 19 nt, Homo sapiens
gcuggaagaauguggaugu

SEQ ID NO: 1196997 - RNA, 19 nt, Homo sapiens
augaagugcuggaagaaug

SEQ ID NO: 1196998 - RNA, 19 nt, Homo sapiens
gaaaagcuuugggcaagau

SEQ ID NO: 1196999 - RNA, 19 nt, Homo sapiens
gauaucagcaaagcauuca

SEQ ID NO: 1197000 - RNA, 19 nt, Homo sapiens
gcagcuacaggaagagaug

SEQ ID NO: 1197001 - RNA, 19 nt, Homo sapiens
agaaugcacacaagaugaa

SEQ ID NO: 1197002 - RNA, 19 nt, Homo sapiens
gacaucaacgccuccgauu

SEQ ID NO: 1197003 - RNA, 19 nt, Homo sapiens
ccucacaccaagagaguuu

SEQ ID NO: 1197004 - RNA, 19 nt, Homo sapiens
ugcaugaagugcuggaaga

SEQ ID NO: 1197005 - RNA, 19 nt, Homo sapiens
gcaaagcauucaccaaaac

SEQ ID NO: 1197006 - RNA, 19 nt, Homo sapiens
ucaacuucaugggucauuu

SEQ ID NO: 1197007 - RNA, 19 nt, Homo sapiens
agaggauuauuucaacuuc

SEQ ID NO: 1197008 - RNA, 19 nt, Homo sapiens
ccagaaaccuguagacaaa

SEQ ID NO: 1197009 - RNA, 19 nt, Homo sapiens
ggaaugggauuucuauaga

SEQ ID NO: 1197010 - RNA, 19 nt, Homo sapiens
gaucagauaugcuaaggaa

SEQ ID NO: 1197011 - RNA, 19 nt, Homo sapiens
gcucauaauucacacauaa

SEQ ID NO: 1197012 - RNA, 19 nt, Homo sapiens
gguaagcgcucauaauuca

SEQ ID NO: 1197013 - RNA, 19 nt, Homo sapiens
ccacugaguuauauacuuu

SEQ ID NO: 1197014 - RNA, 19 nt, Homo sapiens
ggugaagguuuauacguua

SEQ ID NO: 1197015 - RNA, 19 nt, Homo sapiens
gaacaugacuacacaucug

SEQ ID NO: 1197016 - RNA, 19 nt, Homo sapiens
gcucaggccuacagacaua

SEQ ID NO: 1197017 - RNA, 19 nt, Homo sapiens
gagacaagccauuuacaua

SEQ ID NO: 1197018 - RNA, 19 nt, Homo sapiens
ggaaugggauguuggaagu

SEQ ID NO: 1197019 - RNA, 19 nt, Homo sapiens
ggacugcaguugaguggaa

SEQ ID NO: 1197020 - RNA, 19 nt, Homo sapiens
aaaccaaccuccucauuuc

SEQ ID NO: 1197021 - RNA, 19 nt, Homo sapiens
ggaaaacucuugcugauuc

SEQ ID NO: 1197022 - RNA, 19 nt, Homo sapiens
gaacaaacugccuauuuua

SEQ ID NO: 1197023 - RNA, 19 nt, Homo sapiens
agaaaccuguagacaaaua

SEQ ID NO: 1197024 - RNA, 19 nt, Homo sapiens
gaaaaccacugaguuauau

SEQ ID NO: 1197025 - RNA, 19 nt, Homo sapiens
gguggcagcuucaagauuc

SEQ ID NO: 1197026 - RNA, 19 nt, Homo sapiens
ugcaacaggugaagguuua

SEQ ID NO: 1197027 - RNA, 19 nt, Homo sapiens
auacagauauucacaguca

SEQ ID NO: 1197028 - RNA, 19 nt, Homo sapiens
uaaaccaaccuccucauuu

SEQ ID NO: 1197029 - RNA, 19 nt, Homo sapiens
cagguaagcgcucauaauu

SEQ ID NO: 1197030 - RNA, 19 nt, Homo sapiens
gacaagccauuuacauaca

SEQ ID NO: 1197031 - RNA, 19 nt, Homo sapiens
uagaacaaacugccuauuu

SEQ ID NO: 1197032 - RNA, 19 nt, Homo sapiens
ccaagagacaagccauuua

SEQ ID NO: 1197033 - RNA, 19 nt, Homo sapiens
gugauuaugccaucuuuaa

SEQ ID NO: 1197034 - RNA, 19 nt, Homo sapiens
gcaaagauuggaaacacuu

SEQ ID NO: 1197035 - RNA, 19 nt, Homo sapiens
uauagaauguuugcgauug

SEQ ID NO: 1197036 - RNA, 19 nt, Homo sapiens
gaauguugcugcagagacu

SEQ ID NO: 1197037 - RNA, 19 nt, Homo sapiens
gagacugaaugacaugcaa

SEQ ID NO: 1197038 - RNA, 19 nt, Homo sapiens
caaaugcacccaagagaca

SEQ ID NO: 1197039 - RNA, 19 nt, Homo sapiens
caaacugccuauuuuauug

SEQ ID NO: 1197040 - RNA, 19 nt, Homo sapiens
gauugcugcuuuagaacaa

SEQ ID NO: 1197041 - RNA, 19 nt, Homo sapiens
ucagauaugcuaaggaaug

SEQ ID NO: 1197042 - RNA, 19 nt, Homo sapiens
caucuagguuucauuccuu

SEQ ID NO: 1197043 - RNA, 19 nt, Homo sapiens
agaacaaacugccuauuuu

SEQ ID NO: 1197044 - RNA, 19 nt, Homo sapiens
ccucaaacucauuaaagua

SEQ ID NO: 1197045 - RNA, 19 nt, Homo sapiens
uaaggaaugggauuucuau

SEQ ID NO: 1197046 - RNA, 19 nt, Homo sapiens
gcaaccaggaggccaaaga

SEQ ID NO: 1197047 - RNA, 19 nt, Homo sapiens
gauuccagcugucauuugg

SEQ ID NO: 1197048 - RNA, 19 nt, Homo sapiens
caacaggugaagguuuaua

SEQ ID NO: 1197049 - RNA, 19 nt, Homo sapiens
gaagugauuaugccaucuu

SEQ ID NO: 1197050 - RNA, 19 nt, Homo sapiens
ccaggaggccaaagaguug

SEQ ID NO: 1197051 - RNA, 19 nt, Homo sapiens
gagugacccuaaacaucaa

SEQ ID NO: 1197052 - RNA, 19 nt, Homo sapiens
cgaguaugauccuguuauc

SEQ ID NO: 1197053 - RNA, 19 nt, Homo sapiens
gaccagcuguaucugaaag

SEQ ID NO: 1197054 - RNA, 19 nt, Homo sapiens
uggaaagcaucauggucua

SEQ ID NO: 1197055 - RNA, 19 nt, Homo sapiens
cccuaaacaucaaccguaa

SEQ ID NO: 1197056 - RNA, 19 nt, Homo sapiens
agagugacccuaaacauca

SEQ ID NO: 1197057 - RNA, 19 nt, Homo sapiens
ugcgauugcugcuuuagaa

SEQ ID NO: 1197058 - RNA, 19 nt, Homo sapiens
gcaaagcucaggccuacag

SEQ ID NO: 1197059 - RNA, 19 nt, Homo sapiens
gccagaaaccuguagacaa

SEQ ID NO: 1197060 - RNA, 19 nt, Homo sapiens
aaauguuguuacuggcuua

SEQ ID NO: 1197061 - RNA, 19 nt, Homo sapiens
caagagacaagccauuuac

SEQ ID NO: 1197062 - RNA, 19 nt, Homo sapiens
caucauggucuacuucuuc

SEQ ID NO: 1197063 - RNA, 19 nt, Homo sapiens
gccucaaacucauuaaagu

SEQ ID NO: 1197064 - RNA, 19 nt, Homo sapiens
uaucgaguaugauccuguu

SEQ ID NO: 1197065 - RNA, 19 nt, Homo sapiens
gcuaaggaaugggauuucu

SEQ ID NO: 1197066 - RNA, 19 nt, Homo sapiens
gaaaccuguagacaaauau

SEQ ID NO: 1197067 - RNA, 19 nt, Homo sapiens
gugaagguuuauacguuau

SEQ ID NO: 1197068 - RNA, 19 nt, Homo sapiens
agaaagcaaugauaauagc

SEQ ID NO: 1197069 - RNA, 19 nt, Homo sapiens
gacuugaucagauaugcua

SEQ ID NO: 1197070 - RNA, 19 nt, Homo sapiens
gcagagacugaaugacaug

SEQ ID NO: 1197071 - RNA, 19 nt, Homo sapiens
gcaucauggucuacuucuu

SEQ ID NO: 1197072 - RNA, 19 nt, Homo sapiens
caguacaggugcaucgaau

SEQ ID NO: 1197073 - RNA, 19 nt, Homo sapiens
ucauuccuuugacauguuu

SEQ ID NO: 1197074 - RNA, 19 nt, Homo sapiens
ccagguaagcgcucauaau

SEQ ID NO: 1197075 - RNA, 19 nt, Homo sapiens
gaaguucuggacugcaguu

SEQ ID NO: 1197076 - RNA, 19 nt, Homo sapiens
ccacauggacacaaggaau

SEQ ID NO: 1197077 - RNA, 19 nt, Homo sapiens
caagccauuuacauacaga

SEQ ID NO: 1197078 - RNA, 19 nt, Homo sapiens
ugaaaaccacugaguuaua

SEQ ID NO: 1197079 - RNA, 19 nt, Homo sapiens
guucuggacugcaguugag

SEQ ID NO: 1197080 - RNA, 19 nt, Homo sapiens
gauauucacagucacacau

SEQ ID NO: 1197081 - RNA, 19 nt, Homo sapiens
gaagcaaagauuggaaaca

SEQ ID NO: 1197082 - RNA, 19 nt, Homo sapiens
aggugaagguuuauacguu

SEQ ID NO: 1197083 - RNA, 19 nt, Homo sapiens
ccacaaaugcacccaagag

SEQ ID NO: 1197084 - RNA, 19 nt, Homo sapiens
ccaaccuccucauuucugu

SEQ ID NO: 1197085 - RNA, 19 nt, Homo sapiens
aaugggauguuggaaguga

SEQ ID NO: 1197086 - RNA, 19 nt, Homo sapiens
uguuugcgauugcugcuuu

SEQ ID NO: 1197087 - RNA, 19 nt, Homo sapiens
ggugguggcagcuucaaga

SEQ ID NO: 1197088 - RNA, 19 nt, Homo sapiens
gccuacagacauauucuuu

SEQ ID NO: 1197089 - RNA, 19 nt, Homo sapiens
ccuuugacauguuuauauc

SEQ ID NO: 1197090 - RNA, 19 nt, Homo sapiens
acauacagauauucacagu

SEQ ID NO: 1197091 - RNA, 19 nt, Homo sapiens
cuacagacauauucuuuuc

SEQ ID NO: 1197092 - RNA, 19 nt, Homo sapiens
agacaagccauuuacauac

SEQ ID NO: 1197093 - RNA, 19 nt, Homo sapiens
cuuuaaaucucaggacuuc

SEQ ID NO: 1197094 - RNA, 19 nt, Homo sapiens
ggaacaugacuacacaucu

SEQ ID NO: 1197095 - RNA, 19 nt, Homo sapiens
cagauaugcuaaggaaugg

SEQ ID NO: 1197096 - RNA, 19 nt, Homo sapiens
uaaccacggugugcugaag

SEQ ID NO: 1197097 - RNA, 19 nt, Homo sapiens
ucacagucacacauagaaa

SEQ ID NO: 1197098 - RNA, 19 nt, Homo sapiens
ggaagugauuaugccaucu

SEQ ID NO: 1197099 - RNA, 19 nt, Homo sapiens
accguaagcucuccuucuu

SEQ ID NO: 1197100 - RNA, 19 nt, Homo sapiens
cuguaaauccugccagaaa

SEQ ID NO: 1197101 - RNA, 19 nt, Homo sapiens
aaugaaaaccacugaguua

SEQ ID NO: 1197102 - RNA, 19 nt, Homo sapiens
aagcaaagauuggaaacac

SEQ ID NO: 1197103 - RNA, 19 nt, Homo sapiens
cuaaggaaugggauuucua

SEQ ID NO: 1197104 - RNA, 19 nt, Homo sapiens
cugcagagacugaaugaca

SEQ ID NO: 1197105 - RNA, 19 nt, Homo sapiens
ggcaugaccagcuguaucu

SEQ ID NO: 1197106 - RNA, 19 nt, Homo sapiens
uagagugacccuaaacauc

SEQ ID NO: 1197107 - RNA, 19 nt, Homo sapiens
gccauuuacauacagauau

SEQ ID NO: 1197108 - RNA, 19 nt, Homo sapiens
gaacucaccuacucuagaa

SEQ ID NO: 1197109 - RNA, 19 nt, Homo sapiens
gaaacaaucugggaguuaa

SEQ ID NO: 1197110 - RNA, 19 nt, Homo sapiens
gaaaugaugcucagaaguu

SEQ ID NO: 1197111 - RNA, 19 nt, Homo sapiens
gaaguggacugaaacacaa

SEQ ID NO: 1197112 - RNA, 19 nt, Homo sapiens
gaaagaaguugugaucugu

SEQ ID NO: 1197113 - RNA, 19 nt, Homo sapiens
ggaaagaaguugugaucug

SEQ ID NO: 1197114 - RNA, 19 nt, Homo sapiens
caagggaggugucacaguu

SEQ ID NO: 1197115 - RNA, 19 nt, Homo sapiens
gagccaagauugcaccauu

SEQ ID NO: 1197116 - RNA, 19 nt, Homo sapiens
gcucagaaguuuaucuaug

SEQ ID NO: 1197117 - RNA, 19 nt, Homo sapiens
cgagaagacugaagugguu

SEQ ID NO: 1197118 - RNA, 19 nt, Homo sapiens
guugugaucuguugccuaa

SEQ ID NO: 1197119 - RNA, 19 nt, Homo sapiens
cuaaauggguggaaguuga

SEQ ID NO: 1197120 - RNA, 19 nt, Homo sapiens
ggaauucuacagcaugaua

SEQ ID NO: 1197121 - RNA, 19 nt, Homo sapiens
ccauuuagaucaacaacuu

SEQ ID NO: 1197122 - RNA, 19 nt, Homo sapiens
gagaaacacugcagaagcu

SEQ ID NO: 1197123 - RNA, 19 nt, Homo sapiens
acacaagauucuagucaaa

SEQ ID NO: 1197124 - RNA, 19 nt, Homo sapiens
cagcagaacucaccuacuc

SEQ ID NO: 1197125 - RNA, 19 nt, Homo sapiens
ggcaucaucucuccuguug

SEQ ID NO: 1197126 - RNA, 19 nt, Homo sapiens
agaaaucccuagagccaaa

SEQ ID NO: 1197127 - RNA, 19 nt, Homo sapiens
ggacugaaacacaagauuc

SEQ ID NO: 1197128 - RNA, 19 nt, Homo sapiens
cagaaggaguggaaagaga

SEQ ID NO: 1197129 - RNA, 19 nt, Homo sapiens
ggugaugccuacaagaaga

SEQ ID NO: 1197130 - RNA, 19 nt, Homo sapiens
uggcagaacuugcuaccaa

SEQ ID NO: 1197131 - RNA, 19 nt, Homo sapiens
gauggagucucuacuaaaa

SEQ ID NO: 1197132 - RNA, 19 nt, Homo sapiens
ggaaguggacugaaacaca

SEQ ID NO: 1197133 - RNA, 19 nt, Homo sapiens
aagaggaaguggacugaaa

SEQ ID NO: 1197134 - RNA, 19 nt, Homo sapiens
gccaaggacuacaugaaug

SEQ ID NO: 1197135 - RNA, 19 nt, Homo sapiens
gaaacacugcagaagcuaa

SEQ ID NO: 1197136 - RNA, 19 nt, Homo sapiens
ccagagcauucgcuacuug

SEQ ID NO: 1197137 - RNA, 19 nt, Homo sapiens
augaauggaucgcuaauga

SEQ ID NO: 1197138 - RNA, 19 nt, Homo sapiens
gcagaacucaccuacucua

SEQ ID NO: 1197139 - RNA, 19 nt, Homo sapiens
acaggaagguacacaguug

SEQ ID NO: 1197140 - RNA, 19 nt, Homo sapiens
ggaggcagagguugcagua

SEQ ID NO: 1197141 - RNA, 19 nt, Homo sapiens
gaucuguugccuaaacuaa

SEQ ID NO: 1197142 - RNA, 19 nt, Homo sapiens
gaauggaucgcuaaugaca

SEQ ID NO: 1197143 - RNA, 19 nt, Homo sapiens
cucagaaguuuaucuauga

SEQ ID NO: 1197144 - RNA, 19 nt, Homo sapiens
gaagacaucacccaaaucg

SEQ ID NO: 1197145 - RNA, 19 nt, Homo sapiens
gaacaggaagguacacagu

SEQ ID NO: 1197146 - RNA, 19 nt, Homo sapiens
gcauggugccgcauaacua

SEQ ID NO: 1197147 - RNA, 19 nt, Homo sapiens
gagcauucgcuacuuggua

SEQ ID NO: 1197148 - RNA, 19 nt, Homo sapiens
aaaugaugcucagaaguuu

SEQ ID NO: 1197149 - RNA, 19 nt, Homo sapiens
ugccuaaacuaaagcuuaa

SEQ ID NO: 1197150 - RNA, 19 nt, Homo sapiens
caagaagaaaggacucauu

SEQ ID NO: 1197151 - RNA, 19 nt, Homo sapiens
caucaucucuccuguuggu

SEQ ID NO: 1197152 - RNA, 19 nt, Homo sapiens
uaagacaccaucaagagaa

SEQ ID NO: 1197153 - RNA, 19 nt, Homo sapiens
gaaaccccaucucuacuaa

SEQ ID NO: 1197154 - RNA, 19 nt, Homo sapiens
cugcagaagcuaagacaua

SEQ ID NO: 1197155 - RNA, 19 nt, Homo sapiens
guccaagaauacauugaaa

SEQ ID NO: 1197156 - RNA, 19 nt, Homo sapiens
gguaccagaucuuguccaa

SEQ ID NO: 1197157 - RNA, 19 nt, Homo sapiens
ugaaacaaucugggaguua

SEQ ID NO: 1197158 - RNA, 19 nt, Homo sapiens
ggguggaaguugauacaug

SEQ ID NO: 1197159 - RNA, 19 nt, Homo sapiens
cacgugaggucaagaguuc

SEQ ID NO: 1197160 - RNA, 19 nt, Homo sapiens
aaucggaugugcuguggaa

SEQ ID NO: 1197161 - RNA, 19 nt, Homo sapiens
gcaggagaaucgcuugaac

SEQ ID NO: 1197162 - RNA, 19 nt, Homo sapiens
gcaggagaaucgcuugaac

SEQ ID NO: 1197163 - RNA, 19 nt, Homo sapiens
ggaagaggaaguggacuga

SEQ ID NO: 1197164 - RNA, 19 nt, Homo sapiens
uaccaagaauucuaaaugg

SEQ ID NO: 1197165 - RNA, 19 nt, Homo sapiens
aagccaagaucgugccauu

SEQ ID NO: 1197166 - RNA, 19 nt, Homo sapiens
aagaaguugugaucuguug

SEQ ID NO: 1197167 - RNA, 19 nt, Homo sapiens
uaggaauucuacagcauga

SEQ ID NO: 1197168 - RNA, 19 nt, Homo sapiens
caacaagggaggugucaca

SEQ ID NO: 1197169 - RNA, 19 nt, Homo sapiens
ccuuugcuguucccaauuu

SEQ ID NO: 1197170 - RNA, 19 nt, Homo sapiens
gcuaagacaccaucaagag

SEQ ID NO: 1197171 - RNA, 19 nt, Homo sapiens
gaagguacacaguugucaa

SEQ ID NO: 1197172 - RNA, 19 nt, Homo sapiens
gaucgcuaaugacaucuca

SEQ ID NO: 1197173 - RNA, 19 nt, Homo sapiens
uguuugagcuggccaagga

SEQ ID NO: 1197174 - RNA, 19 nt, Homo sapiens
gaaaggccuggaaggaaga

SEQ ID NO: 1197175 - RNA, 19 nt, Homo sapiens
gaaguugauacaugggaaa

SEQ ID NO: 1197176 - RNA, 19 nt, Homo sapiens
cuaccaagaauucuaaaug

SEQ ID NO: 1197177 - RNA, 19 nt, Homo sapiens
ugucacaguuuuccauuua

SEQ ID NO: 1197178 - RNA, 19 nt, Homo sapiens
gcuaagacauaggaauucu

SEQ ID NO: 1197179 - RNA, 19 nt, Homo sapiens
ccaaaucguggccaacuau

SEQ ID NO: 1197180 - RNA, 19 nt, Homo sapiens
gaagcuaagacauaggaau

SEQ ID NO: 1197181 - RNA, 19 nt, Homo sapiens
aaacacaagauucuaguca

SEQ ID NO: 1197182 - RNA, 19 nt, Homo sapiens
guggugggcuccuguaguc

SEQ ID NO: 1197183 - RNA, 19 nt, Homo sapiens
gcaugauauuucagacuuc

SEQ ID NO: 1197184 - RNA, 19 nt, Homo sapiens
aagcuaagacauaggaauu

SEQ ID NO: 1197185 - RNA, 19 nt, Homo sapiens
gaaacaccggagcaacauu

SEQ ID NO: 1197186 - RNA, 19 nt, Homo sapiens
ugaaugaauggaucgcuaa

SEQ ID NO: 1197187 - RNA, 19 nt, Homo sapiens
ggccaaggacuacaugaau

SEQ ID NO: 1197188 - RNA, 19 nt, Homo sapiens
gaagugguucuccuugcuu

SEQ ID NO: 1197189 - RNA, 19 nt, Homo sapiens
cauaggaauucuacagcau

SEQ ID NO: 1197190 - RNA, 19 nt, Homo sapiens
ggaaaugaugcucagaagu

SEQ ID NO: 1197191 - RNA, 19 nt, Homo sapiens
aagacaccaucaagagaaa

SEQ ID NO: 1197192 - RNA, 19 nt, Homo sapiens
ggaaacaccggagcaacau

SEQ ID NO: 1197193 - RNA, 19 nt, Homo sapiens
guggaagagugaagacauc

SEQ ID NO: 1197194 - RNA, 19 nt, Homo sapiens
uagaaaggccuggaaggaa

SEQ ID NO: 1197195 - RNA, 19 nt, Homo sapiens
gaauucuacagcaugauau

SEQ ID NO: 1197196 - RNA, 19 nt, Homo sapiens
guugauacaugggaaaguc

SEQ ID NO: 1197197 - RNA, 19 nt, Homo sapiens
uauuucagacuucccauuu

SEQ ID NO: 1197198 - RNA, 19 nt, Homo sapiens
gguacacaguugucaaagg

SEQ ID NO: 1197199 - RNA, 19 nt, Homo sapiens
aggcagagguugcaguaag

SEQ ID NO: 1197200 - RNA, 19 nt, Homo sapiens
gcagugagccaagauugca

SEQ ID NO: 1197201 - RNA, 19 nt, Homo sapiens
caaaagcugugccaaaggu

SEQ ID NO: 1197202 - RNA, 19 nt, Homo sapiens
gaagaggaaguggacugaa

SEQ ID NO: 1197203 - RNA, 19 nt, Homo sapiens
gacaccaucaagagaaauu

SEQ ID NO: 1197204 - RNA, 19 nt, Homo sapiens
ccuguaaucccagcacuuu

SEQ ID NO: 1197205 - RNA, 19 nt, Homo sapiens
ucaaucccaucaccaacau

SEQ ID NO: 1197206 - RNA, 19 nt, Homo sapiens
gcuugugguucauucaauc

SEQ ID NO: 1197207 - RNA, 19 nt, Homo sapiens
cccaaaucguggccaacua

SEQ ID NO: 1197208 - RNA, 19 nt, Homo sapiens
caagagcacucaagacuuu

SEQ ID NO: 1197209 - RNA, 19 nt, Homo sapiens
ugaagagacuccaauguaa

SEQ ID NO: 1197210 - RNA, 19 nt, Homo sapiens
gcucuacacuguccuguuu

SEQ ID NO: 1197211 - RNA, 19 nt, Homo sapiens
cuucagaaauuccuugaua

SEQ ID NO: 1197212 - RNA, 19 nt, Homo sapiens
ggucuagucuggcaugaaa

SEQ ID NO: 1197213 - RNA, 19 nt, Homo sapiens
gggcuaagauucucucugu

SEQ ID NO: 1197214 - RNA, 19 nt, Homo sapiens
caaguuaccuccgucauau

SEQ ID NO: 1197215 - RNA, 19 nt, Homo sapiens
acaagaaugugaagaaaug

SEQ ID NO: 1197216 - RNA, 19 nt, Homo sapiens
aaucuaaacuguagcugua

SEQ ID NO: 1197217 - RNA, 19 nt, Homo sapiens
gaagagacuccaauguaaa

SEQ ID NO: 1197218 - RNA, 19 nt, Homo sapiens
gcaacuaaacuaagacauu

SEQ ID NO: 1197219 - RNA, 19 nt, Homo sapiens
gaaauccucuaucacaaag

SEQ ID NO: 1197220 - RNA, 19 nt, Homo sapiens
ucauuuaccuuuccaguau

SEQ ID NO: 1197221 - RNA, 19 nt, Homo sapiens
ggaaauccucuaucacaaa

SEQ ID NO: 1197222 - RNA, 19 nt, Homo sapiens
aaagagguuuggcaacuaa

SEQ ID NO: 1197223 - RNA, 19 nt, Homo sapiens
uuacaucugucaagucauu

SEQ ID NO: 1197224 - RNA, 19 nt, Homo sapiens
aaucaacaguuaucaggua

SEQ ID NO: 1197225 - RNA, 19 nt, Homo sapiens
gcucuuuccuuaaaucaga

SEQ ID NO: 1197226 - RNA, 19 nt, Homo sapiens
gacaggagcugcagaacag

SEQ ID NO: 1197227 - RNA, 19 nt, Homo sapiens
gaucuucucaugauucuga

SEQ ID NO: 1197228 - RNA, 19 nt, Homo sapiens
gaagacaggagcugcagaa

SEQ ID NO: 1197229 - RNA, 19 nt, Homo sapiens
gcaaguccuucagaaauuc

SEQ ID NO: 1197230 - RNA, 19 nt, Homo sapiens
gagacaagaaugugaagaa

SEQ ID NO: 1197231 - RNA, 19 nt, Homo sapiens
ccuccagaaucaacaguua

SEQ ID NO: 1197232 - RNA, 19 nt, Homo sapiens
gcacucaagacuuuacuga

SEQ ID NO: 1197233 - RNA, 19 nt, Homo sapiens
uaaagcaaagcgcuaagua

SEQ ID NO: 1197234 - RNA, 19 nt, Homo sapiens
agacaagaaugugaagaaa

SEQ ID NO: 1197235 - RNA, 19 nt, Homo sapiens
gcuaagauucucucuguug

SEQ ID NO: 1197236 - RNA, 19 nt, Homo sapiens
caaauggccuggcgaugag

SEQ ID NO: 1197237 - RNA, 19 nt, Homo sapiens
aagcaaagcgcuaaguaaa

SEQ ID NO: 1197238 - RNA, 19 nt, Homo sapiens
caagucauuuucuggauua

SEQ ID NO: 1197239 - RNA, 19 nt, Homo sapiens
agacuccaauguaaacaaa

SEQ ID NO: 1197240 - RNA, 19 nt, Homo sapiens
ucaaguuaccuccgucaua

SEQ ID NO: 1197241 - RNA, 19 nt, Homo sapiens
gaacaggaccacugagaac

SEQ ID NO: 1197242 - RNA, 19 nt, Homo sapiens
ggaacaggaccacugagaa

SEQ ID NO: 1197243 - RNA, 19 nt, Homo sapiens
agucuggcaugaaauagua

SEQ ID NO: 1197244 - RNA, 19 nt, Homo sapiens
gcauucauguucuuacucu

SEQ ID NO: 1197245 - RNA, 19 nt, Homo sapiens
gaagaccaccaggccauuu

SEQ ID NO: 1197246 - RNA, 19 nt, Homo sapiens
gaacacagucauuucugau

SEQ ID NO: 1197247 - RNA, 19 nt, Homo sapiens
ugcaaguccuucagaaauu

SEQ ID NO: 1197248 - RNA, 19 nt, Homo sapiens
uggauccguucaucuauuu

SEQ ID NO: 1197249 - RNA, 19 nt, Homo sapiens
caggaccacugagaacuuu

SEQ ID NO: 1197250 - RNA, 19 nt, Homo sapiens
ucagguaaccaacaagaaa

SEQ ID NO: 1197251 - RNA, 19 nt, Homo sapiens
ugauaaguaugcugaagug

SEQ ID NO: 1197252 - RNA, 19 nt, Homo sapiens
aaagcaaagcgcuaaguaa

SEQ ID NO: 1197253 - RNA, 19 nt, Homo sapiens
cugcagaacagaacacuuu

SEQ ID NO: 1197254 - RNA, 19 nt, Homo sapiens
ggaugguggugacccaaau

SEQ ID NO: 1197255 - RNA, 19 nt, Homo sapiens
acaaauggccuggcgauga

SEQ ID NO: 1197256 - RNA, 19 nt, Homo sapiens
cuaaacuguagcuguauua

SEQ ID NO: 1197257 - RNA, 19 nt, Homo sapiens
caaaugaagagacuccaau

SEQ ID NO: 1197258 - RNA, 19 nt, Homo sapiens
cauuaucauugcuguauuc

SEQ ID NO: 1197259 - RNA, 19 nt, Homo sapiens
aauuacaucugucaaguca

SEQ ID NO: 1197260 - RNA, 19 nt, Homo sapiens
uaaaucagaguucggucua

SEQ ID NO: 1197261 - RNA, 19 nt, Homo sapiens
gaaaauacucuguucuaug

SEQ ID NO: 1197262 - RNA, 19 nt, Homo sapiens
uuucaaauccggaguaaau

SEQ ID NO: 1197263 - RNA, 19 nt, Homo sapiens
aauacucuguucuauguga

SEQ ID NO: 1197264 - RNA, 19 nt, Homo sapiens
guaccggucauacguaaga

SEQ ID NO: 1197265 - RNA, 19 nt, Homo sapiens
gauucucucuguugucauc

SEQ ID NO: 1197266 - RNA, 19 nt, Homo sapiens
cuaagauucucucuguugu

SEQ ID NO: 1197267 - RNA, 19 nt, Homo sapiens
cagaacucguuaaagcaaa

SEQ ID NO: 1197268 - RNA, 19 nt, Homo sapiens
uuucugaucuucucaugau

SEQ ID NO: 1197269 - RNA, 19 nt, Homo sapiens
augaagagacuccaaugua

SEQ ID NO: 1197270 - RNA, 19 nt, Homo sapiens
aaggugaacgucaaaguuu

SEQ ID NO: 1197271 - RNA, 19 nt, Homo sapiens
gacaagaaugugaagaaau

SEQ ID NO: 1197272 - RNA, 19 nt, Homo sapiens
caucugggcauucauguuc

SEQ ID NO: 1197273 - RNA, 19 nt, Homo sapiens
ucuaaacuguagcuguauu

SEQ ID NO: 1197274 - RNA, 19 nt, Homo sapiens
ccaaacccgggaugucuuu

SEQ ID NO: 1197275 - RNA, 19 nt, Homo sapiens
caauaacuacuacuuacug

SEQ ID NO: 1197276 - RNA, 19 nt, Homo sapiens
uaacuacuacuuacuggau

SEQ ID NO: 1197277 - RNA, 19 nt, Homo sapiens
ucaagacuuuacugacgaa

SEQ ID NO: 1197278 - RNA, 19 nt, Homo sapiens
gggaacaggaccacugaga

SEQ ID NO: 1197279 - RNA, 19 nt, Homo sapiens
uucaaacccuccagaauca

SEQ ID NO: 1197280 - RNA, 19 nt, Homo sapiens
gaacgucaaaguuuucauu

SEQ ID NO: 1197281 - RNA, 19 nt, Homo sapiens
aaaggugaacgucaaaguu

SEQ ID NO: 1197282 - RNA, 19 nt, Homo sapiens
gaacgagggguguagguaa

SEQ ID NO: 1197283 - RNA, 19 nt, Homo sapiens
cuuaagaacacagucauuu

SEQ ID NO: 1197284 - RNA, 19 nt, Homo sapiens
ugacugcacugcugaaaau

SEQ ID NO: 1197285 - RNA, 19 nt, Homo sapiens
cgagagacaagaaugugaa

SEQ ID NO: 1197286 - RNA, 19 nt, Homo sapiens
aagauucucucuguuguca

SEQ ID NO: 1197287 - RNA, 19 nt, Homo sapiens
caaauccggaguaaaucaa

SEQ ID NO: 1197288 - RNA, 19 nt, Homo sapiens
aacuguagcuguauuagca

SEQ ID NO: 1197289 - RNA, 19 nt, Homo sapiens
gcaauaacuacuacuuacu

SEQ ID NO: 1197290 - RNA, 19 nt, Homo sapiens
ucagaacucguuaaagcaa

SEQ ID NO: 1197291 - RNA, 19 nt, Homo sapiens
ucuagucuggcaugaaaua

SEQ ID NO: 1197292 - RNA, 19 nt, Homo sapiens
acacagucauuucugaucu

SEQ ID NO: 1197293 - RNA, 19 nt, Homo sapiens
cuuacuggauacauucaaa

SEQ ID NO: 1197294 - RNA, 19 nt, Homo sapiens
cuaacaugauucugaccaa

SEQ ID NO: 1197295 - RNA, 19 nt, Homo sapiens
gggcauucauguucuuacu

SEQ ID NO: 1197296 - RNA, 19 nt, Homo sapiens
ugcaauaacuacuacuuac

SEQ ID NO: 1197297 - RNA, 19 nt, Homo sapiens
uaaccaacaagaaaugcaa

SEQ ID NO: 1197298 - RNA, 19 nt, Homo sapiens
ucaaauccggaguaaauca

SEQ ID NO: 1197299 - RNA, 19 nt, Homo sapiens
gacgaaaacucaggaaauc

SEQ ID NO: 1197300 - RNA, 19 nt, Homo sapiens
gguaaaguccccaggaaaa

SEQ ID NO: 1197301 - RNA, 19 nt, Homo sapiens
gaacuguaccggucauacg

SEQ ID NO: 1197302 - RNA, 19 nt, Homo sapiens
ccaacaggcagccgagaga

SEQ ID NO: 1197303 - RNA, 19 nt, Homo sapiens
uuaccuccgucauauuuua

SEQ ID NO: 1197304 - RNA, 19 nt, Homo sapiens
gagacuccaauguaaacaa

SEQ ID NO: 1197305 - RNA, 19 nt, Homo sapiens
ucagaaauuccuugauaag

SEQ ID NO: 1197306 - RNA, 19 nt, Homo sapiens
cuggauccguucaucuauu

SEQ ID NO: 1197307 - RNA, 19 nt, Homo sapiens
acuacuuacuggauacauu

SEQ ID NO: 1197308 - RNA, 19 nt, Homo sapiens
ggaggaagcuguuauugaa

SEQ ID NO: 1197309 - RNA, 19 nt, Homo sapiens
gaggacaguucucucauua

SEQ ID NO: 1197310 - RNA, 19 nt, Homo sapiens
gauaugaguuggacagaga

SEQ ID NO: 1197311 - RNA, 19 nt, Homo sapiens
cacaggcacuuucuagaua

SEQ ID NO: 1197312 - RNA, 19 nt, Homo sapiens
gcuggaggcuggucccuuu

SEQ ID NO: 1197313 - RNA, 19 nt, Homo sapiens
gcuguaccguguuuccuua

SEQ ID NO: 1197314 - RNA, 19 nt, Homo sapiens
ucaaaguucugcccauuuc

SEQ ID NO: 1197315 - RNA, 19 nt, Homo sapiens
gcacaggcacuuucuagau

SEQ ID NO: 1197316 - RNA, 19 nt, Homo sapiens
ggacaguucucucauuagc

SEQ ID NO: 1197317 - RNA, 19 nt, Homo sapiens
gggaaagccugcacuucug

SEQ ID NO: 1197318 - RNA, 19 nt, Homo sapiens
ggaagcugguguccuguca

SEQ ID NO: 1197319 - RNA, 19 nt, Homo sapiens
gaaagagccccugguuuua

SEQ ID NO: 1197320 - RNA, 19 nt, Homo sapiens
ggaagcuguuauugaaugu

SEQ ID NO: 1197321 - RNA, 19 nt, Homo sapiens
ccacgaggccugucaguca

SEQ ID NO: 1197322 - RNA, 19 nt, Homo sapiens
ucagugagcaucuacuuug

SEQ ID NO: 1197323 - RNA, 19 nt, Homo sapiens
aggccaagcugccagguuu

SEQ ID NO: 1197324 - RNA, 19 nt, Homo sapiens
aaaacaggcuugcugaaaa

SEQ ID NO: 1197325 - RNA, 19 nt, Homo sapiens
guacaaccacuugccauga

SEQ ID NO: 1197326 - RNA, 19 nt, Homo sapiens
gagggagcgacccagauua

SEQ ID NO: 1197327 - RNA, 19 nt, Homo sapiens
acaggugguugcauucuug

SEQ ID NO: 1197328 - RNA, 19 nt, Homo sapiens
uacaaccacuugccaugaa

SEQ ID NO: 1197329 - RNA, 19 nt, Homo sapiens
ggagccagguguacaacca

SEQ ID NO: 1197330 - RNA, 19 nt, Homo sapiens
cagauuaggugaggacagu

SEQ ID NO: 1197331 - RNA, 19 nt, Homo sapiens
uuccuuagcuugugugugu

SEQ ID NO: 1197332 - RNA, 19 nt, Homo sapiens
aggaagcuguuauugaaug

SEQ ID NO: 1197333 - RNA, 19 nt, Homo sapiens
ggaugauucugaggaggaa

SEQ ID NO: 1197334 - RNA, 19 nt, Homo sapiens
aagcugguguccugucauu

SEQ ID NO: 1197335 - RNA, 19 nt, Homo sapiens
agaaagagccccugguuuu

SEQ ID NO: 1197336 - RNA, 19 nt, Homo sapiens
gaagaaagagccccugguu

SEQ ID NO: 1197337 - RNA, 19 nt, Homo sapiens
ccugagggcugugcugaga

SEQ ID NO: 1197338 - RNA, 19 nt, Homo sapiens
acaggcacuuucuagauau

SEQ ID NO: 1197339 - RNA, 19 nt, Homo sapiens
caaguggagugagaaacug

SEQ ID NO: 1197340 - RNA, 19 nt, Homo sapiens
ugagggagcgacccagauu

SEQ ID NO: 1197341 - RNA, 19 nt, Homo sapiens
gaggaggaagcuguuauug

SEQ ID NO: 1197342 - RNA, 19 nt, Homo sapiens
ggugcauucuaguguaguu

SEQ ID NO: 1197343 - RNA, 19 nt, Homo sapiens
ccaccacuccugucucuuc

SEQ ID NO: 1197344 - RNA, 19 nt, Homo sapiens
ggccaccacuccugucucu

SEQ ID NO: 1197345 - RNA, 19 nt, Homo sapiens
ugaggaggaagcuguuauu

SEQ ID NO: 1197346 - RNA, 19 nt, Homo sapiens
caggcacuuucuagauauu

SEQ ID NO: 1197347 - RNA, 19 nt, Homo sapiens
uuucaaaguucugcccauu

SEQ ID NO: 1197348 - RNA, 19 nt, Homo sapiens
gcgagaagggcacccacaa

SEQ ID NO: 1197349 - RNA, 19 nt, Homo sapiens
gaagcuguuauugaaugua

SEQ ID NO: 1197350 - RNA, 19 nt, Homo sapiens
gugcagugcccagcaugua

SEQ ID NO: 1197351 - RNA, 19 nt, Homo sapiens
ggagcgacccagauuaggu

SEQ ID NO: 1197352 - RNA, 19 nt, Homo sapiens
uuacuagucuuuugacaug

SEQ ID NO: 1197353 - RNA, 19 nt, Homo sapiens
cagcacaggcacuuucuag

SEQ ID NO: 1197354 - RNA, 19 nt, Homo sapiens
aaacaggcuugcugaaaau

SEQ ID NO: 1197355 - RNA, 19 nt, Homo sapiens
ugaguuggacagagacuug

SEQ ID NO: 1197356 - RNA, 19 nt, Homo sapiens
caaaacaggcuugcugaaa

SEQ ID NO: 1197357 - RNA, 19 nt, Homo sapiens
gaagauggaccccucaaca

SEQ ID NO: 1197358 - RNA, 19 nt, Homo sapiens
gaggaagcuguuauugaau

SEQ ID NO: 1197359 - RNA, 19 nt, Homo sapiens
ggcacuuucuagauauuuc

SEQ ID NO: 1197360 - RNA, 19 nt, Homo sapiens
acagacaggcucccacaug

SEQ ID NO: 1197361 - RNA, 19 nt, Homo sapiens
aggaggaagcuguuauuga

SEQ ID NO: 1197362 - RNA, 19 nt, Homo sapiens
caucuacuuugggugcauu

SEQ ID NO: 1197363 - RNA, 19 nt, Homo sapiens
ccaaguggagugagaaacu

SEQ ID NO: 1197364 - RNA, 19 nt, Homo sapiens
cgcaggcuguaccguguuu

SEQ ID NO: 1197365 - RNA, 19 nt, Homo sapiens
ccagguguacaaccacuug

SEQ ID NO: 1197366 - RNA, 19 nt, Homo sapiens
gauuaggugaggacaguuc

SEQ ID NO: 1197367 - RNA, 19 nt, Homo sapiens
gcacuucugcacauuuuga

SEQ ID NO: 1197368 - RNA, 19 nt, Homo sapiens
gcuguuauugaauguauag

SEQ ID NO: 1197369 - RNA, 19 nt, Homo sapiens
cuacuuugggugcauucua

SEQ ID NO: 1197370 - RNA, 19 nt, Homo sapiens
gagauaugaguuggacaga

SEQ ID NO: 1197371 - RNA, 19 nt, Homo sapiens
uacaggugguugcauucuu

SEQ ID NO: 1197372 - RNA, 19 nt, Homo sapiens
uacuuugggugcauucuag

SEQ ID NO: 1197373 - RNA, 19 nt, Homo sapiens
uccuacaggugguugcauu

SEQ ID NO: 1197374 - RNA, 19 nt, Homo sapiens
ggaggaagcuguuauugaa

SEQ ID NO: 1197375 - RNA, 19 nt, Homo sapiens
gauaugaguuggacagaga

SEQ ID NO: 1197376 - RNA, 19 nt, Homo sapiens
cacaggcacuuucuagaua

SEQ ID NO: 1197377 - RNA, 19 nt, Homo sapiens
gcuggaggcuggucccuuu

SEQ ID NO: 1197378 - RNA, 19 nt, Homo sapiens
gcuguaccguguuuccuua

SEQ ID NO: 1197379 - RNA, 19 nt, Homo sapiens
ucaaaguucugcccauuuc

SEQ ID NO: 1197380 - RNA, 19 nt, Homo sapiens
gcacaggcacuuucuagau

SEQ ID NO: 1197381 - RNA, 19 nt, Homo sapiens
gggaaagccugcacuucug

SEQ ID NO: 1197382 - RNA, 19 nt, Homo sapiens
ccaggugguugcauucuug

SEQ ID NO: 1197383 - RNA, 19 nt, Homo sapiens
ggaagcugguguccuguca

SEQ ID NO: 1197384 - RNA, 19 nt, Homo sapiens
gaaagagccccugguuuua

SEQ ID NO: 1197385 - RNA, 19 nt, Homo sapiens
ggaagcuguuauugaaugu

SEQ ID NO: 1197386 - RNA, 19 nt, Homo sapiens
ccacgaggccugucaguca

SEQ ID NO: 1197387 - RNA, 19 nt, Homo sapiens
ucagugagcaucuacuuug

SEQ ID NO: 1197388 - RNA, 19 nt, Homo sapiens
aaaacaggcuugcugaaaa

SEQ ID NO: 1197389 - RNA, 19 nt, Homo sapiens
guacaaccacuugccauga

SEQ ID NO: 1197390 - RNA, 19 nt, Homo sapiens
uacaaccacuugccaugaa

SEQ ID NO: 1197391 - RNA, 19 nt, Homo sapiens
ggagccagguguacaacca

SEQ ID NO: 1197392 - RNA, 19 nt, Homo sapiens
uuccuuagcuugugugugu

SEQ ID NO: 1197393 - RNA, 19 nt, Homo sapiens
aggaagcuguuauugaaug

SEQ ID NO: 1197394 - RNA, 19 nt, Homo sapiens
ggaugauucugaggaggaa

SEQ ID NO: 1197395 - RNA, 19 nt, Homo sapiens
aagcugguguccugucauu

SEQ ID NO: 1197396 - RNA, 19 nt, Homo sapiens
agaaagagccccugguuuu

SEQ ID NO: 1197397 - RNA, 19 nt, Homo sapiens
gaagaaagagccccugguu

SEQ ID NO: 1197398 - RNA, 19 nt, Homo sapiens
acaggcacuuucuagauau

SEQ ID NO: 1197399 - RNA, 19 nt, Homo sapiens
gaggaggaagcuguuauug

SEQ ID NO: 1197400 - RNA, 19 nt, Homo sapiens
ggugcauucuaguguaguu

SEQ ID NO: 1197401 - RNA, 19 nt, Homo sapiens
ccaccacuccugucucuuc

SEQ ID NO: 1197402 - RNA, 19 nt, Homo sapiens
ggccaccacuccugucucu

SEQ ID NO: 1197403 - RNA, 19 nt, Homo sapiens
ugaggaggaagcuguuauu

SEQ ID NO: 1197404 - RNA, 19 nt, Homo sapiens
caggcacuuucuagauauu

SEQ ID NO: 1197405 - RNA, 19 nt, Homo sapiens
uuucaaaguucugcccauu

SEQ ID NO: 1197406 - RNA, 19 nt, Homo sapiens
gcgagaagggcacccacaa

SEQ ID NO: 1197407 - RNA, 19 nt, Homo sapiens
gaagcuguuauugaaugua

SEQ ID NO: 1197408 - RNA, 19 nt, Homo sapiens
gugcagugcccagcaugua

SEQ ID NO: 1197409 - RNA, 19 nt, Homo sapiens
uuacuagucuuuugacaug

SEQ ID NO: 1197410 - RNA, 19 nt, Homo sapiens
caaaacaggcuugcugaaa

SEQ ID NO: 1197411 - RNA, 19 nt, Homo sapiens
cagcacaggcacuuucuag

SEQ ID NO: 1197412 - RNA, 19 nt, Homo sapiens
aaacaggcuugcugaaaau

SEQ ID NO: 1197413 - RNA, 19 nt, Homo sapiens
ugaguuggacagagacuug

SEQ ID NO: 1197414 - RNA, 19 nt, Homo sapiens
gaagauggaccccucaaca

SEQ ID NO: 1197415 - RNA, 19 nt, Homo sapiens
gaggaagcuguuauugaau

SEQ ID NO: 1197416 - RNA, 19 nt, Homo sapiens
ggcacuuucuagauauuuc

SEQ ID NO: 1197417 - RNA, 19 nt, Homo sapiens
acagacaggcucccacaug

SEQ ID NO: 1197418 - RNA, 19 nt, Homo sapiens
aggaggaagcuguuauuga

SEQ ID NO: 1197419 - RNA, 19 nt, Homo sapiens
caucuacuuugggugcauu

SEQ ID NO: 1197420 - RNA, 19 nt, Homo sapiens
cgcaggcuguaccguguuu

SEQ ID NO: 1197421 - RNA, 19 nt, Homo sapiens
ccagguguacaaccacuug

SEQ ID NO: 1197422 - RNA, 19 nt, Homo sapiens
gcacuucugcacauuuuga

SEQ ID NO: 1197423 - RNA, 19 nt, Homo sapiens
gcuguuauugaauguauag

SEQ ID NO: 1197424 - RNA, 19 nt, Homo sapiens
cuacuuugggugcauucua

SEQ ID NO: 1197425 - RNA, 19 nt, Homo sapiens
gagauaugaguuggacaga

SEQ ID NO: 1197426 - RNA, 19 nt, Homo sapiens
uacuuugggugcauucuag

SEQ ID NO: 1197427 - RNA, 19 nt, Homo sapiens
gaaaguagguucaguaaga

SEQ ID NO: 1197428 - RNA, 19 nt, Homo sapiens
ggaugaaucuacagaauua

SEQ ID NO: 1197429 - RNA, 19 nt, Homo sapiens
gaaagucgccucaaagaua

SEQ ID NO: 1197430 - RNA, 19 nt, Homo sapiens
gaaagaaagucgccucaaa

SEQ ID NO: 1197431 - RNA, 19 nt, Homo sapiens
ggacagagccugagaaguu

SEQ ID NO: 1197432 - RNA, 19 nt, Homo sapiens
gaaugaaacgcucagauua

SEQ ID NO: 1197433 - RNA, 19 nt, Homo sapiens
aaacaaagcucuauaugca

SEQ ID NO: 1197434 - RNA, 19 nt, Homo sapiens
caaagcaggugacaaauca

SEQ ID NO: 1197435 - RNA, 19 nt, Homo sapiens
gaaacaaagucccauaaag

SEQ ID NO: 1197436 - RNA, 19 nt, Homo sapiens
cagcauagaucuuuacaga

SEQ ID NO: 1197437 - RNA, 19 nt, Homo sapiens
gcacacagcugaaagaaaa

SEQ ID NO: 1197438 - RNA, 19 nt, Homo sapiens
gagcuuaauuaaccuagua

SEQ ID NO: 1197439 - RNA, 19 nt, Homo sapiens
gaaaugaagaugagcuuaa

SEQ ID NO: 1197440 - RNA, 19 nt, Homo sapiens
caaaagauguuacccauuu

SEQ ID NO: 1197441 - RNA, 19 nt, Homo sapiens
gaacuuggauucucucaac

SEQ ID NO: 1197442 - RNA, 19 nt, Homo sapiens
ggagauauguuggugagaa

SEQ ID NO: 1197443 - RNA, 19 nt, Homo sapiens
guagauuucuuucaacaga

SEQ ID NO: 1197444 - RNA, 19 nt, Homo sapiens
gaugaagaauggaagagaa

SEQ ID NO: 1197445 - RNA, 19 nt, Homo sapiens
acaagcaccucuuuacaaa

SEQ ID NO: 1197446 - RNA, 19 nt, Homo sapiens
gacagagaauguaaugaaa

SEQ ID NO: 1197447 - RNA, 19 nt, Homo sapiens
gaacaaggacagcauagau

SEQ ID NO: 1197448 - RNA, 19 nt, Homo sapiens
gaagaacaaggacagcaua

SEQ ID NO: 1197449 - RNA, 19 nt, Homo sapiens
cuacaaagcaggugacaaa

SEQ ID NO: 1197450 - RNA, 19 nt, Homo sapiens
gaagagaauacgaacauug

SEQ ID NO: 1197451 - RNA, 19 nt, Homo sapiens
gagcugugaucagagaaua

SEQ ID NO: 1197452 - RNA, 19 nt, Homo sapiens
aaagucgccucaaagauaa

SEQ ID NO: 1197453 - RNA, 19 nt, Homo sapiens
ccaaauaaguacagucauc

SEQ ID NO: 1197454 - RNA, 19 nt, Homo sapiens
ugaaaucaauggaguguuc

SEQ ID NO: 1197455 - RNA, 19 nt, Homo sapiens
ucacaaaccagaugccuuu

SEQ ID NO: 1197456 - RNA, 19 nt, Homo sapiens
gaugucuuccugcauauua

SEQ ID NO: 1197457 - RNA, 19 nt, Homo sapiens
gagaaacaaagcucuauau

SEQ ID NO: 1197458 - RNA, 19 nt, Homo sapiens
ggaagagaauacgaacauu

SEQ ID NO: 1197459 - RNA, 19 nt, Homo sapiens
guacuccucuauauuuaug

SEQ ID NO: 1197460 - RNA, 19 nt, Homo sapiens
acagucaucuucucuaguu

SEQ ID NO: 1197461 - RNA, 19 nt, Homo sapiens
ccagaacacuagacacuuc

SEQ ID NO: 1197462 - RNA, 19 nt, Homo sapiens
ccuaaggacuuccacuuug

SEQ ID NO: 1197463 - RNA, 19 nt, Homo sapiens
ugacagagaauguaaugaa

SEQ ID NO: 1197464 - RNA, 19 nt, Homo sapiens
ucugaugucuuccugcaua

SEQ ID NO: 1197465 - RNA, 19 nt, Homo sapiens
guacagucaucuucucuag

SEQ ID NO: 1197466 - RNA, 19 nt, Homo sapiens
gcacuuaagagaugggauu

SEQ ID NO: 1197467 - RNA, 19 nt, Homo sapiens
gaaacaaagcucuauaugc

SEQ ID NO: 1197468 - RNA, 19 nt, Homo sapiens
ggaucucauuccaaacuuu

SEQ ID NO: 1197469 - RNA, 19 nt, Homo sapiens
ucuaugcucuucaccauga

SEQ ID NO: 1197470 - RNA, 19 nt, Homo sapiens
gaguagauuucuuucaaca

SEQ ID NO: 1197471 - RNA, 19 nt, Homo sapiens
cuucaaaccuuguaaagag

SEQ ID NO: 1197472 - RNA, 19 nt, Homo sapiens
ugaaugaaacgcucagauu

SEQ ID NO: 1197473 - RNA, 19 nt, Homo sapiens
ucgaguagauuucuuucaa

SEQ ID NO: 1197474 - RNA, 19 nt, Homo sapiens
gacaaaucaaugccaaaua

SEQ ID NO: 1197475 - RNA, 19 nt, Homo sapiens
gaagaugagcuuaauuaac

SEQ ID NO: 1197476 - RNA, 19 nt, Homo sapiens
ccacugaaauuagacaauc

SEQ ID NO: 1197477 - RNA, 19 nt, Homo sapiens
uuagagcacugcagaacuu

SEQ ID NO: 1197478 - RNA, 19 nt, Homo sapiens
ggaggagauugacgcaguu

SEQ ID NO: 1197479 - RNA, 19 nt, Homo sapiens
gagaauacgaacauugcua

SEQ ID NO: 1197480 - RNA, 19 nt, Homo sapiens
gaacacuagacacuucaaa

SEQ ID NO: 1197481 - RNA, 19 nt, Homo sapiens
caccuacgaugcccuggua

SEQ ID NO: 1197482 - RNA, 19 nt, Homo sapiens
gagaacagcaaguccauca

SEQ ID NO: 1197483 - RNA, 19 nt, Homo sapiens
gaauggaagagaauacgaa

SEQ ID NO: 1197484 - RNA, 19 nt, Homo sapiens
cuaaauaucgguuuguuuc

SEQ ID NO: 1197485 - RNA, 19 nt, Homo sapiens
ggagugaacuuggauucuc

SEQ ID NO: 1197486 - RNA, 19 nt, Homo sapiens
gaagaugaagaauggaaga

SEQ ID NO: 1197487 - RNA, 19 nt, Homo sapiens
uauuacacguugcauacua

SEQ ID NO: 1197488 - RNA, 19 nt, Homo sapiens
ggacuuccacuuuguucaa

SEQ ID NO: 1197489 - RNA, 19 nt, Homo sapiens
gaacuucuccuucaaaccu

SEQ ID NO: 1197490 - RNA, 19 nt, Homo sapiens
gaaguucugcccugaaagu

SEQ ID NO: 1197491 - RNA, 19 nt, Homo sapiens
ccauaaagcucugucugau

SEQ ID NO: 1197492 - RNA, 19 nt, Homo sapiens
caacaagcaccucuuuaca

SEQ ID NO: 1197493 - RNA, 19 nt, Homo sapiens
acacuagacacuucaaauu

SEQ ID NO: 1197494 - RNA, 19 nt, Homo sapiens
gaugaucgacucccagaau

SEQ ID NO: 1197495 - RNA, 19 nt, Homo sapiens
aagaugagcuuaauuaacc

SEQ ID NO: 1197496 - RNA, 19 nt, Homo sapiens
gacaaucuaccaauucuuc

SEQ ID NO: 1197497 - RNA, 19 nt, Homo sapiens
caaaccagaugccuuuagg

SEQ ID NO: 1197498 - RNA, 19 nt, Homo sapiens
ggaaacauggguucuugug

SEQ ID NO: 1197499 - RNA, 19 nt, Homo sapiens
cuaguauacugggugaaua

SEQ ID NO: 1197500 - RNA, 19 nt, Homo sapiens
agaaagcuguaucccagaa

SEQ ID NO: 1197501 - RNA, 19 nt, Homo sapiens
cuaaggacuuccacuuugu

SEQ ID NO: 1197502 - RNA, 19 nt, Homo sapiens
aaaguagguucaguaagaa

SEQ ID NO: 1197503 - RNA, 19 nt, Homo sapiens
gacagagccugagaaguuc

SEQ ID NO: 1197504 - RNA, 19 nt, Homo sapiens
ggagauugacgcaguuuua

SEQ ID NO: 1197505 - RNA, 19 nt, Homo sapiens
auaaagcucugucugaucu

SEQ ID NO: 1197506 - RNA, 19 nt, Homo sapiens
guuacucugucuucacaaa

SEQ ID NO: 1197507 - RNA, 19 nt, Homo sapiens
acuguuaucugaugucuuc

SEQ ID NO: 1197508 - RNA, 19 nt, Homo sapiens
cuagacacuucaaauuguu

SEQ ID NO: 1197509 - RNA, 19 nt, Homo sapiens
ccagucaauuaucaucauu

SEQ ID NO: 1197510 - RNA, 19 nt, Homo sapiens
gcaucgaguagauuucuuu

SEQ ID NO: 1197511 - RNA, 19 nt, Homo sapiens
ccacaagaucccuuucuga

SEQ ID NO: 1197512 - RNA, 19 nt, Homo sapiens
gcacauuauuuggagugaa

SEQ ID NO: 1197513 - RNA, 19 nt, Homo sapiens
gaauguuacucugucuuca

SEQ ID NO: 1197514 - RNA, 19 nt, Homo sapiens
aaagaaacaaagucccaua

SEQ ID NO: 1197515 - RNA, 19 nt, Homo sapiens
ucccagaauuccaaagaaa

SEQ ID NO: 1197516 - RNA, 19 nt, Homo sapiens
cacaagaucccuuucugaa

SEQ ID NO: 1197517 - RNA, 19 nt, Homo sapiens
gaacagcaaguccaucaac

SEQ ID NO: 1197518 - RNA, 19 nt, Homo sapiens
augaaacgcucagauuauu

SEQ ID NO: 1197519 - RNA, 19 nt, Homo sapiens
ugucugaucuggagcuugu

SEQ ID NO: 1197520 - RNA, 19 nt, Homo sapiens
ugguacuccucuauauuua

SEQ ID NO: 1197521 - RNA, 19 nt, Homo sapiens
gagauauguuggugagaag

SEQ ID NO: 1197522 - RNA, 19 nt, Homo sapiens
aaagaaaacuggugaugga

SEQ ID NO: 1197523 - RNA, 19 nt, Homo sapiens
acuagacacuucaaauugu

SEQ ID NO: 1197524 - RNA, 19 nt, Homo sapiens
guucauucccaaaggguua

SEQ ID NO: 1197525 - RNA, 19 nt, Homo sapiens
ccaguuguuaguagaguua

SEQ ID NO: 1197526 - RNA, 19 nt, Homo sapiens
ucucaacaauccacaagau

SEQ ID NO: 1197527 - RNA, 19 nt, Homo sapiens
ggaugaaucuacagaauua

SEQ ID NO: 1197528 - RNA, 19 nt, Homo sapiens
gaaagucgccucaaagaua

SEQ ID NO: 1197529 - RNA, 19 nt, Homo sapiens
gaaagaaagucgccucaaa

SEQ ID NO: 1197530 - RNA, 19 nt, Homo sapiens
ggacagagccugagaaguu

SEQ ID NO: 1197531 - RNA, 19 nt, Homo sapiens
gaaugaaacgcucagauua

SEQ ID NO: 1197532 - RNA, 19 nt, Homo sapiens
aaacaaagcucuauaugca

SEQ ID NO: 1197533 - RNA, 19 nt, Homo sapiens
caaagcaggugacaaauca

SEQ ID NO: 1197534 - RNA, 19 nt, Homo sapiens
gaaacaaagucccauaaag

SEQ ID NO: 1197535 - RNA, 19 nt, Homo sapiens
cagcauagaucuuuacaga

SEQ ID NO: 1197536 - RNA, 19 nt, Homo sapiens
gcacacagcugaaagaaaa

SEQ ID NO: 1197537 - RNA, 19 nt, Homo sapiens
gagcuuaauuaaccuagua

SEQ ID NO: 1197538 - RNA, 19 nt, Homo sapiens
gaaaugaagaugagcuuaa

SEQ ID NO: 1197539 - RNA, 19 nt, Homo sapiens
caaaagauguuacccauuu

SEQ ID NO: 1197540 - RNA, 19 nt, Homo sapiens
gaacuuggauucucucaac

SEQ ID NO: 1197541 - RNA, 19 nt, Homo sapiens
ggagauauguuggugagaa

SEQ ID NO: 1197542 - RNA, 19 nt, Homo sapiens
guagauuucuuucaacaga

SEQ ID NO: 1197543 - RNA, 19 nt, Homo sapiens
gaugaagaauggaagagaa

SEQ ID NO: 1197544 - RNA, 19 nt, Homo sapiens
acaagcaccucuuuacaaa

SEQ ID NO: 1197545 - RNA, 19 nt, Homo sapiens
gacagagaauguaaugaaa

SEQ ID NO: 1197546 - RNA, 19 nt, Homo sapiens
gaacaaggacagcauagau

SEQ ID NO: 1197547 - RNA, 19 nt, Homo sapiens
gaagaacaaggacagcaua

SEQ ID NO: 1197548 - RNA, 19 nt, Homo sapiens
cuacaaagcaggugacaaa

SEQ ID NO: 1197549 - RNA, 19 nt, Homo sapiens
gaagagaauacgaacauug

SEQ ID NO: 1197550 - RNA, 19 nt, Homo sapiens
gagcugugaucagagaaua

SEQ ID NO: 1197551 - RNA, 19 nt, Homo sapiens
aaagucgccucaaagauaa

SEQ ID NO: 1197552 - RNA, 19 nt, Homo sapiens
ccaaauaaguacagucauc

SEQ ID NO: 1197553 - RNA, 19 nt, Homo sapiens
ugaaaucaauggaguguuc

SEQ ID NO: 1197554 - RNA, 19 nt, Homo sapiens
ucacaaaccagaugccuuu

SEQ ID NO: 1197555 - RNA, 19 nt, Homo sapiens
gaugucuuccugcauauua

SEQ ID NO: 1197556 - RNA, 19 nt, Homo sapiens
gagaaacaaagcucuauau

SEQ ID NO: 1197557 - RNA, 19 nt, Homo sapiens
ggaagagaauacgaacauu

SEQ ID NO: 1197558 - RNA, 19 nt, Homo sapiens
guacuccucuauauuuaug

SEQ ID NO: 1197559 - RNA, 19 nt, Homo sapiens
acagucaucuucucuaguu

SEQ ID NO: 1197560 - RNA, 19 nt, Homo sapiens
ccagaacacuagacacuuc

SEQ ID NO: 1197561 - RNA, 19 nt, Homo sapiens
ccuaaggacuuccacuuug

SEQ ID NO: 1197562 - RNA, 19 nt, Homo sapiens
gaaagguucaguaagaaga

SEQ ID NO: 1197563 - RNA, 19 nt, Homo sapiens
ugacagagaauguaaugaa

SEQ ID NO: 1197564 - RNA, 19 nt, Homo sapiens
ucugaugucuuccugcaua

SEQ ID NO: 1197565 - RNA, 19 nt, Homo sapiens
guacagucaucuucucuag

SEQ ID NO: 1197566 - RNA, 19 nt, Homo sapiens
gcacuuaagagaugggauu

SEQ ID NO: 1197567 - RNA, 19 nt, Homo sapiens
gaaacaaagcucuauaugc

SEQ ID NO: 1197568 - RNA, 19 nt, Homo sapiens
ucuaugcucuucaccauga

SEQ ID NO: 1197569 - RNA, 19 nt, Homo sapiens
gaguagauuucuuucaaca

SEQ ID NO: 1197570 - RNA, 19 nt, Homo sapiens
ggaucucauuccaaacuuu

SEQ ID NO: 1197571 - RNA, 19 nt, Homo sapiens
cuucaaaccuuguaaagag

SEQ ID NO: 1197572 - RNA, 19 nt, Homo sapiens
ugaaugaaacgcucagauu

SEQ ID NO: 1197573 - RNA, 19 nt, Homo sapiens
ucgaguagauuucuuucaa

SEQ ID NO: 1197574 - RNA, 19 nt, Homo sapiens
gacaaaucaaugccaaaua

SEQ ID NO: 1197575 - RNA, 19 nt, Homo sapiens
gaagaugagcuuaauuaac

SEQ ID NO: 1197576 - RNA, 19 nt, Homo sapiens
ccacugaaauuagacaauc

SEQ ID NO: 1197577 - RNA, 19 nt, Homo sapiens
uuagagcacugcagaacuu

SEQ ID NO: 1197578 - RNA, 19 nt, Homo sapiens
ggaggagauugacgcaguu

SEQ ID NO: 1197579 - RNA, 19 nt, Homo sapiens
gagaauacgaacauugcua

SEQ ID NO: 1197580 - RNA, 19 nt, Homo sapiens
gaacacuagacacuucaaa

SEQ ID NO: 1197581 - RNA, 19 nt, Homo sapiens
caccuacgaugcccuggua

SEQ ID NO: 1197582 - RNA, 19 nt, Homo sapiens
gagaacagcaaguccauca

SEQ ID NO: 1197583 - RNA, 19 nt, Homo sapiens
gaauggaagagaauacgaa

SEQ ID NO: 1197584 - RNA, 19 nt, Homo sapiens
cuaaauaucgguuuguuuc

SEQ ID NO: 1197585 - RNA, 19 nt, Homo sapiens
ggagugaacuuggauucuc

SEQ ID NO: 1197586 - RNA, 19 nt, Homo sapiens
gaagaugaagaauggaaga

SEQ ID NO: 1197587 - RNA, 19 nt, Homo sapiens
uauuacacguugcauacua

SEQ ID NO: 1197588 - RNA, 19 nt, Homo sapiens
ggacuuccacuuuguucaa

SEQ ID NO: 1197589 - RNA, 19 nt, Homo sapiens
gaacuucuccuucaaaccu

SEQ ID NO: 1197590 - RNA, 19 nt, Homo sapiens
ccauaaagcucugucugau

SEQ ID NO: 1197591 - RNA, 19 nt, Homo sapiens
caacaagcaccucuuuaca

SEQ ID NO: 1197592 - RNA, 19 nt, Homo sapiens
acacuagacacuucaaauu

SEQ ID NO: 1197593 - RNA, 19 nt, Homo sapiens
gaugaucgacucccagaau

SEQ ID NO: 1197594 - RNA, 19 nt, Homo sapiens
aagaugagcuuaauuaacc

SEQ ID NO: 1197595 - RNA, 19 nt, Homo sapiens
gacaaucuaccaauucuuc

SEQ ID NO: 1197596 - RNA, 19 nt, Homo sapiens
caaaccagaugccuuuagg

SEQ ID NO: 1197597 - RNA, 19 nt, Homo sapiens
cuaguauacugggugaaua

SEQ ID NO: 1197598 - RNA, 19 nt, Homo sapiens
agaaagcuguaucccagaa

SEQ ID NO: 1197599 - RNA, 19 nt, Homo sapiens
cuaaggacuuccacuuugu

SEQ ID NO: 1197600 - RNA, 19 nt, Homo sapiens
gacagagccugagaaguuc

SEQ ID NO: 1197601 - RNA, 19 nt, Homo sapiens
ggagauugacgcaguuuua

SEQ ID NO: 1197602 - RNA, 19 nt, Homo sapiens
auaaagcucugucugaucu

SEQ ID NO: 1197603 - RNA, 19 nt, Homo sapiens
ggaaacauggguucuugug

SEQ ID NO: 1197604 - RNA, 19 nt, Homo sapiens
guuacucugucuucacaaa

SEQ ID NO: 1197605 - RNA, 19 nt, Homo sapiens
acuguuaucugaugucuuc

SEQ ID NO: 1197606 - RNA, 19 nt, Homo sapiens
cuagacacuucaaauuguu

SEQ ID NO: 1197607 - RNA, 19 nt, Homo sapiens
ccagucaauuaucaucauu

SEQ ID NO: 1197608 - RNA, 19 nt, Homo sapiens
gcaucgaguagauuucuuu

SEQ ID NO: 1197609 - RNA, 19 nt, Homo sapiens
ccacaagaucccuuucuga

SEQ ID NO: 1197610 - RNA, 19 nt, Homo sapiens
gcacauuauuuggagugaa

SEQ ID NO: 1197611 - RNA, 19 nt, Homo sapiens
gaauguuacucugucuuca

SEQ ID NO: 1197612 - RNA, 19 nt, Homo sapiens
aaagaaacaaagucccaua

SEQ ID NO: 1197613 - RNA, 19 nt, Homo sapiens
ucccagaauuccaaagaaa

SEQ ID NO: 1197614 - RNA, 19 nt, Homo sapiens
cacaagaucccuuucugaa

SEQ ID NO: 1197615 - RNA, 19 nt, Homo sapiens
gaacagcaaguccaucaac

SEQ ID NO: 1197616 - RNA, 19 nt, Homo sapiens
augaaacgcucagauuauu

SEQ ID NO: 1197617 - RNA, 19 nt, Homo sapiens
ugucugaucuggagcuugu

SEQ ID NO: 1197618 - RNA, 19 nt, Homo sapiens
aaagaaaacuggugaugga

SEQ ID NO: 1197619 - RNA, 19 nt, Homo sapiens
ugguacuccucuauauuua

SEQ ID NO: 1197620 - RNA, 19 nt, Homo sapiens
gagauauguuggugagaag

SEQ ID NO: 1197621 - RNA, 19 nt, Homo sapiens
acuagacacuucaaauugu

SEQ ID NO: 1197622 - RNA, 19 nt, Homo sapiens
guucauucccaaaggguua

SEQ ID NO: 1197623 - RNA, 19 nt, Homo sapiens
ccaguuguuaguagaguua

SEQ ID NO: 1197624 - RNA, 19 nt, Homo sapiens
ucucaacaauccacaagau

SEQ ID NO: 1197625 - RNA, 19 nt, Homo sapiens
cauaaaacuugcugucauu

SEQ ID NO: 1197626 - RNA, 19 nt, Homo sapiens
gcagugaugguuccaaucu

SEQ ID NO: 1197627 - RNA, 19 nt, Homo sapiens
ggaugaaucuacagaauua

SEQ ID NO: 1197628 - RNA, 19 nt, Homo sapiens
gaaagucgccucaaagaua

SEQ ID NO: 1197629 - RNA, 19 nt, Homo sapiens
gaaagaaagucgccucaaa

SEQ ID NO: 1197630 - RNA, 19 nt, Homo sapiens
ggacagagccugagaaguu

SEQ ID NO: 1197631 - RNA, 19 nt, Homo sapiens
gaaugaaacgcucagauua

SEQ ID NO: 1197632 - RNA, 19 nt, Homo sapiens
aaacaaagcucuauaugca

SEQ ID NO: 1197633 - RNA, 19 nt, Homo sapiens
caaagcaggugacaaauca

SEQ ID NO: 1197634 - RNA, 19 nt, Homo sapiens
gaaacaaagucccauaaag

SEQ ID NO: 1197635 - RNA, 19 nt, Homo sapiens
gcacacagcugaaagaaaa

SEQ ID NO: 1197636 - RNA, 19 nt, Homo sapiens
gagcuuaauuaaccuagua

SEQ ID NO: 1197637 - RNA, 19 nt, Homo sapiens
gaaaugaagaugagcuuaa

SEQ ID NO: 1197638 - RNA, 19 nt, Homo sapiens
caaaagauguuacccauuu

SEQ ID NO: 1197639 - RNA, 19 nt, Homo sapiens
gaacuuggauucucucaac

SEQ ID NO: 1197640 - RNA, 19 nt, Homo sapiens
ggagauauguuggugagaa

SEQ ID NO: 1197641 - RNA, 19 nt, Homo sapiens
guagauuucuuucaacaga

SEQ ID NO: 1197642 - RNA, 19 nt, Homo sapiens
gaugaagaauggaagagaa

SEQ ID NO: 1197643 - RNA, 19 nt, Homo sapiens
acaagcaccucuuuacaaa

SEQ ID NO: 1197644 - RNA, 19 nt, Homo sapiens
gaaagaucccacugaaauu

SEQ ID NO: 1197645 - RNA, 19 nt, Homo sapiens
gacagagaauguaaugaaa

SEQ ID NO: 1197646 - RNA, 19 nt, Homo sapiens
cuacaaagcaggugacaaa

SEQ ID NO: 1197647 - RNA, 19 nt, Homo sapiens
gaagagaauacgaacauug

SEQ ID NO: 1197648 - RNA, 19 nt, Homo sapiens
gagcugugaucagagaaua

SEQ ID NO: 1197649 - RNA, 19 nt, Homo sapiens
aaagucgccucaaagauaa

SEQ ID NO: 1197650 - RNA, 19 nt, Homo sapiens
ccaaauaaguacagucauc

SEQ ID NO: 1197651 - RNA, 19 nt, Homo sapiens
ugaaaucaauggaguguuc

SEQ ID NO: 1197652 - RNA, 19 nt, Homo sapiens
ugaaagaucccacugaaau

SEQ ID NO: 1197653 - RNA, 19 nt, Homo sapiens
ucacaaaccagaugccuuu

SEQ ID NO: 1197654 - RNA, 19 nt, Homo sapiens
gaugucuuccugcauauua

SEQ ID NO: 1197655 - RNA, 19 nt, Homo sapiens
aaagaucccacugaaauua

SEQ ID NO: 1197656 - RNA, 19 nt, Homo sapiens
gaaguucugcccugaaaga

SEQ ID NO: 1197657 - RNA, 19 nt, Homo sapiens
gagaaacaaagcucuauau

SEQ ID NO: 1197658 - RNA, 19 nt, Homo sapiens
ggaagagaauacgaacauu

SEQ ID NO: 1197659 - RNA, 19 nt, Homo sapiens
guacuccucuauauuuaug

SEQ ID NO: 1197660 - RNA, 19 nt, Homo sapiens
acagucaucuucucuaguu

SEQ ID NO: 1197661 - RNA, 19 nt, Homo sapiens
ccagaacacuagacacuuc

SEQ ID NO: 1197662 - RNA, 19 nt, Homo sapiens
ccuaaggacuuccacuuug

SEQ ID NO: 1197663 - RNA, 19 nt, Homo sapiens
ugacagagaauguaaugaa

SEQ ID NO: 1197664 - RNA, 19 nt, Homo sapiens
ucugaugucuuccugcaua

SEQ ID NO: 1197665 - RNA, 19 nt, Homo sapiens
guacagucaucuucucuag

SEQ ID NO: 1197666 - RNA, 19 nt, Homo sapiens
gcacuuaagagaugggauu

SEQ ID NO: 1197667 - RNA, 19 nt, Homo sapiens
gaaacaaagcucuauaugc

SEQ ID NO: 1197668 - RNA, 19 nt, Homo sapiens
ucuaugcucuucaccauga

SEQ ID NO: 1197669 - RNA, 19 nt, Homo sapiens
ggaucucauuccaaacuuu

SEQ ID NO: 1197670 - RNA, 19 nt, Homo sapiens
gaguagauuucuuucaaca

SEQ ID NO: 1197671 - RNA, 19 nt, Homo sapiens
ugaaugaaacgcucagauu

SEQ ID NO: 1197672 - RNA, 19 nt, Homo sapiens
ucgaguagauuucuuucaa

SEQ ID NO: 1197673 - RNA, 19 nt, Homo sapiens
gacaaaucaaugccaaaua

SEQ ID NO: 1197674 - RNA, 19 nt, Homo sapiens
gaagaugagcuuaauuaac

SEQ ID NO: 1197675 - RNA, 19 nt, Homo sapiens
ccacugaaauuagacaauc

SEQ ID NO: 1197676 - RNA, 19 nt, Homo sapiens
ccugaaagaucccacugaa

SEQ ID NO: 1197677 - RNA, 19 nt, Homo sapiens
ggaggagauugacgcaguu

SEQ ID NO: 1197678 - RNA, 19 nt, Homo sapiens
gagaauacgaacauugcua

SEQ ID NO: 1197679 - RNA, 19 nt, Homo sapiens
gaacacuagacacuucaaa

SEQ ID NO: 1197680 - RNA, 19 nt, Homo sapiens
caccuacgaugcccuggua

SEQ ID NO: 1197681 - RNA, 19 nt, Homo sapiens
gagaacagcaaguccauca

SEQ ID NO: 1197682 - RNA, 19 nt, Homo sapiens
gaauggaagagaauacgaa

SEQ ID NO: 1197683 - RNA, 19 nt, Homo sapiens
cuaaauaucgguuuguuuc

SEQ ID NO: 1197684 - RNA, 19 nt, Homo sapiens
ggagugaacuuggauucuc

SEQ ID NO: 1197685 - RNA, 19 nt, Homo sapiens
gaagaugaagaauggaaga

SEQ ID NO: 1197686 - RNA, 19 nt, Homo sapiens
uauuacacguugcauacua

SEQ ID NO: 1197687 - RNA, 19 nt, Homo sapiens
ggacuuccacuuuguucaa

SEQ ID NO: 1197688 - RNA, 19 nt, Homo sapiens
ccauaaagcucugucugau

SEQ ID NO: 1197689 - RNA, 19 nt, Homo sapiens
caacaagcaccucuuuaca

SEQ ID NO: 1197690 - RNA, 19 nt, Homo sapiens
acacuagacacuucaaauu

SEQ ID NO: 1197691 - RNA, 19 nt, Homo sapiens
gaugaucgacucccagaau

SEQ ID NO: 1197692 - RNA, 19 nt, Homo sapiens
aagaugagcuuaauuaacc

SEQ ID NO: 1197693 - RNA, 19 nt, Homo sapiens
gacaaucuaccaauucuuc

SEQ ID NO: 1197694 - RNA, 19 nt, Homo sapiens
caaaccagaugccuuuagg

SEQ ID NO: 1197695 - RNA, 19 nt, Homo sapiens
cuaguauacugggugaaua

SEQ ID NO: 1197696 - RNA, 19 nt, Homo sapiens
agaaagcuguaucccagaa

SEQ ID NO: 1197697 - RNA, 19 nt, Homo sapiens
cuaaggacuuccacuuugu

SEQ ID NO: 1197698 - RNA, 19 nt, Homo sapiens
ggaaacauggguucuugug

SEQ ID NO: 1197699 - RNA, 19 nt, Homo sapiens
gacagagccugagaaguuc

SEQ ID NO: 1197700 - RNA, 19 nt, Homo sapiens
ggagauugacgcaguuuua

SEQ ID NO: 1197701 - RNA, 19 nt, Homo sapiens
auaaagcucugucugaucu

SEQ ID NO: 1197702 - RNA, 19 nt, Homo sapiens
guuacucugucuucacaaa

SEQ ID NO: 1197703 - RNA, 19 nt, Homo sapiens
acuguuaucugaugucuuc

SEQ ID NO: 1197704 - RNA, 19 nt, Homo sapiens
cuagacacuucaaauuguu

SEQ ID NO: 1197705 - RNA, 19 nt, Homo sapiens
ccagucaauuaucaucauu

SEQ ID NO: 1197706 - RNA, 19 nt, Homo sapiens
gcaucgaguagauuucuuu

SEQ ID NO: 1197707 - RNA, 19 nt, Homo sapiens
ccacaagaucccuuucuga

SEQ ID NO: 1197708 - RNA, 19 nt, Homo sapiens
gcacauuauuuggagugaa

SEQ ID NO: 1197709 - RNA, 19 nt, Homo sapiens
gaauguuacucugucuuca

SEQ ID NO: 1197710 - RNA, 19 nt, Homo sapiens
aaagaaacaaagucccaua

SEQ ID NO: 1197711 - RNA, 19 nt, Homo sapiens
ucccagaauuccaaagaaa

SEQ ID NO: 1197712 - RNA, 19 nt, Homo sapiens
cacaagaucccuuucugaa

SEQ ID NO: 1197713 - RNA, 19 nt, Homo sapiens
gaacagcaaguccaucaac

SEQ ID NO: 1197714 - RNA, 19 nt, Homo sapiens
augaaacgcucagauuauu

SEQ ID NO: 1197715 - RNA, 19 nt, Homo sapiens
ugguacuccucuauauuua

SEQ ID NO: 1197716 - RNA, 19 nt, Homo sapiens
ugucugaucuggagcuugu

SEQ ID NO: 1197717 - RNA, 19 nt, Homo sapiens
gagauauguuggugagaag

SEQ ID NO: 1197718 - RNA, 19 nt, Homo sapiens
aaagaaaacuggugaugga

SEQ ID NO: 1197719 - RNA, 19 nt, Homo sapiens
acuagacacuucaaauugu

SEQ ID NO: 1197720 - RNA, 19 nt, Homo sapiens
guucauucccaaaggguua

SEQ ID NO: 1197721 - RNA, 19 nt, Homo sapiens
ccaguuguuaguagaguua

SEQ ID NO: 1197722 - RNA, 19 nt, Homo sapiens
ucucaacaauccacaagau

SEQ ID NO: 1197723 - RNA, 19 nt, Homo sapiens
gcagugaugguuccaaucu

SEQ ID NO: 1197724 - RNA, 19 nt, Homo sapiens
gaagaauggaagagaauac

SEQ ID NO: 1197725 - RNA, 19 nt, Homo sapiens
gaguauuacacguugcaua

SEQ ID NO: 1197726 - RNA, 19 nt, Homo sapiens
aaacaaagucccauaaagc

SEQ ID NO: 1197727 - RNA, 19 nt, Homo sapiens
uaaaagggcuguacaguua

SEQ ID NO: 1197728 - RNA, 19 nt, Homo sapiens
uuacucaacuugugucuua

SEQ ID NO: 1197729 - RNA, 19 nt, Homo sapiens
cagaagaggucagcaauaa

SEQ ID NO: 1197730 - RNA, 19 nt, Homo sapiens
gaagaggucagcaauaaug

SEQ ID NO: 1197731 - RNA, 19 nt, Homo sapiens
gauaaacucuuccgugcau

SEQ ID NO: 1197732 - RNA, 19 nt, Homo sapiens
gcacaacccuaccuuuggu

SEQ ID NO: 1197733 - RNA, 19 nt, Homo sapiens
gcuuagcccuguccacaaa

SEQ ID NO: 1197734 - RNA, 19 nt, Homo sapiens
ccagggauguggccucauu

SEQ ID NO: 1197735 - RNA, 19 nt, Homo sapiens
ccauucagcugauccaguu

SEQ ID NO: 1197736 - RNA, 19 nt, Homo sapiens
caacagcccugaggcacuu

SEQ ID NO: 1197737 - RNA, 19 nt, Homo sapiens
guacuucguucucucacuu

SEQ ID NO: 1197738 - RNA, 19 nt, Homo sapiens
gaggcuguguguauacgua

SEQ ID NO: 1197739 - RNA, 19 nt, Homo sapiens
ccacggaggcuguguguau

SEQ ID NO: 1197740 - RNA, 19 nt, Homo sapiens
ggacacagugaucuuuauu

SEQ ID NO: 1197741 - RNA, 19 nt, Homo sapiens
gauggaggcuguugugaac

SEQ ID NO: 1197742 - RNA, 19 nt, Homo sapiens
ucagugcccucuccaccua

SEQ ID NO: 1197743 - RNA, 19 nt, Homo sapiens
gagaagcauggccuagaua

SEQ ID NO: 1197744 - RNA, 19 nt, Homo sapiens
ggucaaggccaacugagaa

SEQ ID NO: 1197745 - RNA, 19 nt, Homo sapiens
cuacaugucuuccaucacu

SEQ ID NO: 1197746 - RNA, 19 nt, Homo sapiens
ugagaagcauggccuagau

SEQ ID NO: 1197747 - RNA, 19 nt, Homo sapiens
gcugugacccuguggacua

SEQ ID NO: 1197748 - RNA, 19 nt, Homo sapiens
gcacucucccucuacauug

SEQ ID NO: 1197749 - RNA, 19 nt, Homo sapiens
aaagggcuguacaguuauu

SEQ ID NO: 1197750 - RNA, 19 nt, Homo sapiens
cuacagggaccacggcuuu

SEQ ID NO: 1197751 - RNA, 19 nt, Homo sapiens
gcacaucucccaguacuac

SEQ ID NO: 1197752 - RNA, 19 nt, Homo sapiens
ggauggaggcuguugugaa

SEQ ID NO: 1197753 - RNA, 19 nt, Homo sapiens
acacagugaucuuuauucu

SEQ ID NO: 1197754 - RNA, 19 nt, Homo sapiens
cacggaggcuguguguaua

SEQ ID NO: 1197755 - RNA, 19 nt, Homo sapiens
ccucaggacugcaccuuag

SEQ ID NO: 1197756 - RNA, 19 nt, Homo sapiens
cuccguggcuucaugauug

SEQ ID NO: 1197757 - RNA, 19 nt, Homo sapiens
ggaggcugcuuacucaacu

SEQ ID NO: 1197758 - RNA, 19 nt, Homo sapiens
uguggaggcugcuuacuca

SEQ ID NO: 1197759 - RNA, 19 nt, Homo sapiens
ccaguacccagucauuauu

SEQ ID NO: 1197760 - RNA, 19 nt, Homo sapiens
gagcugauggacacaguga

SEQ ID NO: 1197761 - RNA, 19 nt, Homo sapiens
gauggacacagugaucuuu

SEQ ID NO: 1197762 - RNA, 19 nt, Homo sapiens
gaggucagcaauaauguca

SEQ ID NO: 1197763 - RNA, 19 nt, Homo sapiens
acagaagaggucagcaaua

SEQ ID NO: 1197764 - RNA, 19 nt, Homo sapiens
caaguucauugagcugaug

SEQ ID NO: 1197765 - RNA, 19 nt, Homo sapiens
ggucagcaauaaugucacu

SEQ ID NO: 1197766 - RNA, 19 nt, Homo sapiens
gcacaugacagccauucag

SEQ ID NO: 1197767 - RNA, 19 nt, Homo sapiens
ggccucgcaucauggcuaa

SEQ ID NO: 1197768 - RNA, 19 nt, Homo sapiens
caaggucaaggccaacuga

SEQ ID NO: 1197769 - RNA, 19 nt, Homo sapiens
accaagaggugaugaagca

SEQ ID NO: 1197770 - RNA, 19 nt, Homo sapiens
guauacguaugugaacaga

SEQ ID NO: 1197771 - RNA, 19 nt, Homo sapiens
ccgugcaugucauaaugua

SEQ ID NO: 1197772 - RNA, 19 nt, Homo sapiens
ucacuugggccucgcauca

SEQ ID NO: 1197773 - RNA, 19 nt, Homo sapiens
ggaggcuguugugaacuug

SEQ ID NO: 1197774 - RNA, 19 nt, Homo sapiens
uacuuuauguccagcugua

SEQ ID NO: 1197775 - RNA, 19 nt, Homo sapiens
cgggaggaaugggcucuuu

SEQ ID NO: 1197776 - RNA, 19 nt, Homo sapiens
uggaggcuguugugaacuu

SEQ ID NO: 1197777 - RNA, 19 nt, Homo sapiens
uaccaguacccagucauua

SEQ ID NO: 1197778 - RNA, 19 nt, Homo sapiens
ccaaguucauugagcugau

SEQ ID NO: 1197779 - RNA, 19 nt, Homo sapiens
ucuaugaguuccugauguc

SEQ ID NO: 1197780 - RNA, 19 nt, Homo sapiens
caccugugaccaaggcuua

SEQ ID NO: 1197781 - RNA, 19 nt, Homo sapiens
cuucugguaucacucuuau

SEQ ID NO: 1197782 - RNA, 19 nt, Homo sapiens
ccagcuccguggcuucaug

SEQ ID NO: 1197783 - RNA, 19 nt, Homo sapiens
uggacacagugaucuuuau

SEQ ID NO: 1197784 - RNA, 19 nt, Homo sapiens
caacuucugguaucacucu

SEQ ID NO: 1197785 - RNA, 19 nt, Homo sapiens
ccuccauucuccugaccua

SEQ ID NO: 1197786 - RNA, 19 nt, Homo sapiens
uggcacaacccuaccuuug

SEQ ID NO: 1197787 - RNA, 19 nt, Homo sapiens
cuacggauuaucugccuuu

SEQ ID NO: 1197788 - RNA, 19 nt, Homo sapiens
cuacauugucuaugaguuc

SEQ ID NO: 1197789 - RNA, 19 nt, Homo sapiens
ggcacucucccucuacauu

SEQ ID NO: 1197790 - RNA, 19 nt, Homo sapiens
gcugcuuacucaacuugug

SEQ ID NO: 1197791 - RNA, 19 nt, Homo sapiens
acacagaagaggucagcaa

SEQ ID NO: 1197792 - RNA, 19 nt, Homo sapiens
uuauucaccucaucuggau

SEQ ID NO: 1197793 - RNA, 19 nt, Homo sapiens
cccucuacauugucuauga

SEQ ID NO: 1197794 - RNA, 19 nt, Homo sapiens
aggcuguugugaacuugua

SEQ ID NO: 1197795 - RNA, 19 nt, Homo sapiens
ugaccuacguguacuucgu

SEQ ID NO: 1197796 - RNA, 19 nt, Homo sapiens
gacacagugaucuuuauuc

SEQ ID NO: 1197797 - RNA, 19 nt, Homo sapiens
gugacccuguggacuauuc

SEQ ID NO: 1197798 - RNA, 19 nt, Homo sapiens
cucaacuugugucuuaauu

SEQ ID NO: 1197799 - RNA, 19 nt, Homo sapiens
gcuccguggcuucaugauu

SEQ ID NO: 1197800 - RNA, 19 nt, Homo sapiens
gaccuacguguacuucguu

SEQ ID NO: 1197801 - RNA, 19 nt, Homo sapiens
gaggcugcuuacucaacuu

SEQ ID NO: 1197802 - RNA, 19 nt, Homo sapiens
gcugauggacacagugauc

SEQ ID NO: 1197803 - RNA, 19 nt, Homo sapiens
cuaccaguacccagucauu

SEQ ID NO: 1197804 - RNA, 19 nt, Homo sapiens
gucuaugaguuccugaugu

SEQ ID NO: 1197805 - RNA, 19 nt, Homo sapiens
ccagcuguaacuaccagua

SEQ ID NO: 1197806 - RNA, 19 nt, Homo sapiens
aacccuaccuuugguggaa

SEQ ID NO: 1197807 - RNA, 19 nt, Homo sapiens
uggccuggcucuuccucuu

SEQ ID NO: 1197808 - RNA, 19 nt, Homo sapiens
gggaacacaacacgcuuag

SEQ ID NO: 1197809 - RNA, 19 nt, Homo sapiens
gcagugagaugcugguaaa

SEQ ID NO: 1197810 - RNA, 19 nt, Homo sapiens
cugaggagguggaauauua

SEQ ID NO: 1197811 - RNA, 19 nt, Homo sapiens
agauguugcuguagaaaua

SEQ ID NO: 1197812 - RNA, 19 nt, Homo sapiens
ggccguugcuucuguauau

SEQ ID NO: 1197813 - RNA, 19 nt, Homo sapiens
gugagaugcugguaaagaa

SEQ ID NO: 1197814 - RNA, 19 nt, Homo sapiens
aaagacgguuuaaaucuga

SEQ ID NO: 1197815 - RNA, 19 nt, Homo sapiens
ccagcuccaucccuuauuu

SEQ ID NO: 1197816 - RNA, 19 nt, Homo sapiens
ggagguggaauauuacuau

SEQ ID NO: 1197817 - RNA, 19 nt, Homo sapiens
ccaaagacacacuggauga

SEQ ID NO: 1197818 - RNA, 19 nt, Homo sapiens
ugguagaacugcugaaaga

SEQ ID NO: 1197819 - RNA, 19 nt, Homo sapiens
gggaggaaagcaaggauaa

SEQ ID NO: 1197820 - RNA, 19 nt, Homo sapiens
gaguuuggcucugucaaug

SEQ ID NO: 1197821 - RNA, 19 nt, Homo sapiens
guagaaauaaagacgguuu

SEQ ID NO: 1197822 - RNA, 19 nt, Homo sapiens
ugaggcggcugcucucuau

SEQ ID NO: 1197823 - RNA, 19 nt, Homo sapiens
cuccaucccuuauuuauuc

SEQ ID NO: 1197824 - RNA, 19 nt, Homo sapiens
gcacuggagaucuaugcua

SEQ ID NO: 1197825 - RNA, 19 nt, Homo sapiens
caaccuggcaguccuguau

SEQ ID NO: 1197826 - RNA, 19 nt, Homo sapiens
gcaagcaggcacucgaaga

SEQ ID NO: 1197827 - RNA, 19 nt, Homo sapiens
gcaugggccugcugcuugu

SEQ ID NO: 1197828 - RNA, 19 nt, Homo sapiens
gaagguccugggcaaguuu

SEQ ID NO: 1197829 - RNA, 19 nt, Homo sapiens
guagaacugcugaaagaug

SEQ ID NO: 1197830 - RNA, 19 nt, Homo sapiens
ggaugugucuggucagcau

SEQ ID NO: 1197831 - RNA, 19 nt, Homo sapiens
ccucgucccucuucuagug

SEQ ID NO: 1197832 - RNA, 19 nt, Homo sapiens
ccagagccaagaacacuaa

SEQ ID NO: 1197833 - RNA, 19 nt, Homo sapiens
aagcugaggagguggaaua

SEQ ID NO: 1197834 - RNA, 19 nt, Homo sapiens
caggugaucuuggcauugu

SEQ ID NO: 1197835 - RNA, 19 nt, Homo sapiens
ucgaagaccuggagaagac

SEQ ID NO: 1197836 - RNA, 19 nt, Homo sapiens
acaaccuggugauccaaua

SEQ ID NO: 1197837 - RNA, 19 nt, Homo sapiens
gcaaguuucacccagaugu

SEQ ID NO: 1197838 - RNA, 19 nt, Homo sapiens
gggcaaguuucacccagau

SEQ ID NO: 1197839 - RNA, 19 nt, Homo sapiens
uuucagauguugcuguaga

SEQ ID NO: 1197840 - RNA, 19 nt, Homo sapiens
guaaccuucucccuuguca

SEQ ID NO: 1197841 - RNA, 19 nt, Homo sapiens
gggaucagaacaaguacaa

SEQ ID NO: 1197842 - RNA, 19 nt, Homo sapiens
cugcccaccugcucaauga

SEQ ID NO: 1197843 - RNA, 19 nt, Homo sapiens
gggaauacggcagcuggua

SEQ ID NO: 1197844 - RNA, 19 nt, Homo sapiens
gagguggaauauuacuauc

SEQ ID NO: 1197845 - RNA, 19 nt, Homo sapiens
gagccaagaacacuaagca

SEQ ID NO: 1197846 - RNA, 19 nt, Homo sapiens
gcuccaucccuuauuuauu

SEQ ID NO: 1197847 - RNA, 19 nt, Homo sapiens
cagcuccaucccuuauuua

SEQ ID NO: 1197848 - RNA, 19 nt, Homo sapiens
acaacaagcccaucuggau

SEQ ID NO: 1197849 - RNA, 19 nt, Homo sapiens
gaauacggcagcugguaca

SEQ ID NO: 1197850 - RNA, 19 nt, Homo sapiens
gcaccaaggcugucaucca

SEQ ID NO: 1197851 - RNA, 19 nt, Homo sapiens
gauguugcuguagaaauaa

SEQ ID NO: 1197852 - RNA, 19 nt, Homo sapiens
ucaacaagagcguggaaga

SEQ ID NO: 1197853 - RNA, 19 nt, Homo sapiens
cacacuggaugaccuguuc

SEQ ID NO: 1197854 - RNA, 19 nt, Homo sapiens
gccguugcuucuguauaua

SEQ ID NO: 1197855 - RNA, 19 nt, Homo sapiens
ccugcuggcuccucugguu

SEQ ID NO: 1197856 - RNA, 19 nt, Homo sapiens
ucaacuuccucaacaagag

SEQ ID NO: 1197857 - RNA, 19 nt, Homo sapiens
gcacccucguccucacaga

SEQ ID NO: 1197858 - RNA, 19 nt, Homo sapiens
agaagguccugggcaaguu

SEQ ID NO: 1197859 - RNA, 19 nt, Homo sapiens
gagaagguccugggcaagu

SEQ ID NO: 1197860 - RNA, 19 nt, Homo sapiens
gaccuacagcugaguggaa

SEQ ID NO: 1197861 - RNA, 19 nt, Homo sapiens
cagaggagcgggaggaaag

SEQ ID NO: 1197862 - RNA, 19 nt, Homo sapiens
gcagaggagcgggaggaaa

SEQ ID NO: 1197863 - RNA, 19 nt, Homo sapiens
ccaagcagcucagcaaccu

SEQ ID NO: 1197864 - RNA, 19 nt, Homo sapiens
ggugguagaacugcugaaa

SEQ ID NO: 1197865 - RNA, 19 nt, Homo sapiens
ugagccagauccgcaaguu

SEQ ID NO: 1197866 - RNA, 19 nt, Homo sapiens
ccacgaccacccugacguu

SEQ ID NO: 1197867 - RNA, 19 nt, Homo sapiens
gcaguccuguauggcaaga

SEQ ID NO: 1197868 - RNA, 19 nt, Homo sapiens
uagaaucagagaagcagaa

SEQ ID NO: 1197869 - RNA, 19 nt, Homo sapiens
caacaagagcguggaagag

SEQ ID NO: 1197870 - RNA, 19 nt, Homo sapiens
ucugacagccgcacucuca

SEQ ID NO: 1197871 - RNA, 19 nt, Homo sapiens
gcgcucaugagaaagaguu

SEQ ID NO: 1197872 - RNA, 19 nt, Homo sapiens
ccaauguggccaagaccaa

SEQ ID NO: 1197873 - RNA, 19 nt, Homo sapiens
gagccagauccgcaaguug

SEQ ID NO: 1197874 - RNA, 19 nt, Homo sapiens
ucccucaacuuccucaaca

SEQ ID NO: 1197875 - RNA, 19 nt, Homo sapiens
guagacagccccacaguca

SEQ ID NO: 1197876 - RNA, 19 nt, Homo sapiens
ggaggagaagcagcacuug

SEQ ID NO: 1197877 - RNA, 19 nt, Homo sapiens
aggcggcugcucucuauuu

SEQ ID NO: 1197878 - RNA, 19 nt, Homo sapiens
guaccgcccaggccuuaau

SEQ ID NO: 1197879 - RNA, 19 nt, Homo sapiens
cccaggugaucuuggcauu

SEQ ID NO: 1197880 - RNA, 19 nt, Homo sapiens
gaggcgcagcgguuccuuu

SEQ ID NO: 1197881 - RNA, 19 nt, Homo sapiens
gaagacgccuccccuaacg

SEQ ID NO: 1197882 - RNA, 19 nt, Homo sapiens
gcacacacuagaggacugu

SEQ ID NO: 1197883 - RNA, 19 nt, Homo sapiens
gaggaaagcaaggauaagc

SEQ ID NO: 1197884 - RNA, 19 nt, Homo sapiens
gcaagcgggcacuggagau

SEQ ID NO: 1197885 - RNA, 19 nt, Homo sapiens
ggguaaccuucucccuugu

SEQ ID NO: 1197886 - RNA, 19 nt, Homo sapiens
gauggcaguggcuccuuga

SEQ ID NO: 1197887 - RNA, 19 nt, Homo sapiens
uggccaagaccaagaacaa

SEQ ID NO: 1197888 - RNA, 19 nt, Homo sapiens
gugaggcggcugcucucua

SEQ ID NO: 1197889 - RNA, 19 nt, Homo sapiens
uugcuucuguauauagaga

SEQ ID NO: 1197890 - RNA, 19 nt, Homo sapiens
cuggugggcuaaugcugaa

SEQ ID NO: 1197891 - RNA, 19 nt, Homo sapiens
gcacaaccuggugauccaa

SEQ ID NO: 1197892 - RNA, 19 nt, Homo sapiens
gcagggcaaguaccaggau

SEQ ID NO: 1197893 - RNA, 19 nt, Homo sapiens
gcaagaggggcaaguacaa

SEQ ID NO: 1197894 - RNA, 19 nt, Homo sapiens
gaagagagaugcacuaaca

SEQ ID NO: 1197895 - RNA, 19 nt, Homo sapiens
ggaauugucugacccuaga

SEQ ID NO: 1197896 - RNA, 19 nt, Homo sapiens
caugugggcugcuguaauu

SEQ ID NO: 1197897 - RNA, 19 nt, Homo sapiens
gcacugcacuacuccaaug

SEQ ID NO: 1197898 - RNA, 19 nt, Homo sapiens
gacaaugacuccaacaaca

SEQ ID NO: 1197899 - RNA, 19 nt, Homo sapiens
guuguacccuacuccauua

SEQ ID NO: 1197900 - RNA, 19 nt, Homo sapiens
gucauuggcuacuccauuu

SEQ ID NO: 1197901 - RNA, 19 nt, Homo sapiens
ugggauaucuccuuccauu

SEQ ID NO: 1197902 - RNA, 19 nt, Homo sapiens
gggaaguggucaucauugu

SEQ ID NO: 1197903 - RNA, 19 nt, Homo sapiens
gcacuacuccaaugucuuc

SEQ ID NO: 1197904 - RNA, 19 nt, Homo sapiens
gaagaaacacacccagaag

SEQ ID NO: 1197905 - RNA, 19 nt, Homo sapiens
ccaagcggaugccacaguu

SEQ ID NO: 1197906 - RNA, 19 nt, Homo sapiens
gacggucacucaccucaga

SEQ ID NO: 1197907 - RNA, 19 nt, Homo sapiens
gaaacacacccagaagaga

SEQ ID NO: 1197908 - RNA, 19 nt, Homo sapiens
gaaggcaacaucgucauug

SEQ ID NO: 1197909 - RNA, 19 nt, Homo sapiens
gggagagucacuaguugua

SEQ ID NO: 1197910 - RNA, 19 nt, Homo sapiens
ugaagaaacacacccagaa

SEQ ID NO: 1197911 - RNA, 19 nt, Homo sapiens
aauaaagguucuuggacaa

SEQ ID NO: 1197912 - RNA, 19 nt, Homo sapiens
ugaagacagugacuacaca

SEQ ID NO: 1197913 - RNA, 19 nt, Homo sapiens
gggccuggcugaagacagu

SEQ ID NO: 1197914 - RNA, 19 nt, Homo sapiens
gauaucacuuguuggacau

SEQ ID NO: 1197915 - RNA, 19 nt, Homo sapiens
gaugggauaucuccuucca

SEQ ID NO: 1197916 - RNA, 19 nt, Homo sapiens
caacaccaucgacguuuga

SEQ ID NO: 1197917 - RNA, 19 nt, Homo sapiens
ggacaaugacuccaacaac

SEQ ID NO: 1197918 - RNA, 19 nt, Homo sapiens
cagaagagagaugcacuaa

SEQ ID NO: 1197919 - RNA, 19 nt, Homo sapiens
ucaacaccaucgacguuug

SEQ ID NO: 1197920 - RNA, 19 nt, Homo sapiens
acaacaaucccaaggagaa

SEQ ID NO: 1197921 - RNA, 19 nt, Homo sapiens
caucgacguuugagugaag

SEQ ID NO: 1197922 - RNA, 19 nt, Homo sapiens
cauccucuuuccacuguga

SEQ ID NO: 1197923 - RNA, 19 nt, Homo sapiens
cacaaucucaggccuggua

SEQ ID NO: 1197924 - RNA, 19 nt, Homo sapiens
ggaaguggucaucauugug

SEQ ID NO: 1197925 - RNA, 19 nt, Homo sapiens
uaucacuuguuggacauuu

SEQ ID NO: 1197926 - RNA, 19 nt, Homo sapiens
gggcuguucugccgucagu

SEQ ID NO: 1197927 - RNA, 19 nt, Homo sapiens
ccugguacccauccucuuu

SEQ ID NO: 1197928 - RNA, 19 nt, Homo sapiens
ccagaagagagaugcacua

SEQ ID NO: 1197929 - RNA, 19 nt, Homo sapiens
uaucaacaccaucgacguu

SEQ ID NO: 1197930 - RNA, 19 nt, Homo sapiens
gcucaugugggcugcugua

SEQ ID NO: 1197931 - RNA, 19 nt, Homo sapiens
uaaagguucuuggacaaac

SEQ ID NO: 1197932 - RNA, 19 nt, Homo sapiens
acaaugacuccaacaacaa

SEQ ID NO: 1197933 - RNA, 19 nt, Homo sapiens
caccaucuaucaacaccau

SEQ ID NO: 1197934 - RNA, 19 nt, Homo sapiens
caaugacuccaacaacaau

SEQ ID NO: 1197935 - RNA, 19 nt, Homo sapiens
ccaacaacaaucccaagga

SEQ ID NO: 1197936 - RNA, 19 nt, Homo sapiens
cggcuaccuucaaacaguu

SEQ ID NO: 1197937 - RNA, 19 nt, Homo sapiens
aagaaacacacccagaaga

SEQ ID NO: 1197938 - RNA, 19 nt, Homo sapiens
ucaaggacaaugacuccaa

SEQ ID NO: 1197939 - RNA, 19 nt, Homo sapiens
guggugguguugcucaugu

SEQ ID NO: 1197940 - RNA, 19 nt, Homo sapiens
ccggcuaccuucaaacagu

SEQ ID NO: 1197941 - RNA, 19 nt, Homo sapiens
ggauaucuccuuccauucc

SEQ ID NO: 1197942 - RNA, 19 nt, Homo sapiens
gaccggcuaccuucaaaca

SEQ ID NO: 1197943 - RNA, 19 nt, Homo sapiens
guucuuggacaaacuggaa

SEQ ID NO: 1197944 - RNA, 19 nt, Homo sapiens
gcaaauaaaaggaauuguc

SEQ ID NO: 1197945 - RNA, 19 nt, Homo sapiens
gcuguucugccgucaguau

SEQ ID NO: 1197946 - RNA, 19 nt, Homo sapiens
gagagaugcacuaacaacu

SEQ ID NO: 1197947 - RNA, 19 nt, Homo sapiens
cgucauuggcuacuccauu

SEQ ID NO: 1197948 - RNA, 19 nt, Homo sapiens
cccauccucuuuccacugu

SEQ ID NO: 1197949 - RNA, 19 nt, Homo sapiens
agaaggcaacaucgucauu

SEQ ID NO: 1197950 - RNA, 19 nt, Homo sapiens
agaaacacacccagaagag

SEQ ID NO: 1197951 - RNA, 19 nt, Homo sapiens
cuacuccaaugucuuccau

SEQ ID NO: 1197952 - RNA, 19 nt, Homo sapiens
gagccaacucggccacugu

SEQ ID NO: 1197953 - RNA, 19 nt, Homo sapiens
cugaccggcuaccuucaaa

SEQ ID NO: 1197954 - RNA, 19 nt, Homo sapiens
gcacuaacaacuggggaua

SEQ ID NO: 1197955 - RNA, 19 nt, Homo sapiens
agagaugcacuaacaacug

SEQ ID NO: 1197956 - RNA, 19 nt, Homo sapiens
cuacuccauuucccagcaa

SEQ ID NO: 1197957 - RNA, 19 nt, Homo sapiens
gcacuuccgaacucucaag

SEQ ID NO: 1197958 - RNA, 19 nt, Homo sapiens
ggagaaggaucaccuggaa

SEQ ID NO: 1197959 - RNA, 19 nt, Homo sapiens
gaucuucuaccgucucaua

SEQ ID NO: 1197960 - RNA, 19 nt, Homo sapiens
ggaaccugcccaugucuua

SEQ ID NO: 1197961 - RNA, 19 nt, Homo sapiens
ccucauaacccucuuaaga

SEQ ID NO: 1197962 - RNA, 19 nt, Homo sapiens
ucacuuacguggagcaugu

SEQ ID NO: 1197963 - RNA, 19 nt, Homo sapiens
ggauauccuuccacagcua

SEQ ID NO: 1197964 - RNA, 19 nt, Homo sapiens
ggaaggcccucucucuacu

SEQ ID NO: 1197965 - RNA, 19 nt, Homo sapiens
ggugcgagccuuaaacuug

SEQ ID NO: 1197966 - RNA, 19 nt, Homo sapiens
gccuuaaacuugcucuuug

SEQ ID NO: 1197967 - RNA, 19 nt, Homo sapiens
ggucaaugguggaaguugu

SEQ ID NO: 1197968 - RNA, 19 nt, Homo sapiens
cuacauggcuucaguuucc

SEQ ID NO: 1197969 - RNA, 19 nt, Homo sapiens
uaccugggcucccuguuug

SEQ ID NO: 1197970 - RNA, 19 nt, Homo sapiens
gcuggaaccugcccauguc

SEQ ID NO: 1197971 - RNA, 19 nt, Homo sapiens
ggcauacacuguccacaag

SEQ ID NO: 1197972 - RNA, 19 nt, Homo sapiens
cggcugugcuggucaccua

SEQ ID NO: 1197973 - RNA, 19 nt, Homo sapiens
ggagcugccucggucaaug

SEQ ID NO: 1197974 - RNA, 19 nt, Homo sapiens
gugccugugucuugucaaa

SEQ ID NO: 1197975 - RNA, 19 nt, Homo sapiens
gcagggccuugaccagauc

SEQ ID NO: 1197976 - RNA, 19 nt, Homo sapiens
uuccacagcuaccuacaaa

SEQ ID NO: 1197977 - RNA, 19 nt, Homo sapiens
cccaacaccucaacacaca

SEQ ID NO: 1197978 - RNA, 19 nt, Homo sapiens
ccucagugccugugucuug

SEQ ID NO: 1197979 - RNA, 19 nt, Homo sapiens
agaaggaucaccuggaaug

SEQ ID NO: 1197980 - RNA, 19 nt, Homo sapiens
caacacacacacacacaca

SEQ ID NO: 1197981 - RNA, 19 nt, Homo sapiens
gggaaggcccucucucuac

SEQ ID NO: 1197982 - RNA, 19 nt, Homo sapiens
gccuugugcuguccacuug

SEQ ID NO: 1197983 - RNA, 19 nt, Homo sapiens
gaaccugcccaugucuuau

SEQ ID NO: 1197984 - RNA, 19 nt, Homo sapiens
caucgaggcgucuuccuau

SEQ ID NO: 1197985 - RNA, 19 nt, Homo sapiens
acacacacacacacacaaa

SEQ ID NO: 1197986 - RNA, 19 nt, Homo sapiens
cuaccugggcucccuguuu

SEQ ID NO: 1197987 - RNA, 19 nt, Homo sapiens
ccacagcuaccuacaaacu

SEQ ID NO: 1197988 - RNA, 19 nt, Homo sapiens
ccgccuuccuucuuccuuu

SEQ ID NO: 1197989 - RNA, 19 nt, Homo sapiens
ggcccucucucuacuccuu

SEQ ID NO: 1197990 - RNA, 19 nt, Homo sapiens
caucuguggacccucauaa

SEQ ID NO: 1197991 - RNA, 19 nt, Homo sapiens
caacaccucaacacacaca

SEQ ID NO: 1197992 - RNA, 19 nt, Homo sapiens
gcugcgagccuacgagagu

SEQ ID NO: 1197993 - RNA, 19 nt, Homo sapiens
guucaugggcuaccucuac

SEQ ID NO: 1197994 - RNA, 19 nt, Homo sapiens
ccucaucuaccuacucaug

SEQ ID NO: 1197995 - RNA, 19 nt, Homo sapiens
ccaucgaggcgucuuccua

SEQ ID NO: 1197996 - RNA, 19 nt, Homo sapiens
ccuccuacauggcuucagu

SEQ ID NO: 1197997 - RNA, 19 nt, Homo sapiens
uguccaagccacugaaugu

SEQ ID NO: 1197998 - RNA, 19 nt, Homo sapiens
uggcauacacuguccacaa

SEQ ID NO: 1197999 - RNA, 19 nt, Homo sapiens
ugugcuaccucgugcuguu

SEQ ID NO: 1198000 - RNA, 19 nt, Homo sapiens
gcugucuccuuccacuuca

SEQ ID NO: 1198001 - RNA, 19 nt, Homo sapiens
ccuuaaacuugcucuuugg

SEQ ID NO: 1198002 - RNA, 19 nt, Homo sapiens
gagaugcacaugguagaca

SEQ ID NO: 1198003 - RNA, 19 nt, Homo sapiens
ugggugagaugcacauggu

SEQ ID NO: 1198004 - RNA, 19 nt, Homo sapiens
gagcugccucggucaaugg

SEQ ID NO: 1198005 - RNA, 19 nt, Homo sapiens
gagaaggaucaccuggaau

SEQ ID NO: 1198006 - RNA, 19 nt, Homo sapiens
ccuguuugaugucgaugug

SEQ ID NO: 1198007 - RNA, 19 nt, Homo sapiens
uuggagcucuggccaucuu

SEQ ID NO: 1198008 - RNA, 19 nt, Homo sapiens
gaaggaucaccuggaaugg

SEQ ID NO: 1198009 - RNA, 19 nt, Homo sapiens
ggacugugcugaacgagaa

SEQ ID NO: 1198010 - RNA, 19 nt, Homo sapiens
gaacaaacaaacguaaguu

SEQ ID NO: 1198011 - RNA, 19 nt, Homo sapiens
gaaauccauucucaugaag

SEQ ID NO: 1198012 - RNA, 19 nt, Homo sapiens
aaaccagacuugccuugaa

SEQ ID NO: 1198013 - RNA, 19 nt, Homo sapiens
gcaaggacaagaagaaauc

SEQ ID NO: 1198014 - RNA, 19 nt, Homo sapiens
cauagugggacuuguauuu

SEQ ID NO: 1198015 - RNA, 19 nt, Homo sapiens
caguggaggugcagacgua

SEQ ID NO: 1198016 - RNA, 19 nt, Homo sapiens
ucucucgccuucguaauua

SEQ ID NO: 1198017 - RNA, 19 nt, Homo sapiens
gcgcaugauugcugggaaa

SEQ ID NO: 1198018 - RNA, 19 nt, Homo sapiens
ggaccaacccgccuuccaa

SEQ ID NO: 1198019 - RNA, 19 nt, Homo sapiens
ggacaagaagaaauccauu

SEQ ID NO: 1198020 - RNA, 19 nt, Homo sapiens
agaagcagcugcacacucu

SEQ ID NO: 1198021 - RNA, 19 nt, Homo sapiens
gcagcgaccuggugaugag

SEQ ID NO: 1198022 - RNA, 19 nt, Homo sapiens
ggugaucauuccaagaaga

SEQ ID NO: 1198023 - RNA, 19 nt, Homo sapiens
guucauagugggacuugua

SEQ ID NO: 1198024 - RNA, 19 nt, Homo sapiens
gaaaccagacuugccuuga

SEQ ID NO: 1198025 - RNA, 19 nt, Homo sapiens
ccuugaaaguguuuaaguu

SEQ ID NO: 1198026 - RNA, 19 nt, Homo sapiens
gcccgacgcucucaugaag

SEQ ID NO: 1198027 - RNA, 19 nt, Homo sapiens
ucagauccacgaccaguuu

SEQ ID NO: 1198028 - RNA, 19 nt, Homo sapiens
ggacuuguauuuugaucuu

SEQ ID NO: 1198029 - RNA, 19 nt, Homo sapiens
cagaguaugugagccuuug

SEQ ID NO: 1198030 - RNA, 19 nt, Homo sapiens
aaccagacuugccuugaaa

SEQ ID NO: 1198031 - RNA, 19 nt, Homo sapiens
uccaacagcuggucuccuu

SEQ ID NO: 1198032 - RNA, 19 nt, Homo sapiens
ggacagcguguaccacauc

SEQ ID NO: 1198033 - RNA, 19 nt, Homo sapiens
gcucaggccauuccaguuc

SEQ ID NO: 1198034 - RNA, 19 nt, Homo sapiens
gcagucccauccgccauga

SEQ ID NO: 1198035 - RNA, 19 nt, Homo sapiens
gcuccgaggacucuuaguu

SEQ ID NO: 1198036 - RNA, 19 nt, Homo sapiens
gacaagaagaaauccauuc

SEQ ID NO: 1198037 - RNA, 19 nt, Homo sapiens
uaacucagaggaacagaca

SEQ ID NO: 1198038 - RNA, 19 nt, Homo sapiens
ccgacgcucucaugaagga

SEQ ID NO: 1198039 - RNA, 19 nt, Homo sapiens
gcugcaaggacaagaagaa

SEQ ID NO: 1198040 - RNA, 19 nt, Homo sapiens
ugagagacgggaagaccua

SEQ ID NO: 1198041 - RNA, 19 nt, Homo sapiens
cgaacaaacaaacguaagu

SEQ ID NO: 1198042 - RNA, 19 nt, Homo sapiens
gagagaguaccgagagaca

SEQ ID NO: 1198043 - RNA, 19 nt, Homo sapiens
ggaacagacacucaaacuc

SEQ ID NO: 1198044 - RNA, 19 nt, Homo sapiens
gagcagcugguggagauga

SEQ ID NO: 1198045 - RNA, 19 nt, Homo sapiens
aggagcagcugguggagau

SEQ ID NO: 1198046 - RNA, 19 nt, Homo sapiens
ggacuuaccaggguuagcu

SEQ ID NO: 1198047 - RNA, 19 nt, Homo sapiens
gugaucauuccaagaagaa

SEQ ID NO: 1198048 - RNA, 19 nt, Homo sapiens
cagauccacgaccaguuua

SEQ ID NO: 1198049 - RNA, 19 nt, Homo sapiens
gccgaacaaacaaacguaa

SEQ ID NO: 1198050 - RNA, 19 nt, Homo sapiens
cagaggaacagacacucaa

SEQ ID NO: 1198051 - RNA, 19 nt, Homo sapiens
ugggugaucauuccaagaa

SEQ ID NO: 1198052 - RNA, 19 nt, Homo sapiens
gggacuacgucaggcuguu

SEQ ID NO: 1198053 - RNA, 19 nt, Homo sapiens
gacggaggacagaguaugu

SEQ ID NO: 1198054 - RNA, 19 nt, Homo sapiens
caugauugcugggaaacag

SEQ ID NO: 1198055 - RNA, 19 nt, Homo sapiens
ccucuccucuccucucuac

SEQ ID NO: 1198056 - RNA, 19 nt, Homo sapiens
caacagcuggucuccuucu

SEQ ID NO: 1198057 - RNA, 19 nt, Homo sapiens
ggacuacgucaggcuguuc

SEQ ID NO: 1198058 - RNA, 19 nt, Homo sapiens
cagcagcgaccuggugaug

SEQ ID NO: 1198059 - RNA, 19 nt, Homo sapiens
gugagccuuugccgaacaa

SEQ ID NO: 1198060 - RNA, 19 nt, Homo sapiens
cgacggaggacagaguaug

SEQ ID NO: 1198061 - RNA, 19 nt, Homo sapiens
cuccgaggacucuuaguuu

SEQ ID NO: 1198062 - RNA, 19 nt, Homo sapiens
ggccauuccaguuccgaaa

SEQ ID NO: 1198063 - RNA, 19 nt, Homo sapiens
aauccauucucaugaagca

SEQ ID NO: 1198064 - RNA, 19 nt, Homo sapiens
agaacaagcgcugcaagga

SEQ ID NO: 1198065 - RNA, 19 nt, Homo sapiens
gggacagcguguaccacau

SEQ ID NO: 1198066 - RNA, 19 nt, Homo sapiens
gcaucaagugcgccaagug

SEQ ID NO: 1198067 - RNA, 19 nt, Homo sapiens
gaacaaagcuuuucugaua

SEQ ID NO: 1198068 - RNA, 19 nt, Homo sapiens
gaaggugacuuauguagaa

SEQ ID NO: 1198069 - RNA, 19 nt, Homo sapiens
gauauugccuaacuucaua

SEQ ID NO: 1198070 - RNA, 19 nt, Homo sapiens
gaauucagcugaugguaaa

SEQ ID NO: 1198071 - RNA, 19 nt, Homo sapiens
gaacagacuuaaugagaga

SEQ ID NO: 1198072 - RNA, 19 nt, Homo sapiens
gcaaauccgauguuuauaa

SEQ ID NO: 1198073 - RNA, 19 nt, Homo sapiens
gaacaucagaccauacuaa

SEQ ID NO: 1198074 - RNA, 19 nt, Homo sapiens
uaacucugguucuucauua

SEQ ID NO: 1198075 - RNA, 19 nt, Homo sapiens
guacuuggaucauuuggaa

SEQ ID NO: 1198076 - RNA, 19 nt, Homo sapiens
gaaaguauuacccuuguuu

SEQ ID NO: 1198077 - RNA, 19 nt, Homo sapiens
ccaagaaucugaagguaga

SEQ ID NO: 1198078 - RNA, 19 nt, Homo sapiens
caagaucauugaauucuga

SEQ ID NO: 1198079 - RNA, 19 nt, Homo sapiens
acacguguccgauuuauua

SEQ ID NO: 1198080 - RNA, 19 nt, Homo sapiens
aaagagaaguuggagcuua

SEQ ID NO: 1198081 - RNA, 19 nt, Homo sapiens
agaagaaggugacuuaugu

SEQ ID NO: 1198082 - RNA, 19 nt, Homo sapiens
gaacagauuccucuauuag

SEQ ID NO: 1198083 - RNA, 19 nt, Homo sapiens
ggaaaugguuuaaacacau

SEQ ID NO: 1198084 - RNA, 19 nt, Homo sapiens
agacagaguuccuucauau

SEQ ID NO: 1198085 - RNA, 19 nt, Homo sapiens
agaaauagaugcacaccuu

SEQ ID NO: 1198086 - RNA, 19 nt, Homo sapiens
caaagaccauuucaagaau

SEQ ID NO: 1198087 - RNA, 19 nt, Homo sapiens
caagagauccagaaagauu

SEQ ID NO: 1198088 - RNA, 19 nt, Homo sapiens
acagauuccucuauuagua

SEQ ID NO: 1198089 - RNA, 19 nt, Homo sapiens
gcaacgggaucaugauuca

SEQ ID NO: 1198090 - RNA, 19 nt, Homo sapiens
acacauguaugccuguaua

SEQ ID NO: 1198091 - RNA, 19 nt, Homo sapiens
gaggagagauuuggagaga

SEQ ID NO: 1198092 - RNA, 19 nt, Homo sapiens
ggagaaauguuggaaaugg

SEQ ID NO: 1198093 - RNA, 19 nt, Homo sapiens
ucaaagaccauuucaagaa

SEQ ID NO: 1198094 - RNA, 19 nt, Homo sapiens
acauagagcucaugcaaau

SEQ ID NO: 1198095 - RNA, 19 nt, Homo sapiens
uggaagaaauacaggaaua

SEQ ID NO: 1198096 - RNA, 19 nt, Homo sapiens
gaccuaaacuuuccuguac

SEQ ID NO: 1198097 - RNA, 19 nt, Homo sapiens
gggaaugccuaauaaauac

SEQ ID NO: 1198098 - RNA, 19 nt, Homo sapiens
caaaugaacaagcugagua

SEQ ID NO: 1198099 - RNA, 19 nt, Homo sapiens
agaagaagaaggugacuua

SEQ ID NO: 1198100 - RNA, 19 nt, Homo sapiens
gcacaggaaguuugcagua

SEQ ID NO: 1198101 - RNA, 19 nt, Homo sapiens
ggaauucagcugaugguaa

SEQ ID NO: 1198102 - RNA, 19 nt, Homo sapiens
agaacagauuccucuauua

SEQ ID NO: 1198103 - RNA, 19 nt, Homo sapiens
gaugggaaauacaaaugaa

SEQ ID NO: 1198104 - RNA, 19 nt, Homo sapiens
ggacucagaagaagaagaa

SEQ ID NO: 1198105 - RNA, 19 nt, Homo sapiens
gcacuugggaguaauuuga

SEQ ID NO: 1198106 - RNA, 19 nt, Homo sapiens
ggagagauuuggagagaag

SEQ ID NO: 1198107 - RNA, 19 nt, Homo sapiens
uggaugaucugugaacaua

SEQ ID NO: 1198108 - RNA, 19 nt, Homo sapiens
cauaacaggacauuugaua

SEQ ID NO: 1198109 - RNA, 19 nt, Homo sapiens
gaccauaacaggacauuug

SEQ ID NO: 1198110 - RNA, 19 nt, Homo sapiens
ggaguaauuugaccgacaa

SEQ ID NO: 1198111 - RNA, 19 nt, Homo sapiens
uagcaaauccgauguuuau

SEQ ID NO: 1198112 - RNA, 19 nt, Homo sapiens
gaagaagacggagaccaua

SEQ ID NO: 1198113 - RNA, 19 nt, Homo sapiens
gcucaagguggaagaaaua

SEQ ID NO: 1198114 - RNA, 19 nt, Homo sapiens
gcaauacgcagccuggauu

SEQ ID NO: 1198115 - RNA, 19 nt, Homo sapiens
gaagaacagauuccucuau

SEQ ID NO: 1198116 - RNA, 19 nt, Homo sapiens
ggaagcagaggaaguaguu

SEQ ID NO: 1198117 - RNA, 19 nt, Homo sapiens
ggugacuuauguagaauuu

SEQ ID NO: 1198118 - RNA, 19 nt, Homo sapiens
gaagguaggcggacaacga

SEQ ID NO: 1198119 - RNA, 19 nt, Homo sapiens
caucagaccauacuaaguu

SEQ ID NO: 1198120 - RNA, 19 nt, Homo sapiens
ccaauugccuucugaacau

SEQ ID NO: 1198121 - RNA, 19 nt, Homo sapiens
gaagaaggugacuuaugua

SEQ ID NO: 1198122 - RNA, 19 nt, Homo sapiens
ccagaaagauugcagaaaa

SEQ ID NO: 1198123 - RNA, 19 nt, Homo sapiens
aagaacagauuccucuauu

SEQ ID NO: 1198124 - RNA, 19 nt, Homo sapiens
gcuauauggcaccuaauua

SEQ ID NO: 1198125 - RNA, 19 nt, Homo sapiens
cagaggaaguaguuuaaau

SEQ ID NO: 1198126 - RNA, 19 nt, Homo sapiens
gcacacguguccgauuuau

SEQ ID NO: 1198127 - RNA, 19 nt, Homo sapiens
gcacaccuuuguucucuag

SEQ ID NO: 1198128 - RNA, 19 nt, Homo sapiens
gaggaaguaguuuaaauga

SEQ ID NO: 1198129 - RNA, 19 nt, Homo sapiens
aaugagcacuuuacaguug

SEQ ID NO: 1198130 - RNA, 19 nt, Homo sapiens
gaugaucugugaacauaag

SEQ ID NO: 1198131 - RNA, 19 nt, Homo sapiens
aagagaaguuggagcuuaa

SEQ ID NO: 1198132 - RNA, 19 nt, Homo sapiens
ccaccaagacuguaugaaa

SEQ ID NO: 1198133 - RNA, 19 nt, Homo sapiens
gcagcugcaucaucaucua

SEQ ID NO: 1198134 - RNA, 19 nt, Homo sapiens
gaaauagaugcacaccuuu

SEQ ID NO: 1198135 - RNA, 19 nt, Homo sapiens
gaaucugaagguagaaaua

SEQ ID NO: 1198136 - RNA, 19 nt, Homo sapiens
gacauuugauauugccuaa

SEQ ID NO: 1198137 - RNA, 19 nt, Homo sapiens
ucucuuagccacaaucaua

SEQ ID NO: 1198138 - RNA, 19 nt, Homo sapiens
gaagaucuagucaggauuc

SEQ ID NO: 1198139 - RNA, 19 nt, Homo sapiens
gggaaaguauuacccuugu

SEQ ID NO: 1198140 - RNA, 19 nt, Homo sapiens
aagcacacguguccgauuu

SEQ ID NO: 1198141 - RNA, 19 nt, Homo sapiens
ggaaaguauuacccuuguu

SEQ ID NO: 1198142 - RNA, 19 nt, Homo sapiens
gauaugaugggaaauacaa

SEQ ID NO: 1198143 - RNA, 19 nt, Homo sapiens
guaaccaccugugaacuau

SEQ ID NO: 1198144 - RNA, 19 nt, Homo sapiens
gauucuuccugguuccuua

SEQ ID NO: 1198145 - RNA, 19 nt, Homo sapiens
acaagcaucugcagcauca

SEQ ID NO: 1198146 - RNA, 19 nt, Homo sapiens
caacagaccacaagcaucu

SEQ ID NO: 1198147 - RNA, 19 nt, Homo sapiens
gauauuauuccuucagguu

SEQ ID NO: 1198148 - RNA, 19 nt, Homo sapiens
agaaucaaaugaagugguu

SEQ ID NO: 1198149 - RNA, 19 nt, Homo sapiens
cauagcaaauccgauguuu

SEQ ID NO: 1198150 - RNA, 19 nt, Homo sapiens
gaauaucagucuacaucag

SEQ ID NO: 1198151 - RNA, 19 nt, Homo sapiens
gauaauagggcgucugaag

SEQ ID NO: 1198152 - RNA, 19 nt, Homo sapiens
auacuaaguucuagggauu

SEQ ID NO: 1198153 - RNA, 19 nt, Homo sapiens
uucaagagauccagaaaga

SEQ ID NO: 1198154 - RNA, 19 nt, Homo sapiens
gcacagaaugauccucuug

SEQ ID NO: 1198155 - RNA, 19 nt, Homo sapiens
gaagagaaucaaaugaagu

SEQ ID NO: 1198156 - RNA, 19 nt, Homo sapiens
ucucagggauuucgauuuc

SEQ ID NO: 1198157 - RNA, 19 nt, Homo sapiens
cauaagcaauucagaaagg

SEQ ID NO: 1198158 - RNA, 19 nt, Homo sapiens
guuccuagaucuucaucaa

SEQ ID NO: 1198159 - RNA, 19 nt, Homo sapiens
gagcuuaaccuggaggauu

SEQ ID NO: 1198160 - RNA, 19 nt, Homo sapiens
cagaguuccuucauauuca

SEQ ID NO: 1198161 - RNA, 19 nt, Homo sapiens
uaucagcucuggucucuac

SEQ ID NO: 1198162 - RNA, 19 nt, Homo sapiens
ucaaauggcagcugcauca

SEQ ID NO: 1198163 - RNA, 19 nt, Homo sapiens
ggaagaaauacaggaauau

SEQ ID NO: 1198164 - RNA, 19 nt, Homo sapiens
guaauuugaccgacaaugu

SEQ ID NO: 1198165 - RNA, 19 nt, Homo sapiens
gaagaaauacaggaauauc

SEQ ID NO: 1198166 - RNA, 19 nt, Homo sapiens
ucaaugagcacuuuacagu

SEQ ID NO: 1198167 - RNA, 19 nt, Homo sapiens
ccaaaggcauccugcagua

SEQ ID NO: 1198168 - RNA, 19 nt, Homo sapiens
gugcggaccuugcucaauu

SEQ ID NO: 1198169 - RNA, 19 nt, Homo sapiens
gcacaguguugcugagaau

SEQ ID NO: 1198170 - RNA, 19 nt, Homo sapiens
gaucaacuaugccaccaau

SEQ ID NO: 1198171 - RNA, 19 nt, Homo sapiens
gaacaagaacacccugcua

SEQ ID NO: 1198172 - RNA, 19 nt, Homo sapiens
uugagaagaugcucuauga

SEQ ID NO: 1198173 - RNA, 19 nt, Homo sapiens
ggugaagcaucccaacuga

SEQ ID NO: 1198174 - RNA, 19 nt, Homo sapiens
gaagucaccauaccuccua

SEQ ID NO: 1198175 - RNA, 19 nt, Homo sapiens
gugaugaauucuacucuga

SEQ ID NO: 1198176 - RNA, 19 nt, Homo sapiens
gaaaauagccagcguguca

SEQ ID NO: 1198177 - RNA, 19 nt, Homo sapiens
cgagaacaguggaaacaga

SEQ ID NO: 1198178 - RNA, 19 nt, Homo sapiens
caccauaccuccuacaaca

SEQ ID NO: 1198179 - RNA, 19 nt, Homo sapiens
aagacaggcugaucaacua

SEQ ID NO: 1198180 - RNA, 19 nt, Homo sapiens
gaagugcgacggucaguag

SEQ ID NO: 1198181 - RNA, 19 nt, Homo sapiens
gcugacugcugcccgcuuu

SEQ ID NO: 1198182 - RNA, 19 nt, Homo sapiens
caagaacacccugcuagaa

SEQ ID NO: 1198183 - RNA, 19 nt, Homo sapiens
caucccaacugacuagaga

SEQ ID NO: 1198184 - RNA, 19 nt, Homo sapiens
gaugcuggcugccuggaau

SEQ ID NO: 1198185 - RNA, 19 nt, Homo sapiens
ccaacugacuagagacuca

SEQ ID NO: 1198186 - RNA, 19 nt, Homo sapiens
cacagaggcugguaacauc

SEQ ID NO: 1198187 - RNA, 19 nt, Homo sapiens
gcucucuggugaugaauuc

SEQ ID NO: 1198188 - RNA, 19 nt, Homo sapiens
gagaacaguggaaacagaa

SEQ ID NO: 1198189 - RNA, 19 nt, Homo sapiens
cagcugccuuuccugagua

SEQ ID NO: 1198190 - RNA, 19 nt, Homo sapiens
cguccacucugucuacauu

SEQ ID NO: 1198191 - RNA, 19 nt, Homo sapiens
cagcagauggccuugcaua

SEQ ID NO: 1198192 - RNA, 19 nt, Homo sapiens
cuaacaaggugcugauucu

SEQ ID NO: 1198193 - RNA, 19 nt, Homo sapiens
acaauccuguggacuggua

SEQ ID NO: 1198194 - RNA, 19 nt, Homo sapiens
ccacucacccuagaauaaa

SEQ ID NO: 1198195 - RNA, 19 nt, Homo sapiens
ucacugaucccugcgaauu

SEQ ID NO: 1198196 - RNA, 19 nt, Homo sapiens
gcauaugugugugagaauc

SEQ ID NO: 1198197 - RNA, 19 nt, Homo sapiens
aagaacacccugcuagaaa

SEQ ID NO: 1198198 - RNA, 19 nt, Homo sapiens
caggccagcuccucaugaa

SEQ ID NO: 1198199 - RNA, 19 nt, Homo sapiens
ugagggcuaugaugaggaa

SEQ ID NO: 1198200 - RNA, 19 nt, Homo sapiens
gaacaguggaaacagaaca

SEQ ID NO: 1198201 - RNA, 19 nt, Homo sapiens
gugaggacuuugugagugu

SEQ ID NO: 1198202 - RNA, 19 nt, Homo sapiens
gacaaggccaggaaggaaa

SEQ ID NO: 1198203 - RNA, 19 nt, Homo sapiens
uuaacagugucccguggua

SEQ ID NO: 1198204 - RNA, 19 nt, Homo sapiens
gcagcuggaugagggcuau

SEQ ID NO: 1198205 - RNA, 19 nt, Homo sapiens
ggaaacagaacaagaacac

SEQ ID NO: 1198206 - RNA, 19 nt, Homo sapiens
ugaagcggcacauguuuga

SEQ ID NO: 1198207 - RNA, 19 nt, Homo sapiens
gcagagcccagcgccaauu

SEQ ID NO: 1198208 - RNA, 19 nt, Homo sapiens
ggccuugcauacccugaaa

SEQ ID NO: 1198209 - RNA, 19 nt, Homo sapiens
ccuacaacaugccuacaau

SEQ ID NO: 1198210 - RNA, 19 nt, Homo sapiens
ccaggccacugcauaugug

SEQ ID NO: 1198211 - RNA, 19 nt, Homo sapiens
cgacaaggccaggaaggaa

SEQ ID NO: 1198212 - RNA, 19 nt, Homo sapiens
gaagcaucccaacugacua

SEQ ID NO: 1198213 - RNA, 19 nt, Homo sapiens
cugcauaugugugugagaa

SEQ ID NO: 1198214 - RNA, 19 nt, Homo sapiens
gaaggacgaccaggaugga

SEQ ID NO: 1198215 - RNA, 19 nt, Homo sapiens
caagacaggcugaucaacu

SEQ ID NO: 1198216 - RNA, 19 nt, Homo sapiens
gcaccuggacagcaagaug

SEQ ID NO: 1198217 - RNA, 19 nt, Homo sapiens
ugagcuuccuguucuccua

SEQ ID NO: 1198218 - RNA, 19 nt, Homo sapiens
ggccugacguggacaaggu

SEQ ID NO: 1198219 - RNA, 19 nt, Homo sapiens
cacccuagaauaaacuuaa

SEQ ID NO: 1198220 - RNA, 19 nt, Homo sapiens
ccagcugccuuuccugagu

SEQ ID NO: 1198221 - RNA, 19 nt, Homo sapiens
ggugccacaugauggaaga

SEQ ID NO: 1198222 - RNA, 19 nt, Homo sapiens
gcagggcccuauagaaccu

SEQ ID NO: 1198223 - RNA, 19 nt, Homo sapiens
ucacagaggcugguaacau

SEQ ID NO: 1198224 - RNA, 19 nt, Homo sapiens
gggcuaugaugaggaauac

SEQ ID NO: 1198225 - RNA, 19 nt, Homo sapiens
acaagugugugugccuauu

SEQ ID NO: 1198226 - RNA, 19 nt, Homo sapiens
uggaugagggcuaugauga

SEQ ID NO: 1198227 - RNA, 19 nt, Homo sapiens
gugcgacggucaguaguuc

SEQ ID NO: 1198228 - RNA, 19 nt, Homo sapiens
ccacuggugccacaugaug

SEQ ID NO: 1198229 - RNA, 19 nt, Homo sapiens
cccacucacccuagaauaa

SEQ ID NO: 1198230 - RNA, 19 nt, Homo sapiens
caagugugugugccuauug

SEQ ID NO: 1198231 - RNA, 19 nt, Homo sapiens
ggacuggauggacaagugu

SEQ ID NO: 1198232 - RNA, 19 nt, Homo sapiens
cagcgccaauuccguguca

SEQ ID NO: 1198233 - RNA, 19 nt, Homo sapiens
gauccugagcuuccuguuc

SEQ ID NO: 1198234 - RNA, 19 nt, Homo sapiens
uaacagugucccgugguaa

SEQ ID NO: 1198235 - RNA, 19 nt, Homo sapiens
cacugaucccugcgaauua

SEQ ID NO: 1198236 - RNA, 19 nt, Homo sapiens
gaagcacuacggccucaca

SEQ ID NO: 1198237 - RNA, 19 nt, Homo sapiens
acaagaacacccugcuaga

SEQ ID NO: 1198238 - RNA, 19 nt, Homo sapiens
ccauaccuccuacaacaug

SEQ ID NO: 1198239 - RNA, 19 nt, Homo sapiens
ccacugcauauguguguga

SEQ ID NO: 1198240 - RNA, 19 nt, Homo sapiens
ucaacuaugccaccaaugg

SEQ ID NO: 1198241 - RNA, 19 nt, Homo sapiens
ggccaagacaggcugauca

SEQ ID NO: 1198242 - RNA, 19 nt, Homo sapiens
aagugugugugccuauuga

SEQ ID NO: 1198243 - RNA, 19 nt, Homo sapiens
gagcugcagggccagaaug

SEQ ID NO: 1198244 - RNA, 19 nt, Homo sapiens
gaauacgagaacaguggaa

SEQ ID NO: 1198245 - RNA, 19 nt, Homo sapiens
gcacccacucacccuagaa

SEQ ID NO: 1198246 - RNA, 19 nt, Homo sapiens
agaccaggccacugcauau

SEQ ID NO: 1198247 - RNA, 19 nt, Homo sapiens
gcggcuacuucugcaguga

SEQ ID NO: 1198248 - RNA, 19 nt, Homo sapiens
gccaagacaggcugaucaa

SEQ ID NO: 1198249 - RNA, 19 nt, Homo sapiens
agaacacccugcuagaaaa

SEQ ID NO: 1198250 - RNA, 19 nt, Homo sapiens
ucaauucagggcuggagaa

SEQ ID NO: 1198251 - RNA, 19 nt, Homo sapiens
ggaugagggcuaugaugag

SEQ ID NO: 1198252 - RNA, 19 nt, Homo sapiens
aguggaaacagaacaagaa

SEQ ID NO: 1198253 - RNA, 19 nt, Homo sapiens
guggacaagguguacauga

SEQ ID NO: 1198254 - RNA, 19 nt, Homo sapiens
ugaagcaucccaacugacu

SEQ ID NO: 1198255 - RNA, 19 nt, Homo sapiens
gaccaggccacugcauaug

SEQ ID NO: 1198256 - RNA, 19 nt, Homo sapiens
aagaccaggccacugcaua

SEQ ID NO: 1198257 - RNA, 19 nt, Homo sapiens
aggacuggauggacaagug

SEQ ID NO: 1198258 - RNA, 19 nt, Homo sapiens
ccugaagcggcacauguuu

SEQ ID NO: 1198259 - RNA, 19 nt, Homo sapiens
caugccugcuggagggaaa

SEQ ID NO: 1198260 - RNA, 19 nt, Homo sapiens
auucagggcuggagaagcu

SEQ ID NO: 1198261 - RNA, 19 nt, Homo sapiens
uugcauacccugaaaauga

SEQ ID NO: 1198262 - RNA, 19 nt, Homo sapiens
gaacuaccaucuucauaua

SEQ ID NO: 1198263 - RNA, 19 nt, Homo sapiens
guacaaagauagaggaauu

SEQ ID NO: 1198264 - RNA, 19 nt, Homo sapiens
gaauugggcugucguuaaa

SEQ ID NO: 1198265 - RNA, 19 nt, Homo sapiens
cagauuggcuuauuuauga

SEQ ID NO: 1198266 - RNA, 19 nt, Homo sapiens
gaccagagcccauagaaua

SEQ ID NO: 1198267 - RNA, 19 nt, Homo sapiens
gaaguggcauagcuuauuu

SEQ ID NO: 1198268 - RNA, 19 nt, Homo sapiens
ggaagaacaucaugccuau

SEQ ID NO: 1198269 - RNA, 19 nt, Homo sapiens
cagcauaguuuacuuggua

SEQ ID NO: 1198270 - RNA, 19 nt, Homo sapiens
gaagcuaaaucgagccuuu

SEQ ID NO: 1198271 - RNA, 19 nt, Homo sapiens
gaacuuugcuuacauacca

SEQ ID NO: 1198272 - RNA, 19 nt, Homo sapiens
gaacaucugagcaccauuu

SEQ ID NO: 1198273 - RNA, 19 nt, Homo sapiens
gcagaaagaguacugauga

SEQ ID NO: 1198274 - RNA, 19 nt, Homo sapiens
gacaauagaugcaauggau

SEQ ID NO: 1198275 - RNA, 19 nt, Homo sapiens
cagaguaaguuguuuaaga

SEQ ID NO: 1198276 - RNA, 19 nt, Homo sapiens
ucaaggaucuggacauuuc

SEQ ID NO: 1198277 - RNA, 19 nt, Homo sapiens
ucacaucucuuuauaugga

SEQ ID NO: 1198278 - RNA, 19 nt, Homo sapiens
acaaauacgucaacaccua

SEQ ID NO: 1198279 - RNA, 19 nt, Homo sapiens
ggagaaaggaagcauuuaa

SEQ ID NO: 1198280 - RNA, 19 nt, Homo sapiens
gaacuuggguaucauuugg

SEQ ID NO: 1198281 - RNA, 19 nt, Homo sapiens
gaauaaaguuggauguucu

SEQ ID NO: 1198282 - RNA, 19 nt, Homo sapiens
aaugagagcuccaucuaaa

SEQ ID NO: 1198283 - RNA, 19 nt, Homo sapiens
gaaaugaccagagcccaua

SEQ ID NO: 1198284 - RNA, 19 nt, Homo sapiens
caaaguuucuuccugauca

SEQ ID NO: 1198285 - RNA, 19 nt, Homo sapiens
uaagaaaggccugaauaua

SEQ ID NO: 1198286 - RNA, 19 nt, Homo sapiens
ucagucagccucaauauaa

SEQ ID NO: 1198287 - RNA, 19 nt, Homo sapiens
gcaggcauguauccuaauu

SEQ ID NO: 1198288 - RNA, 19 nt, Homo sapiens
cagauuagauuaagugcuu

SEQ ID NO: 1198289 - RNA, 19 nt, Homo sapiens
gaguguugcuuuagaacua

SEQ ID NO: 1198290 - RNA, 19 nt, Homo sapiens
ccacagauuggcuuauuua

SEQ ID NO: 1198291 - RNA, 19 nt, Homo sapiens
gcacaguaauuaugaccuu

SEQ ID NO: 1198292 - RNA, 19 nt, Homo sapiens
caacaaggacaacaacaaa

SEQ ID NO: 1198293 - RNA, 19 nt, Homo sapiens
gagaaaggaagcauuuaaa

SEQ ID NO: 1198294 - RNA, 19 nt, Homo sapiens
ggacuaggaggaguauuua

SEQ ID NO: 1198295 - RNA, 19 nt, Homo sapiens
gaaagaguacugaugaaau

SEQ ID NO: 1198296 - RNA, 19 nt, Homo sapiens
gaagaacagucugcagguu

SEQ ID NO: 1198297 - RNA, 19 nt, Homo sapiens
aggcauguauccuaauuua

SEQ ID NO: 1198298 - RNA, 19 nt, Homo sapiens
uaacuaagggcuauucauu

SEQ ID NO: 1198299 - RNA, 19 nt, Homo sapiens
ucuuggaggucaaauaaua

SEQ ID NO: 1198300 - RNA, 19 nt, Homo sapiens
agaacagucugcagguuua

SEQ ID NO: 1198301 - RNA, 19 nt, Homo sapiens
ugaugaagcuaccauaaga

SEQ ID NO: 1198302 - RNA, 19 nt, Homo sapiens
ugacugaacuuggguauca

SEQ ID NO: 1198303 - RNA, 19 nt, Homo sapiens
aagaaaugcuguacaaaug

SEQ ID NO: 1198304 - RNA, 19 nt, Homo sapiens
gggaagaucugacugaacu

SEQ ID NO: 1198305 - RNA, 19 nt, Homo sapiens
cgucacaucucuuuauaug

SEQ ID NO: 1198306 - RNA, 19 nt, Homo sapiens
gaacaucaugccuauuuau

SEQ ID NO: 1198307 - RNA, 19 nt, Homo sapiens
uaggaugucuucugagauu

SEQ ID NO: 1198308 - RNA, 19 nt, Homo sapiens
guacaaaugcuuaagacaa

SEQ ID NO: 1198309 - RNA, 19 nt, Homo sapiens
ucaauuugcacaccauuua

SEQ ID NO: 1198310 - RNA, 19 nt, Homo sapiens
agaggcagcuaguuuauug

SEQ ID NO: 1198311 - RNA, 19 nt, Homo sapiens
ggacagagagaaucuagug

SEQ ID NO: 1198312 - RNA, 19 nt, Homo sapiens
gaauaaagggcaaaguuuc

SEQ ID NO: 1198313 - RNA, 19 nt, Homo sapiens
agaaaggccugaauauauc

SEQ ID NO: 1198314 - RNA, 19 nt, Homo sapiens
aagaaaggccugaauauau

SEQ ID NO: 1198315 - RNA, 19 nt, Homo sapiens
guaaugaacggaagcuaaa

SEQ ID NO: 1198316 - RNA, 19 nt, Homo sapiens
ccagcuagauuggcaagua

SEQ ID NO: 1198317 - RNA, 19 nt, Homo sapiens
caggaacuuugcuuacaua

SEQ ID NO: 1198318 - RNA, 19 nt, Homo sapiens
gaaugagagcuccaucuaa

SEQ ID NO: 1198319 - RNA, 19 nt, Homo sapiens
caacuuagagcaucagguu

SEQ ID NO: 1198320 - RNA, 19 nt, Homo sapiens
ccaguuaauugucccauug

SEQ ID NO: 1198321 - RNA, 19 nt, Homo sapiens
gcaagcgccacaauucuaa

SEQ ID NO: 1198322 - RNA, 19 nt, Homo sapiens
cagaauauguuggaauuuc

SEQ ID NO: 1198323 - RNA, 19 nt, Homo sapiens
ccucggaaguacaaagaua

SEQ ID NO: 1198324 - RNA, 19 nt, Homo sapiens
aaagaguacugaugaaauc

SEQ ID NO: 1198325 - RNA, 19 nt, Homo sapiens
ggcuacaacuugauugaaa

SEQ ID NO: 1198326 - RNA, 19 nt, Homo sapiens
gcccauagaauagcuaaua

SEQ ID NO: 1198327 - RNA, 19 nt, Homo sapiens
ccaccagcuuuaauuguaa

SEQ ID NO: 1198328 - RNA, 19 nt, Homo sapiens
gcacaccauuuacucaauc

SEQ ID NO: 1198329 - RNA, 19 nt, Homo sapiens
gaacaguugcuccaguuau

SEQ ID NO: 1198330 - RNA, 19 nt, Homo sapiens
ggaaugacaacaagaaagu

SEQ ID NO: 1198331 - RNA, 19 nt, Homo sapiens
ggacaaaacuacagcuaau

SEQ ID NO: 1198332 - RNA, 19 nt, Homo sapiens
ugaauaaagggcaaaguuu

SEQ ID NO: 1198333 - RNA, 19 nt, Homo sapiens
ccagugaaauucuacaagu

SEQ ID NO: 1198334 - RNA, 19 nt, Homo sapiens
guucaaggaucuggacauu

SEQ ID NO: 1198335 - RNA, 19 nt, Homo sapiens
gggaaagcagcauaguuua

SEQ ID NO: 1198336 - RNA, 19 nt, Homo sapiens
caucuuggaggucaaauaa

SEQ ID NO: 1198337 - RNA, 19 nt, Homo sapiens
cagcuagauuggcaaguaa

SEQ ID NO: 1198338 - RNA, 19 nt, Homo sapiens
agaacaucaugccuauuua

SEQ ID NO: 1198339 - RNA, 19 nt, Homo sapiens
caacaagaaagugcagaua

SEQ ID NO: 1198340 - RNA, 19 nt, Homo sapiens
gauguguaccuuacucuuu

SEQ ID NO: 1198341 - RNA, 19 nt, Homo sapiens
aagaacaucaugccuauuu

SEQ ID NO: 1198342 - RNA, 19 nt, Homo sapiens
acacaaacucugagaauug

SEQ ID NO: 1198343 - RNA, 19 nt, Homo sapiens
ggucuugugugcuguuguu

SEQ ID NO: 1198344 - RNA, 19 nt, Homo sapiens
gaucagauuagauuaagug

SEQ ID NO: 1198345 - RNA, 19 nt, Homo sapiens
cuacaacuccuaguaauga

SEQ ID NO: 1198346 - RNA, 19 nt, Homo sapiens
ggucuacaacuccuaguaa

SEQ ID NO: 1198347 - RNA, 19 nt, Homo sapiens
gaagcuaccauaagagcaa

SEQ ID NO: 1198348 - RNA, 19 nt, Homo sapiens
cgaaugagagcuccaucua

SEQ ID NO: 1198349 - RNA, 19 nt, Homo sapiens
gcccacagauuggcuuauu

SEQ ID NO: 1198350 - RNA, 19 nt, Homo sapiens
uaacacaaacucugagaau

SEQ ID NO: 1198351 - RNA, 19 nt, Homo sapiens
ccacuccuuuccugcauuu

SEQ ID NO: 1198352 - RNA, 19 nt, Homo sapiens
gugaacaguugcuccaguu

SEQ ID NO: 1198353 - RNA, 19 nt, Homo sapiens
cagaaagaguacugaugaa

SEQ ID NO: 1198354 - RNA, 19 nt, Homo sapiens
gaaccuucauccuuuagag

SEQ ID NO: 1198355 - RNA, 19 nt, Homo sapiens
cgacagggccaaaggagaa

SEQ ID NO: 1198356 - RNA, 19 nt, Homo sapiens
gcuauucauucugccauuu

SEQ ID NO: 1198357 - RNA, 19 nt, Homo sapiens
ugggaaagcagcauaguuu

SEQ ID NO: 1198358 - RNA, 19 nt, Homo sapiens
aaggguaucuggucuacaa

SEQ ID NO: 1198359 - RNA, 19 nt, Homo sapiens
ccuguucgauacuucauaa

SEQ ID NO: 1198360 - RNA, 19 nt, Homo sapiens
gccagaggcagcuaguuua

SEQ ID NO: 1198361 - RNA, 19 nt, Homo sapiens
gaaccuccaccagcuuuaa

SEQ ID NO: 1198362 - RNA, 19 nt, Homo sapiens
gaguugaccucucugauuu

SEQ ID NO: 1198363 - RNA, 19 nt, Homo sapiens
guaaauauuugcugcuuga

SEQ ID NO: 1198364 - RNA, 19 nt, Homo sapiens
ggacugggcugauauguac

SEQ ID NO: 1198365 - RNA, 19 nt, Homo sapiens
acagauagcuuuccaagga

SEQ ID NO: 1198366 - RNA, 19 nt, Homo sapiens
ggaagugucugcugaaugg

SEQ ID NO: 1198367 - RNA, 19 nt, Homo sapiens
gaaggccgcugcuuguuug

SEQ ID NO: 1198368 - RNA, 19 nt, Homo sapiens
gauaagaaccaaugcagaa

SEQ ID NO: 1198369 - RNA, 19 nt, Homo sapiens
ggaggaagaauaaaucuga

SEQ ID NO: 1198370 - RNA, 19 nt, Homo sapiens
cauagcaaguguucaguaa

SEQ ID NO: 1198371 - RNA, 19 nt, Homo sapiens
gcaagagguucauucaaag

SEQ ID NO: 1198372 - RNA, 19 nt, Homo sapiens
gaaacggccuacacacugu

SEQ ID NO: 1198373 - RNA, 19 nt, Homo sapiens
gggcacagcuaacauuauc

SEQ ID NO: 1198374 - RNA, 19 nt, Homo sapiens
uaagcuccuuuaucaguua

SEQ ID NO: 1198375 - RNA, 19 nt, Homo sapiens
ucaaguccaugagccauua

SEQ ID NO: 1198376 - RNA, 19 nt, Homo sapiens
caaaggcccucucucaagu

SEQ ID NO: 1198377 - RNA, 19 nt, Homo sapiens
gauaggaggccauucauuc

SEQ ID NO: 1198378 - RNA, 19 nt, Homo sapiens
aagagaaacucaugggauu

SEQ ID NO: 1198379 - RNA, 19 nt, Homo sapiens
ggaaggccgcugcuuguuu

SEQ ID NO: 1198380 - RNA, 19 nt, Homo sapiens
gaaggaggaugaauaucgu

SEQ ID NO: 1198381 - RNA, 19 nt, Homo sapiens
ccacggagaugcaguuucu

SEQ ID NO: 1198382 - RNA, 19 nt, Homo sapiens
uagcaaguguucaguaaau

SEQ ID NO: 1198383 - RNA, 19 nt, Homo sapiens
cagcugcacuuguuguuga

SEQ ID NO: 1198384 - RNA, 19 nt, Homo sapiens
cccaagagauuuaggauuc

SEQ ID NO: 1198385 - RNA, 19 nt, Homo sapiens
gugguaagcauguuuaauu

SEQ ID NO: 1198386 - RNA, 19 nt, Homo sapiens
ugagaaauaagcuccuuua

SEQ ID NO: 1198387 - RNA, 19 nt, Homo sapiens
cuucaaagcucccaacaca

SEQ ID NO: 1198388 - RNA, 19 nt, Homo sapiens
gcuccagaauuaacaagaa

SEQ ID NO: 1198389 - RNA, 19 nt, Homo sapiens
gaacaauuuccagcacaua

SEQ ID NO: 1198390 - RNA, 19 nt, Homo sapiens
gacacuugcuggucaaaga

SEQ ID NO: 1198391 - RNA, 19 nt, Homo sapiens
ccaggaaggaggaugaaua

SEQ ID NO: 1198392 - RNA, 19 nt, Homo sapiens
agcaagagguucauucaaa

SEQ ID NO: 1198393 - RNA, 19 nt, Homo sapiens
ucaguuagcuguuuuauca

SEQ ID NO: 1198394 - RNA, 19 nt, Homo sapiens
gaacacucucucccaagua

SEQ ID NO: 1198395 - RNA, 19 nt, Homo sapiens
gaacauaagagagcuucaa

SEQ ID NO: 1198396 - RNA, 19 nt, Homo sapiens
gaagcaagagguucauuca

SEQ ID NO: 1198397 - RNA, 19 nt, Homo sapiens
agauagggcucgagcugua

SEQ ID NO: 1198398 - RNA, 19 nt, Homo sapiens
ucccugaccuccugucuaa

SEQ ID NO: 1198399 - RNA, 19 nt, Homo sapiens
gcgcccagcugcacuuguu

SEQ ID NO: 1198400 - RNA, 19 nt, Homo sapiens
ggagaugauuugccuuucu

SEQ ID NO: 1198401 - RNA, 19 nt, Homo sapiens
ggaaagggacagauagcuu

SEQ ID NO: 1198402 - RNA, 19 nt, Homo sapiens
gcaugguguuugucucgua

SEQ ID NO: 1198403 - RNA, 19 nt, Homo sapiens
gaagaaggcccaggagaca

SEQ ID NO: 1198404 - RNA, 19 nt, Homo sapiens
gcaaguguucaguaaauau

SEQ ID NO: 1198405 - RNA, 19 nt, Homo sapiens
gagaugauuugccuuucug

SEQ ID NO: 1198406 - RNA, 19 nt, Homo sapiens
gagguucauucaaagagaa

SEQ ID NO: 1198407 - RNA, 19 nt, Homo sapiens
caugagccauuaucuagga

SEQ ID NO: 1198408 - RNA, 19 nt, Homo sapiens
ucaaagcucccaacacaga

SEQ ID NO: 1198409 - RNA, 19 nt, Homo sapiens
gaaccaaugcagaagauag

SEQ ID NO: 1198410 - RNA, 19 nt, Homo sapiens
ggaaggaggaugaauaucg

SEQ ID NO: 1198411 - RNA, 19 nt, Homo sapiens
gaaacucaugggauuugua

SEQ ID NO: 1198412 - RNA, 19 nt, Homo sapiens
ccucugaguuggaaguuga

SEQ ID NO: 1198413 - RNA, 19 nt, Homo sapiens
gauacuuucucucucuuuc

SEQ ID NO: 1198414 - RNA, 19 nt, Homo sapiens
gauauguacucggucaaug

SEQ ID NO: 1198415 - RNA, 19 nt, Homo sapiens
agugugacguggugaauuu

SEQ ID NO: 1198416 - RNA, 19 nt, Homo sapiens
agaaggagguucgaaagga

SEQ ID NO: 1198417 - RNA, 19 nt, Homo sapiens
gaauguuaaucaacuuugg

SEQ ID NO: 1198418 - RNA, 19 nt, Homo sapiens
gcucaucacuguggucauc

SEQ ID NO: 1198419 - RNA, 19 nt, Homo sapiens
gcacauagcaaguguucag

SEQ ID NO: 1198420 - RNA, 19 nt, Homo sapiens
aaacucaugggauuuguaa

SEQ ID NO: 1198421 - RNA, 19 nt, Homo sapiens
gagaaacucaugggauuug

SEQ ID NO: 1198422 - RNA, 19 nt, Homo sapiens
uaagugguaagcauguuua

SEQ ID NO: 1198423 - RNA, 19 nt, Homo sapiens
ggccaaaggcugugaggaa

SEQ ID NO: 1198424 - RNA, 19 nt, Homo sapiens
cuuaauaggacacuguaua

SEQ ID NO: 1198425 - RNA, 19 nt, Homo sapiens
gcaaaucuggcaugguguu

SEQ ID NO: 1198426 - RNA, 19 nt, Homo sapiens
ccucuucaauccuggguuu

SEQ ID NO: 1198427 - RNA, 19 nt, Homo sapiens
ccagugucaucaacaguga

SEQ ID NO: 1198428 - RNA, 19 nt, Homo sapiens
gccaaaggcugugaggaau

SEQ ID NO: 1198429 - RNA, 19 nt, Homo sapiens
aauauuugcugcuugaauc

SEQ ID NO: 1198430 - RNA, 19 nt, Homo sapiens
auaggacacuguauaacuu

SEQ ID NO: 1198431 - RNA, 19 nt, Homo sapiens
ggaagcaagagguucauuc

SEQ ID NO: 1198432 - RNA, 19 nt, Homo sapiens
gagcucaggcccucaggaa

SEQ ID NO: 1198433 - RNA, 19 nt, Homo sapiens
gcaguucaaagcccaggua

SEQ ID NO: 1198434 - RNA, 19 nt, Homo sapiens
guucacuccuucuuccauu

SEQ ID NO: 1198435 - RNA, 19 nt, Homo sapiens
cugcuauaauuucuccuua

SEQ ID NO: 1198436 - RNA, 19 nt, Homo sapiens
ucuaagacuucugaucaaa

SEQ ID NO: 1198437 - RNA, 19 nt, Homo sapiens
ccaccuccuuuccaaguga

SEQ ID NO: 1198438 - RNA, 19 nt, Homo sapiens
caucaacagugagcaaauc

SEQ ID NO: 1198439 - RNA, 19 nt, Homo sapiens
cagaucugcugccugagaa

SEQ ID NO: 1198440 - RNA, 19 nt, Homo sapiens
acagugcccuggaacauca

SEQ ID NO: 1198441 - RNA, 19 nt, Homo sapiens
ggacuggaagcaagagguu

SEQ ID NO: 1198442 - RNA, 19 nt, Homo sapiens
gacaugagacugugcaaag

SEQ ID NO: 1198443 - RNA, 19 nt, Homo sapiens
gcaauguuccaacccaguu

SEQ ID NO: 1198444 - RNA, 19 nt, Homo sapiens
guucaaagcccagguaucu

SEQ ID NO: 1198445 - RNA, 19 nt, Homo sapiens
gaauaucgucggaacaucu

SEQ ID NO: 1198446 - RNA, 19 nt, Homo sapiens
ucacuccuucuuccauuua

SEQ ID NO: 1198447 - RNA, 19 nt, Homo sapiens
ugauuugccuuucugaaca

SEQ ID NO: 1198448 - RNA, 19 nt, Homo sapiens
ggugggaggaugcguugua

SEQ ID NO: 1198449 - RNA, 19 nt, Homo sapiens
ggauaggaggccauucauu

SEQ ID NO: 1198450 - RNA, 19 nt, Homo sapiens
ggucaucgccuucuucacu

SEQ ID NO: 1198451 - RNA, 19 nt, Homo sapiens
ccaaaggcccucucucaag

SEQ ID NO: 1198452 - RNA, 19 nt, Homo sapiens
caggaaggaggaugaauau

SEQ ID NO: 1198453 - RNA, 19 nt, Homo sapiens
cccuuacucugcuauaauu

SEQ ID NO: 1198454 - RNA, 19 nt, Homo sapiens
caagagguucauucaaaga

SEQ ID NO: 1198455 - RNA, 19 nt, Homo sapiens
guugauacagcauaaguga

SEQ ID NO: 1198456 - RNA, 19 nt, Homo sapiens
ggguuaaucccucuuuguu

SEQ ID NO: 1198457 - RNA, 19 nt, Homo sapiens
acagucggcugcuccuuug

SEQ ID NO: 1198458 - RNA, 19 nt, Homo sapiens
ucacacuucccuuuccuaa

SEQ ID NO: 1198459 - RNA, 19 nt, Homo sapiens
ggacaugagacugugcaaa

SEQ ID NO: 1198460 - RNA, 19 nt, Homo sapiens
guguuugucucguacaguu

SEQ ID NO: 1198461 - RNA, 19 nt, Homo sapiens
gccaugaugcuucccauug

SEQ ID NO: 1198462 - RNA, 19 nt, Homo sapiens
gaaagaagcccacauagaa

SEQ ID NO: 1198463 - RNA, 19 nt, Homo sapiens
gaagauugcugccuuuauu

SEQ ID NO: 1198464 - RNA, 19 nt, Homo sapiens
ggucaaagcugcccugaaa

SEQ ID NO: 1198465 - RNA, 19 nt, Homo sapiens
gaagcuaccugauuuauuc

SEQ ID NO: 1198466 - RNA, 19 nt, Homo sapiens
aaacaaagaugcugaaaga

SEQ ID NO: 1198467 - RNA, 19 nt, Homo sapiens
gaaaguggcagaauaugua

SEQ ID NO: 1198468 - RNA, 19 nt, Homo sapiens
gcucugggauggaauauuu

SEQ ID NO: 1198469 - RNA, 19 nt, Homo sapiens
guaagaggcucaagacaug

SEQ ID NO: 1198470 - RNA, 19 nt, Homo sapiens
gaugcgauguccagaguua

SEQ ID NO: 1198471 - RNA, 19 nt, Homo sapiens
guuuauagcugaugaaguu

SEQ ID NO: 1198472 - RNA, 19 nt, Homo sapiens
ugaagaagaugcaaaguuc

SEQ ID NO: 1198473 - RNA, 19 nt, Homo sapiens
gagauuagcccauauaagu

SEQ ID NO: 1198474 - RNA, 19 nt, Homo sapiens
caaauuagagagcaaagua

SEQ ID NO: 1198475 - RNA, 19 nt, Homo sapiens
cagaauaaaccaagugaua

SEQ ID NO: 1198476 - RNA, 19 nt, Homo sapiens
ggaauugucaguuuagauu

SEQ ID NO: 1198477 - RNA, 19 nt, Homo sapiens
gauguauggugaagacuuu

SEQ ID NO: 1198478 - RNA, 19 nt, Homo sapiens
agauuuaccucucauguuu

SEQ ID NO: 1198479 - RNA, 19 nt, Homo sapiens
caaaccaugucaagauuau

SEQ ID NO: 1198480 - RNA, 19 nt, Homo sapiens
gauaggauucuaacaguuu

SEQ ID NO: 1198481 - RNA, 19 nt, Homo sapiens
ggaccaacuugauaggauu

SEQ ID NO: 1198482 - RNA, 19 nt, Homo sapiens
ccaagagaguagggaauua

SEQ ID NO: 1198483 - RNA, 19 nt, Homo sapiens
gguaacaaccaaagaaauu

SEQ ID NO: 1198484 - RNA, 19 nt, Homo sapiens
ggcaguacauguuugauga

SEQ ID NO: 1198485 - RNA, 19 nt, Homo sapiens
ucaaggaaaugccaagaga

SEQ ID NO: 1198486 - RNA, 19 nt, Homo sapiens
gaggaaauccaguaucuug

SEQ ID NO: 1198487 - RNA, 19 nt, Homo sapiens
uaacaggugccuucacuuu

SEQ ID NO: 1198488 - RNA, 19 nt, Homo sapiens
gaauugauuuagugaagga

SEQ ID NO: 1198489 - RNA, 19 nt, Homo sapiens
gcugaaagaagcccacaua

SEQ ID NO: 1198490 - RNA, 19 nt, Homo sapiens
ggucaccuaucauccuuaa

SEQ ID NO: 1198491 - RNA, 19 nt, Homo sapiens
cagcaacucugccggagaa

SEQ ID NO: 1198492 - RNA, 19 nt, Homo sapiens
gacucuagccuguuaauuu

SEQ ID NO: 1198493 - RNA, 19 nt, Homo sapiens
cgauggaccucauagaaau

SEQ ID NO: 1198494 - RNA, 19 nt, Homo sapiens
ugugcgagcuguacaguaa

SEQ ID NO: 1198495 - RNA, 19 nt, Homo sapiens
gauuagcccauauaaguuu

SEQ ID NO: 1198496 - RNA, 19 nt, Homo sapiens
cagauggaacugcuaaaua

SEQ ID NO: 1198497 - RNA, 19 nt, Homo sapiens
ugagaauacuccaugcaaa

SEQ ID NO: 1198498 - RNA, 19 nt, Homo sapiens
cucaagacaugacugauuu

SEQ ID NO: 1198499 - RNA, 19 nt, Homo sapiens
uaaacacacuuugauagga

SEQ ID NO: 1198500 - RNA, 19 nt, Homo sapiens
gcucaagacaugacugauu

SEQ ID NO: 1198501 - RNA, 19 nt, Homo sapiens
cagcaccacugacuccaaa

SEQ ID NO: 1198502 - RNA, 19 nt, Homo sapiens
ugaagaugcucauaacagu

SEQ ID NO: 1198503 - RNA, 19 nt, Homo sapiens
caccaacuccagauacuua

SEQ ID NO: 1198504 - RNA, 19 nt, Homo sapiens
ucaccuaucauccuuaauu

SEQ ID NO: 1198505 - RNA, 19 nt, Homo sapiens
gaaagugugaccucugaga

SEQ ID NO: 1198506 - RNA, 19 nt, Homo sapiens
agacaugacugauuugcau

SEQ ID NO: 1198507 - RNA, 19 nt, Homo sapiens
ugaaagaagcccacauaga

SEQ ID NO: 1198508 - RNA, 19 nt, Homo sapiens
ccgaaagugugaccucuga

SEQ ID NO: 1198509 - RNA, 19 nt, Homo sapiens
ccagaaaguggcagaauau

SEQ ID NO: 1198510 - RNA, 19 nt, Homo sapiens
uccagaaaguggcagaaua

SEQ ID NO: 1198511 - RNA, 19 nt, Homo sapiens
ccagauacuuacagaggaa

SEQ ID NO: 1198512 - RNA, 19 nt, Homo sapiens
gaaaaucccagcagaaaga

SEQ ID NO: 1198513 - RNA, 19 nt, Homo sapiens
caacuugauaggauucuaa

SEQ ID NO: 1198514 - RNA, 19 nt, Homo sapiens
aauggaaugugcacggaua

SEQ ID NO: 1198515 - RNA, 19 nt, Homo sapiens
gcagaaagagaaauggaau

SEQ ID NO: 1198516 - RNA, 19 nt, Homo sapiens
ggaaaugccaagagaguag

SEQ ID NO: 1198517 - RNA, 19 nt, Homo sapiens
guacauguuugaugagaac

SEQ ID NO: 1198518 - RNA, 19 nt, Homo sapiens
ggaaauccaguaucuugug

SEQ ID NO: 1198519 - RNA, 19 nt, Homo sapiens
gcagaguugggaaacauuu

SEQ ID NO: 1198520 - RNA, 19 nt, Homo sapiens
agauggaacugcuaaauac

SEQ ID NO: 1198521 - RNA, 19 nt, Homo sapiens
ugagaacggugaacaguac

SEQ ID NO: 1198522 - RNA, 19 nt, Homo sapiens
gcuaaacacacuuugauag

SEQ ID NO: 1198523 - RNA, 19 nt, Homo sapiens
gaaaggaaaagaugucaaa

SEQ ID NO: 1198524 - RNA, 19 nt, Homo sapiens
ccucauagaaauguacuua

SEQ ID NO: 1198525 - RNA, 19 nt, Homo sapiens
cagcagcucugggauggaa

SEQ ID NO: 1198526 - RNA, 19 nt, Homo sapiens
aaacagauggaacugcuaa

SEQ ID NO: 1198527 - RNA, 19 nt, Homo sapiens
ggaagauugcugccuuuau

SEQ ID NO: 1198528 - RNA, 19 nt, Homo sapiens
ucaaaccaugucaagauua

SEQ ID NO: 1198529 - RNA, 19 nt, Homo sapiens
aagguggaauugucaguuu

SEQ ID NO: 1198530 - RNA, 19 nt, Homo sapiens
agugugaccucugagaaua

SEQ ID NO: 1198531 - RNA, 19 nt, Homo sapiens
caccuaucauccuuaauug

SEQ ID NO: 1198532 - RNA, 19 nt, Homo sapiens
gccaaacgccuuucagcaa

SEQ ID NO: 1198533 - RNA, 19 nt, Homo sapiens
uggaacugcuaaauacaaa

SEQ ID NO: 1198534 - RNA, 19 nt, Homo sapiens
gcuaccugauuuauucuau

SEQ ID NO: 1198535 - RNA, 19 nt, Homo sapiens
uuacagagaaugaguagau

SEQ ID NO: 1198536 - RNA, 19 nt, Homo sapiens
uaauacguauggaggaaau

SEQ ID NO: 1198537 - RNA, 19 nt, Homo sapiens
cugaauccaugcagaguug

SEQ ID NO: 1198538 - RNA, 19 nt, Homo sapiens
agaagaccaugcagacuca

SEQ ID NO: 1198539 - RNA, 19 nt, Homo sapiens
ccagaggcaguacauguuu

SEQ ID NO: 1198540 - RNA, 19 nt, Homo sapiens
gguaaaugaguaaucagaa

SEQ ID NO: 1198541 - RNA, 19 nt, Homo sapiens
gaagaagaugcaaaguuca

SEQ ID NO: 1198542 - RNA, 19 nt, Homo sapiens
cagcacaucaucuacaaga

SEQ ID NO: 1198543 - RNA, 19 nt, Homo sapiens
guaacaaccaaagaaauug

SEQ ID NO: 1198544 - RNA, 19 nt, Homo sapiens
gcucauaacaguggaagga

SEQ ID NO: 1198545 - RNA, 19 nt, Homo sapiens
gaacggugaacaguacuug

SEQ ID NO: 1198546 - RNA, 19 nt, Homo sapiens
uauaacaggugccuucacu

SEQ ID NO: 1198547 - RNA, 19 nt, Homo sapiens
gcagauuuaccucucaugu

SEQ ID NO: 1198548 - RNA, 19 nt, Homo sapiens
gcucuauuauaccucuaaa

SEQ ID NO: 1198549 - RNA, 19 nt, Homo sapiens
aaacagaaggcuaaacaca

SEQ ID NO: 1198550 - RNA, 19 nt, Homo sapiens
gaaacagauggaacugcua

SEQ ID NO: 1198551 - RNA, 19 nt, Homo sapiens
caagagaguagggaauuau

SEQ ID NO: 1198552 - RNA, 19 nt, Homo sapiens
gcagcucugggauggaaua

SEQ ID NO: 1198553 - RNA, 19 nt, Homo sapiens
gcccauauaaguuucagaa

SEQ ID NO: 1198554 - RNA, 19 nt, Homo sapiens
aaucaaaccaugucaagau

SEQ ID NO: 1198555 - RNA, 19 nt, Homo sapiens
guccagaguuacagagaau

SEQ ID NO: 1198556 - RNA, 19 nt, Homo sapiens
ugauaggauucuaacaguu

SEQ ID NO: 1198557 - RNA, 19 nt, Homo sapiens
ccagauguauggugaagac

SEQ ID NO: 1198558 - RNA, 19 nt, Homo sapiens
gcaggcuacuuccagaaag

SEQ ID NO: 1198559 - RNA, 19 nt, Homo sapiens
uucagacucuagccuguua

SEQ ID NO: 1198560 - RNA, 19 nt, Homo sapiens
acaaagaugcugaaagaag

SEQ ID NO: 1198561 - RNA, 19 nt, Homo sapiens
uccaguaucuugugcuguu

SEQ ID NO: 1198562 - RNA, 19 nt, Homo sapiens
caaaguagauggacagaaa

SEQ ID NO: 1198563 - RNA, 19 nt, Homo sapiens
gcaauaaagcugcuaguuu

SEQ ID NO: 1198564 - RNA, 19 nt, Homo sapiens
uagaagagaugguuauaga

SEQ ID NO: 1198565 - RNA, 19 nt, Homo sapiens
ggugaugucucccucagua

SEQ ID NO: 1198566 - RNA, 19 nt, Homo sapiens
caucauuucuuacagguuu

SEQ ID NO: 1198567 - RNA, 19 nt, Homo sapiens
gcaaaagacucaaaguaga

SEQ ID NO: 1198568 - RNA, 19 nt, Homo sapiens
gaacaggcaaccaagagaa

SEQ ID NO: 1198569 - RNA, 19 nt, Homo sapiens
gaagagaggccagaaacug

SEQ ID NO: 1198570 - RNA, 19 nt, Homo sapiens
gcugugaucuugaccucuu

SEQ ID NO: 1198571 - RNA, 19 nt, Homo sapiens
gcugcuaguuuauuaauac

SEQ ID NO: 1198572 - RNA, 19 nt, Homo sapiens
cugaagcccuggacuuuga

SEQ ID NO: 1198573 - RNA, 19 nt, Homo sapiens
ggaucugggugacuuggaa

SEQ ID NO: 1198574 - RNA, 19 nt, Homo sapiens
guccauggcugugaucuug

SEQ ID NO: 1198575 - RNA, 19 nt, Homo sapiens
gagaggcugucuugucaca

SEQ ID NO: 1198576 - RNA, 19 nt, Homo sapiens
caucucaagugaagacaug

SEQ ID NO: 1198577 - RNA, 19 nt, Homo sapiens
uggcagaggugcuuguguu

SEQ ID NO: 1198578 - RNA, 19 nt, Homo sapiens
gaagacaggguagaagaga

SEQ ID NO: 1198579 - RNA, 19 nt, Homo sapiens
cccaaaggcuccagaaucu

SEQ ID NO: 1198580 - RNA, 19 nt, Homo sapiens
ucgagaggcugucuuguca

SEQ ID NO: 1198581 - RNA, 19 nt, Homo sapiens
gggaaggccucggaacuag

SEQ ID NO: 1198582 - RNA, 19 nt, Homo sapiens
gggcacaaaugauaaagcu

SEQ ID NO: 1198583 - RNA, 19 nt, Homo sapiens
gaacuacgagcugcgagaa

SEQ ID NO: 1198584 - RNA, 19 nt, Homo sapiens
gcaauucgacaucucaagu

SEQ ID NO: 1198585 - RNA, 19 nt, Homo sapiens
caggaggucuucacagagu

SEQ ID NO: 1198586 - RNA, 19 nt, Homo sapiens
gguagaagagaugguuaua

SEQ ID NO: 1198587 - RNA, 19 nt, Homo sapiens
gagaaaggcccagggacuu

SEQ ID NO: 1198588 - RNA, 19 nt, Homo sapiens
uauagagguuggagagaug

SEQ ID NO: 1198589 - RNA, 19 nt, Homo sapiens
gggaagacaggguagaaga

SEQ ID NO: 1198590 - RNA, 19 nt, Homo sapiens
caagagaacgcggucagaa

SEQ ID NO: 1198591 - RNA, 19 nt, Homo sapiens
gcucuuccauaaauagcuu

SEQ ID NO: 1198592 - RNA, 19 nt, Homo sapiens
caaggacaagggaguguuu

SEQ ID NO: 1198593 - RNA, 19 nt, Homo sapiens
gagcagcagccaauuacug

SEQ ID NO: 1198594 - RNA, 19 nt, Homo sapiens
agagaugguuauagagguu

SEQ ID NO: 1198595 - RNA, 19 nt, Homo sapiens
caagggaguguuugccauu

SEQ ID NO: 1198596 - RNA, 19 nt, Homo sapiens
gccgagcagcagccaauua

SEQ ID NO: 1198597 - RNA, 19 nt, Homo sapiens
ugcaggaggucuucacaga

SEQ ID NO: 1198598 - RNA, 19 nt, Homo sapiens
gacaugaggcagcccaaga

SEQ ID NO: 1198599 - RNA, 19 nt, Homo sapiens
ugucccagcucacccagaa

SEQ ID NO: 1198600 - RNA, 19 nt, Homo sapiens
gggaguguuugccauugug

SEQ ID NO: 1198601 - RNA, 19 nt, Homo sapiens
cagccuugaugcccacuug

SEQ ID NO: 1198602 - RNA, 19 nt, Homo sapiens
caaggccuguucccugauc

SEQ ID NO: 1198603 - RNA, 19 nt, Homo sapiens
ugaggcagcccaagaaugg

SEQ ID NO: 1198604 - RNA, 19 nt, Homo sapiens
aagagaggccagaaacuga

SEQ ID NO: 1198605 - RNA, 19 nt, Homo sapiens
ccauaaauagcuucgaugu

SEQ ID NO: 1198606 - RNA, 19 nt, Homo sapiens
ugaguacuuccuagcauuu

SEQ ID NO: 1198607 - RNA, 19 nt, Homo sapiens
ggaagacaggguagaagag

SEQ ID NO: 1198608 - RNA, 19 nt, Homo sapiens
guucuucuccuguguaucu

SEQ ID NO: 1198609 - RNA, 19 nt, Homo sapiens
guaacuacgcccugaccuu

SEQ ID NO: 1198610 - RNA, 19 nt, Homo sapiens
gaaggccucggaacuagca

SEQ ID NO: 1198611 - RNA, 19 nt, Homo sapiens
cugaguacuuccuagcauu

SEQ ID NO: 1198612 - RNA, 19 nt, Homo sapiens
guacaggagagucgcuaug

SEQ ID NO: 1198613 - RNA, 19 nt, Homo sapiens
caagcaauucgacaucuca

SEQ ID NO: 1198614 - RNA, 19 nt, Homo sapiens
uuuccucccucaagcaauu

SEQ ID NO: 1198615 - RNA, 19 nt, Homo sapiens
gcgaagagaggccagaaac

SEQ ID NO: 1198616 - RNA, 19 nt, Homo sapiens
gccgaagccuccaguacca

SEQ ID NO: 1198617 - RNA, 19 nt, Homo sapiens
ggcaauaaagcugcuaguu

SEQ ID NO: 1198618 - RNA, 19 nt, Homo sapiens
aauucgacaucucaaguga

SEQ ID NO: 1198619 - RNA, 19 nt, Homo sapiens
caaccgacccagccuugau

SEQ ID NO: 1198620 - RNA, 19 nt, Homo sapiens
uuauagagguuggagagau

SEQ ID NO: 1198621 - RNA, 19 nt, Homo sapiens
cugcuacgccgaucccuuu

SEQ ID NO: 1198622 - RNA, 19 nt, Homo sapiens
caaugucgcagccaaugug

SEQ ID NO: 1198623 - RNA, 19 nt, Homo sapiens
gagcuggugggauccauuc

SEQ ID NO: 1198624 - RNA, 19 nt, Homo sapiens
guagaagagaugguuauag

SEQ ID NO: 1198625 - RNA, 19 nt, Homo sapiens
gagaacgcggucagaagga

SEQ ID NO: 1198626 - RNA, 19 nt, Homo sapiens
gggccugccuucuaaucuc

SEQ ID NO: 1198627 - RNA, 19 nt, Homo sapiens
cugcauaacucccguuucc

SEQ ID NO: 1198628 - RNA, 19 nt, Homo sapiens
guggucaaguucugucauc

SEQ ID NO: 1198629 - RNA, 19 nt, Homo sapiens
ccuuuuggcucuuccauaa

SEQ ID NO: 1198630 - RNA, 19 nt, Homo sapiens
gcauggagccccuggagaa

SEQ ID NO: 1198631 - RNA, 19 nt, Homo sapiens
ggcagaggugcuuguguuu

SEQ ID NO: 1198632 - RNA, 19 nt, Homo sapiens
gcaccggcaccugguagaa

SEQ ID NO: 1198633 - RNA, 19 nt, Homo sapiens
ggguagaagagaugguuau

SEQ ID NO: 1198634 - RNA, 19 nt, Homo sapiens
ccaguucuucuccugugua

SEQ ID NO: 1198635 - RNA, 19 nt, Homo sapiens
cacgggagcagaaggaguu

SEQ ID NO: 1198636 - RNA, 19 nt, Homo sapiens
agacaggguagaagagaug

SEQ ID NO: 1198637 - RNA, 19 nt, Homo sapiens
gaacuggggaguccucuca

SEQ ID NO: 1198638 - RNA, 19 nt, Homo sapiens
caguucuucuccuguguau

SEQ ID NO: 1198639 - RNA, 19 nt, Homo sapiens
caauucgacaucucaagug

SEQ ID NO: 1198640 - RNA, 19 nt, Homo sapiens
ucaagcaauucgacaucuc

SEQ ID NO: 1198641 - RNA, 19 nt, Homo sapiens
ggauucugcucagcucucu

SEQ ID NO: 1198642 - RNA, 19 nt, Homo sapiens
ggucuucacagaguucuuc

SEQ ID NO: 1198643 - RNA, 19 nt, Homo sapiens
ggaggucuucacagaguuc

SEQ ID NO: 1198644 - RNA, 19 nt, Homo sapiens
ccuguucccugaucuccau

SEQ ID NO: 1198645 - RNA, 19 nt, Homo sapiens
acaugaggcagcccaagaa

SEQ ID NO: 1198646 - RNA, 19 nt, Homo sapiens
ccacuugggaggcagaaag

SEQ ID NO: 1198647 - RNA, 19 nt, Homo sapiens
ucagggagggacaagcaaa

SEQ ID NO: 1198648 - RNA, 19 nt, Homo sapiens
ucuccuguguaucuuguug

SEQ ID NO: 1198649 - RNA, 19 nt, Homo sapiens
ggaacagguggaagucgau

SEQ ID NO: 1198650 - RNA, 19 nt, Homo sapiens
uguaucgaguccaaacugu

SEQ ID NO: 1198651 - RNA, 19 nt, Homo sapiens
gaagcccuggacuuugaaa

SEQ ID NO: 1198652 - RNA, 19 nt, Homo sapiens
cgacaucucaagugaagac

SEQ ID NO: 1198653 - RNA, 19 nt, Homo sapiens
gcccuguggucaaguucug

SEQ ID NO: 1198654 - RNA, 19 nt, Homo sapiens
ggagcuggugggauccauu

SEQ ID NO: 1198655 - RNA, 19 nt, Homo sapiens
gaaccaauccuaaagaaua

SEQ ID NO: 1198656 - RNA, 19 nt, Homo sapiens
ggagauggaugaaauuaaa

SEQ ID NO: 1198657 - RNA, 19 nt, Homo sapiens
gaaacccacugacuuuaaa

SEQ ID NO: 1198658 - RNA, 19 nt, Homo sapiens
gugcucaucuucagacuua

SEQ ID NO: 1198659 - RNA, 19 nt, Homo sapiens
gaucuagucuuuacuuuca

SEQ ID NO: 1198660 - RNA, 19 nt, Homo sapiens
uuacacaucuguucacuuu

SEQ ID NO: 1198661 - RNA, 19 nt, Homo sapiens
gaagagaauuugggauuug

SEQ ID NO: 1198662 - RNA, 19 nt, Homo sapiens
uagauaggaucgccauuua

SEQ ID NO: 1198663 - RNA, 19 nt, Homo sapiens
gaugaugauucuaggguua

SEQ ID NO: 1198664 - RNA, 19 nt, Homo sapiens
gcagcuaucuucuuugaau

SEQ ID NO: 1198665 - RNA, 19 nt, Homo sapiens
gucaguaccuggccuauuu

SEQ ID NO: 1198666 - RNA, 19 nt, Homo sapiens
caagaaacccacugacuuu

SEQ ID NO: 1198667 - RNA, 19 nt, Homo sapiens
ucgauuagcuguucuucua

SEQ ID NO: 1198668 - RNA, 19 nt, Homo sapiens
gugcaucgaucccuauauu

SEQ ID NO: 1198669 - RNA, 19 nt, Homo sapiens
gauaggaucgccauuuauu

SEQ ID NO: 1198670 - RNA, 19 nt, Homo sapiens
ggaaugauccugacaugau

SEQ ID NO: 1198671 - RNA, 19 nt, Homo sapiens
ugaagaagcuagaaccaau

SEQ ID NO: 1198672 - RNA, 19 nt, Homo sapiens
gauauuagcaagacaucua

SEQ ID NO: 1198673 - RNA, 19 nt, Homo sapiens
cacaugagguggauauuug

SEQ ID NO: 1198674 - RNA, 19 nt, Homo sapiens
ugaagaagaugaagaagag

SEQ ID NO: 1198675 - RNA, 19 nt, Homo sapiens
gaccaguucugcugccuaa

SEQ ID NO: 1198676 - RNA, 19 nt, Homo sapiens
gaaugauccugacaugaug

SEQ ID NO: 1198677 - RNA, 19 nt, Homo sapiens
auacugacauucauccaua

SEQ ID NO: 1198678 - RNA, 19 nt, Homo sapiens
gcaauaagaaugugcuaga

SEQ ID NO: 1198679 - RNA, 19 nt, Homo sapiens
gagaucuagucuuuacuuu

SEQ ID NO: 1198680 - RNA, 19 nt, Homo sapiens
agacuuaacuccugugcaa

SEQ ID NO: 1198681 - RNA, 19 nt, Homo sapiens
gugcagcuaucuucuuuga

SEQ ID NO: 1198682 - RNA, 19 nt, Homo sapiens
cuagacggauguuaauaaa

SEQ ID NO: 1198683 - RNA, 19 nt, Homo sapiens
ggucauuagcuuacuauaa

SEQ ID NO: 1198684 - RNA, 19 nt, Homo sapiens
uuagauggguuuacaaugu

SEQ ID NO: 1198685 - RNA, 19 nt, Homo sapiens
gaagcuagaaccaauccua

SEQ ID NO: 1198686 - RNA, 19 nt, Homo sapiens
gguuuacaaugucuucuaa

SEQ ID NO: 1198687 - RNA, 19 nt, Homo sapiens
gaaccuggaacuucuguga

SEQ ID NO: 1198688 - RNA, 19 nt, Homo sapiens
gaauuugggauuugaagaa

SEQ ID NO: 1198689 - RNA, 19 nt, Homo sapiens
gcaggucauuagcuuacua

SEQ ID NO: 1198690 - RNA, 19 nt, Homo sapiens
gaaaauaugcaggucauua

SEQ ID NO: 1198691 - RNA, 19 nt, Homo sapiens
gaaggucugucuggauguu

SEQ ID NO: 1198692 - RNA, 19 nt, Homo sapiens
ggcccaagcucaacacaau

SEQ ID NO: 1198693 - RNA, 19 nt, Homo sapiens
gcauaccucuucuuacagu

SEQ ID NO: 1198694 - RNA, 19 nt, Homo sapiens
uguaaucacccuagucaua

SEQ ID NO: 1198695 - RNA, 19 nt, Homo sapiens
ccagaugaccagauuguuu

SEQ ID NO: 1198696 - RNA, 19 nt, Homo sapiens
guagauaggaucgccauuu

SEQ ID NO: 1198697 - RNA, 19 nt, Homo sapiens
gguuguagcugugauuguu

SEQ ID NO: 1198698 - RNA, 19 nt, Homo sapiens
agaaaccacuuuaucuuca

SEQ ID NO: 1198699 - RNA, 19 nt, Homo sapiens
uagaaccaauccuaaagaa

SEQ ID NO: 1198700 - RNA, 19 nt, Homo sapiens
cgccauuuauuuccuauuu

SEQ ID NO: 1198701 - RNA, 19 nt, Homo sapiens
gaucgccauuuauuuccua

SEQ ID NO: 1198702 - RNA, 19 nt, Homo sapiens
auaagaaugugcuagaguu

SEQ ID NO: 1198703 - RNA, 19 nt, Homo sapiens
gaaaccacuuuaucuucau

SEQ ID NO: 1198704 - RNA, 19 nt, Homo sapiens
agaagagaauuugggauuu

SEQ ID NO: 1198705 - RNA, 19 nt, Homo sapiens
cugcauaccucuucuuaca

SEQ ID NO: 1198706 - RNA, 19 nt, Homo sapiens
gucagaugcuaacgagaua

SEQ ID NO: 1198707 - RNA, 19 nt, Homo sapiens
ccucugaaguggccuaaau

SEQ ID NO: 1198708 - RNA, 19 nt, Homo sapiens
uaaauucacccugaucuga

SEQ ID NO: 1198709 - RNA, 19 nt, Homo sapiens
ccaagaaaccacuuuaucu

SEQ ID NO: 1198710 - RNA, 19 nt, Homo sapiens
aaaccugggccaauuguaa

SEQ ID NO: 1198711 - RNA, 19 nt, Homo sapiens
gaacuucugugaauuuuac

SEQ ID NO: 1198712 - RNA, 19 nt, Homo sapiens
acauugagcuccagaagca

SEQ ID NO: 1198713 - RNA, 19 nt, Homo sapiens
cacacagucucaagaagaa

SEQ ID NO: 1198714 - RNA, 19 nt, Homo sapiens
guacacaugagguggauau

SEQ ID NO: 1198715 - RNA, 19 nt, Homo sapiens
ggaaccaucucaaaauaau

SEQ ID NO: 1198716 - RNA, 19 nt, Homo sapiens
gacuuaacgucaagcuuug

SEQ ID NO: 1198717 - RNA, 19 nt, Homo sapiens
ccacacagucucaagaaga

SEQ ID NO: 1198718 - RNA, 19 nt, Homo sapiens
uaauuuaccacuacuccua

SEQ ID NO: 1198719 - RNA, 19 nt, Homo sapiens
gcacaucacacugacguau

SEQ ID NO: 1198720 - RNA, 19 nt, Homo sapiens
uacuuucaguugucuguua

SEQ ID NO: 1198721 - RNA, 19 nt, Homo sapiens
caaaggugcagcuaucuuc

SEQ ID NO: 1198722 - RNA, 19 nt, Homo sapiens
uagcuguucuucuacauca

SEQ ID NO: 1198723 - RNA, 19 nt, Homo sapiens
ugaccaagaaaccacuuua

SEQ ID NO: 1198724 - RNA, 19 nt, Homo sapiens
gaauucccauuugauguuc

SEQ ID NO: 1198725 - RNA, 19 nt, Homo sapiens
gguccauucuguuuacuag

SEQ ID NO: 1198726 - RNA, 19 nt, Homo sapiens
ucuguuagguccauucugu

SEQ ID NO: 1198727 - RNA, 19 nt, Homo sapiens
gcgccgacuucgacucuug

SEQ ID NO: 1198728 - RNA, 19 nt, Homo sapiens
gauuagcuguucuucuaca

SEQ ID NO: 1198729 - RNA, 19 nt, Homo sapiens
caagacaucuacaaaagga

SEQ ID NO: 1198730 - RNA, 19 nt, Homo sapiens
ugaauucacagaagaacaa

SEQ ID NO: 1198731 - RNA, 19 nt, Homo sapiens
agaaacccacugacuuuaa

SEQ ID NO: 1198732 - RNA, 19 nt, Homo sapiens
acaagaaacccacugacuu

SEQ ID NO: 1198733 - RNA, 19 nt, Homo sapiens
aagaagagaauuugggauu

SEQ ID NO: 1198734 - RNA, 19 nt, Homo sapiens
gauauuugauacacagaac

SEQ ID NO: 1198735 - RNA, 19 nt, Homo sapiens
caucacauuguuacucuuu

SEQ ID NO: 1198736 - RNA, 19 nt, Homo sapiens
uaagaaugugcuagaguuu

SEQ ID NO: 1198737 - RNA, 19 nt, Homo sapiens
cagacuuaauacagcaaua

SEQ ID NO: 1198738 - RNA, 19 nt, Homo sapiens
cagcuaucuucuuugaauu

SEQ ID NO: 1198739 - RNA, 19 nt, Homo sapiens
uaacuccugugcaagauac

SEQ ID NO: 1198740 - RNA, 19 nt, Homo sapiens
aaagaauucccauuugaug

SEQ ID NO: 1198741 - RNA, 19 nt, Homo sapiens
aauucacccugaucugaua

SEQ ID NO: 1198742 - RNA, 19 nt, Homo sapiens
gaccaagaaaccacuuuau

SEQ ID NO: 1198743 - RNA, 19 nt, Homo sapiens
uagaguucccgguacuuua

SEQ ID NO: 1198744 - RNA, 19 nt, Homo sapiens
gauucuaggguuaacauug

SEQ ID NO: 1198745 - RNA, 19 nt, Homo sapiens
uggaggcgauagacgagua

SEQ ID NO: 1198746 - RNA, 19 nt, Homo sapiens
gugcuagaguuuacacauc

SEQ ID NO: 1198747 - RNA, 19 nt, Homo sapiens
gaaaccaucauagcucugu

SEQ ID NO: 1198748 - RNA, 19 nt, Homo sapiens
ugacauuacucacuaucag

SEQ ID NO: 1198749 - RNA, 19 nt, Homo sapiens
guacuuuauuaccaagguu

SEQ ID NO: 1198750 - RNA, 19 nt, Homo sapiens
caagcucaacacaauaauu

SEQ ID NO: 1198751 - RNA, 19 nt, Homo sapiens
uguucagccugucccauua

SEQ ID NO: 1198752 - RNA, 19 nt, Homo sapiens
gaagaagcuagaaccaauc

SEQ ID NO: 1198753 - RNA, 19 nt, Homo sapiens
caacugauugugaaaccuu

SEQ ID NO: 1198754 - RNA, 19 nt, Homo sapiens
uaauugagucagaugcuaa

SEQ ID NO: 1198755 - RNA, 19 nt, Homo sapiens
gaauaacgguugcuaauuu

SEQ ID NO: 1198756 - RNA, 19 nt, Homo sapiens
gcaggaugcucaugaauuu

SEQ ID NO: 1198757 - RNA, 19 nt, Homo sapiens
ggaaacacaugcuacugua

SEQ ID NO: 1198758 - RNA, 19 nt, Homo sapiens
gaucuuggcuuccuuuaga

SEQ ID NO: 1198759 - RNA, 19 nt, Homo sapiens
ugaguaaccucgauauuaa

SEQ ID NO: 1198760 - RNA, 19 nt, Homo sapiens
gaguaggccugcuguauuu

SEQ ID NO: 1198761 - RNA, 19 nt, Homo sapiens
caaaggcucugcaguauuc

SEQ ID NO: 1198762 - RNA, 19 nt, Homo sapiens
ccaaagaaguucauuucaa

SEQ ID NO: 1198763 - RNA, 19 nt, Homo sapiens
aaacaccucuugaagcuaa

SEQ ID NO: 1198764 - RNA, 19 nt, Homo sapiens
gggagaauguguuggcaua

SEQ ID NO: 1198765 - RNA, 19 nt, Homo sapiens
ccaugaaacuuacgcagua

SEQ ID NO: 1198766 - RNA, 19 nt, Homo sapiens
ggaagaaccucaucucacu

SEQ ID NO: 1198767 - RNA, 19 nt, Homo sapiens
caaagaaguucauuucaag

SEQ ID NO: 1198768 - RNA, 19 nt, Homo sapiens
gagcagaauacauccauua

SEQ ID NO: 1198769 - RNA, 19 nt, Homo sapiens
ugaagaggauagcacuuua

SEQ ID NO: 1198770 - RNA, 19 nt, Homo sapiens
uaacaaagguacuacaucu

SEQ ID NO: 1198771 - RNA, 19 nt, Homo sapiens
gcaaguauagcuuuaaguu

SEQ ID NO: 1198772 - RNA, 19 nt, Homo sapiens
gaagaagguuggcgucauc

SEQ ID NO: 1198773 - RNA, 19 nt, Homo sapiens
ggaacugauucauaagaaa

SEQ ID NO: 1198774 - RNA, 19 nt, Homo sapiens
gggaaauguuuguacuaua

SEQ ID NO: 1198775 - RNA, 19 nt, Homo sapiens
gaaacagggugaagagaag

SEQ ID NO: 1198776 - RNA, 19 nt, Homo sapiens
gugaguaaccucgauauua

SEQ ID NO: 1198777 - RNA, 19 nt, Homo sapiens
gaugguuggucucuaauau

SEQ ID NO: 1198778 - RNA, 19 nt, Homo sapiens
uggagcagcugcacagaua

SEQ ID NO: 1198779 - RNA, 19 nt, Homo sapiens
cagaagaauuggguagaua

SEQ ID NO: 1198780 - RNA, 19 nt, Homo sapiens
caugaugguuggucucuaa

SEQ ID NO: 1198781 - RNA, 19 nt, Homo sapiens
ugaugaacaugcaaacuuu

SEQ ID NO: 1198782 - RNA, 19 nt, Homo sapiens
agaguuaacugcaaucaga

SEQ ID NO: 1198783 - RNA, 19 nt, Homo sapiens
gaaaauagaugcucaagcu

SEQ ID NO: 1198784 - RNA, 19 nt, Homo sapiens
gaaauggugugggagaugu

SEQ ID NO: 1198785 - RNA, 19 nt, Homo sapiens
gagaggcacuuuccaacug

SEQ ID NO: 1198786 - RNA, 19 nt, Homo sapiens
gcuaugccauucauuaugu

SEQ ID NO: 1198787 - RNA, 19 nt, Homo sapiens
gaaacucgaugcuugaacu

SEQ ID NO: 1198788 - RNA, 19 nt, Homo sapiens
ccaaucaugucucuuuaug

SEQ ID NO: 1198789 - RNA, 19 nt, Homo sapiens
uagaggcaauuucacauuu

SEQ ID NO: 1198790 - RNA, 19 nt, Homo sapiens
caagguaucuuuccaaucc

SEQ ID NO: 1198791 - RNA, 19 nt, Homo sapiens
ccagagcaguuuccaauca

SEQ ID NO: 1198792 - RNA, 19 nt, Homo sapiens
uuggaaggcuguagaagua

SEQ ID NO: 1198793 - RNA, 19 nt, Homo sapiens
aaauguaccuugccuuguu

SEQ ID NO: 1198794 - RNA, 19 nt, Homo sapiens
guuuauugcucagaacuua

SEQ ID NO: 1198795 - RNA, 19 nt, Homo sapiens
ccucaucucacuauaguua

SEQ ID NO: 1198796 - RNA, 19 nt, Homo sapiens
guauagagguggcucaaag

SEQ ID NO: 1198797 - RNA, 19 nt, Homo sapiens
ggugaaagcuaugccauuc

SEQ ID NO: 1198798 - RNA, 19 nt, Homo sapiens
gaaccuggaccgcauguau

SEQ ID NO: 1198799 - RNA, 19 nt, Homo sapiens
agggaacgcuuaccaauga

SEQ ID NO: 1198800 - RNA, 19 nt, Homo sapiens
agaggcaauuucacauuua

SEQ ID NO: 1198801 - RNA, 19 nt, Homo sapiens
gcacggcauuguuccuuau

SEQ ID NO: 1198802 - RNA, 19 nt, Homo sapiens
gaaugucuacggucuguuu

SEQ ID NO: 1198803 - RNA, 19 nt, Homo sapiens
ggcauuauaucacuauugu

SEQ ID NO: 1198804 - RNA, 19 nt, Homo sapiens
gaacgaaccugcggaaaau

SEQ ID NO: 1198805 - RNA, 19 nt, Homo sapiens
aaacaucgccuccaucugu

SEQ ID NO: 1198806 - RNA, 19 nt, Homo sapiens
aaagcuaugccauucauua

SEQ ID NO: 1198807 - RNA, 19 nt, Homo sapiens
gcccaaaggcucugcagua

SEQ ID NO: 1198808 - RNA, 19 nt, Homo sapiens
ccacuuaacuuccauacac

SEQ ID NO: 1198809 - RNA, 19 nt, Homo sapiens
aaauggcgcuguuucuuug

SEQ ID NO: 1198810 - RNA, 19 nt, Homo sapiens
agucauaaguucaggauau

SEQ ID NO: 1198811 - RNA, 19 nt, Homo sapiens
gaggcaauuucacauuuau

SEQ ID NO: 1198812 - RNA, 19 nt, Homo sapiens
caaacaagaagcccagaaa

SEQ ID NO: 1198813 - RNA, 19 nt, Homo sapiens
cagcauucauggauagauu

SEQ ID NO: 1198814 - RNA, 19 nt, Homo sapiens
ggugauugauguagggaaa

SEQ ID NO: 1198815 - RNA, 19 nt, Homo sapiens
agaguuagcuggguauaga

SEQ ID NO: 1198816 - RNA, 19 nt, Homo sapiens
gaagaauuggguagauauu

SEQ ID NO: 1198817 - RNA, 19 nt, Homo sapiens
ggaaggcuguagaaguaau

SEQ ID NO: 1198818 - RNA, 19 nt, Homo sapiens
ucaauggucuggcuguguu

SEQ ID NO: 1198819 - RNA, 19 nt, Homo sapiens
gaaacacaugcuacuguaa

SEQ ID NO: 1198820 - RNA, 19 nt, Homo sapiens
ugaaacaccucuugaagcu

SEQ ID NO: 1198821 - RNA, 19 nt, Homo sapiens
ugaccuagccauuacaauu

SEQ ID NO: 1198822 - RNA, 19 nt, Homo sapiens
ugaacacuauuucggauug

SEQ ID NO: 1198823 - RNA, 19 nt, Homo sapiens
cauuaugucuggcuguauu

SEQ ID NO: 1198824 - RNA, 19 nt, Homo sapiens
ggccaaggauuccgugugu

SEQ ID NO: 1198825 - RNA, 19 nt, Homo sapiens
gacauagaguuaacugcaa

SEQ ID NO: 1198826 - RNA, 19 nt, Homo sapiens
cuaagagacuucagcaaca

SEQ ID NO: 1198827 - RNA, 19 nt, Homo sapiens
uaaagacaguaacaugcaa

SEQ ID NO: 1198828 - RNA, 19 nt, Homo sapiens
gcaacacuccaucagcuuu

SEQ ID NO: 1198829 - RNA, 19 nt, Homo sapiens
caacugaaggugauugaug

SEQ ID NO: 1198830 - RNA, 19 nt, Homo sapiens
gaagaggauagcacuuuau

SEQ ID NO: 1198831 - RNA, 19 nt, Homo sapiens
gauacaccaagcugucuua

SEQ ID NO: 1198832 - RNA, 19 nt, Homo sapiens
cuaaagcgguucaaguaca

SEQ ID NO: 1198833 - RNA, 19 nt, Homo sapiens
agggaucgcugcaaccuuu

SEQ ID NO: 1198834 - RNA, 19 nt, Homo sapiens
caagagaguaacugaaaga

SEQ ID NO: 1198835 - RNA, 19 nt, Homo sapiens
gagaauguguuggcauaca

SEQ ID NO: 1198836 - RNA, 19 nt, Homo sapiens
gcaaacacauuaaaacagu

SEQ ID NO: 1198837 - RNA, 19 nt, Homo sapiens
gaagaaccucaucucacua

SEQ ID NO: 1198838 - RNA, 19 nt, Homo sapiens
gaacuccggcucuucaaca

SEQ ID NO: 1198839 - RNA, 19 nt, Homo sapiens
aaacacacuucuccagcaa

SEQ ID NO: 1198840 - RNA, 19 nt, Homo sapiens
gaaccucaucucacuauag

SEQ ID NO: 1198841 - RNA, 19 nt, Homo sapiens
ucccagggcugauacagaa

SEQ ID NO: 1198842 - RNA, 19 nt, Homo sapiens
agucacggcuucuggcuuu

SEQ ID NO: 1198843 - RNA, 19 nt, Homo sapiens
uaaguaagcaugccaacau

SEQ ID NO: 1198844 - RNA, 19 nt, Homo sapiens
gcacuacucuugguuuuau

SEQ ID NO: 1198845 - RNA, 19 nt, Homo sapiens
ccgcauguaugacuugguu

SEQ ID NO: 1198846 - RNA, 19 nt, Homo sapiens
gaucuuggcccugcaccua

SEQ ID NO: 1198847 - RNA, 19 nt, Homo sapiens
ggagcagaauacauccauu

SEQ ID NO: 1198848 - RNA, 19 nt, Homo sapiens
guagcaaagaugaagauuu

SEQ ID NO: 1198849 - RNA, 19 nt, Homo sapiens
gacugcaaguuacaaaguu

SEQ ID NO: 1198850 - RNA, 19 nt, Homo sapiens
ggcauaaugugaacuaaaa

SEQ ID NO: 1198851 - RNA, 19 nt, Homo sapiens
caaugccucugcucuggaa

SEQ ID NO: 1198852 - RNA, 19 nt, Homo sapiens
gggugcaaguauagcuuua

SEQ ID NO: 1198853 - RNA, 19 nt, Homo sapiens
guguuagacucucuccuuu

SEQ ID NO: 1198854 - RNA, 19 nt, Homo sapiens
gucaagagaguaacugaaa

SEQ ID NO: 1198855 - RNA, 19 nt, Homo sapiens
gaacugacauggaccaaau

SEQ ID NO: 1198856 - RNA, 19 nt, Homo sapiens
ggaagauccugacggaguu

SEQ ID NO: 1198857 - RNA, 19 nt, Homo sapiens
gggcagaaauggacuccuu

SEQ ID NO: 1198858 - RNA, 19 nt, Homo sapiens
caacagugcaggcuacaaa

SEQ ID NO: 1198859 - RNA, 19 nt, Homo sapiens
caagucaccucccucugaa

SEQ ID NO: 1198860 - RNA, 19 nt, Homo sapiens
ccaagcagguggucucugu

SEQ ID NO: 1198861 - RNA, 19 nt, Homo sapiens
ccaccugagucacuuuauu

SEQ ID NO: 1198862 - RNA, 19 nt, Homo sapiens
ucacggacaugaaccugaa

SEQ ID NO: 1198863 - RNA, 19 nt, Homo sapiens
ggugcgagaugucuucuuc

SEQ ID NO: 1198864 - RNA, 19 nt, Homo sapiens
ccgaagauuugcgccuuua

SEQ ID NO: 1198865 - RNA, 19 nt, Homo sapiens
ccaagucaccucccucuga

SEQ ID NO: 1198866 - RNA, 19 nt, Homo sapiens
ggaaguguccugagugaag

SEQ ID NO: 1198867 - RNA, 19 nt, Homo sapiens
ucaaggaggucacggacau

SEQ ID NO: 1198868 - RNA, 19 nt, Homo sapiens
ucacugaggugcgagaugu

SEQ ID NO: 1198869 - RNA, 19 nt, Homo sapiens
gagcugcuaugagaagaug

SEQ ID NO: 1198870 - RNA, 19 nt, Homo sapiens
gcucauuggcaacuccuua

SEQ ID NO: 1198871 - RNA, 19 nt, Homo sapiens
guggagagaugagauuuag

SEQ ID NO: 1198872 - RNA, 19 nt, Homo sapiens
acaaugccguguauacguu

SEQ ID NO: 1198873 - RNA, 19 nt, Homo sapiens
cagcagcgauuugaugugu

SEQ ID NO: 1198874 - RNA, 19 nt, Homo sapiens
ugacauggaccaaauuauc

SEQ ID NO: 1198875 - RNA, 19 nt, Homo sapiens
aaacaaagcggccuaugag

SEQ ID NO: 1198876 - RNA, 19 nt, Homo sapiens
gagaugucuucuucaagga

SEQ ID NO: 1198877 - RNA, 19 nt, Homo sapiens
gacauggaccaaauuauca

SEQ ID NO: 1198878 - RNA, 19 nt, Homo sapiens
gguggagagaugagauuua

SEQ ID NO: 1198879 - RNA, 19 nt, Homo sapiens
ugagcaaccuggugaugga

SEQ ID NO: 1198880 - RNA, 19 nt, Homo sapiens
cagcaucuccugccuggaa

SEQ ID NO: 1198881 - RNA, 19 nt, Homo sapiens
gcgaguacauggagaagcu

SEQ ID NO: 1198882 - RNA, 19 nt, Homo sapiens
ggaacgaggugcagauccu

SEQ ID NO: 1198883 - RNA, 19 nt, Homo sapiens
ucccugauauuguauugaa

SEQ ID NO: 1198884 - RNA, 19 nt, Homo sapiens
gaagauuugcgccuuuagu

SEQ ID NO: 1198885 - RNA, 19 nt, Homo sapiens
gggagcaaauggacaaugc

SEQ ID NO: 1198886 - RNA, 19 nt, Homo sapiens
uggguucagucaacacuuu

SEQ ID NO: 1198887 - RNA, 19 nt, Homo sapiens
ucgaggaggugcuguccaa

SEQ ID NO: 1198888 - RNA, 19 nt, Homo sapiens
gcacacuguucaugcuuuu

SEQ ID NO: 1198889 - RNA, 19 nt, Homo sapiens
ggugcuggguggagagaug

SEQ ID NO: 1198890 - RNA, 19 nt, Homo sapiens
uccaggagcugaucuucga

SEQ ID NO: 1198891 - RNA, 19 nt, Homo sapiens
ccaaggaggagcugugcaa

SEQ ID NO: 1198892 - RNA, 19 nt, Homo sapiens
gcacugcaacaauggaauc

SEQ ID NO: 1198893 - RNA, 19 nt, Homo sapiens
uugacaagcugggcgagua

SEQ ID NO: 1198894 - RNA, 19 nt, Homo sapiens
ccacacaguucccgcucau

SEQ ID NO: 1198895 - RNA, 19 nt, Homo sapiens
ggagugagugagugagaug

SEQ ID NO: 1198896 - RNA, 19 nt, Homo sapiens
caccugagucacuuuauug

SEQ ID NO: 1198897 - RNA, 19 nt, Homo sapiens
ucucugugguccaggauga

SEQ ID NO: 1198898 - RNA, 19 nt, Homo sapiens
gaaccugaacgucaucaac

SEQ ID NO: 1198899 - RNA, 19 nt, Homo sapiens
gcgcgucacuacuacuucu

SEQ ID NO: 1198900 - RNA, 19 nt, Homo sapiens
gcuggguucugucuucuac

SEQ ID NO: 1198901 - RNA, 19 nt, Homo sapiens
aauggacaaugccguguau

SEQ ID NO: 1198902 - RNA, 19 nt, Homo sapiens
aaaauccagucccuucuuu

SEQ ID NO: 1198903 - RNA, 19 nt, Homo sapiens
guagagggcccugcguuca

SEQ ID NO: 1198904 - RNA, 19 nt, Homo sapiens
cuuaugcgcgucacuacua

SEQ ID NO: 1198905 - RNA, 19 nt, Homo sapiens
ugucgucccuccucagcuu

SEQ ID NO: 1198906 - RNA, 19 nt, Homo sapiens
uggauguccuugugaguca

SEQ ID NO: 1198907 - RNA, 19 nt, Homo sapiens
ugagaaaggcccagaacgu

SEQ ID NO: 1198908 - RNA, 19 nt, Homo sapiens
caaggucugcggccugaga

SEQ ID NO: 1198909 - RNA, 19 nt, Homo sapiens
ucgaggacuuugccagguu

SEQ ID NO: 1198910 - RNA, 19 nt, Homo sapiens
cagcuccggucccuuccuu

SEQ ID NO: 1198911 - RNA, 19 nt, Homo sapiens
guacggcaccugggagaug

SEQ ID NO: 1198912 - RNA, 19 nt, Homo sapiens
gggcuggugcucuacgaaa

SEQ ID NO: 1198913 - RNA, 19 nt, Homo sapiens
gauggcugagugaggguua

SEQ ID NO: 1198914 - RNA, 19 nt, Homo sapiens
uggcguggcucucuucaac

SEQ ID NO: 1198915 - RNA, 19 nt, Homo sapiens
aggaggagcugugcaaguc

SEQ ID NO: 1198916 - RNA, 19 nt, Homo sapiens
gcauguaccgacaguccaa

SEQ ID NO: 1198917 - RNA, 19 nt, Homo sapiens
gaggugaaagcugguguga

SEQ ID NO: 1198918 - RNA, 19 nt, Homo sapiens
gcccaccugagucacuuua

SEQ ID NO: 1198919 - RNA, 19 nt, Homo sapiens
ugcgagaugucuucuucaa

SEQ ID NO: 1198920 - RNA, 19 nt, Homo sapiens
gcgcaucuuuucccucuug

SEQ ID NO: 1198921 - RNA, 19 nt, Homo sapiens
gggagugagugagugagau

SEQ ID NO: 1198922 - RNA, 19 nt, Homo sapiens
ggugcagacugaguucuag

SEQ ID NO: 1198923 - RNA, 19 nt, Homo sapiens
ggacuuugccagguucauc

SEQ ID NO: 1198924 - RNA, 19 nt, Homo sapiens
gacaaugccguguauacgu

SEQ ID NO: 1198925 - RNA, 19 nt, Homo sapiens
caagauccgagccuucauc

SEQ ID NO: 1198926 - RNA, 19 nt, Homo sapiens
acuacgggcuggugcucua

SEQ ID NO: 1198927 - RNA, 19 nt, Homo sapiens
cacuacuacuucugcauga

SEQ ID NO: 1198928 - RNA, 19 nt, Homo sapiens
ccacgagccgucaucaaca

SEQ ID NO: 1198929 - RNA, 19 nt, Homo sapiens
gaaaauccagucccuucuu

SEQ ID NO: 1198930 - RNA, 19 nt, Homo sapiens
ggggaaguguccugaguga

SEQ ID NO: 1198931 - RNA, 19 nt, Homo sapiens
gggugcagacugaguucua

SEQ ID NO: 1198932 - RNA, 19 nt, Homo sapiens
ggacaaugccguguauacg

SEQ ID NO: 1198933 - RNA, 19 nt, Homo sapiens
ggacgccguguaccacaug

SEQ ID NO: 1198934 - RNA, 19 nt, Homo sapiens
ggcagaaauggacuccuuu

SEQ ID NO: 1198935 - RNA, 19 nt, Homo sapiens
gggcccaccugagucacuu

SEQ ID NO: 1198936 - RNA, 19 nt, Homo sapiens
gcugaucuucgaggacuuu

SEQ ID NO: 1198937 - RNA, 19 nt, Homo sapiens
ucccguuccugcucaagaa

SEQ ID NO: 1198938 - RNA, 19 nt, Homo sapiens
ggaggucacggacaugaac

SEQ ID NO: 1198939 - RNA, 19 nt, Homo sapiens
acugacauggaccaaauua

SEQ ID NO: 1198940 - RNA, 19 nt, Homo sapiens
ggcccugcguucacagaug

SEQ ID NO: 1198941 - RNA, 19 nt, Homo sapiens
gcguggcucucuucaacag

SEQ ID NO: 1198942 - RNA, 19 nt, Homo sapiens
aauauuaugcacacuguuc

SEQ ID NO: 1198943 - RNA, 19 nt, Homo sapiens
cccgaagauuugcgccuuu

SEQ ID NO: 1198944 - RNA, 19 nt, Homo sapiens
gcagaaauggacuccuuuu

SEQ ID NO: 1198945 - RNA, 19 nt, Homo sapiens
ggagagagggaggugaaag

SEQ ID NO: 1198946 - RNA, 19 nt, Homo sapiens
ccacaugcgggagcaaaug

SEQ ID NO: 1198947 - RNA, 19 nt, Homo sapiens
aaauggacaaugccgugua

SEQ ID NO: 1198948 - RNA, 19 nt, Homo sapiens
gaucucggacgccguguac

SEQ ID NO: 1198949 - RNA, 19 nt, Homo sapiens
uacuacuucugcaugauga

SEQ ID NO: 1198950 - RNA, 19 nt, Homo sapiens
uaccagggaccacggcaaa

SEQ ID NO: 1198951 - RNA, 19 nt, Homo sapiens
ugcacacuguucaugcuuu

SEQ ID NO: 1198952 - RNA, 19 nt, Homo sapiens
ccucccugauauuguauug

SEQ ID NO: 1198953 - RNA, 19 nt, Homo sapiens
cagagcugcuaugagaaga

SEQ ID NO: 1198954 - RNA, 19 nt, Homo sapiens
accaauaccuggagcucau

SEQ ID NO: 1198955 - RNA, 19 nt, Homo sapiens
ggaccgcacugacaggaaa

SEQ ID NO: 1198956 - RNA, 19 nt, Homo sapiens
gggcagagcugggcauuca

SEQ ID NO: 1198957 - RNA, 19 nt, Homo sapiens
uaacaucccagacuuuaaa

SEQ ID NO: 1198958 - RNA, 19 nt, Homo sapiens
gcacaucauuguccaagag

SEQ ID NO: 1198959 - RNA, 19 nt, Homo sapiens
ccacuaacaucccagacuu

SEQ ID NO: 1198960 - RNA, 19 nt, Homo sapiens
gagaagcaccugcacuuug

SEQ ID NO: 1198961 - RNA, 19 nt, Homo sapiens
agaagcaccugcacuuugu

SEQ ID NO: 1198962 - RNA, 19 nt, Homo sapiens
aaucagauguacaccgaaa

SEQ ID NO: 1198963 - RNA, 19 nt, Homo sapiens
guccgugggugauaauuga

SEQ ID NO: 1198964 - RNA, 19 nt, Homo sapiens
gaagaggaagggcgaguag

SEQ ID NO: 1198965 - RNA, 19 nt, Homo sapiens
ccacugggaaucagaggaa

SEQ ID NO: 1198966 - RNA, 19 nt, Homo sapiens
acuaacaucccagacuuua

SEQ ID NO: 1198967 - RNA, 19 nt, Homo sapiens
cgagaagcaccugcacuuu

SEQ ID NO: 1198968 - RNA, 19 nt, Homo sapiens
gauaauugagagcgucaga

SEQ ID NO: 1198969 - RNA, 19 nt, Homo sapiens
gcuagcagccacugggaau

SEQ ID NO: 1198970 - RNA, 19 nt, Homo sapiens
guggguccgugggugauaa

SEQ ID NO: 1198971 - RNA, 19 nt, Homo sapiens
ccgagaagcaccugcacuu

SEQ ID NO: 1198972 - RNA, 19 nt, Homo sapiens
gucagacucccacguguga

SEQ ID NO: 1198973 - RNA, 19 nt, Homo sapiens
gcaccuggacgcugauggu

SEQ ID NO: 1198974 - RNA, 19 nt, Homo sapiens
cuaacaucccagacuuuaa

SEQ ID NO: 1198975 - RNA, 19 nt, Homo sapiens
gguccgugggugauaauug

SEQ ID NO: 1198976 - RNA, 19 nt, Homo sapiens
ggaacgccacggacuggau

SEQ ID NO: 1198977 - RNA, 19 nt, Homo sapiens
cagcaaccacaccaucuuc

SEQ ID NO: 1198978 - RNA, 19 nt, Homo sapiens
ccagcaaccacaccaucuu

SEQ ID NO: 1198979 - RNA, 19 nt, Homo sapiens
ggaaacagauccauacuuu

SEQ ID NO: 1198980 - RNA, 19 nt, Homo sapiens
ucacauagcugggauauuu

SEQ ID NO: 1198981 - RNA, 19 nt, Homo sapiens
ggaaagugcugaucaaucu

SEQ ID NO: 1198982 - RNA, 19 nt, Homo sapiens
ucaaauguguugucagaua

SEQ ID NO: 1198983 - RNA, 19 nt, Homo sapiens
ucaaugaccuuuguuguaa

SEQ ID NO: 1198984 - RNA, 19 nt, Homo sapiens
uaacuaagccauucccaua

SEQ ID NO: 1198985 - RNA, 19 nt, Homo sapiens
guaaagagucugaaucaaa

SEQ ID NO: 1198986 - RNA, 19 nt, Homo sapiens
gcacucaaauaucuucuga

SEQ ID NO: 1198987 - RNA, 19 nt, Homo sapiens
caaagaaggccaagaaaga

SEQ ID NO: 1198988 - RNA, 19 nt, Homo sapiens
ccucguagauuaauugauu

SEQ ID NO: 1198989 - RNA, 19 nt, Homo sapiens
gcacgucucuucuucuugu

SEQ ID NO: 1198990 - RNA, 19 nt, Homo sapiens
gagcccagcugaacaacaa

SEQ ID NO: 1198991 - RNA, 19 nt, Homo sapiens
uaucaaauguguugucaga

SEQ ID NO: 1198992 - RNA, 19 nt, Homo sapiens
gaaacagauccauacuuua

SEQ ID NO: 1198993 - RNA, 19 nt, Homo sapiens
agagagaaauagagaguuu

SEQ ID NO: 1198994 - RNA, 19 nt, Homo sapiens
caagagaccaugaccguaa

SEQ ID NO: 1198995 - RNA, 19 nt, Homo sapiens
caaauguguugucagauau

SEQ ID NO: 1198996 - RNA, 19 nt, Homo sapiens
gaacaugcaaucaucuuau

SEQ ID NO: 1198997 - RNA, 19 nt, Homo sapiens
guacagcaauacaugaguu

SEQ ID NO: 1198998 - RNA, 19 nt, Homo sapiens
gauccauacuuuauaccua

SEQ ID NO: 1198999 - RNA, 19 nt, Homo sapiens
gaacaggaagcgaugaaga

SEQ ID NO: 1199000 - RNA, 19 nt, Homo sapiens
gcugugaccauccaaauaa

SEQ ID NO: 1199001 - RNA, 19 nt, Homo sapiens
gaucugccauuccaacaug

SEQ ID NO: 1199002 - RNA, 19 nt, Homo sapiens
ggagauugaauaauuggua

SEQ ID NO: 1199003 - RNA, 19 nt, Homo sapiens
gaaaacacccacaacauaa

SEQ ID NO: 1199004 - RNA, 19 nt, Homo sapiens
gccaaucacuguccugguu

SEQ ID NO: 1199005 - RNA, 19 nt, Homo sapiens
gugaguauaccuuaacuaa

SEQ ID NO: 1199006 - RNA, 19 nt, Homo sapiens
caaaguugagguaauauug

SEQ ID NO: 1199007 - RNA, 19 nt, Homo sapiens
ccuaguuccucaucuguaa

SEQ ID NO: 1199008 - RNA, 19 nt, Homo sapiens
gaugugcaguaucccagua

SEQ ID NO: 1199009 - RNA, 19 nt, Homo sapiens
agaaagagguaaagagucu

SEQ ID NO: 1199010 - RNA, 19 nt, Homo sapiens
cuauuuggcugaaacaguu

SEQ ID NO: 1199011 - RNA, 19 nt, Homo sapiens
gaguaugcgugagcaaauu

SEQ ID NO: 1199012 - RNA, 19 nt, Homo sapiens
ucagugcacuuaaggucua

SEQ ID NO: 1199013 - RNA, 19 nt, Homo sapiens
uauaauacccuaucaugug

SEQ ID NO: 1199014 - RNA, 19 nt, Homo sapiens
caugggagaugaugaugga

SEQ ID NO: 1199015 - RNA, 19 nt, Homo sapiens
auaauacccuaucauguga

SEQ ID NO: 1199016 - RNA, 19 nt, Homo sapiens
ucagauauuccuccaauug

SEQ ID NO: 1199017 - RNA, 19 nt, Homo sapiens
ccagaucucuauagcaaag

SEQ ID NO: 1199018 - RNA, 19 nt, Homo sapiens
ugacagagacucaaagaag

SEQ ID NO: 1199019 - RNA, 19 nt, Homo sapiens
ccugagcaauuacuuaaau

SEQ ID NO: 1199020 - RNA, 19 nt, Homo sapiens
ccauaaacccugcugaaga

SEQ ID NO: 1199021 - RNA, 19 nt, Homo sapiens
ccacucugguaacuuauug

SEQ ID NO: 1199022 - RNA, 19 nt, Homo sapiens
cuacagguaucuaagcaau

SEQ ID NO: 1199023 - RNA, 19 nt, Homo sapiens
guggcacccugagcaauua

SEQ ID NO: 1199024 - RNA, 19 nt, Homo sapiens
cauaaacccugcugaagac

SEQ ID NO: 1199025 - RNA, 19 nt, Homo sapiens
aacccaagguguuguguuu

SEQ ID NO: 1199026 - RNA, 19 nt, Homo sapiens
ugauuacuauggagauuga

SEQ ID NO: 1199027 - RNA, 19 nt, Homo sapiens
ccacggcuaugagggagua

SEQ ID NO: 1199028 - RNA, 19 nt, Homo sapiens
guaagcaggauagcugaua

SEQ ID NO: 1199029 - RNA, 19 nt, Homo sapiens
gguuauugcuguugcuguu

SEQ ID NO: 1199030 - RNA, 19 nt, Homo sapiens
gaagacaggagaguacaga

SEQ ID NO: 1199031 - RNA, 19 nt, Homo sapiens
gcacuuaaggucuacagau

SEQ ID NO: 1199032 - RNA, 19 nt, Homo sapiens
ucccagaucucuauagcaa

SEQ ID NO: 1199033 - RNA, 19 nt, Homo sapiens
ugaggaaagugcugaucaa

SEQ ID NO: 1199034 - RNA, 19 nt, Homo sapiens
ugcccacucugguaacuua

SEQ ID NO: 1199035 - RNA, 19 nt, Homo sapiens
gagagaaauagagaguuua

SEQ ID NO: 1199036 - RNA, 19 nt, Homo sapiens
gguaaagagucugaaucaa

SEQ ID NO: 1199037 - RNA, 19 nt, Homo sapiens
caucuuauguggguacaga

SEQ ID NO: 1199038 - RNA, 19 nt, Homo sapiens
gaugaggaguuuauuucuc

SEQ ID NO: 1199039 - RNA, 19 nt, Homo sapiens
cgaaaacacccacaacaua

SEQ ID NO: 1199040 - RNA, 19 nt, Homo sapiens
ugucagauauuccuccaau

SEQ ID NO: 1199041 - RNA, 19 nt, Homo sapiens
acucugaccauuccucuua

SEQ ID NO: 1199042 - RNA, 19 nt, Homo sapiens
caccauccaugcuaaagga

SEQ ID NO: 1199043 - RNA, 19 nt, Homo sapiens
uagaugaaauuggacaaga

SEQ ID NO: 1199044 - RNA, 19 nt, Homo sapiens
acuaagccauucccauauu

SEQ ID NO: 1199045 - RNA, 19 nt, Homo sapiens
gagccuaguuccucaucug

SEQ ID NO: 1199046 - RNA, 19 nt, Homo sapiens
gagcugggcgucuggauca

SEQ ID NO: 1199047 - RNA, 19 nt, Homo sapiens
ggaccagguuauugcuguu

SEQ ID NO: 1199048 - RNA, 19 nt, Homo sapiens
gcagcuggcccuggaguuu

SEQ ID NO: 1199049 - RNA, 19 nt, Homo sapiens
acauaaagauuggacucua

SEQ ID NO: 1199050 - RNA, 19 nt, Homo sapiens
gaagcugcccaccagauug

SEQ ID NO: 1199051 - RNA, 19 nt, Homo sapiens
gcugauaccacggcuauga

SEQ ID NO: 1199052 - RNA, 19 nt, Homo sapiens
caaacuaguaagcaggaua

SEQ ID NO: 1199053 - RNA, 19 nt, Homo sapiens
acugauggcuggugggaaa

SEQ ID NO: 1199054 - RNA, 19 nt, Homo sapiens
gacaggagaguacagaaug

SEQ ID NO: 1199055 - RNA, 19 nt, Homo sapiens
cuacagaugaggaguuuau

SEQ ID NO: 1199056 - RNA, 19 nt, Homo sapiens
cccaagguguuguguuuga

SEQ ID NO: 1199057 - RNA, 19 nt, Homo sapiens
caacaccaauugcaaucca

SEQ ID NO: 1199058 - RNA, 19 nt, Homo sapiens
ugaacaugcaaucaucuua

SEQ ID NO: 1199059 - RNA, 19 nt, Homo sapiens
acaggagaguacagaauga

SEQ ID NO: 1199060 - RNA, 19 nt, Homo sapiens
cagaugaggaguuuauuuc

SEQ ID NO: 1199061 - RNA, 19 nt, Homo sapiens
caugaguucuuccucuaga

SEQ ID NO: 1199062 - RNA, 19 nt, Homo sapiens
uacaugaguucuuccucua

SEQ ID NO: 1199063 - RNA, 19 nt, Homo sapiens
gaugaaauuggacaagaga

SEQ ID NO: 1199064 - RNA, 19 nt, Homo sapiens
guaagauggacuugagauu

SEQ ID NO: 1199065 - RNA, 19 nt, Homo sapiens
cacagcaggugaggcauuu

SEQ ID NO: 1199066 - RNA, 19 nt, Homo sapiens
gcucauaaccugacaaaau

SEQ ID NO: 1199067 - RNA, 19 nt, Homo sapiens
gaacaguagugaaaauucu

SEQ ID NO: 1199068 - RNA, 19 nt, Homo sapiens
caggagauuugaccagcaa

SEQ ID NO: 1199069 - RNA, 19 nt, Homo sapiens
gcagugccuuucugugagu

SEQ ID NO: 1199070 - RNA, 19 nt, Homo sapiens
cauaaagauuggacucuac

SEQ ID NO: 1199071 - RNA, 19 nt, Homo sapiens
agauauuccuccaauuguu

SEQ ID NO: 1199072 - RNA, 19 nt, Homo sapiens
gcugggcucuuucccuuag

SEQ ID NO: 1199073 - RNA, 19 nt, Homo sapiens
guacagaaagagguaaaga

SEQ ID NO: 1199074 - RNA, 19 nt, Homo sapiens
ucuuugaaguccuacagua

SEQ ID NO: 1199075 - RNA, 19 nt, Homo sapiens
ggaguaugcgugagcaaau

SEQ ID NO: 1199076 - RNA, 19 nt, Homo sapiens
ggaaucagagugccuggau

SEQ ID NO: 1199077 - RNA, 19 nt, Homo sapiens
cacuuaaggucuacagaug

SEQ ID NO: 1199078 - RNA, 19 nt, Homo sapiens
caaaagagggugacuaugu

SEQ ID NO: 1199079 - RNA, 19 nt, Homo sapiens
ggauaacucuuaggauuua

SEQ ID NO: 1199080 - RNA, 19 nt, Homo sapiens
cgaauaaucuccacaaguu

SEQ ID NO: 1199081 - RNA, 19 nt, Homo sapiens
ggagcaacacuuuaaauua

SEQ ID NO: 1199082 - RNA, 19 nt, Homo sapiens
gagucuaucuucuguauaa

SEQ ID NO: 1199083 - RNA, 19 nt, Homo sapiens
gaagugagaucgugcaaag

SEQ ID NO: 1199084 - RNA, 19 nt, Homo sapiens
caucuuaacuacuguugua

SEQ ID NO: 1199085 - RNA, 19 nt, Homo sapiens
ggacugggauagagaguau

SEQ ID NO: 1199086 - RNA, 19 nt, Homo sapiens
gauaggagcaacacuuuaa

SEQ ID NO: 1199087 - RNA, 19 nt, Homo sapiens
guggauaacucuuaggauu

SEQ ID NO: 1199088 - RNA, 19 nt, Homo sapiens
ggagagccaguacaucuua

SEQ ID NO: 1199089 - RNA, 19 nt, Homo sapiens
guacaugucauaaguggua

SEQ ID NO: 1199090 - RNA, 19 nt, Homo sapiens
uagacaagauaccgaauaa

SEQ ID NO: 1199091 - RNA, 19 nt, Homo sapiens
agaaauggcucuaucaaag

SEQ ID NO: 1199092 - RNA, 19 nt, Homo sapiens
gagauuccauacacuacua

SEQ ID NO: 1199093 - RNA, 19 nt, Homo sapiens
uuacuuagcucugcauuug

SEQ ID NO: 1199094 - RNA, 19 nt, Homo sapiens
ucacauagccuuauuagca

SEQ ID NO: 1199095 - RNA, 19 nt, Homo sapiens
caauaguugugguagauaa

SEQ ID NO: 1199096 - RNA, 19 nt, Homo sapiens
gaugagaucggaggucuua

SEQ ID NO: 1199097 - RNA, 19 nt, Homo sapiens
gaaauggcucuaucaaaga

SEQ ID NO: 1199098 - RNA, 19 nt, Homo sapiens
gcuaaauacucauguguag

SEQ ID NO: 1199099 - RNA, 19 nt, Homo sapiens
gaucggaggucuuauacag

SEQ ID NO: 1199100 - RNA, 19 nt, Homo sapiens
gcucgagucuccuguugaa

SEQ ID NO: 1199101 - RNA, 19 nt, Homo sapiens
auucagaagugccaaauuu

SEQ ID NO: 1199102 - RNA, 19 nt, Homo sapiens
caaaguuucugaacacagu

SEQ ID NO: 1199103 - RNA, 19 nt, Homo sapiens
gaguagugcuccuaacaug

SEQ ID NO: 1199104 - RNA, 19 nt, Homo sapiens
gugaugaccacaauaagua

SEQ ID NO: 1199105 - RNA, 19 nt, Homo sapiens
aaacagugaugaccacaau

SEQ ID NO: 1199106 - RNA, 19 nt, Homo sapiens
ggauagagaguauguuuca

SEQ ID NO: 1199107 - RNA, 19 nt, Homo sapiens
guagugcuccuaacaugua

SEQ ID NO: 1199108 - RNA, 19 nt, Homo sapiens
agagugaacagaagaauaa

SEQ ID NO: 1199109 - RNA, 19 nt, Homo sapiens
gacaagauaccgaauaauc

SEQ ID NO: 1199110 - RNA, 19 nt, Homo sapiens
guagacaagauaccgaaua

SEQ ID NO: 1199111 - RNA, 19 nt, Homo sapiens
cagauuguuugcccuaauu

SEQ ID NO: 1199112 - RNA, 19 nt, Homo sapiens
gcucugcauuuguugcuuu

SEQ ID NO: 1199113 - RNA, 19 nt, Homo sapiens
gaccuaugcuaaauacuca

SEQ ID NO: 1199114 - RNA, 19 nt, Homo sapiens
gagugugcauguugucaaa

SEQ ID NO: 1199115 - RNA, 19 nt, Homo sapiens
gaugaccuaugcuaaauac

SEQ ID NO: 1199116 - RNA, 19 nt, Homo sapiens
gcacagagugaacagaaga

SEQ ID NO: 1199117 - RNA, 19 nt, Homo sapiens
uaagacaucagcuuuauag

SEQ ID NO: 1199118 - RNA, 19 nt, Homo sapiens
aaagaugaccuaugcuaaa

SEQ ID NO: 1199119 - RNA, 19 nt, Homo sapiens
gugggagaauacagcauua

SEQ ID NO: 1199120 - RNA, 19 nt, Homo sapiens
gaauaaucuccacaaguuu

SEQ ID NO: 1199121 - RNA, 19 nt, Homo sapiens
gagagccaguacaucuuaa

SEQ ID NO: 1199122 - RNA, 19 nt, Homo sapiens
ggaauagaaugugaucucu

SEQ ID NO: 1199123 - RNA, 19 nt, Homo sapiens
aaacagauuccuuaucaga

SEQ ID NO: 1199124 - RNA, 19 nt, Homo sapiens
auucagauauugccaacua

SEQ ID NO: 1199125 - RNA, 19 nt, Homo sapiens
caaagacggccaugaagug

SEQ ID NO: 1199126 - RNA, 19 nt, Homo sapiens
aaauggcucuaucaaagaa

SEQ ID NO: 1199127 - RNA, 19 nt, Homo sapiens
ggagugagugugcauguug

SEQ ID NO: 1199128 - RNA, 19 nt, Homo sapiens
guucagugacuacuauuaa

SEQ ID NO: 1199129 - RNA, 19 nt, Homo sapiens
gaacacuuauugcacuuuu

SEQ ID NO: 1199130 - RNA, 19 nt, Homo sapiens
gaacaccaguuuucacaug

SEQ ID NO: 1199131 - RNA, 19 nt, Homo sapiens
aaugugaucucuauugcaa

SEQ ID NO: 1199132 - RNA, 19 nt, Homo sapiens
gaacagcuaguaaucaaac

SEQ ID NO: 1199133 - RNA, 19 nt, Homo sapiens
ugagaucggaggucuuaua

SEQ ID NO: 1199134 - RNA, 19 nt, Homo sapiens
gagaauacagcauuaaagg

SEQ ID NO: 1199135 - RNA, 19 nt, Homo sapiens
caaaagaaguugucuaagg

SEQ ID NO: 1199136 - RNA, 19 nt, Homo sapiens
guaggguggauaacucuua

SEQ ID NO: 1199137 - RNA, 19 nt, Homo sapiens
gcaauugcagcuuuauuca

SEQ ID NO: 1199138 - RNA, 19 nt, Homo sapiens
auaguaacaugcagucuga

SEQ ID NO: 1199139 - RNA, 19 nt, Homo sapiens
uaagauaggagcaacacuu

SEQ ID NO: 1199140 - RNA, 19 nt, Homo sapiens
uaauuuggcuuuguuugug

SEQ ID NO: 1199141 - RNA, 19 nt, Homo sapiens
cacauagccuuauuagcaa

SEQ ID NO: 1199142 - RNA, 19 nt, Homo sapiens
gggagaauacagcauuaaa

SEQ ID NO: 1199143 - RNA, 19 nt, Homo sapiens
ccauagcauuugaauacaa

SEQ ID NO: 1199144 - RNA, 19 nt, Homo sapiens
gccaguacaucuuaacuac

SEQ ID NO: 1199145 - RNA, 19 nt, Homo sapiens
gauauuaagcccggacuga

SEQ ID NO: 1199146 - RNA, 19 nt, Homo sapiens
aauugcagcuuuauucaga

SEQ ID NO: 1199147 - RNA, 19 nt, Homo sapiens
ggaggaaaauuuaaaacug

SEQ ID NO: 1199148 - RNA, 19 nt, Homo sapiens
cuaaagcaauaaccaucaa

SEQ ID NO: 1199149 - RNA, 19 nt, Homo sapiens
ggagaauacagcauuaaag

SEQ ID NO: 1199150 - RNA, 19 nt, Homo sapiens
gucaacgacccacuuauuu

SEQ ID NO: 1199151 - RNA, 19 nt, Homo sapiens
cgagucuccuguugaagaa

SEQ ID NO: 1199152 - RNA, 19 nt, Homo sapiens
uauacuacaugcccuacuu

SEQ ID NO: 1199153 - RNA, 19 nt, Homo sapiens
caacuacaaggaacagcua

SEQ ID NO: 1199154 - RNA, 19 nt, Homo sapiens
gugcaaaguagcagauaaa

SEQ ID NO: 1199155 - RNA, 19 nt, Homo sapiens
caugcagucugaaguccua

SEQ ID NO: 1199156 - RNA, 19 nt, Homo sapiens
gagauguucuuuugucuug

SEQ ID NO: 1199157 - RNA, 19 nt, Homo sapiens
ugaagaaugggaacacuga

SEQ ID NO: 1199158 - RNA, 19 nt, Homo sapiens
acagugaugaccacaauaa

SEQ ID NO: 1199159 - RNA, 19 nt, Homo sapiens
uaagaaauggcucuaucaa

SEQ ID NO: 1199160 - RNA, 19 nt, Homo sapiens
ugacuucguucagugacua

SEQ ID NO: 1199161 - RNA, 19 nt, Homo sapiens
cuuaagacaucagcuuuau

SEQ ID NO: 1199162 - RNA, 19 nt, Homo sapiens
aggaacagcuaguaaucaa

SEQ ID NO: 1199163 - RNA, 19 nt, Homo sapiens
aaaagaaguugucuaagga

SEQ ID NO: 1199164 - RNA, 19 nt, Homo sapiens
uggcuuuguuugugauuaa

SEQ ID NO: 1199165 - RNA, 19 nt, Homo sapiens
caaguuuauuuguggucua

SEQ ID NO: 1199166 - RNA, 19 nt, Homo sapiens
agacggccaugaagugaga

SEQ ID NO: 1199167 - RNA, 19 nt, Homo sapiens
cuccuaacauguauuauca

SEQ ID NO: 1199168 - RNA, 19 nt, Homo sapiens
guuuguggcucucggaaug

SEQ ID NO: 1199169 - RNA, 19 nt, Homo sapiens
aagaugaccuaugcuaaau

SEQ ID NO: 1199170 - RNA, 19 nt, Homo sapiens
caaggaacagcuaguaauc

SEQ ID NO: 1199171 - RNA, 19 nt, Homo sapiens
gggcacagagugaacagaa

SEQ ID NO: 1199172 - RNA, 19 nt, Homo sapiens
caacuuuguggauuacauu

SEQ ID NO: 1199173 - RNA, 19 nt, Homo sapiens
gugcuccuaacauguauua

SEQ ID NO: 1199174 - RNA, 19 nt, Homo sapiens
cggaaugauugacuucguu

SEQ ID NO: 1199175 - RNA, 19 nt, Homo sapiens
gugaguuacuuaagacauc

SEQ ID NO: 1199176 - RNA, 19 nt, Homo sapiens
cuacaaggaacagcuagua

SEQ ID NO: 1199177 - RNA, 19 nt, Homo sapiens
cagagugaacagaagaaua

SEQ ID NO: 1199178 - RNA, 19 nt, Homo sapiens
gaggacagcagaacaaagg

SEQ ID NO: 1199179 - RNA, 19 nt, Homo sapiens
gcaaugaccaggacacaua

SEQ ID NO: 1199180 - RNA, 19 nt, Homo sapiens
gagauaaagucauacgauu

SEQ ID NO: 1199181 - RNA, 19 nt, Homo sapiens
ccaguuauauuccagauuu

SEQ ID NO: 1199182 - RNA, 19 nt, Homo sapiens
ggagaucaguuuccacauu

SEQ ID NO: 1199183 - RNA, 19 nt, Homo sapiens
gaccuuagcugagaucaaa

SEQ ID NO: 1199184 - RNA, 19 nt, Homo sapiens
ugaccaagaucccaccuua

SEQ ID NO: 1199185 - RNA, 19 nt, Homo sapiens
guugagaccuugauugaaa

SEQ ID NO: 1199186 - RNA, 19 nt, Homo sapiens
ccaaaguacugucaucauu

SEQ ID NO: 1199187 - RNA, 19 nt, Homo sapiens
gaagauacaacuaagacua

SEQ ID NO: 1199188 - RNA, 19 nt, Homo sapiens
caacgugaccugauaauga

SEQ ID NO: 1199189 - RNA, 19 nt, Homo sapiens
cauaaagccucaaacaguu

SEQ ID NO: 1199190 - RNA, 19 nt, Homo sapiens
cuagggcacuugaguauaa

SEQ ID NO: 1199191 - RNA, 19 nt, Homo sapiens
guaaaggcauaaucucuug

SEQ ID NO: 1199192 - RNA, 19 nt, Homo sapiens
gcacagugaucccgaagug

SEQ ID NO: 1199193 - RNA, 19 nt, Homo sapiens
ggccaaagcuggugaugga

SEQ ID NO: 1199194 - RNA, 19 nt, Homo sapiens
ucacguggcuuuaguuuag

SEQ ID NO: 1199195 - RNA, 19 nt, Homo sapiens
agaccucucuucaaguuua

SEQ ID NO: 1199196 - RNA, 19 nt, Homo sapiens
ggaaggaggaggaggagua

SEQ ID NO: 1199197 - RNA, 19 nt, Homo sapiens
gagaucaguuuccacauuc

SEQ ID NO: 1199198 - RNA, 19 nt, Homo sapiens
ucaaaggccaauauucuua

SEQ ID NO: 1199199 - RNA, 19 nt, Homo sapiens
guauauaacuuguccuuac

SEQ ID NO: 1199200 - RNA, 19 nt, Homo sapiens
ggacaaaacuucagucaag

SEQ ID NO: 1199201 - RNA, 19 nt, Homo sapiens
ggcaaucacugaagaggaa

SEQ ID NO: 1199202 - RNA, 19 nt, Homo sapiens
ggaguagcccugaaacaaa

SEQ ID NO: 1199203 - RNA, 19 nt, Homo sapiens
ggauaccaauuaaucuuga

SEQ ID NO: 1199204 - RNA, 19 nt, Homo sapiens
ucagaaacuccaagacuua

SEQ ID NO: 1199205 - RNA, 19 nt, Homo sapiens
agaacacccuggagcuuua

SEQ ID NO: 1199206 - RNA, 19 nt, Homo sapiens
agugagagauaaagucaua

SEQ ID NO: 1199207 - RNA, 19 nt, Homo sapiens
gaaccuagucuaaucugaa

SEQ ID NO: 1199208 - RNA, 19 nt, Homo sapiens
acacacaaacccacacuua

SEQ ID NO: 1199209 - RNA, 19 nt, Homo sapiens
gaagugagagauaaaguca

SEQ ID NO: 1199210 - RNA, 19 nt, Homo sapiens
gauguagguauuacuguua

SEQ ID NO: 1199211 - RNA, 19 nt, Homo sapiens
aaacaaaggcaaagcuauu

SEQ ID NO: 1199212 - RNA, 19 nt, Homo sapiens
gaaacuggacccugguuga

SEQ ID NO: 1199213 - RNA, 19 nt, Homo sapiens
caaaucacguggcuuuagu

SEQ ID NO: 1199214 - RNA, 19 nt, Homo sapiens
caagggaagugaucaaggu

SEQ ID NO: 1199215 - RNA, 19 nt, Homo sapiens
gagggaaacacuagacaaa

SEQ ID NO: 1199216 - RNA, 19 nt, Homo sapiens
acuaugugauuaccaguua

SEQ ID NO: 1199217 - RNA, 19 nt, Homo sapiens
ggagucauauauacaucaa

SEQ ID NO: 1199218 - RNA, 19 nt, Homo sapiens
gucaauaaucccaauguua

SEQ ID NO: 1199219 - RNA, 19 nt, Homo sapiens
ggucaauaaucccaauguu

SEQ ID NO: 1199220 - RNA, 19 nt, Homo sapiens
ggacacauacagugaccua

SEQ ID NO: 1199221 - RNA, 19 nt, Homo sapiens
ggaagauggugggcaauag

SEQ ID NO: 1199222 - RNA, 19 nt, Homo sapiens
aggcaaagcuauuuaccaa

SEQ ID NO: 1199223 - RNA, 19 nt, Homo sapiens
gaugacagcucugagucuu

SEQ ID NO: 1199224 - RNA, 19 nt, Homo sapiens
caagguuguugcugucauu

SEQ ID NO: 1199225 - RNA, 19 nt, Homo sapiens
caaaggccaauauucuuaa

SEQ ID NO: 1199226 - RNA, 19 nt, Homo sapiens
caugaaauagcuacaauga

SEQ ID NO: 1199227 - RNA, 19 nt, Homo sapiens
gaguagcccugaaacaaag

SEQ ID NO: 1199228 - RNA, 19 nt, Homo sapiens
cuucugugcuuuauauuga

SEQ ID NO: 1199229 - RNA, 19 nt, Homo sapiens
caaaguacugucaucauug

SEQ ID NO: 1199230 - RNA, 19 nt, Homo sapiens
aaacccacacuuacuauaa

SEQ ID NO: 1199231 - RNA, 19 nt, Homo sapiens
gaagcaagggcuagaggaa

SEQ ID NO: 1199232 - RNA, 19 nt, Homo sapiens
uaacaagaaugagucaaag

SEQ ID NO: 1199233 - RNA, 19 nt, Homo sapiens
gugauuaccaguuauauuc

SEQ ID NO: 1199234 - RNA, 19 nt, Homo sapiens
gucagaaacuccaagacuu

SEQ ID NO: 1199235 - RNA, 19 nt, Homo sapiens
gcuauacuucugugcuuua

SEQ ID NO: 1199236 - RNA, 19 nt, Homo sapiens
gaaauuacuagggcacuug

SEQ ID NO: 1199237 - RNA, 19 nt, Homo sapiens
gcuugaaccuagucuaauc

SEQ ID NO: 1199238 - RNA, 19 nt, Homo sapiens
ccauaggucugccuguaga

SEQ ID NO: 1199239 - RNA, 19 nt, Homo sapiens
cacuaaaucugagcuuauu

SEQ ID NO: 1199240 - RNA, 19 nt, Homo sapiens
cagauuuccucaccuuguu

SEQ ID NO: 1199241 - RNA, 19 nt, Homo sapiens
ucaaguuuguaaaggcaua

SEQ ID NO: 1199242 - RNA, 19 nt, Homo sapiens
gagccuaaagaguuugaua

SEQ ID NO: 1199243 - RNA, 19 nt, Homo sapiens
cacauucuccuguuuguuu

SEQ ID NO: 1199244 - RNA, 19 nt, Homo sapiens
ucauaaagccucaaacagu

SEQ ID NO: 1199245 - RNA, 19 nt, Homo sapiens
ggagaagagccuaguguag

SEQ ID NO: 1199246 - RNA, 19 nt, Homo sapiens
gagcuuccucugcauguuu

SEQ ID NO: 1199247 - RNA, 19 nt, Homo sapiens
guccauaggucugccugua

SEQ ID NO: 1199248 - RNA, 19 nt, Homo sapiens
gaccugauaaugaaucuau

SEQ ID NO: 1199249 - RNA, 19 nt, Homo sapiens
acaaaggcaaagcuauuua

SEQ ID NO: 1199250 - RNA, 19 nt, Homo sapiens
gcaaaucacguggcuuuag

SEQ ID NO: 1199251 - RNA, 19 nt, Homo sapiens
uaccagaccuuagcugaga

SEQ ID NO: 1199252 - RNA, 19 nt, Homo sapiens
ggccagguauauuguccua

SEQ ID NO: 1199253 - RNA, 19 nt, Homo sapiens
ucaagggccagguauauug

SEQ ID NO: 1199254 - RNA, 19 nt, Homo sapiens
ccagguauauuguccuagu

SEQ ID NO: 1199255 - RNA, 19 nt, Homo sapiens
uaugccaagucacaugaua

SEQ ID NO: 1199256 - RNA, 19 nt, Homo sapiens
gucauugaggcaaauauua

SEQ ID NO: 1199257 - RNA, 19 nt, Homo sapiens
aaacaagggaagugucaaa

SEQ ID NO: 1199258 - RNA, 19 nt, Homo sapiens
gguauuacuguuaugauug

SEQ ID NO: 1199259 - RNA, 19 nt, Homo sapiens
gggcgucaguccugcuuau

SEQ ID NO: 1199260 - RNA, 19 nt, Homo sapiens
ggucaagggccagguauau

SEQ ID NO: 1199261 - RNA, 19 nt, Homo sapiens
caaacccacacuuacuaua

SEQ ID NO: 1199262 - RNA, 19 nt, Homo sapiens
gaccagcauugggaugaaa

SEQ ID NO: 1199263 - RNA, 19 nt, Homo sapiens
aacgugaccugauaaugaa

SEQ ID NO: 1199264 - RNA, 19 nt, Homo sapiens
ugauguagguauuacuguu

SEQ ID NO: 1199265 - RNA, 19 nt, Homo sapiens
ggcagagccuguaguugga

SEQ ID NO: 1199266 - RNA, 19 nt, Homo sapiens
ggaggcaauuuuauggaua

SEQ ID NO: 1199267 - RNA, 19 nt, Homo sapiens
ggcaguggcugaggcagaa

SEQ ID NO: 1199268 - RNA, 19 nt, Homo sapiens
ucugcaacgugaccugaua

SEQ ID NO: 1199269 - RNA, 19 nt, Homo sapiens
caaagcuauuuaccaagga

SEQ ID NO: 1199270 - RNA, 19 nt, Homo sapiens
gaacacccuggagcuuuaa

SEQ ID NO: 1199271 - RNA, 19 nt, Homo sapiens
gccuaaagaguuugauaaa

SEQ ID NO: 1199272 - RNA, 19 nt, Homo sapiens
gggaaacacuagacaaaau

SEQ ID NO: 1199273 - RNA, 19 nt, Homo sapiens
cagauuaggcaaagggaaa

SEQ ID NO: 1199274 - RNA, 19 nt, Homo sapiens
cacaaacccacacuuacua

SEQ ID NO: 1199275 - RNA, 19 nt, Homo sapiens
guacuguaaccaagucuga

SEQ ID NO: 1199276 - RNA, 19 nt, Homo sapiens
gguggaagauacaacuaag

SEQ ID NO: 1199277 - RNA, 19 nt, Homo sapiens
cagagugacuacuggacuu

SEQ ID NO: 1199278 - RNA, 19 nt, Homo sapiens
acauucuccuguuuguuua

SEQ ID NO: 1199279 - RNA, 19 nt, Homo sapiens
gcaaugaaguucucaaauu

SEQ ID NO: 1199280 - RNA, 19 nt, Homo sapiens
gcaaauaccuaucccuaaa

SEQ ID NO: 1199281 - RNA, 19 nt, Homo sapiens
gaaaacaacucuagcuuua

SEQ ID NO: 1199282 - RNA, 19 nt, Homo sapiens
gaaguaauagguacaguua

SEQ ID NO: 1199283 - RNA, 19 nt, Homo sapiens
ggauggaucuuuacaguug

SEQ ID NO: 1199284 - RNA, 19 nt, Homo sapiens
ucaaagaucugccaaauac

SEQ ID NO: 1199285 - RNA, 19 nt, Homo sapiens
ccaccaugcugcucacuua

SEQ ID NO: 1199286 - RNA, 19 nt, Homo sapiens
gcaagaccaugcuauugaa

SEQ ID NO: 1199287 - RNA, 19 nt, Homo sapiens
guuguuugcucgaaauuua

SEQ ID NO: 1199288 - RNA, 19 nt, Homo sapiens
gaagaggauacaucuguua

SEQ ID NO: 1199289 - RNA, 19 nt, Homo sapiens
gcuccaaacugucuucuug

SEQ ID NO: 1199290 - RNA, 19 nt, Homo sapiens
ccacuuggcccuuguauga

SEQ ID NO: 1199291 - RNA, 19 nt, Homo sapiens
ccagaggucuuaauccuau

SEQ ID NO: 1199292 - RNA, 19 nt, Homo sapiens
gggaauauuuggaguuguu

SEQ ID NO: 1199293 - RNA, 19 nt, Homo sapiens
ugaaugaaauggaacauca

SEQ ID NO: 1199294 - RNA, 19 nt, Homo sapiens
ggaagaggauacaucuguu

SEQ ID NO: 1199295 - RNA, 19 nt, Homo sapiens
ugaauuggaugcuauggaa

SEQ ID NO: 1199296 - RNA, 19 nt, Homo sapiens
gcaaguaaacagugugauu

SEQ ID NO: 1199297 - RNA, 19 nt, Homo sapiens
gaacaucagacauuacaau

SEQ ID NO: 1199298 - RNA, 19 nt, Homo sapiens
gaauuuguguucccauuag

SEQ ID NO: 1199299 - RNA, 19 nt, Homo sapiens
gagaauuuguguucccauu

SEQ ID NO: 1199300 - RNA, 19 nt, Homo sapiens
gcauuugccuucucugaau

SEQ ID NO: 1199301 - RNA, 19 nt, Homo sapiens
gcaaccacuucuaaacuau

SEQ ID NO: 1199302 - RNA, 19 nt, Homo sapiens
gugacuagccuucauguaa

SEQ ID NO: 1199303 - RNA, 19 nt, Homo sapiens
cuacgaaggucuuauacug

SEQ ID NO: 1199304 - RNA, 19 nt, Homo sapiens
gacagaagcaccuacguuu

SEQ ID NO: 1199305 - RNA, 19 nt, Homo sapiens
aaacaacucuagcuuuaca

SEQ ID NO: 1199306 - RNA, 19 nt, Homo sapiens
caucagacauuacaauugg

SEQ ID NO: 1199307 - RNA, 19 nt, Homo sapiens
ggaauaccauacaaugauc

SEQ ID NO: 1199308 - RNA, 19 nt, Homo sapiens
caaggucacuuuccaagca

SEQ ID NO: 1199309 - RNA, 19 nt, Homo sapiens
ugacauuucuuguaugcaa

SEQ ID NO: 1199310 - RNA, 19 nt, Homo sapiens
ucacuuaugucauccacuu

SEQ ID NO: 1199311 - RNA, 19 nt, Homo sapiens
gaagcugacuaugaucuug

SEQ ID NO: 1199312 - RNA, 19 nt, Homo sapiens
gcagaacaaaucaguuaaa

SEQ ID NO: 1199313 - RNA, 19 nt, Homo sapiens
aaacauggcagcaaguaaa

SEQ ID NO: 1199314 - RNA, 19 nt, Homo sapiens
acagaggccuuuguucuuu

SEQ ID NO: 1199315 - RNA, 19 nt, Homo sapiens
guaaacagugugauuguga

SEQ ID NO: 1199316 - RNA, 19 nt, Homo sapiens
ugacuagccuucauguaau

SEQ ID NO: 1199317 - RNA, 19 nt, Homo sapiens
caaacugucuucuuguuac

SEQ ID NO: 1199318 - RNA, 19 nt, Homo sapiens
gaguugcacuaacauucua

SEQ ID NO: 1199319 - RNA, 19 nt, Homo sapiens
uuaccaacccauauucuua

SEQ ID NO: 1199320 - RNA, 19 nt, Homo sapiens
ggaguuguuugcucgaaau

SEQ ID NO: 1199321 - RNA, 19 nt, Homo sapiens
ccaaacugucuucuuguua

SEQ ID NO: 1199322 - RNA, 19 nt, Homo sapiens
uggcagaacaaaucaguua

SEQ ID NO: 1199323 - RNA, 19 nt, Homo sapiens
ggcaagaccaugcuauuga

SEQ ID NO: 1199324 - RNA, 19 nt, Homo sapiens
gaucuugauuaaaguagug

SEQ ID NO: 1199325 - RNA, 19 nt, Homo sapiens
uaaacagugugauugugaa

SEQ ID NO: 1199326 - RNA, 19 nt, Homo sapiens
uccaagcacuuucugguuu

SEQ ID NO: 1199327 - RNA, 19 nt, Homo sapiens
gguaagcaguuauaaagac

SEQ ID NO: 1199328 - RNA, 19 nt, Homo sapiens
gacuagccuucauguaauu

SEQ ID NO: 1199329 - RNA, 19 nt, Homo sapiens
gcaguuuucuuuuaucuga

SEQ ID NO: 1199330 - RNA, 19 nt, Homo sapiens
caaggugaauuggaugcua

SEQ ID NO: 1199331 - RNA, 19 nt, Homo sapiens
caaguaaacagugugauug

SEQ ID NO: 1199332 - RNA, 19 nt, Homo sapiens
gauuuuggauggaucuuua

SEQ ID NO: 1199333 - RNA, 19 nt, Homo sapiens
caaauacagcaaauaccua

SEQ ID NO: 1199334 - RNA, 19 nt, Homo sapiens
gaauuugcaaccucuggua

SEQ ID NO: 1199335 - RNA, 19 nt, Homo sapiens
uaagugguaagcaguuaua

SEQ ID NO: 1199336 - RNA, 19 nt, Homo sapiens
gcccauuacuuuaccacuu

SEQ ID NO: 1199337 - RNA, 19 nt, Homo sapiens
ugcaaccacuucuaaacua

SEQ ID NO: 1199338 - RNA, 19 nt, Homo sapiens
gguauacuguuauguucug

SEQ ID NO: 1199339 - RNA, 19 nt, Homo sapiens
guagugguuucuucauugu

SEQ ID NO: 1199340 - RNA, 19 nt, Homo sapiens
ucuggaagcugacuaugau

SEQ ID NO: 1199341 - RNA, 19 nt, Homo sapiens
caaccacuucuaaacuaua

SEQ ID NO: 1199342 - RNA, 19 nt, Homo sapiens
cauuccagaccacaaauua

SEQ ID NO: 1199343 - RNA, 19 nt, Homo sapiens
uguaugaccugaauuugca

SEQ ID NO: 1199344 - RNA, 19 nt, Homo sapiens
gccuugugcucuccacuuu

SEQ ID NO: 1199345 - RNA, 19 nt, Homo sapiens
acauuaaaguccagauuuc

SEQ ID NO: 1199346 - RNA, 19 nt, Homo sapiens
uuaaaguagugguuucuuc

SEQ ID NO: 1199347 - RNA, 19 nt, Homo sapiens
gcaccuacguuuuauaaag

SEQ ID NO: 1199348 - RNA, 19 nt, Homo sapiens
cagaagcaccuacguuuua

SEQ ID NO: 1199349 - RNA, 19 nt, Homo sapiens
gcaaauacagcaaauaccu

SEQ ID NO: 1199350 - RNA, 19 nt, Homo sapiens
cacauuaaaguccagauuu

SEQ ID NO: 1199351 - RNA, 19 nt, Homo sapiens
uaaaguagugguuucuuca

SEQ ID NO: 1199352 - RNA, 19 nt, Homo sapiens
guacucuucacucacauaa

SEQ ID NO: 1199353 - RNA, 19 nt, Homo sapiens
aauaaccaauucaggagaa

SEQ ID NO: 1199354 - RNA, 19 nt, Homo sapiens
aauuucagcauguggauua

SEQ ID NO: 1199355 - RNA, 19 nt, Homo sapiens
gggcaaugaaguucucaaa

SEQ ID NO: 1199356 - RNA, 19 nt, Homo sapiens
gcccuacgaaggucuuaua

SEQ ID NO: 1199357 - RNA, 19 nt, Homo sapiens
gauccaccauggcagaaca

SEQ ID NO: 1199358 - RNA, 19 nt, Homo sapiens
gauccaggaaggucucaaa

SEQ ID NO: 1199359 - RNA, 19 nt, Homo sapiens
cccauuacuuuaccacuug

SEQ ID NO: 1199360 - RNA, 19 nt, Homo sapiens
gcccuuguaugaccugaau

SEQ ID NO: 1199361 - RNA, 19 nt, Homo sapiens
gcugcucacuuaugucauc

SEQ ID NO: 1199362 - RNA, 19 nt, Homo sapiens
ccaugcugcucacuuaugu

SEQ ID NO: 1199363 - RNA, 19 nt, Homo sapiens
cagccagguuggacuaguu

SEQ ID NO: 1199364 - RNA, 19 nt, Homo sapiens
uaugugaaauggcaaagca

SEQ ID NO: 1199365 - RNA, 19 nt, Homo sapiens
uagguacaguuauuuguca

SEQ ID NO: 1199366 - RNA, 19 nt, Homo sapiens
gauggaucuuuacaguuga

SEQ ID NO: 1199367 - RNA, 19 nt, Homo sapiens
gaaauggaacaucagacau

SEQ ID NO: 1199368 - RNA, 19 nt, Homo sapiens
aaacaggacaaggguagua

SEQ ID NO: 1199369 - RNA, 19 nt, Homo sapiens
gugguaagcaguuauaaag

SEQ ID NO: 1199370 - RNA, 19 nt, Homo sapiens
agugguuucuucauuguuu

SEQ ID NO: 1199371 - RNA, 19 nt, Homo sapiens
aguagugguuucuucauug

SEQ ID NO: 1199372 - RNA, 19 nt, Homo sapiens
uucagcauguggauuauuu

SEQ ID NO: 1199373 - RNA, 19 nt, Homo sapiens
gcccuguacucuucacuca

SEQ ID NO: 1199374 - RNA, 19 nt, Homo sapiens
ccagaccacaaauuaauug

SEQ ID NO: 1199375 - RNA, 19 nt, Homo sapiens
aaacugcucuaccauugag

SEQ ID NO: 1199376 - RNA, 19 nt, Homo sapiens
caaauaccuaucccuaaau

SEQ ID NO: 1199377 - RNA, 19 nt, Homo sapiens
agaauuuguguucccauua

SEQ ID NO: 1199378 - RNA, 19 nt, Homo sapiens
ugaaauggaacaucagaca

SEQ ID NO: 1199379 - RNA, 19 nt, Homo sapiens
gcacagaacucagaauaaa

SEQ ID NO: 1199380 - RNA, 19 nt, Homo sapiens
ccaauaagcuccaguaugg

SEQ ID NO: 1199381 - RNA, 19 nt, Homo sapiens
ccaaauggauggcaacaaa

SEQ ID NO: 1199382 - RNA, 19 nt, Homo sapiens
gaaaucuguuugggaauua

SEQ ID NO: 1199383 - RNA, 19 nt, Homo sapiens
caacaaauuugcagugaau

SEQ ID NO: 1199384 - RNA, 19 nt, Homo sapiens
gaacaauucucauucuuac

SEQ ID NO: 1199385 - RNA, 19 nt, Homo sapiens
ggacagugauucaaaguca

SEQ ID NO: 1199386 - RNA, 19 nt, Homo sapiens
gcacuucuguuuaugaguu

SEQ ID NO: 1199387 - RNA, 19 nt, Homo sapiens
ugaacaaccugcccucuaa

SEQ ID NO: 1199388 - RNA, 19 nt, Homo sapiens
ucacaaauguucacacaga

SEQ ID NO: 1199389 - RNA, 19 nt, Homo sapiens
ggagacagcuugcaaacca

SEQ ID NO: 1199390 - RNA, 19 nt, Homo sapiens
gaacuuacacaagauagua

SEQ ID NO: 1199391 - RNA, 19 nt, Homo sapiens
caucugaucucacuaauac

SEQ ID NO: 1199392 - RNA, 19 nt, Homo sapiens
gaaggugucauugaaauaa

SEQ ID NO: 1199393 - RNA, 19 nt, Homo sapiens
caaagaagccaaucaguuc

SEQ ID NO: 1199394 - RNA, 19 nt, Homo sapiens
agacuugccucaguucuua

SEQ ID NO: 1199395 - RNA, 19 nt, Homo sapiens
aaaccaagcuugaauggau

SEQ ID NO: 1199396 - RNA, 19 nt, Homo sapiens
cacuaaagauucugaguuu

SEQ ID NO: 1199397 - RNA, 19 nt, Homo sapiens
ucucagaacuuaacuuuca

SEQ ID NO: 1199398 - RNA, 19 nt, Homo sapiens
cgacauacacccauuggua

SEQ ID NO: 1199399 - RNA, 19 nt, Homo sapiens
caagauaucaguguuauga

SEQ ID NO: 1199400 - RNA, 19 nt, Homo sapiens
gcaggaauccguuugcauu

SEQ ID NO: 1199401 - RNA, 19 nt, Homo sapiens
uggaagagcuggugcuuau

SEQ ID NO: 1199402 - RNA, 19 nt, Homo sapiens
ggcaacaaaucacuaaaga

SEQ ID NO: 1199403 - RNA, 19 nt, Homo sapiens
gcaccggucagaucaauuu

SEQ ID NO: 1199404 - RNA, 19 nt, Homo sapiens
gcaucaaggugccacugua

SEQ ID NO: 1199405 - RNA, 19 nt, Homo sapiens
gaaauguuggguuaaauug

SEQ ID NO: 1199406 - RNA, 19 nt, Homo sapiens
gagcaacaauuagauuuca

SEQ ID NO: 1199407 - RNA, 19 nt, Homo sapiens
ggauagugcuuuaggaagu

SEQ ID NO: 1199408 - RNA, 19 nt, Homo sapiens
cagcaaaugucaaugaaca

SEQ ID NO: 1199409 - RNA, 19 nt, Homo sapiens
aauggugacucaaucaaua

SEQ ID NO: 1199410 - RNA, 19 nt, Homo sapiens
ccaggcauuuguaauuuaa

SEQ ID NO: 1199411 - RNA, 19 nt, Homo sapiens
gaagaacaaguauuagguu

SEQ ID NO: 1199412 - RNA, 19 nt, Homo sapiens
gauagugcuuuaggaagua

SEQ ID NO: 1199413 - RNA, 19 nt, Homo sapiens
gaauuccucugcccuuguu

SEQ ID NO: 1199414 - RNA, 19 nt, Homo sapiens
gacccuaaauuaugcacua

SEQ ID NO: 1199415 - RNA, 19 nt, Homo sapiens
ucaaagcacuaucacucua

SEQ ID NO: 1199416 - RNA, 19 nt, Homo sapiens
aagcaaagcugcacuaaaa

SEQ ID NO: 1199417 - RNA, 19 nt, Homo sapiens
gaccagaggaccaaaugua

SEQ ID NO: 1199418 - RNA, 19 nt, Homo sapiens
guagcacacuguaucuaaa

SEQ ID NO: 1199419 - RNA, 19 nt, Homo sapiens
gauaucagguugucuucug

SEQ ID NO: 1199420 - RNA, 19 nt, Homo sapiens
gaagcaagcaaacaguaaa

SEQ ID NO: 1199421 - RNA, 19 nt, Homo sapiens
aagcuugaauggaugaaua

SEQ ID NO: 1199422 - RNA, 19 nt, Homo sapiens
augaagggcuuaaauagaa

SEQ ID NO: 1199423 - RNA, 19 nt, Homo sapiens
gagcaucugaucucacuaa

SEQ ID NO: 1199424 - RNA, 19 nt, Homo sapiens
gagcagcaaaugucaauga

SEQ ID NO: 1199425 - RNA, 19 nt, Homo sapiens
gauacaggaaucuucuuua

SEQ ID NO: 1199426 - RNA, 19 nt, Homo sapiens
gaugaagggcuuaaauaga

SEQ ID NO: 1199427 - RNA, 19 nt, Homo sapiens
gaaacagggauaauauuca

SEQ ID NO: 1199428 - RNA, 19 nt, Homo sapiens
aaaagucgcuguaaugaaa

SEQ ID NO: 1199429 - RNA, 19 nt, Homo sapiens
guugguaauucaucaguuu

SEQ ID NO: 1199430 - RNA, 19 nt, Homo sapiens
uaaagacccuaaauuaugc

SEQ ID NO: 1199431 - RNA, 19 nt, Homo sapiens
aagcuacacuggaagaauu

SEQ ID NO: 1199432 - RNA, 19 nt, Homo sapiens
gagagcaacaauuagauuu

SEQ ID NO: 1199433 - RNA, 19 nt, Homo sapiens
aaccugcccucuaauuaua

SEQ ID NO: 1199434 - RNA, 19 nt, Homo sapiens
gaaagcaaagcugcacuaa

SEQ ID NO: 1199435 - RNA, 19 nt, Homo sapiens
ggaaagcaaagcugcacua

SEQ ID NO: 1199436 - RNA, 19 nt, Homo sapiens
gaaagucuuccuugaaaca

SEQ ID NO: 1199437 - RNA, 19 nt, Homo sapiens
cacuguaucuaaagacaua

SEQ ID NO: 1199438 - RNA, 19 nt, Homo sapiens
ugaugaagcuacacuggaa

SEQ ID NO: 1199439 - RNA, 19 nt, Homo sapiens
ggaaguagccgacauacac

SEQ ID NO: 1199440 - RNA, 19 nt, Homo sapiens
gaacaacagcaagauauca

SEQ ID NO: 1199441 - RNA, 19 nt, Homo sapiens
gagcagucgaucuuuauuu

SEQ ID NO: 1199442 - RNA, 19 nt, Homo sapiens
ucacuaauacugcaucuga

SEQ ID NO: 1199443 - RNA, 19 nt, Homo sapiens
caauagcacuguuaaagac

SEQ ID NO: 1199444 - RNA, 19 nt, Homo sapiens
ggagagcaacaauuagauu

SEQ ID NO: 1199445 - RNA, 19 nt, Homo sapiens
ucaaagaagccaaucaguu

SEQ ID NO: 1199446 - RNA, 19 nt, Homo sapiens
gguauaggcuguuuuguug

SEQ ID NO: 1199447 - RNA, 19 nt, Homo sapiens
guugaaauguuggguuaaa

SEQ ID NO: 1199448 - RNA, 19 nt, Homo sapiens
caacguaaucuuaguggaa

SEQ ID NO: 1199449 - RNA, 19 nt, Homo sapiens
guaaauaacaccaacaaac

SEQ ID NO: 1199450 - RNA, 19 nt, Homo sapiens
ucaggaaaccucaugcuuu

SEQ ID NO: 1199451 - RNA, 19 nt, Homo sapiens
gcaauaaucaaagcacuau

SEQ ID NO: 1199452 - RNA, 19 nt, Homo sapiens
agacccaaaucuacuguuu

SEQ ID NO: 1199453 - RNA, 19 nt, Homo sapiens
ccacuucuaucauccaauc

SEQ ID NO: 1199454 - RNA, 19 nt, Homo sapiens
agaaaucuguuugggaauu

SEQ ID NO: 1199455 - RNA, 19 nt, Homo sapiens
ucagauuccuagcaaggua

SEQ ID NO: 1199456 - RNA, 19 nt, Homo sapiens
ggagcuagcacacauagau

SEQ ID NO: 1199457 - RNA, 19 nt, Homo sapiens
cuuaacaagugucuaaaga

SEQ ID NO: 1199458 - RNA, 19 nt, Homo sapiens
caaccugcccucuaauuau

SEQ ID NO: 1199459 - RNA, 19 nt, Homo sapiens
caaggugccacuguaaaua

SEQ ID NO: 1199460 - RNA, 19 nt, Homo sapiens
gaaugccacaggacacaua

SEQ ID NO: 1199461 - RNA, 19 nt, Homo sapiens
gaaaacgacugucuucuac

SEQ ID NO: 1199462 - RNA, 19 nt, Homo sapiens
ggugaaccguagacaagaa

SEQ ID NO: 1199463 - RNA, 19 nt, Homo sapiens
ggaccauccuacuguugaa

SEQ ID NO: 1199464 - RNA, 19 nt, Homo sapiens
ucuaauaucccacgaucua

SEQ ID NO: 1199465 - RNA, 19 nt, Homo sapiens
gagcuccaaugucaucuca

SEQ ID NO: 1199466 - RNA, 19 nt, Homo sapiens
gaugaacuuacacaagaua

SEQ ID NO: 1199467 - RNA, 19 nt, Homo sapiens
uaaacuugauuccgacaau

SEQ ID NO: 1199468 - RNA, 19 nt, Homo sapiens
gcagacagccuucccaaac

SEQ ID NO: 1199469 - RNA, 19 nt, Homo sapiens
guuuauaucugccaguugu

SEQ ID NO: 1199470 - RNA, 19 nt, Homo sapiens
guaaaugucaguucacaca

SEQ ID NO: 1199471 - RNA, 19 nt, Homo sapiens
guucuuaacaagugucuaa

SEQ ID NO: 1199472 - RNA, 19 nt, Homo sapiens
ccucaguucuuaacaagug

SEQ ID NO: 1199473 - RNA, 19 nt, Homo sapiens
uaacauguagcacacugua

SEQ ID NO: 1199474 - RNA, 19 nt, Homo sapiens
gugacucaaucaauaaaga

SEQ ID NO: 1199475 - RNA, 19 nt, Homo sapiens
caacaacauagcucaaaga

SEQ ID NO: 1199476 - RNA, 19 nt, Homo sapiens
cccgacaucugaaaugauu

SEQ ID NO: 1199477 - RNA, 19 nt, Homo sapiens
gcacgucaacaggcaauaa

SEQ ID NO: 1199478 - RNA, 19 nt, Homo sapiens
ucaaugacuuagagaaauc

SEQ ID NO: 1199479 - RNA, 19 nt, Homo sapiens
gcaaaccgcucaucuauaa

SEQ ID NO: 1199480 - RNA, 19 nt, Homo sapiens
ggagagggauuauguuaua

SEQ ID NO: 1199481 - RNA, 19 nt, Homo sapiens
gaagagcccuuauuugaau

SEQ ID NO: 1199482 - RNA, 19 nt, Homo sapiens
ggaaaggucucaaggaaga

SEQ ID NO: 1199483 - RNA, 19 nt, Homo sapiens
gauaaucucuccaucuaaa

SEQ ID NO: 1199484 - RNA, 19 nt, Homo sapiens
gaagaggaauuauacagaa

SEQ ID NO: 1199485 - RNA, 19 nt, Homo sapiens
cagaauaacuugauccauu

SEQ ID NO: 1199486 - RNA, 19 nt, Homo sapiens
ggugggagguggagucuua

SEQ ID NO: 1199487 - RNA, 19 nt, Homo sapiens
gauaagagacuuccugauu

SEQ ID NO: 1199488 - RNA, 19 nt, Homo sapiens
ggacacagacauucccuua

SEQ ID NO: 1199489 - RNA, 19 nt, Homo sapiens
caucaagucuggagaaaga

SEQ ID NO: 1199490 - RNA, 19 nt, Homo sapiens
gcacagggauguuuuguuu

SEQ ID NO: 1199491 - RNA, 19 nt, Homo sapiens
gagaaucacuuugucauag

SEQ ID NO: 1199492 - RNA, 19 nt, Homo sapiens
caacauuacaguucucaua

SEQ ID NO: 1199493 - RNA, 19 nt, Homo sapiens
guaucaagcuguuuaagug

SEQ ID NO: 1199494 - RNA, 19 nt, Homo sapiens
ucuccuagcugcagcaaua

SEQ ID NO: 1199495 - RNA, 19 nt, Homo sapiens
gaaagcaacauuacaguuc

SEQ ID NO: 1199496 - RNA, 19 nt, Homo sapiens
gacaaugacucccaugugu

SEQ ID NO: 1199497 - RNA, 19 nt, Homo sapiens
ggaaggagagggauuaugu

SEQ ID NO: 1199498 - RNA, 19 nt, Homo sapiens
uaagagaaauuuccucaag

SEQ ID NO: 1199499 - RNA, 19 nt, Homo sapiens
gagcagcauugacacauau

SEQ ID NO: 1199500 - RNA, 19 nt, Homo sapiens
ucacauggcauaaaugaaa

SEQ ID NO: 1199501 - RNA, 19 nt, Homo sapiens
ucaccugacuuaguaauaa

SEQ ID NO: 1199502 - RNA, 19 nt, Homo sapiens
ccagaaauccuaaagaaga

SEQ ID NO: 1199503 - RNA, 19 nt, Homo sapiens
gcaaggcugugaccaagau

SEQ ID NO: 1199504 - RNA, 19 nt, Homo sapiens
ccuauuacuugguagcuua

SEQ ID NO: 1199505 - RNA, 19 nt, Homo sapiens
ccaaauagcugggaucacu

SEQ ID NO: 1199506 - RNA, 19 nt, Homo sapiens
cagguugcauuuauuguaa

SEQ ID NO: 1199507 - RNA, 19 nt, Homo sapiens
cagcaauacuuugacauuu

SEQ ID NO: 1199508 - RNA, 19 nt, Homo sapiens
gcagaugcugucuuaauuu

SEQ ID NO: 1199509 - RNA, 19 nt, Homo sapiens
ccacuucccucuuugacuu

SEQ ID NO: 1199510 - RNA, 19 nt, Homo sapiens
ucaaauguauaaccaccua

SEQ ID NO: 1199511 - RNA, 19 nt, Homo sapiens
ggacauggccuugguaaag

SEQ ID NO: 1199512 - RNA, 19 nt, Homo sapiens
aaagaaagacugggauuaa

SEQ ID NO: 1199513 - RNA, 19 nt, Homo sapiens
gcagguugcauuuauugua

SEQ ID NO: 1199514 - RNA, 19 nt, Homo sapiens
acaaugaggcugaguguuu

SEQ ID NO: 1199515 - RNA, 19 nt, Homo sapiens
agagaaauuuccucaaguu

SEQ ID NO: 1199516 - RNA, 19 nt, Homo sapiens
cagaugcugucuuaauuug

SEQ ID NO: 1199517 - RNA, 19 nt, Homo sapiens
uuacaaagcccaccaggaa

SEQ ID NO: 1199518 - RNA, 19 nt, Homo sapiens
gaggauaggauauuuaagu

SEQ ID NO: 1199519 - RNA, 19 nt, Homo sapiens
caccucagccucccaaaua

SEQ ID NO: 1199520 - RNA, 19 nt, Homo sapiens
gggaauaauuuacaaucug

SEQ ID NO: 1199521 - RNA, 19 nt, Homo sapiens
aaccagaaauccuaaagaa

SEQ ID NO: 1199522 - RNA, 19 nt, Homo sapiens
gacauucccuuacugaaca

SEQ ID NO: 1199523 - RNA, 19 nt, Homo sapiens
cugaagagcccuuauuuga

SEQ ID NO: 1199524 - RNA, 19 nt, Homo sapiens
gcagcaauacuuugacauu

SEQ ID NO: 1199525 - RNA, 19 nt, Homo sapiens
ugacacauaucugcuuuga

SEQ ID NO: 1199526 - RNA, 19 nt, Homo sapiens
gguccuguguuauuuaaga

SEQ ID NO: 1199527 - RNA, 19 nt, Homo sapiens
agacugggauuaaucucua

SEQ ID NO: 1199528 - RNA, 19 nt, Homo sapiens
ccacgagaaagcaacauua

SEQ ID NO: 1199529 - RNA, 19 nt, Homo sapiens
caucuaaaguuccuucauc

SEQ ID NO: 1199530 - RNA, 19 nt, Homo sapiens
aggauaaucucuccaucua

SEQ ID NO: 1199531 - RNA, 19 nt, Homo sapiens
ugaaucccauuguccuaua

SEQ ID NO: 1199532 - RNA, 19 nt, Homo sapiens
gagaucaaauguauaacca

SEQ ID NO: 1199533 - RNA, 19 nt, Homo sapiens
gugcuucacuggaaauaau

SEQ ID NO: 1199534 - RNA, 19 nt, Homo sapiens
uaaauggcguguacugcaa

SEQ ID NO: 1199535 - RNA, 19 nt, Homo sapiens
gggcucacauucucaccua

SEQ ID NO: 1199536 - RNA, 19 nt, Homo sapiens
gcgguuagccagccuguaa

SEQ ID NO: 1199537 - RNA, 19 nt, Homo sapiens
gugguugacuugaguaaug

SEQ ID NO: 1199538 - RNA, 19 nt, Homo sapiens
ugaccaagaugcccaaagu

SEQ ID NO: 1199539 - RNA, 19 nt, Homo sapiens
guucuuuccucuucauuug

SEQ ID NO: 1199540 - RNA, 19 nt, Homo sapiens
gaugcugucuuaauuugug

SEQ ID NO: 1199541 - RNA, 19 nt, Homo sapiens
gaaaagaauguguguguuu

SEQ ID NO: 1199542 - RNA, 19 nt, Homo sapiens
cauacuaacugguuuggau

SEQ ID NO: 1199543 - RNA, 19 nt, Homo sapiens
ggacaacaguuccaauucc

SEQ ID NO: 1199544 - RNA, 19 nt, Homo sapiens
ccauggagccagcagaaua

SEQ ID NO: 1199545 - RNA, 19 nt, Homo sapiens
gaauagucuuuaccuuuag

SEQ ID NO: 1199546 - RNA, 19 nt, Homo sapiens
ggcagaagcuuuugagauu

SEQ ID NO: 1199547 - RNA, 19 nt, Homo sapiens
acaaguaucaagcuguuua

SEQ ID NO: 1199548 - RNA, 19 nt, Homo sapiens
gaaagacugggauuaaucu

SEQ ID NO: 1199549 - RNA, 19 nt, Homo sapiens
caaugaggcugaguguuug

SEQ ID NO: 1199550 - RNA, 19 nt, Homo sapiens
caccagcucugccuuuaga

SEQ ID NO: 1199551 - RNA, 19 nt, Homo sapiens
ucaagcagauccaggugaa

SEQ ID NO: 1199552 - RNA, 19 nt, Homo sapiens
caucaucgagucuguguuu

SEQ ID NO: 1199553 - RNA, 19 nt, Homo sapiens
cagaggauaggauauuuaa

SEQ ID NO: 1199554 - RNA, 19 nt, Homo sapiens
gaauucaccuuggaaaugc

SEQ ID NO: 1199555 - RNA, 19 nt, Homo sapiens
gagaaauuuccucaaguuu

SEQ ID NO: 1199556 - RNA, 19 nt, Homo sapiens
uaagagacuuccugauucu

SEQ ID NO: 1199557 - RNA, 19 nt, Homo sapiens
ugagcagcauugacacaua

SEQ ID NO: 1199558 - RNA, 19 nt, Homo sapiens
gaagugccauuuguugaag

SEQ ID NO: 1199559 - RNA, 19 nt, Homo sapiens
ucaaugaauucaccuugga

SEQ ID NO: 1199560 - RNA, 19 nt, Homo sapiens
cugcaaaguuggccacuga

SEQ ID NO: 1199561 - RNA, 19 nt, Homo sapiens
ggucugacgguguccuuua

SEQ ID NO: 1199562 - RNA, 19 nt, Homo sapiens
ugucuuaauuuguggauga

SEQ ID NO: 1199563 - RNA, 19 nt, Homo sapiens
gaaaugcaccgccucaacu

SEQ ID NO: 1199564 - RNA, 19 nt, Homo sapiens
ccaaagugcugggauuaca

SEQ ID NO: 1199565 - RNA, 19 nt, Homo sapiens
auaagagacuuccugauuc

SEQ ID NO: 1199566 - RNA, 19 nt, Homo sapiens
ccacuuacguaaaacauuu

SEQ ID NO: 1199567 - RNA, 19 nt, Homo sapiens
ccagaggauaggauauuua

SEQ ID NO: 1199568 - RNA, 19 nt, Homo sapiens
uggcauaaaugaaaggaau

SEQ ID NO: 1199569 - RNA, 19 nt, Homo sapiens
gugcugggauuacagaugu

SEQ ID NO: 1199570 - RNA, 19 nt, Homo sapiens
agacaggguuucaccaugu

SEQ ID NO: 1199571 - RNA, 19 nt, Homo sapiens
ucuagaggcuggcugcauu

SEQ ID NO: 1199572 - RNA, 19 nt, Homo sapiens
caaaauggaugucccugaa

SEQ ID NO: 1199573 - RNA, 19 nt, Homo sapiens
cuacugaccgcuagauaaa

SEQ ID NO: 1199574 - RNA, 19 nt, Homo sapiens
cacaaaaucuccuuccuuu

SEQ ID NO: 1199575 - RNA, 19 nt, Homo sapiens
cggcugcaguuccaaguuu

SEQ ID NO: 1199576 - RNA, 19 nt, Homo sapiens
augcaggacuggucucuaa

SEQ ID NO: 1199577 - RNA, 19 nt, Homo sapiens
ugaagagcccuuauuugaa

SEQ ID NO: 1199578 - RNA, 19 nt, Homo sapiens
ggagugcaguggcgcaauc

SEQ ID NO: 1199579 - RNA, 19 nt, Homo sapiens
gaagguaaauacaagguua

SEQ ID NO: 1199580 - RNA, 19 nt, Homo sapiens
caaggaauguguuagcuua

SEQ ID NO: 1199581 - RNA, 19 nt, Homo sapiens
gcucuuguguccauuauua

SEQ ID NO: 1199582 - RNA, 19 nt, Homo sapiens
gcaaagaaaugcuucaauc

SEQ ID NO: 1199583 - RNA, 19 nt, Homo sapiens
ggacaugguuugcagcuuu

SEQ ID NO: 1199584 - RNA, 19 nt, Homo sapiens
cagcaaagcuccuauacuu

SEQ ID NO: 1199585 - RNA, 19 nt, Homo sapiens
gaaaucauccaucacauaa

SEQ ID NO: 1199586 - RNA, 19 nt, Homo sapiens
ccucauaagugcauauaua

SEQ ID NO: 1199587 - RNA, 19 nt, Homo sapiens
gagaacaacucacccaaug

SEQ ID NO: 1199588 - RNA, 19 nt, Homo sapiens
gaaaugcacuuguaaacag

SEQ ID NO: 1199589 - RNA, 19 nt, Homo sapiens
cagcagauuucuuugauaa

SEQ ID NO: 1199590 - RNA, 19 nt, Homo sapiens
gaaagaaccacaaaucuca

SEQ ID NO: 1199591 - RNA, 19 nt, Homo sapiens
cgagauagaugguguuguu

SEQ ID NO: 1199592 - RNA, 19 nt, Homo sapiens
ccaagcaguugauugauaa

SEQ ID NO: 1199593 - RNA, 19 nt, Homo sapiens
ccacugcacuuguuauuau

SEQ ID NO: 1199594 - RNA, 19 nt, Homo sapiens
ccacaaaucucaauagaac

SEQ ID NO: 1199595 - RNA, 19 nt, Homo sapiens
ugaaugcugucauagcuua

SEQ ID NO: 1199596 - RNA, 19 nt, Homo sapiens
caggaaauguaacuagaua

SEQ ID NO: 1199597 - RNA, 19 nt, Homo sapiens
caacaaggacuucagcuuu

SEQ ID NO: 1199598 - RNA, 19 nt, Homo sapiens
gaaaagaaccagagauuaa

SEQ ID NO: 1199599 - RNA, 19 nt, Homo sapiens
gauagaugguguuguuuau

SEQ ID NO: 1199600 - RNA, 19 nt, Homo sapiens
ucacagggaugggcauaua

SEQ ID NO: 1199601 - RNA, 19 nt, Homo sapiens
gaggccaaguuucauauuu

SEQ ID NO: 1199602 - RNA, 19 nt, Homo sapiens
gcagcagauuucuuugaua

SEQ ID NO: 1199603 - RNA, 19 nt, Homo sapiens
gaagggccguuuagguuau

SEQ ID NO: 1199604 - RNA, 19 nt, Homo sapiens
ccacaagcaucuaaggauu

SEQ ID NO: 1199605 - RNA, 19 nt, Homo sapiens
ggacccagauguuggcauu

SEQ ID NO: 1199606 - RNA, 19 nt, Homo sapiens
gagagaaagccaauggaua

SEQ ID NO: 1199607 - RNA, 19 nt, Homo sapiens
ggagagaggccaaguuuca

SEQ ID NO: 1199608 - RNA, 19 nt, Homo sapiens
cauaagagauccagaaggu

SEQ ID NO: 1199609 - RNA, 19 nt, Homo sapiens
gggcauauacaucuguuua

SEQ ID NO: 1199610 - RNA, 19 nt, Homo sapiens
gaaagugagugaucauggu

SEQ ID NO: 1199611 - RNA, 19 nt, Homo sapiens
gaaauugucccucguuaca

SEQ ID NO: 1199612 - RNA, 19 nt, Homo sapiens
ugugugagcuggaaauauu

SEQ ID NO: 1199613 - RNA, 19 nt, Homo sapiens
ggaauaacacagagaaaug

SEQ ID NO: 1199614 - RNA, 19 nt, Homo sapiens
ggagaaagaaccacaaauc

SEQ ID NO: 1199615 - RNA, 19 nt, Homo sapiens
ugacaacaguccucgguuu

SEQ ID NO: 1199616 - RNA, 19 nt, Homo sapiens
uuacauagcaaacgagaua

SEQ ID NO: 1199617 - RNA, 19 nt, Homo sapiens
gaaccugccgcaucuguuu

SEQ ID NO: 1199618 - RNA, 19 nt, Homo sapiens
ugaaagagaaggcauuaaa

SEQ ID NO: 1199619 - RNA, 19 nt, Homo sapiens
gaggagagaggccaaguuu

SEQ ID NO: 1199620 - RNA, 19 nt, Homo sapiens
uaagagauccagaagguaa

SEQ ID NO: 1199621 - RNA, 19 nt, Homo sapiens
gaacuaaccaucgaagaga

SEQ ID NO: 1199622 - RNA, 19 nt, Homo sapiens
acaagcaucuaaggauuua

SEQ ID NO: 1199623 - RNA, 19 nt, Homo sapiens
ccaaugcucaaauuacuua

SEQ ID NO: 1199624 - RNA, 19 nt, Homo sapiens
gcuauaggacuuguauuua

SEQ ID NO: 1199625 - RNA, 19 nt, Homo sapiens
acaauucuccuucuagaua

SEQ ID NO: 1199626 - RNA, 19 nt, Homo sapiens
ugaagugccugucauuugu

SEQ ID NO: 1199627 - RNA, 19 nt, Homo sapiens
gagcuucuguacagccuaa

SEQ ID NO: 1199628 - RNA, 19 nt, Homo sapiens
gcaguuguacaugaaauua

SEQ ID NO: 1199629 - RNA, 19 nt, Homo sapiens
uagaaucugugucuuguau

SEQ ID NO: 1199630 - RNA, 19 nt, Homo sapiens
ucagagacaucaaugacaa

SEQ ID NO: 1199631 - RNA, 19 nt, Homo sapiens
caaugaaggacaacuaauu

SEQ ID NO: 1199632 - RNA, 19 nt, Homo sapiens
gcaaugaagaaagcuauuu

SEQ ID NO: 1199633 - RNA, 19 nt, Homo sapiens
aaucauccaucacauaaga

SEQ ID NO: 1199634 - RNA, 19 nt, Homo sapiens
ggcaucagcugcuccuuug

SEQ ID NO: 1199635 - RNA, 19 nt, Homo sapiens
guaauaagcuuggguucca

SEQ ID NO: 1199636 - RNA, 19 nt, Homo sapiens
gacaacaguccucgguuua

SEQ ID NO: 1199637 - RNA, 19 nt, Homo sapiens
caauagaaccgacucauag

SEQ ID NO: 1199638 - RNA, 19 nt, Homo sapiens
ucacaauucuccuucuaga

SEQ ID NO: 1199639 - RNA, 19 nt, Homo sapiens
ugaaaucauccaucacaua

SEQ ID NO: 1199640 - RNA, 19 nt, Homo sapiens
gcauauacaucuguuuaag

SEQ ID NO: 1199641 - RNA, 19 nt, Homo sapiens
ugagggauuucaugucaaa

SEQ ID NO: 1199642 - RNA, 19 nt, Homo sapiens
aauacaagguuaacugcua

SEQ ID NO: 1199643 - RNA, 19 nt, Homo sapiens
gaaguacagauuccacuga

SEQ ID NO: 1199644 - RNA, 19 nt, Homo sapiens
guagcucugucuguaauaa

SEQ ID NO: 1199645 - RNA, 19 nt, Homo sapiens
uaauagaacuaaccaucga

SEQ ID NO: 1199646 - RNA, 19 nt, Homo sapiens
ucagaaaguuccacaagca

SEQ ID NO: 1199647 - RNA, 19 nt, Homo sapiens
ucagugacauuaaugacaa

SEQ ID NO: 1199648 - RNA, 19 nt, Homo sapiens
uggguaaccuguaguauuc

SEQ ID NO: 1199649 - RNA, 19 nt, Homo sapiens
ucgaauugcuuucuguuug

SEQ ID NO: 1199650 - RNA, 19 nt, Homo sapiens
guauuccacuuucugugua

SEQ ID NO: 1199651 - RNA, 19 nt, Homo sapiens
agagaaagccaauggauau

SEQ ID NO: 1199652 - RNA, 19 nt, Homo sapiens
gguagaaucugugucuugu

SEQ ID NO: 1199653 - RNA, 19 nt, Homo sapiens
gaagguagaaucugugucu

SEQ ID NO: 1199654 - RNA, 19 nt, Homo sapiens
ucaauagaaccgacucaua

SEQ ID NO: 1199655 - RNA, 19 nt, Homo sapiens
gaaccagagauuaauauag

SEQ ID NO: 1199656 - RNA, 19 nt, Homo sapiens
caacauuacuuuggaagag

SEQ ID NO: 1199657 - RNA, 19 nt, Homo sapiens
caacucacccaaugccuuu

SEQ ID NO: 1199658 - RNA, 19 nt, Homo sapiens
ccaccgagcuucuguacag

SEQ ID NO: 1199659 - RNA, 19 nt, Homo sapiens
gaccaaugcucaaauuacu

SEQ ID NO: 1199660 - RNA, 19 nt, Homo sapiens
cugaaucucuugcaaugaa

SEQ ID NO: 1199661 - RNA, 19 nt, Homo sapiens
guaauuaguguaacagaug

SEQ ID NO: 1199662 - RNA, 19 nt, Homo sapiens
caaaaccuauggacuauga

SEQ ID NO: 1199663 - RNA, 19 nt, Homo sapiens
guaaauacaagguuaacug

SEQ ID NO: 1199664 - RNA, 19 nt, Homo sapiens
aaagcuauuucaucaguga

SEQ ID NO: 1199665 - RNA, 19 nt, Homo sapiens
gaagaguauuccacuuucu

SEQ ID NO: 1199666 - RNA, 19 nt, Homo sapiens
ugaagggccguuuagguua

SEQ ID NO: 1199667 - RNA, 19 nt, Homo sapiens
gcaggaaacugggguauug

SEQ ID NO: 1199668 - RNA, 19 nt, Homo sapiens
uaacugacuuuggaucuuc

SEQ ID NO: 1199669 - RNA, 19 nt, Homo sapiens
gaauaacacagagaaaugu

SEQ ID NO: 1199670 - RNA, 19 nt, Homo sapiens
cuuaguagcucugucugua

SEQ ID NO: 1199671 - RNA, 19 nt, Homo sapiens
gaaccacaaaucucaauag

SEQ ID NO: 1199672 - RNA, 19 nt, Homo sapiens
gagaaagaaccacaaaucu

SEQ ID NO: 1199673 - RNA, 19 nt, Homo sapiens
ucacaggaauucugacagu

SEQ ID NO: 1199674 - RNA, 19 nt, Homo sapiens
ugaaaacacuggagucauu

SEQ ID NO: 1199675 - RNA, 19 nt, Homo sapiens
ggauuuauuucaccuggau

SEQ ID NO: 1199676 - RNA, 19 nt, Homo sapiens
cauaggcauucaugacauu

SEQ ID NO: 1199677 - RNA, 19 nt, Homo sapiens
gagauuggaguaauuagug

SEQ ID NO: 1199678 - RNA, 19 nt, Homo sapiens
ggugagauuggaguaauua

SEQ ID NO: 1199679 - RNA, 19 nt, Homo sapiens
ccuaagagcugucaaauua

SEQ ID NO: 1199680 - RNA, 19 nt, Homo sapiens
caacagaauucuacguaua

SEQ ID NO: 1199681 - RNA, 19 nt, Homo sapiens
caaaggagcugacauugau

SEQ ID NO: 1199682 - RNA, 19 nt, Homo sapiens
guaaagaacuaccagauuc

SEQ ID NO: 1199683 - RNA, 19 nt, Homo sapiens
ugaaagagaugucugcaaa

SEQ ID NO: 1199684 - RNA, 19 nt, Homo sapiens
caacauccgugucaucaaa

SEQ ID NO: 1199685 - RNA, 19 nt, Homo sapiens
gaacaguaaugguagaaga

SEQ ID NO: 1199686 - RNA, 19 nt, Homo sapiens
gaagauuaguccagugauu

SEQ ID NO: 1199687 - RNA, 19 nt, Homo sapiens
gaaagucaguauaugaaug

SEQ ID NO: 1199688 - RNA, 19 nt, Homo sapiens
aaaguugacucuacaguaa

SEQ ID NO: 1199689 - RNA, 19 nt, Homo sapiens
gauagcaguugucuggaua

SEQ ID NO: 1199690 - RNA, 19 nt, Homo sapiens
ggaauaaggaacaucauaa

SEQ ID NO: 1199691 - RNA, 19 nt, Homo sapiens
ggaacggaaugaauuuauu

SEQ ID NO: 1199692 - RNA, 19 nt, Homo sapiens
caacauagacuugacauau

SEQ ID NO: 1199693 - RNA, 19 nt, Homo sapiens
gaucauauuuacacacaga

SEQ ID NO: 1199694 - RNA, 19 nt, Homo sapiens
gcaaucauuuaguggcaua

SEQ ID NO: 1199695 - RNA, 19 nt, Homo sapiens
gcucaggaccuuuguaauu

SEQ ID NO: 1199696 - RNA, 19 nt, Homo sapiens
gacuaggcaugcagaaaua

SEQ ID NO: 1199697 - RNA, 19 nt, Homo sapiens
cagauuggcacaugaaaua

SEQ ID NO: 1199698 - RNA, 19 nt, Homo sapiens
ggagaaacagaaaggaaua

SEQ ID NO: 1199699 - RNA, 19 nt, Homo sapiens
cuuaagagcuguagaagau

SEQ ID NO: 1199700 - RNA, 19 nt, Homo sapiens
uguagaagaugccuuugua

SEQ ID NO: 1199701 - RNA, 19 nt, Homo sapiens
agacaacaauuacguauca

SEQ ID NO: 1199702 - RNA, 19 nt, Homo sapiens
uaagagcugucaaauuaug

SEQ ID NO: 1199703 - RNA, 19 nt, Homo sapiens
uaacuuggcaugauaauuc

SEQ ID NO: 1199704 - RNA, 19 nt, Homo sapiens
caaauugccaucuacagua

SEQ ID NO: 1199705 - RNA, 19 nt, Homo sapiens
caaagucucucugauguca

SEQ ID NO: 1199706 - RNA, 19 nt, Homo sapiens
guccaaauguugcauaguu

SEQ ID NO: 1199707 - RNA, 19 nt, Homo sapiens
ugucuguucuguugauuua

SEQ ID NO: 1199708 - RNA, 19 nt, Homo sapiens
ugaagcaacucauguaaag

SEQ ID NO: 1199709 - RNA, 19 nt, Homo sapiens
guaaagaacaacaaggaaa

SEQ ID NO: 1199710 - RNA, 19 nt, Homo sapiens
gcaaacaacauccguguca

SEQ ID NO: 1199711 - RNA, 19 nt, Homo sapiens
cacaucaacucgaacagua

SEQ ID NO: 1199712 - RNA, 19 nt, Homo sapiens
ucuagcaaguggagaaaua

SEQ ID NO: 1199713 - RNA, 19 nt, Homo sapiens
cagaaagugucaacauaga

SEQ ID NO: 1199714 - RNA, 19 nt, Homo sapiens
ccaccgaauuucuuucaaa

SEQ ID NO: 1199715 - RNA, 19 nt, Homo sapiens
caagacauguggaaagauc

SEQ ID NO: 1199716 - RNA, 19 nt, Homo sapiens
gcaagcccuuuaccauuga

SEQ ID NO: 1199717 - RNA, 19 nt, Homo sapiens
ggacuaggcaugcagaaau

SEQ ID NO: 1199718 - RNA, 19 nt, Homo sapiens
gucaguauaugaaugguaa

SEQ ID NO: 1199719 - RNA, 19 nt, Homo sapiens
cuaagacuguuacaccuaa

SEQ ID NO: 1199720 - RNA, 19 nt, Homo sapiens
gauaaaugaaugugaggua

SEQ ID NO: 1199721 - RNA, 19 nt, Homo sapiens
gauaacaaguccugaacuc

SEQ ID NO: 1199722 - RNA, 19 nt, Homo sapiens
gugacagccuucagucuaa

SEQ ID NO: 1199723 - RNA, 19 nt, Homo sapiens
ugaaauaaggugaaaguga

SEQ ID NO: 1199724 - RNA, 19 nt, Homo sapiens
gaacaagcaaucauuuagu

SEQ ID NO: 1199725 - RNA, 19 nt, Homo sapiens
gggaauaaggaacaucaua

SEQ ID NO: 1199726 - RNA, 19 nt, Homo sapiens
ccuuugaaaugcaucuuua

SEQ ID NO: 1199727 - RNA, 19 nt, Homo sapiens
gcaucuacuuuaguucaua

SEQ ID NO: 1199728 - RNA, 19 nt, Homo sapiens
cagcuuaaaugguuguaga

SEQ ID NO: 1199729 - RNA, 19 nt, Homo sapiens
ugacauugaugcacuuugu

SEQ ID NO: 1199730 - RNA, 19 nt, Homo sapiens
gaagggaacagcaagaaca

SEQ ID NO: 1199731 - RNA, 19 nt, Homo sapiens
gaucaccugcugucaaauu

SEQ ID NO: 1199732 - RNA, 19 nt, Homo sapiens
agaguggguuggauuagua

SEQ ID NO: 1199733 - RNA, 19 nt, Homo sapiens
ugagaagccuugauauaag

SEQ ID NO: 1199734 - RNA, 19 nt, Homo sapiens
agauuucacucagcauuua

SEQ ID NO: 1199735 - RNA, 19 nt, Homo sapiens
cagagacacugauaaugga

SEQ ID NO: 1199736 - RNA, 19 nt, Homo sapiens
gcagaaagugucaacauag

SEQ ID NO: 1199737 - RNA, 19 nt, Homo sapiens
ugcagaaagugucaacaua

SEQ ID NO: 1199738 - RNA, 19 nt, Homo sapiens
gcaagacuggcaauacaaa

SEQ ID NO: 1199739 - RNA, 19 nt, Homo sapiens
gugaacaagcaaucauuua

SEQ ID NO: 1199740 - RNA, 19 nt, Homo sapiens
gagacuacccaguaaagaa

SEQ ID NO: 1199741 - RNA, 19 nt, Homo sapiens
gcuaaaggagggaaugaaa

SEQ ID NO: 1199742 - RNA, 19 nt, Homo sapiens
gaauggauuucugauguca

SEQ ID NO: 1199743 - RNA, 19 nt, Homo sapiens
gaaagugacagccuucagu

SEQ ID NO: 1199744 - RNA, 19 nt, Homo sapiens
gauaauggaacaccuuuua

SEQ ID NO: 1199745 - RNA, 19 nt, Homo sapiens
gggcggacuucaauccaaa

SEQ ID NO: 1199746 - RNA, 19 nt, Homo sapiens
ccaaaggagcugacauuga

SEQ ID NO: 1199747 - RNA, 19 nt, Homo sapiens
ucacauaaccaaguugaaa

SEQ ID NO: 1199748 - RNA, 19 nt, Homo sapiens
cagcaucaacaauaagaua

SEQ ID NO: 1199749 - RNA, 19 nt, Homo sapiens
gcaacucauuccagcauca

SEQ ID NO: 1199750 - RNA, 19 nt, Homo sapiens
gcugucaaauugccaucua

SEQ ID NO: 1199751 - RNA, 19 nt, Homo sapiens
ugauagcccuucuguagga

SEQ ID NO: 1199752 - RNA, 19 nt, Homo sapiens
ggauagcaguugucuggau

SEQ ID NO: 1199753 - RNA, 19 nt, Homo sapiens
uaaggaacaucauaaagac

SEQ ID NO: 1199754 - RNA, 19 nt, Homo sapiens
aaagagaugucugcaaaca

SEQ ID NO: 1199755 - RNA, 19 nt, Homo sapiens
ggauuaugcuugaauuacu

SEQ ID NO: 1199756 - RNA, 19 nt, Homo sapiens
gaaugcaugcucaguuuau

SEQ ID NO: 1199757 - RNA, 19 nt, Homo sapiens
guauggcacacuuguauuu

SEQ ID NO: 1199758 - RNA, 19 nt, Homo sapiens
gaguugggcaccauaaauu

SEQ ID NO: 1199759 - RNA, 19 nt, Homo sapiens
guccagugauuacauaaga

SEQ ID NO: 1199760 - RNA, 19 nt, Homo sapiens
uccaaauguugcauaguua

SEQ ID NO: 1199761 - RNA, 19 nt, Homo sapiens
ccucauuuguguagaugua

SEQ ID NO: 1199762 - RNA, 19 nt, Homo sapiens
uauuacagcuuugcauuug

SEQ ID NO: 1199763 - RNA, 19 nt, Homo sapiens
ggacuuuccauuccaguga

SEQ ID NO: 1199764 - RNA, 19 nt, Homo sapiens
guacagacaggcaaacaau

SEQ ID NO: 1199765 - RNA, 19 nt, Homo sapiens
caacaauuacguaucaaug

SEQ ID NO: 1199766 - RNA, 19 nt, Homo sapiens
uaucaucucaugcccauaa

SEQ ID NO: 1199767 - RNA, 19 nt, Homo sapiens
guaaauccaucagauaggu

SEQ ID NO: 1199768 - RNA, 19 nt, Homo sapiens
cugagaagccuugauauaa

SEQ ID NO: 1199769 - RNA, 19 nt, Homo sapiens
ccauugaguugaaauucuu

SEQ ID NO: 1199770 - RNA, 19 nt, Homo sapiens
gcauuuaguagguccagua

SEQ ID NO: 1199771 - RNA, 19 nt, Homo sapiens
cucaggaccuuuguaauuu

SEQ ID NO: 1199772 - RNA, 19 nt, Homo sapiens
ucucacugauugcuacaua

SEQ ID NO: 1199773 - RNA, 19 nt, Homo sapiens
cuaccuuccugcagaaauu

SEQ ID NO: 1199774 - RNA, 19 nt, Homo sapiens
gcagcagcaucuacuuuag

SEQ ID NO: 1199775 - RNA, 19 nt, Homo sapiens
aaacuuaagagcuguagaa

SEQ ID NO: 1199776 - RNA, 19 nt, Homo sapiens
caagauggcauuagaaacu

SEQ ID NO: 1199777 - RNA, 19 nt, Homo sapiens
guaucuaccaccuucuuua

SEQ ID NO: 1199778 - RNA, 19 nt, Homo sapiens
uaaccaggauacugaaagu

SEQ ID NO: 1199779 - RNA, 19 nt, Homo sapiens
ccaaggagguggaucaauu

SEQ ID NO: 1199780 - RNA, 19 nt, Homo sapiens
ccacugcacucuagccuaa

SEQ ID NO: 1199781 - RNA, 19 nt, Homo sapiens
gcaaauagccaguugucaa

SEQ ID NO: 1199782 - RNA, 19 nt, Homo sapiens
gaauauaccacacaugaug

SEQ ID NO: 1199783 - RNA, 19 nt, Homo sapiens
gaugaugguuuccgccuuu

SEQ ID NO: 1199784 - RNA, 19 nt, Homo sapiens
gaaaguaguaacagcagua

SEQ ID NO: 1199785 - RNA, 19 nt, Homo sapiens
gcucaugccuguaauccaa

SEQ ID NO: 1199786 - RNA, 19 nt, Homo sapiens
gcaaagagugcuacagcua

SEQ ID NO: 1199787 - RNA, 19 nt, Homo sapiens
ccaagaagguggccagugu

SEQ ID NO: 1199788 - RNA, 19 nt, Homo sapiens
aaagagugcuacagcuaua

SEQ ID NO: 1199789 - RNA, 19 nt, Homo sapiens
ggacaaaggcauucugcaa

SEQ ID NO: 1199790 - RNA, 19 nt, Homo sapiens
gaaugagcaugaacaagau

SEQ ID NO: 1199791 - RNA, 19 nt, Homo sapiens
gauauugccucucugucaa

SEQ ID NO: 1199792 - RNA, 19 nt, Homo sapiens
ugucaaugcugaaccuuaa

SEQ ID NO: 1199793 - RNA, 19 nt, Homo sapiens
uauggaaacucaauuguca

SEQ ID NO: 1199794 - RNA, 19 nt, Homo sapiens
ugaaugagcaugaacaaga

SEQ ID NO: 1199795 - RNA, 19 nt, Homo sapiens
ccaccucccucuccaaguu

SEQ ID NO: 1199796 - RNA, 19 nt, Homo sapiens
acaaaggcauucugcaaga

SEQ ID NO: 1199797 - RNA, 19 nt, Homo sapiens
gugaauauaccacacauga

SEQ ID NO: 1199798 - RNA, 19 nt, Homo sapiens
ucauagcacucguggacua

SEQ ID NO: 1199799 - RNA, 19 nt, Homo sapiens
gaaccuuccaguuauuuga

SEQ ID NO: 1199800 - RNA, 19 nt, Homo sapiens
ggauauugccucucuguca

SEQ ID NO: 1199801 - RNA, 19 nt, Homo sapiens
gaaggaggcaaagaagaaa

SEQ ID NO: 1199802 - RNA, 19 nt, Homo sapiens
ccuaagcaauggagcaaga

SEQ ID NO: 1199803 - RNA, 19 nt, Homo sapiens
cuacagcuauaccugcaaa

SEQ ID NO: 1199804 - RNA, 19 nt, Homo sapiens
aaacuuagagugauuugga

SEQ ID NO: 1199805 - RNA, 19 nt, Homo sapiens
aaaauuagcugagcauguu

SEQ ID NO: 1199806 - RNA, 19 nt, Homo sapiens
caauugaggccaggaguuu

SEQ ID NO: 1199807 - RNA, 19 nt, Homo sapiens
caaagagugcuacagcuau

SEQ ID NO: 1199808 - RNA, 19 nt, Homo sapiens
gauuauggaaacucaauug

SEQ ID NO: 1199809 - RNA, 19 nt, Homo sapiens
aagcuaagguacagaaagu

SEQ ID NO: 1199810 - RNA, 19 nt, Homo sapiens
agaaggaggcaaagaagaa

SEQ ID NO: 1199811 - RNA, 19 nt, Homo sapiens
gagaaggaggcaaagaaga

SEQ ID NO: 1199812 - RNA, 19 nt, Homo sapiens
cagcaaaggagccagcaaa

SEQ ID NO: 1199813 - RNA, 19 nt, Homo sapiens
caaggagguggaucaauug

SEQ ID NO: 1199814 - RNA, 19 nt, Homo sapiens
gagcccacguagccaagaa

SEQ ID NO: 1199815 - RNA, 19 nt, Homo sapiens
uaaggugaaugagcaugaa

SEQ ID NO: 1199816 - RNA, 19 nt, Homo sapiens
ugucugcauuugugaauau

SEQ ID NO: 1199817 - RNA, 19 nt, Homo sapiens
ggagaaggaggcaaagaag

SEQ ID NO: 1199818 - RNA, 19 nt, Homo sapiens
gcugaaccuuaagacauuu

SEQ ID NO: 1199819 - RNA, 19 nt, Homo sapiens
gaccccaucucuacuaaaa

SEQ ID NO: 1199820 - RNA, 19 nt, Homo sapiens
uagagugauuuggauauug

SEQ ID NO: 1199821 - RNA, 19 nt, Homo sapiens
agcuauaccugcaaacuga

SEQ ID NO: 1199822 - RNA, 19 nt, Homo sapiens
ugcugaaccuuaagacauu

SEQ ID NO: 1199823 - RNA, 19 nt, Homo sapiens
aaacccagacugcccauga

SEQ ID NO: 1199824 - RNA, 19 nt, Homo sapiens
caauggagcaagacccuau

SEQ ID NO: 1199825 - RNA, 19 nt, Homo sapiens
gagccgaccagauuaugga

SEQ ID NO: 1199826 - RNA, 19 nt, Homo sapiens
aaaccuccaucucccuaga

SEQ ID NO: 1199827 - RNA, 19 nt, Homo sapiens
agaaucgucugagaaagga

SEQ ID NO: 1199828 - RNA, 19 nt, Homo sapiens
ggacccaaaacaaaacuua

SEQ ID NO: 1199829 - RNA, 19 nt, Homo sapiens
ccacaguccagaagcagaa

SEQ ID NO: 1199830 - RNA, 19 nt, Homo sapiens
caagagccggugcugcaaa

SEQ ID NO: 1199831 - RNA, 19 nt, Homo sapiens
gagaagggauccccaagag

SEQ ID NO: 1199832 - RNA, 19 nt, Homo sapiens
cuggacagcuucauuacca

SEQ ID NO: 1199833 - RNA, 19 nt, Homo sapiens
ucaggcauaaggugaauga

SEQ ID NO: 1199834 - RNA, 19 nt, Homo sapiens
gagccggugcugcaaauag

SEQ ID NO: 1199835 - RNA, 19 nt, Homo sapiens
ugaauuccgagcccacgua

SEQ ID NO: 1199836 - RNA, 19 nt, Homo sapiens
uggagaaggaggcaaagaa

SEQ ID NO: 1199837 - RNA, 19 nt, Homo sapiens
cagcuucauuaccaucuca

SEQ ID NO: 1199838 - RNA, 19 nt, Homo sapiens
gcacucguggacuagguuu

SEQ ID NO: 1199839 - RNA, 19 nt, Homo sapiens
gcgauucggaaaguaguaa

SEQ ID NO: 1199840 - RNA, 19 nt, Homo sapiens
cacaugauggugucucuga

SEQ ID NO: 1199841 - RNA, 19 nt, Homo sapiens
ccuuugcggugguucaaga

SEQ ID NO: 1199842 - RNA, 19 nt, Homo sapiens
aaggcuugcucgagaguug

SEQ ID NO: 1199843 - RNA, 19 nt, Homo sapiens
ccaccagcauggccacagu

SEQ ID NO: 1199844 - RNA, 19 nt, Homo sapiens
ggugaaugagcaugaacaa

SEQ ID NO: 1199845 - RNA, 19 nt, Homo sapiens
gugagcgauucggaaagua

SEQ ID NO: 1199846 - RNA, 19 nt, Homo sapiens
gcucagccagcuccaagga

SEQ ID NO: 1199847 - RNA, 19 nt, Homo sapiens
agagugauuuggauauugc

SEQ ID NO: 1199848 - RNA, 19 nt, Homo sapiens
gauggcaacgagcuucaga

SEQ ID NO: 1199849 - RNA, 19 nt, Homo sapiens
ggugagaagaccaaucaag

SEQ ID NO: 1199850 - RNA, 19 nt, Homo sapiens
aagagccggugcugcaaau

SEQ ID NO: 1199851 - RNA, 19 nt, Homo sapiens
ucaaugcugaaccuuaaga

SEQ ID NO: 1199852 - RNA, 19 nt, Homo sapiens
cagauuauggaaacucaau

SEQ ID NO: 1199853 - RNA, 19 nt, Homo sapiens
ugagacuaguggccaagug

SEQ ID NO: 1199854 - RNA, 19 nt, Homo sapiens
ccaguuauuugagacuagu

SEQ ID NO: 1199855 - RNA, 19 nt, Homo sapiens
caaggacugggcuggcaaa

SEQ ID NO: 1199856 - RNA, 19 nt, Homo sapiens
gaagaaaaggaaguugaaa

SEQ ID NO: 1199857 - RNA, 19 nt, Homo sapiens
gccuguaauccaagcauuu

SEQ ID NO: 1199858 - RNA, 19 nt, Homo sapiens
cccuggcuuucuagaauuu

SEQ ID NO: 1199859 - RNA, 19 nt, Homo sapiens
ucaauugaggccaggaguu

SEQ ID NO: 1199860 - RNA, 19 nt, Homo sapiens
caguggcucaugccuguaa

SEQ ID NO: 1199861 - RNA, 19 nt, Homo sapiens
ugugagcgauucggaaagu

SEQ ID NO: 1199862 - RNA, 19 nt, Homo sapiens
caaggcccagagaaacuuu

SEQ ID NO: 1199863 - RNA, 19 nt, Homo sapiens
ucucagaagcagcaaagga

SEQ ID NO: 1199864 - RNA, 19 nt, Homo sapiens
ucagaggacccaaaacaaa

SEQ ID NO: 1199865 - RNA, 19 nt, Homo sapiens
ccaaggcccagagaaacuu

SEQ ID NO: 1199866 - RNA, 19 nt, Homo sapiens
caaaagcuaagguacagaa

SEQ ID NO: 1199867 - RNA, 19 nt, Homo sapiens
gcacucuagccuaagcaau

SEQ ID NO: 1199868 - RNA, 19 nt, Homo sapiens
ccgaccagauuauggaaac

SEQ ID NO: 1199869 - RNA, 19 nt, Homo sapiens
agacccugauggugaugaa

SEQ ID NO: 1199870 - RNA, 19 nt, Homo sapiens
gaagauagaugcugugaaa

SEQ ID NO: 1199871 - RNA, 19 nt, Homo sapiens
ggaggaagauuaacauaua

SEQ ID NO: 1199872 - RNA, 19 nt, Homo sapiens
gcauaaaucugaagugguu

SEQ ID NO: 1199873 - RNA, 19 nt, Homo sapiens
ggacugaucuuacacaaag

SEQ ID NO: 1199874 - RNA, 19 nt, Homo sapiens
aagaagaccuuuacaguuu

SEQ ID NO: 1199875 - RNA, 19 nt, Homo sapiens
gaaaggauguagaaacaau

SEQ ID NO: 1199876 - RNA, 19 nt, Homo sapiens
gaucagauuuauccaauga

SEQ ID NO: 1199877 - RNA, 19 nt, Homo sapiens
gaauuauccugucgaguuu

SEQ ID NO: 1199878 - RNA, 19 nt, Homo sapiens
gaagaagaccuuuacaguu

SEQ ID NO: 1199879 - RNA, 19 nt, Homo sapiens
gauaugagccuguaauuuc

SEQ ID NO: 1199880 - RNA, 19 nt, Homo sapiens
ucagaagucuuaggaauaa

SEQ ID NO: 1199881 - RNA, 19 nt, Homo sapiens
gaugagaaauagcugguuu

SEQ ID NO: 1199882 - RNA, 19 nt, Homo sapiens
gaacaccauugucuuugaa

SEQ ID NO: 1199883 - RNA, 19 nt, Homo sapiens
ggucagagacuauuacauu

SEQ ID NO: 1199884 - RNA, 19 nt, Homo sapiens
caauuugucuucagagaaa

SEQ ID NO: 1199885 - RNA, 19 nt, Homo sapiens
ggaauuugcuccuaacagu

SEQ ID NO: 1199886 - RNA, 19 nt, Homo sapiens
gaaauuaugucagcuuugg

SEQ ID NO: 1199887 - RNA, 19 nt, Homo sapiens
ccagaaacauuggaucuuu

SEQ ID NO: 1199888 - RNA, 19 nt, Homo sapiens
cagcagaugugaauaugaa

SEQ ID NO: 1199889 - RNA, 19 nt, Homo sapiens
gauucaggcuuauaacaaa

SEQ ID NO: 1199890 - RNA, 19 nt, Homo sapiens
gaguuuggcugaauuggaa

SEQ ID NO: 1199891 - RNA, 19 nt, Homo sapiens
gauagaugcugugaaauuc

SEQ ID NO: 1199892 - RNA, 19 nt, Homo sapiens
aaauagagcuugcaauucu

SEQ ID NO: 1199893 - RNA, 19 nt, Homo sapiens
gaucccagcguuugaauuu

SEQ ID NO: 1199894 - RNA, 19 nt, Homo sapiens
ggagcagccuuuaucaaga

SEQ ID NO: 1199895 - RNA, 19 nt, Homo sapiens
gcacuuucauguuuaguuc

SEQ ID NO: 1199896 - RNA, 19 nt, Homo sapiens
cauccaagcucuuauucaa

SEQ ID NO: 1199897 - RNA, 19 nt, Homo sapiens
gaaaauagagcuugcaauu

SEQ ID NO: 1199898 - RNA, 19 nt, Homo sapiens
gguuugagguucagaaaga

SEQ ID NO: 1199899 - RNA, 19 nt, Homo sapiens
gagagacaguaacacaauu

SEQ ID NO: 1199900 - RNA, 19 nt, Homo sapiens
guacaacucccaucuugaa

SEQ ID NO: 1199901 - RNA, 19 nt, Homo sapiens
gguauaugcucguauguca

SEQ ID NO: 1199902 - RNA, 19 nt, Homo sapiens
gagaaauuauugcugaugu

SEQ ID NO: 1199903 - RNA, 19 nt, Homo sapiens
cagucaagguugucaauuu

SEQ ID NO: 1199904 - RNA, 19 nt, Homo sapiens
cagcuuauaucuuuaaugg

SEQ ID NO: 1199905 - RNA, 19 nt, Homo sapiens
ggacaucaccauucaggaa

SEQ ID NO: 1199906 - RNA, 19 nt, Homo sapiens
cuaaguguguacuaguuua

SEQ ID NO: 1199907 - RNA, 19 nt, Homo sapiens
gggaagauaugagccugua

SEQ ID NO: 1199908 - RNA, 19 nt, Homo sapiens
caguguaaauucagucuuu

SEQ ID NO: 1199909 - RNA, 19 nt, Homo sapiens
caacuuagagccuccugua

SEQ ID NO: 1199910 - RNA, 19 nt, Homo sapiens
gagaauuaguuauggugaa

SEQ ID NO: 1199911 - RNA, 19 nt, Homo sapiens
aaagcacucuuggaacuua

SEQ ID NO: 1199912 - RNA, 19 nt, Homo sapiens
acagugacuugcuacaaua

SEQ ID NO: 1199913 - RNA, 19 nt, Homo sapiens
guuagcacuuucauguuua

SEQ ID NO: 1199914 - RNA, 19 nt, Homo sapiens
guggaacacugcauaauag

SEQ ID NO: 1199915 - RNA, 19 nt, Homo sapiens
gcagcaacaugucuuucaa

SEQ ID NO: 1199916 - RNA, 19 nt, Homo sapiens
caaagaacguaauaaacca

SEQ ID NO: 1199917 - RNA, 19 nt, Homo sapiens
cuaaaugaccuuucuguug

SEQ ID NO: 1199918 - RNA, 19 nt, Homo sapiens
gcgcugcacuuccagaguu

SEQ ID NO: 1199919 - RNA, 19 nt, Homo sapiens
ugaauugacucaggaaaug

SEQ ID NO: 1199920 - RNA, 19 nt, Homo sapiens
gaaguguuauguacucauc

SEQ ID NO: 1199921 - RNA, 19 nt, Homo sapiens
guacucaucucuacauagg

SEQ ID NO: 1199922 - RNA, 19 nt, Homo sapiens
ucacuacucuugauacagu

SEQ ID NO: 1199923 - RNA, 19 nt, Homo sapiens
acucccaucuugaaacuua

SEQ ID NO: 1199924 - RNA, 19 nt, Homo sapiens
gaagauaugagccuguaau

SEQ ID NO: 1199925 - RNA, 19 nt, Homo sapiens
ugcuauggauggagaauua

SEQ ID NO: 1199926 - RNA, 19 nt, Homo sapiens
ugagagaucacuuagauga

SEQ ID NO: 1199927 - RNA, 19 nt, Homo sapiens
guuggacucuguugccaua

SEQ ID NO: 1199928 - RNA, 19 nt, Homo sapiens
cuacagcacugggaauuug

SEQ ID NO: 1199929 - RNA, 19 nt, Homo sapiens
gaguaauaauccuuucuga

SEQ ID NO: 1199930 - RNA, 19 nt, Homo sapiens
gaaauuauugcugauguga

SEQ ID NO: 1199931 - RNA, 19 nt, Homo sapiens
gucagagacuauuacauuu

SEQ ID NO: 1199932 - RNA, 19 nt, Homo sapiens
gggauugccuuugcacuga

SEQ ID NO: 1199933 - RNA, 19 nt, Homo sapiens
ggacucuguugccauaguu

SEQ ID NO: 1199934 - RNA, 19 nt, Homo sapiens
ugagaaagcacucuuggaa

SEQ ID NO: 1199935 - RNA, 19 nt, Homo sapiens
gugcuagcaugcucucuuu

SEQ ID NO: 1199936 - RNA, 19 nt, Homo sapiens
uaagagaaggugaagguaa

SEQ ID NO: 1199937 - RNA, 19 nt, Homo sapiens
gcaccuaaguguguacuag

SEQ ID NO: 1199938 - RNA, 19 nt, Homo sapiens
ggacucacuacucuugaua

SEQ ID NO: 1199939 - RNA, 19 nt, Homo sapiens
guaaaaugguuugcacuua

SEQ ID NO: 1199940 - RNA, 19 nt, Homo sapiens
ugaauuacguggcaucaca

SEQ ID NO: 1199941 - RNA, 19 nt, Homo sapiens
agagacagguucacccaaa

SEQ ID NO: 1199942 - RNA, 19 nt, Homo sapiens
gagcuucaucaucaacuua

SEQ ID NO: 1199943 - RNA, 19 nt, Homo sapiens
aaacuuauggcagaacuua

SEQ ID NO: 1199944 - RNA, 19 nt, Homo sapiens
gaauuggaaguguuaugua

SEQ ID NO: 1199945 - RNA, 19 nt, Homo sapiens
ggacaucagaaacuacauu

SEQ ID NO: 1199946 - RNA, 19 nt, Homo sapiens
gaagaccuuuacaguuugu

SEQ ID NO: 1199947 - RNA, 19 nt, Homo sapiens
ugaacaccauugucuuuga

SEQ ID NO: 1199948 - RNA, 19 nt, Homo sapiens
ucaccuaccucuucaagca

SEQ ID NO: 1199949 - RNA, 19 nt, Homo sapiens
gaauagaggcugagaaagc

SEQ ID NO: 1199950 - RNA, 19 nt, Homo sapiens
acaauguacuccaggcuuu

SEQ ID NO: 1199951 - RNA, 19 nt, Homo sapiens
gaugguagaucugggugaa

SEQ ID NO: 1199952 - RNA, 19 nt, Homo sapiens
uagagacguucaugacaaa

SEQ ID NO: 1199953 - RNA, 19 nt, Homo sapiens
cuagagacguucaugacaa

SEQ ID NO: 1199954 - RNA, 19 nt, Homo sapiens
aaagguauaugcucguaug

SEQ ID NO: 1199955 - RNA, 19 nt, Homo sapiens
uaacauauaccaguacaga

SEQ ID NO: 1199956 - RNA, 19 nt, Homo sapiens
gacaugugcucuucuugug

SEQ ID NO: 1199957 - RNA, 19 nt, Homo sapiens
cauagggacugaucuuaca

SEQ ID NO: 1199958 - RNA, 19 nt, Homo sapiens
ggacaaccauuuugacaau

SEQ ID NO: 1199959 - RNA, 19 nt, Homo sapiens
gauguaaagcguauguuga

SEQ ID NO: 1199960 - RNA, 19 nt, Homo sapiens
agaauuauccugucgaguu

SEQ ID NO: 1199961 - RNA, 19 nt, Homo sapiens
ugccaaaccuuuaaaucuu

SEQ ID NO: 1199962 - RNA, 19 nt, Homo sapiens
cagaaugucucagcaagug

SEQ ID NO: 1199963 - RNA, 19 nt, Homo sapiens
auuggaaccuguuaaauga

SEQ ID NO: 1199964 - RNA, 19 nt, Homo sapiens
ucaagagacuccugaaggu

SEQ ID NO: 1199965 - RNA, 19 nt, Homo sapiens
gagcagccuuuaucaagag

SEQ ID NO: 1199966 - RNA, 19 nt, Homo sapiens
gcacuuaugguaaucagau

SEQ ID NO: 1199967 - RNA, 19 nt, Homo sapiens
gcuacaccaugcuguuuga

SEQ ID NO: 1199968 - RNA, 19 nt, Homo sapiens
gaagauguaaagcguaugu

SEQ ID NO: 1199969 - RNA, 19 nt, Homo sapiens
ucaaagguauaugcucgua

SEQ ID NO: 1199970 - RNA, 19 nt, Homo sapiens
ccacaagucucaagaauuu

SEQ ID NO: 1199971 - RNA, 19 nt, Homo sapiens
gcagauaccuggauuucuu

SEQ ID NO: 1199972 - RNA, 19 nt, Homo sapiens
ggaaagaagagcuaaguaa

SEQ ID NO: 1199973 - RNA, 19 nt, Homo sapiens
caaagaagcacucacuuaa

SEQ ID NO: 1199974 - RNA, 19 nt, Homo sapiens
ggaccuacauguuacuaaa

SEQ ID NO: 1199975 - RNA, 19 nt, Homo sapiens
ggaagccacugucgagauu

SEQ ID NO: 1199976 - RNA, 19 nt, Homo sapiens
gcaaaggucucaugauagg

SEQ ID NO: 1199977 - RNA, 19 nt, Homo sapiens
aggcaaaggucucaugaua

SEQ ID NO: 1199978 - RNA, 19 nt, Homo sapiens
ggaagcagauaccuggauu

SEQ ID NO: 1199979 - RNA, 19 nt, Homo sapiens
ggaggugccuucagggaaa

SEQ ID NO: 1199980 - RNA, 19 nt, Homo sapiens
ucaaagaagcacucacuua

SEQ ID NO: 1199981 - RNA, 19 nt, Homo sapiens
caagucaauugcuggauuu

SEQ ID NO: 1199982 - RNA, 19 nt, Homo sapiens
cgaaaugccugcagcacuu

SEQ ID NO: 1199983 - RNA, 19 nt, Homo sapiens
gaagagcuaaguaacauug

SEQ ID NO: 1199984 - RNA, 19 nt, Homo sapiens
uagaaauggugcaggauaa

SEQ ID NO: 1199985 - RNA, 19 nt, Homo sapiens
cauaaccacuccagagauu

SEQ ID NO: 1199986 - RNA, 19 nt, Homo sapiens
gcucagagaauaaauccua

SEQ ID NO: 1199987 - RNA, 19 nt, Homo sapiens
gcaugaauaugugauguau

SEQ ID NO: 1199988 - RNA, 19 nt, Homo sapiens
cuaccaaccauauuuguua

SEQ ID NO: 1199989 - RNA, 19 nt, Homo sapiens
ggaaaacagucaagaaguu

SEQ ID NO: 1199990 - RNA, 19 nt, Homo sapiens
ucucagacauuucgcauug

SEQ ID NO: 1199991 - RNA, 19 nt, Homo sapiens
ccaagucaauugcuggauu

SEQ ID NO: 1199992 - RNA, 19 nt, Homo sapiens
acucuaaucuggagacauu

SEQ ID NO: 1199993 - RNA, 19 nt, Homo sapiens
caacauagacaucauuucu

SEQ ID NO: 1199994 - RNA, 19 nt, Homo sapiens
uaaccaagcucagucuuca

SEQ ID NO: 1199995 - RNA, 19 nt, Homo sapiens
gcacauggaguggcucuuu

SEQ ID NO: 1199996 - RNA, 19 nt, Homo sapiens
gugauugguuuaugcauga

SEQ ID NO: 1199997 - RNA, 19 nt, Homo sapiens
ccaacaauguguccagaug

SEQ ID NO: 1199998 - RNA, 19 nt, Homo sapiens
gugcaucacuaaaccagaa

SEQ ID NO: 1199999 - RNA, 19 nt, Homo sapiens
caccauggcuaaagggauu

SEQ ID NO: 1200000 - RNA, 19 nt, Homo sapiens
ccaaugagcuggccaugcu

SEQ ID NO: 1200001 - RNA, 19 nt, Homo sapiens
gcuuagugaugucaaagaa

SEQ ID NO: 1200002 - RNA, 19 nt, Homo sapiens
ucaagaauuugccacguau

SEQ ID NO: 1200003 - RNA, 19 nt, Homo sapiens
gaaagaagagcuaaguaac

SEQ ID NO: 1200004 - RNA, 19 nt, Homo sapiens
ccagacugcugccaagcua

SEQ ID NO: 1200005 - RNA, 19 nt, Homo sapiens
agacaucauuucuuucaga

SEQ ID NO: 1200006 - RNA, 19 nt, Homo sapiens
ggugaacaguggcucagaa

SEQ ID NO: 1200007 - RNA, 19 nt, Homo sapiens
gcucuuugaugcugaagga

SEQ ID NO: 1200008 - RNA, 19 nt, Homo sapiens
cuacaaccguguccuggaa

SEQ ID NO: 1200009 - RNA, 19 nt, Homo sapiens
ccagaaugccuccauguga

SEQ ID NO: 1200010 - RNA, 19 nt, Homo sapiens
ggacaucaguaaccaagcu

SEQ ID NO: 1200011 - RNA, 19 nt, Homo sapiens
gugaagaaguaaaucagau

SEQ ID NO: 1200012 - RNA, 19 nt, Homo sapiens
gaaguugggaccuacaugu

SEQ ID NO: 1200013 - RNA, 19 nt, Homo sapiens
ccucuuaucuugagaacuc

SEQ ID NO: 1200014 - RNA, 19 nt, Homo sapiens
ucacuaaaccagaaguuga

SEQ ID NO: 1200015 - RNA, 19 nt, Homo sapiens
caugauaggcauagaaaug

SEQ ID NO: 1200016 - RNA, 19 nt, Homo sapiens
ccucagggccucuugauau

SEQ ID NO: 1200017 - RNA, 19 nt, Homo sapiens
gaauuugccacguauguuc

SEQ ID NO: 1200018 - RNA, 19 nt, Homo sapiens
gaaauggugcaggauaaga

SEQ ID NO: 1200019 - RNA, 19 nt, Homo sapiens
cagggccucuugauauuug

SEQ ID NO: 1200020 - RNA, 19 nt, Homo sapiens
aagaagagcuaaguaacau

SEQ ID NO: 1200021 - RNA, 19 nt, Homo sapiens
cuaaagggauugggaaugg

SEQ ID NO: 1200022 - RNA, 19 nt, Homo sapiens
gcuaaagaucaguauauug

SEQ ID NO: 1200023 - RNA, 19 nt, Homo sapiens
cagaggagccuaccaugga

SEQ ID NO: 1200024 - RNA, 19 nt, Homo sapiens
caaacaacauagacaucau

SEQ ID NO: 1200025 - RNA, 19 nt, Homo sapiens
gcugcgggaugaauuugaa

SEQ ID NO: 1200026 - RNA, 19 nt, Homo sapiens
acacuuggcuugacaaacg

SEQ ID NO: 1200027 - RNA, 19 nt, Homo sapiens
gccaagugcuuagugaugu

SEQ ID NO: 1200028 - RNA, 19 nt, Homo sapiens
gcaguagaaguauuucguu

SEQ ID NO: 1200029 - RNA, 19 nt, Homo sapiens
cauuggaucugcugugcuu

SEQ ID NO: 1200030 - RNA, 19 nt, Homo sapiens
guauuucguucugccuuaa

SEQ ID NO: 1200031 - RNA, 19 nt, Homo sapiens
uugcuaagcugcgggauga

SEQ ID NO: 1200032 - RNA, 19 nt, Homo sapiens
gaagaaaaucuacaggaaa

SEQ ID NO: 1200033 - RNA, 19 nt, Homo sapiens
gcgcugagaacaccauaug

SEQ ID NO: 1200034 - RNA, 19 nt, Homo sapiens
cucccuagcucagagaaua

SEQ ID NO: 1200035 - RNA, 19 nt, Homo sapiens
cucaagaauuugccacgua

SEQ ID NO: 1200036 - RNA, 19 nt, Homo sapiens
gucaagaaguugggaccua

SEQ ID NO: 1200037 - RNA, 19 nt, Homo sapiens
gaagcagauaccuggauuu

SEQ ID NO: 1200038 - RNA, 19 nt, Homo sapiens
aaagaagagcuaaguaaca

SEQ ID NO: 1200039 - RNA, 19 nt, Homo sapiens
uaccauggaugcaguccuu

SEQ ID NO: 1200040 - RNA, 19 nt, Homo sapiens
aagaagcacucacuuaagc

SEQ ID NO: 1200041 - RNA, 19 nt, Homo sapiens
caagggugaauuugaagaa

SEQ ID NO: 1200042 - RNA, 19 nt, Homo sapiens
gagcuaaguaacauuguca

SEQ ID NO: 1200043 - RNA, 19 nt, Homo sapiens
gauaagcugucggccucuu

SEQ ID NO: 1200044 - RNA, 19 nt, Homo sapiens
ugaggugauuaaagaagaa

SEQ ID NO: 1200045 - RNA, 19 nt, Homo sapiens
caaagggguuucuaaagga

SEQ ID NO: 1200046 - RNA, 19 nt, Homo sapiens
caagcuaaagaucaguaua

SEQ ID NO: 1200047 - RNA, 19 nt, Homo sapiens
aguauuucguucugccuua

SEQ ID NO: 1200048 - RNA, 19 nt, Homo sapiens
uguuagguaugguaauuug

SEQ ID NO: 1200049 - RNA, 19 nt, Homo sapiens
gcacuucaacaccuuugga

SEQ ID NO: 1200050 - RNA, 19 nt, Homo sapiens
ugcuugaggugauuaaaga

SEQ ID NO: 1200051 - RNA, 19 nt, Homo sapiens
ucccauggcagcagucaua

SEQ ID NO: 1200052 - RNA, 19 nt, Homo sapiens
gaagugcagacaggauuug

SEQ ID NO: 1200053 - RNA, 19 nt, Homo sapiens
ccacaaggaacaucuuucu

SEQ ID NO: 1200054 - RNA, 19 nt, Homo sapiens
cacccucacucuucaguuc

SEQ ID NO: 1200055 - RNA, 19 nt, Homo sapiens
guuuaugcaugaauaugug

SEQ ID NO: 1200056 - RNA, 19 nt, Homo sapiens
cuaaguaacauugucagaa

SEQ ID NO: 1200057 - RNA, 19 nt, Homo sapiens
uaagcugcgggaugaauuu

SEQ ID NO: 1200058 - RNA, 19 nt, Homo sapiens
gugcagacaggauuuggaa

SEQ ID NO: 1200059 - RNA, 19 nt, Homo sapiens
ucaaacaacauagacauca

SEQ ID NO: 1200060 - RNA, 19 nt, Homo sapiens
ccagggcgcacucaaacaa

SEQ ID NO: 1200061 - RNA, 19 nt, Homo sapiens
cucagggccucuugauauu

SEQ ID NO: 1200062 - RNA, 19 nt, Homo sapiens
guaauuugauuccccuuug

SEQ ID NO: 1200063 - RNA, 19 nt, Homo sapiens
aaccacaagucucaagaau

SEQ ID NO: 1200064 - RNA, 19 nt, Homo sapiens
aaguaaaucagauccauga

SEQ ID NO: 1200065 - RNA, 19 nt, Homo sapiens
agaagaaaaucuacaggaa

SEQ ID NO: 1200066 - RNA, 19 nt, Homo sapiens
ccaaagggguuucuaaagg

SEQ ID NO: 1200067 - RNA, 19 nt, Homo sapiens
caacaauguguccagaugu

SEQ ID NO: 1200068 - RNA, 19 nt, Homo sapiens
cacauggaguggcucuuug

SEQ ID NO: 1200069 - RNA, 19 nt, Homo sapiens
auagaaauggugcaggaua

SEQ ID NO: 1200070 - RNA, 19 nt, Homo sapiens
ggacaacgcugcuuagaua

SEQ ID NO: 1200071 - RNA, 19 nt, Homo sapiens
ccaaguagcuuuaagauaa

SEQ ID NO: 1200072 - RNA, 19 nt, Homo sapiens
caaacaggcugccauaaua

SEQ ID NO: 1200073 - RNA, 19 nt, Homo sapiens
gauuucggcuuucauauua

SEQ ID NO: 1200074 - RNA, 19 nt, Homo sapiens
gaacuggaauggagaugua

SEQ ID NO: 1200075 - RNA, 19 nt, Homo sapiens
ggaaguaguuaaaugcuuu

SEQ ID NO: 1200076 - RNA, 19 nt, Homo sapiens
gaagauagaggauaugaaa

SEQ ID NO: 1200077 - RNA, 19 nt, Homo sapiens
aaacugaucuuccuauuug

SEQ ID NO: 1200078 - RNA, 19 nt, Homo sapiens
gcacacugaugauauugua

SEQ ID NO: 1200079 - RNA, 19 nt, Homo sapiens
gugauuuacugcugaauua

SEQ ID NO: 1200080 - RNA, 19 nt, Homo sapiens
gcaaagucccauugauuua

SEQ ID NO: 1200081 - RNA, 19 nt, Homo sapiens
aaacugagcugcuuuaguc

SEQ ID NO: 1200082 - RNA, 19 nt, Homo sapiens
ggaagguacuaaauauuga

SEQ ID NO: 1200083 - RNA, 19 nt, Homo sapiens
cgaaugcccuaauuaauug

SEQ ID NO: 1200084 - RNA, 19 nt, Homo sapiens
ggaagaaacuagcgguguu

SEQ ID NO: 1200085 - RNA, 19 nt, Homo sapiens
gaaacuagcgguguucuuu

SEQ ID NO: 1200086 - RNA, 19 nt, Homo sapiens
gcagacgaaugcccuaauu

SEQ ID NO: 1200087 - RNA, 19 nt, Homo sapiens
gaagugaccugcuguugag

SEQ ID NO: 1200088 - RNA, 19 nt, Homo sapiens
ucacaauacuggcacuaua

SEQ ID NO: 1200089 - RNA, 19 nt, Homo sapiens
gcuauucgcuguagauuag

SEQ ID NO: 1200090 - RNA, 19 nt, Homo sapiens
ggaaagagaggaagggaaa

SEQ ID NO: 1200091 - RNA, 19 nt, Homo sapiens
gaaggagacugaauuacuc

SEQ ID NO: 1200092 - RNA, 19 nt, Homo sapiens
guaguuaaaugcuuugguu

SEQ ID NO: 1200093 - RNA, 19 nt, Homo sapiens
ugacacaaguuacaaguug

SEQ ID NO: 1200094 - RNA, 19 nt, Homo sapiens
gacaggaggucauuucaau

SEQ ID NO: 1200095 - RNA, 19 nt, Homo sapiens
gaacauugcagguaaagau

SEQ ID NO: 1200096 - RNA, 19 nt, Homo sapiens
gagauugagugucaguauu

SEQ ID NO: 1200097 - RNA, 19 nt, Homo sapiens
agaaagcaaugcaaacuga

SEQ ID NO: 1200098 - RNA, 19 nt, Homo sapiens
guaggcacuugcuguauuu

SEQ ID NO: 1200099 - RNA, 19 nt, Homo sapiens
ggagaacauugcagguaaa

SEQ ID NO: 1200100 - RNA, 19 nt, Homo sapiens
ggaugaauuuggugccuuu

SEQ ID NO: 1200101 - RNA, 19 nt, Homo sapiens
cagaccagaugggaaauua

SEQ ID NO: 1200102 - RNA, 19 nt, Homo sapiens
ggacauccauuagcugaau

SEQ ID NO: 1200103 - RNA, 19 nt, Homo sapiens
cagcugagauugaguguca

SEQ ID NO: 1200104 - RNA, 19 nt, Homo sapiens
gauuaaggcaguacaaauu

SEQ ID NO: 1200105 - RNA, 19 nt, Homo sapiens
gaauuggccuacacagaga

SEQ ID NO: 1200106 - RNA, 19 nt, Homo sapiens
guaguagccugagcaauga

SEQ ID NO: 1200107 - RNA, 19 nt, Homo sapiens
gcaugugucugccauuuca

SEQ ID NO: 1200108 - RNA, 19 nt, Homo sapiens
gaagaagccaacacucaaa

SEQ ID NO: 1200109 - RNA, 19 nt, Homo sapiens
gagagaaggagacugaauu

SEQ ID NO: 1200110 - RNA, 19 nt, Homo sapiens
aacaagaaauugcagcaua

SEQ ID NO: 1200111 - RNA, 19 nt, Homo sapiens
guuggaagguacuaaauau

SEQ ID NO: 1200112 - RNA, 19 nt, Homo sapiens
ccacauaaaucucaaaucc

SEQ ID NO: 1200113 - RNA, 19 nt, Homo sapiens
gaagccaacacucaaauga

SEQ ID NO: 1200114 - RNA, 19 nt, Homo sapiens
gguaguagccugagcaaug

SEQ ID NO: 1200115 - RNA, 19 nt, Homo sapiens
gagguggguuaaacuguaa

SEQ ID NO: 1200116 - RNA, 19 nt, Homo sapiens
ggauaacaaucuuucaagu

SEQ ID NO: 1200117 - RNA, 19 nt, Homo sapiens
gcaucaagguggagaagga

SEQ ID NO: 1200118 - RNA, 19 nt, Homo sapiens
ggacuaagccaucccaaag

SEQ ID NO: 1200119 - RNA, 19 nt, Homo sapiens
ggcaauuccuuaccaaaug

SEQ ID NO: 1200120 - RNA, 19 nt, Homo sapiens
guucugguuucaaguuaua

SEQ ID NO: 1200121 - RNA, 19 nt, Homo sapiens
gcaaagcaaagucccauug

SEQ ID NO: 1200122 - RNA, 19 nt, Homo sapiens
cauaagacccaaucaaaug

SEQ ID NO: 1200123 - RNA, 19 nt, Homo sapiens
gcggcaagguguucaagaa

SEQ ID NO: 1200124 - RNA, 19 nt, Homo sapiens
gcgagaagcccuacaagug

SEQ ID NO: 1200125 - RNA, 19 nt, Homo sapiens
ggaaauggcccgacagcau

SEQ ID NO: 1200126 - RNA, 19 nt, Homo sapiens
ggagagaaagcugagauuu

SEQ ID NO: 1200127 - RNA, 19 nt, Homo sapiens
aaacaaacaggcugccaua

SEQ ID NO: 1200128 - RNA, 19 nt, Homo sapiens
acaagaaauugcagcauau

SEQ ID NO: 1200129 - RNA, 19 nt, Homo sapiens
aagcuaagcauguguaauu

SEQ ID NO: 1200130 - RNA, 19 nt, Homo sapiens
ggguauccaucccuucuuu

SEQ ID NO: 1200131 - RNA, 19 nt, Homo sapiens
caaagucccauugauuuaa

SEQ ID NO: 1200132 - RNA, 19 nt, Homo sapiens
uuucugaccuguacuuauu

SEQ ID NO: 1200133 - RNA, 19 nt, Homo sapiens
aauggugggucuauaaauu

SEQ ID NO: 1200134 - RNA, 19 nt, Homo sapiens
gaguggaggugauuuacug

SEQ ID NO: 1200135 - RNA, 19 nt, Homo sapiens
uaacaaagccacauuuacu

SEQ ID NO: 1200136 - RNA, 19 nt, Homo sapiens
gcacuuuguuucagaacug

SEQ ID NO: 1200137 - RNA, 19 nt, Homo sapiens
ggaggucauuucaauaugg

SEQ ID NO: 1200138 - RNA, 19 nt, Homo sapiens
gaauuuugcuucuguuuug

SEQ ID NO: 1200139 - RNA, 19 nt, Homo sapiens
cagcaugugucugccauuu

SEQ ID NO: 1200140 - RNA, 19 nt, Homo sapiens
ucucuaagaugucagaugu

SEQ ID NO: 1200141 - RNA, 19 nt, Homo sapiens
gaccagaugggaaauuauu

SEQ ID NO: 1200142 - RNA, 19 nt, Homo sapiens
gaaauaaacccagcacaac

SEQ ID NO: 1200143 - RNA, 19 nt, Homo sapiens
gccauaagacccaaucaaa

SEQ ID NO: 1200144 - RNA, 19 nt, Homo sapiens
gguugaagauagaggauau

SEQ ID NO: 1200145 - RNA, 19 nt, Homo sapiens
gaaauugcagcauauucuu

SEQ ID NO: 1200146 - RNA, 19 nt, Homo sapiens
agacgaaugcccuaauuaa

SEQ ID NO: 1200147 - RNA, 19 nt, Homo sapiens
aaaaggagcuggugauuca

SEQ ID NO: 1200148 - RNA, 19 nt, Homo sapiens
gaacaucuuccuucucuac

SEQ ID NO: 1200149 - RNA, 19 nt, Homo sapiens
ugccuuggguguugaauuu

SEQ ID NO: 1200150 - RNA, 19 nt, Homo sapiens
gaaaacugaucuuccuauu

SEQ ID NO: 1200151 - RNA, 19 nt, Homo sapiens
agagaaggagacugaauua

SEQ ID NO: 1200152 - RNA, 19 nt, Homo sapiens
guugagaccgguacaaauu

SEQ ID NO: 1200153 - RNA, 19 nt, Homo sapiens
uaaaugcuuugguucacaa

SEQ ID NO: 1200154 - RNA, 19 nt, Homo sapiens
uaaauuuagugcacucugu

SEQ ID NO: 1200155 - RNA, 19 nt, Homo sapiens
guuacaaguugauaucguu

SEQ ID NO: 1200156 - RNA, 19 nt, Homo sapiens
agagguggguuaaacugua

SEQ ID NO: 1200157 - RNA, 19 nt, Homo sapiens
gcagcauauucuucucuuu

SEQ ID NO: 1200158 - RNA, 19 nt, Homo sapiens
ggagacugaauuacucuaa

SEQ ID NO: 1200159 - RNA, 19 nt, Homo sapiens
cuugacggcuucucucuuu

SEQ ID NO: 1200160 - RNA, 19 nt, Homo sapiens
acaaggcccuggacaagga

SEQ ID NO: 1200161 - RNA, 19 nt, Homo sapiens
guguugggcuucucucuga

SEQ ID NO: 1200162 - RNA, 19 nt, Homo sapiens
gauguaggcacuugcugua

SEQ ID NO: 1200163 - RNA, 19 nt, Homo sapiens
ccucuggaauggauauauu

SEQ ID NO: 1200164 - RNA, 19 nt, Homo sapiens
ucacauuucugaccuguac

SEQ ID NO: 1200165 - RNA, 19 nt, Homo sapiens
caggaacaacggcuaauuu

SEQ ID NO: 1200166 - RNA, 19 nt, Homo sapiens
guaagggacagcugagauu

SEQ ID NO: 1200167 - RNA, 19 nt, Homo sapiens
aaucucaaauccuauguug

SEQ ID NO: 1200168 - RNA, 19 nt, Homo sapiens
gcaagcagcccuucaacag

SEQ ID NO: 1200169 - RNA, 19 nt, Homo sapiens
ucuguucgaugcacucuuu

SEQ ID NO: 1200170 - RNA, 19 nt, Homo sapiens
guacagcaaugaacaaugu

SEQ ID NO: 1200171 - RNA, 19 nt, Homo sapiens
ggaaagagaggaagggaaa

SEQ ID NO: 1200172 - RNA, 19 nt, Homo sapiens
gcaaugaacaauguagaua

SEQ ID NO: 1200173 - RNA, 19 nt, Homo sapiens
gauacaacuuucugccuuu

SEQ ID NO: 1200174 - RNA, 19 nt, Homo sapiens
gauuaaggcaguacaaauu

SEQ ID NO: 1200175 - RNA, 19 nt, Homo sapiens
gcaucaagguggagaagga

SEQ ID NO: 1200176 - RNA, 19 nt, Homo sapiens
gcggcaagguguucaagaa

SEQ ID NO: 1200177 - RNA, 19 nt, Homo sapiens
gcgagaagcccuacaagug

SEQ ID NO: 1200178 - RNA, 19 nt, Homo sapiens
gcaagcagcccuucaacag

SEQ ID NO: 1200179 - RNA, 19 nt, Homo sapiens
acaaggcccuggacaagga

SEQ ID NO: 1200180 - RNA, 19 nt, Homo sapiens
aagaugagccuuccagcua

SEQ ID NO: 1200181 - RNA, 19 nt, Homo sapiens
gagcaagucgugcgaguuc

SEQ ID NO: 1200182 - RNA, 19 nt, Homo sapiens
cagcuugggugccugcuau

SEQ ID NO: 1200183 - RNA, 19 nt, Homo sapiens
gcaagaccuucaaguucca

SEQ ID NO: 1200184 - RNA, 19 nt, Homo sapiens
gcaaggucauggagaacgu

SEQ ID NO: 1200185 - RNA, 19 nt, Homo sapiens
cagugucaguugucaggua

SEQ ID NO: 1200186 - RNA, 19 nt, Homo sapiens
gcucaccuguggccagugu

SEQ ID NO: 1200187 - RNA, 19 nt, Homo sapiens
aaacagcauagaagaaaga

SEQ ID NO: 1200188 - RNA, 19 nt, Homo sapiens
aggcggcacuccaaccuaa

SEQ ID NO: 1200189 - RNA, 19 nt, Homo sapiens
gcggcaagaccuucaaguu

SEQ ID NO: 1200190 - RNA, 19 nt, Homo sapiens
ggagauagaggagccaagu

SEQ ID NO: 1200191 - RNA, 19 nt, Homo sapiens
cuacagcacccuggagaaa

SEQ ID NO: 1200192 - RNA, 19 nt, Homo sapiens
gcgagcggccuuacaagug

SEQ ID NO: 1200193 - RNA, 19 nt, Homo sapiens
ugaagacgcacaugcacaa

SEQ ID NO: 1200194 - RNA, 19 nt, Homo sapiens
cggcaagaccuucaaguuc

SEQ ID NO: 1200195 - RNA, 19 nt, Homo sapiens
gagccuuccagcuacauuu

SEQ ID NO: 1200196 - RNA, 19 nt, Homo sapiens
ggaggaagagagggaaaga

SEQ ID NO: 1200197 - RNA, 19 nt, Homo sapiens
cucauucauucaacagaua

SEQ ID NO: 1200198 - RNA, 19 nt, Homo sapiens
gaugagccuuccagcuaca

SEQ ID NO: 1200199 - RNA, 19 nt, Homo sapiens
acucauccgugaucacuuc

SEQ ID NO: 1200200 - RNA, 19 nt, Homo sapiens
acgagggucuggagauaga

SEQ ID NO: 1200201 - RNA, 19 nt, Homo sapiens
agagaaugcugaccugacu

SEQ ID NO: 1200202 - RNA, 19 nt, Homo sapiens
gcagcgacacgugcgagua

SEQ ID NO: 1200203 - RNA, 19 nt, Homo sapiens
cagcuacauuugcacaaca

SEQ ID NO: 1200204 - RNA, 19 nt, Homo sapiens
cccagaggcugaccaugug

SEQ ID NO: 1200205 - RNA, 19 nt, Homo sapiens
acagcacccuggagaaaca

SEQ ID NO: 1200206 - RNA, 19 nt, Homo sapiens
agugcgagcugugcaacua

SEQ ID NO: 1200207 - RNA, 19 nt, Homo sapiens
ugggcaaggucauggagaa

SEQ ID NO: 1200208 - RNA, 19 nt, Homo sapiens
ggaugccagugucaguugu

SEQ ID NO: 1200209 - RNA, 19 nt, Homo sapiens
gaagaagaggaggaagaga

SEQ ID NO: 1200210 - RNA, 19 nt, Homo sapiens
agugucaguugucagguaa

SEQ ID NO: 1200211 - RNA, 19 nt, Homo sapiens
ugacaaggcccuggacaag

SEQ ID NO: 1200212 - RNA, 19 nt, Homo sapiens
caaugaacaauguagauac

SEQ ID NO: 1200213 - RNA, 19 nt, Homo sapiens
caacucugugcaaaucauu

SEQ ID NO: 1200214 - RNA, 19 nt, Homo sapiens
aagaagaagaggaggaaga

SEQ ID NO: 1200215 - RNA, 19 nt, Homo sapiens
uguggccagugucaaauga

SEQ ID NO: 1200216 - RNA, 19 nt, Homo sapiens
aggaagagagggaaagaga

SEQ ID NO: 1200217 - RNA, 19 nt, Homo sapiens
ccuuuuaacugugcaauaa

SEQ ID NO: 1200218 - RNA, 19 nt, Homo sapiens
caaauuguggagccuuuua

SEQ ID NO: 1200219 - RNA, 19 nt, Homo sapiens
ugauuaaggcaguacaaau

SEQ ID NO: 1200220 - RNA, 19 nt, Homo sapiens
gcauagaagaaagagcaaa

SEQ ID NO: 1200221 - RNA, 19 nt, Homo sapiens
ggaggaggaggagcugcua

SEQ ID NO: 1200222 - RNA, 19 nt, Homo sapiens
gcucaagcgccacaugaag

SEQ ID NO: 1200223 - RNA, 19 nt, Homo sapiens
ucaguugucagguaaagau

SEQ ID NO: 1200224 - RNA, 19 nt, Homo sapiens
gggcgaugccagaauagau

SEQ ID NO: 1200225 - RNA, 19 nt, Homo sapiens
cuguuugaauucacucauu

SEQ ID NO: 1200226 - RNA, 19 nt, Homo sapiens
ucugcgaaguccuauggaa

SEQ ID NO: 1200227 - RNA, 19 nt, Homo sapiens
gcaagucgugcgaguucug

SEQ ID NO: 1200228 - RNA, 19 nt, Homo sapiens
gcacggcuuccgcaucuac

SEQ ID NO: 1200229 - RNA, 19 nt, Homo sapiens
agaagaagaagaggaggaa

SEQ ID NO: 1200230 - RNA, 19 nt, Homo sapiens
cagcaaugaacaauguaga

SEQ ID NO: 1200231 - RNA, 19 nt, Homo sapiens
uaaccugugucugcgaagu

SEQ ID NO: 1200232 - RNA, 19 nt, Homo sapiens
acuccaaccuaaccugugu

SEQ ID NO: 1200233 - RNA, 19 nt, Homo sapiens
uucaagaacugcagcaacu

SEQ ID NO: 1200234 - RNA, 19 nt, Homo sapiens
ggcgaugccagaauagaug

SEQ ID NO: 1200235 - RNA, 19 nt, Homo sapiens
agaaugcugaccugacuug

SEQ ID NO: 1200236 - RNA, 19 nt, Homo sapiens
ccgccauccucgaagaaga

SEQ ID NO: 1200237 - RNA, 19 nt, Homo sapiens
gcagucacacgggcgagaa

SEQ ID NO: 1200238 - RNA, 19 nt, Homo sapiens
gaggaggaagagagggaaa

SEQ ID NO: 1200239 - RNA, 19 nt, Homo sapiens
acgcacggcuuccgcaucu

SEQ ID NO: 1200240 - RNA, 19 nt, Homo sapiens
acaacucugugcaaaucau

SEQ ID NO: 1200241 - RNA, 19 nt, Homo sapiens
ccgcaccuguacaguggaa

SEQ ID NO: 1200242 - RNA, 19 nt, Homo sapiens
caagcucacgcgccacaug

SEQ ID NO: 1200243 - RNA, 19 nt, Homo sapiens
gagauagaggagccaagug

SEQ ID NO: 1200244 - RNA, 19 nt, Homo sapiens
agauauacuucaggcacaa

SEQ ID NO: 1200245 - RNA, 19 nt, Homo sapiens
acucauucauucaacagau

SEQ ID NO: 1200246 - RNA, 19 nt, Homo sapiens
gaagacgcacgggcagauc

SEQ ID NO: 1200247 - RNA, 19 nt, Homo sapiens
guacugcggcaagguguuc

SEQ ID NO: 1200248 - RNA, 19 nt, Homo sapiens
caugcaagcagcccuucaa

SEQ ID NO: 1200249 - RNA, 19 nt, Homo sapiens
gcaacccgcagcacuuguc

SEQ ID NO: 1200250 - RNA, 19 nt, Homo sapiens
gaacauaugugguuguaua

SEQ ID NO: 1200251 - RNA, 19 nt, Homo sapiens
gcaaugaaguggaaugaua

SEQ ID NO: 1200252 - RNA, 19 nt, Homo sapiens
gaagauagaugcuuacaau

SEQ ID NO: 1200253 - RNA, 19 nt, Homo sapiens
gcaaagaacugccuuguag

SEQ ID NO: 1200254 - RNA, 19 nt, Homo sapiens
gugaagcgcuuucucaaua

SEQ ID NO: 1200255 - RNA, 19 nt, Homo sapiens
gaaagggaauguauaugaa

SEQ ID NO: 1200256 - RNA, 19 nt, Homo sapiens
ggaagaugaucacuaauga

SEQ ID NO: 1200257 - RNA, 19 nt, Homo sapiens
uaacucaucucucuugaaa

SEQ ID NO: 1200258 - RNA, 19 nt, Homo sapiens
guuaagauguucaguguuu

SEQ ID NO: 1200259 - RNA, 19 nt, Homo sapiens
gaacugccuuguagauaaa

SEQ ID NO: 1200260 - RNA, 19 nt, Homo sapiens
ugucagcacuuucauauuu

SEQ ID NO: 1200261 - RNA, 19 nt, Homo sapiens
gauagaugcuuacaaugaa

SEQ ID NO: 1200262 - RNA, 19 nt, Homo sapiens
gugcaaaucuguucaugaa

SEQ ID NO: 1200263 - RNA, 19 nt, Homo sapiens
guucaguguuuccaaauua

SEQ ID NO: 1200264 - RNA, 19 nt, Homo sapiens
gaagcgcuuucucaauaua

SEQ ID NO: 1200265 - RNA, 19 nt, Homo sapiens
gcagaagcgucaaauacuu

SEQ ID NO: 1200266 - RNA, 19 nt, Homo sapiens
ggaucgaccuuaucaauuc

SEQ ID NO: 1200267 - RNA, 19 nt, Homo sapiens
gcacuauggccacaaauaa

SEQ ID NO: 1200268 - RNA, 19 nt, Homo sapiens
gaacugaaagggaauguau

SEQ ID NO: 1200269 - RNA, 19 nt, Homo sapiens
gaacaucaccuccauagca

SEQ ID NO: 1200270 - RNA, 19 nt, Homo sapiens
gaaggcagggaaaugauua

SEQ ID NO: 1200271 - RNA, 19 nt, Homo sapiens
guuagaccguuauguauuu

SEQ ID NO: 1200272 - RNA, 19 nt, Homo sapiens
gcagggaaaugauuaccuu

SEQ ID NO: 1200273 - RNA, 19 nt, Homo sapiens
ucaaauacuuucugaagga

SEQ ID NO: 1200274 - RNA, 19 nt, Homo sapiens
gaaguuaaugguucuauga

SEQ ID NO: 1200275 - RNA, 19 nt, Homo sapiens
ggauaugcccguucaguuu

SEQ ID NO: 1200276 - RNA, 19 nt, Homo sapiens
gagguuagaccguuaugua

SEQ ID NO: 1200277 - RNA, 19 nt, Homo sapiens
caaugaagcugcagucagu

SEQ ID NO: 1200278 - RNA, 19 nt, Homo sapiens
auaggaagaugaucacuaa

SEQ ID NO: 1200279 - RNA, 19 nt, Homo sapiens
gcacagauuauuauuccua

SEQ ID NO: 1200280 - RNA, 19 nt, Homo sapiens
gauaugcccguucaguuua

SEQ ID NO: 1200281 - RNA, 19 nt, Homo sapiens
gaaacaguguaucaaagug

SEQ ID NO: 1200282 - RNA, 19 nt, Homo sapiens
gugaauaccuucucucaag

SEQ ID NO: 1200283 - RNA, 19 nt, Homo sapiens
agaacugccuuguagauaa

SEQ ID NO: 1200284 - RNA, 19 nt, Homo sapiens
caaagacuagugauguuua

SEQ ID NO: 1200285 - RNA, 19 nt, Homo sapiens
gauugcaugugaagucuuu

SEQ ID NO: 1200286 - RNA, 19 nt, Homo sapiens
caaccucggccuccuguua

SEQ ID NO: 1200287 - RNA, 19 nt, Homo sapiens
ccaaauuaauugcucaaga

SEQ ID NO: 1200288 - RNA, 19 nt, Homo sapiens
uacaagauccuguuuauga

SEQ ID NO: 1200289 - RNA, 19 nt, Homo sapiens
cagaaugcauuguauagga

SEQ ID NO: 1200290 - RNA, 19 nt, Homo sapiens
gauggagguuagaccguua

SEQ ID NO: 1200291 - RNA, 19 nt, Homo sapiens
ugaaagggaauguauauga

SEQ ID NO: 1200292 - RNA, 19 nt, Homo sapiens
guagugguguuauguauag

SEQ ID NO: 1200293 - RNA, 19 nt, Homo sapiens
gaaguggaaugauaaacag

SEQ ID NO: 1200294 - RNA, 19 nt, Homo sapiens
gguguuauguauaguaaug

SEQ ID NO: 1200295 - RNA, 19 nt, Homo sapiens
ucugguugcugcauauuua

SEQ ID NO: 1200296 - RNA, 19 nt, Homo sapiens
cagagaaacuacugcaaug

SEQ ID NO: 1200297 - RNA, 19 nt, Homo sapiens
gauguucaguguuuccaaa

SEQ ID NO: 1200298 - RNA, 19 nt, Homo sapiens
gaucacuaaugagaagaua

SEQ ID NO: 1200299 - RNA, 19 nt, Homo sapiens
guaguaaacaugcaaguug

SEQ ID NO: 1200300 - RNA, 19 nt, Homo sapiens
gcacaugaaauuucucaga

SEQ ID NO: 1200301 - RNA, 19 nt, Homo sapiens
gcacuuucauauuuguuug

SEQ ID NO: 1200302 - RNA, 19 nt, Homo sapiens
gaugaucacuaaugagaag

SEQ ID NO: 1200303 - RNA, 19 nt, Homo sapiens
gcaaagacuagugauguuu

SEQ ID NO: 1200304 - RNA, 19 nt, Homo sapiens
ggaaugcuguuugcuuuua

SEQ ID NO: 1200305 - RNA, 19 nt, Homo sapiens
aauaguagcaccagaaauu

SEQ ID NO: 1200306 - RNA, 19 nt, Homo sapiens
gaagcugcagucaguauuu

SEQ ID NO: 1200307 - RNA, 19 nt, Homo sapiens
caugaaauuucucagauca

SEQ ID NO: 1200308 - RNA, 19 nt, Homo sapiens
uauagaguaugucagguuu

SEQ ID NO: 1200309 - RNA, 19 nt, Homo sapiens
agaaacuacugcaaugauu

SEQ ID NO: 1200310 - RNA, 19 nt, Homo sapiens
guggauccauuuaauaugu

SEQ ID NO: 1200311 - RNA, 19 nt, Homo sapiens
uaugcaagccuaaaucuuu

SEQ ID NO: 1200312 - RNA, 19 nt, Homo sapiens
uguauaggauugcauguga

SEQ ID NO: 1200313 - RNA, 19 nt, Homo sapiens
gauaacucaucucucuuga

SEQ ID NO: 1200314 - RNA, 19 nt, Homo sapiens
gaacuccauccgucuguuu

SEQ ID NO: 1200315 - RNA, 19 nt, Homo sapiens
ggcaaagacuagugauguu

SEQ ID NO: 1200316 - RNA, 19 nt, Homo sapiens
ugaaagauugcacuuguuu

SEQ ID NO: 1200317 - RNA, 19 nt, Homo sapiens
aaaccagaaugcauuguau

SEQ ID NO: 1200318 - RNA, 19 nt, Homo sapiens
aauaagccguguacugauu

SEQ ID NO: 1200319 - RNA, 19 nt, Homo sapiens
caaagaagaaggaaauaag

SEQ ID NO: 1200320 - RNA, 19 nt, Homo sapiens
cacuuugucucacagaaua

SEQ ID NO: 1200321 - RNA, 19 nt, Homo sapiens
caaugaaguggaaugauaa

SEQ ID NO: 1200322 - RNA, 19 nt, Homo sapiens
uuucucagaucacuaauga

SEQ ID NO: 1200323 - RNA, 19 nt, Homo sapiens
ggagaucaaccacuacuuc

SEQ ID NO: 1200324 - RNA, 19 nt, Homo sapiens
gaauggugguucagaugga

SEQ ID NO: 1200325 - RNA, 19 nt, Homo sapiens
ggaugcaacuugugauuuu

SEQ ID NO: 1200326 - RNA, 19 nt, Homo sapiens
aaacuuggccugauuaugg

SEQ ID NO: 1200327 - RNA, 19 nt, Homo sapiens
guagauggguccuguuguc

SEQ ID NO: 1200328 - RNA, 19 nt, Homo sapiens
gaaucgagcagagaaacua

SEQ ID NO: 1200329 - RNA, 19 nt, Homo sapiens
gaaacccuaugcucaacau

SEQ ID NO: 1200330 - RNA, 19 nt, Homo sapiens
caaauacuuucugaaggaa

SEQ ID NO: 1200331 - RNA, 19 nt, Homo sapiens
agaauaagccguguacuga

SEQ ID NO: 1200332 - RNA, 19 nt, Homo sapiens
acaagauccuguuuaugaa

SEQ ID NO: 1200333 - RNA, 19 nt, Homo sapiens
cuacugcaaugauucuuau

SEQ ID NO: 1200334 - RNA, 19 nt, Homo sapiens
gcuuacaucuuccugaauc

SEQ ID NO: 1200335 - RNA, 19 nt, Homo sapiens
augagaagauagaugcuua

SEQ ID NO: 1200336 - RNA, 19 nt, Homo sapiens
gcagugaagcgcuuucuca

SEQ ID NO: 1200337 - RNA, 19 nt, Homo sapiens
gaaggaaauaagcaugaaa

SEQ ID NO: 1200338 - RNA, 19 nt, Homo sapiens
ggaaauguacauauccaau

SEQ ID NO: 1200339 - RNA, 19 nt, Homo sapiens
caaagcagagugcaaugaa

SEQ ID NO: 1200340 - RNA, 19 nt, Homo sapiens
ucacauuucuggagcaagu

SEQ ID NO: 1200341 - RNA, 19 nt, Homo sapiens
caaaucuguucaugaagga

SEQ ID NO: 1200342 - RNA, 19 nt, Homo sapiens
gaaacuacugcaaugauuc

SEQ ID NO: 1200343 - RNA, 19 nt, Homo sapiens
acaaacagacgaauggaaa

SEQ ID NO: 1200344 - RNA, 19 nt, Homo sapiens
caaucuuucugcaaacuug

SEQ ID NO: 1200345 - RNA, 19 nt, Homo sapiens
gauugcacuuguuugcuuu

SEQ ID NO: 1200346 - RNA, 19 nt, Homo sapiens
ucucucaaguggcagauuu

SEQ ID NO: 1200347 - RNA, 19 nt, Homo sapiens
agauagaugcuuacaauga

SEQ ID NO: 1200348 - RNA, 19 nt, Homo sapiens
cuuacaagauccuguuuau

SEQ ID NO: 1200349 - RNA, 19 nt, Homo sapiens
gaaaauaggaagaugauca

SEQ ID NO: 1200350 - RNA, 19 nt, Homo sapiens
gaacaagguuacuaucuua

SEQ ID NO: 1200351 - RNA, 19 nt, Homo sapiens
gaacagagauagcuuaaau

SEQ ID NO: 1200352 - RNA, 19 nt, Homo sapiens
gaacuuacuugacaacaaa

SEQ ID NO: 1200353 - RNA, 19 nt, Homo sapiens
gaaacaaacucugaagaaa

SEQ ID NO: 1200354 - RNA, 19 nt, Homo sapiens
ggagcaaggucaaauauga

SEQ ID NO: 1200355 - RNA, 19 nt, Homo sapiens
ggagguacauggucaaauu

SEQ ID NO: 1200356 - RNA, 19 nt, Homo sapiens
ggacagcuauuucuaucua

SEQ ID NO: 1200357 - RNA, 19 nt, Homo sapiens
aaagagaaguccaauguaa

SEQ ID NO: 1200358 - RNA, 19 nt, Homo sapiens
ucacagagcucuauuugau

SEQ ID NO: 1200359 - RNA, 19 nt, Homo sapiens
cuaaacugcucucugauua

SEQ ID NO: 1200360 - RNA, 19 nt, Homo sapiens
ugaaaugcuuccugaaaua

SEQ ID NO: 1200361 - RNA, 19 nt, Homo sapiens
gaaaggcugucaccauaau

SEQ ID NO: 1200362 - RNA, 19 nt, Homo sapiens
cagcagauaucaagaaaga

SEQ ID NO: 1200363 - RNA, 19 nt, Homo sapiens
uaaacaaggugaaacaaga

SEQ ID NO: 1200364 - RNA, 19 nt, Homo sapiens
agagagacauucacaagua

SEQ ID NO: 1200365 - RNA, 19 nt, Homo sapiens
caagaguucuacagacaua

SEQ ID NO: 1200366 - RNA, 19 nt, Homo sapiens
gagcaauguuucccaaauu

SEQ ID NO: 1200367 - RNA, 19 nt, Homo sapiens
aagaaaggcugucaccaua

SEQ ID NO: 1200368 - RNA, 19 nt, Homo sapiens
caccaugccuggcuaauuu

SEQ ID NO: 1200369 - RNA, 19 nt, Homo sapiens
gcaagcagguucaaauaca

SEQ ID NO: 1200370 - RNA, 19 nt, Homo sapiens
ggaagagcaugaagcagaa

SEQ ID NO: 1200371 - RNA, 19 nt, Homo sapiens
gaacaugaaccucuuggaa

SEQ ID NO: 1200372 - RNA, 19 nt, Homo sapiens
aaagugggcaucacaauua

SEQ ID NO: 1200373 - RNA, 19 nt, Homo sapiens
gcagaaaccuaugaagaug

SEQ ID NO: 1200374 - RNA, 19 nt, Homo sapiens
gcacaauguucaggcauaa

SEQ ID NO: 1200375 - RNA, 19 nt, Homo sapiens
gaugauggauuuauugaag

SEQ ID NO: 1200376 - RNA, 19 nt, Homo sapiens
gguagaugaugauggauuu

SEQ ID NO: 1200377 - RNA, 19 nt, Homo sapiens
gagcaagcagguucaaaua

SEQ ID NO: 1200378 - RNA, 19 nt, Homo sapiens
gcuaucaaaugcccaauau

SEQ ID NO: 1200379 - RNA, 19 nt, Homo sapiens
ggauguaccaccacuauuu

SEQ ID NO: 1200380 - RNA, 19 nt, Homo sapiens
ucaguuacaucuacuaaga

SEQ ID NO: 1200381 - RNA, 19 nt, Homo sapiens
ggaaauccaagcucucuuu

SEQ ID NO: 1200382 - RNA, 19 nt, Homo sapiens
gaaacuccaucuauguaau

SEQ ID NO: 1200383 - RNA, 19 nt, Homo sapiens
caggaucacuacaguuuaa

SEQ ID NO: 1200384 - RNA, 19 nt, Homo sapiens
gcacaauaaauuucccuua

SEQ ID NO: 1200385 - RNA, 19 nt, Homo sapiens
ucgaacaacuuaacaagaa

SEQ ID NO: 1200386 - RNA, 19 nt, Homo sapiens
aagcuaaacugcucucuga

SEQ ID NO: 1200387 - RNA, 19 nt, Homo sapiens
guuaucagcucacucaguu

SEQ ID NO: 1200388 - RNA, 19 nt, Homo sapiens
cauaaucccuaauaaguca

SEQ ID NO: 1200389 - RNA, 19 nt, Homo sapiens
cugcagagcuacaauauca

SEQ ID NO: 1200390 - RNA, 19 nt, Homo sapiens
aaacugcucucugauuauu

SEQ ID NO: 1200391 - RNA, 19 nt, Homo sapiens
uaggaagggucuaaagaaa

SEQ ID NO: 1200392 - RNA, 19 nt, Homo sapiens
gagagacauucacaaguau

SEQ ID NO: 1200393 - RNA, 19 nt, Homo sapiens
acugaaugcugauguauuu

SEQ ID NO: 1200394 - RNA, 19 nt, Homo sapiens
gaucucaguuauaaccaaa

SEQ ID NO: 1200395 - RNA, 19 nt, Homo sapiens
ggagcugggcgcuaaauaa

SEQ ID NO: 1200396 - RNA, 19 nt, Homo sapiens
ggucaaauaugagcugaug

SEQ ID NO: 1200397 - RNA, 19 nt, Homo sapiens
ucaauuggcuauaaucaca

SEQ ID NO: 1200398 - RNA, 19 nt, Homo sapiens
acacagguauuugacauaa

SEQ ID NO: 1200399 - RNA, 19 nt, Homo sapiens
gcagauaucaagaaagaug

SEQ ID NO: 1200400 - RNA, 19 nt, Homo sapiens
uuuaauagcucuucgaaca

SEQ ID NO: 1200401 - RNA, 19 nt, Homo sapiens
guguaucucugaaauaaug

SEQ ID NO: 1200402 - RNA, 19 nt, Homo sapiens
gcucguaguucaauaacau

SEQ ID NO: 1200403 - RNA, 19 nt, Homo sapiens
guacauggucaaauuacua

SEQ ID NO: 1200404 - RNA, 19 nt, Homo sapiens
uggcaggcauucauauuaa

SEQ ID NO: 1200405 - RNA, 19 nt, Homo sapiens
gaauacuaauuuccagaga

SEQ ID NO: 1200406 - RNA, 19 nt, Homo sapiens
ucacuacaguuuaauguca

SEQ ID NO: 1200407 - RNA, 19 nt, Homo sapiens
acagagcucuauuugauug

SEQ ID NO: 1200408 - RNA, 19 nt, Homo sapiens
ucacaaguauuuacagaag

SEQ ID NO: 1200409 - RNA, 19 nt, Homo sapiens
cauacuggcuuccaaagug

SEQ ID NO: 1200410 - RNA, 19 nt, Homo sapiens
uaacacagguauuugacau

SEQ ID NO: 1200411 - RNA, 19 nt, Homo sapiens
gaagaugguuuuacuggaa

SEQ ID NO: 1200412 - RNA, 19 nt, Homo sapiens
ucaaaugcccaauauggua

SEQ ID NO: 1200413 - RNA, 19 nt, Homo sapiens
gauuagcuauuuggaugua

SEQ ID NO: 1200414 - RNA, 19 nt, Homo sapiens
gguaaccucuccagucuag

SEQ ID NO: 1200415 - RNA, 19 nt, Homo sapiens
gcaugaagcagaaaccuau

SEQ ID NO: 1200416 - RNA, 19 nt, Homo sapiens
cgacuucacuucucauuuu

SEQ ID NO: 1200417 - RNA, 19 nt, Homo sapiens
gcagagcuacaauaucaaa

SEQ ID NO: 1200418 - RNA, 19 nt, Homo sapiens
ccaacagccugcagagcua

SEQ ID NO: 1200419 - RNA, 19 nt, Homo sapiens
gaaagucacaggcaucaca

SEQ ID NO: 1200420 - RNA, 19 nt, Homo sapiens
gaggaacagagauagcuua

SEQ ID NO: 1200421 - RNA, 19 nt, Homo sapiens
gguauaauaugcuacuucu

SEQ ID NO: 1200422 - RNA, 19 nt, Homo sapiens
gagguacauggucaaauua

SEQ ID NO: 1200423 - RNA, 19 nt, Homo sapiens
caaagugggcaucacaauu

SEQ ID NO: 1200424 - RNA, 19 nt, Homo sapiens
uaucagcucacucaguuua

SEQ ID NO: 1200425 - RNA, 19 nt, Homo sapiens
caagaaauucagaacauga

SEQ ID NO: 1200426 - RNA, 19 nt, Homo sapiens
cgaacaacuuaacaagaaa

SEQ ID NO: 1200427 - RNA, 19 nt, Homo sapiens
agaacaagguuacuaucuu

SEQ ID NO: 1200428 - RNA, 19 nt, Homo sapiens
gcaggaucacuacaguuua

SEQ ID NO: 1200429 - RNA, 19 nt, Homo sapiens
gauggagcaaggucaaaua

SEQ ID NO: 1200430 - RNA, 19 nt, Homo sapiens
gacaguggcuagagguaug

SEQ ID NO: 1200431 - RNA, 19 nt, Homo sapiens
cgaacuuacuugacaacaa

SEQ ID NO: 1200432 - RNA, 19 nt, Homo sapiens
gcuaaacugcucucugauu

SEQ ID NO: 1200433 - RNA, 19 nt, Homo sapiens
guagauagagcaauguuuc

SEQ ID NO: 1200434 - RNA, 19 nt, Homo sapiens
guucaggcauaaucccuaa

SEQ ID NO: 1200435 - RNA, 19 nt, Homo sapiens
ggaagggucuaaagaaaau

SEQ ID NO: 1200436 - RNA, 19 nt, Homo sapiens
gagacauucacaaguauuu

SEQ ID NO: 1200437 - RNA, 19 nt, Homo sapiens
ccucgguaguugacaguua

SEQ ID NO: 1200438 - RNA, 19 nt, Homo sapiens
caagcucucuuucacagau

SEQ ID NO: 1200439 - RNA, 19 nt, Homo sapiens
ugauggagcugggcgcuaa

SEQ ID NO: 1200440 - RNA, 19 nt, Homo sapiens
ccaaagugcugggauuaca

SEQ ID NO: 1200441 - RNA, 19 nt, Homo sapiens
cgccugaccucaugaucua

SEQ ID NO: 1200442 - RNA, 19 nt, Homo sapiens
gguacaauauucugcuuag

SEQ ID NO: 1200443 - RNA, 19 nt, Homo sapiens
acaacugaaugcugaugua

SEQ ID NO: 1200444 - RNA, 19 nt, Homo sapiens
cacaagaguucuacagaca

SEQ ID NO: 1200445 - RNA, 19 nt, Homo sapiens
agacaggguuucaccaugu

SEQ ID NO: 1200446 - RNA, 19 nt, Homo sapiens
agaaacaaacucugaagaa

SEQ ID NO: 1200447 - RNA, 19 nt, Homo sapiens
ucacuguacugacgacuuc

SEQ ID NO: 1200448 - RNA, 19 nt, Homo sapiens
gcucucugauuauucaaga

SEQ ID NO: 1200449 - RNA, 19 nt, Homo sapiens
ggcauaaucccuaauaagu

SEQ ID NO: 1200450 - RNA, 19 nt, Homo sapiens
ggaagcaucuccauuguaa

SEQ ID NO: 1200451 - RNA, 19 nt, Homo sapiens
ucacaaggguggaguauua

SEQ ID NO: 1200452 - RNA, 19 nt, Homo sapiens
gaacaccucuuuauaacuu

SEQ ID NO: 1200453 - RNA, 19 nt, Homo sapiens
ggacuuugcugcuauuuga

SEQ ID NO: 1200454 - RNA, 19 nt, Homo sapiens
gaaggaacaccucuuuaua

SEQ ID NO: 1200455 - RNA, 19 nt, Homo sapiens
gaaacagaguucccuacua

SEQ ID NO: 1200456 - RNA, 19 nt, Homo sapiens
caacauaugucuggccuaa

SEQ ID NO: 1200457 - RNA, 19 nt, Homo sapiens
gauugauccuccagaauua

SEQ ID NO: 1200458 - RNA, 19 nt, Homo sapiens
cacauuaacuguacagaaa

SEQ ID NO: 1200459 - RNA, 19 nt, Homo sapiens
cagcauagcucucaaucga

SEQ ID NO: 1200460 - RNA, 19 nt, Homo sapiens
caaaugugcucguuaugga

SEQ ID NO: 1200461 - RNA, 19 nt, Homo sapiens
cuaaacgucuucaagcuuu

SEQ ID NO: 1200462 - RNA, 19 nt, Homo sapiens
ccauggagcuucucaagga

SEQ ID NO: 1200463 - RNA, 19 nt, Homo sapiens
gaggcauacuuucaacaua

SEQ ID NO: 1200464 - RNA, 19 nt, Homo sapiens
gacccacucuguucucuuu

SEQ ID NO: 1200465 - RNA, 19 nt, Homo sapiens
ggacacauccaauaacaga

SEQ ID NO: 1200466 - RNA, 19 nt, Homo sapiens
guacuggcuuuguguugua

SEQ ID NO: 1200467 - RNA, 19 nt, Homo sapiens
uugcauagccuaaagauaa

SEQ ID NO: 1200468 - RNA, 19 nt, Homo sapiens
aaacagaguucccuacuac

SEQ ID NO: 1200469 - RNA, 19 nt, Homo sapiens
caaggaagcugucacucau

SEQ ID NO: 1200470 - RNA, 19 nt, Homo sapiens
gguagugagugcuauauuc

SEQ ID NO: 1200471 - RNA, 19 nt, Homo sapiens
gcaucuccauuguaaauau

SEQ ID NO: 1200472 - RNA, 19 nt, Homo sapiens
uaaagaugcuggaguaaac

SEQ ID NO: 1200473 - RNA, 19 nt, Homo sapiens
auuagacacucacauguua

SEQ ID NO: 1200474 - RNA, 19 nt, Homo sapiens
caaucgaucccuagguuua

SEQ ID NO: 1200475 - RNA, 19 nt, Homo sapiens
guugcuggguguauuauuu

SEQ ID NO: 1200476 - RNA, 19 nt, Homo sapiens
ccuaaaagcuguucacauu

SEQ ID NO: 1200477 - RNA, 19 nt, Homo sapiens
gcaaagaugguacuuacau

SEQ ID NO: 1200478 - RNA, 19 nt, Homo sapiens
gggcugauaguaaaccuua

SEQ ID NO: 1200479 - RNA, 19 nt, Homo sapiens
gccaauaucuuaucaucuc

SEQ ID NO: 1200480 - RNA, 19 nt, Homo sapiens
gcaguugcuggguguauua

SEQ ID NO: 1200481 - RNA, 19 nt, Homo sapiens
gagauugccaccagaauau

SEQ ID NO: 1200482 - RNA, 19 nt, Homo sapiens
uaucucaucuuguuucugu

SEQ ID NO: 1200483 - RNA, 19 nt, Homo sapiens
ggaaaacuauuaccaaaca

SEQ ID NO: 1200484 - RNA, 19 nt, Homo sapiens
uuacaaagacccaaaugaa

SEQ ID NO: 1200485 - RNA, 19 nt, Homo sapiens
agaguaaaguggagucuug

SEQ ID NO: 1200486 - RNA, 19 nt, Homo sapiens
gcacagugauauuguuguc

SEQ ID NO: 1200487 - RNA, 19 nt, Homo sapiens
guacuggauuucaugaugu

SEQ ID NO: 1200488 - RNA, 19 nt, Homo sapiens
aaggaacaccucuuuauaa

SEQ ID NO: 1200489 - RNA, 19 nt, Homo sapiens
guacccagcgcucgauuaa

SEQ ID NO: 1200490 - RNA, 19 nt, Homo sapiens
gaagcugucacucaucuga

SEQ ID NO: 1200491 - RNA, 19 nt, Homo sapiens
uaaaguggagucuugguuu

SEQ ID NO: 1200492 - RNA, 19 nt, Homo sapiens
ucauacagcuuccagaaag

SEQ ID NO: 1200493 - RNA, 19 nt, Homo sapiens
ugaaggacaucaugacagu

SEQ ID NO: 1200494 - RNA, 19 nt, Homo sapiens
gcugugaucuguuuauugc

SEQ ID NO: 1200495 - RNA, 19 nt, Homo sapiens
uaugauggauucuagugaa

SEQ ID NO: 1200496 - RNA, 19 nt, Homo sapiens
acuuaaagaugcuggagua

SEQ ID NO: 1200497 - RNA, 19 nt, Homo sapiens
cagguuacaggaauacuua

SEQ ID NO: 1200498 - RNA, 19 nt, Homo sapiens
gcuagaacaaagaauagua

SEQ ID NO: 1200499 - RNA, 19 nt, Homo sapiens
gucaguggcuagauugauu

SEQ ID NO: 1200500 - RNA, 19 nt, Homo sapiens
ucaggaagcaucuccauug

SEQ ID NO: 1200501 - RNA, 19 nt, Homo sapiens
ugaaggaacaccucuuuau

SEQ ID NO: 1200502 - RNA, 19 nt, Homo sapiens
cgacguugguggagcuaaa

SEQ ID NO: 1200503 - RNA, 19 nt, Homo sapiens
ggcaggaacaauucauaua

SEQ ID NO: 1200504 - RNA, 19 nt, Homo sapiens
ugagauugccaccagaaua

SEQ ID NO: 1200505 - RNA, 19 nt, Homo sapiens
gaucguauccacaguucuu

SEQ ID NO: 1200506 - RNA, 19 nt, Homo sapiens
cagcauuggugugaucgua

SEQ ID NO: 1200507 - RNA, 19 nt, Homo sapiens
gcaggaacaauucauauac

SEQ ID NO: 1200508 - RNA, 19 nt, Homo sapiens
gaauuagacacucacaugu

SEQ ID NO: 1200509 - RNA, 19 nt, Homo sapiens
ggaguauuauugcuaguac

SEQ ID NO: 1200510 - RNA, 19 nt, Homo sapiens
uaauauugccagaaggaua

SEQ ID NO: 1200511 - RNA, 19 nt, Homo sapiens
ucacauuguucaguucauu

SEQ ID NO: 1200512 - RNA, 19 nt, Homo sapiens
aggcauacuuucaacauau

SEQ ID NO: 1200513 - RNA, 19 nt, Homo sapiens
caggaacaauucauauaca

SEQ ID NO: 1200514 - RNA, 19 nt, Homo sapiens
cuaaggacuuugcugcuau

SEQ ID NO: 1200515 - RNA, 19 nt, Homo sapiens
uacaaagacccaaaugaaa

SEQ ID NO: 1200516 - RNA, 19 nt, Homo sapiens
auauacaggugacaucuga

SEQ ID NO: 1200517 - RNA, 19 nt, Homo sapiens
ugauugauccuccagaauu

SEQ ID NO: 1200518 - RNA, 19 nt, Homo sapiens
gcagaucuuuuacuucuug

SEQ ID NO: 1200519 - RNA, 19 nt, Homo sapiens
acagugcucuaacucauau

SEQ ID NO: 1200520 - RNA, 19 nt, Homo sapiens
uaaggacuuugcugcuauu

SEQ ID NO: 1200521 - RNA, 19 nt, Homo sapiens
gauaguaaaccuuauuggu

SEQ ID NO: 1200522 - RNA, 19 nt, Homo sapiens
aaagcucucugucgacguu

SEQ ID NO: 1200523 - RNA, 19 nt, Homo sapiens
ugacagugcucuaacucau

SEQ ID NO: 1200524 - RNA, 19 nt, Homo sapiens
acauaugucuggccuaagu

SEQ ID NO: 1200525 - RNA, 19 nt, Homo sapiens
uuggagggcugauaguaaa

SEQ ID NO: 1200526 - RNA, 19 nt, Homo sapiens
acacagccauugccuucuu

SEQ ID NO: 1200527 - RNA, 19 nt, Homo sapiens
gacagugcucuaacucaua

SEQ ID NO: 1200528 - RNA, 19 nt, Homo sapiens
caggaagcaucuccauugu

SEQ ID NO: 1200529 - RNA, 19 nt, Homo sapiens
caugaaauacugcaaagau

SEQ ID NO: 1200530 - RNA, 19 nt, Homo sapiens
guacagcagguuacaggaa

SEQ ID NO: 1200531 - RNA, 19 nt, Homo sapiens
uaacucauaugcuuuacac

SEQ ID NO: 1200532 - RNA, 19 nt, Homo sapiens
uuauugcugugaucuguuu

SEQ ID NO: 1200533 - RNA, 19 nt, Homo sapiens
gagcacagugauauuguug

SEQ ID NO: 1200534 - RNA, 19 nt, Homo sapiens
ggagaauaaacaaugaaga

SEQ ID NO: 1200535 - RNA, 19 nt, Homo sapiens
caaggguggaguauuauug

SEQ ID NO: 1200536 - RNA, 19 nt, Homo sapiens
cacagccauugccuucuua

SEQ ID NO: 1200537 - RNA, 19 nt, Homo sapiens
uaaaagcuguucacauugu

SEQ ID NO: 1200538 - RNA, 19 nt, Homo sapiens
gauaugauggauucuagug

SEQ ID NO: 1200539 - RNA, 19 nt, Homo sapiens
ccuggagaauaaacaauga

SEQ ID NO: 1200540 - RNA, 19 nt, Homo sapiens
cugcaaagaugguacuuac

SEQ ID NO: 1200541 - RNA, 19 nt, Homo sapiens
ucacagccauucacaccau

SEQ ID NO: 1200542 - RNA, 19 nt, Homo sapiens
ggagucaguggcuagauug

SEQ ID NO: 1200543 - RNA, 19 nt, Homo sapiens
guaaaguggagucuugguu

SEQ ID NO: 1200544 - RNA, 19 nt, Homo sapiens
caucaugacagugcucuaa

SEQ ID NO: 1200545 - RNA, 19 nt, Homo sapiens
ggaggaggaccagcaaaga

SEQ ID NO: 1200546 - RNA, 19 nt, Homo sapiens
uuauuucacucuugugguu

SEQ ID NO: 1200547 - RNA, 19 nt, Homo sapiens
gguaaaaguggaguaauua

SEQ ID NO: 1200548 - RNA, 19 nt, Homo sapiens
aauauugccagaaggauaa

SEQ ID NO: 1200549 - RNA, 19 nt, Homo sapiens
gaaauacugcaaagauggu

SEQ ID NO: 1200550 - RNA, 19 nt, Homo sapiens
ucacaaagugcuaggauua

SEQ ID NO: 1200551 - RNA, 19 nt, Homo sapiens
gucaagggaucuuauguuu

SEQ ID NO: 1200552 - RNA, 19 nt, Homo sapiens
ccagauaauuggaucacua

SEQ ID NO: 1200553 - RNA, 19 nt, Homo sapiens
gaaacuagugggaaacuga

SEQ ID NO: 1200554 - RNA, 19 nt, Homo sapiens
ggaccacuaagguaaauaa

SEQ ID NO: 1200555 - RNA, 19 nt, Homo sapiens
gcagacaagaauauagaua

SEQ ID NO: 1200556 - RNA, 19 nt, Homo sapiens
guugcuggguguauuauuu

SEQ ID NO: 1200557 - RNA, 19 nt, Homo sapiens
ccuaaaagcuguucacauu

SEQ ID NO: 1200558 - RNA, 19 nt, Homo sapiens
gcaguugcuggguguauua

SEQ ID NO: 1200559 - RNA, 19 nt, Homo sapiens
guuaaaugauccuaggaaa

SEQ ID NO: 1200560 - RNA, 19 nt, Homo sapiens
ucuuggaaaucuagacuua

SEQ ID NO: 1200561 - RNA, 19 nt, Homo sapiens
gggaaacugagaaaucaua

SEQ ID NO: 1200562 - RNA, 19 nt, Homo sapiens
ggaaaacuauuaccaaaca

SEQ ID NO: 1200563 - RNA, 19 nt, Homo sapiens
guacccagcgcucgauuaa

SEQ ID NO: 1200564 - RNA, 19 nt, Homo sapiens
caagggaucuuauguuuuc

SEQ ID NO: 1200565 - RNA, 19 nt, Homo sapiens
ggaaacugagaaaucauaa

SEQ ID NO: 1200566 - RNA, 19 nt, Homo sapiens
cugaguagcuggaauuaca

SEQ ID NO: 1200567 - RNA, 19 nt, Homo sapiens
gggcuucauucaccacauu

SEQ ID NO: 1200568 - RNA, 19 nt, Homo sapiens
gugggaaacugagaaauca

SEQ ID NO: 1200569 - RNA, 19 nt, Homo sapiens
agaauacugucuuggaaau

SEQ ID NO: 1200570 - RNA, 19 nt, Homo sapiens
ucacauuguucaguucauu

SEQ ID NO: 1200571 - RNA, 19 nt, Homo sapiens
cagauaauuggaucacuaa

SEQ ID NO: 1200572 - RNA, 19 nt, Homo sapiens
cagcagacaagaauauaga

SEQ ID NO: 1200573 - RNA, 19 nt, Homo sapiens
uaaaugauccuaggaaacu

SEQ ID NO: 1200574 - RNA, 19 nt, Homo sapiens
uuauuucacucuugugguu

SEQ ID NO: 1200575 - RNA, 19 nt, Homo sapiens
uaaaagcuguucacauugu

SEQ ID NO: 1200576 - RNA, 19 nt, Homo sapiens
acccagcgcucgauuaaca

SEQ ID NO: 1200577 - RNA, 19 nt, Homo sapiens
guguuacuauguuucacua

SEQ ID NO: 1200578 - RNA, 19 nt, Homo sapiens
caccacacccagcucauuu

SEQ ID NO: 1200579 - RNA, 19 nt, Homo sapiens
ggaaacuagugggaaacug

SEQ ID NO: 1200580 - RNA, 19 nt, Homo sapiens
uaccaaacaccagauaauu

SEQ ID NO: 1200581 - RNA, 19 nt, Homo sapiens
acaaagugcuaggauuaca

SEQ ID NO: 1200582 - RNA, 19 nt, Homo sapiens
uuggaaaucuagacuuagu

SEQ ID NO: 1200583 - RNA, 19 nt, Homo sapiens
gguguauuauuucacucuu

SEQ ID NO: 1200584 - RNA, 19 nt, Homo sapiens
guguauuauuucacucuug

SEQ ID NO: 1200585 - RNA, 19 nt, Homo sapiens
aaaugauccuaggaaacua

SEQ ID NO: 1200586 - RNA, 19 nt, Homo sapiens
cauaugaucuccuaaaagc

SEQ ID NO: 1200587 - RNA, 19 nt, Homo sapiens
gaccacuaagguaaauaaa

SEQ ID NO: 1200588 - RNA, 19 nt, Homo sapiens
uuaccaaacaccagauaau

SEQ ID NO: 1200589 - RNA, 19 nt, Homo sapiens
ccaccacacccagcucauu

SEQ ID NO: 1200590 - RNA, 19 nt, Homo sapiens
uaccagcagacaagaauau

SEQ ID NO: 1200591 - RNA, 19 nt, Homo sapiens
accaaacaccagauaauug

SEQ ID NO: 1200592 - RNA, 19 nt, Homo sapiens
ccauuuauaguggaucaaa

SEQ ID NO: 1200593 - RNA, 19 nt, Homo sapiens
auacugucuuggaaaucua

SEQ ID NO: 1200594 - RNA, 19 nt, Homo sapiens
aauacugucuuggaaaucu

SEQ ID NO: 1200595 - RNA, 19 nt, Homo sapiens
gcgcucgauuaacaaaaua

SEQ ID NO: 1200596 - RNA, 19 nt, Homo sapiens
cagaauaagaauacugucu

SEQ ID NO: 1200597 - RNA, 19 nt, Homo sapiens
cgacgcgugugugcuagug

SEQ ID NO: 1200598 - RNA, 19 nt, Homo sapiens
ugggaaaacuauuaccaaa

SEQ ID NO: 1200599 - RNA, 19 nt, Homo sapiens
gcuaggauuacaggcauga

SEQ ID NO: 1200600 - RNA, 19 nt, Homo sapiens
cucacaaagugcuaggauu

SEQ ID NO: 1200601 - RNA, 19 nt, Homo sapiens
aaacaccagauaauuggau

SEQ ID NO: 1200602 - RNA, 19 nt, Homo sapiens
cacauuguucaguucauuu

SEQ ID NO: 1200603 - RNA, 19 nt, Homo sapiens
gaaauuggcuucugugguu

SEQ ID NO: 1200604 - RNA, 19 nt, Homo sapiens
gaaaguggucccagaaaua

SEQ ID NO: 1200605 - RNA, 19 nt, Homo sapiens
gaauggagccuuuguggua

SEQ ID NO: 1200606 - RNA, 19 nt, Homo sapiens
guaagacacuucccuuuga

SEQ ID NO: 1200607 - RNA, 19 nt, Homo sapiens
gaaccugucaccuguaaua

SEQ ID NO: 1200608 - RNA, 19 nt, Homo sapiens
ggaaaguggucccagaaau

SEQ ID NO: 1200609 - RNA, 19 nt, Homo sapiens
gaugcacugugacuuguua

SEQ ID NO: 1200610 - RNA, 19 nt, Homo sapiens
gcaagguacuggugguuga

SEQ ID NO: 1200611 - RNA, 19 nt, Homo sapiens
ggugaaaucucaucuguac

SEQ ID NO: 1200612 - RNA, 19 nt, Homo sapiens
gaaguuccgugccauaaag

SEQ ID NO: 1200613 - RNA, 19 nt, Homo sapiens
gaaaucucaucuguacuaa

SEQ ID NO: 1200614 - RNA, 19 nt, Homo sapiens
gcagagccacugugaagua

SEQ ID NO: 1200615 - RNA, 19 nt, Homo sapiens
ugaaaucucaucuguacua

SEQ ID NO: 1200616 - RNA, 19 nt, Homo sapiens
ugacaacucuuucauucau

SEQ ID NO: 1200617 - RNA, 19 nt, Homo sapiens
gcuaaaaucuuggggcuua

SEQ ID NO: 1200618 - RNA, 19 nt, Homo sapiens
caaguuguaugucuacugu

SEQ ID NO: 1200619 - RNA, 19 nt, Homo sapiens
gagaguaacuauccucaac

SEQ ID NO: 1200620 - RNA, 19 nt, Homo sapiens
gagccacugugaaguaaga

SEQ ID NO: 1200621 - RNA, 19 nt, Homo sapiens
gaguaacuauccucaacuu

SEQ ID NO: 1200622 - RNA, 19 nt, Homo sapiens
gaagcagaguuugcaguga

SEQ ID NO: 1200623 - RNA, 19 nt, Homo sapiens
gcccaaagcucccagaaaa

SEQ ID NO: 1200624 - RNA, 19 nt, Homo sapiens
ggucaaggcuaaggccaaa

SEQ ID NO: 1200625 - RNA, 19 nt, Homo sapiens
gggcaucauuucagugaga

SEQ ID NO: 1200626 - RNA, 19 nt, Homo sapiens
ccaccagccuccuuucaga

SEQ ID NO: 1200627 - RNA, 19 nt, Homo sapiens
gguugaggcuggaagauca

SEQ ID NO: 1200628 - RNA, 19 nt, Homo sapiens
gcuugaagauauagggaaa

SEQ ID NO: 1200629 - RNA, 19 nt, Homo sapiens
caggccagcuugaagauau

SEQ ID NO: 1200630 - RNA, 19 nt, Homo sapiens
uaacuauccucaacuucga

SEQ ID NO: 1200631 - RNA, 19 nt, Homo sapiens
ucugacaacucuuucauuc

SEQ ID NO: 1200632 - RNA, 19 nt, Homo sapiens
gcuggaagaucacuugaac

SEQ ID NO: 1200633 - RNA, 19 nt, Homo sapiens
cagagccacugugaaguaa

SEQ ID NO: 1200634 - RNA, 19 nt, Homo sapiens
caguugaggucaggaguuu

SEQ ID NO: 1200635 - RNA, 19 nt, Homo sapiens
ccaaagggaucugcuaagg

SEQ ID NO: 1200636 - RNA, 19 nt, Homo sapiens
cagcacuggucaaggcuaa

SEQ ID NO: 1200637 - RNA, 19 nt, Homo sapiens
ccaacauggugaaaucuca

SEQ ID NO: 1200638 - RNA, 19 nt, Homo sapiens
caaggcaggugggucaguu

SEQ ID NO: 1200639 - RNA, 19 nt, Homo sapiens
gcacugugacuuguuauuc

SEQ ID NO: 1200640 - RNA, 19 nt, Homo sapiens
gcuaaggccagaacuacaa

SEQ ID NO: 1200641 - RNA, 19 nt, Homo sapiens
cccacuaccuuacaugcua

SEQ ID NO: 1200642 - RNA, 19 nt, Homo sapiens
gcagugcuuucuguaugaa

SEQ ID NO: 1200643 - RNA, 19 nt, Homo sapiens
ccucagugaccaaauaauu

SEQ ID NO: 1200644 - RNA, 19 nt, Homo sapiens
gcagucugauuccuucaca

SEQ ID NO: 1200645 - RNA, 19 nt, Homo sapiens
aggcugcucugguuuguga

SEQ ID NO: 1200646 - RNA, 19 nt, Homo sapiens
ugucuacuguuccaucuau

SEQ ID NO: 1200647 - RNA, 19 nt, Homo sapiens
uaacuguccugcccaucug

SEQ ID NO: 1200648 - RNA, 19 nt, Homo sapiens
gguguguccucccuugguu

SEQ ID NO: 1200649 - RNA, 19 nt, Homo sapiens
ggccaaagggaucugcuaa

SEQ ID NO: 1200650 - RNA, 19 nt, Homo sapiens
gaaccugggaagcagaguu

SEQ ID NO: 1200651 - RNA, 19 nt, Homo sapiens
ucagugagaaucagauguu

SEQ ID NO: 1200652 - RNA, 19 nt, Homo sapiens
gcccaucuguaguccauca

SEQ ID NO: 1200653 - RNA, 19 nt, Homo sapiens
ugucacccuuccugcuuua

SEQ ID NO: 1200654 - RNA, 19 nt, Homo sapiens
aaucuuaagugcucucucu

SEQ ID NO: 1200655 - RNA, 19 nt, Homo sapiens
gcgaugcacugugacuugu

SEQ ID NO: 1200656 - RNA, 19 nt, Homo sapiens
agccauugcugccauauuc

SEQ ID NO: 1200657 - RNA, 19 nt, Homo sapiens
aaacuaagcccagcugucu

SEQ ID NO: 1200658 - RNA, 19 nt, Homo sapiens
gacaacucuuucauucaug

SEQ ID NO: 1200659 - RNA, 19 nt, Homo sapiens
ugcccucagugaccaaaua

SEQ ID NO: 1200660 - RNA, 19 nt, Homo sapiens
ccuugcagcuaguggguuu

SEQ ID NO: 1200661 - RNA, 19 nt, Homo sapiens
uaagacacuucccuuugag

SEQ ID NO: 1200662 - RNA, 19 nt, Homo sapiens
gcaggccagcuugaagaua

SEQ ID NO: 1200663 - RNA, 19 nt, Homo sapiens
cagugagaaucagauguuu

SEQ ID NO: 1200664 - RNA, 19 nt, Homo sapiens
aggcuaaggccaaagcuaa

SEQ ID NO: 1200665 - RNA, 19 nt, Homo sapiens
gaagcagagccacugugaa

SEQ ID NO: 1200666 - RNA, 19 nt, Homo sapiens
cacugugacuuguuauuca

SEQ ID NO: 1200667 - RNA, 19 nt, Homo sapiens
gcugaaguuccgugccaua

SEQ ID NO: 1200668 - RNA, 19 nt, Homo sapiens
guugaggucaggaguuuga

SEQ ID NO: 1200669 - RNA, 19 nt, Homo sapiens
ccuguaaucccagcacuuu

SEQ ID NO: 1200670 - RNA, 19 nt, Homo sapiens
uggccaacauggugaaauc

SEQ ID NO: 1200671 - RNA, 19 nt, Homo sapiens
agaagcagagccacuguga

SEQ ID NO: 1200672 - RNA, 19 nt, Homo sapiens
ugaaguuccgugccauaaa

SEQ ID NO: 1200673 - RNA, 19 nt, Homo sapiens
aagcagagccacugugaag

SEQ ID NO: 1200674 - RNA, 19 nt, Homo sapiens
uccauggucuucugugugu

SEQ ID NO: 1200675 - RNA, 19 nt, Homo sapiens
gaggcuggaagaucacuug

SEQ ID NO: 1200676 - RNA, 19 nt, Homo sapiens
ggagguugaggcuggaaga

SEQ ID NO: 1200677 - RNA, 19 nt, Homo sapiens
guaacuguccugcccaucu

SEQ ID NO: 1200678 - RNA, 19 nt, Homo sapiens
aguaagacacuucccuuug

SEQ ID NO: 1200679 - RNA, 19 nt, Homo sapiens
aaaguggucccagaaauag

SEQ ID NO: 1200680 - RNA, 19 nt, Homo sapiens
gcccucagugaccaaauaa

SEQ ID NO: 1200681 - RNA, 19 nt, Homo sapiens
cuuugaggcugcucugguu

SEQ ID NO: 1200682 - RNA, 19 nt, Homo sapiens
aaacagcccaggccaaggu

SEQ ID NO: 1200683 - RNA, 19 nt, Homo sapiens
ggcccaaagcucccagaaa

SEQ ID NO: 1200684 - RNA, 19 nt, Homo sapiens
cccaguguccggcgaauga

SEQ ID NO: 1200685 - RNA, 19 nt, Homo sapiens
gcagaagcagagccacugu

SEQ ID NO: 1200686 - RNA, 19 nt, Homo sapiens
cuucugugguugucugaga

SEQ ID NO: 1200687 - RNA, 19 nt, Homo sapiens
aggccagcuugaagauaua

SEQ ID NO: 1200688 - RNA, 19 nt, Homo sapiens
ggcaucauuucagugagaa

SEQ ID NO: 1200689 - RNA, 19 nt, Homo sapiens
cuacuugccucugacaacu

SEQ ID NO: 1200690 - RNA, 19 nt, Homo sapiens
aguuguaugucuacuguuc

SEQ ID NO: 1200691 - RNA, 19 nt, Homo sapiens
acaugcuacuugccucuga

SEQ ID NO: 1200692 - RNA, 19 nt, Homo sapiens
gcagggaggggcacacauu

SEQ ID NO: 1200693 - RNA, 19 nt, Homo sapiens
gaccaccagccuccuuuca

SEQ ID NO: 1200694 - RNA, 19 nt, Homo sapiens
guuccgugccauaaaggua

SEQ ID NO: 1200695 - RNA, 19 nt, Homo sapiens
gugguggaccuguggagaa

SEQ ID NO: 1200696 - RNA, 19 nt, Homo sapiens
ggagagaugaggggaaauu

SEQ ID NO: 1200697 - RNA, 19 nt, Homo sapiens
acaccuaaagucccagcua

SEQ ID NO: 1200698 - RNA, 19 nt, Homo sapiens
cuuaagugcucucucuacu

SEQ ID NO: 1200699 - RNA, 19 nt, Homo sapiens
ugggugagguuuuccauga

SEQ ID NO: 1200700 - RNA, 19 nt, Homo sapiens
uuccaucuaucacguuuua

SEQ ID NO: 1200701 - RNA, 19 nt, Homo sapiens
acugugacuuguuauucaa

SEQ ID NO: 1200702 - RNA, 19 nt, Homo sapiens
caaaggagcugcuacaaug

SEQ ID NO: 1200703 - RNA, 19 nt, Homo sapiens
acacacagcuccuugcaua

SEQ ID NO: 1200704 - RNA, 19 nt, Homo sapiens
gcugaugucugaugaaauu

SEQ ID NO: 1200705 - RNA, 19 nt, Homo sapiens
gagaauaacaugagaagaa

SEQ ID NO: 1200706 - RNA, 19 nt, Homo sapiens
uaaggaagcugcagagaau

SEQ ID NO: 1200707 - RNA, 19 nt, Homo sapiens
gaccugggcugaugucuga

SEQ ID NO: 1200708 - RNA, 19 nt, Homo sapiens
caagacaacuguguaauuc

SEQ ID NO: 1200709 - RNA, 19 nt, Homo sapiens
gagaguccaugccgaguuu

SEQ ID NO: 1200710 - RNA, 19 nt, Homo sapiens
caaagaaucaccaaacuga

SEQ ID NO: 1200711 - RNA, 19 nt, Homo sapiens
gauuagugcuuuauaagga

SEQ ID NO: 1200712 - RNA, 19 nt, Homo sapiens
gaaagaaguuccaaaacaa

SEQ ID NO: 1200713 - RNA, 19 nt, Homo sapiens
gcuguuagcaucacucaua

SEQ ID NO: 1200714 - RNA, 19 nt, Homo sapiens
ccaccuagaugaaguuguu

SEQ ID NO: 1200715 - RNA, 19 nt, Homo sapiens
gaaugggauuagugcuuua

SEQ ID NO: 1200716 - RNA, 19 nt, Homo sapiens
ggaagaauggauagaaauu

SEQ ID NO: 1200717 - RNA, 19 nt, Homo sapiens
gcuacaauguggaagaauu

SEQ ID NO: 1200718 - RNA, 19 nt, Homo sapiens
gcaaaguccuauuccaaca

SEQ ID NO: 1200719 - RNA, 19 nt, Homo sapiens
gcaagaagaggaugguuug

SEQ ID NO: 1200720 - RNA, 19 nt, Homo sapiens
ccagaacuguaagaaauaa

SEQ ID NO: 1200721 - RNA, 19 nt, Homo sapiens
gcauagguguggaguuaga

SEQ ID NO: 1200722 - RNA, 19 nt, Homo sapiens
gaauucaacagucaggaua

SEQ ID NO: 1200723 - RNA, 19 nt, Homo sapiens
ggaagcauuuggcgauuuc

SEQ ID NO: 1200724 - RNA, 19 nt, Homo sapiens
caaccucgauccugagaga

SEQ ID NO: 1200725 - RNA, 19 nt, Homo sapiens
uugcauagguguggaguua

SEQ ID NO: 1200726 - RNA, 19 nt, Homo sapiens
gacaagaauuugcuaugga

SEQ ID NO: 1200727 - RNA, 19 nt, Homo sapiens
ccacauauccaaccaccua

SEQ ID NO: 1200728 - RNA, 19 nt, Homo sapiens
cggaucagauuaucauuug

SEQ ID NO: 1200729 - RNA, 19 nt, Homo sapiens
caacagucaugaguacaaa

SEQ ID NO: 1200730 - RNA, 19 nt, Homo sapiens
ggaguuagaucuggacagu

SEQ ID NO: 1200731 - RNA, 19 nt, Homo sapiens
ucaccaaacugauaaagca

SEQ ID NO: 1200732 - RNA, 19 nt, Homo sapiens
ugaaugggauuagugcuuu

SEQ ID NO: 1200733 - RNA, 19 nt, Homo sapiens
ugaaacaagucgugagugu

SEQ ID NO: 1200734 - RNA, 19 nt, Homo sapiens
gaagaauggauagaaauug

SEQ ID NO: 1200735 - RNA, 19 nt, Homo sapiens
gcuuuacucucccuucaaa

SEQ ID NO: 1200736 - RNA, 19 nt, Homo sapiens
gggcugaugucugaugaaa

SEQ ID NO: 1200737 - RNA, 19 nt, Homo sapiens
ccaagacaacuguguaauu

SEQ ID NO: 1200738 - RNA, 19 nt, Homo sapiens
ggacauuccugggcacugu

SEQ ID NO: 1200739 - RNA, 19 nt, Homo sapiens
gauccagacccucuuauau

SEQ ID NO: 1200740 - RNA, 19 nt, Homo sapiens
gaaaaguggcugaugauaa

SEQ ID NO: 1200741 - RNA, 19 nt, Homo sapiens
ucgaguagcuggaauuaca

SEQ ID NO: 1200742 - RNA, 19 nt, Homo sapiens
gaaauugaagcacggauca

SEQ ID NO: 1200743 - RNA, 19 nt, Homo sapiens
uagcaucacucauagaaag

SEQ ID NO: 1200744 - RNA, 19 nt, Homo sapiens
ugauguagcugagcaguau

SEQ ID NO: 1200745 - RNA, 19 nt, Homo sapiens
cuacaauguggaagaauua

SEQ ID NO: 1200746 - RNA, 19 nt, Homo sapiens
aguaucaacugacugagua

SEQ ID NO: 1200747 - RNA, 19 nt, Homo sapiens
guacccauauugagagaau

SEQ ID NO: 1200748 - RNA, 19 nt, Homo sapiens
guggaagaauuauaaagga

SEQ ID NO: 1200749 - RNA, 19 nt, Homo sapiens
gagcuuuacucucccuuca

SEQ ID NO: 1200750 - RNA, 19 nt, Homo sapiens
ggcaccaccuccaguauug

SEQ ID NO: 1200751 - RNA, 19 nt, Homo sapiens
caguaaaggugaaacaagu

SEQ ID NO: 1200752 - RNA, 19 nt, Homo sapiens
guucauaugcucccaauuc

SEQ ID NO: 1200753 - RNA, 19 nt, Homo sapiens
gagaagaaaacgcuaauaa

SEQ ID NO: 1200754 - RNA, 19 nt, Homo sapiens
gaugggaagaaccaaauuu

SEQ ID NO: 1200755 - RNA, 19 nt, Homo sapiens
gcguagcacugacaagaau

SEQ ID NO: 1200756 - RNA, 19 nt, Homo sapiens
agagagcccucaccaggaa

SEQ ID NO: 1200757 - RNA, 19 nt, Homo sapiens
gcacggaucagauuaucau

SEQ ID NO: 1200758 - RNA, 19 nt, Homo sapiens
aaggaagaauggauagaaa

SEQ ID NO: 1200759 - RNA, 19 nt, Homo sapiens
gauaagcauguaacucaaa

SEQ ID NO: 1200760 - RNA, 19 nt, Homo sapiens
ugggauuagugcuuuauaa

SEQ ID NO: 1200761 - RNA, 19 nt, Homo sapiens
gagaaagagcccaguagga

SEQ ID NO: 1200762 - RNA, 19 nt, Homo sapiens
gaagaaaacgcuaauaaag

SEQ ID NO: 1200763 - RNA, 19 nt, Homo sapiens
ggaaguccuuucuuauagg

SEQ ID NO: 1200764 - RNA, 19 nt, Homo sapiens
gcacuacuguggcugaaaa

SEQ ID NO: 1200765 - RNA, 19 nt, Homo sapiens
guacaaagaaucaccaaac

SEQ ID NO: 1200766 - RNA, 19 nt, Homo sapiens
gaaguuguugcugcuguua

SEQ ID NO: 1200767 - RNA, 19 nt, Homo sapiens
gcaaaucacgcugccaaga

SEQ ID NO: 1200768 - RNA, 19 nt, Homo sapiens
gaaaauaaacucaguagag

SEQ ID NO: 1200769 - RNA, 19 nt, Homo sapiens
aguuagaucuggacaguga

SEQ ID NO: 1200770 - RNA, 19 nt, Homo sapiens
gaagcacggaucagauuau

SEQ ID NO: 1200771 - RNA, 19 nt, Homo sapiens
gaauacagauguuuucaag

SEQ ID NO: 1200772 - RNA, 19 nt, Homo sapiens
gaaaggacugucacugcaa

SEQ ID NO: 1200773 - RNA, 19 nt, Homo sapiens
uagcagaggcacauguuaa

SEQ ID NO: 1200774 - RNA, 19 nt, Homo sapiens
gagaggugauuagguuaug

SEQ ID NO: 1200775 - RNA, 19 nt, Homo sapiens
gagagaagcagggaccauu

SEQ ID NO: 1200776 - RNA, 19 nt, Homo sapiens
ugacaagaauuugcuaugg

SEQ ID NO: 1200777 - RNA, 19 nt, Homo sapiens
acaaacaggccguccauga

SEQ ID NO: 1200778 - RNA, 19 nt, Homo sapiens
ggagcugcuuccugaguug

SEQ ID NO: 1200779 - RNA, 19 nt, Homo sapiens
gaaaagggguuugagaaag

SEQ ID NO: 1200780 - RNA, 19 nt, Homo sapiens
gcuaauagggauugagaau

SEQ ID NO: 1200781 - RNA, 19 nt, Homo sapiens
uggcucaucuuaaggauuc

SEQ ID NO: 1200782 - RNA, 19 nt, Homo sapiens
ggagacacgagcaccauga

SEQ ID NO: 1200783 - RNA, 19 nt, Homo sapiens
gacugucacugcaagcaaa

SEQ ID NO: 1200784 - RNA, 19 nt, Homo sapiens
agacucacauuggaaacua

SEQ ID NO: 1200785 - RNA, 19 nt, Homo sapiens
ggaaccagagggcaaauca

SEQ ID NO: 1200786 - RNA, 19 nt, Homo sapiens
aaagaaaaguggcugauga

SEQ ID NO: 1200787 - RNA, 19 nt, Homo sapiens
uuccagaacuguaagaaau

SEQ ID NO: 1200788 - RNA, 19 nt, Homo sapiens
guggagcccugaugaaugg

SEQ ID NO: 1200789 - RNA, 19 nt, Homo sapiens
gaaacuccaccucugugaa

SEQ ID NO: 1200790 - RNA, 19 nt, Homo sapiens
ggaguauaguggugugauc

SEQ ID NO: 1200791 - RNA, 19 nt, Homo sapiens
guaagggagugaaaagaaa

SEQ ID NO: 1200792 - RNA, 19 nt, Homo sapiens
gauugagaauaacaugaga

SEQ ID NO: 1200793 - RNA, 19 nt, Homo sapiens
caagaugaauuuugccauu

SEQ ID NO: 1200794 - RNA, 19 nt, Homo sapiens
aaacaagucgugagugugu

SEQ ID NO: 1200795 - RNA, 19 nt, Homo sapiens
gaauauguugagaucagua

SEQ ID NO: 1200796 - RNA, 19 nt, Homo sapiens
guauaguggugugaucuug

SEQ ID NO: 1200797 - RNA, 19 nt, Homo sapiens
guuggcaccuugagacuuc

SEQ ID NO: 1200798 - RNA, 19 nt, Homo sapiens
ggagaggugauuagguuau

SEQ ID NO: 1200799 - RNA, 19 nt, Homo sapiens
uuggagaggugauuagguu

SEQ ID NO: 1200800 - RNA, 19 nt, Homo sapiens
uguaagauguggucacuac

SEQ ID NO: 1200801 - RNA, 19 nt, Homo sapiens
aaauggaauucaacaguca

SEQ ID NO: 1200802 - RNA, 19 nt, Homo sapiens
ggccauugcucagaacuuu

SEQ ID NO: 1200803 - RNA, 19 nt, Homo sapiens
gcagagugcugagccauca

SEQ ID NO: 1200804 - RNA, 19 nt, Homo sapiens
caaggugggcgaccagaua

SEQ ID NO: 1200805 - RNA, 19 nt, Homo sapiens
gcauccaugucuauaagaa

SEQ ID NO: 1200806 - RNA, 19 nt, Homo sapiens
caacaacgugguccucauu

SEQ ID NO: 1200807 - RNA, 19 nt, Homo sapiens
gcugagccaucacuguuug

SEQ ID NO: 1200808 - RNA, 19 nt, Homo sapiens
ugagugcgauucagaagau

SEQ ID NO: 1200809 - RNA, 19 nt, Homo sapiens
gaucccauggcuuucuuua

SEQ ID NO: 1200810 - RNA, 19 nt, Homo sapiens
guaguauccugugagagaa

SEQ ID NO: 1200811 - RNA, 19 nt, Homo sapiens
cgagagcggaucuaucuug

SEQ ID NO: 1200812 - RNA, 19 nt, Homo sapiens
ccaaggugcuggccauugc

SEQ ID NO: 1200813 - RNA, 19 nt, Homo sapiens
uguaguauccugugagaga

SEQ ID NO: 1200814 - RNA, 19 nt, Homo sapiens
acaacgugguccucauuga

SEQ ID NO: 1200815 - RNA, 19 nt, Homo sapiens
gaagaugacgcggguacga

SEQ ID NO: 1200816 - RNA, 19 nt, Homo sapiens
ggcgagagcggaucuaucu

SEQ ID NO: 1200817 - RNA, 19 nt, Homo sapiens
gaaccacccuuuugcuaag

SEQ ID NO: 1200818 - RNA, 19 nt, Homo sapiens
uugcaggacucgugaaugg

SEQ ID NO: 1200819 - RNA, 19 nt, Homo sapiens
gugcugagccaucacuguu

SEQ ID NO: 1200820 - RNA, 19 nt, Homo sapiens
ucccauggcuuucuuuacu

SEQ ID NO: 1200821 - RNA, 19 nt, Homo sapiens
gggaucccauggcuuucuu

SEQ ID NO: 1200822 - RNA, 19 nt, Homo sapiens
caucaagggacagaagaaa

SEQ ID NO: 1200823 - RNA, 19 nt, Homo sapiens
ccaacaacgugguccucau

SEQ ID NO: 1200824 - RNA, 19 nt, Homo sapiens
gcugcauccaugucuauaa

SEQ ID NO: 1200825 - RNA, 19 nt, Homo sapiens
cugcauccaugucuauaag

SEQ ID NO: 1200826 - RNA, 19 nt, Homo sapiens
gagaaccacccuuuugcua

SEQ ID NO: 1200827 - RNA, 19 nt, Homo sapiens
acucgugaauggagcaguu

SEQ ID NO: 1200828 - RNA, 19 nt, Homo sapiens
ggugggcgaccagauacua

SEQ ID NO: 1200829 - RNA, 19 nt, Homo sapiens
aguauccugugagagaaua

SEQ ID NO: 1200830 - RNA, 19 nt, Homo sapiens
ggguaacaguguaguaucc

SEQ ID NO: 1200831 - RNA, 19 nt, Homo sapiens
caagcgggaaggcgaguau

SEQ ID NO: 1200832 - RNA, 19 nt, Homo sapiens
auccaugucuauaagaaga

SEQ ID NO: 1200833 - RNA, 19 nt, Homo sapiens
cauggcugcucccuucaca

SEQ ID NO: 1200834 - RNA, 19 nt, Homo sapiens
gcaaggugggcgaccagau

SEQ ID NO: 1200835 - RNA, 19 nt, Homo sapiens
ccugugagagaauaaaugu

SEQ ID NO: 1200836 - RNA, 19 nt, Homo sapiens
aguguaguauccugugaga

SEQ ID NO: 1200837 - RNA, 19 nt, Homo sapiens
ggguacgagugguggacaa

SEQ ID NO: 1200838 - RNA, 19 nt, Homo sapiens
ccauugcucagaacuuugu

SEQ ID NO: 1200839 - RNA, 19 nt, Homo sapiens
gcaagcgggaaggcgagua

SEQ ID NO: 1200840 - RNA, 19 nt, Homo sapiens
acaaagagcugcauuaaua

SEQ ID NO: 1200841 - RNA, 19 nt, Homo sapiens
gcucuaaacuuacaaaugu

SEQ ID NO: 1200842 - RNA, 19 nt, Homo sapiens
gaucugacuuuccaacuaa

SEQ ID NO: 1200843 - RNA, 19 nt, Homo sapiens
gcacaucacuaaagucaau

SEQ ID NO: 1200844 - RNA, 19 nt, Homo sapiens
guagcuugcucuaaacuua

SEQ ID NO: 1200845 - RNA, 19 nt, Homo sapiens
guaaucaggugguacguuu

SEQ ID NO: 1200846 - RNA, 19 nt, Homo sapiens
ccacauuaguuaugcuuua

SEQ ID NO: 1200847 - RNA, 19 nt, Homo sapiens
ucaggacacucuucuauaa

SEQ ID NO: 1200848 - RNA, 19 nt, Homo sapiens
ggacacucuucuauaauaa

SEQ ID NO: 1200849 - RNA, 19 nt, Homo sapiens
acagaucaauguacacuua

SEQ ID NO: 1200850 - RNA, 19 nt, Homo sapiens
gugcacaccuugaauuuga

SEQ ID NO: 1200851 - RNA, 19 nt, Homo sapiens
guagaugaguggcuggaua

SEQ ID NO: 1200852 - RNA, 19 nt, Homo sapiens
ucacuaaagucaaucaguu

SEQ ID NO: 1200853 - RNA, 19 nt, Homo sapiens
caauacagcuauccaagga

SEQ ID NO: 1200854 - RNA, 19 nt, Homo sapiens
ggagggaguuccaauaucu

SEQ ID NO: 1200855 - RNA, 19 nt, Homo sapiens
guccaaaugcucacuauua

SEQ ID NO: 1200856 - RNA, 19 nt, Homo sapiens
uaacgcauuuggcagauuu

SEQ ID NO: 1200857 - RNA, 19 nt, Homo sapiens
gagagggugguaucaauua

SEQ ID NO: 1200858 - RNA, 19 nt, Homo sapiens
ugaaauaagugcacaccuu

SEQ ID NO: 1200859 - RNA, 19 nt, Homo sapiens
cuaaaucaguggcucuuaa

SEQ ID NO: 1200860 - RNA, 19 nt, Homo sapiens
gcugaaagguguguaguga

SEQ ID NO: 1200861 - RNA, 19 nt, Homo sapiens
gcucuugcaugcuaaggua

SEQ ID NO: 1200862 - RNA, 19 nt, Homo sapiens
auacauagcaugccacuaa

SEQ ID NO: 1200863 - RNA, 19 nt, Homo sapiens
gguaagaguugcccuccaa

SEQ ID NO: 1200864 - RNA, 19 nt, Homo sapiens
caagcugacugaaauaagu

SEQ ID NO: 1200865 - RNA, 19 nt, Homo sapiens
ggacaagcugacugaaaua

SEQ ID NO: 1200866 - RNA, 19 nt, Homo sapiens
ucaaucagcgucaguauga

SEQ ID NO: 1200867 - RNA, 19 nt, Homo sapiens
aggacacucuucuauaaua

SEQ ID NO: 1200868 - RNA, 19 nt, Homo sapiens
gcauguaccggcucucuaa

SEQ ID NO: 1200869 - RNA, 19 nt, Homo sapiens
guacaacgaguuauucaga

SEQ ID NO: 1200870 - RNA, 19 nt, Homo sapiens
cauccucaaugcaucauaa

SEQ ID NO: 1200871 - RNA, 19 nt, Homo sapiens
caaggcacaucacuaaagu

SEQ ID NO: 1200872 - RNA, 19 nt, Homo sapiens
agaccaggaugcaggauuu

SEQ ID NO: 1200873 - RNA, 19 nt, Homo sapiens
gcuuuaugcugcuuaauca

SEQ ID NO: 1200874 - RNA, 19 nt, Homo sapiens
caaaugcucacuauuagga

SEQ ID NO: 1200875 - RNA, 19 nt, Homo sapiens
acacuuaccucuccagaag

SEQ ID NO: 1200876 - RNA, 19 nt, Homo sapiens
caugaugacuucccuaugg

SEQ ID NO: 1200877 - RNA, 19 nt, Homo sapiens
gcucauagcagcugaugug

SEQ ID NO: 1200878 - RNA, 19 nt, Homo sapiens
caucauaaaugccauagac

SEQ ID NO: 1200879 - RNA, 19 nt, Homo sapiens
cugaugaccucccugguaa

SEQ ID NO: 1200880 - RNA, 19 nt, Homo sapiens
uccaauaucugaaucuuuc

SEQ ID NO: 1200881 - RNA, 19 nt, Homo sapiens
aaucugcucuugcaugcua

SEQ ID NO: 1200882 - RNA, 19 nt, Homo sapiens
cacccuggcugcuaugaaa

SEQ ID NO: 1200883 - RNA, 19 nt, Homo sapiens
cgucauggaagaucauaua

SEQ ID NO: 1200884 - RNA, 19 nt, Homo sapiens
ugaucugacuuuccaacua

SEQ ID NO: 1200885 - RNA, 19 nt, Homo sapiens
accacuaucuacacauuua

SEQ ID NO: 1200886 - RNA, 19 nt, Homo sapiens
uuaaacagaccacuaucua

SEQ ID NO: 1200887 - RNA, 19 nt, Homo sapiens
uacuaccacuucacaauuu

SEQ ID NO: 1200888 - RNA, 19 nt, Homo sapiens
acacaaagagcugcauuaa

SEQ ID NO: 1200889 - RNA, 19 nt, Homo sapiens
guaugaggcugaaagaaac

SEQ ID NO: 1200890 - RNA, 19 nt, Homo sapiens
aggaauaaauguacaacga

SEQ ID NO: 1200891 - RNA, 19 nt, Homo sapiens
gcagggaugucugaaguac

SEQ ID NO: 1200892 - RNA, 19 nt, Homo sapiens
agaccacuaucuacacauu

SEQ ID NO: 1200893 - RNA, 19 nt, Homo sapiens
uaaaucaguggcucuuaaa

SEQ ID NO: 1200894 - RNA, 19 nt, Homo sapiens
ucugacagcuccaggucua

SEQ ID NO: 1200895 - RNA, 19 nt, Homo sapiens
caccuugaauuugaacuuu

SEQ ID NO: 1200896 - RNA, 19 nt, Homo sapiens
uaagugcacaccuugaauu

SEQ ID NO: 1200897 - RNA, 19 nt, Homo sapiens
aggacaagcugacugaaau

SEQ ID NO: 1200898 - RNA, 19 nt, Homo sapiens
aaacagaccacuaucuaca

SEQ ID NO: 1200899 - RNA, 19 nt, Homo sapiens
gacaagcugacugaaauaa

SEQ ID NO: 1200900 - RNA, 19 nt, Homo sapiens
agaauacccagaaagagua

SEQ ID NO: 1200901 - RNA, 19 nt, Homo sapiens
uuucagaccucgucaugga

SEQ ID NO: 1200902 - RNA, 19 nt, Homo sapiens
gggcagcuucugugaguuu

SEQ ID NO: 1200903 - RNA, 19 nt, Homo sapiens
ggauuucuggagcuuguua

SEQ ID NO: 1200904 - RNA, 19 nt, Homo sapiens
ggcaugaucugacuuucca

SEQ ID NO: 1200905 - RNA, 19 nt, Homo sapiens
agagaauucuuuggcauga

SEQ ID NO: 1200906 - RNA, 19 nt, Homo sapiens
auugguagcuugcucuaaa

SEQ ID NO: 1200907 - RNA, 19 nt, Homo sapiens
agacaugcgauaugaguuu

SEQ ID NO: 1200908 - RNA, 19 nt, Homo sapiens
cagggcagcuucugugagu

SEQ ID NO: 1200909 - RNA, 19 nt, Homo sapiens
ggucuauccuggaagaagu

SEQ ID NO: 1200910 - RNA, 19 nt, Homo sapiens
gaacuuucaaggcacauca

SEQ ID NO: 1200911 - RNA, 19 nt, Homo sapiens
agagggugguaucaauuaa

SEQ ID NO: 1200912 - RNA, 19 nt, Homo sapiens
ugaaagguguguagugacu

SEQ ID NO: 1200913 - RNA, 19 nt, Homo sapiens
cacuaaagucaaucaguua

SEQ ID NO: 1200914 - RNA, 19 nt, Homo sapiens
uuucaaggcacaucacuaa

SEQ ID NO: 1200915 - RNA, 19 nt, Homo sapiens
ggugguaucaauuaacuau

SEQ ID NO: 1200916 - RNA, 19 nt, Homo sapiens
ggugagugcucuaaguuuu

SEQ ID NO: 1200917 - RNA, 19 nt, Homo sapiens
caaagacgaacaugagaca

SEQ ID NO: 1200918 - RNA, 19 nt, Homo sapiens
uggagagccuguuggagaa

SEQ ID NO: 1200919 - RNA, 19 nt, Homo sapiens
ccaccuacagucuuuggua

SEQ ID NO: 1200920 - RNA, 19 nt, Homo sapiens
cagaauacccagaaagagu

SEQ ID NO: 1200921 - RNA, 19 nt, Homo sapiens
uccaaaugcucacuauuag

SEQ ID NO: 1200922 - RNA, 19 nt, Homo sapiens
guuuacaugcucauuagua

SEQ ID NO: 1200923 - RNA, 19 nt, Homo sapiens
aaagccauacuugcaauua

SEQ ID NO: 1200924 - RNA, 19 nt, Homo sapiens
gccauagacaccauuacua

SEQ ID NO: 1200925 - RNA, 19 nt, Homo sapiens
uaggacagaucaauguaca

SEQ ID NO: 1200926 - RNA, 19 nt, Homo sapiens
gcauuaauacuacauuguc

SEQ ID NO: 1200927 - RNA, 19 nt, Homo sapiens
gcgccacccucucuugcuu

SEQ ID NO: 1200928 - RNA, 19 nt, Homo sapiens
acuaccacuucacaauuua

SEQ ID NO: 1200929 - RNA, 19 nt, Homo sapiens
ccucaaugcaucauaaaug

SEQ ID NO: 1200930 - RNA, 19 nt, Homo sapiens
augaguggcuggauagcua

SEQ ID NO: 1200931 - RNA, 19 nt, Homo sapiens
aguaugaggcugaaagaaa

SEQ ID NO: 1200932 - RNA, 19 nt, Homo sapiens
ggaguuccaauaucugaau

SEQ ID NO: 1200933 - RNA, 19 nt, Homo sapiens
uacaacgaguuauucagaa

SEQ ID NO: 1200934 - RNA, 19 nt, Homo sapiens
gacaaagacgaacaugaga

SEQ ID NO: 1200935 - RNA, 19 nt, Homo sapiens
agacaaagacgaacaugag

SEQ ID NO: 1200936 - RNA, 19 nt, Homo sapiens
ugaccucccugguaagagu

SEQ ID NO: 1200937 - RNA, 19 nt, Homo sapiens
guuccgccaugccgaugua

SEQ ID NO: 1200938 - RNA, 19 nt, Homo sapiens
gucaggacacucuucuaua

SEQ ID NO: 1200939 - RNA, 19 nt, Homo sapiens
uaaaugccauagacaccau

SEQ ID NO: 1200940 - RNA, 19 nt, Homo sapiens
ucacacaucuuacugauua

SEQ ID NO: 1200941 - RNA, 19 nt, Homo sapiens
ggaauggaauguacuguuu

SEQ ID NO: 1200942 - RNA, 19 nt, Homo sapiens
ccaagaaacuucaauaugu

SEQ ID NO: 1200943 - RNA, 19 nt, Homo sapiens
gcagagugaugaaugauuu

SEQ ID NO: 1200944 - RNA, 19 nt, Homo sapiens
gcccaacacuuucagauaa

SEQ ID NO: 1200945 - RNA, 19 nt, Homo sapiens
caacucgguucauuugaua

SEQ ID NO: 1200946 - RNA, 19 nt, Homo sapiens
guagugccauuaagauaua

SEQ ID NO: 1200947 - RNA, 19 nt, Homo sapiens
gaagauuuccaguagguua

SEQ ID NO: 1200948 - RNA, 19 nt, Homo sapiens
ggucaaaucuaaaugaucu

SEQ ID NO: 1200949 - RNA, 19 nt, Homo sapiens
gagaaaagccucaacauuu

SEQ ID NO: 1200950 - RNA, 19 nt, Homo sapiens
cccaauaagugaaaucuuu

SEQ ID NO: 1200951 - RNA, 19 nt, Homo sapiens
ggacaaacuggaagaugua

SEQ ID NO: 1200952 - RNA, 19 nt, Homo sapiens
gauggagucuugcucuauu

SEQ ID NO: 1200953 - RNA, 19 nt, Homo sapiens
caaccaagaaacuucaaua

SEQ ID NO: 1200954 - RNA, 19 nt, Homo sapiens
ccauuaagauauacuccua

SEQ ID NO: 1200955 - RNA, 19 nt, Homo sapiens
caaaggagauaacagaaaa

SEQ ID NO: 1200956 - RNA, 19 nt, Homo sapiens
ggugacagcugcaguacau

SEQ ID NO: 1200957 - RNA, 19 nt, Homo sapiens
gagauggagucuugcucua

SEQ ID NO: 1200958 - RNA, 19 nt, Homo sapiens
aaacaaggaguacugauga

SEQ ID NO: 1200959 - RNA, 19 nt, Homo sapiens
cauaaugaacggcgaaauu

SEQ ID NO: 1200960 - RNA, 19 nt, Homo sapiens
ucuuaaagcugcagagaau

SEQ ID NO: 1200961 - RNA, 19 nt, Homo sapiens
gguuauggguaaucaguga

SEQ ID NO: 1200962 - RNA, 19 nt, Homo sapiens
gcacucagaaugcaagguu

SEQ ID NO: 1200963 - RNA, 19 nt, Homo sapiens
caauaaaacuguccugguu

SEQ ID NO: 1200964 - RNA, 19 nt, Homo sapiens
uccaguagguuauggguaa

SEQ ID NO: 1200965 - RNA, 19 nt, Homo sapiens
aguuaagacugcagaagua

SEQ ID NO: 1200966 - RNA, 19 nt, Homo sapiens
caacagcaauaaaagauga

SEQ ID NO: 1200967 - RNA, 19 nt, Homo sapiens
ugaagaaguugacccuauc

SEQ ID NO: 1200968 - RNA, 19 nt, Homo sapiens
uuugaaagccuuauucuga

SEQ ID NO: 1200969 - RNA, 19 nt, Homo sapiens
ugucuuugguggucaagua

SEQ ID NO: 1200970 - RNA, 19 nt, Homo sapiens
ggcaugaauuuaacagugu

SEQ ID NO: 1200971 - RNA, 19 nt, Homo sapiens
ccaacucgguucauuugau

SEQ ID NO: 1200972 - RNA, 19 nt, Homo sapiens
aaacuggaauggaauguac

SEQ ID NO: 1200973 - RNA, 19 nt, Homo sapiens
ucaaaggagauaacagaaa

SEQ ID NO: 1200974 - RNA, 19 nt, Homo sapiens
cugaagaaguugacccuau

SEQ ID NO: 1200975 - RNA, 19 nt, Homo sapiens
ucacaagugucuccauuuu

SEQ ID NO: 1200976 - RNA, 19 nt, Homo sapiens
ugaaugcuuucuugcucua

SEQ ID NO: 1200977 - RNA, 19 nt, Homo sapiens
gaacggcgaaauugguguu

SEQ ID NO: 1200978 - RNA, 19 nt, Homo sapiens
uggacaaacuggaagaugu

SEQ ID NO: 1200979 - RNA, 19 nt, Homo sapiens
gacccuaucuucugcaaaa

SEQ ID NO: 1200980 - RNA, 19 nt, Homo sapiens
uugaaagccuuauucugaa

SEQ ID NO: 1200981 - RNA, 19 nt, Homo sapiens
aaacagcacacccacaguu

SEQ ID NO: 1200982 - RNA, 19 nt, Homo sapiens
gaaguauucccaccagagu

SEQ ID NO: 1200983 - RNA, 19 nt, Homo sapiens
ccucaaaggagauaacaga

SEQ ID NO: 1200984 - RNA, 19 nt, Homo sapiens
guccacaaguucagcagaa

SEQ ID NO: 1200985 - RNA, 19 nt, Homo sapiens
ggcugaagauuuccaguag

SEQ ID NO: 1200986 - RNA, 19 nt, Homo sapiens
ccaccagaguuguuuccaa

SEQ ID NO: 1200987 - RNA, 19 nt, Homo sapiens
ccuaaaaccugacaccauu

SEQ ID NO: 1200988 - RNA, 19 nt, Homo sapiens
caauccaggcauccaguua

SEQ ID NO: 1200989 - RNA, 19 nt, Homo sapiens
acacccgucugcuuccuaa

SEQ ID NO: 1200990 - RNA, 19 nt, Homo sapiens
cugcagaaguagaugaaga

SEQ ID NO: 1200991 - RNA, 19 nt, Homo sapiens
guagaaggcucacgaaaac

SEQ ID NO: 1200992 - RNA, 19 nt, Homo sapiens
ccaguuuucuucaaucuuu

SEQ ID NO: 1200993 - RNA, 19 nt, Homo sapiens
caacuuuucacacaucuua

SEQ ID NO: 1200994 - RNA, 19 nt, Homo sapiens
aaacuguccugguuaugca

SEQ ID NO: 1200995 - RNA, 19 nt, Homo sapiens
ccaauaagugaaaucuuug

SEQ ID NO: 1200996 - RNA, 19 nt, Homo sapiens
ccuauacaauuuccuccaa

SEQ ID NO: 1200997 - RNA, 19 nt, Homo sapiens
caguacaucuugaauacca

SEQ ID NO: 1200998 - RNA, 19 nt, Homo sapiens
caagacgaacucuaacuca

SEQ ID NO: 1200999 - RNA, 19 nt, Homo sapiens
gaaucgggcuuugcagaac

SEQ ID NO: 1201000 - RNA, 19 nt, Homo sapiens
cagcugcaguacaucuuga

SEQ ID NO: 1201001 - RNA, 19 nt, Homo sapiens
caaacuggaauggaaugua

SEQ ID NO: 1201002 - RNA, 19 nt, Homo sapiens
uuauaggccuugcugugaa

SEQ ID NO: 1201003 - RNA, 19 nt, Homo sapiens
gaguuaagacugcagaagu

SEQ ID NO: 1201004 - RNA, 19 nt, Homo sapiens
guggcucagucucggcuua

SEQ ID NO: 1201005 - RNA, 19 nt, Homo sapiens
uuucacaagugucuccauu

SEQ ID NO: 1201006 - RNA, 19 nt, Homo sapiens
gaauggaauguacuguuuc

SEQ ID NO: 1201007 - RNA, 19 nt, Homo sapiens
uuucacggcuuggaagauu

SEQ ID NO: 1201008 - RNA, 19 nt, Homo sapiens
gcagaaguagaugaagaaa

SEQ ID NO: 1201009 - RNA, 19 nt, Homo sapiens
ugcaguacaucuugaauac

SEQ ID NO: 1201010 - RNA, 19 nt, Homo sapiens
gguggugacagcugcagua

SEQ ID NO: 1201011 - RNA, 19 nt, Homo sapiens
gaauguacuguuucucaca

SEQ ID NO: 1201012 - RNA, 19 nt, Homo sapiens
gccuugcugugaaugcuuu

SEQ ID NO: 1201013 - RNA, 19 nt, Homo sapiens
ugucacugcccaacacuuu

SEQ ID NO: 1201014 - RNA, 19 nt, Homo sapiens
gaauaccaguuuucuucaa

SEQ ID NO: 1201015 - RNA, 19 nt, Homo sapiens
auaaugaacggcgaaauug

SEQ ID NO: 1201016 - RNA, 19 nt, Homo sapiens
gaagaaguugacccuaucu

SEQ ID NO: 1201017 - RNA, 19 nt, Homo sapiens
aaugcaagguuucacaagu

SEQ ID NO: 1201018 - RNA, 19 nt, Homo sapiens
caaguagaaggcucacgaa

SEQ ID NO: 1201019 - RNA, 19 nt, Homo sapiens
uauaggccuugcugugaau

SEQ ID NO: 1201020 - RNA, 19 nt, Homo sapiens
aaaagccucuucuuacaga

SEQ ID NO: 1201021 - RNA, 19 nt, Homo sapiens
ucauuguucuuccaaccuu

SEQ ID NO: 1201022 - RNA, 19 nt, Homo sapiens
aaggaguacugaugaugga

SEQ ID NO: 1201023 - RNA, 19 nt, Homo sapiens
agggcaaacuggaauggaa

SEQ ID NO: 1201024 - RNA, 19 nt, Homo sapiens
uaagacugcagaaguagau

SEQ ID NO: 1201025 - RNA, 19 nt, Homo sapiens
cugcaguacaucuugaaua

SEQ ID NO: 1201026 - RNA, 19 nt, Homo sapiens
cugaagauuuccaguaggu

SEQ ID NO: 1201027 - RNA, 19 nt, Homo sapiens
gacaaacuggaagauguaa

SEQ ID NO: 1201028 - RNA, 19 nt, Homo sapiens
agacgaacucuaacucaug

SEQ ID NO: 1201029 - RNA, 19 nt, Homo sapiens
aaaccugacaccauuuaau

SEQ ID NO: 1201030 - RNA, 19 nt, Homo sapiens
gcaauuaaaagggcuguuu

SEQ ID NO: 1201031 - RNA, 19 nt, Homo sapiens
caaacuggaagauguaaaa

SEQ ID NO: 1201032 - RNA, 19 nt, Homo sapiens
uaacucaugggauggacaa

SEQ ID NO: 1201033 - RNA, 19 nt, Homo sapiens
gaaugcaagguuucacaag

SEQ ID NO: 1201034 - RNA, 19 nt, Homo sapiens
ugcucuaucugaaguauuc

SEQ ID NO: 1201035 - RNA, 19 nt, Homo sapiens
ggauggacaaacuggaaga

SEQ ID NO: 1201036 - RNA, 19 nt, Homo sapiens
aagacgaacucuaacucau

SEQ ID NO: 1201037 - RNA, 19 nt, Homo sapiens
uaacagaaaacauggaaug

SEQ ID NO: 1201038 - RNA, 19 nt, Homo sapiens
cuugcagagugaugaauga

SEQ ID NO: 1201039 - RNA, 19 nt, Homo sapiens
ccuaucuucugcaaaauaa

SEQ ID NO: 1201040 - RNA, 19 nt, Homo sapiens
ggucuucaaucaagguuua

SEQ ID NO: 1201041 - RNA, 19 nt, Homo sapiens
cagaagggauucggaagua

SEQ ID NO: 1201042 - RNA, 19 nt, Homo sapiens
gggaccaccucuauaguga

SEQ ID NO: 1201043 - RNA, 19 nt, Homo sapiens
ccagaugaguggcuucuau

SEQ ID NO: 1201044 - RNA, 19 nt, Homo sapiens
aagcacaucucuacaagga

SEQ ID NO: 1201045 - RNA, 19 nt, Homo sapiens
guacacacacccugaaaga

SEQ ID NO: 1201046 - RNA, 19 nt, Homo sapiens
gcugagggcaccuuuauug

SEQ ID NO: 1201047 - RNA, 19 nt, Homo sapiens
gcucuucgauguggucauu

SEQ ID NO: 1201048 - RNA, 19 nt, Homo sapiens
ccuacggccucaauccuua

SEQ ID NO: 1201049 - RNA, 19 nt, Homo sapiens
gagggcaccuuuauugucu

SEQ ID NO: 1201050 - RNA, 19 nt, Homo sapiens
ccaaggcccuguucaaugc

SEQ ID NO: 1201051 - RNA, 19 nt, Homo sapiens
ucagcugccugcucaacua

SEQ ID NO: 1201052 - RNA, 19 nt, Homo sapiens
gcgcuucucugaccucuac

SEQ ID NO: 1201053 - RNA, 19 nt, Homo sapiens
ucagaaaacucgaugagaa

SEQ ID NO: 1201054 - RNA, 19 nt, Homo sapiens
uggaaagccugucgacguu

SEQ ID NO: 1201055 - RNA, 19 nt, Homo sapiens
ccaagcacaucucuacaag

SEQ ID NO: 1201056 - RNA, 19 nt, Homo sapiens
gaagggauucggaaguaug

SEQ ID NO: 1201057 - RNA, 19 nt, Homo sapiens
gccacagccuggaguuuga

SEQ ID NO: 1201058 - RNA, 19 nt, Homo sapiens
gcacuacaaguacccagaa

SEQ ID NO: 1201059 - RNA, 19 nt, Homo sapiens
gaacccagcagccaucuac

SEQ ID NO: 1201060 - RNA, 19 nt, Homo sapiens
cacuguaggucuucaauca

SEQ ID NO: 1201061 - RNA, 19 nt, Homo sapiens
gaugcucgcucccguuucu

SEQ ID NO: 1201062 - RNA, 19 nt, Homo sapiens
gaccaccucuauagugauc

SEQ ID NO: 1201063 - RNA, 19 nt, Homo sapiens
ggagaaguacauccugaga

SEQ ID NO: 1201064 - RNA, 19 nt, Homo sapiens
ggaggugauugagcuguau

SEQ ID NO: 1201065 - RNA, 19 nt, Homo sapiens
ugaucgagcacuacaagua

SEQ ID NO: 1201066 - RNA, 19 nt, Homo sapiens
ggaaagaggaauuuuguug

SEQ ID NO: 1201067 - RNA, 19 nt, Homo sapiens
agcaggacauggagaagua

SEQ ID NO: 1201068 - RNA, 19 nt, Homo sapiens
ugaagggccucauguacca

SEQ ID NO: 1201069 - RNA, 19 nt, Homo sapiens
uggaggagguucacuugug

SEQ ID NO: 1201070 - RNA, 19 nt, Homo sapiens
caaguacccagaagggauu

SEQ ID NO: 1201071 - RNA, 19 nt, Homo sapiens
uuaguggaguuucgaaugu

SEQ ID NO: 1201072 - RNA, 19 nt, Homo sapiens
gcgcaggaaagaggaauuu

SEQ ID NO: 1201073 - RNA, 19 nt, Homo sapiens
gagcgguucugcgcaggaa

SEQ ID NO: 1201074 - RNA, 19 nt, Homo sapiens
gcaguucggcagcaucuuc

SEQ ID NO: 1201075 - RNA, 19 nt, Homo sapiens
gcguggacuucaccuucua

SEQ ID NO: 1201076 - RNA, 19 nt, Homo sapiens
cgugagauccgcaucauca

SEQ ID NO: 1201077 - RNA, 19 nt, Homo sapiens
gagauccgcaucaucaaca

SEQ ID NO: 1201078 - RNA, 19 nt, Homo sapiens
cccagcacaucccacuaua

SEQ ID NO: 1201079 - RNA, 19 nt, Homo sapiens
acacacacccugaaagaca

SEQ ID NO: 1201080 - RNA, 19 nt, Homo sapiens
ggcaggagcugaggugcau

SEQ ID NO: 1201081 - RNA, 19 nt, Homo sapiens
ggcgccagcucuucgaugu

SEQ ID NO: 1201082 - RNA, 19 nt, Homo sapiens
ggaucgagcaggacaugga

SEQ ID NO: 1201083 - RNA, 19 nt, Homo sapiens
uaguggaguuucgaaugua

SEQ ID NO: 1201084 - RNA, 19 nt, Homo sapiens
ccacccagacaagcaauaa

SEQ ID NO: 1201085 - RNA, 19 nt, Homo sapiens
gaucgagcacuacaaguac

SEQ ID NO: 1201086 - RNA, 19 nt, Homo sapiens
ccaacaguccuuucagcuu

SEQ ID NO: 1201087 - RNA, 19 nt, Homo sapiens
ugaccaagcacaucucuac

SEQ ID NO: 1201088 - RNA, 19 nt, Homo sapiens
cagacgaggaggugauuga

SEQ ID NO: 1201089 - RNA, 19 nt, Homo sapiens
gauugacgccuuccacuac

SEQ ID NO: 1201090 - RNA, 19 nt, Homo sapiens
acuaugacauucagaagag

SEQ ID NO: 1201091 - RNA, 19 nt, Homo sapiens
ggauucggaaguaugacua

SEQ ID NO: 1201092 - RNA, 19 nt, Homo sapiens
gagaggggaugagacguuu

SEQ ID NO: 1201093 - RNA, 19 nt, Homo sapiens
ggacauggagaaguacauc

SEQ ID NO: 1201094 - RNA, 19 nt, Homo sapiens
ggucuacggcuuugacuac

SEQ ID NO: 1201095 - RNA, 19 nt, Homo sapiens
ggucugcagucuccugaac

SEQ ID NO: 1201096 - RNA, 19 nt, Homo sapiens
ucaccaaggcccuguucaa

SEQ ID NO: 1201097 - RNA, 19 nt, Homo sapiens
ggccacagccuggaguuug

SEQ ID NO: 1201098 - RNA, 19 nt, Homo sapiens
gaaaagggcaagaucuauc

SEQ ID NO: 1201099 - RNA, 19 nt, Homo sapiens
cauggugggucccgauugg

SEQ ID NO: 1201100 - RNA, 19 nt, Homo sapiens
acacggagcaguacaugca

SEQ ID NO: 1201101 - RNA, 19 nt, Homo sapiens
caacacggagcaguacaug

SEQ ID NO: 1201102 - RNA, 19 nt, Homo sapiens
gcaguucauggacaucuuc

SEQ ID NO: 1201103 - RNA, 19 nt, Homo sapiens
uuaagcaguucauggacau

SEQ ID NO: 1201104 - RNA, 19 nt, Homo sapiens
gaucagccugcgugacguu

SEQ ID NO: 1201105 - RNA, 19 nt, Homo sapiens
ccgcugagggcaccuuuau

SEQ ID NO: 1201106 - RNA, 19 nt, Homo sapiens
gagcgugagauccgcauca

SEQ ID NO: 1201107 - RNA, 19 nt, Homo sapiens
aggaggugauugagcugua

SEQ ID NO: 1201108 - RNA, 19 nt, Homo sapiens
agaagggauucggaaguau

SEQ ID NO: 1201109 - RNA, 19 nt, Homo sapiens
guugaggucuacggcuuug

SEQ ID NO: 1201110 - RNA, 19 nt, Homo sapiens
ggacugccacacuguaggu

SEQ ID NO: 1201111 - RNA, 19 nt, Homo sapiens
gcagccaucuacgccaaca

SEQ ID NO: 1201112 - RNA, 19 nt, Homo sapiens
caacuaccgcguggacuuc

SEQ ID NO: 1201113 - RNA, 19 nt, Homo sapiens
cggaucacccgcuuggaaa

SEQ ID NO: 1201114 - RNA, 19 nt, Homo sapiens
guucacuuguggccagguu

SEQ ID NO: 1201115 - RNA, 19 nt, Homo sapiens
gagcaggacauggagaagu

SEQ ID NO: 1201116 - RNA, 19 nt, Homo sapiens
caccaaggcccuguucaau

SEQ ID NO: 1201117 - RNA, 19 nt, Homo sapiens
ggaguuugaccaagcacau

SEQ ID NO: 1201118 - RNA, 19 nt, Homo sapiens
ccagaagggauucggaagu

SEQ ID NO: 1201119 - RNA, 19 nt, Homo sapiens
aaagaggaauuuuguugga

SEQ ID NO: 1201120 - RNA, 19 nt, Homo sapiens
gcaggaaagaggaauuuug

SEQ ID NO: 1201121 - RNA, 19 nt, Homo sapiens
ucaacuaccgcguggacuu

SEQ ID NO: 1201122 - RNA, 19 nt, Homo sapiens
ucaucaacacggagcagua

SEQ ID NO: 1201123 - RNA, 19 nt, Homo sapiens
ccugguggcccaugggaaa

SEQ ID NO: 1201124 - RNA, 19 nt, Homo sapiens
ccugugugguggacuacuu

SEQ ID NO: 1201125 - RNA, 19 nt, Homo sapiens
ccaccucuauagugaucug

SEQ ID NO: 1201126 - RNA, 19 nt, Homo sapiens
ccggaucacccgcuuggaa

SEQ ID NO: 1201127 - RNA, 19 nt, Homo sapiens
uccgagacgugcaugugaa

SEQ ID NO: 1201128 - RNA, 19 nt, Homo sapiens
gucccuccauuaagcaguu

SEQ ID NO: 1201129 - RNA, 19 nt, Homo sapiens
cagaugaguggcuucuaug

SEQ ID NO: 1201130 - RNA, 19 nt, Homo sapiens
ggaaaagggcaagaucuau

SEQ ID NO: 1201131 - RNA, 19 nt, Homo sapiens
cuguaggucuucaaucaag

SEQ ID NO: 1201132 - RNA, 19 nt, Homo sapiens
cauggacugccacacugua

SEQ ID NO: 1201133 - RNA, 19 nt, Homo sapiens
uggcucugcuguccugugu

SEQ ID NO: 1201134 - RNA, 19 nt, Homo sapiens
agauugacgccuuccacua

SEQ ID NO: 1201135 - RNA, 19 nt, Homo sapiens
guacaguugugguuaguua

SEQ ID NO: 1201136 - RNA, 19 nt, Homo sapiens
guagugggauugaaaguaa

SEQ ID NO: 1201137 - RNA, 19 nt, Homo sapiens
gaaagaagagauugcaauu

SEQ ID NO: 1201138 - RNA, 19 nt, Homo sapiens
ccaaguagcugugacuaaa

SEQ ID NO: 1201139 - RNA, 19 nt, Homo sapiens
cagaacaaauuaugcaaga

SEQ ID NO: 1201140 - RNA, 19 nt, Homo sapiens
gauggagucucgcuuuguu

SEQ ID NO: 1201141 - RNA, 19 nt, Homo sapiens
ggaauacuucugugcauuu

SEQ ID NO: 1201142 - RNA, 19 nt, Homo sapiens
aaacaagcuucagaaagua

SEQ ID NO: 1201143 - RNA, 19 nt, Homo sapiens
cuagugugcucauggauaa

SEQ ID NO: 1201144 - RNA, 19 nt, Homo sapiens
ucucaacucuuauuuggaa

SEQ ID NO: 1201145 - RNA, 19 nt, Homo sapiens
gaagauugauuuggacagu

SEQ ID NO: 1201146 - RNA, 19 nt, Homo sapiens
cuggcaaucucaacucuua

SEQ ID NO: 1201147 - RNA, 19 nt, Homo sapiens
gaauacuucugugcauuug

SEQ ID NO: 1201148 - RNA, 19 nt, Homo sapiens
cagaggauccugcccuuaa

SEQ ID NO: 1201149 - RNA, 19 nt, Homo sapiens
gcaaaucgaagcuaaaauu

SEQ ID NO: 1201150 - RNA, 19 nt, Homo sapiens
gaaaagaacaaacagaaga

SEQ ID NO: 1201151 - RNA, 19 nt, Homo sapiens
aagcauauccauaacguuu

SEQ ID NO: 1201152 - RNA, 19 nt, Homo sapiens
gcaaucucaacucuuauuu

SEQ ID NO: 1201153 - RNA, 19 nt, Homo sapiens
ggaaauuguucugcagcuu

SEQ ID NO: 1201154 - RNA, 19 nt, Homo sapiens
gaagugcuaggauuacaga

SEQ ID NO: 1201155 - RNA, 19 nt, Homo sapiens
caccgagccuggucuaguu

SEQ ID NO: 1201156 - RNA, 19 nt, Homo sapiens
gcauauccauaacguuuac

SEQ ID NO: 1201157 - RNA, 19 nt, Homo sapiens
aaaacaagcuucagaaagu

SEQ ID NO: 1201158 - RNA, 19 nt, Homo sapiens
cuaccgaagugcuaggauu

SEQ ID NO: 1201159 - RNA, 19 nt, Homo sapiens
guaguacaguugugguuag

SEQ ID NO: 1201160 - RNA, 19 nt, Homo sapiens
ucagagaggauaaagauca

SEQ ID NO: 1201161 - RNA, 19 nt, Homo sapiens
aacagaagauugauuugga

SEQ ID NO: 1201162 - RNA, 19 nt, Homo sapiens
uccauaacguuuacaguug

SEQ ID NO: 1201163 - RNA, 19 nt, Homo sapiens
gaacaaacagaagauugau

SEQ ID NO: 1201164 - RNA, 19 nt, Homo sapiens
gacaaaacaacaacucuua

SEQ ID NO: 1201165 - RNA, 19 nt, Homo sapiens
aaucucaacucuuauuugg

SEQ ID NO: 1201166 - RNA, 19 nt, Homo sapiens
aaucacagcaggaaucuug

SEQ ID NO: 1201167 - RNA, 19 nt, Homo sapiens
ccauaacguuuacaguugu

SEQ ID NO: 1201168 - RNA, 19 nt, Homo sapiens
agaacaaacagaagauuga

SEQ ID NO: 1201169 - RNA, 19 nt, Homo sapiens
gaaacaccuauuagagcua

SEQ ID NO: 1201170 - RNA, 19 nt, Homo sapiens
uaccgaagugcuaggauua

SEQ ID NO: 1201171 - RNA, 19 nt, Homo sapiens
caguugugguuaguuauuu

SEQ ID NO: 1201172 - RNA, 19 nt, Homo sapiens
aaauuguucugcagcuuga

SEQ ID NO: 1201173 - RNA, 19 nt, Homo sapiens
uugaagaccuggaaaauga

SEQ ID NO: 1201174 - RNA, 19 nt, Homo sapiens
agauugauuuggacaguau

SEQ ID NO: 1201175 - RNA, 19 nt, Homo sapiens
uuagacaggaugagacuuu

SEQ ID NO: 1201176 - RNA, 19 nt, Homo sapiens
aaaagcaaaucgaagcuaa

SEQ ID NO: 1201177 - RNA, 19 nt, Homo sapiens
gacaaaaccuacagaugga

SEQ ID NO: 1201178 - RNA, 19 nt, Homo sapiens
gagcgcguuugccuguuga

SEQ ID NO: 1201179 - RNA, 19 nt, Homo sapiens
gauaacaugaaacaccuau

SEQ ID NO: 1201180 - RNA, 19 nt, Homo sapiens
ugaaaucacagcaggaauc

SEQ ID NO: 1201181 - RNA, 19 nt, Homo sapiens
ggcaaucucaacucuuauu

SEQ ID NO: 1201182 - RNA, 19 nt, Homo sapiens
gaaaucacagcaggaaucu

SEQ ID NO: 1201183 - RNA, 19 nt, Homo sapiens
cgccaugcccagcuaauuu

SEQ ID NO: 1201184 - RNA, 19 nt, Homo sapiens
gauaaagaucauacgacaa

SEQ ID NO: 1201185 - RNA, 19 nt, Homo sapiens
gaggauaaagaucauacga

SEQ ID NO: 1201186 - RNA, 19 nt, Homo sapiens
ugccucagccucccaagua

SEQ ID NO: 1201187 - RNA, 19 nt, Homo sapiens
cagagaggauaaagaucau

SEQ ID NO: 1201188 - RNA, 19 nt, Homo sapiens
gauuuggacaguauggaaa

SEQ ID NO: 1201189 - RNA, 19 nt, Homo sapiens
caugaaacaccuauuagag

SEQ ID NO: 1201190 - RNA, 19 nt, Homo sapiens
acuuucaacugcacuuaaa

SEQ ID NO: 1201191 - RNA, 19 nt, Homo sapiens
uggaauacuucugugcauu

SEQ ID NO: 1201192 - RNA, 19 nt, Homo sapiens
ugagcgcguuugccuguug

SEQ ID NO: 1201193 - RNA, 19 nt, Homo sapiens
caaucucaacucuuauuug

SEQ ID NO: 1201194 - RNA, 19 nt, Homo sapiens
ggaaaacucagagaggaua

SEQ ID NO: 1201195 - RNA, 19 nt, Homo sapiens
agaaagaagagauugcaau

SEQ ID NO: 1201196 - RNA, 19 nt, Homo sapiens
gaucauacgacaaaaccua

SEQ ID NO: 1201197 - RNA, 19 nt, Homo sapiens
gcaagaaaagcaaaucgaa

SEQ ID NO: 1201198 - RNA, 19 nt, Homo sapiens
uuacauuucuggcaaucuc

SEQ ID NO: 1201199 - RNA, 19 nt, Homo sapiens
aagauugauuuggacagua

SEQ ID NO: 1201200 - RNA, 19 nt, Homo sapiens
gagaggauaaagaucauac

SEQ ID NO: 1201201 - RNA, 19 nt, Homo sapiens
gacaggaugagacuuucaa

SEQ ID NO: 1201202 - RNA, 19 nt, Homo sapiens
aagaacaaacagaagauug

SEQ ID NO: 1201203 - RNA, 19 nt, Homo sapiens
acucagagaggauaaagau

SEQ ID NO: 1201204 - RNA, 19 nt, Homo sapiens
acaugaaacaccuauuaga

SEQ ID NO: 1201205 - RNA, 19 nt, Homo sapiens
gacuuucaacugcacuuaa

SEQ ID NO: 1201206 - RNA, 19 nt, Homo sapiens
gugguuaguuauuuguagu

SEQ ID NO: 1201207 - RNA, 19 nt, Homo sapiens
accuacagauggagauaaa

SEQ ID NO: 1201208 - RNA, 19 nt, Homo sapiens
aaacagaagauugauuugg

SEQ ID NO: 1201209 - RNA, 19 nt, Homo sapiens
ucuagugugcucauggaua

SEQ ID NO: 1201210 - RNA, 19 nt, Homo sapiens
guuugccuguugaguggua

SEQ ID NO: 1201211 - RNA, 19 nt, Homo sapiens
gaaaagcaaaucgaagcua

SEQ ID NO: 1201212 - RNA, 19 nt, Homo sapiens
ggauaacaugaaacaccua

SEQ ID NO: 1201213 - RNA, 19 nt, Homo sapiens
caaaacaacaacucuuaga

SEQ ID NO: 1201214 - RNA, 19 nt, Homo sapiens
auacuucugugcauuuguc

SEQ ID NO: 1201215 - RNA, 19 nt, Homo sapiens
gcaauuaaaacaagcuuca

SEQ ID NO: 1201216 - RNA, 19 nt, Homo sapiens
aaagcaaaucgaagcuaaa

SEQ ID NO: 1201217 - RNA, 19 nt, Homo sapiens
ugcccaggcugcucucaga

SEQ ID NO: 1201218 - RNA, 19 nt, Homo sapiens
aaaccuacagauggagaua

SEQ ID NO: 1201219 - RNA, 19 nt, Homo sapiens
gaaauacagacugaaaaga

SEQ ID NO: 1201220 - RNA, 19 nt, Homo sapiens
acaguugugguuaguuauu

SEQ ID NO: 1201221 - RNA, 19 nt, Homo sapiens
aaugguugaugcaagugaa

SEQ ID NO: 1201222 - RNA, 19 nt, Homo sapiens
ccgaagugcuaggauuaca

SEQ ID NO: 1201223 - RNA, 19 nt, Homo sapiens
ccaggcugcucucagaacu

SEQ ID NO: 1201224 - RNA, 19 nt, Homo sapiens
uguagugggauugaaagua

SEQ ID NO: 1201225 - RNA, 19 nt, Homo sapiens
aggaugagacuuucaacug

SEQ ID NO: 1201226 - RNA, 19 nt, Homo sapiens
agaggauccugcccuuaag

SEQ ID NO: 1201227 - RNA, 19 nt, Homo sapiens
uagacaggaugagacuuuc

SEQ ID NO: 1201228 - RNA, 19 nt, Homo sapiens
gaauaaagcaguugguguu

SEQ ID NO: 1201229 - RNA, 19 nt, Homo sapiens
ggucaucugaguaucauua

SEQ ID NO: 1201230 - RNA, 19 nt, Homo sapiens
cagcacagccuucacguuu

SEQ ID NO: 1201231 - RNA, 19 nt, Homo sapiens
gcauuggacucccggaaga

SEQ ID NO: 1201232 - RNA, 19 nt, Homo sapiens
gcccugaccuggaauaaag

SEQ ID NO: 1201233 - RNA, 19 nt, Homo sapiens
caaacgcagugcccuguuc

SEQ ID NO: 1201234 - RNA, 19 nt, Homo sapiens
uaucauggcggaagaguug

SEQ ID NO: 1201235 - RNA, 19 nt, Homo sapiens
gcagccaggucaucugagu

SEQ ID NO: 1201236 - RNA, 19 nt, Homo sapiens
caguugguguugcuuauga

SEQ ID NO: 1201237 - RNA, 19 nt, Homo sapiens
caucugaguaucauuaaga

SEQ ID NO: 1201238 - RNA, 19 nt, Homo sapiens
gaccuggaauaaagcaguu

SEQ ID NO: 1201239 - RNA, 19 nt, Homo sapiens
ccagggaccauguauguau

SEQ ID NO: 1201240 - RNA, 19 nt, Homo sapiens
gaguagugaugggaagauu

SEQ ID NO: 1201241 - RNA, 19 nt, Homo sapiens
gcacagccuucacguuuug

SEQ ID NO: 1201242 - RNA, 19 nt, Homo sapiens
uagagugguuuccaucuca

SEQ ID NO: 1201243 - RNA, 19 nt, Homo sapiens
cugaguaucauuaagagua

SEQ ID NO: 1201244 - RNA, 19 nt, Homo sapiens
ccucugcugucaccacuug

SEQ ID NO: 1201245 - RNA, 19 nt, Homo sapiens
ugaguaucauuaagaguag

SEQ ID NO: 1201246 - RNA, 19 nt, Homo sapiens
uguccgaggugcagaggaa

SEQ ID NO: 1201247 - RNA, 19 nt, Homo sapiens
ggucagaaacuuccaaacg

SEQ ID NO: 1201248 - RNA, 19 nt, Homo sapiens
gcgagcugauggccuggaa

SEQ ID NO: 1201249 - RNA, 19 nt, Homo sapiens
guagugaugggaagauuac

SEQ ID NO: 1201250 - RNA, 19 nt, Homo sapiens
ccacuuggucagaaacuuc

SEQ ID NO: 1201251 - RNA, 19 nt, Homo sapiens
gaugggaagauuacagucu

SEQ ID NO: 1201252 - RNA, 19 nt, Homo sapiens
caagaucgagcgagugaac

SEQ ID NO: 1201253 - RNA, 19 nt, Homo sapiens
ccaggucaucugaguauca

SEQ ID NO: 1201254 - RNA, 19 nt, Homo sapiens
ugguguugcuuaugaggaa

SEQ ID NO: 1201255 - RNA, 19 nt, Homo sapiens
cagggaccauguauguauc

SEQ ID NO: 1201256 - RNA, 19 nt, Homo sapiens
ugggaagauuacagucuga

SEQ ID NO: 1201257 - RNA, 19 nt, Homo sapiens
aggagacccuagagugguu

SEQ ID NO: 1201258 - RNA, 19 nt, Homo sapiens
uauguaucauggcggaaga

SEQ ID NO: 1201259 - RNA, 19 nt, Homo sapiens
cgccagggaccauguaugu

SEQ ID NO: 1201260 - RNA, 19 nt, Homo sapiens
gggccaaacgugccugcuu

SEQ ID NO: 1201261 - RNA, 19 nt, Homo sapiens
cuagagugguuuccaucuc

SEQ ID NO: 1201262 - RNA, 19 nt, Homo sapiens
gcaguugguguugcuuaug

SEQ ID NO: 1201263 - RNA, 19 nt, Homo sapiens
caggucaucugaguaucau

SEQ ID NO: 1201264 - RNA, 19 nt, Homo sapiens
ccucaaagguuguguauaa

SEQ ID NO: 1201265 - RNA, 19 nt, Homo sapiens
caaagguuguguauaagua

SEQ ID NO: 1201266 - RNA, 19 nt, Homo sapiens
gaauaaagaccuucuaucu

SEQ ID NO: 1201267 - RNA, 19 nt, Homo sapiens
cauagucucucaucugcua

SEQ ID NO: 1201268 - RNA, 19 nt, Homo sapiens
aaacuuugcuguccuacuu

SEQ ID NO: 1201269 - RNA, 19 nt, Homo sapiens
auaaguaccucuagaacaa

SEQ ID NO: 1201270 - RNA, 19 nt, Homo sapiens
gggcuacagugaaacuuug

SEQ ID NO: 1201271 - RNA, 19 nt, Homo sapiens
cuacaucgcccaccguaaa

SEQ ID NO: 1201272 - RNA, 19 nt, Homo sapiens
gggacaagccggugaccua

SEQ ID NO: 1201273 - RNA, 19 nt, Homo sapiens
gcuguagccugcagagaau

SEQ ID NO: 1201274 - RNA, 19 nt, Homo sapiens
ucucucaucugcuauugaa

SEQ ID NO: 1201275 - RNA, 19 nt, Homo sapiens
gugaaacuuugcuguccua

SEQ ID NO: 1201276 - RNA, 19 nt, Homo sapiens
ggaaaugcauccccucaga

SEQ ID NO: 1201277 - RNA, 19 nt, Homo sapiens
uccaaacugugcccucaaa

SEQ ID NO: 1201278 - RNA, 19 nt, Homo sapiens
guaaccaguuggagaucug

SEQ ID NO: 1201279 - RNA, 19 nt, Homo sapiens
ggaaacgugggaaaggaau

SEQ ID NO: 1201280 - RNA, 19 nt, Homo sapiens
guguauaaguaccucuaga

SEQ ID NO: 1201281 - RNA, 19 nt, Homo sapiens
acaagccggugaccuacga

SEQ ID NO: 1201282 - RNA, 19 nt, Homo sapiens
aaacugugcccucaaaggu

SEQ ID NO: 1201283 - RNA, 19 nt, Homo sapiens
gaaacgugggaaaggaaug

SEQ ID NO: 1201284 - RNA, 19 nt, Homo sapiens
uguauaaguaccucuagaa

SEQ ID NO: 1201285 - RNA, 19 nt, Homo sapiens
gaauggaaacgugggaaag

SEQ ID NO: 1201286 - RNA, 19 nt, Homo sapiens
uauaaguaccucuagaaca

SEQ ID NO: 1201287 - RNA, 19 nt, Homo sapiens
gacuccaccuccaaacugu

SEQ ID NO: 1201288 - RNA, 19 nt, Homo sapiens
ugaauaaagaccuucuauc

SEQ ID NO: 1201289 - RNA, 19 nt, Homo sapiens
ucaaagguuguguauaagu

SEQ ID NO: 1201290 - RNA, 19 nt, Homo sapiens
cgacuccaccuccaaacug

SEQ ID NO: 1201291 - RNA, 19 nt, Homo sapiens
gguaaccaguuggagaucu

SEQ ID NO: 1201292 - RNA, 19 nt, Homo sapiens
gaacgguggaggauguuuu

SEQ ID NO: 1201293 - RNA, 19 nt, Homo sapiens
cucgugggcuacagugaaa

SEQ ID NO: 1201294 - RNA, 19 nt, Homo sapiens
caaacugugcccucaaagg

SEQ ID NO: 1201295 - RNA, 19 nt, Homo sapiens
gggaaaggaaugguaugug

SEQ ID NO: 1201296 - RNA, 19 nt, Homo sapiens
guauaaguaccucuagaac

SEQ ID NO: 1201297 - RNA, 19 nt, Homo sapiens
ugaagaagauuguugcaaa

SEQ ID NO: 1201298 - RNA, 19 nt, Homo sapiens
caagaacaguuuaugaaga

SEQ ID NO: 1201299 - RNA, 19 nt, Homo sapiens
caagaaggcucugugcauu

SEQ ID NO: 1201300 - RNA, 19 nt, Homo sapiens
caaagacagccaauaaauu

SEQ ID NO: 1201301 - RNA, 19 nt, Homo sapiens
gaauugagaagguugauga

SEQ ID NO: 1201302 - RNA, 19 nt, Homo sapiens
cacaaacgcuaucugcuaa

SEQ ID NO: 1201303 - RNA, 19 nt, Homo sapiens
gccaauaaauucuguucaa

SEQ ID NO: 1201304 - RNA, 19 nt, Homo sapiens
caccaacuaugaugucuuu

SEQ ID NO: 1201305 - RNA, 19 nt, Homo sapiens
gaagaacacuuggagaaac

SEQ ID NO: 1201306 - RNA, 19 nt, Homo sapiens
gauccgcaguuaugaagaa

SEQ ID NO: 1201307 - RNA, 19 nt, Homo sapiens
ggaaauggccaacaagaag

SEQ ID NO: 1201308 - RNA, 19 nt, Homo sapiens
gcucaaagacuaccagaau

SEQ ID NO: 1201309 - RNA, 19 nt, Homo sapiens
ccacaaacgcuaucugcua

SEQ ID NO: 1201310 - RNA, 19 nt, Homo sapiens
gaagaagauuguugcaaac

SEQ ID NO: 1201311 - RNA, 19 nt, Homo sapiens
aaagacagccaauaaauuc

SEQ ID NO: 1201312 - RNA, 19 nt, Homo sapiens
ccuggaggcucgaauuauu

SEQ ID NO: 1201313 - RNA, 19 nt, Homo sapiens
ggaggacgcugaguuugau

SEQ ID NO: 1201314 - RNA, 19 nt, Homo sapiens
gaaugucccuggaauugag

SEQ ID NO: 1201315 - RNA, 19 nt, Homo sapiens
cuucuacgcugcucaaaga

SEQ ID NO: 1201316 - RNA, 19 nt, Homo sapiens
agucuaggcuggaugauga

SEQ ID NO: 1201317 - RNA, 19 nt, Homo sapiens
ucaaagacagccaauaaau

SEQ ID NO: 1201318 - RNA, 19 nt, Homo sapiens
gaagcgaagaagagccuua

SEQ ID NO: 1201319 - RNA, 19 nt, Homo sapiens
ccaaagacacucaaagaca

SEQ ID NO: 1201320 - RNA, 19 nt, Homo sapiens
caacuaugaugucuuugag

SEQ ID NO: 1201321 - RNA, 19 nt, Homo sapiens
gcaagaacaguuuaugaag

SEQ ID NO: 1201322 - RNA, 19 nt, Homo sapiens
acucaaagacagccaauaa

SEQ ID NO: 1201323 - RNA, 19 nt, Homo sapiens
caaacgcuaucugcuaaug

SEQ ID NO: 1201324 - RNA, 19 nt, Homo sapiens
gaacaguuuaugaagaaga

SEQ ID NO: 1201325 - RNA, 19 nt, Homo sapiens
cuacgcugcucaaagacua

SEQ ID NO: 1201326 - RNA, 19 nt, Homo sapiens
gcgccaaguuuccuuucaa

SEQ ID NO: 1201327 - RNA, 19 nt, Homo sapiens
acuaugaugucuuugagaa

SEQ ID NO: 1201328 - RNA, 19 nt, Homo sapiens
gaaaggacaaagcccacaa

SEQ ID NO: 1201329 - RNA, 19 nt, Homo sapiens
cagaaugucccuggaauug

SEQ ID NO: 1201330 - RNA, 19 nt, Homo sapiens
gaugaugacccaccuccuu

SEQ ID NO: 1201331 - RNA, 19 nt, Homo sapiens
gguugaugaugucgugaaa

SEQ ID NO: 1201332 - RNA, 19 nt, Homo sapiens
uugagaagguugaugaugu

SEQ ID NO: 1201333 - RNA, 19 nt, Homo sapiens
ggaaaccagcccagucuag

SEQ ID NO: 1201334 - RNA, 19 nt, Homo sapiens
gccaaagccauaccaaaga

SEQ ID NO: 1201335 - RNA, 19 nt, Homo sapiens
ccaacuaugaugucuuuga

SEQ ID NO: 1201336 - RNA, 19 nt, Homo sapiens
gucaagauccgcaguuaug

SEQ ID NO: 1201337 - RNA, 19 nt, Homo sapiens
uaccaaagacacucaaaga

SEQ ID NO: 1201338 - RNA, 19 nt, Homo sapiens
acaagaaggagaugcuaaa

SEQ ID NO: 1201339 - RNA, 19 nt, Homo sapiens
gcgaagaagagccuuaaag

SEQ ID NO: 1201340 - RNA, 19 nt, Homo sapiens
gaagagcccaccgccgauu

SEQ ID NO: 1201341 - RNA, 19 nt, Homo sapiens
ugaagaacacuuggagaaa

SEQ ID NO: 1201342 - RNA, 19 nt, Homo sapiens
ucaaagacuaccagaaugu

SEQ ID NO: 1201343 - RNA, 19 nt, Homo sapiens
caagauccgcaguuaugaa

SEQ ID NO: 1201344 - RNA, 19 nt, Homo sapiens
caacaagaaggagaugcua

SEQ ID NO: 1201345 - RNA, 19 nt, Homo sapiens
ugagaagguugaugauguc

SEQ ID NO: 1201346 - RNA, 19 nt, Homo sapiens
ccaaagccauaccaaagac

SEQ ID NO: 1201347 - RNA, 19 nt, Homo sapiens
gcucugugcauucggguuu

SEQ ID NO: 1201348 - RNA, 19 nt, Homo sapiens
ccaagaaggcucugugcau

SEQ ID NO: 1201349 - RNA, 19 nt, Homo sapiens
aagaacacuuggagaaaca

SEQ ID NO: 1201350 - RNA, 19 nt, Homo sapiens
gccgauucgugaccaagaa

SEQ ID NO: 1201351 - RNA, 19 nt, Homo sapiens
aagcaagaacaguuuauga

SEQ ID NO: 1201352 - RNA, 19 nt, Homo sapiens
aaucaagcaagaacaguuu

SEQ ID NO: 1201353 - RNA, 19 nt, Homo sapiens
gagcauugaccagaggaaa

SEQ ID NO: 1201354 - RNA, 19 nt, Homo sapiens
gcaguuaugaagaacacuu

SEQ ID NO: 1201355 - RNA, 19 nt, Homo sapiens
acucuugucuuuggaaaug

SEQ ID NO: 1201356 - RNA, 19 nt, Homo sapiens
gaauuauugccuugucugu

SEQ ID NO: 1201357 - RNA, 19 nt, Homo sapiens
gguuagaggucaccaugcu

SEQ ID NO: 1201358 - RNA, 19 nt, Homo sapiens
ggugggagcgccaaguuuc

SEQ ID NO: 1201359 - RNA, 19 nt, Homo sapiens
gaugacccaccuccuucua

SEQ ID NO: 1201360 - RNA, 19 nt, Homo sapiens
auuauugccuugucuguca

SEQ ID NO: 1201361 - RNA, 19 nt, Homo sapiens
ggagcgccaaguuuccuuu

SEQ ID NO: 1201362 - RNA, 19 nt, Homo sapiens
cucaaagacuaccagaaug

SEQ ID NO: 1201363 - RNA, 19 nt, Homo sapiens
uaacaccaacuaugauguc

SEQ ID NO: 1201364 - RNA, 19 nt, Homo sapiens
cugucaagauccgcaguua

SEQ ID NO: 1201365 - RNA, 19 nt, Homo sapiens
caagcaagaacaguuuaug

SEQ ID NO: 1201366 - RNA, 19 nt, Homo sapiens
gcugaagaagcgaagaaga

SEQ ID NO: 1201367 - RNA, 19 nt, Homo sapiens
cguggaggacgcugaguuu

SEQ ID NO: 1201368 - RNA, 19 nt, Homo sapiens
uggaaauggccaacaagaa

SEQ ID NO: 1201369 - RNA, 19 nt, Homo sapiens
uggaggacgcugaguuuga

SEQ ID NO: 1201370 - RNA, 19 nt, Homo sapiens
guaacaccaacuaugaugu

SEQ ID NO: 1201371 - RNA, 19 nt, Homo sapiens
aaaggacaaagcccacaaa

SEQ ID NO: 1201372 - RNA, 19 nt, Homo sapiens
agaaacaucgaaaggacaa

SEQ ID NO: 1201373 - RNA, 19 nt, Homo sapiens
ggauaugucguccggaaac

SEQ ID NO: 1201374 - RNA, 19 nt, Homo sapiens
agcaagaacaguuuaugaa

SEQ ID NO: 1201375 - RNA, 19 nt, Homo sapiens
ccaaguuuccuuucaacca

SEQ ID NO: 1201376 - RNA, 19 nt, Homo sapiens
ccagacagcccugccaaag

SEQ ID NO: 1201377 - RNA, 19 nt, Homo sapiens
gaacacuuggagaaacauc

SEQ ID NO: 1201378 - RNA, 19 nt, Homo sapiens
ucaagauccgcaguuauga

SEQ ID NO: 1201379 - RNA, 19 nt, Homo sapiens
aaaucaagcaagaacaguu

SEQ ID NO: 1201380 - RNA, 19 nt, Homo sapiens
cguaacaccaacuaugaug

SEQ ID NO: 1201381 - RNA, 19 nt, Homo sapiens
caaagcccacaaacgcuau

SEQ ID NO: 1201382 - RNA, 19 nt, Homo sapiens
augaagaacacuuggagaa

SEQ ID NO: 1201383 - RNA, 19 nt, Homo sapiens
ggaauugagaagguugaug

SEQ ID NO: 1201384 - RNA, 19 nt, Homo sapiens
ucaagcaagaacaguuuau

SEQ ID NO: 1201385 - RNA, 19 nt, Homo sapiens
uccguaacaccaacuauga

SEQ ID NO: 1201386 - RNA, 19 nt, Homo sapiens
aaacgcuaucugcuaauga

SEQ ID NO: 1201387 - RNA, 19 nt, Homo sapiens
ucccuggaggcucgaauua

SEQ ID NO: 1201388 - RNA, 19 nt, Homo sapiens
cucaaagacagccaauaaa

SEQ ID NO: 1201389 - RNA, 19 nt, Homo sapiens
ugccaaagccauaccaaag

SEQ ID NO: 1201390 - RNA, 19 nt, Homo sapiens
aagcgaagaagagccuuaa

SEQ ID NO: 1201391 - RNA, 19 nt, Homo sapiens
caaagacuaccagaauguc

SEQ ID NO: 1201392 - RNA, 19 nt, Homo sapiens
gaaagaaauuugaggagau

SEQ ID NO: 1201393 - RNA, 19 nt, Homo sapiens
ucagagcucuccagaauau

SEQ ID NO: 1201394 - RNA, 19 nt, Homo sapiens
gaacuacagugaaagucuu

SEQ ID NO: 1201395 - RNA, 19 nt, Homo sapiens
gaaguaagcuuugcaucuc

SEQ ID NO: 1201396 - RNA, 19 nt, Homo sapiens
gcagaaaguugaacagaac

SEQ ID NO: 1201397 - RNA, 19 nt, Homo sapiens
ugucagagcucuccagaau

SEQ ID NO: 1201398 - RNA, 19 nt, Homo sapiens
acaccaaguucagcauuua

SEQ ID NO: 1201399 - RNA, 19 nt, Homo sapiens
ggagauccuucaggcagua

SEQ ID NO: 1201400 - RNA, 19 nt, Homo sapiens
gaauaugcuuguuggagau

SEQ ID NO: 1201401 - RNA, 19 nt, Homo sapiens
gguagucucugcuaguaau

SEQ ID NO: 1201402 - RNA, 19 nt, Homo sapiens
ggaaggaggccugcacuug

SEQ ID NO: 1201403 - RNA, 19 nt, Homo sapiens
guagaugacuuucccuucu

SEQ ID NO: 1201404 - RNA, 19 nt, Homo sapiens
acagagggauuucggaaug

SEQ ID NO: 1201405 - RNA, 19 nt, Homo sapiens
cagguagucucugcuagua

SEQ ID NO: 1201406 - RNA, 19 nt, Homo sapiens
gaucccaauugcacacauu

SEQ ID NO: 1201407 - RNA, 19 nt, Homo sapiens
gaggugggcaggaaagaaa

SEQ ID NO: 1201408 - RNA, 19 nt, Homo sapiens
caccaucucagaacauuaa

SEQ ID NO: 1201409 - RNA, 19 nt, Homo sapiens
caacacacagauccaggua

SEQ ID NO: 1201410 - RNA, 19 nt, Homo sapiens
caaacucugcucugagaaa

SEQ ID NO: 1201411 - RNA, 19 nt, Homo sapiens
cccaaacucugcucugaga

SEQ ID NO: 1201412 - RNA, 19 nt, Homo sapiens
gaaagaauccccuggugaa

SEQ ID NO: 1201413 - RNA, 19 nt, Homo sapiens
acacacagauccagguagu

SEQ ID NO: 1201414 - RNA, 19 nt, Homo sapiens
gggcaggaaagaaauuuga

SEQ ID NO: 1201415 - RNA, 19 nt, Homo sapiens
ggcccaaacucugcucuga

SEQ ID NO: 1201416 - RNA, 19 nt, Homo sapiens
cacaccaaguucagcauuu

SEQ ID NO: 1201417 - RNA, 19 nt, Homo sapiens
aaagaaauuugaggagauc

SEQ ID NO: 1201418 - RNA, 19 nt, Homo sapiens
cuggugaacuacagugaaa

SEQ ID NO: 1201419 - RNA, 19 nt, Homo sapiens
cauccgaguuguggugaaa

SEQ ID NO: 1201420 - RNA, 19 nt, Homo sapiens
gcacagacagcaggcauag

SEQ ID NO: 1201421 - RNA, 19 nt, Homo sapiens
ucaguggaccuaaugaaga

SEQ ID NO: 1201422 - RNA, 19 nt, Homo sapiens
gaaagucuuauugagcauu

SEQ ID NO: 1201423 - RNA, 19 nt, Homo sapiens
uaaagcaucccacaacaac

SEQ ID NO: 1201424 - RNA, 19 nt, Homo sapiens
acagugaaagucuuauuga

SEQ ID NO: 1201425 - RNA, 19 nt, Homo sapiens
aaggaggccugcacuugga

SEQ ID NO: 1201426 - RNA, 19 nt, Homo sapiens
agcagaaaguugaacagaa

SEQ ID NO: 1201427 - RNA, 19 nt, Homo sapiens
gccuggaagugaucucaau

SEQ ID NO: 1201428 - RNA, 19 nt, Homo sapiens
gcggcgagagcuaaacaaa

SEQ ID NO: 1201429 - RNA, 19 nt, Homo sapiens
ucucugaggugggcaggaa

SEQ ID NO: 1201430 - RNA, 19 nt, Homo sapiens
aauauucaguggaccuaau

SEQ ID NO: 1201431 - RNA, 19 nt, Homo sapiens
gacccaccaucucagaaca

SEQ ID NO: 1201432 - RNA, 19 nt, Homo sapiens
ggcgagagcuaaacaaaag

SEQ ID NO: 1201433 - RNA, 19 nt, Homo sapiens
ccaauugcacacauuaaag

SEQ ID NO: 1201434 - RNA, 19 nt, Homo sapiens
uagaugacuuucccuucug

SEQ ID NO: 1201435 - RNA, 19 nt, Homo sapiens
caguggaccuaaugaagag

SEQ ID NO: 1201436 - RNA, 19 nt, Homo sapiens
agaaguaagcuuugcaucu

SEQ ID NO: 1201437 - RNA, 19 nt, Homo sapiens
ccacaacaacacacagauc

SEQ ID NO: 1201438 - RNA, 19 nt, Homo sapiens
cccaauugcacacauuaaa

SEQ ID NO: 1201439 - RNA, 19 nt, Homo sapiens
cggccaagcagaaaguuga

SEQ ID NO: 1201440 - RNA, 19 nt, Homo sapiens
ucaugcaggcugugagaaa

SEQ ID NO: 1201441 - RNA, 19 nt, Homo sapiens
cagugaaagucuuauugag

SEQ ID NO: 1201442 - RNA, 19 nt, Homo sapiens
gaacugcuagaacgaacca

SEQ ID NO: 1201443 - RNA, 19 nt, Homo sapiens
ccacaccaaguucagcauu

SEQ ID NO: 1201444 - RNA, 19 nt, Homo sapiens
cuacagugaaagucuuauu

SEQ ID NO: 1201445 - RNA, 19 nt, Homo sapiens
gcauuuacccucccauucc

SEQ ID NO: 1201446 - RNA, 19 nt, Homo sapiens
augaagaguagaugacuuu

SEQ ID NO: 1201447 - RNA, 19 nt, Homo sapiens
gaccuaaugaagaguagau

SEQ ID NO: 1201448 - RNA, 19 nt, Homo sapiens
aaugaagaguagaugacuu

SEQ ID NO: 1201449 - RNA, 19 nt, Homo sapiens
ccgacaggcacucauggua

SEQ ID NO: 1201450 - RNA, 19 nt, Homo sapiens
agaauccccuggugaacua

SEQ ID NO: 1201451 - RNA, 19 nt, Homo sapiens
gauuucggaaugccaagaa

SEQ ID NO: 1201452 - RNA, 19 nt, Homo sapiens
uuaaagcaucccacaacaa

SEQ ID NO: 1201453 - RNA, 19 nt, Homo sapiens
cauuaaagcaucccacaac

SEQ ID NO: 1201454 - RNA, 19 nt, Homo sapiens
ccuaaugaagaguagauga

SEQ ID NO: 1201455 - RNA, 19 nt, Homo sapiens
ggugaacuacagugaaagu

SEQ ID NO: 1201456 - RNA, 19 nt, Homo sapiens
ccaccaucucagaacauua

SEQ ID NO: 1201457 - RNA, 19 nt, Homo sapiens
cagcauuuacccucccauu

SEQ ID NO: 1201458 - RNA, 19 nt, Homo sapiens
uacagugaaagucuuauug

SEQ ID NO: 1201459 - RNA, 19 nt, Homo sapiens
uugaggagaucccaauugc

SEQ ID NO: 1201460 - RNA, 19 nt, Homo sapiens
ccaagcagaaaguugaaca

SEQ ID NO: 1201461 - RNA, 19 nt, Homo sapiens
acucugcucugagaaaaua

SEQ ID NO: 1201462 - RNA, 19 nt, Homo sapiens
gcaguaagggagaguuuug

SEQ ID NO: 1201463 - RNA, 19 nt, Homo sapiens
gucagagcucuccagaaua

SEQ ID NO: 1201464 - RNA, 19 nt, Homo sapiens
ccagugggaccuuguaaaa

SEQ ID NO: 1201465 - RNA, 19 nt, Homo sapiens
cccaccaucucagaacauu

SEQ ID NO: 1201466 - RNA, 19 nt, Homo sapiens
gcuccagugggaccuugua

SEQ ID NO: 1201467 - RNA, 19 nt, Homo sapiens
gccaugcacggacugauca

SEQ ID NO: 1201468 - RNA, 19 nt, Homo sapiens
auuaaagcaucccacaaca

SEQ ID NO: 1201469 - RNA, 19 nt, Homo sapiens
ggugggcaggaaagaaauu

SEQ ID NO: 1201470 - RNA, 19 nt, Homo sapiens
gcacuugucucgagauaua

SEQ ID NO: 1201471 - RNA, 19 nt, Homo sapiens
ggaagaauuugcaaguuug

SEQ ID NO: 1201472 - RNA, 19 nt, Homo sapiens
gaacgagcgcuuccuuaua

SEQ ID NO: 1201473 - RNA, 19 nt, Homo sapiens
uauaauaccuccugggauu

SEQ ID NO: 1201474 - RNA, 19 nt, Homo sapiens
gcuacgagcuggcuuuaau

SEQ ID NO: 1201475 - RNA, 19 nt, Homo sapiens
gagaagauucgccagauuu

SEQ ID NO: 1201476 - RNA, 19 nt, Homo sapiens
gagggaauauugucaaaca

SEQ ID NO: 1201477 - RNA, 19 nt, Homo sapiens
ggacagaggagcaauagug

SEQ ID NO: 1201478 - RNA, 19 nt, Homo sapiens
ggacgagaaggaagaauuu

SEQ ID NO: 1201479 - RNA, 19 nt, Homo sapiens
guaaccauguggaaauaaa

SEQ ID NO: 1201480 - RNA, 19 nt, Homo sapiens
gagcacuugucucgagaua

SEQ ID NO: 1201481 - RNA, 19 nt, Homo sapiens
gacgaccaauguauuauau

SEQ ID NO: 1201482 - RNA, 19 nt, Homo sapiens
caaguuuggccuuuauaua

SEQ ID NO: 1201483 - RNA, 19 nt, Homo sapiens
caaagaagaggaagaagug

SEQ ID NO: 1201484 - RNA, 19 nt, Homo sapiens
gaaggaagaauuugcaagu

SEQ ID NO: 1201485 - RNA, 19 nt, Homo sapiens
aggaagaauuugcaaguuu

SEQ ID NO: 1201486 - RNA, 19 nt, Homo sapiens
caacagaggcggguauuuc

SEQ ID NO: 1201487 - RNA, 19 nt, Homo sapiens
uguaauuccuucacauuug

SEQ ID NO: 1201488 - RNA, 19 nt, Homo sapiens
gugauuagagggaauauug

SEQ ID NO: 1201489 - RNA, 19 nt, Homo sapiens
aaacuugauuguagggaaa

SEQ ID NO: 1201490 - RNA, 19 nt, Homo sapiens
ccacaaagaagaggaagaa

SEQ ID NO: 1201491 - RNA, 19 nt, Homo sapiens
gguauuucuugguggauuu

SEQ ID NO: 1201492 - RNA, 19 nt, Homo sapiens
gcugcuacuuugaaacgua

SEQ ID NO: 1201493 - RNA, 19 nt, Homo sapiens
cgaccaauguauuauaugg

SEQ ID NO: 1201494 - RNA, 19 nt, Homo sapiens
ugagaagauucgccagauu

SEQ ID NO: 1201495 - RNA, 19 nt, Homo sapiens
cgagauauagaugugauua

SEQ ID NO: 1201496 - RNA, 19 nt, Homo sapiens
guguaaccauguggaaaua

SEQ ID NO: 1201497 - RNA, 19 nt, Homo sapiens
gcaaguuuggccuuuauau

SEQ ID NO: 1201498 - RNA, 19 nt, Homo sapiens
guaauuccuucacauuugg

SEQ ID NO: 1201499 - RNA, 19 nt, Homo sapiens
ggaagaagugagaagauuc

SEQ ID NO: 1201500 - RNA, 19 nt, Homo sapiens
ugacgaccaauguauuaua

SEQ ID NO: 1201501 - RNA, 19 nt, Homo sapiens
aacgagcgcuuccuuauag

SEQ ID NO: 1201502 - RNA, 19 nt, Homo sapiens
ugcaggugcuguuugauuu

SEQ ID NO: 1201503 - RNA, 19 nt, Homo sapiens
uagagggaauauugucaaa

SEQ ID NO: 1201504 - RNA, 19 nt, Homo sapiens
gcacaacagaggcggguau

SEQ ID NO: 1201505 - RNA, 19 nt, Homo sapiens
gauggacagaggagcaaua

SEQ ID NO: 1201506 - RNA, 19 nt, Homo sapiens
agagacugcugcuacuuug

SEQ ID NO: 1201507 - RNA, 19 nt, Homo sapiens
aggaagaagugagaagauu

SEQ ID NO: 1201508 - RNA, 19 nt, Homo sapiens
gacagaggagcaauaguga

SEQ ID NO: 1201509 - RNA, 19 nt, Homo sapiens
aaaagaaugugaagggauu

SEQ ID NO: 1201510 - RNA, 19 nt, Homo sapiens
cagagacugcugcuacuuu

SEQ ID NO: 1201511 - RNA, 19 nt, Homo sapiens
ugaacgagcgcuuccuuau

SEQ ID NO: 1201512 - RNA, 19 nt, Homo sapiens
gugagaagauucgccagau

SEQ ID NO: 1201513 - RNA, 19 nt, Homo sapiens
uaggaucucugcccacagu

SEQ ID NO: 1201514 - RNA, 19 nt, Homo sapiens
gagcaaaacuuauaauacc

SEQ ID NO: 1201515 - RNA, 19 nt, Homo sapiens
gagcaauagugagggacuu

SEQ ID NO: 1201516 - RNA, 19 nt, Homo sapiens
gugaacgagcgcuuccuua

SEQ ID NO: 1201517 - RNA, 19 nt, Homo sapiens
uauauaagcauguguugca

SEQ ID NO: 1201518 - RNA, 19 nt, Homo sapiens
gaagaagugagaagauucg

SEQ ID NO: 1201519 - RNA, 19 nt, Homo sapiens
gaugugauuagagggaaua

SEQ ID NO: 1201520 - RNA, 19 nt, Homo sapiens
aaggaagaauuugcaaguu

SEQ ID NO: 1201521 - RNA, 19 nt, Homo sapiens
cgauagaggcccugaugga

SEQ ID NO: 1201522 - RNA, 19 nt, Homo sapiens
gcauggacgagaaggaaga

SEQ ID NO: 1201523 - RNA, 19 nt, Homo sapiens
gaagauucgccagauuuua

SEQ ID NO: 1201524 - RNA, 19 nt, Homo sapiens
gaggaagaagugagaagau

SEQ ID NO: 1201525 - RNA, 19 nt, Homo sapiens
caccgcagcuguugaaagc

SEQ ID NO: 1201526 - RNA, 19 nt, Homo sapiens
ggauugugagcuagucauu

SEQ ID NO: 1201527 - RNA, 19 nt, Homo sapiens
gagaaggaagaauuugcaa

SEQ ID NO: 1201528 - RNA, 19 nt, Homo sapiens
gaagaggaagaagugagaa

SEQ ID NO: 1201529 - RNA, 19 nt, Homo sapiens
cagaggcggguauuucuug

SEQ ID NO: 1201530 - RNA, 19 nt, Homo sapiens
gacugcugcuacuuugaaa

SEQ ID NO: 1201531 - RNA, 19 nt, Homo sapiens
ggguauuucuugguggauu

SEQ ID NO: 1201532 - RNA, 19 nt, Homo sapiens
auugugagcuagucauuca

SEQ ID NO: 1201533 - RNA, 19 nt, Homo sapiens
ucuguaaccugcaguacca

SEQ ID NO: 1201534 - RNA, 19 nt, Homo sapiens
uguugcaggugcuguuuga

SEQ ID NO: 1201535 - RNA, 19 nt, Homo sapiens
acaaagaagaggaagaagu

SEQ ID NO: 1201536 - RNA, 19 nt, Homo sapiens
cagcauggacgagaaggaa

SEQ ID NO: 1201537 - RNA, 19 nt, Homo sapiens
agaagaggaagaagugaga

SEQ ID NO: 1201538 - RNA, 19 nt, Homo sapiens
agacugcugcuacuuugaa

SEQ ID NO: 1201539 - RNA, 19 nt, Homo sapiens
cuccugggauugugagcua

SEQ ID NO: 1201540 - RNA, 19 nt, Homo sapiens
guggggaacugcucacuga

SEQ ID NO: 1201541 - RNA, 19 nt, Homo sapiens
uugcaaguuuggccuuuau

SEQ ID NO: 1201542 - RNA, 19 nt, Homo sapiens
gaagaauuugcaaguuugg

SEQ ID NO: 1201543 - RNA, 19 nt, Homo sapiens
ccucugacccaggaacuaa

SEQ ID NO: 1201544 - RNA, 19 nt, Homo sapiens
caacuuuugcuuugaguaa

SEQ ID NO: 1201545 - RNA, 19 nt, Homo sapiens
ggacaacuuuugcuuugag

SEQ ID NO: 1201546 - RNA, 19 nt, Homo sapiens
gagauauagaugugauuag

SEQ ID NO: 1201547 - RNA, 19 nt, Homo sapiens
ccgcagcuguugaaagcau

SEQ ID NO: 1201548 - RNA, 19 nt, Homo sapiens
cgagaaggaagaauuugca

SEQ ID NO: 1201549 - RNA, 19 nt, Homo sapiens
gauuagagggaauauuguc

SEQ ID NO: 1201550 - RNA, 19 nt, Homo sapiens
gauauagaugugauuagag

SEQ ID NO: 1201551 - RNA, 19 nt, Homo sapiens
gcuuugaguaauaaacuug

SEQ ID NO: 1201552 - RNA, 19 nt, Homo sapiens
aaagcaugguggagcacuu

SEQ ID NO: 1201553 - RNA, 19 nt, Homo sapiens
gaccaauguauuauaugga

SEQ ID NO: 1201554 - RNA, 19 nt, Homo sapiens
gccagagacugcugcuacu

SEQ ID NO: 1201555 - RNA, 19 nt, Homo sapiens
gagacugcugcuacuuuga

SEQ ID NO: 1201556 - RNA, 19 nt, Homo sapiens
ggugaacgagcgcuuccuu

SEQ ID NO: 1201557 - RNA, 19 nt, Homo sapiens
uacaacaguaacaccauuu

SEQ ID NO: 1201558 - RNA, 19 nt, Homo sapiens
uuugcaaguuuggccuuua

SEQ ID NO: 1201559 - RNA, 19 nt, Homo sapiens
uggacgagaaggaagaauu

SEQ ID NO: 1201560 - RNA, 19 nt, Homo sapiens
gaacuaaaagaaugugaag

SEQ ID NO: 1201561 - RNA, 19 nt, Homo sapiens
uagugucauuucuuuguca

SEQ ID NO: 1201562 - RNA, 19 nt, Homo sapiens
gaagagagccgccacguaa

SEQ ID NO: 1201563 - RNA, 19 nt, Homo sapiens
gagggaaguuuaaucuuua

SEQ ID NO: 1201564 - RNA, 19 nt, Homo sapiens
gaaugucccucuuaugaaa

SEQ ID NO: 1201565 - RNA, 19 nt, Homo sapiens
agaagaagaugaagguuaa

SEQ ID NO: 1201566 - RNA, 19 nt, Homo sapiens
ggacgcauaucaagaugaa

SEQ ID NO: 1201567 - RNA, 19 nt, Homo sapiens
ugagggaaguuuaaucuuu

SEQ ID NO: 1201568 - RNA, 19 nt, Homo sapiens
gaaagaagaagaugaaggu

SEQ ID NO: 1201569 - RNA, 19 nt, Homo sapiens
gagcgaggauggaguggaa

SEQ ID NO: 1201570 - RNA, 19 nt, Homo sapiens
gaaagagggaagaaagaaa

SEQ ID NO: 1201571 - RNA, 19 nt, Homo sapiens
ggagaaacauaugaggauu

SEQ ID NO: 1201572 - RNA, 19 nt, Homo sapiens
cagacacaaugcuguauuu

SEQ ID NO: 1201573 - RNA, 19 nt, Homo sapiens
acacaaugcuguauuucuu

SEQ ID NO: 1201574 - RNA, 19 nt, Homo sapiens
acagagcaguucaccauuu

SEQ ID NO: 1201575 - RNA, 19 nt, Homo sapiens
gaacaggggucagaucauu

SEQ ID NO: 1201576 - RNA, 19 nt, Homo sapiens
uaaauugacugcagaugag

SEQ ID NO: 1201577 - RNA, 19 nt, Homo sapiens
gaagaguguucucggcaau

SEQ ID NO: 1201578 - RNA, 19 nt, Homo sapiens
ggaaugaagcgcucugugu

SEQ ID NO: 1201579 - RNA, 19 nt, Homo sapiens
guucaccauuugcauuaua

SEQ ID NO: 1201580 - RNA, 19 nt, Homo sapiens
gcagaccauugcccaaaga

SEQ ID NO: 1201581 - RNA, 19 nt, Homo sapiens
gaagaaacaacccaaaggu

SEQ ID NO: 1201582 - RNA, 19 nt, Homo sapiens
ugaagaccauacaauauuc

SEQ ID NO: 1201583 - RNA, 19 nt, Homo sapiens
gagaaacauaugaggauuu

SEQ ID NO: 1201584 - RNA, 19 nt, Homo sapiens
gauguuaccuugccuuuug

SEQ ID NO: 1201585 - RNA, 19 nt, Homo sapiens
cagagcaguucaccauuug

SEQ ID NO: 1201586 - RNA, 19 nt, Homo sapiens
gcaaggaagagcaggagaa

SEQ ID NO: 1201587 - RNA, 19 nt, Homo sapiens
caaggucucuggguccauu

SEQ ID NO: 1201588 - RNA, 19 nt, Homo sapiens
aagaagaagaugaagguua

SEQ ID NO: 1201589 - RNA, 19 nt, Homo sapiens
gagaagagugggaccgaaa

SEQ ID NO: 1201590 - RNA, 19 nt, Homo sapiens
gugaagggcguuaugguuu

SEQ ID NO: 1201591 - RNA, 19 nt, Homo sapiens
cagaugagcuguggaaagg

SEQ ID NO: 1201592 - RNA, 19 nt, Homo sapiens
ccucacagcuugggauguu

SEQ ID NO: 1201593 - RNA, 19 nt, Homo sapiens
uaaccucucuggccuugug

SEQ ID NO: 1201594 - RNA, 19 nt, Homo sapiens
aaacuggacugggaagaug

SEQ ID NO: 1201595 - RNA, 19 nt, Homo sapiens
gcaguucaccauuugcauu

SEQ ID NO: 1201596 - RNA, 19 nt, Homo sapiens
gaaaucgauccgugucuug

SEQ ID NO: 1201597 - RNA, 19 nt, Homo sapiens
gaagguggaggcagacaug

SEQ ID NO: 1201598 - RNA, 19 nt, Homo sapiens
aagaagggccuccauguug

SEQ ID NO: 1201599 - RNA, 19 nt, Homo sapiens
uaagaagggccuccauguu

SEQ ID NO: 1201600 - RNA, 19 nt, Homo sapiens
ggauggaugcuuucaggaa

SEQ ID NO: 1201601 - RNA, 19 nt, Homo sapiens
gcagacacaaugcuguauu

SEQ ID NO: 1201602 - RNA, 19 nt, Homo sapiens
gaaaaggagcugcagguuu

SEQ ID NO: 1201603 - RNA, 19 nt, Homo sapiens
cuaaauugacugcagauga

SEQ ID NO: 1201604 - RNA, 19 nt, Homo sapiens
cugaaugucccucuuauga

SEQ ID NO: 1201605 - RNA, 19 nt, Homo sapiens
caggauacuugagguaaga

SEQ ID NO: 1201606 - RNA, 19 nt, Homo sapiens
gaagagugggaccgaaaga

SEQ ID NO: 1201607 - RNA, 19 nt, Homo sapiens
cgaaagagggaagaaagaa

SEQ ID NO: 1201608 - RNA, 19 nt, Homo sapiens
gacugaaugucccucuuau

SEQ ID NO: 1201609 - RNA, 19 nt, Homo sapiens
agaagggccuccauguugu

SEQ ID NO: 1201610 - RNA, 19 nt, Homo sapiens
caguucaccauuugcauua

SEQ ID NO: 1201611 - RNA, 19 nt, Homo sapiens
gcgaaagagggaagaaaga

SEQ ID NO: 1201612 - RNA, 19 nt, Homo sapiens
gaugaagaaacaacccaaa

SEQ ID NO: 1201613 - RNA, 19 nt, Homo sapiens
ggugaagggcguuaugguu

SEQ ID NO: 1201614 - RNA, 19 nt, Homo sapiens
ggacugggaagaugugaag

SEQ ID NO: 1201615 - RNA, 19 nt, Homo sapiens
gucucuggguccauuaaua

SEQ ID NO: 1201616 - RNA, 19 nt, Homo sapiens
gcagaugagcuguggaaag

SEQ ID NO: 1201617 - RNA, 19 nt, Homo sapiens
ggaaauccgggaggaaugu

SEQ ID NO: 1201618 - RNA, 19 nt, Homo sapiens
cugaugagccagcaguaua

SEQ ID NO: 1201619 - RNA, 19 nt, Homo sapiens
aaaggacgcauaucaagau

SEQ ID NO: 1201620 - RNA, 19 nt, Homo sapiens
aaagagggaagaaagaaau

SEQ ID NO: 1201621 - RNA, 19 nt, Homo sapiens
ucacuaugacugcgaaaga

SEQ ID NO: 1201622 - RNA, 19 nt, Homo sapiens
gcucuguguggucuaauuu

SEQ ID NO: 1201623 - RNA, 19 nt, Homo sapiens
ggaagaggcaaaagaacua

SEQ ID NO: 1201624 - RNA, 19 nt, Homo sapiens
ugaagagagccgccacgua

SEQ ID NO: 1201625 - RNA, 19 nt, Homo sapiens
agaaaucgauccgugucuu

SEQ ID NO: 1201626 - RNA, 19 nt, Homo sapiens
ugaaugucccucuuaugaa

SEQ ID NO: 1201627 - RNA, 19 nt, Homo sapiens
gacaggaaacccaucaaca

SEQ ID NO: 1201628 - RNA, 19 nt, Homo sapiens
ccagcaguauagaccauau

SEQ ID NO: 1201629 - RNA, 19 nt, Homo sapiens
gaagaagaugaagguuaaa

SEQ ID NO: 1201630 - RNA, 19 nt, Homo sapiens
gaccgaaagaagaagauga

SEQ ID NO: 1201631 - RNA, 19 nt, Homo sapiens
ucuguguggucuaauuuga

SEQ ID NO: 1201632 - RNA, 19 nt, Homo sapiens
cugaucggauggaugcuuu

SEQ ID NO: 1201633 - RNA, 19 nt, Homo sapiens
ggaggcaguguucccuaaa

SEQ ID NO: 1201634 - RNA, 19 nt, Homo sapiens
gagugggaccgaaagaaga

SEQ ID NO: 1201635 - RNA, 19 nt, Homo sapiens
ggacucgggccucaggaau

SEQ ID NO: 1201636 - RNA, 19 nt, Homo sapiens
gaagacugcacagggaaug

SEQ ID NO: 1201637 - RNA, 19 nt, Homo sapiens
agaacgauaugaagaccau

SEQ ID NO: 1201638 - RNA, 19 nt, Homo sapiens
aaagaaaggaucugaacag

SEQ ID NO: 1201639 - RNA, 19 nt, Homo sapiens
gaagggccuccauguugug

SEQ ID NO: 1201640 - RNA, 19 nt, Homo sapiens
ccaggauacuugagguaag

SEQ ID NO: 1201641 - RNA, 19 nt, Homo sapiens
ggucagaucauuggugaag

SEQ ID NO: 1201642 - RNA, 19 nt, Homo sapiens
gggauguuaccuugccuuu

SEQ ID NO: 1201643 - RNA, 19 nt, Homo sapiens
gaggcaguguucccuaaac

SEQ ID NO: 1201644 - RNA, 19 nt, Homo sapiens
gaaaagaaaggaucugaac

SEQ ID NO: 1201645 - RNA, 19 nt, Homo sapiens
uagaccauauaguuucuuc

SEQ ID NO: 1201646 - RNA, 19 nt, Homo sapiens
caggaaagcaaagaacaga

SEQ ID NO: 1201647 - RNA, 19 nt, Homo sapiens
ccuggucccuguggagaaa

SEQ ID NO: 1201648 - RNA, 19 nt, Homo sapiens
ugaagggcguuaugguuuu

SEQ ID NO: 1201649 - RNA, 19 nt, Homo sapiens
ucucuggguccauuaauau

SEQ ID NO: 1201650 - RNA, 19 nt, Homo sapiens
ggauuuugauaccaggaua

SEQ ID NO: 1201651 - RNA, 19 nt, Homo sapiens
gugcagaccauugcccaaa

SEQ ID NO: 1201652 - RNA, 19 nt, Homo sapiens
caaacuggacugggaagau

SEQ ID NO: 1201653 - RNA, 19 nt, Homo sapiens
gaaggauccagagccagaa

SEQ ID NO: 1201654 - RNA, 19 nt, Homo sapiens
gcauaucaagaugaagaaa

SEQ ID NO: 1201655 - RNA, 19 nt, Homo sapiens
uuugauaccaggauacuug

SEQ ID NO: 1201656 - RNA, 19 nt, Homo sapiens
gagcagugcagaccauugc

SEQ ID NO: 1201657 - RNA, 19 nt, Homo sapiens
ugaagaaacaacccaaagg

SEQ ID NO: 1201658 - RNA, 19 nt, Homo sapiens
gagcaguucaccauuugca

SEQ ID NO: 1201659 - RNA, 19 nt, Homo sapiens
gacacaaugcuguauuucu

SEQ ID NO: 1201660 - RNA, 19 nt, Homo sapiens
ggagcagugcagaccauug

SEQ ID NO: 1201661 - RNA, 19 nt, Homo sapiens
gagggaagaaagaaaucga

SEQ ID NO: 1201662 - RNA, 19 nt, Homo sapiens
ccucaucucauuucuauua

SEQ ID NO: 1201663 - RNA, 19 nt, Homo sapiens
gcccucaucucauuucuau

SEQ ID NO: 1201664 - RNA, 19 nt, Homo sapiens
ggccugcccucaucucauu

SEQ ID NO: 1201665 - RNA, 19 nt, Homo sapiens
ggagguucgugcagaucaa

SEQ ID NO: 1201666 - RNA, 19 nt, Homo sapiens
gcuggagguucgugcagau

SEQ ID NO: 1201667 - RNA, 19 nt, Homo sapiens
cugacaaccuggaaaagua

SEQ ID NO: 1201668 - RNA, 19 nt, Homo sapiens
ggcaugcuguuaauaaaua

SEQ ID NO: 1201669 - RNA, 19 nt, Homo sapiens
gaucagaaccucuucgaaa

SEQ ID NO: 1201670 - RNA, 19 nt, Homo sapiens
gcaggaagcucuggaggaa

SEQ ID NO: 1201671 - RNA, 19 nt, Homo sapiens
ggagagcucugcuucugaa

SEQ ID NO: 1201672 - RNA, 19 nt, Homo sapiens
acacacaaguggaguuuaa

SEQ ID NO: 1201673 - RNA, 19 nt, Homo sapiens
gagcgucauuguugucuuu

SEQ ID NO: 1201674 - RNA, 19 nt, Homo sapiens
agaagaagguagauccuaa

SEQ ID NO: 1201675 - RNA, 19 nt, Homo sapiens
ccucuaaaguucuuggaua

SEQ ID NO: 1201676 - RNA, 19 nt, Homo sapiens
gaaggcagguacaaugaca

SEQ ID NO: 1201677 - RNA, 19 nt, Homo sapiens
caucagggcuaugcuagaa

SEQ ID NO: 1201678 - RNA, 19 nt, Homo sapiens
gaggagagcucugcuucug

SEQ ID NO: 1201679 - RNA, 19 nt, Homo sapiens
gaagaagguagauccuaaa

SEQ ID NO: 1201680 - RNA, 19 nt, Homo sapiens
gcuaauuccuauugaagau

SEQ ID NO: 1201681 - RNA, 19 nt, Homo sapiens
caagagcuaauuccuauug

SEQ ID NO: 1201682 - RNA, 19 nt, Homo sapiens
gaaucaggcaugcuguuaa

SEQ ID NO: 1201683 - RNA, 19 nt, Homo sapiens
caaguggaguuuaagagau

SEQ ID NO: 1201684 - RNA, 19 nt, Homo sapiens
aaguggaguuuaagagaua

SEQ ID NO: 1201685 - RNA, 19 nt, Homo sapiens
caccaccgaucccuaacua

SEQ ID NO: 1201686 - RNA, 19 nt, Homo sapiens
agaaggaagggccacauua

SEQ ID NO: 1201687 - RNA, 19 nt, Homo sapiens
gaaggaagggccacauuac

SEQ ID NO: 1201688 - RNA, 19 nt, Homo sapiens
ggaaaaggcuacucaagag

SEQ ID NO: 1201689 - RNA, 19 nt, Homo sapiens
caggcaugcuguuaauaaa

SEQ ID NO: 1201690 - RNA, 19 nt, Homo sapiens
ucaggcaugcuguuaauaa

SEQ ID NO: 1201691 - RNA, 19 nt, Homo sapiens
cucaagagcuaauuccuau

SEQ ID NO: 1201692 - RNA, 19 nt, Homo sapiens
acaaugacaucaccaaggu

SEQ ID NO: 1201693 - RNA, 19 nt, Homo sapiens
gagaaggaagggccacauu

SEQ ID NO: 1201694 - RNA, 19 nt, Homo sapiens
gcuagaagcccagcaggaa

SEQ ID NO: 1201695 - RNA, 19 nt, Homo sapiens
ugaagaagugguccuugua

SEQ ID NO: 1201696 - RNA, 19 nt, Homo sapiens
ggaagggccacauuacaca

SEQ ID NO: 1201697 - RNA, 19 nt, Homo sapiens
cuaaaguucuuggauaaag

SEQ ID NO: 1201698 - RNA, 19 nt, Homo sapiens
ccagcgagcgucauuguug

SEQ ID NO: 1201699 - RNA, 19 nt, Homo sapiens
aaucaggcaugcuguuaau

SEQ ID NO: 1201700 - RNA, 19 nt, Homo sapiens
guacacacaaguggaguuu

SEQ ID NO: 1201701 - RNA, 19 nt, Homo sapiens
gaagaagugguccuuguac

SEQ ID NO: 1201702 - RNA, 19 nt, Homo sapiens
cucuaaaguucuuggauaa

SEQ ID NO: 1201703 - RNA, 19 nt, Homo sapiens
gagcuaauuccuauugaag

SEQ ID NO: 1201704 - RNA, 19 nt, Homo sapiens
aaaggcuacucaagagcua

SEQ ID NO: 1201705 - RNA, 19 nt, Homo sapiens
acacaccaccgaucccuaa

SEQ ID NO: 1201706 - RNA, 19 nt, Homo sapiens
ggaaugaccaggguucaag

SEQ ID NO: 1201707 - RNA, 19 nt, Homo sapiens
gcaaaggagcgcuugaaaa

SEQ ID NO: 1201708 - RNA, 19 nt, Homo sapiens
agaaucaggcaugcuguua

SEQ ID NO: 1201709 - RNA, 19 nt, Homo sapiens
ccaucaagcgggauccuaa

SEQ ID NO: 1201710 - RNA, 19 nt, Homo sapiens
ggaggaacugcaacuggaa

SEQ ID NO: 1201711 - RNA, 19 nt, Homo sapiens
cugaagaagugguccuugu

SEQ ID NO: 1201712 - RNA, 19 nt, Homo sapiens
agagcuaauuccuauugaa

SEQ ID NO: 1201713 - RNA, 19 nt, Homo sapiens
cagcgagcgucauuguugu

SEQ ID NO: 1201714 - RNA, 19 nt, Homo sapiens
gaaaaggaagauccgaaaa

SEQ ID NO: 1201715 - RNA, 19 nt, Homo sapiens
caaaggagcgcuugaaaag

SEQ ID NO: 1201716 - RNA, 19 nt, Homo sapiens
acaaguggaguuuaagaga

SEQ ID NO: 1201717 - RNA, 19 nt, Homo sapiens
uuuaagagauagacuugca

SEQ ID NO: 1201718 - RNA, 19 nt, Homo sapiens
ggcagacgcagcuuagaga

SEQ ID NO: 1201719 - RNA, 19 nt, Homo sapiens
gagaucagaaccucuucga

SEQ ID NO: 1201720 - RNA, 19 nt, Homo sapiens
caugagaucagaaccucuu

SEQ ID NO: 1201721 - RNA, 19 nt, Homo sapiens
gcgggauccuaaccuguuc

SEQ ID NO: 1201722 - RNA, 19 nt, Homo sapiens
uaaaguucuuggauaaagc

SEQ ID NO: 1201723 - RNA, 19 nt, Homo sapiens
gaguuuaagagauagacuu

SEQ ID NO: 1201724 - RNA, 19 nt, Homo sapiens
acacaaguggaguuuaaga

SEQ ID NO: 1201725 - RNA, 19 nt, Homo sapiens
agaagugguccuuguacaa

SEQ ID NO: 1201726 - RNA, 19 nt, Homo sapiens
aagagcuaauuccuauuga

SEQ ID NO: 1201727 - RNA, 19 nt, Homo sapiens
gcaugcuguuaauaaauac

SEQ ID NO: 1201728 - RNA, 19 nt, Homo sapiens
aagaagugguccuuguaca

SEQ ID NO: 1201729 - RNA, 19 nt, Homo sapiens
gaaugaccaggguucaagu

SEQ ID NO: 1201730 - RNA, 19 nt, Homo sapiens
aaggagcgcuugaaaagga

SEQ ID NO: 1201731 - RNA, 19 nt, Homo sapiens
acucaagagcuaauuccua

SEQ ID NO: 1201732 - RNA, 19 nt, Homo sapiens
cgucauuguugucuuucug

SEQ ID NO: 1201733 - RNA, 19 nt, Homo sapiens
gguacaaugacaucaccaa

SEQ ID NO: 1201734 - RNA, 19 nt, Homo sapiens
cugaaggcagguacaauga

SEQ ID NO: 1201735 - RNA, 19 nt, Homo sapiens
gaggaacugcaacuggaau

SEQ ID NO: 1201736 - RNA, 19 nt, Homo sapiens
aggaagcucuggaggaacu

SEQ ID NO: 1201737 - RNA, 19 nt, Homo sapiens
cagaaucaggcaugcuguu

SEQ ID NO: 1201738 - RNA, 19 nt, Homo sapiens
aagaagaagguagauccua

SEQ ID NO: 1201739 - RNA, 19 nt, Homo sapiens
gggacaccaucagggcuau

SEQ ID NO: 1201740 - RNA, 19 nt, Homo sapiens
gaagacagaucccaaagag

SEQ ID NO: 1201741 - RNA, 19 nt, Homo sapiens
ccaaagagaagauugauau

SEQ ID NO: 1201742 - RNA, 19 nt, Homo sapiens
ggaccuaccgagaguauuu

SEQ ID NO: 1201743 - RNA, 19 nt, Homo sapiens
ggacguugcuacucacuag

SEQ ID NO: 1201744 - RNA, 19 nt, Homo sapiens
agacagaucccaaagagaa

SEQ ID NO: 1201745 - RNA, 19 nt, Homo sapiens
ggagaagacagaucccaaa

SEQ ID NO: 1201746 - RNA, 19 nt, Homo sapiens
uggagcggcuggagaagua

SEQ ID NO: 1201747 - RNA, 19 nt, Homo sapiens
aagagaagauugauauugg

SEQ ID NO: 1201748 - RNA, 19 nt, Homo sapiens
caacagugacaucgacuug

SEQ ID NO: 1201749 - RNA, 19 nt, Homo sapiens
gggagccgguguuugaguu

SEQ ID NO: 1201750 - RNA, 19 nt, Homo sapiens
ggagccagaugcugaguac

SEQ ID NO: 1201751 - RNA, 19 nt, Homo sapiens
ggauugaucggcagcaaga

SEQ ID NO: 1201752 - RNA, 19 nt, Homo sapiens
gggcuuggagugaaaguga

SEQ ID NO: 1201753 - RNA, 19 nt, Homo sapiens
cagcaagaguaaagacaca

SEQ ID NO: 1201754 - RNA, 19 nt, Homo sapiens
ccaccuauggcaucuacua

SEQ ID NO: 1201755 - RNA, 19 nt, Homo sapiens
cuacaagaaacaccaagaa

SEQ ID NO: 1201756 - RNA, 19 nt, Homo sapiens
gggugaggaugaccugaug

SEQ ID NO: 1201757 - RNA, 19 nt, Homo sapiens
uaccuccacuggcugcuaa

SEQ ID NO: 1201758 - RNA, 19 nt, Homo sapiens
gucaugagcccaccuaugg

SEQ ID NO: 1201759 - RNA, 19 nt, Homo sapiens
uacaagaaacaccaagaaa

SEQ ID NO: 1201760 - RNA, 19 nt, Homo sapiens
gccaugggcgagcauauga

SEQ ID NO: 1201761 - RNA, 19 nt, Homo sapiens
cagaagagggcuccuugug

SEQ ID NO: 1201762 - RNA, 19 nt, Homo sapiens
caagaaacaccaagaaacc

SEQ ID NO: 1201763 - RNA, 19 nt, Homo sapiens
gagaagacagaucccaaag

SEQ ID NO: 1201764 - RNA, 19 nt, Homo sapiens
gagccagagugugcgcauu

SEQ ID NO: 1201765 - RNA, 19 nt, Homo sapiens
ggccgaugcccaacaguga

SEQ ID NO: 1201766 - RNA, 19 nt, Homo sapiens
ggaccagccgauugacuuc

SEQ ID NO: 1201767 - RNA, 19 nt, Homo sapiens
ccugaugccuguguacugu

SEQ ID NO: 1201768 - RNA, 19 nt, Homo sapiens
ccuauggcaucuacuaagg

SEQ ID NO: 1201769 - RNA, 19 nt, Homo sapiens
gcagaagagggcuccuugu

SEQ ID NO: 1201770 - RNA, 19 nt, Homo sapiens
acagugacaucgacuugag

SEQ ID NO: 1201771 - RNA, 19 nt, Homo sapiens
ggugaccuaugaggcagaa

SEQ ID NO: 1201772 - RNA, 19 nt, Homo sapiens
uuucagagcaugggauuga

SEQ ID NO: 1201773 - RNA, 19 nt, Homo sapiens
aaacaccaagaaaccauga

SEQ ID NO: 1201774 - RNA, 19 nt, Homo sapiens
ccaagcagaguccggaauc

SEQ ID NO: 1201775 - RNA, 19 nt, Homo sapiens
gcccaccuauggcaucuac

SEQ ID NO: 1201776 - RNA, 19 nt, Homo sapiens
acaagaaacaccaagaaac

SEQ ID NO: 1201777 - RNA, 19 nt, Homo sapiens
agaagacagaucccaaaga

SEQ ID NO: 1201778 - RNA, 19 nt, Homo sapiens
aagcaggaccagccgauug

SEQ ID NO: 1201779 - RNA, 19 nt, Homo sapiens
gaucccaaagagaagauug

SEQ ID NO: 1201780 - RNA, 19 nt, Homo sapiens
uggcggaccuaccgagagu

SEQ ID NO: 1201781 - RNA, 19 nt, Homo sapiens
gccagagugugcgcauuuc

SEQ ID NO: 1201782 - RNA, 19 nt, Homo sapiens
ugcgggagccgguguuuga

SEQ ID NO: 1201783 - RNA, 19 nt, Homo sapiens
uccacuggcugcuaaccaa

SEQ ID NO: 1201784 - RNA, 19 nt, Homo sapiens
ugaccuaugaggcagaaga

SEQ ID NO: 1201785 - RNA, 19 nt, Homo sapiens
gucucgaucuccugacuuc

SEQ ID NO: 1201786 - RNA, 19 nt, Homo sapiens
gacccaacagcuacuggaa

SEQ ID NO: 1201787 - RNA, 19 nt, Homo sapiens
caccuauggcaucuacuaa

SEQ ID NO: 1201788 - RNA, 19 nt, Homo sapiens
gcggaccuaccgagaguau

SEQ ID NO: 1201789 - RNA, 19 nt, Homo sapiens
cccaaagagaagauugaua

SEQ ID NO: 1201790 - RNA, 19 nt, Homo sapiens
cccagggcuuggagugaaa

SEQ ID NO: 1201791 - RNA, 19 nt, Homo sapiens
gagcccaccuauggcaucu

SEQ ID NO: 1201792 - RNA, 19 nt, Homo sapiens
ccagccggcuuguccuucu

SEQ ID NO: 1201793 - RNA, 19 nt, Homo sapiens
ggagaaugguuguaucuua

SEQ ID NO: 1201794 - RNA, 19 nt, Homo sapiens
gaaagugacuggaagcaaa

SEQ ID NO: 1201795 - RNA, 19 nt, Homo sapiens
gagaaugguuguaucuuau

SEQ ID NO: 1201796 - RNA, 19 nt, Homo sapiens
ggaauuaucacaucaagga

SEQ ID NO: 1201797 - RNA, 19 nt, Homo sapiens
ggugguacgucuacuguaa

SEQ ID NO: 1201798 - RNA, 19 nt, Homo sapiens
ggaaggaauuaucacauca

SEQ ID NO: 1201799 - RNA, 19 nt, Homo sapiens
gacauugcguuaucuuauu

SEQ ID NO: 1201800 - RNA, 19 nt, Homo sapiens
aaacaagacuguccuuaag

SEQ ID NO: 1201801 - RNA, 19 nt, Homo sapiens
agacagauguagacccuuu

SEQ ID NO: 1201802 - RNA, 19 nt, Homo sapiens
gcaaacgcccuaaaaguua

SEQ ID NO: 1201803 - RNA, 19 nt, Homo sapiens
uauagaagacauugcguua

SEQ ID NO: 1201804 - RNA, 19 nt, Homo sapiens
acaagacuguccuuaagaa

SEQ ID NO: 1201805 - RNA, 19 nt, Homo sapiens
uagaagacauugcguuauc

SEQ ID NO: 1201806 - RNA, 19 nt, Homo sapiens
ggugaacccucugcucuau

SEQ ID NO: 1201807 - RNA, 19 nt, Homo sapiens
aaaguuacccaucacguuu

SEQ ID NO: 1201808 - RNA, 19 nt, Homo sapiens
gaaggaauuaucacaucaa

SEQ ID NO: 1201809 - RNA, 19 nt, Homo sapiens
ccaucacguuucaguguaa

SEQ ID NO: 1201810 - RNA, 19 nt, Homo sapiens
caguguaaaugaguaacua

SEQ ID NO: 1201811 - RNA, 19 nt, Homo sapiens
gaaugguuguaucuuaugg

SEQ ID NO: 1201812 - RNA, 19 nt, Homo sapiens
ccaaaacguuccaacuaaa

SEQ ID NO: 1201813 - RNA, 19 nt, Homo sapiens
aaaauagaccuuccgaaua

SEQ ID NO: 1201814 - RNA, 19 nt, Homo sapiens
gcacaagcagagacagaug

SEQ ID NO: 1201815 - RNA, 19 nt, Homo sapiens
uggaaggaauuaucacauc

SEQ ID NO: 1201816 - RNA, 19 nt, Homo sapiens
ugcguuaucuuauuuccaa

SEQ ID NO: 1201817 - RNA, 19 nt, Homo sapiens
agacauugcguuaucuuau

SEQ ID NO: 1201818 - RNA, 19 nt, Homo sapiens
ggaaagugacuggaagcaa

SEQ ID NO: 1201819 - RNA, 19 nt, Homo sapiens
cacaacauggcaaaucuuu

SEQ ID NO: 1201820 - RNA, 19 nt, Homo sapiens
ccucuccacauuucuauuu

SEQ ID NO: 1201821 - RNA, 19 nt, Homo sapiens
ggaagcaaacgcccuaaaa

SEQ ID NO: 1201822 - RNA, 19 nt, Homo sapiens
uaaaauagaccuuccgaau

SEQ ID NO: 1201823 - RNA, 19 nt, Homo sapiens
ugaacccucugcucuaucu

SEQ ID NO: 1201824 - RNA, 19 nt, Homo sapiens
gaguaacuauagaagacau

SEQ ID NO: 1201825 - RNA, 19 nt, Homo sapiens
cccaucacguuucagugua

SEQ ID NO: 1201826 - RNA, 19 nt, Homo sapiens
cgagcccucuccacauuuc

SEQ ID NO: 1201827 - RNA, 19 nt, Homo sapiens
ucgcaucacuugggagaau

SEQ ID NO: 1201828 - RNA, 19 nt, Homo sapiens
uccaaaacguuccaacuaa

SEQ ID NO: 1201829 - RNA, 19 nt, Homo sapiens
cucgagcccucuccacauu

SEQ ID NO: 1201830 - RNA, 19 nt, Homo sapiens
aagcagagacagauguaga

SEQ ID NO: 1201831 - RNA, 19 nt, Homo sapiens
acaagcagagacagaugua

SEQ ID NO: 1201832 - RNA, 19 nt, Homo sapiens
acuguuaccuggugaagag

SEQ ID NO: 1201833 - RNA, 19 nt, Homo sapiens
uuaagaagcgcugcaagga

SEQ ID NO: 1201834 - RNA, 19 nt, Homo sapiens
caucacguuucaguguaaa

SEQ ID NO: 1201835 - RNA, 19 nt, Homo sapiens
aaaacaagacuguccuuaa

SEQ ID NO: 1201836 - RNA, 19 nt, Homo sapiens
caaaacguuccaacuaaaa

SEQ ID NO: 1201837 - RNA, 19 nt, Homo sapiens
guaacuauagaagacauug

SEQ ID NO: 1201838 - RNA, 19 nt, Homo sapiens
guuucaguguaaaugagua

SEQ ID NO: 1201839 - RNA, 19 nt, Homo sapiens
ccacaacauggcaaaucuu

SEQ ID NO: 1201840 - RNA, 19 nt, Homo sapiens
gaagcaaacgcccuaaaag

SEQ ID NO: 1201841 - RNA, 19 nt, Homo sapiens
agaagacauugcguuaucu

SEQ ID NO: 1201842 - RNA, 19 nt, Homo sapiens
aaggaauuaucacaucaag

SEQ ID NO: 1201843 - RNA, 19 nt, Homo sapiens
uuacaaagcuuaucacauc

SEQ ID NO: 1201844 - RNA, 19 nt, Homo sapiens
gcaagucgcugagccauug

SEQ ID NO: 1201845 - RNA, 19 nt, Homo sapiens
ccaaagaacaguacaaaga

SEQ ID NO: 1201846 - RNA, 19 nt, Homo sapiens
gaucucaggcaucggauua

SEQ ID NO: 1201847 - RNA, 19 nt, Homo sapiens
gcgcagaacuacaacuuca

SEQ ID NO: 1201848 - RNA, 19 nt, Homo sapiens
caaagaacaguacaaagaa

SEQ ID NO: 1201849 - RNA, 19 nt, Homo sapiens
cggauuauuucuucuguaa

SEQ ID NO: 1201850 - RNA, 19 nt, Homo sapiens
gaccuugccuggcgcuauu

SEQ ID NO: 1201851 - RNA, 19 nt, Homo sapiens
ugagugcucuccauauugu

SEQ ID NO: 1201852 - RNA, 19 nt, Homo sapiens
ccugagugcucuccauauu

SEQ ID NO: 1201853 - RNA, 19 nt, Homo sapiens
gaccaaagaacaguacaaa

SEQ ID NO: 1201854 - RNA, 19 nt, Homo sapiens
gcaaggcucgcgggaauga

SEQ ID NO: 1201855 - RNA, 19 nt, Homo sapiens
ggcaucggauuauuucuuc

SEQ ID NO: 1201856 - RNA, 19 nt, Homo sapiens
guuaggagaaacuacauuu

SEQ ID NO: 1201857 - RNA, 19 nt, Homo sapiens
caaagcuuaucacauccaa

SEQ ID NO: 1201858 - RNA, 19 nt, Homo sapiens
gaccugagugcucuccaua

SEQ ID NO: 1201859 - RNA, 19 nt, Homo sapiens
ggaccugagugcucuccau

SEQ ID NO: 1201860 - RNA, 19 nt, Homo sapiens
aacuacaacuucaggguuu

SEQ ID NO: 1201861 - RNA, 19 nt, Homo sapiens
acaaagaacauccguguac

SEQ ID NO: 1201862 - RNA, 19 nt, Homo sapiens
caacagaccaaagaacagu

SEQ ID NO: 1201863 - RNA, 19 nt, Homo sapiens
gaacgccucggaccugagu

SEQ ID NO: 1201864 - RNA, 19 nt, Homo sapiens
ucucaggcaucggauuauu

SEQ ID NO: 1201865 - RNA, 19 nt, Homo sapiens
gaacaguacaaagaacauc

SEQ ID NO: 1201866 - RNA, 19 nt, Homo sapiens
aaagaacaguacaaagaac

SEQ ID NO: 1201867 - RNA, 19 nt, Homo sapiens
caacaucaaacgcaagaac

SEQ ID NO: 1201868 - RNA, 19 nt, Homo sapiens
ucaggcaucggauuauuuc

SEQ ID NO: 1201869 - RNA, 19 nt, Homo sapiens
gcaacagaccaaagaacag

SEQ ID NO: 1201870 - RNA, 19 nt, Homo sapiens
ggaccuugccuggcgcuau

SEQ ID NO: 1201871 - RNA, 19 nt, Homo sapiens
gcuaccuguugguguguau

SEQ ID NO: 1201872 - RNA, 19 nt, Homo sapiens
acauuucccauaauccuuu

SEQ ID NO: 1201873 - RNA, 19 nt, Homo sapiens
ucggauuauuucuucugua

SEQ ID NO: 1201874 - RNA, 19 nt, Homo sapiens
gacuaccgacuaccuacaa

SEQ ID NO: 1201875 - RNA, 19 nt, Homo sapiens
gaguaucagccgagcaaca

SEQ ID NO: 1201876 - RNA, 19 nt, Homo sapiens
cugcggauauggcugucuu

SEQ ID NO: 1201877 - RNA, 19 nt, Homo sapiens
gggacccacugcggauaug

SEQ ID NO: 1201878 - RNA, 19 nt, Homo sapiens
gaaguuaaccgguguagga

SEQ ID NO: 1201879 - RNA, 19 nt, Homo sapiens
gaaaucagacgacagauag

SEQ ID NO: 1201880 - RNA, 19 nt, Homo sapiens
gcaaggagacugcagaaau

SEQ ID NO: 1201881 - RNA, 19 nt, Homo sapiens
gcagaagcuuauuaaaguu

SEQ ID NO: 1201882 - RNA, 19 nt, Homo sapiens
caaggagacugcagaaauc

SEQ ID NO: 1201883 - RNA, 19 nt, Homo sapiens
gcagaaaucagacgacaga

SEQ ID NO: 1201884 - RNA, 19 nt, Homo sapiens
uuacagagccagcaaauga

SEQ ID NO: 1201885 - RNA, 19 nt, Homo sapiens
gaagaaauccgcagaagcu

SEQ ID NO: 1201886 - RNA, 19 nt, Homo sapiens
cgcagaagcuuauuaaagu

SEQ ID NO: 1201887 - RNA, 19 nt, Homo sapiens
gaaauccgcagaagcuuau

SEQ ID NO: 1201888 - RNA, 19 nt, Homo sapiens
ugaauguggucaccugaaa

SEQ ID NO: 1201889 - RNA, 19 nt, Homo sapiens
gaauugacaccaaagaugu

SEQ ID NO: 1201890 - RNA, 19 nt, Homo sapiens
acagaaacauguccuuugu

SEQ ID NO: 1201891 - RNA, 19 nt, Homo sapiens
gagaagaaauccgcagaag

SEQ ID NO: 1201892 - RNA, 19 nt, Homo sapiens
ccaaaggcucaauggauua

SEQ ID NO: 1201893 - RNA, 19 nt, Homo sapiens
guuaaccgguguaggagaa

SEQ ID NO: 1201894 - RNA, 19 nt, Homo sapiens
gcccagccauguuuacaga

SEQ ID NO: 1201895 - RNA, 19 nt, Homo sapiens
agaaaucagacgacagaua

SEQ ID NO: 1201896 - RNA, 19 nt, Homo sapiens
guggucaccugaaacagaa

SEQ ID NO: 1201897 - RNA, 19 nt, Homo sapiens
ugaaauagaggaagauucu

SEQ ID NO: 1201898 - RNA, 19 nt, Homo sapiens
ggagaagaaauccgcagaa

SEQ ID NO: 1201899 - RNA, 19 nt, Homo sapiens
uagagacuguggugcugua

SEQ ID NO: 1201900 - RNA, 19 nt, Homo sapiens
gggaccagcauuagcagua

SEQ ID NO: 1201901 - RNA, 19 nt, Homo sapiens
cauagacguuuguccugaa

SEQ ID NO: 1201902 - RNA, 19 nt, Homo sapiens
agaaauccgcagaagcuua

SEQ ID NO: 1201903 - RNA, 19 nt, Homo sapiens
gacgcaccauugaaguuaa

SEQ ID NO: 1201904 - RNA, 19 nt, Homo sapiens
guacagggcccagccaugu

SEQ ID NO: 1201905 - RNA, 19 nt, Homo sapiens
gaucauugaacgagacaga

SEQ ID NO: 1201906 - RNA, 19 nt, Homo sapiens
ggagacugcagaaaucaga

SEQ ID NO: 1201907 - RNA, 19 nt, Homo sapiens
aaacagaaacauguccuuu

SEQ ID NO: 1201908 - RNA, 19 nt, Homo sapiens
gaaacagaaacauguccuu

SEQ ID NO: 1201909 - RNA, 19 nt, Homo sapiens
agaacaacauagacguuug

SEQ ID NO: 1201910 - RNA, 19 nt, Homo sapiens
agacgcaccauugaaguua

SEQ ID NO: 1201911 - RNA, 19 nt, Homo sapiens
gacaccgucugaacaagau

SEQ ID NO: 1201912 - RNA, 19 nt, Homo sapiens
agacguuuguccugaaugu

SEQ ID NO: 1201913 - RNA, 19 nt, Homo sapiens
uaagaacaacauagacguu

SEQ ID NO: 1201914 - RNA, 19 nt, Homo sapiens
gaacaagaucagggcaaga

SEQ ID NO: 1201915 - RNA, 19 nt, Homo sapiens
ccgcagaagcuuauuaaag

SEQ ID NO: 1201916 - RNA, 19 nt, Homo sapiens
acagagccagcaaaugaua

SEQ ID NO: 1201917 - RNA, 19 nt, Homo sapiens
ugacaccaaagauguuaaa

SEQ ID NO: 1201918 - RNA, 19 nt, Homo sapiens
ggaccagcauuagcaguac

SEQ ID NO: 1201919 - RNA, 19 nt, Homo sapiens
agaauugacaccaaagaug

SEQ ID NO: 1201920 - RNA, 19 nt, Homo sapiens
caaaggcucaauggauuau

SEQ ID NO: 1201921 - RNA, 19 nt, Homo sapiens
gggagugcuucgaaacuac

SEQ ID NO: 1201922 - RNA, 19 nt, Homo sapiens
cucaauggauuauguuucu

SEQ ID NO: 1201923 - RNA, 19 nt, Homo sapiens
uuaaggcucccaccauaga

SEQ ID NO: 1201924 - RNA, 19 nt, Homo sapiens
gcucaauggauuauguuuc

SEQ ID NO: 1201925 - RNA, 19 nt, Homo sapiens
uaacacauucuuucuaagc

SEQ ID NO: 1201926 - RNA, 19 nt, Homo sapiens
caccaaagauguuaaaagg

SEQ ID NO: 1201927 - RNA, 19 nt, Homo sapiens
acccagaauugacaccaaa

SEQ ID NO: 1201928 - RNA, 19 nt, Homo sapiens
ucauugaacgagacagaaa

SEQ ID NO: 1201929 - RNA, 19 nt, Homo sapiens
aaauagacgcaccauugaa

SEQ ID NO: 1201930 - RNA, 19 nt, Homo sapiens
ccagaauugacaccaaaga

SEQ ID NO: 1201931 - RNA, 19 nt, Homo sapiens
aagaacaacauagacguuu

SEQ ID NO: 1201932 - RNA, 19 nt, Homo sapiens
acagggcccagccauguuu

SEQ ID NO: 1201933 - RNA, 19 nt, Homo sapiens
ggcaagaggaucauugaac

SEQ ID NO: 1201934 - RNA, 19 nt, Homo sapiens
gacgacagauagggaagca

SEQ ID NO: 1201935 - RNA, 19 nt, Homo sapiens
gaccagcauuagcaguaca

SEQ ID NO: 1201936 - RNA, 19 nt, Homo sapiens
cuacugggagcgacugcua

SEQ ID NO: 1201937 - RNA, 19 nt, Homo sapiens
aaggcucaauggauuaugu

SEQ ID NO: 1201938 - RNA, 19 nt, Homo sapiens
gcaguuuugugugggauaa

SEQ ID NO: 1201939 - RNA, 19 nt, Homo sapiens
cagaauugacaccaaagau

SEQ ID NO: 1201940 - RNA, 19 nt, Homo sapiens
gggcaagaggaucauugaa

SEQ ID NO: 1201941 - RNA, 19 nt, Homo sapiens
ggggagugcuucgaaacua

SEQ ID NO: 1201942 - RNA, 19 nt, Homo sapiens
uaaccgguguaggagaaga

SEQ ID NO: 1201943 - RNA, 19 nt, Homo sapiens
caagaggaucauugaacga

SEQ ID NO: 1201944 - RNA, 19 nt, Homo sapiens
aacagaaacauguccuuug

SEQ ID NO: 1201945 - RNA, 19 nt, Homo sapiens
ugugggauaauuugaagaa

SEQ ID NO: 1201946 - RNA, 19 nt, Homo sapiens
acagauagggaagcaagaa

SEQ ID NO: 1201947 - RNA, 19 nt, Homo sapiens
aauccgcagaagcuuauua

SEQ ID NO: 1201948 - RNA, 19 nt, Homo sapiens
uagacgcaccauugaaguu

SEQ ID NO: 1201949 - RNA, 19 nt, Homo sapiens
cacccagaauugacaccaa

SEQ ID NO: 1201950 - RNA, 19 nt, Homo sapiens
caccugaaacagaaacaug

SEQ ID NO: 1201951 - RNA, 19 nt, Homo sapiens
ggaaggaggucacaccaau

SEQ ID NO: 1201952 - RNA, 19 nt, Homo sapiens
caaaggagguaguugcaaa

SEQ ID NO: 1201953 - RNA, 19 nt, Homo sapiens
ggacaaaggacaucaagga

SEQ ID NO: 1201954 - RNA, 19 nt, Homo sapiens
agaagaagcugccaagaag

SEQ ID NO: 1201955 - RNA, 19 nt, Homo sapiens
ggaggucacaccaauauga

SEQ ID NO: 1201956 - RNA, 19 nt, Homo sapiens
gaaggaggucacaccaaua

SEQ ID NO: 1201957 - RNA, 19 nt, Homo sapiens
ggacaucaaggaaggcauu

SEQ ID NO: 1201958 - RNA, 19 nt, Homo sapiens
ggaccucaguucagaagag

SEQ ID NO: 1201959 - RNA, 19 nt, Homo sapiens
ggucacaccaauaugauga

SEQ ID NO: 1201960 - RNA, 19 nt, Homo sapiens
ugagauugcccgcaucaaa

SEQ ID NO: 1201961 - RNA, 19 nt, Homo sapiens
ugaagcauguguaugagau

SEQ ID NO: 1201962 - RNA, 19 nt, Homo sapiens
gcauuccucugccuaccaa

SEQ ID NO: 1201963 - RNA, 19 nt, Homo sapiens
ucaaugagaggacaaagga

SEQ ID NO: 1201964 - RNA, 19 nt, Homo sapiens
gacaaaggacaucaaggaa

SEQ ID NO: 1201965 - RNA, 19 nt, Homo sapiens
aagaagaagcugccaagaa

SEQ ID NO: 1201966 - RNA, 19 nt, Homo sapiens
gcuugcagcuuuccagaag

SEQ ID NO: 1201967 - RNA, 19 nt, Homo sapiens
gagaggcguuuccaucaac

SEQ ID NO: 1201968 - RNA, 19 nt, Homo sapiens
gagauugcccgcaucaaag

SEQ ID NO: 1201969 - RNA, 19 nt, Homo sapiens
ccaacucccagauuucaaa

SEQ ID NO: 1201970 - RNA, 19 nt, Homo sapiens
cccaccaacucccagauuu

SEQ ID NO: 1201971 - RNA, 19 nt, Homo sapiens
ccuugaagcauguguauga

SEQ ID NO: 1201972 - RNA, 19 nt, Homo sapiens
ccaauaugaugaugguuuu

SEQ ID NO: 1201973 - RNA, 19 nt, Homo sapiens
gcauucgcguggugaagga

SEQ ID NO: 1201974 - RNA, 19 nt, Homo sapiens
ucagaaggaggcagauuug

SEQ ID NO: 1201975 - RNA, 19 nt, Homo sapiens
agagaggcguuuccaucaa

SEQ ID NO: 1201976 - RNA, 19 nt, Homo sapiens
gcguuuccaucaaccaguu

SEQ ID NO: 1201977 - RNA, 19 nt, Homo sapiens
cagagaggcguuuccauca

SEQ ID NO: 1201978 - RNA, 19 nt, Homo sapiens
gaaggaccucaguucagaa

SEQ ID NO: 1201979 - RNA, 19 nt, Homo sapiens
gaagcauguguaugagauu

SEQ ID NO: 1201980 - RNA, 19 nt, Homo sapiens
uggcaggccuggugaccuu

SEQ ID NO: 1201981 - RNA, 19 nt, Homo sapiens
gaagaagcugccaagaagu

SEQ ID NO: 1201982 - RNA, 19 nt, Homo sapiens
cauuugcccugcaggaugu

SEQ ID NO: 1201983 - RNA, 19 nt, Homo sapiens
ugcaaggaguucaaugaga

SEQ ID NO: 1201984 - RNA, 19 nt, Homo sapiens
aagcauguguaugagauug

SEQ ID NO: 1201985 - RNA, 19 nt, Homo sapiens
gaccuugaagcauguguau

SEQ ID NO: 1201986 - RNA, 19 nt, Homo sapiens
ucacaccaauaugaugaug

SEQ ID NO: 1201987 - RNA, 19 nt, Homo sapiens
aaggaggucacaccaauau

SEQ ID NO: 1201988 - RNA, 19 nt, Homo sapiens
acucccagauuucaaagga

SEQ ID NO: 1201989 - RNA, 19 nt, Homo sapiens
cuaccaagauuuuagugaa

SEQ ID NO: 1201990 - RNA, 19 nt, Homo sapiens
gaggucacaccaauaugau

SEQ ID NO: 1201991 - RNA, 19 nt, Homo sapiens
gcccacuguuuccuacuuc

SEQ ID NO: 1201992 - RNA, 19 nt, Homo sapiens
ggagguaguugcaaaagcu

SEQ ID NO: 1201993 - RNA, 19 nt, Homo sapiens
ccaccaacucccagauuuc

SEQ ID NO: 1201994 - RNA, 19 nt, Homo sapiens
caagaagaagcugccaaga

SEQ ID NO: 1201995 - RNA, 19 nt, Homo sapiens
gaggacaaaggacaucaag

SEQ ID NO: 1201996 - RNA, 19 nt, Homo sapiens
gcucagaaggaggcagauu

SEQ ID NO: 1201997 - RNA, 19 nt, Homo sapiens
aagaagcugccaagaagug

SEQ ID NO: 1201998 - RNA, 19 nt, Homo sapiens
cucagaaggaggcagauuu

SEQ ID NO: 1201999 - RNA, 19 nt, Homo sapiens
caccaacucccagauuuca

SEQ ID NO: 1202000 - RNA, 19 nt, Homo sapiens
uugcagcuuuccagaagga

SEQ ID NO: 1202001 - RNA, 19 nt, Homo sapiens
ggaaggaggucacaccaau

SEQ ID NO: 1202002 - RNA, 19 nt, Homo sapiens
caaaggagguaguugcaaa

SEQ ID NO: 1202003 - RNA, 19 nt, Homo sapiens
ggacaaaggacaucaagga

SEQ ID NO: 1202004 - RNA, 19 nt, Homo sapiens
agaagaagcugccaagaag

SEQ ID NO: 1202005 - RNA, 19 nt, Homo sapiens
ggaggucacaccaauauga

SEQ ID NO: 1202006 - RNA, 19 nt, Homo sapiens
gaaggaggucacaccaaua

SEQ ID NO: 1202007 - RNA, 19 nt, Homo sapiens
ggacaucaaggaaggcauu

SEQ ID NO: 1202008 - RNA, 19 nt, Homo sapiens
gagagaggcguuuccauca

SEQ ID NO: 1202009 - RNA, 19 nt, Homo sapiens
ggaccucaguucagaagag

SEQ ID NO: 1202010 - RNA, 19 nt, Homo sapiens
ggucacaccaauaugauga

SEQ ID NO: 1202011 - RNA, 19 nt, Homo sapiens
ugagauugcccgcaucaaa

SEQ ID NO: 1202012 - RNA, 19 nt, Homo sapiens
ugaagcauguguaugagau

SEQ ID NO: 1202013 - RNA, 19 nt, Homo sapiens
gcauuccucugccuaccaa

SEQ ID NO: 1202014 - RNA, 19 nt, Homo sapiens
ucaaugagaggacaaagga

SEQ ID NO: 1202015 - RNA, 19 nt, Homo sapiens
gacaaaggacaucaaggaa

SEQ ID NO: 1202016 - RNA, 19 nt, Homo sapiens
aagaagaagcugccaagaa

SEQ ID NO: 1202017 - RNA, 19 nt, Homo sapiens
gcuugcagcuuuccagaag

SEQ ID NO: 1202018 - RNA, 19 nt, Homo sapiens
gagaggcguuuccaucaac

SEQ ID NO: 1202019 - RNA, 19 nt, Homo sapiens
gagauugcccgcaucaaag

SEQ ID NO: 1202020 - RNA, 19 nt, Homo sapiens
ccaacucccagauuucaaa

SEQ ID NO: 1202021 - RNA, 19 nt, Homo sapiens
cccaccaacucccagauuu

SEQ ID NO: 1202022 - RNA, 19 nt, Homo sapiens
ccuugaagcauguguauga

SEQ ID NO: 1202023 - RNA, 19 nt, Homo sapiens
ccaauaugaugaugguuuu

SEQ ID NO: 1202024 - RNA, 19 nt, Homo sapiens
gcauucgcguggugaagga

SEQ ID NO: 1202025 - RNA, 19 nt, Homo sapiens
ucagaaggaggcagauuug

SEQ ID NO: 1202026 - RNA, 19 nt, Homo sapiens
agagaggcguuuccaucaa

SEQ ID NO: 1202027 - RNA, 19 nt, Homo sapiens
gcguuuccaucaaccaguu

SEQ ID NO: 1202028 - RNA, 19 nt, Homo sapiens
gaaggaccucaguucagaa

SEQ ID NO: 1202029 - RNA, 19 nt, Homo sapiens
gaagcauguguaugagauu

SEQ ID NO: 1202030 - RNA, 19 nt, Homo sapiens
uggcaggccuggugaccuu

SEQ ID NO: 1202031 - RNA, 19 nt, Homo sapiens
gaagaagcugccaagaagu

SEQ ID NO: 1202032 - RNA, 19 nt, Homo sapiens
cauuugcccugcaggaugu

SEQ ID NO: 1202033 - RNA, 19 nt, Homo sapiens
ugcaaggaguucaaugaga

SEQ ID NO: 1202034 - RNA, 19 nt, Homo sapiens
aagcauguguaugagauug

SEQ ID NO: 1202035 - RNA, 19 nt, Homo sapiens
gaccuugaagcauguguau

SEQ ID NO: 1202036 - RNA, 19 nt, Homo sapiens
ucacaccaauaugaugaug

SEQ ID NO: 1202037 - RNA, 19 nt, Homo sapiens
aaggaggucacaccaauau

SEQ ID NO: 1202038 - RNA, 19 nt, Homo sapiens
acucccagauuucaaagga

SEQ ID NO: 1202039 - RNA, 19 nt, Homo sapiens
cuaccaagauuuuagugaa

SEQ ID NO: 1202040 - RNA, 19 nt, Homo sapiens
gaggucacaccaauaugau

SEQ ID NO: 1202041 - RNA, 19 nt, Homo sapiens
gcccacuguuuccuacuuc

SEQ ID NO: 1202042 - RNA, 19 nt, Homo sapiens
ggagguaguugcaaaagcu

SEQ ID NO: 1202043 - RNA, 19 nt, Homo sapiens
ccaccaacucccagauuuc

SEQ ID NO: 1202044 - RNA, 19 nt, Homo sapiens
caagaagaagcugccaaga

SEQ ID NO: 1202045 - RNA, 19 nt, Homo sapiens
gaggacaaaggacaucaag

SEQ ID NO: 1202046 - RNA, 19 nt, Homo sapiens
gcucagaaggaggcagauu

SEQ ID NO: 1202047 - RNA, 19 nt, Homo sapiens
aagaagcugccaagaagug

SEQ ID NO: 1202048 - RNA, 19 nt, Homo sapiens
cucagaaggaggcagauuu

SEQ ID NO: 1202049 - RNA, 19 nt, Homo sapiens
caccaacucccagauuuca

SEQ ID NO: 1202050 - RNA, 19 nt, Homo sapiens
uugcagcuuuccagaagga

SEQ ID NO: 1202051 - RNA, 19 nt, Homo sapiens
ggaaggaggucacaccaau

SEQ ID NO: 1202052 - RNA, 19 nt, Homo sapiens
caaaggagguaguugcaaa

SEQ ID NO: 1202053 - RNA, 19 nt, Homo sapiens
ggacaaaggacaucaagga

SEQ ID NO: 1202054 - RNA, 19 nt, Homo sapiens
agaagaagcugccaagaag

SEQ ID NO: 1202055 - RNA, 19 nt, Homo sapiens
ggaggucacaccaauauga

SEQ ID NO: 1202056 - RNA, 19 nt, Homo sapiens
gaaggaggucacaccaaua

SEQ ID NO: 1202057 - RNA, 19 nt, Homo sapiens
ggacaucaaggaaggcauu

SEQ ID NO: 1202058 - RNA, 19 nt, Homo sapiens
ucuaagaaauggaaagauc

SEQ ID NO: 1202059 - RNA, 19 nt, Homo sapiens
ugggagaaguucaguguga

SEQ ID NO: 1202060 - RNA, 19 nt, Homo sapiens
ggucacaccaauaugauga

SEQ ID NO: 1202061 - RNA, 19 nt, Homo sapiens
ugagauugcccgcaucaaa

SEQ ID NO: 1202062 - RNA, 19 nt, Homo sapiens
ugaagcauguguaugagau

SEQ ID NO: 1202063 - RNA, 19 nt, Homo sapiens
gcauuccucugccuaccaa

SEQ ID NO: 1202064 - RNA, 19 nt, Homo sapiens
ucaaugagaggacaaagga

SEQ ID NO: 1202065 - RNA, 19 nt, Homo sapiens
gaaagaucuccaugaagga

SEQ ID NO: 1202066 - RNA, 19 nt, Homo sapiens
gacaaaggacaucaaggaa

SEQ ID NO: 1202067 - RNA, 19 nt, Homo sapiens
aagaagaagcugccaagaa

SEQ ID NO: 1202068 - RNA, 19 nt, Homo sapiens
gcuugcagcuuuccagaag

SEQ ID NO: 1202069 - RNA, 19 nt, Homo sapiens
gagaggcguuuccaucaac

SEQ ID NO: 1202070 - RNA, 19 nt, Homo sapiens
gauccaagugggagaaguu

SEQ ID NO: 1202071 - RNA, 19 nt, Homo sapiens
gagauugcccgcaucaaag

SEQ ID NO: 1202072 - RNA, 19 nt, Homo sapiens
ccaacucccagauuucaaa

SEQ ID NO: 1202073 - RNA, 19 nt, Homo sapiens
cccaccaacucccagauuu

SEQ ID NO: 1202074 - RNA, 19 nt, Homo sapiens
ccuugaagcauguguauga

SEQ ID NO: 1202075 - RNA, 19 nt, Homo sapiens
ccaauaugaugaugguuuu

SEQ ID NO: 1202076 - RNA, 19 nt, Homo sapiens
gagccucaguucagaagag

SEQ ID NO: 1202077 - RNA, 19 nt, Homo sapiens
gcauucgcguggugaagga

SEQ ID NO: 1202078 - RNA, 19 nt, Homo sapiens
ucagaaggaggcagauuug

SEQ ID NO: 1202079 - RNA, 19 nt, Homo sapiens
agagaggcguuuccaucaa

SEQ ID NO: 1202080 - RNA, 19 nt, Homo sapiens
gcguuuccaucaaccaguu

SEQ ID NO: 1202081 - RNA, 19 nt, Homo sapiens
cagagaggcguuuccauca

SEQ ID NO: 1202082 - RNA, 19 nt, Homo sapiens
gaagcauguguaugagauu

SEQ ID NO: 1202083 - RNA, 19 nt, Homo sapiens
uggcaggccuggugaccuu

SEQ ID NO: 1202084 - RNA, 19 nt, Homo sapiens
gaagaagcugccaagaagu

SEQ ID NO: 1202085 - RNA, 19 nt, Homo sapiens
ccuagagccucaguucaga

SEQ ID NO: 1202086 - RNA, 19 nt, Homo sapiens
ugcaaggaguucaaugaga

SEQ ID NO: 1202087 - RNA, 19 nt, Homo sapiens
cauuugcccugcaggaugu

SEQ ID NO: 1202088 - RNA, 19 nt, Homo sapiens
aagcauguguaugagauug

SEQ ID NO: 1202089 - RNA, 19 nt, Homo sapiens
gaccuugaagcauguguau

SEQ ID NO: 1202090 - RNA, 19 nt, Homo sapiens
ucacaccaauaugaugaug

SEQ ID NO: 1202091 - RNA, 19 nt, Homo sapiens
aaggaggucacaccaauau

SEQ ID NO: 1202092 - RNA, 19 nt, Homo sapiens
acucccagauuucaaagga

SEQ ID NO: 1202093 - RNA, 19 nt, Homo sapiens
cuaccaagauuuuagugaa

SEQ ID NO: 1202094 - RNA, 19 nt, Homo sapiens
gaggucacaccaauaugau

SEQ ID NO: 1202095 - RNA, 19 nt, Homo sapiens
gcccacuguuuccuacuuc

SEQ ID NO: 1202096 - RNA, 19 nt, Homo sapiens
ggagguaguugcaaaagcu

SEQ ID NO: 1202097 - RNA, 19 nt, Homo sapiens
ccaccaacucccagauuuc

SEQ ID NO: 1202098 - RNA, 19 nt, Homo sapiens
caagaagaagcugccaaga

SEQ ID NO: 1202099 - RNA, 19 nt, Homo sapiens
gaggacaaaggacaucaag

SEQ ID NO: 1202100 - RNA, 19 nt, Homo sapiens
gcucagaaggaggcagauu

SEQ ID NO: 1202101 - RNA, 19 nt, Homo sapiens
aagaagcugccaagaagug

SEQ ID NO: 1202102 - RNA, 19 nt, Homo sapiens
cucagaaggaggcagauuu

SEQ ID NO: 1202103 - RNA, 19 nt, Homo sapiens
caccaacucccagauuuca

SEQ ID NO: 1202104 - RNA, 19 nt, Homo sapiens
uugcagcuuuccagaagga

SEQ ID NO: 1202105 - RNA, 19 nt, Homo sapiens
gaagaacaaugucaaaugg

SEQ ID NO: 1202106 - RNA, 19 nt, Homo sapiens
uaaaugggcuugauacugu

SEQ ID NO: 1202107 - RNA, 19 nt, Homo sapiens
acaagaagcuguuugaaga

SEQ ID NO: 1202108 - RNA, 19 nt, Homo sapiens
guaccaggcuguagauuug

SEQ ID NO: 1202109 - RNA, 19 nt, Homo sapiens
gagaacaucugaagacauc

SEQ ID NO: 1202110 - RNA, 19 nt, Homo sapiens
gcugaacccugaaauaguu

SEQ ID NO: 1202111 - RNA, 19 nt, Homo sapiens
ccacauacauuaaaguuac

SEQ ID NO: 1202112 - RNA, 19 nt, Homo sapiens
gcguauacauguugaauuc

SEQ ID NO: 1202113 - RNA, 19 nt, Homo sapiens
ucccagcucugaccaaaua

SEQ ID NO: 1202114 - RNA, 19 nt, Homo sapiens
ggugugaggugacgguaaa

SEQ ID NO: 1202115 - RNA, 19 nt, Homo sapiens
gagcagaaaugugcaagca

SEQ ID NO: 1202116 - RNA, 19 nt, Homo sapiens
ggagcugaacccugaaaua

SEQ ID NO: 1202117 - RNA, 19 nt, Homo sapiens
uagagaagauccagaccaa

SEQ ID NO: 1202118 - RNA, 19 nt, Homo sapiens
gccauugucuccaguacuu

SEQ ID NO: 1202119 - RNA, 19 nt, Homo sapiens
gagcugaacccugaaauag

SEQ ID NO: 1202120 - RNA, 19 nt, Homo sapiens
agaaauugcugagacaaga

SEQ ID NO: 1202121 - RNA, 19 nt, Homo sapiens
gaaguccuguuccagaagu

SEQ ID NO: 1202122 - RNA, 19 nt, Homo sapiens
gaaucuugguguugugguu

SEQ ID NO: 1202123 - RNA, 19 nt, Homo sapiens
gagacaagaaggaaaauua

SEQ ID NO: 1202124 - RNA, 19 nt, Homo sapiens
guacuugccucauucucau

SEQ ID NO: 1202125 - RNA, 19 nt, Homo sapiens
gcacugcguauacauguug

SEQ ID NO: 1202126 - RNA, 19 nt, Homo sapiens
gaugaagaacaaugucaaa

SEQ ID NO: 1202127 - RNA, 19 nt, Homo sapiens
gaccuggccugcaacuuca

SEQ ID NO: 1202128 - RNA, 19 nt, Homo sapiens
gaaggaaaauuagagaaga

SEQ ID NO: 1202129 - RNA, 19 nt, Homo sapiens
ugaagaacaaugucaaaug

SEQ ID NO: 1202130 - RNA, 19 nt, Homo sapiens
gaaauugcugagacaagaa

SEQ ID NO: 1202131 - RNA, 19 nt, Homo sapiens
gggacuggcuguauaugca

SEQ ID NO: 1202132 - RNA, 19 nt, Homo sapiens
uaagcuagaugcaguagac

SEQ ID NO: 1202133 - RNA, 19 nt, Homo sapiens
gagcaguggagcagaaaug

SEQ ID NO: 1202134 - RNA, 19 nt, Homo sapiens
cgaagcaucggcccaaaga

SEQ ID NO: 1202135 - RNA, 19 nt, Homo sapiens
gaaguaccaggcuguagau

SEQ ID NO: 1202136 - RNA, 19 nt, Homo sapiens
gccugcaacuucagccuuu

SEQ ID NO: 1202137 - RNA, 19 nt, Homo sapiens
guaaaugggcuugauacug

SEQ ID NO: 1202138 - RNA, 19 nt, Homo sapiens
aagcaucggcccaaagaaa

SEQ ID NO: 1202139 - RNA, 19 nt, Homo sapiens
caggagagccagccauugu

SEQ ID NO: 1202140 - RNA, 19 nt, Homo sapiens
ggaugaagaacaaugucaa

SEQ ID NO: 1202141 - RNA, 19 nt, Homo sapiens
cgacaucgcgucuauaagc

SEQ ID NO: 1202142 - RNA, 19 nt, Homo sapiens
caagcacccugaucucacu

SEQ ID NO: 1202143 - RNA, 19 nt, Homo sapiens
ugagagugccuaugucugu

SEQ ID NO: 1202144 - RNA, 19 nt, Homo sapiens
gcaggugaggcgacaguga

SEQ ID NO: 1202145 - RNA, 19 nt, Homo sapiens
caacuucagccuuucucaa

SEQ ID NO: 1202146 - RNA, 19 nt, Homo sapiens
cucagggacuggcuguaua

SEQ ID NO: 1202147 - RNA, 19 nt, Homo sapiens
ccaagcagaaauaaagaga

SEQ ID NO: 1202148 - RNA, 19 nt, Homo sapiens
aaacugaacauuuguaucc

SEQ ID NO: 1202149 - RNA, 19 nt, Homo sapiens
ugaccuggccugcaacuuc

SEQ ID NO: 1202150 - RNA, 19 nt, Homo sapiens
gugaggcgacagugaaauu

SEQ ID NO: 1202151 - RNA, 19 nt, Homo sapiens
cgcagucgguggagaaugu

SEQ ID NO: 1202152 - RNA, 19 nt, Homo sapiens
uagaugcaguagaccgaaa

SEQ ID NO: 1202153 - RNA, 19 nt, Homo sapiens
uagagaacaucugaagaca

SEQ ID NO: 1202154 - RNA, 19 nt, Homo sapiens
agauauaaguacugguuag

SEQ ID NO: 1202155 - RNA, 19 nt, Homo sapiens
cgacagugaaauuucuaaa

SEQ ID NO: 1202156 - RNA, 19 nt, Homo sapiens
cuguagauuugauaagcua

SEQ ID NO: 1202157 - RNA, 19 nt, Homo sapiens
agacugcacugcguauaca

SEQ ID NO: 1202158 - RNA, 19 nt, Homo sapiens
gagaaauugcugagacaag

SEQ ID NO: 1202159 - RNA, 19 nt, Homo sapiens
cuccaguacuugccucauu

SEQ ID NO: 1202160 - RNA, 19 nt, Homo sapiens
agaaguaccaggcuguaga

SEQ ID NO: 1202161 - RNA, 19 nt, Homo sapiens
cgggagcaguggagcagaa

SEQ ID NO: 1202162 - RNA, 19 nt, Homo sapiens
gguccucccucaggucuca

SEQ ID NO: 1202163 - RNA, 19 nt, Homo sapiens
guauaugcauccccugaaa

SEQ ID NO: 1202164 - RNA, 19 nt, Homo sapiens
ugucugucgugaacuuuga

SEQ ID NO: 1202165 - RNA, 19 nt, Homo sapiens
cuaugucugucgugaacuu

SEQ ID NO: 1202166 - RNA, 19 nt, Homo sapiens
caagcagaaauaaagagaa

SEQ ID NO: 1202167 - RNA, 19 nt, Homo sapiens
gacgguaaaugggcuugau

SEQ ID NO: 1202168 - RNA, 19 nt, Homo sapiens
ggagaaauugcugagacaa

SEQ ID NO: 1202169 - RNA, 19 nt, Homo sapiens
gggaugaagaacaauguca

SEQ ID NO: 1202170 - RNA, 19 nt, Homo sapiens
guagggaugaagaacaaug

SEQ ID NO: 1202171 - RNA, 19 nt, Homo sapiens
agguagggaugaagaacaa

SEQ ID NO: 1202172 - RNA, 19 nt, Homo sapiens
ggagagccagccauugucu

SEQ ID NO: 1202173 - RNA, 19 nt, Homo sapiens
gagguagggaugaagaaca

SEQ ID NO: 1202174 - RNA, 19 nt, Homo sapiens
gaagcaucggcccaaagaa

SEQ ID NO: 1202175 - RNA, 19 nt, Homo sapiens
caggugaggcgacagugaa

SEQ ID NO: 1202176 - RNA, 19 nt, Homo sapiens
ugacgcagucgguggagaa

SEQ ID NO: 1202177 - RNA, 19 nt, Homo sapiens
ccaaggcagcaaagcagaa

SEQ ID NO: 1202178 - RNA, 19 nt, Homo sapiens
uugagaagcccaagaccaa

SEQ ID NO: 1202179 - RNA, 19 nt, Homo sapiens
gcgacagugaaauuucuaa

SEQ ID NO: 1202180 - RNA, 19 nt, Homo sapiens
gaggcgacagugaaauuuc

SEQ ID NO: 1202181 - RNA, 19 nt, Homo sapiens
ucauccaaacugaacauuu

SEQ ID NO: 1202182 - RNA, 19 nt, Homo sapiens
ccagaaguaccaggcugua

SEQ ID NO: 1202183 - RNA, 19 nt, Homo sapiens
gcaguggagcagaaaugug

SEQ ID NO: 1202184 - RNA, 19 nt, Homo sapiens
gccuaugucugucgugaac

SEQ ID NO: 1202185 - RNA, 19 nt, Homo sapiens
ucagggacuggcuguauau

SEQ ID NO: 1202186 - RNA, 19 nt, Homo sapiens
guagauuugauaagcuaga

SEQ ID NO: 1202187 - RNA, 19 nt, Homo sapiens
gcuguagauuugauaagcu

SEQ ID NO: 1202188 - RNA, 19 nt, Homo sapiens
uguaucccaagcagaaaua

SEQ ID NO: 1202189 - RNA, 19 nt, Homo sapiens
uccaguacuugccucauuc

SEQ ID NO: 1202190 - RNA, 19 nt, Homo sapiens
gacaucgcgucuauaagcu

SEQ ID NO: 1202191 - RNA, 19 nt, Homo sapiens
cccacauacauuaaaguua

SEQ ID NO: 1202192 - RNA, 19 nt, Homo sapiens
ugaggcgacagugaaauuu

SEQ ID NO: 1202193 - RNA, 19 nt, Homo sapiens
aguaccaggcuguagauuu

SEQ ID NO: 1202194 - RNA, 19 nt, Homo sapiens
gcaacuucagccuuucuca

SEQ ID NO: 1202195 - RNA, 19 nt, Homo sapiens
aggagaaauugcugagaca

SEQ ID NO: 1202196 - RNA, 19 nt, Homo sapiens
guuugaagaggagaaauug

SEQ ID NO: 1202197 - RNA, 19 nt, Homo sapiens
caagaagcuguuugaagag

SEQ ID NO: 1202198 - RNA, 19 nt, Homo sapiens
uuagagaacaucugaagac

SEQ ID NO: 1202199 - RNA, 19 nt, Homo sapiens
caaggcagcaaagcagaau

SEQ ID NO: 1202200 - RNA, 19 nt, Homo sapiens
ggagaaagcuguucacuua

SEQ ID NO: 1202201 - RNA, 19 nt, Homo sapiens
gaagauugauccauuguug

SEQ ID NO: 1202202 - RNA, 19 nt, Homo sapiens
gaaauaaugccugaacuua

SEQ ID NO: 1202203 - RNA, 19 nt, Homo sapiens
uuacguagcuguuccagaa

SEQ ID NO: 1202204 - RNA, 19 nt, Homo sapiens
uaaauguggugaauuguga

SEQ ID NO: 1202205 - RNA, 19 nt, Homo sapiens
gcaagcaguuauuaaugaa

SEQ ID NO: 1202206 - RNA, 19 nt, Homo sapiens
ugaggaugaugucuauuua

SEQ ID NO: 1202207 - RNA, 19 nt, Homo sapiens
gaagguuuauuacugaaga

SEQ ID NO: 1202208 - RNA, 19 nt, Homo sapiens
ugaaauuguugcagacuuu

SEQ ID NO: 1202209 - RNA, 19 nt, Homo sapiens
gcaaaguguuuaucuugau

SEQ ID NO: 1202210 - RNA, 19 nt, Homo sapiens
uaucagacaucacuuuguu

SEQ ID NO: 1202211 - RNA, 19 nt, Homo sapiens
uaagguagaugaagaaagg

SEQ ID NO: 1202212 - RNA, 19 nt, Homo sapiens
gacaugaaauuaagguaga

SEQ ID NO: 1202213 - RNA, 19 nt, Homo sapiens
uacaaagucugcaaagaaa

SEQ ID NO: 1202214 - RNA, 19 nt, Homo sapiens
gaauuugggucccuuugug

SEQ ID NO: 1202215 - RNA, 19 nt, Homo sapiens
gcacagaccgcugaauuug

SEQ ID NO: 1202216 - RNA, 19 nt, Homo sapiens
gaaagcuguucacuuacuu

SEQ ID NO: 1202217 - RNA, 19 nt, Homo sapiens
caagaugguuuaucagaca

SEQ ID NO: 1202218 - RNA, 19 nt, Homo sapiens
guacagucauuucaagaau

SEQ ID NO: 1202219 - RNA, 19 nt, Homo sapiens
agacaucacuuuguucuug

SEQ ID NO: 1202220 - RNA, 19 nt, Homo sapiens
gccuaaauguggugaauug

SEQ ID NO: 1202221 - RNA, 19 nt, Homo sapiens
gcaggaggcacuagucuga

SEQ ID NO: 1202222 - RNA, 19 nt, Homo sapiens
cuacaaagucugcaaagaa

SEQ ID NO: 1202223 - RNA, 19 nt, Homo sapiens
gguagagccuugauacauc

SEQ ID NO: 1202224 - RNA, 19 nt, Homo sapiens
caaaauagcggaagaaaau

SEQ ID NO: 1202225 - RNA, 19 nt, Homo sapiens
aaaagaagaugccuaaaug

SEQ ID NO: 1202226 - RNA, 19 nt, Homo sapiens
ugcaagcaguuauuaauga

SEQ ID NO: 1202227 - RNA, 19 nt, Homo sapiens
cauuggauaugucaaguga

SEQ ID NO: 1202228 - RNA, 19 nt, Homo sapiens
gcauagccuuuccaagaug

SEQ ID NO: 1202229 - RNA, 19 nt, Homo sapiens
uuaccaguguucuuaguuu

SEQ ID NO: 1202230 - RNA, 19 nt, Homo sapiens
ggcauagccuuuccaagau

SEQ ID NO: 1202231 - RNA, 19 nt, Homo sapiens
gcuacaaagucugcaaaga

SEQ ID NO: 1202232 - RNA, 19 nt, Homo sapiens
ugccugaacuuaaucgauu

SEQ ID NO: 1202233 - RNA, 19 nt, Homo sapiens
uacagaagauuugggauga

SEQ ID NO: 1202234 - RNA, 19 nt, Homo sapiens
guagaaacguaggaacaau

SEQ ID NO: 1202235 - RNA, 19 nt, Homo sapiens
gaaauuaagguagaugaag

SEQ ID NO: 1202236 - RNA, 19 nt, Homo sapiens
ccauuuaccaguguucuua

SEQ ID NO: 1202237 - RNA, 19 nt, Homo sapiens
gaggaugaugucuauuuaa

SEQ ID NO: 1202238 - RNA, 19 nt, Homo sapiens
gaagauuugggaugaugaa

SEQ ID NO: 1202239 - RNA, 19 nt, Homo sapiens
cagaagauuugggaugaug

SEQ ID NO: 1202240 - RNA, 19 nt, Homo sapiens
uuacagagaaugcaucaga

SEQ ID NO: 1202241 - RNA, 19 nt, Homo sapiens
uauaugagguggagaaagc

SEQ ID NO: 1202242 - RNA, 19 nt, Homo sapiens
aggaggcacuagucugaua

SEQ ID NO: 1202243 - RNA, 19 nt, Homo sapiens
uuuccaagaugguuuauca

SEQ ID NO: 1202244 - RNA, 19 nt, Homo sapiens
agugaagguuuauuacuga

SEQ ID NO: 1202245 - RNA, 19 nt, Homo sapiens
cguagcuguuccagaaaua

SEQ ID NO: 1202246 - RNA, 19 nt, Homo sapiens
agaaacguaggaacaauuu

SEQ ID NO: 1202247 - RNA, 19 nt, Homo sapiens
ggcacagaccgcugaauuu

SEQ ID NO: 1202248 - RNA, 19 nt, Homo sapiens
guccaaagcaaaguguuua

SEQ ID NO: 1202249 - RNA, 19 nt, Homo sapiens
cuucguaguucaacaagug

SEQ ID NO: 1202250 - RNA, 19 nt, Homo sapiens
gaaugcaucagaggucaaa

SEQ ID NO: 1202251 - RNA, 19 nt, Homo sapiens
aagcaaaguguuuaucuug

SEQ ID NO: 1202252 - RNA, 19 nt, Homo sapiens
caaagcaaaguguuuaucu

SEQ ID NO: 1202253 - RNA, 19 nt, Homo sapiens
gaugucuuguuauugauca

SEQ ID NO: 1202254 - RNA, 19 nt, Homo sapiens
uacugaagauugauccauu

SEQ ID NO: 1202255 - RNA, 19 nt, Homo sapiens
gauccauuguugccuaaag

SEQ ID NO: 1202256 - RNA, 19 nt, Homo sapiens
gacaucacuuuguucuugu

SEQ ID NO: 1202257 - RNA, 19 nt, Homo sapiens
cgaaaucaauaaaguugcu

SEQ ID NO: 1202258 - RNA, 19 nt, Homo sapiens
agaaagcuguucacuuacu

SEQ ID NO: 1202259 - RNA, 19 nt, Homo sapiens
aagugaagguuuauuacug

SEQ ID NO: 1202260 - RNA, 19 nt, Homo sapiens
ggaaggcgaaccugaggau

SEQ ID NO: 1202261 - RNA, 19 nt, Homo sapiens
gauuaaggaagaaacugaa

SEQ ID NO: 1202262 - RNA, 19 nt, Homo sapiens
gauauggcacugggaaaga

SEQ ID NO: 1202263 - RNA, 19 nt, Homo sapiens
uagaaacguaggaacaauu

SEQ ID NO: 1202264 - RNA, 19 nt, Homo sapiens
gugaagguuuauuacugaa

SEQ ID NO: 1202265 - RNA, 19 nt, Homo sapiens
caacaagugaagguuuauu

SEQ ID NO: 1202266 - RNA, 19 nt, Homo sapiens
guaggaacaauuucgugaa

SEQ ID NO: 1202267 - RNA, 19 nt, Homo sapiens
cugaggaugaugucuauuu

SEQ ID NO: 1202268 - RNA, 19 nt, Homo sapiens
auuguugccuaaagaagua

SEQ ID NO: 1202269 - RNA, 19 nt, Homo sapiens
caaaauagcaacauuggau

SEQ ID NO: 1202270 - RNA, 19 nt, Homo sapiens
cgauuaaggaagaaacuga

SEQ ID NO: 1202271 - RNA, 19 nt, Homo sapiens
agaaauaaugccugaacuu

SEQ ID NO: 1202272 - RNA, 19 nt, Homo sapiens
agcaaaguguuuaucuuga

SEQ ID NO: 1202273 - RNA, 19 nt, Homo sapiens
uuaagaagcaauggagaaa

SEQ ID NO: 1202274 - RNA, 19 nt, Homo sapiens
cuuccgaaaucaauaaagu

SEQ ID NO: 1202275 - RNA, 19 nt, Homo sapiens
aagaagaugccuaaaugug

SEQ ID NO: 1202276 - RNA, 19 nt, Homo sapiens
uaccaguguucuuaguuug

SEQ ID NO: 1202277 - RNA, 19 nt, Homo sapiens
guguuuaucuugauuugac

SEQ ID NO: 1202278 - RNA, 19 nt, Homo sapiens
gauauaugagguggagaaa

SEQ ID NO: 1202279 - RNA, 19 nt, Homo sapiens
acugaagauugauccauug

SEQ ID NO: 1202280 - RNA, 19 nt, Homo sapiens
gaacuuucuccagaccaaa

SEQ ID NO: 1202281 - RNA, 19 nt, Homo sapiens
cagaaauaaugccugaacu

SEQ ID NO: 1202282 - RNA, 19 nt, Homo sapiens
ggguagagccuugauacau

SEQ ID NO: 1202283 - RNA, 19 nt, Homo sapiens
ucacuuuguucuuguucug

SEQ ID NO: 1202284 - RNA, 19 nt, Homo sapiens
uaggaacaauuucgugaac

SEQ ID NO: 1202285 - RNA, 19 nt, Homo sapiens
caagugaagguuuauuacu

SEQ ID NO: 1202286 - RNA, 19 nt, Homo sapiens
aaagcuguucacuuacuua

SEQ ID NO: 1202287 - RNA, 19 nt, Homo sapiens
uacuuucagugguuuaaga

SEQ ID NO: 1202288 - RNA, 19 nt, Homo sapiens
aaagaagaugccuaaaugu

SEQ ID NO: 1202289 - RNA, 19 nt, Homo sapiens
gugcuuuccuucguaguuc

SEQ ID NO: 1202290 - RNA, 19 nt, Homo sapiens
acaauuucgugaacgcaau

SEQ ID NO: 1202291 - RNA, 19 nt, Homo sapiens
uauccaaagcuuucucgaa

SEQ ID NO: 1202292 - RNA, 19 nt, Homo sapiens
ggagccauuuaccaguguu

SEQ ID NO: 1202293 - RNA, 19 nt, Homo sapiens
gcaauggagaaaaugauaa

SEQ ID NO: 1202294 - RNA, 19 nt, Homo sapiens
ugugguacgugcuuuccuu

SEQ ID NO: 1202295 - RNA, 19 nt, Homo sapiens
aggcacagaccgcugaauu

SEQ ID NO: 1202296 - RNA, 19 nt, Homo sapiens
guagcuguuccagaaauaa

SEQ ID NO: 1202297 - RNA, 19 nt, Homo sapiens
ggauauggcacugggaaag

SEQ ID NO: 1202298 - RNA, 19 nt, Homo sapiens
guuuaucagacaucacuuu

SEQ ID NO: 1202299 - RNA, 19 nt, Homo sapiens
cuaaauguggugaauugug

SEQ ID NO: 1202300 - RNA, 19 nt, Homo sapiens
gcagagaccuggacauuaa

SEQ ID NO: 1202301 - RNA, 19 nt, Homo sapiens
gaacaagggucagguagaa

SEQ ID NO: 1202302 - RNA, 19 nt, Homo sapiens
ggacugcguuguaugcuuu

SEQ ID NO: 1202303 - RNA, 19 nt, Homo sapiens
gaagagagaguuuauuuag

SEQ ID NO: 1202304 - RNA, 19 nt, Homo sapiens
ggaagagagaguuuauuua

SEQ ID NO: 1202305 - RNA, 19 nt, Homo sapiens
gaaugugacuguuugaaag

SEQ ID NO: 1202306 - RNA, 19 nt, Homo sapiens
gaaaugggguucuguuuga

SEQ ID NO: 1202307 - RNA, 19 nt, Homo sapiens
gagaugagaaugucacaaa

SEQ ID NO: 1202308 - RNA, 19 nt, Homo sapiens
uuugaaagcugguagaauu

SEQ ID NO: 1202309 - RNA, 19 nt, Homo sapiens
gacccuaaaucaauaauca

SEQ ID NO: 1202310 - RNA, 19 nt, Homo sapiens
gaagacagaacauggagaa

SEQ ID NO: 1202311 - RNA, 19 nt, Homo sapiens
guagaauucaucccucuua

SEQ ID NO: 1202312 - RNA, 19 nt, Homo sapiens
cauguucccuuuaguuuau

SEQ ID NO: 1202313 - RNA, 19 nt, Homo sapiens
ccacccaucuuucuauuuc

SEQ ID NO: 1202314 - RNA, 19 nt, Homo sapiens
caaaguaaagagccuaauu

SEQ ID NO: 1202315 - RNA, 19 nt, Homo sapiens
ccaccaagcacaccuguuu

SEQ ID NO: 1202316 - RNA, 19 nt, Homo sapiens
ccauggagguguccuguug

SEQ ID NO: 1202317 - RNA, 19 nt, Homo sapiens
cggccuaacuagcacuuua

SEQ ID NO: 1202318 - RNA, 19 nt, Homo sapiens
agaguuaacugugcugaaa

SEQ ID NO: 1202319 - RNA, 19 nt, Homo sapiens
agagagaguuuauuuaguc

SEQ ID NO: 1202320 - RNA, 19 nt, Homo sapiens
guaaagagccuaauuuugu

SEQ ID NO: 1202321 - RNA, 19 nt, Homo sapiens
gcugagaggacaccuauau

SEQ ID NO: 1202322 - RNA, 19 nt, Homo sapiens
aggaggagcuggugaacaa

SEQ ID NO: 1202323 - RNA, 19 nt, Homo sapiens
ggagaucaccaagcacuuu

SEQ ID NO: 1202324 - RNA, 19 nt, Homo sapiens
ugaagguucuggacaugaa

SEQ ID NO: 1202325 - RNA, 19 nt, Homo sapiens
gacauuaaccggccuggaa

SEQ ID NO: 1202326 - RNA, 19 nt, Homo sapiens
ggaaggaacaugacaucga

SEQ ID NO: 1202327 - RNA, 19 nt, Homo sapiens
gagagaguuuauuuaguca

SEQ ID NO: 1202328 - RNA, 19 nt, Homo sapiens
gaauucaucccucuuacug

SEQ ID NO: 1202329 - RNA, 19 nt, Homo sapiens
ggcaaaggcuggauagacu

SEQ ID NO: 1202330 - RNA, 19 nt, Homo sapiens
ccuaugugcuggccaaguu

SEQ ID NO: 1202331 - RNA, 19 nt, Homo sapiens
ccagaaaccagagccauuu

SEQ ID NO: 1202332 - RNA, 19 nt, Homo sapiens
caguacacgucacauuauu

SEQ ID NO: 1202333 - RNA, 19 nt, Homo sapiens
ggacaccuauaugcguauu

SEQ ID NO: 1202334 - RNA, 19 nt, Homo sapiens
gauaacacugcaaaucuug

SEQ ID NO: 1202335 - RNA, 19 nt, Homo sapiens
gcaggcauguuuggagaug

SEQ ID NO: 1202336 - RNA, 19 nt, Homo sapiens
gcccagccauccucaccua

SEQ ID NO: 1202337 - RNA, 19 nt, Homo sapiens
gcccaggacugcguuguau

SEQ ID NO: 1202338 - RNA, 19 nt, Homo sapiens
guagauaacacugcaaauc

SEQ ID NO: 1202339 - RNA, 19 nt, Homo sapiens
gaaagcugguagaauucau

SEQ ID NO: 1202340 - RNA, 19 nt, Homo sapiens
ccucuuggcugcagacaca

SEQ ID NO: 1202341 - RNA, 19 nt, Homo sapiens
gaggagagagcccaugugu

SEQ ID NO: 1202342 - RNA, 19 nt, Homo sapiens
aaacuggacccgaccacua

SEQ ID NO: 1202343 - RNA, 19 nt, Homo sapiens
cagaguuggugcagagcua

SEQ ID NO: 1202344 - RNA, 19 nt, Homo sapiens
auucaucccucuuacugua

SEQ ID NO: 1202345 - RNA, 19 nt, Homo sapiens
ugaaugugacuguuugaaa

SEQ ID NO: 1202346 - RNA, 19 nt, Homo sapiens
ucucagacccuaaaucaau

SEQ ID NO: 1202347 - RNA, 19 nt, Homo sapiens
aggaagagagaguuuauuu

SEQ ID NO: 1202348 - RNA, 19 nt, Homo sapiens
aaacaaaacucuagucaac

SEQ ID NO: 1202349 - RNA, 19 nt, Homo sapiens
uaaggaagagagaguuuau

SEQ ID NO: 1202350 - RNA, 19 nt, Homo sapiens
gagggcaacgccaucagua

SEQ ID NO: 1202351 - RNA, 19 nt, Homo sapiens
gcccauguguggugugugu

SEQ ID NO: 1202352 - RNA, 19 nt, Homo sapiens
gcacaugugacaaucaucu

SEQ ID NO: 1202353 - RNA, 19 nt, Homo sapiens
gcucauguucccuuuaguu

SEQ ID NO: 1202354 - RNA, 19 nt, Homo sapiens
ccagcguggugcagcauuu

SEQ ID NO: 1202355 - RNA, 19 nt, Homo sapiens
cacaaacuaugcuucaaca

SEQ ID NO: 1202356 - RNA, 19 nt, Homo sapiens
guuaguuucugcccaguuc

SEQ ID NO: 1202357 - RNA, 19 nt, Homo sapiens
cucagacccuaaaucaaua

SEQ ID NO: 1202358 - RNA, 19 nt, Homo sapiens
gagaaaggcuuccccuaca

SEQ ID NO: 1202359 - RNA, 19 nt, Homo sapiens
gagaguuuauuuagucaac

SEQ ID NO: 1202360 - RNA, 19 nt, Homo sapiens
ggguuucucugcccaagga

SEQ ID NO: 1202361 - RNA, 19 nt, Homo sapiens
gcauuucggguucaaguau

SEQ ID NO: 1202362 - RNA, 19 nt, Homo sapiens
guagcagugugguguuuca

SEQ ID NO: 1202363 - RNA, 19 nt, Homo sapiens
acaaucaucuggacaacag

SEQ ID NO: 1202364 - RNA, 19 nt, Homo sapiens
gaugagaaugucacaaaca

SEQ ID NO: 1202365 - RNA, 19 nt, Homo sapiens
uccaguacacgucacauua

SEQ ID NO: 1202366 - RNA, 19 nt, Homo sapiens
cuaagaagaauuccagugu

SEQ ID NO: 1202367 - RNA, 19 nt, Homo sapiens
caaguuugcacucaucuuc

SEQ ID NO: 1202368 - RNA, 19 nt, Homo sapiens
gguggcugcugucaugaga

SEQ ID NO: 1202369 - RNA, 19 nt, Homo sapiens
ccaguacacgucacauuau

SEQ ID NO: 1202370 - RNA, 19 nt, Homo sapiens
gaauuccaguguggugaug

SEQ ID NO: 1202371 - RNA, 19 nt, Homo sapiens
ucugguggcugcugucaug

SEQ ID NO: 1202372 - RNA, 19 nt, Homo sapiens
gaaaccagagccauuuguc

SEQ ID NO: 1202373 - RNA, 19 nt, Homo sapiens
gcagcgaggcuucuacagu

SEQ ID NO: 1202374 - RNA, 19 nt, Homo sapiens
ggaccaggcagccacuuuc

SEQ ID NO: 1202375 - RNA, 19 nt, Homo sapiens
ucauguucccuuuaguuua

SEQ ID NO: 1202376 - RNA, 19 nt, Homo sapiens
caacaccuucuucaacuuc

SEQ ID NO: 1202377 - RNA, 19 nt, Homo sapiens
gcugaagguucuggacaug

SEQ ID NO: 1202378 - RNA, 19 nt, Homo sapiens
cuaaggaagagagaguuua

SEQ ID NO: 1202379 - RNA, 19 nt, Homo sapiens
ucucauagcacaugugaca

SEQ ID NO: 1202380 - RNA, 19 nt, Homo sapiens
ucaacaccuucuucaacuu

SEQ ID NO: 1202381 - RNA, 19 nt, Homo sapiens
ccucaugugcuucuucuga

SEQ ID NO: 1202382 - RNA, 19 nt, Homo sapiens
caguagcagugugguguuu

SEQ ID NO: 1202383 - RNA, 19 nt, Homo sapiens
uagcacaugugacaaucau

SEQ ID NO: 1202384 - RNA, 19 nt, Homo sapiens
caagcacaccuguuucugu

SEQ ID NO: 1202385 - RNA, 19 nt, Homo sapiens
cugcagcucuucuggaaca

SEQ ID NO: 1202386 - RNA, 19 nt, Homo sapiens
gagaucaccaagcacuuug

SEQ ID NO: 1202387 - RNA, 19 nt, Homo sapiens
acaccuauaugcguauuuc

SEQ ID NO: 1202388 - RNA, 19 nt, Homo sapiens
gcgauucccugaggagaag

SEQ ID NO: 1202389 - RNA, 19 nt, Homo sapiens
caacguagaaagaguuaac

SEQ ID NO: 1202390 - RNA, 19 nt, Homo sapiens
caugugcuucuucugaaua

SEQ ID NO: 1202391 - RNA, 19 nt, Homo sapiens
ccugguggcguguuaguuu

SEQ ID NO: 1202392 - RNA, 19 nt, Homo sapiens
guacacgucacauuauuuu

SEQ ID NO: 1202393 - RNA, 19 nt, Homo sapiens
cuagccugguggcguguua

SEQ ID NO: 1202394 - RNA, 19 nt, Homo sapiens
cguauuuccucuacacaca

SEQ ID NO: 1202395 - RNA, 19 nt, Homo sapiens
gagauucgcuacggaucca

SEQ ID NO: 1202396 - RNA, 19 nt, Homo sapiens
cacucuccgugguaacuua

SEQ ID NO: 1202397 - RNA, 19 nt, Homo sapiens
ccgcagagaccuggacauu

SEQ ID NO: 1202398 - RNA, 19 nt, Homo sapiens
cagcucuucuggaacaugu

SEQ ID NO: 1202399 - RNA, 19 nt, Homo sapiens
ggccaaguuugcacucauc

SEQ ID NO: 1202400 - RNA, 19 nt, Homo sapiens
gcagagaccuggacauuaa

SEQ ID NO: 1202401 - RNA, 19 nt, Homo sapiens
gaacaagggucagguagaa

SEQ ID NO: 1202402 - RNA, 19 nt, Homo sapiens
ggacugcguuguaugcuuu

SEQ ID NO: 1202403 - RNA, 19 nt, Homo sapiens
gaagagagaguuuauuuag

SEQ ID NO: 1202404 - RNA, 19 nt, Homo sapiens
ggaagagagaguuuauuua

SEQ ID NO: 1202405 - RNA, 19 nt, Homo sapiens
gaaugugacuguuugaaag

SEQ ID NO: 1202406 - RNA, 19 nt, Homo sapiens
gaaaugggguucuguuuga

SEQ ID NO: 1202407 - RNA, 19 nt, Homo sapiens
gagaugagaaugucacaaa

SEQ ID NO: 1202408 - RNA, 19 nt, Homo sapiens
uuugaaagcugguagaauu

SEQ ID NO: 1202409 - RNA, 19 nt, Homo sapiens
gacccuaaaucaauaauca

SEQ ID NO: 1202410 - RNA, 19 nt, Homo sapiens
gaagacagaacauggagaa

SEQ ID NO: 1202411 - RNA, 19 nt, Homo sapiens
guagaauucaucccucuua

SEQ ID NO: 1202412 - RNA, 19 nt, Homo sapiens
cauguucccuuuaguuuau

SEQ ID NO: 1202413 - RNA, 19 nt, Homo sapiens
ccacccaucuuucuauuuc

SEQ ID NO: 1202414 - RNA, 19 nt, Homo sapiens
caaaguaaagagccuaauu

SEQ ID NO: 1202415 - RNA, 19 nt, Homo sapiens
ccaccaagcacaccuguuu

SEQ ID NO: 1202416 - RNA, 19 nt, Homo sapiens
ccauggagguguccuguug

SEQ ID NO: 1202417 - RNA, 19 nt, Homo sapiens
cggccuaacuagcacuuua

SEQ ID NO: 1202418 - RNA, 19 nt, Homo sapiens
agaguuaacugugcugaaa

SEQ ID NO: 1202419 - RNA, 19 nt, Homo sapiens
agagagaguuuauuuaguc

SEQ ID NO: 1202420 - RNA, 19 nt, Homo sapiens
guaaagagccuaauuuugu

SEQ ID NO: 1202421 - RNA, 19 nt, Homo sapiens
gcugagaggacaccuauau

SEQ ID NO: 1202422 - RNA, 19 nt, Homo sapiens
aggaggagcuggugaacaa

SEQ ID NO: 1202423 - RNA, 19 nt, Homo sapiens
ggagaucaccaagcacuuu

SEQ ID NO: 1202424 - RNA, 19 nt, Homo sapiens
ggaaggaacaugacaucga

SEQ ID NO: 1202425 - RNA, 19 nt, Homo sapiens
ugaagguucuggacaugaa

SEQ ID NO: 1202426 - RNA, 19 nt, Homo sapiens
gacauuaaccggccuggaa

SEQ ID NO: 1202427 - RNA, 19 nt, Homo sapiens
gagagaguuuauuuaguca

SEQ ID NO: 1202428 - RNA, 19 nt, Homo sapiens
gaauucaucccucuuacug

SEQ ID NO: 1202429 - RNA, 19 nt, Homo sapiens
ggcaaaggcuggauagacu

SEQ ID NO: 1202430 - RNA, 19 nt, Homo sapiens
ccuaugugcuggccaaguu

SEQ ID NO: 1202431 - RNA, 19 nt, Homo sapiens
ccagaaaccagagccauuu

SEQ ID NO: 1202432 - RNA, 19 nt, Homo sapiens
caguacacgucacauuauu

SEQ ID NO: 1202433 - RNA, 19 nt, Homo sapiens
ggacaccuauaugcguauu

SEQ ID NO: 1202434 - RNA, 19 nt, Homo sapiens
gcccagccauccucaccua

SEQ ID NO: 1202435 - RNA, 19 nt, Homo sapiens
gcaggcauguuuggagaug

SEQ ID NO: 1202436 - RNA, 19 nt, Homo sapiens
ccacucaccuuaccccaua

SEQ ID NO: 1202437 - RNA, 19 nt, Homo sapiens
gcccaggacugcguuguau

SEQ ID NO: 1202438 - RNA, 19 nt, Homo sapiens
gaaagcugguagaauucau

SEQ ID NO: 1202439 - RNA, 19 nt, Homo sapiens
gaggagagagcccaugugu

SEQ ID NO: 1202440 - RNA, 19 nt, Homo sapiens
ccucuuggcugcagacaca

SEQ ID NO: 1202441 - RNA, 19 nt, Homo sapiens
aaacuggacccgaccacua

SEQ ID NO: 1202442 - RNA, 19 nt, Homo sapiens
cagaguuggugcagagcua

SEQ ID NO: 1202443 - RNA, 19 nt, Homo sapiens
auucaucccucuuacugua

SEQ ID NO: 1202444 - RNA, 19 nt, Homo sapiens
ugaaugugacuguuugaaa

SEQ ID NO: 1202445 - RNA, 19 nt, Homo sapiens
ucucagacccuaaaucaau

SEQ ID NO: 1202446 - RNA, 19 nt, Homo sapiens
aggaagagagaguuuauuu

SEQ ID NO: 1202447 - RNA, 19 nt, Homo sapiens
aaacaaaacucuagucaac

SEQ ID NO: 1202448 - RNA, 19 nt, Homo sapiens
uaaggaagagagaguuuau

SEQ ID NO: 1202449 - RNA, 19 nt, Homo sapiens
gagggcaacgccaucagua

SEQ ID NO: 1202450 - RNA, 19 nt, Homo sapiens
gcccauguguggugugugu

SEQ ID NO: 1202451 - RNA, 19 nt, Homo sapiens
gcacaugugacaaucaucu

SEQ ID NO: 1202452 - RNA, 19 nt, Homo sapiens
gcucauguucccuuuaguu

SEQ ID NO: 1202453 - RNA, 19 nt, Homo sapiens
ccagcguggugcagcauuu

SEQ ID NO: 1202454 - RNA, 19 nt, Homo sapiens
cacaaacuaugcuucaaca

SEQ ID NO: 1202455 - RNA, 19 nt, Homo sapiens
guuaguuucugcccaguuc

SEQ ID NO: 1202456 - RNA, 19 nt, Homo sapiens
cucagacccuaaaucaaua

SEQ ID NO: 1202457 - RNA, 19 nt, Homo sapiens
gagaaaggcuuccccuaca

SEQ ID NO: 1202458 - RNA, 19 nt, Homo sapiens
gagaguuuauuuagucaac

SEQ ID NO: 1202459 - RNA, 19 nt, Homo sapiens
ggguuucucugcccaagga

SEQ ID NO: 1202460 - RNA, 19 nt, Homo sapiens
gcauuucggguucaaguau

SEQ ID NO: 1202461 - RNA, 19 nt, Homo sapiens
guagcagugugguguuuca

SEQ ID NO: 1202462 - RNA, 19 nt, Homo sapiens
acaaucaucuggacaacag

SEQ ID NO: 1202463 - RNA, 19 nt, Homo sapiens
gaugagaaugucacaaaca

SEQ ID NO: 1202464 - RNA, 19 nt, Homo sapiens
uccaguacacgucacauua

SEQ ID NO: 1202465 - RNA, 19 nt, Homo sapiens
cuaagaagaauuccagugu

SEQ ID NO: 1202466 - RNA, 19 nt, Homo sapiens
caaguuugcacucaucuuc

SEQ ID NO: 1202467 - RNA, 19 nt, Homo sapiens
gguggcugcugucaugaga

SEQ ID NO: 1202468 - RNA, 19 nt, Homo sapiens
ccaguacacgucacauuau

SEQ ID NO: 1202469 - RNA, 19 nt, Homo sapiens
gaauuccaguguggugaug

SEQ ID NO: 1202470 - RNA, 19 nt, Homo sapiens
caacaccuucuucaacuuc

SEQ ID NO: 1202471 - RNA, 19 nt, Homo sapiens
ucugguggcugcugucaug

SEQ ID NO: 1202472 - RNA, 19 nt, Homo sapiens
gaaaccagagccauuuguc

SEQ ID NO: 1202473 - RNA, 19 nt, Homo sapiens
gcagcgaggcuucuacagu

SEQ ID NO: 1202474 - RNA, 19 nt, Homo sapiens
ggaccaggcagccacuuuc

SEQ ID NO: 1202475 - RNA, 19 nt, Homo sapiens
ucauguucccuuuaguuua

SEQ ID NO: 1202476 - RNA, 19 nt, Homo sapiens
gcugaagguucuggacaug

SEQ ID NO: 1202477 - RNA, 19 nt, Homo sapiens
cuaaggaagagagaguuua

SEQ ID NO: 1202478 - RNA, 19 nt, Homo sapiens
ucucauagcacaugugaca

SEQ ID NO: 1202479 - RNA, 19 nt, Homo sapiens
ucaacaccuucuucaacuu

SEQ ID NO: 1202480 - RNA, 19 nt, Homo sapiens
ccucaugugcuucuucuga

SEQ ID NO: 1202481 - RNA, 19 nt, Homo sapiens
caguagcagugugguguuu

SEQ ID NO: 1202482 - RNA, 19 nt, Homo sapiens
uagcacaugugacaaucau

SEQ ID NO: 1202483 - RNA, 19 nt, Homo sapiens
caagcacaccuguuucugu

SEQ ID NO: 1202484 - RNA, 19 nt, Homo sapiens
cugcagcucuucuggaaca

SEQ ID NO: 1202485 - RNA, 19 nt, Homo sapiens
acaccuauaugcguauuuc

SEQ ID NO: 1202486 - RNA, 19 nt, Homo sapiens
gaagcugagaggacaccua

SEQ ID NO: 1202487 - RNA, 19 nt, Homo sapiens
gcgauucccugaggagaag

SEQ ID NO: 1202488 - RNA, 19 nt, Homo sapiens
gagaucaccaagcacuuug

SEQ ID NO: 1202489 - RNA, 19 nt, Homo sapiens
caacguagaaagaguuaac

SEQ ID NO: 1202490 - RNA, 19 nt, Homo sapiens
caugugcuucuucugaaua

SEQ ID NO: 1202491 - RNA, 19 nt, Homo sapiens
ccugguggcguguuaguuu

SEQ ID NO: 1202492 - RNA, 19 nt, Homo sapiens
guacacgucacauuauuuu

SEQ ID NO: 1202493 - RNA, 19 nt, Homo sapiens
cuagccugguggcguguua

SEQ ID NO: 1202494 - RNA, 19 nt, Homo sapiens
cguauuuccucuacacaca

SEQ ID NO: 1202495 - RNA, 19 nt, Homo sapiens
gagauucgcuacggaucca

SEQ ID NO: 1202496 - RNA, 19 nt, Homo sapiens
cacucuccgugguaacuua

SEQ ID NO: 1202497 - RNA, 19 nt, Homo sapiens
ccgcagagaccuggacauu

SEQ ID NO: 1202498 - RNA, 19 nt, Homo sapiens
cagcucuucuggaacaugu

SEQ ID NO: 1202499 - RNA, 19 nt, Homo sapiens
ggccaaguuugcacucauc

SEQ ID NO: 1202500 - RNA, 19 nt, Homo sapiens
ggagggaacuggugcauau

SEQ ID NO: 1202501 - RNA, 19 nt, Homo sapiens
agaagaaacugcucaagaa

SEQ ID NO: 1202502 - RNA, 19 nt, Homo sapiens
ucaagagccugaagaauau

SEQ ID NO: 1202503 - RNA, 19 nt, Homo sapiens
ugaagcaacugcagaaaga

SEQ ID NO: 1202504 - RNA, 19 nt, Homo sapiens
gcuccugggugaccuguua

SEQ ID NO: 1202505 - RNA, 19 nt, Homo sapiens
caggugagcucaggagaua

SEQ ID NO: 1202506 - RNA, 19 nt, Homo sapiens
ggagccaucucuucccuuu

SEQ ID NO: 1202507 - RNA, 19 nt, Homo sapiens
ccagauggguccacacuga

SEQ ID NO: 1202508 - RNA, 19 nt, Homo sapiens
gcacagauuugagguagau

SEQ ID NO: 1202509 - RNA, 19 nt, Homo sapiens
ucucacagcucaaguaugu

SEQ ID NO: 1202510 - RNA, 19 nt, Homo sapiens
acagagauguggcagagua

SEQ ID NO: 1202511 - RNA, 19 nt, Homo sapiens
guugaggacugcaagauga

SEQ ID NO: 1202512 - RNA, 19 nt, Homo sapiens
acacggauauuuacagaga

SEQ ID NO: 1202513 - RNA, 19 nt, Homo sapiens
acacccagcuguucucaaa

SEQ ID NO: 1202514 - RNA, 19 nt, Homo sapiens
uggugaagcuguugaauga

SEQ ID NO: 1202515 - RNA, 19 nt, Homo sapiens
cucaagagccugaagaaua

SEQ ID NO: 1202516 - RNA, 19 nt, Homo sapiens
gcgccucaguuuccauuaa

SEQ ID NO: 1202517 - RNA, 19 nt, Homo sapiens
ggacacagaugccccacua

SEQ ID NO: 1202518 - RNA, 19 nt, Homo sapiens
gcagaggugugguguggau

SEQ ID NO: 1202519 - RNA, 19 nt, Homo sapiens
ccacaggcaucuccuaugg

SEQ ID NO: 1202520 - RNA, 19 nt, Homo sapiens
gggcggaucugcuuaucug

SEQ ID NO: 1202521 - RNA, 19 nt, Homo sapiens
ccaugaugcugucaccuuu

SEQ ID NO: 1202522 - RNA, 19 nt, Homo sapiens
ccucaggaauaaagauuug

SEQ ID NO: 1202523 - RNA, 19 nt, Homo sapiens
agauugagguggaggugua

SEQ ID NO: 1202524 - RNA, 19 nt, Homo sapiens
agacacggauauuuacaga

SEQ ID NO: 1202525 - RNA, 19 nt, Homo sapiens
gaccuuugcugucaugucu

SEQ ID NO: 1202526 - RNA, 19 nt, Homo sapiens
gaagaaacugcucaagaag

SEQ ID NO: 1202527 - RNA, 19 nt, Homo sapiens
ugccagacacggauauuua

SEQ ID NO: 1202528 - RNA, 19 nt, Homo sapiens
ccacugucccucaucuaua

SEQ ID NO: 1202529 - RNA, 19 nt, Homo sapiens
gaacgacuccaugaucaau

SEQ ID NO: 1202530 - RNA, 19 nt, Homo sapiens
gugaagcuguugaaugaca

SEQ ID NO: 1202531 - RNA, 19 nt, Homo sapiens
gcagccaucaucauuguga

SEQ ID NO: 1202532 - RNA, 19 nt, Homo sapiens
gaagacaugaggagcaaca

SEQ ID NO: 1202533 - RNA, 19 nt, Homo sapiens
ggucuaaagcacagauuug

SEQ ID NO: 1202534 - RNA, 19 nt, Homo sapiens
ggagauaagauggaagaug

SEQ ID NO: 1202535 - RNA, 19 nt, Homo sapiens
gagcucaggagauaagaug

SEQ ID NO: 1202536 - RNA, 19 nt, Homo sapiens
gcagaaagaggagaagcuu

SEQ ID NO: 1202537 - RNA, 19 nt, Homo sapiens
gcugaguucuacagugaug

SEQ ID NO: 1202538 - RNA, 19 nt, Homo sapiens
ccucaucauugucaaacuu

SEQ ID NO: 1202539 - RNA, 19 nt, Homo sapiens
guacucagaggccaaggaa

SEQ ID NO: 1202540 - RNA, 19 nt, Homo sapiens
ucaaugagacagccagaga

SEQ ID NO: 1202541 - RNA, 19 nt, Homo sapiens
aggagaagcuucggaaaca

SEQ ID NO: 1202542 - RNA, 19 nt, Homo sapiens
aagaagaaacugcucaaga

SEQ ID NO: 1202543 - RNA, 19 nt, Homo sapiens
gaagaugcaacagccaaug

SEQ ID NO: 1202544 - RNA, 19 nt, Homo sapiens
gaggcgagacuaccacaug

SEQ ID NO: 1202545 - RNA, 19 nt, Homo sapiens
uaagauggaagaugcaaca

SEQ ID NO: 1202546 - RNA, 19 nt, Homo sapiens
augcugaguucuacaguga

SEQ ID NO: 1202547 - RNA, 19 nt, Homo sapiens
cuucaucuacuuccuguuu

SEQ ID NO: 1202548 - RNA, 19 nt, Homo sapiens
ggaacuggugcauauuuua

SEQ ID NO: 1202549 - RNA, 19 nt, Homo sapiens
gggaacuggugcauauuuu

SEQ ID NO: 1202550 - RNA, 19 nt, Homo sapiens
gugguuggguuugccauug

SEQ ID NO: 1202551 - RNA, 19 nt, Homo sapiens
augcauccaucaccaagaa

SEQ ID NO: 1202552 - RNA, 19 nt, Homo sapiens
gcuugaggcugggcacuuc

SEQ ID NO: 1202553 - RNA, 19 nt, Homo sapiens
caggagauaagauggaaga

SEQ ID NO: 1202554 - RNA, 19 nt, Homo sapiens
caccagccuugaagacaug

SEQ ID NO: 1202555 - RNA, 19 nt, Homo sapiens
gaggagaagcuucggaaac

SEQ ID NO: 1202556 - RNA, 19 nt, Homo sapiens
gcgagacuaccacauggaa

SEQ ID NO: 1202557 - RNA, 19 nt, Homo sapiens
acgacuccaugaucaauga

SEQ ID NO: 1202558 - RNA, 19 nt, Homo sapiens
caacagccaauggucaaga

SEQ ID NO: 1202559 - RNA, 19 nt, Homo sapiens
ggaagaugcaacagccaau

SEQ ID NO: 1202560 - RNA, 19 nt, Homo sapiens
uugaacgacuccaugauca

SEQ ID NO: 1202561 - RNA, 19 nt, Homo sapiens
cuucuacccugucuucauc

SEQ ID NO: 1202562 - RNA, 19 nt, Homo sapiens
gaagaagaaacugcucaag

SEQ ID NO: 1202563 - RNA, 19 nt, Homo sapiens
cccgugaguugcucuaugu

SEQ ID NO: 1202564 - RNA, 19 nt, Homo sapiens
guguuuggccuccaucuga

SEQ ID NO: 1202565 - RNA, 19 nt, Homo sapiens
gauaagauggaagaugcaa

SEQ ID NO: 1202566 - RNA, 19 nt, Homo sapiens
gcaggugagcucaggagau

SEQ ID NO: 1202567 - RNA, 19 nt, Homo sapiens
ggagaagcuucggaaacag

SEQ ID NO: 1202568 - RNA, 19 nt, Homo sapiens
gcucaggagauaagaugga

SEQ ID NO: 1202569 - RNA, 19 nt, Homo sapiens
acaccagccuugaagacau

SEQ ID NO: 1202570 - RNA, 19 nt, Homo sapiens
gcacugcugucugcaacac

SEQ ID NO: 1202571 - RNA, 19 nt, Homo sapiens
gcuaccggguggacagcaa

SEQ ID NO: 1202572 - RNA, 19 nt, Homo sapiens
ugaagcuguugaaugacaa

SEQ ID NO: 1202573 - RNA, 19 nt, Homo sapiens
cgccucaguuuccauuaau

SEQ ID NO: 1202574 - RNA, 19 nt, Homo sapiens
ggugggcagugugacagaa

SEQ ID NO: 1202575 - RNA, 19 nt, Homo sapiens
gggagggaacuggugcaua

SEQ ID NO: 1202576 - RNA, 19 nt, Homo sapiens
guggugaagcuguugaaug

SEQ ID NO: 1202577 - RNA, 19 nt, Homo sapiens
cacugucccucaucuauac

SEQ ID NO: 1202578 - RNA, 19 nt, Homo sapiens
gccacugucccucaucuau

SEQ ID NO: 1202579 - RNA, 19 nt, Homo sapiens
gcacuucccggcacaucuc

SEQ ID NO: 1202580 - RNA, 19 nt, Homo sapiens
cagcucaaguauguguuug

SEQ ID NO: 1202581 - RNA, 19 nt, Homo sapiens
ugggugcccucuccuuugu

SEQ ID NO: 1202582 - RNA, 19 nt, Homo sapiens
caguuuccauuaaugucaa

SEQ ID NO: 1202583 - RNA, 19 nt, Homo sapiens
gggucuaaagcacagauuu

SEQ ID NO: 1202584 - RNA, 19 nt, Homo sapiens
ccuauggcaugggucuaaa

SEQ ID NO: 1202585 - RNA, 19 nt, Homo sapiens
aacagccaauggucaagaa

SEQ ID NO: 1202586 - RNA, 19 nt, Homo sapiens
caacaccagccuugaagac

SEQ ID NO: 1202587 - RNA, 19 nt, Homo sapiens
cuacagugaugcgcugaag

SEQ ID NO: 1202588 - RNA, 19 nt, Homo sapiens
uuaucuggcuggugaccuu

SEQ ID NO: 1202589 - RNA, 19 nt, Homo sapiens
gucuaaagcacagauuuga

SEQ ID NO: 1202590 - RNA, 19 nt, Homo sapiens
gcagcugcccaugccgaua

SEQ ID NO: 1202591 - RNA, 19 nt, Homo sapiens
gaacuggugcauauuuuag

SEQ ID NO: 1202592 - RNA, 19 nt, Homo sapiens
ggugagcucaggagauaag

SEQ ID NO: 1202593 - RNA, 19 nt, Homo sapiens
uuccucaucucccagaaga

SEQ ID NO: 1202594 - RNA, 19 nt, Homo sapiens
acggauauuuacagagaug

SEQ ID NO: 1202595 - RNA, 19 nt, Homo sapiens
gggccucaguaaccuuauc

SEQ ID NO: 1202596 - RNA, 19 nt, Homo sapiens
aaagcacagauuugaggua

SEQ ID NO: 1202597 - RNA, 19 nt, Homo sapiens
ggccacaggcaucuccuau

SEQ ID NO: 1202598 - RNA, 19 nt, Homo sapiens
gggccacugucccucaucu

SEQ ID NO: 1202599 - RNA, 19 nt, Homo sapiens
uugaagacaugaggagcaa

SEQ ID NO: 1202600 - RNA, 19 nt, Homo sapiens
ggagggaacuggugcauau

SEQ ID NO: 1202601 - RNA, 19 nt, Homo sapiens
agaagaaacugcucaagaa

SEQ ID NO: 1202602 - RNA, 19 nt, Homo sapiens
ucaagagccugaagaauau

SEQ ID NO: 1202603 - RNA, 19 nt, Homo sapiens
ugaagcaacugcagaaaga

SEQ ID NO: 1202604 - RNA, 19 nt, Homo sapiens
gcuccugggugaccuguua

SEQ ID NO: 1202605 - RNA, 19 nt, Homo sapiens
ggagccaucucuucccuuu

SEQ ID NO: 1202606 - RNA, 19 nt, Homo sapiens
ccagauggguccacacuga

SEQ ID NO: 1202607 - RNA, 19 nt, Homo sapiens
gcacagauuugagguagau

SEQ ID NO: 1202608 - RNA, 19 nt, Homo sapiens
ucucacagcucaaguaugu

SEQ ID NO: 1202609 - RNA, 19 nt, Homo sapiens
acagagauguggcagagua

SEQ ID NO: 1202610 - RNA, 19 nt, Homo sapiens
guugaggacugcaagauga

SEQ ID NO: 1202611 - RNA, 19 nt, Homo sapiens
acacggauauuuacagaga

SEQ ID NO: 1202612 - RNA, 19 nt, Homo sapiens
acacccagcuguucucaaa

SEQ ID NO: 1202613 - RNA, 19 nt, Homo sapiens
uggugaagcuguugaauga

SEQ ID NO: 1202614 - RNA, 19 nt, Homo sapiens
cucaagagccugaagaaua

SEQ ID NO: 1202615 - RNA, 19 nt, Homo sapiens
gcgccucaguuuccauuaa

SEQ ID NO: 1202616 - RNA, 19 nt, Homo sapiens
ggacacagaugccccacua

SEQ ID NO: 1202617 - RNA, 19 nt, Homo sapiens
gcagaggugugguguggau

SEQ ID NO: 1202618 - RNA, 19 nt, Homo sapiens
ccacaggcaucuccuaugg

SEQ ID NO: 1202619 - RNA, 19 nt, Homo sapiens
gggcggaucugcuuaucug

SEQ ID NO: 1202620 - RNA, 19 nt, Homo sapiens
ccaugaugcugucaccuuu

SEQ ID NO: 1202621 - RNA, 19 nt, Homo sapiens
ccucaggaauaaagauuug

SEQ ID NO: 1202622 - RNA, 19 nt, Homo sapiens
agauugagguggaggugua

SEQ ID NO: 1202623 - RNA, 19 nt, Homo sapiens
agacacggauauuuacaga

SEQ ID NO: 1202624 - RNA, 19 nt, Homo sapiens
gaccuuugcugucaugucu

SEQ ID NO: 1202625 - RNA, 19 nt, Homo sapiens
gaagaaacugcucaagaag

SEQ ID NO: 1202626 - RNA, 19 nt, Homo sapiens
ugccagacacggauauuua

SEQ ID NO: 1202627 - RNA, 19 nt, Homo sapiens
ccacugucccucaucuaua

SEQ ID NO: 1202628 - RNA, 19 nt, Homo sapiens
gaacgacuccaugaucaau

SEQ ID NO: 1202629 - RNA, 19 nt, Homo sapiens
gugaagcuguugaaugaca

SEQ ID NO: 1202630 - RNA, 19 nt, Homo sapiens
gcagccaucaucauuguga

SEQ ID NO: 1202631 - RNA, 19 nt, Homo sapiens
gaagacaugaggagcaaca

SEQ ID NO: 1202632 - RNA, 19 nt, Homo sapiens
ggucuaaagcacagauuug

SEQ ID NO: 1202633 - RNA, 19 nt, Homo sapiens
ggagauaagauggaagaug

SEQ ID NO: 1202634 - RNA, 19 nt, Homo sapiens
gagcucaggagauaagaug

SEQ ID NO: 1202635 - RNA, 19 nt, Homo sapiens
gcagaaagaggagaagcuu

SEQ ID NO: 1202636 - RNA, 19 nt, Homo sapiens
gcugaguucuacagugaug

SEQ ID NO: 1202637 - RNA, 19 nt, Homo sapiens
ccucaucauugucaaacuu

SEQ ID NO: 1202638 - RNA, 19 nt, Homo sapiens
guacucagaggccaaggaa

SEQ ID NO: 1202639 - RNA, 19 nt, Homo sapiens
ucaaugagacagccagaga

SEQ ID NO: 1202640 - RNA, 19 nt, Homo sapiens
auggugagcucaggagaua

SEQ ID NO: 1202641 - RNA, 19 nt, Homo sapiens
aggagaagcuucggaaaca

SEQ ID NO: 1202642 - RNA, 19 nt, Homo sapiens
aagaagaaacugcucaaga

SEQ ID NO: 1202643 - RNA, 19 nt, Homo sapiens
gaagaugcaacagccaaug

SEQ ID NO: 1202644 - RNA, 19 nt, Homo sapiens
gaggcgagacuaccacaug

SEQ ID NO: 1202645 - RNA, 19 nt, Homo sapiens
uaagauggaagaugcaaca

SEQ ID NO: 1202646 - RNA, 19 nt, Homo sapiens
augcugaguucuacaguga

SEQ ID NO: 1202647 - RNA, 19 nt, Homo sapiens
cuucaucuacuuccuguuu

SEQ ID NO: 1202648 - RNA, 19 nt, Homo sapiens
ggaacuggugcauauuuua

SEQ ID NO: 1202649 - RNA, 19 nt, Homo sapiens
gggaacuggugcauauuuu

SEQ ID NO: 1202650 - RNA, 19 nt, Homo sapiens
gugguuggguuugccauug

SEQ ID NO: 1202651 - RNA, 19 nt, Homo sapiens
augcauccaucaccaagaa

SEQ ID NO: 1202652 - RNA, 19 nt, Homo sapiens
gcuugaggcugggcacuuc

SEQ ID NO: 1202653 - RNA, 19 nt, Homo sapiens
caggagauaagauggaaga

SEQ ID NO: 1202654 - RNA, 19 nt, Homo sapiens
caccagccuugaagacaug

SEQ ID NO: 1202655 - RNA, 19 nt, Homo sapiens
gaggagaagcuucggaaac

SEQ ID NO: 1202656 - RNA, 19 nt, Homo sapiens
gcgagacuaccacauggaa

SEQ ID NO: 1202657 - RNA, 19 nt, Homo sapiens
acgacuccaugaucaauga

SEQ ID NO: 1202658 - RNA, 19 nt, Homo sapiens
caacagccaauggucaaga

SEQ ID NO: 1202659 - RNA, 19 nt, Homo sapiens
ggaagaugcaacagccaau

SEQ ID NO: 1202660 - RNA, 19 nt, Homo sapiens
uugaacgacuccaugauca

SEQ ID NO: 1202661 - RNA, 19 nt, Homo sapiens
cuucuacccugucuucauc

SEQ ID NO: 1202662 - RNA, 19 nt, Homo sapiens
gaagaagaaacugcucaag

SEQ ID NO: 1202663 - RNA, 19 nt, Homo sapiens
cccgugaguugcucuaugu

SEQ ID NO: 1202664 - RNA, 19 nt, Homo sapiens
guguuuggccuccaucuga

SEQ ID NO: 1202665 - RNA, 19 nt, Homo sapiens
gauaagauggaagaugcaa

SEQ ID NO: 1202666 - RNA, 19 nt, Homo sapiens
ggagaagcuucggaaacag

SEQ ID NO: 1202667 - RNA, 19 nt, Homo sapiens
gcucaggagauaagaugga

SEQ ID NO: 1202668 - RNA, 19 nt, Homo sapiens
acaccagccuugaagacau

SEQ ID NO: 1202669 - RNA, 19 nt, Homo sapiens
gcuaccggguggacagcaa

SEQ ID NO: 1202670 - RNA, 19 nt, Homo sapiens
ugaagcuguugaaugacaa

SEQ ID NO: 1202671 - RNA, 19 nt, Homo sapiens
gcacugcugucugcaacac

SEQ ID NO: 1202672 - RNA, 19 nt, Homo sapiens
cgccucaguuuccauuaau

SEQ ID NO: 1202673 - RNA, 19 nt, Homo sapiens
ggugggcagugugacagaa

SEQ ID NO: 1202674 - RNA, 19 nt, Homo sapiens
gggagggaacuggugcaua

SEQ ID NO: 1202675 - RNA, 19 nt, Homo sapiens
guggugaagcuguugaaug

SEQ ID NO: 1202676 - RNA, 19 nt, Homo sapiens
cacugucccucaucuauac

SEQ ID NO: 1202677 - RNA, 19 nt, Homo sapiens
gccacugucccucaucuau

SEQ ID NO: 1202678 - RNA, 19 nt, Homo sapiens
cagcucaaguauguguuug

SEQ ID NO: 1202679 - RNA, 19 nt, Homo sapiens
gcacuucccggcacaucuc

SEQ ID NO: 1202680 - RNA, 19 nt, Homo sapiens
ugggugcccucuccuuugu

SEQ ID NO: 1202681 - RNA, 19 nt, Homo sapiens
caguuuccauuaaugucaa

SEQ ID NO: 1202682 - RNA, 19 nt, Homo sapiens
gggucuaaagcacagauuu

SEQ ID NO: 1202683 - RNA, 19 nt, Homo sapiens
ccuauggcaugggucuaaa

SEQ ID NO: 1202684 - RNA, 19 nt, Homo sapiens
aacagccaauggucaagaa

SEQ ID NO: 1202685 - RNA, 19 nt, Homo sapiens
caacaccagccuugaagac

SEQ ID NO: 1202686 - RNA, 19 nt, Homo sapiens
cuacagugaugcgcugaag

SEQ ID NO: 1202687 - RNA, 19 nt, Homo sapiens
uuaucuggcuggugaccuu

SEQ ID NO: 1202688 - RNA, 19 nt, Homo sapiens
gucuaaagcacagauuuga

SEQ ID NO: 1202689 - RNA, 19 nt, Homo sapiens
gcagcugcccaugccgaua

SEQ ID NO: 1202690 - RNA, 19 nt, Homo sapiens
gaacuggugcauauuuuag

SEQ ID NO: 1202691 - RNA, 19 nt, Homo sapiens
ggugagcucaggagauaag

SEQ ID NO: 1202692 - RNA, 19 nt, Homo sapiens
uuccucaucucccagaaga

SEQ ID NO: 1202693 - RNA, 19 nt, Homo sapiens
acggauauuuacagagaug

SEQ ID NO: 1202694 - RNA, 19 nt, Homo sapiens
gggccucaguaaccuuauc

SEQ ID NO: 1202695 - RNA, 19 nt, Homo sapiens
aaagcacagauuugaggua

SEQ ID NO: 1202696 - RNA, 19 nt, Homo sapiens
ggccacaggcaucuccuau

SEQ ID NO: 1202697 - RNA, 19 nt, Homo sapiens
gggccacugucccucaucu

SEQ ID NO: 1202698 - RNA, 19 nt, Homo sapiens
gauggugagcucaggagau

SEQ ID NO: 1202699 - RNA, 19 nt, Homo sapiens
uugaagacaugaggagcaa

SEQ ID NO: 1202700 - RNA, 19 nt, Homo sapiens
ggagggaacuggugcauau

SEQ ID NO: 1202701 - RNA, 19 nt, Homo sapiens
agaagaaacugcucaagaa

SEQ ID NO: 1202702 - RNA, 19 nt, Homo sapiens
ucaagagccugaagaauau

SEQ ID NO: 1202703 - RNA, 19 nt, Homo sapiens
ugaagcaacugcagaaaga

SEQ ID NO: 1202704 - RNA, 19 nt, Homo sapiens
gcuccugggugaccuguua

SEQ ID NO: 1202705 - RNA, 19 nt, Homo sapiens
caggugagcucaggagaua

SEQ ID NO: 1202706 - RNA, 19 nt, Homo sapiens
ggagccaucucuucccuuu

SEQ ID NO: 1202707 - RNA, 19 nt, Homo sapiens
ccagauggguccacacuga

SEQ ID NO: 1202708 - RNA, 19 nt, Homo sapiens
gcacagauuugagguagau

SEQ ID NO: 1202709 - RNA, 19 nt, Homo sapiens
ucucacagcucaaguaugu

SEQ ID NO: 1202710 - RNA, 19 nt, Homo sapiens
acagagauguggcagagua

SEQ ID NO: 1202711 - RNA, 19 nt, Homo sapiens
acacggauauuuacagaga

SEQ ID NO: 1202712 - RNA, 19 nt, Homo sapiens
acacccagcuguucucaaa

SEQ ID NO: 1202713 - RNA, 19 nt, Homo sapiens
uggugaagcuguugaauga

SEQ ID NO: 1202714 - RNA, 19 nt, Homo sapiens
cucaagagccugaagaaua

SEQ ID NO: 1202715 - RNA, 19 nt, Homo sapiens
ggacacagaugccccacua

SEQ ID NO: 1202716 - RNA, 19 nt, Homo sapiens
gcagaggugugguguggau

SEQ ID NO: 1202717 - RNA, 19 nt, Homo sapiens
ccacaggcaucuccuaugg

SEQ ID NO: 1202718 - RNA, 19 nt, Homo sapiens
gggcggaucugcuuaucug

SEQ ID NO: 1202719 - RNA, 19 nt, Homo sapiens
ccaugaugcugucaccuuu

SEQ ID NO: 1202720 - RNA, 19 nt, Homo sapiens
ccucaggaauaaagauuug

SEQ ID NO: 1202721 - RNA, 19 nt, Homo sapiens
agauugagguggaggugua

SEQ ID NO: 1202722 - RNA, 19 nt, Homo sapiens
agacacggauauuuacaga

SEQ ID NO: 1202723 - RNA, 19 nt, Homo sapiens
gaccuuugcugucaugucu

SEQ ID NO: 1202724 - RNA, 19 nt, Homo sapiens
gaagaaacugcucaagaag

SEQ ID NO: 1202725 - RNA, 19 nt, Homo sapiens
ugccagacacggauauuua

SEQ ID NO: 1202726 - RNA, 19 nt, Homo sapiens
ccacugucccucaucuaua

SEQ ID NO: 1202727 - RNA, 19 nt, Homo sapiens
gaacgacuccaugaucaau

SEQ ID NO: 1202728 - RNA, 19 nt, Homo sapiens
gugaagcuguugaaugaca

SEQ ID NO: 1202729 - RNA, 19 nt, Homo sapiens
gcagccaucaucauuguga

SEQ ID NO: 1202730 - RNA, 19 nt, Homo sapiens
ggucuaaagcacagauuug

SEQ ID NO: 1202731 - RNA, 19 nt, Homo sapiens
ggagauaagauggaagaug

SEQ ID NO: 1202732 - RNA, 19 nt, Homo sapiens
gagcucaggagauaagaug

SEQ ID NO: 1202733 - RNA, 19 nt, Homo sapiens
gcagaaagaggagaagcuu

SEQ ID NO: 1202734 - RNA, 19 nt, Homo sapiens
gcugaguucuacagugaug

SEQ ID NO: 1202735 - RNA, 19 nt, Homo sapiens
ccucaucauugucaaacuu

SEQ ID NO: 1202736 - RNA, 19 nt, Homo sapiens
guacucagaggccaaggaa

SEQ ID NO: 1202737 - RNA, 19 nt, Homo sapiens
ucaaugagacagccagaga

SEQ ID NO: 1202738 - RNA, 19 nt, Homo sapiens
aggagaagcuucggaaaca

SEQ ID NO: 1202739 - RNA, 19 nt, Homo sapiens
aagaagaaacugcucaaga

SEQ ID NO: 1202740 - RNA, 19 nt, Homo sapiens
gaagaugcaacagccaaug

SEQ ID NO: 1202741 - RNA, 19 nt, Homo sapiens
gaggcgagacuaccacaug

SEQ ID NO: 1202742 - RNA, 19 nt, Homo sapiens
uaagauggaagaugcaaca

SEQ ID NO: 1202743 - RNA, 19 nt, Homo sapiens
augcugaguucuacaguga

SEQ ID NO: 1202744 - RNA, 19 nt, Homo sapiens
cuucaucuacuuccuguuu

SEQ ID NO: 1202745 - RNA, 19 nt, Homo sapiens
ggaacuggugcauauuuua

SEQ ID NO: 1202746 - RNA, 19 nt, Homo sapiens
gggaacuggugcauauuuu

SEQ ID NO: 1202747 - RNA, 19 nt, Homo sapiens
gugguuggguuugccauug

SEQ ID NO: 1202748 - RNA, 19 nt, Homo sapiens
gcgagacuaccacauggaa

SEQ ID NO: 1202749 - RNA, 19 nt, Homo sapiens
augcauccaucaccaagaa

SEQ ID NO: 1202750 - RNA, 19 nt, Homo sapiens
gcuugaggcugggcacuuc

SEQ ID NO: 1202751 - RNA, 19 nt, Homo sapiens
caggagauaagauggaaga

SEQ ID NO: 1202752 - RNA, 19 nt, Homo sapiens
gaggagaagcuucggaaac

SEQ ID NO: 1202753 - RNA, 19 nt, Homo sapiens
acgacuccaugaucaauga

SEQ ID NO: 1202754 - RNA, 19 nt, Homo sapiens
caacagccaauggucaaga

SEQ ID NO: 1202755 - RNA, 19 nt, Homo sapiens
ggaagaugcaacagccaau

SEQ ID NO: 1202756 - RNA, 19 nt, Homo sapiens
uugaacgacuccaugauca

SEQ ID NO: 1202757 - RNA, 19 nt, Homo sapiens
cuucuacccugucuucauc

SEQ ID NO: 1202758 - RNA, 19 nt, Homo sapiens
gaagaagaaacugcucaag

SEQ ID NO: 1202759 - RNA, 19 nt, Homo sapiens
cccgugaguugcucuaugu

SEQ ID NO: 1202760 - RNA, 19 nt, Homo sapiens
guguuuggccuccaucuga

SEQ ID NO: 1202761 - RNA, 19 nt, Homo sapiens
gauaagauggaagaugcaa

SEQ ID NO: 1202762 - RNA, 19 nt, Homo sapiens
gcaggugagcucaggagau

SEQ ID NO: 1202763 - RNA, 19 nt, Homo sapiens
ggagaagcuucggaaacag

SEQ ID NO: 1202764 - RNA, 19 nt, Homo sapiens
gcucaggagauaagaugga

SEQ ID NO: 1202765 - RNA, 19 nt, Homo sapiens
gcacugcugucugcaacac

SEQ ID NO: 1202766 - RNA, 19 nt, Homo sapiens
gcuaccggguggacagcaa

SEQ ID NO: 1202767 - RNA, 19 nt, Homo sapiens
ugaagcuguugaaugacaa

SEQ ID NO: 1202768 - RNA, 19 nt, Homo sapiens
ggugggcagugugacagaa

SEQ ID NO: 1202769 - RNA, 19 nt, Homo sapiens
gggagggaacuggugcaua

SEQ ID NO: 1202770 - RNA, 19 nt, Homo sapiens
guggugaagcuguugaaug

SEQ ID NO: 1202771 - RNA, 19 nt, Homo sapiens
cacugucccucaucuauac

SEQ ID NO: 1202772 - RNA, 19 nt, Homo sapiens
gccacugucccucaucuau

SEQ ID NO: 1202773 - RNA, 19 nt, Homo sapiens
cagcucaaguauguguuug

SEQ ID NO: 1202774 - RNA, 19 nt, Homo sapiens
gcacuucccggcacaucuc

SEQ ID NO: 1202775 - RNA, 19 nt, Homo sapiens
ugggugcccucuccuuugu

SEQ ID NO: 1202776 - RNA, 19 nt, Homo sapiens
gggucuaaagcacagauuu

SEQ ID NO: 1202777 - RNA, 19 nt, Homo sapiens
ccuauggcaugggucuaaa

SEQ ID NO: 1202778 - RNA, 19 nt, Homo sapiens
aacagccaauggucaagaa

SEQ ID NO: 1202779 - RNA, 19 nt, Homo sapiens
cuacagugaugcgcugaag

SEQ ID NO: 1202780 - RNA, 19 nt, Homo sapiens
uuaucuggcuggugaccuu

SEQ ID NO: 1202781 - RNA, 19 nt, Homo sapiens
gucuaaagcacagauuuga

SEQ ID NO: 1202782 - RNA, 19 nt, Homo sapiens
gcagcugcccaugccgaua

SEQ ID NO: 1202783 - RNA, 19 nt, Homo sapiens
gaacuggugcauauuuuag

SEQ ID NO: 1202784 - RNA, 19 nt, Homo sapiens
ggugagcucaggagauaag

SEQ ID NO: 1202785 - RNA, 19 nt, Homo sapiens
uuccucaucucccagaaga

SEQ ID NO: 1202786 - RNA, 19 nt, Homo sapiens
acggauauuuacagagaug

SEQ ID NO: 1202787 - RNA, 19 nt, Homo sapiens
gggccucaguaaccuuauc

SEQ ID NO: 1202788 - RNA, 19 nt, Homo sapiens
aaagcacagauuugaggua

SEQ ID NO: 1202789 - RNA, 19 nt, Homo sapiens
ggccacaggcaucuccuau

SEQ ID NO: 1202790 - RNA, 19 nt, Homo sapiens
gggccacugucccucaucu

SEQ ID NO: 1202791 - RNA, 19 nt, Homo sapiens
cagccaucaucauugugaa

SEQ ID NO: 1202792 - RNA, 19 nt, Homo sapiens
agggaacuggugcauauuu

SEQ ID NO: 1202793 - RNA, 19 nt, Homo sapiens
cagccaauggucaagaaga

SEQ ID NO: 1202794 - RNA, 19 nt, Homo sapiens
acucagaggccaaggaagu

SEQ ID NO: 1202795 - RNA, 19 nt, Homo sapiens
gugccagacacggauauuu

SEQ ID NO: 1202796 - RNA, 19 nt, Homo sapiens
ggugguugcggucaucuuc

SEQ ID NO: 1202797 - RNA, 19 nt, Homo sapiens
ggcugggccugauccacuu

SEQ ID NO: 1202798 - RNA, 19 nt, Homo sapiens
caaggagacuggugaauaa

SEQ ID NO: 1202799 - RNA, 19 nt, Homo sapiens
uaggagagauggaagauaa

SEQ ID NO: 1202800 - RNA, 19 nt, Homo sapiens
ggaaggagauuugggagaa

SEQ ID NO: 1202801 - RNA, 19 nt, Homo sapiens
gcaaacauaacuccuagua

SEQ ID NO: 1202802 - RNA, 19 nt, Homo sapiens
ccauugcacugguuaguuu

SEQ ID NO: 1202803 - RNA, 19 nt, Homo sapiens
gugaauggcagaauauuaa

SEQ ID NO: 1202804 - RNA, 19 nt, Homo sapiens
caacaccacuguacuuugg

SEQ ID NO: 1202805 - RNA, 19 nt, Homo sapiens
ccacaacuauggcacauca

SEQ ID NO: 1202806 - RNA, 19 nt, Homo sapiens
gaacaauggacaucuacaa

SEQ ID NO: 1202807 - RNA, 19 nt, Homo sapiens
gguguggucuucuccauga

SEQ ID NO: 1202808 - RNA, 19 nt, Homo sapiens
caauggacaucuacaagga

SEQ ID NO: 1202809 - RNA, 19 nt, Homo sapiens
gguggaagauggcuagaau

SEQ ID NO: 1202810 - RNA, 19 nt, Homo sapiens
gaugacaugugugugauga

SEQ ID NO: 1202811 - RNA, 19 nt, Homo sapiens
gcuguugccuggaggguaa

SEQ ID NO: 1202812 - RNA, 19 nt, Homo sapiens
gggauggaauuauagauag

SEQ ID NO: 1202813 - RNA, 19 nt, Homo sapiens
ucaagacgcuggccuccuu

SEQ ID NO: 1202814 - RNA, 19 nt, Homo sapiens
ggagacuggugaauaaugg

SEQ ID NO: 1202815 - RNA, 19 nt, Homo sapiens
gaguggacuuugugagaaa

SEQ ID NO: 1202816 - RNA, 19 nt, Homo sapiens
caacuggugcgggucauua

SEQ ID NO: 1202817 - RNA, 19 nt, Homo sapiens
acaaggagacuggugaaua

SEQ ID NO: 1202818 - RNA, 19 nt, Homo sapiens
gcagacaaguauagcuaca

SEQ ID NO: 1202819 - RNA, 19 nt, Homo sapiens
ggagcucacugacccaaag

SEQ ID NO: 1202820 - RNA, 19 nt, Homo sapiens
gguagucacugcccuggau

SEQ ID NO: 1202821 - RNA, 19 nt, Homo sapiens
agaugugaauggcagaaua

SEQ ID NO: 1202822 - RNA, 19 nt, Homo sapiens
aaacacauauacccugcuu

SEQ ID NO: 1202823 - RNA, 19 nt, Homo sapiens
gguggaugcuggugggaaa

SEQ ID NO: 1202824 - RNA, 19 nt, Homo sapiens
gcugagagcuuuggaaucc

SEQ ID NO: 1202825 - RNA, 19 nt, Homo sapiens
gcagugauggccuggcuuu

SEQ ID NO: 1202826 - RNA, 19 nt, Homo sapiens
gcaccuauauagagaagac

SEQ ID NO: 1202827 - RNA, 19 nt, Homo sapiens
uaacuccuaguaugcuuua

SEQ ID NO: 1202828 - RNA, 19 nt, Homo sapiens
cgaguggacuuugugagaa

SEQ ID NO: 1202829 - RNA, 19 nt, Homo sapiens
ccagaucagcuguuuguga

SEQ ID NO: 1202830 - RNA, 19 nt, Homo sapiens
ucacuugccuugguaguca

SEQ ID NO: 1202831 - RNA, 19 nt, Homo sapiens
acacauauacccugcuuau

SEQ ID NO: 1202832 - RNA, 19 nt, Homo sapiens
gaugccagcuuucucuucu

SEQ ID NO: 1202833 - RNA, 19 nt, Homo sapiens
ggacacaagauaccaaguc

SEQ ID NO: 1202834 - RNA, 19 nt, Homo sapiens
gagaaaaggagacuucaaa

SEQ ID NO: 1202835 - RNA, 19 nt, Homo sapiens
ucacugcccuggaucucuu

SEQ ID NO: 1202836 - RNA, 19 nt, Homo sapiens
gauaccaaguccagauagu

SEQ ID NO: 1202837 - RNA, 19 nt, Homo sapiens
gcaggaagaccagcucuca

SEQ ID NO: 1202838 - RNA, 19 nt, Homo sapiens
gaugugaauggcagaauau

SEQ ID NO: 1202839 - RNA, 19 nt, Homo sapiens
gcgggaggguuagauguga

SEQ ID NO: 1202840 - RNA, 19 nt, Homo sapiens
uggcugagcugcccaggau

SEQ ID NO: 1202841 - RNA, 19 nt, Homo sapiens
gcagagggcccugaugaca

SEQ ID NO: 1202842 - RNA, 19 nt, Homo sapiens
gugcagagggcccugauga

SEQ ID NO: 1202843 - RNA, 19 nt, Homo sapiens
gugggaggcucucuuccuu

SEQ ID NO: 1202844 - RNA, 19 nt, Homo sapiens
agagggcccugaugacaug

SEQ ID NO: 1202845 - RNA, 19 nt, Homo sapiens
ccuuuggccugaauauuug

SEQ ID NO: 1202846 - RNA, 19 nt, Homo sapiens
gaagaccagcucucaugug

SEQ ID NO: 1202847 - RNA, 19 nt, Homo sapiens
gcuacacuauugacuccaa

SEQ ID NO: 1202848 - RNA, 19 nt, Homo sapiens
caagauaccaaguccagau

SEQ ID NO: 1202849 - RNA, 19 nt, Homo sapiens
ugaggaccaugacccuuga

SEQ ID NO: 1202850 - RNA, 19 nt, Homo sapiens
gaauggcagaauauuaaga

SEQ ID NO: 1202851 - RNA, 19 nt, Homo sapiens
gaacuugaacaauggacau

SEQ ID NO: 1202852 - RNA, 19 nt, Homo sapiens
guaagagaaugaaaagaug

SEQ ID NO: 1202853 - RNA, 19 nt, Homo sapiens
ccagcaaacauaacuccua

SEQ ID NO: 1202854 - RNA, 19 nt, Homo sapiens
ggaagaccagcucucaugu

SEQ ID NO: 1202855 - RNA, 19 nt, Homo sapiens
gaaggagauuugggagaag

SEQ ID NO: 1202856 - RNA, 19 nt, Homo sapiens
ugugaauggcagaauauua

SEQ ID NO: 1202857 - RNA, 19 nt, Homo sapiens
cacccaacacucccucuua

SEQ ID NO: 1202858 - RNA, 19 nt, Homo sapiens
gggaggcucucuuccuuuu

SEQ ID NO: 1202859 - RNA, 19 nt, Homo sapiens
cuggugcccuaaacacaua

SEQ ID NO: 1202860 - RNA, 19 nt, Homo sapiens
guuguuuccuucugucaug

SEQ ID NO: 1202861 - RNA, 19 nt, Homo sapiens
cuaauuguccuggucuuaa

SEQ ID NO: 1202862 - RNA, 19 nt, Homo sapiens
gcaucaacaucuccagcau

SEQ ID NO: 1202863 - RNA, 19 nt, Homo sapiens
cuugaacaauggacaucua

SEQ ID NO: 1202864 - RNA, 19 nt, Homo sapiens
ggagaaacagguggaagau

SEQ ID NO: 1202865 - RNA, 19 nt, Homo sapiens
ucuccucccucuucucuug

SEQ ID NO: 1202866 - RNA, 19 nt, Homo sapiens
gcucacugacccaaagauu

SEQ ID NO: 1202867 - RNA, 19 nt, Homo sapiens
caaacauaacuccuaguau

SEQ ID NO: 1202868 - RNA, 19 nt, Homo sapiens
ccucucaucuuguuagcau

SEQ ID NO: 1202869 - RNA, 19 nt, Homo sapiens
ccacuucaucucacuguau

SEQ ID NO: 1202870 - RNA, 19 nt, Homo sapiens
gccagccgaugucgagaug

SEQ ID NO: 1202871 - RNA, 19 nt, Homo sapiens
cccuuuggccugaauauuu

SEQ ID NO: 1202872 - RNA, 19 nt, Homo sapiens
uaauuguccuggucuuaag

SEQ ID NO: 1202873 - RNA, 19 nt, Homo sapiens
ggauggaauuauagauagg

SEQ ID NO: 1202874 - RNA, 19 nt, Homo sapiens
cuacaaaacuggggaacuu

SEQ ID NO: 1202875 - RNA, 19 nt, Homo sapiens
ccucaucuccucccucuuc

SEQ ID NO: 1202876 - RNA, 19 nt, Homo sapiens
ccaacacucccucuuaucu

SEQ ID NO: 1202877 - RNA, 19 nt, Homo sapiens
gacuccagaucagcuguuu

SEQ ID NO: 1202878 - RNA, 19 nt, Homo sapiens
guggucuucuccaugauga

SEQ ID NO: 1202879 - RNA, 19 nt, Homo sapiens
gucauuacauuuggugugu

SEQ ID NO: 1202880 - RNA, 19 nt, Homo sapiens
gugcgggucauuacauuug

SEQ ID NO: 1202881 - RNA, 19 nt, Homo sapiens
caggugugguucaaaauaa

SEQ ID NO: 1202882 - RNA, 19 nt, Homo sapiens
ggagagauggaagauaaca

SEQ ID NO: 1202883 - RNA, 19 nt, Homo sapiens
guaagagggcauccuugga

SEQ ID NO: 1202884 - RNA, 19 nt, Homo sapiens
gacccugaguguggauuug

SEQ ID NO: 1202885 - RNA, 19 nt, Homo sapiens
cauuacauuuggugugugu

SEQ ID NO: 1202886 - RNA, 19 nt, Homo sapiens
acccaacacucccucuuau

SEQ ID NO: 1202887 - RNA, 19 nt, Homo sapiens
gggaaaggaugggguuuga

SEQ ID NO: 1202888 - RNA, 19 nt, Homo sapiens
gagauggaagauaacaaug

SEQ ID NO: 1202889 - RNA, 19 nt, Homo sapiens
ccugaugacauguguguga

SEQ ID NO: 1202890 - RNA, 19 nt, Homo sapiens
gccugaauauuuguaacuu

SEQ ID NO: 1202891 - RNA, 19 nt, Homo sapiens
guccuggucuuaaguucug

SEQ ID NO: 1202892 - RNA, 19 nt, Homo sapiens
gcucgugccggucaaggaa

SEQ ID NO: 1202893 - RNA, 19 nt, Homo sapiens
agagauggaagauaacaau

SEQ ID NO: 1202894 - RNA, 19 nt, Homo sapiens
caaccaggugggacucuga

SEQ ID NO: 1202895 - RNA, 19 nt, Homo sapiens
aagauaccaaguccagaua

SEQ ID NO: 1202896 - RNA, 19 nt, Homo sapiens
ggaagucgucuuggugcuu

SEQ ID NO: 1202897 - RNA, 19 nt, Homo sapiens
cugcuucucucucuucaag

SEQ ID NO: 1202898 - RNA, 19 nt, Homo sapiens
gcauggagcuggugaauua

SEQ ID NO: 1202899 - RNA, 19 nt, Homo sapiens
gcaaaugugcuucaucuaa

SEQ ID NO: 1202900 - RNA, 19 nt, Homo sapiens
caagagaggucccaagcaa

SEQ ID NO: 1202901 - RNA, 19 nt, Homo sapiens
gaagccaucuugaacacaa

SEQ ID NO: 1202902 - RNA, 19 nt, Homo sapiens
gaacugaauauuuggcuuu

SEQ ID NO: 1202903 - RNA, 19 nt, Homo sapiens
gagaccaucugcccgagua

SEQ ID NO: 1202904 - RNA, 19 nt, Homo sapiens
uggccaagcuggucuagua

SEQ ID NO: 1202905 - RNA, 19 nt, Homo sapiens
uggaccagcuacugaauua

SEQ ID NO: 1202906 - RNA, 19 nt, Homo sapiens
caacaugggucagcacguu

SEQ ID NO: 1202907 - RNA, 19 nt, Homo sapiens
uggaagaacuugagugaga

SEQ ID NO: 1202908 - RNA, 19 nt, Homo sapiens
ccaacaggcucacagagaa

SEQ ID NO: 1202909 - RNA, 19 nt, Homo sapiens
gcgcagagagggcugguua

SEQ ID NO: 1202910 - RNA, 19 nt, Homo sapiens
caaaugugcuucaucuaag

SEQ ID NO: 1202911 - RNA, 19 nt, Homo sapiens
gaugagcaguaaguaagua

SEQ ID NO: 1202912 - RNA, 19 nt, Homo sapiens
gccuugaacugaauauuug

SEQ ID NO: 1202913 - RNA, 19 nt, Homo sapiens
uagcgaaagugacggauga

SEQ ID NO: 1202914 - RNA, 19 nt, Homo sapiens
uuacgggagugggaaauua

SEQ ID NO: 1202915 - RNA, 19 nt, Homo sapiens
uggcuaaccuggaguguga

SEQ ID NO: 1202916 - RNA, 19 nt, Homo sapiens
gaguuuggcugugaccuuu

SEQ ID NO: 1202917 - RNA, 19 nt, Homo sapiens
caguaaagguugucuucaa

SEQ ID NO: 1202918 - RNA, 19 nt, Homo sapiens
cagcguagcaugucugauu

SEQ ID NO: 1202919 - RNA, 19 nt, Homo sapiens
gaaguuagacaagaugguu

SEQ ID NO: 1202920 - RNA, 19 nt, Homo sapiens
gaccagcuacugaauuauu

SEQ ID NO: 1202921 - RNA, 19 nt, Homo sapiens
gaaggcagacaucaacaug

SEQ ID NO: 1202922 - RNA, 19 nt, Homo sapiens
gcuuucggcuggaggagua

SEQ ID NO: 1202923 - RNA, 19 nt, Homo sapiens
guaugugccuugaacugaa

SEQ ID NO: 1202924 - RNA, 19 nt, Homo sapiens
ccagggcagugauugacua

SEQ ID NO: 1202925 - RNA, 19 nt, Homo sapiens
gggcagguaucaacauugg

SEQ ID NO: 1202926 - RNA, 19 nt, Homo sapiens
gagcagucacuuacagaaa

SEQ ID NO: 1202927 - RNA, 19 nt, Homo sapiens
gagaaguguuguguggaaa

SEQ ID NO: 1202928 - RNA, 19 nt, Homo sapiens
agagaaguguuguguggaa

SEQ ID NO: 1202929 - RNA, 19 nt, Homo sapiens
gcaaauggaagaacuugag

SEQ ID NO: 1202930 - RNA, 19 nt, Homo sapiens
ggagugggaaauuacauga

SEQ ID NO: 1202931 - RNA, 19 nt, Homo sapiens
gcugcugccuggcugauga

SEQ ID NO: 1202932 - RNA, 19 nt, Homo sapiens
gaaauccgacaacauccuu

SEQ ID NO: 1202933 - RNA, 19 nt, Homo sapiens
ccgcaaaugugcuucaucu

SEQ ID NO: 1202934 - RNA, 19 nt, Homo sapiens
gccaguaccuuugugugaa

SEQ ID NO: 1202935 - RNA, 19 nt, Homo sapiens
ugacuagccucucuuacag

SEQ ID NO: 1202936 - RNA, 19 nt, Homo sapiens
accagcuacugaauuauua

SEQ ID NO: 1202937 - RNA, 19 nt, Homo sapiens
caggagauccaggcaauuu

SEQ ID NO: 1202938 - RNA, 19 nt, Homo sapiens
gagcaucggccugcaguug

SEQ ID NO: 1202939 - RNA, 19 nt, Homo sapiens
gcacagagaccugaaaucc

SEQ ID NO: 1202940 - RNA, 19 nt, Homo sapiens
augaagaacuaucccugua

SEQ ID NO: 1202941 - RNA, 19 nt, Homo sapiens
ugacguaugugccuugaac

SEQ ID NO: 1202942 - RNA, 19 nt, Homo sapiens
ggacgcuguuccucguuau

SEQ ID NO: 1202943 - RNA, 19 nt, Homo sapiens
ggagccaucgccuaugaaa

SEQ ID NO: 1202944 - RNA, 19 nt, Homo sapiens
uggcagaguuuggcuguga

SEQ ID NO: 1202945 - RNA, 19 nt, Homo sapiens
gaaaucuucgggcuuguca

SEQ ID NO: 1202946 - RNA, 19 nt, Homo sapiens
cggacgcuguuccucguua

SEQ ID NO: 1202947 - RNA, 19 nt, Homo sapiens
gugggcagguaucaacauu

SEQ ID NO: 1202948 - RNA, 19 nt, Homo sapiens
caucgccuaugaaaucuuc

SEQ ID NO: 1202949 - RNA, 19 nt, Homo sapiens
ugggagccaucgccuauga

SEQ ID NO: 1202950 - RNA, 19 nt, Homo sapiens
gaccugaaauccgacaaca

SEQ ID NO: 1202951 - RNA, 19 nt, Homo sapiens
gaugacguaugugccuuga

SEQ ID NO: 1202952 - RNA, 19 nt, Homo sapiens
gucaggagauccaggcaau

SEQ ID NO: 1202953 - RNA, 19 nt, Homo sapiens
gggcagugauugacuacag

SEQ ID NO: 1202954 - RNA, 19 nt, Homo sapiens
cuaaaucagcgucaacaug

SEQ ID NO: 1202955 - RNA, 19 nt, Homo sapiens
ggagcagucacuuacagaa

SEQ ID NO: 1202956 - RNA, 19 nt, Homo sapiens
gccaacaggcucacagaga

SEQ ID NO: 1202957 - RNA, 19 nt, Homo sapiens
ccgaguagccgcaaaugug

SEQ ID NO: 1202958 - RNA, 19 nt, Homo sapiens
gcgagaggccagcaagaga

SEQ ID NO: 1202959 - RNA, 19 nt, Homo sapiens
aggaagcuaugccuaaauc

SEQ ID NO: 1202960 - RNA, 19 nt, Homo sapiens
auagggcaguccauuggua

SEQ ID NO: 1202961 - RNA, 19 nt, Homo sapiens
cugaauauuuggcuuuaag

SEQ ID NO: 1202962 - RNA, 19 nt, Homo sapiens
gcgaagccaucuugaacac

SEQ ID NO: 1202963 - RNA, 19 nt, Homo sapiens
uagccucucuuacaggaau

SEQ ID NO: 1202964 - RNA, 19 nt, Homo sapiens
gggcuuggcaaauggaaga

SEQ ID NO: 1202965 - RNA, 19 nt, Homo sapiens
ggagucaggagacaagaca

SEQ ID NO: 1202966 - RNA, 19 nt, Homo sapiens
ggagcuggugaauuacuaa

SEQ ID NO: 1202967 - RNA, 19 nt, Homo sapiens
uggaacaucucggcagguu

SEQ ID NO: 1202968 - RNA, 19 nt, Homo sapiens
ccugaaauccgacaacauc

SEQ ID NO: 1202969 - RNA, 19 nt, Homo sapiens
ggcuggugaucgcagauuu

SEQ ID NO: 1202970 - RNA, 19 nt, Homo sapiens
gcgucaacaugcaguaaag

SEQ ID NO: 1202971 - RNA, 19 nt, Homo sapiens
gaagcuaugccuaaaucag

SEQ ID NO: 1202972 - RNA, 19 nt, Homo sapiens
uggagcuggugaauuacua

SEQ ID NO: 1202973 - RNA, 19 nt, Homo sapiens
ugccuugaacugaauauuu

SEQ ID NO: 1202974 - RNA, 19 nt, Homo sapiens
aauggaagaacuugaguga

SEQ ID NO: 1202975 - RNA, 19 nt, Homo sapiens
ccaagaggcucagcuaccu

SEQ ID NO: 1202976 - RNA, 19 nt, Homo sapiens
cggaaacggcugucugaug

SEQ ID NO: 1202977 - RNA, 19 nt, Homo sapiens
gaagccaccaugccuacau

SEQ ID NO: 1202978 - RNA, 19 nt, Homo sapiens
caacugcagaugacguaug

SEQ ID NO: 1202979 - RNA, 19 nt, Homo sapiens
gagcuggugaauuacuaaa

SEQ ID NO: 1202980 - RNA, 19 nt, Homo sapiens
aagccaccaugccuacauu

SEQ ID NO: 1202981 - RNA, 19 nt, Homo sapiens
ccuguacccugcgccagua

SEQ ID NO: 1202982 - RNA, 19 nt, Homo sapiens
ucucuuacaggaauuguga

SEQ ID NO: 1202983 - RNA, 19 nt, Homo sapiens
gcugucaguggcagaguuu

SEQ ID NO: 1202984 - RNA, 19 nt, Homo sapiens
cuaccaagaggcucagcua

SEQ ID NO: 1202985 - RNA, 19 nt, Homo sapiens
ggcggaaacggcugucuga

SEQ ID NO: 1202986 - RNA, 19 nt, Homo sapiens
gcaguaaagguugucuuca

SEQ ID NO: 1202987 - RNA, 19 nt, Homo sapiens
ugacggaugagcaguaagu

SEQ ID NO: 1202988 - RNA, 19 nt, Homo sapiens
gggucagcacguucaguua

SEQ ID NO: 1202989 - RNA, 19 nt, Homo sapiens
gaauggccaagcuggucua

SEQ ID NO: 1202990 - RNA, 19 nt, Homo sapiens
guauggagcagucacuuac

SEQ ID NO: 1202991 - RNA, 19 nt, Homo sapiens
cagcgaagccaucuugaac

SEQ ID NO: 1202992 - RNA, 19 nt, Homo sapiens
gaagaacuugagugagagu

SEQ ID NO: 1202993 - RNA, 19 nt, Homo sapiens
ccagcgaagccaucuugaa

SEQ ID NO: 1202994 - RNA, 19 nt, Homo sapiens
ggccugcaguugcccuuca

SEQ ID NO: 1202995 - RNA, 19 nt, Homo sapiens
gcgcacagagaccugaaau

SEQ ID NO: 1202996 - RNA, 19 nt, Homo sapiens
ucaacaugcaguaaagguu

SEQ ID NO: 1202997 - RNA, 19 nt, Homo sapiens
ggaugagcaguaaguaagu

SEQ ID NO: 1202998 - RNA, 19 nt, Homo sapiens
gaaagcagcugucauauuu

SEQ ID NO: 1202999 - RNA, 19 nt, Homo sapiens
caaaggacauuaaggaaua

SEQ ID NO: 1203000 - RNA, 19 nt, Homo sapiens
gagcugagccgaaauauaa

SEQ ID NO: 1203001 - RNA, 19 nt, Homo sapiens
ccagaagacuagagaauua

SEQ ID NO: 1203002 - RNA, 19 nt, Homo sapiens
ucucagacaugcuguauua

SEQ ID NO: 1203003 - RNA, 19 nt, Homo sapiens
cagacaugcuguauuauua

SEQ ID NO: 1203004 - RNA, 19 nt, Homo sapiens
gagcugauauucuggauug

SEQ ID NO: 1203005 - RNA, 19 nt, Homo sapiens
ggagucgguuucucucuua

SEQ ID NO: 1203006 - RNA, 19 nt, Homo sapiens
gagccgaaauauaagaaua

SEQ ID NO: 1203007 - RNA, 19 nt, Homo sapiens
caaacucugucuuaaugua

SEQ ID NO: 1203008 - RNA, 19 nt, Homo sapiens
gcagagacauucacagaca

SEQ ID NO: 1203009 - RNA, 19 nt, Homo sapiens
cauaaucccuccuggcuuu

SEQ ID NO: 1203010 - RNA, 19 nt, Homo sapiens
uuacguaucugacaaguug

SEQ ID NO: 1203011 - RNA, 19 nt, Homo sapiens
ggaaucccaucuacccaua

SEQ ID NO: 1203012 - RNA, 19 nt, Homo sapiens
ucacagacaucuuccuuug

SEQ ID NO: 1203013 - RNA, 19 nt, Homo sapiens
gugaaagccuguaagugua

SEQ ID NO: 1203014 - RNA, 19 nt, Homo sapiens
aaauacaacuccaguaaga

SEQ ID NO: 1203015 - RNA, 19 nt, Homo sapiens
cuacaaggcugugaaauca

SEQ ID NO: 1203016 - RNA, 19 nt, Homo sapiens
uuacacagcuucuuagcaa

SEQ ID NO: 1203017 - RNA, 19 nt, Homo sapiens
gaaaggguuugauuugaag

SEQ ID NO: 1203018 - RNA, 19 nt, Homo sapiens
ccaaauacaacuccaguaa

SEQ ID NO: 1203019 - RNA, 19 nt, Homo sapiens
gaaguacccagaauuauca

SEQ ID NO: 1203020 - RNA, 19 nt, Homo sapiens
caaaagaccagacaaguua

SEQ ID NO: 1203021 - RNA, 19 nt, Homo sapiens
ucaaauggaugauguacug

SEQ ID NO: 1203022 - RNA, 19 nt, Homo sapiens
uaaggaauaugucaaaugg

SEQ ID NO: 1203023 - RNA, 19 nt, Homo sapiens
ucacuuugcuggccuuuga

SEQ ID NO: 1203024 - RNA, 19 nt, Homo sapiens
ucucagaugugcuuauaaa

SEQ ID NO: 1203025 - RNA, 19 nt, Homo sapiens
gauguggacuugugcuuau

SEQ ID NO: 1203026 - RNA, 19 nt, Homo sapiens
gaagcgcucuauucucaga

SEQ ID NO: 1203027 - RNA, 19 nt, Homo sapiens
cuaaaucuguuaaggaaga

SEQ ID NO: 1203028 - RNA, 19 nt, Homo sapiens
gaggugagauguggacuug

SEQ ID NO: 1203029 - RNA, 19 nt, Homo sapiens
cagaaaggguuugauuuga

SEQ ID NO: 1203030 - RNA, 19 nt, Homo sapiens
ccuauagaaugaucuguaa

SEQ ID NO: 1203031 - RNA, 19 nt, Homo sapiens
gcaaaaggguauaggaaaa

SEQ ID NO: 1203032 - RNA, 19 nt, Homo sapiens
ugagaacucugcuguuuca

SEQ ID NO: 1203033 - RNA, 19 nt, Homo sapiens
gggagaggcuaaagggaaa

SEQ ID NO: 1203034 - RNA, 19 nt, Homo sapiens
uggaugauguacuggauua

SEQ ID NO: 1203035 - RNA, 19 nt, Homo sapiens
gaaagucuguaauguucau

SEQ ID NO: 1203036 - RNA, 19 nt, Homo sapiens
agaaaggguuugauuugaa

SEQ ID NO: 1203037 - RNA, 19 nt, Homo sapiens
gaccagugcugccgauuuc

SEQ ID NO: 1203038 - RNA, 19 nt, Homo sapiens
guaauucugugcuugacaa

SEQ ID NO: 1203039 - RNA, 19 nt, Homo sapiens
ugaauagcuugcucacuuu

SEQ ID NO: 1203040 - RNA, 19 nt, Homo sapiens
uaaagacacucacuguaca

SEQ ID NO: 1203041 - RNA, 19 nt, Homo sapiens
cacauuagcuggaucuuag

SEQ ID NO: 1203042 - RNA, 19 nt, Homo sapiens
acagacaucuuccuuuguu

SEQ ID NO: 1203043 - RNA, 19 nt, Homo sapiens
gaauaugucaaauggauga

SEQ ID NO: 1203044 - RNA, 19 nt, Homo sapiens
ggaaguacccagaauuauc

SEQ ID NO: 1203045 - RNA, 19 nt, Homo sapiens
ggauacaacugaauguuuu

SEQ ID NO: 1203046 - RNA, 19 nt, Homo sapiens
ccagaaaggguuugauuug

SEQ ID NO: 1203047 - RNA, 19 nt, Homo sapiens
cuucugagguugguaauuu

SEQ ID NO: 1203048 - RNA, 19 nt, Homo sapiens
uggaaagucuguaauguuc

SEQ ID NO: 1203049 - RNA, 19 nt, Homo sapiens
acaaggcugugaaaucaaa

SEQ ID NO: 1203050 - RNA, 19 nt, Homo sapiens
gaacgucucagaugugcuu

SEQ ID NO: 1203051 - RNA, 19 nt, Homo sapiens
cugcugagauguacauuug

SEQ ID NO: 1203052 - RNA, 19 nt, Homo sapiens
gcacauuuccucuaguuca

SEQ ID NO: 1203053 - RNA, 19 nt, Homo sapiens
gaagcuguuugcucauguu

SEQ ID NO: 1203054 - RNA, 19 nt, Homo sapiens
cuauaaacaggcccaauua

SEQ ID NO: 1203055 - RNA, 19 nt, Homo sapiens
gcaaacacggccagccuaa

SEQ ID NO: 1203056 - RNA, 19 nt, Homo sapiens
uaagagugcuugucaacca

SEQ ID NO: 1203057 - RNA, 19 nt, Homo sapiens
gaaauguguucuccgugau

SEQ ID NO: 1203058 - RNA, 19 nt, Homo sapiens
ggugagauguggacuugug

SEQ ID NO: 1203059 - RNA, 19 nt, Homo sapiens
guaaacagcagacucauac

SEQ ID NO: 1203060 - RNA, 19 nt, Homo sapiens
gaugauguacuggauuaua

SEQ ID NO: 1203061 - RNA, 19 nt, Homo sapiens
uguagucccuauagaauga

SEQ ID NO: 1203062 - RNA, 19 nt, Homo sapiens
uccaaacucugucuuaaug

SEQ ID NO: 1203063 - RNA, 19 nt, Homo sapiens
uauccaaacucugucuuaa

SEQ ID NO: 1203064 - RNA, 19 nt, Homo sapiens
ccagacagaagaagaauau

SEQ ID NO: 1203065 - RNA, 19 nt, Homo sapiens
cgucucagaugugcuuaua

SEQ ID NO: 1203066 - RNA, 19 nt, Homo sapiens
gcacuuaacuaugccaaaa

SEQ ID NO: 1203067 - RNA, 19 nt, Homo sapiens
uauaaugccugauacacau

SEQ ID NO: 1203068 - RNA, 19 nt, Homo sapiens
gugcacauuuccucuaguu

SEQ ID NO: 1203069 - RNA, 19 nt, Homo sapiens
uugaagcgcucuauucuca

SEQ ID NO: 1203070 - RNA, 19 nt, Homo sapiens
gaaaucaaaggacauuaag

SEQ ID NO: 1203071 - RNA, 19 nt, Homo sapiens
caucuuccuuuguugguuu

SEQ ID NO: 1203072 - RNA, 19 nt, Homo sapiens
ugaaagcagcugucauauu

SEQ ID NO: 1203073 - RNA, 19 nt, Homo sapiens
ggaguaauucugugcuuga

SEQ ID NO: 1203074 - RNA, 19 nt, Homo sapiens
ggcaaaauguguuuacgua

SEQ ID NO: 1203075 - RNA, 19 nt, Homo sapiens
uaucagaaacgaaugcaaa

SEQ ID NO: 1203076 - RNA, 19 nt, Homo sapiens
gcugagaggauaaacagaa

SEQ ID NO: 1203077 - RNA, 19 nt, Homo sapiens
acugagaacucugcuguuu

SEQ ID NO: 1203078 - RNA, 19 nt, Homo sapiens
gguugaaguucugcuguuu

SEQ ID NO: 1203079 - RNA, 19 nt, Homo sapiens
gcuggaaagucuguaaugu

SEQ ID NO: 1203080 - RNA, 19 nt, Homo sapiens
acugaaagcagcugucaua

SEQ ID NO: 1203081 - RNA, 19 nt, Homo sapiens
aaguacagguuaucaaguu

SEQ ID NO: 1203082 - RNA, 19 nt, Homo sapiens
gcugauuguugccagauau

SEQ ID NO: 1203083 - RNA, 19 nt, Homo sapiens
gauuugaagcugauuguug

SEQ ID NO: 1203084 - RNA, 19 nt, Homo sapiens
gauuguauuuguucguaga

SEQ ID NO: 1203085 - RNA, 19 nt, Homo sapiens
uaacauacaucugaaacac

SEQ ID NO: 1203086 - RNA, 19 nt, Homo sapiens
guacaucccacacuaucuu

SEQ ID NO: 1203087 - RNA, 19 nt, Homo sapiens
ggacuugugcuuauaaacu

SEQ ID NO: 1203088 - RNA, 19 nt, Homo sapiens
cagcagagacauucacaga

SEQ ID NO: 1203089 - RNA, 19 nt, Homo sapiens
gacacucacuguacaacug

SEQ ID NO: 1203090 - RNA, 19 nt, Homo sapiens
gggagucgguuucucucuu

SEQ ID NO: 1203091 - RNA, 19 nt, Homo sapiens
auaaacaggcccaauuaaa

SEQ ID NO: 1203092 - RNA, 19 nt, Homo sapiens
caacccaguuacucauaau

SEQ ID NO: 1203093 - RNA, 19 nt, Homo sapiens
gaaaccacgugagugagau

SEQ ID NO: 1203094 - RNA, 19 nt, Homo sapiens
ucagacaugcuguauuauu

SEQ ID NO: 1203095 - RNA, 19 nt, Homo sapiens
gguguuucuuucaguguaa

SEQ ID NO: 1203096 - RNA, 19 nt, Homo sapiens
ugagagcugagccgaaaua

SEQ ID NO: 1203097 - RNA, 19 nt, Homo sapiens
auuaggagcuucugaaucu

SEQ ID NO: 1203098 - RNA, 19 nt, Homo sapiens
agacuuagauguucagaaa

SEQ ID NO: 1203099 - RNA, 19 nt, Homo sapiens
ggaaguaccauuuauuuag

SEQ ID NO: 1203100 - RNA, 19 nt, Homo sapiens
ggaaacugagucauaauaa

SEQ ID NO: 1203101 - RNA, 19 nt, Homo sapiens
ugaggaaacugagucauaa

SEQ ID NO: 1203102 - RNA, 19 nt, Homo sapiens
gaaggaaguaccauuuauu

SEQ ID NO: 1203103 - RNA, 19 nt, Homo sapiens
gagaagcuguguacacugu

SEQ ID NO: 1203104 - RNA, 19 nt, Homo sapiens
ccacaggaaucuugacgaa

SEQ ID NO: 1203105 - RNA, 19 nt, Homo sapiens
cgaaggaaguaccauuuau

SEQ ID NO: 1203106 - RNA, 19 nt, Homo sapiens
gaccagcccuuguucuguu

SEQ ID NO: 1203107 - RNA, 19 nt, Homo sapiens
gcgaaggaaguaccauuua

SEQ ID NO: 1203108 - RNA, 19 nt, Homo sapiens
caaccaagacuuagauguu

SEQ ID NO: 1203109 - RNA, 19 nt, Homo sapiens
ccacgcugcuugugucuga

SEQ ID NO: 1203110 - RNA, 19 nt, Homo sapiens
gaaguaccauuuauuuagc

SEQ ID NO: 1203111 - RNA, 19 nt, Homo sapiens
acacggugcugaaaugguu

SEQ ID NO: 1203112 - RNA, 19 nt, Homo sapiens
gaaagugguaccagcauca

SEQ ID NO: 1203113 - RNA, 19 nt, Homo sapiens
guucugccuuccaguauga

SEQ ID NO: 1203114 - RNA, 19 nt, Homo sapiens
gggagaagcuguguacacu

SEQ ID NO: 1203115 - RNA, 19 nt, Homo sapiens
ccacaugucauccgaggaa

SEQ ID NO: 1203116 - RNA, 19 nt, Homo sapiens
gaggagcaccuuucagagu

SEQ ID NO: 1203117 - RNA, 19 nt, Homo sapiens
gaguccaccucguccaaug

SEQ ID NO: 1203118 - RNA, 19 nt, Homo sapiens
ggcgaaggaaguaccauuu

SEQ ID NO: 1203119 - RNA, 19 nt, Homo sapiens
aggaaacugagucauaaua

SEQ ID NO: 1203120 - RNA, 19 nt, Homo sapiens
acaagaccgugcacugugu

SEQ ID NO: 1203121 - RNA, 19 nt, Homo sapiens
gggaggaccaggagcauca

SEQ ID NO: 1203122 - RNA, 19 nt, Homo sapiens
ggaguucaaggaguuugua

SEQ ID NO: 1203123 - RNA, 19 nt, Homo sapiens
aaccaagacuuagauguuc

SEQ ID NO: 1203124 - RNA, 19 nt, Homo sapiens
gucacacggugcugaaaug

SEQ ID NO: 1203125 - RNA, 19 nt, Homo sapiens
ugagccaacuccgauguga

SEQ ID NO: 1203126 - RNA, 19 nt, Homo sapiens
gcaaccaagacuuagaugu

SEQ ID NO: 1203127 - RNA, 19 nt, Homo sapiens
gccuggaguucaaggaguu

SEQ ID NO: 1203128 - RNA, 19 nt, Homo sapiens
cugcaggaccuaucucuga

SEQ ID NO: 1203129 - RNA, 19 nt, Homo sapiens
gcacuguguagaugaggaa

SEQ ID NO: 1203130 - RNA, 19 nt, Homo sapiens
ugagaaugaccagcuaauu

SEQ ID NO: 1203131 - RNA, 19 nt, Homo sapiens
gggcgaaggaaguaccauu

SEQ ID NO: 1203132 - RNA, 19 nt, Homo sapiens
aaaccuagccuggaguuca

SEQ ID NO: 1203133 - RNA, 19 nt, Homo sapiens
ggaccagcccuuguucugu

SEQ ID NO: 1203134 - RNA, 19 nt, Homo sapiens
uccacacucugcuuccuuu

SEQ ID NO: 1203135 - RNA, 19 nt, Homo sapiens
agauaccgcuccacacucu

SEQ ID NO: 1203136 - RNA, 19 nt, Homo sapiens
caagaccgugcacugugua

SEQ ID NO: 1203137 - RNA, 19 nt, Homo sapiens
aaccuagccuggaguucaa

SEQ ID NO: 1203138 - RNA, 19 nt, Homo sapiens
ggucacacggugcugaaau

SEQ ID NO: 1203139 - RNA, 19 nt, Homo sapiens
gguucugccuuccaguaug

SEQ ID NO: 1203140 - RNA, 19 nt, Homo sapiens
gacgggaccagcccuuguu

SEQ ID NO: 1203141 - RNA, 19 nt, Homo sapiens
gaggaaacugagucauaau

SEQ ID NO: 1203142 - RNA, 19 nt, Homo sapiens
gaccgugcacuguguagau

SEQ ID NO: 1203143 - RNA, 19 nt, Homo sapiens
guguagaugaggaaacuga

SEQ ID NO: 1203144 - RNA, 19 nt, Homo sapiens
acacucugcuuccuuugag

SEQ ID NO: 1203145 - RNA, 19 nt, Homo sapiens
uugaggagcaccuuucaga

SEQ ID NO: 1203146 - RNA, 19 nt, Homo sapiens
guccaaugcaggccuauca

SEQ ID NO: 1203147 - RNA, 19 nt, Homo sapiens
ccuccuuccucacccaguu

SEQ ID NO: 1203148 - RNA, 19 nt, Homo sapiens
uuacaagaccgugcacugu

SEQ ID NO: 1203149 - RNA, 19 nt, Homo sapiens
gggaccagcccuuguucug

SEQ ID NO: 1203150 - RNA, 19 nt, Homo sapiens
gaacaggccucuuugagua

SEQ ID NO: 1203151 - RNA, 19 nt, Homo sapiens
gaaguacacucuauuagua

SEQ ID NO: 1203152 - RNA, 19 nt, Homo sapiens
ggaagcagcucuauaugaa

SEQ ID NO: 1203153 - RNA, 19 nt, Homo sapiens
ccacugcgguuauaguuua

SEQ ID NO: 1203154 - RNA, 19 nt, Homo sapiens
gcuaucagaugaagaaauu

SEQ ID NO: 1203155 - RNA, 19 nt, Homo sapiens
cgacauacauugaaacaug

SEQ ID NO: 1203156 - RNA, 19 nt, Homo sapiens
gaucuuauuuggccuuauu

SEQ ID NO: 1203157 - RNA, 19 nt, Homo sapiens
aaacaaacauggccaacuu

SEQ ID NO: 1203158 - RNA, 19 nt, Homo sapiens
agagagaccuguugauuug

SEQ ID NO: 1203159 - RNA, 19 nt, Homo sapiens
acucagaaauugccuguua

SEQ ID NO: 1203160 - RNA, 19 nt, Homo sapiens
gaaagcuacucagaaauug

SEQ ID NO: 1203161 - RNA, 19 nt, Homo sapiens
caaauuggcucuaaugacu

SEQ ID NO: 1203162 - RNA, 19 nt, Homo sapiens
ggacagagucagccuauga

SEQ ID NO: 1203163 - RNA, 19 nt, Homo sapiens
caaagcaccuacagacuau

SEQ ID NO: 1203164 - RNA, 19 nt, Homo sapiens
uaagacaaguacuggauaa

SEQ ID NO: 1203165 - RNA, 19 nt, Homo sapiens
aaacaaugaugguggauga

SEQ ID NO: 1203166 - RNA, 19 nt, Homo sapiens
gaucagaguugcccuagag

SEQ ID NO: 1203167 - RNA, 19 nt, Homo sapiens
ugagaaacauugcaggaaa

SEQ ID NO: 1203168 - RNA, 19 nt, Homo sapiens
gauggcagauagaaacaaa

SEQ ID NO: 1203169 - RNA, 19 nt, Homo sapiens
gaugagaggcagacaguaa

SEQ ID NO: 1203170 - RNA, 19 nt, Homo sapiens
ucagcaaucuguacuagaa

SEQ ID NO: 1203171 - RNA, 19 nt, Homo sapiens
uaaagacaguucagagaga

SEQ ID NO: 1203172 - RNA, 19 nt, Homo sapiens
caucaagggcagccaauua

SEQ ID NO: 1203173 - RNA, 19 nt, Homo sapiens
gaaacgaggcacucaguug

SEQ ID NO: 1203174 - RNA, 19 nt, Homo sapiens
cgaaagcuacucagaaauu

SEQ ID NO: 1203175 - RNA, 19 nt, Homo sapiens
uaaagaggcacaagugaaa

SEQ ID NO: 1203176 - RNA, 19 nt, Homo sapiens
ggaagaguccagcaaggua

SEQ ID NO: 1203177 - RNA, 19 nt, Homo sapiens
gcugaaguacacucuauua

SEQ ID NO: 1203178 - RNA, 19 nt, Homo sapiens
caagguaacagcuucguuu

SEQ ID NO: 1203179 - RNA, 19 nt, Homo sapiens
cagcugagauggcagauag

SEQ ID NO: 1203180 - RNA, 19 nt, Homo sapiens
agaagauacuaaacccuua

SEQ ID NO: 1203181 - RNA, 19 nt, Homo sapiens
gaagaguccagcaagguaa

SEQ ID NO: 1203182 - RNA, 19 nt, Homo sapiens
ccacaaauccagaagaaau

SEQ ID NO: 1203183 - RNA, 19 nt, Homo sapiens
gaaggaugauggcaagaag

SEQ ID NO: 1203184 - RNA, 19 nt, Homo sapiens
gcugacaccucacuccuau

SEQ ID NO: 1203185 - RNA, 19 nt, Homo sapiens
uuauccagcuccagcauua

SEQ ID NO: 1203186 - RNA, 19 nt, Homo sapiens
gguaacagcuucguuuuaa

SEQ ID NO: 1203187 - RNA, 19 nt, Homo sapiens
gggaagcagcucuauauga

SEQ ID NO: 1203188 - RNA, 19 nt, Homo sapiens
gcagcuaucagaugaagaa

SEQ ID NO: 1203189 - RNA, 19 nt, Homo sapiens
aacgaaagcuacucagaaa

SEQ ID NO: 1203190 - RNA, 19 nt, Homo sapiens
gaaacgaaagcuacucaga

SEQ ID NO: 1203191 - RNA, 19 nt, Homo sapiens
caucugguaucuacuaugu

SEQ ID NO: 1203192 - RNA, 19 nt, Homo sapiens
gagcaucugguaucuacua

SEQ ID NO: 1203193 - RNA, 19 nt, Homo sapiens
cagagagaccuguugauuu

SEQ ID NO: 1203194 - RNA, 19 nt, Homo sapiens
guugcucucuuaugucuuu

SEQ ID NO: 1203195 - RNA, 19 nt, Homo sapiens
uggaucaugucaacguuua

SEQ ID NO: 1203196 - RNA, 19 nt, Homo sapiens
gcagacaguaagacaagua

SEQ ID NO: 1203197 - RNA, 19 nt, Homo sapiens
gaaaggauuaucuucuuca

SEQ ID NO: 1203198 - RNA, 19 nt, Homo sapiens
gcugaagcauccacaaauc

SEQ ID NO: 1203199 - RNA, 19 nt, Homo sapiens
ucaaaccacuccaaucagu

SEQ ID NO: 1203200 - RNA, 19 nt, Homo sapiens
gcgagcaucugguaucuac

SEQ ID NO: 1203201 - RNA, 19 nt, Homo sapiens
ggaaacaguaagcgucaaa

SEQ ID NO: 1203202 - RNA, 19 nt, Homo sapiens
ugaaugaagcucugaauca

SEQ ID NO: 1203203 - RNA, 19 nt, Homo sapiens
ccauauacaacuugaauga

SEQ ID NO: 1203204 - RNA, 19 nt, Homo sapiens
ggauccgcauugcaaagua

SEQ ID NO: 1203205 - RNA, 19 nt, Homo sapiens
acaaagcaccuacagacua

SEQ ID NO: 1203206 - RNA, 19 nt, Homo sapiens
guaagacaaguacuggaua

SEQ ID NO: 1203207 - RNA, 19 nt, Homo sapiens
ucaaaucacagaaacgaaa

SEQ ID NO: 1203208 - RNA, 19 nt, Homo sapiens
gagcucagcagcauugguu

SEQ ID NO: 1203209 - RNA, 19 nt, Homo sapiens
gcugaucuuugcucuauag

SEQ ID NO: 1203210 - RNA, 19 nt, Homo sapiens
aauuggcucuaaugacuua

SEQ ID NO: 1203211 - RNA, 19 nt, Homo sapiens
uggagcagcuaucagauga

SEQ ID NO: 1203212 - RNA, 19 nt, Homo sapiens
uauaugaacuaccaagaag

SEQ ID NO: 1203213 - RNA, 19 nt, Homo sapiens
uaucuacuauguucccaaa

SEQ ID NO: 1203214 - RNA, 19 nt, Homo sapiens
uggauaaccugauggacaa

SEQ ID NO: 1203215 - RNA, 19 nt, Homo sapiens
aaacgaaagcuacucagaa

SEQ ID NO: 1203216 - RNA, 19 nt, Homo sapiens
ggaucuggaugccuugaug

SEQ ID NO: 1203217 - RNA, 19 nt, Homo sapiens
gguaaagacaguucagaga

SEQ ID NO: 1203218 - RNA, 19 nt, Homo sapiens
gauccgcauugcaaaguau

SEQ ID NO: 1203219 - RNA, 19 nt, Homo sapiens
gcagauagaaacaaagaag

SEQ ID NO: 1203220 - RNA, 19 nt, Homo sapiens
gaucagaguccacaugucu

SEQ ID NO: 1203221 - RNA, 19 nt, Homo sapiens
gaaaccucccuucuucuga

SEQ ID NO: 1203222 - RNA, 19 nt, Homo sapiens
ugaaaggauuaucuucuuc

SEQ ID NO: 1203223 - RNA, 19 nt, Homo sapiens
gaaacauggcaccuugaaa

SEQ ID NO: 1203224 - RNA, 19 nt, Homo sapiens
agaagacagugacaaggaa

SEQ ID NO: 1203225 - RNA, 19 nt, Homo sapiens
ccagaagaaaucucaauau

SEQ ID NO: 1203226 - RNA, 19 nt, Homo sapiens
cauggacucuuuggauauu

SEQ ID NO: 1203227 - RNA, 19 nt, Homo sapiens
uaacuaaucagcacagaag

SEQ ID NO: 1203228 - RNA, 19 nt, Homo sapiens
caucuaauaggauagcuaa

SEQ ID NO: 1203229 - RNA, 19 nt, Homo sapiens
gagcagcuaucagaugaag

SEQ ID NO: 1203230 - RNA, 19 nt, Homo sapiens
acaaauggagagaaucuuu

SEQ ID NO: 1203231 - RNA, 19 nt, Homo sapiens
uuacugagcaugcuauuuc

SEQ ID NO: 1203232 - RNA, 19 nt, Homo sapiens
gagcuggauuugacacauc

SEQ ID NO: 1203233 - RNA, 19 nt, Homo sapiens
gaguuuggauucugacaag

SEQ ID NO: 1203234 - RNA, 19 nt, Homo sapiens
ucagagagaccuguugauu

SEQ ID NO: 1203235 - RNA, 19 nt, Homo sapiens
ggaaaccucccuucuucug

SEQ ID NO: 1203236 - RNA, 19 nt, Homo sapiens
gcucagcaaucuguacuag

SEQ ID NO: 1203237 - RNA, 19 nt, Homo sapiens
ggauuaucuucuucaucua

SEQ ID NO: 1203238 - RNA, 19 nt, Homo sapiens
aaacauggcaccuugaaag

SEQ ID NO: 1203239 - RNA, 19 nt, Homo sapiens
uggcugaucuuugcucuau

SEQ ID NO: 1203240 - RNA, 19 nt, Homo sapiens
uaacuguaccagaaauuga

SEQ ID NO: 1203241 - RNA, 19 nt, Homo sapiens
gagaaacauugcaggaaaa

SEQ ID NO: 1203242 - RNA, 19 nt, Homo sapiens
gagcaugcuauuucucuga

SEQ ID NO: 1203243 - RNA, 19 nt, Homo sapiens
aggauuaucuucuucaucu

SEQ ID NO: 1203244 - RNA, 19 nt, Homo sapiens
ugaagaaauugaucauggu

SEQ ID NO: 1203245 - RNA, 19 nt, Homo sapiens
gaucaugucaacguuuauu

SEQ ID NO: 1203246 - RNA, 19 nt, Homo sapiens
cagaguugcccuagagaaa

SEQ ID NO: 1203247 - RNA, 19 nt, Homo sapiens
agugagugaugcugaagua

SEQ ID NO: 1203248 - RNA, 19 nt, Homo sapiens
uagccgacauacauugaaa

SEQ ID NO: 1203249 - RNA, 19 nt, Homo sapiens
ccaggacuaucggaacaaa

SEQ ID NO: 1203250 - RNA, 19 nt, Homo sapiens
ggacauaaacuaagucuaa

SEQ ID NO: 1203251 - RNA, 19 nt, Homo sapiens
cuaagaagcuucaaaucua

SEQ ID NO: 1203252 - RNA, 19 nt, Homo sapiens
gaugaggagucuuuguuua

SEQ ID NO: 1203253 - RNA, 19 nt, Homo sapiens
cagaauaaauggacaacua

SEQ ID NO: 1203254 - RNA, 19 nt, Homo sapiens
gcccagaaguucaagagua

SEQ ID NO: 1203255 - RNA, 19 nt, Homo sapiens
ccucagaacuuacucauca

SEQ ID NO: 1203256 - RNA, 19 nt, Homo sapiens
gcagagccaucaucuaaca

SEQ ID NO: 1203257 - RNA, 19 nt, Homo sapiens
gggauuagcagaauaaaug

SEQ ID NO: 1203258 - RNA, 19 nt, Homo sapiens
cuucaaaucuaacuccaua

SEQ ID NO: 1203259 - RNA, 19 nt, Homo sapiens
gaggaaggagucccauuua

SEQ ID NO: 1203260 - RNA, 19 nt, Homo sapiens
ccucugagcuggacauaug

SEQ ID NO: 1203261 - RNA, 19 nt, Homo sapiens
gcucuuaugcgacaguuua

SEQ ID NO: 1203262 - RNA, 19 nt, Homo sapiens
ccaaagagacacugacauu

SEQ ID NO: 1203263 - RNA, 19 nt, Homo sapiens
ucaaggcaauaguacauaa

SEQ ID NO: 1203264 - RNA, 19 nt, Homo sapiens
ccagaaaugugugaccuuu

SEQ ID NO: 1203265 - RNA, 19 nt, Homo sapiens
ggaguuucuugcacugaua

SEQ ID NO: 1203266 - RNA, 19 nt, Homo sapiens
ggaagguuauugcuauugu

SEQ ID NO: 1203267 - RNA, 19 nt, Homo sapiens
aaaucuaacuccauacuga

SEQ ID NO: 1203268 - RNA, 19 nt, Homo sapiens
uaacuacaauccagaaugg

SEQ ID NO: 1203269 - RNA, 19 nt, Homo sapiens
caagcuaccuaacuacaau

SEQ ID NO: 1203270 - RNA, 19 nt, Homo sapiens
ggaagaaaauucaguggaa

SEQ ID NO: 1203271 - RNA, 19 nt, Homo sapiens
ggagucccauuuacagcua

SEQ ID NO: 1203272 - RNA, 19 nt, Homo sapiens
gguuauugcuauugucauu

SEQ ID NO: 1203273 - RNA, 19 nt, Homo sapiens
aggaagcacuuguucauga

SEQ ID NO: 1203274 - RNA, 19 nt, Homo sapiens
cccagaaguucaagaguaa

SEQ ID NO: 1203275 - RNA, 19 nt, Homo sapiens
ggaagcacuuguucaugau

SEQ ID NO: 1203276 - RNA, 19 nt, Homo sapiens
ucuccaagcuaccuaacua

SEQ ID NO: 1203277 - RNA, 19 nt, Homo sapiens
ggacaacuaguggcuuuaa

SEQ ID NO: 1203278 - RNA, 19 nt, Homo sapiens
ggaaggagucccauuuaca

SEQ ID NO: 1203279 - RNA, 19 nt, Homo sapiens
gaccuggaauaguuuaaau

SEQ ID NO: 1203280 - RNA, 19 nt, Homo sapiens
aagcacuuguucaugauua

SEQ ID NO: 1203281 - RNA, 19 nt, Homo sapiens
gcugggagccacugaauau

SEQ ID NO: 1203282 - RNA, 19 nt, Homo sapiens
gcaauaguacauaauagug

SEQ ID NO: 1203283 - RNA, 19 nt, Homo sapiens
uguaccagcuuccugauga

SEQ ID NO: 1203284 - RNA, 19 nt, Homo sapiens
ggcugcaucuuuauugaaa

SEQ ID NO: 1203285 - RNA, 19 nt, Homo sapiens
gacaacuaguggcuuuaaa

SEQ ID NO: 1203286 - RNA, 19 nt, Homo sapiens
aaaauucaguggaagguua

SEQ ID NO: 1203287 - RNA, 19 nt, Homo sapiens
aggcagagccaucaucuaa

SEQ ID NO: 1203288 - RNA, 19 nt, Homo sapiens
gaaacaugccaauauugug

SEQ ID NO: 1203289 - RNA, 19 nt, Homo sapiens
caucuuacuugaacuugga

SEQ ID NO: 1203290 - RNA, 19 nt, Homo sapiens
ugacauaauccacaccaaa

SEQ ID NO: 1203291 - RNA, 19 nt, Homo sapiens
gaaggagucccauuuacag

SEQ ID NO: 1203292 - RNA, 19 nt, Homo sapiens
uugaauacaugcacacaga

SEQ ID NO: 1203293 - RNA, 19 nt, Homo sapiens
gcuaaagccagaaaugugu

SEQ ID NO: 1203294 - RNA, 19 nt, Homo sapiens
guacauaauaguggaagaa

SEQ ID NO: 1203295 - RNA, 19 nt, Homo sapiens
gagucuuuguuuacaguuu

SEQ ID NO: 1203296 - RNA, 19 nt, Homo sapiens
ugaaacaugccaauauugu

SEQ ID NO: 1203297 - RNA, 19 nt, Homo sapiens
gaagguuauugcuauuguc

SEQ ID NO: 1203298 - RNA, 19 nt, Homo sapiens
gaaagggcgagaucaccaa

SEQ ID NO: 1203299 - RNA, 19 nt, Homo sapiens
gcuccugcaugacauaauc

SEQ ID NO: 1203300 - RNA, 19 nt, Homo sapiens
ucaccuaugaccuggaaua

SEQ ID NO: 1203301 - RNA, 19 nt, Homo sapiens
ccagacauacucuucagaa

SEQ ID NO: 1203302 - RNA, 19 nt, Homo sapiens
gacauaaacuaagucuaag

SEQ ID NO: 1203303 - RNA, 19 nt, Homo sapiens
ccacugaauauuccucuga

SEQ ID NO: 1203304 - RNA, 19 nt, Homo sapiens
aguggaagguuauugcuau

SEQ ID NO: 1203305 - RNA, 19 nt, Homo sapiens
uuuauguccucaccuauga

SEQ ID NO: 1203306 - RNA, 19 nt, Homo sapiens
ggcuuuauguccucaccua

SEQ ID NO: 1203307 - RNA, 19 nt, Homo sapiens
ccucauaaugucagacuuu

SEQ ID NO: 1203308 - RNA, 19 nt, Homo sapiens
agaggaaggagucccauuu

SEQ ID NO: 1203309 - RNA, 19 nt, Homo sapiens
gguguucaaggcaauagua

SEQ ID NO: 1203310 - RNA, 19 nt, Homo sapiens
guuccagggucaaccuuug

SEQ ID NO: 1203311 - RNA, 19 nt, Homo sapiens
caggcugcaucuuuauuga

SEQ ID NO: 1203312 - RNA, 19 nt, Homo sapiens
guggaagguuauugcuauu

SEQ ID NO: 1203313 - RNA, 19 nt, Homo sapiens
gaagcacuuguucaugauu

SEQ ID NO: 1203314 - RNA, 19 nt, Homo sapiens
agaacuuacucaucaguca

SEQ ID NO: 1203315 - RNA, 19 nt, Homo sapiens
caaagagacacugacauuc

SEQ ID NO: 1203316 - RNA, 19 nt, Homo sapiens
gacauaauccacaccaaag

SEQ ID NO: 1203317 - RNA, 19 nt, Homo sapiens
ggaagagccucccuuuugg

SEQ ID NO: 1203318 - RNA, 19 nt, Homo sapiens
ugaggagucuuuguuuaca

SEQ ID NO: 1203319 - RNA, 19 nt, Homo sapiens
aaagaagcaucauguucca

SEQ ID NO: 1203320 - RNA, 19 nt, Homo sapiens
ccucaccuaugaccuggaa

SEQ ID NO: 1203321 - RNA, 19 nt, Homo sapiens
ccacggaguaacagugauu

SEQ ID NO: 1203322 - RNA, 19 nt, Homo sapiens
gagcucaaacuggcugauu

SEQ ID NO: 1203323 - RNA, 19 nt, Homo sapiens
gaauaaauggacaacuagu

SEQ ID NO: 1203324 - RNA, 19 nt, Homo sapiens
gaaaagaaagggcgagauc

SEQ ID NO: 1203325 - RNA, 19 nt, Homo sapiens
agaaaugugugaccuuuug

SEQ ID NO: 1203326 - RNA, 19 nt, Homo sapiens
gcacuuguucaugauuauu

SEQ ID NO: 1203327 - RNA, 19 nt, Homo sapiens
gagacacugacauucguuu

SEQ ID NO: 1203328 - RNA, 19 nt, Homo sapiens
auauugugcuccugcauga

SEQ ID NO: 1203329 - RNA, 19 nt, Homo sapiens
gggcuguauuucugcaguu

SEQ ID NO: 1203330 - RNA, 19 nt, Homo sapiens
ugaugaggagucuuuguuu

SEQ ID NO: 1203331 - RNA, 19 nt, Homo sapiens
ucagcgcccugccaucuca

SEQ ID NO: 1203332 - RNA, 19 nt, Homo sapiens
ccaggaagcacuuguucau

SEQ ID NO: 1203333 - RNA, 19 nt, Homo sapiens
ugucagacuuuucauguuu

SEQ ID NO: 1203334 - RNA, 19 nt, Homo sapiens
gcagccucaucuuacuuga

SEQ ID NO: 1203335 - RNA, 19 nt, Homo sapiens
ggcaauaguacauaauagu

SEQ ID NO: 1203336 - RNA, 19 nt, Homo sapiens
cuaacuccauacugaacaa

SEQ ID NO: 1203337 - RNA, 19 nt, Homo sapiens
cugcaucuuuauugaaaug

SEQ ID NO: 1203338 - RNA, 19 nt, Homo sapiens
gggcuucauccucauaaug

SEQ ID NO: 1203339 - RNA, 19 nt, Homo sapiens
ucaccacccagcccaguuu

SEQ ID NO: 1203340 - RNA, 19 nt, Homo sapiens
ccaagcuaccuaacuacaa

SEQ ID NO: 1203341 - RNA, 19 nt, Homo sapiens
guaaaaggccacggaguaa

SEQ ID NO: 1203342 - RNA, 19 nt, Homo sapiens
ggcuguauuucugcaguuu

SEQ ID NO: 1203343 - RNA, 19 nt, Homo sapiens
cagcccaguuuagcaaaug

SEQ ID NO: 1203344 - RNA, 19 nt, Homo sapiens
guauaugucucagcaucca

SEQ ID NO: 1203345 - RNA, 19 nt, Homo sapiens
cauaaacuaagucuaagca

SEQ ID NO: 1203346 - RNA, 19 nt, Homo sapiens
guucaaggcaauaguacau

SEQ ID NO: 1203347 - RNA, 19 nt, Homo sapiens
acuaagaagcuucaaaucu

SEQ ID NO: 1203348 - RNA, 19 nt, Homo sapiens
gaguuucuugcacugauaa

SEQ ID NO: 1203349 - RNA, 19 nt, Homo sapiens
caaggggauuagcagaaua

SEQ ID NO: 1203350 - RNA, 19 nt, Homo sapiens
gggccuggcugcagaaguu

SEQ ID NO: 1203351 - RNA, 19 nt, Homo sapiens
ccacccagaucgcgguaua

SEQ ID NO: 1203352 - RNA, 19 nt, Homo sapiens
ggacgacguggaauaaaga

SEQ ID NO: 1203353 - RNA, 19 nt, Homo sapiens
ccagaucgcgguauauaga

SEQ ID NO: 1203354 - RNA, 19 nt, Homo sapiens
ugacaaggccucaguacug

SEQ ID NO: 1203355 - RNA, 19 nt, Homo sapiens
cgaaugugcuggcccgaau

SEQ ID NO: 1203356 - RNA, 19 nt, Homo sapiens
caucaaugacucacccuuu

SEQ ID NO: 1203357 - RNA, 19 nt, Homo sapiens
gcaaccgcaucucgcaugu

SEQ ID NO: 1203358 - RNA, 19 nt, Homo sapiens
gcccacggcacaucaauga

SEQ ID NO: 1203359 - RNA, 19 nt, Homo sapiens
ucaugacacucuaucuguu

SEQ ID NO: 1203360 - RNA, 19 nt, Homo sapiens
uaucggacgacguggaaua

SEQ ID NO: 1203361 - RNA, 19 nt, Homo sapiens
caugacacucuaucuguuu

SEQ ID NO: 1203362 - RNA, 19 nt, Homo sapiens
caaccucacacaccucuuc

SEQ ID NO: 1203363 - RNA, 19 nt, Homo sapiens
uggcgggacuggugacuca

SEQ ID NO: 1203364 - RNA, 19 nt, Homo sapiens
cggacgacguggaauaaag

SEQ ID NO: 1203365 - RNA, 19 nt, Homo sapiens
gugcuggcccgaauugaug

SEQ ID NO: 1203366 - RNA, 19 nt, Homo sapiens
gaaugugcuggcccgaauu

SEQ ID NO: 1203367 - RNA, 19 nt, Homo sapiens
gcagccagguguguguaca

SEQ ID NO: 1203368 - RNA, 19 nt, Homo sapiens
agccagguguguguacaua

SEQ ID NO: 1203369 - RNA, 19 nt, Homo sapiens
aucaaugacucacccuuug

SEQ ID NO: 1203370 - RNA, 19 nt, Homo sapiens
ggaccucagcgauaaugca

SEQ ID NO: 1203371 - RNA, 19 nt, Homo sapiens
ggcuggccgugaccucaaa

SEQ ID NO: 1203372 - RNA, 19 nt, Homo sapiens
ggcagcguuuguuccagaa

SEQ ID NO: 1203373 - RNA, 19 nt, Homo sapiens
ccucgaccgucuccuacug

SEQ ID NO: 1203374 - RNA, 19 nt, Homo sapiens
ccaggcuguucacgcaaga

SEQ ID NO: 1203375 - RNA, 19 nt, Homo sapiens
cagccucgaccgucuccua

SEQ ID NO: 1203376 - RNA, 19 nt, Homo sapiens
cgggacuggugacucagaa

SEQ ID NO: 1203377 - RNA, 19 nt, Homo sapiens
ggacaucgguuacaggaaa

SEQ ID NO: 1203378 - RNA, 19 nt, Homo sapiens
caccauaccuggcuaauuu

SEQ ID NO: 1203379 - RNA, 19 nt, Homo sapiens
ggauuaccaugcagaaaua

SEQ ID NO: 1203380 - RNA, 19 nt, Homo sapiens
gaacugggauuaccaugca

SEQ ID NO: 1203381 - RNA, 19 nt, Homo sapiens
gcuccugaaucaagacuua

SEQ ID NO: 1203382 - RNA, 19 nt, Homo sapiens
ucacguggcuagaaacuug

SEQ ID NO: 1203383 - RNA, 19 nt, Homo sapiens
gcuuugagguaucauaauu

SEQ ID NO: 1203384 - RNA, 19 nt, Homo sapiens
gagcgaaagugagauaaau

SEQ ID NO: 1203385 - RNA, 19 nt, Homo sapiens
ccacagcuuugccuuugua

SEQ ID NO: 1203386 - RNA, 19 nt, Homo sapiens
gcagcagccugaaacuuga

SEQ ID NO: 1203387 - RNA, 19 nt, Homo sapiens
caucagggacuucuuaauu

SEQ ID NO: 1203388 - RNA, 19 nt, Homo sapiens
cagcuuugccuuuguauuu

SEQ ID NO: 1203389 - RNA, 19 nt, Homo sapiens
gaaagugagauaaauguca

SEQ ID NO: 1203390 - RNA, 19 nt, Homo sapiens
ugagauaaaugucaaaggu

SEQ ID NO: 1203391 - RNA, 19 nt, Homo sapiens
agacuugccuuacacaguu

SEQ ID NO: 1203392 - RNA, 19 nt, Homo sapiens
aucagggacuucuuaauua

SEQ ID NO: 1203393 - RNA, 19 nt, Homo sapiens
uuugagauguggaagauaa

SEQ ID NO: 1203394 - RNA, 19 nt, Homo sapiens
cagacuuucuuugcaguua

SEQ ID NO: 1203395 - RNA, 19 nt, Homo sapiens
ccaaagugcugggauuaca

SEQ ID NO: 1203396 - RNA, 19 nt, Homo sapiens
gagauguggaagauaauaa

SEQ ID NO: 1203397 - RNA, 19 nt, Homo sapiens
uuacucaaaugacuggaaa

SEQ ID NO: 1203398 - RNA, 19 nt, Homo sapiens
gugaggaagucguguguca

SEQ ID NO: 1203399 - RNA, 19 nt, Homo sapiens
gaagacgaguacccagaca

SEQ ID NO: 1203400 - RNA, 19 nt, Homo sapiens
cguccgggcugguaagauu

SEQ ID NO: 1203401 - RNA, 19 nt, Homo sapiens
uaaccaagucacaguguuu

SEQ ID NO: 1203402 - RNA, 19 nt, Homo sapiens
caccacagcuuugccuuug

SEQ ID NO: 1203403 - RNA, 19 nt, Homo sapiens
gcuguucuucugaaucuua

SEQ ID NO: 1203404 - RNA, 19 nt, Homo sapiens
gcaccacagcuuugccuuu

SEQ ID NO: 1203405 - RNA, 19 nt, Homo sapiens
gccaaacgccaacaacuug

SEQ ID NO: 1203406 - RNA, 19 nt, Homo sapiens
ccuaguagcugggauuaca

SEQ ID NO: 1203407 - RNA, 19 nt, Homo sapiens
cucuugagauggagucuua

SEQ ID NO: 1203408 - RNA, 19 nt, Homo sapiens
uuccuuagaucuucucaaa

SEQ ID NO: 1203409 - RNA, 19 nt, Homo sapiens
acacuggcccgacuacuuu

SEQ ID NO: 1203410 - RNA, 19 nt, Homo sapiens
gggauuaccaugcagaaau

SEQ ID NO: 1203411 - RNA, 19 nt, Homo sapiens
uagaagaacugaagaaaag

SEQ ID NO: 1203412 - RNA, 19 nt, Homo sapiens
gguagaagaacugaagaaa

SEQ ID NO: 1203413 - RNA, 19 nt, Homo sapiens
caagaacuauccgaacaag

SEQ ID NO: 1203414 - RNA, 19 nt, Homo sapiens
gcgaaagugagauaaaugu

SEQ ID NO: 1203415 - RNA, 19 nt, Homo sapiens
cuuuauggauucacagaaa

SEQ ID NO: 1203416 - RNA, 19 nt, Homo sapiens
gcuguaauaccaauaaagu

SEQ ID NO: 1203417 - RNA, 19 nt, Homo sapiens
aaaguugauugcagaagga

SEQ ID NO: 1203418 - RNA, 19 nt, Homo sapiens
ugagagcgaaagugagaua

SEQ ID NO: 1203419 - RNA, 19 nt, Homo sapiens
caacaacuugggauagaga

SEQ ID NO: 1203420 - RNA, 19 nt, Homo sapiens
gaacuauuccaagcccaaa

SEQ ID NO: 1203421 - RNA, 19 nt, Homo sapiens
agacggccguggaacuauu

SEQ ID NO: 1203422 - RNA, 19 nt, Homo sapiens
aguauugguugcagaagaa

SEQ ID NO: 1203423 - RNA, 19 nt, Homo sapiens
gacuuucuuugcaguuauu

SEQ ID NO: 1203424 - RNA, 19 nt, Homo sapiens
ggccaaacgccaacaacuu

SEQ ID NO: 1203425 - RNA, 19 nt, Homo sapiens
augcagaaauacaagcuuu

SEQ ID NO: 1203426 - RNA, 19 nt, Homo sapiens
caguauugguugcagaaga

SEQ ID NO: 1203427 - RNA, 19 nt, Homo sapiens
ucagggacuucuuaauuac

SEQ ID NO: 1203428 - RNA, 19 nt, Homo sapiens
uuacaggugugagccacua

SEQ ID NO: 1203429 - RNA, 19 nt, Homo sapiens
ucugaaaucuugguuugau

SEQ ID NO: 1203430 - RNA, 19 nt, Homo sapiens
ccagacauuuucacaauug

SEQ ID NO: 1203431 - RNA, 19 nt, Homo sapiens
gacacuggcccgacuacuu

SEQ ID NO: 1203432 - RNA, 19 nt, Homo sapiens
acccagacaugcccacuga

SEQ ID NO: 1203433 - RNA, 19 nt, Homo sapiens
ucaaaugacuggaaaagag

SEQ ID NO: 1203434 - RNA, 19 nt, Homo sapiens
ucacagacuugccuuacac

SEQ ID NO: 1203435 - RNA, 19 nt, Homo sapiens
gcccaaagaaaccuugaga

SEQ ID NO: 1203436 - RNA, 19 nt, Homo sapiens
cuacuuucguuccgucuuc

SEQ ID NO: 1203437 - RNA, 19 nt, Homo sapiens
uagcuuugagguaucauaa

SEQ ID NO: 1203438 - RNA, 19 nt, Homo sapiens
gaaaucuugguuugaucaa

SEQ ID NO: 1203439 - RNA, 19 nt, Homo sapiens
ccgaacaagggacaucuuu

SEQ ID NO: 1203440 - RNA, 19 nt, Homo sapiens
aagcuguucuucugaaucu

SEQ ID NO: 1203441 - RNA, 19 nt, Homo sapiens
gauagagaaagaagcuguu

SEQ ID NO: 1203442 - RNA, 19 nt, Homo sapiens
gcugcuauauuaaaaguga

SEQ ID NO: 1203443 - RNA, 19 nt, Homo sapiens
uuucaucagggacuucuua

SEQ ID NO: 1203444 - RNA, 19 nt, Homo sapiens
gauaaaugucaaagguguu

SEQ ID NO: 1203445 - RNA, 19 nt, Homo sapiens
ccagcuagccgccauggau

SEQ ID NO: 1203446 - RNA, 19 nt, Homo sapiens
ugagauguggaagauaaua

SEQ ID NO: 1203447 - RNA, 19 nt, Homo sapiens
ugugucacguggcuagaaa

SEQ ID NO: 1203448 - RNA, 19 nt, Homo sapiens
gacuugccuuacacaguuu

SEQ ID NO: 1203449 - RNA, 19 nt, Homo sapiens
ugaaaucuugguuugauca

SEQ ID NO: 1203450 - RNA, 19 nt, Homo sapiens
ugagaggacugcacuuuuc

SEQ ID NO: 1203451 - RNA, 19 nt, Homo sapiens
gagaagccgaacugggauu

SEQ ID NO: 1203452 - RNA, 19 nt, Homo sapiens
ggacugcacuuuucaucag

SEQ ID NO: 1203453 - RNA, 19 nt, Homo sapiens
ucaagaacuauccgaacaa

SEQ ID NO: 1203454 - RNA, 19 nt, Homo sapiens
uuaaccaagucacaguguu

SEQ ID NO: 1203455 - RNA, 19 nt, Homo sapiens
gcucgaguggcccuuagaa

SEQ ID NO: 1203456 - RNA, 19 nt, Homo sapiens
gaacugaagaaaaggaaug

SEQ ID NO: 1203457 - RNA, 19 nt, Homo sapiens
guagaagaacugaagaaaa

SEQ ID NO: 1203458 - RNA, 19 nt, Homo sapiens
agacuuucuuugcaguuau

SEQ ID NO: 1203459 - RNA, 19 nt, Homo sapiens
gagagcgaaagugagauaa

SEQ ID NO: 1203460 - RNA, 19 nt, Homo sapiens
ugcagcagccugaaacuug

SEQ ID NO: 1203461 - RNA, 19 nt, Homo sapiens
ggaaacaguauugguugca

SEQ ID NO: 1203462 - RNA, 19 nt, Homo sapiens
guuggcuuauacugugaua

SEQ ID NO: 1203463 - RNA, 19 nt, Homo sapiens
ccugagaggacugcacuuu

SEQ ID NO: 1203464 - RNA, 19 nt, Homo sapiens
ccaccauaccuggcuaauu

SEQ ID NO: 1203465 - RNA, 19 nt, Homo sapiens
gcagacuuucuuugcaguu

SEQ ID NO: 1203466 - RNA, 19 nt, Homo sapiens
acagcagacuuucuuugca

SEQ ID NO: 1203467 - RNA, 19 nt, Homo sapiens
uuacagcagacuuucuuug

SEQ ID NO: 1203468 - RNA, 19 nt, Homo sapiens
caacuugggauagagaaag

SEQ ID NO: 1203469 - RNA, 19 nt, Homo sapiens
agaagccgaacugggauua

SEQ ID NO: 1203470 - RNA, 19 nt, Homo sapiens
ccacuauacccgaccagau

SEQ ID NO: 1203471 - RNA, 19 nt, Homo sapiens
ggaugcagcagccugaaac

SEQ ID NO: 1203472 - RNA, 19 nt, Homo sapiens
uguggaagauaauaaaucc

SEQ ID NO: 1203473 - RNA, 19 nt, Homo sapiens
cuugagagcgaaagugaga

SEQ ID NO: 1203474 - RNA, 19 nt, Homo sapiens
gcuauugguagaagaacug

SEQ ID NO: 1203475 - RNA, 19 nt, Homo sapiens
ccagacaugcccacugaag

SEQ ID NO: 1203476 - RNA, 19 nt, Homo sapiens
agacgaguacccagacaug

SEQ ID NO: 1203477 - RNA, 19 nt, Homo sapiens
gaaauuaccuccagagaaa

SEQ ID NO: 1203478 - RNA, 19 nt, Homo sapiens
ccacucagcugacauauga

SEQ ID NO: 1203479 - RNA, 19 nt, Homo sapiens
cugauaaggucaacaauua

SEQ ID NO: 1203480 - RNA, 19 nt, Homo sapiens
gaaggaacaugaaguggaa

SEQ ID NO: 1203481 - RNA, 19 nt, Homo sapiens
caaguguacugcagaauaa

SEQ ID NO: 1203482 - RNA, 19 nt, Homo sapiens
gaucaucucugcagcauuc

SEQ ID NO: 1203483 - RNA, 19 nt, Homo sapiens
ccacaggacugcagaagaa

SEQ ID NO: 1203484 - RNA, 19 nt, Homo sapiens
gaaauuugcaccuaagaaa

SEQ ID NO: 1203485 - RNA, 19 nt, Homo sapiens
ucaaagaugucacuacuuc

SEQ ID NO: 1203486 - RNA, 19 nt, Homo sapiens
gaagaaacaugggaauaca

SEQ ID NO: 1203487 - RNA, 19 nt, Homo sapiens
cagcugaugugaagaauau

SEQ ID NO: 1203488 - RNA, 19 nt, Homo sapiens
gcacaguauucacuauuga

SEQ ID NO: 1203489 - RNA, 19 nt, Homo sapiens
ccacuaaacuaaugaaugg

SEQ ID NO: 1203490 - RNA, 19 nt, Homo sapiens
gcuuagaucucauuccauu

SEQ ID NO: 1203491 - RNA, 19 nt, Homo sapiens
gaagaaagaagaauagaag

SEQ ID NO: 1203492 - RNA, 19 nt, Homo sapiens
gaucaaagaugucacuacu

SEQ ID NO: 1203493 - RNA, 19 nt, Homo sapiens
cagaauaaacuaccucuuu

SEQ ID NO: 1203494 - RNA, 19 nt, Homo sapiens
gaauggaaccaguuggaua

SEQ ID NO: 1203495 - RNA, 19 nt, Homo sapiens
ucagaacaguuaugugaaa

SEQ ID NO: 1203496 - RNA, 19 nt, Homo sapiens
uaacaccucuugccacuca

SEQ ID NO: 1203497 - RNA, 19 nt, Homo sapiens
agaauaaacuaccucuuug

SEQ ID NO: 1203498 - RNA, 19 nt, Homo sapiens
uaacaaguguacugcagaa

SEQ ID NO: 1203499 - RNA, 19 nt, Homo sapiens
gcaaguggccaauaugaug

SEQ ID NO: 1203500 - RNA, 19 nt, Homo sapiens
cagagaaauuugcaccuaa

SEQ ID NO: 1203501 - RNA, 19 nt, Homo sapiens
gaagauggagguacagaau

SEQ ID NO: 1203502 - RNA, 19 nt, Homo sapiens
ggaagcaaggcaauaguuu

SEQ ID NO: 1203503 - RNA, 19 nt, Homo sapiens
gaaaguucauccucuaaaa

SEQ ID NO: 1203504 - RNA, 19 nt, Homo sapiens
ccagagaaauuugcaccua

SEQ ID NO: 1203505 - RNA, 19 nt, Homo sapiens
gaguacagcuuagaucuca

SEQ ID NO: 1203506 - RNA, 19 nt, Homo sapiens
gaauaaacuaccucuuuga

SEQ ID NO: 1203507 - RNA, 19 nt, Homo sapiens
gcaguuuguuucccaguug

SEQ ID NO: 1203508 - RNA, 19 nt, Homo sapiens
gaggaaagacacaaugcua

SEQ ID NO: 1203509 - RNA, 19 nt, Homo sapiens
cagaauugaucaaagaugu

SEQ ID NO: 1203510 - RNA, 19 nt, Homo sapiens
cuaaucugcugaagaaaga

SEQ ID NO: 1203511 - RNA, 19 nt, Homo sapiens
gaauagacacugauaaggu

SEQ ID NO: 1203512 - RNA, 19 nt, Homo sapiens
gaagccagaauucaauauu

SEQ ID NO: 1203513 - RNA, 19 nt, Homo sapiens
ggauggaugauguuaauga

SEQ ID NO: 1203514 - RNA, 19 nt, Homo sapiens
gagcacauauugaccuuac

SEQ ID NO: 1203515 - RNA, 19 nt, Homo sapiens
caaaagcacucguugauca

SEQ ID NO: 1203516 - RNA, 19 nt, Homo sapiens
gaaacaauuacccaacuau

SEQ ID NO: 1203517 - RNA, 19 nt, Homo sapiens
gaagcaaggcaauaguuug

SEQ ID NO: 1203518 - RNA, 19 nt, Homo sapiens
auaccuaacuggacccuuu

SEQ ID NO: 1203519 - RNA, 19 nt, Homo sapiens
caccacacccggcuaauuu

SEQ ID NO: 1203520 - RNA, 19 nt, Homo sapiens
gggucagcuucuuaaauua

SEQ ID NO: 1203521 - RNA, 19 nt, Homo sapiens
gauguucagaggagacuua

SEQ ID NO: 1203522 - RNA, 19 nt, Homo sapiens
gaucaagguguuaagacua

SEQ ID NO: 1203523 - RNA, 19 nt, Homo sapiens
gagaaaguucauccucuaa

SEQ ID NO: 1203524 - RNA, 19 nt, Homo sapiens
agaaacaauuacccaacua

SEQ ID NO: 1203525 - RNA, 19 nt, Homo sapiens
gagaucaagcaguuuguuu

SEQ ID NO: 1203526 - RNA, 19 nt, Homo sapiens
gaaagacacaaugcuaaga

SEQ ID NO: 1203527 - RNA, 19 nt, Homo sapiens
ggggucagcuucuuaaauu

SEQ ID NO: 1203528 - RNA, 19 nt, Homo sapiens
gagugaaccuaaacguguu

SEQ ID NO: 1203529 - RNA, 19 nt, Homo sapiens
ggcaauaguuugggaugaa

SEQ ID NO: 1203530 - RNA, 19 nt, Homo sapiens
gcaauaguuugggaugaau

SEQ ID NO: 1203531 - RNA, 19 nt, Homo sapiens
agauggagguacagaauau

SEQ ID NO: 1203532 - RNA, 19 nt, Homo sapiens
gauccgagauaagaacuuc

SEQ ID NO: 1203533 - RNA, 19 nt, Homo sapiens
gcgaacagcgguugaagga

SEQ ID NO: 1203534 - RNA, 19 nt, Homo sapiens
ggcuagaguugauggauau

SEQ ID NO: 1203535 - RNA, 19 nt, Homo sapiens
ggggccagcucuuaaaaua

SEQ ID NO: 1203536 - RNA, 19 nt, Homo sapiens
gaguuuaugucuggaauag

SEQ ID NO: 1203537 - RNA, 19 nt, Homo sapiens
gcaaaccauaccucaauug

SEQ ID NO: 1203538 - RNA, 19 nt, Homo sapiens
gcugagauccgagauaaga

SEQ ID NO: 1203539 - RNA, 19 nt, Homo sapiens
acaaguguacugcagaaua

SEQ ID NO: 1203540 - RNA, 19 nt, Homo sapiens
gaugaaauuuauggcauuc

SEQ ID NO: 1203541 - RNA, 19 nt, Homo sapiens
ccacagugcugggauuaca

SEQ ID NO: 1203542 - RNA, 19 nt, Homo sapiens
gaagaaauugcugaaagga

SEQ ID NO: 1203543 - RNA, 19 nt, Homo sapiens
ugaagaaauugcugaaagg

SEQ ID NO: 1203544 - RNA, 19 nt, Homo sapiens
gcgaguuccuggacaagug

SEQ ID NO: 1203545 - RNA, 19 nt, Homo sapiens
ggcguaaccuucgcugaaa

SEQ ID NO: 1203546 - RNA, 19 nt, Homo sapiens
ggaaagacacaaugcuaag

SEQ ID NO: 1203547 - RNA, 19 nt, Homo sapiens
gaggagcucuaugcugaga

SEQ ID NO: 1203548 - RNA, 19 nt, Homo sapiens
cagcuuagaucucauucca

SEQ ID NO: 1203549 - RNA, 19 nt, Homo sapiens
gaaguaaaaccccauagaa

SEQ ID NO: 1203550 - RNA, 19 nt, Homo sapiens
uugcagaauugaucaaaga

SEQ ID NO: 1203551 - RNA, 19 nt, Homo sapiens
ggucagcuucuuaaauuau

SEQ ID NO: 1203552 - RNA, 19 nt, Homo sapiens
ugaaauuaccuccagagaa

SEQ ID NO: 1203553 - RNA, 19 nt, Homo sapiens
gcugaugugaagaauauaa

SEQ ID NO: 1203554 - RNA, 19 nt, Homo sapiens
gaggugaaacugaaaauaa

SEQ ID NO: 1203555 - RNA, 19 nt, Homo sapiens
gggcguaaccuucgcugaa

SEQ ID NO: 1203556 - RNA, 19 nt, Homo sapiens
ggagcucuaugcugagauc

SEQ ID NO: 1203557 - RNA, 19 nt, Homo sapiens
agaaugcgcucggcaagug

SEQ ID NO: 1203558 - RNA, 19 nt, Homo sapiens
gagggugcauucaaagagu

SEQ ID NO: 1203559 - RNA, 19 nt, Homo sapiens
guacagcuuagaucucauu

SEQ ID NO: 1203560 - RNA, 19 nt, Homo sapiens
gcucagggucuucauuaga

SEQ ID NO: 1203561 - RNA, 19 nt, Homo sapiens
aagcucagggucuucauua

SEQ ID NO: 1203562 - RNA, 19 nt, Homo sapiens
guucagaggagacuuaaca

SEQ ID NO: 1203563 - RNA, 19 nt, Homo sapiens
gauaaggucaacaauuaca

SEQ ID NO: 1203564 - RNA, 19 nt, Homo sapiens
ugaaggaucugggugucuu

SEQ ID NO: 1203565 - RNA, 19 nt, Homo sapiens
ggaagauggagguacagaa

SEQ ID NO: 1203566 - RNA, 19 nt, Homo sapiens
cagaaacaauuacccaacu

SEQ ID NO: 1203567 - RNA, 19 nt, Homo sapiens
caagaaagcaaagaucauc

SEQ ID NO: 1203568 - RNA, 19 nt, Homo sapiens
gcaggaagcaaggcaauag

SEQ ID NO: 1203569 - RNA, 19 nt, Homo sapiens
gaaauuuauggcauucaga

SEQ ID NO: 1203570 - RNA, 19 nt, Homo sapiens
cugaggaggugaaacugaa

SEQ ID NO: 1203571 - RNA, 19 nt, Homo sapiens
uagaagaaacaugggaaua

SEQ ID NO: 1203572 - RNA, 19 nt, Homo sapiens
gcaagaaagcaaagaucau

SEQ ID NO: 1203573 - RNA, 19 nt, Homo sapiens
aagagagaguuuacaggaa

SEQ ID NO: 1203574 - RNA, 19 nt, Homo sapiens
caaguggccaauaugauga

SEQ ID NO: 1203575 - RNA, 19 nt, Homo sapiens
gauggaugauguuaaugag

SEQ ID NO: 1203576 - RNA, 19 nt, Homo sapiens
aggcuagaguugauggaua

SEQ ID NO: 1203577 - RNA, 19 nt, Homo sapiens
gggcagaacuguacaagga

SEQ ID NO: 1203578 - RNA, 19 nt, Homo sapiens
gaaguaaggcugucagaga

SEQ ID NO: 1203579 - RNA, 19 nt, Homo sapiens
ggagauccauccaccuauu

SEQ ID NO: 1203580 - RNA, 19 nt, Homo sapiens
ggcuauauguguaugaaua

SEQ ID NO: 1203581 - RNA, 19 nt, Homo sapiens
acaaggagccuaccaauga

SEQ ID NO: 1203582 - RNA, 19 nt, Homo sapiens
agacucagcucaaauagug

SEQ ID NO: 1203583 - RNA, 19 nt, Homo sapiens
gaaaggggcuauaugugua

SEQ ID NO: 1203584 - RNA, 19 nt, Homo sapiens
ggccagagcugcaggacaa

SEQ ID NO: 1203585 - RNA, 19 nt, Homo sapiens
gaagaaggaucggauugau

SEQ ID NO: 1203586 - RNA, 19 nt, Homo sapiens
gcacggcugucuaugaugu

SEQ ID NO: 1203587 - RNA, 19 nt, Homo sapiens
gcacacggauguccuuaag

SEQ ID NO: 1203588 - RNA, 19 nt, Homo sapiens
ggaccugugccuagacuua

SEQ ID NO: 1203589 - RNA, 19 nt, Homo sapiens
uagaggagcuacuaaagga

SEQ ID NO: 1203590 - RNA, 19 nt, Homo sapiens
caagaugucaguaggauga

SEQ ID NO: 1203591 - RNA, 19 nt, Homo sapiens
uggcagagcuguugacaca

SEQ ID NO: 1203592 - RNA, 19 nt, Homo sapiens
acacauggguccugcaaga

SEQ ID NO: 1203593 - RNA, 19 nt, Homo sapiens
gaacugaacccaggagauc

SEQ ID NO: 1203594 - RNA, 19 nt, Homo sapiens
gagauccauccaccuauua

SEQ ID NO: 1203595 - RNA, 19 nt, Homo sapiens
ggauuuguguuucggauuc

SEQ ID NO: 1203596 - RNA, 19 nt, Homo sapiens
ucccuccucugaacuauua

SEQ ID NO: 1203597 - RNA, 19 nt, Homo sapiens
gggaucaguuuaugucuca

SEQ ID NO: 1203598 - RNA, 19 nt, Homo sapiens
gaagaagaaggaucggauu

SEQ ID NO: 1203599 - RNA, 19 nt, Homo sapiens
cagcucagaucccucuuug

SEQ ID NO: 1203600 - RNA, 19 nt, Homo sapiens
ugagaagugucuugcaguu

SEQ ID NO: 1203601 - RNA, 19 nt, Homo sapiens
cuuguaaucccaacacuua

SEQ ID NO: 1203602 - RNA, 19 nt, Homo sapiens
caucugcccuggcuguuug

SEQ ID NO: 1203603 - RNA, 19 nt, Homo sapiens
agaagugucuugcaguuuc

SEQ ID NO: 1203604 - RNA, 19 nt, Homo sapiens
ccugguuucuuguauguaa

SEQ ID NO: 1203605 - RNA, 19 nt, Homo sapiens
aaacugccacuacuaugua

SEQ ID NO: 1203606 - RNA, 19 nt, Homo sapiens
guauagacccggcuagaau

SEQ ID NO: 1203607 - RNA, 19 nt, Homo sapiens
gcaggacauuggaccucua

SEQ ID NO: 1203608 - RNA, 19 nt, Homo sapiens
guaauggugcccaauguug

SEQ ID NO: 1203609 - RNA, 19 nt, Homo sapiens
aaaccuguguccacuaugu

SEQ ID NO: 1203610 - RNA, 19 nt, Homo sapiens
agaaaccuguguccacuau

SEQ ID NO: 1203611 - RNA, 19 nt, Homo sapiens
guaaggcugucagagaaga

SEQ ID NO: 1203612 - RNA, 19 nt, Homo sapiens
aaguaaggcugucagagaa

SEQ ID NO: 1203613 - RNA, 19 nt, Homo sapiens
ccccaucucuuuuaaauaa

SEQ ID NO: 1203614 - RNA, 19 nt, Homo sapiens
ugaaucaucuccaacaaaa

SEQ ID NO: 1203615 - RNA, 19 nt, Homo sapiens
cagguuggcuuccuucgau

SEQ ID NO: 1203616 - RNA, 19 nt, Homo sapiens
gcacacacaguggcauaaa

SEQ ID NO: 1203617 - RNA, 19 nt, Homo sapiens
ucacaaacugccacuacua

SEQ ID NO: 1203618 - RNA, 19 nt, Homo sapiens
gcugaaucaucuccaacaa

SEQ ID NO: 1203619 - RNA, 19 nt, Homo sapiens
ccugaaacccucacuguug

SEQ ID NO: 1203620 - RNA, 19 nt, Homo sapiens
caaacugccacuacuaugu

SEQ ID NO: 1203621 - RNA, 19 nt, Homo sapiens
cauuggaccucuagagcaa

SEQ ID NO: 1203622 - RNA, 19 nt, Homo sapiens
gaagugagagguggacugu

SEQ ID NO: 1203623 - RNA, 19 nt, Homo sapiens
agacugagaucuuguucca

SEQ ID NO: 1203624 - RNA, 19 nt, Homo sapiens
acacacaguggcauaaauu

SEQ ID NO: 1203625 - RNA, 19 nt, Homo sapiens
ggauucgcguggccuauca

SEQ ID NO: 1203626 - RNA, 19 nt, Homo sapiens
cagccaagauccaccaaag

SEQ ID NO: 1203627 - RNA, 19 nt, Homo sapiens
ugucaaccauucugaguuc

SEQ ID NO: 1203628 - RNA, 19 nt, Homo sapiens
ugaacaugcugaaucaucu

SEQ ID NO: 1203629 - RNA, 19 nt, Homo sapiens
gaggcacggcugucuauga

SEQ ID NO: 1203630 - RNA, 19 nt, Homo sapiens
ggcugaacaugcugaauca

SEQ ID NO: 1203631 - RNA, 19 nt, Homo sapiens
guacaaggagccuaccaau

SEQ ID NO: 1203632 - RNA, 19 nt, Homo sapiens
uaaggauggauuuguguuu

SEQ ID NO: 1203633 - RNA, 19 nt, Homo sapiens
gaagugucuugcaguuucu

SEQ ID NO: 1203634 - RNA, 19 nt, Homo sapiens
gagaagugucuugcaguuu

SEQ ID NO: 1203635 - RNA, 19 nt, Homo sapiens
caggagauccauccaccua

SEQ ID NO: 1203636 - RNA, 19 nt, Homo sapiens
ggacaucaggacaguguuc

SEQ ID NO: 1203637 - RNA, 19 nt, Homo sapiens
cugaagcccugcccauguu

SEQ ID NO: 1203638 - RNA, 19 nt, Homo sapiens
agacccggcuagaaucuga

SEQ ID NO: 1203639 - RNA, 19 nt, Homo sapiens
agugagagguggacugugu

SEQ ID NO: 1203640 - RNA, 19 nt, Homo sapiens
gugaggguuucgcugauga

SEQ ID NO: 1203641 - RNA, 19 nt, Homo sapiens
ggaaggcacaggcaaagag

SEQ ID NO: 1203642 - RNA, 19 nt, Homo sapiens
ggagucaggagaaucacuu

SEQ ID NO: 1203643 - RNA, 19 nt, Homo sapiens
acaguggcauaaauucuau

SEQ ID NO: 1203644 - RNA, 19 nt, Homo sapiens
cacaguggcauaaauucua

SEQ ID NO: 1203645 - RNA, 19 nt, Homo sapiens
agacuuagcaugcccuuca

SEQ ID NO: 1203646 - RNA, 19 nt, Homo sapiens
caaccucugugcugauguc

SEQ ID NO: 1203647 - RNA, 19 nt, Homo sapiens
caaggagccuaccaaugag

SEQ ID NO: 1203648 - RNA, 19 nt, Homo sapiens
ggaaaggggcuauaugugu

SEQ ID NO: 1203649 - RNA, 19 nt, Homo sapiens
uugucaaccucaauaauga

SEQ ID NO: 1203650 - RNA, 19 nt, Homo sapiens
ucaacgggaucaguuuaug

SEQ ID NO: 1203651 - RNA, 19 nt, Homo sapiens
gaucuuucccuccucugaa

SEQ ID NO: 1203652 - RNA, 19 nt, Homo sapiens
cuacacccacuuucuggua

SEQ ID NO: 1203653 - RNA, 19 nt, Homo sapiens
ggacauuggaccucuagag

SEQ ID NO: 1203654 - RNA, 19 nt, Homo sapiens
ccaaugaggagcuuaaucg

SEQ ID NO: 1203655 - RNA, 19 nt, Homo sapiens
uagagaagcagcucaugga

SEQ ID NO: 1203656 - RNA, 19 nt, Homo sapiens
ggacaucagccaagaucca

SEQ ID NO: 1203657 - RNA, 19 nt, Homo sapiens
gguauagacccggcuagaa

SEQ ID NO: 1203658 - RNA, 19 nt, Homo sapiens
gagcaagaugucaguagga

SEQ ID NO: 1203659 - RNA, 19 nt, Homo sapiens
ucaauaaugagcucacugu

SEQ ID NO: 1203660 - RNA, 19 nt, Homo sapiens
cagccucuaugucccagaa

SEQ ID NO: 1203661 - RNA, 19 nt, Homo sapiens
acauggguccugcaagaua

SEQ ID NO: 1203662 - RNA, 19 nt, Homo sapiens
ugucagagaagaagaagga

SEQ ID NO: 1203663 - RNA, 19 nt, Homo sapiens
caaauagugccccuccuua

SEQ ID NO: 1203664 - RNA, 19 nt, Homo sapiens
gcugaagcccugcccaugu

SEQ ID NO: 1203665 - RNA, 19 nt, Homo sapiens
ggugaggguuucgcugaug

SEQ ID NO: 1203666 - RNA, 19 nt, Homo sapiens
ccuuaaggauggauuugug

SEQ ID NO: 1203667 - RNA, 19 nt, Homo sapiens
guuuaugucucagcucaga

SEQ ID NO: 1203668 - RNA, 19 nt, Homo sapiens
gcccaauguugaagcaauc

SEQ ID NO: 1203669 - RNA, 19 nt, Homo sapiens
uaauggugcccaauguuga

SEQ ID NO: 1203670 - RNA, 19 nt, Homo sapiens
uaguaauggugcccaaugu

SEQ ID NO: 1203671 - RNA, 19 nt, Homo sapiens
ugauugguguccucuggaa

SEQ ID NO: 1203672 - RNA, 19 nt, Homo sapiens
gaccgugucugcuguucag

SEQ ID NO: 1203673 - RNA, 19 nt, Homo sapiens
gccaagauccaccaaagca

SEQ ID NO: 1203674 - RNA, 19 nt, Homo sapiens
ggacaaugguggggacuau

SEQ ID NO: 1203675 - RNA, 19 nt, Homo sapiens
caacgggaucaguuuaugu

SEQ ID NO: 1203676 - RNA, 19 nt, Homo sapiens
uaacacauggguccugcaa

SEQ ID NO: 1203677 - RNA, 19 nt, Homo sapiens
gggcagaacuguacaagga

SEQ ID NO: 1203678 - RNA, 19 nt, Homo sapiens
gaaguaaggcugucagaga

SEQ ID NO: 1203679 - RNA, 19 nt, Homo sapiens
gaaggagcauauaugugua

SEQ ID NO: 1203680 - RNA, 19 nt, Homo sapiens
ggcuauauguguaugaaua

SEQ ID NO: 1203681 - RNA, 19 nt, Homo sapiens
acaaggagccuaccaauga

SEQ ID NO: 1203682 - RNA, 19 nt, Homo sapiens
agacucagcucaaauagug

SEQ ID NO: 1203683 - RNA, 19 nt, Homo sapiens
gaaaggggcuauaugugua

SEQ ID NO: 1203684 - RNA, 19 nt, Homo sapiens
ggccagagcugcaggacaa

SEQ ID NO: 1203685 - RNA, 19 nt, Homo sapiens
gaagaaggaucggauugau

SEQ ID NO: 1203686 - RNA, 19 nt, Homo sapiens
gcacggcugucuaugaugu

SEQ ID NO: 1203687 - RNA, 19 nt, Homo sapiens
gcacacggauguccuuaag

SEQ ID NO: 1203688 - RNA, 19 nt, Homo sapiens
uagaggagcuacuaaagga

SEQ ID NO: 1203689 - RNA, 19 nt, Homo sapiens
uggcagagcuguugacaca

SEQ ID NO: 1203690 - RNA, 19 nt, Homo sapiens
acacauggguccugcaaga

SEQ ID NO: 1203691 - RNA, 19 nt, Homo sapiens
ggauuuguguuucggauuc

SEQ ID NO: 1203692 - RNA, 19 nt, Homo sapiens
ucccuccucugaacuauua

SEQ ID NO: 1203693 - RNA, 19 nt, Homo sapiens
gggaucaguuuaugucuca

SEQ ID NO: 1203694 - RNA, 19 nt, Homo sapiens
gaagaagaaggaucggauu

SEQ ID NO: 1203695 - RNA, 19 nt, Homo sapiens
ugaaggagcauauaugugu

SEQ ID NO: 1203696 - RNA, 19 nt, Homo sapiens
cagcucagaucccucuuug

SEQ ID NO: 1203697 - RNA, 19 nt, Homo sapiens
ugagaagugucuugcaguu

SEQ ID NO: 1203698 - RNA, 19 nt, Homo sapiens
cuuguaaucccaacacuua

SEQ ID NO: 1203699 - RNA, 19 nt, Homo sapiens
caucugcccuggcuguuug

SEQ ID NO: 1203700 - RNA, 19 nt, Homo sapiens
agaagugucuugcaguuuc

SEQ ID NO: 1203701 - RNA, 19 nt, Homo sapiens
ccugguuucuuguauguaa

SEQ ID NO: 1203702 - RNA, 19 nt, Homo sapiens
aaacugccacuacuaugua

SEQ ID NO: 1203703 - RNA, 19 nt, Homo sapiens
guauagacccggcuagaau

SEQ ID NO: 1203704 - RNA, 19 nt, Homo sapiens
aaaccuguguccacuaugu

SEQ ID NO: 1203705 - RNA, 19 nt, Homo sapiens
agaaaccuguguccacuau

SEQ ID NO: 1203706 - RNA, 19 nt, Homo sapiens
guaaggcugucagagaaga

SEQ ID NO: 1203707 - RNA, 19 nt, Homo sapiens
aaguaaggcugucagagaa

SEQ ID NO: 1203708 - RNA, 19 nt, Homo sapiens
ccccaucucuuuuaaauaa

SEQ ID NO: 1203709 - RNA, 19 nt, Homo sapiens
cagguuggcuuccuucgau

SEQ ID NO: 1203710 - RNA, 19 nt, Homo sapiens
gcacacacaguggcauaaa

SEQ ID NO: 1203711 - RNA, 19 nt, Homo sapiens
ucacaaacugccacuacua

SEQ ID NO: 1203712 - RNA, 19 nt, Homo sapiens
ccugaaacccucacuguug

SEQ ID NO: 1203713 - RNA, 19 nt, Homo sapiens
caaacugccacuacuaugu

SEQ ID NO: 1203714 - RNA, 19 nt, Homo sapiens
agacugagaucuuguucca

SEQ ID NO: 1203715 - RNA, 19 nt, Homo sapiens
acacacaguggcauaaauu

SEQ ID NO: 1203716 - RNA, 19 nt, Homo sapiens
ggauucgcguggccuauca

SEQ ID NO: 1203717 - RNA, 19 nt, Homo sapiens
cagccaagauccaccaaag

SEQ ID NO: 1203718 - RNA, 19 nt, Homo sapiens
ugucaaccauucugaguuc

SEQ ID NO: 1203719 - RNA, 19 nt, Homo sapiens
gaggcacggcugucuauga

SEQ ID NO: 1203720 - RNA, 19 nt, Homo sapiens
uaaggauggauuuguguuu

SEQ ID NO: 1203721 - RNA, 19 nt, Homo sapiens
gaagugucuugcaguuucu

SEQ ID NO: 1203722 - RNA, 19 nt, Homo sapiens
gagaagugucuugcaguuu

SEQ ID NO: 1203723 - RNA, 19 nt, Homo sapiens
guacaaggagccuaccaau

SEQ ID NO: 1203724 - RNA, 19 nt, Homo sapiens
ccacauugaaggagcauau

SEQ ID NO: 1203725 - RNA, 19 nt, Homo sapiens
cugaagcccugcccauguu

SEQ ID NO: 1203726 - RNA, 19 nt, Homo sapiens
ggaaggcacaggcaaagag

SEQ ID NO: 1203727 - RNA, 19 nt, Homo sapiens
agacccggcuagaaucuga

SEQ ID NO: 1203728 - RNA, 19 nt, Homo sapiens
gugaggguuucgcugauga

SEQ ID NO: 1203729 - RNA, 19 nt, Homo sapiens
ggagucaggagaaucacuu

SEQ ID NO: 1203730 - RNA, 19 nt, Homo sapiens
acaguggcauaaauucuau

SEQ ID NO: 1203731 - RNA, 19 nt, Homo sapiens
cacaguggcauaaauucua

SEQ ID NO: 1203732 - RNA, 19 nt, Homo sapiens
caaccucugugcugauguc

SEQ ID NO: 1203733 - RNA, 19 nt, Homo sapiens
caaggagccuaccaaugag

SEQ ID NO: 1203734 - RNA, 19 nt, Homo sapiens
ggaaaggggcuauaugugu

SEQ ID NO: 1203735 - RNA, 19 nt, Homo sapiens
uugucaaccucaauaauga

SEQ ID NO: 1203736 - RNA, 19 nt, Homo sapiens
ucaacgggaucaguuuaug

SEQ ID NO: 1203737 - RNA, 19 nt, Homo sapiens
gaucuuucccuccucugaa

SEQ ID NO: 1203738 - RNA, 19 nt, Homo sapiens
cuacacccacuuucuggua

SEQ ID NO: 1203739 - RNA, 19 nt, Homo sapiens
uagagaagcagcucaugga

SEQ ID NO: 1203740 - RNA, 19 nt, Homo sapiens
ccaaugaggagcuuaaucg

SEQ ID NO: 1203741 - RNA, 19 nt, Homo sapiens
ggacaucagccaagaucca

SEQ ID NO: 1203742 - RNA, 19 nt, Homo sapiens
gguauagacccggcuagaa

SEQ ID NO: 1203743 - RNA, 19 nt, Homo sapiens
ucaauaaugagcucacugu

SEQ ID NO: 1203744 - RNA, 19 nt, Homo sapiens
cagccucuaugucccagaa

SEQ ID NO: 1203745 - RNA, 19 nt, Homo sapiens
acauggguccugcaagaua

SEQ ID NO: 1203746 - RNA, 19 nt, Homo sapiens
ugucagagaagaagaagga

SEQ ID NO: 1203747 - RNA, 19 nt, Homo sapiens
caaauagugccccuccuua

SEQ ID NO: 1203748 - RNA, 19 nt, Homo sapiens
gcugaagcccugcccaugu

SEQ ID NO: 1203749 - RNA, 19 nt, Homo sapiens
ggugaggguuucgcugaug

SEQ ID NO: 1203750 - RNA, 19 nt, Homo sapiens
ccuuaaggauggauuugug

SEQ ID NO: 1203751 - RNA, 19 nt, Homo sapiens
guuuaugucucagcucaga

SEQ ID NO: 1203752 - RNA, 19 nt, Homo sapiens
gaccgugucugcuguucag

SEQ ID NO: 1203753 - RNA, 19 nt, Homo sapiens
gccaagauccaccaaagca

SEQ ID NO: 1203754 - RNA, 19 nt, Homo sapiens
ggacaaugguggggacuau

SEQ ID NO: 1203755 - RNA, 19 nt, Homo sapiens
caacgggaucaguuuaugu

SEQ ID NO: 1203756 - RNA, 19 nt, Homo sapiens
uaacacauggguccugcaa

SEQ ID NO: 1203757 - RNA, 19 nt, Homo sapiens
cagcccagguuacuguugu

SEQ ID NO: 1203758 - RNA, 19 nt, Homo sapiens
ucggauugaugccuuccua

SEQ ID NO: 1203759 - RNA, 19 nt, Homo sapiens
cacuugagcucaggaguuc

SEQ ID NO: 1203760 - RNA, 19 nt, Homo sapiens
cacacacaguggcauaaau

SEQ ID NO: 1203761 - RNA, 19 nt, Homo sapiens
cacaaacugccacuacuau

SEQ ID NO: 1203762 - RNA, 19 nt, Homo sapiens
augaauagaccacauugaa

SEQ ID NO: 1203763 - RNA, 19 nt, Homo sapiens
augaauagaccacauugaa

SEQ ID NO: 1203764 - RNA, 19 nt, Homo sapiens
guccagccuucuccuucua

SEQ ID NO: 1203765 - RNA, 19 nt, Homo sapiens
gacuaugucucagcugcuu

SEQ ID NO: 1203766 - RNA, 19 nt, Homo sapiens
ggcaagaacauguuugaac

SEQ ID NO: 1203767 - RNA, 19 nt, Homo sapiens
gaccccaucucuuuuaaau

SEQ ID NO: 1203768 - RNA, 19 nt, Homo sapiens
ucacuugagcucaggaguu

SEQ ID NO: 1203769 - RNA, 19 nt, Homo sapiens
cagcagggcagaacuguac

SEQ ID NO: 1203770 - RNA, 19 nt, Homo sapiens
uccagacucagcucaaaua

SEQ ID NO: 1203771 - RNA, 19 nt, Homo sapiens
gaaccgaggacaggaaagg

SEQ ID NO: 1203772 - RNA, 19 nt, Homo sapiens
agaagaaggaucggauuga

SEQ ID NO: 1203773 - RNA, 19 nt, Homo sapiens
cugcaucuccguccacuga

SEQ ID NO: 1203774 - RNA, 19 nt, Homo sapiens
aggcacggcugucuaugau

SEQ ID NO: 1203775 - RNA, 19 nt, Homo sapiens
ggccuucuccguugucuuc

SEQ ID NO: 1203776 - RNA, 19 nt, Homo sapiens
ggacaaggacgggcugaac

SEQ ID NO: 1203777 - RNA, 19 nt, Homo sapiens
gggcagaacuguacaagga

SEQ ID NO: 1203778 - RNA, 19 nt, Homo sapiens
gaaguaaggcugucagaga

SEQ ID NO: 1203779 - RNA, 19 nt, Homo sapiens
ggagauccauccaccuauu

SEQ ID NO: 1203780 - RNA, 19 nt, Homo sapiens
ggcuauauguguaugaaua

SEQ ID NO: 1203781 - RNA, 19 nt, Homo sapiens
acaaggagccuaccaauga

SEQ ID NO: 1203782 - RNA, 19 nt, Homo sapiens
agacucagcucaaauagug

SEQ ID NO: 1203783 - RNA, 19 nt, Homo sapiens
gaaaggggcuauaugugua

SEQ ID NO: 1203784 - RNA, 19 nt, Homo sapiens
ggccagagcugcaggacaa

SEQ ID NO: 1203785 - RNA, 19 nt, Homo sapiens
gaagaaggaucggauugau

SEQ ID NO: 1203786 - RNA, 19 nt, Homo sapiens
gcacggcugucuaugaugu

SEQ ID NO: 1203787 - RNA, 19 nt, Homo sapiens
ggaccugugccuagacuua

SEQ ID NO: 1203788 - RNA, 19 nt, Homo sapiens
uagaggagcuacuaaagga

SEQ ID NO: 1203789 - RNA, 19 nt, Homo sapiens
caagaugucaguaggauga

SEQ ID NO: 1203790 - RNA, 19 nt, Homo sapiens
acacauggguccugcaaga

SEQ ID NO: 1203791 - RNA, 19 nt, Homo sapiens
gaacugaacccaggagauc

SEQ ID NO: 1203792 - RNA, 19 nt, Homo sapiens
gagauccauccaccuauua

SEQ ID NO: 1203793 - RNA, 19 nt, Homo sapiens
ucccuccucugaacuauua

SEQ ID NO: 1203794 - RNA, 19 nt, Homo sapiens
gggaucaguuuaugucuca

SEQ ID NO: 1203795 - RNA, 19 nt, Homo sapiens
gaagaagaaggaucggauu

SEQ ID NO: 1203796 - RNA, 19 nt, Homo sapiens
aaagaggccuccagcacaa

SEQ ID NO: 1203797 - RNA, 19 nt, Homo sapiens
cagcucagaucccucuuug

SEQ ID NO: 1203798 - RNA, 19 nt, Homo sapiens
ugagaagugucuugcaguu

SEQ ID NO: 1203799 - RNA, 19 nt, Homo sapiens
cuuguaaucccaacacuua

SEQ ID NO: 1203800 - RNA, 19 nt, Homo sapiens
caucugcccuggcuguuug

SEQ ID NO: 1203801 - RNA, 19 nt, Homo sapiens
agaagugucuugcaguuuc

SEQ ID NO: 1203802 - RNA, 19 nt, Homo sapiens
ccugguuucuuguauguaa

SEQ ID NO: 1203803 - RNA, 19 nt, Homo sapiens
aaacugccacuacuaugua

SEQ ID NO: 1203804 - RNA, 19 nt, Homo sapiens
guauagacccggcuagaau

SEQ ID NO: 1203805 - RNA, 19 nt, Homo sapiens
gcaggacauuggaccucua

SEQ ID NO: 1203806 - RNA, 19 nt, Homo sapiens
guaauggugcccaauguug

SEQ ID NO: 1203807 - RNA, 19 nt, Homo sapiens
aaaccuguguccacuaugu

SEQ ID NO: 1203808 - RNA, 19 nt, Homo sapiens
agaaaccuguguccacuau

SEQ ID NO: 1203809 - RNA, 19 nt, Homo sapiens
guaaggcugucagagaaga

SEQ ID NO: 1203810 - RNA, 19 nt, Homo sapiens
aaguaaggcugucagagaa

SEQ ID NO: 1203811 - RNA, 19 nt, Homo sapiens
ccccaucucuuuuaaauaa

SEQ ID NO: 1203812 - RNA, 19 nt, Homo sapiens
ugaaucaucuccaacaaaa

SEQ ID NO: 1203813 - RNA, 19 nt, Homo sapiens
gcacacacaguggcauaaa

SEQ ID NO: 1203814 - RNA, 19 nt, Homo sapiens
ucacaaacugccacuacua

SEQ ID NO: 1203815 - RNA, 19 nt, Homo sapiens
gcugaaucaucuccaacaa

SEQ ID NO: 1203816 - RNA, 19 nt, Homo sapiens
ccugaaacccucacuguug

SEQ ID NO: 1203817 - RNA, 19 nt, Homo sapiens
caaacugccacuacuaugu

SEQ ID NO: 1203818 - RNA, 19 nt, Homo sapiens
cauuggaccucuagagcaa

SEQ ID NO: 1203819 - RNA, 19 nt, Homo sapiens
gaagugagagguggacugu

SEQ ID NO: 1203820 - RNA, 19 nt, Homo sapiens
agacugagaucuuguucca

SEQ ID NO: 1203821 - RNA, 19 nt, Homo sapiens
acacacaguggcauaaauu

SEQ ID NO: 1203822 - RNA, 19 nt, Homo sapiens
cagccaagauccaccaaag

SEQ ID NO: 1203823 - RNA, 19 nt, Homo sapiens
ugucaaccauucugaguuc

SEQ ID NO: 1203824 - RNA, 19 nt, Homo sapiens
ugaacaugcugaaucaucu

SEQ ID NO: 1203825 - RNA, 19 nt, Homo sapiens
gaggcacggcugucuauga

SEQ ID NO: 1203826 - RNA, 19 nt, Homo sapiens
ggcugaacaugcugaauca

SEQ ID NO: 1203827 - RNA, 19 nt, Homo sapiens
gaagugucuugcaguuucu

SEQ ID NO: 1203828 - RNA, 19 nt, Homo sapiens
gagaagugucuugcaguuu

SEQ ID NO: 1203829 - RNA, 19 nt, Homo sapiens
guacaaggagccuaccaau

SEQ ID NO: 1203830 - RNA, 19 nt, Homo sapiens
caggagauccauccaccua

SEQ ID NO: 1203831 - RNA, 19 nt, Homo sapiens
ggaaggcacaggcaaagag

SEQ ID NO: 1203832 - RNA, 19 nt, Homo sapiens
agacccggcuagaaucuga

SEQ ID NO: 1203833 - RNA, 19 nt, Homo sapiens
agugagagguggacugugu

SEQ ID NO: 1203834 - RNA, 19 nt, Homo sapiens
ggagucaggagaaucacuu

SEQ ID NO: 1203835 - RNA, 19 nt, Homo sapiens
acaguggcauaaauucuau

SEQ ID NO: 1203836 - RNA, 19 nt, Homo sapiens
cacaguggcauaaauucua

SEQ ID NO: 1203837 - RNA, 19 nt, Homo sapiens
agacuuagcaugcccuuca

SEQ ID NO: 1203838 - RNA, 19 nt, Homo sapiens
caaggagccuaccaaugag

SEQ ID NO: 1203839 - RNA, 19 nt, Homo sapiens
caaccucugugcugauguc

SEQ ID NO: 1203840 - RNA, 19 nt, Homo sapiens
ggaaaggggcuauaugugu

SEQ ID NO: 1203841 - RNA, 19 nt, Homo sapiens
ucaacgggaucaguuuaug

SEQ ID NO: 1203842 - RNA, 19 nt, Homo sapiens
gaucuuucccuccucugaa

SEQ ID NO: 1203843 - RNA, 19 nt, Homo sapiens
cuacacccacuuucuggua

SEQ ID NO: 1203844 - RNA, 19 nt, Homo sapiens
ggacauuggaccucuagag

SEQ ID NO: 1203845 - RNA, 19 nt, Homo sapiens
ggacaucagccaagaucca

SEQ ID NO: 1203846 - RNA, 19 nt, Homo sapiens
ccaaugaggagcuuaaucg

SEQ ID NO: 1203847 - RNA, 19 nt, Homo sapiens
gguauagacccggcuagaa

SEQ ID NO: 1203848 - RNA, 19 nt, Homo sapiens
gagcaagaugucaguagga

SEQ ID NO: 1203849 - RNA, 19 nt, Homo sapiens
cagccucuaugucccagaa

SEQ ID NO: 1203850 - RNA, 19 nt, Homo sapiens
acauggguccugcaagaua

SEQ ID NO: 1203851 - RNA, 19 nt, Homo sapiens
ugucagagaagaagaagga

SEQ ID NO: 1203852 - RNA, 19 nt, Homo sapiens
caaauagugccccuccuua

SEQ ID NO: 1203853 - RNA, 19 nt, Homo sapiens
guuuaugucucagcucaga

SEQ ID NO: 1203854 - RNA, 19 nt, Homo sapiens
gcccaauguugaagcaauc

SEQ ID NO: 1203855 - RNA, 19 nt, Homo sapiens
uaauggugcccaauguuga

SEQ ID NO: 1203856 - RNA, 19 nt, Homo sapiens
uaguaauggugcccaaugu

SEQ ID NO: 1203857 - RNA, 19 nt, Homo sapiens
gccaagauccaccaaagca

SEQ ID NO: 1203858 - RNA, 19 nt, Homo sapiens
ggacaaugguggggacuau

SEQ ID NO: 1203859 - RNA, 19 nt, Homo sapiens
caacgggaucaguuuaugu

SEQ ID NO: 1203860 - RNA, 19 nt, Homo sapiens
uaacacauggguccugcaa

SEQ ID NO: 1203861 - RNA, 19 nt, Homo sapiens
cagcccagguuacuguugu

SEQ ID NO: 1203862 - RNA, 19 nt, Homo sapiens
ucggauugaugccuuccua

SEQ ID NO: 1203863 - RNA, 19 nt, Homo sapiens
cacuugagcucaggaguuc

SEQ ID NO: 1203864 - RNA, 19 nt, Homo sapiens
cacacacaguggcauaaau

SEQ ID NO: 1203865 - RNA, 19 nt, Homo sapiens
cacaaacugccacuacuau

SEQ ID NO: 1203866 - RNA, 19 nt, Homo sapiens
augaauagaccacauugaa

SEQ ID NO: 1203867 - RNA, 19 nt, Homo sapiens
gacuaugucucagcugcuu

SEQ ID NO: 1203868 - RNA, 19 nt, Homo sapiens
ggcaagaacauguuugaac

SEQ ID NO: 1203869 - RNA, 19 nt, Homo sapiens
gaccccaucucuuuuaaau

SEQ ID NO: 1203870 - RNA, 19 nt, Homo sapiens
ucacuugagcucaggaguu

SEQ ID NO: 1203871 - RNA, 19 nt, Homo sapiens
uccagacucagcucaaaua

SEQ ID NO: 1203872 - RNA, 19 nt, Homo sapiens
gaaccgaggacaggaaagg

SEQ ID NO: 1203873 - RNA, 19 nt, Homo sapiens
cagcagggcagaacuguac

SEQ ID NO: 1203874 - RNA, 19 nt, Homo sapiens
agaagaaggaucggauuga

SEQ ID NO: 1203875 - RNA, 19 nt, Homo sapiens
ggaacugaacccaggagau

SEQ ID NO: 1203876 - RNA, 19 nt, Homo sapiens
cugcaucuccguccacuga

SEQ ID NO: 1203877 - RNA, 19 nt, Homo sapiens
gaacugaccuguuuauuug

SEQ ID NO: 1203878 - RNA, 19 nt, Homo sapiens
gaagaugacuguaacuuau

SEQ ID NO: 1203879 - RNA, 19 nt, Homo sapiens
gcacaacaauuuccaugua

SEQ ID NO: 1203880 - RNA, 19 nt, Homo sapiens
gcacuuagguucauuguag

SEQ ID NO: 1203881 - RNA, 19 nt, Homo sapiens
uaauuaagcuuccuccaua

SEQ ID NO: 1203882 - RNA, 19 nt, Homo sapiens
ggaagauguugcuuaauaa

SEQ ID NO: 1203883 - RNA, 19 nt, Homo sapiens
gaacuucaguguuauuuca

SEQ ID NO: 1203884 - RNA, 19 nt, Homo sapiens
gcaaguccaucccucauaa

SEQ ID NO: 1203885 - RNA, 19 nt, Homo sapiens
gaaauuugcugagauuguu

SEQ ID NO: 1203886 - RNA, 19 nt, Homo sapiens
ggagagggcugcucacaau

SEQ ID NO: 1203887 - RNA, 19 nt, Homo sapiens
ggacacauccgauaaaguu

SEQ ID NO: 1203888 - RNA, 19 nt, Homo sapiens
ggacagcugugauugaaau

SEQ ID NO: 1203889 - RNA, 19 nt, Homo sapiens
uaacagagccacuuuauca

SEQ ID NO: 1203890 - RNA, 19 nt, Homo sapiens
ugaaauagcuaucaugaag

SEQ ID NO: 1203891 - RNA, 19 nt, Homo sapiens
cuucauagcucaguuuaua

SEQ ID NO: 1203892 - RNA, 19 nt, Homo sapiens
gaaauggacacauccgaua

SEQ ID NO: 1203893 - RNA, 19 nt, Homo sapiens
aggaagauguugcuuaaua

SEQ ID NO: 1203894 - RNA, 19 nt, Homo sapiens
guacuguguuuacuguuua

SEQ ID NO: 1203895 - RNA, 19 nt, Homo sapiens
gagggcugcucacaauuua

SEQ ID NO: 1203896 - RNA, 19 nt, Homo sapiens
gaaguggucuacaguuaau

SEQ ID NO: 1203897 - RNA, 19 nt, Homo sapiens
guacauggauuuggucuau

SEQ ID NO: 1203898 - RNA, 19 nt, Homo sapiens
caaauuauguccacaagca

SEQ ID NO: 1203899 - RNA, 19 nt, Homo sapiens
ggaaauuuguggauucaau

SEQ ID NO: 1203900 - RNA, 19 nt, Homo sapiens
ccgaaucccuucugcauuu

SEQ ID NO: 1203901 - RNA, 19 nt, Homo sapiens
gaggaaccaucacaacauu

SEQ ID NO: 1203902 - RNA, 19 nt, Homo sapiens
gaauaucauugucaccauu

SEQ ID NO: 1203903 - RNA, 19 nt, Homo sapiens
caaaccuucuucuugaaua

SEQ ID NO: 1203904 - RNA, 19 nt, Homo sapiens
uaaggaagauacuuggaaa

SEQ ID NO: 1203905 - RNA, 19 nt, Homo sapiens
ccgauaaaguugaaaugua

SEQ ID NO: 1203906 - RNA, 19 nt, Homo sapiens
uguagugacugacauuaua

SEQ ID NO: 1203907 - RNA, 19 nt, Homo sapiens
gacuaaauguuucaucuug

SEQ ID NO: 1203908 - RNA, 19 nt, Homo sapiens
gguauugauugacaacuuu

SEQ ID NO: 1203909 - RNA, 19 nt, Homo sapiens
uaaaggaucauuucgguuu

SEQ ID NO: 1203910 - RNA, 19 nt, Homo sapiens
cagagccacuuuaucauuu

SEQ ID NO: 1203911 - RNA, 19 nt, Homo sapiens
cauaaaguccugcugauaa

SEQ ID NO: 1203912 - RNA, 19 nt, Homo sapiens
cuaaacacuuucaggauuu

SEQ ID NO: 1203913 - RNA, 19 nt, Homo sapiens
gcauuuaggcaucuguuua

SEQ ID NO: 1203914 - RNA, 19 nt, Homo sapiens
gaagaaauucacacacauu

SEQ ID NO: 1203915 - RNA, 19 nt, Homo sapiens
uugcugagauuguuuagua

SEQ ID NO: 1203916 - RNA, 19 nt, Homo sapiens
uuaggaagauguugcuuaa

SEQ ID NO: 1203917 - RNA, 19 nt, Homo sapiens
cauuaaagguuucaucaga

SEQ ID NO: 1203918 - RNA, 19 nt, Homo sapiens
gaagauacuuggaaaauuc

SEQ ID NO: 1203919 - RNA, 19 nt, Homo sapiens
cagaauggguguagcaaga

SEQ ID NO: 1203920 - RNA, 19 nt, Homo sapiens
caauuuauauggccaacuu

SEQ ID NO: 1203921 - RNA, 19 nt, Homo sapiens
ccagugaaccuauguacua

SEQ ID NO: 1203922 - RNA, 19 nt, Homo sapiens
ccaggcagcugucauggaa

SEQ ID NO: 1203923 - RNA, 19 nt, Homo sapiens
aaacauggaccaaggcaua

SEQ ID NO: 1203924 - RNA, 19 nt, Homo sapiens
gaaauucacacacauucuu

SEQ ID NO: 1203925 - RNA, 19 nt, Homo sapiens
ggaaccaucacaacauuaa

SEQ ID NO: 1203926 - RNA, 19 nt, Homo sapiens
gguacuguguuuacuguuu

SEQ ID NO: 1203927 - RNA, 19 nt, Homo sapiens
caaacaagaguacacuuaa

SEQ ID NO: 1203928 - RNA, 19 nt, Homo sapiens
acaauccgcuucauuucua

SEQ ID NO: 1203929 - RNA, 19 nt, Homo sapiens
ggaauuauaacccauacuu

SEQ ID NO: 1203930 - RNA, 19 nt, Homo sapiens
caaauuugcugucaugaac

SEQ ID NO: 1203931 - RNA, 19 nt, Homo sapiens
ggaagaaauucacacacau

SEQ ID NO: 1203932 - RNA, 19 nt, Homo sapiens
caucacagcugccauguac

SEQ ID NO: 1203933 - RNA, 19 nt, Homo sapiens
ggauugagaaguccaguuu

SEQ ID NO: 1203934 - RNA, 19 nt, Homo sapiens
ccucucagcuguuuaacuu

SEQ ID NO: 1203935 - RNA, 19 nt, Homo sapiens
ccaguuaauugggcuauuu

SEQ ID NO: 1203936 - RNA, 19 nt, Homo sapiens
ugaagaugacuguaacuua

SEQ ID NO: 1203937 - RNA, 19 nt, Homo sapiens
gagaaguccaguuugauuu

SEQ ID NO: 1203938 - RNA, 19 nt, Homo sapiens
gaucuaugcuccucuguac

SEQ ID NO: 1203939 - RNA, 19 nt, Homo sapiens
cugaaguggucuacaguua

SEQ ID NO: 1203940 - RNA, 19 nt, Homo sapiens
ucuaaacacuuucaggauu

SEQ ID NO: 1203941 - RNA, 19 nt, Homo sapiens
gaauaugauuggucuaguc

SEQ ID NO: 1203942 - RNA, 19 nt, Homo sapiens
gaauguauagguugaguga

SEQ ID NO: 1203943 - RNA, 19 nt, Homo sapiens
gaucacggguacauggauu

SEQ ID NO: 1203944 - RNA, 19 nt, Homo sapiens
ggacagacugcaaagugua

SEQ ID NO: 1203945 - RNA, 19 nt, Homo sapiens
gaagcagaauacaaugaug

SEQ ID NO: 1203946 - RNA, 19 nt, Homo sapiens
guaguggaauguuauagau

SEQ ID NO: 1203947 - RNA, 19 nt, Homo sapiens
gagauacucuuuucauuug

SEQ ID NO: 1203948 - RNA, 19 nt, Homo sapiens
gaugaacuacaugcuauua

SEQ ID NO: 1203949 - RNA, 19 nt, Homo sapiens
ucagaaacuuagaugauga

SEQ ID NO: 1203950 - RNA, 19 nt, Homo sapiens
gaugguugguacuguguuu

SEQ ID NO: 1203951 - RNA, 19 nt, Homo sapiens
acaaacaagaguacacuua

SEQ ID NO: 1203952 - RNA, 19 nt, Homo sapiens
gauccaagauacacaacug

SEQ ID NO: 1203953 - RNA, 19 nt, Homo sapiens
ucucauaccauuuggauaa

SEQ ID NO: 1203954 - RNA, 19 nt, Homo sapiens
gggcugcucacaauuuaua

SEQ ID NO: 1203955 - RNA, 19 nt, Homo sapiens
guauacuucugcuuaaaug

SEQ ID NO: 1203956 - RNA, 19 nt, Homo sapiens
ccagaagaaugaauaugau

SEQ ID NO: 1203957 - RNA, 19 nt, Homo sapiens
gaaacggaaauuagacuau

SEQ ID NO: 1203958 - RNA, 19 nt, Homo sapiens
agaacugaccuguuuauuu

SEQ ID NO: 1203959 - RNA, 19 nt, Homo sapiens
caacuuggccacagaaaca

SEQ ID NO: 1203960 - RNA, 19 nt, Homo sapiens
caggacagcugugauugaa

SEQ ID NO: 1203961 - RNA, 19 nt, Homo sapiens
gugaaccuauguacuaaug

SEQ ID NO: 1203962 - RNA, 19 nt, Homo sapiens
cuaauaacaucaucucucu

SEQ ID NO: 1203963 - RNA, 19 nt, Homo sapiens
gcaaagaugggucucauac

SEQ ID NO: 1203964 - RNA, 19 nt, Homo sapiens
gaugaugaacuacaugcua

SEQ ID NO: 1203965 - RNA, 19 nt, Homo sapiens
gauucaauaugcaaacaug

SEQ ID NO: 1203966 - RNA, 19 nt, Homo sapiens
gaaguccaguuugauuuca

SEQ ID NO: 1203967 - RNA, 19 nt, Homo sapiens
uggcaaugcuguuaaagga

SEQ ID NO: 1203968 - RNA, 19 nt, Homo sapiens
gagcugaaguggucuacag

SEQ ID NO: 1203969 - RNA, 19 nt, Homo sapiens
cuacguagaaguguaauaa

SEQ ID NO: 1203970 - RNA, 19 nt, Homo sapiens
uuguagaacugaccuguuu

SEQ ID NO: 1203971 - RNA, 19 nt, Homo sapiens
gaauugguaucuguaguag

SEQ ID NO: 1203972 - RNA, 19 nt, Homo sapiens
gagacaauguauuucaaag

SEQ ID NO: 1203973 - RNA, 19 nt, Homo sapiens
ggaccaaggcauagauguu

SEQ ID NO: 1203974 - RNA, 19 nt, Homo sapiens
gaaggaagaaauucacaca

SEQ ID NO: 1203975 - RNA, 19 nt, Homo sapiens
gagaaguccuuuuguuuug

SEQ ID NO: 1203976 - RNA, 19 nt, Homo sapiens
ggaaacggaaauuagacua

SEQ ID NO: 1203977 - RNA, 19 nt, Homo sapiens
gaccgagaguccagcauuu

SEQ ID NO: 1203978 - RNA, 19 nt, Homo sapiens
gcacuugucuaggauggaa

SEQ ID NO: 1203979 - RNA, 19 nt, Homo sapiens
gagacuacaucaccuacug

SEQ ID NO: 1203980 - RNA, 19 nt, Homo sapiens
caaccugcccugcguguuu

SEQ ID NO: 1203981 - RNA, 19 nt, Homo sapiens
caugugaagugcuugcaaa

SEQ ID NO: 1203982 - RNA, 19 nt, Homo sapiens
gaucaaggcacagcaguga

SEQ ID NO: 1203983 - RNA, 19 nt, Homo sapiens
gagagaggcuguugaugcu

SEQ ID NO: 1203984 - RNA, 19 nt, Homo sapiens
ugucugcucuguucaguga

SEQ ID NO: 1203985 - RNA, 19 nt, Homo sapiens
caacauguggcgcuucuug

SEQ ID NO: 1203986 - RNA, 19 nt, Homo sapiens
cuacaucaccuacuggaaa

SEQ ID NO: 1203987 - RNA, 19 nt, Homo sapiens
ugaaucaugugaagugcuu

SEQ ID NO: 1203988 - RNA, 19 nt, Homo sapiens
ccgacuggcugaaugaguu

SEQ ID NO: 1203989 - RNA, 19 nt, Homo sapiens
cgacuucgaccaccugcua

SEQ ID NO: 1203990 - RNA, 19 nt, Homo sapiens
cagcuggucugucaauguc

SEQ ID NO: 1203991 - RNA, 19 nt, Homo sapiens
guuccaugcugacaucuuc

SEQ ID NO: 1203992 - RNA, 19 nt, Homo sapiens
guggaugacuaccgcuuug

SEQ ID NO: 1203993 - RNA, 19 nt, Homo sapiens
ucugguggcuccucuuaau

SEQ ID NO: 1203994 - RNA, 19 nt, Homo sapiens
gaugggauguggcccuucu

SEQ ID NO: 1203995 - RNA, 19 nt, Homo sapiens
ucaaggucaucgcugagaa

SEQ ID NO: 1203996 - RNA, 19 nt, Homo sapiens
guucugggaugcacuggau

SEQ ID NO: 1203997 - RNA, 19 nt, Homo sapiens
cuacggagacgugguugua

SEQ ID NO: 1203998 - RNA, 19 nt, Homo sapiens
gcacgugccauggcuaugu

SEQ ID NO: 1203999 - RNA, 19 nt, Homo sapiens
ccugaacccucuaguggau

SEQ ID NO: 1204000 - RNA, 19 nt, Homo sapiens
gcaccugucgugaggauag

SEQ ID NO: 1204001 - RNA, 19 nt, Homo sapiens
ccucaaagacuggcacuug

SEQ ID NO: 1204002 - RNA, 19 nt, Homo sapiens
cacgugccauggcuaugua

SEQ ID NO: 1204003 - RNA, 19 nt, Homo sapiens
ugccauggcuauguacauu

SEQ ID NO: 1204004 - RNA, 19 nt, Homo sapiens
ccaccucccugccuuugca

SEQ ID NO: 1204005 - RNA, 19 nt, Homo sapiens
gcucugcccuguggguuca

SEQ ID NO: 1204006 - RNA, 19 nt, Homo sapiens
gcuucaaccuggccaacau

SEQ ID NO: 1204007 - RNA, 19 nt, Homo sapiens
cacuggauguggaugacua

SEQ ID NO: 1204008 - RNA, 19 nt, Homo sapiens
gcugagagaggcuguugau

SEQ ID NO: 1204009 - RNA, 19 nt, Homo sapiens
cgggcgagaugguguuugu

SEQ ID NO: 1204010 - RNA, 19 nt, Homo sapiens
ucagagacuacaucaccua

SEQ ID NO: 1204011 - RNA, 19 nt, Homo sapiens
ugaccgagaguccagcauu

SEQ ID NO: 1204012 - RNA, 19 nt, Homo sapiens
aaucccaucugcugcugaa

SEQ ID NO: 1204013 - RNA, 19 nt, Homo sapiens
aaccacaacugggucaaug

SEQ ID NO: 1204014 - RNA, 19 nt, Homo sapiens
ggaggaggcauccgaaucc

SEQ ID NO: 1204015 - RNA, 19 nt, Homo sapiens
gggaggaggcauccgaauc

SEQ ID NO: 1204016 - RNA, 19 nt, Homo sapiens
gugaugggcuguggaacca

SEQ ID NO: 1204017 - RNA, 19 nt, Homo sapiens
ggugcuggccuccuugguu

SEQ ID NO: 1204018 - RNA, 19 nt, Homo sapiens
gaccuacggagacgugguu

SEQ ID NO: 1204019 - RNA, 19 nt, Homo sapiens
ggacaccagcgcguucuca

SEQ ID NO: 1204020 - RNA, 19 nt, Homo sapiens
cucaaagacuggcacuugu

SEQ ID NO: 1204021 - RNA, 19 nt, Homo sapiens
guuucugucugcucuguuc

SEQ ID NO: 1204022 - RNA, 19 nt, Homo sapiens
ucucugguggcuccucuua

SEQ ID NO: 1204023 - RNA, 19 nt, Homo sapiens
cagugaaucaugugaagug

SEQ ID NO: 1204024 - RNA, 19 nt, Homo sapiens
uagcaccugucgugaggau

SEQ ID NO: 1204025 - RNA, 19 nt, Homo sapiens
ucaaagacuggcacuugug

SEQ ID NO: 1204026 - RNA, 19 nt, Homo sapiens
gcuggcacuugucuaggau

SEQ ID NO: 1204027 - RNA, 19 nt, Homo sapiens
ccacugccaggucaucaug

SEQ ID NO: 1204028 - RNA, 19 nt, Homo sapiens
uacaucaccuacuggaaag

SEQ ID NO: 1204029 - RNA, 19 nt, Homo sapiens
ccaucuccaucaaccacaa

SEQ ID NO: 1204030 - RNA, 19 nt, Homo sapiens
ccauggcuauguacauugc

SEQ ID NO: 1204031 - RNA, 19 nt, Homo sapiens
ggcccacccuuggagauca

SEQ ID NO: 1204032 - RNA, 19 nt, Homo sapiens
ugacuaccgcuuugucuac

SEQ ID NO: 1204033 - RNA, 19 nt, Homo sapiens
gaaggaagaucacuuaagg

SEQ ID NO: 1204034 - RNA, 19 nt, Homo sapiens
ggaggaagaugaagaggaa

SEQ ID NO: 1204035 - RNA, 19 nt, Homo sapiens
ugacgcaucucaaggaaua

SEQ ID NO: 1204036 - RNA, 19 nt, Homo sapiens
ugaagaaccugaagaggaa

SEQ ID NO: 1204037 - RNA, 19 nt, Homo sapiens
ggagaaggcaggcaaauau

SEQ ID NO: 1204038 - RNA, 19 nt, Homo sapiens
guaaggaagucgucccauu

SEQ ID NO: 1204039 - RNA, 19 nt, Homo sapiens
gaaguacaauuuccguuuc

SEQ ID NO: 1204040 - RNA, 19 nt, Homo sapiens
gaacagaaguacaauuucc

SEQ ID NO: 1204041 - RNA, 19 nt, Homo sapiens
gaacccagauucccugaag

SEQ ID NO: 1204042 - RNA, 19 nt, Homo sapiens
gagaagcugcggaaaguaa

SEQ ID NO: 1204043 - RNA, 19 nt, Homo sapiens
gaagaaacaggaggacuuu

SEQ ID NO: 1204044 - RNA, 19 nt, Homo sapiens
agaaacagcucaaggaaag

SEQ ID NO: 1204045 - RNA, 19 nt, Homo sapiens
gaaagaugccaccuucuau

SEQ ID NO: 1204046 - RNA, 19 nt, Homo sapiens
aaacugaggcugacuuaaa

SEQ ID NO: 1204047 - RNA, 19 nt, Homo sapiens
ggaaacugaggcugacuua

SEQ ID NO: 1204048 - RNA, 19 nt, Homo sapiens
gaacgacccugaguuggau

SEQ ID NO: 1204049 - RNA, 19 nt, Homo sapiens
ggaagguuaucuuggagaa

SEQ ID NO: 1204050 - RNA, 19 nt, Homo sapiens
ccauguaccugaaggacua

SEQ ID NO: 1204051 - RNA, 19 nt, Homo sapiens
gaacagcaucgucaucaga

SEQ ID NO: 1204052 - RNA, 19 nt, Homo sapiens
uaaagaagaccugcaugua

SEQ ID NO: 1204053 - RNA, 19 nt, Homo sapiens
agacaucgucgcaaaguua

SEQ ID NO: 1204054 - RNA, 19 nt, Homo sapiens
gaggagaagccacaauuug

SEQ ID NO: 1204055 - RNA, 19 nt, Homo sapiens
ggacgacuccucagacgaa

SEQ ID NO: 1204056 - RNA, 19 nt, Homo sapiens
ugaaggaacugacgcaucu

SEQ ID NO: 1204057 - RNA, 19 nt, Homo sapiens
aggaguaccuggaugagua

SEQ ID NO: 1204058 - RNA, 19 nt, Homo sapiens
gaaaggagaagagggaaga

SEQ ID NO: 1204059 - RNA, 19 nt, Homo sapiens
gcaaaguuauguggaggaa

SEQ ID NO: 1204060 - RNA, 19 nt, Homo sapiens
uaaggaagucgucccauuu

SEQ ID NO: 1204061 - RNA, 19 nt, Homo sapiens
cuacagagagcuaugauug

SEQ ID NO: 1204062 - RNA, 19 nt, Homo sapiens
gauccucgcugcugacgau

SEQ ID NO: 1204063 - RNA, 19 nt, Homo sapiens
ggaggagaagccacaauuu

SEQ ID NO: 1204064 - RNA, 19 nt, Homo sapiens
gaugccaccuucuauaaca

SEQ ID NO: 1204065 - RNA, 19 nt, Homo sapiens
acaagacguucgaggagua

SEQ ID NO: 1204066 - RNA, 19 nt, Homo sapiens
gaaagaagagggagaaagc

SEQ ID NO: 1204067 - RNA, 19 nt, Homo sapiens
gaaacaggaggacuuugaa

SEQ ID NO: 1204068 - RNA, 19 nt, Homo sapiens
caggagacaucgucgcaaa

SEQ ID NO: 1204069 - RNA, 19 nt, Homo sapiens
gaagggacagaaagagauu

SEQ ID NO: 1204070 - RNA, 19 nt, Homo sapiens
gaaggcaggcaaauauguu

SEQ ID NO: 1204071 - RNA, 19 nt, Homo sapiens
caaguuacacagcuuuauu

SEQ ID NO: 1204072 - RNA, 19 nt, Homo sapiens
ggaaauggaggaagagaag

SEQ ID NO: 1204073 - RNA, 19 nt, Homo sapiens
ggaacgacccugaguugga

SEQ ID NO: 1204074 - RNA, 19 nt, Homo sapiens
aaaguuauguggaggaaca

SEQ ID NO: 1204075 - RNA, 19 nt, Homo sapiens
agaggaagguuaucuugga

SEQ ID NO: 1204076 - RNA, 19 nt, Homo sapiens
gaccagcgugggcaacuua

SEQ ID NO: 1204077 - RNA, 19 nt, Homo sapiens
aagaagaccugcauguaca

SEQ ID NO: 1204078 - RNA, 19 nt, Homo sapiens
aaagaugccaccuucuaua

SEQ ID NO: 1204079 - RNA, 19 nt, Homo sapiens
gcccagaacucauggaaaa

SEQ ID NO: 1204080 - RNA, 19 nt, Homo sapiens
ggaagaagaagggcuugaa

SEQ ID NO: 1204081 - RNA, 19 nt, Homo sapiens
ggaggaggccgacuacauc

SEQ ID NO: 1204082 - RNA, 19 nt, Homo sapiens
aagaggaaauggaggaaga

SEQ ID NO: 1204083 - RNA, 19 nt, Homo sapiens
caacauggacgccgacuac

SEQ ID NO: 1204084 - RNA, 19 nt, Homo sapiens
gaucaaguuacacagcuuu

SEQ ID NO: 1204085 - RNA, 19 nt, Homo sapiens
ggaaggaagaucacuuaag

SEQ ID NO: 1204086 - RNA, 19 nt, Homo sapiens
gaccugcccugucgcuuca

SEQ ID NO: 1204087 - RNA, 19 nt, Homo sapiens
gagacaucgucgcaaaguu

SEQ ID NO: 1204088 - RNA, 19 nt, Homo sapiens
uuauggauguggaaacuga

SEQ ID NO: 1204089 - RNA, 19 nt, Homo sapiens
ggagaagcccguguucgaa

SEQ ID NO: 1204090 - RNA, 19 nt, Homo sapiens
ggaggacuuugaacagaag

SEQ ID NO: 1204091 - RNA, 19 nt, Homo sapiens
caggaggacuuugaacaga

SEQ ID NO: 1204092 - RNA, 19 nt, Homo sapiens
gcgacgagcgcguggaauu

SEQ ID NO: 1204093 - RNA, 19 nt, Homo sapiens
ggacuacgaggacaucauc

SEQ ID NO: 1204094 - RNA, 19 nt, Homo sapiens
ucaagcagcugaagaaccu

SEQ ID NO: 1204095 - RNA, 19 nt, Homo sapiens
gaagaagaagggcuugaag

SEQ ID NO: 1204096 - RNA, 19 nt, Homo sapiens
agaaacaggaggacuuuga

SEQ ID NO: 1204097 - RNA, 19 nt, Homo sapiens
gcuaugaggaggaggaaga

SEQ ID NO: 1204098 - RNA, 19 nt, Homo sapiens
gcaggcaaauauguugaug

SEQ ID NO: 1204099 - RNA, 19 nt, Homo sapiens
cacccgacaugacauaaau

SEQ ID NO: 1204100 - RNA, 19 nt, Homo sapiens
gaagagggagaaagcaaag

SEQ ID NO: 1204101 - RNA, 19 nt, Homo sapiens
agaaguacaauuuccguuu

SEQ ID NO: 1204102 - RNA, 19 nt, Homo sapiens
gagaaggcaggcaaauaug

SEQ ID NO: 1204103 - RNA, 19 nt, Homo sapiens
ccacacccgacaugacaua

SEQ ID NO: 1204104 - RNA, 19 nt, Homo sapiens
caacuuagcgagacuccau

SEQ ID NO: 1204105 - RNA, 19 nt, Homo sapiens
uggagaagcugcggaaagu

SEQ ID NO: 1204106 - RNA, 19 nt, Homo sapiens
aagaugccaccuucuauaa

SEQ ID NO: 1204107 - RNA, 19 nt, Homo sapiens
cagaaacagcucaaggaaa

SEQ ID NO: 1204108 - RNA, 19 nt, Homo sapiens
ccacacccacgaucaaguu

SEQ ID NO: 1204109 - RNA, 19 nt, Homo sapiens
gaaacugaggcugacuuaa

SEQ ID NO: 1204110 - RNA, 19 nt, Homo sapiens
gcaagaagaagcgcaaguc

SEQ ID NO: 1204111 - RNA, 19 nt, Homo sapiens
ugaagaaacaggaggacuu

SEQ ID NO: 1204112 - RNA, 19 nt, Homo sapiens
gagauucggaacccagauu

SEQ ID NO: 1204113 - RNA, 19 nt, Homo sapiens
gaaagcuuccgggcauuug

SEQ ID NO: 1204114 - RNA, 19 nt, Homo sapiens
acagagagcuaugauugca

SEQ ID NO: 1204115 - RNA, 19 nt, Homo sapiens
guaccuggaugaguauuac

SEQ ID NO: 1204116 - RNA, 19 nt, Homo sapiens
gaagccacaauuugaggaa

SEQ ID NO: 1204117 - RNA, 19 nt, Homo sapiens
ggagaagccacaauuugag

SEQ ID NO: 1204118 - RNA, 19 nt, Homo sapiens
cgagaggaagguuaucuug

SEQ ID NO: 1204119 - RNA, 19 nt, Homo sapiens
ucacuugagcccaggaauu

SEQ ID NO: 1204120 - RNA, 19 nt, Homo sapiens
ccagaaggcccagaacuca

SEQ ID NO: 1204121 - RNA, 19 nt, Homo sapiens
aaagaagaccugcauguac

SEQ ID NO: 1204122 - RNA, 19 nt, Homo sapiens
aggagaagccacaauuuga

SEQ ID NO: 1204123 - RNA, 19 nt, Homo sapiens
aagcaaagaagcaggaaga

SEQ ID NO: 1204124 - RNA, 19 nt, Homo sapiens
cgacgagcgcguggaauuu

SEQ ID NO: 1204125 - RNA, 19 nt, Homo sapiens
ggaggaagaggaggaggaa

SEQ ID NO: 1204126 - RNA, 19 nt, Homo sapiens
gggcugacaacaggaagua

SEQ ID NO: 1204127 - RNA, 19 nt, Homo sapiens
ucacuuaaggccaugaguu

SEQ ID NO: 1204128 - RNA, 19 nt, Homo sapiens
ggucucgcacccacaagua

SEQ ID NO: 1204129 - RNA, 19 nt, Homo sapiens
ggaagccacagagagauga

SEQ ID NO: 1204130 - RNA, 19 nt, Homo sapiens
cuaaagaagaccugcaugu

SEQ ID NO: 1204131 - RNA, 19 nt, Homo sapiens
ggagaagcugcggaaagua

SEQ ID NO: 1204132 - RNA, 19 nt, Homo sapiens
guaaggaugagcgcagaaa

SEQ ID NO: 1204133 - RNA, 19 nt, Homo sapiens
caagaagccuuucaaauug

SEQ ID NO: 1204134 - RNA, 19 nt, Homo sapiens
gaauaaaugucgucccuuu

SEQ ID NO: 1204135 - RNA, 19 nt, Homo sapiens
gaaaagcaauggagacuua

SEQ ID NO: 1204136 - RNA, 19 nt, Homo sapiens
gcaggugggugaucucuaa

SEQ ID NO: 1204137 - RNA, 19 nt, Homo sapiens
ucaagaagccuuucaaauu

SEQ ID NO: 1204138 - RNA, 19 nt, Homo sapiens
ccaagaagaagaagaaauu

SEQ ID NO: 1204139 - RNA, 19 nt, Homo sapiens
caaguuagguuagugaugu

SEQ ID NO: 1204140 - RNA, 19 nt, Homo sapiens
ggaggucuguaaugugaaa

SEQ ID NO: 1204141 - RNA, 19 nt, Homo sapiens
gcgcugagcagaaugagua

SEQ ID NO: 1204142 - RNA, 19 nt, Homo sapiens
ccaaaucccugagccagaa

SEQ ID NO: 1204143 - RNA, 19 nt, Homo sapiens
cagaaugaguagcuaggua

SEQ ID NO: 1204144 - RNA, 19 nt, Homo sapiens
ccuuacagcuucccaaguu

SEQ ID NO: 1204145 - RNA, 19 nt, Homo sapiens
ggagaauggccacgugaaa

SEQ ID NO: 1204146 - RNA, 19 nt, Homo sapiens
ccaucugguucuccucuua

SEQ ID NO: 1204147 - RNA, 19 nt, Homo sapiens
aaacugugcuguccuugug

SEQ ID NO: 1204148 - RNA, 19 nt, Homo sapiens
cgagggcacugcucaggaa

SEQ ID NO: 1204149 - RNA, 19 nt, Homo sapiens
aguugaagauggucccuua

SEQ ID NO: 1204150 - RNA, 19 nt, Homo sapiens
auaaggcaguuguugguuu

SEQ ID NO: 1204151 - RNA, 19 nt, Homo sapiens
gaaucaacugugucucuuu

SEQ ID NO: 1204152 - RNA, 19 nt, Homo sapiens
ccacuguuguaaauaacuu

SEQ ID NO: 1204153 - RNA, 19 nt, Homo sapiens
ccaaguagguuuuguuuac

SEQ ID NO: 1204154 - RNA, 19 nt, Homo sapiens
ggccuguccuucaagagaa

SEQ ID NO: 1204155 - RNA, 19 nt, Homo sapiens
ggggaggucuguaauguga

SEQ ID NO: 1204156 - RNA, 19 nt, Homo sapiens
ugaaucaacugugucucuu

SEQ ID NO: 1204157 - RNA, 19 nt, Homo sapiens
gcauaaggcaguuguuggu

SEQ ID NO: 1204158 - RNA, 19 nt, Homo sapiens
cuuacagcuucccaaguua

SEQ ID NO: 1204159 - RNA, 19 nt, Homo sapiens
ucaaaccuccagccuguga

SEQ ID NO: 1204160 - RNA, 19 nt, Homo sapiens
uuagguuagugaugugaaa

SEQ ID NO: 1204161 - RNA, 19 nt, Homo sapiens
ggugaucucuaagcugcaa

SEQ ID NO: 1204162 - RNA, 19 nt, Homo sapiens
cucccacuguuguaaauaa

SEQ ID NO: 1204163 - RNA, 19 nt, Homo sapiens
ggucuguaaugugaaacaa

SEQ ID NO: 1204164 - RNA, 19 nt, Homo sapiens
uaaggcaguuguugguuuu

SEQ ID NO: 1204165 - RNA, 19 nt, Homo sapiens
gaaguggggugcuuauacu

SEQ ID NO: 1204166 - RNA, 19 nt, Homo sapiens
ugagcggccuguccuucaa

SEQ ID NO: 1204167 - RNA, 19 nt, Homo sapiens
ugaagauggucccuuacag

SEQ ID NO: 1204168 - RNA, 19 nt, Homo sapiens
uagugcagccucagaagaa

SEQ ID NO: 1204169 - RNA, 19 nt, Homo sapiens
caagaagaagaagaaauuc

SEQ ID NO: 1204170 - RNA, 19 nt, Homo sapiens
caucugguucuccucuuaa

SEQ ID NO: 1204171 - RNA, 19 nt, Homo sapiens
aaucaacugugucucuuuu

SEQ ID NO: 1204172 - RNA, 19 nt, Homo sapiens
ugagcagaaugaguagcua

SEQ ID NO: 1204173 - RNA, 19 nt, Homo sapiens
ucuguaaugugaaacaacu

SEQ ID NO: 1204174 - RNA, 19 nt, Homo sapiens
gccuguccuucaagagaaa

SEQ ID NO: 1204175 - RNA, 19 nt, Homo sapiens
gagaauggccacgugaaaa

SEQ ID NO: 1204176 - RNA, 19 nt, Homo sapiens
aaugugaaacaacuucuug

SEQ ID NO: 1204177 - RNA, 19 nt, Homo sapiens
gugaaucaacugugucucu

SEQ ID NO: 1204178 - RNA, 19 nt, Homo sapiens
gccugugaaucaacugugu

SEQ ID NO: 1204179 - RNA, 19 nt, Homo sapiens
gcuuauacucccaaaccuu

SEQ ID NO: 1204180 - RNA, 19 nt, Homo sapiens
ccucuuaaggccaguugaa

SEQ ID NO: 1204181 - RNA, 19 nt, Homo sapiens
ccaauucuuuuccaaguag

SEQ ID NO: 1204182 - RNA, 19 nt, Homo sapiens
ccaaguuagguuagugaug

SEQ ID NO: 1204183 - RNA, 19 nt, Homo sapiens
ggugggugaucucuaagcu

SEQ ID NO: 1204184 - RNA, 19 nt, Homo sapiens
gaucagagguucagaauug

SEQ ID NO: 1204185 - RNA, 19 nt, Homo sapiens
gagcauacaucaacuuuaa

SEQ ID NO: 1204186 - RNA, 19 nt, Homo sapiens
caagagagaucgaauaaga

SEQ ID NO: 1204187 - RNA, 19 nt, Homo sapiens
gagcuuagcguaaagaaua

SEQ ID NO: 1204188 - RNA, 19 nt, Homo sapiens
gaacacacuuucguugaua

SEQ ID NO: 1204189 - RNA, 19 nt, Homo sapiens
ggagagaaauagaaagaaa

SEQ ID NO: 1204190 - RNA, 19 nt, Homo sapiens
gaugauaaguguugacauu

SEQ ID NO: 1204191 - RNA, 19 nt, Homo sapiens
gaaaggaggaggagagaaa

SEQ ID NO: 1204192 - RNA, 19 nt, Homo sapiens
caauaaaggucaggaauau

SEQ ID NO: 1204193 - RNA, 19 nt, Homo sapiens
gaguaagucuugugucaaa

SEQ ID NO: 1204194 - RNA, 19 nt, Homo sapiens
gaagauuaccucccacuuu

SEQ ID NO: 1204195 - RNA, 19 nt, Homo sapiens
gaaagaaggcugaaaguac

SEQ ID NO: 1204196 - RNA, 19 nt, Homo sapiens
ggaauaucccgcuauagua

SEQ ID NO: 1204197 - RNA, 19 nt, Homo sapiens
aguaagagcugguucuaaa

SEQ ID NO: 1204198 - RNA, 19 nt, Homo sapiens
gcgcauacuucgagaaaga

SEQ ID NO: 1204199 - RNA, 19 nt, Homo sapiens
gaaagugguauuagccaua

SEQ ID NO: 1204200 - RNA, 19 nt, Homo sapiens
ggaaagaaggcugaaagua

SEQ ID NO: 1204201 - RNA, 19 nt, Homo sapiens
agauuaagcugcucaagaa

SEQ ID NO: 1204202 - RNA, 19 nt, Homo sapiens
caaagagaccugaagauga

SEQ ID NO: 1204203 - RNA, 19 nt, Homo sapiens
gaaaagagauaccaaaguc

SEQ ID NO: 1204204 - RNA, 19 nt, Homo sapiens
uauaugagcuuagcguaaa

SEQ ID NO: 1204205 - RNA, 19 nt, Homo sapiens
gaaaguacagaaucaauag

SEQ ID NO: 1204206 - RNA, 19 nt, Homo sapiens
gaaucucagugaugaaaga

SEQ ID NO: 1204207 - RNA, 19 nt, Homo sapiens
gaaauuggacaaagagaau

SEQ ID NO: 1204208 - RNA, 19 nt, Homo sapiens
gaagagaggaggaaaugga

SEQ ID NO: 1204209 - RNA, 19 nt, Homo sapiens
ucaggaauaucccgcuaua

SEQ ID NO: 1204210 - RNA, 19 nt, Homo sapiens
guccagcgaugcagcuuua

SEQ ID NO: 1204211 - RNA, 19 nt, Homo sapiens
gagcacacguuaagcaauc

SEQ ID NO: 1204212 - RNA, 19 nt, Homo sapiens
aaagaaggcugaaaguaca

SEQ ID NO: 1204213 - RNA, 19 nt, Homo sapiens
gcaacaaggagaagaaaga

SEQ ID NO: 1204214 - RNA, 19 nt, Homo sapiens
gacauuggguaguguagaa

SEQ ID NO: 1204215 - RNA, 19 nt, Homo sapiens
ggaaaguuaugccacagau

SEQ ID NO: 1204216 - RNA, 19 nt, Homo sapiens
gaaggagcgcuaugagaaa

SEQ ID NO: 1204217 - RNA, 19 nt, Homo sapiens
aaagagaccugaagaugag

SEQ ID NO: 1204218 - RNA, 19 nt, Homo sapiens
ccagaaagggacaaauuaa

SEQ ID NO: 1204219 - RNA, 19 nt, Homo sapiens
ggaaauggaaagaagaaga

SEQ ID NO: 1204220 - RNA, 19 nt, Homo sapiens
aagauuaccucccacuuug

SEQ ID NO: 1204221 - RNA, 19 nt, Homo sapiens
ggacguagccaugaaggaa

SEQ ID NO: 1204222 - RNA, 19 nt, Homo sapiens
gaaagaagaagagaaacga

SEQ ID NO: 1204223 - RNA, 19 nt, Homo sapiens
ccaaagagcacacguuaag

SEQ ID NO: 1204224 - RNA, 19 nt, Homo sapiens
gaggagagaaauagaaaga

SEQ ID NO: 1204225 - RNA, 19 nt, Homo sapiens
ggcaaagaauagagagaaa

SEQ ID NO: 1204226 - RNA, 19 nt, Homo sapiens
gaaaguuaugccacagaua

SEQ ID NO: 1204227 - RNA, 19 nt, Homo sapiens
gcagaaaggaagcaggaaa

SEQ ID NO: 1204228 - RNA, 19 nt, Homo sapiens
caccaagucuggagauuca

SEQ ID NO: 1204229 - RNA, 19 nt, Homo sapiens
ggucaagagagaucgaaua

SEQ ID NO: 1204230 - RNA, 19 nt, Homo sapiens
gaagauagacagaauucca

SEQ ID NO: 1204231 - RNA, 19 nt, Homo sapiens
gaauaucccgcuauaguag

SEQ ID NO: 1204232 - RNA, 19 nt, Homo sapiens
ccuguuaaauagcaacuuu

SEQ ID NO: 1204233 - RNA, 19 nt, Homo sapiens
ugucaaagcaggaaucuga

SEQ ID NO: 1204234 - RNA, 19 nt, Homo sapiens
auagcgaacuuaaagauga

SEQ ID NO: 1204235 - RNA, 19 nt, Homo sapiens
acaauaaaggucaggaaua

SEQ ID NO: 1204236 - RNA, 19 nt, Homo sapiens
gggaucgcuuugaugguua

SEQ ID NO: 1204237 - RNA, 19 nt, Homo sapiens
guuccgaucuaauucuauu

SEQ ID NO: 1204238 - RNA, 19 nt, Homo sapiens
ucaauaggcagcucagaaa

SEQ ID NO: 1204239 - RNA, 19 nt, Homo sapiens
ggagcagagucgcuuugaa

SEQ ID NO: 1204240 - RNA, 19 nt, Homo sapiens
gcacaggccuaaggagaag

SEQ ID NO: 1204241 - RNA, 19 nt, Homo sapiens
ccaaagagaccugaagaug

SEQ ID NO: 1204242 - RNA, 19 nt, Homo sapiens
cagaaagggacaaauuaaa

SEQ ID NO: 1204243 - RNA, 19 nt, Homo sapiens
gaagaagagaggaggaaau

SEQ ID NO: 1204244 - RNA, 19 nt, Homo sapiens
cgaugaugauccagaauau

SEQ ID NO: 1204245 - RNA, 19 nt, Homo sapiens
gcaggaaagugguauuagc

SEQ ID NO: 1204246 - RNA, 19 nt, Homo sapiens
gaaagaagaaguggucaag

SEQ ID NO: 1204247 - RNA, 19 nt, Homo sapiens
gagcgcauacuucgagaaa

SEQ ID NO: 1204248 - RNA, 19 nt, Homo sapiens
uagaggaaauagaagcaaa

SEQ ID NO: 1204249 - RNA, 19 nt, Homo sapiens
agucucagcuuguuucguu

SEQ ID NO: 1204250 - RNA, 19 nt, Homo sapiens
gauagaacacacuuucguu

SEQ ID NO: 1204251 - RNA, 19 nt, Homo sapiens
gucaagagagaucgaauaa

SEQ ID NO: 1204252 - RNA, 19 nt, Homo sapiens
gggacaaauuaaaggauga

SEQ ID NO: 1204253 - RNA, 19 nt, Homo sapiens
gaaagggacaaauuaaagg

SEQ ID NO: 1204254 - RNA, 19 nt, Homo sapiens
guucagggaucgcuuugau

SEQ ID NO: 1204255 - RNA, 19 nt, Homo sapiens
gaguuuguauccucauaug

SEQ ID NO: 1204256 - RNA, 19 nt, Homo sapiens
ugccugagcaugauuauuu

SEQ ID NO: 1204257 - RNA, 19 nt, Homo sapiens
acacuuucguugauacaaa

SEQ ID NO: 1204258 - RNA, 19 nt, Homo sapiens
gagcagagucgcuuugaag

SEQ ID NO: 1204259 - RNA, 19 nt, Homo sapiens
agaaggagcgcuaugagaa

SEQ ID NO: 1204260 - RNA, 19 nt, Homo sapiens
gaucaggagcgcauacuuc

SEQ ID NO: 1204261 - RNA, 19 nt, Homo sapiens
aaggaugaaccaaagauua

SEQ ID NO: 1204262 - RNA, 19 nt, Homo sapiens
gaaauggaaagaagaagag

SEQ ID NO: 1204263 - RNA, 19 nt, Homo sapiens
gaggaaauggaaagaagaa

SEQ ID NO: 1204264 - RNA, 19 nt, Homo sapiens
aggaacaucuucaaccuau

SEQ ID NO: 1204265 - RNA, 19 nt, Homo sapiens
aaaccaagaggacauuauu

SEQ ID NO: 1204266 - RNA, 19 nt, Homo sapiens
gaaaggaagcaggaaagug

SEQ ID NO: 1204267 - RNA, 19 nt, Homo sapiens
aaagacacacuucgggaua

SEQ ID NO: 1204268 - RNA, 19 nt, Homo sapiens
gaaagagccagugggcaaa

SEQ ID NO: 1204269 - RNA, 19 nt, Homo sapiens
gauccagaauauagaaagu

SEQ ID NO: 1204270 - RNA, 19 nt, Homo sapiens
uaguagaauuugcaccuuu

SEQ ID NO: 1204271 - RNA, 19 nt, Homo sapiens
ggagugauaaguccagaug

SEQ ID NO: 1204272 - RNA, 19 nt, Homo sapiens
guuuguauccucauaugua

SEQ ID NO: 1204273 - RNA, 19 nt, Homo sapiens
agacagaauuccagaaagg

SEQ ID NO: 1204274 - RNA, 19 nt, Homo sapiens
gcagagaaugagagaagaa

SEQ ID NO: 1204275 - RNA, 19 nt, Homo sapiens
aagaagaaguggucaagag

SEQ ID NO: 1204276 - RNA, 19 nt, Homo sapiens
gaugaugauccagaauaua

SEQ ID NO: 1204277 - RNA, 19 nt, Homo sapiens
ucgcuuugaugguuaugua

SEQ ID NO: 1204278 - RNA, 19 nt, Homo sapiens
ucacauaugacacgagaga

SEQ ID NO: 1204279 - RNA, 19 nt, Homo sapiens
agagagaucgaauaagaaa

SEQ ID NO: 1204280 - RNA, 19 nt, Homo sapiens
caacaaggagaagaaagaa

SEQ ID NO: 1204281 - RNA, 19 nt, Homo sapiens
gaggaggagagaaauagaa

SEQ ID NO: 1204282 - RNA, 19 nt, Homo sapiens
uaucgaugaugauccagaa

SEQ ID NO: 1204283 - RNA, 19 nt, Homo sapiens
gacaauccaguguguuuga

SEQ ID NO: 1204284 - RNA, 19 nt, Homo sapiens
gaucagagguucagaauug

SEQ ID NO: 1204285 - RNA, 19 nt, Homo sapiens
gagcauacaucaacuuuaa

SEQ ID NO: 1204286 - RNA, 19 nt, Homo sapiens
caagagagaucgaauaaga

SEQ ID NO: 1204287 - RNA, 19 nt, Homo sapiens
gagcuuagcguaaagaaua

SEQ ID NO: 1204288 - RNA, 19 nt, Homo sapiens
gaacacacuuucguugaua

SEQ ID NO: 1204289 - RNA, 19 nt, Homo sapiens
ggagagaaauagaaagaaa

SEQ ID NO: 1204290 - RNA, 19 nt, Homo sapiens
gaugauaaguguugacauu

SEQ ID NO: 1204291 - RNA, 19 nt, Homo sapiens
gaaaggaggaggagagaaa

SEQ ID NO: 1204292 - RNA, 19 nt, Homo sapiens
caauaaaggucaggaauau

SEQ ID NO: 1204293 - RNA, 19 nt, Homo sapiens
gaguaagucuugugucaaa

SEQ ID NO: 1204294 - RNA, 19 nt, Homo sapiens
gaagauuaccucccacuuu

SEQ ID NO: 1204295 - RNA, 19 nt, Homo sapiens
gaaagaaggcugaaaguac

SEQ ID NO: 1204296 - RNA, 19 nt, Homo sapiens
ggaauaucccgcuauagua

SEQ ID NO: 1204297 - RNA, 19 nt, Homo sapiens
aguaagagcugguucuaaa

SEQ ID NO: 1204298 - RNA, 19 nt, Homo sapiens
gcgcauacuucgagaaaga

SEQ ID NO: 1204299 - RNA, 19 nt, Homo sapiens
gaaagugguauuagccaua

SEQ ID NO: 1204300 - RNA, 19 nt, Homo sapiens
ggaaagaaggcugaaagua

SEQ ID NO: 1204301 - RNA, 19 nt, Homo sapiens
caaagagaccugaagauga

SEQ ID NO: 1204302 - RNA, 19 nt, Homo sapiens
gaaaagagauaccaaaguc

SEQ ID NO: 1204303 - RNA, 19 nt, Homo sapiens
uauaugagcuuagcguaaa

SEQ ID NO: 1204304 - RNA, 19 nt, Homo sapiens
gaaaguacagaaucaauag

SEQ ID NO: 1204305 - RNA, 19 nt, Homo sapiens
gaaucucagugaugaaaga

SEQ ID NO: 1204306 - RNA, 19 nt, Homo sapiens
gaaauuggacaaagagaau

SEQ ID NO: 1204307 - RNA, 19 nt, Homo sapiens
gaagagaggaggaaaugga

SEQ ID NO: 1204308 - RNA, 19 nt, Homo sapiens
ucaggaauaucccgcuaua

SEQ ID NO: 1204309 - RNA, 19 nt, Homo sapiens
guccagcgaugcagcuuua

SEQ ID NO: 1204310 - RNA, 19 nt, Homo sapiens
gagcacacguuaagcaauc

SEQ ID NO: 1204311 - RNA, 19 nt, Homo sapiens
aaagaaggcugaaaguaca

SEQ ID NO: 1204312 - RNA, 19 nt, Homo sapiens
gcaacaaggagaagaaaga

SEQ ID NO: 1204313 - RNA, 19 nt, Homo sapiens
gacauuggguaguguagaa

SEQ ID NO: 1204314 - RNA, 19 nt, Homo sapiens
ggaaaguuaugccacagau

SEQ ID NO: 1204315 - RNA, 19 nt, Homo sapiens
gaaggagcgcuaugagaaa

SEQ ID NO: 1204316 - RNA, 19 nt, Homo sapiens
aaagagaccugaagaugag

SEQ ID NO: 1204317 - RNA, 19 nt, Homo sapiens
ccagaaagggacaaauuaa

SEQ ID NO: 1204318 - RNA, 19 nt, Homo sapiens
ggaaauggaaagaagaaga

SEQ ID NO: 1204319 - RNA, 19 nt, Homo sapiens
aagauuaccucccacuuug

SEQ ID NO: 1204320 - RNA, 19 nt, Homo sapiens
ggacguagccaugaaggaa

SEQ ID NO: 1204321 - RNA, 19 nt, Homo sapiens
gaaagaagaagagaaacga

SEQ ID NO: 1204322 - RNA, 19 nt, Homo sapiens
ccaaagagcacacguuaag

SEQ ID NO: 1204323 - RNA, 19 nt, Homo sapiens
gaggagagaaauagaaaga

SEQ ID NO: 1204324 - RNA, 19 nt, Homo sapiens
ggcaaagaauagagagaaa

SEQ ID NO: 1204325 - RNA, 19 nt, Homo sapiens
gaaaguuaugccacagaua

SEQ ID NO: 1204326 - RNA, 19 nt, Homo sapiens
gcagaaaggaagcaggaaa

SEQ ID NO: 1204327 - RNA, 19 nt, Homo sapiens
caccaagucuggagauuca

SEQ ID NO: 1204328 - RNA, 19 nt, Homo sapiens
ggucaagagagaucgaaua

SEQ ID NO: 1204329 - RNA, 19 nt, Homo sapiens
gaagauagacagaauucca

SEQ ID NO: 1204330 - RNA, 19 nt, Homo sapiens
gaauaucccgcuauaguag

SEQ ID NO: 1204331 - RNA, 19 nt, Homo sapiens
ccuguuaaauagcaacuuu

SEQ ID NO: 1204332 - RNA, 19 nt, Homo sapiens
ugucaaagcaggaaucuga

SEQ ID NO: 1204333 - RNA, 19 nt, Homo sapiens
auagcgaacuuaaagauga

SEQ ID NO: 1204334 - RNA, 19 nt, Homo sapiens
acaauaaaggucaggaaua

SEQ ID NO: 1204335 - RNA, 19 nt, Homo sapiens
gggaucgcuuugaugguua

SEQ ID NO: 1204336 - RNA, 19 nt, Homo sapiens
guuccgaucuaauucuauu

SEQ ID NO: 1204337 - RNA, 19 nt, Homo sapiens
ucaauaggcagcucagaaa

SEQ ID NO: 1204338 - RNA, 19 nt, Homo sapiens
ggagcagagucgcuuugaa

SEQ ID NO: 1204339 - RNA, 19 nt, Homo sapiens
gcacaggccuaaggagaag

SEQ ID NO: 1204340 - RNA, 19 nt, Homo sapiens
ccaaagagaccugaagaug

SEQ ID NO: 1204341 - RNA, 19 nt, Homo sapiens
cagaaagggacaaauuaaa

SEQ ID NO: 1204342 - RNA, 19 nt, Homo sapiens
gaagaagagaggaggaaau

SEQ ID NO: 1204343 - RNA, 19 nt, Homo sapiens
cgaugaugauccagaauau

SEQ ID NO: 1204344 - RNA, 19 nt, Homo sapiens
gcaggaaagugguauuagc

SEQ ID NO: 1204345 - RNA, 19 nt, Homo sapiens
gaaagaagaaguggucaag

SEQ ID NO: 1204346 - RNA, 19 nt, Homo sapiens
gagcgcauacuucgagaaa

SEQ ID NO: 1204347 - RNA, 19 nt, Homo sapiens
uagaggaaauagaagcaaa

SEQ ID NO: 1204348 - RNA, 19 nt, Homo sapiens
agucucagcuuguuucguu

SEQ ID NO: 1204349 - RNA, 19 nt, Homo sapiens
gauagaacacacuuucguu

SEQ ID NO: 1204350 - RNA, 19 nt, Homo sapiens
gucaagagagaucgaauaa

SEQ ID NO: 1204351 - RNA, 19 nt, Homo sapiens
gggacaaauuaaaggauga

SEQ ID NO: 1204352 - RNA, 19 nt, Homo sapiens
gaaagggacaaauuaaagg

SEQ ID NO: 1204353 - RNA, 19 nt, Homo sapiens
guucagggaucgcuuugau

SEQ ID NO: 1204354 - RNA, 19 nt, Homo sapiens
gaguuuguauccucauaug

SEQ ID NO: 1204355 - RNA, 19 nt, Homo sapiens
ugccugagcaugauuauuu

SEQ ID NO: 1204356 - RNA, 19 nt, Homo sapiens
acacuuucguugauacaaa

SEQ ID NO: 1204357 - RNA, 19 nt, Homo sapiens
gagcagagucgcuuugaag

SEQ ID NO: 1204358 - RNA, 19 nt, Homo sapiens
agaaggagcgcuaugagaa

SEQ ID NO: 1204359 - RNA, 19 nt, Homo sapiens
gaucaggagcgcauacuuc

SEQ ID NO: 1204360 - RNA, 19 nt, Homo sapiens
aaggaugaaccaaagauua

SEQ ID NO: 1204361 - RNA, 19 nt, Homo sapiens
gaaauggaaagaagaagag

SEQ ID NO: 1204362 - RNA, 19 nt, Homo sapiens
gaggaaauggaaagaagaa

SEQ ID NO: 1204363 - RNA, 19 nt, Homo sapiens
aaaccaagaggacauuauu

SEQ ID NO: 1204364 - RNA, 19 nt, Homo sapiens
aggaacaucuucaaccuau

SEQ ID NO: 1204365 - RNA, 19 nt, Homo sapiens
gaaaggaagcaggaaagug

SEQ ID NO: 1204366 - RNA, 19 nt, Homo sapiens
aaagacacacuucgggaua

SEQ ID NO: 1204367 - RNA, 19 nt, Homo sapiens
gaaagagccagugggcaaa

SEQ ID NO: 1204368 - RNA, 19 nt, Homo sapiens
gauccagaauauagaaagu

SEQ ID NO: 1204369 - RNA, 19 nt, Homo sapiens
uaguagaauuugcaccuuu

SEQ ID NO: 1204370 - RNA, 19 nt, Homo sapiens
ggagugauaaguccagaug

SEQ ID NO: 1204371 - RNA, 19 nt, Homo sapiens
agacagaauuccagaaagg

SEQ ID NO: 1204372 - RNA, 19 nt, Homo sapiens
guuuguauccucauaugua

SEQ ID NO: 1204373 - RNA, 19 nt, Homo sapiens
gcagagaaugagagaagaa

SEQ ID NO: 1204374 - RNA, 19 nt, Homo sapiens
aagaagaaguggucaagag

SEQ ID NO: 1204375 - RNA, 19 nt, Homo sapiens
uacaagcugugaaucagaa

SEQ ID NO: 1204376 - RNA, 19 nt, Homo sapiens
aaccaaagauuaagguaca

SEQ ID NO: 1204377 - RNA, 19 nt, Homo sapiens
gaugaugauccagaauaua

SEQ ID NO: 1204378 - RNA, 19 nt, Homo sapiens
ucgcuuugaugguuaugua

SEQ ID NO: 1204379 - RNA, 19 nt, Homo sapiens
ucacauaugacacgagaga

SEQ ID NO: 1204380 - RNA, 19 nt, Homo sapiens
agagagaucgaauaagaaa

SEQ ID NO: 1204381 - RNA, 19 nt, Homo sapiens
caacaaggagaagaaagaa

SEQ ID NO: 1204382 - RNA, 19 nt, Homo sapiens
gaggaggagagaaauagaa

SEQ ID NO: 1204383 - RNA, 19 nt, Homo sapiens
uaucgaugaugauccagaa

SEQ ID NO: 1204384 - RNA, 19 nt, Homo sapiens
gcagaauucucacagauuu

SEQ ID NO: 1204385 - RNA, 19 nt, Homo sapiens
gaguaguucuuguuuguua

SEQ ID NO: 1204386 - RNA, 19 nt, Homo sapiens
gaagaaaguuaguauugga

SEQ ID NO: 1204387 - RNA, 19 nt, Homo sapiens
ggauauaucuuccuugaca

SEQ ID NO: 1204388 - RNA, 19 nt, Homo sapiens
gaaaggaccuggccaagac

SEQ ID NO: 1204389 - RNA, 19 nt, Homo sapiens
uaucagaguucacacuaua

SEQ ID NO: 1204390 - RNA, 19 nt, Homo sapiens
gagaaagaaguaaggauua

SEQ ID NO: 1204391 - RNA, 19 nt, Homo sapiens
gaacggcuuuccagaagga

SEQ ID NO: 1204392 - RNA, 19 nt, Homo sapiens
cgaagaugauccagaauau

SEQ ID NO: 1204393 - RNA, 19 nt, Homo sapiens
ucagugaaauugcuaaaug

SEQ ID NO: 1204394 - RNA, 19 nt, Homo sapiens
gaagaaaauugcagagaaa

SEQ ID NO: 1204395 - RNA, 19 nt, Homo sapiens
cagcaaaggccuagaauau

SEQ ID NO: 1204396 - RNA, 19 nt, Homo sapiens
gaaaguuaguauuggauca

SEQ ID NO: 1204397 - RNA, 19 nt, Homo sapiens
gaaaguagugaucuuguau

SEQ ID NO: 1204398 - RNA, 19 nt, Homo sapiens
gaaacacgcagaaaccauu

SEQ ID NO: 1204399 - RNA, 19 nt, Homo sapiens
acaagaaucugaagcacaa

SEQ ID NO: 1204400 - RNA, 19 nt, Homo sapiens
ggaagaaaguuaguauugg

SEQ ID NO: 1204401 - RNA, 19 nt, Homo sapiens
gggaagaaaguuaguauug

SEQ ID NO: 1204402 - RNA, 19 nt, Homo sapiens
gagcagaauucucacagau

SEQ ID NO: 1204403 - RNA, 19 nt, Homo sapiens
gcagagaauucgagaagag

SEQ ID NO: 1204404 - RNA, 19 nt, Homo sapiens
gaagaugauccagaauaua

SEQ ID NO: 1204405 - RNA, 19 nt, Homo sapiens
gcaaaggccuagaauaucc

SEQ ID NO: 1204406 - RNA, 19 nt, Homo sapiens
gggaagggauaaacuagau

SEQ ID NO: 1204407 - RNA, 19 nt, Homo sapiens
gaagagcgcagagguguga

SEQ ID NO: 1204408 - RNA, 19 nt, Homo sapiens
cccaacagcuucaacuauu

SEQ ID NO: 1204409 - RNA, 19 nt, Homo sapiens
agaaaguagugaucuugua

SEQ ID NO: 1204410 - RNA, 19 nt, Homo sapiens
aaagauaccauguggauga

SEQ ID NO: 1204411 - RNA, 19 nt, Homo sapiens
gaagagaagaagaaagaug

SEQ ID NO: 1204412 - RNA, 19 nt, Homo sapiens
agaauauccugcaguggua

SEQ ID NO: 1204413 - RNA, 19 nt, Homo sapiens
gaagggauaaacuagauau

SEQ ID NO: 1204414 - RNA, 19 nt, Homo sapiens
gcagaggugugacgacagu

SEQ ID NO: 1204415 - RNA, 19 nt, Homo sapiens
ccacaccucuuuuggaaua

SEQ ID NO: 1204416 - RNA, 19 nt, Homo sapiens
ggagagaguuagaaaagaa

SEQ ID NO: 1204417 - RNA, 19 nt, Homo sapiens
gaacggaggaggagagagu

SEQ ID NO: 1204418 - RNA, 19 nt, Homo sapiens
ccaacagcuucaacuauug

SEQ ID NO: 1204419 - RNA, 19 nt, Homo sapiens
cgacauccacuuuggguuu

SEQ ID NO: 1204420 - RNA, 19 nt, Homo sapiens
ggaaaggaccuggccaaga

SEQ ID NO: 1204421 - RNA, 19 nt, Homo sapiens
gaaaagagcgacuggcaaa

SEQ ID NO: 1204422 - RNA, 19 nt, Homo sapiens
gagaggaaccaaccacaga

SEQ ID NO: 1204423 - RNA, 19 nt, Homo sapiens
gagccauggugucgaguga

SEQ ID NO: 1204424 - RNA, 19 nt, Homo sapiens
ggaaccaaccacagagaaa

SEQ ID NO: 1204425 - RNA, 19 nt, Homo sapiens
gaagaagaagagaagaaga

SEQ ID NO: 1204426 - RNA, 19 nt, Homo sapiens
gcaagggcaucccagaaac

SEQ ID NO: 1204427 - RNA, 19 nt, Homo sapiens
aagaagagaagaagaaaga

SEQ ID NO: 1204428 - RNA, 19 nt, Homo sapiens
ggaagggauaaacuagaua

SEQ ID NO: 1204429 - RNA, 19 nt, Homo sapiens
ccauuccuguuauaaacua

SEQ ID NO: 1204430 - RNA, 19 nt, Homo sapiens
gagggaagaggcagaguga

SEQ ID NO: 1204431 - RNA, 19 nt, Homo sapiens
gagaagagaagcgagaaga

SEQ ID NO: 1204432 - RNA, 19 nt, Homo sapiens
gggauaaacuagauauagc

SEQ ID NO: 1204433 - RNA, 19 nt, Homo sapiens
ggguuucauucguuuguaa

SEQ ID NO: 1204434 - RNA, 19 nt, Homo sapiens
ccgccgaccugagucuuua

SEQ ID NO: 1204435 - RNA, 19 nt, Homo sapiens
gaagcugucggcccuagaa

SEQ ID NO: 1204436 - RNA, 19 nt, Homo sapiens
gaagacaagagagcucauu

SEQ ID NO: 1204437 - RNA, 19 nt, Homo sapiens
ucagaguucacacuauaua

SEQ ID NO: 1204438 - RNA, 19 nt, Homo sapiens
gcagaggagcugucaguca

SEQ ID NO: 1204439 - RNA, 19 nt, Homo sapiens
ugagaacgacauccacuuu

SEQ ID NO: 1204440 - RNA, 19 nt, Homo sapiens
ccagaaacguguaaaugac

SEQ ID NO: 1204441 - RNA, 19 nt, Homo sapiens
gaaacaggaggaucugcaa

SEQ ID NO: 1204442 - RNA, 19 nt, Homo sapiens
gagcaagggcaucccagaa

SEQ ID NO: 1204443 - RNA, 19 nt, Homo sapiens
ucgaagaugauccagaaua

SEQ ID NO: 1204444 - RNA, 19 nt, Homo sapiens
gguagaguuugcuccauuc

SEQ ID NO: 1204445 - RNA, 19 nt, Homo sapiens
ccagaaggagugaggauga

SEQ ID NO: 1204446 - RNA, 19 nt, Homo sapiens
agagaaagaaguaaggauu

SEQ ID NO: 1204447 - RNA, 19 nt, Homo sapiens
gagaacgacauccacuuug

SEQ ID NO: 1204448 - RNA, 19 nt, Homo sapiens
gaggagaggagauugauac

SEQ ID NO: 1204449 - RNA, 19 nt, Homo sapiens
cagugaaauugcuaaaugu

SEQ ID NO: 1204450 - RNA, 19 nt, Homo sapiens
gauccagaauauaagaagu

SEQ ID NO: 1204451 - RNA, 19 nt, Homo sapiens
gaugauccagaauauaaga

SEQ ID NO: 1204452 - RNA, 19 nt, Homo sapiens
gauuuuaccauuccuguua

SEQ ID NO: 1204453 - RNA, 19 nt, Homo sapiens
cccagaaacguguaaauga

SEQ ID NO: 1204454 - RNA, 19 nt, Homo sapiens
gaaaauugcagagaaagaa

SEQ ID NO: 1204455 - RNA, 19 nt, Homo sapiens
agacagauaaacagaagaa

SEQ ID NO: 1204456 - RNA, 19 nt, Homo sapiens
aagaagaagagaagaagaa

SEQ ID NO: 1204457 - RNA, 19 nt, Homo sapiens
gaagagaagcgagaagaac

SEQ ID NO: 1204458 - RNA, 19 nt, Homo sapiens
gaagaggcagagugaguca

SEQ ID NO: 1204459 - RNA, 19 nt, Homo sapiens
acaaagauaccauguggau

SEQ ID NO: 1204460 - RNA, 19 nt, Homo sapiens
agagacagauaaacagaag

SEQ ID NO: 1204461 - RNA, 19 nt, Homo sapiens
uaaaugaccccgaguguga

SEQ ID NO: 1204462 - RNA, 19 nt, Homo sapiens
acacagcggcagugauaaa

SEQ ID NO: 1204463 - RNA, 19 nt, Homo sapiens
gaagaagaaagaugcaaaa

SEQ ID NO: 1204464 - RNA, 19 nt, Homo sapiens
gaagaagagaagaagaaag

SEQ ID NO: 1204465 - RNA, 19 nt, Homo sapiens
uaucuuccuugacagcaaa

SEQ ID NO: 1204466 - RNA, 19 nt, Homo sapiens
gcacugcgauuuuaaccau

SEQ ID NO: 1204467 - RNA, 19 nt, Homo sapiens
gguaggaauauuuaucaga

SEQ ID NO: 1204468 - RNA, 19 nt, Homo sapiens
gagugaggaugagcagaga

SEQ ID NO: 1204469 - RNA, 19 nt, Homo sapiens
ugacagcaaaggccuagaa

SEQ ID NO: 1204470 - RNA, 19 nt, Homo sapiens
ggauaaacuagauauagca

SEQ ID NO: 1204471 - RNA, 19 nt, Homo sapiens
gggaagaggcagagugagu

SEQ ID NO: 1204472 - RNA, 19 nt, Homo sapiens
acagggauguggagagauc

SEQ ID NO: 1204473 - RNA, 19 nt, Homo sapiens
gaaagaaguaaggauuaag

SEQ ID NO: 1204474 - RNA, 19 nt, Homo sapiens
gagcucauugcuagaagaa

SEQ ID NO: 1204475 - RNA, 19 nt, Homo sapiens
cagaguucacacuauauaa

SEQ ID NO: 1204476 - RNA, 19 nt, Homo sapiens
auggauauaucuuccuuga

SEQ ID NO: 1204477 - RNA, 19 nt, Homo sapiens
uaccauuccuguuauaaac

SEQ ID NO: 1204478 - RNA, 19 nt, Homo sapiens
aagagcgacuggcaaacaa

SEQ ID NO: 1204479 - RNA, 19 nt, Homo sapiens
ucaagaacaagaaucugaa

SEQ ID NO: 1204480 - RNA, 19 nt, Homo sapiens
gcagagaaagaaguaagga

SEQ ID NO: 1204481 - RNA, 19 nt, Homo sapiens
aaagagacagauaaacaga

SEQ ID NO: 1204482 - RNA, 19 nt, Homo sapiens
ugguagaguuugcuccauu

SEQ ID NO: 1204483 - RNA, 19 nt, Homo sapiens
agaagaagaaagaugcaaa

SEQ ID NO: 1204484 - RNA, 19 nt, Homo sapiens
gcaaagauccagaauauaa

SEQ ID NO: 1204485 - RNA, 19 nt, Homo sapiens
gcagaauucucacagauuu

SEQ ID NO: 1204486 - RNA, 19 nt, Homo sapiens
cagcaaagauccagaauau

SEQ ID NO: 1204487 - RNA, 19 nt, Homo sapiens
gaguaguucuuguuuguua

SEQ ID NO: 1204488 - RNA, 19 nt, Homo sapiens
gaagaaaguuaguauugga

SEQ ID NO: 1204489 - RNA, 19 nt, Homo sapiens
ggauauaucuuccuugaca

SEQ ID NO: 1204490 - RNA, 19 nt, Homo sapiens
gaaaggaccuggccaagac

SEQ ID NO: 1204491 - RNA, 19 nt, Homo sapiens
uaucagaguucacacuaua

SEQ ID NO: 1204492 - RNA, 19 nt, Homo sapiens
gagaaagaaguaaggauua

SEQ ID NO: 1204493 - RNA, 19 nt, Homo sapiens
gaacggcuuuccagaagga

SEQ ID NO: 1204494 - RNA, 19 nt, Homo sapiens
ucagugaaauugcuaaaug

SEQ ID NO: 1204495 - RNA, 19 nt, Homo sapiens
gaagaaaauugcagagaaa

SEQ ID NO: 1204496 - RNA, 19 nt, Homo sapiens
gaaaguuaguauuggauca

SEQ ID NO: 1204497 - RNA, 19 nt, Homo sapiens
gaaaguagugaucuuguau

SEQ ID NO: 1204498 - RNA, 19 nt, Homo sapiens
gaaacacgcagaaaccauu

SEQ ID NO: 1204499 - RNA, 19 nt, Homo sapiens
acaagaaucugaagcacaa

SEQ ID NO: 1204500 - RNA, 19 nt, Homo sapiens
ggaagaaaguuaguauugg

SEQ ID NO: 1204501 - RNA, 19 nt, Homo sapiens
gggaagaaaguuaguauug

SEQ ID NO: 1204502 - RNA, 19 nt, Homo sapiens
gagcagaauucucacagau

SEQ ID NO: 1204503 - RNA, 19 nt, Homo sapiens
gcagagaauucgagaagag

SEQ ID NO: 1204504 - RNA, 19 nt, Homo sapiens
gggaagggauaaacuagau

SEQ ID NO: 1204505 - RNA, 19 nt, Homo sapiens
gaagagcgcagagguguga

SEQ ID NO: 1204506 - RNA, 19 nt, Homo sapiens
cccaacagcuucaacuauu

SEQ ID NO: 1204507 - RNA, 19 nt, Homo sapiens
agaaaguagugaucuugua

SEQ ID NO: 1204508 - RNA, 19 nt, Homo sapiens
aaagauaccauguggauga

SEQ ID NO: 1204509 - RNA, 19 nt, Homo sapiens
gaagagaagaagaaagaug

SEQ ID NO: 1204510 - RNA, 19 nt, Homo sapiens
gaagggauaaacuagauau

SEQ ID NO: 1204511 - RNA, 19 nt, Homo sapiens
gcagaggugugacgacagu

SEQ ID NO: 1204512 - RNA, 19 nt, Homo sapiens
ccacaccucuuuuggaaua

SEQ ID NO: 1204513 - RNA, 19 nt, Homo sapiens
ggagagaguuagaaaagaa

SEQ ID NO: 1204514 - RNA, 19 nt, Homo sapiens
gaacggaggaggagagagu

SEQ ID NO: 1204515 - RNA, 19 nt, Homo sapiens
ccaacagcuucaacuauug

SEQ ID NO: 1204516 - RNA, 19 nt, Homo sapiens
cgacauccacuuuggguuu

SEQ ID NO: 1204517 - RNA, 19 nt, Homo sapiens
ggaaaggaccuggccaaga

SEQ ID NO: 1204518 - RNA, 19 nt, Homo sapiens
gaaaagagcgacuggcaaa

SEQ ID NO: 1204519 - RNA, 19 nt, Homo sapiens
gagaggaaccaaccacaga

SEQ ID NO: 1204520 - RNA, 19 nt, Homo sapiens
gagccauggugucgaguga

SEQ ID NO: 1204521 - RNA, 19 nt, Homo sapiens
ggaaccaaccacagagaaa

SEQ ID NO: 1204522 - RNA, 19 nt, Homo sapiens
gaagaagaagagaagaaga

SEQ ID NO: 1204523 - RNA, 19 nt, Homo sapiens
gcaagggcaucccagaaac

SEQ ID NO: 1204524 - RNA, 19 nt, Homo sapiens
aagaagagaagaagaaaga

SEQ ID NO: 1204525 - RNA, 19 nt, Homo sapiens
ggaagggauaaacuagaua

SEQ ID NO: 1204526 - RNA, 19 nt, Homo sapiens
ccauuccuguuauaaacua

SEQ ID NO: 1204527 - RNA, 19 nt, Homo sapiens
gagggaagaggcagaguga

SEQ ID NO: 1204528 - RNA, 19 nt, Homo sapiens
gagaagagaagcgagaaga

SEQ ID NO: 1204529 - RNA, 19 nt, Homo sapiens
gggauaaacuagauauagc

SEQ ID NO: 1204530 - RNA, 19 nt, Homo sapiens
ggguuucauucguuuguaa

SEQ ID NO: 1204531 - RNA, 19 nt, Homo sapiens
gaagcugucggcccuagaa

SEQ ID NO: 1204532 - RNA, 19 nt, Homo sapiens
ccgccgaccugagucuuua

SEQ ID NO: 1204533 - RNA, 19 nt, Homo sapiens
gaagacaagagagcucauu

SEQ ID NO: 1204534 - RNA, 19 nt, Homo sapiens
ucagaguucacacuauaua

SEQ ID NO: 1204535 - RNA, 19 nt, Homo sapiens
gcagaggagcugucaguca

SEQ ID NO: 1204536 - RNA, 19 nt, Homo sapiens
ugagaacgacauccacuuu

SEQ ID NO: 1204537 - RNA, 19 nt, Homo sapiens
ccagaaacguguaaaugac

SEQ ID NO: 1204538 - RNA, 19 nt, Homo sapiens
gaaacaggaggaucugcaa

SEQ ID NO: 1204539 - RNA, 19 nt, Homo sapiens
gagcaagggcaucccagaa

SEQ ID NO: 1204540 - RNA, 19 nt, Homo sapiens
ccagaaggagugaggauga

SEQ ID NO: 1204541 - RNA, 19 nt, Homo sapiens
agagaaagaaguaaggauu

SEQ ID NO: 1204542 - RNA, 19 nt, Homo sapiens
gagaacgacauccacuuug

SEQ ID NO: 1204543 - RNA, 19 nt, Homo sapiens
gaggagaggagauugauac

SEQ ID NO: 1204544 - RNA, 19 nt, Homo sapiens
cagugaaauugcuaaaugu

SEQ ID NO: 1204545 - RNA, 19 nt, Homo sapiens
gauccagaauauaagaagu

SEQ ID NO: 1204546 - RNA, 19 nt, Homo sapiens
gauuuuaccauuccuguua

SEQ ID NO: 1204547 - RNA, 19 nt, Homo sapiens
cccagaaacguguaaauga

SEQ ID NO: 1204548 - RNA, 19 nt, Homo sapiens
gaaaauugcagagaaagaa

SEQ ID NO: 1204549 - RNA, 19 nt, Homo sapiens
agacagauaaacagaagaa

SEQ ID NO: 1204550 - RNA, 19 nt, Homo sapiens
aagaagaagagaagaagaa

SEQ ID NO: 1204551 - RNA, 19 nt, Homo sapiens
gaagagaagcgagaagaac

SEQ ID NO: 1204552 - RNA, 19 nt, Homo sapiens
gaagaggcagagugaguca

SEQ ID NO: 1204553 - RNA, 19 nt, Homo sapiens
acaaagauaccauguggau

SEQ ID NO: 1204554 - RNA, 19 nt, Homo sapiens
agagacagauaaacagaag

SEQ ID NO: 1204555 - RNA, 19 nt, Homo sapiens
uaaaugaccccgaguguga

SEQ ID NO: 1204556 - RNA, 19 nt, Homo sapiens
acacagcggcagugauaaa

SEQ ID NO: 1204557 - RNA, 19 nt, Homo sapiens
uaucuuccuugacagcaaa

SEQ ID NO: 1204558 - RNA, 19 nt, Homo sapiens
gaagaagaaagaugcaaaa

SEQ ID NO: 1204559 - RNA, 19 nt, Homo sapiens
gaagaagagaagaagaaag

SEQ ID NO: 1204560 - RNA, 19 nt, Homo sapiens
gcacugcgauuuuaaccau

SEQ ID NO: 1204561 - RNA, 19 nt, Homo sapiens
gguaggaauauuuaucaga

SEQ ID NO: 1204562 - RNA, 19 nt, Homo sapiens
gagugaggaugagcagaga

SEQ ID NO: 1204563 - RNA, 19 nt, Homo sapiens
ggauaaacuagauauagca

SEQ ID NO: 1204564 - RNA, 19 nt, Homo sapiens
gggaagaggcagagugagu

SEQ ID NO: 1204565 - RNA, 19 nt, Homo sapiens
acagggauguggagagauc

SEQ ID NO: 1204566 - RNA, 19 nt, Homo sapiens
gaaagaaguaaggauuaag

SEQ ID NO: 1204567 - RNA, 19 nt, Homo sapiens
gagcucauugcuagaagaa

SEQ ID NO: 1204568 - RNA, 19 nt, Homo sapiens
cagaguucacacuauauaa

SEQ ID NO: 1204569 - RNA, 19 nt, Homo sapiens
uaccauuccuguuauaaac

SEQ ID NO: 1204570 - RNA, 19 nt, Homo sapiens
auggauauaucuuccuuga

SEQ ID NO: 1204571 - RNA, 19 nt, Homo sapiens
aagagcgacuggcaaacaa

SEQ ID NO: 1204572 - RNA, 19 nt, Homo sapiens
ucaagaacaagaaucugaa

SEQ ID NO: 1204573 - RNA, 19 nt, Homo sapiens
gcagagaaagaaguaagga

SEQ ID NO: 1204574 - RNA, 19 nt, Homo sapiens
aaagagacagauaaacaga

SEQ ID NO: 1204575 - RNA, 19 nt, Homo sapiens
agaagaagaaagaugcaaa

SEQ ID NO: 1204576 - RNA, 19 nt, Homo sapiens
agaacgacauccacuuugg

SEQ ID NO: 1204577 - RNA, 19 nt, Homo sapiens
ugauggauauaucuuccuu

SEQ ID NO: 1204578 - RNA, 19 nt, Homo sapiens
cagcggcagugauaaagag

SEQ ID NO: 1204579 - RNA, 19 nt, Homo sapiens
aaagaggagaggagauuga

SEQ ID NO: 1204580 - RNA, 19 nt, Homo sapiens
ugacagcaaagauccagaa

SEQ ID NO: 1204581 - RNA, 19 nt, Homo sapiens
agaagaaaauugcagagaa

SEQ ID NO: 1204582 - RNA, 19 nt, Homo sapiens
caaagauccagaauauaag

SEQ ID NO: 1204583 - RNA, 19 nt, Homo sapiens
aaccgugcauucuguaguu

SEQ ID NO: 1204584 - RNA, 19 nt, Homo sapiens
gaaaagacaucaccagaua

SEQ ID NO: 1204585 - RNA, 19 nt, Homo sapiens
gaaagacgccaucguagua

SEQ ID NO: 1204586 - RNA, 19 nt, Homo sapiens
gaaagaaagucaucaagag

SEQ ID NO: 1204587 - RNA, 19 nt, Homo sapiens
ggaaauugauggguauuaa

SEQ ID NO: 1204588 - RNA, 19 nt, Homo sapiens
gaaauuugcugaacaagag

SEQ ID NO: 1204589 - RNA, 19 nt, Homo sapiens
ggaaagggcaaagaaauua

SEQ ID NO: 1204590 - RNA, 19 nt, Homo sapiens
gcaaagaaauuacaagaac

SEQ ID NO: 1204591 - RNA, 19 nt, Homo sapiens
gaagagagcgacuaaauuc

SEQ ID NO: 1204592 - RNA, 19 nt, Homo sapiens
guaaauaucagaucaguga

SEQ ID NO: 1204593 - RNA, 19 nt, Homo sapiens
uagaagaucuggccauuug

SEQ ID NO: 1204594 - RNA, 19 nt, Homo sapiens
agacaugaauccaaagaua

SEQ ID NO: 1204595 - RNA, 19 nt, Homo sapiens
ccaaacagcuagcacucua

SEQ ID NO: 1204596 - RNA, 19 nt, Homo sapiens
gcacaaacgcaaagaaaga

SEQ ID NO: 1204597 - RNA, 19 nt, Homo sapiens
ggauguagcucaguugaug

SEQ ID NO: 1204598 - RNA, 19 nt, Homo sapiens
ggaagagagcgacuaaauu

SEQ ID NO: 1204599 - RNA, 19 nt, Homo sapiens
ggaacauaaugacaaagaa

SEQ ID NO: 1204600 - RNA, 19 nt, Homo sapiens
gguguugcauugacuuuaa

SEQ ID NO: 1204601 - RNA, 19 nt, Homo sapiens
gaaauggcaagaucacaaa

SEQ ID NO: 1204602 - RNA, 19 nt, Homo sapiens
ccacuuccauuaaacuuga

SEQ ID NO: 1204603 - RNA, 19 nt, Homo sapiens
uaaacccacuuccauuaaa

SEQ ID NO: 1204604 - RNA, 19 nt, Homo sapiens
guuaaacccacuuccauua

SEQ ID NO: 1204605 - RNA, 19 nt, Homo sapiens
agaagucacucaagaucua

SEQ ID NO: 1204606 - RNA, 19 nt, Homo sapiens
ugacaggacuauagaagga

SEQ ID NO: 1204607 - RNA, 19 nt, Homo sapiens
gcagagagaggaagaaauc

SEQ ID NO: 1204608 - RNA, 19 nt, Homo sapiens
gaagaagacaugaauccaa

SEQ ID NO: 1204609 - RNA, 19 nt, Homo sapiens
aaacgaaagucagauaaug

SEQ ID NO: 1204610 - RNA, 19 nt, Homo sapiens
ccgagaagauuuagcagaa

SEQ ID NO: 1204611 - RNA, 19 nt, Homo sapiens
aagaagacaugaauccaaa

SEQ ID NO: 1204612 - RNA, 19 nt, Homo sapiens
gauaaauccucuaagaaac

SEQ ID NO: 1204613 - RNA, 19 nt, Homo sapiens
ucacaaacccacacacaaa

SEQ ID NO: 1204614 - RNA, 19 nt, Homo sapiens
gaaauuuagaugcucagua

SEQ ID NO: 1204615 - RNA, 19 nt, Homo sapiens
acaaguaacaccucagaua

SEQ ID NO: 1204616 - RNA, 19 nt, Homo sapiens
gagguucuguucucaaugu

SEQ ID NO: 1204617 - RNA, 19 nt, Homo sapiens
ccaaagauaaauccucuaa

SEQ ID NO: 1204618 - RNA, 19 nt, Homo sapiens
caauguugcugcccuguug

SEQ ID NO: 1204619 - RNA, 19 nt, Homo sapiens
gaaaagccgagaagauuua

SEQ ID NO: 1204620 - RNA, 19 nt, Homo sapiens
gaacauucuucugauaaag

SEQ ID NO: 1204621 - RNA, 19 nt, Homo sapiens
ugaggaacauaaugacaaa

SEQ ID NO: 1204622 - RNA, 19 nt, Homo sapiens
cgaucaaggucaagagaaa

SEQ ID NO: 1204623 - RNA, 19 nt, Homo sapiens
gcagcaggaagaaguauuu

SEQ ID NO: 1204624 - RNA, 19 nt, Homo sapiens
gagaagauuuagcagaagu

SEQ ID NO: 1204625 - RNA, 19 nt, Homo sapiens
gacaugaauccaaagauaa

SEQ ID NO: 1204626 - RNA, 19 nt, Homo sapiens
gaauggaugcaguuugaaa

SEQ ID NO: 1204627 - RNA, 19 nt, Homo sapiens
ggaauggguuuggguuuca

SEQ ID NO: 1204628 - RNA, 19 nt, Homo sapiens
gauagaaagaagagaauug

SEQ ID NO: 1204629 - RNA, 19 nt, Homo sapiens
cuaagaaacauaagucuga

SEQ ID NO: 1204630 - RNA, 19 nt, Homo sapiens
gaaaguuacaagacucuga

SEQ ID NO: 1204631 - RNA, 19 nt, Homo sapiens
ccaaucugcugaaauaugg

SEQ ID NO: 1204632 - RNA, 19 nt, Homo sapiens
gaagacaugaauccaaaga

SEQ ID NO: 1204633 - RNA, 19 nt, Homo sapiens
aggaauggaugcaguuuga

SEQ ID NO: 1204634 - RNA, 19 nt, Homo sapiens
uagcucaguugaugaagaa

SEQ ID NO: 1204635 - RNA, 19 nt, Homo sapiens
aaagucagauaaugaagga

SEQ ID NO: 1204636 - RNA, 19 nt, Homo sapiens
gaagcagcaggaagaagua

SEQ ID NO: 1204637 - RNA, 19 nt, Homo sapiens
gaagaugaagcuggaugua

SEQ ID NO: 1204638 - RNA, 19 nt, Homo sapiens
guauuaagagugaagauga

SEQ ID NO: 1204639 - RNA, 19 nt, Homo sapiens
gaguaggagucgagauaga

SEQ ID NO: 1204640 - RNA, 19 nt, Homo sapiens
guagggagcggaagaaauc

SEQ ID NO: 1204641 - RNA, 19 nt, Homo sapiens
gcaaagaaagaaagucauc

SEQ ID NO: 1204642 - RNA, 19 nt, Homo sapiens
gcagggagcggaagaaguc

SEQ ID NO: 1204643 - RNA, 19 nt, Homo sapiens
ugaagaaaguuacaagacu

SEQ ID NO: 1204644 - RNA, 19 nt, Homo sapiens
gggcaaagaaauuacaaga

SEQ ID NO: 1204645 - RNA, 19 nt, Homo sapiens
caaugaaauuugcugaaca

SEQ ID NO: 1204646 - RNA, 19 nt, Homo sapiens
gaagauuuagcagaaguuu

SEQ ID NO: 1204647 - RNA, 19 nt, Homo sapiens
ggacaggcacaaacgcaaa

SEQ ID NO: 1204648 - RNA, 19 nt, Homo sapiens
gagagcgacuaaauucauc

SEQ ID NO: 1204649 - RNA, 19 nt, Homo sapiens
cauaauccagcacagauaa

SEQ ID NO: 1204650 - RNA, 19 nt, Homo sapiens
caaguaacaccucagauag

SEQ ID NO: 1204651 - RNA, 19 nt, Homo sapiens
gcagaagucacucaagauc

SEQ ID NO: 1204652 - RNA, 19 nt, Homo sapiens
aaagagcagucagaaguau

SEQ ID NO: 1204653 - RNA, 19 nt, Homo sapiens
guagcucaguugaugaaga

SEQ ID NO: 1204654 - RNA, 19 nt, Homo sapiens
gcagaaacacagcaaugga

SEQ ID NO: 1204655 - RNA, 19 nt, Homo sapiens
cgugaaagacgccaucgua

SEQ ID NO: 1204656 - RNA, 19 nt, Homo sapiens
gaugucacguccuuguuca

SEQ ID NO: 1204657 - RNA, 19 nt, Homo sapiens
guucugaugucacguccuu

SEQ ID NO: 1204658 - RNA, 19 nt, Homo sapiens
ugauggguauuaagaguga

SEQ ID NO: 1204659 - RNA, 19 nt, Homo sapiens
gcaggaagaaguauuucga

SEQ ID NO: 1204660 - RNA, 19 nt, Homo sapiens
aucccaaucugcugaaaua

SEQ ID NO: 1204661 - RNA, 19 nt, Homo sapiens
cgagauagaaagaagagaa

SEQ ID NO: 1204662 - RNA, 19 nt, Homo sapiens
agaucuaggucucgugaaa

SEQ ID NO: 1204663 - RNA, 19 nt, Homo sapiens
aggcagaagucacucaaga

SEQ ID NO: 1204664 - RNA, 19 nt, Homo sapiens
agaaagaaagucaucaaga

SEQ ID NO: 1204665 - RNA, 19 nt, Homo sapiens
aaacuugacaggacuauag

SEQ ID NO: 1204666 - RNA, 19 nt, Homo sapiens
ggaugcaguuugaaaauga

SEQ ID NO: 1204667 - RNA, 19 nt, Homo sapiens
aggaagaaguauuucgaaa

SEQ ID NO: 1204668 - RNA, 19 nt, Homo sapiens
gaugaagaaaguuacaaga

SEQ ID NO: 1204669 - RNA, 19 nt, Homo sapiens
ggaugcacaggaagcuuua

SEQ ID NO: 1204670 - RNA, 19 nt, Homo sapiens
gaacauaaugacaaagaac

SEQ ID NO: 1204671 - RNA, 19 nt, Homo sapiens
gagggaagaagacaugaau

SEQ ID NO: 1204672 - RNA, 19 nt, Homo sapiens
acaggacuauagaaggaua

SEQ ID NO: 1204673 - RNA, 19 nt, Homo sapiens
gaucacaaacccacacaca

SEQ ID NO: 1204674 - RNA, 19 nt, Homo sapiens
gaaaacgaaagucagauaa

SEQ ID NO: 1204675 - RNA, 19 nt, Homo sapiens
aaaggaagagagcgacuaa

SEQ ID NO: 1204676 - RNA, 19 nt, Homo sapiens
uacuuaaccuuguacaguu

SEQ ID NO: 1204677 - RNA, 19 nt, Homo sapiens
gaaauugauggguauuaag

SEQ ID NO: 1204678 - RNA, 19 nt, Homo sapiens
ccaaugaaauuugcugaac

SEQ ID NO: 1204679 - RNA, 19 nt, Homo sapiens
gcaucaggaacacaaguaa

SEQ ID NO: 1204680 - RNA, 19 nt, Homo sapiens
guacauaauccagcacaga

SEQ ID NO: 1204681 - RNA, 19 nt, Homo sapiens
ggacuuauagacuucuugu

SEQ ID NO: 1204682 - RNA, 19 nt, Homo sapiens
aaagacaucaccagauaga

SEQ ID NO: 1204683 - RNA, 19 nt, Homo sapiens
ggacuauagaaggauaaua

SEQ ID NO: 1204684 - RNA, 19 nt, Homo sapiens
guaguaagcuggucaauua

SEQ ID NO: 1204685 - RNA, 19 nt, Homo sapiens
gagcugauguguacacuga

SEQ ID NO: 1204686 - RNA, 19 nt, Homo sapiens
gggcugagcugauguguac

SEQ ID NO: 1204687 - RNA, 19 nt, Homo sapiens
gcucaccaccuucuacuuu

SEQ ID NO: 1204688 - RNA, 19 nt, Homo sapiens
ccaaaggagagguuuagua

SEQ ID NO: 1204689 - RNA, 19 nt, Homo sapiens
ccagugggcugagcaaguu

SEQ ID NO: 1204690 - RNA, 19 nt, Homo sapiens
ggagagcaccagcccuuaa

SEQ ID NO: 1204691 - RNA, 19 nt, Homo sapiens
gaccaggccuuguccaucu

SEQ ID NO: 1204692 - RNA, 19 nt, Homo sapiens
ccaggcacuuggacacuaa

SEQ ID NO: 1204693 - RNA, 19 nt, Homo sapiens
gaguuugaauuccuugguu

SEQ ID NO: 1204694 - RNA, 19 nt, Homo sapiens
uuggagaacuuggaauuaa

SEQ ID NO: 1204695 - RNA, 19 nt, Homo sapiens
caaaggagagguuuaguac

SEQ ID NO: 1204696 - RNA, 19 nt, Homo sapiens
caucauuacacgucagaua

SEQ ID NO: 1204697 - RNA, 19 nt, Homo sapiens
gcucccagcucaccaccuu

SEQ ID NO: 1204698 - RNA, 19 nt, Homo sapiens
guaagcuggucaauuaucu

SEQ ID NO: 1204699 - RNA, 19 nt, Homo sapiens
uuaaagguguucauagaca

SEQ ID NO: 1204700 - RNA, 19 nt, Homo sapiens
gagagcaccagcccuuaaa

SEQ ID NO: 1204701 - RNA, 19 nt, Homo sapiens
ggagacacuuccagacucu

SEQ ID NO: 1204702 - RNA, 19 nt, Homo sapiens
gaagucaggcagcccaaga

SEQ ID NO: 1204703 - RNA, 19 nt, Homo sapiens
cccaggagguggaaacuuc

SEQ ID NO: 1204704 - RNA, 19 nt, Homo sapiens
ucucagaaagucauugaaa

SEQ ID NO: 1204705 - RNA, 19 nt, Homo sapiens
aguuaagccuggagacgua

SEQ ID NO: 1204706 - RNA, 19 nt, Homo sapiens
gcugucagauccacuacuc

SEQ ID NO: 1204707 - RNA, 19 nt, Homo sapiens
ggaaauaccccaggaugaa

SEQ ID NO: 1204708 - RNA, 19 nt, Homo sapiens
uaaagguguucauagacau

SEQ ID NO: 1204709 - RNA, 19 nt, Homo sapiens
ccacuacucccaacucagu

SEQ ID NO: 1204710 - RNA, 19 nt, Homo sapiens
gugcugcuguuccgcauca

SEQ ID NO: 1204711 - RNA, 19 nt, Homo sapiens
ccaagccucgguuaccuaa

SEQ ID NO: 1204712 - RNA, 19 nt, Homo sapiens
ccaguggguuuaccaaagg

SEQ ID NO: 1204713 - RNA, 19 nt, Homo sapiens
gggcuucauaugcugcuua

SEQ ID NO: 1204714 - RNA, 19 nt, Homo sapiens
gcacucauuccugaagcua

SEQ ID NO: 1204715 - RNA, 19 nt, Homo sapiens
agacaucugccucaaggaa

SEQ ID NO: 1204716 - RNA, 19 nt, Homo sapiens
ccugagaggucccagaacu

SEQ ID NO: 1204717 - RNA, 19 nt, Homo sapiens
gagcucugcuggagaaaau

SEQ ID NO: 1204718 - RNA, 19 nt, Homo sapiens
aaggagagguuuaguacac

SEQ ID NO: 1204719 - RNA, 19 nt, Homo sapiens
gacaucugccucaaggaaa

SEQ ID NO: 1204720 - RNA, 19 nt, Homo sapiens
cauaugcugcuuacacaga

SEQ ID NO: 1204721 - RNA, 19 nt, Homo sapiens
cuaaagcaucugaaucuca

SEQ ID NO: 1204722 - RNA, 19 nt, Homo sapiens
gcuggucaauuaucuaacg

SEQ ID NO: 1204723 - RNA, 19 nt, Homo sapiens
aagcuggucaauuaucuaa

SEQ ID NO: 1204724 - RNA, 19 nt, Homo sapiens
gggagagcaccagcccuua

SEQ ID NO: 1204725 - RNA, 19 nt, Homo sapiens
cugaggagaguuugaauuc

SEQ ID NO: 1204726 - RNA, 19 nt, Homo sapiens
aagccucgguuaccuaaag

SEQ ID NO: 1204727 - RNA, 19 nt, Homo sapiens
ggagaacuuggaauuaacu

SEQ ID NO: 1204728 - RNA, 19 nt, Homo sapiens
uuacacgucagauaaugaa

SEQ ID NO: 1204729 - RNA, 19 nt, Homo sapiens
gaucaggugccuccagaac

SEQ ID NO: 1204730 - RNA, 19 nt, Homo sapiens
aaauugaucaccuucuuca

SEQ ID NO: 1204731 - RNA, 19 nt, Homo sapiens
ucaggcagcccaagaggau

SEQ ID NO: 1204732 - RNA, 19 nt, Homo sapiens
uaucucagaaagucauuga

SEQ ID NO: 1204733 - RNA, 19 nt, Homo sapiens
ucgguuaccuaaagcaucu

SEQ ID NO: 1204734 - RNA, 19 nt, Homo sapiens
acaucugccucaaggaaau

SEQ ID NO: 1204735 - RNA, 19 nt, Homo sapiens
ucauagacaucugccucaa

SEQ ID NO: 1204736 - RNA, 19 nt, Homo sapiens
caccugugcuguaguaagc

SEQ ID NO: 1204737 - RNA, 19 nt, Homo sapiens
uuaccaaaggagagguuua

SEQ ID NO: 1204738 - RNA, 19 nt, Homo sapiens
gcacuuggacacuaaaauc

SEQ ID NO: 1204739 - RNA, 19 nt, Homo sapiens
gaguccagcgcugagauuu

SEQ ID NO: 1204740 - RNA, 19 nt, Homo sapiens
ugagagaccaggccuuguc

SEQ ID NO: 1204741 - RNA, 19 nt, Homo sapiens
cuuggagaacuuggaauua

SEQ ID NO: 1204742 - RNA, 19 nt, Homo sapiens
uaagcuggucaauuaucua

SEQ ID NO: 1204743 - RNA, 19 nt, Homo sapiens
ucaccaccuucuacuuugg

SEQ ID NO: 1204744 - RNA, 19 nt, Homo sapiens
uggagaacuuggaauuaac

SEQ ID NO: 1204745 - RNA, 19 nt, Homo sapiens
ccuuggagaacuuggaauu

SEQ ID NO: 1204746 - RNA, 19 nt, Homo sapiens
gucagauaaugaacuccaa

SEQ ID NO: 1204747 - RNA, 19 nt, Homo sapiens
uguaguaagcuggucaauu

SEQ ID NO: 1204748 - RNA, 19 nt, Homo sapiens
uccaguggguuuaccaaag

SEQ ID NO: 1204749 - RNA, 19 nt, Homo sapiens
ggaugaaugccugagauac

SEQ ID NO: 1204750 - RNA, 19 nt, Homo sapiens
caucugccucaaggaaaua

SEQ ID NO: 1204751 - RNA, 19 nt, Homo sapiens
guaguaagcuggucaauua

SEQ ID NO: 1204752 - RNA, 19 nt, Homo sapiens
gagcugauguguacacuga

SEQ ID NO: 1204753 - RNA, 19 nt, Homo sapiens
gggcugagcugauguguac

SEQ ID NO: 1204754 - RNA, 19 nt, Homo sapiens
gcucaccaccuucuacuuu

SEQ ID NO: 1204755 - RNA, 19 nt, Homo sapiens
ccaaaggagagguuuagua

SEQ ID NO: 1204756 - RNA, 19 nt, Homo sapiens
ccagugggcugagcaaguu

SEQ ID NO: 1204757 - RNA, 19 nt, Homo sapiens
ggagagcaccagcccuuaa

SEQ ID NO: 1204758 - RNA, 19 nt, Homo sapiens
gaccaggccuuguccaucu

SEQ ID NO: 1204759 - RNA, 19 nt, Homo sapiens
ccaggcacuuggacacuaa

SEQ ID NO: 1204760 - RNA, 19 nt, Homo sapiens
gaguuugaauuccuugguu

SEQ ID NO: 1204761 - RNA, 19 nt, Homo sapiens
uuggagaacuuggaauuaa

SEQ ID NO: 1204762 - RNA, 19 nt, Homo sapiens
caaaggagagguuuaguac

SEQ ID NO: 1204763 - RNA, 19 nt, Homo sapiens
caucauuacacgucagaua

SEQ ID NO: 1204764 - RNA, 19 nt, Homo sapiens
gcucccagcucaccaccuu

SEQ ID NO: 1204765 - RNA, 19 nt, Homo sapiens
guaagcuggucaauuaucu

SEQ ID NO: 1204766 - RNA, 19 nt, Homo sapiens
uuaaagguguucauagaca

SEQ ID NO: 1204767 - RNA, 19 nt, Homo sapiens
gagagcaccagcccuuaaa

SEQ ID NO: 1204768 - RNA, 19 nt, Homo sapiens
ggagacacuuccagacucu

SEQ ID NO: 1204769 - RNA, 19 nt, Homo sapiens
cccaggagguggaaacuuc

SEQ ID NO: 1204770 - RNA, 19 nt, Homo sapiens
gaauucaggcagcccaaga

SEQ ID NO: 1204771 - RNA, 19 nt, Homo sapiens
ucucagaaagucauugaaa

SEQ ID NO: 1204772 - RNA, 19 nt, Homo sapiens
aguuaagccuggagacgua

SEQ ID NO: 1204773 - RNA, 19 nt, Homo sapiens
gcugucagauccacuacuc

SEQ ID NO: 1204774 - RNA, 19 nt, Homo sapiens
ggaaauaccccaggaugaa

SEQ ID NO: 1204775 - RNA, 19 nt, Homo sapiens
uaaagguguucauagacau

SEQ ID NO: 1204776 - RNA, 19 nt, Homo sapiens
ccacuacucccaacucagu

SEQ ID NO: 1204777 - RNA, 19 nt, Homo sapiens
gugcugcuguuccgcauca

SEQ ID NO: 1204778 - RNA, 19 nt, Homo sapiens
ccaagccucgguuaccuaa

SEQ ID NO: 1204779 - RNA, 19 nt, Homo sapiens
ccaguggguuuaccaaagg

SEQ ID NO: 1204780 - RNA, 19 nt, Homo sapiens
gggcuucauaugcugcuua

SEQ ID NO: 1204781 - RNA, 19 nt, Homo sapiens
agacaucugccucaaggaa

SEQ ID NO: 1204782 - RNA, 19 nt, Homo sapiens
ccugagaggucccagaacu

SEQ ID NO: 1204783 - RNA, 19 nt, Homo sapiens
aaggagagguuuaguacac

SEQ ID NO: 1204784 - RNA, 19 nt, Homo sapiens
gacaucugccucaaggaaa

SEQ ID NO: 1204785 - RNA, 19 nt, Homo sapiens
cauaugcugcuuacacaga

SEQ ID NO: 1204786 - RNA, 19 nt, Homo sapiens
cuaaagcaucugaaucuca

SEQ ID NO: 1204787 - RNA, 19 nt, Homo sapiens
uguguacacugagggaauu

SEQ ID NO: 1204788 - RNA, 19 nt, Homo sapiens
gcuggucaauuaucuaacg

SEQ ID NO: 1204789 - RNA, 19 nt, Homo sapiens
aagcuggucaauuaucuaa

SEQ ID NO: 1204790 - RNA, 19 nt, Homo sapiens
gggagagcaccagcccuua

SEQ ID NO: 1204791 - RNA, 19 nt, Homo sapiens
cugaggagaguuugaauuc

SEQ ID NO: 1204792 - RNA, 19 nt, Homo sapiens
aagccucgguuaccuaaag

SEQ ID NO: 1204793 - RNA, 19 nt, Homo sapiens
ggagaacuuggaauuaacu

SEQ ID NO: 1204794 - RNA, 19 nt, Homo sapiens
uuacacgucagauaaugaa

SEQ ID NO: 1204795 - RNA, 19 nt, Homo sapiens
gaucaggugccuccagaac

SEQ ID NO: 1204796 - RNA, 19 nt, Homo sapiens
aaauugaucaccuucuuca

SEQ ID NO: 1204797 - RNA, 19 nt, Homo sapiens
ucaggcagcccaagaggau

SEQ ID NO: 1204798 - RNA, 19 nt, Homo sapiens
uaucucagaaagucauuga

SEQ ID NO: 1204799 - RNA, 19 nt, Homo sapiens
ucgguuaccuaaagcaucu

SEQ ID NO: 1204800 - RNA, 19 nt, Homo sapiens
acaucugccucaaggaaau

SEQ ID NO: 1204801 - RNA, 19 nt, Homo sapiens
ucauagacaucugccucaa

SEQ ID NO: 1204802 - RNA, 19 nt, Homo sapiens
caccugugcuguaguaagc

SEQ ID NO: 1204803 - RNA, 19 nt, Homo sapiens
uuaccaaaggagagguuua

SEQ ID NO: 1204804 - RNA, 19 nt, Homo sapiens
gcacuuggacacuaaaauc

SEQ ID NO: 1204805 - RNA, 19 nt, Homo sapiens
gaguccagcgcugagauuu

SEQ ID NO: 1204806 - RNA, 19 nt, Homo sapiens
ugagagaccaggccuuguc

SEQ ID NO: 1204807 - RNA, 19 nt, Homo sapiens
cuuggagaacuuggaauua

SEQ ID NO: 1204808 - RNA, 19 nt, Homo sapiens
uaagcuggucaauuaucua

SEQ ID NO: 1204809 - RNA, 19 nt, Homo sapiens
ucaccaccuucuacuuugg

SEQ ID NO: 1204810 - RNA, 19 nt, Homo sapiens
uggagaacuuggaauuaac

SEQ ID NO: 1204811 - RNA, 19 nt, Homo sapiens
ccuuggagaacuuggaauu

SEQ ID NO: 1204812 - RNA, 19 nt, Homo sapiens
uguaguaagcuggucaauu

SEQ ID NO: 1204813 - RNA, 19 nt, Homo sapiens
uccaguggguuuaccaaag

SEQ ID NO: 1204814 - RNA, 19 nt, Homo sapiens
ggaugaaugccugagauac

SEQ ID NO: 1204815 - RNA, 19 nt, Homo sapiens
caucugccucaaggaaaua

SEQ ID NO: 1204816 - RNA, 19 nt, Homo sapiens
gaaauucagugaucucuuc

SEQ ID NO: 1204817 - RNA, 19 nt, Homo sapiens
ucacagaauugucaaauga

SEQ ID NO: 1204818 - RNA, 19 nt, Homo sapiens
gagagaaguuuccugaguu

SEQ ID NO: 1204819 - RNA, 19 nt, Homo sapiens
caacuucuauccaccauug

SEQ ID NO: 1204820 - RNA, 19 nt, Homo sapiens
acacagaguuuccagauga

SEQ ID NO: 1204821 - RNA, 19 nt, Homo sapiens
gaaagccucuguaccuaau

SEQ ID NO: 1204822 - RNA, 19 nt, Homo sapiens
gagauaaucgugucuuaaa

SEQ ID NO: 1204823 - RNA, 19 nt, Homo sapiens
ggacugcccucuccuucuu

SEQ ID NO: 1204824 - RNA, 19 nt, Homo sapiens
caacagagaagggaaauga

SEQ ID NO: 1204825 - RNA, 19 nt, Homo sapiens
agacucaguucucaacaua

SEQ ID NO: 1204826 - RNA, 19 nt, Homo sapiens
gcggagagcugcugaacau

SEQ ID NO: 1204827 - RNA, 19 nt, Homo sapiens
gaugagaguugcuaugaca

SEQ ID NO: 1204828 - RNA, 19 nt, Homo sapiens
ggugugcccuggaggcuua

SEQ ID NO: 1204829 - RNA, 19 nt, Homo sapiens
gcgaggagauggugaagau

SEQ ID NO: 1204830 - RNA, 19 nt, Homo sapiens
ggacaaaguacuccagcua

SEQ ID NO: 1204831 - RNA, 19 nt, Homo sapiens
cagagauaaucgugucuua

SEQ ID NO: 1204832 - RNA, 19 nt, Homo sapiens
gagcagagacucagugugu

SEQ ID NO: 1204833 - RNA, 19 nt, Homo sapiens
cagcuucucucuacuucua

SEQ ID NO: 1204834 - RNA, 19 nt, Homo sapiens
gcuaccaccugcucuacua

SEQ ID NO: 1204835 - RNA, 19 nt, Homo sapiens
ggaggagucuguaggaaag

SEQ ID NO: 1204836 - RNA, 19 nt, Homo sapiens
ccaaagagccauuucaaca

SEQ ID NO: 1204837 - RNA, 19 nt, Homo sapiens
ggaaagccucuguaccuaa

SEQ ID NO: 1204838 - RNA, 19 nt, Homo sapiens
aaagagccauuucaacaga

SEQ ID NO: 1204839 - RNA, 19 nt, Homo sapiens
uaagacuacuucagaaugu

SEQ ID NO: 1204840 - RNA, 19 nt, Homo sapiens
ugacgaagcccacaagaug

SEQ ID NO: 1204841 - RNA, 19 nt, Homo sapiens
gaucguggcuguuauugac

SEQ ID NO: 1204842 - RNA, 19 nt, Homo sapiens
ggagagcugcugaacauga

SEQ ID NO: 1204843 - RNA, 19 nt, Homo sapiens
cagauaagcuaggaugaga

SEQ ID NO: 1204844 - RNA, 19 nt, Homo sapiens
agacaaggauagcauuaug

SEQ ID NO: 1204845 - RNA, 19 nt, Homo sapiens
ccacaagcauucagaaagg

SEQ ID NO: 1204846 - RNA, 19 nt, Homo sapiens
ucagaauguugcuaggaua

SEQ ID NO: 1204847 - RNA, 19 nt, Homo sapiens
ucaagucccugcucaucaa

SEQ ID NO: 1204848 - RNA, 19 nt, Homo sapiens
acaaccauaugucggauaa

SEQ ID NO: 1204849 - RNA, 19 nt, Homo sapiens
gggcaaugcugagagagaa

SEQ ID NO: 1204850 - RNA, 19 nt, Homo sapiens
caaaagcgauaccaagauu

SEQ ID NO: 1204851 - RNA, 19 nt, Homo sapiens
gaggcaaguuucacagaau

SEQ ID NO: 1204852 - RNA, 19 nt, Homo sapiens
gggagaccuuugagcagua

SEQ ID NO: 1204853 - RNA, 19 nt, Homo sapiens
gaaccuguacgagucauuu

SEQ ID NO: 1204854 - RNA, 19 nt, Homo sapiens
agacuaaacuccucuucau

SEQ ID NO: 1204855 - RNA, 19 nt, Homo sapiens
aagaggaucucaacagcaa

SEQ ID NO: 1204856 - RNA, 19 nt, Homo sapiens
cuaaugaaguacugaguuc

SEQ ID NO: 1204857 - RNA, 19 nt, Homo sapiens
ggucuugguuuguucugaa

SEQ ID NO: 1204858 - RNA, 19 nt, Homo sapiens
caacagcagcuucucucua

SEQ ID NO: 1204859 - RNA, 19 nt, Homo sapiens
ccucuguaccuaauauuua

SEQ ID NO: 1204860 - RNA, 19 nt, Homo sapiens
aauagaggcugaggagauu

SEQ ID NO: 1204861 - RNA, 19 nt, Homo sapiens
gagagcugcugaacaugau

SEQ ID NO: 1204862 - RNA, 19 nt, Homo sapiens
cugcacaccugccugauga

SEQ ID NO: 1204863 - RNA, 19 nt, Homo sapiens
gaucucaacagcaaaggaa

SEQ ID NO: 1204864 - RNA, 19 nt, Homo sapiens
gagaguugcuaugacaaug

SEQ ID NO: 1204865 - RNA, 19 nt, Homo sapiens
gaagggacguuuuauaguc

SEQ ID NO: 1204866 - RNA, 19 nt, Homo sapiens
ggaggaauaugaggacucu

SEQ ID NO: 1204867 - RNA, 19 nt, Homo sapiens
guaagacuacuucagaaug

SEQ ID NO: 1204868 - RNA, 19 nt, Homo sapiens
aauuugaacugcuuuggaa

SEQ ID NO: 1204869 - RNA, 19 nt, Homo sapiens
agagagaaguuuccugagu

SEQ ID NO: 1204870 - RNA, 19 nt, Homo sapiens
ccagacaaggauagcauua

SEQ ID NO: 1204871 - RNA, 19 nt, Homo sapiens
ucuccgagcuauaucagaa

SEQ ID NO: 1204872 - RNA, 19 nt, Homo sapiens
uaugucagaugcaggaaga

SEQ ID NO: 1204873 - RNA, 19 nt, Homo sapiens
ugacugaggcccugcauuc

SEQ ID NO: 1204874 - RNA, 19 nt, Homo sapiens
acaccuagcuccccuguuu

SEQ ID NO: 1204875 - RNA, 19 nt, Homo sapiens
aaaugucgcugccuccaau

SEQ ID NO: 1204876 - RNA, 19 nt, Homo sapiens
gaauuugaacugcuuugga

SEQ ID NO: 1204877 - RNA, 19 nt, Homo sapiens
gaccuucucuccgagcuau

SEQ ID NO: 1204878 - RNA, 19 nt, Homo sapiens
gacaaggauagcauuauga

SEQ ID NO: 1204879 - RNA, 19 nt, Homo sapiens
ggagaccuuugagcaguau

SEQ ID NO: 1204880 - RNA, 19 nt, Homo sapiens
uaggauaccagaauuugaa

SEQ ID NO: 1204881 - RNA, 19 nt, Homo sapiens
aaacuccucuucaugacau

SEQ ID NO: 1204882 - RNA, 19 nt, Homo sapiens
ggguguccauuccuaauca

SEQ ID NO: 1204883 - RNA, 19 nt, Homo sapiens
uaauagaggcugaggagau

SEQ ID NO: 1204884 - RNA, 19 nt, Homo sapiens
guaguccacccuucuaaug

SEQ ID NO: 1204885 - RNA, 19 nt, Homo sapiens
agaggcaaguuucacagaa

SEQ ID NO: 1204886 - RNA, 19 nt, Homo sapiens
cuaccaagcggaaacgaaa

SEQ ID NO: 1204887 - RNA, 19 nt, Homo sapiens
cagccugccucgcaagaga

SEQ ID NO: 1204888 - RNA, 19 nt, Homo sapiens
cagaagcagcccaagauug

SEQ ID NO: 1204889 - RNA, 19 nt, Homo sapiens
gcuaggauaccagaauuug

SEQ ID NO: 1204890 - RNA, 19 nt, Homo sapiens
acuaaacuccucuucauga

SEQ ID NO: 1204891 - RNA, 19 nt, Homo sapiens
gacgaagcccacaagauga

SEQ ID NO: 1204892 - RNA, 19 nt, Homo sapiens
acaaaguacuccagcuaca

SEQ ID NO: 1204893 - RNA, 19 nt, Homo sapiens
gugaaaugggcaucuauga

SEQ ID NO: 1204894 - RNA, 19 nt, Homo sapiens
ggaaacacccuugcugcau

SEQ ID NO: 1204895 - RNA, 19 nt, Homo sapiens
caacaccaagcagaacuuu

SEQ ID NO: 1204896 - RNA, 19 nt, Homo sapiens
caacagcaaaggaaagaag

SEQ ID NO: 1204897 - RNA, 19 nt, Homo sapiens
agagaaguuuccugaguuc

SEQ ID NO: 1204898 - RNA, 19 nt, Homo sapiens
ucaagaacaucccgaaaau

SEQ ID NO: 1204899 - RNA, 19 nt, Homo sapiens
gagacuaaacuccucuuca

SEQ ID NO: 1204900 - RNA, 19 nt, Homo sapiens
ggacauggagacuaaacuc

SEQ ID NO: 1204901 - RNA, 19 nt, Homo sapiens
aggcaaguuucacagaauu

SEQ ID NO: 1204902 - RNA, 19 nt, Homo sapiens
gcuguucccagugauauuu

SEQ ID NO: 1204903 - RNA, 19 nt, Homo sapiens
cagaagaggaagacacgaa

SEQ ID NO: 1204904 - RNA, 19 nt, Homo sapiens
gcucuucaaggcccacuuu

SEQ ID NO: 1204905 - RNA, 19 nt, Homo sapiens
cggauaaggaugagaguug

SEQ ID NO: 1204906 - RNA, 19 nt, Homo sapiens
aaggauagcauuaugaaca

SEQ ID NO: 1204907 - RNA, 19 nt, Homo sapiens
ggugcgauuuggucaacaa

SEQ ID NO: 1204908 - RNA, 19 nt, Homo sapiens
ccagugauauuugggaucu

SEQ ID NO: 1204909 - RNA, 19 nt, Homo sapiens
ugcagcaccucaaauacaa

SEQ ID NO: 1204910 - RNA, 19 nt, Homo sapiens
gccacgugaugauggguaa

SEQ ID NO: 1204911 - RNA, 19 nt, Homo sapiens
acaccugccugaugaugga

SEQ ID NO: 1204912 - RNA, 19 nt, Homo sapiens
ggaggagccaguugauauc

SEQ ID NO: 1204913 - RNA, 19 nt, Homo sapiens
uggaggagccaguugauau

SEQ ID NO: 1204914 - RNA, 19 nt, Homo sapiens
auaaggagcugcgggcaau

SEQ ID NO: 1204915 - RNA, 19 nt, Homo sapiens
acaaggauagcauuaugaa

SEQ ID NO: 1204916 - RNA, 19 nt, Homo sapiens
guaaauggcuucauaacua

SEQ ID NO: 1204917 - RNA, 19 nt, Homo sapiens
caaauuggccuaaguauuc

SEQ ID NO: 1204918 - RNA, 19 nt, Homo sapiens
gagaagagaugggacuauu

SEQ ID NO: 1204919 - RNA, 19 nt, Homo sapiens
uaacaccacuauuaaggua

SEQ ID NO: 1204920 - RNA, 19 nt, Homo sapiens
uagaguaaauggcuucaua

SEQ ID NO: 1204921 - RNA, 19 nt, Homo sapiens
gcacagagcaauucauaga

SEQ ID NO: 1204922 - RNA, 19 nt, Homo sapiens
gcacaaauuggccuaagua

SEQ ID NO: 1204923 - RNA, 19 nt, Homo sapiens
gaaaaccugucucuacuaa

SEQ ID NO: 1204924 - RNA, 19 nt, Homo sapiens
ggucacaucugucucuaga

SEQ ID NO: 1204925 - RNA, 19 nt, Homo sapiens
gcauaacccuauuuaaugg

SEQ ID NO: 1204926 - RNA, 19 nt, Homo sapiens
gagaguuccuuugcuuuaa

SEQ ID NO: 1204927 - RNA, 19 nt, Homo sapiens
caagcuaaauuaugcauuc

SEQ ID NO: 1204928 - RNA, 19 nt, Homo sapiens
gaagagaugggacuauuuc

SEQ ID NO: 1204929 - RNA, 19 nt, Homo sapiens
agaaggacaagcuaaauua

SEQ ID NO: 1204930 - RNA, 19 nt, Homo sapiens
ugaaugaacccauguguga

SEQ ID NO: 1204931 - RNA, 19 nt, Homo sapiens
gagaugggacuauuucuau

SEQ ID NO: 1204932 - RNA, 19 nt, Homo sapiens
aacauucacuucuguagua

SEQ ID NO: 1204933 - RNA, 19 nt, Homo sapiens
acagagcaauucauagaaa

SEQ ID NO: 1204934 - RNA, 19 nt, Homo sapiens
cguaguugcugaaaccuaa

SEQ ID NO: 1204935 - RNA, 19 nt, Homo sapiens
gagagggacuaauuuaaac

SEQ ID NO: 1204936 - RNA, 19 nt, Homo sapiens
ccacaagcauauuaaaucu

SEQ ID NO: 1204937 - RNA, 19 nt, Homo sapiens
ggcauaacccuauuuaaug

SEQ ID NO: 1204938 - RNA, 19 nt, Homo sapiens
guuauaagguuggaaacaa

SEQ ID NO: 1204939 - RNA, 19 nt, Homo sapiens
ugaauuaccuacagaaacu

SEQ ID NO: 1204940 - RNA, 19 nt, Homo sapiens
gagcugaauuaccuacaga

SEQ ID NO: 1204941 - RNA, 19 nt, Homo sapiens
gaggauuauuuaaccauug

SEQ ID NO: 1204942 - RNA, 19 nt, Homo sapiens
guaguaugguuuccaccua

SEQ ID NO: 1204943 - RNA, 19 nt, Homo sapiens
gaaggacaagcuaaauuau

SEQ ID NO: 1204944 - RNA, 19 nt, Homo sapiens
gaccaaaguccaauguauu

SEQ ID NO: 1204945 - RNA, 19 nt, Homo sapiens
gaacugcacagagcaauuc

SEQ ID NO: 1204946 - RNA, 19 nt, Homo sapiens
ugagagggacuaauuuaaa

SEQ ID NO: 1204947 - RNA, 19 nt, Homo sapiens
gaaggucagaucaaaguug

SEQ ID NO: 1204948 - RNA, 19 nt, Homo sapiens
gauggucauugaauuuguu

SEQ ID NO: 1204949 - RNA, 19 nt, Homo sapiens
cuggaugccugcaaaguaa

SEQ ID NO: 1204950 - RNA, 19 nt, Homo sapiens
ugagaguuccuuugcuuua

SEQ ID NO: 1204951 - RNA, 19 nt, Homo sapiens
agaccaaaguccaauguau

SEQ ID NO: 1204952 - RNA, 19 nt, Homo sapiens
ggaggaacgaccuguuaaa

SEQ ID NO: 1204953 - RNA, 19 nt, Homo sapiens
guuuaaagauggaugaaag

SEQ ID NO: 1204954 - RNA, 19 nt, Homo sapiens
ccaaguacgugcaccucaa

SEQ ID NO: 1204955 - RNA, 19 nt, Homo sapiens
gcuuagagcugaauuaccu

SEQ ID NO: 1204956 - RNA, 19 nt, Homo sapiens
ccucgcaucucaucaccua

SEQ ID NO: 1204957 - RNA, 19 nt, Homo sapiens
gagccaagaucacgacacu

SEQ ID NO: 1204958 - RNA, 19 nt, Homo sapiens
gcaugagaaucacuuaaac

SEQ ID NO: 1204959 - RNA, 19 nt, Homo sapiens
uaaauggcuucauaacuac

SEQ ID NO: 1204960 - RNA, 19 nt, Homo sapiens
ggcaugagaaucacuuaaa

SEQ ID NO: 1204961 - RNA, 19 nt, Homo sapiens
aaacaaguccuccuuuagu

SEQ ID NO: 1204962 - RNA, 19 nt, Homo sapiens
ucuggaggcuagaaaugua

SEQ ID NO: 1204963 - RNA, 19 nt, Homo sapiens
uuucagagauucaucauac

SEQ ID NO: 1204964 - RNA, 19 nt, Homo sapiens
gugcuucccucgcaucuca

SEQ ID NO: 1204965 - RNA, 19 nt, Homo sapiens
agaugggacuauuucuaua

SEQ ID NO: 1204966 - RNA, 19 nt, Homo sapiens
gagcccauguuucugugaa

SEQ ID NO: 1204967 - RNA, 19 nt, Homo sapiens
uggcauaacccuauuuaau

SEQ ID NO: 1204968 - RNA, 19 nt, Homo sapiens
ucacuucuguaguaugguu

SEQ ID NO: 1204969 - RNA, 19 nt, Homo sapiens
cagaaggacaagcuaaauu

SEQ ID NO: 1204970 - RNA, 19 nt, Homo sapiens
aaaccugucucuacuaaaa

SEQ ID NO: 1204971 - RNA, 19 nt, Homo sapiens
cgaggcagguggaucacuu

SEQ ID NO: 1204972 - RNA, 19 nt, Homo sapiens
cuagauggucauugaauuu

SEQ ID NO: 1204973 - RNA, 19 nt, Homo sapiens
gaugggacuauuucuauau

SEQ ID NO: 1204974 - RNA, 19 nt, Homo sapiens
ucucuaacaccacuauuaa

SEQ ID NO: 1204975 - RNA, 19 nt, Homo sapiens
gggaaucuucuugguauuu

SEQ ID NO: 1204976 - RNA, 19 nt, Homo sapiens
ucuagauggucauugaauu

SEQ ID NO: 1204977 - RNA, 19 nt, Homo sapiens
gggacuaauuuaaacaagu

SEQ ID NO: 1204978 - RNA, 19 nt, Homo sapiens
ggcuauuccuuuguauaua

SEQ ID NO: 1204979 - RNA, 19 nt, Homo sapiens
ccauguuucugugaaguaa

SEQ ID NO: 1204980 - RNA, 19 nt, Homo sapiens
gcauuugcauuuuaaggua

SEQ ID NO: 1204981 - RNA, 19 nt, Homo sapiens
gcauagaaauuuguaacac

SEQ ID NO: 1204982 - RNA, 19 nt, Homo sapiens
gcugcuggcuauuccuuug

SEQ ID NO: 1204983 - RNA, 19 nt, Homo sapiens
aaugagaguuccuuugcuu

SEQ ID NO: 1204984 - RNA, 19 nt, Homo sapiens
uuaggaggcugaggcauga

SEQ ID NO: 1204985 - RNA, 19 nt, Homo sapiens
uaacccacaagcauauuaa

SEQ ID NO: 1204986 - RNA, 19 nt, Homo sapiens
gaaaaucuggguaguaaau

SEQ ID NO: 1204987 - RNA, 19 nt, Homo sapiens
ggaagugagaccagaagga

SEQ ID NO: 1204988 - RNA, 19 nt, Homo sapiens
gggaggaacgaccuguuaa

SEQ ID NO: 1204989 - RNA, 19 nt, Homo sapiens
gagcaucgccgaggagauc

SEQ ID NO: 1204990 - RNA, 19 nt, Homo sapiens
acacuuuggucacaucugu

SEQ ID NO: 1204991 - RNA, 19 nt, Homo sapiens
aaagaaacaggcaacauuc

SEQ ID NO: 1204992 - RNA, 19 nt, Homo sapiens
gaccagaaggacaagcuaa

SEQ ID NO: 1204993 - RNA, 19 nt, Homo sapiens
uuuaaaugcugcuggcuau

SEQ ID NO: 1204994 - RNA, 19 nt, Homo sapiens
auacauugguagucucuau

SEQ ID NO: 1204995 - RNA, 19 nt, Homo sapiens
guguuuauucugaggauua

SEQ ID NO: 1204996 - RNA, 19 nt, Homo sapiens
ggacaucagggacuacagu

SEQ ID NO: 1204997 - RNA, 19 nt, Homo sapiens
ccacucgcccuucacauug

SEQ ID NO: 1204998 - RNA, 19 nt, Homo sapiens
ucuaugacuuguagcaaug

SEQ ID NO: 1204999 - RNA, 19 nt, Homo sapiens
uuaaagagaacacuuagca

SEQ ID NO: 1205000 - RNA, 19 nt, Homo sapiens
ccaguguuaagguacauua

SEQ ID NO: 1205001 - RNA, 19 nt, Homo sapiens
gaaugagaguuccuuugcu

SEQ ID NO: 1205002 - RNA, 19 nt, Homo sapiens
aauacuagguguuguaagg

SEQ ID NO: 1205003 - RNA, 19 nt, Homo sapiens
guaacacuuuggucacauc

SEQ ID NO: 1205004 - RNA, 19 nt, Homo sapiens
cugcacagagcaauucaua

SEQ ID NO: 1205005 - RNA, 19 nt, Homo sapiens
ggucaagcgggacuucauu

SEQ ID NO: 1205006 - RNA, 19 nt, Homo sapiens
acaaauuggccuaaguauu

SEQ ID NO: 1205007 - RNA, 19 nt, Homo sapiens
acacuuagcagccuaugau

SEQ ID NO: 1205008 - RNA, 19 nt, Homo sapiens
ggaaucuucuugguauuuu

SEQ ID NO: 1205009 - RNA, 19 nt, Homo sapiens
gagaccaaaguccaaugua

SEQ ID NO: 1205010 - RNA, 19 nt, Homo sapiens
gaaugaacccaugugugaa

SEQ ID NO: 1205011 - RNA, 19 nt, Homo sapiens
gucaagcgggacuucauua

SEQ ID NO: 1205012 - RNA, 19 nt, Homo sapiens
gcaaaguaaggaauaaugc

SEQ ID NO: 1205013 - RNA, 19 nt, Homo sapiens
gcugaauuaccuacagaaa

SEQ ID NO: 1205014 - RNA, 19 nt, Homo sapiens
gaaacaggcaacauucacu

SEQ ID NO: 1205015 - RNA, 19 nt, Homo sapiens
gagggacuaauuuaaacaa

SEQ ID NO: 1205016 - RNA, 19 nt, Homo sapiens
ggaaagaagugcauuguuu

SEQ ID NO: 1205017 - RNA, 19 nt, Homo sapiens
agaagaagcugaaauguua

SEQ ID NO: 1205018 - RNA, 19 nt, Homo sapiens
gcaaagggcacaugaauua

SEQ ID NO: 1205019 - RNA, 19 nt, Homo sapiens
gagcaggagugucuaguua

SEQ ID NO: 1205020 - RNA, 19 nt, Homo sapiens
uaucgaagaugaagacuua

SEQ ID NO: 1205021 - RNA, 19 nt, Homo sapiens
ggaaggcgguuuauaguga

SEQ ID NO: 1205022 - RNA, 19 nt, Homo sapiens
gcaguugucucaauaucua

SEQ ID NO: 1205023 - RNA, 19 nt, Homo sapiens
gcaggagugucuaguuaua

SEQ ID NO: 1205024 - RNA, 19 nt, Homo sapiens
cauaaagacucuagaagaa

SEQ ID NO: 1205025 - RNA, 19 nt, Homo sapiens
gaggagauagcaacaauua

SEQ ID NO: 1205026 - RNA, 19 nt, Homo sapiens
gcagagauuuaaagaagaa

SEQ ID NO: 1205027 - RNA, 19 nt, Homo sapiens
gauaagacaucucauagca

SEQ ID NO: 1205028 - RNA, 19 nt, Homo sapiens
gaaagccgauuacgagaau

SEQ ID NO: 1205029 - RNA, 19 nt, Homo sapiens
uaaaggagaccgaguagua

SEQ ID NO: 1205030 - RNA, 19 nt, Homo sapiens
aguaguaccuccuuucuua

SEQ ID NO: 1205031 - RNA, 19 nt, Homo sapiens
ggaaugaacuugucucacu

SEQ ID NO: 1205032 - RNA, 19 nt, Homo sapiens
ggucuucaguuucuucaua

SEQ ID NO: 1205033 - RNA, 19 nt, Homo sapiens
ggucagccauccucaagua

SEQ ID NO: 1205034 - RNA, 19 nt, Homo sapiens
ccuccaaacuuuagucaua

SEQ ID NO: 1205035 - RNA, 19 nt, Homo sapiens
gaucaagugcgagaaauua

SEQ ID NO: 1205036 - RNA, 19 nt, Homo sapiens
gaaggaaauuauugaagga

SEQ ID NO: 1205037 - RNA, 19 nt, Homo sapiens
gcgagcagcugccaccuuu

SEQ ID NO: 1205038 - RNA, 19 nt, Homo sapiens
caauugagaagaacacuua

SEQ ID NO: 1205039 - RNA, 19 nt, Homo sapiens
acaaaggucuggacacuga

SEQ ID NO: 1205040 - RNA, 19 nt, Homo sapiens
caacaauuauggugaacaa

SEQ ID NO: 1205041 - RNA, 19 nt, Homo sapiens
caaagacagaguaucauua

SEQ ID NO: 1205042 - RNA, 19 nt, Homo sapiens
caagaucacugacacaaag

SEQ ID NO: 1205043 - RNA, 19 nt, Homo sapiens
ugaaguagauucugauaca

SEQ ID NO: 1205044 - RNA, 19 nt, Homo sapiens
cagcagacacuaauucaua

SEQ ID NO: 1205045 - RNA, 19 nt, Homo sapiens
ggaccaacauuuccaguag

SEQ ID NO: 1205046 - RNA, 19 nt, Homo sapiens
gaaauaacagauacaguug

SEQ ID NO: 1205047 - RNA, 19 nt, Homo sapiens
ggagauagcaacaauuaug

SEQ ID NO: 1205048 - RNA, 19 nt, Homo sapiens
cagaagauguugcacaaga

SEQ ID NO: 1205049 - RNA, 19 nt, Homo sapiens
ggagaaauaugaugaaucc

SEQ ID NO: 1205050 - RNA, 19 nt, Homo sapiens
gagugcagcuucagucuug

SEQ ID NO: 1205051 - RNA, 19 nt, Homo sapiens
caagcaaacuccugacuuc

SEQ ID NO: 1205052 - RNA, 19 nt, Homo sapiens
ggugaacaaugacuuuauu

SEQ ID NO: 1205053 - RNA, 19 nt, Homo sapiens
guauaucuguguuaucuga

SEQ ID NO: 1205054 - RNA, 19 nt, Homo sapiens
gaagaucaaaguucuaaga

SEQ ID NO: 1205055 - RNA, 19 nt, Homo sapiens
ggcagaggcuccuuuaaga

SEQ ID NO: 1205056 - RNA, 19 nt, Homo sapiens
uaaaugggccgucuucuga

SEQ ID NO: 1205057 - RNA, 19 nt, Homo sapiens
gaacuuagacgugcccaaa

SEQ ID NO: 1205058 - RNA, 19 nt, Homo sapiens
ggaaggagaguucaaacaa

SEQ ID NO: 1205059 - RNA, 19 nt, Homo sapiens
caauuauggugaacaauga

SEQ ID NO: 1205060 - RNA, 19 nt, Homo sapiens
gaagugaaggaaauuauug

SEQ ID NO: 1205061 - RNA, 19 nt, Homo sapiens
agucaaagccuuaguaauu

SEQ ID NO: 1205062 - RNA, 19 nt, Homo sapiens
caaagaaggcccuguccua

SEQ ID NO: 1205063 - RNA, 19 nt, Homo sapiens
gaacuuaugacgucuggaa

SEQ ID NO: 1205064 - RNA, 19 nt, Homo sapiens
ucagugcuaucaaguagua

SEQ ID NO: 1205065 - RNA, 19 nt, Homo sapiens
guaccuccuuucuuaagua

SEQ ID NO: 1205066 - RNA, 19 nt, Homo sapiens
caacguggcuucuguuugc

SEQ ID NO: 1205067 - RNA, 19 nt, Homo sapiens
gcaugaaauugaaucuuug

SEQ ID NO: 1205068 - RNA, 19 nt, Homo sapiens
gaaauuggaaggagaguuc

SEQ ID NO: 1205069 - RNA, 19 nt, Homo sapiens
gcagcaggaugauaucgaa

SEQ ID NO: 1205070 - RNA, 19 nt, Homo sapiens
uaaagaagaagcugaaaug

SEQ ID NO: 1205071 - RNA, 19 nt, Homo sapiens
ccagaagcaugaaauugaa

SEQ ID NO: 1205072 - RNA, 19 nt, Homo sapiens
gaacuccaccuaucauuca

SEQ ID NO: 1205073 - RNA, 19 nt, Homo sapiens
caaagugggucguuucucu

SEQ ID NO: 1205074 - RNA, 19 nt, Homo sapiens
ggagaccucacuagucaua

SEQ ID NO: 1205075 - RNA, 19 nt, Homo sapiens
gcaacaagcagcccuccua

SEQ ID NO: 1205076 - RNA, 19 nt, Homo sapiens
gaaggaugcauacgacaaa

SEQ ID NO: 1205077 - RNA, 19 nt, Homo sapiens
caguauggcuuuccagcua

SEQ ID NO: 1205078 - RNA, 19 nt, Homo sapiens
guacuucuacuccuacuuu

SEQ ID NO: 1205079 - RNA, 19 nt, Homo sapiens
cacagcaccuccaaacuuu

SEQ ID NO: 1205080 - RNA, 19 nt, Homo sapiens
gagagucguuuguggauca

SEQ ID NO: 1205081 - RNA, 19 nt, Homo sapiens
caacugugguuccuaguca

SEQ ID NO: 1205082 - RNA, 19 nt, Homo sapiens
caacagacaguuucauaug

SEQ ID NO: 1205083 - RNA, 19 nt, Homo sapiens
ucgaagagcuggagaccaa

SEQ ID NO: 1205084 - RNA, 19 nt, Homo sapiens
acccaaagcuccuggaauu

SEQ ID NO: 1205085 - RNA, 19 nt, Homo sapiens
ggucacaccugggcaaguu

SEQ ID NO: 1205086 - RNA, 19 nt, Homo sapiens
gcaaacuccugacuucuac

SEQ ID NO: 1205087 - RNA, 19 nt, Homo sapiens
ccaggagauucaaauauug

SEQ ID NO: 1205088 - RNA, 19 nt, Homo sapiens
cccaggagauucaaauauu

SEQ ID NO: 1205089 - RNA, 19 nt, Homo sapiens
gaucuuaaaugugacaaca

SEQ ID NO: 1205090 - RNA, 19 nt, Homo sapiens
agucagauaucgaagauga

SEQ ID NO: 1205091 - RNA, 19 nt, Homo sapiens
ucagagccuucacaucuaa

SEQ ID NO: 1205092 - RNA, 19 nt, Homo sapiens
gcugaaaccgugguaguua

SEQ ID NO: 1205093 - RNA, 19 nt, Homo sapiens
gaaggagaguucaaacaac

SEQ ID NO: 1205094 - RNA, 19 nt, Homo sapiens
guaguagaaugucaauuag

SEQ ID NO: 1205095 - RNA, 19 nt, Homo sapiens
caacagacagugcaguauu

SEQ ID NO: 1205096 - RNA, 19 nt, Homo sapiens
gaaagauauuccaucaaag

SEQ ID NO: 1205097 - RNA, 19 nt, Homo sapiens
cagcaucccaauauuguua

SEQ ID NO: 1205098 - RNA, 19 nt, Homo sapiens
guagaacaauccagugcuu

SEQ ID NO: 1205099 - RNA, 19 nt, Homo sapiens
gaagauguugcacaagaaa

SEQ ID NO: 1205100 - RNA, 19 nt, Homo sapiens
caaaguagcaauuccugaa

SEQ ID NO: 1205101 - RNA, 19 nt, Homo sapiens
gccagaagcaugaaauuga

SEQ ID NO: 1205102 - RNA, 19 nt, Homo sapiens
ggaccuacuucuacaccuu

SEQ ID NO: 1205103 - RNA, 19 nt, Homo sapiens
gaccauggcuaaagcuauc

SEQ ID NO: 1205104 - RNA, 19 nt, Homo sapiens
gaagacgacgacccacuaa

SEQ ID NO: 1205105 - RNA, 19 nt, Homo sapiens
ucaccgcgaucuuaaaugu

SEQ ID NO: 1205106 - RNA, 19 nt, Homo sapiens
agagaagccugaacuguca

SEQ ID NO: 1205107 - RNA, 19 nt, Homo sapiens
acaguugcuuugccaguua

SEQ ID NO: 1205108 - RNA, 19 nt, Homo sapiens
cuucacagcuguccauuca

SEQ ID NO: 1205109 - RNA, 19 nt, Homo sapiens
cauaucaacuccucaugug

SEQ ID NO: 1205110 - RNA, 19 nt, Homo sapiens
uuaaaggucuucaguuucu

SEQ ID NO: 1205111 - RNA, 19 nt, Homo sapiens
caacugugcaucuccauga

SEQ ID NO: 1205112 - RNA, 19 nt, Homo sapiens
ucauuuaacuccucuuaca

SEQ ID NO: 1205113 - RNA, 19 nt, Homo sapiens
gaaggguguuucucaaguc

SEQ ID NO: 1205114 - RNA, 19 nt, Homo sapiens
guccagagauuaucacagu

SEQ ID NO: 1205115 - RNA, 19 nt, Homo sapiens
ccaagccaccucuaacuaa

SEQ ID NO: 1205116 - RNA, 19 nt, Homo sapiens
ggaagaggcucaacuauga

SEQ ID NO: 1205117 - RNA, 19 nt, Homo sapiens
gaagauguuucgacaguuu

SEQ ID NO: 1205118 - RNA, 19 nt, Homo sapiens
caauggagcuacagauaua

SEQ ID NO: 1205119 - RNA, 19 nt, Homo sapiens
gaacagaacaguugaaauc

SEQ ID NO: 1205120 - RNA, 19 nt, Homo sapiens
gaagaaagucggaauggua

SEQ ID NO: 1205121 - RNA, 19 nt, Homo sapiens
caauuugacuucaccuuua

SEQ ID NO: 1205122 - RNA, 19 nt, Homo sapiens
guaguaugcuuauggauuu

SEQ ID NO: 1205123 - RNA, 19 nt, Homo sapiens
guaguaugcuuauggauuu

SEQ ID NO: 1205124 - RNA, 19 nt, Homo sapiens
gcaaaccucuuguugauca

SEQ ID NO: 1205125 - RNA, 19 nt, Homo sapiens
guagaggccuuugauauuu

SEQ ID NO: 1205126 - RNA, 19 nt, Homo sapiens
ggacagauagaguauguua

SEQ ID NO: 1205127 - RNA, 19 nt, Homo sapiens
gaagaguucuggauagaga

SEQ ID NO: 1205128 - RNA, 19 nt, Homo sapiens
gaaaucacaucugaacaaa

SEQ ID NO: 1205129 - RNA, 19 nt, Homo sapiens
ugacaaugcuccaguguuu

SEQ ID NO: 1205130 - RNA, 19 nt, Homo sapiens
gaauggagauccucagaga

SEQ ID NO: 1205131 - RNA, 19 nt, Homo sapiens
gggaagaacagcaaacuua

SEQ ID NO: 1205132 - RNA, 19 nt, Homo sapiens
gcuuauggauuuaguagua

SEQ ID NO: 1205133 - RNA, 19 nt, Homo sapiens
gcagaaagcugaaaaugaa

SEQ ID NO: 1205134 - RNA, 19 nt, Homo sapiens
gaagaugcaagaauguuua

SEQ ID NO: 1205135 - RNA, 19 nt, Homo sapiens
gauauuaaccucaucacua

SEQ ID NO: 1205136 - RNA, 19 nt, Homo sapiens
gcacaaauguuucagaacu

SEQ ID NO: 1205137 - RNA, 19 nt, Homo sapiens
ggacuacuaugaacuuguu

SEQ ID NO: 1205138 - RNA, 19 nt, Homo sapiens
gaacagcaccggaagaguu

SEQ ID NO: 1205139 - RNA, 19 nt, Homo sapiens
gaacucaaaucagaaccua

SEQ ID NO: 1205140 - RNA, 19 nt, Homo sapiens
ugaagaaccuacaacaauu

SEQ ID NO: 1205141 - RNA, 19 nt, Homo sapiens
caacagggcuuaucaccau

SEQ ID NO: 1205142 - RNA, 19 nt, Homo sapiens
ccuaugauguguauguuua

SEQ ID NO: 1205143 - RNA, 19 nt, Homo sapiens
gaacauacacuccauugug

SEQ ID NO: 1205144 - RNA, 19 nt, Homo sapiens
gaucauagucuucaaguug

SEQ ID NO: 1205145 - RNA, 19 nt, Homo sapiens
caacagagccaucgauaga

SEQ ID NO: 1205146 - RNA, 19 nt, Homo sapiens
gaauggaccucuggauuau

SEQ ID NO: 1205147 - RNA, 19 nt, Homo sapiens
gcacuauuaucuaccauga

SEQ ID NO: 1205148 - RNA, 19 nt, Homo sapiens
caucacagguguuaucuau

SEQ ID NO: 1205149 - RNA, 19 nt, Homo sapiens
ggacauugaugauaacagu

SEQ ID NO: 1205150 - RNA, 19 nt, Homo sapiens
ggaaauauaguguuaagga

SEQ ID NO: 1205151 - RNA, 19 nt, Homo sapiens
ugacagacauaagguauuu

SEQ ID NO: 1205152 - RNA, 19 nt, Homo sapiens
gggcaaaccucuuguugau

SEQ ID NO: 1205153 - RNA, 19 nt, Homo sapiens
caacugaagaggcaaauuu

SEQ ID NO: 1205154 - RNA, 19 nt, Homo sapiens
uaacacgagucaaucuuaa

SEQ ID NO: 1205155 - RNA, 19 nt, Homo sapiens
gaucacauaugaaauccuu

SEQ ID NO: 1205156 - RNA, 19 nt, Homo sapiens
gaagaaccuacaacaauuu

SEQ ID NO: 1205157 - RNA, 19 nt, Homo sapiens
ggacuaccauccuucaaau

SEQ ID NO: 1205158 - RNA, 19 nt, Homo sapiens
gacuucaccuuuaagaaua

SEQ ID NO: 1205159 - RNA, 19 nt, Homo sapiens
cuacuucacuguaauguug

SEQ ID NO: 1205160 - RNA, 19 nt, Homo sapiens
caacaacgacaguguguaa

SEQ ID NO: 1205161 - RNA, 19 nt, Homo sapiens
guagacggaucacuuaaga

SEQ ID NO: 1205162 - RNA, 19 nt, Homo sapiens
ggaaaucacaucugaacaa

SEQ ID NO: 1205163 - RNA, 19 nt, Homo sapiens
gaaauaaggcaaggugaaa

SEQ ID NO: 1205164 - RNA, 19 nt, Homo sapiens
caggaaacaucaacaaguu

SEQ ID NO: 1205165 - RNA, 19 nt, Homo sapiens
ugaauggaccucuggauua

SEQ ID NO: 1205166 - RNA, 19 nt, Homo sapiens
ggcaacagauggagcagua

SEQ ID NO: 1205167 - RNA, 19 nt, Homo sapiens
gagacuucaucaucaauaa

SEQ ID NO: 1205168 - RNA, 19 nt, Homo sapiens
ggagagagacaccuauuug

SEQ ID NO: 1205169 - RNA, 19 nt, Homo sapiens
gugaaacacugaugauaga

SEQ ID NO: 1205170 - RNA, 19 nt, Homo sapiens
gaucaggaccggaauauuc

SEQ ID NO: 1205171 - RNA, 19 nt, Homo sapiens
gaacugaaccccauuauug

SEQ ID NO: 1205172 - RNA, 19 nt, Homo sapiens
gaagaaauacuaccgaagu

SEQ ID NO: 1205173 - RNA, 19 nt, Homo sapiens
ucacagguguuaucuaugu

SEQ ID NO: 1205174 - RNA, 19 nt, Homo sapiens
uaacauaugccauugagaa

SEQ ID NO: 1205175 - RNA, 19 nt, Homo sapiens
gacuggaaauauaguguua

SEQ ID NO: 1205176 - RNA, 19 nt, Homo sapiens
ggagaaugaugguaugcuu

SEQ ID NO: 1205177 - RNA, 19 nt, Homo sapiens
gcuaacauguacagucaaa

SEQ ID NO: 1205178 - RNA, 19 nt, Homo sapiens
ccuagaagauuacaccaaa

SEQ ID NO: 1205179 - RNA, 19 nt, Homo sapiens
caaauggacagauagagua

SEQ ID NO: 1205180 - RNA, 19 nt, Homo sapiens
guacaauucugguggacaa

SEQ ID NO: 1205181 - RNA, 19 nt, Homo sapiens
ccaggaggcugaugaggaa

SEQ ID NO: 1205182 - RNA, 19 nt, Homo sapiens
ucacauuucuaucugauga

SEQ ID NO: 1205183 - RNA, 19 nt, Homo sapiens
gaacaaugccaccugguau

SEQ ID NO: 1205184 - RNA, 19 nt, Homo sapiens
agauaagacucgcuacuuu

SEQ ID NO: 1205185 - RNA, 19 nt, Homo sapiens
ggauuuaguaguaugcuua

SEQ ID NO: 1205186 - RNA, 19 nt, Homo sapiens
gcuauaacauguagucauc

SEQ ID NO: 1205187 - RNA, 19 nt, Homo sapiens
aaacuuagcagaacuugaa

SEQ ID NO: 1205188 - RNA, 19 nt, Homo sapiens
aaacagacccucagagaga

SEQ ID NO: 1205189 - RNA, 19 nt, Homo sapiens
gagagacaccuauuuguau

SEQ ID NO: 1205190 - RNA, 19 nt, Homo sapiens
cuacagacaguuuaaagua

SEQ ID NO: 1205191 - RNA, 19 nt, Homo sapiens
gaaggcuacugauaaagau

SEQ ID NO: 1205192 - RNA, 19 nt, Homo sapiens
cagcuaaaguauacauuga

SEQ ID NO: 1205193 - RNA, 19 nt, Homo sapiens
uagaggccuuugauauuua

SEQ ID NO: 1205194 - RNA, 19 nt, Homo sapiens
gguagaggccuuugauauu

SEQ ID NO: 1205195 - RNA, 19 nt, Homo sapiens
cagugaagcuuaacagaga

SEQ ID NO: 1205196 - RNA, 19 nt, Homo sapiens
aaauaaaucucaggugcua

SEQ ID NO: 1205197 - RNA, 19 nt, Homo sapiens
ucaaucuacuucacuguaa

SEQ ID NO: 1205198 - RNA, 19 nt, Homo sapiens
ccaaacaucucuccuucug

SEQ ID NO: 1205199 - RNA, 19 nt, Homo sapiens
guacaaagacugcacgaau

SEQ ID NO: 1205200 - RNA, 19 nt, Homo sapiens
gcuaaaguauacauugaga

SEQ ID NO: 1205201 - RNA, 19 nt, Homo sapiens
ugaagaagauacauuugga

SEQ ID NO: 1205202 - RNA, 19 nt, Homo sapiens
aaaugugucuuaccggaua

SEQ ID NO: 1205203 - RNA, 19 nt, Homo sapiens
acacagcagugaagcuuaa

SEQ ID NO: 1205204 - RNA, 19 nt, Homo sapiens
ugaaauauccuaugaugug

SEQ ID NO: 1205205 - RNA, 19 nt, Homo sapiens
gacaauggagcuacagaua

SEQ ID NO: 1205206 - RNA, 19 nt, Homo sapiens
ugacuuaagugcccauaau

SEQ ID NO: 1205207 - RNA, 19 nt, Homo sapiens
aaacugaagucugcaagaa

SEQ ID NO: 1205208 - RNA, 19 nt, Homo sapiens
uacaaagacugcacgaauu

SEQ ID NO: 1205209 - RNA, 19 nt, Homo sapiens
gcucuggccuucaucauca

SEQ ID NO: 1205210 - RNA, 19 nt, Homo sapiens
gagugaaggcuacugauaa

SEQ ID NO: 1205211 - RNA, 19 nt, Homo sapiens
ggaacaaugccaccuggua

SEQ ID NO: 1205212 - RNA, 19 nt, Homo sapiens
ggagaacuaucgcuuuuaa

SEQ ID NO: 1205213 - RNA, 19 nt, Homo sapiens
gauaagaagcccagaagug

SEQ ID NO: 1205214 - RNA, 19 nt, Homo sapiens
ggccaaagaugucgaccuu

SEQ ID NO: 1205215 - RNA, 19 nt, Homo sapiens
gaaauauccuaugaugugu

SEQ ID NO: 1205216 - RNA, 19 nt, Homo sapiens
ggugugaacugaccucuaa

SEQ ID NO: 1205217 - RNA, 19 nt, Homo sapiens
ugaaugagguggugauuga

SEQ ID NO: 1205218 - RNA, 19 nt, Homo sapiens
gaacugaagagcuguguuu

SEQ ID NO: 1205219 - RNA, 19 nt, Homo sapiens
gcaaaucagucgguugaaa

SEQ ID NO: 1205220 - RNA, 19 nt, Homo sapiens
gaugagaccuggaguuaca

SEQ ID NO: 1205221 - RNA, 19 nt, Homo sapiens
uaaagaagcgugagaaaug

SEQ ID NO: 1205222 - RNA, 19 nt, Homo sapiens
cagcauggguguccuuuga

SEQ ID NO: 1205223 - RNA, 19 nt, Homo sapiens
ggaagcaggccaugcagua

SEQ ID NO: 1205224 - RNA, 19 nt, Homo sapiens
ccaggaagguaguuuaaau

SEQ ID NO: 1205225 - RNA, 19 nt, Homo sapiens
ccaaagagcguccuuguca

SEQ ID NO: 1205226 - RNA, 19 nt, Homo sapiens
caauggaaauggaacaaga

SEQ ID NO: 1205227 - RNA, 19 nt, Homo sapiens
gcaacuguaaugagaauuu

SEQ ID NO: 1205228 - RNA, 19 nt, Homo sapiens
gugcugauguacauacuuu

SEQ ID NO: 1205229 - RNA, 19 nt, Homo sapiens
ccaaguuacucaggugaua

SEQ ID NO: 1205230 - RNA, 19 nt, Homo sapiens
ggaaugaucuagaaaacuu

SEQ ID NO: 1205231 - RNA, 19 nt, Homo sapiens
caauuuccaugccaggaua

SEQ ID NO: 1205232 - RNA, 19 nt, Homo sapiens
gcgaugagaccuggaguua

SEQ ID NO: 1205233 - RNA, 19 nt, Homo sapiens
ggagacagcaucagcauca

SEQ ID NO: 1205234 - RNA, 19 nt, Homo sapiens
gaugacauuuccaaucaga

SEQ ID NO: 1205235 - RNA, 19 nt, Homo sapiens
gaccuguccuucaauguug

SEQ ID NO: 1205236 - RNA, 19 nt, Homo sapiens
gaaauucagaggagucaga

SEQ ID NO: 1205237 - RNA, 19 nt, Homo sapiens
caucauagccacuccuuug

SEQ ID NO: 1205238 - RNA, 19 nt, Homo sapiens
gaccaugaauaaggaauug

SEQ ID NO: 1205239 - RNA, 19 nt, Homo sapiens
ggaagaagcaagcccacuu

SEQ ID NO: 1205240 - RNA, 19 nt, Homo sapiens
ugacauuuccaaucagaua

SEQ ID NO: 1205241 - RNA, 19 nt, Homo sapiens
ggacucaacacgcugauuc

SEQ ID NO: 1205242 - RNA, 19 nt, Homo sapiens
ggacggaagagacaagaga

SEQ ID NO: 1205243 - RNA, 19 nt, Homo sapiens
gcauggguguccuuugaug

SEQ ID NO: 1205244 - RNA, 19 nt, Homo sapiens
ccuccuaccuguccaaugu

SEQ ID NO: 1205245 - RNA, 19 nt, Homo sapiens
cgccagcgaugaaagcuuu

SEQ ID NO: 1205246 - RNA, 19 nt, Homo sapiens
ucagauagacuucaucauc

SEQ ID NO: 1205247 - RNA, 19 nt, Homo sapiens
ugaccgaagugcucauuuc

SEQ ID NO: 1205248 - RNA, 19 nt, Homo sapiens
caaaucagucgguugaaau

SEQ ID NO: 1205249 - RNA, 19 nt, Homo sapiens
acaaugggcugggugagaa

SEQ ID NO: 1205250 - RNA, 19 nt, Homo sapiens
uuucugaagugcugaugua

SEQ ID NO: 1205251 - RNA, 19 nt, Homo sapiens
gaagacggccgugcacaau

SEQ ID NO: 1205252 - RNA, 19 nt, Homo sapiens
cauagccacuccuuuguca

SEQ ID NO: 1205253 - RNA, 19 nt, Homo sapiens
gaagacggcaguguucaga

SEQ ID NO: 1205254 - RNA, 19 nt, Homo sapiens
gggcagugaagaagaaauu

SEQ ID NO: 1205255 - RNA, 19 nt, Homo sapiens
gucauugaaagccuuauua

SEQ ID NO: 1205256 - RNA, 19 nt, Homo sapiens
acacgaaguugcccucauc

SEQ ID NO: 1205257 - RNA, 19 nt, Homo sapiens
ccaaucagauagacuucau

SEQ ID NO: 1205258 - RNA, 19 nt, Homo sapiens
aaaugaccaugaauaagga

SEQ ID NO: 1205259 - RNA, 19 nt, Homo sapiens
ccagagagcaggcaucagu

SEQ ID NO: 1205260 - RNA, 19 nt, Homo sapiens
guaccuuucgagaagauua

SEQ ID NO: 1205261 - RNA, 19 nt, Homo sapiens
aggagaacaugaucgugua

SEQ ID NO: 1205262 - RNA, 19 nt, Homo sapiens
gugagcgacugguuugaga

SEQ ID NO: 1205263 - RNA, 19 nt, Homo sapiens
aaaagaaagugcuagaaga

SEQ ID NO: 1205264 - RNA, 19 nt, Homo sapiens
caaagagcguccuugucau

SEQ ID NO: 1205265 - RNA, 19 nt, Homo sapiens
guccagacgcggcugcuua

SEQ ID NO: 1205266 - RNA, 19 nt, Homo sapiens
agacggcaguguucagaau

SEQ ID NO: 1205267 - RNA, 19 nt, Homo sapiens
gacagcaucagcaucacua

SEQ ID NO: 1205268 - RNA, 19 nt, Homo sapiens
cgaccuguccuucaauguu

SEQ ID NO: 1205269 - RNA, 19 nt, Homo sapiens
ccgcaaaucagucgguuga

SEQ ID NO: 1205270 - RNA, 19 nt, Homo sapiens
aaagaagcgugagaaaugg

SEQ ID NO: 1205271 - RNA, 19 nt, Homo sapiens
gaagugcugauguacauac

SEQ ID NO: 1205272 - RNA, 19 nt, Homo sapiens
ucacugugguccugaacug

SEQ ID NO: 1205273 - RNA, 19 nt, Homo sapiens
gagacgggacgcugcugua

SEQ ID NO: 1205274 - RNA, 19 nt, Homo sapiens
gaaaagaaagugcuagaag

SEQ ID NO: 1205275 - RNA, 19 nt, Homo sapiens
cugaagugcugauguacau

SEQ ID NO: 1205276 - RNA, 19 nt, Homo sapiens
cagcaucuguggacuugag

SEQ ID NO: 1205277 - RNA, 19 nt, Homo sapiens
gacucgaccuguccuucaa

SEQ ID NO: 1205278 - RNA, 19 nt, Homo sapiens
cccagugccugcauuggaa

SEQ ID NO: 1205279 - RNA, 19 nt, Homo sapiens
gagaagauuaugaugacau

SEQ ID NO: 1205280 - RNA, 19 nt, Homo sapiens
caugcccggugaccacuuu

SEQ ID NO: 1205281 - RNA, 19 nt, Homo sapiens
gccgugggcuuaggagaga

SEQ ID NO: 1205282 - RNA, 19 nt, Homo sapiens
gcaaggcgguuuuguucug

SEQ ID NO: 1205283 - RNA, 19 nt, Homo sapiens
gcacggccacuuccuuucu

SEQ ID NO: 1205284 - RNA, 19 nt, Homo sapiens
ggaggacacgcucucuuca

SEQ ID NO: 1205285 - RNA, 19 nt, Homo sapiens
gcuggaagacggcaguguu

SEQ ID NO: 1205286 - RNA, 19 nt, Homo sapiens
ggaagguaguuuaaauccu

SEQ ID NO: 1205287 - RNA, 19 nt, Homo sapiens
gugcucauuuccugacaau

SEQ ID NO: 1205288 - RNA, 19 nt, Homo sapiens
gcaauuuccaugccaggau

SEQ ID NO: 1205289 - RNA, 19 nt, Homo sapiens
gccuccagcugccgcaauu

SEQ ID NO: 1205290 - RNA, 19 nt, Homo sapiens
cuaaagaagcgugagaaau

SEQ ID NO: 1205291 - RNA, 19 nt, Homo sapiens
ucgagaagauuaugaugac

SEQ ID NO: 1205292 - RNA, 19 nt, Homo sapiens
cggcugacguggaacaagu

SEQ ID NO: 1205293 - RNA, 19 nt, Homo sapiens
aggacacgcucucuucaug

SEQ ID NO: 1205294 - RNA, 19 nt, Homo sapiens
gagcaggcaucaguguuuu

SEQ ID NO: 1205295 - RNA, 19 nt, Homo sapiens
acacauuccucacguagcu

SEQ ID NO: 1205296 - RNA, 19 nt, Homo sapiens
cugcaggccuggacaugga

SEQ ID NO: 1205297 - RNA, 19 nt, Homo sapiens
agacggccgugcacaaugg

SEQ ID NO: 1205298 - RNA, 19 nt, Homo sapiens
gagagcaggcaucaguguu

SEQ ID NO: 1205299 - RNA, 19 nt, Homo sapiens
ggagaacaugaucguguau

SEQ ID NO: 1205300 - RNA, 19 nt, Homo sapiens
gaugggaaugaucuagaaa

SEQ ID NO: 1205301 - RNA, 19 nt, Homo sapiens
gaccagagagcaggcauca

SEQ ID NO: 1205302 - RNA, 19 nt, Homo sapiens
uaacacagcgagggacuca

SEQ ID NO: 1205303 - RNA, 19 nt, Homo sapiens
uugcuucccuuuccaguca

SEQ ID NO: 1205304 - RNA, 19 nt, Homo sapiens
gauccuugcuucccuuucc

SEQ ID NO: 1205305 - RNA, 19 nt, Homo sapiens
cagucgagcugaagaucau

SEQ ID NO: 1205306 - RNA, 19 nt, Homo sapiens
gcagucgagcugaagauca

SEQ ID NO: 1205307 - RNA, 19 nt, Homo sapiens
agagcaggcaucaguguuu

SEQ ID NO: 1205308 - RNA, 19 nt, Homo sapiens
cgauaaggaaggcacaaga

SEQ ID NO: 1205309 - RNA, 19 nt, Homo sapiens
aaaucagucgguugaaauu

SEQ ID NO: 1205310 - RNA, 19 nt, Homo sapiens
ccacuuccuuucuguagcu

SEQ ID NO: 1205311 - RNA, 19 nt, Homo sapiens
ccauucagcuuugagaacu

SEQ ID NO: 1205312 - RNA, 19 nt, Homo sapiens
ugagcagguuggcacuuug

SEQ ID NO: 1205313 - RNA, 19 nt, Homo sapiens
gcucugcacgcaccucaug

SEQ ID NO: 1205314 - RNA, 19 nt, Homo sapiens
gaucaugcugucaccugaa

SEQ ID NO: 1205315 - RNA, 19 nt, Homo sapiens
gagagaugccagccuacug

SEQ ID NO: 1205316 - RNA, 19 nt, Homo sapiens
ggaagaaucuccaaaugua

SEQ ID NO: 1205317 - RNA, 19 nt, Homo sapiens
ggagaaagaccauauaaau

SEQ ID NO: 1205318 - RNA, 19 nt, Homo sapiens
gagaggacauugaggagua

SEQ ID NO: 1205319 - RNA, 19 nt, Homo sapiens
gaauuaaugugaagucaga

SEQ ID NO: 1205320 - RNA, 19 nt, Homo sapiens
agaaauaccuucagcaaug

SEQ ID NO: 1205321 - RNA, 19 nt, Homo sapiens
guacauaccuaacucaaca

SEQ ID NO: 1205322 - RNA, 19 nt, Homo sapiens
gcagauacaacauagauuu

SEQ ID NO: 1205323 - RNA, 19 nt, Homo sapiens
ggacguaucuguggacuuc

SEQ ID NO: 1205324 - RNA, 19 nt, Homo sapiens
gaacucauguuagagagaa

SEQ ID NO: 1205325 - RNA, 19 nt, Homo sapiens
gagaaacccuaugaaugua

SEQ ID NO: 1205326 - RNA, 19 nt, Homo sapiens
gugaaacccuauauuugua

SEQ ID NO: 1205327 - RNA, 19 nt, Homo sapiens
ggacugauccagcauuuga

SEQ ID NO: 1205328 - RNA, 19 nt, Homo sapiens
ugacacaccuggaaagaga

SEQ ID NO: 1205329 - RNA, 19 nt, Homo sapiens
gaauacaucuuucuaucca

SEQ ID NO: 1205330 - RNA, 19 nt, Homo sapiens
caaaguucaucucuuauuc

SEQ ID NO: 1205331 - RNA, 19 nt, Homo sapiens
gaacuacauuguggccuaa

SEQ ID NO: 1205332 - RNA, 19 nt, Homo sapiens
gagaaagaccauauaaaug

SEQ ID NO: 1205333 - RNA, 19 nt, Homo sapiens
gaaauaccuucagcaaugu

SEQ ID NO: 1205334 - RNA, 19 nt, Homo sapiens
ggaaaagccuucagcugua

SEQ ID NO: 1205335 - RNA, 19 nt, Homo sapiens
ggagacagauggagcucaa

SEQ ID NO: 1205336 - RNA, 19 nt, Homo sapiens
gagaagcagauacaacaua

SEQ ID NO: 1205337 - RNA, 19 nt, Homo sapiens
ggaaagagaagcagauaca

SEQ ID NO: 1205338 - RNA, 19 nt, Homo sapiens
gcaauguugugugaaauau

SEQ ID NO: 1205339 - RNA, 19 nt, Homo sapiens
agacauccuucaucgcuua

SEQ ID NO: 1205340 - RNA, 19 nt, Homo sapiens
agccaaaguucaucucuua

SEQ ID NO: 1205341 - RNA, 19 nt, Homo sapiens
gaagaaucuccaaauguaa

SEQ ID NO: 1205342 - RNA, 19 nt, Homo sapiens
caucaaagaaucuauguug

SEQ ID NO: 1205343 - RNA, 19 nt, Homo sapiens
ggugugaaacccuauauuu

SEQ ID NO: 1205344 - RNA, 19 nt, Homo sapiens
gaaguugcgucauccaaag

SEQ ID NO: 1205345 - RNA, 19 nt, Homo sapiens
gaaaagcccuaugaaugua

SEQ ID NO: 1205346 - RNA, 19 nt, Homo sapiens
ugagaaacccuaugaaugu

SEQ ID NO: 1205347 - RNA, 19 nt, Homo sapiens
ugacuaagauguuuaaagc

SEQ ID NO: 1205348 - RNA, 19 nt, Homo sapiens
guucaucccuuauuagaca

SEQ ID NO: 1205349 - RNA, 19 nt, Homo sapiens
ggaugugacuaagauguuu

SEQ ID NO: 1205350 - RNA, 19 nt, Homo sapiens
gggaggaugugacuaagau

SEQ ID NO: 1205351 - RNA, 19 nt, Homo sapiens
ugucagagcuuccagcaau

SEQ ID NO: 1205352 - RNA, 19 nt, Homo sapiens
uguaguucaucccuuauua

SEQ ID NO: 1205353 - RNA, 19 nt, Homo sapiens
gaguaggagucggcgauua

SEQ ID NO: 1205354 - RNA, 19 nt, Homo sapiens
gaauguaggguaugugaga

SEQ ID NO: 1205355 - RNA, 19 nt, Homo sapiens
ucagugggaugucagcuuu

SEQ ID NO: 1205356 - RNA, 19 nt, Homo sapiens
caagagaaccaaagaaugg

SEQ ID NO: 1205357 - RNA, 19 nt, Homo sapiens
ucagcaauguugugugaaa

SEQ ID NO: 1205358 - RNA, 19 nt, Homo sapiens
gagaauucauacuggagaa

SEQ ID NO: 1205359 - RNA, 19 nt, Homo sapiens
caacaccagagaacucaua

SEQ ID NO: 1205360 - RNA, 19 nt, Homo sapiens
aaugugaagucagaaguua

SEQ ID NO: 1205361 - RNA, 19 nt, Homo sapiens
ggagagaggccaagagucu

SEQ ID NO: 1205362 - RNA, 19 nt, Homo sapiens
uaagaaauaccuucagcaa

SEQ ID NO: 1205363 - RNA, 19 nt, Homo sapiens
cuucaucgcuuacucaaca

SEQ ID NO: 1205364 - RNA, 19 nt, Homo sapiens
guuaaucauucaaggaguu

SEQ ID NO: 1205365 - RNA, 19 nt, Homo sapiens
cuagaaagccaacaagaga

SEQ ID NO: 1205366 - RNA, 19 nt, Homo sapiens
aaaggaagcagcauguauu

SEQ ID NO: 1205367 - RNA, 19 nt, Homo sapiens
ggaaagauuuacaaaagga

SEQ ID NO: 1205368 - RNA, 19 nt, Homo sapiens
ccaaaguucaucucuuauu

SEQ ID NO: 1205369 - RNA, 19 nt, Homo sapiens
aaacagcuuauucaccuua

SEQ ID NO: 1205370 - RNA, 19 nt, Homo sapiens
gggaagaaucuccaaaugu

SEQ ID NO: 1205371 - RNA, 19 nt, Homo sapiens
gaaacccuaugaauguaag

SEQ ID NO: 1205372 - RNA, 19 nt, Homo sapiens
ggaaaagcccuaugaaugu

SEQ ID NO: 1205373 - RNA, 19 nt, Homo sapiens
gugagaaacccuaugaaug

SEQ ID NO: 1205374 - RNA, 19 nt, Homo sapiens
caacaagagaaccaaagaa

SEQ ID NO: 1205375 - RNA, 19 nt, Homo sapiens
ggagaaaggagaagaacca

SEQ ID NO: 1205376 - RNA, 19 nt, Homo sapiens
gaugucagcuuuccaaacc

SEQ ID NO: 1205377 - RNA, 19 nt, Homo sapiens
cuucagcaauguuguguga

SEQ ID NO: 1205378 - RNA, 19 nt, Homo sapiens
ccugagagccgaugauaga

SEQ ID NO: 1205379 - RNA, 19 nt, Homo sapiens
gagagauauuucaggaguu

SEQ ID NO: 1205380 - RNA, 19 nt, Homo sapiens
gggaaaaccuucagacauc

SEQ ID NO: 1205381 - RNA, 19 nt, Homo sapiens
uuaaggagaucgguacaau

SEQ ID NO: 1205382 - RNA, 19 nt, Homo sapiens
agaagcagauacaacauag

SEQ ID NO: 1205383 - RNA, 19 nt, Homo sapiens
uuccaaaccuggcgugauu

SEQ ID NO: 1205384 - RNA, 19 nt, Homo sapiens
gggaggugaugcuggagaa

SEQ ID NO: 1205385 - RNA, 19 nt, Homo sapiens
caucagagaauucauacug

SEQ ID NO: 1205386 - RNA, 19 nt, Homo sapiens
caucagagaauucauacug

SEQ ID NO: 1205387 - RNA, 19 nt, Homo sapiens
gaaagagaagcagauacaa

SEQ ID NO: 1205388 - RNA, 19 nt, Homo sapiens
gagucagccuuacagaaug

SEQ ID NO: 1205389 - RNA, 19 nt, Homo sapiens
aaccaaagagucagccuua

SEQ ID NO: 1205390 - RNA, 19 nt, Homo sapiens
ggugagaaacccuaugaau

SEQ ID NO: 1205391 - RNA, 19 nt, Homo sapiens
aaggagaucgguacaauug

SEQ ID NO: 1205392 - RNA, 19 nt, Homo sapiens
ucaaagaaucuauguugga

SEQ ID NO: 1205393 - RNA, 19 nt, Homo sapiens
gggaaaagcccuaugaaug

SEQ ID NO: 1205394 - RNA, 19 nt, Homo sapiens
gaaguuaugccaggaccaa

SEQ ID NO: 1205395 - RNA, 19 nt, Homo sapiens
gccuaaugauggaaagauu

SEQ ID NO: 1205396 - RNA, 19 nt, Homo sapiens
gaugugacuaagauguuua

SEQ ID NO: 1205397 - RNA, 19 nt, Homo sapiens
gagaacucauacuggagaa

SEQ ID NO: 1205398 - RNA, 19 nt, Homo sapiens
aguaaaaccuucagccaua

SEQ ID NO: 1205399 - RNA, 19 nt, Homo sapiens
ucaccuuacugaacacaug

SEQ ID NO: 1205400 - RNA, 19 nt, Homo sapiens
ugaaaaccuuugaguguaa

SEQ ID NO: 1205401 - RNA, 19 nt, Homo sapiens
ugggaagaaucuccaaaug

SEQ ID NO: 1205402 - RNA, 19 nt, Homo sapiens
caucagagaguccauacug

SEQ ID NO: 1205403 - RNA, 19 nt, Homo sapiens
gaacucauacuggagaaag

SEQ ID NO: 1205404 - RNA, 19 nt, Homo sapiens
gagagaaaccuuuuacaug

SEQ ID NO: 1205405 - RNA, 19 nt, Homo sapiens
ccaaauguaauaagcuaga

SEQ ID NO: 1205406 - RNA, 19 nt, Homo sapiens
cauaguacauaccuaacuc

SEQ ID NO: 1205407 - RNA, 19 nt, Homo sapiens
ugugaaacccuauauuugu

SEQ ID NO: 1205408 - RNA, 19 nt, Homo sapiens
gugugaaacccuauauuug

SEQ ID NO: 1205409 - RNA, 19 nt, Homo sapiens
ccgcaucagagaauucaua

SEQ ID NO: 1205410 - RNA, 19 nt, Homo sapiens
ccaacaagagaaccaaaga

SEQ ID NO: 1205411 - RNA, 19 nt, Homo sapiens
cuccaaauguaauaagcua

SEQ ID NO: 1205412 - RNA, 19 nt, Homo sapiens
ugggaagccuccugucaga

SEQ ID NO: 1205413 - RNA, 19 nt, Homo sapiens
ccagagcauuggacugauc

SEQ ID NO: 1205414 - RNA, 19 nt, Homo sapiens
uaaagcagaaggaacuguu

SEQ ID NO: 1205415 - RNA, 19 nt, Homo sapiens
uuacugaacacaugagaau

SEQ ID NO: 1205416 - RNA, 19 nt, Homo sapiens
gaaaggagauuaacagcua

SEQ ID NO: 1205417 - RNA, 19 nt, Homo sapiens
gaagagcauugauucauuu

SEQ ID NO: 1205418 - RNA, 19 nt, Homo sapiens
ggaagucuaugagaaagua

SEQ ID NO: 1205419 - RNA, 19 nt, Homo sapiens
gagcuagucugucaccuuu

SEQ ID NO: 1205420 - RNA, 19 nt, Homo sapiens
gaaacaagccuuugcugaa

SEQ ID NO: 1205421 - RNA, 19 nt, Homo sapiens
guaaaucaguuuccauuca

SEQ ID NO: 1205422 - RNA, 19 nt, Homo sapiens
cauauaaucucccuggaaa

SEQ ID NO: 1205423 - RNA, 19 nt, Homo sapiens
agaaacagcucgugguauu

SEQ ID NO: 1205424 - RNA, 19 nt, Homo sapiens
gaacaugaaagagaagaua

SEQ ID NO: 1205425 - RNA, 19 nt, Homo sapiens
gagcaacaaugaaauuauc

SEQ ID NO: 1205426 - RNA, 19 nt, Homo sapiens
gcagugagcugagauugug

SEQ ID NO: 1205427 - RNA, 19 nt, Homo sapiens
gagcugauaucaagcacuu

SEQ ID NO: 1205428 - RNA, 19 nt, Homo sapiens
gugcaauaguuccuaauaa

SEQ ID NO: 1205429 - RNA, 19 nt, Homo sapiens
agagauaccuacacucaaa

SEQ ID NO: 1205430 - RNA, 19 nt, Homo sapiens
gagcauugauucauuugga

SEQ ID NO: 1205431 - RNA, 19 nt, Homo sapiens
guagagacccuaaagaaga

SEQ ID NO: 1205432 - RNA, 19 nt, Homo sapiens
gauaucaagcacuuuguua

SEQ ID NO: 1205433 - RNA, 19 nt, Homo sapiens
aagcuaaguuccaauauug

SEQ ID NO: 1205434 - RNA, 19 nt, Homo sapiens
gacaagaaguugauacaag

SEQ ID NO: 1205435 - RNA, 19 nt, Homo sapiens
ggagagcuguuuaauggau

SEQ ID NO: 1205436 - RNA, 19 nt, Homo sapiens
ggagacacuuucaauagau

SEQ ID NO: 1205437 - RNA, 19 nt, Homo sapiens
agagaaaggugguaugaau

SEQ ID NO: 1205438 - RNA, 19 nt, Homo sapiens
acaagaaguugauacaaga

SEQ ID NO: 1205439 - RNA, 19 nt, Homo sapiens
gaaacccugucuguacuaa

SEQ ID NO: 1205440 - RNA, 19 nt, Homo sapiens
agaauggugucucugauuu

SEQ ID NO: 1205441 - RNA, 19 nt, Homo sapiens
gaagauaaaugcgguacgu

SEQ ID NO: 1205442 - RNA, 19 nt, Homo sapiens
ggaaacagaaccagaagga

SEQ ID NO: 1205443 - RNA, 19 nt, Homo sapiens
gaaagaacacuaggaaaca

SEQ ID NO: 1205444 - RNA, 19 nt, Homo sapiens
ccagugauauggauugaau

SEQ ID NO: 1205445 - RNA, 19 nt, Homo sapiens
ucauguggcuguucaaaug

SEQ ID NO: 1205446 - RNA, 19 nt, Homo sapiens
cuaauaagagcaacaauga

SEQ ID NO: 1205447 - RNA, 19 nt, Homo sapiens
gaacuagagucagcaugga

SEQ ID NO: 1205448 - RNA, 19 nt, Homo sapiens
gcaauaguuccuaauaaga

SEQ ID NO: 1205449 - RNA, 19 nt, Homo sapiens
acagcaggauuucguauuu

SEQ ID NO: 1205450 - RNA, 19 nt, Homo sapiens
augaaugucugcaaugaua

SEQ ID NO: 1205451 - RNA, 19 nt, Homo sapiens
ggaaagaacacuaggaaac

SEQ ID NO: 1205452 - RNA, 19 nt, Homo sapiens
guucuugucuccuuauuuc

SEQ ID NO: 1205453 - RNA, 19 nt, Homo sapiens
agaagagcauugauucauu

SEQ ID NO: 1205454 - RNA, 19 nt, Homo sapiens
uaaagaagagcauugauuc

SEQ ID NO: 1205455 - RNA, 19 nt, Homo sapiens
gcaauugguugagcucaga

SEQ ID NO: 1205456 - RNA, 19 nt, Homo sapiens
agugaaagcugaagcaaug

SEQ ID NO: 1205457 - RNA, 19 nt, Homo sapiens
aaacaagccuuugcugaau

SEQ ID NO: 1205458 - RNA, 19 nt, Homo sapiens
ccagugaaguacucaaaga

SEQ ID NO: 1205459 - RNA, 19 nt, Homo sapiens
uaacuggacuuuaggaaac

SEQ ID NO: 1205460 - RNA, 19 nt, Homo sapiens
guaucgaguuguaguuaaa

SEQ ID NO: 1205461 - RNA, 19 nt, Homo sapiens
aaacagaaccagaaggauu

SEQ ID NO: 1205462 - RNA, 19 nt, Homo sapiens
gcaaugauacuuccugaca

SEQ ID NO: 1205463 - RNA, 19 nt, Homo sapiens
gaggaaagaacacuaggaa

SEQ ID NO: 1205464 - RNA, 19 nt, Homo sapiens
gguaucgaguuguaguuaa

SEQ ID NO: 1205465 - RNA, 19 nt, Homo sapiens
gugaaguacucaaagaaug

SEQ ID NO: 1205466 - RNA, 19 nt, Homo sapiens
ucaaaucaguguuuagucu

SEQ ID NO: 1205467 - RNA, 19 nt, Homo sapiens
ugccaaaucucucucaaga

SEQ ID NO: 1205468 - RNA, 19 nt, Homo sapiens
gacaguaacaggcaagaaa

SEQ ID NO: 1205469 - RNA, 19 nt, Homo sapiens
caacugcacacuuccguuu

SEQ ID NO: 1205470 - RNA, 19 nt, Homo sapiens
gaaucugguuggucauuuc

SEQ ID NO: 1205471 - RNA, 19 nt, Homo sapiens
ugaaauggacaaagugaaa

SEQ ID NO: 1205472 - RNA, 19 nt, Homo sapiens
gaauuggagagcuguuuaa

SEQ ID NO: 1205473 - RNA, 19 nt, Homo sapiens
cuagggaagucuaugagaa

SEQ ID NO: 1205474 - RNA, 19 nt, Homo sapiens
cccaaugccuuguuuccua

SEQ ID NO: 1205475 - RNA, 19 nt, Homo sapiens
gaagaggaaagaacacuag

SEQ ID NO: 1205476 - RNA, 19 nt, Homo sapiens
ccaggaaacaccauugaaa

SEQ ID NO: 1205477 - RNA, 19 nt, Homo sapiens
uacaagugcuaacaagaaa

SEQ ID NO: 1205478 - RNA, 19 nt, Homo sapiens
ccaauauucuacuuucugu

SEQ ID NO: 1205479 - RNA, 19 nt, Homo sapiens
gaaaaggaaaggagauuaa

SEQ ID NO: 1205480 - RNA, 19 nt, Homo sapiens
cuugauaacuggacuuuag

SEQ ID NO: 1205481 - RNA, 19 nt, Homo sapiens
gcugcuggcuaccaauauu

SEQ ID NO: 1205482 - RNA, 19 nt, Homo sapiens
cuaaagaagagcauugauu

SEQ ID NO: 1205483 - RNA, 19 nt, Homo sapiens
uuggagagcuguuuaaugg

SEQ ID NO: 1205484 - RNA, 19 nt, Homo sapiens
ggaagguagugccagugaa

SEQ ID NO: 1205485 - RNA, 19 nt, Homo sapiens
gaacagcaggauuucguau

SEQ ID NO: 1205486 - RNA, 19 nt, Homo sapiens
ggagacagagcaagacuca

SEQ ID NO: 1205487 - RNA, 19 nt, Homo sapiens
ggacaaagugaaagcugaa

SEQ ID NO: 1205488 - RNA, 19 nt, Homo sapiens
gaaagaggccagacucacu

SEQ ID NO: 1205489 - RNA, 19 nt, Homo sapiens
caggaaugcugccaaaucu

SEQ ID NO: 1205490 - RNA, 19 nt, Homo sapiens
gagacacuuucaauagaug

SEQ ID NO: 1205491 - RNA, 19 nt, Homo sapiens
uggagacacuuucaauaga

SEQ ID NO: 1205492 - RNA, 19 nt, Homo sapiens
caucccagauuccaguaaa

SEQ ID NO: 1205493 - RNA, 19 nt, Homo sapiens
ggauucaucaggauucauu

SEQ ID NO: 1205494 - RNA, 19 nt, Homo sapiens
ccaaugccuuguuuccuau

SEQ ID NO: 1205495 - RNA, 19 nt, Homo sapiens
agaacgugcuggagauuug

SEQ ID NO: 1205496 - RNA, 19 nt, Homo sapiens
ccaaagaacagcuauucga

SEQ ID NO: 1205497 - RNA, 19 nt, Homo sapiens
acaagugucucauccaaag

SEQ ID NO: 1205498 - RNA, 19 nt, Homo sapiens
guaaauaugaugaggaucu

SEQ ID NO: 1205499 - RNA, 19 nt, Homo sapiens
guaacggcaucccagauuc

SEQ ID NO: 1205500 - RNA, 19 nt, Homo sapiens
cuaccaauauucuacuuuc

SEQ ID NO: 1205501 - RNA, 19 nt, Homo sapiens
ugaaagagaagauaaaugc

SEQ ID NO: 1205502 - RNA, 19 nt, Homo sapiens
caguaugggucguuacaga

SEQ ID NO: 1205503 - RNA, 19 nt, Homo sapiens
caaugaaauuauccugguu

SEQ ID NO: 1205504 - RNA, 19 nt, Homo sapiens
aaaguuagcugagcauggu

SEQ ID NO: 1205505 - RNA, 19 nt, Homo sapiens
caaugauacuuccugacaa

SEQ ID NO: 1205506 - RNA, 19 nt, Homo sapiens
cugguuaccucauauaauc

SEQ ID NO: 1205507 - RNA, 19 nt, Homo sapiens
gaaaaugaaacaagccuuu

SEQ ID NO: 1205508 - RNA, 19 nt, Homo sapiens
gagaaaggugguaugaaug

SEQ ID NO: 1205509 - RNA, 19 nt, Homo sapiens
cucaaagaauggacaguaa

SEQ ID NO: 1205510 - RNA, 19 nt, Homo sapiens
gaaggauucaucaggauuc

SEQ ID NO: 1205511 - RNA, 19 nt, Homo sapiens
ugaauuggagagcuguuua

SEQ ID NO: 1205512 - RNA, 19 nt, Homo sapiens
aaaucucucucaagaccua

SEQ ID NO: 1205513 - RNA, 19 nt, Homo sapiens
caggauccaugcugcagaa

SEQ ID NO: 1205514 - RNA, 19 nt, Homo sapiens
uucaauagaugccagagaa

SEQ ID NO: 1205515 - RNA, 19 nt, Homo sapiens
gcagcacuuugauaacugu

SEQ ID NO: 1205516 - RNA, 19 nt, Homo sapiens
gaauagagcugcaauaaau

SEQ ID NO: 1205517 - RNA, 19 nt, Homo sapiens
gaaauaaggcugagacaaa

SEQ ID NO: 1205518 - RNA, 19 nt, Homo sapiens
ggaaaggguugacuauuga

SEQ ID NO: 1205519 - RNA, 19 nt, Homo sapiens
ugaaugaacuguuaucuga

SEQ ID NO: 1205520 - RNA, 19 nt, Homo sapiens
gaacuuggcuuaacagaac

SEQ ID NO: 1205521 - RNA, 19 nt, Homo sapiens
acagagaccugauuaguuu

SEQ ID NO: 1205522 - RNA, 19 nt, Homo sapiens
gggaaaggguugacuauug

SEQ ID NO: 1205523 - RNA, 19 nt, Homo sapiens
acaaagaacugacaaggaa

SEQ ID NO: 1205524 - RNA, 19 nt, Homo sapiens
gaaggcucaucuuaaauuu

SEQ ID NO: 1205525 - RNA, 19 nt, Homo sapiens
cuagaaggcucaucuuaaa

SEQ ID NO: 1205526 - RNA, 19 nt, Homo sapiens
gcaagaacaugauccuuuc

SEQ ID NO: 1205527 - RNA, 19 nt, Homo sapiens
uaucuuagcuguugugaau

SEQ ID NO: 1205528 - RNA, 19 nt, Homo sapiens
gacgauaccuucagaaauc

SEQ ID NO: 1205529 - RNA, 19 nt, Homo sapiens
aaacaggaauggaugcuuu

SEQ ID NO: 1205530 - RNA, 19 nt, Homo sapiens
gaaagaagcaaugugaauu

SEQ ID NO: 1205531 - RNA, 19 nt, Homo sapiens
uaucuugccuccuccuuua

SEQ ID NO: 1205532 - RNA, 19 nt, Homo sapiens
ggacagaagcaaugaaaga

SEQ ID NO: 1205533 - RNA, 19 nt, Homo sapiens
uaaaugagcuggcagaaaa

SEQ ID NO: 1205534 - RNA, 19 nt, Homo sapiens
gcaggaaaguaagggaaua

SEQ ID NO: 1205535 - RNA, 19 nt, Homo sapiens
ggacuggaaugccaucgaa

SEQ ID NO: 1205536 - RNA, 19 nt, Homo sapiens
caggagaucuucugucuuc

SEQ ID NO: 1205537 - RNA, 19 nt, Homo sapiens
aagaaagaauggcaaagua

SEQ ID NO: 1205538 - RNA, 19 nt, Homo sapiens
gcagguguguguagaguau

SEQ ID NO: 1205539 - RNA, 19 nt, Homo sapiens
gcuacgcagucuccaguua

SEQ ID NO: 1205540 - RNA, 19 nt, Homo sapiens
ucugaugaaugaacuguua

SEQ ID NO: 1205541 - RNA, 19 nt, Homo sapiens
ggauauucaucaccucaaa

SEQ ID NO: 1205542 - RNA, 19 nt, Homo sapiens
gacaaaagaugaagcauga

SEQ ID NO: 1205543 - RNA, 19 nt, Homo sapiens
gaaacaaccauauacagau

SEQ ID NO: 1205544 - RNA, 19 nt, Homo sapiens
gcaccucaguuaugugguu

SEQ ID NO: 1205545 - RNA, 19 nt, Homo sapiens
acaauucccuucuacaaga

SEQ ID NO: 1205546 - RNA, 19 nt, Homo sapiens
aaaccgaguuauauccaua

SEQ ID NO: 1205547 - RNA, 19 nt, Homo sapiens
ggaaaguaagggaauauga

SEQ ID NO: 1205548 - RNA, 19 nt, Homo sapiens
ggucacaguuuucuaauaa

SEQ ID NO: 1205549 - RNA, 19 nt, Homo sapiens
ucugaaagauuaacagguu

SEQ ID NO: 1205550 - RNA, 19 nt, Homo sapiens
uggcagacauucacaaaga

SEQ ID NO: 1205551 - RNA, 19 nt, Homo sapiens
aaacaaccauauacagaug

SEQ ID NO: 1205552 - RNA, 19 nt, Homo sapiens
ggaagaaacaggaauggau

SEQ ID NO: 1205553 - RNA, 19 nt, Homo sapiens
gaaagaagagagauucaag

SEQ ID NO: 1205554 - RNA, 19 nt, Homo sapiens
aaacaaugcuacucuccuu

SEQ ID NO: 1205555 - RNA, 19 nt, Homo sapiens
cagaaaccauugccuaaca

SEQ ID NO: 1205556 - RNA, 19 nt, Homo sapiens
ccuccagaauucagcauua

SEQ ID NO: 1205557 - RNA, 19 nt, Homo sapiens
uugcagacauuauugauga

SEQ ID NO: 1205558 - RNA, 19 nt, Homo sapiens
gugaauagagcugcaauaa

SEQ ID NO: 1205559 - RNA, 19 nt, Homo sapiens
ggaaugccaucgaagacau

SEQ ID NO: 1205560 - RNA, 19 nt, Homo sapiens
gaaucaacauggucacagu

SEQ ID NO: 1205561 - RNA, 19 nt, Homo sapiens
ggcaagaacaugauccuuu

SEQ ID NO: 1205562 - RNA, 19 nt, Homo sapiens
gaacugacaaggaaagaag

SEQ ID NO: 1205563 - RNA, 19 nt, Homo sapiens
ugaagaacuuggcuuaaca

SEQ ID NO: 1205564 - RNA, 19 nt, Homo sapiens
agaagcagguaugguauuu

SEQ ID NO: 1205565 - RNA, 19 nt, Homo sapiens
gaaccaguauccuucaacu

SEQ ID NO: 1205566 - RNA, 19 nt, Homo sapiens
ucaguaacuuugccuuuau

SEQ ID NO: 1205567 - RNA, 19 nt, Homo sapiens
uuaccuggauuagccauua

SEQ ID NO: 1205568 - RNA, 19 nt, Homo sapiens
gugcgagaguguuucagua

SEQ ID NO: 1205569 - RNA, 19 nt, Homo sapiens
cguacggucugaugaauga

SEQ ID NO: 1205570 - RNA, 19 nt, Homo sapiens
gcaaucaaaucaggguaau

SEQ ID NO: 1205571 - RNA, 19 nt, Homo sapiens
cuacucuccuuaccaaauu

SEQ ID NO: 1205572 - RNA, 19 nt, Homo sapiens
ucaacuacuucaucaaugu

SEQ ID NO: 1205573 - RNA, 19 nt, Homo sapiens
guuaugugguucugaaaga

SEQ ID NO: 1205574 - RNA, 19 nt, Homo sapiens
acacugcccuucuccaaga

SEQ ID NO: 1205575 - RNA, 19 nt, Homo sapiens
caaguugaaugcagaagca

SEQ ID NO: 1205576 - RNA, 19 nt, Homo sapiens
gcaauccacuuuacaugac

SEQ ID NO: 1205577 - RNA, 19 nt, Homo sapiens
cuaucaaggcuaaacauua

SEQ ID NO: 1205578 - RNA, 19 nt, Homo sapiens
uauuucagcugccuucuau

SEQ ID NO: 1205579 - RNA, 19 nt, Homo sapiens
gcauaaccuacuuucaaua

SEQ ID NO: 1205580 - RNA, 19 nt, Homo sapiens
cuucagaaauccauaagau

SEQ ID NO: 1205581 - RNA, 19 nt, Homo sapiens
ggacgauaccuucagaaau

SEQ ID NO: 1205582 - RNA, 19 nt, Homo sapiens
ucaaauauauguccaaacc

SEQ ID NO: 1205583 - RNA, 19 nt, Homo sapiens
guaauugggauauucauca

SEQ ID NO: 1205584 - RNA, 19 nt, Homo sapiens
caaagcagcaguaagaaag

SEQ ID NO: 1205585 - RNA, 19 nt, Homo sapiens
gcugcucucugaacacuau

SEQ ID NO: 1205586 - RNA, 19 nt, Homo sapiens
ugacuggauugacugauau

SEQ ID NO: 1205587 - RNA, 19 nt, Homo sapiens
aaagcacacuaucaucuga

SEQ ID NO: 1205588 - RNA, 19 nt, Homo sapiens
uaccaacccugaaucucua

SEQ ID NO: 1205589 - RNA, 19 nt, Homo sapiens
uguaagaccuggauaucau

SEQ ID NO: 1205590 - RNA, 19 nt, Homo sapiens
ugacugauauugcagacau

SEQ ID NO: 1205591 - RNA, 19 nt, Homo sapiens
gaagcaauccacuuuacau

SEQ ID NO: 1205592 - RNA, 19 nt, Homo sapiens
ccagaagcaauccacuuua

SEQ ID NO: 1205593 - RNA, 19 nt, Homo sapiens
gaauggcaaaguacuuaaa

SEQ ID NO: 1205594 - RNA, 19 nt, Homo sapiens
agaaggcucaucuuaaauu

SEQ ID NO: 1205595 - RNA, 19 nt, Homo sapiens
gccaggagaucuucugucu

SEQ ID NO: 1205596 - RNA, 19 nt, Homo sapiens
cucaguaacuuugccuuua

SEQ ID NO: 1205597 - RNA, 19 nt, Homo sapiens
agacggaguuuccagugaa

SEQ ID NO: 1205598 - RNA, 19 nt, Homo sapiens
uggaaacauucaaaccuuu

SEQ ID NO: 1205599 - RNA, 19 nt, Homo sapiens
guacagagaccugauuagu

SEQ ID NO: 1205600 - RNA, 19 nt, Homo sapiens
gaaaccauugccuaacaaa

SEQ ID NO: 1205601 - RNA, 19 nt, Homo sapiens
gauauugcagacauuauug

SEQ ID NO: 1205602 - RNA, 19 nt, Homo sapiens
cagaagcaauccacuuuac

SEQ ID NO: 1205603 - RNA, 19 nt, Homo sapiens
ggaaagaagagagauucaa

SEQ ID NO: 1205604 - RNA, 19 nt, Homo sapiens
ugaauagagcugcaauaaa

SEQ ID NO: 1205605 - RNA, 19 nt, Homo sapiens
aagcagguaugguauuuca

SEQ ID NO: 1205606 - RNA, 19 nt, Homo sapiens
gugcuccaauaaugucaua

SEQ ID NO: 1205607 - RNA, 19 nt, Homo sapiens
aacccugaaucucuaaaua

SEQ ID NO: 1205608 - RNA, 19 nt, Homo sapiens
ccaaagcagcaguaagaaa

SEQ ID NO: 1205609 - RNA, 19 nt, Homo sapiens
ggaaauaaggcugagacaa

SEQ ID NO: 1205610 - RNA, 19 nt, Homo sapiens
gaauggugcgagaguguuu

SEQ ID NO: 1205611 - RNA, 19 nt, Homo sapiens
ucuagaaggcucaucuuaa

SEQ ID NO: 1205612 - RNA, 19 nt, Homo sapiens
gaaaguaagggaauaugac

SEQ ID NO: 1205613 - RNA, 19 nt, Homo sapiens
ggaggaagaaacaggaaug

SEQ ID NO: 1205614 - RNA, 19 nt, Homo sapiens
uuuauuacccucugaguuu

SEQ ID NO: 1205615 - RNA, 19 nt, Homo sapiens
ugucauagucugcagcaua

SEQ ID NO: 1205616 - RNA, 19 nt, Homo sapiens
gagauuaugugucuuauga

SEQ ID NO: 1205617 - RNA, 19 nt, Homo sapiens
gaagggcaaucucaacaua

SEQ ID NO: 1205618 - RNA, 19 nt, Homo sapiens
gaaaggagccugcugaguu

SEQ ID NO: 1205619 - RNA, 19 nt, Homo sapiens
cgagagagcucacaaagga

SEQ ID NO: 1205620 - RNA, 19 nt, Homo sapiens
gaacaaaugccuacggaaa

SEQ ID NO: 1205621 - RNA, 19 nt, Homo sapiens
ccagaagucuugccuugua

SEQ ID NO: 1205622 - RNA, 19 nt, Homo sapiens
gagcauaagagaauucaua

SEQ ID NO: 1205623 - RNA, 19 nt, Homo sapiens
gagagaaacccuauaaaug

SEQ ID NO: 1205624 - RNA, 19 nt, Homo sapiens
gcacaucagagauaucaua

SEQ ID NO: 1205625 - RNA, 19 nt, Homo sapiens
gaaaagcccuguuaauaug

SEQ ID NO: 1205626 - RNA, 19 nt, Homo sapiens
ggaaaaggcuucauucaga

SEQ ID NO: 1205627 - RNA, 19 nt, Homo sapiens
gggaaagccuucuacaaga

SEQ ID NO: 1205628 - RNA, 19 nt, Homo sapiens
gggaaagccuucuacaaga

SEQ ID NO: 1205629 - RNA, 19 nt, Homo sapiens
gaagguaauuacaucuuga

SEQ ID NO: 1205630 - RNA, 19 nt, Homo sapiens
ggaagguaauuacaucuug

SEQ ID NO: 1205631 - RNA, 19 nt, Homo sapiens
gagagaagccucauacaug

SEQ ID NO: 1205632 - RNA, 19 nt, Homo sapiens
cauauugucuccuuuguug

SEQ ID NO: 1205633 - RNA, 19 nt, Homo sapiens
ggagagaaacccuauaaau

SEQ ID NO: 1205634 - RNA, 19 nt, Homo sapiens
caacauacaucaacgaacu

SEQ ID NO: 1205635 - RNA, 19 nt, Homo sapiens
guacaucagcgaacucaua

SEQ ID NO: 1205636 - RNA, 19 nt, Homo sapiens
gaaaguggaacccucauga

SEQ ID NO: 1205637 - RNA, 19 nt, Homo sapiens
gaacacggaagaacuuuga

SEQ ID NO: 1205638 - RNA, 19 nt, Homo sapiens
gaugagauuaugugucuua

SEQ ID NO: 1205639 - RNA, 19 nt, Homo sapiens
aaaggagccugcugaguuu

SEQ ID NO: 1205640 - RNA, 19 nt, Homo sapiens
gaaccacuauggacacuag

SEQ ID NO: 1205641 - RNA, 19 nt, Homo sapiens
ugugagggauugcauauuu

SEQ ID NO: 1205642 - RNA, 19 nt, Homo sapiens
gaacaaggagaaccacuau

SEQ ID NO: 1205643 - RNA, 19 nt, Homo sapiens
uauguccucuccaaauuua

SEQ ID NO: 1205644 - RNA, 19 nt, Homo sapiens
cggaagaacuuugaaauca

SEQ ID NO: 1205645 - RNA, 19 nt, Homo sapiens
gacauuauaucacuuacug

SEQ ID NO: 1205646 - RNA, 19 nt, Homo sapiens
ggaagaacuuugaaaucau

SEQ ID NO: 1205647 - RNA, 19 nt, Homo sapiens
gugagggauugcauauuua

SEQ ID NO: 1205648 - RNA, 19 nt, Homo sapiens
ggaaaucugagcuuacuga

SEQ ID NO: 1205649 - RNA, 19 nt, Homo sapiens
gauuaugugucuuaugaga

SEQ ID NO: 1205650 - RNA, 19 nt, Homo sapiens
gagaaacccuauaaaugca

SEQ ID NO: 1205651 - RNA, 19 nt, Homo sapiens
aaucugagcuuacugaaca

SEQ ID NO: 1205652 - RNA, 19 nt, Homo sapiens
agucacagcuuaaguccua

SEQ ID NO: 1205653 - RNA, 19 nt, Homo sapiens
ggaaagccuucuacaagag

SEQ ID NO: 1205654 - RNA, 19 nt, Homo sapiens
ugaauucccugaaaguaga

SEQ ID NO: 1205655 - RNA, 19 nt, Homo sapiens
gucagucuaugguguauuu

SEQ ID NO: 1205656 - RNA, 19 nt, Homo sapiens
gaacaucaaaggauucaca

SEQ ID NO: 1205657 - RNA, 19 nt, Homo sapiens
cauccugcauucaugauaa

SEQ ID NO: 1205658 - RNA, 19 nt, Homo sapiens
ggaaaagcccuguuaauau

SEQ ID NO: 1205659 - RNA, 19 nt, Homo sapiens
acaaaugccuacggaaauu

SEQ ID NO: 1205660 - RNA, 19 nt, Homo sapiens
ggaacaaggagaaccacua

SEQ ID NO: 1205661 - RNA, 19 nt, Homo sapiens
uaguaggguuuacaagaua

SEQ ID NO: 1205662 - RNA, 19 nt, Homo sapiens
ggagagaaaccuuauggau

SEQ ID NO: 1205663 - RNA, 19 nt, Homo sapiens
gaaaaggcuucauucagaa

SEQ ID NO: 1205664 - RNA, 19 nt, Homo sapiens
ccucauacaugcagugaau

SEQ ID NO: 1205665 - RNA, 19 nt, Homo sapiens
gagcagaagauacaacaga

SEQ ID NO: 1205666 - RNA, 19 nt, Homo sapiens
cgugagaaaugaauguuug

SEQ ID NO: 1205667 - RNA, 19 nt, Homo sapiens
gggaaaagcccuguuaaua

SEQ ID NO: 1205668 - RNA, 19 nt, Homo sapiens
cacagcaagucacagcuua

SEQ ID NO: 1205669 - RNA, 19 nt, Homo sapiens
gaaaaucacuacucguugu

SEQ ID NO: 1205670 - RNA, 19 nt, Homo sapiens
gaagauacaacagaaagga

SEQ ID NO: 1205671 - RNA, 19 nt, Homo sapiens
gcugaguguguuuauauua

SEQ ID NO: 1205672 - RNA, 19 nt, Homo sapiens
cagcuuaaguccuagugaa

SEQ ID NO: 1205673 - RNA, 19 nt, Homo sapiens
gaaaccuuauggaugcauu

SEQ ID NO: 1205674 - RNA, 19 nt, Homo sapiens
ucacugagcauaagagaau

SEQ ID NO: 1205675 - RNA, 19 nt, Homo sapiens
ggauguggcuguggacuuc

SEQ ID NO: 1205676 - RNA, 19 nt, Homo sapiens
caaaguauguuuucucuca

SEQ ID NO: 1205677 - RNA, 19 nt, Homo sapiens
caucagagauaucauacag

SEQ ID NO: 1205678 - RNA, 19 nt, Homo sapiens
gguacaggcucacugaaca

SEQ ID NO: 1205679 - RNA, 19 nt, Homo sapiens
gcauaaaccaggaaaugga

SEQ ID NO: 1205680 - RNA, 19 nt, Homo sapiens
uagaguagcugaguguguu

SEQ ID NO: 1205681 - RNA, 19 nt, Homo sapiens
uauaugucuugccuuguua

SEQ ID NO: 1205682 - RNA, 19 nt, Homo sapiens
cuauaugucuugccuuguu

SEQ ID NO: 1205683 - RNA, 19 nt, Homo sapiens
ggagagaagccucauacau

SEQ ID NO: 1205684 - RNA, 19 nt, Homo sapiens
cacaauuccuuaaacauca

SEQ ID NO: 1205685 - RNA, 19 nt, Homo sapiens
gggaugugauguuggagaa

SEQ ID NO: 1205686 - RNA, 19 nt, Homo sapiens
gaacgugagaaaugaaugu

SEQ ID NO: 1205687 - RNA, 19 nt, Homo sapiens
agaaugagaugaccaugca

SEQ ID NO: 1205688 - RNA, 19 nt, Homo sapiens
guagcugaguguguuuaua

SEQ ID NO: 1205689 - RNA, 19 nt, Homo sapiens
caggagagaaacccuauaa

SEQ ID NO: 1205690 - RNA, 19 nt, Homo sapiens
gagcuuuucuccaugauaa

SEQ ID NO: 1205691 - RNA, 19 nt, Homo sapiens
ucaaggacauuauaucacu

SEQ ID NO: 1205692 - RNA, 19 nt, Homo sapiens
guaccgggaugugauguug

SEQ ID NO: 1205693 - RNA, 19 nt, Homo sapiens
agaaugauaucucuuacuc

SEQ ID NO: 1205694 - RNA, 19 nt, Homo sapiens
gacaaaggcccaggaauca

SEQ ID NO: 1205695 - RNA, 19 nt, Homo sapiens
uagggaggauccagaagaa

SEQ ID NO: 1205696 - RNA, 19 nt, Homo sapiens
gcaagucacagcuuaaguc

SEQ ID NO: 1205697 - RNA, 19 nt, Homo sapiens
gaacucacacuggagagaa

SEQ ID NO: 1205698 - RNA, 19 nt, Homo sapiens
ucagcaaacacacaacaua

SEQ ID NO: 1205699 - RNA, 19 nt, Homo sapiens
gcagaagauacaacagaaa

SEQ ID NO: 1205700 - RNA, 19 nt, Homo sapiens
ugacaaaggcccaggaauc

SEQ ID NO: 1205701 - RNA, 19 nt, Homo sapiens
gagaugaccaugcauaaac

SEQ ID NO: 1205702 - RNA, 19 nt, Homo sapiens
gaaagcuuacuucuauaug

SEQ ID NO: 1205703 - RNA, 19 nt, Homo sapiens
guacaucacagaacucaca

SEQ ID NO: 1205704 - RNA, 19 nt, Homo sapiens
agagauaucauacaggaaa

SEQ ID NO: 1205705 - RNA, 19 nt, Homo sapiens
uauggacacuagaagauga

SEQ ID NO: 1205706 - RNA, 19 nt, Homo sapiens
gaaaauccuuccacagcaa

SEQ ID NO: 1205707 - RNA, 19 nt, Homo sapiens
gaauuaagccccaucaaug

SEQ ID NO: 1205708 - RNA, 19 nt, Homo sapiens
ggaagugugaccuuuggaa

SEQ ID NO: 1205709 - RNA, 19 nt, Homo sapiens
guuaacaaucucugucuuu

SEQ ID NO: 1205710 - RNA, 19 nt, Homo sapiens
uggagacucagauuucuua

SEQ ID NO: 1205711 - RNA, 19 nt, Homo sapiens
agagaaagcccaugaaugc

SEQ ID NO: 1205712 - RNA, 19 nt, Homo sapiens
gcagggcagugugaguuug

SEQ ID NO: 1205713 - RNA, 19 nt, Homo sapiens
gcaaggccuucagccagaa

SEQ ID NO: 1205714 - RNA, 19 nt, Homo sapiens
gagaauucauacaggaaag

SEQ ID NO: 1205715 - RNA, 19 nt, Homo sapiens
gcaaacacacaacauagag

SEQ ID NO: 1205716 - RNA, 19 nt, Homo sapiens
gggagcagaugccaacuua

SEQ ID NO: 1205717 - RNA, 19 nt, Homo sapiens
acucauagcuguugucuuu

SEQ ID NO: 1205718 - RNA, 19 nt, Homo sapiens
gggcagagaucauguuaga

SEQ ID NO: 1205719 - RNA, 19 nt, Homo sapiens
guacuguucucaugcuaua

SEQ ID NO: 1205720 - RNA, 19 nt, Homo sapiens
gaacacauacaaaguagaa

SEQ ID NO: 1205721 - RNA, 19 nt, Homo sapiens
caucaaagguugcaucugu

SEQ ID NO: 1205722 - RNA, 19 nt, Homo sapiens
gacauuggcuuccauuaug

SEQ ID NO: 1205723 - RNA, 19 nt, Homo sapiens
gcauggcuguuauaaauga

SEQ ID NO: 1205724 - RNA, 19 nt, Homo sapiens
aagcauggcuguuauaaau

SEQ ID NO: 1205725 - RNA, 19 nt, Homo sapiens
uaucaaagcccaagaaaug

SEQ ID NO: 1205726 - RNA, 19 nt, Homo sapiens
gaugaacacauacaaagua

SEQ ID NO: 1205727 - RNA, 19 nt, Homo sapiens
gcgcagagcuggaaagcau

SEQ ID NO: 1205728 - RNA, 19 nt, Homo sapiens
gcagagaucauguuagaau

SEQ ID NO: 1205729 - RNA, 19 nt, Homo sapiens
gagaagugaugcuaacugu

SEQ ID NO: 1205730 - RNA, 19 nt, Homo sapiens
gaagugaugcuaacuguuc

SEQ ID NO: 1205731 - RNA, 19 nt, Homo sapiens
ggagaacuaugacgugcuu

SEQ ID NO: 1205732 - RNA, 19 nt, Homo sapiens
aagcagagcucauugaagu

SEQ ID NO: 1205733 - RNA, 19 nt, Homo sapiens
gaagguaguugcuggaaac

SEQ ID NO: 1205734 - RNA, 19 nt, Homo sapiens
ggugaacccuugauggauu

SEQ ID NO: 1205735 - RNA, 19 nt, Homo sapiens
gaaagcauggcuguuauaa

SEQ ID NO: 1205736 - RNA, 19 nt, Homo sapiens
uaauuggccugaagugaaa

SEQ ID NO: 1205737 - RNA, 19 nt, Homo sapiens
gcaggcgccauuauaaaua

SEQ ID NO: 1205738 - RNA, 19 nt, Homo sapiens
caaucucucugucuuuaaa

SEQ ID NO: 1205739 - RNA, 19 nt, Homo sapiens
ggaaagcauggcuguuaua

SEQ ID NO: 1205740 - RNA, 19 nt, Homo sapiens
ggagagagcguuccagaca

SEQ ID NO: 1205741 - RNA, 19 nt, Homo sapiens
guaccaaucucucugucuu

SEQ ID NO: 1205742 - RNA, 19 nt, Homo sapiens
gagcagaugccaacuuaga

SEQ ID NO: 1205743 - RNA, 19 nt, Homo sapiens
guaauuggccugaagugaa

SEQ ID NO: 1205744 - RNA, 19 nt, Homo sapiens
ugaaaugaguaacugcaaa

SEQ ID NO: 1205745 - RNA, 19 nt, Homo sapiens
gagcaggcgccauuauaaa

SEQ ID NO: 1205746 - RNA, 19 nt, Homo sapiens
gcagagcucauugaaguuu

SEQ ID NO: 1205747 - RNA, 19 nt, Homo sapiens
gcacacacuugggauuaug

SEQ ID NO: 1205748 - RNA, 19 nt, Homo sapiens
gaaauucucaaucacugaa

SEQ ID NO: 1205749 - RNA, 19 nt, Homo sapiens
ugaggugacuuggugauuu

SEQ ID NO: 1205750 - RNA, 19 nt, Homo sapiens
gguugcaucuguacaguau

SEQ ID NO: 1205751 - RNA, 19 nt, Homo sapiens
gaagagcaggcgccauuau

SEQ ID NO: 1205752 - RNA, 19 nt, Homo sapiens
uuagcgaucuuucagugua

SEQ ID NO: 1205753 - RNA, 19 nt, Homo sapiens
gagaugaacacauacaaag

SEQ ID NO: 1205754 - RNA, 19 nt, Homo sapiens
ccacuggcuggacaaauua

SEQ ID NO: 1205755 - RNA, 19 nt, Homo sapiens
uggaugaugagaccaauua

SEQ ID NO: 1205756 - RNA, 19 nt, Homo sapiens
gagaucauguuagaaucaa

SEQ ID NO: 1205757 - RNA, 19 nt, Homo sapiens
cccaagaaauggaacuuug

SEQ ID NO: 1205758 - RNA, 19 nt, Homo sapiens
aauuauaggugcccagcua

SEQ ID NO: 1205759 - RNA, 19 nt, Homo sapiens
gcagcauuauccucuguau

SEQ ID NO: 1205760 - RNA, 19 nt, Homo sapiens
gugaacccuugauggauuu

SEQ ID NO: 1205761 - RNA, 19 nt, Homo sapiens
gaagaguucauugcuguug

SEQ ID NO: 1205762 - RNA, 19 nt, Homo sapiens
ccucgcagcucuccugugu

SEQ ID NO: 1205763 - RNA, 19 nt, Homo sapiens
cagcacacacuugggauua

SEQ ID NO: 1205764 - RNA, 19 nt, Homo sapiens
cauugaaguuucucacaga

SEQ ID NO: 1205765 - RNA, 19 nt, Homo sapiens
ucacugaaaugaguaacug

SEQ ID NO: 1205766 - RNA, 19 nt, Homo sapiens
gaaagcguaagacaagaug

SEQ ID NO: 1205767 - RNA, 19 nt, Homo sapiens
gaacuaugacgugcuuuca

SEQ ID NO: 1205768 - RNA, 19 nt, Homo sapiens
gguaguugcuggaaaccau

SEQ ID NO: 1205769 - RNA, 19 nt, Homo sapiens
caggcgccauuauaaauau

SEQ ID NO: 1205770 - RNA, 19 nt, Homo sapiens
gcauuaacuuugugauggu

SEQ ID NO: 1205771 - RNA, 19 nt, Homo sapiens
ugacauuggcuuccauuau

SEQ ID NO: 1205772 - RNA, 19 nt, Homo sapiens
caagucauguacagcugaa

SEQ ID NO: 1205773 - RNA, 19 nt, Homo sapiens
accaaucucucugucuuua

SEQ ID NO: 1205774 - RNA, 19 nt, Homo sapiens
cuauuaaugucgucacuca

SEQ ID NO: 1205775 - RNA, 19 nt, Homo sapiens
gcaucacgcccacagacua

SEQ ID NO: 1205776 - RNA, 19 nt, Homo sapiens
cauuuaaggagaacuauga

SEQ ID NO: 1205777 - RNA, 19 nt, Homo sapiens
guggacagguacucuacaa

SEQ ID NO: 1205778 - RNA, 19 nt, Homo sapiens
uguggcaucugcucugaaa

SEQ ID NO: 1205779 - RNA, 19 nt, Homo sapiens
ugaagguaguugcuggaaa

SEQ ID NO: 1205780 - RNA, 19 nt, Homo sapiens
ggaaagcguaagacaagau

SEQ ID NO: 1205781 - RNA, 19 nt, Homo sapiens
gagcucagcgucccaucuu

SEQ ID NO: 1205782 - RNA, 19 nt, Homo sapiens
guuagaaucaaguggauga

SEQ ID NO: 1205783 - RNA, 19 nt, Homo sapiens
cuggaaagcauggcuguua

SEQ ID NO: 1205784 - RNA, 19 nt, Homo sapiens
aagagcaggcgccauuaua

SEQ ID NO: 1205785 - RNA, 19 nt, Homo sapiens
uaaagaggaagaguucauu

SEQ ID NO: 1205786 - RNA, 19 nt, Homo sapiens
gaggugacuuggugauuuu

SEQ ID NO: 1205787 - RNA, 19 nt, Homo sapiens
agagcaggcgccauuauaa

SEQ ID NO: 1205788 - RNA, 19 nt, Homo sapiens
uagcgaucuuucaguguaa

SEQ ID NO: 1205789 - RNA, 19 nt, Homo sapiens
gauuuguuguugcuugaga

SEQ ID NO: 1205790 - RNA, 19 nt, Homo sapiens
uggaaagcauggcuguuau

SEQ ID NO: 1205791 - RNA, 19 nt, Homo sapiens
gaaaugaguaacugcaaaa

SEQ ID NO: 1205792 - RNA, 19 nt, Homo sapiens
cacuugggauuauguguau

SEQ ID NO: 1205793 - RNA, 19 nt, Homo sapiens
ugauuguacuguucucaug

SEQ ID NO: 1205794 - RNA, 19 nt, Homo sapiens
ggagaagugaugcuaacug

SEQ ID NO: 1205795 - RNA, 19 nt, Homo sapiens
ugagaugaacacauacaaa

SEQ ID NO: 1205796 - RNA, 19 nt, Homo sapiens
acauuggcuuccauuauga

SEQ ID NO: 1205797 - RNA, 19 nt, Homo sapiens
gaagggaauggcagaugga

SEQ ID NO: 1205798 - RNA, 19 nt, Homo sapiens
ucauugcuguugaaacuca

SEQ ID NO: 1205799 - RNA, 19 nt, Homo sapiens
cuugauggauuuguuguug

SEQ ID NO: 1205800 - RNA, 19 nt, Homo sapiens
gaacuuugggcagagauca

SEQ ID NO: 1205801 - RNA, 19 nt, Homo sapiens
uggcuuccauuaugagaug

SEQ ID NO: 1205802 - RNA, 19 nt, Homo sapiens
cauuaaagaggaagaguuc

SEQ ID NO: 1205803 - RNA, 19 nt, Homo sapiens
cagagaucauguuagaauc

SEQ ID NO: 1205804 - RNA, 19 nt, Homo sapiens
ucaguuggaggaacagaaa

SEQ ID NO: 1205805 - RNA, 19 nt, Homo sapiens
cagaagcagagcucauuga

SEQ ID NO: 1205806 - RNA, 19 nt, Homo sapiens
gcuguggcaucugcucuga

SEQ ID NO: 1205807 - RNA, 19 nt, Homo sapiens
uguuguugcuugagaaaug

SEQ ID NO: 1205808 - RNA, 19 nt, Homo sapiens
cuauaaaaguggacaggua

SEQ ID NO: 1205809 - RNA, 19 nt, Homo sapiens
gaaguuucucacagacuga

SEQ ID NO: 1205810 - RNA, 19 nt, Homo sapiens
gaagcagagcucauugaag

SEQ ID NO: 1205811 - RNA, 19 nt, Homo sapiens
gauguggagcgguuucaga

SEQ ID NO: 1205812 - RNA, 19 nt, Homo sapiens
gaucauguuagaaucaagu

SEQ ID NO: 1205813 - RNA, 19 nt, Homo sapiens
ugucuuugcugugcuucua

SEQ ID NO: 1205814 - RNA, 19 nt, Homo sapiens
gacagaauuuucauccauu

SEQ ID NO: 1205815 - RNA, 19 nt, Homo sapiens
uaaaagaugaggugacuug

SEQ ID NO: 1205816 - RNA, 19 nt, Homo sapiens
gcgauaauaugaagcuuua

SEQ ID NO: 1205817 - RNA, 19 nt, Homo sapiens
gaaagacaguuugauacua

SEQ ID NO: 1205818 - RNA, 19 nt, Homo sapiens
gaaggagcaucauggguuu

SEQ ID NO: 1205819 - RNA, 19 nt, Homo sapiens
gcagagugauuauggauug

SEQ ID NO: 1205820 - RNA, 19 nt, Homo sapiens
ggaauuuaguuagagguua

SEQ ID NO: 1205821 - RNA, 19 nt, Homo sapiens
guaguaagaccuaggauuu

SEQ ID NO: 1205822 - RNA, 19 nt, Homo sapiens
gauuauggauugagauguu

SEQ ID NO: 1205823 - RNA, 19 nt, Homo sapiens
gaaaugaguguuuaucuag

SEQ ID NO: 1205824 - RNA, 19 nt, Homo sapiens
ccaauuaagugcaaauagu

SEQ ID NO: 1205825 - RNA, 19 nt, Homo sapiens
ggauugagauguucuuaac

SEQ ID NO: 1205826 - RNA, 19 nt, Homo sapiens
cgucagagcuuuuagaauu

SEQ ID NO: 1205827 - RNA, 19 nt, Homo sapiens
gagauguucuuaacuugau

SEQ ID NO: 1205828 - RNA, 19 nt, Homo sapiens
gaguguuuaucuaguagua

SEQ ID NO: 1205829 - RNA, 19 nt, Homo sapiens
aaaccgaggaauuuaguua

SEQ ID NO: 1205830 - RNA, 19 nt, Homo sapiens
gcguuagaccugcaucuua

SEQ ID NO: 1205831 - RNA, 19 nt, Homo sapiens
caucuuagcaaugugaaua

SEQ ID NO: 1205832 - RNA, 19 nt, Homo sapiens
uauguguacugugaacuua

SEQ ID NO: 1205833 - RNA, 19 nt, Homo sapiens
ucugaaagacaguuugaua

SEQ ID NO: 1205834 - RNA, 19 nt, Homo sapiens
gguuauaaauugcucuaag

SEQ ID NO: 1205835 - RNA, 19 nt, Homo sapiens
cuuuauauguguacuguga

SEQ ID NO: 1205836 - RNA, 19 nt, Homo sapiens
gggagcaucugggacuuug

SEQ ID NO: 1205837 - RNA, 19 nt, Homo sapiens
gcaggagaaucgcuugaac

SEQ ID NO: 1205838 - RNA, 19 nt, Homo sapiens
ugucacacguugucaccua

SEQ ID NO: 1205839 - RNA, 19 nt, Homo sapiens
aaauuggccuggcgugaga

SEQ ID NO: 1205840 - RNA, 19 nt, Homo sapiens
gaauauugcaucccuagag

SEQ ID NO: 1205841 - RNA, 19 nt, Homo sapiens
guauuuauaagcagaguga

SEQ ID NO: 1205842 - RNA, 19 nt, Homo sapiens
caaggugcgggucucguua

SEQ ID NO: 1205843 - RNA, 19 nt, Homo sapiens
ccacggacaugucgucacu

SEQ ID NO: 1205844 - RNA, 19 nt, Homo sapiens
gagcaucugggacuuuguu

SEQ ID NO: 1205845 - RNA, 19 nt, Homo sapiens
gcugggagcccuuccuguu

SEQ ID NO: 1205846 - RNA, 19 nt, Homo sapiens
aauauugcaucccuagaga

SEQ ID NO: 1205847 - RNA, 19 nt, Homo sapiens
cguuagaccugcaucuuag

SEQ ID NO: 1205848 - RNA, 19 nt, Homo sapiens
uaagcagagugauuaugga

SEQ ID NO: 1205849 - RNA, 19 nt, Homo sapiens
gcgagacucuggcucaaaa

SEQ ID NO: 1205850 - RNA, 19 nt, Homo sapiens
caucauggguuuuguuuuc

SEQ ID NO: 1205851 - RNA, 19 nt, Homo sapiens
gagugauuauggauugaga

SEQ ID NO: 1205852 - RNA, 19 nt, Homo sapiens
guacuuaugaaaugagugu

SEQ ID NO: 1205853 - RNA, 19 nt, Homo sapiens
uguguacugugaacuuaaa

SEQ ID NO: 1205854 - RNA, 19 nt, Homo sapiens
uaaaugcaaacccacagaa

SEQ ID NO: 1205855 - RNA, 19 nt, Homo sapiens
ugucaccuaucuaguccua

SEQ ID NO: 1205856 - RNA, 19 nt, Homo sapiens
agagcuccguccugcauuu

SEQ ID NO: 1205857 - RNA, 19 nt, Homo sapiens
guuauaaauugcucuaagc

SEQ ID NO: 1205858 - RNA, 19 nt, Homo sapiens
gcaccuguagucccagcua

SEQ ID NO: 1205859 - RNA, 19 nt, Homo sapiens
gucagagcuuuuagaauua

SEQ ID NO: 1205860 - RNA, 19 nt, Homo sapiens
ggaccgugagucagcauug

SEQ ID NO: 1205861 - RNA, 19 nt, Homo sapiens
gcucugcagccucauccua

SEQ ID NO: 1205862 - RNA, 19 nt, Homo sapiens
ugagauguucuuaacuuga

SEQ ID NO: 1205863 - RNA, 19 nt, Homo sapiens
uagagaaggaccuggaaga

SEQ ID NO: 1205864 - RNA, 19 nt, Homo sapiens
cugaaacuaguacuuauga

SEQ ID NO: 1205865 - RNA, 19 nt, Homo sapiens
gagguuauaaauugcucua

SEQ ID NO: 1205866 - RNA, 19 nt, Homo sapiens
gguccugacacuacuguga

SEQ ID NO: 1205867 - RNA, 19 nt, Homo sapiens
uugcaucccuagagaagga

SEQ ID NO: 1205868 - RNA, 19 nt, Homo sapiens
ugaaagacaguuugauacu

SEQ ID NO: 1205869 - RNA, 19 nt, Homo sapiens
caagugaaggagcaucaug

SEQ ID NO: 1205870 - RNA, 19 nt, Homo sapiens
cugggagcccuuccuguua

SEQ ID NO: 1205871 - RNA, 19 nt, Homo sapiens
ccugugaucccagcacuuu

SEQ ID NO: 1205872 - RNA, 19 nt, Homo sapiens
cccgccagguucugcguua

SEQ ID NO: 1205873 - RNA, 19 nt, Homo sapiens
ccaaggugcgggucucguu

SEQ ID NO: 1205874 - RNA, 19 nt, Homo sapiens
uuuguaaaccgaggaauuu

SEQ ID NO: 1205875 - RNA, 19 nt, Homo sapiens
guguuuaucuaguaguaag

SEQ ID NO: 1205876 - RNA, 19 nt, Homo sapiens
agaccugcaucuuagcaau

SEQ ID NO: 1205877 - RNA, 19 nt, Homo sapiens
gugcaaccccgucuuagua

SEQ ID NO: 1205878 - RNA, 19 nt, Homo sapiens
cagagugauuauggauuga

SEQ ID NO: 1205879 - RNA, 19 nt, Homo sapiens
gaaggaccuggaagagcaa

SEQ ID NO: 1205880 - RNA, 19 nt, Homo sapiens
uaucuaguaguaagaccua

SEQ ID NO: 1205881 - RNA, 19 nt, Homo sapiens
uugagauguucuuaacuug

SEQ ID NO: 1205882 - RNA, 19 nt, Homo sapiens
guuagagguuauaaauugc

SEQ ID NO: 1205883 - RNA, 19 nt, Homo sapiens
ccuguuacacguuaucaug

SEQ ID NO: 1205884 - RNA, 19 nt, Homo sapiens
gauggaaggagcuaguuuu

SEQ ID NO: 1205885 - RNA, 19 nt, Homo sapiens
gaccugcaucuuagcaaug

SEQ ID NO: 1205886 - RNA, 19 nt, Homo sapiens
ccuaaggucaggaguucaa

SEQ ID NO: 1205887 - RNA, 19 nt, Homo sapiens
gcuccguccugcauuucug

SEQ ID NO: 1205888 - RNA, 19 nt, Homo sapiens
gcaaccccgucuuaguaaa

SEQ ID NO: 1205889 - RNA, 19 nt, Homo sapiens
ccucugaaagacaguuuga

SEQ ID NO: 1205890 - RNA, 19 nt, Homo sapiens
ucggagagcaagugaagga

SEQ ID NO: 1205891 - RNA, 19 nt, Homo sapiens
gugauuauggauugagaug

SEQ ID NO: 1205892 - RNA, 19 nt, Homo sapiens
gaccgugagucagcauugg

SEQ ID NO: 1205893 - RNA, 19 nt, Homo sapiens
accgaggaauuuaguuaga

SEQ ID NO: 1205894 - RNA, 19 nt, Homo sapiens
gacaguuugauacuaacaa

SEQ ID NO: 1205895 - RNA, 19 nt, Homo sapiens
gguuuuguuuucucccuua

SEQ ID NO: 1205896 - RNA, 19 nt, Homo sapiens
ugauggaaggagcuaguuu

SEQ ID NO: 1205897 - RNA, 19 nt, Homo sapiens
gaagagacauuggcaguua

SEQ ID NO: 1205898 - RNA, 19 nt, Homo sapiens
ggaaucagcugucaucauu

SEQ ID NO: 1205899 - RNA, 19 nt, Homo sapiens
gaagggauccggaagaauu

SEQ ID NO: 1205900 - RNA, 19 nt, Homo sapiens
gaagauagccauguuuaug

SEQ ID NO: 1205901 - RNA, 19 nt, Homo sapiens
gccaagguguugaaguuua

SEQ ID NO: 1205902 - RNA, 19 nt, Homo sapiens
cagaacguaucuugguuua

SEQ ID NO: 1205903 - RNA, 19 nt, Homo sapiens
gaguauagccuacaauguu

SEQ ID NO: 1205904 - RNA, 19 nt, Homo sapiens
gaauuuguagcuccauuua

SEQ ID NO: 1205905 - RNA, 19 nt, Homo sapiens
gaggauagcaggaaguuug

SEQ ID NO: 1205906 - RNA, 19 nt, Homo sapiens
ccaagguguugaaguuuaa

SEQ ID NO: 1205907 - RNA, 19 nt, Homo sapiens
gcacaugauggacagguua

SEQ ID NO: 1205908 - RNA, 19 nt, Homo sapiens
gcuaucggcugguggacua

SEQ ID NO: 1205909 - RNA, 19 nt, Homo sapiens
gcuaggaguuuguaagcaa

SEQ ID NO: 1205910 - RNA, 19 nt, Homo sapiens
aaacuugggacuugaauuu

SEQ ID NO: 1205911 - RNA, 19 nt, Homo sapiens
guccaacccuuaacauuug

SEQ ID NO: 1205912 - RNA, 19 nt, Homo sapiens
gaaaggccagggacuacua

SEQ ID NO: 1205913 - RNA, 19 nt, Homo sapiens
uuacguaauugaggucuua

SEQ ID NO: 1205914 - RNA, 19 nt, Homo sapiens
gugaagauagccauguuua

SEQ ID NO: 1205915 - RNA, 19 nt, Homo sapiens
uaaaggcuguuaugcuuca

SEQ ID NO: 1205916 - RNA, 19 nt, Homo sapiens
uaacugucccugugaauga

SEQ ID NO: 1205917 - RNA, 19 nt, Homo sapiens
cuuaaaggcuguuaugcuu

SEQ ID NO: 1205918 - RNA, 19 nt, Homo sapiens
gguguucuguacaauguuu

SEQ ID NO: 1205919 - RNA, 19 nt, Homo sapiens
gggaugguguugauaagga

SEQ ID NO: 1205920 - RNA, 19 nt, Homo sapiens
agucacaucuuucaguaaa

SEQ ID NO: 1205921 - RNA, 19 nt, Homo sapiens
agagucacaucuuucagua

SEQ ID NO: 1205922 - RNA, 19 nt, Homo sapiens
caaccucagugccauguuc

SEQ ID NO: 1205923 - RNA, 19 nt, Homo sapiens
ugagaagccuggaaagaag

SEQ ID NO: 1205924 - RNA, 19 nt, Homo sapiens
ggaccuggcauguaaauac

SEQ ID NO: 1205925 - RNA, 19 nt, Homo sapiens
ugacuuacauaaucauugg

SEQ ID NO: 1205926 - RNA, 19 nt, Homo sapiens
aguauagccuacaauguuu

SEQ ID NO: 1205927 - RNA, 19 nt, Homo sapiens
gagaaccagcacagugaua

SEQ ID NO: 1205928 - RNA, 19 nt, Homo sapiens
gaagggaggauagcaggaa

SEQ ID NO: 1205929 - RNA, 19 nt, Homo sapiens
gugagaagccuggaaagaa

SEQ ID NO: 1205930 - RNA, 19 nt, Homo sapiens
gauagcaggaaguuugaaa

SEQ ID NO: 1205931 - RNA, 19 nt, Homo sapiens
cuagagagcccuggagauu

SEQ ID NO: 1205932 - RNA, 19 nt, Homo sapiens
caggguugcugaagaagau

SEQ ID NO: 1205933 - RNA, 19 nt, Homo sapiens
uguccaacccuuaacauuu

SEQ ID NO: 1205934 - RNA, 19 nt, Homo sapiens
cugccaagguguugaaguu

SEQ ID NO: 1205935 - RNA, 19 nt, Homo sapiens
ucaguaaauucacagagau

SEQ ID NO: 1205936 - RNA, 19 nt, Homo sapiens
cuaaaggaaucagcuguca

SEQ ID NO: 1205937 - RNA, 19 nt, Homo sapiens
gaugguggcuauacuucca

SEQ ID NO: 1205938 - RNA, 19 nt, Homo sapiens
ccucugacuuacauaauca

SEQ ID NO: 1205939 - RNA, 19 nt, Homo sapiens
uaggauggcuugaaaauca

SEQ ID NO: 1205940 - RNA, 19 nt, Homo sapiens
ccuuuagagucacaucuuu

SEQ ID NO: 1205941 - RNA, 19 nt, Homo sapiens
uggauguucugugaagaua

SEQ ID NO: 1205942 - RNA, 19 nt, Homo sapiens
guauagccuacaauguuua

SEQ ID NO: 1205943 - RNA, 19 nt, Homo sapiens
guaaauacuccaugaaagc

SEQ ID NO: 1205944 - RNA, 19 nt, Homo sapiens
gaacaguuaaauagucaca

SEQ ID NO: 1205945 - RNA, 19 nt, Homo sapiens
uggaagggauccggaagaa

SEQ ID NO: 1205946 - RNA, 19 nt, Homo sapiens
agagagcccuggagauugg

SEQ ID NO: 1205947 - RNA, 19 nt, Homo sapiens
ggaguauagccuacaaugu

SEQ ID NO: 1205948 - RNA, 19 nt, Homo sapiens
aagagacauuggcaguuaa

SEQ ID NO: 1205949 - RNA, 19 nt, Homo sapiens
cagcuccuguuucugaaga

SEQ ID NO: 1205950 - RNA, 19 nt, Homo sapiens
uguaaauacuccaugaaag

SEQ ID NO: 1205951 - RNA, 19 nt, Homo sapiens
gcugguggacuauuuggaa

SEQ ID NO: 1205952 - RNA, 19 nt, Homo sapiens
cuugggacuugaauuugua

SEQ ID NO: 1205953 - RNA, 19 nt, Homo sapiens
uggcagcuccuguuucuga

SEQ ID NO: 1205954 - RNA, 19 nt, Homo sapiens
cccugugaaugaacaauuu

SEQ ID NO: 1205955 - RNA, 19 nt, Homo sapiens
gccagggacuacuacacaa

SEQ ID NO: 1205956 - RNA, 19 nt, Homo sapiens
acauggagguggagugcaa

SEQ ID NO: 1205957 - RNA, 19 nt, Homo sapiens
guaagcaaggacuuuguga

SEQ ID NO: 1205958 - RNA, 19 nt, Homo sapiens
aagagggacgugcaacaua

SEQ ID NO: 1205959 - RNA, 19 nt, Homo sapiens
ucagaacguaucuugguuu

SEQ ID NO: 1205960 - RNA, 19 nt, Homo sapiens
gaaucagcugucaucauuu

SEQ ID NO: 1205961 - RNA, 19 nt, Homo sapiens
ggaugguguugauaaggau

SEQ ID NO: 1205962 - RNA, 19 nt, Homo sapiens
gaccuggcauguaaauacu

SEQ ID NO: 1205963 - RNA, 19 nt, Homo sapiens
aagagaaccagcacaguga

SEQ ID NO: 1205964 - RNA, 19 nt, Homo sapiens
gaagucaauagcagcaugu

SEQ ID NO: 1205965 - RNA, 19 nt, Homo sapiens
gaucaagagggacgugcaa

SEQ ID NO: 1205966 - RNA, 19 nt, Homo sapiens
agagggacgugcaacauac

SEQ ID NO: 1205967 - RNA, 19 nt, Homo sapiens
ugguuaggauggcuugaaa

SEQ ID NO: 1205968 - RNA, 19 nt, Homo sapiens
aaucagcugucaucauuuu

SEQ ID NO: 1205969 - RNA, 19 nt, Homo sapiens
aaaggaaucagcugucauc

SEQ ID NO: 1205970 - RNA, 19 nt, Homo sapiens
aauaggagcaaacuagaga

SEQ ID NO: 1205971 - RNA, 19 nt, Homo sapiens
gauguucugugaagauagc

SEQ ID NO: 1205972 - RNA, 19 nt, Homo sapiens
acuaccacccucugacuua

SEQ ID NO: 1205973 - RNA, 19 nt, Homo sapiens
ugaauuuguagcuccauuu

SEQ ID NO: 1205974 - RNA, 19 nt, Homo sapiens
ggccugugaugguggcuau

SEQ ID NO: 1205975 - RNA, 19 nt, Homo sapiens
cgugcaacauacagcuuaa

SEQ ID NO: 1205976 - RNA, 19 nt, Homo sapiens
uucaguaaauucacagaga

SEQ ID NO: 1205977 - RNA, 19 nt, Homo sapiens
guaaauucacagagaucaa

SEQ ID NO: 1205978 - RNA, 19 nt, Homo sapiens
ugaagauagccauguuuau

SEQ ID NO: 1205979 - RNA, 19 nt, Homo sapiens
ggacccggacgguugcuau

SEQ ID NO: 1205980 - RNA, 19 nt, Homo sapiens
cagucaauauuccuuuauc

SEQ ID NO: 1205981 - RNA, 19 nt, Homo sapiens
ggagguggagugcaacuac

SEQ ID NO: 1205982 - RNA, 19 nt, Homo sapiens
cccacuaugugacuggaaa

SEQ ID NO: 1205983 - RNA, 19 nt, Homo sapiens
uggguguucuguacaaugu

SEQ ID NO: 1205984 - RNA, 19 nt, Homo sapiens
acaguuaaauagucacaac

SEQ ID NO: 1205985 - RNA, 19 nt, Homo sapiens
guaucuugguuuacguaau

SEQ ID NO: 1205986 - RNA, 19 nt, Homo sapiens
cagucaauauuccuucauc

SEQ ID NO: 1205987 - RNA, 19 nt, Homo sapiens
uaucugggccugugccaau

SEQ ID NO: 1205988 - RNA, 19 nt, Homo sapiens
ggccagggacuacuacaca

SEQ ID NO: 1205989 - RNA, 19 nt, Homo sapiens
ggcacaugauggacagguu

SEQ ID NO: 1205990 - RNA, 19 nt, Homo sapiens
aagcaaggacuuugugaca

SEQ ID NO: 1205991 - RNA, 19 nt, Homo sapiens
caagagggacgugcaacau

SEQ ID NO: 1205992 - RNA, 19 nt, Homo sapiens
gggcuucguuuugccuuua

SEQ ID NO: 1205993 - RNA, 19 nt, Homo sapiens
gcaacauacagcuuaaagg

SEQ ID NO: 1205994 - RNA, 19 nt, Homo sapiens
uaaauucacagagaucaag

SEQ ID NO: 1205995 - RNA, 19 nt, Homo sapiens
gagucacaucuuucaguaa

SEQ ID NO: 1205996 - RNA, 19 nt, Homo sapiens
gggaggauagcaggaaguu

SEQ ID NO: 1205997 - RNA, 19 nt, Homo sapiens
gaaccuaugucacuuucaa

SEQ ID NO: 1205998 - RNA, 19 nt, Homo sapiens
ccaaggagcucagcagaaa

SEQ ID NO: 1205999 - RNA, 19 nt, Homo sapiens
cuaaggagaugggaauaaa

SEQ ID NO: 1206000 - RNA, 19 nt, Homo sapiens
gagccuagcccguccguaa

SEQ ID NO: 1206001 - RNA, 19 nt, Homo sapiens
gauacaggcucccucuuuc

SEQ ID NO: 1206002 - RNA, 19 nt, Homo sapiens
ggauacaggcucccucuuu

SEQ ID NO: 1206003 - RNA, 19 nt, Homo sapiens
ugaaggagccgucaagaug

SEQ ID NO: 1206004 - RNA, 19 nt, Homo sapiens
ccaccacacuggccucuga

SEQ ID NO: 1206005 - RNA, 19 nt, Homo sapiens
ggaauaaagaggccagaga

SEQ ID NO: 1206006 - RNA, 19 nt, Homo sapiens
gauggcgucuuggucauuu

SEQ ID NO: 1206007 - RNA, 19 nt, Homo sapiens
ggucaccacugaacacauc

SEQ ID NO: 1206008 - RNA, 19 nt, Homo sapiens
aguggaagcucagcacaua

SEQ ID NO: 1206009 - RNA, 19 nt, Homo sapiens
gcaugagggucuccuacug

SEQ ID NO: 1206010 - RNA, 19 nt, Homo sapiens
gagcuugccuuuggcuuuc

SEQ ID NO: 1206011 - RNA, 19 nt, Homo sapiens
caacagacaggaaccuaug

SEQ ID NO: 1206012 - RNA, 19 nt, Homo sapiens
ggagcuugccuuuggcuuu

SEQ ID NO: 1206013 - RNA, 19 nt, Homo sapiens
caucugcucucucuuacuc

SEQ ID NO: 1206014 - RNA, 19 nt, Homo sapiens
cuucaucugcucucucuua

SEQ ID NO: 1206015 - RNA, 19 nt, Homo sapiens
gcugcaacauugguucuga

SEQ ID NO: 1206016 - RNA, 19 nt, Homo sapiens
gcagugagcccaccuugcu

SEQ ID NO: 1206017 - RNA, 19 nt, Homo sapiens
ggacuucugcccuucaucu

SEQ ID NO: 1206018 - RNA, 19 nt, Homo sapiens
ccuaagcuccugacaagug

SEQ ID NO: 1206019 - RNA, 19 nt, Homo sapiens
ggccagagagcaccaagug

SEQ ID NO: 1206020 - RNA, 19 nt, Homo sapiens
gaucaauccaccagugcaa

SEQ ID NO: 1206021 - RNA, 19 nt, Homo sapiens
gagauggcgucuuggucau

SEQ ID NO: 1206022 - RNA, 19 nt, Homo sapiens
ccacugaacacaucuuggu

SEQ ID NO: 1206023 - RNA, 19 nt, Homo sapiens
ccaagugagcucauguuuc

SEQ ID NO: 1206024 - RNA, 19 nt, Homo sapiens
ccgcaugguugggcaguug

SEQ ID NO: 1206025 - RNA, 19 nt, Homo sapiens
aaggagaugggaauaaaga

SEQ ID NO: 1206026 - RNA, 19 nt, Homo sapiens
ggaccacgcacuccaacca

SEQ ID NO: 1206027 - RNA, 19 nt, Homo sapiens
acaggaaccuaugucacuu

SEQ ID NO: 1206028 - RNA, 19 nt, Homo sapiens
gcaccaagugagcucaugu

SEQ ID NO: 1206029 - RNA, 19 nt, Homo sapiens
ccuaaggagaugggaauaa

SEQ ID NO: 1206030 - RNA, 19 nt, Homo sapiens
gccaaggagcucagcagaa

SEQ ID NO: 1206031 - RNA, 19 nt, Homo sapiens
ccaacagacaggaaccuau

SEQ ID NO: 1206032 - RNA, 19 nt, Homo sapiens
gcagaccccuggcuuaguc

SEQ ID NO: 1206033 - RNA, 19 nt, Homo sapiens
guugaggccaugaacagaa

SEQ ID NO: 1206034 - RNA, 19 nt, Homo sapiens
caucagagcaggaaaagug

SEQ ID NO: 1206035 - RNA, 19 nt, Homo sapiens
ggaaggggccauagugaug

SEQ ID NO: 1206036 - RNA, 19 nt, Homo sapiens
ggacggcaggucaggaaag

SEQ ID NO: 1206037 - RNA, 19 nt, Homo sapiens
caggaaccuaugucacuuu

SEQ ID NO: 1206038 - RNA, 19 nt, Homo sapiens
auccuaagcuccugacaag

SEQ ID NO: 1206039 - RNA, 19 nt, Homo sapiens
gcacgcuccaucccucaug

SEQ ID NO: 1206040 - RNA, 19 nt, Homo sapiens
uggcguggccuucgugugu

SEQ ID NO: 1206041 - RNA, 19 nt, Homo sapiens
ugcccaaccugcccugugu

SEQ ID NO: 1206042 - RNA, 19 nt, Homo sapiens
gggaaagucugcuugagua

SEQ ID NO: 1206043 - RNA, 19 nt, Homo sapiens
gaacagugguggagucuag

SEQ ID NO: 1206044 - RNA, 19 nt, Homo sapiens
ugacuaagauucaugcauu

SEQ ID NO: 1206045 - RNA, 19 nt, Homo sapiens
gggcuguccuuguguauuu

SEQ ID NO: 1206046 - RNA, 19 nt, Homo sapiens
gaaauggacucugauagca

SEQ ID NO: 1206047 - RNA, 19 nt, Homo sapiens
gggauaucauguccauuua

SEQ ID NO: 1206048 - RNA, 19 nt, Homo sapiens
gcacaggagucaaagagau

SEQ ID NO: 1206049 - RNA, 19 nt, Homo sapiens
gagcaugucuggcauagca

SEQ ID NO: 1206050 - RNA, 19 nt, Homo sapiens
gcuaguccuuguuguauuu

SEQ ID NO: 1206051 - RNA, 19 nt, Homo sapiens
guauuuagcugcagugauc

SEQ ID NO: 1206052 - RNA, 19 nt, Homo sapiens
ccacaggccagcauaauuu

SEQ ID NO: 1206053 - RNA, 19 nt, Homo sapiens
ccacagggccagcuccuua

SEQ ID NO: 1206054 - RNA, 19 nt, Homo sapiens
caauuucccucuuccauuc

SEQ ID NO: 1206055 - RNA, 19 nt, Homo sapiens
uagcugcagugauccuuua

SEQ ID NO: 1206056 - RNA, 19 nt, Homo sapiens
gagcaaggguagccaaugg

SEQ ID NO: 1206057 - RNA, 19 nt, Homo sapiens
ggagugugcccaaaugauu

SEQ ID NO: 1206058 - RNA, 19 nt, Homo sapiens
ggacagagacagaccuuca

SEQ ID NO: 1206059 - RNA, 19 nt, Homo sapiens
gauguaagacagaagguaa

SEQ ID NO: 1206060 - RNA, 19 nt, Homo sapiens
ccucagugcucaucucuau

SEQ ID NO: 1206061 - RNA, 19 nt, Homo sapiens
ggacccugcuuccaauuuc

SEQ ID NO: 1206062 - RNA, 19 nt, Homo sapiens
guauuugccuggcuuuguu

SEQ ID NO: 1206063 - RNA, 19 nt, Homo sapiens
gcaauaacacagugagguu

SEQ ID NO: 1206064 - RNA, 19 nt, Homo sapiens
ggauuagagccacuacaua

SEQ ID NO: 1206065 - RNA, 19 nt, Homo sapiens
uaaugagaaugcagaaaug

SEQ ID NO: 1206066 - RNA, 19 nt, Homo sapiens
agaauagucucuuacagau

SEQ ID NO: 1206067 - RNA, 19 nt, Homo sapiens
gagggagugugcccaaaug

SEQ ID NO: 1206068 - RNA, 19 nt, Homo sapiens
aaagucugcuugaguauuc

SEQ ID NO: 1206069 - RNA, 19 nt, Homo sapiens
gauuagagccacuacauag

SEQ ID NO: 1206070 - RNA, 19 nt, Homo sapiens
cagcugcucuugucacugu

SEQ ID NO: 1206071 - RNA, 19 nt, Homo sapiens
uaaaugugacugggacuua

SEQ ID NO: 1206072 - RNA, 19 nt, Homo sapiens
gagguggccugcaaagauc

SEQ ID NO: 1206073 - RNA, 19 nt, Homo sapiens
gaaagucugcuugaguauu

SEQ ID NO: 1206074 - RNA, 19 nt, Homo sapiens
uaagacagaagguaaaugu

SEQ ID NO: 1206075 - RNA, 19 nt, Homo sapiens
gggcuucguucauccauuc

SEQ ID NO: 1206076 - RNA, 19 nt, Homo sapiens
caugggagccugaggguuu

SEQ ID NO: 1206077 - RNA, 19 nt, Homo sapiens
aguccuuucuggaguauua

SEQ ID NO: 1206078 - RNA, 19 nt, Homo sapiens
gcacgagaccaucagaguu

SEQ ID NO: 1206079 - RNA, 19 nt, Homo sapiens
guaagaagcugaaaauacu

SEQ ID NO: 1206080 - RNA, 19 nt, Homo sapiens
cuaggcugcugaucaguaa

SEQ ID NO: 1206081 - RNA, 19 nt, Homo sapiens
uagaauagucucuuacaga

SEQ ID NO: 1206082 - RNA, 19 nt, Homo sapiens
agacagaagguaaauguga

SEQ ID NO: 1206083 - RNA, 19 nt, Homo sapiens
ggccagcuccuuagggaua

SEQ ID NO: 1206084 - RNA, 19 nt, Homo sapiens
gcccuaaucuugaguugag

SEQ ID NO: 1206085 - RNA, 19 nt, Homo sapiens
cgggauaucauguccauuu

SEQ ID NO: 1206086 - RNA, 19 nt, Homo sapiens
gaugcuaguccuuguugua

SEQ ID NO: 1206087 - RNA, 19 nt, Homo sapiens
uaagauucaugcauugauc

SEQ ID NO: 1206088 - RNA, 19 nt, Homo sapiens
gcccugcccucugcuauga

SEQ ID NO: 1206089 - RNA, 19 nt, Homo sapiens
gacuaagauucaugcauug

SEQ ID NO: 1206090 - RNA, 19 nt, Homo sapiens
ggaacggaaguuuaucuug

SEQ ID NO: 1206091 - RNA, 19 nt, Homo sapiens
gaauagucucuuacagauu

SEQ ID NO: 1206092 - RNA, 19 nt, Homo sapiens
gagaggcuccauaaugaga

SEQ ID NO: 1206093 - RNA, 19 nt, Homo sapiens
gaaguccuuucuggaguau

SEQ ID NO: 1206094 - RNA, 19 nt, Homo sapiens
cauagcagccugacuuuua

SEQ ID NO: 1206095 - RNA, 19 nt, Homo sapiens
gcuucucuaucuguauuua

SEQ ID NO: 1206096 - RNA, 19 nt, Homo sapiens
aaaugugacugggacuuaa

SEQ ID NO: 1206097 - RNA, 19 nt, Homo sapiens
ggagaggcacuguguaucu

SEQ ID NO: 1206098 - RNA, 19 nt, Homo sapiens
ucugggugguugucuauuu

SEQ ID NO: 1206099 - RNA, 19 nt, Homo sapiens
gaucaagcgggauaucaug

SEQ ID NO: 1206100 - RNA, 19 nt, Homo sapiens
ugucauccauuuaaguguu

SEQ ID NO: 1206101 - RNA, 19 nt, Homo sapiens
ucauguccauuuauaagga

SEQ ID NO: 1206102 - RNA, 19 nt, Homo sapiens
aaacuaugcaggacccuuu

SEQ ID NO: 1206103 - RNA, 19 nt, Homo sapiens
ucuaugagguggccugcaa

SEQ ID NO: 1206104 - RNA, 19 nt, Homo sapiens
ggaguauuacgacuucuau

SEQ ID NO: 1206105 - RNA, 19 nt, Homo sapiens
ggacucugauagcaguuca

SEQ ID NO: 1206106 - RNA, 19 nt, Homo sapiens
aauaacacagugagguuua

SEQ ID NO: 1206107 - RNA, 19 nt, Homo sapiens
gguccaguguugucuguca

SEQ ID NO: 1206108 - RNA, 19 nt, Homo sapiens
ccaauuucccucuuccauu

SEQ ID NO: 1206109 - RNA, 19 nt, Homo sapiens
gggagaggauaguguguac

SEQ ID NO: 1206110 - RNA, 19 nt, Homo sapiens
cuagacagaccaaagagaa

SEQ ID NO: 1206111 - RNA, 19 nt, Homo sapiens
uauagucacuguucuagac

SEQ ID NO: 1206112 - RNA, 19 nt, Homo sapiens
cauuugacacuccuuauga

SEQ ID NO: 1206113 - RNA, 19 nt, Homo sapiens
aaucuugaguugaggaaau

SEQ ID NO: 1206114 - RNA, 19 nt, Homo sapiens
gaggcugggucucuucaca

SEQ ID NO: 1206115 - RNA, 19 nt, Homo sapiens
cguuguaccugauacuguu

SEQ ID NO: 1206116 - RNA, 19 nt, Homo sapiens
ggaaagucugcuugaguau

SEQ ID NO: 1206117 - RNA, 19 nt, Homo sapiens
gcaauaaaguuuguuuugg

SEQ ID NO: 1206118 - RNA, 19 nt, Homo sapiens
ugcuuuaggugcccuguaa

SEQ ID NO: 1206119 - RNA, 19 nt, Homo sapiens
ggauaucauguccauuuau

SEQ ID NO: 1206120 - RNA, 19 nt, Homo sapiens
ggauggagaggcacugugu

SEQ ID NO: 1206121 - RNA, 19 nt, Homo sapiens
caauaacacagugagguuu

SEQ ID NO: 1206122 - RNA, 19 nt, Homo sapiens
uauaugcacaggagucaaa

SEQ ID NO: 1206123 - RNA, 19 nt, Homo sapiens
guugggcuguccuugugua

SEQ ID NO: 1206124 - RNA, 19 nt, Homo sapiens
guucuagacagaccaaaga

SEQ ID NO: 1206125 - RNA, 19 nt, Homo sapiens
gauaaguggaagauggaaa

SEQ ID NO: 1206126 - RNA, 19 nt, Homo sapiens
ugagguggccugcaaagau

SEQ ID NO: 1206127 - RNA, 19 nt, Homo sapiens
gcaaugggaaagucugcuu

SEQ ID NO: 1206128 - RNA, 19 nt, Homo sapiens
ccaggaauguucguuguac

SEQ ID NO: 1206129 - RNA, 19 nt, Homo sapiens
gggauuagagccacuacau

SEQ ID NO: 1206130 - RNA, 19 nt, Homo sapiens
cuauuugucugucuucagu

SEQ ID NO: 1206131 - RNA, 19 nt, Homo sapiens
gugacaugauggaaggaaa

SEQ ID NO: 1206132 - RNA, 19 nt, Homo sapiens
cacgagaccaucagaguug

SEQ ID NO: 1206133 - RNA, 19 nt, Homo sapiens
uguugucugucauccauuu

SEQ ID NO: 1206134 - RNA, 19 nt, Homo sapiens
gaucacaggcccauuugac

SEQ ID NO: 1206135 - RNA, 19 nt, Homo sapiens
uagagccacuacauagaau

SEQ ID NO: 1206136 - RNA, 19 nt, Homo sapiens
uuagagccacuacauagaa

SEQ ID NO: 1206137 - RNA, 19 nt, Homo sapiens
gaggcuccauaaugagaau

SEQ ID NO: 1206138 - RNA, 19 nt, Homo sapiens
uggcauagcagccugacuu

SEQ ID NO: 1206139 - RNA, 19 nt, Homo sapiens
gcaggaagcaaaggaacug

SEQ ID NO: 1206140 - RNA, 19 nt, Homo sapiens
gggacccugcuuccaauuu

SEQ ID NO: 1206141 - RNA, 19 nt, Homo sapiens
auaacacagugagguuuaa

SEQ ID NO: 1206142 - RNA, 19 nt, Homo sapiens
caugugaccuuaccuauua

SEQ ID NO: 1206143 - RNA, 19 nt, Homo sapiens
gaugaaauguucucucuuu

SEQ ID NO: 1206144 - RNA, 19 nt, Homo sapiens
gauaaggagugaaagagua

SEQ ID NO: 1206145 - RNA, 19 nt, Homo sapiens
gaagaugccuguugcaaag

SEQ ID NO: 1206146 - RNA, 19 nt, Homo sapiens
gaagugaguguucaaagua

SEQ ID NO: 1206147 - RNA, 19 nt, Homo sapiens
ggacaugccugaugaagag

SEQ ID NO: 1206148 - RNA, 19 nt, Homo sapiens
gagaagcuguauaaucgua

SEQ ID NO: 1206149 - RNA, 19 nt, Homo sapiens
gaaaggaaucccugucaaa

SEQ ID NO: 1206150 - RNA, 19 nt, Homo sapiens
ucaaaugguuuagugcuua

SEQ ID NO: 1206151 - RNA, 19 nt, Homo sapiens
ggcacgagcuguuccagua

SEQ ID NO: 1206152 - RNA, 19 nt, Homo sapiens
uaacaguucuggccugaga

SEQ ID NO: 1206153 - RNA, 19 nt, Homo sapiens
agagagaggugcauuuaga

SEQ ID NO: 1206154 - RNA, 19 nt, Homo sapiens
ucucagagcugcugcuuau

SEQ ID NO: 1206155 - RNA, 19 nt, Homo sapiens
gauguuugcugguaucuuc

SEQ ID NO: 1206156 - RNA, 19 nt, Homo sapiens
gaccuuaccuauuauugga

SEQ ID NO: 1206157 - RNA, 19 nt, Homo sapiens
ggugugagaccaucagaua

SEQ ID NO: 1206158 - RNA, 19 nt, Homo sapiens
ggaagaugccuguugcaaa

SEQ ID NO: 1206159 - RNA, 19 nt, Homo sapiens
gagcccagcugccuacuca

SEQ ID NO: 1206160 - RNA, 19 nt, Homo sapiens
caaaugguuuagugcuuaa

SEQ ID NO: 1206161 - RNA, 19 nt, Homo sapiens
cgagaaggccucagagaaa

SEQ ID NO: 1206162 - RNA, 19 nt, Homo sapiens
gagcuguuccaguauaaua

SEQ ID NO: 1206163 - RNA, 19 nt, Homo sapiens
gaaaguacuaaaugucuga

SEQ ID NO: 1206164 - RNA, 19 nt, Homo sapiens
ccacuugggugcuucauag

SEQ ID NO: 1206165 - RNA, 19 nt, Homo sapiens
ccaggugucuuuucuuuua

SEQ ID NO: 1206166 - RNA, 19 nt, Homo sapiens
gaguuuagguucaauuucu

SEQ ID NO: 1206167 - RNA, 19 nt, Homo sapiens
gcuuaaugcuguuauguca

SEQ ID NO: 1206168 - RNA, 19 nt, Homo sapiens
gagcaaauuagugaaagua

SEQ ID NO: 1206169 - RNA, 19 nt, Homo sapiens
ccaaggauuuguagcuguu

SEQ ID NO: 1206170 - RNA, 19 nt, Homo sapiens
gcugguaucuuccaaacuc

SEQ ID NO: 1206171 - RNA, 19 nt, Homo sapiens
uggagaagcuguauaaucg

SEQ ID NO: 1206172 - RNA, 19 nt, Homo sapiens
uagcaucagugucaaggaa

SEQ ID NO: 1206173 - RNA, 19 nt, Homo sapiens
caaaagaccccguucguuu

SEQ ID NO: 1206174 - RNA, 19 nt, Homo sapiens
gcaaauuagugaaaguacu

SEQ ID NO: 1206175 - RNA, 19 nt, Homo sapiens
cugcaggccucgcucuaua

SEQ ID NO: 1206176 - RNA, 19 nt, Homo sapiens
gagugugagccuucucuua

SEQ ID NO: 1206177 - RNA, 19 nt, Homo sapiens
gcgagaaggccucagagaa

SEQ ID NO: 1206178 - RNA, 19 nt, Homo sapiens
caaagccacucuggacaug

SEQ ID NO: 1206179 - RNA, 19 nt, Homo sapiens
cuaguccgcuuucauguuc

SEQ ID NO: 1206180 - RNA, 19 nt, Homo sapiens
agaguaugcugaccaccua

SEQ ID NO: 1206181 - RNA, 19 nt, Homo sapiens
ugaaaggaaucccugucaa

SEQ ID NO: 1206182 - RNA, 19 nt, Homo sapiens
guacucagucuuuaggauu

SEQ ID NO: 1206183 - RNA, 19 nt, Homo sapiens
agagagagaggugcauuua

SEQ ID NO: 1206184 - RNA, 19 nt, Homo sapiens
ggugcaaccuguagaugga

SEQ ID NO: 1206185 - RNA, 19 nt, Homo sapiens
gcugaugcacuccuuguuu

SEQ ID NO: 1206186 - RNA, 19 nt, Homo sapiens
gagaaggccucagagaaac

SEQ ID NO: 1206187 - RNA, 19 nt, Homo sapiens
ggagcaaauuagugaaagu

SEQ ID NO: 1206188 - RNA, 19 nt, Homo sapiens
cacgagcuguuccaguaua

SEQ ID NO: 1206189 - RNA, 19 nt, Homo sapiens
ucaaaguauuguagaagga

SEQ ID NO: 1206190 - RNA, 19 nt, Homo sapiens
gagagagagaggugcauuu

SEQ ID NO: 1206191 - RNA, 19 nt, Homo sapiens
gaaagagcaggcuauugga

SEQ ID NO: 1206192 - RNA, 19 nt, Homo sapiens
uacucagucuuuaggauua

SEQ ID NO: 1206193 - RNA, 19 nt, Homo sapiens
gaagaguuuagguucaauu

SEQ ID NO: 1206194 - RNA, 19 nt, Homo sapiens
gaaacucgccccagaagaa

SEQ ID NO: 1206195 - RNA, 19 nt, Homo sapiens
gaaucccugucaaaugguu

SEQ ID NO: 1206196 - RNA, 19 nt, Homo sapiens
guacacugguuuucacuuu

SEQ ID NO: 1206197 - RNA, 19 nt, Homo sapiens
gagagaggugcauuuagaa

SEQ ID NO: 1206198 - RNA, 19 nt, Homo sapiens
ggaauauuguacucagucu

SEQ ID NO: 1206199 - RNA, 19 nt, Homo sapiens
agaaagagcaggcuauugg

SEQ ID NO: 1206200 - RNA, 19 nt, Homo sapiens
guacuaaaugucugauaug

SEQ ID NO: 1206201 - RNA, 19 nt, Homo sapiens
uuagauagcaggagcaaau

SEQ ID NO: 1206202 - RNA, 19 nt, Homo sapiens
aggccaggcucuguucuua

SEQ ID NO: 1206203 - RNA, 19 nt, Homo sapiens
caaccuacgugcaguaacg

SEQ ID NO: 1206204 - RNA, 19 nt, Homo sapiens
cagagcugcugcuuauuca

SEQ ID NO: 1206205 - RNA, 19 nt, Homo sapiens
cuauagggcucagauggaa

SEQ ID NO: 1206206 - RNA, 19 nt, Homo sapiens
ggaagaggcagcugaugca

SEQ ID NO: 1206207 - RNA, 19 nt, Homo sapiens
gauagcaggagcaaauuag

SEQ ID NO: 1206208 - RNA, 19 nt, Homo sapiens
gaaguggccagaagacaag

SEQ ID NO: 1206209 - RNA, 19 nt, Homo sapiens
uagaggaaguacagaagau

SEQ ID NO: 1206210 - RNA, 19 nt, Homo sapiens
cauauugcccuaaucucua

SEQ ID NO: 1206211 - RNA, 19 nt, Homo sapiens
aggaaucccugucaaaugg

SEQ ID NO: 1206212 - RNA, 19 nt, Homo sapiens
ucagagaacccuggaguug

SEQ ID NO: 1206213 - RNA, 19 nt, Homo sapiens
gcaauuacucuuuauucca

SEQ ID NO: 1206214 - RNA, 19 nt, Homo sapiens
ccucauugguggcuugaug

SEQ ID NO: 1206215 - RNA, 19 nt, Homo sapiens
gagcaaccuacgugcagua

SEQ ID NO: 1206216 - RNA, 19 nt, Homo sapiens
gauggagccaccagaaaga

SEQ ID NO: 1206217 - RNA, 19 nt, Homo sapiens
guagauggagccaccagaa

SEQ ID NO: 1206218 - RNA, 19 nt, Homo sapiens
uaagcugucucucucucuu

SEQ ID NO: 1206219 - RNA, 19 nt, Homo sapiens
uaaauugaagugaguguuc

SEQ ID NO: 1206220 - RNA, 19 nt, Homo sapiens
ggagaugguucacauuccu

SEQ ID NO: 1206221 - RNA, 19 nt, Homo sapiens
cgaaguggccagaagacaa

SEQ ID NO: 1206222 - RNA, 19 nt, Homo sapiens
cuacaaucauaaccuagga

SEQ ID NO: 1206223 - RNA, 19 nt, Homo sapiens
uaguggagaagcuguauaa

SEQ ID NO: 1206224 - RNA, 19 nt, Homo sapiens
cugaugcacuccuuguuug

SEQ ID NO: 1206225 - RNA, 19 nt, Homo sapiens
cauguuccauccuguauac

SEQ ID NO: 1206226 - RNA, 19 nt, Homo sapiens
ccagaagacaagaguguga

SEQ ID NO: 1206227 - RNA, 19 nt, Homo sapiens
uaauaauccucacccuaca

SEQ ID NO: 1206228 - RNA, 19 nt, Homo sapiens
ggaaccagcauggcaccua

SEQ ID NO: 1206229 - RNA, 19 nt, Homo sapiens
uuaaguggcuguugguaac

SEQ ID NO: 1206230 - RNA, 19 nt, Homo sapiens
gcaguagcaucagugucaa

SEQ ID NO: 1206231 - RNA, 19 nt, Homo sapiens
ucccucaccugguaccuuu

SEQ ID NO: 1206232 - RNA, 19 nt, Homo sapiens
ggauaaggagugaaagagu

SEQ ID NO: 1206233 - RNA, 19 nt, Homo sapiens
gucaaaugguuuagugcuu

SEQ ID NO: 1206234 - RNA, 19 nt, Homo sapiens
ucagagcugcugcuuauuc

SEQ ID NO: 1206235 - RNA, 19 nt, Homo sapiens
gcacgagcuguuccaguau

SEQ ID NO: 1206236 - RNA, 19 nt, Homo sapiens
gcugaccaccuauguuaga

SEQ ID NO: 1206237 - RNA, 19 nt, Homo sapiens
uauaaucguacacugguuu

SEQ ID NO: 1206238 - RNA, 19 nt, Homo sapiens
guggagaagcuguauaauc

SEQ ID NO: 1206239 - RNA, 19 nt, Homo sapiens
gcccaggugucuuuucuuu

SEQ ID NO: 1206240 - RNA, 19 nt, Homo sapiens
gcagaaauaauggcauaag

SEQ ID NO: 1206241 - RNA, 19 nt, Homo sapiens
gugugagccuucucuuaug

SEQ ID NO: 1206242 - RNA, 19 nt, Homo sapiens
ggacguggcuccuucaaga

SEQ ID NO: 1206243 - RNA, 19 nt, Homo sapiens
gaacagaagccauguaucu

SEQ ID NO: 1206244 - RNA, 19 nt, Homo sapiens
gauugcagcugccauggua

SEQ ID NO: 1206245 - RNA, 19 nt, Homo sapiens
cagcugccaugguauauaa

SEQ ID NO: 1206246 - RNA, 19 nt, Homo sapiens
gaagggaugggacaaauga

SEQ ID NO: 1206247 - RNA, 19 nt, Homo sapiens
cagcugagguggagaguga

SEQ ID NO: 1206248 - RNA, 19 nt, Homo sapiens
ggacagcuaugccucagau

SEQ ID NO: 1206249 - RNA, 19 nt, Homo sapiens
ggaggagccagcaccauua

SEQ ID NO: 1206250 - RNA, 19 nt, Homo sapiens
ggacagcccggaagagauu

SEQ ID NO: 1206251 - RNA, 19 nt, Homo sapiens
gggcugagcugcagagucu

SEQ ID NO: 1206252 - RNA, 19 nt, Homo sapiens
gagaagggaugggacaaau

SEQ ID NO: 1206253 - RNA, 19 nt, Homo sapiens
gauggugaccuuccgauuu

SEQ ID NO: 1206254 - RNA, 19 nt, Homo sapiens
caacaucguccgcuucuau

SEQ ID NO: 1206255 - RNA, 19 nt, Homo sapiens
ggcaggaugugaauucaga

SEQ ID NO: 1206256 - RNA, 19 nt, Homo sapiens
gaagauacccgaggugaag

SEQ ID NO: 1206257 - RNA, 19 nt, Homo sapiens
caacaaaacugagcaagga

SEQ ID NO: 1206258 - RNA, 19 nt, Homo sapiens
gaugcuuucugaucaacaa

SEQ ID NO: 1206259 - RNA, 19 nt, Homo sapiens
ucagagagcucagauacag

SEQ ID NO: 1206260 - RNA, 19 nt, Homo sapiens
gaugugaauucagaacaga

SEQ ID NO: 1206261 - RNA, 19 nt, Homo sapiens
gaucucaagugcgacaaug

SEQ ID NO: 1206262 - RNA, 19 nt, Homo sapiens
ggacuucauuuccuacacu

SEQ ID NO: 1206263 - RNA, 19 nt, Homo sapiens
ccauggagcuuguguucuc

SEQ ID NO: 1206264 - RNA, 19 nt, Homo sapiens
caugguauauaacgaguuc

SEQ ID NO: 1206265 - RNA, 19 nt, Homo sapiens
ggagaccaccguccucaug

SEQ ID NO: 1206266 - RNA, 19 nt, Homo sapiens
gagaagcugcguaaagcaa

SEQ ID NO: 1206267 - RNA, 19 nt, Homo sapiens
ggcagaagcacuugucaga

SEQ ID NO: 1206268 - RNA, 19 nt, Homo sapiens
guauauaacgaguucauuc

SEQ ID NO: 1206269 - RNA, 19 nt, Homo sapiens
guggagacccuguugaaga

SEQ ID NO: 1206270 - RNA, 19 nt, Homo sapiens
ggagaagggaugggacaaa

SEQ ID NO: 1206271 - RNA, 19 nt, Homo sapiens
cgggcacgcucaagacgua

SEQ ID NO: 1206272 - RNA, 19 nt, Homo sapiens
cagaacagaagccauguau

SEQ ID NO: 1206273 - RNA, 19 nt, Homo sapiens
guucucaggucacucuuag

SEQ ID NO: 1206274 - RNA, 19 nt, Homo sapiens
gaguggagacccuguugaa

SEQ ID NO: 1206275 - RNA, 19 nt, Homo sapiens
ggaugugaauucagaacag

SEQ ID NO: 1206276 - RNA, 19 nt, Homo sapiens
gauguuggcaggaugugaa

SEQ ID NO: 1206277 - RNA, 19 nt, Homo sapiens
ugucagagguggaaacacu

SEQ ID NO: 1206278 - RNA, 19 nt, Homo sapiens
gcgggucacuagugucuca

SEQ ID NO: 1206279 - RNA, 19 nt, Homo sapiens
caaccaggccaucgaguuc

SEQ ID NO: 1206280 - RNA, 19 nt, Homo sapiens
gcacuugucagagguggaa

SEQ ID NO: 1206281 - RNA, 19 nt, Homo sapiens
gcagcugccaugguauaua

SEQ ID NO: 1206282 - RNA, 19 nt, Homo sapiens
guaaagcaagggaauugga

SEQ ID NO: 1206283 - RNA, 19 nt, Homo sapiens
gugagaagcugcguaaagc

SEQ ID NO: 1206284 - RNA, 19 nt, Homo sapiens
acagcaagauggugaccuu

SEQ ID NO: 1206285 - RNA, 19 nt, Homo sapiens
ucccaggucuccucaaauc

SEQ ID NO: 1206286 - RNA, 19 nt, Homo sapiens
ggauuucucagacggauuc

SEQ ID NO: 1206287 - RNA, 19 nt, Homo sapiens
caaguuugacaucgagauu

SEQ ID NO: 1206288 - RNA, 19 nt, Homo sapiens
ccgccuagcuccaaagaac

SEQ ID NO: 1206289 - RNA, 19 nt, Homo sapiens
ggaaacacuacagacacua

SEQ ID NO: 1206290 - RNA, 19 nt, Homo sapiens
cgacuucuccaccuacguu

SEQ ID NO: 1206291 - RNA, 19 nt, Homo sapiens
cauggaggcugcugaagac

SEQ ID NO: 1206292 - RNA, 19 nt, Homo sapiens
agacggauucgggagauua

SEQ ID NO: 1206293 - RNA, 19 nt, Homo sapiens
gaugcagcuucaggccuua

SEQ ID NO: 1206294 - RNA, 19 nt, Homo sapiens
caucuaccacuucggauug

SEQ ID NO: 1206295 - RNA, 19 nt, Homo sapiens
gcguaaagcaagggaauug

SEQ ID NO: 1206296 - RNA, 19 nt, Homo sapiens
gaaacacuacagacacuac

SEQ ID NO: 1206297 - RNA, 19 nt, Homo sapiens
ccagacccauccaaugaag

SEQ ID NO: 1206298 - RNA, 19 nt, Homo sapiens
ccauggaggcugcugaaga

SEQ ID NO: 1206299 - RNA, 19 nt, Homo sapiens
auggugaccuuccgauuug

SEQ ID NO: 1206300 - RNA, 19 nt, Homo sapiens
gaggugaaggagaucauug

SEQ ID NO: 1206301 - RNA, 19 nt, Homo sapiens
cagaggagguggagaugcu

SEQ ID NO: 1206302 - RNA, 19 nt, Homo sapiens
gagcagcgaggagucagaa

SEQ ID NO: 1206303 - RNA, 19 nt, Homo sapiens
ucccagacccauccaauga

SEQ ID NO: 1206304 - RNA, 19 nt, Homo sapiens
ggagguggcacaggagaug

SEQ ID NO: 1206305 - RNA, 19 nt, Homo sapiens
ucucaggucacucuuaguu

SEQ ID NO: 1206306 - RNA, 19 nt, Homo sapiens
ccucagacccugcccuuca

SEQ ID NO: 1206307 - RNA, 19 nt, Homo sapiens
gcuggucaccgaacucaug

SEQ ID NO: 1206308 - RNA, 19 nt, Homo sapiens
gguggaaacacuacagaca

SEQ ID NO: 1206309 - RNA, 19 nt, Homo sapiens
uggaugaacuacuccuaca

SEQ ID NO: 1206310 - RNA, 19 nt, Homo sapiens
gcucuccacuuccauucuc

SEQ ID NO: 1206311 - RNA, 19 nt, Homo sapiens
cuucccaggucuccucaaa

SEQ ID NO: 1206312 - RNA, 19 nt, Homo sapiens
cccaccagcucuccacuuc

SEQ ID NO: 1206313 - RNA, 19 nt, Homo sapiens
uggagacccuguugaagag

SEQ ID NO: 1206314 - RNA, 19 nt, Homo sapiens
gauggccgauaccucaagu

SEQ ID NO: 1206315 - RNA, 19 nt, Homo sapiens
cggauaagaacgagagguu

SEQ ID NO: 1206316 - RNA, 19 nt, Homo sapiens
gcagcgaggagucagaaag

SEQ ID NO: 1206317 - RNA, 19 nt, Homo sapiens
cacgccagcuacucaucua

SEQ ID NO: 1206318 - RNA, 19 nt, Homo sapiens
ggugaaggagaucauugaa

SEQ ID NO: 1206319 - RNA, 19 nt, Homo sapiens
gagauggccaccucugagu

SEQ ID NO: 1206320 - RNA, 19 nt, Homo sapiens
ggaccuacuggcucuguca

SEQ ID NO: 1206321 - RNA, 19 nt, Homo sapiens
cuacagacacuacagaaaa

SEQ ID NO: 1206322 - RNA, 19 nt, Homo sapiens
ccucagcucacuucagaga

SEQ ID NO: 1206323 - RNA, 19 nt, Homo sapiens
caccagcucuccacuucca

SEQ ID NO: 1206324 - RNA, 19 nt, Homo sapiens
ggccaucgaguuccuguuc

SEQ ID NO: 1206325 - RNA, 19 nt, Homo sapiens
gcaaggaagaucccaacac

SEQ ID NO: 1206326 - RNA, 19 nt, Homo sapiens
gagguggaaacacuacaga

SEQ ID NO: 1206327 - RNA, 19 nt, Homo sapiens
gggaagaugaggaguucug

SEQ ID NO: 1206328 - RNA, 19 nt, Homo sapiens
gagaccaccguccucaugu

SEQ ID NO: 1206329 - RNA, 19 nt, Homo sapiens
cuucaggccuuagcgaugu

SEQ ID NO: 1206330 - RNA, 19 nt, Homo sapiens
cagcaccagcccuuccuuu

SEQ ID NO: 1206331 - RNA, 19 nt, Homo sapiens
aaacugagcaaggaagauc

SEQ ID NO: 1206332 - RNA, 19 nt, Homo sapiens
uggccgauaccucaaguuu

SEQ ID NO: 1206333 - RNA, 19 nt, Homo sapiens
uacccgaggugaaggagau

SEQ ID NO: 1206334 - RNA, 19 nt, Homo sapiens
ucagaacagaagccaugua

SEQ ID NO: 1206335 - RNA, 19 nt, Homo sapiens
uggaaacacuacagacacu

SEQ ID NO: 1206336 - RNA, 19 nt, Homo sapiens
ccagaaugacagagugguu

SEQ ID NO: 1206337 - RNA, 19 nt, Homo sapiens
cgaacagcuuccacaaggu

SEQ ID NO: 1206338 - RNA, 19 nt, Homo sapiens
aaucugaugcuuucugauc

SEQ ID NO: 1206339 - RNA, 19 nt, Homo sapiens
caccauggagcuuguguuc

SEQ ID NO: 1206340 - RNA, 19 nt, Homo sapiens
cugaagcuguggcccuaga

SEQ ID NO: 1206341 - RNA, 19 nt, Homo sapiens
caguguggaugaacuacuc

SEQ ID NO: 1206342 - RNA, 19 nt, Homo sapiens
gcagauaccuucaauuuaa

SEQ ID NO: 1206343 - RNA, 19 nt, Homo sapiens
gaaaucaacucaagaugua

SEQ ID NO: 1206344 - RNA, 19 nt, Homo sapiens
gaaacgaagugggcaauua

SEQ ID NO: 1206345 - RNA, 19 nt, Homo sapiens
ggagguaugcuaaauauua

SEQ ID NO: 1206346 - RNA, 19 nt, Homo sapiens
ggaauuugcucuaauaauc

SEQ ID NO: 1206347 - RNA, 19 nt, Homo sapiens
caacccacauuaagaaaua

SEQ ID NO: 1206348 - RNA, 19 nt, Homo sapiens
uaauggaggugccaaauaa

SEQ ID NO: 1206349 - RNA, 19 nt, Homo sapiens
caacagaagagaagaauaa

SEQ ID NO: 1206350 - RNA, 19 nt, Homo sapiens
cuaaggaacuacuagauaa

SEQ ID NO: 1206351 - RNA, 19 nt, Homo sapiens
gaggaaaucuauaccuuug

SEQ ID NO: 1206352 - RNA, 19 nt, Homo sapiens
ucacagacaucaagcauug

SEQ ID NO: 1206353 - RNA, 19 nt, Homo sapiens
gccauuaacuugcugcuaa

SEQ ID NO: 1206354 - RNA, 19 nt, Homo sapiens
gauauaaccuccaggaaag

SEQ ID NO: 1206355 - RNA, 19 nt, Homo sapiens
gggcagauaccuucaauuu

SEQ ID NO: 1206356 - RNA, 19 nt, Homo sapiens
acauaaaggugacugauuu

SEQ ID NO: 1206357 - RNA, 19 nt, Homo sapiens
gaauggagcugcuauugag

SEQ ID NO: 1206358 - RNA, 19 nt, Homo sapiens
ucacagaaauuuccaagga

SEQ ID NO: 1206359 - RNA, 19 nt, Homo sapiens
aaacuugccauacguauua

SEQ ID NO: 1206360 - RNA, 19 nt, Homo sapiens
ucaagaaccucaaauguag

SEQ ID NO: 1206361 - RNA, 19 nt, Homo sapiens
gagcauaggcgucguaaug

SEQ ID NO: 1206362 - RNA, 19 nt, Homo sapiens
gcauaggcgucguaaugua

SEQ ID NO: 1206363 - RNA, 19 nt, Homo sapiens
gagacaagguggaucauuc

SEQ ID NO: 1206364 - RNA, 19 nt, Homo sapiens
ggaaagauuugcccucaag

SEQ ID NO: 1206365 - RNA, 19 nt, Homo sapiens
gagaccaaccaauguauua

SEQ ID NO: 1206366 - RNA, 19 nt, Homo sapiens
ggaaaucuauaccuuugga

SEQ ID NO: 1206367 - RNA, 19 nt, Homo sapiens
gcuaaggaacuacuagaua

SEQ ID NO: 1206368 - RNA, 19 nt, Homo sapiens
ccacuacgcaguuugauaa

SEQ ID NO: 1206369 - RNA, 19 nt, Homo sapiens
gcacuagaagacuuuguua

SEQ ID NO: 1206370 - RNA, 19 nt, Homo sapiens
ggaaaucaacucaagaugu

SEQ ID NO: 1206371 - RNA, 19 nt, Homo sapiens
gcuggaagcucugcuguga

SEQ ID NO: 1206372 - RNA, 19 nt, Homo sapiens
agaauaagccguccacuga

SEQ ID NO: 1206373 - RNA, 19 nt, Homo sapiens
ccaauuacacuucagauga

SEQ ID NO: 1206374 - RNA, 19 nt, Homo sapiens
aaagcagucuuauugauga

SEQ ID NO: 1206375 - RNA, 19 nt, Homo sapiens
caagaggccaaauauagua

SEQ ID NO: 1206376 - RNA, 19 nt, Homo sapiens
gagcugcuauugaggaaau

SEQ ID NO: 1206377 - RNA, 19 nt, Homo sapiens
cacacacacucuauacaua

SEQ ID NO: 1206378 - RNA, 19 nt, Homo sapiens
guaauggaggugccaaaua

SEQ ID NO: 1206379 - RNA, 19 nt, Homo sapiens
ccucaaauguagagagaaa

SEQ ID NO: 1206380 - RNA, 19 nt, Homo sapiens
gauaguggcuuagauaaaa

SEQ ID NO: 1206381 - RNA, 19 nt, Homo sapiens
cuagaagacuuuguuagaa

SEQ ID NO: 1206382 - RNA, 19 nt, Homo sapiens
gaaaacaagaggccaaaua

SEQ ID NO: 1206383 - RNA, 19 nt, Homo sapiens
caaugguccuaguuaagua

SEQ ID NO: 1206384 - RNA, 19 nt, Homo sapiens
uauuagagaugaugaagga

SEQ ID NO: 1206385 - RNA, 19 nt, Homo sapiens
caagguggaucauucaaag

SEQ ID NO: 1206386 - RNA, 19 nt, Homo sapiens
gaauaugugucuagugcau

SEQ ID NO: 1206387 - RNA, 19 nt, Homo sapiens
aaacaagaggccaaauaua

SEQ ID NO: 1206388 - RNA, 19 nt, Homo sapiens
ccaaguacccugcuaaauc

SEQ ID NO: 1206389 - RNA, 19 nt, Homo sapiens
caaggagguaugcuaaaua

SEQ ID NO: 1206390 - RNA, 19 nt, Homo sapiens
ccacaacccacauuaagaa

SEQ ID NO: 1206391 - RNA, 19 nt, Homo sapiens
uguaacugcuugccauuaa

SEQ ID NO: 1206392 - RNA, 19 nt, Homo sapiens
caucauacaucuggaacaa

SEQ ID NO: 1206393 - RNA, 19 nt, Homo sapiens
gcugauaguggcuuagaua

SEQ ID NO: 1206394 - RNA, 19 nt, Homo sapiens
ccaggaugguaauagguua

SEQ ID NO: 1206395 - RNA, 19 nt, Homo sapiens
ccaaggagguaugcuaaau

SEQ ID NO: 1206396 - RNA, 19 nt, Homo sapiens
gaggauacuuaugaggaua

SEQ ID NO: 1206397 - RNA, 19 nt, Homo sapiens
guaaggacaacuuugauau

SEQ ID NO: 1206398 - RNA, 19 nt, Homo sapiens
ggauggagaacucaaagaa

SEQ ID NO: 1206399 - RNA, 19 nt, Homo sapiens
aaauguaccuugugaugga

SEQ ID NO: 1206400 - RNA, 19 nt, Homo sapiens
gauaugugcaguucaaguu

SEQ ID NO: 1206401 - RNA, 19 nt, Homo sapiens
caaccaauguauuagagau

SEQ ID NO: 1206402 - RNA, 19 nt, Homo sapiens
aaucacagcuaaggaacua

SEQ ID NO: 1206403 - RNA, 19 nt, Homo sapiens
aaacgaagugggcaauuaa

SEQ ID NO: 1206404 - RNA, 19 nt, Homo sapiens
ggcagauaccuucaauuua

SEQ ID NO: 1206405 - RNA, 19 nt, Homo sapiens
gcaaccaaguacccugcua

SEQ ID NO: 1206406 - RNA, 19 nt, Homo sapiens
caaagucucgcaucagcua

SEQ ID NO: 1206407 - RNA, 19 nt, Homo sapiens
gaacgagaggugaacauuc

SEQ ID NO: 1206408 - RNA, 19 nt, Homo sapiens
uuaaacaaauggcugauag

SEQ ID NO: 1206409 - RNA, 19 nt, Homo sapiens
ucaaacaguggaaacauuu

SEQ ID NO: 1206410 - RNA, 19 nt, Homo sapiens
uuaacuugcugcuaaauuc

SEQ ID NO: 1206411 - RNA, 19 nt, Homo sapiens
ggccaaauauaguaaugga

SEQ ID NO: 1206412 - RNA, 19 nt, Homo sapiens
uaaaggacagccaccagua

SEQ ID NO: 1206413 - RNA, 19 nt, Homo sapiens
ggaagaagacagcccuaug

SEQ ID NO: 1206414 - RNA, 19 nt, Homo sapiens
acugagaucuuuccaacuu

SEQ ID NO: 1206415 - RNA, 19 nt, Homo sapiens
aaggagguaugcuaaauau

SEQ ID NO: 1206416 - RNA, 19 nt, Homo sapiens
ggaaguuucucaaaguacu

SEQ ID NO: 1206417 - RNA, 19 nt, Homo sapiens
ggaauagucauugaagcua

SEQ ID NO: 1206418 - RNA, 19 nt, Homo sapiens
gagaauggagcugcuauug

SEQ ID NO: 1206419 - RNA, 19 nt, Homo sapiens
uaaguaaaaugcugccaua

SEQ ID NO: 1206420 - RNA, 19 nt, Homo sapiens
gaagaagacagcccuaugc

SEQ ID NO: 1206421 - RNA, 19 nt, Homo sapiens
ccaguaaggacaacuuuga

SEQ ID NO: 1206422 - RNA, 19 nt, Homo sapiens
caaguacccugcuaaaucc

SEQ ID NO: 1206423 - RNA, 19 nt, Homo sapiens
gaagcucugcugugaaguu

SEQ ID NO: 1206424 - RNA, 19 nt, Homo sapiens
gaauaagccguccacugaa

SEQ ID NO: 1206425 - RNA, 19 nt, Homo sapiens
gauggagaacucaaagaaa

SEQ ID NO: 1206426 - RNA, 19 nt, Homo sapiens
guaauaggaauuugcucua

SEQ ID NO: 1206427 - RNA, 19 nt, Homo sapiens
cuacgcaguuugauaagau

SEQ ID NO: 1206428 - RNA, 19 nt, Homo sapiens
cuaauaaacuugccauacg

SEQ ID NO: 1206429 - RNA, 19 nt, Homo sapiens
uggaggugccaaauaauua

SEQ ID NO: 1206430 - RNA, 19 nt, Homo sapiens
ggugagaccaaccaaugua

SEQ ID NO: 1206431 - RNA, 19 nt, Homo sapiens
gcucacagaaucacagcua

SEQ ID NO: 1206432 - RNA, 19 nt, Homo sapiens
ucauacaucuggaacaagu

SEQ ID NO: 1206433 - RNA, 19 nt, Homo sapiens
ccugaggacuucaccaguu

SEQ ID NO: 1206434 - RNA, 19 nt, Homo sapiens
gcacacacacacucuauac

SEQ ID NO: 1206435 - RNA, 19 nt, Homo sapiens
ccauuaacuugcugcuaaa

SEQ ID NO: 1206436 - RNA, 19 nt, Homo sapiens
gaggccaaauauaguaaug

SEQ ID NO: 1206437 - RNA, 19 nt, Homo sapiens
acauaaggauugagaaugg

SEQ ID NO: 1206438 - RNA, 19 nt, Homo sapiens
ucaacuaccuuauccuuuu

SEQ ID NO: 1206439 - RNA, 19 nt, Homo sapiens
ggaggugccaaauaauuau

SEQ ID NO: 1206440 - RNA, 19 nt, Homo sapiens
gcccuaugcugagcuugua

SEQ ID NO: 1206441 - RNA, 19 nt, Homo sapiens
caaccaaguacccugcuaa

SEQ ID NO: 1206442 - RNA, 19 nt, Homo sapiens
caagaugacugcucuauau

SEQ ID NO: 1206443 - RNA, 19 nt, Homo sapiens
cgaagaaccuacucagaua

SEQ ID NO: 1206444 - RNA, 19 nt, Homo sapiens
gcauaaagauggcaguuug

SEQ ID NO: 1206445 - RNA, 19 nt, Homo sapiens
gaugguauguauuccuuua

SEQ ID NO: 1206446 - RNA, 19 nt, Homo sapiens
ccuaauaacuucacaguau

SEQ ID NO: 1206447 - RNA, 19 nt, Homo sapiens
ucacaacgcuugaggaaug

SEQ ID NO: 1206448 - RNA, 19 nt, Homo sapiens
ggguauacguuguucuuua

SEQ ID NO: 1206449 - RNA, 19 nt, Homo sapiens
gaaccaguaucuacacuuc

SEQ ID NO: 1206450 - RNA, 19 nt, Homo sapiens
ugacagaagugugauauau

SEQ ID NO: 1206451 - RNA, 19 nt, Homo sapiens
gagcagcauuucuacauga

SEQ ID NO: 1206452 - RNA, 19 nt, Homo sapiens
gauggcaguuugugaaauu

SEQ ID NO: 1206453 - RNA, 19 nt, Homo sapiens
guagugauauuccucuuga

SEQ ID NO: 1206454 - RNA, 19 nt, Homo sapiens
gauagccaaugccaaguuu

SEQ ID NO: 1206455 - RNA, 19 nt, Homo sapiens
gaaguugacacuacugauu

SEQ ID NO: 1206456 - RNA, 19 nt, Homo sapiens
guccauaccuauugucauu

SEQ ID NO: 1206457 - RNA, 19 nt, Homo sapiens
auauuaagcugcuguugua

SEQ ID NO: 1206458 - RNA, 19 nt, Homo sapiens
ccucuacugugaccucuua

SEQ ID NO: 1206459 - RNA, 19 nt, Homo sapiens
ugaggaaugugugaagaua

SEQ ID NO: 1206460 - RNA, 19 nt, Homo sapiens
caggguguauuguagcuua

SEQ ID NO: 1206461 - RNA, 19 nt, Homo sapiens
caacacaagaauggaauua

SEQ ID NO: 1206462 - RNA, 19 nt, Homo sapiens
gugcagagaacaugaauga

SEQ ID NO: 1206463 - RNA, 19 nt, Homo sapiens
gcagagaacaugaaugaag

SEQ ID NO: 1206464 - RNA, 19 nt, Homo sapiens
aagcugcuguuguaaagua

SEQ ID NO: 1206465 - RNA, 19 nt, Homo sapiens
ggaacacaauauucuaagu

SEQ ID NO: 1206466 - RNA, 19 nt, Homo sapiens
ggauaaggagcacuuuaaa

SEQ ID NO: 1206467 - RNA, 19 nt, Homo sapiens
uccaauaucuagagacauu

SEQ ID NO: 1206468 - RNA, 19 nt, Homo sapiens
acagaagugugauauaugu

SEQ ID NO: 1206469 - RNA, 19 nt, Homo sapiens
cagcaaccauuccugaaga

SEQ ID NO: 1206470 - RNA, 19 nt, Homo sapiens
uugcagcucuuuccaauau

SEQ ID NO: 1206471 - RNA, 19 nt, Homo sapiens
agauagaccuguucacugu

SEQ ID NO: 1206472 - RNA, 19 nt, Homo sapiens
ggaauuuguucaccaugau

SEQ ID NO: 1206473 - RNA, 19 nt, Homo sapiens
gcaaaggaagcauaaagau

SEQ ID NO: 1206474 - RNA, 19 nt, Homo sapiens
guauuguccuucauaaugu

SEQ ID NO: 1206475 - RNA, 19 nt, Homo sapiens
gaagagaauuuuagugcuu

SEQ ID NO: 1206476 - RNA, 19 nt, Homo sapiens
uaagauggguauacguugu

SEQ ID NO: 1206477 - RNA, 19 nt, Homo sapiens
gguguauuguagcuuauaa

SEQ ID NO: 1206478 - RNA, 19 nt, Homo sapiens
cacuuacacuagagaaaua

SEQ ID NO: 1206479 - RNA, 19 nt, Homo sapiens
gcagacaacacaagaaugg

SEQ ID NO: 1206480 - RNA, 19 nt, Homo sapiens
caaaggaagcauaaagaug

SEQ ID NO: 1206481 - RNA, 19 nt, Homo sapiens
uuaaugcuguagugacuuu

SEQ ID NO: 1206482 - RNA, 19 nt, Homo sapiens
acaagaugauguuugcaaa

SEQ ID NO: 1206483 - RNA, 19 nt, Homo sapiens
cuauaucacuugagaaugg

SEQ ID NO: 1206484 - RNA, 19 nt, Homo sapiens
ugacugcucuauaucacuu

SEQ ID NO: 1206485 - RNA, 19 nt, Homo sapiens
gaugauugcauucuaacuu

SEQ ID NO: 1206486 - RNA, 19 nt, Homo sapiens
cagccucguugguuuguuu

SEQ ID NO: 1206487 - RNA, 19 nt, Homo sapiens
uuaggacucugcacuuuau

SEQ ID NO: 1206488 - RNA, 19 nt, Homo sapiens
uaauggagauuuggcauca

SEQ ID NO: 1206489 - RNA, 19 nt, Homo sapiens
gagcaaaggaagcauaaag

SEQ ID NO: 1206490 - RNA, 19 nt, Homo sapiens
gauauuaagcugcuguugu

SEQ ID NO: 1206491 - RNA, 19 nt, Homo sapiens
gguauacguuguucuuuac

SEQ ID NO: 1206492 - RNA, 19 nt, Homo sapiens
cuaauaacuucacaguaug

SEQ ID NO: 1206493 - RNA, 19 nt, Homo sapiens
ggaaucuuauccuacuaug

SEQ ID NO: 1206494 - RNA, 19 nt, Homo sapiens
acagauucuuguagugaua

SEQ ID NO: 1206495 - RNA, 19 nt, Homo sapiens
ugcaaaagcugcuguaauu

SEQ ID NO: 1206496 - RNA, 19 nt, Homo sapiens
aaagcauguuugacugaua

SEQ ID NO: 1206497 - RNA, 19 nt, Homo sapiens
cuacuaugauucacaagau

SEQ ID NO: 1206498 - RNA, 19 nt, Homo sapiens
ugacauccauaaggacaaa

SEQ ID NO: 1206499 - RNA, 19 nt, Homo sapiens
gaaaacaaaccacauacuu

SEQ ID NO: 1206500 - RNA, 19 nt, Homo sapiens
ggcaguuugugaaauuaaa

SEQ ID NO: 1206501 - RNA, 19 nt, Homo sapiens
caaaagcugcuguaauuaa

SEQ ID NO: 1206502 - RNA, 19 nt, Homo sapiens
gaaccuacucagauacaga

SEQ ID NO: 1206503 - RNA, 19 nt, Homo sapiens
gcaccauccggaucccuua

SEQ ID NO: 1206504 - RNA, 19 nt, Homo sapiens
gagagcagcauuucuacau

SEQ ID NO: 1206505 - RNA, 19 nt, Homo sapiens
gagcaucuuuaaauaacca

SEQ ID NO: 1206506 - RNA, 19 nt, Homo sapiens
ggacucugcacuuuauaga

SEQ ID NO: 1206507 - RNA, 19 nt, Homo sapiens
gucauuguuugccuuguaa

SEQ ID NO: 1206508 - RNA, 19 nt, Homo sapiens
ugucauuguuugccuugua

SEQ ID NO: 1206509 - RNA, 19 nt, Homo sapiens
ucaagaugacugcucuaua

SEQ ID NO: 1206510 - RNA, 19 nt, Homo sapiens
ugacauauugagcaucuuu

SEQ ID NO: 1206511 - RNA, 19 nt, Homo sapiens
gaagugugauauauguaac

SEQ ID NO: 1206512 - RNA, 19 nt, Homo sapiens
aaagauggcaguuugugaa

SEQ ID NO: 1206513 - RNA, 19 nt, Homo sapiens
caagaaaacaaaccacaua

SEQ ID NO: 1206514 - RNA, 19 nt, Homo sapiens
guaauacauucaucacaac

SEQ ID NO: 1206515 - RNA, 19 nt, Homo sapiens
uauuaggguuuccguuuga

SEQ ID NO: 1206516 - RNA, 19 nt, Homo sapiens
uggauaaggagcacuuuaa

SEQ ID NO: 1206517 - RNA, 19 nt, Homo sapiens
gcagcucuuuccaauaucu

SEQ ID NO: 1206518 - RNA, 19 nt, Homo sapiens
gugaugguauguauuccuu

SEQ ID NO: 1206519 - RNA, 19 nt, Homo sapiens
uugaacaaaugauggugua

SEQ ID NO: 1206520 - RNA, 19 nt, Homo sapiens
acucugcacuuuauagaau

SEQ ID NO: 1206521 - RNA, 19 nt, Homo sapiens
caugacauauugagcaucu

SEQ ID NO: 1206522 - RNA, 19 nt, Homo sapiens
gguauguauuccuuuaauc

SEQ ID NO: 1206523 - RNA, 19 nt, Homo sapiens
gggagcaaaggaagcauaa

SEQ ID NO: 1206524 - RNA, 19 nt, Homo sapiens
uaaagauggcaguuuguga

SEQ ID NO: 1206525 - RNA, 19 nt, Homo sapiens
gacagaagugugauauaug

SEQ ID NO: 1206526 - RNA, 19 nt, Homo sapiens
gcaagaguauuuuccuaau

SEQ ID NO: 1206527 - RNA, 19 nt, Homo sapiens
uagccaaugccaaguuuaa

SEQ ID NO: 1206528 - RNA, 19 nt, Homo sapiens
caucacaacgcuugaggaa

SEQ ID NO: 1206529 - RNA, 19 nt, Homo sapiens
ccauaccuauugucauugu

SEQ ID NO: 1206530 - RNA, 19 nt, Homo sapiens
aaggaauucugucaagaug

SEQ ID NO: 1206531 - RNA, 19 nt, Homo sapiens
caaaaggaauucugucaag

SEQ ID NO: 1206532 - RNA, 19 nt, Homo sapiens
uuaagcugcuguuguaaag

SEQ ID NO: 1206533 - RNA, 19 nt, Homo sapiens
ugaccuaccaaauuuaaga

SEQ ID NO: 1206534 - RNA, 19 nt, Homo sapiens
uguauuguccuucauaaug

SEQ ID NO: 1206535 - RNA, 19 nt, Homo sapiens
ccuuaggacucugcacuuu

SEQ ID NO: 1206536 - RNA, 19 nt, Homo sapiens
ccgaagaaccuacucagau

SEQ ID NO: 1206537 - RNA, 19 nt, Homo sapiens
guuugcagcucuuuccaau

SEQ ID NO: 1206538 - RNA, 19 nt, Homo sapiens
gacauauugagcaucuuua

SEQ ID NO: 1206539 - RNA, 19 nt, Homo sapiens
ugauggugaugguauguau

SEQ ID NO: 1206540 - RNA, 19 nt, Homo sapiens
guacaaguggaccaacuau

SEQ ID NO: 1206541 - RNA, 19 nt, Homo sapiens
gaacaaaugaugguguaac

SEQ ID NO: 1206542 - RNA, 19 nt, Homo sapiens
ggacagcacuuugaaugua

SEQ ID NO: 1206543 - RNA, 19 nt, Homo sapiens
uaacagaugcucaagauua

SEQ ID NO: 1206544 - RNA, 19 nt, Homo sapiens
ugacaaggcugccauaaga

SEQ ID NO: 1206545 - RNA, 19 nt, Homo sapiens
ggaagagccaguaagauua

SEQ ID NO: 1206546 - RNA, 19 nt, Homo sapiens
gccaagcgaugccauguua

SEQ ID NO: 1206547 - RNA, 19 nt, Homo sapiens
ggagggaacuuuagcacuu

SEQ ID NO: 1206548 - RNA, 19 nt, Homo sapiens
ugaagaagaugaagaugaa

SEQ ID NO: 1206549 - RNA, 19 nt, Homo sapiens
ggaagauucugagguuuaa

SEQ ID NO: 1206550 - RNA, 19 nt, Homo sapiens
cgacuaggcucaacuggaa

SEQ ID NO: 1206551 - RNA, 19 nt, Homo sapiens
gaagagagcaaacauuuua

SEQ ID NO: 1206552 - RNA, 19 nt, Homo sapiens
gaacuagaacaacgcaaua

SEQ ID NO: 1206553 - RNA, 19 nt, Homo sapiens
gaaucaacauggcugcuuu

SEQ ID NO: 1206554 - RNA, 19 nt, Homo sapiens
gaagccagccuaauucuga

SEQ ID NO: 1206555 - RNA, 19 nt, Homo sapiens
gguaacagaugcucaagau

SEQ ID NO: 1206556 - RNA, 19 nt, Homo sapiens
uaaaccagcucacagaaau

SEQ ID NO: 1206557 - RNA, 19 nt, Homo sapiens
guaccgagaugaagaagau

SEQ ID NO: 1206558 - RNA, 19 nt, Homo sapiens
gagaagagcugguuaaaag

SEQ ID NO: 1206559 - RNA, 19 nt, Homo sapiens
ccaggaagauucugagguu

SEQ ID NO: 1206560 - RNA, 19 nt, Homo sapiens
gaaauacggcaccagauug

SEQ ID NO: 1206561 - RNA, 19 nt, Homo sapiens
gagcaaaccuguccaucca

SEQ ID NO: 1206562 - RNA, 19 nt, Homo sapiens
cauaucagaugaaagcauu

SEQ ID NO: 1206563 - RNA, 19 nt, Homo sapiens
gcgaugccauguuaaagaa

SEQ ID NO: 1206564 - RNA, 19 nt, Homo sapiens
gcggagaucuggaaacagu

SEQ ID NO: 1206565 - RNA, 19 nt, Homo sapiens
aaagugggacucugucuua

SEQ ID NO: 1206566 - RNA, 19 nt, Homo sapiens
ccaacaaagugaagaggaa

SEQ ID NO: 1206567 - RNA, 19 nt, Homo sapiens
gacacaguuugcaccauua

SEQ ID NO: 1206568 - RNA, 19 nt, Homo sapiens
gcaaggaggaguggaauga

SEQ ID NO: 1206569 - RNA, 19 nt, Homo sapiens
gaagaugaaagcuaucaga

SEQ ID NO: 1206570 - RNA, 19 nt, Homo sapiens
gaacugucccaagcaauaa

SEQ ID NO: 1206571 - RNA, 19 nt, Homo sapiens
ccaaagugcugggauuaga

SEQ ID NO: 1206572 - RNA, 19 nt, Homo sapiens
ccaaauguguaggcucuaa

SEQ ID NO: 1206573 - RNA, 19 nt, Homo sapiens
cagaaggucccauucagua

SEQ ID NO: 1206574 - RNA, 19 nt, Homo sapiens
aauaaacagugguacauug

SEQ ID NO: 1206575 - RNA, 19 nt, Homo sapiens
gaagaggaccuaaagaaac

SEQ ID NO: 1206576 - RNA, 19 nt, Homo sapiens
gaagagcacguguucuaug

SEQ ID NO: 1206577 - RNA, 19 nt, Homo sapiens
caagagaagagcugguuaa

SEQ ID NO: 1206578 - RNA, 19 nt, Homo sapiens
cacaacaccuccuaccaaa

SEQ ID NO: 1206579 - RNA, 19 nt, Homo sapiens
cagaagaggaccuaaagaa

SEQ ID NO: 1206580 - RNA, 19 nt, Homo sapiens
gcaauacaguccucuugag

SEQ ID NO: 1206581 - RNA, 19 nt, Homo sapiens
agacacaguuugcaccauu

SEQ ID NO: 1206582 - RNA, 19 nt, Homo sapiens
cuagaaagcucagucaaag

SEQ ID NO: 1206583 - RNA, 19 nt, Homo sapiens
gaacuacuaccaaugaucu

SEQ ID NO: 1206584 - RNA, 19 nt, Homo sapiens
gcucggaacuacuaccaau

SEQ ID NO: 1206585 - RNA, 19 nt, Homo sapiens
gaaaauaucuaugcgaaag

SEQ ID NO: 1206586 - RNA, 19 nt, Homo sapiens
caacaaagugggacucugu

SEQ ID NO: 1206587 - RNA, 19 nt, Homo sapiens
ggaggaguggaaugaaaua

SEQ ID NO: 1206588 - RNA, 19 nt, Homo sapiens
ccucagucauuccuaaauu

SEQ ID NO: 1206589 - RNA, 19 nt, Homo sapiens
ggaagacccugagcaaggu

SEQ ID NO: 1206590 - RNA, 19 nt, Homo sapiens
ucccuaaacugguuaauag

SEQ ID NO: 1206591 - RNA, 19 nt, Homo sapiens
gcaccugaccuaagaggaa

SEQ ID NO: 1206592 - RNA, 19 nt, Homo sapiens
ugaacugucccaagcaaua

SEQ ID NO: 1206593 - RNA, 19 nt, Homo sapiens
gaagagccaguaagauuag

SEQ ID NO: 1206594 - RNA, 19 nt, Homo sapiens
guagcaugcuugaggaguu

SEQ ID NO: 1206595 - RNA, 19 nt, Homo sapiens
ggaaagacacacuggcaau

SEQ ID NO: 1206596 - RNA, 19 nt, Homo sapiens
agaugaagaugaaagcuau

SEQ ID NO: 1206597 - RNA, 19 nt, Homo sapiens
gagagaagagcacguguuc

SEQ ID NO: 1206598 - RNA, 19 nt, Homo sapiens
gaugaaagcauugcacugu

SEQ ID NO: 1206599 - RNA, 19 nt, Homo sapiens
ugaaauacggcaccagauu

SEQ ID NO: 1206600 - RNA, 19 nt, Homo sapiens
uaagagaggcauuccauca

SEQ ID NO: 1206601 - RNA, 19 nt, Homo sapiens
ccaguaagauuagcaaguc

SEQ ID NO: 1206602 - RNA, 19 nt, Homo sapiens
gaugccauguuaaagaaug

SEQ ID NO: 1206603 - RNA, 19 nt, Homo sapiens
agauggagguucaugaaga

SEQ ID NO: 1206604 - RNA, 19 nt, Homo sapiens
aaacgucggcucacuagaa

SEQ ID NO: 1206605 - RNA, 19 nt, Homo sapiens
gaaagacacacuggcaaug

SEQ ID NO: 1206606 - RNA, 19 nt, Homo sapiens
gagcaaguucucaggcuuu

SEQ ID NO: 1206607 - RNA, 19 nt, Homo sapiens
gcagugagccaagaucaug

SEQ ID NO: 1206608 - RNA, 19 nt, Homo sapiens
uuaccacacuggcauauca

SEQ ID NO: 1206609 - RNA, 19 nt, Homo sapiens
ucacuggaacagagucuua

SEQ ID NO: 1206610 - RNA, 19 nt, Homo sapiens
acacugauccggcgacuga

SEQ ID NO: 1206611 - RNA, 19 nt, Homo sapiens
cucagucauuccuaaauua

SEQ ID NO: 1206612 - RNA, 19 nt, Homo sapiens
gcaaagacuguuaaucucu

SEQ ID NO: 1206613 - RNA, 19 nt, Homo sapiens
gaaaccccaucucuacuaa

SEQ ID NO: 1206614 - RNA, 19 nt, Homo sapiens
cuaccucagucauuccuaa

SEQ ID NO: 1206615 - RNA, 19 nt, Homo sapiens
gcaugguccuggauagugu

SEQ ID NO: 1206616 - RNA, 19 nt, Homo sapiens
agaagaggaccuaaagaaa

SEQ ID NO: 1206617 - RNA, 19 nt, Homo sapiens
caagcgaugccauguuaaa

SEQ ID NO: 1206618 - RNA, 19 nt, Homo sapiens
ggaagauccauuugagaug

SEQ ID NO: 1206619 - RNA, 19 nt, Homo sapiens
gcaauaaacagugguacau

SEQ ID NO: 1206620 - RNA, 19 nt, Homo sapiens
agaaauagcaacccuguca

SEQ ID NO: 1206621 - RNA, 19 nt, Homo sapiens
cauagggaaugccagauca

SEQ ID NO: 1206622 - RNA, 19 nt, Homo sapiens
ucugacauguucuuccuuu

SEQ ID NO: 1206623 - RNA, 19 nt, Homo sapiens
acacuggcauaucagauga

SEQ ID NO: 1206624 - RNA, 19 nt, Homo sapiens
cuagaacaacgcaauauau

SEQ ID NO: 1206625 - RNA, 19 nt, Homo sapiens
ucaaagaccaacaccagaa

SEQ ID NO: 1206626 - RNA, 19 nt, Homo sapiens
gcaccagauuggaaacaca

SEQ ID NO: 1206627 - RNA, 19 nt, Homo sapiens
gcugaacugucccaagcaa

SEQ ID NO: 1206628 - RNA, 19 nt, Homo sapiens
ccaaccagaauccaaauug

SEQ ID NO: 1206629 - RNA, 19 nt, Homo sapiens
gauggagguucaugaagag

SEQ ID NO: 1206630 - RNA, 19 nt, Homo sapiens
aaggaggaguggaaugaaa

SEQ ID NO: 1206631 - RNA, 19 nt, Homo sapiens
gaguugaaccugaauucuu

SEQ ID NO: 1206632 - RNA, 19 nt, Homo sapiens
aggaagagccaguaagauu

SEQ ID NO: 1206633 - RNA, 19 nt, Homo sapiens
gacagcacuuugaauguag

SEQ ID NO: 1206634 - RNA, 19 nt, Homo sapiens
aacagaugcucaagauuau

SEQ ID NO: 1206635 - RNA, 19 nt, Homo sapiens
uaaauuaccacagugucua

SEQ ID NO: 1206636 - RNA, 19 nt, Homo sapiens
ucccaucacuauugaaaug

SEQ ID NO: 1206637 - RNA, 19 nt, Homo sapiens
gaucugacauguucuuccu

SEQ ID NO: 1206638 - RNA, 19 nt, Homo sapiens
ugaaagcauugcacuguac

SEQ ID NO: 1206639 - RNA, 19 nt, Homo sapiens
caacgggccagguaggauu

SEQ ID NO: 1206640 - RNA, 19 nt, Homo sapiens
aguugaaccugaauucuug

SEQ ID NO: 1206641 - RNA, 19 nt, Homo sapiens
gugguacauuguuaucaaa

SEQ ID NO: 1206642 - RNA, 19 nt, Homo sapiens
gaagaaauguucccaugaa

SEQ ID NO: 1206643 - RNA, 19 nt, Homo sapiens
gaccucaagugaaauaaua

SEQ ID NO: 1206644 - RNA, 19 nt, Homo sapiens
uaagggaccucaagugaaa

SEQ ID NO: 1206645 - RNA, 19 nt, Homo sapiens
gcuaagugaucaccacaua

SEQ ID NO: 1206646 - RNA, 19 nt, Homo sapiens
ggacuugucuccuaaucuu

SEQ ID NO: 1206647 - RNA, 19 nt, Homo sapiens
ggagaugccuguugugugu

SEQ ID NO: 1206648 - RNA, 19 nt, Homo sapiens
ccacauacauggacacugu

SEQ ID NO: 1206649 - RNA, 19 nt, Homo sapiens
gggaaugccugcagcuuga

SEQ ID NO: 1206650 - RNA, 19 nt, Homo sapiens
cuacguggcuugcacugua

SEQ ID NO: 1206651 - RNA, 19 nt, Homo sapiens
ucacugaccucauuuccuu

SEQ ID NO: 1206652 - RNA, 19 nt, Homo sapiens
guuaucagcugcauguuug

SEQ ID NO: 1206653 - RNA, 19 nt, Homo sapiens
gguaugagcugaaaacauu

SEQ ID NO: 1206654 - RNA, 19 nt, Homo sapiens
gaaguuaucagcugcaugu

SEQ ID NO: 1206655 - RNA, 19 nt, Homo sapiens
gagcacaccuauucagcaa

SEQ ID NO: 1206656 - RNA, 19 nt, Homo sapiens
uaagagaaguagagcaaug

SEQ ID NO: 1206657 - RNA, 19 nt, Homo sapiens
ugagucggauguaucuuua

SEQ ID NO: 1206658 - RNA, 19 nt, Homo sapiens
gugaagcccucugcagaua

SEQ ID NO: 1206659 - RNA, 19 nt, Homo sapiens
uagagagccuuguguagaa

SEQ ID NO: 1206660 - RNA, 19 nt, Homo sapiens
gauaagagaaguagagcaa

SEQ ID NO: 1206661 - RNA, 19 nt, Homo sapiens
gaagcccucugcagauaga

SEQ ID NO: 1206662 - RNA, 19 nt, Homo sapiens
uagcagcccugauaagaga

SEQ ID NO: 1206663 - RNA, 19 nt, Homo sapiens
aguagaaacugccaagaaa

SEQ ID NO: 1206664 - RNA, 19 nt, Homo sapiens
gcuccuggauauucaauga

SEQ ID NO: 1206665 - RNA, 19 nt, Homo sapiens
caacauguagucuguagaa

SEQ ID NO: 1206666 - RNA, 19 nt, Homo sapiens
ugaauugucugugguauca

SEQ ID NO: 1206667 - RNA, 19 nt, Homo sapiens
cgacagccauuugaacuug

SEQ ID NO: 1206668 - RNA, 19 nt, Homo sapiens
caugaagccuccagaugaa

SEQ ID NO: 1206669 - RNA, 19 nt, Homo sapiens
agauacagcuguugaggaa

SEQ ID NO: 1206670 - RNA, 19 nt, Homo sapiens
caagucaguuacggaauuu

SEQ ID NO: 1206671 - RNA, 19 nt, Homo sapiens
ggauguaucuuuauauucc

SEQ ID NO: 1206672 - RNA, 19 nt, Homo sapiens
gccaagaccuaacucuaga

SEQ ID NO: 1206673 - RNA, 19 nt, Homo sapiens
uaagugaucaccacauauu

SEQ ID NO: 1206674 - RNA, 19 nt, Homo sapiens
gaauucaggaucaaccuuu

SEQ ID NO: 1206675 - RNA, 19 nt, Homo sapiens
acaagucaguuacggaauu

SEQ ID NO: 1206676 - RNA, 19 nt, Homo sapiens
ccaugaagccuccagauga

SEQ ID NO: 1206677 - RNA, 19 nt, Homo sapiens
caaugaagauacagcuguu

SEQ ID NO: 1206678 - RNA, 19 nt, Homo sapiens
gcuuuaagaugaugagcaa

SEQ ID NO: 1206679 - RNA, 19 nt, Homo sapiens
acuuggagcucucuaauga

SEQ ID NO: 1206680 - RNA, 19 nt, Homo sapiens
ccaguguguuccugucaua

SEQ ID NO: 1206681 - RNA, 19 nt, Homo sapiens
guugggaaguuguuuaugu

SEQ ID NO: 1206682 - RNA, 19 nt, Homo sapiens
gcucauguguugggaaguu

SEQ ID NO: 1206683 - RNA, 19 nt, Homo sapiens
guugggaaguuguuuaugu

SEQ ID NO: 1206684 - RNA, 19 nt, Homo sapiens
gcucauguguugggaaguu

SEQ ID NO: 1206685 - RNA, 19 nt, Homo sapiens
acauaaggcuggucucuuc

SEQ ID NO: 1206686 - RNA, 19 nt, Homo sapiens
ugaggaaccugucccugaa

SEQ ID NO: 1206687 - RNA, 19 nt, Homo sapiens
gaacuuggagcucucuaau

SEQ ID NO: 1206688 - RNA, 19 nt, Homo sapiens
ccugaggaguggagucaua

SEQ ID NO: 1206689 - RNA, 19 nt, Homo sapiens
ccugaggaguggagucaua

SEQ ID NO: 1206690 - RNA, 19 nt, Homo sapiens
ccugaggaguggagucaua

SEQ ID NO: 1206691 - RNA, 19 nt, Homo sapiens
gagaaaagauccccaugga

SEQ ID NO: 1206692 - RNA, 19 nt, Homo sapiens
uaagggcuacugguuauua

SEQ ID NO: 1206693 - RNA, 19 nt, Homo sapiens
cugcuuggcucauguguug

SEQ ID NO: 1206694 - RNA, 19 nt, Homo sapiens
gaaccugucccugaaguug

SEQ ID NO: 1206695 - RNA, 19 nt, Homo sapiens
gaagggauaccaaagucuu

SEQ ID NO: 1206696 - RNA, 19 nt, Homo sapiens
aaacauugcuaagugauca

SEQ ID NO: 1206697 - RNA, 19 nt, Homo sapiens
gcagcucuguucuggaguu

SEQ ID NO: 1206698 - RNA, 19 nt, Homo sapiens
gaagaaacaaagucaccuu

SEQ ID NO: 1206699 - RNA, 19 nt, Homo sapiens
gcacaccuauucagcaacu

SEQ ID NO: 1206700 - RNA, 19 nt, Homo sapiens
agucggauguaucuuuaua

SEQ ID NO: 1206701 - RNA, 19 nt, Homo sapiens
gcuaauccuuucucuugga

SEQ ID NO: 1206702 - RNA, 19 nt, Homo sapiens
ggccagauaccguguacua

SEQ ID NO: 1206703 - RNA, 19 nt, Homo sapiens
gugauaaugcaaugacaua

SEQ ID NO: 1206704 - RNA, 19 nt, Homo sapiens
gaucaccacauauuguuga

SEQ ID NO: 1206705 - RNA, 19 nt, Homo sapiens
guagugguaugagcugaaa

SEQ ID NO: 1206706 - RNA, 19 nt, Homo sapiens
gcugggagaugccuguugu

SEQ ID NO: 1206707 - RNA, 19 nt, Homo sapiens
cugcguggcuuguguguug

SEQ ID NO: 1206708 - RNA, 19 nt, Homo sapiens
cugcguggcucauguguug

SEQ ID NO: 1206709 - RNA, 19 nt, Homo sapiens
cugcuuggcucacguguug

SEQ ID NO: 1206710 - RNA, 19 nt, Homo sapiens
cugcguggcuuguguguug

SEQ ID NO: 1206711 - RNA, 19 nt, Homo sapiens
cauuaauccuugcagguuu

SEQ ID NO: 1206712 - RNA, 19 nt, Homo sapiens
ccaaagucuuguauucaau

SEQ ID NO: 1206713 - RNA, 19 nt, Homo sapiens
uguaagggcuacugguuau

SEQ ID NO: 1206714 - RNA, 19 nt, Homo sapiens
cuacugcgcuuucgaugca

SEQ ID NO: 1206715 - RNA, 19 nt, Homo sapiens
gagagaagaaacaaaguca

SEQ ID NO: 1206716 - RNA, 19 nt, Homo sapiens
gaaaaccaguccacacaug

SEQ ID NO: 1206717 - RNA, 19 nt, Homo sapiens
ugucuggccucauucugua

SEQ ID NO: 1206718 - RNA, 19 nt, Homo sapiens
gggugugucuggccucauu

SEQ ID NO: 1206719 - RNA, 19 nt, Homo sapiens
caucagacaaggacuuuga

SEQ ID NO: 1206720 - RNA, 19 nt, Homo sapiens
gcccuggaauugccacauu

SEQ ID NO: 1206721 - RNA, 19 nt, Homo sapiens
cacgcaggcuuuaagauga

SEQ ID NO: 1206722 - RNA, 19 nt, Homo sapiens
gaugugugauaaugcaaug

SEQ ID NO: 1206723 - RNA, 19 nt, Homo sapiens
gggaugggauguaaagaac

SEQ ID NO: 1206724 - RNA, 19 nt, Homo sapiens
gcucucuaaugaagggaua

SEQ ID NO: 1206725 - RNA, 19 nt, Homo sapiens
gauguaagggcuacugguu

SEQ ID NO: 1206726 - RNA, 19 nt, Homo sapiens
gagcguuccguguccauaa

SEQ ID NO: 1206727 - RNA, 19 nt, Homo sapiens
aaugagagcacaccuauuc

SEQ ID NO: 1206728 - RNA, 19 nt, Homo sapiens
ggucuucauuucauuugug

SEQ ID NO: 1206729 - RNA, 19 nt, Homo sapiens
ucaacuccgugucccauug

SEQ ID NO: 1206730 - RNA, 19 nt, Homo sapiens
ugaccacgcucuccuuucu

SEQ ID NO: 1206731 - RNA, 19 nt, Homo sapiens
ugaggcaccgcccuuguua

SEQ ID NO: 1206732 - RNA, 19 nt, Homo sapiens
ugcaauugcuccuggauau

SEQ ID NO: 1206733 - RNA, 19 nt, Homo sapiens
cagauacugugaacuugga

SEQ ID NO: 1206734 - RNA, 19 nt, Homo sapiens
cauuugaacuuggaugaga

SEQ ID NO: 1206735 - RNA, 19 nt, Homo sapiens
cgcuuucgaugcagaauaa

SEQ ID NO: 1206736 - RNA, 19 nt, Homo sapiens
gggugugggugguggguuu

SEQ ID NO: 1206737 - RNA, 19 nt, Homo sapiens
gcaggugacauuaauccuu

SEQ ID NO: 1206738 - RNA, 19 nt, Homo sapiens
gaggccacguggucacuga

SEQ ID NO: 1206739 - RNA, 19 nt, Homo sapiens
ucaagcugaugugugauaa

SEQ ID NO: 1206740 - RNA, 19 nt, Homo sapiens
cuguauggcuugcguguug

SEQ ID NO: 1206741 - RNA, 19 nt, Homo sapiens
gauaaugcaaugacauaca

SEQ ID NO: 1206742 - RNA, 19 nt, Homo sapiens
ggaaguagcuggaaauauu

SEQ ID NO: 1206743 - RNA, 19 nt, Homo sapiens
gaacuugacuaccucauua

SEQ ID NO: 1206744 - RNA, 19 nt, Homo sapiens
gaaagucaguacaguauug

SEQ ID NO: 1206745 - RNA, 19 nt, Homo sapiens
ggaaacauccuccguauug

SEQ ID NO: 1206746 - RNA, 19 nt, Homo sapiens
gagaguaccugucugcaaa

SEQ ID NO: 1206747 - RNA, 19 nt, Homo sapiens
gaagaagugcuacauaauu

SEQ ID NO: 1206748 - RNA, 19 nt, Homo sapiens
ugaaggaucuacugucuaa

SEQ ID NO: 1206749 - RNA, 19 nt, Homo sapiens
aaacugaccugcccugaaa

SEQ ID NO: 1206750 - RNA, 19 nt, Homo sapiens
gaaguuagcauucuuguuc

SEQ ID NO: 1206751 - RNA, 19 nt, Homo sapiens
gaagcaagauacaccuaaa

SEQ ID NO: 1206752 - RNA, 19 nt, Homo sapiens
ccaaacaacugagaauaaa

SEQ ID NO: 1206753 - RNA, 19 nt, Homo sapiens
guuggaagcuguagagaaa

SEQ ID NO: 1206754 - RNA, 19 nt, Homo sapiens
gaagcaaacuccaaagucu

SEQ ID NO: 1206755 - RNA, 19 nt, Homo sapiens
gcacuuacguuuucauuuu

SEQ ID NO: 1206756 - RNA, 19 nt, Homo sapiens
ucaaaugcuugcuugguua

SEQ ID NO: 1206757 - RNA, 19 nt, Homo sapiens
ugacagaaguagauuauuc

SEQ ID NO: 1206758 - RNA, 19 nt, Homo sapiens
agaaugagcucuuaaacug

SEQ ID NO: 1206759 - RNA, 19 nt, Homo sapiens
ucaagagacugcaaauuau

SEQ ID NO: 1206760 - RNA, 19 nt, Homo sapiens
ucaagaagcugcugguuca

SEQ ID NO: 1206761 - RNA, 19 nt, Homo sapiens
gggaagggcucgcuagaau

SEQ ID NO: 1206762 - RNA, 19 nt, Homo sapiens
gaacagaacaccaccaagu

SEQ ID NO: 1206763 - RNA, 19 nt, Homo sapiens
acaaguaucucaagcauca

SEQ ID NO: 1206764 - RNA, 19 nt, Homo sapiens
gcgcaagggccacugauua

SEQ ID NO: 1206765 - RNA, 19 nt, Homo sapiens
ugauggaacuauucaagua

SEQ ID NO: 1206766 - RNA, 19 nt, Homo sapiens
ccucaugacugauugguuu

SEQ ID NO: 1206767 - RNA, 19 nt, Homo sapiens
caacugccaucuauacaug

SEQ ID NO: 1206768 - RNA, 19 nt, Homo sapiens
gaacacagaacccaaagau

SEQ ID NO: 1206769 - RNA, 19 nt, Homo sapiens
cagcaagccucauaccaaa

SEQ ID NO: 1206770 - RNA, 19 nt, Homo sapiens
gaagggcucgcuagaauga

SEQ ID NO: 1206771 - RNA, 19 nt, Homo sapiens
gaaaugaaagucugagugu

SEQ ID NO: 1206772 - RNA, 19 nt, Homo sapiens
ggagauuaauaaccaauuc

SEQ ID NO: 1206773 - RNA, 19 nt, Homo sapiens
agaccaaccuauuguguuu

SEQ ID NO: 1206774 - RNA, 19 nt, Homo sapiens
caaagaagcaaacuccaaa

SEQ ID NO: 1206775 - RNA, 19 nt, Homo sapiens
gaacagaggaaacaagaca

SEQ ID NO: 1206776 - RNA, 19 nt, Homo sapiens
gauacaaccacaagaguuu

SEQ ID NO: 1206777 - RNA, 19 nt, Homo sapiens
ggacucauaugccuuaaac

SEQ ID NO: 1206778 - RNA, 19 nt, Homo sapiens
caacgaaaccuuuaacagu

SEQ ID NO: 1206779 - RNA, 19 nt, Homo sapiens
ccugagguauuuaacguua

SEQ ID NO: 1206780 - RNA, 19 nt, Homo sapiens
agagaaauaugaagaagug

SEQ ID NO: 1206781 - RNA, 19 nt, Homo sapiens
aaaggaugguguucuaauu

SEQ ID NO: 1206782 - RNA, 19 nt, Homo sapiens
cucaagagacugcaaauua

SEQ ID NO: 1206783 - RNA, 19 nt, Homo sapiens
ggaaacaagacaccucaaa

SEQ ID NO: 1206784 - RNA, 19 nt, Homo sapiens
gaaauaugaagaagugcua

SEQ ID NO: 1206785 - RNA, 19 nt, Homo sapiens
caggcuaucuucuuuauca

SEQ ID NO: 1206786 - RNA, 19 nt, Homo sapiens
ucacagauuucuccaaagu

SEQ ID NO: 1206787 - RNA, 19 nt, Homo sapiens
gaaagaaaugaaagucuga

SEQ ID NO: 1206788 - RNA, 19 nt, Homo sapiens
gaagaaaggagcucugaag

SEQ ID NO: 1206789 - RNA, 19 nt, Homo sapiens
ucaccuggcuacaaucaaa

SEQ ID NO: 1206790 - RNA, 19 nt, Homo sapiens
ccaggaaguugaacacaga

SEQ ID NO: 1206791 - RNA, 19 nt, Homo sapiens
ggucuacucugccggaaga

SEQ ID NO: 1206792 - RNA, 19 nt, Homo sapiens
gcuaauacaaucagagaaa

SEQ ID NO: 1206793 - RNA, 19 nt, Homo sapiens
ggaggaagaaaugcuaaua

SEQ ID NO: 1206794 - RNA, 19 nt, Homo sapiens
gagccuagaucuacuaaaa

SEQ ID NO: 1206795 - RNA, 19 nt, Homo sapiens
uagcggcacuaauuacuuu

SEQ ID NO: 1206796 - RNA, 19 nt, Homo sapiens
gaucugcccucaugagaag

SEQ ID NO: 1206797 - RNA, 19 nt, Homo sapiens
guuccaagcuagagaguau

SEQ ID NO: 1206798 - RNA, 19 nt, Homo sapiens
ccaaagcuguggccaguuc

SEQ ID NO: 1206799 - RNA, 19 nt, Homo sapiens
gaccugcccugaaagaaau

SEQ ID NO: 1206800 - RNA, 19 nt, Homo sapiens
uggaagcuguagagaaaua

SEQ ID NO: 1206801 - RNA, 19 nt, Homo sapiens
ggugagggaucauguaaag

SEQ ID NO: 1206802 - RNA, 19 nt, Homo sapiens
gaaagaacaagauccaaag

SEQ ID NO: 1206803 - RNA, 19 nt, Homo sapiens
gcagucauccuuguacuuu

SEQ ID NO: 1206804 - RNA, 19 nt, Homo sapiens
guacaaguaucucaagcau

SEQ ID NO: 1206805 - RNA, 19 nt, Homo sapiens
gucaagcugugaauguaua

SEQ ID NO: 1206806 - RNA, 19 nt, Homo sapiens
aaaucaagcugaaugacaa

SEQ ID NO: 1206807 - RNA, 19 nt, Homo sapiens
caaaaucuguccagucaaa

SEQ ID NO: 1206808 - RNA, 19 nt, Homo sapiens
ggaccacucccauguguga

SEQ ID NO: 1206809 - RNA, 19 nt, Homo sapiens
caguucagcugcagaaaga

SEQ ID NO: 1206810 - RNA, 19 nt, Homo sapiens
guugggauaugcuuacuga

SEQ ID NO: 1206811 - RNA, 19 nt, Homo sapiens
augaagaagugcuacauaa

SEQ ID NO: 1206812 - RNA, 19 nt, Homo sapiens
ggaagcaagauacaccuaa

SEQ ID NO: 1206813 - RNA, 19 nt, Homo sapiens
uaacagacgcuauaugaca

SEQ ID NO: 1206814 - RNA, 19 nt, Homo sapiens
ggaagaaaugcuaauacaa

SEQ ID NO: 1206815 - RNA, 19 nt, Homo sapiens
cuggaaauauucuacguuu

SEQ ID NO: 1206816 - RNA, 19 nt, Homo sapiens
ggagcaauuuauggaagua

SEQ ID NO: 1206817 - RNA, 19 nt, Homo sapiens
acacagaacccaaagaugu

SEQ ID NO: 1206818 - RNA, 19 nt, Homo sapiens
ucauaugccuuaaacacaa

SEQ ID NO: 1206819 - RNA, 19 nt, Homo sapiens
uguauuaacguucagcuua

SEQ ID NO: 1206820 - RNA, 19 nt, Homo sapiens
ccaugaaacugcuagcaau

SEQ ID NO: 1206821 - RNA, 19 nt, Homo sapiens
gugaauggcacuuacguuu

SEQ ID NO: 1206822 - RNA, 19 nt, Homo sapiens
ggugggagauuaauaacca

SEQ ID NO: 1206823 - RNA, 19 nt, Homo sapiens
gcaguuuccuuagaacaga

SEQ ID NO: 1206824 - RNA, 19 nt, Homo sapiens
uaaacugacugccucaagu

SEQ ID NO: 1206825 - RNA, 19 nt, Homo sapiens
uguuugcacuuaauccuua

SEQ ID NO: 1206826 - RNA, 19 nt, Homo sapiens
gaagacugaaucugucaaa

SEQ ID NO: 1206827 - RNA, 19 nt, Homo sapiens
cguaugagaccuauauuga

SEQ ID NO: 1206828 - RNA, 19 nt, Homo sapiens
acagaggacucccuucaau

SEQ ID NO: 1206829 - RNA, 19 nt, Homo sapiens
gaucaggcuucuucuggau

SEQ ID NO: 1206830 - RNA, 19 nt, Homo sapiens
gcaagccucauaccaaaug

SEQ ID NO: 1206831 - RNA, 19 nt, Homo sapiens
gaucuacugucuaaauugc

SEQ ID NO: 1206832 - RNA, 19 nt, Homo sapiens
uuauaaggaucgccugaaa

SEQ ID NO: 1206833 - RNA, 19 nt, Homo sapiens
gaugcgaguugccuucuca

SEQ ID NO: 1206834 - RNA, 19 nt, Homo sapiens
agaggacucccuucaauuu

SEQ ID NO: 1206835 - RNA, 19 nt, Homo sapiens
gauggaacuauucaaguaa

SEQ ID NO: 1206836 - RNA, 19 nt, Homo sapiens
gcuacuucuucuccaguua

SEQ ID NO: 1206837 - RNA, 19 nt, Homo sapiens
agucacagauuucuccaaa

SEQ ID NO: 1206838 - RNA, 19 nt, Homo sapiens
gaagcugcugguucacuua

SEQ ID NO: 1206839 - RNA, 19 nt, Homo sapiens
caagcugaaugacaauuag

SEQ ID NO: 1206840 - RNA, 19 nt, Homo sapiens
agaacaagauccaaagaag

SEQ ID NO: 1206841 - RNA, 19 nt, Homo sapiens
caaacaaggcgaagagcaa

SEQ ID NO: 1206842 - RNA, 19 nt, Homo sapiens
ggaaguagcuggaaauauu

SEQ ID NO: 1206843 - RNA, 19 nt, Homo sapiens
gaacuugacuaccucauua

SEQ ID NO: 1206844 - RNA, 19 nt, Homo sapiens
gaaagucaguacaguauug

SEQ ID NO: 1206845 - RNA, 19 nt, Homo sapiens
ggaaacauccuccguauug

SEQ ID NO: 1206846 - RNA, 19 nt, Homo sapiens
gagaguaccugucugcaaa

SEQ ID NO: 1206847 - RNA, 19 nt, Homo sapiens
gaagaagugcuacauaauu

SEQ ID NO: 1206848 - RNA, 19 nt, Homo sapiens
ugaaggaucuacugucuaa

SEQ ID NO: 1206849 - RNA, 19 nt, Homo sapiens
aaacugaccugcccugaaa

SEQ ID NO: 1206850 - RNA, 19 nt, Homo sapiens
gaaguuagcauucuuguuc

SEQ ID NO: 1206851 - RNA, 19 nt, Homo sapiens
gaagcaagauacaccuaaa

SEQ ID NO: 1206852 - RNA, 19 nt, Homo sapiens
ccaaacaacugagaauaaa

SEQ ID NO: 1206853 - RNA, 19 nt, Homo sapiens
guuggaagcuguagagaaa

SEQ ID NO: 1206854 - RNA, 19 nt, Homo sapiens
gcaaguaguaguucaguaa

SEQ ID NO: 1206855 - RNA, 19 nt, Homo sapiens
gaagcaaacuccaaagucu

SEQ ID NO: 1206856 - RNA, 19 nt, Homo sapiens
gcacuuacguuuucauuuu

SEQ ID NO: 1206857 - RNA, 19 nt, Homo sapiens
ucaaaugcuugcuugguua

SEQ ID NO: 1206858 - RNA, 19 nt, Homo sapiens
ugacagaaguagauuauuc

SEQ ID NO: 1206859 - RNA, 19 nt, Homo sapiens
agaaugagcucuuaaacug

SEQ ID NO: 1206860 - RNA, 19 nt, Homo sapiens
ucaagagacugcaaauuau

SEQ ID NO: 1206861 - RNA, 19 nt, Homo sapiens
ucaagaagcugcugguuca

SEQ ID NO: 1206862 - RNA, 19 nt, Homo sapiens
gggaagggcucgcuagaau

SEQ ID NO: 1206863 - RNA, 19 nt, Homo sapiens
gaacagaacaccaccaagu

SEQ ID NO: 1206864 - RNA, 19 nt, Homo sapiens
acaaguaucucaagcauca

SEQ ID NO: 1206865 - RNA, 19 nt, Homo sapiens
gcgcaagggccacugauua

SEQ ID NO: 1206866 - RNA, 19 nt, Homo sapiens
ugauggaacuauucaagua

SEQ ID NO: 1206867 - RNA, 19 nt, Homo sapiens
ccucaugacugauugguuu

SEQ ID NO: 1206868 - RNA, 19 nt, Homo sapiens
caacugccaucuauacaug

SEQ ID NO: 1206869 - RNA, 19 nt, Homo sapiens
gaacacagaacccaaagau

SEQ ID NO: 1206870 - RNA, 19 nt, Homo sapiens
cagcaagccucauaccaaa

SEQ ID NO: 1206871 - RNA, 19 nt, Homo sapiens
gaagggcucgcuagaauga

SEQ ID NO: 1206872 - RNA, 19 nt, Homo sapiens
ggagauuaauaaccaauuc

SEQ ID NO: 1206873 - RNA, 19 nt, Homo sapiens
guaguucaguaaccauuaa

SEQ ID NO: 1206874 - RNA, 19 nt, Homo sapiens
agaccaaccuauuguguuu

SEQ ID NO: 1206875 - RNA, 19 nt, Homo sapiens
cagacaguauuuaacguua

SEQ ID NO: 1206876 - RNA, 19 nt, Homo sapiens
caaagaagcaaacuccaaa

SEQ ID NO: 1206877 - RNA, 19 nt, Homo sapiens
gaacagaggaaacaagaca

SEQ ID NO: 1206878 - RNA, 19 nt, Homo sapiens
gauacaaccacaagaguuu

SEQ ID NO: 1206879 - RNA, 19 nt, Homo sapiens
ggacucauaugccuuaaac

SEQ ID NO: 1206880 - RNA, 19 nt, Homo sapiens
caacgaaaccuuuaacagu

SEQ ID NO: 1206881 - RNA, 19 nt, Homo sapiens
agagaaauaugaagaagug

SEQ ID NO: 1206882 - RNA, 19 nt, Homo sapiens
aaaggaugguguucuaauu

SEQ ID NO: 1206883 - RNA, 19 nt, Homo sapiens
cucaagagacugcaaauua

SEQ ID NO: 1206884 - RNA, 19 nt, Homo sapiens
ggaaacaagacaccucaaa

SEQ ID NO: 1206885 - RNA, 19 nt, Homo sapiens
gaaauaugaagaagugcua

SEQ ID NO: 1206886 - RNA, 19 nt, Homo sapiens
caggcuaucuucuuuauca

SEQ ID NO: 1206887 - RNA, 19 nt, Homo sapiens
ucacagauuucuccaaagu

SEQ ID NO: 1206888 - RNA, 19 nt, Homo sapiens
gaaagaaaugaaagucuga

SEQ ID NO: 1206889 - RNA, 19 nt, Homo sapiens
gaagaaaggagcucugaag

SEQ ID NO: 1206890 - RNA, 19 nt, Homo sapiens
ucaccuggcuacaaucaaa

SEQ ID NO: 1206891 - RNA, 19 nt, Homo sapiens
ccaggaaguugaacacaga

SEQ ID NO: 1206892 - RNA, 19 nt, Homo sapiens
ggucuacucugccggaaga

SEQ ID NO: 1206893 - RNA, 19 nt, Homo sapiens
gcuaauacaaucagagaaa

SEQ ID NO: 1206894 - RNA, 19 nt, Homo sapiens
ggaggaagaaaugcuaaua

SEQ ID NO: 1206895 - RNA, 19 nt, Homo sapiens
gagccuagaucuacuaaaa

SEQ ID NO: 1206896 - RNA, 19 nt, Homo sapiens
uagcggcacuaauuacuuu

SEQ ID NO: 1206897 - RNA, 19 nt, Homo sapiens
gaucugcccucaugagaag

SEQ ID NO: 1206898 - RNA, 19 nt, Homo sapiens
guuccaagcuagagaguau

SEQ ID NO: 1206899 - RNA, 19 nt, Homo sapiens
ccaaagcuguggccaguuc

SEQ ID NO: 1206900 - RNA, 19 nt, Homo sapiens
gaccugcccugaaagaaau

SEQ ID NO: 1206901 - RNA, 19 nt, Homo sapiens
uggaagcuguagagaaaua

SEQ ID NO: 1206902 - RNA, 19 nt, Homo sapiens
ggugagggaucauguaaag

SEQ ID NO: 1206903 - RNA, 19 nt, Homo sapiens
gaaagaacaagauccaaag

SEQ ID NO: 1206904 - RNA, 19 nt, Homo sapiens
guacaaguaucucaagcau

SEQ ID NO: 1206905 - RNA, 19 nt, Homo sapiens
gucaagcugugaauguaua

SEQ ID NO: 1206906 - RNA, 19 nt, Homo sapiens
aaaucaagcugaaugacaa

SEQ ID NO: 1206907 - RNA, 19 nt, Homo sapiens
caaaaucuguccagucaaa

SEQ ID NO: 1206908 - RNA, 19 nt, Homo sapiens
ggaccacucccauguguga

SEQ ID NO: 1206909 - RNA, 19 nt, Homo sapiens
caguucagcugcagaaaga

SEQ ID NO: 1206910 - RNA, 19 nt, Homo sapiens
guugggauaugcuuacuga

SEQ ID NO: 1206911 - RNA, 19 nt, Homo sapiens
augaagaagugcuacauaa

SEQ ID NO: 1206912 - RNA, 19 nt, Homo sapiens
ggaagcaagauacaccuaa

SEQ ID NO: 1206913 - RNA, 19 nt, Homo sapiens
uaacagacgcuauaugaca

SEQ ID NO: 1206914 - RNA, 19 nt, Homo sapiens
ggaagaaaugcuaauacaa

SEQ ID NO: 1206915 - RNA, 19 nt, Homo sapiens
cuggaaauauucuacguuu

SEQ ID NO: 1206916 - RNA, 19 nt, Homo sapiens
ggagcaauuuauggaagua

SEQ ID NO: 1206917 - RNA, 19 nt, Homo sapiens
uaacacagcacccuuucaa

SEQ ID NO: 1206918 - RNA, 19 nt, Homo sapiens
acacagaacccaaagaugu

SEQ ID NO: 1206919 - RNA, 19 nt, Homo sapiens
ucauaugccuuaaacacaa

SEQ ID NO: 1206920 - RNA, 19 nt, Homo sapiens
uguauuaacguucagcuua

SEQ ID NO: 1206921 - RNA, 19 nt, Homo sapiens
ccaugaaacugcuagcaau

SEQ ID NO: 1206922 - RNA, 19 nt, Homo sapiens
gugaauggcacuuacguuu

SEQ ID NO: 1206923 - RNA, 19 nt, Homo sapiens
ggugggagauuaauaacca

SEQ ID NO: 1206924 - RNA, 19 nt, Homo sapiens
gcaguuuccuuagaacaga

SEQ ID NO: 1206925 - RNA, 19 nt, Homo sapiens
uaaacugacugccucaagu

SEQ ID NO: 1206926 - RNA, 19 nt, Homo sapiens
uguuugcacuuaauccuua

SEQ ID NO: 1206927 - RNA, 19 nt, Homo sapiens
gaagacugaaucugucaaa

SEQ ID NO: 1206928 - RNA, 19 nt, Homo sapiens
cguaugagaccuauauuga

SEQ ID NO: 1206929 - RNA, 19 nt, Homo sapiens
gaucaggcuucuucuggau

SEQ ID NO: 1206930 - RNA, 19 nt, Homo sapiens
gcaagccucauaccaaaug

SEQ ID NO: 1206931 - RNA, 19 nt, Homo sapiens
gaucuacugucuaaauugc

SEQ ID NO: 1206932 - RNA, 19 nt, Homo sapiens
uuauaaggaucgccugaaa

SEQ ID NO: 1206933 - RNA, 19 nt, Homo sapiens
gaugcgaguugccuucuca

SEQ ID NO: 1206934 - RNA, 19 nt, Homo sapiens
agaggacucccuucaauuu

SEQ ID NO: 1206935 - RNA, 19 nt, Homo sapiens
gauggaacuauucaaguaa

SEQ ID NO: 1206936 - RNA, 19 nt, Homo sapiens
gcagacaguauuuaacguu

SEQ ID NO: 1206937 - RNA, 19 nt, Homo sapiens
gcuacuucuucuccaguua

SEQ ID NO: 1206938 - RNA, 19 nt, Homo sapiens
agucacagauuucuccaaa

SEQ ID NO: 1206939 - RNA, 19 nt, Homo sapiens
gaagcugcugguucacuua

SEQ ID NO: 1206940 - RNA, 19 nt, Homo sapiens
caagcugaaugacaauuag

SEQ ID NO: 1206941 - RNA, 19 nt, Homo sapiens
agaacaagauccaaagaag

SEQ ID NO: 1206942 - RNA, 19 nt, Homo sapiens
ggaaagagauccacaagga

SEQ ID NO: 1206943 - RNA, 19 nt, Homo sapiens
cagaaugcaucauguagua

SEQ ID NO: 1206944 - RNA, 19 nt, Homo sapiens
gaagcuguuuccuaguuua

SEQ ID NO: 1206945 - RNA, 19 nt, Homo sapiens
gaugucaacuucacuucua

SEQ ID NO: 1206946 - RNA, 19 nt, Homo sapiens
ggaaaucaauuagcaagug

SEQ ID NO: 1206947 - RNA, 19 nt, Homo sapiens
gagaacugguugcaaugua

SEQ ID NO: 1206948 - RNA, 19 nt, Homo sapiens
caacuucacuucuaaucug

SEQ ID NO: 1206949 - RNA, 19 nt, Homo sapiens
cagaagcuguuuccuaguu

SEQ ID NO: 1206950 - RNA, 19 nt, Homo sapiens
gaacuccgguugguggaaa

SEQ ID NO: 1206951 - RNA, 19 nt, Homo sapiens
gggaagcccucaccucugu

SEQ ID NO: 1206952 - RNA, 19 nt, Homo sapiens
ggucccagcccauuuagua

SEQ ID NO: 1206953 - RNA, 19 nt, Homo sapiens
ucgcagagaucacagaaau

SEQ ID NO: 1206954 - RNA, 19 nt, Homo sapiens
acacagcaaugaagcagaa

SEQ ID NO: 1206955 - RNA, 19 nt, Homo sapiens
gaaagagauccacaaggaa

SEQ ID NO: 1206956 - RNA, 19 nt, Homo sapiens
gcaaugaagcagaauaaag

SEQ ID NO: 1206957 - RNA, 19 nt, Homo sapiens
ugucagggcugcuggaaga

SEQ ID NO: 1206958 - RNA, 19 nt, Homo sapiens
agaacugguugcaauguaa

SEQ ID NO: 1206959 - RNA, 19 nt, Homo sapiens
gaaugcaucauguaguaaa

SEQ ID NO: 1206960 - RNA, 19 nt, Homo sapiens
gaauaaaguaggccagaau

SEQ ID NO: 1206961 - RNA, 19 nt, Homo sapiens
caaugaagcagaauaaagu

SEQ ID NO: 1206962 - RNA, 19 nt, Homo sapiens
agaaaugcuugcagccuaa

SEQ ID NO: 1206963 - RNA, 19 nt, Homo sapiens
ggaagcagccucccagaag

SEQ ID NO: 1206964 - RNA, 19 nt, Homo sapiens
guaaaggcaaauacuguuu

SEQ ID NO: 1206965 - RNA, 19 nt, Homo sapiens
gagcaaaggagacuaaacu

SEQ ID NO: 1206966 - RNA, 19 nt, Homo sapiens
aggagaaccugaagagcua

SEQ ID NO: 1206967 - RNA, 19 nt, Homo sapiens
cagcaaugaagcagaauaa

SEQ ID NO: 1206968 - RNA, 19 nt, Homo sapiens
ugucagcuguuuagccuuu

SEQ ID NO: 1206969 - RNA, 19 nt, Homo sapiens
uggaguagcucgcagagau

SEQ ID NO: 1206970 - RNA, 19 nt, Homo sapiens
gaagaagacucggcuuucc

SEQ ID NO: 1206971 - RNA, 19 nt, Homo sapiens
ggaagaagacucggcuuuc

SEQ ID NO: 1206972 - RNA, 19 nt, Homo sapiens
gcugggaaguugugagcaa

SEQ ID NO: 1206973 - RNA, 19 nt, Homo sapiens
ugugagaacugguugcaau

SEQ ID NO: 1206974 - RNA, 19 nt, Homo sapiens
gaaauuuugucagcuguuu

SEQ ID NO: 1206975 - RNA, 19 nt, Homo sapiens
caugcuagguuauuugaca

SEQ ID NO: 1206976 - RNA, 19 nt, Homo sapiens
gaagcccucaccucuguaa

SEQ ID NO: 1206977 - RNA, 19 nt, Homo sapiens
ucgcguguguuuaccuaua

SEQ ID NO: 1206978 - RNA, 19 nt, Homo sapiens
caggguugcucaaguggaa

SEQ ID NO: 1206979 - RNA, 19 nt, Homo sapiens
gaaguugugagcaaaauaa

SEQ ID NO: 1206980 - RNA, 19 nt, Homo sapiens
ccacugaggaggaggaaga

SEQ ID NO: 1206981 - RNA, 19 nt, Homo sapiens
gagaagcaaagaccgaaga

SEQ ID NO: 1206982 - RNA, 19 nt, Homo sapiens
guguagaguugccuuaaag

SEQ ID NO: 1206983 - RNA, 19 nt, Homo sapiens
gcaguguagaguugccuua

SEQ ID NO: 1206984 - RNA, 19 nt, Homo sapiens
ggcucauccucaauucuua

SEQ ID NO: 1206985 - RNA, 19 nt, Homo sapiens
gcagagaucacagaaaugc

SEQ ID NO: 1206986 - RNA, 19 nt, Homo sapiens
agaagcuguuuccuaguuu

SEQ ID NO: 1206987 - RNA, 19 nt, Homo sapiens
guacuuggcgugaugucaa

SEQ ID NO: 1206988 - RNA, 19 nt, Homo sapiens
gcuagguuauuugacauug

SEQ ID NO: 1206989 - RNA, 19 nt, Homo sapiens
gauguugccuuuggagaag

SEQ ID NO: 1206990 - RNA, 19 nt, Homo sapiens
uaguuuaccucgcgugugu

SEQ ID NO: 1206991 - RNA, 19 nt, Homo sapiens
aagcagaagcuguuuccua

SEQ ID NO: 1206992 - RNA, 19 nt, Homo sapiens
ccucaccucuguaaacaca

SEQ ID NO: 1206993 - RNA, 19 nt, Homo sapiens
ucgcugauguccuggaaga

SEQ ID NO: 1206994 - RNA, 19 nt, Homo sapiens
agcagaagcugaaguccuu

SEQ ID NO: 1206995 - RNA, 19 nt, Homo sapiens
gggcucauccucaauucuu

SEQ ID NO: 1206996 - RNA, 19 nt, Homo sapiens
agaauaaaguaggccagaa

SEQ ID NO: 1206997 - RNA, 19 nt, Homo sapiens
aaugggaaaucaauuagca

SEQ ID NO: 1206998 - RNA, 19 nt, Homo sapiens
ggccagaaugcaucaugua

SEQ ID NO: 1206999 - RNA, 19 nt, Homo sapiens
gcccucaccucuguaaaca

SEQ ID NO: 1207000 - RNA, 19 nt, Homo sapiens
uagguuauuugacauugug

SEQ ID NO: 1207001 - RNA, 19 nt, Homo sapiens
cuaauaaagaucugucugu

SEQ ID NO: 1207002 - RNA, 19 nt, Homo sapiens
cgccggauguggaagaaga

SEQ ID NO: 1207003 - RNA, 19 nt, Homo sapiens
cggcgaaacugggaaccaa

SEQ ID NO: 1207004 - RNA, 19 nt, Homo sapiens
cauggacccucugcugcua

SEQ ID NO: 1207005 - RNA, 19 nt, Homo sapiens
ccagugcuuucuucaaguc

SEQ ID NO: 1207006 - RNA, 19 nt, Homo sapiens
guagaguugccuuaaagug

SEQ ID NO: 1207007 - RNA, 19 nt, Homo sapiens
ccagaagacccacgagaag

SEQ ID NO: 1207008 - RNA, 19 nt, Homo sapiens
gcgaaacugggaaccaaga

SEQ ID NO: 1207009 - RNA, 19 nt, Homo sapiens
cuaaaugugagaacugguu

SEQ ID NO: 1207010 - RNA, 19 nt, Homo sapiens
uaaaguaggccagaaugca

SEQ ID NO: 1207011 - RNA, 19 nt, Homo sapiens
uggcuagacagucacauuu

SEQ ID NO: 1207012 - RNA, 19 nt, Homo sapiens
gaacugguugcaauguaag

SEQ ID NO: 1207013 - RNA, 19 nt, Homo sapiens
ccucgcguguguuuaccua

SEQ ID NO: 1207014 - RNA, 19 nt, Homo sapiens
ccugggugguggcacagua

SEQ ID NO: 1207015 - RNA, 19 nt, Homo sapiens
aguguagaguugccuuaaa

SEQ ID NO: 1207016 - RNA, 19 nt, Homo sapiens
uaagcgcucccaacgagaa

SEQ ID NO: 1207017 - RNA, 19 nt, Homo sapiens
uggaagaagacucggcuuu

SEQ ID NO: 1207018 - RNA, 19 nt, Homo sapiens
gcagaggcaguccgucauc

SEQ ID NO: 1207019 - RNA, 19 nt, Homo sapiens
ugccagugcuuucuucaag

SEQ ID NO: 1207020 - RNA, 19 nt, Homo sapiens
gcggcuuccugugguguuu

SEQ ID NO: 1207021 - RNA, 19 nt, Homo sapiens
ggagaucccggcaccuucu

SEQ ID NO: 1207022 - RNA, 19 nt, Homo sapiens
gaucugccagugcuuucuu

SEQ ID NO: 1207023 - RNA, 19 nt, Homo sapiens
acaccgagcagaagcugaa

SEQ ID NO: 1207024 - RNA, 19 nt, Homo sapiens
ucugagacacccuggcuuu

SEQ ID NO: 1207025 - RNA, 19 nt, Homo sapiens
aaacuccuugggcuacaua

SEQ ID NO: 1207026 - RNA, 19 nt, Homo sapiens
gcuagacagucacauuuuc

SEQ ID NO: 1207027 - RNA, 19 nt, Homo sapiens
gucccuggcuagacaguca

SEQ ID NO: 1207028 - RNA, 19 nt, Homo sapiens
agagaucacagaaaugcuu

SEQ ID NO: 1207029 - RNA, 19 nt, Homo sapiens
uuaccuauauggaguagcu

SEQ ID NO: 1207030 - RNA, 19 nt, Homo sapiens
gccagugcuuucuucaagu

SEQ ID NO: 1207031 - RNA, 19 nt, Homo sapiens
agaagacccacgagaagga

SEQ ID NO: 1207032 - RNA, 19 nt, Homo sapiens
uaaagaucugucugucuga

SEQ ID NO: 1207033 - RNA, 19 nt, Homo sapiens
gcucgcagagaucacagaa

SEQ ID NO: 1207034 - RNA, 19 nt, Homo sapiens
gcgggcucauccucaauuc

SEQ ID NO: 1207035 - RNA, 19 nt, Homo sapiens
gugggcagcguuagggaaa

SEQ ID NO: 1207036 - RNA, 19 nt, Homo sapiens
ucacccauacaucuaaaug

SEQ ID NO: 1207037 - RNA, 19 nt, Homo sapiens
ccagaaugcaucauguagu

SEQ ID NO: 1207038 - RNA, 19 nt, Homo sapiens
ccuggcaccucuccuuugg

SEQ ID NO: 1207039 - RNA, 19 nt, Homo sapiens
ggaguagcucgcagagauc

SEQ ID NO: 1207040 - RNA, 19 nt, Homo sapiens
gcuggacacugaggaacuc

SEQ ID NO: 1207041 - RNA, 19 nt, Homo sapiens
cagaggagggucagagaag

SEQ ID NO: 1207042 - RNA, 19 nt, Homo sapiens
guacauauuugucuccuua

SEQ ID NO: 1207043 - RNA, 19 nt, Homo sapiens
gauuuaaguucuuggguua

SEQ ID NO: 1207044 - RNA, 19 nt, Homo sapiens
gaaauacuauaccaaggaa

SEQ ID NO: 1207045 - RNA, 19 nt, Homo sapiens
gcaugugacugaaguacua

SEQ ID NO: 1207046 - RNA, 19 nt, Homo sapiens
gaacacacucucuuggaua

SEQ ID NO: 1207047 - RNA, 19 nt, Homo sapiens
ggcaagacauggaaggaua

SEQ ID NO: 1207048 - RNA, 19 nt, Homo sapiens
caaaggauauucuguuucu

SEQ ID NO: 1207049 - RNA, 19 nt, Homo sapiens
gaacagaguaccugaagga

SEQ ID NO: 1207050 - RNA, 19 nt, Homo sapiens
cagcuaacauagugaaauu

SEQ ID NO: 1207051 - RNA, 19 nt, Homo sapiens
uuacaacgguuuaaaggaa

SEQ ID NO: 1207052 - RNA, 19 nt, Homo sapiens
cuaauaagcgaauugguua

SEQ ID NO: 1207053 - RNA, 19 nt, Homo sapiens
uaaaauaacuggugguuug

SEQ ID NO: 1207054 - RNA, 19 nt, Homo sapiens
gaaaucaccugugugucuu

SEQ ID NO: 1207055 - RNA, 19 nt, Homo sapiens
ugacugaacuacagcaaga

SEQ ID NO: 1207056 - RNA, 19 nt, Homo sapiens
gugguuugcuaacuauuua

SEQ ID NO: 1207057 - RNA, 19 nt, Homo sapiens
uuacagaaguugcuugaga

SEQ ID NO: 1207058 - RNA, 19 nt, Homo sapiens
agaaacuguuggaaucuua

SEQ ID NO: 1207059 - RNA, 19 nt, Homo sapiens
gaaacacccugcuaacacu

SEQ ID NO: 1207060 - RNA, 19 nt, Homo sapiens
gcgaauugguuacaucguu

SEQ ID NO: 1207061 - RNA, 19 nt, Homo sapiens
guacaaaggauauucuguu

SEQ ID NO: 1207062 - RNA, 19 nt, Homo sapiens
guuggaaucuuacauaaag

SEQ ID NO: 1207063 - RNA, 19 nt, Homo sapiens
cgaauugguuacaucguuu

SEQ ID NO: 1207064 - RNA, 19 nt, Homo sapiens
acacaaagccugcgaaagu

SEQ ID NO: 1207065 - RNA, 19 nt, Homo sapiens
gcuaauaagcgaauugguu

SEQ ID NO: 1207066 - RNA, 19 nt, Homo sapiens
ggaaggauauaguaguucu

SEQ ID NO: 1207067 - RNA, 19 nt, Homo sapiens
gauggugccucuuuagcaa

SEQ ID NO: 1207068 - RNA, 19 nt, Homo sapiens
caagcaggaugucuguauu

SEQ ID NO: 1207069 - RNA, 19 nt, Homo sapiens
ucaccugugugucuuaauu

SEQ ID NO: 1207070 - RNA, 19 nt, Homo sapiens
gcuuacagcuaacauagug

SEQ ID NO: 1207071 - RNA, 19 nt, Homo sapiens
ggacacccauaauacugaa

SEQ ID NO: 1207072 - RNA, 19 nt, Homo sapiens
gacagaaucccaaacaguu

SEQ ID NO: 1207073 - RNA, 19 nt, Homo sapiens
gaucauagcaacagucaca

SEQ ID NO: 1207074 - RNA, 19 nt, Homo sapiens
gacuguagguggacuaugu

SEQ ID NO: 1207075 - RNA, 19 nt, Homo sapiens
gcaaggugaauuuaacauu

SEQ ID NO: 1207076 - RNA, 19 nt, Homo sapiens
cuuaacgacuuucaaacua

SEQ ID NO: 1207077 - RNA, 19 nt, Homo sapiens
gaagaaggcaagacaugga

SEQ ID NO: 1207078 - RNA, 19 nt, Homo sapiens
acagacagguacauauuug

SEQ ID NO: 1207079 - RNA, 19 nt, Homo sapiens
cauauggguuggcugguuu

SEQ ID NO: 1207080 - RNA, 19 nt, Homo sapiens
caagcaaggugaauuuaac

SEQ ID NO: 1207081 - RNA, 19 nt, Homo sapiens
gugauaagaacgacuguaa

SEQ ID NO: 1207082 - RNA, 19 nt, Homo sapiens
gccaaacgcccugaucaua

SEQ ID NO: 1207083 - RNA, 19 nt, Homo sapiens
gugguccuuucaagaauua

SEQ ID NO: 1207084 - RNA, 19 nt, Homo sapiens
acacucucuuggauaauua

SEQ ID NO: 1207085 - RNA, 19 nt, Homo sapiens
agaaguugcuugagaaugg

SEQ ID NO: 1207086 - RNA, 19 nt, Homo sapiens
ucacagacagguacauauu

SEQ ID NO: 1207087 - RNA, 19 nt, Homo sapiens
ggucacaaguacaauucaa

SEQ ID NO: 1207088 - RNA, 19 nt, Homo sapiens
acacaaagaucucuauucc

SEQ ID NO: 1207089 - RNA, 19 nt, Homo sapiens
gaagagggagagcaaacuu

SEQ ID NO: 1207090 - RNA, 19 nt, Homo sapiens
uaaccaagacuuaacuaug

SEQ ID NO: 1207091 - RNA, 19 nt, Homo sapiens
gucagaaacuguuggaauc

SEQ ID NO: 1207092 - RNA, 19 nt, Homo sapiens
ccaagagucucccuguaca

SEQ ID NO: 1207093 - RNA, 19 nt, Homo sapiens
ggauauaguaguucugguu

SEQ ID NO: 1207094 - RNA, 19 nt, Homo sapiens
gguaucauaagaucuguaa

SEQ ID NO: 1207095 - RNA, 19 nt, Homo sapiens
aaagucaagucucagaaau

SEQ ID NO: 1207096 - RNA, 19 nt, Homo sapiens
ucagaaaacuggauuuguu

SEQ ID NO: 1207097 - RNA, 19 nt, Homo sapiens
uaucaagcaaggugaauuu

SEQ ID NO: 1207098 - RNA, 19 nt, Homo sapiens
gcaauaaauggcucuaagu

SEQ ID NO: 1207099 - RNA, 19 nt, Homo sapiens
ggcaauaaauggcucuaag

SEQ ID NO: 1207100 - RNA, 19 nt, Homo sapiens
cgaacacacucucuuggau

SEQ ID NO: 1207101 - RNA, 19 nt, Homo sapiens
uacauaaagucaagucuca

SEQ ID NO: 1207102 - RNA, 19 nt, Homo sapiens
cagaguaccugaaggaaaa

SEQ ID NO: 1207103 - RNA, 19 nt, Homo sapiens
gacauggaaggauauagua

SEQ ID NO: 1207104 - RNA, 19 nt, Homo sapiens
caacgaagaaggcaagaca

SEQ ID NO: 1207105 - RNA, 19 nt, Homo sapiens
gagcagaccgcccuucauc

SEQ ID NO: 1207106 - RNA, 19 nt, Homo sapiens
caccugccaucuacuacua

SEQ ID NO: 1207107 - RNA, 19 nt, Homo sapiens
guuauguucugguugaaau

SEQ ID NO: 1207108 - RNA, 19 nt, Homo sapiens
ucaaacaaguaacaucuac

SEQ ID NO: 1207109 - RNA, 19 nt, Homo sapiens
uacagaaguugcuugagaa

SEQ ID NO: 1207110 - RNA, 19 nt, Homo sapiens
ggccugaggucacaaguac

SEQ ID NO: 1207111 - RNA, 19 nt, Homo sapiens
uaaagucaagucucagaaa

SEQ ID NO: 1207112 - RNA, 19 nt, Homo sapiens
aaggauacaucauauacug

SEQ ID NO: 1207113 - RNA, 19 nt, Homo sapiens
caaacuaaaggauacauca

SEQ ID NO: 1207114 - RNA, 19 nt, Homo sapiens
gaaaauacaaguguuggua

SEQ ID NO: 1207115 - RNA, 19 nt, Homo sapiens
gauaagaacgacuguaaaa

SEQ ID NO: 1207116 - RNA, 19 nt, Homo sapiens
ucaagcaaggugaauuuaa

SEQ ID NO: 1207117 - RNA, 19 nt, Homo sapiens
agaaugguguggaggagaa

SEQ ID NO: 1207118 - RNA, 19 nt, Homo sapiens
ccuguuauguucugguuga

SEQ ID NO: 1207119 - RNA, 19 nt, Homo sapiens
aacacacucucuuggauaa

SEQ ID NO: 1207120 - RNA, 19 nt, Homo sapiens
caauaaaaguugaccuuga

SEQ ID NO: 1207121 - RNA, 19 nt, Homo sapiens
gcaagcagaugagaaucca

SEQ ID NO: 1207122 - RNA, 19 nt, Homo sapiens
caauccaucuucugcugaa

SEQ ID NO: 1207123 - RNA, 19 nt, Homo sapiens
gccaaaagguguaauagug

SEQ ID NO: 1207124 - RNA, 19 nt, Homo sapiens
gcucuaaguggacagguuu

SEQ ID NO: 1207125 - RNA, 19 nt, Homo sapiens
caauaaauggcucuaagug

SEQ ID NO: 1207126 - RNA, 19 nt, Homo sapiens
gcuugagaauggugacuga

SEQ ID NO: 1207127 - RNA, 19 nt, Homo sapiens
guccgaugcuucaccauau

SEQ ID NO: 1207128 - RNA, 19 nt, Homo sapiens
caaaacugcucuucuagug

SEQ ID NO: 1207129 - RNA, 19 nt, Homo sapiens
gaggaaccacugaagcaaa

SEQ ID NO: 1207130 - RNA, 19 nt, Homo sapiens
uaauuggacugauucuuac

SEQ ID NO: 1207131 - RNA, 19 nt, Homo sapiens
gaauaucaagcaaggugaa

SEQ ID NO: 1207132 - RNA, 19 nt, Homo sapiens
cgaaagugcucgggaagag

SEQ ID NO: 1207133 - RNA, 19 nt, Homo sapiens
cccaaacaguucugaaugu

SEQ ID NO: 1207134 - RNA, 19 nt, Homo sapiens
caacagucacagacaggua

SEQ ID NO: 1207135 - RNA, 19 nt, Homo sapiens
cgguaacccuaauaaagaa

SEQ ID NO: 1207136 - RNA, 19 nt, Homo sapiens
gaaaaucauuagccuaugg

SEQ ID NO: 1207137 - RNA, 19 nt, Homo sapiens
caucauauacugacaaacu

SEQ ID NO: 1207138 - RNA, 19 nt, Homo sapiens
cacacucucuuggauaauu

SEQ ID NO: 1207139 - RNA, 19 nt, Homo sapiens
ucagaaauguccgaugcuu

SEQ ID NO: 1207140 - RNA, 19 nt, Homo sapiens
gcaagacauggaaggauau

SEQ ID NO: 1207141 - RNA, 19 nt, Homo sapiens
cccaaguaaucauuucaaa

SEQ ID NO: 1207142 - RNA, 19 nt, Homo sapiens
gaaaggagaucggguuguu

SEQ ID NO: 1207143 - RNA, 19 nt, Homo sapiens
gaacuuguaucucuaaucu

SEQ ID NO: 1207144 - RNA, 19 nt, Homo sapiens
gagaucggguuguugguua

SEQ ID NO: 1207145 - RNA, 19 nt, Homo sapiens
ggaaaucuauaacauugug

SEQ ID NO: 1207146 - RNA, 19 nt, Homo sapiens
caaagagaaugacagaguu

SEQ ID NO: 1207147 - RNA, 19 nt, Homo sapiens
ggagaguuaugaugacuug

SEQ ID NO: 1207148 - RNA, 19 nt, Homo sapiens
gacauuaucuccugcuuca

SEQ ID NO: 1207149 - RNA, 19 nt, Homo sapiens
gcaaggaguggcuuuguuu

SEQ ID NO: 1207150 - RNA, 19 nt, Homo sapiens
ggaaagugcuaugaugaau

SEQ ID NO: 1207151 - RNA, 19 nt, Homo sapiens
gaaggcguauuucuccaaa

SEQ ID NO: 1207152 - RNA, 19 nt, Homo sapiens
gagcggccauggucuugua

SEQ ID NO: 1207153 - RNA, 19 nt, Homo sapiens
gcacaaagagaaugacaga

SEQ ID NO: 1207154 - RNA, 19 nt, Homo sapiens
gcaaagagcacaaccacau

SEQ ID NO: 1207155 - RNA, 19 nt, Homo sapiens
ugaauggcuuuacauguuu

SEQ ID NO: 1207156 - RNA, 19 nt, Homo sapiens
gaaaaugggugcgaagaaa

SEQ ID NO: 1207157 - RNA, 19 nt, Homo sapiens
cgaaaggaaucgcagaugu

SEQ ID NO: 1207158 - RNA, 19 nt, Homo sapiens
cugaauggcuuuacauguu

SEQ ID NO: 1207159 - RNA, 19 nt, Homo sapiens
gcaaagaggaaauugugaa

SEQ ID NO: 1207160 - RNA, 19 nt, Homo sapiens
gccuggcgcuggagaguua

SEQ ID NO: 1207161 - RNA, 19 nt, Homo sapiens
uaagucaagucacggguuu

SEQ ID NO: 1207162 - RNA, 19 nt, Homo sapiens
cauacaggaucucuuuauu

SEQ ID NO: 1207163 - RNA, 19 nt, Homo sapiens
uaugaugacuuguaccauu

SEQ ID NO: 1207164 - RNA, 19 nt, Homo sapiens
aaacugagcacaaugaaau

SEQ ID NO: 1207165 - RNA, 19 nt, Homo sapiens
ucggaaaucuauaacauug

SEQ ID NO: 1207166 - RNA, 19 nt, Homo sapiens
gcucggaaaucuauaacau

SEQ ID NO: 1207167 - RNA, 19 nt, Homo sapiens
gaaagugcuaugaugaauu

SEQ ID NO: 1207168 - RNA, 19 nt, Homo sapiens
gagagaacauagaccuuuc

SEQ ID NO: 1207169 - RNA, 19 nt, Homo sapiens
gaagaaagugguggugauu

SEQ ID NO: 1207170 - RNA, 19 nt, Homo sapiens
gcagucggcucaacuaugc

SEQ ID NO: 1207171 - RNA, 19 nt, Homo sapiens
gaaguugccgucaaacaga

SEQ ID NO: 1207172 - RNA, 19 nt, Homo sapiens
ugacagaguugcccuuuac

SEQ ID NO: 1207173 - RNA, 19 nt, Homo sapiens
uggaggcuguugucuauaa

SEQ ID NO: 1207174 - RNA, 19 nt, Homo sapiens
gaaacugagcacaaugaaa

SEQ ID NO: 1207175 - RNA, 19 nt, Homo sapiens
cguaugaacuuguaucucu

SEQ ID NO: 1207176 - RNA, 19 nt, Homo sapiens
gaguugcccuuuacauugu

SEQ ID NO: 1207177 - RNA, 19 nt, Homo sapiens
aggcaucacuguccuggua

SEQ ID NO: 1207178 - RNA, 19 nt, Homo sapiens
gagcacaaccacauggaaa

SEQ ID NO: 1207179 - RNA, 19 nt, Homo sapiens
ggagggaucguuucucugu

SEQ ID NO: 1207180 - RNA, 19 nt, Homo sapiens
gcacagacugaauggcuuu

SEQ ID NO: 1207181 - RNA, 19 nt, Homo sapiens
guaugaacuuguaucucua

SEQ ID NO: 1207182 - RNA, 19 nt, Homo sapiens
ggugagagugugugucuuu

SEQ ID NO: 1207183 - RNA, 19 nt, Homo sapiens
gaauuaggcaugugaagca

SEQ ID NO: 1207184 - RNA, 19 nt, Homo sapiens
cugcagggcuucugaguca

SEQ ID NO: 1207185 - RNA, 19 nt, Homo sapiens
ugucagugcuggaagagaa

SEQ ID NO: 1207186 - RNA, 19 nt, Homo sapiens
gcaguugguauguacaauu

SEQ ID NO: 1207187 - RNA, 19 nt, Homo sapiens
ccgagacccuggaucugua

SEQ ID NO: 1207188 - RNA, 19 nt, Homo sapiens
gcagcucggaaaucuauaa

SEQ ID NO: 1207189 - RNA, 19 nt, Homo sapiens
ggcaaggaguggcuuuguu

SEQ ID NO: 1207190 - RNA, 19 nt, Homo sapiens
gaaaggaaucgcagauguc

SEQ ID NO: 1207191 - RNA, 19 nt, Homo sapiens
acaauucaguucagcguau

SEQ ID NO: 1207192 - RNA, 19 nt, Homo sapiens
gagagugugugucuuugca

SEQ ID NO: 1207193 - RNA, 19 nt, Homo sapiens
cagacuggcuggcguguca

SEQ ID NO: 1207194 - RNA, 19 nt, Homo sapiens
ccaagggcaucccguauac

SEQ ID NO: 1207195 - RNA, 19 nt, Homo sapiens
uguggaggcuguugucuau

SEQ ID NO: 1207196 - RNA, 19 nt, Homo sapiens
ggacuucggugugaauggu

SEQ ID NO: 1207197 - RNA, 19 nt, Homo sapiens
ggacacaucgaaaggaauc

SEQ ID NO: 1207198 - RNA, 19 nt, Homo sapiens
gggaaagugcuaugaugaa

SEQ ID NO: 1207199 - RNA, 19 nt, Homo sapiens
acuuguaucucuaaucuga

SEQ ID NO: 1207200 - RNA, 19 nt, Homo sapiens
gaugagaacggcaacaagu

SEQ ID NO: 1207201 - RNA, 19 nt, Homo sapiens
ugaagaaagugguggugau

SEQ ID NO: 1207202 - RNA, 19 nt, Homo sapiens
gaaggugacuuuugaagag

SEQ ID NO: 1207203 - RNA, 19 nt, Homo sapiens
ugugggagccugacaguaa

SEQ ID NO: 1207204 - RNA, 19 nt, Homo sapiens
gcccagagcuacgaguaug

SEQ ID NO: 1207205 - RNA, 19 nt, Homo sapiens
ggaaggcaaagaggaaauu

SEQ ID NO: 1207206 - RNA, 19 nt, Homo sapiens
cagaguugcccuuuacauu

SEQ ID NO: 1207207 - RNA, 19 nt, Homo sapiens
guaagaagaacacgcagau

SEQ ID NO: 1207208 - RNA, 19 nt, Homo sapiens
caguaugccuuugagcuuu

SEQ ID NO: 1207209 - RNA, 19 nt, Homo sapiens
gcucaagaaauuauacaga

SEQ ID NO: 1207210 - RNA, 19 nt, Homo sapiens
ucuauaacauuguggaauc

SEQ ID NO: 1207211 - RNA, 19 nt, Homo sapiens
guggacacaucgaaaggaa

SEQ ID NO: 1207212 - RNA, 19 nt, Homo sapiens
uuaaaggccuaccagacuu

SEQ ID NO: 1207213 - RNA, 19 nt, Homo sapiens
aaacagaucaucgcuggaa

SEQ ID NO: 1207214 - RNA, 19 nt, Homo sapiens
caaagcucaucuucucugu

SEQ ID NO: 1207215 - RNA, 19 nt, Homo sapiens
ucucuaaucugauguccau

SEQ ID NO: 1207216 - RNA, 19 nt, Homo sapiens
gaauggcuuuacauguuuc

SEQ ID NO: 1207217 - RNA, 19 nt, Homo sapiens
agggaucguuucucuguuu

SEQ ID NO: 1207218 - RNA, 19 nt, Homo sapiens
uuugugugcucaagaaauu

SEQ ID NO: 1207219 - RNA, 19 nt, Homo sapiens
gagcugguguguacuaagc

SEQ ID NO: 1207220 - RNA, 19 nt, Homo sapiens
caguugguauguacaauuc

SEQ ID NO: 1207221 - RNA, 19 nt, Homo sapiens
caagucacggguuuccaua

SEQ ID NO: 1207222 - RNA, 19 nt, Homo sapiens
ggaaguugccgucaaacag

SEQ ID NO: 1207223 - RNA, 19 nt, Homo sapiens
cagccugacuugguuaaga

SEQ ID NO: 1207224 - RNA, 19 nt, Homo sapiens
ucucacguguguaugauga

SEQ ID NO: 1207225 - RNA, 19 nt, Homo sapiens
ucaggaggcaccgacauua

SEQ ID NO: 1207226 - RNA, 19 nt, Homo sapiens
ucggguuguugguuauuua

SEQ ID NO: 1207227 - RNA, 19 nt, Homo sapiens
uacaggaucucuuuauugc

SEQ ID NO: 1207228 - RNA, 19 nt, Homo sapiens
aguaugccuuugagcuuua

SEQ ID NO: 1207229 - RNA, 19 nt, Homo sapiens
uuucaaagauuccaaacag

SEQ ID NO: 1207230 - RNA, 19 nt, Homo sapiens
cuaccagacuugaagaaag

SEQ ID NO: 1207231 - RNA, 19 nt, Homo sapiens
ggaggcuguugucuauaau

SEQ ID NO: 1207232 - RNA, 19 nt, Homo sapiens
aagaggaaauugugaaggu

SEQ ID NO: 1207233 - RNA, 19 nt, Homo sapiens
acaaagagaaugacagagu

SEQ ID NO: 1207234 - RNA, 19 nt, Homo sapiens
ggaaggcguauuucuccaa

SEQ ID NO: 1207235 - RNA, 19 nt, Homo sapiens
gcgagcugguguguacuaa

SEQ ID NO: 1207236 - RNA, 19 nt, Homo sapiens
caaagauuccaaacagugu

SEQ ID NO: 1207237 - RNA, 19 nt, Homo sapiens
ggaccgguuuucucaaauu

SEQ ID NO: 1207238 - RNA, 19 nt, Homo sapiens
agaguugcccuuuacauug

SEQ ID NO: 1207239 - RNA, 19 nt, Homo sapiens
gagcacaaugaaauccuuu

SEQ ID NO: 1207240 - RNA, 19 nt, Homo sapiens
gccaggcaguugguaugua

SEQ ID NO: 1207241 - RNA, 19 nt, Homo sapiens
ccaaggaaugaguggauuu

SEQ ID NO: 1207242 - RNA, 19 nt, Homo sapiens
uauaagaacuggagaggua

SEQ ID NO: 1207243 - RNA, 19 nt, Homo sapiens
gaacagagaaagaaaggua

SEQ ID NO: 1207244 - RNA, 19 nt, Homo sapiens
gaaguacagugacaauuga

SEQ ID NO: 1207245 - RNA, 19 nt, Homo sapiens
ggaaugaacuaacugacuu

SEQ ID NO: 1207246 - RNA, 19 nt, Homo sapiens
aaacaauacuacccacuua

SEQ ID NO: 1207247 - RNA, 19 nt, Homo sapiens
gaacuggagagguaauuua

SEQ ID NO: 1207248 - RNA, 19 nt, Homo sapiens
ggauggaucuccugaaaug

SEQ ID NO: 1207249 - RNA, 19 nt, Homo sapiens
gcaggcagccguuucuuua

SEQ ID NO: 1207250 - RNA, 19 nt, Homo sapiens
gcucuaaucugauaaaugg

SEQ ID NO: 1207251 - RNA, 19 nt, Homo sapiens
caaaugagaacucuuauug

SEQ ID NO: 1207252 - RNA, 19 nt, Homo sapiens
guaugucucuagaugauua

SEQ ID NO: 1207253 - RNA, 19 nt, Homo sapiens
gacauucccuggugcauaa

SEQ ID NO: 1207254 - RNA, 19 nt, Homo sapiens
caaggaagaaccagauuua

SEQ ID NO: 1207255 - RNA, 19 nt, Homo sapiens
gaagaaugauguuaugaag

SEQ ID NO: 1207256 - RNA, 19 nt, Homo sapiens
gcacaggacuauacagcaa

SEQ ID NO: 1207257 - RNA, 19 nt, Homo sapiens
acaaauguaugguguguaa

SEQ ID NO: 1207258 - RNA, 19 nt, Homo sapiens
cacggaaucuuaccaauuu

SEQ ID NO: 1207259 - RNA, 19 nt, Homo sapiens
gcacuccgcugcucaacuu

SEQ ID NO: 1207260 - RNA, 19 nt, Homo sapiens
ggaaguacagugacaauug

SEQ ID NO: 1207261 - RNA, 19 nt, Homo sapiens
ggucaaagccuuauagcaa

SEQ ID NO: 1207262 - RNA, 19 nt, Homo sapiens
ugaaucaucucuaaucaug

SEQ ID NO: 1207263 - RNA, 19 nt, Homo sapiens
guucaaacuugccgaaauu

SEQ ID NO: 1207264 - RNA, 19 nt, Homo sapiens
aaagaaagcccuaaccaaa

SEQ ID NO: 1207265 - RNA, 19 nt, Homo sapiens
ggaaugugaaugcaaauuu

SEQ ID NO: 1207266 - RNA, 19 nt, Homo sapiens
ugaaagaccuaauugaaag

SEQ ID NO: 1207267 - RNA, 19 nt, Homo sapiens
gcaagaagguguagaucag

SEQ ID NO: 1207268 - RNA, 19 nt, Homo sapiens
ggagugagaucauuuagcu

SEQ ID NO: 1207269 - RNA, 19 nt, Homo sapiens
ggaagaaccagauuuagau

SEQ ID NO: 1207270 - RNA, 19 nt, Homo sapiens
gaagauugcucaguaaugc

SEQ ID NO: 1207271 - RNA, 19 nt, Homo sapiens
ugagaacucuuauugcuau

SEQ ID NO: 1207272 - RNA, 19 nt, Homo sapiens
ucaaaugagugaaguuguu

SEQ ID NO: 1207273 - RNA, 19 nt, Homo sapiens
cuucuagucuuagguauua

SEQ ID NO: 1207274 - RNA, 19 nt, Homo sapiens
ccacauacucagucaguua

SEQ ID NO: 1207275 - RNA, 19 nt, Homo sapiens
gcauuuggaccuaauauga

SEQ ID NO: 1207276 - RNA, 19 nt, Homo sapiens
guaguuauguugcugugaa

SEQ ID NO: 1207277 - RNA, 19 nt, Homo sapiens
caacuucugcgacaacuaa

SEQ ID NO: 1207278 - RNA, 19 nt, Homo sapiens
uaacugacuuccuccauuc

SEQ ID NO: 1207279 - RNA, 19 nt, Homo sapiens
gcaaguaauguaaagauug

SEQ ID NO: 1207280 - RNA, 19 nt, Homo sapiens
ccaagucucuaaugcagaa

SEQ ID NO: 1207281 - RNA, 19 nt, Homo sapiens
uaacugaccuacuauacuc

SEQ ID NO: 1207282 - RNA, 19 nt, Homo sapiens
agacauggaucucgacguu

SEQ ID NO: 1207283 - RNA, 19 nt, Homo sapiens
uaauagagauggucugucu

SEQ ID NO: 1207284 - RNA, 19 nt, Homo sapiens
gccgaaauuucauuaaaga

SEQ ID NO: 1207285 - RNA, 19 nt, Homo sapiens
ggccaaaugagaacucuua

SEQ ID NO: 1207286 - RNA, 19 nt, Homo sapiens
gagagguaauuuauuggaa

SEQ ID NO: 1207287 - RNA, 19 nt, Homo sapiens
uuuagaagauugcucagua

SEQ ID NO: 1207288 - RNA, 19 nt, Homo sapiens
gaacucuuauugcuaucaa

SEQ ID NO: 1207289 - RNA, 19 nt, Homo sapiens
gucaaagccuuauagcaaa

SEQ ID NO: 1207290 - RNA, 19 nt, Homo sapiens
ucagucaguuaucaaagua

SEQ ID NO: 1207291 - RNA, 19 nt, Homo sapiens
gaaaaccaguuaauagaga

SEQ ID NO: 1207292 - RNA, 19 nt, Homo sapiens
ggccagcuaucuucaaaug

SEQ ID NO: 1207293 - RNA, 19 nt, Homo sapiens
caaggauacuggucuuaug

SEQ ID NO: 1207294 - RNA, 19 nt, Homo sapiens
ccaagucucuucuagucuu

SEQ ID NO: 1207295 - RNA, 19 nt, Homo sapiens
gaacuugaaggcuugcaaa

SEQ ID NO: 1207296 - RNA, 19 nt, Homo sapiens
augaagagcuaguugauga

SEQ ID NO: 1207297 - RNA, 19 nt, Homo sapiens
gaaaauacacuacucauca

SEQ ID NO: 1207298 - RNA, 19 nt, Homo sapiens
ugaaauggcugaaaaugaa

SEQ ID NO: 1207299 - RNA, 19 nt, Homo sapiens
auacuggucuuaugucuug

SEQ ID NO: 1207300 - RNA, 19 nt, Homo sapiens
cuggagagguaauuuauug

SEQ ID NO: 1207301 - RNA, 19 nt, Homo sapiens
caagucucuucuagucuua

SEQ ID NO: 1207302 - RNA, 19 nt, Homo sapiens
ggaugaaucaggagaaguu

SEQ ID NO: 1207303 - RNA, 19 nt, Homo sapiens
gcugguacuucacaugauu

SEQ ID NO: 1207304 - RNA, 19 nt, Homo sapiens
gcagccaccuguugccuau

SEQ ID NO: 1207305 - RNA, 19 nt, Homo sapiens
augauuaacugaccuacua

SEQ ID NO: 1207306 - RNA, 19 nt, Homo sapiens
gcuaguugaugauggagaa

SEQ ID NO: 1207307 - RNA, 19 nt, Homo sapiens
aaauacagacgaacacuaa

SEQ ID NO: 1207308 - RNA, 19 nt, Homo sapiens
ggcaaguaauguaaagauu

SEQ ID NO: 1207309 - RNA, 19 nt, Homo sapiens
cuucaaagcucauaagaac

SEQ ID NO: 1207310 - RNA, 19 nt, Homo sapiens
gagguaauuuauuggaaug

SEQ ID NO: 1207311 - RNA, 19 nt, Homo sapiens
ccaaaugaaugacaguagu

SEQ ID NO: 1207312 - RNA, 19 nt, Homo sapiens
acaacuaaaugaacagaga

SEQ ID NO: 1207313 - RNA, 19 nt, Homo sapiens
ggugaaucaucucuaauca

SEQ ID NO: 1207314 - RNA, 19 nt, Homo sapiens
uuagaagauugcucaguaa

SEQ ID NO: 1207315 - RNA, 19 nt, Homo sapiens
caaagaaagcccuaaccaa

SEQ ID NO: 1207316 - RNA, 19 nt, Homo sapiens
ggaggaaggauaucugugu

SEQ ID NO: 1207317 - RNA, 19 nt, Homo sapiens
gagagacuguccagcacuu

SEQ ID NO: 1207318 - RNA, 19 nt, Homo sapiens
gauauuuucugacauggua

SEQ ID NO: 1207319 - RNA, 19 nt, Homo sapiens
uaaaccaagucucuucuag

SEQ ID NO: 1207320 - RNA, 19 nt, Homo sapiens
caagaaaccugggaaaaug

SEQ ID NO: 1207321 - RNA, 19 nt, Homo sapiens
ucacaugauuucaaguaug

SEQ ID NO: 1207322 - RNA, 19 nt, Homo sapiens
aaaugaaucugaaggucaa

SEQ ID NO: 1207323 - RNA, 19 nt, Homo sapiens
cgacgagggccaaauagaa

SEQ ID NO: 1207324 - RNA, 19 nt, Homo sapiens
cuaacugacuuccuccauu

SEQ ID NO: 1207325 - RNA, 19 nt, Homo sapiens
cuauuuggguccuaugaaa

SEQ ID NO: 1207326 - RNA, 19 nt, Homo sapiens
cgaggagaaugaaguagga

SEQ ID NO: 1207327 - RNA, 19 nt, Homo sapiens
gcaaauuuauuggcugaag

SEQ ID NO: 1207328 - RNA, 19 nt, Homo sapiens
gacgagggccaaauagaaa

SEQ ID NO: 1207329 - RNA, 19 nt, Homo sapiens
gaaagaccuaauugaaaga

SEQ ID NO: 1207330 - RNA, 19 nt, Homo sapiens
cugcugcucuaaucugaua

SEQ ID NO: 1207331 - RNA, 19 nt, Homo sapiens
gguacaugcuggauaguag

SEQ ID NO: 1207332 - RNA, 19 nt, Homo sapiens
gggacaggauacagaauuc

SEQ ID NO: 1207333 - RNA, 19 nt, Homo sapiens
gcugugauauuuguggaaa

SEQ ID NO: 1207334 - RNA, 19 nt, Homo sapiens
aauggugaaucaucucuaa

SEQ ID NO: 1207335 - RNA, 19 nt, Homo sapiens
gaagaaccagauuuagaug

SEQ ID NO: 1207336 - RNA, 19 nt, Homo sapiens
guacuauaccucaguccua

SEQ ID NO: 1207337 - RNA, 19 nt, Homo sapiens
uaaagagcuuacauucaug

SEQ ID NO: 1207338 - RNA, 19 nt, Homo sapiens
gaaaauaguccuuaaagag

SEQ ID NO: 1207339 - RNA, 19 nt, Homo sapiens
caauuuggcaaguaaugua

SEQ ID NO: 1207340 - RNA, 19 nt, Homo sapiens
caaacuugccgaaauuuca

SEQ ID NO: 1207341 - RNA, 19 nt, Homo sapiens
cuugaaggcuugcaaaaua

SEQ ID NO: 1207342 - RNA, 19 nt, Homo sapiens
uaagagcacuccaucaaua

SEQ ID NO: 1207343 - RNA, 19 nt, Homo sapiens
gcucaaagcuggcagagau

SEQ ID NO: 1207344 - RNA, 19 nt, Homo sapiens
gcacaucccugaaguguac

SEQ ID NO: 1207345 - RNA, 19 nt, Homo sapiens
gagcagagacuguuaugaa

SEQ ID NO: 1207346 - RNA, 19 nt, Homo sapiens
ggaaggcgguccuagacaa

SEQ ID NO: 1207347 - RNA, 19 nt, Homo sapiens
gcacauucuuacucaguuu

SEQ ID NO: 1207348 - RNA, 19 nt, Homo sapiens
ggagcaggaugcauauuau

SEQ ID NO: 1207349 - RNA, 19 nt, Homo sapiens
agacugaccucuuacauca

SEQ ID NO: 1207350 - RNA, 19 nt, Homo sapiens
caacugaugccacuauauu

SEQ ID NO: 1207351 - RNA, 19 nt, Homo sapiens
uggcguggcuuaugaaauu

SEQ ID NO: 1207352 - RNA, 19 nt, Homo sapiens
ucacaaacaucaggcaauu

SEQ ID NO: 1207353 - RNA, 19 nt, Homo sapiens
ggcaagagaugugagauga

SEQ ID NO: 1207354 - RNA, 19 nt, Homo sapiens
gagagcacauucuuacuca

SEQ ID NO: 1207355 - RNA, 19 nt, Homo sapiens
ccaauaacaagaccaagua

SEQ ID NO: 1207356 - RNA, 19 nt, Homo sapiens
ucaagucuguugucaaguu

SEQ ID NO: 1207357 - RNA, 19 nt, Homo sapiens
ggacaugccacagaucuuu

SEQ ID NO: 1207358 - RNA, 19 nt, Homo sapiens
ggcacagcauucugauuua

SEQ ID NO: 1207359 - RNA, 19 nt, Homo sapiens
ucuagagucuugccacuaa

SEQ ID NO: 1207360 - RNA, 19 nt, Homo sapiens
cagagacuguuaugaauuc

SEQ ID NO: 1207361 - RNA, 19 nt, Homo sapiens
gcagagacuguuaugaauu

SEQ ID NO: 1207362 - RNA, 19 nt, Homo sapiens
gccuggagauggacauuaa

SEQ ID NO: 1207363 - RNA, 19 nt, Homo sapiens
auucagagguccuguguuu

SEQ ID NO: 1207364 - RNA, 19 nt, Homo sapiens
caagagaugugagaugaca

SEQ ID NO: 1207365 - RNA, 19 nt, Homo sapiens
gagcuguccucuucucuag

SEQ ID NO: 1207366 - RNA, 19 nt, Homo sapiens
guucaagucuguugucaag

SEQ ID NO: 1207367 - RNA, 19 nt, Homo sapiens
gagugcaucaucagcauua

SEQ ID NO: 1207368 - RNA, 19 nt, Homo sapiens
caagucuguugucaaguuu

SEQ ID NO: 1207369 - RNA, 19 nt, Homo sapiens
auaagaagauguucaaguc

SEQ ID NO: 1207370 - RNA, 19 nt, Homo sapiens
ccugugaacuugcuggaaa

SEQ ID NO: 1207371 - RNA, 19 nt, Homo sapiens
gagaugcugugggugcuaa

SEQ ID NO: 1207372 - RNA, 19 nt, Homo sapiens
gaauugcuaccucuuguau

SEQ ID NO: 1207373 - RNA, 19 nt, Homo sapiens
cauacaagauacugugaau

SEQ ID NO: 1207374 - RNA, 19 nt, Homo sapiens
gauaagaagauguucaagu

SEQ ID NO: 1207375 - RNA, 19 nt, Homo sapiens
gaacuugcuggaaauacaa

SEQ ID NO: 1207376 - RNA, 19 nt, Homo sapiens
uaacaagaccaaguaagaa

SEQ ID NO: 1207377 - RNA, 19 nt, Homo sapiens
gguacaagguauucuccaa

SEQ ID NO: 1207378 - RNA, 19 nt, Homo sapiens
gcacagcauucugauuuac

SEQ ID NO: 1207379 - RNA, 19 nt, Homo sapiens
ucccagagcuccucaugga

SEQ ID NO: 1207380 - RNA, 19 nt, Homo sapiens
uaccaaacccuccaaguga

SEQ ID NO: 1207381 - RNA, 19 nt, Homo sapiens
uggcacagcauucugauuu

SEQ ID NO: 1207382 - RNA, 19 nt, Homo sapiens
guucugacccaaagaugua

SEQ ID NO: 1207383 - RNA, 19 nt, Homo sapiens
gcaggaugcauauuauuca

SEQ ID NO: 1207384 - RNA, 19 nt, Homo sapiens
gacgaugucuacuguugug

SEQ ID NO: 1207385 - RNA, 19 nt, Homo sapiens
caacaggaacauacaagau

SEQ ID NO: 1207386 - RNA, 19 nt, Homo sapiens
ugaacuugcuggaaauaca

SEQ ID NO: 1207387 - RNA, 19 nt, Homo sapiens
gaggcucaguucuacgaaa

SEQ ID NO: 1207388 - RNA, 19 nt, Homo sapiens
gcucaguucuacgaaauca

SEQ ID NO: 1207389 - RNA, 19 nt, Homo sapiens
ucuacgaaaucaagccuuu

SEQ ID NO: 1207390 - RNA, 19 nt, Homo sapiens
acaaugcguuggcaagaga

SEQ ID NO: 1207391 - RNA, 19 nt, Homo sapiens
gagcaggaugcauauuauu

SEQ ID NO: 1207392 - RNA, 19 nt, Homo sapiens
gcgagaaccuggagcucau

SEQ ID NO: 1207393 - RNA, 19 nt, Homo sapiens
gaccaucucuagaaaagaa

SEQ ID NO: 1207394 - RNA, 19 nt, Homo sapiens
ggccgacgaugucuacugu

SEQ ID NO: 1207395 - RNA, 19 nt, Homo sapiens
uaaaccacuugcacgagaa

SEQ ID NO: 1207396 - RNA, 19 nt, Homo sapiens
aacaggaacauacaagaua

SEQ ID NO: 1207397 - RNA, 19 nt, Homo sapiens
ccgacgaugucuacuguug

SEQ ID NO: 1207398 - RNA, 19 nt, Homo sapiens
ccuaagagcacuccaucaa

SEQ ID NO: 1207399 - RNA, 19 nt, Homo sapiens
caagguauucuccaaguuc

SEQ ID NO: 1207400 - RNA, 19 nt, Homo sapiens
ucagacccauccuggacua

SEQ ID NO: 1207401 - RNA, 19 nt, Homo sapiens
caauaacaagaccaaguaa

SEQ ID NO: 1207402 - RNA, 19 nt, Homo sapiens
ggguuggucuagagucuug

SEQ ID NO: 1207403 - RNA, 19 nt, Homo sapiens
ugaauucuggcguggcuua

SEQ ID NO: 1207404 - RNA, 19 nt, Homo sapiens
caaguaagaauguuucaac

SEQ ID NO: 1207405 - RNA, 19 nt, Homo sapiens
acaaacaucaggcaauuuc

SEQ ID NO: 1207406 - RNA, 19 nt, Homo sapiens
aggagcaggaugcauauua

SEQ ID NO: 1207407 - RNA, 19 nt, Homo sapiens
auaacaagaccaaguaaga

SEQ ID NO: 1207408 - RNA, 19 nt, Homo sapiens
gaugacaacaggaacauac

SEQ ID NO: 1207409 - RNA, 19 nt, Homo sapiens
gcaacugaugccacuauau

SEQ ID NO: 1207410 - RNA, 19 nt, Homo sapiens
cugaggagcaggaugcaua

SEQ ID NO: 1207411 - RNA, 19 nt, Homo sapiens
cagcauuaccugugaacuu

SEQ ID NO: 1207412 - RNA, 19 nt, Homo sapiens
caagaccaaguaagaaugu

SEQ ID NO: 1207413 - RNA, 19 nt, Homo sapiens
cccagacccuucucuugaa

SEQ ID NO: 1207414 - RNA, 19 nt, Homo sapiens
ccagagcuccucauggaau

SEQ ID NO: 1207415 - RNA, 19 nt, Homo sapiens
ggcguggcuuaugaaauua

SEQ ID NO: 1207416 - RNA, 19 nt, Homo sapiens
gagcacauucuuacucagu

SEQ ID NO: 1207417 - RNA, 19 nt, Homo sapiens
acaagguauucuccaaguu

SEQ ID NO: 1207418 - RNA, 19 nt, Homo sapiens
agaagauguucaagucugu

SEQ ID NO: 1207419 - RNA, 19 nt, Homo sapiens
uacaagguauucuccaagu

SEQ ID NO: 1207420 - RNA, 19 nt, Homo sapiens
ccucuuacaucaaggaacu

SEQ ID NO: 1207421 - RNA, 19 nt, Homo sapiens
ccaaacccuccaagugauu

SEQ ID NO: 1207422 - RNA, 19 nt, Homo sapiens
agcauuaccugugaacuug

SEQ ID NO: 1207423 - RNA, 19 nt, Homo sapiens
caucagcauuaccugugaa

SEQ ID NO: 1207424 - RNA, 19 nt, Homo sapiens
ucaucagcauuaccuguga

SEQ ID NO: 1207425 - RNA, 19 nt, Homo sapiens
aagagcacuccaucaauaa

SEQ ID NO: 1207426 - RNA, 19 nt, Homo sapiens
gcacgugcagaagccauaa

SEQ ID NO: 1207427 - RNA, 19 nt, Homo sapiens
aaucaagccuuuggucaag

SEQ ID NO: 1207428 - RNA, 19 nt, Homo sapiens
uagauguucugacccaaag

SEQ ID NO: 1207429 - RNA, 19 nt, Homo sapiens
acaggaacauacaagauac

SEQ ID NO: 1207430 - RNA, 19 nt, Homo sapiens
uuucaaagccucauguauc

SEQ ID NO: 1207431 - RNA, 19 nt, Homo sapiens
uuaccaaacccuccaagug

SEQ ID NO: 1207432 - RNA, 19 nt, Homo sapiens
gaccaaguaagaauguuuc

SEQ ID NO: 1207433 - RNA, 19 nt, Homo sapiens
ccacuauauuugccuagca

SEQ ID NO: 1207434 - RNA, 19 nt, Homo sapiens
gaaguuuccgggcucaaag

SEQ ID NO: 1207435 - RNA, 19 nt, Homo sapiens
gcauucugauuuaccaaac

SEQ ID NO: 1207436 - RNA, 19 nt, Homo sapiens
cagagugcaucaucagcau

SEQ ID NO: 1207437 - RNA, 19 nt, Homo sapiens
ucccagacccuucucuuga

SEQ ID NO: 1207438 - RNA, 19 nt, Homo sapiens
uucaaagccucauguaucu

SEQ ID NO: 1207439 - RNA, 19 nt, Homo sapiens
ugcaacugaugccacuaua

SEQ ID NO: 1207440 - RNA, 19 nt, Homo sapiens
agacaacagcgaccucaug

SEQ ID NO: 1207441 - RNA, 19 nt, Homo sapiens
uggaggacaugccacagau

SEQ ID NO: 1207442 - RNA, 19 nt, Homo sapiens
gcacggcgcugacuucuca

SEQ ID NO: 1207443 - RNA, 19 nt, Homo sapiens
ccaaguagcuggaauuaca

SEQ ID NO: 1207444 - RNA, 19 nt, Homo sapiens
gcaacacuaugccugguua

SEQ ID NO: 1207445 - RNA, 19 nt, Homo sapiens
ggauugagguagagaagaa

SEQ ID NO: 1207446 - RNA, 19 nt, Homo sapiens
gcacuggccuucauugucu

SEQ ID NO: 1207447 - RNA, 19 nt, Homo sapiens
cacuaugccugguuaauuu

SEQ ID NO: 1207448 - RNA, 19 nt, Homo sapiens
ggaaugcaguggugugaac

SEQ ID NO: 1207449 - RNA, 19 nt, Homo sapiens
guagagaagaaccuuguuu

SEQ ID NO: 1207450 - RNA, 19 nt, Homo sapiens
cuaagaggauugagguaga

SEQ ID NO: 1207451 - RNA, 19 nt, Homo sapiens
ccaaagugcugggauuaca

SEQ ID NO: 1207452 - RNA, 19 nt, Homo sapiens
ccaaagugcugggauuaca

SEQ ID NO: 1207453 - RNA, 19 nt, Homo sapiens
ugaucaggcuggucucaaa

SEQ ID NO: 1207454 - RNA, 19 nt, Homo sapiens
uggcuaggcuggucucgaa

SEQ ID NO: 1207455 - RNA, 19 nt, Homo sapiens
caaggaagaggaaagacaa

SEQ ID NO: 1207456 - RNA, 19 nt, Homo sapiens
gaagacaucguccaguucu

SEQ ID NO: 1207457 - RNA, 19 nt, Homo sapiens
ccacugcacuggccuucau

SEQ ID NO: 1207458 - RNA, 19 nt, Homo sapiens
gaaacaaggaagaggaaag

SEQ ID NO: 1207459 - RNA, 19 nt, Homo sapiens
ccagugacccuguauugga

SEQ ID NO: 1207460 - RNA, 19 nt, Homo sapiens
uugaagacaucguccaguu

SEQ ID NO: 1207461 - RNA, 19 nt, Homo sapiens
cagugacccuguauuggaa

SEQ ID NO: 1207462 - RNA, 19 nt, Homo sapiens
ucagauggcugugacuaca

SEQ ID NO: 1207463 - RNA, 19 nt, Homo sapiens
ccacaagacaauacccauu

SEQ ID NO: 1207464 - RNA, 19 nt, Homo sapiens
aaacaaggaagaggaaaga

SEQ ID NO: 1207465 - RNA, 19 nt, Homo sapiens
gaagcggacccagcagauu

SEQ ID NO: 1207466 - RNA, 19 nt, Homo sapiens
ccagagaugcuaagaggau

SEQ ID NO: 1207467 - RNA, 19 nt, Homo sapiens
ggagcugcguguggaguug

SEQ ID NO: 1207468 - RNA, 19 nt, Homo sapiens
acacuaugccugguuaauu

SEQ ID NO: 1207469 - RNA, 19 nt, Homo sapiens
ucgcagccaucggcccuua

SEQ ID NO: 1207470 - RNA, 19 nt, Homo sapiens
cugcugggcucaaggaauc

SEQ ID NO: 1207471 - RNA, 19 nt, Homo sapiens
cgacguggccguguacuuc

SEQ ID NO: 1207472 - RNA, 19 nt, Homo sapiens
cagagaugcuaagaggauu

SEQ ID NO: 1207473 - RNA, 19 nt, Homo sapiens
gugaccaucuagacauugu

SEQ ID NO: 1207474 - RNA, 19 nt, Homo sapiens
ggaagaggaaagacaaagg

SEQ ID NO: 1207475 - RNA, 19 nt, Homo sapiens
ggugcgaucucgacucacu

SEQ ID NO: 1207476 - RNA, 19 nt, Homo sapiens
aggcagggcugaggugaga

SEQ ID NO: 1207477 - RNA, 19 nt, Homo sapiens
cagaaacaaggaagaggaa

SEQ ID NO: 1207478 - RNA, 19 nt, Homo sapiens
gaccuucccacaagacaau

SEQ ID NO: 1207479 - RNA, 19 nt, Homo sapiens
gagaugcuaagaggauuga

SEQ ID NO: 1207480 - RNA, 19 nt, Homo sapiens
cuacaggugggcaacacua

SEQ ID NO: 1207481 - RNA, 19 nt, Homo sapiens
uaagaggauugagguagag

SEQ ID NO: 1207482 - RNA, 19 nt, Homo sapiens
aagugaccaucuagacauu

SEQ ID NO: 1207483 - RNA, 19 nt, Homo sapiens
ccagcagauuccagaaaca

SEQ ID NO: 1207484 - RNA, 19 nt, Homo sapiens
agacaucguccaguucuga

SEQ ID NO: 1207485 - RNA, 19 nt, Homo sapiens
gaaccuuguuuucucuguu

SEQ ID NO: 1207486 - RNA, 19 nt, Homo sapiens
aaagugaccaucuagacau

SEQ ID NO: 1207487 - RNA, 19 nt, Homo sapiens
cagcagauuccagaaacaa

SEQ ID NO: 1207488 - RNA, 19 nt, Homo sapiens
caacacuaugccugguuaa

SEQ ID NO: 1207489 - RNA, 19 nt, Homo sapiens
ucuuugaccuucccacaag

SEQ ID NO: 1207490 - RNA, 19 nt, Homo sapiens
ccacccaaguagcuggaau

SEQ ID NO: 1207491 - RNA, 19 nt, Homo sapiens
ugccucagccacccaagua

SEQ ID NO: 1207492 - RNA, 19 nt, Homo sapiens
agccaucggcccuuaguuu

SEQ ID NO: 1207493 - RNA, 19 nt, Homo sapiens
aaccagugacccuguauug

SEQ ID NO: 1207494 - RNA, 19 nt, Homo sapiens
ucaaacuccucgguucaag

SEQ ID NO: 1207495 - RNA, 19 nt, Homo sapiens
gccaucggcccuuaguuuc

SEQ ID NO: 1207496 - RNA, 19 nt, Homo sapiens
ugaagacaucguccaguuc

SEQ ID NO: 1207497 - RNA, 19 nt, Homo sapiens
gaggagaaggccgaacugu

SEQ ID NO: 1207498 - RNA, 19 nt, Homo sapiens
gaggauugagguagagaag

SEQ ID NO: 1207499 - RNA, 19 nt, Homo sapiens
ggaggagaaggccgaacug

SEQ ID NO: 1207500 - RNA, 19 nt, Homo sapiens
gcucucagcagccucuucu

SEQ ID NO: 1207501 - RNA, 19 nt, Homo sapiens
acaaggaagaggaaagaca

SEQ ID NO: 1207502 - RNA, 19 nt, Homo sapiens
ugacaaagaugaacauauc

SEQ ID NO: 1207503 - RNA, 19 nt, Homo sapiens
gaccaggagugucagguua

SEQ ID NO: 1207504 - RNA, 19 nt, Homo sapiens
ccucacaccagaaauauua

SEQ ID NO: 1207505 - RNA, 19 nt, Homo sapiens
caccucagcuguaguggua

SEQ ID NO: 1207506 - RNA, 19 nt, Homo sapiens
gcaagaggcugggcuaggu

SEQ ID NO: 1207507 - RNA, 19 nt, Homo sapiens
caaguucugugacaaagau

SEQ ID NO: 1207508 - RNA, 19 nt, Homo sapiens
gagcagaggagcacacaga

SEQ ID NO: 1207509 - RNA, 19 nt, Homo sapiens
ggacgcuucugcaccauca

SEQ ID NO: 1207510 - RNA, 19 nt, Homo sapiens
cagaggagcacacagauga

SEQ ID NO: 1207511 - RNA, 19 nt, Homo sapiens
gcaggcaaguucugugaca

SEQ ID NO: 1207512 - RNA, 19 nt, Homo sapiens
gaccugugagcuugucuua

SEQ ID NO: 1207513 - RNA, 19 nt, Homo sapiens
guaccauugugugugcuua

SEQ ID NO: 1207514 - RNA, 19 nt, Homo sapiens
cagccucacaccagaaaua

SEQ ID NO: 1207515 - RNA, 19 nt, Homo sapiens
cagaauguaagauggaauu

SEQ ID NO: 1207516 - RNA, 19 nt, Homo sapiens
ggaggccagugcauguaug

SEQ ID NO: 1207517 - RNA, 19 nt, Homo sapiens
gguucuggcuacuguguug

SEQ ID NO: 1207518 - RNA, 19 nt, Homo sapiens
ggaccaggagugucagguu

SEQ ID NO: 1207519 - RNA, 19 nt, Homo sapiens
gcagaggagcacacagaug

SEQ ID NO: 1207520 - RNA, 19 nt, Homo sapiens
ccucacugcugcccugguu

SEQ ID NO: 1207521 - RNA, 19 nt, Homo sapiens
gggcaggcaaguucuguga

SEQ ID NO: 1207522 - RNA, 19 nt, Homo sapiens
cagcuuggguacacacaca

SEQ ID NO: 1207523 - RNA, 19 nt, Homo sapiens
gcaaguucugugacaaaga

SEQ ID NO: 1207524 - RNA, 19 nt, Homo sapiens
cacagaauguaagauggaa

SEQ ID NO: 1207525 - RNA, 19 nt, Homo sapiens
gaggccagugcauguauga

SEQ ID NO: 1207526 - RNA, 19 nt, Homo sapiens
gccaggaccaggaguguca

SEQ ID NO: 1207527 - RNA, 19 nt, Homo sapiens
gugacaaagaugaacauau

SEQ ID NO: 1207528 - RNA, 19 nt, Homo sapiens
ggcaaguucugugacaaag

SEQ ID NO: 1207529 - RNA, 19 nt, Homo sapiens
acacagaauguaagaugga

SEQ ID NO: 1207530 - RNA, 19 nt, Homo sapiens
gcaaggcuggacccugaug

SEQ ID NO: 1207531 - RNA, 19 nt, Homo sapiens
ggagcacacagaugaagca

SEQ ID NO: 1207532 - RNA, 19 nt, Homo sapiens
ccugugagcuugucuuacc

SEQ ID NO: 1207533 - RNA, 19 nt, Homo sapiens
gaugcggccuugugcuaac

SEQ ID NO: 1207534 - RNA, 19 nt, Homo sapiens
caucucgugugccuguugu

SEQ ID NO: 1207535 - RNA, 19 nt, Homo sapiens
ugacugcagcucccacugu

SEQ ID NO: 1207536 - RNA, 19 nt, Homo sapiens
uggcaagaccugugagcuu

SEQ ID NO: 1207537 - RNA, 19 nt, Homo sapiens
gcggugaguaccauugugu

SEQ ID NO: 1207538 - RNA, 19 nt, Homo sapiens
ggugaguaccauugugugu

SEQ ID NO: 1207539 - RNA, 19 nt, Homo sapiens
gaaaggaacugaauacauu

SEQ ID NO: 1207540 - RNA, 19 nt, Homo sapiens
gagacaagcucaccgaaau

SEQ ID NO: 1207541 - RNA, 19 nt, Homo sapiens
gagaacacauuacaagaug

SEQ ID NO: 1207542 - RNA, 19 nt, Homo sapiens
gcaggaaucuggaccuuca

SEQ ID NO: 1207543 - RNA, 19 nt, Homo sapiens
gaagagacaauaguccuua

SEQ ID NO: 1207544 - RNA, 19 nt, Homo sapiens
gcaagacacuuaugagaac

SEQ ID NO: 1207545 - RNA, 19 nt, Homo sapiens
gugcacagguuucauauuc

SEQ ID NO: 1207546 - RNA, 19 nt, Homo sapiens
ccagaagguuggaaaguug

SEQ ID NO: 1207547 - RNA, 19 nt, Homo sapiens
ccaaagagcagcugaagau

SEQ ID NO: 1207548 - RNA, 19 nt, Homo sapiens
gagguggugucauuuguga

SEQ ID NO: 1207549 - RNA, 19 nt, Homo sapiens
caacccagcuguucauugg

SEQ ID NO: 1207550 - RNA, 19 nt, Homo sapiens
gaaagguugucccaaacug

SEQ ID NO: 1207551 - RNA, 19 nt, Homo sapiens
ccugaaagguugucccaaa

SEQ ID NO: 1207552 - RNA, 19 nt, Homo sapiens
ggaaaggaacugaauacau

SEQ ID NO: 1207553 - RNA, 19 nt, Homo sapiens
gaacugaauacauuuccuu

SEQ ID NO: 1207554 - RNA, 19 nt, Homo sapiens
gaccucauguucauuguuc

SEQ ID NO: 1207555 - RNA, 19 nt, Homo sapiens
gaauacauuuccuuuaagc

SEQ ID NO: 1207556 - RNA, 19 nt, Homo sapiens
gcacagguuucauauucca

SEQ ID NO: 1207557 - RNA, 19 nt, Homo sapiens
cugaggagguggugucauu

SEQ ID NO: 1207558 - RNA, 19 nt, Homo sapiens
gaagauccguaagagcaau

SEQ ID NO: 1207559 - RNA, 19 nt, Homo sapiens
ggagaaggacaugaagaaa

SEQ ID NO: 1207560 - RNA, 19 nt, Homo sapiens
ccucuacacuccaucauag

SEQ ID NO: 1207561 - RNA, 19 nt, Homo sapiens
ggacaugaagaaagccaaa

SEQ ID NO: 1207562 - RNA, 19 nt, Homo sapiens
gaguggauccugaaagguu

SEQ ID NO: 1207563 - RNA, 19 nt, Homo sapiens
gagaaggacaugaagaaag

SEQ ID NO: 1207564 - RNA, 19 nt, Homo sapiens
gcugagcucugugauguag

SEQ ID NO: 1207565 - RNA, 19 nt, Homo sapiens
ugucauuugugaagaagaa

SEQ ID NO: 1207566 - RNA, 19 nt, Homo sapiens
gaaacuuugagggaaauuu

SEQ ID NO: 1207567 - RNA, 19 nt, Homo sapiens
cacuggaccuugcggaauu

SEQ ID NO: 1207568 - RNA, 19 nt, Homo sapiens
aaggaaacuuugagggaaa

SEQ ID NO: 1207569 - RNA, 19 nt, Homo sapiens
acacuuaugagaacacauu

SEQ ID NO: 1207570 - RNA, 19 nt, Homo sapiens
agaaggacaugaagaaagc

SEQ ID NO: 1207571 - RNA, 19 nt, Homo sapiens
gcagauccucuacgugugu

SEQ ID NO: 1207572 - RNA, 19 nt, Homo sapiens
ugagaacacauuacaagau

SEQ ID NO: 1207573 - RNA, 19 nt, Homo sapiens
gaggagguggugucauuug

SEQ ID NO: 1207574 - RNA, 19 nt, Homo sapiens
ggcaacgaguggagaagga

SEQ ID NO: 1207575 - RNA, 19 nt, Homo sapiens
gcaacccagcuguucauug

SEQ ID NO: 1207576 - RNA, 19 nt, Homo sapiens
gcauggaaaggaacugaau

SEQ ID NO: 1207577 - RNA, 19 nt, Homo sapiens
cagcugaagauccguaaga

SEQ ID NO: 1207578 - RNA, 19 nt, Homo sapiens
cgagacaagcucaccgaaa

SEQ ID NO: 1207579 - RNA, 19 nt, Homo sapiens
acgcugagcucugugaugu

SEQ ID NO: 1207580 - RNA, 19 nt, Homo sapiens
cauggaaaggaacugaaua

SEQ ID NO: 1207581 - RNA, 19 nt, Homo sapiens
gaguggagaaggacaugaa

SEQ ID NO: 1207582 - RNA, 19 nt, Homo sapiens
gggcaggaaucuggaccuu

SEQ ID NO: 1207583 - RNA, 19 nt, Homo sapiens
uugcggaauuugcuaagaa

SEQ ID NO: 1207584 - RNA, 19 nt, Homo sapiens
acauuuccuuuaagcauga

SEQ ID NO: 1207585 - RNA, 19 nt, Homo sapiens
uggagaaggacaugaagaa

SEQ ID NO: 1207586 - RNA, 19 nt, Homo sapiens
aagcacauagauaaccuua

SEQ ID NO: 1207587 - RNA, 19 nt, Homo sapiens
uaugagaacacauuacaag

SEQ ID NO: 1207588 - RNA, 19 nt, Homo sapiens
cguaagagcaaucagauac

SEQ ID NO: 1207589 - RNA, 19 nt, Homo sapiens
caagacacuuaugagaaca

SEQ ID NO: 1207590 - RNA, 19 nt, Homo sapiens
gguggcagaagagacaaua

SEQ ID NO: 1207591 - RNA, 19 nt, Homo sapiens
cauacuggguacaucaaag

SEQ ID NO: 1207592 - RNA, 19 nt, Homo sapiens
gccauuaccaaucgcgaaa

SEQ ID NO: 1207593 - RNA, 19 nt, Homo sapiens
ugcaagacacuuaugagaa

SEQ ID NO: 1207594 - RNA, 19 nt, Homo sapiens
ccaugcaagacacuuauga

SEQ ID NO: 1207595 - RNA, 19 nt, Homo sapiens
ggagguggugucauuugug

SEQ ID NO: 1207596 - RNA, 19 nt, Homo sapiens
ugagggaaauuuugaguca

SEQ ID NO: 1207597 - RNA, 19 nt, Homo sapiens
ggcugaccguggaggauga

SEQ ID NO: 1207598 - RNA, 19 nt, Homo sapiens
guuggaaaguuggcugcaa

SEQ ID NO: 1207599 - RNA, 19 nt, Homo sapiens
gccucuacacuccaucaua

SEQ ID NO: 1207600 - RNA, 19 nt, Homo sapiens
uaagagcaaucagauaccu

SEQ ID NO: 1207601 - RNA, 19 nt, Homo sapiens
cagguuucauauuccagaa

SEQ ID NO: 1207602 - RNA, 19 nt, Homo sapiens
gcuaagaagcagccauggu

SEQ ID NO: 1207603 - RNA, 19 nt, Homo sapiens
ucgagucccuccuccucuu

SEQ ID NO: 1207604 - RNA, 19 nt, Homo sapiens
gacaagcucaccgaaaugg

SEQ ID NO: 1207605 - RNA, 19 nt, Homo sapiens
aaaccauacuggguacauc

SEQ ID NO: 1207606 - RNA, 19 nt, Homo sapiens
ugucccaaacuguugauuu

SEQ ID NO: 1207607 - RNA, 19 nt, Homo sapiens
gucuguaggccaacaagaa

SEQ ID NO: 1207608 - RNA, 19 nt, Homo sapiens
ccgcgcagauccucuacgu

SEQ ID NO: 1207609 - RNA, 19 nt, Homo sapiens
caugguggcguaagcuguu

SEQ ID NO: 1207610 - RNA, 19 nt, Homo sapiens
gaugaguggauccugaaag

SEQ ID NO: 1207611 - RNA, 19 nt, Homo sapiens
gcugguacaagucaaugug

SEQ ID NO: 1207612 - RNA, 19 nt, Homo sapiens
guucauuguuccugguuuu

SEQ ID NO: 1207613 - RNA, 19 nt, Homo sapiens
gccaaagagcagcugaaga

SEQ ID NO: 1207614 - RNA, 19 nt, Homo sapiens
gauaagcaggugaaauuua

SEQ ID NO: 1207615 - RNA, 19 nt, Homo sapiens
gaaguccuguucuuauuau

SEQ ID NO: 1207616 - RNA, 19 nt, Homo sapiens
gccaggcaguuauagauua

SEQ ID NO: 1207617 - RNA, 19 nt, Homo sapiens
ggaggaaggugucgagaag

SEQ ID NO: 1207618 - RNA, 19 nt, Homo sapiens
uagauaagcaggugaaauu

SEQ ID NO: 1207619 - RNA, 19 nt, Homo sapiens
gugaaguccuguucuuauu

SEQ ID NO: 1207620 - RNA, 19 nt, Homo sapiens
gcacucaggacaccauaaa

SEQ ID NO: 1207621 - RNA, 19 nt, Homo sapiens
ccaggcaguuauagauuaa

SEQ ID NO: 1207622 - RNA, 19 nt, Homo sapiens
ugaaguccuguucuuauua

SEQ ID NO: 1207623 - RNA, 19 nt, Homo sapiens
gauuaaaggccugugagua

SEQ ID NO: 1207624 - RNA, 19 nt, Homo sapiens
gaggaguaccugaaacuga

SEQ ID NO: 1207625 - RNA, 19 nt, Homo sapiens
aagagccacugcacaauga

SEQ ID NO: 1207626 - RNA, 19 nt, Homo sapiens
uaggagagaccaugacuga

SEQ ID NO: 1207627 - RNA, 19 nt, Homo sapiens
auaagcaggugaaauuuag

SEQ ID NO: 1207628 - RNA, 19 nt, Homo sapiens
gacuauaacaggugugauu

SEQ ID NO: 1207629 - RNA, 19 nt, Homo sapiens
gaaauuuaggcuucagaau

SEQ ID NO: 1207630 - RNA, 19 nt, Homo sapiens
ggugaaguccuguucuuau

SEQ ID NO: 1207631 - RNA, 19 nt, Homo sapiens
aggaguaccugaaacugaa

SEQ ID NO: 1207632 - RNA, 19 nt, Homo sapiens
gcaugaggaguaccugaaa

SEQ ID NO: 1207633 - RNA, 19 nt, Homo sapiens
gaaaauuggagcuaagaaa

SEQ ID NO: 1207634 - RNA, 19 nt, Homo sapiens
caagagccacugcacaaug

SEQ ID NO: 1207635 - RNA, 19 nt, Homo sapiens
guccuguucuuauuaugaa

SEQ ID NO: 1207636 - RNA, 19 nt, Homo sapiens
cuaccuggcuauacaucuu

SEQ ID NO: 1207637 - RNA, 19 nt, Homo sapiens
gccaagagccacugcacaa

SEQ ID NO: 1207638 - RNA, 19 nt, Homo sapiens
gggcagaagcagaugagaa

SEQ ID NO: 1207639 - RNA, 19 nt, Homo sapiens
cuuggaagcuggugaaguc

SEQ ID NO: 1207640 - RNA, 19 nt, Homo sapiens
ugcggaagcuggaggagaa

SEQ ID NO: 1207641 - RNA, 19 nt, Homo sapiens
gaccaugacugaggaacag

SEQ ID NO: 1207642 - RNA, 19 nt, Homo sapiens
ggaggaggaaggcguagga

SEQ ID NO: 1207643 - RNA, 19 nt, Homo sapiens
gaggaaggcguaggagaga

SEQ ID NO: 1207644 - RNA, 19 nt, Homo sapiens
cuaagaaacugcggaagcu

SEQ ID NO: 1207645 - RNA, 19 nt, Homo sapiens
ggccaggcaguuauagauu

SEQ ID NO: 1207646 - RNA, 19 nt, Homo sapiens
uggccuaccuggcuauaca

SEQ ID NO: 1207647 - RNA, 19 nt, Homo sapiens
gagaaacaagcgcgaaagg

SEQ ID NO: 1207648 - RNA, 19 nt, Homo sapiens
gaagcuggaggagaaacaa

SEQ ID NO: 1207649 - RNA, 19 nt, Homo sapiens
caucaagcaguccaagguu

SEQ ID NO: 1207650 - RNA, 19 nt, Homo sapiens
guucaucaacuacaucaag

SEQ ID NO: 1207651 - RNA, 19 nt, Homo sapiens
gcucugcuagucggcuuua

SEQ ID NO: 1207652 - RNA, 19 nt, Homo sapiens
ggagaaacaagcgcgaaag

SEQ ID NO: 1207653 - RNA, 19 nt, Homo sapiens
ggcagaagcagaugagaac

SEQ ID NO: 1207654 - RNA, 19 nt, Homo sapiens
ggaagcuggaggagaaaca

SEQ ID NO: 1207655 - RNA, 19 nt, Homo sapiens
uauaacaggugugauugac

SEQ ID NO: 1207656 - RNA, 19 nt, Homo sapiens
agagcuuccugacagaguu

SEQ ID NO: 1207657 - RNA, 19 nt, Homo sapiens
ugugaguacugcugagcuu

SEQ ID NO: 1207658 - RNA, 19 nt, Homo sapiens
gcgaagcugaguggaagaa

SEQ ID NO: 1207659 - RNA, 19 nt, Homo sapiens
cuggugaaguccuguucuu

SEQ ID NO: 1207660 - RNA, 19 nt, Homo sapiens
cuauaacaggugugauuga

SEQ ID NO: 1207661 - RNA, 19 nt, Homo sapiens
agauaagcaggugaaauuu

SEQ ID NO: 1207662 - RNA, 19 nt, Homo sapiens
uuaaaggccugugaguacu

SEQ ID NO: 1207663 - RNA, 19 nt, Homo sapiens
aguccaagguugugcucuu

SEQ ID NO: 1207664 - RNA, 19 nt, Homo sapiens
ucaagcaguccaagguugu

SEQ ID NO: 1207665 - RNA, 19 nt, Homo sapiens
cagaagcagaugagaacga

SEQ ID NO: 1207666 - RNA, 19 nt, Homo sapiens
aauuggagcuaagaaacug

SEQ ID NO: 1207667 - RNA, 19 nt, Homo sapiens
gaaagggaauaaagagaaa

SEQ ID NO: 1207668 - RNA, 19 nt, Homo sapiens
gcauggaacccugggauua

SEQ ID NO: 1207669 - RNA, 19 nt, Homo sapiens
ggaccuuauugaugaaaga

SEQ ID NO: 1207670 - RNA, 19 nt, Homo sapiens
ggagaucgaacacgucaug

SEQ ID NO: 1207671 - RNA, 19 nt, Homo sapiens
ugaaagggaauaaagagaa

SEQ ID NO: 1207672 - RNA, 19 nt, Homo sapiens
agaaaccgucuuugcguua

SEQ ID NO: 1207673 - RNA, 19 nt, Homo sapiens
gaagcuaugaaagggaaua

SEQ ID NO: 1207674 - RNA, 19 nt, Homo sapiens
gaucgaacacgucauguac

SEQ ID NO: 1207675 - RNA, 19 nt, Homo sapiens
gaaaccgucuuugcguuac

SEQ ID NO: 1207676 - RNA, 19 nt, Homo sapiens
gcuaugaaagggaauaaag

SEQ ID NO: 1207677 - RNA, 19 nt, Homo sapiens
gaggagcccaugcugaaug

SEQ ID NO: 1207678 - RNA, 19 nt, Homo sapiens
gaaccagcggguggccuua

SEQ ID NO: 1207679 - RNA, 19 nt, Homo sapiens
ucugagggucugcaucuua

SEQ ID NO: 1207680 - RNA, 19 nt, Homo sapiens
ccgaggagcccaugcugaa

SEQ ID NO: 1207681 - RNA, 19 nt, Homo sapiens
guggggaccuuauugauga

SEQ ID NO: 1207682 - RNA, 19 nt, Homo sapiens
ggccaugauuaucgcagaa

SEQ ID NO: 1207683 - RNA, 19 nt, Homo sapiens
gcagaggauacgcauggaa

SEQ ID NO: 1207684 - RNA, 19 nt, Homo sapiens
uaucgcagaacgacagaaa

SEQ ID NO: 1207685 - RNA, 19 nt, Homo sapiens
aaacaggaagacaaaggaa

SEQ ID NO: 1207686 - RNA, 19 nt, Homo sapiens
cuaugaaagggaauaaaga

SEQ ID NO: 1207687 - RNA, 19 nt, Homo sapiens
cugagggucugcaucuuag

SEQ ID NO: 1207688 - RNA, 19 nt, Homo sapiens
cggcagaagcuaugaaagg

SEQ ID NO: 1207689 - RNA, 19 nt, Homo sapiens
ucgaacacgucauguacca

SEQ ID NO: 1207690 - RNA, 19 nt, Homo sapiens
gggauuacccugcaaaaca

SEQ ID NO: 1207691 - RNA, 19 nt, Homo sapiens
acacggcgcagaacuugga

SEQ ID NO: 1207692 - RNA, 19 nt, Homo sapiens
cuacacggcgcagaacuug

SEQ ID NO: 1207693 - RNA, 19 nt, Homo sapiens
ggaauaaagagaaaagaag

SEQ ID NO: 1207694 - RNA, 19 nt, Homo sapiens
agaucgaacacgucaugua

SEQ ID NO: 1207695 - RNA, 19 nt, Homo sapiens
gggaauaaagagaaaagaa

SEQ ID NO: 1207696 - RNA, 19 nt, Homo sapiens
uaugaaagggaauaaagag

SEQ ID NO: 1207697 - RNA, 19 nt, Homo sapiens
gaucccggcagaagcuaug

SEQ ID NO: 1207698 - RNA, 19 nt, Homo sapiens
uaaagaagcucuagagaag

SEQ ID NO: 1207699 - RNA, 19 nt, Homo sapiens
gcagcuaccuuucaacuga

SEQ ID NO: 1207700 - RNA, 19 nt, Homo sapiens
ggacugagcagcuaccuuu

SEQ ID NO: 1207701 - RNA, 19 nt, Homo sapiens
guaaagaagcucuagagaa

SEQ ID NO: 1207702 - RNA, 19 nt, Homo sapiens
cacugaagcuauugauaua

SEQ ID NO: 1207703 - RNA, 19 nt, Homo sapiens
gaagcaguuuccacaguga

SEQ ID NO: 1207704 - RNA, 19 nt, Homo sapiens
auacaucacugaagcuauu

SEQ ID NO: 1207705 - RNA, 19 nt, Homo sapiens
uagcaaaucuaugccaauu

SEQ ID NO: 1207706 - RNA, 19 nt, Homo sapiens
ugaagaagcugggacuguu

SEQ ID NO: 1207707 - RNA, 19 nt, Homo sapiens
gcaaaucuaugccaauucc

SEQ ID NO: 1207708 - RNA, 19 nt, Homo sapiens
guccaagcauacauuuaua

SEQ ID NO: 1207709 - RNA, 19 nt, Homo sapiens
cccagugucuuacguaauu

SEQ ID NO: 1207710 - RNA, 19 nt, Homo sapiens
gaucucgcccagugucuua

SEQ ID NO: 1207711 - RNA, 19 nt, Homo sapiens
gagaaaagcacguaaagaa

SEQ ID NO: 1207712 - RNA, 19 nt, Homo sapiens
gaccaucacucagcaagga

SEQ ID NO: 1207713 - RNA, 19 nt, Homo sapiens
acucagggcucaagaugaa

SEQ ID NO: 1207714 - RNA, 19 nt, Homo sapiens
gaacaagaagagacacaug

SEQ ID NO: 1207715 - RNA, 19 nt, Homo sapiens
ggaaagauuuugcagguau

SEQ ID NO: 1207716 - RNA, 19 nt, Homo sapiens
ucacugaagcuauugauau

SEQ ID NO: 1207717 - RNA, 19 nt, Homo sapiens
gaagcugccaccuaauauu

SEQ ID NO: 1207718 - RNA, 19 nt, Homo sapiens
gauauaacacaaugaguca

SEQ ID NO: 1207719 - RNA, 19 nt, Homo sapiens
gcucaucccuccgccagaa

SEQ ID NO: 1207720 - RNA, 19 nt, Homo sapiens
caccuaauauuguucugaa

SEQ ID NO: 1207721 - RNA, 19 nt, Homo sapiens
ggaagcugccaccuaauau

SEQ ID NO: 1207722 - RNA, 19 nt, Homo sapiens
cccggaagcugccaccuaa

SEQ ID NO: 1207723 - RNA, 19 nt, Homo sapiens
gagagcagacuccuucaga

SEQ ID NO: 1207724 - RNA, 19 nt, Homo sapiens
uguccuggcugaacaagaa

SEQ ID NO: 1207725 - RNA, 19 nt, Homo sapiens
cgccagagccugagaaaga

SEQ ID NO: 1207726 - RNA, 19 nt, Homo sapiens
gaagaagcugggacuguug

SEQ ID NO: 1207727 - RNA, 19 nt, Homo sapiens
cggaagcugccaccuaaua

SEQ ID NO: 1207728 - RNA, 19 nt, Homo sapiens
ccacaacucccagagguuu

SEQ ID NO: 1207729 - RNA, 19 nt, Homo sapiens
caaaggguguccccaauga

SEQ ID NO: 1207730 - RNA, 19 nt, Homo sapiens
ucagggaccuuugccaaug

SEQ ID NO: 1207731 - RNA, 19 nt, Homo sapiens
gaucuccuguucacugcaa

SEQ ID NO: 1207732 - RNA, 19 nt, Homo sapiens
gaaggugaucuccacaaga

SEQ ID NO: 1207733 - RNA, 19 nt, Homo sapiens
ccauguggaucauucugaa

SEQ ID NO: 1207734 - RNA, 19 nt, Homo sapiens
gccagagccugagaaagaa

SEQ ID NO: 1207735 - RNA, 19 nt, Homo sapiens
caacucagggcucaagaug

SEQ ID NO: 1207736 - RNA, 19 nt, Homo sapiens
gaaagagagcagacuccuu

SEQ ID NO: 1207737 - RNA, 19 nt, Homo sapiens
ccauccagcucccaggaaa

SEQ ID NO: 1207738 - RNA, 19 nt, Homo sapiens
agauuugaguccaagcaua

SEQ ID NO: 1207739 - RNA, 19 nt, Homo sapiens
cagaggagaccaucacuca

SEQ ID NO: 1207740 - RNA, 19 nt, Homo sapiens
gcuccaagcgccuguccua

SEQ ID NO: 1207741 - RNA, 19 nt, Homo sapiens
cagggaccuuugccaauga

SEQ ID NO: 1207742 - RNA, 19 nt, Homo sapiens
cuccaucucugcccuuuga

SEQ ID NO: 1207743 - RNA, 19 nt, Homo sapiens
ggaggcugcccuugacuug

SEQ ID NO: 1207744 - RNA, 19 nt, Homo sapiens
cacaaugagucacuguuca

SEQ ID NO: 1207745 - RNA, 19 nt, Homo sapiens
augagucacuguucagaaa

SEQ ID NO: 1207746 - RNA, 19 nt, Homo sapiens
gggagagauuugaguccaa

SEQ ID NO: 1207747 - RNA, 19 nt, Homo sapiens
gcugccaccuaauauuguu

SEQ ID NO: 1207748 - RNA, 19 nt, Homo sapiens
ggauacaucacugaagcua

SEQ ID NO: 1207749 - RNA, 19 nt, Homo sapiens
ugaaugggagggagagauu

SEQ ID NO: 1207750 - RNA, 19 nt, Homo sapiens
agagcagacuccuucagaa

SEQ ID NO: 1207751 - RNA, 19 nt, Homo sapiens
aaggugaucuccacaagag

SEQ ID NO: 1207752 - RNA, 19 nt, Homo sapiens
ugaaggugaucuccacaag

SEQ ID NO: 1207753 - RNA, 19 nt, Homo sapiens
agagacacaugcuccacuu

SEQ ID NO: 1207754 - RNA, 19 nt, Homo sapiens
gggaggcccugaagaagcu

SEQ ID NO: 1207755 - RNA, 19 nt, Homo sapiens
caacaccccuggccugaga

SEQ ID NO: 1207756 - RNA, 19 nt, Homo sapiens
gcagcuagcaaaucuaugc

SEQ ID NO: 1207757 - RNA, 19 nt, Homo sapiens
gccauugaguucccaugug

SEQ ID NO: 1207758 - RNA, 19 nt, Homo sapiens
gaguccaagcauacauuua

SEQ ID NO: 1207759 - RNA, 19 nt, Homo sapiens
gaaugggagggagagauuu

SEQ ID NO: 1207760 - RNA, 19 nt, Homo sapiens
acagagccgugacaagcuu

SEQ ID NO: 1207761 - RNA, 19 nt, Homo sapiens
ccaagcgccuguccuacca

SEQ ID NO: 1207762 - RNA, 19 nt, Homo sapiens
ccgaagcaguuuccacagu

SEQ ID NO: 1207763 - RNA, 19 nt, Homo sapiens
ugcaagagcugaagaugcu

SEQ ID NO: 1207764 - RNA, 19 nt, Homo sapiens
ucagaagccaugucccaaa

SEQ ID NO: 1207765 - RNA, 19 nt, Homo sapiens
cuaggaauauccacauugc

SEQ ID NO: 1207766 - RNA, 19 nt, Homo sapiens
guucccauguggaucauuc

SEQ ID NO: 1207767 - RNA, 19 nt, Homo sapiens
cuaauauuguucugaagag

SEQ ID NO: 1207768 - RNA, 19 nt, Homo sapiens
gaaugcaagagcugaagau

SEQ ID NO: 1207769 - RNA, 19 nt, Homo sapiens
caaggacgaacgccaagga

SEQ ID NO: 1207770 - RNA, 19 nt, Homo sapiens
caagagggugugugugugu

SEQ ID NO: 1207771 - RNA, 19 nt, Homo sapiens
ucucugcccuuugaaacaa

SEQ ID NO: 1207772 - RNA, 19 nt, Homo sapiens
gagcagcuaccuuucaacu

SEQ ID NO: 1207773 - RNA, 19 nt, Homo sapiens
aagagcagccgaagcaguu

SEQ ID NO: 1207774 - RNA, 19 nt, Homo sapiens
cagaagccaugucccaaaa

SEQ ID NO: 1207775 - RNA, 19 nt, Homo sapiens
cugagcagcuaccuuucaa

SEQ ID NO: 1207776 - RNA, 19 nt, Homo sapiens
ccuaauauuguucugaaga

SEQ ID NO: 1207777 - RNA, 19 nt, Homo sapiens
aagcugccaccuaauauug

SEQ ID NO: 1207778 - RNA, 19 nt, Homo sapiens
ggacccaaacagccgacua

SEQ ID NO: 1207779 - RNA, 19 nt, Homo sapiens
cugcaggguugccucagaa

SEQ ID NO: 1207780 - RNA, 19 nt, Homo sapiens
cgaacgccaaggacaguaa

SEQ ID NO: 1207781 - RNA, 19 nt, Homo sapiens
aguccaagcauacauuuau

SEQ ID NO: 1207782 - RNA, 19 nt, Homo sapiens
uacagccucccuaggaaua

SEQ ID NO: 1207783 - RNA, 19 nt, Homo sapiens
gauuugaguccaagcauac

SEQ ID NO: 1207784 - RNA, 19 nt, Homo sapiens
gcaacucagggcucaagau

SEQ ID NO: 1207785 - RNA, 19 nt, Homo sapiens
gcgugggacugagcagcua

SEQ ID NO: 1207786 - RNA, 19 nt, Homo sapiens
aaaucuaugccaauuccua

SEQ ID NO: 1207787 - RNA, 19 nt, Homo sapiens
gcacguaaagaagcucuag

SEQ ID NO: 1207788 - RNA, 19 nt, Homo sapiens
ggccugaucuccuguucac

SEQ ID NO: 1207789 - RNA, 19 nt, Homo sapiens
cugaagcuauugauauaac

SEQ ID NO: 1207790 - RNA, 19 nt, Homo sapiens
gaaagaugccagccccaaa

SEQ ID NO: 1207791 - RNA, 19 nt, Homo sapiens
gcagagaaaagcacguaaa

SEQ ID NO: 1207792 - RNA, 19 nt, Homo sapiens
gcaggguugccucagaaug

SEQ ID NO: 1207793 - RNA, 19 nt, Homo sapiens
cgcucuggaucuagugaua

SEQ ID NO: 1207794 - RNA, 19 nt, Homo sapiens
gacccaaacagccgacuag

SEQ ID NO: 1207795 - RNA, 19 nt, Homo sapiens
cuugggacauuguucacuu

SEQ ID NO: 1207796 - RNA, 19 nt, Homo sapiens
acacaaugagucacuguuc

SEQ ID NO: 1207797 - RNA, 19 nt, Homo sapiens
agccagaacuucaggaaaa

SEQ ID NO: 1207798 - RNA, 19 nt, Homo sapiens
gguaagcucucaugguuua

SEQ ID NO: 1207799 - RNA, 19 nt, Homo sapiens
gcaggaacguugaauauug

SEQ ID NO: 1207800 - RNA, 19 nt, Homo sapiens
ggaaugaaagaacagauua

SEQ ID NO: 1207801 - RNA, 19 nt, Homo sapiens
gcauucaacuaccuuguaa

SEQ ID NO: 1207802 - RNA, 19 nt, Homo sapiens
cgaagaaccucccucauuc

SEQ ID NO: 1207803 - RNA, 19 nt, Homo sapiens
guaaagaggucagucacaa

SEQ ID NO: 1207804 - RNA, 19 nt, Homo sapiens
agaaagggcuggagcagaa

SEQ ID NO: 1207805 - RNA, 19 nt, Homo sapiens
ggaacacuauucuuacaga

SEQ ID NO: 1207806 - RNA, 19 nt, Homo sapiens
gacuuugacuguauaguuu

SEQ ID NO: 1207807 - RNA, 19 nt, Homo sapiens
aagaacagauuaagcauug

SEQ ID NO: 1207808 - RNA, 19 nt, Homo sapiens
gcccguaccugcacuuauu

SEQ ID NO: 1207809 - RNA, 19 nt, Homo sapiens
gcgaagaaccucccucauu

SEQ ID NO: 1207810 - RNA, 19 nt, Homo sapiens
ugaaagaaaugcagguaau

SEQ ID NO: 1207811 - RNA, 19 nt, Homo sapiens
guaaaugguucauggcaau

SEQ ID NO: 1207812 - RNA, 19 nt, Homo sapiens
ccagauuucuuucuuuaug

SEQ ID NO: 1207813 - RNA, 19 nt, Homo sapiens
ucaacuaccuuguaaaugg

SEQ ID NO: 1207814 - RNA, 19 nt, Homo sapiens
uaccugcacuuauuuauug

SEQ ID NO: 1207815 - RNA, 19 nt, Homo sapiens
ucaagacacuccagguauu

SEQ ID NO: 1207816 - RNA, 19 nt, Homo sapiens
cagguaaucucuauacuag

SEQ ID NO: 1207817 - RNA, 19 nt, Homo sapiens
gcagguaaucucuauacua

SEQ ID NO: 1207818 - RNA, 19 nt, Homo sapiens
ccacugagccacucucuga

SEQ ID NO: 1207819 - RNA, 19 nt, Homo sapiens
gcagugaacagcugaauag

SEQ ID NO: 1207820 - RNA, 19 nt, Homo sapiens
aaggguggcugaaauacua

SEQ ID NO: 1207821 - RNA, 19 nt, Homo sapiens
ugaagugucugucagugaa

SEQ ID NO: 1207822 - RNA, 19 nt, Homo sapiens
ccaaauguauugaugugau

SEQ ID NO: 1207823 - RNA, 19 nt, Homo sapiens
gaaauguacucugugucuu

SEQ ID NO: 1207824 - RNA, 19 nt, Homo sapiens
ccacucaugcuuuggcuua

SEQ ID NO: 1207825 - RNA, 19 nt, Homo sapiens
gcauugauaggcuuucuuu

SEQ ID NO: 1207826 - RNA, 19 nt, Homo sapiens
gaagagggccugagguucu

SEQ ID NO: 1207827 - RNA, 19 nt, Homo sapiens
guauucagguccaugagaa

SEQ ID NO: 1207828 - RNA, 19 nt, Homo sapiens
gaaaugcagguaaucucua

SEQ ID NO: 1207829 - RNA, 19 nt, Homo sapiens
gacguuggguugcuuccua

SEQ ID NO: 1207830 - RNA, 19 nt, Homo sapiens
ugaaagaacagauuaagca

SEQ ID NO: 1207831 - RNA, 19 nt, Homo sapiens
aaacagcagccuagcagua

SEQ ID NO: 1207832 - RNA, 19 nt, Homo sapiens
cuagacaaguucagauaga

SEQ ID NO: 1207833 - RNA, 19 nt, Homo sapiens
cuccacagaugcacuuuaa

SEQ ID NO: 1207834 - RNA, 19 nt, Homo sapiens
acccagauuucuuucuuua

SEQ ID NO: 1207835 - RNA, 19 nt, Homo sapiens
gaagaggagguuuaagcaa

SEQ ID NO: 1207836 - RNA, 19 nt, Homo sapiens
gcgaugcgccucauucaga

SEQ ID NO: 1207837 - RNA, 19 nt, Homo sapiens
gaacagauuaagcauugau

SEQ ID NO: 1207838 - RNA, 19 nt, Homo sapiens
uacaagagcuaugaacuca

SEQ ID NO: 1207839 - RNA, 19 nt, Homo sapiens
ggcauaaucguuucgguuu

SEQ ID NO: 1207840 - RNA, 19 nt, Homo sapiens
uaugugaaauguacucugu

SEQ ID NO: 1207841 - RNA, 19 nt, Homo sapiens
gagccacucucugaauaug

SEQ ID NO: 1207842 - RNA, 19 nt, Homo sapiens
gaacuucacgcucuucaac

SEQ ID NO: 1207843 - RNA, 19 nt, Homo sapiens
gaguuuaugggccagaaua

SEQ ID NO: 1207844 - RNA, 19 nt, Homo sapiens
ucucuuaccaguaugauuu

SEQ ID NO: 1207845 - RNA, 19 nt, Homo sapiens
uugguaagcucucaugguu

SEQ ID NO: 1207846 - RNA, 19 nt, Homo sapiens
gggaaugaaagaacagauu

SEQ ID NO: 1207847 - RNA, 19 nt, Homo sapiens
gcauaaucguuucgguuuc

SEQ ID NO: 1207848 - RNA, 19 nt, Homo sapiens
cugagccacucucugaaua

SEQ ID NO: 1207849 - RNA, 19 nt, Homo sapiens
ggauugaugaggcuugaaa

SEQ ID NO: 1207850 - RNA, 19 nt, Homo sapiens
guaccugcacuuauuuauu

SEQ ID NO: 1207851 - RNA, 19 nt, Homo sapiens
uggaggagcugugaacuuc

SEQ ID NO: 1207852 - RNA, 19 nt, Homo sapiens
gaaagaacagauuaagcau

SEQ ID NO: 1207853 - RNA, 19 nt, Homo sapiens
aaaugcagguaaucucuau

SEQ ID NO: 1207854 - RNA, 19 nt, Homo sapiens
guauugaugugauuuacag

SEQ ID NO: 1207855 - RNA, 19 nt, Homo sapiens
caacuaccuuguaaauggu

SEQ ID NO: 1207856 - RNA, 19 nt, Homo sapiens
cugaauaugugaaauguac

SEQ ID NO: 1207857 - RNA, 19 nt, Homo sapiens
gaaagaaaugcagguaauc

SEQ ID NO: 1207858 - RNA, 19 nt, Homo sapiens
guucaagacacuccaggua

SEQ ID NO: 1207859 - RNA, 19 nt, Homo sapiens
ccugaaggauacccagauu

SEQ ID NO: 1207860 - RNA, 19 nt, Homo sapiens
caccaaauguauugaugug

SEQ ID NO: 1207861 - RNA, 19 nt, Homo sapiens
gugcaggaacguugaauau

SEQ ID NO: 1207862 - RNA, 19 nt, Homo sapiens
ccuaaggguggcugaaaua

SEQ ID NO: 1207863 - RNA, 19 nt, Homo sapiens
ugaaggauacccagauuuc

SEQ ID NO: 1207864 - RNA, 19 nt, Homo sapiens
ggugugacuuguguaaaug

SEQ ID NO: 1207865 - RNA, 19 nt, Homo sapiens
gcaguuucaccaaauguau

SEQ ID NO: 1207866 - RNA, 19 nt, Homo sapiens
uagacaaguucagauagaa

SEQ ID NO: 1207867 - RNA, 19 nt, Homo sapiens
uaaagaggucagucacaaa

SEQ ID NO: 1207868 - RNA, 19 nt, Homo sapiens
caagaggaagaauugcuuu

SEQ ID NO: 1207869 - RNA, 19 nt, Homo sapiens
caagagggccuguggaacu

SEQ ID NO: 1207870 - RNA, 19 nt, Homo sapiens
caggaacguugaauauugg

SEQ ID NO: 1207871 - RNA, 19 nt, Homo sapiens
ggccugagguucuccuagu

SEQ ID NO: 1207872 - RNA, 19 nt, Homo sapiens
gcugaccuguugcacauca

SEQ ID NO: 1207873 - RNA, 19 nt, Homo sapiens
uuucuaaccugaaggauac

SEQ ID NO: 1207874 - RNA, 19 nt, Homo sapiens
aaauguacucugugucuuu

SEQ ID NO: 1207875 - RNA, 19 nt, Homo sapiens
cgaugcgccucauucagaa

SEQ ID NO: 1207876 - RNA, 19 nt, Homo sapiens
gccacucucugaauaugug

SEQ ID NO: 1207877 - RNA, 19 nt, Homo sapiens
gcuaggcugcucauucuau

SEQ ID NO: 1207878 - RNA, 19 nt, Homo sapiens
aagcugaccuguugcacau

SEQ ID NO: 1207879 - RNA, 19 nt, Homo sapiens
gcuuuggcuuaaacuguaa

SEQ ID NO: 1207880 - RNA, 19 nt, Homo sapiens
agacuuugacuguauaguu

SEQ ID NO: 1207881 - RNA, 19 nt, Homo sapiens
gccuaaggguggcugaaau

SEQ ID NO: 1207882 - RNA, 19 nt, Homo sapiens
ggugaaacccuggcucuuc

SEQ ID NO: 1207883 - RNA, 19 nt, Homo sapiens
gauuuacagugggaaugaa

SEQ ID NO: 1207884 - RNA, 19 nt, Homo sapiens
gccaagagggccuguggaa

SEQ ID NO: 1207885 - RNA, 19 nt, Homo sapiens
ccacagaugcacuuuaaaa

SEQ ID NO: 1207886 - RNA, 19 nt, Homo sapiens
ugugaaauguacucugugu

SEQ ID NO: 1207887 - RNA, 19 nt, Homo sapiens
caucggugacuaugaaaga

SEQ ID NO: 1207888 - RNA, 19 nt, Homo sapiens
ugcuuuggcuuaaacugua

SEQ ID NO: 1207889 - RNA, 19 nt, Homo sapiens
ccaagaggaagaauugcuu

SEQ ID NO: 1207890 - RNA, 19 nt, Homo sapiens
cauaaucguuucgguuucu

SEQ ID NO: 1207891 - RNA, 19 nt, Homo sapiens
gaagugucugucagugaaa

SEQ ID NO: 1207892 - RNA, 19 nt, Homo sapiens
uggugugacuuguguaaau

SEQ ID NO: 1207893 - RNA, 19 nt, Homo sapiens
cccagacuuugacuguaua

SEQ ID NO: 1207894 - RNA, 19 nt, Homo sapiens
uacccagauuucuuucuuu

SEQ ID NO: 1207895 - RNA, 19 nt, Homo sapiens
auacccagauuucuuucuu

SEQ ID NO: 1207896 - RNA, 19 nt, Homo sapiens
ggugguccguugcaguuuc

SEQ ID NO: 1207897 - RNA, 19 nt, Homo sapiens
ugaaauguacucugugucu

SEQ ID NO: 1207898 - RNA, 19 nt, Homo sapiens
gcaggaagcuggaauugau

SEQ ID NO: 1207899 - RNA, 19 nt, Homo sapiens
gcacauggacuuucuguau

SEQ ID NO: 1207900 - RNA, 19 nt, Homo sapiens
ggaccuaugccuucuauaa

SEQ ID NO: 1207901 - RNA, 19 nt, Homo sapiens
ggaaggcauugucagauga

SEQ ID NO: 1207902 - RNA, 19 nt, Homo sapiens
caacaagagugcaaacauc

SEQ ID NO: 1207903 - RNA, 19 nt, Homo sapiens
acauggacuuucuguauua

SEQ ID NO: 1207904 - RNA, 19 nt, Homo sapiens
gcugacaccuucauguuug

SEQ ID NO: 1207905 - RNA, 19 nt, Homo sapiens
gaaaugcaucuucagcuuu

SEQ ID NO: 1207906 - RNA, 19 nt, Homo sapiens
gugcaaacaucaugcuuga

SEQ ID NO: 1207907 - RNA, 19 nt, Homo sapiens
uguauuaccucucccauga

SEQ ID NO: 1207908 - RNA, 19 nt, Homo sapiens
ggagaggcccagugaauau

SEQ ID NO: 1207909 - RNA, 19 nt, Homo sapiens
gggaaggcauugucagaug

SEQ ID NO: 1207910 - RNA, 19 nt, Homo sapiens
ggacauuguucucccagau

SEQ ID NO: 1207911 - RNA, 19 nt, Homo sapiens
ggagcucagugcccuugua

SEQ ID NO: 1207912 - RNA, 19 nt, Homo sapiens
gagcacaucagccucauga

SEQ ID NO: 1207913 - RNA, 19 nt, Homo sapiens
gcaaacaucaugcuugaca

SEQ ID NO: 1207914 - RNA, 19 nt, Homo sapiens
gagcagaggcugacaccuu

SEQ ID NO: 1207915 - RNA, 19 nt, Homo sapiens
gaauguaggcuugcaguga

SEQ ID NO: 1207916 - RNA, 19 nt, Homo sapiens
ggaccgcgauccuaaagag

SEQ ID NO: 1207917 - RNA, 19 nt, Homo sapiens
gaaggagagccugagguua

SEQ ID NO: 1207918 - RNA, 19 nt, Homo sapiens
ucagugcccuuguagagaa

SEQ ID NO: 1207919 - RNA, 19 nt, Homo sapiens
cacauggacuuucuguauu

SEQ ID NO: 1207920 - RNA, 19 nt, Homo sapiens
aaaugcaucuucagcuuug

SEQ ID NO: 1207921 - RNA, 19 nt, Homo sapiens
agaaaugcaucuucagcuu

SEQ ID NO: 1207922 - RNA, 19 nt, Homo sapiens
gugaauauauugccaccau

SEQ ID NO: 1207923 - RNA, 19 nt, Homo sapiens
ccacucaggguauugauga

SEQ ID NO: 1207924 - RNA, 19 nt, Homo sapiens
gagaggcccagugaauaua

SEQ ID NO: 1207925 - RNA, 19 nt, Homo sapiens
uuaccugccucaucgauau

SEQ ID NO: 1207926 - RNA, 19 nt, Homo sapiens
ucaacauccugaaguccua

SEQ ID NO: 1207927 - RNA, 19 nt, Homo sapiens
gagaaaagaagccagcaua

SEQ ID NO: 1207928 - RNA, 19 nt, Homo sapiens
ccauugcacccaaggauaa

SEQ ID NO: 1207929 - RNA, 19 nt, Homo sapiens
ggauuucauugaugugcuu

SEQ ID NO: 1207930 - RNA, 19 nt, Homo sapiens
auccugaaguccuauauaa

SEQ ID NO: 1207931 - RNA, 19 nt, Homo sapiens
caaggauaaucucuucauc

SEQ ID NO: 1207932 - RNA, 19 nt, Homo sapiens
ucccagggcuuuacgguau

SEQ ID NO: 1207933 - RNA, 19 nt, Homo sapiens
caaacaucaugcuugacaa

SEQ ID NO: 1207934 - RNA, 19 nt, Homo sapiens
gaggcccagugaauauauu

SEQ ID NO: 1207935 - RNA, 19 nt, Homo sapiens
gacuuuggauuucauugau

SEQ ID NO: 1207936 - RNA, 19 nt, Homo sapiens
gaaggacucgacccagaug

SEQ ID NO: 1207937 - RNA, 19 nt, Homo sapiens
ugcagauugucaugaauaa

SEQ ID NO: 1207938 - RNA, 19 nt, Homo sapiens
ugaaggagagccugagguu

SEQ ID NO: 1207939 - RNA, 19 nt, Homo sapiens
gaauauauugccaccaucu

SEQ ID NO: 1207940 - RNA, 19 nt, Homo sapiens
caagagugcaaacaucaug

SEQ ID NO: 1207941 - RNA, 19 nt, Homo sapiens
acaagcugcucccgacaga

SEQ ID NO: 1207942 - RNA, 19 nt, Homo sapiens
cauccuggcuuggaccuau

SEQ ID NO: 1207943 - RNA, 19 nt, Homo sapiens
cucaggguauugaugauuu

SEQ ID NO: 1207944 - RNA, 19 nt, Homo sapiens
caggagaggcccagugaau

SEQ ID NO: 1207945 - RNA, 19 nt, Homo sapiens
ccuaugccuucuauaacaa

SEQ ID NO: 1207946 - RNA, 19 nt, Homo sapiens
gacaccauccggucuauca

SEQ ID NO: 1207947 - RNA, 19 nt, Homo sapiens
ggucaccucuggcuuuuau

SEQ ID NO: 1207948 - RNA, 19 nt, Homo sapiens
gcucagugcccuuguagag

SEQ ID NO: 1207949 - RNA, 19 nt, Homo sapiens
cagaggagggcuugaagga

SEQ ID NO: 1207950 - RNA, 19 nt, Homo sapiens
ggccggauccugaggucua

SEQ ID NO: 1207951 - RNA, 19 nt, Homo sapiens
ccgcgauccuaaagagauu

SEQ ID NO: 1207952 - RNA, 19 nt, Homo sapiens
gacaaagccaaguccaaga

SEQ ID NO: 1207953 - RNA, 19 nt, Homo sapiens
gaagaugggaaggcauugu

SEQ ID NO: 1207954 - RNA, 19 nt, Homo sapiens
gccauugcacccaaggaua

SEQ ID NO: 1207955 - RNA, 19 nt, Homo sapiens
gcagauugucaugaauaaa

SEQ ID NO: 1207956 - RNA, 19 nt, Homo sapiens
gaagcuggaauugaucaug

SEQ ID NO: 1207957 - RNA, 19 nt, Homo sapiens
ccagaugucggccaccuau

SEQ ID NO: 1207958 - RNA, 19 nt, Homo sapiens
cauccugaaguccuauaua

SEQ ID NO: 1207959 - RNA, 19 nt, Homo sapiens
ggcugacaccuucauguuu

SEQ ID NO: 1207960 - RNA, 19 nt, Homo sapiens
gauccuaaagagauugaau

SEQ ID NO: 1207961 - RNA, 19 nt, Homo sapiens
gaaaagaagccagcauauc

SEQ ID NO: 1207962 - RNA, 19 nt, Homo sapiens
uugcagauugucaugaaua

SEQ ID NO: 1207963 - RNA, 19 nt, Homo sapiens
agacuuuggauuucauuga

SEQ ID NO: 1207964 - RNA, 19 nt, Homo sapiens
aggauaaucucuucaucag

SEQ ID NO: 1207965 - RNA, 19 nt, Homo sapiens
ucuccuggguccuguacaa

SEQ ID NO: 1207966 - RNA, 19 nt, Homo sapiens
cuacagaggagggcuugaa

SEQ ID NO: 1207967 - RNA, 19 nt, Homo sapiens
cauccggucuaucaccaau

SEQ ID NO: 1207968 - RNA, 19 nt, Homo sapiens
uugcgaggcacccagaaua

SEQ ID NO: 1207969 - RNA, 19 nt, Homo sapiens
auugucagaugaggauaua

SEQ ID NO: 1207970 - RNA, 19 nt, Homo sapiens
aggagaggcccagugaaua

SEQ ID NO: 1207971 - RNA, 19 nt, Homo sapiens
ucaacaagagugcaaacau

SEQ ID NO: 1207972 - RNA, 19 nt, Homo sapiens
ccaaggauaaucucuucau

SEQ ID NO: 1207973 - RNA, 19 nt, Homo sapiens
ucaaagacaaagccaaguc

SEQ ID NO: 1207974 - RNA, 19 nt, Homo sapiens
gagcucagugcccuuguag

SEQ ID NO: 1207975 - RNA, 19 nt, Homo sapiens
gaccuaugccuucuauaac

SEQ ID NO: 1207976 - RNA, 19 nt, Homo sapiens
acccaaggauaaucucuuc

SEQ ID NO: 1207977 - RNA, 19 nt, Homo sapiens
aaggagagccugagguuac

SEQ ID NO: 1207978 - RNA, 19 nt, Homo sapiens
cugaaguccuauauaacga

SEQ ID NO: 1207979 - RNA, 19 nt, Homo sapiens
gacauuguucucccagaug

SEQ ID NO: 1207980 - RNA, 19 nt, Homo sapiens
gucaggagaggcccaguga

SEQ ID NO: 1207981 - RNA, 19 nt, Homo sapiens
aaggauaaucucuucauca

SEQ ID NO: 1207982 - RNA, 19 nt, Homo sapiens
gcugagcaaggaugaagau

SEQ ID NO: 1207983 - RNA, 19 nt, Homo sapiens
gaauaaaacggugcuguca

SEQ ID NO: 1207984 - RNA, 19 nt, Homo sapiens
gaggugcaagagcuucuga

SEQ ID NO: 1207985 - RNA, 19 nt, Homo sapiens
caagacuuuggauuucauu

SEQ ID NO: 1207986 - RNA, 19 nt, Homo sapiens
cgccuuccauuucaacauc

SEQ ID NO: 1207987 - RNA, 19 nt, Homo sapiens
accuaugccuucuauaaca

SEQ ID NO: 1207988 - RNA, 19 nt, Homo sapiens
gcacccaggacauuguucu

SEQ ID NO: 1207989 - RNA, 19 nt, Homo sapiens
gaggcugacaccuucaugu

SEQ ID NO: 1207990 - RNA, 19 nt, Homo sapiens
ugccucagcugccauugca

SEQ ID NO: 1207991 - RNA, 19 nt, Homo sapiens
caaagacgcugcuggagaa

SEQ ID NO: 1207992 - RNA, 19 nt, Homo sapiens
gggcucaacuucuauggua

SEQ ID NO: 1207993 - RNA, 19 nt, Homo sapiens
ggacuggacuuacgaugau

SEQ ID NO: 1207994 - RNA, 19 nt, Homo sapiens
ggacagcucugcccagcau

SEQ ID NO: 1207995 - RNA, 19 nt, Homo sapiens
gggcauagguggguacaug

SEQ ID NO: 1207996 - RNA, 19 nt, Homo sapiens
ggaggcacgucgucuucua

SEQ ID NO: 1207997 - RNA, 19 nt, Homo sapiens
ggcacuggguucugguuua

SEQ ID NO: 1207998 - RNA, 19 nt, Homo sapiens
gggcgucccucacucagaa

SEQ ID NO: 1207999 - RNA, 19 nt, Homo sapiens
cagauaagccggugcaaga

SEQ ID NO: 1208000 - RNA, 19 nt, Homo sapiens
gaauuuggaggcaucauga

SEQ ID NO: 1208001 - RNA, 19 nt, Homo sapiens
ggagcaaguucacacagau

SEQ ID NO: 1208002 - RNA, 19 nt, Homo sapiens
gagcaggugugaaauacag

SEQ ID NO: 1208003 - RNA, 19 nt, Homo sapiens
gcaaagaaccagcauuucg

SEQ ID NO: 1208004 - RNA, 19 nt, Homo sapiens
gggagcaaguucacacaga

SEQ ID NO: 1208005 - RNA, 19 nt, Homo sapiens
gaggaacgcugggcaacau

SEQ ID NO: 1208006 - RNA, 19 nt, Homo sapiens
gcacuggguucugguuuag

SEQ ID NO: 1208007 - RNA, 19 nt, Homo sapiens
ugagugagcaggugugaaa

SEQ ID NO: 1208008 - RNA, 19 nt, Homo sapiens
ccaagggccugcacauagu

SEQ ID NO: 1208009 - RNA, 19 nt, Homo sapiens
cagagcacuucuucgagua

SEQ ID NO: 1208010 - RNA, 19 nt, Homo sapiens
caaagaaccagcauuucga

SEQ ID NO: 1208011 - RNA, 19 nt, Homo sapiens
acacuacccugucaaaguc

SEQ ID NO: 1208012 - RNA, 19 nt, Homo sapiens
uggcaaagaaccagcauuu

SEQ ID NO: 1208013 - RNA, 19 nt, Homo sapiens
gggcauaggagauacaagu

SEQ ID NO: 1208014 - RNA, 19 nt, Homo sapiens
agacagugaggaugagaua

SEQ ID NO: 1208015 - RNA, 19 nt, Homo sapiens
ggaauuuggaggcaucaug

SEQ ID NO: 1208016 - RNA, 19 nt, Homo sapiens
gccaagggccugcacauag

SEQ ID NO: 1208017 - RNA, 19 nt, Homo sapiens
gcuacgaugucaccaaggu

SEQ ID NO: 1208018 - RNA, 19 nt, Homo sapiens
gggauguacugggcuaugu

SEQ ID NO: 1208019 - RNA, 19 nt, Homo sapiens
gcaucagccuggcccuaau

SEQ ID NO: 1208020 - RNA, 19 nt, Homo sapiens
ggagauacaaguggugugu

SEQ ID NO: 1208021 - RNA, 19 nt, Homo sapiens
ccagguacauccagacacu

SEQ ID NO: 1208022 - RNA, 19 nt, Homo sapiens
uagaggagcugagcaagac

SEQ ID NO: 1208023 - RNA, 19 nt, Homo sapiens
ccuguaaucccaguacuuu

SEQ ID NO: 1208024 - RNA, 19 nt, Homo sapiens
gacacgggcauaggagaua

SEQ ID NO: 1208025 - RNA, 19 nt, Homo sapiens
gugagcaggugugaaauac

SEQ ID NO: 1208026 - RNA, 19 nt, Homo sapiens
ccucagagcacuucuucga

SEQ ID NO: 1208027 - RNA, 19 nt, Homo sapiens
gaugguuucagccucauga

SEQ ID NO: 1208028 - RNA, 19 nt, Homo sapiens
ugccucggcuccuguuuga

SEQ ID NO: 1208029 - RNA, 19 nt, Homo sapiens
gguuuagagucaguaaugu

SEQ ID NO: 1208030 - RNA, 19 nt, Homo sapiens
gggaggcccuggggaauuu

SEQ ID NO: 1208031 - RNA, 19 nt, Homo sapiens
gguggugacggaccucaaa

SEQ ID NO: 1208032 - RNA, 19 nt, Homo sapiens
cccuagaaauggacucaga

SEQ ID NO: 1208033 - RNA, 19 nt, Homo sapiens
ucuaagccauggagugagu

SEQ ID NO: 1208034 - RNA, 19 nt, Homo sapiens
gagcacuucuucgaguaca

SEQ ID NO: 1208035 - RNA, 19 nt, Homo sapiens
gcucaacuucuaugguaug

SEQ ID NO: 1208036 - RNA, 19 nt, Homo sapiens
guuucagccucaugaccua

SEQ ID NO: 1208037 - RNA, 19 nt, Homo sapiens
acagugaggaugagauaga

SEQ ID NO: 1208038 - RNA, 19 nt, Homo sapiens
aagagucaguuuucagaua

SEQ ID NO: 1208039 - RNA, 19 nt, Homo sapiens
ggagaagagucaguuuuca

SEQ ID NO: 1208040 - RNA, 19 nt, Homo sapiens
ucacgcacaaggaguuuga

SEQ ID NO: 1208041 - RNA, 19 nt, Homo sapiens
agagucaguuuucagauaa

SEQ ID NO: 1208042 - RNA, 19 nt, Homo sapiens
cugagagugugguucuuga

SEQ ID NO: 1208043 - RNA, 19 nt, Homo sapiens
gucaaagucagaugccaaa

SEQ ID NO: 1208044 - RNA, 19 nt, Homo sapiens
gcagcccuguucacacuac

SEQ ID NO: 1208045 - RNA, 19 nt, Homo sapiens
ccacaugcucacccacuug

SEQ ID NO: 1208046 - RNA, 19 nt, Homo sapiens
caaguucacacagaucuca

SEQ ID NO: 1208047 - RNA, 19 nt, Homo sapiens
ggauguggguuuggaagcu

SEQ ID NO: 1208048 - RNA, 19 nt, Homo sapiens
gaccuacgacuacucuaca

SEQ ID NO: 1208049 - RNA, 19 nt, Homo sapiens
gagugugguucuugagcau

SEQ ID NO: 1208050 - RNA, 19 nt, Homo sapiens
gcugagagugugguucuug

SEQ ID NO: 1208051 - RNA, 19 nt, Homo sapiens
ggcccacccucuugaaacu

SEQ ID NO: 1208052 - RNA, 19 nt, Homo sapiens
agacgcugcuggagaagag

SEQ ID NO: 1208053 - RNA, 19 nt, Homo sapiens
ccucaugaccuacgacuac

SEQ ID NO: 1208054 - RNA, 19 nt, Homo sapiens
gauguacugggcuauguca

SEQ ID NO: 1208055 - RNA, 19 nt, Homo sapiens
agugagcaggugugaaaua

SEQ ID NO: 1208056 - RNA, 19 nt, Homo sapiens
guuggacccuacugugaca

SEQ ID NO: 1208057 - RNA, 19 nt, Homo sapiens
ccgaccagcugggcauguu

SEQ ID NO: 1208058 - RNA, 19 nt, Homo sapiens
cacacuacccugucaaagu

SEQ ID NO: 1208059 - RNA, 19 nt, Homo sapiens
gagcaaguucacacagauc

SEQ ID NO: 1208060 - RNA, 19 nt, Homo sapiens
ggaggaacgcugggcaaca

SEQ ID NO: 1208061 - RNA, 19 nt, Homo sapiens
gcuaugucacuccauggaa

SEQ ID NO: 1208062 - RNA, 19 nt, Homo sapiens
gggcacuggguucugguuu

SEQ ID NO: 1208063 - RNA, 19 nt, Homo sapiens
gguccugggcaccauguga

SEQ ID NO: 1208064 - RNA, 19 nt, Homo sapiens
guuuagagucaguaauguu

SEQ ID NO: 1208065 - RNA, 19 nt, Homo sapiens
ggguucugguuuagaguca

SEQ ID NO: 1208066 - RNA, 19 nt, Homo sapiens
gcuggagaagagucaguuu

SEQ ID NO: 1208067 - RNA, 19 nt, Homo sapiens
cugcagcccuguucacacu

SEQ ID NO: 1208068 - RNA, 19 nt, Homo sapiens
guacauccagacacugaag

SEQ ID NO: 1208069 - RNA, 19 nt, Homo sapiens
ugauuuccggaacgucuua

SEQ ID NO: 1208070 - RNA, 19 nt, Homo sapiens
agacguggccgugagaugu

SEQ ID NO: 1208071 - RNA, 19 nt, Homo sapiens
guaaucccaguacuuugga

SEQ ID NO: 1208072 - RNA, 19 nt, Homo sapiens
gcauguucacgcacaagga

SEQ ID NO: 1208073 - RNA, 19 nt, Homo sapiens
aaagaaccagcauuucgau

SEQ ID NO: 1208074 - RNA, 19 nt, Homo sapiens
gacguggccgugagauguu

SEQ ID NO: 1208075 - RNA, 19 nt, Homo sapiens
gagacguggccgugagaug

SEQ ID NO: 1208076 - RNA, 19 nt, Homo sapiens
ugagauggcuuauauguuu

SEQ ID NO: 1208077 - RNA, 19 nt, Homo sapiens
caacaugaaugcaguggua

SEQ ID NO: 1208078 - RNA, 19 nt, Homo sapiens
gugaugagcugauucgaua

SEQ ID NO: 1208079 - RNA, 19 nt, Homo sapiens
gcucagauguccagaauga

SEQ ID NO: 1208080 - RNA, 19 nt, Homo sapiens
ggauagauaugcacugaaa

SEQ ID NO: 1208081 - RNA, 19 nt, Homo sapiens
cagaaugacugaagaauug

SEQ ID NO: 1208082 - RNA, 19 nt, Homo sapiens
ggaacucgcugcucgaauu

SEQ ID NO: 1208083 - RNA, 19 nt, Homo sapiens
gaacaacuaccacaguaua

SEQ ID NO: 1208084 - RNA, 19 nt, Homo sapiens
gaaagaaguagaucuguuu

SEQ ID NO: 1208085 - RNA, 19 nt, Homo sapiens
uaaauaaccuuaggcauga

SEQ ID NO: 1208086 - RNA, 19 nt, Homo sapiens
ugaggaaucuucucucuuu

SEQ ID NO: 1208087 - RNA, 19 nt, Homo sapiens
aaacacaucugccuucuug

SEQ ID NO: 1208088 - RNA, 19 nt, Homo sapiens
gaagaaucccugcuguuua

SEQ ID NO: 1208089 - RNA, 19 nt, Homo sapiens
gaauauaagugucccugaa

SEQ ID NO: 1208090 - RNA, 19 nt, Homo sapiens
gcugauuccucccaauuua

SEQ ID NO: 1208091 - RNA, 19 nt, Homo sapiens
ggaaagaaguagaucuguu

SEQ ID NO: 1208092 - RNA, 19 nt, Homo sapiens
gaagugcaaucaauaggaa

SEQ ID NO: 1208093 - RNA, 19 nt, Homo sapiens
caacagcagugcaguguga

SEQ ID NO: 1208094 - RNA, 19 nt, Homo sapiens
caagaaagaugaguuacuu

SEQ ID NO: 1208095 - RNA, 19 nt, Homo sapiens
gaagaaaaccucaugaaua

SEQ ID NO: 1208096 - RNA, 19 nt, Homo sapiens
gaccaggugucauuacuaa

SEQ ID NO: 1208097 - RNA, 19 nt, Homo sapiens
gauaugcacugaaacaugu

SEQ ID NO: 1208098 - RNA, 19 nt, Homo sapiens
ggaaucuucucucuuuaaa

SEQ ID NO: 1208099 - RNA, 19 nt, Homo sapiens
ggaaccauaucuuaucuga

SEQ ID NO: 1208100 - RNA, 19 nt, Homo sapiens
gaucccaaaucuuauguaa

SEQ ID NO: 1208101 - RNA, 19 nt, Homo sapiens
cagaaacuguuaccuauga

SEQ ID NO: 1208102 - RNA, 19 nt, Homo sapiens
ucaaggaacuggaagaaga

SEQ ID NO: 1208103 - RNA, 19 nt, Homo sapiens
gaagagacuuuccguuaca

SEQ ID NO: 1208104 - RNA, 19 nt, Homo sapiens
caauggagcugcacgaguu

SEQ ID NO: 1208105 - RNA, 19 nt, Homo sapiens
ggagauguauggcuugaga

SEQ ID NO: 1208106 - RNA, 19 nt, Homo sapiens
gaaauaaaggaacuucgua

SEQ ID NO: 1208107 - RNA, 19 nt, Homo sapiens
aagaaucccugcuguuuaa

SEQ ID NO: 1208108 - RNA, 19 nt, Homo sapiens
gggcaggcauuaaauagaa

SEQ ID NO: 1208109 - RNA, 19 nt, Homo sapiens
ucaauagaguguagaguuu

SEQ ID NO: 1208110 - RNA, 19 nt, Homo sapiens
ggaaguagcgguagcaguu

SEQ ID NO: 1208111 - RNA, 19 nt, Homo sapiens
gaagagugaugagcugauu

SEQ ID NO: 1208112 - RNA, 19 nt, Homo sapiens
gaaaggauccugcaugagu

SEQ ID NO: 1208113 - RNA, 19 nt, Homo sapiens
ggaauuagggaauguugua

SEQ ID NO: 1208114 - RNA, 19 nt, Homo sapiens
gaacuugcuggcacauuua

SEQ ID NO: 1208115 - RNA, 19 nt, Homo sapiens
gcaaacagaggacaaauca

SEQ ID NO: 1208116 - RNA, 19 nt, Homo sapiens
uuaaucagcugcagcauga

SEQ ID NO: 1208117 - RNA, 19 nt, Homo sapiens
caaauaagcauaucugauc

SEQ ID NO: 1208118 - RNA, 19 nt, Homo sapiens
ccaaauaccacucaauuau

SEQ ID NO: 1208119 - RNA, 19 nt, Homo sapiens
caagggaggaaauaaguua

SEQ ID NO: 1208120 - RNA, 19 nt, Homo sapiens
gaagauggucucucccuuu

SEQ ID NO: 1208121 - RNA, 19 nt, Homo sapiens
gcuaagaaauggaaagaag

SEQ ID NO: 1208122 - RNA, 19 nt, Homo sapiens
uaaaggaacuucguaguag

SEQ ID NO: 1208123 - RNA, 19 nt, Homo sapiens
gaagaaagugaaacugauu

SEQ ID NO: 1208124 - RNA, 19 nt, Homo sapiens
ggacaagccuuugaucaag

SEQ ID NO: 1208125 - RNA, 19 nt, Homo sapiens
uaaagaacuucgugaaaca

SEQ ID NO: 1208126 - RNA, 19 nt, Homo sapiens
gagaaaaucugucuaaaag

SEQ ID NO: 1208127 - RNA, 19 nt, Homo sapiens
acucaaagcuuguuaucuu

SEQ ID NO: 1208128 - RNA, 19 nt, Homo sapiens
gcacgcaguucagaaagaa

SEQ ID NO: 1208129 - RNA, 19 nt, Homo sapiens
ugaacuugcuggcacauuu

SEQ ID NO: 1208130 - RNA, 19 nt, Homo sapiens
ggacuaaggaggaaucaga

SEQ ID NO: 1208131 - RNA, 19 nt, Homo sapiens
gaggaaucuucucucuuua

SEQ ID NO: 1208132 - RNA, 19 nt, Homo sapiens
ugaaacaaaugcucagaug

SEQ ID NO: 1208133 - RNA, 19 nt, Homo sapiens
caggaaacaucaggaagua

SEQ ID NO: 1208134 - RNA, 19 nt, Homo sapiens
caaaagacaugauagagaa

SEQ ID NO: 1208135 - RNA, 19 nt, Homo sapiens
ggucuggucugacuugaga

SEQ ID NO: 1208136 - RNA, 19 nt, Homo sapiens
caaguuagcacaugaagga

SEQ ID NO: 1208137 - RNA, 19 nt, Homo sapiens
caaugaguccuuuagcuua

SEQ ID NO: 1208138 - RNA, 19 nt, Homo sapiens
auagugagauggcuuauau

SEQ ID NO: 1208139 - RNA, 19 nt, Homo sapiens
gcacaugaaggauagauau

SEQ ID NO: 1208140 - RNA, 19 nt, Homo sapiens
gaucacaaacucuguauca

SEQ ID NO: 1208141 - RNA, 19 nt, Homo sapiens
aaagaugaguuacuucgaa

SEQ ID NO: 1208142 - RNA, 19 nt, Homo sapiens
aagaaaggauccugcauga

SEQ ID NO: 1208143 - RNA, 19 nt, Homo sapiens
caccaccuguagaauauua

SEQ ID NO: 1208144 - RNA, 19 nt, Homo sapiens
gaagaauuggagccuaaua

SEQ ID NO: 1208145 - RNA, 19 nt, Homo sapiens
gcaauugggacaagccuuu

SEQ ID NO: 1208146 - RNA, 19 nt, Homo sapiens
aagaacaacuaccacagua

SEQ ID NO: 1208147 - RNA, 19 nt, Homo sapiens
ugaauggcuugauggauuu

SEQ ID NO: 1208148 - RNA, 19 nt, Homo sapiens
aaauucagguagcaguuua

SEQ ID NO: 1208149 - RNA, 19 nt, Homo sapiens
guacaguagccaaggaaua

SEQ ID NO: 1208150 - RNA, 19 nt, Homo sapiens
auacagagauacugaacuu

SEQ ID NO: 1208151 - RNA, 19 nt, Homo sapiens
gaauggaggaauggaaaua

SEQ ID NO: 1208152 - RNA, 19 nt, Homo sapiens
gaaaaggaauguugcacaa

SEQ ID NO: 1208153 - RNA, 19 nt, Homo sapiens
gaagaauugucagggaaga

SEQ ID NO: 1208154 - RNA, 19 nt, Homo sapiens
gacacucucuuucuauaug

SEQ ID NO: 1208155 - RNA, 19 nt, Homo sapiens
aagaagaauuggagccuaa

SEQ ID NO: 1208156 - RNA, 19 nt, Homo sapiens
gagaguaguacaacguuaa

SEQ ID NO: 1208157 - RNA, 19 nt, Homo sapiens
gaaauggaaagaaguagau

SEQ ID NO: 1208158 - RNA, 19 nt, Homo sapiens
ugacacaggcuaagaaaug

SEQ ID NO: 1208159 - RNA, 19 nt, Homo sapiens
ccaaagugcgcuaugcaua

SEQ ID NO: 1208160 - RNA, 19 nt, Homo sapiens
gcucuggguucccuucauu

SEQ ID NO: 1208161 - RNA, 19 nt, Homo sapiens
ccaggacccucaggagaua

SEQ ID NO: 1208162 - RNA, 19 nt, Homo sapiens
cagaagcggguauuugaua

SEQ ID NO: 1208163 - RNA, 19 nt, Homo sapiens
cagcgacuguguuaaagaa

SEQ ID NO: 1208164 - RNA, 19 nt, Homo sapiens
gaaacugauuccagcuguu

SEQ ID NO: 1208165 - RNA, 19 nt, Homo sapiens
cugaagagacuuuccguua

SEQ ID NO: 1208166 - RNA, 19 nt, Homo sapiens
guaguacaacguuaaauug

SEQ ID NO: 1208167 - RNA, 19 nt, Homo sapiens
gugaguaaauugaaaccaa

SEQ ID NO: 1208168 - RNA, 19 nt, Homo sapiens
gaggaagucgggcaaauug

SEQ ID NO: 1208169 - RNA, 19 nt, Homo sapiens
gcagaaauugguccucaaa

SEQ ID NO: 1208170 - RNA, 19 nt, Homo sapiens
gagcuuggccaaacuucua

SEQ ID NO: 1208171 - RNA, 19 nt, Homo sapiens
caacacggcugugaauucu

SEQ ID NO: 1208172 - RNA, 19 nt, Homo sapiens
ggacaaaucacuccugaac

SEQ ID NO: 1208173 - RNA, 19 nt, Homo sapiens
caacagaagcggguauuug

SEQ ID NO: 1208174 - RNA, 19 nt, Homo sapiens
gaauauggagugucuagga

SEQ ID NO: 1208175 - RNA, 19 nt, Homo sapiens
aaacaugaguagcuugaau

SEQ ID NO: 1208176 - RNA, 19 nt, Homo sapiens
caagagaucuccaaggaau

SEQ ID NO: 1208177 - RNA, 19 nt, Homo sapiens
ggcaagaccuuccaagaga

SEQ ID NO: 1208178 - RNA, 19 nt, Homo sapiens
ggaggagccuggagguuau

SEQ ID NO: 1208179 - RNA, 19 nt, Homo sapiens
ucacggcgguuguuaguug

SEQ ID NO: 1208180 - RNA, 19 nt, Homo sapiens
gcuauaaccucucuaucau

SEQ ID NO: 1208181 - RNA, 19 nt, Homo sapiens
gagaugagcuuggggcuua

SEQ ID NO: 1208182 - RNA, 19 nt, Homo sapiens
gaugagagcgcuccgaaga

SEQ ID NO: 1208183 - RNA, 19 nt, Homo sapiens
caucugcgcugccggcauu

SEQ ID NO: 1208184 - RNA, 19 nt, Homo sapiens
uauaaccucucuaucauca

SEQ ID NO: 1208185 - RNA, 19 nt, Homo sapiens
gaaaccagccuagguaaca

SEQ ID NO: 1208186 - RNA, 19 nt, Homo sapiens
caucuacacuggccuguuc

SEQ ID NO: 1208187 - RNA, 19 nt, Homo sapiens
uaaccucucuaucaucaau

SEQ ID NO: 1208188 - RNA, 19 nt, Homo sapiens
gcaagaccuuccaagagau

SEQ ID NO: 1208189 - RNA, 19 nt, Homo sapiens
gagagccacugcccgauca

SEQ ID NO: 1208190 - RNA, 19 nt, Homo sapiens
gcaggucccuuggccauca

SEQ ID NO: 1208191 - RNA, 19 nt, Homo sapiens
gaucaccuaguccugcuua

SEQ ID NO: 1208192 - RNA, 19 nt, Homo sapiens
uccaagagaucuccaagga

SEQ ID NO: 1208193 - RNA, 19 nt, Homo sapiens
acagaacucuagucccaaa

SEQ ID NO: 1208194 - RNA, 19 nt, Homo sapiens
gccauggccugcaucuuug

SEQ ID NO: 1208195 - RNA, 19 nt, Homo sapiens
ggaauucaccaaugagaca

SEQ ID NO: 1208196 - RNA, 19 nt, Homo sapiens
agagaucuccaaggaauua

SEQ ID NO: 1208197 - RNA, 19 nt, Homo sapiens
uaacaucuuugugguguca

SEQ ID NO: 1208198 - RNA, 19 nt, Homo sapiens
gguaauuaacugacagaaa

SEQ ID NO: 1208199 - RNA, 19 nt, Homo sapiens
ugacaagccucgugguucu

SEQ ID NO: 1208200 - RNA, 19 nt, Homo sapiens
cagccuagguaacauagug

SEQ ID NO: 1208201 - RNA, 19 nt, Homo sapiens
agaagucccuccuggugaa

SEQ ID NO: 1208202 - RNA, 19 nt, Homo sapiens
guuguuaguugugugguaa

SEQ ID NO: 1208203 - RNA, 19 nt, Homo sapiens
caaggugggaggaucaauu

SEQ ID NO: 1208204 - RNA, 19 nt, Homo sapiens
gcaggcuccuuugagauga

SEQ ID NO: 1208205 - RNA, 19 nt, Homo sapiens
ggcuauaaccucucuauca

SEQ ID NO: 1208206 - RNA, 19 nt, Homo sapiens
caugagcucagccaucuuu

SEQ ID NO: 1208207 - RNA, 19 nt, Homo sapiens
ggcuaaagguaauuaacug

SEQ ID NO: 1208208 - RNA, 19 nt, Homo sapiens
ccuccugcauuccucauuu

SEQ ID NO: 1208209 - RNA, 19 nt, Homo sapiens
gccaugagcucagccaucu

SEQ ID NO: 1208210 - RNA, 19 nt, Homo sapiens
cagcagcaauccuguuugg

SEQ ID NO: 1208211 - RNA, 19 nt, Homo sapiens
gcuaaagguaauuaacuga

SEQ ID NO: 1208212 - RNA, 19 nt, Homo sapiens
uggaggagccuggagguua

SEQ ID NO: 1208213 - RNA, 19 nt, Homo sapiens
ccuggugaauaacaucuuu

SEQ ID NO: 1208214 - RNA, 19 nt, Homo sapiens
ucaauugaggccagaguuu

SEQ ID NO: 1208215 - RNA, 19 nt, Homo sapiens
ggaauuacacagacucaac

SEQ ID NO: 1208216 - RNA, 19 nt, Homo sapiens
uguggcagcucaugacugu

SEQ ID NO: 1208217 - RNA, 19 nt, Homo sapiens
guaaggagugagcggcuuu

SEQ ID NO: 1208218 - RNA, 19 nt, Homo sapiens
gguuguuaguuguguggua

SEQ ID NO: 1208219 - RNA, 19 nt, Homo sapiens
gaacuggagccguccuuac

SEQ ID NO: 1208220 - RNA, 19 nt, Homo sapiens
uggcagcucaugacuguaa

SEQ ID NO: 1208221 - RNA, 19 nt, Homo sapiens
agaggcggauggaggauga

SEQ ID NO: 1208222 - RNA, 19 nt, Homo sapiens
cggaagcgaagauccagua

SEQ ID NO: 1208223 - RNA, 19 nt, Homo sapiens
gaggagcuguggccaugag

SEQ ID NO: 1208224 - RNA, 19 nt, Homo sapiens
cuccugcauuccucauuua

SEQ ID NO: 1208225 - RNA, 19 nt, Homo sapiens
gcccaggacgcacagauga

SEQ ID NO: 1208226 - RNA, 19 nt, Homo sapiens
caauugaggccagaguuug

SEQ ID NO: 1208227 - RNA, 19 nt, Homo sapiens
cgcgcuaccuccucauuga

SEQ ID NO: 1208228 - RNA, 19 nt, Homo sapiens
gaauuacacagacucaacu

SEQ ID NO: 1208229 - RNA, 19 nt, Homo sapiens
ccaaggaauuacacagacu

SEQ ID NO: 1208230 - RNA, 19 nt, Homo sapiens
caccuaguccugcuuaugu

SEQ ID NO: 1208231 - RNA, 19 nt, Homo sapiens
uucaggaauucaccaauga

SEQ ID NO: 1208232 - RNA, 19 nt, Homo sapiens
ugagagcgcuccgaagacu

SEQ ID NO: 1208233 - RNA, 19 nt, Homo sapiens
ccaagagaucuccaaggaa

SEQ ID NO: 1208234 - RNA, 19 nt, Homo sapiens
ccaucacgcugggaaggaa

SEQ ID NO: 1208235 - RNA, 19 nt, Homo sapiens
ccagucaacagaacucuag

SEQ ID NO: 1208236 - RNA, 19 nt, Homo sapiens
gagguuauccagucaacag

SEQ ID NO: 1208237 - RNA, 19 nt, Homo sapiens
ggugacaagccucgugguu

SEQ ID NO: 1208238 - RNA, 19 nt, Homo sapiens
ggacagguggucggacuca

SEQ ID NO: 1208239 - RNA, 19 nt, Homo sapiens
uuugaaaccagccuaggua

SEQ ID NO: 1208240 - RNA, 19 nt, Homo sapiens
cugcauuccucauuuaagg

SEQ ID NO: 1208241 - RNA, 19 nt, Homo sapiens
gcucacggcgguuguuagu

SEQ ID NO: 1208242 - RNA, 19 nt, Homo sapiens
gucagcagcaauccuguuu

SEQ ID NO: 1208243 - RNA, 19 nt, Homo sapiens
gacagaaaaucaguaacaa

SEQ ID NO: 1208244 - RNA, 19 nt, Homo sapiens
ccucauuuaaggaguguuu

SEQ ID NO: 1208245 - RNA, 19 nt, Homo sapiens
gcgggaaugacucggugua

SEQ ID NO: 1208246 - RNA, 19 nt, Homo sapiens
gauuucccuuuaucaugga

SEQ ID NO: 1208247 - RNA, 19 nt, Homo sapiens
gcaggugugagcaugaaca

SEQ ID NO: 1208248 - RNA, 19 nt, Homo sapiens
agucccuccuggugaauaa

SEQ ID NO: 1208249 - RNA, 19 nt, Homo sapiens
uuaguugugugguaaucga

SEQ ID NO: 1208250 - RNA, 19 nt, Homo sapiens
gagcucagccaucuuuacg

SEQ ID NO: 1208251 - RNA, 19 nt, Homo sapiens
gaccuugcacauucaggaa

SEQ ID NO: 1208252 - RNA, 19 nt, Homo sapiens
ugaacuggagccguccuua

SEQ ID NO: 1208253 - RNA, 19 nt, Homo sapiens
gcggauggaggaugaacug

SEQ ID NO: 1208254 - RNA, 19 nt, Homo sapiens
ccucaucgugucucuguau

SEQ ID NO: 1208255 - RNA, 19 nt, Homo sapiens
acuguaaucccagcacuuu

SEQ ID NO: 1208256 - RNA, 19 nt, Homo sapiens
ccaggacgcacagaugaga

SEQ ID NO: 1208257 - RNA, 19 nt, Homo sapiens
cuaugucccuuuccuuggu

SEQ ID NO: 1208258 - RNA, 19 nt, Homo sapiens
cgaagacugagaugagcuu

SEQ ID NO: 1208259 - RNA, 19 nt, Homo sapiens
caggaauucaccaaugaga

SEQ ID NO: 1208260 - RNA, 19 nt, Homo sapiens
aaaccagccuagguaacau

SEQ ID NO: 1208261 - RNA, 19 nt, Homo sapiens
aaggugggaggaucaauug

SEQ ID NO: 1208262 - RNA, 19 nt, Homo sapiens
gguuauccagucaacagaa

SEQ ID NO: 1208263 - RNA, 19 nt, Homo sapiens
gccacugcccgaucaccua

SEQ ID NO: 1208264 - RNA, 19 nt, Homo sapiens
ggauuuaagugcacuauua

SEQ ID NO: 1208265 - RNA, 19 nt, Homo sapiens
uaacgaagcugaaaucuau

SEQ ID NO: 1208266 - RNA, 19 nt, Homo sapiens
gaaugugacucuuggauuu

SEQ ID NO: 1208267 - RNA, 19 nt, Homo sapiens
ggaaggagcaucaauauug

SEQ ID NO: 1208268 - RNA, 19 nt, Homo sapiens
gcacagauggcuaguguua

SEQ ID NO: 1208269 - RNA, 19 nt, Homo sapiens
gaccuaguauucuaaguua

SEQ ID NO: 1208270 - RNA, 19 nt, Homo sapiens
gcaagaauuugaacucuau

SEQ ID NO: 1208271 - RNA, 19 nt, Homo sapiens
guaagucuguguaacauuu

SEQ ID NO: 1208272 - RNA, 19 nt, Homo sapiens
uaaaguaggucaucagguu

SEQ ID NO: 1208273 - RNA, 19 nt, Homo sapiens
gaagguagcuacauuucga

SEQ ID NO: 1208274 - RNA, 19 nt, Homo sapiens
gcugaaaucuauucucauu

SEQ ID NO: 1208275 - RNA, 19 nt, Homo sapiens
ccagugagcugaguaaauu

SEQ ID NO: 1208276 - RNA, 19 nt, Homo sapiens
gaggaaugcuugaauauag

SEQ ID NO: 1208277 - RNA, 19 nt, Homo sapiens
gaauauagccaguuccauu

SEQ ID NO: 1208278 - RNA, 19 nt, Homo sapiens
gcacugcccuugucuaaag

SEQ ID NO: 1208279 - RNA, 19 nt, Homo sapiens
gaacauuucugggcaacaa

SEQ ID NO: 1208280 - RNA, 19 nt, Homo sapiens
gcagauccuucgucaguuu

SEQ ID NO: 1208281 - RNA, 19 nt, Homo sapiens
gcacacacacauauacaua

SEQ ID NO: 1208282 - RNA, 19 nt, Homo sapiens
ucagagaacuuuccagguu

SEQ ID NO: 1208283 - RNA, 19 nt, Homo sapiens
gaagaaagcaagcagaaau

SEQ ID NO: 1208284 - RNA, 19 nt, Homo sapiens
ggcaggaccuuucaauaaa

SEQ ID NO: 1208285 - RNA, 19 nt, Homo sapiens
gcaaggagcauaagagaug

SEQ ID NO: 1208286 - RNA, 19 nt, Homo sapiens
gaaauguccaucuuaguuu

SEQ ID NO: 1208287 - RNA, 19 nt, Homo sapiens
gaugagaguuuacugacuu

SEQ ID NO: 1208288 - RNA, 19 nt, Homo sapiens
gaagaaaugguuaacauca

SEQ ID NO: 1208289 - RNA, 19 nt, Homo sapiens
gaaauucuaggacuggaua

SEQ ID NO: 1208290 - RNA, 19 nt, Homo sapiens
gaacguggcucagcaaacu

SEQ ID NO: 1208291 - RNA, 19 nt, Homo sapiens
ggaugaagcauaugaagaa

SEQ ID NO: 1208292 - RNA, 19 nt, Homo sapiens
ccaauuuaguggaagauaa

SEQ ID NO: 1208293 - RNA, 19 nt, Homo sapiens
gaaaacccaugucuacuaa

SEQ ID NO: 1208294 - RNA, 19 nt, Homo sapiens
ucuggaagcuuugaaauuu

SEQ ID NO: 1208295 - RNA, 19 nt, Homo sapiens
agggauagcuguuugaauu

SEQ ID NO: 1208296 - RNA, 19 nt, Homo sapiens
ggcaauaguuacaauaguu

SEQ ID NO: 1208297 - RNA, 19 nt, Homo sapiens
auaaggauccucagauuua

SEQ ID NO: 1208298 - RNA, 19 nt, Homo sapiens
ggagagcugccuuugauaa

SEQ ID NO: 1208299 - RNA, 19 nt, Homo sapiens
guaaugaccaaacacauaa

SEQ ID NO: 1208300 - RNA, 19 nt, Homo sapiens
acagauggcuaguguuaaa

SEQ ID NO: 1208301 - RNA, 19 nt, Homo sapiens
ccacauagauuagcuacug

SEQ ID NO: 1208302 - RNA, 19 nt, Homo sapiens
gaacuuugaggccugauuu

SEQ ID NO: 1208303 - RNA, 19 nt, Homo sapiens
uaacaggcauauaaggaaa

SEQ ID NO: 1208304 - RNA, 19 nt, Homo sapiens
ggaauuuguuacugauuga

SEQ ID NO: 1208305 - RNA, 19 nt, Homo sapiens
ucaaagagauucugacaac

SEQ ID NO: 1208306 - RNA, 19 nt, Homo sapiens
uagauuagcuacugcuuau

SEQ ID NO: 1208307 - RNA, 19 nt, Homo sapiens
ggacaauaauagacauuca

SEQ ID NO: 1208308 - RNA, 19 nt, Homo sapiens
gugcuuaccuggaugagaa

SEQ ID NO: 1208309 - RNA, 19 nt, Homo sapiens
uaaacacucugaccauaga

SEQ ID NO: 1208310 - RNA, 19 nt, Homo sapiens
gggacuauuuggugguuua

SEQ ID NO: 1208311 - RNA, 19 nt, Homo sapiens
ugaagcauaugaagaaaug

SEQ ID NO: 1208312 - RNA, 19 nt, Homo sapiens
ggucuaaggauuaacuaua

SEQ ID NO: 1208313 - RNA, 19 nt, Homo sapiens
gccugaaccuguuaucuaa

SEQ ID NO: 1208314 - RNA, 19 nt, Homo sapiens
acagaaguguuauuuggua

SEQ ID NO: 1208315 - RNA, 19 nt, Homo sapiens
aaacagugaugacuauuca

SEQ ID NO: 1208316 - RNA, 19 nt, Homo sapiens
ggaaggaggugcuagucau

SEQ ID NO: 1208317 - RNA, 19 nt, Homo sapiens
guauuuggaugaagcauau

SEQ ID NO: 1208318 - RNA, 19 nt, Homo sapiens
gaacagaaggaacugauuc

SEQ ID NO: 1208319 - RNA, 19 nt, Homo sapiens
gaagauggcuggcauuccu

SEQ ID NO: 1208320 - RNA, 19 nt, Homo sapiens
caguacaucugauaaaguu

SEQ ID NO: 1208321 - RNA, 19 nt, Homo sapiens
gcaggaccuuucaauaaau

SEQ ID NO: 1208322 - RNA, 19 nt, Homo sapiens
ggaggaaugcuugaauaua

SEQ ID NO: 1208323 - RNA, 19 nt, Homo sapiens
gcacugguuuauaugugua

SEQ ID NO: 1208324 - RNA, 19 nt, Homo sapiens
caaugaaagugaaagaugu

SEQ ID NO: 1208325 - RNA, 19 nt, Homo sapiens
caggagagcuuaaucaaac

SEQ ID NO: 1208326 - RNA, 19 nt, Homo sapiens
guacagguuuccauauugu

SEQ ID NO: 1208327 - RNA, 19 nt, Homo sapiens
cuaauaccaucuacacaaa

SEQ ID NO: 1208328 - RNA, 19 nt, Homo sapiens
gacauuugcuucacuuuua

SEQ ID NO: 1208329 - RNA, 19 nt, Homo sapiens
caaaguaauucugaugaga

SEQ ID NO: 1208330 - RNA, 19 nt, Homo sapiens
ggaguaauguuucguugca

SEQ ID NO: 1208331 - RNA, 19 nt, Homo sapiens
aaagcaagcagaaauagua

SEQ ID NO: 1208332 - RNA, 19 nt, Homo sapiens
gagcugccuuugauaaaug

SEQ ID NO: 1208333 - RNA, 19 nt, Homo sapiens
uggcagaacuggaaacaga

SEQ ID NO: 1208334 - RNA, 19 nt, Homo sapiens
ucaucagguucacuuauua

SEQ ID NO: 1208335 - RNA, 19 nt, Homo sapiens
guuaaacacuugaaugaag

SEQ ID NO: 1208336 - RNA, 19 nt, Homo sapiens
ccuccgauauuuacauuaa

SEQ ID NO: 1208337 - RNA, 19 nt, Homo sapiens
gauggcuaguguuaaauuu

SEQ ID NO: 1208338 - RNA, 19 nt, Homo sapiens
gguacagguuuccauauug

SEQ ID NO: 1208339 - RNA, 19 nt, Homo sapiens
cacagcaucuuccuuuaaa

SEQ ID NO: 1208340 - RNA, 19 nt, Homo sapiens
caggaccuuucaauaaaua

SEQ ID NO: 1208341 - RNA, 19 nt, Homo sapiens
cuacagaaguguuauuugg

SEQ ID NO: 1208342 - RNA, 19 nt, Homo sapiens
ccaccuacauuucuguuug

SEQ ID NO: 1208343 - RNA, 19 nt, Homo sapiens
uagaaacagugaugacuau

SEQ ID NO: 1208344 - RNA, 19 nt, Homo sapiens
uaagcuaugucaauaagga

SEQ ID NO: 1208345 - RNA, 19 nt, Homo sapiens
gaggacaguugcacagaug

SEQ ID NO: 1208346 - RNA, 19 nt, Homo sapiens
gagacccucugaaauucua

SEQ ID NO: 1208347 - RNA, 19 nt, Homo sapiens
gaaaugggcaauaguuaca

SEQ ID NO: 1208348 - RNA, 19 nt, Homo sapiens
gaccagaaaugggcaauag

SEQ ID NO: 1208349 - RNA, 19 nt, Homo sapiens
ggauaaagguuuugguauu

SEQ ID NO: 1208350 - RNA, 19 nt, Homo sapiens
agaagacacucguuaaaca

SEQ ID NO: 1208351 - RNA, 19 nt, Homo sapiens
gagccagaguacagucaua

SEQ ID NO: 1208352 - RNA, 19 nt, Homo sapiens
gggcaacaaugaaagugaa

SEQ ID NO: 1208353 - RNA, 19 nt, Homo sapiens
gaacaagaagcucauuauc

SEQ ID NO: 1208354 - RNA, 19 nt, Homo sapiens
gaacucuauucuucagcua

SEQ ID NO: 1208355 - RNA, 19 nt, Homo sapiens
ccuguuaucuaaauccuuu

SEQ ID NO: 1208356 - RNA, 19 nt, Homo sapiens
agagaacuuuccagguuua

SEQ ID NO: 1208357 - RNA, 19 nt, Homo sapiens
cagagaacuuuccagguuu

SEQ ID NO: 1208358 - RNA, 19 nt, Homo sapiens
agacaacaaucuauacugu

SEQ ID NO: 1208359 - RNA, 19 nt, Homo sapiens
gaagugaaggcuuuagaug

SEQ ID NO: 1208360 - RNA, 19 nt, Homo sapiens
ggauuguucucuugauaau

SEQ ID NO: 1208361 - RNA, 19 nt, Homo sapiens
gcaaaguaauucugaugag

SEQ ID NO: 1208362 - RNA, 19 nt, Homo sapiens
gggcaagacuccaucucaa

SEQ ID NO: 1208363 - RNA, 19 nt, Homo sapiens
uaaggauccucagauuuaa

SEQ ID NO: 1208364 - RNA, 19 nt, Homo sapiens
caacauaucaccagguuua

SEQ ID NO: 1208365 - RNA, 19 nt, Homo sapiens
gauaagaagcugaacauug

SEQ ID NO: 1208366 - RNA, 19 nt, Homo sapiens
ugaaagaagugaagauugu

SEQ ID NO: 1208367 - RNA, 19 nt, Homo sapiens
gaacagugaucccuaaucg

SEQ ID NO: 1208368 - RNA, 19 nt, Homo sapiens
ggaacaauguaucuaacaa

SEQ ID NO: 1208369 - RNA, 19 nt, Homo sapiens
gaugcaaacagauucauua

SEQ ID NO: 1208370 - RNA, 19 nt, Homo sapiens
gcuagaagcugcccguugu

SEQ ID NO: 1208371 - RNA, 19 nt, Homo sapiens
cagcucaacugauuucuug

SEQ ID NO: 1208372 - RNA, 19 nt, Homo sapiens
caaaccagaugcaaacaga

SEQ ID NO: 1208373 - RNA, 19 nt, Homo sapiens
caauguaucuaacaacuuc

SEQ ID NO: 1208374 - RNA, 19 nt, Homo sapiens
caacugauuucuuguccaa

SEQ ID NO: 1208375 - RNA, 19 nt, Homo sapiens
ugacagagcuggaguaucc

SEQ ID NO: 1208376 - RNA, 19 nt, Homo sapiens
ucaacuggauauccuuaua

SEQ ID NO: 1208377 - RNA, 19 nt, Homo sapiens
cuggauauccuuauacuua

SEQ ID NO: 1208378 - RNA, 19 nt, Homo sapiens
gacaaacgaaagugauuua

SEQ ID NO: 1208379 - RNA, 19 nt, Homo sapiens
guaaugaccuuuucuacaa

SEQ ID NO: 1208380 - RNA, 19 nt, Homo sapiens
cuucugagguuauuuauca

SEQ ID NO: 1208381 - RNA, 19 nt, Homo sapiens
gguaugguuucgucacuuu

SEQ ID NO: 1208382 - RNA, 19 nt, Homo sapiens
guugugaaacuuaguguua

SEQ ID NO: 1208383 - RNA, 19 nt, Homo sapiens
auaagaagcugaacauugg

SEQ ID NO: 1208384 - RNA, 19 nt, Homo sapiens
guuaauaccucaccauacu

SEQ ID NO: 1208385 - RNA, 19 nt, Homo sapiens
gaagcugcccguugugaaa

SEQ ID NO: 1208386 - RNA, 19 nt, Homo sapiens
gaaagaagugaagauugua

SEQ ID NO: 1208387 - RNA, 19 nt, Homo sapiens
gaagugaagauuguaaaug

SEQ ID NO: 1208388 - RNA, 19 nt, Homo sapiens
guaugggucugugaaagaa

SEQ ID NO: 1208389 - RNA, 19 nt, Homo sapiens
gugcuaaccuaacuguaau

SEQ ID NO: 1208390 - RNA, 19 nt, Homo sapiens
gaucauggaguucaagcaa

SEQ ID NO: 1208391 - RNA, 19 nt, Homo sapiens
uagcucagcccauuuauca

SEQ ID NO: 1208392 - RNA, 19 nt, Homo sapiens
caccugugccuuugaauaa

SEQ ID NO: 1208393 - RNA, 19 nt, Homo sapiens
guauguagcuccccuguga

SEQ ID NO: 1208394 - RNA, 19 nt, Homo sapiens
uaacaacuucaacuggaua

SEQ ID NO: 1208395 - RNA, 19 nt, Homo sapiens
gcuggaacaauguaucuaa

SEQ ID NO: 1208396 - RNA, 19 nt, Homo sapiens
gaucccuaaucgcaucuuu

SEQ ID NO: 1208397 - RNA, 19 nt, Homo sapiens
cagcuguucuacaaaauua

SEQ ID NO: 1208398 - RNA, 19 nt, Homo sapiens
caauugggcagcucuauuc

SEQ ID NO: 1208399 - RNA, 19 nt, Homo sapiens
uauuccagcucaacugauu

SEQ ID NO: 1208400 - RNA, 19 nt, Homo sapiens
gaugcagccugagccaauu

SEQ ID NO: 1208401 - RNA, 19 nt, Homo sapiens
caacauguuuuauccauuc

SEQ ID NO: 1208402 - RNA, 19 nt, Homo sapiens
gaucccucguucuaguaua

SEQ ID NO: 1208403 - RNA, 19 nt, Homo sapiens
acucaguuauuccacuaua

SEQ ID NO: 1208404 - RNA, 19 nt, Homo sapiens
caacaagugccccaagaua

SEQ ID NO: 1208405 - RNA, 19 nt, Homo sapiens
ucaccugugccuuugaaua

SEQ ID NO: 1208406 - RNA, 19 nt, Homo sapiens
gaacaauguaucuaacaac

SEQ ID NO: 1208407 - RNA, 19 nt, Homo sapiens
gaagauuguaaaugacaga

SEQ ID NO: 1208408 - RNA, 19 nt, Homo sapiens
ccuaaucgcaucuuuguag

SEQ ID NO: 1208409 - RNA, 19 nt, Homo sapiens
gugcccaaguucacgauga

SEQ ID NO: 1208410 - RNA, 19 nt, Homo sapiens
ucaccauacucaguuauuc

SEQ ID NO: 1208411 - RNA, 19 nt, Homo sapiens
ucauggaguucaagcaaca

SEQ ID NO: 1208412 - RNA, 19 nt, Homo sapiens
gugaaagaagugaagauug

SEQ ID NO: 1208413 - RNA, 19 nt, Homo sapiens
uugaauaacccaacaagug

SEQ ID NO: 1208414 - RNA, 19 nt, Homo sapiens
ugugcuaaccuaacuguaa

SEQ ID NO: 1208415 - RNA, 19 nt, Homo sapiens
uuagguagauguggcaugu

SEQ ID NO: 1208416 - RNA, 19 nt, Homo sapiens
auacucaguuauuccacua

SEQ ID NO: 1208417 - RNA, 19 nt, Homo sapiens
caaacgaaagugauuuaag

SEQ ID NO: 1208418 - RNA, 19 nt, Homo sapiens
gagauccagcuucaacgaa

SEQ ID NO: 1208419 - RNA, 19 nt, Homo sapiens
ggccaccacacaguauuua

SEQ ID NO: 1208420 - RNA, 19 nt, Homo sapiens
gauguggcauguugguuuu

SEQ ID NO: 1208421 - RNA, 19 nt, Homo sapiens
agguagauguggcauguug

SEQ ID NO: 1208422 - RNA, 19 nt, Homo sapiens
uaguuaauaccucaccaua

SEQ ID NO: 1208423 - RNA, 19 nt, Homo sapiens
cuaacaacuucaacuggau

SEQ ID NO: 1208424 - RNA, 19 nt, Homo sapiens
ggauaagaagcugaacauu

SEQ ID NO: 1208425 - RNA, 19 nt, Homo sapiens
ggaacagugaucccuaauc

SEQ ID NO: 1208426 - RNA, 19 nt, Homo sapiens
ggaguucaagcaacauauc

SEQ ID NO: 1208427 - RNA, 19 nt, Homo sapiens
cuucugcuccauucuuaua

SEQ ID NO: 1208428 - RNA, 19 nt, Homo sapiens
agacaaacgaaagugauuu

SEQ ID NO: 1208429 - RNA, 19 nt, Homo sapiens
acugauuucuuguccaaug

SEQ ID NO: 1208430 - RNA, 19 nt, Homo sapiens
uaagacaaacgaaagugau

SEQ ID NO: 1208431 - RNA, 19 nt, Homo sapiens
gcuaaccuaacuguaauga

SEQ ID NO: 1208432 - RNA, 19 nt, Homo sapiens
ugucaccugugccuuugaa

SEQ ID NO: 1208433 - RNA, 19 nt, Homo sapiens
caacuggauauccuuauac

SEQ ID NO: 1208434 - RNA, 19 nt, Homo sapiens
gggaucccucguucuagua

SEQ ID NO: 1208435 - RNA, 19 nt, Homo sapiens
cacuauaagcugucuaaau

SEQ ID NO: 1208436 - RNA, 19 nt, Homo sapiens
ggaaauugcacaggauggu

SEQ ID NO: 1208437 - RNA, 19 nt, Homo sapiens
gccuucacguucuguaugu

SEQ ID NO: 1208438 - RNA, 19 nt, Homo sapiens
agauguggcauguugguuu

SEQ ID NO: 1208439 - RNA, 19 nt, Homo sapiens
ugguagcucagcccauuua

SEQ ID NO: 1208440 - RNA, 19 nt, Homo sapiens
uuaagacaaacgaaaguga

SEQ ID NO: 1208441 - RNA, 19 nt, Homo sapiens
aauaaccacauugggaaua

SEQ ID NO: 1208442 - RNA, 19 nt, Homo sapiens
caagauauggaacagugau

SEQ ID NO: 1208443 - RNA, 19 nt, Homo sapiens
uggccgagauccagcuuca

SEQ ID NO: 1208444 - RNA, 19 nt, Homo sapiens
cugauuucuuguccaauga

SEQ ID NO: 1208445 - RNA, 19 nt, Homo sapiens
ccagguuuaugcuccaagu

SEQ ID NO: 1208446 - RNA, 19 nt, Homo sapiens
agcaacauaucaccagguu

SEQ ID NO: 1208447 - RNA, 19 nt, Homo sapiens
uaauaccucaccauacuca

SEQ ID NO: 1208448 - RNA, 19 nt, Homo sapiens
auggaacagugaucccuaa

SEQ ID NO: 1208449 - RNA, 19 nt, Homo sapiens
acaauugggcagcucuauu

SEQ ID NO: 1208450 - RNA, 19 nt, Homo sapiens
gaguucaagcaacauauca

SEQ ID NO: 1208451 - RNA, 19 nt, Homo sapiens
acaggaugguggauguguu

SEQ ID NO: 1208452 - RNA, 19 nt, Homo sapiens
uaucaaccaguggaaauug

SEQ ID NO: 1208453 - RNA, 19 nt, Homo sapiens
ucguuucggugcccaaguu

SEQ ID NO: 1208454 - RNA, 19 nt, Homo sapiens
uauccaaaggguaugguuu

SEQ ID NO: 1208455 - RNA, 19 nt, Homo sapiens
gugaagauuguaaaugaca

SEQ ID NO: 1208456 - RNA, 19 nt, Homo sapiens
ccaguaugggucugugaaa

SEQ ID NO: 1208457 - RNA, 19 nt, Homo sapiens
cucuucugcuccauucuua

SEQ ID NO: 1208458 - RNA, 19 nt, Homo sapiens
aaccagaugcaaacagauu

SEQ ID NO: 1208459 - RNA, 19 nt, Homo sapiens
uaacuguaaugaccuuuuc

SEQ ID NO: 1208460 - RNA, 19 nt, Homo sapiens
cuucaguuccagagccuua

SEQ ID NO: 1208461 - RNA, 19 nt, Homo sapiens
uaucuaacaacuucaacug

SEQ ID NO: 1208462 - RNA, 19 nt, Homo sapiens
cacugcugcuggcggauuu

SEQ ID NO: 1208463 - RNA, 19 nt, Homo sapiens
ugugaaagaagugaagauu

SEQ ID NO: 1208464 - RNA, 19 nt, Homo sapiens
gcgaagagauggugugaaa

SEQ ID NO: 1208465 - RNA, 19 nt, Homo sapiens
ggagguagcuagcguguga

SEQ ID NO: 1208466 - RNA, 19 nt, Homo sapiens
gcagcuaccuggcaacuga

SEQ ID NO: 1208467 - RNA, 19 nt, Homo sapiens
ggaagauccuggugcauug

SEQ ID NO: 1208468 - RNA, 19 nt, Homo sapiens
ccaagcgucucgaggauaa

SEQ ID NO: 1208469 - RNA, 19 nt, Homo sapiens
caacauccuuuccucaaug

SEQ ID NO: 1208470 - RNA, 19 nt, Homo sapiens
ggaagaugguccugggauu

SEQ ID NO: 1208471 - RNA, 19 nt, Homo sapiens
ucuaagaugugcccuggua

SEQ ID NO: 1208472 - RNA, 19 nt, Homo sapiens
gguguagaguugugugaaa

SEQ ID NO: 1208473 - RNA, 19 nt, Homo sapiens
gcaaugguguagaguugug

SEQ ID NO: 1208474 - RNA, 19 nt, Homo sapiens
gugcauggcuggcagucuu

SEQ ID NO: 1208475 - RNA, 19 nt, Homo sapiens
caaccugucuugggcagaa

SEQ ID NO: 1208476 - RNA, 19 nt, Homo sapiens
gaaauugucacucgcuuac

SEQ ID NO: 1208477 - RNA, 19 nt, Homo sapiens
ucucgaggauaaauaaaga

SEQ ID NO: 1208478 - RNA, 19 nt, Homo sapiens
gggaagauccuggugcauu

SEQ ID NO: 1208479 - RNA, 19 nt, Homo sapiens
gugcagaaagucagggaua

SEQ ID NO: 1208480 - RNA, 19 nt, Homo sapiens
gaagaugguccugggauuc

SEQ ID NO: 1208481 - RNA, 19 nt, Homo sapiens
uggccuaccucaugcugua

SEQ ID NO: 1208482 - RNA, 19 nt, Homo sapiens
ugaaugcaaugguguagag

SEQ ID NO: 1208483 - RNA, 19 nt, Homo sapiens
gcaacugaacccaucauca

SEQ ID NO: 1208484 - RNA, 19 nt, Homo sapiens
ugaaauugucacucgcuua

SEQ ID NO: 1208485 - RNA, 19 nt, Homo sapiens
ucaacauccuuuccucaau

SEQ ID NO: 1208486 - RNA, 19 nt, Homo sapiens
gcgcacacgcugauuugaa

SEQ ID NO: 1208487 - RNA, 19 nt, Homo sapiens
ccacgacucgccagccuuu

SEQ ID NO: 1208488 - RNA, 19 nt, Homo sapiens
gagaccgagucccuuuaug

SEQ ID NO: 1208489 - RNA, 19 nt, Homo sapiens
ggcuggcagucuugaaauu

SEQ ID NO: 1208490 - RNA, 19 nt, Homo sapiens
gagaccaggacauggcuaa

SEQ ID NO: 1208491 - RNA, 19 nt, Homo sapiens
gcuuugggcuucuaugacu

SEQ ID NO: 1208492 - RNA, 19 nt, Homo sapiens
caacugaacccaucaucac

SEQ ID NO: 1208493 - RNA, 19 nt, Homo sapiens
ggagaugccaaccguucaa

SEQ ID NO: 1208494 - RNA, 19 nt, Homo sapiens
ucacgcacguccucaaugc

SEQ ID NO: 1208495 - RNA, 19 nt, Homo sapiens
gaagagauggugugaaaag

SEQ ID NO: 1208496 - RNA, 19 nt, Homo sapiens
gggcuucuaugacuuuuau

SEQ ID NO: 1208497 - RNA, 19 nt, Homo sapiens
gcgucucgaggauaaauaa

SEQ ID NO: 1208498 - RNA, 19 nt, Homo sapiens
gacagacagcgaagagaug

SEQ ID NO: 1208499 - RNA, 19 nt, Homo sapiens
augcaaugguguagaguug

SEQ ID NO: 1208500 - RNA, 19 nt, Homo sapiens
ggauacggcaagcaugaau

SEQ ID NO: 1208501 - RNA, 19 nt, Homo sapiens
ucucugcccugcacuugug

SEQ ID NO: 1208502 - RNA, 19 nt, Homo sapiens
ccaggccacugucacucuu

SEQ ID NO: 1208503 - RNA, 19 nt, Homo sapiens
gugagaccgagucccuuua

SEQ ID NO: 1208504 - RNA, 19 nt, Homo sapiens
ugacaugagcauccacuuc

SEQ ID NO: 1208505 - RNA, 19 nt, Homo sapiens
gagauggugugaaaagcuu

SEQ ID NO: 1208506 - RNA, 19 nt, Homo sapiens
uggaggccaucaagaaagu

SEQ ID NO: 1208507 - RNA, 19 nt, Homo sapiens
agaccgagucccuuuaugu

SEQ ID NO: 1208508 - RNA, 19 nt, Homo sapiens
gcacaggaggagguagcua

SEQ ID NO: 1208509 - RNA, 19 nt, Homo sapiens
gaccgagucccuuuauguc

SEQ ID NO: 1208510 - RNA, 19 nt, Homo sapiens
gcuggcagucuugaaauug

SEQ ID NO: 1208511 - RNA, 19 nt, Homo sapiens
cguggaggccaucaagaaa

SEQ ID NO: 1208512 - RNA, 19 nt, Homo sapiens
acgugugugucauggcuua

SEQ ID NO: 1208513 - RNA, 19 nt, Homo sapiens
gaagauccuggugcauugu

SEQ ID NO: 1208514 - RNA, 19 nt, Homo sapiens
accaggacauggcuaacaa

SEQ ID NO: 1208515 - RNA, 19 nt, Homo sapiens
ucaaugucuucgaguugga

SEQ ID NO: 1208516 - RNA, 19 nt, Homo sapiens
caaccguucaacauccuuu

SEQ ID NO: 1208517 - RNA, 19 nt, Homo sapiens
agacagacagcgaagagau

SEQ ID NO: 1208518 - RNA, 19 nt, Homo sapiens
ggccaucaagaaagucaaa

SEQ ID NO: 1208519 - RNA, 19 nt, Homo sapiens
gaugccaaccguucaacau

SEQ ID NO: 1208520 - RNA, 19 nt, Homo sapiens
gauacggcaagcaugaaug

SEQ ID NO: 1208521 - RNA, 19 nt, Homo sapiens
ugagaccgagucccuuuau

SEQ ID NO: 1208522 - RNA, 19 nt, Homo sapiens
ucgccagccuuugacauga

SEQ ID NO: 1208523 - RNA, 19 nt, Homo sapiens
gaccaggacauggcuaaca

SEQ ID NO: 1208524 - RNA, 19 nt, Homo sapiens
aauugucacucgcuuacug

SEQ ID NO: 1208525 - RNA, 19 nt, Homo sapiens
ccaucaagaaagucaaaga

SEQ ID NO: 1208526 - RNA, 19 nt, Homo sapiens
ccucaaugucuucgaguug

SEQ ID NO: 1208527 - RNA, 19 nt, Homo sapiens
cacagacuuuccacuccaa

SEQ ID NO: 1208528 - RNA, 19 nt, Homo sapiens
uugcagaaccagacagaga

SEQ ID NO: 1208529 - RNA, 19 nt, Homo sapiens
ucugccaccucuaagaugu

SEQ ID NO: 1208530 - RNA, 19 nt, Homo sapiens
ccaagcacaggaggaggua

SEQ ID NO: 1208531 - RNA, 19 nt, Homo sapiens
gagugagguugggcagugu

SEQ ID NO: 1208532 - RNA, 19 nt, Homo sapiens
cucaaggucuccuguucga

SEQ ID NO: 1208533 - RNA, 19 nt, Homo sapiens
agaaaggucuuggaaaguu

SEQ ID NO: 1208534 - RNA, 19 nt, Homo sapiens
caggacagcuugguuuauu

SEQ ID NO: 1208535 - RNA, 19 nt, Homo sapiens
guggagagcuggugguuuc

SEQ ID NO: 1208536 - RNA, 19 nt, Homo sapiens
cuucuggaauugcaucuua

SEQ ID NO: 1208537 - RNA, 19 nt, Homo sapiens
uuacagagcagcccaggua

SEQ ID NO: 1208538 - RNA, 19 nt, Homo sapiens
ccaggucgcuguaagaagu

SEQ ID NO: 1208539 - RNA, 19 nt, Homo sapiens
ccucaaguguguagacauu

SEQ ID NO: 1208540 - RNA, 19 nt, Homo sapiens
gagagaacaagcaguguga

SEQ ID NO: 1208541 - RNA, 19 nt, Homo sapiens
gagaacaagcagugugaaa

SEQ ID NO: 1208542 - RNA, 19 nt, Homo sapiens
ccaaauacaaagacaguga

SEQ ID NO: 1208543 - RNA, 19 nt, Homo sapiens
gaugacagaagacgaguug

SEQ ID NO: 1208544 - RNA, 19 nt, Homo sapiens
gggacugguugacagcuuu

SEQ ID NO: 1208545 - RNA, 19 nt, Homo sapiens
acacugagggcuccuauga

SEQ ID NO: 1208546 - RNA, 19 nt, Homo sapiens
gcacagagggagccaacug

SEQ ID NO: 1208547 - RNA, 19 nt, Homo sapiens
cauugccacuuauuuauuc

SEQ ID NO: 1208548 - RNA, 19 nt, Homo sapiens
cagcaggcuucuucucaga

SEQ ID NO: 1208549 - RNA, 19 nt, Homo sapiens
cuguggagcugaccaauuc

SEQ ID NO: 1208550 - RNA, 19 nt, Homo sapiens
ggacugguugacagcuuua

SEQ ID NO: 1208551 - RNA, 19 nt, Homo sapiens
gacaagaggcugacuucug

SEQ ID NO: 1208552 - RNA, 19 nt, Homo sapiens
gcaggugggcuccaagugu

SEQ ID NO: 1208553 - RNA, 19 nt, Homo sapiens
gaacacugagggcuccuau

SEQ ID NO: 1208554 - RNA, 19 nt, Homo sapiens
uaucagacccucagacaag

SEQ ID NO: 1208555 - RNA, 19 nt, Homo sapiens
uaacaagggccuggagaga

SEQ ID NO: 1208556 - RNA, 19 nt, Homo sapiens
guucaccgccaucuucauu

SEQ ID NO: 1208557 - RNA, 19 nt, Homo sapiens
gagagcuggugguuucaca

SEQ ID NO: 1208558 - RNA, 19 nt, Homo sapiens
gagggugugugcagcaagu

SEQ ID NO: 1208559 - RNA, 19 nt, Homo sapiens
gaaccauccgggacaacuu

SEQ ID NO: 1208560 - RNA, 19 nt, Homo sapiens
gccaguuccuguucugugu

SEQ ID NO: 1208561 - RNA, 19 nt, Homo sapiens
gaccaauucugcgugaaca

SEQ ID NO: 1208562 - RNA, 19 nt, Homo sapiens
ccacuuauuuauucaucuc

SEQ ID NO: 1208563 - RNA, 19 nt, Homo sapiens
caaggagcgaggccacuuu

SEQ ID NO: 1208564 - RNA, 19 nt, Homo sapiens
ccugaggaaucaaacuguu

SEQ ID NO: 1208565 - RNA, 19 nt, Homo sapiens
gcuggugguuucacaagca

SEQ ID NO: 1208566 - RNA, 19 nt, Homo sapiens
caucucaggaaauaaagaa

SEQ ID NO: 1208567 - RNA, 19 nt, Homo sapiens
ccauugccacuuauuuauu

SEQ ID NO: 1208568 - RNA, 19 nt, Homo sapiens
ggacuggcaggcuucacaa

SEQ ID NO: 1208569 - RNA, 19 nt, Homo sapiens
acugagggcuccuaugagu

SEQ ID NO: 1208570 - RNA, 19 nt, Homo sapiens
ggacagcuugguuuauuuu

SEQ ID NO: 1208571 - RNA, 19 nt, Homo sapiens
aggacagcuugguuuauuu

SEQ ID NO: 1208572 - RNA, 19 nt, Homo sapiens
caguggcugugcucagauu

SEQ ID NO: 1208573 - RNA, 19 nt, Homo sapiens
acaagggccuggagagaac

SEQ ID NO: 1208574 - RNA, 19 nt, Homo sapiens
ggaaggcaucugugugaag

SEQ ID NO: 1208575 - RNA, 19 nt, Homo sapiens
ccugggaggaagagaauuu

SEQ ID NO: 1208576 - RNA, 19 nt, Homo sapiens
cuggcaggcuucacaaugu

SEQ ID NO: 1208577 - RNA, 19 nt, Homo sapiens
ugcaucaccucaagugugu

SEQ ID NO: 1208578 - RNA, 19 nt, Homo sapiens
gguggcugcuagagcuuug

SEQ ID NO: 1208579 - RNA, 19 nt, Homo sapiens
ucaccgccaucuucauugg

SEQ ID NO: 1208580 - RNA, 19 nt, Homo sapiens
cuucaucaagggcagauaa

SEQ ID NO: 1208581 - RNA, 19 nt, Homo sapiens
cagacaagaggcugacuuc

SEQ ID NO: 1208582 - RNA, 19 nt, Homo sapiens
uguagacauugaugagugu

SEQ ID NO: 1208583 - RNA, 19 nt, Homo sapiens
gaccugaggaaucaaacug

SEQ ID NO: 1208584 - RNA, 19 nt, Homo sapiens
guguggccuuggcuacuuu

SEQ ID NO: 1208585 - RNA, 19 nt, Homo sapiens
ccacggcaccuuagaacag

SEQ ID NO: 1208586 - RNA, 19 nt, Homo sapiens
acuuauuucucuucuggaa

SEQ ID NO: 1208587 - RNA, 19 nt, Homo sapiens
agagucagcaggcuucuuc

SEQ ID NO: 1208588 - RNA, 19 nt, Homo sapiens
caacuguggagcugaccaa

SEQ ID NO: 1208589 - RNA, 19 nt, Homo sapiens
aggaagagaauuuguccaa

SEQ ID NO: 1208590 - RNA, 19 nt, Homo sapiens
acucaggacagcuugguuu

SEQ ID NO: 1208591 - RNA, 19 nt, Homo sapiens
uacccaguuuggccucuuu

SEQ ID NO: 1208592 - RNA, 19 nt, Homo sapiens
caccuuagaacagaccuuu

SEQ ID NO: 1208593 - RNA, 19 nt, Homo sapiens
cacggcaccuuagaacaga

SEQ ID NO: 1208594 - RNA, 19 nt, Homo sapiens
caucaagggcagauaaucg

SEQ ID NO: 1208595 - RNA, 19 nt, Homo sapiens
uaagggcgacuugguguuc

SEQ ID NO: 1208596 - RNA, 19 nt, Homo sapiens
ugacagaagacgaguuggu

SEQ ID NO: 1208597 - RNA, 19 nt, Homo sapiens
gaacaagcagugugaaaac

SEQ ID NO: 1208598 - RNA, 19 nt, Homo sapiens
ccccuaauauucuuuauca

SEQ ID NO: 1208599 - RNA, 19 nt, Homo sapiens
ggccaggucgcuguaagaa

SEQ ID NO: 1208600 - RNA, 19 nt, Homo sapiens
gggccaggucgcuguaaga

SEQ ID NO: 1208601 - RNA, 19 nt, Homo sapiens
uccaguggcugugcucaga

SEQ ID NO: 1208602 - RNA, 19 nt, Homo sapiens
cagugagacccgccuggua

SEQ ID NO: 1208603 - RNA, 19 nt, Homo sapiens
aaacacugccugggaggaa

SEQ ID NO: 1208604 - RNA, 19 nt, Homo sapiens
gagcuuuggccccugcuua

SEQ ID NO: 1208605 - RNA, 19 nt, Homo sapiens
gcgccacggcaccuuagaa

SEQ ID NO: 1208606 - RNA, 19 nt, Homo sapiens
guggauaccaugagcucuu

SEQ ID NO: 1208607 - RNA, 19 nt, Homo sapiens
gagcuggugguuucacaag

SEQ ID NO: 1208608 - RNA, 19 nt, Homo sapiens
gggaggaagagaauuuguc

SEQ ID NO: 1208609 - RNA, 19 nt, Homo sapiens
ugcagcagauguucuuugg

SEQ ID NO: 1208610 - RNA, 19 nt, Homo sapiens
gcuccaagugucucgaugu

SEQ ID NO: 1208611 - RNA, 19 nt, Homo sapiens
ugcuagcgaggauaacuua

SEQ ID NO: 1208612 - RNA, 19 nt, Homo sapiens
agagaaccauccgggacaa

SEQ ID NO: 1208613 - RNA, 19 nt, Homo sapiens
gauuugaggucuuugcuua

SEQ ID NO: 1208614 - RNA, 19 nt, Homo sapiens
ggucuuugcuuaaguauga

SEQ ID NO: 1208615 - RNA, 19 nt, Homo sapiens
gaaggaaagcugcaauaaa

SEQ ID NO: 1208616 - RNA, 19 nt, Homo sapiens
aaacccgucucuacuaaua

SEQ ID NO: 1208617 - RNA, 19 nt, Homo sapiens
caauaaagccacaaugauu

SEQ ID NO: 1208618 - RNA, 19 nt, Homo sapiens
ucacggagcugaccaucuu

SEQ ID NO: 1208619 - RNA, 19 nt, Homo sapiens
aaggaaagcugcaauaaag

SEQ ID NO: 1208620 - RNA, 19 nt, Homo sapiens
gugaguagcugugcgaauu

SEQ ID NO: 1208621 - RNA, 19 nt, Homo sapiens
gcaauaaagccacaaugau

SEQ ID NO: 1208622 - RNA, 19 nt, Homo sapiens
gcuuuaucaugcaacauua

SEQ ID NO: 1208623 - RNA, 19 nt, Homo sapiens
ugaggucuuugcuuaagua

SEQ ID NO: 1208624 - RNA, 19 nt, Homo sapiens
aggcagagguugcaaugaa

SEQ ID NO: 1208625 - RNA, 19 nt, Homo sapiens
acaaugauuugaggucuuu

SEQ ID NO: 1208626 - RNA, 19 nt, Homo sapiens
aaacaaacaugaguagucu

SEQ ID NO: 1208627 - RNA, 19 nt, Homo sapiens
ccuguaaucccaacacuuu

SEQ ID NO: 1208628 - RNA, 19 nt, Homo sapiens
gauaggaagauagggauuu

SEQ ID NO: 1208629 - RNA, 19 nt, Homo sapiens
aacuguagcuugugugaaa

SEQ ID NO: 1208630 - RNA, 19 nt, Homo sapiens
caaacaaacaugaguaguc

SEQ ID NO: 1208631 - RNA, 19 nt, Homo sapiens
aaaauuagcuggguauguu

SEQ ID NO: 1208632 - RNA, 19 nt, Homo sapiens
uaaaacccgucucuacuaa

SEQ ID NO: 1208633 - RNA, 19 nt, Homo sapiens
ggacauuuaagcgaaguaa

SEQ ID NO: 1208634 - RNA, 19 nt, Homo sapiens
guagucugcauaucgaaua

SEQ ID NO: 1208635 - RNA, 19 nt, Homo sapiens
ugaaggaaagcugcaauaa

SEQ ID NO: 1208636 - RNA, 19 nt, Homo sapiens
gcaaagcccgucccucucu

SEQ ID NO: 1208637 - RNA, 19 nt, Homo sapiens
uaauugcuguccugugguu

SEQ ID NO: 1208638 - RNA, 19 nt, Homo sapiens
ugaguagucugcauaucga

SEQ ID NO: 1208639 - RNA, 19 nt, Homo sapiens
gcuguccugugguuucauu

SEQ ID NO: 1208640 - RNA, 19 nt, Homo sapiens
caguuaaacauacuccuaa

SEQ ID NO: 1208641 - RNA, 19 nt, Homo sapiens
aaacaugaguagucugcau

SEQ ID NO: 1208642 - RNA, 19 nt, Homo sapiens
cagaugauauuuugaagga

SEQ ID NO: 1208643 - RNA, 19 nt, Homo sapiens
gcucgaccaucucaauguc

SEQ ID NO: 1208644 - RNA, 19 nt, Homo sapiens
ucaguuaaacauacuccua

SEQ ID NO: 1208645 - RNA, 19 nt, Homo sapiens
agauagggauuuccucagu

SEQ ID NO: 1208646 - RNA, 19 nt, Homo sapiens
caaagcccgucccucucuu

SEQ ID NO: 1208647 - RNA, 19 nt, Homo sapiens
ucgaggcggagaaccauua

SEQ ID NO: 1208648 - RNA, 19 nt, Homo sapiens
ugcaauaaagccacaauga

SEQ ID NO: 1208649 - RNA, 19 nt, Homo sapiens
uuggaccagucuuuauuaa

SEQ ID NO: 1208650 - RNA, 19 nt, Homo sapiens
ccaagaaaugguccuaauc

SEQ ID NO: 1208651 - RNA, 19 nt, Homo sapiens
caagaaaugguccuaaucc

SEQ ID NO: 1208652 - RNA, 19 nt, Homo sapiens
gcgccaagcagaacaugau

SEQ ID NO: 1208653 - RNA, 19 nt, Homo sapiens
ggcagagguugcaaugaag

SEQ ID NO: 1208654 - RNA, 19 nt, Homo sapiens
ggcuuuaucaugcaacauu

SEQ ID NO: 1208655 - RNA, 19 nt, Homo sapiens
ccaguucgccuccgcaaag

SEQ ID NO: 1208656 - RNA, 19 nt, Homo sapiens
agucgucacccuuggauuu

SEQ ID NO: 1208657 - RNA, 19 nt, Homo sapiens
ucaaugucaccaagaaaug

SEQ ID NO: 1208658 - RNA, 19 nt, Homo sapiens
gagcugaccaucuuuaccu

SEQ ID NO: 1208659 - RNA, 19 nt, Homo sapiens
cacaaugauuugaggucuu

SEQ ID NO: 1208660 - RNA, 19 nt, Homo sapiens
cggaccagcucgaccaucu

SEQ ID NO: 1208661 - RNA, 19 nt, Homo sapiens
agucacagaugauauuuug

SEQ ID NO: 1208662 - RNA, 19 nt, Homo sapiens
auagggauuuccucaguca

SEQ ID NO: 1208663 - RNA, 19 nt, Homo sapiens
auaaagccacaaugauuug

SEQ ID NO: 1208664 - RNA, 19 nt, Homo sapiens
gaccagcucgaccaucuca

SEQ ID NO: 1208665 - RNA, 19 nt, Homo sapiens
auaggaagauagggauuuc

SEQ ID NO: 1208666 - RNA, 19 nt, Homo sapiens
uuuggaccagucuuuauua

SEQ ID NO: 1208667 - RNA, 19 nt, Homo sapiens
uugaaggaaagcugcaaua

SEQ ID NO: 1208668 - RNA, 19 nt, Homo sapiens
gaagcggagguugcaguga

SEQ ID NO: 1208669 - RNA, 19 nt, Homo sapiens
ucacuugaggucaggaguu

SEQ ID NO: 1208670 - RNA, 19 nt, Homo sapiens
uaaagccacaaugauuuga

SEQ ID NO: 1208671 - RNA, 19 nt, Homo sapiens
aacaugaguagucugcaua

SEQ ID NO: 1208672 - RNA, 19 nt, Homo sapiens
gugcgaauucgguucucua

SEQ ID NO: 1208673 - RNA, 19 nt, Homo sapiens
ccagcucgaccaucucaau

SEQ ID NO: 1208674 - RNA, 19 nt, Homo sapiens
uuuccucagucacagauga

SEQ ID NO: 1208675 - RNA, 19 nt, Homo sapiens
guccugugguuucauuagu

SEQ ID NO: 1208676 - RNA, 19 nt, Homo sapiens
cacuugaggucaggaguuc

SEQ ID NO: 1208677 - RNA, 19 nt, Homo sapiens
ugguuucauuagucugaua

SEQ ID NO: 1208678 - RNA, 19 nt, Homo sapiens
cagaauugcucuuccauaa

SEQ ID NO: 1208679 - RNA, 19 nt, Homo sapiens
gaauugcucuuccauaaag

SEQ ID NO: 1208680 - RNA, 19 nt, Homo sapiens
gaaaauggccuaugcuuaa

SEQ ID NO: 1208681 - RNA, 19 nt, Homo sapiens
uguccaagcuauacaauaa

SEQ ID NO: 1208682 - RNA, 19 nt, Homo sapiens
gagcucaaguucaucaaga

SEQ ID NO: 1208683 - RNA, 19 nt, Homo sapiens
ucaacgaccuggagaagga

SEQ ID NO: 1208684 - RNA, 19 nt, Homo sapiens
gaagaagcagaguuucauu

SEQ ID NO: 1208685 - RNA, 19 nt, Homo sapiens
gaaccaggccucccaugug

SEQ ID NO: 1208686 - RNA, 19 nt, Homo sapiens
ggccuaugcuuaagaggaa

SEQ ID NO: 1208687 - RNA, 19 nt, Homo sapiens
gcuguugucuaaacugaga

SEQ ID NO: 1208688 - RNA, 19 nt, Homo sapiens
gggcuguugucuaaacuga

SEQ ID NO: 1208689 - RNA, 19 nt, Homo sapiens
ccagcgagcucaaguucau

SEQ ID NO: 1208690 - RNA, 19 nt, Homo sapiens
ccucgucccuggccucaaa

SEQ ID NO: 1208691 - RNA, 19 nt, Homo sapiens
aagaagcagaguuucauua

SEQ ID NO: 1208692 - RNA, 19 nt, Homo sapiens
aaccaggccucccauguga

SEQ ID NO: 1208693 - RNA, 19 nt, Homo sapiens
guacuucaugugugaguuu

SEQ ID NO: 1208694 - RNA, 19 nt, Homo sapiens
ugacaaggagaacauguga

SEQ ID NO: 1208695 - RNA, 19 nt, Homo sapiens
ccagaauugcucuuccaua

SEQ ID NO: 1208696 - RNA, 19 nt, Homo sapiens
agacggagagcaagaucua

SEQ ID NO: 1208697 - RNA, 19 nt, Homo sapiens
uucauuaccuguauuguag

SEQ ID NO: 1208698 - RNA, 19 nt, Homo sapiens
ugugugaguuugacaagga

SEQ ID NO: 1208699 - RNA, 19 nt, Homo sapiens
gcggugagcccaacaaugc

SEQ ID NO: 1208700 - RNA, 19 nt, Homo sapiens
gcucuuccauaaagcuugu

SEQ ID NO: 1208701 - RNA, 19 nt, Homo sapiens
agaguuucauuaccuguau

SEQ ID NO: 1208702 - RNA, 19 nt, Homo sapiens
gaccagcgagcucaaguuc

SEQ ID NO: 1208703 - RNA, 19 nt, Homo sapiens
ggagcugucccucugugaa

SEQ ID NO: 1208704 - RNA, 19 nt, Homo sapiens
gcgccuucguguacucuga

SEQ ID NO: 1208705 - RNA, 19 nt, Homo sapiens
ucaaguucaucaagaaugc

SEQ ID NO: 1208706 - RNA, 19 nt, Homo sapiens
gaguuucauuaccuguauu

SEQ ID NO: 1208707 - RNA, 19 nt, Homo sapiens
aagcagaguuucauuaccu

SEQ ID NO: 1208708 - RNA, 19 nt, Homo sapiens
gaagcagaguuucauuacc

SEQ ID NO: 1208709 - RNA, 19 nt, Homo sapiens
agaauugcucuuccauaaa

SEQ ID NO: 1208710 - RNA, 19 nt, Homo sapiens
gggagagaagggagacaaa

SEQ ID NO: 1208711 - RNA, 19 nt, Homo sapiens
agaucuaccugcuggugaa

SEQ ID NO: 1208712 - RNA, 19 nt, Homo sapiens
gagagaagggagacaaagg

SEQ ID NO: 1208713 - RNA, 19 nt, Homo sapiens
cagaguuucauuaccugua

SEQ ID NO: 1208714 - RNA, 19 nt, Homo sapiens
cagccuggccuuccuguca

SEQ ID NO: 1208715 - RNA, 19 nt, Homo sapiens
ggagagaagggagacaaag

SEQ ID NO: 1208716 - RNA, 19 nt, Homo sapiens
gcucuaaaggugagaaagg

SEQ ID NO: 1208717 - RNA, 19 nt, Homo sapiens
gagcugucccucugugaag

SEQ ID NO: 1208718 - RNA, 19 nt, Homo sapiens
augcggaccuucaacaagu

SEQ ID NO: 1208719 - RNA, 19 nt, Homo sapiens
cagugugggucgucaugga

SEQ ID NO: 1208720 - RNA, 19 nt, Homo sapiens
gcucaaguucaucaagaau

SEQ ID NO: 1208721 - RNA, 19 nt, Homo sapiens
agauuccggugacauagga

SEQ ID NO: 1208722 - RNA, 19 nt, Homo sapiens
agagggcuguugucuaaac

SEQ ID NO: 1208723 - RNA, 19 nt, Homo sapiens
agaaaauggccuaugcuua

SEQ ID NO: 1208724 - RNA, 19 nt, Homo sapiens
ugucuaaacugagaaaaug

SEQ ID NO: 1208725 - RNA, 19 nt, Homo sapiens
gcaucaacgaccuggagaa

SEQ ID NO: 1208726 - RNA, 19 nt, Homo sapiens
ggagauuccggugacauag

SEQ ID NO: 1208727 - RNA, 19 nt, Homo sapiens
caaggacgaggcugccaau

SEQ ID NO: 1208728 - RNA, 19 nt, Homo sapiens
aggagauuccggugacaua

SEQ ID NO: 1208729 - RNA, 19 nt, Homo sapiens
ggaggacugcguggagaug

SEQ ID NO: 1208730 - RNA, 19 nt, Homo sapiens
agaagcagaguuucauuac

SEQ ID NO: 1208731 - RNA, 19 nt, Homo sapiens
gcagggagaucuucaaguu

SEQ ID NO: 1208732 - RNA, 19 nt, Homo sapiens
gaacgaggccuacccacua

SEQ ID NO: 1208733 - RNA, 19 nt, Homo sapiens
caauagcacucucagauau

SEQ ID NO: 1208734 - RNA, 19 nt, Homo sapiens
ucacaggaauguaaauuug

SEQ ID NO: 1208735 - RNA, 19 nt, Homo sapiens
ggacuaugguaacuuggua

SEQ ID NO: 1208736 - RNA, 19 nt, Homo sapiens
gaacagacaagccauggaa

SEQ ID NO: 1208737 - RNA, 19 nt, Homo sapiens
cagacuggcuggagaaauu

SEQ ID NO: 1208738 - RNA, 19 nt, Homo sapiens
gaaccgagcagacuucuuc

SEQ ID NO: 1208739 - RNA, 19 nt, Homo sapiens
gacaaaugcuuucuaacug

SEQ ID NO: 1208740 - RNA, 19 nt, Homo sapiens
gcagaggaaggccaaguua

SEQ ID NO: 1208741 - RNA, 19 nt, Homo sapiens
caaaggcucuggcuaaguc

SEQ ID NO: 1208742 - RNA, 19 nt, Homo sapiens
gagcagagcagacgcuuug

SEQ ID NO: 1208743 - RNA, 19 nt, Homo sapiens
gaacaauuagcaacagaaa

SEQ ID NO: 1208744 - RNA, 19 nt, Homo sapiens
ccguuuaccugcucuauaa

SEQ ID NO: 1208745 - RNA, 19 nt, Homo sapiens
gaaacuucuucaaugcuuu

SEQ ID NO: 1208746 - RNA, 19 nt, Homo sapiens
caaccugacugcacaagga

SEQ ID NO: 1208747 - RNA, 19 nt, Homo sapiens
ggacaaaugcuuucuaacu

SEQ ID NO: 1208748 - RNA, 19 nt, Homo sapiens
gaggguaggugggaaagaa

SEQ ID NO: 1208749 - RNA, 19 nt, Homo sapiens
ugagauuccuugugugaaa

SEQ ID NO: 1208750 - RNA, 19 nt, Homo sapiens
gaaauggcaacaauaccua

SEQ ID NO: 1208751 - RNA, 19 nt, Homo sapiens
uaacuucagcauucacuua

SEQ ID NO: 1208752 - RNA, 19 nt, Homo sapiens
aguaggagcucaaauuguu

SEQ ID NO: 1208753 - RNA, 19 nt, Homo sapiens
ggacagaggcuuacaagac

SEQ ID NO: 1208754 - RNA, 19 nt, Homo sapiens
gaugggaacugcuucuaca

SEQ ID NO: 1208755 - RNA, 19 nt, Homo sapiens
ggacuuguuucuucaacug

SEQ ID NO: 1208756 - RNA, 19 nt, Homo sapiens
caacaauaccuauguguca

SEQ ID NO: 1208757 - RNA, 19 nt, Homo sapiens
ggccaaauccgaaccauug

SEQ ID NO: 1208758 - RNA, 19 nt, Homo sapiens
ccaauagcacucucagaua

SEQ ID NO: 1208759 - RNA, 19 nt, Homo sapiens
gacauucuauccauucuuc

SEQ ID NO: 1208760 - RNA, 19 nt, Homo sapiens
ggaaggagaguugcuuuga

SEQ ID NO: 1208761 - RNA, 19 nt, Homo sapiens
ggaaaccgccugggaauuc

SEQ ID NO: 1208762 - RNA, 19 nt, Homo sapiens
gucacuggauuauugguua

SEQ ID NO: 1208763 - RNA, 19 nt, Homo sapiens
gaaggagaguugcuuugag

SEQ ID NO: 1208764 - RNA, 19 nt, Homo sapiens
ggagaaauucccucuagga

SEQ ID NO: 1208765 - RNA, 19 nt, Homo sapiens
gggcugcuaugucucugua

SEQ ID NO: 1208766 - RNA, 19 nt, Homo sapiens
ucacugggcugcuaugucu

SEQ ID NO: 1208767 - RNA, 19 nt, Homo sapiens
aaacauucuccuagcauua

SEQ ID NO: 1208768 - RNA, 19 nt, Homo sapiens
gugaauaucaucaucuuug

SEQ ID NO: 1208769 - RNA, 19 nt, Homo sapiens
gacagaggcuuacaagacu

SEQ ID NO: 1208770 - RNA, 19 nt, Homo sapiens
gaacauuccggcucuucaa

SEQ ID NO: 1208771 - RNA, 19 nt, Homo sapiens
acaauuagcaacagaaaga

SEQ ID NO: 1208772 - RNA, 19 nt, Homo sapiens
ucaccacccugagcagaua

SEQ ID NO: 1208773 - RNA, 19 nt, Homo sapiens
cauuccggcucuucaauuu

SEQ ID NO: 1208774 - RNA, 19 nt, Homo sapiens
gguucuaacuucagcauuc

SEQ ID NO: 1208775 - RNA, 19 nt, Homo sapiens
ugacuggguuccuauuuua

SEQ ID NO: 1208776 - RNA, 19 nt, Homo sapiens
aaggagaguugcuuugaga

SEQ ID NO: 1208777 - RNA, 19 nt, Homo sapiens
gcugcuaugucucuguauu

SEQ ID NO: 1208778 - RNA, 19 nt, Homo sapiens
gacugucaccucugaauuu

SEQ ID NO: 1208779 - RNA, 19 nt, Homo sapiens
ucacuggauuauugguuaa

SEQ ID NO: 1208780 - RNA, 19 nt, Homo sapiens
gggaacaauuagcaacaga

SEQ ID NO: 1208781 - RNA, 19 nt, Homo sapiens
uaugagaaguacacuggaa

SEQ ID NO: 1208782 - RNA, 19 nt, Homo sapiens
ggccauaccccuuaaauaa

SEQ ID NO: 1208783 - RNA, 19 nt, Homo sapiens
aguggaaccugucaccuaa

SEQ ID NO: 1208784 - RNA, 19 nt, Homo sapiens
gccgauaaacauugauuaa

SEQ ID NO: 1208785 - RNA, 19 nt, Homo sapiens
ucaaagacuucugcacuca

SEQ ID NO: 1208786 - RNA, 19 nt, Homo sapiens
ugucaccucugaauuuguu

SEQ ID NO: 1208787 - RNA, 19 nt, Homo sapiens
cugcagggauuuacuggaa

SEQ ID NO: 1208788 - RNA, 19 nt, Homo sapiens
ucucuggacuuguuucuuc

SEQ ID NO: 1208789 - RNA, 19 nt, Homo sapiens
agggacaaaugcuuucuaa

SEQ ID NO: 1208790 - RNA, 19 nt, Homo sapiens
cagcuucccuaggcaguaa

SEQ ID NO: 1208791 - RNA, 19 nt, Homo sapiens
ccaccauggucuaugagaa

SEQ ID NO: 1208792 - RNA, 19 nt, Homo sapiens
gcccucagcuggaguuugg

SEQ ID NO: 1208793 - RNA, 19 nt, Homo sapiens
gcaugagucugcugacaac

SEQ ID NO: 1208794 - RNA, 19 nt, Homo sapiens
ccucaggaccuucaagauu

SEQ ID NO: 1208795 - RNA, 19 nt, Homo sapiens
ggccucuggugucucuuua

SEQ ID NO: 1208796 - RNA, 19 nt, Homo sapiens
uauggacuaugguaacuug

SEQ ID NO: 1208797 - RNA, 19 nt, Homo sapiens
uaugauacuuucucuccaa

SEQ ID NO: 1208798 - RNA, 19 nt, Homo sapiens
gccaauagcacucucagau

SEQ ID NO: 1208799 - RNA, 19 nt, Homo sapiens
gaggaaaagcucaagguua

SEQ ID NO: 1208800 - RNA, 19 nt, Homo sapiens
ucacuuacuagcuguauga

SEQ ID NO: 1208801 - RNA, 19 nt, Homo sapiens
cuucagcauucacuuacua

SEQ ID NO: 1208802 - RNA, 19 nt, Homo sapiens
gggaaaacauaguggauga

SEQ ID NO: 1208803 - RNA, 19 nt, Homo sapiens
gaugacgccuuggcuguuc

SEQ ID NO: 1208804 - RNA, 19 nt, Homo sapiens
caucaucuuugccagacaa

SEQ ID NO: 1208805 - RNA, 19 nt, Homo sapiens
gguguggaauugcccuuug

SEQ ID NO: 1208806 - RNA, 19 nt, Homo sapiens
ccaguccagucacuuguug

SEQ ID NO: 1208807 - RNA, 19 nt, Homo sapiens
ugacuuaccaggccuacaa

SEQ ID NO: 1208808 - RNA, 19 nt, Homo sapiens
cuuacuagcuguaugaucu

SEQ ID NO: 1208809 - RNA, 19 nt, Homo sapiens
ggaacaauuagcaacagaa

SEQ ID NO: 1208810 - RNA, 19 nt, Homo sapiens
ucuauucuaucacuucaga

SEQ ID NO: 1208811 - RNA, 19 nt, Homo sapiens
gcacaaggacuggguagca

SEQ ID NO: 1208812 - RNA, 19 nt, Homo sapiens
agggagaucuucaaguuca

SEQ ID NO: 1208813 - RNA, 19 nt, Homo sapiens
ccaauucccaaguuuguga

SEQ ID NO: 1208814 - RNA, 19 nt, Homo sapiens
augcugacauuccauugua

SEQ ID NO: 1208815 - RNA, 19 nt, Homo sapiens
gacaugauuugugaauauc

SEQ ID NO: 1208816 - RNA, 19 nt, Homo sapiens
ucuggauacuucaaggaua

SEQ ID NO: 1208817 - RNA, 19 nt, Homo sapiens
gcugcggugugguuucaaa

SEQ ID NO: 1208818 - RNA, 19 nt, Homo sapiens
ggaggucccugccuaugcu

SEQ ID NO: 1208819 - RNA, 19 nt, Homo sapiens
uggcggcucuggucacuau

SEQ ID NO: 1208820 - RNA, 19 nt, Homo sapiens
cucaggaccuucaagauuc

SEQ ID NO: 1208821 - RNA, 19 nt, Homo sapiens
ccaccuggacagaggcuua

SEQ ID NO: 1208822 - RNA, 19 nt, Homo sapiens
cuaugucucuguauuugug

SEQ ID NO: 1208823 - RNA, 19 nt, Homo sapiens
ggaauguaaauuugacugu

SEQ ID NO: 1208824 - RNA, 19 nt, Homo sapiens
uauuggugcugcugcauga

SEQ ID NO: 1208825 - RNA, 19 nt, Homo sapiens
ucucacagguuucauucug

SEQ ID NO: 1208826 - RNA, 19 nt, Homo sapiens
gaaguggagucuggauacu

SEQ ID NO: 1208827 - RNA, 19 nt, Homo sapiens
gggcugcggugugguuuca

SEQ ID NO: 1208828 - RNA, 19 nt, Homo sapiens
gcucaagguuagcugucuu

SEQ ID NO: 1208829 - RNA, 19 nt, Homo sapiens
gacauuccauuguagaaaa

SEQ ID NO: 1208830 - RNA, 19 nt, Homo sapiens
aaacaucccacuacaacau

SEQ ID NO: 1208831 - RNA, 19 nt, Homo sapiens
gcaauaagcugguuuguuc

SEQ ID NO: 1208832 - RNA, 19 nt, Homo sapiens
caacagcucugacuucuau

SEQ ID NO: 1208833 - RNA, 19 nt, Homo sapiens
gaucauagcuccugguuac

SEQ ID NO: 1208834 - RNA, 19 nt, Homo sapiens
ggucaagacugaacuguga

SEQ ID NO: 1208835 - RNA, 19 nt, Homo sapiens
caacaucacugcauauugg

SEQ ID NO: 1208836 - RNA, 19 nt, Homo sapiens
agagagcagucauaucuua

SEQ ID NO: 1208837 - RNA, 19 nt, Homo sapiens
ccaccaggcuucuuucuga

SEQ ID NO: 1208838 - RNA, 19 nt, Homo sapiens
ugaaguaagaggagaauua

SEQ ID NO: 1208839 - RNA, 19 nt, Homo sapiens
gaagaaagaagaagguguu

SEQ ID NO: 1208840 - RNA, 19 nt, Homo sapiens
gaagagaugugugccugaa

SEQ ID NO: 1208841 - RNA, 19 nt, Homo sapiens
caacagcagcagcaacuua

SEQ ID NO: 1208842 - RNA, 19 nt, Homo sapiens
ggagaugacugugguagga

SEQ ID NO: 1208843 - RNA, 19 nt, Homo sapiens
cuucagacuugguuucuua

SEQ ID NO: 1208844 - RNA, 19 nt, Homo sapiens
ucaugaggaucuauaagua

SEQ ID NO: 1208845 - RNA, 19 nt, Homo sapiens
ggaaauccaagccaguaua

SEQ ID NO: 1208846 - RNA, 19 nt, Homo sapiens
gagguuagccugguacuuu

SEQ ID NO: 1208847 - RNA, 19 nt, Homo sapiens
agagaugugugccugaaua

SEQ ID NO: 1208848 - RNA, 19 nt, Homo sapiens
ccagaugguuacaaauaaa

SEQ ID NO: 1208849 - RNA, 19 nt, Homo sapiens
gaaguaagaggagaauuau

SEQ ID NO: 1208850 - RNA, 19 nt, Homo sapiens
gcucugcuguggcccauuu

SEQ ID NO: 1208851 - RNA, 19 nt, Homo sapiens
gcaacaauauaaagaagag

SEQ ID NO: 1208852 - RNA, 19 nt, Homo sapiens
gaggaaugcaacaauauaa

SEQ ID NO: 1208853 - RNA, 19 nt, Homo sapiens
guagagagcagucauaucu

SEQ ID NO: 1208854 - RNA, 19 nt, Homo sapiens
ucaacaagcagcacuauga

SEQ ID NO: 1208855 - RNA, 19 nt, Homo sapiens
gacacuagcuugaaguaag

SEQ ID NO: 1208856 - RNA, 19 nt, Homo sapiens
gcagagaacuaugagucuu

SEQ ID NO: 1208857 - RNA, 19 nt, Homo sapiens
gaaauccaagccaguauau

SEQ ID NO: 1208858 - RNA, 19 nt, Homo sapiens
gggagagccugggaacuuu

SEQ ID NO: 1208859 - RNA, 19 nt, Homo sapiens
gaagagaaguccccagaug

SEQ ID NO: 1208860 - RNA, 19 nt, Homo sapiens
ugagguaccuaguucagaa

SEQ ID NO: 1208861 - RNA, 19 nt, Homo sapiens
gauuugagguaccuaguuc

SEQ ID NO: 1208862 - RNA, 19 nt, Homo sapiens
guaggauucuucagagguu

SEQ ID NO: 1208863 - RNA, 19 nt, Homo sapiens
agacuugguuucuuagcua

SEQ ID NO: 1208864 - RNA, 19 nt, Homo sapiens
acgcagcgcuuuauugaug

SEQ ID NO: 1208865 - RNA, 19 nt, Homo sapiens
gaauagucgucaccauauc

SEQ ID NO: 1208866 - RNA, 19 nt, Homo sapiens
gcuagaaaccagaagacua

SEQ ID NO: 1208867 - RNA, 19 nt, Homo sapiens
aauccaagccaguauauuu

SEQ ID NO: 1208868 - RNA, 19 nt, Homo sapiens
cagagaacuaugagucuua

SEQ ID NO: 1208869 - RNA, 19 nt, Homo sapiens
ucacgcagcgcuuuauuga

SEQ ID NO: 1208870 - RNA, 19 nt, Homo sapiens
uggaggaggucauggagaa

SEQ ID NO: 1208871 - RNA, 19 nt, Homo sapiens
acacuagcuugaaguaaga

SEQ ID NO: 1208872 - RNA, 19 nt, Homo sapiens
ggaaugcaacaauauaaag

SEQ ID NO: 1208873 - RNA, 19 nt, Homo sapiens
ugaggaaugcaacaauaua

SEQ ID NO: 1208874 - RNA, 19 nt, Homo sapiens
augcaaagauugaggaaug

SEQ ID NO: 1208875 - RNA, 19 nt, Homo sapiens
gggaauauaaggcagagaa

SEQ ID NO: 1208876 - RNA, 19 nt, Homo sapiens
ccuacugucugccuauauu

SEQ ID NO: 1208877 - RNA, 19 nt, Homo sapiens
gaccuacugucugccuaua

SEQ ID NO: 1208878 - RNA, 19 nt, Homo sapiens
caucugcccugucaacauc

SEQ ID NO: 1208879 - RNA, 19 nt, Homo sapiens
caacauccuuaccacagau

SEQ ID NO: 1208880 - RNA, 19 nt, Homo sapiens
ccaacauccuuaccacaga

SEQ ID NO: 1208881 - RNA, 19 nt, Homo sapiens
ccacaauggacaaucaauu

SEQ ID NO: 1208882 - RNA, 19 nt, Homo sapiens
cagcagcaacuuaaccuuu

SEQ ID NO: 1208883 - RNA, 19 nt, Homo sapiens
gccauucucuuccuuaugc

SEQ ID NO: 1208884 - RNA, 19 nt, Homo sapiens
cagaaaaccuaagaaauga

SEQ ID NO: 1208885 - RNA, 19 nt, Homo sapiens
ugaggcaaccuacaagaaa

SEQ ID NO: 1208886 - RNA, 19 nt, Homo sapiens
ugaauagucgucaccauau

SEQ ID NO: 1208887 - RNA, 19 nt, Homo sapiens
aauauaaggcagagaacua

SEQ ID NO: 1208888 - RNA, 19 nt, Homo sapiens
gggugcagaucgacgugua

SEQ ID NO: 1208889 - RNA, 19 nt, Homo sapiens
ggacacuagcuugaaguaa

SEQ ID NO: 1208890 - RNA, 19 nt, Homo sapiens
uagaagggaagaucagaaa

SEQ ID NO: 1208891 - RNA, 19 nt, Homo sapiens
ccaagccaguauauuuguu

SEQ ID NO: 1208892 - RNA, 19 nt, Homo sapiens
uguaccagguggcguauga

SEQ ID NO: 1208893 - RNA, 19 nt, Homo sapiens
gggaguccaccuuuguuaa

SEQ ID NO: 1208894 - RNA, 19 nt, Homo sapiens
aagaggagaauuaugcuuu

SEQ ID NO: 1208895 - RNA, 19 nt, Homo sapiens
guucaucccagcagaagaa

SEQ ID NO: 1208896 - RNA, 19 nt, Homo sapiens
cugaauagucgucaccaua

SEQ ID NO: 1208897 - RNA, 19 nt, Homo sapiens
acuguggacuugauagauu

SEQ ID NO: 1208898 - RNA, 19 nt, Homo sapiens
caagccaguauauuuguuu

SEQ ID NO: 1208899 - RNA, 19 nt, Homo sapiens
gcucugacuucuaugacau

SEQ ID NO: 1208900 - RNA, 19 nt, Homo sapiens
uggaggagacugacuggua

SEQ ID NO: 1208901 - RNA, 19 nt, Homo sapiens
caauugaggcaaccuacaa

SEQ ID NO: 1208902 - RNA, 19 nt, Homo sapiens
guaccaggcccacggcuau

SEQ ID NO: 1208903 - RNA, 19 nt, Homo sapiens
ccuaagaaaugaucauagc

SEQ ID NO: 1208904 - RNA, 19 nt, Homo sapiens
ugcacaaggucaagacuga

SEQ ID NO: 1208905 - RNA, 19 nt, Homo sapiens
gaucagaaaaccuaagaaa

SEQ ID NO: 1208906 - RNA, 19 nt, Homo sapiens
ccucauguaucaagcaucu

SEQ ID NO: 1208907 - RNA, 19 nt, Homo sapiens
gcaggagccaugucacuag

SEQ ID NO: 1208908 - RNA, 19 nt, Homo sapiens
gcagaagaaagaagaaggu

SEQ ID NO: 1208909 - RNA, 19 nt, Homo sapiens
ucagaaaaccuaagaaaug

SEQ ID NO: 1208910 - RNA, 19 nt, Homo sapiens
gcaacagcucugacuucua

SEQ ID NO: 1208911 - RNA, 19 nt, Homo sapiens
caucccagcagaagaaaga

SEQ ID NO: 1208912 - RNA, 19 nt, Homo sapiens
gaugugugccugaauaguc

SEQ ID NO: 1208913 - RNA, 19 nt, Homo sapiens
guagaagggaagaucagaa

SEQ ID NO: 1208914 - RNA, 19 nt, Homo sapiens
ggcaacagcucugacuucu

SEQ ID NO: 1208915 - RNA, 19 nt, Homo sapiens
uggagaaguucaugaggau

SEQ ID NO: 1208916 - RNA, 19 nt, Homo sapiens
gaggcaaccuacaagaaaa

SEQ ID NO: 1208917 - RNA, 19 nt, Homo sapiens
agagaacuaugagucuuau

SEQ ID NO: 1208918 - RNA, 19 nt, Homo sapiens
ccagguggcguaugagaau

SEQ ID NO: 1208919 - RNA, 19 nt, Homo sapiens
uaaaguagaagggaagauc

SEQ ID NO: 1208920 - RNA, 19 nt, Homo sapiens
cuacugucugccuauauua

SEQ ID NO: 1208921 - RNA, 19 nt, Homo sapiens
caacaucugcccugucaac

SEQ ID NO: 1208922 - RNA, 19 nt, Homo sapiens
augcgaggcuguaggaaga

SEQ ID NO: 1208923 - RNA, 19 nt, Homo sapiens
cauagcuccugguuacugu

SEQ ID NO: 1208924 - RNA, 19 nt, Homo sapiens
gaaaagagaaggaaaucca

SEQ ID NO: 1208925 - RNA, 19 nt, Homo sapiens
gaauuaugcuuuucuuugc

SEQ ID NO: 1208926 - RNA, 19 nt, Homo sapiens
gggaagaucagaaaaccua

SEQ ID NO: 1208927 - RNA, 19 nt, Homo sapiens
uaacaugacccagcacucu

SEQ ID NO: 1208928 - RNA, 19 nt, Homo sapiens
cuagaaaccagaagacuac

SEQ ID NO: 1208929 - RNA, 19 nt, Homo sapiens
gagaaguucaugaggaucu

SEQ ID NO: 1208930 - RNA, 19 nt, Homo sapiens
gaguccaccuuuguuaaca

SEQ ID NO: 1208931 - RNA, 19 nt, Homo sapiens
gagcugaccuuccaugaau

SEQ ID NO: 1208932 - RNA, 19 nt, Homo sapiens
ucacaucucugcccucaaa

SEQ ID NO: 1208933 - RNA, 19 nt, Homo sapiens
gagaugauucugcuacuuu

SEQ ID NO: 1208934 - RNA, 19 nt, Homo sapiens
gcaaaggugauucagagaa

SEQ ID NO: 1208935 - RNA, 19 nt, Homo sapiens
ggccugagcuccagcaucu

SEQ ID NO: 1208936 - RNA, 19 nt, Homo sapiens
gccaugggcuguaaguugu

SEQ ID NO: 1208937 - RNA, 19 nt, Homo sapiens
gggcucagguggcagcuau

SEQ ID NO: 1208938 - RNA, 19 nt, Homo sapiens
ggccaugggcuguaaguug

SEQ ID NO: 1208939 - RNA, 19 nt, Homo sapiens
gaggaggccacuaaucuuc

SEQ ID NO: 1208940 - RNA, 19 nt, Homo sapiens
gcuacucccucuuugucuu

SEQ ID NO: 1208941 - RNA, 19 nt, Homo sapiens
gggagcagaaggagaagaa

SEQ ID NO: 1208942 - RNA, 19 nt, Homo sapiens
ggaggccacuaaucuucug

SEQ ID NO: 1208943 - RNA, 19 nt, Homo sapiens
ugagucgguuggagucuga

SEQ ID NO: 1208944 - RNA, 19 nt, Homo sapiens
cuacggcuacucccucuuu

SEQ ID NO: 1208945 - RNA, 19 nt, Homo sapiens
gcuauggagccgaggauga

SEQ ID NO: 1208946 - RNA, 19 nt, Homo sapiens
ccaccugcuuucccuccua

SEQ ID NO: 1208947 - RNA, 19 nt, Homo sapiens
cugcuacuuuccagacuuu

SEQ ID NO: 1208948 - RNA, 19 nt, Homo sapiens
ugagaugauucugcuacuu

SEQ ID NO: 1208949 - RNA, 19 nt, Homo sapiens
ccacaggcaacaccuaagu

SEQ ID NO: 1208950 - RNA, 19 nt, Homo sapiens
gcagccaccaccagcagaa

SEQ ID NO: 1208951 - RNA, 19 nt, Homo sapiens
cgaggaggccacuaaucuu

SEQ ID NO: 1208952 - RNA, 19 nt, Homo sapiens
cgagcugaccuuccaugaa

SEQ ID NO: 1208953 - RNA, 19 nt, Homo sapiens
ggaccuucagcuacuauca

SEQ ID NO: 1208954 - RNA, 19 nt, Homo sapiens
gauucuggaccuucagcua

SEQ ID NO: 1208955 - RNA, 19 nt, Homo sapiens
ccgacgagcugaccuucca

SEQ ID NO: 1208956 - RNA, 19 nt, Homo sapiens
gcuccagcaucugaguuug

SEQ ID NO: 1208957 - RNA, 19 nt, Homo sapiens
uuugacaccuugagaugau

SEQ ID NO: 1208958 - RNA, 19 nt, Homo sapiens
acaccuuccuggagacugu

SEQ ID NO: 1208959 - RNA, 19 nt, Homo sapiens
uggcugcaguggcucuuug

SEQ ID NO: 1208960 - RNA, 19 nt, Homo sapiens
uggcaggcaucagcaucua

SEQ ID NO: 1208961 - RNA, 19 nt, Homo sapiens
agaugauucugcuacuuuc

SEQ ID NO: 1208962 - RNA, 19 nt, Homo sapiens
gagcagaaggagaagaaaa

SEQ ID NO: 1208963 - RNA, 19 nt, Homo sapiens
ccugagcuccagcaucuga

SEQ ID NO: 1208964 - RNA, 19 nt, Homo sapiens
cagccgagcagggagcuuu

SEQ ID NO: 1208965 - RNA, 19 nt, Homo sapiens
ucgaggaggccacuaaucu

SEQ ID NO: 1208966 - RNA, 19 nt, Homo sapiens
caccugcuuucccuccuau

SEQ ID NO: 1208967 - RNA, 19 nt, Homo sapiens
gcugaccuuccaugaauuc

SEQ ID NO: 1208968 - RNA, 19 nt, Homo sapiens
uggagacugugugcaucua

SEQ ID NO: 1208969 - RNA, 19 nt, Homo sapiens
acuaucagagcuucuuuga

SEQ ID NO: 1208970 - RNA, 19 nt, Homo sapiens
caacaagaauuaccaauca

SEQ ID NO: 1208971 - RNA, 19 nt, Homo sapiens
caaugaagcuggaguugaa

SEQ ID NO: 1208972 - RNA, 19 nt, Homo sapiens
gaagaaauuuacaccaaca

SEQ ID NO: 1208973 - RNA, 19 nt, Homo sapiens
gcugagggcuucauugaug

SEQ ID NO: 1208974 - RNA, 19 nt, Homo sapiens
ccaaucagguugaacaaga

SEQ ID NO: 1208975 - RNA, 19 nt, Homo sapiens
gagcuuugcugacaucuuc

SEQ ID NO: 1208976 - RNA, 19 nt, Homo sapiens
gaagacaucgccaguccua

SEQ ID NO: 1208977 - RNA, 19 nt, Homo sapiens
gaggagggcccuucacaaa

SEQ ID NO: 1208978 - RNA, 19 nt, Homo sapiens
gaaauuuacaccaacaaga

SEQ ID NO: 1208979 - RNA, 19 nt, Homo sapiens
gaguucagcuuggaagaaa

SEQ ID NO: 1208980 - RNA, 19 nt, Homo sapiens
gaacucaggaccacaauac

SEQ ID NO: 1208981 - RNA, 19 nt, Homo sapiens
gagcugagcccaugaggau

SEQ ID NO: 1208982 - RNA, 19 nt, Homo sapiens
gaagaggguaucugcuuga

SEQ ID NO: 1208983 - RNA, 19 nt, Homo sapiens
uggaagaaauuuacaccaa

SEQ ID NO: 1208984 - RNA, 19 nt, Homo sapiens
ggagagcuuugcugacauc

SEQ ID NO: 1208985 - RNA, 19 nt, Homo sapiens
ggacuguuccucccaaugu

SEQ ID NO: 1208986 - RNA, 19 nt, Homo sapiens
caaucagguugaacaagaa

SEQ ID NO: 1208987 - RNA, 19 nt, Homo sapiens
aaagguuucucgauucaga

SEQ ID NO: 1208988 - RNA, 19 nt, Homo sapiens
gaagaugucauggcuguuc

SEQ ID NO: 1208989 - RNA, 19 nt, Homo sapiens
gccucugacucgagcauua

SEQ ID NO: 1208990 - RNA, 19 nt, Homo sapiens
gcaaugggacucugauuuu

SEQ ID NO: 1208991 - RNA, 19 nt, Homo sapiens
gcuaaaccuuacaccaaug

SEQ ID NO: 1208992 - RNA, 19 nt, Homo sapiens
cagcuaaaccuuacaccaa

SEQ ID NO: 1208993 - RNA, 19 nt, Homo sapiens
ccaccaccguccagccuuu

SEQ ID NO: 1208994 - RNA, 19 nt, Homo sapiens
caucaucccagcacaaaga

SEQ ID NO: 1208995 - RNA, 19 nt, Homo sapiens
ggaggaagaaacaguagau

SEQ ID NO: 1208996 - RNA, 19 nt, Homo sapiens
ggacugccucgaccaauca

SEQ ID NO: 1208997 - RNA, 19 nt, Homo sapiens
ggaaaccucccaggcaguu

SEQ ID NO: 1208998 - RNA, 19 nt, Homo sapiens
caaccaggaggaccuuuga

SEQ ID NO: 1208999 - RNA, 19 nt, Homo sapiens
cagcagccuuccucgauca

SEQ ID NO: 1209000 - RNA, 19 nt, Homo sapiens
gggacugccucgaccaauc

SEQ ID NO: 1209001 - RNA, 19 nt, Homo sapiens
ggaguucagcuuggaagaa

SEQ ID NO: 1209002 - RNA, 19 nt, Homo sapiens
gaaaccucccaggcaguua

SEQ ID NO: 1209003 - RNA, 19 nt, Homo sapiens
gacagcagccuuccucgau

SEQ ID NO: 1209004 - RNA, 19 nt, Homo sapiens
ccaacaagaauuaccaauc

SEQ ID NO: 1209005 - RNA, 19 nt, Homo sapiens
gugaagaggguaucugcuu

SEQ ID NO: 1209006 - RNA, 19 nt, Homo sapiens
ggaggaccuuugagaccau

SEQ ID NO: 1209007 - RNA, 19 nt, Homo sapiens
gaaggaguucagcuuggaa

SEQ ID NO: 1209008 - RNA, 19 nt, Homo sapiens
agaccaagaccaugggaaa

SEQ ID NO: 1209009 - RNA, 19 nt, Homo sapiens
ccaaugaagcuggaguuga

SEQ ID NO: 1209010 - RNA, 19 nt, Homo sapiens
ggagggcccuucacaaaag

SEQ ID NO: 1209011 - RNA, 19 nt, Homo sapiens
agaaggaguucagcuugga

SEQ ID NO: 1209012 - RNA, 19 nt, Homo sapiens
agacaucgccaguccuaga

SEQ ID NO: 1209013 - RNA, 19 nt, Homo sapiens
guucagcuuggaagaaauu

SEQ ID NO: 1209014 - RNA, 19 nt, Homo sapiens
ggaccaggugcuuucagaa

SEQ ID NO: 1209015 - RNA, 19 nt, Homo sapiens
cuggagagcuuugcugaca

SEQ ID NO: 1209016 - RNA, 19 nt, Homo sapiens
ccacagcuaccaucaggau

SEQ ID NO: 1209017 - RNA, 19 nt, Homo sapiens
cgaccaaucagguugaaca

SEQ ID NO: 1209018 - RNA, 19 nt, Homo sapiens
ccgcugagggcuucauuga

SEQ ID NO: 1209019 - RNA, 19 nt, Homo sapiens
cgcaaugggacucugauuu

SEQ ID NO: 1209020 - RNA, 19 nt, Homo sapiens
ccuuugagaccaucuuuga

SEQ ID NO: 1209021 - RNA, 19 nt, Homo sapiens
acaagaaggaguucagcuu

SEQ ID NO: 1209022 - RNA, 19 nt, Homo sapiens
uaccacagcaccacagcua

SEQ ID NO: 1209023 - RNA, 19 nt, Homo sapiens
ggaccuaggugccccaucu

SEQ ID NO: 1209024 - RNA, 19 nt, Homo sapiens
ccaagaccaugggaaaggu

SEQ ID NO: 1209025 - RNA, 19 nt, Homo sapiens
ggcccugucuccggaaaga

SEQ ID NO: 1209026 - RNA, 19 nt, Homo sapiens
ccucaaagcagaccuccau

SEQ ID NO: 1209027 - RNA, 19 nt, Homo sapiens
gagcgcaaugggacucuga

SEQ ID NO: 1209028 - RNA, 19 nt, Homo sapiens
gaccuuugagaccaucuuu

SEQ ID NO: 1209029 - RNA, 19 nt, Homo sapiens
cguccucagcuaaaccuua

SEQ ID NO: 1209030 - RNA, 19 nt, Homo sapiens
gagccaagagccucaaagg

SEQ ID NO: 1209031 - RNA, 19 nt, Homo sapiens
gcugagcccaugaggauag

SEQ ID NO: 1209032 - RNA, 19 nt, Homo sapiens
ggugcuagaagaugucaug

SEQ ID NO: 1209033 - RNA, 19 nt, Homo sapiens
cgaacucaggaccacaaua

SEQ ID NO: 1209034 - RNA, 19 nt, Homo sapiens
guccucagcuaaaccuuac

SEQ ID NO: 1209035 - RNA, 19 nt, Homo sapiens
gcgcaaugggacucugauu

SEQ ID NO: 1209036 - RNA, 19 nt, Homo sapiens
gaccaaucagguugaacaa

SEQ ID NO: 1209037 - RNA, 19 nt, Homo sapiens
caaagagcugagcccauga

SEQ ID NO: 1209038 - RNA, 19 nt, Homo sapiens
ccuggaggaagaaacagua

SEQ ID NO: 1209039 - RNA, 19 nt, Homo sapiens
gacuguuccucccaaugug

SEQ ID NO: 1209040 - RNA, 19 nt, Homo sapiens
cagcuuggaagaaauuuac

SEQ ID NO: 1209041 - RNA, 19 nt, Homo sapiens
ucagcuuggaagaaauuua

SEQ ID NO: 1209042 - RNA, 19 nt, Homo sapiens
agcuaaaccuuacaccaau

SEQ ID NO: 1209043 - RNA, 19 nt, Homo sapiens
aggaccaggugcuuucaga

SEQ ID NO: 1209044 - RNA, 19 nt, Homo sapiens
gaagcuggaguugaagauc

SEQ ID NO: 1209045 - RNA, 19 nt, Homo sapiens
caaagggaaggagccaaga

SEQ ID NO: 1209046 - RNA, 19 nt, Homo sapiens
cagaggagggcccuucaca

SEQ ID NO: 1209047 - RNA, 19 nt, Homo sapiens
aaaccucccaggcaguuau

SEQ ID NO: 1209048 - RNA, 19 nt, Homo sapiens
gguugaacaagaaggaguu

SEQ ID NO: 1209049 - RNA, 19 nt, Homo sapiens
gaccaggugcuuucagaac

SEQ ID NO: 1209050 - RNA, 19 nt, Homo sapiens
gagcccaugaggauaguuc

SEQ ID NO: 1209051 - RNA, 19 nt, Homo sapiens
gaacaagacgaauuugaua

SEQ ID NO: 1209052 - RNA, 19 nt, Homo sapiens
gacuagcucuggauuauuu

SEQ ID NO: 1209053 - RNA, 19 nt, Homo sapiens
gaagaaggccagcaugauu

SEQ ID NO: 1209054 - RNA, 19 nt, Homo sapiens
ggacagagguguggccuau

SEQ ID NO: 1209055 - RNA, 19 nt, Homo sapiens
gaaaggagccacaccacaa

SEQ ID NO: 1209056 - RNA, 19 nt, Homo sapiens
ccaacaaccugguccauau

SEQ ID NO: 1209057 - RNA, 19 nt, Homo sapiens
gaagcagauuggaguguuu

SEQ ID NO: 1209058 - RNA, 19 nt, Homo sapiens
ugacagaagugcucagaga

SEQ ID NO: 1209059 - RNA, 19 nt, Homo sapiens
gaagaggaguuugaagaug

SEQ ID NO: 1209060 - RNA, 19 nt, Homo sapiens
gcagcaaguugguggcuuu

SEQ ID NO: 1209061 - RNA, 19 nt, Homo sapiens
gaacagcacagaaccuaga

SEQ ID NO: 1209062 - RNA, 19 nt, Homo sapiens
ccacaaagcggguaucaug

SEQ ID NO: 1209063 - RNA, 19 nt, Homo sapiens
gcagagaaccgguuuacug

SEQ ID NO: 1209064 - RNA, 19 nt, Homo sapiens
ggagaagucuggaggacau

SEQ ID NO: 1209065 - RNA, 19 nt, Homo sapiens
gcgggaggguucaguauug

SEQ ID NO: 1209066 - RNA, 19 nt, Homo sapiens
gagaagaaggccagcauga

SEQ ID NO: 1209067 - RNA, 19 nt, Homo sapiens
aagaggaguuugaagauga

SEQ ID NO: 1209068 - RNA, 19 nt, Homo sapiens
ccaaguuccugguuaagug

SEQ ID NO: 1209069 - RNA, 19 nt, Homo sapiens
guaccuuguucugaaauaa

SEQ ID NO: 1209070 - RNA, 19 nt, Homo sapiens
acagagguguggccuauug

SEQ ID NO: 1209071 - RNA, 19 nt, Homo sapiens
gaagcuguuugcuguggaa

SEQ ID NO: 1209072 - RNA, 19 nt, Homo sapiens
ggaagaggaguuugaagau

SEQ ID NO: 1209073 - RNA, 19 nt, Homo sapiens
gaguggaucuugccagaag

SEQ ID NO: 1209074 - RNA, 19 nt, Homo sapiens
gcagugaggccauaccaau

SEQ ID NO: 1209075 - RNA, 19 nt, Homo sapiens
acaaccugguccauauuua

SEQ ID NO: 1209076 - RNA, 19 nt, Homo sapiens
uggauuauuuccucggaua

SEQ ID NO: 1209077 - RNA, 19 nt, Homo sapiens
ggacagcugaggagaugaa

SEQ ID NO: 1209078 - RNA, 19 nt, Homo sapiens
gcaaguugguggcuuugag

SEQ ID NO: 1209079 - RNA, 19 nt, Homo sapiens
gaagagugacagugacaga

SEQ ID NO: 1209080 - RNA, 19 nt, Homo sapiens
ccagggagcucugcagaca

SEQ ID NO: 1209081 - RNA, 19 nt, Homo sapiens
gcuccagugucuuccauug

SEQ ID NO: 1209082 - RNA, 19 nt, Homo sapiens
gauccugucauccaaugua

SEQ ID NO: 1209083 - RNA, 19 nt, Homo sapiens
gcaggacaacccaccauga

SEQ ID NO: 1209084 - RNA, 19 nt, Homo sapiens
agacgaauuugauaaaguc

SEQ ID NO: 1209085 - RNA, 19 nt, Homo sapiens
cagagaagagugacaguga

SEQ ID NO: 1209086 - RNA, 19 nt, Homo sapiens
uauuguaccuuguucugaa

SEQ ID NO: 1209087 - RNA, 19 nt, Homo sapiens
gcucauccaugcccaaggu

SEQ ID NO: 1209088 - RNA, 19 nt, Homo sapiens
caagacgaauuugauaaag

SEQ ID NO: 1209089 - RNA, 19 nt, Homo sapiens
caacaaccugguccauauu

SEQ ID NO: 1209090 - RNA, 19 nt, Homo sapiens
ggcccuggcugaccaugaa

SEQ ID NO: 1209091 - RNA, 19 nt, Homo sapiens
caacaagaaaggccuguca

SEQ ID NO: 1209092 - RNA, 19 nt, Homo sapiens
gagcuggaauguggaguca

SEQ ID NO: 1209093 - RNA, 19 nt, Homo sapiens
agaagcagaugaccuggau

SEQ ID NO: 1209094 - RNA, 19 nt, Homo sapiens
ggaagaacucccagaagca

SEQ ID NO: 1209095 - RNA, 19 nt, Homo sapiens
caacauggcggugaugauc

SEQ ID NO: 1209096 - RNA, 19 nt, Homo sapiens
ucuccaaguuccugguuaa

SEQ ID NO: 1209097 - RNA, 19 nt, Homo sapiens
gcucagagagacagcaaga

SEQ ID NO: 1209098 - RNA, 19 nt, Homo sapiens
ccaccugggucguguccaa

SEQ ID NO: 1209099 - RNA, 19 nt, Homo sapiens
ugaagcagauuggaguguu

SEQ ID NO: 1209100 - RNA, 19 nt, Homo sapiens
guucugaaauaaagcaucu

SEQ ID NO: 1209101 - RNA, 19 nt, Homo sapiens
gcucaggcuuccucugcuu

SEQ ID NO: 1209102 - RNA, 19 nt, Homo sapiens
gcacaauggacgccagugu

SEQ ID NO: 1209103 - RNA, 19 nt, Homo sapiens
caggaugagucucuagauc

SEQ ID NO: 1209104 - RNA, 19 nt, Homo sapiens
gauaaaguccuggcaagca

SEQ ID NO: 1209105 - RNA, 19 nt, Homo sapiens
uaaggccugucucuacuuc

SEQ ID NO: 1209106 - RNA, 19 nt, Homo sapiens
ccuggcgacuuucccuaua

SEQ ID NO: 1209107 - RNA, 19 nt, Homo sapiens
ccuagcugcuuccucugua

SEQ ID NO: 1209108 - RNA, 19 nt, Homo sapiens
cagagauuguugcuaguuc

SEQ ID NO: 1209109 - RNA, 19 nt, Homo sapiens
ggacuagcucuggauuauu

SEQ ID NO: 1209110 - RNA, 19 nt, Homo sapiens
gcagcgggaggguucagua

SEQ ID NO: 1209111 - RNA, 19 nt, Homo sapiens
ugaacaagacgaauuugau

SEQ ID NO: 1209112 - RNA, 19 nt, Homo sapiens
gcaguuugcagaagcuguu

SEQ ID NO: 1209113 - RNA, 19 nt, Homo sapiens
cagaacagcacagaaccua

SEQ ID NO: 1209114 - RNA, 19 nt, Homo sapiens
ggaacaagguccccaacau

SEQ ID NO: 1209115 - RNA, 19 nt, Homo sapiens
uggcuaaauuccagacaga

SEQ ID NO: 1209116 - RNA, 19 nt, Homo sapiens
aggacuagcucuggauuau

SEQ ID NO: 1209117 - RNA, 19 nt, Homo sapiens
ucuacucccucaaggacua

SEQ ID NO: 1209118 - RNA, 19 nt, Homo sapiens
caacuccacugggaagucu

SEQ ID NO: 1209119 - RNA, 19 nt, Homo sapiens
gaacaagguccccaacaug

SEQ ID NO: 1209120 - RNA, 19 nt, Homo sapiens
uaaauuccagacagagauu

SEQ ID NO: 1209121 - RNA, 19 nt, Homo sapiens
gcuaaauuccagacagaga

SEQ ID NO: 1209122 - RNA, 19 nt, Homo sapiens
uggaggacaucaugguuuc

SEQ ID NO: 1209123 - RNA, 19 nt, Homo sapiens
uggaagaggaguuugaaga

SEQ ID NO: 1209124 - RNA, 19 nt, Homo sapiens
uccauugggucuccuguug

SEQ ID NO: 1209125 - RNA, 19 nt, Homo sapiens
ccauuccagucuccaaguu

SEQ ID NO: 1209126 - RNA, 19 nt, Homo sapiens
guuugaagaugaggauuuc

SEQ ID NO: 1209127 - RNA, 19 nt, Homo sapiens
gagaagagugacagugaca

SEQ ID NO: 1209128 - RNA, 19 nt, Homo sapiens
ugaggaagaacucccagaa

SEQ ID NO: 1209129 - RNA, 19 nt, Homo sapiens
gagugacagugacagaagu

SEQ ID NO: 1209130 - RNA, 19 nt, Homo sapiens
gaggauauugggccugguu

SEQ ID NO: 1209131 - RNA, 19 nt, Homo sapiens
auggugcucuggcuaaauu

SEQ ID NO: 1209132 - RNA, 19 nt, Homo sapiens
gcuagagggaccauucaga

SEQ ID NO: 1209133 - RNA, 19 nt, Homo sapiens
uagauccugucauccaaug

SEQ ID NO: 1209134 - RNA, 19 nt, Homo sapiens
ccuccaggcugcugcuguu

SEQ ID NO: 1209135 - RNA, 19 nt, Homo sapiens
ggccugaacaagacgaauu

SEQ ID NO: 1209136 - RNA, 19 nt, Homo sapiens
uguaccuuguucugaaaua

SEQ ID NO: 1209137 - RNA, 19 nt, Homo sapiens
aagaaggccagcaugauug

SEQ ID NO: 1209138 - RNA, 19 nt, Homo sapiens
ggcaaucagagaagaguga

SEQ ID NO: 1209139 - RNA, 19 nt, Homo sapiens
cagggagcuuccagcauga

SEQ ID NO: 1209140 - RNA, 19 nt, Homo sapiens
ccaggcugcugcuguuaca

SEQ ID NO: 1209141 - RNA, 19 nt, Homo sapiens
caaaaucguuucccuuguc

SEQ ID NO: 1209142 - RNA, 19 nt, Homo sapiens
auucagagcagcccucaaa

SEQ ID NO: 1209143 - RNA, 19 nt, Homo sapiens
gagccacaccacaacaaug

SEQ ID NO: 1209144 - RNA, 19 nt, Homo sapiens
uaaguggcaaagcucauuu

SEQ ID NO: 1209145 - RNA, 19 nt, Homo sapiens
gcuauggcgugcaguuugc

SEQ ID NO: 1209146 - RNA, 19 nt, Homo sapiens
uggcaagcauggaguugga

SEQ ID NO: 1209147 - RNA, 19 nt, Homo sapiens
gaggaagaacucccagaag

SEQ ID NO: 1209148 - RNA, 19 nt, Homo sapiens
ccauggugcucuggcuaaa

SEQ ID NO: 1209149 - RNA, 19 nt, Homo sapiens
caaggacuagcucuggauu

SEQ ID NO: 1209150 - RNA, 19 nt, Homo sapiens
ggaugcagagaaccgguuu

SEQ ID NO: 1209151 - RNA, 19 nt, Homo sapiens
ggacaggaauauaugaaua

SEQ ID NO: 1209152 - RNA, 19 nt, Homo sapiens
guacagagauggaaaccuu

SEQ ID NO: 1209153 - RNA, 19 nt, Homo sapiens
ggaggaagccuguuucaaa

SEQ ID NO: 1209154 - RNA, 19 nt, Homo sapiens
gaaugaggcugagauaguu

SEQ ID NO: 1209155 - RNA, 19 nt, Homo sapiens
ggaagaggaugugcugaaa

SEQ ID NO: 1209156 - RNA, 19 nt, Homo sapiens
gauuuaccuuccugaauua

SEQ ID NO: 1209157 - RNA, 19 nt, Homo sapiens
aagaggaugugcugaaaua

SEQ ID NO: 1209158 - RNA, 19 nt, Homo sapiens
gcagcuagcuauaaagcaa

SEQ ID NO: 1209159 - RNA, 19 nt, Homo sapiens
caaacgagcugcccacagu

SEQ ID NO: 1209160 - RNA, 19 nt, Homo sapiens
gacgagagaacgagauuua

SEQ ID NO: 1209161 - RNA, 19 nt, Homo sapiens
caaagaauguggcaccaau

SEQ ID NO: 1209162 - RNA, 19 nt, Homo sapiens
gaggacaaauggaccugua

SEQ ID NO: 1209163 - RNA, 19 nt, Homo sapiens
gaagagacacugaggacaa

SEQ ID NO: 1209164 - RNA, 19 nt, Homo sapiens
agauuuaccuuccugaauu

SEQ ID NO: 1209165 - RNA, 19 nt, Homo sapiens
caucaugagucuaucaaug

SEQ ID NO: 1209166 - RNA, 19 nt, Homo sapiens
ggcauaaacugugcacuga

SEQ ID NO: 1209167 - RNA, 19 nt, Homo sapiens
ccagguggcuacaaagaau

SEQ ID NO: 1209168 - RNA, 19 nt, Homo sapiens
ccauuugacucccucugua

SEQ ID NO: 1209169 - RNA, 19 nt, Homo sapiens
gaggaagccuguuucaaaa

SEQ ID NO: 1209170 - RNA, 19 nt, Homo sapiens
gugagaagguacagagaug

SEQ ID NO: 1209171 - RNA, 19 nt, Homo sapiens
ccaacuuacuggaaccaaa

SEQ ID NO: 1209172 - RNA, 19 nt, Homo sapiens
ccaauugucuguguuaguc

SEQ ID NO: 1209173 - RNA, 19 nt, Homo sapiens
ggaagaggacagugggaaa

SEQ ID NO: 1209174 - RNA, 19 nt, Homo sapiens
ccauacagguuuuccaaua

SEQ ID NO: 1209175 - RNA, 19 nt, Homo sapiens
gaagguacagagauggaaa

SEQ ID NO: 1209176 - RNA, 19 nt, Homo sapiens
caagagaucacaccagagu

SEQ ID NO: 1209177 - RNA, 19 nt, Homo sapiens
gacaaauggaccuguaauu

SEQ ID NO: 1209178 - RNA, 19 nt, Homo sapiens
gcucuggagucccaauugu

SEQ ID NO: 1209179 - RNA, 19 nt, Homo sapiens
gcggaaggcaggacucaaa

SEQ ID NO: 1209180 - RNA, 19 nt, Homo sapiens
ucucugugcuccuaccuuu

SEQ ID NO: 1209181 - RNA, 19 nt, Homo sapiens
gaauaaaucacugccauac

SEQ ID NO: 1209182 - RNA, 19 nt, Homo sapiens
cgacaaggacuguguacug

SEQ ID NO: 1209183 - RNA, 19 nt, Homo sapiens
ggacaaauggaccuguaau

SEQ ID NO: 1209184 - RNA, 19 nt, Homo sapiens
gacaggagcccagaagaga

SEQ ID NO: 1209185 - RNA, 19 nt, Homo sapiens
ccgggcagcuagcuauaaa

SEQ ID NO: 1209186 - RNA, 19 nt, Homo sapiens
ugaaggaggaagccuguuu

SEQ ID NO: 1209187 - RNA, 19 nt, Homo sapiens
ugaaauacguccgggagau

SEQ ID NO: 1209188 - RNA, 19 nt, Homo sapiens
gaauguggcaccaaugaag

SEQ ID NO: 1209189 - RNA, 19 nt, Homo sapiens
aaagaucaacucccacuga

SEQ ID NO: 1209190 - RNA, 19 nt, Homo sapiens
gagauuuaccuuccugaau

SEQ ID NO: 1209191 - RNA, 19 nt, Homo sapiens
gaaggaggaagccuguuuc

SEQ ID NO: 1209192 - RNA, 19 nt, Homo sapiens
gaagaggaugugcugaaau

SEQ ID NO: 1209193 - RNA, 19 nt, Homo sapiens
ugaauaaaucacugccaua

SEQ ID NO: 1209194 - RNA, 19 nt, Homo sapiens
ggacaggagcccagaagag

SEQ ID NO: 1209195 - RNA, 19 nt, Homo sapiens
gggcugccguucugagugu

SEQ ID NO: 1209196 - RNA, 19 nt, Homo sapiens
ugaaugaggcugagauagu

SEQ ID NO: 1209197 - RNA, 19 nt, Homo sapiens
auaaaucacugccauacag

SEQ ID NO: 1209198 - RNA, 19 nt, Homo sapiens
cauaaacugugcacugaac

SEQ ID NO: 1209199 - RNA, 19 nt, Homo sapiens
gaacgagauuuaccuuccu

SEQ ID NO: 1209200 - RNA, 19 nt, Homo sapiens
uggaauugcuacaguuuag

SEQ ID NO: 1209201 - RNA, 19 nt, Homo sapiens
acaaauggaccuguaauuc

SEQ ID NO: 1209202 - RNA, 19 nt, Homo sapiens
gagcagcagugaggaagag

SEQ ID NO: 1209203 - RNA, 19 nt, Homo sapiens
ugagauaguugauguugcu

SEQ ID NO: 1209204 - RNA, 19 nt, Homo sapiens
caaggacuguguacugcau

SEQ ID NO: 1209205 - RNA, 19 nt, Homo sapiens
gauggaaaccuuacaaucc

SEQ ID NO: 1209206 - RNA, 19 nt, Homo sapiens
gaucacaccagaguacaug

SEQ ID NO: 1209207 - RNA, 19 nt, Homo sapiens
gcaagacucccugcgacaa

SEQ ID NO: 1209208 - RNA, 19 nt, Homo sapiens
cgcaugaucucuccugaag

SEQ ID NO: 1209209 - RNA, 19 nt, Homo sapiens
gaaauacguccgggagauc

SEQ ID NO: 1209210 - RNA, 19 nt, Homo sapiens
caugaaugaggcugagaua

SEQ ID NO: 1209211 - RNA, 19 nt, Homo sapiens
cauguggugguccaacuua

SEQ ID NO: 1209212 - RNA, 19 nt, Homo sapiens
gagauggaaaccuuacaau

SEQ ID NO: 1209213 - RNA, 19 nt, Homo sapiens
gagaagguacagagaugga

SEQ ID NO: 1209214 - RNA, 19 nt, Homo sapiens
aggcugagauaguugaugu

SEQ ID NO: 1209215 - RNA, 19 nt, Homo sapiens
gcuuuggacaggaauauau

SEQ ID NO: 1209216 - RNA, 19 nt, Homo sapiens
aagcuugggcccugacuuu

SEQ ID NO: 1209217 - RNA, 19 nt, Homo sapiens
caaauggaccuguaauucc

SEQ ID NO: 1209218 - RNA, 19 nt, Homo sapiens
gcauaaacugugcacugaa

SEQ ID NO: 1209219 - RNA, 19 nt, Homo sapiens
gcugagauaguugauguug

SEQ ID NO: 1209220 - RNA, 19 nt, Homo sapiens
gaauugcuacaguuuaguc

SEQ ID NO: 1209221 - RNA, 19 nt, Homo sapiens
caacuuacuggaaccaaag

SEQ ID NO: 1209222 - RNA, 19 nt, Homo sapiens
gagagccgcaaacaggaaa

SEQ ID NO: 1209223 - RNA, 19 nt, Homo sapiens
aagaauguggcaccaauga

SEQ ID NO: 1209224 - RNA, 19 nt, Homo sapiens
cuaccuuugugccuucuug

SEQ ID NO: 1209225 - RNA, 19 nt, Homo sapiens
acacacaauuccccaauga

SEQ ID NO: 1209226 - RNA, 19 nt, Homo sapiens
acaugucucugccucuguu

SEQ ID NO: 1209227 - RNA, 19 nt, Homo sapiens
ggaggaggaggaagaggau

SEQ ID NO: 1209228 - RNA, 19 nt, Homo sapiens
gguuccagcucugccugua

SEQ ID NO: 1209229 - RNA, 19 nt, Homo sapiens
gcuagaaaauacacacaau

SEQ ID NO: 1209230 - RNA, 19 nt, Homo sapiens
cagccagccuagaaagcaa

SEQ ID NO: 1209231 - RNA, 19 nt, Homo sapiens
gaaccaaagagacaguacu

SEQ ID NO: 1209232 - RNA, 19 nt, Homo sapiens
gaaggcaggacucaaaaug

SEQ ID NO: 1209233 - RNA, 19 nt, Homo sapiens
gacggcagggcuuaaaguu

SEQ ID NO: 1209234 - RNA, 19 nt, Homo sapiens
gaagaggacagugggaaac

SEQ ID NO: 1209235 - RNA, 19 nt, Homo sapiens
acacugaggacaagagauc

SEQ ID NO: 1209236 - RNA, 19 nt, Homo sapiens
uaccuugcuuucaccugua

SEQ ID NO: 1209237 - RNA, 19 nt, Homo sapiens
auacacaagugcuagaaaa

SEQ ID NO: 1209238 - RNA, 19 nt, Homo sapiens
ccaauacacaagugcuaga

SEQ ID NO: 1209239 - RNA, 19 nt, Homo sapiens
gguugaggccacaguguau

SEQ ID NO: 1209240 - RNA, 19 nt, Homo sapiens
caacucccacugaggacaa

SEQ ID NO: 1209241 - RNA, 19 nt, Homo sapiens
caauacacaagugcuagaa

SEQ ID NO: 1209242 - RNA, 19 nt, Homo sapiens
gcccagguggcuacaaaga

SEQ ID NO: 1209243 - RNA, 19 nt, Homo sapiens
gcaugaaugaggcugagau

SEQ ID NO: 1209244 - RNA, 19 nt, Homo sapiens
gcccucuccuggcucuuga

SEQ ID NO: 1209245 - RNA, 19 nt, Homo sapiens
cgagacggcagggcuuaaa

SEQ ID NO: 1209246 - RNA, 19 nt, Homo sapiens
aagagacaguacuuugcaa

SEQ ID NO: 1209247 - RNA, 19 nt, Homo sapiens
gucccaauugucuguguua

SEQ ID NO: 1209248 - RNA, 19 nt, Homo sapiens
cagcuagggcauaaacugu

SEQ ID NO: 1209249 - RNA, 19 nt, Homo sapiens
gcugcuaccuugcuuucac

SEQ ID NO: 1209250 - RNA, 19 nt, Homo sapiens
agagacaguacuuugcaaa

SEQ ID NO: 1209251 - RNA, 19 nt, Homo sapiens
caagccaucuccuucaaua

SEQ ID NO: 1209252 - RNA, 19 nt, Homo sapiens
ggacaaagccgacaucaag

SEQ ID NO: 1209253 - RNA, 19 nt, Homo sapiens
gaugugagcuaccugaaga

SEQ ID NO: 1209254 - RNA, 19 nt, Homo sapiens
guaacucacugucucauga

SEQ ID NO: 1209255 - RNA, 19 nt, Homo sapiens
gaacuguggagacugguua

SEQ ID NO: 1209256 - RNA, 19 nt, Homo sapiens
gggagagccugguucugua

SEQ ID NO: 1209257 - RNA, 19 nt, Homo sapiens
ccacggaccucaugaaacu

SEQ ID NO: 1209258 - RNA, 19 nt, Homo sapiens
gcgacaacaucaucaguga

SEQ ID NO: 1209259 - RNA, 19 nt, Homo sapiens
gaggugggacuuucaguaa

SEQ ID NO: 1209260 - RNA, 19 nt, Homo sapiens
agaggaagcuggagaacga

SEQ ID NO: 1209261 - RNA, 19 nt, Homo sapiens
gauucaaggucucaagaug

SEQ ID NO: 1209262 - RNA, 19 nt, Homo sapiens
gagcacacccucucauugu

SEQ ID NO: 1209263 - RNA, 19 nt, Homo sapiens
guaauaauaccgucagugu

SEQ ID NO: 1209264 - RNA, 19 nt, Homo sapiens
ugagcuaccugaagaagau

SEQ ID NO: 1209265 - RNA, 19 nt, Homo sapiens
gaaggcagcagccaucauc

SEQ ID NO: 1209266 - RNA, 19 nt, Homo sapiens
cgagauccgcagacauuua

SEQ ID NO: 1209267 - RNA, 19 nt, Homo sapiens
aauaauaccgucaguguga

SEQ ID NO: 1209268 - RNA, 19 nt, Homo sapiens
gaaacuggaccaugaagag

SEQ ID NO: 1209269 - RNA, 19 nt, Homo sapiens
gacgugagccugccacaga

SEQ ID NO: 1209270 - RNA, 19 nt, Homo sapiens
ccgcagacauuuagccaau

SEQ ID NO: 1209271 - RNA, 19 nt, Homo sapiens
gccgagauccgcagacauu

SEQ ID NO: 1209272 - RNA, 19 nt, Homo sapiens
ggaaaguccugggugacau

SEQ ID NO: 1209273 - RNA, 19 nt, Homo sapiens
ggguuuggccuuaguagaa

SEQ ID NO: 1209274 - RNA, 19 nt, Homo sapiens
caagaaauacugggaagau

SEQ ID NO: 1209275 - RNA, 19 nt, Homo sapiens
ccagaucauugacuaugug

SEQ ID NO: 1209276 - RNA, 19 nt, Homo sapiens
caacaucaucagugacuau

SEQ ID NO: 1209277 - RNA, 19 nt, Homo sapiens
ggaaagggucuugguguca

SEQ ID NO: 1209278 - RNA, 19 nt, Homo sapiens
gguuuggccuuaguagaaa

SEQ ID NO: 1209279 - RNA, 19 nt, Homo sapiens
ucauuguccuucugauuug

SEQ ID NO: 1209280 - RNA, 19 nt, Homo sapiens
gugaaaacauuccguaguu

SEQ ID NO: 1209281 - RNA, 19 nt, Homo sapiens
gaagcgagagagagagaga

SEQ ID NO: 1209282 - RNA, 19 nt, Homo sapiens
ggccacggcucuacuaaaa

SEQ ID NO: 1209283 - RNA, 19 nt, Homo sapiens
gaaguagacguugccaaug

SEQ ID NO: 1209284 - RNA, 19 nt, Homo sapiens
caaccugcaguccuucuuu

SEQ ID NO: 1209285 - RNA, 19 nt, Homo sapiens
guuaggaucugaggugagu

SEQ ID NO: 1209286 - RNA, 19 nt, Homo sapiens
ggaggugcccgucaucauc

SEQ ID NO: 1209287 - RNA, 19 nt, Homo sapiens
gagauccgcagacauuuag

SEQ ID NO: 1209288 - RNA, 19 nt, Homo sapiens
ucacugccgcucaugcaua

SEQ ID NO: 1209289 - RNA, 19 nt, Homo sapiens
ggcccaaccugcaguccuu

SEQ ID NO: 1209290 - RNA, 19 nt, Homo sapiens
cagcagccaucauccucuu

SEQ ID NO: 1209291 - RNA, 19 nt, Homo sapiens
gcccuaccuuucuaaacaa

SEQ ID NO: 1209292 - RNA, 19 nt, Homo sapiens
uguguuggguuuggccuua

SEQ ID NO: 1209293 - RNA, 19 nt, Homo sapiens
agaaguagacguugccaau

SEQ ID NO: 1209294 - RNA, 19 nt, Homo sapiens
cuacugguaccucaagaaa

SEQ ID NO: 1209295 - RNA, 19 nt, Homo sapiens
aggcggagcuggagaagag

SEQ ID NO: 1209296 - RNA, 19 nt, Homo sapiens
ggacauggacuagcuugag

SEQ ID NO: 1209297 - RNA, 19 nt, Homo sapiens
gaggugagucccaggaugu

SEQ ID NO: 1209298 - RNA, 19 nt, Homo sapiens
gagacugguuaggaucuga

SEQ ID NO: 1209299 - RNA, 19 nt, Homo sapiens
cugcaguccuucuuugaga

SEQ ID NO: 1209300 - RNA, 19 nt, Homo sapiens
gaucuuggagcaugaugau

SEQ ID NO: 1209301 - RNA, 19 nt, Homo sapiens
ccagucgggucucacuuuc

SEQ ID NO: 1209302 - RNA, 19 nt, Homo sapiens
gacaaagccgacaucaaga

SEQ ID NO: 1209303 - RNA, 19 nt, Homo sapiens
gaccagaucauugacuaug

SEQ ID NO: 1209304 - RNA, 19 nt, Homo sapiens
ccacggcucuacuaaaaga

SEQ ID NO: 1209305 - RNA, 19 nt, Homo sapiens
caaggccacggcucuacua

SEQ ID NO: 1209306 - RNA, 19 nt, Homo sapiens
ugaggugggacuuucagua

SEQ ID NO: 1209307 - RNA, 19 nt, Homo sapiens
gaacucuuccacaggacaa

SEQ ID NO: 1209308 - RNA, 19 nt, Homo sapiens
gaaaguccugggugacauc

SEQ ID NO: 1209309 - RNA, 19 nt, Homo sapiens
ggugggacuuucaguaaaa

SEQ ID NO: 1209310 - RNA, 19 nt, Homo sapiens
aagccgacaucaagacuca

SEQ ID NO: 1209311 - RNA, 19 nt, Homo sapiens
aagaaauacugggaagaug

SEQ ID NO: 1209312 - RNA, 19 nt, Homo sapiens
caagacucaacuccucuaa

SEQ ID NO: 1209313 - RNA, 19 nt, Homo sapiens
aacauuccguaguuuagaa

SEQ ID NO: 1209314 - RNA, 19 nt, Homo sapiens
cuucugauuugguccaugu

SEQ ID NO: 1209315 - RNA, 19 nt, Homo sapiens
cucauuguccuucugauuu

SEQ ID NO: 1209316 - RNA, 19 nt, Homo sapiens
uaaccgguaccucugaaug

SEQ ID NO: 1209317 - RNA, 19 nt, Homo sapiens
agacucaacuccucuaacc

SEQ ID NO: 1209318 - RNA, 19 nt, Homo sapiens
caaggagcccugguucaug

SEQ ID NO: 1209319 - RNA, 19 nt, Homo sapiens
caccacggaccucaugaaa

SEQ ID NO: 1209320 - RNA, 19 nt, Homo sapiens
ccuccuagccucuguccaa

SEQ ID NO: 1209321 - RNA, 19 nt, Homo sapiens
ggagacugguuaggaucug

SEQ ID NO: 1209322 - RNA, 19 nt, Homo sapiens
uaacucacugucucaugaa

SEQ ID NO: 1209323 - RNA, 19 nt, Homo sapiens
agcccuaccuuucuaaaca

SEQ ID NO: 1209324 - RNA, 19 nt, Homo sapiens
uucaaggucucaagaugga

SEQ ID NO: 1209325 - RNA, 19 nt, Homo sapiens
agaggaagcgagagagaga

SEQ ID NO: 1209326 - RNA, 19 nt, Homo sapiens
gacaacaucaucagugacu

SEQ ID NO: 1209327 - RNA, 19 nt, Homo sapiens
uguugacccucucucagaa

SEQ ID NO: 1209328 - RNA, 19 nt, Homo sapiens
gaguaauaauaccgucagu

SEQ ID NO: 1209329 - RNA, 19 nt, Homo sapiens
ucucugugcugugugauuc

SEQ ID NO: 1209330 - RNA, 19 nt, Homo sapiens
agaagaggaagcuggagaa

SEQ ID NO: 1209331 - RNA, 19 nt, Homo sapiens
caaggcaguggcacccaaa

SEQ ID NO: 1209332 - RNA, 19 nt, Homo sapiens
uguggagacugguuaggau

SEQ ID NO: 1209333 - RNA, 19 nt, Homo sapiens
ggucaguccagcccaagug

SEQ ID NO: 1209334 - RNA, 19 nt, Homo sapiens
aaguagacguugccaaugc

SEQ ID NO: 1209335 - RNA, 19 nt, Homo sapiens
gcuacuuugccuacuggua

SEQ ID NO: 1209336 - RNA, 19 nt, Homo sapiens
aaccugcaguccuucuuug

SEQ ID NO: 1209337 - RNA, 19 nt, Homo sapiens
uccaagccaucuccuucaa

SEQ ID NO: 1209338 - RNA, 19 nt, Homo sapiens
ccugugaggugggacuuuc

SEQ ID NO: 1209339 - RNA, 19 nt, Homo sapiens
ugauuugguccauguguug

SEQ ID NO: 1209340 - RNA, 19 nt, Homo sapiens
ucuaaccgguaccucugaa

SEQ ID NO: 1209341 - RNA, 19 nt, Homo sapiens
ucaagacucaacuccucua

SEQ ID NO: 1209342 - RNA, 19 nt, Homo sapiens
agagagaggaagcgagaga

SEQ ID NO: 1209343 - RNA, 19 nt, Homo sapiens
ggugggaugggcuacuuug

SEQ ID NO: 1209344 - RNA, 19 nt, Homo sapiens
uccgagcccuaccuuucua

SEQ ID NO: 1209345 - RNA, 19 nt, Homo sapiens
gcauagaaaccaccaaaag

SEQ ID NO: 1209346 - RNA, 19 nt, Homo sapiens
ccaccacggaccucaugaa

SEQ ID NO: 1209347 - RNA, 19 nt, Homo sapiens
aggugggacuuucaguaaa

SEQ ID NO: 1209348 - RNA, 19 nt, Homo sapiens
ggaacuguggagacugguu

SEQ ID NO: 1209349 - RNA, 19 nt, Homo sapiens
uaguuuagaaguagacguu

SEQ ID NO: 1209350 - RNA, 19 nt, Homo sapiens
uaauaccgucagugugaaa

SEQ ID NO: 1209351 - RNA, 19 nt, Homo sapiens
gaaaugguauccaguucuu

SEQ ID NO: 1209352 - RNA, 19 nt, Homo sapiens
gacaaugccugcuuucuuc

SEQ ID NO: 1209353 - RNA, 19 nt, Homo sapiens
gaacacacccuuugaagag

SEQ ID NO: 1209354 - RNA, 19 nt, Homo sapiens
cuaagaggcuuguuccaaa

SEQ ID NO: 1209355 - RNA, 19 nt, Homo sapiens
gaacuuguuuccagaacga

SEQ ID NO: 1209356 - RNA, 19 nt, Homo sapiens
gaacccacgugcuuucaga

SEQ ID NO: 1209357 - RNA, 19 nt, Homo sapiens
guacagaacccacauccuu

SEQ ID NO: 1209358 - RNA, 19 nt, Homo sapiens
gcaacagccuucucauaag

SEQ ID NO: 1209359 - RNA, 19 nt, Homo sapiens
gguauccaguucuuacgua

SEQ ID NO: 1209360 - RNA, 19 nt, Homo sapiens
ccacgugcuuucagaacua

SEQ ID NO: 1209361 - RNA, 19 nt, Homo sapiens
ggccgaugcuuccaaaguu

SEQ ID NO: 1209362 - RNA, 19 nt, Homo sapiens
gaaccugcuuuccgaaucu

SEQ ID NO: 1209363 - RNA, 19 nt, Homo sapiens
cuucugggcucaagcaauu

SEQ ID NO: 1209364 - RNA, 19 nt, Homo sapiens
caccacacccggcuaauuu

SEQ ID NO: 1209365 - RNA, 19 nt, Homo sapiens
cagcaacagccuucucaua

SEQ ID NO: 1209366 - RNA, 19 nt, Homo sapiens
ucuaaauccugaaggcuaa

SEQ ID NO: 1209367 - RNA, 19 nt, Homo sapiens
gcaacgggacccucuaaga

SEQ ID NO: 1209368 - RNA, 19 nt, Homo sapiens
gcaagcaugugugacugaa

SEQ ID NO: 1209369 - RNA, 19 nt, Homo sapiens
gcucagaacacacccuuug

SEQ ID NO: 1209370 - RNA, 19 nt, Homo sapiens
gcugagcccugggaucauu

SEQ ID NO: 1209371 - RNA, 19 nt, Homo sapiens
ucacacaggcuacaugaga

SEQ ID NO: 1209372 - RNA, 19 nt, Homo sapiens
gagcugagcccugggauca

SEQ ID NO: 1209373 - RNA, 19 nt, Homo sapiens
ggcauuaccauaucaguga

SEQ ID NO: 1209374 - RNA, 19 nt, Homo sapiens
gacaggguuucgccacauu

SEQ ID NO: 1209375 - RNA, 19 nt, Homo sapiens
cgacaaugccugcuuucuu

SEQ ID NO: 1209376 - RNA, 19 nt, Homo sapiens
uuucagaacuaccuguuug

SEQ ID NO: 1209377 - RNA, 19 nt, Homo sapiens
aagcaugugugacugaaau

SEQ ID NO: 1209378 - RNA, 19 nt, Homo sapiens
gcucugugguucaaguuuc

SEQ ID NO: 1209379 - RNA, 19 nt, Homo sapiens
uuccuggacugaccuauuu

SEQ ID NO: 1209380 - RNA, 19 nt, Homo sapiens
ggucaucaaguuccucuga

SEQ ID NO: 1209381 - RNA, 19 nt, Homo sapiens
ccucuuagcagucuucaga

SEQ ID NO: 1209382 - RNA, 19 nt, Homo sapiens
cagcagcucugugguucaa

SEQ ID NO: 1209383 - RNA, 19 nt, Homo sapiens
agcaacagccuucucauaa

SEQ ID NO: 1209384 - RNA, 19 nt, Homo sapiens
gcagcucugugguucaagu

SEQ ID NO: 1209385 - RNA, 19 nt, Homo sapiens
auccaguucuuacguauuu

SEQ ID NO: 1209386 - RNA, 19 nt, Homo sapiens
caggaggcauuaccauauc

SEQ ID NO: 1209387 - RNA, 19 nt, Homo sapiens
ccgaaucucuuuacuucca

SEQ ID NO: 1209388 - RNA, 19 nt, Homo sapiens
uucagaaccuacuuucaaa

SEQ ID NO: 1209389 - RNA, 19 nt, Homo sapiens
uuccgaaucucuuuacuuc

SEQ ID NO: 1209390 - RNA, 19 nt, Homo sapiens
caaaagugcuggauuacag

SEQ ID NO: 1209391 - RNA, 19 nt, Homo sapiens
ucccaaaagugcuggauua

SEQ ID NO: 1209392 - RNA, 19 nt, Homo sapiens
cugaauagcugggacuaca

SEQ ID NO: 1209393 - RNA, 19 nt, Homo sapiens
cagaggccauugggaaguu

SEQ ID NO: 1209394 - RNA, 19 nt, Homo sapiens
guauccaguucuuacguau

SEQ ID NO: 1209395 - RNA, 19 nt, Homo sapiens
ucagaacacacccuuugaa

SEQ ID NO: 1209396 - RNA, 19 nt, Homo sapiens
gaaucacacaggcuacaug

SEQ ID NO: 1209397 - RNA, 19 nt, Homo sapiens
cgaaccugcuuuccgaauc

SEQ ID NO: 1209398 - RNA, 19 nt, Homo sapiens
acaggaggcauuaccauau

SEQ ID NO: 1209399 - RNA, 19 nt, Homo sapiens
uacaggaggcauuaccaua

SEQ ID NO: 1209400 - RNA, 19 nt, Homo sapiens
uuagcagucuucagaguca

SEQ ID NO: 1209401 - RNA, 19 nt, Homo sapiens
gacccaaacccucuuagca

SEQ ID NO: 1209402 - RNA, 19 nt, Homo sapiens
ggucucgccucagcucaga

SEQ ID NO: 1209403 - RNA, 19 nt, Homo sapiens
uuucagaaccuacuuucaa

SEQ ID NO: 1209404 - RNA, 19 nt, Homo sapiens
ucagaacuaccuguuugua

SEQ ID NO: 1209405 - RNA, 19 nt, Homo sapiens
uaagaggcuuguuccaaaa

SEQ ID NO: 1209406 - RNA, 19 nt, Homo sapiens
ccaugugagucaucuccuu

SEQ ID NO: 1209407 - RNA, 19 nt, Homo sapiens
gccgaugcuuccaaaguuc

SEQ ID NO: 1209408 - RNA, 19 nt, Homo sapiens
gaaccuacuuucaaaacca

SEQ ID NO: 1209409 - RNA, 19 nt, Homo sapiens
guagaacuuguuuccagaa

SEQ ID NO: 1209410 - RNA, 19 nt, Homo sapiens
ccaccacacccggcuaauu

SEQ ID NO: 1209411 - RNA, 19 nt, Homo sapiens
caaacccucuuagcagucu

SEQ ID NO: 1209412 - RNA, 19 nt, Homo sapiens
gucaucaaguuccucugaa

SEQ ID NO: 1209413 - RNA, 19 nt, Homo sapiens
agaacacacccuuugaaga

SEQ ID NO: 1209414 - RNA, 19 nt, Homo sapiens
ccagaacgaaccugcuuuc

SEQ ID NO: 1209415 - RNA, 19 nt, Homo sapiens
agaggccauugggaaguua

SEQ ID NO: 1209416 - RNA, 19 nt, Homo sapiens
ccagaaccuccguacagaa

SEQ ID NO: 1209417 - RNA, 19 nt, Homo sapiens
ugggagcccuucagcuugu

SEQ ID NO: 1209418 - RNA, 19 nt, Homo sapiens
gcaauucaucugccucaac

SEQ ID NO: 1209419 - RNA, 19 nt, Homo sapiens
uccagaaccuccguacaga

SEQ ID NO: 1209420 - RNA, 19 nt, Homo sapiens
cugaaaugguauccaguuc

SEQ ID NO: 1209421 - RNA, 19 nt, Homo sapiens
aaucacacaggcuacauga

SEQ ID NO: 1209422 - RNA, 19 nt, Homo sapiens
ccugggagcccuucagcuu

SEQ ID NO: 1209423 - RNA, 19 nt, Homo sapiens
acagggaugagccaccaua

SEQ ID NO: 1209424 - RNA, 19 nt, Homo sapiens
cagaacacacccuuugaag

SEQ ID NO: 1209425 - RNA, 19 nt, Homo sapiens
augugugacugaaauggua

SEQ ID NO: 1209426 - RNA, 19 nt, Homo sapiens
guacaggaggcauuaccau

SEQ ID NO: 1209427 - RNA, 19 nt, Homo sapiens
gggccgaugcuuccaaagu

SEQ ID NO: 1209428 - RNA, 19 nt, Homo sapiens
cuccugggcucaugugauc

SEQ ID NO: 1209429 - RNA, 19 nt, Homo sapiens
ucaucaaguuccucugaag

SEQ ID NO: 1209430 - RNA, 19 nt, Homo sapiens
ccacggcuccuggucauca

SEQ ID NO: 1209431 - RNA, 19 nt, Homo sapiens
ccaccugcuuggagaacug

SEQ ID NO: 1209432 - RNA, 19 nt, Homo sapiens
ccauugggaaguuaagaga

SEQ ID NO: 1209433 - RNA, 19 nt, Homo sapiens
ccagaaccuccguccagaa

SEQ ID NO: 1209434 - RNA, 19 nt, Homo sapiens
cggcaacgggacccucuaa

SEQ ID NO: 1209435 - RNA, 19 nt, Homo sapiens
ucuaagaggcuuguuccaa

SEQ ID NO: 1209436 - RNA, 19 nt, Homo sapiens
ucaaacuucugggcucaag

SEQ ID NO: 1209437 - RNA, 19 nt, Homo sapiens
gcacuuguguggggacuuc

SEQ ID NO: 1209438 - RNA, 19 nt, Homo sapiens
ucucacuucugccugaauc

SEQ ID NO: 1209439 - RNA, 19 nt, Homo sapiens
cuccgacaaugccugcuuu

SEQ ID NO: 1209440 - RNA, 19 nt, Homo sapiens
ugucagcaagcauguguga

SEQ ID NO: 1209441 - RNA, 19 nt, Homo sapiens
guacagcagagacccaaac

SEQ ID NO: 1209442 - RNA, 19 nt, Homo sapiens
cgccucagcucagaacaca

SEQ ID NO: 1209443 - RNA, 19 nt, Homo sapiens
ggaccaccugcuuggagaa

SEQ ID NO: 1209444 - RNA, 19 nt, Homo sapiens
uuacuuccagagcuuguuu

SEQ ID NO: 1209445 - RNA, 19 nt, Homo sapiens
ggaagagagugugguguga

SEQ ID NO: 1209446 - RNA, 19 nt, Homo sapiens
caacgggaccuuagagauu

SEQ ID NO: 1209447 - RNA, 19 nt, Homo sapiens
ggccacagcccgaguagaa

SEQ ID NO: 1209448 - RNA, 19 nt, Homo sapiens
gcugguggcugccuuacug

SEQ ID NO: 1209449 - RNA, 19 nt, Homo sapiens
gcggcuggcugacaacuuc

SEQ ID NO: 1209450 - RNA, 19 nt, Homo sapiens
caaccuggaccauaaccuu

SEQ ID NO: 1209451 - RNA, 19 nt, Homo sapiens
ccaccgaggccugcuguuu

SEQ ID NO: 1209452 - RNA, 19 nt, Homo sapiens
guacaacagcagcgaagau

SEQ ID NO: 1209453 - RNA, 19 nt, Homo sapiens
aagagaguguggugugaug

SEQ ID NO: 1209454 - RNA, 19 nt, Homo sapiens
caacagcagcgaagaugag

SEQ ID NO: 1209455 - RNA, 19 nt, Homo sapiens
cccucaaccuggaccauaa

SEQ ID NO: 1209456 - RNA, 19 nt, Homo sapiens
gaagagaguguggugugau

SEQ ID NO: 1209457 - RNA, 19 nt, Homo sapiens
aacgggaccuuagagauug

SEQ ID NO: 1209458 - RNA, 19 nt, Homo sapiens
cuuaacugcuugggaaaug

SEQ ID NO: 1209459 - RNA, 19 nt, Homo sapiens
caccgaggccugcuguuug

SEQ ID NO: 1209460 - RNA, 19 nt, Homo sapiens
aaccuggaccauaaccuua

SEQ ID NO: 1209461 - RNA, 19 nt, Homo sapiens
gagaguguggugugaugga

SEQ ID NO: 1209462 - RNA, 19 nt, Homo sapiens
cuugggaaaugugaccuuu

SEQ ID NO: 1209463 - RNA, 19 nt, Homo sapiens
ugggaaaugugaccuuugc

SEQ ID NO: 1209464 - RNA, 19 nt, Homo sapiens
ccaacgggaccuuagagau

SEQ ID NO: 1209465 - RNA, 19 nt, Homo sapiens
acaccugcaucgccaccaa

SEQ ID NO: 1209466 - RNA, 19 nt, Homo sapiens
acccucaucuaccggauug

SEQ ID NO: 1209467 - RNA, 19 nt, Homo sapiens
ggaaaguucuuguuugcua

SEQ ID NO: 1209468 - RNA, 19 nt, Homo sapiens
gcagacacauuuaaucaaa

SEQ ID NO: 1209469 - RNA, 19 nt, Homo sapiens
gagacgagguuucaccaua

SEQ ID NO: 1209470 - RNA, 19 nt, Homo sapiens
caacaaagaguccaagaaa

SEQ ID NO: 1209471 - RNA, 19 nt, Homo sapiens
caucuucucuguguaaaua

SEQ ID NO: 1209472 - RNA, 19 nt, Homo sapiens
ggaaagugcagacacauuu

SEQ ID NO: 1209473 - RNA, 19 nt, Homo sapiens
uaacuggaauugggacuua

SEQ ID NO: 1209474 - RNA, 19 nt, Homo sapiens
aagaagaacuaucagagua

SEQ ID NO: 1209475 - RNA, 19 nt, Homo sapiens
gaaagugcagacacauuua

SEQ ID NO: 1209476 - RNA, 19 nt, Homo sapiens
ggaaggugguggcugguaa

SEQ ID NO: 1209477 - RNA, 19 nt, Homo sapiens
ggugguggcugguaaauuc

SEQ ID NO: 1209478 - RNA, 19 nt, Homo sapiens
aaagucagaucaacaaaga

SEQ ID NO: 1209479 - RNA, 19 nt, Homo sapiens
ggagaaagaaaggcuaaua

SEQ ID NO: 1209480 - RNA, 19 nt, Homo sapiens
gaauggugcuaguuuccua

SEQ ID NO: 1209481 - RNA, 19 nt, Homo sapiens
ggaccuugcuuauggaugu

SEQ ID NO: 1209482 - RNA, 19 nt, Homo sapiens
ggagugaguuuguuuaggu

SEQ ID NO: 1209483 - RNA, 19 nt, Homo sapiens
cgacccagcuagaccauuu

SEQ ID NO: 1209484 - RNA, 19 nt, Homo sapiens
ggagaaacacaccaaacua

SEQ ID NO: 1209485 - RNA, 19 nt, Homo sapiens
aaaggugucugccaaagaa

SEQ ID NO: 1209486 - RNA, 19 nt, Homo sapiens
gaagaacuaucagaguaug

SEQ ID NO: 1209487 - RNA, 19 nt, Homo sapiens
gcagcacaguggguauuua

SEQ ID NO: 1209488 - RNA, 19 nt, Homo sapiens
caaagaagagcuccaucua

SEQ ID NO: 1209489 - RNA, 19 nt, Homo sapiens
uaucagacaccaauucuaa

SEQ ID NO: 1209490 - RNA, 19 nt, Homo sapiens
guaaucaaguuaucagaca

SEQ ID NO: 1209491 - RNA, 19 nt, Homo sapiens
caacugagcuaucuuugcu

SEQ ID NO: 1209492 - RNA, 19 nt, Homo sapiens
ggauuggcaucauggcuuu

SEQ ID NO: 1209493 - RNA, 19 nt, Homo sapiens
aagaagagcuccaucuaca

SEQ ID NO: 1209494 - RNA, 19 nt, Homo sapiens
gagaaagaaaggcuaauau

SEQ ID NO: 1209495 - RNA, 19 nt, Homo sapiens
gagaagagagguagaaugg

SEQ ID NO: 1209496 - RNA, 19 nt, Homo sapiens
gagcaucuucucuguguaa

SEQ ID NO: 1209497 - RNA, 19 nt, Homo sapiens
ugauuacucuugacccuuu

SEQ ID NO: 1209498 - RNA, 19 nt, Homo sapiens
gaggaugggccaacucaaa

SEQ ID NO: 1209499 - RNA, 19 nt, Homo sapiens
ggagucaacuuuucacuga

SEQ ID NO: 1209500 - RNA, 19 nt, Homo sapiens
gaaaggugucugccaaaga

SEQ ID NO: 1209501 - RNA, 19 nt, Homo sapiens
guagaauggugcuaguuuc

SEQ ID NO: 1209502 - RNA, 19 nt, Homo sapiens
cuaaauguuugaagcuuug

SEQ ID NO: 1209503 - RNA, 19 nt, Homo sapiens
agacaccaauucuaaaugu

SEQ ID NO: 1209504 - RNA, 19 nt, Homo sapiens
gguagaauggugcuaguuu

SEQ ID NO: 1209505 - RNA, 19 nt, Homo sapiens
ccaaagugcugagauuaca

SEQ ID NO: 1209506 - RNA, 19 nt, Homo sapiens
guuugaagcuuuguuucua

SEQ ID NO: 1209507 - RNA, 19 nt, Homo sapiens
uagaaucggugaaacaaag

SEQ ID NO: 1209508 - RNA, 19 nt, Homo sapiens
aaacauagaaucggugaaa

SEQ ID NO: 1209509 - RNA, 19 nt, Homo sapiens
guacaacaaucuggaugug

SEQ ID NO: 1209510 - RNA, 19 nt, Homo sapiens
uaacuguacagcacuuuaa

SEQ ID NO: 1209511 - RNA, 19 nt, Homo sapiens
gacgagguuucaccauauu

SEQ ID NO: 1209512 - RNA, 19 nt, Homo sapiens
gagaggagugaguuuguuu

SEQ ID NO: 1209513 - RNA, 19 nt, Homo sapiens
gaagccugauuugcucuuu

SEQ ID NO: 1209514 - RNA, 19 nt, Homo sapiens
ggaauggcuucaugagucu

SEQ ID NO: 1209515 - RNA, 19 nt, Homo sapiens
aagaguguuucaucucaua

SEQ ID NO: 1209516 - RNA, 19 nt, Homo sapiens
gcagugaccagaagagugu

SEQ ID NO: 1209517 - RNA, 19 nt, Homo sapiens
agacgagguuucaccauau

SEQ ID NO: 1209518 - RNA, 19 nt, Homo sapiens
ugaaugagucuaugaugaa

SEQ ID NO: 1209519 - RNA, 19 nt, Homo sapiens
cugaaugagucuaugauga

SEQ ID NO: 1209520 - RNA, 19 nt, Homo sapiens
gcaguaccauuguuaagac

SEQ ID NO: 1209521 - RNA, 19 nt, Homo sapiens
gaagaguguuucaucucau

SEQ ID NO: 1209522 - RNA, 19 nt, Homo sapiens
ccaggacucugaagguaau

SEQ ID NO: 1209523 - RNA, 19 nt, Homo sapiens
agaagaguguuucaucuca

SEQ ID NO: 1209524 - RNA, 19 nt, Homo sapiens
gaaagacaaauggcaguga

SEQ ID NO: 1209525 - RNA, 19 nt, Homo sapiens
gaaagucagaucaacaaag

SEQ ID NO: 1209526 - RNA, 19 nt, Homo sapiens
ccagaagaguguuucaucu

SEQ ID NO: 1209527 - RNA, 19 nt, Homo sapiens
ggagagaagagagguagaa

SEQ ID NO: 1209528 - RNA, 19 nt, Homo sapiens
gcacaguggguauuuaucu

SEQ ID NO: 1209529 - RNA, 19 nt, Homo sapiens
gaagguggcaugggaugaa

SEQ ID NO: 1209530 - RNA, 19 nt, Homo sapiens
agccugagcuguacaacaa

SEQ ID NO: 1209531 - RNA, 19 nt, Homo sapiens
ggagagaggagugaguuug

SEQ ID NO: 1209532 - RNA, 19 nt, Homo sapiens
caaguuaucagacaccaau

SEQ ID NO: 1209533 - RNA, 19 nt, Homo sapiens
gagaaacacaccaaacuac

SEQ ID NO: 1209534 - RNA, 19 nt, Homo sapiens
guaacuguacagcacuuua

SEQ ID NO: 1209535 - RNA, 19 nt, Homo sapiens
caacccagguguggagaga

SEQ ID NO: 1209536 - RNA, 19 nt, Homo sapiens
ugauagagauguaggaaaa

SEQ ID NO: 1209537 - RNA, 19 nt, Homo sapiens
gaagguaaucaaguuauca

SEQ ID NO: 1209538 - RNA, 19 nt, Homo sapiens
cagaaagucagaucaacaa

SEQ ID NO: 1209539 - RNA, 19 nt, Homo sapiens
gugcagacacauuuaauca

SEQ ID NO: 1209540 - RNA, 19 nt, Homo sapiens
auaaagggcaguaccauug

SEQ ID NO: 1209541 - RNA, 19 nt, Homo sapiens
caccaauucuaaauguuug

SEQ ID NO: 1209542 - RNA, 19 nt, Homo sapiens
gaaggugguggcugguaaa

SEQ ID NO: 1209543 - RNA, 19 nt, Homo sapiens
acaaagccguaguccaguu

SEQ ID NO: 1209544 - RNA, 19 nt, Homo sapiens
aggcaagacuaaauuggaa

SEQ ID NO: 1209545 - RNA, 19 nt, Homo sapiens
ggguauuuaucucuaugaa

SEQ ID NO: 1209546 - RNA, 19 nt, Homo sapiens
gacaccaauucuaaauguu

SEQ ID NO: 1209547 - RNA, 19 nt, Homo sapiens
agacugugcuggagauagu

SEQ ID NO: 1209548 - RNA, 19 nt, Homo sapiens
gcuggacucucuccucagu

SEQ ID NO: 1209549 - RNA, 19 nt, Homo sapiens
ccaccacgcccagcuaauu

SEQ ID NO: 1209550 - RNA, 19 nt, Homo sapiens
gagagaggagugaguuugu

SEQ ID NO: 1209551 - RNA, 19 nt, Homo sapiens
caaagccguaguccaguuu

SEQ ID NO: 1209552 - RNA, 19 nt, Homo sapiens
ccagaugugugagcuuuua

SEQ ID NO: 1209553 - RNA, 19 nt, Homo sapiens
aaucaaaccaggcaccaaa

SEQ ID NO: 1209554 - RNA, 19 nt, Homo sapiens
caaauggcagugaccagaa

SEQ ID NO: 1209555 - RNA, 19 nt, Homo sapiens
ugaagguaaucaaguuauc

SEQ ID NO: 1209556 - RNA, 19 nt, Homo sapiens
guaguccaguuucuguguu

SEQ ID NO: 1209557 - RNA, 19 nt, Homo sapiens
caaacuaccuggggacaaa

SEQ ID NO: 1209558 - RNA, 19 nt, Homo sapiens
ccuaagcuugggaugauua

SEQ ID NO: 1209559 - RNA, 19 nt, Homo sapiens
gaaugagucuaugaugaac

SEQ ID NO: 1209560 - RNA, 19 nt, Homo sapiens
aaagugcagacacauuuaa

SEQ ID NO: 1209561 - RNA, 19 nt, Homo sapiens
aagccugauuugcucuuua

SEQ ID NO: 1209562 - RNA, 19 nt, Homo sapiens
uaagaagaacuaucagagu

SEQ ID NO: 1209563 - RNA, 19 nt, Homo sapiens
gagguagaauggugcuagu

SEQ ID NO: 1209564 - RNA, 19 nt, Homo sapiens
agucuaugaugaacacuga

SEQ ID NO: 1209565 - RNA, 19 nt, Homo sapiens
aaaugggaauggcuucaug

SEQ ID NO: 1209566 - RNA, 19 nt, Homo sapiens
gugcuaguuuccuauuuua

SEQ ID NO: 1209567 - RNA, 19 nt, Homo sapiens
cuacagcuauuguuagguu

SEQ ID NO: 1209568 - RNA, 19 nt, Homo sapiens
cauauucgguugcaucuuc

SEQ ID NO: 1209569 - RNA, 19 nt, Homo sapiens
gcucuaugauuucugcauu

SEQ ID NO: 1209570 - RNA, 19 nt, Homo sapiens
gaccucaucugcuuugcuu

SEQ ID NO: 1209571 - RNA, 19 nt, Homo sapiens
gggcggaaccuggagauaa

SEQ ID NO: 1209572 - RNA, 19 nt, Homo sapiens
ggcggaaccuggagauaau

SEQ ID NO: 1209573 - RNA, 19 nt, Homo sapiens
caaucaauccaacagcaua

SEQ ID NO: 1209574 - RNA, 19 nt, Homo sapiens
gcuuagugcucucgcucua

SEQ ID NO: 1209575 - RNA, 19 nt, Homo sapiens
ggacagcauccucaaucaa

SEQ ID NO: 1209576 - RNA, 19 nt, Homo sapiens
gacagcauccucaaucaau

SEQ ID NO: 1209577 - RNA, 19 nt, Homo sapiens
gcaugugagccuugccuaa

SEQ ID NO: 1209578 - RNA, 19 nt, Homo sapiens
cacacuacagcuauuguua

SEQ ID NO: 1209579 - RNA, 19 nt, Homo sapiens
gcaccgccaucagcuguuc

SEQ ID NO: 1209580 - RNA, 19 nt, Homo sapiens
aggcugaccucaucugcuu

SEQ ID NO: 1209581 - RNA, 19 nt, Homo sapiens
gcuuugcuuuggcauguga

SEQ ID NO: 1209582 - RNA, 19 nt, Homo sapiens
cccaugggcuggucuccaa

SEQ ID NO: 1209583 - RNA, 19 nt, Homo sapiens
ucuucgugcucuaugauuu

SEQ ID NO: 1209584 - RNA, 19 nt, Homo sapiens
ucuacgcgcugcacgugaa

SEQ ID NO: 1209585 - RNA, 19 nt, Homo sapiens
acaugacaauggaccaaau

SEQ ID NO: 1209586 - RNA, 19 nt, Homo sapiens
ccucaucugcuuugcuuug

SEQ ID NO: 1209587 - RNA, 19 nt, Homo sapiens
ucuacacacuacagcuauu

SEQ ID NO: 1209588 - RNA, 19 nt, Homo sapiens
gcauaucugggucccuaga

SEQ ID NO: 1209589 - RNA, 19 nt, Homo sapiens
ugagcucccuggugucucu

SEQ ID NO: 1209590 - RNA, 19 nt, Homo sapiens
gccacacgcucgcucuuuu

SEQ ID NO: 1209591 - RNA, 19 nt, Homo sapiens
gcugaccucaucugcuuug

SEQ ID NO: 1209592 - RNA, 19 nt, Homo sapiens
ucuaugauuucugcauugu

SEQ ID NO: 1209593 - RNA, 19 nt, Homo sapiens
ugacaauggaccaaaugug

SEQ ID NO: 1209594 - RNA, 19 nt, Homo sapiens
cacuacagcuauuguuagg

SEQ ID NO: 1209595 - RNA, 19 nt, Homo sapiens
ucaauccaacagcauauuc

SEQ ID NO: 1209596 - RNA, 19 nt, Homo sapiens
uguaucaccaccuaugcua

SEQ ID NO: 1209597 - RNA, 19 nt, Homo sapiens
acagcauccucaaucaauc

SEQ ID NO: 1209598 - RNA, 19 nt, Homo sapiens
ccaccuaugcuaucaacgu

SEQ ID NO: 1209599 - RNA, 19 nt, Homo sapiens
acacuacagcuauuguuag

SEQ ID NO: 1209600 - RNA, 19 nt, Homo sapiens
guaaagaacuugacuuagu

SEQ ID NO: 1209601 - RNA, 19 nt, Homo sapiens
gaugagguauuaacaagua

SEQ ID NO: 1209602 - RNA, 19 nt, Homo sapiens
gguccgggcuccacacuua

SEQ ID NO: 1209603 - RNA, 19 nt, Homo sapiens
guacauggcagaagugaaa

SEQ ID NO: 1209604 - RNA, 19 nt, Homo sapiens
gacggaggaugagguauua

SEQ ID NO: 1209605 - RNA, 19 nt, Homo sapiens
uaaagaacuugacuuagug

SEQ ID NO: 1209606 - RNA, 19 nt, Homo sapiens
gaagacggaggaugaggua

SEQ ID NO: 1209607 - RNA, 19 nt, Homo sapiens
ggaacaaacuagcccucaa

SEQ ID NO: 1209608 - RNA, 19 nt, Homo sapiens
gcacuugccucgugagacu

SEQ ID NO: 1209609 - RNA, 19 nt, Homo sapiens
ccaaguacauggcagaagu

SEQ ID NO: 1209610 - RNA, 19 nt, Homo sapiens
gaaggaaaccgagaugcuu

SEQ ID NO: 1209611 - RNA, 19 nt, Homo sapiens
gcgauguacauaacuauuu

SEQ ID NO: 1209612 - RNA, 19 nt, Homo sapiens
gaacaaacuagcccucaag

SEQ ID NO: 1209613 - RNA, 19 nt, Homo sapiens
ccucaagacgggaauagua

SEQ ID NO: 1209614 - RNA, 19 nt, Homo sapiens
gcgacagccuucccugaga

SEQ ID NO: 1209615 - RNA, 19 nt, Homo sapiens
ccagugcggugacgaugau

SEQ ID NO: 1209616 - RNA, 19 nt, Homo sapiens
gaggaugagguauuaacaa

SEQ ID NO: 1209617 - RNA, 19 nt, Homo sapiens
gcagaaggaaaccgagaug

SEQ ID NO: 1209618 - RNA, 19 nt, Homo sapiens
gguauuaacaaguaaaggu

SEQ ID NO: 1209619 - RNA, 19 nt, Homo sapiens
cgugagacuucauagaaca

SEQ ID NO: 1209620 - RNA, 19 nt, Homo sapiens
ggaggaugagguauuaaca

SEQ ID NO: 1209621 - RNA, 19 nt, Homo sapiens
agacggaggaugagguauu

SEQ ID NO: 1209622 - RNA, 19 nt, Homo sapiens
gaauaguagccaagaagca

SEQ ID NO: 1209623 - RNA, 19 nt, Homo sapiens
gggaauaguagccaagaag

SEQ ID NO: 1209624 - RNA, 19 nt, Homo sapiens
aggaugagguauuaacaag

SEQ ID NO: 1209625 - RNA, 19 nt, Homo sapiens
ucugcgauguacauaacua

SEQ ID NO: 1209626 - RNA, 19 nt, Homo sapiens
ggacuuaaaagcagaagga

SEQ ID NO: 1209627 - RNA, 19 nt, Homo sapiens
gugcggugacgaugauaaa

SEQ ID NO: 1209628 - RNA, 19 nt, Homo sapiens
cuucucaccuccucauucu

SEQ ID NO: 1209629 - RNA, 19 nt, Homo sapiens
cuucauagaacagugguuu

SEQ ID NO: 1209630 - RNA, 19 nt, Homo sapiens
gcagaggcgggaacaaacu

SEQ ID NO: 1209631 - RNA, 19 nt, Homo sapiens
cagaggcgggaacaaacua

SEQ ID NO: 1209632 - RNA, 19 nt, Homo sapiens
ucucugcgauguacauaac

SEQ ID NO: 1209633 - RNA, 19 nt, Homo sapiens
gggacucucugcgauguac

SEQ ID NO: 1209634 - RNA, 19 nt, Homo sapiens
gagcacuugccucgugaga

SEQ ID NO: 1209635 - RNA, 19 nt, Homo sapiens
cgggaauaguagccaagaa

SEQ ID NO: 1209636 - RNA, 19 nt, Homo sapiens
cauucucucuggcucuuuc

SEQ ID NO: 1209637 - RNA, 19 nt, Homo sapiens
ggaugagguauuaacaagu

SEQ ID NO: 1209638 - RNA, 19 nt, Homo sapiens
gagcuguucaagcggaaga

SEQ ID NO: 1209639 - RNA, 19 nt, Homo sapiens
acgcagaggcgggaacaaa

SEQ ID NO: 1209640 - RNA, 19 nt, Homo sapiens
caaguacauggcagaagug

SEQ ID NO: 1209641 - RNA, 19 nt, Homo sapiens
agcagaagacggaggauga

SEQ ID NO: 1209642 - RNA, 19 nt, Homo sapiens
guacaagacugaauuaugu

SEQ ID NO: 1209643 - RNA, 19 nt, Homo sapiens
gaaagaagcauguagcaaa

SEQ ID NO: 1209644 - RNA, 19 nt, Homo sapiens
gaacuaggcugaagcaucu

SEQ ID NO: 1209645 - RNA, 19 nt, Homo sapiens
ggucauaaguccuuuguga

SEQ ID NO: 1209646 - RNA, 19 nt, Homo sapiens
gaaacgaggccucacuaua

SEQ ID NO: 1209647 - RNA, 19 nt, Homo sapiens
gaaucugccuuauaccuaa

SEQ ID NO: 1209648 - RNA, 19 nt, Homo sapiens
ggaagaguaguuacaaaua

SEQ ID NO: 1209649 - RNA, 19 nt, Homo sapiens
gcagaagaccuuagacaaa

SEQ ID NO: 1209650 - RNA, 19 nt, Homo sapiens
gaacagccaacauagagua

SEQ ID NO: 1209651 - RNA, 19 nt, Homo sapiens
gaagggauccaacaaagaa

SEQ ID NO: 1209652 - RNA, 19 nt, Homo sapiens
gaaguacaagacugaauua

SEQ ID NO: 1209653 - RNA, 19 nt, Homo sapiens
gcaucugagucuucuaaua

SEQ ID NO: 1209654 - RNA, 19 nt, Homo sapiens
gguggcuccuuuaauauua

SEQ ID NO: 1209655 - RNA, 19 nt, Homo sapiens
cauaaggacuguucaaauc

SEQ ID NO: 1209656 - RNA, 19 nt, Homo sapiens
aagaagccaugaccaguua

SEQ ID NO: 1209657 - RNA, 19 nt, Homo sapiens
caucugagucuucuaauaa

SEQ ID NO: 1209658 - RNA, 19 nt, Homo sapiens
gaagcaguuuggaagagua

SEQ ID NO: 1209659 - RNA, 19 nt, Homo sapiens
aaacgaggccucacuauau

SEQ ID NO: 1209660 - RNA, 19 nt, Homo sapiens
gaugagaccagacaagaaa

SEQ ID NO: 1209661 - RNA, 19 nt, Homo sapiens
ccacuuugcugagguauga

SEQ ID NO: 1209662 - RNA, 19 nt, Homo sapiens
gaaagcuuguguuuacaug

SEQ ID NO: 1209663 - RNA, 19 nt, Homo sapiens
gcuaaaagguggagcuaua

SEQ ID NO: 1209664 - RNA, 19 nt, Homo sapiens
gguagaaguucaucaaugg

SEQ ID NO: 1209665 - RNA, 19 nt, Homo sapiens
aaaggaagcauguagcaua

SEQ ID NO: 1209666 - RNA, 19 nt, Homo sapiens
ugucaacucuuucuuguau

SEQ ID NO: 1209667 - RNA, 19 nt, Homo sapiens
aaacagacguugacuuucu

SEQ ID NO: 1209668 - RNA, 19 nt, Homo sapiens
gaucaagccgcauuuauuc

SEQ ID NO: 1209669 - RNA, 19 nt, Homo sapiens
ggaagcauguagcauauac

SEQ ID NO: 1209670 - RNA, 19 nt, Homo sapiens
acggguggcuccuuuaaua

SEQ ID NO: 1209671 - RNA, 19 nt, Homo sapiens
gcaaaugcacagagaaguu

SEQ ID NO: 1209672 - RNA, 19 nt, Homo sapiens
ucaaaguugucuaggauga

SEQ ID NO: 1209673 - RNA, 19 nt, Homo sapiens
ucaagaaacugagucucua

SEQ ID NO: 1209674 - RNA, 19 nt, Homo sapiens
uagcaaugguuguuccuaa

SEQ ID NO: 1209675 - RNA, 19 nt, Homo sapiens
gugggaaauuuguguuuaa

SEQ ID NO: 1209676 - RNA, 19 nt, Homo sapiens
ggaaucugccuuauaccua

SEQ ID NO: 1209677 - RNA, 19 nt, Homo sapiens
caccaugcuuggcuaauuu

SEQ ID NO: 1209678 - RNA, 19 nt, Homo sapiens
gggaagggauccaacaaag

SEQ ID NO: 1209679 - RNA, 19 nt, Homo sapiens
guucaaaucauaccaguga

SEQ ID NO: 1209680 - RNA, 19 nt, Homo sapiens
gaacagguuauucugaaga

SEQ ID NO: 1209681 - RNA, 19 nt, Homo sapiens
ggaucuacauugcauuuca

SEQ ID NO: 1209682 - RNA, 19 nt, Homo sapiens
aaaguugucuaggaugaua

SEQ ID NO: 1209683 - RNA, 19 nt, Homo sapiens
gaucuacauugcauuucaa

SEQ ID NO: 1209684 - RNA, 19 nt, Homo sapiens
cugaguggcucuuuuauua

SEQ ID NO: 1209685 - RNA, 19 nt, Homo sapiens
cuaaagagcagaacuugga

SEQ ID NO: 1209686 - RNA, 19 nt, Homo sapiens
uuaaacggguggcuccuuu

SEQ ID NO: 1209687 - RNA, 19 nt, Homo sapiens
caaaugcacagagaaguuu

SEQ ID NO: 1209688 - RNA, 19 nt, Homo sapiens
gggcauugguuaagucauc

SEQ ID NO: 1209689 - RNA, 19 nt, Homo sapiens
guaggaggcaguagucaaa

SEQ ID NO: 1209690 - RNA, 19 nt, Homo sapiens
caaaauaaauccccugaca

SEQ ID NO: 1209691 - RNA, 19 nt, Homo sapiens
gagucaauauguaguggaa

SEQ ID NO: 1209692 - RNA, 19 nt, Homo sapiens
ggaagggauccaacaaaga

SEQ ID NO: 1209693 - RNA, 19 nt, Homo sapiens
gaaaggacauuuugauaac

SEQ ID NO: 1209694 - RNA, 19 nt, Homo sapiens
gaauaaggaaagaagagaa

SEQ ID NO: 1209695 - RNA, 19 nt, Homo sapiens
ggguguauuugcaaugaaa

SEQ ID NO: 1209696 - RNA, 19 nt, Homo sapiens
gacguugacuuucuuugau

SEQ ID NO: 1209697 - RNA, 19 nt, Homo sapiens
gugccaaagucacagguuu

SEQ ID NO: 1209698 - RNA, 19 nt, Homo sapiens
gaguauauggguaagaauu

SEQ ID NO: 1209699 - RNA, 19 nt, Homo sapiens
ucaccaugcuuggcuaauu

SEQ ID NO: 1209700 - RNA, 19 nt, Homo sapiens
caugaccaguuaaagauau

SEQ ID NO: 1209701 - RNA, 19 nt, Homo sapiens
gcaggccguugaacagguu

SEQ ID NO: 1209702 - RNA, 19 nt, Homo sapiens
ugucuaggaugauaauuca

SEQ ID NO: 1209703 - RNA, 19 nt, Homo sapiens
uaucuuaauugcucaguag

SEQ ID NO: 1209704 - RNA, 19 nt, Homo sapiens
cagcaucuccagaaagaaa

SEQ ID NO: 1209705 - RNA, 19 nt, Homo sapiens
gauagaucaugaggccuaa

SEQ ID NO: 1209706 - RNA, 19 nt, Homo sapiens
ucaacucuuucuuguauuc

SEQ ID NO: 1209707 - RNA, 19 nt, Homo sapiens
caagcaaauugaggacauu

SEQ ID NO: 1209708 - RNA, 19 nt, Homo sapiens
cagaagaccuuagacaaaa

SEQ ID NO: 1209709 - RNA, 19 nt, Homo sapiens
cuacagaacauuagagaca

SEQ ID NO: 1209710 - RNA, 19 nt, Homo sapiens
uaguaucccugguucagaa

SEQ ID NO: 1209711 - RNA, 19 nt, Homo sapiens
gcagagaucaugggacuag

SEQ ID NO: 1209712 - RNA, 19 nt, Homo sapiens
uuucaagacuaccuauuug

SEQ ID NO: 1209713 - RNA, 19 nt, Homo sapiens
ggcagaggcugagaacaga

SEQ ID NO: 1209714 - RNA, 19 nt, Homo sapiens
gaaauagcaaugguuguuc

SEQ ID NO: 1209715 - RNA, 19 nt, Homo sapiens
ggaaagaagcauguagcaa

SEQ ID NO: 1209716 - RNA, 19 nt, Homo sapiens
gcugagguaugaaguguac

SEQ ID NO: 1209717 - RNA, 19 nt, Homo sapiens
ggaaucgaaacgacugaaa

SEQ ID NO: 1209718 - RNA, 19 nt, Homo sapiens
caaaauggagcaacuguuu

SEQ ID NO: 1209719 - RNA, 19 nt, Homo sapiens
ugaucaagccgcauuuauu

SEQ ID NO: 1209720 - RNA, 19 nt, Homo sapiens
aagcuuguguuuacaugaa

SEQ ID NO: 1209721 - RNA, 19 nt, Homo sapiens
auugaaagcuuguguuuac

SEQ ID NO: 1209722 - RNA, 19 nt, Homo sapiens
uuagguaucuaugccaauu

SEQ ID NO: 1209723 - RNA, 19 nt, Homo sapiens
aaggaagcauguagcauau

SEQ ID NO: 1209724 - RNA, 19 nt, Homo sapiens
aacgaggccucacuauauu

SEQ ID NO: 1209725 - RNA, 19 nt, Homo sapiens
ggaugagaccagacaagaa

SEQ ID NO: 1209726 - RNA, 19 nt, Homo sapiens
gaagccaugaccaguuaaa

SEQ ID NO: 1209727 - RNA, 19 nt, Homo sapiens
gguccacuuugcugaggua

SEQ ID NO: 1209728 - RNA, 19 nt, Homo sapiens
cauaaggacuguucaaacc

SEQ ID NO: 1209729 - RNA, 19 nt, Homo sapiens
gagaucaugggacuaguga

SEQ ID NO: 1209730 - RNA, 19 nt, Homo sapiens
gagaagaugaggcgguaga

SEQ ID NO: 1209731 - RNA, 19 nt, Homo sapiens
cuaccuauuugaagugaug

SEQ ID NO: 1209732 - RNA, 19 nt, Homo sapiens
cuacgaggcccaguucuuu

SEQ ID NO: 1209733 - RNA, 19 nt, Homo sapiens
agaacccacuggaguagaa

SEQ ID NO: 1209734 - RNA, 19 nt, Homo sapiens
cgguagaaguucaucaaug

SEQ ID NO: 1209735 - RNA, 19 nt, Homo sapiens
cuucaaaguugucuaggau

SEQ ID NO: 1209736 - RNA, 19 nt, Homo sapiens
uaaggacuguucaaaucau

SEQ ID NO: 1209737 - RNA, 19 nt, Homo sapiens
guacuaagcaggcccuucu

SEQ ID NO: 1209738 - RNA, 19 nt, Homo sapiens
agaaguacaagacugaauu

SEQ ID NO: 1209739 - RNA, 19 nt, Homo sapiens
cguauucccucaaacaucu

SEQ ID NO: 1209740 - RNA, 19 nt, Homo sapiens
uugaacagguuauucugaa

SEQ ID NO: 1209741 - RNA, 19 nt, Homo sapiens
agacugaucugugccaaag

SEQ ID NO: 1209742 - RNA, 19 nt, Homo sapiens
ccaagaagcugauccgaua

SEQ ID NO: 1209743 - RNA, 19 nt, Homo sapiens
ggaagaagcugugcagaug

SEQ ID NO: 1209744 - RNA, 19 nt, Homo sapiens
gaaaguaccgcuuccauug

SEQ ID NO: 1209745 - RNA, 19 nt, Homo sapiens
gcauggagcuggagaggau

SEQ ID NO: 1209746 - RNA, 19 nt, Homo sapiens
gaacaaagagaaccugcaa

SEQ ID NO: 1209747 - RNA, 19 nt, Homo sapiens
gaggagaacuucgauaugg

SEQ ID NO: 1209748 - RNA, 19 nt, Homo sapiens
ccacauacaucaaccucaa

SEQ ID NO: 1209749 - RNA, 19 nt, Homo sapiens
gaggucaucuucuccuaug

SEQ ID NO: 1209750 - RNA, 19 nt, Homo sapiens
cgacggagcagaagagaga

SEQ ID NO: 1209751 - RNA, 19 nt, Homo sapiens
cauaguaucagaagauuca

SEQ ID NO: 1209752 - RNA, 19 nt, Homo sapiens
gaugguggauagcgcauag

SEQ ID NO: 1209753 - RNA, 19 nt, Homo sapiens
gaaaugcucaaagaagaga

SEQ ID NO: 1209754 - RNA, 19 nt, Homo sapiens
cagaggagaacuucgauau

SEQ ID NO: 1209755 - RNA, 19 nt, Homo sapiens
gcgcauaguaucagaagau

SEQ ID NO: 1209756 - RNA, 19 nt, Homo sapiens
guaaagguggcccaaggaa

SEQ ID NO: 1209757 - RNA, 19 nt, Homo sapiens
gcuccauaguguuaaccua

SEQ ID NO: 1209758 - RNA, 19 nt, Homo sapiens
uaaagguggcccaaggaaa

SEQ ID NO: 1209759 - RNA, 19 nt, Homo sapiens
gagaugaaggccacauaca

SEQ ID NO: 1209760 - RNA, 19 nt, Homo sapiens
gcugguagagggaaaggaa

SEQ ID NO: 1209761 - RNA, 19 nt, Homo sapiens
aaaguaccgcuuccauuga

SEQ ID NO: 1209762 - RNA, 19 nt, Homo sapiens
caucuucuccuaugugcuu

SEQ ID NO: 1209763 - RNA, 19 nt, Homo sapiens
agaaaguaccgcuuccauu

SEQ ID NO: 1209764 - RNA, 19 nt, Homo sapiens
auacaucgacaaccaggua

SEQ ID NO: 1209765 - RNA, 19 nt, Homo sapiens
gaugauggaggccuaugug

SEQ ID NO: 1209766 - RNA, 19 nt, Homo sapiens
gagcucugguguccaaggu

SEQ ID NO: 1209767 - RNA, 19 nt, Homo sapiens
caucagaggagaacuucga

SEQ ID NO: 1209768 - RNA, 19 nt, Homo sapiens
ggagaugaaggccacauac

SEQ ID NO: 1209769 - RNA, 19 nt, Homo sapiens
gggagcgauucaaagaugu

SEQ ID NO: 1209770 - RNA, 19 nt, Homo sapiens
cugcagacacccaagauga

SEQ ID NO: 1209771 - RNA, 19 nt, Homo sapiens
cgaccucaguggcuuggau

SEQ ID NO: 1209772 - RNA, 19 nt, Homo sapiens
gcgaugccaggaacaaaga

SEQ ID NO: 1209773 - RNA, 19 nt, Homo sapiens
gagcgaugccaggaacaaa

SEQ ID NO: 1209774 - RNA, 19 nt, Homo sapiens
ccuuugcuccauaguguua

SEQ ID NO: 1209775 - RNA, 19 nt, Homo sapiens
ggggagcgauucaaagaug

SEQ ID NO: 1209776 - RNA, 19 nt, Homo sapiens
gaaggccacauacaucaac

SEQ ID NO: 1209777 - RNA, 19 nt, Homo sapiens
ucuacuccuuugcuccaua

SEQ ID NO: 1209778 - RNA, 19 nt, Homo sapiens
gaagcugauccgauacauc

SEQ ID NO: 1209779 - RNA, 19 nt, Homo sapiens
cgcauaguaucagaagauu

SEQ ID NO: 1209780 - RNA, 19 nt, Homo sapiens
ggucaucuucuccuaugug

SEQ ID NO: 1209781 - RNA, 19 nt, Homo sapiens
ucagaggagaacuucgaua

SEQ ID NO: 1209782 - RNA, 19 nt, Homo sapiens
auauggaggcuuucacuga

SEQ ID NO: 1209783 - RNA, 19 nt, Homo sapiens
ggaugcaggagcccuauac

SEQ ID NO: 1209784 - RNA, 19 nt, Homo sapiens
caagccagccagaaaguac

SEQ ID NO: 1209785 - RNA, 19 nt, Homo sapiens
cuacuccuuugcuccauag

SEQ ID NO: 1209786 - RNA, 19 nt, Homo sapiens
ucaagccagccagaaagua

SEQ ID NO: 1209787 - RNA, 19 nt, Homo sapiens
caaaggggagcgauucaaa

SEQ ID NO: 1209788 - RNA, 19 nt, Homo sapiens
aggagaacuucgauaugga

SEQ ID NO: 1209789 - RNA, 19 nt, Homo sapiens
cuccuuugcuccauagugu

SEQ ID NO: 1209790 - RNA, 19 nt, Homo sapiens
ggcuuucacugagaugaug

SEQ ID NO: 1209791 - RNA, 19 nt, Homo sapiens
aaagguggcccaaggaaaa

SEQ ID NO: 1209792 - RNA, 19 nt, Homo sapiens
gggaugcaggagcccuaua

SEQ ID NO: 1209793 - RNA, 19 nt, Homo sapiens
uggaagaagcugugcagau

SEQ ID NO: 1209794 - RNA, 19 nt, Homo sapiens
gcagaagagagagcaugga

SEQ ID NO: 1209795 - RNA, 19 nt, Homo sapiens
gacgagcccuggaccauua

SEQ ID NO: 1209796 - RNA, 19 nt, Homo sapiens
gcacagagcuccccacuau

SEQ ID NO: 1209797 - RNA, 19 nt, Homo sapiens
gcaagaagcagccgggaaa

SEQ ID NO: 1209798 - RNA, 19 nt, Homo sapiens
gaacagagaauuuaucacu

SEQ ID NO: 1209799 - RNA, 19 nt, Homo sapiens
aaagaaagcagaauccaaa

SEQ ID NO: 1209800 - RNA, 19 nt, Homo sapiens
gaaagaaagcagaauccaa

SEQ ID NO: 1209801 - RNA, 19 nt, Homo sapiens
gaaaggaaagaaagcagaa

SEQ ID NO: 1209802 - RNA, 19 nt, Homo sapiens
agaaacaucuguccagcuu

SEQ ID NO: 1209803 - RNA, 19 nt, Homo sapiens
uacaaugggugcugagaaa

SEQ ID NO: 1209804 - RNA, 19 nt, Homo sapiens
ggacgaggucgauggguaa

SEQ ID NO: 1209805 - RNA, 19 nt, Homo sapiens
gagaagggaagaaaccaaa

SEQ ID NO: 1209806 - RNA, 19 nt, Homo sapiens
acagagaauuuaucacuuc

SEQ ID NO: 1209807 - RNA, 19 nt, Homo sapiens
gaauugagaagggaagaaa

SEQ ID NO: 1209808 - RNA, 19 nt, Homo sapiens
ucccauucauucacaaaua

SEQ ID NO: 1209809 - RNA, 19 nt, Homo sapiens
caaagugggaagaucagua

SEQ ID NO: 1209810 - RNA, 19 nt, Homo sapiens
gauggacgcuuugcuugug

SEQ ID NO: 1209811 - RNA, 19 nt, Homo sapiens
cccauucauucacaaauaa

SEQ ID NO: 1209812 - RNA, 19 nt, Homo sapiens
ggagucagcaacugucuca

SEQ ID NO: 1209813 - RNA, 19 nt, Homo sapiens
gaagcagccgggaaaggaa

SEQ ID NO: 1209814 - RNA, 19 nt, Homo sapiens
gggaccuccuagccaguua

SEQ ID NO: 1209815 - RNA, 19 nt, Homo sapiens
ucaacucaaugugcucaaa

SEQ ID NO: 1209816 - RNA, 19 nt, Homo sapiens
aaaccggaacagagaauuu

SEQ ID NO: 1209817 - RNA, 19 nt, Homo sapiens
gaaaccggaacagagaauu

SEQ ID NO: 1209818 - RNA, 19 nt, Homo sapiens
gcuucgggauggacgcuuu

SEQ ID NO: 1209819 - RNA, 19 nt, Homo sapiens
ccuccuagccaguuacauu

SEQ ID NO: 1209820 - RNA, 19 nt, Homo sapiens
cuucgaagcucuggaugga

SEQ ID NO: 1209821 - RNA, 19 nt, Homo sapiens
gaggucaaacuccaaagug

SEQ ID NO: 1209822 - RNA, 19 nt, Homo sapiens
cuaacucagacacgacuua

SEQ ID NO: 1209823 - RNA, 19 nt, Homo sapiens
gaaagcagaauccaaaaca

SEQ ID NO: 1209824 - RNA, 19 nt, Homo sapiens
caagagggaaggagacgau

SEQ ID NO: 1209825 - RNA, 19 nt, Homo sapiens
acucagacacgacuuauca

SEQ ID NO: 1209826 - RNA, 19 nt, Homo sapiens
ggcgaaaccggaacagaga

SEQ ID NO: 1209827 - RNA, 19 nt, Homo sapiens
ggagacgauuggagucaac

SEQ ID NO: 1209828 - RNA, 19 nt, Homo sapiens
aaccggaacagagaauuua

SEQ ID NO: 1209829 - RNA, 19 nt, Homo sapiens
ggauggacgcuuugcuugu

SEQ ID NO: 1209830 - RNA, 19 nt, Homo sapiens
ggaggaaccaccugaucuc

SEQ ID NO: 1209831 - RNA, 19 nt, Homo sapiens
gaggaggaaccaccugauc

SEQ ID NO: 1209832 - RNA, 19 nt, Homo sapiens
gaagaucaguagggaaccu

SEQ ID NO: 1209833 - RNA, 19 nt, Homo sapiens
cggaacagagaauuuauca

SEQ ID NO: 1209834 - RNA, 19 nt, Homo sapiens
ggaaagaaagcagaaucca

SEQ ID NO: 1209835 - RNA, 19 nt, Homo sapiens
caucagaaugaauugagaa

SEQ ID NO: 1209836 - RNA, 19 nt, Homo sapiens
gagggaaggagacgauugg

SEQ ID NO: 1209837 - RNA, 19 nt, Homo sapiens
ccaccgugcaggcaagaaa

SEQ ID NO: 1209838 - RNA, 19 nt, Homo sapiens
ucagaggucaaacuccaaa

SEQ ID NO: 1209839 - RNA, 19 nt, Homo sapiens
gaagggaagaaaccaaagc

SEQ ID NO: 1209840 - RNA, 19 nt, Homo sapiens
acagagcuccccacuauaa

SEQ ID NO: 1209841 - RNA, 19 nt, Homo sapiens
uaacucagacacgacuuau

SEQ ID NO: 1209842 - RNA, 19 nt, Homo sapiens
acaucagaaugaauugaga

SEQ ID NO: 1209843 - RNA, 19 nt, Homo sapiens
agaagcagccgggaaagga

SEQ ID NO: 1209844 - RNA, 19 nt, Homo sapiens
aaagugggaagaucaguag

SEQ ID NO: 1209845 - RNA, 19 nt, Homo sapiens
ugacucugaugaggaggaa

SEQ ID NO: 1209846 - RNA, 19 nt, Homo sapiens
cauuaucucacccuucgaa

SEQ ID NO: 1209847 - RNA, 19 nt, Homo sapiens
aggcuccucugcuaacuca

SEQ ID NO: 1209848 - RNA, 19 nt, Homo sapiens
gcuugcagcuuuucuaugg

SEQ ID NO: 1209849 - RNA, 19 nt, Homo sapiens
gcgaaaccggaacagagaa

SEQ ID NO: 1209850 - RNA, 19 nt, Homo sapiens
gcaggcaagaaacaucugu

SEQ ID NO: 1209851 - RNA, 19 nt, Homo sapiens
cgaaaccggaacagagaau

SEQ ID NO: 1209852 - RNA, 19 nt, Homo sapiens
gcccuggaccauuaucuca

SEQ ID NO: 1209853 - RNA, 19 nt, Homo sapiens
uuacaaugggugcugagaa

SEQ ID NO: 1209854 - RNA, 19 nt, Homo sapiens
gggcugaccuccauucgua

SEQ ID NO: 1209855 - RNA, 19 nt, Homo sapiens
gcaggagucugucaucacu

SEQ ID NO: 1209856 - RNA, 19 nt, Homo sapiens
caccagcgacuucguaauu

SEQ ID NO: 1209857 - RNA, 19 nt, Homo sapiens
ccaggcaccuuccucuuca

SEQ ID NO: 1209858 - RNA, 19 nt, Homo sapiens
gaugggacuaucaauaaga

SEQ ID NO: 1209859 - RNA, 19 nt, Homo sapiens
ccagcgacuucguaauuca

SEQ ID NO: 1209860 - RNA, 19 nt, Homo sapiens
ccacugcuuuggaggugau

SEQ ID NO: 1209861 - RNA, 19 nt, Homo sapiens
ggacuaucaauaagaacuc

SEQ ID NO: 1209862 - RNA, 19 nt, Homo sapiens
augggacuaucaauaagaa

SEQ ID NO: 1209863 - RNA, 19 nt, Homo sapiens
aggagucugucaucacugu

SEQ ID NO: 1209864 - RNA, 19 nt, Homo sapiens
ggagaaaccuggaagaaua

SEQ ID NO: 1209865 - RNA, 19 nt, Homo sapiens
ccacagagcucguuugcaa

SEQ ID NO: 1209866 - RNA, 19 nt, Homo sapiens
gagcgagacuccaucuaaa

SEQ ID NO: 1209867 - RNA, 19 nt, Homo sapiens
gcuaagggaucacagaaug

SEQ ID NO: 1209868 - RNA, 19 nt, Homo sapiens
cagcagagcuuuggagaug

SEQ ID NO: 1209869 - RNA, 19 nt, Homo sapiens
gaugacaccucccggaaug

SEQ ID NO: 1209870 - RNA, 19 nt, Homo sapiens
gcaaagcacacauggagaa

SEQ ID NO: 1209871 - RNA, 19 nt, Homo sapiens
ucacugagcucaccgacau

SEQ ID NO: 1209872 - RNA, 19 nt, Homo sapiens
aauauuugcucaacuguga

SEQ ID NO: 1209873 - RNA, 19 nt, Homo sapiens
gcacagcccaguggccuua

SEQ ID NO: 1209874 - RNA, 19 nt, Homo sapiens
ggaagaauauuugcucaac

SEQ ID NO: 1209875 - RNA, 19 nt, Homo sapiens
caaguccauucccuccuua

SEQ ID NO: 1209876 - RNA, 19 nt, Homo sapiens
gacagcaagucaaagaaug

SEQ ID NO: 1209877 - RNA, 19 nt, Homo sapiens
cggaggcgcugucucacua

SEQ ID NO: 1209878 - RNA, 19 nt, Homo sapiens
ccaggaacgugcugaggaa

SEQ ID NO: 1209879 - RNA, 19 nt, Homo sapiens
gcaagucaaagaaugaguu

SEQ ID NO: 1209880 - RNA, 19 nt, Homo sapiens
gcucagaacaccaaauauc

SEQ ID NO: 1209881 - RNA, 19 nt, Homo sapiens
uagcucagaacaccaaaua

SEQ ID NO: 1209882 - RNA, 19 nt, Homo sapiens
gaagaauauuugcucaacu

SEQ ID NO: 1209883 - RNA, 19 nt, Homo sapiens
gagaaaccuggaagaauau

SEQ ID NO: 1209884 - RNA, 19 nt, Homo sapiens
ggaacgugcugaggaaugg

SEQ ID NO: 1209885 - RNA, 19 nt, Homo sapiens
gaaaccuggaagaauauuu

SEQ ID NO: 1209886 - RNA, 19 nt, Homo sapiens
ggagcuggccgaggucuuu

SEQ ID NO: 1209887 - RNA, 19 nt, Homo sapiens
aagaauauuugcucaacug

SEQ ID NO: 1209888 - RNA, 19 nt, Homo sapiens
ccaaggcucagcucuaaga

SEQ ID NO: 1209889 - RNA, 19 nt, Homo sapiens
gcccagcagcuuucucuuu

SEQ ID NO: 1209890 - RNA, 19 nt, Homo sapiens
ggucuucgccucacuugga

SEQ ID NO: 1209891 - RNA, 19 nt, Homo sapiens
caagucaaagaaugaguuu

SEQ ID NO: 1209892 - RNA, 19 nt, Homo sapiens
uaaacuugcugggcagguu

SEQ ID NO: 1209893 - RNA, 19 nt, Homo sapiens
cgaacacgauggcagaucu

SEQ ID NO: 1209894 - RNA, 19 nt, Homo sapiens
agagcgagacuccaucuaa

SEQ ID NO: 1209895 - RNA, 19 nt, Homo sapiens
cccagcagcuuucucuuuc

SEQ ID NO: 1209896 - RNA, 19 nt, Homo sapiens
caccaaauaucaccagacu

SEQ ID NO: 1209897 - RNA, 19 nt, Homo sapiens
aggcaugguugguggcuaa

SEQ ID NO: 1209898 - RNA, 19 nt, Homo sapiens
gggagaaaccuggaagaau

SEQ ID NO: 1209899 - RNA, 19 nt, Homo sapiens
ucaccagacugccuaagag

SEQ ID NO: 1209900 - RNA, 19 nt, Homo sapiens
aaaccuggaagaauauuug

SEQ ID NO: 1209901 - RNA, 19 nt, Homo sapiens
acaaguccauucccuccuu

SEQ ID NO: 1209902 - RNA, 19 nt, Homo sapiens
acacagagcccagcagcuu

SEQ ID NO: 1209903 - RNA, 19 nt, Homo sapiens
gcccacggcccuuaaacuu

SEQ ID NO: 1209904 - RNA, 19 nt, Homo sapiens
gcucacacccucccaaugc

SEQ ID NO: 1209905 - RNA, 19 nt, Homo sapiens
ugcugaagcucacagaaug

SEQ ID NO: 1209906 - RNA, 19 nt, Homo sapiens
caggaggacuagaccaucu

SEQ ID NO: 1209907 - RNA, 19 nt, Homo sapiens
ccuccgcacugcuggcaaa

SEQ ID NO: 1209908 - RNA, 19 nt, Homo sapiens
ccugagcuccuucugugua

SEQ ID NO: 1209909 - RNA, 19 nt, Homo sapiens
ugacagagcgagacuccau

SEQ ID NO: 1209910 - RNA, 19 nt, Homo sapiens
uaaagcaucacugcgcauu

SEQ ID NO: 1209911 - RNA, 19 nt, Homo sapiens
aaauaaacaugggagaaac

SEQ ID NO: 1209912 - RNA, 19 nt, Homo sapiens
ccagcagcuuucucuuuca

SEQ ID NO: 1209913 - RNA, 19 nt, Homo sapiens
ccuaagagacuugaugaca

SEQ ID NO: 1209914 - RNA, 19 nt, Homo sapiens
gacagccacuccaggaacu

SEQ ID NO: 1209915 - RNA, 19 nt, Homo sapiens
caucacugcgcauucgaaa

SEQ ID NO: 1209916 - RNA, 19 nt, Homo sapiens
uaccugcucccacuucuga

SEQ ID NO: 1209917 - RNA, 19 nt, Homo sapiens
acagcaagucaaagaauga

SEQ ID NO: 1209918 - RNA, 19 nt, Homo sapiens
ggguucaccucuccuuguc

SEQ ID NO: 1209919 - RNA, 19 nt, Homo sapiens
guugguggcuaagggauca

SEQ ID NO: 1209920 - RNA, 19 nt, Homo sapiens
cauccuuccugcugagcuu

SEQ ID NO: 1209921 - RNA, 19 nt, Homo sapiens
gagcccagcagcuuucucu

SEQ ID NO: 1209922 - RNA, 19 nt, Homo sapiens
gaccugcaccugcuucucu

SEQ ID NO: 1209923 - RNA, 19 nt, Homo sapiens
ggcaugcccugagcuccuu

SEQ ID NO: 1209924 - RNA, 19 nt, Homo sapiens
caaaauucccaccuugauu

SEQ ID NO: 1209925 - RNA, 19 nt, Homo sapiens
gaacacgauggcagaucug

SEQ ID NO: 1209926 - RNA, 19 nt, Homo sapiens
cacacccucccaaugcuua

SEQ ID NO: 1209927 - RNA, 19 nt, Homo sapiens
ucucguuucugcucacauc

SEQ ID NO: 1209928 - RNA, 19 nt, Homo sapiens
ccacugcuaggccacauuc

SEQ ID NO: 1209929 - RNA, 19 nt, Homo sapiens
gcaucacugcgcauucgaa

SEQ ID NO: 1209930 - RNA, 19 nt, Homo sapiens
gccuauuccuccugagauc

SEQ ID NO: 1209931 - RNA, 19 nt, Homo sapiens
cagcagcuuucucuuucag

SEQ ID NO: 1209932 - RNA, 19 nt, Homo sapiens
cuccuggccuucacucuca

SEQ ID NO: 1209933 - RNA, 19 nt, Homo sapiens
gcuaggccacauucucguu

SEQ ID NO: 1209934 - RNA, 19 nt, Homo sapiens
ugacccagcagacacacuu

SEQ ID NO: 1209935 - RNA, 19 nt, Homo sapiens
ccccaaggcucagcucuaa

SEQ ID NO: 1209936 - RNA, 19 nt, Homo sapiens
ggacgacgagaaccucaac

SEQ ID NO: 1209937 - RNA, 19 nt, Homo sapiens
gcuccaaccuccgcguuuu

SEQ ID NO: 1209938 - RNA, 19 nt, Homo sapiens
aguagaagacucagaauua

SEQ ID NO: 1209939 - RNA, 19 nt, Homo sapiens
guagaagacucagaauuag

SEQ ID NO: 1209940 - RNA, 19 nt, Homo sapiens
gcgcaggucccuuugauga

SEQ ID NO: 1209941 - RNA, 19 nt, Homo sapiens
gcuaagggcccaugugauc

SEQ ID NO: 1209942 - RNA, 19 nt, Homo sapiens
gagagacagccuucgcuuu

SEQ ID NO: 1209943 - RNA, 19 nt, Homo sapiens
ccagauggacacugagaaa

SEQ ID NO: 1209944 - RNA, 19 nt, Homo sapiens
agaagacucagaauuagaa

SEQ ID NO: 1209945 - RNA, 19 nt, Homo sapiens
ggaagaaccagggcagcuu

SEQ ID NO: 1209946 - RNA, 19 nt, Homo sapiens
agagacagccuucgcuuuc

SEQ ID NO: 1209947 - RNA, 19 nt, Homo sapiens
gcgucuaccugcucuacug

SEQ ID NO: 1209948 - RNA, 19 nt, Homo sapiens
gccaaugcccuugcuguga

SEQ ID NO: 1209949 - RNA, 19 nt, Homo sapiens
uagaagacucagaauuaga

SEQ ID NO: 1209950 - RNA, 19 nt, Homo sapiens
ugugccagauggacacuga

SEQ ID NO: 1209951 - RNA, 19 nt, Homo sapiens
ccgcgcaggucccuuugau

SEQ ID NO: 1209952 - RNA, 19 nt, Homo sapiens
caaugcccuugcugugaga

SEQ ID NO: 1209953 - RNA, 19 nt, Homo sapiens
cugcuaagggcccauguga

SEQ ID NO: 1209954 - RNA, 19 nt, Homo sapiens
aaguagaagacucagaauu

SEQ ID NO: 1209955 - RNA, 19 nt, Homo sapiens
ggaaagaacuuaacagaaa

SEQ ID NO: 1209956 - RNA, 19 nt, Homo sapiens
ggaaacacaucuucuaauu

SEQ ID NO: 1209957 - RNA, 19 nt, Homo sapiens
gaauagaaaucgaucaaga

SEQ ID NO: 1209958 - RNA, 19 nt, Homo sapiens
gaacaaaucuacuuaucca

SEQ ID NO: 1209959 - RNA, 19 nt, Homo sapiens
gaagggagggcuauuauuu

SEQ ID NO: 1209960 - RNA, 19 nt, Homo sapiens
gccaaagacuucaaagaua

SEQ ID NO: 1209961 - RNA, 19 nt, Homo sapiens
agaaagaggucaacuaaga

SEQ ID NO: 1209962 - RNA, 19 nt, Homo sapiens
caacuacuguggaacauuu

SEQ ID NO: 1209963 - RNA, 19 nt, Homo sapiens
ccaaagaaaucaagaaaca

SEQ ID NO: 1209964 - RNA, 19 nt, Homo sapiens
gaaaugguauugacaucuu

SEQ ID NO: 1209965 - RNA, 19 nt, Homo sapiens
gaagaaggauuuaauagac

SEQ ID NO: 1209966 - RNA, 19 nt, Homo sapiens
caaagaaguuggucguauu

SEQ ID NO: 1209967 - RNA, 19 nt, Homo sapiens
acagaaagcugaguaguaa

SEQ ID NO: 1209968 - RNA, 19 nt, Homo sapiens
ccaaagacuucaaagauau

SEQ ID NO: 1209969 - RNA, 19 nt, Homo sapiens
ggacagggauuuguauaug

SEQ ID NO: 1209970 - RNA, 19 nt, Homo sapiens
gcaaagaaguuggucguau

SEQ ID NO: 1209971 - RNA, 19 nt, Homo sapiens
gauguuagauuuagguuuc

SEQ ID NO: 1209972 - RNA, 19 nt, Homo sapiens
ugaaguggaucagauguua

SEQ ID NO: 1209973 - RNA, 19 nt, Homo sapiens
uaacugaaauggccaugaa

SEQ ID NO: 1209974 - RNA, 19 nt, Homo sapiens
gaaaagaucuaccaaaugg

SEQ ID NO: 1209975 - RNA, 19 nt, Homo sapiens
gaucagauguuagauuuag

SEQ ID NO: 1209976 - RNA, 19 nt, Homo sapiens
agugugagcuugccuauuu

SEQ ID NO: 1209977 - RNA, 19 nt, Homo sapiens
gaaagaacuuaacagaaag

SEQ ID NO: 1209978 - RNA, 19 nt, Homo sapiens
ggccaugaauccacacaua

SEQ ID NO: 1209979 - RNA, 19 nt, Homo sapiens
gguggaacaucauaucaaa

SEQ ID NO: 1209980 - RNA, 19 nt, Homo sapiens
ggaagucaaggcaccauua

SEQ ID NO: 1209981 - RNA, 19 nt, Homo sapiens
caagaagaauguaacugaa

SEQ ID NO: 1209982 - RNA, 19 nt, Homo sapiens
agaaaucgaucaagaagug

SEQ ID NO: 1209983 - RNA, 19 nt, Homo sapiens
aaauauggguguuugcuuu

SEQ ID NO: 1209984 - RNA, 19 nt, Homo sapiens
gaaagacuccaaagaaauc

SEQ ID NO: 1209985 - RNA, 19 nt, Homo sapiens
gaugagaaaucagaaacaa

SEQ ID NO: 1209986 - RNA, 19 nt, Homo sapiens
ccaguuauaccuuugaaua

SEQ ID NO: 1209987 - RNA, 19 nt, Homo sapiens
ucucauaagucaagaagaa

SEQ ID NO: 1209988 - RNA, 19 nt, Homo sapiens
ggaagucgcucaggaaguc

SEQ ID NO: 1209989 - RNA, 19 nt, Homo sapiens
gaaaggaaauauggguguu

SEQ ID NO: 1209990 - RNA, 19 nt, Homo sapiens
caaaucuacuuauccaguu

SEQ ID NO: 1209991 - RNA, 19 nt, Homo sapiens
ucacaagaauggaacaaau

SEQ ID NO: 1209992 - RNA, 19 nt, Homo sapiens
ccacauuucuggugcauca

SEQ ID NO: 1209993 - RNA, 19 nt, Homo sapiens
uggaucagauguuagauuu

SEQ ID NO: 1209994 - RNA, 19 nt, Homo sapiens
ggacggacagggauuugua

SEQ ID NO: 1209995 - RNA, 19 nt, Homo sapiens
ccaagaagaauguaacuga

SEQ ID NO: 1209996 - RNA, 19 nt, Homo sapiens
cuauaaagcuucugaaagg

SEQ ID NO: 1209997 - RNA, 19 nt, Homo sapiens
gagauguccuucaagucua

SEQ ID NO: 1209998 - RNA, 19 nt, Homo sapiens
gauuggaucuuucuaaacu

SEQ ID NO: 1209999 - RNA, 19 nt, Homo sapiens
ggaacuggcaaaccaagua

SEQ ID NO: 1210000 - RNA, 19 nt, Homo sapiens
gaaaucagaaacaagagaa

SEQ ID NO: 1210001 - RNA, 19 nt, Homo sapiens
gaaugugccuccugaaagg

SEQ ID NO: 1210002 - RNA, 19 nt, Homo sapiens
agacaauccucagacuuua

SEQ ID NO: 1210003 - RNA, 19 nt, Homo sapiens
caagggaacuggcaaacca

SEQ ID NO: 1210004 - RNA, 19 nt, Homo sapiens
acauaucucuuuccuauuc

SEQ ID NO: 1210005 - RNA, 19 nt, Homo sapiens
gaaacacaucuucuaauuc

SEQ ID NO: 1210006 - RNA, 19 nt, Homo sapiens
agagaaagaggucaacuaa

SEQ ID NO: 1210007 - RNA, 19 nt, Homo sapiens
uugaaagacuccaaagaaa

SEQ ID NO: 1210008 - RNA, 19 nt, Homo sapiens
gaagcuaaauggagacacu

SEQ ID NO: 1210009 - RNA, 19 nt, Homo sapiens
ggaaagccuagaggaaaua

SEQ ID NO: 1210010 - RNA, 19 nt, Homo sapiens
ggacauuccugaaguugac

SEQ ID NO: 1210011 - RNA, 19 nt, Homo sapiens
caaaccaaguagccaaaga

SEQ ID NO: 1210012 - RNA, 19 nt, Homo sapiens
ucagaugaauucuccaaau

SEQ ID NO: 1210013 - RNA, 19 nt, Homo sapiens
aaacacaucuucuaauucc

SEQ ID NO: 1210014 - RNA, 19 nt, Homo sapiens
guaaugcagugucucagau

SEQ ID NO: 1210015 - RNA, 19 nt, Homo sapiens
ccgauuggaucuuucuaaa

SEQ ID NO: 1210016 - RNA, 19 nt, Homo sapiens
caaauggagauauagauga

SEQ ID NO: 1210017 - RNA, 19 nt, Homo sapiens
gaauggaacaaaucuacuu

SEQ ID NO: 1210018 - RNA, 19 nt, Homo sapiens
agagaaaggugcaguggau

SEQ ID NO: 1210019 - RNA, 19 nt, Homo sapiens
gaaagaggucaacuaagau

SEQ ID NO: 1210020 - RNA, 19 nt, Homo sapiens
ugagaaaucagaaacaaga

SEQ ID NO: 1210021 - RNA, 19 nt, Homo sapiens
ugaagagacuauaaagcuu

SEQ ID NO: 1210022 - RNA, 19 nt, Homo sapiens
cagaugaauucuccaaauc

SEQ ID NO: 1210023 - RNA, 19 nt, Homo sapiens
gaaagagaagcuaaaugga

SEQ ID NO: 1210024 - RNA, 19 nt, Homo sapiens
ugagguaugugucugcuau

SEQ ID NO: 1210025 - RNA, 19 nt, Homo sapiens
gacagggauuuguauaugu

SEQ ID NO: 1210026 - RNA, 19 nt, Homo sapiens
ggagauguccuucaagucu

SEQ ID NO: 1210027 - RNA, 19 nt, Homo sapiens
cuccaaaucucauaaguca

SEQ ID NO: 1210028 - RNA, 19 nt, Homo sapiens
ugaaagagaagcuaaaugg

SEQ ID NO: 1210029 - RNA, 19 nt, Homo sapiens
gaugucagcugugcuugga

SEQ ID NO: 1210030 - RNA, 19 nt, Homo sapiens
aaagaggucaacuaagaua

SEQ ID NO: 1210031 - RNA, 19 nt, Homo sapiens
gacauguugugcuugauga

SEQ ID NO: 1210032 - RNA, 19 nt, Homo sapiens
gaagucaaggcaccauuau

SEQ ID NO: 1210033 - RNA, 19 nt, Homo sapiens
gaggucaacuaagauaugu

SEQ ID NO: 1210034 - RNA, 19 nt, Homo sapiens
gaaguugaccuggugauuc

SEQ ID NO: 1210035 - RNA, 19 nt, Homo sapiens
gcacggacaggaacaggaa

SEQ ID NO: 1210036 - RNA, 19 nt, Homo sapiens
uaaacuagaggagaccuua

SEQ ID NO: 1210037 - RNA, 19 nt, Homo sapiens
ggaagucgacaagauggua

SEQ ID NO: 1210038 - RNA, 19 nt, Homo sapiens
ccagccaaauuaccugaaa

SEQ ID NO: 1210039 - RNA, 19 nt, Homo sapiens
gaaauauggguguuugcuu

SEQ ID NO: 1210040 - RNA, 19 nt, Homo sapiens
gcacagucacaaagagaaa

SEQ ID NO: 1210041 - RNA, 19 nt, Homo sapiens
cuuaacacgugaacagaaa

SEQ ID NO: 1210042 - RNA, 19 nt, Homo sapiens
cagcugugcuuggaaagaa

SEQ ID NO: 1210043 - RNA, 19 nt, Homo sapiens
caugaaauccagauaugaa

SEQ ID NO: 1210044 - RNA, 19 nt, Homo sapiens
uacaugaaauccagauaug

SEQ ID NO: 1210045 - RNA, 19 nt, Homo sapiens
gaagacaauccucagacuu

SEQ ID NO: 1210046 - RNA, 19 nt, Homo sapiens
cuacaaaacugauucugaa

SEQ ID NO: 1210047 - RNA, 19 nt, Homo sapiens
cugaacaaguugaagauau

SEQ ID NO: 1210048 - RNA, 19 nt, Homo sapiens
ucucagaggccagcaguua

SEQ ID NO: 1210049 - RNA, 19 nt, Homo sapiens
ucuaccaaauggagauaua

SEQ ID NO: 1210050 - RNA, 19 nt, Homo sapiens
caaggaagucgcucaggaa

SEQ ID NO: 1210051 - RNA, 19 nt, Homo sapiens
gaugaauucuccaaaucuc

SEQ ID NO: 1210052 - RNA, 19 nt, Homo sapiens
aaugcagugucucagauua

SEQ ID NO: 1210053 - RNA, 19 nt, Homo sapiens
gaugguagaagacgaagug

SEQ ID NO: 1210054 - RNA, 19 nt, Homo sapiens
ucgacaagaugguagaaga

SEQ ID NO: 1210055 - RNA, 19 nt, Homo sapiens
ggaagaagaugauuaugag

SEQ ID NO: 1210056 - RNA, 19 nt, Homo sapiens
ggaggugacugacagauau

SEQ ID NO: 1210057 - RNA, 19 nt, Homo sapiens
gggaaaggaggaacaauua

SEQ ID NO: 1210058 - RNA, 19 nt, Homo sapiens
ggaagaggcugcugguugu

SEQ ID NO: 1210059 - RNA, 19 nt, Homo sapiens
gcagaaagguagggcagua

SEQ ID NO: 1210060 - RNA, 19 nt, Homo sapiens
gauccuggcuggugacuau

SEQ ID NO: 1210061 - RNA, 19 nt, Homo sapiens
gcaauccaccuuucuauga

SEQ ID NO: 1210062 - RNA, 19 nt, Homo sapiens
gcaaugcugcuucugauaa

SEQ ID NO: 1210063 - RNA, 19 nt, Homo sapiens
caucaagacugaggaguuu

SEQ ID NO: 1210064 - RNA, 19 nt, Homo sapiens
ggucugcucugguguguga

SEQ ID NO: 1210065 - RNA, 19 nt, Homo sapiens
cugaagaacucgaagauug

SEQ ID NO: 1210066 - RNA, 19 nt, Homo sapiens
ggcaauaacucauaaucug

SEQ ID NO: 1210067 - RNA, 19 nt, Homo sapiens
acaaugaaaugaagaggaa

SEQ ID NO: 1210068 - RNA, 19 nt, Homo sapiens
gcauggcaauaacucauaa

SEQ ID NO: 1210069 - RNA, 19 nt, Homo sapiens
gcaauaacucauaaucuga

SEQ ID NO: 1210070 - RNA, 19 nt, Homo sapiens
gcggaaagcugccaagaac

SEQ ID NO: 1210071 - RNA, 19 nt, Homo sapiens
gcgacaagaagaacuauaa

SEQ ID NO: 1210072 - RNA, 19 nt, Homo sapiens
cuacugaaccuggcaaaua

SEQ ID NO: 1210073 - RNA, 19 nt, Homo sapiens
ggaugcugcucuagggaua

SEQ ID NO: 1210074 - RNA, 19 nt, Homo sapiens
uacugaaccuggcaaauaa

SEQ ID NO: 1210075 - RNA, 19 nt, Homo sapiens
cuaagacccuguuauuugu

SEQ ID NO: 1210076 - RNA, 19 nt, Homo sapiens
ggaacucccucuuucuaca

SEQ ID NO: 1210077 - RNA, 19 nt, Homo sapiens
ccuaagacccuguuauuug

SEQ ID NO: 1210078 - RNA, 19 nt, Homo sapiens
ggaggaggccagcugagua

SEQ ID NO: 1210079 - RNA, 19 nt, Homo sapiens
cgaagauugucaucaguga

SEQ ID NO: 1210080 - RNA, 19 nt, Homo sapiens
ugagaaccaugauaagaau

SEQ ID NO: 1210081 - RNA, 19 nt, Homo sapiens
gagauaggcauccucaaga

SEQ ID NO: 1210082 - RNA, 19 nt, Homo sapiens
ggaugaggaaguaggguua

SEQ ID NO: 1210083 - RNA, 19 nt, Homo sapiens
gcacauggcuagggauacu

SEQ ID NO: 1210084 - RNA, 19 nt, Homo sapiens
ccauuggagucaucaugua

SEQ ID NO: 1210085 - RNA, 19 nt, Homo sapiens
gcaaggaguacuuuaucuu

SEQ ID NO: 1210086 - RNA, 19 nt, Homo sapiens
ggaaagcugccaagaacga

SEQ ID NO: 1210087 - RNA, 19 nt, Homo sapiens
gaaggucgguggguuaacu

SEQ ID NO: 1210088 - RNA, 19 nt, Homo sapiens
uagagucacuggcaugaug

SEQ ID NO: 1210089 - RNA, 19 nt, Homo sapiens
gcggaucacugcagaagag

SEQ ID NO: 1210090 - RNA, 19 nt, Homo sapiens
ugauggagguggagcaaga

SEQ ID NO: 1210091 - RNA, 19 nt, Homo sapiens
gcuccacccucuaguaaag

SEQ ID NO: 1210092 - RNA, 19 nt, Homo sapiens
gacaggucaucaagacuga

SEQ ID NO: 1210093 - RNA, 19 nt, Homo sapiens
gaaccuggcaaauaaacau

SEQ ID NO: 1210094 - RNA, 19 nt, Homo sapiens
gaaaggaggaacaauuagg

SEQ ID NO: 1210095 - RNA, 19 nt, Homo sapiens
ggaguggagagaaugagua

SEQ ID NO: 1210096 - RNA, 19 nt, Homo sapiens
cuacagcucacuucuauca

SEQ ID NO: 1210097 - RNA, 19 nt, Homo sapiens
cugcucaguucaacaauga

SEQ ID NO: 1210098 - RNA, 19 nt, Homo sapiens
gagcagauacaggcuggua

SEQ ID NO: 1210099 - RNA, 19 nt, Homo sapiens
ugacugacagauaugauuu

SEQ ID NO: 1210100 - RNA, 19 nt, Homo sapiens
gagcaagaccagcggauca

SEQ ID NO: 1210101 - RNA, 19 nt, Homo sapiens
uggaagaagaugauuauga

SEQ ID NO: 1210102 - RNA, 19 nt, Homo sapiens
gguggaagaagaugauuau

SEQ ID NO: 1210103 - RNA, 19 nt, Homo sapiens
gaaagguagggcaguaugu

SEQ ID NO: 1210104 - RNA, 19 nt, Homo sapiens
cgagugaccacccucauga

SEQ ID NO: 1210105 - RNA, 19 nt, Homo sapiens
gaagaagaugauuaugaga

SEQ ID NO: 1210106 - RNA, 19 nt, Homo sapiens
caaggaguacuuuaucuuc

SEQ ID NO: 1210107 - RNA, 19 nt, Homo sapiens
ggugaagcaucccaacauc

SEQ ID NO: 1210108 - RNA, 19 nt, Homo sapiens
gguagggcaguauguuuaa

SEQ ID NO: 1210109 - RNA, 19 nt, Homo sapiens
ggaaaggaggaacaauuag

SEQ ID NO: 1210110 - RNA, 19 nt, Homo sapiens
uauagaggaugcagaaagg

SEQ ID NO: 1210111 - RNA, 19 nt, Homo sapiens
acagcucacuucuaucaga

SEQ ID NO: 1210112 - RNA, 19 nt, Homo sapiens
uuaacugugugccuacuga

SEQ ID NO: 1210113 - RNA, 19 nt, Homo sapiens
ccucaggaguggagagaau

SEQ ID NO: 1210114 - RNA, 19 nt, Homo sapiens
gcuucucacuguacauaga

SEQ ID NO: 1210115 - RNA, 19 nt, Homo sapiens
gggcuucucacuguacaua

SEQ ID NO: 1210116 - RNA, 19 nt, Homo sapiens
gauuaugagaaccaugaua

SEQ ID NO: 1210117 - RNA, 19 nt, Homo sapiens
uauuugcacucacucaaga

SEQ ID NO: 1210118 - RNA, 19 nt, Homo sapiens
ugugugggcugcucuagga

SEQ ID NO: 1210119 - RNA, 19 nt, Homo sapiens
gaggccaucucccaugagu

SEQ ID NO: 1210120 - RNA, 19 nt, Homo sapiens
aagaggccaucucccauga

SEQ ID NO: 1210121 - RNA, 19 nt, Homo sapiens
ucaagaucgugcacaggaa

SEQ ID NO: 1210122 - RNA, 19 nt, Homo sapiens
gaaccucaugagccucuaa

SEQ ID NO: 1210123 - RNA, 19 nt, Homo sapiens
uguguuauuuccugccuuu

SEQ ID NO: 1210124 - RNA, 19 nt, Homo sapiens
ucauguacauccugcuuuc

SEQ ID NO: 1210125 - RNA, 19 nt, Homo sapiens
cagccuuacuggguccuua

SEQ ID NO: 1210126 - RNA, 19 nt, Homo sapiens
cugcaaagagugauaaugu

SEQ ID NO: 1210127 - RNA, 19 nt, Homo sapiens
caaugcugcuucugauaag

SEQ ID NO: 1210128 - RNA, 19 nt, Homo sapiens
aaaauggccucaucaagga

SEQ ID NO: 1210129 - RNA, 19 nt, Homo sapiens
uuucugggaugaggaagua

SEQ ID NO: 1210130 - RNA, 19 nt, Homo sapiens
caaacagggagggcugaua

SEQ ID NO: 1210131 - RNA, 19 nt, Homo sapiens
uuugcuagcuucaccaguu

SEQ ID NO: 1210132 - RNA, 19 nt, Homo sapiens
gaagcaucccaacauccua

SEQ ID NO: 1210133 - RNA, 19 nt, Homo sapiens
gacccuguuauuuguguua

SEQ ID NO: 1210134 - RNA, 19 nt, Homo sapiens
gggcagaagcuuccauuuu

SEQ ID NO: 1210135 - RNA, 19 nt, Homo sapiens
guggagagaaugaguagga

SEQ ID NO: 1210136 - RNA, 19 nt, Homo sapiens
uagaggaugcagaaaggua

SEQ ID NO: 1210137 - RNA, 19 nt, Homo sapiens
guauagaggaugcagaaag

SEQ ID NO: 1210138 - RNA, 19 nt, Homo sapiens
gcgcuacuccagccacuga

SEQ ID NO: 1210139 - RNA, 19 nt, Homo sapiens
augaggagguggaagaaga

SEQ ID NO: 1210140 - RNA, 19 nt, Homo sapiens
cgagauaggcauccucaag

SEQ ID NO: 1210141 - RNA, 19 nt, Homo sapiens
uaugagaaccaugauaaga

SEQ ID NO: 1210142 - RNA, 19 nt, Homo sapiens
ggagguggaagaagaugau

SEQ ID NO: 1210143 - RNA, 19 nt, Homo sapiens
caauccaccuuucuaugag

SEQ ID NO: 1210144 - RNA, 19 nt, Homo sapiens
ugaagaacucgaagauugu

SEQ ID NO: 1210145 - RNA, 19 nt, Homo sapiens
agacacaagcaacguggua

SEQ ID NO: 1210146 - RNA, 19 nt, Homo sapiens
uuuggagguuugcccuuua

SEQ ID NO: 1210147 - RNA, 19 nt, Homo sapiens
cuagggauacugcucacua

SEQ ID NO: 1210148 - RNA, 19 nt, Homo sapiens
agauaggcauccucaagau

SEQ ID NO: 1210149 - RNA, 19 nt, Homo sapiens
gcagucucgucuccugugu

SEQ ID NO: 1210150 - RNA, 19 nt, Homo sapiens
gaggaggccagcugaguag

SEQ ID NO: 1210151 - RNA, 19 nt, Homo sapiens
ggcaaugcugcuucugaua

SEQ ID NO: 1210152 - RNA, 19 nt, Homo sapiens
gcuggugacuaugaguuug

SEQ ID NO: 1210153 - RNA, 19 nt, Homo sapiens
agaagaugauuaugagaac

SEQ ID NO: 1210154 - RNA, 19 nt, Homo sapiens
aaaggaggaacaauuagga

SEQ ID NO: 1210155 - RNA, 19 nt, Homo sapiens
ggacagaucagaagacaua

SEQ ID NO: 1210156 - RNA, 19 nt, Homo sapiens
gaagagcccugcacaaugc

SEQ ID NO: 1210157 - RNA, 19 nt, Homo sapiens
gaaguuugccuuuauucua

SEQ ID NO: 1210158 - RNA, 19 nt, Homo sapiens
ggugaugagugccacauuu

SEQ ID NO: 1210159 - RNA, 19 nt, Homo sapiens
gaccagcgagguagcauua

SEQ ID NO: 1210160 - RNA, 19 nt, Homo sapiens
gcaaggccuucuagcauuc

SEQ ID NO: 1210161 - RNA, 19 nt, Homo sapiens
gaagaaggagccugaagga

SEQ ID NO: 1210162 - RNA, 19 nt, Homo sapiens
gaagggagagccacauguu

SEQ ID NO: 1210163 - RNA, 19 nt, Homo sapiens
gagaugauuucaagcagau

SEQ ID NO: 1210164 - RNA, 19 nt, Homo sapiens
gcagaaagacuuggagaug

SEQ ID NO: 1210165 - RNA, 19 nt, Homo sapiens
ggaagagcccugcacaaug

SEQ ID NO: 1210166 - RNA, 19 nt, Homo sapiens
gaagucaccauucaggauu

SEQ ID NO: 1210167 - RNA, 19 nt, Homo sapiens
gagacgacaccaccagaua

SEQ ID NO: 1210168 - RNA, 19 nt, Homo sapiens
acacagggcuuuuaccaua

SEQ ID NO: 1210169 - RNA, 19 nt, Homo sapiens
ucacucauguucuugaaug

SEQ ID NO: 1210170 - RNA, 19 nt, Homo sapiens
gcacaaggcccacggugau

SEQ ID NO: 1210171 - RNA, 19 nt, Homo sapiens
uaugagagcugggaaaugg

SEQ ID NO: 1210172 - RNA, 19 nt, Homo sapiens
ccagauagaagucaccauu

SEQ ID NO: 1210173 - RNA, 19 nt, Homo sapiens
caccaucacucauguucuu

SEQ ID NO: 1210174 - RNA, 19 nt, Homo sapiens
ggucuuccaugauacugaa

SEQ ID NO: 1210175 - RNA, 19 nt, Homo sapiens
agaugcagccugaccauua

SEQ ID NO: 1210176 - RNA, 19 nt, Homo sapiens
ugagggaccuacccaacaa

SEQ ID NO: 1210177 - RNA, 19 nt, Homo sapiens
agaaagacuuggagaugga

SEQ ID NO: 1210178 - RNA, 19 nt, Homo sapiens
uggagacccugaagaagaa

SEQ ID NO: 1210179 - RNA, 19 nt, Homo sapiens
gcacaccacccaaguacau

SEQ ID NO: 1210180 - RNA, 19 nt, Homo sapiens
agauagaagucaccauuca

SEQ ID NO: 1210181 - RNA, 19 nt, Homo sapiens
ccauccacaucuaaacuuu

SEQ ID NO: 1210182 - RNA, 19 nt, Homo sapiens
gaugcagccugaccauuag

SEQ ID NO: 1210183 - RNA, 19 nt, Homo sapiens
gagccaccaucacucaugu

SEQ ID NO: 1210184 - RNA, 19 nt, Homo sapiens
acgaggagcugcagaugau

SEQ ID NO: 1210185 - RNA, 19 nt, Homo sapiens
gaacgaggagcugcagaug

SEQ ID NO: 1210186 - RNA, 19 nt, Homo sapiens
gaccuuguguaccuguuug

SEQ ID NO: 1210187 - RNA, 19 nt, Homo sapiens
ugcaaggccuucuagcauu

SEQ ID NO: 1210188 - RNA, 19 nt, Homo sapiens
cagaucagaagacauaguu

SEQ ID NO: 1210189 - RNA, 19 nt, Homo sapiens
caucacucauguucuugaa

SEQ ID NO: 1210190 - RNA, 19 nt, Homo sapiens
gaggagcugcagaugauga

SEQ ID NO: 1210191 - RNA, 19 nt, Homo sapiens
ggaacgaggagcugcagau

SEQ ID NO: 1210192 - RNA, 19 nt, Homo sapiens
gggaacaugggcuggauga

SEQ ID NO: 1210193 - RNA, 19 nt, Homo sapiens
ugaagccgcgagaugauuu

SEQ ID NO: 1210194 - RNA, 19 nt, Homo sapiens
ggaccuuguguaccuguuu

SEQ ID NO: 1210195 - RNA, 19 nt, Homo sapiens
ggcaggagcagaaagacuu

SEQ ID NO: 1210196 - RNA, 19 nt, Homo sapiens
ggaccuacccaacaagaac

SEQ ID NO: 1210197 - RNA, 19 nt, Homo sapiens
ggagauccaccagcuguuc

SEQ ID NO: 1210198 - RNA, 19 nt, Homo sapiens
cauucaggauuuggacuuu

SEQ ID NO: 1210199 - RNA, 19 nt, Homo sapiens
gaagaagaaggagccugaa

SEQ ID NO: 1210200 - RNA, 19 nt, Homo sapiens
ccagaacggugacuaaaag

SEQ ID NO: 1210201 - RNA, 19 nt, Homo sapiens
gugaugagugccacauuug

SEQ ID NO: 1210202 - RNA, 19 nt, Homo sapiens
gacgacaccaccagauaga

SEQ ID NO: 1210203 - RNA, 19 nt, Homo sapiens
gccgcgagaugauuucaag

SEQ ID NO: 1210204 - RNA, 19 nt, Homo sapiens
gcaggagcagaaagacuug

SEQ ID NO: 1210205 - RNA, 19 nt, Homo sapiens
uggaagagcccugcacaau

SEQ ID NO: 1210206 - RNA, 19 nt, Homo sapiens
gggcuccacauccuucauu

SEQ ID NO: 1210207 - RNA, 19 nt, Homo sapiens
guggacagaucagaagaca

SEQ ID NO: 1210208 - RNA, 19 nt, Homo sapiens
ugaauccccugguaaguga

SEQ ID NO: 1210209 - RNA, 19 nt, Homo sapiens
ggagacgacaccaccagau

SEQ ID NO: 1210210 - RNA, 19 nt, Homo sapiens
gacggucccuagagaggau

SEQ ID NO: 1210211 - RNA, 19 nt, Homo sapiens
ugaaggcccgucagguuug

SEQ ID NO: 1210212 - RNA, 19 nt, Homo sapiens
ucuacuccauccacaucua

SEQ ID NO: 1210213 - RNA, 19 nt, Homo sapiens
gcuggaagguuuucuugug

SEQ ID NO: 1210214 - RNA, 19 nt, Homo sapiens
ggaccagcgagguagcauu

SEQ ID NO: 1210215 - RNA, 19 nt, Homo sapiens
gcaagaugcacaggaccuu

SEQ ID NO: 1210216 - RNA, 19 nt, Homo sapiens
cuggagacccugaagaaga

SEQ ID NO: 1210217 - RNA, 19 nt, Homo sapiens
gcuaugagagcugggaaau

SEQ ID NO: 1210218 - RNA, 19 nt, Homo sapiens
gccuggagacccugaagaa

SEQ ID NO: 1210219 - RNA, 19 nt, Homo sapiens
gacggcaggagcagaaaga

SEQ ID NO: 1210220 - RNA, 19 nt, Homo sapiens
gccaaggccaaauugcaaa

SEQ ID NO: 1210221 - RNA, 19 nt, Homo sapiens
aaguuugccuuuauucuac

SEQ ID NO: 1210222 - RNA, 19 nt, Homo sapiens
ggagagccacauguugaug

SEQ ID NO: 1210223 - RNA, 19 nt, Homo sapiens
cuacuccauccacaucuaa

SEQ ID NO: 1210224 - RNA, 19 nt, Homo sapiens
aagucaccauucaggauuu

SEQ ID NO: 1210225 - RNA, 19 nt, Homo sapiens
agggagagccacauguuga

SEQ ID NO: 1210226 - RNA, 19 nt, Homo sapiens
ucauuagugcgguuacuga

SEQ ID NO: 1210227 - RNA, 19 nt, Homo sapiens
gaugagugccacauuugag

SEQ ID NO: 1210228 - RNA, 19 nt, Homo sapiens
cgacaccaccagauagaag

SEQ ID NO: 1210229 - RNA, 19 nt, Homo sapiens
ucuaaacuuuggaggucaa

SEQ ID NO: 1210230 - RNA, 19 nt, Homo sapiens
ugaugagugccacauuuga

SEQ ID NO: 1210231 - RNA, 19 nt, Homo sapiens
gagauccaccagcuguuca

SEQ ID NO: 1210232 - RNA, 19 nt, Homo sapiens
cagauagaagucaccauuc

SEQ ID NO: 1210233 - RNA, 19 nt, Homo sapiens
gggagagccacauguugau

SEQ ID NO: 1210234 - RNA, 19 nt, Homo sapiens
gaaggcccgucagguuugc

SEQ ID NO: 1210235 - RNA, 19 nt, Homo sapiens
gcagaugcagccugaccau

SEQ ID NO: 1210236 - RNA, 19 nt, Homo sapiens
gucaccacaucacuucuca

SEQ ID NO: 1210237 - RNA, 19 nt, Homo sapiens
gauagaagucaccauucag

SEQ ID NO: 1210238 - RNA, 19 nt, Homo sapiens
uguguacccugcucuuucu

SEQ ID NO: 1210239 - RNA, 19 nt, Homo sapiens
agagacggcaggagcagaa

SEQ ID NO: 1210240 - RNA, 19 nt, Homo sapiens
cauccuucauucacugauc

SEQ ID NO: 1210241 - RNA, 19 nt, Homo sapiens
gaagaugggucuaaugacu

SEQ ID NO: 1210242 - RNA, 19 nt, Homo sapiens
ggguuaagccugcaacaua

SEQ ID NO: 1210243 - RNA, 19 nt, Homo sapiens
ggaaguuaauguccuggaa

SEQ ID NO: 1210244 - RNA, 19 nt, Homo sapiens
gagaagaaucaaccaaauu

SEQ ID NO: 1210245 - RNA, 19 nt, Homo sapiens
ugaagaggguuuaauaugg

SEQ ID NO: 1210246 - RNA, 19 nt, Homo sapiens
gguuaagccugcaacauau

SEQ ID NO: 1210247 - RNA, 19 nt, Homo sapiens
ccagaaccaugagccaaua

SEQ ID NO: 1210248 - RNA, 19 nt, Homo sapiens
gguccacucuguauugcua

SEQ ID NO: 1210249 - RNA, 19 nt, Homo sapiens
gaaaauagcagaugagaag

SEQ ID NO: 1210250 - RNA, 19 nt, Homo sapiens
ggaagaaaauagcagauga

SEQ ID NO: 1210251 - RNA, 19 nt, Homo sapiens
caaacugaguaauugaaga

SEQ ID NO: 1210252 - RNA, 19 nt, Homo sapiens
ugagaagaaucaaccaaau

SEQ ID NO: 1210253 - RNA, 19 nt, Homo sapiens
aaacucagccggucauguu

SEQ ID NO: 1210254 - RNA, 19 nt, Homo sapiens
uaagagugccaggaaguua

SEQ ID NO: 1210255 - RNA, 19 nt, Homo sapiens
ccaaauaaacuacuugcau

SEQ ID NO: 1210256 - RNA, 19 nt, Homo sapiens
aaacuaagagugccaggaa

SEQ ID NO: 1210257 - RNA, 19 nt, Homo sapiens
ccagagaggacugcagaua

SEQ ID NO: 1210258 - RNA, 19 nt, Homo sapiens
gcuacuuacugcuaacaga

SEQ ID NO: 1210259 - RNA, 19 nt, Homo sapiens
gaaaacguaugaggaagaa

SEQ ID NO: 1210260 - RNA, 19 nt, Homo sapiens
acauggcaauagcuacuua

SEQ ID NO: 1210261 - RNA, 19 nt, Homo sapiens
ucgcuccucugcuggguua

SEQ ID NO: 1210262 - RNA, 19 nt, Homo sapiens
gcaccuugauauuggacuu

SEQ ID NO: 1210263 - RNA, 19 nt, Homo sapiens
uguuuccucuucccaaaua

SEQ ID NO: 1210264 - RNA, 19 nt, Homo sapiens
agagaggacugcagauagu

SEQ ID NO: 1210265 - RNA, 19 nt, Homo sapiens
gcucaagaccagccuguau

SEQ ID NO: 1210266 - RNA, 19 nt, Homo sapiens
cauguuuccucuucccaaa

SEQ ID NO: 1210267 - RNA, 19 nt, Homo sapiens
gccagcaccuugauauugg

SEQ ID NO: 1210268 - RNA, 19 nt, Homo sapiens
uagcagaugagaagaauca

SEQ ID NO: 1210269 - RNA, 19 nt, Homo sapiens
ugguguagcugcccauaug

SEQ ID NO: 1210270 - RNA, 19 nt, Homo sapiens
uggaagaugggucuaauga

SEQ ID NO: 1210271 - RNA, 19 nt, Homo sapiens
gaugccagcaccuugauau

SEQ ID NO: 1210272 - RNA, 19 nt, Homo sapiens
ggugugggcugguguagcu

SEQ ID NO: 1210273 - RNA, 19 nt, Homo sapiens
gcuguguggauaaugaaua

SEQ ID NO: 1210274 - RNA, 19 nt, Homo sapiens
gguuuaauaugggaguuau

SEQ ID NO: 1210275 - RNA, 19 nt, Homo sapiens
guggugaccugcucauguc

SEQ ID NO: 1210276 - RNA, 19 nt, Homo sapiens
gaaccaggugccacacuca

SEQ ID NO: 1210277 - RNA, 19 nt, Homo sapiens
accaugagccaauacauuu

SEQ ID NO: 1210278 - RNA, 19 nt, Homo sapiens
ucacugguccacucuguau

SEQ ID NO: 1210279 - RNA, 19 nt, Homo sapiens
cgugcuguguggauaauga

SEQ ID NO: 1210280 - RNA, 19 nt, Homo sapiens
uuccagguauucugcuaua

SEQ ID NO: 1210281 - RNA, 19 nt, Homo sapiens
gaugagaagaaucaaccaa

SEQ ID NO: 1210282 - RNA, 19 nt, Homo sapiens
aauagcagaugagaagaau

SEQ ID NO: 1210283 - RNA, 19 nt, Homo sapiens
guaauugaagaggguuuaa

SEQ ID NO: 1210284 - RNA, 19 nt, Homo sapiens
ccaauacauuucuguucca

SEQ ID NO: 1210285 - RNA, 19 nt, Homo sapiens
gagccaauacauuucuguu

SEQ ID NO: 1210286 - RNA, 19 nt, Homo sapiens
gaaccaugagccaauacau

SEQ ID NO: 1210287 - RNA, 19 nt, Homo sapiens
cagagaggacugcagauag

SEQ ID NO: 1210288 - RNA, 19 nt, Homo sapiens
gaaacucagccggucaugu

SEQ ID NO: 1210289 - RNA, 19 nt, Homo sapiens
ggaaggcagaugcaagaag

SEQ ID NO: 1210290 - RNA, 19 nt, Homo sapiens
gcuaugaagaagcucaaga

SEQ ID NO: 1210291 - RNA, 19 nt, Homo sapiens
guauugcuaugaagaagcu

SEQ ID NO: 1210292 - RNA, 19 nt, Homo sapiens
caagcuuucuguagucacu

SEQ ID NO: 1210293 - RNA, 19 nt, Homo sapiens
aaauagcagaugagaagaa

SEQ ID NO: 1210294 - RNA, 19 nt, Homo sapiens
gggaguuauuuacauaggu

SEQ ID NO: 1210295 - RNA, 19 nt, Homo sapiens
uugaagaggguuuaauaug

SEQ ID NO: 1210296 - RNA, 19 nt, Homo sapiens
guguggauaaugaauauug

SEQ ID NO: 1210297 - RNA, 19 nt, Homo sapiens
ccucuucccaaauaaacua

SEQ ID NO: 1210298 - RNA, 19 nt, Homo sapiens
ucaagaccagccuguauca

SEQ ID NO: 1210299 - RNA, 19 nt, Homo sapiens
ugcaacauauucaucaucu

SEQ ID NO: 1210300 - RNA, 19 nt, Homo sapiens
aagagugccaggaaguuaa

SEQ ID NO: 1210301 - RNA, 19 nt, Homo sapiens
ucucaagcuuucuguaguc

SEQ ID NO: 1210302 - RNA, 19 nt, Homo sapiens
cuguguggauaaugaauau

SEQ ID NO: 1210303 - RNA, 19 nt, Homo sapiens
gcaacauauucaucaucuc

SEQ ID NO: 1210304 - RNA, 19 nt, Homo sapiens
guuaagccugcaacauauu

SEQ ID NO: 1210305 - RNA, 19 nt, Homo sapiens
gaccugcucaugucagcuu

SEQ ID NO: 1210306 - RNA, 19 nt, Homo sapiens
ggguuuaauaugggaguua

SEQ ID NO: 1210307 - RNA, 19 nt, Homo sapiens
ccuggaagaugggucuaau

SEQ ID NO: 1210308 - RNA, 19 nt, Homo sapiens
aaccaugagccaauacauu

SEQ ID NO: 1210309 - RNA, 19 nt, Homo sapiens
guggcgugcuguguggaua

SEQ ID NO: 1210310 - RNA, 19 nt, Homo sapiens
caauacauuucuguuccau

SEQ ID NO: 1210311 - RNA, 19 nt, Homo sapiens
ccagcaccuugauauugga

SEQ ID NO: 1210312 - RNA, 19 nt, Homo sapiens
aaacugaguaauugaagag

SEQ ID NO: 1210313 - RNA, 19 nt, Homo sapiens
caaccaaauuccggaagcu

SEQ ID NO: 1210314 - RNA, 19 nt, Homo sapiens
cugcccauaugcccucaaa

SEQ ID NO: 1210315 - RNA, 19 nt, Homo sapiens
ggugccacacucaaacuga

SEQ ID NO: 1210316 - RNA, 19 nt, Homo sapiens
ugccagcaccuugauauug

SEQ ID NO: 1210317 - RNA, 19 nt, Homo sapiens
cauaggagccgauguauuu

SEQ ID NO: 1210318 - RNA, 19 nt, Homo sapiens
ugaaaggacugccugucua

SEQ ID NO: 1210319 - RNA, 19 nt, Homo sapiens
aaagaacgcugccaagaag

SEQ ID NO: 1210320 - RNA, 19 nt, Homo sapiens
aacagaagauggcagauuu

SEQ ID NO: 1210321 - RNA, 19 nt, Homo sapiens
gaagagagaccaggagcaa

SEQ ID NO: 1210322 - RNA, 19 nt, Homo sapiens
cgaggacacuuaagacucu

SEQ ID NO: 1210323 - RNA, 19 nt, Homo sapiens
ccucauaggagccgaugua

SEQ ID NO: 1210324 - RNA, 19 nt, Homo sapiens
gagccgauguauuuauuuu

SEQ ID NO: 1210325 - RNA, 19 nt, Homo sapiens
gcgaguacccgucugaaca

SEQ ID NO: 1210326 - RNA, 19 nt, Homo sapiens
cagaucaucgugacagaaa

SEQ ID NO: 1210327 - RNA, 19 nt, Homo sapiens
gaaaggacugccugucuac

SEQ ID NO: 1210328 - RNA, 19 nt, Homo sapiens
aaacagaagauggcagauu

SEQ ID NO: 1210329 - RNA, 19 nt, Homo sapiens
ggccguggcuggaaguuac

SEQ ID NO: 1210330 - RNA, 19 nt, Homo sapiens
uaucaagcguugguuaaag

SEQ ID NO: 1210331 - RNA, 19 nt, Homo sapiens
aggagccgauguauuuauu

SEQ ID NO: 1210332 - RNA, 19 nt, Homo sapiens
cgacggaggaaacagaaga

SEQ ID NO: 1210333 - RNA, 19 nt, Homo sapiens
guaucaagcguugguuaaa

SEQ ID NO: 1210334 - RNA, 19 nt, Homo sapiens
ggagccgauguauuuauuu

SEQ ID NO: 1210335 - RNA, 19 nt, Homo sapiens
gaacgcugccaagaagaga

SEQ ID NO: 1210336 - RNA, 19 nt, Homo sapiens
gcacgaggacacuuaagac

SEQ ID NO: 1210337 - RNA, 19 nt, Homo sapiens
uguaucaagcguugguuaa

SEQ ID NO: 1210338 - RNA, 19 nt, Homo sapiens
ggacugccugucuacaaca

SEQ ID NO: 1210339 - RNA, 19 nt, Homo sapiens
gaccgacagcccagacaug

SEQ ID NO: 1210340 - RNA, 19 nt, Homo sapiens
agagagaccaggagcaagu

SEQ ID NO: 1210341 - RNA, 19 nt, Homo sapiens
gacugccugucuacaacaa

SEQ ID NO: 1210342 - RNA, 19 nt, Homo sapiens
uuuaugcuguaaccuguau

SEQ ID NO: 1210343 - RNA, 19 nt, Homo sapiens
ucauaggagccgauguauu

SEQ ID NO: 1210344 - RNA, 19 nt, Homo sapiens
aaaagaacgcugccaagaa

SEQ ID NO: 1210345 - RNA, 19 nt, Homo sapiens
caccacuuccaaccucaua

SEQ ID NO: 1210346 - RNA, 19 nt, Homo sapiens
acaugcacgaggacacuua

SEQ ID NO: 1210347 - RNA, 19 nt, Homo sapiens
caucagcaaugggacaaaa

SEQ ID NO: 1210348 - RNA, 19 nt, Homo sapiens
gaaauaaccugucgaaguu

SEQ ID NO: 1210349 - RNA, 19 nt, Homo sapiens
gaaguuaucugaugacaaa

SEQ ID NO: 1210350 - RNA, 19 nt, Homo sapiens
gauaggaguuagacaauuu

SEQ ID NO: 1210351 - RNA, 19 nt, Homo sapiens
gaaagaugguauacuguuu

SEQ ID NO: 1210352 - RNA, 19 nt, Homo sapiens
ggaaaggucucagaagaaa

SEQ ID NO: 1210353 - RNA, 19 nt, Homo sapiens
gcagugcucugaaggagua

SEQ ID NO: 1210354 - RNA, 19 nt, Homo sapiens
gaauugaucuuaagugucu

SEQ ID NO: 1210355 - RNA, 19 nt, Homo sapiens
ccaaaugacuauacaggaa

SEQ ID NO: 1210356 - RNA, 19 nt, Homo sapiens
ugaaagcuauucucuugaa

SEQ ID NO: 1210357 - RNA, 19 nt, Homo sapiens
caggaaaggucucagaaga

SEQ ID NO: 1210358 - RNA, 19 nt, Homo sapiens
gaugacaaauuacgaaagu

SEQ ID NO: 1210359 - RNA, 19 nt, Homo sapiens
ggaaagaugguauacuguu

SEQ ID NO: 1210360 - RNA, 19 nt, Homo sapiens
gaauugcucugcucugucu

SEQ ID NO: 1210361 - RNA, 19 nt, Homo sapiens
ggauaggaguuagacaauu

SEQ ID NO: 1210362 - RNA, 19 nt, Homo sapiens
caauagaaccaaaugacua

SEQ ID NO: 1210363 - RNA, 19 nt, Homo sapiens
agaguaaucugcagacaau

SEQ ID NO: 1210364 - RNA, 19 nt, Homo sapiens
acugaaagcuauucucuug

SEQ ID NO: 1210365 - RNA, 19 nt, Homo sapiens
gggaaacacaaacucuuua

SEQ ID NO: 1210366 - RNA, 19 nt, Homo sapiens
cagaagaaauugaagacau

SEQ ID NO: 1210367 - RNA, 19 nt, Homo sapiens
ggagggauagccaccauuu

SEQ ID NO: 1210368 - RNA, 19 nt, Homo sapiens
gcagacaauugauaauaac

SEQ ID NO: 1210369 - RNA, 19 nt, Homo sapiens
gcucugaaggaguaucuua

SEQ ID NO: 1210370 - RNA, 19 nt, Homo sapiens
cacaaacucuuuagaacau

SEQ ID NO: 1210371 - RNA, 19 nt, Homo sapiens
ggaguaguauggaaaauga

SEQ ID NO: 1210372 - RNA, 19 nt, Homo sapiens
ugauggugcuggugaauug

SEQ ID NO: 1210373 - RNA, 19 nt, Homo sapiens
gcucugcucugucugagau

SEQ ID NO: 1210374 - RNA, 19 nt, Homo sapiens
gaaacacaaacucuuuaga

SEQ ID NO: 1210375 - RNA, 19 nt, Homo sapiens
gaaauugaagacaucauca

SEQ ID NO: 1210376 - RNA, 19 nt, Homo sapiens
uguaugagggccugaaaua

SEQ ID NO: 1210377 - RNA, 19 nt, Homo sapiens
agaaauaaccugucgaagu

SEQ ID NO: 1210378 - RNA, 19 nt, Homo sapiens
aaaggucucagaagaaauu

SEQ ID NO: 1210379 - RNA, 19 nt, Homo sapiens
caaaugacuauacaggaaa

SEQ ID NO: 1210380 - RNA, 19 nt, Homo sapiens
caagagaaguuaaaagcaa

SEQ ID NO: 1210381 - RNA, 19 nt, Homo sapiens
agaagaaauugaagacauc

SEQ ID NO: 1210382 - RNA, 19 nt, Homo sapiens
ugugaacacugaaagcuau

SEQ ID NO: 1210383 - RNA, 19 nt, Homo sapiens
ugucgaaguuaucugauga

SEQ ID NO: 1210384 - RNA, 19 nt, Homo sapiens
ucagaguccuggcgaugaa

SEQ ID NO: 1210385 - RNA, 19 nt, Homo sapiens
guaaucugcagacaauuga

SEQ ID NO: 1210386 - RNA, 19 nt, Homo sapiens
ggaaacacaaacucuuuag

SEQ ID NO: 1210387 - RNA, 19 nt, Homo sapiens
aaagaaauaaccugucgaa

SEQ ID NO: 1210388 - RNA, 19 nt, Homo sapiens
uaugagggccugaaauaug

SEQ ID NO: 1210389 - RNA, 19 nt, Homo sapiens
aaaguggaauguauguugu

SEQ ID NO: 1210390 - RNA, 19 nt, Homo sapiens
aagcuugacuuuggcaauu

SEQ ID NO: 1210391 - RNA, 19 nt, Homo sapiens
gugaauugcucugcucugu

SEQ ID NO: 1210392 - RNA, 19 nt, Homo sapiens
gagaguaaucugcagacaa

SEQ ID NO: 1210393 - RNA, 19 nt, Homo sapiens
ggucucagaagaaauugaa

SEQ ID NO: 1210394 - RNA, 19 nt, Homo sapiens
ccugaaauaugugacaaau

SEQ ID NO: 1210395 - RNA, 19 nt, Homo sapiens
ggccguuccuuacacuuug

SEQ ID NO: 1210396 - RNA, 19 nt, Homo sapiens
gcaauagaaccaaaugacu

SEQ ID NO: 1210397 - RNA, 19 nt, Homo sapiens
ggaguaucaagagaaguua

SEQ ID NO: 1210398 - RNA, 19 nt, Homo sapiens
uuggaaagaugguauacug

SEQ ID NO: 1210399 - RNA, 19 nt, Homo sapiens
gaagaaauugaagacauca

SEQ ID NO: 1210400 - RNA, 19 nt, Homo sapiens
guuugccgcuggaguauca

SEQ ID NO: 1210401 - RNA, 19 nt, Homo sapiens
cugcagacaauugauaaua

SEQ ID NO: 1210402 - RNA, 19 nt, Homo sapiens
ugacaaaugaaugugagua

SEQ ID NO: 1210403 - RNA, 19 nt, Homo sapiens
aaaagaaacugggauagga

SEQ ID NO: 1210404 - RNA, 19 nt, Homo sapiens
gcuggaguaucaagagaag

SEQ ID NO: 1210405 - RNA, 19 nt, Homo sapiens
guccagaugaggagaguuu

SEQ ID NO: 1210406 - RNA, 19 nt, Homo sapiens
gguuaaaaguggaauguau

SEQ ID NO: 1210407 - RNA, 19 nt, Homo sapiens
gggauaggaguuagacaau

SEQ ID NO: 1210408 - RNA, 19 nt, Homo sapiens
acacaaacucuuuagaaca

SEQ ID NO: 1210409 - RNA, 19 nt, Homo sapiens
gcucucuggccguuccuua

SEQ ID NO: 1210410 - RNA, 19 nt, Homo sapiens
uaucuaaggguauucuaug

SEQ ID NO: 1210411 - RNA, 19 nt, Homo sapiens
agaaccaaaugacuauaca

SEQ ID NO: 1210412 - RNA, 19 nt, Homo sapiens
auuuguagcucacuugaug

SEQ ID NO: 1210413 - RNA, 19 nt, Homo sapiens
cuugggugauuccuuguuu

SEQ ID NO: 1210414 - RNA, 19 nt, Homo sapiens
uaucuuacuugggugauuc

SEQ ID NO: 1210415 - RNA, 19 nt, Homo sapiens
gcaagaagggguuaaaagu

SEQ ID NO: 1210416 - RNA, 19 nt, Homo sapiens
aaucugcagacaauugaua

SEQ ID NO: 1210417 - RNA, 19 nt, Homo sapiens
augagggccugaaauaugu

SEQ ID NO: 1210418 - RNA, 19 nt, Homo sapiens
gaaaggucucagaagaaau

SEQ ID NO: 1210419 - RNA, 19 nt, Homo sapiens
guaugagggccugaaauau

SEQ ID NO: 1210420 - RNA, 19 nt, Homo sapiens
gaguaucaagagaaguuaa

SEQ ID NO: 1210421 - RNA, 19 nt, Homo sapiens
gaacacugaaagcuauucu

SEQ ID NO: 1210422 - RNA, 19 nt, Homo sapiens
guaucuuacuugggugauu

SEQ ID NO: 1210423 - RNA, 19 nt, Homo sapiens
ggccugaaauaugugacaa

SEQ ID NO: 1210424 - RNA, 19 nt, Homo sapiens
aacacaaacucuuuagaac

SEQ ID NO: 1210425 - RNA, 19 nt, Homo sapiens
uggaguaucaagagaaguu

SEQ ID NO: 1210426 - RNA, 19 nt, Homo sapiens
ccgcuggaguaucaagaga

SEQ ID NO: 1210427 - RNA, 19 nt, Homo sapiens
aguggaauguauguuguaa

SEQ ID NO: 1210428 - RNA, 19 nt, Homo sapiens
gcaggggcguagugggaua

SEQ ID NO: 1210429 - RNA, 19 nt, Homo sapiens
ggagaguuuucuguacuuu

SEQ ID NO: 1210430 - RNA, 19 nt, Homo sapiens
gacaaaugaaugugaguac

SEQ ID NO: 1210431 - RNA, 19 nt, Homo sapiens
aggaaaggucucagaagaa

SEQ ID NO: 1210432 - RNA, 19 nt, Homo sapiens
aguaaucugcagacaauug

SEQ ID NO: 1210433 - RNA, 19 nt, Homo sapiens
gaaaauuggaaagauggua

SEQ ID NO: 1210434 - RNA, 19 nt, Homo sapiens
ugaugauggugcuggugaa

SEQ ID NO: 1210435 - RNA, 19 nt, Homo sapiens
agaaauugaagacaucauc

SEQ ID NO: 1210436 - RNA, 19 nt, Homo sapiens
aaaugacuauacaggaaag

SEQ ID NO: 1210437 - RNA, 19 nt, Homo sapiens
gaaccaaaugacuauacag

SEQ ID NO: 1210438 - RNA, 19 nt, Homo sapiens
ucucagaagaaauugaaga

SEQ ID NO: 1210439 - RNA, 19 nt, Homo sapiens
aaagcaauagaaccaaaug

SEQ ID NO: 1210440 - RNA, 19 nt, Homo sapiens
ggaauguauguuguaauag

SEQ ID NO: 1210441 - RNA, 19 nt, Homo sapiens
ggaaaaugaacaaaagcaa

SEQ ID NO: 1210442 - RNA, 19 nt, Homo sapiens
acacugaaagcuauucucu

SEQ ID NO: 1210443 - RNA, 19 nt, Homo sapiens
uggcaauucccaaggcaaa

SEQ ID NO: 1210444 - RNA, 19 nt, Homo sapiens
ggggaaacacaaacucuuu

SEQ ID NO: 1210445 - RNA, 19 nt, Homo sapiens
ucacaaagcaugaauguua

SEQ ID NO: 1210446 - RNA, 19 nt, Homo sapiens
gcugagcccuguacuguua

SEQ ID NO: 1210447 - RNA, 19 nt, Homo sapiens
caucagggaucacuaaauu

SEQ ID NO: 1210448 - RNA, 19 nt, Homo sapiens
gaagucagcagccuccaua

SEQ ID NO: 1210449 - RNA, 19 nt, Homo sapiens
gggaaacucuuaccuuugu

SEQ ID NO: 1210450 - RNA, 19 nt, Homo sapiens
uauggcaaaugcacaauua

SEQ ID NO: 1210451 - RNA, 19 nt, Homo sapiens
cagaugacuuugauuauga

SEQ ID NO: 1210452 - RNA, 19 nt, Homo sapiens
gugcaaagcuagugaguag

SEQ ID NO: 1210453 - RNA, 19 nt, Homo sapiens
ucagggaucacuaaauuua

SEQ ID NO: 1210454 - RNA, 19 nt, Homo sapiens
gggcaauacuaaacuuaaa

SEQ ID NO: 1210455 - RNA, 19 nt, Homo sapiens
caagugggaugcagaugaa

SEQ ID NO: 1210456 - RNA, 19 nt, Homo sapiens
ggagaaguguguuccuguu

SEQ ID NO: 1210457 - RNA, 19 nt, Homo sapiens
uaacucagaugacuuugau

SEQ ID NO: 1210458 - RNA, 19 nt, Homo sapiens
ggaugcagaugaagauguu

SEQ ID NO: 1210459 - RNA, 19 nt, Homo sapiens
cagaacagcaaccaaauaa

SEQ ID NO: 1210460 - RNA, 19 nt, Homo sapiens
cacaaagcaugaauguuaa

SEQ ID NO: 1210461 - RNA, 19 nt, Homo sapiens
gaacagcaaccaaauaaaa

SEQ ID NO: 1210462 - RNA, 19 nt, Homo sapiens
ggagggagcagucuucguu

SEQ ID NO: 1210463 - RNA, 19 nt, Homo sapiens
gcaaaugcacaauuauuca

SEQ ID NO: 1210464 - RNA, 19 nt, Homo sapiens
gcaagugggaugcagauga

SEQ ID NO: 1210465 - RNA, 19 nt, Homo sapiens
ucagaugacuuugauuaug

SEQ ID NO: 1210466 - RNA, 19 nt, Homo sapiens
guggguacuugaagauuaa

SEQ ID NO: 1210467 - RNA, 19 nt, Homo sapiens
augaagagcugaagaaugg

SEQ ID NO: 1210468 - RNA, 19 nt, Homo sapiens
uguggguacuugaagauua

SEQ ID NO: 1210469 - RNA, 19 nt, Homo sapiens
acagcuaacuucuacauca

SEQ ID NO: 1210470 - RNA, 19 nt, Homo sapiens
caacuugagggcaauacua

SEQ ID NO: 1210471 - RNA, 19 nt, Homo sapiens
gaaguguguuccuguuucu

SEQ ID NO: 1210472 - RNA, 19 nt, Homo sapiens
ucagaacagcaaccaaaua

SEQ ID NO: 1210473 - RNA, 19 nt, Homo sapiens
gugcacccaucuaugaauu

SEQ ID NO: 1210474 - RNA, 19 nt, Homo sapiens
ccauagagggcuacuacua

SEQ ID NO: 1210475 - RNA, 19 nt, Homo sapiens
acucagaugacuuugauua

SEQ ID NO: 1210476 - RNA, 19 nt, Homo sapiens
acgggaaacucuuaccuuu

SEQ ID NO: 1210477 - RNA, 19 nt, Homo sapiens
ggagcagucuucguucuuc

SEQ ID NO: 1210478 - RNA, 19 nt, Homo sapiens
uaucagucccucaaucuaa

SEQ ID NO: 1210479 - RNA, 19 nt, Homo sapiens
gagggcaauacuaaacuua

SEQ ID NO: 1210480 - RNA, 19 nt, Homo sapiens
gagaaguguguuccuguuu

SEQ ID NO: 1210481 - RNA, 19 nt, Homo sapiens
gaacacagugcacccaucu

SEQ ID NO: 1210482 - RNA, 19 nt, Homo sapiens
ugacuuugauuaugaagag

SEQ ID NO: 1210483 - RNA, 19 nt, Homo sapiens
ugaagauguugaucggaaa

SEQ ID NO: 1210484 - RNA, 19 nt, Homo sapiens
ggcaaaugcacaauuauuc

SEQ ID NO: 1210485 - RNA, 19 nt, Homo sapiens
ucugguagcucaagagaag

SEQ ID NO: 1210486 - RNA, 19 nt, Homo sapiens
gcacagcuaacuucuacau

SEQ ID NO: 1210487 - RNA, 19 nt, Homo sapiens
gagggcuacuacuaccaua

SEQ ID NO: 1210488 - RNA, 19 nt, Homo sapiens
gcugaagaauggagacuac

SEQ ID NO: 1210489 - RNA, 19 nt, Homo sapiens
gagcagacucgcaucacaa

SEQ ID NO: 1210490 - RNA, 19 nt, Homo sapiens
gaacuuugccgagaaaauu

SEQ ID NO: 1210491 - RNA, 19 nt, Homo sapiens
acagugcacccaucuauga

SEQ ID NO: 1210492 - RNA, 19 nt, Homo sapiens
gcuccaaacuuuucaacuu

SEQ ID NO: 1210493 - RNA, 19 nt, Homo sapiens
agaaguguguuccuguuuc

SEQ ID NO: 1210494 - RNA, 19 nt, Homo sapiens
gagguggaaggaacaguuu

SEQ ID NO: 1210495 - RNA, 19 nt, Homo sapiens
ggagaaauaaucagcaaaa

SEQ ID NO: 1210496 - RNA, 19 nt, Homo sapiens
gaggaguauccaacccuua

SEQ ID NO: 1210497 - RNA, 19 nt, Homo sapiens
cuacagcggcuccaaguuc

SEQ ID NO: 1210498 - RNA, 19 nt, Homo sapiens
cagauuccaguccugcuua

SEQ ID NO: 1210499 - RNA, 19 nt, Homo sapiens
ugagggcaauacuaaacuu

SEQ ID NO: 1210500 - RNA, 19 nt, Homo sapiens
caucacaaagcaugaaugu

SEQ ID NO: 1210501 - RNA, 19 nt, Homo sapiens
aaggagaaauaaucagcaa

SEQ ID NO: 1210502 - RNA, 19 nt, Homo sapiens
cugcacagcuaacuucuac

SEQ ID NO: 1210503 - RNA, 19 nt, Homo sapiens
uggcaaaugcacaauuauu

SEQ ID NO: 1210504 - RNA, 19 nt, Homo sapiens
ggaaacucuuaccuuugug

SEQ ID NO: 1210505 - RNA, 19 nt, Homo sapiens
acacagugcacccaucuau

SEQ ID NO: 1210506 - RNA, 19 nt, Homo sapiens
gagugucugugugugugua

SEQ ID NO: 1210507 - RNA, 19 nt, Homo sapiens
gaauguuaacccacagaau

SEQ ID NO: 1210508 - RNA, 19 nt, Homo sapiens
agacaucaguggugcuucu

SEQ ID NO: 1210509 - RNA, 19 nt, Homo sapiens
aaacacccuuucuuaacuc

SEQ ID NO: 1210510 - RNA, 19 nt, Homo sapiens
ccaccagccugcucuacag

SEQ ID NO: 1210511 - RNA, 19 nt, Homo sapiens
uguuaacagugcaaagcua

SEQ ID NO: 1210512 - RNA, 19 nt, Homo sapiens
uaacuucuacaucacugaa

SEQ ID NO: 1210513 - RNA, 19 nt, Homo sapiens
gccagaaccaggagaagug

SEQ ID NO: 1210514 - RNA, 19 nt, Homo sapiens
guaucagucccucaaucua

SEQ ID NO: 1210515 - RNA, 19 nt, Homo sapiens
uaccauaggaguucagaau

SEQ ID NO: 1210516 - RNA, 19 nt, Homo sapiens
caucaguggugcuucuuuu

SEQ ID NO: 1210517 - RNA, 19 nt, Homo sapiens
cagggaucacuaaauuuaa

SEQ ID NO: 1210518 - RNA, 19 nt, Homo sapiens
cgaggacccuauggcaaau

SEQ ID NO: 1210519 - RNA, 19 nt, Homo sapiens
gguaucagucccucaaucu

SEQ ID NO: 1210520 - RNA, 19 nt, Homo sapiens
cauaggaguucagaauggu

SEQ ID NO: 1210521 - RNA, 19 nt, Homo sapiens
gaguauccaacccuuacaa

SEQ ID NO: 1210522 - RNA, 19 nt, Homo sapiens
aauguuaacccacagaauc

SEQ ID NO: 1210523 - RNA, 19 nt, Homo sapiens
ucuaacccauguuccugaa

SEQ ID NO: 1210524 - RNA, 19 nt, Homo sapiens
cauagagggcuacuacuac

SEQ ID NO: 1210525 - RNA, 19 nt, Homo sapiens
guucuacuacaucugcuuu

SEQ ID NO: 1210526 - RNA, 19 nt, Homo sapiens
uaugaagagcugaagaaug

SEQ ID NO: 1210527 - RNA, 19 nt, Homo sapiens
acgaggacccuauggcaaa

SEQ ID NO: 1210528 - RNA, 19 nt, Homo sapiens
gaagauuaaaggccuuacu

SEQ ID NO: 1210529 - RNA, 19 nt, Homo sapiens
agacucgcaucacaaagca

SEQ ID NO: 1210530 - RNA, 19 nt, Homo sapiens
agggaucacuaaauuuaag

SEQ ID NO: 1210531 - RNA, 19 nt, Homo sapiens
uaacagugcaaagcuagug

SEQ ID NO: 1210532 - RNA, 19 nt, Homo sapiens
ccuuacaaccuucuucgaa

SEQ ID NO: 1210533 - RNA, 19 nt, Homo sapiens
guguuuguguguugugugu

SEQ ID NO: 1210534 - RNA, 19 nt, Homo sapiens
gcaaccaaauaaaacugaa

SEQ ID NO: 1210535 - RNA, 19 nt, Homo sapiens
gggagcagucuucguucuu

SEQ ID NO: 1210536 - RNA, 19 nt, Homo sapiens
cuucgaaggagaaauaauc

SEQ ID NO: 1210537 - RNA, 19 nt, Homo sapiens
caaaugcacaauuauucag

SEQ ID NO: 1210538 - RNA, 19 nt, Homo sapiens
gggaugcagaugaagaugu

SEQ ID NO: 1210539 - RNA, 19 nt, Homo sapiens
agauuaaaggccuuacuga

SEQ ID NO: 1210540 - RNA, 19 nt, Homo sapiens
gcacccaucuaugaauucc

SEQ ID NO: 1210541 - RNA, 19 nt, Homo sapiens
ugagguggaaggaacaguu

SEQ ID NO: 1210542 - RNA, 19 nt, Homo sapiens
ucuacuacaucugcuuuca

SEQ ID NO: 1210543 - RNA, 19 nt, Homo sapiens
gauuaugaagagcugaaga

SEQ ID NO: 1210544 - RNA, 19 nt, Homo sapiens
cgggaaacucuuaccuuug

SEQ ID NO: 1210545 - RNA, 19 nt, Homo sapiens
uuaagcagcuggcguguua

SEQ ID NO: 1210546 - RNA, 19 nt, Homo sapiens
gaauugaccugaucguguu

SEQ ID NO: 1210547 - RNA, 19 nt, Homo sapiens
cguguuacaucuccauuua

SEQ ID NO: 1210548 - RNA, 19 nt, Homo sapiens
gaacacggccaccaucuug

SEQ ID NO: 1210549 - RNA, 19 nt, Homo sapiens
gcaaauacagucuccagaa

SEQ ID NO: 1210550 - RNA, 19 nt, Homo sapiens
gagagccacugcagcauuc

SEQ ID NO: 1210551 - RNA, 19 nt, Homo sapiens
gaagcuggcccacaccuau

SEQ ID NO: 1210552 - RNA, 19 nt, Homo sapiens
uugcagagccugugucuuu

SEQ ID NO: 1210553 - RNA, 19 nt, Homo sapiens
caaauacagucuccagaac

SEQ ID NO: 1210554 - RNA, 19 nt, Homo sapiens
gcagagccugugucuuuaa

SEQ ID NO: 1210555 - RNA, 19 nt, Homo sapiens
ggagagccacugcagcauu

SEQ ID NO: 1210556 - RNA, 19 nt, Homo sapiens
gagccugugucuuuaagca

SEQ ID NO: 1210557 - RNA, 19 nt, Homo sapiens
caaaaggucuguggcuaaa

SEQ ID NO: 1210558 - RNA, 19 nt, Homo sapiens
gcuucgugcugacuccaua

SEQ ID NO: 1210559 - RNA, 19 nt, Homo sapiens
cggacucgaugcucaaaga

SEQ ID NO: 1210560 - RNA, 19 nt, Homo sapiens
gcugugaugucgguguuga

SEQ ID NO: 1210561 - RNA, 19 nt, Homo sapiens
gaucguguuugugguuaau

SEQ ID NO: 1210562 - RNA, 19 nt, Homo sapiens
gcacggaggaugcucuucu

SEQ ID NO: 1210563 - RNA, 19 nt, Homo sapiens
ugcagagccugugucuuua

SEQ ID NO: 1210564 - RNA, 19 nt, Homo sapiens
ugguuaaucuucacagcaa

SEQ ID NO: 1210565 - RNA, 19 nt, Homo sapiens
gcagcuggcguguuacauc

SEQ ID NO: 1210566 - RNA, 19 nt, Homo sapiens
ccuuugcccuccaguguga

SEQ ID NO: 1210567 - RNA, 19 nt, Homo sapiens
acaucuccauuuaagguuu

SEQ ID NO: 1210568 - RNA, 19 nt, Homo sapiens
cagcuggcguguuacaucu

SEQ ID NO: 1210569 - RNA, 19 nt, Homo sapiens
uguuacaucuccauuuaag

SEQ ID NO: 1210570 - RNA, 19 nt, Homo sapiens
cgugcugacuccauaaaca

SEQ ID NO: 1210571 - RNA, 19 nt, Homo sapiens
gguuaaucuucacagcaaa

SEQ ID NO: 1210572 - RNA, 19 nt, Homo sapiens
ggaugccagcuucuucuug

SEQ ID NO: 1210573 - RNA, 19 nt, Homo sapiens
uuacaucuccauuuaaggu

SEQ ID NO: 1210574 - RNA, 19 nt, Homo sapiens
ggagagcugggcagaagca

SEQ ID NO: 1210575 - RNA, 19 nt, Homo sapiens
caucuccauuuaagguuuc

SEQ ID NO: 1210576 - RNA, 19 nt, Homo sapiens
cagagccugugucuuuaag

SEQ ID NO: 1210577 - RNA, 19 nt, Homo sapiens
gaagguccacuuggcaaag

SEQ ID NO: 1210578 - RNA, 19 nt, Homo sapiens
cugaucguguuugugguua

SEQ ID NO: 1210579 - RNA, 19 nt, Homo sapiens
gcguguuacaucuccauuu

SEQ ID NO: 1210580 - RNA, 19 nt, Homo sapiens
agggagagcugggcagaag

SEQ ID NO: 1210581 - RNA, 19 nt, Homo sapiens
cggcugugaugucgguguu

SEQ ID NO: 1210582 - RNA, 19 nt, Homo sapiens
ugaucguguuugugguuaa

SEQ ID NO: 1210583 - RNA, 19 nt, Homo sapiens
ugaagguccacuuggcaaa

SEQ ID NO: 1210584 - RNA, 19 nt, Homo sapiens
uguugaggauguccaguca

SEQ ID NO: 1210585 - RNA, 19 nt, Homo sapiens
ggagguggaaggcuuuagg

SEQ ID NO: 1210586 - RNA, 19 nt, Homo sapiens
aaauacagucuccagaaca

SEQ ID NO: 1210587 - RNA, 19 nt, Homo sapiens
caaccaggguguuaaauuu

SEQ ID NO: 1210588 - RNA, 19 nt, Homo sapiens
uauauaaccucccaaagua

SEQ ID NO: 1210589 - RNA, 19 nt, Homo sapiens
gaaaugggcauaucuguga

SEQ ID NO: 1210590 - RNA, 19 nt, Homo sapiens
ggaagaaguuguuaguguu

SEQ ID NO: 1210591 - RNA, 19 nt, Homo sapiens
cagagaagcugaaagaaau

SEQ ID NO: 1210592 - RNA, 19 nt, Homo sapiens
gcuuucagcuguauuguaa

SEQ ID NO: 1210593 - RNA, 19 nt, Homo sapiens
gcaauuaagaaccgaaaua

SEQ ID NO: 1210594 - RNA, 19 nt, Homo sapiens
gcagagaagcugaaagaaa

SEQ ID NO: 1210595 - RNA, 19 nt, Homo sapiens
gaaccgaaauacgucuaua

SEQ ID NO: 1210596 - RNA, 19 nt, Homo sapiens
caucuaaacuggugggaaa

SEQ ID NO: 1210597 - RNA, 19 nt, Homo sapiens
gaauauggcuacauugcau

SEQ ID NO: 1210598 - RNA, 19 nt, Homo sapiens
uauggaggcugccacuuua

SEQ ID NO: 1210599 - RNA, 19 nt, Homo sapiens
gaccagaguugaccgagaa

SEQ ID NO: 1210600 - RNA, 19 nt, Homo sapiens
ccaaggaacugaucaagag

SEQ ID NO: 1210601 - RNA, 19 nt, Homo sapiens
caagagagaagcuuaucua

SEQ ID NO: 1210602 - RNA, 19 nt, Homo sapiens
gagcgugccuugagacuag

SEQ ID NO: 1210603 - RNA, 19 nt, Homo sapiens
acagauaccuuaggagaaa

SEQ ID NO: 1210604 - RNA, 19 nt, Homo sapiens
uuacagagcacuaaccuaa

SEQ ID NO: 1210605 - RNA, 19 nt, Homo sapiens
caagagagcagaaucacuu

SEQ ID NO: 1210606 - RNA, 19 nt, Homo sapiens
gguguuaaauuuagugugu

SEQ ID NO: 1210607 - RNA, 19 nt, Homo sapiens
cauggaauauggcuacauu

SEQ ID NO: 1210608 - RNA, 19 nt, Homo sapiens
gggccaauauggugacaaa

SEQ ID NO: 1210609 - RNA, 19 nt, Homo sapiens
gggccacuguguuaauuaa

SEQ ID NO: 1210610 - RNA, 19 nt, Homo sapiens
gaugagggcccugaacuuu

SEQ ID NO: 1210611 - RNA, 19 nt, Homo sapiens
cuucaugucuuugguuaua

SEQ ID NO: 1210612 - RNA, 19 nt, Homo sapiens
agagagggccacuguguua

SEQ ID NO: 1210613 - RNA, 19 nt, Homo sapiens
cauagaagguggugcaaag

SEQ ID NO: 1210614 - RNA, 19 nt, Homo sapiens
guauauaaccucccaaagu

SEQ ID NO: 1210615 - RNA, 19 nt, Homo sapiens
agaaagugcucacagaaca

SEQ ID NO: 1210616 - RNA, 19 nt, Homo sapiens
gcaaaugguggucauacuu

SEQ ID NO: 1210617 - RNA, 19 nt, Homo sapiens
gaaagaaaugggcauaucu

SEQ ID NO: 1210618 - RNA, 19 nt, Homo sapiens
gaaaguagaagcuggaaaa

SEQ ID NO: 1210619 - RNA, 19 nt, Homo sapiens
ugucagagcugcaaacaac

SEQ ID NO: 1210620 - RNA, 19 nt, Homo sapiens
gagggccacuguguuaauu

SEQ ID NO: 1210621 - RNA, 19 nt, Homo sapiens
caagugagagugaaucaga

SEQ ID NO: 1210622 - RNA, 19 nt, Homo sapiens
ucaacgcucuguuagauca

SEQ ID NO: 1210623 - RNA, 19 nt, Homo sapiens
uggaagaaguuguuagugu

SEQ ID NO: 1210624 - RNA, 19 nt, Homo sapiens
ggaguuguuugcuugugaa

SEQ ID NO: 1210625 - RNA, 19 nt, Homo sapiens
gaacaagcagagcaagaga

SEQ ID NO: 1210626 - RNA, 19 nt, Homo sapiens
ggaggcugccacuuuauuu

SEQ ID NO: 1210627 - RNA, 19 nt, Homo sapiens
gaaauuaaggucgaugugu

SEQ ID NO: 1210628 - RNA, 19 nt, Homo sapiens
ugaaagaaaugggcauauc

SEQ ID NO: 1210629 - RNA, 19 nt, Homo sapiens
ucacaucaucuuugcauuu

SEQ ID NO: 1210630 - RNA, 19 nt, Homo sapiens
uagcaacccucacaucauc

SEQ ID NO: 1210631 - RNA, 19 nt, Homo sapiens
gcacaagagagaagcuuau

SEQ ID NO: 1210632 - RNA, 19 nt, Homo sapiens
cacaaugacugcuaauagu

SEQ ID NO: 1210633 - RNA, 19 nt, Homo sapiens
uaagcgaauuaauguggua

SEQ ID NO: 1210634 - RNA, 19 nt, Homo sapiens
gaucaagagagcagaauca

SEQ ID NO: 1210635 - RNA, 19 nt, Homo sapiens
aauagccgcucauuaacaa

SEQ ID NO: 1210636 - RNA, 19 nt, Homo sapiens
aaagcaaacccuuguggua

SEQ ID NO: 1210637 - RNA, 19 nt, Homo sapiens
gaagaaguuguuaguguuc

SEQ ID NO: 1210638 - RNA, 19 nt, Homo sapiens
aaccacauuucauggaaua

SEQ ID NO: 1210639 - RNA, 19 nt, Homo sapiens
uaaggucgaugugugcaaa

SEQ ID NO: 1210640 - RNA, 19 nt, Homo sapiens
aguagaagcuggaaaagua

SEQ ID NO: 1210641 - RNA, 19 nt, Homo sapiens
ccgaaauacgucuauauaa

SEQ ID NO: 1210642 - RNA, 19 nt, Homo sapiens
aagagaaagugcucacaga

SEQ ID NO: 1210643 - RNA, 19 nt, Homo sapiens
caaaugguggucauacuug

SEQ ID NO: 1210644 - RNA, 19 nt, Homo sapiens
gagaacucuuaaaccagua

SEQ ID NO: 1210645 - RNA, 19 nt, Homo sapiens
acagagcacuaaccuaaca

SEQ ID NO: 1210646 - RNA, 19 nt, Homo sapiens
gaaucacuuucuagaucaa

SEQ ID NO: 1210647 - RNA, 19 nt, Homo sapiens
caucagcccagagcacuua

SEQ ID NO: 1210648 - RNA, 19 nt, Homo sapiens
ucacaaugacugcuaauag

SEQ ID NO: 1210649 - RNA, 19 nt, Homo sapiens
gaaagugcucacagaacaa

SEQ ID NO: 1210650 - RNA, 19 nt, Homo sapiens
aagaguaaaucuggacauu

SEQ ID NO: 1210651 - RNA, 19 nt, Homo sapiens
uaaccuaacacaccugaga

SEQ ID NO: 1210652 - RNA, 19 nt, Homo sapiens
aagaaaagguggcauagaa

SEQ ID NO: 1210653 - RNA, 19 nt, Homo sapiens
guaaaacugagaacucuua

SEQ ID NO: 1210654 - RNA, 19 nt, Homo sapiens
gaaaauauacuagcaagug

SEQ ID NO: 1210655 - RNA, 19 nt, Homo sapiens
gagcuucaaccaagugaga

SEQ ID NO: 1210656 - RNA, 19 nt, Homo sapiens
gagaggagacauaguagca

SEQ ID NO: 1210657 - RNA, 19 nt, Homo sapiens
cuaaccacauuucauggaa

SEQ ID NO: 1210658 - RNA, 19 nt, Homo sapiens
guuguuugcuugugaaucu

SEQ ID NO: 1210659 - RNA, 19 nt, Homo sapiens
gaggaaagagcagguucua

SEQ ID NO: 1210660 - RNA, 19 nt, Homo sapiens
ugugagaggagacauagua

SEQ ID NO: 1210661 - RNA, 19 nt, Homo sapiens
gcaaacccuugugguagau

SEQ ID NO: 1210662 - RNA, 19 nt, Homo sapiens
ugagagccauuguggaauc

SEQ ID NO: 1210663 - RNA, 19 nt, Homo sapiens
gcuauuaaagagucucauu

SEQ ID NO: 1210664 - RNA, 19 nt, Homo sapiens
gcauuagugcaauuaagaa

SEQ ID NO: 1210665 - RNA, 19 nt, Homo sapiens
aaacugagaacucuuaaac

SEQ ID NO: 1210666 - RNA, 19 nt, Homo sapiens
ccaucacaaugacugcuaa

SEQ ID NO: 1210667 - RNA, 19 nt, Homo sapiens
ucuguuagaucacccugaa

SEQ ID NO: 1210668 - RNA, 19 nt, Homo sapiens
gaaucgccauagccaagga

SEQ ID NO: 1210669 - RNA, 19 nt, Homo sapiens
gagagagggccacuguguu

SEQ ID NO: 1210670 - RNA, 19 nt, Homo sapiens
agucaacgcucuguuagau

SEQ ID NO: 1210671 - RNA, 19 nt, Homo sapiens
ccggaaggcugaagcucuu

SEQ ID NO: 1210672 - RNA, 19 nt, Homo sapiens
ggucauacuugggugaaag

SEQ ID NO: 1210673 - RNA, 19 nt, Homo sapiens
cagaaaaccuggaagaagu

SEQ ID NO: 1210674 - RNA, 19 nt, Homo sapiens
ggaauauggcuacauugca

SEQ ID NO: 1210675 - RNA, 19 nt, Homo sapiens
uaaccacauuucauggaau

SEQ ID NO: 1210676 - RNA, 19 nt, Homo sapiens
acugagaacucuuaaacca

SEQ ID NO: 1210677 - RNA, 19 nt, Homo sapiens
ggacgggagacacccuaaa

SEQ ID NO: 1210678 - RNA, 19 nt, Homo sapiens
cuauggaggcugccacuuu

SEQ ID NO: 1210679 - RNA, 19 nt, Homo sapiens
uggcagagaagcugaaaga

SEQ ID NO: 1210680 - RNA, 19 nt, Homo sapiens
uuauacagauaccuuagga

SEQ ID NO: 1210681 - RNA, 19 nt, Homo sapiens
ccugagagccauuguggaa

SEQ ID NO: 1210682 - RNA, 19 nt, Homo sapiens
gcauuaaauaucuggagaa

SEQ ID NO: 1210683 - RNA, 19 nt, Homo sapiens
aaccaggguguuaaauuua

SEQ ID NO: 1210684 - RNA, 19 nt, Homo sapiens
agaguaaaucuggacauua

SEQ ID NO: 1210685 - RNA, 19 nt, Homo sapiens
gagagggccacuguguuaa

SEQ ID NO: 1210686 - RNA, 19 nt, Homo sapiens
aagcagagcaagagaggaa

SEQ ID NO: 1210687 - RNA, 19 nt, Homo sapiens
guacauaugugacuacuaa

SEQ ID NO: 1210688 - RNA, 19 nt, Homo sapiens
caacagagcaaguaaauga

SEQ ID NO: 1210689 - RNA, 19 nt, Homo sapiens
uaaaugaguugguggcuuu

SEQ ID NO: 1210690 - RNA, 19 nt, Homo sapiens
gcaaauaguuggcacucaa

SEQ ID NO: 1210691 - RNA, 19 nt, Homo sapiens
gagcuaggauugugaguga

SEQ ID NO: 1210692 - RNA, 19 nt, Homo sapiens
gugagcaacuggugaauuu

SEQ ID NO: 1210693 - RNA, 19 nt, Homo sapiens
ucacuuaacucccagcaaa

SEQ ID NO: 1210694 - RNA, 19 nt, Homo sapiens
ggaaacaccucccuauggu

SEQ ID NO: 1210695 - RNA, 19 nt, Homo sapiens
gaacauggauuggggauuu

SEQ ID NO: 1210696 - RNA, 19 nt, Homo sapiens
gagagggaccauccaaaua

SEQ ID NO: 1210697 - RNA, 19 nt, Homo sapiens
gaagagagcacagcauaug

SEQ ID NO: 1210698 - RNA, 19 nt, Homo sapiens
ggaauugguucacuuaacu

SEQ ID NO: 1210699 - RNA, 19 nt, Homo sapiens
ggaggaauugguucacuua

SEQ ID NO: 1210700 - RNA, 19 nt, Homo sapiens
aaacagaccuagucaggau

SEQ ID NO: 1210701 - RNA, 19 nt, Homo sapiens
gaauucaccgggagagaua

SEQ ID NO: 1210702 - RNA, 19 nt, Homo sapiens
cuacuaacgucucccuuau

SEQ ID NO: 1210703 - RNA, 19 nt, Homo sapiens
acacaguggucaguacaua

SEQ ID NO: 1210704 - RNA, 19 nt, Homo sapiens
uagaagagagcacagcaua

SEQ ID NO: 1210705 - RNA, 19 nt, Homo sapiens
caacugcuauugguucuuc

SEQ ID NO: 1210706 - RNA, 19 nt, Homo sapiens
ugacaccaguggcauauca

SEQ ID NO: 1210707 - RNA, 19 nt, Homo sapiens
gaaacaccucccuauggua

SEQ ID NO: 1210708 - RNA, 19 nt, Homo sapiens
gcaucaaaguggugaaagu

SEQ ID NO: 1210709 - RNA, 19 nt, Homo sapiens
ccacagcuauuuaacaacu

SEQ ID NO: 1210710 - RNA, 19 nt, Homo sapiens
caacauagugaucuucaug

SEQ ID NO: 1210711 - RNA, 19 nt, Homo sapiens
gucaggauaugaauuuguu

SEQ ID NO: 1210712 - RNA, 19 nt, Homo sapiens
guucuuagggcauuauaaa

SEQ ID NO: 1210713 - RNA, 19 nt, Homo sapiens
caucauggccacccugaaa

SEQ ID NO: 1210714 - RNA, 19 nt, Homo sapiens
gagauagcaucaccugucu

SEQ ID NO: 1210715 - RNA, 19 nt, Homo sapiens
gauucacccuucauccauu

SEQ ID NO: 1210716 - RNA, 19 nt, Homo sapiens
ccaaauaccuaagagaaaa

SEQ ID NO: 1210717 - RNA, 19 nt, Homo sapiens
cuagucaggauaugaauuu

SEQ ID NO: 1210718 - RNA, 19 nt, Homo sapiens
cgaagaggcuggacaugac

SEQ ID NO: 1210719 - RNA, 19 nt, Homo sapiens
ggagugagcaacuggugaa

SEQ ID NO: 1210720 - RNA, 19 nt, Homo sapiens
gaacacaguggucaguaca

SEQ ID NO: 1210721 - RNA, 19 nt, Homo sapiens
gaauuuguuucagcuguuc

SEQ ID NO: 1210722 - RNA, 19 nt, Homo sapiens
acacagugaucagagauug

SEQ ID NO: 1210723 - RNA, 19 nt, Homo sapiens
gggacaggcuacauuccaa

SEQ ID NO: 1210724 - RNA, 19 nt, Homo sapiens
aagaagccauugcucaguu

SEQ ID NO: 1210725 - RNA, 19 nt, Homo sapiens
acuaacgucucccuuauuc

SEQ ID NO: 1210726 - RNA, 19 nt, Homo sapiens
ggcgaaagcaagaagauga

SEQ ID NO: 1210727 - RNA, 19 nt, Homo sapiens
ucagcgaacuaagcaauau

SEQ ID NO: 1210728 - RNA, 19 nt, Homo sapiens
gauagcaucaccugucuca

SEQ ID NO: 1210729 - RNA, 19 nt, Homo sapiens
cagagcaaguaaaugaguu

SEQ ID NO: 1210730 - RNA, 19 nt, Homo sapiens
gcagagagggaccauccaa

SEQ ID NO: 1210731 - RNA, 19 nt, Homo sapiens
guaagcagaggaggaauug

SEQ ID NO: 1210732 - RNA, 19 nt, Homo sapiens
gauccuggugcacaacaua

SEQ ID NO: 1210733 - RNA, 19 nt, Homo sapiens
gagcaacuggugaauuuua

SEQ ID NO: 1210734 - RNA, 19 nt, Homo sapiens
caggcuacauuccaacaga

SEQ ID NO: 1210735 - RNA, 19 nt, Homo sapiens
gaagaagccauugcucagu

SEQ ID NO: 1210736 - RNA, 19 nt, Homo sapiens
cgagaugggaggaccguuu

SEQ ID NO: 1210737 - RNA, 19 nt, Homo sapiens
uguuucagcuguucccaaa

SEQ ID NO: 1210738 - RNA, 19 nt, Homo sapiens
gaccuagucaggauaugaa

SEQ ID NO: 1210739 - RNA, 19 nt, Homo sapiens
ggccugaguucuggaccua

SEQ ID NO: 1210740 - RNA, 19 nt, Homo sapiens
uuccacagcuauuuaacaa

SEQ ID NO: 1210741 - RNA, 19 nt, Homo sapiens
ccagccagauucaguacau

SEQ ID NO: 1210742 - RNA, 19 nt, Homo sapiens
ggaauucaccgggagagau

SEQ ID NO: 1210743 - RNA, 19 nt, Homo sapiens
gcaucugguuuggugguuu

SEQ ID NO: 1210744 - RNA, 19 nt, Homo sapiens
ggcacucaauaaagauuug

SEQ ID NO: 1210745 - RNA, 19 nt, Homo sapiens
gaggaauugguucacuuaa

SEQ ID NO: 1210746 - RNA, 19 nt, Homo sapiens
gagagcacagcauauguuc

SEQ ID NO: 1210747 - RNA, 19 nt, Homo sapiens
ccgaagaggcuggacauga

SEQ ID NO: 1210748 - RNA, 19 nt, Homo sapiens
gggcuugauucacccuuca

SEQ ID NO: 1210749 - RNA, 19 nt, Homo sapiens
ggaccauccaaauaccuaa

SEQ ID NO: 1210750 - RNA, 19 nt, Homo sapiens
gaagaggcuggacaugaca

SEQ ID NO: 1210751 - RNA, 19 nt, Homo sapiens
auucaguccuuguggauga

SEQ ID NO: 1210752 - RNA, 19 nt, Homo sapiens
ccauugcucaguucccaua

SEQ ID NO: 1210753 - RNA, 19 nt, Homo sapiens
cagcuguucuuagggcauu

SEQ ID NO: 1210754 - RNA, 19 nt, Homo sapiens
aguuggcacucaauaaaga

SEQ ID NO: 1210755 - RNA, 19 nt, Homo sapiens
auaguuggcacucaauaaa

SEQ ID NO: 1210756 - RNA, 19 nt, Homo sapiens
gguguaagcagaggaggaa

SEQ ID NO: 1210757 - RNA, 19 nt, Homo sapiens
uuuaacaacugcuauuggu

SEQ ID NO: 1210758 - RNA, 19 nt, Homo sapiens
gcacaacauagugaucuuc

SEQ ID NO: 1210759 - RNA, 19 nt, Homo sapiens
aauaguuggcacucaauaa

SEQ ID NO: 1210760 - RNA, 19 nt, Homo sapiens
caaauaguuggcacucaau

SEQ ID NO: 1210761 - RNA, 19 nt, Homo sapiens
uaacgucucccuuauucca

SEQ ID NO: 1210762 - RNA, 19 nt, Homo sapiens
acuacuaacgucucccuua

SEQ ID NO: 1210763 - RNA, 19 nt, Homo sapiens
aaauaaacccugcuuuuga

SEQ ID NO: 1210764 - RNA, 19 nt, Homo sapiens
gggaccauccaaauaccua

SEQ ID NO: 1210765 - RNA, 19 nt, Homo sapiens
agagagggaccauccaaau

SEQ ID NO: 1210766 - RNA, 19 nt, Homo sapiens
aacauccuccugccacuua

SEQ ID NO: 1210767 - RNA, 19 nt, Homo sapiens
ugaacacaguggucaguac

SEQ ID NO: 1210768 - RNA, 19 nt, Homo sapiens
ucaggaacuccaacuucua

SEQ ID NO: 1210769 - RNA, 19 nt, Homo sapiens
aaauaguuggcacucaaua

SEQ ID NO: 1210770 - RNA, 19 nt, Homo sapiens
gaggaggaauugguucacu

SEQ ID NO: 1210771 - RNA, 19 nt, Homo sapiens
agagagcacagcauauguu

SEQ ID NO: 1210772 - RNA, 19 nt, Homo sapiens
cauuaucagugccucaucu

SEQ ID NO: 1210773 - RNA, 19 nt, Homo sapiens
aagacucccuuguaauucu

SEQ ID NO: 1210774 - RNA, 19 nt, Homo sapiens
uugcucaguucccauaugu

SEQ ID NO: 1210775 - RNA, 19 nt, Homo sapiens
gaccugcaggccauuauca

SEQ ID NO: 1210776 - RNA, 19 nt, Homo sapiens
uccaaauaccuaagagaaa

SEQ ID NO: 1210777 - RNA, 19 nt, Homo sapiens
cagagagggaccauccaaa

SEQ ID NO: 1210778 - RNA, 19 nt, Homo sapiens
gcaggaagaagccauugcu

SEQ ID NO: 1210779 - RNA, 19 nt, Homo sapiens
gcagaaguggcagcagaga

SEQ ID NO: 1210780 - RNA, 19 nt, Homo sapiens
aaucaggaacuccaacuuc

SEQ ID NO: 1210781 - RNA, 19 nt, Homo sapiens
agagggaccauccaaauac

SEQ ID NO: 1210782 - RNA, 19 nt, Homo sapiens
ucucagaaccagcagaauc

SEQ ID NO: 1210783 - RNA, 19 nt, Homo sapiens
agaagccauugcucaguuc

SEQ ID NO: 1210784 - RNA, 19 nt, Homo sapiens
ugaacgagagcaggaagaa

SEQ ID NO: 1210785 - RNA, 19 nt, Homo sapiens
gcauucaguccuuguggau

SEQ ID NO: 1210786 - RNA, 19 nt, Homo sapiens
aagaugacagggacgguuu

SEQ ID NO: 1210787 - RNA, 19 nt, Homo sapiens
gaucacaccugcaggauuu

SEQ ID NO: 1210788 - RNA, 19 nt, Homo sapiens
caagaugccucaagaaaug

SEQ ID NO: 1210789 - RNA, 19 nt, Homo sapiens
caaagaaggccaagaaauu

SEQ ID NO: 1210790 - RNA, 19 nt, Homo sapiens
uaagagaccuguucacaug

SEQ ID NO: 1210791 - RNA, 19 nt, Homo sapiens
gaagcaagaugccucaaga

SEQ ID NO: 1210792 - RNA, 19 nt, Homo sapiens
gaacaagugccauuaaugu

SEQ ID NO: 1210793 - RNA, 19 nt, Homo sapiens
cuucagaucuucaggauaa

SEQ ID NO: 1210794 - RNA, 19 nt, Homo sapiens
caggaaaccuaauugcaua

SEQ ID NO: 1210795 - RNA, 19 nt, Homo sapiens
gcaagccaguuucaaauuc

SEQ ID NO: 1210796 - RNA, 19 nt, Homo sapiens
gaucgagccugcuuauuca

SEQ ID NO: 1210797 - RNA, 19 nt, Homo sapiens
agacuagacuugauucauu

SEQ ID NO: 1210798 - RNA, 19 nt, Homo sapiens
ggccauaccgauuucauua

SEQ ID NO: 1210799 - RNA, 19 nt, Homo sapiens
ggaagaagaagcagacguu

SEQ ID NO: 1210800 - RNA, 19 nt, Homo sapiens
cauacaagaugaagcaaga

SEQ ID NO: 1210801 - RNA, 19 nt, Homo sapiens
gccaagaaauugcaagugu

SEQ ID NO: 1210802 - RNA, 19 nt, Homo sapiens
gguagaauuuaaucccuuu

SEQ ID NO: 1210803 - RNA, 19 nt, Homo sapiens
gcaagaugccucaagaaau

SEQ ID NO: 1210804 - RNA, 19 nt, Homo sapiens
cauaugguggcaauaauua

SEQ ID NO: 1210805 - RNA, 19 nt, Homo sapiens
ggaucgagccugcuuauuc

SEQ ID NO: 1210806 - RNA, 19 nt, Homo sapiens
gaaaugcugccuacacugu

SEQ ID NO: 1210807 - RNA, 19 nt, Homo sapiens
ugacugaaguauaaagugu

SEQ ID NO: 1210808 - RNA, 19 nt, Homo sapiens
ugcaggaaaugauugguua

SEQ ID NO: 1210809 - RNA, 19 nt, Homo sapiens
cagaacaagugccauuaau

SEQ ID NO: 1210810 - RNA, 19 nt, Homo sapiens
gacuagacuugauucauug

SEQ ID NO: 1210811 - RNA, 19 nt, Homo sapiens
gaauggaacaauccgguuu

SEQ ID NO: 1210812 - RNA, 19 nt, Homo sapiens
gaacuuggaaggagugcaa

SEQ ID NO: 1210813 - RNA, 19 nt, Homo sapiens
gaaaaugucucaguugcuu

SEQ ID NO: 1210814 - RNA, 19 nt, Homo sapiens
gaauuuaaucccuuugaga

SEQ ID NO: 1210815 - RNA, 19 nt, Homo sapiens
caagaaauugcaaguguga

SEQ ID NO: 1210816 - RNA, 19 nt, Homo sapiens
gcauaugguggcaauaauu

SEQ ID NO: 1210817 - RNA, 19 nt, Homo sapiens
gcuaaugguugcagagaag

SEQ ID NO: 1210818 - RNA, 19 nt, Homo sapiens
caagccaguuucaaauuca

SEQ ID NO: 1210819 - RNA, 19 nt, Homo sapiens
gaaaccuaauugcauaugg

SEQ ID NO: 1210820 - RNA, 19 nt, Homo sapiens
uugggugacugaaguauaa

SEQ ID NO: 1210821 - RNA, 19 nt, Homo sapiens
gaacaauccgguuuuauga

SEQ ID NO: 1210822 - RNA, 19 nt, Homo sapiens
ccauaccgauuucauuaau

SEQ ID NO: 1210823 - RNA, 19 nt, Homo sapiens
agaagaagcagacguugaa

SEQ ID NO: 1210824 - RNA, 19 nt, Homo sapiens
aaagaaggccaagaaauug

SEQ ID NO: 1210825 - RNA, 19 nt, Homo sapiens
gauauuacucgguccaguu

SEQ ID NO: 1210826 - RNA, 19 nt, Homo sapiens
gaggagacuuuuaagcuaa

SEQ ID NO: 1210827 - RNA, 19 nt, Homo sapiens
ccaaagaaggccaagaaau

SEQ ID NO: 1210828 - RNA, 19 nt, Homo sapiens
uuaaugguuugguguuuga

SEQ ID NO: 1210829 - RNA, 19 nt, Homo sapiens
uaccuuagauucacaaacu

SEQ ID NO: 1210830 - RNA, 19 nt, Homo sapiens
gaggagaccacaagcuguu

SEQ ID NO: 1210831 - RNA, 19 nt, Homo sapiens
agucaggguugauggcaua

SEQ ID NO: 1210832 - RNA, 19 nt, Homo sapiens
gaacucucccucugugugu

SEQ ID NO: 1210833 - RNA, 19 nt, Homo sapiens
agagaagaauggaacaauc

SEQ ID NO: 1210834 - RNA, 19 nt, Homo sapiens
ccgauuucauuaaugguuu

SEQ ID NO: 1210835 - RNA, 19 nt, Homo sapiens
ggauucaggaaaccuaauu

SEQ ID NO: 1210836 - RNA, 19 nt, Homo sapiens
ucagaacaagugccauuaa

SEQ ID NO: 1210837 - RNA, 19 nt, Homo sapiens
cauuaaugguuugguguuu

SEQ ID NO: 1210838 - RNA, 19 nt, Homo sapiens
uccaguagaaggcuauuua

SEQ ID NO: 1210839 - RNA, 19 nt, Homo sapiens
auaauuauguggucauugg

SEQ ID NO: 1210840 - RNA, 19 nt, Homo sapiens
gcaggaaaugauugguuaa

SEQ ID NO: 1210841 - RNA, 19 nt, Homo sapiens
ccaguagaaggcuauuuaa

SEQ ID NO: 1210842 - RNA, 19 nt, Homo sapiens
ggcaagccaguuucaaauu

SEQ ID NO: 1210843 - RNA, 19 nt, Homo sapiens
ccagagacuagacuugauu

SEQ ID NO: 1210844 - RNA, 19 nt, Homo sapiens
gugcaugugguagaauuua

SEQ ID NO: 1210845 - RNA, 19 nt, Homo sapiens
ugacauacaagaugaagca

SEQ ID NO: 1210846 - RNA, 19 nt, Homo sapiens
ccuacacuguggauuguga

SEQ ID NO: 1210847 - RNA, 19 nt, Homo sapiens
ggaacaauccgguuuuaug

SEQ ID NO: 1210848 - RNA, 19 nt, Homo sapiens
uagagggccauaccgauuu

SEQ ID NO: 1210849 - RNA, 19 nt, Homo sapiens
gcccagagacuagacuuga

SEQ ID NO: 1210850 - RNA, 19 nt, Homo sapiens
guacguuucaggaagaaga

SEQ ID NO: 1210851 - RNA, 19 nt, Homo sapiens
gaaaaucuguuugcaacca

SEQ ID NO: 1210852 - RNA, 19 nt, Homo sapiens
uucgugaccuuguccagua

SEQ ID NO: 1210853 - RNA, 19 nt, Homo sapiens
gccauaccgauuucauuaa

SEQ ID NO: 1210854 - RNA, 19 nt, Homo sapiens
aaaccuaauugcauauggu

SEQ ID NO: 1210855 - RNA, 19 nt, Homo sapiens
uuuaaucccuuugagaaug

SEQ ID NO: 1210856 - RNA, 19 nt, Homo sapiens
aagaaaugcugccuacacu

SEQ ID NO: 1210857 - RNA, 19 nt, Homo sapiens
gcagagaagaauggaacaa

SEQ ID NO: 1210858 - RNA, 19 nt, Homo sapiens
ugaggagacuuuuaagcua

SEQ ID NO: 1210859 - RNA, 19 nt, Homo sapiens
cauaccgauuucauuaaug

SEQ ID NO: 1210860 - RNA, 19 nt, Homo sapiens
ggaaaccuaauugcauaug

SEQ ID NO: 1210861 - RNA, 19 nt, Homo sapiens
ucaggaaaccuaauugcau

SEQ ID NO: 1210862 - RNA, 19 nt, Homo sapiens
acaagugccauuaauguca

SEQ ID NO: 1210863 - RNA, 19 nt, Homo sapiens
caagaaaugcugccuacac

SEQ ID NO: 1210864 - RNA, 19 nt, Homo sapiens
cguguacguuucaggaaga

SEQ ID NO: 1210865 - RNA, 19 nt, Homo sapiens
caaaauaagagaccuguuc

SEQ ID NO: 1210866 - RNA, 19 nt, Homo sapiens
aaucagaacaagugccauu

SEQ ID NO: 1210867 - RNA, 19 nt, Homo sapiens
gagugcaaacagcucauuu

SEQ ID NO: 1210868 - RNA, 19 nt, Homo sapiens
ugcaugugguagaauuuaa

SEQ ID NO: 1210869 - RNA, 19 nt, Homo sapiens
gcuuggagcccagagacua

SEQ ID NO: 1210870 - RNA, 19 nt, Homo sapiens
gcaugugguagaauuuaau

SEQ ID NO: 1210871 - RNA, 19 nt, Homo sapiens
auaccgauuucauuaaugg

SEQ ID NO: 1210872 - RNA, 19 nt, Homo sapiens
gggccauaccgauuucauu

SEQ ID NO: 1210873 - RNA, 19 nt, Homo sapiens
uuagagggccauaccgauu

SEQ ID NO: 1210874 - RNA, 19 nt, Homo sapiens
gcaauaauuauguggucau

SEQ ID NO: 1210875 - RNA, 19 nt, Homo sapiens
auauuacucgguccaguua

SEQ ID NO: 1210876 - RNA, 19 nt, Homo sapiens
agaacaagugccauuaaug

SEQ ID NO: 1210877 - RNA, 19 nt, Homo sapiens
cgauuucauuaaugguuug

SEQ ID NO: 1210878 - RNA, 19 nt, Homo sapiens
agagaccuguucacaugga

SEQ ID NO: 1210879 - RNA, 19 nt, Homo sapiens
gagaagaauggaacaaucc

SEQ ID NO: 1210880 - RNA, 19 nt, Homo sapiens
ggagugcaaacagcucauu

SEQ ID NO: 1210881 - RNA, 19 nt, Homo sapiens
ucccaaagaaggccaagaa

SEQ ID NO: 1210882 - RNA, 19 nt, Homo sapiens
ucgaacauuucaccaugga

SEQ ID NO: 1210883 - RNA, 19 nt, Homo sapiens
ccaacaggcuauuuuaucu

SEQ ID NO: 1210884 - RNA, 19 nt, Homo sapiens
gugaagauuaugugcaugu

SEQ ID NO: 1210885 - RNA, 19 nt, Homo sapiens
aagaagaagcagacguuga

SEQ ID NO: 1210886 - RNA, 19 nt, Homo sapiens
cacuguggauugugaagau

SEQ ID NO: 1210887 - RNA, 19 nt, Homo sapiens
ccagaagcaucuuguaaua

SEQ ID NO: 1210888 - RNA, 19 nt, Homo sapiens
ccacaacuuugguuucuua

SEQ ID NO: 1210889 - RNA, 19 nt, Homo sapiens
gagaggugcuuccaaauug

SEQ ID NO: 1210890 - RNA, 19 nt, Homo sapiens
ggacugcucuggacauuca

SEQ ID NO: 1210891 - RNA, 19 nt, Homo sapiens
caacuuugguuucuuauca

SEQ ID NO: 1210892 - RNA, 19 nt, Homo sapiens
ggacgaguuucaucuguga

SEQ ID NO: 1210893 - RNA, 19 nt, Homo sapiens
gcacauaggguuuguaguc

SEQ ID NO: 1210894 - RNA, 19 nt, Homo sapiens
ggagaggugcuuccaaauu

SEQ ID NO: 1210895 - RNA, 19 nt, Homo sapiens
cccaagaaccugaguauuu

SEQ ID NO: 1210896 - RNA, 19 nt, Homo sapiens
ugugacaccuguugaauga

SEQ ID NO: 1210897 - RNA, 19 nt, Homo sapiens
ggguuuagguuccucugua

SEQ ID NO: 1210898 - RNA, 19 nt, Homo sapiens
aaacggaauugcaaacaug

SEQ ID NO: 1210899 - RNA, 19 nt, Homo sapiens
gcaagugugcuguguaguu

SEQ ID NO: 1210900 - RNA, 19 nt, Homo sapiens
ggucuccucuggucuauca

SEQ ID NO: 1210901 - RNA, 19 nt, Homo sapiens
aaaggcagcccugauguua

SEQ ID NO: 1210902 - RNA, 19 nt, Homo sapiens
gcauguagucugucucuga

SEQ ID NO: 1210903 - RNA, 19 nt, Homo sapiens
ccaagaaccugaguauuuu

SEQ ID NO: 1210904 - RNA, 19 nt, Homo sapiens
uguagucugucucugauuu

SEQ ID NO: 1210905 - RNA, 19 nt, Homo sapiens
guccaaagcacucagcuaa

SEQ ID NO: 1210906 - RNA, 19 nt, Homo sapiens
gguuuagucuucaguuuca

SEQ ID NO: 1210907 - RNA, 19 nt, Homo sapiens
caagugugcuguguaguuc

SEQ ID NO: 1210908 - RNA, 19 nt, Homo sapiens
guuagugccuccucugaug

SEQ ID NO: 1210909 - RNA, 19 nt, Homo sapiens
ccaaagcacucagcuaaaa

SEQ ID NO: 1210910 - RNA, 19 nt, Homo sapiens
gcaaacaugguacccacaa

SEQ ID NO: 1210911 - RNA, 19 nt, Homo sapiens
caauuuccaugguuuaguc

SEQ ID NO: 1210912 - RNA, 19 nt, Homo sapiens
auaagaugauggcuacauu

SEQ ID NO: 1210913 - RNA, 19 nt, Homo sapiens
guaagugcuuguucccaau

SEQ ID NO: 1210914 - RNA, 19 nt, Homo sapiens
gugcaagugugcuguguag

SEQ ID NO: 1210915 - RNA, 19 nt, Homo sapiens
gaagcugagugugcaagug

SEQ ID NO: 1210916 - RNA, 19 nt, Homo sapiens
cagaagaggaccaaaguca

SEQ ID NO: 1210917 - RNA, 19 nt, Homo sapiens
cagcagagcagaaggcaau

SEQ ID NO: 1210918 - RNA, 19 nt, Homo sapiens
agggagaggugcuuccaaa

SEQ ID NO: 1210919 - RNA, 19 nt, Homo sapiens
cagaagcaucuuguaauaa

SEQ ID NO: 1210920 - RNA, 19 nt, Homo sapiens
gguuuagguuccucuguau

SEQ ID NO: 1210921 - RNA, 19 nt, Homo sapiens
ggacaccuuaguaggaauu

SEQ ID NO: 1210922 - RNA, 19 nt, Homo sapiens
ggagagaugaagcccaaga

SEQ ID NO: 1210923 - RNA, 19 nt, Homo sapiens
guagucugucucugauuua

SEQ ID NO: 1210924 - RNA, 19 nt, Homo sapiens
ucuaucagcucccaucucu

SEQ ID NO: 1210925 - RNA, 19 nt, Homo sapiens
caucaaagaauugcauuuc

SEQ ID NO: 1210926 - RNA, 19 nt, Homo sapiens
ucagcacucuccagcauca

SEQ ID NO: 1210927 - RNA, 19 nt, Homo sapiens
gccagaagcaucuuguaau

SEQ ID NO: 1210928 - RNA, 19 nt, Homo sapiens
ccauuccuauccugucauu

SEQ ID NO: 1210929 - RNA, 19 nt, Homo sapiens
gagagaugaagcccaagaa

SEQ ID NO: 1210930 - RNA, 19 nt, Homo sapiens
gcaaugccacgcagaagag

SEQ ID NO: 1210931 - RNA, 19 nt, Homo sapiens
cauguagucugucucugau

SEQ ID NO: 1210932 - RNA, 19 nt, Homo sapiens
gguuucuuaucauccauuu

SEQ ID NO: 1210933 - RNA, 19 nt, Homo sapiens
gugagguaauaggcuaaua

SEQ ID NO: 1210934 - RNA, 19 nt, Homo sapiens
gaugagccauacgccagaa

SEQ ID NO: 1210935 - RNA, 19 nt, Homo sapiens
caucugugacaccuacaua

SEQ ID NO: 1210936 - RNA, 19 nt, Homo sapiens
augaggaggugaugcauuc

SEQ ID NO: 1210937 - RNA, 19 nt, Homo sapiens
cacauaggguuuguaguca

SEQ ID NO: 1210938 - RNA, 19 nt, Homo sapiens
gucuucaguuucagucuuu

SEQ ID NO: 1210939 - RNA, 19 nt, Homo sapiens
ccacugaagaggccaagga

SEQ ID NO: 1210940 - RNA, 19 nt, Homo sapiens
caggacugcucuggacauu

SEQ ID NO: 1210941 - RNA, 19 nt, Homo sapiens
gcccuuugagaguuuaaua

SEQ ID NO: 1210942 - RNA, 19 nt, Homo sapiens
guacccacaacuuugguuu

SEQ ID NO: 1210943 - RNA, 19 nt, Homo sapiens
gauaagaugauggcuacau

SEQ ID NO: 1210944 - RNA, 19 nt, Homo sapiens
ugagguaauaggcuaauau

SEQ ID NO: 1210945 - RNA, 19 nt, Homo sapiens
ucaaggccaccaccacuga

SEQ ID NO: 1210946 - RNA, 19 nt, Homo sapiens
ugucucugauuuaggguuu

SEQ ID NO: 1210947 - RNA, 19 nt, Homo sapiens
uugcauuucugacccaaga

SEQ ID NO: 1210948 - RNA, 19 nt, Homo sapiens
caugguacccacaacuuug

SEQ ID NO: 1210949 - RNA, 19 nt, Homo sapiens
cggaauugcaaacauggua

SEQ ID NO: 1210950 - RNA, 19 nt, Homo sapiens
ugucagcacucuccagcau

SEQ ID NO: 1210951 - RNA, 19 nt, Homo sapiens
aggcagcccugauguuagu

SEQ ID NO: 1210952 - RNA, 19 nt, Homo sapiens
guucaugggccucauuaag

SEQ ID NO: 1210953 - RNA, 19 nt, Homo sapiens
auuaagcucugccuuccuu

SEQ ID NO: 1210954 - RNA, 19 nt, Homo sapiens
uggcuacauuccauuccua

SEQ ID NO: 1210955 - RNA, 19 nt, Homo sapiens
uuuagguuccucuguauuu

SEQ ID NO: 1210956 - RNA, 19 nt, Homo sapiens
gaaagguggaggaaaagaa

SEQ ID NO: 1210957 - RNA, 19 nt, Homo sapiens
uaagaugauggcuacauuc

SEQ ID NO: 1210958 - RNA, 19 nt, Homo sapiens
uaucagcucccaucucucu

SEQ ID NO: 1210959 - RNA, 19 nt, Homo sapiens
aauuggcccuguaggcaaa

SEQ ID NO: 1210960 - RNA, 19 nt, Homo sapiens
caccuuaguaggaauucua

SEQ ID NO: 1210961 - RNA, 19 nt, Homo sapiens
gguuggccuugaaugaaga

SEQ ID NO: 1210962 - RNA, 19 nt, Homo sapiens
guucccaauuuccaugguu

SEQ ID NO: 1210963 - RNA, 19 nt, Homo sapiens
uaagugcuuguucccaauu

SEQ ID NO: 1210964 - RNA, 19 nt, Homo sapiens
gcagaagggagagaugaag

SEQ ID NO: 1210965 - RNA, 19 nt, Homo sapiens
gaaggcagaagggagagau

SEQ ID NO: 1210966 - RNA, 19 nt, Homo sapiens
caaacaugguacccacaac

SEQ ID NO: 1210967 - RNA, 19 nt, Homo sapiens
ccuauccugucauucaauc

SEQ ID NO: 1210968 - RNA, 19 nt, Homo sapiens
caaagucaggugccagaag

SEQ ID NO: 1210969 - RNA, 19 nt, Homo sapiens
gcagaagaggaccaaaguc

SEQ ID NO: 1210970 - RNA, 19 nt, Homo sapiens
uuguauaucugcauguagu

SEQ ID NO: 1210971 - RNA, 19 nt, Homo sapiens
ccucacagggugcuggaaa

SEQ ID NO: 1210972 - RNA, 19 nt, Homo sapiens
ucaugggccucauuaagcu

SEQ ID NO: 1210973 - RNA, 19 nt, Homo sapiens
cuggaaagguggaggaaaa

SEQ ID NO: 1210974 - RNA, 19 nt, Homo sapiens
guggucagauaagaugaug

SEQ ID NO: 1210975 - RNA, 19 nt, Homo sapiens
ccaucaaagaauugcauuu

SEQ ID NO: 1210976 - RNA, 19 nt, Homo sapiens
acauaguccucgcuuggau

SEQ ID NO: 1210977 - RNA, 19 nt, Homo sapiens
ccaucucucucccagucuu

SEQ ID NO: 1210978 - RNA, 19 nt, Homo sapiens
ggcagaagggagagaugaa

SEQ ID NO: 1210979 - RNA, 19 nt, Homo sapiens
gccuuugguuggccuugaa

SEQ ID NO: 1210980 - RNA, 19 nt, Homo sapiens
agccagaagcaucuuguaa

SEQ ID NO: 1210981 - RNA, 19 nt, Homo sapiens
acaugguacccacaacuuu

SEQ ID NO: 1210982 - RNA, 19 nt, Homo sapiens
guaccacugucagcacucu

SEQ ID NO: 1210983 - RNA, 19 nt, Homo sapiens
cauaggguuuguagucacu

SEQ ID NO: 1210984 - RNA, 19 nt, Homo sapiens
caagaugccugucguguuu

SEQ ID NO: 1210985 - RNA, 19 nt, Homo sapiens
gcaaugcccugcgugaguu

SEQ ID NO: 1210986 - RNA, 19 nt, Homo sapiens
caaccgauccuauaaguuc

SEQ ID NO: 1210987 - RNA, 19 nt, Homo sapiens
gaguguaaaugcacauaug

SEQ ID NO: 1210988 - RNA, 19 nt, Homo sapiens
ccacaucggagcaguauga

SEQ ID NO: 1210989 - RNA, 19 nt, Homo sapiens
gcacagcucagaccaagau

SEQ ID NO: 1210990 - RNA, 19 nt, Homo sapiens
gagaugaggaggauggaaa

SEQ ID NO: 1210991 - RNA, 19 nt, Homo sapiens
uaaagaagaguguaaaugc

SEQ ID NO: 1210992 - RNA, 19 nt, Homo sapiens
caucggagcaguaugaguu

SEQ ID NO: 1210993 - RNA, 19 nt, Homo sapiens
ccuauaaguucaccaucaa

SEQ ID NO: 1210994 - RNA, 19 nt, Homo sapiens
aaagaagaguguaaaugca

SEQ ID NO: 1210995 - RNA, 19 nt, Homo sapiens
uccugaagcucccggauaa

SEQ ID NO: 1210996 - RNA, 19 nt, Homo sapiens
ccaccaagaucccgcacau

SEQ ID NO: 1210997 - RNA, 19 nt, Homo sapiens
cguaagugcuccuacuaca

SEQ ID NO: 1210998 - RNA, 19 nt, Homo sapiens
guaaaugcacauauggaau

SEQ ID NO: 1210999 - RNA, 19 nt, Homo sapiens
uaagugcuccuacuacauc

SEQ ID NO: 1211000 - RNA, 19 nt, Homo sapiens
gaaccagaggcguggaaga

SEQ ID NO: 1211001 - RNA, 19 nt, Homo sapiens
ccaagaugccugucguguu

SEQ ID NO: 1211002 - RNA, 19 nt, Homo sapiens
ccuccacgcugguguacga

SEQ ID NO: 1211003 - RNA, 19 nt, Homo sapiens
ggauggaaagggugucuuc

SEQ ID NO: 1211004 - RNA, 19 nt, Homo sapiens
ugaagcucccggauaauga

SEQ ID NO: 1211005 - RNA, 19 nt, Homo sapiens
gauaaugagcacccaugug

SEQ ID NO: 1211006 - RNA, 19 nt, Homo sapiens
ucugagagaugauuuucua

SEQ ID NO: 1211007 - RNA, 19 nt, Homo sapiens
cccaaccgauccuauaagu

SEQ ID NO: 1211008 - RNA, 19 nt, Homo sapiens
gaaguuccagcgcaugaag

SEQ ID NO: 1211009 - RNA, 19 nt, Homo sapiens
uguaaaugcacauauggaa

SEQ ID NO: 1211010 - RNA, 19 nt, Homo sapiens
ggauaaugagcacccaugu

SEQ ID NO: 1211011 - RNA, 19 nt, Homo sapiens
uauaaguucaccaucaaga

SEQ ID NO: 1211012 - RNA, 19 nt, Homo sapiens
caguaugaguugcgcuuca

SEQ ID NO: 1211013 - RNA, 19 nt, Homo sapiens
uccuauaaguucaccauca

SEQ ID NO: 1211014 - RNA, 19 nt, Homo sapiens
gacagcuuccugaccauga

SEQ ID NO: 1211015 - RNA, 19 nt, Homo sapiens
gaagcucccggauaaugag

SEQ ID NO: 1211016 - RNA, 19 nt, Homo sapiens
ggguggagaugaggaggau

SEQ ID NO: 1211017 - RNA, 19 nt, Homo sapiens
gaugucagugccaccaaga

SEQ ID NO: 1211018 - RNA, 19 nt, Homo sapiens
guaagugcuccuacuacau

SEQ ID NO: 1211019 - RNA, 19 nt, Homo sapiens
gccugggccuggacaagau

SEQ ID NO: 1211020 - RNA, 19 nt, Homo sapiens
gauccuauaaguucaccau

SEQ ID NO: 1211021 - RNA, 19 nt, Homo sapiens
agaugccugucguguuuga

SEQ ID NO: 1211022 - RNA, 19 nt, Homo sapiens
caacaaacaccugcaguua

SEQ ID NO: 1211023 - RNA, 19 nt, Homo sapiens
acaaacaccugcaguuaaa

SEQ ID NO: 1211024 - RNA, 19 nt, Homo sapiens
gcaaagaccagaacaaaca

SEQ ID NO: 1211025 - RNA, 19 nt, Homo sapiens
gggcuuagguuugggacua

SEQ ID NO: 1211026 - RNA, 19 nt, Homo sapiens
caucagcacuggaaugcaa

SEQ ID NO: 1211027 - RNA, 19 nt, Homo sapiens
gcucugaagugguucugaa

SEQ ID NO: 1211028 - RNA, 19 nt, Homo sapiens
cugcaaagauggagaagga

SEQ ID NO: 1211029 - RNA, 19 nt, Homo sapiens
gcaacaaacaccugcaguu

SEQ ID NO: 1211030 - RNA, 19 nt, Homo sapiens
gauuauccuucgcucguuu

SEQ ID NO: 1211031 - RNA, 19 nt, Homo sapiens
gaacacaccacagccauca

SEQ ID NO: 1211032 - RNA, 19 nt, Homo sapiens
gcggaauccugcaaagaug

SEQ ID NO: 1211033 - RNA, 19 nt, Homo sapiens
gagcaugcauguuuauagc

SEQ ID NO: 1211034 - RNA, 19 nt, Homo sapiens
accgagggcugcugcauaa

SEQ ID NO: 1211035 - RNA, 19 nt, Homo sapiens
gaccgagggcugcugcaua

SEQ ID NO: 1211036 - RNA, 19 nt, Homo sapiens
cugcagcucugaagugguu

SEQ ID NO: 1211037 - RNA, 19 nt, Homo sapiens
gcacugggguggucaagga

SEQ ID NO: 1211038 - RNA, 19 nt, Homo sapiens
gggacagagugugggcuua

SEQ ID NO: 1211039 - RNA, 19 nt, Homo sapiens
ggagcaugcauguuuauag

SEQ ID NO: 1211040 - RNA, 19 nt, Homo sapiens
gugccaccaucuacuuuga

SEQ ID NO: 1211041 - RNA, 19 nt, Homo sapiens
uuucggagcaugcauguuu

SEQ ID NO: 1211042 - RNA, 19 nt, Homo sapiens
caaaugcaggacuguagaa

SEQ ID NO: 1211043 - RNA, 19 nt, Homo sapiens
aacaaacaccugcaguuaa

SEQ ID NO: 1211044 - RNA, 19 nt, Homo sapiens
ugcaggaggugacgcagaa

SEQ ID NO: 1211045 - RNA, 19 nt, Homo sapiens
gagcggaauccugcaaaga

SEQ ID NO: 1211046 - RNA, 19 nt, Homo sapiens
ggacagagugugggcuuag

SEQ ID NO: 1211047 - RNA, 19 nt, Homo sapiens
ccaaaugcaggacuguaga

SEQ ID NO: 1211048 - RNA, 19 nt, Homo sapiens
cgagauucccgacgagaga

SEQ ID NO: 1211049 - RNA, 19 nt, Homo sapiens
gagugugggcuuagguuug

SEQ ID NO: 1211050 - RNA, 19 nt, Homo sapiens
caccugcaguuaaaggaau

SEQ ID NO: 1211051 - RNA, 19 nt, Homo sapiens
guagaagcggccaggaaga

SEQ ID NO: 1211052 - RNA, 19 nt, Homo sapiens
cuauggugcucaggugauu

SEQ ID NO: 1211053 - RNA, 19 nt, Homo sapiens
uagaagcggccaggaagaa

SEQ ID NO: 1211054 - RNA, 19 nt, Homo sapiens
gaccuggacccgugaaguc

SEQ ID NO: 1211055 - RNA, 19 nt, Homo sapiens
ggaaugcaaagaccagaac

SEQ ID NO: 1211056 - RNA, 19 nt, Homo sapiens
ggaauccugcaaagaugga

SEQ ID NO: 1211057 - RNA, 19 nt, Homo sapiens
gccaccaucuacuuugaca

SEQ ID NO: 1211058 - RNA, 19 nt, Homo sapiens
acauuuaucaagcaucuga

SEQ ID NO: 1211059 - RNA, 19 nt, Homo sapiens
ggagaaggaggaggagaca

SEQ ID NO: 1211060 - RNA, 19 nt, Homo sapiens
uucggagcaugcauguuua

SEQ ID NO: 1211061 - RNA, 19 nt, Homo sapiens
uuuggagcauuguucuaaa

SEQ ID NO: 1211062 - RNA, 19 nt, Homo sapiens
augcaaagaccagaacaaa

SEQ ID NO: 1211063 - RNA, 19 nt, Homo sapiens
aaauucagcucuucaguua

SEQ ID NO: 1211064 - RNA, 19 nt, Homo sapiens
gaagugauguuagagaauu

SEQ ID NO: 1211065 - RNA, 19 nt, Homo sapiens
gggcaaagaaguuaaauuu

SEQ ID NO: 1211066 - RNA, 19 nt, Homo sapiens
gggcuucccucauguuuaa

SEQ ID NO: 1211067 - RNA, 19 nt, Homo sapiens
gagaagugauguuagagaa

SEQ ID NO: 1211068 - RNA, 19 nt, Homo sapiens
ggaaauaccagcccaggaa

SEQ ID NO: 1211069 - RNA, 19 nt, Homo sapiens
aaucgcagcuccucaaauu

SEQ ID NO: 1211070 - RNA, 19 nt, Homo sapiens
ccacgauugugagauauua

SEQ ID NO: 1211071 - RNA, 19 nt, Homo sapiens
uauauugccuuuccugauu

SEQ ID NO: 1211072 - RNA, 19 nt, Homo sapiens
gagcagugauggaggaaau

SEQ ID NO: 1211073 - RNA, 19 nt, Homo sapiens
cuacagagaagugauguua

SEQ ID NO: 1211074 - RNA, 19 nt, Homo sapiens
acagagaagugauguuaga

SEQ ID NO: 1211075 - RNA, 19 nt, Homo sapiens
gugccuaacucuccuguga

SEQ ID NO: 1211076 - RNA, 19 nt, Homo sapiens
gcaccuuacucgagaggaa

SEQ ID NO: 1211077 - RNA, 19 nt, Homo sapiens
gcucgucccugcucggaaa

SEQ ID NO: 1211078 - RNA, 19 nt, Homo sapiens
gagaagggagggcaaagaa

SEQ ID NO: 1211079 - RNA, 19 nt, Homo sapiens
uuacagaguuuccaacagu

SEQ ID NO: 1211080 - RNA, 19 nt, Homo sapiens
caaauucagcucuucaguu

SEQ ID NO: 1211081 - RNA, 19 nt, Homo sapiens
gaagggagggcaaagaagu

SEQ ID NO: 1211082 - RNA, 19 nt, Homo sapiens
caagagauggcccaaguau

SEQ ID NO: 1211083 - RNA, 19 nt, Homo sapiens
gcaggacaccgacauggaa

SEQ ID NO: 1211084 - RNA, 19 nt, Homo sapiens
ccaaggaagcccucuguug

SEQ ID NO: 1211085 - RNA, 19 nt, Homo sapiens
caccaaggguccaguuuca

SEQ ID NO: 1211086 - RNA, 19 nt, Homo sapiens
ggauguggcugugcaccuu

SEQ ID NO: 1211087 - RNA, 19 nt, Homo sapiens
ggagggcaaagaaguuaaa

SEQ ID NO: 1211088 - RNA, 19 nt, Homo sapiens
uuccuacccuuuauucuuu

SEQ ID NO: 1211089 - RNA, 19 nt, Homo sapiens
gcucuucaguuauggucuu

SEQ ID NO: 1211090 - RNA, 19 nt, Homo sapiens
ggucaucaucuacuuguau

SEQ ID NO: 1211091 - RNA, 19 nt, Homo sapiens
uuuccacgauugugagaua

SEQ ID NO: 1211092 - RNA, 19 nt, Homo sapiens
gucaucaucuacuuguauu

SEQ ID NO: 1211093 - RNA, 19 nt, Homo sapiens
cagcaggaaucuccaagag

SEQ ID NO: 1211094 - RNA, 19 nt, Homo sapiens
ggagaagggagggcaaaga

SEQ ID NO: 1211095 - RNA, 19 nt, Homo sapiens
ucaucuacuuguauuguga

SEQ ID NO: 1211096 - RNA, 19 nt, Homo sapiens
ccacccggauucauagugu

SEQ ID NO: 1211097 - RNA, 19 nt, Homo sapiens
ggguccaguuucagucuuu

SEQ ID NO: 1211098 - RNA, 19 nt, Homo sapiens
auauugccuuuccugauua

SEQ ID NO: 1211099 - RNA, 19 nt, Homo sapiens
auucagcucuucaguuaug

SEQ ID NO: 1211100 - RNA, 19 nt, Homo sapiens
ccucaaauuaccucuguuu

SEQ ID NO: 1211101 - RNA, 19 nt, Homo sapiens
gaaacacuugccguccuua

SEQ ID NO: 1211102 - RNA, 19 nt, Homo sapiens
guugcaaccagauauguuu

SEQ ID NO: 1211103 - RNA, 19 nt, Homo sapiens
ggaugccaccacuguguaa

SEQ ID NO: 1211104 - RNA, 19 nt, Homo sapiens
gguugguggucaucaucua

SEQ ID NO: 1211105 - RNA, 19 nt, Homo sapiens
uccaagagauggcccaagu

SEQ ID NO: 1211106 - RNA, 19 nt, Homo sapiens
agaaacacuugccguccuu

SEQ ID NO: 1211107 - RNA, 19 nt, Homo sapiens
ccaagagauggcccaagua

SEQ ID NO: 1211108 - RNA, 19 nt, Homo sapiens
accaggaguuugugacauu

SEQ ID NO: 1211109 - RNA, 19 nt, Homo sapiens
ccagguaccaggaguuugu

SEQ ID NO: 1211110 - RNA, 19 nt, Homo sapiens
acagaguuuccaacaguua

SEQ ID NO: 1211111 - RNA, 19 nt, Homo sapiens
ccaggcaagugcuuucucu

SEQ ID NO: 1211112 - RNA, 19 nt, Homo sapiens
gauguggcugugcaccuua

SEQ ID NO: 1211113 - RNA, 19 nt, Homo sapiens
uguaaacuguaaagugaca

SEQ ID NO: 1211114 - RNA, 19 nt, Homo sapiens
cagaguuuccaacaguuaa

SEQ ID NO: 1211115 - RNA, 19 nt, Homo sapiens
cuaccuuccuacccuuuau

SEQ ID NO: 1211116 - RNA, 19 nt, Homo sapiens
gcaaccagauauguuuuga

SEQ ID NO: 1211117 - RNA, 19 nt, Homo sapiens
agagauggcccaaguaucg

SEQ ID NO: 1211118 - RNA, 19 nt, Homo sapiens
uacagaguuuccaacaguu

SEQ ID NO: 1211119 - RNA, 19 nt, Homo sapiens
acccugggcuucccucaug

SEQ ID NO: 1211120 - RNA, 19 nt, Homo sapiens
caucaucuacuuguauugu

SEQ ID NO: 1211121 - RNA, 19 nt, Homo sapiens
ccaaggguccaguuucagu

SEQ ID NO: 1211122 - RNA, 19 nt, Homo sapiens
ccaggaguuugugacauuc

SEQ ID NO: 1211123 - RNA, 19 nt, Homo sapiens
uauugccuuuccugauuaa

SEQ ID NO: 1211124 - RNA, 19 nt, Homo sapiens
gccuaacucuccugugaac

SEQ ID NO: 1211125 - RNA, 19 nt, Homo sapiens
guaccaggaguuugugaca

SEQ ID NO: 1211126 - RNA, 19 nt, Homo sapiens
ugccuuuccugauuaagug

SEQ ID NO: 1211127 - RNA, 19 nt, Homo sapiens
aauagaagcuccccaggau

SEQ ID NO: 1211128 - RNA, 19 nt, Homo sapiens
gggagggcaaagaaguuaa

SEQ ID NO: 1211129 - RNA, 19 nt, Homo sapiens
gaagcagcagggucaccaa

SEQ ID NO: 1211130 - RNA, 19 nt, Homo sapiens
agagaagugauguuagaga

SEQ ID NO: 1211131 - RNA, 19 nt, Homo sapiens
ucaccaaggguccaguuuc

SEQ ID NO: 1211132 - RNA, 19 nt, Homo sapiens
aggaagcccucuguugcaa

SEQ ID NO: 1211133 - RNA, 19 nt, Homo sapiens
aauguuaggguccaaggaa

SEQ ID NO: 1211134 - RNA, 19 nt, Homo sapiens
ccaccacccggauucauag

SEQ ID NO: 1211135 - RNA, 19 nt, Homo sapiens
cccaccacccggauucaua

SEQ ID NO: 1211136 - RNA, 19 nt, Homo sapiens
gguccaguuucagucuuug

SEQ ID NO: 1211137 - RNA, 19 nt, Homo sapiens
cucaaauuaccucuguuua

SEQ ID NO: 1211138 - RNA, 19 nt, Homo sapiens
ucgcagcuccucaaauuac

SEQ ID NO: 1211139 - RNA, 19 nt, Homo sapiens
caggaugccaccacugugu

SEQ ID NO: 1211140 - RNA, 19 nt, Homo sapiens
gguaaagccuucagucaua

SEQ ID NO: 1211141 - RNA, 19 nt, Homo sapiens
agucagagcucaagucuua

SEQ ID NO: 1211142 - RNA, 19 nt, Homo sapiens
acaaagagaugcccuguaa

SEQ ID NO: 1211143 - RNA, 19 nt, Homo sapiens
caucagagcucagcccuua

SEQ ID NO: 1211144 - RNA, 19 nt, Homo sapiens
aaagagaacucaugaaugu

SEQ ID NO: 1211145 - RNA, 19 nt, Homo sapiens
gaagaugggaagauauuua

SEQ ID NO: 1211146 - RNA, 19 nt, Homo sapiens
gaaaagaacuccagucaga

SEQ ID NO: 1211147 - RNA, 19 nt, Homo sapiens
gaaauugguucuuaguguu

SEQ ID NO: 1211148 - RNA, 19 nt, Homo sapiens
gugaggagauucagucaua

SEQ ID NO: 1211149 - RNA, 19 nt, Homo sapiens
ggaaagagaaaucguauga

SEQ ID NO: 1211150 - RNA, 19 nt, Homo sapiens
agucauagcucagaucuua

SEQ ID NO: 1211151 - RNA, 19 nt, Homo sapiens
gagagaagcccuacaaaug

SEQ ID NO: 1211152 - RNA, 19 nt, Homo sapiens
gaauauggguuggccuaua

SEQ ID NO: 1211153 - RNA, 19 nt, Homo sapiens
gagaugcccuguaagugua

SEQ ID NO: 1211154 - RNA, 19 nt, Homo sapiens
cggaagaagugcauucaua

SEQ ID NO: 1211155 - RNA, 19 nt, Homo sapiens
agucaaaccucaugccuua

SEQ ID NO: 1211156 - RNA, 19 nt, Homo sapiens
ucaaacauguauacccuua

SEQ ID NO: 1211157 - RNA, 19 nt, Homo sapiens
uaacaagaguucaugauuc

SEQ ID NO: 1211158 - RNA, 19 nt, Homo sapiens
guucacaacuuccauaaga

SEQ ID NO: 1211159 - RNA, 19 nt, Homo sapiens
ggaaaagacuucagauuga

SEQ ID NO: 1211160 - RNA, 19 nt, Homo sapiens
caauauauccaguccaaua

SEQ ID NO: 1211161 - RNA, 19 nt, Homo sapiens
uaacuucuccauucucuua

SEQ ID NO: 1211162 - RNA, 19 nt, Homo sapiens
cuagggaucuuaugucgua

SEQ ID NO: 1211163 - RNA, 19 nt, Homo sapiens
cgacguaaguagcucauuu

SEQ ID NO: 1211164 - RNA, 19 nt, Homo sapiens
ggaaauaccagcccaggaa

SEQ ID NO: 1211165 - RNA, 19 nt, Homo sapiens
uaaugaagaugggaagaua

SEQ ID NO: 1211166 - RNA, 19 nt, Homo sapiens
gagggcaguuucagucaua

SEQ ID NO: 1211167 - RNA, 19 nt, Homo sapiens
gaagaagacaugauaagga

SEQ ID NO: 1211168 - RNA, 19 nt, Homo sapiens
gacaauauauccaguccaa

SEQ ID NO: 1211169 - RNA, 19 nt, Homo sapiens
ucauggaguuccuuuauuu

SEQ ID NO: 1211170 - RNA, 19 nt, Homo sapiens
cuaauagccucacuacauu

SEQ ID NO: 1211171 - RNA, 19 nt, Homo sapiens
gaacucauuuaagcuguuu

SEQ ID NO: 1211172 - RNA, 19 nt, Homo sapiens
guaauaagcauguaugugu

SEQ ID NO: 1211173 - RNA, 19 nt, Homo sapiens
gauaaauccuguaguccaa

SEQ ID NO: 1211174 - RNA, 19 nt, Homo sapiens
ccauuaggauugcagauaa

SEQ ID NO: 1211175 - RNA, 19 nt, Homo sapiens
acacaaaucagcaucauaa

SEQ ID NO: 1211176 - RNA, 19 nt, Homo sapiens
caacaucagagcauucaua

SEQ ID NO: 1211177 - RNA, 19 nt, Homo sapiens
gacaguauuugaaguguga

SEQ ID NO: 1211178 - RNA, 19 nt, Homo sapiens
gaacagagauggggucuug

SEQ ID NO: 1211179 - RNA, 19 nt, Homo sapiens
caaaugaugcccaagguuu

SEQ ID NO: 1211180 - RNA, 19 nt, Homo sapiens
gagcacaucuaguucaaca

SEQ ID NO: 1211181 - RNA, 19 nt, Homo sapiens
gaaaagcccuauacgugua

SEQ ID NO: 1211182 - RNA, 19 nt, Homo sapiens
gaauucagccucugguaaa

SEQ ID NO: 1211183 - RNA, 19 nt, Homo sapiens
gagagagaguuuaggcaaa

SEQ ID NO: 1211184 - RNA, 19 nt, Homo sapiens
gagcaggacucucucucaa

SEQ ID NO: 1211185 - RNA, 19 nt, Homo sapiens
guaaauggcagaucuuuca

SEQ ID NO: 1211186 - RNA, 19 nt, Homo sapiens
ugguaaacaugaacacuua

SEQ ID NO: 1211187 - RNA, 19 nt, Homo sapiens
gaauacagaauaccgauga

SEQ ID NO: 1211188 - RNA, 19 nt, Homo sapiens
gaauaaagguguguuuggu

SEQ ID NO: 1211189 - RNA, 19 nt, Homo sapiens
agagaaagccuaugaguau

SEQ ID NO: 1211190 - RNA, 19 nt, Homo sapiens
gaauaccgaugacaaugau

SEQ ID NO: 1211191 - RNA, 19 nt, Homo sapiens
uagaaagacuucaggaaau

SEQ ID NO: 1211192 - RNA, 19 nt, Homo sapiens
caacaagacuccuaauagc

SEQ ID NO: 1211193 - RNA, 19 nt, Homo sapiens
gaauauccauaguagacaa

SEQ ID NO: 1211194 - RNA, 19 nt, Homo sapiens
gagcagugauggaggaaau

SEQ ID NO: 1211195 - RNA, 19 nt, Homo sapiens
guucaugauucuuuaggua

SEQ ID NO: 1211196 - RNA, 19 nt, Homo sapiens
caucagagaauccauacua

SEQ ID NO: 1211197 - RNA, 19 nt, Homo sapiens
gcucagcccuuacuagaca

SEQ ID NO: 1211198 - RNA, 19 nt, Homo sapiens
ugaaauugguucuuagugu

SEQ ID NO: 1211199 - RNA, 19 nt, Homo sapiens
aauggcagaucuuucaaua

SEQ ID NO: 1211200 - RNA, 19 nt, Homo sapiens
ggagaaaucauguauguac

SEQ ID NO: 1211201 - RNA, 19 nt, Homo sapiens
ucagagagcacaucuaguu

SEQ ID NO: 1211202 - RNA, 19 nt, Homo sapiens
caacaaggaauucauuuca

SEQ ID NO: 1211203 - RNA, 19 nt, Homo sapiens
gagaaauccuauaaaugug

SEQ ID NO: 1211204 - RNA, 19 nt, Homo sapiens
gagaaacccucugaaugug

SEQ ID NO: 1211205 - RNA, 19 nt, Homo sapiens
agaaagacuucaggaaauu

SEQ ID NO: 1211206 - RNA, 19 nt, Homo sapiens
agaagugcauucauacaaa

SEQ ID NO: 1211207 - RNA, 19 nt, Homo sapiens
gaauucugcuccucucuca

SEQ ID NO: 1211208 - RNA, 19 nt, Homo sapiens
gagacaguauuucaagaga

SEQ ID NO: 1211209 - RNA, 19 nt, Homo sapiens
ggaagacucaaacacgaua

SEQ ID NO: 1211210 - RNA, 19 nt, Homo sapiens
gaagugcauucauacaaag

SEQ ID NO: 1211211 - RNA, 19 nt, Homo sapiens
aaacauguauacccuuaug

SEQ ID NO: 1211212 - RNA, 19 nt, Homo sapiens
gugaguaagacaaauguua

SEQ ID NO: 1211213 - RNA, 19 nt, Homo sapiens
ccaaagagaacucaugaau

SEQ ID NO: 1211214 - RNA, 19 nt, Homo sapiens
gagagcacaucuaguucaa

SEQ ID NO: 1211215 - RNA, 19 nt, Homo sapiens
gagagaguuuaggcaaaua

SEQ ID NO: 1211216 - RNA, 19 nt, Homo sapiens
acacuuggauuccuguuga

SEQ ID NO: 1211217 - RNA, 19 nt, Homo sapiens
ucaaagaaacuaccuuguu

SEQ ID NO: 1211218 - RNA, 19 nt, Homo sapiens
agucauagcucagccauug

SEQ ID NO: 1211219 - RNA, 19 nt, Homo sapiens
gaucuuauccugcaacaag

SEQ ID NO: 1211220 - RNA, 19 nt, Homo sapiens
agccaaaucuuacaaaugu

SEQ ID NO: 1211221 - RNA, 19 nt, Homo sapiens
gcagaucagagaguucuua

SEQ ID NO: 1211222 - RNA, 19 nt, Homo sapiens
ccagugagaagaacaauga

SEQ ID NO: 1211223 - RNA, 19 nt, Homo sapiens
caucauauaccuaacaaga

SEQ ID NO: 1211224 - RNA, 19 nt, Homo sapiens
guucagggccaccaucaua

SEQ ID NO: 1211225 - RNA, 19 nt, Homo sapiens
gaauguagccuuccaacag

SEQ ID NO: 1211226 - RNA, 19 nt, Homo sapiens
uugcuggucuggugucuua

SEQ ID NO: 1211227 - RNA, 19 nt, Homo sapiens
ucacaacuuccauaagaua

SEQ ID NO: 1211228 - RNA, 19 nt, Homo sapiens
gaacuuauuuggguguagu

SEQ ID NO: 1211229 - RNA, 19 nt, Homo sapiens
gaagagaaagccuaugagu

SEQ ID NO: 1211230 - RNA, 19 nt, Homo sapiens
ggaaugugcuuuuguacuu

SEQ ID NO: 1211231 - RNA, 19 nt, Homo sapiens
uuaagcaccuuuagaagau

SEQ ID NO: 1211232 - RNA, 19 nt, Homo sapiens
gacguaaguagcucauuua

SEQ ID NO: 1211233 - RNA, 19 nt, Homo sapiens
cuaaguagguacguuuauu

SEQ ID NO: 1211234 - RNA, 19 nt, Homo sapiens
acaaggaauucauuucaga

SEQ ID NO: 1211235 - RNA, 19 nt, Homo sapiens
cuagagaaguguauaaguc

SEQ ID NO: 1211236 - RNA, 19 nt, Homo sapiens
auacauagucccaaucuuu

SEQ ID NO: 1211237 - RNA, 19 nt, Homo sapiens
ggagagaaagcacaugaau

SEQ ID NO: 1211238 - RNA, 19 nt, Homo sapiens
uuacaaaugugaagcaucu

SEQ ID NO: 1211239 - RNA, 19 nt, Homo sapiens
gagcucagcccuuacuaga

SEQ ID NO: 1211240 - RNA, 19 nt, Homo sapiens
gagccaagauguacuauuc

SEQ ID NO: 1211241 - RNA, 19 nt, Homo sapiens
gguaagagauggcaagugu

SEQ ID NO: 1211242 - RNA, 19 nt, Homo sapiens
ggguuaagcuggauucauu

SEQ ID NO: 1211243 - RNA, 19 nt, Homo sapiens
gaaaagacaugcuggagaa

SEQ ID NO: 1211244 - RNA, 19 nt, Homo sapiens
gccguuagaucccuucaaa

SEQ ID NO: 1211245 - RNA, 19 nt, Homo sapiens
gagcccaucuuguccagaa

SEQ ID NO: 1211246 - RNA, 19 nt, Homo sapiens
cacaagugguacaguauuu

SEQ ID NO: 1211247 - RNA, 19 nt, Homo sapiens
gaaguuccuuacaauaucu

SEQ ID NO: 1211248 - RNA, 19 nt, Homo sapiens
gauguacuauucaacuaug

SEQ ID NO: 1211249 - RNA, 19 nt, Homo sapiens
ccaacccuaucuucaauga

SEQ ID NO: 1211250 - RNA, 19 nt, Homo sapiens
uuacuagccuucagcuuga

SEQ ID NO: 1211251 - RNA, 19 nt, Homo sapiens
uaagagauggcaaguguga

SEQ ID NO: 1211252 - RNA, 19 nt, Homo sapiens
ucaacuauguguuucuguu

SEQ ID NO: 1211253 - RNA, 19 nt, Homo sapiens
gccaagauguacuauucaa

SEQ ID NO: 1211254 - RNA, 19 nt, Homo sapiens
acucuuaguugcugauaaa

SEQ ID NO: 1211255 - RNA, 19 nt, Homo sapiens
cgaaugcucuuuguaugug

SEQ ID NO: 1211256 - RNA, 19 nt, Homo sapiens
caacuauguguuucuguuu

SEQ ID NO: 1211257 - RNA, 19 nt, Homo sapiens
ccaagugccauaaguguau

SEQ ID NO: 1211258 - RNA, 19 nt, Homo sapiens
caacuuggagccacuuaau

SEQ ID NO: 1211259 - RNA, 19 nt, Homo sapiens
ucuguggucugucuguuaa

SEQ ID NO: 1211260 - RNA, 19 nt, Homo sapiens
guagggagcccaucuuguc

SEQ ID NO: 1211261 - RNA, 19 nt, Homo sapiens
gaaagaggcugguuuugcu

SEQ ID NO: 1211262 - RNA, 19 nt, Homo sapiens
gaaggaaaauggacacucu

SEQ ID NO: 1211263 - RNA, 19 nt, Homo sapiens
aagacaugcuggagaagaa

SEQ ID NO: 1211264 - RNA, 19 nt, Homo sapiens
cuuaguugcugauaaagug

SEQ ID NO: 1211265 - RNA, 19 nt, Homo sapiens
gcagggugaagaaagguuu

SEQ ID NO: 1211266 - RNA, 19 nt, Homo sapiens
gcuuuggaucuuuguaaua

SEQ ID NO: 1211267 - RNA, 19 nt, Homo sapiens
gaaccauggugcuuuuguu

SEQ ID NO: 1211268 - RNA, 19 nt, Homo sapiens
aaaugcaggaucuuuguaa

SEQ ID NO: 1211269 - RNA, 19 nt, Homo sapiens
gcaacuuggagccacuuaa

SEQ ID NO: 1211270 - RNA, 19 nt, Homo sapiens
ggugaagaaagguuuaaau

SEQ ID NO: 1211271 - RNA, 19 nt, Homo sapiens
caggaaauauuuugggaaa

SEQ ID NO: 1211272 - RNA, 19 nt, Homo sapiens
gucgaaugcucuuuguaug

SEQ ID NO: 1211273 - RNA, 19 nt, Homo sapiens
guaaguucuucccaagcuu

SEQ ID NO: 1211274 - RNA, 19 nt, Homo sapiens
cauaggagaauguuagaca

SEQ ID NO: 1211275 - RNA, 19 nt, Homo sapiens
gcaguuccaagugccauaa

SEQ ID NO: 1211276 - RNA, 19 nt, Homo sapiens
caagauguacuauucaacu

SEQ ID NO: 1211277 - RNA, 19 nt, Homo sapiens
ccauuugccuuccuguauc

SEQ ID NO: 1211278 - RNA, 19 nt, Homo sapiens
gacuuuguauugaguucuu

SEQ ID NO: 1211279 - RNA, 19 nt, Homo sapiens
gaccaaaccaugccaacca

SEQ ID NO: 1211280 - RNA, 19 nt, Homo sapiens
gaguagggagcccaucuug

SEQ ID NO: 1211281 - RNA, 19 nt, Homo sapiens
ccacuuaggaccaggaaag

SEQ ID NO: 1211282 - RNA, 19 nt, Homo sapiens
aaugcaggaucuuuguaaa

SEQ ID NO: 1211283 - RNA, 19 nt, Homo sapiens
gaaugcucuuuguaugugu

SEQ ID NO: 1211284 - RNA, 19 nt, Homo sapiens
acuuggagccacuuaauuu

SEQ ID NO: 1211285 - RNA, 19 nt, Homo sapiens
ucaaugaccaguccagaag

SEQ ID NO: 1211286 - RNA, 19 nt, Homo sapiens
acaauaucuuucucaggaa

SEQ ID NO: 1211287 - RNA, 19 nt, Homo sapiens
aaauuggcuuuggaucuuu

SEQ ID NO: 1211288 - RNA, 19 nt, Homo sapiens
ccagcagggugaagaaagg

SEQ ID NO: 1211289 - RNA, 19 nt, Homo sapiens
ggaaaugggguaagagaug

SEQ ID NO: 1211290 - RNA, 19 nt, Homo sapiens
ugucgaaugcucuuuguau

SEQ ID NO: 1211291 - RNA, 19 nt, Homo sapiens
caucgccucugccacuuag

SEQ ID NO: 1211292 - RNA, 19 nt, Homo sapiens
ggcuuuggaucuuuguaau

SEQ ID NO: 1211293 - RNA, 19 nt, Homo sapiens
uaagcuggauucauuugcu

SEQ ID NO: 1211294 - RNA, 19 nt, Homo sapiens
aaaauuggcuuuggaucuu

SEQ ID NO: 1211295 - RNA, 19 nt, Homo sapiens
guacuauucaacuaugugu

SEQ ID NO: 1211296 - RNA, 19 nt, Homo sapiens
ggagccaagauguacuauu

SEQ ID NO: 1211297 - RNA, 19 nt, Homo sapiens
gguuaagcuggauucauuu

SEQ ID NO: 1211298 - RNA, 19 nt, Homo sapiens
agagauggcaagugugaga

SEQ ID NO: 1211299 - RNA, 19 nt, Homo sapiens
cguaaguucuucccaagcu

SEQ ID NO: 1211300 - RNA, 19 nt, Homo sapiens
guuaagcuggauucauuug

SEQ ID NO: 1211301 - RNA, 19 nt, Homo sapiens
agacuaacacugugacucu

SEQ ID NO: 1211302 - RNA, 19 nt, Homo sapiens
gagaguagggagcccaucu

SEQ ID NO: 1211303 - RNA, 19 nt, Homo sapiens
guucaucaccauucuaaaa

SEQ ID NO: 1211304 - RNA, 19 nt, Homo sapiens
guugcuacgucauggauac

SEQ ID NO: 1211305 - RNA, 19 nt, Homo sapiens
ugagacgggcugugucaga

SEQ ID NO: 1211306 - RNA, 19 nt, Homo sapiens
guggagccaagauguacua

SEQ ID NO: 1211307 - RNA, 19 nt, Homo sapiens
guuaauaaugacacuguuc

SEQ ID NO: 1211308 - RNA, 19 nt, Homo sapiens
ucgguaaucagccaucuug

SEQ ID NO: 1211309 - RNA, 19 nt, Homo sapiens
gaaaauggacacucuacag

SEQ ID NO: 1211310 - RNA, 19 nt, Homo sapiens
gcuguccagucccuguguu

SEQ ID NO: 1211311 - RNA, 19 nt, Homo sapiens
gugcuuuuguucuuaguuu

SEQ ID NO: 1211312 - RNA, 19 nt, Homo sapiens
aaagacaugcuggagaaga

SEQ ID NO: 1211313 - RNA, 19 nt, Homo sapiens
caucuguggucugucuguu

SEQ ID NO: 1211314 - RNA, 19 nt, Homo sapiens
cagggugaagaaagguuua

SEQ ID NO: 1211315 - RNA, 19 nt, Homo sapiens
uuccaacccuaucuucaau

SEQ ID NO: 1211316 - RNA, 19 nt, Homo sapiens
ugacacuguucaucaccau

SEQ ID NO: 1211317 - RNA, 19 nt, Homo sapiens
gcuacgucauggauacagu

SEQ ID NO: 1211318 - RNA, 19 nt, Homo sapiens
acacugugacucugggauu

SEQ ID NO: 1211319 - RNA, 19 nt, Homo sapiens
cuuuggaucuuuguaauac

SEQ ID NO: 1211320 - RNA, 19 nt, Homo sapiens
gauuggcaggugcaacuug

SEQ ID NO: 1211321 - RNA, 19 nt, Homo sapiens
cguuagaucccuucaaacu

SEQ ID NO: 1211322 - RNA, 19 nt, Homo sapiens
ggcguggagccaagaugua

SEQ ID NO: 1211323 - RNA, 19 nt, Homo sapiens
uggcuuuggaucuuuguaa

SEQ ID NO: 1211324 - RNA, 19 nt, Homo sapiens
ucgaaugcucuuuguaugu

SEQ ID NO: 1211325 - RNA, 19 nt, Homo sapiens
gggauuggcaggugcaacu

SEQ ID NO: 1211326 - RNA, 19 nt, Homo sapiens
ggacuuggcuuuauaugaa

SEQ ID NO: 1211327 - RNA, 19 nt, Homo sapiens
aaauagaccugauguguua

SEQ ID NO: 1211328 - RNA, 19 nt, Homo sapiens
gaguggagcugaucuguuu

SEQ ID NO: 1211329 - RNA, 19 nt, Homo sapiens
gaaaggaaauucugcaagu

SEQ ID NO: 1211330 - RNA, 19 nt, Homo sapiens
guuacgaccuggaagauua

SEQ ID NO: 1211331 - RNA, 19 nt, Homo sapiens
guuagauacugcuuuguua

SEQ ID NO: 1211332 - RNA, 19 nt, Homo sapiens
caacuacagugaaacaaga

SEQ ID NO: 1211333 - RNA, 19 nt, Homo sapiens
gaacuugccugucguuugc

SEQ ID NO: 1211334 - RNA, 19 nt, Homo sapiens
ggaaguaaaucaagucaac

SEQ ID NO: 1211335 - RNA, 19 nt, Homo sapiens
cacaggagcugcugagaaa

SEQ ID NO: 1211336 - RNA, 19 nt, Homo sapiens
uaaccgaagugucaugauu

SEQ ID NO: 1211337 - RNA, 19 nt, Homo sapiens
gaaauucugcaagugauua

SEQ ID NO: 1211338 - RNA, 19 nt, Homo sapiens
ugaauuagaugguguugga

SEQ ID NO: 1211339 - RNA, 19 nt, Homo sapiens
ugaaauagacuuccuugaa

SEQ ID NO: 1211340 - RNA, 19 nt, Homo sapiens
caacaggaguuucaagaag

SEQ ID NO: 1211341 - RNA, 19 nt, Homo sapiens
ggagauugguggccuugaa

SEQ ID NO: 1211342 - RNA, 19 nt, Homo sapiens
gagaagaggaaguaaauca

SEQ ID NO: 1211343 - RNA, 19 nt, Homo sapiens
gagagaagaggaaguaaau

SEQ ID NO: 1211344 - RNA, 19 nt, Homo sapiens
ucacugcucuuucguuuca

SEQ ID NO: 1211345 - RNA, 19 nt, Homo sapiens
gauaagcuaaggcucauuu

SEQ ID NO: 1211346 - RNA, 19 nt, Homo sapiens
uaacguggaagguauuuaa

SEQ ID NO: 1211347 - RNA, 19 nt, Homo sapiens
ggacuuaagacaauagaga

SEQ ID NO: 1211348 - RNA, 19 nt, Homo sapiens
ccugaugucuccuuagaaa

SEQ ID NO: 1211349 - RNA, 19 nt, Homo sapiens
cgaagugucaugauuauug

SEQ ID NO: 1211350 - RNA, 19 nt, Homo sapiens
gacaggaugugauguucaa

SEQ ID NO: 1211351 - RNA, 19 nt, Homo sapiens
caagagcacuuucuaaaau

SEQ ID NO: 1211352 - RNA, 19 nt, Homo sapiens
caaauagaccugauguguu

SEQ ID NO: 1211353 - RNA, 19 nt, Homo sapiens
gcacaggagcugcugagaa

SEQ ID NO: 1211354 - RNA, 19 nt, Homo sapiens
guuugcaacuucacacuuu

SEQ ID NO: 1211355 - RNA, 19 nt, Homo sapiens
agacgcaacuacagugaaa

SEQ ID NO: 1211356 - RNA, 19 nt, Homo sapiens
gaccugauguguuagauac

SEQ ID NO: 1211357 - RNA, 19 nt, Homo sapiens
agcuaaggcucauuuauuu

SEQ ID NO: 1211358 - RNA, 19 nt, Homo sapiens
aaacaagagcacuuucuaa

SEQ ID NO: 1211359 - RNA, 19 nt, Homo sapiens
guaaaaccgucguuaaguu

SEQ ID NO: 1211360 - RNA, 19 nt, Homo sapiens
ggccugaugucuccuuaga

SEQ ID NO: 1211361 - RNA, 19 nt, Homo sapiens
gggcaggcuuucuauuuua

SEQ ID NO: 1211362 - RNA, 19 nt, Homo sapiens
ccuggaagauuagauaaga

SEQ ID NO: 1211363 - RNA, 19 nt, Homo sapiens
caacaaauagaccugaugu

SEQ ID NO: 1211364 - RNA, 19 nt, Homo sapiens
gaagugucaugauuauugc

SEQ ID NO: 1211365 - RNA, 19 nt, Homo sapiens
uaaagcugcuacccuuaga

SEQ ID NO: 1211366 - RNA, 19 nt, Homo sapiens
gaagaggaaguaaaucaag

SEQ ID NO: 1211367 - RNA, 19 nt, Homo sapiens
gcaagcacuccagcaauuu

SEQ ID NO: 1211368 - RNA, 19 nt, Homo sapiens
ucagauauuucgacaagca

SEQ ID NO: 1211369 - RNA, 19 nt, Homo sapiens
aagcuaaggcucauuuauu

SEQ ID NO: 1211370 - RNA, 19 nt, Homo sapiens
cgaccuggaagauuagaua

SEQ ID NO: 1211371 - RNA, 19 nt, Homo sapiens
caagacaggaugugauguu

SEQ ID NO: 1211372 - RNA, 19 nt, Homo sapiens
ugucacugcucuuucguuu

SEQ ID NO: 1211373 - RNA, 19 nt, Homo sapiens
gaucacaagggcaggcuuu

SEQ ID NO: 1211374 - RNA, 19 nt, Homo sapiens
gagcugaucuuagaaaccu

SEQ ID NO: 1211375 - RNA, 19 nt, Homo sapiens
ucucagauauuucgacaag

SEQ ID NO: 1211376 - RNA, 19 nt, Homo sapiens
ugaguggccucugaaauuc

SEQ ID NO: 1211377 - RNA, 19 nt, Homo sapiens
gaaaugacaguuggcuaug

SEQ ID NO: 1211378 - RNA, 19 nt, Homo sapiens
guucaguucacauuaauug

SEQ ID NO: 1211379 - RNA, 19 nt, Homo sapiens
aaaguguugucucagauau

SEQ ID NO: 1211380 - RNA, 19 nt, Homo sapiens
ggaaauucugcaagugauu

SEQ ID NO: 1211381 - RNA, 19 nt, Homo sapiens
aacaagagcacuuucuaaa

SEQ ID NO: 1211382 - RNA, 19 nt, Homo sapiens
aguguugucucagauauuu

SEQ ID NO: 1211383 - RNA, 19 nt, Homo sapiens
cuuguucaguucacauuaa

SEQ ID NO: 1211384 - RNA, 19 nt, Homo sapiens
gacuuggcuuuauaugaaa

SEQ ID NO: 1211385 - RNA, 19 nt, Homo sapiens
acaaauagaccugaugugu

SEQ ID NO: 1211386 - RNA, 19 nt, Homo sapiens
caagucaacaggaguuuca

SEQ ID NO: 1211387 - RNA, 19 nt, Homo sapiens
agcaagcacuccagcaauu

SEQ ID NO: 1211388 - RNA, 19 nt, Homo sapiens
gagaagaaccaggacaauc

SEQ ID NO: 1211389 - RNA, 19 nt, Homo sapiens
uuucuguucuccugaauga

SEQ ID NO: 1211390 - RNA, 19 nt, Homo sapiens
uguguuagauacugcuuug

SEQ ID NO: 1211391 - RNA, 19 nt, Homo sapiens
acaggaguuucaagaaguu

SEQ ID NO: 1211392 - RNA, 19 nt, Homo sapiens
uagaugguguuggacuuaa

SEQ ID NO: 1211393 - RNA, 19 nt, Homo sapiens
aaugacaguuggcuauguu

SEQ ID NO: 1211394 - RNA, 19 nt, Homo sapiens
gcguagacccgggagauuu

SEQ ID NO: 1211395 - RNA, 19 nt, Homo sapiens
gcaacuacagugaaacaag

SEQ ID NO: 1211396 - RNA, 19 nt, Homo sapiens
gcaagaaaauggacuagac

SEQ ID NO: 1211397 - RNA, 19 nt, Homo sapiens
aagggcaggcuuucuauuu

SEQ ID NO: 1211398 - RNA, 19 nt, Homo sapiens
gcaacaaauagaccugaug

SEQ ID NO: 1211399 - RNA, 19 nt, Homo sapiens
guguuggacuuaagacaau

SEQ ID NO: 1211400 - RNA, 19 nt, Homo sapiens
cgagauggacgccuugugu

SEQ ID NO: 1211401 - RNA, 19 nt, Homo sapiens
gagcaagcacuccagcaau

SEQ ID NO: 1211402 - RNA, 19 nt, Homo sapiens
ucgaagcgucauuggauua

SEQ ID NO: 1211403 - RNA, 19 nt, Homo sapiens
agaaaugacaguuggcuau

SEQ ID NO: 1211404 - RNA, 19 nt, Homo sapiens
aaaggaaauucugcaagug

SEQ ID NO: 1211405 - RNA, 19 nt, Homo sapiens
cacaagggcaggcuuucua

SEQ ID NO: 1211406 - RNA, 19 nt, Homo sapiens
aaccgaagugucaugauua

SEQ ID NO: 1211407 - RNA, 19 nt, Homo sapiens
gaaugaauuagaugguguu

SEQ ID NO: 1211408 - RNA, 19 nt, Homo sapiens
uugaguggccucugaaauu

SEQ ID NO: 1211409 - RNA, 19 nt, Homo sapiens
gaagcgucauuggauuaau

SEQ ID NO: 1211410 - RNA, 19 nt, Homo sapiens
ggacuagacgcaacuacag

SEQ ID NO: 1211411 - RNA, 19 nt, Homo sapiens
aggaugugauguucaagaa

SEQ ID NO: 1211412 - RNA, 19 nt, Homo sapiens
gaccuggaagauuagauaa

SEQ ID NO: 1211413 - RNA, 19 nt, Homo sapiens
ucaacaggaguuucaagaa

SEQ ID NO: 1211414 - RNA, 19 nt, Homo sapiens
uaagcuaaggcucauuuau

SEQ ID NO: 1211415 - RNA, 19 nt, Homo sapiens
caacuucacacuuuuagaa

SEQ ID NO: 1211416 - RNA, 19 nt, Homo sapiens
uuucuaacguggaagguau

SEQ ID NO: 1211417 - RNA, 19 nt, Homo sapiens
caagugauuaccucgaaga

SEQ ID NO: 1211418 - RNA, 19 nt, Homo sapiens
aagaggaaguaaaucaagu

SEQ ID NO: 1211419 - RNA, 19 nt, Homo sapiens
auagagagaagaggaagua

SEQ ID NO: 1211420 - RNA, 19 nt, Homo sapiens
gguguuggacuuaagacaa

SEQ ID NO: 1211421 - RNA, 19 nt, Homo sapiens
agagagaagaggaaguaaa

SEQ ID NO: 1211422 - RNA, 19 nt, Homo sapiens
cgaagcgucauuggauuaa

SEQ ID NO: 1211423 - RNA, 19 nt, Homo sapiens
augcaugcccuccuucaua

SEQ ID NO: 1211424 - RNA, 19 nt, Homo sapiens
ugcaagugauuaccucgaa

SEQ ID NO: 1211425 - RNA, 19 nt, Homo sapiens
ggaagauuagauaagauca

SEQ ID NO: 1211426 - RNA, 19 nt, Homo sapiens
gaaguuuccugaugucaaa

SEQ ID NO: 1211427 - RNA, 19 nt, Homo sapiens
gcaacuaaacugaagaaua

SEQ ID NO: 1211428 - RNA, 19 nt, Homo sapiens
caacugaacuggaaacaag

SEQ ID NO: 1211429 - RNA, 19 nt, Homo sapiens
caaccugcauacccaauua

SEQ ID NO: 1211430 - RNA, 19 nt, Homo sapiens
gaaagcaacuaaacugaag

SEQ ID NO: 1211431 - RNA, 19 nt, Homo sapiens
gagaugaguuggaauggaa

SEQ ID NO: 1211432 - RNA, 19 nt, Homo sapiens
gcaugaaccugacaagaga

SEQ ID NO: 1211433 - RNA, 19 nt, Homo sapiens
gaaggauuauguucaagaa

SEQ ID NO: 1211434 - RNA, 19 nt, Homo sapiens
gacaagagaugaguuggaa

SEQ ID NO: 1211435 - RNA, 19 nt, Homo sapiens
uaucaaggcucaguuuauu

SEQ ID NO: 1211436 - RNA, 19 nt, Homo sapiens
uggaagagcuggaggauca

SEQ ID NO: 1211437 - RNA, 19 nt, Homo sapiens
caaggaaagucugaaagaa

SEQ ID NO: 1211438 - RNA, 19 nt, Homo sapiens
gaaugaauccuugugguuu

SEQ ID NO: 1211439 - RNA, 19 nt, Homo sapiens
cuaagaagccgauugaaga

SEQ ID NO: 1211440 - RNA, 19 nt, Homo sapiens
ggaaagcaacuaaacugaa

SEQ ID NO: 1211441 - RNA, 19 nt, Homo sapiens
gauauuuguuuaccuggaa

SEQ ID NO: 1211442 - RNA, 19 nt, Homo sapiens
aggaaagucugaaagaauu

SEQ ID NO: 1211443 - RNA, 19 nt, Homo sapiens
gauaucaaggcucaguuua

SEQ ID NO: 1211444 - RNA, 19 nt, Homo sapiens
ggauuauguucaagaaguu

SEQ ID NO: 1211445 - RNA, 19 nt, Homo sapiens
ugacagaccuggaggaaaa

SEQ ID NO: 1211446 - RNA, 19 nt, Homo sapiens
ggaaucugcccacgauauu

SEQ ID NO: 1211447 - RNA, 19 nt, Homo sapiens
gagacuggcugaguggaaa

SEQ ID NO: 1211448 - RNA, 19 nt, Homo sapiens
gaauggaaacugucugaau

SEQ ID NO: 1211449 - RNA, 19 nt, Homo sapiens
gaaucuggagcaauuauga

SEQ ID NO: 1211450 - RNA, 19 nt, Homo sapiens
ggaaggauuauguucaaga

SEQ ID NO: 1211451 - RNA, 19 nt, Homo sapiens
ucaguggacuugccaggaa

SEQ ID NO: 1211452 - RNA, 19 nt, Homo sapiens
caagagaugaguuggaaug

SEQ ID NO: 1211453 - RNA, 19 nt, Homo sapiens
uaucaaagccauuucaaca

SEQ ID NO: 1211454 - RNA, 19 nt, Homo sapiens
ccaaggaaagucugaaaga

SEQ ID NO: 1211455 - RNA, 19 nt, Homo sapiens
ucaaagccauuucaacaac

SEQ ID NO: 1211456 - RNA, 19 nt, Homo sapiens
ggcuacagcuucuaucaca

SEQ ID NO: 1211457 - RNA, 19 nt, Homo sapiens
aauggaaacugucugaauc

SEQ ID NO: 1211458 - RNA, 19 nt, Homo sapiens
gucugaaucuggagcaauu

SEQ ID NO: 1211459 - RNA, 19 nt, Homo sapiens
gcacagcugguuugagcaa

SEQ ID NO: 1211460 - RNA, 19 nt, Homo sapiens
cuggagauucuguuaaaua

SEQ ID NO: 1211461 - RNA, 19 nt, Homo sapiens
gaaucugcccacgauauuu

SEQ ID NO: 1211462 - RNA, 19 nt, Homo sapiens
ugggucaucuugcaccuuu

SEQ ID NO: 1211463 - RNA, 19 nt, Homo sapiens
gaucaugaagacgaguuua

SEQ ID NO: 1211464 - RNA, 19 nt, Homo sapiens
gaaugacaucuuacgcaaa

SEQ ID NO: 1211465 - RNA, 19 nt, Homo sapiens
caucuugcaccuuuacaaa

SEQ ID NO: 1211466 - RNA, 19 nt, Homo sapiens
ggaaagucugaaagaauug

SEQ ID NO: 1211467 - RNA, 19 nt, Homo sapiens
gaacuggaaacaagaugca

SEQ ID NO: 1211468 - RNA, 19 nt, Homo sapiens
ggaagaggaggcagaagag

SEQ ID NO: 1211469 - RNA, 19 nt, Homo sapiens
augccgaacuuucuuguga

SEQ ID NO: 1211470 - RNA, 19 nt, Homo sapiens
ucaagaaguuaccaaagcu

SEQ ID NO: 1211471 - RNA, 19 nt, Homo sapiens
uugagcaacugaacuggaa

SEQ ID NO: 1211472 - RNA, 19 nt, Homo sapiens
auaggaaucugcccacgau

SEQ ID NO: 1211473 - RNA, 19 nt, Homo sapiens
ugcuggagauucuguuaaa

SEQ ID NO: 1211474 - RNA, 19 nt, Homo sapiens
aggauuauguucaagaagu

SEQ ID NO: 1211475 - RNA, 19 nt, Homo sapiens
gcuggaggaucaugaagac

SEQ ID NO: 1211476 - RNA, 19 nt, Homo sapiens
ucuaucacaugccgaacuu

SEQ ID NO: 1211477 - RNA, 19 nt, Homo sapiens
ugcccacgauauuuguuua

SEQ ID NO: 1211478 - RNA, 19 nt, Homo sapiens
agggaaggauuauguucaa

SEQ ID NO: 1211479 - RNA, 19 nt, Homo sapiens
ggcaugaaccugacaagag

SEQ ID NO: 1211480 - RNA, 19 nt, Homo sapiens
caugaagacgaguuuaaug

SEQ ID NO: 1211481 - RNA, 19 nt, Homo sapiens
aauaaucauugcuggagau

SEQ ID NO: 1211482 - RNA, 19 nt, Homo sapiens
agaaugaauccuugugguu

SEQ ID NO: 1211483 - RNA, 19 nt, Homo sapiens
gaggcuacagcuucuauca

SEQ ID NO: 1211484 - RNA, 19 nt, Homo sapiens
cuggagcaauuaugacaga

SEQ ID NO: 1211485 - RNA, 19 nt, Homo sapiens
gcaacugaacuggaaacaa

SEQ ID NO: 1211486 - RNA, 19 nt, Homo sapiens
gcuggagauucuguuaaau

SEQ ID NO: 1211487 - RNA, 19 nt, Homo sapiens
aaugacaucuuacgcaaaa

SEQ ID NO: 1211488 - RNA, 19 nt, Homo sapiens
ggagauaucaaggcucagu

SEQ ID NO: 1211489 - RNA, 19 nt, Homo sapiens
guggaaagcaacuaaacug

SEQ ID NO: 1211490 - RNA, 19 nt, Homo sapiens
gagggugacugaggcuaca

SEQ ID NO: 1211491 - RNA, 19 nt, Homo sapiens
aaggaaagucugaaagaau

SEQ ID NO: 1211492 - RNA, 19 nt, Homo sapiens
guuuccugaugucaaauuu

SEQ ID NO: 1211493 - RNA, 19 nt, Homo sapiens
cuacagcuucuaucacaug

SEQ ID NO: 1211494 - RNA, 19 nt, Homo sapiens
ucuugcaccuuuacaaaca

SEQ ID NO: 1211495 - RNA, 19 nt, Homo sapiens
uggaagaggaggcagaaga

SEQ ID NO: 1211496 - RNA, 19 nt, Homo sapiens
ggaucaugaagacgaguuu

SEQ ID NO: 1211497 - RNA, 19 nt, Homo sapiens
gaagagggacagcgauucc

SEQ ID NO: 1211498 - RNA, 19 nt, Homo sapiens
ccuaagaagccgauugaag

SEQ ID NO: 1211499 - RNA, 19 nt, Homo sapiens
gggcuugugggucaucuug

SEQ ID NO: 1211500 - RNA, 19 nt, Homo sapiens
ggagaucucagggaaggau

SEQ ID NO: 1211501 - RNA, 19 nt, Homo sapiens
augaagacgaguuuaauga

SEQ ID NO: 1211502 - RNA, 19 nt, Homo sapiens
aaagcaagaaugaauccuu

SEQ ID NO: 1211503 - RNA, 19 nt, Homo sapiens
gccgaacuuucuugugaca

SEQ ID NO: 1211504 - RNA, 19 nt, Homo sapiens
ucacaugccgaacuuucuu

SEQ ID NO: 1211505 - RNA, 19 nt, Homo sapiens
ggaauggaaacugucugaa

SEQ ID NO: 1211506 - RNA, 19 nt, Homo sapiens
agagaugaguuggaaugga

SEQ ID NO: 1211507 - RNA, 19 nt, Homo sapiens
ugacaagagaugaguugga

SEQ ID NO: 1211508 - RNA, 19 nt, Homo sapiens
gcuugugggucaucuugca

SEQ ID NO: 1211509 - RNA, 19 nt, Homo sapiens
ucucagggaaggauuaugu

SEQ ID NO: 1211510 - RNA, 19 nt, Homo sapiens
gaaccugacaagagaugag

SEQ ID NO: 1211511 - RNA, 19 nt, Homo sapiens
ucaaggcucaguuuauugg

SEQ ID NO: 1211512 - RNA, 19 nt, Homo sapiens
agauaucaaggcucaguuu

SEQ ID NO: 1211513 - RNA, 19 nt, Homo sapiens
gaagagcuggaggaucaug

SEQ ID NO: 1211514 - RNA, 19 nt, Homo sapiens
aaucugcccacgauauuug

SEQ ID NO: 1211515 - RNA, 19 nt, Homo sapiens
uggaaagcaacuaaacuga

SEQ ID NO: 1211516 - RNA, 19 nt, Homo sapiens
uaucacaugccgaacuuuc

SEQ ID NO: 1211517 - RNA, 19 nt, Homo sapiens
gagauaucaaggcucaguu

SEQ ID NO: 1211518 - RNA, 19 nt, Homo sapiens
cagggaaggauuauguuca

SEQ ID NO: 1211519 - RNA, 19 nt, Homo sapiens
gaucucagggaaggauuau

SEQ ID NO: 1211520 - RNA, 19 nt, Homo sapiens
gaaagucugaaagaauugg

SEQ ID NO: 1211521 - RNA, 19 nt, Homo sapiens
agucaguggugaaaacaua

SEQ ID NO: 1211522 - RNA, 19 nt, Homo sapiens
uauugguccucugguguuu

SEQ ID NO: 1211523 - RNA, 19 nt, Homo sapiens
gacugaggcuacagcuucu

SEQ ID NO: 1211524 - RNA, 19 nt, Homo sapiens
ucaugaagacgaguuuaau

SEQ ID NO: 1211525 - RNA, 19 nt, Homo sapiens
ggugaaaacauaugaagau

SEQ ID NO: 1211526 - RNA, 19 nt, Homo sapiens
gcaacaaggucacaaagga

SEQ ID NO: 1211527 - RNA, 19 nt, Homo sapiens
ggacuugcuugaaaugauu

SEQ ID NO: 1211528 - RNA, 19 nt, Homo sapiens
gagaugaccugagaaccuu

SEQ ID NO: 1211529 - RNA, 19 nt, Homo sapiens
uagaggagaucaacagguu

SEQ ID NO: 1211530 - RNA, 19 nt, Homo sapiens
gacccaagguugauucuca

SEQ ID NO: 1211531 - RNA, 19 nt, Homo sapiens
ccuauggacuugcuugaaa

SEQ ID NO: 1211532 - RNA, 19 nt, Homo sapiens
ccaaggagguguuguacca

SEQ ID NO: 1211533 - RNA, 19 nt, Homo sapiens
cacgagagaugaccugaga

SEQ ID NO: 1211534 - RNA, 19 nt, Homo sapiens
ggacgcccgugguuuacug

SEQ ID NO: 1211535 - RNA, 19 nt, Homo sapiens
ggaugagcuuguugggaaa

SEQ ID NO: 1211536 - RNA, 19 nt, Homo sapiens
guagugaccacaagcuuau

SEQ ID NO: 1211537 - RNA, 19 nt, Homo sapiens
cagggaggcugucaggaau

SEQ ID NO: 1211538 - RNA, 19 nt, Homo sapiens
ggcgugaccuuucccuuca

SEQ ID NO: 1211539 - RNA, 19 nt, Homo sapiens
gguuuacugugugagguua

SEQ ID NO: 1211540 - RNA, 19 nt, Homo sapiens
gagacucccaccucuugua

SEQ ID NO: 1211541 - RNA, 19 nt, Homo sapiens
gaugacuacugcuguuugg

SEQ ID NO: 1211542 - RNA, 19 nt, Homo sapiens
gggaggcugucaggaauuc

SEQ ID NO: 1211543 - RNA, 19 nt, Homo sapiens
gagauucugcugccaguuc

SEQ ID NO: 1211544 - RNA, 19 nt, Homo sapiens
cguagugaccacaagcuua

SEQ ID NO: 1211545 - RNA, 19 nt, Homo sapiens
ccgugugucuggccucuuu

SEQ ID NO: 1211546 - RNA, 19 nt, Homo sapiens
gcuccaggcugccccauaa

SEQ ID NO: 1211547 - RNA, 19 nt, Homo sapiens
ugaccgagaagaaucugua

SEQ ID NO: 1211548 - RNA, 19 nt, Homo sapiens
ucagggaggcugucaggaa

SEQ ID NO: 1211549 - RNA, 19 nt, Homo sapiens
gugccgggauccauucaga

SEQ ID NO: 1211550 - RNA, 19 nt, Homo sapiens
uguaccaccuggacaucua

SEQ ID NO: 1211551 - RNA, 19 nt, Homo sapiens
gccaauaggauucuuagag

SEQ ID NO: 1211552 - RNA, 19 nt, Homo sapiens
gcaaaccaaggacucuguu

SEQ ID NO: 1211553 - RNA, 19 nt, Homo sapiens
cuugaaaucaugugcaauu

SEQ ID NO: 1211554 - RNA, 19 nt, Homo sapiens
gcgcagcccaagagacuga

SEQ ID NO: 1211555 - RNA, 19 nt, Homo sapiens
ccacauggucccgcuggua

SEQ ID NO: 1211556 - RNA, 19 nt, Homo sapiens
gcaccugaccgagaagaau

SEQ ID NO: 1211557 - RNA, 19 nt, Homo sapiens
gugucuaaauuuccuuuca

SEQ ID NO: 1211558 - RNA, 19 nt, Homo sapiens
ccaauggccaugucagcaa

SEQ ID NO: 1211559 - RNA, 19 nt, Homo sapiens
cuauggacuugcuugaaau

SEQ ID NO: 1211560 - RNA, 19 nt, Homo sapiens
caguucaucaccuccguua

SEQ ID NO: 1211561 - RNA, 19 nt, Homo sapiens
ucaggagcuucaacuucuu

SEQ ID NO: 1211562 - RNA, 19 nt, Homo sapiens
ccgagaagaaucuguaugg

SEQ ID NO: 1211563 - RNA, 19 nt, Homo sapiens
cggccaaucugccaauagg

SEQ ID NO: 1211564 - RNA, 19 nt, Homo sapiens
ggugcaagcccgugugucu

SEQ ID NO: 1211565 - RNA, 19 nt, Homo sapiens
ggucgcauucuuugacaug

SEQ ID NO: 1211566 - RNA, 19 nt, Homo sapiens
gccgaugacagccggauga

SEQ ID NO: 1211567 - RNA, 19 nt, Homo sapiens
caacuucuugaaaucaugu

SEQ ID NO: 1211568 - RNA, 19 nt, Homo sapiens
ccacccggucgcauucuuu

SEQ ID NO: 1211569 - RNA, 19 nt, Homo sapiens
uggccggacucccagaaga

SEQ ID NO: 1211570 - RNA, 19 nt, Homo sapiens
uucaggagcuucaacuucu

SEQ ID NO: 1211571 - RNA, 19 nt, Homo sapiens
uggacuugcuugaaaugau

SEQ ID NO: 1211572 - RNA, 19 nt, Homo sapiens
uggagcugcuggaggaguu

SEQ ID NO: 1211573 - RNA, 19 nt, Homo sapiens
ccaccuggacaucuacuuc

SEQ ID NO: 1211574 - RNA, 19 nt, Homo sapiens
ucagcaacaaggucacaaa

SEQ ID NO: 1211575 - RNA, 19 nt, Homo sapiens
ugaaggcaccccuggcuua

SEQ ID NO: 1211576 - RNA, 19 nt, Homo sapiens
ccgccaaggagguguugua

SEQ ID NO: 1211577 - RNA, 19 nt, Homo sapiens
ugaccucauuccaccuaug

SEQ ID NO: 1211578 - RNA, 19 nt, Homo sapiens
gagccugcugcgugcauuu

SEQ ID NO: 1211579 - RNA, 19 nt, Homo sapiens
gccaaucugccaauaggau

SEQ ID NO: 1211580 - RNA, 19 nt, Homo sapiens
gaauucccuucaggagcuu

SEQ ID NO: 1211581 - RNA, 19 nt, Homo sapiens
gcuggaggaguucguguuc

SEQ ID NO: 1211582 - RNA, 19 nt, Homo sapiens
aggcaccccuggcuuauaa

SEQ ID NO: 1211583 - RNA, 19 nt, Homo sapiens
ccucuguucucugcgcauu

SEQ ID NO: 1211584 - RNA, 19 nt, Homo sapiens
gauccucuucgaccacaug

SEQ ID NO: 1211585 - RNA, 19 nt, Homo sapiens
gaccgagaagaaucuguau

SEQ ID NO: 1211586 - RNA, 19 nt, Homo sapiens
gaggacccaagguugauuc

SEQ ID NO: 1211587 - RNA, 19 nt, Homo sapiens
caagauagccuuccacuga

SEQ ID NO: 1211588 - RNA, 19 nt, Homo sapiens
ggagaauucuguaugguuu

SEQ ID NO: 1211589 - RNA, 19 nt, Homo sapiens
ucaagaaucugaaccuuau

SEQ ID NO: 1211590 - RNA, 19 nt, Homo sapiens
gcagaagauuggagaauuc

SEQ ID NO: 1211591 - RNA, 19 nt, Homo sapiens
gagcgaaacuccaucucaa

SEQ ID NO: 1211592 - RNA, 19 nt, Homo sapiens
gagccgaaauugcaccauu

SEQ ID NO: 1211593 - RNA, 19 nt, Homo sapiens
ggcaaaggauccaagcauu

SEQ ID NO: 1211594 - RNA, 19 nt, Homo sapiens
gagauagcaugacauucuu

SEQ ID NO: 1211595 - RNA, 19 nt, Homo sapiens
caagagauagcaugacauu

SEQ ID NO: 1211596 - RNA, 19 nt, Homo sapiens
gcaaaggauccaagcauug

SEQ ID NO: 1211597 - RNA, 19 nt, Homo sapiens
ccagcaacccuguuaguaa

SEQ ID NO: 1211598 - RNA, 19 nt, Homo sapiens
uauccacccuaaucucaua

SEQ ID NO: 1211599 - RNA, 19 nt, Homo sapiens
caaaggauccaagcauuga

SEQ ID NO: 1211600 - RNA, 19 nt, Homo sapiens
gaaugggaauggacugagu

SEQ ID NO: 1211601 - RNA, 19 nt, Homo sapiens
gaagauuggagaauucugu

SEQ ID NO: 1211602 - RNA, 19 nt, Homo sapiens
ggaggagcagcaagagaua

SEQ ID NO: 1211603 - RNA, 19 nt, Homo sapiens
gaaccagaaugggaaugga

SEQ ID NO: 1211604 - RNA, 19 nt, Homo sapiens
gagaauucuguaugguuua

SEQ ID NO: 1211605 - RNA, 19 nt, Homo sapiens
aaacaggcagcaucaauau

SEQ ID NO: 1211606 - RNA, 19 nt, Homo sapiens
cgacggagaccuuugugaa

SEQ ID NO: 1211607 - RNA, 19 nt, Homo sapiens
gaggugagccgaaauugca

SEQ ID NO: 1211608 - RNA, 19 nt, Homo sapiens
gagccuucauccucuauuc

SEQ ID NO: 1211609 - RNA, 19 nt, Homo sapiens
caaaggguacgcuucaguu

SEQ ID NO: 1211610 - RNA, 19 nt, Homo sapiens
ccugcucucuuuccucuuu

SEQ ID NO: 1211611 - RNA, 19 nt, Homo sapiens
gaaaccccgugucuacuaa

SEQ ID NO: 1211612 - RNA, 19 nt, Homo sapiens
gcagcaagagauagcauga

SEQ ID NO: 1211613 - RNA, 19 nt, Homo sapiens
gcucaagaaucugaaccuu

SEQ ID NO: 1211614 - RNA, 19 nt, Homo sapiens
ggugagcaguguccuuauc

SEQ ID NO: 1211615 - RNA, 19 nt, Homo sapiens
ggacgauguuggcaaucug

SEQ ID NO: 1211616 - RNA, 19 nt, Homo sapiens
ccaacaaggcggugcagaa

SEQ ID NO: 1211617 - RNA, 19 nt, Homo sapiens
ccaaccacaucccaagugu

SEQ ID NO: 1211618 - RNA, 19 nt, Homo sapiens
acaaggcggugcagaacga

SEQ ID NO: 1211619 - RNA, 19 nt, Homo sapiens
gaacgacagcaacccuuca

SEQ ID NO: 1211620 - RNA, 19 nt, Homo sapiens
agagauagcaugacauucu

SEQ ID NO: 1211621 - RNA, 19 nt, Homo sapiens
auucugagguuccuaacuu

SEQ ID NO: 1211622 - RNA, 19 nt, Homo sapiens
ugcagaagauuggagaauu

SEQ ID NO: 1211623 - RNA, 19 nt, Homo sapiens
gaaucugaaccuuaucuuc

SEQ ID NO: 1211624 - RNA, 19 nt, Homo sapiens
guggugagcaguguccuua

SEQ ID NO: 1211625 - RNA, 19 nt, Homo sapiens
ucuguaugguuuauucuga

SEQ ID NO: 1211626 - RNA, 19 nt, Homo sapiens
cugauuggcugguguagca

SEQ ID NO: 1211627 - RNA, 19 nt, Homo sapiens
ggaggguggugagcagugu

SEQ ID NO: 1211628 - RNA, 19 nt, Homo sapiens
ccacccagcacccgaauca

SEQ ID NO: 1211629 - RNA, 19 nt, Homo sapiens
agauagccuuccacugauu

SEQ ID NO: 1211630 - RNA, 19 nt, Homo sapiens
gacagcaacccuucagcuu

SEQ ID NO: 1211631 - RNA, 19 nt, Homo sapiens
gauuggagaauucuguaug

SEQ ID NO: 1211632 - RNA, 19 nt, Homo sapiens
agacaaaggacgggcauga

SEQ ID NO: 1211633 - RNA, 19 nt, Homo sapiens
gauagcaugacauucuuuc

SEQ ID NO: 1211634 - RNA, 19 nt, Homo sapiens
gggcaaaggauccaagcau

SEQ ID NO: 1211635 - RNA, 19 nt, Homo sapiens
cucaagaaucugaaccuua

SEQ ID NO: 1211636 - RNA, 19 nt, Homo sapiens
ccacugauuggcuggugua

SEQ ID NO: 1211637 - RNA, 19 nt, Homo sapiens
agcaugacauucuuucuuc

SEQ ID NO: 1211638 - RNA, 19 nt, Homo sapiens
uagcaugacauucuuucuu

SEQ ID NO: 1211639 - RNA, 19 nt, Homo sapiens
aaaggguacgcuucaguuu

SEQ ID NO: 1211640 - RNA, 19 nt, Homo sapiens
agaccagccugaccaacau

SEQ ID NO: 1211641 - RNA, 19 nt, Homo sapiens
gauagccuuccacugauug

SEQ ID NO: 1211642 - RNA, 19 nt, Homo sapiens
aagauagccuuccacugau

SEQ ID NO: 1211643 - RNA, 19 nt, Homo sapiens
gcaugacgacggagaccuu

SEQ ID NO: 1211644 - RNA, 19 nt, Homo sapiens
gggacgauguuggcaaucu

SEQ ID NO: 1211645 - RNA, 19 nt, Homo sapiens
cgcaguggcucacgcuugu

SEQ ID NO: 1211646 - RNA, 19 nt, Homo sapiens
uaacuucagugagccaaac

SEQ ID NO: 1211647 - RNA, 19 nt, Homo sapiens
gaaccuuaucuucauugug

SEQ ID NO: 1211648 - RNA, 19 nt, Homo sapiens
caacaaggcggugcagaac

SEQ ID NO: 1211649 - RNA, 19 nt, Homo sapiens
uaugguuuauucugagguu

SEQ ID NO: 1211650 - RNA, 19 nt, Homo sapiens
ggagaaaccccgugucuac

SEQ ID NO: 1211651 - RNA, 19 nt, Homo sapiens
agcaagagauagcaugaca

SEQ ID NO: 1211652 - RNA, 19 nt, Homo sapiens
guugaggugagccgaaauu

SEQ ID NO: 1211653 - RNA, 19 nt, Homo sapiens
aaucucauacucccucauu

SEQ ID NO: 1211654 - RNA, 19 nt, Homo sapiens
aaaacaggcagcaucaaua

SEQ ID NO: 1211655 - RNA, 19 nt, Homo sapiens
caaaguggcggacaaaaca

SEQ ID NO: 1211656 - RNA, 19 nt, Homo sapiens
gccgagugaccaagacaaa

SEQ ID NO: 1211657 - RNA, 19 nt, Homo sapiens
caccaaaggguacgcuuca

SEQ ID NO: 1211658 - RNA, 19 nt, Homo sapiens
cggaggagcagcaagagau

SEQ ID NO: 1211659 - RNA, 19 nt, Homo sapiens
acaggcagcaucaauaucu

SEQ ID NO: 1211660 - RNA, 19 nt, Homo sapiens
gcgaaacuccaucucaaaa

SEQ ID NO: 1211661 - RNA, 19 nt, Homo sapiens
aauaagagcgaaacuccau

SEQ ID NO: 1211662 - RNA, 19 nt, Homo sapiens
agccgaaauugcaccauug

SEQ ID NO: 1211663 - RNA, 19 nt, Homo sapiens
ugaccaacauggagaaacc

SEQ ID NO: 1211664 - RNA, 19 nt, Homo sapiens
cuuguaaucccagcacuuu

SEQ ID NO: 1211665 - RNA, 19 nt, Homo sapiens
guccuuauccacccuaauc

SEQ ID NO: 1211666 - RNA, 19 nt, Homo sapiens
ugagguuccuaacuucagu

SEQ ID NO: 1211667 - RNA, 19 nt, Homo sapiens
ccaaaggguacgcuucagu

SEQ ID NO: 1211668 - RNA, 19 nt, Homo sapiens
gacgauguuggcaaucuga

SEQ ID NO: 1211669 - RNA, 19 nt, Homo sapiens
ugacgacggagaccuuugu

SEQ ID NO: 1211670 - RNA, 19 nt, Homo sapiens
caguggcucacgcuuguaa

SEQ ID NO: 1211671 - RNA, 19 nt, Homo sapiens
aaaggacgggcaugagguu

SEQ ID NO: 1211672 - RNA, 19 nt, Homo sapiens
gacggagaccuuugugaag

SEQ ID NO: 1211673 - RNA, 19 nt, Homo sapiens
gguggcguaugccuguaau

SEQ ID NO: 1211674 - RNA, 19 nt, Homo sapiens
caaaacaggcagcaucaau

SEQ ID NO: 1211675 - RNA, 19 nt, Homo sapiens
gagccaaacccagaguaca

SEQ ID NO: 1211676 - RNA, 19 nt, Homo sapiens
ucucauacucccucauugu

SEQ ID NO: 1211677 - RNA, 19 nt, Homo sapiens
uggcugguguagcaguauu

SEQ ID NO: 1211678 - RNA, 19 nt, Homo sapiens
gcaagagauagcaugacau

SEQ ID NO: 1211679 - RNA, 19 nt, Homo sapiens
ggaaagaguuuaauggaau

SEQ ID NO: 1211680 - RNA, 19 nt, Homo sapiens
gaacaucucuauucugcaa

SEQ ID NO: 1211681 - RNA, 19 nt, Homo sapiens
gaacacagaugaugucaac

SEQ ID NO: 1211682 - RNA, 19 nt, Homo sapiens
gaagaaugcuuagaagguu

SEQ ID NO: 1211683 - RNA, 19 nt, Homo sapiens
caaggagguuucugagaua

SEQ ID NO: 1211684 - RNA, 19 nt, Homo sapiens
ccagaggccuucagccaua

SEQ ID NO: 1211685 - RNA, 19 nt, Homo sapiens
gggaaagaguuuaauggaa

SEQ ID NO: 1211686 - RNA, 19 nt, Homo sapiens
ucaaggagguuucugagau

SEQ ID NO: 1211687 - RNA, 19 nt, Homo sapiens
caagcacggucuccucuga

SEQ ID NO: 1211688 - RNA, 19 nt, Homo sapiens
gaacaugcuggaccgcuuu

SEQ ID NO: 1211689 - RNA, 19 nt, Homo sapiens
ggagaugacgggcgaauag

SEQ ID NO: 1211690 - RNA, 19 nt, Homo sapiens
ugagauagguagaagucuu

SEQ ID NO: 1211691 - RNA, 19 nt, Homo sapiens
ggagccaccucgggaaaga

SEQ ID NO: 1211692 - RNA, 19 nt, Homo sapiens
ccucagaacaucucuauuc

SEQ ID NO: 1211693 - RNA, 19 nt, Homo sapiens
caaauacuuucuccuuggu

SEQ ID NO: 1211694 - RNA, 19 nt, Homo sapiens
gagauagguagaagucuug

SEQ ID NO: 1211695 - RNA, 19 nt, Homo sapiens
gcuuugagaagaccaauga

SEQ ID NO: 1211696 - RNA, 19 nt, Homo sapiens
gcuccuuccuuccucagaa

SEQ ID NO: 1211697 - RNA, 19 nt, Homo sapiens
cagaugcuguugggaaguu

SEQ ID NO: 1211698 - RNA, 19 nt, Homo sapiens
ggagguuucugagauaggu

SEQ ID NO: 1211699 - RNA, 19 nt, Homo sapiens
cuuagaagguucccagaca

SEQ ID NO: 1211700 - RNA, 19 nt, Homo sapiens
cagcggaggaggagaaaga

SEQ ID NO: 1211701 - RNA, 19 nt, Homo sapiens
gcccugagcgugcugaguu

SEQ ID NO: 1211702 - RNA, 19 nt, Homo sapiens
ugacgucugcucugaagaa

SEQ ID NO: 1211703 - RNA, 19 nt, Homo sapiens
ugaagaaugcuuagaaggu

SEQ ID NO: 1211704 - RNA, 19 nt, Homo sapiens
cgucugcucugaagaaugc

SEQ ID NO: 1211705 - RNA, 19 nt, Homo sapiens
cgaggacccuaguagagau

SEQ ID NO: 1211706 - RNA, 19 nt, Homo sapiens
ggaggaagaggaugaagac

SEQ ID NO: 1211707 - RNA, 19 nt, Homo sapiens
ggaccuggacagcaucuuc

SEQ ID NO: 1211708 - RNA, 19 nt, Homo sapiens
gagaugcugcucaacuuca

SEQ ID NO: 1211709 - RNA, 19 nt, Homo sapiens
ugagaagaccaaugagaug

SEQ ID NO: 1211710 - RNA, 19 nt, Homo sapiens
cgugcugaguucuguguuu

SEQ ID NO: 1211711 - RNA, 19 nt, Homo sapiens
uacccgauguuuacagaug

SEQ ID NO: 1211712 - RNA, 19 nt, Homo sapiens
guucuguguuucucugaau

SEQ ID NO: 1211713 - RNA, 19 nt, Homo sapiens
ggaggaggagaaagagaug

SEQ ID NO: 1211714 - RNA, 19 nt, Homo sapiens
gugcugaguucuguguuuc

SEQ ID NO: 1211715 - RNA, 19 nt, Homo sapiens
gcauggugaacacagauga

SEQ ID NO: 1211716 - RNA, 19 nt, Homo sapiens
ugagcauggugaacacaga

SEQ ID NO: 1211717 - RNA, 19 nt, Homo sapiens
ggacccuaguagagaugaa

SEQ ID NO: 1211718 - RNA, 19 nt, Homo sapiens
ccaccucgggaaagaguuu

SEQ ID NO: 1211719 - RNA, 19 nt, Homo sapiens
ccacacgaggacccuagua

SEQ ID NO: 1211720 - RNA, 19 nt, Homo sapiens
cgggaaagaguuuaaugga

SEQ ID NO: 1211721 - RNA, 19 nt, Homo sapiens
ucugaagaaugcuuagaag

SEQ ID NO: 1211722 - RNA, 19 nt, Homo sapiens
gaggcuggccauccauuca

SEQ ID NO: 1211723 - RNA, 19 nt, Homo sapiens
gcacggucuccucugaguu

SEQ ID NO: 1211724 - RNA, 19 nt, Homo sapiens
gcaccacgaccaccauugc

SEQ ID NO: 1211725 - RNA, 19 nt, Homo sapiens
acacgaggacccuaguaga

SEQ ID NO: 1211726 - RNA, 19 nt, Homo sapiens
gacgucugcucugaagaau

SEQ ID NO: 1211727 - RNA, 19 nt, Homo sapiens
ccugacgucugcucugaag

SEQ ID NO: 1211728 - RNA, 19 nt, Homo sapiens
agacagaugacgaggagau

SEQ ID NO: 1211729 - RNA, 19 nt, Homo sapiens
cagaggccuucagccauau

SEQ ID NO: 1211730 - RNA, 19 nt, Homo sapiens
ggaggcuggccauccauuc

SEQ ID NO: 1211731 - RNA, 19 nt, Homo sapiens
auagguagaagucuugaga

SEQ ID NO: 1211732 - RNA, 19 nt, Homo sapiens
gagcauggugaacacagau

SEQ ID NO: 1211733 - RNA, 19 nt, Homo sapiens
ggugaacacagaugauguc

SEQ ID NO: 1211734 - RNA, 19 nt, Homo sapiens
acaucucuauucugcaaga

SEQ ID NO: 1211735 - RNA, 19 nt, Homo sapiens
cuggaccgcuuugagaaga

SEQ ID NO: 1211736 - RNA, 19 nt, Homo sapiens
caccauugccaccucagaa

SEQ ID NO: 1211737 - RNA, 19 nt, Homo sapiens
ccagcaggccucucugaag

SEQ ID NO: 1211738 - RNA, 19 nt, Homo sapiens
ggaccacgcuggcuguguu

SEQ ID NO: 1211739 - RNA, 19 nt, Homo sapiens
gcaacacaguuucucugaa

SEQ ID NO: 1211740 - RNA, 19 nt, Homo sapiens
gaacguggcauccggcaau

SEQ ID NO: 1211741 - RNA, 19 nt, Homo sapiens
uaagucagcaacacaguuu

SEQ ID NO: 1211742 - RNA, 19 nt, Homo sapiens
caauaagugucccauaggu

SEQ ID NO: 1211743 - RNA, 19 nt, Homo sapiens
gcacguggcagcuuugucu

SEQ ID NO: 1211744 - RNA, 19 nt, Homo sapiens
gcagcuuugucucuguuga

SEQ ID NO: 1211745 - RNA, 19 nt, Homo sapiens
gcacgagcaugggcaccaa

SEQ ID NO: 1211746 - RNA, 19 nt, Homo sapiens
caacuaagucagcaacaca

SEQ ID NO: 1211747 - RNA, 19 nt, Homo sapiens
uccaauaagugucccauag

SEQ ID NO: 1211748 - RNA, 19 nt, Homo sapiens
ggagguguggguucaaguu

SEQ ID NO: 1211749 - RNA, 19 nt, Homo sapiens
caucugcugcgccgacaua

SEQ ID NO: 1211750 - RNA, 19 nt, Homo sapiens
gcaacuaagucagcaacac

SEQ ID NO: 1211751 - RNA, 19 nt, Homo sapiens
ggugugagugugugaguga

SEQ ID NO: 1211752 - RNA, 19 nt, Homo sapiens
gcucuucacgucccuuaug

SEQ ID NO: 1211753 - RNA, 19 nt, Homo sapiens
gcugacaacaugaagacuu

SEQ ID NO: 1211754 - RNA, 19 nt, Homo sapiens
gagcagcaucucucucauc

SEQ ID NO: 1211755 - RNA, 19 nt, Homo sapiens
caccuucugcugcaaguuu

SEQ ID NO: 1211756 - RNA, 19 nt, Homo sapiens
ccaucucccuggugacugu

SEQ ID NO: 1211757 - RNA, 19 nt, Homo sapiens
cugcggauguggucugugu

SEQ ID NO: 1211758 - RNA, 19 nt, Homo sapiens
gcaccgagagcacgagcau

SEQ ID NO: 1211759 - RNA, 19 nt, Homo sapiens
gaggggaaguggcuguuug

SEQ ID NO: 1211760 - RNA, 19 nt, Homo sapiens
uggcagcuuugucucuguu

SEQ ID NO: 1211761 - RNA, 19 nt, Homo sapiens
gugucuaccuccuucaucu

SEQ ID NO: 1211762 - RNA, 19 nt, Homo sapiens
ccaauaagugucccauagg

SEQ ID NO: 1211763 - RNA, 19 nt, Homo sapiens
ccugggugcugcugaccuu

SEQ ID NO: 1211764 - RNA, 19 nt, Homo sapiens
ucgaugagagagaccauga

SEQ ID NO: 1211765 - RNA, 19 nt, Homo sapiens
gagguguggguucaaguuc

SEQ ID NO: 1211766 - RNA, 19 nt, Homo sapiens
gcaacucacucauguauuu

SEQ ID NO: 1211767 - RNA, 19 nt, Homo sapiens
ccacuuaccuugucacuaa

SEQ ID NO: 1211768 - RNA, 19 nt, Homo sapiens
ucacagacuuguccacuua

SEQ ID NO: 1211769 - RNA, 19 nt, Homo sapiens
gcaauauguucacaguuua

SEQ ID NO: 1211770 - RNA, 19 nt, Homo sapiens
ggagauguaugcaguguga

SEQ ID NO: 1211771 - RNA, 19 nt, Homo sapiens
ggagacagccacuaugaaa

SEQ ID NO: 1211772 - RNA, 19 nt, Homo sapiens
uaagaugacuguacagcaa

SEQ ID NO: 1211773 - RNA, 19 nt, Homo sapiens
gagcuacacuacugcuaaa

SEQ ID NO: 1211774 - RNA, 19 nt, Homo sapiens
gaaaugcaacucacucaug

SEQ ID NO: 1211775 - RNA, 19 nt, Homo sapiens
agagaaaccugaaacuaug

SEQ ID NO: 1211776 - RNA, 19 nt, Homo sapiens
ugcaauauguucacaguuu

SEQ ID NO: 1211777 - RNA, 19 nt, Homo sapiens
gcacuugccuuagccuguu

SEQ ID NO: 1211778 - RNA, 19 nt, Homo sapiens
cuacacuacugcuaaacua

SEQ ID NO: 1211779 - RNA, 19 nt, Homo sapiens
cugccaagcuccucuauga

SEQ ID NO: 1211780 - RNA, 19 nt, Homo sapiens
cagagaaaccugaaacuau

SEQ ID NO: 1211781 - RNA, 19 nt, Homo sapiens
agacugagcuacacuacug

SEQ ID NO: 1211782 - RNA, 19 nt, Homo sapiens
ugugagugauccuuugaua

SEQ ID NO: 1211783 - RNA, 19 nt, Homo sapiens
gcagugugacgccaaguuu

SEQ ID NO: 1211784 - RNA, 19 nt, Homo sapiens
guucacaguuuauuaaugc

SEQ ID NO: 1211785 - RNA, 19 nt, Homo sapiens
ucaaggaggcggaguucua

SEQ ID NO: 1211786 - RNA, 19 nt, Homo sapiens
gcauguuccugcaguauac

SEQ ID NO: 1211787 - RNA, 19 nt, Homo sapiens
aaaugcaacucacucaugu

SEQ ID NO: 1211788 - RNA, 19 nt, Homo sapiens
gcccaucaauauucauuuc

SEQ ID NO: 1211789 - RNA, 19 nt, Homo sapiens
cuugucgucuuuccaauaa

SEQ ID NO: 1211790 - RNA, 19 nt, Homo sapiens
guuuacagcacuugccuua

SEQ ID NO: 1211791 - RNA, 19 nt, Homo sapiens
acuaugacuugucgucuuu

SEQ ID NO: 1211792 - RNA, 19 nt, Homo sapiens
ugaguucgcaggucuacua

SEQ ID NO: 1211793 - RNA, 19 nt, Homo sapiens
ggauggagacagccacuau

SEQ ID NO: 1211794 - RNA, 19 nt, Homo sapiens
gagaaaccugaaacuauga

SEQ ID NO: 1211795 - RNA, 19 nt, Homo sapiens
cacuacugcuaaacuauuu

SEQ ID NO: 1211796 - RNA, 19 nt, Homo sapiens
uaaccagagauacuuguuu

SEQ ID NO: 1211797 - RNA, 19 nt, Homo sapiens
gaaccaguuugggcaguag

SEQ ID NO: 1211798 - RNA, 19 nt, Homo sapiens
cagccacuaugaaaucgaa

SEQ ID NO: 1211799 - RNA, 19 nt, Homo sapiens
ccaauaaccagagauacuu

SEQ ID NO: 1211800 - RNA, 19 nt, Homo sapiens
ggagccuguucgccucuaa

SEQ ID NO: 1211801 - RNA, 19 nt, Homo sapiens
ucauguauuuggagaaaca

SEQ ID NO: 1211802 - RNA, 19 nt, Homo sapiens
gccaagcuccucuaugaau

SEQ ID NO: 1211803 - RNA, 19 nt, Homo sapiens
ccaccuuccucgucacguu

SEQ ID NO: 1211804 - RNA, 19 nt, Homo sapiens
gugcagauccucacagaag

SEQ ID NO: 1211805 - RNA, 19 nt, Homo sapiens
aaccagagauacuuguuuc

SEQ ID NO: 1211806 - RNA, 19 nt, Homo sapiens
ccaagcuccucuaugaauc

SEQ ID NO: 1211807 - RNA, 19 nt, Homo sapiens
gagagacugagcuacacua

SEQ ID NO: 1211808 - RNA, 19 nt, Homo sapiens
caaggagugucggagaugu

SEQ ID NO: 1211809 - RNA, 19 nt, Homo sapiens
ccacuaugaaaucgaaauu

SEQ ID NO: 1211810 - RNA, 19 nt, Homo sapiens
gguucuggcccaucaauau

SEQ ID NO: 1211811 - RNA, 19 nt, Homo sapiens
acucauguauuuggagaaa

SEQ ID NO: 1211812 - RNA, 19 nt, Homo sapiens
cacucacuauuucacuuua

SEQ ID NO: 1211813 - RNA, 19 nt, Homo sapiens
ucacucacuauuucacuuu

SEQ ID NO: 1211814 - RNA, 19 nt, Homo sapiens
agacagccacuaugaaauc

SEQ ID NO: 1211815 - RNA, 19 nt, Homo sapiens
cgacaagcagcucaaagug

SEQ ID NO: 1211816 - RNA, 19 nt, Homo sapiens
gagugauccuuugauacuu

SEQ ID NO: 1211817 - RNA, 19 nt, Homo sapiens
uuacagcacuugccuuagc

SEQ ID NO: 1211818 - RNA, 19 nt, Homo sapiens
ugagcuacacuacugcuaa

SEQ ID NO: 1211819 - RNA, 19 nt, Homo sapiens
ggcauguuccugcaguaua

SEQ ID NO: 1211820 - RNA, 19 nt, Homo sapiens
gagacagccacuaugaaau

SEQ ID NO: 1211821 - RNA, 19 nt, Homo sapiens
guucuggcccaucaauauu

SEQ ID NO: 1211822 - RNA, 19 nt, Homo sapiens
acacuacugcuaaacuauu

SEQ ID NO: 1211823 - RNA, 19 nt, Homo sapiens
gcuuuaaacagcuucaugu

SEQ ID NO: 1211824 - RNA, 19 nt, Homo sapiens
agaaccaguuugggcagua

SEQ ID NO: 1211825 - RNA, 19 nt, Homo sapiens
ggaaaugcaacucacucau

SEQ ID NO: 1211826 - RNA, 19 nt, Homo sapiens
ugacuugucgucuuuccaa

SEQ ID NO: 1211827 - RNA, 19 nt, Homo sapiens
gggaaaugcaacucacuca

SEQ ID NO: 1211828 - RNA, 19 nt, Homo sapiens
caauaaccagagauacuug

SEQ ID NO: 1211829 - RNA, 19 nt, Homo sapiens
ugagugauccuuugauacu

SEQ ID NO: 1211830 - RNA, 19 nt, Homo sapiens
ucuaauagccaguuuacag

SEQ ID NO: 1211831 - RNA, 19 nt, Homo sapiens
gaaaucgaaauuguacaca

SEQ ID NO: 1211832 - RNA, 19 nt, Homo sapiens
agaugacuguacagcaauu

SEQ ID NO: 1211833 - RNA, 19 nt, Homo sapiens
gggcugugagugauccuuu

SEQ ID NO: 1211834 - RNA, 19 nt, Homo sapiens
aaccugaaacuaugacuug

SEQ ID NO: 1211835 - RNA, 19 nt, Homo sapiens
aggcggaguucuacgacaa

SEQ ID NO: 1211836 - RNA, 19 nt, Homo sapiens
gauggagacagccacuaug

SEQ ID NO: 1211837 - RNA, 19 nt, Homo sapiens
gcugugagugauccuuuga

SEQ ID NO: 1211838 - RNA, 19 nt, Homo sapiens
ggugggagagacugagcua

SEQ ID NO: 1211839 - RNA, 19 nt, Homo sapiens
ugccuuagccuguuucaca

SEQ ID NO: 1211840 - RNA, 19 nt, Homo sapiens
caacucacucauguauuug

SEQ ID NO: 1211841 - RNA, 19 nt, Homo sapiens
ccgugcagauccucacaga

SEQ ID NO: 1211842 - RNA, 19 nt, Homo sapiens
cuuaccuugucacuaauuu

SEQ ID NO: 1211843 - RNA, 19 nt, Homo sapiens
uugcguaccacagggauua

SEQ ID NO: 1211844 - RNA, 19 nt, Homo sapiens
ugacuguacagcaauuugu

SEQ ID NO: 1211845 - RNA, 19 nt, Homo sapiens
gaugacuguacagcaauuu

SEQ ID NO: 1211846 - RNA, 19 nt, Homo sapiens
agugauccuuugauacuuc

SEQ ID NO: 1211847 - RNA, 19 nt, Homo sapiens
ggcugugagugauccuuug

SEQ ID NO: 1211848 - RNA, 19 nt, Homo sapiens
gagauacuuguuucuggau

SEQ ID NO: 1211849 - RNA, 19 nt, Homo sapiens
gugauccuuugauacuuca

SEQ ID NO: 1211850 - RNA, 19 nt, Homo sapiens
agacuuguccacuuaccuu

SEQ ID NO: 1211851 - RNA, 19 nt, Homo sapiens
caccagaaagcaccacugu

SEQ ID NO: 1211852 - RNA, 19 nt, Homo sapiens
cauuuaauucuuccacaga

SEQ ID NO: 1211853 - RNA, 19 nt, Homo sapiens
gggagagacugagcuacac

SEQ ID NO: 1211854 - RNA, 19 nt, Homo sapiens
gcacagcccucccaucuuc

SEQ ID NO: 1211855 - RNA, 19 nt, Homo sapiens
ggaaacggauucaggaaga

SEQ ID NO: 1211856 - RNA, 19 nt, Homo sapiens
gaagacaagaagaagauua

SEQ ID NO: 1211857 - RNA, 19 nt, Homo sapiens
gcagacaccuucacagcuu

SEQ ID NO: 1211858 - RNA, 19 nt, Homo sapiens
agaagaagauuaagacaga

SEQ ID NO: 1211859 - RNA, 19 nt, Homo sapiens
caccugcacuauccaauua

SEQ ID NO: 1211860 - RNA, 19 nt, Homo sapiens
gaaaaucccgacauaauua

SEQ ID NO: 1211861 - RNA, 19 nt, Homo sapiens
ucaaaggcaucaugaagaa

SEQ ID NO: 1211862 - RNA, 19 nt, Homo sapiens
ccaaacugcugguggaauu

SEQ ID NO: 1211863 - RNA, 19 nt, Homo sapiens
gcacgaaaaucccgacaua

SEQ ID NO: 1211864 - RNA, 19 nt, Homo sapiens
gaaguucacuaaggagcua

SEQ ID NO: 1211865 - RNA, 19 nt, Homo sapiens
uaucagaaguggaaacaga

SEQ ID NO: 1211866 - RNA, 19 nt, Homo sapiens
gcauguggcuguggaaaug

SEQ ID NO: 1211867 - RNA, 19 nt, Homo sapiens
ggagagacccagguacuaa

SEQ ID NO: 1211868 - RNA, 19 nt, Homo sapiens
caacacccauccagaggaa

SEQ ID NO: 1211869 - RNA, 19 nt, Homo sapiens
ggccuggucugaucucauu

SEQ ID NO: 1211870 - RNA, 19 nt, Homo sapiens
cuaaggagcuaggcaaguu

SEQ ID NO: 1211871 - RNA, 19 nt, Homo sapiens
ggugaucucucaucuagca

SEQ ID NO: 1211872 - RNA, 19 nt, Homo sapiens
cauauucauugguuuguga

SEQ ID NO: 1211873 - RNA, 19 nt, Homo sapiens
guacuaaaaucccagcuaa

SEQ ID NO: 1211874 - RNA, 19 nt, Homo sapiens
gcccagcacugcaggagaa

SEQ ID NO: 1211875 - RNA, 19 nt, Homo sapiens
caaguucacuggccucaag

SEQ ID NO: 1211876 - RNA, 19 nt, Homo sapiens
gaauggagagacccaggua

SEQ ID NO: 1211877 - RNA, 19 nt, Homo sapiens
caggagccaucaucuguga

SEQ ID NO: 1211878 - RNA, 19 nt, Homo sapiens
ucagucauauucauugguu

SEQ ID NO: 1211879 - RNA, 19 nt, Homo sapiens
ucccagagguggugacuga

SEQ ID NO: 1211880 - RNA, 19 nt, Homo sapiens
ggaaaugugggcccuccua

SEQ ID NO: 1211881 - RNA, 19 nt, Homo sapiens
ccucccaucuucccaauga

SEQ ID NO: 1211882 - RNA, 19 nt, Homo sapiens
ggucugaucucauuuuaga

SEQ ID NO: 1211883 - RNA, 19 nt, Homo sapiens
cagagcagcugcaggagau

SEQ ID NO: 1211884 - RNA, 19 nt, Homo sapiens
ggagauccccucauuaaaa

SEQ ID NO: 1211885 - RNA, 19 nt, Homo sapiens
gagagguccugcaugaaca

SEQ ID NO: 1211886 - RNA, 19 nt, Homo sapiens
ggaagaccaucccggugau

SEQ ID NO: 1211887 - RNA, 19 nt, Homo sapiens
cauggacccuguucugaga

SEQ ID NO: 1211888 - RNA, 19 nt, Homo sapiens
gacaagaagaagauuaaga

SEQ ID NO: 1211889 - RNA, 19 nt, Homo sapiens
ugaagggugugcaggaguu

SEQ ID NO: 1211890 - RNA, 19 nt, Homo sapiens
gccugaagcugcagagugu

SEQ ID NO: 1211891 - RNA, 19 nt, Homo sapiens
gagagacccagguacuaaa

SEQ ID NO: 1211892 - RNA, 19 nt, Homo sapiens
ccucaagacugcccugauc

SEQ ID NO: 1211893 - RNA, 19 nt, Homo sapiens
gaucagucauauucauugg

SEQ ID NO: 1211894 - RNA, 19 nt, Homo sapiens
gguggugacugagauccua

SEQ ID NO: 1211895 - RNA, 19 nt, Homo sapiens
gaaaugugggcccuccuau

SEQ ID NO: 1211896 - RNA, 19 nt, Homo sapiens
ggagccaucaucugugaaa

SEQ ID NO: 1211897 - RNA, 19 nt, Homo sapiens
gacaggaagacaagaagaa

SEQ ID NO: 1211898 - RNA, 19 nt, Homo sapiens
ggacaggaagacaagaaga

SEQ ID NO: 1211899 - RNA, 19 nt, Homo sapiens
gagcugcgcccacaucuac

SEQ ID NO: 1211900 - RNA, 19 nt, Homo sapiens
ucugagaccugacaaagag

SEQ ID NO: 1211901 - RNA, 19 nt, Homo sapiens
agaagcagccugagaagga

SEQ ID NO: 1211902 - RNA, 19 nt, Homo sapiens
ccacucucauugugacuga

SEQ ID NO: 1211903 - RNA, 19 nt, Homo sapiens
cugcugccuuguccauuua

SEQ ID NO: 1211904 - RNA, 19 nt, Homo sapiens
gagagaguguggaggacau

SEQ ID NO: 1211905 - RNA, 19 nt, Homo sapiens
cgaagcaccacgccgagua

SEQ ID NO: 1211906 - RNA, 19 nt, Homo sapiens
gguuugugaccuacucuua

SEQ ID NO: 1211907 - RNA, 19 nt, Homo sapiens
aaagaacagugaugauggu

SEQ ID NO: 1211908 - RNA, 19 nt, Homo sapiens
agaacaagaagaagaagaa

SEQ ID NO: 1211909 - RNA, 19 nt, Homo sapiens
caggauggaagaccaguuu

SEQ ID NO: 1211910 - RNA, 19 nt, Homo sapiens
ggacggcgaguuugagauc

SEQ ID NO: 1211911 - RNA, 19 nt, Homo sapiens
ggaucagucauauucauug

SEQ ID NO: 1211912 - RNA, 19 nt, Homo sapiens
uaacguggcagaggaguug

SEQ ID NO: 1211913 - RNA, 19 nt, Homo sapiens
agacagagacauuugaaca

SEQ ID NO: 1211914 - RNA, 19 nt, Homo sapiens
gcaagaugcggaagaggau

SEQ ID NO: 1211915 - RNA, 19 nt, Homo sapiens
ccaagcagcagauccugaa

SEQ ID NO: 1211916 - RNA, 19 nt, Homo sapiens
uaagacagagacauuugaa

SEQ ID NO: 1211917 - RNA, 19 nt, Homo sapiens
gaucaaucucgccaaauuc

SEQ ID NO: 1211918 - RNA, 19 nt, Homo sapiens
ccaaugaggaaacggauuc

SEQ ID NO: 1211919 - RNA, 19 nt, Homo sapiens
ucugcugccuuguccauuu

SEQ ID NO: 1211920 - RNA, 19 nt, Homo sapiens
gaagcugggaccuggaaga

SEQ ID NO: 1211921 - RNA, 19 nt, Homo sapiens
agcgagaccuguaucagaa

SEQ ID NO: 1211922 - RNA, 19 nt, Homo sapiens
ggaaugcaccucggaugug

SEQ ID NO: 1211923 - RNA, 19 nt, Homo sapiens
gaaacggauucaggaagag

SEQ ID NO: 1211924 - RNA, 19 nt, Homo sapiens
guaagaagaagcgguuugu

SEQ ID NO: 1211925 - RNA, 19 nt, Homo sapiens
uggaauacgugguguucga

SEQ ID NO: 1211926 - RNA, 19 nt, Homo sapiens
gagcuacccgguguucaaa

SEQ ID NO: 1211927 - RNA, 19 nt, Homo sapiens
gaggaaacggauucaggaa

SEQ ID NO: 1211928 - RNA, 19 nt, Homo sapiens
ccuguccucugucuucuug

SEQ ID NO: 1211929 - RNA, 19 nt, Homo sapiens
ggaccaggaauucuacauc

SEQ ID NO: 1211930 - RNA, 19 nt, Homo sapiens
caagagggccaaggagaug

SEQ ID NO: 1211931 - RNA, 19 nt, Homo sapiens
cgacagcccgcaagaucaa

SEQ ID NO: 1211932 - RNA, 19 nt, Homo sapiens
gcccagaacaagaagaaga

SEQ ID NO: 1211933 - RNA, 19 nt, Homo sapiens
gaagaccccugcccaccuu

SEQ ID NO: 1211934 - RNA, 19 nt, Homo sapiens
gguccugcaugaacagcuu

SEQ ID NO: 1211935 - RNA, 19 nt, Homo sapiens
uuggugaucucucaucuag

SEQ ID NO: 1211936 - RNA, 19 nt, Homo sapiens
gggccuuggugaucucuca

SEQ ID NO: 1211937 - RNA, 19 nt, Homo sapiens
caagugggaccguaagaag

SEQ ID NO: 1211938 - RNA, 19 nt, Homo sapiens
gugcuccacucucauugug

SEQ ID NO: 1211939 - RNA, 19 nt, Homo sapiens
acaagaagaagaagaaguc

SEQ ID NO: 1211940 - RNA, 19 nt, Homo sapiens
ggaagacaagaagaagauu

SEQ ID NO: 1211941 - RNA, 19 nt, Homo sapiens
gaacaagaagaagaagaag

SEQ ID NO: 1211942 - RNA, 19 nt, Homo sapiens
cgaaaaucccgacauaauu

SEQ ID NO: 1211943 - RNA, 19 nt, Homo sapiens
gcugucaccugcacuaucc

SEQ ID NO: 1211944 - RNA, 19 nt, Homo sapiens
gagauccccucauuaaaag

SEQ ID NO: 1211945 - RNA, 19 nt, Homo sapiens
ggaaacagaaacagaaaau

SEQ ID NO: 1211946 - RNA, 19 nt, Homo sapiens
aauacgugguguucgauga

SEQ ID NO: 1211947 - RNA, 19 nt, Homo sapiens
cagagguggugacugagau

SEQ ID NO: 1211948 - RNA, 19 nt, Homo sapiens
gcaggaguucgccagcaaa

SEQ ID NO: 1211949 - RNA, 19 nt, Homo sapiens
cuaagacagagacauuuga

SEQ ID NO: 1211950 - RNA, 19 nt, Homo sapiens
gaccaucccggugaucuug

SEQ ID NO: 1211951 - RNA, 19 nt, Homo sapiens
ucaccugcacuauccaauu

SEQ ID NO: 1211952 - RNA, 19 nt, Homo sapiens
gcccacagcacucugaaca

SEQ ID NO: 1211953 - RNA, 19 nt, Homo sapiens
gaggacggcgaguuugaga

SEQ ID NO: 1211954 - RNA, 19 nt, Homo sapiens
gaacgcagcugccgaugau

SEQ ID NO: 1211955 - RNA, 19 nt, Homo sapiens
gaucaaaacucccgccuua

SEQ ID NO: 1211956 - RNA, 19 nt, Homo sapiens
uggaccagcuuguggaaua

SEQ ID NO: 1211957 - RNA, 19 nt, Homo sapiens
gggucaggguuguaaguaa

SEQ ID NO: 1211958 - RNA, 19 nt, Homo sapiens
ggaccagcuuguggaauau

SEQ ID NO: 1211959 - RNA, 19 nt, Homo sapiens
ggucaggguuguaaguaag

SEQ ID NO: 1211960 - RNA, 19 nt, Homo sapiens
gaaugugggucaggguugu

SEQ ID NO: 1211961 - RNA, 19 nt, Homo sapiens
ggacauccuggccgcauug

SEQ ID NO: 1211962 - RNA, 19 nt, Homo sapiens
acucggaugugcccuagaa

SEQ ID NO: 1211963 - RNA, 19 nt, Homo sapiens
cgacugccgcacauaauga

SEQ ID NO: 1211964 - RNA, 19 nt, Homo sapiens
gaugguggcccgucaaguc

SEQ ID NO: 1211965 - RNA, 19 nt, Homo sapiens
gggcuuugcgggacgauga

SEQ ID NO: 1211966 - RNA, 19 nt, Homo sapiens
gaacgugaggagcucuuca

SEQ ID NO: 1211967 - RNA, 19 nt, Homo sapiens
gcgguucgacgucauuguu

SEQ ID NO: 1211968 - RNA, 19 nt, Homo sapiens
cagccuccuuugccaguug

SEQ ID NO: 1211969 - RNA, 19 nt, Homo sapiens
gcgacugccgcacauaaug

SEQ ID NO: 1211970 - RNA, 19 nt, Homo sapiens
ggaugugcccuagaaaaua

SEQ ID NO: 1211971 - RNA, 19 nt, Homo sapiens
cgaacgcagcugccgauga

SEQ ID NO: 1211972 - RNA, 19 nt, Homo sapiens
gcacaacacgaggaucgau

SEQ ID NO: 1211973 - RNA, 19 nt, Homo sapiens
agaccucaguccuucuuca

SEQ ID NO: 1211974 - RNA, 19 nt, Homo sapiens
gguucgacgucauuguuag

SEQ ID NO: 1211975 - RNA, 19 nt, Homo sapiens
gcagcgguucgacgucauu

SEQ ID NO: 1211976 - RNA, 19 nt, Homo sapiens
ccgcgacugccgcacauaa

SEQ ID NO: 1211977 - RNA, 19 nt, Homo sapiens
cgucaagucgggcagcauu

SEQ ID NO: 1211978 - RNA, 19 nt, Homo sapiens
ccgaucggcaucaugauug

SEQ ID NO: 1211979 - RNA, 19 nt, Homo sapiens
gaugugcccuagaaaauac

SEQ ID NO: 1211980 - RNA, 19 nt, Homo sapiens
gcucuucacacccaugucu

SEQ ID NO: 1211981 - RNA, 19 nt, Homo sapiens
gcagugagcugagaucuuc

SEQ ID NO: 1211982 - RNA, 19 nt, Homo sapiens
gggagccacugaucgauua

SEQ ID NO: 1211983 - RNA, 19 nt, Homo sapiens
gcucaugccuauaauccua

SEQ ID NO: 1211984 - RNA, 19 nt, Homo sapiens
ggaagaagaaggccaagaa

SEQ ID NO: 1211985 - RNA, 19 nt, Homo sapiens
ggaugaggaugaagaacuu

SEQ ID NO: 1211986 - RNA, 19 nt, Homo sapiens
gcaggagaaucacaugaau

SEQ ID NO: 1211987 - RNA, 19 nt, Homo sapiens
ggcaugauauucuuaguuc

SEQ ID NO: 1211988 - RNA, 19 nt, Homo sapiens
cacaguggcucaugccuau

SEQ ID NO: 1211989 - RNA, 19 nt, Homo sapiens
gcgcucagaccuauccuuu

SEQ ID NO: 1211990 - RNA, 19 nt, Homo sapiens
ccuauaauccuagcacuuu

SEQ ID NO: 1211991 - RNA, 19 nt, Homo sapiens
ccaacgagauccugcacau

SEQ ID NO: 1211992 - RNA, 19 nt, Homo sapiens
ggcagcagcuccagucaag

SEQ ID NO: 1211993 - RNA, 19 nt, Homo sapiens
gcucagaccuauccuuucc

SEQ ID NO: 1211994 - RNA, 19 nt, Homo sapiens
ucagcugucugguacuuga

SEQ ID NO: 1211995 - RNA, 19 nt, Homo sapiens
gaagaagaaggccaagaag

SEQ ID NO: 1211996 - RNA, 19 nt, Homo sapiens
cagcagcuccagucaagaa

SEQ ID NO: 1211997 - RNA, 19 nt, Homo sapiens
gcccucauguccaacuuug

SEQ ID NO: 1211998 - RNA, 19 nt, Homo sapiens
gcaacugggugggucaaag

SEQ ID NO: 1211999 - RNA, 19 nt, Homo sapiens
gucacugguuggcaugaua

SEQ ID NO: 1212000 - RNA, 19 nt, Homo sapiens
cagcuccagucaagaaugu

SEQ ID NO: 1212001 - RNA, 19 nt, Homo sapiens
cgaccucaguuacuucauc

SEQ ID NO: 1212002 - RNA, 19 nt, Homo sapiens
gcugucugguacuugauuu

SEQ ID NO: 1212003 - RNA, 19 nt, Homo sapiens
cccauagagucacagcuuu

SEQ ID NO: 1212004 - RNA, 19 nt, Homo sapiens
ccacugaucgauuacuuca

SEQ ID NO: 1212005 - RNA, 19 nt, Homo sapiens
gaacuggcgcucagcuucu

SEQ ID NO: 1212006 - RNA, 19 nt, Homo sapiens
ggcaggagaaucacaugaa

SEQ ID NO: 1212007 - RNA, 19 nt, Homo sapiens
caaagccagccucaucuuc

SEQ ID NO: 1212008 - RNA, 19 nt, Homo sapiens
caguggcucaugccuauaa

SEQ ID NO: 1212009 - RNA, 19 nt, Homo sapiens
uccucuaccucaaguauga

SEQ ID NO: 1212010 - RNA, 19 nt, Homo sapiens
gccaggagcucagcauucg

SEQ ID NO: 1212011 - RNA, 19 nt, Homo sapiens
cuauaauccuagcacuuug

SEQ ID NO: 1212012 - RNA, 19 nt, Homo sapiens
ggaccucuucuacaagugu

SEQ ID NO: 1212013 - RNA, 19 nt, Homo sapiens
guccaaagccagccucauc

SEQ ID NO: 1212014 - RNA, 19 nt, Homo sapiens
cccuggaccucuucuacaa

SEQ ID NO: 1212015 - RNA, 19 nt, Homo sapiens
ccucagcugucugguacuu

SEQ ID NO: 1212016 - RNA, 19 nt, Homo sapiens
aggccaagaaggcggauua

SEQ ID NO: 1212017 - RNA, 19 nt, Homo sapiens
agcgagggcuccaggaaga

SEQ ID NO: 1212018 - RNA, 19 nt, Homo sapiens
caucuucaccuuguucaug

SEQ ID NO: 1212019 - RNA, 19 nt, Homo sapiens
gcuacauccuggcugaucu

SEQ ID NO: 1212020 - RNA, 19 nt, Homo sapiens
aaagccagccucaucuuca

SEQ ID NO: 1212021 - RNA, 19 nt, Homo sapiens
ccaaagccagccucaucuu

SEQ ID NO: 1212022 - RNA, 19 nt, Homo sapiens
gggaugaggaugaagaacu

SEQ ID NO: 1212023 - RNA, 19 nt, Homo sapiens
ccaaguccaaggaggaguu

SEQ ID NO: 1212024 - RNA, 19 nt, Homo sapiens
ugacagccacccacucaca

SEQ ID NO: 1212025 - RNA, 19 nt, Homo sapiens
gguguccuguaagguguuu

SEQ ID NO: 1212026 - RNA, 19 nt, Homo sapiens
ucgauuacuucagcaacaa

SEQ ID NO: 1212027 - RNA, 19 nt, Homo sapiens
cauccucuaccucaaguau

SEQ ID NO: 1212028 - RNA, 19 nt, Homo sapiens
gaaaccccaucucuaccaa

SEQ ID NO: 1212029 - RNA, 19 nt, Homo sapiens
gcagcuccagucaagaaug

SEQ ID NO: 1212030 - RNA, 19 nt, Homo sapiens
ggccaggagcucagcauuc

SEQ ID NO: 1212031 - RNA, 19 nt, Homo sapiens
ucacgcccaucaccacuac

SEQ ID NO: 1212032 - RNA, 19 nt, Homo sapiens
gcaugauauucuuaguucu

SEQ ID NO: 1212033 - RNA, 19 nt, Homo sapiens
aacgagauccugcacaugu

SEQ ID NO: 1212034 - RNA, 19 nt, Homo sapiens
cugcaaaucagggucauug

SEQ ID NO: 1212035 - RNA, 19 nt, Homo sapiens
agccucaucuucaucuuca

SEQ ID NO: 1212036 - RNA, 19 nt, Homo sapiens
ggaagccagagaccaacga

SEQ ID NO: 1212037 - RNA, 19 nt, Homo sapiens
caacugggugggucaaagg

SEQ ID NO: 1212038 - RNA, 19 nt, Homo sapiens
gaugaggaugaagaacuuu

SEQ ID NO: 1212039 - RNA, 19 nt, Homo sapiens
gauauggggaugaggauga

SEQ ID NO: 1212040 - RNA, 19 nt, Homo sapiens
gaggcuuccugcgcucaga

SEQ ID NO: 1212041 - RNA, 19 nt, Homo sapiens
ggacugagcgcucccaauu

SEQ ID NO: 1212042 - RNA, 19 nt, Homo sapiens
gagcugcgcuacaguaucu

SEQ ID NO: 1212043 - RNA, 19 nt, Homo sapiens
gcacuuauuggcuguguuu

SEQ ID NO: 1212044 - RNA, 19 nt, Homo sapiens
gcccagaucugcucuccuu

SEQ ID NO: 1212045 - RNA, 19 nt, Homo sapiens
ggaaccagcgucagaaaga

SEQ ID NO: 1212046 - RNA, 19 nt, Homo sapiens
cuacaggguuuaagucuca

SEQ ID NO: 1212047 - RNA, 19 nt, Homo sapiens
cgacugcgaauuacuguuu

SEQ ID NO: 1212048 - RNA, 19 nt, Homo sapiens
gaacauccuccuaccuuuc

SEQ ID NO: 1212049 - RNA, 19 nt, Homo sapiens
caagagccuuucuggaugu

SEQ ID NO: 1212050 - RNA, 19 nt, Homo sapiens
gcgaauuacuguuuaugag

SEQ ID NO: 1212051 - RNA, 19 nt, Homo sapiens
gaggugacuuccuggucua

SEQ ID NO: 1212052 - RNA, 19 nt, Homo sapiens
caggaggucucaauaaacu

SEQ ID NO: 1212053 - RNA, 19 nt, Homo sapiens
gcuacaguaucuacagaga

SEQ ID NO: 1212054 - RNA, 19 nt, Homo sapiens
cuaagaagcagaaacuaga

SEQ ID NO: 1212055 - RNA, 19 nt, Homo sapiens
ggaggucucaauaaacuug

SEQ ID NO: 1212056 - RNA, 19 nt, Homo sapiens
gacugcgaauuacuguuua

SEQ ID NO: 1212057 - RNA, 19 nt, Homo sapiens
cucaggaggucucaauaaa

SEQ ID NO: 1212058 - RNA, 19 nt, Homo sapiens
ggguuugauucaucuguuu

SEQ ID NO: 1212059 - RNA, 19 nt, Homo sapiens
acugugagcuucccgagaa

SEQ ID NO: 1212060 - RNA, 19 nt, Homo sapiens
gcucuucucugggagucua

SEQ ID NO: 1212061 - RNA, 19 nt, Homo sapiens
gcgcuacaguaucuacaga

SEQ ID NO: 1212062 - RNA, 19 nt, Homo sapiens
gggccaggcugcuaagaag

SEQ ID NO: 1212063 - RNA, 19 nt, Homo sapiens
ggacagugggacauucuga

SEQ ID NO: 1212064 - RNA, 19 nt, Homo sapiens
agaacauccuccuaccuuu

SEQ ID NO: 1212065 - RNA, 19 nt, Homo sapiens
gcuaagaagcagaaacuag

SEQ ID NO: 1212066 - RNA, 19 nt, Homo sapiens
gaaacuagaacaggcuuca

SEQ ID NO: 1212067 - RNA, 19 nt, Homo sapiens
caagcaggacccucaaaug

SEQ ID NO: 1212068 - RNA, 19 nt, Homo sapiens
uaagaagcagaaacuagaa

SEQ ID NO: 1212069 - RNA, 19 nt, Homo sapiens
gugacucgcugguucuauc

SEQ ID NO: 1212070 - RNA, 19 nt, Homo sapiens
ucucaggaggucucaauaa

SEQ ID NO: 1212071 - RNA, 19 nt, Homo sapiens
cuaccuuucuccgcgguua

SEQ ID NO: 1212072 - RNA, 19 nt, Homo sapiens
uagaacauccuccuaccuu

SEQ ID NO: 1212073 - RNA, 19 nt, Homo sapiens
gaaccagcgucagaaagac

SEQ ID NO: 1212074 - RNA, 19 nt, Homo sapiens
guaguuaccuauuuucaca

SEQ ID NO: 1212075 - RNA, 19 nt, Homo sapiens
ggccuggguuugauucauc

SEQ ID NO: 1212076 - RNA, 19 nt, Homo sapiens
uuucgaacacuacaucuuu

SEQ ID NO: 1212077 - RNA, 19 nt, Homo sapiens
ggucuacaccucccugcaa

SEQ ID NO: 1212078 - RNA, 19 nt, Homo sapiens
ccaagcaggacccucaaau

SEQ ID NO: 1212079 - RNA, 19 nt, Homo sapiens
gaggaugagaccagugaug

SEQ ID NO: 1212080 - RNA, 19 nt, Homo sapiens
gagguccuggagaagauua

SEQ ID NO: 1212081 - RNA, 19 nt, Homo sapiens
guucuuccuuguuucaaag

SEQ ID NO: 1212082 - RNA, 19 nt, Homo sapiens
acugagcgcucccaauugg

SEQ ID NO: 1212083 - RNA, 19 nt, Homo sapiens
cagugcggcuggcaaguuc

SEQ ID NO: 1212084 - RNA, 19 nt, Homo sapiens
cagaucugcucuccuuguc

SEQ ID NO: 1212085 - RNA, 19 nt, Homo sapiens
aagcaggacccucaaaugg

SEQ ID NO: 1212086 - RNA, 19 nt, Homo sapiens
gacagugggacauucugaa

SEQ ID NO: 1212087 - RNA, 19 nt, Homo sapiens
gguggacagugggacauuc

SEQ ID NO: 1212088 - RNA, 19 nt, Homo sapiens
agacccugcuccucuguuc

SEQ ID NO: 1212089 - RNA, 19 nt, Homo sapiens
agcaagagccuuucuggau

SEQ ID NO: 1212090 - RNA, 19 nt, Homo sapiens
ccagaucugcucuccuugu

SEQ ID NO: 1212091 - RNA, 19 nt, Homo sapiens
ggucucaauaaacuuggua

SEQ ID NO: 1212092 - RNA, 19 nt, Homo sapiens
aagaggaugagaccaguga

SEQ ID NO: 1212093 - RNA, 19 nt, Homo sapiens
gagaauggggccuggguuu

SEQ ID NO: 1212094 - RNA, 19 nt, Homo sapiens
cacgagcugcgcuacagua

SEQ ID NO: 1212095 - RNA, 19 nt, Homo sapiens
gacugagcgcucccaauug

SEQ ID NO: 1212096 - RNA, 19 nt, Homo sapiens
gucuacaccucccugcaau

SEQ ID NO: 1212097 - RNA, 19 nt, Homo sapiens
gccuggcccugacauccuu

SEQ ID NO: 1212098 - RNA, 19 nt, Homo sapiens
cuccgcagccugaugguaa

SEQ ID NO: 1212099 - RNA, 19 nt, Homo sapiens
guauauggcuccuuuaaua

SEQ ID NO: 1212100 - RNA, 19 nt, Homo sapiens
ggagagagggcauagguua

SEQ ID NO: 1212101 - RNA, 19 nt, Homo sapiens
gcacaaacccacauaguug

SEQ ID NO: 1212102 - RNA, 19 nt, Homo sapiens
gguacaggauguucuauaa

SEQ ID NO: 1212103 - RNA, 19 nt, Homo sapiens
ggagaaaccuuggagauuc

SEQ ID NO: 1212104 - RNA, 19 nt, Homo sapiens
guacaauugucgugcauuu

SEQ ID NO: 1212105 - RNA, 19 nt, Homo sapiens
uaaagaugcugauguacaa

SEQ ID NO: 1212106 - RNA, 19 nt, Homo sapiens
ggacagaggcugaguggaa

SEQ ID NO: 1212107 - RNA, 19 nt, Homo sapiens
gaccaaugcuucuuuaucu

SEQ ID NO: 1212108 - RNA, 19 nt, Homo sapiens
gaagagccgucugcagcua

SEQ ID NO: 1212109 - RNA, 19 nt, Homo sapiens
uccgagagauggcuuauuu

SEQ ID NO: 1212110 - RNA, 19 nt, Homo sapiens
acagggaacucuccauuau

SEQ ID NO: 1212111 - RNA, 19 nt, Homo sapiens
gagaaaccuuggagauuca

SEQ ID NO: 1212112 - RNA, 19 nt, Homo sapiens
guuacacccuacagaauaa

SEQ ID NO: 1212113 - RNA, 19 nt, Homo sapiens
gaacuaaacccaggcaaca

SEQ ID NO: 1212114 - RNA, 19 nt, Homo sapiens
ggacagggaacucuccauu

SEQ ID NO: 1212115 - RNA, 19 nt, Homo sapiens
gcuguagacuuguauaugg

SEQ ID NO: 1212116 - RNA, 19 nt, Homo sapiens
ccugagaccuucacguuug

SEQ ID NO: 1212117 - RNA, 19 nt, Homo sapiens
gacagggaacucuccauua

SEQ ID NO: 1212118 - RNA, 19 nt, Homo sapiens
gguuacacccuacagaaua

SEQ ID NO: 1212119 - RNA, 19 nt, Homo sapiens
gacagaggcugaguggaaa

SEQ ID NO: 1212120 - RNA, 19 nt, Homo sapiens
agggaacucuccauuauug

SEQ ID NO: 1212121 - RNA, 19 nt, Homo sapiens
uggccacgcucaccaagua

SEQ ID NO: 1212122 - RNA, 19 nt, Homo sapiens
ugcagagacucaaauauug

SEQ ID NO: 1212123 - RNA, 19 nt, Homo sapiens
guaaagaugcugauguaca

SEQ ID NO: 1212124 - RNA, 19 nt, Homo sapiens
gagcaguggucucggaaag

SEQ ID NO: 1212125 - RNA, 19 nt, Homo sapiens
caauggcuguagacuugua

SEQ ID NO: 1212126 - RNA, 19 nt, Homo sapiens
gguccucgcuucacacaca

SEQ ID NO: 1212127 - RNA, 19 nt, Homo sapiens
uuguaaagaugcugaugua

SEQ ID NO: 1212128 - RNA, 19 nt, Homo sapiens
gcacguuaccucaggaaug

SEQ ID NO: 1212129 - RNA, 19 nt, Homo sapiens
caccugggcugcuggagaa

SEQ ID NO: 1212130 - RNA, 19 nt, Homo sapiens
gacuuuggauucgaacuaa

SEQ ID NO: 1212131 - RNA, 19 nt, Homo sapiens
cauaaaugaugcucucaag

SEQ ID NO: 1212132 - RNA, 19 nt, Homo sapiens
ggaccaaugcuucuuuauc

SEQ ID NO: 1212133 - RNA, 19 nt, Homo sapiens
gggagaaaccuuggagauu

SEQ ID NO: 1212134 - RNA, 19 nt, Homo sapiens
guacaggauguucuauaaa

SEQ ID NO: 1212135 - RNA, 19 nt, Homo sapiens
aaggaccaaugcuucuuua

SEQ ID NO: 1212136 - RNA, 19 nt, Homo sapiens
cugcagagacucaaauauu

SEQ ID NO: 1212137 - RNA, 19 nt, Homo sapiens
gauaagccgccucuucaau

SEQ ID NO: 1212138 - RNA, 19 nt, Homo sapiens
caaggaccaaugcuucuuu

SEQ ID NO: 1212139 - RNA, 19 nt, Homo sapiens
gcaguggucucggaaagag

SEQ ID NO: 1212140 - RNA, 19 nt, Homo sapiens
gaauuggacagcucagaug

SEQ ID NO: 1212141 - RNA, 19 nt, Homo sapiens
augcgaauaugcacaguuu

SEQ ID NO: 1212142 - RNA, 19 nt, Homo sapiens
uauggcuccuuuaauauug

SEQ ID NO: 1212143 - RNA, 19 nt, Homo sapiens
gcgaauaugcacaguuuua

SEQ ID NO: 1212144 - RNA, 19 nt, Homo sapiens
ggcacaaacccacauaguu

SEQ ID NO: 1212145 - RNA, 19 nt, Homo sapiens
cagcccagcucaccaaguc

SEQ ID NO: 1212146 - RNA, 19 nt, Homo sapiens
ccucagggcugcacguuac

SEQ ID NO: 1212147 - RNA, 19 nt, Homo sapiens
gggcugagugauucuguaa

SEQ ID NO: 1212148 - RNA, 19 nt, Homo sapiens
ggaguucugccuguguaua

SEQ ID NO: 1212149 - RNA, 19 nt, Homo sapiens
ccugagggcugagugauuc

SEQ ID NO: 1212150 - RNA, 19 nt, Homo sapiens
acaguuugaagcaacauua

SEQ ID NO: 1212151 - RNA, 19 nt, Homo sapiens
ccggagacgucaugugcaa

SEQ ID NO: 1212152 - RNA, 19 nt, Homo sapiens
uacacuagccugccgauga

SEQ ID NO: 1212153 - RNA, 19 nt, Homo sapiens
ccacugcuguucgaaucaa

SEQ ID NO: 1212154 - RNA, 19 nt, Homo sapiens
ucaacucgguacaggaugu

SEQ ID NO: 1212155 - RNA, 19 nt, Homo sapiens
cggaugacuuuaaggacuu

SEQ ID NO: 1212156 - RNA, 19 nt, Homo sapiens
ggauaagccgccucuucaa

SEQ ID NO: 1212157 - RNA, 19 nt, Homo sapiens
cgacaggcccaaagaugga

SEQ ID NO: 1212158 - RNA, 19 nt, Homo sapiens
ugacuuuggauucgaacua

SEQ ID NO: 1212159 - RNA, 19 nt, Homo sapiens
gcaacauuauuucauugac

SEQ ID NO: 1212160 - RNA, 19 nt, Homo sapiens
uaagccgccucuucaaugg

SEQ ID NO: 1212161 - RNA, 19 nt, Homo sapiens
caccugagaccuucacguu

SEQ ID NO: 1212162 - RNA, 19 nt, Homo sapiens
ggacagaugcagggaugug

SEQ ID NO: 1212163 - RNA, 19 nt, Homo sapiens
ggccaugugucuggagaga

SEQ ID NO: 1212164 - RNA, 19 nt, Homo sapiens
gcaggagacggguguuaca

SEQ ID NO: 1212165 - RNA, 19 nt, Homo sapiens
gcucaacucgguacaggau

SEQ ID NO: 1212166 - RNA, 19 nt, Homo sapiens
agaugcugauguacaauug

SEQ ID NO: 1212167 - RNA, 19 nt, Homo sapiens
aggcagaccuggcgcucuu

SEQ ID NO: 1212168 - RNA, 19 nt, Homo sapiens
acacuagccugccgaugag

SEQ ID NO: 1212169 - RNA, 19 nt, Homo sapiens
ggugcucaguucucaguca

SEQ ID NO: 1212170 - RNA, 19 nt, Homo sapiens
cuucagaggagcuguuuau

SEQ ID NO: 1212171 - RNA, 19 nt, Homo sapiens
gaucgucacaggagaaggu

SEQ ID NO: 1212172 - RNA, 19 nt, Homo sapiens
caggauaagccgccucuuc

SEQ ID NO: 1212173 - RNA, 19 nt, Homo sapiens
gcgagaaggcccucaucga

SEQ ID NO: 1212174 - RNA, 19 nt, Homo sapiens
cccaguccaugccauaaau

SEQ ID NO: 1212175 - RNA, 19 nt, Homo sapiens
caauugucgugcauuugug

SEQ ID NO: 1212176 - RNA, 19 nt, Homo sapiens
acuuguauauggcuccuuu

SEQ ID NO: 1212177 - RNA, 19 nt, Homo sapiens
uugaugcgacccaaagaua

SEQ ID NO: 1212178 - RNA, 19 nt, Homo sapiens
uagggaccuuugucaguga

SEQ ID NO: 1212179 - RNA, 19 nt, Homo sapiens
cccaccagcugccaagaga

SEQ ID NO: 1212180 - RNA, 19 nt, Homo sapiens
uaauucacguuguuacacu

SEQ ID NO: 1212181 - RNA, 19 nt, Homo sapiens
cacguuaccucaggaaugg

SEQ ID NO: 1212182 - RNA, 19 nt, Homo sapiens
cagggaacucuccauuauu

SEQ ID NO: 1212183 - RNA, 19 nt, Homo sapiens
cuucaaaccaccuggaaug

SEQ ID NO: 1212184 - RNA, 19 nt, Homo sapiens
gccaucaccauccugugua

SEQ ID NO: 1212185 - RNA, 19 nt, Homo sapiens
guccaugccauaaaugaug

SEQ ID NO: 1212186 - RNA, 19 nt, Homo sapiens
gcagaccuggcgcucuuga

SEQ ID NO: 1212187 - RNA, 19 nt, Homo sapiens
gcggagggaggaaacaugu

SEQ ID NO: 1212188 - RNA, 19 nt, Homo sapiens
gaugcgacccaaagauaca

SEQ ID NO: 1212189 - RNA, 19 nt, Homo sapiens
cccagcacgugguucugua

SEQ ID NO: 1212190 - RNA, 19 nt, Homo sapiens
ggacuaggcccugcuucag

SEQ ID NO: 1212191 - RNA, 19 nt, Homo sapiens
aggauaagccgccucuuca

SEQ ID NO: 1212192 - RNA, 19 nt, Homo sapiens
guucagcgaguaugugcuu

SEQ ID NO: 1212193 - RNA, 19 nt, Homo sapiens
uugaugaccucuguuucuu

SEQ ID NO: 1212194 - RNA, 19 nt, Homo sapiens
guuacacgcagucaucaga

SEQ ID NO: 1212195 - RNA, 19 nt, Homo sapiens
ccgaugagacccagacaca

SEQ ID NO: 1212196 - RNA, 19 nt, Homo sapiens
gcugagugauucuguaacc

SEQ ID NO: 1212197 - RNA, 19 nt, Homo sapiens
caggugucauggcaacaga

SEQ ID NO: 1212198 - RNA, 19 nt, Homo sapiens
guccaacuagguuugcuaa

SEQ ID NO: 1212199 - RNA, 19 nt, Homo sapiens
gaacugaucuccacuccuu

SEQ ID NO: 1212200 - RNA, 19 nt, Homo sapiens
gaaugugguuucugucuua

SEQ ID NO: 1212201 - RNA, 19 nt, Homo sapiens
ucaaagaacugguccguuu

SEQ ID NO: 1212202 - RNA, 19 nt, Homo sapiens
gaaaugaaagcucuguuua

SEQ ID NO: 1212203 - RNA, 19 nt, Homo sapiens
ggaaauugaucagcauuaa

SEQ ID NO: 1212204 - RNA, 19 nt, Homo sapiens
ugaaagcucuguuuaagaa

SEQ ID NO: 1212205 - RNA, 19 nt, Homo sapiens
ggaacuauaucaucugaga

SEQ ID NO: 1212206 - RNA, 19 nt, Homo sapiens
gaauagagacaccgaaauu

SEQ ID NO: 1212207 - RNA, 19 nt, Homo sapiens
gcagccagaugcuuaguaa

SEQ ID NO: 1212208 - RNA, 19 nt, Homo sapiens
ggacagaguuugcuuucau

SEQ ID NO: 1212209 - RNA, 19 nt, Homo sapiens
caagagggcuacagggaaa

SEQ ID NO: 1212210 - RNA, 19 nt, Homo sapiens
ugacagcccuggagaagaa

SEQ ID NO: 1212211 - RNA, 19 nt, Homo sapiens
gaaagcagcgucuccaaga

SEQ ID NO: 1212212 - RNA, 19 nt, Homo sapiens
gaaagaagagacagaauag

SEQ ID NO: 1212213 - RNA, 19 nt, Homo sapiens
ucacaucauuuguccauuu

SEQ ID NO: 1212214 - RNA, 19 nt, Homo sapiens
gacaggaaauccagaauca

SEQ ID NO: 1212215 - RNA, 19 nt, Homo sapiens
ugaaguaccuagauuuguu

SEQ ID NO: 1212216 - RNA, 19 nt, Homo sapiens
cagcagaugucaaaccauu

SEQ ID NO: 1212217 - RNA, 19 nt, Homo sapiens
gacagaguuugcuuucaua

SEQ ID NO: 1212218 - RNA, 19 nt, Homo sapiens
gggaacacuuggaggauuu

SEQ ID NO: 1212219 - RNA, 19 nt, Homo sapiens
ccagaaagauccagucaag

SEQ ID NO: 1212220 - RNA, 19 nt, Homo sapiens
ugaaagaagagacagaaua

SEQ ID NO: 1212221 - RNA, 19 nt, Homo sapiens
gaacaauaugucagagaua

SEQ ID NO: 1212222 - RNA, 19 nt, Homo sapiens
gugagaagauacagucaaa

SEQ ID NO: 1212223 - RNA, 19 nt, Homo sapiens
caaccucacugaagaagau

SEQ ID NO: 1212224 - RNA, 19 nt, Homo sapiens
ggacuuuccugaacugcaa

SEQ ID NO: 1212225 - RNA, 19 nt, Homo sapiens
gagaauaguuugaaaucag

SEQ ID NO: 1212226 - RNA, 19 nt, Homo sapiens
agauaacucuucauccaua

SEQ ID NO: 1212227 - RNA, 19 nt, Homo sapiens
gcuucaaccucucaaauga

SEQ ID NO: 1212228 - RNA, 19 nt, Homo sapiens
gaaagaacggcaagagaga

SEQ ID NO: 1212229 - RNA, 19 nt, Homo sapiens
gauugaagaugccgaggaa

SEQ ID NO: 1212230 - RNA, 19 nt, Homo sapiens
gaaaaccuaugaugagaaa

SEQ ID NO: 1212231 - RNA, 19 nt, Homo sapiens
gagccacacuacauugaaa

SEQ ID NO: 1212232 - RNA, 19 nt, Homo sapiens
gagcagaacauucccuuug

SEQ ID NO: 1212233 - RNA, 19 nt, Homo sapiens
gaaguggaugcuuguguua

SEQ ID NO: 1212234 - RNA, 19 nt, Homo sapiens
gcuagagguucacaucauu

SEQ ID NO: 1212235 - RNA, 19 nt, Homo sapiens
gacauuaucuacagaacug

SEQ ID NO: 1212236 - RNA, 19 nt, Homo sapiens
cagaauagcugagccaagu

SEQ ID NO: 1212237 - RNA, 19 nt, Homo sapiens
ggaaaauacuggaaaaugu

SEQ ID NO: 1212238 - RNA, 19 nt, Homo sapiens
caccgaaauuucaaucuaa

SEQ ID NO: 1212239 - RNA, 19 nt, Homo sapiens
ucaagagccuccaaggauu

SEQ ID NO: 1212240 - RNA, 19 nt, Homo sapiens
cgacagacauuaucuacag

SEQ ID NO: 1212241 - RNA, 19 nt, Homo sapiens
uaacccaaaugaaucugua

SEQ ID NO: 1212242 - RNA, 19 nt, Homo sapiens
gcaaagcaguccuccaaac

SEQ ID NO: 1212243 - RNA, 19 nt, Homo sapiens
gcaguugcaucugaaagaa

SEQ ID NO: 1212244 - RNA, 19 nt, Homo sapiens
cacaucauuuguccauuua

SEQ ID NO: 1212245 - RNA, 19 nt, Homo sapiens
ucaaacaccugaagcucaa

SEQ ID NO: 1212246 - RNA, 19 nt, Homo sapiens
ggacaccaauggguuaugu

SEQ ID NO: 1212247 - RNA, 19 nt, Homo sapiens
aaaaccagcugcaguguua

SEQ ID NO: 1212248 - RNA, 19 nt, Homo sapiens
ugaaagggcugauggaacu

SEQ ID NO: 1212249 - RNA, 19 nt, Homo sapiens
guauugaaguaccuagauu

SEQ ID NO: 1212250 - RNA, 19 nt, Homo sapiens
gaagagccacacuacauug

SEQ ID NO: 1212251 - RNA, 19 nt, Homo sapiens
aaugaagccucaagaaaga

SEQ ID NO: 1212252 - RNA, 19 nt, Homo sapiens
gaaguaccuagauuuguuu

SEQ ID NO: 1212253 - RNA, 19 nt, Homo sapiens
guagugaccuugaacaaaa

SEQ ID NO: 1212254 - RNA, 19 nt, Homo sapiens
ucuaaagcaucacaaggua

SEQ ID NO: 1212255 - RNA, 19 nt, Homo sapiens
uaaagaccauugcuucauc

SEQ ID NO: 1212256 - RNA, 19 nt, Homo sapiens
cagcugcaguguuaucaaa

SEQ ID NO: 1212257 - RNA, 19 nt, Homo sapiens
gauguacccuggagcuaga

SEQ ID NO: 1212258 - RNA, 19 nt, Homo sapiens
gcagaacauucccuuugug

SEQ ID NO: 1212259 - RNA, 19 nt, Homo sapiens
acaccgaaauuucaaucua

SEQ ID NO: 1212260 - RNA, 19 nt, Homo sapiens
aaauguaucuaccuccaaa

SEQ ID NO: 1212261 - RNA, 19 nt, Homo sapiens
ugagauaacucuucaucca

SEQ ID NO: 1212262 - RNA, 19 nt, Homo sapiens
ugacagagcagaaaauaua

SEQ ID NO: 1212263 - RNA, 19 nt, Homo sapiens
guaccuagauuuguuugau

SEQ ID NO: 1212264 - RNA, 19 nt, Homo sapiens
gaaacuuccucuccauugc

SEQ ID NO: 1212265 - RNA, 19 nt, Homo sapiens
gcuaaugccgcuaccaauu

SEQ ID NO: 1212266 - RNA, 19 nt, Homo sapiens
uguugaaucuggaaauuga

SEQ ID NO: 1212267 - RNA, 19 nt, Homo sapiens
ccagaugcuuaguaaagaa

SEQ ID NO: 1212268 - RNA, 19 nt, Homo sapiens
caggaaauccagaaucauu

SEQ ID NO: 1212269 - RNA, 19 nt, Homo sapiens
gauaacucuucauccauau

SEQ ID NO: 1212270 - RNA, 19 nt, Homo sapiens
gaauagcugagccaaguga

SEQ ID NO: 1212271 - RNA, 19 nt, Homo sapiens
gaugacacuuugcacacaa

SEQ ID NO: 1212272 - RNA, 19 nt, Homo sapiens
uuaccgaccuacucaaaga

SEQ ID NO: 1212273 - RNA, 19 nt, Homo sapiens
ccaaaugaaucuguaacug

SEQ ID NO: 1212274 - RNA, 19 nt, Homo sapiens
agaauacuuuggcugcuaa

SEQ ID NO: 1212275 - RNA, 19 nt, Homo sapiens
agaaguggaugcuuguguu

SEQ ID NO: 1212276 - RNA, 19 nt, Homo sapiens
guuaucagcagaugucaaa

SEQ ID NO: 1212277 - RNA, 19 nt, Homo sapiens
caggaucaguuccacaaga

SEQ ID NO: 1212278 - RNA, 19 nt, Homo sapiens
gccagaugcuuaguaaaga

SEQ ID NO: 1212279 - RNA, 19 nt, Homo sapiens
guuaucaaagggugaaaua

SEQ ID NO: 1212280 - RNA, 19 nt, Homo sapiens
aaugaaagcucuguuuaag

SEQ ID NO: 1212281 - RNA, 19 nt, Homo sapiens
ugaagaugccgaggaauuu

SEQ ID NO: 1212282 - RNA, 19 nt, Homo sapiens
ugagaguucuugccugugu

SEQ ID NO: 1212283 - RNA, 19 nt, Homo sapiens
gaauuuaugagaguucuug

SEQ ID NO: 1212284 - RNA, 19 nt, Homo sapiens
aagccaaccucacugaaga

SEQ ID NO: 1212285 - RNA, 19 nt, Homo sapiens
agaaaugaaagcucuguuu

SEQ ID NO: 1212286 - RNA, 19 nt, Homo sapiens
ugagugaguuugcagaaag

SEQ ID NO: 1212287 - RNA, 19 nt, Homo sapiens
uagaauacuuuggcugcua

SEQ ID NO: 1212288 - RNA, 19 nt, Homo sapiens
agaccaugcuggagaaugu

SEQ ID NO: 1212289 - RNA, 19 nt, Homo sapiens
acaagaccaugcuggagaa

SEQ ID NO: 1212290 - RNA, 19 nt, Homo sapiens
gacuaaacgucgacuugug

SEQ ID NO: 1212291 - RNA, 19 nt, Homo sapiens
agaagaagcagcacucuca

SEQ ID NO: 1212292 - RNA, 19 nt, Homo sapiens
ugucagagauacagaagca

SEQ ID NO: 1212293 - RNA, 19 nt, Homo sapiens
aaagcucuguuuaagaaga

SEQ ID NO: 1212294 - RNA, 19 nt, Homo sapiens
ccauaugccuauucuccuu

SEQ ID NO: 1212295 - RNA, 19 nt, Homo sapiens
ggaggacagaguuugcuuu

SEQ ID NO: 1212296 - RNA, 19 nt, Homo sapiens
caagaugguugagcugaca

SEQ ID NO: 1212297 - RNA, 19 nt, Homo sapiens
ggaugacacuuugcacaca

SEQ ID NO: 1212298 - RNA, 19 nt, Homo sapiens
gcgagggcaucaaguuauc

SEQ ID NO: 1212299 - RNA, 19 nt, Homo sapiens
gggaguaccuggacuacga

SEQ ID NO: 1212300 - RNA, 19 nt, Homo sapiens
ggaguacccugacuucuac

SEQ ID NO: 1212301 - RNA, 19 nt, Homo sapiens
cccgagagcucuucaaguu

SEQ ID NO: 1212302 - RNA, 19 nt, Homo sapiens
ggaaggcaacuaccuguuc

SEQ ID NO: 1212303 - RNA, 19 nt, Homo sapiens
gagcgggaccugaagaaga

SEQ ID NO: 1212304 - RNA, 19 nt, Homo sapiens
gguccugccuuucaucugu

SEQ ID NO: 1212305 - RNA, 19 nt, Homo sapiens
agaaggugcugcugauugu

SEQ ID NO: 1212306 - RNA, 19 nt, Homo sapiens
acaagaaggugcugcugau

SEQ ID NO: 1212307 - RNA, 19 nt, Homo sapiens
gaagcucuacggccucuug

SEQ ID NO: 1212308 - RNA, 19 nt, Homo sapiens
gcgcacuccugaaguuugu

SEQ ID NO: 1212309 - RNA, 19 nt, Homo sapiens
ggaaguacaagguguggau

SEQ ID NO: 1212310 - RNA, 19 nt, Homo sapiens
gcccaccugugaauaaauc

SEQ ID NO: 1212311 - RNA, 19 nt, Homo sapiens
acaaacacaaccuggagua

SEQ ID NO: 1212312 - RNA, 19 nt, Homo sapiens
gcucacggccuacgagauc

SEQ ID NO: 1212313 - RNA, 19 nt, Homo sapiens
uggaguacccugacuucua

SEQ ID NO: 1212314 - RNA, 19 nt, Homo sapiens
agcgggaccugaagaagaa

SEQ ID NO: 1212315 - RNA, 19 nt, Homo sapiens
gucuccagcuucuauguga

SEQ ID NO: 1212316 - RNA, 19 nt, Homo sapiens
gagccacacggaaguacaa

SEQ ID NO: 1212317 - RNA, 19 nt, Homo sapiens
gcugagaauccgcguuguu

SEQ ID NO: 1212318 - RNA, 19 nt, Homo sapiens
caaagccgccagcgucauc

SEQ ID NO: 1212319 - RNA, 19 nt, Homo sapiens
aagaaggugcugcugauug

SEQ ID NO: 1212320 - RNA, 19 nt, Homo sapiens
caagaaggugcugcugauu

SEQ ID NO: 1212321 - RNA, 19 nt, Homo sapiens
uggccgugcugcagucuga

SEQ ID NO: 1212322 - RNA, 19 nt, Homo sapiens
guacaagguguggaugaga

SEQ ID NO: 1212323 - RNA, 19 nt, Homo sapiens
guccugccuuucaucugua

SEQ ID NO: 1212324 - RNA, 19 nt, Homo sapiens
ucaucuugauucacaaaca

SEQ ID NO: 1212325 - RNA, 19 nt, Homo sapiens
uggcccaccugugaauaaa

SEQ ID NO: 1212326 - RNA, 19 nt, Homo sapiens
gggcuguucaucuugauuc

SEQ ID NO: 1212327 - RNA, 19 nt, Homo sapiens
ccacgcucaugaucgacuu

SEQ ID NO: 1212328 - RNA, 19 nt, Homo sapiens
caagugggaaggcaacuac

SEQ ID NO: 1212329 - RNA, 19 nt, Homo sapiens
ggaugagacaccgcuauca

SEQ ID NO: 1212330 - RNA, 19 nt, Homo sapiens
ccaacgccguguucgacau

SEQ ID NO: 1212331 - RNA, 19 nt, Homo sapiens
gggaaggcaacuaccuguu

SEQ ID NO: 1212332 - RNA, 19 nt, Homo sapiens
ccacacggaaguacaaggu

SEQ ID NO: 1212333 - RNA, 19 nt, Homo sapiens
cggugccacuggaguuuau

SEQ ID NO: 1212334 - RNA, 19 nt, Homo sapiens
guucaucuugauucacaaa

SEQ ID NO: 1212335 - RNA, 19 nt, Homo sapiens
aaggagcacaggaggguuu

SEQ ID NO: 1212336 - RNA, 19 nt, Homo sapiens
ccaagugggaaggcaacua

SEQ ID NO: 1212337 - RNA, 19 nt, Homo sapiens
uaaaggaacugcuuagaaa

SEQ ID NO: 1212338 - RNA, 19 nt, Homo sapiens
ggaaggagcauuucucuuu

SEQ ID NO: 1212339 - RNA, 19 nt, Homo sapiens
gaacuucggguuauuaauu

SEQ ID NO: 1212340 - RNA, 19 nt, Homo sapiens
caccagaacuucccauuaa

SEQ ID NO: 1212341 - RNA, 19 nt, Homo sapiens
guaaaugcauugauggaaa

SEQ ID NO: 1212342 - RNA, 19 nt, Homo sapiens
ggaagucugcugugaauuu

SEQ ID NO: 1212343 - RNA, 19 nt, Homo sapiens
gcacacugauugccauauu

SEQ ID NO: 1212344 - RNA, 19 nt, Homo sapiens
gaaggagcauuucucuuug

SEQ ID NO: 1212345 - RNA, 19 nt, Homo sapiens
ugucacauguugccaaaua

SEQ ID NO: 1212346 - RNA, 19 nt, Homo sapiens
gcaccagaacuucccauua

SEQ ID NO: 1212347 - RNA, 19 nt, Homo sapiens
gaagucugcugugaauuug

SEQ ID NO: 1212348 - RNA, 19 nt, Homo sapiens
gcucuucacugcaccagaa

SEQ ID NO: 1212349 - RNA, 19 nt, Homo sapiens
cagaguggacguuggauua

SEQ ID NO: 1212350 - RNA, 19 nt, Homo sapiens
ugaaucagcugccucaagu

SEQ ID NO: 1212351 - RNA, 19 nt, Homo sapiens
gccuugagcuccuuuaugu

SEQ ID NO: 1212352 - RNA, 19 nt, Homo sapiens
gcauauggaaggagcauuu

SEQ ID NO: 1212353 - RNA, 19 nt, Homo sapiens
gaaacuggcuugcuaucac

SEQ ID NO: 1212354 - RNA, 19 nt, Homo sapiens
caccgaaacuggcuugcua

SEQ ID NO: 1212355 - RNA, 19 nt, Homo sapiens
ccacauaccauuccacaga

SEQ ID NO: 1212356 - RNA, 19 nt, Homo sapiens
uauaguauuucgucacuga

SEQ ID NO: 1212357 - RNA, 19 nt, Homo sapiens
gcaggagacgcuucgauuu

SEQ ID NO: 1212358 - RNA, 19 nt, Homo sapiens
gaguauauccugucacaug

SEQ ID NO: 1212359 - RNA, 19 nt, Homo sapiens
ucagcugccucaagucuuu

SEQ ID NO: 1212360 - RNA, 19 nt, Homo sapiens
ccagaugggucuauucgau

SEQ ID NO: 1212361 - RNA, 19 nt, Homo sapiens
ggacauuauucccucuuuc

SEQ ID NO: 1212362 - RNA, 19 nt, Homo sapiens
uuacuaaccucaguguauu

SEQ ID NO: 1212363 - RNA, 19 nt, Homo sapiens
ugucaucgguuugaaauug

SEQ ID NO: 1212364 - RNA, 19 nt, Homo sapiens
gcauuucucuuugcuguuc

SEQ ID NO: 1212365 - RNA, 19 nt, Homo sapiens
gcaguaggcgucacauaug

SEQ ID NO: 1212366 - RNA, 19 nt, Homo sapiens
gggugacucuucucaaaug

SEQ ID NO: 1212367 - RNA, 19 nt, Homo sapiens
uggaagaguuucagcuuug

SEQ ID NO: 1212368 - RNA, 19 nt, Homo sapiens
ucaagcauaucuaccucua

SEQ ID NO: 1212369 - RNA, 19 nt, Homo sapiens
gcaauugguuuucggcuuu

SEQ ID NO: 1212370 - RNA, 19 nt, Homo sapiens
caagacaaagaaacaauga

SEQ ID NO: 1212371 - RNA, 19 nt, Homo sapiens
uuucgucacugaagacuuu

SEQ ID NO: 1212372 - RNA, 19 nt, Homo sapiens
ugaauaaaggaacugcuua

SEQ ID NO: 1212373 - RNA, 19 nt, Homo sapiens
gcaagacaaagaaacaaug

SEQ ID NO: 1212374 - RNA, 19 nt, Homo sapiens
gauguacucuuuguguaug

SEQ ID NO: 1212375 - RNA, 19 nt, Homo sapiens
cuucaucccuuuguuacua

SEQ ID NO: 1212376 - RNA, 19 nt, Homo sapiens
cuuuauggauguacucuuu

SEQ ID NO: 1212377 - RNA, 19 nt, Homo sapiens
acucacaguuugccaauau

SEQ ID NO: 1212378 - RNA, 19 nt, Homo sapiens
gaccacaacaggacauuau

SEQ ID NO: 1212379 - RNA, 19 nt, Homo sapiens
ggaagaguuucagcuuugu

SEQ ID NO: 1212380 - RNA, 19 nt, Homo sapiens
uaaaccagaugggucuauu

SEQ ID NO: 1212381 - RNA, 19 nt, Homo sapiens
gaucaagaaaugcugaaug

SEQ ID NO: 1212382 - RNA, 19 nt, Homo sapiens
gaauaaaggaacugcuuag

SEQ ID NO: 1212383 - RNA, 19 nt, Homo sapiens
ucuauucgauggaagaguu

SEQ ID NO: 1212384 - RNA, 19 nt, Homo sapiens
ucucuuugcuguucuccua

SEQ ID NO: 1212385 - RNA, 19 nt, Homo sapiens
uugcaugguuugaguauau

SEQ ID NO: 1212386 - RNA, 19 nt, Homo sapiens
gcuauuggcaagacaaaga

SEQ ID NO: 1212387 - RNA, 19 nt, Homo sapiens
ggauguggaucaaguuggu

SEQ ID NO: 1212388 - RNA, 19 nt, Homo sapiens
cagcuuuguucguguuauu

SEQ ID NO: 1212389 - RNA, 19 nt, Homo sapiens
ggauguacucuuuguguau

SEQ ID NO: 1212390 - RNA, 19 nt, Homo sapiens
gaaaugcugaauguccaua

SEQ ID NO: 1212391 - RNA, 19 nt, Homo sapiens
cacauaugcuugguucaaa

SEQ ID NO: 1212392 - RNA, 19 nt, Homo sapiens
gggccucugucaugcauau

SEQ ID NO: 1212393 - RNA, 19 nt, Homo sapiens
uaucacagugguauuauga

SEQ ID NO: 1212394 - RNA, 19 nt, Homo sapiens
guucagcaguuccaacaca

SEQ ID NO: 1212395 - RNA, 19 nt, Homo sapiens
uauauccugucacauguug

SEQ ID NO: 1212396 - RNA, 19 nt, Homo sapiens
agucugcugugaauuugua

SEQ ID NO: 1212397 - RNA, 19 nt, Homo sapiens
gauggaagaguuucagcuu

SEQ ID NO: 1212398 - RNA, 19 nt, Homo sapiens
ugcugaauguccauaauuu

SEQ ID NO: 1212399 - RNA, 19 nt, Homo sapiens
gggacugguuguuuucuua

SEQ ID NO: 1212400 - RNA, 19 nt, Homo sapiens
uggauguacucuuugugua

SEQ ID NO: 1212401 - RNA, 19 nt, Homo sapiens
aaugacaagugguuugguu

SEQ ID NO: 1212402 - RNA, 19 nt, Homo sapiens
cuugagcuccuuuauguuu

SEQ ID NO: 1212403 - RNA, 19 nt, Homo sapiens
cccaaggccucaaugacaa

SEQ ID NO: 1212404 - RNA, 19 nt, Homo sapiens
acaaagugcugucugucau

SEQ ID NO: 1212405 - RNA, 19 nt, Homo sapiens
gcuguucuccuacauuuca

SEQ ID NO: 1212406 - RNA, 19 nt, Homo sapiens
uugcuguucuccuacauuu

SEQ ID NO: 1212407 - RNA, 19 nt, Homo sapiens
gauuaaugcuacucuccau

SEQ ID NO: 1212408 - RNA, 19 nt, Homo sapiens
gguauuaugaggcaacuuc

SEQ ID NO: 1212409 - RNA, 19 nt, Homo sapiens
auaaaggaacugcuuagaa

SEQ ID NO: 1212410 - RNA, 19 nt, Homo sapiens
acacaguccuucccucagu

SEQ ID NO: 1212411 - RNA, 19 nt, Homo sapiens
gaaaaggcauauggaagga

SEQ ID NO: 1212412 - RNA, 19 nt, Homo sapiens
ugagugcuguaaaugcauu

SEQ ID NO: 1212413 - RNA, 19 nt, Homo sapiens
uugauugacucugcuauug

SEQ ID NO: 1212414 - RNA, 19 nt, Homo sapiens
ccacaacaggacauuauuc

SEQ ID NO: 1212415 - RNA, 19 nt, Homo sapiens
agccauacuucuagcaauu

SEQ ID NO: 1212416 - RNA, 19 nt, Homo sapiens
ccaagggcccagaggcuuu

SEQ ID NO: 1212417 - RNA, 19 nt, Homo sapiens
gaacuucccauuaaaaucu

SEQ ID NO: 1212418 - RNA, 19 nt, Homo sapiens
gucaucgguuugaaauuga

SEQ ID NO: 1212419 - RNA, 19 nt, Homo sapiens
ucacauguugccaaauauu

SEQ ID NO: 1212420 - RNA, 19 nt, Homo sapiens
cuggaagucugcugugaau

SEQ ID NO: 1212421 - RNA, 19 nt, Homo sapiens
caccauauauaguauuucg

SEQ ID NO: 1212422 - RNA, 19 nt, Homo sapiens
gccauauugcccucuauuu

SEQ ID NO: 1212423 - RNA, 19 nt, Homo sapiens
gaagaguuucagcuuuguu

SEQ ID NO: 1212424 - RNA, 19 nt, Homo sapiens
guccgugagugcuguaaau

SEQ ID NO: 1212425 - RNA, 19 nt, Homo sapiens
gcugaauguccauaauuug

SEQ ID NO: 1212426 - RNA, 19 nt, Homo sapiens
aucaagaaaugcugaaugu

SEQ ID NO: 1212427 - RNA, 19 nt, Homo sapiens
ucacauaugcuugguucaa

SEQ ID NO: 1212428 - RNA, 19 nt, Homo sapiens
cacacugauugccauauug

SEQ ID NO: 1212429 - RNA, 19 nt, Homo sapiens
acucuccauugcacgauua

SEQ ID NO: 1212430 - RNA, 19 nt, Homo sapiens
guggaacuucggguuauua

SEQ ID NO: 1212431 - RNA, 19 nt, Homo sapiens
cugaauguccauaauuuga

SEQ ID NO: 1212432 - RNA, 19 nt, Homo sapiens
cacauguugccaaauauuu

SEQ ID NO: 1212433 - RNA, 19 nt, Homo sapiens
uagcaauucucccaaugag

SEQ ID NO: 1212434 - RNA, 19 nt, Homo sapiens
cuucugggcuuuguacaau

SEQ ID NO: 1212435 - RNA, 19 nt, Homo sapiens
cucaguguauugugcagua

SEQ ID NO: 1212436 - RNA, 19 nt, Homo sapiens
cauguuacuauucaccaua

SEQ ID NO: 1212437 - RNA, 19 nt, Homo sapiens
ggaaucagcuagagaagua

SEQ ID NO: 1212438 - RNA, 19 nt, Homo sapiens
gcugagaccuugagaauaa

SEQ ID NO: 1212439 - RNA, 19 nt, Homo sapiens
gaacaucuauccuaugaau

SEQ ID NO: 1212440 - RNA, 19 nt, Homo sapiens
cgaauguucucaccuauua

SEQ ID NO: 1212441 - RNA, 19 nt, Homo sapiens
gagaacaucuauccuauga

SEQ ID NO: 1212442 - RNA, 19 nt, Homo sapiens
gaagaaaccugucgacaag

SEQ ID NO: 1212443 - RNA, 19 nt, Homo sapiens
gaacacauauauaggagaa

SEQ ID NO: 1212444 - RNA, 19 nt, Homo sapiens
gaaugugucuucuuuauca

SEQ ID NO: 1212445 - RNA, 19 nt, Homo sapiens
acaugaaccugaacuauua

SEQ ID NO: 1212446 - RNA, 19 nt, Homo sapiens
ucaaauggcucaaagaaau

SEQ ID NO: 1212447 - RNA, 19 nt, Homo sapiens
gcaaugguauggagagauu

SEQ ID NO: 1212448 - RNA, 19 nt, Homo sapiens
gaagaagucaauaugcuua

SEQ ID NO: 1212449 - RNA, 19 nt, Homo sapiens
ggaaguuucucacccauga

SEQ ID NO: 1212450 - RNA, 19 nt, Homo sapiens
gaaaugcccauaauuaguu

SEQ ID NO: 1212451 - RNA, 19 nt, Homo sapiens
cuaauuaguuggcauauug

SEQ ID NO: 1212452 - RNA, 19 nt, Homo sapiens
gaaugcugaugaacaauuu

SEQ ID NO: 1212453 - RNA, 19 nt, Homo sapiens
ccgaggagcuggcuaauga

SEQ ID NO: 1212454 - RNA, 19 nt, Homo sapiens
gaaauggaacuacaagaaa

SEQ ID NO: 1212455 - RNA, 19 nt, Homo sapiens
gaagacggauauaaaggaa

SEQ ID NO: 1212456 - RNA, 19 nt, Homo sapiens
gaaagcgacuuggugaauu

SEQ ID NO: 1212457 - RNA, 19 nt, Homo sapiens
gaaggaagcuacuaaaaga

SEQ ID NO: 1212458 - RNA, 19 nt, Homo sapiens
gguaaucacugcuaacaau

SEQ ID NO: 1212459 - RNA, 19 nt, Homo sapiens
accaagaacuggaagauua

SEQ ID NO: 1212460 - RNA, 19 nt, Homo sapiens
uaaagugugugauugguuu

SEQ ID NO: 1212461 - RNA, 19 nt, Homo sapiens
gaagaaagggaaguauaua

SEQ ID NO: 1212462 - RNA, 19 nt, Homo sapiens
caagagauccacuguauau

SEQ ID NO: 1212463 - RNA, 19 nt, Homo sapiens
gcacaaggcaauugaaaug

SEQ ID NO: 1212464 - RNA, 19 nt, Homo sapiens
ccaauugauucucuacuuu

SEQ ID NO: 1212465 - RNA, 19 nt, Homo sapiens
cacaagagauccacuguau

SEQ ID NO: 1212466 - RNA, 19 nt, Homo sapiens
ggaagaaagggaaguauau

SEQ ID NO: 1212467 - RNA, 19 nt, Homo sapiens
gacuggagguugauaguuu

SEQ ID NO: 1212468 - RNA, 19 nt, Homo sapiens
gcaaggaauuaacacaaau

SEQ ID NO: 1212469 - RNA, 19 nt, Homo sapiens
gagaauaaagugugugauu

SEQ ID NO: 1212470 - RNA, 19 nt, Homo sapiens
ggaagaaaccugucgacaa

SEQ ID NO: 1212471 - RNA, 19 nt, Homo sapiens
cagcagcgaugaagacuug

SEQ ID NO: 1212472 - RNA, 19 nt, Homo sapiens
ucacugaacucuucuccaa

SEQ ID NO: 1212473 - RNA, 19 nt, Homo sapiens
guauagaauuggagagauu

SEQ ID NO: 1212474 - RNA, 19 nt, Homo sapiens
gcuccacucuucuaauaaa

SEQ ID NO: 1212475 - RNA, 19 nt, Homo sapiens
agagggaacuguuaaaugu

SEQ ID NO: 1212476 - RNA, 19 nt, Homo sapiens
uuagacaacuggauacaaa

SEQ ID NO: 1212477 - RNA, 19 nt, Homo sapiens
ggaaacugguugcgaacuu

SEQ ID NO: 1212478 - RNA, 19 nt, Homo sapiens
gaucaaauggcucaaagaa

SEQ ID NO: 1212479 - RNA, 19 nt, Homo sapiens
gcuaucgacuacuaaauga

SEQ ID NO: 1212480 - RNA, 19 nt, Homo sapiens
gccaagaauuccuauaaug

SEQ ID NO: 1212481 - RNA, 19 nt, Homo sapiens
gcaauugaaaugcccauaa

SEQ ID NO: 1212482 - RNA, 19 nt, Homo sapiens
agaaggaacucuccaaagu

SEQ ID NO: 1212483 - RNA, 19 nt, Homo sapiens
gaaacgagaaugugucuuc

SEQ ID NO: 1212484 - RNA, 19 nt, Homo sapiens
ugaagggaaugguauagaa

SEQ ID NO: 1212485 - RNA, 19 nt, Homo sapiens
cggcuccacucuucuaaua

SEQ ID NO: 1212486 - RNA, 19 nt, Homo sapiens
aagcaaagcuccggaauca

SEQ ID NO: 1212487 - RNA, 19 nt, Homo sapiens
gaaacacaccaaggaauuu

SEQ ID NO: 1212488 - RNA, 19 nt, Homo sapiens
ugaguguguucaugaaaua

SEQ ID NO: 1212489 - RNA, 19 nt, Homo sapiens
ggaaugguauagaauugga

SEQ ID NO: 1212490 - RNA, 19 nt, Homo sapiens
ggauacuccucuuauuuau

SEQ ID NO: 1212491 - RNA, 19 nt, Homo sapiens
ggagagauuucccgagaca

SEQ ID NO: 1212492 - RNA, 19 nt, Homo sapiens
ccaagaauuccuauaauga

SEQ ID NO: 1212493 - RNA, 19 nt, Homo sapiens
gaaaauaacuacucacaac

SEQ ID NO: 1212494 - RNA, 19 nt, Homo sapiens
caauugaaaugcccauaau

SEQ ID NO: 1212495 - RNA, 19 nt, Homo sapiens
ugucuggacuacauuauuu

SEQ ID NO: 1212496 - RNA, 19 nt, Homo sapiens
gggaugaaauugugagcaa

SEQ ID NO: 1212497 - RNA, 19 nt, Homo sapiens
ugagauacaugaaccugaa

SEQ ID NO: 1212498 - RNA, 19 nt, Homo sapiens
ucaccaggcuccuauugaa

SEQ ID NO: 1212499 - RNA, 19 nt, Homo sapiens
caaauuaggccagauucua

SEQ ID NO: 1212500 - RNA, 19 nt, Homo sapiens
aaagcgacuuggugaauuu

SEQ ID NO: 1212501 - RNA, 19 nt, Homo sapiens
gcaagaucauauuaaggaa

SEQ ID NO: 1212502 - RNA, 19 nt, Homo sapiens
gggacgagauggacauaga

SEQ ID NO: 1212503 - RNA, 19 nt, Homo sapiens
guugauaguuuaagugugu

SEQ ID NO: 1212504 - RNA, 19 nt, Homo sapiens
ucucaagggucuucugaaa

SEQ ID NO: 1212505 - RNA, 19 nt, Homo sapiens
gcagguuacucugagaauu

SEQ ID NO: 1212506 - RNA, 19 nt, Homo sapiens
gcacccagaucaaccaaag

SEQ ID NO: 1212507 - RNA, 19 nt, Homo sapiens
acagaaaacuugcccaaua

SEQ ID NO: 1212508 - RNA, 19 nt, Homo sapiens
cccaguaccuuauggauga

SEQ ID NO: 1212509 - RNA, 19 nt, Homo sapiens
gggaagaaagggaaguaua

SEQ ID NO: 1212510 - RNA, 19 nt, Homo sapiens
ugaaggcuaucuccaguug

SEQ ID NO: 1212511 - RNA, 19 nt, Homo sapiens
gguacaugguggaugauuu

SEQ ID NO: 1212512 - RNA, 19 nt, Homo sapiens
ugaagacucuggccaaagu

SEQ ID NO: 1212513 - RNA, 19 nt, Homo sapiens
uggauacuccucuuauuua

SEQ ID NO: 1212514 - RNA, 19 nt, Homo sapiens
gugauugguuucauacuug

SEQ ID NO: 1212515 - RNA, 19 nt, Homo sapiens
agaauaaagugugugauug

SEQ ID NO: 1212516 - RNA, 19 nt, Homo sapiens
ggaaugcugaugaacaauu

SEQ ID NO: 1212517 - RNA, 19 nt, Homo sapiens
gaaacugguugcgaacuuc

SEQ ID NO: 1212518 - RNA, 19 nt, Homo sapiens
ggacuuagccaaugaugag

SEQ ID NO: 1212519 - RNA, 19 nt, Homo sapiens
gaugaacacauauauagga

SEQ ID NO: 1212520 - RNA, 19 nt, Homo sapiens
aaacuuaggacccaagauu

SEQ ID NO: 1212521 - RNA, 19 nt, Homo sapiens
ggaagaagcuggggaugaa

SEQ ID NO: 1212522 - RNA, 19 nt, Homo sapiens
caacuaugguggcaagauc

SEQ ID NO: 1212523 - RNA, 19 nt, Homo sapiens
cuucauagcaggaauugua

SEQ ID NO: 1212524 - RNA, 19 nt, Homo sapiens
uuacggcucucauaaagga

SEQ ID NO: 1212525 - RNA, 19 nt, Homo sapiens
ggagguugauaguuuaagu

SEQ ID NO: 1212526 - RNA, 19 nt, Homo sapiens
ggaacucuccaaagucauu

SEQ ID NO: 1212527 - RNA, 19 nt, Homo sapiens
caacaaccacacacauuug

SEQ ID NO: 1212528 - RNA, 19 nt, Homo sapiens
gagagggaacuguuaaaug

SEQ ID NO: 1212529 - RNA, 19 nt, Homo sapiens
cuacugacuuuguucuuau

SEQ ID NO: 1212530 - RNA, 19 nt, Homo sapiens
caacuggauacaaagcuua

SEQ ID NO: 1212531 - RNA, 19 nt, Homo sapiens
uuacugaccuguggaaugu

SEQ ID NO: 1212532 - RNA, 19 nt, Homo sapiens
ggagucugcugaccuucaa

SEQ ID NO: 1212533 - RNA, 19 nt, Homo sapiens
ggaaccagcuggacuuagc

SEQ ID NO: 1212534 - RNA, 19 nt, Homo sapiens
agacggauauaaaggaaga

SEQ ID NO: 1212535 - RNA, 19 nt, Homo sapiens
caaccaaagugagaaaugg

SEQ ID NO: 1212536 - RNA, 19 nt, Homo sapiens
gugagacagugguacguaa

SEQ ID NO: 1212537 - RNA, 19 nt, Homo sapiens
gaaacccggucucuacuaa

SEQ ID NO: 1212538 - RNA, 19 nt, Homo sapiens
gaagaaguguuuacaucaa

SEQ ID NO: 1212539 - RNA, 19 nt, Homo sapiens
gcaggaauauucagcuaaa

SEQ ID NO: 1212540 - RNA, 19 nt, Homo sapiens
gaagaacuuugcaauuaug

SEQ ID NO: 1212541 - RNA, 19 nt, Homo sapiens
gagaagaaguguuuacauc

SEQ ID NO: 1212542 - RNA, 19 nt, Homo sapiens
ggacacaguuuguuugaca

SEQ ID NO: 1212543 - RNA, 19 nt, Homo sapiens
gaaagagagugcaaugaag

SEQ ID NO: 1212544 - RNA, 19 nt, Homo sapiens
uuacuuggcuacuaucuuu

SEQ ID NO: 1212545 - RNA, 19 nt, Homo sapiens
gagcaagacuccaucucaa

SEQ ID NO: 1212546 - RNA, 19 nt, Homo sapiens
cauagacgccuucuguaua

SEQ ID NO: 1212547 - RNA, 19 nt, Homo sapiens
auagacgccuucuguauaa

SEQ ID NO: 1212548 - RNA, 19 nt, Homo sapiens
uguggaggaugcaggauua

SEQ ID NO: 1212549 - RNA, 19 nt, Homo sapiens
aggauuaccuucuuaugaa

SEQ ID NO: 1212550 - RNA, 19 nt, Homo sapiens
gauuugaucuggagcucuu

SEQ ID NO: 1212551 - RNA, 19 nt, Homo sapiens
gcacacucccuccaucauu

SEQ ID NO: 1212552 - RNA, 19 nt, Homo sapiens
ggaggcagagguugcagua

SEQ ID NO: 1212553 - RNA, 19 nt, Homo sapiens
cacacucccuccaucauuu

SEQ ID NO: 1212554 - RNA, 19 nt, Homo sapiens
caguggcgcugaccagaaa

SEQ ID NO: 1212555 - RNA, 19 nt, Homo sapiens
ggaauauucagcuaaagga

SEQ ID NO: 1212556 - RNA, 19 nt, Homo sapiens
agaaagagagugcaaugaa

SEQ ID NO: 1212557 - RNA, 19 nt, Homo sapiens
caacauccaugcucuucag

SEQ ID NO: 1212558 - RNA, 19 nt, Homo sapiens
ugaggaagccagagagauu

SEQ ID NO: 1212559 - RNA, 19 nt, Homo sapiens
gaugcaggauuaccuucuu

SEQ ID NO: 1212560 - RNA, 19 nt, Homo sapiens
auuaauugcugcuggagua

SEQ ID NO: 1212561 - RNA, 19 nt, Homo sapiens
caggauuaccuucuuauga

SEQ ID NO: 1212562 - RNA, 19 nt, Homo sapiens
gagcgucgccgagguuuga

SEQ ID NO: 1212563 - RNA, 19 nt, Homo sapiens
gcucuucagccgucuauga

SEQ ID NO: 1212564 - RNA, 19 nt, Homo sapiens
cuaaaggaccaaccacaaa

SEQ ID NO: 1212565 - RNA, 19 nt, Homo sapiens
gcuaaaggaccaaccacaa

SEQ ID NO: 1212566 - RNA, 19 nt, Homo sapiens
gauguuaugggccuucuga

SEQ ID NO: 1212567 - RNA, 19 nt, Homo sapiens
gaggaagccagagagauuu

SEQ ID NO: 1212568 - RNA, 19 nt, Homo sapiens
uggauuacuuggcuacuau

SEQ ID NO: 1212569 - RNA, 19 nt, Homo sapiens
ggaugaagauaaaacgauu

SEQ ID NO: 1212570 - RNA, 19 nt, Homo sapiens
aaagagagugcaaugaaga

SEQ ID NO: 1212571 - RNA, 19 nt, Homo sapiens
agagugcaaugaagaacuu

SEQ ID NO: 1212572 - RNA, 19 nt, Homo sapiens
auacauagacgccuucugu

SEQ ID NO: 1212573 - RNA, 19 nt, Homo sapiens
gagaucacgccacugcauu

SEQ ID NO: 1212574 - RNA, 19 nt, Homo sapiens
ggugaaacccggucucuac

SEQ ID NO: 1212575 - RNA, 19 nt, Homo sapiens
ccuucugacuggauuaauu

SEQ ID NO: 1212576 - RNA, 19 nt, Homo sapiens
ggagaagaaguguuuacau

SEQ ID NO: 1212577 - RNA, 19 nt, Homo sapiens
aauugcugcuggaguauuu

SEQ ID NO: 1212578 - RNA, 19 nt, Homo sapiens
ggcugaagcaggagaauug

SEQ ID NO: 1212579 - RNA, 19 nt, Homo sapiens
cuaugucucucccaucuca

SEQ ID NO: 1212580 - RNA, 19 nt, Homo sapiens
aaaaucagauggcaacaga

SEQ ID NO: 1212581 - RNA, 19 nt, Homo sapiens
cgacagagcaagacuccau

SEQ ID NO: 1212582 - RNA, 19 nt, Homo sapiens
ucucccaucucacugacua

SEQ ID NO: 1212583 - RNA, 19 nt, Homo sapiens
acaaaaggauuuaggguau

SEQ ID NO: 1212584 - RNA, 19 nt, Homo sapiens
gcaguggcgcugaccagaa

SEQ ID NO: 1212585 - RNA, 19 nt, Homo sapiens
acaguuuguuugacaguug

SEQ ID NO: 1212586 - RNA, 19 nt, Homo sapiens
uggcaggaauauucagcua

SEQ ID NO: 1212587 - RNA, 19 nt, Homo sapiens
caaugaagaacuuugcaau

SEQ ID NO: 1212588 - RNA, 19 nt, Homo sapiens
gcaggauuaccuucuuaug

SEQ ID NO: 1212589 - RNA, 19 nt, Homo sapiens
agacgccuucuguauaaua

SEQ ID NO: 1212590 - RNA, 19 nt, Homo sapiens
agaagaaguguuuacauca

SEQ ID NO: 1212591 - RNA, 19 nt, Homo sapiens
gcaagacuccaucucaaaa

SEQ ID NO: 1212592 - RNA, 19 nt, Homo sapiens
ggauuaccuucuuaugaac

SEQ ID NO: 1212593 - RNA, 19 nt, Homo sapiens
augcaggauuaccuucuua

SEQ ID NO: 1212594 - RNA, 19 nt, Homo sapiens
gacaguugccagacuaugu

SEQ ID NO: 1212595 - RNA, 19 nt, Homo sapiens
aggcagagguugcaguaag

SEQ ID NO: 1212596 - RNA, 19 nt, Homo sapiens
ccaucucacugacuaccuu

SEQ ID NO: 1212597 - RNA, 19 nt, Homo sapiens
ucagauggcaacagagaga

SEQ ID NO: 1212598 - RNA, 19 nt, Homo sapiens
ccuguaaucccagcacuuu

SEQ ID NO: 1212599 - RNA, 19 nt, Homo sapiens
ugaaacccggucucuacua

SEQ ID NO: 1212600 - RNA, 19 nt, Homo sapiens
cuagaaagagagugcaaug

SEQ ID NO: 1212601 - RNA, 19 nt, Homo sapiens
acauagacgccuucuguau

SEQ ID NO: 1212602 - RNA, 19 nt, Homo sapiens
caacagagagaaaauagau

SEQ ID NO: 1212603 - RNA, 19 nt, Homo sapiens
gagguccaaaggcuucuaa

SEQ ID NO: 1212604 - RNA, 19 nt, Homo sapiens
ccggcaaccuagaaagaga

SEQ ID NO: 1212605 - RNA, 19 nt, Homo sapiens
aaucagauggcaacagaga

SEQ ID NO: 1212606 - RNA, 19 nt, Homo sapiens
gacgccuucuguauaauag

SEQ ID NO: 1212607 - RNA, 19 nt, Homo sapiens
ccaggcccuucccagguuu

SEQ ID NO: 1212608 - RNA, 19 nt, Homo sapiens
caaaaggauuuaggguauu

SEQ ID NO: 1212609 - RNA, 19 nt, Homo sapiens
uaagcaugcgggagaagaa

SEQ ID NO: 1212610 - RNA, 19 nt, Homo sapiens
gaggaugcaggauuaccuu

SEQ ID NO: 1212611 - RNA, 19 nt, Homo sapiens
ggcaggaauauucagcuaa

SEQ ID NO: 1212612 - RNA, 19 nt, Homo sapiens
uuugacaguugccagacua

SEQ ID NO: 1212613 - RNA, 19 nt, Homo sapiens
gcuacuaucuuuguaucac

SEQ ID NO: 1212614 - RNA, 19 nt, Homo sapiens
uagaaagagagugcaauga

SEQ ID NO: 1212615 - RNA, 19 nt, Homo sapiens
agagcaagacuccaucuca

SEQ ID NO: 1212616 - RNA, 19 nt, Homo sapiens
gggagaagaaguguuuaca

SEQ ID NO: 1212617 - RNA, 19 nt, Homo sapiens
uggcuacuaucuuuguauc

SEQ ID NO: 1212618 - RNA, 19 nt, Homo sapiens
uaaaggaccaaccacaaaa

SEQ ID NO: 1212619 - RNA, 19 nt, Homo sapiens
gaagauaaaacgauugcau

SEQ ID NO: 1212620 - RNA, 19 nt, Homo sapiens
caaaagaagaagcaaacuu

SEQ ID NO: 1212621 - RNA, 19 nt, Homo sapiens
uuggauuacuuggcuacua

SEQ ID NO: 1212622 - RNA, 19 nt, Homo sapiens
ggcagagguugcaguaagc

SEQ ID NO: 1212623 - RNA, 19 nt, Homo sapiens
acaguugccagacuauguu

SEQ ID NO: 1212624 - RNA, 19 nt, Homo sapiens
cgccuucuguauaauagau

SEQ ID NO: 1212625 - RNA, 19 nt, Homo sapiens
cuucugacuggauuaauug

SEQ ID NO: 1212626 - RNA, 19 nt, Homo sapiens
ggaacuggcuucucuuaug

SEQ ID NO: 1212627 - RNA, 19 nt, Homo sapiens
gagcucagaugccauguau

SEQ ID NO: 1212628 - RNA, 19 nt, Homo sapiens
ggaagucaguugucagaga

SEQ ID NO: 1212629 - RNA, 19 nt, Homo sapiens
ccaaauaauucccuaacug

SEQ ID NO: 1212630 - RNA, 19 nt, Homo sapiens
caaaugcagucuacucugu

SEQ ID NO: 1212631 - RNA, 19 nt, Homo sapiens
gaacuggcuucucuuaugc

SEQ ID NO: 1212632 - RNA, 19 nt, Homo sapiens
ugauuucuguccuugcuua

SEQ ID NO: 1212633 - RNA, 19 nt, Homo sapiens
gcucagaugccauguaugu

SEQ ID NO: 1212634 - RNA, 19 nt, Homo sapiens
caaauaauucccuaacugu

SEQ ID NO: 1212635 - RNA, 19 nt, Homo sapiens
ccuccaacauccugucuuu

SEQ ID NO: 1212636 - RNA, 19 nt, Homo sapiens
uuuccgaggucuccuauuu

SEQ ID NO: 1212637 - RNA, 19 nt, Homo sapiens
ggaggucaaggaaguguuu

SEQ ID NO: 1212638 - RNA, 19 nt, Homo sapiens
ggcuguaucuccucaucua

SEQ ID NO: 1212639 - RNA, 19 nt, Homo sapiens
ggaccacgcaugagucgaa

SEQ ID NO: 1212640 - RNA, 19 nt, Homo sapiens
gagagugcauggaggagau

SEQ ID NO: 1212641 - RNA, 19 nt, Homo sapiens
gaaguugcaaagauucauu

SEQ ID NO: 1212642 - RNA, 19 nt, Homo sapiens
ggacagggacaaggacuga

SEQ ID NO: 1212643 - RNA, 19 nt, Homo sapiens
ggaauaaccccauugaguu

SEQ ID NO: 1212644 - RNA, 19 nt, Homo sapiens
gagcaucauggcaguguuu

SEQ ID NO: 1212645 - RNA, 19 nt, Homo sapiens
gaaaggguacccaaaugca

SEQ ID NO: 1212646 - RNA, 19 nt, Homo sapiens
uggaaaggguacccaaaug

SEQ ID NO: 1212647 - RNA, 19 nt, Homo sapiens
ucucugagguccuuuccaa

SEQ ID NO: 1212648 - RNA, 19 nt, Homo sapiens
caggaacuggcuucucuua

SEQ ID NO: 1212649 - RNA, 19 nt, Homo sapiens
ccacugucacuguugauuu

SEQ ID NO: 1212650 - RNA, 19 nt, Homo sapiens
gacaaguagugggacguuu

SEQ ID NO: 1212651 - RNA, 19 nt, Homo sapiens
guacccaaaugcagucuac

SEQ ID NO: 1212652 - RNA, 19 nt, Homo sapiens
ccuccuuguugccaaauaa

SEQ ID NO: 1212653 - RNA, 19 nt, Homo sapiens
uauagaugcucagaacaug

SEQ ID NO: 1212654 - RNA, 19 nt, Homo sapiens
cugagguccuuuccaauug

SEQ ID NO: 1212655 - RNA, 19 nt, Homo sapiens
cacugucacuguugauuug

SEQ ID NO: 1212656 - RNA, 19 nt, Homo sapiens
caaaguacgaggagauagu

SEQ ID NO: 1212657 - RNA, 19 nt, Homo sapiens
ggaggugccagcugcagaa

SEQ ID NO: 1212658 - RNA, 19 nt, Homo sapiens
ggaaaggguacccaaaugc

SEQ ID NO: 1212659 - RNA, 19 nt, Homo sapiens
uggaggagaucugcagcua

SEQ ID NO: 1212660 - RNA, 19 nt, Homo sapiens
ggguggcacugcugauugu

SEQ ID NO: 1212661 - RNA, 19 nt, Homo sapiens
aaacagccuuagccuccuu

SEQ ID NO: 1212662 - RNA, 19 nt, Homo sapiens
ggguagggaccacgcauga

SEQ ID NO: 1212663 - RNA, 19 nt, Homo sapiens
gccaaauaauucccuaacu

SEQ ID NO: 1212664 - RNA, 19 nt, Homo sapiens
gucaucgccuuguucauca

SEQ ID NO: 1212665 - RNA, 19 nt, Homo sapiens
ggccaaggaugcccauucg

SEQ ID NO: 1212666 - RNA, 19 nt, Homo sapiens
ucugagguccuuuccaauu

SEQ ID NO: 1212667 - RNA, 19 nt, Homo sapiens
gaauaaccccauugaguug

SEQ ID NO: 1212668 - RNA, 19 nt, Homo sapiens
acgaggaggucaaggaagu

SEQ ID NO: 1212669 - RNA, 19 nt, Homo sapiens
ggagcaucauggcaguguu

SEQ ID NO: 1212670 - RNA, 19 nt, Homo sapiens
auuggaaguugcaaagauu

SEQ ID NO: 1212671 - RNA, 19 nt, Homo sapiens
agccuuagccuccuuguug

SEQ ID NO: 1212672 - RNA, 19 nt, Homo sapiens
aauuggaaguugcaaagau

SEQ ID NO: 1212673 - RNA, 19 nt, Homo sapiens
ccaauuggaaguugcaaag

SEQ ID NO: 1212674 - RNA, 19 nt, Homo sapiens
guagggaccacgcaugagu

SEQ ID NO: 1212675 - RNA, 19 nt, Homo sapiens
ggugccagcugcagaaagc

SEQ ID NO: 1212676 - RNA, 19 nt, Homo sapiens
gcuacgaggaggucaagga

SEQ ID NO: 1212677 - RNA, 19 nt, Homo sapiens
ucuuauagaugcucagaac

SEQ ID NO: 1212678 - RNA, 19 nt, Homo sapiens
ggaagagccaaaggccaaa

SEQ ID NO: 1212679 - RNA, 19 nt, Homo sapiens
ccaaaggaauaaccccauu

SEQ ID NO: 1212680 - RNA, 19 nt, Homo sapiens
uugauuugcuuaaccuugu

SEQ ID NO: 1212681 - RNA, 19 nt, Homo sapiens
uagaugcucagaacauguu

SEQ ID NO: 1212682 - RNA, 19 nt, Homo sapiens
uaggaagucaguugucaga

SEQ ID NO: 1212683 - RNA, 19 nt, Homo sapiens
acaaguagugggacguuug

SEQ ID NO: 1212684 - RNA, 19 nt, Homo sapiens
ugccauguaugugguggua

SEQ ID NO: 1212685 - RNA, 19 nt, Homo sapiens
caaguagugggacguuugu

SEQ ID NO: 1212686 - RNA, 19 nt, Homo sapiens
ucacuguugauuugcuuaa

SEQ ID NO: 1212687 - RNA, 19 nt, Homo sapiens
caaggaaguguuugagaac

SEQ ID NO: 1212688 - RNA, 19 nt, Homo sapiens
cuacgaggaggucaaggaa

SEQ ID NO: 1212689 - RNA, 19 nt, Homo sapiens
ugucugagcccgucucucu

SEQ ID NO: 1212690 - RNA, 19 nt, Homo sapiens
aaacgauggaguucuggaa

SEQ ID NO: 1212691 - RNA, 19 nt, Homo sapiens
cauccugucuuuccaucag

SEQ ID NO: 1212692 - RNA, 19 nt, Homo sapiens
ccaacauccugucuuucca

SEQ ID NO: 1212693 - RNA, 19 nt, Homo sapiens
uguccuugcuuacauuugg

SEQ ID NO: 1212694 - RNA, 19 nt, Homo sapiens
caacauccugucuuuccau

SEQ ID NO: 1212695 - RNA, 19 nt, Homo sapiens
ugagguccuuuccaauugg

SEQ ID NO: 1212696 - RNA, 19 nt, Homo sapiens
cagcugagggagcaucaug

SEQ ID NO: 1212697 - RNA, 19 nt, Homo sapiens
gggaaaacgcugaaagguu

SEQ ID NO: 1212698 - RNA, 19 nt, Homo sapiens
uuuaggaagucaguuguca

SEQ ID NO: 1212699 - RNA, 19 nt, Homo sapiens
uagccuccuuguugccaaa

SEQ ID NO: 1212700 - RNA, 19 nt, Homo sapiens
gaggucuccuauuuucuuu

SEQ ID NO: 1212701 - RNA, 19 nt, Homo sapiens
gaggccagcgugucuuaca

SEQ ID NO: 1212702 - RNA, 19 nt, Homo sapiens
ugauugucaucgccuuguu

SEQ ID NO: 1212703 - RNA, 19 nt, Homo sapiens
cgauggaguucuggaaagg

SEQ ID NO: 1212704 - RNA, 19 nt, Homo sapiens
uguaucuccucaucuaucu

SEQ ID NO: 1212705 - RNA, 19 nt, Homo sapiens
cccaaaguacgaggagaua

SEQ ID NO: 1212706 - RNA, 19 nt, Homo sapiens
gcaggacucuuucuguuca

SEQ ID NO: 1212707 - RNA, 19 nt, Homo sapiens
ggagcugccugaugaguuc

SEQ ID NO: 1212708 - RNA, 19 nt, Homo sapiens
cagcaggaauaaagacuug

SEQ ID NO: 1212709 - RNA, 19 nt, Homo sapiens
gacaucaucuucagcuaag

SEQ ID NO: 1212710 - RNA, 19 nt, Homo sapiens
gugaauaugaucugaaguu

SEQ ID NO: 1212711 - RNA, 19 nt, Homo sapiens
cagcuaaguugccgaaguc

SEQ ID NO: 1212712 - RNA, 19 nt, Homo sapiens
ucagggaggcgcagauaaa

SEQ ID NO: 1212713 - RNA, 19 nt, Homo sapiens
uggcccagcucaagaguga

SEQ ID NO: 1212714 - RNA, 19 nt, Homo sapiens
ugacaucaucuucagcuaa

SEQ ID NO: 1212715 - RNA, 19 nt, Homo sapiens
gaauaugaucugaaguuuc

SEQ ID NO: 1212716 - RNA, 19 nt, Homo sapiens
ggaauaaagacuugugcau

SEQ ID NO: 1212717 - RNA, 19 nt, Homo sapiens
ccacgaggccucugacauc

SEQ ID NO: 1212718 - RNA, 19 nt, Homo sapiens
gggaggcgcagauaaagga

SEQ ID NO: 1212719 - RNA, 19 nt, Homo sapiens
caucagguuugucaugaag

SEQ ID NO: 1212720 - RNA, 19 nt, Homo sapiens
gggagcuucucagccauuu

SEQ ID NO: 1212721 - RNA, 19 nt, Homo sapiens
cgagguugcaggacucuuu

SEQ ID NO: 1212722 - RNA, 19 nt, Homo sapiens
cgaggccucugacaucauc

SEQ ID NO: 1212723 - RNA, 19 nt, Homo sapiens
uugcaggacucuuucuguu

SEQ ID NO: 1212724 - RNA, 19 nt, Homo sapiens
ucagguuugucaugaagug

SEQ ID NO: 1212725 - RNA, 19 nt, Homo sapiens
gcaggaauaaagacuugug

SEQ ID NO: 1212726 - RNA, 19 nt, Homo sapiens
ucagcuaaguugccgaagu

SEQ ID NO: 1212727 - RNA, 19 nt, Homo sapiens
ccaucagguuugucaugaa

SEQ ID NO: 1212728 - RNA, 19 nt, Homo sapiens
gguuugucaugaagugcua

SEQ ID NO: 1212729 - RNA, 19 nt, Homo sapiens
gcgagcacacucaggagaa

SEQ ID NO: 1212730 - RNA, 19 nt, Homo sapiens
acacgcagacccucuuuca

SEQ ID NO: 1212731 - RNA, 19 nt, Homo sapiens
accccgagcugucauuuua

SEQ ID NO: 1212732 - RNA, 19 nt, Homo sapiens
caucaucuucagcuaaguu

SEQ ID NO: 1212733 - RNA, 19 nt, Homo sapiens
uugccaaccugcccaacaa

SEQ ID NO: 1212734 - RNA, 19 nt, Homo sapiens
gcuguugccgauaaaguug

SEQ ID NO: 1212735 - RNA, 19 nt, Homo sapiens
cacgaggccucugacauca

SEQ ID NO: 1212736 - RNA, 19 nt, Homo sapiens
aggcgcagauaaaggagaa

SEQ ID NO: 1212737 - RNA, 19 nt, Homo sapiens
gacgguggacgacgugaga

SEQ ID NO: 1212738 - RNA, 19 nt, Homo sapiens
gcagcgccaccaucagguu

SEQ ID NO: 1212739 - RNA, 19 nt, Homo sapiens
ccacacgcagacccucuuu

SEQ ID NO: 1212740 - RNA, 19 nt, Homo sapiens
gcugccugaugaguucuuu

SEQ ID NO: 1212741 - RNA, 19 nt, Homo sapiens
accaucagguuugucauga

SEQ ID NO: 1212742 - RNA, 19 nt, Homo sapiens
gacuugugcaucccucaaa

SEQ ID NO: 1212743 - RNA, 19 nt, Homo sapiens
ggcuguugccgauaaaguu

SEQ ID NO: 1212744 - RNA, 19 nt, Homo sapiens
ggacaaaacuggacacuuc

SEQ ID NO: 1212745 - RNA, 19 nt, Homo sapiens
gacaaggucucgcuauguu

SEQ ID NO: 1212746 - RNA, 19 nt, Homo sapiens
uaccggagcuugugaagaa

SEQ ID NO: 1212747 - RNA, 19 nt, Homo sapiens
acaaggaggucaagauuca

SEQ ID NO: 1212748 - RNA, 19 nt, Homo sapiens
guucacaccuguuguaauc

SEQ ID NO: 1212749 - RNA, 19 nt, Homo sapiens
ggucaagauucauuaacaa

SEQ ID NO: 1212750 - RNA, 19 nt, Homo sapiens
ugaagucccugccaugcua

SEQ ID NO: 1212751 - RNA, 19 nt, Homo sapiens
gaccuugucucuauuuaca

SEQ ID NO: 1212752 - RNA, 19 nt, Homo sapiens
gaagaaaugaccucaaguc

SEQ ID NO: 1212753 - RNA, 19 nt, Homo sapiens
caacauagcgagaccuugu

SEQ ID NO: 1212754 - RNA, 19 nt, Homo sapiens
gcagcugccuaacaguaaa

SEQ ID NO: 1212755 - RNA, 19 nt, Homo sapiens
gugaagaaaugaccucaag

SEQ ID NO: 1212756 - RNA, 19 nt, Homo sapiens
aaacgccaaucuuagaaug

SEQ ID NO: 1212757 - RNA, 19 nt, Homo sapiens
ggaggucaagauucauuaa

SEQ ID NO: 1212758 - RNA, 19 nt, Homo sapiens
aaacuggacacuucccuaa

SEQ ID NO: 1212759 - RNA, 19 nt, Homo sapiens
ggacacuucccuaacacaa

SEQ ID NO: 1212760 - RNA, 19 nt, Homo sapiens
acacaaggaggucaagauu

SEQ ID NO: 1212761 - RNA, 19 nt, Homo sapiens
ggagccagguguguugguu

SEQ ID NO: 1212762 - RNA, 19 nt, Homo sapiens
guuguaaucccagcacuuu

SEQ ID NO: 1212763 - RNA, 19 nt, Homo sapiens
caaaggccgacgcuucuau

SEQ ID NO: 1212764 - RNA, 19 nt, Homo sapiens
acgcuucuauuuccucuug

SEQ ID NO: 1212765 - RNA, 19 nt, Homo sapiens
ugaagcagguaucuugcau

SEQ ID NO: 1212766 - RNA, 19 nt, Homo sapiens
ucacaguuccuuugaagca

SEQ ID NO: 1212767 - RNA, 19 nt, Homo sapiens
aaauaaaggagcagucauc

SEQ ID NO: 1212768 - RNA, 19 nt, Homo sapiens
gacacuucccuaacacaaa

SEQ ID NO: 1212769 - RNA, 19 nt, Homo sapiens
ggccgacgcuucuauuucc

SEQ ID NO: 1212770 - RNA, 19 nt, Homo sapiens
uaacaaccagggucacaca

SEQ ID NO: 1212771 - RNA, 19 nt, Homo sapiens
caaggucucgcuauguugu

SEQ ID NO: 1212772 - RNA, 19 nt, Homo sapiens
ucuauuuccucuuggacaa

SEQ ID NO: 1212773 - RNA, 19 nt, Homo sapiens
caugcuaccucugaaaguc

SEQ ID NO: 1212774 - RNA, 19 nt, Homo sapiens
acacuucccuaacacaaaa

SEQ ID NO: 1212775 - RNA, 19 nt, Homo sapiens
acuggacacuucccuaaca

SEQ ID NO: 1212776 - RNA, 19 nt, Homo sapiens
acaaauaaaggagcaguca

SEQ ID NO: 1212777 - RNA, 19 nt, Homo sapiens
ccauuucacaguuccuuug

SEQ ID NO: 1212778 - RNA, 19 nt, Homo sapiens
aggucaagauucauuaaca

SEQ ID NO: 1212779 - RNA, 19 nt, Homo sapiens
gcuucuauuuccucuugga

SEQ ID NO: 1212780 - RNA, 19 nt, Homo sapiens
cggagcuugugaagaaaug

SEQ ID NO: 1212781 - RNA, 19 nt, Homo sapiens
aaaggccgacgcuucuauu

SEQ ID NO: 1212782 - RNA, 19 nt, Homo sapiens
cuuugaagcagguaucuug

SEQ ID NO: 1212783 - RNA, 19 nt, Homo sapiens
uagaauggaguaacaacca

SEQ ID NO: 1212784 - RNA, 19 nt, Homo sapiens
gaaaauggcucccuuauca

SEQ ID NO: 1212785 - RNA, 19 nt, Homo sapiens
ugacagaacuggacaucua

SEQ ID NO: 1212786 - RNA, 19 nt, Homo sapiens
guacaugaauugcuucuug

SEQ ID NO: 1212787 - RNA, 19 nt, Homo sapiens
aagaauggcuucacaugua

SEQ ID NO: 1212788 - RNA, 19 nt, Homo sapiens
gaauaugcauccacagaga

SEQ ID NO: 1212789 - RNA, 19 nt, Homo sapiens
ggaccuggcucucuguuuc

SEQ ID NO: 1212790 - RNA, 19 nt, Homo sapiens
gaagguuucuaaauuguag

SEQ ID NO: 1212791 - RNA, 19 nt, Homo sapiens
ggucauugcuggugucuuc

SEQ ID NO: 1212792 - RNA, 19 nt, Homo sapiens
ccaaguacaugaauugcuu

SEQ ID NO: 1212793 - RNA, 19 nt, Homo sapiens
ggacuaugacauccuauuu

SEQ ID NO: 1212794 - RNA, 19 nt, Homo sapiens
uuauugcccucaccauuua

SEQ ID NO: 1212795 - RNA, 19 nt, Homo sapiens
ugacacugcuggccaagaa

SEQ ID NO: 1212796 - RNA, 19 nt, Homo sapiens
aaagggaguuugaccagaa

SEQ ID NO: 1212797 - RNA, 19 nt, Homo sapiens
gaauugcgcugcccgaacu

SEQ ID NO: 1212798 - RNA, 19 nt, Homo sapiens
guacaaggcaguguucauu

SEQ ID NO: 1212799 - RNA, 19 nt, Homo sapiens
gagaaccugugccaacugu

SEQ ID NO: 1212800 - RNA, 19 nt, Homo sapiens
agacagaggccucagugua

SEQ ID NO: 1212801 - RNA, 19 nt, Homo sapiens
ggauuggcaucgcuaacuu

SEQ ID NO: 1212802 - RNA, 19 nt, Homo sapiens
ugucugcccuuccguauug

SEQ ID NO: 1212803 - RNA, 19 nt, Homo sapiens
ggacggcuccucugagugu

SEQ ID NO: 1212804 - RNA, 19 nt, Homo sapiens
caagggaggugccaacacu

SEQ ID NO: 1212805 - RNA, 19 nt, Homo sapiens
gaaccugagcggcauguau

SEQ ID NO: 1212806 - RNA, 19 nt, Homo sapiens
ccacaaacgugagcugaca

SEQ ID NO: 1212807 - RNA, 19 nt, Homo sapiens
ggagaucuuugagcucaug

SEQ ID NO: 1212808 - RNA, 19 nt, Homo sapiens
gagccugcaugcccucuau

SEQ ID NO: 1212809 - RNA, 19 nt, Homo sapiens
gcacgcugcuggucacucu

SEQ ID NO: 1212810 - RNA, 19 nt, Homo sapiens
gcucucuguuucucaauga

SEQ ID NO: 1212811 - RNA, 19 nt, Homo sapiens
gccuggugcugucagaaua

SEQ ID NO: 1212812 - RNA, 19 nt, Homo sapiens
gcucaugcaguuccucuuu

SEQ ID NO: 1212813 - RNA, 19 nt, Homo sapiens
cauccuggcugugcuuauu

SEQ ID NO: 1212814 - RNA, 19 nt, Homo sapiens
ucuuugagcucaugcaguu

SEQ ID NO: 1212815 - RNA, 19 nt, Homo sapiens
gcgcuacgguggcaucaca

SEQ ID NO: 1212816 - RNA, 19 nt, Homo sapiens
agaauggcuucacauguau

SEQ ID NO: 1212817 - RNA, 19 nt, Homo sapiens
ggagcaggauggaaauacu

SEQ ID NO: 1212818 - RNA, 19 nt, Homo sapiens
gcucugcgcaucccuaugu

SEQ ID NO: 1212819 - RNA, 19 nt, Homo sapiens
ucagcugcguggacuauga

SEQ ID NO: 1212820 - RNA, 19 nt, Homo sapiens
gcccagcucuuccaguaca

SEQ ID NO: 1212821 - RNA, 19 nt, Homo sapiens
guacaacuuugagcugauc

SEQ ID NO: 1212822 - RNA, 19 nt, Homo sapiens
gcagaaggagcaccagauc

SEQ ID NO: 1212823 - RNA, 19 nt, Homo sapiens
ucuauaacauuugcugcua

SEQ ID NO: 1212824 - RNA, 19 nt, Homo sapiens
gaccguguacagcuugaua

SEQ ID NO: 1212825 - RNA, 19 nt, Homo sapiens
cagaauaugcauccacaga

SEQ ID NO: 1212826 - RNA, 19 nt, Homo sapiens
uuauagacuucuuccgaaa

SEQ ID NO: 1212827 - RNA, 19 nt, Homo sapiens
uugcccagcucuuccagua

SEQ ID NO: 1212828 - RNA, 19 nt, Homo sapiens
gcagacccgggacgaguuu

SEQ ID NO: 1212829 - RNA, 19 nt, Homo sapiens
ccucaaggccgaguacaaa

SEQ ID NO: 1212830 - RNA, 19 nt, Homo sapiens
gacagaggccucaguguac

SEQ ID NO: 1212831 - RNA, 19 nt, Homo sapiens
gacuaugacauccuauuug

SEQ ID NO: 1212832 - RNA, 19 nt, Homo sapiens
gagcaggauggaaauacuu

SEQ ID NO: 1212833 - RNA, 19 nt, Homo sapiens
gggagaaccugugccaacu

SEQ ID NO: 1212834 - RNA, 19 nt, Homo sapiens
gcaguuccucuuugugguu

SEQ ID NO: 1212835 - RNA, 19 nt, Homo sapiens
gaaaaugcccucuuuacgu

SEQ ID NO: 1212836 - RNA, 19 nt, Homo sapiens
cuuauugcccucaccauuu

SEQ ID NO: 1212837 - RNA, 19 nt, Homo sapiens
uguaggagcaggauggaaa

SEQ ID NO: 1212838 - RNA, 19 nt, Homo sapiens
cguggacuaugacauccua

SEQ ID NO: 1212839 - RNA, 19 nt, Homo sapiens
uuacgucuauccaguccuu

SEQ ID NO: 1212840 - RNA, 19 nt, Homo sapiens
caccauuuaugacgaagau

SEQ ID NO: 1212841 - RNA, 19 nt, Homo sapiens
ccagaucugcauccacaaa

SEQ ID NO: 1212842 - RNA, 19 nt, Homo sapiens
cuacugaacccgucaaggu

SEQ ID NO: 1212843 - RNA, 19 nt, Homo sapiens
gcuugauaacccuuaauaa

SEQ ID NO: 1212844 - RNA, 19 nt, Homo sapiens
gggcccucauugcugcuua

SEQ ID NO: 1212845 - RNA, 19 nt, Homo sapiens
ugagagcacagccuuccua

SEQ ID NO: 1212846 - RNA, 19 nt, Homo sapiens
ggauggaaagacagaguug

SEQ ID NO: 1212847 - RNA, 19 nt, Homo sapiens
ucacagauccuggcacagu

SEQ ID NO: 1212848 - RNA, 19 nt, Homo sapiens
gcuuauugcccucaccauu

SEQ ID NO: 1212849 - RNA, 19 nt, Homo sapiens
guucaucuauaacauuugc

SEQ ID NO: 1212850 - RNA, 19 nt, Homo sapiens
acaaggcaguguucauuuu

SEQ ID NO: 1212851 - RNA, 19 nt, Homo sapiens
ccucaccauuuaugacgaa

SEQ ID NO: 1212852 - RNA, 19 nt, Homo sapiens
ccucauugcugcuuaucgu

SEQ ID NO: 1212853 - RNA, 19 nt, Homo sapiens
ucaugcaguuccucuuugu

SEQ ID NO: 1212854 - RNA, 19 nt, Homo sapiens
ccucaaccguggcuacaag

SEQ ID NO: 1212855 - RNA, 19 nt, Homo sapiens
cauccuauuugccaacaag

SEQ ID NO: 1212856 - RNA, 19 nt, Homo sapiens
uacaaggcaguguucauuu

SEQ ID NO: 1212857 - RNA, 19 nt, Homo sapiens
uacaugaauugcuucuugu

SEQ ID NO: 1212858 - RNA, 19 nt, Homo sapiens
ucuaugccuucuucagcua

SEQ ID NO: 1212859 - RNA, 19 nt, Homo sapiens
ggagauuauagacuucuuc

SEQ ID NO: 1212860 - RNA, 19 nt, Homo sapiens
cccguggucucaaguacaa

SEQ ID NO: 1212861 - RNA, 19 nt, Homo sapiens
uggcacugguuaacaaauc

SEQ ID NO: 1212862 - RNA, 19 nt, Homo sapiens
agaaggagcaccagaucug

SEQ ID NO: 1212863 - RNA, 19 nt, Homo sapiens
gcuuaucaaguucaucuau

SEQ ID NO: 1212864 - RNA, 19 nt, Homo sapiens
uccaccggcuuaucaaguu

SEQ ID NO: 1212865 - RNA, 19 nt, Homo sapiens
aagggaguuugaccagaaa

SEQ ID NO: 1212866 - RNA, 19 nt, Homo sapiens
cgauagaagcugccaagca

SEQ ID NO: 1212867 - RNA, 19 nt, Homo sapiens
cagaguguggugcuagaaa

SEQ ID NO: 1212868 - RNA, 19 nt, Homo sapiens
ccuccaaguacaugaauug

SEQ ID NO: 1212869 - RNA, 19 nt, Homo sapiens
gcugcuaccuccgccacuu

SEQ ID NO: 1212870 - RNA, 19 nt, Homo sapiens
aauccucuaugccuucuuc

SEQ ID NO: 1212871 - RNA, 19 nt, Homo sapiens
acuuugagcugauccucuu

SEQ ID NO: 1212872 - RNA, 19 nt, Homo sapiens
aacgugagcugacagaacu

SEQ ID NO: 1212873 - RNA, 19 nt, Homo sapiens
acagcuugauaacccuuaa

SEQ ID NO: 1212874 - RNA, 19 nt, Homo sapiens
uugggagaguggugaauug

SEQ ID NO: 1212875 - RNA, 19 nt, Homo sapiens
gcaggauggaaauacuuug

SEQ ID NO: 1212876 - RNA, 19 nt, Homo sapiens
ucaccucucuccgcuucuu

SEQ ID NO: 1212877 - RNA, 19 nt, Homo sapiens
ggucagcugcguggacuau

SEQ ID NO: 1212878 - RNA, 19 nt, Homo sapiens
cccuggagauuauagacuu

SEQ ID NO: 1212879 - RNA, 19 nt, Homo sapiens
caaauccucuaugccuucu

SEQ ID NO: 1212880 - RNA, 19 nt, Homo sapiens
gggugaccuuggcugugua

SEQ ID NO: 1212881 - RNA, 19 nt, Homo sapiens
acuaugacauccuauuugc

SEQ ID NO: 1212882 - RNA, 19 nt, Homo sapiens
ccuuaucgcaaauguggua

SEQ ID NO: 1212883 - RNA, 19 nt, Homo sapiens
uauggcaaauccucuaugc

SEQ ID NO: 1212884 - RNA, 19 nt, Homo sapiens
ggacaaaccuccugacuuu

SEQ ID NO: 1212885 - RNA, 19 nt, Homo sapiens
caacagaaguggaugauau

SEQ ID NO: 1212886 - RNA, 19 nt, Homo sapiens
ggaaacguguugauaguaa

SEQ ID NO: 1212887 - RNA, 19 nt, Homo sapiens
guacuuaccuacucacauu

SEQ ID NO: 1212888 - RNA, 19 nt, Homo sapiens
gauaguaacuugcuuugga

SEQ ID NO: 1212889 - RNA, 19 nt, Homo sapiens
gaauuguggucaucaguaa

SEQ ID NO: 1212890 - RNA, 19 nt, Homo sapiens
guagguagcuuaagaaggu

SEQ ID NO: 1212891 - RNA, 19 nt, Homo sapiens
gagagaaaccuuaguaaug

SEQ ID NO: 1212892 - RNA, 19 nt, Homo sapiens
cuacauacguaaccaaauu

SEQ ID NO: 1212893 - RNA, 19 nt, Homo sapiens
gaagagugagccuuaauuu

SEQ ID NO: 1212894 - RNA, 19 nt, Homo sapiens
guagcacgauguggaauua

SEQ ID NO: 1212895 - RNA, 19 nt, Homo sapiens
uuaagaaggucucagauau

SEQ ID NO: 1212896 - RNA, 19 nt, Homo sapiens
ggagaaggcagcauacuga

SEQ ID NO: 1212897 - RNA, 19 nt, Homo sapiens
ggaauuaucccucaaagca

SEQ ID NO: 1212898 - RNA, 19 nt, Homo sapiens
gaacugcugugccuuaacu

SEQ ID NO: 1212899 - RNA, 19 nt, Homo sapiens
aagaaggucucagauauuu

SEQ ID NO: 1212900 - RNA, 19 nt, Homo sapiens
caacagaaagcccucagua

SEQ ID NO: 1212901 - RNA, 19 nt, Homo sapiens
gaacagggaucugaugaac

SEQ ID NO: 1212902 - RNA, 19 nt, Homo sapiens
ggagguggacgaugccuua

SEQ ID NO: 1212903 - RNA, 19 nt, Homo sapiens
gaagaggaauugacauagg

SEQ ID NO: 1212904 - RNA, 19 nt, Homo sapiens
ggcagaaggaggugaauua

SEQ ID NO: 1212905 - RNA, 19 nt, Homo sapiens
gauggaagagugagccuua

SEQ ID NO: 1212906 - RNA, 19 nt, Homo sapiens
gaaaccuccugcacaguug

SEQ ID NO: 1212907 - RNA, 19 nt, Homo sapiens
uaagcagcauguucagaua

SEQ ID NO: 1212908 - RNA, 19 nt, Homo sapiens
gaugauauguguuucaacu

SEQ ID NO: 1212909 - RNA, 19 nt, Homo sapiens
gagcguaucaucugcguuu

SEQ ID NO: 1212910 - RNA, 19 nt, Homo sapiens
guuaugagguggaguuuua

SEQ ID NO: 1212911 - RNA, 19 nt, Homo sapiens
ugauaaacguuaagaagga

SEQ ID NO: 1212912 - RNA, 19 nt, Homo sapiens
ggaauuguggucaucagua

SEQ ID NO: 1212913 - RNA, 19 nt, Homo sapiens
caaagagucuggcaauagg

SEQ ID NO: 1212914 - RNA, 19 nt, Homo sapiens
gaaaacuccuggauucauu

SEQ ID NO: 1212915 - RNA, 19 nt, Homo sapiens
caaaguaacguacacugaa

SEQ ID NO: 1212916 - RNA, 19 nt, Homo sapiens
ucaccaggauucugacaaa

SEQ ID NO: 1212917 - RNA, 19 nt, Homo sapiens
ggaagagugagccuuaauu

SEQ ID NO: 1212918 - RNA, 19 nt, Homo sapiens
ggagagaaaccuuaguaau

SEQ ID NO: 1212919 - RNA, 19 nt, Homo sapiens
gggccuaccuugcaucaau

SEQ ID NO: 1212920 - RNA, 19 nt, Homo sapiens
acagaaagcccucaguaaa

SEQ ID NO: 1212921 - RNA, 19 nt, Homo sapiens
gaaggaauuaucccucaaa

SEQ ID NO: 1212922 - RNA, 19 nt, Homo sapiens
caugacagucuacaacuua

SEQ ID NO: 1212923 - RNA, 19 nt, Homo sapiens
ggagacggcggaaggcaua

SEQ ID NO: 1212924 - RNA, 19 nt, Homo sapiens
ccugauggaugcucuuaaa

SEQ ID NO: 1212925 - RNA, 19 nt, Homo sapiens
ggaaggagcagcagagucu

SEQ ID NO: 1212926 - RNA, 19 nt, Homo sapiens
ggucaucaguaacaacaga

SEQ ID NO: 1212927 - RNA, 19 nt, Homo sapiens
guaguguggucauuuacaa

SEQ ID NO: 1212928 - RNA, 19 nt, Homo sapiens
ggaauuaucuucgaaaaca

SEQ ID NO: 1212929 - RNA, 19 nt, Homo sapiens
agaaggaggugaauuagag

SEQ ID NO: 1212930 - RNA, 19 nt, Homo sapiens
gaagaccuccgccuaguuc

SEQ ID NO: 1212931 - RNA, 19 nt, Homo sapiens
agaaguggaugauaugugu

SEQ ID NO: 1212932 - RNA, 19 nt, Homo sapiens
gagacuaauucccacaguu

SEQ ID NO: 1212933 - RNA, 19 nt, Homo sapiens
gaguaacuguguccuugaa

SEQ ID NO: 1212934 - RNA, 19 nt, Homo sapiens
gaagucagccuuuuccuaa

SEQ ID NO: 1212935 - RNA, 19 nt, Homo sapiens
gguauuuccucgcaacaga

SEQ ID NO: 1212936 - RNA, 19 nt, Homo sapiens
ggaaugccaggguucagua

SEQ ID NO: 1212937 - RNA, 19 nt, Homo sapiens
uaagaaggucucagauauu

SEQ ID NO: 1212938 - RNA, 19 nt, Homo sapiens
ggaggugaauuagaguuug

SEQ ID NO: 1212939 - RNA, 19 nt, Homo sapiens
ggaggagcuucgcauacaa

SEQ ID NO: 1212940 - RNA, 19 nt, Homo sapiens
gauauguguuucaacuaug

SEQ ID NO: 1212941 - RNA, 19 nt, Homo sapiens
gucguaguguggucauuua

SEQ ID NO: 1212942 - RNA, 19 nt, Homo sapiens
gaaaagagagcgugugaga

SEQ ID NO: 1212943 - RNA, 19 nt, Homo sapiens
ccgccuaguucuguuaaua

SEQ ID NO: 1212944 - RNA, 19 nt, Homo sapiens
gugagcggcugaugauaga

SEQ ID NO: 1212945 - RNA, 19 nt, Homo sapiens
ugauguugcuuauuucaga

SEQ ID NO: 1212946 - RNA, 19 nt, Homo sapiens
ugaaccagcuuugcaccua

SEQ ID NO: 1212947 - RNA, 19 nt, Homo sapiens
gguggacgaugccuuagug

SEQ ID NO: 1212948 - RNA, 19 nt, Homo sapiens
aaaguaacguacacugaau

SEQ ID NO: 1212949 - RNA, 19 nt, Homo sapiens
agaagacacuccugaugga

SEQ ID NO: 1212950 - RNA, 19 nt, Homo sapiens
agagugagccuuaauuuua

SEQ ID NO: 1212951 - RNA, 19 nt, Homo sapiens
aaccagcgguccuauuuga

SEQ ID NO: 1212952 - RNA, 19 nt, Homo sapiens
caagaaauagauacaagga

SEQ ID NO: 1212953 - RNA, 19 nt, Homo sapiens
ccgaagaggaauugacaua

SEQ ID NO: 1212954 - RNA, 19 nt, Homo sapiens
gcggaacugcugugccuua

SEQ ID NO: 1212955 - RNA, 19 nt, Homo sapiens
agagaaaccuuaguaaugc

SEQ ID NO: 1212956 - RNA, 19 nt, Homo sapiens
uugcauaucuggcauccaa

SEQ ID NO: 1212957 - RNA, 19 nt, Homo sapiens
gauguggaauuaucuucga

SEQ ID NO: 1212958 - RNA, 19 nt, Homo sapiens
caacggagcccaggaccaa

SEQ ID NO: 1212959 - RNA, 19 nt, Homo sapiens
aaagagagcgugugagaca

SEQ ID NO: 1212960 - RNA, 19 nt, Homo sapiens
gaggugaauuagaguuugu

SEQ ID NO: 1212961 - RNA, 19 nt, Homo sapiens
cagccuaggguucuguuua

SEQ ID NO: 1212962 - RNA, 19 nt, Homo sapiens
ugagacagcugagagaagu

SEQ ID NO: 1212963 - RNA, 19 nt, Homo sapiens
ucaaugcaugcaagaaaua

SEQ ID NO: 1212964 - RNA, 19 nt, Homo sapiens
gcauccaaauauccagauu

SEQ ID NO: 1212965 - RNA, 19 nt, Homo sapiens
gaaauagauacaaggacaa

SEQ ID NO: 1212966 - RNA, 19 nt, Homo sapiens
caaaaguacucuccgaaga

SEQ ID NO: 1212967 - RNA, 19 nt, Homo sapiens
gauguugcuuauuucagaa

SEQ ID NO: 1212968 - RNA, 19 nt, Homo sapiens
cuaugcggcugcuuuaaga

SEQ ID NO: 1212969 - RNA, 19 nt, Homo sapiens
ccaaagagucuggcaauag

SEQ ID NO: 1212970 - RNA, 19 nt, Homo sapiens
ccaaaguaacguacacuga

SEQ ID NO: 1212971 - RNA, 19 nt, Homo sapiens
gaucugaugaaccagcuuu

SEQ ID NO: 1212972 - RNA, 19 nt, Homo sapiens
gaaccucggccucagagau

SEQ ID NO: 1212973 - RNA, 19 nt, Homo sapiens
gaaugccacugcacuacag

SEQ ID NO: 1212974 - RNA, 19 nt, Homo sapiens
gggagagaaaccuuaguaa

SEQ ID NO: 1212975 - RNA, 19 nt, Homo sapiens
gaugaaaggagugaggaaa

SEQ ID NO: 1212976 - RNA, 19 nt, Homo sapiens
gucacgacauggauugaaa

SEQ ID NO: 1212977 - RNA, 19 nt, Homo sapiens
cuuaagaaggucucagaua

SEQ ID NO: 1212978 - RNA, 19 nt, Homo sapiens
cguaucaucugcguuucua

SEQ ID NO: 1212979 - RNA, 19 nt, Homo sapiens
acagggaucugaugaacca

SEQ ID NO: 1212980 - RNA, 19 nt, Homo sapiens
gagcggcugaugauagaaa

SEQ ID NO: 1212981 - RNA, 19 nt, Homo sapiens
ggucagaaggguuguuugu

SEQ ID NO: 1212982 - RNA, 19 nt, Homo sapiens
gauuugaagguccagcaua

SEQ ID NO: 1212983 - RNA, 19 nt, Homo sapiens
cgagaaaacccauaacauu

SEQ ID NO: 1212984 - RNA, 19 nt, Homo sapiens
gaagacacauuucuacuua

SEQ ID NO: 1212985 - RNA, 19 nt, Homo sapiens
gaacugcccugaaaccauu

SEQ ID NO: 1212986 - RNA, 19 nt, Homo sapiens
gagaugaacugcccugaaa

SEQ ID NO: 1212987 - RNA, 19 nt, Homo sapiens
gcacuuugcuacuuuauug

SEQ ID NO: 1212988 - RNA, 19 nt, Homo sapiens
ccaggaauaugccaauuua

SEQ ID NO: 1212989 - RNA, 19 nt, Homo sapiens
gcgaugacauauucuguua

SEQ ID NO: 1212990 - RNA, 19 nt, Homo sapiens
agagagaucuggcacauuu

SEQ ID NO: 1212991 - RNA, 19 nt, Homo sapiens
ggacaagaauuugcaagaa

SEQ ID NO: 1212992 - RNA, 19 nt, Homo sapiens
gacaagaauuugcaagaaa

SEQ ID NO: 1212993 - RNA, 19 nt, Homo sapiens
ucucaugacuguacuuuaa

SEQ ID NO: 1212994 - RNA, 19 nt, Homo sapiens
gaaauccaauucaaacauc

SEQ ID NO: 1212995 - RNA, 19 nt, Homo sapiens
cggauucgcucccaaauga

SEQ ID NO: 1212996 - RNA, 19 nt, Homo sapiens
gauggguccuucauaguaa

SEQ ID NO: 1212997 - RNA, 19 nt, Homo sapiens
gcaauucacuagaguugga

SEQ ID NO: 1212998 - RNA, 19 nt, Homo sapiens
gagaguccgucuuguaaau

SEQ ID NO: 1212999 - RNA, 19 nt, Homo sapiens
guaaauguuuggcacuuug

SEQ ID NO: 1213000 - RNA, 19 nt, Homo sapiens
aaacauccauccgaucuuu

SEQ ID NO: 1213001 - RNA, 19 nt, Homo sapiens
ggcgaaagaucacgaugaa

SEQ ID NO: 1213002 - RNA, 19 nt, Homo sapiens
cgaaagaucacgaugaaga

SEQ ID NO: 1213003 - RNA, 19 nt, Homo sapiens
gauguggagcucuuuguua

SEQ ID NO: 1213004 - RNA, 19 nt, Homo sapiens
gaagcaggauuccaucuac

SEQ ID NO: 1213005 - RNA, 19 nt, Homo sapiens
aaauaucgauggcacugua

SEQ ID NO: 1213006 - RNA, 19 nt, Homo sapiens
aaagauggguccuucauag

SEQ ID NO: 1213007 - RNA, 19 nt, Homo sapiens
gaauaauggugcucugaag

SEQ ID NO: 1213008 - RNA, 19 nt, Homo sapiens
gacgaccucuucccuugua

SEQ ID NO: 1213009 - RNA, 19 nt, Homo sapiens
ggaauaugccaauuuacaa

SEQ ID NO: 1213010 - RNA, 19 nt, Homo sapiens
uaucaagacucauggugaa

SEQ ID NO: 1213011 - RNA, 19 nt, Homo sapiens
guggauacaucagggaaua

SEQ ID NO: 1213012 - RNA, 19 nt, Homo sapiens
guggagcucuuuguuaauu

SEQ ID NO: 1213013 - RNA, 19 nt, Homo sapiens
ggagcucuuuguuaauuug

SEQ ID NO: 1213014 - RNA, 19 nt, Homo sapiens
gugauuguuugcaguauga

SEQ ID NO: 1213015 - RNA, 19 nt, Homo sapiens
caugggcgaugacauauuc

SEQ ID NO: 1213016 - RNA, 19 nt, Homo sapiens
aaacacuacauuccaguua

SEQ ID NO: 1213017 - RNA, 19 nt, Homo sapiens
gcuacuuuauugcuucuuu

SEQ ID NO: 1213018 - RNA, 19 nt, Homo sapiens
cgagacagccgcaaagaga

SEQ ID NO: 1213019 - RNA, 19 nt, Homo sapiens
ccacagauuccaaggauau

SEQ ID NO: 1213020 - RNA, 19 nt, Homo sapiens
gcaguaugaagacacauuu

SEQ ID NO: 1213021 - RNA, 19 nt, Homo sapiens
gaggagcaauucacuagag

SEQ ID NO: 1213022 - RNA, 19 nt, Homo sapiens
agacacauuucuacuuaug

SEQ ID NO: 1213023 - RNA, 19 nt, Homo sapiens
cuuaucgccugccauauuu

SEQ ID NO: 1213024 - RNA, 19 nt, Homo sapiens
gagagacucgagcugguua

SEQ ID NO: 1213025 - RNA, 19 nt, Homo sapiens
ugaaaccauugcucagauu

SEQ ID NO: 1213026 - RNA, 19 nt, Homo sapiens
gagcaauucacuagaguug

SEQ ID NO: 1213027 - RNA, 19 nt, Homo sapiens
gcuuaucgccugccauauu

SEQ ID NO: 1213028 - RNA, 19 nt, Homo sapiens
ggagaagagcgaaauaugg

SEQ ID NO: 1213029 - RNA, 19 nt, Homo sapiens
cagcuuaucgccugccaua

SEQ ID NO: 1213030 - RNA, 19 nt, Homo sapiens
cgauuugacugauucuguu

SEQ ID NO: 1213031 - RNA, 19 nt, Homo sapiens
ggcaacauguggccaaauc

SEQ ID NO: 1213032 - RNA, 19 nt, Homo sapiens
gaaacacuacauuccaguu

SEQ ID NO: 1213033 - RNA, 19 nt, Homo sapiens
ggguaagucuggauaugau

SEQ ID NO: 1213034 - RNA, 19 nt, Homo sapiens
gaacauguagguuuuagaa

SEQ ID NO: 1213035 - RNA, 19 nt, Homo sapiens
aggauuccaucuacuauga

SEQ ID NO: 1213036 - RNA, 19 nt, Homo sapiens
guucaucauuguccugaga

SEQ ID NO: 1213037 - RNA, 19 nt, Homo sapiens
guaugaagacacauuucua

SEQ ID NO: 1213038 - RNA, 19 nt, Homo sapiens
gguccuucauaguaagaua

SEQ ID NO: 1213039 - RNA, 19 nt, Homo sapiens
aaacuuaaaugggcgaaag

SEQ ID NO: 1213040 - RNA, 19 nt, Homo sapiens
gcuaguuggugacaguguu

SEQ ID NO: 1213041 - RNA, 19 nt, Homo sapiens
cuuaaaggauaacaagguu

SEQ ID NO: 1213042 - RNA, 19 nt, Homo sapiens
cagaaaagauugcaguaga

SEQ ID NO: 1213043 - RNA, 19 nt, Homo sapiens
ggagaugaacugcccugaa

SEQ ID NO: 1213044 - RNA, 19 nt, Homo sapiens
ggauacaucagggaauaaa

SEQ ID NO: 1213045 - RNA, 19 nt, Homo sapiens
gaauaugccaauuuacaag

SEQ ID NO: 1213046 - RNA, 19 nt, Homo sapiens
gaaagaucacgaugaagag

SEQ ID NO: 1213047 - RNA, 19 nt, Homo sapiens
uuaaaugggcgaaagauca

SEQ ID NO: 1213048 - RNA, 19 nt, Homo sapiens
cuaugucacuacaccuuaa

SEQ ID NO: 1213049 - RNA, 19 nt, Homo sapiens
ccucuuacacuucuucauu

SEQ ID NO: 1213050 - RNA, 19 nt, Homo sapiens
ugaagacacauuucuacuu

SEQ ID NO: 1213051 - RNA, 19 nt, Homo sapiens
ggguagaaccacagacuga

SEQ ID NO: 1213052 - RNA, 19 nt, Homo sapiens
gggcgaaagaucacgauga

SEQ ID NO: 1213053 - RNA, 19 nt, Homo sapiens
gacucgagcugguuaaacu

SEQ ID NO: 1213054 - RNA, 19 nt, Homo sapiens
gaguccgucuuguaaaugu

SEQ ID NO: 1213055 - RNA, 19 nt, Homo sapiens
aacacuacauuccaguuaa

SEQ ID NO: 1213056 - RNA, 19 nt, Homo sapiens
gcaggauuccaucuacuau

SEQ ID NO: 1213057 - RNA, 19 nt, Homo sapiens
ugauguccgugcaagcuaa

SEQ ID NO: 1213058 - RNA, 19 nt, Homo sapiens
auguggagcucuuuguuaa

SEQ ID NO: 1213059 - RNA, 19 nt, Homo sapiens
ugcaagaaauaaucucaug

SEQ ID NO: 1213060 - RNA, 19 nt, Homo sapiens
cuacguacgauuugacuga

SEQ ID NO: 1213061 - RNA, 19 nt, Homo sapiens
ucgagaguccgucuuguaa

SEQ ID NO: 1213062 - RNA, 19 nt, Homo sapiens
ccugagcgaucugcuagaa

SEQ ID NO: 1213063 - RNA, 19 nt, Homo sapiens
ggagacuggccuuuggaaa

SEQ ID NO: 1213064 - RNA, 19 nt, Homo sapiens
gccauacuacuuucuuuga

SEQ ID NO: 1213065 - RNA, 19 nt, Homo sapiens
cauaguaagauacagaaug

SEQ ID NO: 1213066 - RNA, 19 nt, Homo sapiens
agauggguccuucauagua

SEQ ID NO: 1213067 - RNA, 19 nt, Homo sapiens
caaccugagcgaucugcua

SEQ ID NO: 1213068 - RNA, 19 nt, Homo sapiens
ugaagcaggauuccaucua

SEQ ID NO: 1213069 - RNA, 19 nt, Homo sapiens
ugguuaaacucaguagaaa

SEQ ID NO: 1213070 - RNA, 19 nt, Homo sapiens
gacugauucuguucuggaa

SEQ ID NO: 1213071 - RNA, 19 nt, Homo sapiens
gaaaccauugcucagauuc

SEQ ID NO: 1213072 - RNA, 19 nt, Homo sapiens
uguaaauguuuggcacuuu

SEQ ID NO: 1213073 - RNA, 19 nt, Homo sapiens
cagcugagcccggagaaga

SEQ ID NO: 1213074 - RNA, 19 nt, Homo sapiens
cagaggagcaauucacuag

SEQ ID NO: 1213075 - RNA, 19 nt, Homo sapiens
auuuaucgguggaucauuu

SEQ ID NO: 1213076 - RNA, 19 nt, Homo sapiens
acacauuucuacuuaugca

SEQ ID NO: 1213077 - RNA, 19 nt, Homo sapiens
caagacucauggugaacau

SEQ ID NO: 1213078 - RNA, 19 nt, Homo sapiens
gaaaagauugcaguagaaa

SEQ ID NO: 1213079 - RNA, 19 nt, Homo sapiens
uugcucagauucagagaga

SEQ ID NO: 1213080 - RNA, 19 nt, Homo sapiens
cucuuacacuucuucauuu

SEQ ID NO: 1213081 - RNA, 19 nt, Homo sapiens
ugagcgaucugcuagaaaa

SEQ ID NO: 1213082 - RNA, 19 nt, Homo sapiens
cguacgauuugacugauuc

SEQ ID NO: 1213083 - RNA, 19 nt, Homo sapiens
ccaauuuacaagugaguga

SEQ ID NO: 1213084 - RNA, 19 nt, Homo sapiens
caaaggcuauuaacacaua

SEQ ID NO: 1213085 - RNA, 19 nt, Homo sapiens
caagucagcuucagaaaug

SEQ ID NO: 1213086 - RNA, 19 nt, Homo sapiens
ggagaacacucgaaaucaa

SEQ ID NO: 1213087 - RNA, 19 nt, Homo sapiens
gaaaacggguucuguagua

SEQ ID NO: 1213088 - RNA, 19 nt, Homo sapiens
caaggcagcuuagggauaa

SEQ ID NO: 1213089 - RNA, 19 nt, Homo sapiens
gagcauuucugauaguuga

SEQ ID NO: 1213090 - RNA, 19 nt, Homo sapiens
guaaaguuguucaauguga

SEQ ID NO: 1213091 - RNA, 19 nt, Homo sapiens
acacuuaucccucaaauuu

SEQ ID NO: 1213092 - RNA, 19 nt, Homo sapiens
ucacauuucucuaagauga

SEQ ID NO: 1213093 - RNA, 19 nt, Homo sapiens
acucauaacuuuccaaaug

SEQ ID NO: 1213094 - RNA, 19 nt, Homo sapiens
gauaaacacucaaccaaac

SEQ ID NO: 1213095 - RNA, 19 nt, Homo sapiens
gaacagaagaguaaauaca

SEQ ID NO: 1213096 - RNA, 19 nt, Homo sapiens
gaacuaggagauacaauau

SEQ ID NO: 1213097 - RNA, 19 nt, Homo sapiens
caauggaccugucagcaaa

SEQ ID NO: 1213098 - RNA, 19 nt, Homo sapiens
ccaaauacaugugucaaug

SEQ ID NO: 1213099 - RNA, 19 nt, Homo sapiens
gaacuguaauuucuacucu

SEQ ID NO: 1213100 - RNA, 19 nt, Homo sapiens
ggagguugguucaugacua

SEQ ID NO: 1213101 - RNA, 19 nt, Homo sapiens
ggucggcaccuaaugaaua

SEQ ID NO: 1213102 - RNA, 19 nt, Homo sapiens
ucaacuaacuucaucuuca

SEQ ID NO: 1213103 - RNA, 19 nt, Homo sapiens
cgaacuaggagauacaaua

SEQ ID NO: 1213104 - RNA, 19 nt, Homo sapiens
ucaagcgcuuuacagauua

SEQ ID NO: 1213105 - RNA, 19 nt, Homo sapiens
ggagaaaggcagugggaaa

SEQ ID NO: 1213106 - RNA, 19 nt, Homo sapiens
gagguugguucaugacuau

SEQ ID NO: 1213107 - RNA, 19 nt, Homo sapiens
acacaauccuuucuaacuu

SEQ ID NO: 1213108 - RNA, 19 nt, Homo sapiens
caacgaaagcugaauagug

SEQ ID NO: 1213109 - RNA, 19 nt, Homo sapiens
acacuaaacuggagccaau

SEQ ID NO: 1213110 - RNA, 19 nt, Homo sapiens
cacaauccuuucuaacuuu

SEQ ID NO: 1213111 - RNA, 19 nt, Homo sapiens
gauuuaacccaguaaguuu

SEQ ID NO: 1213112 - RNA, 19 nt, Homo sapiens
cacacacacucauaacuuu

SEQ ID NO: 1213113 - RNA, 19 nt, Homo sapiens
aacgaaagcugaauagugu

SEQ ID NO: 1213114 - RNA, 19 nt, Homo sapiens
aaacaacgaaagcugaaua

SEQ ID NO: 1213115 - RNA, 19 nt, Homo sapiens
gaacugaggaagccauuag

SEQ ID NO: 1213116 - RNA, 19 nt, Homo sapiens
ccaaaugaauagaaacaca

SEQ ID NO: 1213117 - RNA, 19 nt, Homo sapiens
ggccaaaucagaagauauu

SEQ ID NO: 1213118 - RNA, 19 nt, Homo sapiens
ugaaauacuugucaugucu

SEQ ID NO: 1213119 - RNA, 19 nt, Homo sapiens
gcacauagccacgcauaca

SEQ ID NO: 1213120 - RNA, 19 nt, Homo sapiens
gaggugagccgaagaucaa

SEQ ID NO: 1213121 - RNA, 19 nt, Homo sapiens
caaagcacccgaacuagga

SEQ ID NO: 1213122 - RNA, 19 nt, Homo sapiens
gcagaggagacuaaucaaa

SEQ ID NO: 1213123 - RNA, 19 nt, Homo sapiens
aagcaaagcacccgaacua

SEQ ID NO: 1213124 - RNA, 19 nt, Homo sapiens
auucugggcuuaugcauuu

SEQ ID NO: 1213125 - RNA, 19 nt, Homo sapiens
ucuguaugcugccuuuaua

SEQ ID NO: 1213126 - RNA, 19 nt, Homo sapiens
gaagauauucauccugcuu

SEQ ID NO: 1213127 - RNA, 19 nt, Homo sapiens
gcaauacuacaacaaacuu

SEQ ID NO: 1213128 - RNA, 19 nt, Homo sapiens
gcaauguagagguguuuaa

SEQ ID NO: 1213129 - RNA, 19 nt, Homo sapiens
ugaauaguguuggaacuga

SEQ ID NO: 1213130 - RNA, 19 nt, Homo sapiens
acuaggagauacaauauuc

SEQ ID NO: 1213131 - RNA, 19 nt, Homo sapiens
uuagugcucuggucucuga

SEQ ID NO: 1213132 - RNA, 19 nt, Homo sapiens
ccaaugaacaugucagugu

SEQ ID NO: 1213133 - RNA, 19 nt, Homo sapiens
gggauaauuagguugauuu

SEQ ID NO: 1213134 - RNA, 19 nt, Homo sapiens
gcuuagggauaauuagguu

SEQ ID NO: 1213135 - RNA, 19 nt, Homo sapiens
cugaugggcugugugguua

SEQ ID NO: 1213136 - RNA, 19 nt, Homo sapiens
gcuuauaugguguacauuu

SEQ ID NO: 1213137 - RNA, 19 nt, Homo sapiens
ugaauaaacgagcaaaguu

SEQ ID NO: 1213138 - RNA, 19 nt, Homo sapiens
gucggcaccuaaugaauaa

SEQ ID NO: 1213139 - RNA, 19 nt, Homo sapiens
gcaccuccaucuccaagca

SEQ ID NO: 1213140 - RNA, 19 nt, Homo sapiens
gugcuuauaugguguacau

SEQ ID NO: 1213141 - RNA, 19 nt, Homo sapiens
cuaacuuuauggacacuaa

SEQ ID NO: 1213142 - RNA, 19 nt, Homo sapiens
cacacacaauccuuucuaa

SEQ ID NO: 1213143 - RNA, 19 nt, Homo sapiens
gaaaucaagcgcuuuacag

SEQ ID NO: 1213144 - RNA, 19 nt, Homo sapiens
aaacaugagcaaacacaaa

SEQ ID NO: 1213145 - RNA, 19 nt, Homo sapiens
cuucugccauuucuucuuu

SEQ ID NO: 1213146 - RNA, 19 nt, Homo sapiens
gaacuggugcuuauauggu

SEQ ID NO: 1213147 - RNA, 19 nt, Homo sapiens
aaacuggagccaauagaaa

SEQ ID NO: 1213148 - RNA, 19 nt, Homo sapiens
gagcacaacacacacaauc

SEQ ID NO: 1213149 - RNA, 19 nt, Homo sapiens
cccauucccucuuuaucua

SEQ ID NO: 1213150 - RNA, 19 nt, Homo sapiens
ccaaggcagcuuagggaua

SEQ ID NO: 1213151 - RNA, 19 nt, Homo sapiens
gaaaauggcacaaggaauc

SEQ ID NO: 1213152 - RNA, 19 nt, Homo sapiens
cacaguauagcgcauauuu

SEQ ID NO: 1213153 - RNA, 19 nt, Homo sapiens
aguguugacuuuacaagaa

SEQ ID NO: 1213154 - RNA, 19 nt, Homo sapiens
acucuuaagugagauauga

SEQ ID NO: 1213155 - RNA, 19 nt, Homo sapiens
aaacaaaggcuauuaacac

SEQ ID NO: 1213156 - RNA, 19 nt, Homo sapiens
caaacaaaggcuauuaaca

SEQ ID NO: 1213157 - RNA, 19 nt, Homo sapiens
ggaagcagaagcugaucuu

SEQ ID NO: 1213158 - RNA, 19 nt, Homo sapiens
aucaagcgcuuuacagauu

SEQ ID NO: 1213159 - RNA, 19 nt, Homo sapiens
gacaggagaacacucgaaa

SEQ ID NO: 1213160 - RNA, 19 nt, Homo sapiens
ucacacacacucauaacuu

SEQ ID NO: 1213161 - RNA, 19 nt, Homo sapiens
acagaagaguaaauacaga

SEQ ID NO: 1213162 - RNA, 19 nt, Homo sapiens
gcuuaugcauuugugcuaa

SEQ ID NO: 1213163 - RNA, 19 nt, Homo sapiens
caagcaauguagagguguu

SEQ ID NO: 1213164 - RNA, 19 nt, Homo sapiens
gaaaggcagugggaaaaga

SEQ ID NO: 1213165 - RNA, 19 nt, Homo sapiens
ggaccacugugagcuggaa

SEQ ID NO: 1213166 - RNA, 19 nt, Homo sapiens
ggguguauaucuagaacga

SEQ ID NO: 1213167 - RNA, 19 nt, Homo sapiens
uaaacuggagccaauagaa

SEQ ID NO: 1213168 - RNA, 19 nt, Homo sapiens
aacaaaggcuauuaacaca

SEQ ID NO: 1213169 - RNA, 19 nt, Homo sapiens
ggcaaacaaaggcuauuaa

SEQ ID NO: 1213170 - RNA, 19 nt, Homo sapiens
ucuaucaacucuaggacaa

SEQ ID NO: 1213171 - RNA, 19 nt, Homo sapiens
gcuuugagaguguacagua

SEQ ID NO: 1213172 - RNA, 19 nt, Homo sapiens
uuucuacucuuaagugaga

SEQ ID NO: 1213173 - RNA, 19 nt, Homo sapiens
caacuaacuucaucuucac

SEQ ID NO: 1213174 - RNA, 19 nt, Homo sapiens
gcaaacaaaggcuauuaac

SEQ ID NO: 1213175 - RNA, 19 nt, Homo sapiens
aagcagaggagacuaauca

SEQ ID NO: 1213176 - RNA, 19 nt, Homo sapiens
cagaagcagaggagacuaa

SEQ ID NO: 1213177 - RNA, 19 nt, Homo sapiens
gugauguacucuuacuaug

SEQ ID NO: 1213178 - RNA, 19 nt, Homo sapiens
ucacugugcuccuguacuc

SEQ ID NO: 1213179 - RNA, 19 nt, Homo sapiens
aagcccaaaugaauagaaa

SEQ ID NO: 1213180 - RNA, 19 nt, Homo sapiens
ucaaagcccaaaugaauag

SEQ ID NO: 1213181 - RNA, 19 nt, Homo sapiens
caauguagagguguuuaaa

SEQ ID NO: 1213182 - RNA, 19 nt, Homo sapiens
caaaugaaaccccacagua

SEQ ID NO: 1213183 - RNA, 19 nt, Homo sapiens
aacggguucuguaguauuu

SEQ ID NO: 1213184 - RNA, 19 nt, Homo sapiens
caagugaagucauuucuua

SEQ ID NO: 1213185 - RNA, 19 nt, Homo sapiens
ggaaagaagcuauuaaaca

SEQ ID NO: 1213186 - RNA, 19 nt, Homo sapiens
gugaauugguggaauauuu

SEQ ID NO: 1213187 - RNA, 19 nt, Homo sapiens
ggaaugcccuuucuauaag

SEQ ID NO: 1213188 - RNA, 19 nt, Homo sapiens
acaaagacaccuacaguua

SEQ ID NO: 1213189 - RNA, 19 nt, Homo sapiens
gguggaauauuuacaaaga

SEQ ID NO: 1213190 - RNA, 19 nt, Homo sapiens
caaccugaguccuaaauug

SEQ ID NO: 1213191 - RNA, 19 nt, Homo sapiens
gcuauucacucauuucaau

SEQ ID NO: 1213192 - RNA, 19 nt, Homo sapiens
gaaguucgcaaucuuugua

SEQ ID NO: 1213193 - RNA, 19 nt, Homo sapiens
ggauagcacuguguauuga

SEQ ID NO: 1213194 - RNA, 19 nt, Homo sapiens
gagaauagcaucuuucaag

SEQ ID NO: 1213195 - RNA, 19 nt, Homo sapiens
ccaaaugccucugcuuuau

SEQ ID NO: 1213196 - RNA, 19 nt, Homo sapiens
gacgugaauugguggaaua

SEQ ID NO: 1213197 - RNA, 19 nt, Homo sapiens
gcacaacugacccaacuuu

SEQ ID NO: 1213198 - RNA, 19 nt, Homo sapiens
ucacagcugucaaacacua

SEQ ID NO: 1213199 - RNA, 19 nt, Homo sapiens
uagcaucuuucaagcuuua

SEQ ID NO: 1213200 - RNA, 19 nt, Homo sapiens
gaagaaggauuuguauugc

SEQ ID NO: 1213201 - RNA, 19 nt, Homo sapiens
caaaacuccuuccuaaaua

SEQ ID NO: 1213202 - RNA, 19 nt, Homo sapiens
ggaugaacaccaaacauuu

SEQ ID NO: 1213203 - RNA, 19 nt, Homo sapiens
ugaagaaggauuuguauug

SEQ ID NO: 1213204 - RNA, 19 nt, Homo sapiens
ccacccaaaucauuauuga

SEQ ID NO: 1213205 - RNA, 19 nt, Homo sapiens
gcauguggauccucaaagu

SEQ ID NO: 1213206 - RNA, 19 nt, Homo sapiens
ggagcaagauuauauuuug

SEQ ID NO: 1213207 - RNA, 19 nt, Homo sapiens
uggaaugcccuuucuauaa

SEQ ID NO: 1213208 - RNA, 19 nt, Homo sapiens
gguaaagaaucucauuugg

SEQ ID NO: 1213209 - RNA, 19 nt, Homo sapiens
gacacuagaacucauuaua

SEQ ID NO: 1213210 - RNA, 19 nt, Homo sapiens
cuucauucauguucacuua

SEQ ID NO: 1213211 - RNA, 19 nt, Homo sapiens
uggaggcguucauauauuu

SEQ ID NO: 1213212 - RNA, 19 nt, Homo sapiens
gauauuguggcccuuuaua

SEQ ID NO: 1213213 - RNA, 19 nt, Homo sapiens
gggaaagucugauuacacu

SEQ ID NO: 1213214 - RNA, 19 nt, Homo sapiens
gcaggagcuuuacaacgaa

SEQ ID NO: 1213215 - RNA, 19 nt, Homo sapiens
gaucaugugcuguaaagga

SEQ ID NO: 1213216 - RNA, 19 nt, Homo sapiens
gaaacuucuucauucaugu

SEQ ID NO: 1213217 - RNA, 19 nt, Homo sapiens
gcauuuccucugauuauaa

SEQ ID NO: 1213218 - RNA, 19 nt, Homo sapiens
guuacucgguuaucaaguu

SEQ ID NO: 1213219 - RNA, 19 nt, Homo sapiens
guaaagaaucucauuugga

SEQ ID NO: 1213220 - RNA, 19 nt, Homo sapiens
ugaucaaagucaagcauuu

SEQ ID NO: 1213221 - RNA, 19 nt, Homo sapiens
ucaagcauuuccucugauu

SEQ ID NO: 1213222 - RNA, 19 nt, Homo sapiens
aagaaauacuggagaauag

SEQ ID NO: 1213223 - RNA, 19 nt, Homo sapiens
caaaagaaauacuggagaa

SEQ ID NO: 1213224 - RNA, 19 nt, Homo sapiens
gaagauauccauaaaagga

SEQ ID NO: 1213225 - RNA, 19 nt, Homo sapiens
aaaguagccuguugcugaa

SEQ ID NO: 1213226 - RNA, 19 nt, Homo sapiens
caauugaucaugugcugua

SEQ ID NO: 1213227 - RNA, 19 nt, Homo sapiens
guucauugguugcaagaau

SEQ ID NO: 1213228 - RNA, 19 nt, Homo sapiens
gcuuuaugcuuucaguuug

SEQ ID NO: 1213229 - RNA, 19 nt, Homo sapiens
gggcacaacugacccaacu

SEQ ID NO: 1213230 - RNA, 19 nt, Homo sapiens
caaaugccucugcuuuauu

SEQ ID NO: 1213231 - RNA, 19 nt, Homo sapiens
guauugccauccacagcua

SEQ ID NO: 1213232 - RNA, 19 nt, Homo sapiens
gaugaagaaggauuuguau

SEQ ID NO: 1213233 - RNA, 19 nt, Homo sapiens
aauagcaucuuucaagcuu

SEQ ID NO: 1213234 - RNA, 19 nt, Homo sapiens
ucugaaagcaucuguaguu

SEQ ID NO: 1213235 - RNA, 19 nt, Homo sapiens
uugcaagaaugaauacuga

SEQ ID NO: 1213236 - RNA, 19 nt, Homo sapiens
aaacaaagacaccuacagu

SEQ ID NO: 1213237 - RNA, 19 nt, Homo sapiens
ccacagcuaaugaagauau

SEQ ID NO: 1213238 - RNA, 19 nt, Homo sapiens
gaucugaaagcaucuguag

SEQ ID NO: 1213239 - RNA, 19 nt, Homo sapiens
gcuaaugaagauauccaua

SEQ ID NO: 1213240 - RNA, 19 nt, Homo sapiens
caagguaaagaaucucauu

SEQ ID NO: 1213241 - RNA, 19 nt, Homo sapiens
agucaagcauuuccucuga

SEQ ID NO: 1213242 - RNA, 19 nt, Homo sapiens
cagaaaagguggcauggaa

SEQ ID NO: 1213243 - RNA, 19 nt, Homo sapiens
cacguuggauccugaaguu

SEQ ID NO: 1213244 - RNA, 19 nt, Homo sapiens
cauggaaguucgcaaucuu

SEQ ID NO: 1213245 - RNA, 19 nt, Homo sapiens
gcauggaaguucgcaaucu

SEQ ID NO: 1213246 - RNA, 19 nt, Homo sapiens
cuagacuggugaucugaaa

SEQ ID NO: 1213247 - RNA, 19 nt, Homo sapiens
caaagacaccuacaguuac

SEQ ID NO: 1213248 - RNA, 19 nt, Homo sapiens
guccaaaacuccuuccuaa

SEQ ID NO: 1213249 - RNA, 19 nt, Homo sapiens
caccaaaugccucugcuuu

SEQ ID NO: 1213250 - RNA, 19 nt, Homo sapiens
ccacuuugcagaauauguu

SEQ ID NO: 1213251 - RNA, 19 nt, Homo sapiens
guuaucaaguuguucagau

SEQ ID NO: 1213252 - RNA, 19 nt, Homo sapiens
auagauaugugaagauugg

SEQ ID NO: 1213253 - RNA, 19 nt, Homo sapiens
gcugcaagguaaagaaucu

SEQ ID NO: 1213254 - RNA, 19 nt, Homo sapiens
gaucaaagucaagcauuuc

SEQ ID NO: 1213255 - RNA, 19 nt, Homo sapiens
caugugcuguaaaggaauu

SEQ ID NO: 1213256 - RNA, 19 nt, Homo sapiens
gaaauacuggagaauagca

SEQ ID NO: 1213257 - RNA, 19 nt, Homo sapiens
cugaaagcaucuguaguuu

SEQ ID NO: 1213258 - RNA, 19 nt, Homo sapiens
aagaaugaauacugacuuc

SEQ ID NO: 1213259 - RNA, 19 nt, Homo sapiens
uauggcagcaggagcuuua

SEQ ID NO: 1213260 - RNA, 19 nt, Homo sapiens
caacuuuucccuaucaaua

SEQ ID NO: 1213261 - RNA, 19 nt, Homo sapiens
cgcaaucuuuguauucuug

SEQ ID NO: 1213262 - RNA, 19 nt, Homo sapiens
guucuagacuggugaucug

SEQ ID NO: 1213263 - RNA, 19 nt, Homo sapiens
agcaggagcuuuacaacga

SEQ ID NO: 1213264 - RNA, 19 nt, Homo sapiens
ccucacagcugucaaacac

SEQ ID NO: 1213265 - RNA, 19 nt, Homo sapiens
aaucucauuuggacacauu

SEQ ID NO: 1213266 - RNA, 19 nt, Homo sapiens
ccugaguccuaaauugauu

SEQ ID NO: 1213267 - RNA, 19 nt, Homo sapiens
aaugugaauuagccacuuu

SEQ ID NO: 1213268 - RNA, 19 nt, Homo sapiens
cuaguuuagugacugcuuu

SEQ ID NO: 1213269 - RNA, 19 nt, Homo sapiens
aaagacaccuacaguuacu

SEQ ID NO: 1213270 - RNA, 19 nt, Homo sapiens
cuaaauaucaagugaaguc

SEQ ID NO: 1213271 - RNA, 19 nt, Homo sapiens
cauuugggaaacucaauua

SEQ ID NO: 1213272 - RNA, 19 nt, Homo sapiens
gcagggucauggaguacug

SEQ ID NO: 1213273 - RNA, 19 nt, Homo sapiens
uugcaggcauguacugaaa

SEQ ID NO: 1213274 - RNA, 19 nt, Homo sapiens
cuagugucauagauacuuu

SEQ ID NO: 1213275 - RNA, 19 nt, Homo sapiens
ggaacucaguauuaaaaga

SEQ ID NO: 1213276 - RNA, 19 nt, Homo sapiens
ggagcuuuacaacgaauuu

SEQ ID NO: 1213277 - RNA, 19 nt, Homo sapiens
uugacacccuauuguuaua

SEQ ID NO: 1213278 - RNA, 19 nt, Homo sapiens
guugacacccuauuguuau

SEQ ID NO: 1213279 - RNA, 19 nt, Homo sapiens
uucaacggcugcaagguaa

SEQ ID NO: 1213280 - RNA, 19 nt, Homo sapiens
caagcauuuccucugauua

SEQ ID NO: 1213281 - RNA, 19 nt, Homo sapiens
ugcaagcucugauucuguu

SEQ ID NO: 1213282 - RNA, 19 nt, Homo sapiens
uggaugaacaccaaacauu

SEQ ID NO: 1213283 - RNA, 19 nt, Homo sapiens
uagccacuuugcagaauau

SEQ ID NO: 1213284 - RNA, 19 nt, Homo sapiens
uaaauaaagugcacgcuau

SEQ ID NO: 1213285 - RNA, 19 nt, Homo sapiens
guuggucucucaugacuua

SEQ ID NO: 1213286 - RNA, 19 nt, Homo sapiens
gaacacaggcagcuccuuu

SEQ ID NO: 1213287 - RNA, 19 nt, Homo sapiens
gaaagcauguguucaaagc

SEQ ID NO: 1213288 - RNA, 19 nt, Homo sapiens
ggauguaccuugugucucu

SEQ ID NO: 1213289 - RNA, 19 nt, Homo sapiens
cagcugcagugauauauau

SEQ ID NO: 1213290 - RNA, 19 nt, Homo sapiens
ggaggaggauguaccuugu

SEQ ID NO: 1213291 - RNA, 19 nt, Homo sapiens
gggacuagcuggugauuac

SEQ ID NO: 1213292 - RNA, 19 nt, Homo sapiens
caagagaaacagagaaaga

SEQ ID NO: 1213293 - RNA, 19 nt, Homo sapiens
gggaaagcauguguucaaa

SEQ ID NO: 1213294 - RNA, 19 nt, Homo sapiens
ggauagcaguggccugaga

SEQ ID NO: 1213295 - RNA, 19 nt, Homo sapiens
gaagaauaaaugcccaauu

SEQ ID NO: 1213296 - RNA, 19 nt, Homo sapiens
ggaccuugcugggcauuau

SEQ ID NO: 1213297 - RNA, 19 nt, Homo sapiens
guucaaagccauucugaug

SEQ ID NO: 1213298 - RNA, 19 nt, Homo sapiens
aaacaucacugccguuggu

SEQ ID NO: 1213299 - RNA, 19 nt, Homo sapiens
ugagaaagacccagucaug

SEQ ID NO: 1213300 - RNA, 19 nt, Homo sapiens
gccugaagcuugucaucuu

SEQ ID NO: 1213301 - RNA, 19 nt, Homo sapiens
gacacuggaugccuggauu

SEQ ID NO: 1213302 - RNA, 19 nt, Homo sapiens
ugccuuggcuuccuccuaa

SEQ ID NO: 1213303 - RNA, 19 nt, Homo sapiens
aaacagagaaagaccauuc

SEQ ID NO: 1213304 - RNA, 19 nt, Homo sapiens
guucagguuugauguggaa

SEQ ID NO: 1213305 - RNA, 19 nt, Homo sapiens
gcccaauucuuacuguuca

SEQ ID NO: 1213306 - RNA, 19 nt, Homo sapiens
ggagguggauguccuucuc

SEQ ID NO: 1213307 - RNA, 19 nt, Homo sapiens
gauggcugcugcuuuguag

SEQ ID NO: 1213308 - RNA, 19 nt, Homo sapiens
uaucagugcuugguugguu

SEQ ID NO: 1213309 - RNA, 19 nt, Homo sapiens
cugcuugccugcugccaua

SEQ ID NO: 1213310 - RNA, 19 nt, Homo sapiens
cgaagucgcacgugaagga

SEQ ID NO: 1213311 - RNA, 19 nt, Homo sapiens
gccaagagaaacagagaaa

SEQ ID NO: 1213312 - RNA, 19 nt, Homo sapiens
ggcccugucuucugagguu

SEQ ID NO: 1213313 - RNA, 19 nt, Homo sapiens
gcaguggccugagaaagac

SEQ ID NO: 1213314 - RNA, 19 nt, Homo sapiens
gaagagagaagccccaguu

SEQ ID NO: 1213315 - RNA, 19 nt, Homo sapiens
gcuccuguccuccucauug

SEQ ID NO: 1213316 - RNA, 19 nt, Homo sapiens
ggaaagcauguguucaaag

SEQ ID NO: 1213317 - RNA, 19 nt, Homo sapiens
gcugcagugauauauauuu

SEQ ID NO: 1213318 - RNA, 19 nt, Homo sapiens
uacccugucuuggugguua

SEQ ID NO: 1213319 - RNA, 19 nt, Homo sapiens
gagcagucacucucagaau

SEQ ID NO: 1213320 - RNA, 19 nt, Homo sapiens
ccaaaccaugguccuuuaa

SEQ ID NO: 1213321 - RNA, 19 nt, Homo sapiens
gcucuccuguccuucugaa

SEQ ID NO: 1213322 - RNA, 19 nt, Homo sapiens
cuucugagguucucugucu

SEQ ID NO: 1213323 - RNA, 19 nt, Homo sapiens
gcacaacugcaugcacuuc

SEQ ID NO: 1213324 - RNA, 19 nt, Homo sapiens
gccagugucauaccaaaga

SEQ ID NO: 1213325 - RNA, 19 nt, Homo sapiens
gauaaaggguggggaaaca

SEQ ID NO: 1213326 - RNA, 19 nt, Homo sapiens
ccaccaggccaacagaaga

SEQ ID NO: 1213327 - RNA, 19 nt, Homo sapiens
gauagcaguggccugagaa

SEQ ID NO: 1213328 - RNA, 19 nt, Homo sapiens
gaccuugcugggcauuaua

SEQ ID NO: 1213329 - RNA, 19 nt, Homo sapiens
ggccaucucaucagccauu

SEQ ID NO: 1213330 - RNA, 19 nt, Homo sapiens
gaggauguaccuugugucu

SEQ ID NO: 1213331 - RNA, 19 nt, Homo sapiens
ccauuucuguggccuucuu

SEQ ID NO: 1213332 - RNA, 19 nt, Homo sapiens
gcagucacucucagaaucu

SEQ ID NO: 1213333 - RNA, 19 nt, Homo sapiens
gcugaaugccuugggacua

SEQ ID NO: 1213334 - RNA, 19 nt, Homo sapiens
uaccuugugucucuuucaa

SEQ ID NO: 1213335 - RNA, 19 nt, Homo sapiens
gagagaagccccaguugau

SEQ ID NO: 1213336 - RNA, 19 nt, Homo sapiens
ccacuagccaagagaaaca

SEQ ID NO: 1213337 - RNA, 19 nt, Homo sapiens
agugcacgcuauuuuauua

SEQ ID NO: 1213338 - RNA, 19 nt, Homo sapiens
ccgccagugucauaccaaa

SEQ ID NO: 1213339 - RNA, 19 nt, Homo sapiens
ucuacuggcugcugucucu

SEQ ID NO: 1213340 - RNA, 19 nt, Homo sapiens
cugaaugccuugggacuag

SEQ ID NO: 1213341 - RNA, 19 nt, Homo sapiens
gcaccaccaggccaacaga

SEQ ID NO: 1213342 - RNA, 19 nt, Homo sapiens
cggguuugguggcgcguuu

SEQ ID NO: 1213343 - RNA, 19 nt, Homo sapiens
uaaggggaccugaggauaa

SEQ ID NO: 1213344 - RNA, 19 nt, Homo sapiens
ccagcucccuucuuguuuu

SEQ ID NO: 1213345 - RNA, 19 nt, Homo sapiens
gugcuugguugguuuuaaa

SEQ ID NO: 1213346 - RNA, 19 nt, Homo sapiens
aguguucuguggcugcuuu

SEQ ID NO: 1213347 - RNA, 19 nt, Homo sapiens
ugccguuggucucucauga

SEQ ID NO: 1213348 - RNA, 19 nt, Homo sapiens
caucugcgccagcaaacau

SEQ ID NO: 1213349 - RNA, 19 nt, Homo sapiens
uuggcucucuuaacccuuu

SEQ ID NO: 1213350 - RNA, 19 nt, Homo sapiens
gaaacagagaaagaccauu

SEQ ID NO: 1213351 - RNA, 19 nt, Homo sapiens
uggccuugcugauccucua

SEQ ID NO: 1213352 - RNA, 19 nt, Homo sapiens
aggaggauguaccuugugu

SEQ ID NO: 1213353 - RNA, 19 nt, Homo sapiens
ggacacuggaugccuggau

SEQ ID NO: 1213354 - RNA, 19 nt, Homo sapiens
ggucucucaugacuuaacu

SEQ ID NO: 1213355 - RNA, 19 nt, Homo sapiens
guugugggccaucucauca

SEQ ID NO: 1213356 - RNA, 19 nt, Homo sapiens
ggauugggccagagaccau

SEQ ID NO: 1213357 - RNA, 19 nt, Homo sapiens
acagcugcagugauauaua

SEQ ID NO: 1213358 - RNA, 19 nt, Homo sapiens
uuucuugcccugucucuga

SEQ ID NO: 1213359 - RNA, 19 nt, Homo sapiens
agcaguggccugagaaaga

SEQ ID NO: 1213360 - RNA, 19 nt, Homo sapiens
ucucaucagccauuucugu

SEQ ID NO: 1213361 - RNA, 19 nt, Homo sapiens
gccaucucaucagccauuu

SEQ ID NO: 1213362 - RNA, 19 nt, Homo sapiens
gauggaaguucaacaagua

SEQ ID NO: 1213363 - RNA, 19 nt, Homo sapiens
gagaacaacaugagauuaa

SEQ ID NO: 1213364 - RNA, 19 nt, Homo sapiens
gaaaagaccccucaucgua

SEQ ID NO: 1213365 - RNA, 19 nt, Homo sapiens
caggcaagcuuuaccagua

SEQ ID NO: 1213366 - RNA, 19 nt, Homo sapiens
cuuaagagguuucaaauag

SEQ ID NO: 1213367 - RNA, 19 nt, Homo sapiens
ugaaacugauguaagagua

SEQ ID NO: 1213368 - RNA, 19 nt, Homo sapiens
gaauggagauaaugaucga

SEQ ID NO: 1213369 - RNA, 19 nt, Homo sapiens
ggaaaaugauggaaaagaa

SEQ ID NO: 1213370 - RNA, 19 nt, Homo sapiens
uaaacagaaccaugacuua

SEQ ID NO: 1213371 - RNA, 19 nt, Homo sapiens
aaccaugacuuaacgcaua
